United States Patent 7,888,497 (BIOINFORMATICALLY DETECTABLE GROUP OF NOVEL REGULATORY OLIGONUCLEOTIDES AND USES THEREOF) - sequence listing, part 22

SEQ ID NO: 899629 - DNA, 13 bp, Homo sapiens
gttgtccaggctg

SEQ ID NO: 899630 - DNA, 18 bp, Homo sapiens
gttgtcccatctgccctc

SEQ ID NO: 899631 - DNA, 13 bp, Homo sapiens
gttgtccctctgc

SEQ ID NO: 899632 - DNA, 17 bp, Homo sapiens
gttgtccctctgctacg

SEQ ID NO: 899633 - DNA, 19 bp, Homo sapiens
gttgtcctatggacaactt

SEQ ID NO: 899634 - DNA, 15 bp, Homo sapiens
gttgtccttgcccca

SEQ ID NO: 899635 - DNA, 21 bp, Homo sapiens
gttgtctccacttgtatatat

SEQ ID NO: 899636 - DNA, 11 bp, Homo sapiens
gttgtctctga

SEQ ID NO: 899637 - DNA, 14 bp, Homo sapiens
gttgtctctgatgc

SEQ ID NO: 899638 - DNA, 19 bp, Homo sapiens
gttgtctgaagtcactgca

SEQ ID NO: 899639 - DNA, 21 bp, Homo sapiens
gttgtctgtccaggcccttag

SEQ ID NO: 899640 - DNA, 18 bp, Homo sapiens
gttgtgaaatgtaacatg

SEQ ID NO: 899641 - DNA, 18 bp, Homo sapiens
gttgtgagccctctaggg

SEQ ID NO: 899642 - DNA, 18 bp, Homo sapiens
gttgtgattgacagaacc

SEQ ID NO: 899643 - DNA, 17 bp, Homo sapiens
gttgtgcaaattaacag

SEQ ID NO: 899644 - DNA, 16 bp, Homo sapiens
gttgtgcatgtatgta

SEQ ID NO: 899645 - DNA, 12 bp, Homo sapiens
gttgtgccaaat

SEQ ID NO: 899646 - DNA, 19 bp, Homo sapiens
gttgtggaaagcctctgct

SEQ ID NO: 899647 - DNA, 14 bp, Homo sapiens
gttgtggatatcag

SEQ ID NO: 899648 - DNA, 17 bp, Homo sapiens
gttgtggatgctccagg

SEQ ID NO: 899649 - DNA, 12 bp, Homo sapiens
gttgtggggagg

SEQ ID NO: 899650 - DNA, 20 bp, Homo sapiens
gttgtggggaggctgcactg

SEQ ID NO: 899651 - DNA, 15 bp, Homo sapiens
gttgtgggtgggaga

SEQ ID NO: 899652 - DNA, 16 bp, Homo sapiens
gttgtgggtgggagag

SEQ ID NO: 899653 - DNA, 14 bp, Homo sapiens
gttgtggttaatct

SEQ ID NO: 899654 - DNA, 12 bp, Homo sapiens
gttgtgtattgt

SEQ ID NO: 899655 - DNA, 22 bp, Homo sapiens
gttgtgtctgtgccctccaaag

SEQ ID NO: 899656 - DNA, 12 bp, Homo sapiens
gttgtgttcctg

SEQ ID NO: 899657 - DNA, 16 bp, Homo sapiens
gttgtgttcctggctg

SEQ ID NO: 899658 - DNA, 16 bp, Homo sapiens
gttgtgttctgttgaa

SEQ ID NO: 899659 - DNA, 23 bp, Homo sapiens
gttgtgttgttttttgttcaatg

SEQ ID NO: 899660 - DNA, 21 bp, Homo sapiens
gttgttaaacacgtgtctata

SEQ ID NO: 899661 - DNA, 18 bp, Homo sapiens
gttgttaatgaaaatgtc

SEQ ID NO: 899662 - DNA, 19 bp, Homo sapiens
gttgttaatgaaaatgtca

SEQ ID NO: 899663 - DNA, 13 bp, Homo sapiens
gttgttaatttag

SEQ ID NO: 899664 - DNA, 16 bp, Homo sapiens
tgttcaatgtttaatg

SEQ ID NO: 899665 - DNA, 15 bp, Homo sapiens
tgttcacaaactgtg

SEQ ID NO: 899666 - DNA, 16 bp, Homo sapiens
tgttcacaaactgtga

SEQ ID NO: 899667 - DNA, 17 bp, Homo sapiens
tgttcacactgcagaga

SEQ ID NO: 899668 - DNA, 20 bp, Homo sapiens
tgttcaccttcaaaatgttc

SEQ ID NO: 899669 - DNA, 23 bp, Homo sapiens
tgttcacggtgacacaggtcagg

SEQ ID NO: 899670 - DNA, 20 bp, Homo sapiens
tgttcactgctccttgctgc

SEQ ID NO: 899671 - DNA, 22 bp, Homo sapiens
tgttcagaaagcaataactttg

SEQ ID NO: 899672 - DNA, 22 bp, Homo sapiens
tgttcagaagaaattctgtcat

SEQ ID NO: 899673 - DNA, 19 bp, Homo sapiens
tgttcagaattaagcagaa

SEQ ID NO: 899674 - DNA, 15 bp, Homo sapiens
tgttcagatgtgcat

SEQ ID NO: 899675 - DNA, 14 bp, Homo sapiens
tgttcagcagaacc

SEQ ID NO: 899676 - DNA, 18 bp, Homo sapiens
tgttcagcagaacctgca

SEQ ID NO: 899677 - DNA, 22 bp, Homo sapiens
tgttcagcagaacctgcacaca

SEQ ID NO: 899678 - DNA, 21 bp, Homo sapiens
tgttcagctctttccaaatta

SEQ ID NO: 899679 - DNA, 17 bp, Homo sapiens
tgttcagcttataatga

SEQ ID NO: 899680 - DNA, 23 bp, Homo sapiens
tgttcaggaaaaggttgaataat

SEQ ID NO: 899681 - DNA, 18 bp, Homo sapiens
tgttcagtgagatatcat

SEQ ID NO: 899682 - DNA, 17 bp, Homo sapiens
tgttcagtgtcccgggc

SEQ ID NO: 899683 - DNA, 12 bp, Homo sapiens
tgttcatacatt

SEQ ID NO: 899684 - DNA, 14 bp, Homo sapiens
tgttcatagcccag

SEQ ID NO: 899685 - DNA, 20 bp, Homo sapiens
tgttcatagcccagtagacc

SEQ ID NO: 899686 - DNA, 23 bp, Homo sapiens
tgttcatagcccagtagaccttg

SEQ ID NO: 899687 - DNA, 11 bp, Homo sapiens
tgttcatattg

SEQ ID NO: 899688 - DNA, 16 bp, Homo sapiens
tgttcatcatccagat

SEQ ID NO: 899689 - DNA, 19 bp, Homo sapiens
tgttcatcatcctaagcta

SEQ ID NO: 899690 - DNA, 11 bp, Homo sapiens
tgttcatccca

SEQ ID NO: 899691 - DNA, 22 bp, Homo sapiens
tgttcatcctcattgcctcctg

SEQ ID NO: 899692 - DNA, 23 bp, Homo sapiens
tgttcatcctcattgcctcctgt

SEQ ID NO: 899693 - DNA, 21 bp, Homo sapiens
tgttcatctgtaactctaaaa

SEQ ID NO: 899694 - DNA, 16 bp, Homo sapiens
tgttcatggagagctg

SEQ ID NO: 899695 - DNA, 20 bp, Homo sapiens
tgttcattcaagctatttaa

SEQ ID NO: 899696 - DNA, 12 bp, Homo sapiens
tgttcattgtaa

SEQ ID NO: 899697 - DNA, 16 bp, Homo sapiens
tgttcattgtaatgtt

SEQ ID NO: 899698 - DNA, 19 bp, Homo sapiens
tgttcattgtaatgttact

SEQ ID NO: 899699 - DNA, 11 bp, Homo sapiens
tgttcatttag

SEQ ID NO: 899700 - DNA, 19 bp, Homo sapiens
tgttcatttagataatttg

SEQ ID NO: 899701 - DNA, 13 bp, Homo sapiens
tgttcatttcatt

SEQ ID NO: 899702 - DNA, 22 bp, Homo sapiens
tgttcatttggtgttcctggaa

SEQ ID NO: 899703 - DNA, 18 bp, Homo sapiens
tgttcattttattttcat

SEQ ID NO: 899704 - DNA, 18 bp, Homo sapiens
tgttcattttgagctgaa

SEQ ID NO: 899705 - DNA, 10 bp, Homo sapiens
tgttccaaat

SEQ ID NO: 899706 - DNA, 17 bp, Homo sapiens
tgttccaaatgaatgtt

SEQ ID NO: 899707 - DNA, 18 bp, Homo sapiens
tgttccaaattcagtttc

SEQ ID NO: 899708 - DNA, 19 bp, Homo sapiens
tgttccaaattcagtttca

SEQ ID NO: 899709 - DNA, 15 bp, Homo sapiens
tgttccaagacattg

SEQ ID NO: 899710 - DNA, 20 bp, Homo sapiens
tgttccaagacattgtcaat

SEQ ID NO: 899711 - DNA, 16 bp, Homo sapiens
gtttaatattccaata

SEQ ID NO: 899712 - DNA, 15 bp, Homo sapiens
gtttaatatttaaac

SEQ ID NO: 899713 - DNA, 19 bp, Homo sapiens
gtttaatgttcattttctc

SEQ ID NO: 899714 - DNA, 13 bp, Homo sapiens
gtttaatgttttg

SEQ ID NO: 899715 - DNA, 15 bp, Homo sapiens
gtttaattctgtctt

SEQ ID NO: 899716 - DNA, 19 bp, Homo sapiens
gtttacaagcccccccttc

SEQ ID NO: 899717 - DNA, 18 bp, Homo sapiens
gtttacaagtgtatatca

SEQ ID NO: 899718 - DNA, 19 bp, Homo sapiens
gtttacaagtgtatatcag

SEQ ID NO: 899719 - DNA, 18 bp, Homo sapiens
gtttacaatgatgccgaa

SEQ ID NO: 899720 - DNA, 18 bp, Homo sapiens
gtttacaatttacaaagt

SEQ ID NO: 899721 - DNA, 13 bp, Homo sapiens
gtttacagaaaaa

SEQ ID NO: 899722 - DNA, 14 bp, Homo sapiens
gtttacaggccctg

SEQ ID NO: 899723 - DNA, 17 bp, Homo sapiens
gtttacaggtttgaatt

SEQ ID NO: 899724 - DNA, 17 bp, Homo sapiens
gtttacagtgaagaaag

SEQ ID NO: 899725 - DNA, 17 bp, Homo sapiens
gtttacagtttgtgttt

SEQ ID NO: 899726 - DNA, 20 bp, Homo sapiens
gtttacagtttgtgttttaa

SEQ ID NO: 899727 - DNA, 13 bp, Homo sapiens
gtttacatgcaga

SEQ ID NO: 899728 - DNA, 11 bp, Homo sapiens
gtttacatgta

SEQ ID NO: 899729 - DNA, 20 bp, Homo sapiens
gtttacattgtcctgtagct

SEQ ID NO: 899730 - DNA, 21 bp, Homo sapiens
gtttacatttgatgcatgtct

SEQ ID NO: 899731 - DNA, 15 bp, Homo sapiens
gtttaccagttgcct

SEQ ID NO: 899732 - DNA, 17 bp, Homo sapiens
gtttaccatttgtaata

SEQ ID NO: 899733 - DNA, 18 bp, Homo sapiens
gtttaccatttgtaataa

SEQ ID NO: 899734 - DNA, 21 bp, Homo sapiens
gtttaccatttgtaataaagt

SEQ ID NO: 899735 - DNA, 22 bp, Homo sapiens
gtttacctcatccatgcacttt

SEQ ID NO: 899736 - DNA, 21 bp, Homo sapiens
gtttacctggcttatttaata

SEQ ID NO: 899737 - DNA, 15 bp, Homo sapiens
gtttacctggggatc

SEQ ID NO: 899738 - DNA, 21 bp, Homo sapiens
gtttactatgtgccagttcct

SEQ ID NO: 899739 - DNA, 23 bp, Homo sapiens
gtttactatgtgccagttcctgt

SEQ ID NO: 899740 - DNA, 20 bp, Homo sapiens
gtttactcccttctgtagtt

SEQ ID NO: 899741 - DNA, 14 bp, Homo sapiens
gtttactgaaattt

SEQ ID NO: 899742 - DNA, 11 bp, Homo sapiens
gtttacttgtc

SEQ ID NO: 899743 - DNA, 18 bp, Homo sapiens
gtttactttttggctgga

SEQ ID NO: 899744 - DNA, 19 bp, Homo sapiens
gtttactttttggctggag

SEQ ID NO: 899745 - DNA, 15 bp, Homo sapiens
gtttagataatacac

SEQ ID NO: 899746 - DNA, 23 bp, Homo sapiens
gtttagcagcagcctttaatgca

SEQ ID NO: 899747 - DNA, 15 bp, Homo sapiens
gtttagcagtggctg

SEQ ID NO: 899748 - DNA, 23 bp, Homo sapiens
gtttagcttcctccagaggaggg

SEQ ID NO: 899749 - DNA, 23 bp, Homo sapiens
gtttaggcctcatttctttgtct

SEQ ID NO: 899750 - DNA, 23 bp, Homo sapiens
gtttaggctatttgtaaatctgc

SEQ ID NO: 899751 - DNA, 18 bp, Homo sapiens
gtttaggctggtggccca

SEQ ID NO: 899752 - DNA, 15 bp, Homo sapiens
gtttagttctgttga

SEQ ID NO: 899753 - DNA, 20 bp, Homo sapiens
gtttagtttctagaggcctc

SEQ ID NO: 899754 - DNA, 19 bp, Homo sapiens
gtttagttttacattttaa

SEQ ID NO: 899755 - DNA, 13 bp, Homo sapiens
gtttataaactga

SEQ ID NO: 899756 - DNA, 12 bp, Homo sapiens
gtttataaagca

SEQ ID NO: 899757 - DNA, 15 bp, Homo sapiens
gtttataataaaaat

SEQ ID NO: 899758 - DNA, 16 bp, Homo sapiens
gtttataatctgaaga

SEQ ID NO: 899759 - DNA, 18 bp, Homo sapiens
gtttatacacaactttgc

SEQ ID NO: 899760 - DNA, 19 bp, Homo sapiens
gtttatacactgtgtaaat

SEQ ID NO: 899761 - DNA, 21 bp, Homo sapiens
gtttatacagaactcacagta

SEQ ID NO: 899762 - DNA, 19 bp, Homo sapiens
gtttatacgtggaaacaca

SEQ ID NO: 899763 - DNA, 21 bp, Homo sapiens
gtttatagagggccaagactt

SEQ ID NO: 899764 - DNA, 17 bp, Homo sapiens
gtttatatattgaaagt

SEQ ID NO: 899765 - DNA, 21 bp, Homo sapiens
gtttatatattgaaagttgct

SEQ ID NO: 899766 - DNA, 23 bp, Homo sapiens
gtttatatattgaaagttgcttt

SEQ ID NO: 899767 - DNA, 15 bp, Homo sapiens
gtttatcagatacat

SEQ ID NO: 899768 - DNA, 15 bp, Homo sapiens
gtttatcattcaagt

SEQ ID NO: 899769 - DNA, 17 bp, Homo sapiens
gtttatcattcaagtgt

SEQ ID NO: 899770 - DNA, 21 bp, Homo sapiens
gtttatcctcttggtgtctgg

SEQ ID NO: 899771 - DNA, 23 bp, Homo sapiens
gtttatcctgacatattcaagtg

SEQ ID NO: 899772 - DNA, 21 bp, Homo sapiens
gtttatgaattataaatgtgt

SEQ ID NO: 899773 - DNA, 16 bp, Homo sapiens
gtttatgagaaactgg

SEQ ID NO: 899774 - DNA, 15 bp, Homo sapiens
gtttatgatatttct

SEQ ID NO: 899775 - DNA, 13 bp, Homo sapiens
gtttatggcctca

SEQ ID NO: 899776 - DNA, 15 bp, Homo sapiens
gtttatggcctcagc

SEQ ID NO: 899777 - DNA, 18 bp, Homo sapiens
gtttatgtgttatgaaca

SEQ ID NO: 899778 - DNA, 13 bp, Homo sapiens
gtttattaacaaa

SEQ ID NO: 899779 - DNA, 19 bp, Homo sapiens
gtttattacaatgtatctt

SEQ ID NO: 899780 - DNA, 14 bp, Homo sapiens
gtttattacaattt

SEQ ID NO: 899781 - DNA, 21 bp, Homo sapiens
gtttattacttccatgaattt

SEQ ID NO: 899782 - DNA, 18 bp, Homo sapiens
gtttattcccaagtatgc

SEQ ID NO: 899783 - DNA, 19 bp, Homo sapiens
gtttattccttctgtagtg

SEQ ID NO: 899784 - DNA, 13 bp, Homo sapiens
gtttattctgtgg

SEQ ID NO: 899785 - DNA, 14 bp, Homo sapiens
tctctagtgctgtg

SEQ ID NO: 899786 - DNA, 16 bp, Homo sapiens
tctctagtgctgtgaa

SEQ ID NO: 899787 - DNA, 18 bp, Homo sapiens
tctctagtttgattaaat

SEQ ID NO: 899788 - DNA, 18 bp, Homo sapiens
tctctatcctctcttcct

SEQ ID NO: 899789 - DNA, 20 bp, Homo sapiens
tctctatgcaaaatgtctgt

SEQ ID NO: 899790 - DNA, 12 bp, Homo sapiens
tctctatgtact

SEQ ID NO: 899791 - DNA, 14 bp, Homo sapiens
tctctattagctgg

SEQ ID NO: 899792 - DNA, 15 bp, Homo sapiens
tctctattagctggg

SEQ ID NO: 899793 - DNA, 18 bp, Homo sapiens
tctctattctctgcaatt

SEQ ID NO: 899794 - DNA, 15 bp, Homo sapiens
tctctatttaatatt

SEQ ID NO: 899795 - DNA, 18 bp, Homo sapiens
tctctatttgaattattt

SEQ ID NO: 899796 - DNA, 13 bp, Homo sapiens
tctctcaagtgat

SEQ ID NO: 899797 - DNA, 13 bp, Homo sapiens
tctctcactgcat

SEQ ID NO: 899798 - DNA, 22 bp, Homo sapiens
tctctcactgtgttactgcttt

SEQ ID NO: 899799 - DNA, 14 bp, Homo sapiens
tctctcaggagcac

SEQ ID NO: 899800 - DNA, 18 bp, Homo sapiens
tctctcaggagcacaggc

SEQ ID NO: 899801 - DNA, 18 bp, Homo sapiens
tctctcatcttgttcttc

SEQ ID NO: 899802 - DNA, 16 bp, Homo sapiens
tctctcatgagaagcc

SEQ ID NO: 899803 - DNA, 19 bp, Homo sapiens
tctctcatgagaagccaag

SEQ ID NO: 899804 - DNA, 18 bp, Homo sapiens
tctctccacagtgttgtg

SEQ ID NO: 899805 - DNA, 22 bp, Homo sapiens
tctctccagaaacagctgcttc

SEQ ID NO: 899806 - DNA, 13 bp, Homo sapiens
tctctccagatgt

SEQ ID NO: 899807 - DNA, 11 bp, Homo sapiens
tctctccagga

SEQ ID NO: 899808 - DNA, 18 bp, Homo sapiens
agccgggcccctgggctt

SEQ ID NO: 899809 - DNA, 22 bp, Homo sapiens
agccgggcgtggtggcaggcac

SEQ ID NO: 899810 - DNA, 13 bp, Homo sapiens
agccggggcctta

SEQ ID NO: 899811 - DNA, 23 bp, Homo sapiens
agccgggggaggggccctcaggc

SEQ ID NO: 899812 - DNA, 22 bp, Homo sapiens
agccggtgcctggcgcccctgc

SEQ ID NO: 899813 - DNA, 16 bp, Homo sapiens
agccggtgtccctgga

SEQ ID NO: 899814 - DNA, 15 bp, Homo sapiens
agccgtattttacat

SEQ ID NO: 899815 - DNA, 14 bp, Homo sapiens
agccgtccatggca

SEQ ID NO: 899816 - DNA, 16 bp, Homo sapiens
agccgtccatggcacc

SEQ ID NO: 899817 - DNA, 17 bp, Homo sapiens
agccgtccatggcacca

SEQ ID NO: 899818 - DNA, 19 bp, Homo sapiens
agccgtccatggcaccagc

SEQ ID NO: 899819 - DNA, 23 bp, Homo sapiens
agccgtcctggcgcctggcagtc

SEQ ID NO: 899820 - DNA, 23 bp, Homo sapiens
agccgtctgactccagagtctga

SEQ ID NO: 899821 - DNA, 24 bp, Homo sapiens
agccgtctgactccagagtctgag

SEQ ID NO: 899822 - DNA, 17 bp, Homo sapiens
agccgtgccttcagctc

SEQ ID NO: 899823 - DNA, 15 bp, Homo sapiens
agccgttgaatctgg

SEQ ID NO: 899824 - DNA, 19 bp, Homo sapiens
agccgttgaatctgggagg

SEQ ID NO: 899825 - DNA, 20 bp, Homo sapiens
agccgttgaatctgggaggg

SEQ ID NO: 899826 - DNA, 21 bp, Homo sapiens
agcctaaaacgaatggtcttt

SEQ ID NO: 899827 - DNA, 13 bp, Homo sapiens
agcctaaaattac

SEQ ID NO: 899828 - DNA, 17 bp, Homo sapiens
agcctaaagggcagggc

SEQ ID NO: 899829 - DNA, 22 bp, Homo sapiens
agcctaaagggcagggcccacg

SEQ ID NO: 899830 - DNA, 18 bp, Homo sapiens
agcctaaggctcctgttt

SEQ ID NO: 899831 - DNA, 15 bp, Homo sapiens
agcctaatacaacat

SEQ ID NO: 899832 - DNA, 15 bp, Homo sapiens
agcctaatccctggg

SEQ ID NO: 899833 - DNA, 19 bp, Homo sapiens
agcctaatgagagtgcact

SEQ ID NO: 899834 - DNA, 18 bp, Homo sapiens
agcctacagaagggcagt

SEQ ID NO: 899835 - DNA, 20 bp, Homo sapiens
agcctacccgactctattta

SEQ ID NO: 899836 - DNA, 22 bp, Homo sapiens
agcctacccttcctgcatttct

SEQ ID NO: 899837 - DNA, 16 bp, Homo sapiens
agcctaccgtatttca

SEQ ID NO: 899838 - DNA, 20 bp, Homo sapiens
agcctaccgtatttcagcca

SEQ ID NO: 899839 - DNA, 19 bp, Homo sapiens
agcctaccttcaccaccta

SEQ ID NO: 899840 - DNA, 23 bp, Homo sapiens
agcctactgtactatttaaaatg

SEQ ID NO: 899841 - DNA, 18 bp, Homo sapiens
agcctagaacatccctgg

SEQ ID NO: 899842 - DNA, 15 bp, Homo sapiens
cagctctctgccctg

SEQ ID NO: 899843 - DNA, 13 bp, Homo sapiens
cagctctctgctg

SEQ ID NO: 899844 - DNA, 16 bp, Homo sapiens
cagctctctgctgggt

SEQ ID NO: 899845 - DNA, 14 bp, Homo sapiens
cagctctgacattc

SEQ ID NO: 899846 - DNA, 19 bp, Homo sapiens
cagctctgagatcctggag

SEQ ID NO: 899847 - DNA, 19 bp, Homo sapiens
cagctctgccgtctctgga

SEQ ID NO: 899848 - DNA, 22 bp, Homo sapiens
cagctctgccgtctctggagcg

SEQ ID NO: 899849 - DNA, 18 bp, Homo sapiens
cagctctgctatgagtgt

SEQ ID NO: 899850 - DNA, 18 bp, Homo sapiens
cagctctggaggggaggg

SEQ ID NO: 899851 - DNA, 14 bp, Homo sapiens
cagctctggcttcc

SEQ ID NO: 899852 - DNA, 22 bp, Homo sapiens
cagctctgggccattctccaca

SEQ ID NO: 899853 - DNA, 23 bp, Homo sapiens
cagctctgggccattctccacag

SEQ ID NO: 899854 - DNA, 14 bp, Homo sapiens
cagctctgggcctc

SEQ ID NO: 899855 - DNA, 15 bp, Homo sapiens
cagctctgggcctct

SEQ ID NO: 899856 - DNA, 17 bp, Homo sapiens
cagctctgggcctcttt

SEQ ID NO: 899857 - DNA, 18 bp, Homo sapiens
cagctctgggcctctttt

SEQ ID NO: 899858 - DNA, 20 bp, Homo sapiens
cagctctggtccaggccctg

SEQ ID NO: 899859 - DNA, 14 bp, Homo sapiens
cagctctgtggcct

SEQ ID NO: 899860 - DNA, 24 bp, Homo sapiens
cagctctgtggcctgtgtccagca

SEQ ID NO: 899861 - DNA, 13 bp, Homo sapiens
cagctcttccagg

SEQ ID NO: 899862 - DNA, 18 bp, Homo sapiens
cagctcttctccccaggt

SEQ ID NO: 899863 - DNA, 15 bp, Homo sapiens
cagctcttgcccttc

SEQ ID NO: 899864 - DNA, 23 bp, Homo sapiens
cagctcttgcccttccctgtccc

SEQ ID NO: 899865 - DNA, 19 bp, Homo sapiens
cagctcttgctctcttgtg

SEQ ID NO: 899866 - DNA, 17 bp, Homo sapiens
cagctcttggctccact

SEQ ID NO: 899867 - DNA, 16 bp, Homo sapiens
cagctctttccaaatt

SEQ ID NO: 899868 - DNA, 18 bp, Homo sapiens
cagctctttccaaattaa

SEQ ID NO: 899869 - DNA, 19 bp, Homo sapiens
cagctctttccaaattaaa

SEQ ID NO: 899870 - DNA, 17 bp, Homo sapiens
cagctgaaagaggagga

SEQ ID NO: 899871 - DNA, 21 bp, Homo sapiens
cagctgaagaaaaaatcagaa

SEQ ID NO: 899872 - DNA, 17 bp, Homo sapiens
cagctgaatgcctcctg

SEQ ID NO: 899873 - DNA, 16 bp, Homo sapiens
cagctgaattatctat

SEQ ID NO: 899874 - DNA, 14 bp, Homo sapiens
cagctgaccgggct

SEQ ID NO: 899875 - DNA, 19 bp, Homo sapiens
cagctgactccagtataat

SEQ ID NO: 899876 - DNA, 20 bp, Homo sapiens
cagctgactgtggccccctc

SEQ ID NO: 899877 - DNA, 20 bp, Homo sapiens
cagctgactgttggctctct

SEQ ID NO: 899878 - DNA, 23 bp, Homo sapiens
cagctgacttggttctgaagcca

SEQ ID NO: 899879 - DNA, 21 bp, Homo sapiens
cagctgagagacttttaatca

SEQ ID NO: 899880 - DNA, 15 bp, Homo sapiens
cagctgagagccctg

SEQ ID NO: 899881 - DNA, 20 bp, Homo sapiens
cagctgagagccctgctgtg

SEQ ID NO: 899882 - DNA, 21 bp, Homo sapiens
cagctgagagccctgctgtgg

SEQ ID NO: 899883 - DNA, 19 bp, Homo sapiens
cagctgaggacacacccca

SEQ ID NO: 899884 - DNA, 20 bp, Homo sapiens
cagctgaggacacaccccac

SEQ ID NO: 899885 - DNA, 22 bp, Homo sapiens
cagctgaggacacaccccacac

SEQ ID NO: 899886 - DNA, 12 bp, Homo sapiens
cagctgaggctg

SEQ ID NO: 899887 - DNA, 19 bp, Homo sapiens
cagctgagggtgagtgggt

SEQ ID NO: 899888 - DNA, 19 bp, Homo sapiens
cagctgaggtctcttgagg

SEQ ID NO: 899889 - DNA, 14 bp, Homo sapiens
cagctgagttatga

SEQ ID NO: 899890 - DNA, 16 bp, Homo sapiens
cagctgatacttcatt

SEQ ID NO: 899891 - DNA, 21 bp, Homo sapiens
cagctgatattatggcaagtg

SEQ ID NO: 899892 - DNA, 14 bp, Homo sapiens
cagctgatgagtta

SEQ ID NO: 899893 - DNA, 20 bp, Homo sapiens
cagctgatgagttacagcct

SEQ ID NO: 899894 - DNA, 12 bp, Homo sapiens
cagctgatttta

SEQ ID NO: 899895 - DNA, 22 bp, Homo sapiens
cagctgcaaggtactctggtga

SEQ ID NO: 899896 - DNA, 14 bp, Homo sapiens
cagctgcaccagag

SEQ ID NO: 899897 - DNA, 16 bp, Homo sapiens
cagctgcaccagcagg

SEQ ID NO: 899898 - DNA, 18 bp, Homo sapiens
cagctgcacctgccagcc

SEQ ID NO: 899899 - DNA, 21 bp, Homo sapiens
cagctgcacctgccagcctgg

SEQ ID NO: 899900 - DNA, 20 bp, Homo sapiens
cagctgcagaccatgccaga

SEQ ID NO: 899901 - DNA, 17 bp, Homo sapiens
cagctgcagctgatcca

SEQ ID NO: 899902 - DNA, 13 bp, Homo sapiens
cagctgcagctgg

SEQ ID NO: 899903 - DNA, 14 bp, Homo sapiens
cagctgcagctggg

SEQ ID NO: 899904 - DNA, 17 bp, Homo sapiens
cagctgcagctgggccc

SEQ ID NO: 899905 - DNA, 23 bp, Homo sapiens
cagctgcagctgggccccatgct

SEQ ID NO: 899906 - DNA, 13 bp, Homo sapiens
cagctgcagggca

SEQ ID NO: 899907 - DNA, 14 bp, Homo sapiens
cagctgcagggcac

SEQ ID NO: 899908 - DNA, 23 bp, Homo sapiens
cagctgcagggcacggggacctg

SEQ ID NO: 899909 - DNA, 16 bp, Homo sapiens
cagctgcattccgcag

SEQ ID NO: 899910 - DNA, 13 bp, Homo sapiens
cagctgccaagca

SEQ ID NO: 899911 - DNA, 22 bp, Homo sapiens
cagctgccaagcactcgagacc

SEQ ID NO: 899912 - DNA, 15 bp, Homo sapiens
cagctgccagagaag

SEQ ID NO: 899913 - DNA, 16 bp, Homo sapiens
cagctgccagagaagc

SEQ ID NO: 899914 - DNA, 15 bp, Homo sapiens
cagctgccaggcggc

SEQ ID NO: 899915 - DNA, 16 bp, Homo sapiens
cagctgccaggcggcc

SEQ ID NO: 899916 - DNA, 21 bp, Homo sapiens
cagctgccaggcggccctggg

SEQ ID NO: 899917 - DNA, 15 bp, Homo sapiens
cagctgccccagcca

SEQ ID NO: 899918 - DNA, 19 bp, Homo sapiens
cagctgccccggcccctcc

SEQ ID NO: 899919 - DNA, 22 bp, Homo sapiens
cagctgccccggcccctccccc

SEQ ID NO: 899920 - DNA, 12 bp, Homo sapiens
cagctgcccctc

SEQ ID NO: 899921 - DNA, 18 bp, Homo sapiens
cagctgccctatgggcct

SEQ ID NO: 899922 - DNA, 16 bp, Homo sapiens
cagctgccctgctgcc

SEQ ID NO: 899923 - DNA, 22 bp, Homo sapiens
cagctgccctgctgccacagca

SEQ ID NO: 899924 - DNA, 22 bp, Homo sapiens
cagctgccgggcctgatttggt

SEQ ID NO: 899925 - DNA, 14 bp, Homo sapiens
cagctgcctctgct

SEQ ID NO: 899926 - DNA, 15 bp, Homo sapiens
cagctgcctctgctc

SEQ ID NO: 899927 - DNA, 16 bp, Homo sapiens
cagctgcctctgctcc

SEQ ID NO: 899928 - DNA, 20 bp, Homo sapiens
cagctgcctctgctccctct

SEQ ID NO: 899929 - DNA, 15 bp, Homo sapiens
agcctccccttcttc

SEQ ID NO: 899930 - DNA, 16 bp, Homo sapiens
agcctccccttcttcc

SEQ ID NO: 899931 - DNA, 18 bp, Homo sapiens
agcctccccttcttcccg

SEQ ID NO: 899932 - DNA, 21 bp, Homo sapiens
agcctcccgagtagctgggat

SEQ ID NO: 899933 - DNA, 14 bp, Homo sapiens
agcctccctcagcc

SEQ ID NO: 899934 - DNA, 16 bp, Homo sapiens
agcctccctcagcccc

SEQ ID NO: 899935 - DNA, 22 bp, Homo sapiens
agcctccctcagcccccaggat

SEQ ID NO: 899936 - DNA, 21 bp, Homo sapiens
agcctccctctgacctgcagg

SEQ ID NO: 899937 - DNA, 17 bp, Homo sapiens
agcctccctgaagacca

SEQ ID NO: 899938 - DNA, 15 bp, Homo sapiens
agcctccctgagcct

SEQ ID NO: 899939 - DNA, 11 bp, Homo sapiens
agcctccctgc

SEQ ID NO: 899940 - DNA, 12 bp, Homo sapiens
agcctccctgca

SEQ ID NO: 899941 - DNA, 15 bp, Homo sapiens
agcctccctgcacgg

SEQ ID NO: 899942 - DNA, 17 bp, Homo sapiens
agcctccctgtctccag

SEQ ID NO: 899943 - DNA, 19 bp, Homo sapiens
agcctccctgtctccagct

SEQ ID NO: 899944 - DNA, 14 bp, Homo sapiens
agcctccgagaggg

SEQ ID NO: 899945 - DNA, 15 bp, Homo sapiens
agcctccggaagctg

SEQ ID NO: 899946 - DNA, 22 bp, Homo sapiens
agcctccgtcatccatgccctc

SEQ ID NO: 899947 - DNA, 18 bp, Homo sapiens
agcctccgtggaacattc

SEQ ID NO: 899948 - DNA, 18 bp, Homo sapiens
agcctccgtttatgggcc

SEQ ID NO: 899949 - DNA, 21 bp, Homo sapiens
agcctccgtttatgggccttg

SEQ ID NO: 899950 - DNA, 22 bp, Homo sapiens
agcctccgtttatgggccttgc

SEQ ID NO: 899951 - DNA, 23 bp, Homo sapiens
agcctccgtttatgggccttgct

SEQ ID NO: 899952 - DNA, 20 bp, Homo sapiens
agcctcctcatcccgtgttc

SEQ ID NO: 899953 - DNA, 13 bp, Homo sapiens
agcctcctctgga

SEQ ID NO: 899954 - DNA, 19 bp, Homo sapiens
agcctcctctggacggcag

SEQ ID NO: 899955 - DNA, 23 bp, Homo sapiens
agcctcctgaagttgctgctgtg

SEQ ID NO: 899956 - DNA, 11 bp, Homo sapiens
agcctcctgag

SEQ ID NO: 899957 - DNA, 18 bp, Homo sapiens
agcctcctgagcctgtgg

SEQ ID NO: 899958 - DNA, 11 bp, Homo sapiens
agcctcctggg

SEQ ID NO: 899959 - DNA, 18 bp, Homo sapiens
agcctcctgtacctcagt

SEQ ID NO: 899960 - DNA, 21 bp, Homo sapiens
agcctcctgtgcctggcccca

SEQ ID NO: 899961 - DNA, 10 bp, Homo sapiens
agcctccttg

SEQ ID NO: 899962 - DNA, 12 bp, Homo sapiens
agcctccttgct

SEQ ID NO: 899963 - DNA, 21 bp, Homo sapiens
agcctcgacacccccccaacc

SEQ ID NO: 899964 - DNA, 17 bp, Homo sapiens
agcctcgcacaggccct

SEQ ID NO: 899965 - DNA, 16 bp, Homo sapiens
agcctcggcctaggtc

SEQ ID NO: 899966 - DNA, 21 bp, Homo sapiens
agcctcgtggagctcgcccct

SEQ ID NO: 899967 - DNA, 22 bp, Homo sapiens
agcctcgtggagctcgcccctc

SEQ ID NO: 899968 - DNA, 16 bp, Homo sapiens
aatccaaaagacaaaa

SEQ ID NO: 899969 - DNA, 22 bp, Homo sapiens
aatccaaaagacaaaaatcaaa

SEQ ID NO: 899970 - DNA, 13 bp, Homo sapiens
aatccaaaatgaa

SEQ ID NO: 899971 - DNA, 18 bp, Homo sapiens
aatccaaccattttcatt

SEQ ID NO: 899972 - DNA, 23 bp, Homo sapiens
aatccaagcgaggtcaacagaga

SEQ ID NO: 899973 - DNA, 17 bp, Homo sapiens
aatccaagctccctgcc

SEQ ID NO: 899974 - DNA, 20 bp, Homo sapiens
aatccaagctccctgcccca

SEQ ID NO: 899975 - DNA, 19 bp, Homo sapiens
aatccaatactgcccaagg

SEQ ID NO: 899976 - DNA, 15 bp, Homo sapiens
aatccaatattgtaa

SEQ ID NO: 899977 - DNA, 19 bp, Homo sapiens
atataagcataaaagatca

SEQ ID NO: 899978 - DNA, 18 bp, Homo sapiens
atataagtgtacatatgt

SEQ ID NO: 899979 - DNA, 21 bp, Homo sapiens
atataataaatgtacattaat

SEQ ID NO: 899980 - DNA, 20 bp, Homo sapiens
atataataactttattgcat

SEQ ID NO: 899981 - DNA, 17 bp, Homo sapiens
atataatatatttgtgt

SEQ ID NO: 899982 - DNA, 17 bp, Homo sapiens
atataatatctaaagtt

SEQ ID NO: 899983 - DNA, 20 bp, Homo sapiens
atataatatctaaagttata

SEQ ID NO: 899984 - DNA, 20 bp, Homo sapiens
atataatattcagccagctt

SEQ ID NO: 899985 - DNA, 23 bp, Homo sapiens
atataatcatgctcatgtatatt

SEQ ID NO: 899986 - DNA, 23 bp, Homo sapiens
atataatcttggcttcttaaaaa

SEQ ID NO: 899987 - DNA, 11 bp, Homo sapiens
atataatgaac

SEQ ID NO: 899988 - DNA, 14 bp, Homo sapiens
atataatgaacacg

SEQ ID NO: 899989 - DNA, 22 bp, Homo sapiens
atataatgctttgcagtatctg

SEQ ID NO: 899990 - DNA, 19 bp, Homo sapiens
atataatggtgatgtcata

SEQ ID NO: 899991 - DNA, 16 bp, Homo sapiens
atataatgtgtgcttt

SEQ ID NO: 899992 - DNA, 14 bp, Homo sapiens
atataattctggag

SEQ ID NO: 899993 - DNA, 12 bp, Homo sapiens
atataattctgt

SEQ ID NO: 899994 - DNA, 17 bp, Homo sapiens
atataattctgtaaatg

SEQ ID NO: 899995 - DNA, 19 bp, Homo sapiens
atataatttgagtgtatat

SEQ ID NO: 899996 - DNA, 15 bp, Homo sapiens
atatacaaaacttta

SEQ ID NO: 899997 - DNA, 18 bp, Homo sapiens
atatacaataacataatt

SEQ ID NO: 899998 - DNA, 19 bp, Homo sapiens
atatacacaggatcctatt

SEQ ID NO: 899999 - DNA, 13 bp, Homo sapiens
atatacacataca

SEQ ID NO: 900000 - DNA, 23 bp, Homo sapiens
atatacagtaactttatgtgtaa

SEQ ID NO: 900001 - DNA, 15 bp, Homo sapiens
atatacatacttaca

SEQ ID NO: 900002 - DNA, 14 bp, Homo sapiens
atatacatatatat

SEQ ID NO: 900003 - DNA, 22 bp, Homo sapiens
atatacatatgagaatatacct

SEQ ID NO: 900004 - DNA, 18 bp, Homo sapiens
atatacattcaaacttaa

SEQ ID NO: 900005 - DNA, 18 bp, Homo sapiens
atatacattctttatctt

SEQ ID NO: 900006 - DNA, 16 bp, Homo sapiens
atatacattgcttaga

SEQ ID NO: 900007 - DNA, 13 bp, Homo sapiens
atatacattgtgt

SEQ ID NO: 900008 - DNA, 15 bp, Homo sapiens
atatacattgtgtga

SEQ ID NO: 900009 - DNA, 17 bp, Homo sapiens
atatacattttctaaat

SEQ ID NO: 900010 - DNA, 12 bp, Homo sapiens
atatacattttt

SEQ ID NO: 900011 - DNA, 16 bp, Homo sapiens
atataccccaaattgt

SEQ ID NO: 900012 - DNA, 17 bp, Homo sapiens
atataccccaaattgtg

SEQ ID NO: 900013 - DNA, 18 bp, Homo sapiens
atatacctggcttttact

SEQ ID NO: 900014 - DNA, 14 bp, Homo sapiens
atatacctggttta

SEQ ID NO: 900015 - DNA, 14 bp, Homo sapiens
atataccttattta

SEQ ID NO: 900016 - DNA, 16 bp, Homo sapiens
atataccttatttatt

SEQ ID NO: 900017 - DNA, 22 bp, Homo sapiens
atatactataattgtaaatatt

SEQ ID NO: 900018 - DNA, 13 bp, Homo sapiens
atatactgcagct

SEQ ID NO: 900019 - DNA, 15 bp, Homo sapiens
atatactgcagcttt

SEQ ID NO: 900020 - DNA, 22 bp, Homo sapiens
atatactgggttcttgttttat

SEQ ID NO: 900021 - DNA, 15 bp, Homo sapiens
atatacttaagaata

SEQ ID NO: 900022 - DNA, 19 bp, Homo sapiens
atatacttaagaatacaca

SEQ ID NO: 900023 - DNA, 12 bp, Homo sapiens
atatagaaaaca

SEQ ID NO: 900024 - DNA, 13 bp, Homo sapiens
atatagaaaacaa

SEQ ID NO: 900025 - DNA, 19 bp, Homo sapiens
atatagaaaacaaaggagc

SEQ ID NO: 900026 - DNA, 18 bp, Homo sapiens
atatagacattctcacat

SEQ ID NO: 900027 - DNA, 21 bp, Homo sapiens
atatagagacaggacagaatg

SEQ ID NO: 900028 - DNA, 14 bp, Homo sapiens
atatagagatgttt

SEQ ID NO: 900029 - DNA, 15 bp, Homo sapiens
atatagagatgtttt

SEQ ID NO: 900030 - DNA, 17 bp, Homo sapiens
atatagagattgtacat

SEQ ID NO: 900031 - DNA, 23 bp, Homo sapiens
atatagctaggtgacatatacat

SEQ ID NO: 900032 - DNA, 17 bp, Homo sapiens
atatagctgatcagttt

SEQ ID NO: 900033 - DNA, 17 bp, Homo sapiens
atatagctgtacaaata

SEQ ID NO: 900034 - DNA, 19 bp, Homo sapiens
atatagctgtacaaatata

SEQ ID NO: 900035 - DNA, 16 bp, Homo sapiens
atataggaacttaaat

SEQ ID NO: 900036 - DNA, 19 bp, Homo sapiens
atataggatagacactgga

SEQ ID NO: 900037 - DNA, 21 bp, Homo sapiens
atataggatagacactggaca

SEQ ID NO: 900038 - DNA, 19 bp, Homo sapiens
atatagggtgtggctccta

SEQ ID NO: 900039 - DNA, 15 bp, Homo sapiens
atatagggttttttt

SEQ ID NO: 900040 - DNA, 21 bp, Homo sapiens
atataggtctcttctcccaga

SEQ ID NO: 900041 - DNA, 22 bp, Homo sapiens
atataggtctcttctcccagaa

SEQ ID NO: 900042 - DNA, 19 bp, Homo sapiens
atataggtttctattcttg

SEQ ID NO: 900043 - DNA, 13 bp, Homo sapiens
atatagtatattt

SEQ ID NO: 900044 - DNA, 21 bp, Homo sapiens
atatagtatatttatactcta

SEQ ID NO: 900045 - DNA, 15 bp, Homo sapiens
atatagtccagacac

SEQ ID NO: 900046 - DNA, 16 bp, Homo sapiens
atatagtccagacact

SEQ ID NO: 900047 - DNA, 14 bp, Homo sapiens
atatagtctacagt

SEQ ID NO: 900048 - DNA, 21 bp, Homo sapiens
atatagtggatgatatacaca

SEQ ID NO: 900049 - DNA, 17 bp, Homo sapiens
atatagtgggtacatca

SEQ ID NO: 900050 - DNA, 22 bp, Homo sapiens
atatagtgggtacatcaagtcc

SEQ ID NO: 900051 - DNA, 22 bp, Homo sapiens
atatagttagctaataaaaagc

SEQ ID NO: 900052 - DNA, 12 bp, Homo sapiens
atatagttcctt

SEQ ID NO: 900053 - DNA, 19 bp, Homo sapiens
atatagttccttgccttaa

SEQ ID NO: 900054 - DNA, 13 bp, Homo sapiens
atatagttctgtg

SEQ ID NO: 900055 - DNA, 20 bp, Homo sapiens
atatagttctgtgtagagaa

SEQ ID NO: 900056 - DNA, 23 bp, Homo sapiens
atatagttctgtgtagagaatgt

SEQ ID NO: 900057 - DNA, 13 bp, Homo sapiens
atatagttttact

SEQ ID NO: 900058 - DNA, 16 bp, Homo sapiens
atatagttttactttt

SEQ ID NO: 900059 - DNA, 18 bp, Homo sapiens
atatagttttacttttaa

SEQ ID NO: 900060 - DNA, 13 bp, Homo sapiens
atatataaaataa

SEQ ID NO: 900061 - DNA, 18 bp, Homo sapiens
atatataaaataaatata

SEQ ID NO: 900062 - DNA, 19 bp, Homo sapiens
atatataaacaataaaaac

SEQ ID NO: 900063 - DNA, 14 bp, Homo sapiens
atatataaatatat

SEQ ID NO: 900064 - DNA, 21 bp, Homo sapiens
atatataagtttacaccttta

SEQ ID NO: 900065 - DNA, 15 bp, Homo sapiens
atatataatatgtat

SEQ ID NO: 900066 - DNA, 16 bp, Homo sapiens
atatataatttcctca

SEQ ID NO: 900067 - DNA, 14 bp, Homo sapiens
atatatacacatac

SEQ ID NO: 900068 - DNA, 16 bp, Homo sapiens
atatatacacatacat

SEQ ID NO: 900069 - DNA, 23 bp, Homo sapiens
atatatacacatacatacacata

SEQ ID NO: 900070 - DNA, 18 bp, Homo sapiens
atatatacagtaacttta

SEQ ID NO: 900071 - DNA, 13 bp, Homo sapiens
atatatagaatct

SEQ ID NO: 900072 - DNA, 23 bp, Homo sapiens
atatatagctacattcacacact

SEQ ID NO: 900073 - DNA, 20 bp, Homo sapiens
atatataggctattttctaa

SEQ ID NO: 900074 - DNA, 17 bp, Homo sapiens
atatatagtccagacac

SEQ ID NO: 900075 - DNA, 14 bp, Homo sapiens
atatatataaacct

SEQ ID NO: 900076 - DNA, 15 bp, Homo sapiens
atatatataaatata

SEQ ID NO: 900077 - DNA, 14 bp, Homo sapiens
atatatatacacat

SEQ ID NO: 900078 - DNA, 16 bp, Homo sapiens
atatatatacacatac

SEQ ID NO: 900079 - DNA, 10 bp, Homo sapiens
atatatatat

SEQ ID NO: 900080 - DNA, 13 bp, Homo sapiens
atatatatataaa

SEQ ID NO: 900081 - DNA, 15 bp, Homo sapiens
atatatatatacaca

SEQ ID NO: 900082 - DNA, 13 bp, Homo sapiens
atatatatatata

SEQ ID NO: 900083 - DNA, 14 bp, Homo sapiens
atatatatatatat

SEQ ID NO: 900084 - DNA, 16 bp, Homo sapiens
atatatatatatataa

SEQ ID NO: 900085 - DNA, 14 bp, Homo sapiens
atatatatatatgt

SEQ ID NO: 900086 - DNA, 14 bp, Homo sapiens
atatatatatattt

SEQ ID NO: 900087 - DNA, 13 bp, Homo sapiens
atatatatatgta

SEQ ID NO: 900088 - DNA, 13 bp, Homo sapiens
atatatatattta

SEQ ID NO: 900089 - DNA, 14 bp, Homo sapiens
atatatatctgata

SEQ ID NO: 900090 - DNA, 15 bp, Homo sapiens
atatatatgaataaa

SEQ ID NO: 900091 - DNA, 20 bp, Homo sapiens
atatatatgtacagttatct

SEQ ID NO: 900092 - DNA, 20 bp, Homo sapiens
atatatatgtgtgtgtatgt

SEQ ID NO: 900093 - DNA, 14 bp, Homo sapiens
atatatattgtaaa

SEQ ID NO: 900094 - DNA, 11 bp, Homo sapiens
atatatattta

SEQ ID NO: 900095 - DNA, 16 bp, Homo sapiens
atatatatttgtaaca

SEQ ID NO: 900096 - DNA, 20 bp, Homo sapiens
atatatatttgtaacattgt

SEQ ID NO: 900097 - DNA, 23 bp, Homo sapiens
atatatattttttgcttttgtat

SEQ ID NO: 900098 - DNA, 17 bp, Homo sapiens
atatatcaagaagtctt

SEQ ID NO: 900099 - DNA, 15 bp, Homo sapiens
atatatctatctatt

SEQ ID NO: 900100 - DNA, 18 bp, Homo sapiens
atatatctatctatttga

SEQ ID NO: 900101 - DNA, 19 bp, Homo sapiens
atatatctatctatttgag

SEQ ID NO: 900102 - DNA, 19 bp, Homo sapiens
atatatcttataaagtgga

SEQ ID NO: 900103 - DNA, 17 bp, Homo sapiens
aatccaatattgtaatc

SEQ ID NO: 900104 - DNA, 19 bp, Homo sapiens
aatccacaatgagatgcat

SEQ ID NO: 900105 - DNA, 12 bp, Homo sapiens
aatccacccatc

SEQ ID NO: 900106 - DNA, 12 bp, Homo sapiens
aatccaccccca

SEQ ID NO: 900107 - DNA, 13 bp, Homo sapiens
aatccacctgcct

SEQ ID NO: 900108 - DNA, 19 bp, Homo sapiens
aatccacctgcctcggcct

SEQ ID NO: 900109 - DNA, 13 bp, Homo sapiens
aatccagaggaac

SEQ ID NO: 900110 - DNA, 19 bp, Homo sapiens
aatccagaggaacaagcat

SEQ ID NO: 900111 - DNA, 13 bp, Homo sapiens
aatccagctccct

SEQ ID NO: 900112 - DNA, 18 bp, Homo sapiens
aatccagctccctagact

SEQ ID NO: 900113 - DNA, 24 bp, Homo sapiens
aatccagtattatattatcatatc

SEQ ID NO: 900114 - DNA, 21 bp, Homo sapiens
aatccagtattgctgatttta

SEQ ID NO: 900115 - DNA, 14 bp, Homo sapiens
aatccataaatgtg

SEQ ID NO: 900116 - DNA, 14 bp, Homo sapiens
aatccatgcttcac

SEQ ID NO: 900117 - DNA, 15 bp, Homo sapiens
aatccatgcttgggt

SEQ ID NO: 900118 - DNA, 19 bp, Homo sapiens
aatccatgtgaccattctg

SEQ ID NO: 900119 - DNA, 21 bp, Homo sapiens
aatccatgtgattaatgtttt

SEQ ID NO: 900120 - DNA, 18 bp, Homo sapiens
aatccattatcctttatt

SEQ ID NO: 900121 - DNA, 19 bp, Homo sapiens
aatccattgaactggaaga

SEQ ID NO: 900122 - DNA, 17 bp, Homo sapiens
aatccattgtttaaaga

SEQ ID NO: 900123 - DNA, 19 bp, Homo sapiens
aatccattgtttaaagatg

SEQ ID NO: 900124 - DNA, 22 bp, Homo sapiens
aatccattttaggtgataaaat

SEQ ID NO: 900125 - DNA, 22 bp, Homo sapiens
aatcccaatctttctatataaa

SEQ ID NO: 900126 - DNA, 15 bp, Homo sapiens
aatcccaatgtttga

SEQ ID NO: 900127 - DNA, 14 bp, Homo sapiens
aatcccactgtatg

SEQ ID NO: 900128 - DNA, 15 bp, Homo sapiens
aatcccagcactttg

SEQ ID NO: 900129 - DNA, 21 bp, Homo sapiens
aatcccagggaaggacttgga

SEQ ID NO: 900130 - DNA, 15 bp, Homo sapiens
aatcccatttcttga

SEQ ID NO: 900131 - DNA, 18 bp, Homo sapiens
aatccccaacatgcactg

SEQ ID NO: 900132 - DNA, 16 bp, Homo sapiens
aatccccatcattact

SEQ ID NO: 900133 - DNA, 22 bp, Homo sapiens
aatccccatcattactggtaaa

SEQ ID NO: 900134 - DNA, 16 bp, Homo sapiens
aatccccccttcagaa

SEQ ID NO: 900135 - DNA, 20 bp, Homo sapiens
aatccccgacccccctaccc

SEQ ID NO: 900136 - DNA, 22 bp, Homo sapiens
aatccccgacccccctacccca

SEQ ID NO: 900137 - DNA, 14 bp, Homo sapiens
aatcccctcattca

SEQ ID NO: 900138 - DNA, 10 bp, Homo sapiens
aatccctctc

SEQ ID NO: 900139 - DNA, 16 bp, Homo sapiens
aatccctctccactct

SEQ ID NO: 900140 - DNA, 23 bp, Homo sapiens
aatccctctccactcttctctcc

SEQ ID NO: 900141 - DNA, 14 bp, Homo sapiens
aatccctgccactg

SEQ ID NO: 900142 - DNA, 21 bp, Homo sapiens
aatccctgccactgggctctg

SEQ ID NO: 900143 - DNA, 23 bp, Homo sapiens
aatccctgccactgggctctgga

SEQ ID NO: 900144 - DNA, 14 bp, Homo sapiens
aatccctgttcatt

SEQ ID NO: 900145 - DNA, 17 bp, Homo sapiens
aatccctgttcattgta

SEQ ID NO: 900146 - DNA, 17 bp, Homo sapiens
aatccctgtttaatatt

SEQ ID NO: 900147 - DNA, 13 bp, Homo sapiens
aatcccttaaaat

SEQ ID NO: 900148 - DNA, 18 bp, Homo sapiens
aatcccttaacagttgta

SEQ ID NO: 900149 - DNA, 22 bp, Homo sapiens
aatcccttaacagttgtattta

SEQ ID NO: 900150 - DNA, 21 bp, Homo sapiens
aatcccttaatatcctaaaca

SEQ ID NO: 900151 - DNA, 13 bp, Homo sapiens
aatccgacttgaa

SEQ ID NO: 900152 - DNA, 20 bp, Homo sapiens
aatccgctctcttcctgccc

SEQ ID NO: 900153 - DNA, 23 bp, Homo sapiens
aatccgctctcttcctgcccctc

SEQ ID NO: 900154 - DNA, 15 bp, Homo sapiens
aatcctaaaagaagc

SEQ ID NO: 900155 - DNA, 14 bp, Homo sapiens
aatcctaagacaca

SEQ ID NO: 900156 - DNA, 17 bp, Homo sapiens
aatcctacctcaaaatt

SEQ ID NO: 900157 - DNA, 19 bp, Homo sapiens
aatcctagacttgaaagtt

SEQ ID NO: 900158 - DNA, 20 bp, Homo sapiens
aatcctagacttgaaagttt

SEQ ID NO: 900159 - DNA, 14 bp, Homo sapiens
aatcctatatctgt

SEQ ID NO: 900160 - DNA, 22 bp, Homo sapiens
aatcctatctggggagctcctg

SEQ ID NO: 900161 - DNA, 15 bp, Homo sapiens
aatcctattactctt

SEQ ID NO: 900162 - DNA, 21 bp, Homo sapiens
aatcctcagagagttgtctgt

SEQ ID NO: 900163 - DNA, 21 bp, Homo sapiens
aatcctcagccgagaaattgg

SEQ ID NO: 900164 - DNA, 9 bp, Homo sapiens
aatcctcct

SEQ ID NO: 900165 - DNA, 19 bp, Homo sapiens
aatcctcctacctcagcct

SEQ ID NO: 900166 - DNA, 15 bp, Homo sapiens
aatcctctcctttct

SEQ ID NO: 900167 - DNA, 11 bp, Homo sapiens
aatcctctggc

SEQ ID NO: 900168 - DNA, 14 bp, Homo sapiens
aatcctcttcctct

SEQ ID NO: 900169 - DNA, 15 bp, Homo sapiens
aatcctcttcctctg

SEQ ID NO: 900170 - DNA, 18 bp, Homo sapiens
aatcctcttcctctgagg

SEQ ID NO: 900171 - DNA, 18 bp, Homo sapiens
aatcctgaataaaccagt

SEQ ID NO: 900172 - DNA, 14 bp, Homo sapiens
aatcctgcaatgaa

SEQ ID NO: 900173 - DNA, 17 bp, Homo sapiens
aatcctgcaatgaaagg

SEQ ID NO: 900174 - DNA, 14 bp, Homo sapiens
aatcctgcctctcc

SEQ ID NO: 900175 - DNA, 14 bp, Homo sapiens
aatcctggaagaca

SEQ ID NO: 900176 - DNA, 23 bp, Homo sapiens
aatcctggaagacaacccaggca

SEQ ID NO: 900177 - DNA, 17 bp, Homo sapiens
aatcctggaaggacaca

SEQ ID NO: 900178 - DNA, 12 bp, Homo sapiens
aatcctggcagc

SEQ ID NO: 900179 - DNA, 16 bp, Homo sapiens
aatcctggcagcccag

SEQ ID NO: 900180 - DNA, 18 bp, Homo sapiens
aatcctggtaattaaaag

SEQ ID NO: 900181 - DNA, 12 bp, Homo sapiens
aatcctgtcttt

SEQ ID NO: 900182 - DNA, 14 bp, Homo sapiens
aatcctgtttataa

SEQ ID NO: 900183 - DNA, 16 bp, Homo sapiens
aatccttccctgctct

SEQ ID NO: 900184 - DNA, 18 bp, Homo sapiens
aatccttcgtcctaacat

SEQ ID NO: 900185 - DNA, 20 bp, Homo sapiens
aatccttctagtttcccaca

SEQ ID NO: 900186 - DNA, 19 bp, Homo sapiens
aatccttctattctagcct

SEQ ID NO: 900187 - DNA, 17 bp, Homo sapiens
aatccttgataatatat

SEQ ID NO: 900188 - DNA, 22 bp, Homo sapiens
aatccttggctgaattaaaatg

SEQ ID NO: 900189 - DNA, 23 bp, Homo sapiens
aatccttggctgaattaaaatgg

SEQ ID NO: 900190 - DNA, 20 bp, Homo sapiens
aatccttgtgacttacaatt

SEQ ID NO: 900191 - DNA, 21 bp, Homo sapiens
aatcctttctgccccccaggg

SEQ ID NO: 900192 - DNA, 22 bp, Homo sapiens
aatcctttgttttctgactaat

SEQ ID NO: 900193 - DNA, 19 bp, Homo sapiens
aatcgagagtgtgctctcc

SEQ ID NO: 900194 - DNA, 17 bp, Homo sapiens
aatcgaggaaccagagc

SEQ ID NO: 900195 - DNA, 20 bp, Homo sapiens
aatcgatgggggatgcttca

SEQ ID NO: 900196 - DNA, 21 bp, Homo sapiens
aatcgatgggggatgcttcat

SEQ ID NO: 900197 - DNA, 14 bp, Homo sapiens
aatcgattggcttt

SEQ ID NO: 900198 - DNA, 15 bp, Homo sapiens
aatcgatttcctccc

SEQ ID NO: 900199 - DNA, 14 bp, Homo sapiens
aatcgccccagact

SEQ ID NO: 900200 - DNA, 17 bp, Homo sapiens
aatcgcttgaacctggg

SEQ ID NO: 900201 - DNA, 22 bp, Homo sapiens
aatcggatctggggctctggga

SEQ ID NO: 900202 - DNA, 22 bp, Homo sapiens
aatcggcccacagctcccaccc

SEQ ID NO: 900203 - DNA, 21 bp, Homo sapiens
aatcggctacccctcgactca

SEQ ID NO: 900204 - DNA, 22 bp, Homo sapiens
aatcgggctaaggtccctgggg

SEQ ID NO: 900205 - DNA, 23 bp, Homo sapiens
aatcgtggcacgtattgctgtgt

SEQ ID NO: 900206 - DNA, 22 bp, Homo sapiens
aatcgtgtgccatggatctgat

SEQ ID NO: 900207 - DNA, 15 bp, Homo sapiens
aatcgtttctcagaa

SEQ ID NO: 900208 - DNA, 23 bp, Homo sapiens
aatctaaaacaaaatctgaactc

SEQ ID NO: 900209 - DNA, 14 bp, Homo sapiens
aatctaaaatgatt

SEQ ID NO: 900210 - DNA, 19 bp, Homo sapiens
aatctaaatctatttatta

SEQ ID NO: 900211 - DNA, 19 bp, Homo sapiens
aatctaagctgtttgccaa

SEQ ID NO: 900212 - DNA, 17 bp, Homo sapiens
atatcctctccccctcc

SEQ ID NO: 900213 - DNA, 15 bp, Homo sapiens
atatcctgagccatc

SEQ ID NO: 900214 - DNA, 12 bp, Homo sapiens
atatcctgcctc

SEQ ID NO: 900215 - DNA, 14 bp, Homo sapiens
atatcctgtaacta

SEQ ID NO: 900216 - DNA, 20 bp, Homo sapiens
atatcctgtgactgtctcac

SEQ ID NO: 900217 - DNA, 22 bp, Homo sapiens
atatcggggggtggaccacgcc

SEQ ID NO: 900218 - DNA, 22 bp, Homo sapiens
atatctaaagctttggacaagt

SEQ ID NO: 900219 - DNA, 20 bp, Homo sapiens
atatctaaagttatatttca

SEQ ID NO: 900220 - DNA, 19 bp, Homo sapiens
atatctaatatatatgaat

SEQ ID NO: 900221 - DNA, 20 bp, Homo sapiens
atatctaattattttgcagt

SEQ ID NO: 900222 - DNA, 17 bp, Homo sapiens
atatctacacatacaga

SEQ ID NO: 900223 - DNA, 23 bp, Homo sapiens
atatctacacatacagaaagaag

SEQ ID NO: 900224 - DNA, 14 bp, Homo sapiens
atatctattatgta

SEQ ID NO: 900225 - DNA, 17 bp, Homo sapiens
atatctcaatctgcagc

SEQ ID NO: 900226 - DNA, 22 bp, Homo sapiens
atatctccatggccctgtccca

SEQ ID NO: 900227 - DNA, 23 bp, Homo sapiens
atatctcctgaaaaggtttatga

SEQ ID NO: 900228 - DNA, 12 bp, Homo sapiens
atatctctgccg

SEQ ID NO: 900229 - DNA, 21 bp, Homo sapiens
aatctagaagatgtgtaaaca

SEQ ID NO: 900230 - DNA, 22 bp, Homo sapiens
aatctagaagatgtgtaaacag

SEQ ID NO: 900231 - DNA, 14 bp, Homo sapiens
aatctagaggaaaa

SEQ ID NO: 900232 - DNA, 19 bp, Homo sapiens
aatctagaggaaaagaaag

SEQ ID NO: 900233 - DNA, 20 bp, Homo sapiens
aatctagtgggttgaccttt

SEQ ID NO: 900234 - DNA, 23 bp, Homo sapiens
aatctagttttttttgtaaactg

SEQ ID NO: 900235 - DNA, 20 bp, Homo sapiens
aatctatagttcactgacac

SEQ ID NO: 900236 - DNA, 18 bp, Homo sapiens
aatctatatttgtcttcc

SEQ ID NO: 900237 - DNA, 23 bp, Homo sapiens
aatctatcactaaaaatttttac

SEQ ID NO: 900238 - DNA, 18 bp, Homo sapiens
aatctatgccaaagatca

SEQ ID NO: 900239 - DNA, 22 bp, Homo sapiens
aatctatggcttatttctatga

SEQ ID NO: 900240 - DNA, 21 bp, Homo sapiens
aatctatggtcgggagacagc

SEQ ID NO: 900241 - DNA, 19 bp, Homo sapiens
aatctatgtcgtgttttca

SEQ ID NO: 900242 - DNA, 15 bp, Homo sapiens
aatctatgtgtttct

SEQ ID NO: 900243 - DNA, 19 bp, Homo sapiens
aatctatgtgtttctgtaa

SEQ ID NO: 900244 - DNA, 14 bp, Homo sapiens
aatctattagattt

SEQ ID NO: 900245 - DNA, 19 bp, Homo sapiens
aatctattcagacaagcaa

SEQ ID NO: 900246 - DNA, 11 bp, Homo sapiens
aatctatttaa

SEQ ID NO: 900247 - DNA, 18 bp, Homo sapiens
aatctatttattaatatt

SEQ ID NO: 900248 - DNA, 12 bp, Homo sapiens
aatctatttcta

SEQ ID NO: 900249 - DNA, 13 bp, Homo sapiens
aatctcaaaatta

SEQ ID NO: 900250 - DNA, 14 bp, Homo sapiens
aatctcaaaattag

SEQ ID NO: 900251 - DNA, 15 bp, Homo sapiens
aatctcaaaggagaa

SEQ ID NO: 900252 - DNA, 16 bp, Homo sapiens
aatctcaaaggagaaa

SEQ ID NO: 900253 - DNA, 20 bp, Homo sapiens
aatctcaaaggagaaaaaaa

SEQ ID NO: 900254 - DNA, 15 bp, Homo sapiens
aatctcaaataacta

SEQ ID NO: 900255 - DNA, 15 bp, Homo sapiens
aatctcaaatttcta

SEQ ID NO: 900256 - DNA, 17 bp, Homo sapiens
aatctcaaatttctaaa

SEQ ID NO: 900257 - DNA, 18 bp, Homo sapiens
aatctcaaatttctaaat

SEQ ID NO: 900258 - DNA, 13 bp, Homo sapiens
aatctcagcaaag

SEQ ID NO: 900259 - DNA, 22 bp, Homo sapiens
aatctcagcaatgattactctt

SEQ ID NO: 900260 - DNA, 14 bp, Homo sapiens
aatctcagtgcttt

SEQ ID NO: 900261 - DNA, 20 bp, Homo sapiens
aatctcagttgtttgcttct

SEQ ID NO: 900262 - DNA, 21 bp, Homo sapiens
aatctcagttgtttgcttctt

SEQ ID NO: 900263 - DNA, 23 bp, Homo sapiens
aatctcataggttgccaataata

SEQ ID NO: 900264 - DNA, 13 bp, Homo sapiens
aatctcatccccc

SEQ ID NO: 900265 - DNA, 14 bp, Homo sapiens
aatctcatcccccc

SEQ ID NO: 900266 - DNA, 15 bp, Homo sapiens
aatctcatcccccca

SEQ ID NO: 900267 - DNA, 18 bp, Homo sapiens
aatctcatgattccatgc

SEQ ID NO: 900268 - DNA, 13 bp, Homo sapiens
aatctccaaaata

SEQ ID NO: 900269 - DNA, 16 bp, Homo sapiens
aatctcccagcccacc

SEQ ID NO: 900270 - DNA, 17 bp, Homo sapiens
aatctcccgctgctgct

SEQ ID NO: 900271 - DNA, 19 bp, Homo sapiens
aatctcccgctgctgctgc

SEQ ID NO: 900272 - DNA, 19 bp, Homo sapiens
aatctctcatattcgctag

SEQ ID NO: 900273 - DNA, 22 bp, Homo sapiens
aatctctcatattcgctagtgt

SEQ ID NO: 900274 - DNA, 16 bp, Homo sapiens
aatctctctgcagctg

SEQ ID NO: 900275 - DNA, 18 bp, Homo sapiens
aatctctctgcagctgcc

SEQ ID NO: 900276 - DNA, 19 bp, Homo sapiens
aatctcttcactaccctga

SEQ ID NO: 900277 - DNA, 19 bp, Homo sapiens
aatctcttcatgcttgaca

SEQ ID NO: 900278 - DNA, 19 bp, Homo sapiens
aatctcttcttatacagat

SEQ ID NO: 900279 - DNA, 17 bp, Homo sapiens
aatctcttgattataaa

SEQ ID NO: 900280 - DNA, 22 bp, Homo sapiens
aatctgaactctcaaaagtcta

SEQ ID NO: 900281 - DNA, 23 bp, Homo sapiens
aatctgaagatatatttcacttt

SEQ ID NO: 900282 - DNA, 17 bp, Homo sapiens
aatctgaggcctcctct

SEQ ID NO: 900283 - DNA, 19 bp, Homo sapiens
aatctgagggaaatgtttt

SEQ ID NO: 900284 - DNA, 20 bp, Homo sapiens
aatctgagggaaatgttttg

SEQ ID NO: 900285 - DNA, 21 bp, Homo sapiens
aatctgagggaaatgttttgt

SEQ ID NO: 900286 - DNA, 16 bp, Homo sapiens
aatctgatggccttaa

SEQ ID NO: 900287 - DNA, 20 bp, Homo sapiens
aatctgatggccttaatttc

SEQ ID NO: 900288 - DNA, 15 bp, Homo sapiens
aatctgattagaagt

SEQ ID NO: 900289 - DNA, 15 bp, Homo sapiens
aatctgatttaatgt

SEQ ID NO: 900290 - DNA, 19 bp, Homo sapiens
aatctgatttaatgttttc

SEQ ID NO: 900291 - DNA, 12 bp, Homo sapiens
aatctgcagcca

SEQ ID NO: 900292 - DNA, 11 bp, Homo sapiens
aatctgcaggg

SEQ ID NO: 900293 - DNA, 18 bp, Homo sapiens
aatctgcagggagcaact

SEQ ID NO: 900294 - DNA, 18 bp, Homo sapiens
aatctgcattttaacaag

SEQ ID NO: 900295 - DNA, 11 bp, Homo sapiens
aatctgctgtt

SEQ ID NO: 900296 - DNA, 16 bp, Homo sapiens
aatctggaaatctgtt

SEQ ID NO: 900297 - DNA, 15 bp, Homo sapiens
aatctggaagaaaaa

SEQ ID NO: 900298 - DNA, 22 bp, Homo sapiens
aatctggaccccatctgtgaat

SEQ ID NO: 900299 - DNA, 15 bp, Homo sapiens
aatctggactcctct

SEQ ID NO: 900300 - DNA, 17 bp, Homo sapiens
aatctggactcctctgt

SEQ ID NO: 900301 - DNA, 11 bp, Homo sapiens
aatctggatta

SEQ ID NO: 900302 - DNA, 21 bp, Homo sapiens
aatctggcattctacacctgg

SEQ ID NO: 900303 - DNA, 15 bp, Homo sapiens
aatctgggactttca

SEQ ID NO: 900304 - DNA, 16 bp, Homo sapiens
aatctgggagggaagt

SEQ ID NO: 900305 - DNA, 18 bp, Homo sapiens
aatctggggaagaggttt

SEQ ID NO: 900306 - DNA, 14 bp, Homo sapiens
aatctgggggtgag

SEQ ID NO: 900307 - DNA, 11 bp, Homo sapiens
aatctgtaaac

SEQ ID NO: 900308 - DNA, 13 bp, Homo sapiens
aatctgtacaatg

SEQ ID NO: 900309 - DNA, 20 bp, Homo sapiens
aatctgtataatactttgta

SEQ ID NO: 900310 - DNA, 14 bp, Homo sapiens
aatctgtcaaaaca

SEQ ID NO: 900311 - DNA, 20 bp, Homo sapiens
aatctgtcaaaacactgtgg

SEQ ID NO: 900312 - DNA, 16 bp, Homo sapiens
aatctgtgaattaaaa

SEQ ID NO: 900313 - DNA, 12 bp, Homo sapiens
aatctgtgcctg

SEQ ID NO: 900314 - DNA, 16 bp, Homo sapiens
aatctgtgctctttca

SEQ ID NO: 900315 - DNA, 13 bp, Homo sapiens
aatctgtgtacaa

SEQ ID NO: 900316 - DNA, 17 bp, Homo sapiens
aatctgtgtacaaagaa

SEQ ID NO: 900317 - DNA, 18 bp, Homo sapiens
aatctgtgtacaaagaaa

SEQ ID NO: 900318 - DNA, 18 bp, Homo sapiens
aatctgtgtgcatatttg

SEQ ID NO: 900319 - DNA, 19 bp, Homo sapiens
aatctgtgtgcatatttgt

SEQ ID NO: 900320 - DNA, 16 bp, Homo sapiens
aatctgtgtgtatatt

SEQ ID NO: 900321 - DNA, 23 bp, Homo sapiens
aatctgttatgtactagtgttct

SEQ ID NO: 900322 - DNA, 14 bp, Homo sapiens
aatctgtttctctg

SEQ ID NO: 900323 - DNA, 15 bp, Homo sapiens
aatctgtttctctgc

SEQ ID NO: 900324 - DNA, 20 bp, Homo sapiens
aatctgtttctctgctgtca

SEQ ID NO: 900325 - DNA, 18 bp, Homo sapiens
aatctgtttgtgcaaaca

SEQ ID NO: 900326 - DNA, 21 bp, Homo sapiens
aatctgttttataccttgctt

SEQ ID NO: 900327 - DNA, 22 bp, Homo sapiens
aatctgttttgtatatgatcta

SEQ ID NO: 900328 - DNA, 19 bp, Homo sapiens
aatctgtttttacgtatgt

SEQ ID NO: 900329 - DNA, 15 bp, Homo sapiens
aatcttaaaagtgta

SEQ ID NO: 900330 - DNA, 19 bp, Homo sapiens
aatcttaaacaatgtataa

SEQ ID NO: 900331 - DNA, 14 bp, Homo sapiens
aatcttaacatcat

SEQ ID NO: 900332 - DNA, 23 bp, Homo sapiens
aatcttaagtaccaatgggaagc

SEQ ID NO: 900333 - DNA, 16 bp, Homo sapiens
aatcttaccagatgct

SEQ ID NO: 900334 - DNA, 21 bp, Homo sapiens
atatgggaacaaattagagga

SEQ ID NO: 900335 - DNA, 20 bp, Homo sapiens
atatgggggcctggattcat

SEQ ID NO: 900336 - DNA, 17 bp, Homo sapiens
atatggggggccaacac

SEQ ID NO: 900337 - DNA, 18 bp, Homo sapiens
atatggtcttgagccagt

SEQ ID NO: 900338 - DNA, 14 bp, Homo sapiens
atatggttctccaa

SEQ ID NO: 900339 - DNA, 17 bp, Homo sapiens
atatggttctccaagaa

SEQ ID NO: 900340 - DNA, 20 bp, Homo sapiens
atatggttggagagccctgg

SEQ ID NO: 900341 - DNA, 15 bp, Homo sapiens
atatggtttggtttt

SEQ ID NO: 900342 - DNA, 14 bp, Homo sapiens
atatgtaaaacatt

SEQ ID NO: 900343 - DNA, 15 bp, Homo sapiens
atatgtaaaacattt

SEQ ID NO: 900344 - DNA, 22 bp, Homo sapiens
atatgtaaatggtatgtcattc

SEQ ID NO: 900345 - DNA, 14 bp, Homo sapiens
atatgtaagggaaa

SEQ ID NO: 900346 - DNA, 14 bp, Homo sapiens
atatgtaagtactt

SEQ ID NO: 900347 - DNA, 18 bp, Homo sapiens
atatgtaatataaattta

SEQ ID NO: 900348 - DNA, 15 bp, Homo sapiens
atatgtacagctctc

SEQ ID NO: 900349 - DNA, 14 bp, Homo sapiens
atatgtacagttat

SEQ ID NO: 900350 - DNA, 16 bp, Homo sapiens
atatgtacagtttatt

SEQ ID NO: 900351 - DNA, 14 bp, Homo sapiens
atatgtaccatgta

SEQ ID NO: 900352 - DNA, 19 bp, Homo sapiens
atatgtacttgtcaaagaa

SEQ ID NO: 900353 - DNA, 16 bp, Homo sapiens
atatgtagaaggcaca

SEQ ID NO: 900354 - DNA, 16 bp, Homo sapiens
atatgtagatgtatgc

SEQ ID NO: 900355 - DNA, 18 bp, Homo sapiens
atatgtagatgtatgcac

SEQ ID NO: 900356 - DNA, 15 bp, Homo sapiens
atatgtagtatctat

SEQ ID NO: 900357 - DNA, 16 bp, Homo sapiens
aaacaataattttaac

SEQ ID NO: 900358 - DNA, 15 bp, Homo sapiens
aaacaatatctgcag

SEQ ID NO: 900359 - DNA, 22 bp, Homo sapiens
aaacaatcccaatctttctata

SEQ ID NO: 900360 - DNA, 13 bp, Homo sapiens
aaacaatcttatt

SEQ ID NO: 900361 - DNA, 22 bp, Homo sapiens
aaacaatgtataaagattgtac

SEQ ID NO: 900362 - DNA, 16 bp, Homo sapiens
aaacaatgttgtccaa

SEQ ID NO: 900363 - DNA, 23 bp, Homo sapiens
aaacaatgtttgggggaaaaaaa

SEQ ID NO: 900364 - DNA, 17 bp, Homo sapiens
aaacaattcaagctgag

SEQ ID NO: 900365 - DNA, 20 bp, Homo sapiens
aaacaattcaagctgagaaa

SEQ ID NO: 900366 - DNA, 13 bp, Homo sapiens
aaacaattcagtg

SEQ ID NO: 900367 - DNA, 16 bp, Homo sapiens
aaacaattcagtggtc

SEQ ID NO: 900368 - DNA, 23 bp, Homo sapiens
aaacaattcccttctttttcatc

SEQ ID NO: 900369 - DNA, 17 bp, Homo sapiens
aaacaatttattttatt

SEQ ID NO: 900370 - DNA, 14 bp, Homo sapiens
aaacacaaaacaac

SEQ ID NO: 900371 - DNA, 23 bp, Homo sapiens
aaacacaccaggctgtgggcctc

SEQ ID NO: 900372 - DNA, 19 bp, Homo sapiens
aaacacagtcaaaataatt

SEQ ID NO: 900373 - DNA, 13 bp, Homo sapiens
aaacacagttaca

SEQ ID NO: 900374 - DNA, 17 bp, Homo sapiens
aaacacatacaaaagaa

SEQ ID NO: 900375 - DNA, 18 bp, Homo sapiens
aaacacatagattcacct

SEQ ID NO: 900376 - DNA, 18 bp, Homo sapiens
aaacacatctagtagttg

SEQ ID NO: 900377 - DNA, 14 bp, Homo sapiens
aaacacatgccagt

SEQ ID NO: 900378 - DNA, 19 bp, Homo sapiens
aaacaccaacatgttggga

SEQ ID NO: 900379 - DNA, 15 bp, Homo sapiens
aaacaccattataaa

SEQ ID NO: 900380 - DNA, 12 bp, Homo sapiens
aaacaccattca

SEQ ID NO: 900381 - DNA, 13 bp, Homo sapiens
aaacacctcccca

SEQ ID NO: 900382 - DNA, 17 bp, Homo sapiens
aaacacctccccagccc

SEQ ID NO: 900383 - DNA, 13 bp, Homo sapiens
aaacacgaaactt

SEQ ID NO: 900384 - DNA, 14 bp, Homo sapiens
aaacacgaaacttg

SEQ ID NO: 900385 - DNA, 15 bp, Homo sapiens
aaacacgaaacttgt

SEQ ID NO: 900386 - DNA, 17 bp, Homo sapiens
aaacacgaaacttgtta

SEQ ID NO: 900387 - DNA, 22 bp, Homo sapiens
aaacacgccttgttcctgctct

SEQ ID NO: 900388 - DNA, 20 bp, Homo sapiens
aaacactccacagtgtttat

SEQ ID NO: 900389 - DNA, 11 bp, Homo sapiens
aaacactggac

SEQ ID NO: 900390 - DNA, 18 bp, Homo sapiens
aaacactggacctggggg

SEQ ID NO: 900391 - DNA, 15 bp, Homo sapiens
aaacactgtaatctt

SEQ ID NO: 900392 - DNA, 13 bp, Homo sapiens
aaacactgtgcac

SEQ ID NO: 900393 - DNA, 17 bp, Homo sapiens
aaacacttccagtctgg

SEQ ID NO: 900394 - DNA, 19 bp, Homo sapiens
aaacacttggcatacaaaa

SEQ ID NO: 900395 - DNA, 14 bp, Homo sapiens
aaacactttctctt

SEQ ID NO: 900396 - DNA, 11 bp, Homo sapiens
aaacagaaata

SEQ ID NO: 900397 - DNA, 15 bp, Homo sapiens
aaacagaactccctt

SEQ ID NO: 900398 - DNA, 14 bp, Homo sapiens
aaacagaactcgat

SEQ ID NO: 900399 - DNA, 21 bp, Homo sapiens
aaacagaataaaagttcctct

SEQ ID NO: 900400 - DNA, 14 bp, Homo sapiens
aaacagacaatatg

SEQ ID NO: 900401 - DNA, 20 bp, Homo sapiens
aaacagactcgattcatatt

SEQ ID NO: 900402 - DNA, 16 bp, Homo sapiens
aaacagagacaggccc

SEQ ID NO: 900403 - DNA, 22 bp, Homo sapiens
aaacagagacaggcccaagaga

SEQ ID NO: 900404 - DNA, 22 bp, Homo sapiens
aaacagagtccaatttaaggaa

SEQ ID NO: 900405 - DNA, 15 bp, Homo sapiens
aaacagagtggcctc

SEQ ID NO: 900406 - DNA, 18 bp, Homo sapiens
aaacagagtggcctccct

SEQ ID NO: 900407 - DNA, 18 bp, Homo sapiens
aaacagatgaccataatt

SEQ ID NO: 900408 - DNA, 19 bp, Homo sapiens
aaacagatgataaatattt

SEQ ID NO: 900409 - DNA, 20 bp, Homo sapiens
aaacagatgataaatattta

SEQ ID NO: 900410 - DNA, 21 bp, Homo sapiens
aaacagatgtattatgctgtt

SEQ ID NO: 900411 - DNA, 22 bp, Homo sapiens
aaacagattcaggccagcccag

SEQ ID NO: 900412 - DNA, 19 bp, Homo sapiens
aaacagattctgattccct

SEQ ID NO: 900413 - DNA, 17 bp, Homo sapiens
aaacagatttggaaaga

SEQ ID NO: 900414 - DNA, 14 bp, Homo sapiens
aaacagatttttac

SEQ ID NO: 900415 - DNA, 15 bp, Homo sapiens
aaacagcagtttgtg

SEQ ID NO: 900416 - DNA, 21 bp, Homo sapiens
aaacagcagtttgtgatatag

SEQ ID NO: 900417 - DNA, 15 bp, Homo sapiens
aaacagcatgaataa

SEQ ID NO: 900418 - DNA, 18 bp, Homo sapiens
aaacagcattgctttctg

SEQ ID NO: 900419 - DNA, 21 bp, Homo sapiens
aaacagcattgctttctgaaa

SEQ ID NO: 900420 - DNA, 19 bp, Homo sapiens
aaacagccccagtcttcct

SEQ ID NO: 900421 - DNA, 20 bp, Homo sapiens
aaacagccccagtcttcctt

SEQ ID NO: 900422 - DNA, 22 bp, Homo sapiens
aaacagccgtcagccaaatgta

SEQ ID NO: 900423 - DNA, 14 bp, Homo sapiens
aaacagctattata

SEQ ID NO: 900424 - DNA, 20 bp, Homo sapiens
aaacagcttcatgcctttgt

SEQ ID NO: 900425 - DNA, 17 bp, Homo sapiens
aaacatggttacaatca

SEQ ID NO: 900426 - DNA, 20 bp, Homo sapiens
aaacatgtcacaatacagta

SEQ ID NO: 900427 - DNA, 17 bp, Homo sapiens
aaacatgttagaagcaa

SEQ ID NO: 900428 - DNA, 21 bp, Homo sapiens
aaacatgtttaaatagcctaa

SEQ ID NO: 900429 - DNA, 12 bp, Homo sapiens
aaacattaaaca

SEQ ID NO: 900430 - DNA, 21 bp, Homo sapiens
aaacattaaacactgtaatct

SEQ ID NO: 900431 - DNA, 14 bp, Homo sapiens
aaacattaagaaaa

SEQ ID NO: 900432 - DNA, 16 bp, Homo sapiens
aaacattaagtaaatg

SEQ ID NO: 900433 - DNA, 20 bp, Homo sapiens
aaacattaatagcagccttt

SEQ ID NO: 900434 - DNA, 21 bp, Homo sapiens
aaacattaatagcagcctttc

SEQ ID NO: 900435 - DNA, 16 bp, Homo sapiens
aaacattaattttgtg

SEQ ID NO: 900436 - DNA, 18 bp, Homo sapiens
aaacattatatgtataca

SEQ ID NO: 900437 - DNA, 17 bp, Homo sapiens
aaacattcctccagcct

SEQ ID NO: 900438 - DNA, 19 bp, Homo sapiens
aaacattctatctactgat

SEQ ID NO: 900439 - DNA, 23 bp, Homo sapiens
aaacattctgatttggaaaaaga

SEQ ID NO: 900440 - DNA, 17 bp, Homo sapiens
aaacattgcctttgaat

SEQ ID NO: 900441 - DNA, 12 bp, Homo sapiens
aaacattgctgc

SEQ ID NO: 900442 - DNA, 14 bp, Homo sapiens
aaacatttaacata

SEQ ID NO: 900443 - DNA, 13 bp, Homo sapiens
aaacatttacaat

SEQ ID NO: 900444 - DNA, 18 bp, Homo sapiens
aaacatttacaataaata

SEQ ID NO: 900445 - DNA, 19 bp, Homo sapiens
aaacatttacaataaatat

SEQ ID NO: 900446 - DNA, 23 bp, Homo sapiens
aaacatttacaataaatattctg

SEQ ID NO: 900447 - DNA, 12 bp, Homo sapiens
aaacatttattt

SEQ ID NO: 900448 - DNA, 17 bp, Homo sapiens
aaacatttattttgaca

SEQ ID NO: 900449 - DNA, 14 bp, Homo sapiens
aaacatttcataat

SEQ ID NO: 900450 - DNA, 16 bp, Homo sapiens
aaacatttcataattt

SEQ ID NO: 900451 - DNA, 18 bp, Homo sapiens
aaacatttcataatttgt

SEQ ID NO: 900452 - DNA, 22 bp, Homo sapiens
aaacatttcataatttgtttcc

SEQ ID NO: 900453 - DNA, 14 bp, Homo sapiens
aaacatttgctgaa

SEQ ID NO: 900454 - DNA, 17 bp, Homo sapiens
aaacattttatactgta

SEQ ID NO: 900455 - DNA, 19 bp, Homo sapiens
aaacattttatactgtaca

SEQ ID NO: 900456 - DNA, 23 bp, Homo sapiens
aaacattttatcattaaaaatta

SEQ ID NO: 900457 - DNA, 14 bp, Homo sapiens
aaacattttatttt

SEQ ID NO: 900458 - DNA, 16 bp, Homo sapiens
aaacattttctttctt

SEQ ID NO: 900459 - DNA, 15 bp, Homo sapiens
aaacattttgaagtg

SEQ ID NO: 900460 - DNA, 19 bp, Homo sapiens
aaacattttgtcatataag

SEQ ID NO: 900461 - DNA, 21 bp, Homo sapiens
aaacattttgtggtcattaag

SEQ ID NO: 900462 - DNA, 20 bp, Homo sapiens
aaacattttttaaggaggga

SEQ ID NO: 900463 - DNA, 21 bp, Homo sapiens
aaaccaaaaaaaaaaaaaatc

SEQ ID NO: 900464 - DNA, 16 bp, Homo sapiens
aaaccaaacccagcca

SEQ ID NO: 900465 - DNA, 17 bp, Homo sapiens
aaaccaaagagggcttc

SEQ ID NO: 900466 - DNA, 19 bp, Homo sapiens
aaaccaaagagggcttcct

SEQ ID NO: 900467 - DNA, 18 bp, Homo sapiens
aaaccaaagctgcctgtg

SEQ ID NO: 900468 - DNA, 11 bp, Homo sapiens
aaaccaaagtc

SEQ ID NO: 900469 - DNA, 16 bp, Homo sapiens
aaaccaaagtctgccg

SEQ ID NO: 900470 - DNA, 21 bp, Homo sapiens
aaaccaagaaggagacctttt

SEQ ID NO: 900471 - DNA, 16 bp, Homo sapiens
aaaccaagcatcaggg

SEQ ID NO: 900472 - DNA, 16 bp, Homo sapiens
aaaccaagccgtggct

SEQ ID NO: 900473 - DNA, 14 bp, Homo sapiens
aaaccaagccttgg

SEQ ID NO: 900474 - DNA, 23 bp, Homo sapiens
aaaccaagtcaagtgaaaaagga

SEQ ID NO: 900475 - DNA, 13 bp, Homo sapiens
aaaccaatttctt

SEQ ID NO: 900476 - DNA, 18 bp, Homo sapiens
aaaccaatttcttccttc

SEQ ID NO: 900477 - DNA, 21 bp, Homo sapiens
aaaccacaaggctgttgcatg

SEQ ID NO: 900478 - DNA, 16 bp, Homo sapiens
aaaccacacttcttga

SEQ ID NO: 900479 - DNA, 13 bp, Homo sapiens
aaaccacagcagg

SEQ ID NO: 900480 - DNA, 16 bp, Homo sapiens
aaaccacagccctgtc

SEQ ID NO: 900481 - DNA, 20 bp, Homo sapiens
aaaccacagctgggcagggt

SEQ ID NO: 900482 - DNA, 20 bp, Homo sapiens
aaaccacataatttttgtac

SEQ ID NO: 900483 - DNA, 16 bp, Homo sapiens
aaaccaccctctgggg

SEQ ID NO: 900484 - DNA, 13 bp, Homo sapiens
ccgcaccagctgc

SEQ ID NO: 900485 - DNA, 16 bp, Homo sapiens
ccgcaccagctgctct

SEQ ID NO: 900486 - DNA, 18 bp, Homo sapiens
ccgcaccagctgctctgc

SEQ ID NO: 900487 - DNA, 19 bp, Homo sapiens
ccgcaccagctgctctgcc

SEQ ID NO: 900488 - DNA, 17 bp, Homo sapiens
ccgcaccccagagtgtg

SEQ ID NO: 900489 - DNA, 15 bp, Homo sapiens
ccgcaccccatccca

SEQ ID NO: 900490 - DNA, 15 bp, Homo sapiens
ccgcacccccaccct

SEQ ID NO: 900491 - DNA, 13 bp, Homo sapiens
ccgcaccccccaa

SEQ ID NO: 900492 - DNA, 19 bp, Homo sapiens
ccgcacccccgccaggcgc

SEQ ID NO: 900493 - DNA, 13 bp, Homo sapiens
ccgcaccctgcac

SEQ ID NO: 900494 - DNA, 23 bp, Homo sapiens
ccgcaccctgcacctgctgcgtc

SEQ ID NO: 900495 - DNA, 22 bp, Homo sapiens
ccgcacctgtcggtggctgcct

SEQ ID NO: 900496 - DNA, 16 bp, Homo sapiens
ccgcaccttcctcctc

SEQ ID NO: 900497 - DNA, 20 bp, Homo sapiens
ccgcacgggctgtctgggtg

SEQ ID NO: 900498 - DNA, 14 bp, Homo sapiens
ccgcactaggggat

SEQ ID NO: 900499 - DNA, 14 bp, Homo sapiens
ccgcactctgcccc

SEQ ID NO: 900500 - DNA, 13 bp, Homo sapiens
ccgcagaagcagc

SEQ ID NO: 900501 - DNA, 14 bp, Homo sapiens
ccgcagaagcagcc

SEQ ID NO: 900502 - DNA, 17 bp, Homo sapiens
ccgcagaagcagcccct

SEQ ID NO: 900503 - DNA, 12 bp, Homo sapiens
ccgcagactgct

SEQ ID NO: 900504 - DNA, 14 bp, Homo sapiens
ccgcagactgcttg

SEQ ID NO: 900505 - DNA, 19 bp, Homo sapiens
ccgcagactgcttggccag

SEQ ID NO: 900506 - DNA, 21 bp, Homo sapiens
ccgcagactgcttggccagat

SEQ ID NO: 900507 - DNA, 15 bp, Homo sapiens
ccgcagagcccacgc

SEQ ID NO: 900508 - DNA, 14 bp, Homo sapiens
ccgcagcagctccc

SEQ ID NO: 900509 - DNA, 22 bp, Homo sapiens
ccgcagccagccggtgcctggc

SEQ ID NO: 900510 - DNA, 13 bp, Homo sapiens
ccgcagccccttt

SEQ ID NO: 900511 - DNA, 14 bp, Homo sapiens
ccgcagcctccctc

SEQ ID NO: 900512 - DNA, 18 bp, Homo sapiens
ccgcaggaactgggctgg

SEQ ID NO: 900513 - DNA, 20 bp, Homo sapiens
ccgcaggaactgggctgggc

SEQ ID NO: 900514 - DNA, 14 bp, Homo sapiens
ccgcaggagggagg

SEQ ID NO: 900515 - DNA, 22 bp, Homo sapiens
ccgcaggcagactacacaggat

SEQ ID NO: 900516 - DNA, 14 bp, Homo sapiens
ccgcagggccatgc

SEQ ID NO: 900517 - DNA, 21 bp, Homo sapiens
ccgcaggggtttgggtggggg

SEQ ID NO: 900518 - DNA, 20 bp, Homo sapiens
ccgcaggtgggtgctgccct

SEQ ID NO: 900519 - DNA, 21 bp, Homo sapiens
ccgcaggtgggtgctgccctg

SEQ ID NO: 900520 - DNA, 22 bp, Homo sapiens
ccgcaggtgggtgctgccctgt

SEQ ID NO: 900521 - DNA, 16 bp, Homo sapiens
ccgcagtccccagccc

SEQ ID NO: 900522 - DNA, 17 bp, Homo sapiens
ccgcagtccccagccct

SEQ ID NO: 900523 - DNA, 15 bp, Homo sapiens
ccgcataggcccagc

SEQ ID NO: 900524 - DNA, 22 bp, Homo sapiens
ccgcataggcccagccagggtg

SEQ ID NO: 900525 - DNA, 18 bp, Homo sapiens
ccgcatatgcatgccagg

SEQ ID NO: 900526 - DNA, 19 bp, Homo sapiens
ccgcatatgcatgccaggc

SEQ ID NO: 900527 - DNA, 23 bp, Homo sapiens
ccgcatatgcatgccaggctggg

SEQ ID NO: 900528 - DNA, 12 bp, Homo sapiens
ccgcatcttctc

SEQ ID NO: 900529 - DNA, 19 bp, Homo sapiens
ccgcatcttctccatctgg

SEQ ID NO: 900530 - DNA, 20 bp, Homo sapiens
ccgcatcttctccatctggc

SEQ ID NO: 900531 - DNA, 14 bp, Homo sapiens
ccgcatgtgtgcct

SEQ ID NO: 900532 - DNA, 20 bp, Homo sapiens
ccgcattcagtgcacctgcc

SEQ ID NO: 900533 - DNA, 15 bp, Homo sapiens
ccgcattccctgagt

SEQ ID NO: 900534 - DNA, 19 bp, Homo sapiens
ccgcattggaagagcccgc

SEQ ID NO: 900535 - DNA, 17 bp, Homo sapiens
ccgccaaggctggggga

SEQ ID NO: 900536 - DNA, 22 bp, Homo sapiens
ccgccacatggtgtggccatca

SEQ ID NO: 900537 - DNA, 17 bp, Homo sapiens
ccgccacccccatcttc

SEQ ID NO: 900538 - DNA, 14 bp, Homo sapiens
ccgccacctcaggg

SEQ ID NO: 900539 - DNA, 20 bp, Homo sapiens
ccgccactaggtgtccccaa

SEQ ID NO: 900540 - DNA, 21 bp, Homo sapiens
ccgccactcccgggccaagac

SEQ ID NO: 900541 - DNA, 19 bp, Homo sapiens
ccgccagaccccgtggctc

SEQ ID NO: 900542 - DNA, 19 bp, Homo sapiens
ccgccagccccgctcccac

SEQ ID NO: 900543 - DNA, 14 bp, Homo sapiens
ccgccagcctcagt

SEQ ID NO: 900544 - DNA, 15 bp, Homo sapiens
ccgccagcctcctct

SEQ ID NO: 900545 - DNA, 18 bp, Homo sapiens
ccgccagcctcctctgga

SEQ ID NO: 900546 - DNA, 12 bp, Homo sapiens
ccgccagcgtgt

SEQ ID NO: 900547 - DNA, 16 bp, Homo sapiens
ccgccagcgtgtggag

SEQ ID NO: 900548 - DNA, 17 bp, Homo sapiens
ccgccagcgtgtggagc

SEQ ID NO: 900549 - DNA, 22 bp, Homo sapiens
ccgccagcgtgtggagcagagc

SEQ ID NO: 900550 - DNA, 18 bp, Homo sapiens
ccgccaggcgcatgtctg

SEQ ID NO: 900551 - DNA, 23 bp, Homo sapiens
ccgccaggcgcatgtctgcacct

SEQ ID NO: 900552 - DNA, 13 bp, Homo sapiens
ccgccagggctgg

SEQ ID NO: 900553 - DNA, 16 bp, Homo sapiens
ccgccagggctgggga

SEQ ID NO: 900554 - DNA, 19 bp, Homo sapiens
ccgccatacattaaggagc

SEQ ID NO: 900555 - DNA, 15 bp, Homo sapiens
ccgccatagccccag

SEQ ID NO: 900556 - DNA, 21 bp, Homo sapiens
ccgccatccagggtctggcag

SEQ ID NO: 900557 - DNA, 14 bp, Homo sapiens
ccgccatctgcgca

SEQ ID NO: 900558 - DNA, 20 bp, Homo sapiens
ccgccatggggtcggctcct

SEQ ID NO: 900559 - DNA, 21 bp, Homo sapiens
ccgccatggggtcggctcctg

SEQ ID NO: 900560 - DNA, 17 bp, Homo sapiens
ccgccatggtgtcccgg

SEQ ID NO: 900561 - DNA, 14 bp, Homo sapiens
ccgccattgccacc

SEQ ID NO: 900562 - DNA, 15 bp, Homo sapiens
ccgccattgccacca

SEQ ID NO: 900563 - DNA, 13 bp, Homo sapiens
ccgcccaccccca

SEQ ID NO: 900564 - DNA, 20 bp, Homo sapiens
ccgcccacctcgctcccctc

SEQ ID NO: 900565 - DNA, 19 bp, Homo sapiens
ccgcccacgccggcctctg

SEQ ID NO: 900566 - DNA, 16 bp, Homo sapiens
ccgcccactgtcctgg

SEQ ID NO: 900567 - DNA, 19 bp, Homo sapiens
ccgcccactgtcctgggcg

SEQ ID NO: 900568 - DNA, 22 bp, Homo sapiens
ccgcccagctgcacctgccagc

SEQ ID NO: 900569 - DNA, 13 bp, Homo sapiens
ccgccccacctcc

SEQ ID NO: 900570 - DNA, 12 bp, Homo sapiens
ccgccccagagt

SEQ ID NO: 900571 - DNA, 13 bp, Homo sapiens
ccgcccccaccgg

SEQ ID NO: 900572 - DNA, 17 bp, Homo sapiens
ccgcccccaccgggctg

SEQ ID NO: 900573 - DNA, 13 bp, Homo sapiens
ccgcccccagcct

SEQ ID NO: 900574 - DNA, 19 bp, Homo sapiens
ccgcccccagtccccaccc

SEQ ID NO: 900575 - DNA, 17 bp, Homo sapiens
cagcccagcagtgtgga

SEQ ID NO: 900576 - DNA, 23 bp, Homo sapiens
cagcccagcagtgtggagaccct

SEQ ID NO: 900577 - DNA, 13 bp, Homo sapiens
cagcccagccagg

SEQ ID NO: 900578 - DNA, 14 bp, Homo sapiens
cagcccagccaggc

SEQ ID NO: 900579 - DNA, 23 bp, Homo sapiens
cagcccagccccgccccgttgtg

SEQ ID NO: 900580 - DNA, 13 bp, Homo sapiens
cagcccagcctgc

SEQ ID NO: 900581 - DNA, 14 bp, Homo sapiens
cagcccagcctgcc

SEQ ID NO: 900582 - DNA, 20 bp, Homo sapiens
cagcccagcctgccccctat

SEQ ID NO: 900583 - DNA, 23 bp, Homo sapiens
cagcccagcttggccctttcctt

SEQ ID NO: 900584 - DNA, 20 bp, Homo sapiens
cagcccaggatactggcaca

SEQ ID NO: 900585 - DNA, 22 bp, Homo sapiens
cagcccaggatactggcacaga

SEQ ID NO: 900586 - DNA, 19 bp, Homo sapiens
cagcccaggcatctccttg

SEQ ID NO: 900587 - DNA, 23 bp, Homo sapiens
cagcccaggccggggtggagcat

SEQ ID NO: 900588 - DNA, 12 bp, Homo sapiens
cagcccagggcc

SEQ ID NO: 900589 - DNA, 15 bp, Homo sapiens
cagcccagggcctgc

SEQ ID NO: 900590 - DNA, 16 bp, Homo sapiens
cagcccagggcctgca

SEQ ID NO: 900591 - DNA, 17 bp, Homo sapiens
cagcccagggttccccc

SEQ ID NO: 900592 - DNA, 21 bp, Homo sapiens
cagcccatccattaggccagc

SEQ ID NO: 900593 - DNA, 15 bp, Homo sapiens
cagcccatggccccc

SEQ ID NO: 900594 - DNA, 20 bp, Homo sapiens
cagcccatggcccccaataa

SEQ ID NO: 900595 - DNA, 21 bp, Homo sapiens
cagcccatggcccccaataaa

SEQ ID NO: 900596 - DNA, 23 bp, Homo sapiens
cagcccatggcccccaataaagg

SEQ ID NO: 900597 - DNA, 22 bp, Homo sapiens
cagcccattctctctcctgtcc

SEQ ID NO: 900598 - DNA, 14 bp, Homo sapiens
cagcccattgctgc

SEQ ID NO: 900599 - DNA, 15 bp, Homo sapiens
cagcccattgctgcc

SEQ ID NO: 900600 - DNA, 16 bp, Homo sapiens
cagcccattgctgcca

SEQ ID NO: 900601 - DNA, 22 bp, Homo sapiens
cagcccattggccgagctcctg

SEQ ID NO: 900602 - DNA, 23 bp, Homo sapiens
cagcccattggccgagctcctgg

SEQ ID NO: 900603 - DNA, 21 bp, Homo sapiens
cagccccaagcttctgagtct

SEQ ID NO: 900604 - DNA, 15 bp, Homo sapiens
cagccccacagtccc

SEQ ID NO: 900605 - DNA, 21 bp, Homo sapiens
cagccccacagtcccattcct

SEQ ID NO: 900606 - DNA, 13 bp, Homo sapiens
cagccccacccag

SEQ ID NO: 900607 - DNA, 21 bp, Homo sapiens
cagccccacccccagccaggc

SEQ ID NO: 900608 - DNA, 23 bp, Homo sapiens
cagccccacccccagccaggcta

SEQ ID NO: 900609 - DNA, 12 bp, Homo sapiens
cagccccactgc

SEQ ID NO: 900610 - DNA, 13 bp, Homo sapiens
cagccccactgcc

SEQ ID NO: 900611 - DNA, 14 bp, Homo sapiens
cagccccactgcca

SEQ ID NO: 900612 - DNA, 13 bp, Homo sapiens
cagccccacttct

SEQ ID NO: 900613 - DNA, 17 bp, Homo sapiens
cagccccagtcttcctt

SEQ ID NO: 900614 - DNA, 22 bp, Homo sapiens
cagccccatcgccccaactcca

SEQ ID NO: 900615 - DNA, 17 bp, Homo sapiens
cagcccccaccagggga

SEQ ID NO: 900616 - DNA, 13 bp, Homo sapiens
cagcccccactcc

SEQ ID NO: 900617 - DNA, 12 bp, Homo sapiens
cagcccccagcc

SEQ ID NO: 900618 - DNA, 16 bp, Homo sapiens
cagcccccagggcccc

SEQ ID NO: 900619 - DNA, 12 bp, Homo sapiens
cagcccccccac

SEQ ID NO: 900620 - DNA, 14 bp, Homo sapiens
cagcccccccaccc

SEQ ID NO: 900621 - DNA, 16 bp, Homo sapiens
cagcccccccacccac

SEQ ID NO: 900622 - DNA, 17 bp, Homo sapiens
cagcccccccacccacc

SEQ ID NO: 900623 - DNA, 20 bp, Homo sapiens
cagcccccccacccaccccc

SEQ ID NO: 900624 - DNA, 15 bp, Homo sapiens
cagcccccccctcaa

SEQ ID NO: 900625 - DNA, 19 bp, Homo sapiens
cagcccccccctcaagggg

SEQ ID NO: 900626 - DNA, 15 bp, Homo sapiens
cagcccccgccccag

SEQ ID NO: 900627 - DNA, 22 bp, Homo sapiens
cagcccccgcgccctccctccg

SEQ ID NO: 900628 - DNA, 17 bp, Homo sapiens
cagcccccgggacaccg

SEQ ID NO: 900629 - DNA, 11 bp, Homo sapiens
cagccccctcc

SEQ ID NO: 900630 - DNA, 15 bp, Homo sapiens
cagccccctccacac

SEQ ID NO: 900631 - DNA, 16 bp, Homo sapiens
cagccccctccacacc

SEQ ID NO: 900632 - DNA, 19 bp, Homo sapiens
cagcccccttgccctccgc

SEQ ID NO: 900633 - DNA, 20 bp, Homo sapiens
cagcccccttgccctccgcc

SEQ ID NO: 900634 - DNA, 15 bp, Homo sapiens
cagccccgactccag

SEQ ID NO: 900635 - DNA, 17 bp, Homo sapiens
cagccccgactccagcc

SEQ ID NO: 900636 - DNA, 20 bp, Homo sapiens
cagccccgactccagccagc

SEQ ID NO: 900637 - DNA, 17 bp, Homo sapiens
cagccccgacttcctga

SEQ ID NO: 900638 - DNA, 21 bp, Homo sapiens
cagccccgcgaccatgtggcc

SEQ ID NO: 900639 - DNA, 15 bp, Homo sapiens
cagccccgctcccag

SEQ ID NO: 900640 - DNA, 18 bp, Homo sapiens
cagccccgttttggggac

SEQ ID NO: 900641 - DNA, 15 bp, Homo sapiens
cagcccctaagcccc

SEQ ID NO: 900642 - DNA, 13 bp, Homo sapiens
cagcccctacccc

SEQ ID NO: 900643 - DNA, 18 bp, Homo sapiens
cagcccctacccctgccc

SEQ ID NO: 900644 - DNA, 15 bp, Homo sapiens
acctatctcgtggga

SEQ ID NO: 900645 - DNA, 14 bp, Homo sapiens
acctatgaagcaat

SEQ ID NO: 900646 - DNA, 15 bp, Homo sapiens
acctatgactttttt

SEQ ID NO: 900647 - DNA, 21 bp, Homo sapiens
acctatgagatggccatgctc

SEQ ID NO: 900648 - DNA, 15 bp, Homo sapiens
acctatgcagggagg

SEQ ID NO: 900649 - DNA, 12 bp, Homo sapiens
acctatgcctgt

SEQ ID NO: 900650 - DNA, 22 bp, Homo sapiens
acctatgcctgtggtgaagtgt

SEQ ID NO: 900651 - DNA, 18 bp, Homo sapiens
acctatggaagtggttct

SEQ ID NO: 900652 - DNA, 23 bp, Homo sapiens
acctatggaagtggttctatgtc

SEQ ID NO: 900653 - DNA, 22 bp, Homo sapiens
acctatggtataatggttgact

SEQ ID NO: 900654 - DNA, 12 bp, Homo sapiens
acctatgtactt

SEQ ID NO: 900655 - DNA, 22 bp, Homo sapiens
acctatgtcctaaggacacact

SEQ ID NO: 900656 - DNA, 23 bp, Homo sapiens
acctatgttattttgtgtacaag

SEQ ID NO: 900657 - DNA, 12 bp, Homo sapiens
acctattaggtg

SEQ ID NO: 900658 - DNA, 16 bp, Homo sapiens
acctattcaccctcca

SEQ ID NO: 900659 - DNA, 16 bp, Homo sapiens
acctatttccagaaat

SEQ ID NO: 900660 - DNA, 17 bp, Homo sapiens
acctatttccagaaata

SEQ ID NO: 900661 - DNA, 12 bp, Homo sapiens
acctatttccat

SEQ ID NO: 900662 - DNA, 17 bp, Homo sapiens
acctatttctgatgatg

SEQ ID NO: 900663 - DNA, 18 bp, Homo sapiens
acctatttctgatgatgt

SEQ ID NO: 900664 - DNA, 14 bp, Homo sapiens
acctatttgacata

SEQ ID NO: 900665 - DNA, 18 bp, Homo sapiens
acctattttcatttgtac

SEQ ID NO: 900666 - DNA, 15 bp, Homo sapiens
acctcaaagggcagt

SEQ ID NO: 900667 - DNA, 20 bp, Homo sapiens
acctcaaagggcagttttga

SEQ ID NO: 900668 - DNA, 21 bp, Homo sapiens
acctcaaagggcagttttgag

SEQ ID NO: 900669 - DNA, 16 bp, Homo sapiens
acctcaaccaatgcca

SEQ ID NO: 900670 - DNA, 21 bp, Homo sapiens
acctcaaccatcctggctgcg

SEQ ID NO: 900671 - DNA, 15 bp, Homo sapiens
acctcaacccagagg

SEQ ID NO: 900672 - DNA, 19 bp, Homo sapiens
acctcaacccccatttcta

SEQ ID NO: 900673 - DNA, 17 bp, Homo sapiens
acctcaactaaccctta

SEQ ID NO: 900674 - DNA, 22 bp, Homo sapiens
acctcaactaacccttaaaaat

SEQ ID NO: 900675 - DNA, 16 bp, Homo sapiens
acctcaactgcctact

SEQ ID NO: 900676 - DNA, 22 bp, Homo sapiens
acctcaactgcctactccaaaa

SEQ ID NO: 900677 - DNA, 14 bp, Homo sapiens
acctcaagaccccc

SEQ ID NO: 900678 - DNA, 13 bp, Homo sapiens
acctcaagccatc

SEQ ID NO: 900679 - DNA, 15 bp, Homo sapiens
acctcaagggggact

SEQ ID NO: 900680 - DNA, 15 bp, Homo sapiens
acctcaatgccctgc

SEQ ID NO: 900681 - DNA, 17 bp, Homo sapiens
acctcaatggaggtttg

SEQ ID NO: 900682 - DNA, 20 bp, Homo sapiens
acctcaatttttgtttttga

SEQ ID NO: 900683 - DNA, 23 bp, Homo sapiens
acctcacaaccgtacagtttctg

SEQ ID NO: 900684 - DNA, 16 bp, Homo sapiens
acctcacacacggctg

SEQ ID NO: 900685 - DNA, 14 bp, Homo sapiens
acctcaccaaacta

SEQ ID NO: 900686 - DNA, 19 bp, Homo sapiens
acctcaccattgtgaagca

SEQ ID NO: 900687 - DNA, 18 bp, Homo sapiens
acctcacccttgcaccgt

SEQ ID NO: 900688 - DNA, 14 bp, Homo sapiens
acctcactcctgtt

SEQ ID NO: 900689 - DNA, 22 bp, Homo sapiens
acctcactgagaggcctggagc

SEQ ID NO: 900690 - DNA, 21 bp, Homo sapiens
acctcactgggcctttccaga

SEQ ID NO: 900691 - DNA, 14 bp, Homo sapiens
acctcactgtcagg

SEQ ID NO: 900692 - DNA, 23 bp, Homo sapiens
acctcagaaagtcaccaggactt

SEQ ID NO: 900693 - DNA, 14 bp, Homo sapiens
acctcagccatgag

SEQ ID NO: 900694 - DNA, 14 bp, Homo sapiens
acctcagcctggag

SEQ ID NO: 900695 - DNA, 20 bp, Homo sapiens
acctcagcctggagaggcct

SEQ ID NO: 900696 - DNA, 12 bp, Homo sapiens
acctcagcctgt

SEQ ID NO: 900697 - DNA, 14 bp, Homo sapiens
acctcagccttgga

SEQ ID NO: 900698 - DNA, 15 bp, Homo sapiens
acctcagctctggga

SEQ ID NO: 900699 - DNA, 16 bp, Homo sapiens
acctcagctgcacatt

SEQ ID NO: 900700 - DNA, 19 bp, Homo sapiens
acctcagctgcacattcct

SEQ ID NO: 900701 - DNA, 20 bp, Homo sapiens
acctcagctgcacattcctg

SEQ ID NO: 900702 - DNA, 22 bp, Homo sapiens
acctcagctgcacattcctggc

SEQ ID NO: 900703 - DNA, 15 bp, Homo sapiens
acctcaggagggcag

SEQ ID NO: 900704 - DNA, 19 bp, Homo sapiens
acctcaggcttccttggca

SEQ ID NO: 900705 - DNA, 17 bp, Homo sapiens
agcatcctgagccccgc

SEQ ID NO: 900706 - DNA, 23 bp, Homo sapiens
agcatcctgagccccgccctctt

SEQ ID NO: 900707 - DNA, 19 bp, Homo sapiens
agcatccttttctgcagag

SEQ ID NO: 900708 - DNA, 19 bp, Homo sapiens
agcatcgggagcacccaga

SEQ ID NO: 900709 - DNA, 21 bp, Homo sapiens
agcatcgggagcacccagagc

SEQ ID NO: 900710 - DNA, 22 bp, Homo sapiens
agcatcgtgacccttcagggcc

SEQ ID NO: 900711 - DNA, 15 bp, Homo sapiens
agcatctacttcagg

SEQ ID NO: 900712 - DNA, 20 bp, Homo sapiens
agcatctcagcctaccatga

SEQ ID NO: 900713 - DNA, 22 bp, Homo sapiens
agcatctcttcttccctgtcag

SEQ ID NO: 900714 - DNA, 14 bp, Homo sapiens
agcatctgcaacaa

SEQ ID NO: 900715 - DNA, 20 bp, Homo sapiens
agcatctggctgtctagaat

SEQ ID NO: 900716 - DNA, 23 bp, Homo sapiens
agcatctggctgtctagaatgtg

SEQ ID NO: 900717 - DNA, 12 bp, Homo sapiens
agcatcttctgg

SEQ ID NO: 900718 - DNA, 15 bp, Homo sapiens
agcatcttctggagt

SEQ ID NO: 900719 - DNA, 18 bp, Homo sapiens
agcatcttgccagcctca

SEQ ID NO: 900720 - DNA, 13 bp, Homo sapiens
agcatgaaaaagc

SEQ ID NO: 900721 - DNA, 15 bp, Homo sapiens
agcatgaataaaaca

SEQ ID NO: 900722 - DNA, 20 bp, Homo sapiens
agcatgaataaaacactcat

SEQ ID NO: 900723 - DNA, 13 bp, Homo sapiens
agcatgacaaaaa

SEQ ID NO: 900724 - DNA, 16 bp, Homo sapiens
agcatgacaaaaataa

SEQ ID NO: 900725 - DNA, 15 bp, Homo sapiens
agcatgacaactttt

SEQ ID NO: 900726 - DNA, 21 bp, Homo sapiens
agcatgacaacttttaaagaa

SEQ ID NO: 900727 - DNA, 22 bp, Homo sapiens
agcatgacaagccccaggcagg

SEQ ID NO: 900728 - DNA, 20 bp, Homo sapiens
agcatgacagcctgcagcag

SEQ ID NO: 900729 - DNA, 20 bp, Homo sapiens
agcatgagttatctgatttt

SEQ ID NO: 900730 - DNA, 20 bp, Homo sapiens
agcatgatcttgttactgtg

SEQ ID NO: 900731 - DNA, 19 bp, Homo sapiens
agcatgattttaagaggct

SEQ ID NO: 900732 - DNA, 12 bp, Homo sapiens
agcatgcaagct

SEQ ID NO: 900733 - DNA, 17 bp, Homo sapiens
agcatgcacagctgctt

SEQ ID NO: 900734 - DNA, 16 bp, Homo sapiens
agcatgcccagattcc

SEQ ID NO: 900735 - DNA, 20 bp, Homo sapiens
agcatgcccagattcccaga

SEQ ID NO: 900736 - DNA, 18 bp, Homo sapiens
agcatgcggagccagcag

SEQ ID NO: 900737 - DNA, 20 bp, Homo sapiens
agcatgcggagccagcaggc

SEQ ID NO: 900738 - DNA, 19 bp, Homo sapiens
agcatgcttcctttctctc

SEQ ID NO: 900739 - DNA, 20 bp, Homo sapiens
agcatgcttcctttctctcc

SEQ ID NO: 900740 - DNA, 15 bp, Homo sapiens
agcatgcttgggctg

SEQ ID NO: 900741 - DNA, 16 bp, Homo sapiens
agcatgcttgggctga

SEQ ID NO: 900742 - DNA, 20 bp, Homo sapiens
agcatgcttgggctgaccca

SEQ ID NO: 900743 - DNA, 14 bp, Homo sapiens
agcatgctttgctg

SEQ ID NO: 900744 - DNA, 16 bp, Homo sapiens
agcatgctttgctgct

SEQ ID NO: 900745 - DNA, 18 bp, Homo sapiens
agcatgctttgctgctat

SEQ ID NO: 900746 - DNA, 16 bp, Homo sapiens
agcatggactctgggt

SEQ ID NO: 900747 - DNA, 20 bp, Homo sapiens
agcatggcatagccccggcc

SEQ ID NO: 900748 - DNA, 17 bp, Homo sapiens
agcatggctattttata

SEQ ID NO: 900749 - DNA, 22 bp, Homo sapiens
agcatggctgtctgcacagagg

SEQ ID NO: 900750 - DNA, 14 bp, Homo sapiens
agcatgggcctggc

SEQ ID NO: 900751 - DNA, 19 bp, Homo sapiens
agcatgggcctggccacct

SEQ ID NO: 900752 - DNA, 15 bp, Homo sapiens
agcatggggcccctg

SEQ ID NO: 900753 - DNA, 13 bp, Homo sapiens
agcatggggtcag

SEQ ID NO: 900754 - DNA, 19 bp, Homo sapiens
agcatgggtccaagagaca

SEQ ID NO: 900755 - DNA, 16 bp, Homo sapiens
agcatggtccctgcct

SEQ ID NO: 900756 - DNA, 13 bp, Homo sapiens
agcatgtaatggt

SEQ ID NO: 900757 - DNA, 21 bp, Homo sapiens
agcatgtaatgttaatgttat

SEQ ID NO: 900758 - DNA, 20 bp, Homo sapiens
agcatgtacggattttcagt

SEQ ID NO: 900759 - DNA, 21 bp, Homo sapiens
agcatgtacggattttcagtt

SEQ ID NO: 900760 - DNA, 15 bp, Homo sapiens
agcatgtatgtctgc

SEQ ID NO: 900761 - DNA, 20 bp, Homo sapiens
agcatgtatttttgtcaatt

SEQ ID NO: 900762 - DNA, 15 bp, Homo sapiens
agcatgtctctctgc

SEQ ID NO: 900763 - DNA, 17 bp, Homo sapiens
agcatgtctctctgcca

SEQ ID NO: 900764 - DNA, 15 bp, Homo sapiens
agcatgtctctgctt

SEQ ID NO: 900765 - DNA, 16 bp, Homo sapiens
agcatgtctctgcttc

SEQ ID NO: 900766 - DNA, 20 bp, Homo sapiens
agcatgtctctgcttccatg

SEQ ID NO: 900767 - DNA, 23 bp, Homo sapiens
agcatgtctctgcttccatggct

SEQ ID NO: 900768 - DNA, 19 bp, Homo sapiens
agcatgtgtatttccagtg

SEQ ID NO: 900769 - DNA, 14 bp, Homo sapiens
agcatgtttcatgt

SEQ ID NO: 900770 - DNA, 17 bp, Homo sapiens
agcatgtttcatgtttt

SEQ ID NO: 900771 - DNA, 18 bp, Homo sapiens
agcatgtttcatgttttg

SEQ ID NO: 900772 - DNA, 14 bp, Homo sapiens
agcattaactaatc

SEQ ID NO: 900773 - DNA, 18 bp, Homo sapiens
agcattaacttctctgga

SEQ ID NO: 900774 - DNA, 13 bp, Homo sapiens
agcattacattat

SEQ ID NO: 900775 - DNA, 21 bp, Homo sapiens
agcattacattattaaacgat

SEQ ID NO: 900776 - DNA, 19 bp, Homo sapiens
agcattactctttttcaat

SEQ ID NO: 900777 - DNA, 14 bp, Homo sapiens
agcattaggctttt

SEQ ID NO: 900778 - DNA, 21 bp, Homo sapiens
agcattaggcttttaagaaac

SEQ ID NO: 900779 - DNA, 16 bp, Homo sapiens
agcattatgcaattag

SEQ ID NO: 900780 - DNA, 17 bp, Homo sapiens
agcattcagaagaaaaa

SEQ ID NO: 900781 - DNA, 19 bp, Homo sapiens
agcattcagaagaaaaaga

SEQ ID NO: 900782 - DNA, 16 bp, Homo sapiens
agcattcagagagcag

SEQ ID NO: 900783 - DNA, 17 bp, Homo sapiens
agcattcagagagcagc

SEQ ID NO: 900784 - DNA, 20 bp, Homo sapiens
agcattcaggcagcactgac

SEQ ID NO: 900785 - DNA, 13 bp, Homo sapiens
agcattccagctc

SEQ ID NO: 900786 - DNA, 17 bp, Homo sapiens
agcattccagctctgcc

SEQ ID NO: 900787 - DNA, 18 bp, Homo sapiens
agcattccagctctgccc

SEQ ID NO: 900788 - DNA, 15 bp, Homo sapiens
agcattccagtaact

SEQ ID NO: 900789 - DNA, 17 bp, Homo sapiens
agcattccagtaacttt

SEQ ID NO: 900790 - DNA, 14 bp, Homo sapiens
agcattcccaccaa

SEQ ID NO: 900791 - DNA, 18 bp, Homo sapiens
agcattctcactcctacc

SEQ ID NO: 900792 - DNA, 22 bp, Homo sapiens
agcattctcactcctacctggt

SEQ ID NO: 900793 - DNA, 17 bp, Homo sapiens
agcattctgagctgggc

SEQ ID NO: 900794 - DNA, 18 bp, Homo sapiens
agcattctggaggggaga

SEQ ID NO: 900795 - DNA, 16 bp, Homo sapiens
agcattcttgtcacaa

SEQ ID NO: 900796 - DNA, 15 bp, Homo sapiens
agcattctttaacag

SEQ ID NO: 900797 - DNA, 19 bp, Homo sapiens
agcattctttggagttaaa

SEQ ID NO: 900798 - DNA, 22 bp, Homo sapiens
agcattctttggagttaaaatg

SEQ ID NO: 900799 - DNA, 22 bp, Homo sapiens
agcattgaacatttcttatgat

SEQ ID NO: 900800 - DNA, 13 bp, Homo sapiens
agcattgaagaga

SEQ ID NO: 900801 - DNA, 15 bp, Homo sapiens
agcattgaatggcta

SEQ ID NO: 900802 - DNA, 16 bp, Homo sapiens
agcattgataatcttc

SEQ ID NO: 900803 - DNA, 20 bp, Homo sapiens
agcattgataatcttcaggt

SEQ ID NO: 900804 - DNA, 14 bp, Homo sapiens
agcattgctggttc

SEQ ID NO: 900805 - DNA, 15 bp, Homo sapiens
agcattgctggttct

SEQ ID NO: 900806 - DNA, 11 bp, Homo sapiens
agcattgcttt

SEQ ID NO: 900807 - DNA, 13 bp, Homo sapiens
agcattgctttct

SEQ ID NO: 900808 - DNA, 14 bp, Homo sapiens
agcattgtaaaata

SEQ ID NO: 900809 - DNA, 13 bp, Homo sapiens
agcattgtctctc

SEQ ID NO: 900810 - DNA, 16 bp, Homo sapiens
agcattgtctttgctg

SEQ ID NO: 900811 - DNA, 18 bp, Homo sapiens
agcattgtctttgctgta

SEQ ID NO: 900812 - DNA, 15 bp, Homo sapiens
agcattgttccacac

SEQ ID NO: 900813 - DNA, 23 bp, Homo sapiens
agcattgtttgcttattgttcca

SEQ ID NO: 900814 - DNA, 22 bp, Homo sapiens
agcatttaacccccctgtacac

SEQ ID NO: 900815 - DNA, 20 bp, Homo sapiens
agcatttaatggcagctagt

SEQ ID NO: 900816 - DNA, 17 bp, Homo sapiens
agcatttagcacaattt

SEQ ID NO: 900817 - DNA, 18 bp, Homo sapiens
agcatttagcacaatttg

SEQ ID NO: 900818 - DNA, 18 bp, Homo sapiens
agcatttagtcttgccag

SEQ ID NO: 900819 - DNA, 13 bp, Homo sapiens
agcatttatttct

SEQ ID NO: 900820 - DNA, 18 bp, Homo sapiens
agcatttcaaagccctgc

SEQ ID NO: 900821 - DNA, 19 bp, Homo sapiens
agcatttcaaagccctgcc

SEQ ID NO: 900822 - DNA, 20 bp, Homo sapiens
agcatttcaaagccctgcct

SEQ ID NO: 900823 - DNA, 14 bp, Homo sapiens
agcatttcatgaaa

SEQ ID NO: 900824 - DNA, 14 bp, Homo sapiens
agcatttccaacac

SEQ ID NO: 900825 - DNA, 17 bp, Homo sapiens
agcatttccaacaccac

SEQ ID NO: 900826 - DNA, 18 bp, Homo sapiens
agcatttccaacaccaca

SEQ ID NO: 900827 - DNA, 19 bp, Homo sapiens
agccaccccgggctctctg

SEQ ID NO: 900828 - DNA, 14 bp, Homo sapiens
agccacccctgcca

SEQ ID NO: 900829 - DNA, 16 bp, Homo sapiens
agccacccctgccact

SEQ ID NO: 900830 - DNA, 14 bp, Homo sapiens
agccaccgctgcca

SEQ ID NO: 900831 - DNA, 15 bp, Homo sapiens
agccaccgtgcctgg

SEQ ID NO: 900832 - DNA, 17 bp, Homo sapiens
agccaccgtgcctggcc

SEQ ID NO: 900833 - DNA, 19 bp, Homo sapiens
agccaccgtgcctggccag

SEQ ID NO: 900834 - DNA, 21 bp, Homo sapiens
agccaccgtgcctggccagat

SEQ ID NO: 900835 - DNA, 14 bp, Homo sapiens
agccacctccgcca

SEQ ID NO: 900836 - DNA, 18 bp, Homo sapiens
agccacctccgccagacc

SEQ ID NO: 900837 - DNA, 14 bp, Homo sapiens
agccacctgcaaga

SEQ ID NO: 900838 - DNA, 19 bp, Homo sapiens
agccacctgcaagatggac

SEQ ID NO: 900839 - DNA, 17 bp, Homo sapiens
agccacctgggaacaca

SEQ ID NO: 900840 - DNA, 18 bp, Homo sapiens
agccacctgggaacacag

SEQ ID NO: 900841 - DNA, 15 bp, Homo sapiens
agccaccttgttaca

SEQ ID NO: 900842 - DNA, 15 bp, Homo sapiens
agccacgattggaga

SEQ ID NO: 900843 - DNA, 22 bp, Homo sapiens
agccacgcctatgccctgccct

SEQ ID NO: 900844 - DNA, 14 bp, Homo sapiens
agccacgctgtcct

SEQ ID NO: 900845 - DNA, 18 bp, Homo sapiens
agccacgctgtcctctcg

SEQ ID NO: 900846 - DNA, 19 bp, Homo sapiens
agccacggagggaggcacc

SEQ ID NO: 900847 - DNA, 17 bp, Homo sapiens
agccacgttccttactg

SEQ ID NO: 900848 - DNA, 21 bp, Homo sapiens
agccacgttccttactgcaga

SEQ ID NO: 900849 - DNA, 23 bp, Homo sapiens
agccacgttccttactgcagaat

SEQ ID NO: 900850 - DNA, 19 bp, Homo sapiens
agccactaaccttgcctgg

SEQ ID NO: 900851 - DNA, 20 bp, Homo sapiens
agccactaaccttgcctggt

SEQ ID NO: 900852 - DNA, 22 bp, Homo sapiens
agccactcaggaggctgaggca

SEQ ID NO: 900853 - DNA, 15 bp, Homo sapiens
agccactccaagccc

SEQ ID NO: 900854 - DNA, 18 bp, Homo sapiens
agccactccaagccccct

SEQ ID NO: 900855 - DNA, 21 bp, Homo sapiens
agccactccaagccccctggc

SEQ ID NO: 900856 - DNA, 22 bp, Homo sapiens
agccactccaagccccctggca

SEQ ID NO: 900857 - DNA, 23 bp, Homo sapiens
agccactccaagccccctggcag

SEQ ID NO: 900858 - DNA, 12 bp, Homo sapiens
agccactccagg

SEQ ID NO: 900859 - DNA, 17 bp, Homo sapiens
agccactccctcccaga

SEQ ID NO: 900860 - DNA, 14 bp, Homo sapiens
agccactcctctga

SEQ ID NO: 900861 - DNA, 19 bp, Homo sapiens
agccactcctgtcccgcct

SEQ ID NO: 900862 - DNA, 21 bp, Homo sapiens
agccactccttccttcaggac

SEQ ID NO: 900863 - DNA, 13 bp, Homo sapiens
agccactgaagct

SEQ ID NO: 900864 - DNA, 14 bp, Homo sapiens
agccactgggcccc

SEQ ID NO: 900865 - DNA, 15 bp, Homo sapiens
agccactgggcccct

SEQ ID NO: 900866 - DNA, 20 bp, Homo sapiens
agccactgggcccctgtccc

SEQ ID NO: 900867 - DNA, 15 bp, Homo sapiens
agccacttctcccca

SEQ ID NO: 900868 - DNA, 13 bp, Homo sapiens
agccagaaagggt

SEQ ID NO: 900869 - DNA, 17 bp, Homo sapiens
agccagaaatgggcagt

SEQ ID NO: 900870 - DNA, 20 bp, Homo sapiens
agccagaaatgggcagttct

SEQ ID NO: 900871 - DNA, 16 bp, Homo sapiens
agccagacactctgct

SEQ ID NO: 900872 - DNA, 19 bp, Homo sapiens
agccagacctagcaggctg

SEQ ID NO: 900873 - DNA, 14 bp, Homo sapiens
agccagactctggt

SEQ ID NO: 900874 - DNA, 15 bp, Homo sapiens
agccagagagacaga

SEQ ID NO: 900875 - DNA, 13 bp, Homo sapiens
agccagagcccca

SEQ ID NO: 900876 - DNA, 20 bp, Homo sapiens
agccagagccccaagcagga

SEQ ID NO: 900877 - DNA, 15 bp, Homo sapiens
agccagagcctgggg

SEQ ID NO: 900878 - DNA, 13 bp, Homo sapiens
agccagagctggg

SEQ ID NO: 900879 - DNA, 16 bp, Homo sapiens
agccagagctgtgcct

SEQ ID NO: 900880 - DNA, 17 bp, Homo sapiens
agccagaggagggcaga

SEQ ID NO: 900881 - DNA, 19 bp, Homo sapiens
agccagagggtgggagcct

SEQ ID NO: 900882 - DNA, 22 bp, Homo sapiens
agccagagggtgggagcctaag

SEQ ID NO: 900883 - DNA, 18 bp, Homo sapiens
agccagatttgtcttttt

SEQ ID NO: 900884 - DNA, 23 bp, Homo sapiens
agccagattttttaaaatttata

SEQ ID NO: 900885 - DNA, 20 bp, Homo sapiens
agccagcacttgtccagctg

SEQ ID NO: 900886 - DNA, 21 bp, Homo sapiens
agccagcacttgtccagctga

SEQ ID NO: 900887 - DNA, 18 bp, Homo sapiens
agccagcagcagcccaag

SEQ ID NO: 900888 - DNA, 20 bp, Homo sapiens
agccagcagccagctctcag

SEQ ID NO: 900889 - DNA, 16 bp, Homo sapiens
agccagcagctgaagt

SEQ ID NO: 900890 - DNA, 19 bp, Homo sapiens
agccagcattcagcacaca

SEQ ID NO: 900891 - DNA, 24 bp, Homo sapiens
agccagccaagctttaaattatgt

SEQ ID NO: 900892 - DNA, 14 bp, Homo sapiens
agccagccacccct

SEQ ID NO: 900893 - DNA, 19 bp, Homo sapiens
agccagcccaaaccttggg

SEQ ID NO: 900894 - DNA, 17 bp, Homo sapiens
agccagcccagcccagc

SEQ ID NO: 900895 - DNA, 18 bp, Homo sapiens
agccagcccagcccagct

SEQ ID NO: 900896 - DNA, 23 bp, Homo sapiens
agccagcccatggcccccaataa

SEQ ID NO: 900897 - DNA, 17 bp, Homo sapiens
agccagccccctccagc

SEQ ID NO: 900898 - DNA, 20 bp, Homo sapiens
agccagccccctccagctca

SEQ ID NO: 900899 - DNA, 20 bp, Homo sapiens
agccagccctccctgtcctc

SEQ ID NO: 900900 - DNA, 18 bp, Homo sapiens
agccagccctggcccacc

SEQ ID NO: 900901 - DNA, 19 bp, Homo sapiens
agccagcccttccctggcc

SEQ ID NO: 900902 - DNA, 15 bp, Homo sapiens
agccagccgccctgg

SEQ ID NO: 900903 - DNA, 16 bp, Homo sapiens
agccagccgccctggg

SEQ ID NO: 900904 - DNA, 21 bp, Homo sapiens
agccagccgccctgggctgtc

SEQ ID NO: 900905 - DNA, 22 bp, Homo sapiens
agccagccgccctgggctgtct

SEQ ID NO: 900906 - DNA, 18 bp, Homo sapiens
agccagccggtgcctggc

SEQ ID NO: 900907 - DNA, 16 bp, Homo sapiens
agccagcctcagaagg

SEQ ID NO: 900908 - DNA, 18 bp, Homo sapiens
agccagcctgaccttcct

SEQ ID NO: 900909 - DNA, 12 bp, Homo sapiens
agccagcctggc

SEQ ID NO: 900910 - DNA, 13 bp, Homo sapiens
agccagcctggga

SEQ ID NO: 900911 - DNA, 16 bp, Homo sapiens
agccagcctgggactc

SEQ ID NO: 900912 - DNA, 20 bp, Homo sapiens
agccagcctgggactcccag

SEQ ID NO: 900913 - DNA, 15 bp, Homo sapiens
agccagccttcccca

SEQ ID NO: 900914 - DNA, 19 bp, Homo sapiens
agccagcgcctccctccac

SEQ ID NO: 900915 - DNA, 21 bp, Homo sapiens
agccagcgcctccctccaccc

SEQ ID NO: 900916 - DNA, 22 bp, Homo sapiens
agccagcgcctccctccacccc

SEQ ID NO: 900917 - DNA, 18 bp, Homo sapiens
agccagcgtcctcctctg

SEQ ID NO: 900918 - DNA, 21 bp, Homo sapiens
agccagctcacagtgctgtgt

SEQ ID NO: 900919 - DNA, 15 bp, Homo sapiens
agccagctccctcta

SEQ ID NO: 900920 - DNA, 17 bp, Homo sapiens
agccagctccctctatt

SEQ ID NO: 900921 - DNA, 19 bp, Homo sapiens
agccagctccctctattta

SEQ ID NO: 900922 - DNA, 22 bp, Homo sapiens
agccagctccctctatttatgt

SEQ ID NO: 900923 - DNA, 13 bp, Homo sapiens
agccagctctcag

SEQ ID NO: 900924 - DNA, 16 bp, Homo sapiens
agccagctctgcatta

SEQ ID NO: 900925 - DNA, 17 bp, Homo sapiens
agccagctgcagggcac

SEQ ID NO: 900926 - DNA, 20 bp, Homo sapiens
agccagctgccgaccagagc

SEQ ID NO: 900927 - DNA, 22 bp, Homo sapiens
agccaggacccgcctgctccca

SEQ ID NO: 900928 - DNA, 15 bp, Homo sapiens
agccaggagaagctc

SEQ ID NO: 900929 - DNA, 13 bp, Homo sapiens
agccaggagcaaa

SEQ ID NO: 900930 - DNA, 23 bp, Homo sapiens
agccaggagcaaatgtttctgca

SEQ ID NO: 900931 - DNA, 12 bp, Homo sapiens
agccaggagcag

SEQ ID NO: 900932 - DNA, 13 bp, Homo sapiens
agccaggagcaga

SEQ ID NO: 900933 - DNA, 16 bp, Homo sapiens
agccaggaggcctgct

SEQ ID NO: 900934 - DNA, 19 bp, Homo sapiens
agccaggatgcccagatga

SEQ ID NO: 900935 - DNA, 18 bp, Homo sapiens
agccaggccaacagcacc

SEQ ID NO: 900936 - DNA, 10 bp, Homo sapiens
agccaggccc

SEQ ID NO: 900937 - DNA, 11 bp, Homo sapiens
agccaggccca

SEQ ID NO: 900938 - DNA, 17 bp, Homo sapiens
agccaggcccaggccag

SEQ ID NO: 900939 - DNA, 20 bp, Homo sapiens
agccaggcccaggccagccc

SEQ ID NO: 900940 - DNA, 12 bp, Homo sapiens
agccaggcctgg

SEQ ID NO: 900941 - DNA, 15 bp, Homo sapiens
agccaggcgggctca

SEQ ID NO: 900942 - DNA, 18 bp, Homo sapiens
agccaggcgggctcaagg

SEQ ID NO: 900943 - DNA, 21 bp, Homo sapiens
agccaggctatggttgccacc

SEQ ID NO: 900944 - DNA, 20 bp, Homo sapiens
agccaggctctccgggcctt

SEQ ID NO: 900945 - DNA, 22 bp, Homo sapiens
agccaggctgggccgcaagggc

SEQ ID NO: 900946 - DNA, 18 bp, Homo sapiens
agccaggcttggatggaa

SEQ ID NO: 900947 - DNA, 17 bp, Homo sapiens
agccagggcagaggaat

SEQ ID NO: 900948 - DNA, 12 bp, Homo sapiens
agccagggccag

SEQ ID NO: 900949 - DNA, 22 bp, Homo sapiens
agcccccaccttgatcccaatc

SEQ ID NO: 900950 - DNA, 19 bp, Homo sapiens
agcccccagatagagctgg

SEQ ID NO: 900951 - DNA, 17 bp, Homo sapiens
agcccccagccctggga

SEQ ID NO: 900952 - DNA, 12 bp, Homo sapiens
agcccccagcct

SEQ ID NO: 900953 - DNA, 18 bp, Homo sapiens
agcccccagccttgtttc

SEQ ID NO: 900954 - DNA, 13 bp, Homo sapiens
agcccccaggatc

SEQ ID NO: 900955 - DNA, 11 bp, Homo sapiens
agcccccaggc

SEQ ID NO: 900956 - DNA, 17 bp, Homo sapiens
agcccccaggctgctgg

SEQ ID NO: 900957 - DNA, 20 bp, Homo sapiens
agcccccccaacactgtgcc

SEQ ID NO: 900958 - DNA, 13 bp, Homo sapiens
agcccccccaccc

SEQ ID NO: 900959 - DNA, 21 bp, Homo sapiens
agcccccccacccacccccag

SEQ ID NO: 900960 - DNA, 22 bp, Homo sapiens
agccccccccttgaatctgcag

SEQ ID NO: 900961 - DNA, 13 bp, Homo sapiens
agcccccccttcc

SEQ ID NO: 900962 - DNA, 14 bp, Homo sapiens
agcccccctttggc

SEQ ID NO: 900963 - DNA, 23 bp, Homo sapiens
agcccccgccccgccccacattc

SEQ ID NO: 900964 - DNA, 20 bp, Homo sapiens
agcccccgggccgctggctg

SEQ ID NO: 900965 - DNA, 17 bp, Homo sapiens
agccccctccacaccag

SEQ ID NO: 900966 - DNA, 16 bp, Homo sapiens
agccccctccagctca

SEQ ID NO: 900967 - DNA, 14 bp, Homo sapiens
agccccctcttcct

SEQ ID NO: 900968 - DNA, 15 bp, Homo sapiens
agccccctcttcctc

SEQ ID NO: 900969 - DNA, 16 bp, Homo sapiens
agccccctcttcctcc

SEQ ID NO: 900970 - DNA, 19 bp, Homo sapiens
agccccctggatgtcccct

SEQ ID NO: 900971 - DNA, 14 bp, Homo sapiens
agccccctggcagc

SEQ ID NO: 900972 - DNA, 15 bp, Homo sapiens
agccccctggcagct

SEQ ID NO: 900973 - DNA, 19 bp, Homo sapiens
agccccctggcagctgccc

SEQ ID NO: 900974 - DNA, 16 bp, Homo sapiens
agcccccttctccatg

SEQ ID NO: 900975 - DNA, 14 bp, Homo sapiens
agccccgactccag

SEQ ID NO: 900976 - DNA, 20 bp, Homo sapiens
agccccgactccagccagcg

SEQ ID NO: 900977 - DNA, 21 bp, Homo sapiens
agccccgactccagccagcgc

SEQ ID NO: 900978 - DNA, 15 bp, Homo sapiens
agccccgacttcctg

SEQ ID NO: 900979 - DNA, 19 bp, Homo sapiens
agccccgccccagccctca

SEQ ID NO: 900980 - DNA, 15 bp, Homo sapiens
agccccgccctcttc

SEQ ID NO: 900981 - DNA, 19 bp, Homo sapiens
agccccgccctcttcctga

SEQ ID NO: 900982 - DNA, 20 bp, Homo sapiens
agccccgcctgtcacaataa

SEQ ID NO: 900983 - DNA, 15 bp, Homo sapiens
agccccgcgcctcct

SEQ ID NO: 900984 - DNA, 18 bp, Homo sapiens
agccccgcgcctccttcc

SEQ ID NO: 900985 - DNA, 15 bp, Homo sapiens
agccccggcaagcca

SEQ ID NO: 900986 - DNA, 22 bp, Homo sapiens
agccccggcaagccacaggaag

SEQ ID NO: 900987 - DNA, 16 bp, Homo sapiens
agccccgttttgggga

SEQ ID NO: 900988 - DNA, 12 bp, Homo sapiens
agcccctacccc

SEQ ID NO: 900989 - DNA, 17 bp, Homo sapiens
agcccctaccccacacc

SEQ ID NO: 900990 - DNA, 21 bp, Homo sapiens
agcccctaccccacaccaggc

SEQ ID NO: 900991 - DNA, 14 bp, Homo sapiens
agcccctacccctg

SEQ ID NO: 900992 - DNA, 16 bp, Homo sapiens
agcccctacccctgcc

SEQ ID NO: 900993 - DNA, 17 bp, Homo sapiens
agcccctacccctgccc

SEQ ID NO: 900994 - DNA, 19 bp, Homo sapiens
agcccctacccctgccctg

SEQ ID NO: 900995 - DNA, 20 bp, Homo sapiens
agcccctacccctgccctgc

SEQ ID NO: 900996 - DNA, 17 bp, Homo sapiens
agcccctactgctgtga

SEQ ID NO: 900997 - DNA, 18 bp, Homo sapiens
agcccctagaaacccaag

SEQ ID NO: 900998 - DNA, 18 bp, Homo sapiens
agcccctatagcactgag

SEQ ID NO: 900999 - DNA, 16 bp, Homo sapiens
agcccctcagcccttg

SEQ ID NO: 901000 - DNA, 21 bp, Homo sapiens
agcccctcagcccttgccccc

SEQ ID NO: 901001 - DNA, 13 bp, Homo sapiens
agcccctcccacc

SEQ ID NO: 901002 - DNA, 17 bp, Homo sapiens
agcccctcccaccacag

SEQ ID NO: 901003 - DNA, 23 bp, Homo sapiens
agcccctcccaccacagcaggtg

SEQ ID NO: 901004 - DNA, 12 bp, Homo sapiens
agcccctcccca

SEQ ID NO: 901005 - DNA, 14 bp, Homo sapiens
agcccctccccagc

SEQ ID NO: 901006 - DNA, 20 bp, Homo sapiens
agcccctcctccagcccctg

SEQ ID NO: 901007 - DNA, 21 bp, Homo sapiens
agcccctcctccagcccctgt

SEQ ID NO: 901008 - DNA, 14 bp, Homo sapiens
agcccctcctcccc

SEQ ID NO: 901009 - DNA, 14 bp, Homo sapiens
agcccctcctctgc

SEQ ID NO: 901010 - DNA, 15 bp, Homo sapiens
agcccctcctctgcc

SEQ ID NO: 901011 - DNA, 19 bp, Homo sapiens
agcccctcctctgccacct

SEQ ID NO: 901012 - DNA, 14 bp, Homo sapiens
agcccctcggctct

SEQ ID NO: 901013 - DNA, 15 bp, Homo sapiens
agcccctctcccctc

SEQ ID NO: 901014 - DNA, 16 bp, Homo sapiens
agcccctctcccctct

SEQ ID NO: 901015 - DNA, 23 bp, Homo sapiens
agcccctctcccctctctgctcc

SEQ ID NO: 901016 - DNA, 12 bp, Homo sapiens
agcccctctctc

SEQ ID NO: 901017 - DNA, 13 bp, Homo sapiens
agcccctctggat

SEQ ID NO: 901018 - DNA, 20 bp, Homo sapiens
agcccctctggattcccttt

SEQ ID NO: 901019 - DNA, 21 bp, Homo sapiens
agcccctctggattccctttt

SEQ ID NO: 901020 - DNA, 16 bp, Homo sapiens
agcccctctggtcgct

SEQ ID NO: 901021 - DNA, 17 bp, Homo sapiens
agcccctcttccccaat

SEQ ID NO: 901022 - DNA, 17 bp, Homo sapiens
agcccctcttcccttcc

SEQ ID NO: 901023 - DNA, 18 bp, Homo sapiens
agcccctcttcccttcct

SEQ ID NO: 901024 - DNA, 22 bp, Homo sapiens
agcccctcttcccttcctccat

SEQ ID NO: 901025 - DNA, 18 bp, Homo sapiens
agcccctcttggagaagt

SEQ ID NO: 901026 - DNA, 16 bp, Homo sapiens
agcccctgaaagccat

SEQ ID NO: 901027 - DNA, 11 bp, Homo sapiens
agcccctgagt

SEQ ID NO: 901028 - DNA, 19 bp, Homo sapiens
agcccctgagtccgcctgc

SEQ ID NO: 901029 - DNA, 20 bp, Homo sapiens
agcccctgatctctgacctc

SEQ ID NO: 901030 - DNA, 22 bp, Homo sapiens
agcccctgatctctgacctctg

SEQ ID NO: 901031 - DNA, 12 bp, Homo sapiens
agcccctgcccc

SEQ ID NO: 901032 - DNA, 19 bp, Homo sapiens
agcccctgccctggggaga

SEQ ID NO: 901033 - DNA, 22 bp, Homo sapiens
agcccctgccctggggagaaag

SEQ ID NO: 901034 - DNA, 15 bp, Homo sapiens
agcccctggacccct

SEQ ID NO: 901035 - DNA, 21 bp, Homo sapiens
agcccctggacccctggggtg

SEQ ID NO: 901036 - DNA, 12 bp, Homo sapiens
agcccctgggaa

SEQ ID NO: 901037 - DNA, 19 bp, Homo sapiens
agcccctgggaacaggccc

SEQ ID NO: 901038 - DNA, 21 bp, Homo sapiens
agcccctgggaacaggcccca

SEQ ID NO: 901039 - DNA, 16 bp, Homo sapiens
agcccctggggcccag

SEQ ID NO: 901040 - DNA, 22 bp, Homo sapiens
agcccctggggtggccaccagt

SEQ ID NO: 901041 - DNA, 12 bp, Homo sapiens
agcccctgggtg

SEQ ID NO: 901042 - DNA, 17 bp, Homo sapiens
agcccctggtcttctct

SEQ ID NO: 901043 - DNA, 20 bp, Homo sapiens
agcccctgtctagagaggga

SEQ ID NO: 901044 - DNA, 16 bp, Homo sapiens
agcccctgtgaccctc

SEQ ID NO: 901045 - DNA, 14 bp, Homo sapiens
agccccttctccca

SEQ ID NO: 901046 - DNA, 22 bp, Homo sapiens
agccccttctgctcagctctgg

SEQ ID NO: 901047 - DNA, 17 bp, Homo sapiens
agccccttgagaaacct

SEQ ID NO: 901048 - DNA, 23 bp, Homo sapiens
agccccttgctctcccctgccct

SEQ ID NO: 901049 - DNA, 21 bp, Homo sapiens
agcccctttgcctctgtcctc

SEQ ID NO: 901050 - DNA, 20 bp, Homo sapiens
agccccttttctctgctctt

SEQ ID NO: 901051 - DNA, 22 bp, Homo sapiens
agcccctttttcatatgttgct

SEQ ID NO: 901052 - DNA, 15 bp, Homo sapiens
agcccgacagtgcca

SEQ ID NO: 901053 - DNA, 21 bp, Homo sapiens
agcccgacagtgccatcccca

SEQ ID NO: 901054 - DNA, 15 bp, Homo sapiens
agcccgcacccccac

SEQ ID NO: 901055 - DNA, 21 bp, Homo sapiens
agcccgcacccccaccctttg

SEQ ID NO: 901056 - DNA, 19 bp, Homo sapiens
agcccgccaaggtagccat

SEQ ID NO: 901057 - DNA, 19 bp, Homo sapiens
agcccgccgtctgcagggg

SEQ ID NO: 901058 - DNA, 15 bp, Homo sapiens
agcccgcggggacat

SEQ ID NO: 901059 - DNA, 20 bp, Homo sapiens
agcccgcggggacattggga

SEQ ID NO: 901060 - DNA, 23 bp, Homo sapiens
agcccgctaggctcgccttccct

SEQ ID NO: 901061 - DNA, 16 bp, Homo sapiens
agcccgctctctggct

SEQ ID NO: 901062 - DNA, 21 bp, Homo sapiens
agcccgcttcaagctctctgt

SEQ ID NO: 901063 - DNA, 16 bp, Homo sapiens
agcccggccccacctc

SEQ ID NO: 901064 - DNA, 21 bp, Homo sapiens
agcccggccccacctccctgc

SEQ ID NO: 901065 - DNA, 16 bp, Homo sapiens
agcccggcgcccctgc

SEQ ID NO: 901066 - DNA, 18 bp, Homo sapiens
agcccggcgcccctgcca

SEQ ID NO: 901067 - DNA, 22 bp, Homo sapiens
agcccggcgcccctgccacctc

SEQ ID NO: 901068 - DNA, 15 bp, Homo sapiens
agcccggctgctgct

SEQ ID NO: 901069 - DNA, 14 bp, Homo sapiens
agcccgggagccta

SEQ ID NO: 901070 - DNA, 15 bp, Homo sapiens
agcccgggagcctag

SEQ ID NO: 901071 - DNA, 19 bp, Homo sapiens
ccatcactggtccaggtct

SEQ ID NO: 901072 - DNA, 17 bp, Homo sapiens
ccatcacttctccccgc

SEQ ID NO: 901073 - DNA, 18 bp, Homo sapiens
ccatcagaacctgagcta

SEQ ID NO: 901074 - DNA, 13 bp, Homo sapiens
ccatcagatattt

SEQ ID NO: 901075 - DNA, 13 bp, Homo sapiens
ccatcagcccctg

SEQ ID NO: 901076 - DNA, 14 bp, Homo sapiens
ccatcagcccctgg

SEQ ID NO: 901077 - DNA, 16 bp, Homo sapiens
ccatcagcccctggga

SEQ ID NO: 901078 - DNA, 22 bp, Homo sapiens
ccatcagcgggtctcctcccag

SEQ ID NO: 901079 - DNA, 13 bp, Homo sapiens
ccatcagctccca

SEQ ID NO: 901080 - DNA, 14 bp, Homo sapiens
ccatcagctcccaa

SEQ ID NO: 901081 - DNA, 12 bp, Homo sapiens
ccatcaggcagt

SEQ ID NO: 901082 - DNA, 12 bp, Homo sapiens
ccatcagggccc

SEQ ID NO: 901083 - DNA, 24 bp, Homo sapiens
ccatcagggtgggccactctcccc

SEQ ID NO: 901084 - DNA, 17 bp, Homo sapiens
ccatcaggttccatccc

SEQ ID NO: 901085 - DNA, 16 bp, Homo sapiens
ccatcagttcccccag

SEQ ID NO: 901086 - DNA, 18 bp, Homo sapiens
ccatcatatgcctgaccc

SEQ ID NO: 901087 - DNA, 18 bp, Homo sapiens
ccatcatcactgtaaaga

SEQ ID NO: 901088 - DNA, 16 bp, Homo sapiens
ccatcatcccagctgc

SEQ ID NO: 901089 - DNA, 13 bp, Homo sapiens
ccatcatgccttg

SEQ ID NO: 901090 - DNA, 15 bp, Homo sapiens
ccatcatgccttgat

SEQ ID NO: 901091 - DNA, 23 bp, Homo sapiens
ccatcatgcggtgggtgctgcca

SEQ ID NO: 901092 - DNA, 13 bp, Homo sapiens
ccatcatgtctgt

SEQ ID NO: 901093 - DNA, 15 bp, Homo sapiens
ccatccaaggccagg

SEQ ID NO: 901094 - DNA, 17 bp, Homo sapiens
ccatccacatgggagcc

SEQ ID NO: 901095 - DNA, 17 bp, Homo sapiens
ccatccacctttcccaa

SEQ ID NO: 901096 - DNA, 22 bp, Homo sapiens
ccatccagaggaataaaaaggt

SEQ ID NO: 901097 - DNA, 17 bp, Homo sapiens
ccatccagccacggagg

SEQ ID NO: 901098 - DNA, 23 bp, Homo sapiens
ccatccagccacggagggaggca

SEQ ID NO: 901099 - DNA, 14 bp, Homo sapiens
ccatccagccagac

SEQ ID NO: 901100 - DNA, 12 bp, Homo sapiens
ccatccaggcag

SEQ ID NO: 901101 - DNA, 13 bp, Homo sapiens
ccatccaggcagt

SEQ ID NO: 901102 - DNA, 16 bp, Homo sapiens
ccatccagggtctggc

SEQ ID NO: 901103 - DNA, 19 bp, Homo sapiens
ccatccagggtctggcaga

SEQ ID NO: 901104 - DNA, 20 bp, Homo sapiens
ccatccagggtctggcagag

SEQ ID NO: 901105 - DNA, 23 bp, Homo sapiens
ccatccagggtctggcagagcct

SEQ ID NO: 901106 - DNA, 15 bp, Homo sapiens
ccatccatccctaga

SEQ ID NO: 901107 - DNA, 14 bp, Homo sapiens
ccatccatctccag

SEQ ID NO: 901108 - DNA, 14 bp, Homo sapiens
ccatcccacaccct

SEQ ID NO: 901109 - DNA, 17 bp, Homo sapiens
ccatcccactgctcccc

SEQ ID NO: 901110 - DNA, 17 bp, Homo sapiens
ccatcccagggtcccac

SEQ ID NO: 901111 - DNA, 19 bp, Homo sapiens
ccatcccatgaacacactg

SEQ ID NO: 901112 - DNA, 22 bp, Homo sapiens
ccatcccattttcatcctgagc

SEQ ID NO: 901113 - DNA, 14 bp, Homo sapiens
ccatccccaccact

SEQ ID NO: 901114 - DNA, 13 bp, Homo sapiens
ccatccccaccag

SEQ ID NO: 901115 - DNA, 16 bp, Homo sapiens
ccatccccaccagctc

SEQ ID NO: 901116 - DNA, 15 bp, Homo sapiens
ccatccccagctggt

SEQ ID NO: 901117 - DNA, 12 bp, Homo sapiens
ccatccccaggt

SEQ ID NO: 901118 - DNA, 14 bp, Homo sapiens
ccatccccatcggc

SEQ ID NO: 901119 - DNA, 18 bp, Homo sapiens
ccatccccatcggccctg

SEQ ID NO: 901120 - DNA, 20 bp, Homo sapiens
ccatccccctctcacgccac

SEQ ID NO: 901121 - DNA, 15 bp, Homo sapiens
ccatccccctgccct

SEQ ID NO: 901122 - DNA, 14 bp, Homo sapiens
ccatcccccttctt

SEQ ID NO: 901123 - DNA, 14 bp, Homo sapiens
ccatccccgcagtg

SEQ ID NO: 901124 - DNA, 17 bp, Homo sapiens
ccatccccgcagtgtgc

SEQ ID NO: 901125 - DNA, 17 bp, Homo sapiens
ccatcccctatggacca

SEQ ID NO: 901126 - DNA, 12 bp, Homo sapiens
ccatcccctcaa

SEQ ID NO: 901127 - DNA, 21 bp, Homo sapiens
ccatcccctcaacaccctgct

SEQ ID NO: 901128 - DNA, 15 bp, Homo sapiens
ccatcccctccctgc

SEQ ID NO: 901129 - DNA, 17 bp, Homo sapiens
ccatcccctccctgcct

SEQ ID NO: 901130 - DNA, 21 bp, Homo sapiens
ccatcccctccctgcctgctc

SEQ ID NO: 901131 - DNA, 18 bp, Homo sapiens
ccatcccctcctagcaca

SEQ ID NO: 901132 - DNA, 13 bp, Homo sapiens
ccatcccctggac

SEQ ID NO: 901133 - DNA, 22 bp, Homo sapiens
ccatccccttcccccatcccta

SEQ ID NO: 901134 - DNA, 20 bp, Homo sapiens
ccatcccctttcctccccac

SEQ ID NO: 901135 - DNA, 20 bp, Homo sapiens
ccatcccgaagccatcactt

SEQ ID NO: 901136 - DNA, 16 bp, Homo sapiens
ccatcccgcttagcct

SEQ ID NO: 901137 - DNA, 18 bp, Homo sapiens
ccatcccgcttagcctgc

SEQ ID NO: 901138 - DNA, 21 bp, Homo sapiens
ccatcccgcttagcctgcctc

SEQ ID NO: 901139 - DNA, 21 bp, Homo sapiens
ccatccctagaagagcacaga

SEQ ID NO: 901140 - DNA, 22 bp, Homo sapiens
ccatccctagaagagcacagag

SEQ ID NO: 901141 - DNA, 15 bp, Homo sapiens
ccatccctgctctgg

SEQ ID NO: 901142 - DNA, 14 bp, Homo sapiens
ccatccctgggccc

SEQ ID NO: 901143 - DNA, 20 bp, Homo sapiens
ccatccctgggcccctccac

SEQ ID NO: 901144 - DNA, 13 bp, Homo sapiens
ccatccctgtcat

SEQ ID NO: 901145 - DNA, 13 bp, Homo sapiens
ccatcccttcctg

SEQ ID NO: 901146 - DNA, 16 bp, Homo sapiens
ccatcccttcggagcc

SEQ ID NO: 901147 - DNA, 20 bp, Homo sapiens
ccatcccttcggagccaaca

SEQ ID NO: 901148 - DNA, 12 bp, Homo sapiens
ccatcccttggg

SEQ ID NO: 901149 - DNA, 19 bp, Homo sapiens
ccatcccttttcctttctg

SEQ ID NO: 901150 - DNA, 20 bp, Homo sapiens
ccatcccttttcctttctgg

SEQ ID NO: 901151 - DNA, 23 bp, Homo sapiens
ccatcccttttcctttctggccc

SEQ ID NO: 901152 - DNA, 16 bp, Homo sapiens
ccatccgactgcccct

SEQ ID NO: 901153 - DNA, 21 bp, Homo sapiens
ccatccgactgcccctgctgt

SEQ ID NO: 901154 - DNA, 23 bp, Homo sapiens
ccatccgactgcccctgctgtgc

SEQ ID NO: 901155 - DNA, 22 bp, Homo sapiens
ccatccgcagactgcttggcca

SEQ ID NO: 901156 - DNA, 15 bp, Homo sapiens
ccatcctaaaagcca

SEQ ID NO: 901157 - DNA, 12 bp, Homo sapiens
ccatcctaccct

SEQ ID NO: 901158 - DNA, 16 bp, Homo sapiens
ccatcctaccctcggg

SEQ ID NO: 901159 - DNA, 22 bp, Homo sapiens
ccatcctaccctcgggcccacc

SEQ ID NO: 901160 - DNA, 12 bp, Homo sapiens
ccatcctcagag

SEQ ID NO: 901161 - DNA, 16 bp, Homo sapiens
ccatcctcagaggctg

SEQ ID NO: 901162 - DNA, 13 bp, Homo sapiens
ccatcctccagcc

SEQ ID NO: 901163 - DNA, 14 bp, Homo sapiens
ccatcctccagctt

SEQ ID NO: 901164 - DNA, 15 bp, Homo sapiens
ccatcctccagcttc

SEQ ID NO: 901165 - DNA, 17 bp, Homo sapiens
ccatcctccagcttctg

SEQ ID NO: 901166 - DNA, 21 bp, Homo sapiens
ccatcctccccttccctgcaa

SEQ ID NO: 901167 - DNA, 12 bp, Homo sapiens
ccatcctgacca

SEQ ID NO: 901168 - DNA, 12 bp, Homo sapiens
ccatcctgactg

SEQ ID NO: 901169 - DNA, 13 bp, Homo sapiens
ccatcctgatccc

SEQ ID NO: 901170 - DNA, 17 bp, Homo sapiens
ccatcctgatcccagac

SEQ ID NO: 901171 - DNA, 21 bp, Homo sapiens
ccatcctgatggacctgcccc

SEQ ID NO: 901172 - DNA, 11 bp, Homo sapiens
ccatcctgcaa

SEQ ID NO: 901173 - DNA, 16 bp, Homo sapiens
ccatcctgcaaaggcc

SEQ ID NO: 901174 - DNA, 16 bp, Homo sapiens
ccatcctgcagcctcc

SEQ ID NO: 901175 - DNA, 16 bp, Homo sapiens
ccatcctggcccctcc

SEQ ID NO: 901176 - DNA, 13 bp, Homo sapiens
ccatcctggctgc

SEQ ID NO: 901177 - DNA, 15 bp, Homo sapiens
ccatcctggggcagc

SEQ ID NO: 901178 - DNA, 16 bp, Homo sapiens
ccatcctggggcagca

SEQ ID NO: 901179 - DNA, 21 bp, Homo sapiens
ccatcctggggcagcactccc

SEQ ID NO: 901180 - DNA, 17 bp, Homo sapiens
ccatcgccatcttcttc

SEQ ID NO: 901181 - DNA, 19 bp, Homo sapiens
ccatcgccccaccgcagct

SEQ ID NO: 901182 - DNA, 16 bp, Homo sapiens
ccatcgctgtgtgtta

SEQ ID NO: 901183 - DNA, 20 bp, Homo sapiens
ccatcgctgtgtgttagttc

SEQ ID NO: 901184 - DNA, 20 bp, Homo sapiens
ccatcggccctgtcccctgg

SEQ ID NO: 901185 - DNA, 22 bp, Homo sapiens
ccatcggtgtccatttatagaa

SEQ ID NO: 901186 - DNA, 15 bp, Homo sapiens
ccatcgtccagccct

SEQ ID NO: 901187 - DNA, 14 bp, Homo sapiens
ccatcgtcctggga

SEQ ID NO: 901188 - DNA, 22 bp, Homo sapiens
ccatcgtctcatcctcctttca

SEQ ID NO: 901189 - DNA, 23 bp, Homo sapiens
ccatcgtgtgtgccttgggtctc

SEQ ID NO: 901190 - DNA, 19 bp, Homo sapiens
ccatctaatgcttgtttat

SEQ ID NO: 901191 - DNA, 17 bp, Homo sapiens
ccatctagtacttgaaa

SEQ ID NO: 901192 - DNA, 12 bp, Homo sapiens
ccatctcagcct

SEQ ID NO: 901193 - DNA, 15 bp, Homo sapiens
ccatctcagcctcct

SEQ ID NO: 901194 - DNA, 21 bp, Homo sapiens
ccattcttcagtgtctctgtt

SEQ ID NO: 901195 - DNA, 12 bp, Homo sapiens
ccattcttcccg

SEQ ID NO: 901196 - DNA, 14 bp, Homo sapiens
ccattcttcttgct

SEQ ID NO: 901197 - DNA, 21 bp, Homo sapiens
ccattctttataatcctctgt

SEQ ID NO: 901198 - DNA, 16 bp, Homo sapiens
ccattgaacagctgtg

SEQ ID NO: 901199 - DNA, 19 bp, Homo sapiens
ccattgaacagctgtgagc

SEQ ID NO: 901200 - DNA, 22 bp, Homo sapiens
ccattgaattcttggttgagga

SEQ ID NO: 901201 - DNA, 16 bp, Homo sapiens
ccattgacctcagctg

SEQ ID NO: 901202 - DNA, 14 bp, Homo sapiens
ccattgagtccctg

SEQ ID NO: 901203 - DNA, 17 bp, Homo sapiens
ccattgccaccaggaga

SEQ ID NO: 901204 - DNA, 13 bp, Homo sapiens
ccattgccaggag

SEQ ID NO: 901205 - DNA, 14 bp, Homo sapiens
ccattgccaggaga

SEQ ID NO: 901206 - DNA, 16 bp, Homo sapiens
ccattgccccagacct

SEQ ID NO: 901207 - DNA, 17 bp, Homo sapiens
ccattgcctagctcttt

SEQ ID NO: 901208 - DNA, 22 bp, Homo sapiens
ccattgctcttagtcccaagct

SEQ ID NO: 901209 - DNA, 21 bp, Homo sapiens
ccattggacagatttcagtaa

SEQ ID NO: 901210 - DNA, 19 bp, Homo sapiens
ccattggagcacctgggcc

SEQ ID NO: 901211 - DNA, 16 bp, Homo sapiens
ccattggatctgcaag

SEQ ID NO: 901212 - DNA, 18 bp, Homo sapiens
ccattggccgagctcctg

SEQ ID NO: 901213 - DNA, 13 bp, Homo sapiens
ccattggcctctt

SEQ ID NO: 901214 - DNA, 16 bp, Homo sapiens
ccattggtccaccctt

SEQ ID NO: 901215 - DNA, 16 bp, Homo sapiens
ccattggttggaagct

SEQ ID NO: 901216 - DNA, 19 bp, Homo sapiens
ccattgtaaatctgaagaa

SEQ ID NO: 901217 - DNA, 21 bp, Homo sapiens
ccattgtaactattaaccttt

SEQ ID NO: 901218 - DNA, 20 bp, Homo sapiens
ccattgtactccagcctggg

SEQ ID NO: 901219 - DNA, 15 bp, Homo sapiens
ccattgtccctctgc

SEQ ID NO: 901220 - DNA, 17 bp, Homo sapiens
ccattgtccctctgccc

SEQ ID NO: 901221 - DNA, 19 bp, Homo sapiens
ccattgtccctctgcccca

SEQ ID NO: 901222 - DNA, 12 bp, Homo sapiens
ccattgtcctcc

SEQ ID NO: 901223 - DNA, 15 bp, Homo sapiens
ccattgtcctccttt

SEQ ID NO: 901224 - DNA, 17 bp, Homo sapiens
ccattgtcctccttttc

SEQ ID NO: 901225 - DNA, 20 bp, Homo sapiens
ccattgtgtgatccagccct

SEQ ID NO: 901226 - DNA, 16 bp, Homo sapiens
ccattgtgtggcctgg

SEQ ID NO: 901227 - DNA, 24 bp, Homo sapiens
ccattgttcccttcctcttcctgc

SEQ ID NO: 901228 - DNA, 17 bp, Homo sapiens
ccattgttgtcaaatgc

SEQ ID NO: 901229 - DNA, 18 bp, Homo sapiens
ccattgttgtcaaggaag

SEQ ID NO: 901230 - DNA, 22 bp, Homo sapiens
ccattgtttgaaacaaagaagg

SEQ ID NO: 901231 - DNA, 20 bp, Homo sapiens
ccatttaagtatcttgtgct

SEQ ID NO: 901232 - DNA, 22 bp, Homo sapiens
ccatttagcactatttaaaata

SEQ ID NO: 901233 - DNA, 19 bp, Homo sapiens
ccatttagttctttgttat

SEQ ID NO: 901234 - DNA, 20 bp, Homo sapiens
ccatttataaccccagcctg

SEQ ID NO: 901235 - DNA, 20 bp, Homo sapiens
ccatttattgtttgaaatgt

SEQ ID NO: 901236 - DNA, 13 bp, Homo sapiens
ccatttcagagag

SEQ ID NO: 901237 - DNA, 19 bp, Homo sapiens
ccatttcaggaatttaaaa

SEQ ID NO: 901238 - DNA, 20 bp, Homo sapiens
ccatttcaggaatttaaaat

SEQ ID NO: 901239 - DNA, 17 bp, Homo sapiens
ccatttcagtggcttcc

SEQ ID NO: 901240 - DNA, 17 bp, Homo sapiens
ccatttcatctatttct

SEQ ID NO: 901241 - DNA, 15 bp, Homo sapiens
ccatttcatgtccat

SEQ ID NO: 901242 - DNA, 15 bp, Homo sapiens
ccatttcccacatct

SEQ ID NO: 901243 - DNA, 18 bp, Homo sapiens
ccatttcccacatctttc

SEQ ID NO: 901244 - DNA, 14 bp, Homo sapiens
ccatttcccatctg

SEQ ID NO: 901245 - DNA, 16 bp, Homo sapiens
ccatttccccctcctc

SEQ ID NO: 901246 - DNA, 22 bp, Homo sapiens
ccatttcccttctggacactga

SEQ ID NO: 901247 - DNA, 12 bp, Homo sapiens
ccatttcctgta

SEQ ID NO: 901248 - DNA, 13 bp, Homo sapiens
ccatttcctgtac

SEQ ID NO: 901249 - DNA, 12 bp, Homo sapiens
ccatttctattt

SEQ ID NO: 901250 - DNA, 19 bp, Homo sapiens
ccatttctcaatcagtgca

SEQ ID NO: 901251 - DNA, 17 bp, Homo sapiens
ccatttctctacactaa

SEQ ID NO: 901252 - DNA, 13 bp, Homo sapiens
ccatttctgcctc

SEQ ID NO: 901253 - DNA, 15 bp, Homo sapiens
ccatttctgtggagg

SEQ ID NO: 901254 - DNA, 14 bp, Homo sapiens
ccatttctgttgct

SEQ ID NO: 901255 - DNA, 16 bp, Homo sapiens
ccatttctgttgctgg

SEQ ID NO: 901256 - DNA, 16 bp, Homo sapiens
ccatttcttgctagct

SEQ ID NO: 901257 - DNA, 22 bp, Homo sapiens
ccatttcttggcattggaattc

SEQ ID NO: 901258 - DNA, 16 bp, Homo sapiens
ccatttctttcttcca

SEQ ID NO: 901259 - DNA, 12 bp, Homo sapiens
ccatttctttta

SEQ ID NO: 901260 - DNA, 19 bp, Homo sapiens
ccatttgcaataacagctg

SEQ ID NO: 901261 - DNA, 22 bp, Homo sapiens
ccatttgcaataacagctgcaa

SEQ ID NO: 901262 - DNA, 12 bp, Homo sapiens
ccatttgcattt

SEQ ID NO: 901263 - DNA, 15 bp, Homo sapiens
ccatttgcatttgtt

SEQ ID NO: 901264 - DNA, 22 bp, Homo sapiens
ccatttgcatttgtttatgtaa

SEQ ID NO: 901265 - DNA, 20 bp, Homo sapiens
ccatttgctagttctgctgc

SEQ ID NO: 901266 - DNA, 21 bp, Homo sapiens
ccatttggtgtggattttcta

SEQ ID NO: 901267 - DNA, 12 bp, Homo sapiens
ccatttgtaata

SEQ ID NO: 901268 - DNA, 16 bp, Homo sapiens
ccatttgtattaccat

SEQ ID NO: 901269 - DNA, 14 bp, Homo sapiens
ccatttgtcccaga

SEQ ID NO: 901270 - DNA, 14 bp, Homo sapiens
ccatttgtgtgtgt

SEQ ID NO: 901271 - DNA, 15 bp, Homo sapiens
ccatttgttaatatc

SEQ ID NO: 901272 - DNA, 14 bp, Homo sapiens
ccatttgttcctgc

SEQ ID NO: 901273 - DNA, 20 bp, Homo sapiens
ccatttgttcctgcttccga

SEQ ID NO: 901274 - DNA, 22 bp, Homo sapiens
ccattttaaagttagtatcttt

SEQ ID NO: 901275 - DNA, 14 bp, Homo sapiens
ccattttacacagc

SEQ ID NO: 901276 - DNA, 19 bp, Homo sapiens
ccattttattttatatgat

SEQ ID NO: 901277 - DNA, 21 bp, Homo sapiens
ccattttattttttgggccat

SEQ ID NO: 901278 - DNA, 21 bp, Homo sapiens
ccattttcccatcatcctttg

SEQ ID NO: 901279 - DNA, 10 bp, Homo sapiens
ccattttcta

SEQ ID NO: 901280 - DNA, 20 bp, Homo sapiens
ccattttcttctctgtgaag

SEQ ID NO: 901281 - DNA, 19 bp, Homo sapiens
ccattttgcccttccatag

SEQ ID NO: 901282 - DNA, 18 bp, Homo sapiens
ccattttgttattgacta

SEQ ID NO: 901283 - DNA, 14 bp, Homo sapiens
ccatttttaatgat

SEQ ID NO: 901284 - DNA, 14 bp, Homo sapiens
ccatttttacaagt

SEQ ID NO: 901285 - DNA, 16 bp, Homo sapiens
ccatttttcaaagcaa

SEQ ID NO: 901286 - DNA, 14 bp, Homo sapiens
ccatttttctgggg

SEQ ID NO: 901287 - DNA, 23 bp, Homo sapiens
ccattttttcttcccttttccct

SEQ ID NO: 901288 - DNA, 17 bp, Homo sapiens
cccaaaacccagggcaa

SEQ ID NO: 901289 - DNA, 14 bp, Homo sapiens
cccaaaagattgct

SEQ ID NO: 901290 - DNA, 23 bp, Homo sapiens
cccaaaagtcaaaaggtgcctgt

SEQ ID NO: 901291 - DNA, 14 bp, Homo sapiens
cccaaacacaaaac

SEQ ID NO: 901292 - DNA, 21 bp, Homo sapiens
cccaaacaccagtcacctcgt

SEQ ID NO: 901293 - DNA, 16 bp, Homo sapiens
cccaaacaccttccag

SEQ ID NO: 901294 - DNA, 22 bp, Homo sapiens
cccaaacacttctgctttcact

SEQ ID NO: 901295 - DNA, 16 bp, Homo sapiens
cccaaacaggacagca

SEQ ID NO: 901296 - DNA, 14 bp, Homo sapiens
cccaaacatagccc

SEQ ID NO: 901297 - DNA, 14 bp, Homo sapiens
cccaaacatctggc

SEQ ID NO: 901298 - DNA, 23 bp, Homo sapiens
cccaaacattaatcaccaaagta

SEQ ID NO: 901299 - DNA, 20 bp, Homo sapiens
cccaaacccttaactgacat

SEQ ID NO: 901300 - DNA, 23 bp, Homo sapiens
cccaaacgccctttcctcctcag

SEQ ID NO: 901301 - DNA, 13 bp, Homo sapiens
cccaaactcccct

SEQ ID NO: 901302 - DNA, 17 bp, Homo sapiens
cccaaactccccttccc

SEQ ID NO: 901303 - DNA, 20 bp, Homo sapiens
cccaaactccccttccctgg

SEQ ID NO: 901304 - DNA, 17 bp, Homo sapiens
cccaaacttatggacac

SEQ ID NO: 901305 - DNA, 23 bp, Homo sapiens
cccaaacttatggacactgcctt

SEQ ID NO: 901306 - DNA, 17 bp, Homo sapiens
cccaaactttaaaatgc

SEQ ID NO: 901307 - DNA, 23 bp, Homo sapiens
cccaaagaattcctgaagccaga

SEQ ID NO: 901308 - DNA, 18 bp, Homo sapiens
cccaaagagcctggagaa

SEQ ID NO: 901309 - DNA, 19 bp, Homo sapiens
cccaaagagcctggagaag

SEQ ID NO: 901310 - DNA, 15 bp, Homo sapiens
cccaaagctcagact

SEQ ID NO: 901311 - DNA, 16 bp, Homo sapiens
cccaaagctttcctgc

SEQ ID NO: 901312 - DNA, 20 bp, Homo sapiens
cccaaaggatgagaatgtga

SEQ ID NO: 901313 - DNA, 14 bp, Homo sapiens
cccaaaggcccagg

SEQ ID NO: 901314 - DNA, 18 bp, Homo sapiens
cccaaaggcccagggagg

SEQ ID NO: 901315 - DNA, 22 bp, Homo sapiens
cccaaaggcccagggaggcagc

SEQ ID NO: 901316 - DNA, 16 bp, Homo sapiens
gattcacctcttcctc

SEQ ID NO: 901317 - DNA, 18 bp, Homo sapiens
gattcacctcttcctctg

SEQ ID NO: 901318 - DNA, 13 bp, Homo sapiens
gattcacctgtaa

SEQ ID NO: 901319 - DNA, 18 bp, Homo sapiens
gattcactgccttcctct

SEQ ID NO: 901320 - DNA, 17 bp, Homo sapiens
gattcactgtcttttga

SEQ ID NO: 901321 - DNA, 21 bp, Homo sapiens
gattcagaaaatgttctgttt

SEQ ID NO: 901322 - DNA, 21 bp, Homo sapiens
gattcagccttctttttctgg

SEQ ID NO: 901323 - DNA, 23 bp, Homo sapiens
gattcagctcattatgaaaaaca

SEQ ID NO: 901324 - DNA, 17 bp, Homo sapiens
gattcaggccagcccag

SEQ ID NO: 901325 - DNA, 21 bp, Homo sapiens
gattcaggccagcccagccag

SEQ ID NO: 901326 - DNA, 12 bp, Homo sapiens
gattcaggctgc

SEQ ID NO: 901327 - DNA, 18 bp, Homo sapiens
gattcaggggaagggcag

SEQ ID NO: 901328 - DNA, 20 bp, Homo sapiens
gattcaggggaagggcaggc

SEQ ID NO: 901329 - DNA, 20 bp, Homo sapiens
gattcaggggctttgggccc

SEQ ID NO: 901330 - DNA, 21 bp, Homo sapiens
gattcaggggctttgggccca

SEQ ID NO: 901331 - DNA, 15 bp, Homo sapiens
gattcagttttcatt

SEQ ID NO: 901332 - DNA, 17 bp, Homo sapiens
gattcataaagtaatga

SEQ ID NO: 901333 - DNA, 20 bp, Homo sapiens
gattcataaagtaatgatga

SEQ ID NO: 901334 - DNA, 19 bp, Homo sapiens
gattcataagacacttaga

SEQ ID NO: 901335 - DNA, 19 bp, Homo sapiens
gattcatatttacttctta

SEQ ID NO: 901336 - DNA, 13 bp, Homo sapiens
gattcatctctgg

SEQ ID NO: 901337 - DNA, 18 bp, Homo sapiens
gattcatgttatatttaa

SEQ ID NO: 901338 - DNA, 14 bp, Homo sapiens
gattcattttcctg

SEQ ID NO: 901339 - DNA, 15 bp, Homo sapiens
gattcattttcctgt

SEQ ID NO: 901340 - DNA, 14 bp, Homo sapiens
gattccaaaaacat

SEQ ID NO: 901341 - DNA, 23 bp, Homo sapiens
gattccaaagagtagaattgcat

SEQ ID NO: 901342 - DNA, 12 bp, Homo sapiens
gattccaaataa

SEQ ID NO: 901343 - DNA, 19 bp, Homo sapiens
gattccagagagtggctcc

SEQ ID NO: 901344 - DNA, 22 bp, Homo sapiens
gattcccaccaaggtcttcagc

SEQ ID NO: 901345 - DNA, 21 bp, Homo sapiens
gattcccccccctttcctaaa

SEQ ID NO: 901346 - DNA, 16 bp, Homo sapiens
gattccccctgccctg

SEQ ID NO: 901347 - DNA, 21 bp, Homo sapiens
gattccccctgccctgtgccg

SEQ ID NO: 901348 - DNA, 18 bp, Homo sapiens
gattcccttctgggcttc

SEQ ID NO: 901349 - DNA, 22 bp, Homo sapiens
gattcctacccctcttccagct

SEQ ID NO: 901350 - DNA, 16 bp, Homo sapiens
gattcctattactgca

SEQ ID NO: 901351 - DNA, 13 bp, Homo sapiens
gattcctgaccca

SEQ ID NO: 901352 - DNA, 15 bp, Homo sapiens
gattcctgacccagg

SEQ ID NO: 901353 - DNA, 17 bp, Homo sapiens
gattcctgagctggcct

SEQ ID NO: 901354 - DNA, 19 bp, Homo sapiens
gattcctgagctggcctgt

SEQ ID NO: 901355 - DNA, 18 bp, Homo sapiens
gattccttagactctttt

SEQ ID NO: 901356 - DNA, 13 bp, Homo sapiens
gattcctttaaaa

SEQ ID NO: 901357 - DNA, 17 bp, Homo sapiens
gattcctttaaaatata

SEQ ID NO: 901358 - DNA, 20 bp, Homo sapiens
gattccttttgatggggaga

SEQ ID NO: 901359 - DNA, 22 bp, Homo sapiens
gattccttttgatggggagaaa

SEQ ID NO: 901360 - DNA, 16 bp, Homo sapiens
gattcggtatcccccc

SEQ ID NO: 901361 - DNA, 14 bp, Homo sapiens
gattctactttaag

SEQ ID NO: 901362 - DNA, 23 bp, Homo sapiens
gattctactttaagcactacata

SEQ ID NO: 901363 - DNA, 21 bp, Homo sapiens
gattctagtacataattgatt

SEQ ID NO: 901364 - DNA, 22 bp, Homo sapiens
gattctatattattatatatat

SEQ ID NO: 901365 - DNA, 21 bp, Homo sapiens
gattctatttaattgaaactc

SEQ ID NO: 901366 - DNA, 20 bp, Homo sapiens
gattctatttcccctcttct

SEQ ID NO: 901367 - DNA, 16 bp, Homo sapiens
gattctcccaaagtac

SEQ ID NO: 901368 - DNA, 15 bp, Homo sapiens
gattctcctgcctca

SEQ ID NO: 901369 - DNA, 16 bp, Homo sapiens
gattctcctgcctcag

SEQ ID NO: 901370 - DNA, 16 bp, Homo sapiens
gattctcctgtgctag

SEQ ID NO: 901371 - DNA, 18 bp, Homo sapiens
gattctctacatgctctt

SEQ ID NO: 901372 - DNA, 12 bp, Homo sapiens
gattctctgccc

SEQ ID NO: 901373 - DNA, 12 bp, Homo sapiens
gattctgaatct

SEQ ID NO: 901374 - DNA, 15 bp, Homo sapiens
gattctgacatttat

SEQ ID NO: 901375 - DNA, 20 bp, Homo sapiens
gattctgaccttaaatgcaa

SEQ ID NO: 901376 - DNA, 23 bp, Homo sapiens
gattctgatttcagtttttcatt

SEQ ID NO: 901377 - DNA, 16 bp, Homo sapiens
gattctgcagtaaatc

SEQ ID NO: 901378 - DNA, 21 bp, Homo sapiens
gattctgcagtaaatctttta

SEQ ID NO: 901379 - DNA, 13 bp, Homo sapiens
gattctgcctctc

SEQ ID NO: 901380 - DNA, 13 bp, Homo sapiens
gattctgctttta

SEQ ID NO: 901381 - DNA, 17 bp, Homo sapiens
gattctggatctcctgc

SEQ ID NO: 901382 - DNA, 12 bp, Homo sapiens
gattctgggttt

SEQ ID NO: 901383 - DNA, 19 bp, Homo sapiens
gattctgtgtgttttcata

SEQ ID NO: 901384 - DNA, 22 bp, Homo sapiens
gattctgtttattcttccagaa

SEQ ID NO: 901385 - DNA, 21 bp, Homo sapiens
gattcttaacacagccttcct

SEQ ID NO: 901386 - DNA, 22 bp, Homo sapiens
gattcttaacacagccttcctt

SEQ ID NO: 901387 - DNA, 16 bp, Homo sapiens
gattcttcaaaagcat

SEQ ID NO: 901388 - DNA, 17 bp, Homo sapiens
gattcttgattcctggc

SEQ ID NO: 901389 - DNA, 17 bp, Homo sapiens
gattcttgtaaatcttt

SEQ ID NO: 901390 - DNA, 18 bp, Homo sapiens
gattcttgtaaatctttt

SEQ ID NO: 901391 - DNA, 19 bp, Homo sapiens
gattctttaatagaagttt

SEQ ID NO: 901392 - DNA, 18 bp, Homo sapiens
gattctttccatttgcat

SEQ ID NO: 901393 - DNA, 13 bp, Homo sapiens
gattctttcccca

SEQ ID NO: 901394 - DNA, 15 bp, Homo sapiens
gattctttccccaga

SEQ ID NO: 901395 - DNA, 23 bp, Homo sapiens
gattcttttgtatgtaacaattg

SEQ ID NO: 901396 - DNA, 15 bp, Homo sapiens
gattcttttttcagt

SEQ ID NO: 901397 - DNA, 20 bp, Homo sapiens
gattgaaaatgtccaggaaa

SEQ ID NO: 901398 - DNA, 18 bp, Homo sapiens
gattgaagaatctgcccc

SEQ ID NO: 901399 - DNA, 16 bp, Homo sapiens
gattgaagggtcctgc

SEQ ID NO: 901400 - DNA, 21 bp, Homo sapiens
gattgaagtattttgctggaa

SEQ ID NO: 901401 - DNA, 23 bp, Homo sapiens
gattgaagtattttgctggaata

SEQ ID NO: 901402 - DNA, 17 bp, Homo sapiens
gattgacagctttgctg

SEQ ID NO: 901403 - DNA, 20 bp, Homo sapiens
gattgacctgaggagacatc

SEQ ID NO: 901404 - DNA, 12 bp, Homo sapiens
gattgacctgct

SEQ ID NO: 901405 - DNA, 14 bp, Homo sapiens
gattgacctgctcc

SEQ ID NO: 901406 - DNA, 14 bp, Homo sapiens
gattgactaaataa

SEQ ID NO: 901407 - DNA, 18 bp, Homo sapiens
gattgagaactgacaaag

SEQ ID NO: 901408 - DNA, 22 bp, Homo sapiens
gattgaggcctgccctcaggga

SEQ ID NO: 901409 - DNA, 19 bp, Homo sapiens
gattgatagagtgttatca

SEQ ID NO: 901410 - DNA, 22 bp, Homo sapiens
gattgatcggagcctcctctct

SEQ ID NO: 901411 - DNA, 14 bp, Homo sapiens
gattgatgtacaga

SEQ ID NO: 901412 - DNA, 14 bp, Homo sapiens
gattgcacagaatt

SEQ ID NO: 901413 - DNA, 14 bp, Homo sapiens
gattgcacattgtt

SEQ ID NO: 901414 - DNA, 16 bp, Homo sapiens
gattgcaccactgcac

SEQ ID NO: 901415 - DNA, 15 bp, Homo sapiens
gattgcacgtggcct

SEQ ID NO: 901416 - DNA, 17 bp, Homo sapiens
gattgcacgtggcctct

SEQ ID NO: 901417 - DNA, 23 bp, Homo sapiens
gattgcacgtggcctcttgagca

SEQ ID NO: 901418 - DNA, 12 bp, Homo sapiens
gattgcactgct

SEQ ID NO: 901419 - DNA, 19 bp, Homo sapiens
gattgcagaaaattctgtg

SEQ ID NO: 901420 - DNA, 23 bp, Homo sapiens
gattgccccagagccccactccc

SEQ ID NO: 901421 - DNA, 19 bp, Homo sapiens
gattgcgcctttgtattat

SEQ ID NO: 901422 - DNA, 19 bp, Homo sapiens
gattgcggtttacagctat

SEQ ID NO: 901423 - DNA, 16 bp, Homo sapiens
gattgctctggagcag

SEQ ID NO: 901424 - DNA, 17 bp, Homo sapiens
gattgctctggagcagc

SEQ ID NO: 901425 - DNA, 20 bp, Homo sapiens
gattgctctggagcagccaa

SEQ ID NO: 901426 - DNA, 11 bp, Homo sapiens
gattgctgcca

SEQ ID NO: 901427 - DNA, 21 bp, Homo sapiens
gattgctgccccatcagtgct

SEQ ID NO: 901428 - DNA, 19 bp, Homo sapiens
gattgctggaaaccaagtc

SEQ ID NO: 901429 - DNA, 16 bp, Homo sapiens
gattgcttctgtagta

SEQ ID NO: 901430 - DNA, 19 bp, Homo sapiens
gattgcttgagcccaggag

SEQ ID NO: 901431 - DNA, 11 bp, Homo sapiens
gattgctttgc

SEQ ID NO: 901432 - DNA, 21 bp, Homo sapiens
gattgctttgcattactgtcc

SEQ ID NO: 901433 - DNA, 16 bp, Homo sapiens
gattggaaagacagga

SEQ ID NO: 901434 - DNA, 20 bp, Homo sapiens
gattggaaagacaggaagac

SEQ ID NO: 901435 - DNA, 22 bp, Homo sapiens
gattggaatttctggcctccta

SEQ ID NO: 901436 - DNA, 23 bp, Homo sapiens
gattggacggcctgatgctccct

SEQ ID NO: 901437 - DNA, 22 bp, Homo sapiens
gcaaaggagacaaagcaggagt

SEQ ID NO: 901438 - DNA, 22 bp, Homo sapiens
gcaaaggaggggaaacaatgaa

SEQ ID NO: 901439 - DNA, 12 bp, Homo sapiens
gcaaaggcagtc

SEQ ID NO: 901440 - DNA, 20 bp, Homo sapiens
gcaaaggcccatgccccctt

SEQ ID NO: 901441 - DNA, 13 bp, Homo sapiens
gcaaaggcccttg

SEQ ID NO: 901442 - DNA, 22 bp, Homo sapiens
gcaaaggcccttgtcattgcct

SEQ ID NO: 901443 - DNA, 11 bp, Homo sapiens
gcaaaggcctg

SEQ ID NO: 901444 - DNA, 22 bp, Homo sapiens
gcaaagggcctgcccagacaag

SEQ ID NO: 901445 - DNA, 19 bp, Homo sapiens
gcaaagggctgaaagccat

SEQ ID NO: 901446 - DNA, 22 bp, Homo sapiens
gcaaagggctgaaagccatttg

SEQ ID NO: 901447 - DNA, 17 bp, Homo sapiens
gcaaaggggggaggtca

SEQ ID NO: 901448 - DNA, 21 bp, Homo sapiens
gcaaaggttccaactgtatat

SEQ ID NO: 901449 - DNA, 22 bp, Homo sapiens
gcaaagtatcaaagaaaaacaa

SEQ ID NO: 901450 - DNA, 15 bp, Homo sapiens
gcaaagtattgtaaa

SEQ ID NO: 901451 - DNA, 18 bp, Homo sapiens
gcaaagtattgtaaatta

SEQ ID NO: 901452 - DNA, 22 bp, Homo sapiens
gcaaagtcgccagtcactgctg

SEQ ID NO: 901453 - DNA, 23 bp, Homo sapiens
gcaaagtcgccagtcactgctgc

SEQ ID NO: 901454 - DNA, 23 bp, Homo sapiens
gcaaagtgctgtacccttccacc

SEQ ID NO: 901455 - DNA, 17 bp, Homo sapiens
gcaaagtttacagatgt

SEQ ID NO: 901456 - DNA, 15 bp, Homo sapiens
gcaaagttttacaga

SEQ ID NO: 901457 - DNA, 12 bp, Homo sapiens
gcaaataaaagt

SEQ ID NO: 901458 - DNA, 15 bp, Homo sapiens
gcaaataaagccttt

SEQ ID NO: 901459 - DNA, 20 bp, Homo sapiens
gcaaataaatacgtgtcaaa

SEQ ID NO: 901460 - DNA, 17 bp, Homo sapiens
gcaaataagtgtatttt

SEQ ID NO: 901461 - DNA, 17 bp, Homo sapiens
gcaaatagaaaacagga

SEQ ID NO: 901462 - DNA, 17 bp, Homo sapiens
gcaaatattagcaaaga

SEQ ID NO: 901463 - DNA, 18 bp, Homo sapiens
gcaaatattagcaaagaa

SEQ ID NO: 901464 - DNA, 22 bp, Homo sapiens
gcaaatcagaaacttgtgaagt

SEQ ID NO: 901465 - DNA, 17 bp, Homo sapiens
gcaaatcaggcttttgt

SEQ ID NO: 901466 - DNA, 16 bp, Homo sapiens
gcaaatcaggggccag

SEQ ID NO: 901467 - DNA, 14 bp, Homo sapiens
gcaaatcatttgtt

SEQ ID NO: 901468 - DNA, 15 bp, Homo sapiens
gcaaatcccatttct

SEQ ID NO: 901469 - DNA, 19 bp, Homo sapiens
gcaaatctttctgtaaaca

SEQ ID NO: 901470 - DNA, 22 bp, Homo sapiens
gcaaatctttctgtaaacagaa

SEQ ID NO: 901471 - DNA, 17 bp, Homo sapiens
gcaaatgaatcattgtt

SEQ ID NO: 901472 - DNA, 18 bp, Homo sapiens
gcaaatgccagggcccgc

SEQ ID NO: 901473 - DNA, 14 bp, Homo sapiens
gcaaatggagataa

SEQ ID NO: 901474 - DNA, 23 bp, Homo sapiens
gcaaatggagataaaagcaattc

SEQ ID NO: 901475 - DNA, 18 bp, Homo sapiens
gcaaatggaggcttttca

SEQ ID NO: 901476 - DNA, 20 bp, Homo sapiens
gcaaatggaggcttttcact

SEQ ID NO: 901477 - DNA, 19 bp, Homo sapiens
gcaaatggctgagatggag

SEQ ID NO: 901478 - DNA, 20 bp, Homo sapiens
gcaaatgggagctgagcagc

SEQ ID NO: 901479 - DNA, 15 bp, Homo sapiens
gcaaatgggcagctc

SEQ ID NO: 901480 - DNA, 16 bp, Homo sapiens
gcaaatgtcacagtaa

SEQ ID NO: 901481 - DNA, 22 bp, Homo sapiens
gcaaatgtcacagtaatgcaag

SEQ ID NO: 901482 - DNA, 20 bp, Homo sapiens
gcaaattcttttgaattgtt

SEQ ID NO: 901483 - DNA, 16 bp, Homo sapiens
gcaaattgctagtcag

SEQ ID NO: 901484 - DNA, 14 bp, Homo sapiens
gcaaattgtatctt

SEQ ID NO: 901485 - DNA, 18 bp, Homo sapiens
gcaaattgtttcagtttt

SEQ ID NO: 901486 - DNA, 14 bp, Homo sapiens
gcaaatttaagaga

SEQ ID NO: 901487 - DNA, 12 bp, Homo sapiens
gcaaattttaaa

SEQ ID NO: 901488 - DNA, 21 bp, Homo sapiens
gcaacaacaattggtaaaact

SEQ ID NO: 901489 - DNA, 20 bp, Homo sapiens
gcaacaagactgccaggtgg

SEQ ID NO: 901490 - DNA, 21 bp, Homo sapiens
gcaacaagcccgttagcccca

SEQ ID NO: 901491 - DNA, 13 bp, Homo sapiens
gcaacaataaata

SEQ ID NO: 901492 - DNA, 16 bp, Homo sapiens
gcaacacaagctggaa

SEQ ID NO: 901493 - DNA, 19 bp, Homo sapiens
gcaacacaagctggaagca

SEQ ID NO: 901494 - DNA, 13 bp, Homo sapiens
gcaacactccggt

SEQ ID NO: 901495 - DNA, 17 bp, Homo sapiens
gcaacactccggtcagc

SEQ ID NO: 901496 - DNA, 17 bp, Homo sapiens
gcaacactctatattta

SEQ ID NO: 901497 - DNA, 22 bp, Homo sapiens
gcaacactggaacatggctagc

SEQ ID NO: 901498 - DNA, 19 bp, Homo sapiens
gcaacagacaagtgactgt

SEQ ID NO: 901499 - DNA, 13 bp, Homo sapiens
gcaacagagcact

SEQ ID NO: 901500 - DNA, 18 bp, Homo sapiens
gcaacagattgaaaagac

SEQ ID NO: 901501 - DNA, 15 bp, Homo sapiens
gcaacagcaagaaat

SEQ ID NO: 901502 - DNA, 18 bp, Homo sapiens
gcaacagcactggctctc

SEQ ID NO: 901503 - DNA, 20 bp, Homo sapiens
gcaacagcactggctctctc

SEQ ID NO: 901504 - DNA, 18 bp, Homo sapiens
gcaacaggggaggaaaaa

SEQ ID NO: 901505 - DNA, 21 bp, Homo sapiens
gcaacatagtgagattctgtt

SEQ ID NO: 901506 - DNA, 18 bp, Homo sapiens
gcaacatctagcaaatgt

SEQ ID NO: 901507 - DNA, 19 bp, Homo sapiens
gcaacatctcgagccccct

SEQ ID NO: 901508 - DNA, 13 bp, Homo sapiens
gcaacatcttttt

SEQ ID NO: 901509 - DNA, 23 bp, Homo sapiens
gcaacattcctttcttgtgccct

SEQ ID NO: 901510 - DNA, 20 bp, Homo sapiens
gcaacatttctgtatactgt

SEQ ID NO: 901511 - DNA, 22 bp, Homo sapiens
gcaacatttgtatggatttaag

SEQ ID NO: 901512 - DNA, 12 bp, Homo sapiens
gcaaccacatgt

SEQ ID NO: 901513 - DNA, 11 bp, Homo sapiens
gcaaccaggaa

SEQ ID NO: 901514 - DNA, 17 bp, Homo sapiens
gcaaccaggaacagcaa

SEQ ID NO: 901515 - DNA, 14 bp, Homo sapiens
gcaaccatttgaaa

SEQ ID NO: 901516 - DNA, 14 bp, Homo sapiens
gcaacccacgtgta

SEQ ID NO: 901517 - DNA, 19 bp, Homo sapiens
gcaaccccagttctgctcc

SEQ ID NO: 901518 - DNA, 19 bp, Homo sapiens
gcaacccctgtacccagct

SEQ ID NO: 901519 - DNA, 20 bp, Homo sapiens
gcaacccgctggagcccaca

SEQ ID NO: 901520 - DNA, 23 bp, Homo sapiens
gcaaccctcctatcacctcccct

SEQ ID NO: 901521 - DNA, 21 bp, Homo sapiens
gcaacccttaccccttagcct

SEQ ID NO: 901522 - DNA, 22 bp, Homo sapiens
gcaacccttagagattgcccca

SEQ ID NO: 901523 - DNA, 17 bp, Homo sapiens
gcaacctcaccttcctg

SEQ ID NO: 901524 - DNA, 13 bp, Homo sapiens
gcaacctctgcct

SEQ ID NO: 901525 - DNA, 17 bp, Homo sapiens
gcaacctgtggctcagg

SEQ ID NO: 901526 - DNA, 19 bp, Homo sapiens
gcaacgcccctccaaacct

SEQ ID NO: 901527 - DNA, 14 bp, Homo sapiens
gcaacgtagcctgg

SEQ ID NO: 901528 - DNA, 15 bp, Homo sapiens
gcaactaaggacaaa

SEQ ID NO: 901529 - DNA, 19 bp, Homo sapiens
gcaactaatgtttgaacaa

SEQ ID NO: 901530 - DNA, 15 bp, Homo sapiens
gcaactacaacttct

SEQ ID NO: 901531 - DNA, 16 bp, Homo sapiens
gcaactacaacttctc

SEQ ID NO: 901532 - DNA, 18 bp, Homo sapiens
gcaactacaacttctcct

SEQ ID NO: 901533 - DNA, 18 bp, Homo sapiens
gcaactacagaagtggaa

SEQ ID NO: 901534 - DNA, 14 bp, Homo sapiens
gcaactcatcttag

SEQ ID NO: 901535 - DNA, 15 bp, Homo sapiens
gcaactcttgattat

SEQ ID NO: 901536 - DNA, 14 bp, Homo sapiens
gcaactcttggaag

SEQ ID NO: 901537 - DNA, 17 bp, Homo sapiens
gcaactcttttaagtgc

SEQ ID NO: 901538 - DNA, 23 bp, Homo sapiens
gcaactgacttcatttgtgccac

SEQ ID NO: 901539 - DNA, 14 bp, Homo sapiens
gcaactgaggcaga

SEQ ID NO: 901540 - DNA, 15 bp, Homo sapiens
gcaactgaggcagac

SEQ ID NO: 901541 - DNA, 22 bp, Homo sapiens
gcaactgaggcagacagcagct

SEQ ID NO: 901542 - DNA, 12 bp, Homo sapiens
gcaactgttatg

SEQ ID NO: 901543 - DNA, 18 bp, Homo sapiens
gcaactgttatgaaataa

SEQ ID NO: 901544 - DNA, 19 bp, Homo sapiens
gcaacttgtctttttctgg

SEQ ID NO: 901545 - DNA, 23 bp, Homo sapiens
gcaacttgtctttttctggactg

SEQ ID NO: 901546 - DNA, 12 bp, Homo sapiens
gcaacttgtgaa

SEQ ID NO: 901547 - DNA, 14 bp, Homo sapiens
gcaacttgtgaact

SEQ ID NO: 901548 - DNA, 13 bp, Homo sapiens
gcaacttttaaag

SEQ ID NO: 901549 - DNA, 15 bp, Homo sapiens
gcaactttttaaagt

SEQ ID NO: 901550 - DNA, 11 bp, Homo sapiens
gcaagaaaagg

SEQ ID NO: 901551 - DNA, 20 bp, Homo sapiens
gcaagaaagcttgagtctca

SEQ ID NO: 901552 - DNA, 23 bp, Homo sapiens
gcaagaaatggcgtctgctctgg

SEQ ID NO: 901553 - DNA, 18 bp, Homo sapiens
gcaagaacccaagtgcct

SEQ ID NO: 901554 - DNA, 18 bp, Homo sapiens
gcaagaagaaaatgtggc

SEQ ID NO: 901555 - DNA, 14 bp, Homo sapiens
gcaagaaggaattg

SEQ ID NO: 901556 - DNA, 16 bp, Homo sapiens
gcaagaaggcaaaaat

SEQ ID NO: 901557 - DNA, 21 bp, Homo sapiens
gcaagaaggcaaaaatagttt

SEQ ID NO: 901558 - DNA, 13 bp, Homo sapiens
gcaagaagtagca

SEQ ID NO: 901559 - DNA, 18 bp, Homo sapiens
gcacattgcccatggctg

SEQ ID NO: 901560 - DNA, 16 bp, Homo sapiens
gcacatttatatatat

SEQ ID NO: 901561 - DNA, 20 bp, Homo sapiens
gcacatttatatatatatgt

SEQ ID NO: 901562 - DNA, 13 bp, Homo sapiens
gcacatttcagaa

SEQ ID NO: 901563 - DNA, 22 bp, Homo sapiens
gcacattttccacggaaacaga

SEQ ID NO: 901564 - DNA, 16 bp, Homo sapiens
gcaccaaaagaagtaa

SEQ ID NO: 901565 - DNA, 18 bp, Homo sapiens
gcaccaaaagaagtaaaa

SEQ ID NO: 901566 - DNA, 11 bp, Homo sapiens
gcaccaagcag

SEQ ID NO: 901567 - DNA, 15 bp, Homo sapiens
gcaccacaaaatata

SEQ ID NO: 901568 - DNA, 13 bp, Homo sapiens
gcaccacactggg

SEQ ID NO: 901569 - DNA, 23 bp, Homo sapiens
gcaccacactgggtgcgtctcca

SEQ ID NO: 901570 - DNA, 21 bp, Homo sapiens
gcaccacagccggtcagagga

SEQ ID NO: 901571 - DNA, 16 bp, Homo sapiens
gcaccacattgcctca

SEQ ID NO: 901572 - DNA, 13 bp, Homo sapiens
gcaccaccaagcc

SEQ ID NO: 901573 - DNA, 14 bp, Homo sapiens
gcaccaccaagcca

SEQ ID NO: 901574 - DNA, 14 bp, Homo sapiens
gcaccaccacacag

SEQ ID NO: 901575 - DNA, 16 bp, Homo sapiens
gcaccaccacacagtc

SEQ ID NO: 901576 - DNA, 17 bp, Homo sapiens
gcaccaccacacagtca

SEQ ID NO: 901577 - DNA, 14 bp, Homo sapiens
gcaccaccagggtg

SEQ ID NO: 901578 - DNA, 19 bp, Homo sapiens
gcaccaccagggtggacca

SEQ ID NO: 901579 - DNA, 14 bp, Homo sapiens
gcaccaccatgccc

SEQ ID NO: 901580 - DNA, 17 bp, Homo sapiens
gcaccacctacacagga

SEQ ID NO: 901581 - DNA, 21 bp, Homo sapiens
gcaccacggcgtttttttaca

SEQ ID NO: 901582 - DNA, 21 bp, Homo sapiens
gcaccactgcactccagcctg

SEQ ID NO: 901583 - DNA, 23 bp, Homo sapiens
gcaccactgcactccagcctggg

SEQ ID NO: 901584 - DNA, 12 bp, Homo sapiens
gcaccactgcca

SEQ ID NO: 901585 - DNA, 17 bp, Homo sapiens
gcaccactgctgaggag

SEQ ID NO: 901586 - DNA, 15 bp, Homo sapiens
gcaccagaggctgca

SEQ ID NO: 901587 - DNA, 21 bp, Homo sapiens
gcaccagcaggtgccatcacg

SEQ ID NO: 901588 - DNA, 12 bp, Homo sapiens
gcaccagccagc

SEQ ID NO: 901589 - DNA, 16 bp, Homo sapiens
gcaccagccccctgga

SEQ ID NO: 901590 - DNA, 17 bp, Homo sapiens
gcaccagcgcccccaga

SEQ ID NO: 901591 - DNA, 18 bp, Homo sapiens
gcaccagctctgtggcct

SEQ ID NO: 901592 - DNA, 22 bp, Homo sapiens
gcaccagctctgtggcctgtgt

SEQ ID NO: 901593 - DNA, 23 bp, Homo sapiens
gcaccagctctgtggcctgtgtc

SEQ ID NO: 901594 - DNA, 13 bp, Homo sapiens
gcaccagctgctc

SEQ ID NO: 901595 - DNA, 20 bp, Homo sapiens
gcaccagctgctctgcccct

SEQ ID NO: 901596 - DNA, 16 bp, Homo sapiens
gcaccagcttctccag

SEQ ID NO: 901597 - DNA, 19 bp, Homo sapiens
gcaccagcttctccaggct

SEQ ID NO: 901598 - DNA, 20 bp, Homo sapiens
gcaccagcttctccaggctc

SEQ ID NO: 901599 - DNA, 14 bp, Homo sapiens
gcaccaggaagccg

SEQ ID NO: 901600 - DNA, 18 bp, Homo sapiens
gcaccaggaagccgtcct

SEQ ID NO: 901601 - DNA, 21 bp, Homo sapiens
gcaccaggcacgaacccacct

SEQ ID NO: 901602 - DNA, 16 bp, Homo sapiens
gcaccaggggtttctc

SEQ ID NO: 901603 - DNA, 14 bp, Homo sapiens
gcaccatccctttt

SEQ ID NO: 901604 - DNA, 19 bp, Homo sapiens
gcaccatgcaaatgtcttc

SEQ ID NO: 901605 - DNA, 16 bp, Homo sapiens
gcaccatggacatgtg

SEQ ID NO: 901606 - DNA, 19 bp, Homo sapiens
gcaccatgtgggcacggag

SEQ ID NO: 901607 - DNA, 15 bp, Homo sapiens
gcaccattctcctgc

SEQ ID NO: 901608 - DNA, 15 bp, Homo sapiens
gcaccattctgactc

SEQ ID NO: 901609 - DNA, 17 bp, Homo sapiens
gcacccaaaactcaagc

SEQ ID NO: 901610 - DNA, 15 bp, Homo sapiens
gcacccacaagcccg

SEQ ID NO: 901611 - DNA, 22 bp, Homo sapiens
gcacccacaagcccgtgacaga

SEQ ID NO: 901612 - DNA, 17 bp, Homo sapiens
gcacccaccaccacgcc

SEQ ID NO: 901613 - DNA, 21 bp, Homo sapiens
gcacccaccgtctcggccctg

SEQ ID NO: 901614 - DNA, 18 bp, Homo sapiens
gcacccacctccaccccc

SEQ ID NO: 901615 - DNA, 13 bp, Homo sapiens
gcacccacctgtt

SEQ ID NO: 901616 - DNA, 18 bp, Homo sapiens
gcacccacctgttttctg

SEQ ID NO: 901617 - DNA, 21 bp, Homo sapiens
gcacccacctgttttctgaaa

SEQ ID NO: 901618 - DNA, 22 bp, Homo sapiens
gcacccacctgttttctgaaac

SEQ ID NO: 901619 - DNA, 14 bp, Homo sapiens
gcacccactcacca

SEQ ID NO: 901620 - DNA, 19 bp, Homo sapiens
gcacccagagaaaattaat

SEQ ID NO: 901621 - DNA, 20 bp, Homo sapiens
gcaccccaaagctttcctgc

SEQ ID NO: 901622 - DNA, 15 bp, Homo sapiens
gcaccccactgggag

SEQ ID NO: 901623 - DNA, 22 bp, Homo sapiens
gcaccccagcattccagctctg

SEQ ID NO: 901624 - DNA, 16 bp, Homo sapiens
gcaccccagcgtcagg

SEQ ID NO: 901625 - DNA, 19 bp, Homo sapiens
gcaccccagctaccccttc

SEQ ID NO: 901626 - DNA, 19 bp, Homo sapiens
gcaccccatcccaccagcc

SEQ ID NO: 901627 - DNA, 16 bp, Homo sapiens
gcacccccacccacct

SEQ ID NO: 901628 - DNA, 18 bp, Homo sapiens
gcacccccacccacctcc

SEQ ID NO: 901629 - DNA, 21 bp, Homo sapiens
gcacccccacccacctccacc

SEQ ID NO: 901630 - DNA, 13 bp, Homo sapiens
gcacccccaccct

SEQ ID NO: 901631 - DNA, 18 bp, Homo sapiens
gcacccccaccctttggg

SEQ ID NO: 901632 - DNA, 12 bp, Homo sapiens
gcacccccgcca

SEQ ID NO: 901633 - DNA, 22 bp, Homo sapiens
gcaccccgcttttgcagcagag

SEQ ID NO: 901634 - DNA, 23 bp, Homo sapiens
gcaccccgcttttgcagcagagg

SEQ ID NO: 901635 - DNA, 13 bp, Homo sapiens
gcacccctcccag

SEQ ID NO: 901636 - DNA, 13 bp, Homo sapiens
gcacccctccctg

SEQ ID NO: 901637 - DNA, 17 bp, Homo sapiens
gcacccctccctgcttg

SEQ ID NO: 901638 - DNA, 20 bp, Homo sapiens
gcacccctccgtgtggagca

SEQ ID NO: 901639 - DNA, 12 bp, Homo sapiens
gcacccctggaa

SEQ ID NO: 901640 - DNA, 18 bp, Homo sapiens
gcacccctgggccagcgg

SEQ ID NO: 901641 - DNA, 12 bp, Homo sapiens
gcaccccttctc

SEQ ID NO: 901642 - DNA, 20 bp, Homo sapiens
gcaccccttctctcctcccc

SEQ ID NO: 901643 - DNA, 19 bp, Homo sapiens
gcacccctttcctccccat

SEQ ID NO: 901644 - DNA, 21 bp, Homo sapiens
gcaccctagttctacctcagg

SEQ ID NO: 901645 - DNA, 13 bp, Homo sapiens
gcaccctataaat

SEQ ID NO: 901646 - DNA, 15 bp, Homo sapiens
gcaccctcaggcagg

SEQ ID NO: 901647 - DNA, 19 bp, Homo sapiens
gcaccctcaggcaggtggg

SEQ ID NO: 901648 - DNA, 17 bp, Homo sapiens
gcaccctcatacacaga

SEQ ID NO: 901649 - DNA, 20 bp, Homo sapiens
gcaccctcatacacagaaac

SEQ ID NO: 901650 - DNA, 14 bp, Homo sapiens
gcaccctccaccct

SEQ ID NO: 901651 - DNA, 15 bp, Homo sapiens
gcaccctccaccctg

SEQ ID NO: 901652 - DNA, 15 bp, Homo sapiens
gcaccctctcctggg

SEQ ID NO: 901653 - DNA, 16 bp, Homo sapiens
gcaccctgcacctgct

SEQ ID NO: 901654 - DNA, 18 bp, Homo sapiens
gcaccctgccctcatggg

SEQ ID NO: 901655 - DNA, 22 bp, Homo sapiens
gcaccctggaaaggggagttga

SEQ ID NO: 901656 - DNA, 14 bp, Homo sapiens
gcaccctggggcct

SEQ ID NO: 901657 - DNA, 17 bp, Homo sapiens
gcaccctggggcctgga

SEQ ID NO: 901658 - DNA, 13 bp, Homo sapiens
gcaccctgggtgc

SEQ ID NO: 901659 - DNA, 15 bp, Homo sapiens
gcaccctgggtgcca

SEQ ID NO: 901660 - DNA, 22 bp, Homo sapiens
gcaccctgggtgccattcccag

SEQ ID NO: 901661 - DNA, 19 bp, Homo sapiens
gcacccttctcggagaccc

SEQ ID NO: 901662 - DNA, 18 bp, Homo sapiens
gcacccttctttcctctt

SEQ ID NO: 901663 - DNA, 21 bp, Homo sapiens
gcacccttctttcctcttccc

SEQ ID NO: 901664 - DNA, 16 bp, Homo sapiens
gcaccgacccgaggcc

SEQ ID NO: 901665 - DNA, 18 bp, Homo sapiens
gcaccgacccgaggccca

SEQ ID NO: 901666 - DNA, 13 bp, Homo sapiens
gcaccgccgcaga

SEQ ID NO: 901667 - DNA, 15 bp, Homo sapiens
gcaccgccgccaccc

SEQ ID NO: 901668 - DNA, 14 bp, Homo sapiens
gcaccgcctgccct

SEQ ID NO: 901669 - DNA, 15 bp, Homo sapiens
gcaccgcctgccctc

SEQ ID NO: 901670 - DNA, 21 bp, Homo sapiens
gcaccgcctgccctcccgcac

SEQ ID NO: 901671 - DNA, 12 bp, Homo sapiens
gcaccggcgctg

SEQ ID NO: 901672 - DNA, 17 bp, Homo sapiens
gcaccggcgctgcaggt

SEQ ID NO: 901673 - DNA, 16 bp, Homo sapiens
gcaccgggctccatgc

SEQ ID NO: 901674 - DNA, 22 bp, Homo sapiens
gcaccgggctccatgcctctgg

SEQ ID NO: 901675 - DNA, 13 bp, Homo sapiens
gcaccgggctggc

SEQ ID NO: 901676 - DNA, 24 bp, Homo sapiens
gcaccgtgatggagaggacagagc

SEQ ID NO: 901677 - DNA, 20 bp, Homo sapiens
gcaccgtgtcaagctgctct

SEQ ID NO: 901678 - DNA, 17 bp, Homo sapiens
gcaccgtgtcctcctct

SEQ ID NO: 901679 - DNA, 14 bp, Homo sapiens
gcaccgttctgtgc

SEQ ID NO: 901680 - DNA, 19 bp, Homo sapiens
gcacctaaaccaccagtgc

SEQ ID NO: 901681 - DNA, 13 bp, Homo sapiens
tccagctaattca

SEQ ID NO: 901682 - DNA, 19 bp, Homo sapiens
tccagctcagaacccaggg

SEQ ID NO: 901683 - DNA, 14 bp, Homo sapiens
tccagctcctctag

SEQ ID NO: 901684 - DNA, 17 bp, Homo sapiens
tccagctctgacatccc

SEQ ID NO: 901685 - DNA, 15 bp, Homo sapiens
tccagctctggaggg

SEQ ID NO: 901686 - DNA, 14 bp, Homo sapiens
tccagctgactaaa

SEQ ID NO: 901687 - DNA, 17 bp, Homo sapiens
tccagctgcaccagagc

SEQ ID NO: 901688 - DNA, 16 bp, Homo sapiens
tccagctgcccctccc

SEQ ID NO: 901689 - DNA, 18 bp, Homo sapiens
tccagctgcccctccctc

SEQ ID NO: 901690 - DNA, 21 bp, Homo sapiens
tccagctgcccttccgcagtg

SEQ ID NO: 901691 - DNA, 12 bp, Homo sapiens
tccagctgcctg

SEQ ID NO: 901692 - DNA, 13 bp, Homo sapiens
tccagctgcctgg

SEQ ID NO: 901693 - DNA, 14 bp, Homo sapiens
tccagctgcctggg

SEQ ID NO: 901694 - DNA, 15 bp, Homo sapiens
tccagctgcctgggc

SEQ ID NO: 901695 - DNA, 17 bp, Homo sapiens
tccagctgcctgggccc

SEQ ID NO: 901696 - DNA, 14 bp, Homo sapiens
tccagctgctgtct

SEQ ID NO: 901697 - DNA, 15 bp, Homo sapiens
tccagctgctgtctt

SEQ ID NO: 901698 - DNA, 12 bp, Homo sapiens
tccagctggcct

SEQ ID NO: 901699 - DNA, 12 bp, Homo sapiens
tccagctgggac

SEQ ID NO: 901700 - DNA, 18 bp, Homo sapiens
tccagctggggccagagg

SEQ ID NO: 901701 - DNA, 14 bp, Homo sapiens
tccagctgtcgtct

SEQ ID NO: 901702 - DNA, 15 bp, Homo sapiens
tccagctgttcttag

SEQ ID NO: 901703 - DNA, 17 bp, Homo sapiens
tccagcttcagctcaac

SEQ ID NO: 901704 - DNA, 16 bp, Homo sapiens
tccagcttcggagggc

SEQ ID NO: 901705 - DNA, 23 bp, Homo sapiens
tccagcttcggagggcccctgcg

SEQ ID NO: 901706 - DNA, 23 bp, Homo sapiens
tccagcttctggtactctcctag

SEQ ID NO: 901707 - DNA, 17 bp, Homo sapiens
tccagcttgctcttcag

SEQ ID NO: 901708 - DNA, 19 bp, Homo sapiens
tccagcttgctcttcagtg

SEQ ID NO: 901709 - DNA, 14 bp, Homo sapiens
tccagctttaaggg

SEQ ID NO: 901710 - DNA, 16 bp, Homo sapiens
tccagctttctgccat

SEQ ID NO: 901711 - DNA, 14 bp, Homo sapiens
tccagctttgggga

SEQ ID NO: 901712 - DNA, 17 bp, Homo sapiens
tccagcttttcctcagg

SEQ ID NO: 901713 - DNA, 19 bp, Homo sapiens
tccagcttttcctcagggt

SEQ ID NO: 901714 - DNA, 13 bp, Homo sapiens
tccaggaaaaaat

SEQ ID NO: 901715 - DNA, 19 bp, Homo sapiens
tccaggaaaaaataaaaag

SEQ ID NO: 901716 - DNA, 19 bp, Homo sapiens
tccaggaaaactgggacat

SEQ ID NO: 901717 - DNA, 11 bp, Homo sapiens
tccaggaaaga

SEQ ID NO: 901718 - DNA, 15 bp, Homo sapiens
tccaggaaagagcag

SEQ ID NO: 901719 - DNA, 14 bp, Homo sapiens
tccaggaaccaaaa

SEQ ID NO: 901720 - DNA, 16 bp, Homo sapiens
tccaggaactgcctgg

SEQ ID NO: 901721 - DNA, 21 bp, Homo sapiens
tccaggaagaaagaatgttac

SEQ ID NO: 901722 - DNA, 12 bp, Homo sapiens
tccaggaaggca

SEQ ID NO: 901723 - DNA, 14 bp, Homo sapiens
tccaggaaggcagc

SEQ ID NO: 901724 - DNA, 15 bp, Homo sapiens
tccaggaaggcagct

SEQ ID NO: 901725 - DNA, 16 bp, Homo sapiens
tccaggaaggcagctg

SEQ ID NO: 901726 - DNA, 18 bp, Homo sapiens
tccaggaaggcagctgct

SEQ ID NO: 901727 - DNA, 19 bp, Homo sapiens
tccaggaaggcagctgctc

SEQ ID NO: 901728 - DNA, 16 bp, Homo sapiens
tccaggaataggcatt

SEQ ID NO: 901729 - DNA, 22 bp, Homo sapiens
tccaggaatgctgggcccccag

SEQ ID NO: 901730 - DNA, 18 bp, Homo sapiens
tccaggacatgatactga

SEQ ID NO: 901731 - DNA, 20 bp, Homo sapiens
tccaggagaaggccaattcc

SEQ ID NO: 901732 - DNA, 17 bp, Homo sapiens
tccaggagacatatata

SEQ ID NO: 901733 - DNA, 17 bp, Homo sapiens
tccaggagagagccagg

SEQ ID NO: 901734 - DNA, 16 bp, Homo sapiens
tccaggagagcctggg

SEQ ID NO: 901735 - DNA, 18 bp, Homo sapiens
tccaggagagcctggggg

SEQ ID NO: 901736 - DNA, 18 bp, Homo sapiens
tccaggagcctgtgcctc

SEQ ID NO: 901737 - DNA, 16 bp, Homo sapiens
tccaggagcttcttgt

SEQ ID NO: 901738 - DNA, 23 bp, Homo sapiens
tccaggagcttcttgtttccttg

SEQ ID NO: 901739 - DNA, 17 bp, Homo sapiens
tccaggatcctgcagga

SEQ ID NO: 901740 - DNA, 20 bp, Homo sapiens
tccaggatctccactgataa

SEQ ID NO: 901741 - DNA, 21 bp, Homo sapiens
tccaggatggatgcatcacac

SEQ ID NO: 901742 - DNA, 16 bp, Homo sapiens
tccaggattttaattt

SEQ ID NO: 901743 - DNA, 23 bp, Homo sapiens
tccaggattttaatttcaggaaa

SEQ ID NO: 901744 - DNA, 12 bp, Homo sapiens
tccaggcacagg

SEQ ID NO: 901745 - DNA, 13 bp, Homo sapiens
tccaggcacagga

SEQ ID NO: 901746 - DNA, 18 bp, Homo sapiens
tccaggcacaggatgctg

SEQ ID NO: 901747 - DNA, 21 bp, Homo sapiens
tccaggcaccaggactagggc

SEQ ID NO: 901748 - DNA, 18 bp, Homo sapiens
tccaggcaccctcaggga

SEQ ID NO: 901749 - DNA, 15 bp, Homo sapiens
tccaggcacccttct

SEQ ID NO: 901750 - DNA, 20 bp, Homo sapiens
tccaggcacccttctttcct

SEQ ID NO: 901751 - DNA, 16 bp, Homo sapiens
tccaggcactgagata

SEQ ID NO: 901752 - DNA, 17 bp, Homo sapiens
tccaggcagcagacaca

SEQ ID NO: 901753 - DNA, 15 bp, Homo sapiens
tccaggcaggccagg

SEQ ID NO: 901754 - DNA, 23 bp, Homo sapiens
tccaggcaggccaggctgcctcg

SEQ ID NO: 901755 - DNA, 17 bp, Homo sapiens
tccaggccactgtggcc

SEQ ID NO: 901756 - DNA, 15 bp, Homo sapiens
tccaggccaggtggg

SEQ ID NO: 901757 - DNA, 21 bp, Homo sapiens
tccaggccagtgggcctggta

SEQ ID NO: 901758 - DNA, 11 bp, Homo sapiens
tccaggcccaa

SEQ ID NO: 901759 - DNA, 17 bp, Homo sapiens
tccaggcccaaggctcc

SEQ ID NO: 901760 - DNA, 19 bp, Homo sapiens
tccaggcccaaggctcccg

SEQ ID NO: 901761 - DNA, 16 bp, Homo sapiens
tccaggcccctgagga

SEQ ID NO: 901762 - DNA, 17 bp, Homo sapiens
tccaggcccctgaggac

SEQ ID NO: 901763 - DNA, 22 bp, Homo sapiens
tccaggcccctgaggactggag

SEQ ID NO: 901764 - DNA, 17 bp, Homo sapiens
tccaggcctctctctgc

SEQ ID NO: 901765 - DNA, 20 bp, Homo sapiens
tccaggcctctctctgctcc

SEQ ID NO: 901766 - DNA, 21 bp, Homo sapiens
tccaggcctctctctgctcca

SEQ ID NO: 901767 - DNA, 14 bp, Homo sapiens
tccaggcctgcagc

SEQ ID NO: 901768 - DNA, 14 bp, Homo sapiens
tccaggcctgcctc

SEQ ID NO: 901769 - DNA, 15 bp, Homo sapiens
tccaggcctgcctcc

SEQ ID NO: 901770 - DNA, 16 bp, Homo sapiens
tccaggcctgcctccc

SEQ ID NO: 901771 - DNA, 21 bp, Homo sapiens
tccaggctacaatcttcattt

SEQ ID NO: 901772 - DNA, 22 bp, Homo sapiens
tccaggctctgggcacagtgct

SEQ ID NO: 901773 - DNA, 15 bp, Homo sapiens
tccaggctcttcctg

SEQ ID NO: 901774 - DNA, 20 bp, Homo sapiens
tccaggctcttcctggacct

SEQ ID NO: 901775 - DNA, 22 bp, Homo sapiens
tccaggctggtcttgaattcct

SEQ ID NO: 901776 - DNA, 15 bp, Homo sapiens
tccaggcttgcctca

SEQ ID NO: 901777 - DNA, 21 bp, Homo sapiens
tccagggaaggtggccacagc

SEQ ID NO: 901778 - DNA, 14 bp, Homo sapiens
tccagggaatccaa

SEQ ID NO: 901779 - DNA, 20 bp, Homo sapiens
tccagggaatccaagcctcc

SEQ ID NO: 901780 - DNA, 15 bp, Homo sapiens
tccagggacccttgc

SEQ ID NO: 901781 - DNA, 17 bp, Homo sapiens
tccagggacccttgcct

SEQ ID NO: 901782 - DNA, 21 bp, Homo sapiens
tccagggacccttgcctgcct

SEQ ID NO: 901783 - DNA, 14 bp, Homo sapiens
tccagggcagcagc

SEQ ID NO: 901784 - DNA, 16 bp, Homo sapiens
tccagggcagcagccg

SEQ ID NO: 901785 - DNA, 13 bp, Homo sapiens
tccagggcagcct

SEQ ID NO: 901786 - DNA, 23 bp, Homo sapiens
tccagggccacgtgccaggcccg

SEQ ID NO: 901787 - DNA, 14 bp, Homo sapiens
tccagggcccaggt

SEQ ID NO: 901788 - DNA, 21 bp, Homo sapiens
tccagggccccaggcccgcgg

SEQ ID NO: 901789 - DNA, 13 bp, Homo sapiens
tccagggccctga

SEQ ID NO: 901790 - DNA, 20 bp, Homo sapiens
tccagggcgccagggtgctg

SEQ ID NO: 901791 - DNA, 14 bp, Homo sapiens
tccagggctagtga

SEQ ID NO: 901792 - DNA, 21 bp, Homo sapiens
tccagggctccaaatctgcct

SEQ ID NO: 901793 - DNA, 11 bp, Homo sapiens
tccagggctgg

SEQ ID NO: 901794 - DNA, 15 bp, Homo sapiens
tccagggctggggtg

SEQ ID NO: 901795 - DNA, 14 bp, Homo sapiens
tccaggggaacctg

SEQ ID NO: 901796 - DNA, 12 bp, Homo sapiens
tccaggggcacc

SEQ ID NO: 901797 - DNA, 21 bp, Homo sapiens
tccaggggcccttgggacagc

SEQ ID NO: 901798 - DNA, 23 bp, Homo sapiens
tccaggggcccttgggacagcca

SEQ ID NO: 901799 - DNA, 13 bp, Homo sapiens
tccaggggctcct

SEQ ID NO: 901800 - DNA, 16 bp, Homo sapiens
tccaggggctcctggg

SEQ ID NO: 901801 - DNA, 22 bp, Homo sapiens
tccaggggctgcttcctcctgg

SEQ ID NO: 901802 - DNA, 19 bp, Homo sapiens
tccagggggaaggccaagg

SEQ ID NO: 901803 - DNA, 18 bp, Homo sapiens
tccagggtccctctgtgt

SEQ ID NO: 901804 - DNA, 14 bp, Homo sapiens
tttccttatttgct

SEQ ID NO: 901805 - DNA, 14 bp, Homo sapiens
tttccttcaggttt

SEQ ID NO: 901806 - DNA, 12 bp, Homo sapiens
tttccttccact

SEQ ID NO: 901807 - DNA, 19 bp, Homo sapiens
tttccttccatccctaccc

SEQ ID NO: 901808 - DNA, 21 bp, Homo sapiens
tgaacacacacgccagctcct

SEQ ID NO: 901809 - DNA, 17 bp, Homo sapiens
tgaacacagtgtctgtt

SEQ ID NO: 901810 - DNA, 15 bp, Homo sapiens
tgaacacagtttagt

SEQ ID NO: 901811 - DNA, 22 bp, Homo sapiens
tgaacacgaaagaaatgtacct

SEQ ID NO: 901812 - DNA, 19 bp, Homo sapiens
tgaacactagtctgtgtaa

SEQ ID NO: 901813 - DNA, 18 bp, Homo sapiens
tgaacactggcaacaaca

SEQ ID NO: 901814 - DNA, 17 bp, Homo sapiens
tgaacactgggggaggg

SEQ ID NO: 901815 - DNA, 22 bp, Homo sapiens
tgaacactgggggaggggacat

SEQ ID NO: 901816 - DNA, 13 bp, Homo sapiens
tgaacactgtcat

SEQ ID NO: 901817 - DNA, 12 bp, Homo sapiens
tgaacactgtga

SEQ ID NO: 901818 - DNA, 16 bp, Homo sapiens
tgaacagaagctctta

SEQ ID NO: 901819 - DNA, 21 bp, Homo sapiens
tgaacagaagctcttactctt

SEQ ID NO: 901820 - DNA, 20 bp, Homo sapiens
tgaacagagggagagactaa

SEQ ID NO: 901821 - DNA, 21 bp, Homo sapiens
tgaacagagggagagactaac

SEQ ID NO: 901822 - DNA, 19 bp, Homo sapiens
tgaacagcagtaatcctgg

SEQ ID NO: 901823 - DNA, 20 bp, Homo sapiens
tgaacagcagtaatcctggg

SEQ ID NO: 901824 - DNA, 13 bp, Homo sapiens
tgaacagctgtga

SEQ ID NO: 901825 - DNA, 17 bp, Homo sapiens
tgaacagctgtgtctgc

SEQ ID NO: 901826 - DNA, 13 bp, Homo sapiens
tgaacaggctggg

SEQ ID NO: 901827 - DNA, 15 bp, Homo sapiens
tgaacaggctggggc

SEQ ID NO: 901828 - DNA, 18 bp, Homo sapiens
tgaacagttgctgttctt

SEQ ID NO: 901829 - DNA, 19 bp, Homo sapiens
tgaacagttgctgttctta

SEQ ID NO: 901830 - DNA, 19 bp, Homo sapiens
tgaacatacttcaaaaata

SEQ ID NO: 901831 - DNA, 22 bp, Homo sapiens
tgaacatcagggtgtggcattt

SEQ ID NO: 901832 - DNA, 18 bp, Homo sapiens
tgaacatccttccttccc

SEQ ID NO: 901833 - DNA, 20 bp, Homo sapiens
tgaacatccttccttcccac

SEQ ID NO: 901834 - DNA, 17 bp, Homo sapiens
tgaacatctgagtcctg

SEQ ID NO: 901835 - DNA, 22 bp, Homo sapiens
tgaacatgcagttcattatttt

SEQ ID NO: 901836 - DNA, 22 bp, Homo sapiens
tgaacatgcctgccaaagacgt

SEQ ID NO: 901837 - DNA, 20 bp, Homo sapiens
tgaacatgtgccttttctga

SEQ ID NO: 901838 - DNA, 12 bp, Homo sapiens
tgaacatgttta

SEQ ID NO: 901839 - DNA, 15 bp, Homo sapiens
tgaacatgtttacag

SEQ ID NO: 901840 - DNA, 16 bp, Homo sapiens
tgaacattaaaatata

SEQ ID NO: 901841 - DNA, 12 bp, Homo sapiens
tgaacattgcat

SEQ ID NO: 901842 - DNA, 22 bp, Homo sapiens
tgaacattgcatataacttata

SEQ ID NO: 901843 - DNA, 23 bp, Homo sapiens
tgaacattggggattgaaaatca

SEQ ID NO: 901844 - DNA, 20 bp, Homo sapiens
tgaacattggttctttcatt

SEQ ID NO: 901845 - DNA, 15 bp, Homo sapiens
tgaacatttcaaatt

SEQ ID NO: 901846 - DNA, 21 bp, Homo sapiens
tgaacatttcaaattgaattt

SEQ ID NO: 901847 - DNA, 22 bp, Homo sapiens
tgaacatttgggttactatttc

SEQ ID NO: 901848 - DNA, 22 bp, Homo sapiens
tgaacattttgtggagtttgta

SEQ ID NO: 901849 - DNA, 15 bp, Homo sapiens
tgaaccaaagcctct

SEQ ID NO: 901850 - DNA, 15 bp, Homo sapiens
tgaaccaacatcttt

SEQ ID NO: 901851 - DNA, 14 bp, Homo sapiens
tgaaccaagggatc

SEQ ID NO: 901852 - DNA, 19 bp, Homo sapiens
tgaaccacaagtgaatctt

SEQ ID NO: 901853 - DNA, 14 bp, Homo sapiens
ggccagaggctggg

SEQ ID NO: 901854 - DNA, 15 bp, Homo sapiens
ggccagaggctggga

SEQ ID NO: 901855 - DNA, 15 bp, Homo sapiens
ggccagagggcagtg

SEQ ID NO: 901856 - DNA, 15 bp, Homo sapiens
ggccagagtggcctg

SEQ ID NO: 901857 - DNA, 20 bp, Homo sapiens
ggccagagtggcctggccag

SEQ ID NO: 901858 - DNA, 20 bp, Homo sapiens
ggccagatgcacatccctgg

SEQ ID NO: 901859 - DNA, 21 bp, Homo sapiens
ggccagatgcacatccctgga

SEQ ID NO: 901860 - DNA, 19 bp, Homo sapiens
ggccagcaaaaactgtggg

SEQ ID NO: 901861 - DNA, 14 bp, Homo sapiens
ggccagcaaggcag

SEQ ID NO: 901862 - DNA, 16 bp, Homo sapiens
ggccagcaaggcaggt

SEQ ID NO: 901863 - DNA, 17 bp, Homo sapiens
ggccagcaccctctcct

SEQ ID NO: 901864 - DNA, 14 bp, Homo sapiens
ggccagcagagggc

SEQ ID NO: 901865 - DNA, 20 bp, Homo sapiens
ggccagcataggggggaggg

SEQ ID NO: 901866 - DNA, 14 bp, Homo sapiens
ggccagccaggcgg

SEQ ID NO: 901867 - DNA, 16 bp, Homo sapiens
ggccagccaggcgggc

SEQ ID NO: 901868 - DNA, 15 bp, Homo sapiens
ggccagccatgtctg

SEQ ID NO: 901869 - DNA, 11 bp, Homo sapiens
ggccagcccag

SEQ ID NO: 901870 - DNA, 20 bp, Homo sapiens
ggccagccccacccaggagg

SEQ ID NO: 901871 - DNA, 21 bp, Homo sapiens
ggccagccccacccaggaggg

SEQ ID NO: 901872 - DNA, 23 bp, Homo sapiens
ggccagccccacccccagccagg

SEQ ID NO: 901873 - DNA, 18 bp, Homo sapiens
ggccagcccccccaccca

SEQ ID NO: 901874 - DNA, 16 bp, Homo sapiens
ggccagcccctggggc

SEQ ID NO: 901875 - DNA, 22 bp, Homo sapiens
ggccagcccctggggcccagcc

SEQ ID NO: 901876 - DNA, 15 bp, Homo sapiens
ggccagcccggctgg

SEQ ID NO: 901877 - DNA, 18 bp, Homo sapiens
ggccagcccggctggttt

SEQ ID NO: 901878 - DNA, 22 bp, Homo sapiens
ggccagcctccgagagggagag

SEQ ID NO: 901879 - DNA, 13 bp, Homo sapiens
ggccagcctggat

SEQ ID NO: 901880 - DNA, 16 bp, Homo sapiens
ggccagcgccagggcc

SEQ ID NO: 901881 - DNA, 18 bp, Homo sapiens
ggccagcgccagggccca

SEQ ID NO: 901882 - DNA, 22 bp, Homo sapiens
ggccagcgccagggcccaggcc

SEQ ID NO: 901883 - DNA, 14 bp, Homo sapiens
ggccagcggggctg

SEQ ID NO: 901884 - DNA, 19 bp, Homo sapiens
ggccagcggggctgctcac

SEQ ID NO: 901885 - DNA, 21 bp, Homo sapiens
ggccagctaatttttgtatgt

SEQ ID NO: 901886 - DNA, 20 bp, Homo sapiens
ggccagctgccccagccaga

SEQ ID NO: 901887 - DNA, 13 bp, Homo sapiens
ggccagctgggga

SEQ ID NO: 901888 - DNA, 14 bp, Homo sapiens
ggccagctggggag

SEQ ID NO: 901889 - DNA, 18 bp, Homo sapiens
ggccagctggggagatgg

SEQ ID NO: 901890 - DNA, 22 bp, Homo sapiens
ggccagctggggagatgggggc

SEQ ID NO: 901891 - DNA, 16 bp, Homo sapiens
ggccaggacaggcccg

SEQ ID NO: 901892 - DNA, 15 bp, Homo sapiens
ggccaggagctcttc

SEQ ID NO: 901893 - DNA, 19 bp, Homo sapiens
ggccaggagtttgagacca

SEQ ID NO: 901894 - DNA, 20 bp, Homo sapiens
ggccaggagtttgagaccag

SEQ ID NO: 901895 - DNA, 22 bp, Homo sapiens
ggccaggatccccctctttgca

SEQ ID NO: 901896 - DNA, 11 bp, Homo sapiens
ggccaggcaga

SEQ ID NO: 901897 - DNA, 12 bp, Homo sapiens
ggccaggcagaa

SEQ ID NO: 901898 - DNA, 20 bp, Homo sapiens
ggccaggcagaatggctgca

SEQ ID NO: 901899 - DNA, 15 bp, Homo sapiens
ggccaggcagatctg

SEQ ID NO: 901900 - DNA, 16 bp, Homo sapiens
ggccaggccaccagga

SEQ ID NO: 901901 - DNA, 22 bp, Homo sapiens
ggccaggcctcgcacttgcaga

SEQ ID NO: 901902 - DNA, 15 bp, Homo sapiens
ggccaggcctgcaga

SEQ ID NO: 901903 - DNA, 11 bp, Homo sapiens
ggccaggcctt

SEQ ID NO: 901904 - DNA, 23 bp, Homo sapiens
ggccaggccttacatctggctgg

SEQ ID NO: 901905 - DNA, 14 bp, Homo sapiens
ggccaggcgagcct

SEQ ID NO: 901906 - DNA, 21 bp, Homo sapiens
ggccaggctgatgggacagaa

SEQ ID NO: 901907 - DNA, 14 bp, Homo sapiens
ggccaggctgcctc

SEQ ID NO: 901908 - DNA, 19 bp, Homo sapiens
ggccagggacccaaagcag

SEQ ID NO: 901909 - DNA, 12 bp, Homo sapiens
ggccagggaggc

SEQ ID NO: 901910 - DNA, 14 bp, Homo sapiens
ggccagggaggcgc

SEQ ID NO: 901911 - DNA, 18 bp, Homo sapiens
ggccagggaggcgcaggg

SEQ ID NO: 901912 - DNA, 20 bp, Homo sapiens
ggccagggaggcgcagggac

SEQ ID NO: 901913 - DNA, 20 bp, Homo sapiens
ggccagggccacgctccagc

SEQ ID NO: 901914 - DNA, 16 bp, Homo sapiens
ggccagggccctgcag

SEQ ID NO: 901915 - DNA, 17 bp, Homo sapiens
ggccagggccctgcaga

SEQ ID NO: 901916 - DNA, 17 bp, Homo sapiens
ggccagggcctctccaa

SEQ ID NO: 901917 - DNA, 16 bp, Homo sapiens
ggccagggcggccagg

SEQ ID NO: 901918 - DNA, 19 bp, Homo sapiens
ggccagggctatagctcag

SEQ ID NO: 901919 - DNA, 20 bp, Homo sapiens
ggccagggctatagctcagg

SEQ ID NO: 901920 - DNA, 21 bp, Homo sapiens
ggccagggctcaccagctggg

SEQ ID NO: 901921 - DNA, 18 bp, Homo sapiens
ggccagggctgccctgag

SEQ ID NO: 901922 - DNA, 20 bp, Homo sapiens
ggccagggctgccctgagaa

SEQ ID NO: 901923 - DNA, 24 bp, Homo sapiens
ggccagggcttccccatcagctcc

SEQ ID NO: 901924 - DNA, 23 bp, Homo sapiens
ggccagggtctgtgtgaatgtgg

SEQ ID NO: 901925 - DNA, 16 bp, Homo sapiens
ggccagggtgagagct

SEQ ID NO: 901926 - DNA, 11 bp, Homo sapiens
ggccagggtgg

SEQ ID NO: 901927 - DNA, 16 bp, Homo sapiens
ggccagggtgggaaga

SEQ ID NO: 901928 - DNA, 13 bp, Homo sapiens
ggccactgaccca

SEQ ID NO: 901929 - DNA, 14 bp, Homo sapiens
ggccactgacccac

SEQ ID NO: 901930 - DNA, 16 bp, Homo sapiens
ggccactgacccacct

SEQ ID NO: 901931 - DNA, 13 bp, Homo sapiens
ggccactgcgcca

SEQ ID NO: 901932 - DNA, 21 bp, Homo sapiens
ggccactgcgccactgccatc

SEQ ID NO: 901933 - DNA, 18 bp, Homo sapiens
ggccactgtcaaggcagg

SEQ ID NO: 901934 - DNA, 15 bp, Homo sapiens
ggccactgtccctgt

SEQ ID NO: 901935 - DNA, 19 bp, Homo sapiens
ggccactgtccctgtcctt

SEQ ID NO: 901936 - DNA, 15 bp, Homo sapiens
ggccactgtggccag

SEQ ID NO: 901937 - DNA, 17 bp, Homo sapiens
ggccactgtggccagag

SEQ ID NO: 901938 - DNA, 20 bp, Homo sapiens
ggccactgtggccagagctg

SEQ ID NO: 901939 - DNA, 13 bp, Homo sapiens
ggccactgtgggt

SEQ ID NO: 901940 - DNA, 15 bp, Homo sapiens
ggccactgtgggtga

SEQ ID NO: 901941 - DNA, 21 bp, Homo sapiens
ggccactgtgggtgaagcgcc

SEQ ID NO: 901942 - DNA, 18 bp, Homo sapiens
ggccactgtgtctctgtt

SEQ ID NO: 901943 - DNA, 22 bp, Homo sapiens
ggccactttcagagcccccagc

SEQ ID NO: 901944 - DNA, 15 bp, Homo sapiens
ggccacttttgacta

SEQ ID NO: 901945 - DNA, 13 bp, Homo sapiens
ggccagaaggagg

SEQ ID NO: 901946 - DNA, 14 bp, Homo sapiens
ggccagaaggaggg

SEQ ID NO: 901947 - DNA, 15 bp, Homo sapiens
ggccagaaggagggc

SEQ ID NO: 901948 - DNA, 16 bp, Homo sapiens
ggccagaaggagggca

SEQ ID NO: 901949 - DNA, 20 bp, Homo sapiens
ggccagaaggagggcagagc

SEQ ID NO: 901950 - DNA, 23 bp, Homo sapiens
ggccagaaggagggcagagccat

SEQ ID NO: 901951 - DNA, 24 bp, Homo sapiens
ggccagaaggagggcagagccatg

SEQ ID NO: 901952 - DNA, 16 bp, Homo sapiens
ggccagaagtaccaga

SEQ ID NO: 901953 - DNA, 17 bp, Homo sapiens
ggccagactggaagaca

SEQ ID NO: 901954 - DNA, 22 bp, Homo sapiens
ggccagactggaagacacttca

SEQ ID NO: 901955 - DNA, 23 bp, Homo sapiens
ggccagagaagataatgttcttt

SEQ ID NO: 901956 - DNA, 13 bp, Homo sapiens
ggccagagagcag

SEQ ID NO: 901957 - DNA, 14 bp, Homo sapiens
ggccagagagcagg

SEQ ID NO: 901958 - DNA, 15 bp, Homo sapiens
ggccagagagcaggg

SEQ ID NO: 901959 - DNA, 16 bp, Homo sapiens
ggccagagagcagggg

SEQ ID NO: 901960 - DNA, 17 bp, Homo sapiens
ggccagagagcagggga

SEQ ID NO: 901961 - DNA, 18 bp, Homo sapiens
ggccagagagcctggtgc

SEQ ID NO: 901962 - DNA, 23 bp, Homo sapiens
ggccagagagcctggtgctgctg

SEQ ID NO: 901963 - DNA, 12 bp, Homo sapiens
ggccagagaggg

SEQ ID NO: 901964 - DNA, 13 bp, Homo sapiens
ggccagagagggc

SEQ ID NO: 901965 - DNA, 20 bp, Homo sapiens
ggccagagagggcccagctg

SEQ ID NO: 901966 - DNA, 23 bp, Homo sapiens
ggccagagagggcccagctgtag

SEQ ID NO: 901967 - DNA, 14 bp, Homo sapiens
ggccagagcctctg

SEQ ID NO: 901968 - DNA, 14 bp, Homo sapiens
ggccagagctaggg

SEQ ID NO: 901969 - DNA, 16 bp, Homo sapiens
ggccagagctggaagg

SEQ ID NO: 901970 - DNA, 17 bp, Homo sapiens
ggccagagctggaaggc

SEQ ID NO: 901971 - DNA, 19 bp, Homo sapiens
ggccagagctggaaggcag

SEQ ID NO: 901972 - DNA, 22 bp, Homo sapiens
ggccagagctggaaggcagggc

SEQ ID NO: 901973 - DNA, 17 bp, Homo sapiens
ggccagagctgggaggc

SEQ ID NO: 901974 - DNA, 21 bp, Homo sapiens
ggccagagctgggaggcatgg

SEQ ID NO: 901975 - DNA, 21 bp, Homo sapiens
ggccagaggcccccagcccag

SEQ ID NO: 901976 - DNA, 11 bp, Homo sapiens
ggccagaggct

SEQ ID NO: 901977 - DNA, 18 bp, Homo sapiens
gagcataggaggggtctg

SEQ ID NO: 901978 - DNA, 13 bp, Homo sapiens
gagcatcaatctt

SEQ ID NO: 901979 - DNA, 22 bp, Homo sapiens
gagcatcagccagtgaatctgt

SEQ ID NO: 901980 - DNA, 19 bp, Homo sapiens
gagcatcccccaaagttca

SEQ ID NO: 901981 - DNA, 23 bp, Homo sapiens
gagcatccccctcctctccctgt

SEQ ID NO: 901982 - DNA, 13 bp, Homo sapiens
gagcatcccggag

SEQ ID NO: 901983 - DNA, 19 bp, Homo sapiens
gagcatccggccaaatgca

SEQ ID NO: 901984 - DNA, 15 bp, Homo sapiens
gagcatcctgagccc

SEQ ID NO: 901985 - DNA, 16 bp, Homo sapiens
gagcatcctgagcccc

SEQ ID NO: 901986 - DNA, 18 bp, Homo sapiens
gagcatcctgagccccgc

SEQ ID NO: 901987 - DNA, 19 bp, Homo sapiens
gagcatcggagggagtccc

SEQ ID NO: 901988 - DNA, 19 bp, Homo sapiens
gagcatcgtgacccttcag

SEQ ID NO: 901989 - DNA, 20 bp, Homo sapiens
gagcatctcttgaggccagg

SEQ ID NO: 901990 - DNA, 17 bp, Homo sapiens
gagcatgacagcctgca

SEQ ID NO: 901991 - DNA, 13 bp, Homo sapiens
gagcatgatttga

SEQ ID NO: 901992 - DNA, 18 bp, Homo sapiens
gagcatgcggagccagca

SEQ ID NO: 901993 - DNA, 21 bp, Homo sapiens
gagcatgcggagccagcaggc

SEQ ID NO: 901994 - DNA, 18 bp, Homo sapiens
gagcatggaacacttcga

SEQ ID NO: 901995 - DNA, 17 bp, Homo sapiens
gagcatgggcctggcca

SEQ ID NO: 901996 - DNA, 13 bp, Homo sapiens
gagcatgggtgtg

SEQ ID NO: 901997 - DNA, 15 bp, Homo sapiens
gagcatgtcgtggac

SEQ ID NO: 901998 - DNA, 20 bp, Homo sapiens
gagcattaactaaatgctca

SEQ ID NO: 901999 - DNA, 17 bp, Homo sapiens
gagcattacgtgagcca

SEQ ID NO: 902000 - DNA, 14 bp, Homo sapiens
gagcattagctggc

SEQ ID NO: 902001 - DNA, 20 bp, Homo sapiens
gagcattcaggcagcactga

SEQ ID NO: 902002 - DNA, 23 bp, Homo sapiens
gagcatttccaacaccacagaca

SEQ ID NO: 902003 - DNA, 14 bp, Homo sapiens
gagccaaattttat

SEQ ID NO: 902004 - DNA, 21 bp, Homo sapiens
gagccaacaagaccgccccag

SEQ ID NO: 902005 - DNA, 19 bp, Homo sapiens
gagccaacctcggcttgtg

SEQ ID NO: 902006 - DNA, 22 bp, Homo sapiens
gagccaacctcggcttgtgggc

SEQ ID NO: 902007 - DNA, 21 bp, Homo sapiens
gagccaactgattttgtatgt

SEQ ID NO: 902008 - DNA, 15 bp, Homo sapiens
gagccaagaaacact

SEQ ID NO: 902009 - DNA, 14 bp, Homo sapiens
gagccaagctgcac

SEQ ID NO: 902010 - DNA, 12 bp, Homo sapiens
gagccaaggagg

SEQ ID NO: 902011 - DNA, 20 bp, Homo sapiens
gagccaaggaggcctgggga

SEQ ID NO: 902012 - DNA, 12 bp, Homo sapiens
gagccaaggcca

SEQ ID NO: 902013 - DNA, 13 bp, Homo sapiens
gagccaaggccac

SEQ ID NO: 902014 - DNA, 14 bp, Homo sapiens
gagccaagggaggg

SEQ ID NO: 902015 - DNA, 19 bp, Homo sapiens
gagccaagggagggaaggg

SEQ ID NO: 902016 - DNA, 19 bp, Homo sapiens
gagccaagggttcagagac

SEQ ID NO: 902017 - DNA, 15 bp, Homo sapiens
gagccacaagctgca

SEQ ID NO: 902018 - DNA, 17 bp, Homo sapiens
gagccacaagctgcact

SEQ ID NO: 902019 - DNA, 21 bp, Homo sapiens
gagccacaagctgcactgtga

SEQ ID NO: 902020 - DNA, 21 bp, Homo sapiens
gagccacaggaacggccctgc

SEQ ID NO: 902021 - DNA, 22 bp, Homo sapiens
gagccacaggcaggggtgagag

SEQ ID NO: 902022 - DNA, 19 bp, Homo sapiens
gagccacagtgcctggccc

SEQ ID NO: 902023 - DNA, 14 bp, Homo sapiens
gagccacagtggga

SEQ ID NO: 902024 - DNA, 14 bp, Homo sapiens
gagccaccagttct

SEQ ID NO: 902025 - DNA, 18 bp, Homo sapiens
gagccaccgcgcccagcc

SEQ ID NO: 902026 - DNA, 14 bp, Homo sapiens
gagccaccgctgcc

SEQ ID NO: 902027 - DNA, 14 bp, Homo sapiens
gagccaccgtgcct

SEQ ID NO: 902028 - DNA, 12 bp, Homo sapiens
gagccacctcac

SEQ ID NO: 902029 - DNA, 11 bp, Homo sapiens
gagccacctgc

SEQ ID NO: 902030 - DNA, 18 bp, Homo sapiens
gagccacctgcaagatgg

SEQ ID NO: 902031 - DNA, 19 bp, Homo sapiens
gagccacctgcaagatgga

SEQ ID NO: 902032 - DNA, 13 bp, Homo sapiens
gagccacctggca

SEQ ID NO: 902033 - DNA, 20 bp, Homo sapiens
gagccacctggcagggctca

SEQ ID NO: 902034 - DNA, 18 bp, Homo sapiens
gagccacgcctatgccct

SEQ ID NO: 902035 - DNA, 13 bp, Homo sapiens
gagccactccttc

SEQ ID NO: 902036 - DNA, 21 bp, Homo sapiens
gagccactcgcagtcgcagga

SEQ ID NO: 902037 - DNA, 21 bp, Homo sapiens
gagccactgcacctgcccagc

SEQ ID NO: 902038 - DNA, 20 bp, Homo sapiens
gagccactgcgcccagcctg

SEQ ID NO: 902039 - DNA, 17 bp, Homo sapiens
gagccactgggcccctg

SEQ ID NO: 902040 - DNA, 21 bp, Homo sapiens
gagccactgggcccctgtccc

SEQ ID NO: 902041 - DNA, 16 bp, Homo sapiens
gagccacttctcccca

SEQ ID NO: 902042 - DNA, 23 bp, Homo sapiens
gagccagaaatgggcagttctcc

SEQ ID NO: 902043 - DNA, 23 bp, Homo sapiens
gagccagactctggtcttctttg

SEQ ID NO: 902044 - DNA, 23 bp, Homo sapiens
gagccagagagaacaacaggcag

SEQ ID NO: 902045 - DNA, 19 bp, Homo sapiens
gagccagcagctgaagtct

SEQ ID NO: 902046 - DNA, 21 bp, Homo sapiens
gagccagcagctgaagtctct

SEQ ID NO: 902047 - DNA, 13 bp, Homo sapiens
gagccagcctggc

SEQ ID NO: 902048 - DNA, 14 bp, Homo sapiens
gagccagcctggct

SEQ ID NO: 902049 - DNA, 15 bp, Homo sapiens
gagccagcctgggac

SEQ ID NO: 902050 - DNA, 13 bp, Homo sapiens
gagccagctgctt

SEQ ID NO: 902051 - DNA, 23 bp, Homo sapiens
gagccagctgcttgacctagctc

SEQ ID NO: 902052 - DNA, 20 bp, Homo sapiens
gagccaggaagatcccccag

SEQ ID NO: 902053 - DNA, 21 bp, Homo sapiens
gagccaggaagatcccccaga

SEQ ID NO: 902054 - DNA, 13 bp, Homo sapiens
gagccaggagaag

SEQ ID NO: 902055 - DNA, 14 bp, Homo sapiens
gagccaggagaagc

SEQ ID NO: 902056 - DNA, 21 bp, Homo sapiens
gagccaggagaagctcagctg

SEQ ID NO: 902057 - DNA, 12 bp, Homo sapiens
gagccaggcctg

SEQ ID NO: 902058 - DNA, 14 bp, Homo sapiens
gagccaggcttgga

SEQ ID NO: 902059 - DNA, 18 bp, Homo sapiens
gagccaggcttggatgga

SEQ ID NO: 902060 - DNA, 17 bp, Homo sapiens
gagccagggcagaggaa

SEQ ID NO: 902061 - DNA, 13 bp, Homo sapiens
gagccagggcctc

SEQ ID NO: 902062 - DNA, 15 bp, Homo sapiens
gagccagggtagagc

SEQ ID NO: 902063 - DNA, 17 bp, Homo sapiens
gagccagggtagagcaa

SEQ ID NO: 902064 - DNA, 23 bp, Homo sapiens
gagccagggtagagcaaaggaga

SEQ ID NO: 902065 - DNA, 23 bp, Homo sapiens
gagccagtgagggcagtcctgca

SEQ ID NO: 902066 - DNA, 23 bp, Homo sapiens
gagccagtggaacagcgggagac

SEQ ID NO: 902067 - DNA, 23 bp, Homo sapiens
gagccatataagtttgaaggaaa

SEQ ID NO: 902068 - DNA, 19 bp, Homo sapiens
gagccatattaattgcctg

SEQ ID NO: 902069 - DNA, 22 bp, Homo sapiens
gagccatcactagaagaaaagc

SEQ ID NO: 902070 - DNA, 20 bp, Homo sapiens
gagccatcccttcggagcca

SEQ ID NO: 902071 - DNA, 22 bp, Homo sapiens
gagccatcccttcggagccaac

SEQ ID NO: 902072 - DNA, 14 bp, Homo sapiens
gagccatgcctccc

SEQ ID NO: 902073 - DNA, 16 bp, Homo sapiens
gagccatgcctccctg

SEQ ID NO: 902074 - DNA, 22 bp, Homo sapiens
gagccattagagcacagcttct

SEQ ID NO: 902075 - DNA, 21 bp, Homo sapiens
gagccattgagtgctggggga

SEQ ID NO: 902076 - DNA, 15 bp, Homo sapiens
gagccattgtccctc

SEQ ID NO: 902077 - DNA, 13 bp, Homo sapiens
gagccatttgaga

SEQ ID NO: 902078 - DNA, 14 bp, Homo sapiens
gagcccaagggaat

SEQ ID NO: 902079 - DNA, 15 bp, Homo sapiens
gagcccacagcgagc

SEQ ID NO: 902080 - DNA, 16 bp, Homo sapiens
gagcccacagcgagcc

SEQ ID NO: 902081 - DNA, 17 bp, Homo sapiens
gagcccacagcgagcct

SEQ ID NO: 902082 - DNA, 18 bp, Homo sapiens
gagcccacagcgagcctg

SEQ ID NO: 902083 - DNA, 21 bp, Homo sapiens
gagcccacagcgagcctgtgc

SEQ ID NO: 902084 - DNA, 13 bp, Homo sapiens
gagcccaccagcc

SEQ ID NO: 902085 - DNA, 20 bp, Homo sapiens
gagcccaccagccagccctg

SEQ ID NO: 902086 - DNA, 21 bp, Homo sapiens
gagcccactgcccaccccctc

SEQ ID NO: 902087 - DNA, 16 bp, Homo sapiens
gagcccagagaacagc

SEQ ID NO: 902088 - DNA, 20 bp, Homo sapiens
gagcccagccagaaagcact

SEQ ID NO: 902089 - DNA, 15 bp, Homo sapiens
gagcccagccctccc

SEQ ID NO: 902090 - DNA, 23 bp, Homo sapiens
gagcccagcctgggagcccagag

SEQ ID NO: 902091 - DNA, 21 bp, Homo sapiens
gagcccagctacattcctcag

SEQ ID NO: 902092 - DNA, 16 bp, Homo sapiens
gagcctgcatcttctt

SEQ ID NO: 902093 - DNA, 19 bp, Homo sapiens
gagcctgcatcttcttgca

SEQ ID NO: 902094 - DNA, 23 bp, Homo sapiens
gagcctgcatttcctcgcagcct

SEQ ID NO: 902095 - DNA, 12 bp, Homo sapiens
gagcctgctgga

SEQ ID NO: 902096 - DNA, 15 bp, Homo sapiens
gagcctgctggcacc

SEQ ID NO: 902097 - DNA, 10 bp, Homo sapiens
gagcctggca

SEQ ID NO: 902098 - DNA, 23 bp, Homo sapiens
gagcctggcaaggcattcctcat

SEQ ID NO: 902099 - DNA, 15 bp, Homo sapiens
gagcctggccccagg

SEQ ID NO: 902100 - DNA, 23 bp, Homo sapiens
gagcctggctccgtccaggagcc

SEQ ID NO: 902101 - DNA, 16 bp, Homo sapiens
gagcctggctgcccat

SEQ ID NO: 902102 - DNA, 13 bp, Homo sapiens
taaagtgcagtca

SEQ ID NO: 902103 - DNA, 22 bp, Homo sapiens
taaagtgccagtattttaaaat

SEQ ID NO: 902104 - DNA, 15 bp, Homo sapiens
taaagtgccttctgg

SEQ ID NO: 902105 - DNA, 16 bp, Homo sapiens
taaagtgccttctggg

SEQ ID NO: 902106 - DNA, 15 bp, Homo sapiens
taaagtgcttgcttt

SEQ ID NO: 902107 - DNA, 19 bp, Homo sapiens
taaagtgcttgctttttgc

SEQ ID NO: 902108 - DNA, 16 bp, Homo sapiens
taaagtgtaaatcctt

SEQ ID NO: 902109 - DNA, 19 bp, Homo sapiens
taaagtgtaacaattgtgt

SEQ ID NO: 902110 - DNA, 15 bp, Homo sapiens
taaagtgtatttttt

SEQ ID NO: 902111 - DNA, 21 bp, Homo sapiens
taaagtgtatttttttactaa

SEQ ID NO: 902112 - DNA, 23 bp, Homo sapiens
taaagtgtatttttttactaata

SEQ ID NO: 902113 - DNA, 13 bp, Homo sapiens
taaagtgtgtgat

SEQ ID NO: 902114 - DNA, 17 bp, Homo sapiens
taaagtgtgttgttgct

SEQ ID NO: 902115 - DNA, 20 bp, Homo sapiens
taaagtgttctgccagatct

SEQ ID NO: 902116 - DNA, 18 bp, Homo sapiens
taaagttaaacattttta

SEQ ID NO: 902117 - DNA, 15 bp, Homo sapiens
taaagttactactga

SEQ ID NO: 902118 - DNA, 23 bp, Homo sapiens
taaagttactactgattttaaaa

SEQ ID NO: 902119 - DNA, 20 bp, Homo sapiens
taaagttagtatcttttgat

SEQ ID NO: 902120 - DNA, 19 bp, Homo sapiens
taaagttctgcaaaataca

SEQ ID NO: 902121 - DNA, 20 bp, Homo sapiens
taaagttcttattttagtat

SEQ ID NO: 902122 - DNA, 18 bp, Homo sapiens
taaagttgaagcatttgt

SEQ ID NO: 902123 - DNA, 13 bp, Homo sapiens
ggggaacggatgc

SEQ ID NO: 902124 - DNA, 17 bp, Homo sapiens
ggggaagaagcagagag

SEQ ID NO: 902125 - DNA, 18 bp, Homo sapiens
ggggaagaagcagagaga

SEQ ID NO: 902126 - DNA, 13 bp, Homo sapiens
ggggaagccctgg

SEQ ID NO: 902127 - DNA, 14 bp, Homo sapiens
ggggaagctggctt

SEQ ID NO: 902128 - DNA, 14 bp, Homo sapiens
ggggaagctgggcc

SEQ ID NO: 902129 - DNA, 16 bp, Homo sapiens
ggggaaggcagaggct

SEQ ID NO: 902130 - DNA, 18 bp, Homo sapiens
ggggaaggcagaggctgg

SEQ ID NO: 902131 - DNA, 20 bp, Homo sapiens
ggggaaggcagaggctggca

SEQ ID NO: 902132 - DNA, 15 bp, Homo sapiens
ggggaaggccctgag

SEQ ID NO: 902133 - DNA, 18 bp, Homo sapiens
ggggaaggcgctgggtgc

SEQ ID NO: 902134 - DNA, 14 bp, Homo sapiens
ggggaagggcaggc

SEQ ID NO: 902135 - DNA, 22 bp, Homo sapiens
ggggaagggccagtctgggctg

SEQ ID NO: 902136 - DNA, 12 bp, Homo sapiens
ggggaaggggcc

SEQ ID NO: 902137 - DNA, 21 bp, Homo sapiens
ggggaatgagcccagagaaca

SEQ ID NO: 902138 - DNA, 18 bp, Homo sapiens
ggggaatgctcccagctg

SEQ ID NO: 902139 - DNA, 10 bp, Homo sapiens
ggtgggtcca

SEQ ID NO: 902140 - DNA, 20 bp, Homo sapiens
ggtgggtccatgggcagagc

SEQ ID NO: 902141 - DNA, 23 bp, Homo sapiens
ggtgggtctacctcatctctgaa

SEQ ID NO: 902142 - DNA, 22 bp, Homo sapiens
ggtgggtctatgttccccagga

SEQ ID NO: 902143 - DNA, 14 bp, Homo sapiens
ggtgggtgctcaga

SEQ ID NO: 902144 - DNA, 15 bp, Homo sapiens
ggtgggtgggcctga

SEQ ID NO: 902145 - DNA, 12 bp, Homo sapiens
ggtggtaaagaa

SEQ ID NO: 902146 - DNA, 22 bp, Homo sapiens
ggtggtaaatattttcaaagag

SEQ ID NO: 902147 - DNA, 14 bp, Homo sapiens
ggtggtaaccctgg

SEQ ID NO: 902148 - DNA, 23 bp, Homo sapiens
ggtggtactttattcttgctggg

SEQ ID NO: 902149 - DNA, 17 bp, Homo sapiens
ggtggtcctgagacctg

SEQ ID NO: 902150 - DNA, 20 bp, Homo sapiens
ggtggtctcttcctgtctgg

SEQ ID NO: 902151 - DNA, 19 bp, Homo sapiens
ggtggtctgaatgttctga

SEQ ID NO: 902152 - DNA, 16 bp, Homo sapiens
ggtggtctgttggcag

SEQ ID NO: 902153 - DNA, 16 bp, Homo sapiens
ggtggtgtcgggccct

SEQ ID NO: 902154 - DNA, 19 bp, Homo sapiens
ggtggtgtcgggcccttct

SEQ ID NO: 902155 - DNA, 22 bp, Homo sapiens
ggtggttttcagagcaggaggc

SEQ ID NO: 902156 - DNA, 23 bp, Homo sapiens
ggtggttttcagagcaggaggcc

SEQ ID NO: 902157 - DNA, 18 bp, Homo sapiens
ggtggttttctgttcttt

SEQ ID NO: 902158 - DNA, 18 bp, Homo sapiens
ggtgtaatcattttaaat

SEQ ID NO: 902159 - DNA, 14 bp, Homo sapiens
ggtgtaatggagca

SEQ ID NO: 902160 - DNA, 17 bp, Homo sapiens
ggtgtagccctcccact

SEQ ID NO: 902161 - DNA, 13 bp, Homo sapiens
ggtgtaggctggg

SEQ ID NO: 902162 - DNA, 12 bp, Homo sapiens
ggtgtaggggcc

SEQ ID NO: 902163 - DNA, 17 bp, Homo sapiens
ggtgtaggggccacctc

SEQ ID NO: 902164 - DNA, 21 bp, Homo sapiens
ggtgtaggggccacctcctcc

SEQ ID NO: 902165 - DNA, 22 bp, Homo sapiens
ggtgtaggggccacctcctccc

SEQ ID NO: 902166 - DNA, 13 bp, Homo sapiens
ggtgtatagtgtt

SEQ ID NO: 902167 - DNA, 15 bp, Homo sapiens
ggtgtatataatttt

SEQ ID NO: 902168 - DNA, 16 bp, Homo sapiens
ggtgtatttaaactat

SEQ ID NO: 902169 - DNA, 23 bp, Homo sapiens
ggtgtatttattttcctccccag

SEQ ID NO: 902170 - DNA, 19 bp, Homo sapiens
ggtgtcacatggtgcccct

SEQ ID NO: 902171 - DNA, 19 bp, Homo sapiens
ggtgtcaccctgcagagct

SEQ ID NO: 902172 - DNA, 21 bp, Homo sapiens
ggtgtcagcccctcttccctt

SEQ ID NO: 902173 - DNA, 13 bp, Homo sapiens
ggtgtcatgcttt

SEQ ID NO: 902174 - DNA, 18 bp, Homo sapiens
ggtgtcatttcattccat

SEQ ID NO: 902175 - DNA, 15 bp, Homo sapiens
ggtgtccccaacgtc

SEQ ID NO: 902176 - DNA, 19 bp, Homo sapiens
ggtgtccccttcccctgct

SEQ ID NO: 902177 - DNA, 20 bp, Homo sapiens
ggtgtccccttcccctgctg

SEQ ID NO: 902178 - DNA, 23 bp, Homo sapiens
ggtgtccccttcccctgctgacc

SEQ ID NO: 902179 - DNA, 20 bp, Homo sapiens
ggtgtcctgaccaccctccc

SEQ ID NO: 902180 - DNA, 20 bp, Homo sapiens
ggtgtcctgcctgtctgccc

SEQ ID NO: 902181 - DNA, 12 bp, Homo sapiens
ggtgtctccctc

SEQ ID NO: 902182 - DNA, 17 bp, Homo sapiens
ggtgtctctgggcctgt

SEQ ID NO: 902183 - DNA, 14 bp, Homo sapiens
ggtgtctctggtct

SEQ ID NO: 902184 - DNA, 22 bp, Homo sapiens
ggtgtcttttccactcctatgg

SEQ ID NO: 902185 - DNA, 20 bp, Homo sapiens
ggtgtgaactcaccctggga

SEQ ID NO: 902186 - DNA, 11 bp, Homo sapiens
ggtgtgaccat

SEQ ID NO: 902187 - DNA, 21 bp, Homo sapiens
ggtgtgactcgggagctgcac

SEQ ID NO: 902188 - DNA, 23 bp, Homo sapiens
ggtgtgagatcctctttactctg

SEQ ID NO: 902189 - DNA, 20 bp, Homo sapiens
ggtgtgcaatgtctgagtga

SEQ ID NO: 902190 - DNA, 17 bp, Homo sapiens
ggtgtgcaccagggttg

SEQ ID NO: 902191 - DNA, 16 bp, Homo sapiens
ggtgtgcctgccctgg

SEQ ID NO: 902192 - DNA, 19 bp, Homo sapiens
ggtgtgcctgccctggagg

SEQ ID NO: 902193 - DNA, 21 bp, Homo sapiens
ggtgtgcggaggcaggagcat

SEQ ID NO: 902194 - DNA, 19 bp, Homo sapiens
ggtgtgctagaacaaggtc

SEQ ID NO: 902195 - DNA, 11 bp, Homo sapiens
ggtgtggaagg

SEQ ID NO: 902196 - DNA, 18 bp, Homo sapiens
ggtgtggaagggaccaag

SEQ ID NO: 902197 - DNA, 12 bp, Homo sapiens
ggtgtggagaag

SEQ ID NO: 902198 - DNA, 23 bp, Homo sapiens
ggtgtggagaagcggctggcagc

SEQ ID NO: 902199 - DNA, 17 bp, Homo sapiens
ggtgtggataaggctta

SEQ ID NO: 902200 - DNA, 15 bp, Homo sapiens
ggtgtggccctgcca

SEQ ID NO: 902201 - DNA, 19 bp, Homo sapiens
ggtgtggctttccaggcac

SEQ ID NO: 902202 - DNA, 22 bp, Homo sapiens
ggtgtggggacacagcagtgag

SEQ ID NO: 902203 - DNA, 15 bp, Homo sapiens
ggtgtggtggctcat

SEQ ID NO: 902204 - DNA, 18 bp, Homo sapiens
ggtgtgtccttgaactga

SEQ ID NO: 902205 - DNA, 19 bp, Homo sapiens
ggtgtgtccttgaactgag

SEQ ID NO: 902206 - DNA, 23 bp, Homo sapiens
ggtgtgtccttgaactgaggccc

SEQ ID NO: 902207 - DNA, 15 bp, Homo sapiens
ggtgtgtgcgcctga

SEQ ID NO: 902208 - DNA, 18 bp, Homo sapiens
ggtgtgtggcctccctgg

SEQ ID NO: 902209 - DNA, 22 bp, Homo sapiens
ggtgtgtggcctccctggctcc

SEQ ID NO: 902210 - DNA, 18 bp, Homo sapiens
ggtgttaaagctgtacac

SEQ ID NO: 902211 - DNA, 20 bp, Homo sapiens
ggtgttacacagcccaagag

SEQ ID NO: 902212 - DNA, 12 bp, Homo sapiens
ggtgttatttgg

SEQ ID NO: 902213 - DNA, 19 bp, Homo sapiens
ggtgttcaccaaaaccaaa

SEQ ID NO: 902214 - DNA, 23 bp, Homo sapiens
ggtgttccgaaaccaaagaagaa

SEQ ID NO: 902215 - DNA, 18 bp, Homo sapiens
ggtgttcctaccaggact

SEQ ID NO: 902216 - DNA, 13 bp, Homo sapiens
ggtgttcctggaa

SEQ ID NO: 902217 - DNA, 16 bp, Homo sapiens
ggtgttcctggaagca

SEQ ID NO: 902218 - DNA, 17 bp, Homo sapiens
ggtgttcgtttccatca

SEQ ID NO: 902219 - DNA, 21 bp, Homo sapiens
ggtgttgccaaatatgtcctg

SEQ ID NO: 902220 - DNA, 22 bp, Homo sapiens
ggtgttgccatttctctgctta

SEQ ID NO: 902221 - DNA, 12 bp, Homo sapiens
ggtgttgctgtt

SEQ ID NO: 902222 - DNA, 21 bp, Homo sapiens
ggtgtttattacaagtggctc

SEQ ID NO: 902223 - DNA, 16 bp, Homo sapiens
ggtgtttcccttcctc

SEQ ID NO: 902224 - DNA, 23 bp, Homo sapiens
ggtgtttcttgtgtttgagaacc

SEQ ID NO: 902225 - DNA, 14 bp, Homo sapiens
ggtgttttcatgta

SEQ ID NO: 902226 - DNA, 15 bp, Homo sapiens
ggtgtttttaataaa

SEQ ID NO: 902227 - DNA, 16 bp, Homo sapiens
ggttaaaaaaaaaagt

SEQ ID NO: 902228 - DNA, 17 bp, Homo sapiens
ggttaaaaaacaaatgt

SEQ ID NO: 902229 - DNA, 23 bp, Homo sapiens
ggttaaacaaaatgaaaatatct

SEQ ID NO: 902230 - DNA, 20 bp, Homo sapiens
ggttaaatagtatgggaaaa

SEQ ID NO: 902231 - DNA, 16 bp, Homo sapiens
ggttaaggccagggcc

SEQ ID NO: 902232 - DNA, 19 bp, Homo sapiens
ggttaaggtgggtccagga

SEQ ID NO: 902233 - DNA, 17 bp, Homo sapiens
ggttaatctttcctgat

SEQ ID NO: 902234 - DNA, 15 bp, Homo sapiens
ggttaatttttcctg

SEQ ID NO: 902235 - DNA, 15 bp, Homo sapiens
ggttacaaactgcaa

SEQ ID NO: 902236 - DNA, 16 bp, Homo sapiens
ggttaccaagaagcct

SEQ ID NO: 902237 - DNA, 13 bp, Homo sapiens
ggttacctccctc

SEQ ID NO: 902238 - DNA, 23 bp, Homo sapiens
ggttacctgttccattgttgtca

SEQ ID NO: 902239 - DNA, 17 bp, Homo sapiens
ggttacttcttctctta

SEQ ID NO: 902240 - DNA, 19 bp, Homo sapiens
ggttagagccaagctgcac

SEQ ID NO: 902241 - DNA, 19 bp, Homo sapiens
ggttagctaaaccaagaag

SEQ ID NO: 902242 - DNA, 17 bp, Homo sapiens
ggttaggaatctcttca

SEQ ID NO: 902243 - DNA, 13 bp, Homo sapiens
ggttagggagggg

SEQ ID NO: 902244 - DNA, 17 bp, Homo sapiens
ggttagtcattgataga

SEQ ID NO: 902245 - DNA, 14 bp, Homo sapiens
ggttagtcgggtgc

SEQ ID NO: 902246 - DNA, 19 bp, Homo sapiens
ggttataacagcaaatgaa

SEQ ID NO: 902247 - DNA, 23 bp, Homo sapiens
ggttataacttaatgaaaacaat

SEQ ID NO: 902248 - DNA, 12 bp, Homo sapiens
ggttataatttt

SEQ ID NO: 902249 - DNA, 14 bp, Homo sapiens
ggttatctctgtgt

SEQ ID NO: 902250 - DNA, 16 bp, Homo sapiens
ggttatctgcctggcc

SEQ ID NO: 902251 - DNA, 21 bp, Homo sapiens
ggttatctgcctggcctggct

SEQ ID NO: 902252 - DNA, 23 bp, Homo sapiens
ggttatctgcctggcctggctcc

SEQ ID NO: 902253 - DNA, 18 bp, Homo sapiens
ggttatctttttaaaaac

SEQ ID NO: 902254 - DNA, 13 bp, Homo sapiens
ggttatgaaacat

SEQ ID NO: 902255 - DNA, 17 bp, Homo sapiens
ggttatgtatcagaaga

SEQ ID NO: 902256 - DNA, 11 bp, Homo sapiens
ggttatgtttt

SEQ ID NO: 902257 - DNA, 23 bp, Homo sapiens
ggttattcacaacctcaccaaac

SEQ ID NO: 902258 - DNA, 20 bp, Homo sapiens
ggttatttagggaactgctt

SEQ ID NO: 902259 - DNA, 19 bp, Homo sapiens
ggttattttaaatataaat

SEQ ID NO: 902260 - DNA, 18 bp, Homo sapiens
agccctactccctgcaga

SEQ ID NO: 902261 - DNA, 20 bp, Homo sapiens
agccctactccctgcagatg

SEQ ID NO: 902262 - DNA, 21 bp, Homo sapiens
agccctagctgtcccatgggg

SEQ ID NO: 902263 - DNA, 16 bp, Homo sapiens
agccctatggatgtgg

SEQ ID NO: 902264 - DNA, 11 bp, Homo sapiens
agccctcacct

SEQ ID NO: 902265 - DNA, 10 bp, Homo sapiens
agccctcaga

SEQ ID NO: 902266 - DNA, 13 bp, Homo sapiens
agccctcagaaca

SEQ ID NO: 902267 - DNA, 14 bp, Homo sapiens
agccctcaggctcc

SEQ ID NO: 902268 - DNA, 19 bp, Homo sapiens
agccctcaggctccccaga

SEQ ID NO: 902269 - DNA, 12 bp, Homo sapiens
agccctcatccc

SEQ ID NO: 902270 - DNA, 21 bp, Homo sapiens
agccctcatcccacttccttt

SEQ ID NO: 902271 - DNA, 16 bp, Homo sapiens
agccctcatcccgagc

SEQ ID NO: 902272 - DNA, 12 bp, Homo sapiens
agccctcccact

SEQ ID NO: 902273 - DNA, 13 bp, Homo sapiens
agccctcccactt

SEQ ID NO: 902274 - DNA, 19 bp, Homo sapiens
agccctccccccagctccc

SEQ ID NO: 902275 - DNA, 23 bp, Homo sapiens
agccctccccctcaacctcacca

SEQ ID NO: 902276 - DNA, 21 bp, Homo sapiens
agccctcccccttccccttct

SEQ ID NO: 902277 - DNA, 15 bp, Homo sapiens
agccctccctgcccc

SEQ ID NO: 902278 - DNA, 14 bp, Homo sapiens
agccctccctgtcc

SEQ ID NO: 902279 - DNA, 13 bp, Homo sapiens
agccctcctcacc

SEQ ID NO: 902280 - DNA, 18 bp, Homo sapiens
agccctcgaaccaaggca

SEQ ID NO: 902281 - DNA, 23 bp, Homo sapiens
agccctcgaaccaaggcagcctc

SEQ ID NO: 902282 - DNA, 17 bp, Homo sapiens
agccctcggcctccgag

SEQ ID NO: 902283 - DNA, 20 bp, Homo sapiens
agccctcggcctccgaggct

SEQ ID NO: 902284 - DNA, 14 bp, Homo sapiens
agccctctagggca

SEQ ID NO: 902285 - DNA, 14 bp, Homo sapiens
agccctctcactcc

SEQ ID NO: 902286 - DNA, 18 bp, Homo sapiens
agccctctcactccagcc

SEQ ID NO: 902287 - DNA, 20 bp, Homo sapiens
agccctctcactccagccaa

SEQ ID NO: 902288 - DNA, 12 bp, Homo sapiens
agccctctgcct

SEQ ID NO: 902289 - DNA, 22 bp, Homo sapiens
agccctctgcctcctccccagg

SEQ ID NO: 902290 - DNA, 21 bp, Homo sapiens
agccctctttaatgctgtctt

SEQ ID NO: 902291 - DNA, 18 bp, Homo sapiens
agccctgaacatttcatg

SEQ ID NO: 902292 - DNA, 15 bp, Homo sapiens
agccctgaccctgtg

SEQ ID NO: 902293 - DNA, 12 bp, Homo sapiens
agccctgacctt

SEQ ID NO: 902294 - DNA, 18 bp, Homo sapiens
agccctgactcctggact

SEQ ID NO: 902295 - DNA, 19 bp, Homo sapiens
agccctgactcctggactc

SEQ ID NO: 902296 - DNA, 18 bp, Homo sapiens
agccctgaggacctctca

SEQ ID NO: 902297 - DNA, 19 bp, Homo sapiens
agccctgaggacctctcag

SEQ ID NO: 902298 - DNA, 16 bp, Homo sapiens
agccctgaggggctgg

SEQ ID NO: 902299 - DNA, 19 bp, Homo sapiens
agccctgaggggctgggct

SEQ ID NO: 902300 - DNA, 16 bp, Homo sapiens
agccgggaccctcagg

SEQ ID NO: 902301 - DNA, 14 bp, Homo sapiens
agccgggcccctgg

SEQ ID NO: 902302 - DNA, 17 bp, Homo sapiens
agccgggcccctgggct

SEQ ID NO: 902303 - DNA, 19 bp, Homo sapiens
agccgggcctggggctcct

SEQ ID NO: 902304 - DNA, 14 bp, Homo sapiens
agccgggggagggg

SEQ ID NO: 902305 - DNA, 21 bp, Homo sapiens
agccgggggaggggccctcag

SEQ ID NO: 902306 - DNA, 22 bp, Homo sapiens
agccggggtgtaacttcctgct

SEQ ID NO: 902307 - DNA, 21 bp, Homo sapiens
agccgggtctgcctcttctgg

SEQ ID NO: 902308 - DNA, 12 bp, Homo sapiens
agccggtgcctg

SEQ ID NO: 902309 - DNA, 13 bp, Homo sapiens
agccggtgtccct

SEQ ID NO: 902310 - DNA, 21 bp, Homo sapiens
agccgtccatggcaccagccc

SEQ ID NO: 902311 - DNA, 13 bp, Homo sapiens
agccgtcccaggc

SEQ ID NO: 902312 - DNA, 22 bp, Homo sapiens
agccgtcccgcgttcaagactt

SEQ ID NO: 902313 - DNA, 18 bp, Homo sapiens
agccgtctgactccagag

SEQ ID NO: 902314 - DNA, 19 bp, Homo sapiens
agccgtctgactccagagt

SEQ ID NO: 902315 - DNA, 21 bp, Homo sapiens
agccgtctgactccagagtct

SEQ ID NO: 902316 - DNA, 17 bp, Homo sapiens
agccgtgatgctcaggc

SEQ ID NO: 902317 - DNA, 19 bp, Homo sapiens
agccgtgatgctcaggctt

SEQ ID NO: 902318 - DNA, 16 bp, Homo sapiens
agccgtgccttcagct

SEQ ID NO: 902319 - DNA, 18 bp, Homo sapiens
agccgtgctcgccccagc

SEQ ID NO: 902320 - DNA, 18 bp, Homo sapiens
agccgtgctcttttaaaa

SEQ ID NO: 902321 - DNA, 23 bp, Homo sapiens
agccgtggcttcccgctcagccc

SEQ ID NO: 902322 - DNA, 15 bp, Homo sapiens
agccgtggtccctga

SEQ ID NO: 902323 - DNA, 16 bp, Homo sapiens
agccgtggtcctttgg

SEQ ID NO: 902324 - DNA, 19 bp, Homo sapiens
agccgtgtgggtggcgggt

SEQ ID NO: 902325 - DNA, 21 bp, Homo sapiens
agccgttgaatctgggaggga

SEQ ID NO: 902326 - DNA, 13 bp, Homo sapiens
agccgttttcctc

SEQ ID NO: 902327 - DNA, 23 bp, Homo sapiens
agcctaaagggcagggcccacgt

SEQ ID NO: 902328 - DNA, 18 bp, Homo sapiens
agcctaagatgaagagga

SEQ ID NO: 902329 - DNA, 19 bp, Homo sapiens
agcctaagcggctgtttac

SEQ ID NO: 902330 - DNA, 19 bp, Homo sapiens
agcctaaggctcctgtttt

SEQ ID NO: 902331 - DNA, 16 bp, Homo sapiens
agcctaagggatcctg

SEQ ID NO: 902332 - DNA, 23 bp, Homo sapiens
agcctaatccctgggcattgctt

SEQ ID NO: 902333 - DNA, 23 bp, Homo sapiens
agcctacattctccagttgatta

SEQ ID NO: 902334 - DNA, 19 bp, Homo sapiens
agcctacattttagtttct

SEQ ID NO: 902335 - DNA, 17 bp, Homo sapiens
agcctaccgtatttcag

SEQ ID NO: 902336 - DNA, 16 bp, Homo sapiens
agcctacgctgaagat

SEQ ID NO: 902337 - DNA, 17 bp, Homo sapiens
agcctagaacatccctg

SEQ ID NO: 902338 - DNA, 21 bp, Homo sapiens
agcctagaacatccctgggca

SEQ ID NO: 902339 - DNA, 22 bp, Homo sapiens
agcctagaacatccctgggcaa

SEQ ID NO: 902340 - DNA, 15 bp, Homo sapiens
agcctagaccctcct

SEQ ID NO: 902341 - DNA, 18 bp, Homo sapiens
agcctagcggagcccagc

SEQ ID NO: 902342 - DNA, 22 bp, Homo sapiens
agcctaggaccactcagcccct

SEQ ID NO: 902343 - DNA, 18 bp, Homo sapiens
agcctaggacgccaactt

SEQ ID NO: 902344 - DNA, 16 bp, Homo sapiens
agcctaggtggaggca

SEQ ID NO: 902345 - DNA, 19 bp, Homo sapiens
agcctaggtggaggcaagt

SEQ ID NO: 902346 - DNA, 21 bp, Homo sapiens
agcctagttatcaaggggatg

SEQ ID NO: 902347 - DNA, 15 bp, Homo sapiens
agcctagttcatcca

SEQ ID NO: 902348 - DNA, 17 bp, Homo sapiens
agcctatacgtttctgt

SEQ ID NO: 902349 - DNA, 17 bp, Homo sapiens
agcctatagtaaatgtg

SEQ ID NO: 902350 - DNA, 17 bp, Homo sapiens
agcctatgagcatcctg

SEQ ID NO: 902351 - DNA, 19 bp, Homo sapiens
agcctatgagcatcctgag

SEQ ID NO: 902352 - DNA, 20 bp, Homo sapiens
agcctatgggggctctcgga

SEQ ID NO: 902353 - DNA, 17 bp, Homo sapiens
agcctatttttttagat

SEQ ID NO: 902354 - DNA, 22 bp, Homo sapiens
agcctcaaaacgggtcagtatt

SEQ ID NO: 902355 - DNA, 19 bp, Homo sapiens
agcctcaacctcctgggtt

SEQ ID NO: 902356 - DNA, 17 bp, Homo sapiens
agcctcaaggccctcgg

SEQ ID NO: 902357 - DNA, 15 bp, Homo sapiens
agcctcaatttctga

SEQ ID NO: 902358 - DNA, 22 bp, Homo sapiens
agcctcacttgaatgtgtcact

SEQ ID NO: 902359 - DNA, 18 bp, Homo sapiens
agcctcagaaagggattg

SEQ ID NO: 902360 - DNA, 15 bp, Homo sapiens
agcctcagaaggccc

SEQ ID NO: 902361 - DNA, 14 bp, Homo sapiens
agcctcagactgga

SEQ ID NO: 902362 - DNA, 21 bp, Homo sapiens
agcctcagcccaacttcttac

SEQ ID NO: 902363 - DNA, 15 bp, Homo sapiens
agcctcagcctactc

SEQ ID NO: 902364 - DNA, 16 bp, Homo sapiens
agcctcagctgtacga

SEQ ID NO: 902365 - DNA, 22 bp, Homo sapiens
agcctcaggcttgagggagggc

SEQ ID NO: 902366 - DNA, 19 bp, Homo sapiens
agcctcagtctccctccct

SEQ ID NO: 902367 - DNA, 18 bp, Homo sapiens
agcctcagtgccacttga

SEQ ID NO: 902368 - DNA, 22 bp, Homo sapiens
agcctcatacctacatcagaca

SEQ ID NO: 902369 - DNA, 14 bp, Homo sapiens
agcctcatatttaa

SEQ ID NO: 902370 - DNA, 14 bp, Homo sapiens
agcctcatccgagg

SEQ ID NO: 902371 - DNA, 17 bp, Homo sapiens
agcctcatccgaggcag

SEQ ID NO: 902372 - DNA, 18 bp, Homo sapiens
agcctcatccgaggcagg

SEQ ID NO: 902373 - DNA, 21 bp, Homo sapiens
agcctcatcctccccaggacc

SEQ ID NO: 902374 - DNA, 14 bp, Homo sapiens
agcctcatgttctc

SEQ ID NO: 902375 - DNA, 15 bp, Homo sapiens
agcctcatgttctct

SEQ ID NO: 902376 - DNA, 20 bp, Homo sapiens
agcctcatgttctcttccca

SEQ ID NO: 902377 - DNA, 21 bp, Homo sapiens
agcctcatgttctcttcccag

SEQ ID NO: 902378 - DNA, 16 bp, Homo sapiens
agcctcatgttctgtg

SEQ ID NO: 902379 - DNA, 18 bp, Homo sapiens
agcctcattgtgccaagc

SEQ ID NO: 902380 - DNA, 20 bp, Homo sapiens
agcctcattgtgccaagcct

SEQ ID NO: 902381 - DNA, 20 bp, Homo sapiens
agcctccaaagtggagctgg

SEQ ID NO: 902382 - DNA, 22 bp, Homo sapiens
agcctccaaagtggagctggga

SEQ ID NO: 902383 - DNA, 21 bp, Homo sapiens
agcctccacagcgagggcagc

SEQ ID NO: 902384 - DNA, 22 bp, Homo sapiens
agcctccacagcgagggcagct

SEQ ID NO: 902385 - DNA, 22 bp, Homo sapiens
agcctccaccccacaacccaaa

SEQ ID NO: 902386 - DNA, 15 bp, Homo sapiens
agcctccagagaagc

SEQ ID NO: 902387 - DNA, 17 bp, Homo sapiens
agcctccagagaagccc

SEQ ID NO: 902388 - DNA, 21 bp, Homo sapiens
agcctccagagaagccccgca

SEQ ID NO: 902389 - DNA, 23 bp, Homo sapiens
agccagtaaatgggggtgcattt

SEQ ID NO: 902390 - DNA, 15 bp, Homo sapiens
agccagtaatcttta

SEQ ID NO: 902391 - DNA, 21 bp, Homo sapiens
agccagtcatggaatcttgct

SEQ ID NO: 902392 - DNA, 12 bp, Homo sapiens
agccagtctcag

SEQ ID NO: 902393 - DNA, 19 bp, Homo sapiens
agccagtctcagagaccag

SEQ ID NO: 902394 - DNA, 20 bp, Homo sapiens
agccagtctcagagaccagc

SEQ ID NO: 902395 - DNA, 22 bp, Homo sapiens
agccagtctcagagaccagcac

SEQ ID NO: 902396 - DNA, 23 bp, Homo sapiens
agccagtctcagagaccagcact

SEQ ID NO: 902397 - DNA, 13 bp, Homo sapiens
agccagtgaagga

SEQ ID NO: 902398 - DNA, 18 bp, Homo sapiens
agccagtgaaggagccac

SEQ ID NO: 902399 - DNA, 13 bp, Homo sapiens
agccagtgacttt

SEQ ID NO: 902400 - DNA, 14 bp, Homo sapiens
agccagtgactttt

SEQ ID NO: 902401 - DNA, 16 bp, Homo sapiens
agccagtgagggcagt

SEQ ID NO: 902402 - DNA, 19 bp, Homo sapiens
agccagtggagctggtctg

SEQ ID NO: 902403 - DNA, 16 bp, Homo sapiens
agccagtggcacagga

SEQ ID NO: 902404 - DNA, 16 bp, Homo sapiens
agccagttaaggaaag

SEQ ID NO: 902405 - DNA, 17 bp, Homo sapiens
agccagttaaggaaaga

SEQ ID NO: 902406 - DNA, 18 bp, Homo sapiens
agccagttaaggaaagaa

SEQ ID NO: 902407 - DNA, 20 bp, Homo sapiens
agccagttctccttccctgc

SEQ ID NO: 902408 - DNA, 18 bp, Homo sapiens
agccagttggatctctgg

SEQ ID NO: 902409 - DNA, 14 bp, Homo sapiens
agccagttgtccta

SEQ ID NO: 902410 - DNA, 20 bp, Homo sapiens
agccagttgtcctatggaca

SEQ ID NO: 902411 - DNA, 21 bp, Homo sapiens
agccagtttgccggatacaaa

SEQ ID NO: 902412 - DNA, 16 bp, Homo sapiens
agccataaaagcattg

SEQ ID NO: 902413 - DNA, 17 bp, Homo sapiens
agccataaaagcattgt

SEQ ID NO: 902414 - DNA, 20 bp, Homo sapiens
agccataacgtgcccccaga

SEQ ID NO: 902415 - DNA, 13 bp, Homo sapiens
agccataataaaa

SEQ ID NO: 902416 - DNA, 12 bp, Homo sapiens
agccataatttt

SEQ ID NO: 902417 - DNA, 16 bp, Homo sapiens
agccataattttgcat

SEQ ID NO: 902418 - DNA, 16 bp, Homo sapiens
agccatacataaaaga

SEQ ID NO: 902419 - DNA, 22 bp, Homo sapiens
agccataccgaccatcgtccag

SEQ ID NO: 902420 - DNA, 17 bp, Homo sapiens
agccataggcccaggat

SEQ ID NO: 902421 - DNA, 21 bp, Homo sapiens
agccatagggggctgcacggg

SEQ ID NO: 902422 - DNA, 22 bp, Homo sapiens
agccatagggggctgcacggga

SEQ ID NO: 902423 - DNA, 16 bp, Homo sapiens
agccatattaattgcc

SEQ ID NO: 902424 - DNA, 18 bp, Homo sapiens
agccatattaattgcctg

SEQ ID NO: 902425 - DNA, 20 bp, Homo sapiens
agccatattaattgcctgtt

SEQ ID NO: 902426 - DNA, 18 bp, Homo sapiens
agccatattcacacctca

SEQ ID NO: 902427 - DNA, 19 bp, Homo sapiens
agccatattccagcagtga

SEQ ID NO: 902428 - DNA, 16 bp, Homo sapiens
agccatcaaaatgctt

SEQ ID NO: 902429 - DNA, 18 bp, Homo sapiens
agccatcaacaagagttg

SEQ ID NO: 902430 - DNA, 15 bp, Homo sapiens
agccatcaccctcac

SEQ ID NO: 902431 - DNA, 18 bp, Homo sapiens
agccatcactagaagaaa

SEQ ID NO: 902432 - DNA, 20 bp, Homo sapiens
agccatcactagaagaaaag

SEQ ID NO: 902433 - DNA, 17 bp, Homo sapiens
agccatcacttctcccc

SEQ ID NO: 902434 - DNA, 19 bp, Homo sapiens
agccatcacttctccccgc

SEQ ID NO: 902435 - DNA, 17 bp, Homo sapiens
agccatcccgcttagcc

SEQ ID NO: 902436 - DNA, 20 bp, Homo sapiens
agccatcccgcttagcctgc

SEQ ID NO: 902437 - DNA, 21 bp, Homo sapiens
agccatcccgcttagcctgcc

SEQ ID NO: 902438 - DNA, 22 bp, Homo sapiens
agccatcccgcttagcctgcct

SEQ ID NO: 902439 - DNA, 23 bp, Homo sapiens
agccatcccgcttagcctgcctc

SEQ ID NO: 902440 - DNA, 15 bp, Homo sapiens
agccatcccttgggg

SEQ ID NO: 902441 - DNA, 19 bp, Homo sapiens
agccatcccttggggaagg

SEQ ID NO: 902442 - DNA, 15 bp, Homo sapiens
agccatcctccctcc

SEQ ID NO: 902443 - DNA, 16 bp, Homo sapiens
agccatcctccctcca

SEQ ID NO: 902444 - DNA, 22 bp, Homo sapiens
agccatcggtgaaactaacaga

SEQ ID NO: 902445 - DNA, 18 bp, Homo sapiens
agccatcgtcctgggact

SEQ ID NO: 902446 - DNA, 22 bp, Homo sapiens
agccatcgtcctgggactcgga

SEQ ID NO: 902447 - DNA, 23 bp, Homo sapiens
agccatctaatgcttgtttatga

SEQ ID NO: 902448 - DNA, 23 bp, Homo sapiens
agccatctcatgaggggagagga

SEQ ID NO: 902449 - DNA, 16 bp, Homo sapiens
agccatctgacagcag

SEQ ID NO: 902450 - DNA, 15 bp, Homo sapiens
agccatctgcccagg

SEQ ID NO: 902451 - DNA, 19 bp, Homo sapiens
agccatgaggagttgctgt

SEQ ID NO: 902452 - DNA, 20 bp, Homo sapiens
agccatgaggagttgctgtt

SEQ ID NO: 902453 - DNA, 19 bp, Homo sapiens
agccatgatttgtcccagc

SEQ ID NO: 902454 - DNA, 21 bp, Homo sapiens
agccatgatttgtcccagcct

SEQ ID NO: 902455 - DNA, 15 bp, Homo sapiens
agccatgattttcta

SEQ ID NO: 902456 - DNA, 16 bp, Homo sapiens
agccatgattttctaa

SEQ ID NO: 902457 - DNA, 21 bp, Homo sapiens
agccatgccagctggcctttg

SEQ ID NO: 902458 - DNA, 16 bp, Homo sapiens
agccatgccaggctgc

SEQ ID NO: 902459 - DNA, 16 bp, Homo sapiens
agccatgcctccctgg

SEQ ID NO: 902460 - DNA, 16 bp, Homo sapiens
agccatgcgccccctc

SEQ ID NO: 902461 - DNA, 16 bp, Homo sapiens
agccatggaaggtgcc

SEQ ID NO: 902462 - DNA, 19 bp, Homo sapiens
agccatggaaggtgccaga

SEQ ID NO: 902463 - DNA, 20 bp, Homo sapiens
agccatggagattctcataa

SEQ ID NO: 902464 - DNA, 22 bp, Homo sapiens
agccatggagattctcataact

SEQ ID NO: 902465 - DNA, 15 bp, Homo sapiens
agccatggctcaggc

SEQ ID NO: 902466 - DNA, 21 bp, Homo sapiens
agccatggctcaggcaagccc

SEQ ID NO: 902467 - DNA, 14 bp, Homo sapiens
agccatgggcctgg

SEQ ID NO: 902468 - DNA, 15 bp, Homo sapiens
agccatgggcctggg

SEQ ID NO: 902469 - DNA, 20 bp, Homo sapiens
agccatgggcctgggcctgc

SEQ ID NO: 902470 - DNA, 21 bp, Homo sapiens
agccatgggcctgggcctgct

SEQ ID NO: 902471 - DNA, 17 bp, Homo sapiens
agccatgtagccaccca

SEQ ID NO: 902472 - DNA, 20 bp, Homo sapiens
agccatgtatttcagggacc

SEQ ID NO: 902473 - DNA, 21 bp, Homo sapiens
agccatgtatttcagggacct

SEQ ID NO: 902474 - DNA, 22 bp, Homo sapiens
agccatgtatttcagggacctc

SEQ ID NO: 902475 - DNA, 23 bp, Homo sapiens
agccatgtccaagttcttcacct

SEQ ID NO: 902476 - DNA, 14 bp, Homo sapiens
agccattaaaataa

SEQ ID NO: 902477 - DNA, 22 bp, Homo sapiens
agccattaaaataaaacaagcc

SEQ ID NO: 902478 - DNA, 14 bp, Homo sapiens
agccattcactgcc

SEQ ID NO: 902479 - DNA, 13 bp, Homo sapiens
agccattcttcag

SEQ ID NO: 902480 - DNA, 12 bp, Homo sapiens
agccattctttt

SEQ ID NO: 902481 - DNA, 14 bp, Homo sapiens
agccattgaacagc

SEQ ID NO: 902482 - DNA, 20 bp, Homo sapiens
agccattgaacagctgtgag

SEQ ID NO: 902483 - DNA, 22 bp, Homo sapiens
agccattggctatttaaaactt

SEQ ID NO: 902484 - DNA, 18 bp, Homo sapiens
agccattgttggctttcc

SEQ ID NO: 902485 - DNA, 21 bp, Homo sapiens
agccatttatacctttgaaat

SEQ ID NO: 902486 - DNA, 22 bp, Homo sapiens
agccatttatacctttgaaata

SEQ ID NO: 902487 - DNA, 16 bp, Homo sapiens
agccatttccccctcc

SEQ ID NO: 902488 - DNA, 18 bp, Homo sapiens
agccatttctccatgggc

SEQ ID NO: 902489 - DNA, 17 bp, Homo sapiens
agccatttgttggggca

SEQ ID NO: 902490 - DNA, 12 bp, Homo sapiens
agccatttttag

SEQ ID NO: 902491 - DNA, 13 bp, Homo sapiens
agccatttttaga

SEQ ID NO: 902492 - DNA, 19 bp, Homo sapiens
agccatttttcaaagcaat

SEQ ID NO: 902493 - DNA, 16 bp, Homo sapiens
agcccaaaccttgggc

SEQ ID NO: 902494 - DNA, 20 bp, Homo sapiens
agcccaaagtggtatagaaa

SEQ ID NO: 902495 - DNA, 20 bp, Homo sapiens
agcccaaattcatataaaag

SEQ ID NO: 902496 - DNA, 23 bp, Homo sapiens
agcccaacagacaccatcttttg

SEQ ID NO: 902497 - DNA, 19 bp, Homo sapiens
agcccaacttccagaggac

SEQ ID NO: 902498 - DNA, 18 bp, Homo sapiens
agcccaagcatcactgcc

SEQ ID NO: 902499 - DNA, 15 bp, Homo sapiens
agcccaagcttccct

SEQ ID NO: 902500 - DNA, 16 bp, Homo sapiens
agcccaaggtcaggga

SEQ ID NO: 902501 - DNA, 23 bp, Homo sapiens
agcccaagttcatgcagctgtgg

SEQ ID NO: 902502 - DNA, 22 bp, Homo sapiens
agcccacaaccttcggctccgg

SEQ ID NO: 902503 - DNA, 17 bp, Homo sapiens
agcccacacttgagagg

SEQ ID NO: 902504 - DNA, 12 bp, Homo sapiens
agcccacagagc

SEQ ID NO: 902505 - DNA, 14 bp, Homo sapiens
agcccacagagcct

SEQ ID NO: 902506 - DNA, 14 bp, Homo sapiens
agcccacagcgagc

SEQ ID NO: 902507 - DNA, 20 bp, Homo sapiens
agcccacagtatattttatt

SEQ ID NO: 902508 - DNA, 18 bp, Homo sapiens
agcccaccaatctgccct

SEQ ID NO: 902509 - DNA, 19 bp, Homo sapiens
agcccaccaatctgccctt

SEQ ID NO: 902510 - DNA, 23 bp, Homo sapiens
agcccaccagacgtcaggccctg

SEQ ID NO: 902511 - DNA, 17 bp, Homo sapiens
agcccaccagccagccc

SEQ ID NO: 902512 - DNA, 17 bp, Homo sapiens
agcattgctttctgaaa

SEQ ID NO: 902513 - DNA, 17 bp, Homo sapiens
agcattggcccctgagc

SEQ ID NO: 902514 - DNA, 17 bp, Homo sapiens
agcattgtaaaagcatt

SEQ ID NO: 902515 - DNA, 20 bp, Homo sapiens
agcattgtaaaataattctg

SEQ ID NO: 902516 - DNA, 21 bp, Homo sapiens
agcattgtctcgtgtacagct

SEQ ID NO: 902517 - DNA, 17 bp, Homo sapiens
agcattgtctttgctgt

SEQ ID NO: 902518 - DNA, 17 bp, Homo sapiens
agcattgtgaactgaca

SEQ ID NO: 902519 - DNA, 12 bp, Homo sapiens
agcattgttcca

SEQ ID NO: 902520 - DNA, 23 bp, Homo sapiens
agcattgttccacacatttaaaa

SEQ ID NO: 902521 - DNA, 16 bp, Homo sapiens
agcattgtttcaaaat

SEQ ID NO: 902522 - DNA, 21 bp, Homo sapiens
agcattgtttgcttattgttc

SEQ ID NO: 902523 - DNA, 13 bp, Homo sapiens
agcatttaaaatg

SEQ ID NO: 902524 - DNA, 21 bp, Homo sapiens
agcatttaacccccctgtaca

SEQ ID NO: 902525 - DNA, 23 bp, Homo sapiens
agcatttaacccccctgtacaca

SEQ ID NO: 902526 - DNA, 15 bp, Homo sapiens
agcatttagaaaact

SEQ ID NO: 902527 - DNA, 21 bp, Homo sapiens
agcatttagcacaatttgaga

SEQ ID NO: 902528 - DNA, 22 bp, Homo sapiens
agcatttagttacaacctgaag

SEQ ID NO: 902529 - DNA, 13 bp, Homo sapiens
agcatttatgttt

SEQ ID NO: 902530 - DNA, 22 bp, Homo sapiens
agcatttcaaagccctgcctct

SEQ ID NO: 902531 - DNA, 23 bp, Homo sapiens
agcatttcaaagccctgcctctg

SEQ ID NO: 902532 - DNA, 20 bp, Homo sapiens
agcatttcttttctggccaa

SEQ ID NO: 902533 - DNA, 13 bp, Homo sapiens
agcatttgccact

SEQ ID NO: 902534 - DNA, 14 bp, Homo sapiens
agcatttgtatatt

SEQ ID NO: 902535 - DNA, 15 bp, Homo sapiens
agcatttgtattatt

SEQ ID NO: 902536 - DNA, 14 bp, Homo sapiens
agcatttgtccttt

SEQ ID NO: 902537 - DNA, 19 bp, Homo sapiens
agcattttaaacaaaatag

SEQ ID NO: 902538 - DNA, 17 bp, Homo sapiens
agcattttaattctctc

SEQ ID NO: 902539 - DNA, 18 bp, Homo sapiens
agcattttagaaactaca

SEQ ID NO: 902540 - DNA, 20 bp, Homo sapiens
agcattttagaaactacaaa

SEQ ID NO: 902541 - DNA, 14 bp, Homo sapiens
agcattttcctgtt

SEQ ID NO: 902542 - DNA, 14 bp, Homo sapiens
agcattttgaaaca

SEQ ID NO: 902543 - DNA, 18 bp, Homo sapiens
agcattttgaaacaaagt

SEQ ID NO: 902544 - DNA, 20 bp, Homo sapiens
agcattttgggatccttcag

SEQ ID NO: 902545 - DNA, 17 bp, Homo sapiens
agcattttgtaagttga

SEQ ID NO: 902546 - DNA, 15 bp, Homo sapiens
agcattttgtatttg

SEQ ID NO: 902547 - DNA, 16 bp, Homo sapiens
agcatttttatgcaga

SEQ ID NO: 902548 - DNA, 17 bp, Homo sapiens
agcatttttatgcagac

SEQ ID NO: 902549 - DNA, 16 bp, Homo sapiens
agcatttttcaatata

SEQ ID NO: 902550 - DNA, 13 bp, Homo sapiens
agcatttttccat

SEQ ID NO: 902551 - DNA, 23 bp, Homo sapiens
agccaaaaaggcaaataatggaa

SEQ ID NO: 902552 - DNA, 19 bp, Homo sapiens
agccaaacccatgaggcaa

SEQ ID NO: 902553 - DNA, 20 bp, Homo sapiens
agccaaagaaatgggcctgc

SEQ ID NO: 902554 - DNA, 13 bp, Homo sapiens
agccaaagccagg

SEQ ID NO: 902555 - DNA, 15 bp, Homo sapiens
agccaaaggggagcc

SEQ ID NO: 902556 - DNA, 16 bp, Homo sapiens
agccaaaggggagcca

SEQ ID NO: 902557 - DNA, 17 bp, Homo sapiens
agccaaaggggagccag

SEQ ID NO: 902558 - DNA, 15 bp, Homo sapiens
agccaaagtttctgt

SEQ ID NO: 902559 - DNA, 17 bp, Homo sapiens
agccaaagtttctgttg

SEQ ID NO: 902560 - DNA, 19 bp, Homo sapiens
agccaaagtttctgttgaa

SEQ ID NO: 902561 - DNA, 17 bp, Homo sapiens
agccaaagttttcaaac

SEQ ID NO: 902562 - DNA, 22 bp, Homo sapiens
agccaaatgcagggaggggagg

SEQ ID NO: 902563 - DNA, 23 bp, Homo sapiens
agccaaatgcagggaggggaggc

SEQ ID NO: 902564 - DNA, 12 bp, Homo sapiens
agccaaatttaa

SEQ ID NO: 902565 - DNA, 13 bp, Homo sapiens
agccaaatttaaa

SEQ ID NO: 902566 - DNA, 13 bp, Homo sapiens
agccaaatttcct

SEQ ID NO: 902567 - DNA, 20 bp, Homo sapiens
agcactttaaccctctcttc

SEQ ID NO: 902568 - DNA, 19 bp, Homo sapiens
agcactttgaaaatatttc

SEQ ID NO: 902569 - DNA, 20 bp, Homo sapiens
agcactttgaaaatatttct

SEQ ID NO: 902570 - DNA, 23 bp, Homo sapiens
agcactttgaaaatatttctatg

SEQ ID NO: 902571 - DNA, 11 bp, Homo sapiens
agcactttgat

SEQ ID NO: 902572 - DNA, 21 bp, Homo sapiens
agcactttgattgaagtattc

SEQ ID NO: 902573 - DNA, 16 bp, Homo sapiens
agcactttgcacttaa

SEQ ID NO: 902574 - DNA, 21 bp, Homo sapiens
agcactttgggaggccaaggt

SEQ ID NO: 902575 - DNA, 22 bp, Homo sapiens
agcactttgggaggccaaggtg

SEQ ID NO: 902576 - DNA, 22 bp, Homo sapiens
agcagaaaacccttgggccaga

SEQ ID NO: 902577 - DNA, 18 bp, Homo sapiens
agcagaaaggcacgtcca

SEQ ID NO: 902578 - DNA, 22 bp, Homo sapiens
agcagaaagtgcctttatctca

SEQ ID NO: 902579 - DNA, 11 bp, Homo sapiens
agcagaaatgc

SEQ ID NO: 902580 - DNA, 20 bp, Homo sapiens
agcagaaatgcccccattct

SEQ ID NO: 902581 - DNA, 13 bp, Homo sapiens
agcagaaatgcct

SEQ ID NO: 902582 - DNA, 14 bp, Homo sapiens
agcagaacaaatgt

SEQ ID NO: 902583 - DNA, 15 bp, Homo sapiens
agcagaacaaatgtg

SEQ ID NO: 902584 - DNA, 16 bp, Homo sapiens
agcagaacaaatgtgt

SEQ ID NO: 902585 - DNA, 21 bp, Homo sapiens
agcagaacaaatgtgtttttc

SEQ ID NO: 902586 - DNA, 14 bp, Homo sapiens
agcagaacaggtag

SEQ ID NO: 902587 - DNA, 16 bp, Homo sapiens
agcagaacctgcacac

SEQ ID NO: 902588 - DNA, 23 bp, Homo sapiens
agcagaacctgcacacaggacag

SEQ ID NO: 902589 - DNA, 18 bp, Homo sapiens
agcagaagcagggtaccc

SEQ ID NO: 902590 - DNA, 16 bp, Homo sapiens
agcagaagtggagctg

SEQ ID NO: 902591 - DNA, 18 bp, Homo sapiens
agcagaatactggtctca

SEQ ID NO: 902592 - DNA, 18 bp, Homo sapiens
agcagaatggagaaagta

SEQ ID NO: 902593 - DNA, 19 bp, Homo sapiens
agcagaatgttgtacttga

SEQ ID NO: 902594 - DNA, 21 bp, Homo sapiens
agcagaatgttgtacttgaaa

SEQ ID NO: 902595 - DNA, 16 bp, Homo sapiens
agcagaattcattcat

SEQ ID NO: 902596 - DNA, 13 bp, Homo sapiens
agcagaattttaa

SEQ ID NO: 902597 - DNA, 14 bp, Homo sapiens
agcagaattttaat

SEQ ID NO: 902598 - DNA, 18 bp, Homo sapiens
agcagaattttaatgtga

SEQ ID NO: 902599 - DNA, 13 bp, Homo sapiens
agcagacagaaac

SEQ ID NO: 902600 - DNA, 15 bp, Homo sapiens
agcagacagaaactg

SEQ ID NO: 902601 - DNA, 16 bp, Homo sapiens
agcagacagaaactgg

SEQ ID NO: 902602 - DNA, 14 bp, Homo sapiens
agcagacagagcca

SEQ ID NO: 902603 - DNA, 20 bp, Homo sapiens
agcagacaggcctggccctg

SEQ ID NO: 902604 - DNA, 11 bp, Homo sapiens
agcagacattt

SEQ ID NO: 902605 - DNA, 22 bp, Homo sapiens
agcagacccatacctttccagg

SEQ ID NO: 902606 - DNA, 14 bp, Homo sapiens
agcagactccagcc

SEQ ID NO: 902607 - DNA, 17 bp, Homo sapiens
agcagactccagcccct

SEQ ID NO: 902608 - DNA, 19 bp, Homo sapiens
agcagactccagcccctgg

SEQ ID NO: 902609 - DNA, 20 bp, Homo sapiens
agcagactccagcccctgga

SEQ ID NO: 902610 - DNA, 19 bp, Homo sapiens
agcagagagagaggacaga

SEQ ID NO: 902611 - DNA, 19 bp, Homo sapiens
agcagagagagccagacag

SEQ ID NO: 902612 - DNA, 14 bp, Homo sapiens
agcagagagccctg

SEQ ID NO: 902613 - DNA, 15 bp, Homo sapiens
agcagagatgtactg

SEQ ID NO: 902614 - DNA, 18 bp, Homo sapiens
agcagagcaaatgaggga

SEQ ID NO: 902615 - DNA, 15 bp, Homo sapiens
agcagagcaggggca

SEQ ID NO: 902616 - DNA, 14 bp, Homo sapiens
agcagagccaaggc

SEQ ID NO: 902617 - DNA, 18 bp, Homo sapiens
agcagagcccaccagcca

SEQ ID NO: 902618 - DNA, 11 bp, Homo sapiens
agcagagccta

SEQ ID NO: 902619 - DNA, 13 bp, Homo sapiens
agcagaggagctg

SEQ ID NO: 902620 - DNA, 16 bp, Homo sapiens
agcagaggcaggctgg

SEQ ID NO: 902621 - DNA, 14 bp, Homo sapiens
agcagaggcagtgg

SEQ ID NO: 902622 - DNA, 18 bp, Homo sapiens
agcagagggactttgtat

SEQ ID NO: 902623 - DNA, 17 bp, Homo sapiens
agcagagggaggaagat

SEQ ID NO: 902624 - DNA, 14 bp, Homo sapiens
agcagaggggctga

SEQ ID NO: 902625 - DNA, 18 bp, Homo sapiens
agcagagggggagtagcc

SEQ ID NO: 902626 - DNA, 14 bp, Homo sapiens
agcagagtctgggc

SEQ ID NO: 902627 - DNA, 19 bp, Homo sapiens
agcagagtctgggcctctg

SEQ ID NO: 902628 - DNA, 21 bp, Homo sapiens
agcagagtctgggcctctgac

SEQ ID NO: 902629 - DNA, 16 bp, Homo sapiens
agcagagtctgtctct

SEQ ID NO: 902630 - DNA, 20 bp, Homo sapiens
agcagagtgggacttggaga

SEQ ID NO: 902631 - DNA, 18 bp, Homo sapiens
agcagagttaaatctcaa

SEQ ID NO: 902632 - DNA, 12 bp, Homo sapiens
agcagagtttac

SEQ ID NO: 902633 - DNA, 22 bp, Homo sapiens
agcagatgctgttgtgaagcta

SEQ ID NO: 902634 - DNA, 14 bp, Homo sapiens
agcagatggacagc

SEQ ID NO: 902635 - DNA, 19 bp, Homo sapiens
agcagatggtttccacatt

SEQ ID NO: 902636 - DNA, 22 bp, Homo sapiens
agcagattttaattttgaataa

SEQ ID NO: 902637 - DNA, 20 bp, Homo sapiens
agcagcaaatgaaagaaccg

SEQ ID NO: 902638 - DNA, 14 bp, Homo sapiens
agcagcaagaagca

SEQ ID NO: 902639 - DNA, 19 bp, Homo sapiens
agcagcaagaagcagcctg

SEQ ID NO: 902640 - DNA, 13 bp, Homo sapiens
agcagcaagtgtg

SEQ ID NO: 902641 - DNA, 14 bp, Homo sapiens
agcagcacaaggaa

SEQ ID NO: 902642 - DNA, 14 bp, Homo sapiens
agcagcacaattct

SEQ ID NO: 902643 - DNA, 15 bp, Homo sapiens
agcagcacaattctg

SEQ ID NO: 902644 - DNA, 13 bp, Homo sapiens
agcagcacctcct

SEQ ID NO: 902645 - DNA, 16 bp, Homo sapiens
agcagcacctttctct

SEQ ID NO: 902646 - DNA, 22 bp, Homo sapiens
agcagcactcaaacctggagct

SEQ ID NO: 902647 - DNA, 15 bp, Homo sapiens
agcagcagagagccc

SEQ ID NO: 902648 - DNA, 15 bp, Homo sapiens
agcagcagaggtgag

SEQ ID NO: 902649 - DNA, 14 bp, Homo sapiens
agcagcagccagca

SEQ ID NO: 902650 - DNA, 17 bp, Homo sapiens
agcagcagccagcacca

SEQ ID NO: 902651 - DNA, 19 bp, Homo sapiens
agcagcagcctttaatgca

SEQ ID NO: 902652 - DNA, 22 bp, Homo sapiens
agcagcagctaggactgaggag

SEQ ID NO: 902653 - DNA, 18 bp, Homo sapiens
agcagcaggatgggctga

SEQ ID NO: 902654 - DNA, 15 bp, Homo sapiens
agcagcaggctcagg

SEQ ID NO: 902655 - DNA, 21 bp, Homo sapiens
agcagcaggtgctgtgcgcct

SEQ ID NO: 902656 - DNA, 16 bp, Homo sapiens
agcagcatcccagcct

SEQ ID NO: 902657 - DNA, 17 bp, Homo sapiens
agcagcatggaaaaatg

SEQ ID NO: 902658 - DNA, 20 bp, Homo sapiens
agcagcatggaaaaatggtt

SEQ ID NO: 902659 - DNA, 18 bp, Homo sapiens
agcagcattctggagggg

SEQ ID NO: 902660 - DNA, 19 bp, Homo sapiens
agcagccacacttccttta

SEQ ID NO: 902661 - DNA, 13 bp, Homo sapiens
agcagccacgagg

SEQ ID NO: 902662 - DNA, 13 bp, Homo sapiens
agcagccagagct

SEQ ID NO: 902663 - DNA, 14 bp, Homo sapiens
agcagccagagctg

SEQ ID NO: 902664 - DNA, 12 bp, Homo sapiens
agcagccagcac

SEQ ID NO: 902665 - DNA, 13 bp, Homo sapiens
agcagccagcacc

SEQ ID NO: 902666 - DNA, 15 bp, Homo sapiens
agcagccagccagtc

SEQ ID NO: 902667 - DNA, 16 bp, Homo sapiens
agcagccagccagtct

SEQ ID NO: 902668 - DNA, 17 bp, Homo sapiens
agcagccagctctcagc

SEQ ID NO: 902669 - DNA, 23 bp, Homo sapiens
agcagccagctctcagccaacga

SEQ ID NO: 902670 - DNA, 15 bp, Homo sapiens
agcagccaggacccg

SEQ ID NO: 902671 - DNA, 15 bp, Homo sapiens
agcagccaggaggga

SEQ ID NO: 902672 - DNA, 16 bp, Homo sapiens
agcagccaggagggac

SEQ ID NO: 902673 - DNA, 15 bp, Homo sapiens
agcagccagtctcag

SEQ ID NO: 902674 - DNA, 18 bp, Homo sapiens
agcagccagtctcagaga

SEQ ID NO: 902675 - DNA, 19 bp, Homo sapiens
agcagccagtctcagagac

SEQ ID NO: 902676 - DNA, 19 bp, Homo sapiens
agcagccatcataggaagg

SEQ ID NO: 902677 - DNA, 12 bp, Homo sapiens
agcagcccagct

SEQ ID NO: 902678 - DNA, 13 bp, Homo sapiens
agcagccccccag

SEQ ID NO: 902679 - DNA, 22 bp, Homo sapiens
agcagcccccgggccgctggct

SEQ ID NO: 902680 - DNA, 18 bp, Homo sapiens
agcagcccctcgaggcct

SEQ ID NO: 902681 - DNA, 17 bp, Homo sapiens
agcagccctcctcaccc

SEQ ID NO: 902682 - DNA, 17 bp, Homo sapiens
agcagccctctgcctcc

SEQ ID NO: 902683 - DNA, 12 bp, Homo sapiens
agcagcccttgt

SEQ ID NO: 902684 - DNA, 14 bp, Homo sapiens
agcagcccttgtgt

SEQ ID NO: 902685 - DNA, 19 bp, Homo sapiens
agcagcccttgtgtgtgcc

SEQ ID NO: 902686 - DNA, 22 bp, Homo sapiens
agcagcccttgtgtgtgccctg

SEQ ID NO: 902687 - DNA, 22 bp, Homo sapiens
agcagcctcaaaacgggtcagt

SEQ ID NO: 902688 - DNA, 20 bp, Homo sapiens
agcagcctcagagtggtcga

SEQ ID NO: 902689 - DNA, 12 bp, Homo sapiens
agcagcctcgag

SEQ ID NO: 902690 - DNA, 16 bp, Homo sapiens
agcagcctcgaggctg

SEQ ID NO: 902691 - DNA, 17 bp, Homo sapiens
agcagcctcgaggctgg

SEQ ID NO: 902692 - DNA, 18 bp, Homo sapiens
agcagcctcgaggctggt

SEQ ID NO: 902693 - DNA, 21 bp, Homo sapiens
agcacatgtctgtcctcagag

SEQ ID NO: 902694 - DNA, 19 bp, Homo sapiens
agcaccaaaataagaaaag

SEQ ID NO: 902695 - DNA, 13 bp, Homo sapiens
agcaccacactgg

SEQ ID NO: 902696 - DNA, 15 bp, Homo sapiens
agcaccactgctgag

SEQ ID NO: 902697 - DNA, 16 bp, Homo sapiens
agcaccactgctgagg

SEQ ID NO: 902698 - DNA, 17 bp, Homo sapiens
agcaccagcttctccag

SEQ ID NO: 902699 - DNA, 18 bp, Homo sapiens
agcaccagcttctccagg

SEQ ID NO: 902700 - DNA, 14 bp, Homo sapiens
agcacccagagcac

SEQ ID NO: 902701 - DNA, 14 bp, Homo sapiens
agcacccatttcaa

SEQ ID NO: 902702 - DNA, 21 bp, Homo sapiens
agcacccatttcaatgtgtat

SEQ ID NO: 902703 - DNA, 15 bp, Homo sapiens
agcacccccaagcct

SEQ ID NO: 902704 - DNA, 17 bp, Homo sapiens
agcacccccaagcctgg

SEQ ID NO: 902705 - DNA, 14 bp, Homo sapiens
agcacccccaccca

SEQ ID NO: 902706 - DNA, 17 bp, Homo sapiens
agcacccccacccacct

SEQ ID NO: 902707 - DNA, 20 bp, Homo sapiens
agcacccccacccacctcca

SEQ ID NO: 902708 - DNA, 21 bp, Homo sapiens
agcaccccctcattcccctcg

SEQ ID NO: 902709 - DNA, 22 bp, Homo sapiens
agcaccccgaagggagcatctg

SEQ ID NO: 902710 - DNA, 23 bp, Homo sapiens
agcaccccgaagggagcatctgt

SEQ ID NO: 902711 - DNA, 23 bp, Homo sapiens
agcaccccgcttttgcagcagag

SEQ ID NO: 902712 - DNA, 16 bp, Homo sapiens
agcacccctctctgca

SEQ ID NO: 902713 - DNA, 13 bp, Homo sapiens
agcaccctccccc

SEQ ID NO: 902714 - DNA, 18 bp, Homo sapiens
agcaccctcccccgcagc

SEQ ID NO: 902715 - DNA, 12 bp, Homo sapiens
agcaccctctcc

SEQ ID NO: 902716 - DNA, 13 bp, Homo sapiens
agcaccctctcct

SEQ ID NO: 902717 - DNA, 15 bp, Homo sapiens
agcaccctctcctgg

SEQ ID NO: 902718 - DNA, 16 bp, Homo sapiens
agcaccctctcctggg

SEQ ID NO: 902719 - DNA, 12 bp, Homo sapiens
agcaccctgggt

SEQ ID NO: 902720 - DNA, 14 bp, Homo sapiens
agcaccctgggtgc

SEQ ID NO: 902721 - DNA, 17 bp, Homo sapiens
agcaccctgggtgccat

SEQ ID NO: 902722 - DNA, 22 bp, Homo sapiens
agcacccttctcggagacccat

SEQ ID NO: 902723 - DNA, 21 bp, Homo sapiens
agcaccgataataggtagcct

SEQ ID NO: 902724 - DNA, 21 bp, Homo sapiens
agcaccgcttttgttctcgca

SEQ ID NO: 902725 - DNA, 16 bp, Homo sapiens
agcaccgtgccaaccc

SEQ ID NO: 902726 - DNA, 17 bp, Homo sapiens
agcaccgttctgtgcac

SEQ ID NO: 902727 - DNA, 23 bp, Homo sapiens
agcacctactatgtgctgggtgc

SEQ ID NO: 902728 - DNA, 16 bp, Homo sapiens
agcacctccaaccaaa

SEQ ID NO: 902729 - DNA, 22 bp, Homo sapiens
agcacctccaaccaaataagac

SEQ ID NO: 902730 - DNA, 16 bp, Homo sapiens
agcacctccagcctga

SEQ ID NO: 902731 - DNA, 20 bp, Homo sapiens
agcacctccagcctgaacag

SEQ ID NO: 902732 - DNA, 15 bp, Homo sapiens
agcacctgaacccca

SEQ ID NO: 902733 - DNA, 21 bp, Homo sapiens
agcacctgaaccccatgggct

SEQ ID NO: 902734 - DNA, 15 bp, Homo sapiens
agcacctgccgacct

SEQ ID NO: 902735 - DNA, 16 bp, Homo sapiens
agcacctgccgacctc

SEQ ID NO: 902736 - DNA, 18 bp, Homo sapiens
agcacctgcctcctcgtt

SEQ ID NO: 902737 - DNA, 18 bp, Homo sapiens
agcacctggaccccctgc

SEQ ID NO: 902738 - DNA, 20 bp, Homo sapiens
agcacctggaccccctgccc

SEQ ID NO: 902739 - DNA, 19 bp, Homo sapiens
agcacctgggccccactgg

SEQ ID NO: 902740 - DNA, 14 bp, Homo sapiens
agcaccttcagggc

SEQ ID NO: 902741 - DNA, 16 bp, Homo sapiens
agcaccttcagggctg

SEQ ID NO: 902742 - DNA, 22 bp, Homo sapiens
agcaccttcagggctgagttct

SEQ ID NO: 902743 - DNA, 20 bp, Homo sapiens
agcaccttcctcacttccat

SEQ ID NO: 902744 - DNA, 20 bp, Homo sapiens
agcaccttctttctggactg

SEQ ID NO: 902745 - DNA, 22 bp, Homo sapiens
agcaccttctttctggactggc

SEQ ID NO: 902746 - DNA, 17 bp, Homo sapiens
agcacctttctctgaga

SEQ ID NO: 902747 - DNA, 17 bp, Homo sapiens
agcacgaaatgttattt

SEQ ID NO: 902748 - DNA, 17 bp, Homo sapiens
agcacgatttctgttta

SEQ ID NO: 902749 - DNA, 13 bp, Homo sapiens
agcacgcctgcca

SEQ ID NO: 902750 - DNA, 18 bp, Homo sapiens
agcacgctgcctgccaaa

SEQ ID NO: 902751 - DNA, 15 bp, Homo sapiens
agcacggcccggccc

SEQ ID NO: 902752 - DNA, 18 bp, Homo sapiens
agcacggcccggcccctc

SEQ ID NO: 902753 - DNA, 19 bp, Homo sapiens
agcacggcccggcccctca

SEQ ID NO: 902754 - DNA, 13 bp, Homo sapiens
agcacgtggagat

SEQ ID NO: 902755 - DNA, 14 bp, Homo sapiens
agcacgtggagata

SEQ ID NO: 902756 - DNA, 16 bp, Homo sapiens
agcactaaagcagtgg

SEQ ID NO: 902757 - DNA, 19 bp, Homo sapiens
agcactaaccaatgccttt

SEQ ID NO: 902758 - DNA, 16 bp, Homo sapiens
agcactaacgtaaata

SEQ ID NO: 902759 - DNA, 20 bp, Homo sapiens
agcactactgggtgtcattt

SEQ ID NO: 902760 - DNA, 22 bp, Homo sapiens
agcactactgggtgtcatttca

SEQ ID NO: 902761 - DNA, 15 bp, Homo sapiens
agcactagtttgatt

SEQ ID NO: 902762 - DNA, 22 bp, Homo sapiens
agcactagtttgattattatgt

SEQ ID NO: 902763 - DNA, 23 bp, Homo sapiens
agcactagtttgattattatgtt

SEQ ID NO: 902764 - DNA, 20 bp, Homo sapiens
agcactattttatatttaaa

SEQ ID NO: 902765 - DNA, 16 bp, Homo sapiens
agcactcacacaggac

SEQ ID NO: 902766 - DNA, 18 bp, Homo sapiens
agcactcacgccctaagc

SEQ ID NO: 902767 - DNA, 14 bp, Homo sapiens
agcactcagcctca

SEQ ID NO: 902768 - DNA, 18 bp, Homo sapiens
agcactccccagagctgt

SEQ ID NO: 902769 - DNA, 22 bp, Homo sapiens
agcactccccagagctgtgcca

SEQ ID NO: 902770 - DNA, 23 bp, Homo sapiens
agcactcccgctgcacacagacg

SEQ ID NO: 902771 - DNA, 22 bp, Homo sapiens
agcactcccttaggcattattt

SEQ ID NO: 902772 - DNA, 20 bp, Homo sapiens
agcactccgcatcacctcac

SEQ ID NO: 902773 - DNA, 22 bp, Homo sapiens
agcactccgcatcacctcacca

SEQ ID NO: 902774 - DNA, 17 bp, Homo sapiens
agcactcctcaagactt

SEQ ID NO: 902775 - DNA, 19 bp, Homo sapiens
agcactcctcaagactttg

SEQ ID NO: 902776 - DNA, 20 bp, Homo sapiens
agcactcctcaagactttga

SEQ ID NO: 902777 - DNA, 18 bp, Homo sapiens
agcactcgagaccatcct

SEQ ID NO: 902778 - DNA, 20 bp, Homo sapiens
agcactcgagaccatcctgg

SEQ ID NO: 902779 - DNA, 21 bp, Homo sapiens
agcactcgagaccatcctggc

SEQ ID NO: 902780 - DNA, 15 bp, Homo sapiens
agcactctcacccca

SEQ ID NO: 902781 - DNA, 13 bp, Homo sapiens
agcactgacctgt

SEQ ID NO: 902782 - DNA, 11 bp, Homo sapiens
agcactgagca

SEQ ID NO: 902783 - DNA, 22 bp, Homo sapiens
agcactgatagtcctttttcca

SEQ ID NO: 902784 - DNA, 14 bp, Homo sapiens
agcactgcctcctg

SEQ ID NO: 902785 - DNA, 15 bp, Homo sapiens
agcactgcctcctgt

SEQ ID NO: 902786 - DNA, 21 bp, Homo sapiens
agcactgcctcctgttttctc

SEQ ID NO: 902787 - DNA, 23 bp, Homo sapiens
agcactgcctctatgccctgcag

SEQ ID NO: 902788 - DNA, 21 bp, Homo sapiens
agcactgctaggcgagtgcca

SEQ ID NO: 902789 - DNA, 17 bp, Homo sapiens
agcactggagtgcaggg

SEQ ID NO: 902790 - DNA, 22 bp, Homo sapiens
agcactggagtgcagggaggag

SEQ ID NO: 902791 - DNA, 23 bp, Homo sapiens
agcactggagtgcagggaggaga

SEQ ID NO: 902792 - DNA, 16 bp, Homo sapiens
agcactggccagagag

SEQ ID NO: 902793 - DNA, 16 bp, Homo sapiens
agcactgtcccttgcc

SEQ ID NO: 902794 - DNA, 15 bp, Homo sapiens
agcactgttcacatc

SEQ ID NO: 902795 - DNA, 15 bp, Homo sapiens
agcactgttgatgta

SEQ ID NO: 902796 - DNA, 17 bp, Homo sapiens
agcactgttgatgtatc

SEQ ID NO: 902797 - DNA, 18 bp, Homo sapiens
agcactgttgatgtatct

SEQ ID NO: 902798 - DNA, 13 bp, Homo sapiens
agcacttaagaga

SEQ ID NO: 902799 - DNA, 17 bp, Homo sapiens
agcacttaagagaatat

SEQ ID NO: 902800 - DNA, 15 bp, Homo sapiens
agcacttatttaatg

SEQ ID NO: 902801 - DNA, 14 bp, Homo sapiens
agcacttctagaat

SEQ ID NO: 902802 - DNA, 23 bp, Homo sapiens
agcacttgaccttttcgacgctt

SEQ ID NO: 902803 - DNA, 22 bp, Homo sapiens
agcacttgagaaccagtctcct

SEQ ID NO: 902804 - DNA, 13 bp, Homo sapiens
agcacttgcctgg

SEQ ID NO: 902805 - DNA, 21 bp, Homo sapiens
agcacttgcctggaataaaat

SEQ ID NO: 902806 - DNA, 14 bp, Homo sapiens
agcacttgcgtcct

SEQ ID NO: 902807 - DNA, 17 bp, Homo sapiens
agcacttgcgtcctgca

SEQ ID NO: 902808 - DNA, 14 bp, Homo sapiens
agcacttggagcca

SEQ ID NO: 902809 - DNA, 17 bp, Homo sapiens
agcacttggagccaagg

SEQ ID NO: 902810 - DNA, 22 bp, Homo sapiens
agcacttgggggttcaggcccg

SEQ ID NO: 902811 - DNA, 12 bp, Homo sapiens
agcacttgtata

SEQ ID NO: 902812 - DNA, 15 bp, Homo sapiens
agcacttgttttaaa

SEQ ID NO: 902813 - DNA, 17 bp, Homo sapiens
agcacttgttttaaaat

SEQ ID NO: 902814 - DNA, 21 bp, Homo sapiens
agcacttgttttaaaatgcag

SEQ ID NO: 902815 - DNA, 18 bp, Homo sapiens
agcactttaaagaggctg

SEQ ID NO: 902816 - DNA, 19 bp, Homo sapiens
agcactttaaccctctctt

SEQ ID NO: 902817 - DNA, 14 bp, Homo sapiens
agcaagccagacct

SEQ ID NO: 902818 - DNA, 14 bp, Homo sapiens
agcaagccatcatc

SEQ ID NO: 902819 - DNA, 20 bp, Homo sapiens
agcaagccctacagagctgt

SEQ ID NO: 902820 - DNA, 15 bp, Homo sapiens
agcaagcgggagccc

SEQ ID NO: 902821 - DNA, 19 bp, Homo sapiens
agcaaggaaatgtcctgca

SEQ ID NO: 902822 - DNA, 21 bp, Homo sapiens
agcaaggaaatgtcctgcatg

SEQ ID NO: 902823 - DNA, 14 bp, Homo sapiens
agcaaggagattta

SEQ ID NO: 902824 - DNA, 17 bp, Homo sapiens
agcaaggagatttacaa

SEQ ID NO: 902825 - DNA, 20 bp, Homo sapiens
agcaaggcgcctgccttggg

SEQ ID NO: 902826 - DNA, 21 bp, Homo sapiens
agcaaggcgcctgccttggga

SEQ ID NO: 902827 - DNA, 14 bp, Homo sapiens
agcaaggctgctgc

SEQ ID NO: 902828 - DNA, 13 bp, Homo sapiens
agcaagggacctg

SEQ ID NO: 902829 - DNA, 12 bp, Homo sapiens
agcaagggagaa

SEQ ID NO: 902830 - DNA, 16 bp, Homo sapiens
agcaagggagaaaaga

SEQ ID NO: 902831 - DNA, 14 bp, Homo sapiens
agcaagggctccag

SEQ ID NO: 902832 - DNA, 17 bp, Homo sapiens
agcaaggggaccttggc

SEQ ID NO: 902833 - DNA, 20 bp, Homo sapiens
agcaagggttccctcaagag

SEQ ID NO: 902834 - DNA, 21 bp, Homo sapiens
agcaagggttggaggcaatgt

SEQ ID NO: 902835 - DNA, 20 bp, Homo sapiens
agcaagtagataaatatttg

SEQ ID NO: 902836 - DNA, 13 bp, Homo sapiens
agcaagtcccaga

SEQ ID NO: 902837 - DNA, 16 bp, Homo sapiens
agcaagtcttaacaaa

SEQ ID NO: 902838 - DNA, 12 bp, Homo sapiens
agcaagtgagca

SEQ ID NO: 902839 - DNA, 15 bp, Homo sapiens
agcaagtgagcagag

SEQ ID NO: 902840 - DNA, 16 bp, Homo sapiens
agcaagtgagcagaga

SEQ ID NO: 902841 - DNA, 23 bp, Homo sapiens
agcaagtgagtctggtggaggag

SEQ ID NO: 902842 - DNA, 20 bp, Homo sapiens
agcaagttcctgagtgcgtg

SEQ ID NO: 902843 - DNA, 21 bp, Homo sapiens
agcaagttctagagaagaggc

SEQ ID NO: 902844 - DNA, 23 bp, Homo sapiens
agcaagttctagagaagaggctg

SEQ ID NO: 902845 - DNA, 14 bp, Homo sapiens
agcaataaagctct

SEQ ID NO: 902846 - DNA, 13 bp, Homo sapiens
agcaataaatgaa

SEQ ID NO: 902847 - DNA, 17 bp, Homo sapiens
agcaataacactatatt

SEQ ID NO: 902848 - DNA, 19 bp, Homo sapiens
agcaataacattcccactg

SEQ ID NO: 902849 - DNA, 17 bp, Homo sapiens
agcaataactccaagca

SEQ ID NO: 902850 - DNA, 19 bp, Homo sapiens
agcaataactccaagcaga

SEQ ID NO: 902851 - DNA, 13 bp, Homo sapiens
agcaataattgtt

SEQ ID NO: 902852 - DNA, 16 bp, Homo sapiens
agcaatacaactttac

SEQ ID NO: 902853 - DNA, 20 bp, Homo sapiens
agcaatacaactttaccata

SEQ ID NO: 902854 - DNA, 16 bp, Homo sapiens
agcaatactcatcaga

SEQ ID NO: 902855 - DNA, 18 bp, Homo sapiens
agcaatactgtttccatt

SEQ ID NO: 902856 - DNA, 24 bp, Homo sapiens
agcaatatattaccagcaagaata

SEQ ID NO: 902857 - DNA, 15 bp, Homo sapiens
agcaatattgcctgt

SEQ ID NO: 902858 - DNA, 21 bp, Homo sapiens
agcaatattgcctgtgcttct

SEQ ID NO: 902859 - DNA, 22 bp, Homo sapiens
agcaatcaaggttataattttt

SEQ ID NO: 902860 - DNA, 15 bp, Homo sapiens
agcaatcattttatg

SEQ ID NO: 902861 - DNA, 23 bp, Homo sapiens
agcaatccatgatctatacacat

SEQ ID NO: 902862 - DNA, 23 bp, Homo sapiens
agcaatccatgttagtttttact

SEQ ID NO: 902863 - DNA, 17 bp, Homo sapiens
agcaatcctcctgcctc

SEQ ID NO: 902864 - DNA, 15 bp, Homo sapiens
agcaatctcttcatt

SEQ ID NO: 902865 - DNA, 18 bp, Homo sapiens
agcaatctcttcattatt

SEQ ID NO: 902866 - DNA, 16 bp, Homo sapiens
agcaatctttgaaata

SEQ ID NO: 902867 - DNA, 21 bp, Homo sapiens
agcaatgacatctcaggggcc

SEQ ID NO: 902868 - DNA, 19 bp, Homo sapiens
agcaatgatgtccagaaga

SEQ ID NO: 902869 - DNA, 21 bp, Homo sapiens
agcaatgcccgtaatgcttag

SEQ ID NO: 902870 - DNA, 22 bp, Homo sapiens
agcaatgcttttaatgaattta

SEQ ID NO: 902871 - DNA, 18 bp, Homo sapiens
agcaatggccagagcctc

SEQ ID NO: 902872 - DNA, 20 bp, Homo sapiens
agcaatggccagagcctctg

SEQ ID NO: 902873 - DNA, 18 bp, Homo sapiens
agcaatggggaatacaag

SEQ ID NO: 902874 - DNA, 18 bp, Homo sapiens
agcaatgggtcttagctc

SEQ ID NO: 902875 - DNA, 15 bp, Homo sapiens
agcaattagtgatat

SEQ ID NO: 902876 - DNA, 17 bp, Homo sapiens
agcaattatgaaaataa

SEQ ID NO: 902877 - DNA, 16 bp, Homo sapiens
agcaattctcctgcct

SEQ ID NO: 902878 - DNA, 16 bp, Homo sapiens
agcaattctctttctt

SEQ ID NO: 902879 - DNA, 15 bp, Homo sapiens
agcaattctgactgt

SEQ ID NO: 902880 - DNA, 15 bp, Homo sapiens
agcaattgccctgta

SEQ ID NO: 902881 - DNA, 18 bp, Homo sapiens
agcaattggttgtttaac

SEQ ID NO: 902882 - DNA, 16 bp, Homo sapiens
agcaatttaaatgtta

SEQ ID NO: 902883 - DNA, 19 bp, Homo sapiens
agcaatttaaatgttatga

SEQ ID NO: 902884 - DNA, 15 bp, Homo sapiens
agcaatttagacaaa

SEQ ID NO: 902885 - DNA, 20 bp, Homo sapiens
agcaatttatacaatatcat

SEQ ID NO: 902886 - DNA, 16 bp, Homo sapiens
agcaatttcccccctc

SEQ ID NO: 902887 - DNA, 22 bp, Homo sapiens
agcaatttcgccgttgaagagg

SEQ ID NO: 902888 - DNA, 20 bp, Homo sapiens
agcaattttctttgtttctt

SEQ ID NO: 902889 - DNA, 15 bp, Homo sapiens
agcacaaaattcaaa

SEQ ID NO: 902890 - DNA, 22 bp, Homo sapiens
agcacaaaattcaaagcatgga

SEQ ID NO: 902891 - DNA, 21 bp, Homo sapiens
agcacaaagttctcagagctc

SEQ ID NO: 902892 - DNA, 22 bp, Homo sapiens
agcacaaagttctcagagctct

SEQ ID NO: 902893 - DNA, 16 bp, Homo sapiens
agcacaaccggtccct

SEQ ID NO: 902894 - DNA, 19 bp, Homo sapiens
agcacaactttaagaggac

SEQ ID NO: 902895 - DNA, 17 bp, Homo sapiens
agcacaaggagtgcccg

SEQ ID NO: 902896 - DNA, 15 bp, Homo sapiens
agcacaagggcacat

SEQ ID NO: 902897 - DNA, 17 bp, Homo sapiens
agcacaagttatttaaa

SEQ ID NO: 902898 - DNA, 22 bp, Homo sapiens
agcacaatggtcttacattgga

SEQ ID NO: 902899 - DNA, 19 bp, Homo sapiens
agcacaattctgtccctgt

SEQ ID NO: 902900 - DNA, 19 bp, Homo sapiens
agcacacacaaacctactg

SEQ ID NO: 902901 - DNA, 17 bp, Homo sapiens
agcacaccaagttatat

SEQ ID NO: 902902 - DNA, 16 bp, Homo sapiens
agcacaccagccgctg

SEQ ID NO: 902903 - DNA, 17 bp, Homo sapiens
agcacaccagccgctgc

SEQ ID NO: 902904 - DNA, 20 bp, Homo sapiens
agcacaccagccgctgcagg

SEQ ID NO: 902905 - DNA, 14 bp, Homo sapiens
agcacacctctggg

SEQ ID NO: 902906 - DNA, 20 bp, Homo sapiens
agcacactcatcccctcact

SEQ ID NO: 902907 - DNA, 14 bp, Homo sapiens
agcacactgtagca

SEQ ID NO: 902908 - DNA, 16 bp, Homo sapiens
agcacacttatttatg

SEQ ID NO: 902909 - DNA, 17 bp, Homo sapiens
agcacacttatttatga

SEQ ID NO: 902910 - DNA, 14 bp, Homo sapiens
agcacagagaggga

SEQ ID NO: 902911 - DNA, 16 bp, Homo sapiens
agcacagagagggaca

SEQ ID NO: 902912 - DNA, 20 bp, Homo sapiens
agagtgggggagagcaggct

SEQ ID NO: 902913 - DNA, 18 bp, Homo sapiens
agagtggtatttgcagac

SEQ ID NO: 902914 - DNA, 18 bp, Homo sapiens
agagtggtctttctggag

SEQ ID NO: 902915 - DNA, 17 bp, Homo sapiens
agagctactcagaaatg

SEQ ID NO: 902916 - DNA, 19 bp, Homo sapiens
agagctactcagaaatgga

SEQ ID NO: 902917 - DNA, 17 bp, Homo sapiens
agagctagaaaaataaa

SEQ ID NO: 902918 - DNA, 13 bp, Homo sapiens
agagctagcgctg

SEQ ID NO: 902919 - DNA, 14 bp, Homo sapiens
agagctagcgctgc

SEQ ID NO: 902920 - DNA, 23 bp, Homo sapiens
agagctagctgccactttcacgt

SEQ ID NO: 902921 - DNA, 17 bp, Homo sapiens
agagctagggctgctgc

SEQ ID NO: 902922 - DNA, 20 bp, Homo sapiens
agagctcatcccccctgctg

SEQ ID NO: 902923 - DNA, 15 bp, Homo sapiens
agagctcccctccac

SEQ ID NO: 902924 - DNA, 18 bp, Homo sapiens
agagctcccctccacagc

SEQ ID NO: 902925 - DNA, 20 bp, Homo sapiens
agagctcccctccacagctg

SEQ ID NO: 902926 - DNA, 22 bp, Homo sapiens
agagctcccctccacagctgca

SEQ ID NO: 902927 - DNA, 20 bp, Homo sapiens
agagctcccgaggaagcaca

SEQ ID NO: 902928 - DNA, 22 bp, Homo sapiens
agagctcccgaggaagcacagc

SEQ ID NO: 902929 - DNA, 23 bp, Homo sapiens
agagctctcccctcctgctgggc

SEQ ID NO: 902930 - DNA, 15 bp, Homo sapiens
agagctcttaatgtt

SEQ ID NO: 902931 - DNA, 22 bp, Homo sapiens
agagctcttcaagctgtcccct

SEQ ID NO: 902932 - DNA, 14 bp, Homo sapiens
agagctgagccagt

SEQ ID NO: 902933 - DNA, 18 bp, Homo sapiens
agagctgagccagttgtc

SEQ ID NO: 902934 - DNA, 20 bp, Homo sapiens
agaggcccaggcaccaccag

SEQ ID NO: 902935 - DNA, 21 bp, Homo sapiens
agaggcccaggcaccaccagg

SEQ ID NO: 902936 - DNA, 14 bp, Homo sapiens
agaggcccccagcc

SEQ ID NO: 902937 - DNA, 21 bp, Homo sapiens
agaggcccccagcccagggct

SEQ ID NO: 902938 - DNA, 16 bp, Homo sapiens
agaggcccccagtggg

SEQ ID NO: 902939 - DNA, 20 bp, Homo sapiens
agaggcccccagtggggaca

SEQ ID NO: 902940 - DNA, 17 bp, Homo sapiens
agaggcccgcccgccca

SEQ ID NO: 902941 - DNA, 12 bp, Homo sapiens
agaggcctcagt

SEQ ID NO: 902942 - DNA, 16 bp, Homo sapiens
agaggcctgctgccag

SEQ ID NO: 902943 - DNA, 14 bp, Homo sapiens
agaggcctgggctg

SEQ ID NO: 902944 - DNA, 19 bp, Homo sapiens
agaggcctgggctgggaaa

SEQ ID NO: 902945 - DNA, 21 bp, Homo sapiens
agaggcctgggggacccctgg

SEQ ID NO: 902946 - DNA, 22 bp, Homo sapiens
agaggcctgggggacccctggc

SEQ ID NO: 902947 - DNA, 21 bp, Homo sapiens
agaggcctggggtgggacagg

SEQ ID NO: 902948 - DNA, 21 bp, Homo sapiens
agaggccttgtcatcctccct

SEQ ID NO: 902949 - DNA, 17 bp, Homo sapiens
agaggcgcgtctgcccc

SEQ ID NO: 902950 - DNA, 18 bp, Homo sapiens
agaggcgcgtctgcccca

SEQ ID NO: 902951 - DNA, 15 bp, Homo sapiens
agaggcgggccagcc

SEQ ID NO: 902952 - DNA, 16 bp, Homo sapiens
agaggcgggccagcca

SEQ ID NO: 902953 - DNA, 17 bp, Homo sapiens
agaggcgggccagccag

SEQ ID NO: 902954 - DNA, 20 bp, Homo sapiens
agaggcgggccagccaggcg

SEQ ID NO: 902955 - DNA, 19 bp, Homo sapiens
agaggcgtgtgcaggccga

SEQ ID NO: 902956 - DNA, 22 bp, Homo sapiens
agaggcgtgtgcaggccgacag

SEQ ID NO: 902957 - DNA, 16 bp, Homo sapiens
agaggctaagatgaga

SEQ ID NO: 902958 - DNA, 15 bp, Homo sapiens
agaggctactcttga

SEQ ID NO: 902959 - DNA, 18 bp, Homo sapiens
agaggctcagattgtaat

SEQ ID NO: 902960 - DNA, 19 bp, Homo sapiens
agaggctctggacagcaga

SEQ ID NO: 902961 - DNA, 22 bp, Homo sapiens
agaggctctggacagcagaagc

SEQ ID NO: 902962 - DNA, 23 bp, Homo sapiens
agaggctctggacagcagaagcc

SEQ ID NO: 902963 - DNA, 16 bp, Homo sapiens
agaggctcttgatggt

SEQ ID NO: 902964 - DNA, 13 bp, Homo sapiens
agaggctgaaaga

SEQ ID NO: 902965 - DNA, 16 bp, Homo sapiens
agaggctgagccctgt

SEQ ID NO: 902966 - DNA, 12 bp, Homo sapiens
agaggctgcccc

SEQ ID NO: 902967 - DNA, 13 bp, Homo sapiens
agaggctgcctca

SEQ ID NO: 902968 - DNA, 17 bp, Homo sapiens
agaggctgcctcagcca

SEQ ID NO: 902969 - DNA, 17 bp, Homo sapiens
agaggctggaggcaggg

SEQ ID NO: 902970 - DNA, 13 bp, Homo sapiens
agaggctgggagg

SEQ ID NO: 902971 - DNA, 23 bp, Homo sapiens
agaggctgggaggttgggaggct

SEQ ID NO: 902972 - DNA, 16 bp, Homo sapiens
agaggctgtggctggt

SEQ ID NO: 902973 - DNA, 16 bp, Homo sapiens
agaggctgtgtggcca

SEQ ID NO: 902974 - DNA, 14 bp, Homo sapiens
agagggaaaaagag

SEQ ID NO: 902975 - DNA, 21 bp, Homo sapiens
agagggaaaatgtgaaatctc

SEQ ID NO: 902976 - DNA, 19 bp, Homo sapiens
agagggaatgttccctgca

SEQ ID NO: 902977 - DNA, 16 bp, Homo sapiens
agagggacacatgccc

SEQ ID NO: 902978 - DNA, 17 bp, Homo sapiens
agagggacacatgcccc

SEQ ID NO: 902979 - DNA, 18 bp, Homo sapiens
agagggacacatgcccct

SEQ ID NO: 902980 - DNA, 20 bp, Homo sapiens
agagggacacatgcccctcc

SEQ ID NO: 902981 - DNA, 13 bp, Homo sapiens
agagggacagggt

SEQ ID NO: 902982 - DNA, 17 bp, Homo sapiens
agagggaccatgtgtca

SEQ ID NO: 902983 - DNA, 15 bp, Homo sapiens
agagggacctctccc

SEQ ID NO: 902984 - DNA, 16 bp, Homo sapiens
agagggacctctccca

SEQ ID NO: 902985 - DNA, 13 bp, Homo sapiens
agagggagaagaa

SEQ ID NO: 902986 - DNA, 19 bp, Homo sapiens
agagggagaagcatgaaaa

SEQ ID NO: 902987 - DNA, 14 bp, Homo sapiens
agagggagaatcca

SEQ ID NO: 902988 - DNA, 12 bp, Homo sapiens
agagggagagag

SEQ ID NO: 902989 - DNA, 10 bp, Homo sapiens
agagggagca

SEQ ID NO: 902990 - DNA, 24 bp, Homo sapiens
agagggaggagaatgagcctcggc

SEQ ID NO: 902991 - DNA, 17 bp, Homo sapiens
agagggaggcaagccct

SEQ ID NO: 902992 - DNA, 14 bp, Homo sapiens
agagggaggggcct

SEQ ID NO: 902993 - DNA, 22 bp, Homo sapiens
agagggaggtcactggaaaggg

SEQ ID NO: 902994 - DNA, 14 bp, Homo sapiens
agagggaggtgttt

SEQ ID NO: 902995 - DNA, 23 bp, Homo sapiens
agagggagtttaatacaggaaat

SEQ ID NO: 902996 - DNA, 17 bp, Homo sapiens
agagggatacaagagag

SEQ ID NO: 902997 - DNA, 18 bp, Homo sapiens
agagggatgggttcctgc

SEQ ID NO: 902998 - DNA, 15 bp, Homo sapiens
agagggatttccctg

SEQ ID NO: 902999 - DNA, 18 bp, Homo sapiens
agagggatttccctgcag

SEQ ID NO: 903000 - DNA, 23 bp, Homo sapiens
agagggcatgcgcacaaggctga

SEQ ID NO: 903001 - DNA, 24 bp, Homo sapiens
agagggccagagctagggctgctg

SEQ ID NO: 903002 - DNA, 15 bp, Homo sapiens
agagggccagcaggc

SEQ ID NO: 903003 - DNA, 21 bp, Homo sapiens
agagggccagcaggctcctgg

SEQ ID NO: 903004 - DNA, 13 bp, Homo sapiens
agagggcccagcc

SEQ ID NO: 903005 - DNA, 14 bp, Homo sapiens
agagggcccagccc

SEQ ID NO: 903006 - DNA, 16 bp, Homo sapiens
agagggcccagctgta

SEQ ID NO: 903007 - DNA, 23 bp, Homo sapiens
agagggcccagctgtagccatgg

SEQ ID NO: 903008 - DNA, 19 bp, Homo sapiens
agagggcctgtgggagcct

SEQ ID NO: 903009 - DNA, 12 bp, Homo sapiens
agagggccttgc

SEQ ID NO: 903010 - DNA, 14 bp, Homo sapiens
agagggctagggag

SEQ ID NO: 903011 - DNA, 19 bp, Homo sapiens
agagggctggaggcccagg

SEQ ID NO: 903012 - DNA, 12 bp, Homo sapiens
agagggcttcct

SEQ ID NO: 903013 - DNA, 15 bp, Homo sapiens
agagggctttttaaa

SEQ ID NO: 903014 - DNA, 12 bp, Homo sapiens
agaggggaagaa

SEQ ID NO: 903015 - DNA, 20 bp, Homo sapiens
agaggggaataatagaagaa

SEQ ID NO: 903016 - DNA, 20 bp, Homo sapiens
agaggggacaaaacccacct

SEQ ID NO: 903017 - DNA, 18 bp, Homo sapiens
agaggggactctgggcta

SEQ ID NO: 903018 - DNA, 14 bp, Homo sapiens
agaggggactgggg

SEQ ID NO: 903019 - DNA, 20 bp, Homo sapiens
agaggggagggctcctgggg

SEQ ID NO: 903020 - DNA, 18 bp, Homo sapiens
agaggggaggggcctagg

SEQ ID NO: 903021 - DNA, 14 bp, Homo sapiens
agaggggcagccgc

SEQ ID NO: 903022 - DNA, 21 bp, Homo sapiens
agaggggcctgatgagactcc

SEQ ID NO: 903023 - DNA, 23 bp, Homo sapiens
agaggggcgccttttcagccctt

SEQ ID NO: 903024 - DNA, 15 bp, Homo sapiens
agaggggcgggctca

SEQ ID NO: 903025 - DNA, 17 bp, Homo sapiens
agaggggcgggctcaga

SEQ ID NO: 903026 - DNA, 21 bp, Homo sapiens
agaggggctgaatagcagaag

SEQ ID NO: 903027 - DNA, 22 bp, Homo sapiens
agagggggactgctgctgcctg

SEQ ID NO: 903028 - DNA, 16 bp, Homo sapiens
agagggggagtagcca

SEQ ID NO: 903029 - DNA, 12 bp, Homo sapiens
agagggggcctg

SEQ ID NO: 903030 - DNA, 19 bp, Homo sapiens
agagggggcctgggacttc

SEQ ID NO: 903031 - DNA, 22 bp, Homo sapiens
agagggggcctgggacttccat

SEQ ID NO: 903032 - DNA, 16 bp, Homo sapiens
agaggggtgcacccac

SEQ ID NO: 903033 - DNA, 23 bp, Homo sapiens
agaggggtgcacccactcaccag

SEQ ID NO: 903034 - DNA, 18 bp, Homo sapiens
agaggggtgcagaggctg

SEQ ID NO: 903035 - DNA, 19 bp, Homo sapiens
agaggggtgcagaggctgt

SEQ ID NO: 903036 - DNA, 19 bp, Homo sapiens
agaggggtggagactgctt

SEQ ID NO: 903037 - DNA, 16 bp, Homo sapiens
agagggtcccattgtg

SEQ ID NO: 903038 - DNA, 18 bp, Homo sapiens
agagggtctggagaagca

SEQ ID NO: 903039 - DNA, 22 bp, Homo sapiens
agagggtgtggctttccaggca

SEQ ID NO: 903040 - DNA, 22 bp, Homo sapiens
agaggtaaaagtgtgagcagtg

SEQ ID NO: 903041 - DNA, 17 bp, Homo sapiens
agaggtagcgagctgct

SEQ ID NO: 903042 - DNA, 17 bp, Homo sapiens
agaggtatttatcttta

SEQ ID NO: 903043 - DNA, 16 bp, Homo sapiens
agaggtcaccagctgc

SEQ ID NO: 903044 - DNA, 14 bp, Homo sapiens
agaggtcagactaa

SEQ ID NO: 903045 - DNA, 18 bp, Homo sapiens
agagcagctggctctcca

SEQ ID NO: 903046 - DNA, 21 bp, Homo sapiens
agagcagctttaaactcaggg

SEQ ID NO: 903047 - DNA, 20 bp, Homo sapiens
agagcaggaagcattcagag

SEQ ID NO: 903048 - DNA, 21 bp, Homo sapiens
agagcaggactccaggcccaa

SEQ ID NO: 903049 - DNA, 22 bp, Homo sapiens
agagcaggagcccctggggctg

SEQ ID NO: 903050 - DNA, 11 bp, Homo sapiens
agagcaggagg

SEQ ID NO: 903051 - DNA, 12 bp, Homo sapiens
agagcaggaggc

SEQ ID NO: 903052 - DNA, 13 bp, Homo sapiens
agagcaggaggcc

SEQ ID NO: 903053 - DNA, 20 bp, Homo sapiens
agagcaggaggcccctggcc

SEQ ID NO: 903054 - DNA, 19 bp, Homo sapiens
agagcaggcacatggagga

SEQ ID NO: 903055 - DNA, 21 bp, Homo sapiens
agagcaggcaggggcatctgt

SEQ ID NO: 903056 - DNA, 15 bp, Homo sapiens
agagcaggccaggcg

SEQ ID NO: 903057 - DNA, 13 bp, Homo sapiens
agagcaggctcag

SEQ ID NO: 903058 - DNA, 19 bp, Homo sapiens
agagcaggggagcttggga

SEQ ID NO: 903059 - DNA, 17 bp, Homo sapiens
agagcaggggctccagc

SEQ ID NO: 903060 - DNA, 22 bp, Homo sapiens
agagcaggtgactgtgctgtgc

SEQ ID NO: 903061 - DNA, 14 bp, Homo sapiens
agagcagtgggcag

SEQ ID NO: 903062 - DNA, 21 bp, Homo sapiens
agagcagttggccaagcagaa

SEQ ID NO: 903063 - DNA, 18 bp, Homo sapiens
agagcatacaacagaggg

SEQ ID NO: 903064 - DNA, 19 bp, Homo sapiens
agagcatgatttgaaaaaa

SEQ ID NO: 903065 - DNA, 16 bp, Homo sapiens
agagcattagctggcg

SEQ ID NO: 903066 - DNA, 19 bp, Homo sapiens
agagcattgaattggagag

SEQ ID NO: 903067 - DNA, 15 bp, Homo sapiens
agagccaacctcggc

SEQ ID NO: 903068 - DNA, 21 bp, Homo sapiens
agagccaacctcggcttgtgg

SEQ ID NO: 903069 - DNA, 22 bp, Homo sapiens
agacttggacatctctctggct

SEQ ID NO: 903070 - DNA, 23 bp, Homo sapiens
agacttggacatctctctggctt

SEQ ID NO: 903071 - DNA, 17 bp, Homo sapiens
agacttggcaacagaag

SEQ ID NO: 903072 - DNA, 14 bp, Homo sapiens
agacttggggccag

SEQ ID NO: 903073 - DNA, 18 bp, Homo sapiens
agacttgggttgatctct

SEQ ID NO: 903074 - DNA, 21 bp, Homo sapiens
agacttggttggtagggtggg

SEQ ID NO: 903075 - DNA, 22 bp, Homo sapiens
agacttggttggtagggtggga

SEQ ID NO: 903076 - DNA, 15 bp, Homo sapiens
agacttgttcttggt

SEQ ID NO: 903077 - DNA, 22 bp, Homo sapiens
agactttaatcactgctgaaga

SEQ ID NO: 903078 - DNA, 18 bp, Homo sapiens
agactttagcttttcctt

SEQ ID NO: 903079 - DNA, 19 bp, Homo sapiens
agactttccattaaatcaa

SEQ ID NO: 903080 - DNA, 14 bp, Homo sapiens
agactttctcagtg

SEQ ID NO: 903081 - DNA, 17 bp, Homo sapiens
agactttctgaaaacac

SEQ ID NO: 903082 - DNA, 12 bp, Homo sapiens
agactttcttct

SEQ ID NO: 903083 - DNA, 17 bp, Homo sapiens
agactttgatccttgga

SEQ ID NO: 903084 - DNA, 18 bp, Homo sapiens
agactttgatccttggaa

SEQ ID NO: 903085 - DNA, 17 bp, Homo sapiens
agactttgctgcatttt

SEQ ID NO: 903086 - DNA, 18 bp, Homo sapiens
agactttgtttttaaaat

SEQ ID NO: 903087 - DNA, 21 bp, Homo sapiens
agacttttatgtgagatttcc

SEQ ID NO: 903088 - DNA, 23 bp, Homo sapiens
agacttttatgtgagatttcctt

SEQ ID NO: 903089 - DNA, 16 bp, Homo sapiens
agacttttcagaagat

SEQ ID NO: 903090 - DNA, 23 bp, Homo sapiens
agacttttgcttaccttttccta

SEQ ID NO: 903091 - DNA, 16 bp, Homo sapiens
agagaaaaaaaaaata

SEQ ID NO: 903092 - DNA, 13 bp, Homo sapiens
agagaaaaaagaa

SEQ ID NO: 903093 - DNA, 14 bp, Homo sapiens
agagaaaaaagcca

SEQ ID NO: 903094 - DNA, 20 bp, Homo sapiens
agagaaaaagcagaggccaa

SEQ ID NO: 903095 - DNA, 13 bp, Homo sapiens
agagaaaagaaaa

SEQ ID NO: 903096 - DNA, 15 bp, Homo sapiens
agagaaaagaaaaaa

SEQ ID NO: 903097 - DNA, 12 bp, Homo sapiens
agagaaaataaa

SEQ ID NO: 903098 - DNA, 15 bp, Homo sapiens
agagaaaatatatgt

SEQ ID NO: 903099 - DNA, 16 bp, Homo sapiens
agagaaaatatatgta

SEQ ID NO: 903100 - DNA, 14 bp, Homo sapiens
agagaaaatgaatt

SEQ ID NO: 903101 - DNA, 16 bp, Homo sapiens
agagaaaatgaatttg

SEQ ID NO: 903102 - DNA, 22 bp, Homo sapiens
agagaaacactgaaaagaagga

SEQ ID NO: 903103 - DNA, 22 bp, Homo sapiens
agagaggcagaagaaccctggc

SEQ ID NO: 903104 - DNA, 15 bp, Homo sapiens
agagaggcagcaagt

SEQ ID NO: 903105 - DNA, 13 bp, Homo sapiens
agagaggcctgct

SEQ ID NO: 903106 - DNA, 20 bp, Homo sapiens
agagaggcgcgtctgcccca

SEQ ID NO: 903107 - DNA, 16 bp, Homo sapiens
agagaggcgggcccca

SEQ ID NO: 903108 - DNA, 19 bp, Homo sapiens
agagaggctcaacaaggaa

SEQ ID NO: 903109 - DNA, 18 bp, Homo sapiens
agagagggacacatgccc

SEQ ID NO: 903110 - DNA, 19 bp, Homo sapiens
agagagggacacatgcccc

SEQ ID NO: 903111 - DNA, 23 bp, Homo sapiens
agagagggacacatgcccctccc

SEQ ID NO: 903112 - DNA, 22 bp, Homo sapiens
agagagggagaaacaagtggac

SEQ ID NO: 903113 - DNA, 16 bp, Homo sapiens
agagagggagaagaag

SEQ ID NO: 903114 - DNA, 19 bp, Homo sapiens
agagagggagaagaagtca

SEQ ID NO: 903115 - DNA, 12 bp, Homo sapiens
agagagggccca

SEQ ID NO: 903116 - DNA, 13 bp, Homo sapiens
agagagggcccag

SEQ ID NO: 903117 - DNA, 15 bp, Homo sapiens
agagagggctttaat

SEQ ID NO: 903118 - DNA, 16 bp, Homo sapiens
agagaggggaagaatt

SEQ ID NO: 903119 - DNA, 14 bp, Homo sapiens
agagaggggaagag

SEQ ID NO: 903120 - DNA, 22 bp, Homo sapiens
agagaggggaataatagaagaa

SEQ ID NO: 903121 - DNA, 15 bp, Homo sapiens
agagagggggctctc

SEQ ID NO: 903122 - DNA, 22 bp, Homo sapiens
agagaggtttttcttgggaaag

SEQ ID NO: 903123 - DNA, 14 bp, Homo sapiens
agagagtataaata

SEQ ID NO: 903124 - DNA, 14 bp, Homo sapiens
agagagtggctcct

SEQ ID NO: 903125 - DNA, 15 bp, Homo sapiens
agagagttagcatgt

SEQ ID NO: 903126 - DNA, 13 bp, Homo sapiens
agagagtttcaaa

SEQ ID NO: 903127 - DNA, 13 bp, Homo sapiens
agagagtttgtaa

SEQ ID NO: 903128 - DNA, 15 bp, Homo sapiens
agagatagcttctct

SEQ ID NO: 903129 - DNA, 16 bp, Homo sapiens
agagatagcttctctt

SEQ ID NO: 903130 - DNA, 15 bp, Homo sapiens
agagatagttctaaa

SEQ ID NO: 903131 - DNA, 20 bp, Homo sapiens
agagatatgtagaaggcaca

SEQ ID NO: 903132 - DNA, 16 bp, Homo sapiens
agagatattgatattg

SEQ ID NO: 903133 - DNA, 18 bp, Homo sapiens
agagatattttaaaatga

SEQ ID NO: 903134 - DNA, 13 bp, Homo sapiens
agagatattttgt

SEQ ID NO: 903135 - DNA, 14 bp, Homo sapiens
agagatattttgta

SEQ ID NO: 903136 - DNA, 16 bp, Homo sapiens
agagatattttgtaaa

SEQ ID NO: 903137 - DNA, 20 bp, Homo sapiens
agagatcacccactcctatg

SEQ ID NO: 903138 - DNA, 23 bp, Homo sapiens
agagatcgagaccatcctggcca

SEQ ID NO: 903139 - DNA, 15 bp, Homo sapiens
agagatctgggcatt

SEQ ID NO: 903140 - DNA, 15 bp, Homo sapiens
agagatgaaataatt

SEQ ID NO: 903141 - DNA, 16 bp, Homo sapiens
agagatgcatgcgcag

SEQ ID NO: 903142 - DNA, 16 bp, Homo sapiens
agagatgcctccaccg

SEQ ID NO: 903143 - DNA, 21 bp, Homo sapiens
agagatgctgtaacttaaaat

SEQ ID NO: 903144 - DNA, 15 bp, Homo sapiens
agagatgtactgcaa

SEQ ID NO: 903145 - DNA, 23 bp, Homo sapiens
agagatgtccatttttacaagtt

SEQ ID NO: 903146 - DNA, 19 bp, Homo sapiens
agagatgtggcaaagtgct

SEQ ID NO: 903147 - DNA, 16 bp, Homo sapiens
agagatgtttacagta

SEQ ID NO: 903148 - DNA, 23 bp, Homo sapiens
agagatgtttacagtatgatgaa

SEQ ID NO: 903149 - DNA, 12 bp, Homo sapiens
agagatgttttt

SEQ ID NO: 903150 - DNA, 20 bp, Homo sapiens
agagatgtttttaaaagttt

SEQ ID NO: 903151 - DNA, 19 bp, Homo sapiens
agagattacctcctgagaa

SEQ ID NO: 903152 - DNA, 13 bp, Homo sapiens
agagattcttcta

SEQ ID NO: 903153 - DNA, 19 bp, Homo sapiens
agagattgccccagagccc

SEQ ID NO: 903154 - DNA, 14 bp, Homo sapiens
agagattgggagaa

SEQ ID NO: 903155 - DNA, 13 bp, Homo sapiens
agagatttatctt

SEQ ID NO: 903156 - DNA, 16 bp, Homo sapiens
agagcaaaagggagga

SEQ ID NO: 903157 - DNA, 15 bp, Homo sapiens
agagcaaagcgccca

SEQ ID NO: 903158 - DNA, 14 bp, Homo sapiens
agagcaaaggagac

SEQ ID NO: 903159 - DNA, 22 bp, Homo sapiens
agagcaaaggagacaaagcagg

SEQ ID NO: 903160 - DNA, 15 bp, Homo sapiens
agagcaaaggcccat

SEQ ID NO: 903161 - DNA, 16 bp, Homo sapiens
agagcaaaggcccatg

SEQ ID NO: 903162 - DNA, 16 bp, Homo sapiens
agagcaaatgagggag

SEQ ID NO: 903163 - DNA, 17 bp, Homo sapiens
agagcaacctctcactc

SEQ ID NO: 903164 - DNA, 18 bp, Homo sapiens
agagcaacctctgtatta

SEQ ID NO: 903165 - DNA, 14 bp, Homo sapiens
agagcaagactctg

SEQ ID NO: 903166 - DNA, 17 bp, Homo sapiens
agagcaataacactata

SEQ ID NO: 903167 - DNA, 19 bp, Homo sapiens
agagcaataacactatatt

SEQ ID NO: 903168 - DNA, 21 bp, Homo sapiens
agagcaatgcccgtaatgctt

SEQ ID NO: 903169 - DNA, 18 bp, Homo sapiens
agagcacaaacttcagaa

SEQ ID NO: 903170 - DNA, 23 bp, Homo sapiens
agagcacacttatttatgaattg

SEQ ID NO: 903171 - DNA, 14 bp, Homo sapiens
agagcacagagccc

SEQ ID NO: 903172 - DNA, 13 bp, Homo sapiens
agagcacagccca

SEQ ID NO: 903173 - DNA, 17 bp, Homo sapiens
agagcacagcccacggg

SEQ ID NO: 903174 - DNA, 14 bp, Homo sapiens
agagcacagcttct

SEQ ID NO: 903175 - DNA, 18 bp, Homo sapiens
agagcacagcttcttctg

SEQ ID NO: 903176 - DNA, 23 bp, Homo sapiens
agagcacccccaagcctgggctt

SEQ ID NO: 903177 - DNA, 18 bp, Homo sapiens
agagcacctagtccagtg

SEQ ID NO: 903178 - DNA, 16 bp, Homo sapiens
agagcaccttgcagtt

SEQ ID NO: 903179 - DNA, 20 bp, Homo sapiens
agagcacctttgcacaggat

SEQ ID NO: 903180 - DNA, 15 bp, Homo sapiens
agagcactagaagtg

SEQ ID NO: 903181 - DNA, 18 bp, Homo sapiens
agagcactgcctctatgc

SEQ ID NO: 903182 - DNA, 20 bp, Homo sapiens
agagcactgcctctatgccc

SEQ ID NO: 903183 - DNA, 20 bp, Homo sapiens
agagcactgggttgcagggg

SEQ ID NO: 903184 - DNA, 20 bp, Homo sapiens
agagcagaacggagccccag

SEQ ID NO: 903185 - DNA, 16 bp, Homo sapiens
agagcagagcctacag

SEQ ID NO: 903186 - DNA, 15 bp, Homo sapiens
agagcagcagcacca

SEQ ID NO: 903187 - DNA, 16 bp, Homo sapiens
agagcagcagcaccaa

SEQ ID NO: 903188 - DNA, 15 bp, Homo sapiens
agagcagcagcacct

SEQ ID NO: 903189 - DNA, 16 bp, Homo sapiens
agagcagcaggtgctg

SEQ ID NO: 903190 - DNA, 14 bp, Homo sapiens
agagcagcctcgtg

SEQ ID NO: 903191 - DNA, 11 bp, Homo sapiens
agagcagcctg

SEQ ID NO: 903192 - DNA, 18 bp, Homo sapiens
agagcagcctgatggcca

SEQ ID NO: 903193 - DNA, 19 bp, Homo sapiens
agagcagcctgatggccaa

SEQ ID NO: 903194 - DNA, 21 bp, Homo sapiens
agagcagcgcccaggcctgct

SEQ ID NO: 903195 - DNA, 18 bp, Homo sapiens
agagcagctaactccgag

SEQ ID NO: 903196 - DNA, 19 bp, Homo sapiens
agagcagctccctttctca

SEQ ID NO: 903197 - DNA, 21 bp, Homo sapiens
agagcagctccctttctcagg

SEQ ID NO: 903198 - DNA, 12 bp, Homo sapiens
agagcagctggc

SEQ ID NO: 903199 - DNA, 21 bp, Homo sapiens
agaccgcttcacccctgcact

SEQ ID NO: 903200 - DNA, 16 bp, Homo sapiens
agaccgggcccccctg

SEQ ID NO: 903201 - DNA, 17 bp, Homo sapiens
agaccgggccctgggtt

SEQ ID NO: 903202 - DNA, 15 bp, Homo sapiens
agaccgtacaaactc

SEQ ID NO: 903203 - DNA, 15 bp, Homo sapiens
agacctacattccct

SEQ ID NO: 903204 - DNA, 23 bp, Homo sapiens
agacctacattccctctcctgcc

SEQ ID NO: 903205 - DNA, 18 bp, Homo sapiens
agacctagcaggctgttc

SEQ ID NO: 903206 - DNA, 20 bp, Homo sapiens
agacctagcaggctgttcca

SEQ ID NO: 903207 - DNA, 18 bp, Homo sapiens
agacctagctatgttggc

SEQ ID NO: 903208 - DNA, 14 bp, Homo sapiens
agacctagggagga

SEQ ID NO: 903209 - DNA, 19 bp, Homo sapiens
agacctagggaggacctta

SEQ ID NO: 903210 - DNA, 17 bp, Homo sapiens
agacctcactgtcaggg

SEQ ID NO: 903211 - DNA, 11 bp, Homo sapiens
agacctcagcc

SEQ ID NO: 903212 - DNA, 14 bp, Homo sapiens
agacctcagccatg

SEQ ID NO: 903213 - DNA, 12 bp, Homo sapiens
agacctcagcct

SEQ ID NO: 903214 - DNA, 16 bp, Homo sapiens
agacctcagcctgtgc

SEQ ID NO: 903215 - DNA, 15 bp, Homo sapiens
agacctcatcaggat

SEQ ID NO: 903216 - DNA, 17 bp, Homo sapiens
agacctcatcaggatga

SEQ ID NO: 903217 - DNA, 13 bp, Homo sapiens
agacctcatcctg

SEQ ID NO: 903218 - DNA, 13 bp, Homo sapiens
agacctcatgccc

SEQ ID NO: 903219 - DNA, 15 bp, Homo sapiens
agacctcatgcccag

SEQ ID NO: 903220 - DNA, 22 bp, Homo sapiens
agacctcatgcccagctctctg

SEQ ID NO: 903221 - DNA, 23 bp, Homo sapiens
agacctcatgcccagctctctga

SEQ ID NO: 903222 - DNA, 16 bp, Homo sapiens
agacctccccctcact

SEQ ID NO: 903223 - DNA, 13 bp, Homo sapiens
agacctctgccta

SEQ ID NO: 903224 - DNA, 20 bp, Homo sapiens
agacctctggttaatttata

SEQ ID NO: 903225 - DNA, 19 bp, Homo sapiens
agacctcttctaagaggat

SEQ ID NO: 903226 - DNA, 15 bp, Homo sapiens
agacctgaattcttt

SEQ ID NO: 903227 - DNA, 19 bp, Homo sapiens
agacctgacaagcactgct

SEQ ID NO: 903228 - DNA, 23 bp, Homo sapiens
agacctgacaccgtccctcagtg

SEQ ID NO: 903229 - DNA, 22 bp, Homo sapiens
agacctgcagtgaggggccctc

SEQ ID NO: 903230 - DNA, 13 bp, Homo sapiens
agacctgcatttg

SEQ ID NO: 903231 - DNA, 14 bp, Homo sapiens
agacctggaaccag

SEQ ID NO: 903232 - DNA, 16 bp, Homo sapiens
agacctggagcccctg

SEQ ID NO: 903233 - DNA, 22 bp, Homo sapiens
agacctggagcccctgggtggg

SEQ ID NO: 903234 - DNA, 12 bp, Homo sapiens
agacctggcctt

SEQ ID NO: 903235 - DNA, 17 bp, Homo sapiens
agacctggtgtgcggag

SEQ ID NO: 903236 - DNA, 14 bp, Homo sapiens
agacctgtcttcca

SEQ ID NO: 903237 - DNA, 15 bp, Homo sapiens
agacctgtcttccaa

SEQ ID NO: 903238 - DNA, 23 bp, Homo sapiens
agacctgtcttccaaggagacca

SEQ ID NO: 903239 - DNA, 17 bp, Homo sapiens
agacctgttggcctgtg

SEQ ID NO: 903240 - DNA, 21 bp, Homo sapiens
agacctgttggcctgtgggcc

SEQ ID NO: 903241 - DNA, 23 bp, Homo sapiens
agacctgttggtataggaatgta

SEQ ID NO: 903242 - DNA, 18 bp, Homo sapiens
agaccttaagacactgtg

SEQ ID NO: 903243 - DNA, 17 bp, Homo sapiens
agaccttactcagggga

SEQ ID NO: 903244 - DNA, 23 bp, Homo sapiens
agaccttccataatgctactgtc

SEQ ID NO: 903245 - DNA, 18 bp, Homo sapiens
agaccttctccaaatgag

SEQ ID NO: 903246 - DNA, 19 bp, Homo sapiens
agaccttctccaaatgaga

SEQ ID NO: 903247 - DNA, 17 bp, Homo sapiens
agaccttgagggtgggc

SEQ ID NO: 903248 - DNA, 19 bp, Homo sapiens
agaccttgagggtgggcca

SEQ ID NO: 903249 - DNA, 21 bp, Homo sapiens
agaccttgttacttctgaggt

SEQ ID NO: 903250 - DNA, 12 bp, Homo sapiens
agacctttactg

SEQ ID NO: 903251 - DNA, 18 bp, Homo sapiens
agacctttatttttctat

SEQ ID NO: 903252 - DNA, 22 bp, Homo sapiens
agacctttgatgaattcttcct

SEQ ID NO: 903253 - DNA, 12 bp, Homo sapiens
agaccttttcaa

SEQ ID NO: 903254 - DNA, 16 bp, Homo sapiens
agaccttttttaggaa

SEQ ID NO: 903255 - DNA, 20 bp, Homo sapiens
agaccttttttttttttcca

SEQ ID NO: 903256 - DNA, 18 bp, Homo sapiens
agacgagatcctgtttca

SEQ ID NO: 903257 - DNA, 13 bp, Homo sapiens
agacgatatactc

SEQ ID NO: 903258 - DNA, 17 bp, Homo sapiens
agacgatttgtcagtta

SEQ ID NO: 903259 - DNA, 22 bp, Homo sapiens
agacgcatagactgaggtataa

SEQ ID NO: 903260 - DNA, 18 bp, Homo sapiens
agacgccactccctggga

SEQ ID NO: 903261 - DNA, 15 bp, Homo sapiens
agacgcctgagctca

SEQ ID NO: 903262 - DNA, 13 bp, Homo sapiens
agacgcctgagga

SEQ ID NO: 903263 - DNA, 16 bp, Homo sapiens
agacgctgccgctgcc

SEQ ID NO: 903264 - DNA, 13 bp, Homo sapiens
agacggatggcag

SEQ ID NO: 903265 - DNA, 14 bp, Homo sapiens
agacggatggcagg

SEQ ID NO: 903266 - DNA, 13 bp, Homo sapiens
agacggccctgct

SEQ ID NO: 903267 - DNA, 23 bp, Homo sapiens
agacggccggccggacctctgag

SEQ ID NO: 903268 - DNA, 19 bp, Homo sapiens
agacggcctaggggtggcg

SEQ ID NO: 903269 - DNA, 23 bp, Homo sapiens
agacggcctaggggtggcgctca

SEQ ID NO: 903270 - DNA, 22 bp, Homo sapiens
agacgggaatgcctaggtccct

SEQ ID NO: 903271 - DNA, 19 bp, Homo sapiens
agacggggtttcaccatgt

SEQ ID NO: 903272 - DNA, 13 bp, Homo sapiens
agacggtctgtgt

SEQ ID NO: 903273 - DNA, 16 bp, Homo sapiens
agacgtaaagaatttt

SEQ ID NO: 903274 - DNA, 17 bp, Homo sapiens
agacgtcaggccctgac

SEQ ID NO: 903275 - DNA, 18 bp, Homo sapiens
agacgtggaacctctgtc

SEQ ID NO: 903276 - DNA, 20 bp, Homo sapiens
agacgtggaacctctgtctc

SEQ ID NO: 903277 - DNA, 14 bp, Homo sapiens
agacgtggactcct

SEQ ID NO: 903278 - DNA, 14 bp, Homo sapiens
agacgtgtttgtgt

SEQ ID NO: 903279 - DNA, 16 bp, Homo sapiens
agacgttttctttatc

SEQ ID NO: 903280 - DNA, 21 bp, Homo sapiens
agacgtttttgtgctgtgggc

SEQ ID NO: 903281 - DNA, 19 bp, Homo sapiens
agactaaaggatccagaga

SEQ ID NO: 903282 - DNA, 17 bp, Homo sapiens
agactaagaaatattcc

SEQ ID NO: 903283 - DNA, 19 bp, Homo sapiens
agactaagaaatattccaa

SEQ ID NO: 903284 - DNA, 23 bp, Homo sapiens
agactaagccctgtcgagacact

SEQ ID NO: 903285 - DNA, 14 bp, Homo sapiens
agactaatttaaaa

SEQ ID NO: 903286 - DNA, 15 bp, Homo sapiens
agactaatttaaaaa

SEQ ID NO: 903287 - DNA, 14 bp, Homo sapiens
agactagaattcta

SEQ ID NO: 903288 - DNA, 17 bp, Homo sapiens
agactagaattctagtg

SEQ ID NO: 903289 - DNA, 23 bp, Homo sapiens
agactagaattctagtgctgctg

SEQ ID NO: 903290 - DNA, 21 bp, Homo sapiens
agactagagtctgagatgccc

SEQ ID NO: 903291 - DNA, 13 bp, Homo sapiens
agactagatgtag

SEQ ID NO: 903292 - DNA, 14 bp, Homo sapiens
agactagatgtagt

SEQ ID NO: 903293 - DNA, 23 bp, Homo sapiens
agactagatgtagtattttttgt

SEQ ID NO: 903294 - DNA, 17 bp, Homo sapiens
agactagcaatctcttc

SEQ ID NO: 903295 - DNA, 17 bp, Homo sapiens
agactagggctgcaagt

SEQ ID NO: 903296 - DNA, 21 bp, Homo sapiens
agactagtgccgtagggagta

SEQ ID NO: 903297 - DNA, 21 bp, Homo sapiens
agactagttctcttgtcctgt

SEQ ID NO: 903298 - DNA, 24 bp, Homo sapiens
agactagttctcttgtcctgtgat

SEQ ID NO: 903299 - DNA, 13 bp, Homo sapiens
agactataaataa

SEQ ID NO: 903300 - DNA, 19 bp, Homo sapiens
agactatctaaatgttgaa

SEQ ID NO: 903301 - DNA, 17 bp, Homo sapiens
agactatttcaaaatgt

SEQ ID NO: 903302 - DNA, 20 bp, Homo sapiens
agactattttctattttccc

SEQ ID NO: 903303 - DNA, 18 bp, Homo sapiens
agactcaaaacctggaga

SEQ ID NO: 903304 - DNA, 13 bp, Homo sapiens
agactcaaatgct

SEQ ID NO: 903305 - DNA, 20 bp, Homo sapiens
agactcacactctctgcagc

SEQ ID NO: 903306 - DNA, 22 bp, Homo sapiens
agactcacaggaaggaggagcc

SEQ ID NO: 903307 - DNA, 12 bp, Homo sapiens
agactcacctct

SEQ ID NO: 903308 - DNA, 14 bp, Homo sapiens
agactcacctctgc

SEQ ID NO: 903309 - DNA, 15 bp, Homo sapiens
agactcacctctgcc

SEQ ID NO: 903310 - DNA, 19 bp, Homo sapiens
agactcacctctgcctcaa

SEQ ID NO: 903311 - DNA, 14 bp, Homo sapiens
agactcacttgcca

SEQ ID NO: 903312 - DNA, 20 bp, Homo sapiens
agactcagatgaggacagag

SEQ ID NO: 903313 - DNA, 15 bp, Homo sapiens
agactcagctccaga

SEQ ID NO: 903314 - DNA, 17 bp, Homo sapiens
agactcagctccagaat

SEQ ID NO: 903315 - DNA, 20 bp, Homo sapiens
agactcaggccaagaaacgt

SEQ ID NO: 903316 - DNA, 18 bp, Homo sapiens
agactcagggccccagca

SEQ ID NO: 903317 - DNA, 20 bp, Homo sapiens
agactcagggccccagcact

SEQ ID NO: 903318 - DNA, 16 bp, Homo sapiens
agactcaggttccaga

SEQ ID NO: 903319 - DNA, 17 bp, Homo sapiens
agactcaggttccagaa

SEQ ID NO: 903320 - DNA, 15 bp, Homo sapiens
agactcagtttgtca

SEQ ID NO: 903321 - DNA, 15 bp, Homo sapiens
agactccaaggagct

SEQ ID NO: 903322 - DNA, 16 bp, Homo sapiens
agactccaaggagcta

SEQ ID NO: 903323 - DNA, 19 bp, Homo sapiens
agactccagaatctgctgt

SEQ ID NO: 903324 - DNA, 21 bp, Homo sapiens
agacatgccttggtgccggtc

SEQ ID NO: 903325 - DNA, 22 bp, Homo sapiens
agacatgctctttttttaagtg

SEQ ID NO: 903326 - DNA, 19 bp, Homo sapiens
agacatgcttactttttaa

SEQ ID NO: 903327 - DNA, 14 bp, Homo sapiens
agacatggaccagc

SEQ ID NO: 903328 - DNA, 18 bp, Homo sapiens
agacatggaccagcatct

SEQ ID NO: 903329 - DNA, 19 bp, Homo sapiens
agacatggagactcctgcc

SEQ ID NO: 903330 - DNA, 22 bp, Homo sapiens
agacatggagactcctgccctg

SEQ ID NO: 903331 - DNA, 18 bp, Homo sapiens
agacatgtctgttctaca

SEQ ID NO: 903332 - DNA, 14 bp, Homo sapiens
agacatgtgacatt

SEQ ID NO: 903333 - DNA, 14 bp, Homo sapiens
agacattaaataat

SEQ ID NO: 903334 - DNA, 17 bp, Homo sapiens
agacattaagcagcctt

SEQ ID NO: 903335 - DNA, 19 bp, Homo sapiens
agacattctcacataagcc

SEQ ID NO: 903336 - DNA, 22 bp, Homo sapiens
agacattctggtgaccagactt

SEQ ID NO: 903337 - DNA, 14 bp, Homo sapiens
agacattcttttaa

SEQ ID NO: 903338 - DNA, 21 bp, Homo sapiens
agacatttatactcttttttc

SEQ ID NO: 903339 - DNA, 16 bp, Homo sapiens
agacatttcaaaatta

SEQ ID NO: 903340 - DNA, 18 bp, Homo sapiens
agacatttcaaaattaat

SEQ ID NO: 903341 - DNA, 20 bp, Homo sapiens
agacatttcaaaattaatag

SEQ ID NO: 903342 - DNA, 17 bp, Homo sapiens
agacatttgccttttgt

SEQ ID NO: 903343 - DNA, 18 bp, Homo sapiens
agacatttgctgaactca

SEQ ID NO: 903344 - DNA, 11 bp, Homo sapiens
agacatttgta

SEQ ID NO: 903345 - DNA, 18 bp, Homo sapiens
agacatttgtttgctgta

SEQ ID NO: 903346 - DNA, 13 bp, Homo sapiens
agacatttttatt

SEQ ID NO: 903347 - DNA, 15 bp, Homo sapiens
agacatttttgtgcc

SEQ ID NO: 903348 - DNA, 23 bp, Homo sapiens
agacattttttgctataatcatt

SEQ ID NO: 903349 - DNA, 17 bp, Homo sapiens
agaccaaaatgacaatg

SEQ ID NO: 903350 - DNA, 18 bp, Homo sapiens
agaccaaaatgacaatga

SEQ ID NO: 903351 - DNA, 21 bp, Homo sapiens
agaccaaaattactaataaat

SEQ ID NO: 903352 - DNA, 11 bp, Homo sapiens
agaccaaagca

SEQ ID NO: 903353 - DNA, 24 bp, Homo sapiens
agaccaaatctcagttgtttgctt

SEQ ID NO: 903354 - DNA, 18 bp, Homo sapiens
agaccaacgttactcagg

SEQ ID NO: 903355 - DNA, 14 bp, Homo sapiens
agaccaacttttca

SEQ ID NO: 903356 - DNA, 23 bp, Homo sapiens
agaccaaggcgggagcatctctt

SEQ ID NO: 903357 - DNA, 13 bp, Homo sapiens
agaccacagacgg

SEQ ID NO: 903358 - DNA, 17 bp, Homo sapiens
agaccacagagctgtca

SEQ ID NO: 903359 - DNA, 21 bp, Homo sapiens
agaccacagggttcaaaatgt

SEQ ID NO: 903360 - DNA, 23 bp, Homo sapiens
agaccaccagccgccccagcccc

SEQ ID NO: 903361 - DNA, 21 bp, Homo sapiens
agaccaccagggtcccaggaa

SEQ ID NO: 903362 - DNA, 23 bp, Homo sapiens
agaccaccagggtcccaggaagc

SEQ ID NO: 903363 - DNA, 16 bp, Homo sapiens
agaccaccccgcctgc

SEQ ID NO: 903364 - DNA, 13 bp, Homo sapiens
agaccacctccaa

SEQ ID NO: 903365 - DNA, 19 bp, Homo sapiens
agaccacgcccgtcctgcc

SEQ ID NO: 903366 - DNA, 21 bp, Homo sapiens
agaccacgcccgtcctgcctg

SEQ ID NO: 903367 - DNA, 12 bp, Homo sapiens
agaccactgtct

SEQ ID NO: 903368 - DNA, 23 bp, Homo sapiens
agaccagaattcccttgaattgt

SEQ ID NO: 903369 - DNA, 17 bp, Homo sapiens
agaccagactgtggaga

SEQ ID NO: 903370 - DNA, 18 bp, Homo sapiens
agaccagactgtggagaa

SEQ ID NO: 903371 - DNA, 22 bp, Homo sapiens
agaccagactgtggagaaataa

SEQ ID NO: 903372 - DNA, 15 bp, Homo sapiens
agaccagcactcagc

SEQ ID NO: 903373 - DNA, 15 bp, Homo sapiens
agaccagcagacaga

SEQ ID NO: 903374 - DNA, 15 bp, Homo sapiens
agaccagccctgcag

SEQ ID NO: 903375 - DNA, 16 bp, Homo sapiens
agaccaggctgtgtcc

SEQ ID NO: 903376 - DNA, 12 bp, Homo sapiens
agaccagggctc

SEQ ID NO: 903377 - DNA, 16 bp, Homo sapiens
agaccagggctccagc

SEQ ID NO: 903378 - DNA, 13 bp, Homo sapiens
agaccagtactgg

SEQ ID NO: 903379 - DNA, 14 bp, Homo sapiens
agaccagtctggcc

SEQ ID NO: 903380 - DNA, 16 bp, Homo sapiens
agaccagtgcttagca

SEQ ID NO: 903381 - DNA, 22 bp, Homo sapiens
agaccagtggtctggaaacagc

SEQ ID NO: 903382 - DNA, 14 bp, Homo sapiens
agaccagtttgcat

SEQ ID NO: 903383 - DNA, 13 bp, Homo sapiens
agaccatcctggc

SEQ ID NO: 903384 - DNA, 14 bp, Homo sapiens
agaccatcctggcc

SEQ ID NO: 903385 - DNA, 15 bp, Homo sapiens
agaccatcctggccc

SEQ ID NO: 903386 - DNA, 16 bp, Homo sapiens
agaccatcctggcccc

SEQ ID NO: 903387 - DNA, 17 bp, Homo sapiens
agaccatcctggcccct

SEQ ID NO: 903388 - DNA, 19 bp, Homo sapiens
agaccatcctggcccctcc

SEQ ID NO: 903389 - DNA, 14 bp, Homo sapiens
agaccatcctggct

SEQ ID NO: 903390 - DNA, 16 bp, Homo sapiens
agaccatgaagtaaat

SEQ ID NO: 903391 - DNA, 17 bp, Homo sapiens
agaccatgccagaccca

SEQ ID NO: 903392 - DNA, 13 bp, Homo sapiens
agaccattctgtg

SEQ ID NO: 903393 - DNA, 15 bp, Homo sapiens
agacccaaaccccca

SEQ ID NO: 903394 - DNA, 21 bp, Homo sapiens
agacccaactcgcctgtggac

SEQ ID NO: 903395 - DNA, 14 bp, Homo sapiens
agacccaaggagga

SEQ ID NO: 903396 - DNA, 22 bp, Homo sapiens
agacccagaggccctgaagcct

SEQ ID NO: 903397 - DNA, 14 bp, Homo sapiens
agacccagatgtga

SEQ ID NO: 903398 - DNA, 19 bp, Homo sapiens
agacccagcccgcggcctg

SEQ ID NO: 903399 - DNA, 18 bp, Homo sapiens
agacccatacctttccag

SEQ ID NO: 903400 - DNA, 23 bp, Homo sapiens
agaccccacccaagcttggcagc

SEQ ID NO: 903401 - DNA, 18 bp, Homo sapiens
agaccccaccctacgctc

SEQ ID NO: 903402 - DNA, 17 bp, Homo sapiens
agaccccacgctgacca

SEQ ID NO: 903403 - DNA, 17 bp, Homo sapiens
agacccccaccccttcc

SEQ ID NO: 903404 - DNA, 21 bp, Homo sapiens
agacccccaccccttccccac

SEQ ID NO: 903405 - DNA, 20 bp, Homo sapiens
agacccccatttgtcccaga

SEQ ID NO: 903406 - DNA, 23 bp, Homo sapiens
agacccccccatttcccgcacat

SEQ ID NO: 903407 - DNA, 13 bp, Homo sapiens
agaccccctcagc

SEQ ID NO: 903408 - DNA, 15 bp, Homo sapiens
agaccccctcagcct

SEQ ID NO: 903409 - DNA, 15 bp, Homo sapiens
agaccccgcactgca

SEQ ID NO: 903410 - DNA, 16 bp, Homo sapiens
agaccccgcactgcag

SEQ ID NO: 903411 - DNA, 17 bp, Homo sapiens
agaccccgtggctctgg

SEQ ID NO: 903412 - DNA, 21 bp, Homo sapiens
agaccccgtggctctgggaga

SEQ ID NO: 903413 - DNA, 18 bp, Homo sapiens
agacccctctcaacaccc

SEQ ID NO: 903414 - DNA, 17 bp, Homo sapiens
agacccctctggccagg

SEQ ID NO: 903415 - DNA, 18 bp, Homo sapiens
agacccctgcctggactt

SEQ ID NO: 903416 - DNA, 19 bp, Homo sapiens
agaccccttcctttcctct

SEQ ID NO: 903417 - DNA, 13 bp, Homo sapiens
agaccccttgttg

SEQ ID NO: 903418 - DNA, 20 bp, Homo sapiens
agaccccttgttgcactgcc

SEQ ID NO: 903419 - DNA, 22 bp, Homo sapiens
agaccctactgaagtggctggt

SEQ ID NO: 903420 - DNA, 11 bp, Homo sapiens
agaccctcact

SEQ ID NO: 903421 - DNA, 21 bp, Homo sapiens
agaccctcactgctggggagt

SEQ ID NO: 903422 - DNA, 19 bp, Homo sapiens
agaccctcgcccaactcca

SEQ ID NO: 903423 - DNA, 19 bp, Homo sapiens
agaccctcgggccccatcc

SEQ ID NO: 903424 - DNA, 14 bp, Homo sapiens
agaccctgaaccca

SEQ ID NO: 903425 - DNA, 20 bp, Homo sapiens
agaccctgaacccacacctg

SEQ ID NO: 903426 - DNA, 11 bp, Homo sapiens
agaccctgaga

SEQ ID NO: 903427 - DNA, 13 bp, Homo sapiens
agaccctgagact

SEQ ID NO: 903428 - DNA, 15 bp, Homo sapiens
agaccctgccacagc

SEQ ID NO: 903429 - DNA, 16 bp, Homo sapiens
agaccctgccacagcc

SEQ ID NO: 903430 - DNA, 19 bp, Homo sapiens
agaccctgccccctgccag

SEQ ID NO: 903431 - DNA, 11 bp, Homo sapiens
agaccctgcct

SEQ ID NO: 903432 - DNA, 15 bp, Homo sapiens
agaccctgcctgagc

SEQ ID NO: 903433 - DNA, 22 bp, Homo sapiens
agaccctgcctgagcccaggag

SEQ ID NO: 903434 - DNA, 20 bp, Homo sapiens
agaccctggaattcagcacc

SEQ ID NO: 903435 - DNA, 22 bp, Homo sapiens
agaccctggaattcagcaccct

SEQ ID NO: 903436 - DNA, 17 bp, Homo sapiens
agaccctgggagagaag

SEQ ID NO: 903437 - DNA, 19 bp, Homo sapiens
agaccctgggtgggctctg

SEQ ID NO: 903438 - DNA, 12 bp, Homo sapiens
agaccctgtctc

SEQ ID NO: 903439 - DNA, 13 bp, Homo sapiens
agaccctgtctct

SEQ ID NO: 903440 - DNA, 21 bp, Homo sapiens
agacccttattgctgtcctgg

SEQ ID NO: 903441 - DNA, 22 bp, Homo sapiens
agacccttattgctgtcctgga

SEQ ID NO: 903442 - DNA, 15 bp, Homo sapiens
agaccgagaggccag

SEQ ID NO: 903443 - DNA, 21 bp, Homo sapiens
agaccgagcgctttctggaaa

SEQ ID NO: 903444 - DNA, 16 bp, Homo sapiens
agaccgagtgaaccta

SEQ ID NO: 903445 - DNA, 15 bp, Homo sapiens
agaccgatcggcggc

SEQ ID NO: 903446 - DNA, 16 bp, Homo sapiens
agaccgcagagggaag

SEQ ID NO: 903447 - DNA, 15 bp, Homo sapiens
agaccgccccagggc

SEQ ID NO: 903448 - DNA, 16 bp, Homo sapiens
agaccgccccagggct

SEQ ID NO: 903449 - DNA, 16 bp, Homo sapiens
agatggtccatttgtt

SEQ ID NO: 903450 - DNA, 17 bp, Homo sapiens
agatggtccatttgttc

SEQ ID NO: 903451 - DNA, 21 bp, Homo sapiens
agatggtccatttgttcctgc

SEQ ID NO: 903452 - DNA, 22 bp, Homo sapiens
agatggtccgtgcccaggccct

SEQ ID NO: 903453 - DNA, 14 bp, Homo sapiens
agatggtggcagta

SEQ ID NO: 903454 - DNA, 15 bp, Homo sapiens
agatggtggccacag

SEQ ID NO: 903455 - DNA, 17 bp, Homo sapiens
agatggtggctgtgtct

SEQ ID NO: 903456 - DNA, 21 bp, Homo sapiens
agatggtgtgggtgtcctgcc

SEQ ID NO: 903457 - DNA, 22 bp, Homo sapiens
agatggtgtgggtgtcctgcct

SEQ ID NO: 903458 - DNA, 18 bp, Homo sapiens
agatggttaaaaaggcca

SEQ ID NO: 903459 - DNA, 17 bp, Homo sapiens
agatgtaaaaggtatta

SEQ ID NO: 903460 - DNA, 22 bp, Homo sapiens
agatgtaattatgttttcaact

SEQ ID NO: 903461 - DNA, 13 bp, Homo sapiens
agatgtaattttg

SEQ ID NO: 903462 - DNA, 14 bp, Homo sapiens
agatgtaattttgt

SEQ ID NO: 903463 - DNA, 21 bp, Homo sapiens
agatgtacatagagatctatt

SEQ ID NO: 903464 - DNA, 14 bp, Homo sapiens
agatgtacatttaa

SEQ ID NO: 903465 - DNA, 12 bp, Homo sapiens
agatgtagcatt

SEQ ID NO: 903466 - DNA, 15 bp, Homo sapiens
agatgtatatttgca

SEQ ID NO: 903467 - DNA, 16 bp, Homo sapiens
agatgtatatttgcat

SEQ ID NO: 903468 - DNA, 13 bp, Homo sapiens
agatgtatgcaca

SEQ ID NO: 903469 - DNA, 18 bp, Homo sapiens
agatgtatgcacacacat

SEQ ID NO: 903470 - DNA, 22 bp, Homo sapiens
agatgtatgctttgaatgcaaa

SEQ ID NO: 903471 - DNA, 17 bp, Homo sapiens
agatgtattgactgtac

SEQ ID NO: 903472 - DNA, 13 bp, Homo sapiens
agatgtatttttg

SEQ ID NO: 903473 - DNA, 21 bp, Homo sapiens
agatgtatttttgatgtatat

SEQ ID NO: 903474 - DNA, 22 bp, Homo sapiens
agatgtatttttgatgtatata

SEQ ID NO: 903475 - DNA, 18 bp, Homo sapiens
agatgtcagactggctgg

SEQ ID NO: 903476 - DNA, 20 bp, Homo sapiens
agatgtcagccgagccgggc

SEQ ID NO: 903477 - DNA, 24 bp, Homo sapiens
agatgtcccttgatgcacagagaa

SEQ ID NO: 903478 - DNA, 20 bp, Homo sapiens
agatgtccctttcttggcca

SEQ ID NO: 903479 - DNA, 21 bp, Homo sapiens
agatgtccctttcttggccag

SEQ ID NO: 903480 - DNA, 22 bp, Homo sapiens
agatgtccctttcttggccagt

SEQ ID NO: 903481 - DNA, 21 bp, Homo sapiens
agatgtctatgtagctgaaaa

SEQ ID NO: 903482 - DNA, 12 bp, Homo sapiens
agatgtctattc

SEQ ID NO: 903483 - DNA, 14 bp, Homo sapiens
agatgtctctgggg

SEQ ID NO: 903484 - DNA, 16 bp, Homo sapiens
agatgtcttccctggg

SEQ ID NO: 903485 - DNA, 13 bp, Homo sapiens
agatgtcttggaa

SEQ ID NO: 903486 - DNA, 13 bp, Homo sapiens
agatgtctttagg

SEQ ID NO: 903487 - DNA, 15 bp, Homo sapiens
agatgtgagccaccg

SEQ ID NO: 903488 - DNA, 22 bp, Homo sapiens
agatgtgagccaccgtgcctgg

SEQ ID NO: 903489 - DNA, 13 bp, Homo sapiens
agatgtgcaataa

SEQ ID NO: 903490 - DNA, 17 bp, Homo sapiens
agatgtgcaataatttg

SEQ ID NO: 903491 - DNA, 14 bp, Homo sapiens
agatgtgcctgtgg

SEQ ID NO: 903492 - DNA, 18 bp, Homo sapiens
agatgtgcctgtgggagg

SEQ ID NO: 903493 - DNA, 20 bp, Homo sapiens
agatgtgcctgtgggagggg

SEQ ID NO: 903494 - DNA, 13 bp, Homo sapiens
agatgtgcttctg

SEQ ID NO: 903495 - DNA, 16 bp, Homo sapiens
agatgtggatttggca

SEQ ID NO: 903496 - DNA, 15 bp, Homo sapiens
agatgtgtctgggag

SEQ ID NO: 903497 - DNA, 19 bp, Homo sapiens
agatgtgtctgggagagcc

SEQ ID NO: 903498 - DNA, 20 bp, Homo sapiens
agatgtgtctgggagagcct

SEQ ID NO: 903499 - DNA, 14 bp, Homo sapiens
agatgttaaaataa

SEQ ID NO: 903500 - DNA, 13 bp, Homo sapiens
agatgttaaaatc

SEQ ID NO: 903501 - DNA, 13 bp, Homo sapiens
agatgttaaatgg

SEQ ID NO: 903502 - DNA, 21 bp, Homo sapiens
agatgttaatggggaccctcc

SEQ ID NO: 903503 - DNA, 16 bp, Homo sapiens
agatgttaatttactt

SEQ ID NO: 903504 - DNA, 16 bp, Homo sapiens
agatgttattactgtt

SEQ ID NO: 903505 - DNA, 19 bp, Homo sapiens
agatgttccagtgaggaac

SEQ ID NO: 903506 - DNA, 20 bp, Homo sapiens
agatgttctaagtctttcca

SEQ ID NO: 903507 - DNA, 18 bp, Homo sapiens
agatgttgaggggaggag

SEQ ID NO: 903508 - DNA, 12 bp, Homo sapiens
agatgtttaaca

SEQ ID NO: 903509 - DNA, 19 bp, Homo sapiens
agatgtttaacaaatctaa

SEQ ID NO: 903510 - DNA, 14 bp, Homo sapiens
agatgtttacattt

SEQ ID NO: 903511 - DNA, 14 bp, Homo sapiens
agatgtttcacacc

SEQ ID NO: 903512 - DNA, 23 bp, Homo sapiens
agatgtttccagacttccttgag

SEQ ID NO: 903513 - DNA, 13 bp, Homo sapiens
agatgtttgaaaa

SEQ ID NO: 903514 - DNA, 24 bp, Homo sapiens
agatgtttgtcagatatgatatgt

SEQ ID NO: 903515 - DNA, 21 bp, Homo sapiens
agatgttttacgcaaggaagg

SEQ ID NO: 903516 - DNA, 20 bp, Homo sapiens
agatgttttgggatcaggag

SEQ ID NO: 903517 - DNA, 23 bp, Homo sapiens
agatgttttggtcaagtagtttg

SEQ ID NO: 903518 - DNA, 18 bp, Homo sapiens
agatgtttttaattctag

SEQ ID NO: 903519 - DNA, 18 bp, Homo sapiens
agattaacctgaaagaac

SEQ ID NO: 903520 - DNA, 11 bp, Homo sapiens
agattaatatt

SEQ ID NO: 903521 - DNA, 11 bp, Homo sapiens
agattaatttt

SEQ ID NO: 903522 - DNA, 21 bp, Homo sapiens
agattaccccctcattgttta

SEQ ID NO: 903523 - DNA, 18 bp, Homo sapiens
agattactttgctgcctt

SEQ ID NO: 903524 - DNA, 15 bp, Homo sapiens
agattactttgtccc

SEQ ID NO: 903525 - DNA, 16 bp, Homo sapiens
agattactttgtcccg

SEQ ID NO: 903526 - DNA, 17 bp, Homo sapiens
agattaggagaaacaca

SEQ ID NO: 903527 - DNA, 17 bp, Homo sapiens
agattaggtcgttttcc

SEQ ID NO: 903528 - DNA, 19 bp, Homo sapiens
agattatcgttttcttaaa

SEQ ID NO: 903529 - DNA, 19 bp, Homo sapiens
agattatctgattccttta

SEQ ID NO: 903530 - DNA, 14 bp, Homo sapiens
agattatgatgcat

SEQ ID NO: 903531 - DNA, 14 bp, Homo sapiens
agattattccttct

SEQ ID NO: 903532 - DNA, 14 bp, Homo sapiens
agattatttacaag

SEQ ID NO: 903533 - DNA, 19 bp, Homo sapiens
agattatttacaagaagaa

SEQ ID NO: 903534 - DNA, 21 bp, Homo sapiens
agattatttcatatactataa

SEQ ID NO: 903535 - DNA, 16 bp, Homo sapiens
agattatttcattcgt

SEQ ID NO: 903536 - DNA, 12 bp, Homo sapiens
agattatttctg

SEQ ID NO: 903537 - DNA, 17 bp, Homo sapiens
agattattttttaaaaa

SEQ ID NO: 903538 - DNA, 17 bp, Homo sapiens
agattcaattttcttta

SEQ ID NO: 903539 - DNA, 17 bp, Homo sapiens
agattcacctgtaaaac

SEQ ID NO: 903540 - DNA, 19 bp, Homo sapiens
agattcacctgtaaaactt

SEQ ID NO: 903541 - DNA, 20 bp, Homo sapiens
agattcacctgtaaaacttt

SEQ ID NO: 903542 - DNA, 21 bp, Homo sapiens
agattcacctgtaaaacttta

SEQ ID NO: 903543 - DNA, 17 bp, Homo sapiens
agattcactttgtttat

SEQ ID NO: 903544 - DNA, 16 bp, Homo sapiens
agattcaggccagccc

SEQ ID NO: 903545 - DNA, 16 bp, Homo sapiens
agattcaggggaaggg

SEQ ID NO: 903546 - DNA, 17 bp, Homo sapiens
agattcaggggaagggc

SEQ ID NO: 903547 - DNA, 21 bp, Homo sapiens
agattcaggggaagggcaggc

SEQ ID NO: 903548 - DNA, 19 bp, Homo sapiens
agattcataaagtaatgat

SEQ ID NO: 903549 - DNA, 21 bp, Homo sapiens
agattcattatttttccactt

SEQ ID NO: 903550 - DNA, 23 bp, Homo sapiens
agattccacaggacacgaaggct

SEQ ID NO: 903551 - DNA, 19 bp, Homo sapiens
agattccagagagtggctc

SEQ ID NO: 903552 - DNA, 22 bp, Homo sapiens
agattccagagagtggctcctc

SEQ ID NO: 903553 - DNA, 12 bp, Homo sapiens
agattccaggat

SEQ ID NO: 903554 - DNA, 12 bp, Homo sapiens
agattcccagac

SEQ ID NO: 903555 - DNA, 13 bp, Homo sapiens
agattcccagaga

SEQ ID NO: 903556 - DNA, 16 bp, Homo sapiens
agattcccctgtgtca

SEQ ID NO: 903557 - DNA, 16 bp, Homo sapiens
agattcgctttccatg

SEQ ID NO: 903558 - DNA, 15 bp, Homo sapiens
agattctcctgtgct

SEQ ID NO: 903559 - DNA, 13 bp, Homo sapiens
agattctctttaa

SEQ ID NO: 903560 - DNA, 22 bp, Homo sapiens
agattctgaaacaggccctctg

SEQ ID NO: 903561 - DNA, 16 bp, Homo sapiens
agattctgacatttat

SEQ ID NO: 903562 - DNA, 19 bp, Homo sapiens
agattctgacatttatatt

SEQ ID NO: 903563 - DNA, 14 bp, Homo sapiens
agattctgattcag

SEQ ID NO: 903564 - DNA, 14 bp, Homo sapiens
agattctgcctctc

SEQ ID NO: 903565 - DNA, 15 bp, Homo sapiens
agattctgcctctct

SEQ ID NO: 903566 - DNA, 19 bp, Homo sapiens
agattctggatctcctgct

SEQ ID NO: 903567 - DNA, 21 bp, Homo sapiens
agattctgtgatcttttaaag

SEQ ID NO: 903568 - DNA, 17 bp, Homo sapiens
agattcttacaaggccc

SEQ ID NO: 903569 - DNA, 14 bp, Homo sapiens
agattcttcctttt

SEQ ID NO: 903570 - DNA, 12 bp, Homo sapiens
agattcttttaa

SEQ ID NO: 903571 - DNA, 18 bp, Homo sapiens
agattgaaaatcttgtgt

SEQ ID NO: 903572 - DNA, 20 bp, Homo sapiens
agattgaagaatctgcccct

SEQ ID NO: 903573 - DNA, 21 bp, Homo sapiens
agattgacctgaggagacatc

SEQ ID NO: 903574 - DNA, 17 bp, Homo sapiens
agattgacgacaagtgc

SEQ ID NO: 903575 - DNA, 12 bp, Homo sapiens
agattgagaaat

SEQ ID NO: 903576 - DNA, 19 bp, Homo sapiens
agattgagagaagagacaa

SEQ ID NO: 903577 - DNA, 19 bp, Homo sapiens
agattgaggcctgccctca

SEQ ID NO: 903578 - DNA, 21 bp, Homo sapiens
agattgagtaggtaccttgta

SEQ ID NO: 903579 - DNA, 12 bp, Homo sapiens
agattgcactgc

SEQ ID NO: 903580 - DNA, 19 bp, Homo sapiens
agattgcactgctgcattc

SEQ ID NO: 903581 - DNA, 17 bp, Homo sapiens
agattgccccagagccc

SEQ ID NO: 903582 - DNA, 19 bp, Homo sapiens
agattgctgaaaaagtaga

SEQ ID NO: 903583 - DNA, 13 bp, Homo sapiens
agattgctgaaat

SEQ ID NO: 903584 - DNA, 22 bp, Homo sapiens
agattgctgaatcccatcaggc

SEQ ID NO: 903585 - DNA, 15 bp, Homo sapiens
agattgctgcttctg

SEQ ID NO: 903586 - DNA, 16 bp, Homo sapiens
agattgcttaaaatag

SEQ ID NO: 903587 - DNA, 16 bp, Homo sapiens
agattggagctgaaga

SEQ ID NO: 903588 - DNA, 15 bp, Homo sapiens
agattggatcaagta

SEQ ID NO: 903589 - DNA, 15 bp, Homo sapiens
agattggcatggctt

SEQ ID NO: 903590 - DNA, 23 bp, Homo sapiens
agattggcatggctttatttgtt

SEQ ID NO: 903591 - DNA, 16 bp, Homo sapiens
agattggccagtgaga

SEQ ID NO: 903592 - DNA, 16 bp, Homo sapiens
agattggttctgtttt

SEQ ID NO: 903593 - DNA, 16 bp, Homo sapiens
agattgtacttagcca

SEQ ID NO: 903594 - DNA, 14 bp, Homo sapiens
agattgtcatagtt

SEQ ID NO: 903595 - DNA, 18 bp, Homo sapiens
agattgtgaatatttcca

SEQ ID NO: 903596 - DNA, 22 bp, Homo sapiens
agattgtggaatgttggataag

SEQ ID NO: 903597 - DNA, 17 bp, Homo sapiens
agattgttattaaatgt

SEQ ID NO: 903598 - DNA, 22 bp, Homo sapiens
agattgttgataggaactgtct

SEQ ID NO: 903599 - DNA, 21 bp, Homo sapiens
agattgttggtgaattttcaa

SEQ ID NO: 903600 - DNA, 23 bp, Homo sapiens
agattgttgtttgccatactttg

SEQ ID NO: 903601 - DNA, 16 bp, Homo sapiens
agattgttttgccact

SEQ ID NO: 903602 - DNA, 23 bp, Homo sapiens
agatttaagtgaatacattaacg

SEQ ID NO: 903603 - DNA, 20 bp, Homo sapiens
agatttaatctgccaagggc

SEQ ID NO: 903604 - DNA, 14 bp, Homo sapiens
agatttacattcca

SEQ ID NO: 903605 - DNA, 22 bp, Homo sapiens
agatttaccttttctgttgtac

SEQ ID NO: 903606 - DNA, 17 bp, Homo sapiens
agatttacttaattgct

SEQ ID NO: 903607 - DNA, 17 bp, Homo sapiens
agatttaggagcagaaa

SEQ ID NO: 903608 - DNA, 18 bp, Homo sapiens
agatttagttttgtaact

SEQ ID NO: 903609 - DNA, 14 bp, Homo sapiens
agatttatacagtt

SEQ ID NO: 903610 - DNA, 17 bp, Homo sapiens
agatttatctttataca

SEQ ID NO: 903611 - DNA, 18 bp, Homo sapiens
agatttatttttcagttc

SEQ ID NO: 903612 - DNA, 20 bp, Homo sapiens
agatttcagtaatgtcttca

SEQ ID NO: 903613 - DNA, 22 bp, Homo sapiens
agatttccattgtgtggcctgg

SEQ ID NO: 903614 - DNA, 21 bp, Homo sapiens
agatttcccttcatttaaact

SEQ ID NO: 903615 - DNA, 17 bp, Homo sapiens
agatttcctccatggtg

SEQ ID NO: 903616 - DNA, 15 bp, Homo sapiens
agatttccttttttc

SEQ ID NO: 903617 - DNA, 22 bp, Homo sapiens
agatttccttttttcttttctt

SEQ ID NO: 903618 - DNA, 20 bp, Homo sapiens
agatttctcttgggcaggca

SEQ ID NO: 903619 - DNA, 16 bp, Homo sapiens
agatttctggttgatt

SEQ ID NO: 903620 - DNA, 12 bp, Homo sapiens
agatttgaaaat

SEQ ID NO: 903621 - DNA, 13 bp, Homo sapiens
agatttgaaaatt

SEQ ID NO: 903622 - DNA, 14 bp, Homo sapiens
agatttgaaaattg

SEQ ID NO: 903623 - DNA, 14 bp, Homo sapiens
agatttgacgttgt

SEQ ID NO: 903624 - DNA, 15 bp, Homo sapiens
agatttgccagcaca

SEQ ID NO: 903625 - DNA, 23 bp, Homo sapiens
agatttgtccttttatttctcca

SEQ ID NO: 903626 - DNA, 15 bp, Homo sapiens
agatttgtctaattg

SEQ ID NO: 903627 - DNA, 13 bp, Homo sapiens
agatttgtgttat

SEQ ID NO: 903628 - DNA, 17 bp, Homo sapiens
agatttgttactgtatt

SEQ ID NO: 903629 - DNA, 16 bp, Homo sapiens
agatttgttgacagca

SEQ ID NO: 903630 - DNA, 17 bp, Homo sapiens
agatttgtttttaaact

SEQ ID NO: 903631 - DNA, 22 bp, Homo sapiens
agatttgtttttaaactgtaca

SEQ ID NO: 903632 - DNA, 23 bp, Homo sapiens
agatttgtttttaaactgtacag

SEQ ID NO: 903633 - DNA, 18 bp, Homo sapiens
agattttaagtattgttt

SEQ ID NO: 903634 - DNA, 18 bp, Homo sapiens
agattttaatttatttgt

SEQ ID NO: 903635 - DNA, 14 bp, Homo sapiens
agattttactttaa

SEQ ID NO: 903636 - DNA, 15 bp, Homo sapiens
agattttatattttc

SEQ ID NO: 903637 - DNA, 18 bp, Homo sapiens
agattttatgcacagcct

SEQ ID NO: 903638 - DNA, 15 bp, Homo sapiens
agattttattgtata

SEQ ID NO: 903639 - DNA, 16 bp, Homo sapiens
agattttatttatgcg

SEQ ID NO: 903640 - DNA, 20 bp, Homo sapiens
agattttctaagaaccaaaa

SEQ ID NO: 903641 - DNA, 22 bp, Homo sapiens
agattttcttttgccttttgca

SEQ ID NO: 903642 - DNA, 21 bp, Homo sapiens
agattttgaaatttttattaa

SEQ ID NO: 903643 - DNA, 18 bp, Homo sapiens
agatttttaacaaaaaac

SEQ ID NO: 903644 - DNA, 18 bp, Homo sapiens
agatttttgatatctcaa

SEQ ID NO: 903645 - DNA, 17 bp, Homo sapiens
agatttttgattcagct

SEQ ID NO: 903646 - DNA, 14 bp, Homo sapiens
agattttttaataa

SEQ ID NO: 903647 - DNA, 21 bp, Homo sapiens
agatttttttcatagatttga

SEQ ID NO: 903648 - DNA, 22 bp, Homo sapiens
agatttttttcatagatttgaa

SEQ ID NO: 903649 - DNA, 14 bp, Homo sapiens
agatttttttgtgt

SEQ ID NO: 903650 - DNA, 13 bp, Homo sapiens
agattttttttaa

SEQ ID NO: 903651 - DNA, 18 bp, Homo sapiens
agattttttttaaagttt

SEQ ID NO: 903652 - DNA, 18 bp, Homo sapiens
agattttttttttaagtg

SEQ ID NO: 903653 - DNA, 14 bp, Homo sapiens
agcaaaaacatgta

SEQ ID NO: 903654 - DNA, 16 bp, Homo sapiens
agcaaaaactacattt

SEQ ID NO: 903655 - DNA, 16 bp, Homo sapiens
agcaaaaactgtggga

SEQ ID NO: 903656 - DNA, 20 bp, Homo sapiens
agcaaaaatgacaacagaaa

SEQ ID NO: 903657 - DNA, 12 bp, Homo sapiens
agcaaaacaaaa

SEQ ID NO: 903658 - DNA, 17 bp, Homo sapiens
agcaaaacaaattcaaa

SEQ ID NO: 903659 - DNA, 16 bp, Homo sapiens
agcaaaacaagtgaca

SEQ ID NO: 903660 - DNA, 16 bp, Homo sapiens
agcaaaacatctctgc

SEQ ID NO: 903661 - DNA, 22 bp, Homo sapiens
agcaaaaccattgcttcactac

SEQ ID NO: 903662 - DNA, 14 bp, Homo sapiens
agcaaaagaaaaag

SEQ ID NO: 903663 - DNA, 14 bp, Homo sapiens
agcaaaagaaacta

SEQ ID NO: 903664 - DNA, 17 bp, Homo sapiens
agcaaaagaatggcaga

SEQ ID NO: 903665 - DNA, 17 bp, Homo sapiens
agcaaaagaccaaatct

SEQ ID NO: 903666 - DNA, 18 bp, Homo sapiens
agcaaaagatgcttctca

SEQ ID NO: 903667 - DNA, 14 bp, Homo sapiens
agcaaaaggcagct

SEQ ID NO: 903668 - DNA, 22 bp, Homo sapiens
agcaaaaggcagctcacccctg

SEQ ID NO: 903669 - DNA, 17 bp, Homo sapiens
agcaaaataaggaagag

SEQ ID NO: 903670 - DNA, 21 bp, Homo sapiens
agcaaaataaggaagagggct

SEQ ID NO: 903671 - DNA, 21 bp, Homo sapiens
agcaaaataattttaaacaaa

SEQ ID NO: 903672 - DNA, 16 bp, Homo sapiens
agcaaaatatgcccct

SEQ ID NO: 903673 - DNA, 24 bp, Homo sapiens
agcaaaatatgccccttcttgggc

SEQ ID NO: 903674 - DNA, 17 bp, Homo sapiens
agcaaaatggaagcaaa

SEQ ID NO: 903675 - DNA, 13 bp, Homo sapiens
agcaaaatgttga

SEQ ID NO: 903676 - DNA, 15 bp, Homo sapiens
agcaaacaatggtgt

SEQ ID NO: 903677 - DNA, 13 bp, Homo sapiens
agcaaacagctga

SEQ ID NO: 903678 - DNA, 23 bp, Homo sapiens
agcaaacagctgaaagaggagga

SEQ ID NO: 903679 - DNA, 16 bp, Homo sapiens
agcaaacatcaaataa

SEQ ID NO: 903680 - DNA, 21 bp, Homo sapiens
agcaaacatcaaataaatttc

SEQ ID NO: 903681 - DNA, 11 bp, Homo sapiens
agcaaaccaat

SEQ ID NO: 903682 - DNA, 11 bp, Homo sapiens
agcaaaccatt

SEQ ID NO: 903683 - DNA, 17 bp, Homo sapiens
agcaaaccatttttaaa

SEQ ID NO: 903684 - DNA, 23 bp, Homo sapiens
agcaaaccatttttaaagtagaa

SEQ ID NO: 903685 - DNA, 19 bp, Homo sapiens
agcaaacccagaggtggat

SEQ ID NO: 903686 - DNA, 20 bp, Homo sapiens
agcaaacgtctattttgtat

SEQ ID NO: 903687 - DNA, 13 bp, Homo sapiens
agcaaactaagcc

SEQ ID NO: 903688 - DNA, 13 bp, Homo sapiens
agcaaacttggaa

SEQ ID NO: 903689 - DNA, 12 bp, Homo sapiens
agcaaagacaaa

SEQ ID NO: 903690 - DNA, 19 bp, Homo sapiens
agcaaagacaaaagaaact

SEQ ID NO: 903691 - DNA, 20 bp, Homo sapiens
agcaaagacaaaagaaactt

SEQ ID NO: 903692 - DNA, 16 bp, Homo sapiens
agcaaagagtgggctg

SEQ ID NO: 903693 - DNA, 14 bp, Homo sapiens
agcaaagatcaaaa

SEQ ID NO: 903694 - DNA, 14 bp, Homo sapiens
agcaaagatttcag

SEQ ID NO: 903695 - DNA, 20 bp, Homo sapiens
agcaaagcacccatttcaat

SEQ ID NO: 903696 - DNA, 19 bp, Homo sapiens
agcaaagcgcccacccagg

SEQ ID NO: 903697 - DNA, 12 bp, Homo sapiens
agcaaaggcagt

SEQ ID NO: 903698 - DNA, 12 bp, Homo sapiens
agcaaagggggg

SEQ ID NO: 903699 - DNA, 22 bp, Homo sapiens
cagaggacgcacgctcgctgcc

SEQ ID NO: 903700 - DNA, 20 bp, Homo sapiens
cagaggagagtcccagagca

SEQ ID NO: 903701 - DNA, 17 bp, Homo sapiens
cagaggagcaaggttta

SEQ ID NO: 903702 - DNA, 13 bp, Homo sapiens
cagaggagcccag

SEQ ID NO: 903703 - DNA, 14 bp, Homo sapiens
cagaggagcccagt

SEQ ID NO: 903704 - DNA, 18 bp, Homo sapiens
cagaggagcgcaggcagc

SEQ ID NO: 903705 - DNA, 14 bp, Homo sapiens
cagaggagggcaga

SEQ ID NO: 903706 - DNA, 19 bp, Homo sapiens
cagaggaggggacttgtag

SEQ ID NO: 903707 - DNA, 14 bp, Homo sapiens
cagaggaggggccg

SEQ ID NO: 903708 - DNA, 19 bp, Homo sapiens
cagaggaggggccgctgcc

SEQ ID NO: 903709 - DNA, 20 bp, Homo sapiens
cagaggaggggccgctgcca

SEQ ID NO: 903710 - DNA, 15 bp, Homo sapiens
cagaggatgcctttt

SEQ ID NO: 903711 - DNA, 16 bp, Homo sapiens
cagaggcaactgactt

SEQ ID NO: 903712 - DNA, 13 bp, Homo sapiens
cagaggcacctca

SEQ ID NO: 903713 - DNA, 11 bp, Homo sapiens
cagaggcaggc

SEQ ID NO: 903714 - DNA, 14 bp, Homo sapiens
cagaggcaggctgg

SEQ ID NO: 903715 - DNA, 15 bp, Homo sapiens
cagaggcaggctggg

SEQ ID NO: 903716 - DNA, 16 bp, Homo sapiens
cagaggccaaggactg

SEQ ID NO: 903717 - DNA, 20 bp, Homo sapiens
cagaggccaaggactgactt

SEQ ID NO: 903718 - DNA, 17 bp, Homo sapiens
cagaggcccccagccca

SEQ ID NO: 903719 - DNA, 16 bp, Homo sapiens
cagaggcccccagtgg

SEQ ID NO: 903720 - DNA, 19 bp, Homo sapiens
cagaggcccccagtgggga

SEQ ID NO: 903721 - DNA, 23 bp, Homo sapiens
cagaggcccccagtggggacagg

SEQ ID NO: 903722 - DNA, 18 bp, Homo sapiens
cagaggccctaggcggga

SEQ ID NO: 903723 - DNA, 23 bp, Homo sapiens
cagaggccctaggcgggatgggc

SEQ ID NO: 903724 - DNA, 19 bp, Homo sapiens
cagaggccctcgctgccag

SEQ ID NO: 903725 - DNA, 11 bp, Homo sapiens
cagaggccctg

SEQ ID NO: 903726 - DNA, 13 bp, Homo sapiens
cagaggccctgaa

SEQ ID NO: 903727 - DNA, 14 bp, Homo sapiens
cagaggccctgaag

SEQ ID NO: 903728 - DNA, 19 bp, Homo sapiens
cagaggccctgaagcctcc

SEQ ID NO: 903729 - DNA, 22 bp, Homo sapiens
cagaggccctgaagcctccgtg

SEQ ID NO: 903730 - DNA, 12 bp, Homo sapiens
cagaggccctgc

SEQ ID NO: 903731 - DNA, 16 bp, Homo sapiens
cagaggccctgccacg

SEQ ID NO: 903732 - DNA, 17 bp, Homo sapiens
cagaggccctgccacgt

SEQ ID NO: 903733 - DNA, 17 bp, Homo sapiens
cagaggccggggtccag

SEQ ID NO: 903734 - DNA, 19 bp, Homo sapiens
cagaggcctgaagctgagc

SEQ ID NO: 903735 - DNA, 16 bp, Homo sapiens
cagaggcctgctgcca

SEQ ID NO: 903736 - DNA, 15 bp, Homo sapiens
cagaggcctggggga

SEQ ID NO: 903737 - DNA, 23 bp, Homo sapiens
cagaggcctgggggacccctggc

SEQ ID NO: 903738 - DNA, 20 bp, Homo sapiens
cagaggccttgtcatcctcc

SEQ ID NO: 903739 - DNA, 22 bp, Homo sapiens
cagaggccttgtcatcctccct

SEQ ID NO: 903740 - DNA, 18 bp, Homo sapiens
cagaggcgcactgtgacc

SEQ ID NO: 903741 - DNA, 16 bp, Homo sapiens
cagaggctgagccctg

SEQ ID NO: 903742 - DNA, 20 bp, Homo sapiens
cagaggctgagccctgtacc

SEQ ID NO: 903743 - DNA, 21 bp, Homo sapiens
cagaggctgcacccctgggcc

SEQ ID NO: 903744 - DNA, 22 bp, Homo sapiens
cagaggctgcacccctgggcca

SEQ ID NO: 903745 - DNA, 23 bp, Homo sapiens
cagaggctgcacccctgggccag

SEQ ID NO: 903746 - DNA, 23 bp, Homo sapiens
cagaggctgcctctcccatcact

SEQ ID NO: 903747 - DNA, 19 bp, Homo sapiens
cagaggctggaggcagggc

SEQ ID NO: 903748 - DNA, 20 bp, Homo sapiens
cagaggctggaggcagggcc

SEQ ID NO: 903749 - DNA, 15 bp, Homo sapiens
cagaggctggcacca

SEQ ID NO: 903750 - DNA, 14 bp, Homo sapiens
cagaggctgggagt

SEQ ID NO: 903751 - DNA, 14 bp, Homo sapiens
cagaggctgggttc

SEQ ID NO: 903752 - DNA, 23 bp, Homo sapiens
cagaggcttccgtgtcctctccc

SEQ ID NO: 903753 - DNA, 15 bp, Homo sapiens
cagaggcttcttcag

SEQ ID NO: 903754 - DNA, 19 bp, Homo sapiens
cagagggaaactcagatgt

SEQ ID NO: 903755 - DNA, 18 bp, Homo sapiens
cagagggaaggggcctac

SEQ ID NO: 903756 - DNA, 19 bp, Homo sapiens
cagagggaatgttccctgc

SEQ ID NO: 903757 - DNA, 14 bp, Homo sapiens
cagagggacagggt

SEQ ID NO: 903758 - DNA, 17 bp, Homo sapiens
cagagggacagggtgga

SEQ ID NO: 903759 - DNA, 19 bp, Homo sapiens
cagagggactttgtataga

SEQ ID NO: 903760 - DNA, 23 bp, Homo sapiens
cagagggagacagggctgctccc

SEQ ID NO: 903761 - DNA, 18 bp, Homo sapiens
cagagggagacggccctg

SEQ ID NO: 903762 - DNA, 20 bp, Homo sapiens
cagagggagacggccctgct

SEQ ID NO: 903763 - DNA, 15 bp, Homo sapiens
cagagggagtagaat

SEQ ID NO: 903764 - DNA, 18 bp, Homo sapiens
cagagggcagaggctgga

SEQ ID NO: 903765 - DNA, 15 bp, Homo sapiens
cagagggcagtggcc

SEQ ID NO: 903766 - DNA, 14 bp, Homo sapiens
cagagggcatgctg

SEQ ID NO: 903767 - DNA, 12 bp, Homo sapiens
cagagggccaga

SEQ ID NO: 903768 - DNA, 15 bp, Homo sapiens
cagagggccagagct

SEQ ID NO: 903769 - DNA, 14 bp, Homo sapiens
cagagggccagcag

SEQ ID NO: 903770 - DNA, 15 bp, Homo sapiens
cagagggccagcagg

SEQ ID NO: 903771 - DNA, 20 bp, Homo sapiens
cagagggccagcaggctcct

SEQ ID NO: 903772 - DNA, 21 bp, Homo sapiens
cagagggccagcaggctcctg

SEQ ID NO: 903773 - DNA, 15 bp, Homo sapiens
cagagggcccaggca

SEQ ID NO: 903774 - DNA, 18 bp, Homo sapiens
cagagggcccaggcaggc

SEQ ID NO: 903775 - DNA, 14 bp, Homo sapiens
cagagggcctggac

SEQ ID NO: 903776 - DNA, 16 bp, Homo sapiens
cagagggcgccaccac

SEQ ID NO: 903777 - DNA, 21 bp, Homo sapiens
cagagggcgccaccaccacct

SEQ ID NO: 903778 - DNA, 22 bp, Homo sapiens
cagagggcgccaccaccacctg

SEQ ID NO: 903779 - DNA, 11 bp, Homo sapiens
cagagggctgg

SEQ ID NO: 903780 - DNA, 14 bp, Homo sapiens
cagagggctggagg

SEQ ID NO: 903781 - DNA, 17 bp, Homo sapiens
cagagggctggaggccc

SEQ ID NO: 903782 - DNA, 14 bp, Homo sapiens
cagagggctggatt

SEQ ID NO: 903783 - DNA, 12 bp, Homo sapiens
cagaggggagca

SEQ ID NO: 903784 - DNA, 13 bp, Homo sapiens
cagaggggagcag

SEQ ID NO: 903785 - DNA, 19 bp, Homo sapiens
cagaggggctttctggaga

SEQ ID NO: 903786 - DNA, 20 bp, Homo sapiens
cagagggggagtagccaagc

SEQ ID NO: 903787 - DNA, 19 bp, Homo sapiens
cagaggggtaagagaggat

SEQ ID NO: 903788 - DNA, 23 bp, Homo sapiens
cagaggggtgggttcctcttccc

SEQ ID NO: 903789 - DNA, 15 bp, Homo sapiens
cagagggtgtggctt

SEQ ID NO: 903790 - DNA, 19 bp, Homo sapiens
cagagggtgtggctttcca

SEQ ID NO: 903791 - DNA, 20 bp, Homo sapiens
cagagggtgtggctttccag

SEQ ID NO: 903792 - DNA, 17 bp, Homo sapiens
cagagggtttgtgccca

SEQ ID NO: 903793 - DNA, 20 bp, Homo sapiens
cagaggtaaaagtgtgagca

SEQ ID NO: 903794 - DNA, 15 bp, Homo sapiens
cagaggtccagccca

SEQ ID NO: 903795 - DNA, 23 bp, Homo sapiens
cagaggtcccagccccaggcctg

SEQ ID NO: 903796 - DNA, 18 bp, Homo sapiens
cagaggtctccaaactga

SEQ ID NO: 903797 - DNA, 19 bp, Homo sapiens
cagaggtctctgccggctc

SEQ ID NO: 903798 - DNA, 23 bp, Homo sapiens
cagaggtctctgccggctctttc

SEQ ID NO: 903799 - DNA, 14 bp, Homo sapiens
cagaggtctgtgct

SEQ ID NO: 903800 - DNA, 14 bp, Homo sapiens
cagaggtgcaagac

SEQ ID NO: 903801 - DNA, 14 bp, Homo sapiens
cagaggtggccaga

SEQ ID NO: 903802 - DNA, 13 bp, Homo sapiens
cagaggtggccct

SEQ ID NO: 903803 - DNA, 14 bp, Homo sapiens
cagaggtggccctt

SEQ ID NO: 903804 - DNA, 14 bp, Homo sapiens
cagaggtgggcagg

SEQ ID NO: 903805 - DNA, 15 bp, Homo sapiens
cagaggtgggcaggt

SEQ ID NO: 903806 - DNA, 17 bp, Homo sapiens
cagaggttatctgcctg

SEQ ID NO: 903807 - DNA, 21 bp, Homo sapiens
cagaggttatctgcctggcct

SEQ ID NO: 903808 - DNA, 19 bp, Homo sapiens
cagagtacgttaaaagcaa

SEQ ID NO: 903809 - DNA, 21 bp, Homo sapiens
cagagtaggctattcctgaga

SEQ ID NO: 903810 - DNA, 20 bp, Homo sapiens
cagagtatttgaaaaatgta

SEQ ID NO: 903811 - DNA, 18 bp, Homo sapiens
cagagtcagaggagaaga

SEQ ID NO: 903812 - DNA, 19 bp, Homo sapiens
cagagtcagaggagaagag

SEQ ID NO: 903813 - DNA, 17 bp, Homo sapiens
cagagtccaatttaagg

SEQ ID NO: 903814 - DNA, 15 bp, Homo sapiens
cagagtccactgtgg

SEQ ID NO: 903815 - DNA, 12 bp, Homo sapiens
cagagtccagtg

SEQ ID NO: 903816 - DNA, 21 bp, Homo sapiens
cagagtccagtgctctgcctc

SEQ ID NO: 903817 - DNA, 16 bp, Homo sapiens
cagagtccggaggcag

SEQ ID NO: 903818 - DNA, 17 bp, Homo sapiens
cagagtcctcattataa

SEQ ID NO: 903819 - DNA, 19 bp, Homo sapiens
cagagtccttagtggaggg

SEQ ID NO: 903820 - DNA, 20 bp, Homo sapiens
cagagtccttattcttctca

SEQ ID NO: 903821 - DNA, 19 bp, Homo sapiens
cagagtctcccagtgggtg

SEQ ID NO: 903822 - DNA, 20 bp, Homo sapiens
cagagtctcccagtgggtga

SEQ ID NO: 903823 - DNA, 15 bp, Homo sapiens
cagagtctgagcccc

SEQ ID NO: 903824 - DNA, 16 bp, Homo sapiens
agcaaaggggggaggt

SEQ ID NO: 903825 - DNA, 14 bp, Homo sapiens
agcaaataaatacg

SEQ ID NO: 903826 - DNA, 21 bp, Homo sapiens
agcaaataaatacgtgtcaaa

SEQ ID NO: 903827 - DNA, 22 bp, Homo sapiens
agcaaataaatgccttccacct

SEQ ID NO: 903828 - DNA, 20 bp, Homo sapiens
agcaaatcagaaacttgtga

SEQ ID NO: 903829 - DNA, 16 bp, Homo sapiens
agcaaatcccatttct

SEQ ID NO: 903830 - DNA, 17 bp, Homo sapiens
agcaaatcccatttctt

SEQ ID NO: 903831 - DNA, 18 bp, Homo sapiens
agcaaatcccatttcttg

SEQ ID NO: 903832 - DNA, 22 bp, Homo sapiens
agcaaatcgaatgaaattaact

SEQ ID NO: 903833 - DNA, 11 bp, Homo sapiens
agcaaatcttt

SEQ ID NO: 903834 - DNA, 13 bp, Homo sapiens
agcaaatgcaaaa

SEQ ID NO: 903835 - DNA, 22 bp, Homo sapiens
agcaaatgcaaaaactctttga

SEQ ID NO: 903836 - DNA, 21 bp, Homo sapiens
agcaaatggaaaatgtatatt

SEQ ID NO: 903837 - DNA, 16 bp, Homo sapiens
agcaaatgtttctgca

SEQ ID NO: 903838 - DNA, 17 bp, Homo sapiens
agcaaattagttggttt

SEQ ID NO: 903839 - DNA, 11 bp, Homo sapiens
agcaaattgat

SEQ ID NO: 903840 - DNA, 14 bp, Homo sapiens
agcaaattgtttca

SEQ ID NO: 903841 - DNA, 20 bp, Homo sapiens
agcaacaaacctcactgaga

SEQ ID NO: 903842 - DNA, 14 bp, Homo sapiens
agcaacacaagctg

SEQ ID NO: 903843 - DNA, 13 bp, Homo sapiens
agcaacagaaaaa

SEQ ID NO: 903844 - DNA, 20 bp, Homo sapiens
agcaacagagtgagaccctg

SEQ ID NO: 903845 - DNA, 14 bp, Homo sapiens
agcaacagcttcag

SEQ ID NO: 903846 - DNA, 14 bp, Homo sapiens
agcaacaggaaaaa

SEQ ID NO: 903847 - DNA, 18 bp, Homo sapiens
agcaacaggttttataat

SEQ ID NO: 903848 - DNA, 15 bp, Homo sapiens
agcaacattcatagt

SEQ ID NO: 903849 - DNA, 14 bp, Homo sapiens
agcaacatttgtat

SEQ ID NO: 903850 - DNA, 19 bp, Homo sapiens
agcaacccctgtacccagc

SEQ ID NO: 903851 - DNA, 19 bp, Homo sapiens
agcaacccgctggagccca

SEQ ID NO: 903852 - DNA, 22 bp, Homo sapiens
agcaacccgctggagcccacag

SEQ ID NO: 903853 - DNA, 15 bp, Homo sapiens
agcaacgcccctcca

SEQ ID NO: 903854 - DNA, 16 bp, Homo sapiens
agcaacgcccctccaa

SEQ ID NO: 903855 - DNA, 17 bp, Homo sapiens
agcaacgcttgtagaac

SEQ ID NO: 903856 - DNA, 13 bp, Homo sapiens
agcaacggcacag

SEQ ID NO: 903857 - DNA, 18 bp, Homo sapiens
agcaacggcccatagcct

SEQ ID NO: 903858 - DNA, 20 bp, Homo sapiens
agcaactccgtgtgcctggg

SEQ ID NO: 903859 - DNA, 16 bp, Homo sapiens
agcaactcttgattat

SEQ ID NO: 903860 - DNA, 20 bp, Homo sapiens
agcaactcttgattatccat

SEQ ID NO: 903861 - DNA, 14 bp, Homo sapiens
agcaactgaataaa

SEQ ID NO: 903862 - DNA, 19 bp, Homo sapiens
agcaactgaataaatacct

SEQ ID NO: 903863 - DNA, 21 bp, Homo sapiens
agcaactgaataaatacctct

SEQ ID NO: 903864 - DNA, 23 bp, Homo sapiens
agcaactgaataaatacctctta

SEQ ID NO: 903865 - DNA, 16 bp, Homo sapiens
agcaactgacctgagc

SEQ ID NO: 903866 - DNA, 20 bp, Homo sapiens
agcaactgttatgaaataaa

SEQ ID NO: 903867 - DNA, 16 bp, Homo sapiens
agcaacttcttctcca

SEQ ID NO: 903868 - DNA, 21 bp, Homo sapiens
agcaacttcttctccatccct

SEQ ID NO: 903869 - DNA, 21 bp, Homo sapiens
agcaacttgtctttttctgga

SEQ ID NO: 903870 - DNA, 23 bp, Homo sapiens
agcaacttgtctttttctggact

SEQ ID NO: 903871 - DNA, 16 bp, Homo sapiens
agcaagaagaaaatgt

SEQ ID NO: 903872 - DNA, 19 bp, Homo sapiens
agcaagaagaaaatgtggc

SEQ ID NO: 903873 - DNA, 19 bp, Homo sapiens
agcaagaaggcaaaaatag

SEQ ID NO: 903874 - DNA, 19 bp, Homo sapiens
agcaagacgtaaagaattt

SEQ ID NO: 903875 - DNA, 20 bp, Homo sapiens
agcaagagagcagcgcccag

SEQ ID NO: 903876 - DNA, 18 bp, Homo sapiens
agcaagagtaagcagtgt

SEQ ID NO: 903877 - DNA, 14 bp, Homo sapiens
agcaagatgcaaat

SEQ ID NO: 903878 - DNA, 15 bp, Homo sapiens
agcaagcattcagaa

SEQ ID NO: 903879 - DNA, 19 bp, Homo sapiens
agcaagccagtgtccttcg

SEQ ID NO: 903880 - DNA, 13 bp, Homo sapiens
agcaagccatcat

SEQ ID NO: 903881 - DNA, 17 bp, Homo sapiens
agcaagccatcatcctc

SEQ ID NO: 903882 - DNA, 22 bp, Homo sapiens
agcaagcttacacaagaagtga

SEQ ID NO: 903883 - DNA, 18 bp, Homo sapiens
agcaaggaaatgtcctgc

SEQ ID NO: 903884 - DNA, 16 bp, Homo sapiens
agcaaggcaggttgga

SEQ ID NO: 903885 - DNA, 22 bp, Homo sapiens
agcaaggccttggtggagcagc

SEQ ID NO: 903886 - DNA, 19 bp, Homo sapiens
agcaaggcgcctgccttgg

SEQ ID NO: 903887 - DNA, 20 bp, Homo sapiens
agcaagggagaaaagagaaa

SEQ ID NO: 903888 - DNA, 20 bp, Homo sapiens
agcaagggagatttttgaat

SEQ ID NO: 903889 - DNA, 24 bp, Homo sapiens
agcaagggcacaaactgcagctgt

SEQ ID NO: 903890 - DNA, 20 bp, Homo sapiens
agcaagggctccagcatcca

SEQ ID NO: 903891 - DNA, 14 bp, Homo sapiens
agcaagggggccca

SEQ ID NO: 903892 - DNA, 17 bp, Homo sapiens
agcaaggtggccacagt

SEQ ID NO: 903893 - DNA, 19 bp, Homo sapiens
agcaaggtttcgtggcagc

SEQ ID NO: 903894 - DNA, 19 bp, Homo sapiens
agcaagtaagaatggccaa

SEQ ID NO: 903895 - DNA, 22 bp, Homo sapiens
agcaagtacagcggctcccctc

SEQ ID NO: 903896 - DNA, 14 bp, Homo sapiens
agcaagtcacctta

SEQ ID NO: 903897 - DNA, 20 bp, Homo sapiens
agcaagtcccagacaaggag

SEQ ID NO: 903898 - DNA, 16 bp, Homo sapiens
agcaagtgttcactgc

SEQ ID NO: 903899 - DNA, 23 bp, Homo sapiens
agcaataaaaactgtctgtctcc

SEQ ID NO: 903900 - DNA, 18 bp, Homo sapiens
agcaataaagatttttca

SEQ ID NO: 903901 - DNA, 18 bp, Homo sapiens
agcaataaagtggaaaca

SEQ ID NO: 903902 - DNA, 19 bp, Homo sapiens
agcaataacactatattta

SEQ ID NO: 903903 - DNA, 22 bp, Homo sapiens
agcaataacattcccactgcca

SEQ ID NO: 903904 - DNA, 12 bp, Homo sapiens
agcaataacttc

SEQ ID NO: 903905 - DNA, 15 bp, Homo sapiens
agcaataacttctat

SEQ ID NO: 903906 - DNA, 22 bp, Homo sapiens
agcaataacttctatgttggtt

SEQ ID NO: 903907 - DNA, 23 bp, Homo sapiens
agcaataacttctatgttggttt

SEQ ID NO: 903908 - DNA, 19 bp, Homo sapiens
agcaataatggtcccatcc

SEQ ID NO: 903909 - DNA, 23 bp, Homo sapiens
agcaataatggtcccatccaggc

SEQ ID NO: 903910 - DNA, 17 bp, Homo sapiens
agcaataattgtttcca

SEQ ID NO: 903911 - DNA, 15 bp, Homo sapiens
agcaatacaacttta

SEQ ID NO: 903912 - DNA, 23 bp, Homo sapiens
agcaatatattaccagcaagaat

SEQ ID NO: 903913 - DNA, 12 bp, Homo sapiens
agcaatatgtca

SEQ ID NO: 903914 - DNA, 20 bp, Homo sapiens
agcaatattgcctgtgcttc

SEQ ID NO: 903915 - DNA, 21 bp, Homo sapiens
agcaatattgtatatttttat

SEQ ID NO: 903916 - DNA, 17 bp, Homo sapiens
agcaatcaagcaccagg

SEQ ID NO: 903917 - DNA, 14 bp, Homo sapiens
agcaatcattttat

SEQ ID NO: 903918 - DNA, 22 bp, Homo sapiens
agcaatccatgttagtttttac

SEQ ID NO: 903919 - DNA, 13 bp, Homo sapiens
agcaatcctccta

SEQ ID NO: 903920 - DNA, 14 bp, Homo sapiens
agcaatcctcctgc

SEQ ID NO: 903921 - DNA, 16 bp, Homo sapiens
agcaatcctcctgcct

SEQ ID NO: 903922 - DNA, 21 bp, Homo sapiens
agcaatcctcctgcctcagcc

SEQ ID NO: 903923 - DNA, 22 bp, Homo sapiens
agcaatcctcctgcctcagcct

SEQ ID NO: 903924 - DNA, 23 bp, Homo sapiens
agcaatcctcctgcctcagcctt

SEQ ID NO: 903925 - DNA, 20 bp, Homo sapiens
agcaatctgcattttaacaa

SEQ ID NO: 903926 - DNA, 13 bp, Homo sapiens
agcaatctttgaa

SEQ ID NO: 903927 - DNA, 17 bp, Homo sapiens
agcaatctttgaaataa

SEQ ID NO: 903928 - DNA, 19 bp, Homo sapiens
agcaatctttgaaataaaa

SEQ ID NO: 903929 - DNA, 19 bp, Homo sapiens
agcaatgacatctcagggg

SEQ ID NO: 903930 - DNA, 20 bp, Homo sapiens
agcaatgacatctcaggggc

SEQ ID NO: 903931 - DNA, 20 bp, Homo sapiens
agcaatgcccgtaatgctta

SEQ ID NO: 903932 - DNA, 19 bp, Homo sapiens
agcaatgcttttaatgaat

SEQ ID NO: 903933 - DNA, 20 bp, Homo sapiens
agcaatgcttttaatgaatt

SEQ ID NO: 903934 - DNA, 15 bp, Homo sapiens
agcaatggccagagc

SEQ ID NO: 903935 - DNA, 22 bp, Homo sapiens
agcaatggccagagcctctggc

SEQ ID NO: 903936 - DNA, 23 bp, Homo sapiens
agcaatgggtcttagctctttct

SEQ ID NO: 903937 - DNA, 23 bp, Homo sapiens
agcaatggtaactgcacctgggc

SEQ ID NO: 903938 - DNA, 15 bp, Homo sapiens
agcaatgtctgtgct

SEQ ID NO: 903939 - DNA, 16 bp, Homo sapiens
agcaattcagacccct

SEQ ID NO: 903940 - DNA, 23 bp, Homo sapiens
agcaattctcctgcctcagcctc

SEQ ID NO: 903941 - DNA, 13 bp, Homo sapiens
agcaattgcagca

SEQ ID NO: 903942 - DNA, 14 bp, Homo sapiens
agcaattgccctgt

SEQ ID NO: 903943 - DNA, 17 bp, Homo sapiens
agcaatttaaatgttat

SEQ ID NO: 903944 - DNA, 21 bp, Homo sapiens
agcaatttcgccgttgaagag

SEQ ID NO: 903945 - DNA, 13 bp, Homo sapiens
agcaatttctaat

SEQ ID NO: 903946 - DNA, 22 bp, Homo sapiens
agcaattttctttgtttctttt

SEQ ID NO: 903947 - DNA, 11 bp, Homo sapiens
agcacaaaatt

SEQ ID NO: 903948 - DNA, 20 bp, Homo sapiens
agcacaaaattcaaagcatg

SEQ ID NO: 903949 - DNA, 16 bp, Homo sapiens
agcacaaacattgctg

SEQ ID NO: 903950 - DNA, 21 bp, Homo sapiens
agcacaaacattgctgccttt

SEQ ID NO: 903951 - DNA, 19 bp, Homo sapiens
agcacaaagttctcagagc

SEQ ID NO: 903952 - DNA, 19 bp, Homo sapiens
agcacaaattagttatata

SEQ ID NO: 903953 - DNA, 13 bp, Homo sapiens
agcacaactccct

SEQ ID NO: 903954 - DNA, 12 bp, Homo sapiens
agcacaaggaat

SEQ ID NO: 903955 - DNA, 21 bp, Homo sapiens
agcacaaggccttgcctggcc

SEQ ID NO: 903956 - DNA, 20 bp, Homo sapiens
agcacaagggcacattgccc

SEQ ID NO: 903957 - DNA, 23 bp, Homo sapiens
agcacaatgtctcacatgggaca

SEQ ID NO: 903958 - DNA, 21 bp, Homo sapiens
agcacaatgtggatttgggga

SEQ ID NO: 903959 - DNA, 15 bp, Homo sapiens
agcacaccagccgct

SEQ ID NO: 903960 - DNA, 16 bp, Homo sapiens
agcacacctctggggg

SEQ ID NO: 903961 - DNA, 14 bp, Homo sapiens
agcacactcatccc

SEQ ID NO: 903962 - DNA, 15 bp, Homo sapiens
agcacactgtatgtt

SEQ ID NO: 903963 - DNA, 23 bp, Homo sapiens
agcacactttacacaagaatcta

SEQ ID NO: 903964 - DNA, 19 bp, Homo sapiens
agcacagaaacagaggaga

SEQ ID NO: 903965 - DNA, 14 bp, Homo sapiens
agcacagaatattt

SEQ ID NO: 903966 - DNA, 12 bp, Homo sapiens
agcacagaatga

SEQ ID NO: 903967 - DNA, 12 bp, Homo sapiens
agcacagagagg

SEQ ID NO: 903968 - DNA, 22 bp, Homo sapiens
agcacagagccctgaggggctg

SEQ ID NO: 903969 - DNA, 22 bp, Homo sapiens
agcacagagcctggccccaggc

SEQ ID NO: 903970 - DNA, 16 bp, Homo sapiens
agcacagagcgtcctt

SEQ ID NO: 903971 - DNA, 16 bp, Homo sapiens
agcacagattttgaat

SEQ ID NO: 903972 - DNA, 10 bp, Homo sapiens
agcacagcag

SEQ ID NO: 903973 - DNA, 12 bp, Homo sapiens
agcacagcagcc

SEQ ID NO: 903974 - DNA, 13 bp, Homo sapiens
agcacagcagctt

SEQ ID NO: 903975 - DNA, 23 bp, Homo sapiens
agcacagccaacacgcacctgcc

SEQ ID NO: 903976 - DNA, 12 bp, Homo sapiens
agcacagccacc

SEQ ID NO: 903977 - DNA, 19 bp, Homo sapiens
agcacagccacctccgcca

SEQ ID NO: 903978 - DNA, 13 bp, Homo sapiens
agcacagcccagg

SEQ ID NO: 903979 - DNA, 15 bp, Homo sapiens
agcacagcccagggc

SEQ ID NO: 903980 - DNA, 16 bp, Homo sapiens
agcacagcccagggcc

SEQ ID NO: 903981 - DNA, 14 bp, Homo sapiens
agcacagccctggg

SEQ ID NO: 903982 - DNA, 16 bp, Homo sapiens
agcacagccctgggag

SEQ ID NO: 903983 - DNA, 12 bp, Homo sapiens
agcacagccctt

SEQ ID NO: 903984 - DNA, 12 bp, Homo sapiens
agcacagcctag

SEQ ID NO: 903985 - DNA, 16 bp, Homo sapiens
agcacagcctcgggga

SEQ ID NO: 903986 - DNA, 20 bp, Homo sapiens
agcacagcttagatttcata

SEQ ID NO: 903987 - DNA, 14 bp, Homo sapiens
agcacagcttgacc

SEQ ID NO: 903988 - DNA, 17 bp, Homo sapiens
agcacaggaattctcaa

SEQ ID NO: 903989 - DNA, 13 bp, Homo sapiens
agcacaggcagct

SEQ ID NO: 903990 - DNA, 12 bp, Homo sapiens
agcacaggctaa

SEQ ID NO: 903991 - DNA, 17 bp, Homo sapiens
agcacaggctaattttt

SEQ ID NO: 903992 - DNA, 12 bp, Homo sapiens
agcacaggggcc

SEQ ID NO: 903993 - DNA, 16 bp, Homo sapiens
agcacaggggccccag

SEQ ID NO: 903994 - DNA, 23 bp, Homo sapiens
agcacaggtcccacctccagccc

SEQ ID NO: 903995 - DNA, 22 bp, Homo sapiens
agcacaggttagggtgtgtgcc

SEQ ID NO: 903996 - DNA, 15 bp, Homo sapiens
agcacagtcaggggc

SEQ ID NO: 903997 - DNA, 16 bp, Homo sapiens
agcacagtcaggggct

SEQ ID NO: 903998 - DNA, 17 bp, Homo sapiens
agcacagtttgaacaaa

SEQ ID NO: 903999 - DNA, 21 bp, Homo sapiens
agcacataactggattttgaa

SEQ ID NO: 904000 - DNA, 19 bp, Homo sapiens
agcacatactgtgttccaa

SEQ ID NO: 904001 - DNA, 17 bp, Homo sapiens
agcacatagtgtcctgc

SEQ ID NO: 904002 - DNA, 21 bp, Homo sapiens
agcacatagtgtcctgcccac

SEQ ID NO: 904003 - DNA, 14 bp, Homo sapiens
agcacatcacctct

SEQ ID NO: 904004 - DNA, 23 bp, Homo sapiens
agcacatcacctctttgcccccg

SEQ ID NO: 904005 - DNA, 16 bp, Homo sapiens
agcacatctctctgcc

SEQ ID NO: 904006 - DNA, 14 bp, Homo sapiens
agcacatgatcatg

SEQ ID NO: 904007 - DNA, 19 bp, Homo sapiens
agcacatgatcatgggaat

SEQ ID NO: 904008 - DNA, 17 bp, Homo sapiens
agcacatggccatagag

SEQ ID NO: 904009 - DNA, 22 bp, Homo sapiens
agcacatggccatagaggccca

SEQ ID NO: 904010 - DNA, 23 bp, Homo sapiens
agcacatggccatagaggcccag

SEQ ID NO: 904011 - DNA, 17 bp, Homo sapiens
agcacatgtctgtcctc

SEQ ID NO: 904012 - DNA, 18 bp, Homo sapiens
agcacatgtgtatttata

SEQ ID NO: 904013 - DNA, 23 bp, Homo sapiens
agcacattcgggaccaatatata

SEQ ID NO: 904014 - DNA, 21 bp, Homo sapiens
agcaccaaaataagaaaagat

SEQ ID NO: 904015 - DNA, 15 bp, Homo sapiens
agcaccaaccacagc

SEQ ID NO: 904016 - DNA, 17 bp, Homo sapiens
agcaccacattgcctca

SEQ ID NO: 904017 - DNA, 17 bp, Homo sapiens
agcaccacctacacagg

SEQ ID NO: 904018 - DNA, 20 bp, Homo sapiens
agcaccacctacacaggagt

SEQ ID NO: 904019 - DNA, 22 bp, Homo sapiens
agcaccagcaattctctttctt

SEQ ID NO: 904020 - DNA, 19 bp, Homo sapiens
agcaccagcttctccaggc

SEQ ID NO: 904021 - DNA, 20 bp, Homo sapiens
agcaccagcttctccaggct

SEQ ID NO: 904022 - DNA, 21 bp, Homo sapiens
agcaccagcttctccaggctc

SEQ ID NO: 904023 - DNA, 12 bp, Homo sapiens
agcaccaggaag

SEQ ID NO: 904024 - DNA, 14 bp, Homo sapiens
agcaccaggcacga

SEQ ID NO: 904025 - DNA, 12 bp, Homo sapiens
agcacccacagc

SEQ ID NO: 904026 - DNA, 23 bp, Homo sapiens
agcacccacgtgagagaatctgc

SEQ ID NO: 904027 - DNA, 19 bp, Homo sapiens
agcaccccatgccaaagct

SEQ ID NO: 904028 - DNA, 13 bp, Homo sapiens
agcacccccaccc

SEQ ID NO: 904029 - DNA, 15 bp, Homo sapiens
agcacccccacccac

SEQ ID NO: 904030 - DNA, 12 bp, Homo sapiens
agcaccccctca

SEQ ID NO: 904031 - DNA, 18 bp, Homo sapiens
agcaccccctcattcccc

SEQ ID NO: 904032 - DNA, 22 bp, Homo sapiens
agcaccccgcttttgcagcaga

SEQ ID NO: 904033 - DNA, 13 bp, Homo sapiens
agcaccccttcca

SEQ ID NO: 904034 - DNA, 16 bp, Homo sapiens
agcaccctaggcagcc

SEQ ID NO: 904035 - DNA, 14 bp, Homo sapiens
agcaccctcccccg

SEQ ID NO: 904036 - DNA, 15 bp, Homo sapiens
agcaccctcgagaag

SEQ ID NO: 904037 - DNA, 14 bp, Homo sapiens
agcaccctctcctg

SEQ ID NO: 904038 - DNA, 18 bp, Homo sapiens
agcaccctctcctggggg

SEQ ID NO: 904039 - DNA, 23 bp, Homo sapiens
agcaccctgccctcatgggacct

SEQ ID NO: 904040 - DNA, 16 bp, Homo sapiens
agcaccgaatattgag

SEQ ID NO: 904041 - DNA, 17 bp, Homo sapiens
agcaccgtgatggagag

SEQ ID NO: 904042 - DNA, 23 bp, Homo sapiens
agcaccgtgatggagaggacaga

SEQ ID NO: 904043 - DNA, 20 bp, Homo sapiens
agcaccgtgtcaagctgctc

SEQ ID NO: 904044 - DNA, 18 bp, Homo sapiens
agcaccgttctgtgcaca

SEQ ID NO: 904045 - DNA, 22 bp, Homo sapiens
agcacctacagtgtacagtctt

SEQ ID NO: 904046 - DNA, 20 bp, Homo sapiens
agcacctactatgtgctggg

SEQ ID NO: 904047 - DNA, 14 bp, Homo sapiens
agcacctccagcct

SEQ ID NO: 904048 - DNA, 16 bp, Homo sapiens
agcacctccaggcctg

SEQ ID NO: 904049 - DNA, 17 bp, Homo sapiens
agcacctccaggcctgt

SEQ ID NO: 904050 - DNA, 21 bp, Homo sapiens
agcacctccattaaagtctga

SEQ ID NO: 904051 - DNA, 23 bp, Homo sapiens
agcacctgaaccccatgggcttg

SEQ ID NO: 904052 - DNA, 12 bp, Homo sapiens
agcacctgcccc

SEQ ID NO: 904053 - DNA, 22 bp, Homo sapiens
agcacctgccgacctcgtcctc

SEQ ID NO: 904054 - DNA, 21 bp, Homo sapiens
agcacctgcttcatgctcagc

SEQ ID NO: 904055 - DNA, 22 bp, Homo sapiens
agcacctggaccccctgcccgc

SEQ ID NO: 904056 - DNA, 12 bp, Homo sapiens
agcacctgggcc

SEQ ID NO: 904057 - DNA, 13 bp, Homo sapiens
agcacctgggccc

SEQ ID NO: 904058 - DNA, 13 bp, Homo sapiens
agcacctgtctgg

SEQ ID NO: 904059 - DNA, 22 bp, Homo sapiens
agcaccttcaagcgctccaggg

SEQ ID NO: 904060 - DNA, 18 bp, Homo sapiens
agcaccttcctcacttcc

SEQ ID NO: 904061 - DNA, 15 bp, Homo sapiens
agcaccttctttctg

SEQ ID NO: 904062 - DNA, 17 bp, Homo sapiens
agcaccttctttctgga

SEQ ID NO: 904063 - DNA, 21 bp, Homo sapiens
agcaccttctttctggactgg

SEQ ID NO: 904064 - DNA, 14 bp, Homo sapiens
agcacctttctctg

SEQ ID NO: 904065 - DNA, 15 bp, Homo sapiens
agcacctttctctga

SEQ ID NO: 904066 - DNA, 19 bp, Homo sapiens
agcacctttgcacaggatg

SEQ ID NO: 904067 - DNA, 13 bp, Homo sapiens
agcacgatttctg

SEQ ID NO: 904068 - DNA, 14 bp, Homo sapiens
agcacgcctgccat

SEQ ID NO: 904069 - DNA, 13 bp, Homo sapiens
agcacgctgcctg

SEQ ID NO: 904070 - DNA, 21 bp, Homo sapiens
agcacgctgcctgccaaagta

SEQ ID NO: 904071 - DNA, 23 bp, Homo sapiens
agcacgctgcctgccaaagtagt

SEQ ID NO: 904072 - DNA, 18 bp, Homo sapiens
cagagtctgggcctctga

SEQ ID NO: 904073 - DNA, 24 bp, Homo sapiens
cagagtctgggcctctgactctga

SEQ ID NO: 904074 - DNA, 12 bp, Homo sapiens
cagagtctgtct

SEQ ID NO: 904075 - DNA, 15 bp, Homo sapiens
cagagtgaaagggct

SEQ ID NO: 904076 - DNA, 23 bp, Homo sapiens
cagagtgaaagggctatggcaag

SEQ ID NO: 904077 - DNA, 23 bp, Homo sapiens
cagagtgaatttcagtataaaga

SEQ ID NO: 904078 - DNA, 19 bp, Homo sapiens
cagagtgacagtcataaat

SEQ ID NO: 904079 - DNA, 15 bp, Homo sapiens
cagagtgaccctcag

SEQ ID NO: 904080 - DNA, 16 bp, Homo sapiens
cagagtgaccctcagc

SEQ ID NO: 904081 - DNA, 17 bp, Homo sapiens
cagagtgagacccagcc

SEQ ID NO: 904082 - DNA, 22 bp, Homo sapiens
cagagtgagcaagggggcccaa

SEQ ID NO: 904083 - DNA, 22 bp, Homo sapiens
cagagtgaggatgtgttttgca

SEQ ID NO: 904084 - DNA, 18 bp, Homo sapiens
cagagtgcaagcccctgc

SEQ ID NO: 904085 - DNA, 23 bp, Homo sapiens
cagagtgctgaggccagggctga

SEQ ID NO: 904086 - DNA, 13 bp, Homo sapiens
cagagtgctggga

SEQ ID NO: 904087 - DNA, 18 bp, Homo sapiens
cagagtgctgtcgggacc

SEQ ID NO: 904088 - DNA, 17 bp, Homo sapiens
cagagtggaataagaca

SEQ ID NO: 904089 - DNA, 18 bp, Homo sapiens
cagagtggaataagacag

SEQ ID NO: 904090 - DNA, 13 bp, Homo sapiens
cagagtggagtct

SEQ ID NO: 904091 - DNA, 17 bp, Homo sapiens
cagagtggagtctgagt

SEQ ID NO: 904092 - DNA, 19 bp, Homo sapiens
cagagtggagttgaaactg

SEQ ID NO: 904093 - DNA, 17 bp, Homo sapiens
cagagtggcccctcacc

SEQ ID NO: 904094 - DNA, 17 bp, Homo sapiens
cagagtggcctccctgc

SEQ ID NO: 904095 - DNA, 19 bp, Homo sapiens
cagagtggcctccctgctg

SEQ ID NO: 904096 - DNA, 15 bp, Homo sapiens
cagagtggcctggcc

SEQ ID NO: 904097 - DNA, 20 bp, Homo sapiens
cagagtggcgtgagctgccc

SEQ ID NO: 904098 - DNA, 17 bp, Homo sapiens
cagagtggcgtggcctc

SEQ ID NO: 904099 - DNA, 11 bp, Homo sapiens
cagagtggctc

SEQ ID NO: 904100 - DNA, 14 bp, Homo sapiens
cagagtggctcact

SEQ ID NO: 904101 - DNA, 17 bp, Homo sapiens
cagagtggctcactggc

SEQ ID NO: 904102 - DNA, 22 bp, Homo sapiens
cagagtggctcactggctggga

SEQ ID NO: 904103 - DNA, 17 bp, Homo sapiens
cagagtgggacttggag

SEQ ID NO: 904104 - DNA, 18 bp, Homo sapiens
cagagtggtcgagtgaca

SEQ ID NO: 904105 - DNA, 21 bp, Homo sapiens
cagagtggtctttctggagag

SEQ ID NO: 904106 - DNA, 12 bp, Homo sapiens
cagagtggtggg

SEQ ID NO: 904107 - DNA, 15 bp, Homo sapiens
cagagtgtacaaatt

SEQ ID NO: 904108 - DNA, 17 bp, Homo sapiens
cagagttaaatctcaaa

SEQ ID NO: 904109 - DNA, 12 bp, Homo sapiens
cagagttacagt

SEQ ID NO: 904110 - DNA, 13 bp, Homo sapiens
cagagttacagtt

SEQ ID NO: 904111 - DNA, 17 bp, Homo sapiens
cagagttacagttctgt

SEQ ID NO: 904112 - DNA, 18 bp, Homo sapiens
cagagttagatattattt

SEQ ID NO: 904113 - DNA, 12 bp, Homo sapiens
cagagttcacta

SEQ ID NO: 904114 - DNA, 20 bp, Homo sapiens
cagagttctgtgaagaggaa

SEQ ID NO: 904115 - DNA, 22 bp, Homo sapiens
cagagttctgtgaagaggaaca

SEQ ID NO: 904116 - DNA, 15 bp, Homo sapiens
cagagttgctgggag

SEQ ID NO: 904117 - DNA, 16 bp, Homo sapiens
cagagttgctgtgccg

SEQ ID NO: 904118 - DNA, 12 bp, Homo sapiens
cagagttgtaaa

SEQ ID NO: 904119 - DNA, 14 bp, Homo sapiens
cagagttgtaaata

SEQ ID NO: 904120 - DNA, 23 bp, Homo sapiens
cagagttgtaaatatataaatat

SEQ ID NO: 904121 - DNA, 14 bp, Homo sapiens
cagagttgttacat

SEQ ID NO: 904122 - DNA, 15 bp, Homo sapiens
cagagttgttacatt

SEQ ID NO: 904123 - DNA, 21 bp, Homo sapiens
cagagttgttgtttgccaagc

SEQ ID NO: 904124 - DNA, 17 bp, Homo sapiens
cagagtttacattctaa

SEQ ID NO: 904125 - DNA, 23 bp, Homo sapiens
cagagtttacattctaatttgca

SEQ ID NO: 904126 - DNA, 23 bp, Homo sapiens
cagagtttagaggaaaaaaatga

SEQ ID NO: 904127 - DNA, 16 bp, Homo sapiens
cagagtttgccttcct

SEQ ID NO: 904128 - DNA, 19 bp, Homo sapiens
cagagtttgccttcctttc

SEQ ID NO: 904129 - DNA, 13 bp, Homo sapiens
cagagtttgtgtg

SEQ ID NO: 904130 - DNA, 21 bp, Homo sapiens
cagagtttgtgtgtatttgta

SEQ ID NO: 904131 - DNA, 17 bp, Homo sapiens
cagagtttgtgtgttgt

SEQ ID NO: 904132 - DNA, 13 bp, Homo sapiens
cagataaaatatt

SEQ ID NO: 904133 - DNA, 15 bp, Homo sapiens
cagataaaatatttt

SEQ ID NO: 904134 - DNA, 14 bp, Homo sapiens
cagataaaatgttc

SEQ ID NO: 904135 - DNA, 18 bp, Homo sapiens
cagataaatagaactatc

SEQ ID NO: 904136 - DNA, 15 bp, Homo sapiens
cagataactctcttt

SEQ ID NO: 904137 - DNA, 22 bp, Homo sapiens
cagataactctctttccttgag

SEQ ID NO: 904138 - DNA, 21 bp, Homo sapiens
cagataagaatgctggttttc

SEQ ID NO: 904139 - DNA, 22 bp, Homo sapiens
cagataagcaagagagatgttt

SEQ ID NO: 904140 - DNA, 16 bp, Homo sapiens
cagataagtatgggat

SEQ ID NO: 904141 - DNA, 16 bp, Homo sapiens
cagataatcagcctct

SEQ ID NO: 904142 - DNA, 19 bp, Homo sapiens
cagataattcatttgtatt

SEQ ID NO: 904143 - DNA, 15 bp, Homo sapiens
cagataattctggac

SEQ ID NO: 904144 - DNA, 12 bp, Homo sapiens
cagatacatcac

SEQ ID NO: 904145 - DNA, 13 bp, Homo sapiens
cagatacatcact

SEQ ID NO: 904146 - DNA, 15 bp, Homo sapiens
cagatacatcactgc

SEQ ID NO: 904147 - DNA, 16 bp, Homo sapiens
cagatacatcactgct

SEQ ID NO: 904148 - DNA, 17 bp, Homo sapiens
cagatacatggttgtga

SEQ ID NO: 904149 - DNA, 14 bp, Homo sapiens
cagataccagcccc

SEQ ID NO: 904150 - DNA, 16 bp, Homo sapiens
cagataccagcccctg

SEQ ID NO: 904151 - DNA, 18 bp, Homo sapiens
cagatacccagtggaatt

SEQ ID NO: 904152 - DNA, 17 bp, Homo sapiens
cagatacctcatcatcc

SEQ ID NO: 904153 - DNA, 18 bp, Homo sapiens
cagatacctccaaccctg

SEQ ID NO: 904154 - DNA, 20 bp, Homo sapiens
cagatacctccaaccctgcc

SEQ ID NO: 904155 - DNA, 17 bp, Homo sapiens
cagataccttgaaagga

SEQ ID NO: 904156 - DNA, 18 bp, Homo sapiens
cagataccttgaaaggaa

SEQ ID NO: 904157 - DNA, 20 bp, Homo sapiens
cagatacgggggctgtgact

SEQ ID NO: 904158 - DNA, 18 bp, Homo sapiens
cagatactggaagttttg

SEQ ID NO: 904159 - DNA, 15 bp, Homo sapiens
cagatagcccaggag

SEQ ID NO: 904160 - DNA, 20 bp, Homo sapiens
cagatatagatcctgagctc

SEQ ID NO: 904161 - DNA, 21 bp, Homo sapiens
cagatatagatcctgagctca

SEQ ID NO: 904162 - DNA, 19 bp, Homo sapiens
cagatatatacacacagtg

SEQ ID NO: 904163 - DNA, 13 bp, Homo sapiens
cagatatattttt

SEQ ID NO: 904164 - DNA, 15 bp, Homo sapiens
cagatatatttttca

SEQ ID NO: 904165 - DNA, 14 bp, Homo sapiens
cagatatcaaaatt

SEQ ID NO: 904166 - DNA, 23 bp, Homo sapiens
cagatatcaaaattctagctgta

SEQ ID NO: 904167 - DNA, 24 bp, Homo sapiens
cagatatcaaaattctagctgtat

SEQ ID NO: 904168 - DNA, 20 bp, Homo sapiens
cagatatcttggacaaatca

SEQ ID NO: 904169 - DNA, 15 bp, Homo sapiens
cagatatgatatgta

SEQ ID NO: 904170 - DNA, 15 bp, Homo sapiens
cagatatgcttacta

SEQ ID NO: 904171 - DNA, 17 bp, Homo sapiens
cagatatttagctctgt

SEQ ID NO: 904172 - DNA, 18 bp, Homo sapiens
cagatatttagctctgtg

SEQ ID NO: 904173 - DNA, 17 bp, Homo sapiens
cagatcaagctgtgaga

SEQ ID NO: 904174 - DNA, 19 bp, Homo sapiens
cagatcaagctgtgagaca

SEQ ID NO: 904175 - DNA, 14 bp, Homo sapiens
cagatcactcctgg

SEQ ID NO: 904176 - DNA, 18 bp, Homo sapiens
cagatcactgaatttata

SEQ ID NO: 904177 - DNA, 19 bp, Homo sapiens
cagatcactgaatttataa

SEQ ID NO: 904178 - DNA, 13 bp, Homo sapiens
cagatcactgcca

SEQ ID NO: 904179 - DNA, 20 bp, Homo sapiens
cagatcagaacatgaaatgc

SEQ ID NO: 904180 - DNA, 23 bp, Homo sapiens
cagatcaggaaccagggcctccc

SEQ ID NO: 904181 - DNA, 16 bp, Homo sapiens
cagatcagtaaagaac

SEQ ID NO: 904182 - DNA, 16 bp, Homo sapiens
cagatcagtgtaccat

SEQ ID NO: 904183 - DNA, 13 bp, Homo sapiens
cagatcatctggg

SEQ ID NO: 904184 - DNA, 22 bp, Homo sapiens
cagatccaaggccgcggcccag

SEQ ID NO: 904185 - DNA, 20 bp, Homo sapiens
cagatccaccctatccctgt

SEQ ID NO: 904186 - DNA, 15 bp, Homo sapiens
cagatccagactgta

SEQ ID NO: 904187 - DNA, 22 bp, Homo sapiens
cagatccagactgtaagatgtt

SEQ ID NO: 904188 - DNA, 19 bp, Homo sapiens
cagatccccaagcctggca

SEQ ID NO: 904189 - DNA, 18 bp, Homo sapiens
cagatccccactgtccta

SEQ ID NO: 904190 - DNA, 16 bp, Homo sapiens
cagatcctcacaacca

SEQ ID NO: 904191 - DNA, 21 bp, Homo sapiens
cagatcctgttacttgcttca

SEQ ID NO: 904192 - DNA, 16 bp, Homo sapiens
cagatcggccacaggg

SEQ ID NO: 904193 - DNA, 13 bp, Homo sapiens
cagatcgttcatt

SEQ ID NO: 904194 - DNA, 20 bp, Homo sapiens
cagatctctctctctctcct

SEQ ID NO: 904195 - DNA, 13 bp, Homo sapiens
cagatctgaggtt

SEQ ID NO: 904196 - DNA, 21 bp, Homo sapiens
cagatctgcaccaccatgccc

SEQ ID NO: 904197 - DNA, 21 bp, Homo sapiens
agcacggcccggcccctcacc

SEQ ID NO: 904198 - DNA, 17 bp, Homo sapiens
agcacgtggagatagtg

SEQ ID NO: 904199 - DNA, 22 bp, Homo sapiens
agcacgtggagatagtgccagg

SEQ ID NO: 904200 - DNA, 18 bp, Homo sapiens
agcactacaccttgcctt

SEQ ID NO: 904201 - DNA, 16 bp, Homo sapiens
agcactacataaactg

SEQ ID NO: 904202 - DNA, 17 bp, Homo sapiens
agcactacataaactga

SEQ ID NO: 904203 - DNA, 21 bp, Homo sapiens
agcactacataaactgacttt

SEQ ID NO: 904204 - DNA, 14 bp, Homo sapiens
agcactactgggtg

SEQ ID NO: 904205 - DNA, 23 bp, Homo sapiens
agcactactgggtgtcatttcat

SEQ ID NO: 904206 - DNA, 18 bp, Homo sapiens
agcactagtttgattatt

SEQ ID NO: 904207 - DNA, 14 bp, Homo sapiens
agcactatacagat

SEQ ID NO: 904208 - DNA, 17 bp, Homo sapiens
agcactatgctttcctt

SEQ ID NO: 904209 - DNA, 18 bp, Homo sapiens
agcactatgctttccttc

SEQ ID NO: 904210 - DNA, 22 bp, Homo sapiens
agcactattttatatttaaaaa

SEQ ID NO: 904211 - DNA, 19 bp, Homo sapiens
agcactcaaacctggagct

SEQ ID NO: 904212 - DNA, 13 bp, Homo sapiens
agcactcagcctc

SEQ ID NO: 904213 - DNA, 16 bp, Homo sapiens
agcactcccgctgcac

SEQ ID NO: 904214 - DNA, 17 bp, Homo sapiens
agcactcccgctgcaca

SEQ ID NO: 904215 - DNA, 20 bp, Homo sapiens
agcactcccgctgcacacag

SEQ ID NO: 904216 - DNA, 18 bp, Homo sapiens
agcactcctcaagacttt

SEQ ID NO: 904217 - DNA, 14 bp, Homo sapiens
agcactctctgcag

SEQ ID NO: 904218 - DNA, 18 bp, Homo sapiens
agcactctctgcagtcct

SEQ ID NO: 904219 - DNA, 20 bp, Homo sapiens
agcactctctgcagtcctcc

SEQ ID NO: 904220 - DNA, 23 bp, Homo sapiens
agcactctgagtttaccatttgt

SEQ ID NO: 904221 - DNA, 20 bp, Homo sapiens
agcactgacctgtcatgccc

SEQ ID NO: 904222 - DNA, 21 bp, Homo sapiens
agcactgagctcacatgggac

SEQ ID NO: 904223 - DNA, 21 bp, Homo sapiens
agcactgatagtcctttttcc

SEQ ID NO: 904224 - DNA, 18 bp, Homo sapiens
agcactgatttcacaaca

SEQ ID NO: 904225 - DNA, 13 bp, Homo sapiens
agcactgcctcct

SEQ ID NO: 904226 - DNA, 16 bp, Homo sapiens
agcactgcctcctgtt

SEQ ID NO: 904227 - DNA, 12 bp, Homo sapiens
agcactgcctct

SEQ ID NO: 904228 - DNA, 22 bp, Homo sapiens
agcactgctaggcgagtgccag

SEQ ID NO: 904229 - DNA, 23 bp, Homo sapiens
agcactgctaggcgagtgccagg

SEQ ID NO: 904230 - DNA, 16 bp, Homo sapiens
agcactggagtgcagg

SEQ ID NO: 904231 - DNA, 12 bp, Homo sapiens
agcactggccag

SEQ ID NO: 904232 - DNA, 13 bp, Homo sapiens
agcactggctctc

SEQ ID NO: 904233 - DNA, 19 bp, Homo sapiens
agcactggctctctccagg

SEQ ID NO: 904234 - DNA, 20 bp, Homo sapiens
agcactggctctctccagga

SEQ ID NO: 904235 - DNA, 17 bp, Homo sapiens
agcactgggaagctgga

SEQ ID NO: 904236 - DNA, 17 bp, Homo sapiens
agcactgggttgacttt

SEQ ID NO: 904237 - DNA, 19 bp, Homo sapiens
agcactgggttgcagggga

SEQ ID NO: 904238 - DNA, 12 bp, Homo sapiens
agcactgtccct

SEQ ID NO: 904239 - DNA, 14 bp, Homo sapiens
agcactgtctcagt

SEQ ID NO: 904240 - DNA, 20 bp, Homo sapiens
agcactgtctcagtttcact

SEQ ID NO: 904241 - DNA, 20 bp, Homo sapiens
agcactgttgatgtatctga

SEQ ID NO: 904242 - DNA, 21 bp, Homo sapiens
agcactgttgatgtatctgag

SEQ ID NO: 904243 - DNA, 18 bp, Homo sapiens
agcacttaaattcctcaa

SEQ ID NO: 904244 - DNA, 12 bp, Homo sapiens
agcacttaagag

SEQ ID NO: 904245 - DNA, 18 bp, Homo sapiens
agcacttaagagaatatt

SEQ ID NO: 904246 - DNA, 18 bp, Homo sapiens
agcacttacgtaaaacat

SEQ ID NO: 904247 - DNA, 20 bp, Homo sapiens
agcacttcacagctggaccc

SEQ ID NO: 904248 - DNA, 12 bp, Homo sapiens
agcacttctaga

SEQ ID NO: 904249 - DNA, 13 bp, Homo sapiens
agcacttctagaa

SEQ ID NO: 904250 - DNA, 22 bp, Homo sapiens
agcacttgcaaccgtctgttat

SEQ ID NO: 904251 - DNA, 15 bp, Homo sapiens
agcacttgcgtcctg

SEQ ID NO: 904252 - DNA, 16 bp, Homo sapiens
agcacttgcgtcctgc

SEQ ID NO: 904253 - DNA, 19 bp, Homo sapiens
agcacttgcgtcctgcaga

SEQ ID NO: 904254 - DNA, 21 bp, Homo sapiens
agcacttgcttacatcctctg

SEQ ID NO: 904255 - DNA, 13 bp, Homo sapiens
agcacttggactc

SEQ ID NO: 904256 - DNA, 18 bp, Homo sapiens
agcacttggactcttgct

SEQ ID NO: 904257 - DNA, 20 bp, Homo sapiens
agcacttggactcttgctct

SEQ ID NO: 904258 - DNA, 21 bp, Homo sapiens
agcacttggactcttgctctt

SEQ ID NO: 904259 - DNA, 16 bp, Homo sapiens
agcacttgtccagctg

SEQ ID NO: 904260 - DNA, 18 bp, Homo sapiens
agcacttgttttaaaatg

SEQ ID NO: 904261 - DNA, 21 bp, Homo sapiens
agcactttaaagaggctgtgt

SEQ ID NO: 904262 - DNA, 23 bp, Homo sapiens
agcactttaaagaggctgtgtgg

SEQ ID NO: 904263 - DNA, 17 bp, Homo sapiens
agcactttaaccctctc

SEQ ID NO: 904264 - DNA, 23 bp, Homo sapiens
agcactttaatggcctggaggga

SEQ ID NO: 904265 - DNA, 15 bp, Homo sapiens
agcactttgcactta

SEQ ID NO: 904266 - DNA, 12 bp, Homo sapiens
agcactttggga

SEQ ID NO: 904267 - DNA, 14 bp, Homo sapiens
agcactttgggagg

SEQ ID NO: 904268 - DNA, 18 bp, Homo sapiens
agcactttgggaggccaa

SEQ ID NO: 904269 - DNA, 22 bp, Homo sapiens
agcactttgggaggccgaggtg

SEQ ID NO: 904270 - DNA, 22 bp, Homo sapiens
agcactttgggaggctgaggtg

SEQ ID NO: 904271 - DNA, 18 bp, Homo sapiens
agcacttttaaaaaaatt

SEQ ID NO: 904272 - DNA, 23 bp, Homo sapiens
agcagaaaaaggctgtgctgccc

SEQ ID NO: 904273 - DNA, 21 bp, Homo sapiens
agcagaaaacccttgggccag

SEQ ID NO: 904274 - DNA, 18 bp, Homo sapiens
agcagaaaagatgaattt

SEQ ID NO: 904275 - DNA, 18 bp, Homo sapiens
agcagaaaataaaggaag

SEQ ID NO: 904276 - DNA, 15 bp, Homo sapiens
agcagaaatgccccc

SEQ ID NO: 904277 - DNA, 22 bp, Homo sapiens
agcagaaatgcccccattctcc

SEQ ID NO: 904278 - DNA, 12 bp, Homo sapiens
agcagaacactg

SEQ ID NO: 904279 - DNA, 20 bp, Homo sapiens
agcagaacagatcttttact

SEQ ID NO: 904280 - DNA, 22 bp, Homo sapiens
agcagaacaggtagtattacac

SEQ ID NO: 904281 - DNA, 15 bp, Homo sapiens
agcagaacctgcaca

SEQ ID NO: 904282 - DNA, 20 bp, Homo sapiens
agcagaacctgcacacagga

SEQ ID NO: 904283 - DNA, 22 bp, Homo sapiens
agcagaacctgcacacaggaca

SEQ ID NO: 904284 - DNA, 21 bp, Homo sapiens
agcagaacggagccccaggcc

SEQ ID NO: 904285 - DNA, 16 bp, Homo sapiens
agcagaagtctggctt

SEQ ID NO: 904286 - DNA, 14 bp, Homo sapiens
agcagaatactggt

SEQ ID NO: 904287 - DNA, 16 bp, Homo sapiens
agcagaatactggtct

SEQ ID NO: 904288 - DNA, 17 bp, Homo sapiens
agcagaatactggtctc

SEQ ID NO: 904289 - DNA, 15 bp, Homo sapiens
agcagaatggaaaaa

SEQ ID NO: 904290 - DNA, 20 bp, Homo sapiens
agcagaatggagaaagtaag

SEQ ID NO: 904291 - DNA, 18 bp, Homo sapiens
agcagaatggaggcaggg

SEQ ID NO: 904292 - DNA, 13 bp, Homo sapiens
agcagaatgtgat

SEQ ID NO: 904293 - DNA, 20 bp, Homo sapiens
agcagaatgttgtacttgaa

SEQ ID NO: 904294 - DNA, 15 bp, Homo sapiens
agcagaattttaatg

SEQ ID NO: 904295 - DNA, 20 bp, Homo sapiens
agcagaattttaatgtgaag

SEQ ID NO: 904296 - DNA, 12 bp, Homo sapiens
agcagacagaaa

SEQ ID NO: 904297 - DNA, 14 bp, Homo sapiens
agcagacagaaact

SEQ ID NO: 904298 - DNA, 16 bp, Homo sapiens
agcagacagagccagg

SEQ ID NO: 904299 - DNA, 14 bp, Homo sapiens
agcagacaggcctg

SEQ ID NO: 904300 - DNA, 21 bp, Homo sapiens
agcagacagtgttttctggga

SEQ ID NO: 904301 - DNA, 16 bp, Homo sapiens
agcagaccagctttga

SEQ ID NO: 904302 - DNA, 17 bp, Homo sapiens
agcagacccagcttaga

SEQ ID NO: 904303 - DNA, 17 bp, Homo sapiens
agcagacctacctgcag

SEQ ID NO: 904304 - DNA, 20 bp, Homo sapiens
agcagacgcagcagctggga

SEQ ID NO: 904305 - DNA, 16 bp, Homo sapiens
agcagactcagctctg

SEQ ID NO: 904306 - DNA, 15 bp, Homo sapiens
agcagactccagccc

SEQ ID NO: 904307 - DNA, 23 bp, Homo sapiens
agcagactccagcccctggaccc

SEQ ID NO: 904308 - DNA, 20 bp, Homo sapiens
agcagactttcccaaatgta

SEQ ID NO: 904309 - DNA, 15 bp, Homo sapiens
agcagagacactaac

SEQ ID NO: 904310 - DNA, 11 bp, Homo sapiens
agcagagagag

SEQ ID NO: 904311 - DNA, 15 bp, Homo sapiens
agcagagagagagga

SEQ ID NO: 904312 - DNA, 12 bp, Homo sapiens
agcagagagagc

SEQ ID NO: 904313 - DNA, 15 bp, Homo sapiens
agcagagagatgcgg

SEQ ID NO: 904314 - DNA, 13 bp, Homo sapiens
agcagagagccct

SEQ ID NO: 904315 - DNA, 15 bp, Homo sapiens
agcagagagccctgg

SEQ ID NO: 904316 - DNA, 11 bp, Homo sapiens
agcagagccaa

SEQ ID NO: 904317 - DNA, 13 bp, Homo sapiens
agcagagccaagg

SEQ ID NO: 904318 - DNA, 22 bp, Homo sapiens
agcagagcccaccagccagccc

SEQ ID NO: 904319 - DNA, 15 bp, Homo sapiens
agcagagcctcctgg

SEQ ID NO: 904320 - DNA, 17 bp, Homo sapiens
agcagaggaaggagagg

SEQ ID NO: 904321 - DNA, 14 bp, Homo sapiens
cagatctgcctggg

SEQ ID NO: 904322 - DNA, 18 bp, Homo sapiens
cagatctggtcccttgca

SEQ ID NO: 904323 - DNA, 20 bp, Homo sapiens
cagatctggtctagttaacc

SEQ ID NO: 904324 - DNA, 12 bp, Homo sapiens
cagatctgtgcc

SEQ ID NO: 904325 - DNA, 15 bp, Homo sapiens
cagatctgtgcccca

SEQ ID NO: 904326 - DNA, 23 bp, Homo sapiens
cagatctgtgccccatgcctgtc

SEQ ID NO: 904327 - DNA, 15 bp, Homo sapiens
cagatctgtgcctgg

SEQ ID NO: 904328 - DNA, 17 bp, Homo sapiens
cagatctgtgcctggga

SEQ ID NO: 904329 - DNA, 12 bp, Homo sapiens
cagatctttctc

SEQ ID NO: 904330 - DNA, 18 bp, Homo sapiens
cagatctttctccttgaa

SEQ ID NO: 904331 - DNA, 22 bp, Homo sapiens
cagatcttttctttaaaataaa

SEQ ID NO: 904332 - DNA, 12 bp, Homo sapiens
cagatgaacatt

SEQ ID NO: 904333 - DNA, 14 bp, Homo sapiens
cagatgaacatttc

SEQ ID NO: 904334 - DNA, 14 bp, Homo sapiens
cagatgaatgataa

SEQ ID NO: 904335 - DNA, 17 bp, Homo sapiens
cagatgaatgccgtgga

SEQ ID NO: 904336 - DNA, 15 bp, Homo sapiens
cagatgaatgtattt

SEQ ID NO: 904337 - DNA, 19 bp, Homo sapiens
cagatgaatgtatttattt

SEQ ID NO: 904338 - DNA, 21 bp, Homo sapiens
cagatgacacgcgctctccac

SEQ ID NO: 904339 - DNA, 17 bp, Homo sapiens
cagatgaccataatttt

SEQ ID NO: 904340 - DNA, 20 bp, Homo sapiens
cagatgaccccagaaactga

SEQ ID NO: 904341 - DNA, 19 bp, Homo sapiens
cagatgaccgtgtacaata

SEQ ID NO: 904342 - DNA, 14 bp, Homo sapiens
cagatgagaacaaa

SEQ ID NO: 904343 - DNA, 16 bp, Homo sapiens
cagatgagaacaaagc

SEQ ID NO: 904344 - DNA, 21 bp, Homo sapiens
cagatgagaacaaagctgtta

SEQ ID NO: 904345 - DNA, 17 bp, Homo sapiens
cagatgagatccgggag

SEQ ID NO: 904346 - DNA, 12 bp, Homo sapiens
cagatgagctgt

SEQ ID NO: 904347 - DNA, 16 bp, Homo sapiens
cagatgaggagcagct

SEQ ID NO: 904348 - DNA, 22 bp, Homo sapiens
cagatgaggagcagctggggta

SEQ ID NO: 904349 - DNA, 18 bp, Homo sapiens
cagatgaggggccactga

SEQ ID NO: 904350 - DNA, 16 bp, Homo sapiens
cagatgagtaaaggag

SEQ ID NO: 904351 - DNA, 15 bp, Homo sapiens
cagatgagtgtgtgt

SEQ ID NO: 904352 - DNA, 16 bp, Homo sapiens
cagatgagtgtgtgtt

SEQ ID NO: 904353 - DNA, 17 bp, Homo sapiens
cagatgataaatattta

SEQ ID NO: 904354 - DNA, 23 bp, Homo sapiens
cagatgatagtccaatttttact

SEQ ID NO: 904355 - DNA, 22 bp, Homo sapiens
cagatgatggccatttctaaat

SEQ ID NO: 904356 - DNA, 16 bp, Homo sapiens
cagatgatttcccccc

SEQ ID NO: 904357 - DNA, 16 bp, Homo sapiens
cagatgattttcctcc

SEQ ID NO: 904358 - DNA, 16 bp, Homo sapiens
cagatgcaacctcact

SEQ ID NO: 904359 - DNA, 19 bp, Homo sapiens
cagatgcaacctcactatg

SEQ ID NO: 904360 - DNA, 14 bp, Homo sapiens
cagatgcaatgact

SEQ ID NO: 904361 - DNA, 13 bp, Homo sapiens
cagatgcagggca

SEQ ID NO: 904362 - DNA, 21 bp, Homo sapiens
cagatgccaacttcccacacg

SEQ ID NO: 904363 - DNA, 12 bp, Homo sapiens
cagatgcccacg

SEQ ID NO: 904364 - DNA, 15 bp, Homo sapiens
cagatgcccagaggg

SEQ ID NO: 904365 - DNA, 18 bp, Homo sapiens
cagatgccccagagctgt

SEQ ID NO: 904366 - DNA, 11 bp, Homo sapiens
cagatgccctt

SEQ ID NO: 904367 - DNA, 19 bp, Homo sapiens
cagatgcctgcttgataat

SEQ ID NO: 904368 - DNA, 15 bp, Homo sapiens
cagatgccttctaga

SEQ ID NO: 904369 - DNA, 15 bp, Homo sapiens
cagatgcggggacag

SEQ ID NO: 904370 - DNA, 17 bp, Homo sapiens
cagatgcggggacaggc

SEQ ID NO: 904371 - DNA, 21 bp, Homo sapiens
cagatgctaaaatccctggat

SEQ ID NO: 904372 - DNA, 16 bp, Homo sapiens
cagatgctactggact

SEQ ID NO: 904373 - DNA, 21 bp, Homo sapiens
cagatgctgaattgagaataa

SEQ ID NO: 904374 - DNA, 15 bp, Homo sapiens
cagatgctgagccat

SEQ ID NO: 904375 - DNA, 16 bp, Homo sapiens
cagatgctgctgaaga

SEQ ID NO: 904376 - DNA, 18 bp, Homo sapiens
cagatgctgctgaagaga

SEQ ID NO: 904377 - DNA, 20 bp, Homo sapiens
cagatgctgtcactggcaga

SEQ ID NO: 904378 - DNA, 17 bp, Homo sapiens
cagatgctgtcattagt

SEQ ID NO: 904379 - DNA, 17 bp, Homo sapiens
cagatgcttttgtgaga

SEQ ID NO: 904380 - DNA, 19 bp, Homo sapiens
cagatggaaaattcatttt

SEQ ID NO: 904381 - DNA, 19 bp, Homo sapiens
cagatggacagcgatgagg

SEQ ID NO: 904382 - DNA, 18 bp, Homo sapiens
cagatggactccagcctg

SEQ ID NO: 904383 - DNA, 15 bp, Homo sapiens
cagatggagatcaga

SEQ ID NO: 904384 - DNA, 14 bp, Homo sapiens
cagatggagcccat

SEQ ID NO: 904385 - DNA, 12 bp, Homo sapiens
cagatggcactt

SEQ ID NO: 904386 - DNA, 14 bp, Homo sapiens
cagatggcccaagg

SEQ ID NO: 904387 - DNA, 21 bp, Homo sapiens
cagatggcccaagggatggca

SEQ ID NO: 904388 - DNA, 16 bp, Homo sapiens
cagatggcccctccac

SEQ ID NO: 904389 - DNA, 18 bp, Homo sapiens
cagatggcccctccactg

SEQ ID NO: 904390 - DNA, 22 bp, Homo sapiens
cagatggcccctccactgggga

SEQ ID NO: 904391 - DNA, 13 bp, Homo sapiens
cagatggctcttt

SEQ ID NO: 904392 - DNA, 18 bp, Homo sapiens
cagatggggtctgtgact

SEQ ID NO: 904393 - DNA, 20 bp, Homo sapiens
cagatggggtcttgctatgt

SEQ ID NO: 904394 - DNA, 20 bp, Homo sapiens
cagatgggtctgatattaat

SEQ ID NO: 904395 - DNA, 22 bp, Homo sapiens
cagatggttgcaattgatcctt

SEQ ID NO: 904396 - DNA, 19 bp, Homo sapiens
cagatggtttccacattta

SEQ ID NO: 904397 - DNA, 16 bp, Homo sapiens
cagatgtaatgttttc

SEQ ID NO: 904398 - DNA, 23 bp, Homo sapiens
cagatgtaatgttttctttgcaa

SEQ ID NO: 904399 - DNA, 13 bp, Homo sapiens
cagatgtctctgg

SEQ ID NO: 904400 - DNA, 15 bp, Homo sapiens
cagatgtcttccctg

SEQ ID NO: 904401 - DNA, 13 bp, Homo sapiens
cagatgtcttctg

SEQ ID NO: 904402 - DNA, 15 bp, Homo sapiens
cagatgtcttctgcc

SEQ ID NO: 904403 - DNA, 16 bp, Homo sapiens
cagatgtcttctgcct

SEQ ID NO: 904404 - DNA, 17 bp, Homo sapiens
cagatgtcttctgcctg

SEQ ID NO: 904405 - DNA, 23 bp, Homo sapiens
cagatgtgagccaccgtgcctgg

SEQ ID NO: 904406 - DNA, 21 bp, Homo sapiens
cagatgtgcaataatttgtac

SEQ ID NO: 904407 - DNA, 22 bp, Homo sapiens
cagatgtgctataatctgtttt

SEQ ID NO: 904408 - DNA, 12 bp, Homo sapiens
cagatgtggcta

SEQ ID NO: 904409 - DNA, 19 bp, Homo sapiens
cagatgtggctactgacat

SEQ ID NO: 904410 - DNA, 20 bp, Homo sapiens
cagatgtggctactgacata

SEQ ID NO: 904411 - DNA, 18 bp, Homo sapiens
cagatgtggggctgagct

SEQ ID NO: 904412 - DNA, 20 bp, Homo sapiens
cagatgtgtcccccccaggc

SEQ ID NO: 904413 - DNA, 21 bp, Homo sapiens
cagatgtgtcccccccaggcc

SEQ ID NO: 904414 - DNA, 22 bp, Homo sapiens
cagatgtgttcctccattttct

SEQ ID NO: 904415 - DNA, 15 bp, Homo sapiens
cagatgttgggagga

SEQ ID NO: 904416 - DNA, 23 bp, Homo sapiens
cagatgttgggaggatacagagg

SEQ ID NO: 904417 - DNA, 15 bp, Homo sapiens
cagatgtttccagac

SEQ ID NO: 904418 - DNA, 16 bp, Homo sapiens
cagatgtttccagact

SEQ ID NO: 904419 - DNA, 22 bp, Homo sapiens
cagatgttttacgtctgggaga

SEQ ID NO: 904420 - DNA, 13 bp, Homo sapiens
cagatgttttgat

SEQ ID NO: 904421 - DNA, 23 bp, Homo sapiens
cagattaaaagcacaagcgtgtt

SEQ ID NO: 904422 - DNA, 12 bp, Homo sapiens
cagattaatatt

SEQ ID NO: 904423 - DNA, 17 bp, Homo sapiens
cagattcaggccagccc

SEQ ID NO: 904424 - DNA, 21 bp, Homo sapiens
cagattccaggcgatgtgcaa

SEQ ID NO: 904425 - DNA, 23 bp, Homo sapiens
cagattccaggcgatgtgcaagt

SEQ ID NO: 904426 - DNA, 12 bp, Homo sapiens
cagattcccaga

SEQ ID NO: 904427 - DNA, 14 bp, Homo sapiens
cagattcccagagc

SEQ ID NO: 904428 - DNA, 12 bp, Homo sapiens
cagattcctatg

SEQ ID NO: 904429 - DNA, 15 bp, Homo sapiens
cagattcctgggcct

SEQ ID NO: 904430 - DNA, 16 bp, Homo sapiens
cagattcctgggcctg

SEQ ID NO: 904431 - DNA, 20 bp, Homo sapiens
cagattctgaaacaggccct

SEQ ID NO: 904432 - DNA, 12 bp, Homo sapiens
cagattctgatg

SEQ ID NO: 904433 - DNA, 14 bp, Homo sapiens
cagattctgatgca

SEQ ID NO: 904434 - DNA, 12 bp, Homo sapiens
cagattctgatt

SEQ ID NO: 904435 - DNA, 16 bp, Homo sapiens
cagattctgcctctct

SEQ ID NO: 904436 - DNA, 17 bp, Homo sapiens
cagattctgcctctctg

SEQ ID NO: 904437 - DNA, 18 bp, Homo sapiens
cagattctttttttctgt

SEQ ID NO: 904438 - DNA, 13 bp, Homo sapiens
cagattgaactta

SEQ ID NO: 904439 - DNA, 12 bp, Homo sapiens
cagattgaagaa

SEQ ID NO: 904440 - DNA, 21 bp, Homo sapiens
cagattgaggtaataatgaca

SEQ ID NO: 904441 - DNA, 13 bp, Homo sapiens
cagattgcctcct

SEQ ID NO: 904442 - DNA, 14 bp, Homo sapiens
cagattgcctcctt

SEQ ID NO: 904443 - DNA, 15 bp, Homo sapiens
cagattgctctgccc

SEQ ID NO: 904444 - DNA, 15 bp, Homo sapiens
cagattgctgaaact

SEQ ID NO: 904445 - DNA, 15 bp, Homo sapiens
cagattgctgcttct

SEQ ID NO: 904446 - DNA, 21 bp, Homo sapiens
cagattggcacccctttctag

SEQ ID NO: 904447 - DNA, 12 bp, Homo sapiens
agcagaggaggg

SEQ ID NO: 904448 - DNA, 15 bp, Homo sapiens
agcagaggaggggcc

SEQ ID NO: 904449 - DNA, 21 bp, Homo sapiens
agcagaggaggggccgctgcc

SEQ ID NO: 904450 - DNA, 15 bp, Homo sapiens
agcagaggcaggctg

SEQ ID NO: 904451 - DNA, 19 bp, Homo sapiens
agcagaggcaggctgggac

SEQ ID NO: 904452 - DNA, 19 bp, Homo sapiens
agcagaggcagtggccacg

SEQ ID NO: 904453 - DNA, 16 bp, Homo sapiens
agcagagggcgccacc

SEQ ID NO: 904454 - DNA, 19 bp, Homo sapiens
agcagagggggagtagcca

SEQ ID NO: 904455 - DNA, 23 bp, Homo sapiens
agcagaggtggccagagctggga

SEQ ID NO: 904456 - DNA, 16 bp, Homo sapiens
agcagagtctgggcct

SEQ ID NO: 904457 - DNA, 17 bp, Homo sapiens
agcagagtctgtctctt

SEQ ID NO: 904458 - DNA, 17 bp, Homo sapiens
agcagagtgaggatgtg

SEQ ID NO: 904459 - DNA, 18 bp, Homo sapiens
agcagagtgaggatgtgt

SEQ ID NO: 904460 - DNA, 20 bp, Homo sapiens
agcagagtgaggatgtgttt

SEQ ID NO: 904461 - DNA, 12 bp, Homo sapiens
agcagagttaaa

SEQ ID NO: 904462 - DNA, 18 bp, Homo sapiens
agcagatctgttttgtgg

SEQ ID NO: 904463 - DNA, 19 bp, Homo sapiens
agcagatgcaatgactcag

SEQ ID NO: 904464 - DNA, 15 bp, Homo sapiens
agcagatggaaagaa

SEQ ID NO: 904465 - DNA, 21 bp, Homo sapiens
agcagattttaattttgaata

SEQ ID NO: 904466 - DNA, 15 bp, Homo sapiens
agcagcaaattttca

SEQ ID NO: 904467 - DNA, 20 bp, Homo sapiens
agcagcaaattttcagcatt

SEQ ID NO: 904468 - DNA, 15 bp, Homo sapiens
agcagcacaaggaat

SEQ ID NO: 904469 - DNA, 18 bp, Homo sapiens
agcagcacaattctgtcc

SEQ ID NO: 904470 - DNA, 22 bp, Homo sapiens
agcagcacaattctgtccctgt

SEQ ID NO: 904471 - DNA, 20 bp, Homo sapiens
agcagcacctttctctgaga

SEQ ID NO: 904472 - DNA, 15 bp, Homo sapiens
agcagcactcccgct

SEQ ID NO: 904473 - DNA, 20 bp, Homo sapiens
agcagcactcccgctgcaca

SEQ ID NO: 904474 - DNA, 24 bp, Homo sapiens
agcagcactcccgctgcacacaga

SEQ ID NO: 904475 - DNA, 14 bp, Homo sapiens
agcagcactgtgag

SEQ ID NO: 904476 - DNA, 17 bp, Homo sapiens
agcagcagaggtgagaa

SEQ ID NO: 904477 - DNA, 23 bp, Homo sapiens
agcagcagcacctttctctgaga

SEQ ID NO: 904478 - DNA, 12 bp, Homo sapiens
agcagcagccag

SEQ ID NO: 904479 - DNA, 15 bp, Homo sapiens
agcagcagccagcac

SEQ ID NO: 904480 - DNA, 16 bp, Homo sapiens
agcagcagccagcacc

SEQ ID NO: 904481 - DNA, 12 bp, Homo sapiens
agcagcagccct

SEQ ID NO: 904482 - DNA, 13 bp, Homo sapiens
agcagcaggaagg

SEQ ID NO: 904483 - DNA, 13 bp, Homo sapiens
agcagcaggatgg

SEQ ID NO: 904484 - DNA, 20 bp, Homo sapiens
agcagcaggatgggctgagc

SEQ ID NO: 904485 - DNA, 21 bp, Homo sapiens
agcagcaggatgggctgagct

SEQ ID NO: 904486 - DNA, 18 bp, Homo sapiens
agcagcaggcctctggtt

SEQ ID NO: 904487 - DNA, 14 bp, Homo sapiens
agcagcatcccagc

SEQ ID NO: 904488 - DNA, 22 bp, Homo sapiens
agcagccaaggccgccagcgtg

SEQ ID NO: 904489 - DNA, 23 bp, Homo sapiens
agcagccaccagggagtggccat

SEQ ID NO: 904490 - DNA, 15 bp, Homo sapiens
agcagccagagctgt

SEQ ID NO: 904491 - DNA, 10 bp, Homo sapiens
agcagccagc

SEQ ID NO: 904492 - DNA, 12 bp, Homo sapiens
agcagccagcca

SEQ ID NO: 904493 - DNA, 18 bp, Homo sapiens
agcagccagctctcagcc

SEQ ID NO: 904494 - DNA, 11 bp, Homo sapiens
agcagccagga

SEQ ID NO: 904495 - DNA, 21 bp, Homo sapiens
agcagccaggacccgcctgct

SEQ ID NO: 904496 - DNA, 23 bp, Homo sapiens
agcagccagtctcagagaccagc

SEQ ID NO: 904497 - DNA, 20 bp, Homo sapiens
agcagccatcataggaaggg

SEQ ID NO: 904498 - DNA, 13 bp, Homo sapiens
agcagcccaagct

SEQ ID NO: 904499 - DNA, 18 bp, Homo sapiens
agcagcccaagcttccct

SEQ ID NO: 904500 - DNA, 18 bp, Homo sapiens
agcagccctcctcacccc

SEQ ID NO: 904501 - DNA, 15 bp, Homo sapiens
agcagccctctgcct

SEQ ID NO: 904502 - DNA, 21 bp, Homo sapiens
agcagcccttgtgtgtgccct

SEQ ID NO: 904503 - DNA, 12 bp, Homo sapiens
agcagccgccag

SEQ ID NO: 904504 - DNA, 19 bp, Homo sapiens
agcagccgccagctgggag

SEQ ID NO: 904505 - DNA, 21 bp, Homo sapiens
agcagccgccttaagctgatc

SEQ ID NO: 904506 - DNA, 20 bp, Homo sapiens
agcagccggaatagagcctc

SEQ ID NO: 904507 - DNA, 12 bp, Homo sapiens
agcagcctcaga

SEQ ID NO: 904508 - DNA, 16 bp, Homo sapiens
agcagcctcattctga

SEQ ID NO: 904509 - DNA, 24 bp, Homo sapiens
agcagcctcgcacaggccctagct

SEQ ID NO: 904510 - DNA, 14 bp, Homo sapiens
agcagcctctgaag

SEQ ID NO: 904511 - DNA, 21 bp, Homo sapiens
agcagcctctggacagccagt

SEQ ID NO: 904512 - DNA, 13 bp, Homo sapiens
agcagcctgagca

SEQ ID NO: 904513 - DNA, 19 bp, Homo sapiens
agcagcctgagcaactctt

SEQ ID NO: 904514 - DNA, 23 bp, Homo sapiens
agcagcctgagcaactcttgatt

SEQ ID NO: 904515 - DNA, 20 bp, Homo sapiens
agcagcctgatggccaaggg

SEQ ID NO: 904516 - DNA, 12 bp, Homo sapiens
agcagcctgggg

SEQ ID NO: 904517 - DNA, 13 bp, Homo sapiens
agcagcctgtggc

SEQ ID NO: 904518 - DNA, 11 bp, Homo sapiens
agcagcctttc

SEQ ID NO: 904519 - DNA, 22 bp, Homo sapiens
agcagcctttctctctttatac

SEQ ID NO: 904520 - DNA, 18 bp, Homo sapiens
agcagcgaccgccccctc

SEQ ID NO: 904521 - DNA, 16 bp, Homo sapiens
agcagcgcccaggcct

SEQ ID NO: 904522 - DNA, 17 bp, Homo sapiens
agcagcgcccaggcctg

SEQ ID NO: 904523 - DNA, 21 bp, Homo sapiens
agcagcgcccaggcctgctgg

SEQ ID NO: 904524 - DNA, 22 bp, Homo sapiens
agcagcgcccaggcctgctggc

SEQ ID NO: 904525 - DNA, 21 bp, Homo sapiens
agcagcgctcggcccggagca

SEQ ID NO: 904526 - DNA, 18 bp, Homo sapiens
agcagcgcttcctggctg

SEQ ID NO: 904527 - DNA, 20 bp, Homo sapiens
agcagcggattgctctggag

SEQ ID NO: 904528 - DNA, 22 bp, Homo sapiens
agcagcggattgctctggagca

SEQ ID NO: 904529 - DNA, 15 bp, Homo sapiens
agcagcgggagctag

SEQ ID NO: 904530 - DNA, 22 bp, Homo sapiens
agcagcggtttggggagcagag

SEQ ID NO: 904531 - DNA, 23 bp, Homo sapiens
agcagcggtttggggagcagaga

SEQ ID NO: 904532 - DNA, 13 bp, Homo sapiens
agcagcgtttcta

SEQ ID NO: 904533 - DNA, 19 bp, Homo sapiens
agcagcgtttctatgacac

SEQ ID NO: 904534 - DNA, 20 bp, Homo sapiens
agcagctaaaccaaggactg

SEQ ID NO: 904535 - DNA, 11 bp, Homo sapiens
agcagctacca

SEQ ID NO: 904536 - DNA, 15 bp, Homo sapiens
agcagctactgtaac

SEQ ID NO: 904537 - DNA, 22 bp, Homo sapiens
agcagctaggactgaggagtgg

SEQ ID NO: 904538 - DNA, 21 bp, Homo sapiens
agcagctcaggcacacttctt

SEQ ID NO: 904539 - DNA, 15 bp, Homo sapiens
agcagctccctttct

SEQ ID NO: 904540 - DNA, 18 bp, Homo sapiens
agcagctccctttctcag

SEQ ID NO: 904541 - DNA, 19 bp, Homo sapiens
agcagctccctttctcagg

SEQ ID NO: 904542 - DNA, 12 bp, Homo sapiens
agcagctctccc

SEQ ID NO: 904543 - DNA, 14 bp, Homo sapiens
agcagctctcccct

SEQ ID NO: 904544 - DNA, 18 bp, Homo sapiens
agcagctgaagaaaaaat

SEQ ID NO: 904545 - DNA, 19 bp, Homo sapiens
agcagctgaagaaaaaatc

SEQ ID NO: 904546 - DNA, 21 bp, Homo sapiens
agcagctgaagtctctttttc

SEQ ID NO: 904547 - DNA, 15 bp, Homo sapiens
agcagctgcattttt

SEQ ID NO: 904548 - DNA, 21 bp, Homo sapiens
agcagctgcgggtctgaagga

SEQ ID NO: 904549 - DNA, 10 bp, Homo sapiens
agcagctgga

SEQ ID NO: 904550 - DNA, 11 bp, Homo sapiens
agcagctggcc

SEQ ID NO: 904551 - DNA, 13 bp, Homo sapiens
agcagctggccta

SEQ ID NO: 904552 - DNA, 20 bp, Homo sapiens
agcagctggtcagtctttgc

SEQ ID NO: 904553 - DNA, 21 bp, Homo sapiens
agcagctggtcagtctttgct

SEQ ID NO: 904554 - DNA, 22 bp, Homo sapiens
agcagctggtcagtctttgctc

SEQ ID NO: 904555 - DNA, 16 bp, Homo sapiens
agcagctggtcttttc

SEQ ID NO: 904556 - DNA, 17 bp, Homo sapiens
agcagctggtcttttct

SEQ ID NO: 904557 - DNA, 15 bp, Homo sapiens
agcagcttcaccaga

SEQ ID NO: 904558 - DNA, 12 bp, Homo sapiens
agcagcttccag

SEQ ID NO: 904559 - DNA, 16 bp, Homo sapiens
agcagcttccttctgg

SEQ ID NO: 904560 - DNA, 17 bp, Homo sapiens
agcagcttccttctggg

SEQ ID NO: 904561 - DNA, 16 bp, Homo sapiens
agcagcttcttgggct

SEQ ID NO: 904562 - DNA, 18 bp, Homo sapiens
agcagcttcttgggctga

SEQ ID NO: 904563 - DNA, 20 bp, Homo sapiens
agcagcttcttgggctgagt

SEQ ID NO: 904564 - DNA, 15 bp, Homo sapiens
agcaggaaatgaaaa

SEQ ID NO: 904565 - DNA, 21 bp, Homo sapiens
agcaggaaatgaaaatgtctt

SEQ ID NO: 904566 - DNA, 21 bp, Homo sapiens
agcaggaagcattcagagagc

SEQ ID NO: 904567 - DNA, 22 bp, Homo sapiens
agcaggaaggacaggaagctgg

SEQ ID NO: 904568 - DNA, 11 bp, Homo sapiens
agcaggaaggg

SEQ ID NO: 904569 - DNA, 21 bp, Homo sapiens
agcaggacctactaggagagg

SEQ ID NO: 904570 - DNA, 12 bp, Homo sapiens
agcaggacctag

SEQ ID NO: 904571 - DNA, 18 bp, Homo sapiens
agcaggacctcccttccg

SEQ ID NO: 904572 - DNA, 22 bp, Homo sapiens
cagattggcacccctttctagt

SEQ ID NO: 904573 - DNA, 20 bp, Homo sapiens
cagattgtggaatgttggat

SEQ ID NO: 904574 - DNA, 21 bp, Homo sapiens
cagattgtggaatgttggata

SEQ ID NO: 904575 - DNA, 16 bp, Homo sapiens
cagattgtggggtgca

SEQ ID NO: 904576 - DNA, 21 bp, Homo sapiens
cagattgtggggtgcagctgg

SEQ ID NO: 904577 - DNA, 13 bp, Homo sapiens
cagatttaataca

SEQ ID NO: 904578 - DNA, 18 bp, Homo sapiens
cagatttacactgggaga

SEQ ID NO: 904579 - DNA, 13 bp, Homo sapiens
cagatttctggtt

SEQ ID NO: 904580 - DNA, 14 bp, Homo sapiens
cagatttgtctttt

SEQ ID NO: 904581 - DNA, 13 bp, Homo sapiens
cagatttgtgccc

SEQ ID NO: 904582 - DNA, 20 bp, Homo sapiens
cagatttgtgcccattccta

SEQ ID NO: 904583 - DNA, 22 bp, Homo sapiens
cagattttaaaaagtcttcact

SEQ ID NO: 904584 - DNA, 16 bp, Homo sapiens
cagattttacaaaaga

SEQ ID NO: 904585 - DNA, 19 bp, Homo sapiens
cagattttacagagcgcac

SEQ ID NO: 904586 - DNA, 17 bp, Homo sapiens
cagattttatattttct

SEQ ID NO: 904587 - DNA, 19 bp, Homo sapiens
cagattttcagcaaactct

SEQ ID NO: 904588 - DNA, 23 bp, Homo sapiens
cagattttggggttgtgttgtca

SEQ ID NO: 904589 - DNA, 23 bp, Homo sapiens
cagattttgttggcatagctctg

SEQ ID NO: 904590 - DNA, 15 bp, Homo sapiens
cagatttttacaaat

SEQ ID NO: 904591 - DNA, 15 bp, Homo sapiens
cagattttttaaaat

SEQ ID NO: 904592 - DNA, 21 bp, Homo sapiens
cagcaaaaactgtgggaagat

SEQ ID NO: 904593 - DNA, 13 bp, Homo sapiens
cagcaaaaagcaa

SEQ ID NO: 904594 - DNA, 12 bp, Homo sapiens
cagcaaaaccat

SEQ ID NO: 904595 - DNA, 18 bp, Homo sapiens
cagcaaaaccattgcttc

SEQ ID NO: 904596 - DNA, 20 bp, Homo sapiens
cagcaaaaccattgcttcac

SEQ ID NO: 904597 - DNA, 18 bp, Homo sapiens
cagcaaaatggaagcaaa

SEQ ID NO: 904598 - DNA, 23 bp, Homo sapiens
cagcaaaatggaagcaaagacaa

SEQ ID NO: 904599 - DNA, 15 bp, Homo sapiens
cagcaaacactccac

SEQ ID NO: 904600 - DNA, 11 bp, Homo sapiens
cagcaaaccat

SEQ ID NO: 904601 - DNA, 15 bp, Homo sapiens
cagcaaagaaaaaaa

SEQ ID NO: 904602 - DNA, 17 bp, Homo sapiens
cagcaaagaggggcgct

SEQ ID NO: 904603 - DNA, 19 bp, Homo sapiens
cagcaaagagtgggctgca

SEQ ID NO: 904604 - DNA, 19 bp, Homo sapiens
cagcaacaataaatagaca

SEQ ID NO: 904605 - DNA, 21 bp, Homo sapiens
cagcaacacaagctggaagca

SEQ ID NO: 904606 - DNA, 14 bp, Homo sapiens
cagcaacagaaaaa

SEQ ID NO: 904607 - DNA, 17 bp, Homo sapiens
cagcaacagaaaaatgg

SEQ ID NO: 904608 - DNA, 17 bp, Homo sapiens
cagcaacagcaagaaat

SEQ ID NO: 904609 - DNA, 13 bp, Homo sapiens
cagcaaccccagg

SEQ ID NO: 904610 - DNA, 17 bp, Homo sapiens
cagcaaccccaggctga

SEQ ID NO: 904611 - DNA, 20 bp, Homo sapiens
cagcaacggggaggccaagt

SEQ ID NO: 904612 - DNA, 13 bp, Homo sapiens
cagcaactgaata

SEQ ID NO: 904613 - DNA, 14 bp, Homo sapiens
cagcaactgaataa

SEQ ID NO: 904614 - DNA, 12 bp, Homo sapiens
cagcaactgacc

SEQ ID NO: 904615 - DNA, 16 bp, Homo sapiens
cagcaactgcccttcc

SEQ ID NO: 904616 - DNA, 18 bp, Homo sapiens
cagcaacttgtctttttc

SEQ ID NO: 904617 - DNA, 19 bp, Homo sapiens
cagcaacttgtctttttct

SEQ ID NO: 904618 - DNA, 22 bp, Homo sapiens
cagcaacttgtctttttctgga

SEQ ID NO: 904619 - DNA, 12 bp, Homo sapiens
cagcaagaaata

SEQ ID NO: 904620 - DNA, 12 bp, Homo sapiens
cagcaagaagca

SEQ ID NO: 904621 - DNA, 21 bp, Homo sapiens
cagcaagactttataattcct

SEQ ID NO: 904622 - DNA, 23 bp, Homo sapiens
cagcaagagggaacaaaactgtt

SEQ ID NO: 904623 - DNA, 16 bp, Homo sapiens
cagcaagagtaagcag

SEQ ID NO: 904624 - DNA, 19 bp, Homo sapiens
cagcaagagtaagcagtgt

SEQ ID NO: 904625 - DNA, 20 bp, Homo sapiens
cagcaagagtaagcagtgtt

SEQ ID NO: 904626 - DNA, 21 bp, Homo sapiens
cagcaagccctacagagctgt

SEQ ID NO: 904627 - DNA, 12 bp, Homo sapiens
cagcaagccggc

SEQ ID NO: 904628 - DNA, 14 bp, Homo sapiens
cagcaagcgggagc

SEQ ID NO: 904629 - DNA, 19 bp, Homo sapiens
cagcaaggaaatgtcctgc

SEQ ID NO: 904630 - DNA, 21 bp, Homo sapiens
cagcaaggaaatgtcctgcat

SEQ ID NO: 904631 - DNA, 23 bp, Homo sapiens
cagcaaggccttggtggagcagc

SEQ ID NO: 904632 - DNA, 21 bp, Homo sapiens
cagcaaggcgcctgccttggg

SEQ ID NO: 904633 - DNA, 19 bp, Homo sapiens
cagcaagtacagcggctcc

SEQ ID NO: 904634 - DNA, 15 bp, Homo sapiens
cagcaagtgagcaga

SEQ ID NO: 904635 - DNA, 23 bp, Homo sapiens
cagcaagttagaactagccaaac

SEQ ID NO: 904636 - DNA, 13 bp, Homo sapiens
cagcaataaagca

SEQ ID NO: 904637 - DNA, 20 bp, Homo sapiens
cagcaatactcatcagagca

SEQ ID NO: 904638 - DNA, 22 bp, Homo sapiens
cagcaatactcatcagagcagc

SEQ ID NO: 904639 - DNA, 22 bp, Homo sapiens
cagcaatattgcctgtgcttct

SEQ ID NO: 904640 - DNA, 12 bp, Homo sapiens
cagcaatctgca

SEQ ID NO: 904641 - DNA, 19 bp, Homo sapiens
cagcaatgacatctcaggg

SEQ ID NO: 904642 - DNA, 19 bp, Homo sapiens
cagcaatgccatttcagtg

SEQ ID NO: 904643 - DNA, 19 bp, Homo sapiens
cagcaattatgaaaataat

SEQ ID NO: 904644 - DNA, 23 bp, Homo sapiens
cagcaatttctaatttttaagaa

SEQ ID NO: 904645 - DNA, 17 bp, Homo sapiens
cagcacaattctgtccc

SEQ ID NO: 904646 - DNA, 19 bp, Homo sapiens
cagcacaattctgtccctg

SEQ ID NO: 904647 - DNA, 23 bp, Homo sapiens
cagcacaattctgtccctgtccc

SEQ ID NO: 904648 - DNA, 19 bp, Homo sapiens
cagcacacagggcagtgag

SEQ ID NO: 904649 - DNA, 16 bp, Homo sapiens
cagcacaccaagtggc

SEQ ID NO: 904650 - DNA, 21 bp, Homo sapiens
cagcacaccaagtggctgggt

SEQ ID NO: 904651 - DNA, 22 bp, Homo sapiens
cagcacaccaagtggctgggtg

SEQ ID NO: 904652 - DNA, 18 bp, Homo sapiens
cagcacaccagccgctgc

SEQ ID NO: 904653 - DNA, 19 bp, Homo sapiens
cagcacaccagccgctgca

SEQ ID NO: 904654 - DNA, 16 bp, Homo sapiens
cagcacacctctgggg

SEQ ID NO: 904655 - DNA, 14 bp, Homo sapiens
cagcacagaatgag

SEQ ID NO: 904656 - DNA, 12 bp, Homo sapiens
cagcacagagcg

SEQ ID NO: 904657 - DNA, 20 bp, Homo sapiens
cagcacagccacctccgcca

SEQ ID NO: 904658 - DNA, 16 bp, Homo sapiens
cagcacagcccagggc

SEQ ID NO: 904659 - DNA, 16 bp, Homo sapiens
cagcacagcttgacct

SEQ ID NO: 904660 - DNA, 22 bp, Homo sapiens
cagcacagcttgacctgaggct

SEQ ID NO: 904661 - DNA, 13 bp, Homo sapiens
cagcacaggggcc

SEQ ID NO: 904662 - DNA, 20 bp, Homo sapiens
cagcacaggggccccagatc

SEQ ID NO: 904663 - DNA, 22 bp, Homo sapiens
cagcacaggggccccagatctg

SEQ ID NO: 904664 - DNA, 15 bp, Homo sapiens
cagcacatcacctct

SEQ ID NO: 904665 - DNA, 15 bp, Homo sapiens
cagcacatgcgggct

SEQ ID NO: 904666 - DNA, 18 bp, Homo sapiens
cagcacatggccatagag

SEQ ID NO: 904667 - DNA, 20 bp, Homo sapiens
cagcacattcgggaccaata

SEQ ID NO: 904668 - DNA, 16 bp, Homo sapiens
cagcacatttccgctg

SEQ ID NO: 904669 - DNA, 16 bp, Homo sapiens
cagcaccacattgcct

SEQ ID NO: 904670 - DNA, 18 bp, Homo sapiens
cagcaccacattgcctca

SEQ ID NO: 904671 - DNA, 19 bp, Homo sapiens
cagcaccacattgcctcat

SEQ ID NO: 904672 - DNA, 19 bp, Homo sapiens
cagcaccacctacacagga

SEQ ID NO: 904673 - DNA, 21 bp, Homo sapiens
cagcaccacctacacaggagt

SEQ ID NO: 904674 - DNA, 20 bp, Homo sapiens
cagcaccactgctgaggagt

SEQ ID NO: 904675 - DNA, 17 bp, Homo sapiens
cagcacccccacccacc

SEQ ID NO: 904676 - DNA, 19 bp, Homo sapiens
cagcacccccacccacctc

SEQ ID NO: 904677 - DNA, 23 bp, Homo sapiens
cagcaccccgaagggagcatctg

SEQ ID NO: 904678 - DNA, 14 bp, Homo sapiens
cagcaccccttcca

SEQ ID NO: 904679 - DNA, 15 bp, Homo sapiens
cagcaccccttccat

SEQ ID NO: 904680 - DNA, 16 bp, Homo sapiens
cagcaccccttccatg

SEQ ID NO: 904681 - DNA, 13 bp, Homo sapiens
cagcaccctaaga

SEQ ID NO: 904682 - DNA, 17 bp, Homo sapiens
cagcaccctataaatca

SEQ ID NO: 904683 - DNA, 14 bp, Homo sapiens
cagcaccctctcct

SEQ ID NO: 904684 - DNA, 18 bp, Homo sapiens
cagcaccctctcctgggg

SEQ ID NO: 904685 - DNA, 19 bp, Homo sapiens
cagcaccctctcctggggg

SEQ ID NO: 904686 - DNA, 20 bp, Homo sapiens
cagcaccctgggtgccattc

SEQ ID NO: 904687 - DNA, 22 bp, Homo sapiens
cagcacccttctcggagaccca

SEQ ID NO: 904688 - DNA, 15 bp, Homo sapiens
cagcaccgtgccaac

SEQ ID NO: 904689 - DNA, 17 bp, Homo sapiens
cagcaccgttctgtgca

SEQ ID NO: 904690 - DNA, 20 bp, Homo sapiens
cagcacctacagtgtacagt

SEQ ID NO: 904691 - DNA, 18 bp, Homo sapiens
cagcacctccaggcctgt

SEQ ID NO: 904692 - DNA, 16 bp, Homo sapiens
cagcaccttggcccag

SEQ ID NO: 904693 - DNA, 23 bp, Homo sapiens
cagcaccttggcccaggagctct

SEQ ID NO: 904694 - DNA, 16 bp, Homo sapiens
cagcacctttctctga

SEQ ID NO: 904695 - DNA, 19 bp, Homo sapiens
cagcacctttctctgagaa

SEQ ID NO: 904696 - DNA, 22 bp, Homo sapiens
agcaggacctcccttccgaccc

SEQ ID NO: 904697 - DNA, 19 bp, Homo sapiens
agcaggactccaggcccaa

SEQ ID NO: 904698 - DNA, 23 bp, Homo sapiens
agcaggactgaattgtccccagt

SEQ ID NO: 904699 - DNA, 21 bp, Homo sapiens
agcaggacttgctaaagcact

SEQ ID NO: 904700 - DNA, 13 bp, Homo sapiens
agcaggagcccct

SEQ ID NO: 904701 - DNA, 20 bp, Homo sapiens
agcaggaggccaataaaaag

SEQ ID NO: 904702 - DNA, 13 bp, Homo sapiens
agcaggagtggtg

SEQ ID NO: 904703 - DNA, 19 bp, Homo sapiens
agcaggatcgaagggtttt

SEQ ID NO: 904704 - DNA, 20 bp, Homo sapiens
agcaggatgaccacgcacct

SEQ ID NO: 904705 - DNA, 21 bp, Homo sapiens
agcaggatgaccacgcacctc

SEQ ID NO: 904706 - DNA, 23 bp, Homo sapiens
agcaggatgggctgagctagcct

SEQ ID NO: 904707 - DNA, 17 bp, Homo sapiens
agcaggcaaaaaaggga

SEQ ID NO: 904708 - DNA, 22 bp, Homo sapiens
agcaggcaaaaaagggacagca

SEQ ID NO: 904709 - DNA, 19 bp, Homo sapiens
agcaggcaatgctgtactt

SEQ ID NO: 904710 - DNA, 20 bp, Homo sapiens
agcaggcacggcccgcagcc

SEQ ID NO: 904711 - DNA, 20 bp, Homo sapiens
agcaggcacttgattccttg

SEQ ID NO: 904712 - DNA, 14 bp, Homo sapiens
agcaggcagcgcca

SEQ ID NO: 904713 - DNA, 16 bp, Homo sapiens
agcaggcagcgccaag

SEQ ID NO: 904714 - DNA, 12 bp, Homo sapiens
agcaggcaggca

SEQ ID NO: 904715 - DNA, 20 bp, Homo sapiens
agcaggcaggcactgtggcc

SEQ ID NO: 904716 - DNA, 13 bp, Homo sapiens
agcaggcaggctg

SEQ ID NO: 904717 - DNA, 16 bp, Homo sapiens
agcaggcaggctgggg

SEQ ID NO: 904718 - DNA, 12 bp, Homo sapiens
agcaggcccagc

SEQ ID NO: 904719 - DNA, 13 bp, Homo sapiens
agcaggcccagca

SEQ ID NO: 904720 - DNA, 15 bp, Homo sapiens
agcaggcctctggtt

SEQ ID NO: 904721 - DNA, 17 bp, Homo sapiens
agcaggctactgggacc

SEQ ID NO: 904722 - DNA, 18 bp, Homo sapiens
agcaggctcctggctgtg

SEQ ID NO: 904723 - DNA, 19 bp, Homo sapiens
agcaggctcctggctgtgc

SEQ ID NO: 904724 - DNA, 16 bp, Homo sapiens
agcaggctggcagctc

SEQ ID NO: 904725 - DNA, 22 bp, Homo sapiens
agcaggctggcagctctccagt

SEQ ID NO: 904726 - DNA, 21 bp, Homo sapiens
agcagggaaaatgcagcaggg

SEQ ID NO: 904727 - DNA, 23 bp, Homo sapiens
agcagggctaccctgagctgagg

SEQ ID NO: 904728 - DNA, 15 bp, Homo sapiens
agcaggggagcttgg

SEQ ID NO: 904729 - DNA, 17 bp, Homo sapiens
agcaggggagcttggga

SEQ ID NO: 904730 - DNA, 18 bp, Homo sapiens
agcaggggcaggcgcaga

SEQ ID NO: 904731 - DNA, 15 bp, Homo sapiens
agcaggggggctgtg

SEQ ID NO: 904732 - DNA, 21 bp, Homo sapiens
agcagggtaccctttggggag

SEQ ID NO: 904733 - DNA, 16 bp, Homo sapiens
agcagggtcttttcat

SEQ ID NO: 904734 - DNA, 18 bp, Homo sapiens
agcagggtcttttcatct

SEQ ID NO: 904735 - DNA, 15 bp, Homo sapiens
agcagggtggggtct

SEQ ID NO: 904736 - DNA, 16 bp, Homo sapiens
agcagggtggggtctg

SEQ ID NO: 904737 - DNA, 19 bp, Homo sapiens
agcagggtggggtctggga

SEQ ID NO: 904738 - DNA, 19 bp, Homo sapiens
agcaggtgattggaccagg

SEQ ID NO: 904739 - DNA, 22 bp, Homo sapiens
agcaggtgattggaccaggcca

SEQ ID NO: 904740 - DNA, 13 bp, Homo sapiens
agcaggtgctgac

SEQ ID NO: 904741 - DNA, 19 bp, Homo sapiens
agcaggtggcatctctaat

SEQ ID NO: 904742 - DNA, 13 bp, Homo sapiens
agcaggtggtcct

SEQ ID NO: 904743 - DNA, 18 bp, Homo sapiens
agcaggtgtggtggctca

SEQ ID NO: 904744 - DNA, 16 bp, Homo sapiens
agcaggttcccaagct

SEQ ID NO: 904745 - DNA, 16 bp, Homo sapiens
agcaggttcttgatgt

SEQ ID NO: 904746 - DNA, 21 bp, Homo sapiens
agcaggttcttgatgtcatgt

SEQ ID NO: 904747 - DNA, 13 bp, Homo sapiens
agcagtaaaagat

SEQ ID NO: 904748 - DNA, 19 bp, Homo sapiens
agcagtaaaagataaattt

SEQ ID NO: 904749 - DNA, 21 bp, Homo sapiens
agcagtaaaagatgaagtttt

SEQ ID NO: 904750 - DNA, 19 bp, Homo sapiens
agcagtaaatacttgcagt

SEQ ID NO: 904751 - DNA, 21 bp, Homo sapiens
agcagtaaatacttgcagttg

SEQ ID NO: 904752 - DNA, 23 bp, Homo sapiens
agcagtaaatacttgcagttgtg

SEQ ID NO: 904753 - DNA, 17 bp, Homo sapiens
agcagtaaatttgctag

SEQ ID NO: 904754 - DNA, 19 bp, Homo sapiens
agcagtaaatttgctagca

SEQ ID NO: 904755 - DNA, 22 bp, Homo sapiens
agcagtacacttggatgcagtg

SEQ ID NO: 904756 - DNA, 21 bp, Homo sapiens
agcagtagaaataatatgcat

SEQ ID NO: 904757 - DNA, 15 bp, Homo sapiens
agcagtatataataa

SEQ ID NO: 904758 - DNA, 17 bp, Homo sapiens
agcagtatataataact

SEQ ID NO: 904759 - DNA, 20 bp, Homo sapiens
agcagtatataataacttta

SEQ ID NO: 904760 - DNA, 16 bp, Homo sapiens
agcagtatcatgaagc

SEQ ID NO: 904761 - DNA, 11 bp, Homo sapiens
agcagtatttt

SEQ ID NO: 904762 - DNA, 12 bp, Homo sapiens
agcagtattttt

SEQ ID NO: 904763 - DNA, 11 bp, Homo sapiens
agcagtcacaa

SEQ ID NO: 904764 - DNA, 14 bp, Homo sapiens
agcagtcacaacag

SEQ ID NO: 904765 - DNA, 17 bp, Homo sapiens
agcagtcagagtccagt

SEQ ID NO: 904766 - DNA, 14 bp, Homo sapiens
agcagtcagccctt

SEQ ID NO: 904767 - DNA, 23 bp, Homo sapiens
agcagtcccagtattctcagagc

SEQ ID NO: 904768 - DNA, 15 bp, Homo sapiens
agcagtcccattcat

SEQ ID NO: 904769 - DNA, 22 bp, Homo sapiens
agcagtcctgcctcagcctccg

SEQ ID NO: 904770 - DNA, 16 bp, Homo sapiens
agcagtcgtgcctgtg

SEQ ID NO: 904771 - DNA, 17 bp, Homo sapiens
agcagtcgtgcctgtgt

SEQ ID NO: 904772 - DNA, 21 bp, Homo sapiens
agcagtcgtgcctgtgtccat

SEQ ID NO: 904773 - DNA, 18 bp, Homo sapiens
agcagtctaccctgtcct

SEQ ID NO: 904774 - DNA, 20 bp, Homo sapiens
agcagtgaaacttgtgctat

SEQ ID NO: 904775 - DNA, 20 bp, Homo sapiens
agcagtgaatgattcagtgt

SEQ ID NO: 904776 - DNA, 21 bp, Homo sapiens
agcagtgaatgattcagtgtt

SEQ ID NO: 904777 - DNA, 20 bp, Homo sapiens
agcagtgatctcagggcaga

SEQ ID NO: 904778 - DNA, 23 bp, Homo sapiens
agcagtgcacatttcatagtttc

SEQ ID NO: 904779 - DNA, 19 bp, Homo sapiens
agcagtgccttccataatt

SEQ ID NO: 904780 - DNA, 23 bp, Homo sapiens
agcagtgccttccataattatga

SEQ ID NO: 904781 - DNA, 11 bp, Homo sapiens
agcagtggctg

SEQ ID NO: 904782 - DNA, 21 bp, Homo sapiens
agcagtggctggtccagggct

SEQ ID NO: 904783 - DNA, 22 bp, Homo sapiens
agcagtggctggtccagggcta

SEQ ID NO: 904784 - DNA, 17 bp, Homo sapiens
agcagtggctggtgccc

SEQ ID NO: 904785 - DNA, 15 bp, Homo sapiens
agcagtgggcaggtg

SEQ ID NO: 904786 - DNA, 16 bp, Homo sapiens
agcagtgggcaggtgg

SEQ ID NO: 904787 - DNA, 18 bp, Homo sapiens
agcagtgggcaggtggcc

SEQ ID NO: 904788 - DNA, 19 bp, Homo sapiens
agcagtgggcaggtggccg

SEQ ID NO: 904789 - DNA, 13 bp, Homo sapiens
agcagtggggtga

SEQ ID NO: 904790 - DNA, 13 bp, Homo sapiens
agcagtgtcatca

SEQ ID NO: 904791 - DNA, 19 bp, Homo sapiens
agcagtgtcatcagaagat

SEQ ID NO: 904792 - DNA, 16 bp, Homo sapiens
agcagtgtcttccata

SEQ ID NO: 904793 - DNA, 22 bp, Homo sapiens
agcagtgtgaatagcctggcca

SEQ ID NO: 904794 - DNA, 20 bp, Homo sapiens
agcagtgtgacctcctgtga

SEQ ID NO: 904795 - DNA, 21 bp, Homo sapiens
agcagttacaaaaaccttccc

SEQ ID NO: 904796 - DNA, 20 bp, Homo sapiens
agcagttatggtgatgactt

SEQ ID NO: 904797 - DNA, 21 bp, Homo sapiens
agcagttgacatccaaatcta

SEQ ID NO: 904798 - DNA, 22 bp, Homo sapiens
agcagttgacatccaaatctag

SEQ ID NO: 904799 - DNA, 23 bp, Homo sapiens
agcagttgagtcgtcatcacttt

SEQ ID NO: 904800 - DNA, 15 bp, Homo sapiens
agcagtttcattgtg

SEQ ID NO: 904801 - DNA, 21 bp, Homo sapiens
agcagttttcaagtcaaatta

SEQ ID NO: 904802 - DNA, 16 bp, Homo sapiens
agcagttttcccctgg

SEQ ID NO: 904803 - DNA, 23 bp, Homo sapiens
agcataaaaattagccaagtgtg

SEQ ID NO: 904804 - DNA, 15 bp, Homo sapiens
agcataaaacctaaa

SEQ ID NO: 904805 - DNA, 21 bp, Homo sapiens
agcataaaagaatatttagaa

SEQ ID NO: 904806 - DNA, 13 bp, Homo sapiens
agcataaagctca

SEQ ID NO: 904807 - DNA, 23 bp, Homo sapiens
agcataaagctcaaatgaaatgt

SEQ ID NO: 904808 - DNA, 18 bp, Homo sapiens
agcataaataaaactgaa

SEQ ID NO: 904809 - DNA, 13 bp, Homo sapiens
agcataacatatg

SEQ ID NO: 904810 - DNA, 13 bp, Homo sapiens
agcataactgtag

SEQ ID NO: 904811 - DNA, 16 bp, Homo sapiens
agcataactgtagctc

SEQ ID NO: 904812 - DNA, 14 bp, Homo sapiens
agcataatatgaag

SEQ ID NO: 904813 - DNA, 18 bp, Homo sapiens
agcataatgctcccatct

SEQ ID NO: 904814 - DNA, 16 bp, Homo sapiens
agcataatttaaaaat

SEQ ID NO: 904815 - DNA, 18 bp, Homo sapiens
agcataatttaaaaatat

SEQ ID NO: 904816 - DNA, 20 bp, Homo sapiens
agcataatttaaaaatatat

SEQ ID NO: 904817 - DNA, 22 bp, Homo sapiens
agcataatttaaaaatatattt

SEQ ID NO: 904818 - DNA, 16 bp, Homo sapiens
agcataatttgtttaa

SEQ ID NO: 904819 - DNA, 15 bp, Homo sapiens
cagcacgatttctgt

SEQ ID NO: 904820 - DNA, 16 bp, Homo sapiens
cagcacgatttctgtt

SEQ ID NO: 904821 - DNA, 18 bp, Homo sapiens
cagcacgcaggcggggca

SEQ ID NO: 904822 - DNA, 17 bp, Homo sapiens
cagcacggcccggcccc

SEQ ID NO: 904823 - DNA, 23 bp, Homo sapiens
cagcacggcccggcccctcaccc

SEQ ID NO: 904824 - DNA, 16 bp, Homo sapiens
cagcactaaggccgtg

SEQ ID NO: 904825 - DNA, 22 bp, Homo sapiens
cagcactaaggccgtgtctctg

SEQ ID NO: 904826 - DNA, 16 bp, Homo sapiens
cagcactactgggtgt

SEQ ID NO: 904827 - DNA, 18 bp, Homo sapiens
cagcactcaaacctggag

SEQ ID NO: 904828 - DNA, 14 bp, Homo sapiens
cagcactcagcctc

SEQ ID NO: 904829 - DNA, 12 bp, Homo sapiens
cagcactcccca

SEQ ID NO: 904830 - DNA, 13 bp, Homo sapiens
cagcactcccgct

SEQ ID NO: 904831 - DNA, 18 bp, Homo sapiens
cagcactcccgctgcaca

SEQ ID NO: 904832 - DNA, 21 bp, Homo sapiens
cagcactcccgctgcacacag

SEQ ID NO: 904833 - DNA, 14 bp, Homo sapiens
cagcactgcctcct

SEQ ID NO: 904834 - DNA, 16 bp, Homo sapiens
cagcactgcttgagga

SEQ ID NO: 904835 - DNA, 22 bp, Homo sapiens
cagcactgggaagctggagtgc

SEQ ID NO: 904836 - DNA, 22 bp, Homo sapiens
cagcactggtgaactgagctgg

SEQ ID NO: 904837 - DNA, 14 bp, Homo sapiens
cagcactgtccctt

SEQ ID NO: 904838 - DNA, 16 bp, Homo sapiens
cagcactgtcccttgc

SEQ ID NO: 904839 - DNA, 20 bp, Homo sapiens
cagcactgtcccttgcctca

SEQ ID NO: 904840 - DNA, 15 bp, Homo sapiens
cagcactgtctcagt

SEQ ID NO: 904841 - DNA, 12 bp, Homo sapiens
cagcactgtgag

SEQ ID NO: 904842 - DNA, 13 bp, Homo sapiens
cagcacttccatg

SEQ ID NO: 904843 - DNA, 13 bp, Homo sapiens
cagcacttgtata

SEQ ID NO: 904844 - DNA, 15 bp, Homo sapiens
cagcacttgtccagc

SEQ ID NO: 904845 - DNA, 17 bp, Homo sapiens
cagcacttgtccagctg

SEQ ID NO: 904846 - DNA, 21 bp, Homo sapiens
cagcactttaaagaggctgtg

SEQ ID NO: 904847 - DNA, 21 bp, Homo sapiens
cagcactttaaccctctcttc

SEQ ID NO: 904848 - DNA, 23 bp, Homo sapiens
cagcactttaaccctctcttccc

SEQ ID NO: 904849 - DNA, 16 bp, Homo sapiens
cagcactttgggaggc

SEQ ID NO: 904850 - DNA, 18 bp, Homo sapiens
cagcactttgggaggcct

SEQ ID NO: 904851 - DNA, 19 bp, Homo sapiens
cagcactttgggaggctga

SEQ ID NO: 904852 - DNA, 23 bp, Homo sapiens
cagcactttgggaggctgaggtg

SEQ ID NO: 904853 - DNA, 18 bp, Homo sapiens
cagcagaaatgcccccat

SEQ ID NO: 904854 - DNA, 21 bp, Homo sapiens
cagcagaaatgcccccattct

SEQ ID NO: 904855 - DNA, 22 bp, Homo sapiens
cagcagaaatgccttaccctca

SEQ ID NO: 904856 - DNA, 16 bp, Homo sapiens
cagcagaacctgcaca

SEQ ID NO: 904857 - DNA, 15 bp, Homo sapiens
cagcagaagacaaaa

SEQ ID NO: 904858 - DNA, 12 bp, Homo sapiens
cagcagaagcct

SEQ ID NO: 904859 - DNA, 16 bp, Homo sapiens
cagcagaatggaggca

SEQ ID NO: 904860 - DNA, 12 bp, Homo sapiens
cagcagacacat

SEQ ID NO: 904861 - DNA, 21 bp, Homo sapiens
cagcagacagagccaggagaa

SEQ ID NO: 904862 - DNA, 18 bp, Homo sapiens
cagcagactcagctctga

SEQ ID NO: 904863 - DNA, 12 bp, Homo sapiens
cagcagagccca

SEQ ID NO: 904864 - DNA, 15 bp, Homo sapiens
cagcagagcccacca

SEQ ID NO: 904865 - DNA, 22 bp, Homo sapiens
cagcagagcccaccagccagcc

SEQ ID NO: 904866 - DNA, 14 bp, Homo sapiens
cagcagagcggggt

SEQ ID NO: 904867 - DNA, 23 bp, Homo sapiens
cagcagagcggggtcccctctgt

SEQ ID NO: 904868 - DNA, 12 bp, Homo sapiens
cagcagaggcag

SEQ ID NO: 904869 - DNA, 14 bp, Homo sapiens
cagcagaggcagtg

SEQ ID NO: 904870 - DNA, 19 bp, Homo sapiens
cagcagaggcagtggccac

SEQ ID NO: 904871 - DNA, 18 bp, Homo sapiens
cagcagagggcgccacca

SEQ ID NO: 904872 - DNA, 14 bp, Homo sapiens
cagcagaggtgaga

SEQ ID NO: 904873 - DNA, 16 bp, Homo sapiens
cagcagaggtgagaac

SEQ ID NO: 904874 - DNA, 21 bp, Homo sapiens
cagcagaggtgagaactcaga

SEQ ID NO: 904875 - DNA, 22 bp, Homo sapiens
cagcagaggtgagaactcagaa

SEQ ID NO: 904876 - DNA, 23 bp, Homo sapiens
cagcagagtgagcaagggggccc

SEQ ID NO: 904877 - DNA, 22 bp, Homo sapiens
cagcagagttattgaatcttaa

SEQ ID NO: 904878 - DNA, 22 bp, Homo sapiens
cagcagatgctgttgtgaagct

SEQ ID NO: 904879 - DNA, 16 bp, Homo sapiens
cagcagcacaaacatt

SEQ ID NO: 904880 - DNA, 14 bp, Homo sapiens
cagcagcaccaacc

SEQ ID NO: 904881 - DNA, 19 bp, Homo sapiens
cagcagcaccaaccacagc

SEQ ID NO: 904882 - DNA, 20 bp, Homo sapiens
cagcagcacctttctctgag

SEQ ID NO: 904883 - DNA, 21 bp, Homo sapiens
cagcagcacctttctctgaga

SEQ ID NO: 904884 - DNA, 11 bp, Homo sapiens
cagcagcactc

SEQ ID NO: 904885 - DNA, 20 bp, Homo sapiens
cagcagcactcccgctgcac

SEQ ID NO: 904886 - DNA, 24 bp, Homo sapiens
cagcagcactcccgctgcacacag

SEQ ID NO: 904887 - DNA, 16 bp, Homo sapiens
cagcagcagaatggaa

SEQ ID NO: 904888 - DNA, 22 bp, Homo sapiens
cagcagcaggatgggctgagct

SEQ ID NO: 904889 - DNA, 23 bp, Homo sapiens
cagcagcaggatgggctgagcta

SEQ ID NO: 904890 - DNA, 13 bp, Homo sapiens
cagcagcatccca

SEQ ID NO: 904891 - DNA, 14 bp, Homo sapiens
cagcagcatcccag

SEQ ID NO: 904892 - DNA, 18 bp, Homo sapiens
cagcagcatcccagcctt

SEQ ID NO: 904893 - DNA, 20 bp, Homo sapiens
cagcagcatcccagccttga

SEQ ID NO: 904894 - DNA, 16 bp, Homo sapiens
cagcagccactgcaca

SEQ ID NO: 904895 - DNA, 13 bp, Homo sapiens
cagcagccagcac

SEQ ID NO: 904896 - DNA, 18 bp, Homo sapiens
cagcagccagcaccacct

SEQ ID NO: 904897 - DNA, 20 bp, Homo sapiens
cagcagccagctctcagcca

SEQ ID NO: 904898 - DNA, 19 bp, Homo sapiens
cagcagccagtctcagaga

SEQ ID NO: 904899 - DNA, 18 bp, Homo sapiens
cagcagccatcataggaa

SEQ ID NO: 904900 - DNA, 21 bp, Homo sapiens
cagcagccatcataggaaggg

SEQ ID NO: 904901 - DNA, 22 bp, Homo sapiens
cagcagccatcataggaaggga

SEQ ID NO: 904902 - DNA, 18 bp, Homo sapiens
cagcagcccaagcttccc

SEQ ID NO: 904903 - DNA, 19 bp, Homo sapiens
cagcagcccaagcttccct

SEQ ID NO: 904904 - DNA, 20 bp, Homo sapiens
cagcagcccaagcttccctc

SEQ ID NO: 904905 - DNA, 18 bp, Homo sapiens
cagcagcccagcttcctg

SEQ ID NO: 904906 - DNA, 21 bp, Homo sapiens
cagcagcccagcttcctggtg

SEQ ID NO: 904907 - DNA, 12 bp, Homo sapiens
cagcagcccccc

SEQ ID NO: 904908 - DNA, 18 bp, Homo sapiens
cagcagccccccagcact

SEQ ID NO: 904909 - DNA, 21 bp, Homo sapiens
cagcagccccccagcactaag

SEQ ID NO: 904910 - DNA, 16 bp, Homo sapiens
cagcagcccctgcaca

SEQ ID NO: 904911 - DNA, 11 bp, Homo sapiens
cagcagcccta

SEQ ID NO: 904912 - DNA, 16 bp, Homo sapiens
cagcagccctaaggat

SEQ ID NO: 904913 - DNA, 23 bp, Homo sapiens
cagcagccctaaggatctctcag

SEQ ID NO: 904914 - DNA, 15 bp, Homo sapiens
cagcagccctcctca

SEQ ID NO: 904915 - DNA, 14 bp, Homo sapiens
cagcagcctcgcac

SEQ ID NO: 904916 - DNA, 20 bp, Homo sapiens
cagcagcctcgcacaggccc

SEQ ID NO: 904917 - DNA, 21 bp, Homo sapiens
cagcagcctcgcacaggccct

SEQ ID NO: 904918 - DNA, 13 bp, Homo sapiens
cagcagcctctga

SEQ ID NO: 904919 - DNA, 14 bp, Homo sapiens
cagcagcctggacc

SEQ ID NO: 904920 - DNA, 19 bp, Homo sapiens
cagcagcctggaccctgtg

SEQ ID NO: 904921 - DNA, 20 bp, Homo sapiens
cagcagcctggggctggcct

SEQ ID NO: 904922 - DNA, 17 bp, Homo sapiens
cagcagcctgtgaggga

SEQ ID NO: 904923 - DNA, 20 bp, Homo sapiens
cagcagcctgtgagggagtg

SEQ ID NO: 904924 - DNA, 17 bp, Homo sapiens
cagcagcgcctttccca

SEQ ID NO: 904925 - DNA, 22 bp, Homo sapiens
cagcagcgctcggcccggagca

SEQ ID NO: 904926 - DNA, 16 bp, Homo sapiens
cagcagctaggactga

SEQ ID NO: 904927 - DNA, 19 bp, Homo sapiens
cagcagctaggactgagga

SEQ ID NO: 904928 - DNA, 22 bp, Homo sapiens
cagcagctaggactgaggagtg

SEQ ID NO: 904929 - DNA, 14 bp, Homo sapiens
cagcagctgcaccc

SEQ ID NO: 904930 - DNA, 17 bp, Homo sapiens
cagcagctgcgggtctg

SEQ ID NO: 904931 - DNA, 21 bp, Homo sapiens
cagcagcttataatgggctct

SEQ ID NO: 904932 - DNA, 23 bp, Homo sapiens
cagcagcttataatgggctctcc

SEQ ID NO: 904933 - DNA, 15 bp, Homo sapiens
cagcaggaaggaccc

SEQ ID NO: 904934 - DNA, 20 bp, Homo sapiens
cagcaggaaggaccccacat

SEQ ID NO: 904935 - DNA, 22 bp, Homo sapiens
cagcaggacttgctaaagcact

SEQ ID NO: 904936 - DNA, 11 bp, Homo sapiens
cagcaggagag

SEQ ID NO: 904937 - DNA, 20 bp, Homo sapiens
cagcaggagagactgagcag

SEQ ID NO: 904938 - DNA, 20 bp, Homo sapiens
cagcaggaggttctgggcct

SEQ ID NO: 904939 - DNA, 18 bp, Homo sapiens
cagcaggatcgaagggtt

SEQ ID NO: 904940 - DNA, 19 bp, Homo sapiens
cagcaggatgctaatggaa

SEQ ID NO: 904941 - DNA, 11 bp, Homo sapiens
cagcaggcaga

SEQ ID NO: 904942 - DNA, 13 bp, Homo sapiens
cagcaggcagagt

SEQ ID NO: 904943 - DNA, 12 bp, Homo sapiens
agcatacaactt

SEQ ID NO: 904944 - DNA, 14 bp, Homo sapiens
agcatacatttata

SEQ ID NO: 904945 - DNA, 14 bp, Homo sapiens
agcatacattttct

SEQ ID NO: 904946 - DNA, 18 bp, Homo sapiens
agcatacattttctggtg

SEQ ID NO: 904947 - DNA, 16 bp, Homo sapiens
agcatacgtacacatt

SEQ ID NO: 904948 - DNA, 20 bp, Homo sapiens
agcatacgtacacattttat

SEQ ID NO: 904949 - DNA, 21 bp, Homo sapiens
agcatacgtacacattttatt

SEQ ID NO: 904950 - DNA, 15 bp, Homo sapiens
agcatactgtgtatg

SEQ ID NO: 904951 - DNA, 17 bp, Homo sapiens
agcatactgtgtatgtt

SEQ ID NO: 904952 - DNA, 11 bp, Homo sapiens
agcatacttaa

SEQ ID NO: 904953 - DNA, 15 bp, Homo sapiens
agcatacttctagga

SEQ ID NO: 904954 - DNA, 13 bp, Homo sapiens
agcatactttgta

SEQ ID NO: 904955 - DNA, 22 bp, Homo sapiens
agcatactttgtaaataggatt

SEQ ID NO: 904956 - DNA, 16 bp, Homo sapiens
agcatagaagccacat

SEQ ID NO: 904957 - DNA, 13 bp, Homo sapiens
agcatagccagca

SEQ ID NO: 904958 - DNA, 22 bp, Homo sapiens
agcatagccagcattcagcaca

SEQ ID NO: 904959 - DNA, 17 bp, Homo sapiens
agcatagcctgcctgat

SEQ ID NO: 904960 - DNA, 17 bp, Homo sapiens
agcatagctacaatttg

SEQ ID NO: 904961 - DNA, 19 bp, Homo sapiens
agcatagctacaatttgtt

SEQ ID NO: 904962 - DNA, 21 bp, Homo sapiens
agcataggaggggtctggaca

SEQ ID NO: 904963 - DNA, 22 bp, Homo sapiens
agcatatcgtaaagctgttcaa

SEQ ID NO: 904964 - DNA, 16 bp, Homo sapiens
agcatatctgattgtt

SEQ ID NO: 904965 - DNA, 16 bp, Homo sapiens
agcatatctggtatat

SEQ ID NO: 904966 - DNA, 21 bp, Homo sapiens
agcatatctggtatatgtcat

SEQ ID NO: 904967 - DNA, 22 bp, Homo sapiens
agcatatctggtatatgtcatt

SEQ ID NO: 904968 - DNA, 15 bp, Homo sapiens
agcatatgcagccaa

SEQ ID NO: 904969 - DNA, 16 bp, Homo sapiens
agcatatgctatcatt

SEQ ID NO: 904970 - DNA, 13 bp, Homo sapiens
agcatatttgaga

SEQ ID NO: 904971 - DNA, 20 bp, Homo sapiens
agcatatttgtatagttgct

SEQ ID NO: 904972 - DNA, 22 bp, Homo sapiens
agcatattttcttacttttatt

SEQ ID NO: 904973 - DNA, 14 bp, Homo sapiens
agcatattttgctg

SEQ ID NO: 904974 - DNA, 16 bp, Homo sapiens
agcatattttgctggt

SEQ ID NO: 904975 - DNA, 20 bp, Homo sapiens
agcatcaagttctccccagg

SEQ ID NO: 904976 - DNA, 15 bp, Homo sapiens
agcatcacctcaggc

SEQ ID NO: 904977 - DNA, 20 bp, Homo sapiens
agcatcacctcaggccaggt

SEQ ID NO: 904978 - DNA, 19 bp, Homo sapiens
agcatcactgccttggccc

SEQ ID NO: 904979 - DNA, 21 bp, Homo sapiens
agcatcactgccttggcccct

SEQ ID NO: 904980 - DNA, 23 bp, Homo sapiens
agcatcagaaggttcacccagca

SEQ ID NO: 904981 - DNA, 18 bp, Homo sapiens
agcatcagggggaagaag

SEQ ID NO: 904982 - DNA, 13 bp, Homo sapiens
agcatcagtcccc

SEQ ID NO: 904983 - DNA, 21 bp, Homo sapiens
agcatcattatttgcagagac

SEQ ID NO: 904984 - DNA, 22 bp, Homo sapiens
agcatcattttgcattcaaatt

SEQ ID NO: 904985 - DNA, 12 bp, Homo sapiens
agcatccagcct

SEQ ID NO: 904986 - DNA, 14 bp, Homo sapiens
agcatccagcctgt

SEQ ID NO: 904987 - DNA, 23 bp, Homo sapiens
agcatccatcaatacctgtacta

SEQ ID NO: 904988 - DNA, 13 bp, Homo sapiens
agcatcccagcct

SEQ ID NO: 904989 - DNA, 12 bp, Homo sapiens
agcatcccccaa

SEQ ID NO: 904990 - DNA, 14 bp, Homo sapiens
agcatccccctcct

SEQ ID NO: 904991 - DNA, 17 bp, Homo sapiens
agcatccctcagcctgt

SEQ ID NO: 904992 - DNA, 12 bp, Homo sapiens
agcatccctgga

SEQ ID NO: 904993 - DNA, 14 bp, Homo sapiens
agcatccctggagc

SEQ ID NO: 904994 - DNA, 13 bp, Homo sapiens
agcatcccttccc

SEQ ID NO: 904995 - DNA, 16 bp, Homo sapiens
agcatccgcaggtgct

SEQ ID NO: 904996 - DNA, 23 bp, Homo sapiens
agcatccgtgtatttggctgggc

SEQ ID NO: 904997 - DNA, 13 bp, Homo sapiens
agcatcctgagcc

SEQ ID NO: 904998 - DNA, 16 bp, Homo sapiens
agcatcctgagccccg

SEQ ID NO: 904999 - DNA, 22 bp, Homo sapiens
agcatcctgcaaggtgaaacga

SEQ ID NO: 905000 - DNA, 22 bp, Homo sapiens
agcatcgggagcacccagagca

SEQ ID NO: 905001 - DNA, 18 bp, Homo sapiens
agcatcgggggcctgcaa

SEQ ID NO: 905002 - DNA, 23 bp, Homo sapiens
agcatcgtgacccttcagggcca

SEQ ID NO: 905003 - DNA, 21 bp, Homo sapiens
agcatcgtgatcactgagcca

SEQ ID NO: 905004 - DNA, 17 bp, Homo sapiens
agcatctcagcgccagc

SEQ ID NO: 905005 - DNA, 19 bp, Homo sapiens
agcatctcttcttccctgt

SEQ ID NO: 905006 - DNA, 17 bp, Homo sapiens
agcatctcttgaggcca

SEQ ID NO: 905007 - DNA, 17 bp, Homo sapiens
agcatctgcaacaaaaa

SEQ ID NO: 905008 - DNA, 13 bp, Homo sapiens
agcatctgctaat

SEQ ID NO: 905009 - DNA, 18 bp, Homo sapiens
agcatctggctctaattc

SEQ ID NO: 905010 - DNA, 13 bp, Homo sapiens
agcatctggctgt

SEQ ID NO: 905011 - DNA, 14 bp, Homo sapiens
agcatctggctgtc

SEQ ID NO: 905012 - DNA, 23 bp, Homo sapiens
agcatcttcacttctaaatgcat

SEQ ID NO: 905013 - DNA, 15 bp, Homo sapiens
agcatcttcctctgc

SEQ ID NO: 905014 - DNA, 15 bp, Homo sapiens
agcatcttgccagcc

SEQ ID NO: 905015 - DNA, 23 bp, Homo sapiens
agcatcttgggggggtggccgct

SEQ ID NO: 905016 - DNA, 19 bp, Homo sapiens
agcatgaataaaacactca

SEQ ID NO: 905017 - DNA, 23 bp, Homo sapiens
agcatgaataaaacactcatccc

SEQ ID NO: 905018 - DNA, 21 bp, Homo sapiens
agcatgaataacatttaaatt

SEQ ID NO: 905019 - DNA, 20 bp, Homo sapiens
agcatgaatttttttcatct

SEQ ID NO: 905020 - DNA, 21 bp, Homo sapiens
agcatgacaaaaataacactg

SEQ ID NO: 905021 - DNA, 23 bp, Homo sapiens
agcatgacaaaaataacactgtt

SEQ ID NO: 905022 - DNA, 17 bp, Homo sapiens
agcatgacaacttttaa

SEQ ID NO: 905023 - DNA, 17 bp, Homo sapiens
agcatgacaagccccag

SEQ ID NO: 905024 - DNA, 21 bp, Homo sapiens
agcatgacaagccccaggcag

SEQ ID NO: 905025 - DNA, 22 bp, Homo sapiens
agcatgacctgtgaccagcact

SEQ ID NO: 905026 - DNA, 23 bp, Homo sapiens
agcatgacctgtgaccagcactg

SEQ ID NO: 905027 - DNA, 13 bp, Homo sapiens
agcatgagacttt

SEQ ID NO: 905028 - DNA, 16 bp, Homo sapiens
agcatgagactttctg

SEQ ID NO: 905029 - DNA, 20 bp, Homo sapiens
agcatgagagggatgaggca

SEQ ID NO: 905030 - DNA, 17 bp, Homo sapiens
agcatgatattgttctc

SEQ ID NO: 905031 - DNA, 18 bp, Homo sapiens
agcatgatattgttctcc

SEQ ID NO: 905032 - DNA, 20 bp, Homo sapiens
agcatgatgggaaaatattt

SEQ ID NO: 905033 - DNA, 20 bp, Homo sapiens
agcatgattctttaatagaa

SEQ ID NO: 905034 - DNA, 14 bp, Homo sapiens
agcatgatttgaaa

SEQ ID NO: 905035 - DNA, 23 bp, Homo sapiens
agcatgatttgaaaaaaagcatg

SEQ ID NO: 905036 - DNA, 13 bp, Homo sapiens
agcatgcacatgc

SEQ ID NO: 905037 - DNA, 13 bp, Homo sapiens
agcatgcccagat

SEQ ID NO: 905038 - DNA, 21 bp, Homo sapiens
agcatgcccagattcccagac

SEQ ID NO: 905039 - DNA, 14 bp, Homo sapiens
agcatgctgctttg

SEQ ID NO: 905040 - DNA, 22 bp, Homo sapiens
agcatgcttaccttctgctgtt

SEQ ID NO: 905041 - DNA, 14 bp, Homo sapiens
agcatgcttccttt

SEQ ID NO: 905042 - DNA, 18 bp, Homo sapiens
agcatgcttcctttctct

SEQ ID NO: 905043 - DNA, 17 bp, Homo sapiens
agcatgcttgggctgac

SEQ ID NO: 905044 - DNA, 13 bp, Homo sapiens
agcatggaaaaat

SEQ ID NO: 905045 - DNA, 15 bp, Homo sapiens
agcatggaaaaatgg

SEQ ID NO: 905046 - DNA, 22 bp, Homo sapiens
agcatggaaaaatggttgatgg

SEQ ID NO: 905047 - DNA, 14 bp, Homo sapiens
agcatggacattta

SEQ ID NO: 905048 - DNA, 20 bp, Homo sapiens
agcatggagagcctcttagt

SEQ ID NO: 905049 - DNA, 21 bp, Homo sapiens
agcatggaggaggagggaggc

SEQ ID NO: 905050 - DNA, 15 bp, Homo sapiens
agcatggctgtctgc

SEQ ID NO: 905051 - DNA, 16 bp, Homo sapiens
agcatggctgtctgca

SEQ ID NO: 905052 - DNA, 21 bp, Homo sapiens
agcatggctgtctgcacagag

SEQ ID NO: 905053 - DNA, 18 bp, Homo sapiens
agcatggggtcagcccca

SEQ ID NO: 905054 - DNA, 19 bp, Homo sapiens
agcatggggtcagccccaa

SEQ ID NO: 905055 - DNA, 15 bp, Homo sapiens
agcatgtaggagaat

SEQ ID NO: 905056 - DNA, 21 bp, Homo sapiens
agcatgtatgtctgcaggtgt

SEQ ID NO: 905057 - DNA, 19 bp, Homo sapiens
agcatgtctattcagcttc

SEQ ID NO: 905058 - DNA, 16 bp, Homo sapiens
agcatgtctctctgcc

SEQ ID NO: 905059 - DNA, 18 bp, Homo sapiens
agcatgtctctctgccaa

SEQ ID NO: 905060 - DNA, 14 bp, Homo sapiens
agcatgtctctgct

SEQ ID NO: 905061 - DNA, 14 bp, Homo sapiens
agcatgtgccaaga

SEQ ID NO: 905062 - DNA, 15 bp, Homo sapiens
agcatgtgccctcct

SEQ ID NO: 905063 - DNA, 17 bp, Homo sapiens
agcatgtgccctcctga

SEQ ID NO: 905064 - DNA, 17 bp, Homo sapiens
agcatgtggcatgttca

SEQ ID NO: 905065 - DNA, 18 bp, Homo sapiens
agcatgtggcatgttcat

SEQ ID NO: 905066 - DNA, 13 bp, Homo sapiens
agcatgtgtcaga

SEQ ID NO: 905067 - DNA, 15 bp, Homo sapiens
cagcaggcagcgcca

SEQ ID NO: 905068 - DNA, 16 bp, Homo sapiens
cagcaggcagcgccaa

SEQ ID NO: 905069 - DNA, 21 bp, Homo sapiens
cagcaggcaggcactgtggcc

SEQ ID NO: 905070 - DNA, 16 bp, Homo sapiens
cagcaggcaggctggg

SEQ ID NO: 905071 - DNA, 13 bp, Homo sapiens
cagcaggcccagc

SEQ ID NO: 905072 - DNA, 14 bp, Homo sapiens
cagcaggcccagca

SEQ ID NO: 905073 - DNA, 13 bp, Homo sapiens
cagcaggctcagg

SEQ ID NO: 905074 - DNA, 14 bp, Homo sapiens
cagcaggctcaggc

SEQ ID NO: 905075 - DNA, 15 bp, Homo sapiens
cagcaggctcaggca

SEQ ID NO: 905076 - DNA, 17 bp, Homo sapiens
cagcaggctcaggcaca

SEQ ID NO: 905077 - DNA, 14 bp, Homo sapiens
cagcaggctggcct

SEQ ID NO: 905078 - DNA, 24 bp, Homo sapiens
cagcagggaaaatgcagcagggat

SEQ ID NO: 905079 - DNA, 19 bp, Homo sapiens
cagcagggacaagatacat

SEQ ID NO: 905080 - DNA, 22 bp, Homo sapiens
cagcagggactgtaaacacaga

SEQ ID NO: 905081 - DNA, 18 bp, Homo sapiens
cagcagggagggcttctg

SEQ ID NO: 905082 - DNA, 17 bp, Homo sapiens
cagcagggcctcaaagt

SEQ ID NO: 905083 - DNA, 18 bp, Homo sapiens
cagcagggctgggcctgc

SEQ ID NO: 905084 - DNA, 14 bp, Homo sapiens
cagcaggggctgct

SEQ ID NO: 905085 - DNA, 17 bp, Homo sapiens
cagcaggggggctgtgc

SEQ ID NO: 905086 - DNA, 22 bp, Homo sapiens
cagcagggtcttttcatctggg

SEQ ID NO: 905087 - DNA, 22 bp, Homo sapiens
cagcaggtcctccatcccaaca

SEQ ID NO: 905088 - DNA, 21 bp, Homo sapiens
cagcaggtgccatcacgcttg

SEQ ID NO: 905089 - DNA, 17 bp, Homo sapiens
cagcaggtgtggtggct

SEQ ID NO: 905090 - DNA, 23 bp, Homo sapiens
cagcaggtgtggtggctcatggc

SEQ ID NO: 905091 - DNA, 16 bp, Homo sapiens
cagcagtaatcctggg

SEQ ID NO: 905092 - DNA, 19 bp, Homo sapiens
cagcagtacctataaagta

SEQ ID NO: 905093 - DNA, 13 bp, Homo sapiens
cagcagtagcttt

SEQ ID NO: 905094 - DNA, 19 bp, Homo sapiens
cagcagtcggttggagcga

SEQ ID NO: 905095 - DNA, 14 bp, Homo sapiens
cagcagtgagactg

SEQ ID NO: 905096 - DNA, 20 bp, Homo sapiens
cagcagtgatctcagggcag

SEQ ID NO: 905097 - DNA, 16 bp, Homo sapiens
cagcagtgcagccggg

SEQ ID NO: 905098 - DNA, 17 bp, Homo sapiens
cagcagtgtgaggccag

SEQ ID NO: 905099 - DNA, 20 bp, Homo sapiens
cagcagtgtgaggccagggc

SEQ ID NO: 905100 - DNA, 21 bp, Homo sapiens
cagcagtgttccccatctggg

SEQ ID NO: 905101 - DNA, 23 bp, Homo sapiens
cagcagtgttccccatctgggtc

SEQ ID NO: 905102 - DNA, 13 bp, Homo sapiens
cagcagtttgtga

SEQ ID NO: 905103 - DNA, 14 bp, Homo sapiens
cagcatacttcaaa

SEQ ID NO: 905104 - DNA, 21 bp, Homo sapiens
cagcatacttcaaaactgttt

SEQ ID NO: 905105 - DNA, 17 bp, Homo sapiens
cagcatagcctgcctga

SEQ ID NO: 905106 - DNA, 17 bp, Homo sapiens
cagcataggggggaggg

SEQ ID NO: 905107 - DNA, 18 bp, Homo sapiens
cagcataggggggagggt

SEQ ID NO: 905108 - DNA, 20 bp, Homo sapiens
cagcatatgggggcctggat

SEQ ID NO: 905109 - DNA, 14 bp, Homo sapiens
cagcatatttatag

SEQ ID NO: 905110 - DNA, 18 bp, Homo sapiens
cagcatatttatagcaat

SEQ ID NO: 905111 - DNA, 22 bp, Homo sapiens
cagcatcactggtatgatgtat

SEQ ID NO: 905112 - DNA, 16 bp, Homo sapiens
cagcatccagcctgtg

SEQ ID NO: 905113 - DNA, 17 bp, Homo sapiens
cagcatccagcctgtgt

SEQ ID NO: 905114 - DNA, 18 bp, Homo sapiens
cagcatccagcctgtgtg

SEQ ID NO: 905115 - DNA, 13 bp, Homo sapiens
cagcatcccagcc

SEQ ID NO: 905116 - DNA, 17 bp, Homo sapiens
cagcatcccagccttga

SEQ ID NO: 905117 - DNA, 12 bp, Homo sapiens
cagcatccctgg

SEQ ID NO: 905118 - DNA, 14 bp, Homo sapiens
cagcatccctggag

SEQ ID NO: 905119 - DNA, 20 bp, Homo sapiens
cagcatccctggagcaggag

SEQ ID NO: 905120 - DNA, 22 bp, Homo sapiens
cagcatccctggagcaggagcc

SEQ ID NO: 905121 - DNA, 12 bp, Homo sapiens
cagcatccgcag

SEQ ID NO: 905122 - DNA, 17 bp, Homo sapiens
cagcatccgcaggtgct

SEQ ID NO: 905123 - DNA, 22 bp, Homo sapiens
cagcatcgggagcacccagagc

SEQ ID NO: 905124 - DNA, 14 bp, Homo sapiens
cagcatcgggggcc

SEQ ID NO: 905125 - DNA, 21 bp, Homo sapiens
cagcatcgtgatcactgagcc

SEQ ID NO: 905126 - DNA, 16 bp, Homo sapiens
cagcatctcagcgcca

SEQ ID NO: 905127 - DNA, 22 bp, Homo sapiens
cagcatctggctgtctagaatg

SEQ ID NO: 905128 - DNA, 13 bp, Homo sapiens
cagcatctggtct

SEQ ID NO: 905129 - DNA, 14 bp, Homo sapiens
cagcatctttcacc

SEQ ID NO: 905130 - DNA, 18 bp, Homo sapiens
cagcatgaataaaacact

SEQ ID NO: 905131 - DNA, 19 bp, Homo sapiens
cagcatgacaaaaataaca

SEQ ID NO: 905132 - DNA, 21 bp, Homo sapiens
cagcatgacaaaaataacact

SEQ ID NO: 905133 - DNA, 20 bp, Homo sapiens
cagcatgagactttctgctg

SEQ ID NO: 905134 - DNA, 17 bp, Homo sapiens
cagcatgcccagattcc

SEQ ID NO: 905135 - DNA, 15 bp, Homo sapiens
cagcatgccccttgg

SEQ ID NO: 905136 - DNA, 15 bp, Homo sapiens
cagcatgcttgggct

SEQ ID NO: 905137 - DNA, 17 bp, Homo sapiens
cagcatgcttgggctga

SEQ ID NO: 905138 - DNA, 15 bp, Homo sapiens
cagcatggaaaaatg

SEQ ID NO: 905139 - DNA, 16 bp, Homo sapiens
cagcatggaaaaatgg

SEQ ID NO: 905140 - DNA, 19 bp, Homo sapiens
cagcatggcatagccccgg

SEQ ID NO: 905141 - DNA, 15 bp, Homo sapiens
cagcatggcatccaa

SEQ ID NO: 905142 - DNA, 16 bp, Homo sapiens
cagcatggggttttta

SEQ ID NO: 905143 - DNA, 22 bp, Homo sapiens
cagcatgggtccttgatgccag

SEQ ID NO: 905144 - DNA, 20 bp, Homo sapiens
cagcatggtccctgccttag

SEQ ID NO: 905145 - DNA, 20 bp, Homo sapiens
cagcatgtacggattttcag

SEQ ID NO: 905146 - DNA, 21 bp, Homo sapiens
cagcatgtacggattttcagt

SEQ ID NO: 905147 - DNA, 12 bp, Homo sapiens
cagcatgtgcca

SEQ ID NO: 905148 - DNA, 16 bp, Homo sapiens
cagcatgtgccctcct

SEQ ID NO: 905149 - DNA, 23 bp, Homo sapiens
cagcattagagaaatgaattata

SEQ ID NO: 905150 - DNA, 17 bp, Homo sapiens
cagcattattcctccag

SEQ ID NO: 905151 - DNA, 18 bp, Homo sapiens
cagcattattcctccagg

SEQ ID NO: 905152 - DNA, 16 bp, Homo sapiens
cagcattcagcacaca

SEQ ID NO: 905153 - DNA, 17 bp, Homo sapiens
cagcattcagcacacac

SEQ ID NO: 905154 - DNA, 16 bp, Homo sapiens
cagcattccagcccct

SEQ ID NO: 905155 - DNA, 20 bp, Homo sapiens
cagcattccagcccctctgg

SEQ ID NO: 905156 - DNA, 16 bp, Homo sapiens
cagcattccagctctg

SEQ ID NO: 905157 - DNA, 17 bp, Homo sapiens
cagcattccagctctgc

SEQ ID NO: 905158 - DNA, 19 bp, Homo sapiens
cagcattccagctctgccc

SEQ ID NO: 905159 - DNA, 21 bp, Homo sapiens
cagcattcttgtcacaataaa

SEQ ID NO: 905160 - DNA, 17 bp, Homo sapiens
cagcattgctggttcta

SEQ ID NO: 905161 - DNA, 12 bp, Homo sapiens
cagcattgcttt

SEQ ID NO: 905162 - DNA, 14 bp, Homo sapiens
cagcattgctttct

SEQ ID NO: 905163 - DNA, 16 bp, Homo sapiens
cagcattgctttctga

SEQ ID NO: 905164 - DNA, 12 bp, Homo sapiens
cagcattgtctt

SEQ ID NO: 905165 - DNA, 13 bp, Homo sapiens
cagcattgtcttt

SEQ ID NO: 905166 - DNA, 19 bp, Homo sapiens
cagcattgtctttgctgta

SEQ ID NO: 905167 - DNA, 22 bp, Homo sapiens
cagcattgtctttgctgtactc

SEQ ID NO: 905168 - DNA, 19 bp, Homo sapiens
cagcattgtgacttggaga

SEQ ID NO: 905169 - DNA, 19 bp, Homo sapiens
cagcattgtttcaaaatag

SEQ ID NO: 905170 - DNA, 23 bp, Homo sapiens
cagcatttccacaccaagcagca

SEQ ID NO: 905171 - DNA, 14 bp, Homo sapiens
cagcatttgatctg

SEQ ID NO: 905172 - DNA, 18 bp, Homo sapiens
cagcattttagaaactac

SEQ ID NO: 905173 - DNA, 18 bp, Homo sapiens
cagccaaagaaatgggcc

SEQ ID NO: 905174 - DNA, 20 bp, Homo sapiens
cagccaaagaaatgggcctg

SEQ ID NO: 905175 - DNA, 21 bp, Homo sapiens
cagccaaagaaatgggcctgc

SEQ ID NO: 905176 - DNA, 24 bp, Homo sapiens
cagccaaagaaatgggcctgcctg

SEQ ID NO: 905177 - DNA, 20 bp, Homo sapiens
cagccaaagataatctctca

SEQ ID NO: 905178 - DNA, 11 bp, Homo sapiens
cagccaaagtc

SEQ ID NO: 905179 - DNA, 16 bp, Homo sapiens
cagccaacccctgtgg

SEQ ID NO: 905180 - DNA, 16 bp, Homo sapiens
cagccaacgagacaca

SEQ ID NO: 905181 - DNA, 17 bp, Homo sapiens
cagccaacgagacacat

SEQ ID NO: 905182 - DNA, 20 bp, Homo sapiens
cagccaacgagacacattgc

SEQ ID NO: 905183 - DNA, 18 bp, Homo sapiens
cagccaactagcccctgg

SEQ ID NO: 905184 - DNA, 15 bp, Homo sapiens
cagccaagcacctcc

SEQ ID NO: 905185 - DNA, 20 bp, Homo sapiens
cagccaaggaatgtgtccaa

SEQ ID NO: 905186 - DNA, 22 bp, Homo sapiens
cagccaaggccgaagctctggc

SEQ ID NO: 905187 - DNA, 23 bp, Homo sapiens
cagccaaggccgaagctctggct

SEQ ID NO: 905188 - DNA, 17 bp, Homo sapiens
cagccaagggtcctcac

SEQ ID NO: 905189 - DNA, 14 bp, Homo sapiens
cagccaagttttat

SEQ ID NO: 905190 - DNA, 15 bp, Homo sapiens
cagccaatttcccgg

SEQ ID NO: 905191 - DNA, 22 bp, Homo sapiens
agcatgtgttaatcttaatgta

SEQ ID NO: 905192 - DNA, 22 bp, Homo sapiens
agcatgtgtttggttctggggc

SEQ ID NO: 905193 - DNA, 14 bp, Homo sapiens
agcatgttcctcct

SEQ ID NO: 905194 - DNA, 21 bp, Homo sapiens
agcatgttgagccaggcctgg

SEQ ID NO: 905195 - DNA, 17 bp, Homo sapiens
agcatgttgctgaggag

SEQ ID NO: 905196 - DNA, 19 bp, Homo sapiens
agcatgttgggttgttaca

SEQ ID NO: 905197 - DNA, 19 bp, Homo sapiens
agcatgttgttttttcata

SEQ ID NO: 905198 - DNA, 21 bp, Homo sapiens
agcatgttgttttttcatagt

SEQ ID NO: 905199 - DNA, 22 bp, Homo sapiens
agcatgttgttttttcatagtg

SEQ ID NO: 905200 - DNA, 21 bp, Homo sapiens
agcatgtttcatgttttgtga

SEQ ID NO: 905201 - DNA, 19 bp, Homo sapiens
agcattaactaaatgctca

SEQ ID NO: 905202 - DNA, 21 bp, Homo sapiens
agcattaactaaatgctcata

SEQ ID NO: 905203 - DNA, 15 bp, Homo sapiens
agcattaagcccaat

SEQ ID NO: 905204 - DNA, 17 bp, Homo sapiens
agcattaaggtatttcg

SEQ ID NO: 905205 - DNA, 14 bp, Homo sapiens
agcattacattatt

SEQ ID NO: 905206 - DNA, 17 bp, Homo sapiens
agcattacgtgagccag

SEQ ID NO: 905207 - DNA, 18 bp, Homo sapiens
agcattacgtgagccagg

SEQ ID NO: 905208 - DNA, 19 bp, Homo sapiens
agcattacgtgagccaggt

SEQ ID NO: 905209 - DNA, 15 bp, Homo sapiens
agcattattcttcag

SEQ ID NO: 905210 - DNA, 14 bp, Homo sapiens
agcattcagaagaa

SEQ ID NO: 905211 - DNA, 15 bp, Homo sapiens
agcattcagaagaaa

SEQ ID NO: 905212 - DNA, 15 bp, Homo sapiens
agcattcagcacaca

SEQ ID NO: 905213 - DNA, 16 bp, Homo sapiens
agcattcagcacacac

SEQ ID NO: 905214 - DNA, 15 bp, Homo sapiens
agcattcaggcagca

SEQ ID NO: 905215 - DNA, 20 bp, Homo sapiens
agcattcattacctgtttat

SEQ ID NO: 905216 - DNA, 19 bp, Homo sapiens
agcattccagctctgcccc

SEQ ID NO: 905217 - DNA, 20 bp, Homo sapiens
agcattccagctctgccccc

SEQ ID NO: 905218 - DNA, 16 bp, Homo sapiens
agcattcccaccaaca

SEQ ID NO: 905219 - DNA, 19 bp, Homo sapiens
agcattcccaccaacaaaa

SEQ ID NO: 905220 - DNA, 20 bp, Homo sapiens
agcattctcactcctacctg

SEQ ID NO: 905221 - DNA, 14 bp, Homo sapiens
agcattctggaggg

SEQ ID NO: 905222 - DNA, 19 bp, Homo sapiens
agcattcttgtcacaataa

SEQ ID NO: 905223 - DNA, 12 bp, Homo sapiens
agcattgcactt

SEQ ID NO: 905224 - DNA, 15 bp, Homo sapiens
agcattggcccctga

SEQ ID NO: 905225 - DNA, 16 bp, Homo sapiens
agcattggcccctgag

SEQ ID NO: 905226 - DNA, 21 bp, Homo sapiens
agcattgtctttgctgtactc

SEQ ID NO: 905227 - DNA, 23 bp, Homo sapiens
agcattgtctttgctgtactctt

SEQ ID NO: 905228 - DNA, 19 bp, Homo sapiens
agcattgtttcaaaatagt

SEQ ID NO: 905229 - DNA, 17 bp, Homo sapiens
agcattgtttgcttatt

SEQ ID NO: 905230 - DNA, 23 bp, Homo sapiens
agcattgttttcttttacagact

SEQ ID NO: 905231 - DNA, 23 bp, Homo sapiens
agcatttagcttgttccactgca

SEQ ID NO: 905232 - DNA, 14 bp, Homo sapiens
agcatttaggaatg

SEQ ID NO: 905233 - DNA, 15 bp, Homo sapiens
agcatttatttctct

SEQ ID NO: 905234 - DNA, 16 bp, Homo sapiens
agcatttatttctctg

SEQ ID NO: 905235 - DNA, 17 bp, Homo sapiens
agcatttcaaagccctg

SEQ ID NO: 905236 - DNA, 11 bp, Homo sapiens
agcatttcatg

SEQ ID NO: 905237 - DNA, 21 bp, Homo sapiens
agcatttccaacaccacagac

SEQ ID NO: 905238 - DNA, 20 bp, Homo sapiens
agcatttcgcgatggacaga

SEQ ID NO: 905239 - DNA, 21 bp, Homo sapiens
agcatttgacccttgctgtga

SEQ ID NO: 905240 - DNA, 15 bp, Homo sapiens
agcatttgatctgtt

SEQ ID NO: 905241 - DNA, 22 bp, Homo sapiens
agcatttgatctgttgcaagcc

SEQ ID NO: 905242 - DNA, 19 bp, Homo sapiens
agcatttgattaacatttg

SEQ ID NO: 905243 - DNA, 19 bp, Homo sapiens
agcatttggtgcctatttg

SEQ ID NO: 905244 - DNA, 20 bp, Homo sapiens
agcatttgtccttttgtgaa

SEQ ID NO: 905245 - DNA, 22 bp, Homo sapiens
agcatttgtccttttgtgaaat

SEQ ID NO: 905246 - DNA, 19 bp, Homo sapiens
agcatttgtttctactttg

SEQ ID NO: 905247 - DNA, 20 bp, Homo sapiens
agcatttgtttgaccccagt

SEQ ID NO: 905248 - DNA, 13 bp, Homo sapiens
agcattttaaaca

SEQ ID NO: 905249 - DNA, 15 bp, Homo sapiens
agcattttaaacaaa

SEQ ID NO: 905250 - DNA, 17 bp, Homo sapiens
agcattttaaacaaaat

SEQ ID NO: 905251 - DNA, 12 bp, Homo sapiens
agcattttcctg

SEQ ID NO: 905252 - DNA, 13 bp, Homo sapiens
agcattttcctgt

SEQ ID NO: 905253 - DNA, 19 bp, Homo sapiens
agcattttcctgtttactg

SEQ ID NO: 905254 - DNA, 18 bp, Homo sapiens
agcatttttatgcagaca

SEQ ID NO: 905255 - DNA, 19 bp, Homo sapiens
agcatttttatgcagacag

SEQ ID NO: 905256 - DNA, 20 bp, Homo sapiens
agcatttttattcatgccat

SEQ ID NO: 905257 - DNA, 20 bp, Homo sapiens
agcatttttcaatatattga

SEQ ID NO: 905258 - DNA, 23 bp, Homo sapiens
agcatttttcaatatattgaact

SEQ ID NO: 905259 - DNA, 18 bp, Homo sapiens
agcatttttccatctgtg

SEQ ID NO: 905260 - DNA, 13 bp, Homo sapiens
agcatttttctaa

SEQ ID NO: 905261 - DNA, 18 bp, Homo sapiens
agcatttttgatttatgc

SEQ ID NO: 905262 - DNA, 17 bp, Homo sapiens
agccaaaaaggcaaata

SEQ ID NO: 905263 - DNA, 14 bp, Homo sapiens
agccaaaaatagct

SEQ ID NO: 905264 - DNA, 16 bp, Homo sapiens
agccaaaacagatcca

SEQ ID NO: 905265 - DNA, 19 bp, Homo sapiens
agccaaaagtccctccctg

SEQ ID NO: 905266 - DNA, 20 bp, Homo sapiens
agccaaaagtccctccctgc

SEQ ID NO: 905267 - DNA, 17 bp, Homo sapiens
agccaaaatgactttga

SEQ ID NO: 905268 - DNA, 18 bp, Homo sapiens
agccaaacatcctacaag

SEQ ID NO: 905269 - DNA, 16 bp, Homo sapiens
agccaaaccctgtctg

SEQ ID NO: 905270 - DNA, 15 bp, Homo sapiens
agccaaactctgcca

SEQ ID NO: 905271 - DNA, 14 bp, Homo sapiens
agccaaactgtctt

SEQ ID NO: 905272 - DNA, 12 bp, Homo sapiens
agccaaagaaaa

SEQ ID NO: 905273 - DNA, 13 bp, Homo sapiens
agccaaagaaaaa

SEQ ID NO: 905274 - DNA, 22 bp, Homo sapiens
agccaaagaaacaagctgtgca

SEQ ID NO: 905275 - DNA, 15 bp, Homo sapiens
agccaaagaaatggg

SEQ ID NO: 905276 - DNA, 21 bp, Homo sapiens
agccaaagaaatgggcctgcc

SEQ ID NO: 905277 - DNA, 22 bp, Homo sapiens
agccaaagaaatgggcctgcct

SEQ ID NO: 905278 - DNA, 11 bp, Homo sapiens
agccaaagagt

SEQ ID NO: 905279 - DNA, 14 bp, Homo sapiens
agccaaaggggagc

SEQ ID NO: 905280 - DNA, 20 bp, Homo sapiens
agccaaatttcctgtttgaa

SEQ ID NO: 905281 - DNA, 20 bp, Homo sapiens
agccaacaactctgccttta

SEQ ID NO: 905282 - DNA, 16 bp, Homo sapiens
agccaacaagaccgcc

SEQ ID NO: 905283 - DNA, 23 bp, Homo sapiens
agccaacaccctgtctaaaaaac

SEQ ID NO: 905284 - DNA, 18 bp, Homo sapiens
agccaacagaagcttcca

SEQ ID NO: 905285 - DNA, 15 bp, Homo sapiens
agccaacaggtggca

SEQ ID NO: 905286 - DNA, 23 bp, Homo sapiens
agccaacaggtggcaggaccagg

SEQ ID NO: 905287 - DNA, 14 bp, Homo sapiens
agccaacccctgtg

SEQ ID NO: 905288 - DNA, 20 bp, Homo sapiens
agccaacctcggcttgtggg

SEQ ID NO: 905289 - DNA, 22 bp, Homo sapiens
agccaacgagacacattgcctt

SEQ ID NO: 905290 - DNA, 20 bp, Homo sapiens
agccaacgagattgctggaa

SEQ ID NO: 905291 - DNA, 17 bp, Homo sapiens
agccaactagcccctgg

SEQ ID NO: 905292 - DNA, 20 bp, Homo sapiens
agccaactatgattattaac

SEQ ID NO: 905293 - DNA, 17 bp, Homo sapiens
agccaactgattttgta

SEQ ID NO: 905294 - DNA, 18 bp, Homo sapiens
agccaacttgtaaataca

SEQ ID NO: 905295 - DNA, 20 bp, Homo sapiens
agccaacttgtaaatacacc

SEQ ID NO: 905296 - DNA, 19 bp, Homo sapiens
agccaagatcgcgccactg

SEQ ID NO: 905297 - DNA, 12 bp, Homo sapiens
agccaagctgca

SEQ ID NO: 905298 - DNA, 17 bp, Homo sapiens
agccaaggaatgtgtcc

SEQ ID NO: 905299 - DNA, 12 bp, Homo sapiens
agccaaggaggc

SEQ ID NO: 905300 - DNA, 15 bp, Homo sapiens
agccaaggaggcctg

SEQ ID NO: 905301 - DNA, 19 bp, Homo sapiens
agccaaggagtcactgaga

SEQ ID NO: 905302 - DNA, 13 bp, Homo sapiens
agccaaggccacc

SEQ ID NO: 905303 - DNA, 14 bp, Homo sapiens
agccaagggaaagg

SEQ ID NO: 905304 - DNA, 20 bp, Homo sapiens
agccaagggaaaggggtgct

SEQ ID NO: 905305 - DNA, 17 bp, Homo sapiens
agccaagggaacctgtg

SEQ ID NO: 905306 - DNA, 22 bp, Homo sapiens
agccaagggagggaagggccac

SEQ ID NO: 905307 - DNA, 23 bp, Homo sapiens
agccaagggagggaagggccacc

SEQ ID NO: 905308 - DNA, 23 bp, Homo sapiens
agccaagggcaacagatcagtaa

SEQ ID NO: 905309 - DNA, 14 bp, Homo sapiens
agccaaggggctgc

SEQ ID NO: 905310 - DNA, 22 bp, Homo sapiens
agccaagggttcagagactcag

SEQ ID NO: 905311 - DNA, 17 bp, Homo sapiens
agccaagtagcctctcc

SEQ ID NO: 905312 - DNA, 13 bp, Homo sapiens
agccaagtccaga

SEQ ID NO: 905313 - DNA, 19 bp, Homo sapiens
agccaagtgtcttttaaac

SEQ ID NO: 905314 - DNA, 22 bp, Homo sapiens
agccaagttttataatccttaa

SEQ ID NO: 905315 - DNA, 16 bp, Homo sapiens
cagccaatttcccgga

SEQ ID NO: 905316 - DNA, 17 bp, Homo sapiens
cagccaatttcccggag

SEQ ID NO: 905317 - DNA, 23 bp, Homo sapiens
cagccacacgcaggcggccaggg

SEQ ID NO: 905318 - DNA, 14 bp, Homo sapiens
cagccacactgggc

SEQ ID NO: 905319 - DNA, 23 bp, Homo sapiens
cagccacagagcaaaagagggtt

SEQ ID NO: 905320 - DNA, 17 bp, Homo sapiens
cagccaccaccctcagg

SEQ ID NO: 905321 - DNA, 19 bp, Homo sapiens
cagccaccaccctcaggtg

SEQ ID NO: 905322 - DNA, 21 bp, Homo sapiens
cagccaccaccctcaggtgcc

SEQ ID NO: 905323 - DNA, 13 bp, Homo sapiens
cagccaccagtgg

SEQ ID NO: 905324 - DNA, 17 bp, Homo sapiens
cagccaccagtggacct

SEQ ID NO: 905325 - DNA, 15 bp, Homo sapiens
cagccacccaagcct

SEQ ID NO: 905326 - DNA, 19 bp, Homo sapiens
cagccacccaagcctgctg

SEQ ID NO: 905327 - DNA, 20 bp, Homo sapiens
cagccacccaagcctgctgg

SEQ ID NO: 905328 - DNA, 15 bp, Homo sapiens
cagccacccctgcca

SEQ ID NO: 905329 - DNA, 16 bp, Homo sapiens
cagccacccctgccac

SEQ ID NO: 905330 - DNA, 16 bp, Homo sapiens
cagccaccctgagttg

SEQ ID NO: 905331 - DNA, 17 bp, Homo sapiens
cagccaccgtttcttcc

SEQ ID NO: 905332 - DNA, 12 bp, Homo sapiens
cagccacctccc

SEQ ID NO: 905333 - DNA, 13 bp, Homo sapiens
cagccacctggga

SEQ ID NO: 905334 - DNA, 19 bp, Homo sapiens
cagccacgaacagcccgcc

SEQ ID NO: 905335 - DNA, 16 bp, Homo sapiens
cagccacggagggagg

SEQ ID NO: 905336 - DNA, 17 bp, Homo sapiens
cagccacggagggaggc

SEQ ID NO: 905337 - DNA, 21 bp, Homo sapiens
cagccacggagggaggcacca

SEQ ID NO: 905338 - DNA, 21 bp, Homo sapiens
cagccactccaagccccctgg

SEQ ID NO: 905339 - DNA, 14 bp, Homo sapiens
cagccactgcacag

SEQ ID NO: 905340 - DNA, 22 bp, Homo sapiens
cagccactgccaagcttcctgt

SEQ ID NO: 905341 - DNA, 12 bp, Homo sapiens
cagccactggct

SEQ ID NO: 905342 - DNA, 22 bp, Homo sapiens
cagccacttggtttttggctct

SEQ ID NO: 905343 - DNA, 22 bp, Homo sapiens
cagccagaaagcactacaatca

SEQ ID NO: 905344 - DNA, 22 bp, Homo sapiens
cagccagaccccacgctgacca

SEQ ID NO: 905345 - DNA, 13 bp, Homo sapiens
cagccagagctgg

SEQ ID NO: 905346 - DNA, 17 bp, Homo sapiens
cagccagagctgggtgg

SEQ ID NO: 905347 - DNA, 15 bp, Homo sapiens
cagccagagctgtgc

SEQ ID NO: 905348 - DNA, 17 bp, Homo sapiens
cagccagagctgtgcct

SEQ ID NO: 905349 - DNA, 20 bp, Homo sapiens
cagccagagctgtgcctgct

SEQ ID NO: 905350 - DNA, 23 bp, Homo sapiens
cagccagagctgtgcctgctcag

SEQ ID NO: 905351 - DNA, 17 bp, Homo sapiens
cagccagaggagggcag

SEQ ID NO: 905352 - DNA, 18 bp, Homo sapiens
cagccagaggagggcaga

SEQ ID NO: 905353 - DNA, 19 bp, Homo sapiens
cagccagagttcctgcgga

SEQ ID NO: 905354 - DNA, 20 bp, Homo sapiens
cagccagagttcctgcggag

SEQ ID NO: 905355 - DNA, 21 bp, Homo sapiens
cagccagagttcctgcggagt

SEQ ID NO: 905356 - DNA, 15 bp, Homo sapiens
cagccagcaccacct

SEQ ID NO: 905357 - DNA, 13 bp, Homo sapiens
cagccagcacctg

SEQ ID NO: 905358 - DNA, 16 bp, Homo sapiens
cagccagcacctggca

SEQ ID NO: 905359 - DNA, 14 bp, Homo sapiens
cagccagcagaggg

SEQ ID NO: 905360 - DNA, 12 bp, Homo sapiens
cagccagcagcc

SEQ ID NO: 905361 - DNA, 14 bp, Homo sapiens
cagccagcagccag

SEQ ID NO: 905362 - DNA, 21 bp, Homo sapiens
cagccagcagccagctctcag

SEQ ID NO: 905363 - DNA, 19 bp, Homo sapiens
cagccagccacccctgcca

SEQ ID NO: 905364 - DNA, 21 bp, Homo sapiens
cagccagccacccctgccact

SEQ ID NO: 905365 - DNA, 19 bp, Homo sapiens
cagccagcccagcccagct

SEQ ID NO: 905366 - DNA, 20 bp, Homo sapiens
cagccagcccatggccccca

SEQ ID NO: 905367 - DNA, 14 bp, Homo sapiens
cagccagcccttcc

SEQ ID NO: 905368 - DNA, 15 bp, Homo sapiens
cagccagcccttccc

SEQ ID NO: 905369 - DNA, 14 bp, Homo sapiens
cagccagccgccct

SEQ ID NO: 905370 - DNA, 13 bp, Homo sapiens
cagccagcctcag

SEQ ID NO: 905371 - DNA, 14 bp, Homo sapiens
cagccagcctcaga

SEQ ID NO: 905372 - DNA, 19 bp, Homo sapiens
cagccagcctcagaaggcc

SEQ ID NO: 905373 - DNA, 18 bp, Homo sapiens
cagccagcgcctccctcc

SEQ ID NO: 905374 - DNA, 21 bp, Homo sapiens
cagccagcgcctccctccacc

SEQ ID NO: 905375 - DNA, 23 bp, Homo sapiens
cagccagcgcctccctccacccc

SEQ ID NO: 905376 - DNA, 15 bp, Homo sapiens
cagccagctgcaggg

SEQ ID NO: 905377 - DNA, 17 bp, Homo sapiens
cagccagctgcagggca

SEQ ID NO: 905378 - DNA, 23 bp, Homo sapiens
cagccagctgcagggcacgggga

SEQ ID NO: 905379 - DNA, 19 bp, Homo sapiens
cagccaggacccgcctgct

SEQ ID NO: 905380 - DNA, 11 bp, Homo sapiens
cagccaggcag

SEQ ID NO: 905381 - DNA, 11 bp, Homo sapiens
cagccaggccc

SEQ ID NO: 905382 - DNA, 20 bp, Homo sapiens
cagccaggcccaggccagcc

SEQ ID NO: 905383 - DNA, 12 bp, Homo sapiens
cagccaggcggg

SEQ ID NO: 905384 - DNA, 22 bp, Homo sapiens
cagccaggctgccaaggccaga

SEQ ID NO: 905385 - DNA, 15 bp, Homo sapiens
cagccaggctgggcc

SEQ ID NO: 905386 - DNA, 16 bp, Homo sapiens
cagccagggagcttgc

SEQ ID NO: 905387 - DNA, 15 bp, Homo sapiens
cagccagtctcagag

SEQ ID NO: 905388 - DNA, 17 bp, Homo sapiens
cagccagtctcagagac

SEQ ID NO: 905389 - DNA, 19 bp, Homo sapiens
cagccagtgaatctgtttc

SEQ ID NO: 905390 - DNA, 24 bp, Homo sapiens
cagccagtgccattccactccact

SEQ ID NO: 905391 - DNA, 16 bp, Homo sapiens
cagccagtggcacagg

SEQ ID NO: 905392 - DNA, 18 bp, Homo sapiens
cagccagtgtgaccggcg

SEQ ID NO: 905393 - DNA, 20 bp, Homo sapiens
cagccagttttactgtgatt

SEQ ID NO: 905394 - DNA, 18 bp, Homo sapiens
cagccatcaagagactga

SEQ ID NO: 905395 - DNA, 18 bp, Homo sapiens
cagccatcataggaaggg

SEQ ID NO: 905396 - DNA, 19 bp, Homo sapiens
cagccatcataggaaggga

SEQ ID NO: 905397 - DNA, 23 bp, Homo sapiens
cagccatccagggggcaagagga

SEQ ID NO: 905398 - DNA, 15 bp, Homo sapiens
cagccatcgtcctgg

SEQ ID NO: 905399 - DNA, 17 bp, Homo sapiens
cagccatcgtcctggga

SEQ ID NO: 905400 - DNA, 17 bp, Homo sapiens
cagccatctgcccaggg

SEQ ID NO: 905401 - DNA, 18 bp, Homo sapiens
cagccatctgcccagggg

SEQ ID NO: 905402 - DNA, 19 bp, Homo sapiens
cagccatctgcccaggggt

SEQ ID NO: 905403 - DNA, 22 bp, Homo sapiens
cagccatgaggagttgctgttt

SEQ ID NO: 905404 - DNA, 16 bp, Homo sapiens
cagccatgccagctgg

SEQ ID NO: 905405 - DNA, 17 bp, Homo sapiens
cagccatgccagctggc

SEQ ID NO: 905406 - DNA, 18 bp, Homo sapiens
cagccatgccagctggcc

SEQ ID NO: 905407 - DNA, 21 bp, Homo sapiens
cagccatgcccgcattagctc

SEQ ID NO: 905408 - DNA, 12 bp, Homo sapiens
cagccatgcctc

SEQ ID NO: 905409 - DNA, 14 bp, Homo sapiens
cagccatgcgtggc

SEQ ID NO: 905410 - DNA, 21 bp, Homo sapiens
cagccatggggtccatcccct

SEQ ID NO: 905411 - DNA, 17 bp, Homo sapiens
cagccattaaaataaaa

SEQ ID NO: 905412 - DNA, 22 bp, Homo sapiens
cagccattaaaataaaacaagc

SEQ ID NO: 905413 - DNA, 16 bp, Homo sapiens
cagccattaccatgga

SEQ ID NO: 905414 - DNA, 20 bp, Homo sapiens
cagccattaccatggagaca

SEQ ID NO: 905415 - DNA, 19 bp, Homo sapiens
cagccattcactgccccca

SEQ ID NO: 905416 - DNA, 22 bp, Homo sapiens
cagccattcttcaggtcgtagc

SEQ ID NO: 905417 - DNA, 16 bp, Homo sapiens
cagccatttccccctc

SEQ ID NO: 905418 - DNA, 21 bp, Homo sapiens
cagccatttccccctcctcag

SEQ ID NO: 905419 - DNA, 22 bp, Homo sapiens
cagccatttccccctcctcaga

SEQ ID NO: 905420 - DNA, 14 bp, Homo sapiens
cagccatttttaat

SEQ ID NO: 905421 - DNA, 19 bp, Homo sapiens
cagcccaaaacccagggca

SEQ ID NO: 905422 - DNA, 15 bp, Homo sapiens
cagcccaaaccttgg

SEQ ID NO: 905423 - DNA, 16 bp, Homo sapiens
cagcccaaaccttggg

SEQ ID NO: 905424 - DNA, 16 bp, Homo sapiens
cagcccaacttcttac

SEQ ID NO: 905425 - DNA, 17 bp, Homo sapiens
cagcccaatctgccaga

SEQ ID NO: 905426 - DNA, 13 bp, Homo sapiens
cagcccacagagc

SEQ ID NO: 905427 - DNA, 15 bp, Homo sapiens
cagcccacagagcct

SEQ ID NO: 905428 - DNA, 19 bp, Homo sapiens
cagcccacatagtgatggt

SEQ ID NO: 905429 - DNA, 12 bp, Homo sapiens
cagcccaccagg

SEQ ID NO: 905430 - DNA, 21 bp, Homo sapiens
cagcccaccaggagcacctgg

SEQ ID NO: 905431 - DNA, 11 bp, Homo sapiens
cagcccacccc

SEQ ID NO: 905432 - DNA, 14 bp, Homo sapiens
cagcccacccccct

SEQ ID NO: 905433 - DNA, 16 bp, Homo sapiens
cagcccacccccctca

SEQ ID NO: 905434 - DNA, 15 bp, Homo sapiens
cagcccacccctcaa

SEQ ID NO: 905435 - DNA, 11 bp, Homo sapiens
cagcccaccct

SEQ ID NO: 905436 - DNA, 21 bp, Homo sapiens
cagcccaccctgctcctcctg

SEQ ID NO: 905437 - DNA, 16 bp, Homo sapiens
cagcccactgagaagt

SEQ ID NO: 905438 - DNA, 12 bp, Homo sapiens
cagcccagagac

SEQ ID NO: 905439 - DNA, 17 bp, Homo sapiens
cagcccagagactttgt

SEQ ID NO: 905440 - DNA, 20 bp, Homo sapiens
agccaatattaaaagagacc

SEQ ID NO: 905441 - DNA, 19 bp, Homo sapiens
agccaatatttactcatca

SEQ ID NO: 905442 - DNA, 14 bp, Homo sapiens
agccaatcccctcc

SEQ ID NO: 905443 - DNA, 17 bp, Homo sapiens
agccaatccctggccat

SEQ ID NO: 905444 - DNA, 20 bp, Homo sapiens
agccaatgtctcctcccctt

SEQ ID NO: 905445 - DNA, 18 bp, Homo sapiens
agccaattcagacaggca

SEQ ID NO: 905446 - DNA, 17 bp, Homo sapiens
agccacaaccacataca

SEQ ID NO: 905447 - DNA, 15 bp, Homo sapiens
agccacaagctgcac

SEQ ID NO: 905448 - DNA, 17 bp, Homo sapiens
agccacaagctgcactg

SEQ ID NO: 905449 - DNA, 19 bp, Homo sapiens
agccacaagctgcactgtg

SEQ ID NO: 905450 - DNA, 21 bp, Homo sapiens
agccacaagctgcactgtgaa

SEQ ID NO: 905451 - DNA, 22 bp, Homo sapiens
agccacaagctgcactgtgaac

SEQ ID NO: 905452 - DNA, 21 bp, Homo sapiens
agccacacctggactgaccct

SEQ ID NO: 905453 - DNA, 20 bp, Homo sapiens
agccacacgcaggcggccag

SEQ ID NO: 905454 - DNA, 12 bp, Homo sapiens
agccacactggg

SEQ ID NO: 905455 - DNA, 14 bp, Homo sapiens
agccacactgggcc

SEQ ID NO: 905456 - DNA, 16 bp, Homo sapiens
agccacactgggcctg

SEQ ID NO: 905457 - DNA, 21 bp, Homo sapiens
agccacactgtgggactcttc

SEQ ID NO: 905458 - DNA, 20 bp, Homo sapiens
agccacagaagccaggagca

SEQ ID NO: 905459 - DNA, 18 bp, Homo sapiens
agccacagctgctgttct

SEQ ID NO: 905460 - DNA, 12 bp, Homo sapiens
agccacaggaac

SEQ ID NO: 905461 - DNA, 16 bp, Homo sapiens
agccacaggaacggcc

SEQ ID NO: 905462 - DNA, 18 bp, Homo sapiens
agccacaggaacggccct

SEQ ID NO: 905463 - DNA, 19 bp, Homo sapiens
agccacaggaacggccctg

SEQ ID NO: 905464 - DNA, 24 bp, Homo sapiens
agccacaggactgagccctctcac

SEQ ID NO: 905465 - DNA, 13 bp, Homo sapiens
agccacagtggga

SEQ ID NO: 905466 - DNA, 20 bp, Homo sapiens
agccacatttggaatacttt

SEQ ID NO: 905467 - DNA, 21 bp, Homo sapiens
agccaccaaagtcacatccac

SEQ ID NO: 905468 - DNA, 15 bp, Homo sapiens
agccaccaccctcag

SEQ ID NO: 905469 - DNA, 18 bp, Homo sapiens
agccaccagtggacctag

SEQ ID NO: 905470 - DNA, 12 bp, Homo sapiens
agccaccagttc

SEQ ID NO: 905471 - DNA, 14 bp, Homo sapiens
agccaccagttctc

SEQ ID NO: 905472 - DNA, 17 bp, Homo sapiens
agccacccaagcctgct

SEQ ID NO: 905473 - DNA, 14 bp, Homo sapiens
agccacccccaggc

SEQ ID NO: 905474 - DNA, 21 bp, Homo sapiens
agccaccccgggctctctgct

SEQ ID NO: 905475 - DNA, 13 bp, Homo sapiens
agccacccctgag

SEQ ID NO: 905476 - DNA, 19 bp, Homo sapiens
agccacccgtggggtgctg

SEQ ID NO: 905477 - DNA, 12 bp, Homo sapiens
agccaccctgag

SEQ ID NO: 905478 - DNA, 14 bp, Homo sapiens
agccaccctgagtt

SEQ ID NO: 905479 - DNA, 15 bp, Homo sapiens
agccaccgaagccgc

SEQ ID NO: 905480 - DNA, 20 bp, Homo sapiens
agccaccgaagccgcctgtg

SEQ ID NO: 905481 - DNA, 21 bp, Homo sapiens
agccacctaaacggttcagtt

SEQ ID NO: 905482 - DNA, 11 bp, Homo sapiens
agccacctccc

SEQ ID NO: 905483 - DNA, 19 bp, Homo sapiens
agccacctccgccagaccc

SEQ ID NO: 905484 - DNA, 14 bp, Homo sapiens
agccacctggcagg

SEQ ID NO: 905485 - DNA, 22 bp, Homo sapiens
agccacctgggaacacagttct

SEQ ID NO: 905486 - DNA, 15 bp, Homo sapiens
agccacgactgccat

SEQ ID NO: 905487 - DNA, 16 bp, Homo sapiens
agccacgattggagaa

SEQ ID NO: 905488 - DNA, 16 bp, Homo sapiens
agccacggagggaggc

SEQ ID NO: 905489 - DNA, 22 bp, Homo sapiens
agccacggagggaggcaccatg

SEQ ID NO: 905490 - DNA, 15 bp, Homo sapiens
agccacgtgaatggc

SEQ ID NO: 905491 - DNA, 16 bp, Homo sapiens
agccactaaaacacaa

SEQ ID NO: 905492 - DNA, 19 bp, Homo sapiens
agccactcagtctcttcca

SEQ ID NO: 905493 - DNA, 19 bp, Homo sapiens
agccactccaagccccctg

SEQ ID NO: 905494 - DNA, 12 bp, Homo sapiens
agccactcctct

SEQ ID NO: 905495 - DNA, 13 bp, Homo sapiens
agccactcctctg

SEQ ID NO: 905496 - DNA, 22 bp, Homo sapiens
agccactcctctgactcagggc

SEQ ID NO: 905497 - DNA, 14 bp, Homo sapiens
agccactcctgtcc

SEQ ID NO: 905498 - DNA, 23 bp, Homo sapiens
agccactccttccttcaggactc

SEQ ID NO: 905499 - DNA, 23 bp, Homo sapiens
agccactcgcagtcgcaggatcc

SEQ ID NO: 905500 - DNA, 19 bp, Homo sapiens
agccactcgggaggctgag

SEQ ID NO: 905501 - DNA, 17 bp, Homo sapiens
agccactctgtcccttc

SEQ ID NO: 905502 - DNA, 21 bp, Homo sapiens
agccactgccaagcttcctgt

SEQ ID NO: 905503 - DNA, 16 bp, Homo sapiens
agccactgcctctccc

SEQ ID NO: 905504 - DNA, 17 bp, Homo sapiens
agccactgcctctccct

SEQ ID NO: 905505 - DNA, 20 bp, Homo sapiens
agccactgcctctccctctg

SEQ ID NO: 905506 - DNA, 21 bp, Homo sapiens
agccactgcctctccctctgg

SEQ ID NO: 905507 - DNA, 13 bp, Homo sapiens
agccactgggccc

SEQ ID NO: 905508 - DNA, 19 bp, Homo sapiens
agccactgggcccctgtcc

SEQ ID NO: 905509 - DNA, 18 bp, Homo sapiens
agccactgtgcttggcca

SEQ ID NO: 905510 - DNA, 17 bp, Homo sapiens
agccacttaaaatgttc

SEQ ID NO: 905511 - DNA, 18 bp, Homo sapiens
agccacttctccccagaa

SEQ ID NO: 905512 - DNA, 20 bp, Homo sapiens
agccacttctggcttcagcc

SEQ ID NO: 905513 - DNA, 15 bp, Homo sapiens
agccacttgcctgtg

SEQ ID NO: 905514 - DNA, 22 bp, Homo sapiens
agccacttgcctgtgctacaat

SEQ ID NO: 905515 - DNA, 16 bp, Homo sapiens
agccacttggcccaga

SEQ ID NO: 905516 - DNA, 14 bp, Homo sapiens
agccagaaagcact

SEQ ID NO: 905517 - DNA, 19 bp, Homo sapiens
agccagaaataaagttggt

SEQ ID NO: 905518 - DNA, 18 bp, Homo sapiens
agccagaaatgggcagtt

SEQ ID NO: 905519 - DNA, 12 bp, Homo sapiens
agccagaattca

SEQ ID NO: 905520 - DNA, 21 bp, Homo sapiens
agccagacaaaatttgagaat

SEQ ID NO: 905521 - DNA, 20 bp, Homo sapiens
agccagacaacttctgtttc

SEQ ID NO: 905522 - DNA, 22 bp, Homo sapiens
agccagacaacttctgtttctt

SEQ ID NO: 905523 - DNA, 14 bp, Homo sapiens
agccagacacgttc

SEQ ID NO: 905524 - DNA, 14 bp, Homo sapiens
agccagacactctg

SEQ ID NO: 905525 - DNA, 19 bp, Homo sapiens
agccagacactctgctctg

SEQ ID NO: 905526 - DNA, 20 bp, Homo sapiens
agccagacactctgctctgc

SEQ ID NO: 905527 - DNA, 22 bp, Homo sapiens
agccagacccagagccctctga

SEQ ID NO: 905528 - DNA, 16 bp, Homo sapiens
agccagactctggtct

SEQ ID NO: 905529 - DNA, 18 bp, Homo sapiens
agccagactctggtcttc

SEQ ID NO: 905530 - DNA, 15 bp, Homo sapiens
agccagagagaacaa

SEQ ID NO: 905531 - DNA, 12 bp, Homo sapiens
agccagagagga

SEQ ID NO: 905532 - DNA, 17 bp, Homo sapiens
agccagagaggagcacc

SEQ ID NO: 905533 - DNA, 15 bp, Homo sapiens
agccagagccccaag

SEQ ID NO: 905534 - DNA, 16 bp, Homo sapiens
agccagagctgggtgg

SEQ ID NO: 905535 - DNA, 14 bp, Homo sapiens
agccagagctgtgc

SEQ ID NO: 905536 - DNA, 19 bp, Homo sapiens
agccagagctgtgcctgct

SEQ ID NO: 905537 - DNA, 20 bp, Homo sapiens
agccagagctgtgcctgctc

SEQ ID NO: 905538 - DNA, 23 bp, Homo sapiens
agccagagctgtgcctgctcagc

SEQ ID NO: 905539 - DNA, 24 bp, Homo sapiens
agccagagctgtgcctgctcagca

SEQ ID NO: 905540 - DNA, 18 bp, Homo sapiens
agccagaggagggcagag

SEQ ID NO: 905541 - DNA, 18 bp, Homo sapiens
agccagaggctgggttca

SEQ ID NO: 905542 - DNA, 22 bp, Homo sapiens
agccagcaagagggaacaaaac

SEQ ID NO: 905543 - DNA, 22 bp, Homo sapiens
agccagcaatgatgtccagaag

SEQ ID NO: 905544 - DNA, 23 bp, Homo sapiens
agccagcaatgatgtccagaaga

SEQ ID NO: 905545 - DNA, 13 bp, Homo sapiens
agccagcacacag

SEQ ID NO: 905546 - DNA, 15 bp, Homo sapiens
agccagcacacaggg

SEQ ID NO: 905547 - DNA, 17 bp, Homo sapiens
agccagcacacagggca

SEQ ID NO: 905548 - DNA, 19 bp, Homo sapiens
agccagcacacagggcagt

SEQ ID NO: 905549 - DNA, 13 bp, Homo sapiens
agccagcaccacc

SEQ ID NO: 905550 - DNA, 21 bp, Homo sapiens
agccagcaccacctacacagg

SEQ ID NO: 905551 - DNA, 13 bp, Homo sapiens
agccagcacctgg

SEQ ID NO: 905552 - DNA, 23 bp, Homo sapiens
agccagcacctggcatcgcacca

SEQ ID NO: 905553 - DNA, 22 bp, Homo sapiens
agccagcacttgtccagctgag

SEQ ID NO: 905554 - DNA, 16 bp, Homo sapiens
agccagcagcagccca

SEQ ID NO: 905555 - DNA, 15 bp, Homo sapiens
agccagcagcaggat

SEQ ID NO: 905556 - DNA, 16 bp, Homo sapiens
agccagcagccagctc

SEQ ID NO: 905557 - DNA, 23 bp, Homo sapiens
agccagcagctgaagtctctttt

SEQ ID NO: 905558 - DNA, 15 bp, Homo sapiens
agccagcattcagca

SEQ ID NO: 905559 - DNA, 13 bp, Homo sapiens
agccagccacccc

SEQ ID NO: 905560 - DNA, 21 bp, Homo sapiens
agccagccacccctgccactc

SEQ ID NO: 905561 - DNA, 20 bp, Homo sapiens
agccagcccaaaccttgggc

SEQ ID NO: 905562 - DNA, 15 bp, Homo sapiens
agccagcccagccca

SEQ ID NO: 905563 - DNA, 19 bp, Homo sapiens
agccagccccctccagctc

SEQ ID NO: 905564 - DNA, 12 bp, Homo sapiens
cagcccagagcc

SEQ ID NO: 905565 - DNA, 17 bp, Homo sapiens
cagcccagcccagctgg

SEQ ID NO: 905566 - DNA, 15 bp, Homo sapiens
cagcccagcctgccc

SEQ ID NO: 905567 - DNA, 13 bp, Homo sapiens
cagcccagctcag

SEQ ID NO: 905568 - DNA, 18 bp, Homo sapiens
cagcccaggcatctcctt

SEQ ID NO: 905569 - DNA, 22 bp, Homo sapiens
cagcccaggcatctccttgggc

SEQ ID NO: 905570 - DNA, 14 bp, Homo sapiens
cagcccagggcctg

SEQ ID NO: 905571 - DNA, 17 bp, Homo sapiens
cagcccagggctcctgc

SEQ ID NO: 905572 - DNA, 18 bp, Homo sapiens
cagcccagggctcctgca

SEQ ID NO: 905573 - DNA, 21 bp, Homo sapiens
cagcccagggctcctgcactt

SEQ ID NO: 905574 - DNA, 19 bp, Homo sapiens
cagcccagggttcccccag

SEQ ID NO: 905575 - DNA, 18 bp, Homo sapiens
cagcccatccattaggcc

SEQ ID NO: 905576 - DNA, 16 bp, Homo sapiens
cagcccatctcggagc

SEQ ID NO: 905577 - DNA, 17 bp, Homo sapiens
cagcccatctcggagca

SEQ ID NO: 905578 - DNA, 19 bp, Homo sapiens
cagcccatgcccacctgcc

SEQ ID NO: 905579 - DNA, 22 bp, Homo sapiens
cagcccatggcccccaataaag

SEQ ID NO: 905580 - DNA, 20 bp, Homo sapiens
cagcccattctctctcctgt

SEQ ID NO: 905581 - DNA, 21 bp, Homo sapiens
cagcccattctctctcctgtc

SEQ ID NO: 905582 - DNA, 23 bp, Homo sapiens
cagcccattctctctcctgtcca

SEQ ID NO: 905583 - DNA, 19 bp, Homo sapiens
cagcccattgctgccaagg

SEQ ID NO: 905584 - DNA, 24 bp, Homo sapiens
cagcccattggccgagctcctggg

SEQ ID NO: 905585 - DNA, 17 bp, Homo sapiens
cagccccaactccaggg

SEQ ID NO: 905586 - DNA, 15 bp, Homo sapiens
cagccccaagctggg

SEQ ID NO: 905587 - DNA, 17 bp, Homo sapiens
cagccccaagcttctga

SEQ ID NO: 905588 - DNA, 15 bp, Homo sapiens
cagccccacaggact

SEQ ID NO: 905589 - DNA, 14 bp, Homo sapiens
cagccccacccagg

SEQ ID NO: 905590 - DNA, 16 bp, Homo sapiens
cagccccacccaggag

SEQ ID NO: 905591 - DNA, 22 bp, Homo sapiens
cagccccacccaggagggaggg

SEQ ID NO: 905592 - DNA, 17 bp, Homo sapiens
cagccccacccccagcc

SEQ ID NO: 905593 - DNA, 19 bp, Homo sapiens
cagccccacccccagccag

SEQ ID NO: 905594 - DNA, 20 bp, Homo sapiens
cagccccacccccagccagg

SEQ ID NO: 905595 - DNA, 16 bp, Homo sapiens
cagccccactgccagc

SEQ ID NO: 905596 - DNA, 20 bp, Homo sapiens
cagccccactgccagcagca

SEQ ID NO: 905597 - DNA, 22 bp, Homo sapiens
cagccccactgccagcagcagc

SEQ ID NO: 905598 - DNA, 19 bp, Homo sapiens
cagccccacttcaccccca

SEQ ID NO: 905599 - DNA, 20 bp, Homo sapiens
cagccccagacaacagccca

SEQ ID NO: 905600 - DNA, 16 bp, Homo sapiens
cagccccaggcctggc

SEQ ID NO: 905601 - DNA, 18 bp, Homo sapiens
cagccccaggcctggcct

SEQ ID NO: 905602 - DNA, 23 bp, Homo sapiens
cagccccagtcttccttgtctct

SEQ ID NO: 905603 - DNA, 17 bp, Homo sapiens
cagccccatcagaacct

SEQ ID NO: 905604 - DNA, 14 bp, Homo sapiens
cagcccccagcctt

SEQ ID NO: 905605 - DNA, 19 bp, Homo sapiens
cagcccccaggatctgggt

SEQ ID NO: 905606 - DNA, 20 bp, Homo sapiens
cagcccccaggatctgggtt

SEQ ID NO: 905607 - DNA, 16 bp, Homo sapiens
cagcccccaggccagg

SEQ ID NO: 905608 - DNA, 12 bp, Homo sapiens
cagcccccaggg

SEQ ID NO: 905609 - DNA, 13 bp, Homo sapiens
cagcccccagggc

SEQ ID NO: 905610 - DNA, 17 bp, Homo sapiens
cagcccccagtgcgctc

SEQ ID NO: 905611 - DNA, 16 bp, Homo sapiens
cagccccccagcacta

SEQ ID NO: 905612 - DNA, 15 bp, Homo sapiens
cagcccccccaccca

SEQ ID NO: 905613 - DNA, 21 bp, Homo sapiens
cagcccccccacccaccccca

SEQ ID NO: 905614 - DNA, 22 bp, Homo sapiens
cagcccccccacccacccccag

SEQ ID NO: 905615 - DNA, 23 bp, Homo sapiens
cagcccccccacccacccccagg

SEQ ID NO: 905616 - DNA, 17 bp, Homo sapiens
cagcccccgccccagag

SEQ ID NO: 905617 - DNA, 18 bp, Homo sapiens
cagcccccgccccagagt

SEQ ID NO: 905618 - DNA, 15 bp, Homo sapiens
cagcccccgcgccct

SEQ ID NO: 905619 - DNA, 18 bp, Homo sapiens
cagcccccgcgccctccc

SEQ ID NO: 905620 - DNA, 14 bp, Homo sapiens
cagccccctggatg

SEQ ID NO: 905621 - DNA, 22 bp, Homo sapiens
cagccccctggatgggcattgg

SEQ ID NO: 905622 - DNA, 13 bp, Homo sapiens
cagccccctgtgg

SEQ ID NO: 905623 - DNA, 21 bp, Homo sapiens
cagcccccttgccctccgcct

SEQ ID NO: 905624 - DNA, 16 bp, Homo sapiens
cagccccgactccagc

SEQ ID NO: 905625 - DNA, 15 bp, Homo sapiens
cagccccgacttcct

SEQ ID NO: 905626 - DNA, 18 bp, Homo sapiens
cagccccgacttcctgac

SEQ ID NO: 905627 - DNA, 22 bp, Homo sapiens
cagccccgatgattcttaacac

SEQ ID NO: 905628 - DNA, 17 bp, Homo sapiens
cagccccgccccgttgt

SEQ ID NO: 905629 - DNA, 15 bp, Homo sapiens
cagccccgcctgtca

SEQ ID NO: 905630 - DNA, 16 bp, Homo sapiens
cagccccgcctgtcac

SEQ ID NO: 905631 - DNA, 17 bp, Homo sapiens
cagccccgcctgtcaca

SEQ ID NO: 905632 - DNA, 18 bp, Homo sapiens
cagccccgcctgtcacaa

SEQ ID NO: 905633 - DNA, 15 bp, Homo sapiens
cagccccgctcaggc

SEQ ID NO: 905634 - DNA, 20 bp, Homo sapiens
cagcccctacccctgccctg

SEQ ID NO: 905635 - DNA, 21 bp, Homo sapiens
cagcccctacccctgccctgc

SEQ ID NO: 905636 - DNA, 14 bp, Homo sapiens
cagcccctcccacc

SEQ ID NO: 905637 - DNA, 15 bp, Homo sapiens
cagcccctcccacca

SEQ ID NO: 905638 - DNA, 13 bp, Homo sapiens
cagcccctcctct

SEQ ID NO: 905639 - DNA, 19 bp, Homo sapiens
cagcccctcctctgccacc

SEQ ID NO: 905640 - DNA, 20 bp, Homo sapiens
cagcccctcctctgccacct

SEQ ID NO: 905641 - DNA, 14 bp, Homo sapiens
cagcccctctggtc

SEQ ID NO: 905642 - DNA, 12 bp, Homo sapiens
cagcccctcttc

SEQ ID NO: 905643 - DNA, 13 bp, Homo sapiens
cagcccctcttcc

SEQ ID NO: 905644 - DNA, 14 bp, Homo sapiens
cagcccctcttccc

SEQ ID NO: 905645 - DNA, 15 bp, Homo sapiens
cagcccctcttccct

SEQ ID NO: 905646 - DNA, 17 bp, Homo sapiens
cagcccctcttgccccc

SEQ ID NO: 905647 - DNA, 21 bp, Homo sapiens
cagcccctcttgccccccacc

SEQ ID NO: 905648 - DNA, 22 bp, Homo sapiens
cagcccctcttgccccccaccc

SEQ ID NO: 905649 - DNA, 18 bp, Homo sapiens
cagcccctcttggagaag

SEQ ID NO: 905650 - DNA, 24 bp, Homo sapiens
cagcccctcttggagaagtctcag

SEQ ID NO: 905651 - DNA, 16 bp, Homo sapiens
cagcccctgatctctg

SEQ ID NO: 905652 - DNA, 17 bp, Homo sapiens
cagcccctgatctctga

SEQ ID NO: 905653 - DNA, 23 bp, Homo sapiens
cagcccctgatctctgacctctg

SEQ ID NO: 905654 - DNA, 13 bp, Homo sapiens
cagcccctgcaca

SEQ ID NO: 905655 - DNA, 23 bp, Homo sapiens
cagcccctggacccctggggtgg

SEQ ID NO: 905656 - DNA, 21 bp, Homo sapiens
cagcccctggccccaggacct

SEQ ID NO: 905657 - DNA, 12 bp, Homo sapiens
cagcccctggga

SEQ ID NO: 905658 - DNA, 20 bp, Homo sapiens
cagcccctgggaacaggccc

SEQ ID NO: 905659 - DNA, 23 bp, Homo sapiens
cagcccctgggaacaggccccac

SEQ ID NO: 905660 - DNA, 14 bp, Homo sapiens
cagcccctgggccc

SEQ ID NO: 905661 - DNA, 13 bp, Homo sapiens
cagcccctggggc

SEQ ID NO: 905662 - DNA, 19 bp, Homo sapiens
cagcccctggggcccagcc

SEQ ID NO: 905663 - DNA, 20 bp, Homo sapiens
cagcccctggggcccagccc

SEQ ID NO: 905664 - DNA, 22 bp, Homo sapiens
cagcccctggggcccagcccct

SEQ ID NO: 905665 - DNA, 13 bp, Homo sapiens
cagcccctgtccc

SEQ ID NO: 905666 - DNA, 22 bp, Homo sapiens
cagccccttctcagaatctacc

SEQ ID NO: 905667 - DNA, 16 bp, Homo sapiens
cagccccttctcccag

SEQ ID NO: 905668 - DNA, 17 bp, Homo sapiens
cagccccttgagaaacc

SEQ ID NO: 905669 - DNA, 21 bp, Homo sapiens
cagcccctttgcctctgtcct

SEQ ID NO: 905670 - DNA, 13 bp, Homo sapiens
cagccccttttct

SEQ ID NO: 905671 - DNA, 21 bp, Homo sapiens
cagcccgacagtgccatcccc

SEQ ID NO: 905672 - DNA, 16 bp, Homo sapiens
cagcccgccgcccgcc

SEQ ID NO: 905673 - DNA, 22 bp, Homo sapiens
cagcccgcctgccgtgcatggc

SEQ ID NO: 905674 - DNA, 15 bp, Homo sapiens
cagcccgcggcctgg

SEQ ID NO: 905675 - DNA, 17 bp, Homo sapiens
cagcccgcggcctggac

SEQ ID NO: 905676 - DNA, 18 bp, Homo sapiens
cagcccggaccttggcag

SEQ ID NO: 905677 - DNA, 23 bp, Homo sapiens
cagcccggcctgctcccagcagc

SEQ ID NO: 905678 - DNA, 14 bp, Homo sapiens
cagcccggctgctg

SEQ ID NO: 905679 - DNA, 15 bp, Homo sapiens
cagcccgggagccta

SEQ ID NO: 905680 - DNA, 22 bp, Homo sapiens
cagcccgtgaagcagtgcctcg

SEQ ID NO: 905681 - DNA, 23 bp, Homo sapiens
cagcccgtgaagcagtgcctcga

SEQ ID NO: 905682 - DNA, 17 bp, Homo sapiens
cagcccgtgtggcccct

SEQ ID NO: 905683 - DNA, 17 bp, Homo sapiens
cagcccgtttcagaagg

SEQ ID NO: 905684 - DNA, 19 bp, Homo sapiens
cagccctaaggatctctca

SEQ ID NO: 905685 - DNA, 20 bp, Homo sapiens
cagccctaaggatctctcag

SEQ ID NO: 905686 - DNA, 16 bp, Homo sapiens
cagccctactcctgcg

SEQ ID NO: 905687 - DNA, 18 bp, Homo sapiens
cagccctagggtggagag

SEQ ID NO: 905688 - DNA, 16 bp, Homo sapiens
agccagcccctcttcc

SEQ ID NO: 905689 - DNA, 12 bp, Homo sapiens
agccagccctcc

SEQ ID NO: 905690 - DNA, 18 bp, Homo sapiens
agccagccctccctgtcc

SEQ ID NO: 905691 - DNA, 14 bp, Homo sapiens
agccagccctggcc

SEQ ID NO: 905692 - DNA, 21 bp, Homo sapiens
agccagcccttccctggcccc

SEQ ID NO: 905693 - DNA, 14 bp, Homo sapiens
agccagccgccctg

SEQ ID NO: 905694 - DNA, 15 bp, Homo sapiens
agccagccggtgcct

SEQ ID NO: 905695 - DNA, 22 bp, Homo sapiens
agccagcctcagaaggccccag

SEQ ID NO: 905696 - DNA, 11 bp, Homo sapiens
agccagcctgg

SEQ ID NO: 905697 - DNA, 12 bp, Homo sapiens
agccagcctggt

SEQ ID NO: 905698 - DNA, 12 bp, Homo sapiens
agccagcgcctc

SEQ ID NO: 905699 - DNA, 16 bp, Homo sapiens
agccagcgcctccctc

SEQ ID NO: 905700 - DNA, 22 bp, Homo sapiens
agccagcgggaatggcagctgc

SEQ ID NO: 905701 - DNA, 19 bp, Homo sapiens
agccagcgtcctcctctgt

SEQ ID NO: 905702 - DNA, 21 bp, Homo sapiens
agccagcgtcctcctctgtga

SEQ ID NO: 905703 - DNA, 11 bp, Homo sapiens
agccagctctc

SEQ ID NO: 905704 - DNA, 15 bp, Homo sapiens
agccagctctcagcc

SEQ ID NO: 905705 - DNA, 13 bp, Homo sapiens
agccagctctctc

SEQ ID NO: 905706 - DNA, 14 bp, Homo sapiens
agccagctgcaggg

SEQ ID NO: 905707 - DNA, 16 bp, Homo sapiens
agccagctgcagggca

SEQ ID NO: 905708 - DNA, 19 bp, Homo sapiens
agccagctgcagggcacgg

SEQ ID NO: 905709 - DNA, 14 bp, Homo sapiens
agccagctgcccta

SEQ ID NO: 905710 - DNA, 16 bp, Homo sapiens
agccagctgccgacca

SEQ ID NO: 905711 - DNA, 11 bp, Homo sapiens
agccagctgct

SEQ ID NO: 905712 - DNA, 13 bp, Homo sapiens
agccagctgcttt

SEQ ID NO: 905713 - DNA, 14 bp, Homo sapiens
agccagctgctttt

SEQ ID NO: 905714 - DNA, 14 bp, Homo sapiens
agccagcttaaacc

SEQ ID NO: 905715 - DNA, 22 bp, Homo sapiens
agccagcttaaacccatacaat

SEQ ID NO: 905716 - DNA, 12 bp, Homo sapiens
agccagcttggg

SEQ ID NO: 905717 - DNA, 13 bp, Homo sapiens
agccagctttccc

SEQ ID NO: 905718 - DNA, 15 bp, Homo sapiens
agccaggaaacatga

SEQ ID NO: 905719 - DNA, 20 bp, Homo sapiens
agccaggaagtacttccacc

SEQ ID NO: 905720 - DNA, 18 bp, Homo sapiens
agccaggacccgcctgct

SEQ ID NO: 905721 - DNA, 19 bp, Homo sapiens
agccaggacccgcctgctc

SEQ ID NO: 905722 - DNA, 22 bp, Homo sapiens
agccaggagcaaatgtttctgc

SEQ ID NO: 905723 - DNA, 18 bp, Homo sapiens
agccaggaggcctgcacc

SEQ ID NO: 905724 - DNA, 17 bp, Homo sapiens
agccaggagggacctgc

SEQ ID NO: 905725 - DNA, 18 bp, Homo sapiens
agccaggatgcccagatg

SEQ ID NO: 905726 - DNA, 13 bp, Homo sapiens
agccaggcagagg

SEQ ID NO: 905727 - DNA, 12 bp, Homo sapiens
agccaggcccag

SEQ ID NO: 905728 - DNA, 14 bp, Homo sapiens
agccaggcccaggc

SEQ ID NO: 905729 - DNA, 15 bp, Homo sapiens
agccaggcccaggcc

SEQ ID NO: 905730 - DNA, 16 bp, Homo sapiens
agccaggcccaggcca

SEQ ID NO: 905731 - DNA, 21 bp, Homo sapiens
agccaggcccaggccagcccc

SEQ ID NO: 905732 - DNA, 14 bp, Homo sapiens
agccaggccccagg

SEQ ID NO: 905733 - DNA, 12 bp, Homo sapiens
agccaggcctga

SEQ ID NO: 905734 - DNA, 13 bp, Homo sapiens
agccaggcctggc

SEQ ID NO: 905735 - DNA, 14 bp, Homo sapiens
agccaggcgggctc

SEQ ID NO: 905736 - DNA, 11 bp, Homo sapiens
agccaggctat

SEQ ID NO: 905737 - DNA, 16 bp, Homo sapiens
agccaggctatggttg

SEQ ID NO: 905738 - DNA, 20 bp, Homo sapiens
agccaggctatggttgccac

SEQ ID NO: 905739 - DNA, 23 bp, Homo sapiens
agccaggctgggccgcaagggcc

SEQ ID NO: 905740 - DNA, 15 bp, Homo sapiens
agccagggcagagga

SEQ ID NO: 905741 - DNA, 19 bp, Homo sapiens
agccagggcagaggaatgt

SEQ ID NO: 905742 - DNA, 17 bp, Homo sapiens
agccagggccaggggtc

SEQ ID NO: 905743 - DNA, 14 bp, Homo sapiens
agccagggcccaga

SEQ ID NO: 905744 - DNA, 17 bp, Homo sapiens
agccagggcccagagcc

SEQ ID NO: 905745 - DNA, 11 bp, Homo sapiens
agccagggctg

SEQ ID NO: 905746 - DNA, 12 bp, Homo sapiens
agccagggctgg

SEQ ID NO: 905747 - DNA, 13 bp, Homo sapiens
agccagggctgga

SEQ ID NO: 905748 - DNA, 15 bp, Homo sapiens
agccagggctgtcct

SEQ ID NO: 905749 - DNA, 20 bp, Homo sapiens
agccagggtagagcaaagga

SEQ ID NO: 905750 - DNA, 23 bp, Homo sapiens
agccaggtaatgagggactggaa

SEQ ID NO: 905751 - DNA, 17 bp, Homo sapiens
agccaggtacaggagag

SEQ ID NO: 905752 - DNA, 18 bp, Homo sapiens
agccaggtacaggagagg

SEQ ID NO: 905753 - DNA, 22 bp, Homo sapiens
agccaggtacaggagaggcagc

SEQ ID NO: 905754 - DNA, 17 bp, Homo sapiens
agccaggtatggctctg

SEQ ID NO: 905755 - DNA, 19 bp, Homo sapiens
agccaggtatggctctgca

SEQ ID NO: 905756 - DNA, 22 bp, Homo sapiens
agccaggttctcattaggtttt

SEQ ID NO: 905757 - DNA, 17 bp, Homo sapiens
agccaggtttagcggca

SEQ ID NO: 905758 - DNA, 13 bp, Homo sapiens
agccagtaaatgg

SEQ ID NO: 905759 - DNA, 14 bp, Homo sapiens
agccagtaatcttt

SEQ ID NO: 905760 - DNA, 21 bp, Homo sapiens
agccagtaatctttatactgg

SEQ ID NO: 905761 - DNA, 19 bp, Homo sapiens
agccagtcaccttctgggc

SEQ ID NO: 905762 - DNA, 22 bp, Homo sapiens
agccagtcatggaatcttgctg

SEQ ID NO: 905763 - DNA, 15 bp, Homo sapiens
agccagtctcagaga

SEQ ID NO: 905764 - DNA, 21 bp, Homo sapiens
agccagtctcagagaccagca

SEQ ID NO: 905765 - DNA, 19 bp, Homo sapiens
agccagtcttgcctaggcc

SEQ ID NO: 905766 - DNA, 12 bp, Homo sapiens
agccagtgactt

SEQ ID NO: 905767 - DNA, 15 bp, Homo sapiens
agccagtgacttttt

SEQ ID NO: 905768 - DNA, 13 bp, Homo sapiens
agccagtgagatg

SEQ ID NO: 905769 - DNA, 16 bp, Homo sapiens
agccagtggagctggt

SEQ ID NO: 905770 - DNA, 19 bp, Homo sapiens
agccagtggcacaggagac

SEQ ID NO: 905771 - DNA, 18 bp, Homo sapiens
agccagtggcgggtgatg

SEQ ID NO: 905772 - DNA, 21 bp, Homo sapiens
agccagtgggccagccacaga

SEQ ID NO: 905773 - DNA, 23 bp, Homo sapiens
agccagtgtgcccaaaagccatg

SEQ ID NO: 905774 - DNA, 22 bp, Homo sapiens
agccagttgcttcttcagctga

SEQ ID NO: 905775 - DNA, 17 bp, Homo sapiens
agccagttgtcctatgg

SEQ ID NO: 905776 - DNA, 22 bp, Homo sapiens
agccagtttgggtaaaatactt

SEQ ID NO: 905777 - DNA, 21 bp, Homo sapiens
agccataaaagcattgtctct

SEQ ID NO: 905778 - DNA, 13 bp, Homo sapiens
agccataaatgat

SEQ ID NO: 905779 - DNA, 18 bp, Homo sapiens
agccataacgtgccccca

SEQ ID NO: 905780 - DNA, 17 bp, Homo sapiens
agccatacataaaagaa

SEQ ID NO: 905781 - DNA, 21 bp, Homo sapiens
agccatacataaaagaaataa

SEQ ID NO: 905782 - DNA, 23 bp, Homo sapiens
agccatacataaaagaaataaac

SEQ ID NO: 905783 - DNA, 16 bp, Homo sapiens
agccatagaccctgag

SEQ ID NO: 905784 - DNA, 19 bp, Homo sapiens
agccatagggggctgcacg

SEQ ID NO: 905785 - DNA, 15 bp, Homo sapiens
agccataggtgcagt

SEQ ID NO: 905786 - DNA, 21 bp, Homo sapiens
agccatataagtttgaaggaa

SEQ ID NO: 905787 - DNA, 19 bp, Homo sapiens
agccatatatgaccagaag

SEQ ID NO: 905788 - DNA, 21 bp, Homo sapiens
agccatatatgaccagaagcc

SEQ ID NO: 905789 - DNA, 12 bp, Homo sapiens
agccatattcca

SEQ ID NO: 905790 - DNA, 13 bp, Homo sapiens
agccatattccag

SEQ ID NO: 905791 - DNA, 18 bp, Homo sapiens
agccatattccagcagtg

SEQ ID NO: 905792 - DNA, 17 bp, Homo sapiens
agccatcaagagactga

SEQ ID NO: 905793 - DNA, 18 bp, Homo sapiens
agccatcacttctccccg

SEQ ID NO: 905794 - DNA, 18 bp, Homo sapiens
agccatcccttcggagcc

SEQ ID NO: 905795 - DNA, 14 bp, Homo sapiens
agccatcccttggg

SEQ ID NO: 905796 - DNA, 17 bp, Homo sapiens
agccatcccttggggaa

SEQ ID NO: 905797 - DNA, 18 bp, Homo sapiens
agccatcccttggggaag

SEQ ID NO: 905798 - DNA, 20 bp, Homo sapiens
agccatccctttttttacat

SEQ ID NO: 905799 - DNA, 16 bp, Homo sapiens
agccatccgcagactg

SEQ ID NO: 905800 - DNA, 14 bp, Homo sapiens
agccatcctccctc

SEQ ID NO: 905801 - DNA, 22 bp, Homo sapiens
agccatcctccctccacctcaa

SEQ ID NO: 905802 - DNA, 16 bp, Homo sapiens
agccatcgtcctggga

SEQ ID NO: 905803 - DNA, 19 bp, Homo sapiens
agccatcgtcctgggactc

SEQ ID NO: 905804 - DNA, 12 bp, Homo sapiens
agccatctcagg

SEQ ID NO: 905805 - DNA, 14 bp, Homo sapiens
agccatctgcccag

SEQ ID NO: 905806 - DNA, 16 bp, Homo sapiens
agccatctgcccaggg

SEQ ID NO: 905807 - DNA, 23 bp, Homo sapiens
agccatgaagcattaaaatgcat

SEQ ID NO: 905808 - DNA, 18 bp, Homo sapiens
agccatgaggagttgctg

SEQ ID NO: 905809 - DNA, 23 bp, Homo sapiens
agccatgagttccagaaagtaaa

SEQ ID NO: 905810 - DNA, 17 bp, Homo sapiens
agccatgatttgtccca

SEQ ID NO: 905811 - DNA, 20 bp, Homo sapiens
agccatgatttgtcccagcc

SEQ ID NO: 905812 - DNA, 23 bp, Homo sapiens
agccatgatttgtcccagcctgg

SEQ ID NO: 905813 - DNA, 17 bp, Homo sapiens
agccatgattttctaaa

SEQ ID NO: 905814 - DNA, 20 bp, Homo sapiens
cagccctcacctctgaggac

SEQ ID NO: 905815 - DNA, 13 bp, Homo sapiens
cagccctcagttc

SEQ ID NO: 905816 - DNA, 13 bp, Homo sapiens
cagccctcatccc

SEQ ID NO: 905817 - DNA, 16 bp, Homo sapiens
cagccctccactccag

SEQ ID NO: 905818 - DNA, 20 bp, Homo sapiens
cagccctccccatggagcca

SEQ ID NO: 905819 - DNA, 18 bp, Homo sapiens
cagccctccctgcccctc

SEQ ID NO: 905820 - DNA, 22 bp, Homo sapiens
cagccctccctgcccctccctt

SEQ ID NO: 905821 - DNA, 14 bp, Homo sapiens
cagccctccctgtc

SEQ ID NO: 905822 - DNA, 16 bp, Homo sapiens
cagccctccctgtcct

SEQ ID NO: 905823 - DNA, 16 bp, Homo sapiens
cagccctccttcaggg

SEQ ID NO: 905824 - DNA, 15 bp, Homo sapiens
cagccctcggcctcc

SEQ ID NO: 905825 - DNA, 16 bp, Homo sapiens
cagccctctgcctcct

SEQ ID NO: 905826 - DNA, 13 bp, Homo sapiens
cagccctgaccct

SEQ ID NO: 905827 - DNA, 17 bp, Homo sapiens
cagccctgagtggtcac

SEQ ID NO: 905828 - DNA, 18 bp, Homo sapiens
cagccctgagtggtcact

SEQ ID NO: 905829 - DNA, 13 bp, Homo sapiens
cagccctgcagcc

SEQ ID NO: 905830 - DNA, 16 bp, Homo sapiens
cagccctgcagcccaa

SEQ ID NO: 905831 - DNA, 11 bp, Homo sapiens
cagccctgctg

SEQ ID NO: 905832 - DNA, 22 bp, Homo sapiens
cagccctgctttgggctgccct

SEQ ID NO: 905833 - DNA, 15 bp, Homo sapiens
cagccctggcccacc

SEQ ID NO: 905834 - DNA, 21 bp, Homo sapiens
cagccctggcccaccccccag

SEQ ID NO: 905835 - DNA, 13 bp, Homo sapiens
cagccctggcccc

SEQ ID NO: 905836 - DNA, 13 bp, Homo sapiens
cagccctggcctt

SEQ ID NO: 905837 - DNA, 12 bp, Homo sapiens
cagccctggctc

SEQ ID NO: 905838 - DNA, 20 bp, Homo sapiens
cagccctgggaaccactccc

SEQ ID NO: 905839 - DNA, 12 bp, Homo sapiens
cagccctgggag

SEQ ID NO: 905840 - DNA, 18 bp, Homo sapiens
cagccctgggccccacca

SEQ ID NO: 905841 - DNA, 19 bp, Homo sapiens
cagccctgggccccaccac

SEQ ID NO: 905842 - DNA, 20 bp, Homo sapiens
cagccctgggccccaccacc

SEQ ID NO: 905843 - DNA, 18 bp, Homo sapiens
cagccctgggcttggctc

SEQ ID NO: 905844 - DNA, 22 bp, Homo sapiens
cagccctgggcttggctcttgg

SEQ ID NO: 905845 - DNA, 21 bp, Homo sapiens
cagccctgggggattcctgag

SEQ ID NO: 905846 - DNA, 23 bp, Homo sapiens
cagccctgggggattcctgagct

SEQ ID NO: 905847 - DNA, 13 bp, Homo sapiens
cagccctgtcctg

SEQ ID NO: 905848 - DNA, 17 bp, Homo sapiens
cagccctgtcctggttc

SEQ ID NO: 905849 - DNA, 22 bp, Homo sapiens
cagccctgtgtctgtcacaggc

SEQ ID NO: 905850 - DNA, 23 bp, Homo sapiens
cagccctgtgtctgtcacaggct

SEQ ID NO: 905851 - DNA, 24 bp, Homo sapiens
cagccctgtgtctgtcacaggctg

SEQ ID NO: 905852 - DNA, 21 bp, Homo sapiens
cagcccttagcacagagaggg

SEQ ID NO: 905853 - DNA, 13 bp, Homo sapiens
cagcccttcagac

SEQ ID NO: 905854 - DNA, 16 bp, Homo sapiens
cagcccttccaaactc

SEQ ID NO: 905855 - DNA, 11 bp, Homo sapiens
cagcccttcct

SEQ ID NO: 905856 - DNA, 14 bp, Homo sapiens
cagcccttcctcct

SEQ ID NO: 905857 - DNA, 15 bp, Homo sapiens
cagcccttcctcctg

SEQ ID NO: 905858 - DNA, 18 bp, Homo sapiens
cagcccttcctcctgaag

SEQ ID NO: 905859 - DNA, 16 bp, Homo sapiens
cagcccttccttgggc

SEQ ID NO: 905860 - DNA, 23 bp, Homo sapiens
cagcccttccttgggcgtctccc

SEQ ID NO: 905861 - DNA, 12 bp, Homo sapiens
cagcccttctgc

SEQ ID NO: 905862 - DNA, 16 bp, Homo sapiens
cagcccttctgccttt

SEQ ID NO: 905863 - DNA, 12 bp, Homo sapiens
cagcccttgccc

SEQ ID NO: 905864 - DNA, 15 bp, Homo sapiens
cagcccttgccccca

SEQ ID NO: 905865 - DNA, 15 bp, Homo sapiens
cagcccttgcttgtt

SEQ ID NO: 905866 - DNA, 23 bp, Homo sapiens
cagcccttgtgtgtgccctgggc

SEQ ID NO: 905867 - DNA, 22 bp, Homo sapiens
cagccctttgctctgatttcct

SEQ ID NO: 905868 - DNA, 23 bp, Homo sapiens
cagccgaccctcctggccttcct

SEQ ID NO: 905869 - DNA, 12 bp, Homo sapiens
cagccgagccgg

SEQ ID NO: 905870 - DNA, 17 bp, Homo sapiens
cagccgagccgggcctg

SEQ ID NO: 905871 - DNA, 19 bp, Homo sapiens
cagccgagccgggcctggg

SEQ ID NO: 905872 - DNA, 22 bp, Homo sapiens
cagccgagctcgtgtatcctgg

SEQ ID NO: 905873 - DNA, 19 bp, Homo sapiens
cagccgcagcctccctctg

SEQ ID NO: 905874 - DNA, 16 bp, Homo sapiens
cagccgcagcgcagcc

SEQ ID NO: 905875 - DNA, 20 bp, Homo sapiens
cagccgcattggtgactcac

SEQ ID NO: 905876 - DNA, 23 bp, Homo sapiens
cagccgccatgctcctggcccac

SEQ ID NO: 905877 - DNA, 17 bp, Homo sapiens
cagccgccattgccacc

SEQ ID NO: 905878 - DNA, 16 bp, Homo sapiens
cagccgccccagcccc

SEQ ID NO: 905879 - DNA, 14 bp, Homo sapiens
cagccgccctgggc

SEQ ID NO: 905880 - DNA, 15 bp, Homo sapiens
cagccgccctgggct

SEQ ID NO: 905881 - DNA, 18 bp, Homo sapiens
cagccgccttaagctgat

SEQ ID NO: 905882 - DNA, 19 bp, Homo sapiens
cagccgccttaagctgatc

SEQ ID NO: 905883 - DNA, 15 bp, Homo sapiens
cagccgctaggagag

SEQ ID NO: 905884 - DNA, 16 bp, Homo sapiens
cagccgctcctgtctg

SEQ ID NO: 905885 - DNA, 18 bp, Homo sapiens
cagccgctcctgtctgcc

SEQ ID NO: 905886 - DNA, 20 bp, Homo sapiens
cagccgctcctgtctgccag

SEQ ID NO: 905887 - DNA, 20 bp, Homo sapiens
cagccgctgcagggctccca

SEQ ID NO: 905888 - DNA, 14 bp, Homo sapiens
cagccggaggagga

SEQ ID NO: 905889 - DNA, 17 bp, Homo sapiens
cagccggcacagggtct

SEQ ID NO: 905890 - DNA, 23 bp, Homo sapiens
cagccggcacagggtctgctctt

SEQ ID NO: 905891 - DNA, 20 bp, Homo sapiens
cagccggccaatggaaacct

SEQ ID NO: 905892 - DNA, 15 bp, Homo sapiens
cagccggcctctctg

SEQ ID NO: 905893 - DNA, 18 bp, Homo sapiens
cagccggcctctctggcc

SEQ ID NO: 905894 - DNA, 19 bp, Homo sapiens
cagccggcctctctggcct

SEQ ID NO: 905895 - DNA, 22 bp, Homo sapiens
cagccggcctctctggcctccc

SEQ ID NO: 905896 - DNA, 12 bp, Homo sapiens
cagccgggccct

SEQ ID NO: 905897 - DNA, 13 bp, Homo sapiens
cagccgggccctg

SEQ ID NO: 905898 - DNA, 13 bp, Homo sapiens
cagccggtgcctg

SEQ ID NO: 905899 - DNA, 23 bp, Homo sapiens
cagccggttctgctagagcagac

SEQ ID NO: 905900 - DNA, 13 bp, Homo sapiens
cagccgtatttta

SEQ ID NO: 905901 - DNA, 15 bp, Homo sapiens
cagccgtattttaca

SEQ ID NO: 905902 - DNA, 15 bp, Homo sapiens
cagccgtcccaggcc

SEQ ID NO: 905903 - DNA, 18 bp, Homo sapiens
cagccgtcccaggccacc

SEQ ID NO: 905904 - DNA, 14 bp, Homo sapiens
cagccgtcccgcgt

SEQ ID NO: 905905 - DNA, 16 bp, Homo sapiens
cagccgtgatgctcag

SEQ ID NO: 905906 - DNA, 14 bp, Homo sapiens
cagccgtgccttca

SEQ ID NO: 905907 - DNA, 16 bp, Homo sapiens
cagccgtgccttcagc

SEQ ID NO: 905908 - DNA, 15 bp, Homo sapiens
cagcctaccatgaga

SEQ ID NO: 905909 - DNA, 19 bp, Homo sapiens
cagcctagcacagcagctt

SEQ ID NO: 905910 - DNA, 19 bp, Homo sapiens
cagcctagcctggctctgc

SEQ ID NO: 905911 - DNA, 14 bp, Homo sapiens
cagcctagggcaga

SEQ ID NO: 905912 - DNA, 21 bp, Homo sapiens
cagcctatgagcatcctgagc

SEQ ID NO: 905913 - DNA, 14 bp, Homo sapiens
cagcctatgggggc

SEQ ID NO: 905914 - DNA, 14 bp, Homo sapiens
cagcctcacagaag

SEQ ID NO: 905915 - DNA, 22 bp, Homo sapiens
cagcctcagaaggccccagaga

SEQ ID NO: 905916 - DNA, 14 bp, Homo sapiens
cagcctcagactgg

SEQ ID NO: 905917 - DNA, 12 bp, Homo sapiens
cagcctcagccc

SEQ ID NO: 905918 - DNA, 15 bp, Homo sapiens
cagcctcagcccaac

SEQ ID NO: 905919 - DNA, 22 bp, Homo sapiens
cagcctcaggcttgagggaggg

SEQ ID NO: 905920 - DNA, 15 bp, Homo sapiens
cagcctcagtgccac

SEQ ID NO: 905921 - DNA, 21 bp, Homo sapiens
cagcctcatactcctgggctc

SEQ ID NO: 905922 - DNA, 22 bp, Homo sapiens
cagcctcatcctccccaggacc

SEQ ID NO: 905923 - DNA, 21 bp, Homo sapiens
cagcctcattctgaggcctga

SEQ ID NO: 905924 - DNA, 16 bp, Homo sapiens
cagcctcattgtgcca

SEQ ID NO: 905925 - DNA, 23 bp, Homo sapiens
cagcctcattgtgccaagccttc

SEQ ID NO: 905926 - DNA, 20 bp, Homo sapiens
cagcctccaagctccatctc

SEQ ID NO: 905927 - DNA, 18 bp, Homo sapiens
cagcctccagagaagccc

SEQ ID NO: 905928 - DNA, 22 bp, Homo sapiens
cagcctccagagaagccccgca

SEQ ID NO: 905929 - DNA, 13 bp, Homo sapiens
cagcctccagagc

SEQ ID NO: 905930 - DNA, 18 bp, Homo sapiens
cagcctccagagccagcc

SEQ ID NO: 905931 - DNA, 19 bp, Homo sapiens
cagcctccagagccagcct

SEQ ID NO: 905932 - DNA, 18 bp, Homo sapiens
cagcctccaggcccccaa

SEQ ID NO: 905933 - DNA, 13 bp, Homo sapiens
cagcctccagggc

SEQ ID NO: 905934 - DNA, 14 bp, Homo sapiens
cagcctccatgctg

SEQ ID NO: 905935 - DNA, 15 bp, Homo sapiens
cagcctccatgctgc

SEQ ID NO: 905936 - DNA, 18 bp, Homo sapiens
cagcctcccaaagtgctg

SEQ ID NO: 905937 - DNA, 21 bp, Homo sapiens
cagcctcccaaagtgctggga

SEQ ID NO: 905938 - DNA, 14 bp, Homo sapiens
cagcctcccaagta

SEQ ID NO: 905939 - DNA, 14 bp, Homo sapiens
agccatgccagctg

SEQ ID NO: 905940 - DNA, 15 bp, Homo sapiens
agccatgcccgcatt

SEQ ID NO: 905941 - DNA, 14 bp, Homo sapiens
agccatgcctcatg

SEQ ID NO: 905942 - DNA, 15 bp, Homo sapiens
agccatgcctcatgc

SEQ ID NO: 905943 - DNA, 19 bp, Homo sapiens
agccatgctgggaagacgc

SEQ ID NO: 905944 - DNA, 12 bp, Homo sapiens
agccatggctca

SEQ ID NO: 905945 - DNA, 14 bp, Homo sapiens
agccatggctcagg

SEQ ID NO: 905946 - DNA, 19 bp, Homo sapiens
agccatggctcaggcaagc

SEQ ID NO: 905947 - DNA, 20 bp, Homo sapiens
agccatggctcaggcaagcc

SEQ ID NO: 905948 - DNA, 12 bp, Homo sapiens
agccatgggacc

SEQ ID NO: 905949 - DNA, 13 bp, Homo sapiens
agccatgggacct

SEQ ID NO: 905950 - DNA, 19 bp, Homo sapiens
agccatgggacctcctccc

SEQ ID NO: 905951 - DNA, 21 bp, Homo sapiens
agccatgggacctcctccctc

SEQ ID NO: 905952 - DNA, 13 bp, Homo sapiens
agccatgggcctg

SEQ ID NO: 905953 - DNA, 18 bp, Homo sapiens
agccatgggcctgggcct

SEQ ID NO: 905954 - DNA, 19 bp, Homo sapiens
agccatgggcctgggcctg

SEQ ID NO: 905955 - DNA, 17 bp, Homo sapiens
agccatgtatttcaggg

SEQ ID NO: 905956 - DNA, 18 bp, Homo sapiens
agccatgtatttcaggga

SEQ ID NO: 905957 - DNA, 16 bp, Homo sapiens
agccatgtccaagttc

SEQ ID NO: 905958 - DNA, 23 bp, Homo sapiens
agccatgtggggttgctgaagat

SEQ ID NO: 905959 - DNA, 16 bp, Homo sapiens
agccatgttaaatgac

SEQ ID NO: 905960 - DNA, 23 bp, Homo sapiens
agccattaaaataaaacaagcct

SEQ ID NO: 905961 - DNA, 18 bp, Homo sapiens
agccattaccatggagac

SEQ ID NO: 905962 - DNA, 23 bp, Homo sapiens
agccattagagcacagcttcttc

SEQ ID NO: 905963 - DNA, 20 bp, Homo sapiens
agccattcctggtacccagc

SEQ ID NO: 905964 - DNA, 22 bp, Homo sapiens
agccattcctggtacccagcca

SEQ ID NO: 905965 - DNA, 23 bp, Homo sapiens
agccattcctggtacccagccat

SEQ ID NO: 905966 - DNA, 13 bp, Homo sapiens
agccattctttta

SEQ ID NO: 905967 - DNA, 13 bp, Homo sapiens
agccattgaaatg

SEQ ID NO: 905968 - DNA, 21 bp, Homo sapiens
agccattgtaatttgaagatg

SEQ ID NO: 905969 - DNA, 17 bp, Homo sapiens
agccattgtggaagaca

SEQ ID NO: 905970 - DNA, 22 bp, Homo sapiens
agccatttcactctcaaacttc

SEQ ID NO: 905971 - DNA, 18 bp, Homo sapiens
agccatttccccctcctc

SEQ ID NO: 905972 - DNA, 19 bp, Homo sapiens
agccatttccccctcctca

SEQ ID NO: 905973 - DNA, 11 bp, Homo sapiens
agccatttctc

SEQ ID NO: 905974 - DNA, 22 bp, Homo sapiens
agccatttgttggggcagtggt

SEQ ID NO: 905975 - DNA, 12 bp, Homo sapiens
agccatttttaa

SEQ ID NO: 905976 - DNA, 14 bp, Homo sapiens
agccatttttaatg

SEQ ID NO: 905977 - DNA, 20 bp, Homo sapiens
agccatttttcaaagcaatt

SEQ ID NO: 905978 - DNA, 19 bp, Homo sapiens
agccattttttgaggagag

SEQ ID NO: 905979 - DNA, 15 bp, Homo sapiens
agcccaaaacccagg

SEQ ID NO: 905980 - DNA, 16 bp, Homo sapiens
agcccaaaacccaggg

SEQ ID NO: 905981 - DNA, 20 bp, Homo sapiens
agcccaaaccttgggccctg

SEQ ID NO: 905982 - DNA, 22 bp, Homo sapiens
agcccaaaccttgggccctgga

SEQ ID NO: 905983 - DNA, 16 bp, Homo sapiens
agcccaaagctgttgg

SEQ ID NO: 905984 - DNA, 21 bp, Homo sapiens
agcccaaaggggacaggcctc

SEQ ID NO: 905985 - DNA, 23 bp, Homo sapiens
agcccaaaggggacaggcctcac

SEQ ID NO: 905986 - DNA, 17 bp, Homo sapiens
agcccaaattcatataa

SEQ ID NO: 905987 - DNA, 20 bp, Homo sapiens
agcccaaccaggccctgcca

SEQ ID NO: 905988 - DNA, 23 bp, Homo sapiens
agcccaacttccagaggacagct

SEQ ID NO: 905989 - DNA, 16 bp, Homo sapiens
agcccaagggatctgg

SEQ ID NO: 905990 - DNA, 21 bp, Homo sapiens
agcccaagggatctggtccta

SEQ ID NO: 905991 - DNA, 22 bp, Homo sapiens
agcccaagggatctggtcctac

SEQ ID NO: 905992 - DNA, 21 bp, Homo sapiens
agcccaagttcatgcagctgt

SEQ ID NO: 905993 - DNA, 15 bp, Homo sapiens
agcccaatattataa

SEQ ID NO: 905994 - DNA, 17 bp, Homo sapiens
agcccacaaagccttat

SEQ ID NO: 905995 - DNA, 15 bp, Homo sapiens
agcccacacttgaga

SEQ ID NO: 905996 - DNA, 23 bp, Homo sapiens
agcccacacttgagaggatgaat

SEQ ID NO: 905997 - DNA, 15 bp, Homo sapiens
agcccacagagcctg

SEQ ID NO: 905998 - DNA, 20 bp, Homo sapiens
agcccacagcgagcctgtgc

SEQ ID NO: 905999 - DNA, 17 bp, Homo sapiens
agcccacaggcctgttc

SEQ ID NO: 906000 - DNA, 16 bp, Homo sapiens
agcccacagtatattt

SEQ ID NO: 906001 - DNA, 15 bp, Homo sapiens
agcccaccagccagc

SEQ ID NO: 906002 - DNA, 16 bp, Homo sapiens
agcccaccagccagcc

SEQ ID NO: 906003 - DNA, 14 bp, Homo sapiens
agcccacccccctc

SEQ ID NO: 906004 - DNA, 23 bp, Homo sapiens
agcccacccctcaacacctctgc

SEQ ID NO: 906005 - DNA, 11 bp, Homo sapiens
agcccacctga

SEQ ID NO: 906006 - DNA, 20 bp, Homo sapiens
agcccacctgaaagcctgtc

SEQ ID NO: 906007 - DNA, 14 bp, Homo sapiens
agcccacctgggct

SEQ ID NO: 906008 - DNA, 17 bp, Homo sapiens
agcccacctgggctggg

SEQ ID NO: 906009 - DNA, 17 bp, Homo sapiens
agcccactgcctcctgc

SEQ ID NO: 906010 - DNA, 17 bp, Homo sapiens
agcccagaacaaaaaga

SEQ ID NO: 906011 - DNA, 17 bp, Homo sapiens
agcccagaatccccaag

SEQ ID NO: 906012 - DNA, 14 bp, Homo sapiens
agcccagagaacag

SEQ ID NO: 906013 - DNA, 20 bp, Homo sapiens
agcccagagactttgtagat

SEQ ID NO: 906014 - DNA, 14 bp, Homo sapiens
agcccagagccacc

SEQ ID NO: 906015 - DNA, 16 bp, Homo sapiens
agcccagagccacctg

SEQ ID NO: 906016 - DNA, 21 bp, Homo sapiens
agcccagagcctggctgccca

SEQ ID NO: 906017 - DNA, 16 bp, Homo sapiens
agcccagatcagctcc

SEQ ID NO: 906018 - DNA, 17 bp, Homo sapiens
agcccagatcagctcct

SEQ ID NO: 906019 - DNA, 18 bp, Homo sapiens
agcccagatcagctccta

SEQ ID NO: 906020 - DNA, 22 bp, Homo sapiens
agcccagatgttttacgtctgg

SEQ ID NO: 906021 - DNA, 20 bp, Homo sapiens
agcccagcagggcctcaaag

SEQ ID NO: 906022 - DNA, 19 bp, Homo sapiens
agcccagcagtgtggagac

SEQ ID NO: 906023 - DNA, 22 bp, Homo sapiens
agcccagcagtgtggagaccct

SEQ ID NO: 906024 - DNA, 15 bp, Homo sapiens
agcccagcccagctg

SEQ ID NO: 906025 - DNA, 13 bp, Homo sapiens
agcccagcctgcc

SEQ ID NO: 906026 - DNA, 13 bp, Homo sapiens
agcccagcctggg

SEQ ID NO: 906027 - DNA, 14 bp, Homo sapiens
agcccagcgacaca

SEQ ID NO: 906028 - DNA, 18 bp, Homo sapiens
agcccagctacattcctc

SEQ ID NO: 906029 - DNA, 23 bp, Homo sapiens
agcccagctacattcctcagctg

SEQ ID NO: 906030 - DNA, 11 bp, Homo sapiens
agcccagctct

SEQ ID NO: 906031 - DNA, 12 bp, Homo sapiens
agcccagctctg

SEQ ID NO: 906032 - DNA, 13 bp, Homo sapiens
agcccagctcttg

SEQ ID NO: 906033 - DNA, 15 bp, Homo sapiens
agcccagctcttgct

SEQ ID NO: 906034 - DNA, 19 bp, Homo sapiens
agcccagctcttgctctct

SEQ ID NO: 906035 - DNA, 15 bp, Homo sapiens
agcccagctgggtca

SEQ ID NO: 906036 - DNA, 21 bp, Homo sapiens
agcccagctgggtcaggcagg

SEQ ID NO: 906037 - DNA, 13 bp, Homo sapiens
agcccagctggtg

SEQ ID NO: 906038 - DNA, 18 bp, Homo sapiens
agcccagcttcctggtgt

SEQ ID NO: 906039 - DNA, 21 bp, Homo sapiens
agcccagcttggccctttcct

SEQ ID NO: 906040 - DNA, 23 bp, Homo sapiens
agcccagcttggccctttccttc

SEQ ID NO: 906041 - DNA, 24 bp, Homo sapiens
agcccaggaatttgaagctgcagt

SEQ ID NO: 906042 - DNA, 13 bp, Homo sapiens
agcccaggagcaa

SEQ ID NO: 906043 - DNA, 15 bp, Homo sapiens
agcccaggagttcga

SEQ ID NO: 906044 - DNA, 19 bp, Homo sapiens
agcccaggatactggcaca

SEQ ID NO: 906045 - DNA, 23 bp, Homo sapiens
agcccaggatactggcacagagg

SEQ ID NO: 906046 - DNA, 11 bp, Homo sapiens
agcccaggccg

SEQ ID NO: 906047 - DNA, 21 bp, Homo sapiens
agcccaggccgttccccttgg

SEQ ID NO: 906048 - DNA, 14 bp, Homo sapiens
agcccagggcctgc

SEQ ID NO: 906049 - DNA, 14 bp, Homo sapiens
agcccagggctcct

SEQ ID NO: 906050 - DNA, 15 bp, Homo sapiens
agcccagggctcctg

SEQ ID NO: 906051 - DNA, 17 bp, Homo sapiens
agcccagggctcctgca

SEQ ID NO: 906052 - DNA, 21 bp, Homo sapiens
agcccaggggagaatgcagcc

SEQ ID NO: 906053 - DNA, 13 bp, Homo sapiens
agcccaggggccg

SEQ ID NO: 906054 - DNA, 16 bp, Homo sapiens
agcccagggttccccc

SEQ ID NO: 906055 - DNA, 16 bp, Homo sapiens
agcccagtcgagacct

SEQ ID NO: 906056 - DNA, 14 bp, Homo sapiens
agcccagtgaagcc

SEQ ID NO: 906057 - DNA, 16 bp, Homo sapiens
agcccagtgaagcctc

SEQ ID NO: 906058 - DNA, 18 bp, Homo sapiens
agcccagtgaagcctctg

SEQ ID NO: 906059 - DNA, 14 bp, Homo sapiens
agcccagtgcttct

SEQ ID NO: 906060 - DNA, 14 bp, Homo sapiens
agcccataaccagt

SEQ ID NO: 906061 - DNA, 14 bp, Homo sapiens
agcccataaggcca

SEQ ID NO: 906062 - DNA, 20 bp, Homo sapiens
agcccatactcagcctgctg

SEQ ID NO: 906063 - DNA, 24 bp, Homo sapiens
agcccataggccaccccctatcct

SEQ ID NO: 906064 - DNA, 20 bp, Homo sapiens
cagcctcccaattagcttgg

SEQ ID NO: 906065 - DNA, 19 bp, Homo sapiens
cagcctcccacccccatct

SEQ ID NO: 906066 - DNA, 18 bp, Homo sapiens
cagcctcccatccagggc

SEQ ID NO: 906067 - DNA, 19 bp, Homo sapiens
cagcctcccatccagggcc

SEQ ID NO: 906068 - DNA, 21 bp, Homo sapiens
cagcctccccaccccagtggg

SEQ ID NO: 906069 - DNA, 18 bp, Homo sapiens
cagcctcccccgccagcc

SEQ ID NO: 906070 - DNA, 21 bp, Homo sapiens
cagcctcccccgccagcccca

SEQ ID NO: 906071 - DNA, 21 bp, Homo sapiens
cagcctcccctcccctgggga

SEQ ID NO: 906072 - DNA, 22 bp, Homo sapiens
cagcctcccctcccctggggac

SEQ ID NO: 906073 - DNA, 20 bp, Homo sapiens
cagcctcccctgccagggca

SEQ ID NO: 906074 - DNA, 20 bp, Homo sapiens
cagcctccccttcttcccgc

SEQ ID NO: 906075 - DNA, 19 bp, Homo sapiens
cagcctcccgagtagctgg

SEQ ID NO: 906076 - DNA, 15 bp, Homo sapiens
cagcctccctctgac

SEQ ID NO: 906077 - DNA, 24 bp, Homo sapiens
cagcctccctgagcctgcattctg

SEQ ID NO: 906078 - DNA, 16 bp, Homo sapiens
cagcctccctgtctcc

SEQ ID NO: 906079 - DNA, 20 bp, Homo sapiens
cagcctccctgtctccagct

SEQ ID NO: 906080 - DNA, 17 bp, Homo sapiens
cagcctccgtcatccat

SEQ ID NO: 906081 - DNA, 13 bp, Homo sapiens
cagcctcctcctg

SEQ ID NO: 906082 - DNA, 15 bp, Homo sapiens
cagcctcctcctgac

SEQ ID NO: 906083 - DNA, 17 bp, Homo sapiens
cagcctcctctggacgg

SEQ ID NO: 906084 - DNA, 23 bp, Homo sapiens
cagcctcctctggacggcaggct

SEQ ID NO: 906085 - DNA, 16 bp, Homo sapiens
cagcctcctgagcctg

SEQ ID NO: 906086 - DNA, 17 bp, Homo sapiens
cagcctcctgagcctgt

SEQ ID NO: 906087 - DNA, 18 bp, Homo sapiens
cagcctcctgagcctgtg

SEQ ID NO: 906088 - DNA, 16 bp, Homo sapiens
cagcctcctgtttggt

SEQ ID NO: 906089 - DNA, 22 bp, Homo sapiens
cagcctccttgctgaccccagg

SEQ ID NO: 906090 - DNA, 20 bp, Homo sapiens
cagcctcctttgtgtgtatt

SEQ ID NO: 906091 - DNA, 22 bp, Homo sapiens
cagcctcgagtgcccctgtccc

SEQ ID NO: 906092 - DNA, 22 bp, Homo sapiens
cagcctcgtggagctcgcccct

SEQ ID NO: 906093 - DNA, 18 bp, Homo sapiens
cagcctcgttggaagagg

SEQ ID NO: 906094 - DNA, 19 bp, Homo sapiens
cagcctcgttggagagcag

SEQ ID NO: 906095 - DNA, 19 bp, Homo sapiens
cagcctctacagccgtccc

SEQ ID NO: 906096 - DNA, 16 bp, Homo sapiens
cagcctctccccaggt

SEQ ID NO: 906097 - DNA, 23 bp, Homo sapiens
cagcctctccccaggtccagctc

SEQ ID NO: 906098 - DNA, 19 bp, Homo sapiens
cagcctctcccggctgcct

SEQ ID NO: 906099 - DNA, 21 bp, Homo sapiens
cagcctctcccggctgcctgc

SEQ ID NO: 906100 - DNA, 14 bp, Homo sapiens
cagcctctctggct

SEQ ID NO: 906101 - DNA, 12 bp, Homo sapiens
cagcctctgaag

SEQ ID NO: 906102 - DNA, 20 bp, Homo sapiens
cagcctctgaagttggacag

SEQ ID NO: 906103 - DNA, 21 bp, Homo sapiens
cagcctctgaagttggacagc

SEQ ID NO: 906104 - DNA, 23 bp, Homo sapiens
cagcctctgacttaagctgcctc

SEQ ID NO: 906105 - DNA, 17 bp, Homo sapiens
cagcctctgcaactgca

SEQ ID NO: 906106 - DNA, 19 bp, Homo sapiens
cagcctctgcaactgcaag

SEQ ID NO: 906107 - DNA, 13 bp, Homo sapiens
cagcctctgcctc

SEQ ID NO: 906108 - DNA, 13 bp, Homo sapiens
cagcctctggaca

SEQ ID NO: 906109 - DNA, 18 bp, Homo sapiens
cagcctctggacagccag

SEQ ID NO: 906110 - DNA, 21 bp, Homo sapiens
cagcctctggacagccagtga

SEQ ID NO: 906111 - DNA, 13 bp, Homo sapiens
cagcctcttactt

SEQ ID NO: 906112 - DNA, 11 bp, Homo sapiens
cagcctcttgc

SEQ ID NO: 906113 - DNA, 18 bp, Homo sapiens
cagcctcttggccccaga

SEQ ID NO: 906114 - DNA, 17 bp, Homo sapiens
cagcctgaacagaagct

SEQ ID NO: 906115 - DNA, 15 bp, Homo sapiens
cagcctgaagcctgg

SEQ ID NO: 906116 - DNA, 16 bp, Homo sapiens
cagcctgaagcctgga

SEQ ID NO: 906117 - DNA, 20 bp, Homo sapiens
cagcctgaagcctggattcc

SEQ ID NO: 906118 - DNA, 22 bp, Homo sapiens
cagcctgaccttccttcctgtt

SEQ ID NO: 906119 - DNA, 20 bp, Homo sapiens
cagcctgagcaactcttgat

SEQ ID NO: 906120 - DNA, 17 bp, Homo sapiens
cagcctgagtctcctgt

SEQ ID NO: 906121 - DNA, 18 bp, Homo sapiens
cagcctgagtctcctgtg

SEQ ID NO: 906122 - DNA, 19 bp, Homo sapiens
cagcctgagtctcctgtgc

SEQ ID NO: 906123 - DNA, 16 bp, Homo sapiens
cagcctgatggccaag

SEQ ID NO: 906124 - DNA, 21 bp, Homo sapiens
cagcctgcaggacctcgtgcc

SEQ ID NO: 906125 - DNA, 20 bp, Homo sapiens
cagcctgcccacctctccct

SEQ ID NO: 906126 - DNA, 23 bp, Homo sapiens
cagcctgccccctatcttgtcct

SEQ ID NO: 906127 - DNA, 17 bp, Homo sapiens
cagcctgctccagctgt

SEQ ID NO: 906128 - DNA, 20 bp, Homo sapiens
cagcctgctccagctgttca

SEQ ID NO: 906129 - DNA, 12 bp, Homo sapiens
cagcctgctctg

SEQ ID NO: 906130 - DNA, 14 bp, Homo sapiens
cagcctgctgccca

SEQ ID NO: 906131 - DNA, 14 bp, Homo sapiens
cagcctgctggcag

SEQ ID NO: 906132 - DNA, 17 bp, Homo sapiens
cagcctgctggcagggc

SEQ ID NO: 906133 - DNA, 21 bp, Homo sapiens
cagcctgctggcagggccagg

SEQ ID NO: 906134 - DNA, 15 bp, Homo sapiens
cagcctgctggggct

SEQ ID NO: 906135 - DNA, 13 bp, Homo sapiens
cagcctgctttgg

SEQ ID NO: 906136 - DNA, 17 bp, Homo sapiens
cagcctggagacttcct

SEQ ID NO: 906137 - DNA, 18 bp, Homo sapiens
cagcctggagaggcctgg

SEQ ID NO: 906138 - DNA, 13 bp, Homo sapiens
cagcctggcacag

SEQ ID NO: 906139 - DNA, 20 bp, Homo sapiens
cagcctggcacagggcagtg

SEQ ID NO: 906140 - DNA, 13 bp, Homo sapiens
cagcctggcatct

SEQ ID NO: 906141 - DNA, 19 bp, Homo sapiens
cagcctggcatctgtgcgt

SEQ ID NO: 906142 - DNA, 21 bp, Homo sapiens
cagcctggcttctggagccct

SEQ ID NO: 906143 - DNA, 12 bp, Homo sapiens
cagcctgggaca

SEQ ID NO: 906144 - DNA, 14 bp, Homo sapiens
cagcctgggacaca

SEQ ID NO: 906145 - DNA, 16 bp, Homo sapiens
cagcctgggactccca

SEQ ID NO: 906146 - DNA, 16 bp, Homo sapiens
cagcctgggcaatgtg

SEQ ID NO: 906147 - DNA, 17 bp, Homo sapiens
cagcctgggcagccagg

SEQ ID NO: 906148 - DNA, 19 bp, Homo sapiens
cagcctgggcagccaggct

SEQ ID NO: 906149 - DNA, 20 bp, Homo sapiens
cagcctgggcagccaggctg

SEQ ID NO: 906150 - DNA, 11 bp, Homo sapiens
cagcctgggcc

SEQ ID NO: 906151 - DNA, 20 bp, Homo sapiens
cagcctgggccatctcttag

SEQ ID NO: 906152 - DNA, 14 bp, Homo sapiens
cagcctgggcccat

SEQ ID NO: 906153 - DNA, 18 bp, Homo sapiens
cagcctgggcccatctcc

SEQ ID NO: 906154 - DNA, 17 bp, Homo sapiens
cagcctgggctccctct

SEQ ID NO: 906155 - DNA, 17 bp, Homo sapiens
cagcctggggctccctc

SEQ ID NO: 906156 - DNA, 20 bp, Homo sapiens
cagcctggggctccctctct

SEQ ID NO: 906157 - DNA, 22 bp, Homo sapiens
cagcctggggctccctctctgg

SEQ ID NO: 906158 - DNA, 24 bp, Homo sapiens
cagcctggggctccctctctggtt

SEQ ID NO: 906159 - DNA, 14 bp, Homo sapiens
cagcctggggctct

SEQ ID NO: 906160 - DNA, 18 bp, Homo sapiens
cagcctggggctctctga

SEQ ID NO: 906161 - DNA, 22 bp, Homo sapiens
cagcctggggctctctgacccg

SEQ ID NO: 906162 - DNA, 14 bp, Homo sapiens
cagcctgggtgacg

SEQ ID NO: 906163 - DNA, 16 bp, Homo sapiens
cagcctggtgggcctc

SEQ ID NO: 906164 - DNA, 17 bp, Homo sapiens
cagcctggtgggcctcc

SEQ ID NO: 906165 - DNA, 22 bp, Homo sapiens
cagcctggtttgcaaagaccac

SEQ ID NO: 906166 - DNA, 24 bp, Homo sapiens
cagcctggtttgcaaagaccacct

SEQ ID NO: 906167 - DNA, 21 bp, Homo sapiens
cagcctgtcccatggacactc

SEQ ID NO: 906168 - DNA, 13 bp, Homo sapiens
cagcctgtcctgg

SEQ ID NO: 906169 - DNA, 18 bp, Homo sapiens
cagcctgtcctggtacag

SEQ ID NO: 906170 - DNA, 19 bp, Homo sapiens
cagcctgtggcggtgcctg

SEQ ID NO: 906171 - DNA, 22 bp, Homo sapiens
cagcctgtggcggtgcctgggt

SEQ ID NO: 906172 - DNA, 20 bp, Homo sapiens
cagcctgtggcttggagtgg

SEQ ID NO: 906173 - DNA, 19 bp, Homo sapiens
cagcctgtggttacagtgc

SEQ ID NO: 906174 - DNA, 22 bp, Homo sapiens
cagcctgtggttacagtgcaga

SEQ ID NO: 906175 - DNA, 14 bp, Homo sapiens
cagccttaatattt

SEQ ID NO: 906176 - DNA, 17 bp, Homo sapiens
cagccttagatgcctcg

SEQ ID NO: 906177 - DNA, 19 bp, Homo sapiens
cagccttagctctcccaac

SEQ ID NO: 906178 - DNA, 21 bp, Homo sapiens
cagccttagctgccagtgctg

SEQ ID NO: 906179 - DNA, 15 bp, Homo sapiens
cagccttcccctccc

SEQ ID NO: 906180 - DNA, 18 bp, Homo sapiens
cagccttcccctccctgt

SEQ ID NO: 906181 - DNA, 21 bp, Homo sapiens
cagccttccccttgcccaggg

SEQ ID NO: 906182 - DNA, 19 bp, Homo sapiens
cagccttcctctgcagctg

SEQ ID NO: 906183 - DNA, 11 bp, Homo sapiens
cagccttcctt

SEQ ID NO: 906184 - DNA, 14 bp, Homo sapiens
cagccttccttctg

SEQ ID NO: 906185 - DNA, 21 bp, Homo sapiens
cagccttccttctgctcccac

SEQ ID NO: 906186 - DNA, 13 bp, Homo sapiens
cagccttcggagc

SEQ ID NO: 906187 - DNA, 14 bp, Homo sapiens
agcccatcacctct

SEQ ID NO: 906188 - DNA, 15 bp, Homo sapiens
agcccatcctgacca

SEQ ID NO: 906189 - DNA, 17 bp, Homo sapiens
agcccatcctgaccagc

SEQ ID NO: 906190 - DNA, 18 bp, Homo sapiens
agcccatccttccctttg

SEQ ID NO: 906191 - DNA, 15 bp, Homo sapiens
agcccatctcggagc

SEQ ID NO: 906192 - DNA, 22 bp, Homo sapiens
agcccatgcccacctgcccatc

SEQ ID NO: 906193 - DNA, 15 bp, Homo sapiens
agcccatggccccca

SEQ ID NO: 906194 - DNA, 23 bp, Homo sapiens
agcccatggcccccaataaaggc

SEQ ID NO: 906195 - DNA, 19 bp, Homo sapiens
agcccatgtcttctgctgt

SEQ ID NO: 906196 - DNA, 21 bp, Homo sapiens
agcccatgttctgcccccagc

SEQ ID NO: 906197 - DNA, 23 bp, Homo sapiens
agcccatgttctgcccccagccc

SEQ ID NO: 906198 - DNA, 14 bp, Homo sapiens
agcccattcttctg

SEQ ID NO: 906199 - DNA, 17 bp, Homo sapiens
agcccattgctgccaag

SEQ ID NO: 906200 - DNA, 23 bp, Homo sapiens
agcccattggccgagctcctggg

SEQ ID NO: 906201 - DNA, 22 bp, Homo sapiens
agccccaactccaggggcacct

SEQ ID NO: 906202 - DNA, 15 bp, Homo sapiens
agccccaagggctgg

SEQ ID NO: 906203 - DNA, 16 bp, Homo sapiens
agccccaagggctggg

SEQ ID NO: 906204 - DNA, 22 bp, Homo sapiens
agccccacagcctggcacgaag

SEQ ID NO: 906205 - DNA, 13 bp, Homo sapiens
agccccacccagg

SEQ ID NO: 906206 - DNA, 20 bp, Homo sapiens
agccccacccaggagggagg

SEQ ID NO: 906207 - DNA, 16 bp, Homo sapiens
agccccacccccagcc

SEQ ID NO: 906208 - DNA, 21 bp, Homo sapiens
agccccacccccagccaggct

SEQ ID NO: 906209 - DNA, 14 bp, Homo sapiens
agccccactgccag

SEQ ID NO: 906210 - DNA, 15 bp, Homo sapiens
agccccactgccagc

SEQ ID NO: 906211 - DNA, 16 bp, Homo sapiens
agccccactgccagca

SEQ ID NO: 906212 - DNA, 19 bp, Homo sapiens
agccccactgccagcagca

SEQ ID NO: 906213 - DNA, 17 bp, Homo sapiens
agccccacttcaccccc

SEQ ID NO: 906214 - DNA, 13 bp, Homo sapiens
agccccacttctg

SEQ ID NO: 906215 - DNA, 14 bp, Homo sapiens
agccccagaagaaa

SEQ ID NO: 906216 - DNA, 19 bp, Homo sapiens
agccccagacaacagccca

SEQ ID NO: 906217 - DNA, 21 bp, Homo sapiens
agccccagacaacagcccagg

SEQ ID NO: 906218 - DNA, 16 bp, Homo sapiens
agccccagactgggcc

SEQ ID NO: 906219 - DNA, 17 bp, Homo sapiens
agccccagagtgcttta

SEQ ID NO: 906220 - DNA, 23 bp, Homo sapiens
agccccagagtgctttaaaaaat

SEQ ID NO: 906221 - DNA, 15 bp, Homo sapiens
agccccagcactaac

SEQ ID NO: 906222 - DNA, 19 bp, Homo sapiens
agccccagcccagccccac

SEQ ID NO: 906223 - DNA, 13 bp, Homo sapiens
agccccagcccct

SEQ ID NO: 906224 - DNA, 12 bp, Homo sapiens
agccccagctga

SEQ ID NO: 906225 - DNA, 13 bp, Homo sapiens
agccccaggcagg

SEQ ID NO: 906226 - DNA, 12 bp, Homo sapiens
agccccaggcct

SEQ ID NO: 906227 - DNA, 15 bp, Homo sapiens
agccccaggcctctg

SEQ ID NO: 906228 - DNA, 18 bp, Homo sapiens
agccccaggcctggcctc

SEQ ID NO: 906229 - DNA, 12 bp, Homo sapiens
agccccagggcc

SEQ ID NO: 906230 - DNA, 15 bp, Homo sapiens
agccccagggcctgg

SEQ ID NO: 906231 - DNA, 16 bp, Homo sapiens
agccccagggcctggg

SEQ ID NO: 906232 - DNA, 18 bp, Homo sapiens
agccccagggtcttccct

SEQ ID NO: 906233 - DNA, 22 bp, Homo sapiens
agccccagggtcttccctacct

SEQ ID NO: 906234 - DNA, 19 bp, Homo sapiens
agccccaggtcttttcttt

SEQ ID NO: 906235 - DNA, 23 bp, Homo sapiens
agccccataattttttttttcct

SEQ ID NO: 906236 - DNA, 19 bp, Homo sapiens
agccccatcgccccaactc

SEQ ID NO: 906237 - DNA, 17 bp, Homo sapiens
agccccatctcatcctg

SEQ ID NO: 906238 - DNA, 14 bp, Homo sapiens
agcccccacccggg

SEQ ID NO: 906239 - DNA, 19 bp, Homo sapiens
agcccccaccgtgggcagg

SEQ ID NO: 906240 - DNA, 14 bp, Homo sapiens
agcccccagccctg

SEQ ID NO: 906241 - DNA, 22 bp, Homo sapiens
agcccccagccctgggaaccac

SEQ ID NO: 906242 - DNA, 15 bp, Homo sapiens
agcccccaggatctg

SEQ ID NO: 906243 - DNA, 16 bp, Homo sapiens
agcccccaggatctgg

SEQ ID NO: 906244 - DNA, 18 bp, Homo sapiens
agcccccaggctgctgga

SEQ ID NO: 906245 - DNA, 22 bp, Homo sapiens
agccccccagagagagctctgc

SEQ ID NO: 906246 - DNA, 13 bp, Homo sapiens
agccccccagcac

SEQ ID NO: 906247 - DNA, 18 bp, Homo sapiens
agcccccccaacactgtg

SEQ ID NO: 906248 - DNA, 19 bp, Homo sapiens
agcccccccaacactgtgc

SEQ ID NO: 906249 - DNA, 21 bp, Homo sapiens
agcccccccaacactgtgccc

SEQ ID NO: 906250 - DNA, 23 bp, Homo sapiens
agcccccccaacactgtgccctg

SEQ ID NO: 906251 - DNA, 16 bp, Homo sapiens
agcccccccacccacc

SEQ ID NO: 906252 - DNA, 19 bp, Homo sapiens
agcccccccacccaccccc

SEQ ID NO: 906253 - DNA, 20 bp, Homo sapiens
agcccccccacccaccccca

SEQ ID NO: 906254 - DNA, 23 bp, Homo sapiens
agcccccccctcaaggggcaggg

SEQ ID NO: 906255 - DNA, 13 bp, Homo sapiens
agcccccctttgg

SEQ ID NO: 906256 - DNA, 15 bp, Homo sapiens
agcccccgccccaga

SEQ ID NO: 906257 - DNA, 16 bp, Homo sapiens
agcccccgccccagag

SEQ ID NO: 906258 - DNA, 22 bp, Homo sapiens
agcccccgccccgccccacatt

SEQ ID NO: 906259 - DNA, 15 bp, Homo sapiens
agcccccgggacacc

SEQ ID NO: 906260 - DNA, 17 bp, Homo sapiens
agccccctccagctcat

SEQ ID NO: 906261 - DNA, 20 bp, Homo sapiens
agccccctggatgggcattg

SEQ ID NO: 906262 - DNA, 21 bp, Homo sapiens
agccccctggcagctgcccct

SEQ ID NO: 906263 - DNA, 14 bp, Homo sapiens
agccccctggcctc

SEQ ID NO: 906264 - DNA, 15 bp, Homo sapiens
agccccctggcctct

SEQ ID NO: 906265 - DNA, 16 bp, Homo sapiens
agccccctggcctctg

SEQ ID NO: 906266 - DNA, 17 bp, Homo sapiens
agccccctggcctctgt

SEQ ID NO: 906267 - DNA, 16 bp, Homo sapiens
agccccgactccagcc

SEQ ID NO: 906268 - DNA, 18 bp, Homo sapiens
agccccgactccagccag

SEQ ID NO: 906269 - DNA, 14 bp, Homo sapiens
agccccgcacgggc

SEQ ID NO: 906270 - DNA, 15 bp, Homo sapiens
agccccgccccagcc

SEQ ID NO: 906271 - DNA, 21 bp, Homo sapiens
agccccgccccagccctcagt

SEQ ID NO: 906272 - DNA, 14 bp, Homo sapiens
agccccgccctctt

SEQ ID NO: 906273 - DNA, 15 bp, Homo sapiens
agccccgctcaggcc

SEQ ID NO: 906274 - DNA, 22 bp, Homo sapiens
agccccgctcaggcctaggagg

SEQ ID NO: 906275 - DNA, 14 bp, Homo sapiens
agccccgctcccac

SEQ ID NO: 906276 - DNA, 20 bp, Homo sapiens
agccccgctcctcccctctt

SEQ ID NO: 906277 - DNA, 14 bp, Homo sapiens
agccccggcccccc

SEQ ID NO: 906278 - DNA, 15 bp, Homo sapiens
agcccctacccctgc

SEQ ID NO: 906279 - DNA, 23 bp, Homo sapiens
agcccctactgctgtgaaccctg

SEQ ID NO: 906280 - DNA, 21 bp, Homo sapiens
agcccctatagcactgagctc

SEQ ID NO: 906281 - DNA, 13 bp, Homo sapiens
agcccctcagccc

SEQ ID NO: 906282 - DNA, 16 bp, Homo sapiens
agcccctcccaccaca

SEQ ID NO: 906283 - DNA, 18 bp, Homo sapiens
agcccctcccaccacagc

SEQ ID NO: 906284 - DNA, 15 bp, Homo sapiens
agcccctccccagcc

SEQ ID NO: 906285 - DNA, 16 bp, Homo sapiens
agcccctccccagcca

SEQ ID NO: 906286 - DNA, 21 bp, Homo sapiens
agcccctccccagccagccct

SEQ ID NO: 906287 - DNA, 22 bp, Homo sapiens
agcccctccccagccagccctt

SEQ ID NO: 906288 - DNA, 11 bp, Homo sapiens
agcccctcctc

SEQ ID NO: 906289 - DNA, 23 bp, Homo sapiens
agcccctcctccagcccctgtcc

SEQ ID NO: 906290 - DNA, 13 bp, Homo sapiens
agcccctcctctg

SEQ ID NO: 906291 - DNA, 16 bp, Homo sapiens
agcccctcctctgcca

SEQ ID NO: 906292 - DNA, 18 bp, Homo sapiens
agcccctcctctgccacc

SEQ ID NO: 906293 - DNA, 20 bp, Homo sapiens
agcccctcctctgccacctc

SEQ ID NO: 906294 - DNA, 21 bp, Homo sapiens
agcccctcctctgccacctcc

SEQ ID NO: 906295 - DNA, 13 bp, Homo sapiens
agcccctcgaggc

SEQ ID NO: 906296 - DNA, 16 bp, Homo sapiens
agcccctcgaggccta

SEQ ID NO: 906297 - DNA, 20 bp, Homo sapiens
agcccctcgaggcctacaga

SEQ ID NO: 906298 - DNA, 17 bp, Homo sapiens
agcccctcggctctgga

SEQ ID NO: 906299 - DNA, 11 bp, Homo sapiens
agcccctctct

SEQ ID NO: 906300 - DNA, 12 bp, Homo sapiens
agcccctctggt

SEQ ID NO: 906301 - DNA, 20 bp, Homo sapiens
agcccctctggtcgctcctg

SEQ ID NO: 906302 - DNA, 16 bp, Homo sapiens
agcccctcttgccccc

SEQ ID NO: 906303 - DNA, 17 bp, Homo sapiens
agcccctcttgcccccc

SEQ ID NO: 906304 - DNA, 17 bp, Homo sapiens
agcccctgaaagcctca

SEQ ID NO: 906305 - DNA, 18 bp, Homo sapiens
agcccctgaaagcctcac

SEQ ID NO: 906306 - DNA, 21 bp, Homo sapiens
agcccctgagtccgcctgcgc

SEQ ID NO: 906307 - DNA, 18 bp, Homo sapiens
agcccctgccctggggag

SEQ ID NO: 906308 - DNA, 18 bp, Homo sapiens
agcccctggacccctggg

SEQ ID NO: 906309 - DNA, 17 bp, Homo sapiens
agcccctggcaatccca

SEQ ID NO: 906310 - DNA, 16 bp, Homo sapiens
agcccctgggaacagg

SEQ ID NO: 906311 - DNA, 19 bp, Homo sapiens
agcccctgggcccttgtgc

SEQ ID NO: 906312 - DNA, 23 bp, Homo sapiens
cagccttcggagcgttctctgtc

SEQ ID NO: 906313 - DNA, 16 bp, Homo sapiens
cagccttctccatatc

SEQ ID NO: 906314 - DNA, 12 bp, Homo sapiens
cagccttctgag

SEQ ID NO: 906315 - DNA, 21 bp, Homo sapiens
cagccttctttttctggactc

SEQ ID NO: 906316 - DNA, 21 bp, Homo sapiens
cagccttgaactcctggcctc

SEQ ID NO: 906317 - DNA, 17 bp, Homo sapiens
cagccttgatcagtgac

SEQ ID NO: 906318 - DNA, 15 bp, Homo sapiens
cagccttgcacaccc

SEQ ID NO: 906319 - DNA, 18 bp, Homo sapiens
cagccttgcacacccact

SEQ ID NO: 906320 - DNA, 22 bp, Homo sapiens
cagccttgcacacccactgccc

SEQ ID NO: 906321 - DNA, 23 bp, Homo sapiens
cagccttgcacacccactgcccc

SEQ ID NO: 906322 - DNA, 13 bp, Homo sapiens
cagccttgcgctg

SEQ ID NO: 906323 - DNA, 16 bp, Homo sapiens
cagccttgcgctgtcc

SEQ ID NO: 906324 - DNA, 17 bp, Homo sapiens
cagccttgcgctgtccc

SEQ ID NO: 906325 - DNA, 21 bp, Homo sapiens
cagccttgcgctgtcccaggc

SEQ ID NO: 906326 - DNA, 11 bp, Homo sapiens
cagccttggaa

SEQ ID NO: 906327 - DNA, 21 bp, Homo sapiens
cagccttggataatgctgttg

SEQ ID NO: 906328 - DNA, 14 bp, Homo sapiens
cagccttgggcctt

SEQ ID NO: 906329 - DNA, 18 bp, Homo sapiens
cagccttgggggggctgc

SEQ ID NO: 906330 - DNA, 20 bp, Homo sapiens
cagccttgggggggctgcct

SEQ ID NO: 906331 - DNA, 23 bp, Homo sapiens
cagccttgggggggctgcctttg

SEQ ID NO: 906332 - DNA, 21 bp, Homo sapiens
cagccttgttcctcagcaccc

SEQ ID NO: 906333 - DNA, 23 bp, Homo sapiens
cagcctttcgttctgctgaccaa

SEQ ID NO: 906334 - DNA, 16 bp, Homo sapiens
cagcctttgggtcctg

SEQ ID NO: 906335 - DNA, 22 bp, Homo sapiens
cagcctttgggtcctgggcagg

SEQ ID NO: 906336 - DNA, 13 bp, Homo sapiens
cagcctttgttaa

SEQ ID NO: 906337 - DNA, 18 bp, Homo sapiens
cagcgaagtagcttgctc

SEQ ID NO: 906338 - DNA, 22 bp, Homo sapiens
cagcgaagtagcttgctccctg

SEQ ID NO: 906339 - DNA, 21 bp, Homo sapiens
cagcgaagtctcatgggaagc

SEQ ID NO: 906340 - DNA, 14 bp, Homo sapiens
cagcgacccttggt

SEQ ID NO: 906341 - DNA, 17 bp, Homo sapiens
cagcgaccgccccctcc

SEQ ID NO: 906342 - DNA, 18 bp, Homo sapiens
cagcgaccgccccctcct

SEQ ID NO: 906343 - DNA, 18 bp, Homo sapiens
cagcgacgctcccctgag

SEQ ID NO: 906344 - DNA, 17 bp, Homo sapiens
cagcgactccgttggcc

SEQ ID NO: 906345 - DNA, 20 bp, Homo sapiens
cagcgactggatgctcgcca

SEQ ID NO: 906346 - DNA, 15 bp, Homo sapiens
cagcgagaaggagtg

SEQ ID NO: 906347 - DNA, 22 bp, Homo sapiens
cagcgagagagtttcaaaagca

SEQ ID NO: 906348 - DNA, 13 bp, Homo sapiens
cagcgagccacag

SEQ ID NO: 906349 - DNA, 17 bp, Homo sapiens
cagcgagccacaggaac

SEQ ID NO: 906350 - DNA, 16 bp, Homo sapiens
cagcgaggaggctcca

SEQ ID NO: 906351 - DNA, 15 bp, Homo sapiens
cagcgagggcagctg

SEQ ID NO: 906352 - DNA, 18 bp, Homo sapiens
cagcgagggcagctgcta

SEQ ID NO: 906353 - DNA, 13 bp, Homo sapiens
cagcgaggtggga

SEQ ID NO: 906354 - DNA, 22 bp, Homo sapiens
cagcgaggtgggagaggcctca

SEQ ID NO: 906355 - DNA, 19 bp, Homo sapiens
cagcgatgtatataagcca

SEQ ID NO: 906356 - DNA, 23 bp, Homo sapiens
cagcgatgtatgcagctatctgg

SEQ ID NO: 906357 - DNA, 17 bp, Homo sapiens
cagcgcagccgccgggc

SEQ ID NO: 906358 - DNA, 23 bp, Homo sapiens
cagcgcagccgccgggcaggcct

SEQ ID NO: 906359 - DNA, 13 bp, Homo sapiens
cagcgcaggctgc

SEQ ID NO: 906360 - DNA, 15 bp, Homo sapiens
cagcgcaggctgcag

SEQ ID NO: 906361 - DNA, 19 bp, Homo sapiens
cagcgcaggctgcagagcc

SEQ ID NO: 906362 - DNA, 21 bp, Homo sapiens
cagcgcaggctgcagagcccg

SEQ ID NO: 906363 - DNA, 12 bp, Homo sapiens
cagcgcagggct

SEQ ID NO: 906364 - DNA, 14 bp, Homo sapiens
cagcgcagggctgg

SEQ ID NO: 906365 - DNA, 23 bp, Homo sapiens
cagcgccaaaacaagccaaagag

SEQ ID NO: 906366 - DNA, 19 bp, Homo sapiens
cagcgccaaatgttcatcc

SEQ ID NO: 906367 - DNA, 21 bp, Homo sapiens
cagcgccaaatgttcatcctc

SEQ ID NO: 906368 - DNA, 21 bp, Homo sapiens
cagcgccaagtaaacagggta

SEQ ID NO: 906369 - DNA, 14 bp, Homo sapiens
cagcgccagcctca

SEQ ID NO: 906370 - DNA, 18 bp, Homo sapiens
cagcgccaggctgaccac

SEQ ID NO: 906371 - DNA, 13 bp, Homo sapiens
cagcgccagggcc

SEQ ID NO: 906372 - DNA, 15 bp, Homo sapiens
cagcgccagggccca

SEQ ID NO: 906373 - DNA, 17 bp, Homo sapiens
cagcgccagggcccagg

SEQ ID NO: 906374 - DNA, 18 bp, Homo sapiens
cagcgcccaggcctgctg

SEQ ID NO: 906375 - DNA, 19 bp, Homo sapiens
cagcgcccaggcctgctgg

SEQ ID NO: 906376 - DNA, 20 bp, Homo sapiens
cagcgcccagggaggagtca

SEQ ID NO: 906377 - DNA, 16 bp, Homo sapiens
cagcgcccgctgggct

SEQ ID NO: 906378 - DNA, 19 bp, Homo sapiens
cagcgcccgctgggctgag

SEQ ID NO: 906379 - DNA, 18 bp, Homo sapiens
cagcgcctccctccaccc

SEQ ID NO: 906380 - DNA, 13 bp, Homo sapiens
cagcgcctttccc

SEQ ID NO: 906381 - DNA, 14 bp, Homo sapiens
cagcgcctttccca

SEQ ID NO: 906382 - DNA, 22 bp, Homo sapiens
cagcgcctttcccaactctagc

SEQ ID NO: 906383 - DNA, 15 bp, Homo sapiens
cagcgcggaggagga

SEQ ID NO: 906384 - DNA, 19 bp, Homo sapiens
cagcgctcgccacgctcag

SEQ ID NO: 906385 - DNA, 21 bp, Homo sapiens
cagcgctcgccacgctcagtg

SEQ ID NO: 906386 - DNA, 22 bp, Homo sapiens
cagcgctcgccacgctcagtgc

SEQ ID NO: 906387 - DNA, 22 bp, Homo sapiens
cagcgctgtatttacagacaca

SEQ ID NO: 906388 - DNA, 17 bp, Homo sapiens
cagcggaaacaggtgtg

SEQ ID NO: 906389 - DNA, 22 bp, Homo sapiens
cagcggaggtgtggagccgagg

SEQ ID NO: 906390 - DNA, 17 bp, Homo sapiens
cagcggagtctgtcctg

SEQ ID NO: 906391 - DNA, 15 bp, Homo sapiens
cagcggattgctctg

SEQ ID NO: 906392 - DNA, 21 bp, Homo sapiens
cagcggattgctctggagcag

SEQ ID NO: 906393 - DNA, 22 bp, Homo sapiens
cagcggattgctctggagcagc

SEQ ID NO: 906394 - DNA, 12 bp, Homo sapiens
cagcggcccccc

SEQ ID NO: 906395 - DNA, 19 bp, Homo sapiens
cagcggcccctcccacaca

SEQ ID NO: 906396 - DNA, 14 bp, Homo sapiens
cagcggcctcaggg

SEQ ID NO: 906397 - DNA, 20 bp, Homo sapiens
cagcggccttgaagacagag

SEQ ID NO: 906398 - DNA, 22 bp, Homo sapiens
cagcggccttgaagacagagca

SEQ ID NO: 906399 - DNA, 16 bp, Homo sapiens
cagcggctccagctca

SEQ ID NO: 906400 - DNA, 16 bp, Homo sapiens
cagcggctcccctctg

SEQ ID NO: 906401 - DNA, 16 bp, Homo sapiens
cagcggctctggtcct

SEQ ID NO: 906402 - DNA, 20 bp, Homo sapiens
cagcggcttagccaagccct

SEQ ID NO: 906403 - DNA, 14 bp, Homo sapiens
cagcgggagccagt

SEQ ID NO: 906404 - DNA, 17 bp, Homo sapiens
cagcgggagccagtggt

SEQ ID NO: 906405 - DNA, 20 bp, Homo sapiens
cagcgggcaggttctgcctg

SEQ ID NO: 906406 - DNA, 16 bp, Homo sapiens
cagcgggctgtgcccg

SEQ ID NO: 906407 - DNA, 18 bp, Homo sapiens
cagcggggccccagggct

SEQ ID NO: 906408 - DNA, 22 bp, Homo sapiens
cagcggggtggggggggagaga

SEQ ID NO: 906409 - DNA, 13 bp, Homo sapiens
cagcgggtctcct

SEQ ID NO: 906410 - DNA, 21 bp, Homo sapiens
cagcgggtctcctcccagcgg

SEQ ID NO: 906411 - DNA, 14 bp, Homo sapiens
cagcggtgggaagg

SEQ ID NO: 906412 - DNA, 15 bp, Homo sapiens
cagcggttcctgtgc

SEQ ID NO: 906413 - DNA, 18 bp, Homo sapiens
cagcggttcctgtgcaga

SEQ ID NO: 906414 - DNA, 21 bp, Homo sapiens
cagcggttcctgtgcagatgc

SEQ ID NO: 906415 - DNA, 14 bp, Homo sapiens
cagcgtcccctgct

SEQ ID NO: 906416 - DNA, 15 bp, Homo sapiens
cagcgtccctggcgc

SEQ ID NO: 906417 - DNA, 14 bp, Homo sapiens
cagcgtcctgtcca

SEQ ID NO: 906418 - DNA, 19 bp, Homo sapiens
cagcgtctgcagggtgacg

SEQ ID NO: 906419 - DNA, 21 bp, Homo sapiens
cagcgtgctggcgacactcag

SEQ ID NO: 906420 - DNA, 15 bp, Homo sapiens
cagcgtgggctctgc

SEQ ID NO: 906421 - DNA, 17 bp, Homo sapiens
cagcgtgggctctgcca

SEQ ID NO: 906422 - DNA, 18 bp, Homo sapiens
cagcgtgggctctgccaa

SEQ ID NO: 906423 - DNA, 13 bp, Homo sapiens
cagcgtgtggagc

SEQ ID NO: 906424 - DNA, 16 bp, Homo sapiens
cagcgtgtggagcaga

SEQ ID NO: 906425 - DNA, 18 bp, Homo sapiens
cagcgtgtggagcagagc

SEQ ID NO: 906426 - DNA, 20 bp, Homo sapiens
cagcgtgtggagcagagctc

SEQ ID NO: 906427 - DNA, 17 bp, Homo sapiens
cagcgttcccttctccc

SEQ ID NO: 906428 - DNA, 19 bp, Homo sapiens
cagcgtttctatgacacat

SEQ ID NO: 906429 - DNA, 12 bp, Homo sapiens
cagctaaagcaa

SEQ ID NO: 906430 - DNA, 19 bp, Homo sapiens
cagctaaagcaatatgcat

SEQ ID NO: 906431 - DNA, 18 bp, Homo sapiens
cagctaaagcccaacctc

SEQ ID NO: 906432 - DNA, 21 bp, Homo sapiens
cagctaaatgcagggaaactc

SEQ ID NO: 906433 - DNA, 20 bp, Homo sapiens
cagctaagctcacgtcctga

SEQ ID NO: 906434 - DNA, 22 bp, Homo sapiens
cagctaaggaggggaaaaaaat

SEQ ID NO: 906435 - DNA, 16 bp, Homo sapiens
cagctaatctgtaggg

SEQ ID NO: 906436 - DNA, 20 bp, Homo sapiens
agcccctgggcccttgtgct

SEQ ID NO: 906437 - DNA, 17 bp, Homo sapiens
agcccctggggcccagc

SEQ ID NO: 906438 - DNA, 18 bp, Homo sapiens
agcccctggggcccagcc

SEQ ID NO: 906439 - DNA, 19 bp, Homo sapiens
agcccctggggcccagccc

SEQ ID NO: 906440 - DNA, 21 bp, Homo sapiens
agcccctggggcccagcccct

SEQ ID NO: 906441 - DNA, 14 bp, Homo sapiens
agcccctggtcctg

SEQ ID NO: 906442 - DNA, 13 bp, Homo sapiens
agcccctggtctt

SEQ ID NO: 906443 - DNA, 18 bp, Homo sapiens
agcccctgtatggcactg

SEQ ID NO: 906444 - DNA, 11 bp, Homo sapiens
agcccctgtcc

SEQ ID NO: 906445 - DNA, 13 bp, Homo sapiens
agcccctgtccca

SEQ ID NO: 906446 - DNA, 13 bp, Homo sapiens
agcccctgtcgcc

SEQ ID NO: 906447 - DNA, 20 bp, Homo sapiens
agcccctgtgaccctctcac

SEQ ID NO: 906448 - DNA, 20 bp, Homo sapiens
agcccctgtttactggttct

SEQ ID NO: 906449 - DNA, 21 bp, Homo sapiens
agccccttcatccgcctgtgg

SEQ ID NO: 906450 - DNA, 23 bp, Homo sapiens
agccccttccttgctctgcaccc

SEQ ID NO: 906451 - DNA, 18 bp, Homo sapiens
agccccttctcagaatct

SEQ ID NO: 906452 - DNA, 19 bp, Homo sapiens
agccccttctgctcagctc

SEQ ID NO: 906453 - DNA, 12 bp, Homo sapiens
agccccttggag

SEQ ID NO: 906454 - DNA, 15 bp, Homo sapiens
agccccttggagaga

SEQ ID NO: 906455 - DNA, 14 bp, Homo sapiens
agcccctttgcctc

SEQ ID NO: 906456 - DNA, 15 bp, Homo sapiens
agcccctttgcctct

SEQ ID NO: 906457 - DNA, 16 bp, Homo sapiens
agcccctttgcctctg

SEQ ID NO: 906458 - DNA, 17 bp, Homo sapiens
agccccttttctctgct

SEQ ID NO: 906459 - DNA, 23 bp, Homo sapiens
agcccctttttcatatgttgctc

SEQ ID NO: 906460 - DNA, 13 bp, Homo sapiens
agcccgacagtgc

SEQ ID NO: 906461 - DNA, 17 bp, Homo sapiens
agcccgatattctccct

SEQ ID NO: 906462 - DNA, 20 bp, Homo sapiens
agcccgatattctccctgac

SEQ ID NO: 906463 - DNA, 15 bp, Homo sapiens
agcccgcacacctgc

SEQ ID NO: 906464 - DNA, 18 bp, Homo sapiens
agcccgcacccccaccct

SEQ ID NO: 906465 - DNA, 16 bp, Homo sapiens
agcccgcaggatcagg

SEQ ID NO: 906466 - DNA, 14 bp, Homo sapiens
agcccgcagggcca

SEQ ID NO: 906467 - DNA, 16 bp, Homo sapiens
agcccgcctccagcac

SEQ ID NO: 906468 - DNA, 20 bp, Homo sapiens
agcccgccttggctttctcc

SEQ ID NO: 906469 - DNA, 15 bp, Homo sapiens
agcccgcggcctgga

SEQ ID NO: 906470 - DNA, 16 bp, Homo sapiens
agcccgcggcctggac

SEQ ID NO: 906471 - DNA, 21 bp, Homo sapiens
agcccgctaggctcgccttcc

SEQ ID NO: 906472 - DNA, 20 bp, Homo sapiens
agcccggaccttggcagccc

SEQ ID NO: 906473 - DNA, 22 bp, Homo sapiens
agcccggccccacctccctgcg

SEQ ID NO: 906474 - DNA, 21 bp, Homo sapiens
agcccggccctcccccagctc

SEQ ID NO: 906475 - DNA, 22 bp, Homo sapiens
agcccggccctcccccagctcc

SEQ ID NO: 906476 - DNA, 19 bp, Homo sapiens
agcccggcctgctcccagc

SEQ ID NO: 906477 - DNA, 20 bp, Homo sapiens
agcccggcctgctcccagca

SEQ ID NO: 906478 - DNA, 20 bp, Homo sapiens
agcccggcgccaccatcctg

SEQ ID NO: 906479 - DNA, 21 bp, Homo sapiens
agcccggcgccaccatcctgc

SEQ ID NO: 906480 - DNA, 13 bp, Homo sapiens
agcccggctgctg

SEQ ID NO: 906481 - DNA, 14 bp, Homo sapiens
agcccggctgctgc

SEQ ID NO: 906482 - DNA, 19 bp, Homo sapiens
agcccggctgctgcttgga

SEQ ID NO: 906483 - DNA, 16 bp, Homo sapiens
agcccgggagcctagg

SEQ ID NO: 906484 - DNA, 13 bp, Homo sapiens
agcccgggctgcc

SEQ ID NO: 906485 - DNA, 21 bp, Homo sapiens
agcccgggtgtgcctgccctg

SEQ ID NO: 906486 - DNA, 16 bp, Homo sapiens
agcccggtaagagcaa

SEQ ID NO: 906487 - DNA, 22 bp, Homo sapiens
agcccggtaagagcaaaagaat

SEQ ID NO: 906488 - DNA, 16 bp, Homo sapiens
agcccgtcctcctcta

SEQ ID NO: 906489 - DNA, 15 bp, Homo sapiens
agcccgtctcagtgt

SEQ ID NO: 906490 - DNA, 20 bp, Homo sapiens
agcccgtgaagcagtgcctc

SEQ ID NO: 906491 - DNA, 18 bp, Homo sapiens
agcccgtgtggccccttc

SEQ ID NO: 906492 - DNA, 19 bp, Homo sapiens
agcccgttagccccaggga

SEQ ID NO: 906493 - DNA, 13 bp, Homo sapiens
agccctaaacatc

SEQ ID NO: 906494 - DNA, 15 bp, Homo sapiens
agccctaaacatcat

SEQ ID NO: 906495 - DNA, 21 bp, Homo sapiens
agccctaaacatcattcttga

SEQ ID NO: 906496 - DNA, 17 bp, Homo sapiens
agccctaacttctgtaa

SEQ ID NO: 906497 - DNA, 13 bp, Homo sapiens
agccctactccct

SEQ ID NO: 906498 - DNA, 15 bp, Homo sapiens
agccctactccctgc

SEQ ID NO: 906499 - DNA, 16 bp, Homo sapiens
agccctactccctgca

SEQ ID NO: 906500 - DNA, 17 bp, Homo sapiens
agccctactccctgcag

SEQ ID NO: 906501 - DNA, 14 bp, Homo sapiens
agccctactcctgc

SEQ ID NO: 906502 - DNA, 16 bp, Homo sapiens
agccctagctgtccca

SEQ ID NO: 906503 - DNA, 16 bp, Homo sapiens
agccctagggtggaga

SEQ ID NO: 906504 - DNA, 20 bp, Homo sapiens
agccctagggtggagagcca

SEQ ID NO: 906505 - DNA, 12 bp, Homo sapiens
agccctatggat

SEQ ID NO: 906506 - DNA, 18 bp, Homo sapiens
agccctcacctctgagga

SEQ ID NO: 906507 - DNA, 22 bp, Homo sapiens
agccctcagacatttatatatt

SEQ ID NO: 906508 - DNA, 10 bp, Homo sapiens
agccctcagg

SEQ ID NO: 906509 - DNA, 18 bp, Homo sapiens
agccctcaggctccccag

SEQ ID NO: 906510 - DNA, 21 bp, Homo sapiens
agccctcaggctccccagaac

SEQ ID NO: 906511 - DNA, 17 bp, Homo sapiens
agccctcagtcagttcc

SEQ ID NO: 906512 - DNA, 17 bp, Homo sapiens
agccctcagttccttca

SEQ ID NO: 906513 - DNA, 22 bp, Homo sapiens
agccctcatcccacttcctttc

SEQ ID NO: 906514 - DNA, 23 bp, Homo sapiens
agccctcatcccacttcctttcc

SEQ ID NO: 906515 - DNA, 20 bp, Homo sapiens
agccctcatttttataacct

SEQ ID NO: 906516 - DNA, 20 bp, Homo sapiens
agccctccactccagctctg

SEQ ID NO: 906517 - DNA, 17 bp, Homo sapiens
agccctccatggtcctg

SEQ ID NO: 906518 - DNA, 14 bp, Homo sapiens
agccctccccccag

SEQ ID NO: 906519 - DNA, 16 bp, Homo sapiens
agccctccccccagct

SEQ ID NO: 906520 - DNA, 17 bp, Homo sapiens
agccctccccccagctc

SEQ ID NO: 906521 - DNA, 18 bp, Homo sapiens
agccctccccccagctcc

SEQ ID NO: 906522 - DNA, 19 bp, Homo sapiens
agccctccccctcaacctc

SEQ ID NO: 906523 - DNA, 20 bp, Homo sapiens
agccctcccccttccccttc

SEQ ID NO: 906524 - DNA, 22 bp, Homo sapiens
agccctcccccttccccttctg

SEQ ID NO: 906525 - DNA, 16 bp, Homo sapiens
agccctccctgcccct

SEQ ID NO: 906526 - DNA, 17 bp, Homo sapiens
agccctccctgcccctc

SEQ ID NO: 906527 - DNA, 19 bp, Homo sapiens
agccctccctgcccctccc

SEQ ID NO: 906528 - DNA, 22 bp, Homo sapiens
agccctccctgcccctcccttc

SEQ ID NO: 906529 - DNA, 17 bp, Homo sapiens
agccctccctgtcctcc

SEQ ID NO: 906530 - DNA, 19 bp, Homo sapiens
agccctccctgtcctcctc

SEQ ID NO: 906531 - DNA, 22 bp, Homo sapiens
agccctccctgtcctcctcgga

SEQ ID NO: 906532 - DNA, 14 bp, Homo sapiens
agccctcctacgca

SEQ ID NO: 906533 - DNA, 12 bp, Homo sapiens
agccctccttca

SEQ ID NO: 906534 - DNA, 15 bp, Homo sapiens
agccctccttcaggg

SEQ ID NO: 906535 - DNA, 13 bp, Homo sapiens
agccctccttcca

SEQ ID NO: 906536 - DNA, 12 bp, Homo sapiens
agccctcctttg

SEQ ID NO: 906537 - DNA, 20 bp, Homo sapiens
agccctcctttggagcaaag

SEQ ID NO: 906538 - DNA, 20 bp, Homo sapiens
agccctcgaaccaaggcagc

SEQ ID NO: 906539 - DNA, 16 bp, Homo sapiens
agccctcggcctccga

SEQ ID NO: 906540 - DNA, 14 bp, Homo sapiens
agccctcgtctccc

SEQ ID NO: 906541 - DNA, 13 bp, Homo sapiens
agccctctcactc

SEQ ID NO: 906542 - DNA, 16 bp, Homo sapiens
agccctctgagccgcc

SEQ ID NO: 906543 - DNA, 20 bp, Homo sapiens
agccctctgcctcctcccca

SEQ ID NO: 906544 - DNA, 16 bp, Homo sapiens
agccctcttgcccgca

SEQ ID NO: 906545 - DNA, 20 bp, Homo sapiens
agccctctttaatgctgtct

SEQ ID NO: 906546 - DNA, 22 bp, Homo sapiens
agccctctttaatgctgtcttt

SEQ ID NO: 906547 - DNA, 17 bp, Homo sapiens
agccctgaatttcttct

SEQ ID NO: 906548 - DNA, 18 bp, Homo sapiens
agccctgaatttcttctt

SEQ ID NO: 906549 - DNA, 19 bp, Homo sapiens
agccctgaccttggctgac

SEQ ID NO: 906550 - DNA, 12 bp, Homo sapiens
agccctgagccc

SEQ ID NO: 906551 - DNA, 14 bp, Homo sapiens
agccctgagcccgg

SEQ ID NO: 906552 - DNA, 21 bp, Homo sapiens
agccctgaggacctctcagca

SEQ ID NO: 906553 - DNA, 20 bp, Homo sapiens
agccctgaggggctgggctg

SEQ ID NO: 906554 - DNA, 15 bp, Homo sapiens
agccctgagtggtca

SEQ ID NO: 906555 - DNA, 24 bp, Homo sapiens
agccctgagtggtcactggtcagg

SEQ ID NO: 906556 - DNA, 23 bp, Homo sapiens
agccctgatgtgtcctcagggag

SEQ ID NO: 906557 - DNA, 12 bp, Homo sapiens
agccctgcagcc

SEQ ID NO: 906558 - DNA, 18 bp, Homo sapiens
agccctgcataatgttaa

SEQ ID NO: 906559 - DNA, 20 bp, Homo sapiens
agccctgccccacacctcct

SEQ ID NO: 906560 - DNA, 12 bp, Homo sapiens
cagctacattcc

SEQ ID NO: 906561 - DNA, 17 bp, Homo sapiens
cagctacattcctcagc

SEQ ID NO: 906562 - DNA, 19 bp, Homo sapiens
cagctacattcctcagctg

SEQ ID NO: 906563 - DNA, 21 bp, Homo sapiens
cagctacattcctcagctgcc

SEQ ID NO: 906564 - DNA, 23 bp, Homo sapiens
cagctaccaccacggccaccact

SEQ ID NO: 906565 - DNA, 18 bp, Homo sapiens
cagctaccaggtgttcta

SEQ ID NO: 906566 - DNA, 23 bp, Homo sapiens
cagctaccccttctttgcagggc

SEQ ID NO: 906567 - DNA, 19 bp, Homo sapiens
cagctaccccttgtgggca

SEQ ID NO: 906568 - DNA, 21 bp, Homo sapiens
cagctacctcaaccaatgcca

SEQ ID NO: 906569 - DNA, 13 bp, Homo sapiens
cagctacctgaga

SEQ ID NO: 906570 - DNA, 20 bp, Homo sapiens
cagctactcaagaggctgag

SEQ ID NO: 906571 - DNA, 15 bp, Homo sapiens
cagctactcagaagc

SEQ ID NO: 906572 - DNA, 21 bp, Homo sapiens
cagctactcagaagcctgagg

SEQ ID NO: 906573 - DNA, 22 bp, Homo sapiens
cagctactcagaagcctgaggc

SEQ ID NO: 906574 - DNA, 13 bp, Homo sapiens
cagctactctccc

SEQ ID NO: 906575 - DNA, 18 bp, Homo sapiens
cagctactctgtccaggc

SEQ ID NO: 906576 - DNA, 20 bp, Homo sapiens
cagctactctgtccaggcca

SEQ ID NO: 906577 - DNA, 23 bp, Homo sapiens
cagctactctgtccaggccactg

SEQ ID NO: 906578 - DNA, 16 bp, Homo sapiens
cagctactggaatggt

SEQ ID NO: 906579 - DNA, 12 bp, Homo sapiens
cagctactgtaa

SEQ ID NO: 906580 - DNA, 13 bp, Homo sapiens
cagctactgtaac

SEQ ID NO: 906581 - DNA, 18 bp, Homo sapiens
cagctactgtaacttttt

SEQ ID NO: 906582 - DNA, 16 bp, Homo sapiens
cagctacttgggaagc

SEQ ID NO: 906583 - DNA, 20 bp, Homo sapiens
cagctacttgggagcctgag

SEQ ID NO: 906584 - DNA, 21 bp, Homo sapiens
cagctacttgggagcctgagg

SEQ ID NO: 906585 - DNA, 16 bp, Homo sapiens
cagctacttgggaggc

SEQ ID NO: 906586 - DNA, 18 bp, Homo sapiens
cagctagaagatccacat

SEQ ID NO: 906587 - DNA, 24 bp, Homo sapiens
cagctagaagatccacatcctcta

SEQ ID NO: 906588 - DNA, 15 bp, Homo sapiens
cagctagaatttctg

SEQ ID NO: 906589 - DNA, 14 bp, Homo sapiens
cagctagactggag

SEQ ID NO: 906590 - DNA, 16 bp, Homo sapiens
cagctagactggagtg

SEQ ID NO: 906591 - DNA, 19 bp, Homo sapiens
cagctaggtggggcctaga

SEQ ID NO: 906592 - DNA, 20 bp, Homo sapiens
cagctagtgccaaataattg

SEQ ID NO: 906593 - DNA, 12 bp, Homo sapiens
cagctagtgcct

SEQ ID NO: 906594 - DNA, 17 bp, Homo sapiens
cagctatctgcactcta

SEQ ID NO: 906595 - DNA, 22 bp, Homo sapiens
cagctatctgtcatctctctgg

SEQ ID NO: 906596 - DNA, 13 bp, Homo sapiens
cagctatgctggt

SEQ ID NO: 906597 - DNA, 15 bp, Homo sapiens
cagctatgggagccc

SEQ ID NO: 906598 - DNA, 17 bp, Homo sapiens
cagctatgggagcccca

SEQ ID NO: 906599 - DNA, 20 bp, Homo sapiens
cagctatgggagccccaggg

SEQ ID NO: 906600 - DNA, 21 bp, Homo sapiens
cagctatgggagccccagggt

SEQ ID NO: 906601 - DNA, 23 bp, Homo sapiens
cagctatgggagccccagggtct

SEQ ID NO: 906602 - DNA, 20 bp, Homo sapiens
cagctatgttatattgaaaa

SEQ ID NO: 906603 - DNA, 19 bp, Homo sapiens
cagctattaagaaaatcac

SEQ ID NO: 906604 - DNA, 20 bp, Homo sapiens
cagctatttcagcctcctgt

SEQ ID NO: 906605 - DNA, 23 bp, Homo sapiens
cagctattttaagccatctcaga

SEQ ID NO: 906606 - DNA, 14 bp, Homo sapiens
cagctattttgtga

SEQ ID NO: 906607 - DNA, 21 bp, Homo sapiens
cagctcaactcacagcttctc

SEQ ID NO: 906608 - DNA, 13 bp, Homo sapiens
cagctcacagtgc

SEQ ID NO: 906609 - DNA, 20 bp, Homo sapiens
cagctcacagtgctgtgtgc

SEQ ID NO: 906610 - DNA, 16 bp, Homo sapiens
cagctcacccctgggc

SEQ ID NO: 906611 - DNA, 18 bp, Homo sapiens
cagctcacccctgggcag

SEQ ID NO: 906612 - DNA, 19 bp, Homo sapiens
cagctcacccctgggcagg

SEQ ID NO: 906613 - DNA, 12 bp, Homo sapiens
cagctcagaacc

SEQ ID NO: 906614 - DNA, 19 bp, Homo sapiens
cagctcagaacccagggct

SEQ ID NO: 906615 - DNA, 20 bp, Homo sapiens
cagctcagaacccagggctc

SEQ ID NO: 906616 - DNA, 16 bp, Homo sapiens
cagctcagagatgaaa

SEQ ID NO: 906617 - DNA, 11 bp, Homo sapiens
cagctcagccc

SEQ ID NO: 906618 - DNA, 16 bp, Homo sapiens
cagctcagccctggcc

SEQ ID NO: 906619 - DNA, 11 bp, Homo sapiens
cagctcagcgc

SEQ ID NO: 906620 - DNA, 18 bp, Homo sapiens
cagctcagcgccagcctg

SEQ ID NO: 906621 - DNA, 14 bp, Homo sapiens
cagctcaggcagct

SEQ ID NO: 906622 - DNA, 23 bp, Homo sapiens
cagctcagttctagtctctctgg

SEQ ID NO: 906623 - DNA, 13 bp, Homo sapiens
cagctcatctcca

SEQ ID NO: 906624 - DNA, 17 bp, Homo sapiens
cagctcatgcccccttt

SEQ ID NO: 906625 - DNA, 23 bp, Homo sapiens
cagctcatgtaggtgagcctggg

SEQ ID NO: 906626 - DNA, 14 bp, Homo sapiens
cagctcattaaact

SEQ ID NO: 906627 - DNA, 22 bp, Homo sapiens
cagctcattataatgtcattaa

SEQ ID NO: 906628 - DNA, 16 bp, Homo sapiens
cagctcattatgaaaa

SEQ ID NO: 906629 - DNA, 18 bp, Homo sapiens
cagctcattatgaaaaac

SEQ ID NO: 906630 - DNA, 20 bp, Homo sapiens
cagctcattatgaaaaacat

SEQ ID NO: 906631 - DNA, 20 bp, Homo sapiens
cagctcatttaatcccagga

SEQ ID NO: 906632 - DNA, 21 bp, Homo sapiens
cagctccacacattccagcca

SEQ ID NO: 906633 - DNA, 15 bp, Homo sapiens
cagctccaccctggc

SEQ ID NO: 906634 - DNA, 16 bp, Homo sapiens
cagctccagaatacct

SEQ ID NO: 906635 - DNA, 19 bp, Homo sapiens
cagctccaggggcccttgg

SEQ ID NO: 906636 - DNA, 21 bp, Homo sapiens
cagctccagtgccgctcctgc

SEQ ID NO: 906637 - DNA, 17 bp, Homo sapiens
cagctcccaacgagcct

SEQ ID NO: 906638 - DNA, 14 bp, Homo sapiens
cagctcccacccca

SEQ ID NO: 906639 - DNA, 20 bp, Homo sapiens
cagctcccaccccaccccct

SEQ ID NO: 906640 - DNA, 23 bp, Homo sapiens
cagctcccaccccacccccttca

SEQ ID NO: 906641 - DNA, 19 bp, Homo sapiens
cagctccccaactccctgc

SEQ ID NO: 906642 - DNA, 19 bp, Homo sapiens
cagctccctaggagaccaa

SEQ ID NO: 906643 - DNA, 13 bp, Homo sapiens
cagctccctcctg

SEQ ID NO: 906644 - DNA, 15 bp, Homo sapiens
cagctccctcctgca

SEQ ID NO: 906645 - DNA, 18 bp, Homo sapiens
cagctccctcctgcacac

SEQ ID NO: 906646 - DNA, 14 bp, Homo sapiens
cagctccctgcacc

SEQ ID NO: 906647 - DNA, 15 bp, Homo sapiens
cagctccctgcaccg

SEQ ID NO: 906648 - DNA, 14 bp, Homo sapiens
cagctcccttccct

SEQ ID NO: 906649 - DNA, 18 bp, Homo sapiens
cagctccctttctcagga

SEQ ID NO: 906650 - DNA, 21 bp, Homo sapiens
cagctccctttctcaggagct

SEQ ID NO: 906651 - DNA, 17 bp, Homo sapiens
cagctccgacctctctc

SEQ ID NO: 906652 - DNA, 18 bp, Homo sapiens
cagctccgacctctctca

SEQ ID NO: 906653 - DNA, 16 bp, Homo sapiens
cagctccgcctgctgg

SEQ ID NO: 906654 - DNA, 22 bp, Homo sapiens
cagctccggagggggtcctcct

SEQ ID NO: 906655 - DNA, 12 bp, Homo sapiens
cagctcctcagc

SEQ ID NO: 906656 - DNA, 19 bp, Homo sapiens
aggaagcagttggggccct

SEQ ID NO: 906657 - DNA, 21 bp, Homo sapiens
aggaagcagttggggccctct

SEQ ID NO: 906658 - DNA, 15 bp, Homo sapiens
aggaagcattgtaaa

SEQ ID NO: 906659 - DNA, 17 bp, Homo sapiens
aggaagcattgtaaaat

SEQ ID NO: 906660 - DNA, 18 bp, Homo sapiens
aggaagccagtcaccttc

SEQ ID NO: 906661 - DNA, 15 bp, Homo sapiens
aggaagcccaggctc

SEQ ID NO: 906662 - DNA, 22 bp, Homo sapiens
aggaagccgccagtacttgtca

SEQ ID NO: 906663 - DNA, 20 bp, Homo sapiens
aggaagccggtgtccctgga

SEQ ID NO: 906664 - DNA, 22 bp, Homo sapiens
aggaagccggtgtccctggatg

SEQ ID NO: 906665 - DNA, 14 bp, Homo sapiens
aggaagccgtcctg

SEQ ID NO: 906666 - DNA, 20 bp, Homo sapiens
aggaagccgttgaatctggg

SEQ ID NO: 906667 - DNA, 22 bp, Homo sapiens
aggaagccgttgaatctgggag

SEQ ID NO: 906668 - DNA, 15 bp, Homo sapiens
aggaagcgtggggta

SEQ ID NO: 906669 - DNA, 15 bp, Homo sapiens
aggaagctccactgt

SEQ ID NO: 906670 - DNA, 16 bp, Homo sapiens
aggaagctccttcctg

SEQ ID NO: 906671 - DNA, 23 bp, Homo sapiens
aggaagcttggcttcctcttctt

SEQ ID NO: 906672 - DNA, 11 bp, Homo sapiens
aggaaggaaaa

SEQ ID NO: 906673 - DNA, 11 bp, Homo sapiens
aggaaggaaac

SEQ ID NO: 906674 - DNA, 12 bp, Homo sapiens
aggaaggaaact

SEQ ID NO: 906675 - DNA, 13 bp, Homo sapiens
aggaaggaaactg

SEQ ID NO: 906676 - DNA, 16 bp, Homo sapiens
aggaaggactatgaaa

SEQ ID NO: 906677 - DNA, 21 bp, Homo sapiens
aggaaggagactcacctctgc

SEQ ID NO: 906678 - DNA, 14 bp, Homo sapiens
aggaaggagagatg

SEQ ID NO: 906679 - DNA, 19 bp, Homo sapiens
aggaaggaggacccaggac

SEQ ID NO: 906680 - DNA, 14 bp, Homo sapiens
aggaaggagggcac

SEQ ID NO: 906681 - DNA, 14 bp, Homo sapiens
aggaaggaggggag

SEQ ID NO: 906682 - DNA, 13 bp, Homo sapiens
aggaaggcagctg

SEQ ID NO: 906683 - DNA, 14 bp, Homo sapiens
aggaaggcagctgc

SEQ ID NO: 906684 - DNA, 18 bp, Homo sapiens
aggaaggcagctgctctt

SEQ ID NO: 906685 - DNA, 15 bp, Homo sapiens
aggaaggcaggaggg

SEQ ID NO: 906686 - DNA, 21 bp, Homo sapiens
aggaaggccaaaatcaagagt

SEQ ID NO: 906687 - DNA, 14 bp, Homo sapiens
aggaaggcctttct

SEQ ID NO: 906688 - DNA, 14 bp, Homo sapiens
aggaagggaagcgt

SEQ ID NO: 906689 - DNA, 16 bp, Homo sapiens
aggaagggaccaaggc

SEQ ID NO: 906690 - DNA, 23 bp, Homo sapiens
aggaagggaccaaggcaaggcag

SEQ ID NO: 906691 - DNA, 14 bp, Homo sapiens
aggaagggagtgag

SEQ ID NO: 906692 - DNA, 17 bp, Homo sapiens
aggaagggatctgagaa

SEQ ID NO: 906693 - DNA, 12 bp, Homo sapiens
aggaagggcaaa

SEQ ID NO: 906694 - DNA, 18 bp, Homo sapiens
aggaaggggccagaggct

SEQ ID NO: 906695 - DNA, 20 bp, Homo sapiens
aggaaggggccagaggctcg

SEQ ID NO: 906696 - DNA, 14 bp, Homo sapiens
aggaaggtagaaat

SEQ ID NO: 906697 - DNA, 16 bp, Homo sapiens
aggaaggtgcctggcc

SEQ ID NO: 906698 - DNA, 21 bp, Homo sapiens
aggaaggtgctgagcttagcc

SEQ ID NO: 906699 - DNA, 15 bp, Homo sapiens
aggaaggtttttaag

SEQ ID NO: 906700 - DNA, 18 bp, Homo sapiens
aggaagtcaaagcaagga

SEQ ID NO: 906701 - DNA, 23 bp, Homo sapiens
aaaaagactgaacatgtttacag

SEQ ID NO: 906702 - DNA, 21 bp, Homo sapiens
aaaaagactgtcaaatgaact

SEQ ID NO: 906703 - DNA, 20 bp, Homo sapiens
aaaaagacttgagacaatgt

SEQ ID NO: 906704 - DNA, 20 bp, Homo sapiens
aaaaagagtatgagtcttct

SEQ ID NO: 906705 - DNA, 13 bp, Homo sapiens
aaaaagatatatt

SEQ ID NO: 906706 - DNA, 22 bp, Homo sapiens
aaaaagatatattaaaaatata

SEQ ID NO: 906707 - DNA, 14 bp, Homo sapiens
aaaaagatccaggg

SEQ ID NO: 906708 - DNA, 22 bp, Homo sapiens
aaaaagatggcctttgcttatg

SEQ ID NO: 906709 - DNA, 14 bp, Homo sapiens
aaaaagatgtacag

SEQ ID NO: 906710 - DNA, 15 bp, Homo sapiens
aaaaagattctacta

SEQ ID NO: 906711 - DNA, 20 bp, Homo sapiens
aaaaagcagcagaggtgaga

SEQ ID NO: 906712 - DNA, 17 bp, Homo sapiens
aaaaagcataaaaacat

SEQ ID NO: 906713 - DNA, 17 bp, Homo sapiens
aaaaagcctccaagggt

SEQ ID NO: 906714 - DNA, 19 bp, Homo sapiens
aaaaagctcatattttgta

SEQ ID NO: 906715 - DNA, 12 bp, Homo sapiens
aaaaagcttaaa

SEQ ID NO: 906716 - DNA, 17 bp, Homo sapiens
aaaaagcttaaaacttt

SEQ ID NO: 906717 - DNA, 13 bp, Homo sapiens
aaaaagcttcccc

SEQ ID NO: 906718 - DNA, 19 bp, Homo sapiens
aaaaaggaaatttgtttgt

SEQ ID NO: 906719 - DNA, 15 bp, Homo sapiens
aaaaaggatacataa

SEQ ID NO: 906720 - DNA, 14 bp, Homo sapiens
aaaaaggcaaatat

SEQ ID NO: 906721 - DNA, 14 bp, Homo sapiens
aaaaaggccaaaga

SEQ ID NO: 906722 - DNA, 16 bp, Homo sapiens
aaaaagggagtttttg

SEQ ID NO: 906723 - DNA, 21 bp, Homo sapiens
aaaaagggatccgtacattca

SEQ ID NO: 906724 - DNA, 16 bp, Homo sapiens
aaaaaggggaggagaa

SEQ ID NO: 906725 - DNA, 21 bp, Homo sapiens
aaaaaggttggagcagtgctt

SEQ ID NO: 906726 - DNA, 21 bp, Homo sapiens
aaaaagtaagttaataatgta

SEQ ID NO: 906727 - DNA, 23 bp, Homo sapiens
aaaaagtaatgacttagaaactg

SEQ ID NO: 906728 - DNA, 20 bp, Homo sapiens
aaaaagtcagactgctggga

SEQ ID NO: 906729 - DNA, 14 bp, Homo sapiens
aaaaagtctgtatg

SEQ ID NO: 906730 - DNA, 20 bp, Homo sapiens
aaaaagtctgtatggcatga

SEQ ID NO: 906731 - DNA, 17 bp, Homo sapiens
aaaaagtgaacttttgt

SEQ ID NO: 906732 - DNA, 17 bp, Homo sapiens
aaaaagtgacacagcag

SEQ ID NO: 906733 - DNA, 13 bp, Homo sapiens
aaaaagtttgttt

SEQ ID NO: 906734 - DNA, 17 bp, Homo sapiens
aaaaagttttatttttc

SEQ ID NO: 906735 - DNA, 21 bp, Homo sapiens
aaaaataaaaactgactcctt

SEQ ID NO: 906736 - DNA, 12 bp, Homo sapiens
aaaaataaaata

SEQ ID NO: 906737 - DNA, 13 bp, Homo sapiens
aaaaataaaatgt

SEQ ID NO: 906738 - DNA, 13 bp, Homo sapiens
aaaaataaaatta

SEQ ID NO: 906739 - DNA, 15 bp, Homo sapiens
aaaaataacactgtt

SEQ ID NO: 906740 - DNA, 14 bp, Homo sapiens
aaaaataactattt

SEQ ID NO: 906741 - DNA, 16 bp, Homo sapiens
aaaaataagaagaatg

SEQ ID NO: 906742 - DNA, 16 bp, Homo sapiens
aaaaataataataatg

SEQ ID NO: 906743 - DNA, 12 bp, Homo sapiens
aaaaataatcaa

SEQ ID NO: 906744 - DNA, 17 bp, Homo sapiens
aaaaataatcaagattt

SEQ ID NO: 906745 - DNA, 14 bp, Homo sapiens
aaaaatacatgcat

SEQ ID NO: 906746 - DNA, 14 bp, Homo sapiens
aaaaatacatgttc

SEQ ID NO: 906747 - DNA, 16 bp, Homo sapiens
aaaaataccattgaaa

SEQ ID NO: 906748 - DNA, 22 bp, Homo sapiens
aaaaataccattgaaatcagca

SEQ ID NO: 906749 - DNA, 22 bp, Homo sapiens
aaaaatacgttttgtgtatatt

SEQ ID NO: 906750 - DNA, 12 bp, Homo sapiens
aaaaatactacc

SEQ ID NO: 906751 - DNA, 11 bp, Homo sapiens
aaaaatacttc

SEQ ID NO: 906752 - DNA, 21 bp, Homo sapiens
aaaaatagagcaaaatcaaca

SEQ ID NO: 906753 - DNA, 21 bp, Homo sapiens
aaaaatagctaaatacctcaa

SEQ ID NO: 906754 - DNA, 14 bp, Homo sapiens
aaaaatagtaaaca

SEQ ID NO: 906755 - DNA, 18 bp, Homo sapiens
aaaaatagtcttccacaa

SEQ ID NO: 906756 - DNA, 12 bp, Homo sapiens
aaaaatataaaa

SEQ ID NO: 906757 - DNA, 14 bp, Homo sapiens
aaaaatataactta

SEQ ID NO: 906758 - DNA, 16 bp, Homo sapiens
aaaaatataatgttga

SEQ ID NO: 906759 - DNA, 11 bp, Homo sapiens
aaaaatatata

SEQ ID NO: 906760 - DNA, 12 bp, Homo sapiens
aaaaatatatat

SEQ ID NO: 906761 - DNA, 17 bp, Homo sapiens
aaaaatatatgtatata

SEQ ID NO: 906762 - DNA, 12 bp, Homo sapiens
aaaaatatctcc

SEQ ID NO: 906763 - DNA, 20 bp, Homo sapiens
aaaaatatggaacttctaat

SEQ ID NO: 906764 - DNA, 18 bp, Homo sapiens
aaaaatattttaagaaag

SEQ ID NO: 906765 - DNA, 15 bp, Homo sapiens
aaaaatcaatcaatg

SEQ ID NO: 906766 - DNA, 17 bp, Homo sapiens
aaaaatcacaaaaattt

SEQ ID NO: 906767 - DNA, 15 bp, Homo sapiens
aaaaatcacatcctg

SEQ ID NO: 906768 - DNA, 12 bp, Homo sapiens
aaaaatcactgt

SEQ ID NO: 906769 - DNA, 21 bp, Homo sapiens
aaaaatcatgccagtattttt

SEQ ID NO: 906770 - DNA, 11 bp, Homo sapiens
aaaaatcatgt

SEQ ID NO: 906771 - DNA, 15 bp, Homo sapiens
aaaaatcatgtgata

SEQ ID NO: 906772 - DNA, 19 bp, Homo sapiens
aaaaatcctcttcctctga

SEQ ID NO: 906773 - DNA, 23 bp, Homo sapiens
aaaaatctagtgggttgaccttt

SEQ ID NO: 906774 - DNA, 13 bp, Homo sapiens
aaaaatctagttt

SEQ ID NO: 906775 - DNA, 14 bp, Homo sapiens
aaaaatctagtttt

SEQ ID NO: 906776 - DNA, 17 bp, Homo sapiens
aaaaatctcaaatttct

SEQ ID NO: 906777 - DNA, 20 bp, Homo sapiens
aaaaatctgcagaaggaaaa

SEQ ID NO: 906778 - DNA, 12 bp, Homo sapiens
aaaaatctgttt

SEQ ID NO: 906779 - DNA, 17 bp, Homo sapiens
aaaatattatttgatat

SEQ ID NO: 906780 - DNA, 15 bp, Homo sapiens
aaaatattcaagtaa

SEQ ID NO: 906781 - DNA, 15 bp, Homo sapiens
aaaatattcctgcat

SEQ ID NO: 906782 - DNA, 13 bp, Homo sapiens
aaaatattgctaa

SEQ ID NO: 906783 - DNA, 17 bp, Homo sapiens
aaaatattgctaaaagt

SEQ ID NO: 906784 - DNA, 22 bp, Homo sapiens
aaaatattgctaaaagtgcatt

SEQ ID NO: 906785 - DNA, 22 bp, Homo sapiens
aaaatattgtttctgcattcat

SEQ ID NO: 906786 - DNA, 20 bp, Homo sapiens
aaaatattgttttacaatag

SEQ ID NO: 906787 - DNA, 11 bp, Homo sapiens
aaaatatttaa

SEQ ID NO: 906788 - DNA, 21 bp, Homo sapiens
aaaatatttataaaacttctc

SEQ ID NO: 906789 - DNA, 17 bp, Homo sapiens
aaaatatttcagatatc

SEQ ID NO: 906790 - DNA, 15 bp, Homo sapiens
aaaatatttcctgac

SEQ ID NO: 906791 - DNA, 22 bp, Homo sapiens
aaaatatttcctgacttgagtg

SEQ ID NO: 906792 - DNA, 12 bp, Homo sapiens
aaaatatttcta

SEQ ID NO: 906793 - DNA, 13 bp, Homo sapiens
aaaatattttaag

SEQ ID NO: 906794 - DNA, 17 bp, Homo sapiens
aaaatattttagatgtt

SEQ ID NO: 906795 - DNA, 17 bp, Homo sapiens
aaaatattttataattt

SEQ ID NO: 906796 - DNA, 18 bp, Homo sapiens
aaaatattttataatttt

SEQ ID NO: 906797 - DNA, 23 bp, Homo sapiens
aaaatattttctctgtacttttc

SEQ ID NO: 906798 - DNA, 16 bp, Homo sapiens
aaaatcaaagaacaga

SEQ ID NO: 906799 - DNA, 15 bp, Homo sapiens
aaaatcaatcaatgg

SEQ ID NO: 906800 - DNA, 20 bp, Homo sapiens
aaaatcaatcaatggtgcaa

SEQ ID NO: 906801 - DNA, 18 bp, Homo sapiens
aaaatcacaaaaacaaaa

SEQ ID NO: 906802 - DNA, 14 bp, Homo sapiens
aaaatcacgttaaa

SEQ ID NO: 906803 - DNA, 13 bp, Homo sapiens
aaaatcactgttt

SEQ ID NO: 906804 - DNA, 14 bp, Homo sapiens
aaaatcacttcaga

SEQ ID NO: 906805 - DNA, 17 bp, Homo sapiens
aaaatcacttcagatct

SEQ ID NO: 906806 - DNA, 15 bp, Homo sapiens
aaaatcactttcata

SEQ ID NO: 906807 - DNA, 21 bp, Homo sapiens
aaaatcactttgtctaactca

SEQ ID NO: 906808 - DNA, 21 bp, Homo sapiens
aaaatcaggtggcttttgcgg

SEQ ID NO: 906809 - DNA, 14 bp, Homo sapiens
aaaatcatattgct

SEQ ID NO: 906810 - DNA, 12 bp, Homo sapiens
aaaatcatcaag

SEQ ID NO: 906811 - DNA, 19 bp, Homo sapiens
aaaatcatgaaaagaggaa

SEQ ID NO: 906812 - DNA, 15 bp, Homo sapiens
aaaatcatgtttatt

SEQ ID NO: 906813 - DNA, 15 bp, Homo sapiens
aaaatcatgtttgct

SEQ ID NO: 906814 - DNA, 22 bp, Homo sapiens
aaaatcattgattgtcagctac

SEQ ID NO: 906815 - DNA, 19 bp, Homo sapiens
aaaatcattttatatgtca

SEQ ID NO: 906816 - DNA, 22 bp, Homo sapiens
aaaatcattttatatgtcaaag

SEQ ID NO: 906817 - DNA, 15 bp, Homo sapiens
aaaatccaaaaagct

SEQ ID NO: 906818 - DNA, 20 bp, Homo sapiens
aaaatccaataatcagaaaa

SEQ ID NO: 906819 - DNA, 16 bp, Homo sapiens
aaaatccaatattgta

SEQ ID NO: 906820 - DNA, 19 bp, Homo sapiens
aaaatccattccaggtagc

SEQ ID NO: 906821 - DNA, 20 bp, Homo sapiens
aaaatccattttacacagca

SEQ ID NO: 906822 - DNA, 17 bp, Homo sapiens
aaaatcccccagcactt

SEQ ID NO: 906823 - DNA, 23 bp, Homo sapiens
aaaatcccctcagcctcttctct

SEQ ID NO: 906824 - DNA, 14 bp, Homo sapiens
aaaatcctatatct

SEQ ID NO: 906825 - DNA, 22 bp, Homo sapiens
aaaatcctcaacactattgtaa

SEQ ID NO: 906826 - DNA, 15 bp, Homo sapiens
aaaatcctcaggaaa

SEQ ID NO: 906827 - DNA, 22 bp, Homo sapiens
aaaatcctgaactttctccctc

SEQ ID NO: 906828 - DNA, 18 bp, Homo sapiens
aaaatcgccataggccaa

SEQ ID NO: 906829 - DNA, 14 bp, Homo sapiens
aaaatctaaaacaa

SEQ ID NO: 906830 - DNA, 12 bp, Homo sapiens
aaaatctatatt

SEQ ID NO: 906831 - DNA, 16 bp, Homo sapiens
aaaatctgaactctca

SEQ ID NO: 906832 - DNA, 17 bp, Homo sapiens
aaaatctgaactctcaa

SEQ ID NO: 906833 - DNA, 22 bp, Homo sapiens
aaaatctgaactctcaaaagtc

SEQ ID NO: 906834 - DNA, 22 bp, Homo sapiens
aaaatctgagaaactctacatg

SEQ ID NO: 906835 - DNA, 20 bp, Homo sapiens
aaaatctgatttaatgtttt

SEQ ID NO: 906836 - DNA, 21 bp, Homo sapiens
aaaatctgatttaatgttttc

SEQ ID NO: 906837 - DNA, 23 bp, Homo sapiens
aaaatctgatttaatgttttctg

SEQ ID NO: 906838 - DNA, 14 bp, Homo sapiens
aaaatctggaaatc

SEQ ID NO: 906839 - DNA, 16 bp, Homo sapiens
aaaatctggaaatctg

SEQ ID NO: 906840 - DNA, 17 bp, Homo sapiens
aaaatcttcatggaatt

SEQ ID NO: 906841 - DNA, 23 bp, Homo sapiens
aaaatcttcatggaattcacaaa

SEQ ID NO: 906842 - DNA, 19 bp, Homo sapiens
aaaatcttgttaatgtcat

SEQ ID NO: 906843 - DNA, 16 bp, Homo sapiens
aaaatgaaaacttttg

SEQ ID NO: 906844 - DNA, 15 bp, Homo sapiens
aaaatgaaaattgta

SEQ ID NO: 906845 - DNA, 14 bp, Homo sapiens
aaaatgaaagctac

SEQ ID NO: 906846 - DNA, 19 bp, Homo sapiens
aaaatgaaagctactcata

SEQ ID NO: 906847 - DNA, 18 bp, Homo sapiens
aggatacgacagtacact

SEQ ID NO: 906848 - DNA, 23 bp, Homo sapiens
aggatagaagtatacctgatttt

SEQ ID NO: 906849 - DNA, 14 bp, Homo sapiens
aggatagacactgg

SEQ ID NO: 906850 - DNA, 19 bp, Homo sapiens
aggatagacactggacatg

SEQ ID NO: 906851 - DNA, 14 bp, Homo sapiens
aggatataaaagga

SEQ ID NO: 906852 - DNA, 21 bp, Homo sapiens
aggatataagagggcttttta

SEQ ID NO: 906853 - DNA, 15 bp, Homo sapiens
aggatatactgcagc

SEQ ID NO: 906854 - DNA, 21 bp, Homo sapiens
aggatatattttcactttgtg

SEQ ID NO: 906855 - DNA, 18 bp, Homo sapiens
aggatatcagagctggga

SEQ ID NO: 906856 - DNA, 20 bp, Homo sapiens
aggatatccttatcagagct

SEQ ID NO: 906857 - DNA, 13 bp, Homo sapiens
aggatatgattaa

SEQ ID NO: 906858 - DNA, 18 bp, Homo sapiens
aggatattaaacgtgtaa

SEQ ID NO: 906859 - DNA, 19 bp, Homo sapiens
aggatattgatttaaaatt

SEQ ID NO: 906860 - DNA, 14 bp, Homo sapiens
aggatatttaagaa

SEQ ID NO: 906861 - DNA, 15 bp, Homo sapiens
aggatcaagaaagtg

SEQ ID NO: 906862 - DNA, 12 bp, Homo sapiens
aggatcaggctg

SEQ ID NO: 906863 - DNA, 14 bp, Homo sapiens
aggatcaggctgct

SEQ ID NO: 906864 - DNA, 17 bp, Homo sapiens
aggatcagttaactatt

SEQ ID NO: 906865 - DNA, 13 bp, Homo sapiens
aggatcagttttt

SEQ ID NO: 906866 - DNA, 13 bp, Homo sapiens
aggatcatctgaa

SEQ ID NO: 906867 - DNA, 19 bp, Homo sapiens
aggatcatttgagcccagg

SEQ ID NO: 906868 - DNA, 17 bp, Homo sapiens
aggatccaggaatatga

SEQ ID NO: 906869 - DNA, 13 bp, Homo sapiens
aggatccagtgac

SEQ ID NO: 906870 - DNA, 14 bp, Homo sapiens
aggatccggaaaga

SEQ ID NO: 906871 - DNA, 14 bp, Homo sapiens
aggatcctctccac

SEQ ID NO: 906872 - DNA, 12 bp, Homo sapiens
aggatcctgcag

SEQ ID NO: 906873 - DNA, 14 bp, Homo sapiens
aggatcctgcagga

SEQ ID NO: 906874 - DNA, 15 bp, Homo sapiens
aggatcgaggcatgg

SEQ ID NO: 906875 - DNA, 17 bp, Homo sapiens
aggatcggactctgccc

SEQ ID NO: 906876 - DNA, 20 bp, Homo sapiens
aggatcggactctgcccctg

SEQ ID NO: 906877 - DNA, 23 bp, Homo sapiens
aggatcggactctgcccctggac

SEQ ID NO: 906878 - DNA, 16 bp, Homo sapiens
aggatctaagggaaga

SEQ ID NO: 906879 - DNA, 16 bp, Homo sapiens
aggatctagaatgtgt

SEQ ID NO: 906880 - DNA, 16 bp, Homo sapiens
aggatctcaagccagc

SEQ ID NO: 906881 - DNA, 19 bp, Homo sapiens
aggatctctaaagagcatc

SEQ ID NO: 906882 - DNA, 14 bp, Homo sapiens
aggatctctcagga

SEQ ID NO: 906883 - DNA, 15 bp, Homo sapiens
aggatctctcaggag

SEQ ID NO: 906884 - DNA, 19 bp, Homo sapiens
aggatctctcaggagcaca

SEQ ID NO: 906885 - DNA, 12 bp, Homo sapiens
aggatctcttga

SEQ ID NO: 906886 - DNA, 17 bp, Homo sapiens
aggatctcttgagcctg

SEQ ID NO: 906887 - DNA, 18 bp, Homo sapiens
aggatctcttgagcctgg

SEQ ID NO: 906888 - DNA, 19 bp, Homo sapiens
aggatctcttgagcctggg

SEQ ID NO: 906889 - DNA, 22 bp, Homo sapiens
aggatctgcaaacaatgaagaa

SEQ ID NO: 906890 - DNA, 13 bp, Homo sapiens
aggatctgctgag

SEQ ID NO: 906891 - DNA, 23 bp, Homo sapiens
aggatctgctgaggcccagtgca

SEQ ID NO: 906892 - DNA, 19 bp, Homo sapiens
aggatgaatgaggtcccag

SEQ ID NO: 906893 - DNA, 21 bp, Homo sapiens
aggatgaatgaggtcccaggc

SEQ ID NO: 906894 - DNA, 12 bp, Homo sapiens
aggatgagcaga

SEQ ID NO: 906895 - DNA, 20 bp, Homo sapiens
aggatgagcagaccagcttt

SEQ ID NO: 906896 - DNA, 16 bp, Homo sapiens
aggatgagctggaagg

SEQ ID NO: 906897 - DNA, 21 bp, Homo sapiens
aggatgaggccgctagaggcc

SEQ ID NO: 906898 - DNA, 24 bp, Homo sapiens
aggatgatgccagttacttgcttt

SEQ ID NO: 906899 - DNA, 20 bp, Homo sapiens
aggatgattgtacagaatca

SEQ ID NO: 906900 - DNA, 17 bp, Homo sapiens
aggatgccccgtccccc

SEQ ID NO: 906901 - DNA, 14 bp, Homo sapiens
aaacaaaaaaagac

SEQ ID NO: 906902 - DNA, 19 bp, Homo sapiens
aaacaaaaacagaatttga

SEQ ID NO: 906903 - DNA, 17 bp, Homo sapiens
aaacaaaaagaacaaaa

SEQ ID NO: 906904 - DNA, 14 bp, Homo sapiens
aaacaaaaagctaa

SEQ ID NO: 906905 - DNA, 19 bp, Homo sapiens
aaacaaaaattaaaatcct

SEQ ID NO: 906906 - DNA, 17 bp, Homo sapiens
aaacaaaacaaaacaaa

SEQ ID NO: 906907 - DNA, 19 bp, Homo sapiens
aaacaaaaccaagccttgg

SEQ ID NO: 906908 - DNA, 10 bp, Homo sapiens
aaacaaaaga

SEQ ID NO: 906909 - DNA, 20 bp, Homo sapiens
aaacaaaagggtgtatagtg

SEQ ID NO: 906910 - DNA, 21 bp, Homo sapiens
aaacaaaagggtgtatagtgt

SEQ ID NO: 906911 - DNA, 16 bp, Homo sapiens
aaacaaaatcctcagg

SEQ ID NO: 906912 - DNA, 15 bp, Homo sapiens
aaacaaaatctgaac

SEQ ID NO: 906913 - DNA, 12 bp, Homo sapiens
aaacaaaatgaa

SEQ ID NO: 906914 - DNA, 21 bp, Homo sapiens
aaacaaaatgaaaatatcttc

SEQ ID NO: 906915 - DNA, 16 bp, Homo sapiens
aaacaaaatgaaacaa

SEQ ID NO: 906916 - DNA, 13 bp, Homo sapiens
aaacaaaatttca

SEQ ID NO: 906917 - DNA, 13 bp, Homo sapiens
aaacaaaatttga

SEQ ID NO: 906918 - DNA, 15 bp, Homo sapiens
aaacaaaatttgact

SEQ ID NO: 906919 - DNA, 17 bp, Homo sapiens
aaacaaaatttgactaa

SEQ ID NO: 906920 - DNA, 11 bp, Homo sapiens
aaacaaagaag

SEQ ID NO: 906921 - DNA, 18 bp, Homo sapiens
aaacaaagagttcaagaa

SEQ ID NO: 906922 - DNA, 14 bp, Homo sapiens
aaacaaagcagtat

SEQ ID NO: 906923 - DNA, 23 bp, Homo sapiens
aaacaaagcagtatataataact

SEQ ID NO: 906924 - DNA, 14 bp, Homo sapiens
aaacaaatatgaaa

SEQ ID NO: 906925 - DNA, 22 bp, Homo sapiens
aaacaaatatgaaaaatgtaaa

SEQ ID NO: 906926 - DNA, 18 bp, Homo sapiens
aaacaacaaaaaccaaaa

SEQ ID NO: 906927 - DNA, 16 bp, Homo sapiens
aaacaacaatttctac

SEQ ID NO: 906928 - DNA, 12 bp, Homo sapiens
aaacaacattta

SEQ ID NO: 906929 - DNA, 15 bp, Homo sapiens
aaacaaccatgtcat

SEQ ID NO: 906930 - DNA, 17 bp, Homo sapiens
aaacaaccatgtcattt

SEQ ID NO: 906931 - DNA, 22 bp, Homo sapiens
aaacaaccattttttgttctgt

SEQ ID NO: 906932 - DNA, 13 bp, Homo sapiens
aaacaacctgaat

SEQ ID NO: 906933 - DNA, 19 bp, Homo sapiens
aaacaacgcattgccacgg

SEQ ID NO: 906934 - DNA, 16 bp, Homo sapiens
aaacaactttcacttc

SEQ ID NO: 906935 - DNA, 20 bp, Homo sapiens
aaacaagaccacgtttctaa

SEQ ID NO: 906936 - DNA, 16 bp, Homo sapiens
aaacaagactgcctcc

SEQ ID NO: 906937 - DNA, 12 bp, Homo sapiens
aaacaagaggac

SEQ ID NO: 906938 - DNA, 22 bp, Homo sapiens
aaacaagattttaaagacatgt

SEQ ID NO: 906939 - DNA, 23 bp, Homo sapiens
aaacaagccaagaaagatgtata

SEQ ID NO: 906940 - DNA, 12 bp, Homo sapiens
aaacaaggaagc

SEQ ID NO: 906941 - DNA, 20 bp, Homo sapiens
aaacaagtctagtcttctgg

SEQ ID NO: 906942 - DNA, 19 bp, Homo sapiens
aaacaagtggatgttttta

SEQ ID NO: 906943 - DNA, 14 bp, Homo sapiens
aaacaataagacat

SEQ ID NO: 906944 - DNA, 19 bp, Homo sapiens
aaacaatatctgcagcgtt

SEQ ID NO: 906945 - DNA, 14 bp, Homo sapiens
aaacaatattgttt

SEQ ID NO: 906946 - DNA, 17 bp, Homo sapiens
aaacaatattgtttcta

SEQ ID NO: 906947 - DNA, 17 bp, Homo sapiens
aaacaatcccaatcttt

SEQ ID NO: 906948 - DNA, 18 bp, Homo sapiens
aaacaatcccaatctttc

SEQ ID NO: 906949 - DNA, 16 bp, Homo sapiens
aaacaatgaatgtctt

SEQ ID NO: 906950 - DNA, 22 bp, Homo sapiens
aaacaatggtgtctcttttatg

SEQ ID NO: 906951 - DNA, 13 bp, Homo sapiens
aaacaatgtaaag

SEQ ID NO: 906952 - DNA, 13 bp, Homo sapiens
aaacaatgtataa

SEQ ID NO: 906953 - DNA, 15 bp, Homo sapiens
aaacaatgtataaag

SEQ ID NO: 906954 - DNA, 21 bp, Homo sapiens
aaacaatgtataaagattgta

SEQ ID NO: 906955 - DNA, 21 bp, Homo sapiens
aaacaatgttgtccaacaata

SEQ ID NO: 906956 - DNA, 12 bp, Homo sapiens
aaacaatttatt

SEQ ID NO: 906957 - DNA, 22 bp, Homo sapiens
aaacacaaaacaacaaaaacca

SEQ ID NO: 906958 - DNA, 20 bp, Homo sapiens
aaacacaaaagttagctgag

SEQ ID NO: 906959 - DNA, 14 bp, Homo sapiens
aaacacaatatttt

SEQ ID NO: 906960 - DNA, 16 bp, Homo sapiens
aaacacaccaggctgt

SEQ ID NO: 906961 - DNA, 17 bp, Homo sapiens
aaacacagggttttgta

SEQ ID NO: 906962 - DNA, 23 bp, Homo sapiens
aaacacatacaaaagaattaaac

SEQ ID NO: 906963 - DNA, 14 bp, Homo sapiens
aaacacatagattc

SEQ ID NO: 906964 - DNA, 21 bp, Homo sapiens
aaacacatgccttaaatttgt

SEQ ID NO: 906965 - DNA, 14 bp, Homo sapiens
aaacacattgaatg

SEQ ID NO: 906966 - DNA, 21 bp, Homo sapiens
aaacacattgaatgcgcttta

SEQ ID NO: 906967 - DNA, 22 bp, Homo sapiens
aaacacccaaaaatatctcctc

SEQ ID NO: 906968 - DNA, 20 bp, Homo sapiens
aaacaccccaacttggcagc

SEQ ID NO: 906969 - DNA, 13 bp, Homo sapiens
aaacacccctctg

SEQ ID NO: 906970 - DNA, 20 bp, Homo sapiens
aaacacccctctgtctagga

SEQ ID NO: 906971 - DNA, 15 bp, Homo sapiens
aaacaccttctctgg

SEQ ID NO: 906972 - DNA, 21 bp, Homo sapiens
aaacacgcacttagtctctaa

SEQ ID NO: 906973 - DNA, 23 bp, Homo sapiens
aaacacgccttgttcctgctctt

SEQ ID NO: 906974 - DNA, 21 bp, Homo sapiens
aaacacgtgtctataatggaa

SEQ ID NO: 906975 - DNA, 20 bp, Homo sapiens
aaacactcagtccactgttg

SEQ ID NO: 906976 - DNA, 13 bp, Homo sapiens
aaacactcatccc

SEQ ID NO: 906977 - DNA, 16 bp, Homo sapiens
aaacactccacagtgt

SEQ ID NO: 906978 - DNA, 17 bp, Homo sapiens
aaacactccacagtgtt

SEQ ID NO: 906979 - DNA, 17 bp, Homo sapiens
aaacactcggcatttca

SEQ ID NO: 906980 - DNA, 21 bp, Homo sapiens
aggcagcaccacactgggtgc

SEQ ID NO: 906981 - DNA, 12 bp, Homo sapiens
aggcagcagggg

SEQ ID NO: 906982 - DNA, 18 bp, Homo sapiens
aggcagcaggggctgctg

SEQ ID NO: 906983 - DNA, 19 bp, Homo sapiens
aggcagcagtgtgaggcca

SEQ ID NO: 906984 - DNA, 20 bp, Homo sapiens
aggcagcatgcttgggctga

SEQ ID NO: 906985 - DNA, 19 bp, Homo sapiens
aggcagccaacctaagcaa

SEQ ID NO: 906986 - DNA, 14 bp, Homo sapiens
aggcagccaccagt

SEQ ID NO: 906987 - DNA, 14 bp, Homo sapiens
aggcagccagggct

SEQ ID NO: 906988 - DNA, 13 bp, Homo sapiens
aggcagcccagca

SEQ ID NO: 906989 - DNA, 20 bp, Homo sapiens
aggcagcccagcagtgtgga

SEQ ID NO: 906990 - DNA, 13 bp, Homo sapiens
aggcagccccctc

SEQ ID NO: 906991 - DNA, 14 bp, Homo sapiens
aggcagccccctcc

SEQ ID NO: 906992 - DNA, 17 bp, Homo sapiens
aggcagccccctccaca

SEQ ID NO: 906993 - DNA, 22 bp, Homo sapiens
aggcagccctcacctctgagga

SEQ ID NO: 906994 - DNA, 23 bp, Homo sapiens
aggcagccctcacctctgaggac

SEQ ID NO: 906995 - DNA, 12 bp, Homo sapiens
aggcagcctcca

SEQ ID NO: 906996 - DNA, 19 bp, Homo sapiens
aggcagcctccagagccag

SEQ ID NO: 906997 - DNA, 22 bp, Homo sapiens
aggcagcctccagagccagcct

SEQ ID NO: 906998 - DNA, 13 bp, Homo sapiens
aggcagcctcctt

SEQ ID NO: 906999 - DNA, 14 bp, Homo sapiens
aggcagcctctctg

SEQ ID NO: 907000 - DNA, 22 bp, Homo sapiens
aggcagcctggacatagagagg

SEQ ID NO: 907001 - DNA, 15 bp, Homo sapiens
aggcagcgcagggct

SEQ ID NO: 907002 - DNA, 18 bp, Homo sapiens
aggcagcgtgggctctgc

SEQ ID NO: 907003 - DNA, 12 bp, Homo sapiens
aggcagctcttc

SEQ ID NO: 907004 - DNA, 14 bp, Homo sapiens
aggcagctgcctct

SEQ ID NO: 907005 - DNA, 18 bp, Homo sapiens
aggcagctgcctctgctc

SEQ ID NO: 907006 - DNA, 21 bp, Homo sapiens
aggcagctgcctctgctccct

SEQ ID NO: 907007 - DNA, 14 bp, Homo sapiens
aggcagcttctaag

SEQ ID NO: 907008 - DNA, 14 bp, Homo sapiens
aggcaggaagggaa

SEQ ID NO: 907009 - DNA, 22 bp, Homo sapiens
aggcaggagcatgtatgtctgc

SEQ ID NO: 907010 - DNA, 15 bp, Homo sapiens
aggcaggcattcctg

SEQ ID NO: 907011 - DNA, 14 bp, Homo sapiens
aggcaggccagatg

SEQ ID NO: 907012 - DNA, 22 bp, Homo sapiens
aggcaggccagatggcccctcc

SEQ ID NO: 907013 - DNA, 19 bp, Homo sapiens
aggcaggccaggctgcctc

SEQ ID NO: 907014 - DNA, 20 bp, Homo sapiens
aggcaggcctccgtcttccc

SEQ ID NO: 907015 - DNA, 21 bp, Homo sapiens
aggcaggcctccgtcttccca

SEQ ID NO: 907016 - DNA, 22 bp, Homo sapiens
aggcaggcgggccggggcaggg

SEQ ID NO: 907017 - DNA, 23 bp, Homo sapiens
aggcaggctgggacggaccagca

SEQ ID NO: 907018 - DNA, 18 bp, Homo sapiens
aggcagggaatgcctgga

SEQ ID NO: 907019 - DNA, 14 bp, Homo sapiens
aggcagggagggga

SEQ ID NO: 907020 - DNA, 14 bp, Homo sapiens
aggcagggcagagg

SEQ ID NO: 907021 - DNA, 15 bp, Homo sapiens
aggcagggcagaggg

SEQ ID NO: 907022 - DNA, 13 bp, Homo sapiens
aggcagggctgga

SEQ ID NO: 907023 - DNA, 21 bp, Homo sapiens
aaacaggcaaagttttacaga

SEQ ID NO: 907024 - DNA, 21 bp, Homo sapiens
aaacaggcagttggccagaga

SEQ ID NO: 907025 - DNA, 14 bp, Homo sapiens
aaacaggcccagca

SEQ ID NO: 907026 - DNA, 21 bp, Homo sapiens
aaacaggccctctgtggcctg

SEQ ID NO: 907027 - DNA, 17 bp, Homo sapiens
aaacagggacaaagaaa

SEQ ID NO: 907028 - DNA, 10 bp, Homo sapiens
aaacagggca

SEQ ID NO: 907029 - DNA, 13 bp, Homo sapiens
aaacagggcagca

SEQ ID NO: 907030 - DNA, 15 bp, Homo sapiens
aaacagggctgcctt

SEQ ID NO: 907031 - DNA, 17 bp, Homo sapiens
aaacaggtgtgtgtgaa

SEQ ID NO: 907032 - DNA, 19 bp, Homo sapiens
aaacaggtgtgtgtgaact

SEQ ID NO: 907033 - DNA, 19 bp, Homo sapiens
aaacagtagttgtattctt

SEQ ID NO: 907034 - DNA, 19 bp, Homo sapiens
aaacagtatattctttggt

SEQ ID NO: 907035 - DNA, 14 bp, Homo sapiens
aaacagtgagcata

SEQ ID NO: 907036 - DNA, 18 bp, Homo sapiens
aaacagtgagcatatctg

SEQ ID NO: 907037 - DNA, 14 bp, Homo sapiens
aaacagtgagcctg

SEQ ID NO: 907038 - DNA, 18 bp, Homo sapiens
aaacagtgcctgctgaat

SEQ ID NO: 907039 - DNA, 16 bp, Homo sapiens
aaacagtgtgttggtg

SEQ ID NO: 907040 - DNA, 22 bp, Homo sapiens
aaacagtgtgttggtgctttag

SEQ ID NO: 907041 - DNA, 14 bp, Homo sapiens
aaacagttaacttt

SEQ ID NO: 907042 - DNA, 18 bp, Homo sapiens
aaacagttaactttcaga

SEQ ID NO: 907043 - DNA, 16 bp, Homo sapiens
aaacagttctcactgg

SEQ ID NO: 907044 - DNA, 16 bp, Homo sapiens
aaacagttgctgtgaa

SEQ ID NO: 907045 - DNA, 19 bp, Homo sapiens
aaacagttggtaacttttg

SEQ ID NO: 907046 - DNA, 22 bp, Homo sapiens
aaacagtttttattaaaacatg

SEQ ID NO: 907047 - DNA, 15 bp, Homo sapiens
aaacataaaaagcag

SEQ ID NO: 907048 - DNA, 22 bp, Homo sapiens
aaacataataccaccatttaaa

SEQ ID NO: 907049 - DNA, 10 bp, Homo sapiens
aaacataatt

SEQ ID NO: 907050 - DNA, 20 bp, Homo sapiens
aaacatacagaggatgcctt

SEQ ID NO: 907051 - DNA, 16 bp, Homo sapiens
aaacatacttacattt

SEQ ID NO: 907052 - DNA, 23 bp, Homo sapiens
aaacatatctcttatcttacgaa

SEQ ID NO: 907053 - DNA, 14 bp, Homo sapiens
aaacatatttcatt

SEQ ID NO: 907054 - DNA, 13 bp, Homo sapiens
aaacatatttgtg

SEQ ID NO: 907055 - DNA, 14 bp, Homo sapiens
aaacatatttttat

SEQ ID NO: 907056 - DNA, 14 bp, Homo sapiens
aaacatcaaataaa

SEQ ID NO: 907057 - DNA, 19 bp, Homo sapiens
aaacatcaaataaatttct

SEQ ID NO: 907058 - DNA, 22 bp, Homo sapiens
aaacatcacacacacagacaga

SEQ ID NO: 907059 - DNA, 13 bp, Homo sapiens
aaacatcacattc

SEQ ID NO: 907060 - DNA, 23 bp, Homo sapiens
aaacatcagttactctgaagggc

SEQ ID NO: 907061 - DNA, 21 bp, Homo sapiens
aaacatccacttaagttcttt

SEQ ID NO: 907062 - DNA, 17 bp, Homo sapiens
aaacatcccaaacttta

SEQ ID NO: 907063 - DNA, 18 bp, Homo sapiens
aaacatcccaaactttaa

SEQ ID NO: 907064 - DNA, 16 bp, Homo sapiens
aaacatcccactgact

SEQ ID NO: 907065 - DNA, 22 bp, Homo sapiens
aaacatcctacaagacacagtg

SEQ ID NO: 907066 - DNA, 18 bp, Homo sapiens
aaacatccttcaagaact

SEQ ID NO: 907067 - DNA, 16 bp, Homo sapiens
aaacatctagcagtaa

SEQ ID NO: 907068 - DNA, 18 bp, Homo sapiens
aaacatctcatcatgtct

SEQ ID NO: 907069 - DNA, 15 bp, Homo sapiens
aaacatgaacccaaa

SEQ ID NO: 907070 - DNA, 20 bp, Homo sapiens
aaacatgaagcataatttgt

SEQ ID NO: 907071 - DNA, 16 bp, Homo sapiens
aaacatgaatttagaa

SEQ ID NO: 907072 - DNA, 19 bp, Homo sapiens
aaacatgaccctaaatctt

SEQ ID NO: 907073 - DNA, 21 bp, Homo sapiens
aaacatgaccctaaatcttga

SEQ ID NO: 907074 - DNA, 19 bp, Homo sapiens
aaacatgactctttattgt

SEQ ID NO: 907075 - DNA, 22 bp, Homo sapiens
aaacatgcagctcttcaacatg

SEQ ID NO: 907076 - DNA, 24 bp, Homo sapiens
aaacatgctaaatagttctatcag

SEQ ID NO: 907077 - DNA, 16 bp, Homo sapiens
aaacatgctacacact

SEQ ID NO: 907078 - DNA, 18 bp, Homo sapiens
aaacatggaaaacagagt

SEQ ID NO: 907079 - DNA, 16 bp, Homo sapiens
aaacatgggtttagtt

SEQ ID NO: 907080 - DNA, 12 bp, Homo sapiens
aaacatgtatgt

SEQ ID NO: 907081 - DNA, 22 bp, Homo sapiens
aaacatgtctcctatcctggtt

SEQ ID NO: 907082 - DNA, 14 bp, Homo sapiens
aaacatgtgtttta

SEQ ID NO: 907083 - DNA, 21 bp, Homo sapiens
aaacatgtttatttttcttgt

SEQ ID NO: 907084 - DNA, 14 bp, Homo sapiens
aaacattaaacact

SEQ ID NO: 907085 - DNA, 15 bp, Homo sapiens
aaacattaagattga

SEQ ID NO: 907086 - DNA, 17 bp, Homo sapiens
aaacattaattttgtgc

SEQ ID NO: 907087 - DNA, 21 bp, Homo sapiens
aaacattaattttgtgcattc

SEQ ID NO: 907088 - DNA, 22 bp, Homo sapiens
aaacattaattttgtgcattct

SEQ ID NO: 907089 - DNA, 23 bp, Homo sapiens
aaacattaattttgtgcattctt

SEQ ID NO: 907090 - DNA, 18 bp, Homo sapiens
aaacattacagttcataa

SEQ ID NO: 907091 - DNA, 20 bp, Homo sapiens
aaacattagtgaaaattctg

SEQ ID NO: 907092 - DNA, 19 bp, Homo sapiens
aaacattatatgtatacat

SEQ ID NO: 907093 - DNA, 19 bp, Homo sapiens
aaacattcagaggaagaca

SEQ ID NO: 907094 - DNA, 16 bp, Homo sapiens
aaacattcatgtaact

SEQ ID NO: 907095 - DNA, 19 bp, Homo sapiens
aaacattccacgtgcccct

SEQ ID NO: 907096 - DNA, 15 bp, Homo sapiens
aaacattcctccagc

SEQ ID NO: 907097 - DNA, 20 bp, Homo sapiens
aaacattcctccagcctccc

SEQ ID NO: 907098 - DNA, 23 bp, Homo sapiens
aaacattcctccagcctcccctc

SEQ ID NO: 907099 - DNA, 13 bp, Homo sapiens
aaacattgctgcc

SEQ ID NO: 907100 - DNA, 17 bp, Homo sapiens
aaacattgtaaatattt

SEQ ID NO: 907101 - DNA, 23 bp, Homo sapiens
aaacattgtaaatatttactctt

SEQ ID NO: 907102 - DNA, 14 bp, Homo sapiens
aaacatttaaactt

SEQ ID NO: 907103 - DNA, 16 bp, Homo sapiens
aaacatttactgacca

SEQ ID NO: 907104 - DNA, 21 bp, Homo sapiens
aaacatttattttgacataaa

SEQ ID NO: 907105 - DNA, 21 bp, Homo sapiens
aaacatttcataatttgtttc

SEQ ID NO: 907106 - DNA, 13 bp, Homo sapiens
aaacatttcatcc

SEQ ID NO: 907107 - DNA, 14 bp, Homo sapiens
aggccaaccagccc

SEQ ID NO: 907108 - DNA, 14 bp, Homo sapiens
aggccaagaaacgt

SEQ ID NO: 907109 - DNA, 14 bp, Homo sapiens
aggccaagaatcaa

SEQ ID NO: 907110 - DNA, 14 bp, Homo sapiens
aggccaagagcaga

SEQ ID NO: 907111 - DNA, 19 bp, Homo sapiens
aggccaagcagtgcctgcc

SEQ ID NO: 907112 - DNA, 14 bp, Homo sapiens
aggccaaggcaggt

SEQ ID NO: 907113 - DNA, 20 bp, Homo sapiens
aggccaaggcgggtggatca

SEQ ID NO: 907114 - DNA, 22 bp, Homo sapiens
aggccaaggggagtcaccttcc

SEQ ID NO: 907115 - DNA, 12 bp, Homo sapiens
aggccaaggtgc

SEQ ID NO: 907116 - DNA, 12 bp, Homo sapiens
aggccaataaaa

SEQ ID NO: 907117 - DNA, 15 bp, Homo sapiens
aggccaataaaaagt

SEQ ID NO: 907118 - DNA, 16 bp, Homo sapiens
aggccaataaaaagtt

SEQ ID NO: 907119 - DNA, 23 bp, Homo sapiens
aggccaataaaaagttcagagtt

SEQ ID NO: 907120 - DNA, 16 bp, Homo sapiens
aggccacaaaaacaat

SEQ ID NO: 907121 - DNA, 21 bp, Homo sapiens
aggccacaccatctcctttca

SEQ ID NO: 907122 - DNA, 18 bp, Homo sapiens
aggccacactcagcacaa

SEQ ID NO: 907123 - DNA, 13 bp, Homo sapiens
aggccacaggaga

SEQ ID NO: 907124 - DNA, 17 bp, Homo sapiens
aggccacaggcagtcca

SEQ ID NO: 907125 - DNA, 19 bp, Homo sapiens
aggccacagtggggctgca

SEQ ID NO: 907126 - DNA, 23 bp, Homo sapiens
aggccacagtggggctgcaggca

SEQ ID NO: 907127 - DNA, 21 bp, Homo sapiens
aggccaccattataatttata

SEQ ID NO: 907128 - DNA, 12 bp, Homo sapiens
aggccaccccaa

SEQ ID NO: 907129 - DNA, 13 bp, Homo sapiens
aggccaccccaaa

SEQ ID NO: 907130 - DNA, 20 bp, Homo sapiens
aggccaccccaaaccccagc

SEQ ID NO: 907131 - DNA, 21 bp, Homo sapiens
aggccacccccatggaagcaa

SEQ ID NO: 907132 - DNA, 20 bp, Homo sapiens
aggccaccccctatcctctg

SEQ ID NO: 907133 - DNA, 15 bp, Homo sapiens
aggccacccgggctg

SEQ ID NO: 907134 - DNA, 19 bp, Homo sapiens
aggccacccgggctgcctg

SEQ ID NO: 907135 - DNA, 11 bp, Homo sapiens
aggccacctct

SEQ ID NO: 907136 - DNA, 12 bp, Homo sapiens
aggccacctctc

SEQ ID NO: 907137 - DNA, 14 bp, Homo sapiens
aggccacctctcca

SEQ ID NO: 907138 - DNA, 15 bp, Homo sapiens
aggccacctctccaa

SEQ ID NO: 907139 - DNA, 16 bp, Homo sapiens
aggccacctctccaag

SEQ ID NO: 907140 - DNA, 18 bp, Homo sapiens
aggccacctctccaaggg

SEQ ID NO: 907141 - DNA, 23 bp, Homo sapiens
aggccacctctccaagggcttct

SEQ ID NO: 907142 - DNA, 18 bp, Homo sapiens
aggccacctgcccccttc

SEQ ID NO: 907143 - DNA, 19 bp, Homo sapiens
aggccacctgcccccttct

SEQ ID NO: 907144 - DNA, 21 bp, Homo sapiens
aggccacctgcccccttctcc

SEQ ID NO: 907145 - DNA, 21 bp, Homo sapiens
aaactactgaatgaagcagta

SEQ ID NO: 907146 - DNA, 17 bp, Homo sapiens
aaactactgtacatttt

SEQ ID NO: 907147 - DNA, 16 bp, Homo sapiens
aaactacttttctaaa

SEQ ID NO: 907148 - DNA, 19 bp, Homo sapiens
aaactagaaggcttctctc

SEQ ID NO: 907149 - DNA, 15 bp, Homo sapiens
aaactagctgtcact

SEQ ID NO: 907150 - DNA, 17 bp, Homo sapiens
aaactaggaaatttttt

SEQ ID NO: 907151 - DNA, 15 bp, Homo sapiens
aaactagtttttcct

SEQ ID NO: 907152 - DNA, 16 bp, Homo sapiens
aaactagtttttccta

SEQ ID NO: 907153 - DNA, 19 bp, Homo sapiens
aaactatcaagagagtaaa

SEQ ID NO: 907154 - DNA, 16 bp, Homo sapiens
aaactatcagtttgtc

SEQ ID NO: 907155 - DNA, 17 bp, Homo sapiens
aaactatcctgattcca

SEQ ID NO: 907156 - DNA, 19 bp, Homo sapiens
aaactatcctgattccaaa

SEQ ID NO: 907157 - DNA, 17 bp, Homo sapiens
aaactatgatttatttt

SEQ ID NO: 907158 - DNA, 23 bp, Homo sapiens
aaactatggttcccaataaaagt

SEQ ID NO: 907159 - DNA, 20 bp, Homo sapiens
aaactatgtgtttttctcat

SEQ ID NO: 907160 - DNA, 18 bp, Homo sapiens
aaactattagagtatttc

SEQ ID NO: 907161 - DNA, 18 bp, Homo sapiens
aaactattgagccttgca

SEQ ID NO: 907162 - DNA, 11 bp, Homo sapiens
aaactatttat

SEQ ID NO: 907163 - DNA, 17 bp, Homo sapiens
aaactatttattgtgct

SEQ ID NO: 907164 - DNA, 19 bp, Homo sapiens
aaactatttattgtgctgg

SEQ ID NO: 907165 - DNA, 21 bp, Homo sapiens
aaactatttattgtgctgggt

SEQ ID NO: 907166 - DNA, 16 bp, Homo sapiens
aaactcacctgctggc

SEQ ID NO: 907167 - DNA, 19 bp, Homo sapiens
aaactcacctgctggcccc

SEQ ID NO: 907168 - DNA, 22 bp, Homo sapiens
aaactcacggaccactcgaggc

SEQ ID NO: 907169 - DNA, 15 bp, Homo sapiens
aaactcactgctcaa

SEQ ID NO: 907170 - DNA, 13 bp, Homo sapiens
aaactcactgtga

SEQ ID NO: 907171 - DNA, 14 bp, Homo sapiens
aaactcagatcctt

SEQ ID NO: 907172 - DNA, 17 bp, Homo sapiens
aaactcagatgtccaaa

SEQ ID NO: 907173 - DNA, 17 bp, Homo sapiens
aaactcagggacagagc

SEQ ID NO: 907174 - DNA, 21 bp, Homo sapiens
aaactcatgatcaagatatat

SEQ ID NO: 907175 - DNA, 22 bp, Homo sapiens
aaactcatttcctatgtaactg

SEQ ID NO: 907176 - DNA, 15 bp, Homo sapiens
aaactccagatgcca

SEQ ID NO: 907177 - DNA, 17 bp, Homo sapiens
aaactcccaatacaaag

SEQ ID NO: 907178 - DNA, 20 bp, Homo sapiens
aaactccccttccctgggga

SEQ ID NO: 907179 - DNA, 21 bp, Homo sapiens
aaactccccttccctggggag

SEQ ID NO: 907180 - DNA, 14 bp, Homo sapiens
aaactccgaagaaa

SEQ ID NO: 907181 - DNA, 16 bp, Homo sapiens
aaactccgcccccagc

SEQ ID NO: 907182 - DNA, 19 bp, Homo sapiens
aaactccgtcttagaagtg

SEQ ID NO: 907183 - DNA, 17 bp, Homo sapiens
aaactcctgattttgta

SEQ ID NO: 907184 - DNA, 11 bp, Homo sapiens
aaactcctgtg

SEQ ID NO: 907185 - DNA, 21 bp, Homo sapiens
aaactcctttactgcagcctg

SEQ ID NO: 907186 - DNA, 21 bp, Homo sapiens
aaactcgcgagtgtaactttc

SEQ ID NO: 907187 - DNA, 20 bp, Homo sapiens
aaactctaaacattaatcaa

SEQ ID NO: 907188 - DNA, 19 bp, Homo sapiens
aaactctaggggaattaac

SEQ ID NO: 907189 - DNA, 18 bp, Homo sapiens
aaactctgaaggagagga

SEQ ID NO: 907190 - DNA, 17 bp, Homo sapiens
aaactctgccagaaaaa

SEQ ID NO: 907191 - DNA, 22 bp, Homo sapiens
aaactctggacactctatatgt

SEQ ID NO: 907192 - DNA, 14 bp, Homo sapiens
aaactctgggaaat

SEQ ID NO: 907193 - DNA, 20 bp, Homo sapiens
aaactctgggtcttggccat

SEQ ID NO: 907194 - DNA, 19 bp, Homo sapiens
aaactctggtgataaaaat

SEQ ID NO: 907195 - DNA, 23 bp, Homo sapiens
aaactctggtgataaaaataaag

SEQ ID NO: 907196 - DNA, 18 bp, Homo sapiens
aaactctgttacactttt

SEQ ID NO: 907197 - DNA, 18 bp, Homo sapiens
aaactctgttgtaagtaa

SEQ ID NO: 907198 - DNA, 15 bp, Homo sapiens
aaactcttaatctgt

SEQ ID NO: 907199 - DNA, 17 bp, Homo sapiens
aaactcttaatctgtgt

SEQ ID NO: 907200 - DNA, 19 bp, Homo sapiens
aaactcttcagttaattct

SEQ ID NO: 907201 - DNA, 15 bp, Homo sapiens
aaactctttcattct

SEQ ID NO: 907202 - DNA, 17 bp, Homo sapiens
aaactctttcattcttc

SEQ ID NO: 907203 - DNA, 15 bp, Homo sapiens
aaactgaaagtgttt

SEQ ID NO: 907204 - DNA, 16 bp, Homo sapiens
aaactgaaataaacct

SEQ ID NO: 907205 - DNA, 17 bp, Homo sapiens
aaactgaaccaacagaa

SEQ ID NO: 907206 - DNA, 12 bp, Homo sapiens
aaactgaagatg

SEQ ID NO: 907207 - DNA, 21 bp, Homo sapiens
aaactgaagcagcctctcccc

SEQ ID NO: 907208 - DNA, 12 bp, Homo sapiens
aaactgaaggtt

SEQ ID NO: 907209 - DNA, 14 bp, Homo sapiens
aaactgaaggtttt

SEQ ID NO: 907210 - DNA, 14 bp, Homo sapiens
aaactgaatatttt

SEQ ID NO: 907211 - DNA, 17 bp, Homo sapiens
aaactgacagtattaag

SEQ ID NO: 907212 - DNA, 20 bp, Homo sapiens
aaactgacatgccctccctt

SEQ ID NO: 907213 - DNA, 12 bp, Homo sapiens
aaactgacttta

SEQ ID NO: 907214 - DNA, 20 bp, Homo sapiens
aaactgagtaaattggaaac

SEQ ID NO: 907215 - DNA, 16 bp, Homo sapiens
aaactgagtccatgaa

SEQ ID NO: 907216 - DNA, 13 bp, Homo sapiens
aaactgagtgact

SEQ ID NO: 907217 - DNA, 11 bp, Homo sapiens
aaactgatttc

SEQ ID NO: 907218 - DNA, 16 bp, Homo sapiens
aaactgcaatagagac

SEQ ID NO: 907219 - DNA, 21 bp, Homo sapiens
aaactgcaatagagactgtag

SEQ ID NO: 907220 - DNA, 12 bp, Homo sapiens
aaactgcacatc

SEQ ID NO: 907221 - DNA, 10 bp, Homo sapiens
aaactgcagc

SEQ ID NO: 907222 - DNA, 23 bp, Homo sapiens
aaactgcataagtgaaaatctta

SEQ ID NO: 907223 - DNA, 16 bp, Homo sapiens
aaactgcatgaaaaat

SEQ ID NO: 907224 - DNA, 15 bp, Homo sapiens
aaactgccctggctc

SEQ ID NO: 907225 - DNA, 16 bp, Homo sapiens
aaactgctaaattcta

SEQ ID NO: 907226 - DNA, 23 bp, Homo sapiens
aaactgctaaattctatgttaaa

SEQ ID NO: 907227 - DNA, 12 bp, Homo sapiens
aaactgctttat

SEQ ID NO: 907228 - DNA, 13 bp, Homo sapiens
aaactgctttatt

SEQ ID NO: 907229 - DNA, 14 bp, Homo sapiens
aaactgctttattt

SEQ ID NO: 907230 - DNA, 15 bp, Homo sapiens
aaactgctttatttt

SEQ ID NO: 907231 - DNA, 21 bp, Homo sapiens
aaactgcttttttttttccag

SEQ ID NO: 907232 - DNA, 19 bp, Homo sapiens
aaactggattaaaacaatt

SEQ ID NO: 907233 - DNA, 15 bp, Homo sapiens
aaactggcaaagcag

SEQ ID NO: 907234 - DNA, 16 bp, Homo sapiens
aaactggcaaagcaga

SEQ ID NO: 907235 - DNA, 20 bp, Homo sapiens
aaactggcatctgacacaaa

SEQ ID NO: 907236 - DNA, 14 bp, Homo sapiens
aaactggctttggc

SEQ ID NO: 907237 - DNA, 16 bp, Homo sapiens
aaactggggcctccct

SEQ ID NO: 907238 - DNA, 23 bp, Homo sapiens
aaactggtgggtctttaataaaa

SEQ ID NO: 907239 - DNA, 17 bp, Homo sapiens
aaactgtaaataaaatg

SEQ ID NO: 907240 - DNA, 21 bp, Homo sapiens
aaactgtaaataaaatgtgta

SEQ ID NO: 907241 - DNA, 19 bp, Homo sapiens
aggcctcaggtgctgtcca

SEQ ID NO: 907242 - DNA, 13 bp, Homo sapiens
aggcctcagtgga

SEQ ID NO: 907243 - DNA, 14 bp, Homo sapiens
aggcctcatctcct

SEQ ID NO: 907244 - DNA, 18 bp, Homo sapiens
aggcctcatctcctttat

SEQ ID NO: 907245 - DNA, 14 bp, Homo sapiens
aggcctcatttctt

SEQ ID NO: 907246 - DNA, 23 bp, Homo sapiens
aggcctccaacgcccctgtggcc

SEQ ID NO: 907247 - DNA, 24 bp, Homo sapiens
aggcctccaacgcccctgtggcca

SEQ ID NO: 907248 - DNA, 16 bp, Homo sapiens
aggcctccagcctctc

SEQ ID NO: 907249 - DNA, 14 bp, Homo sapiens
aggcctcccaagtt

SEQ ID NO: 907250 - DNA, 22 bp, Homo sapiens
aggcctccctagcacctccccc

SEQ ID NO: 907251 - DNA, 20 bp, Homo sapiens
aggcctcctaggggaagggg

SEQ ID NO: 907252 - DNA, 23 bp, Homo sapiens
aggcctcctggctgtctgaggct

SEQ ID NO: 907253 - DNA, 23 bp, Homo sapiens
aggcctctccagtttgcacctgt

SEQ ID NO: 907254 - DNA, 18 bp, Homo sapiens
aggcctctctctgctcca

SEQ ID NO: 907255 - DNA, 20 bp, Homo sapiens
aggcctctctctgctccatc

SEQ ID NO: 907256 - DNA, 19 bp, Homo sapiens
aggcctctggaaagcaaag

SEQ ID NO: 907257 - DNA, 20 bp, Homo sapiens
aggcctctggactggcctgt

SEQ ID NO: 907258 - DNA, 23 bp, Homo sapiens
aggcctctggactggcctgtctg

SEQ ID NO: 907259 - DNA, 15 bp, Homo sapiens
aggcctctggccctc

SEQ ID NO: 907260 - DNA, 12 bp, Homo sapiens
aggcctctggtt

SEQ ID NO: 907261 - DNA, 23 bp, Homo sapiens
aggcctctgtgtccttccctgca

SEQ ID NO: 907262 - DNA, 18 bp, Homo sapiens
aggcctcttgctgaaagc

SEQ ID NO: 907263 - DNA, 21 bp, Homo sapiens
aggcctcttggacctctgctc

SEQ ID NO: 907264 - DNA, 19 bp, Homo sapiens
aggcctcttgtaaagactg

SEQ ID NO: 907265 - DNA, 15 bp, Homo sapiens
aggcctcttgtgctc

SEQ ID NO: 907266 - DNA, 21 bp, Homo sapiens
aggcctcttgtgctcacgctc

SEQ ID NO: 907267 - DNA, 22 bp, Homo sapiens
aaagaattggtcttaatgttga

SEQ ID NO: 907268 - DNA, 23 bp, Homo sapiens
aaagacaaaaatcaaagaacaga

SEQ ID NO: 907269 - DNA, 13 bp, Homo sapiens
aaagacaaaagaa

SEQ ID NO: 907270 - DNA, 17 bp, Homo sapiens
aaagacaaaagaaactt

SEQ ID NO: 907271 - DNA, 19 bp, Homo sapiens
aaagacaaattctgtttct

SEQ ID NO: 907272 - DNA, 22 bp, Homo sapiens
aaagacaagtatgaatattact

SEQ ID NO: 907273 - DNA, 13 bp, Homo sapiens
aaagacagaatgg

SEQ ID NO: 907274 - DNA, 19 bp, Homo sapiens
aaagacagaatggtggagt

SEQ ID NO: 907275 - DNA, 15 bp, Homo sapiens
aaagacagagtgaat

SEQ ID NO: 907276 - DNA, 16 bp, Homo sapiens
aaagacaggaagacca

SEQ ID NO: 907277 - DNA, 14 bp, Homo sapiens
aaagacatacctga

SEQ ID NO: 907278 - DNA, 13 bp, Homo sapiens
aaagacattttaa

SEQ ID NO: 907279 - DNA, 23 bp, Homo sapiens
aaagacattttaagtttgtagta

SEQ ID NO: 907280 - DNA, 13 bp, Homo sapiens
aaagaccacctcc

SEQ ID NO: 907281 - DNA, 16 bp, Homo sapiens
aaagacccgggagctg

SEQ ID NO: 907282 - DNA, 20 bp, Homo sapiens
aaagaccctgagactccaga

SEQ ID NO: 907283 - DNA, 17 bp, Homo sapiens
aaagactatctaaatgt

SEQ ID NO: 907284 - DNA, 18 bp, Homo sapiens
aaagactcagccaagaca

SEQ ID NO: 907285 - DNA, 16 bp, Homo sapiens
aaagactcctctgggc

SEQ ID NO: 907286 - DNA, 11 bp, Homo sapiens
aaagactctga

SEQ ID NO: 907287 - DNA, 13 bp, Homo sapiens
aaagactctgagc

SEQ ID NO: 907288 - DNA, 16 bp, Homo sapiens
aaagactgaacatgtt

SEQ ID NO: 907289 - DNA, 17 bp, Homo sapiens
aaagactgaacatgttt

SEQ ID NO: 907290 - DNA, 16 bp, Homo sapiens
aaagactgcagctgct

SEQ ID NO: 907291 - DNA, 18 bp, Homo sapiens
aaagactgcagctgctga

SEQ ID NO: 907292 - DNA, 12 bp, Homo sapiens
aaagactggctt

SEQ ID NO: 907293 - DNA, 15 bp, Homo sapiens
aaagactggttttct

SEQ ID NO: 907294 - DNA, 14 bp, Homo sapiens
aaagactgtacaaa

SEQ ID NO: 907295 - DNA, 15 bp, Homo sapiens
aaagactgtacaaag

SEQ ID NO: 907296 - DNA, 19 bp, Homo sapiens
aaagactgtcaaatgaact

SEQ ID NO: 907297 - DNA, 20 bp, Homo sapiens
aaagactgtcaaatgaactt

SEQ ID NO: 907298 - DNA, 14 bp, Homo sapiens
aaagactgtgaaca

SEQ ID NO: 907299 - DNA, 18 bp, Homo sapiens
aaagactgtgaacagctt

SEQ ID NO: 907300 - DNA, 17 bp, Homo sapiens
aaagactgtgctgagaa

SEQ ID NO: 907301 - DNA, 18 bp, Homo sapiens
aaagacttagtatatttt

SEQ ID NO: 907302 - DNA, 20 bp, Homo sapiens
aaagacttagtatattttct

SEQ ID NO: 907303 - DNA, 20 bp, Homo sapiens
aaagacttggttggtagggt

SEQ ID NO: 907304 - DNA, 22 bp, Homo sapiens
aaagacttttatgtgagatttc

SEQ ID NO: 907305 - DNA, 12 bp, Homo sapiens
aaagagaaaaga

SEQ ID NO: 907306 - DNA, 23 bp, Homo sapiens
aaagagaaaagggaaaaaagaaa

SEQ ID NO: 907307 - DNA, 13 bp, Homo sapiens
aaagagaaacacg

SEQ ID NO: 907308 - DNA, 22 bp, Homo sapiens
aaagagaaacagttggtaactt

SEQ ID NO: 907309 - DNA, 14 bp, Homo sapiens
aaagagaatgaact

SEQ ID NO: 907310 - DNA, 13 bp, Homo sapiens
aaagagacagtga

SEQ ID NO: 907311 - DNA, 20 bp, Homo sapiens
aaagagaccacccatatcat

SEQ ID NO: 907312 - DNA, 18 bp, Homo sapiens
aaagagacttctctgtaa

SEQ ID NO: 907313 - DNA, 18 bp, Homo sapiens
aaagagagaaacactgaa

SEQ ID NO: 907314 - DNA, 20 bp, Homo sapiens
aaagagagagagagaaaaaa

SEQ ID NO: 907315 - DNA, 13 bp, Homo sapiens
aaagagatatttt

SEQ ID NO: 907316 - DNA, 20 bp, Homo sapiens
aaagagatattttaaaatga

SEQ ID NO: 907317 - DNA, 13 bp, Homo sapiens
aaagagattcgaa

SEQ ID NO: 907318 - DNA, 14 bp, Homo sapiens
aaagagattcgaat

SEQ ID NO: 907319 - DNA, 23 bp, Homo sapiens
aaagagatttcccttcatttaaa

SEQ ID NO: 907320 - DNA, 22 bp, Homo sapiens
aaagagcacttaagagaatatt

SEQ ID NO: 907321 - DNA, 14 bp, Homo sapiens
aaagagcagtcaga

SEQ ID NO: 907322 - DNA, 17 bp, Homo sapiens
aaagagccctggctctg

SEQ ID NO: 907323 - DNA, 19 bp, Homo sapiens
aaagagccctggctctgcc

SEQ ID NO: 907324 - DNA, 20 bp, Homo sapiens
aaagagccttcactggttct

SEQ ID NO: 907325 - DNA, 12 bp, Homo sapiens
aaagagctactc

SEQ ID NO: 907326 - DNA, 17 bp, Homo sapiens
aaagagctactcagaaa

SEQ ID NO: 907327 - DNA, 13 bp, Homo sapiens
aaagaggagaagg

SEQ ID NO: 907328 - DNA, 16 bp, Homo sapiens
aaagaggagaccctgg

SEQ ID NO: 907329 - DNA, 20 bp, Homo sapiens
aaagaggatgatttcagaag

SEQ ID NO: 907330 - DNA, 16 bp, Homo sapiens
aaagaggctgaaagag

SEQ ID NO: 907331 - DNA, 21 bp, Homo sapiens
aaagaggctgaggcctggact

SEQ ID NO: 907332 - DNA, 15 bp, Homo sapiens
aaagagggcttcctc

SEQ ID NO: 907333 - DNA, 14 bp, Homo sapiens
aaagaggggcgctg

SEQ ID NO: 907334 - DNA, 18 bp, Homo sapiens
aaagaggtcgcttgggaa

SEQ ID NO: 907335 - DNA, 14 bp, Homo sapiens
aaagaggtgtcatg

SEQ ID NO: 907336 - DNA, 14 bp, Homo sapiens
aaagagtcacacaa

SEQ ID NO: 907337 - DNA, 20 bp, Homo sapiens
aaagagttattcaaatgaag

SEQ ID NO: 907338 - DNA, 19 bp, Homo sapiens
aaagagttggcatgaaagt

SEQ ID NO: 907339 - DNA, 21 bp, Homo sapiens
aaagataaaaggtttcttttt

SEQ ID NO: 907340 - DNA, 13 bp, Homo sapiens
aaagataaagatg

SEQ ID NO: 907341 - DNA, 22 bp, Homo sapiens
aaagataacaagatctttcagg

SEQ ID NO: 907342 - DNA, 16 bp, Homo sapiens
aaagataataaattga

SEQ ID NO: 907343 - DNA, 19 bp, Homo sapiens
aaagataatctctcagctt

SEQ ID NO: 907344 - DNA, 21 bp, Homo sapiens
aaagatacagaactctttcaa

SEQ ID NO: 907345 - DNA, 15 bp, Homo sapiens
aaagatacagttact

SEQ ID NO: 907346 - DNA, 19 bp, Homo sapiens
aaagatacccaaattttaa

SEQ ID NO: 907347 - DNA, 22 bp, Homo sapiens
aaagatacgactttattttctg

SEQ ID NO: 907348 - DNA, 20 bp, Homo sapiens
aaagatatattaaaaatata

SEQ ID NO: 907349 - DNA, 17 bp, Homo sapiens
aaagatcaaaataaaaa

SEQ ID NO: 907350 - DNA, 15 bp, Homo sapiens
aaagatcaccttgta

SEQ ID NO: 907351 - DNA, 12 bp, Homo sapiens
aaagatgacaaa

SEQ ID NO: 907352 - DNA, 20 bp, Homo sapiens
aaagatgagctctgaacaaa

SEQ ID NO: 907353 - DNA, 11 bp, Homo sapiens
aaagatgagtt

SEQ ID NO: 907354 - DNA, 15 bp, Homo sapiens
aaagatgatggaaac

SEQ ID NO: 907355 - DNA, 21 bp, Homo sapiens
aaagatgccaattattgttac

SEQ ID NO: 907356 - DNA, 16 bp, Homo sapiens
aaagatgccatagcat

SEQ ID NO: 907357 - DNA, 19 bp, Homo sapiens
aaagatgccatagcataat

SEQ ID NO: 907358 - DNA, 16 bp, Homo sapiens
aaagatggatgtgctt

SEQ ID NO: 907359 - DNA, 18 bp, Homo sapiens
aaagatggatttgaaaat

SEQ ID NO: 907360 - DNA, 20 bp, Homo sapiens
aaagatggcttatgtcatca

SEQ ID NO: 907361 - DNA, 20 bp, Homo sapiens
aaagatggttaaacattttc

SEQ ID NO: 907362 - DNA, 22 bp, Homo sapiens
aaagatggttgtagcatttaaa

SEQ ID NO: 907363 - DNA, 13 bp, Homo sapiens
aaagatgtatata

SEQ ID NO: 907364 - DNA, 17 bp, Homo sapiens
aaagatgtatatttgca

SEQ ID NO: 907365 - DNA, 17 bp, Homo sapiens
aaagatgttaaatggaa

SEQ ID NO: 907366 - DNA, 21 bp, Homo sapiens
aaagatgttccagtgaggaac

SEQ ID NO: 907367 - DNA, 17 bp, Homo sapiens
aaagattaatctttaaa

SEQ ID NO: 907368 - DNA, 17 bp, Homo sapiens
aaagattatgatgcata

SEQ ID NO: 907369 - DNA, 22 bp, Homo sapiens
aaagattattgtgacttcactg

SEQ ID NO: 907370 - DNA, 13 bp, Homo sapiens
aaagattctgtct

SEQ ID NO: 907371 - DNA, 17 bp, Homo sapiens
aaagattgctgaaaaag

SEQ ID NO: 907372 - DNA, 19 bp, Homo sapiens
aaagattgctgaaatttta

SEQ ID NO: 907373 - DNA, 22 bp, Homo sapiens
aaagatttcagtagaattttag

SEQ ID NO: 907374 - DNA, 18 bp, Homo sapiens
aggctgcactggagccac

SEQ ID NO: 907375 - DNA, 13 bp, Homo sapiens
aggctgcagagcc

SEQ ID NO: 907376 - DNA, 18 bp, Homo sapiens
aggctgcagagctgaccc

SEQ ID NO: 907377 - DNA, 21 bp, Homo sapiens
aggctgcagaggcacctcaac

SEQ ID NO: 907378 - DNA, 13 bp, Homo sapiens
aggctgcagcagg

SEQ ID NO: 907379 - DNA, 20 bp, Homo sapiens
aggctgcagcaggtgctggg

SEQ ID NO: 907380 - DNA, 20 bp, Homo sapiens
aggctgcagccgtggtccaa

SEQ ID NO: 907381 - DNA, 16 bp, Homo sapiens
aggctgcagctggaca

SEQ ID NO: 907382 - DNA, 18 bp, Homo sapiens
aggctgcagctggacaga

SEQ ID NO: 907383 - DNA, 14 bp, Homo sapiens
aggctgcaggaggg

SEQ ID NO: 907384 - DNA, 16 bp, Homo sapiens
aggctgcaggagggca

SEQ ID NO: 907385 - DNA, 18 bp, Homo sapiens
aggctgcaggagggcact

SEQ ID NO: 907386 - DNA, 21 bp, Homo sapiens
aggctgcagtcagtcatgatg

SEQ ID NO: 907387 - DNA, 17 bp, Homo sapiens
aggctgcagtgagccga

SEQ ID NO: 907388 - DNA, 18 bp, Homo sapiens
aggctgcatgctctggaa

SEQ ID NO: 907389 - DNA, 13 bp, Homo sapiens
agggaaaaaagaa

SEQ ID NO: 907390 - DNA, 14 bp, Homo sapiens
agggaaaaaagaaa

SEQ ID NO: 907391 - DNA, 16 bp, Homo sapiens
agggaaaaaagaaaga

SEQ ID NO: 907392 - DNA, 17 bp, Homo sapiens
agggaaaaaagaaagaa

SEQ ID NO: 907393 - DNA, 18 bp, Homo sapiens
agggaaaaaagaaagaaa

SEQ ID NO: 907394 - DNA, 21 bp, Homo sapiens
agggaaaaaagaaagaaaaag

SEQ ID NO: 907395 - DNA, 13 bp, Homo sapiens
agggaaaaatata

SEQ ID NO: 907396 - DNA, 18 bp, Homo sapiens
agggaaaataggcaggaa

SEQ ID NO: 907397 - DNA, 22 bp, Homo sapiens
agggaaaatgcagcagggatgc

SEQ ID NO: 907398 - DNA, 21 bp, Homo sapiens
agggaaaccttggagaggaga

SEQ ID NO: 907399 - DNA, 12 bp, Homo sapiens
agggaaaccttt

SEQ ID NO: 907400 - DNA, 13 bp, Homo sapiens
agggaaactggct

SEQ ID NO: 907401 - DNA, 15 bp, Homo sapiens
agggaaactggctga

SEQ ID NO: 907402 - DNA, 14 bp, Homo sapiens
agggaaagcgggca

SEQ ID NO: 907403 - DNA, 22 bp, Homo sapiens
agggaaaggctctgaaagccag

SEQ ID NO: 907404 - DNA, 16 bp, Homo sapiens
agggaaagggaagcac

SEQ ID NO: 907405 - DNA, 18 bp, Homo sapiens
agggaaaggggtgctttt

SEQ ID NO: 907406 - DNA, 19 bp, Homo sapiens
agggaaaggttttgtattt

SEQ ID NO: 907407 - DNA, 21 bp, Homo sapiens
agggaaaggttttgtattttt

SEQ ID NO: 907408 - DNA, 18 bp, Homo sapiens
agggaaatgttttgtaaa

SEQ ID NO: 907409 - DNA, 21 bp, Homo sapiens
agggaaattgtttatgtgtta

SEQ ID NO: 907410 - DNA, 19 bp, Homo sapiens
agggaacactcatccctgg

SEQ ID NO: 907411 - DNA, 13 bp, Homo sapiens
agggaacagacag

SEQ ID NO: 907412 - DNA, 15 bp, Homo sapiens
agggaacagacagga

SEQ ID NO: 907413 - DNA, 17 bp, Homo sapiens
agggaacagacaggaga

SEQ ID NO: 907414 - DNA, 14 bp, Homo sapiens
agggaacagggcgg

SEQ ID NO: 907415 - DNA, 17 bp, Homo sapiens
agggaaccaccagcgtt

SEQ ID NO: 907416 - DNA, 17 bp, Homo sapiens
agggaaccactttctta

SEQ ID NO: 907417 - DNA, 14 bp, Homo sapiens
agggaactgcttgc

SEQ ID NO: 907418 - DNA, 22 bp, Homo sapiens
agggaactgcttgcccagggtg

SEQ ID NO: 907419 - DNA, 13 bp, Homo sapiens
agggaagaaaaag

SEQ ID NO: 907420 - DNA, 23 bp, Homo sapiens
agggaagaaaaagcaagtgttca

SEQ ID NO: 907421 - DNA, 14 bp, Homo sapiens
agggaagaactatt

SEQ ID NO: 907422 - DNA, 18 bp, Homo sapiens
agggaagaccagaattcc

SEQ ID NO: 907423 - DNA, 12 bp, Homo sapiens
agggaagagcag

SEQ ID NO: 907424 - DNA, 14 bp, Homo sapiens
agggaagagggcag

SEQ ID NO: 907425 - DNA, 21 bp, Homo sapiens
agggaagagtcttccaaggcc

SEQ ID NO: 907426 - DNA, 14 bp, Homo sapiens
agggaagagtgcat

SEQ ID NO: 907427 - DNA, 12 bp, Homo sapiens
agggaagcaggg

SEQ ID NO: 907428 - DNA, 17 bp, Homo sapiens
agggaagctggcctgag

SEQ ID NO: 907429 - DNA, 15 bp, Homo sapiens
agggaaggaacagga

SEQ ID NO: 907430 - DNA, 23 bp, Homo sapiens
agggaaggaactctggcttccag

SEQ ID NO: 907431 - DNA, 17 bp, Homo sapiens
agggaaggcaaaggcag

SEQ ID NO: 907432 - DNA, 19 bp, Homo sapiens
agggaaggcaaaggcagag

SEQ ID NO: 907433 - DNA, 21 bp, Homo sapiens
agggaaggcaaaggcagagga

SEQ ID NO: 907434 - DNA, 22 bp, Homo sapiens
agggaaggcaaaggcagaggaa

SEQ ID NO: 907435 - DNA, 14 bp, Homo sapiens
agggaagggccacc

SEQ ID NO: 907436 - DNA, 16 bp, Homo sapiens
agggaagggcctgcca

SEQ ID NO: 907437 - DNA, 20 bp, Homo sapiens
agggaaggggaggcagccgg

SEQ ID NO: 907438 - DNA, 20 bp, Homo sapiens
agggaaggggatggaggcca

SEQ ID NO: 907439 - DNA, 12 bp, Homo sapiens
agggaaggggcc

SEQ ID NO: 907440 - DNA, 17 bp, Homo sapiens
agggaaggggcctccct

SEQ ID NO: 907441 - DNA, 20 bp, Homo sapiens
agggaaggtgaccgcccagc

SEQ ID NO: 907442 - DNA, 12 bp, Homo sapiens
agggaaggtggg

SEQ ID NO: 907443 - DNA, 23 bp, Homo sapiens
agggaaggtggggccctgcccct

SEQ ID NO: 907444 - DNA, 18 bp, Homo sapiens
agggaagtgaggcccaag

SEQ ID NO: 907445 - DNA, 22 bp, Homo sapiens
agggaagtgaggcccaaggagc

SEQ ID NO: 907446 - DNA, 21 bp, Homo sapiens
agggaagtggaggttgctgta

SEQ ID NO: 907447 - DNA, 22 bp, Homo sapiens
agggaagtgtgtgtgtgtccat

SEQ ID NO: 907448 - DNA, 19 bp, Homo sapiens
agggaagttcaggctctga

SEQ ID NO: 907449 - DNA, 16 bp, Homo sapiens
agggaagttgtctcct

SEQ ID NO: 907450 - DNA, 19 bp, Homo sapiens
agggaatccaagcctccac

SEQ ID NO: 907451 - DNA, 22 bp, Homo sapiens
agggaatccaagcctccacagc

SEQ ID NO: 907452 - DNA, 20 bp, Homo sapiens
agggaatgagagttccttct

SEQ ID NO: 907453 - DNA, 16 bp, Homo sapiens
agggaatgttccctgc

SEQ ID NO: 907454 - DNA, 18 bp, Homo sapiens
agggaatgttccctgcac

SEQ ID NO: 907455 - DNA, 19 bp, Homo sapiens
agggaatgttccctgcacc

SEQ ID NO: 907456 - DNA, 22 bp, Homo sapiens
agggaattaaaaagaagatgaa

SEQ ID NO: 907457 - DNA, 18 bp, Homo sapiens
agggaattgaggtctgct

SEQ ID NO: 907458 - DNA, 13 bp, Homo sapiens
agggaattgctca

SEQ ID NO: 907459 - DNA, 17 bp, Homo sapiens
agggacacacagcctag

SEQ ID NO: 907460 - DNA, 18 bp, Homo sapiens
agggacacacagcctagc

SEQ ID NO: 907461 - DNA, 14 bp, Homo sapiens
agggacacatgccc

SEQ ID NO: 907462 - DNA, 16 bp, Homo sapiens
agggacacatgcccct

SEQ ID NO: 907463 - DNA, 17 bp, Homo sapiens
agggacacatgcccctc

SEQ ID NO: 907464 - DNA, 18 bp, Homo sapiens
agggacagagacacctgc

SEQ ID NO: 907465 - DNA, 19 bp, Homo sapiens
agggacagagacacctgca

SEQ ID NO: 907466 - DNA, 14 bp, Homo sapiens
agggacagagccat

SEQ ID NO: 907467 - DNA, 14 bp, Homo sapiens
agggacagaggcca

SEQ ID NO: 907468 - DNA, 17 bp, Homo sapiens
agggacagaggccaagg

SEQ ID NO: 907469 - DNA, 18 bp, Homo sapiens
agggacagaggccaagga

SEQ ID NO: 907470 - DNA, 22 bp, Homo sapiens
agggacagaggccaaggactga

SEQ ID NO: 907471 - DNA, 15 bp, Homo sapiens
agggacagcaagtga

SEQ ID NO: 907472 - DNA, 16 bp, Homo sapiens
agggacaggaccccag

SEQ ID NO: 907473 - DNA, 14 bp, Homo sapiens
agggacaggagaag

SEQ ID NO: 907474 - DNA, 18 bp, Homo sapiens
agggacaggctgaagaga

SEQ ID NO: 907475 - DNA, 23 bp, Homo sapiens
agggacagttacaaaccaggtca

SEQ ID NO: 907476 - DNA, 15 bp, Homo sapiens
agggacatgatgggg

SEQ ID NO: 907477 - DNA, 16 bp, Homo sapiens
agggacatgccctgtg

SEQ ID NO: 907478 - DNA, 19 bp, Homo sapiens
agggacatgccctgtgtgg

SEQ ID NO: 907479 - DNA, 19 bp, Homo sapiens
agggacatgctcacctcta

SEQ ID NO: 907480 - DNA, 17 bp, Homo sapiens
agggacattgcagagtg

SEQ ID NO: 907481 - DNA, 18 bp, Homo sapiens
agggaccaaattgcttct

SEQ ID NO: 907482 - DNA, 16 bp, Homo sapiens
agggaccaactgggcc

SEQ ID NO: 907483 - DNA, 14 bp, Homo sapiens
agggaccaaggacc

SEQ ID NO: 907484 - DNA, 23 bp, Homo sapiens
agggaccaaggcaaggcaggtgc

SEQ ID NO: 907485 - DNA, 18 bp, Homo sapiens
agggaccactgggtgaga

SEQ ID NO: 907486 - DNA, 19 bp, Homo sapiens
agggaccatctgctgcagt

SEQ ID NO: 907487 - DNA, 19 bp, Homo sapiens
agggacccggggtctcctg

SEQ ID NO: 907488 - DNA, 15 bp, Homo sapiens
agggacccttgcctg

SEQ ID NO: 907489 - DNA, 23 bp, Homo sapiens
agggacccttgcctgcctcctag

SEQ ID NO: 907490 - DNA, 15 bp, Homo sapiens
agggaccctttgggg

SEQ ID NO: 907491 - DNA, 21 bp, Homo sapiens
agggaccggtgctgcaggagt

SEQ ID NO: 907492 - DNA, 23 bp, Homo sapiens
agggacctttttggtcatggagg

SEQ ID NO: 907493 - DNA, 16 bp, Homo sapiens
agggacgcggaggagg

SEQ ID NO: 907494 - DNA, 14 bp, Homo sapiens
agggacgctttgtc

SEQ ID NO: 907495 - DNA, 16 bp, Homo sapiens
agggacgggggtggga

SEQ ID NO: 907496 - DNA, 22 bp, Homo sapiens
agggacgggggtgggaggtagg

SEQ ID NO: 907497 - DNA, 15 bp, Homo sapiens
agggactagtgagtc

SEQ ID NO: 907498 - DNA, 20 bp, Homo sapiens
agggactcaagggtccagaa

SEQ ID NO: 907499 - DNA, 21 bp, Homo sapiens
agggactcaagggtccagaag

SEQ ID NO: 907500 - DNA, 13 bp, Homo sapiens
agggactgagaga

SEQ ID NO: 907501 - DNA, 17 bp, Homo sapiens
agggactgccaggctgt

SEQ ID NO: 907502 - DNA, 18 bp, Homo sapiens
agggactgccaggctgtt

SEQ ID NO: 907503 - DNA, 18 bp, Homo sapiens
aaagcggggggagggttg

SEQ ID NO: 907504 - DNA, 15 bp, Homo sapiens
aaagcggtccctgtc

SEQ ID NO: 907505 - DNA, 21 bp, Homo sapiens
aaagcgtgagcttaaaataca

SEQ ID NO: 907506 - DNA, 22 bp, Homo sapiens
aaagcgtgagcttaaaatacaa

SEQ ID NO: 907507 - DNA, 18 bp, Homo sapiens
aaagcgttggatgtagca

SEQ ID NO: 907508 - DNA, 14 bp, Homo sapiens
aaagcgtttgcaca

SEQ ID NO: 907509 - DNA, 15 bp, Homo sapiens
aaagctaaactgaat

SEQ ID NO: 907510 - DNA, 14 bp, Homo sapiens
aaagctaaattttg

SEQ ID NO: 907511 - DNA, 14 bp, Homo sapiens
agggatgggggaag

SEQ ID NO: 907512 - DNA, 15 bp, Homo sapiens
agggatgggggaaga

SEQ ID NO: 907513 - DNA, 16 bp, Homo sapiens
agggatgggggaagat

SEQ ID NO: 907514 - DNA, 14 bp, Homo sapiens
agggatgtatttgt

SEQ ID NO: 907515 - DNA, 22 bp, Homo sapiens
agggatgtgaattgcctgcaga

SEQ ID NO: 907516 - DNA, 17 bp, Homo sapiens
agggatgtttggaaaaa

SEQ ID NO: 907517 - DNA, 18 bp, Homo sapiens
agggattcacatctgcat

SEQ ID NO: 907518 - DNA, 15 bp, Homo sapiens
agggattcaggctgc

SEQ ID NO: 907519 - DNA, 16 bp, Homo sapiens
agggattctcacaata

SEQ ID NO: 907520 - DNA, 20 bp, Homo sapiens
agggattctggttccagggt

SEQ ID NO: 907521 - DNA, 16 bp, Homo sapiens
agggattgaggagttg

SEQ ID NO: 907522 - DNA, 20 bp, Homo sapiens
agggattggaccgagctgga

SEQ ID NO: 907523 - DNA, 13 bp, Homo sapiens
agggatttccctg

SEQ ID NO: 907524 - DNA, 20 bp, Homo sapiens
agggcaaaatcgccataggc

SEQ ID NO: 907525 - DNA, 15 bp, Homo sapiens
agggcaactcttgga

SEQ ID NO: 907526 - DNA, 20 bp, Homo sapiens
agggcaactcttggaagaaa

SEQ ID NO: 907527 - DNA, 22 bp, Homo sapiens
agggcaagaacccaagtgcctc

SEQ ID NO: 907528 - DNA, 13 bp, Homo sapiens
agggcaagccacc

SEQ ID NO: 907529 - DNA, 14 bp, Homo sapiens
agggcaagccacca

SEQ ID NO: 907530 - DNA, 15 bp, Homo sapiens
agggcaagccaccaa

SEQ ID NO: 907531 - DNA, 17 bp, Homo sapiens
agggcaaggggtttcca

SEQ ID NO: 907532 - DNA, 16 bp, Homo sapiens
agggcaatgccatcag

SEQ ID NO: 907533 - DNA, 20 bp, Homo sapiens
agggcacaaactgcagctgt

SEQ ID NO: 907534 - DNA, 22 bp, Homo sapiens
agggcacaaactgcagctgtga

SEQ ID NO: 907535 - DNA, 20 bp, Homo sapiens
agggcacaagtcctggatgt

SEQ ID NO: 907536 - DNA, 14 bp, Homo sapiens
agggcacagctgcc

SEQ ID NO: 907537 - DNA, 18 bp, Homo sapiens
agggcacagctgccctgc

SEQ ID NO: 907538 - DNA, 21 bp, Homo sapiens
agggcaccaggggtttctcgc

SEQ ID NO: 907539 - DNA, 21 bp, Homo sapiens
agggcaccctagttctacctc

SEQ ID NO: 907540 - DNA, 16 bp, Homo sapiens
agggcacgcaggacca

SEQ ID NO: 907541 - DNA, 16 bp, Homo sapiens
agggcacggggacctg

SEQ ID NO: 907542 - DNA, 13 bp, Homo sapiens
agggcactaaact

SEQ ID NO: 907543 - DNA, 13 bp, Homo sapiens
agggcactgggct

SEQ ID NO: 907544 - DNA, 14 bp, Homo sapiens
agggcactggtggc

SEQ ID NO: 907545 - DNA, 18 bp, Homo sapiens
agggcacttaatttgtaa

SEQ ID NO: 907546 - DNA, 14 bp, Homo sapiens
agggcacttcaggt

SEQ ID NO: 907547 - DNA, 16 bp, Homo sapiens
agggcacttcaggtcc

SEQ ID NO: 907548 - DNA, 17 bp, Homo sapiens
agggcacttcaggtccg

SEQ ID NO: 907549 - DNA, 22 bp, Homo sapiens
agggcacttcaggtccgtgggc

SEQ ID NO: 907550 - DNA, 17 bp, Homo sapiens
agggcacttcctccaca

SEQ ID NO: 907551 - DNA, 20 bp, Homo sapiens
agggcagaccacattgcttt

SEQ ID NO: 907552 - DNA, 20 bp, Homo sapiens
agggcagactggggcatcct

SEQ ID NO: 907553 - DNA, 23 bp, Homo sapiens
agggcagagccatgggcctgggc

SEQ ID NO: 907554 - DNA, 16 bp, Homo sapiens
agggcagaggaagaga

SEQ ID NO: 907555 - DNA, 22 bp, Homo sapiens
agggcagaggaatgtagggcct

SEQ ID NO: 907556 - DNA, 17 bp, Homo sapiens
agggcagaggctggagg

SEQ ID NO: 907557 - DNA, 12 bp, Homo sapiens
agggcagagtga

SEQ ID NO: 907558 - DNA, 19 bp, Homo sapiens
agggcagagtgagacccag

SEQ ID NO: 907559 - DNA, 14 bp, Homo sapiens
agggcagcaaggga

SEQ ID NO: 907560 - DNA, 21 bp, Homo sapiens
agggcagcactgggaagctgg

SEQ ID NO: 907561 - DNA, 18 bp, Homo sapiens
agggcagccctccatggt

SEQ ID NO: 907562 - DNA, 17 bp, Homo sapiens
agggcagcctggatccc

SEQ ID NO: 907563 - DNA, 14 bp, Homo sapiens
agggcagcgccagg

SEQ ID NO: 907564 - DNA, 16 bp, Homo sapiens
agggcagcgccaggct

SEQ ID NO: 907565 - DNA, 15 bp, Homo sapiens
agggcagcggctcca

SEQ ID NO: 907566 - DNA, 12 bp, Homo sapiens
agggcagctgcc

SEQ ID NO: 907567 - DNA, 13 bp, Homo sapiens
agggcagctgcct

SEQ ID NO: 907568 - DNA, 14 bp, Homo sapiens
agggcagctgcctg

SEQ ID NO: 907569 - DNA, 19 bp, Homo sapiens
agggcagctgcctggccat

SEQ ID NO: 907570 - DNA, 19 bp, Homo sapiens
agggcagctggcccccagc

SEQ ID NO: 907571 - DNA, 17 bp, Homo sapiens
agggcagcttgccccgg

SEQ ID NO: 907572 - DNA, 23 bp, Homo sapiens
agggcagcttgccccggccccgg

SEQ ID NO: 907573 - DNA, 18 bp, Homo sapiens
agggcaggaaggagagcc

SEQ ID NO: 907574 - DNA, 14 bp, Homo sapiens
agggcaggccttgc

SEQ ID NO: 907575 - DNA, 12 bp, Homo sapiens
agggcaggctga

SEQ ID NO: 907576 - DNA, 17 bp, Homo sapiens
agggcaggcttggggaa

SEQ ID NO: 907577 - DNA, 19 bp, Homo sapiens
agggcaggcttggggaaaa

SEQ ID NO: 907578 - DNA, 22 bp, Homo sapiens
agggcaggcttggggaaaatgg

SEQ ID NO: 907579 - DNA, 13 bp, Homo sapiens
agggcagggcatc

SEQ ID NO: 907580 - DNA, 12 bp, Homo sapiens
agggcagggccc

SEQ ID NO: 907581 - DNA, 16 bp, Homo sapiens
agggcaggtcttcata

SEQ ID NO: 907582 - DNA, 15 bp, Homo sapiens
agggcagtacctggg

SEQ ID NO: 907583 - DNA, 16 bp, Homo sapiens
agggcagtacctggga

SEQ ID NO: 907584 - DNA, 17 bp, Homo sapiens
agggcagtacctgggaa

SEQ ID NO: 907585 - DNA, 20 bp, Homo sapiens
agggcagtcgatagagctgt

SEQ ID NO: 907586 - DNA, 13 bp, Homo sapiens
agggcagtggcca

SEQ ID NO: 907587 - DNA, 18 bp, Homo sapiens
agggcagtggccaagcct

SEQ ID NO: 907588 - DNA, 21 bp, Homo sapiens
agggcagtggccaagcctgct

SEQ ID NO: 907589 - DNA, 14 bp, Homo sapiens
agggcagttttgag

SEQ ID NO: 907590 - DNA, 20 bp, Homo sapiens
agggcataaagtaaatacat

SEQ ID NO: 907591 - DNA, 17 bp, Homo sapiens
agggcatcaggcactgg

SEQ ID NO: 907592 - DNA, 13 bp, Homo sapiens
agggcatctcctg

SEQ ID NO: 907593 - DNA, 14 bp, Homo sapiens
agggcatctcctgt

SEQ ID NO: 907594 - DNA, 16 bp, Homo sapiens
agggcatctcctgtgc

SEQ ID NO: 907595 - DNA, 20 bp, Homo sapiens
agggcatgcacgggcatgca

SEQ ID NO: 907596 - DNA, 21 bp, Homo sapiens
agggcatgggttggcagggtg

SEQ ID NO: 907597 - DNA, 21 bp, Homo sapiens
agggcatgtgcggctgaactg

SEQ ID NO: 907598 - DNA, 23 bp, Homo sapiens
agggcatgtgcggctgaactgag

SEQ ID NO: 907599 - DNA, 23 bp, Homo sapiens
agggcattgtatctgtctttcca

SEQ ID NO: 907600 - DNA, 17 bp, Homo sapiens
agggccaaacccacttc

SEQ ID NO: 907601 - DNA, 22 bp, Homo sapiens
agggccaaacccacttctggcc

SEQ ID NO: 907602 - DNA, 23 bp, Homo sapiens
agggccaacttgagggcccagag

SEQ ID NO: 907603 - DNA, 21 bp, Homo sapiens
agggccaagcccagcactgct

SEQ ID NO: 907604 - DNA, 18 bp, Homo sapiens
agggccacactattacca

SEQ ID NO: 907605 - DNA, 17 bp, Homo sapiens
agggccaccctgctgca

SEQ ID NO: 907606 - DNA, 18 bp, Homo sapiens
agggccacctgcaggacc

SEQ ID NO: 907607 - DNA, 17 bp, Homo sapiens
agggccacgctccagct

SEQ ID NO: 907608 - DNA, 20 bp, Homo sapiens
agggccacgctccagctgcc

SEQ ID NO: 907609 - DNA, 20 bp, Homo sapiens
agggccacgtgccaggcccg

SEQ ID NO: 907610 - DNA, 23 bp, Homo sapiens
agggccactttttttttatactg

SEQ ID NO: 907611 - DNA, 14 bp, Homo sapiens
agggccagaaggag

SEQ ID NO: 907612 - DNA, 19 bp, Homo sapiens
agggccagaaggagggcag

SEQ ID NO: 907613 - DNA, 22 bp, Homo sapiens
agggccagaaggagggcagagc

SEQ ID NO: 907614 - DNA, 13 bp, Homo sapiens
agggccagactgg

SEQ ID NO: 907615 - DNA, 18 bp, Homo sapiens
agggccagcaggctcctg

SEQ ID NO: 907616 - DNA, 22 bp, Homo sapiens
agggccaggcaggtgcctggac

SEQ ID NO: 907617 - DNA, 16 bp, Homo sapiens
agggccagggaggcag

SEQ ID NO: 907618 - DNA, 12 bp, Homo sapiens
agggccagggca

SEQ ID NO: 907619 - DNA, 16 bp, Homo sapiens
agggccagggcaatgc

SEQ ID NO: 907620 - DNA, 20 bp, Homo sapiens
agggccagggcaatgccatc

SEQ ID NO: 907621 - DNA, 12 bp, Homo sapiens
agggccagggcc

SEQ ID NO: 907622 - DNA, 19 bp, Homo sapiens
agggccagggccctgcaga

SEQ ID NO: 907623 - DNA, 21 bp, Homo sapiens
agggccaggggtctccctgga

SEQ ID NO: 907624 - DNA, 17 bp, Homo sapiens
agggccaggtgcggcct

SEQ ID NO: 907625 - DNA, 22 bp, Homo sapiens
agggccagtcctcctgggagcc

SEQ ID NO: 907626 - DNA, 23 bp, Homo sapiens
agggccagtcctcctgggagccc

SEQ ID NO: 907627 - DNA, 12 bp, Homo sapiens
agggccagtgat

SEQ ID NO: 907628 - DNA, 22 bp, Homo sapiens
agggccagtgatgatgttttga

SEQ ID NO: 907629 - DNA, 14 bp, Homo sapiens
agggccatgcagac

SEQ ID NO: 907630 - DNA, 16 bp, Homo sapiens
agggccatgcagacct

SEQ ID NO: 907631 - DNA, 17 bp, Homo sapiens
agggccatgcctgcccc

SEQ ID NO: 907632 - DNA, 19 bp, Homo sapiens
agggccatgctgaggcctg

SEQ ID NO: 907633 - DNA, 23 bp, Homo sapiens
aaatacaaattttgtataacttt

SEQ ID NO: 907634 - DNA, 13 bp, Homo sapiens
aaatacaataaac

SEQ ID NO: 907635 - DNA, 17 bp, Homo sapiens
aaatacacaagtaaaca

SEQ ID NO: 907636 - DNA, 18 bp, Homo sapiens
aaatacacatagcatgta

SEQ ID NO: 907637 - DNA, 14 bp, Homo sapiens
aaatacagacacta

SEQ ID NO: 907638 - DNA, 16 bp, Homo sapiens
aaatacagacactaag

SEQ ID NO: 907639 - DNA, 20 bp, Homo sapiens
aaatacagataattcatttg

SEQ ID NO: 907640 - DNA, 21 bp, Homo sapiens
aaatacatatcgctgacttca

SEQ ID NO: 907641 - DNA, 20 bp, Homo sapiens
aaatacatgaagcttcatgc

SEQ ID NO: 907642 - DNA, 14 bp, Homo sapiens
aaatacatgcatct

SEQ ID NO: 907643 - DNA, 15 bp, Homo sapiens
agggctgcttttctt

SEQ ID NO: 907644 - DNA, 18 bp, Homo sapiens
agggctgcttttcttaag

SEQ ID NO: 907645 - DNA, 13 bp, Homo sapiens
agggctggaccta

SEQ ID NO: 907646 - DNA, 14 bp, Homo sapiens
agggctggagaaca

SEQ ID NO: 907647 - DNA, 21 bp, Homo sapiens
agggctggaggcccaggctgg

SEQ ID NO: 907648 - DNA, 13 bp, Homo sapiens
agggctggatgga

SEQ ID NO: 907649 - DNA, 19 bp, Homo sapiens
agggctggatggacagaca

SEQ ID NO: 907650 - DNA, 22 bp, Homo sapiens
agggctggcacgtgacaggctc

SEQ ID NO: 907651 - DNA, 19 bp, Homo sapiens
agggctggctcctgatcca

SEQ ID NO: 907652 - DNA, 17 bp, Homo sapiens
agggctggctggcctca

SEQ ID NO: 907653 - DNA, 11 bp, Homo sapiens
agggctgggcc

SEQ ID NO: 907654 - DNA, 15 bp, Homo sapiens
agggctggggactgg

SEQ ID NO: 907655 - DNA, 11 bp, Homo sapiens
agggctggggt

SEQ ID NO: 907656 - DNA, 18 bp, Homo sapiens
agggctggggtgagcctg

SEQ ID NO: 907657 - DNA, 16 bp, Homo sapiens
agggctggtctctgct

SEQ ID NO: 907658 - DNA, 15 bp, Homo sapiens
agggctggtggccac

SEQ ID NO: 907659 - DNA, 16 bp, Homo sapiens
agggctggttaatgta

SEQ ID NO: 907660 - DNA, 20 bp, Homo sapiens
agggctgtagacttactttc

SEQ ID NO: 907661 - DNA, 12 bp, Homo sapiens
agggctgtccca

SEQ ID NO: 907662 - DNA, 13 bp, Homo sapiens
agggctgtcccag

SEQ ID NO: 907663 - DNA, 16 bp, Homo sapiens
agggctgttggacagc

SEQ ID NO: 907664 - DNA, 19 bp, Homo sapiens
agggctgttggacagctgc

SEQ ID NO: 907665 - DNA, 19 bp, Homo sapiens
agggctgttggaggacccc

SEQ ID NO: 907666 - DNA, 18 bp, Homo sapiens
agggcttacctgtacact

SEQ ID NO: 907667 - DNA, 19 bp, Homo sapiens
agggcttccccatcagctc

SEQ ID NO: 907668 - DNA, 12 bp, Homo sapiens
agggcttcctct

SEQ ID NO: 907669 - DNA, 21 bp, Homo sapiens
agggcttcctctagaagccaa

SEQ ID NO: 907670 - DNA, 14 bp, Homo sapiens
agggcttctgcacc

SEQ ID NO: 907671 - DNA, 16 bp, Homo sapiens
agggcttctgcaccct

SEQ ID NO: 907672 - DNA, 19 bp, Homo sapiens
agggcttctgcaccctcca

SEQ ID NO: 907673 - DNA, 21 bp, Homo sapiens
agggcttgaggtgaatttcat

SEQ ID NO: 907674 - DNA, 21 bp, Homo sapiens
agggcttggggctgcacctcc

SEQ ID NO: 907675 - DNA, 21 bp, Homo sapiens
agggctttaaggcacaggctg

SEQ ID NO: 907676 - DNA, 17 bp, Homo sapiens
agggctttgagggtgga

SEQ ID NO: 907677 - DNA, 15 bp, Homo sapiens
agggctttggttcct

SEQ ID NO: 907678 - DNA, 17 bp, Homo sapiens
agggctttggttccttc

SEQ ID NO: 907679 - DNA, 21 bp, Homo sapiens
agggctttggttccttctctg

SEQ ID NO: 907680 - DNA, 22 bp, Homo sapiens
agggcttttattttttcttttg

SEQ ID NO: 907681 - DNA, 16 bp, Homo sapiens
agggctttttaaattt

SEQ ID NO: 907682 - DNA, 16 bp, Homo sapiens
aggggaaaaaaatgtt

SEQ ID NO: 907683 - DNA, 21 bp, Homo sapiens
aggggaaaccagtgtagcctt

SEQ ID NO: 907684 - DNA, 23 bp, Homo sapiens
aggggaaaccagtgtagccttgc

SEQ ID NO: 907685 - DNA, 14 bp, Homo sapiens
aggggaacctgcca

SEQ ID NO: 907686 - DNA, 18 bp, Homo sapiens
aggggaagagaagacaaa

SEQ ID NO: 907687 - DNA, 14 bp, Homo sapiens
aggggaagaggcct

SEQ ID NO: 907688 - DNA, 17 bp, Homo sapiens
aggggaagcactcgtgt

SEQ ID NO: 907689 - DNA, 17 bp, Homo sapiens
aggggaagctgggccca

SEQ ID NO: 907690 - DNA, 13 bp, Homo sapiens
aggggaagggcag

SEQ ID NO: 907691 - DNA, 17 bp, Homo sapiens
aggggaagggcaggcac

SEQ ID NO: 907692 - DNA, 14 bp, Homo sapiens
aggggaagggccag

SEQ ID NO: 907693 - DNA, 21 bp, Homo sapiens
aggggaagggctttgagggtg

SEQ ID NO: 907694 - DNA, 21 bp, Homo sapiens
aggggaaggggccggggaggg

SEQ ID NO: 907695 - DNA, 14 bp, Homo sapiens
aggggaagggggtg

SEQ ID NO: 907696 - DNA, 14 bp, Homo sapiens
aggggacactggcc

SEQ ID NO: 907697 - DNA, 14 bp, Homo sapiens
aggggacagagctg

SEQ ID NO: 907698 - DNA, 16 bp, Homo sapiens
aggggacagagctgag

SEQ ID NO: 907699 - DNA, 17 bp, Homo sapiens
aggggacagagctgagg

SEQ ID NO: 907700 - DNA, 18 bp, Homo sapiens
aggggacagagctgagga

SEQ ID NO: 907701 - DNA, 15 bp, Homo sapiens
aggggacagaggccc

SEQ ID NO: 907702 - DNA, 16 bp, Homo sapiens
aggggacagaggccct

SEQ ID NO: 907703 - DNA, 19 bp, Homo sapiens
aggggacagaggccctgcc

SEQ ID NO: 907704 - DNA, 18 bp, Homo sapiens
aggggacaggcctcacct

SEQ ID NO: 907705 - DNA, 14 bp, Homo sapiens
aggggacccccgcc

SEQ ID NO: 907706 - DNA, 19 bp, Homo sapiens
aggggacccccgccccctg

SEQ ID NO: 907707 - DNA, 23 bp, Homo sapiens
aggggactctgggctatggacac

SEQ ID NO: 907708 - DNA, 20 bp, Homo sapiens
aggggactgggggactggga

SEQ ID NO: 907709 - DNA, 21 bp, Homo sapiens
aggggactgggggactgggag

SEQ ID NO: 907710 - DNA, 13 bp, Homo sapiens
aggggactggtcc

SEQ ID NO: 907711 - DNA, 14 bp, Homo sapiens
aggggactgttcct

SEQ ID NO: 907712 - DNA, 22 bp, Homo sapiens
aggggagaaactgaaagtgttt

SEQ ID NO: 907713 - DNA, 19 bp, Homo sapiens
aggggagaagtcagctact

SEQ ID NO: 907714 - DNA, 18 bp, Homo sapiens
aggggagaatgcagccca

SEQ ID NO: 907715 - DNA, 19 bp, Homo sapiens
aggggagaatgcagcccac

SEQ ID NO: 907716 - DNA, 16 bp, Homo sapiens
aggggagacaggagcc

SEQ ID NO: 907717 - DNA, 17 bp, Homo sapiens
aggggagagacaggcag

SEQ ID NO: 907718 - DNA, 16 bp, Homo sapiens
aggggagagcctgctg

SEQ ID NO: 907719 - DNA, 17 bp, Homo sapiens
aggggagagggtctgga

SEQ ID NO: 907720 - DNA, 15 bp, Homo sapiens
aggggagccagctgc

SEQ ID NO: 907721 - DNA, 18 bp, Homo sapiens
aggggagccagctgcttg

SEQ ID NO: 907722 - DNA, 12 bp, Homo sapiens
aggggagccagg

SEQ ID NO: 907723 - DNA, 17 bp, Homo sapiens
aggggaggaaaaaagaa

SEQ ID NO: 907724 - DNA, 14 bp, Homo sapiens
aggggaggagggga

SEQ ID NO: 907725 - DNA, 22 bp, Homo sapiens
aggggaggcacctccaggcagg

SEQ ID NO: 907726 - DNA, 18 bp, Homo sapiens
aggggagggctcctgggg

SEQ ID NO: 907727 - DNA, 15 bp, Homo sapiens
aggggaggggcctag

SEQ ID NO: 907728 - DNA, 19 bp, Homo sapiens
aggggaggggggaggggga

SEQ ID NO: 907729 - DNA, 22 bp, Homo sapiens
aggggaggggggagggggaagc

SEQ ID NO: 907730 - DNA, 22 bp, Homo sapiens
aggggagggtgttcagaggcag

SEQ ID NO: 907731 - DNA, 18 bp, Homo sapiens
aggggatataggagagga

SEQ ID NO: 907732 - DNA, 13 bp, Homo sapiens
aggggatatttaa

SEQ ID NO: 907733 - DNA, 23 bp, Homo sapiens
aggggatcatgttaaaaatagca

SEQ ID NO: 907734 - DNA, 19 bp, Homo sapiens
aggggatggaattcttcct

SEQ ID NO: 907735 - DNA, 18 bp, Homo sapiens
aggggatggacaccccca

SEQ ID NO: 907736 - DNA, 16 bp, Homo sapiens
aggggatggaggccag

SEQ ID NO: 907737 - DNA, 19 bp, Homo sapiens
aggggatggaggccagagt

SEQ ID NO: 907738 - DNA, 14 bp, Homo sapiens
aggggattctctac

SEQ ID NO: 907739 - DNA, 17 bp, Homo sapiens
aggggattgaagccctc

SEQ ID NO: 907740 - DNA, 19 bp, Homo sapiens
aggggattgaagccctcca

SEQ ID NO: 907741 - DNA, 22 bp, Homo sapiens
aggggcaaccaactgccccagg

SEQ ID NO: 907742 - DNA, 23 bp, Homo sapiens
aggggcaaccaactgccccaggg

SEQ ID NO: 907743 - DNA, 19 bp, Homo sapiens
aggggcacaccactgccct

SEQ ID NO: 907744 - DNA, 22 bp, Homo sapiens
aggggcacgccctcctcagcga

SEQ ID NO: 907745 - DNA, 13 bp, Homo sapiens
aggggcactctcc

SEQ ID NO: 907746 - DNA, 16 bp, Homo sapiens
aggggcagagaggaag

SEQ ID NO: 907747 - DNA, 17 bp, Homo sapiens
aggggcagagccaggaa

SEQ ID NO: 907748 - DNA, 12 bp, Homo sapiens
aggggcagcagg

SEQ ID NO: 907749 - DNA, 13 bp, Homo sapiens
aggggcagcagga

SEQ ID NO: 907750 - DNA, 22 bp, Homo sapiens
aggggcagcaggaggagtggaa

SEQ ID NO: 907751 - DNA, 15 bp, Homo sapiens
aggggcagccctgag

SEQ ID NO: 907752 - DNA, 16 bp, Homo sapiens
aggggcagccctgagt

SEQ ID NO: 907753 - DNA, 13 bp, Homo sapiens
aggggcagccctt

SEQ ID NO: 907754 - DNA, 16 bp, Homo sapiens
aggggcagcccttgct

SEQ ID NO: 907755 - DNA, 19 bp, Homo sapiens
agggggccagctggggaga

SEQ ID NO: 907756 - DNA, 20 bp, Homo sapiens
agggggcccatccctgccca

SEQ ID NO: 907757 - DNA, 20 bp, Homo sapiens
agggggccccgccagggctg

SEQ ID NO: 907758 - DNA, 22 bp, Homo sapiens
agggggccccgccagggctggg

SEQ ID NO: 907759 - DNA, 23 bp, Homo sapiens
agggggccccgccagggctgggg

SEQ ID NO: 907760 - DNA, 16 bp, Homo sapiens
agggggccctgcccca

SEQ ID NO: 907761 - DNA, 20 bp, Homo sapiens
agggggccctgccccacccc

SEQ ID NO: 907762 - DNA, 21 bp, Homo sapiens
agggggccttgcggaagccat

SEQ ID NO: 907763 - DNA, 15 bp, Homo sapiens
agggggcgctcagga

SEQ ID NO: 907764 - DNA, 18 bp, Homo sapiens
agggggcgctcaggaccc

SEQ ID NO: 907765 - DNA, 22 bp, Homo sapiens
agggggcgctcaggacccaggc

SEQ ID NO: 907766 - DNA, 23 bp, Homo sapiens
agggggcgctcaggacccaggcc

SEQ ID NO: 907767 - DNA, 14 bp, Homo sapiens
agggggcggcaggg

SEQ ID NO: 907768 - DNA, 21 bp, Homo sapiens
agggggctctccaaaggggct

SEQ ID NO: 907769 - DNA, 22 bp, Homo sapiens
agggggctctccaaaggggctg

SEQ ID NO: 907770 - DNA, 14 bp, Homo sapiens
agggggctctgccc

SEQ ID NO: 907771 - DNA, 21 bp, Homo sapiens
agggggctctgcccacctggg

SEQ ID NO: 907772 - DNA, 22 bp, Homo sapiens
agggggctctgccccaggccct

SEQ ID NO: 907773 - DNA, 19 bp, Homo sapiens
aaatatccaaagactgtac

SEQ ID NO: 907774 - DNA, 14 bp, Homo sapiens
aaatatccacccag

SEQ ID NO: 907775 - DNA, 23 bp, Homo sapiens
aaatatcctcaggggtggagaag

SEQ ID NO: 907776 - DNA, 16 bp, Homo sapiens
aaatatcctgtaacta

SEQ ID NO: 907777 - DNA, 22 bp, Homo sapiens
aaatatcctgtaactacaatga

SEQ ID NO: 907778 - DNA, 14 bp, Homo sapiens
aaatatctcctcca

SEQ ID NO: 907779 - DNA, 17 bp, Homo sapiens
aaatatctctatttaat

SEQ ID NO: 907780 - DNA, 14 bp, Homo sapiens
aaatatctgaaaat

SEQ ID NO: 907781 - DNA, 17 bp, Homo sapiens
aaatatctgaaaatgta

SEQ ID NO: 907782 - DNA, 22 bp, Homo sapiens
aaatatctgaaaatgtatgtgt

SEQ ID NO: 907783 - DNA, 15 bp, Homo sapiens
aaatatctgtgaaat

SEQ ID NO: 907784 - DNA, 16 bp, Homo sapiens
aaatatcttcctttgg

SEQ ID NO: 907785 - DNA, 20 bp, Homo sapiens
aaatatgaaaaatgtaaata

SEQ ID NO: 907786 - DNA, 13 bp, Homo sapiens
aaatatgaaccta

SEQ ID NO: 907787 - DNA, 23 bp, Homo sapiens
aaatatgaacctattttcatttg

SEQ ID NO: 907788 - DNA, 15 bp, Homo sapiens
aaatatgaagagttt

SEQ ID NO: 907789 - DNA, 15 bp, Homo sapiens
aaatatgatgttaaa

SEQ ID NO: 907790 - DNA, 21 bp, Homo sapiens
aaatatgcactttccctagaa

SEQ ID NO: 907791 - DNA, 23 bp, Homo sapiens
aaatatgccccttcttgggcccc

SEQ ID NO: 907792 - DNA, 17 bp, Homo sapiens
aaatatggaacttacat

SEQ ID NO: 907793 - DNA, 18 bp, Homo sapiens
aaatatggaacttctaat

SEQ ID NO: 907794 - DNA, 15 bp, Homo sapiens
aaatatgtaatataa

SEQ ID NO: 907795 - DNA, 12 bp, Homo sapiens
aaatatgtacaa

SEQ ID NO: 907796 - DNA, 15 bp, Homo sapiens
aaatatgtcgtagaa

SEQ ID NO: 907797 - DNA, 17 bp, Homo sapiens
aaatatgtcgtagaatt

SEQ ID NO: 907798 - DNA, 15 bp, Homo sapiens
aaatatgtgaagaaa

SEQ ID NO: 907799 - DNA, 13 bp, Homo sapiens
aaatatgtgaagt

SEQ ID NO: 907800 - DNA, 12 bp, Homo sapiens
aaatattaaaat

SEQ ID NO: 907801 - DNA, 15 bp, Homo sapiens
aaatattaaaatcac

SEQ ID NO: 907802 - DNA, 16 bp, Homo sapiens
aaatattaacattctt

SEQ ID NO: 907803 - DNA, 19 bp, Homo sapiens
aaatattaagaaagactat

SEQ ID NO: 907804 - DNA, 15 bp, Homo sapiens
aaatattagcaaaga

SEQ ID NO: 907805 - DNA, 20 bp, Homo sapiens
aaatattataacttaaaaaa

SEQ ID NO: 907806 - DNA, 23 bp, Homo sapiens
aaatattatccagcaagcagtct

SEQ ID NO: 907807 - DNA, 21 bp, Homo sapiens
aaatattatttgtgtttccta

SEQ ID NO: 907808 - DNA, 14 bp, Homo sapiens
aaatattcaagtaa

SEQ ID NO: 907809 - DNA, 17 bp, Homo sapiens
aaatattcactggcccc

SEQ ID NO: 907810 - DNA, 13 bp, Homo sapiens
aaatattcatatt

SEQ ID NO: 907811 - DNA, 19 bp, Homo sapiens
aaatattccctagaaactt

SEQ ID NO: 907812 - DNA, 16 bp, Homo sapiens
aaatattcctttgcat

SEQ ID NO: 907813 - DNA, 13 bp, Homo sapiens
aaatattctatat

SEQ ID NO: 907814 - DNA, 14 bp, Homo sapiens
aaatattctatatg

SEQ ID NO: 907815 - DNA, 13 bp, Homo sapiens
aaatattctgaat

SEQ ID NO: 907816 - DNA, 15 bp, Homo sapiens
aaatattgaagttgt

SEQ ID NO: 907817 - DNA, 17 bp, Homo sapiens
aaatattgaagttgttt

SEQ ID NO: 907818 - DNA, 15 bp, Homo sapiens
aaatattgatgaaaa

SEQ ID NO: 907819 - DNA, 13 bp, Homo sapiens
aaatattgctaaa

SEQ ID NO: 907820 - DNA, 14 bp, Homo sapiens
aaatattgctaaaa

SEQ ID NO: 907821 - DNA, 20 bp, Homo sapiens
aaatattgctaaaagtgcat

SEQ ID NO: 907822 - DNA, 21 bp, Homo sapiens
aaatattgctaaaagtgcatt

SEQ ID NO: 907823 - DNA, 17 bp, Homo sapiens
aaatattgttgacaact

SEQ ID NO: 907824 - DNA, 21 bp, Homo sapiens
aaatattgtttctgcattcat

SEQ ID NO: 907825 - DNA, 22 bp, Homo sapiens
aaatattgtttctgcattcatt

SEQ ID NO: 907826 - DNA, 14 bp, Homo sapiens
aaatatttaaaaat

SEQ ID NO: 907827 - DNA, 14 bp, Homo sapiens
aaatatttaaacct

SEQ ID NO: 907828 - DNA, 16 bp, Homo sapiens
aaatatttaacttttt

SEQ ID NO: 907829 - DNA, 17 bp, Homo sapiens
aaatatttaagtatata

SEQ ID NO: 907830 - DNA, 20 bp, Homo sapiens
aaatatttaagtatatagta

SEQ ID NO: 907831 - DNA, 20 bp, Homo sapiens
aaatatttaagtgaaggaga

SEQ ID NO: 907832 - DNA, 16 bp, Homo sapiens
aaatatttaccttgaa

SEQ ID NO: 907833 - DNA, 19 bp, Homo sapiens
aaatatttactctttgcaa

SEQ ID NO: 907834 - DNA, 22 bp, Homo sapiens
aaatatttatgcttaaaatatg

SEQ ID NO: 907835 - DNA, 15 bp, Homo sapiens
aaatatttatttatt

SEQ ID NO: 907836 - DNA, 17 bp, Homo sapiens
aaatatttcatttagct

SEQ ID NO: 907837 - DNA, 20 bp, Homo sapiens
aaatatttcctgacttgagt

SEQ ID NO: 907838 - DNA, 12 bp, Homo sapiens
aaatatttcctt

SEQ ID NO: 907839 - DNA, 17 bp, Homo sapiens
aaatatttctatgtaaa

SEQ ID NO: 907840 - DNA, 17 bp, Homo sapiens
aaatatttgaatgaaaa

SEQ ID NO: 907841 - DNA, 20 bp, Homo sapiens
aaatatttgaatgaaaacat

SEQ ID NO: 907842 - DNA, 23 bp, Homo sapiens
aaatatttgaatgaaaacatttt

SEQ ID NO: 907843 - DNA, 15 bp, Homo sapiens
aaatattttaaagaa

SEQ ID NO: 907844 - DNA, 17 bp, Homo sapiens
aaatattttaagaaaga

SEQ ID NO: 907845 - DNA, 22 bp, Homo sapiens
aaatattttaagaaagagaatg

SEQ ID NO: 907846 - DNA, 16 bp, Homo sapiens
aaatattttagaagct

SEQ ID NO: 907847 - DNA, 19 bp, Homo sapiens
aaatattttagatgttatt

SEQ ID NO: 907848 - DNA, 13 bp, Homo sapiens
aaatattttcaag

SEQ ID NO: 907849 - DNA, 12 bp, Homo sapiens
aaatattttcta

SEQ ID NO: 907850 - DNA, 13 bp, Homo sapiens
aaatattttctat

SEQ ID NO: 907851 - DNA, 14 bp, Homo sapiens
aaatattttctatt

SEQ ID NO: 907852 - DNA, 15 bp, Homo sapiens
aaatattttctctgt

SEQ ID NO: 907853 - DNA, 21 bp, Homo sapiens
aaatattttgaatcaataata

SEQ ID NO: 907854 - DNA, 13 bp, Homo sapiens
aaatattttgata

SEQ ID NO: 907855 - DNA, 17 bp, Homo sapiens
aaatattttgatacaaa

SEQ ID NO: 907856 - DNA, 14 bp, Homo sapiens
aaatattttggatg

SEQ ID NO: 907857 - DNA, 15 bp, Homo sapiens
aaatattttgtctaa

SEQ ID NO: 907858 - DNA, 21 bp, Homo sapiens
aaatattttgttaacttttgt

SEQ ID NO: 907859 - DNA, 14 bp, Homo sapiens
aaatattttttctg

SEQ ID NO: 907860 - DNA, 13 bp, Homo sapiens
aaatcaaacccac

SEQ ID NO: 907861 - DNA, 13 bp, Homo sapiens
aaatcaaagaaca

SEQ ID NO: 907862 - DNA, 16 bp, Homo sapiens
aaatcaaagaacagat

SEQ ID NO: 907863 - DNA, 17 bp, Homo sapiens
aaatcaaagaacagatg

SEQ ID NO: 907864 - DNA, 13 bp, Homo sapiens
aaatcaaatgaat

SEQ ID NO: 907865 - DNA, 21 bp, Homo sapiens
aaatcaacaccttaatatgct

SEQ ID NO: 907866 - DNA, 16 bp, Homo sapiens
aaatcaacagaagcat

SEQ ID NO: 907867 - DNA, 19 bp, Homo sapiens
aaatcaacagaagcatttg

SEQ ID NO: 907868 - DNA, 17 bp, Homo sapiens
aaatcaaccctctcctg

SEQ ID NO: 907869 - DNA, 23 bp, Homo sapiens
aaatcaacttgtggttgaccgct

SEQ ID NO: 907870 - DNA, 12 bp, Homo sapiens
aaatcaaggaaa

SEQ ID NO: 907871 - DNA, 23 bp, Homo sapiens
aaatcaaggaaaggctcatttaa

SEQ ID NO: 907872 - DNA, 18 bp, Homo sapiens
aaatcaaggcaaaaggaa

SEQ ID NO: 907873 - DNA, 16 bp, Homo sapiens
aaatcaagtcctttaa

SEQ ID NO: 907874 - DNA, 21 bp, Homo sapiens
aaatcaagtttgaccagtgca

SEQ ID NO: 907875 - DNA, 23 bp, Homo sapiens
aaatcaagtttgaccagtgcagt

SEQ ID NO: 907876 - DNA, 15 bp, Homo sapiens
aaatcaatacactag

SEQ ID NO: 907877 - DNA, 19 bp, Homo sapiens
aaatctttagggaatgaga

SEQ ID NO: 907878 - DNA, 14 bp, Homo sapiens
aaatctttctttct

SEQ ID NO: 907879 - DNA, 17 bp, Homo sapiens
aaatctttttgcttcta

SEQ ID NO: 907880 - DNA, 17 bp, Homo sapiens
aaatgaaaacttttgta

SEQ ID NO: 907881 - DNA, 19 bp, Homo sapiens
aaatgaaaacttttgtaaa

SEQ ID NO: 907882 - DNA, 21 bp, Homo sapiens
aaatgaaaacttttgtaaatt

SEQ ID NO: 907883 - DNA, 16 bp, Homo sapiens
aaatgaaaagcaatac

SEQ ID NO: 907884 - DNA, 19 bp, Homo sapiens
aaatgaaaattacgttctt

SEQ ID NO: 907885 - DNA, 14 bp, Homo sapiens
aaatgaaaattgta

SEQ ID NO: 907886 - DNA, 15 bp, Homo sapiens
aaatgaaagcatgtg

SEQ ID NO: 907887 - DNA, 23 bp, Homo sapiens
aaatgaaagtgactttaaaagaa

SEQ ID NO: 907888 - DNA, 15 bp, Homo sapiens
aaatgaaatgtatgc

SEQ ID NO: 907889 - DNA, 22 bp, Homo sapiens
aaatgaaattactacaaaattt

SEQ ID NO: 907890 - DNA, 14 bp, Homo sapiens
aaatgaaattgtaa

SEQ ID NO: 907891 - DNA, 17 bp, Homo sapiens
aaatgaacttttacaga

SEQ ID NO: 907892 - DNA, 16 bp, Homo sapiens
aaatgaagaaagtcaa

SEQ ID NO: 907893 - DNA, 18 bp, Homo sapiens
aaatgaagcagctttaaa

SEQ ID NO: 907894 - DNA, 18 bp, Homo sapiens
aaatgaataatttcccaa

SEQ ID NO: 907895 - DNA, 23 bp, Homo sapiens
aaatgaatagcttgtttctgtca

SEQ ID NO: 907896 - DNA, 16 bp, Homo sapiens
aaatgaatcattgtta

SEQ ID NO: 907897 - DNA, 23 bp, Homo sapiens
aaatgaatggaggaactttccaa

SEQ ID NO: 907898 - DNA, 15 bp, Homo sapiens
aaatgacaaagccat

SEQ ID NO: 907899 - DNA, 14 bp, Homo sapiens
aaatgacaaagtgt

SEQ ID NO: 907900 - DNA, 19 bp, Homo sapiens
aaatgacaaagtgttgaaa

SEQ ID NO: 907901 - DNA, 14 bp, Homo sapiens
aaatgacaacagaa

SEQ ID NO: 907902 - DNA, 19 bp, Homo sapiens
aaatgacaacagaaaaaca

SEQ ID NO: 907903 - DNA, 23 bp, Homo sapiens
agggtcttgctctgtcccccagg

SEQ ID NO: 907904 - DNA, 14 bp, Homo sapiens
agggtcttgggaaa

SEQ ID NO: 907905 - DNA, 14 bp, Homo sapiens
agggtcttgggcta

SEQ ID NO: 907906 - DNA, 21 bp, Homo sapiens
agggtcttgggctactggcag

SEQ ID NO: 907907 - DNA, 22 bp, Homo sapiens
agggtcttgggctactggcagc

SEQ ID NO: 907908 - DNA, 20 bp, Homo sapiens
agggtcttgggggtcagggg

SEQ ID NO: 907909 - DNA, 18 bp, Homo sapiens
agggtctttggtgttttt

SEQ ID NO: 907910 - DNA, 18 bp, Homo sapiens
agggtcttttaccctgtg

SEQ ID NO: 907911 - DNA, 19 bp, Homo sapiens
agggtcttttaccctgtgt

SEQ ID NO: 907912 - DNA, 20 bp, Homo sapiens
agggtcttttaccctgtgtc

SEQ ID NO: 907913 - DNA, 19 bp, Homo sapiens
agggtgaaacttaaaaaaa

SEQ ID NO: 907914 - DNA, 22 bp, Homo sapiens
agggtgacatggggaaggcaga

SEQ ID NO: 907915 - DNA, 22 bp, Homo sapiens
agggtgacccacagctctgggc

SEQ ID NO: 907916 - DNA, 23 bp, Homo sapiens
agggtgacccacagctctgggcc

SEQ ID NO: 907917 - DNA, 19 bp, Homo sapiens
agggtgacgcccagctccg

SEQ ID NO: 907918 - DNA, 15 bp, Homo sapiens
agggtgacgcctgag

SEQ ID NO: 907919 - DNA, 20 bp, Homo sapiens
agggtgacgcctgagacagc

SEQ ID NO: 907920 - DNA, 14 bp, Homo sapiens
agggtgagaagcta

SEQ ID NO: 907921 - DNA, 14 bp, Homo sapiens
agggtgcagcccaa

SEQ ID NO: 907922 - DNA, 20 bp, Homo sapiens
agggtgcagtatcatgccct

SEQ ID NO: 907923 - DNA, 20 bp, Homo sapiens
agggtgcagttttccaggaa

SEQ ID NO: 907924 - DNA, 17 bp, Homo sapiens
agggtgcccatttgtga

SEQ ID NO: 907925 - DNA, 17 bp, Homo sapiens
agggtgccctttggggt

SEQ ID NO: 907926 - DNA, 21 bp, Homo sapiens
agggtgccctttggggtcccg

SEQ ID NO: 907927 - DNA, 24 bp, Homo sapiens
agggtgccgtgtcccctgacaggg

SEQ ID NO: 907928 - DNA, 13 bp, Homo sapiens
agggtgcctcagg

SEQ ID NO: 907929 - DNA, 15 bp, Homo sapiens
agggtgcctcaggac

SEQ ID NO: 907930 - DNA, 14 bp, Homo sapiens
agggtgctgactgg

SEQ ID NO: 907931 - DNA, 17 bp, Homo sapiens
agggtggaaaaatgccc

SEQ ID NO: 907932 - DNA, 12 bp, Homo sapiens
agggtggaaata

SEQ ID NO: 907933 - DNA, 19 bp, Homo sapiens
agggtggaaataatttgaa

SEQ ID NO: 907934 - DNA, 18 bp, Homo sapiens
agggtggaccaggcctgg

SEQ ID NO: 907935 - DNA, 19 bp, Homo sapiens
agggtggaccaggcctgga

SEQ ID NO: 907936 - DNA, 22 bp, Homo sapiens
agggtggagagggagactcctg

SEQ ID NO: 907937 - DNA, 18 bp, Homo sapiens
agggtggaggaaggtgct

SEQ ID NO: 907938 - DNA, 19 bp, Homo sapiens
agggtggatgacagggcag

SEQ ID NO: 907939 - DNA, 13 bp, Homo sapiens
agggtggcagcaa

SEQ ID NO: 907940 - DNA, 17 bp, Homo sapiens
agggtggcaggtcactg

SEQ ID NO: 907941 - DNA, 11 bp, Homo sapiens
agggtggccct

SEQ ID NO: 907942 - DNA, 14 bp, Homo sapiens
agggtgggaagaga

SEQ ID NO: 907943 - DNA, 16 bp, Homo sapiens
agggtgggcaaactct

SEQ ID NO: 907944 - DNA, 18 bp, Homo sapiens
agggtgggccactctccc

SEQ ID NO: 907945 - DNA, 12 bp, Homo sapiens
agggtgggccag

SEQ ID NO: 907946 - DNA, 19 bp, Homo sapiens
agggtgggcgtttggggcc

SEQ ID NO: 907947 - DNA, 18 bp, Homo sapiens
agggtgggggccacctgc

SEQ ID NO: 907948 - DNA, 22 bp, Homo sapiens
agggtgggggccacctgcctgc

SEQ ID NO: 907949 - DNA, 23 bp, Homo sapiens
agggtgggggccacctgcctgcg

SEQ ID NO: 907950 - DNA, 23 bp, Homo sapiens
agggtggggggatttgtagcata

SEQ ID NO: 907951 - DNA, 21 bp, Homo sapiens
agggtggggtctgggaggggg

SEQ ID NO: 907952 - DNA, 20 bp, Homo sapiens
agggtggtctgagcaccccc

SEQ ID NO: 907953 - DNA, 17 bp, Homo sapiens
agggtggtgctgggact

SEQ ID NO: 907954 - DNA, 18 bp, Homo sapiens
agggtggtggtattctgt

SEQ ID NO: 907955 - DNA, 19 bp, Homo sapiens
agggtggtggtattctgtc

SEQ ID NO: 907956 - DNA, 14 bp, Homo sapiens
agggtgtaggggcc

SEQ ID NO: 907957 - DNA, 15 bp, Homo sapiens
agggtgtaggggcca

SEQ ID NO: 907958 - DNA, 23 bp, Homo sapiens
agggtgtgactcgggagctgcac

SEQ ID NO: 907959 - DNA, 24 bp, Homo sapiens
agggtgtgactcgggagctgcaca

SEQ ID NO: 907960 - DNA, 15 bp, Homo sapiens
agggtgtggctttcc

SEQ ID NO: 907961 - DNA, 12 bp, Homo sapiens
agggtgtgtgct

SEQ ID NO: 907962 - DNA, 19 bp, Homo sapiens
agggtgtgtgttcaccttc

SEQ ID NO: 907963 - DNA, 20 bp, Homo sapiens
agggtgtgtgttcaccttca

SEQ ID NO: 907964 - DNA, 20 bp, Homo sapiens
agggtgtgtttgaaatcatc

SEQ ID NO: 907965 - DNA, 19 bp, Homo sapiens
agggtgttttgggtggcat

SEQ ID NO: 907966 - DNA, 17 bp, Homo sapiens
agggttagcctgcaccg

SEQ ID NO: 907967 - DNA, 18 bp, Homo sapiens
agggttaggaatctcttc

SEQ ID NO: 907968 - DNA, 16 bp, Homo sapiens
agggttagggaggggt

SEQ ID NO: 907969 - DNA, 14 bp, Homo sapiens
agggttatatttgg

SEQ ID NO: 907970 - DNA, 18 bp, Homo sapiens
agggttattgcatttgga

SEQ ID NO: 907971 - DNA, 20 bp, Homo sapiens
agggttatttagtaaagttt

SEQ ID NO: 907972 - DNA, 14 bp, Homo sapiens
agggttcaaaatgt

SEQ ID NO: 907973 - DNA, 17 bp, Homo sapiens
agggttcccccagccct

SEQ ID NO: 907974 - DNA, 13 bp, Homo sapiens
agggttcccctgg

SEQ ID NO: 907975 - DNA, 16 bp, Homo sapiens
agggttccgccactcc

SEQ ID NO: 907976 - DNA, 18 bp, Homo sapiens
agggttcctcttaggtca

SEQ ID NO: 907977 - DNA, 23 bp, Homo sapiens
agggttctgccctgcctgaggag

SEQ ID NO: 907978 - DNA, 14 bp, Homo sapiens
agggttctggctgc

SEQ ID NO: 907979 - DNA, 21 bp, Homo sapiens
agggttgaagacggaaaacaa

SEQ ID NO: 907980 - DNA, 14 bp, Homo sapiens
agggttgagagcca

SEQ ID NO: 907981 - DNA, 19 bp, Homo sapiens
agggttgcttctgagtggt

SEQ ID NO: 907982 - DNA, 21 bp, Homo sapiens
agggttgcttctgagtggtgt

SEQ ID NO: 907983 - DNA, 18 bp, Homo sapiens
agggtttacccagtggga

SEQ ID NO: 907984 - DNA, 15 bp, Homo sapiens
agggtttcgactggt

SEQ ID NO: 907985 - DNA, 19 bp, Homo sapiens
agggtttcgactggtccag

SEQ ID NO: 907986 - DNA, 23 bp, Homo sapiens
agggtttcgactggtccagctct

SEQ ID NO: 907987 - DNA, 12 bp, Homo sapiens
agggtttctctg

SEQ ID NO: 907988 - DNA, 21 bp, Homo sapiens
agggtttggctgtgtctaaac

SEQ ID NO: 907989 - DNA, 23 bp, Homo sapiens
agggtttggctgtgtctaaactg

SEQ ID NO: 907990 - DNA, 18 bp, Homo sapiens
agggttttccaccctgga

SEQ ID NO: 907991 - DNA, 13 bp, Homo sapiens
agggttttctttt

SEQ ID NO: 907992 - DNA, 16 bp, Homo sapiens
agggttttcttttctt

SEQ ID NO: 907993 - DNA, 13 bp, Homo sapiens
agggttttgcccc

SEQ ID NO: 907994 - DNA, 11 bp, Homo sapiens
agggttttgta

SEQ ID NO: 907995 - DNA, 14 bp, Homo sapiens
agggtttttagaga

SEQ ID NO: 907996 - DNA, 20 bp, Homo sapiens
agggtttttagagaatgtgt

SEQ ID NO: 907997 - DNA, 16 bp, Homo sapiens
agggttttttttaatg

SEQ ID NO: 907998 - DNA, 21 bp, Homo sapiens
caggacagtgcttcagcctga

SEQ ID NO: 907999 - DNA, 17 bp, Homo sapiens
caggacataggcacagg

SEQ ID NO: 908000 - DNA, 18 bp, Homo sapiens
caggacatgcggtagcca

SEQ ID NO: 908001 - DNA, 21 bp, Homo sapiens
caggacatgcggtagccagca

SEQ ID NO: 908002 - DNA, 12 bp, Homo sapiens
caggacatttct

SEQ ID NO: 908003 - DNA, 14 bp, Homo sapiens
caggacatttctct

SEQ ID NO: 908004 - DNA, 15 bp, Homo sapiens
caggaccaagggggc

SEQ ID NO: 908005 - DNA, 21 bp, Homo sapiens
caggaccaagggggcggggac

SEQ ID NO: 908006 - DNA, 20 bp, Homo sapiens
caggaccagccagcagcagc

SEQ ID NO: 908007 - DNA, 13 bp, Homo sapiens
caggaccagcctg

SEQ ID NO: 908008 - DNA, 15 bp, Homo sapiens
caggaccagcctgta

SEQ ID NO: 908009 - DNA, 12 bp, Homo sapiens
caggaccagctg

SEQ ID NO: 908010 - DNA, 13 bp, Homo sapiens
caggaccaggact

SEQ ID NO: 908011 - DNA, 17 bp, Homo sapiens
caggacccaggccctcc

SEQ ID NO: 908012 - DNA, 21 bp, Homo sapiens
caggacccaggccctccatgg

SEQ ID NO: 908013 - DNA, 23 bp, Homo sapiens
caggacccagggtcccctcccca

SEQ ID NO: 908014 - DNA, 17 bp, Homo sapiens
caggaccccagctctgc

SEQ ID NO: 908015 - DNA, 16 bp, Homo sapiens
caggaccccaggtcag

SEQ ID NO: 908016 - DNA, 21 bp, Homo sapiens
caggaccccaggtcaggggct

SEQ ID NO: 908017 - DNA, 14 bp, Homo sapiens
caggacccccgagg

SEQ ID NO: 908018 - DNA, 15 bp, Homo sapiens
caggacccccgaggg

SEQ ID NO: 908019 - DNA, 19 bp, Homo sapiens
caggacccctcagctcccc

SEQ ID NO: 908020 - DNA, 15 bp, Homo sapiens
caggacccgccagcc

SEQ ID NO: 908021 - DNA, 18 bp, Homo sapiens
caggaccctgtcctgcag

SEQ ID NO: 908022 - DNA, 22 bp, Homo sapiens
caggaccctgtcctgcagtccc

SEQ ID NO: 908023 - DNA, 24 bp, Homo sapiens
caggaccctgtcctgcagtcccac

SEQ ID NO: 908024 - DNA, 21 bp, Homo sapiens
caggacctcagagtccaggcc

SEQ ID NO: 908025 - DNA, 17 bp, Homo sapiens
caggacctcccttccga

SEQ ID NO: 908026 - DNA, 19 bp, Homo sapiens
caggacctcccttccgacc

SEQ ID NO: 908027 - DNA, 20 bp, Homo sapiens
caggacctcccttccgaccc

SEQ ID NO: 908028 - DNA, 18 bp, Homo sapiens
caggacctcgtgccaccc

SEQ ID NO: 908029 - DNA, 13 bp, Homo sapiens
caggacctgacta

SEQ ID NO: 908030 - DNA, 13 bp, Homo sapiens
caggacctgccta

SEQ ID NO: 908031 - DNA, 15 bp, Homo sapiens
caggacctgcctagc

SEQ ID NO: 908032 - DNA, 20 bp, Homo sapiens
caggacctgcctagcatggg

SEQ ID NO: 908033 - DNA, 16 bp, Homo sapiens
caggacctggctgcca

SEQ ID NO: 908034 - DNA, 21 bp, Homo sapiens
caggaccttcgggctgtgccc

SEQ ID NO: 908035 - DNA, 12 bp, Homo sapiens
caggacgccact

SEQ ID NO: 908036 - DNA, 14 bp, Homo sapiens
caggacgccactca

SEQ ID NO: 908037 - DNA, 17 bp, Homo sapiens
caggacgccactcattt

SEQ ID NO: 908038 - DNA, 13 bp, Homo sapiens
caggacggctcct

SEQ ID NO: 908039 - DNA, 23 bp, Homo sapiens
caggacggctcctcagagcgcca

SEQ ID NO: 908040 - DNA, 23 bp, Homo sapiens
caggacgtccttccatatccctg

SEQ ID NO: 908041 - DNA, 17 bp, Homo sapiens
caggacgtctggggtgt

SEQ ID NO: 908042 - DNA, 22 bp, Homo sapiens
caggactccaaccaagaggatt

SEQ ID NO: 908043 - DNA, 16 bp, Homo sapiens
caggactccaggccca

SEQ ID NO: 908044 - DNA, 17 bp, Homo sapiens
caggactccaggcccaa

SEQ ID NO: 908045 - DNA, 19 bp, Homo sapiens
caggactccaggcccaagg

SEQ ID NO: 908046 - DNA, 15 bp, Homo sapiens
caggactccccaggc

SEQ ID NO: 908047 - DNA, 17 bp, Homo sapiens
caggactccccaggcca

SEQ ID NO: 908048 - DNA, 13 bp, Homo sapiens
caggactccctcc

SEQ ID NO: 908049 - DNA, 14 bp, Homo sapiens
caggactccctcct

SEQ ID NO: 908050 - DNA, 15 bp, Homo sapiens
caggactccctcctc

SEQ ID NO: 908051 - DNA, 20 bp, Homo sapiens
caggactccctcctcacctc

SEQ ID NO: 908052 - DNA, 15 bp, Homo sapiens
caggactcctggcag

SEQ ID NO: 908053 - DNA, 20 bp, Homo sapiens
caggactcctggcagggcca

SEQ ID NO: 908054 - DNA, 14 bp, Homo sapiens
caggactctggcac

SEQ ID NO: 908055 - DNA, 20 bp, Homo sapiens
caggactgaattgtccccag

SEQ ID NO: 908056 - DNA, 18 bp, Homo sapiens
caggactgagccctctca

SEQ ID NO: 908057 - DNA, 22 bp, Homo sapiens
caggactgagccctctcactcc

SEQ ID NO: 908058 - DNA, 13 bp, Homo sapiens
caggactgcacag

SEQ ID NO: 908059 - DNA, 13 bp, Homo sapiens
caggactggctgt

SEQ ID NO: 908060 - DNA, 15 bp, Homo sapiens
caggacttaaaatga

SEQ ID NO: 908061 - DNA, 19 bp, Homo sapiens
caggacttaacggctccag

SEQ ID NO: 908062 - DNA, 21 bp, Homo sapiens
caggacttaacggctccagga

SEQ ID NO: 908063 - DNA, 21 bp, Homo sapiens
caggacttagaatagtgccta

SEQ ID NO: 908064 - DNA, 16 bp, Homo sapiens
caggacttgaaagaaa

SEQ ID NO: 908065 - DNA, 21 bp, Homo sapiens
caggacttgctaaagcacttt

SEQ ID NO: 908066 - DNA, 17 bp, Homo sapiens
caggacttggggtcagg

SEQ ID NO: 908067 - DNA, 23 bp, Homo sapiens
caggacttggtctgatttcagga

SEQ ID NO: 908068 - DNA, 19 bp, Homo sapiens
caggactttgaggcaagtg

SEQ ID NO: 908069 - DNA, 18 bp, Homo sapiens
caggagaaagccggggga

SEQ ID NO: 908070 - DNA, 22 bp, Homo sapiens
caggagaaagccgggggagggg

SEQ ID NO: 908071 - DNA, 19 bp, Homo sapiens
caggagaaagtaccctctt

SEQ ID NO: 908072 - DNA, 23 bp, Homo sapiens
caggagaaatgcatccattcctc

SEQ ID NO: 908073 - DNA, 19 bp, Homo sapiens
caggagaagaacctgaaga

SEQ ID NO: 908074 - DNA, 13 bp, Homo sapiens
caggagaagctca

SEQ ID NO: 908075 - DNA, 14 bp, Homo sapiens
caggagaagctcag

SEQ ID NO: 908076 - DNA, 15 bp, Homo sapiens
caggagaagctcagc

SEQ ID NO: 908077 - DNA, 17 bp, Homo sapiens
caggagaagctcagctg

SEQ ID NO: 908078 - DNA, 23 bp, Homo sapiens
caggagaaggtcagcgagaagga

SEQ ID NO: 908079 - DNA, 20 bp, Homo sapiens
caggagaatggggttcctgc

SEQ ID NO: 908080 - DNA, 22 bp, Homo sapiens
caggagaatggggttcctgctg

SEQ ID NO: 908081 - DNA, 15 bp, Homo sapiens
caggagacaggaagg

SEQ ID NO: 908082 - DNA, 16 bp, Homo sapiens
caggagacatatatag

SEQ ID NO: 908083 - DNA, 18 bp, Homo sapiens
caggagactccaaggagc

SEQ ID NO: 908084 - DNA, 22 bp, Homo sapiens
caggagactgggctctggctct

SEQ ID NO: 908085 - DNA, 19 bp, Homo sapiens
caggagagactgagcagcc

SEQ ID NO: 908086 - DNA, 21 bp, Homo sapiens
caggagagactgagcagccgc

SEQ ID NO: 908087 - DNA, 12 bp, Homo sapiens
caggagagagat

SEQ ID NO: 908088 - DNA, 15 bp, Homo sapiens
caggagagagcagca

SEQ ID NO: 908089 - DNA, 18 bp, Homo sapiens
caggagagccagccctcc

SEQ ID NO: 908090 - DNA, 21 bp, Homo sapiens
caggagagccagccctccctg

SEQ ID NO: 908091 - DNA, 23 bp, Homo sapiens
caggagagccagccctccctgtc

SEQ ID NO: 908092 - DNA, 22 bp, Homo sapiens
caggagagcccccaccagcagc

SEQ ID NO: 908093 - DNA, 19 bp, Homo sapiens
caggagagtgtgtgggcag

SEQ ID NO: 908094 - DNA, 13 bp, Homo sapiens
caggagatcagca

SEQ ID NO: 908095 - DNA, 16 bp, Homo sapiens
caggagatcagcagcg

SEQ ID NO: 908096 - DNA, 22 bp, Homo sapiens
caggagatcgagaccatcctgg

SEQ ID NO: 908097 - DNA, 20 bp, Homo sapiens
caggagatggaagttgcagt

SEQ ID NO: 908098 - DNA, 14 bp, Homo sapiens
caggagatggaggg

SEQ ID NO: 908099 - DNA, 16 bp, Homo sapiens
caggagatggagggct

SEQ ID NO: 908100 - DNA, 21 bp, Homo sapiens
caggagatggagggcttggcc

SEQ ID NO: 908101 - DNA, 15 bp, Homo sapiens
caggagatgggtcca

SEQ ID NO: 908102 - DNA, 20 bp, Homo sapiens
caggagatgggtccaggggt

SEQ ID NO: 908103 - DNA, 22 bp, Homo sapiens
caggagcaaatgtttctgcagt

SEQ ID NO: 908104 - DNA, 19 bp, Homo sapiens
caggagcacctggaccccc

SEQ ID NO: 908105 - DNA, 17 bp, Homo sapiens
caggagcagatggacag

SEQ ID NO: 908106 - DNA, 12 bp, Homo sapiens
caggagcagcag

SEQ ID NO: 908107 - DNA, 17 bp, Homo sapiens
caggagcagcagccagc

SEQ ID NO: 908108 - DNA, 24 bp, Homo sapiens
caggagcagcagccagcaccacct

SEQ ID NO: 908109 - DNA, 17 bp, Homo sapiens
caggagcaggcacgggt

SEQ ID NO: 908110 - DNA, 11 bp, Homo sapiens
caggagcaggg

SEQ ID NO: 908111 - DNA, 15 bp, Homo sapiens
caggagcagggcggc

SEQ ID NO: 908112 - DNA, 20 bp, Homo sapiens
caggagcagtatcatgaagc

SEQ ID NO: 908113 - DNA, 21 bp, Homo sapiens
caggagcatagaagccacatc

SEQ ID NO: 908114 - DNA, 21 bp, Homo sapiens
caggagcccccaacacaggca

SEQ ID NO: 908115 - DNA, 22 bp, Homo sapiens
caggagcccctggggctgtatt

SEQ ID NO: 908116 - DNA, 17 bp, Homo sapiens
caggagccgaagcccag

SEQ ID NO: 908117 - DNA, 18 bp, Homo sapiens
caggagccgaagcccagg

SEQ ID NO: 908118 - DNA, 13 bp, Homo sapiens
caggagcctagcg

SEQ ID NO: 908119 - DNA, 16 bp, Homo sapiens
caggagcctagcggag

SEQ ID NO: 908120 - DNA, 19 bp, Homo sapiens
caggagcctagcggagccc

SEQ ID NO: 908121 - DNA, 21 bp, Homo sapiens
caggagcctagcggagcccag

SEQ ID NO: 908122 - DNA, 23 bp, Homo sapiens
agcctcgtggagctcgcccctcc

SEQ ID NO: 908123 - DNA, 15 bp, Homo sapiens
agcctcgtgtcatct

SEQ ID NO: 908124 - DNA, 16 bp, Homo sapiens
agcctcgtgtcatctc

SEQ ID NO: 908125 - DNA, 15 bp, Homo sapiens
agcctcgtgtccaga

SEQ ID NO: 908126 - DNA, 21 bp, Homo sapiens
agcctcgttggagagcagcag

SEQ ID NO: 908127 - DNA, 22 bp, Homo sapiens
agcctcgttggagagcagcagg

SEQ ID NO: 908128 - DNA, 18 bp, Homo sapiens
agcctctcacctgtactc

SEQ ID NO: 908129 - DNA, 23 bp, Homo sapiens
agcctctccaggaatgcctcctc

SEQ ID NO: 908130 - DNA, 15 bp, Homo sapiens
agcctctcccggctg

SEQ ID NO: 908131 - DNA, 19 bp, Homo sapiens
agcctctcccggctgcctg

SEQ ID NO: 908132 - DNA, 21 bp, Homo sapiens
agcctctcccggctgcctgcc

SEQ ID NO: 908133 - DNA, 23 bp, Homo sapiens
agcctctctccttggccacagac

SEQ ID NO: 908134 - DNA, 14 bp, Homo sapiens
agcctctctggctg

SEQ ID NO: 908135 - DNA, 21 bp, Homo sapiens
agcctctgagatgatgcatga

SEQ ID NO: 908136 - DNA, 22 bp, Homo sapiens
agcctctgagatgctaatttat

SEQ ID NO: 908137 - DNA, 18 bp, Homo sapiens
agcctctgcaactgcaag

SEQ ID NO: 908138 - DNA, 19 bp, Homo sapiens
agcctctgcaactgcaaga

SEQ ID NO: 908139 - DNA, 14 bp, Homo sapiens
agcctctgccctgc

SEQ ID NO: 908140 - DNA, 14 bp, Homo sapiens
agcctctggacagc

SEQ ID NO: 908141 - DNA, 22 bp, Homo sapiens
agcctctggcattagaattatt

SEQ ID NO: 908142 - DNA, 13 bp, Homo sapiens
agcctctggcccc

SEQ ID NO: 908143 - DNA, 17 bp, Homo sapiens
agcctctggcccctcac

SEQ ID NO: 908144 - DNA, 11 bp, Homo sapiens
agcctctggct

SEQ ID NO: 908145 - DNA, 15 bp, Homo sapiens
agcctctggctagag

SEQ ID NO: 908146 - DNA, 12 bp, Homo sapiens
agcctctggctt

SEQ ID NO: 908147 - DNA, 16 bp, Homo sapiens
agcctctggcttccct

SEQ ID NO: 908148 - DNA, 23 bp, Homo sapiens
agcctctggcttccctaaactgc

SEQ ID NO: 908149 - DNA, 14 bp, Homo sapiens
agcctcttattcca

SEQ ID NO: 908150 - DNA, 21 bp, Homo sapiens
agcctcttattccaggagaag

SEQ ID NO: 908151 - DNA, 21 bp, Homo sapiens
agcctcttcaaaaagcagagt

SEQ ID NO: 908152 - DNA, 12 bp, Homo sapiens
agcctcttccct

SEQ ID NO: 908153 - DNA, 14 bp, Homo sapiens
agcctcttccctct

SEQ ID NO: 908154 - DNA, 21 bp, Homo sapiens
agcctcttgcccgtcggccct

SEQ ID NO: 908155 - DNA, 15 bp, Homo sapiens
agcctctttttcctt

SEQ ID NO: 908156 - DNA, 16 bp, Homo sapiens
agcctctttttgatac

SEQ ID NO: 908157 - DNA, 18 bp, Homo sapiens
agcctgaagcctggattc

SEQ ID NO: 908158 - DNA, 17 bp, Homo sapiens
agcctgacaacatttct

SEQ ID NO: 908159 - DNA, 17 bp, Homo sapiens
agcctgacccggaggaa

SEQ ID NO: 908160 - DNA, 15 bp, Homo sapiens
agcctgacctgagac

SEQ ID NO: 908161 - DNA, 15 bp, Homo sapiens
agcctgacctgagag

SEQ ID NO: 908162 - DNA, 16 bp, Homo sapiens
agcctgacctgagagt

SEQ ID NO: 908163 - DNA, 21 bp, Homo sapiens
agcctgaccttccttcctgtt

SEQ ID NO: 908164 - DNA, 15 bp, Homo sapiens
agcctgagcagggcg

SEQ ID NO: 908165 - DNA, 12 bp, Homo sapiens
agcctgaggcag

SEQ ID NO: 908166 - DNA, 17 bp, Homo sapiens
agcctgaggtcccctcg

SEQ ID NO: 908167 - DNA, 16 bp, Homo sapiens
agcctgagtcacctgc

SEQ ID NO: 908168 - DNA, 19 bp, Homo sapiens
agcctgagtcacctgcaga

SEQ ID NO: 908169 - DNA, 17 bp, Homo sapiens
agcctgagtctcctgtg

SEQ ID NO: 908170 - DNA, 18 bp, Homo sapiens
agcctgatgagattttta

SEQ ID NO: 908171 - DNA, 19 bp, Homo sapiens
agcctgatgagatttttaa

SEQ ID NO: 908172 - DNA, 19 bp, Homo sapiens
agcctgatggccaaggggg

SEQ ID NO: 908173 - DNA, 23 bp, Homo sapiens
agcctgcaccgccgccaccctgc

SEQ ID NO: 908174 - DNA, 12 bp, Homo sapiens
agcctgcagggt

SEQ ID NO: 908175 - DNA, 18 bp, Homo sapiens
agcctgcagggtggtgct

SEQ ID NO: 908176 - DNA, 15 bp, Homo sapiens
agcctgcatcttctt

SEQ ID NO: 908177 - DNA, 19 bp, Homo sapiens
agcctgccaaagtgcctgg

SEQ ID NO: 908178 - DNA, 16 bp, Homo sapiens
agcctgcccacctctc

SEQ ID NO: 908179 - DNA, 22 bp, Homo sapiens
agcctgcccacctctccctgca

SEQ ID NO: 908180 - DNA, 15 bp, Homo sapiens
agcctgcctcaccca

SEQ ID NO: 908181 - DNA, 16 bp, Homo sapiens
agcctgcctcacccac

SEQ ID NO: 908182 - DNA, 19 bp, Homo sapiens
agcctgcggcgccagcctc

SEQ ID NO: 908183 - DNA, 10 bp, Homo sapiens
agcctgctca

SEQ ID NO: 908184 - DNA, 14 bp, Homo sapiens
agcctgctccagct

SEQ ID NO: 908185 - DNA, 15 bp, Homo sapiens
agcctgctcccccac

SEQ ID NO: 908186 - DNA, 17 bp, Homo sapiens
agcctgctcccccaccc

SEQ ID NO: 908187 - DNA, 19 bp, Homo sapiens
agcctgctcccccaccccc

SEQ ID NO: 908188 - DNA, 21 bp, Homo sapiens
agcctgctcccccaccccctc

SEQ ID NO: 908189 - DNA, 16 bp, Homo sapiens
agcctgctgagagccc

SEQ ID NO: 908190 - DNA, 18 bp, Homo sapiens
agcctgctgagagccccc

SEQ ID NO: 908191 - DNA, 17 bp, Homo sapiens
agcctgctgcccaggct

SEQ ID NO: 908192 - DNA, 12 bp, Homo sapiens
agcctgctggaa

SEQ ID NO: 908193 - DNA, 19 bp, Homo sapiens
agcctgctggaagcccagc

SEQ ID NO: 908194 - DNA, 17 bp, Homo sapiens
agcctgctggcacccac

SEQ ID NO: 908195 - DNA, 13 bp, Homo sapiens
agcctgctggcag

SEQ ID NO: 908196 - DNA, 16 bp, Homo sapiens
agcctgctggcagggc

SEQ ID NO: 908197 - DNA, 19 bp, Homo sapiens
agcctgctggcagggccag

SEQ ID NO: 908198 - DNA, 13 bp, Homo sapiens
agcctgctggctg

SEQ ID NO: 908199 - DNA, 15 bp, Homo sapiens
agcctgctggctgcg

SEQ ID NO: 908200 - DNA, 19 bp, Homo sapiens
agcctgctggctgcggccc

SEQ ID NO: 908201 - DNA, 17 bp, Homo sapiens
agcctgctggggctaag

SEQ ID NO: 908202 - DNA, 13 bp, Homo sapiens
agcctgctgtggg

SEQ ID NO: 908203 - DNA, 14 bp, Homo sapiens
agcctgctgtgtcc

SEQ ID NO: 908204 - DNA, 22 bp, Homo sapiens
agcctgctgtgtccttcctcca

SEQ ID NO: 908205 - DNA, 23 bp, Homo sapiens
agcctgctgtgtccttcctccac

SEQ ID NO: 908206 - DNA, 21 bp, Homo sapiens
agcctgcttcttcccctctgc

SEQ ID NO: 908207 - DNA, 21 bp, Homo sapiens
agcctgctttggcctttcctt

SEQ ID NO: 908208 - DNA, 11 bp, Homo sapiens
agcctggaagc

SEQ ID NO: 908209 - DNA, 14 bp, Homo sapiens
agcctggaagccat

SEQ ID NO: 908210 - DNA, 23 bp, Homo sapiens
agcctggaagccatcctgccctt

SEQ ID NO: 908211 - DNA, 20 bp, Homo sapiens
agcctggactctaagctgga

SEQ ID NO: 908212 - DNA, 23 bp, Homo sapiens
agcctggactctaagctggagct

SEQ ID NO: 908213 - DNA, 14 bp, Homo sapiens
agcctggactctgc

SEQ ID NO: 908214 - DNA, 18 bp, Homo sapiens
agcctggactctgcccca

SEQ ID NO: 908215 - DNA, 13 bp, Homo sapiens
agcctggagaagc

SEQ ID NO: 908216 - DNA, 16 bp, Homo sapiens
agcctggagaggcctg

SEQ ID NO: 908217 - DNA, 21 bp, Homo sapiens
agcctggagaggcctggggtg

SEQ ID NO: 908218 - DNA, 21 bp, Homo sapiens
agcctggatggcccctccttg

SEQ ID NO: 908219 - DNA, 23 bp, Homo sapiens
agcctggatggcccctccttgca

SEQ ID NO: 908220 - DNA, 20 bp, Homo sapiens
agcctggatgtgggccaagt

SEQ ID NO: 908221 - DNA, 16 bp, Homo sapiens
agcctggattccagca

SEQ ID NO: 908222 - DNA, 12 bp, Homo sapiens
agcctggcaagg

SEQ ID NO: 908223 - DNA, 22 bp, Homo sapiens
agcctggcaaggcattcctcat

SEQ ID NO: 908224 - DNA, 13 bp, Homo sapiens
agcctggccagac

SEQ ID NO: 908225 - DNA, 14 bp, Homo sapiens
agcctggccagaca

SEQ ID NO: 908226 - DNA, 17 bp, Homo sapiens
agcctggctctgccccc

SEQ ID NO: 908227 - DNA, 15 bp, Homo sapiens
agcctgggacacaca

SEQ ID NO: 908228 - DNA, 15 bp, Homo sapiens
agcctgggcaacaga

SEQ ID NO: 908229 - DNA, 18 bp, Homo sapiens
agcctgggcaacagagca

SEQ ID NO: 908230 - DNA, 21 bp, Homo sapiens
agcctgggcaacagagcaaga

SEQ ID NO: 908231 - DNA, 15 bp, Homo sapiens
agcctgggcagccag

SEQ ID NO: 908232 - DNA, 18 bp, Homo sapiens
agcctgggcagccaggct

SEQ ID NO: 908233 - DNA, 16 bp, Homo sapiens
agcctgggcagcttct

SEQ ID NO: 908234 - DNA, 15 bp, Homo sapiens
agcctgggccagaga

SEQ ID NO: 908235 - DNA, 22 bp, Homo sapiens
agcctgggccaggagcccacag

SEQ ID NO: 908236 - DNA, 18 bp, Homo sapiens
agcctgggcccatctccc

SEQ ID NO: 908237 - DNA, 21 bp, Homo sapiens
agcctgggcccatctccctgc

SEQ ID NO: 908238 - DNA, 23 bp, Homo sapiens
agcctgggcccatctccctgctt

SEQ ID NO: 908239 - DNA, 15 bp, Homo sapiens
agcctgggctcactg

SEQ ID NO: 908240 - DNA, 18 bp, Homo sapiens
agcctgggctcactgtgc

SEQ ID NO: 908241 - DNA, 20 bp, Homo sapiens
agcctgggctcactgtgctg

SEQ ID NO: 908242 - DNA, 16 bp, Homo sapiens
agcctgggctccctct

SEQ ID NO: 908243 - DNA, 19 bp, Homo sapiens
agcctgggctccctcttgt

SEQ ID NO: 908244 - DNA, 22 bp, Homo sapiens
agcctgggcttgagctgcagaa

SEQ ID NO: 908245 - DNA, 17 bp, Homo sapiens
agcctggggcctgggga

SEQ ID NO: 908246 - DNA, 17 bp, Homo sapiens
agcctggggctccctct

SEQ ID NO: 908247 - DNA, 22 bp, Homo sapiens
caggagcctagcggagcccagc

SEQ ID NO: 908248 - DNA, 12 bp, Homo sapiens
caggagcctccc

SEQ ID NO: 908249 - DNA, 13 bp, Homo sapiens
caggagcctccct

SEQ ID NO: 908250 - DNA, 21 bp, Homo sapiens
caggagcctccctgcacggcc

SEQ ID NO: 908251 - DNA, 15 bp, Homo sapiens
caggagctctgcgcc

SEQ ID NO: 908252 - DNA, 20 bp, Homo sapiens
caggagctctgcgccaggca

SEQ ID NO: 908253 - DNA, 18 bp, Homo sapiens
caggagctcttcaggcct

SEQ ID NO: 908254 - DNA, 19 bp, Homo sapiens
caggagctgagtcacctcc

SEQ ID NO: 908255 - DNA, 21 bp, Homo sapiens
caggagctgtcaccaaggaaa

SEQ ID NO: 908256 - DNA, 20 bp, Homo sapiens
caggagcttattacagaaaa

SEQ ID NO: 908257 - DNA, 17 bp, Homo sapiens
caggagctttggaccta

SEQ ID NO: 908258 - DNA, 16 bp, Homo sapiens
caggaggaatactgaa

SEQ ID NO: 908259 - DNA, 23 bp, Homo sapiens
caggaggaatcatgtcaggcctg

SEQ ID NO: 908260 - DNA, 23 bp, Homo sapiens
caggaggagctgcctcttctctt

SEQ ID NO: 908261 - DNA, 18 bp, Homo sapiens
caggaggaggagatggcc

SEQ ID NO: 908262 - DNA, 21 bp, Homo sapiens
caggaggaggctgccctgagg

SEQ ID NO: 908263 - DNA, 18 bp, Homo sapiens
caggaggattgcctttaa

SEQ ID NO: 908264 - DNA, 19 bp, Homo sapiens
caggaggccaataaaaagt

SEQ ID NO: 908265 - DNA, 22 bp, Homo sapiens
caggaggccaataaaaagttca

SEQ ID NO: 908266 - DNA, 23 bp, Homo sapiens
caggaggccaataaaaagttcag

SEQ ID NO: 908267 - DNA, 17 bp, Homo sapiens
caggaggcccctggccc

SEQ ID NO: 908268 - DNA, 19 bp, Homo sapiens
caggaggcccctggcccag

SEQ ID NO: 908269 - DNA, 13 bp, Homo sapiens
caggaggccctgg

SEQ ID NO: 908270 - DNA, 13 bp, Homo sapiens
caggaggcgccct

SEQ ID NO: 908271 - DNA, 22 bp, Homo sapiens
caggaggcggcagctcttctgg

SEQ ID NO: 908272 - DNA, 14 bp, Homo sapiens
caggaggctccggc

SEQ ID NO: 908273 - DNA, 20 bp, Homo sapiens
caggaggctccggcccacag

SEQ ID NO: 908274 - DNA, 18 bp, Homo sapiens
caggaggctgaggcagga

SEQ ID NO: 908275 - DNA, 15 bp, Homo sapiens
caggaggctgagggg

SEQ ID NO: 908276 - DNA, 19 bp, Homo sapiens
caggaggctttaagctcca

SEQ ID NO: 908277 - DNA, 14 bp, Homo sapiens
caggagggaggcgg

SEQ ID NO: 908278 - DNA, 20 bp, Homo sapiens
caggagggaggcggggagga

SEQ ID NO: 908279 - DNA, 19 bp, Homo sapiens
caggagggaggtttgtgag

SEQ ID NO: 908280 - DNA, 16 bp, Homo sapiens
caggagggcaagggcc

SEQ ID NO: 908281 - DNA, 17 bp, Homo sapiens
caggagggcaagggcca

SEQ ID NO: 908282 - DNA, 13 bp, Homo sapiens
caggagggcacag

SEQ ID NO: 908283 - DNA, 13 bp, Homo sapiens
caggagggcactg

SEQ ID NO: 908284 - DNA, 14 bp, Homo sapiens
caggagggcaggct

SEQ ID NO: 908285 - DNA, 15 bp, Homo sapiens
caggagggcaggctg

SEQ ID NO: 908286 - DNA, 19 bp, Homo sapiens
caggagggcaggctgaggt

SEQ ID NO: 908287 - DNA, 19 bp, Homo sapiens
caggagggccagcgctgtg

SEQ ID NO: 908288 - DNA, 22 bp, Homo sapiens
caggagggccagcgctgtggac

SEQ ID NO: 908289 - DNA, 14 bp, Homo sapiens
caggagggcccgga

SEQ ID NO: 908290 - DNA, 12 bp, Homo sapiens
caggagggccct

SEQ ID NO: 908291 - DNA, 18 bp, Homo sapiens
caggagggctaattagaa

SEQ ID NO: 908292 - DNA, 24 bp, Homo sapiens
caggaggggtgagtcccctactcc

SEQ ID NO: 908293 - DNA, 19 bp, Homo sapiens
caggagggtgacgcccagc

SEQ ID NO: 908294 - DNA, 21 bp, Homo sapiens
caggagggtgacgcccagctc

SEQ ID NO: 908295 - DNA, 23 bp, Homo sapiens
caggagggtgacgcccagctccg

SEQ ID NO: 908296 - DNA, 15 bp, Homo sapiens
caggaggtggaggtt

SEQ ID NO: 908297 - DNA, 19 bp, Homo sapiens
caggaggtggaggttgcag

SEQ ID NO: 908298 - DNA, 18 bp, Homo sapiens
caggaggtggctatggcc

SEQ ID NO: 908299 - DNA, 18 bp, Homo sapiens
caggaggttctgggcctc

SEQ ID NO: 908300 - DNA, 21 bp, Homo sapiens
caggaggttgtggatgctcca

SEQ ID NO: 908301 - DNA, 23 bp, Homo sapiens
caggagtatcttacctgtaaagt

SEQ ID NO: 908302 - DNA, 14 bp, Homo sapiens
caggagtccacttt

SEQ ID NO: 908303 - DNA, 16 bp, Homo sapiens
caggagtcccaaggaa

SEQ ID NO: 908304 - DNA, 17 bp, Homo sapiens
caggagtcccaaggaaa

SEQ ID NO: 908305 - DNA, 18 bp, Homo sapiens
caggagtctctgccaccc

SEQ ID NO: 908306 - DNA, 20 bp, Homo sapiens
caggagtctctgccacccac

SEQ ID NO: 908307 - DNA, 22 bp, Homo sapiens
caggagtctctggtagcctgca

SEQ ID NO: 908308 - DNA, 15 bp, Homo sapiens
caggagtctgtgctc

SEQ ID NO: 908309 - DNA, 19 bp, Homo sapiens
caggagtcttcagacccag

SEQ ID NO: 908310 - DNA, 13 bp, Homo sapiens
caggagtgccagg

SEQ ID NO: 908311 - DNA, 15 bp, Homo sapiens
caggagtgccaggac

SEQ ID NO: 908312 - DNA, 16 bp, Homo sapiens
caggagtgccaggacc

SEQ ID NO: 908313 - DNA, 18 bp, Homo sapiens
caggagtgccaggaccag

SEQ ID NO: 908314 - DNA, 20 bp, Homo sapiens
caggagtggtgcagacagaa

SEQ ID NO: 908315 - DNA, 21 bp, Homo sapiens
caggagtgtcctcttccctct

SEQ ID NO: 908316 - DNA, 17 bp, Homo sapiens
caggagtgtcctgccca

SEQ ID NO: 908317 - DNA, 22 bp, Homo sapiens
caggagtgtcctgcccatgccc

SEQ ID NO: 908318 - DNA, 21 bp, Homo sapiens
caggagttcgagaccaaccta

SEQ ID NO: 908319 - DNA, 23 bp, Homo sapiens
caggagttcgagaccagcctggc

SEQ ID NO: 908320 - DNA, 16 bp, Homo sapiens
caggagttgtgagccc

SEQ ID NO: 908321 - DNA, 20 bp, Homo sapiens
caggagttgtgagccctcta

SEQ ID NO: 908322 - DNA, 22 bp, Homo sapiens
caggagttgtgagccctctagg

SEQ ID NO: 908323 - DNA, 22 bp, Homo sapiens
caggagtttaagaccagcctgg

SEQ ID NO: 908324 - DNA, 23 bp, Homo sapiens
caggagtttgagaccaacctggg

SEQ ID NO: 908325 - DNA, 23 bp, Homo sapiens
caggataagaaagcctaaaattg

SEQ ID NO: 908326 - DNA, 22 bp, Homo sapiens
caggataaggagactgaggctt

SEQ ID NO: 908327 - DNA, 19 bp, Homo sapiens
caggataatatatttgcag

SEQ ID NO: 908328 - DNA, 14 bp, Homo sapiens
caggatacatgtgc

SEQ ID NO: 908329 - DNA, 23 bp, Homo sapiens
caggatactctgtcagatgggaa

SEQ ID NO: 908330 - DNA, 22 bp, Homo sapiens
caggatatccttatcagagcta

SEQ ID NO: 908331 - DNA, 13 bp, Homo sapiens
caggatcagatga

SEQ ID NO: 908332 - DNA, 15 bp, Homo sapiens
caggatcagttaact

SEQ ID NO: 908333 - DNA, 14 bp, Homo sapiens
caggatccagtgac

SEQ ID NO: 908334 - DNA, 18 bp, Homo sapiens
caggatccagtgacatga

SEQ ID NO: 908335 - DNA, 15 bp, Homo sapiens
caggatccgctgcca

SEQ ID NO: 908336 - DNA, 18 bp, Homo sapiens
caggatccgctgccacca

SEQ ID NO: 908337 - DNA, 19 bp, Homo sapiens
caggatccgctgccaccac

SEQ ID NO: 908338 - DNA, 19 bp, Homo sapiens
caggatcctattctcacca

SEQ ID NO: 908339 - DNA, 13 bp, Homo sapiens
caggatcctgcag

SEQ ID NO: 908340 - DNA, 15 bp, Homo sapiens
caggatcctgcagga

SEQ ID NO: 908341 - DNA, 15 bp, Homo sapiens
caggatcgaagggtt

SEQ ID NO: 908342 - DNA, 10 bp, Homo sapiens
caggatctat

SEQ ID NO: 908343 - DNA, 15 bp, Homo sapiens
caggatctcaagcca

SEQ ID NO: 908344 - DNA, 16 bp, Homo sapiens
caggatctcaagccag

SEQ ID NO: 908345 - DNA, 19 bp, Homo sapiens
caggatctcaagccagccc

SEQ ID NO: 908346 - DNA, 17 bp, Homo sapiens
caggatgaacccaggac

SEQ ID NO: 908347 - DNA, 16 bp, Homo sapiens
caggatgaccacgcac

SEQ ID NO: 908348 - DNA, 19 bp, Homo sapiens
caggatgaccacgcacctc

SEQ ID NO: 908349 - DNA, 17 bp, Homo sapiens
caggatgattgtacaga

SEQ ID NO: 908350 - DNA, 16 bp, Homo sapiens
caggatgcacatttct

SEQ ID NO: 908351 - DNA, 20 bp, Homo sapiens
caggatgcacatttctggat

SEQ ID NO: 908352 - DNA, 22 bp, Homo sapiens
caggatggaattcttcctcctc

SEQ ID NO: 908353 - DNA, 15 bp, Homo sapiens
caggatggaggggtg

SEQ ID NO: 908354 - DNA, 21 bp, Homo sapiens
caggatggaggggtggtcctg

SEQ ID NO: 908355 - DNA, 23 bp, Homo sapiens
caggatggaggggtggtcctgac

SEQ ID NO: 908356 - DNA, 16 bp, Homo sapiens
caggatggcctttcct

SEQ ID NO: 908357 - DNA, 15 bp, Homo sapiens
caggatgggctgagc

SEQ ID NO: 908358 - DNA, 19 bp, Homo sapiens
caggatgggctgagctagc

SEQ ID NO: 908359 - DNA, 18 bp, Homo sapiens
caggatgggggctggcct

SEQ ID NO: 908360 - DNA, 19 bp, Homo sapiens
caggatgggggctggcctc

SEQ ID NO: 908361 - DNA, 21 bp, Homo sapiens
caggatgggggctggcctctg

SEQ ID NO: 908362 - DNA, 23 bp, Homo sapiens
caggatggggtatggattctaaa

SEQ ID NO: 908363 - DNA, 19 bp, Homo sapiens
caggatggtgggcaggatc

SEQ ID NO: 908364 - DNA, 20 bp, Homo sapiens
caggatggtgggcaggatct

SEQ ID NO: 908365 - DNA, 16 bp, Homo sapiens
caggatggtttggaaa

SEQ ID NO: 908366 - DNA, 21 bp, Homo sapiens
caggatgtagttctgccaggc

SEQ ID NO: 908367 - DNA, 23 bp, Homo sapiens
caggatgtagttctgccaggcaa

SEQ ID NO: 908368 - DNA, 21 bp, Homo sapiens
caggatgtggcttatgagata

SEQ ID NO: 908369 - DNA, 15 bp, Homo sapiens
caggatttaaaaact

SEQ ID NO: 908370 - DNA, 18 bp, Homo sapiens
caggatttaaaaactgga

SEQ ID NO: 908371 - DNA, 19 bp, Homo sapiens
caggatttaaaaactggaa

SEQ ID NO: 908372 - DNA, 20 bp, Homo sapiens
caggatttaaaaactggaac

SEQ ID NO: 908373 - DNA, 22 bp, Homo sapiens
caggatttcaccagaagttaca

SEQ ID NO: 908374 - DNA, 17 bp, Homo sapiens
caggcaaaacacgcaag

SEQ ID NO: 908375 - DNA, 20 bp, Homo sapiens
caggcaaaacacgcaagggc

SEQ ID NO: 908376 - DNA, 21 bp, Homo sapiens
caggcaaaacacgcaagggca

SEQ ID NO: 908377 - DNA, 14 bp, Homo sapiens
caggcaaaatcctt

SEQ ID NO: 908378 - DNA, 13 bp, Homo sapiens
caggcaaatcagt

SEQ ID NO: 908379 - DNA, 13 bp, Homo sapiens
caggcaagcagct

SEQ ID NO: 908380 - DNA, 14 bp, Homo sapiens
caggcaagcagctg

SEQ ID NO: 908381 - DNA, 21 bp, Homo sapiens
caggcaatcacttgaggtcag

SEQ ID NO: 908382 - DNA, 18 bp, Homo sapiens
caggcaatcttgccttct

SEQ ID NO: 908383 - DNA, 16 bp, Homo sapiens
caggcaatgctgtact

SEQ ID NO: 908384 - DNA, 23 bp, Homo sapiens
caggcacacaaggggcccttgga

SEQ ID NO: 908385 - DNA, 18 bp, Homo sapiens
caggcacacacagcccct

SEQ ID NO: 908386 - DNA, 15 bp, Homo sapiens
caggcacacagcagc

SEQ ID NO: 908387 - DNA, 17 bp, Homo sapiens
caggcacacagcagccc

SEQ ID NO: 908388 - DNA, 14 bp, Homo sapiens
caggcacacagcta

SEQ ID NO: 908389 - DNA, 20 bp, Homo sapiens
caggcacacagctactctcc

SEQ ID NO: 908390 - DNA, 16 bp, Homo sapiens
caggcacacagggccc

SEQ ID NO: 908391 - DNA, 15 bp, Homo sapiens
caggcacacttcttc

SEQ ID NO: 908392 - DNA, 16 bp, Homo sapiens
caggcacagctgagtt

SEQ ID NO: 908393 - DNA, 12 bp, Homo sapiens
caggcacaggat

SEQ ID NO: 908394 - DNA, 22 bp, Homo sapiens
caggcacatacacctcgtcaag

SEQ ID NO: 908395 - DNA, 19 bp, Homo sapiens
caggcaccaaaagaagtaa

SEQ ID NO: 908396 - DNA, 13 bp, Homo sapiens
caggcaccaccag

SEQ ID NO: 908397 - DNA, 17 bp, Homo sapiens
caggcaccaccaggagc

SEQ ID NO: 908398 - DNA, 18 bp, Homo sapiens
caggcaccaccaggagca

SEQ ID NO: 908399 - DNA, 16 bp, Homo sapiens
caggcaccccctggag

SEQ ID NO: 908400 - DNA, 15 bp, Homo sapiens
caggcaccctcaggg

SEQ ID NO: 908401 - DNA, 22 bp, Homo sapiens
caggcaccctcagggagcctcc

SEQ ID NO: 908402 - DNA, 14 bp, Homo sapiens
caggcaccgggctg

SEQ ID NO: 908403 - DNA, 22 bp, Homo sapiens
caggcaccgggctggctgcttg

SEQ ID NO: 908404 - DNA, 15 bp, Homo sapiens
caggcacctaccacc

SEQ ID NO: 908405 - DNA, 17 bp, Homo sapiens
caggcacctggcctgct

SEQ ID NO: 908406 - DNA, 20 bp, Homo sapiens
caggcacctggcctgctggg

SEQ ID NO: 908407 - DNA, 21 bp, Homo sapiens
caggcacgaacccacctgctg

SEQ ID NO: 908408 - DNA, 22 bp, Homo sapiens
caggcacgaacccacctgctga

SEQ ID NO: 908409 - DNA, 23 bp, Homo sapiens
caggcacgggtggtccccgttcc

SEQ ID NO: 908410 - DNA, 12 bp, Homo sapiens
caggcactccaa

SEQ ID NO: 908411 - DNA, 18 bp, Homo sapiens
caggcactctcatcaccc

SEQ ID NO: 908412 - DNA, 19 bp, Homo sapiens
caggcactctcctgtctga

SEQ ID NO: 908413 - DNA, 17 bp, Homo sapiens
caggcactgaacaggct

SEQ ID NO: 908414 - DNA, 19 bp, Homo sapiens
caggcactgaacaggctgg

SEQ ID NO: 908415 - DNA, 23 bp, Homo sapiens
caggcactgaacaggctggggcc

SEQ ID NO: 908416 - DNA, 16 bp, Homo sapiens
caggcactgagaatga

SEQ ID NO: 908417 - DNA, 18 bp, Homo sapiens
caggcactgccttctcct

SEQ ID NO: 908418 - DNA, 21 bp, Homo sapiens
caggcactgccttctcctctc

SEQ ID NO: 908419 - DNA, 17 bp, Homo sapiens
caggcactgctgcccag

SEQ ID NO: 908420 - DNA, 23 bp, Homo sapiens
caggcactgctgcccagcctcca

SEQ ID NO: 908421 - DNA, 17 bp, Homo sapiens
caggcactggtggcatc

SEQ ID NO: 908422 - DNA, 13 bp, Homo sapiens
caggcactgtggc

SEQ ID NO: 908423 - DNA, 18 bp, Homo sapiens
caggcagaatggctgcac

SEQ ID NO: 908424 - DNA, 19 bp, Homo sapiens
caggcagacaaccttgtcc

SEQ ID NO: 908425 - DNA, 18 bp, Homo sapiens
caggcagacaagagctgc

SEQ ID NO: 908426 - DNA, 19 bp, Homo sapiens
caggcagacaagagctgct

SEQ ID NO: 908427 - DNA, 20 bp, Homo sapiens
caggcagacaagagctgctg

SEQ ID NO: 908428 - DNA, 23 bp, Homo sapiens
caggcagacaagagctgctgtcc

SEQ ID NO: 908429 - DNA, 12 bp, Homo sapiens
caggcagacacg

SEQ ID NO: 908430 - DNA, 22 bp, Homo sapiens
caggcagacacggatctgagaa

SEQ ID NO: 908431 - DNA, 21 bp, Homo sapiens
caggcagactacacaggatga

SEQ ID NO: 908432 - DNA, 20 bp, Homo sapiens
caggcagagctggagccccc

SEQ ID NO: 908433 - DNA, 12 bp, Homo sapiens
caggcagaggtt

SEQ ID NO: 908434 - DNA, 20 bp, Homo sapiens
caggcagagtggcgtggcct

SEQ ID NO: 908435 - DNA, 22 bp, Homo sapiens
caggcagagtggcgtggcctcc

SEQ ID NO: 908436 - DNA, 18 bp, Homo sapiens
caggcagatcctctggac

SEQ ID NO: 908437 - DNA, 13 bp, Homo sapiens
caggcagatctgt

SEQ ID NO: 908438 - DNA, 12 bp, Homo sapiens
caggcagcacca

SEQ ID NO: 908439 - DNA, 15 bp, Homo sapiens
caggcagcaccacac

SEQ ID NO: 908440 - DNA, 18 bp, Homo sapiens
caggcagcaccacactgg

SEQ ID NO: 908441 - DNA, 16 bp, Homo sapiens
caggcagcagacacat

SEQ ID NO: 908442 - DNA, 16 bp, Homo sapiens
caggcagcaggggctg

SEQ ID NO: 908443 - DNA, 12 bp, Homo sapiens
caggcagcccag

SEQ ID NO: 908444 - DNA, 20 bp, Homo sapiens
caggcagcccagcagtgtgg

SEQ ID NO: 908445 - DNA, 15 bp, Homo sapiens
caggcagcctcaagg

SEQ ID NO: 908446 - DNA, 17 bp, Homo sapiens
caggcagccttgaccac

SEQ ID NO: 908447 - DNA, 18 bp, Homo sapiens
caggcagcgatggtctca

SEQ ID NO: 908448 - DNA, 19 bp, Homo sapiens
caggcagcgccaagtgcgt

SEQ ID NO: 908449 - DNA, 23 bp, Homo sapiens
caggcagctatttcagcctcctg

SEQ ID NO: 908450 - DNA, 16 bp, Homo sapiens
caggcagctccctcct

SEQ ID NO: 908451 - DNA, 18 bp, Homo sapiens
caggcagctccctcctgc

SEQ ID NO: 908452 - DNA, 18 bp, Homo sapiens
caggcaggaagggcagga

SEQ ID NO: 908453 - DNA, 19 bp, Homo sapiens
caggcaggaagggcaggaa

SEQ ID NO: 908454 - DNA, 15 bp, Homo sapiens
caggcaggcactgtg

SEQ ID NO: 908455 - DNA, 16 bp, Homo sapiens
caggcaggccagatgg

SEQ ID NO: 908456 - DNA, 19 bp, Homo sapiens
caggcaggccagatggccc

SEQ ID NO: 908457 - DNA, 18 bp, Homo sapiens
caggcaggccaggctgcc

SEQ ID NO: 908458 - DNA, 16 bp, Homo sapiens
caggcaggcggctcct

SEQ ID NO: 908459 - DNA, 19 bp, Homo sapiens
caggcaggcggctcctcct

SEQ ID NO: 908460 - DNA, 14 bp, Homo sapiens
caggcaggctgggg

SEQ ID NO: 908461 - DNA, 13 bp, Homo sapiens
caggcagggagaa

SEQ ID NO: 908462 - DNA, 21 bp, Homo sapiens
caggcaggggtgggggtggag

SEQ ID NO: 908463 - DNA, 22 bp, Homo sapiens
caggcaggggtgggggtggagg

SEQ ID NO: 908464 - DNA, 15 bp, Homo sapiens
caggcagggtgcagt

SEQ ID NO: 908465 - DNA, 19 bp, Homo sapiens
caggcaggtcacagaaagg

SEQ ID NO: 908466 - DNA, 20 bp, Homo sapiens
caggcaggtcacagaaaggc

SEQ ID NO: 908467 - DNA, 16 bp, Homo sapiens
caggcaggtctgcaag

SEQ ID NO: 908468 - DNA, 13 bp, Homo sapiens
caggcaggtttgc

SEQ ID NO: 908469 - DNA, 18 bp, Homo sapiens
caggcaggtttgccagtg

SEQ ID NO: 908470 - DNA, 15 bp, Homo sapiens
caggcagtgcatgtg

SEQ ID NO: 908471 - DNA, 14 bp, Homo sapiens
caggcatagaggct

SEQ ID NO: 908472 - DNA, 14 bp, Homo sapiens
caggcataggcctg

SEQ ID NO: 908473 - DNA, 15 bp, Homo sapiens
caggcataggcctgg

SEQ ID NO: 908474 - DNA, 15 bp, Homo sapiens
caggcatctgcctct

SEQ ID NO: 908475 - DNA, 18 bp, Homo sapiens
caggcatctgcctctgga

SEQ ID NO: 908476 - DNA, 22 bp, Homo sapiens
caggcatctgttagcagagtct

SEQ ID NO: 908477 - DNA, 24 bp, Homo sapiens
caggcatctgttagcagagtctgt

SEQ ID NO: 908478 - DNA, 18 bp, Homo sapiens
caggcatgcagctgcctg

SEQ ID NO: 908479 - DNA, 21 bp, Homo sapiens
caggcatgcagctgcctgggg

SEQ ID NO: 908480 - DNA, 16 bp, Homo sapiens
caggcatggctcagag

SEQ ID NO: 908481 - DNA, 15 bp, Homo sapiens
caggcatgtgccacc

SEQ ID NO: 908482 - DNA, 21 bp, Homo sapiens
caggcattcctgaagggaact

SEQ ID NO: 908483 - DNA, 20 bp, Homo sapiens
caggcattgaggaagagtct

SEQ ID NO: 908484 - DNA, 18 bp, Homo sapiens
caggcattggctcagccc

SEQ ID NO: 908485 - DNA, 17 bp, Homo sapiens
caggcatttagccctca

SEQ ID NO: 908486 - DNA, 13 bp, Homo sapiens
caggcatttgttc

SEQ ID NO: 908487 - DNA, 15 bp, Homo sapiens
caggccaaagcccca

SEQ ID NO: 908488 - DNA, 17 bp, Homo sapiens
caggccaagaaacgtct

SEQ ID NO: 908489 - DNA, 19 bp, Homo sapiens
caggccaaggccttctcct

SEQ ID NO: 908490 - DNA, 14 bp, Homo sapiens
caggccacagtggg

SEQ ID NO: 908491 - DNA, 23 bp, Homo sapiens
caggccacagtggggctgcaggc

SEQ ID NO: 908492 - DNA, 11 bp, Homo sapiens
caggccacctc

SEQ ID NO: 908493 - DNA, 16 bp, Homo sapiens
caggccacctccagaa

SEQ ID NO: 908494 - DNA, 21 bp, Homo sapiens
agcctggggctccctctctgg

SEQ ID NO: 908495 - DNA, 16 bp, Homo sapiens
agcctggggtgacctc

SEQ ID NO: 908496 - DNA, 20 bp, Homo sapiens
agcctggggtggggtcatgc

SEQ ID NO: 908497 - DNA, 23 bp, Homo sapiens
agcctggggtggggtcatgccct

SEQ ID NO: 908498 - DNA, 15 bp, Homo sapiens
agcctgggtctggat

SEQ ID NO: 908499 - DNA, 18 bp, Homo sapiens
agcctgggtgacagagcg

SEQ ID NO: 908500 - DNA, 11 bp, Homo sapiens
agcctggtggg

SEQ ID NO: 908501 - DNA, 16 bp, Homo sapiens
agcctggtgggcctcc

SEQ ID NO: 908502 - DNA, 18 bp, Homo sapiens
agcctggttcagacacag

SEQ ID NO: 908503 - DNA, 18 bp, Homo sapiens
agcctggtttagcctgga

SEQ ID NO: 908504 - DNA, 22 bp, Homo sapiens
agcctgtaaactttatcactta

SEQ ID NO: 908505 - DNA, 16 bp, Homo sapiens
agcctgtaagcctgca

SEQ ID NO: 908506 - DNA, 18 bp, Homo sapiens
agcctgtaagcctgcaag

SEQ ID NO: 908507 - DNA, 15 bp, Homo sapiens
agcctgtaatcccag

SEQ ID NO: 908508 - DNA, 17 bp, Homo sapiens
agcctgtaatcccagct

SEQ ID NO: 908509 - DNA, 15 bp, Homo sapiens
agcctgtatgtggtg

SEQ ID NO: 908510 - DNA, 21 bp, Homo sapiens
agcctgtatgtggtgtggggc

SEQ ID NO: 908511 - DNA, 15 bp, Homo sapiens
agcctgtcacccagc

SEQ ID NO: 908512 - DNA, 20 bp, Homo sapiens
agcctgtcacccagctcctc

SEQ ID NO: 908513 - DNA, 14 bp, Homo sapiens
agcctgtcccagga

SEQ ID NO: 908514 - DNA, 12 bp, Homo sapiens
agcctgtcccca

SEQ ID NO: 908515 - DNA, 13 bp, Homo sapiens
agcctgtccccag

SEQ ID NO: 908516 - DNA, 17 bp, Homo sapiens
agcctgtccccagacca

SEQ ID NO: 908517 - DNA, 18 bp, Homo sapiens
agcctgtccccagaccaa

SEQ ID NO: 908518 - DNA, 19 bp, Homo sapiens
agcctgtccccgccttccc

SEQ ID NO: 908519 - DNA, 20 bp, Homo sapiens
agcctgtccccgccttccct

SEQ ID NO: 908520 - DNA, 21 bp, Homo sapiens
agcctgtccccgccttccctc

SEQ ID NO: 908521 - DNA, 23 bp, Homo sapiens
agcctgtccccgccttccctcac

SEQ ID NO: 908522 - DNA, 11 bp, Homo sapiens
agcctgtcctc

SEQ ID NO: 908523 - DNA, 14 bp, Homo sapiens
agcctgtcctcacc

SEQ ID NO: 908524 - DNA, 23 bp, Homo sapiens
agcctgtcctggtacagcagggt

SEQ ID NO: 908525 - DNA, 13 bp, Homo sapiens
agcctgtctcggg

SEQ ID NO: 908526 - DNA, 17 bp, Homo sapiens
agcctgtctcgggctga

SEQ ID NO: 908527 - DNA, 18 bp, Homo sapiens
agcctgtctcgggctgac

SEQ ID NO: 908528 - DNA, 15 bp, Homo sapiens
agcctgtctctttcc

SEQ ID NO: 908529 - DNA, 16 bp, Homo sapiens
agcctgtctctttcca

SEQ ID NO: 908530 - DNA, 14 bp, Homo sapiens
agcctgtgagggag

SEQ ID NO: 908531 - DNA, 21 bp, Homo sapiens
agcctgtgagggagtgcagaa

SEQ ID NO: 908532 - DNA, 21 bp, Homo sapiens
agcctgtgattaacttgctta

SEQ ID NO: 908533 - DNA, 22 bp, Homo sapiens
agcctgtgattaacttgcttag

SEQ ID NO: 908534 - DNA, 21 bp, Homo sapiens
agcctgtgcaaaaaaattaaa

SEQ ID NO: 908535 - DNA, 14 bp, Homo sapiens
agcctgtgccagca

SEQ ID NO: 908536 - DNA, 17 bp, Homo sapiens
agcctgtgcctctggga

SEQ ID NO: 908537 - DNA, 18 bp, Homo sapiens
agcctgtgcctctgggac

SEQ ID NO: 908538 - DNA, 19 bp, Homo sapiens
agcctgtgcctctgggact

SEQ ID NO: 908539 - DNA, 16 bp, Homo sapiens
agcctgtgccttcctc

SEQ ID NO: 908540 - DNA, 18 bp, Homo sapiens
agcctgtgccttcctccc

SEQ ID NO: 908541 - DNA, 21 bp, Homo sapiens
agcctgtggcatctttgcctt

SEQ ID NO: 908542 - DNA, 20 bp, Homo sapiens
agcctgtggcggtgcctggg

SEQ ID NO: 908543 - DNA, 19 bp, Homo sapiens
agcctgtggcttggagtgg

SEQ ID NO: 908544 - DNA, 23 bp, Homo sapiens
agcctgtggcttggagtggccaa

SEQ ID NO: 908545 - DNA, 20 bp, Homo sapiens
agcctgtgggcagcatgccc

SEQ ID NO: 908546 - DNA, 23 bp, Homo sapiens
agcctgtgggcagcatgcccaga

SEQ ID NO: 908547 - DNA, 14 bp, Homo sapiens
agcctgtgtgttct

SEQ ID NO: 908548 - DNA, 21 bp, Homo sapiens
agcctgtgttagtgtctgtcc

SEQ ID NO: 908549 - DNA, 22 bp, Homo sapiens
agcctgtgttagtgtctgtcca

SEQ ID NO: 908550 - DNA, 23 bp, Homo sapiens
agcctgtgttagtgtctgtccat

SEQ ID NO: 908551 - DNA, 20 bp, Homo sapiens
agcctgttcccctcactgga

SEQ ID NO: 908552 - DNA, 20 bp, Homo sapiens
agcctgttcttttaccactg

SEQ ID NO: 908553 - DNA, 22 bp, Homo sapiens
agcctgttgcccctgcctccca

SEQ ID NO: 908554 - DNA, 16 bp, Homo sapiens
agccttaaatttttgt

SEQ ID NO: 908555 - DNA, 20 bp, Homo sapiens
agccttaactaagactcccg

SEQ ID NO: 908556 - DNA, 21 bp, Homo sapiens
agccttaatagacttctctta

SEQ ID NO: 908557 - DNA, 15 bp, Homo sapiens
agccttaatttgcac

SEQ ID NO: 908558 - DNA, 21 bp, Homo sapiens
agccttagacgaagaagctgg

SEQ ID NO: 908559 - DNA, 22 bp, Homo sapiens
agccttagacgaagaagctggc

SEQ ID NO: 908560 - DNA, 19 bp, Homo sapiens
agccttagaggtatgtcag

SEQ ID NO: 908561 - DNA, 20 bp, Homo sapiens
agccttagctctcccaactc

SEQ ID NO: 908562 - DNA, 13 bp, Homo sapiens
agccttagctgcc

SEQ ID NO: 908563 - DNA, 20 bp, Homo sapiens
agccttagctgccagtgctg

SEQ ID NO: 908564 - DNA, 21 bp, Homo sapiens
agccttagttaccctgatctg

SEQ ID NO: 908565 - DNA, 15 bp, Homo sapiens
agccttatcaagtgt

SEQ ID NO: 908566 - DNA, 17 bp, Homo sapiens
agccttattctaaggtg

SEQ ID NO: 908567 - DNA, 21 bp, Homo sapiens
agccttcagaatgctcctgag

SEQ ID NO: 908568 - DNA, 16 bp, Homo sapiens
agccttcagccttaat

SEQ ID NO: 908569 - DNA, 14 bp, Homo sapiens
agccttccccagct

SEQ ID NO: 908570 - DNA, 15 bp, Homo sapiens
agccttccccagctc

SEQ ID NO: 908571 - DNA, 19 bp, Homo sapiens
agccttccccagctccagc

SEQ ID NO: 908572 - DNA, 20 bp, Homo sapiens
agccttccccttgcccaggg

SEQ ID NO: 908573 - DNA, 21 bp, Homo sapiens
agccttcctccacatcctttc

SEQ ID NO: 908574 - DNA, 18 bp, Homo sapiens
agccttcctctgcagctg

SEQ ID NO: 908575 - DNA, 21 bp, Homo sapiens
agccttcctctgcagctgacc

SEQ ID NO: 908576 - DNA, 19 bp, Homo sapiens
agccttccttctgctccca

SEQ ID NO: 908577 - DNA, 14 bp, Homo sapiens
agccttcttctgcc

SEQ ID NO: 908578 - DNA, 16 bp, Homo sapiens
agccttctttttctgg

SEQ ID NO: 908579 - DNA, 17 bp, Homo sapiens
agccttctttttctgga

SEQ ID NO: 908580 - DNA, 18 bp, Homo sapiens
agccttctttttctggac

SEQ ID NO: 908581 - DNA, 13 bp, Homo sapiens
agccttgaacttt

SEQ ID NO: 908582 - DNA, 15 bp, Homo sapiens
agccttgaactttga

SEQ ID NO: 908583 - DNA, 22 bp, Homo sapiens
agccttgaactttgacctctgc

SEQ ID NO: 908584 - DNA, 15 bp, Homo sapiens
agccttgaagaaaat

SEQ ID NO: 908585 - DNA, 20 bp, Homo sapiens
agccttgaagaaaatgactt

SEQ ID NO: 908586 - DNA, 17 bp, Homo sapiens
agccttgagccctggct

SEQ ID NO: 908587 - DNA, 20 bp, Homo sapiens
agccttgatttgttcttaca

SEQ ID NO: 908588 - DNA, 18 bp, Homo sapiens
agccttgcacacccactg

SEQ ID NO: 908589 - DNA, 19 bp, Homo sapiens
agccttgcacacccactgc

SEQ ID NO: 908590 - DNA, 21 bp, Homo sapiens
agccttgcacacccactgccc

SEQ ID NO: 908591 - DNA, 22 bp, Homo sapiens
agccttgcatgtacttgaagga

SEQ ID NO: 908592 - DNA, 21 bp, Homo sapiens
agccttgcccggattctggga

SEQ ID NO: 908593 - DNA, 21 bp, Homo sapiens
agccttgcctaaatttaatgc

SEQ ID NO: 908594 - DNA, 13 bp, Homo sapiens
agccttgcgctgt

SEQ ID NO: 908595 - DNA, 19 bp, Homo sapiens
agccttgcgctgtcccagg

SEQ ID NO: 908596 - DNA, 23 bp, Homo sapiens
agccttgcgctgtcccaggcatg

SEQ ID NO: 908597 - DNA, 19 bp, Homo sapiens
agccttgcggaaggttcta

SEQ ID NO: 908598 - DNA, 16 bp, Homo sapiens
agccttgctgggccag

SEQ ID NO: 908599 - DNA, 15 bp, Homo sapiens
agccttggaaccagc

SEQ ID NO: 908600 - DNA, 20 bp, Homo sapiens
agccttggataatgctgttg

SEQ ID NO: 908601 - DNA, 17 bp, Homo sapiens
agccttggcccacactg

SEQ ID NO: 908602 - DNA, 19 bp, Homo sapiens
agccttggcctctttcctc

SEQ ID NO: 908603 - DNA, 23 bp, Homo sapiens
agccttgggaacatgcgtgtgac

SEQ ID NO: 908604 - DNA, 16 bp, Homo sapiens
agccttgggcctttca

SEQ ID NO: 908605 - DNA, 22 bp, Homo sapiens
agccttgggcctttcagtccca

SEQ ID NO: 908606 - DNA, 13 bp, Homo sapiens
agccttggggcat

SEQ ID NO: 908607 - DNA, 22 bp, Homo sapiens
agccttgggggggctgcctttg

SEQ ID NO: 908608 - DNA, 16 bp, Homo sapiens
agccttggtgtccacc

SEQ ID NO: 908609 - DNA, 13 bp, Homo sapiens
agccttgtgagat

SEQ ID NO: 908610 - DNA, 14 bp, Homo sapiens
agccttgtgccctg

SEQ ID NO: 908611 - DNA, 19 bp, Homo sapiens
agccttgtgccctgccccc

SEQ ID NO: 908612 - DNA, 17 bp, Homo sapiens
agccttgtgtttctgtg

SEQ ID NO: 908613 - DNA, 15 bp, Homo sapiens
agccttgtttctgat

SEQ ID NO: 908614 - DNA, 20 bp, Homo sapiens
agcctttactgtttgatata

SEQ ID NO: 908615 - DNA, 23 bp, Homo sapiens
agcctttcctcaaaactggagtc

SEQ ID NO: 908616 - DNA, 14 bp, Homo sapiens
agcctttcctcggt

SEQ ID NO: 908617 - DNA, 19 bp, Homo sapiens
agcctttcgttctgctgac

SEQ ID NO: 908618 - DNA, 21 bp, Homo sapiens
agcctttgaataaaaatgcac

SEQ ID NO: 908619 - DNA, 18 bp, Homo sapiens
agcctttgctccctcccc

SEQ ID NO: 908620 - DNA, 17 bp, Homo sapiens
agcctttgggtcctggg

SEQ ID NO: 908621 - DNA, 18 bp, Homo sapiens
agcctttgggtcctgggc

SEQ ID NO: 908622 - DNA, 19 bp, Homo sapiens
agcctttgggtcctgggca

SEQ ID NO: 908623 - DNA, 22 bp, Homo sapiens
agcctttgggtcctgggcaggt

SEQ ID NO: 908624 - DNA, 23 bp, Homo sapiens
agcctttgtcaataaacctgtca

SEQ ID NO: 908625 - DNA, 13 bp, Homo sapiens
agccttttaaatc

SEQ ID NO: 908626 - DNA, 14 bp, Homo sapiens
agccttttatctgc

SEQ ID NO: 908627 - DNA, 19 bp, Homo sapiens
agccttttatctgcagaac

SEQ ID NO: 908628 - DNA, 21 bp, Homo sapiens
agccttttctggtccctcttc

SEQ ID NO: 908629 - DNA, 18 bp, Homo sapiens
agcctttttgtttcaatg

SEQ ID NO: 908630 - DNA, 20 bp, Homo sapiens
agcgaacgtatttctccaga

SEQ ID NO: 908631 - DNA, 22 bp, Homo sapiens
agcgaacttcacataggaaggg

SEQ ID NO: 908632 - DNA, 15 bp, Homo sapiens
agcgaaggaacctct

SEQ ID NO: 908633 - DNA, 17 bp, Homo sapiens
agcgaaggaacctctcg

SEQ ID NO: 908634 - DNA, 17 bp, Homo sapiens
agcgaagtagcttgctc

SEQ ID NO: 908635 - DNA, 12 bp, Homo sapiens
agcgacagattc

SEQ ID NO: 908636 - DNA, 17 bp, Homo sapiens
agcgacatctctgactt

SEQ ID NO: 908637 - DNA, 17 bp, Homo sapiens
agcgacctctctgcctc

SEQ ID NO: 908638 - DNA, 22 bp, Homo sapiens
agcgaccttcctcatccacccc

SEQ ID NO: 908639 - DNA, 17 bp, Homo sapiens
agcgacgctcccctgag

SEQ ID NO: 908640 - DNA, 20 bp, Homo sapiens
agcgactccgttggccactc

SEQ ID NO: 908641 - DNA, 21 bp, Homo sapiens
agcgactccgttggccactcc

SEQ ID NO: 908642 - DNA, 13 bp, Homo sapiens
agcgactctcctg

SEQ ID NO: 908643 - DNA, 18 bp, Homo sapiens
agcgactggatgctcgcc

SEQ ID NO: 908644 - DNA, 20 bp, Homo sapiens
agcgacttttgttctcttct

SEQ ID NO: 908645 - DNA, 21 bp, Homo sapiens
agcgacttttgttctcttctg

SEQ ID NO: 908646 - DNA, 15 bp, Homo sapiens
agcgagagagtttca

SEQ ID NO: 908647 - DNA, 16 bp, Homo sapiens
agcgagaggcagcaag

SEQ ID NO: 908648 - DNA, 21 bp, Homo sapiens
agcgagattccgtctcaaaaa

SEQ ID NO: 908649 - DNA, 15 bp, Homo sapiens
agcgagcaagccggc

SEQ ID NO: 908650 - DNA, 15 bp, Homo sapiens
agcgagcatccccca

SEQ ID NO: 908651 - DNA, 19 bp, Homo sapiens
agcgagcatcccccaaagt

SEQ ID NO: 908652 - DNA, 22 bp, Homo sapiens
agcgagccacaggaacggccct

SEQ ID NO: 908653 - DNA, 23 bp, Homo sapiens
agcgagcctgtgccttcctcccc

SEQ ID NO: 908654 - DNA, 15 bp, Homo sapiens
agcgagctgctctgc

SEQ ID NO: 908655 - DNA, 13 bp, Homo sapiens
agcgaggaaagga

SEQ ID NO: 908656 - DNA, 17 bp, Homo sapiens
agcgagggcagctgcta

SEQ ID NO: 908657 - DNA, 23 bp, Homo sapiens
agcgaggtcaacagagaaggcag

SEQ ID NO: 908658 - DNA, 16 bp, Homo sapiens
agcgaggtcagaggag

SEQ ID NO: 908659 - DNA, 14 bp, Homo sapiens
agcgagttgtggaa

SEQ ID NO: 908660 - DNA, 14 bp, Homo sapiens
agcgatcatttatt

SEQ ID NO: 908661 - DNA, 17 bp, Homo sapiens
agcgatggcaggcctga

SEQ ID NO: 908662 - DNA, 19 bp, Homo sapiens
agcgatgggcccctggccc

SEQ ID NO: 908663 - DNA, 18 bp, Homo sapiens
agcgatgtatgcagctat

SEQ ID NO: 908664 - DNA, 16 bp, Homo sapiens
agcgattctcctgcct

SEQ ID NO: 908665 - DNA, 20 bp, Homo sapiens
agcgattgattgatgtacag

SEQ ID NO: 908666 - DNA, 18 bp, Homo sapiens
agcgcacccagagaaaat

SEQ ID NO: 908667 - DNA, 12 bp, Homo sapiens
agcgcacctgcc

SEQ ID NO: 908668 - DNA, 17 bp, Homo sapiens
agcgcacctgccccctg

SEQ ID NO: 908669 - DNA, 21 bp, Homo sapiens
agcgcacctgccccctggtgg

SEQ ID NO: 908670 - DNA, 20 bp, Homo sapiens
agcgcagcagcgggagctag

SEQ ID NO: 908671 - DNA, 23 bp, Homo sapiens
agcgcagccgccgggcaggcctg

SEQ ID NO: 908672 - DNA, 12 bp, Homo sapiens
agcgcaggcagc

SEQ ID NO: 908673 - DNA, 12 bp, Homo sapiens
agcgcaggctgc

SEQ ID NO: 908674 - DNA, 17 bp, Homo sapiens
agcgcaggctgcagagc

SEQ ID NO: 908675 - DNA, 19 bp, Homo sapiens
agcgcaggctgcagagccc

SEQ ID NO: 908676 - DNA, 21 bp, Homo sapiens
agcgcaggctgcagagcccgg

SEQ ID NO: 908677 - DNA, 14 bp, Homo sapiens
agcgcagttttttt

SEQ ID NO: 908678 - DNA, 20 bp, Homo sapiens
agcgccaagtggccactggc

SEQ ID NO: 908679 - DNA, 13 bp, Homo sapiens
agcgccagcctca

SEQ ID NO: 908680 - DNA, 19 bp, Homo sapiens
agcgccagcctcagactgg

SEQ ID NO: 908681 - DNA, 19 bp, Homo sapiens
agcgccaggaagccagagc

SEQ ID NO: 908682 - DNA, 14 bp, Homo sapiens
agcgccaggctgga

SEQ ID NO: 908683 - DNA, 15 bp, Homo sapiens
agcgccagggcccag

SEQ ID NO: 908684 - DNA, 16 bp, Homo sapiens
agcgccagggcccagg

SEQ ID NO: 908685 - DNA, 23 bp, Homo sapiens
agcgccagggcccaggccatgtg

SEQ ID NO: 908686 - DNA, 13 bp, Homo sapiens
agcgcccacccag

SEQ ID NO: 908687 - DNA, 15 bp, Homo sapiens
agcgcccacccaggt

SEQ ID NO: 908688 - DNA, 18 bp, Homo sapiens
agcgcccccatctgtctt

SEQ ID NO: 908689 - DNA, 14 bp, Homo sapiens
agcgcccgctgggc

SEQ ID NO: 908690 - DNA, 23 bp, Homo sapiens
agcgcctagtggggtctccctct

SEQ ID NO: 908691 - DNA, 20 bp, Homo sapiens
agcgcctcagttacacagga

SEQ ID NO: 908692 - DNA, 19 bp, Homo sapiens
agcgcctccaaccctagca

SEQ ID NO: 908693 - DNA, 22 bp, Homo sapiens
agcgcctccatccaaggccagg

SEQ ID NO: 908694 - DNA, 12 bp, Homo sapiens
agcgcctccctc

SEQ ID NO: 908695 - DNA, 14 bp, Homo sapiens
agcgcctccctcca

SEQ ID NO: 908696 - DNA, 17 bp, Homo sapiens
agcgcctcttcctctgg

SEQ ID NO: 908697 - DNA, 19 bp, Homo sapiens
agcgcctcttcctctgggc

SEQ ID NO: 908698 - DNA, 20 bp, Homo sapiens
agcgcctcttcctctgggca

SEQ ID NO: 908699 - DNA, 21 bp, Homo sapiens
agcgcctcttcctctgggcag

SEQ ID NO: 908700 - DNA, 17 bp, Homo sapiens
agcgcctggccttgtgt

SEQ ID NO: 908701 - DNA, 17 bp, Homo sapiens
agcgcctttcccaactc

SEQ ID NO: 908702 - DNA, 20 bp, Homo sapiens
agcgcctttcccaactctag

SEQ ID NO: 908703 - DNA, 12 bp, Homo sapiens
agcgcgctcctg

SEQ ID NO: 908704 - DNA, 22 bp, Homo sapiens
agcgcgctcctgacccctccct

SEQ ID NO: 908705 - DNA, 16 bp, Homo sapiens
agcgctagtgccttgc

SEQ ID NO: 908706 - DNA, 23 bp, Homo sapiens
agcgctagtgccttgcccacagg

SEQ ID NO: 908707 - DNA, 16 bp, Homo sapiens
agcgctcctctgcctt

SEQ ID NO: 908708 - DNA, 14 bp, Homo sapiens
agcgctcgccacgc

SEQ ID NO: 908709 - DNA, 22 bp, Homo sapiens
agcgctcgccacgctcagtgcc

SEQ ID NO: 908710 - DNA, 14 bp, Homo sapiens
agcgctcggcccgg

SEQ ID NO: 908711 - DNA, 11 bp, Homo sapiens
agcgctctgga

SEQ ID NO: 908712 - DNA, 14 bp, Homo sapiens
agcgctctggacag

SEQ ID NO: 908713 - DNA, 17 bp, Homo sapiens
agcgctgccgcacccca

SEQ ID NO: 908714 - DNA, 19 bp, Homo sapiens
agcgctgccgcaccccaga

SEQ ID NO: 908715 - DNA, 18 bp, Homo sapiens
agcgctgtggactgtcct

SEQ ID NO: 908716 - DNA, 16 bp, Homo sapiens
agcggaaacaggtgtg

SEQ ID NO: 908717 - DNA, 19 bp, Homo sapiens
agcggaaacaggtgtgtgt

SEQ ID NO: 908718 - DNA, 17 bp, Homo sapiens
agcggaacaaggagtca

SEQ ID NO: 908719 - DNA, 19 bp, Homo sapiens
agcggacatcagctggtca

SEQ ID NO: 908720 - DNA, 21 bp, Homo sapiens
agcggagagggctagccctga

SEQ ID NO: 908721 - DNA, 22 bp, Homo sapiens
agcggagcccgatattctccct

SEQ ID NO: 908722 - DNA, 15 bp, Homo sapiens
agcggaggctgtgtg

SEQ ID NO: 908723 - DNA, 14 bp, Homo sapiens
agcggaggtgtgga

SEQ ID NO: 908724 - DNA, 18 bp, Homo sapiens
agcggcaccctggtctgt

SEQ ID NO: 908725 - DNA, 23 bp, Homo sapiens
agcggccccccgcacagccaccc

SEQ ID NO: 908726 - DNA, 14 bp, Homo sapiens
agcggcccctccca

SEQ ID NO: 908727 - DNA, 18 bp, Homo sapiens
agcggcccctcccacaca

SEQ ID NO: 908728 - DNA, 12 bp, Homo sapiens
agcggcctcagg

SEQ ID NO: 908729 - DNA, 14 bp, Homo sapiens
agcggctcccctct

SEQ ID NO: 908730 - DNA, 13 bp, Homo sapiens
agcggctcctcgc

SEQ ID NO: 908731 - DNA, 15 bp, Homo sapiens
agcggctcctcgccc

SEQ ID NO: 908732 - DNA, 20 bp, Homo sapiens
agcggctcctcgcccccacc

SEQ ID NO: 908733 - DNA, 20 bp, Homo sapiens
agcggctctggtcctcggag

SEQ ID NO: 908734 - DNA, 21 bp, Homo sapiens
agcggctgagtcatgatctcc

SEQ ID NO: 908735 - DNA, 16 bp, Homo sapiens
agcggctgttccccct

SEQ ID NO: 908736 - DNA, 18 bp, Homo sapiens
agcggctgtttactgctt

SEQ ID NO: 908737 - DNA, 14 bp, Homo sapiens
agcgggaaaaggag

SEQ ID NO: 908738 - DNA, 17 bp, Homo sapiens
agcgggagacctgtgct

SEQ ID NO: 908739 - DNA, 13 bp, Homo sapiens
agcgggagggagt

SEQ ID NO: 908740 - DNA, 21 bp, Homo sapiens
agcgggagggagtctcaggag

SEQ ID NO: 908741 - DNA, 15 bp, Homo sapiens
caggccacctcccca

SEQ ID NO: 908742 - DNA, 16 bp, Homo sapiens
caggccacctccccag

SEQ ID NO: 908743 - DNA, 16 bp, Homo sapiens
caggccacctgccccc

SEQ ID NO: 908744 - DNA, 17 bp, Homo sapiens
caggccacctgccccct

SEQ ID NO: 908745 - DNA, 22 bp, Homo sapiens
caggccacctgcccccttctcc

SEQ ID NO: 908746 - DNA, 14 bp, Homo sapiens
caggccactagtga

SEQ ID NO: 908747 - DNA, 20 bp, Homo sapiens
caggccactagtgacagttt

SEQ ID NO: 908748 - DNA, 12 bp, Homo sapiens
caggccactgtg

SEQ ID NO: 908749 - DNA, 19 bp, Homo sapiens
caggccactgtggccagag

SEQ ID NO: 908750 - DNA, 20 bp, Homo sapiens
caggccactgtggccagagc

SEQ ID NO: 908751 - DNA, 16 bp, Homo sapiens
caggccagagggcagt

SEQ ID NO: 908752 - DNA, 19 bp, Homo sapiens
caggccagcaataaaaact

SEQ ID NO: 908753 - DNA, 18 bp, Homo sapiens
caggccagcccagccagg

SEQ ID NO: 908754 - DNA, 20 bp, Homo sapiens
caggccagcccccccaccca

SEQ ID NO: 908755 - DNA, 15 bp, Homo sapiens
caggccagctgcctc

SEQ ID NO: 908756 - DNA, 21 bp, Homo sapiens
caggccagcttcgtgctggag

SEQ ID NO: 908757 - DNA, 23 bp, Homo sapiens
caggccagcttcgtgctggagga

SEQ ID NO: 908758 - DNA, 16 bp, Homo sapiens
caggccaggccaccag

SEQ ID NO: 908759 - DNA, 14 bp, Homo sapiens
caggccaggccagc

SEQ ID NO: 908760 - DNA, 16 bp, Homo sapiens
caggccaggctgcctc

SEQ ID NO: 908761 - DNA, 13 bp, Homo sapiens
caggccagggctc

SEQ ID NO: 908762 - DNA, 13 bp, Homo sapiens
caggccaggtggg

SEQ ID NO: 908763 - DNA, 15 bp, Homo sapiens
caggccaggtgggcg

SEQ ID NO: 908764 - DNA, 17 bp, Homo sapiens
caggccaggtgggcgga

SEQ ID NO: 908765 - DNA, 20 bp, Homo sapiens
caggccaggtgggcggacaa

SEQ ID NO: 908766 - DNA, 18 bp, Homo sapiens
caggccagtgggcctggt

SEQ ID NO: 908767 - DNA, 17 bp, Homo sapiens
caggccatgtggcctgc

SEQ ID NO: 908768 - DNA, 19 bp, Homo sapiens
caggccatgtggcctgccc

SEQ ID NO: 908769 - DNA, 21 bp, Homo sapiens
caggccatgtggcctgcccag

SEQ ID NO: 908770 - DNA, 16 bp, Homo sapiens
caggccattctgccgc

SEQ ID NO: 908771 - DNA, 20 bp, Homo sapiens
caggccattgtgaaccaatg

SEQ ID NO: 908772 - DNA, 15 bp, Homo sapiens
caggcccaactgtga

SEQ ID NO: 908773 - DNA, 18 bp, Homo sapiens
caggcccaagagatgaag

SEQ ID NO: 908774 - DNA, 15 bp, Homo sapiens
caggcccaatctggg

SEQ ID NO: 908775 - DNA, 22 bp, Homo sapiens
caggcccaccggatgctgtgcc

SEQ ID NO: 908776 - DNA, 23 bp, Homo sapiens
caggcccaccggatgctgtgcct

SEQ ID NO: 908777 - DNA, 17 bp, Homo sapiens
caggcccacgaggagca

SEQ ID NO: 908778 - DNA, 21 bp, Homo sapiens
caggcccacgaggagcagcag

SEQ ID NO: 908779 - DNA, 22 bp, Homo sapiens
caggcccacgaggagcagcagc

SEQ ID NO: 908780 - DNA, 13 bp, Homo sapiens
caggcccactccc

SEQ ID NO: 908781 - DNA, 14 bp, Homo sapiens
caggcccactcccc

SEQ ID NO: 908782 - DNA, 16 bp, Homo sapiens
caggcccactccccag

SEQ ID NO: 908783 - DNA, 18 bp, Homo sapiens
caggcccactccccagcc

SEQ ID NO: 908784 - DNA, 17 bp, Homo sapiens
caggcccactgtgcctc

SEQ ID NO: 908785 - DNA, 16 bp, Homo sapiens
caggcccagcatgcag

SEQ ID NO: 908786 - DNA, 19 bp, Homo sapiens
caggcccagcattgctggt

SEQ ID NO: 908787 - DNA, 22 bp, Homo sapiens
caggcccagcattgctggttct

SEQ ID NO: 908788 - DNA, 15 bp, Homo sapiens
caggcccagctgctc

SEQ ID NO: 908789 - DNA, 12 bp, Homo sapiens
caggcccaggcc

SEQ ID NO: 908790 - DNA, 13 bp, Homo sapiens
caggcccaggcca

SEQ ID NO: 908791 - DNA, 15 bp, Homo sapiens
caggcccaggccagc

SEQ ID NO: 908792 - DNA, 16 bp, Homo sapiens
caggcccaggccagcc

SEQ ID NO: 908793 - DNA, 17 bp, Homo sapiens
caggcccaggccagccc

SEQ ID NO: 908794 - DNA, 14 bp, Homo sapiens
caggcccagtgaca

SEQ ID NO: 908795 - DNA, 21 bp, Homo sapiens
caggcccatctcaggtgccac

SEQ ID NO: 908796 - DNA, 22 bp, Homo sapiens
caggcccatctcaggtgccact

SEQ ID NO: 908797 - DNA, 24 bp, Homo sapiens
caggcccatctcaggtgccactcc

SEQ ID NO: 908798 - DNA, 19 bp, Homo sapiens
caggccccaaaaccacagc

SEQ ID NO: 908799 - DNA, 23 bp, Homo sapiens
caggccccaaaaccacagccctg

SEQ ID NO: 908800 - DNA, 23 bp, Homo sapiens
caggccccactccttcctgattg

SEQ ID NO: 908801 - DNA, 14 bp, Homo sapiens
caggccccagacag

SEQ ID NO: 908802 - DNA, 16 bp, Homo sapiens
caggccccagacaggg

SEQ ID NO: 908803 - DNA, 19 bp, Homo sapiens
caggccccagcctccaggc

SEQ ID NO: 908804 - DNA, 22 bp, Homo sapiens
caggcccccggctttcctccgg

SEQ ID NO: 908805 - DNA, 15 bp, Homo sapiens
caggccccctgcatc

SEQ ID NO: 908806 - DNA, 21 bp, Homo sapiens
caggccccgtgaggcaatggg

SEQ ID NO: 908807 - DNA, 13 bp, Homo sapiens
caggcccctgagg

SEQ ID NO: 908808 - DNA, 16 bp, Homo sapiens
caggcccctgaggact

SEQ ID NO: 908809 - DNA, 21 bp, Homo sapiens
caggcccgccctctgcctcct

SEQ ID NO: 908810 - DNA, 17 bp, Homo sapiens
caggcccgcgggcacag

SEQ ID NO: 908811 - DNA, 21 bp, Homo sapiens
caggcccgcgggcacagccag

SEQ ID NO: 908812 - DNA, 22 bp, Homo sapiens
caggcccgcgggcacagccagc

SEQ ID NO: 908813 - DNA, 17 bp, Homo sapiens
caggcccggactcacca

SEQ ID NO: 908814 - DNA, 21 bp, Homo sapiens
caggcccggcccagcctaggc

SEQ ID NO: 908815 - DNA, 19 bp, Homo sapiens
caggcccggcgcggtggct

SEQ ID NO: 908816 - DNA, 15 bp, Homo sapiens
caggcccggggctgg

SEQ ID NO: 908817 - DNA, 22 bp, Homo sapiens
caggcccgtcggagctgcctgc

SEQ ID NO: 908818 - DNA, 15 bp, Homo sapiens
caggccctccagtgg

SEQ ID NO: 908819 - DNA, 18 bp, Homo sapiens
caggccctccatgggcta

SEQ ID NO: 908820 - DNA, 12 bp, Homo sapiens
caggccctccca

SEQ ID NO: 908821 - DNA, 16 bp, Homo sapiens
caggccctcccaccac

SEQ ID NO: 908822 - DNA, 14 bp, Homo sapiens
caggccctccctct

SEQ ID NO: 908823 - DNA, 23 bp, Homo sapiens
caggccctccctctactcttcct

SEQ ID NO: 908824 - DNA, 23 bp, Homo sapiens
caggccctccctgactccctgtg

SEQ ID NO: 908825 - DNA, 15 bp, Homo sapiens
caggccctccctgtc

SEQ ID NO: 908826 - DNA, 16 bp, Homo sapiens
caggccctccctgtct

SEQ ID NO: 908827 - DNA, 17 bp, Homo sapiens
caggccctccctgtctc

SEQ ID NO: 908828 - DNA, 22 bp, Homo sapiens
caggccctccctgtctccaggg

SEQ ID NO: 908829 - DNA, 14 bp, Homo sapiens
caggccctcctctc

SEQ ID NO: 908830 - DNA, 16 bp, Homo sapiens
caggccctcctctccc

SEQ ID NO: 908831 - DNA, 19 bp, Homo sapiens
caggccctctgcctgcact

SEQ ID NO: 908832 - DNA, 22 bp, Homo sapiens
caggccctctgcctgcactccc

SEQ ID NO: 908833 - DNA, 14 bp, Homo sapiens
caggccctctgtgg

SEQ ID NO: 908834 - DNA, 18 bp, Homo sapiens
caggccctctgtggcctg

SEQ ID NO: 908835 - DNA, 13 bp, Homo sapiens
caggccctgactc

SEQ ID NO: 908836 - DNA, 14 bp, Homo sapiens
caggccctgactcc

SEQ ID NO: 908837 - DNA, 16 bp, Homo sapiens
caggccctgctcctgc

SEQ ID NO: 908838 - DNA, 19 bp, Homo sapiens
caggccctgctcctgcagc

SEQ ID NO: 908839 - DNA, 20 bp, Homo sapiens
caggccctgctcctgcagca

SEQ ID NO: 908840 - DNA, 14 bp, Homo sapiens
caggccctggcctc

SEQ ID NO: 908841 - DNA, 15 bp, Homo sapiens
caggccctgtccagc

SEQ ID NO: 908842 - DNA, 17 bp, Homo sapiens
caggccctgtccagccc

SEQ ID NO: 908843 - DNA, 19 bp, Homo sapiens
caggccctgtccagccccc

SEQ ID NO: 908844 - DNA, 18 bp, Homo sapiens
caggcccttagggaagtt

SEQ ID NO: 908845 - DNA, 21 bp, Homo sapiens
caggcccttattttcaagaaa

SEQ ID NO: 908846 - DNA, 17 bp, Homo sapiens
caggcccttcctctcca

SEQ ID NO: 908847 - DNA, 19 bp, Homo sapiens
caggcccttcctctccact

SEQ ID NO: 908848 - DNA, 20 bp, Homo sapiens
caggcccttcctctccactg

SEQ ID NO: 908849 - DNA, 20 bp, Homo sapiens
caggcccttggctgcaggca

SEQ ID NO: 908850 - DNA, 20 bp, Homo sapiens
caggccctttgaagcctcag

SEQ ID NO: 908851 - DNA, 23 bp, Homo sapiens
caggccgacagtcggtgacccca

SEQ ID NO: 908852 - DNA, 13 bp, Homo sapiens
caggccggagccc

SEQ ID NO: 908853 - DNA, 14 bp, Homo sapiens
caggccggagccca

SEQ ID NO: 908854 - DNA, 16 bp, Homo sapiens
caggccggagcccaga

SEQ ID NO: 908855 - DNA, 13 bp, Homo sapiens
caggccggcccag

SEQ ID NO: 908856 - DNA, 19 bp, Homo sapiens
caggccggtgtgggctgtg

SEQ ID NO: 908857 - DNA, 18 bp, Homo sapiens
caggccgtcctcccgggc

SEQ ID NO: 908858 - DNA, 22 bp, Homo sapiens
caggccgtcctcccgggccctc

SEQ ID NO: 908859 - DNA, 14 bp, Homo sapiens
caggccgtgccttg

SEQ ID NO: 908860 - DNA, 18 bp, Homo sapiens
caggcctaagacatgtga

SEQ ID NO: 908861 - DNA, 23 bp, Homo sapiens
caggcctacctcaagttcttgga

SEQ ID NO: 908862 - DNA, 17 bp, Homo sapiens
caggcctcacctctacc

SEQ ID NO: 908863 - DNA, 17 bp, Homo sapiens
caggcctcactggctca

SEQ ID NO: 908864 - DNA, 22 bp, Homo sapiens
caggcctcactggctcatgccc

SEQ ID NO: 908865 - DNA, 12 bp, Homo sapiens
agcgggcagccc

SEQ ID NO: 908866 - DNA, 12 bp, Homo sapiens
agcgggcagggc

SEQ ID NO: 908867 - DNA, 13 bp, Homo sapiens
agcgggcgcctgt

SEQ ID NO: 908868 - DNA, 17 bp, Homo sapiens
agcgggctgtgcccggc

SEQ ID NO: 908869 - DNA, 18 bp, Homo sapiens
agcgggctgtgcccggcc

SEQ ID NO: 908870 - DNA, 18 bp, Homo sapiens
agcgggggcctaaaaaaa

SEQ ID NO: 908871 - DNA, 14 bp, Homo sapiens
agcggggggagggt

SEQ ID NO: 908872 - DNA, 16 bp, Homo sapiens
agcggggtcccctctg

SEQ ID NO: 908873 - DNA, 17 bp, Homo sapiens
agcggggtcccctctgt

SEQ ID NO: 908874 - DNA, 22 bp, Homo sapiens
agcggtccctgcagaagccaga

SEQ ID NO: 908875 - DNA, 14 bp, Homo sapiens
agcggtgaccagcc

SEQ ID NO: 908876 - DNA, 20 bp, Homo sapiens
agcggtgaccagcctgtcac

SEQ ID NO: 908877 - DNA, 22 bp, Homo sapiens
agcggtgctgtcctcaggtggc

SEQ ID NO: 908878 - DNA, 21 bp, Homo sapiens
agcggtggataactagccaga

SEQ ID NO: 908879 - DNA, 14 bp, Homo sapiens
agcggtgggaagga

SEQ ID NO: 908880 - DNA, 21 bp, Homo sapiens
agcggtgggaaggaaaggcag

SEQ ID NO: 908881 - DNA, 15 bp, Homo sapiens
agcggttcctgtgca

SEQ ID NO: 908882 - DNA, 19 bp, Homo sapiens
agcgtatatacttaagaat

SEQ ID NO: 908883 - DNA, 14 bp, Homo sapiens
agcgtcaagacatt

SEQ ID NO: 908884 - DNA, 16 bp, Homo sapiens
agcgtcaagacatttg

SEQ ID NO: 908885 - DNA, 20 bp, Homo sapiens
agcgtcactgcccaccaaag

SEQ ID NO: 908886 - DNA, 16 bp, Homo sapiens
agcgtcacttctcctg

SEQ ID NO: 908887 - DNA, 15 bp, Homo sapiens
agcgtcagctgctcc

SEQ ID NO: 908888 - DNA, 13 bp, Homo sapiens
agcgtcaggccta

SEQ ID NO: 908889 - DNA, 20 bp, Homo sapiens
agcgtcaggcctacctcaag

SEQ ID NO: 908890 - DNA, 21 bp, Homo sapiens
agcgtcagggttggtgtgctg

SEQ ID NO: 908891 - DNA, 16 bp, Homo sapiens
agcgtcagtttcactc

SEQ ID NO: 908892 - DNA, 21 bp, Homo sapiens
agcgtcagtttcactccctct

SEQ ID NO: 908893 - DNA, 15 bp, Homo sapiens
agcgtccctggcgca

SEQ ID NO: 908894 - DNA, 16 bp, Homo sapiens
agcgtcctcctctgtg

SEQ ID NO: 908895 - DNA, 14 bp, Homo sapiens
agcgtcctgaggaa

SEQ ID NO: 908896 - DNA, 15 bp, Homo sapiens
agcgtcctgccctgc

SEQ ID NO: 908897 - DNA, 12 bp, Homo sapiens
agcgtctgcagg

SEQ ID NO: 908898 - DNA, 14 bp, Homo sapiens
agcgtctgcagggt

SEQ ID NO: 908899 - DNA, 21 bp, Homo sapiens
agcgtctgcagggtgacgcct

SEQ ID NO: 908900 - DNA, 17 bp, Homo sapiens
agcgtgacggagcccac

SEQ ID NO: 908901 - DNA, 15 bp, Homo sapiens
agcgtgcacatctgc

SEQ ID NO: 908902 - DNA, 19 bp, Homo sapiens
agcgtgcaccatccctttt

SEQ ID NO: 908903 - DNA, 13 bp, Homo sapiens
agcgtggaagggg

SEQ ID NO: 908904 - DNA, 14 bp, Homo sapiens
agcgtggcccaggc

SEQ ID NO: 908905 - DNA, 20 bp, Homo sapiens
agcgtggcccaggccgggaa

SEQ ID NO: 908906 - DNA, 12 bp, Homo sapiens
agcgtggccttg

SEQ ID NO: 908907 - DNA, 16 bp, Homo sapiens
agcgtggccttgggag

SEQ ID NO: 908908 - DNA, 17 bp, Homo sapiens
agcgtggccttgggagg

SEQ ID NO: 908909 - DNA, 21 bp, Homo sapiens
agcgtggccttgggaggacat

SEQ ID NO: 908910 - DNA, 16 bp, Homo sapiens
agcgtggggtagcaga

SEQ ID NO: 908911 - DNA, 15 bp, Homo sapiens
agcgtgtgccaggca

SEQ ID NO: 908912 - DNA, 17 bp, Homo sapiens
agcgtgtggagcagagc

SEQ ID NO: 908913 - DNA, 19 bp, Homo sapiens
agcgttcccttctccccct

SEQ ID NO: 908914 - DNA, 15 bp, Homo sapiens
agcgttcctggcctt

SEQ ID NO: 908915 - DNA, 14 bp, Homo sapiens
agcgttctggactc

SEQ ID NO: 908916 - DNA, 16 bp, Homo sapiens
agcgtttgctgtgcca

SEQ ID NO: 908917 - DNA, 18 bp, Homo sapiens
agcgtttttaacctgttt

SEQ ID NO: 908918 - DNA, 17 bp, Homo sapiens
agcgttttttaaatgta

SEQ ID NO: 908919 - DNA, 23 bp, Homo sapiens
agcgttttttaaatgtatactat

SEQ ID NO: 908920 - DNA, 16 bp, Homo sapiens
agctaaaaatattact

SEQ ID NO: 908921 - DNA, 19 bp, Homo sapiens
agctaaaataaagaaatag

SEQ ID NO: 908922 - DNA, 20 bp, Homo sapiens
agctaaaatgattttatctg

SEQ ID NO: 908923 - DNA, 19 bp, Homo sapiens
agctaaaccaagaaggaga

SEQ ID NO: 908924 - DNA, 21 bp, Homo sapiens
agctaaagaggctgaaagagg

SEQ ID NO: 908925 - DNA, 13 bp, Homo sapiens
agctaaatccttt

SEQ ID NO: 908926 - DNA, 17 bp, Homo sapiens
agctaaatgcaatttaa

SEQ ID NO: 908927 - DNA, 22 bp, Homo sapiens
agctaaatgtaacttattccaa

SEQ ID NO: 908928 - DNA, 17 bp, Homo sapiens
agctaacactggcccct

SEQ ID NO: 908929 - DNA, 12 bp, Homo sapiens
agctaacatctt

SEQ ID NO: 908930 - DNA, 13 bp, Homo sapiens
agctaacatcttt

SEQ ID NO: 908931 - DNA, 14 bp, Homo sapiens
agctaacatcttta

SEQ ID NO: 908932 - DNA, 20 bp, Homo sapiens
agctaacattttaaataaaa

SEQ ID NO: 908933 - DNA, 23 bp, Homo sapiens
agctaacccccttctactgagcc

SEQ ID NO: 908934 - DNA, 18 bp, Homo sapiens
agctaagctaggaatgaa

SEQ ID NO: 908935 - DNA, 19 bp, Homo sapiens
agctaaggacatttcccag

SEQ ID NO: 908936 - DNA, 23 bp, Homo sapiens
agctaaggaggggaaaaaaatgt

SEQ ID NO: 908937 - DNA, 19 bp, Homo sapiens
agctaaggtttagataaat

SEQ ID NO: 908938 - DNA, 19 bp, Homo sapiens
agctaagtcacccagagca

SEQ ID NO: 908939 - DNA, 16 bp, Homo sapiens
agctaataaaaagctt

SEQ ID NO: 908940 - DNA, 18 bp, Homo sapiens
agctaataaaaagctttt

SEQ ID NO: 908941 - DNA, 16 bp, Homo sapiens
agctaatcagcattct

SEQ ID NO: 908942 - DNA, 20 bp, Homo sapiens
agctaatctgcctggtttta

SEQ ID NO: 908943 - DNA, 13 bp, Homo sapiens
agctaatctgtag

SEQ ID NO: 908944 - DNA, 19 bp, Homo sapiens
agctaatctgtagggctgg

SEQ ID NO: 908945 - DNA, 21 bp, Homo sapiens
agctaattctactcacagtgc

SEQ ID NO: 908946 - DNA, 15 bp, Homo sapiens
agctaattgggagtc

SEQ ID NO: 908947 - DNA, 16 bp, Homo sapiens
agctaatttatagcaa

SEQ ID NO: 908948 - DNA, 19 bp, Homo sapiens
agctacagcctctttccta

SEQ ID NO: 908949 - DNA, 18 bp, Homo sapiens
agctacagtgcatagttg

SEQ ID NO: 908950 - DNA, 18 bp, Homo sapiens
agctacattcctcagctg

SEQ ID NO: 908951 - DNA, 20 bp, Homo sapiens
agctacattcctcagctgcc

SEQ ID NO: 908952 - DNA, 19 bp, Homo sapiens
agctaccagagctctatcc

SEQ ID NO: 908953 - DNA, 18 bp, Homo sapiens
agctaccattttacattt

SEQ ID NO: 908954 - DNA, 16 bp, Homo sapiens
agctaccccttctttg

SEQ ID NO: 908955 - DNA, 16 bp, Homo sapiens
agctacgtatttaata

SEQ ID NO: 908956 - DNA, 14 bp, Homo sapiens
agctactaaaatca

SEQ ID NO: 908957 - DNA, 13 bp, Homo sapiens
agctactaatgat

SEQ ID NO: 908958 - DNA, 22 bp, Homo sapiens
agctactcaagaggctgaggca

SEQ ID NO: 908959 - DNA, 21 bp, Homo sapiens
agctactcagaagcctgaggc

SEQ ID NO: 908960 - DNA, 13 bp, Homo sapiens
agctactcaggag

SEQ ID NO: 908961 - DNA, 18 bp, Homo sapiens
agctactcccctttcttc

SEQ ID NO: 908962 - DNA, 23 bp, Homo sapiens
agctactcgatagcctgaggtgg

SEQ ID NO: 908963 - DNA, 14 bp, Homo sapiens
agctactctgtcca

SEQ ID NO: 908964 - DNA, 18 bp, Homo sapiens
agctactctgtccaggcc

SEQ ID NO: 908965 - DNA, 19 bp, Homo sapiens
agctactctgtccaggcca

SEQ ID NO: 908966 - DNA, 17 bp, Homo sapiens
agctactgaaccagcca

SEQ ID NO: 908967 - DNA, 13 bp, Homo sapiens
agctactgatgaa

SEQ ID NO: 908968 - DNA, 18 bp, Homo sapiens
agctactgatgaaatctg

SEQ ID NO: 908969 - DNA, 20 bp, Homo sapiens
agctactgatttcctttgga

SEQ ID NO: 908970 - DNA, 23 bp, Homo sapiens
agctactgatttcctttggagct

SEQ ID NO: 908971 - DNA, 17 bp, Homo sapiens
agctactggaatggtgt

SEQ ID NO: 908972 - DNA, 13 bp, Homo sapiens
agctactgtaact

SEQ ID NO: 908973 - DNA, 20 bp, Homo sapiens
agctactgtaacttttttaa

SEQ ID NO: 908974 - DNA, 20 bp, Homo sapiens
agctactgtgtgtgtgaatg

SEQ ID NO: 908975 - DNA, 23 bp, Homo sapiens
agctactgtgtgtgtgaatgaac

SEQ ID NO: 908976 - DNA, 17 bp, Homo sapiens
agctacttgggagcctg

SEQ ID NO: 908977 - DNA, 14 bp, Homo sapiens
agctacttgggagg

SEQ ID NO: 908978 - DNA, 21 bp, Homo sapiens
agctacttgggaggctgaggc

SEQ ID NO: 908979 - DNA, 14 bp, Homo sapiens
agctacttggtttg

SEQ ID NO: 908980 - DNA, 19 bp, Homo sapiens
agctagaaaaataaaatgt

SEQ ID NO: 908981 - DNA, 11 bp, Homo sapiens
agctagaaatg

SEQ ID NO: 908982 - DNA, 21 bp, Homo sapiens
agctagaacttctctaagcct

SEQ ID NO: 908983 - DNA, 14 bp, Homo sapiens
agctagaaggccac

SEQ ID NO: 908984 - DNA, 15 bp, Homo sapiens
agctagaatttctgg

SEQ ID NO: 908985 - DNA, 15 bp, Homo sapiens
agctagacacatgaa

SEQ ID NO: 908986 - DNA, 16 bp, Homo sapiens
agctagacacatgaag

SEQ ID NO: 908987 - DNA, 15 bp, Homo sapiens
agctagactggagtg

SEQ ID NO: 908988 - DNA, 13 bp, Homo sapiens
agctagatgcttt

SEQ ID NO: 908989 - DNA, 13 bp, Homo sapiens
agctagccagcca

SEQ ID NO: 908990 - DNA, 17 bp, Homo sapiens
agcttaactaatttgaa

SEQ ID NO: 908991 - DNA, 17 bp, Homo sapiens
agcttaagaaagaacat

SEQ ID NO: 908992 - DNA, 16 bp, Homo sapiens
agcttaagccactgcc

SEQ ID NO: 908993 - DNA, 17 bp, Homo sapiens
agcttaatagccctccc

SEQ ID NO: 908994 - DNA, 20 bp, Homo sapiens
agcttaatagctgtagtttt

SEQ ID NO: 908995 - DNA, 17 bp, Homo sapiens
agcttaatcaacagaag

SEQ ID NO: 908996 - DNA, 19 bp, Homo sapiens
agcttaatggctgataatt

SEQ ID NO: 908997 - DNA, 17 bp, Homo sapiens
agcttacaagccagctg

SEQ ID NO: 908998 - DNA, 12 bp, Homo sapiens
agcttacactga

SEQ ID NO: 908999 - DNA, 19 bp, Homo sapiens
agcttacactgaggactgt

SEQ ID NO: 909000 - DNA, 18 bp, Homo sapiens
agcttacccaagctgtgg

SEQ ID NO: 909001 - DNA, 15 bp, Homo sapiens
agcttactgatgatg

SEQ ID NO: 909002 - DNA, 14 bp, Homo sapiens
agcttagacctcag

SEQ ID NO: 909003 - DNA, 15 bp, Homo sapiens
agcttagacctcagc

SEQ ID NO: 909004 - DNA, 17 bp, Homo sapiens
agcttagacctcagcct

SEQ ID NO: 909005 - DNA, 19 bp, Homo sapiens
agcttagacctcagcctgt

SEQ ID NO: 909006 - DNA, 20 bp, Homo sapiens
agcttagacctcagcctgtg

SEQ ID NO: 909007 - DNA, 18 bp, Homo sapiens
agcttagagttcttcttt

SEQ ID NO: 909008 - DNA, 15 bp, Homo sapiens
agcttagatttcata

SEQ ID NO: 909009 - DNA, 17 bp, Homo sapiens
agcttagccaatgtggg

SEQ ID NO: 909010 - DNA, 13 bp, Homo sapiens
agcttagccttgt

SEQ ID NO: 909011 - DNA, 15 bp, Homo sapiens
agcttagccttgtgc

SEQ ID NO: 909012 - DNA, 20 bp, Homo sapiens
agcttagccttgtgccctgc

SEQ ID NO: 909013 - DNA, 22 bp, Homo sapiens
agcttagccttgtgccctgccc

SEQ ID NO: 909014 - DNA, 18 bp, Homo sapiens
agcttatacgaaataatt

SEQ ID NO: 909015 - DNA, 14 bp, Homo sapiens
agcttatctcaggg

SEQ ID NO: 909016 - DNA, 15 bp, Homo sapiens
agcttatctttcttt

SEQ ID NO: 909017 - DNA, 16 bp, Homo sapiens
agcttatctttctttc

SEQ ID NO: 909018 - DNA, 17 bp, Homo sapiens
agcttatctttctttcc

SEQ ID NO: 909019 - DNA, 22 bp, Homo sapiens
agcttatctttctttccattta

SEQ ID NO: 909020 - DNA, 20 bp, Homo sapiens
agccacaggaacggccctgc

SEQ ID NO: 909021 - DNA, 13 bp, Homo sapiens
agccacaggaagg

SEQ ID NO: 909022 - DNA, 23 bp, Homo sapiens
agccacaggaaggaggggagaga

SEQ ID NO: 909023 - DNA, 21 bp, Homo sapiens
agccacaggactgagccctct

SEQ ID NO: 909024 - DNA, 21 bp, Homo sapiens
agccacaggccccttttgtgg

SEQ ID NO: 909025 - DNA, 16 bp, Homo sapiens
agccacagtcactgga

SEQ ID NO: 909026 - DNA, 11 bp, Homo sapiens
agccacatccc

SEQ ID NO: 909027 - DNA, 12 bp, Homo sapiens
agccacatcttg

SEQ ID NO: 909028 - DNA, 13 bp, Homo sapiens
agccacatcttgc

SEQ ID NO: 909029 - DNA, 14 bp, Homo sapiens
agccacattatttc

SEQ ID NO: 909030 - DNA, 19 bp, Homo sapiens
agccaccaccctcaggtgc

SEQ ID NO: 909031 - DNA, 20 bp, Homo sapiens
agccaccaccctcaggtgcc

SEQ ID NO: 909032 - DNA, 17 bp, Homo sapiens
agccaccacgtccagct

SEQ ID NO: 909033 - DNA, 20 bp, Homo sapiens
agccaccagacttggcctcc

SEQ ID NO: 909034 - DNA, 21 bp, Homo sapiens
agccaccagtggacctagcct

SEQ ID NO: 909035 - DNA, 22 bp, Homo sapiens
agccaccatgcttgcctgaagc

SEQ ID NO: 909036 - DNA, 21 bp, Homo sapiens
agccacccaagcctgctggct

SEQ ID NO: 909037 - DNA, 16 bp, Homo sapiens
agccaccccatgagct

SEQ ID NO: 909038 - DNA, 19 bp, Homo sapiens
agccaccccatgagctcgg

SEQ ID NO: 909039 - DNA, 22 bp, Homo sapiens
agccacccccaggcatctgtta

SEQ ID NO: 909040 - DNA, 13 bp, Homo sapiens
agccacccctcag

SEQ ID NO: 909041 - DNA, 17 bp, Homo sapiens
agccacccctcagatgc

SEQ ID NO: 909042 - DNA, 21 bp, Homo sapiens
agccacccgtggggtgctgcc

SEQ ID NO: 909043 - DNA, 23 bp, Homo sapiens
agccacccgtggggtgctgccct

SEQ ID NO: 909044 - DNA, 21 bp, Homo sapiens
agccaccgaagccgcctgtgg

SEQ ID NO: 909045 - DNA, 16 bp, Homo sapiens
agccaccgctgccagc

SEQ ID NO: 909046 - DNA, 18 bp, Homo sapiens
agccaccgtgcccggcca

SEQ ID NO: 909047 - DNA, 21 bp, Homo sapiens
agccaccgtgcccggccaagt

SEQ ID NO: 909048 - DNA, 18 bp, Homo sapiens
agccaccgtgcctggcca

SEQ ID NO: 909049 - DNA, 15 bp, Homo sapiens
agccacctccgccag

SEQ ID NO: 909050 - DNA, 17 bp, Homo sapiens
agccacctccgccagac

SEQ ID NO: 909051 - DNA, 12 bp, Homo sapiens
agccacctctcc

SEQ ID NO: 909052 - DNA, 14 bp, Homo sapiens
agccacctctccct

SEQ ID NO: 909053 - DNA, 15 bp, Homo sapiens
agccacctctccctc

SEQ ID NO: 909054 - DNA, 16 bp, Homo sapiens
agccacctggcagggc

SEQ ID NO: 909055 - DNA, 12 bp, Homo sapiens
agccacctggga

SEQ ID NO: 909056 - DNA, 16 bp, Homo sapiens
agccaccttcccaccc

SEQ ID NO: 909057 - DNA, 22 bp, Homo sapiens
agccaccttttgggaatgtttt

SEQ ID NO: 909058 - DNA, 14 bp, Homo sapiens
agccacgactgcca

SEQ ID NO: 909059 - DNA, 17 bp, Homo sapiens
agccacgattggagaat

SEQ ID NO: 909060 - DNA, 18 bp, Homo sapiens
agccacgcagtgcctgga

SEQ ID NO: 909061 - DNA, 15 bp, Homo sapiens
agccacgctgtcctc

SEQ ID NO: 909062 - DNA, 13 bp, Homo sapiens
agccacggaggga

SEQ ID NO: 909063 - DNA, 21 bp, Homo sapiens
agccacggagggaggcaccat

SEQ ID NO: 909064 - DNA, 18 bp, Homo sapiens
agccacgttccttactgc

SEQ ID NO: 909065 - DNA, 20 bp, Homo sapiens
agccacgttccttactgcag

SEQ ID NO: 909066 - DNA, 22 bp, Homo sapiens
agccactaaccttgcctggtac

SEQ ID NO: 909067 - DNA, 22 bp, Homo sapiens
agccactaagaacccctctgct

SEQ ID NO: 909068 - DNA, 15 bp, Homo sapiens
agccactcaggaggc

SEQ ID NO: 909069 - DNA, 20 bp, Homo sapiens
agccactcagtctcttccac

SEQ ID NO: 909070 - DNA, 14 bp, Homo sapiens
agccactccaagcc

SEQ ID NO: 909071 - DNA, 20 bp, Homo sapiens
agccactccaagccccctgg

SEQ ID NO: 909072 - DNA, 11 bp, Homo sapiens
agccactccct

SEQ ID NO: 909073 - DNA, 13 bp, Homo sapiens
agccactccctcc

SEQ ID NO: 909074 - DNA, 15 bp, Homo sapiens
agccactccctccca

SEQ ID NO: 909075 - DNA, 16 bp, Homo sapiens
agccactccctcccag

SEQ ID NO: 909076 - DNA, 15 bp, Homo sapiens
agccactcctctgac

SEQ ID NO: 909077 - DNA, 22 bp, Homo sapiens
agccactccttccttcaggact

SEQ ID NO: 909078 - DNA, 20 bp, Homo sapiens
agccactcgcagtcgcagga

SEQ ID NO: 909079 - DNA, 12 bp, Homo sapiens
agccactgaagc

SEQ ID NO: 909080 - DNA, 11 bp, Homo sapiens
agctggggaga

SEQ ID NO: 909081 - DNA, 12 bp, Homo sapiens
agctggggagat

SEQ ID NO: 909082 - DNA, 13 bp, Homo sapiens
agctggggagatg

SEQ ID NO: 909083 - DNA, 14 bp, Homo sapiens
agctggggagatgg

SEQ ID NO: 909084 - DNA, 18 bp, Homo sapiens
agctggggaggagctttg

SEQ ID NO: 909085 - DNA, 23 bp, Homo sapiens
agctggggaggtgggaggccagg

SEQ ID NO: 909086 - DNA, 14 bp, Homo sapiens
agctggggccagag

SEQ ID NO: 909087 - DNA, 19 bp, Homo sapiens
agctggggccagaggctgg

SEQ ID NO: 909088 - DNA, 20 bp, Homo sapiens
agctggggctgccagcctga

SEQ ID NO: 909089 - DNA, 22 bp, Homo sapiens
agctggggggatgttctgcctc

SEQ ID NO: 909090 - DNA, 17 bp, Homo sapiens
agctgggggtgggccag

SEQ ID NO: 909091 - DNA, 18 bp, Homo sapiens
agctgggggtgggccagg

SEQ ID NO: 909092 - DNA, 21 bp, Homo sapiens
agctgggggtgggccaggctg

SEQ ID NO: 909093 - DNA, 15 bp, Homo sapiens
agctggggtctgggc

SEQ ID NO: 909094 - DNA, 22 bp, Homo sapiens
agctggggtctgggcagtgcca

SEQ ID NO: 909095 - DNA, 20 bp, Homo sapiens
agctgggttccgggaggcag

SEQ ID NO: 909096 - DNA, 16 bp, Homo sapiens
agctggtaaaaatgac

SEQ ID NO: 909097 - DNA, 13 bp, Homo sapiens
agctggtaacatc

SEQ ID NO: 909098 - DNA, 15 bp, Homo sapiens
agctggtagttagta

SEQ ID NO: 909099 - DNA, 22 bp, Homo sapiens
agctggtagttagtagcatgtt

SEQ ID NO: 909100 - DNA, 13 bp, Homo sapiens
agctggtcagtct

SEQ ID NO: 909101 - DNA, 14 bp, Homo sapiens
agctggtcctgtgg

SEQ ID NO: 909102 - DNA, 14 bp, Homo sapiens
agctggtctgccag

SEQ ID NO: 909103 - DNA, 18 bp, Homo sapiens
agctggtcttaaactcct

SEQ ID NO: 909104 - DNA, 18 bp, Homo sapiens
agctggtgacagccttgg

SEQ ID NO: 909105 - DNA, 16 bp, Homo sapiens
agctgagtcacctcct

SEQ ID NO: 909106 - DNA, 17 bp, Homo sapiens
agctgagtcacctcctc

SEQ ID NO: 909107 - DNA, 14 bp, Homo sapiens
agctgagtttccta

SEQ ID NO: 909108 - DNA, 20 bp, Homo sapiens
agctgatacttcatttaaaa

SEQ ID NO: 909109 - DNA, 21 bp, Homo sapiens
agctgatacttcatttaaaaa

SEQ ID NO: 909110 - DNA, 20 bp, Homo sapiens
agctgatactttgacagtgt

SEQ ID NO: 909111 - DNA, 20 bp, Homo sapiens
agctgatattatggcaagtg

SEQ ID NO: 909112 - DNA, 18 bp, Homo sapiens
agctgatattatttcttc

SEQ ID NO: 909113 - DNA, 13 bp, Homo sapiens
agctgatccagag

SEQ ID NO: 909114 - DNA, 15 bp, Homo sapiens
agctgatccatagga

SEQ ID NO: 909115 - DNA, 20 bp, Homo sapiens
agctgatgaacttattctgt

SEQ ID NO: 909116 - DNA, 15 bp, Homo sapiens
agctgatgatgtctc

SEQ ID NO: 909117 - DNA, 23 bp, Homo sapiens
agctgatgatgtctcttgtagaa

SEQ ID NO: 909118 - DNA, 16 bp, Homo sapiens
agctgatggcagctgg

SEQ ID NO: 909119 - DNA, 17 bp, Homo sapiens
agctgatgttggaagag

SEQ ID NO: 909120 - DNA, 21 bp, Homo sapiens
agctgatgttggaagagaaag

SEQ ID NO: 909121 - DNA, 22 bp, Homo sapiens
agctgattactgtcaataaaca

SEQ ID NO: 909122 - DNA, 18 bp, Homo sapiens
agctgattccagaacaaa

SEQ ID NO: 909123 - DNA, 17 bp, Homo sapiens
agctgatttccaggccc

SEQ ID NO: 909124 - DNA, 18 bp, Homo sapiens
agctgatttccaggcccc

SEQ ID NO: 909125 - DNA, 23 bp, Homo sapiens
agctgatttccaggcccctgagg

SEQ ID NO: 909126 - DNA, 15 bp, Homo sapiens
agctgatttgtatat

SEQ ID NO: 909127 - DNA, 14 bp, Homo sapiens
agctgattttaaca

SEQ ID NO: 909128 - DNA, 16 bp, Homo sapiens
agctgcaaaaataatc

SEQ ID NO: 909129 - DNA, 17 bp, Homo sapiens
agctgcaattccctgga

SEQ ID NO: 909130 - DNA, 15 bp, Homo sapiens
agctgcacacacctg

SEQ ID NO: 909131 - DNA, 14 bp, Homo sapiens
agctgcacagcaaa

SEQ ID NO: 909132 - DNA, 21 bp, Homo sapiens
agctgcacagcaaaagaaact

SEQ ID NO: 909133 - DNA, 11 bp, Homo sapiens
agctgcacatg

SEQ ID NO: 909134 - DNA, 15 bp, Homo sapiens
agctgcacattcctg

SEQ ID NO: 909135 - DNA, 22 bp, Homo sapiens
agctgcacattcctggccccgg

SEQ ID NO: 909136 - DNA, 22 bp, Homo sapiens
agctgcaccccagcgtcaggcc

SEQ ID NO: 909137 - DNA, 18 bp, Homo sapiens
agctgcaccctcaggcag

SEQ ID NO: 909138 - DNA, 22 bp, Homo sapiens
agctgcaccctcaggcaggtgg

SEQ ID NO: 909139 - DNA, 15 bp, Homo sapiens
agctgcactgtgaac

SEQ ID NO: 909140 - DNA, 14 bp, Homo sapiens
agctgcagagcagc

SEQ ID NO: 909141 - DNA, 12 bp, Homo sapiens
agctgcagctgg

SEQ ID NO: 909142 - DNA, 13 bp, Homo sapiens
agctgcagctggg

SEQ ID NO: 909143 - DNA, 17 bp, Homo sapiens
agctgcagctgggcccc

SEQ ID NO: 909144 - DNA, 12 bp, Homo sapiens
agctgcagggca

SEQ ID NO: 909145 - DNA, 15 bp, Homo sapiens
agctgcagggcacgg

SEQ ID NO: 909146 - DNA, 20 bp, Homo sapiens
agctgcagggcacggggacc

SEQ ID NO: 909147 - DNA, 22 bp, Homo sapiens
agctgcagggcacggggacctg

SEQ ID NO: 909148 - DNA, 22 bp, Homo sapiens
agctgcaggtttgtaatgcaaa

SEQ ID NO: 909149 - DNA, 15 bp, Homo sapiens
agctgcatggagcct

SEQ ID NO: 909150 - DNA, 18 bp, Homo sapiens
agctgcatggagcctgga

SEQ ID NO: 909151 - DNA, 18 bp, Homo sapiens
agctgcatgttaagtgcc

SEQ ID NO: 909152 - DNA, 16 bp, Homo sapiens
agctgccactgggcac

SEQ ID NO: 909153 - DNA, 14 bp, Homo sapiens
agctgccagagaag

SEQ ID NO: 909154 - DNA, 13 bp, Homo sapiens
agctgccagccgg

SEQ ID NO: 909155 - DNA, 12 bp, Homo sapiens
agctgccaggcg

SEQ ID NO: 909156 - DNA, 14 bp, Homo sapiens
agctgccaggcggc

SEQ ID NO: 909157 - DNA, 18 bp, Homo sapiens
agctgccaggcggccctg

SEQ ID NO: 909158 - DNA, 19 bp, Homo sapiens
agctgccaggcggccctgg

SEQ ID NO: 909159 - DNA, 20 bp, Homo sapiens
agctgccaggcggccctggg

SEQ ID NO: 909160 - DNA, 22 bp, Homo sapiens
agctgccaggcggccctgggga

SEQ ID NO: 909161 - DNA, 13 bp, Homo sapiens
agctgccagtgct

SEQ ID NO: 909162 - DNA, 19 bp, Homo sapiens
agctgccatcgctgtgatg

SEQ ID NO: 909163 - DNA, 24 bp, Homo sapiens
agctgcccactgtttctcttgagc

SEQ ID NO: 909164 - DNA, 15 bp, Homo sapiens
agctgccccagccag

SEQ ID NO: 909165 - DNA, 16 bp, Homo sapiens
agctgccccagccaga

SEQ ID NO: 909166 - DNA, 16 bp, Homo sapiens
agctgccccggcccct

SEQ ID NO: 909167 - DNA, 13 bp, Homo sapiens
agctgcccctcct

SEQ ID NO: 909168 - DNA, 16 bp, Homo sapiens
agctgcccctcctgga

SEQ ID NO: 909169 - DNA, 18 bp, Homo sapiens
agctgcccctcctggagc

SEQ ID NO: 909170 - DNA, 15 bp, Homo sapiens
agctgcccggcgcct

SEQ ID NO: 909171 - DNA, 19 bp, Homo sapiens
agctgcccggcgcctgccc

SEQ ID NO: 909172 - DNA, 15 bp, Homo sapiens
agctgccctagctga

SEQ ID NO: 909173 - DNA, 16 bp, Homo sapiens
agctgccctagctgac

SEQ ID NO: 909174 - DNA, 16 bp, Homo sapiens
agctgccctgctgcca

SEQ ID NO: 909175 - DNA, 21 bp, Homo sapiens
agctgccctgctgccacagca

SEQ ID NO: 909176 - DNA, 13 bp, Homo sapiens
agctgccgaccag

SEQ ID NO: 909177 - DNA, 18 bp, Homo sapiens
agctgccgaccagagccc

SEQ ID NO: 909178 - DNA, 23 bp, Homo sapiens
agctgcctcccctctccttcctg

SEQ ID NO: 909179 - DNA, 13 bp, Homo sapiens
agctgcctctgct

SEQ ID NO: 909180 - DNA, 15 bp, Homo sapiens
agctgcctctgggcc

SEQ ID NO: 909181 - DNA, 17 bp, Homo sapiens
agctgcctcttctcttg

SEQ ID NO: 909182 - DNA, 16 bp, Homo sapiens
agctgcctcttctgtg

SEQ ID NO: 909183 - DNA, 10 bp, Homo sapiens
agctgcctgc

SEQ ID NO: 909184 - DNA, 11 bp, Homo sapiens
agctgcctggc

SEQ ID NO: 909185 - DNA, 14 bp, Homo sapiens
agctgcctggccat

SEQ ID NO: 909186 - DNA, 17 bp, Homo sapiens
agctgcctggccatgct

SEQ ID NO: 909187 - DNA, 14 bp, Homo sapiens
agctgcctgggccc

SEQ ID NO: 909188 - DNA, 13 bp, Homo sapiens
agctgcctggggc

SEQ ID NO: 909189 - DNA, 18 bp, Homo sapiens
agctgcctggggcccaag

SEQ ID NO: 909190 - DNA, 14 bp, Homo sapiens
agctgcctgtagtt

SEQ ID NO: 909191 - DNA, 15 bp, Homo sapiens
agctgcctgtagtta

SEQ ID NO: 909192 - DNA, 23 bp, Homo sapiens
agctgcctgtccctaccccatgg

SEQ ID NO: 909193 - DNA, 19 bp, Homo sapiens
agctgcctgtgccatgccc

SEQ ID NO: 909194 - DNA, 12 bp, Homo sapiens
agctgccttccc

SEQ ID NO: 909195 - DNA, 14 bp, Homo sapiens
agctgccttcccta

SEQ ID NO: 909196 - DNA, 19 bp, Homo sapiens
agctgccttccctagcttt

SEQ ID NO: 909197 - DNA, 20 bp, Homo sapiens
agctgccttggctcagacat

SEQ ID NO: 909198 - DNA, 10 bp, Homo sapiens
agctgctata

SEQ ID NO: 909199 - DNA, 19 bp, Homo sapiens
agctgctatccccatctcc

SEQ ID NO: 909200 - DNA, 23 bp, Homo sapiens
agctgctatgctaaacctcctgc

SEQ ID NO: 909201 - DNA, 19 bp, Homo sapiens
agctgctatttattttcct

SEQ ID NO: 909202 - DNA, 19 bp, Homo sapiens
agctgctcattacagttct

SEQ ID NO: 909203 - DNA, 22 bp, Homo sapiens
agctgctcattacagttctttc

SEQ ID NO: 909204 - DNA, 17 bp, Homo sapiens
agctgctccaggcctgc

SEQ ID NO: 909205 - DNA, 16 bp, Homo sapiens
agctgctcccctgcca

SEQ ID NO: 909206 - DNA, 18 bp, Homo sapiens
agctgctcccctgccacg

SEQ ID NO: 909207 - DNA, 20 bp, Homo sapiens
agctgctccgaggacccagg

SEQ ID NO: 909208 - DNA, 22 bp, Homo sapiens
agctgctccgaggacccaggaa

SEQ ID NO: 909209 - DNA, 22 bp, Homo sapiens
agctgctcctagagggaggggc

SEQ ID NO: 909210 - DNA, 18 bp, Homo sapiens
agctgctcctttaccctc

SEQ ID NO: 909211 - DNA, 14 bp, Homo sapiens
agctgctctattgt

SEQ ID NO: 909212 - DNA, 18 bp, Homo sapiens
agctgctctgagccacag

SEQ ID NO: 909213 - DNA, 14 bp, Homo sapiens
agctgctctggaaa

SEQ ID NO: 909214 - DNA, 20 bp, Homo sapiens
agctgctcttagtgcccgcc

SEQ ID NO: 909215 - DNA, 21 bp, Homo sapiens
agctgctcttagtgcccgcct

SEQ ID NO: 909216 - DNA, 20 bp, Homo sapiens
agctctagacaaccctgcaa

SEQ ID NO: 909217 - DNA, 22 bp, Homo sapiens
agctctattaagatttccaagt

SEQ ID NO: 909218 - DNA, 17 bp, Homo sapiens
agctctattttaaagta

SEQ ID NO: 909219 - DNA, 13 bp, Homo sapiens
agctctcagccaa

SEQ ID NO: 909220 - DNA, 12 bp, Homo sapiens
agctctccaggc

SEQ ID NO: 909221 - DNA, 15 bp, Homo sapiens
agctctccaggcccc

SEQ ID NO: 909222 - DNA, 19 bp, Homo sapiens
agctctccagtcaggaggc

SEQ ID NO: 909223 - DNA, 12 bp, Homo sapiens
agctctcccagt

SEQ ID NO: 909224 - DNA, 15 bp, Homo sapiens
agctctcccagtgaa

SEQ ID NO: 909225 - DNA, 16 bp, Homo sapiens
agctctcccctcctgc

SEQ ID NO: 909226 - DNA, 21 bp, Homo sapiens
agctctcccctcctgctgggc

SEQ ID NO: 909227 - DNA, 22 bp, Homo sapiens
agctctcccctcctgctgggcg

SEQ ID NO: 909228 - DNA, 15 bp, Homo sapiens
agctctccctctggc

SEQ ID NO: 909229 - DNA, 16 bp, Homo sapiens
agctctccctctggcc

SEQ ID NO: 909230 - DNA, 19 bp, Homo sapiens
agctctccctctggccctg

SEQ ID NO: 909231 - DNA, 18 bp, Homo sapiens
agctctcccttgtttact

SEQ ID NO: 909232 - DNA, 21 bp, Homo sapiens
agctctcgggactagctgcct

SEQ ID NO: 909233 - DNA, 18 bp, Homo sapiens
agctctcgttctccttcc

SEQ ID NO: 909234 - DNA, 19 bp, Homo sapiens
agctctcgttctccttccc

SEQ ID NO: 909235 - DNA, 11 bp, Homo sapiens
agctctctgca

SEQ ID NO: 909236 - DNA, 19 bp, Homo sapiens
agctctctgccctgtgtac

SEQ ID NO: 909237 - DNA, 14 bp, Homo sapiens
agctctgaaaacaa

SEQ ID NO: 909238 - DNA, 18 bp, Homo sapiens
agctctgaaaccagtgtt

SEQ ID NO: 909239 - DNA, 15 bp, Homo sapiens
agctctgaaagagaa

SEQ ID NO: 909240 - DNA, 22 bp, Homo sapiens
agctctgaaagagaaacacgta

SEQ ID NO: 909241 - DNA, 18 bp, Homo sapiens
agctctgaacaaacactg

SEQ ID NO: 909242 - DNA, 21 bp, Homo sapiens
agctctgaagaactctctgga

SEQ ID NO: 909243 - DNA, 19 bp, Homo sapiens
agctctgacatcccttcct

SEQ ID NO: 909244 - DNA, 19 bp, Homo sapiens
agctctgagacccttttct

SEQ ID NO: 909245 - DNA, 20 bp, Homo sapiens
agctctgagacccttttctc

SEQ ID NO: 909246 - DNA, 21 bp, Homo sapiens
agctctgagacccttttctca

SEQ ID NO: 909247 - DNA, 13 bp, Homo sapiens
agctctgcccccg

SEQ ID NO: 909248 - DNA, 15 bp, Homo sapiens
agctctgcccccgcg

SEQ ID NO: 909249 - DNA, 17 bp, Homo sapiens
agctctgccgtctctgg

SEQ ID NO: 909250 - DNA, 20 bp, Homo sapiens
agctctgccgtctctggagc

SEQ ID NO: 909251 - DNA, 11 bp, Homo sapiens
agctctgcctc

SEQ ID NO: 909252 - DNA, 20 bp, Homo sapiens
agctctgcgccaggcagagc

SEQ ID NO: 909253 - DNA, 17 bp, Homo sapiens
agctctggaccagcctg

SEQ ID NO: 909254 - DNA, 12 bp, Homo sapiens
agctctggaggg

SEQ ID NO: 909255 - DNA, 20 bp, Homo sapiens
agctctggaggggaggggga

SEQ ID NO: 909256 - DNA, 20 bp, Homo sapiens
agctctggctgaaccctgtg

SEQ ID NO: 909257 - DNA, 22 bp, Homo sapiens
agctctggctgaaccctgtgct

SEQ ID NO: 909258 - DNA, 20 bp, Homo sapiens
agctctggcttcctgctgag

SEQ ID NO: 909259 - DNA, 15 bp, Homo sapiens
agctctgggcctctt

SEQ ID NO: 909260 - DNA, 11 bp, Homo sapiens
agctctgggga

SEQ ID NO: 909261 - DNA, 19 bp, Homo sapiens
agctctggggacagcttcc

SEQ ID NO: 909262 - DNA, 20 bp, Homo sapiens
agctctggggtgggcagttt

SEQ ID NO: 909263 - DNA, 21 bp, Homo sapiens
agctctggggtgggcagtttt

SEQ ID NO: 909264 - DNA, 23 bp, Homo sapiens
agctctggtgagtcttggcggca

SEQ ID NO: 909265 - DNA, 16 bp, Homo sapiens
agctctgtaacttaca

SEQ ID NO: 909266 - DNA, 23 bp, Homo sapiens
agctctgtatcaggacccagagg

SEQ ID NO: 909267 - DNA, 14 bp, Homo sapiens
agctctgtggcctg

SEQ ID NO: 909268 - DNA, 19 bp, Homo sapiens
agctctgtggcctgtgtcc

SEQ ID NO: 909269 - DNA, 20 bp, Homo sapiens
agctctgtggcctgtgtcca

SEQ ID NO: 909270 - DNA, 18 bp, Homo sapiens
agctcttactctttccta

SEQ ID NO: 909271 - DNA, 13 bp, Homo sapiens
agctcttcaggcc

SEQ ID NO: 909272 - DNA, 18 bp, Homo sapiens
agctcttcaggcctccct

SEQ ID NO: 909273 - DNA, 20 bp, Homo sapiens
agctcttcggtttctgagca

SEQ ID NO: 909274 - DNA, 16 bp, Homo sapiens
agctcttctccccagg

SEQ ID NO: 909275 - DNA, 20 bp, Homo sapiens
agctcttctccccaggtgtg

SEQ ID NO: 909276 - DNA, 17 bp, Homo sapiens
agctcttctgggcagag

SEQ ID NO: 909277 - DNA, 20 bp, Homo sapiens
agctcttgccccactccctg

SEQ ID NO: 909278 - DNA, 14 bp, Homo sapiens
agctcttgcccttc

SEQ ID NO: 909279 - DNA, 15 bp, Homo sapiens
agctcttgcccttcc

SEQ ID NO: 909280 - DNA, 18 bp, Homo sapiens
agctcttgcccttccctg

SEQ ID NO: 909281 - DNA, 21 bp, Homo sapiens
agctcttgcccttccctgtcc

SEQ ID NO: 909282 - DNA, 12 bp, Homo sapiens
agctcttggaag

SEQ ID NO: 909283 - DNA, 20 bp, Homo sapiens
agctcttggacaacagctct

SEQ ID NO: 909284 - DNA, 22 bp, Homo sapiens
agctcttttttgtttgtttctt

SEQ ID NO: 909285 - DNA, 21 bp, Homo sapiens
agctgaaaaatcacatcctgg

SEQ ID NO: 909286 - DNA, 14 bp, Homo sapiens
agctgaaaactaat

SEQ ID NO: 909287 - DNA, 19 bp, Homo sapiens
agctgaaaactaatgtact

SEQ ID NO: 909288 - DNA, 20 bp, Homo sapiens
agctgaaaactaatgtactg

SEQ ID NO: 909289 - DNA, 13 bp, Homo sapiens
agctgaaaagcat

SEQ ID NO: 909290 - DNA, 13 bp, Homo sapiens
agctgaaatttta

SEQ ID NO: 909291 - DNA, 15 bp, Homo sapiens
agctgaaccacagaa

SEQ ID NO: 909292 - DNA, 19 bp, Homo sapiens
agctgaacccattttgagt

SEQ ID NO: 909293 - DNA, 15 bp, Homo sapiens
agctgaacctgggta

SEQ ID NO: 909294 - DNA, 15 bp, Homo sapiens
agctgaagaaaaaat

SEQ ID NO: 909295 - DNA, 22 bp, Homo sapiens
agctgaagaggttgaagctaaa

SEQ ID NO: 909296 - DNA, 22 bp, Homo sapiens
agctgaagctacaggttgtgaa

SEQ ID NO: 909297 - DNA, 22 bp, Homo sapiens
agctgaatgcctcctgtgggga

SEQ ID NO: 909298 - DNA, 22 bp, Homo sapiens
agctgaatgtttgtttcagtgc

SEQ ID NO: 909299 - DNA, 14 bp, Homo sapiens
agctgaattatatt

SEQ ID NO: 909300 - DNA, 12 bp, Homo sapiens
agctgacatgga

SEQ ID NO: 909301 - DNA, 21 bp, Homo sapiens
agctgacccagagtggagtct

SEQ ID NO: 909302 - DNA, 17 bp, Homo sapiens
agctgaccccgagaagt

SEQ ID NO: 909303 - DNA, 12 bp, Homo sapiens
agctgacctctg

SEQ ID NO: 909304 - DNA, 16 bp, Homo sapiens
agctgactgttggctc

SEQ ID NO: 909305 - DNA, 21 bp, Homo sapiens
agctgactgttggctctctga

SEQ ID NO: 909306 - DNA, 20 bp, Homo sapiens
agctgactgttttttttgca

SEQ ID NO: 909307 - DNA, 18 bp, Homo sapiens
agctgacttggcacttaa

SEQ ID NO: 909308 - DNA, 20 bp, Homo sapiens
agctgacttggttctgaagc

SEQ ID NO: 909309 - DNA, 15 bp, Homo sapiens
agctgacttttctgt

SEQ ID NO: 909310 - DNA, 17 bp, Homo sapiens
agctgagaagaggagga

SEQ ID NO: 909311 - DNA, 19 bp, Homo sapiens
agctgagaagaggaggagg

SEQ ID NO: 909312 - DNA, 20 bp, Homo sapiens
agctgagaagaggaggaggt

SEQ ID NO: 909313 - DNA, 11 bp, Homo sapiens
agctgagacca

SEQ ID NO: 909314 - DNA, 17 bp, Homo sapiens
agctgagagaccctggc

SEQ ID NO: 909315 - DNA, 19 bp, Homo sapiens
agctgagagaccctggcct

SEQ ID NO: 909316 - DNA, 21 bp, Homo sapiens
agctgagagaccctggcctca

SEQ ID NO: 909317 - DNA, 14 bp, Homo sapiens
agctgagagccctg

SEQ ID NO: 909318 - DNA, 16 bp, Homo sapiens
agctgagagccctgct

SEQ ID NO: 909319 - DNA, 16 bp, Homo sapiens
agctgagagtctgaaa

SEQ ID NO: 909320 - DNA, 23 bp, Homo sapiens
agctgagagtctgaaagacagaa

SEQ ID NO: 909321 - DNA, 20 bp, Homo sapiens
agctgagcacccagctctgt

SEQ ID NO: 909322 - DNA, 12 bp, Homo sapiens
agctgagcagcc

SEQ ID NO: 909323 - DNA, 16 bp, Homo sapiens
agctgagcagcctctg

SEQ ID NO: 909324 - DNA, 22 bp, Homo sapiens
agctgagcaggacagccagcag

SEQ ID NO: 909325 - DNA, 11 bp, Homo sapiens
agctgagccac

SEQ ID NO: 909326 - DNA, 15 bp, Homo sapiens
agctgagccagttgt

SEQ ID NO: 909327 - DNA, 15 bp, Homo sapiens
agctgagcgccagga

SEQ ID NO: 909328 - DNA, 17 bp, Homo sapiens
agctgagcgccaggatg

SEQ ID NO: 909329 - DNA, 18 bp, Homo sapiens
agctgagctggaaggggc

SEQ ID NO: 909330 - DNA, 19 bp, Homo sapiens
agctgagctggaaggggcc

SEQ ID NO: 909331 - DNA, 19 bp, Homo sapiens
agctgaggaacaggttcct

SEQ ID NO: 909332 - DNA, 22 bp, Homo sapiens
agctgaggccacactcagcaca

SEQ ID NO: 909333 - DNA, 12 bp, Homo sapiens
agctgagggagg

SEQ ID NO: 909334 - DNA, 13 bp, Homo sapiens
agctgagggaggg

SEQ ID NO: 909335 - DNA, 14 bp, Homo sapiens
agctgagggaggga

SEQ ID NO: 909336 - DNA, 22 bp, Homo sapiens
agctgagggccctgtggagtcc

SEQ ID NO: 909337 - DNA, 22 bp, Homo sapiens
agctgaggggggccgtgcccag

SEQ ID NO: 909338 - DNA, 23 bp, Homo sapiens
agctgaggtctcttgagggagct

SEQ ID NO: 909339 - DNA, 13 bp, Homo sapiens
agctgagtcacct

SEQ ID NO: 909340 - DNA, 14 bp, Homo sapiens
agctagccagccaa

SEQ ID NO: 909341 - DNA, 16 bp, Homo sapiens
agctagcgctgccgca

SEQ ID NO: 909342 - DNA, 15 bp, Homo sapiens
agctagctagcgcac

SEQ ID NO: 909343 - DNA, 18 bp, Homo sapiens
agctagctagcgcaccgc

SEQ ID NO: 909344 - DNA, 13 bp, Homo sapiens
agctagctctttg

SEQ ID NO: 909345 - DNA, 23 bp, Homo sapiens
agctagctctttggtctattttc

SEQ ID NO: 909346 - DNA, 12 bp, Homo sapiens
agctagctgcca

SEQ ID NO: 909347 - DNA, 18 bp, Homo sapiens
agctaggaagagcaggac

SEQ ID NO: 909348 - DNA, 12 bp, Homo sapiens
agctaggaatga

SEQ ID NO: 909349 - DNA, 15 bp, Homo sapiens
agctaggactgagga

SEQ ID NO: 909350 - DNA, 13 bp, Homo sapiens
agctagggctgct

SEQ ID NO: 909351 - DNA, 14 bp, Homo sapiens
agctagggctgctg

SEQ ID NO: 909352 - DNA, 20 bp, Homo sapiens
agctagggctgctgcttctg

SEQ ID NO: 909353 - DNA, 24 bp, Homo sapiens
agctagggctgctgcttctgctcc

SEQ ID NO: 909354 - DNA, 14 bp, Homo sapiens
agctaggtgacata

SEQ ID NO: 909355 - DNA, 16 bp, Homo sapiens
agctagtagcaatgtg

SEQ ID NO: 909356 - DNA, 19 bp, Homo sapiens
agctagtcttttgcttttg

SEQ ID NO: 909357 - DNA, 18 bp, Homo sapiens
agctagtgccaaataatt

SEQ ID NO: 909358 - DNA, 16 bp, Homo sapiens
agctagtgtacctcct

SEQ ID NO: 909359 - DNA, 22 bp, Homo sapiens
agctagtgtacctcctctcagt

SEQ ID NO: 909360 - DNA, 14 bp, Homo sapiens
agctagtgtcttat

SEQ ID NO: 909361 - DNA, 12 bp, Homo sapiens
agctagtttgct

SEQ ID NO: 909362 - DNA, 17 bp, Homo sapiens
agctagtttgctttttg

SEQ ID NO: 909363 - DNA, 22 bp, Homo sapiens
agctagttttattcttggtttt

SEQ ID NO: 909364 - DNA, 22 bp, Homo sapiens
agctataaagcagtatttttct

SEQ ID NO: 909365 - DNA, 17 bp, Homo sapiens
agctataaagtatatat

SEQ ID NO: 909366 - DNA, 11 bp, Homo sapiens
agctatataag

SEQ ID NO: 909367 - DNA, 17 bp, Homo sapiens
agctatataagacaaga

SEQ ID NO: 909368 - DNA, 15 bp, Homo sapiens
agctatatccatgta

SEQ ID NO: 909369 - DNA, 22 bp, Homo sapiens
agctatatccatgtactgtagt

SEQ ID NO: 909370 - DNA, 20 bp, Homo sapiens
agctatatcctgatgctgga

SEQ ID NO: 909371 - DNA, 23 bp, Homo sapiens
agctatcacgttgaaccacgtga

SEQ ID NO: 909372 - DNA, 17 bp, Homo sapiens
agctatcgaacttcaca

SEQ ID NO: 909373 - DNA, 18 bp, Homo sapiens
agctatcttcatgtaaat

SEQ ID NO: 909374 - DNA, 18 bp, Homo sapiens
agctatgcgcaatgtggc

SEQ ID NO: 909375 - DNA, 20 bp, Homo sapiens
agctatgctgtatctgtgct

SEQ ID NO: 909376 - DNA, 16 bp, Homo sapiens
agctatggcccagaaa

SEQ ID NO: 909377 - DNA, 16 bp, Homo sapiens
agctatgttccctcca

SEQ ID NO: 909378 - DNA, 18 bp, Homo sapiens
agctatgttccctccagc

SEQ ID NO: 909379 - DNA, 20 bp, Homo sapiens
agctattactgtctggtttt

SEQ ID NO: 909380 - DNA, 18 bp, Homo sapiens
agctattagcggctcctc

SEQ ID NO: 909381 - DNA, 19 bp, Homo sapiens
agctattagcggctcctcg

SEQ ID NO: 909382 - DNA, 15 bp, Homo sapiens
agctattcacctcag

SEQ ID NO: 909383 - DNA, 13 bp, Homo sapiens
agctattcctttc

SEQ ID NO: 909384 - DNA, 16 bp, Homo sapiens
agctattcctttccct

SEQ ID NO: 909385 - DNA, 22 bp, Homo sapiens
agctatttaatatctggcactg

SEQ ID NO: 909386 - DNA, 17 bp, Homo sapiens
agctatttcatctattt

SEQ ID NO: 909387 - DNA, 15 bp, Homo sapiens
agctattttaagcca

SEQ ID NO: 909388 - DNA, 17 bp, Homo sapiens
agctattttaagccatc

SEQ ID NO: 909389 - DNA, 13 bp, Homo sapiens
agctattttcctt

SEQ ID NO: 909390 - DNA, 21 bp, Homo sapiens
agctattttccttgcttttct

SEQ ID NO: 909391 - DNA, 20 bp, Homo sapiens
agctcaagcaggaagttcaa

SEQ ID NO: 909392 - DNA, 21 bp, Homo sapiens
agctcaagcccttggggaggg

SEQ ID NO: 909393 - DNA, 14 bp, Homo sapiens
agctcaagtttaaa

SEQ ID NO: 909394 - DNA, 14 bp, Homo sapiens
agctcaatggactg

SEQ ID NO: 909395 - DNA, 18 bp, Homo sapiens
agctcaattgttaatgtg

SEQ ID NO: 909396 - DNA, 18 bp, Homo sapiens
agctcacagtgctgtgtg

SEQ ID NO: 909397 - DNA, 20 bp, Homo sapiens
agctcacatccagccttgga

SEQ ID NO: 909398 - DNA, 16 bp, Homo sapiens
agctcacatgggactg

SEQ ID NO: 909399 - DNA, 14 bp, Homo sapiens
agctcacccctggg

SEQ ID NO: 909400 - DNA, 18 bp, Homo sapiens
agctcacccctgggcagg

SEQ ID NO: 909401 - DNA, 20 bp, Homo sapiens
agctcacccctgggcaggcg

SEQ ID NO: 909402 - DNA, 14 bp, Homo sapiens
agctcaccctgccc

SEQ ID NO: 909403 - DNA, 17 bp, Homo sapiens
agctcaccctgcccgct

SEQ ID NO: 909404 - DNA, 19 bp, Homo sapiens
agctcaccctgcccgctcc

SEQ ID NO: 909405 - DNA, 20 bp, Homo sapiens
agctcaccctgcccgctccc

SEQ ID NO: 909406 - DNA, 20 bp, Homo sapiens
agctcacgtcctgagaaagc

SEQ ID NO: 909407 - DNA, 17 bp, Homo sapiens
agctcactgcagcctca

SEQ ID NO: 909408 - DNA, 13 bp, Homo sapiens
agctcactgctga

SEQ ID NO: 909409 - DNA, 13 bp, Homo sapiens
agctcacttctgg

SEQ ID NO: 909410 - DNA, 17 bp, Homo sapiens
agctcagaacccagggc

SEQ ID NO: 909411 - DNA, 22 bp, Homo sapiens
agctcagaggcgcactgtgacc

SEQ ID NO: 909412 - DNA, 14 bp, Homo sapiens
agctcagcccaccc

SEQ ID NO: 909413 - DNA, 16 bp, Homo sapiens
agctcagcccaccccc

SEQ ID NO: 909414 - DNA, 17 bp, Homo sapiens
agctcagccctggcctg

SEQ ID NO: 909415 - DNA, 21 bp, Homo sapiens
agctcagctactgatttttgt

SEQ ID NO: 909416 - DNA, 17 bp, Homo sapiens
agctcagcttcttccta

SEQ ID NO: 909417 - DNA, 16 bp, Homo sapiens
agctcaggaagaagag

SEQ ID NO: 909418 - DNA, 14 bp, Homo sapiens
agctcaggcagctc

SEQ ID NO: 909419 - DNA, 16 bp, Homo sapiens
agctcaggggacactg

SEQ ID NO: 909420 - DNA, 18 bp, Homo sapiens
agctcaggggacactggc

SEQ ID NO: 909421 - DNA, 19 bp, Homo sapiens
agctcaggggacactggcc

SEQ ID NO: 909422 - DNA, 23 bp, Homo sapiens
agctcaggggacactggccccac

SEQ ID NO: 909423 - DNA, 13 bp, Homo sapiens
agctcaggtgcct

SEQ ID NO: 909424 - DNA, 22 bp, Homo sapiens
agctcagtcatcaaagcagaag

SEQ ID NO: 909425 - DNA, 23 bp, Homo sapiens
agctcagttctagtctctctggg

SEQ ID NO: 909426 - DNA, 21 bp, Homo sapiens
agctcatacaaaataaatggt

SEQ ID NO: 909427 - DNA, 23 bp, Homo sapiens
agctcatagaattttgagtattc

SEQ ID NO: 909428 - DNA, 20 bp, Homo sapiens
agctcatcccccctgctgcc

SEQ ID NO: 909429 - DNA, 16 bp, Homo sapiens
agctcatctgcaaaag

SEQ ID NO: 909430 - DNA, 22 bp, Homo sapiens
agctcatgtaggtgagcctggg

SEQ ID NO: 909431 - DNA, 19 bp, Homo sapiens
agctcattaaactttttta

SEQ ID NO: 909432 - DNA, 20 bp, Homo sapiens
agctcattctccttgtgtta

SEQ ID NO: 909433 - DNA, 21 bp, Homo sapiens
agctcattctccttgtgttac

SEQ ID NO: 909434 - DNA, 20 bp, Homo sapiens
agctccacacattccagcca

SEQ ID NO: 909435 - DNA, 23 bp, Homo sapiens
agctccacacattccagccaggc

SEQ ID NO: 909436 - DNA, 12 bp, Homo sapiens
agctccacctct

SEQ ID NO: 909437 - DNA, 23 bp, Homo sapiens
agctccacggtgcgtggctgtgg

SEQ ID NO: 909438 - DNA, 11 bp, Homo sapiens
agctccactct

SEQ ID NO: 909439 - DNA, 12 bp, Homo sapiens
agctccactctg

SEQ ID NO: 909440 - DNA, 16 bp, Homo sapiens
agctccactctgcttc

SEQ ID NO: 909441 - DNA, 19 bp, Homo sapiens
agctccactctgcttctct

SEQ ID NO: 909442 - DNA, 21 bp, Homo sapiens
agctccactgtcaccctccac

SEQ ID NO: 909443 - DNA, 19 bp, Homo sapiens
agctccagaataccttctt

SEQ ID NO: 909444 - DNA, 16 bp, Homo sapiens
agctccagacccccag

SEQ ID NO: 909445 - DNA, 19 bp, Homo sapiens
agctccagacccccagcaa

SEQ ID NO: 909446 - DNA, 12 bp, Homo sapiens
agctccaggaca

SEQ ID NO: 909447 - DNA, 12 bp, Homo sapiens
agctccaggccc

SEQ ID NO: 909448 - DNA, 20 bp, Homo sapiens
agctccaggggcccttggga

SEQ ID NO: 909449 - DNA, 20 bp, Homo sapiens
agctccagtgccgctcctgc

SEQ ID NO: 909450 - DNA, 15 bp, Homo sapiens
agctccatctccact

SEQ ID NO: 909451 - DNA, 15 bp, Homo sapiens
agctccatgtgcata

SEQ ID NO: 909452 - DNA, 20 bp, Homo sapiens
agctcccaacgagcctcctc

SEQ ID NO: 909453 - DNA, 22 bp, Homo sapiens
agctcccacccacctgtagggc

SEQ ID NO: 909454 - DNA, 15 bp, Homo sapiens
agctcccaccccacc

SEQ ID NO: 909455 - DNA, 17 bp, Homo sapiens
agctcccaccccacccc

SEQ ID NO: 909456 - DNA, 14 bp, Homo sapiens
agctcccacctccc

SEQ ID NO: 909457 - DNA, 14 bp, Homo sapiens
agctcccaggaaca

SEQ ID NO: 909458 - DNA, 18 bp, Homo sapiens
agctccccccgcccaccc

SEQ ID NO: 909459 - DNA, 19 bp, Homo sapiens
agctccccccgcccaccca

SEQ ID NO: 909460 - DNA, 14 bp, Homo sapiens
agctcccctccaca

SEQ ID NO: 909461 - DNA, 16 bp, Homo sapiens
agctcccctccacagc

SEQ ID NO: 909462 - DNA, 20 bp, Homo sapiens
agctcccctccacagctgca

SEQ ID NO: 909463 - DNA, 22 bp, Homo sapiens
agctcccgaggaagcacagctt

SEQ ID NO: 909464 - DNA, 22 bp, Homo sapiens
aacagttggtaacttttgtgaa

SEQ ID NO: 909465 - DNA, 14 bp, Homo sapiens
aacagtttgcctgc

SEQ ID NO: 909466 - DNA, 13 bp, Homo sapiens
aacagttttccat

SEQ ID NO: 909467 - DNA, 16 bp, Homo sapiens
aacagttttccatgaa

SEQ ID NO: 909468 - DNA, 19 bp, Homo sapiens
aacagttttccatgaaaac

SEQ ID NO: 909469 - DNA, 13 bp, Homo sapiens
aacataaaaagca

SEQ ID NO: 909470 - DNA, 22 bp, Homo sapiens
aacataaaaaggacatcagcaa

SEQ ID NO: 909471 - DNA, 21 bp, Homo sapiens
aacataaaacaaaaccaagcc

SEQ ID NO: 909472 - DNA, 21 bp, Homo sapiens
aacataaccattacagggagc

SEQ ID NO: 909473 - DNA, 14 bp, Homo sapiens
aacataactgcttc

SEQ ID NO: 909474 - DNA, 14 bp, Homo sapiens
aacataatctagtt

SEQ ID NO: 909475 - DNA, 20 bp, Homo sapiens
aacataatcttctgccttct

SEQ ID NO: 909476 - DNA, 19 bp, Homo sapiens
aacataatggttgtgaaat

SEQ ID NO: 909477 - DNA, 22 bp, Homo sapiens
aacataatggttgtgaaatgta

SEQ ID NO: 909478 - DNA, 20 bp, Homo sapiens
aacatacttcaaaaataatg

SEQ ID NO: 909479 - DNA, 16 bp, Homo sapiens
aacatagacagaagaa

SEQ ID NO: 909480 - DNA, 19 bp, Homo sapiens
aacatagacagaagaaaca

SEQ ID NO: 909481 - DNA, 21 bp, Homo sapiens
aacatatcatggtaatgacag

SEQ ID NO: 909482 - DNA, 13 bp, Homo sapiens
aacatatcatttg

SEQ ID NO: 909483 - DNA, 19 bp, Homo sapiens
aacatatccaagtttgaat

SEQ ID NO: 909484 - DNA, 14 bp, Homo sapiens
aacatatctctgcc

SEQ ID NO: 909485 - DNA, 15 bp, Homo sapiens
aacatatctctgccg

SEQ ID NO: 909486 - DNA, 21 bp, Homo sapiens
aacatatctctgccgtctctc

SEQ ID NO: 909487 - DNA, 17 bp, Homo sapiens
aacatatgaaaatacaa

SEQ ID NO: 909488 - DNA, 14 bp, Homo sapiens
aacatatggtctcc

SEQ ID NO: 909489 - DNA, 22 bp, Homo sapiens
aacatatgtattaagccaaaca

SEQ ID NO: 909490 - DNA, 18 bp, Homo sapiens
aacatattcaatgcaagt

SEQ ID NO: 909491 - DNA, 22 bp, Homo sapiens
aacatattcaatgcaagtaaga

SEQ ID NO: 909492 - DNA, 17 bp, Homo sapiens
aacatatttcattttaa

SEQ ID NO: 909493 - DNA, 18 bp, Homo sapiens
aacatatttcattttaac

SEQ ID NO: 909494 - DNA, 13 bp, Homo sapiens
aacatatttttat

SEQ ID NO: 909495 - DNA, 18 bp, Homo sapiens
aacatatttttatacttt

SEQ ID NO: 909496 - DNA, 19 bp, Homo sapiens
aacatcaaaacttaagatg

SEQ ID NO: 909497 - DNA, 19 bp, Homo sapiens
aacatcaaataaatttctg

SEQ ID NO: 909498 - DNA, 14 bp, Homo sapiens
aacatcaacatctt

SEQ ID NO: 909499 - DNA, 17 bp, Homo sapiens
aacatcaagataccttt

SEQ ID NO: 909500 - DNA, 13 bp, Homo sapiens
aacatcaatgttc

SEQ ID NO: 909501 - DNA, 18 bp, Homo sapiens
aacatcaatgttcattgt

SEQ ID NO: 909502 - DNA, 18 bp, Homo sapiens
aacatcacacctgcccta

SEQ ID NO: 909503 - DNA, 13 bp, Homo sapiens
aacatcacagccc

SEQ ID NO: 909504 - DNA, 16 bp, Homo sapiens
aacatcagtgtctgtt

SEQ ID NO: 909505 - DNA, 19 bp, Homo sapiens
aacatcagttactctgaag

SEQ ID NO: 909506 - DNA, 14 bp, Homo sapiens
aacatcataattac

SEQ ID NO: 909507 - DNA, 20 bp, Homo sapiens
aacatcataattacattcct

SEQ ID NO: 909508 - DNA, 21 bp, Homo sapiens
aacatcataattacattccta

SEQ ID NO: 909509 - DNA, 22 bp, Homo sapiens
aacatcatgaatttattgcaca

SEQ ID NO: 909510 - DNA, 21 bp, Homo sapiens
aacatccaaaaaaagggaagg

SEQ ID NO: 909511 - DNA, 16 bp, Homo sapiens
aacatccaaccttccc

SEQ ID NO: 909512 - DNA, 20 bp, Homo sapiens
aacatccacttaagttcttt

SEQ ID NO: 909513 - DNA, 15 bp, Homo sapiens
aacatcccaaacttt

SEQ ID NO: 909514 - DNA, 16 bp, Homo sapiens
aacatcccaaacttta

SEQ ID NO: 909515 - DNA, 23 bp, Homo sapiens
aacatcccaaactttaaaatgcg

SEQ ID NO: 909516 - DNA, 17 bp, Homo sapiens
aacattttacccacaca

SEQ ID NO: 909517 - DNA, 15 bp, Homo sapiens
aacattttatactgt

SEQ ID NO: 909518 - DNA, 19 bp, Homo sapiens
aacattttatactgtacat

SEQ ID NO: 909519 - DNA, 21 bp, Homo sapiens
aaccaaaaaaaaaaaaaatca

SEQ ID NO: 909520 - DNA, 12 bp, Homo sapiens
aaccaaaaagag

SEQ ID NO: 909521 - DNA, 13 bp, Homo sapiens
aaccaaaacttcc

SEQ ID NO: 909522 - DNA, 21 bp, Homo sapiens
aaccaaaagaacaagaatttc

SEQ ID NO: 909523 - DNA, 20 bp, Homo sapiens
aaccaaacttgttcatttag

SEQ ID NO: 909524 - DNA, 13 bp, Homo sapiens
aaccaaagctgcc

SEQ ID NO: 909525 - DNA, 21 bp, Homo sapiens
aaccaaagctgcctgtgccat

SEQ ID NO: 909526 - DNA, 15 bp, Homo sapiens
aaccaaagtctgccg

SEQ ID NO: 909527 - DNA, 22 bp, Homo sapiens
aaccaaagtctgccgcccacct

SEQ ID NO: 909528 - DNA, 15 bp, Homo sapiens
aaccaaatacctcaa

SEQ ID NO: 909529 - DNA, 15 bp, Homo sapiens
aaccaaatctggaag

SEQ ID NO: 909530 - DNA, 17 bp, Homo sapiens
aaccaacattaaaactc

SEQ ID NO: 909531 - DNA, 17 bp, Homo sapiens
aaccaactacaaccaag

SEQ ID NO: 909532 - DNA, 17 bp, Homo sapiens
aaccaactatttttgag

SEQ ID NO: 909533 - DNA, 17 bp, Homo sapiens
aaccaactgccccaggg

SEQ ID NO: 909534 - DNA, 14 bp, Homo sapiens
aaccaagagctttt

SEQ ID NO: 909535 - DNA, 10 bp, Homo sapiens
aaccaagagg

SEQ ID NO: 909536 - DNA, 18 bp, Homo sapiens
aaccaagaggatttcttc

SEQ ID NO: 909537 - DNA, 13 bp, Homo sapiens
aaccaagaggctg

SEQ ID NO: 909538 - DNA, 12 bp, Homo sapiens
aaccaagagtta

SEQ ID NO: 909539 - DNA, 13 bp, Homo sapiens
aaccaagcagctt

SEQ ID NO: 909540 - DNA, 18 bp, Homo sapiens
aaccaagccgtggcttcc

SEQ ID NO: 909541 - DNA, 19 bp, Homo sapiens
aaccaagctgagtttccta

SEQ ID NO: 909542 - DNA, 19 bp, Homo sapiens
aaccaaggaaggagcccct

SEQ ID NO: 909543 - DNA, 15 bp, Homo sapiens
aaccaagtcaggcca

SEQ ID NO: 909544 - DNA, 16 bp, Homo sapiens
aaccaagtcaggccag

SEQ ID NO: 909545 - DNA, 20 bp, Homo sapiens
aaccaagtcatgtgcatttc

SEQ ID NO: 909546 - DNA, 20 bp, Homo sapiens
aaccaagtgatcaaactaca

SEQ ID NO: 909547 - DNA, 15 bp, Homo sapiens
aaccaagtgggctgg

SEQ ID NO: 909548 - DNA, 16 bp, Homo sapiens
aaccaagttatttttc

SEQ ID NO: 909549 - DNA, 16 bp, Homo sapiens
aaccaatacagaattg

SEQ ID NO: 909550 - DNA, 18 bp, Homo sapiens
aaccaatcccgtgaaaga

SEQ ID NO: 909551 - DNA, 15 bp, Homo sapiens
aaccaatgctgatga

SEQ ID NO: 909552 - DNA, 16 bp, Homo sapiens
aaccacaatgtttctt

SEQ ID NO: 909553 - DNA, 15 bp, Homo sapiens
aaccacacaaagaca

SEQ ID NO: 909554 - DNA, 18 bp, Homo sapiens
aaccacacaattttttct

SEQ ID NO: 909555 - DNA, 21 bp, Homo sapiens
aaccacaccacatctaagcct

SEQ ID NO: 909556 - DNA, 21 bp, Homo sapiens
aaccacactcaccccagcctc

SEQ ID NO: 909557 - DNA, 20 bp, Homo sapiens
aaccacagaaatcacagtca

SEQ ID NO: 909558 - DNA, 12 bp, Homo sapiens
aaccacagagaa

SEQ ID NO: 909559 - DNA, 12 bp, Homo sapiens
aaccacagctgg

SEQ ID NO: 909560 - DNA, 18 bp, Homo sapiens
aaccacatataacactta

SEQ ID NO: 909561 - DNA, 13 bp, Homo sapiens
aaccacatgggct

SEQ ID NO: 909562 - DNA, 15 bp, Homo sapiens
aaccacatgggctgg

SEQ ID NO: 909563 - DNA, 16 bp, Homo sapiens
aaccacatgggctggg

SEQ ID NO: 909564 - DNA, 16 bp, Homo sapiens
aaccacatgtcccaga

SEQ ID NO: 909565 - DNA, 16 bp, Homo sapiens
aaccacattgaagaat

SEQ ID NO: 909566 - DNA, 17 bp, Homo sapiens
aaccaccctctggggac

SEQ ID NO: 909567 - DNA, 19 bp, Homo sapiens
aaccaccgcatatgcatgc

SEQ ID NO: 909568 - DNA, 20 bp, Homo sapiens
aaccaccgctccccagccca

SEQ ID NO: 909569 - DNA, 19 bp, Homo sapiens
aaccacctcagaaaggatt

SEQ ID NO: 909570 - DNA, 18 bp, Homo sapiens
aaccacgaggctgccccc

SEQ ID NO: 909571 - DNA, 19 bp, Homo sapiens
aaccacgaggctgccccca

SEQ ID NO: 909572 - DNA, 22 bp, Homo sapiens
aaccacggaggatgatgccagt

SEQ ID NO: 909573 - DNA, 15 bp, Homo sapiens
aaccacgtgaaactg

SEQ ID NO: 909574 - DNA, 14 bp, Homo sapiens
aaccactctacaga

SEQ ID NO: 909575 - DNA, 16 bp, Homo sapiens
aaccactgaaaaaata

SEQ ID NO: 909576 - DNA, 19 bp, Homo sapiens
aaccactgaaaaaatatat

SEQ ID NO: 909577 - DNA, 18 bp, Homo sapiens
aaccactggtcccagagc

SEQ ID NO: 909578 - DNA, 21 bp, Homo sapiens
aaccactgtgaacatttttta

SEQ ID NO: 909579 - DNA, 13 bp, Homo sapiens
aaccacttaaaaa

SEQ ID NO: 909580 - DNA, 19 bp, Homo sapiens
aaccacttctccatgctgc

SEQ ID NO: 909581 - DNA, 17 bp, Homo sapiens
aaccacttctctgctgc

SEQ ID NO: 909582 - DNA, 13 bp, Homo sapiens
aaccacttgcctg

SEQ ID NO: 909583 - DNA, 15 bp, Homo sapiens
aaccacttgcctggg

SEQ ID NO: 909584 - DNA, 17 bp, Homo sapiens
aaccacttgcctggggc

SEQ ID NO: 909585 - DNA, 19 bp, Homo sapiens
aaccagaaacacccctctg

SEQ ID NO: 909586 - DNA, 18 bp, Homo sapiens
aaccagaacgtggtttgc

SEQ ID NO: 909587 - DNA, 18 bp, Homo sapiens
aaccagaataaagttctg

SEQ ID NO: 909588 - DNA, 21 bp, Homo sapiens
aaccagactttgaaaaattgt

SEQ ID NO: 909589 - DNA, 18 bp, Homo sapiens
aaccagagccatggactc

SEQ ID NO: 909590 - DNA, 23 bp, Homo sapiens
aaccagagggcatgctgaatgcc

SEQ ID NO: 909591 - DNA, 22 bp, Homo sapiens
aaccagatggaacactggaaca

SEQ ID NO: 909592 - DNA, 12 bp, Homo sapiens
aaccagccaggc

SEQ ID NO: 909593 - DNA, 13 bp, Homo sapiens
aaccagcccagcc

SEQ ID NO: 909594 - DNA, 16 bp, Homo sapiens
aaccagcccagcctgc

SEQ ID NO: 909595 - DNA, 19 bp, Homo sapiens
agcttaaaaaaattactgt

SEQ ID NO: 909596 - DNA, 14 bp, Homo sapiens
agcttaaaactttg

SEQ ID NO: 909597 - DNA, 20 bp, Homo sapiens
agcttaaaatacaagactgc

SEQ ID NO: 909598 - DNA, 23 bp, Homo sapiens
agcttaaacccatacaatgtatg

SEQ ID NO: 909599 - DNA, 16 bp, Homo sapiens
agcttaaataggaaag

SEQ ID NO: 909600 - DNA, 22 bp, Homo sapiens
agcttaacattgacttcttggt

SEQ ID NO: 909601 - DNA, 15 bp, Homo sapiens
agcttaactaatttg

SEQ ID NO: 909602 - DNA, 17 bp, Homo sapiens
agcttaagagtccaact

SEQ ID NO: 909603 - DNA, 22 bp, Homo sapiens
agcttaagagtccaactcactt

SEQ ID NO: 909604 - DNA, 21 bp, Homo sapiens
agcttaagccactgcctctcc

SEQ ID NO: 909605 - DNA, 13 bp, Homo sapiens
agcttaataaatt

SEQ ID NO: 909606 - DNA, 21 bp, Homo sapiens
agcttaatagccctccccctc

SEQ ID NO: 909607 - DNA, 12 bp, Homo sapiens
agcttaatagct

SEQ ID NO: 909608 - DNA, 22 bp, Homo sapiens
agcttaatggctgataatttta

SEQ ID NO: 909609 - DNA, 21 bp, Homo sapiens
agcttaattctccttcccaga

SEQ ID NO: 909610 - DNA, 14 bp, Homo sapiens
agcttacaggaagc

SEQ ID NO: 909611 - DNA, 20 bp, Homo sapiens
agcttaccagaagcttccat

SEQ ID NO: 909612 - DNA, 15 bp, Homo sapiens
agcttacccaagctg

SEQ ID NO: 909613 - DNA, 13 bp, Homo sapiens
agcttactacagt

SEQ ID NO: 909614 - DNA, 21 bp, Homo sapiens
agcttactctgtccatttatc

SEQ ID NO: 909615 - DNA, 10 bp, Homo sapiens
agcttagaac

SEQ ID NO: 909616 - DNA, 18 bp, Homo sapiens
agcttagacctcagcctg

SEQ ID NO: 909617 - DNA, 15 bp, Homo sapiens
agcttagactaaggc

SEQ ID NO: 909618 - DNA, 13 bp, Homo sapiens
agcttagagttct

SEQ ID NO: 909619 - DNA, 14 bp, Homo sapiens
agcttagagttctt

SEQ ID NO: 909620 - DNA, 14 bp, Homo sapiens
agcttagggccctg

SEQ ID NO: 909621 - DNA, 16 bp, Homo sapiens
agcttagggccctgga

SEQ ID NO: 909622 - DNA, 17 bp, Homo sapiens
agcttagggccctggag

SEQ ID NO: 909623 - DNA, 15 bp, Homo sapiens
agcttataatgggct

SEQ ID NO: 909624 - DNA, 20 bp, Homo sapiens
agcttatacgaaataattgt

SEQ ID NO: 909625 - DNA, 21 bp, Homo sapiens
agcttatacgaaataattgtt

SEQ ID NO: 909626 - DNA, 15 bp, Homo sapiens
agcttatctcagggg

SEQ ID NO: 909627 - DNA, 11 bp, Homo sapiens
agcttatctct

SEQ ID NO: 909628 - DNA, 13 bp, Homo sapiens
agcttatctcttt

SEQ ID NO: 909629 - DNA, 19 bp, Homo sapiens
agcttatctcttttatatt

SEQ ID NO: 909630 - DNA, 23 bp, Homo sapiens
agcttatctcttttatatttgta

SEQ ID NO: 909631 - DNA, 20 bp, Homo sapiens
agcttatgggatccttgtct

SEQ ID NO: 909632 - DNA, 17 bp, Homo sapiens
agcttattacagaaaaa

SEQ ID NO: 909633 - DNA, 22 bp, Homo sapiens
agcttattcatctgtttttctt

SEQ ID NO: 909634 - DNA, 15 bp, Homo sapiens
agcttattgacatca

SEQ ID NO: 909635 - DNA, 17 bp, Homo sapiens
agcttattgatcccaca

SEQ ID NO: 909636 - DNA, 14 bp, Homo sapiens
agcttattggccac

SEQ ID NO: 909637 - DNA, 15 bp, Homo sapiens
agcttattggccact

SEQ ID NO: 909638 - DNA, 20 bp, Homo sapiens
agcttattggccactgggtc

SEQ ID NO: 909639 - DNA, 19 bp, Homo sapiens
agcttcaatataagaagca

SEQ ID NO: 909640 - DNA, 15 bp, Homo sapiens
agcttcaccagagca

SEQ ID NO: 909641 - DNA, 19 bp, Homo sapiens
agcttcagtcattaaatta

SEQ ID NO: 909642 - DNA, 13 bp, Homo sapiens
agcttcagttgtt

SEQ ID NO: 909643 - DNA, 20 bp, Homo sapiens
agcttcatgcctttgtaagt

SEQ ID NO: 909644 - DNA, 21 bp, Homo sapiens
agcttcatgcctttgtaagtt

SEQ ID NO: 909645 - DNA, 22 bp, Homo sapiens
agcttcatgcctttgtaagtta

SEQ ID NO: 909646 - DNA, 18 bp, Homo sapiens
agcttcattatctgagtt

SEQ ID NO: 909647 - DNA, 21 bp, Homo sapiens
agcttcattctccttgttgtt

SEQ ID NO: 909648 - DNA, 19 bp, Homo sapiens
agcttccaaatgtgtcaga

SEQ ID NO: 909649 - DNA, 20 bp, Homo sapiens
agcttccacaaaattagaaa

SEQ ID NO: 909650 - DNA, 23 bp, Homo sapiens
agcttccattccaagcctgacca

SEQ ID NO: 909651 - DNA, 18 bp, Homo sapiens
agcttcctcacacccctg

SEQ ID NO: 909652 - DNA, 15 bp, Homo sapiens
agcttcctgagggct

SEQ ID NO: 909653 - DNA, 13 bp, Homo sapiens
agcttcctggctc

SEQ ID NO: 909654 - DNA, 15 bp, Homo sapiens
agcttcctggctctg

SEQ ID NO: 909655 - DNA, 16 bp, Homo sapiens
agcttcctggctctgg

SEQ ID NO: 909656 - DNA, 13 bp, Homo sapiens
agcttcctgtgcc

SEQ ID NO: 909657 - DNA, 21 bp, Homo sapiens
agcttcctgtgccctcacccc

SEQ ID NO: 909658 - DNA, 21 bp, Homo sapiens
agcttcggagggcccctgcgt

SEQ ID NO: 909659 - DNA, 18 bp, Homo sapiens
agcttcggggcctcctca

SEQ ID NO: 909660 - DNA, 18 bp, Homo sapiens
agcttcggttctccagaa

SEQ ID NO: 909661 - DNA, 23 bp, Homo sapiens
agcttcgtcttgtgtttgctgca

SEQ ID NO: 909662 - DNA, 18 bp, Homo sapiens
agcttctaccatgaacag

SEQ ID NO: 909663 - DNA, 17 bp, Homo sapiens
agcttctatcccaggag

SEQ ID NO: 909664 - DNA, 16 bp, Homo sapiens
agcttctctctccagg

SEQ ID NO: 909665 - DNA, 14 bp, Homo sapiens
agcttctctctccc

SEQ ID NO: 909666 - DNA, 17 bp, Homo sapiens
agcttctctctccctgt

SEQ ID NO: 909667 - DNA, 18 bp, Homo sapiens
agcttctgaggcgctgct

SEQ ID NO: 909668 - DNA, 17 bp, Homo sapiens
agcttctgcttttctgc

SEQ ID NO: 909669 - DNA, 17 bp, Homo sapiens
agcttctggtactctcc

SEQ ID NO: 909670 - DNA, 23 bp, Homo sapiens
agcttctggtactctcctagaga

SEQ ID NO: 909671 - DNA, 12 bp, Homo sapiens
agcttcttcaga

SEQ ID NO: 909672 - DNA, 18 bp, Homo sapiens
agcttcttcagagtgaag

SEQ ID NO: 909673 - DNA, 21 bp, Homo sapiens
agcttcttgcactccttccct

SEQ ID NO: 909674 - DNA, 16 bp, Homo sapiens
agcttcttgggctgag

SEQ ID NO: 909675 - DNA, 22 bp, Homo sapiens
agcttcttgggctgagtgcagc

SEQ ID NO: 909676 - DNA, 23 bp, Homo sapiens
agcttgaaagcagttaaactgat

SEQ ID NO: 909677 - DNA, 14 bp, Homo sapiens
agcttgaacctgct

SEQ ID NO: 909678 - DNA, 16 bp, Homo sapiens
agcttgacctgaggct

SEQ ID NO: 909679 - DNA, 21 bp, Homo sapiens
agcttgagccgggcccctggg

SEQ ID NO: 909680 - DNA, 23 bp, Homo sapiens
agcttgagccgggcccctgggct

SEQ ID NO: 909681 - DNA, 14 bp, Homo sapiens
agcttgaggcaatt

SEQ ID NO: 909682 - DNA, 14 bp, Homo sapiens
agcttgatctgtga

SEQ ID NO: 909683 - DNA, 14 bp, Homo sapiens
agcttgcacagcca

SEQ ID NO: 909684 - DNA, 15 bp, Homo sapiens
agcttgcacagccaa

SEQ ID NO: 909685 - DNA, 18 bp, Homo sapiens
agcttgcaccttttcatg

SEQ ID NO: 909686 - DNA, 18 bp, Homo sapiens
agcttgccacactcttct

SEQ ID NO: 909687 - DNA, 14 bp, Homo sapiens
agcttgccccggcc

SEQ ID NO: 909688 - DNA, 21 bp, Homo sapiens
agcttgctcagatagatctgt

SEQ ID NO: 909689 - DNA, 21 bp, Homo sapiens
agcttgcttgctttctttttt

SEQ ID NO: 909690 - DNA, 18 bp, Homo sapiens
agcttgctttgatttaca

SEQ ID NO: 909691 - DNA, 22 bp, Homo sapiens
agcttgctttgatttacagcaa

SEQ ID NO: 909692 - DNA, 16 bp, Homo sapiens
agcttggagggatgga

SEQ ID NO: 909693 - DNA, 18 bp, Homo sapiens
agcttggattaaatacat

SEQ ID NO: 909694 - DNA, 14 bp, Homo sapiens
agcttggcagccga

SEQ ID NO: 909695 - DNA, 15 bp, Homo sapiens
agcttggcagccgag

SEQ ID NO: 909696 - DNA, 20 bp, Homo sapiens
agcttggcagccgagctcgt

SEQ ID NO: 909697 - DNA, 12 bp, Homo sapiens
agcttggccttg

SEQ ID NO: 909698 - DNA, 18 bp, Homo sapiens
agcttgggactcaggtct

SEQ ID NO: 909699 - DNA, 12 bp, Homo sapiens
agcttgggcagt

SEQ ID NO: 909700 - DNA, 18 bp, Homo sapiens
agcttgggcccagctggg

SEQ ID NO: 909701 - DNA, 20 bp, Homo sapiens
agcttgggcccagctgggct

SEQ ID NO: 909702 - DNA, 18 bp, Homo sapiens
agcttgggcttcttcctc

SEQ ID NO: 909703 - DNA, 18 bp, Homo sapiens
agcttgggtccaccatgc

SEQ ID NO: 909704 - DNA, 19 bp, Homo sapiens
agcttgggtccaccatgca

SEQ ID NO: 909705 - DNA, 18 bp, Homo sapiens
agcttggttctgtgaaca

SEQ ID NO: 909706 - DNA, 21 bp, Homo sapiens
agcttgtatagtgtaaaataa

SEQ ID NO: 909707 - DNA, 22 bp, Homo sapiens
agcttgtctatggtacaaaaat

SEQ ID NO: 909708 - DNA, 17 bp, Homo sapiens
agcttgtggcaagtgaa

SEQ ID NO: 909709 - DNA, 23 bp, Homo sapiens
agcttgtggccccttttactttt

SEQ ID NO: 909710 - DNA, 17 bp, Homo sapiens
agcttgtgtcctgtcct

SEQ ID NO: 909711 - DNA, 22 bp, Homo sapiens
agcttgttgtctccacttgtat

SEQ ID NO: 909712 - DNA, 22 bp, Homo sapiens
agcttgttttgtttcatcctgt

SEQ ID NO: 909713 - DNA, 13 bp, Homo sapiens
agctttaaaagaa

SEQ ID NO: 909714 - DNA, 13 bp, Homo sapiens
agctttaaatcat

SEQ ID NO: 909715 - DNA, 14 bp, Homo sapiens
agctttaaatcatt

SEQ ID NO: 909716 - DNA, 17 bp, Homo sapiens
agctttaaattatgtga

SEQ ID NO: 909717 - DNA, 21 bp, Homo sapiens
agctttaatgatatgcttgta

SEQ ID NO: 909718 - DNA, 19 bp, Homo sapiens
agctttacatattcctttg

SEQ ID NO: 909719 - DNA, 15 bp, Homo sapiens
agctttacatgcaat

SEQ ID NO: 909720 - DNA, 13 bp, Homo sapiens
agctttaccctca

SEQ ID NO: 909721 - DNA, 16 bp, Homo sapiens
agctttactactgtgg

SEQ ID NO: 909722 - DNA, 22 bp, Homo sapiens
agctttactactgtggaaagac

SEQ ID NO: 909723 - DNA, 19 bp, Homo sapiens
agctttactgtttctcaag

SEQ ID NO: 909724 - DNA, 18 bp, Homo sapiens
agctttagacagcagagc

SEQ ID NO: 909725 - DNA, 16 bp, Homo sapiens
agctttagaccctggg

SEQ ID NO: 909726 - DNA, 22 bp, Homo sapiens
agctttaggcagagccataatg

SEQ ID NO: 909727 - DNA, 17 bp, Homo sapiens
agctttatatatggaca

SEQ ID NO: 909728 - DNA, 18 bp, Homo sapiens
agctttatatatggacat

SEQ ID NO: 909729 - DNA, 14 bp, Homo sapiens
agctttatctttgt

SEQ ID NO: 909730 - DNA, 15 bp, Homo sapiens
agctttatctttgtg

SEQ ID NO: 909731 - DNA, 23 bp, Homo sapiens
agctttatctttgtgtaatctaa

SEQ ID NO: 909732 - DNA, 14 bp, Homo sapiens
agctttattcttca

SEQ ID NO: 909733 - DNA, 20 bp, Homo sapiens
agctttatttgcatatttat

SEQ ID NO: 909734 - DNA, 16 bp, Homo sapiens
agctttatttttcttt

SEQ ID NO: 909735 - DNA, 17 bp, Homo sapiens
agctttcaaagaaggaa

SEQ ID NO: 909736 - DNA, 15 bp, Homo sapiens
agctttcaacatgta

SEQ ID NO: 909737 - DNA, 17 bp, Homo sapiens
agctttcagagccagtg

SEQ ID NO: 909738 - DNA, 20 bp, Homo sapiens
agctttccatgttgctgcca

SEQ ID NO: 909739 - DNA, 12 bp, Homo sapiens
agctttccctgc

SEQ ID NO: 909740 - DNA, 13 bp, Homo sapiens
agctttcctgccc

SEQ ID NO: 909741 - DNA, 23 bp, Homo sapiens
agctttccttctccaggaatact

SEQ ID NO: 909742 - DNA, 14 bp, Homo sapiens
agctttctcaatgt

SEQ ID NO: 909743 - DNA, 16 bp, Homo sapiens
agctttctcagggggt

SEQ ID NO: 909744 - DNA, 21 bp, Homo sapiens
agctttctcctcatccatttc

SEQ ID NO: 909745 - DNA, 22 bp, Homo sapiens
agctttctcctcatccatttct

SEQ ID NO: 909746 - DNA, 18 bp, Homo sapiens
agctttctcgcgccctcc

SEQ ID NO: 909747 - DNA, 19 bp, Homo sapiens
agctttctcgcgccctccc

SEQ ID NO: 909748 - DNA, 13 bp, Homo sapiens
agctttctctcag

SEQ ID NO: 909749 - DNA, 22 bp, Homo sapiens
agctttctgaggccctgagcat

SEQ ID NO: 909750 - DNA, 14 bp, Homo sapiens
agctttcttttgta

SEQ ID NO: 909751 - DNA, 12 bp, Homo sapiens
agctttgaaact

SEQ ID NO: 909752 - DNA, 19 bp, Homo sapiens
agctttgactctataagca

SEQ ID NO: 909753 - DNA, 21 bp, Homo sapiens
agctttgaggttgacctgttt

SEQ ID NO: 909754 - DNA, 15 bp, Homo sapiens
agctttgatttttac

SEQ ID NO: 909755 - DNA, 15 bp, Homo sapiens
agctttgcacccctt

SEQ ID NO: 909756 - DNA, 18 bp, Homo sapiens
agctttgcacccctttcc

SEQ ID NO: 909757 - DNA, 17 bp, Homo sapiens
agctttgccagctgctg

SEQ ID NO: 909758 - DNA, 19 bp, Homo sapiens
agctttgccagctgctgct

SEQ ID NO: 909759 - DNA, 20 bp, Homo sapiens
agctttgccagctgctgctg

SEQ ID NO: 909760 - DNA, 10 bp, Homo sapiens
agctttgcta

SEQ ID NO: 909761 - DNA, 13 bp, Homo sapiens
agctttgctattc

SEQ ID NO: 909762 - DNA, 23 bp, Homo sapiens
agctttgctctttggtagaaaag

SEQ ID NO: 909763 - DNA, 13 bp, Homo sapiens
agctttgctgctg

SEQ ID NO: 909764 - DNA, 22 bp, Homo sapiens
agctttgctgctgaaggctcat

SEQ ID NO: 909765 - DNA, 16 bp, Homo sapiens
agctttggaaacagga

SEQ ID NO: 909766 - DNA, 13 bp, Homo sapiens
agctttggaatat

SEQ ID NO: 909767 - DNA, 18 bp, Homo sapiens
agctttggacctaatcca

SEQ ID NO: 909768 - DNA, 19 bp, Homo sapiens
agctttggacctaatccaa

SEQ ID NO: 909769 - DNA, 13 bp, Homo sapiens
agctttgtcactt

SEQ ID NO: 909770 - DNA, 21 bp, Homo sapiens
agctttgtcacttgccacatg

SEQ ID NO: 909771 - DNA, 11 bp, Homo sapiens
agctttgtgaa

SEQ ID NO: 909772 - DNA, 20 bp, Homo sapiens
agcttttaagaaaaacaaag

SEQ ID NO: 909773 - DNA, 19 bp, Homo sapiens
agcttttacagatccagaa

SEQ ID NO: 909774 - DNA, 20 bp, Homo sapiens
agcttttagtatccacagga

SEQ ID NO: 909775 - DNA, 19 bp, Homo sapiens
agcttttattgtataaact

SEQ ID NO: 909776 - DNA, 23 bp, Homo sapiens
agcttttcatggaagtggcagtg

SEQ ID NO: 909777 - DNA, 16 bp, Homo sapiens
agcttttcccttcttt

SEQ ID NO: 909778 - DNA, 14 bp, Homo sapiens
agcttttctgtaga

SEQ ID NO: 909779 - DNA, 16 bp, Homo sapiens
agcttttgcatttcct

SEQ ID NO: 909780 - DNA, 18 bp, Homo sapiens
agcttttgccagtattat

SEQ ID NO: 909781 - DNA, 19 bp, Homo sapiens
agcttttgccagtattatg

SEQ ID NO: 909782 - DNA, 22 bp, Homo sapiens
agcttttgccagtattatgcat

SEQ ID NO: 909783 - DNA, 23 bp, Homo sapiens
agcttttgtgtgcctggtagaaa

SEQ ID NO: 909784 - DNA, 15 bp, Homo sapiens
agcttttgttctaga

SEQ ID NO: 909785 - DNA, 17 bp, Homo sapiens
agcttttgttctagact

SEQ ID NO: 909786 - DNA, 18 bp, Homo sapiens
agctttttaatagcacta

SEQ ID NO: 909787 - DNA, 15 bp, Homo sapiens
agctttttattccct

SEQ ID NO: 909788 - DNA, 18 bp, Homo sapiens
agctttttattccctgcc

SEQ ID NO: 909789 - DNA, 22 bp, Homo sapiens
agctttttcagaaacagggcag

SEQ ID NO: 909790 - DNA, 23 bp, Homo sapiens
agctttttcagaaacagggcagc

SEQ ID NO: 909791 - DNA, 12 bp, Homo sapiens
agctttttctca

SEQ ID NO: 909792 - DNA, 15 bp, Homo sapiens
agctttttctgtgga

SEQ ID NO: 909793 - DNA, 23 bp, Homo sapiens
agctttttctgtggaggacagac

SEQ ID NO: 909794 - DNA, 18 bp, Homo sapiens
agcttttttacacaaatg

SEQ ID NO: 909795 - DNA, 21 bp, Homo sapiens
agcttttttccttaatccagc

SEQ ID NO: 909796 - DNA, 14 bp, Homo sapiens
aggaaaaaaacttt

SEQ ID NO: 909797 - DNA, 15 bp, Homo sapiens
aggaaaaaaactttt

SEQ ID NO: 909798 - DNA, 14 bp, Homo sapiens
aggaaaaaaatgac

SEQ ID NO: 909799 - DNA, 20 bp, Homo sapiens
aggaaaaaagaaccaaaact

SEQ ID NO: 909800 - DNA, 23 bp, Homo sapiens
aggaaaaaatgttggatttataa

SEQ ID NO: 909801 - DNA, 20 bp, Homo sapiens
aggaaaaacaaaacaaagaa

SEQ ID NO: 909802 - DNA, 18 bp, Homo sapiens
aggaaaaaccgagatagg

SEQ ID NO: 909803 - DNA, 22 bp, Homo sapiens
aggaaaaagcaagttcgtctgt

SEQ ID NO: 909804 - DNA, 12 bp, Homo sapiens
aggaaaaaggtc

SEQ ID NO: 909805 - DNA, 14 bp, Homo sapiens
aggaaaaataaacg

SEQ ID NO: 909806 - DNA, 18 bp, Homo sapiens
aggaaaaatgccactccc

SEQ ID NO: 909807 - DNA, 13 bp, Homo sapiens
aggaaaaatgtgt

SEQ ID NO: 909808 - DNA, 14 bp, Homo sapiens
aggaaaaatgtgta

SEQ ID NO: 909809 - DNA, 23 bp, Homo sapiens
aggaaaaccaagccgtggcttcc

SEQ ID NO: 909810 - DNA, 16 bp, Homo sapiens
aggaaaacctgaagac

SEQ ID NO: 909811 - DNA, 13 bp, Homo sapiens
aggaaaagaaaag

SEQ ID NO: 909812 - DNA, 14 bp, Homo sapiens
aggaaaagaaacct

SEQ ID NO: 909813 - DNA, 23 bp, Homo sapiens
aggaaaagaacaaacaaaactta

SEQ ID NO: 909814 - DNA, 21 bp, Homo sapiens
aggaaaagcaagaaacagttt

SEQ ID NO: 909815 - DNA, 13 bp, Homo sapiens
aggaaaaggattt

SEQ ID NO: 909816 - DNA, 22 bp, Homo sapiens
aggaaaagtacatttaatacag

SEQ ID NO: 909817 - DNA, 16 bp, Homo sapiens
aggaaaatatttcatt

SEQ ID NO: 909818 - DNA, 14 bp, Homo sapiens
aggaaaatcctctg

SEQ ID NO: 909819 - DNA, 11 bp, Homo sapiens
aggaaaatgag

SEQ ID NO: 909820 - DNA, 16 bp, Homo sapiens
aggaaaatgagtattt

SEQ ID NO: 909821 - DNA, 15 bp, Homo sapiens
aggaaaatgatctga

SEQ ID NO: 909822 - DNA, 21 bp, Homo sapiens
aggaaaatgtatccagaggaa

SEQ ID NO: 909823 - DNA, 14 bp, Homo sapiens
aggaaaatgtctgt

SEQ ID NO: 909824 - DNA, 20 bp, Homo sapiens
aggaaaatgtctgtaataat

SEQ ID NO: 909825 - DNA, 11 bp, Homo sapiens
aggaaaattat

SEQ ID NO: 909826 - DNA, 19 bp, Homo sapiens
aggaaaattgaaagtattc

SEQ ID NO: 909827 - DNA, 14 bp, Homo sapiens
aggaaaattgaatg

SEQ ID NO: 909828 - DNA, 17 bp, Homo sapiens
aggaaacacttctattt

SEQ ID NO: 909829 - DNA, 22 bp, Homo sapiens
aggaaacatgaagcataatttg

SEQ ID NO: 909830 - DNA, 12 bp, Homo sapiens
aggaaaccacaa

SEQ ID NO: 909831 - DNA, 22 bp, Homo sapiens
aggaaaccacaaccttgcagta

SEQ ID NO: 909832 - DNA, 23 bp, Homo sapiens
aggaaaccgagtagaaaatgtga

SEQ ID NO: 909833 - DNA, 16 bp, Homo sapiens
aggaaaccgcctagtt

SEQ ID NO: 909834 - DNA, 22 bp, Homo sapiens
aggaaaccgcctagtttactgt

SEQ ID NO: 909835 - DNA, 20 bp, Homo sapiens
aggaaacgagactttccatt

SEQ ID NO: 909836 - DNA, 16 bp, Homo sapiens
aggaaactaagcattg

SEQ ID NO: 909837 - DNA, 21 bp, Homo sapiens
aggaaactactgcctttagaa

SEQ ID NO: 909838 - DNA, 23 bp, Homo sapiens
aggaaactcacctgctggcccct

SEQ ID NO: 909839 - DNA, 16 bp, Homo sapiens
aggaaactccacatct

SEQ ID NO: 909840 - DNA, 21 bp, Homo sapiens
aggaaacttcagttgatcttc

SEQ ID NO: 909841 - DNA, 21 bp, Homo sapiens
aggaaacttctgatgtttatt

SEQ ID NO: 909842 - DNA, 22 bp, Homo sapiens
aggaaactttatttaaatgcat

SEQ ID NO: 909843 - DNA, 12 bp, Homo sapiens
caggcctcagcc

SEQ ID NO: 909844 - DNA, 18 bp, Homo sapiens
caggcctccagcctctcc

SEQ ID NO: 909845 - DNA, 14 bp, Homo sapiens
caggcctccctctc

SEQ ID NO: 909846 - DNA, 16 bp, Homo sapiens
caggcctccctctctc

SEQ ID NO: 909847 - DNA, 23 bp, Homo sapiens
caggcctccctctctcttctgct

SEQ ID NO: 909848 - DNA, 18 bp, Homo sapiens
caggcctccgtcttccca

SEQ ID NO: 909849 - DNA, 17 bp, Homo sapiens
caggcctcctaggggaa

SEQ ID NO: 909850 - DNA, 18 bp, Homo sapiens
caggcctcctaggggaag

SEQ ID NO: 909851 - DNA, 20 bp, Homo sapiens
caggcctcctaggggaaggg

SEQ ID NO: 909852 - DNA, 14 bp, Homo sapiens
caggcctctctctg

SEQ ID NO: 909853 - DNA, 19 bp, Homo sapiens
caggcctctggttgcctcc

SEQ ID NO: 909854 - DNA, 17 bp, Homo sapiens
caggcctctgtgtcctt

SEQ ID NO: 909855 - DNA, 15 bp, Homo sapiens
caggcctcttggcag

SEQ ID NO: 909856 - DNA, 22 bp, Homo sapiens
caggcctgaacccgtccattca

SEQ ID NO: 909857 - DNA, 19 bp, Homo sapiens
caggcctgaagtcttctcc

SEQ ID NO: 909858 - DNA, 22 bp, Homo sapiens
caggcctgacccacggggcagt

SEQ ID NO: 909859 - DNA, 13 bp, Homo sapiens
caggcctgagaat

SEQ ID NO: 909860 - DNA, 13 bp, Homo sapiens
caggcctgcagac

SEQ ID NO: 909861 - DNA, 20 bp, Homo sapiens
caggcctgcagacagacctc

SEQ ID NO: 909862 - DNA, 12 bp, Homo sapiens
caggcctgcctc

SEQ ID NO: 909863 - DNA, 13 bp, Homo sapiens
caggcctgcctcc

SEQ ID NO: 909864 - DNA, 14 bp, Homo sapiens
caggcctgcctccc

SEQ ID NO: 909865 - DNA, 15 bp, Homo sapiens
caggcctgcctccca

SEQ ID NO: 909866 - DNA, 14 bp, Homo sapiens
caggcctgcctgca

SEQ ID NO: 909867 - DNA, 16 bp, Homo sapiens
caggcctgcgtgccgg

SEQ ID NO: 909868 - DNA, 16 bp, Homo sapiens
caggcctgctggcatc

SEQ ID NO: 909869 - DNA, 21 bp, Homo sapiens
caggcctgctggcatcaggtc

SEQ ID NO: 909870 - DNA, 23 bp, Homo sapiens
caggcctgctggcatcaggtctg

SEQ ID NO: 909871 - DNA, 14 bp, Homo sapiens
caggcctggacggg

SEQ ID NO: 909872 - DNA, 19 bp, Homo sapiens
caggcctggacgggccctc

SEQ ID NO: 909873 - DNA, 15 bp, Homo sapiens
caggcctggctcccc

SEQ ID NO: 909874 - DNA, 22 bp, Homo sapiens
caggcctggctccccgagggct

SEQ ID NO: 909875 - DNA, 21 bp, Homo sapiens
caggcctggctggaggagcag

SEQ ID NO: 909876 - DNA, 12 bp, Homo sapiens
caggcctgggac

SEQ ID NO: 909877 - DNA, 13 bp, Homo sapiens
caggcctgggacc

SEQ ID NO: 909878 - DNA, 15 bp, Homo sapiens
caggcctgggatgca

SEQ ID NO: 909879 - DNA, 16 bp, Homo sapiens
caggcctgggatgcag

SEQ ID NO: 909880 - DNA, 13 bp, Homo sapiens
caggcctgggcag

SEQ ID NO: 909881 - DNA, 14 bp, Homo sapiens
caggcctgggtctg

SEQ ID NO: 909882 - DNA, 18 bp, Homo sapiens
caggcctgggtctgtgtc

SEQ ID NO: 909883 - DNA, 19 bp, Homo sapiens
caggcctgggtctgtgtct

SEQ ID NO: 909884 - DNA, 23 bp, Homo sapiens
caggcctgttgctatagagccta

SEQ ID NO: 909885 - DNA, 20 bp, Homo sapiens
caggccttacatctggctgg

SEQ ID NO: 909886 - DNA, 22 bp, Homo sapiens
caggccttatctccaagaccag

SEQ ID NO: 909887 - DNA, 17 bp, Homo sapiens
caggccttgctgactct

SEQ ID NO: 909888 - DNA, 18 bp, Homo sapiens
caggccttgctggggtcc

SEQ ID NO: 909889 - DNA, 11 bp, Homo sapiens
caggccttgtc

SEQ ID NO: 909890 - DNA, 23 bp, Homo sapiens
caggccttgtcctacgtccaagg

SEQ ID NO: 909891 - DNA, 13 bp, Homo sapiens
caggcgagcctga

SEQ ID NO: 909892 - DNA, 17 bp, Homo sapiens
caggcgagcctgactct

SEQ ID NO: 909893 - DNA, 16 bp, Homo sapiens
caggcgcagaggtccc

SEQ ID NO: 909894 - DNA, 22 bp, Homo sapiens
caggcgcagaggtcccagcccc

SEQ ID NO: 909895 - DNA, 23 bp, Homo sapiens
caggcgcatgagtatctgtggga

SEQ ID NO: 909896 - DNA, 23 bp, Homo sapiens
caggcgcatgtctgcacctccgc

SEQ ID NO: 909897 - DNA, 15 bp, Homo sapiens
caggcgcctgccatc

SEQ ID NO: 909898 - DNA, 23 bp, Homo sapiens
caggcgctgcggacaccgtggcc

SEQ ID NO: 909899 - DNA, 12 bp, Homo sapiens
caggcggccagg

SEQ ID NO: 909900 - DNA, 13 bp, Homo sapiens
caggcggccaggg

SEQ ID NO: 909901 - DNA, 17 bp, Homo sapiens
caggcggccctcagtgc

SEQ ID NO: 909902 - DNA, 23 bp, Homo sapiens
caggcggccctcagtgcatcccc

SEQ ID NO: 909903 - DNA, 13 bp, Homo sapiens
caggcggccctgg

SEQ ID NO: 909904 - DNA, 14 bp, Homo sapiens
caggcggccctggg

SEQ ID NO: 909905 - DNA, 15 bp, Homo sapiens
caggcggccctgggg

SEQ ID NO: 909906 - DNA, 16 bp, Homo sapiens
caggcggccctgggga

SEQ ID NO: 909907 - DNA, 15 bp, Homo sapiens
caggcgggcaagtca

SEQ ID NO: 909908 - DNA, 18 bp, Homo sapiens
caggcgggcccagaccgg

SEQ ID NO: 909909 - DNA, 18 bp, Homo sapiens
caggcgggccggggcagg

SEQ ID NO: 909910 - DNA, 20 bp, Homo sapiens
caggcgggccggggcaggga

SEQ ID NO: 909911 - DNA, 15 bp, Homo sapiens
caggcgttggtgcca

SEQ ID NO: 909912 - DNA, 16 bp, Homo sapiens
caggcgttggtgccac

SEQ ID NO: 909913 - DNA, 17 bp, Homo sapiens
caggcgttggtgccact

SEQ ID NO: 909914 - DNA, 19 bp, Homo sapiens
caggcgttggtgccacttc

SEQ ID NO: 909915 - DNA, 13 bp, Homo sapiens
caggctaattttt

SEQ ID NO: 909916 - DNA, 19 bp, Homo sapiens
caggctacaatcttcattt

SEQ ID NO: 909917 - DNA, 18 bp, Homo sapiens
caggctatggttgccacc

SEQ ID NO: 909918 - DNA, 20 bp, Homo sapiens
caggctatggttgccacccc

SEQ ID NO: 909919 - DNA, 13 bp, Homo sapiens
caggctattattt

SEQ ID NO: 909920 - DNA, 22 bp, Homo sapiens
caggctattatttattgtatta

SEQ ID NO: 909921 - DNA, 21 bp, Homo sapiens
caggctcaagctatccttgca

SEQ ID NO: 909922 - DNA, 18 bp, Homo sapiens
caggctccaagaggctga

SEQ ID NO: 909923 - DNA, 12 bp, Homo sapiens
caggctccccag

SEQ ID NO: 909924 - DNA, 16 bp, Homo sapiens
caggctccgcccttag

SEQ ID NO: 909925 - DNA, 17 bp, Homo sapiens
caggctccgcccttagt

SEQ ID NO: 909926 - DNA, 14 bp, Homo sapiens
caggctcctcagcc

SEQ ID NO: 909927 - DNA, 22 bp, Homo sapiens
caggctcctggctgtgcccagc

SEQ ID NO: 909928 - DNA, 23 bp, Homo sapiens
caggctcctggctgtgcccagca

SEQ ID NO: 909929 - DNA, 19 bp, Homo sapiens
caggctcggaggaccctgg

SEQ ID NO: 909930 - DNA, 21 bp, Homo sapiens
caggctcggaggaccctggaa

SEQ ID NO: 909931 - DNA, 14 bp, Homo sapiens
caggctcgtcagcc

SEQ ID NO: 909932 - DNA, 17 bp, Homo sapiens
caggctcgtcagccacc

SEQ ID NO: 909933 - DNA, 21 bp, Homo sapiens
caggctcgtggactgagtggg

SEQ ID NO: 909934 - DNA, 21 bp, Homo sapiens
caggctctagagagagggaga

SEQ ID NO: 909935 - DNA, 16 bp, Homo sapiens
caggctctctcctctc

SEQ ID NO: 909936 - DNA, 18 bp, Homo sapiens
caggctctggagccagag

SEQ ID NO: 909937 - DNA, 19 bp, Homo sapiens
caggctctggagccagaga

SEQ ID NO: 909938 - DNA, 15 bp, Homo sapiens
caggctctgggcaca

SEQ ID NO: 909939 - DNA, 16 bp, Homo sapiens
caggctctgggcacag

SEQ ID NO: 909940 - DNA, 17 bp, Homo sapiens
caggctctgggctcagg

SEQ ID NO: 909941 - DNA, 14 bp, Homo sapiens
caggctctgttcct

SEQ ID NO: 909942 - DNA, 18 bp, Homo sapiens
caggctcttagcagcttc

SEQ ID NO: 909943 - DNA, 16 bp, Homo sapiens
caggctcttcctggac

SEQ ID NO: 909944 - DNA, 12 bp, Homo sapiens
caggctcttctc

SEQ ID NO: 909945 - DNA, 18 bp, Homo sapiens
caggctcttctcctttca

SEQ ID NO: 909946 - DNA, 22 bp, Homo sapiens
caggctcttctcctttcacaac

SEQ ID NO: 909947 - DNA, 22 bp, Homo sapiens
caggctctttggggtcagccag

SEQ ID NO: 909948 - DNA, 16 bp, Homo sapiens
caggctgacatctgtg

SEQ ID NO: 909949 - DNA, 15 bp, Homo sapiens
caggctgaccacagc

SEQ ID NO: 909950 - DNA, 22 bp, Homo sapiens
caggctgaccacagcacagcca

SEQ ID NO: 909951 - DNA, 16 bp, Homo sapiens
caggctgagcctcagt

SEQ ID NO: 909952 - DNA, 18 bp, Homo sapiens
caggctgaggtggggaag

SEQ ID NO: 909953 - DNA, 19 bp, Homo sapiens
caggctgaggtggggaagg

SEQ ID NO: 909954 - DNA, 21 bp, Homo sapiens
caggctgaggtggggaaggag

SEQ ID NO: 909955 - DNA, 21 bp, Homo sapiens
caggctgagtccctccatgca

SEQ ID NO: 909956 - DNA, 17 bp, Homo sapiens
caggctgatttctaggt

SEQ ID NO: 909957 - DNA, 14 bp, Homo sapiens
caggctgcactgca

SEQ ID NO: 909958 - DNA, 16 bp, Homo sapiens
caggctgcactgcagt

SEQ ID NO: 909959 - DNA, 18 bp, Homo sapiens
caggctgcactgcagtga

SEQ ID NO: 909960 - DNA, 20 bp, Homo sapiens
caggctgcactgcagtgatg

SEQ ID NO: 909961 - DNA, 13 bp, Homo sapiens
caggctgcagagc

SEQ ID NO: 909962 - DNA, 14 bp, Homo sapiens
caggctgcagagcc

SEQ ID NO: 909963 - DNA, 19 bp, Homo sapiens
caggctgcagagcccggcc

SEQ ID NO: 909964 - DNA, 20 bp, Homo sapiens
caggctgcagaggcacctca

SEQ ID NO: 909965 - DNA, 20 bp, Homo sapiens
caggctgcagctggacagag

SEQ ID NO: 909966 - DNA, 21 bp, Homo sapiens
caggctgcaggagggcactgg

SEQ ID NO: 909967 - DNA, 22 bp, Homo sapiens
caggctgcctcggactccatgg

SEQ ID NO: 909968 - DNA, 24 bp, Homo sapiens
aggaaactttatttaaatgcatgt

SEQ ID NO: 909969 - DNA, 12 bp, Homo sapiens
aggaaagaaaac

SEQ ID NO: 909970 - DNA, 12 bp, Homo sapiens
aggaaagaacta

SEQ ID NO: 909971 - DNA, 16 bp, Homo sapiens
aggaaagaagcatttc

SEQ ID NO: 909972 - DNA, 12 bp, Homo sapiens
aggaaagagagt

SEQ ID NO: 909973 - DNA, 13 bp, Homo sapiens
aggaaagagagtt

SEQ ID NO: 909974 - DNA, 16 bp, Homo sapiens
aggaaagcaataaatg

SEQ ID NO: 909975 - DNA, 22 bp, Homo sapiens
aggaaagcaataaatgaatggg

SEQ ID NO: 909976 - DNA, 20 bp, Homo sapiens
aggaaagccacacggagagg

SEQ ID NO: 909977 - DNA, 17 bp, Homo sapiens
aggaaagccctccccct

SEQ ID NO: 909978 - DNA, 23 bp, Homo sapiens
aggaaagccctcccccttcccct

SEQ ID NO: 909979 - DNA, 15 bp, Homo sapiens
aggaaaggattttac

SEQ ID NO: 909980 - DNA, 23 bp, Homo sapiens
aggaaaggattttaccaaagcat

SEQ ID NO: 909981 - DNA, 14 bp, Homo sapiens
aggaaaggcagatg

SEQ ID NO: 909982 - DNA, 22 bp, Homo sapiens
aggaaagggcctggccagtcct

SEQ ID NO: 909983 - DNA, 14 bp, Homo sapiens
aggaaataaaacct

SEQ ID NO: 909984 - DNA, 17 bp, Homo sapiens
aggaaataaaacctttc

SEQ ID NO: 909985 - DNA, 21 bp, Homo sapiens
aggaaataaagggataaagaa

SEQ ID NO: 909986 - DNA, 16 bp, Homo sapiens
aggaaataacagagag

SEQ ID NO: 909987 - DNA, 12 bp, Homo sapiens
aggaaataacat

SEQ ID NO: 909988 - DNA, 17 bp, Homo sapiens
aggaaataacattgcac

SEQ ID NO: 909989 - DNA, 20 bp, Homo sapiens
aggaaataagaaaaatcatg

SEQ ID NO: 909990 - DNA, 19 bp, Homo sapiens
aggaaatactttgcataaa

SEQ ID NO: 909991 - DNA, 19 bp, Homo sapiens
aggaaatccaaaaaagcaa

SEQ ID NO: 909992 - DNA, 20 bp, Homo sapiens
aggaaatccattgtttaaag

SEQ ID NO: 909993 - DNA, 15 bp, Homo sapiens
aggaaatctcctctt

SEQ ID NO: 909994 - DNA, 19 bp, Homo sapiens
aggaaatctcctcttttgt

SEQ ID NO: 909995 - DNA, 19 bp, Homo sapiens
aggaaatgaaaatgtcttg

SEQ ID NO: 909996 - DNA, 17 bp, Homo sapiens
aggaaatgagtggccag

SEQ ID NO: 909997 - DNA, 22 bp, Homo sapiens
aggaaatgatggaatttttctg

SEQ ID NO: 909998 - DNA, 23 bp, Homo sapiens
aggaaatgctattgttgtgggct

SEQ ID NO: 909999 - DNA, 23 bp, Homo sapiens
aggaaatgtcacagaagcagcta

SEQ ID NO: 910000 - DNA, 17 bp, Homo sapiens
aggaaatgtcctgcatg

SEQ ID NO: 910001 - DNA, 23 bp, Homo sapiens
aggaaatgtggtagcctcacttt

SEQ ID NO: 910002 - DNA, 12 bp, Homo sapiens
aggaaattagtc

SEQ ID NO: 910003 - DNA, 17 bp, Homo sapiens
aggaaattagtcttttt

SEQ ID NO: 910004 - DNA, 14 bp, Homo sapiens
aggaaattccaaat

SEQ ID NO: 910005 - DNA, 22 bp, Homo sapiens
aggaaattctttcccagtctgt

SEQ ID NO: 910006 - DNA, 17 bp, Homo sapiens
aggaaatttgtttgtat

SEQ ID NO: 910007 - DNA, 14 bp, Homo sapiens
aggaacaagctggc

SEQ ID NO: 910008 - DNA, 19 bp, Homo sapiens
aggaacaagctggcttctg

SEQ ID NO: 910009 - DNA, 23 bp, Homo sapiens
aggaacacccgactcctcaaaag

SEQ ID NO: 910010 - DNA, 15 bp, Homo sapiens
aggaacagtggctgg

SEQ ID NO: 910011 - DNA, 21 bp, Homo sapiens
aggaacagtgtggtttgggaa

SEQ ID NO: 910012 - DNA, 12 bp, Homo sapiens
aggaacatacag

SEQ ID NO: 910013 - DNA, 13 bp, Homo sapiens
aggaacatttttt

SEQ ID NO: 910014 - DNA, 15 bp, Homo sapiens
aggaaccacaccaca

SEQ ID NO: 910015 - DNA, 19 bp, Homo sapiens
aggaaccacatataacact

SEQ ID NO: 910016 - DNA, 21 bp, Homo sapiens
aggaaccacatataacactta

SEQ ID NO: 910017 - DNA, 16 bp, Homo sapiens
aggaaccctcaggcca

SEQ ID NO: 910018 - DNA, 14 bp, Homo sapiens
aggaacctctgatt

SEQ ID NO: 910019 - DNA, 19 bp, Homo sapiens
aggaaccttccttcctgct

SEQ ID NO: 910020 - DNA, 22 bp, Homo sapiens
aggaacgagcactggccagaga

SEQ ID NO: 910021 - DNA, 14 bp, Homo sapiens
aggaacgggcagcc

SEQ ID NO: 910022 - DNA, 20 bp, Homo sapiens
aggaacggtaaatttctgtg

SEQ ID NO: 910023 - DNA, 13 bp, Homo sapiens
aggaactcacata

SEQ ID NO: 910024 - DNA, 14 bp, Homo sapiens
aggaactcccagca

SEQ ID NO: 910025 - DNA, 23 bp, Homo sapiens
aggaactcccagcaacacaagct

SEQ ID NO: 910026 - DNA, 21 bp, Homo sapiens
aggaactctggcttccaggta

SEQ ID NO: 910027 - DNA, 14 bp, Homo sapiens
aggaactgcctggg

SEQ ID NO: 910028 - DNA, 15 bp, Homo sapiens
aggaactgtccagag

SEQ ID NO: 910029 - DNA, 19 bp, Homo sapiens
aggaactgtccagagagca

SEQ ID NO: 910030 - DNA, 17 bp, Homo sapiens
aggaactgtctcaaaag

SEQ ID NO: 910031 - DNA, 20 bp, Homo sapiens
aggaactgtctcaaaaggat

SEQ ID NO: 910032 - DNA, 13 bp, Homo sapiens
aggaacttcagag

SEQ ID NO: 910033 - DNA, 14 bp, Homo sapiens
aggaacttccaggt

SEQ ID NO: 910034 - DNA, 14 bp, Homo sapiens
aggaacttgaatac

SEQ ID NO: 910035 - DNA, 14 bp, Homo sapiens
aggaacttgctgct

SEQ ID NO: 910036 - DNA, 19 bp, Homo sapiens
aggaacttgctgctgtgcc

SEQ ID NO: 910037 - DNA, 21 bp, Homo sapiens
aggaacttgctgctgtgcctg

SEQ ID NO: 910038 - DNA, 12 bp, Homo sapiens
aggaagaaaacg

SEQ ID NO: 910039 - DNA, 13 bp, Homo sapiens
aggaagaaatcac

SEQ ID NO: 910040 - DNA, 16 bp, Homo sapiens
aggaagaacgtttttt

SEQ ID NO: 910041 - DNA, 14 bp, Homo sapiens
aggaagagaaacca

SEQ ID NO: 910042 - DNA, 17 bp, Homo sapiens
aggaagagcaggcacat

SEQ ID NO: 910043 - DNA, 18 bp, Homo sapiens
aggaagagccacctgcaa

SEQ ID NO: 910044 - DNA, 21 bp, Homo sapiens
aggaagaggcccactagaggg

SEQ ID NO: 910045 - DNA, 19 bp, Homo sapiens
aggaagagggctgagctga

SEQ ID NO: 910046 - DNA, 21 bp, Homo sapiens
aggaagagggctgagctgagc

SEQ ID NO: 910047 - DNA, 23 bp, Homo sapiens
aggaagatggctcccaaggttcc

SEQ ID NO: 910048 - DNA, 21 bp, Homo sapiens
aggaagatgtatgctttgaat

SEQ ID NO: 910049 - DNA, 16 bp, Homo sapiens
aggaagatgtttacat

SEQ ID NO: 910050 - DNA, 14 bp, Homo sapiens
aggaagcaacagct

SEQ ID NO: 910051 - DNA, 15 bp, Homo sapiens
aggaagcaagcttaa

SEQ ID NO: 910052 - DNA, 23 bp, Homo sapiens
aggaagcactgaaaatagtgttc

SEQ ID NO: 910053 - DNA, 19 bp, Homo sapiens
aggaagcagggagagttgg

SEQ ID NO: 910054 - DNA, 16 bp, Homo sapiens
aggaagcagttggggc

SEQ ID NO: 910055 - DNA, 20 bp, Homo sapiens
aggaagcagttggggccctc

SEQ ID NO: 910056 - DNA, 22 bp, Homo sapiens
aggaagcagttggggccctctt

SEQ ID NO: 910057 - DNA, 16 bp, Homo sapiens
aggaagcattgtaaaa

SEQ ID NO: 910058 - DNA, 22 bp, Homo sapiens
aggaagcattgtaaaataattc

SEQ ID NO: 910059 - DNA, 15 bp, Homo sapiens
aggaagccaaagagt

SEQ ID NO: 910060 - DNA, 20 bp, Homo sapiens
aggaagccagtcaccttctg

SEQ ID NO: 910061 - DNA, 14 bp, Homo sapiens
aggaagccagtgga

SEQ ID NO: 910062 - DNA, 21 bp, Homo sapiens
aggaagcccaccaatctgccc

SEQ ID NO: 910063 - DNA, 18 bp, Homo sapiens
aggaagccgccagtactt

SEQ ID NO: 910064 - DNA, 21 bp, Homo sapiens
aggaagccggtgcctgggtgg

SEQ ID NO: 910065 - DNA, 20 bp, Homo sapiens
aggaagcctgcagtcctgga

SEQ ID NO: 910066 - DNA, 15 bp, Homo sapiens
aggaagccttgctca

SEQ ID NO: 910067 - DNA, 14 bp, Homo sapiens
aggaagctccagat

SEQ ID NO: 910068 - DNA, 12 bp, Homo sapiens
aggaaggacatg

SEQ ID NO: 910069 - DNA, 13 bp, Homo sapiens
aggaaggacccca

SEQ ID NO: 910070 - DNA, 19 bp, Homo sapiens
aggaaggacttacccagta

SEQ ID NO: 910071 - DNA, 17 bp, Homo sapiens
aggaaggagagcctgct

SEQ ID NO: 910072 - DNA, 15 bp, Homo sapiens
aggaaggagaggaga

SEQ ID NO: 910073 - DNA, 12 bp, Homo sapiens
aggaaggagccc

SEQ ID NO: 910074 - DNA, 20 bp, Homo sapiens
aggaaggaggacccaggaca

SEQ ID NO: 910075 - DNA, 22 bp, Homo sapiens
aggaaggaggacccaggacagg

SEQ ID NO: 910076 - DNA, 20 bp, Homo sapiens
aggaaggaggggagagacag

SEQ ID NO: 910077 - DNA, 15 bp, Homo sapiens
aggaaggcagctgct

SEQ ID NO: 910078 - DNA, 14 bp, Homo sapiens
aggaaggccaaaat

SEQ ID NO: 910079 - DNA, 20 bp, Homo sapiens
aggaaggcctttcttctgtg

SEQ ID NO: 910080 - DNA, 13 bp, Homo sapiens
aggaagggaagcg

SEQ ID NO: 910081 - DNA, 17 bp, Homo sapiens
aggaagggaccaaggca

SEQ ID NO: 910082 - DNA, 16 bp, Homo sapiens
aggaagggatctgaga

SEQ ID NO: 910083 - DNA, 19 bp, Homo sapiens
aggaagggatgtatttgta

SEQ ID NO: 910084 - DNA, 12 bp, Homo sapiens
aggaagggcaga

SEQ ID NO: 910085 - DNA, 17 bp, Homo sapiens
aggaagggcaggaagga

SEQ ID NO: 910086 - DNA, 13 bp, Homo sapiens
aggaagggtggga

SEQ ID NO: 910087 - DNA, 18 bp, Homo sapiens
aggaaggtgactgtgtgt

SEQ ID NO: 910088 - DNA, 14 bp, Homo sapiens
aggaaggtgcctgg

SEQ ID NO: 910089 - DNA, 16 bp, Homo sapiens
aggaaggtgctgagct

SEQ ID NO: 910090 - DNA, 17 bp, Homo sapiens
aggaaggtgctgagctt

SEQ ID NO: 910091 - DNA, 15 bp, Homo sapiens
aggaaggtggatggc

SEQ ID NO: 910092 - DNA, 16 bp, Homo sapiens
aggaaggtggatggcc

SEQ ID NO: 910093 - DNA, 19 bp, Homo sapiens
caggctgctggagtgcagt

SEQ ID NO: 910094 - DNA, 15 bp, Homo sapiens
caggctgcttgggat

SEQ ID NO: 910095 - DNA, 18 bp, Homo sapiens
caggctggaatgagggag

SEQ ID NO: 910096 - DNA, 23 bp, Homo sapiens
caggctggagactggaccgctga

SEQ ID NO: 910097 - DNA, 18 bp, Homo sapiens
caggctggagtgcagtga

SEQ ID NO: 910098 - DNA, 20 bp, Homo sapiens
caggctggcaccgccttctc

SEQ ID NO: 910099 - DNA, 16 bp, Homo sapiens
caggctggcagctctc

SEQ ID NO: 910100 - DNA, 17 bp, Homo sapiens
caggctggcagctctcc

SEQ ID NO: 910101 - DNA, 18 bp, Homo sapiens
caggctggcagctctcca

SEQ ID NO: 910102 - DNA, 20 bp, Homo sapiens
caggctggcagctctccagt

SEQ ID NO: 910103 - DNA, 16 bp, Homo sapiens
caggctggcgcagcca

SEQ ID NO: 910104 - DNA, 17 bp, Homo sapiens
caggctggcgcagccaa

SEQ ID NO: 910105 - DNA, 14 bp, Homo sapiens
caggctgggacgga

SEQ ID NO: 910106 - DNA, 20 bp, Homo sapiens
caggctgggacggaccagca

SEQ ID NO: 910107 - DNA, 10 bp, Homo sapiens
caggctgggc

SEQ ID NO: 910108 - DNA, 16 bp, Homo sapiens
caggctgggcacggct

SEQ ID NO: 910109 - DNA, 22 bp, Homo sapiens
caggctgggccatgtccaaaga

SEQ ID NO: 910110 - DNA, 23 bp, Homo sapiens
caggctgggccatgtccaaagag

SEQ ID NO: 910111 - DNA, 18 bp, Homo sapiens
caggctggggaggtgctg

SEQ ID NO: 910112 - DNA, 17 bp, Homo sapiens
caggctgggtcaaaaga

SEQ ID NO: 910113 - DNA, 22 bp, Homo sapiens
caggctgggtcaaaagagccct

SEQ ID NO: 910114 - DNA, 23 bp, Homo sapiens
caggctgggtcaaaagagccctg

SEQ ID NO: 910115 - DNA, 23 bp, Homo sapiens
caggctggtctcaaactcctgac

SEQ ID NO: 910116 - DNA, 19 bp, Homo sapiens
caggctgtggggtggagca

SEQ ID NO: 910117 - DNA, 18 bp, Homo sapiens
caggctgttattatgaag

SEQ ID NO: 910118 - DNA, 22 bp, Homo sapiens
caggctgttattatgaaggaat

SEQ ID NO: 910119 - DNA, 23 bp, Homo sapiens
caggctgttattatgaaggaatt

SEQ ID NO: 910120 - DNA, 16 bp, Homo sapiens
caggcttagggacagg

SEQ ID NO: 910121 - DNA, 14 bp, Homo sapiens
caggcttccccctt

SEQ ID NO: 910122 - DNA, 17 bp, Homo sapiens
caggcttcccccttgat

SEQ ID NO: 910123 - DNA, 12 bp, Homo sapiens
caggcttccgcg

SEQ ID NO: 910124 - DNA, 19 bp, Homo sapiens
caggcttctgtcaatttca

SEQ ID NO: 910125 - DNA, 13 bp, Homo sapiens
caggcttgcctgg

SEQ ID NO: 910126 - DNA, 24 bp, Homo sapiens
caggcttgggggttttcaatgtga

SEQ ID NO: 910127 - DNA, 14 bp, Homo sapiens
caggctttctggag

SEQ ID NO: 910128 - DNA, 14 bp, Homo sapiens
caggcttttatgag

SEQ ID NO: 910129 - DNA, 14 bp, Homo sapiens
caggcttttgtttc

SEQ ID NO: 910130 - DNA, 19 bp, Homo sapiens
cagggaaaagcagctctcc

SEQ ID NO: 910131 - DNA, 20 bp, Homo sapiens
cagggaaaatgcagcaggga

SEQ ID NO: 910132 - DNA, 12 bp, Homo sapiens
cagggaaaggaa

SEQ ID NO: 910133 - DNA, 15 bp, Homo sapiens
cagggaaaggccagt

SEQ ID NO: 910134 - DNA, 14 bp, Homo sapiens
cagggaaaggctct

SEQ ID NO: 910135 - DNA, 19 bp, Homo sapiens
cagggaaccctgcttgcac

SEQ ID NO: 910136 - DNA, 15 bp, Homo sapiens
cagggaactgcttgc

SEQ ID NO: 910137 - DNA, 15 bp, Homo sapiens
cagggaagagcagaa

SEQ ID NO: 910138 - DNA, 12 bp, Homo sapiens
cagggaagaggg

SEQ ID NO: 910139 - DNA, 14 bp, Homo sapiens
cagggaagagggca

SEQ ID NO: 910140 - DNA, 22 bp, Homo sapiens
cagggaagagggcagtacctgg

SEQ ID NO: 910141 - DNA, 21 bp, Homo sapiens
cagggaagcgtcgccccagtg

SEQ ID NO: 910142 - DNA, 14 bp, Homo sapiens
cagggaagctggcc

SEQ ID NO: 910143 - DNA, 17 bp, Homo sapiens
cagggaagctggccgag

SEQ ID NO: 910144 - DNA, 23 bp, Homo sapiens
cagggaaggacttggagagaatc

SEQ ID NO: 910145 - DNA, 18 bp, Homo sapiens
cagggaaggtggccacag

SEQ ID NO: 910146 - DNA, 17 bp, Homo sapiens
cagggaaggtggggccc

SEQ ID NO: 910147 - DNA, 18 bp, Homo sapiens
cagggaaggtggggccct

SEQ ID NO: 910148 - DNA, 20 bp, Homo sapiens
cagggaaggtggggccctgc

SEQ ID NO: 910149 - DNA, 21 bp, Homo sapiens
cagggaatactatacagccat

SEQ ID NO: 910150 - DNA, 22 bp, Homo sapiens
cagggaatactatacagccata

SEQ ID NO: 910151 - DNA, 12 bp, Homo sapiens
cagggaatccag

SEQ ID NO: 910152 - DNA, 23 bp, Homo sapiens
cagggaatgcaatccttccctgc

SEQ ID NO: 910153 - DNA, 16 bp, Homo sapiens
cagggaatgcagcagg

SEQ ID NO: 910154 - DNA, 15 bp, Homo sapiens
cagggaatgcctgga

SEQ ID NO: 910155 - DNA, 16 bp, Homo sapiens
cagggaattcctgggg

SEQ ID NO: 910156 - DNA, 13 bp, Homo sapiens
cagggacaaagag

SEQ ID NO: 910157 - DNA, 19 bp, Homo sapiens
cagggacagagacacctgc

SEQ ID NO: 910158 - DNA, 13 bp, Homo sapiens
cagggacagagcc

SEQ ID NO: 910159 - DNA, 14 bp, Homo sapiens
cagggacagaggcc

SEQ ID NO: 910160 - DNA, 16 bp, Homo sapiens
cagggacagaggccaa

SEQ ID NO: 910161 - DNA, 17 bp, Homo sapiens
cagggacagaggccaag

SEQ ID NO: 910162 - DNA, 12 bp, Homo sapiens
cagggacaggat

SEQ ID NO: 910163 - DNA, 19 bp, Homo sapiens
cagggacatgccctgtgtg

SEQ ID NO: 910164 - DNA, 17 bp, Homo sapiens
cagggacatggggcaag

SEQ ID NO: 910165 - DNA, 20 bp, Homo sapiens
cagggacatggggcaagcca

SEQ ID NO: 910166 - DNA, 22 bp, Homo sapiens
cagggacatggggcaagccagg

SEQ ID NO: 910167 - DNA, 19 bp, Homo sapiens
cagggacattgcagagtgg

SEQ ID NO: 910168 - DNA, 19 bp, Homo sapiens
cagggaccaaggacccctc

SEQ ID NO: 910169 - DNA, 18 bp, Homo sapiens
cagggaccactgggtgag

SEQ ID NO: 910170 - DNA, 16 bp, Homo sapiens
cagggacccaaagcag

SEQ ID NO: 910171 - DNA, 22 bp, Homo sapiens
cagggacccacttcacacacag

SEQ ID NO: 910172 - DNA, 19 bp, Homo sapiens
cagggacccttgcctgcct

SEQ ID NO: 910173 - DNA, 20 bp, Homo sapiens
cagggacccttgcctgcctc

SEQ ID NO: 910174 - DNA, 23 bp, Homo sapiens
cagggaccggcggaccccagcca

SEQ ID NO: 910175 - DNA, 20 bp, Homo sapiens
cagggaccggtgctgcagga

SEQ ID NO: 910176 - DNA, 22 bp, Homo sapiens
cagggaccggtgctgcaggagt

SEQ ID NO: 910177 - DNA, 15 bp, Homo sapiens
cagggaccgtccagg

SEQ ID NO: 910178 - DNA, 17 bp, Homo sapiens
cagggaccgtccagggg

SEQ ID NO: 910179 - DNA, 12 bp, Homo sapiens
cagggacctcag

SEQ ID NO: 910180 - DNA, 13 bp, Homo sapiens
cagggacctcagg

SEQ ID NO: 910181 - DNA, 21 bp, Homo sapiens
cagggactcaagggtccagaa

SEQ ID NO: 910182 - DNA, 20 bp, Homo sapiens
cagggactgaaaacctctcc

SEQ ID NO: 910183 - DNA, 21 bp, Homo sapiens
cagggactgaaaacctctcct

SEQ ID NO: 910184 - DNA, 23 bp, Homo sapiens
cagggagaaaatccaggtcatgc

SEQ ID NO: 910185 - DNA, 15 bp, Homo sapiens
cagggagaagtagct

SEQ ID NO: 910186 - DNA, 15 bp, Homo sapiens
cagggagacatctgc

SEQ ID NO: 910187 - DNA, 14 bp, Homo sapiens
cagggagagcgcct

SEQ ID NO: 910188 - DNA, 17 bp, Homo sapiens
cagggagaggccatgat

SEQ ID NO: 910189 - DNA, 18 bp, Homo sapiens
cagggagagttggggaag

SEQ ID NO: 910190 - DNA, 21 bp, Homo sapiens
cagggagcaggcggtgggcac

SEQ ID NO: 910191 - DNA, 16 bp, Homo sapiens
cagggagcagggaagg

SEQ ID NO: 910192 - DNA, 13 bp, Homo sapiens
cagggagcctccc

SEQ ID NO: 910193 - DNA, 22 bp, Homo sapiens
cagggagcgatccaggggaagc

SEQ ID NO: 910194 - DNA, 16 bp, Homo sapiens
cagggagctctgggga

SEQ ID NO: 910195 - DNA, 22 bp, Homo sapiens
cagggagctgatgccccttctc

SEQ ID NO: 910196 - DNA, 15 bp, Homo sapiens
cagggagctgggaca

SEQ ID NO: 910197 - DNA, 20 bp, Homo sapiens
cagggagcttcctggctctg

SEQ ID NO: 910198 - DNA, 18 bp, Homo sapiens
cagggagcttgccacact

SEQ ID NO: 910199 - DNA, 17 bp, Homo sapiens
cagggaggaaaagtgca

SEQ ID NO: 910200 - DNA, 23 bp, Homo sapiens
cagggaggagaggggaagggcca

SEQ ID NO: 910201 - DNA, 19 bp, Homo sapiens
cagggaggaggtggcagcc

SEQ ID NO: 910202 - DNA, 21 bp, Homo sapiens
cagggaggaggtggcagccct

SEQ ID NO: 910203 - DNA, 13 bp, Homo sapiens
cagggaggcagcg

SEQ ID NO: 910204 - DNA, 23 bp, Homo sapiens
cagggaggccacgtcccacccca

SEQ ID NO: 910205 - DNA, 19 bp, Homo sapiens
cagggaggcgcagggacat

SEQ ID NO: 910206 - DNA, 20 bp, Homo sapiens
cagggagggaaggggatgga

SEQ ID NO: 910207 - DNA, 13 bp, Homo sapiens
cagggagggccag

SEQ ID NO: 910208 - DNA, 22 bp, Homo sapiens
cagggagggccggcggctctga

SEQ ID NO: 910209 - DNA, 16 bp, Homo sapiens
cagggagggcttctgc

SEQ ID NO: 910210 - DNA, 12 bp, Homo sapiens
cagggaggggac

SEQ ID NO: 910211 - DNA, 13 bp, Homo sapiens
cagggaggggact

SEQ ID NO: 910212 - DNA, 13 bp, Homo sapiens
cagggaggggagg

SEQ ID NO: 910213 - DNA, 12 bp, Homo sapiens
cagggaggggcc

SEQ ID NO: 910214 - DNA, 14 bp, Homo sapiens
cagggaggggccgg

SEQ ID NO: 910215 - DNA, 20 bp, Homo sapiens
cagggaggggccggctggcc

SEQ ID NO: 910216 - DNA, 17 bp, Homo sapiens
cagggaggggctggggc

SEQ ID NO: 910217 - DNA, 16 bp, Homo sapiens
aggaaggtgtgatgtc

SEQ ID NO: 910218 - DNA, 14 bp, Homo sapiens
aggaaggttttctc

SEQ ID NO: 910219 - DNA, 15 bp, Homo sapiens
aggaagtaggaagta

SEQ ID NO: 910220 - DNA, 17 bp, Homo sapiens
aggaagtggggacagat

SEQ ID NO: 910221 - DNA, 19 bp, Homo sapiens
aggaagtggggacagattc

SEQ ID NO: 910222 - DNA, 16 bp, Homo sapiens
aggaagtggggtctgg

SEQ ID NO: 910223 - DNA, 19 bp, Homo sapiens
aggaagtggggtctggcct

SEQ ID NO: 910224 - DNA, 16 bp, Homo sapiens
aggaagtgtaacagct

SEQ ID NO: 910225 - DNA, 16 bp, Homo sapiens
aggaagtgtgtttgcc

SEQ ID NO: 910226 - DNA, 12 bp, Homo sapiens
aggaagttctcc

SEQ ID NO: 910227 - DNA, 19 bp, Homo sapiens
aggaagtttgatttttgtt

SEQ ID NO: 910228 - DNA, 16 bp, Homo sapiens
aggaagttttgtctaa

SEQ ID NO: 910229 - DNA, 22 bp, Homo sapiens
aggaataaaaccatcctgtttg

SEQ ID NO: 910230 - DNA, 22 bp, Homo sapiens
aggaataaagtttttttcctta

SEQ ID NO: 910231 - DNA, 19 bp, Homo sapiens
aggaataaattgctccttg

SEQ ID NO: 910232 - DNA, 14 bp, Homo sapiens
aggaataataaatt

SEQ ID NO: 910233 - DNA, 16 bp, Homo sapiens
aggaataataaattca

SEQ ID NO: 910234 - DNA, 17 bp, Homo sapiens
aggaatactgaacatct

SEQ ID NO: 910235 - DNA, 17 bp, Homo sapiens
aggaatagaggaagaaa

SEQ ID NO: 910236 - DNA, 17 bp, Homo sapiens
aggaatagttgagcccc

SEQ ID NO: 910237 - DNA, 22 bp, Homo sapiens
aggaatatcaatataatgtttt

SEQ ID NO: 910238 - DNA, 23 bp, Homo sapiens
aggaatatcccaaacttcggaaa

SEQ ID NO: 910239 - DNA, 20 bp, Homo sapiens
aggaatatgacggaagaaca

SEQ ID NO: 910240 - DNA, 22 bp, Homo sapiens
aggaatatgacggaagaacata

SEQ ID NO: 910241 - DNA, 20 bp, Homo sapiens
aggaatcaaatcttacaaaa

SEQ ID NO: 910242 - DNA, 16 bp, Homo sapiens
aggaatcactggggat

SEQ ID NO: 910243 - DNA, 22 bp, Homo sapiens
aggaatcatgtcaggcctgtgt

SEQ ID NO: 910244 - DNA, 18 bp, Homo sapiens
aggaatcattccagtgct

SEQ ID NO: 910245 - DNA, 22 bp, Homo sapiens
aggaatccatcctgcaaaggcc

SEQ ID NO: 910246 - DNA, 12 bp, Homo sapiens
aggaatcctttg

SEQ ID NO: 910247 - DNA, 19 bp, Homo sapiens
aggaatcgaggaaccagag

SEQ ID NO: 910248 - DNA, 13 bp, Homo sapiens
aggaatctcttca

SEQ ID NO: 910249 - DNA, 14 bp, Homo sapiens
aggaatctgccttc

SEQ ID NO: 910250 - DNA, 20 bp, Homo sapiens
aggaatctgccttccagccc

SEQ ID NO: 910251 - DNA, 23 bp, Homo sapiens
aggaatctgccttccagcccaga

SEQ ID NO: 910252 - DNA, 22 bp, Homo sapiens
aggaatctgtgggtctgggagt

SEQ ID NO: 910253 - DNA, 23 bp, Homo sapiens
aggaatgagtcaatcagccttta

SEQ ID NO: 910254 - DNA, 21 bp, Homo sapiens
aggaatgcctgtgccaataaa

SEQ ID NO: 910255 - DNA, 13 bp, Homo sapiens
aggaatgctcccc

SEQ ID NO: 910256 - DNA, 20 bp, Homo sapiens
aggaatgctcccccatcctc

SEQ ID NO: 910257 - DNA, 22 bp, Homo sapiens
aggaatgctcccccatcctccc

SEQ ID NO: 910258 - DNA, 16 bp, Homo sapiens
aggaatgctggactgg

SEQ ID NO: 910259 - DNA, 14 bp, Homo sapiens
aggaatgctgggcc

SEQ ID NO: 910260 - DNA, 15 bp, Homo sapiens
aggaatgctgggccc

SEQ ID NO: 910261 - DNA, 20 bp, Homo sapiens
aggaatgctgggcccccagc

SEQ ID NO: 910262 - DNA, 15 bp, Homo sapiens
aggaatgggggtcag

SEQ ID NO: 910263 - DNA, 15 bp, Homo sapiens
aggaatgtagggcct

SEQ ID NO: 910264 - DNA, 19 bp, Homo sapiens
aggaatgtcagggccaggt

SEQ ID NO: 910265 - DNA, 23 bp, Homo sapiens
aggaatgtgaaatttaaataata

SEQ ID NO: 910266 - DNA, 14 bp, Homo sapiens
aggaatgtgtccaa

SEQ ID NO: 910267 - DNA, 15 bp, Homo sapiens
aggaatgtgtccaag

SEQ ID NO: 910268 - DNA, 17 bp, Homo sapiens
aggaattaaataatgta

SEQ ID NO: 910269 - DNA, 17 bp, Homo sapiens
aggaattaagttatctt

SEQ ID NO: 910270 - DNA, 19 bp, Homo sapiens
aggaattcaatttggcaaa

SEQ ID NO: 910271 - DNA, 20 bp, Homo sapiens
aggaattccccaaagaatgt

SEQ ID NO: 910272 - DNA, 13 bp, Homo sapiens
aggaattcctctt

SEQ ID NO: 910273 - DNA, 22 bp, Homo sapiens
aggaattctaggcatcccaggg

SEQ ID NO: 910274 - DNA, 19 bp, Homo sapiens
aggaattctcaagacctga

SEQ ID NO: 910275 - DNA, 16 bp, Homo sapiens
aggaattctttgcatt

SEQ ID NO: 910276 - DNA, 23 bp, Homo sapiens
aggaattgattgtcagccacctc

SEQ ID NO: 910277 - DNA, 15 bp, Homo sapiens
aggaattgtttatac

SEQ ID NO: 910278 - DNA, 17 bp, Homo sapiens
aggaatttactttcttc

SEQ ID NO: 910279 - DNA, 22 bp, Homo sapiens
aggaatttactttcttcaccaa

SEQ ID NO: 910280 - DNA, 22 bp, Homo sapiens
aggaatttcacctgtaaacctg

SEQ ID NO: 910281 - DNA, 18 bp, Homo sapiens
aggaatttccctgtgtgg

SEQ ID NO: 910282 - DNA, 19 bp, Homo sapiens
aggaatttccctgtgtgga

SEQ ID NO: 910283 - DNA, 17 bp, Homo sapiens
aggaatttcctcccaat

SEQ ID NO: 910284 - DNA, 15 bp, Homo sapiens
aggaatttcttaact

SEQ ID NO: 910285 - DNA, 19 bp, Homo sapiens
aggaatttgtacttcttat

SEQ ID NO: 910286 - DNA, 23 bp, Homo sapiens
aggaatttgtacttcttattgca

SEQ ID NO: 910287 - DNA, 19 bp, Homo sapiens
aggaattttattttgctga

SEQ ID NO: 910288 - DNA, 23 bp, Homo sapiens
aggaattttattttgctgagttg

SEQ ID NO: 910289 - DNA, 14 bp, Homo sapiens
aggaattttctttg

SEQ ID NO: 910290 - DNA, 13 bp, Homo sapiens
aggacaaaataaa

SEQ ID NO: 910291 - DNA, 19 bp, Homo sapiens
aggacaaattagcatgcaa

SEQ ID NO: 910292 - DNA, 20 bp, Homo sapiens
aggacaaattagcatgcaag

SEQ ID NO: 910293 - DNA, 23 bp, Homo sapiens
aggacaaattagcatgcaagctt

SEQ ID NO: 910294 - DNA, 18 bp, Homo sapiens
aggacaagcaataactct

SEQ ID NO: 910295 - DNA, 22 bp, Homo sapiens
aggacaaggccttgctcactca

SEQ ID NO: 910296 - DNA, 20 bp, Homo sapiens
aggacaatcagtcccctccc

SEQ ID NO: 910297 - DNA, 22 bp, Homo sapiens
aggacaatcagtcccctcccat

SEQ ID NO: 910298 - DNA, 20 bp, Homo sapiens
aggacaatgaaatactccag

SEQ ID NO: 910299 - DNA, 21 bp, Homo sapiens
aggacaatgaaatactccagc

SEQ ID NO: 910300 - DNA, 13 bp, Homo sapiens
aggacacaatggc

SEQ ID NO: 910301 - DNA, 20 bp, Homo sapiens
aggacacaatggcacctctg

SEQ ID NO: 910302 - DNA, 20 bp, Homo sapiens
aggacacaccccacacccca

SEQ ID NO: 910303 - DNA, 23 bp, Homo sapiens
aggacacaccccacaccccagcc

SEQ ID NO: 910304 - DNA, 23 bp, Homo sapiens
aggacacactaatcgaactatga

SEQ ID NO: 910305 - DNA, 13 bp, Homo sapiens
aggacacagcaca

SEQ ID NO: 910306 - DNA, 14 bp, Homo sapiens
aggacacagcagta

SEQ ID NO: 910307 - DNA, 17 bp, Homo sapiens
aggacacagcagtattg

SEQ ID NO: 910308 - DNA, 18 bp, Homo sapiens
aggacacatcccggcctc

SEQ ID NO: 910309 - DNA, 16 bp, Homo sapiens
aggacacttcctgcct

SEQ ID NO: 910310 - DNA, 22 bp, Homo sapiens
aggacagaggccggggtccagg

SEQ ID NO: 910311 - DNA, 15 bp, Homo sapiens
aggacagcagcactc

SEQ ID NO: 910312 - DNA, 13 bp, Homo sapiens
aggacagctgtcc

SEQ ID NO: 910313 - DNA, 14 bp, Homo sapiens
aggacaggaagctg

SEQ ID NO: 910314 - DNA, 19 bp, Homo sapiens
aggacaggaagctggcaga

SEQ ID NO: 910315 - DNA, 13 bp, Homo sapiens
aggacaggagcct

SEQ ID NO: 910316 - DNA, 15 bp, Homo sapiens
aggacaggagcctgg

SEQ ID NO: 910317 - DNA, 18 bp, Homo sapiens
aggacaggagcctggtcc

SEQ ID NO: 910318 - DNA, 20 bp, Homo sapiens
aggacaggatccaggccggc

SEQ ID NO: 910319 - DNA, 15 bp, Homo sapiens
aggacaggcaggcca

SEQ ID NO: 910320 - DNA, 15 bp, Homo sapiens
aggacaggctggtgc

SEQ ID NO: 910321 - DNA, 18 bp, Homo sapiens
aggacagtgcttcagcct

SEQ ID NO: 910322 - DNA, 18 bp, Homo sapiens
aggacagtttatcctgtc

SEQ ID NO: 910323 - DNA, 22 bp, Homo sapiens
aggacagtttatcctgtctgag

SEQ ID NO: 910324 - DNA, 16 bp, Homo sapiens
aggacagtttttttgt

SEQ ID NO: 910325 - DNA, 13 bp, Homo sapiens
aggacatcaaagt

SEQ ID NO: 910326 - DNA, 16 bp, Homo sapiens
aggacatcagcaaaca

SEQ ID NO: 910327 - DNA, 22 bp, Homo sapiens
aggacatcagcaaacaggatca

SEQ ID NO: 910328 - DNA, 21 bp, Homo sapiens
aggacatgatggagcgcacct

SEQ ID NO: 910329 - DNA, 19 bp, Homo sapiens
aggacatgcgtgtgtcagg

SEQ ID NO: 910330 - DNA, 15 bp, Homo sapiens
aggacatttcccagg

SEQ ID NO: 910331 - DNA, 14 bp, Homo sapiens
aggacatttctcta

SEQ ID NO: 910332 - DNA, 19 bp, Homo sapiens
aggaccaaaaaacctcact

SEQ ID NO: 910333 - DNA, 20 bp, Homo sapiens
aggaccaaaaaacctcactg

SEQ ID NO: 910334 - DNA, 22 bp, Homo sapiens
aggaccacagtgggtggcacct

SEQ ID NO: 910335 - DNA, 18 bp, Homo sapiens
aggaccactcagccccta

SEQ ID NO: 910336 - DNA, 22 bp, Homo sapiens
aggaccactcctgtacactgaa

SEQ ID NO: 910337 - DNA, 19 bp, Homo sapiens
aggaccagattgctctgcc

SEQ ID NO: 910338 - DNA, 14 bp, Homo sapiens
aggaccagctgggg

SEQ ID NO: 910339 - DNA, 22 bp, Homo sapiens
aggaccaggactatagcccagg

SEQ ID NO: 910340 - DNA, 20 bp, Homo sapiens
agctcttggaagagctcttc

SEQ ID NO: 910341 - DNA, 21 bp, Homo sapiens
agctcttggacaacagctctc

SEQ ID NO: 910342 - DNA, 13 bp, Homo sapiens
agctctttccaaa

SEQ ID NO: 910343 - DNA, 17 bp, Homo sapiens
agctctttccaaattaa

SEQ ID NO: 910344 - DNA, 21 bp, Homo sapiens
agctctttgggcctctcctgc

SEQ ID NO: 910345 - DNA, 19 bp, Homo sapiens
agctctttggtctattttc

SEQ ID NO: 910346 - DNA, 11 bp, Homo sapiens
agctcttttaa

SEQ ID NO: 910347 - DNA, 23 bp, Homo sapiens
agctgaaaactaatgtactgtac

SEQ ID NO: 910348 - DNA, 12 bp, Homo sapiens
agctgaaaaggg

SEQ ID NO: 910349 - DNA, 19 bp, Homo sapiens
agctgaaaagggcactccc

SEQ ID NO: 910350 - DNA, 21 bp, Homo sapiens
agctgaaacattccgaagagg

SEQ ID NO: 910351 - DNA, 22 bp, Homo sapiens
agctgaaacattccgaagaggg

SEQ ID NO: 910352 - DNA, 15 bp, Homo sapiens
agctgaaagaggagg

SEQ ID NO: 910353 - DNA, 16 bp, Homo sapiens
agctgaaatgctgcat

SEQ ID NO: 910354 - DNA, 17 bp, Homo sapiens
agctgaaattttagaaa

SEQ ID NO: 910355 - DNA, 21 bp, Homo sapiens
agctgaacaataggctgttcc

SEQ ID NO: 910356 - DNA, 22 bp, Homo sapiens
agctgaacaataggctgttccc

SEQ ID NO: 910357 - DNA, 23 bp, Homo sapiens
agctgaacaataggctgttccca

SEQ ID NO: 910358 - DNA, 21 bp, Homo sapiens
agctgaacacatttgcccaat

SEQ ID NO: 910359 - DNA, 14 bp, Homo sapiens
agctgaaccaaagc

SEQ ID NO: 910360 - DNA, 15 bp, Homo sapiens
agctgaagagcaagg

SEQ ID NO: 910361 - DNA, 19 bp, Homo sapiens
agctgaagcccccctttgg

SEQ ID NO: 910362 - DNA, 12 bp, Homo sapiens
agctgaagctac

SEQ ID NO: 910363 - DNA, 22 bp, Homo sapiens
agctgaatattttttatttcta

SEQ ID NO: 910364 - DNA, 17 bp, Homo sapiens
agctgaatgcctcctgt

SEQ ID NO: 910365 - DNA, 16 bp, Homo sapiens
agctgacattgccaaa

SEQ ID NO: 910366 - DNA, 22 bp, Homo sapiens
agctgacccagagtggagtctg

SEQ ID NO: 910367 - DNA, 22 bp, Homo sapiens
agctgacctctgttgtcctccc

SEQ ID NO: 910368 - DNA, 13 bp, Homo sapiens
agctgactcacac

SEQ ID NO: 910369 - DNA, 22 bp, Homo sapiens
agctgactccagtataatctcc

SEQ ID NO: 910370 - DNA, 13 bp, Homo sapiens
agctgactgtggc

SEQ ID NO: 910371 - DNA, 18 bp, Homo sapiens
agctgactgtggccccct

SEQ ID NO: 910372 - DNA, 23 bp, Homo sapiens
agctgacttggcacttaagtgca

SEQ ID NO: 910373 - DNA, 22 bp, Homo sapiens
agctgagaaaagtattctcaaa

SEQ ID NO: 910374 - DNA, 16 bp, Homo sapiens
agctgagaccagggtc

SEQ ID NO: 910375 - DNA, 18 bp, Homo sapiens
agctgagagaccctggcc

SEQ ID NO: 910376 - DNA, 14 bp, Homo sapiens
agctgagagacttt

SEQ ID NO: 910377 - DNA, 15 bp, Homo sapiens
agctgagagactttt

SEQ ID NO: 910378 - DNA, 18 bp, Homo sapiens
agctgagagccctgctgt

SEQ ID NO: 910379 - DNA, 22 bp, Homo sapiens
agctgagagtctgaaagacaga

SEQ ID NO: 910380 - DNA, 21 bp, Homo sapiens
agctgagcacttagcaggcac

SEQ ID NO: 910381 - DNA, 18 bp, Homo sapiens
agctgagcagcctctgga

SEQ ID NO: 910382 - DNA, 15 bp, Homo sapiens
agctgagcaggacag

SEQ ID NO: 910383 - DNA, 19 bp, Homo sapiens
agctgagcaggacagccag

SEQ ID NO: 910384 - DNA, 20 bp, Homo sapiens
agctgagcaggacagccagc

SEQ ID NO: 910385 - DNA, 23 bp, Homo sapiens
agctgagcaggacagccagcagc

SEQ ID NO: 910386 - DNA, 14 bp, Homo sapiens
agctgagcgccagg

SEQ ID NO: 910387 - DNA, 15 bp, Homo sapiens
agctgagctggaagg

SEQ ID NO: 910388 - DNA, 20 bp, Homo sapiens
agctgagctggaaggggcca

SEQ ID NO: 910389 - DNA, 13 bp, Homo sapiens
agctgagcttttg

SEQ ID NO: 910390 - DNA, 22 bp, Homo sapiens
agctgaggaacaggttcctgtg

SEQ ID NO: 910391 - DNA, 18 bp, Homo sapiens
agctgaggatttcctgga

SEQ ID NO: 910392 - DNA, 16 bp, Homo sapiens
agctgaggcagcagtg

SEQ ID NO: 910393 - DNA, 17 bp, Homo sapiens
agctgaggcagcagtgt

SEQ ID NO: 910394 - DNA, 17 bp, Homo sapiens
agctgaggccacactca

SEQ ID NO: 910395 - DNA, 21 bp, Homo sapiens
agctgaggccacactcagcac

SEQ ID NO: 910396 - DNA, 23 bp, Homo sapiens
agctgaggctttggtacccccaa

SEQ ID NO: 910397 - DNA, 19 bp, Homo sapiens
agctgagggagggagccat

SEQ ID NO: 910398 - DNA, 20 bp, Homo sapiens
agctgagggagggagccatg

SEQ ID NO: 910399 - DNA, 23 bp, Homo sapiens
agctgagggccctgtggagtcca

SEQ ID NO: 910400 - DNA, 15 bp, Homo sapiens
agctgaggggacggg

SEQ ID NO: 910401 - DNA, 23 bp, Homo sapiens
agctgaggggggccgtgcccagg

SEQ ID NO: 910402 - DNA, 14 bp, Homo sapiens
agctgagtcacctc

SEQ ID NO: 910403 - DNA, 18 bp, Homo sapiens
agctgagtcacctcctcc

SEQ ID NO: 910404 - DNA, 19 bp, Homo sapiens
agctgagtcacctcctcca

SEQ ID NO: 910405 - DNA, 18 bp, Homo sapiens
agctgagtgagagggttt

SEQ ID NO: 910406 - DNA, 13 bp, Homo sapiens
agctgagtggcca

SEQ ID NO: 910407 - DNA, 20 bp, Homo sapiens
agctgagttacttgtctgag

SEQ ID NO: 910408 - DNA, 21 bp, Homo sapiens
agctgagtttcctatgggaac

SEQ ID NO: 910409 - DNA, 19 bp, Homo sapiens
agctgataaggaaacttta

SEQ ID NO: 910410 - DNA, 17 bp, Homo sapiens
agctgatattatttctt

SEQ ID NO: 910411 - DNA, 22 bp, Homo sapiens
agctgatattatttcttctctt

SEQ ID NO: 910412 - DNA, 20 bp, Homo sapiens
agctgatgatgtctcttgta

SEQ ID NO: 910413 - DNA, 18 bp, Homo sapiens
agctgattactgtcaata

SEQ ID NO: 910414 - DNA, 20 bp, Homo sapiens
agctgattactgtcaataaa

SEQ ID NO: 910415 - DNA, 20 bp, Homo sapiens
agctgatttccaggcccctg

SEQ ID NO: 910416 - DNA, 21 bp, Homo sapiens
agctgatttccaggcccctga

SEQ ID NO: 910417 - DNA, 16 bp, Homo sapiens
agctgattttaacaat

SEQ ID NO: 910418 - DNA, 20 bp, Homo sapiens
agctgattttaacaataact

SEQ ID NO: 910419 - DNA, 23 bp, Homo sapiens
agctgcaaggtactctggtgagt

SEQ ID NO: 910420 - DNA, 14 bp, Homo sapiens
agctgcacacacct

SEQ ID NO: 910421 - DNA, 20 bp, Homo sapiens
agctgcacattcctggcccc

SEQ ID NO: 910422 - DNA, 16 bp, Homo sapiens
agctgcaccagagcaa

SEQ ID NO: 910423 - DNA, 23 bp, Homo sapiens
agctgcaccagagcaacctctca

SEQ ID NO: 910424 - DNA, 18 bp, Homo sapiens
agctgcaccagcaggtgc

SEQ ID NO: 910425 - DNA, 23 bp, Homo sapiens
agctgcaccccagcgtcaggcct

SEQ ID NO: 910426 - DNA, 13 bp, Homo sapiens
agctgcaccctca

SEQ ID NO: 910427 - DNA, 17 bp, Homo sapiens
agctgcaccctcaggca

SEQ ID NO: 910428 - DNA, 19 bp, Homo sapiens
agctgcaccctcaggcagg

SEQ ID NO: 910429 - DNA, 22 bp, Homo sapiens
agctgcacctgccagcctggct

SEQ ID NO: 910430 - DNA, 11 bp, Homo sapiens
agctgcagaac

SEQ ID NO: 910431 - DNA, 17 bp, Homo sapiens
agctgcagatgcctctg

SEQ ID NO: 910432 - DNA, 16 bp, Homo sapiens
agctgcagctgggccc

SEQ ID NO: 910433 - DNA, 19 bp, Homo sapiens
agctgcagctgggccccat

SEQ ID NO: 910434 - DNA, 13 bp, Homo sapiens
agctgcagggcac

SEQ ID NO: 910435 - DNA, 18 bp, Homo sapiens
agctgcagggcacgggga

SEQ ID NO: 910436 - DNA, 13 bp, Homo sapiens
agctgcagtgagc

SEQ ID NO: 910437 - DNA, 21 bp, Homo sapiens
agctgccacagagaagtttgt

SEQ ID NO: 910438 - DNA, 18 bp, Homo sapiens
agctgccacccctcttct

SEQ ID NO: 910439 - DNA, 20 bp, Homo sapiens
agctgccacccctcttctgc

SEQ ID NO: 910440 - DNA, 21 bp, Homo sapiens
agctgccacccctcttctgct

SEQ ID NO: 910441 - DNA, 10 bp, Homo sapiens
agctgccact

SEQ ID NO: 910442 - DNA, 14 bp, Homo sapiens
agctgccactgggc

SEQ ID NO: 910443 - DNA, 20 bp, Homo sapiens
agctgccactgggcacctgc

SEQ ID NO: 910444 - DNA, 24 bp, Homo sapiens
agctgccactgggcacctgcgcac

SEQ ID NO: 910445 - DNA, 18 bp, Homo sapiens
agctgccagaatcaggtt

SEQ ID NO: 910446 - DNA, 12 bp, Homo sapiens
agctgccagaga

SEQ ID NO: 910447 - DNA, 23 bp, Homo sapiens
agctgccaggcggccctggggag

SEQ ID NO: 910448 - DNA, 19 bp, Homo sapiens
agctgccagtgctggtcac

SEQ ID NO: 910449 - DNA, 18 bp, Homo sapiens
agctgcccagagttgctg

SEQ ID NO: 910450 - DNA, 22 bp, Homo sapiens
agctgcccctccctcagggagc

SEQ ID NO: 910451 - DNA, 20 bp, Homo sapiens
agctgcccctcctggagcag

SEQ ID NO: 910452 - DNA, 21 bp, Homo sapiens
agctgcccctcctggagcaga

SEQ ID NO: 910453 - DNA, 16 bp, Homo sapiens
agctgcccggcgcctg

SEQ ID NO: 910454 - DNA, 10 bp, Homo sapiens
agctgcccta

SEQ ID NO: 910455 - DNA, 14 bp, Homo sapiens
agctgccctagctg

SEQ ID NO: 910456 - DNA, 18 bp, Homo sapiens
agctgccctagctgaccc

SEQ ID NO: 910457 - DNA, 19 bp, Homo sapiens
agctgccctagctgacccc

SEQ ID NO: 910458 - DNA, 21 bp, Homo sapiens
agctgccctatgggcctgccg

SEQ ID NO: 910459 - DNA, 13 bp, Homo sapiens
agctgccctgctg

SEQ ID NO: 910460 - DNA, 14 bp, Homo sapiens
agctgccctgctgc

SEQ ID NO: 910461 - DNA, 20 bp, Homo sapiens
agctgccctgctgccacagc

SEQ ID NO: 910462 - DNA, 17 bp, Homo sapiens
agctgccgacttggaga

SEQ ID NO: 910463 - DNA, 18 bp, Homo sapiens
agctgccgggcctgattt

SEQ ID NO: 910464 - DNA, 13 bp, Homo sapiens
agctgcctaccta

SEQ ID NO: 910465 - DNA, 20 bp, Homo sapiens
agctgcctctcggtggccag

SEQ ID NO: 910466 - DNA, 18 bp, Homo sapiens
agctgcctctgacagcag

SEQ ID NO: 910467 - DNA, 14 bp, Homo sapiens
agctgcctctgctc

SEQ ID NO: 910468 - DNA, 16 bp, Homo sapiens
agctgcctctgctccc

SEQ ID NO: 910469 - DNA, 16 bp, Homo sapiens
agctgcctctgggcca

SEQ ID NO: 910470 - DNA, 18 bp, Homo sapiens
agctgcctgaaacagcca

SEQ ID NO: 910471 - DNA, 19 bp, Homo sapiens
agctgcctgaaacagccat

SEQ ID NO: 910472 - DNA, 12 bp, Homo sapiens
agctgcctgcag

SEQ ID NO: 910473 - DNA, 14 bp, Homo sapiens
agctgcctgcagca

SEQ ID NO: 910474 - DNA, 19 bp, Homo sapiens
agctgcctgcagcacatgc

SEQ ID NO: 910475 - DNA, 10 bp, Homo sapiens
agctgcctgg

SEQ ID NO: 910476 - DNA, 18 bp, Homo sapiens
agctgcctggccatgctg

SEQ ID NO: 910477 - DNA, 23 bp, Homo sapiens
agctgcctggcggggttggccct

SEQ ID NO: 910478 - DNA, 11 bp, Homo sapiens
agctgcctggg

SEQ ID NO: 910479 - DNA, 14 bp, Homo sapiens
agctgcctggggcc

SEQ ID NO: 910480 - DNA, 19 bp, Homo sapiens
agctgcctggggcccaagt

SEQ ID NO: 910481 - DNA, 15 bp, Homo sapiens
agctgcctggtatat

SEQ ID NO: 910482 - DNA, 18 bp, Homo sapiens
agctgcctgtagttagga

SEQ ID NO: 910483 - DNA, 23 bp, Homo sapiens
agctgcctgtagttaggaaataa

SEQ ID NO: 910484 - DNA, 16 bp, Homo sapiens
agctgcctgtgccatg

SEQ ID NO: 910485 - DNA, 18 bp, Homo sapiens
agctgcctgtgccatgcc

SEQ ID NO: 910486 - DNA, 10 bp, Homo sapiens
agctgccttc

SEQ ID NO: 910487 - DNA, 14 bp, Homo sapiens
agctgccttcaagg

SEQ ID NO: 910488 - DNA, 18 bp, Homo sapiens
agctgccttcaaggactg

SEQ ID NO: 910489 - DNA, 13 bp, Homo sapiens
agctgccttccct

SEQ ID NO: 910490 - DNA, 16 bp, Homo sapiens
agctgccttccctagc

SEQ ID NO: 910491 - DNA, 16 bp, Homo sapiens
agctgccttggctcag

SEQ ID NO: 910492 - DNA, 19 bp, Homo sapiens
agctgccttggctcagaca

SEQ ID NO: 910493 - DNA, 19 bp, Homo sapiens
agctgctacctaaaaaaag

SEQ ID NO: 910494 - DNA, 15 bp, Homo sapiens
agctgctatatattt

SEQ ID NO: 910495 - DNA, 18 bp, Homo sapiens
agctgctatccccatctc

SEQ ID NO: 910496 - DNA, 20 bp, Homo sapiens
agctgctatttattttccta

SEQ ID NO: 910497 - DNA, 16 bp, Homo sapiens
agctgctcagggaaaa

SEQ ID NO: 910498 - DNA, 21 bp, Homo sapiens
agctgctcagggaaaagcagc

SEQ ID NO: 910499 - DNA, 18 bp, Homo sapiens
agctgctccaggcctgca

SEQ ID NO: 910500 - DNA, 14 bp, Homo sapiens
agctgctcccctgc

SEQ ID NO: 910501 - DNA, 19 bp, Homo sapiens
agctgctccgaggacccag

SEQ ID NO: 910502 - DNA, 17 bp, Homo sapiens
agctgctcctagaggga

SEQ ID NO: 910503 - DNA, 19 bp, Homo sapiens
agctgctcctagagggagg

SEQ ID NO: 910504 - DNA, 20 bp, Homo sapiens
agctgctcctagagggaggg

SEQ ID NO: 910505 - DNA, 12 bp, Homo sapiens
agctgctctgcc

SEQ ID NO: 910506 - DNA, 15 bp, Homo sapiens
agctgctctgcccct

SEQ ID NO: 910507 - DNA, 21 bp, Homo sapiens
agctgctctgccccttgggca

SEQ ID NO: 910508 - DNA, 13 bp, Homo sapiens
agctgctctgcta

SEQ ID NO: 910509 - DNA, 15 bp, Homo sapiens
agctgctctggaaaa

SEQ ID NO: 910510 - DNA, 19 bp, Homo sapiens
agctgctcttagtgcccgc

SEQ ID NO: 910511 - DNA, 20 bp, Homo sapiens
agctgctgaccaattgtgct

SEQ ID NO: 910512 - DNA, 23 bp, Homo sapiens
agctgctgaccaattgtgctgcc

SEQ ID NO: 910513 - DNA, 14 bp, Homo sapiens
agctgctggcttgc

SEQ ID NO: 910514 - DNA, 12 bp, Homo sapiens
agctgctgtctt

SEQ ID NO: 910515 - DNA, 18 bp, Homo sapiens
agctgctgtcttctggac

SEQ ID NO: 910516 - DNA, 18 bp, Homo sapiens
agctgctgttctcaggac

SEQ ID NO: 910517 - DNA, 11 bp, Homo sapiens
agctgcttctc

SEQ ID NO: 910518 - DNA, 15 bp, Homo sapiens
agctgcttctccccc

SEQ ID NO: 910519 - DNA, 18 bp, Homo sapiens
agctgcttctccccccat

SEQ ID NO: 910520 - DNA, 24 bp, Homo sapiens
agctgcttctccccccatcccagg

SEQ ID NO: 910521 - DNA, 17 bp, Homo sapiens
agctgcttctgctgcct

SEQ ID NO: 910522 - DNA, 23 bp, Homo sapiens
agctgctttgagctacaggacaa

SEQ ID NO: 910523 - DNA, 14 bp, Homo sapiens
agctgcttttaaaa

SEQ ID NO: 910524 - DNA, 16 bp, Homo sapiens
agctggaacatttgat

SEQ ID NO: 910525 - DNA, 12 bp, Homo sapiens
agctggaagcac

SEQ ID NO: 910526 - DNA, 12 bp, Homo sapiens
agctggaaggca

SEQ ID NO: 910527 - DNA, 18 bp, Homo sapiens
agctggaaggggccacgt

SEQ ID NO: 910528 - DNA, 22 bp, Homo sapiens
agctggacatactgctggagtc

SEQ ID NO: 910529 - DNA, 17 bp, Homo sapiens
agctggaccatctctgt

SEQ ID NO: 910530 - DNA, 18 bp, Homo sapiens
agctggaccatctctgta

SEQ ID NO: 910531 - DNA, 15 bp, Homo sapiens
agctggactagtgtc

SEQ ID NO: 910532 - DNA, 16 bp, Homo sapiens
agctggactctgcatc

SEQ ID NO: 910533 - DNA, 17 bp, Homo sapiens
agctggagaaatatggt

SEQ ID NO: 910534 - DNA, 22 bp, Homo sapiens
agctggagatctgaacccagct

SEQ ID NO: 910535 - DNA, 18 bp, Homo sapiens
agctggagatgaggccag

SEQ ID NO: 910536 - DNA, 19 bp, Homo sapiens
agctggagatgaggccaga

SEQ ID NO: 910537 - DNA, 18 bp, Homo sapiens
agctggagcccccagcag

SEQ ID NO: 910538 - DNA, 21 bp, Homo sapiens
agctggaggaatacattttat

SEQ ID NO: 910539 - DNA, 23 bp, Homo sapiens
agctggagtgagggcctcagagc

SEQ ID NO: 910540 - DNA, 20 bp, Homo sapiens
agctggagtgctgcttgtgc

SEQ ID NO: 910541 - DNA, 20 bp, Homo sapiens
agctggatagacttgggatg

SEQ ID NO: 910542 - DNA, 21 bp, Homo sapiens
agctggatagacttgggatgg

SEQ ID NO: 910543 - DNA, 11 bp, Homo sapiens
agctggcagga

SEQ ID NO: 910544 - DNA, 23 bp, Homo sapiens
agctggcaggacacatcccggcc

SEQ ID NO: 910545 - DNA, 13 bp, Homo sapiens
agctggccccgcc

SEQ ID NO: 910546 - DNA, 21 bp, Homo sapiens
agctggccccgcttggtggcc

SEQ ID NO: 910547 - DNA, 18 bp, Homo sapiens
agctggcccgtgacagac

SEQ ID NO: 910548 - DNA, 20 bp, Homo sapiens
agctggccgagggtcctggc

SEQ ID NO: 910549 - DNA, 11 bp, Homo sapiens
agctggcctcc

SEQ ID NO: 910550 - DNA, 22 bp, Homo sapiens
agctggcctggggtccctctga

SEQ ID NO: 910551 - DNA, 13 bp, Homo sapiens
agctggctagcat

SEQ ID NO: 910552 - DNA, 18 bp, Homo sapiens
agctggctagtcctttct

SEQ ID NO: 910553 - DNA, 21 bp, Homo sapiens
agctggctagtcctttctgtg

SEQ ID NO: 910554 - DNA, 13 bp, Homo sapiens
agctggctctgag

SEQ ID NO: 910555 - DNA, 14 bp, Homo sapiens
agctggctctgagc

SEQ ID NO: 910556 - DNA, 19 bp, Homo sapiens
agctggctctgagcgcctc

SEQ ID NO: 910557 - DNA, 21 bp, Homo sapiens
agctggctgtacctgttcctc

SEQ ID NO: 910558 - DNA, 16 bp, Homo sapiens
agctggctgtgcctgc

SEQ ID NO: 910559 - DNA, 22 bp, Homo sapiens
agctggctgtgcctgcttctgt

SEQ ID NO: 910560 - DNA, 14 bp, Homo sapiens
agctggcttctgtg

SEQ ID NO: 910561 - DNA, 15 bp, Homo sapiens
agctggcttctgtga

SEQ ID NO: 910562 - DNA, 20 bp, Homo sapiens
agctggctttgaaacctcag

SEQ ID NO: 910563 - DNA, 20 bp, Homo sapiens
agctgggaaaaaagttttga

SEQ ID NO: 910564 - DNA, 20 bp, Homo sapiens
agctgggaaattcatgtgga

SEQ ID NO: 910565 - DNA, 14 bp, Homo sapiens
agctgggaaccagc

SEQ ID NO: 910566 - DNA, 15 bp, Homo sapiens
agctgggacccctcc

SEQ ID NO: 910567 - DNA, 18 bp, Homo sapiens
agctgggacctaatgctg

SEQ ID NO: 910568 - DNA, 17 bp, Homo sapiens
agctgggactacaggtg

SEQ ID NO: 910569 - DNA, 13 bp, Homo sapiens
agctgggagccag

SEQ ID NO: 910570 - DNA, 17 bp, Homo sapiens
agctgggagccagtgtg

SEQ ID NO: 910571 - DNA, 14 bp, Homo sapiens
agctgggaggaaaa

SEQ ID NO: 910572 - DNA, 15 bp, Homo sapiens
agctgggaggaaaag

SEQ ID NO: 910573 - DNA, 13 bp, Homo sapiens
agctgggaggcaa

SEQ ID NO: 910574 - DNA, 23 bp, Homo sapiens
agctgggaggcaagaggggtgga

SEQ ID NO: 910575 - DNA, 14 bp, Homo sapiens
agctgggaggcatg

SEQ ID NO: 910576 - DNA, 16 bp, Homo sapiens
agctgggaggcatggc

SEQ ID NO: 910577 - DNA, 21 bp, Homo sapiens
agctgggaggcatggccctgg

SEQ ID NO: 910578 - DNA, 15 bp, Homo sapiens
agctgggcagggtga

SEQ ID NO: 910579 - DNA, 16 bp, Homo sapiens
agctgggccagccgcc

SEQ ID NO: 910580 - DNA, 20 bp, Homo sapiens
agctgggccagccgcccacc

SEQ ID NO: 910581 - DNA, 11 bp, Homo sapiens
agctgggccca

SEQ ID NO: 910582 - DNA, 20 bp, Homo sapiens
agctgggcccagcccctcca

SEQ ID NO: 910583 - DNA, 17 bp, Homo sapiens
agctgggccccacctac

SEQ ID NO: 910584 - DNA, 16 bp, Homo sapiens
agctgggccccatgct

SEQ ID NO: 910585 - DNA, 17 bp, Homo sapiens
agctgggcccctgcaca

SEQ ID NO: 910586 - DNA, 12 bp, Homo sapiens
agctgggcctgt

SEQ ID NO: 910587 - DNA, 22 bp, Homo sapiens
agctgggcctgtgcactgggca

SEQ ID NO: 910588 - DNA, 20 bp, Homo sapiens
agctcccgtgtaaataattt

SEQ ID NO: 910589 - DNA, 21 bp, Homo sapiens
agctcccgtgtaaataattta

SEQ ID NO: 910590 - DNA, 17 bp, Homo sapiens
agctccctagactgcat

SEQ ID NO: 910591 - DNA, 15 bp, Homo sapiens
agctccctaggagac

SEQ ID NO: 910592 - DNA, 12 bp, Homo sapiens
agctccctgcac

SEQ ID NO: 910593 - DNA, 14 bp, Homo sapiens
agctccctgcaccg

SEQ ID NO: 910594 - DNA, 13 bp, Homo sapiens
agctccctgcccc

SEQ ID NO: 910595 - DNA, 14 bp, Homo sapiens
agctccctggagcc

SEQ ID NO: 910596 - DNA, 17 bp, Homo sapiens
agctccctggagccctg

SEQ ID NO: 910597 - DNA, 15 bp, Homo sapiens
agctcccttccctgc

SEQ ID NO: 910598 - DNA, 14 bp, Homo sapiens
agctccgacctctc

SEQ ID NO: 910599 - DNA, 17 bp, Homo sapiens
agctccgacctctctca

SEQ ID NO: 910600 - DNA, 22 bp, Homo sapiens
agctccgacctctctcagcccc

SEQ ID NO: 910601 - DNA, 13 bp, Homo sapiens
agctccgcctgct

SEQ ID NO: 910602 - DNA, 21 bp, Homo sapiens
agctccggagggggtcctcct

SEQ ID NO: 910603 - DNA, 12 bp, Homo sapiens
agctcctcagcg

SEQ ID NO: 910604 - DNA, 16 bp, Homo sapiens
agctcctcagcggctc

SEQ ID NO: 910605 - DNA, 10 bp, Homo sapiens
agctcctcca

SEQ ID NO: 910606 - DNA, 14 bp, Homo sapiens
agctcctccagccc

SEQ ID NO: 910607 - DNA, 16 bp, Homo sapiens
agctcctccagccctg

SEQ ID NO: 910608 - DNA, 18 bp, Homo sapiens
agctcctccagccctgcc

SEQ ID NO: 910609 - DNA, 14 bp, Homo sapiens
agctcctccctgtg

SEQ ID NO: 910610 - DNA, 17 bp, Homo sapiens
agctcctccctgtgccc

SEQ ID NO: 910611 - DNA, 14 bp, Homo sapiens
agctcctcctccct

SEQ ID NO: 910612 - DNA, 15 bp, Homo sapiens
agctcctcctccctg

SEQ ID NO: 910613 - DNA, 17 bp, Homo sapiens
agctcctcctccctgca

SEQ ID NO: 910614 - DNA, 13 bp, Homo sapiens
agctcctctaggg

SEQ ID NO: 910615 - DNA, 17 bp, Homo sapiens
agctcctctaggggcag

SEQ ID NO: 910616 - DNA, 14 bp, Homo sapiens
agctcctctccttg

SEQ ID NO: 910617 - DNA, 17 bp, Homo sapiens
agctcctctgggcagga

SEQ ID NO: 910618 - DNA, 15 bp, Homo sapiens
agctcctcttccatg

SEQ ID NO: 910619 - DNA, 18 bp, Homo sapiens
agctcctcttccatgctg

SEQ ID NO: 910620 - DNA, 20 bp, Homo sapiens
agctcctgccacatggagcc

SEQ ID NO: 910621 - DNA, 21 bp, Homo sapiens
agctcctgccacatggagccc

SEQ ID NO: 910622 - DNA, 13 bp, Homo sapiens
agctcctggccag

SEQ ID NO: 910623 - DNA, 19 bp, Homo sapiens
agctcctggggagctcctg

SEQ ID NO: 910624 - DNA, 21 bp, Homo sapiens
agctcctggggagctcctggg

SEQ ID NO: 910625 - DNA, 15 bp, Homo sapiens
agctcctgtggcccc

SEQ ID NO: 910626 - DNA, 13 bp, Homo sapiens
agctccttcctgg

SEQ ID NO: 910627 - DNA, 15 bp, Homo sapiens
agctccttcctggag

SEQ ID NO: 910628 - DNA, 13 bp, Homo sapiens
agctccttcctgt

SEQ ID NO: 910629 - DNA, 19 bp, Homo sapiens
agctccttgagtaaaaagg

SEQ ID NO: 910630 - DNA, 14 bp, Homo sapiens
agctccttggagca

SEQ ID NO: 910631 - DNA, 11 bp, Homo sapiens
agctccttggc

SEQ ID NO: 910632 - DNA, 18 bp, Homo sapiens
agctccttggctgcagcc

SEQ ID NO: 910633 - DNA, 19 bp, Homo sapiens
agctccttggctgcagcca

SEQ ID NO: 910634 - DNA, 20 bp, Homo sapiens
agctccttggctgcagccat

SEQ ID NO: 910635 - DNA, 19 bp, Homo sapiens
agctcctttctcctgtgaa

SEQ ID NO: 910636 - DNA, 18 bp, Homo sapiens
agctccttttgtccccag

SEQ ID NO: 910637 - DNA, 19 bp, Homo sapiens
agctccttttgtccccagg

SEQ ID NO: 910638 - DNA, 22 bp, Homo sapiens
agctccttttgtccccagggcc

SEQ ID NO: 910639 - DNA, 16 bp, Homo sapiens
agctcgcagcccccgc

SEQ ID NO: 910640 - DNA, 18 bp, Homo sapiens
agctcgcccctcccctca

SEQ ID NO: 910641 - DNA, 21 bp, Homo sapiens
agctcgcccctcccctcagcc

SEQ ID NO: 910642 - DNA, 15 bp, Homo sapiens
agctcgggtctccct

SEQ ID NO: 910643 - DNA, 20 bp, Homo sapiens
agctcggtggacccagggat

SEQ ID NO: 910644 - DNA, 17 bp, Homo sapiens
agctctaagcagccagg

SEQ ID NO: 910645 - DNA, 19 bp, Homo sapiens
agctctaagcagccaggag

SEQ ID NO: 910646 - DNA, 17 bp, Homo sapiens
agctctaataagtttgt

SEQ ID NO: 910647 - DNA, 17 bp, Homo sapiens
agctctactgcctcaac

SEQ ID NO: 910648 - DNA, 19 bp, Homo sapiens
agctctagacaaccctgca

SEQ ID NO: 910649 - DNA, 19 bp, Homo sapiens
agctctagttttcagcctt

SEQ ID NO: 910650 - DNA, 22 bp, Homo sapiens
agctctatcaccaaggagccaa

SEQ ID NO: 910651 - DNA, 20 bp, Homo sapiens
agctctattaagatttccaa

SEQ ID NO: 910652 - DNA, 14 bp, Homo sapiens
agctctccaggcca

SEQ ID NO: 910653 - DNA, 19 bp, Homo sapiens
agctctcccacatcccact

SEQ ID NO: 910654 - DNA, 22 bp, Homo sapiens
agctctcccctcccttgtcctt

SEQ ID NO: 910655 - DNA, 15 bp, Homo sapiens
agctctcccctcctg

SEQ ID NO: 910656 - DNA, 13 bp, Homo sapiens
agctctccctctg

SEQ ID NO: 910657 - DNA, 17 bp, Homo sapiens
agctctccctctggccc

SEQ ID NO: 910658 - DNA, 23 bp, Homo sapiens
agctctccctctggccctgcctt

SEQ ID NO: 910659 - DNA, 16 bp, Homo sapiens
agctctcccttgttta

SEQ ID NO: 910660 - DNA, 17 bp, Homo sapiens
agctctcctgactttta

SEQ ID NO: 910661 - DNA, 22 bp, Homo sapiens
agctctcgggactagctgcctt

SEQ ID NO: 910662 - DNA, 17 bp, Homo sapiens
agctctcgttctccttc

SEQ ID NO: 910663 - DNA, 18 bp, Homo sapiens
agctctctaggcctctcc

SEQ ID NO: 910664 - DNA, 11 bp, Homo sapiens
agctctctgac

SEQ ID NO: 910665 - DNA, 22 bp, Homo sapiens
agctctctgacgcttgtgacag

SEQ ID NO: 910666 - DNA, 15 bp, Homo sapiens
agctctctgcatcta

SEQ ID NO: 910667 - DNA, 13 bp, Homo sapiens
agctctctgccct

SEQ ID NO: 910668 - DNA, 23 bp, Homo sapiens
agctctgaacaaacactgaatca

SEQ ID NO: 910669 - DNA, 22 bp, Homo sapiens
agctctgaagaactctctggaa

SEQ ID NO: 910670 - DNA, 21 bp, Homo sapiens
agctctgaagtcacatcacag

SEQ ID NO: 910671 - DNA, 15 bp, Homo sapiens
agctctgacatccct

SEQ ID NO: 910672 - DNA, 17 bp, Homo sapiens
agctctgacatcccttc

SEQ ID NO: 910673 - DNA, 21 bp, Homo sapiens
agctctgacatcccttcctgg

SEQ ID NO: 910674 - DNA, 22 bp, Homo sapiens
agctctgacatcccttcctgga

SEQ ID NO: 910675 - DNA, 23 bp, Homo sapiens
agctctgagacccttttctcagg

SEQ ID NO: 910676 - DNA, 15 bp, Homo sapiens
agctctgaggggagg

SEQ ID NO: 910677 - DNA, 20 bp, Homo sapiens
agctctgaggggaggcacct

SEQ ID NO: 910678 - DNA, 12 bp, Homo sapiens
agctctgcatta

SEQ ID NO: 910679 - DNA, 12 bp, Homo sapiens
agctctgccccc

SEQ ID NO: 910680 - DNA, 19 bp, Homo sapiens
agctctgccgtctctggag

SEQ ID NO: 910681 - DNA, 16 bp, Homo sapiens
agctctgcgccaggca

SEQ ID NO: 910682 - DNA, 17 bp, Homo sapiens
agctctgcgccaggcag

SEQ ID NO: 910683 - DNA, 22 bp, Homo sapiens
agctctgcgccaggcagagctg

SEQ ID NO: 910684 - DNA, 15 bp, Homo sapiens
agctctggaccagcc

SEQ ID NO: 910685 - DNA, 17 bp, Homo sapiens
agctctggaggggaggg

SEQ ID NO: 910686 - DNA, 18 bp, Homo sapiens
agctctggaggggagggg

SEQ ID NO: 910687 - DNA, 20 bp, Homo sapiens
agctctggaggtgctgctct

SEQ ID NO: 910688 - DNA, 18 bp, Homo sapiens
agctctggatgaaggcaa

SEQ ID NO: 910689 - DNA, 17 bp, Homo sapiens
agctctggcttcctgct

SEQ ID NO: 910690 - DNA, 18 bp, Homo sapiens
agctctggcttcctgctg

SEQ ID NO: 910691 - DNA, 18 bp, Homo sapiens
agctctgggagaggattt

SEQ ID NO: 910692 - DNA, 22 bp, Homo sapiens
agctctggggacagcttcctca

SEQ ID NO: 910693 - DNA, 21 bp, Homo sapiens
agctctggggatgggtgggga

SEQ ID NO: 910694 - DNA, 14 bp, Homo sapiens
agctctggggtggg

SEQ ID NO: 910695 - DNA, 19 bp, Homo sapiens
agctctggggtgggcagtt

SEQ ID NO: 910696 - DNA, 18 bp, Homo sapiens
agctctggttatttttct

SEQ ID NO: 910697 - DNA, 12 bp, Homo sapiens
agctctgtatca

SEQ ID NO: 910698 - DNA, 14 bp, Homo sapiens
agctctgtggaatt

SEQ ID NO: 910699 - DNA, 15 bp, Homo sapiens
agctctgtggcctgt

SEQ ID NO: 910700 - DNA, 17 bp, Homo sapiens
agctcttactctttcct

SEQ ID NO: 910701 - DNA, 19 bp, Homo sapiens
agctcttactctttcctat

SEQ ID NO: 910702 - DNA, 18 bp, Homo sapiens
agctcttagtctctttgg

SEQ ID NO: 910703 - DNA, 15 bp, Homo sapiens
agctcttcatttctg

SEQ ID NO: 910704 - DNA, 21 bp, Homo sapiens
agctcttctggagtttctcta

SEQ ID NO: 910705 - DNA, 14 bp, Homo sapiens
agctcttctgggca

SEQ ID NO: 910706 - DNA, 15 bp, Homo sapiens
agctcttctgggcag

SEQ ID NO: 910707 - DNA, 22 bp, Homo sapiens
agctcttctgggcagagcctgt

SEQ ID NO: 910708 - DNA, 18 bp, Homo sapiens
agctcttcttaaagtatt

SEQ ID NO: 910709 - DNA, 19 bp, Homo sapiens
agctcttgcccttccctgt

SEQ ID NO: 910710 - DNA, 22 bp, Homo sapiens
agctcttgcccttccctgtccc

SEQ ID NO: 910711 - DNA, 18 bp, Homo sapiens
agctcttgctctcttgtg

SEQ ID NO: 910712 - DNA, 16 bp, Homo sapiens
agctcttggaagagct

SEQ ID NO: 910713 - DNA, 17 bp, Homo sapiens
cattctacacagagcag

SEQ ID NO: 910714 - DNA, 19 bp, Homo sapiens
cattctacacagagcagga

SEQ ID NO: 910715 - DNA, 14 bp, Homo sapiens
cattctacacctgg

SEQ ID NO: 910716 - DNA, 16 bp, Homo sapiens
cattctacagaataat

SEQ ID NO: 910717 - DNA, 20 bp, Homo sapiens
cattctacagaataatccag

SEQ ID NO: 910718 - DNA, 16 bp, Homo sapiens
cattctacttcagctt

SEQ ID NO: 910719 - DNA, 17 bp, Homo sapiens
cattctacttcagcttt

SEQ ID NO: 910720 - DNA, 11 bp, Homo sapiens
cattctagatc

SEQ ID NO: 910721 - DNA, 21 bp, Homo sapiens
cattctagatgcaagtctctt

SEQ ID NO: 910722 - DNA, 16 bp, Homo sapiens
cattctaggatgtgga

SEQ ID NO: 910723 - DNA, 14 bp, Homo sapiens
cattctatctactg

SEQ ID NO: 910724 - DNA, 17 bp, Homo sapiens
cattctatgacattttt

SEQ ID NO: 910725 - DNA, 17 bp, Homo sapiens
cattctattttagaata

SEQ ID NO: 910726 - DNA, 17 bp, Homo sapiens
cattctcactcctacct

SEQ ID NO: 910727 - DNA, 16 bp, Homo sapiens
cattctcataattcct

SEQ ID NO: 910728 - DNA, 14 bp, Homo sapiens
cattctcatctgca

SEQ ID NO: 910729 - DNA, 15 bp, Homo sapiens
cattctcatctgcac

SEQ ID NO: 910730 - DNA, 23 bp, Homo sapiens
cattctcatctgcacccttcttt

SEQ ID NO: 910731 - DNA, 12 bp, Homo sapiens
cattctcccagt

SEQ ID NO: 910732 - DNA, 19 bp, Homo sapiens
cattctcccagtctctgtc

SEQ ID NO: 910733 - DNA, 16 bp, Homo sapiens
cattctcctcatgctt

SEQ ID NO: 910734 - DNA, 17 bp, Homo sapiens
cattctcgcttccctga

SEQ ID NO: 910735 - DNA, 19 bp, Homo sapiens
cattctcgtgagtcattta

SEQ ID NO: 910736 - DNA, 18 bp, Homo sapiens
cattctctcccatcctgg

SEQ ID NO: 910737 - DNA, 21 bp, Homo sapiens
cattctctcccatcctggggc

SEQ ID NO: 910738 - DNA, 16 bp, Homo sapiens
cattctctctcctgta

SEQ ID NO: 910739 - DNA, 11 bp, Homo sapiens
cattctgaatg

SEQ ID NO: 910740 - DNA, 13 bp, Homo sapiens
cattctgaatgct

SEQ ID NO: 910741 - DNA, 18 bp, Homo sapiens
cattctgaatgcttctaa

SEQ ID NO: 910742 - DNA, 20 bp, Homo sapiens
cattctgaattaattaattt

SEQ ID NO: 910743 - DNA, 23 bp, Homo sapiens
cattctgaattaattaatttgga

SEQ ID NO: 910744 - DNA, 21 bp, Homo sapiens
cattctgactcggtttctcca

SEQ ID NO: 910745 - DNA, 17 bp, Homo sapiens
cattctgagctccccat

SEQ ID NO: 910746 - DNA, 13 bp, Homo sapiens
cattctgagctgg

SEQ ID NO: 910747 - DNA, 17 bp, Homo sapiens
cattctgataggagggg

SEQ ID NO: 910748 - DNA, 15 bp, Homo sapiens
cattctgatgagcaa

SEQ ID NO: 910749 - DNA, 22 bp, Homo sapiens
cattctgattcgaatgacactg

SEQ ID NO: 910750 - DNA, 20 bp, Homo sapiens
cattctgatttggaaaaaga

SEQ ID NO: 910751 - DNA, 16 bp, Homo sapiens
cattctgcacgctgcc

SEQ ID NO: 910752 - DNA, 15 bp, Homo sapiens
cattctgcattgcta

SEQ ID NO: 910753 - DNA, 20 bp, Homo sapiens
cattctgcattgctagataa

SEQ ID NO: 910754 - DNA, 18 bp, Homo sapiens
cattctgccgccccctcc

SEQ ID NO: 910755 - DNA, 14 bp, Homo sapiens
cattctgcctgctc

SEQ ID NO: 910756 - DNA, 15 bp, Homo sapiens
cattctgcctgctcc

SEQ ID NO: 910757 - DNA, 20 bp, Homo sapiens
cattctggggaaacaacatt

SEQ ID NO: 910758 - DNA, 18 bp, Homo sapiens
cattctggtgaccagact

SEQ ID NO: 910759 - DNA, 17 bp, Homo sapiens
cattctgttaatcatta

SEQ ID NO: 910760 - DNA, 18 bp, Homo sapiens
agtggggttatctctgtg

SEQ ID NO: 910761 - DNA, 15 bp, Homo sapiens
agtgggtacatcaag

SEQ ID NO: 910762 - DNA, 14 bp, Homo sapiens
agtgggtctgggat

SEQ ID NO: 910763 - DNA, 23 bp, Homo sapiens
agtgggtctgggatatggctgcc

SEQ ID NO: 910764 - DNA, 15 bp, Homo sapiens
agtgggtggcacctc

SEQ ID NO: 910765 - DNA, 15 bp, Homo sapiens
agtgggtttcacaag

SEQ ID NO: 910766 - DNA, 16 bp, Homo sapiens
agtggtaagctctggc

SEQ ID NO: 910767 - DNA, 19 bp, Homo sapiens
agtggtaagctctggcttt

SEQ ID NO: 910768 - DNA, 18 bp, Homo sapiens
agtggtaatcatatgtgt

SEQ ID NO: 910769 - DNA, 18 bp, Homo sapiens
agtggtagtaatttcctt

SEQ ID NO: 910770 - DNA, 15 bp, Homo sapiens
agtggtatgtctctt

SEQ ID NO: 910771 - DNA, 16 bp, Homo sapiens
agtggtcactggtcag

SEQ ID NO: 910772 - DNA, 17 bp, Homo sapiens
agtggtcactggtcagg

SEQ ID NO: 910773 - DNA, 21 bp, Homo sapiens
agtggtcactggtcagggcag

SEQ ID NO: 910774 - DNA, 15 bp, Homo sapiens
agtggtcataaaata

SEQ ID NO: 910775 - DNA, 20 bp, Homo sapiens
agtggtctttcctatcatgg

SEQ ID NO: 910776 - DNA, 16 bp, Homo sapiens
agtggtctttctggag

SEQ ID NO: 910777 - DNA, 18 bp, Homo sapiens
agtggtctttctggagag

SEQ ID NO: 910778 - DNA, 17 bp, Homo sapiens
agtggtgaccaaaattt

SEQ ID NO: 910779 - DNA, 21 bp, Homo sapiens
agtggtgaccaaaatttttag

SEQ ID NO: 910780 - DNA, 19 bp, Homo sapiens
agtggtgagtggaagggag

SEQ ID NO: 910781 - DNA, 22 bp, Homo sapiens
agtggtgcaatcacagctcact

SEQ ID NO: 910782 - DNA, 19 bp, Homo sapiens
agtggtgctataagtttta

SEQ ID NO: 910783 - DNA, 19 bp, Homo sapiens
agtggtggtaaccctggtg

SEQ ID NO: 910784 - DNA, 17 bp, Homo sapiens
agtggtggttttctgtt

SEQ ID NO: 910785 - DNA, 18 bp, Homo sapiens
agtggtggttttctgttc

SEQ ID NO: 910786 - DNA, 23 bp, Homo sapiens
agtggtggttttctgttctttct

SEQ ID NO: 910787 - DNA, 20 bp, Homo sapiens
agtggttattcattattcct

SEQ ID NO: 910788 - DNA, 22 bp, Homo sapiens
agtggttattcattattcctca

SEQ ID NO: 910789 - DNA, 16 bp, Homo sapiens
agtggtttctacttcc

SEQ ID NO: 910790 - DNA, 18 bp, Homo sapiens
agtggtttgcaggtcagc

SEQ ID NO: 910791 - DNA, 17 bp, Homo sapiens
agtggttttatactgaa

SEQ ID NO: 910792 - DNA, 11 bp, Homo sapiens
agtgtaaaata

SEQ ID NO: 910793 - DNA, 14 bp, Homo sapiens
agtgtaaataattt

SEQ ID NO: 910794 - DNA, 21 bp, Homo sapiens
agtgtaaatcctttttcttta

SEQ ID NO: 910795 - DNA, 23 bp, Homo sapiens
agtgtaacaattgtgtagccttt

SEQ ID NO: 910796 - DNA, 17 bp, Homo sapiens
agtgtaacagctgaggt

SEQ ID NO: 910797 - DNA, 20 bp, Homo sapiens
agtgtaacttgcttaaattt

SEQ ID NO: 910798 - DNA, 12 bp, Homo sapiens
agtgtaagaact

SEQ ID NO: 910799 - DNA, 14 bp, Homo sapiens
agtgtaagaactgt

SEQ ID NO: 910800 - DNA, 14 bp, Homo sapiens
agtgtaataatgtt

SEQ ID NO: 910801 - DNA, 17 bp, Homo sapiens
agtgtacaattgatctt

SEQ ID NO: 910802 - DNA, 13 bp, Homo sapiens
agtgtacagtctt

SEQ ID NO: 910803 - DNA, 21 bp, Homo sapiens
agtgtacatggaataacatgt

SEQ ID NO: 910804 - DNA, 18 bp, Homo sapiens
agtgtacatttatgttcc

SEQ ID NO: 910805 - DNA, 22 bp, Homo sapiens
agtgtacccatctttaatttat

SEQ ID NO: 910806 - DNA, 14 bp, Homo sapiens
agtgtacctcctct

SEQ ID NO: 910807 - DNA, 17 bp, Homo sapiens
agtgtacctcctctcag

SEQ ID NO: 910808 - DNA, 21 bp, Homo sapiens
agtgtacctcctctcagtgtt

SEQ ID NO: 910809 - DNA, 17 bp, Homo sapiens
agtgtacctgtgtacat

SEQ ID NO: 910810 - DNA, 20 bp, Homo sapiens
agtgtacctgtgtacataac

SEQ ID NO: 910811 - DNA, 15 bp, Homo sapiens
agtgtactgtgcctg

SEQ ID NO: 910812 - DNA, 16 bp, Homo sapiens
agtgtactgtgcctgg

SEQ ID NO: 910813 - DNA, 20 bp, Homo sapiens
agtgtagaacctaattcaat

SEQ ID NO: 910814 - DNA, 19 bp, Homo sapiens
agtgtagaagaaaatatcc

SEQ ID NO: 910815 - DNA, 20 bp, Homo sapiens
agtgtagacctgagctggga

SEQ ID NO: 910816 - DNA, 18 bp, Homo sapiens
agtgtagatgtagcattg

SEQ ID NO: 910817 - DNA, 14 bp, Homo sapiens
agtgtagattttat

SEQ ID NO: 910818 - DNA, 19 bp, Homo sapiens
agtgtagcctaaagggcag

SEQ ID NO: 910819 - DNA, 18 bp, Homo sapiens
agtgtagccttgcccgga

SEQ ID NO: 910820 - DNA, 19 bp, Homo sapiens
agtgtagcgggaggaagcc

SEQ ID NO: 910821 - DNA, 13 bp, Homo sapiens
agtgtagctgcca

SEQ ID NO: 910822 - DNA, 14 bp, Homo sapiens
agtgtagctgtaag

SEQ ID NO: 910823 - DNA, 21 bp, Homo sapiens
agtgtagctgtaagggcagtg

SEQ ID NO: 910824 - DNA, 15 bp, Homo sapiens
agtgtagctgtgaaa

SEQ ID NO: 910825 - DNA, 16 bp, Homo sapiens
agtgtagctgtgaaat

SEQ ID NO: 910826 - DNA, 23 bp, Homo sapiens
agtgtagctgtgtggctttcctt

SEQ ID NO: 910827 - DNA, 21 bp, Homo sapiens
agtgtaggataatataaaaag

SEQ ID NO: 910828 - DNA, 16 bp, Homo sapiens
agtgtaggcagacaca

SEQ ID NO: 910829 - DNA, 13 bp, Homo sapiens
agtgtataaatcc

SEQ ID NO: 910830 - DNA, 21 bp, Homo sapiens
agtgtatactctgtagtctca

SEQ ID NO: 910831 - DNA, 23 bp, Homo sapiens
agtgtatactctgtagtctcagt

SEQ ID NO: 910832 - DNA, 16 bp, Homo sapiens
agtgtatatatattta

SEQ ID NO: 910833 - DNA, 18 bp, Homo sapiens
agtgtatgactgcacatg

SEQ ID NO: 910834 - DNA, 20 bp, Homo sapiens
agtgtatgagttgcatttgt

SEQ ID NO: 910835 - DNA, 19 bp, Homo sapiens
agtgtatgattactggcct

SEQ ID NO: 910836 - DNA, 20 bp, Homo sapiens
agtgtatggaaataaatgta

SEQ ID NO: 910837 - DNA, 14 bp, Homo sapiens
agtgtatggggcag

SEQ ID NO: 910838 - DNA, 13 bp, Homo sapiens
agtgtatgtgtgt

SEQ ID NO: 910839 - DNA, 15 bp, Homo sapiens
agtgtattacaacaa

SEQ ID NO: 910840 - DNA, 21 bp, Homo sapiens
cattgctgcctttgtccccac

SEQ ID NO: 910841 - DNA, 22 bp, Homo sapiens
cattgctgctgctaccagcgcc

SEQ ID NO: 910842 - DNA, 13 bp, Homo sapiens
cattgctggacta

SEQ ID NO: 910843 - DNA, 23 bp, Homo sapiens
cattgctggtagagacccccagg

SEQ ID NO: 910844 - DNA, 15 bp, Homo sapiens
cattgctgtcttgcc

SEQ ID NO: 910845 - DNA, 17 bp, Homo sapiens
cattgctgtcttgcccc

SEQ ID NO: 910846 - DNA, 21 bp, Homo sapiens
cattgctgttgtccctctgct

SEQ ID NO: 910847 - DNA, 18 bp, Homo sapiens
cattgcttattcttgagc

SEQ ID NO: 910848 - DNA, 11 bp, Homo sapiens
cattgcttcac

SEQ ID NO: 910849 - DNA, 18 bp, Homo sapiens
cattgctttcgtgtaaat

SEQ ID NO: 910850 - DNA, 20 bp, Homo sapiens
cattgctttgccctggagca

SEQ ID NO: 910851 - DNA, 15 bp, Homo sapiens
cattggaagacccca

SEQ ID NO: 910852 - DNA, 17 bp, Homo sapiens
cattggaatgccttgga

SEQ ID NO: 910853 - DNA, 22 bp, Homo sapiens
cattggagaagcggtggataac

SEQ ID NO: 910854 - DNA, 18 bp, Homo sapiens
cattggatattttttact

SEQ ID NO: 910855 - DNA, 23 bp, Homo sapiens
cattggcaagatgaaataatttt

SEQ ID NO: 910856 - DNA, 16 bp, Homo sapiens
cattggcccctgagcc

SEQ ID NO: 910857 - DNA, 12 bp, Homo sapiens
cattggcctctt

SEQ ID NO: 910858 - DNA, 21 bp, Homo sapiens
cattggcctcttgtcccttgg

SEQ ID NO: 910859 - DNA, 19 bp, Homo sapiens
cattggctcagcccgctga

SEQ ID NO: 910860 - DNA, 23 bp, Homo sapiens
cattgggaaggggacccccgccc

SEQ ID NO: 910861 - DNA, 16 bp, Homo sapiens
cattgggcacagtcca

SEQ ID NO: 910862 - DNA, 19 bp, Homo sapiens
cattgggtgggtaaattca

SEQ ID NO: 910863 - DNA, 21 bp, Homo sapiens
cattgggtttggggccatggt

SEQ ID NO: 910864 - DNA, 23 bp, Homo sapiens
cattgggtttggggccatggtgg

SEQ ID NO: 910865 - DNA, 13 bp, Homo sapiens
cattggtgttgtc

SEQ ID NO: 910866 - DNA, 15 bp, Homo sapiens
cattggttcttcctt

SEQ ID NO: 910867 - DNA, 22 bp, Homo sapiens
cattggttcttcctttccctgg

SEQ ID NO: 910868 - DNA, 23 bp, Homo sapiens
cattggttcttcctttccctgga

SEQ ID NO: 910869 - DNA, 23 bp, Homo sapiens
cattgtaaaagcattttgtaata

SEQ ID NO: 910870 - DNA, 13 bp, Homo sapiens
cattgtaaagtat

SEQ ID NO: 910871 - DNA, 15 bp, Homo sapiens
cattgtaatgttact

SEQ ID NO: 910872 - DNA, 17 bp, Homo sapiens
cattgtaatgttactga

SEQ ID NO: 910873 - DNA, 15 bp, Homo sapiens
cattgtactacctgt

SEQ ID NO: 910874 - DNA, 15 bp, Homo sapiens
cattgtactccagcc

SEQ ID NO: 910875 - DNA, 17 bp, Homo sapiens
cattgtactccagcctg

SEQ ID NO: 910876 - DNA, 21 bp, Homo sapiens
cattgtactgttgctttaata

SEQ ID NO: 910877 - DNA, 22 bp, Homo sapiens
cattgtactgttgctttaatat

SEQ ID NO: 910878 - DNA, 21 bp, Homo sapiens
cattgtagaaacacagttttg

SEQ ID NO: 910879 - DNA, 16 bp, Homo sapiens
cattgtagagcttctg

SEQ ID NO: 910880 - DNA, 21 bp, Homo sapiens
cattgtagagcttctggcact

SEQ ID NO: 910881 - DNA, 20 bp, Homo sapiens
cattgtatagatataatgaa

SEQ ID NO: 910882 - DNA, 21 bp, Homo sapiens
cattgtataggccatctgtaa

SEQ ID NO: 910883 - DNA, 22 bp, Homo sapiens
cattgtatatatgtgtgtttaa

SEQ ID NO: 910884 - DNA, 17 bp, Homo sapiens
cattgtatctgtctttc

SEQ ID NO: 910885 - DNA, 18 bp, Homo sapiens
cattgtatgatgtgttgt

SEQ ID NO: 910886 - DNA, 20 bp, Homo sapiens
cattgtatgatgtgttgtga

SEQ ID NO: 910887 - DNA, 17 bp, Homo sapiens
cattgtatgcagggagc

SEQ ID NO: 910888 - DNA, 23 bp, Homo sapiens
cattgtcatcagaggggagcagc

SEQ ID NO: 910889 - DNA, 15 bp, Homo sapiens
cattgtccctctgcc

SEQ ID NO: 910890 - DNA, 19 bp, Homo sapiens
cattgtccctctgccccat

SEQ ID NO: 910891 - DNA, 18 bp, Homo sapiens
cattgtccctcttcactc

SEQ ID NO: 910892 - DNA, 20 bp, Homo sapiens
cattgtccctctttggaaca

SEQ ID NO: 910893 - DNA, 22 bp, Homo sapiens
cattgtctaatctgtagaagct

SEQ ID NO: 910894 - DNA, 22 bp, Homo sapiens
cattgtctactcctagaagaac

SEQ ID NO: 910895 - DNA, 15 bp, Homo sapiens
cattgtctttgctgt

SEQ ID NO: 910896 - DNA, 19 bp, Homo sapiens
cattgtctttgctgtactc

SEQ ID NO: 910897 - DNA, 15 bp, Homo sapiens
cattgtgaaccaatg

SEQ ID NO: 910898 - DNA, 16 bp, Homo sapiens
cattgtgaagcaccta

SEQ ID NO: 910899 - DNA, 13 bp, Homo sapiens
cattgtgacttgg

SEQ ID NO: 910900 - DNA, 15 bp, Homo sapiens
cattgtgacttggag

SEQ ID NO: 910901 - DNA, 18 bp, Homo sapiens
cattgtgattggcctgta

SEQ ID NO: 910902 - DNA, 15 bp, Homo sapiens
cattgtggaagacag

SEQ ID NO: 910903 - DNA, 18 bp, Homo sapiens
cattgtgtgatccagccc

SEQ ID NO: 910904 - DNA, 22 bp, Homo sapiens
cattgtgtgatccagccctggt

SEQ ID NO: 910905 - DNA, 16 bp, Homo sapiens
cattgtgtggcctggt

SEQ ID NO: 910906 - DNA, 18 bp, Homo sapiens
cattgttacctctatata

SEQ ID NO: 910907 - DNA, 16 bp, Homo sapiens
cattgttattgtggaa

SEQ ID NO: 910908 - DNA, 16 bp, Homo sapiens
cattgttatttataca

SEQ ID NO: 910909 - DNA, 15 bp, Homo sapiens
cattgttcccttcct

SEQ ID NO: 910910 - DNA, 19 bp, Homo sapiens
cattgttcttattctggca

SEQ ID NO: 910911 - DNA, 21 bp, Homo sapiens
cattgttgaggtggtctgaat

SEQ ID NO: 910912 - DNA, 20 bp, Homo sapiens
cattgttggagtgtaaacca

SEQ ID NO: 910913 - DNA, 14 bp, Homo sapiens
cattgtttgcttat

SEQ ID NO: 910914 - DNA, 17 bp, Homo sapiens
cattgtttgcttattgt

SEQ ID NO: 910915 - DNA, 18 bp, Homo sapiens
cattgtttgtctgtcttc

SEQ ID NO: 910916 - DNA, 12 bp, Homo sapiens
catttaaaaaaa

SEQ ID NO: 910917 - DNA, 15 bp, Homo sapiens
catttaaaaaaaatc

SEQ ID NO: 910918 - DNA, 15 bp, Homo sapiens
catttaaaaaaatca

SEQ ID NO: 910919 - DNA, 20 bp, Homo sapiens
catttaaaaagctcactgct

SEQ ID NO: 910920 - DNA, 23 bp, Homo sapiens
catttaaaaagctcactgctgat

SEQ ID NO: 910921 - DNA, 12 bp, Homo sapiens
catttaaaacag

SEQ ID NO: 910922 - DNA, 17 bp, Homo sapiens
catttaaaacagacact

SEQ ID NO: 910923 - DNA, 19 bp, Homo sapiens
catttaaaacattaaaata

SEQ ID NO: 910924 - DNA, 12 bp, Homo sapiens
catttaaaatga

SEQ ID NO: 910925 - DNA, 17 bp, Homo sapiens
catttaaaatgattaga

SEQ ID NO: 910926 - DNA, 22 bp, Homo sapiens
catttaaaatggaaaagagaga

SEQ ID NO: 910927 - DNA, 15 bp, Homo sapiens
catttaaaattgcta

SEQ ID NO: 910928 - DNA, 19 bp, Homo sapiens
catttaaaattgctatgtt

SEQ ID NO: 910929 - DNA, 14 bp, Homo sapiens
catttaaacccaat

SEQ ID NO: 910930 - DNA, 13 bp, Homo sapiens
catttaaactctg

SEQ ID NO: 910931 - DNA, 20 bp, Homo sapiens
catttaaactttttaaaata

SEQ ID NO: 910932 - DNA, 21 bp, Homo sapiens
catttaaactttttaaaatac

SEQ ID NO: 910933 - DNA, 19 bp, Homo sapiens
catttaaagctaaattttg

SEQ ID NO: 910934 - DNA, 20 bp, Homo sapiens
catttaaatacagtcttcca

SEQ ID NO: 910935 - DNA, 20 bp, Homo sapiens
catttaaatgtgtacaatgt

SEQ ID NO: 910936 - DNA, 17 bp, Homo sapiens
catttaaattccacaga

SEQ ID NO: 910937 - DNA, 23 bp, Homo sapiens
catttaaattttaccctttagac

SEQ ID NO: 910938 - DNA, 22 bp, Homo sapiens
catttaacataatggttgtgaa

SEQ ID NO: 910939 - DNA, 14 bp, Homo sapiens
catttaacattgtt

SEQ ID NO: 910940 - DNA, 15 bp, Homo sapiens
catttaagagactct

SEQ ID NO: 910941 - DNA, 16 bp, Homo sapiens
catttaagggaaaaat

SEQ ID NO: 910942 - DNA, 19 bp, Homo sapiens
catttaagggaaaaatata

SEQ ID NO: 910943 - DNA, 22 bp, Homo sapiens
catttaagggaaaaatatatat

SEQ ID NO: 910944 - DNA, 23 bp, Homo sapiens
catttaagtatcttgtgcttctt

SEQ ID NO: 910945 - DNA, 17 bp, Homo sapiens
catttaataaagatgag

SEQ ID NO: 910946 - DNA, 18 bp, Homo sapiens
catttaataaagatgagt

SEQ ID NO: 910947 - DNA, 19 bp, Homo sapiens
catttaataatatcaaaga

SEQ ID NO: 910948 - DNA, 16 bp, Homo sapiens
catttacaaactgaag

SEQ ID NO: 910949 - DNA, 18 bp, Homo sapiens
catttacaataaatattc

SEQ ID NO: 910950 - DNA, 19 bp, Homo sapiens
catttacaataaatattct

SEQ ID NO: 910951 - DNA, 11 bp, Homo sapiens
catttacacac

SEQ ID NO: 910952 - DNA, 13 bp, Homo sapiens
catttacaggagg

SEQ ID NO: 910953 - DNA, 22 bp, Homo sapiens
catttacaggagggcccggaga

SEQ ID NO: 910954 - DNA, 16 bp, Homo sapiens
catttacagtctcttt

SEQ ID NO: 910955 - DNA, 18 bp, Homo sapiens
catttaccaaattgcttg

SEQ ID NO: 910956 - DNA, 19 bp, Homo sapiens
catttaccaaattgcttga

SEQ ID NO: 910957 - DNA, 14 bp, Homo sapiens
catttactgacact

SEQ ID NO: 910958 - DNA, 14 bp, Homo sapiens
catttacttaagac

SEQ ID NO: 910959 - DNA, 16 bp, Homo sapiens
catttacttaagactt

SEQ ID NO: 910960 - DNA, 17 bp, Homo sapiens
catttacttaagactta

SEQ ID NO: 910961 - DNA, 12 bp, Homo sapiens
catttagaaaag

SEQ ID NO: 910962 - DNA, 15 bp, Homo sapiens
catttagaaaagtga

SEQ ID NO: 910963 - DNA, 19 bp, Homo sapiens
catttagaactttctgctt

SEQ ID NO: 910964 - DNA, 12 bp, Homo sapiens
agtgtatttatt

SEQ ID NO: 910965 - DNA, 14 bp, Homo sapiens
agtgtatttggaaa

SEQ ID NO: 910966 - DNA, 15 bp, Homo sapiens
agtgtattttattca

SEQ ID NO: 910967 - DNA, 16 bp, Homo sapiens
agtgtatttttcaata

SEQ ID NO: 910968 - DNA, 15 bp, Homo sapiens
agtgtcaagttgtgc

SEQ ID NO: 910969 - DNA, 18 bp, Homo sapiens
agtgtcaagttgtgcttg

SEQ ID NO: 910970 - DNA, 17 bp, Homo sapiens
agtgtcaccctgtgggt

SEQ ID NO: 910971 - DNA, 15 bp, Homo sapiens
agtgtcactggtcag

SEQ ID NO: 910972 - DNA, 20 bp, Homo sapiens
agtgtcagaatcagaatcat

SEQ ID NO: 910973 - DNA, 20 bp, Homo sapiens
agtgtcatatgtaggtgtct

SEQ ID NO: 910974 - DNA, 14 bp, Homo sapiens
agtgtccagcttcc

SEQ ID NO: 910975 - DNA, 21 bp, Homo sapiens
agtgtccccatgggctcccac

SEQ ID NO: 910976 - DNA, 16 bp, Homo sapiens
agtgtccccccttgaa

SEQ ID NO: 910977 - DNA, 18 bp, Homo sapiens
agtgtccccccttgaagc

SEQ ID NO: 910978 - DNA, 21 bp, Homo sapiens
agtgtccccccttgaagcaat

SEQ ID NO: 910979 - DNA, 22 bp, Homo sapiens
agtgtccccccttgaagcaata

SEQ ID NO: 910980 - DNA, 20 bp, Homo sapiens
agtgtcctgtgctttctgca

SEQ ID NO: 910981 - DNA, 14 bp, Homo sapiens
agtgtctcaaagga

SEQ ID NO: 910982 - DNA, 23 bp, Homo sapiens
agtgtctcaaaggagctttctca

SEQ ID NO: 910983 - DNA, 13 bp, Homo sapiens
agtgtctccacct

SEQ ID NO: 910984 - DNA, 22 bp, Homo sapiens
agtgtctcggagggattcccct

SEQ ID NO: 910985 - DNA, 16 bp, Homo sapiens
agtgtctggaattgtg

SEQ ID NO: 910986 - DNA, 21 bp, Homo sapiens
agtgtctggaattgtggctat

SEQ ID NO: 910987 - DNA, 21 bp, Homo sapiens
agtgtctggatcagtaaaatt

SEQ ID NO: 910988 - DNA, 21 bp, Homo sapiens
agtgtctgggtttggcccaag

SEQ ID NO: 910989 - DNA, 22 bp, Homo sapiens
agtgtctgggtttggcccaaga

SEQ ID NO: 910990 - DNA, 22 bp, Homo sapiens
agtgtctgtatcggagacagtg

SEQ ID NO: 910991 - DNA, 20 bp, Homo sapiens
agtgtctgtccatctgtctg

SEQ ID NO: 910992 - DNA, 12 bp, Homo sapiens
agtgtctgtgag

SEQ ID NO: 910993 - DNA, 22 bp, Homo sapiens
agtgtctgtgtgcaagtgtgtg

SEQ ID NO: 910994 - DNA, 13 bp, Homo sapiens
agtgtctgttcag

SEQ ID NO: 910995 - DNA, 16 bp, Homo sapiens
agtgtctgttcagcaa

SEQ ID NO: 910996 - DNA, 15 bp, Homo sapiens
agtgtcttccataat

SEQ ID NO: 910997 - DNA, 21 bp, Homo sapiens
agtgtcttctgttcccaagga

SEQ ID NO: 910998 - DNA, 14 bp, Homo sapiens
agtgtctttctagc

SEQ ID NO: 910999 - DNA, 16 bp, Homo sapiens
agtgtctttttttgta

SEQ ID NO: 911000 - DNA, 20 bp, Homo sapiens
agtgtgaaatagttctgcca

SEQ ID NO: 911001 - DNA, 14 bp, Homo sapiens
agtgtgaaatatat

SEQ ID NO: 911002 - DNA, 14 bp, Homo sapiens
catttcatctcatt

SEQ ID NO: 911003 - DNA, 15 bp, Homo sapiens
catttcatctcattt

SEQ ID NO: 911004 - DNA, 13 bp, Homo sapiens
catttcatgaaaa

SEQ ID NO: 911005 - DNA, 20 bp, Homo sapiens
catttcatgaaaaagctgct

SEQ ID NO: 911006 - DNA, 15 bp, Homo sapiens
catttcattatgctt

SEQ ID NO: 911007 - DNA, 15 bp, Homo sapiens
catttcattcaaatc

SEQ ID NO: 911008 - DNA, 13 bp, Homo sapiens
catttcattccat

SEQ ID NO: 911009 - DNA, 19 bp, Homo sapiens
catttcattccattgccta

SEQ ID NO: 911010 - DNA, 18 bp, Homo sapiens
catttcattcctaacaca

SEQ ID NO: 911011 - DNA, 14 bp, Homo sapiens
catttcattgtaca

SEQ ID NO: 911012 - DNA, 11 bp, Homo sapiens
catttccaaac

SEQ ID NO: 911013 - DNA, 16 bp, Homo sapiens
catttccaaatgaact

SEQ ID NO: 911014 - DNA, 17 bp, Homo sapiens
catttccaaattcacaa

SEQ ID NO: 911015 - DNA, 18 bp, Homo sapiens
catttccaacaccacaga

SEQ ID NO: 911016 - DNA, 22 bp, Homo sapiens
catttccaacaccacagacaca

SEQ ID NO: 911017 - DNA, 16 bp, Homo sapiens
catttccaccaggccg

SEQ ID NO: 911018 - DNA, 16 bp, Homo sapiens
catttccatttattgt

SEQ ID NO: 911019 - DNA, 20 bp, Homo sapiens
catttcccaaagtcctctgc

SEQ ID NO: 911020 - DNA, 18 bp, Homo sapiens
catttcccacatctttcc

SEQ ID NO: 911021 - DNA, 14 bp, Homo sapiens
catttcccatctgc

SEQ ID NO: 911022 - DNA, 15 bp, Homo sapiens
catttcccatctgca

SEQ ID NO: 911023 - DNA, 20 bp, Homo sapiens
catttcccatctgcacccct

SEQ ID NO: 911024 - DNA, 18 bp, Homo sapiens
catttccctatcttctcc

SEQ ID NO: 911025 - DNA, 23 bp, Homo sapiens
catttccggctgctgtgtgtgag

SEQ ID NO: 911026 - DNA, 16 bp, Homo sapiens
catttccgtccccccc

SEQ ID NO: 911027 - DNA, 21 bp, Homo sapiens
catttccgtccccccccaggc

SEQ ID NO: 911028 - DNA, 23 bp, Homo sapiens
catttcctatcacctatttccat

SEQ ID NO: 911029 - DNA, 13 bp, Homo sapiens
catttcctatgca

SEQ ID NO: 911030 - DNA, 17 bp, Homo sapiens
catttcctatgtaactg

SEQ ID NO: 911031 - DNA, 18 bp, Homo sapiens
catttcctcacactaaga

SEQ ID NO: 911032 - DNA, 22 bp, Homo sapiens
catttcctcacactaagagggc

SEQ ID NO: 911033 - DNA, 13 bp, Homo sapiens
catttcctgacag

SEQ ID NO: 911034 - DNA, 15 bp, Homo sapiens
catttcctgatctag

SEQ ID NO: 911035 - DNA, 13 bp, Homo sapiens
catttcctgccct

SEQ ID NO: 911036 - DNA, 20 bp, Homo sapiens
catttcctgcccttcctcag

SEQ ID NO: 911037 - DNA, 15 bp, Homo sapiens
catttcctgggagaa

SEQ ID NO: 911038 - DNA, 18 bp, Homo sapiens
catttcctgggagaaaga

SEQ ID NO: 911039 - DNA, 21 bp, Homo sapiens
catttcctgtgtttgtcctgg

SEQ ID NO: 911040 - DNA, 16 bp, Homo sapiens
catttcgttttttaca

SEQ ID NO: 911041 - DNA, 13 bp, Homo sapiens
catttctaacata

SEQ ID NO: 911042 - DNA, 18 bp, Homo sapiens
catttctaacatatgtat

SEQ ID NO: 911043 - DNA, 14 bp, Homo sapiens
catttctatacttt

SEQ ID NO: 911044 - DNA, 21 bp, Homo sapiens
catttctatactttacaggaa

SEQ ID NO: 911045 - DNA, 23 bp, Homo sapiens
catttctatagccaaaaatagct

SEQ ID NO: 911046 - DNA, 17 bp, Homo sapiens
catttctatgcaggcag

SEQ ID NO: 911047 - DNA, 13 bp, Homo sapiens
catttctatttat

SEQ ID NO: 911048 - DNA, 22 bp, Homo sapiens
catttctcaatcagtgcagtga

SEQ ID NO: 911049 - DNA, 12 bp, Homo sapiens
catttctcactg

SEQ ID NO: 911050 - DNA, 14 bp, Homo sapiens
catttctctgagca

SEQ ID NO: 911051 - DNA, 19 bp, Homo sapiens
catttctctgagcagtcag

SEQ ID NO: 911052 - DNA, 22 bp, Homo sapiens
catttctgagtttcattctcct

SEQ ID NO: 911053 - DNA, 13 bp, Homo sapiens
catttctgcctcg

SEQ ID NO: 911054 - DNA, 23 bp, Homo sapiens
catttctggattgtggttccatg

SEQ ID NO: 911055 - DNA, 13 bp, Homo sapiens
catttctgtatac

SEQ ID NO: 911056 - DNA, 23 bp, Homo sapiens
catttctgtggatacagtgccca

SEQ ID NO: 911057 - DNA, 17 bp, Homo sapiens
catttctgttgctggag

SEQ ID NO: 911058 - DNA, 21 bp, Homo sapiens
catttctgttgctggaggggc

SEQ ID NO: 911059 - DNA, 22 bp, Homo sapiens
catttcttacgttctttcactt

SEQ ID NO: 911060 - DNA, 12 bp, Homo sapiens
catttcttagac

SEQ ID NO: 911061 - DNA, 14 bp, Homo sapiens
catttcttcagagg

SEQ ID NO: 911062 - DNA, 15 bp, Homo sapiens
catttcttcagaggg

SEQ ID NO: 911063 - DNA, 16 bp, Homo sapiens
catttcttcctctgca

SEQ ID NO: 911064 - DNA, 14 bp, Homo sapiens
catttcttctctct

SEQ ID NO: 911065 - DNA, 20 bp, Homo sapiens
catttcttgaaaagccttgg

SEQ ID NO: 911066 - DNA, 12 bp, Homo sapiens
catttcttgggc

SEQ ID NO: 911067 - DNA, 16 bp, Homo sapiens
catttcttgggccctc

SEQ ID NO: 911068 - DNA, 17 bp, Homo sapiens
catttcttgggccctcc

SEQ ID NO: 911069 - DNA, 18 bp, Homo sapiens
catttctttgtctttttc

SEQ ID NO: 911070 - DNA, 21 bp, Homo sapiens
catttcttttactctgtgtaa

SEQ ID NO: 911071 - DNA, 22 bp, Homo sapiens
catttgaaaattttgatgtttt

SEQ ID NO: 911072 - DNA, 16 bp, Homo sapiens
catttgaacacattat

SEQ ID NO: 911073 - DNA, 23 bp, Homo sapiens
catttgacacaaagcttctaaag

SEQ ID NO: 911074 - DNA, 19 bp, Homo sapiens
catttgacccttgctgtga

SEQ ID NO: 911075 - DNA, 17 bp, Homo sapiens
catttgagcccaggagt

SEQ ID NO: 911076 - DNA, 22 bp, Homo sapiens
catttgagttattttaattatc

SEQ ID NO: 911077 - DNA, 16 bp, Homo sapiens
catttgatattatcta

SEQ ID NO: 911078 - DNA, 13 bp, Homo sapiens
catttgatatttt

SEQ ID NO: 911079 - DNA, 16 bp, Homo sapiens
catttgatgcatgtct

SEQ ID NO: 911080 - DNA, 17 bp, Homo sapiens
catttgatgcatgtctt

SEQ ID NO: 911081 - DNA, 22 bp, Homo sapiens
catttgatgcatgtcttttaaa

SEQ ID NO: 911082 - DNA, 14 bp, Homo sapiens
catttgatgctaaa

SEQ ID NO: 911083 - DNA, 15 bp, Homo sapiens
catttgatgctaaat

SEQ ID NO: 911084 - DNA, 15 bp, Homo sapiens
catttgattctgtgt

SEQ ID NO: 911085 - DNA, 16 bp, Homo sapiens
catttgatttgttcat

SEQ ID NO: 911086 - DNA, 16 bp, Homo sapiens
catttgatttttctaa

SEQ ID NO: 911087 - DNA, 13 bp, Homo sapiens
catttgcaagctg

SEQ ID NO: 911088 - DNA, 19 bp, Homo sapiens
catttgcaataacagctgc

SEQ ID NO: 911089 - DNA, 15 bp, Homo sapiens
catttgcaccctccg

SEQ ID NO: 911090 - DNA, 18 bp, Homo sapiens
catttgcagagtcctgca

SEQ ID NO: 911091 - DNA, 16 bp, Homo sapiens
agtgttgaaaatgttc

SEQ ID NO: 911092 - DNA, 16 bp, Homo sapiens
agtgttgcatggatgt

SEQ ID NO: 911093 - DNA, 20 bp, Homo sapiens
agtgttgtgccccttcactc

SEQ ID NO: 911094 - DNA, 22 bp, Homo sapiens
agtgttgtgccccttcactcat

SEQ ID NO: 911095 - DNA, 15 bp, Homo sapiens
agtgttgtgttcctg

SEQ ID NO: 911096 - DNA, 18 bp, Homo sapiens
agtgttgtgttcctggct

SEQ ID NO: 911097 - DNA, 23 bp, Homo sapiens
agtgttgtgttcctggctgatga

SEQ ID NO: 911098 - DNA, 19 bp, Homo sapiens
agtgttgtttgtaaataag

SEQ ID NO: 911099 - DNA, 17 bp, Homo sapiens
agtgtttaacttgtcaa

SEQ ID NO: 911100 - DNA, 13 bp, Homo sapiens
agtgtttatgtgc

SEQ ID NO: 911101 - DNA, 16 bp, Homo sapiens
agtgtttatgtgctat

SEQ ID NO: 911102 - DNA, 18 bp, Homo sapiens
agtgtttatgttgtttat

SEQ ID NO: 911103 - DNA, 19 bp, Homo sapiens
agtgtttcagattttttaa

SEQ ID NO: 911104 - DNA, 21 bp, Homo sapiens
agtgtttctagctaaataaat

SEQ ID NO: 911105 - DNA, 14 bp, Homo sapiens
agtgtttctgtgaa

SEQ ID NO: 911106 - DNA, 14 bp, Homo sapiens
agtgtttcttttaa

SEQ ID NO: 911107 - DNA, 14 bp, Homo sapiens
agtgttttactctt

SEQ ID NO: 911108 - DNA, 16 bp, Homo sapiens
agtgttttagatgtta

SEQ ID NO: 911109 - DNA, 16 bp, Homo sapiens
agtgttttcaatttta

SEQ ID NO: 911110 - DNA, 16 bp, Homo sapiens
agtgttttctcagaac

SEQ ID NO: 911111 - DNA, 16 bp, Homo sapiens
agtgttttctttgagg

SEQ ID NO: 911112 - DNA, 14 bp, Homo sapiens
agtgttttggactc

SEQ ID NO: 911113 - DNA, 15 bp, Homo sapiens
agtgttttggactcc

SEQ ID NO: 911114 - DNA, 18 bp, Homo sapiens
agtgttttggactccatc

SEQ ID NO: 911115 - DNA, 23 bp, Homo sapiens
agtgttttggactccatctctca

SEQ ID NO: 911116 - DNA, 21 bp, Homo sapiens
agtgttttggagaaaaaaatc

SEQ ID NO: 911117 - DNA, 19 bp, Homo sapiens
agtgttttgttttttaatt

SEQ ID NO: 911118 - DNA, 18 bp, Homo sapiens
agttaaaacaaaggaact

SEQ ID NO: 911119 - DNA, 18 bp, Homo sapiens
agttaaaatcacatttta

SEQ ID NO: 911120 - DNA, 20 bp, Homo sapiens
agttaaaatcacattttaag

SEQ ID NO: 911121 - DNA, 22 bp, Homo sapiens
agttaaaatcacattttaagtg

SEQ ID NO: 911122 - DNA, 13 bp, Homo sapiens
agttaaagaaagg

SEQ ID NO: 911123 - DNA, 18 bp, Homo sapiens
agttaaagaaaggaaaag

SEQ ID NO: 911124 - DNA, 22 bp, Homo sapiens
agttcacttctttgcagagcct

SEQ ID NO: 911125 - DNA, 16 bp, Homo sapiens
agttcagatacagggt

SEQ ID NO: 911126 - DNA, 18 bp, Homo sapiens
agttcagcaccaccctag

SEQ ID NO: 911127 - DNA, 21 bp, Homo sapiens
agttcagcatccgcaggtgct

SEQ ID NO: 911128 - DNA, 16 bp, Homo sapiens
agttcagccaccctga

SEQ ID NO: 911129 - DNA, 21 bp, Homo sapiens
agttcaggagtcccaaggaaa

SEQ ID NO: 911130 - DNA, 16 bp, Homo sapiens
agttcagggaccgtcc

SEQ ID NO: 911131 - DNA, 17 bp, Homo sapiens
agttcagtagaattacc

SEQ ID NO: 911132 - DNA, 18 bp, Homo sapiens
agttcagtagaattacca

SEQ ID NO: 911133 - DNA, 19 bp, Homo sapiens
agttcagtagatttccttt

SEQ ID NO: 911134 - DNA, 22 bp, Homo sapiens
agttcagtgataactctgagca

SEQ ID NO: 911135 - DNA, 23 bp, Homo sapiens
agttcagtgtatggcgttggttt

SEQ ID NO: 911136 - DNA, 15 bp, Homo sapiens
agttcatatatacat

SEQ ID NO: 911137 - DNA, 19 bp, Homo sapiens
agttcatgagtattcctag

SEQ ID NO: 911138 - DNA, 18 bp, Homo sapiens
agttcatggggatctggg

SEQ ID NO: 911139 - DNA, 16 bp, Homo sapiens
agttcattattttgtg

SEQ ID NO: 911140 - DNA, 18 bp, Homo sapiens
agttccaaaatgccaaat

SEQ ID NO: 911141 - DNA, 16 bp, Homo sapiens
agttccaaatgtttat

SEQ ID NO: 911142 - DNA, 17 bp, Homo sapiens
agttccaaatgtttata

SEQ ID NO: 911143 - DNA, 16 bp, Homo sapiens
agttccagtttctcct

SEQ ID NO: 911144 - DNA, 22 bp, Homo sapiens
agttccatgaagaccacatcca

SEQ ID NO: 911145 - DNA, 19 bp, Homo sapiens
agttcccacattaaagaag

SEQ ID NO: 911146 - DNA, 14 bp, Homo sapiens
agttcccagctccc

SEQ ID NO: 911147 - DNA, 17 bp, Homo sapiens
agttcccagctcccccc

SEQ ID NO: 911148 - DNA, 18 bp, Homo sapiens
agttcccatggtgtatgt

SEQ ID NO: 911149 - DNA, 20 bp, Homo sapiens
agttccccatccctgtcatt

SEQ ID NO: 911150 - DNA, 15 bp, Homo sapiens
agttcccccaacctc

SEQ ID NO: 911151 - DNA, 18 bp, Homo sapiens
agttcccggagcacagcc

SEQ ID NO: 911152 - DNA, 21 bp, Homo sapiens
agttcccggagcacagccctg

SEQ ID NO: 911153 - DNA, 22 bp, Homo sapiens
agttcccggagcacagccctgg

SEQ ID NO: 911154 - DNA, 16 bp, Homo sapiens
agttccctcctgccca

SEQ ID NO: 911155 - DNA, 18 bp, Homo sapiens
agttccctcctgcccagg

SEQ ID NO: 911156 - DNA, 19 bp, Homo sapiens
agttccctcctgcccagga

SEQ ID NO: 911157 - DNA, 15 bp, Homo sapiens
agttcccttggcctc

SEQ ID NO: 911158 - DNA, 14 bp, Homo sapiens
agttccggcctggg

SEQ ID NO: 911159 - DNA, 20 bp, Homo sapiens
agttccggcctgggcaccag

SEQ ID NO: 911160 - DNA, 22 bp, Homo sapiens
agttcctaccgtactccctgca

SEQ ID NO: 911161 - DNA, 12 bp, Homo sapiens
agttcctcgccc

SEQ ID NO: 911162 - DNA, 13 bp, Homo sapiens
agttcctcgccct

SEQ ID NO: 911163 - DNA, 16 bp, Homo sapiens
agttcctcgccctggg

SEQ ID NO: 911164 - DNA, 18 bp, Homo sapiens
agttcctctagtgccctc

SEQ ID NO: 911165 - DNA, 15 bp, Homo sapiens
agttcctctgcagtt

SEQ ID NO: 911166 - DNA, 13 bp, Homo sapiens
agttcctctgggt

SEQ ID NO: 911167 - DNA, 14 bp, Homo sapiens
agttcctcttttgt

SEQ ID NO: 911168 - DNA, 20 bp, Homo sapiens
agttcctgagtaccttctac

SEQ ID NO: 911169 - DNA, 13 bp, Homo sapiens
agttcctgctccg

SEQ ID NO: 911170 - DNA, 15 bp, Homo sapiens
agttcctgctccgtg

SEQ ID NO: 911171 - DNA, 20 bp, Homo sapiens
agttcctgctccgtggactg

SEQ ID NO: 911172 - DNA, 18 bp, Homo sapiens
agttcctgctctctgctc

SEQ ID NO: 911173 - DNA, 23 bp, Homo sapiens
agttcctgctctctgctcatggg

SEQ ID NO: 911174 - DNA, 21 bp, Homo sapiens
agttcctggcccatcaactgt

SEQ ID NO: 911175 - DNA, 13 bp, Homo sapiens
agttcctgggaac

SEQ ID NO: 911176 - DNA, 23 bp, Homo sapiens
agttcctgtcccttctcttaatt

SEQ ID NO: 911177 - DNA, 17 bp, Homo sapiens
agttcctgtggctccct

SEQ ID NO: 911178 - DNA, 21 bp, Homo sapiens
agttccttaggttttctttgg

SEQ ID NO: 911179 - DNA, 20 bp, Homo sapiens
agttccttgatctgtatata

SEQ ID NO: 911180 - DNA, 14 bp, Homo sapiens
agttccttgcctta

SEQ ID NO: 911181 - DNA, 19 bp, Homo sapiens
agttcctttccttttcttt

SEQ ID NO: 911182 - DNA, 18 bp, Homo sapiens
agttcctttgtgtgtact

SEQ ID NO: 911183 - DNA, 17 bp, Homo sapiens
agttcgagaccagcctg

SEQ ID NO: 911184 - DNA, 19 bp, Homo sapiens
agttcgagaccagcctggc

SEQ ID NO: 911185 - DNA, 21 bp, Homo sapiens
agttcgttggtagagccctca

SEQ ID NO: 911186 - DNA, 23 bp, Homo sapiens
agttcgttggtagagccctcaga

SEQ ID NO: 911187 - DNA, 22 bp, Homo sapiens
agttctaaaaaaaatgcatatt

SEQ ID NO: 911188 - DNA, 13 bp, Homo sapiens
agttctaaaattg

SEQ ID NO: 911189 - DNA, 17 bp, Homo sapiens
agttctacaagcatatt

SEQ ID NO: 911190 - DNA, 20 bp, Homo sapiens
agttctacaagcatatttga

SEQ ID NO: 911191 - DNA, 13 bp, Homo sapiens
agttctacagaaa

SEQ ID NO: 911192 - DNA, 15 bp, Homo sapiens
agttctagagaagag

SEQ ID NO: 911193 - DNA, 17 bp, Homo sapiens
agttctagagaagaggc

SEQ ID NO: 911194 - DNA, 23 bp, Homo sapiens
agttctagatggagaaagtaaca

SEQ ID NO: 911195 - DNA, 23 bp, Homo sapiens
agttctaggggagaagagccctg

SEQ ID NO: 911196 - DNA, 17 bp, Homo sapiens
agttctagtctctctgg

SEQ ID NO: 911197 - DNA, 13 bp, Homo sapiens
agttctagtgttt

SEQ ID NO: 911198 - DNA, 19 bp, Homo sapiens
agttctataagtgaggaag

SEQ ID NO: 911199 - DNA, 23 bp, Homo sapiens
agttctatcagttatcctttgtg

SEQ ID NO: 911200 - DNA, 19 bp, Homo sapiens
agttctatccccaagctgg

SEQ ID NO: 911201 - DNA, 18 bp, Homo sapiens
agttctatggagactttg

SEQ ID NO: 911202 - DNA, 22 bp, Homo sapiens
agttctatggagactttgctgt

SEQ ID NO: 911203 - DNA, 23 bp, Homo sapiens
agttctatggagactttgctgtt

SEQ ID NO: 911204 - DNA, 17 bp, Homo sapiens
agttctcaatcactgct

SEQ ID NO: 911205 - DNA, 17 bp, Homo sapiens
agttctcactcctagga

SEQ ID NO: 911206 - DNA, 19 bp, Homo sapiens
agttctcactgggaagaag

SEQ ID NO: 911207 - DNA, 13 bp, Homo sapiens
agttctcagagct

SEQ ID NO: 911208 - DNA, 17 bp, Homo sapiens
agttctccagcttcagc

SEQ ID NO: 911209 - DNA, 22 bp, Homo sapiens
agttctcctggaggcaggggct

SEQ ID NO: 911210 - DNA, 23 bp, Homo sapiens
agttctcctggaggcaggggctg

SEQ ID NO: 911211 - DNA, 16 bp, Homo sapiens
agttctctagggtctg

SEQ ID NO: 911212 - DNA, 16 bp, Homo sapiens
agttctctcccttcct

SEQ ID NO: 911213 - DNA, 16 bp, Homo sapiens
agttctctcgtaactg

SEQ ID NO: 911214 - DNA, 11 bp, Homo sapiens
agttctctgat

SEQ ID NO: 911215 - DNA, 17 bp, Homo sapiens
agttctctgatgcagaa

SEQ ID NO: 911216 - DNA, 14 bp, Homo sapiens
agttctcttccgca

SEQ ID NO: 911217 - DNA, 15 bp, Homo sapiens
agttctcttgctttc

SEQ ID NO: 911218 - DNA, 14 bp, Homo sapiens
agttctgacttgac

SEQ ID NO: 911219 - DNA, 15 bp, Homo sapiens
agttctgagtgtttt

SEQ ID NO: 911220 - DNA, 14 bp, Homo sapiens
catttttaaatgtg

SEQ ID NO: 911221 - DNA, 13 bp, Homo sapiens
catttttaacagc

SEQ ID NO: 911222 - DNA, 23 bp, Homo sapiens
catttttaagatagaacacaaaa

SEQ ID NO: 911223 - DNA, 22 bp, Homo sapiens
catttttaagctccatgtgcat

SEQ ID NO: 911224 - DNA, 23 bp, Homo sapiens
catttttaagctccatgtgcata

SEQ ID NO: 911225 - DNA, 22 bp, Homo sapiens
catttttaatattactgtcttt

SEQ ID NO: 911226 - DNA, 14 bp, Homo sapiens
catttttaatgtat

SEQ ID NO: 911227 - DNA, 15 bp, Homo sapiens
catttttaatgtatc

SEQ ID NO: 911228 - DNA, 20 bp, Homo sapiens
catttttacactattgtgaa

SEQ ID NO: 911229 - DNA, 22 bp, Homo sapiens
catttttagaaatcacaacaaa

SEQ ID NO: 911230 - DNA, 22 bp, Homo sapiens
catttttataacctggcaaaat

SEQ ID NO: 911231 - DNA, 12 bp, Homo sapiens
catttttatagc

SEQ ID NO: 911232 - DNA, 18 bp, Homo sapiens
catttttatatgaaataa

SEQ ID NO: 911233 - DNA, 15 bp, Homo sapiens
catttttattagaaa

SEQ ID NO: 911234 - DNA, 20 bp, Homo sapiens
catttttattcatgccatct

SEQ ID NO: 911235 - DNA, 10 bp, Homo sapiens
catttttcaa

SEQ ID NO: 911236 - DNA, 17 bp, Homo sapiens
catttttcaaagcaatt

SEQ ID NO: 911237 - DNA, 15 bp, Homo sapiens
catttttcaatatat

SEQ ID NO: 911238 - DNA, 16 bp, Homo sapiens
catttttcatgataat

SEQ ID NO: 911239 - DNA, 14 bp, Homo sapiens
catttttcttattt

SEQ ID NO: 911240 - DNA, 17 bp, Homo sapiens
catttttgatttatgca

SEQ ID NO: 911241 - DNA, 15 bp, Homo sapiens
catttttgctaatta

SEQ ID NO: 911242 - DNA, 14 bp, Homo sapiens
catttttgggggga

SEQ ID NO: 911243 - DNA, 22 bp, Homo sapiens
catttttgtgagcctctttgta

SEQ ID NO: 911244 - DNA, 14 bp, Homo sapiens
catttttgtgcaca

SEQ ID NO: 911245 - DNA, 15 bp, Homo sapiens
agttcttcctgtaat

SEQ ID NO: 911246 - DNA, 13 bp, Homo sapiens
agttcttctccaa

SEQ ID NO: 911247 - DNA, 12 bp, Homo sapiens
agttcttgaatt

SEQ ID NO: 911248 - DNA, 14 bp, Homo sapiens
agttcttggaccag

SEQ ID NO: 911249 - DNA, 19 bp, Homo sapiens
agttcttggtgactgtccc

SEQ ID NO: 911250 - DNA, 21 bp, Homo sapiens
agttcttggtgactgtcccac

SEQ ID NO: 911251 - DNA, 16 bp, Homo sapiens
agttcttggtgctctg

SEQ ID NO: 911252 - DNA, 13 bp, Homo sapiens
agttcttgtgcat

SEQ ID NO: 911253 - DNA, 16 bp, Homo sapiens
agttcttgtgcatgtt

SEQ ID NO: 911254 - DNA, 17 bp, Homo sapiens
agttcttgtgcatgttt

SEQ ID NO: 911255 - DNA, 20 bp, Homo sapiens
agttcttgtgcatgtttact

SEQ ID NO: 911256 - DNA, 21 bp, Homo sapiens
agttctttcctccccctgcaa

SEQ ID NO: 911257 - DNA, 16 bp, Homo sapiens
agttctttgatttgta

SEQ ID NO: 911258 - DNA, 21 bp, Homo sapiens
agttctttgatttgtaccatt

SEQ ID NO: 911259 - DNA, 15 bp, Homo sapiens
agttctttgctgccc

SEQ ID NO: 911260 - DNA, 20 bp, Homo sapiens
agttctttgctgcccctgtc

SEQ ID NO: 911261 - DNA, 18 bp, Homo sapiens
agttgaaaaacagctgag

SEQ ID NO: 911262 - DNA, 16 bp, Homo sapiens
agttgaaaaatctagt

SEQ ID NO: 911263 - DNA, 21 bp, Homo sapiens
agttgaactatgactggagta

SEQ ID NO: 911264 - DNA, 14 bp, Homo sapiens
agttgaagcaaatc

SEQ ID NO: 911265 - DNA, 16 bp, Homo sapiens
agttgaagggaggtga

SEQ ID NO: 911266 - DNA, 20 bp, Homo sapiens
agttgaatggcctgccttga

SEQ ID NO: 911267 - DNA, 17 bp, Homo sapiens
agttgacaacctagaat

SEQ ID NO: 911268 - DNA, 18 bp, Homo sapiens
agttgacaacctagaatg

SEQ ID NO: 911269 - DNA, 16 bp, Homo sapiens
agttgacaattctgca

SEQ ID NO: 911270 - DNA, 22 bp, Homo sapiens
agttgaccgttttcatcctggc

SEQ ID NO: 911271 - DNA, 15 bp, Homo sapiens
agttgactcacaggc

SEQ ID NO: 911272 - DNA, 17 bp, Homo sapiens
agttgactgactgagca

SEQ ID NO: 911273 - DNA, 21 bp, Homo sapiens
agttgacttatagtacatgat

SEQ ID NO: 911274 - DNA, 18 bp, Homo sapiens
agttgagatagttttcat

SEQ ID NO: 911275 - DNA, 21 bp, Homo sapiens
agttgagatttttaagaactt

SEQ ID NO: 911276 - DNA, 16 bp, Homo sapiens
agttgagccccaagtc

SEQ ID NO: 911277 - DNA, 21 bp, Homo sapiens
agttgagccccaagtcctgaa

SEQ ID NO: 911278 - DNA, 15 bp, Homo sapiens
agttgaggacttctt

SEQ ID NO: 911279 - DNA, 23 bp, Homo sapiens
agttgagggaaagagcttataaa

SEQ ID NO: 911280 - DNA, 20 bp, Homo sapiens
agttgagtacagtgaggagg

SEQ ID NO: 911281 - DNA, 20 bp, Homo sapiens
agttgagtcgtcatcacttt

SEQ ID NO: 911282 - DNA, 21 bp, Homo sapiens
agttgataaagattttttaat

SEQ ID NO: 911283 - DNA, 16 bp, Homo sapiens
agttgatactacagtt

SEQ ID NO: 911284 - DNA, 21 bp, Homo sapiens
agttgatatgttttatttcat

SEQ ID NO: 911285 - DNA, 16 bp, Homo sapiens
agttgatctgctctgt

SEQ ID NO: 911286 - DNA, 16 bp, Homo sapiens
agttgatgttgcattt

SEQ ID NO: 911287 - DNA, 13 bp, Homo sapiens
agttgattcagct

SEQ ID NO: 911288 - DNA, 17 bp, Homo sapiens
agttgattcagctctgc

SEQ ID NO: 911289 - DNA, 18 bp, Homo sapiens
agttgattttgaactttt

SEQ ID NO: 911290 - DNA, 23 bp, Homo sapiens
agttgatttttttttttttttcc

SEQ ID NO: 911291 - DNA, 19 bp, Homo sapiens
agttgcaaggcaaatgttt

SEQ ID NO: 911292 - DNA, 18 bp, Homo sapiens
agttgcaattgaattaaa

SEQ ID NO: 911293 - DNA, 15 bp, Homo sapiens
agttgcactgatatt

SEQ ID NO: 911294 - DNA, 17 bp, Homo sapiens
agttgcatagcagtata

SEQ ID NO: 911295 - DNA, 15 bp, Homo sapiens
agttgcatgtagtaa

SEQ ID NO: 911296 - DNA, 17 bp, Homo sapiens
agttgcatgtagtaaca

SEQ ID NO: 911297 - DNA, 19 bp, Homo sapiens
agttgcatgtagtaacact

SEQ ID NO: 911298 - DNA, 14 bp, Homo sapiens
agttgcatttgtaa

SEQ ID NO: 911299 - DNA, 15 bp, Homo sapiens
agttgcatttgtaaa

SEQ ID NO: 911300 - DNA, 20 bp, Homo sapiens
agttgccaccacctctgtgg

SEQ ID NO: 911301 - DNA, 19 bp, Homo sapiens
agttgccctagcccagact

SEQ ID NO: 911302 - DNA, 21 bp, Homo sapiens
agttgcctgactcctgggtgg

SEQ ID NO: 911303 - DNA, 16 bp, Homo sapiens
agttgcgtttaagttg

SEQ ID NO: 911304 - DNA, 20 bp, Homo sapiens
agttgctagtactggggaga

SEQ ID NO: 911305 - DNA, 17 bp, Homo sapiens
agttgctgggagctgaa

SEQ ID NO: 911306 - DNA, 14 bp, Homo sapiens
agttgctgtcataa

SEQ ID NO: 911307 - DNA, 21 bp, Homo sapiens
agttgctgtgaactttcatgt

SEQ ID NO: 911308 - DNA, 13 bp, Homo sapiens
agttgctgtggac

SEQ ID NO: 911309 - DNA, 20 bp, Homo sapiens
agttgctgtgtgtctgtcct

SEQ ID NO: 911310 - DNA, 17 bp, Homo sapiens
agttgcttaattttgat

SEQ ID NO: 911311 - DNA, 16 bp, Homo sapiens
agttgctttgccagag

SEQ ID NO: 911312 - DNA, 17 bp, Homo sapiens
agttgctttgccagagc

SEQ ID NO: 911313 - DNA, 20 bp, Homo sapiens
agttgctttgccagagcagg

SEQ ID NO: 911314 - DNA, 21 bp, Homo sapiens
agttgctttgccagagcagga

SEQ ID NO: 911315 - DNA, 13 bp, Homo sapiens
agttgcttttcag

SEQ ID NO: 911316 - DNA, 12 bp, Homo sapiens
agttggaaggat

SEQ ID NO: 911317 - DNA, 15 bp, Homo sapiens
agttggaaggatctg

SEQ ID NO: 911318 - DNA, 11 bp, Homo sapiens
agttggacagt

SEQ ID NO: 911319 - DNA, 14 bp, Homo sapiens
agttggactctcag

SEQ ID NO: 911320 - DNA, 15 bp, Homo sapiens
agttggacttgtttt

SEQ ID NO: 911321 - DNA, 19 bp, Homo sapiens
agttggagtgagtgtggct

SEQ ID NO: 911322 - DNA, 21 bp, Homo sapiens
agttggagttttatttttaag

SEQ ID NO: 911323 - DNA, 19 bp, Homo sapiens
agttggcacatttcatgag

SEQ ID NO: 911324 - DNA, 14 bp, Homo sapiens
agttggcagagaag

SEQ ID NO: 911325 - DNA, 19 bp, Homo sapiens
agttggcagagaaggcctc

SEQ ID NO: 911326 - DNA, 21 bp, Homo sapiens
agttggcagagaaggcctctt

SEQ ID NO: 911327 - DNA, 15 bp, Homo sapiens
agttggctcaggcag

SEQ ID NO: 911328 - DNA, 19 bp, Homo sapiens
agttgggactcaggatatt

SEQ ID NO: 911329 - DNA, 16 bp, Homo sapiens
agttgggagcactgga

SEQ ID NO: 911330 - DNA, 15 bp, Homo sapiens
agttggggaaggcaa

SEQ ID NO: 911331 - DNA, 17 bp, Homo sapiens
agttggggacagaactc

SEQ ID NO: 911332 - DNA, 11 bp, Homo sapiens
agttggggccc

SEQ ID NO: 911333 - DNA, 15 bp, Homo sapiens
agttggggccctctt

SEQ ID NO: 911334 - DNA, 23 bp, Homo sapiens
agttggggccctcttgccagcct

SEQ ID NO: 911335 - DNA, 12 bp, Homo sapiens
agttggggctgc

SEQ ID NO: 911336 - DNA, 17 bp, Homo sapiens
agttgggggagggaaga

SEQ ID NO: 911337 - DNA, 18 bp, Homo sapiens
agttgggggtcagtgctg

SEQ ID NO: 911338 - DNA, 17 bp, Homo sapiens
agttggggtctggcagc

SEQ ID NO: 911339 - DNA, 21 bp, Homo sapiens
agttggggtctggcagcctcc

SEQ ID NO: 911340 - DNA, 15 bp, Homo sapiens
agttgggtagaaaaa

SEQ ID NO: 911341 - DNA, 21 bp, Homo sapiens
agttgggtagaaaaattatta

SEQ ID NO: 911342 - DNA, 11 bp, Homo sapiens
agttgggtgtt

SEQ ID NO: 911343 - DNA, 19 bp, Homo sapiens
agttgggttcacttgccat

SEQ ID NO: 911344 - DNA, 13 bp, Homo sapiens
agttggtaacttt

SEQ ID NO: 911345 - DNA, 16 bp, Homo sapiens
agttggtaacttttgt

SEQ ID NO: 911346 - DNA, 14 bp, Homo sapiens
agttggtttgtatg

SEQ ID NO: 911347 - DNA, 18 bp, Homo sapiens
agttgtaaaaatgaaagt

SEQ ID NO: 911348 - DNA, 9 bp, Homo sapiens
ccaaagagt

SEQ ID NO: 911349 - DNA, 15 bp, Homo sapiens
ccaaagagtgatagt

SEQ ID NO: 911350 - DNA, 21 bp, Homo sapiens
ccaaagatatatacacaggat

SEQ ID NO: 911351 - DNA, 13 bp, Homo sapiens
ccaaagcagacag

SEQ ID NO: 911352 - DNA, 15 bp, Homo sapiens
ccaaagccagaacca

SEQ ID NO: 911353 - DNA, 16 bp, Homo sapiens
ccaaagccaggcctga

SEQ ID NO: 911354 - DNA, 12 bp, Homo sapiens
ccaaagccccat

SEQ ID NO: 911355 - DNA, 16 bp, Homo sapiens
ccaaagcggtccctgt

SEQ ID NO: 911356 - DNA, 23 bp, Homo sapiens
ccaaagctagggtggcccttgca

SEQ ID NO: 911357 - DNA, 21 bp, Homo sapiens
ccaaagctttactactgtgga

SEQ ID NO: 911358 - DNA, 17 bp, Homo sapiens
ccaaagctttcctgccc

SEQ ID NO: 911359 - DNA, 20 bp, Homo sapiens
ccaaagctttcctgccccag

SEQ ID NO: 911360 - DNA, 20 bp, Homo sapiens
ccaaaggaataacctttctg

SEQ ID NO: 911361 - DNA, 12 bp, Homo sapiens
ccaaaggaggct

SEQ ID NO: 911362 - DNA, 22 bp, Homo sapiens
ccaaaggccagcggtgaccagc

SEQ ID NO: 911363 - DNA, 13 bp, Homo sapiens
ccaaaggcccagg

SEQ ID NO: 911364 - DNA, 16 bp, Homo sapiens
ccaaaggcccagggag

SEQ ID NO: 911365 - DNA, 17 bp, Homo sapiens
ccaaaggcccagggagg

SEQ ID NO: 911366 - DNA, 24 bp, Homo sapiens
ccaaagggaagtgaggcccaagga

SEQ ID NO: 911367 - DNA, 20 bp, Homo sapiens
agttgtcctgatttcttatt

SEQ ID NO: 911368 - DNA, 14 bp, Homo sapiens
agttgtctccttcc

SEQ ID NO: 911369 - DNA, 11 bp, Homo sapiens
agttgtctctg

SEQ ID NO: 911370 - DNA, 12 bp, Homo sapiens
agttgtctctga

SEQ ID NO: 911371 - DNA, 13 bp, Homo sapiens
agttgtctctgat

SEQ ID NO: 911372 - DNA, 12 bp, Homo sapiens
agttgtctctgt

SEQ ID NO: 911373 - DNA, 14 bp, Homo sapiens
agttgtctctgttg

SEQ ID NO: 911374 - DNA, 21 bp, Homo sapiens
agttgtcttatgtgaaaaatt

SEQ ID NO: 911375 - DNA, 23 bp, Homo sapiens
agttgtcttatgtgaaaaattaa

SEQ ID NO: 911376 - DNA, 14 bp, Homo sapiens
agttgtgagccctc

SEQ ID NO: 911377 - DNA, 15 bp, Homo sapiens
agttgtgcatgtatg

SEQ ID NO: 911378 - DNA, 16 bp, Homo sapiens
agttgtgcatgtatgt

SEQ ID NO: 911379 - DNA, 20 bp, Homo sapiens
agttgtgcatgtatgtatac

SEQ ID NO: 911380 - DNA, 19 bp, Homo sapiens
agttgtgccttttatagct

SEQ ID NO: 911381 - DNA, 22 bp, Homo sapiens
agttgtgccttttatagctatt

SEQ ID NO: 911382 - DNA, 14 bp, Homo sapiens
agttgtgcttgttt

SEQ ID NO: 911383 - DNA, 14 bp, Homo sapiens
agttgtggaaagat

SEQ ID NO: 911384 - DNA, 17 bp, Homo sapiens
agttgtggaaagataat

SEQ ID NO: 911385 - DNA, 20 bp, Homo sapiens
agttgtggaaagcctctgct

SEQ ID NO: 911386 - DNA, 23 bp, Homo sapiens
agttgtgttgacacatatgaaca

SEQ ID NO: 911387 - DNA, 17 bp, Homo sapiens
agttgtgttttttaaga

SEQ ID NO: 911388 - DNA, 19 bp, Homo sapiens
agttgtgttttttaagatg

SEQ ID NO: 911389 - DNA, 13 bp, Homo sapiens
agttgttacattt

SEQ ID NO: 911390 - DNA, 19 bp, Homo sapiens
agttgttactaactaaact

SEQ ID NO: 911391 - DNA, 18 bp, Homo sapiens
agttgttattgttgaaca

SEQ ID NO: 911392 - DNA, 19 bp, Homo sapiens
agttgttccttaagtcaga

SEQ ID NO: 911393 - DNA, 13 bp, Homo sapiens
agttgttctgaaa

SEQ ID NO: 911394 - DNA, 18 bp, Homo sapiens
agttgttctttttagaaa

SEQ ID NO: 911395 - DNA, 13 bp, Homo sapiens
agttgttggcctc

SEQ ID NO: 911396 - DNA, 19 bp, Homo sapiens
agttgttggcctccggcct

SEQ ID NO: 911397 - DNA, 17 bp, Homo sapiens
agttgttgtttgccaag

SEQ ID NO: 911398 - DNA, 23 bp, Homo sapiens
agttgtttctagactataaatgt

SEQ ID NO: 911399 - DNA, 23 bp, Homo sapiens
agttgtttgaggcaaattaactg

SEQ ID NO: 911400 - DNA, 16 bp, Homo sapiens
agttgttttatctttt

SEQ ID NO: 911401 - DNA, 17 bp, Homo sapiens
agtttaaaagcatgaaa

SEQ ID NO: 911402 - DNA, 21 bp, Homo sapiens
agtttaaaagcatgaaacatt

SEQ ID NO: 911403 - DNA, 18 bp, Homo sapiens
agtttaaaagccatgtat

SEQ ID NO: 911404 - DNA, 16 bp, Homo sapiens
agtttaaagagaaaag

SEQ ID NO: 911405 - DNA, 22 bp, Homo sapiens
agtttaaagagaaaagggaaaa

SEQ ID NO: 911406 - DNA, 13 bp, Homo sapiens
agtttaacaaatg

SEQ ID NO: 911407 - DNA, 22 bp, Homo sapiens
agtttaacacaagtcctgtgaa

SEQ ID NO: 911408 - DNA, 18 bp, Homo sapiens
agtttaactttaaaactg

SEQ ID NO: 911409 - DNA, 14 bp, Homo sapiens
agtttaaggaatat

SEQ ID NO: 911410 - DNA, 18 bp, Homo sapiens
agtttaagtaattgccta

SEQ ID NO: 911411 - DNA, 22 bp, Homo sapiens
agtttaagtctcctttactgaa

SEQ ID NO: 911412 - DNA, 17 bp, Homo sapiens
agtttaataaatttatt

SEQ ID NO: 911413 - DNA, 23 bp, Homo sapiens
agtttaatacaggaaattgactt

SEQ ID NO: 911414 - DNA, 16 bp, Homo sapiens
agtttaatcagaggaa

SEQ ID NO: 911415 - DNA, 15 bp, Homo sapiens
agtttaattgactta

SEQ ID NO: 911416 - DNA, 23 bp, Homo sapiens
agtttacaacttgattttttcaa

SEQ ID NO: 911417 - DNA, 15 bp, Homo sapiens
agtttacaagtgtat

SEQ ID NO: 911418 - DNA, 21 bp, Homo sapiens
agtttacacttcatatagcat

SEQ ID NO: 911419 - DNA, 14 bp, Homo sapiens
agtttacagatgtt

SEQ ID NO: 911420 - DNA, 14 bp, Homo sapiens
agtttacagtttgt

SEQ ID NO: 911421 - DNA, 16 bp, Homo sapiens
agtttacagtttgtgt

SEQ ID NO: 911422 - DNA, 14 bp, Homo sapiens
agtttacattctaa

SEQ ID NO: 911423 - DNA, 14 bp, Homo sapiens
agtttacattgtcc

SEQ ID NO: 911424 - DNA, 17 bp, Homo sapiens
agtttacattgtcctgt

SEQ ID NO: 911425 - DNA, 20 bp, Homo sapiens
agtttaccagttgcctttta

SEQ ID NO: 911426 - DNA, 19 bp, Homo sapiens
agtttaccatttgtaataa

SEQ ID NO: 911427 - DNA, 21 bp, Homo sapiens
agtttaccatttgtaataaag

SEQ ID NO: 911428 - DNA, 21 bp, Homo sapiens
agtttacccatgaagattggt

SEQ ID NO: 911429 - DNA, 13 bp, Homo sapiens
agtttacctcatc

SEQ ID NO: 911430 - DNA, 23 bp, Homo sapiens
agtttacctcatccatgcacttt

SEQ ID NO: 911431 - DNA, 20 bp, Homo sapiens
agtttaccttgtatactgta

SEQ ID NO: 911432 - DNA, 15 bp, Homo sapiens
agtttactttgccaa

SEQ ID NO: 911433 - DNA, 19 bp, Homo sapiens
agtttagaggaaaaaaatg

SEQ ID NO: 911434 - DNA, 14 bp, Homo sapiens
agtttaggaaaatg

SEQ ID NO: 911435 - DNA, 21 bp, Homo sapiens
agtttagggaacaatttggca

SEQ ID NO: 911436 - DNA, 20 bp, Homo sapiens
agtttagtcgtctaaacata

SEQ ID NO: 911437 - DNA, 20 bp, Homo sapiens
agtttagtgtgataaaggca

SEQ ID NO: 911438 - DNA, 20 bp, Homo sapiens
agtttagtgtgtgtgcagag

SEQ ID NO: 911439 - DNA, 13 bp, Homo sapiens
agtttataaaagt

SEQ ID NO: 911440 - DNA, 14 bp, Homo sapiens
agtttatacagaac

SEQ ID NO: 911441 - DNA, 15 bp, Homo sapiens
agtttatacagaact

SEQ ID NO: 911442 - DNA, 16 bp, Homo sapiens
agtttatacagaactc

SEQ ID NO: 911443 - DNA, 18 bp, Homo sapiens
agtttatcagtaaataac

SEQ ID NO: 911444 - DNA, 13 bp, Homo sapiens
agtttatccaaat

SEQ ID NO: 911445 - DNA, 19 bp, Homo sapiens
agtttatcctgacatattc

SEQ ID NO: 911446 - DNA, 17 bp, Homo sapiens
agtttatggcagaaggg

SEQ ID NO: 911447 - DNA, 19 bp, Homo sapiens
agtttattacaatgtatct

SEQ ID NO: 911448 - DNA, 22 bp, Homo sapiens
agtttattacaatgtatcttta

SEQ ID NO: 911449 - DNA, 14 bp, Homo sapiens
agtttattctgatt

SEQ ID NO: 911450 - DNA, 12 bp, Homo sapiens
agtttattctgt

SEQ ID NO: 911451 - DNA, 14 bp, Homo sapiens
agtttattctgtgg

SEQ ID NO: 911452 - DNA, 15 bp, Homo sapiens
agtttattctgtggt

SEQ ID NO: 911453 - DNA, 21 bp, Homo sapiens
agtttattctgtggttctata

SEQ ID NO: 911454 - DNA, 23 bp, Homo sapiens
agtttatttccactattttcaaa

SEQ ID NO: 911455 - DNA, 13 bp, Homo sapiens
agtttatttgaga

SEQ ID NO: 911456 - DNA, 20 bp, Homo sapiens
agtttatttgagaaaatata

SEQ ID NO: 911457 - DNA, 23 bp, Homo sapiens
agtttatttgagaaaatataata

SEQ ID NO: 911458 - DNA, 18 bp, Homo sapiens
agtttatttgttgagagt

SEQ ID NO: 911459 - DNA, 19 bp, Homo sapiens
agtttatttgttgagagtg

SEQ ID NO: 911460 - DNA, 23 bp, Homo sapiens
agtttatttgttgagagtgtgac

SEQ ID NO: 911461 - DNA, 15 bp, Homo sapiens
agtttattttaagac

SEQ ID NO: 911462 - DNA, 18 bp, Homo sapiens
agtttcaagttttaaagt

SEQ ID NO: 911463 - DNA, 20 bp, Homo sapiens
agtttcaagttttaaagttc

SEQ ID NO: 911464 - DNA, 22 bp, Homo sapiens
agtttcaagttttaaagttcat

SEQ ID NO: 911465 - DNA, 15 bp, Homo sapiens
agtttcaatgtgatt

SEQ ID NO: 911466 - DNA, 17 bp, Homo sapiens
agtttcacagaaaataa

SEQ ID NO: 911467 - DNA, 17 bp, Homo sapiens
agtttcacaggtcaata

SEQ ID NO: 911468 - DNA, 23 bp, Homo sapiens
agtttcacaggtcaataaactta

SEQ ID NO: 911469 - DNA, 15 bp, Homo sapiens
agtttcaccactcct

SEQ ID NO: 911470 - DNA, 17 bp, Homo sapiens
agtttcaccactcctct

SEQ ID NO: 911471 - DNA, 18 bp, Homo sapiens
agtttcacgtaaatattc

SEQ ID NO: 911472 - DNA, 20 bp, Homo sapiens
agtttcacgtaaatattcat

SEQ ID NO: 911473 - DNA, 18 bp, Homo sapiens
agtttcactgtactgcat

SEQ ID NO: 911474 - DNA, 23 bp, Homo sapiens
agtttcactgtactgcatgtgac

SEQ ID NO: 911475 - DNA, 22 bp, Homo sapiens
ccaacagatgcttttctgtctc

SEQ ID NO: 911476 - DNA, 17 bp, Homo sapiens
ccaacagcaaaggaact

SEQ ID NO: 911477 - DNA, 15 bp, Homo sapiens
ccaacagcaagtgtt

SEQ ID NO: 911478 - DNA, 15 bp, Homo sapiens
ccaacagcacctccc

SEQ ID NO: 911479 - DNA, 17 bp, Homo sapiens
ccaacagcacctccccg

SEQ ID NO: 911480 - DNA, 13 bp, Homo sapiens
ccaacagccatgc

SEQ ID NO: 911481 - DNA, 20 bp, Homo sapiens
ccaacagggtagatttctct

SEQ ID NO: 911482 - DNA, 22 bp, Homo sapiens
ccaacagggtagatttctcttg

SEQ ID NO: 911483 - DNA, 18 bp, Homo sapiens
ccaacaggtttatctgaa

SEQ ID NO: 911484 - DNA, 12 bp, Homo sapiens
ccaacagtgagt

SEQ ID NO: 911485 - DNA, 12 bp, Homo sapiens
ccaacagttgta

SEQ ID NO: 911486 - DNA, 20 bp, Homo sapiens
ccaacagttgtatgtttgct

SEQ ID NO: 911487 - DNA, 16 bp, Homo sapiens
ccaacagtttattttt

SEQ ID NO: 911488 - DNA, 14 bp, Homo sapiens
ccaacataaaacaa

SEQ ID NO: 911489 - DNA, 23 bp, Homo sapiens
ccaacataaaacaaaaccaagcc

SEQ ID NO: 911490 - DNA, 18 bp, Homo sapiens
ccaacatcacagcccagc

SEQ ID NO: 911491 - DNA, 12 bp, Homo sapiens
ccaacatccaga

SEQ ID NO: 911492 - DNA, 13 bp, Homo sapiens
ccaacatccagat

SEQ ID NO: 911493 - DNA, 19 bp, Homo sapiens
ccaacatgggagggatcag

SEQ ID NO: 911494 - DNA, 15 bp, Homo sapiens
ccaacatggtgaaac

SEQ ID NO: 911495 - DNA, 17 bp, Homo sapiens
ccaacatgtggctcctc

SEQ ID NO: 911496 - DNA, 15 bp, Homo sapiens
ccaacattaaaactc

SEQ ID NO: 911497 - DNA, 15 bp, Homo sapiens
ccaacattctgcaat

SEQ ID NO: 911498 - DNA, 15 bp, Homo sapiens
ccaacatttctcact

SEQ ID NO: 911499 - DNA, 13 bp, Homo sapiens
ccaaccaaggaag

SEQ ID NO: 911500 - DNA, 18 bp, Homo sapiens
ccaaccaaggaaggagcc

SEQ ID NO: 911501 - DNA, 21 bp, Homo sapiens
ccaaccaaggaaggagcccct

SEQ ID NO: 911502 - DNA, 20 bp, Homo sapiens
ccaaccaagtggctcccaca

SEQ ID NO: 911503 - DNA, 12 bp, Homo sapiens
ccaaccagcctt

SEQ ID NO: 911504 - DNA, 14 bp, Homo sapiens
ccaaccaggaccca

SEQ ID NO: 911505 - DNA, 16 bp, Homo sapiens
ccaaccaggacccagg

SEQ ID NO: 911506 - DNA, 12 bp, Homo sapiens
ccaaccaggcag

SEQ ID NO: 911507 - DNA, 13 bp, Homo sapiens
ccaacccaatccc

SEQ ID NO: 911508 - DNA, 13 bp, Homo sapiens
ccaacccagccac

SEQ ID NO: 911509 - DNA, 12 bp, Homo sapiens
ccaacccatcag

SEQ ID NO: 911510 - DNA, 16 bp, Homo sapiens
ccaaccccaacaattg

SEQ ID NO: 911511 - DNA, 23 bp, Homo sapiens
ccaaccccagcatcagcctgtag

SEQ ID NO: 911512 - DNA, 19 bp, Homo sapiens
ccaacccccaccccacact

SEQ ID NO: 911513 - DNA, 22 bp, Homo sapiens
ccaacccccagaggtggccctt

SEQ ID NO: 911514 - DNA, 15 bp, Homo sapiens
ccaacccccctcctg

SEQ ID NO: 911515 - DNA, 18 bp, Homo sapiens
ccaacccccctcctgctc

SEQ ID NO: 911516 - DNA, 20 bp, Homo sapiens
ccaacccccctcctgctcct

SEQ ID NO: 911517 - DNA, 21 bp, Homo sapiens
ccaacccccctcctgctcctc

SEQ ID NO: 911518 - DNA, 23 bp, Homo sapiens
ccaacccccctcctgctcctccc

SEQ ID NO: 911519 - DNA, 17 bp, Homo sapiens
ccaaccccgcggcccag

SEQ ID NO: 911520 - DNA, 21 bp, Homo sapiens
ccaaccccgcggtgctctggc

SEQ ID NO: 911521 - DNA, 22 bp, Homo sapiens
ccaaccccgcggtgctctggcg

SEQ ID NO: 911522 - DNA, 17 bp, Homo sapiens
ccaaccccggaaaacat

SEQ ID NO: 911523 - DNA, 15 bp, Homo sapiens
ccaaccctgcccctg

SEQ ID NO: 911524 - DNA, 12 bp, Homo sapiens
ccaaccctggga

SEQ ID NO: 911525 - DNA, 13 bp, Homo sapiens
ccaaccctgggac

SEQ ID NO: 911526 - DNA, 14 bp, Homo sapiens
ccaaccctgggacc

SEQ ID NO: 911527 - DNA, 16 bp, Homo sapiens
ccaaccctgtcctccc

SEQ ID NO: 911528 - DNA, 21 bp, Homo sapiens
ccaacccttctcctcttgtaa

SEQ ID NO: 911529 - DNA, 18 bp, Homo sapiens
ccaacctaacccctttcc

SEQ ID NO: 911530 - DNA, 20 bp, Homo sapiens
ccaacctcaatgccctgcca

SEQ ID NO: 911531 - DNA, 16 bp, Homo sapiens
ccaacctcactgccct

SEQ ID NO: 911532 - DNA, 22 bp, Homo sapiens
ccaacctcggcttgtgggctgg

SEQ ID NO: 911533 - DNA, 16 bp, Homo sapiens
ccaacctctcggcccc

SEQ ID NO: 911534 - DNA, 18 bp, Homo sapiens
ccaacctctttttcctcc

SEQ ID NO: 911535 - DNA, 16 bp, Homo sapiens
ccaacctgaccaacat

SEQ ID NO: 911536 - DNA, 18 bp, Homo sapiens
ccaacctgatgccccttc

SEQ ID NO: 911537 - DNA, 19 bp, Homo sapiens
ccaacctgatgccccttcc

SEQ ID NO: 911538 - DNA, 20 bp, Homo sapiens
ccaacctgatgccccttccc

SEQ ID NO: 911539 - DNA, 18 bp, Homo sapiens
ccaacctgcctgtgcatg

SEQ ID NO: 911540 - DNA, 18 bp, Homo sapiens
ccaacctgctctgtcccc

SEQ ID NO: 911541 - DNA, 21 bp, Homo sapiens
ccaaccttcacatctgtcacg

SEQ ID NO: 911542 - DNA, 16 bp, Homo sapiens
ccaacctttccctcac

SEQ ID NO: 911543 - DNA, 19 bp, Homo sapiens
ccaacctttccctcacccc

SEQ ID NO: 911544 - DNA, 14 bp, Homo sapiens
ccaacgagacacat

SEQ ID NO: 911545 - DNA, 20 bp, Homo sapiens
ccaacgagcctcctcagggg

SEQ ID NO: 911546 - DNA, 21 bp, Homo sapiens
ccaacgagcctcctcaggggg

SEQ ID NO: 911547 - DNA, 12 bp, Homo sapiens
ccaacgcccctg

SEQ ID NO: 911548 - DNA, 14 bp, Homo sapiens
ccaacgcccctgtg

SEQ ID NO: 911549 - DNA, 16 bp, Homo sapiens
ccaacgcccctgtggc

SEQ ID NO: 911550 - DNA, 17 bp, Homo sapiens
ccaacgcccctgtggcc

SEQ ID NO: 911551 - DNA, 15 bp, Homo sapiens
ccaacggcaacagca

SEQ ID NO: 911552 - DNA, 20 bp, Homo sapiens
ccaacggccctgcagccagc

SEQ ID NO: 911553 - DNA, 14 bp, Homo sapiens
ccaacgtcccctcc

SEQ ID NO: 911554 - DNA, 22 bp, Homo sapiens
ccaactacaaccaagctctctg

SEQ ID NO: 911555 - DNA, 14 bp, Homo sapiens
ccaactactaatag

SEQ ID NO: 911556 - DNA, 15 bp, Homo sapiens
ccaactagcccctgg

SEQ ID NO: 911557 - DNA, 17 bp, Homo sapiens
ccaactagctgggacta

SEQ ID NO: 911558 - DNA, 14 bp, Homo sapiens
ccaactatccaagt

SEQ ID NO: 911559 - DNA, 14 bp, Homo sapiens
ccaactcacctgag

SEQ ID NO: 911560 - DNA, 23 bp, Homo sapiens
ccaactccatggggttcgagact

SEQ ID NO: 911561 - DNA, 17 bp, Homo sapiens
ccaactcctgatgccct

SEQ ID NO: 911562 - DNA, 19 bp, Homo sapiens
ccaactcctggaagctgtg

SEQ ID NO: 911563 - DNA, 14 bp, Homo sapiens
ccaactctccccag

SEQ ID NO: 911564 - DNA, 14 bp, Homo sapiens
ccaactctcctggc

SEQ ID NO: 911565 - DNA, 15 bp, Homo sapiens
ccaactctgcactcc

SEQ ID NO: 911566 - DNA, 19 bp, Homo sapiens
ccaactcttcctcccctct

SEQ ID NO: 911567 - DNA, 23 bp, Homo sapiens
ccaactgaaggctaaaaagcaac

SEQ ID NO: 911568 - DNA, 20 bp, Homo sapiens
ccaactgacctgccagccgg

SEQ ID NO: 911569 - DNA, 16 bp, Homo sapiens
ccaactgattttgtat

SEQ ID NO: 911570 - DNA, 18 bp, Homo sapiens
ccaactgattttgtatgt

SEQ ID NO: 911571 - DNA, 20 bp, Homo sapiens
ccaactgcaaaaaaagcctc

SEQ ID NO: 911572 - DNA, 22 bp, Homo sapiens
ccaactgcaaaaaaagcctcca

SEQ ID NO: 911573 - DNA, 13 bp, Homo sapiens
ccaactgccccag

SEQ ID NO: 911574 - DNA, 14 bp, Homo sapiens
ccaactgccccagg

SEQ ID NO: 911575 - DNA, 15 bp, Homo sapiens
ccaactgccccaggg

SEQ ID NO: 911576 - DNA, 21 bp, Homo sapiens
ccaactgccctaagcccccag

SEQ ID NO: 911577 - DNA, 18 bp, Homo sapiens
ccaactgcctaaggccct

SEQ ID NO: 911578 - DNA, 13 bp, Homo sapiens
ccaactggcttct

SEQ ID NO: 911579 - DNA, 10 bp, Homo sapiens
ccaactgtgt

SEQ ID NO: 911580 - DNA, 21 bp, Homo sapiens
ccaactgtgttgtattaacaa

SEQ ID NO: 911581 - DNA, 23 bp, Homo sapiens
ccaactgtgttgtattaacaaaa

SEQ ID NO: 911582 - DNA, 17 bp, Homo sapiens
ccaacttcaccaccccc

SEQ ID NO: 911583 - DNA, 17 bp, Homo sapiens
ccaacttcctctgccat

SEQ ID NO: 911584 - DNA, 18 bp, Homo sapiens
ccaacttctcccacccct

SEQ ID NO: 911585 - DNA, 20 bp, Homo sapiens
ccaacttctcttgctttcta

SEQ ID NO: 911586 - DNA, 21 bp, Homo sapiens
ccaacttgaaggattgcatcc

SEQ ID NO: 911587 - DNA, 23 bp, Homo sapiens
ccaacttgaaggattgcatcctg

SEQ ID NO: 911588 - DNA, 10 bp, Homo sapiens
ccaacttgag

SEQ ID NO: 911589 - DNA, 20 bp, Homo sapiens
ccaacttgagggcccagagc

SEQ ID NO: 911590 - DNA, 21 bp, Homo sapiens
ccaacttgagggcccagagca

SEQ ID NO: 911591 - DNA, 14 bp, Homo sapiens
ccaacttgatgtca

SEQ ID NO: 911592 - DNA, 17 bp, Homo sapiens
ccaacttgatgtcaagc

SEQ ID NO: 911593 - DNA, 11 bp, Homo sapiens
ccaagaaaaat

SEQ ID NO: 911594 - DNA, 14 bp, Homo sapiens
ccaagaaacgtctt

SEQ ID NO: 911595 - DNA, 22 bp, Homo sapiens
ccaagaaagatgtatataggtg

SEQ ID NO: 911596 - DNA, 13 bp, Homo sapiens
ccaagaaagcagg

SEQ ID NO: 911597 - DNA, 14 bp, Homo sapiens
ccaagaacattatc

SEQ ID NO: 911598 - DNA, 22 bp, Homo sapiens
ccaagaacggcttggcagccag

SEQ ID NO: 911599 - DNA, 11 bp, Homo sapiens
ccaagaactgc

SEQ ID NO: 911600 - DNA, 16 bp, Homo sapiens
agtttcagagagtcaa

SEQ ID NO: 911601 - DNA, 21 bp, Homo sapiens
agtttcagagagtcaatgtca

SEQ ID NO: 911602 - DNA, 19 bp, Homo sapiens
agtttcagtaaataatgaa

SEQ ID NO: 911603 - DNA, 20 bp, Homo sapiens
agtttcagtattagatgcac

SEQ ID NO: 911604 - DNA, 20 bp, Homo sapiens
agtttcattctcctgcctgt

SEQ ID NO: 911605 - DNA, 21 bp, Homo sapiens
agtttcatttatgatacaaaa

SEQ ID NO: 911606 - DNA, 16 bp, Homo sapiens
agtttccagaaaagaa

SEQ ID NO: 911607 - DNA, 12 bp, Homo sapiens
agtttcccctct

SEQ ID NO: 911608 - DNA, 14 bp, Homo sapiens
agtttcccctctcg

SEQ ID NO: 911609 - DNA, 20 bp, Homo sapiens
agtttccgaatctctttccc

SEQ ID NO: 911610 - DNA, 21 bp, Homo sapiens
agtttccgaatctctttccct

SEQ ID NO: 911611 - DNA, 18 bp, Homo sapiens
ccaagacagatgccccag

SEQ ID NO: 911612 - DNA, 19 bp, Homo sapiens
ccaagacagatgccccaga

SEQ ID NO: 911613 - DNA, 21 bp, Homo sapiens
ccaagacagatgccccagagc

SEQ ID NO: 911614 - DNA, 22 bp, Homo sapiens
ccaagacagatgccccagagct

SEQ ID NO: 911615 - DNA, 24 bp, Homo sapiens
ccaagacagatgccccagagctgt

SEQ ID NO: 911616 - DNA, 22 bp, Homo sapiens
ccaagacagtgagacagtctgg

SEQ ID NO: 911617 - DNA, 14 bp, Homo sapiens
ccaagaccaccagg

SEQ ID NO: 911618 - DNA, 15 bp, Homo sapiens
ccaagaccaccaggg

SEQ ID NO: 911619 - DNA, 18 bp, Homo sapiens
ccaagaccaccagggtcc

SEQ ID NO: 911620 - DNA, 19 bp, Homo sapiens
ccaagaccctgccccctgc

SEQ ID NO: 911621 - DNA, 17 bp, Homo sapiens
ccaagactcctcaggca

SEQ ID NO: 911622 - DNA, 10 bp, Homo sapiens
ccaagactga

SEQ ID NO: 911623 - DNA, 14 bp, Homo sapiens
ccaagactgaagac

SEQ ID NO: 911624 - DNA, 15 bp, Homo sapiens
ccaagactgaagact

SEQ ID NO: 911625 - DNA, 18 bp, Homo sapiens
ccaagactgaagactgca

SEQ ID NO: 911626 - DNA, 13 bp, Homo sapiens
ccaagagaactcg

SEQ ID NO: 911627 - DNA, 23 bp, Homo sapiens
ccaagagaactcgcgctcagtaa

SEQ ID NO: 911628 - DNA, 12 bp, Homo sapiens
ccaagagagaaa

SEQ ID NO: 911629 - DNA, 14 bp, Homo sapiens
ccaagagagaaaga

SEQ ID NO: 911630 - DNA, 20 bp, Homo sapiens
ccaagagcaatttacctggt

SEQ ID NO: 911631 - DNA, 19 bp, Homo sapiens
ccaagagcagagtctgggc

SEQ ID NO: 911632 - DNA, 23 bp, Homo sapiens
ccaagagcagagtctgggcctct

SEQ ID NO: 911633 - DNA, 21 bp, Homo sapiens
ccaagaggaagttcagatctt

SEQ ID NO: 911634 - DNA, 15 bp, Homo sapiens
ccaagaggctgagga

SEQ ID NO: 911635 - DNA, 13 bp, Homo sapiens
ccaagaggctggt

SEQ ID NO: 911636 - DNA, 19 bp, Homo sapiens
ccaagagggtcctttagta

SEQ ID NO: 911637 - DNA, 17 bp, Homo sapiens
ccaagaggtctgagccc

SEQ ID NO: 911638 - DNA, 19 bp, Homo sapiens
ccaagataggagttctctg

SEQ ID NO: 911639 - DNA, 21 bp, Homo sapiens
ccaagataggagttctctgat

SEQ ID NO: 911640 - DNA, 17 bp, Homo sapiens
ccaagatgactggggtg

SEQ ID NO: 911641 - DNA, 19 bp, Homo sapiens
ccaagatgagctgcagccc

SEQ ID NO: 911642 - DNA, 23 bp, Homo sapiens
ccaagatggaagtcacctttctg

SEQ ID NO: 911643 - DNA, 17 bp, Homo sapiens
ccaagatgttctcctga

SEQ ID NO: 911644 - DNA, 19 bp, Homo sapiens
ccaagattttcctcttgtg

SEQ ID NO: 911645 - DNA, 20 bp, Homo sapiens
ccaagattttcctcttgtga

SEQ ID NO: 911646 - DNA, 22 bp, Homo sapiens
ccaagattttcctcttgtgatt

SEQ ID NO: 911647 - DNA, 18 bp, Homo sapiens
ccaagattttgaaggaaa

SEQ ID NO: 911648 - DNA, 14 bp, Homo sapiens
ccaagcaaaccaat

SEQ ID NO: 911649 - DNA, 13 bp, Homo sapiens
ccaagcaacattt

SEQ ID NO: 911650 - DNA, 16 bp, Homo sapiens
ccaagcaacatttgta

SEQ ID NO: 911651 - DNA, 14 bp, Homo sapiens
ccaagcaagtagct

SEQ ID NO: 911652 - DNA, 16 bp, Homo sapiens
ccaagcacagagcctg

SEQ ID NO: 911653 - DNA, 12 bp, Homo sapiens
ccaagcacagca

SEQ ID NO: 911654 - DNA, 15 bp, Homo sapiens
ccaagcacagcagcc

SEQ ID NO: 911655 - DNA, 17 bp, Homo sapiens
ccaagcacagcagcctg

SEQ ID NO: 911656 - DNA, 21 bp, Homo sapiens
ccaagcactcgagaccatcct

SEQ ID NO: 911657 - DNA, 22 bp, Homo sapiens
ccaagcactcgagaccatcctg

SEQ ID NO: 911658 - DNA, 17 bp, Homo sapiens
ccaagcagactccagcc

SEQ ID NO: 911659 - DNA, 20 bp, Homo sapiens
ccaagcagactccagcccct

SEQ ID NO: 911660 - DNA, 21 bp, Homo sapiens
ccaagcagactccagcccctg

SEQ ID NO: 911661 - DNA, 23 bp, Homo sapiens
ccaagcagactccagcccctgga

SEQ ID NO: 911662 - DNA, 11 bp, Homo sapiens
ccaagcagcca

SEQ ID NO: 911663 - DNA, 15 bp, Homo sapiens
ccaagcagccagcca

SEQ ID NO: 911664 - DNA, 21 bp, Homo sapiens
ccaagcagccgcagcgcagcc

SEQ ID NO: 911665 - DNA, 18 bp, Homo sapiens
ccaagcagtgcctgccta

SEQ ID NO: 911666 - DNA, 15 bp, Homo sapiens
ccaagcagtggcctt

SEQ ID NO: 911667 - DNA, 16 bp, Homo sapiens
ccaagcatcaggggga

SEQ ID NO: 911668 - DNA, 13 bp, Homo sapiens
ccaagcatcttgg

SEQ ID NO: 911669 - DNA, 23 bp, Homo sapiens
ccaagcatcttgggggggtggcc

SEQ ID NO: 911670 - DNA, 20 bp, Homo sapiens
ccaagccaagggaacctgtg

SEQ ID NO: 911671 - DNA, 16 bp, Homo sapiens
ccaagccagaggctgg

SEQ ID NO: 911672 - DNA, 17 bp, Homo sapiens
ccaagccagaggctggg

SEQ ID NO: 911673 - DNA, 15 bp, Homo sapiens
ccaagccccctggca

SEQ ID NO: 911674 - DNA, 20 bp, Homo sapiens
ccaagccccctggcagctgc

SEQ ID NO: 911675 - DNA, 21 bp, Homo sapiens
ccaagccccctggcagctgcc

SEQ ID NO: 911676 - DNA, 22 bp, Homo sapiens
ccaagccccctggcagctgccc

SEQ ID NO: 911677 - DNA, 23 bp, Homo sapiens
ccaagccctaagcctgtccccag

SEQ ID NO: 911678 - DNA, 17 bp, Homo sapiens
ccaagccctcctttgga

SEQ ID NO: 911679 - DNA, 23 bp, Homo sapiens
ccaagccgaccttccctccgcct

SEQ ID NO: 911680 - DNA, 14 bp, Homo sapiens
ccaagccgtggctt

SEQ ID NO: 911681 - DNA, 19 bp, Homo sapiens
ccaagcctccacagcgagg

SEQ ID NO: 911682 - DNA, 16 bp, Homo sapiens
ccaagcctgctggctg

SEQ ID NO: 911683 - DNA, 13 bp, Homo sapiens
ccaagcctgctgt

SEQ ID NO: 911684 - DNA, 13 bp, Homo sapiens
ccaagcctggcac

SEQ ID NO: 911685 - DNA, 15 bp, Homo sapiens
ccaagcctggcaccc

SEQ ID NO: 911686 - DNA, 12 bp, Homo sapiens
ccaagccttctg

SEQ ID NO: 911687 - DNA, 15 bp, Homo sapiens
ccaagccttctgtga

SEQ ID NO: 911688 - DNA, 17 bp, Homo sapiens
ccaagctattcaattct

SEQ ID NO: 911689 - DNA, 13 bp, Homo sapiens
ccaagctattcct

SEQ ID NO: 911690 - DNA, 16 bp, Homo sapiens
ccaagctattcctttc

SEQ ID NO: 911691 - DNA, 17 bp, Homo sapiens
ccaagctattcctttcc

SEQ ID NO: 911692 - DNA, 19 bp, Homo sapiens
ccaagctattcctttccct

SEQ ID NO: 911693 - DNA, 13 bp, Homo sapiens
ccaagctccctgc

SEQ ID NO: 911694 - DNA, 15 bp, Homo sapiens
ccaagctccctgccc

SEQ ID NO: 911695 - DNA, 17 bp, Homo sapiens
ccaagctccctgcccca

SEQ ID NO: 911696 - DNA, 19 bp, Homo sapiens
ccaagctccctgccccaaa

SEQ ID NO: 911697 - DNA, 22 bp, Homo sapiens
ccaagctccctgccccaaataa

SEQ ID NO: 911698 - DNA, 14 bp, Homo sapiens
ccaagctccctgga

SEQ ID NO: 911699 - DNA, 13 bp, Homo sapiens
ccaagctcctcct

SEQ ID NO: 911700 - DNA, 20 bp, Homo sapiens
ccaagctcctcctcggaacc

SEQ ID NO: 911701 - DNA, 22 bp, Homo sapiens
ccaagctcctcctcggaaccgc

SEQ ID NO: 911702 - DNA, 16 bp, Homo sapiens
ccaagctgggccgagg

SEQ ID NO: 911703 - DNA, 12 bp, Homo sapiens
ccaagctgtggc

SEQ ID NO: 911704 - DNA, 20 bp, Homo sapiens
ccaagcttaatagccctccc

SEQ ID NO: 911705 - DNA, 21 bp, Homo sapiens
ccaagcttaatagccctcccc

SEQ ID NO: 911706 - DNA, 13 bp, Homo sapiens
ccaagcttccctc

SEQ ID NO: 911707 - DNA, 15 bp, Homo sapiens
ccaagcttcctgtgc

SEQ ID NO: 911708 - DNA, 16 bp, Homo sapiens
ccaagcttcctgtgcc

SEQ ID NO: 911709 - DNA, 23 bp, Homo sapiens
ccaagcttcctgtgccctcaccc

SEQ ID NO: 911710 - DNA, 17 bp, Homo sapiens
ccaagcttggcagccga

SEQ ID NO: 911711 - DNA, 22 bp, Homo sapiens
ccaagcttggtttgtggcgtct

SEQ ID NO: 911712 - DNA, 14 bp, Homo sapiens
ccaaggaaggagcc

SEQ ID NO: 911713 - DNA, 17 bp, Homo sapiens
ccaaggaaggagcccct

SEQ ID NO: 911714 - DNA, 18 bp, Homo sapiens
ccaaggaaggagcccctg

SEQ ID NO: 911715 - DNA, 16 bp, Homo sapiens
ccaaggaatcagcagg

SEQ ID NO: 911716 - DNA, 21 bp, Homo sapiens
ccaaggaatgtgtccaagaca

SEQ ID NO: 911717 - DNA, 13 bp, Homo sapiens
ccaaggaccaggt

SEQ ID NO: 911718 - DNA, 14 bp, Homo sapiens
ccaaggaccaggtt

SEQ ID NO: 911719 - DNA, 16 bp, Homo sapiens
ccaaggacccctcacc

SEQ ID NO: 911720 - DNA, 22 bp, Homo sapiens
ccaaggaccttttggaatgact

SEQ ID NO: 911721 - DNA, 19 bp, Homo sapiens
ccaaggactgactttgcca

SEQ ID NO: 911722 - DNA, 15 bp, Homo sapiens
ccaaggactgccgac

SEQ ID NO: 911723 - DNA, 13 bp, Homo sapiens
ccaaggagaccaa

SEQ ID NO: 911724 - DNA, 22 bp, Homo sapiens
ccaaggagaccaagtcctggct

SEQ ID NO: 911725 - DNA, 13 bp, Homo sapiens
ccaaggagcacag

SEQ ID NO: 911726 - DNA, 18 bp, Homo sapiens
ccaaggagcacaggtccc

SEQ ID NO: 911727 - DNA, 22 bp, Homo sapiens
agttttgtgtttgttgtagatt

SEQ ID NO: 911728 - DNA, 18 bp, Homo sapiens
agtttttacaaaactgct

SEQ ID NO: 911729 - DNA, 18 bp, Homo sapiens
agtttttacagctgtgtt

SEQ ID NO: 911730 - DNA, 21 bp, Homo sapiens
agtttttacctaccacagtgt

SEQ ID NO: 911731 - DNA, 15 bp, Homo sapiens
agtttttactgaaca

SEQ ID NO: 911732 - DNA, 23 bp, Homo sapiens
agtttttatatagtctacagttg

SEQ ID NO: 911733 - DNA, 13 bp, Homo sapiens
ccaaggagctgct

SEQ ID NO: 911734 - DNA, 13 bp, Homo sapiens
ccaaggaggaaaa

SEQ ID NO: 911735 - DNA, 21 bp, Homo sapiens
ccaaggaggaaaaacagacaa

SEQ ID NO: 911736 - DNA, 22 bp, Homo sapiens
ccaaggaggaaataactaagag

SEQ ID NO: 911737 - DNA, 18 bp, Homo sapiens
ccaaggaggcctggggag

SEQ ID NO: 911738 - DNA, 21 bp, Homo sapiens
ccaaggaggtgggccacaccc

SEQ ID NO: 911739 - DNA, 17 bp, Homo sapiens
ccaaggagtcactgaga

SEQ ID NO: 911740 - DNA, 18 bp, Homo sapiens
ccaaggatcggactctgc

SEQ ID NO: 911741 - DNA, 18 bp, Homo sapiens
ccaaggatgccttagcat

SEQ ID NO: 911742 - DNA, 13 bp, Homo sapiens
ccaaggcaaacaa

SEQ ID NO: 911743 - DNA, 14 bp, Homo sapiens
ccaaggcaaacaat

SEQ ID NO: 911744 - DNA, 15 bp, Homo sapiens
ccaaggcaaggcagg

SEQ ID NO: 911745 - DNA, 15 bp, Homo sapiens
ccaaggcagaggcct

SEQ ID NO: 911746 - DNA, 16 bp, Homo sapiens
ccaaggcagaggcctg

SEQ ID NO: 911747 - DNA, 14 bp, Homo sapiens
ccaaggcagcctcc

SEQ ID NO: 911748 - DNA, 16 bp, Homo sapiens
ccaaggcagcctccag

SEQ ID NO: 911749 - DNA, 21 bp, Homo sapiens
ccaaggcagcctccagagcca

SEQ ID NO: 911750 - DNA, 17 bp, Homo sapiens
ccaaggccagaaggagg

SEQ ID NO: 911751 - DNA, 15 bp, Homo sapiens
ccaaggccccaggga

SEQ ID NO: 911752 - DNA, 20 bp, Homo sapiens
ccaaggccgcggcccagacc

SEQ ID NO: 911753 - DNA, 16 bp, Homo sapiens
ccaaggcctcggcaga

SEQ ID NO: 911754 - DNA, 22 bp, Homo sapiens
ccaaggcctctcaccccacttc

SEQ ID NO: 911755 - DNA, 17 bp, Homo sapiens
ccaaggcctttcctaca

SEQ ID NO: 911756 - DNA, 19 bp, Homo sapiens
ccaaggctcactgcagcgc

SEQ ID NO: 911757 - DNA, 19 bp, Homo sapiens
ccaaggctctcccctctcg

SEQ ID NO: 911758 - DNA, 22 bp, Homo sapiens
ccaaggcttctccaattctgcc

SEQ ID NO: 911759 - DNA, 17 bp, Homo sapiens
ccaaggctttaaagctg

SEQ ID NO: 911760 - DNA, 17 bp, Homo sapiens
ccaagggaaaggggtgc

SEQ ID NO: 911761 - DNA, 18 bp, Homo sapiens
ccaagggacaggagaaga

SEQ ID NO: 911762 - DNA, 15 bp, Homo sapiens
ccaagggacaggtgg

SEQ ID NO: 911763 - DNA, 22 bp, Homo sapiens
ccaagggagggtgcagccctct

SEQ ID NO: 911764 - DNA, 15 bp, Homo sapiens
ccaagggccaaaccc

SEQ ID NO: 911765 - DNA, 13 bp, Homo sapiens
ccaagggcccaaa

SEQ ID NO: 911766 - DNA, 14 bp, Homo sapiens
ccaagggccccagg

SEQ ID NO: 911767 - DNA, 16 bp, Homo sapiens
ccaagggccccagggg

SEQ ID NO: 911768 - DNA, 21 bp, Homo sapiens
ccaagggccccaggggcagca

SEQ ID NO: 911769 - DNA, 12 bp, Homo sapiens
ccaagggccgtg

SEQ ID NO: 911770 - DNA, 19 bp, Homo sapiens
ccaagggctggggcggagc

SEQ ID NO: 911771 - DNA, 20 bp, Homo sapiens
ccaagggcttctgcaccctc

SEQ ID NO: 911772 - DNA, 21 bp, Homo sapiens
ccaaggggctgcgctagcagc

SEQ ID NO: 911773 - DNA, 14 bp, Homo sapiens
ccaagggggcgggg

SEQ ID NO: 911774 - DNA, 23 bp, Homo sapiens
ccaagggtatccaagttggactg

SEQ ID NO: 911775 - DNA, 19 bp, Homo sapiens
ccaagggtatgggaagcca

SEQ ID NO: 911776 - DNA, 15 bp, Homo sapiens
ccaagggttgagagc

SEQ ID NO: 911777 - DNA, 17 bp, Homo sapiens
ccaagggttgagagcca

SEQ ID NO: 911778 - DNA, 15 bp, Homo sapiens
ccaagggtttcgact

SEQ ID NO: 911779 - DNA, 23 bp, Homo sapiens
ccaagggtttcgactggtccagc

SEQ ID NO: 911780 - DNA, 23 bp, Homo sapiens
ccaaggtcagggaggggcaacca

SEQ ID NO: 911781 - DNA, 23 bp, Homo sapiens
ccaaggtccccccacagctccag

SEQ ID NO: 911782 - DNA, 16 bp, Homo sapiens
ccaaggtcccctccac

SEQ ID NO: 911783 - DNA, 16 bp, Homo sapiens
ccaaggtcctctcagt

SEQ ID NO: 911784 - DNA, 16 bp, Homo sapiens
ccaaggtcttcttaat

SEQ ID NO: 911785 - DNA, 19 bp, Homo sapiens
ccaaggtgaatagcacagg

SEQ ID NO: 911786 - DNA, 19 bp, Homo sapiens
ccaaggtgcatatagaaaa

SEQ ID NO: 911787 - DNA, 18 bp, Homo sapiens
ccaaggtggagggaagga

SEQ ID NO: 911788 - DNA, 20 bp, Homo sapiens
ccaaggtgggctgagccctg

SEQ ID NO: 911789 - DNA, 23 bp, Homo sapiens
ccaaggtgggctgagccctggca

SEQ ID NO: 911790 - DNA, 20 bp, Homo sapiens
ccaaggttactcagcagcag

SEQ ID NO: 911791 - DNA, 16 bp, Homo sapiens
ccaaggttctccaaca

SEQ ID NO: 911792 - DNA, 20 bp, Homo sapiens
ccaaggttggagcccagggc

SEQ ID NO: 911793 - DNA, 24 bp, Homo sapiens
ccaagtaaccaggccccagcctcc

SEQ ID NO: 911794 - DNA, 20 bp, Homo sapiens
ccaagtagctaggactacag

SEQ ID NO: 911795 - DNA, 21 bp, Homo sapiens
ccaagtatgccttaagcagaa

SEQ ID NO: 911796 - DNA, 15 bp, Homo sapiens
ccaagtcactagaag

SEQ ID NO: 911797 - DNA, 21 bp, Homo sapiens
ccaagtcagctttgccttcca

SEQ ID NO: 911798 - DNA, 16 bp, Homo sapiens
ccaagtcaggccaggt

SEQ ID NO: 911799 - DNA, 18 bp, Homo sapiens
ccaagtcaggccaggtgg

SEQ ID NO: 911800 - DNA, 18 bp, Homo sapiens
ccaagtcatttccgtccc

SEQ ID NO: 911801 - DNA, 14 bp, Homo sapiens
ccaagtccactgtc

SEQ ID NO: 911802 - DNA, 12 bp, Homo sapiens
ccaagtccctgt

SEQ ID NO: 911803 - DNA, 13 bp, Homo sapiens
ccaagtccctgtt

SEQ ID NO: 911804 - DNA, 22 bp, Homo sapiens
ccaagtccctgttttctgagcc

SEQ ID NO: 911805 - DNA, 16 bp, Homo sapiens
ccaagtcctgaagagg

SEQ ID NO: 911806 - DNA, 19 bp, Homo sapiens
ccaagtcctgaagaggcgg

SEQ ID NO: 911807 - DNA, 17 bp, Homo sapiens
ccaagtcggcacccttt

SEQ ID NO: 911808 - DNA, 14 bp, Homo sapiens
ccaagtctctctgt

SEQ ID NO: 911809 - DNA, 19 bp, Homo sapiens
ccaagtgaaggttcccaag

SEQ ID NO: 911810 - DNA, 22 bp, Homo sapiens
ccaagtgaaggttcccaaggac

SEQ ID NO: 911811 - DNA, 23 bp, Homo sapiens
ccaagtgaaggttcccaaggaca

SEQ ID NO: 911812 - DNA, 12 bp, Homo sapiens
ccaagtgcaata

SEQ ID NO: 911813 - DNA, 16 bp, Homo sapiens
ccaagtgcaatagatt

SEQ ID NO: 911814 - DNA, 16 bp, Homo sapiens
ccaagtgcaggctggc

SEQ ID NO: 911815 - DNA, 19 bp, Homo sapiens
ccaagtgcaggctggcacc

SEQ ID NO: 911816 - DNA, 14 bp, Homo sapiens
ccaagtgcctcacc

SEQ ID NO: 911817 - DNA, 13 bp, Homo sapiens
ccaagtgcgtgcc

SEQ ID NO: 911818 - DNA, 21 bp, Homo sapiens
ccaagtggacagtctggccac

SEQ ID NO: 911819 - DNA, 20 bp, Homo sapiens
ccaagtggaccttgagacca

SEQ ID NO: 911820 - DNA, 11 bp, Homo sapiens
ccaagtggctg

SEQ ID NO: 911821 - DNA, 13 bp, Homo sapiens
ccaagtgggcagt

SEQ ID NO: 911822 - DNA, 23 bp, Homo sapiens
ccaagtgggcagtcaccacccag

SEQ ID NO: 911823 - DNA, 13 bp, Homo sapiens
ccaagtgggctgg

SEQ ID NO: 911824 - DNA, 18 bp, Homo sapiens
ccaagtgggggcagaggg

SEQ ID NO: 911825 - DNA, 16 bp, Homo sapiens
ccaagtggggtgctgg

SEQ ID NO: 911826 - DNA, 14 bp, Homo sapiens
ccaagtggtcagga

SEQ ID NO: 911827 - DNA, 12 bp, Homo sapiens
ccaagtgtgtgt

SEQ ID NO: 911828 - DNA, 17 bp, Homo sapiens
ccaagttatattgaata

SEQ ID NO: 911829 - DNA, 18 bp, Homo sapiens
ccaagttcacagtagagt

SEQ ID NO: 911830 - DNA, 19 bp, Homo sapiens
ccaagttccgtcagtccaa

SEQ ID NO: 911831 - DNA, 20 bp, Homo sapiens
ccaagttctaggccccccag

SEQ ID NO: 911832 - DNA, 19 bp, Homo sapiens
ccaagttcttcacctctat

SEQ ID NO: 911833 - DNA, 16 bp, Homo sapiens
ccaagttgcagtgagc

SEQ ID NO: 911834 - DNA, 18 bp, Homo sapiens
ccaagttgctgtcactgt

SEQ ID NO: 911835 - DNA, 17 bp, Homo sapiens
ccaagttgtgcttgagc

SEQ ID NO: 911836 - DNA, 16 bp, Homo sapiens
ccaagtttccatagca

SEQ ID NO: 911837 - DNA, 9 bp, Homo sapiens
ccaataaaa

SEQ ID NO: 911838 - DNA, 14 bp, Homo sapiens
ccaataaaaagttc

SEQ ID NO: 911839 - DNA, 21 bp, Homo sapiens
ccaataaaaagttcagagttc

SEQ ID NO: 911840 - DNA, 11 bp, Homo sapiens
ccaataaaagt

SEQ ID NO: 911841 - DNA, 14 bp, Homo sapiens
ccaataaaagtgac

SEQ ID NO: 911842 - DNA, 14 bp, Homo sapiens
ccaataaaccaggt

SEQ ID NO: 911843 - DNA, 11 bp, Homo sapiens
ccaataaactg

SEQ ID NO: 911844 - DNA, 16 bp, Homo sapiens
ccaataaactgagcga

SEQ ID NO: 911845 - DNA, 19 bp, Homo sapiens
ccaataaactgagcgaccc

SEQ ID NO: 911846 - DNA, 12 bp, Homo sapiens
ccaataaaggca

SEQ ID NO: 911847 - DNA, 14 bp, Homo sapiens
ccaataaaggcagc

SEQ ID NO: 911848 - DNA, 23 bp, Homo sapiens
ccaataaaggcagctgcctctgc

SEQ ID NO: 911849 - DNA, 15 bp, Homo sapiens
ccaataaagtgatct

SEQ ID NO: 911850 - DNA, 18 bp, Homo sapiens
ccaataaagtgccttctg

SEQ ID NO: 911851 - DNA, 20 bp, Homo sapiens
ccaataaagtgccttctggg

SEQ ID NO: 911852 - DNA, 14 bp, Homo sapiens
ccaataacattctt

SEQ ID NO: 911853 - DNA, 16 bp, Homo sapiens
ccaataataaagacat

SEQ ID NO: 911854 - DNA, 22 bp, Homo sapiens
ccaataataaatgccctcttct

SEQ ID NO: 911855 - DNA, 15 bp, Homo sapiens
ataaagtctgagaaa

SEQ ID NO: 911856 - DNA, 16 bp, Homo sapiens
ataaagtctgagaaat

SEQ ID NO: 911857 - DNA, 17 bp, Homo sapiens
ataaagtctgagaaata

SEQ ID NO: 911858 - DNA, 17 bp, Homo sapiens
ccaataccctactgtgg

SEQ ID NO: 911859 - DNA, 19 bp, Homo sapiens
ccaataccctactgtgggg

SEQ ID NO: 911860 - DNA, 22 bp, Homo sapiens
ccaataccctactgtggggaga

SEQ ID NO: 911861 - DNA, 13 bp, Homo sapiens
ccaataggagtct

SEQ ID NO: 911862 - DNA, 18 bp, Homo sapiens
ccaataggcaaattaatc

SEQ ID NO: 911863 - DNA, 21 bp, Homo sapiens
ccaatatcatgtcttgtgcat

SEQ ID NO: 911864 - DNA, 22 bp, Homo sapiens
ccaatattaacacgctgcctgg

SEQ ID NO: 911865 - DNA, 17 bp, Homo sapiens
ccaatatttaccagacc

SEQ ID NO: 911866 - DNA, 18 bp, Homo sapiens
ccaatatttctcagacat

SEQ ID NO: 911867 - DNA, 13 bp, Homo sapiens
ccaatcacaagga

SEQ ID NO: 911868 - DNA, 15 bp, Homo sapiens
ccaatcagagagcct

SEQ ID NO: 911869 - DNA, 14 bp, Homo sapiens
ccaatcagcttttg

SEQ ID NO: 911870 - DNA, 23 bp, Homo sapiens
ccaatcagcttttgttctagact

SEQ ID NO: 911871 - DNA, 14 bp, Homo sapiens
ccaatcattttaat

SEQ ID NO: 911872 - DNA, 16 bp, Homo sapiens
ccaatccatgcttcac

SEQ ID NO: 911873 - DNA, 18 bp, Homo sapiens
ccaatcccagctacctca

SEQ ID NO: 911874 - DNA, 15 bp, Homo sapiens
ccaatccctctccac

SEQ ID NO: 911875 - DNA, 16 bp, Homo sapiens
ccaatccctctccact

SEQ ID NO: 911876 - DNA, 19 bp, Homo sapiens
ccaatccctctccactctt

SEQ ID NO: 911877 - DNA, 16 bp, Homo sapiens
ccaatccctgccactg

SEQ ID NO: 911878 - DNA, 14 bp, Homo sapiens
ccaatccctggcca

SEQ ID NO: 911879 - DNA, 15 bp, Homo sapiens
ccaatcctcactggg

SEQ ID NO: 911880 - DNA, 18 bp, Homo sapiens
ccaatcctcactgggtgg

SEQ ID NO: 911881 - DNA, 22 bp, Homo sapiens
ccaatcctttccaccctattcc

SEQ ID NO: 911882 - DNA, 17 bp, Homo sapiens
ccaatcggactgccaaa

SEQ ID NO: 911883 - DNA, 23 bp, Homo sapiens
ccaatcgggtccagagaccacac

SEQ ID NO: 911884 - DNA, 21 bp, Homo sapiens
ccaatctatgtcgtgttttca

SEQ ID NO: 911885 - DNA, 21 bp, Homo sapiens
ccaatcttgcccactggccgc

SEQ ID NO: 911886 - DNA, 12 bp, Homo sapiens
ccaatgaaatga

SEQ ID NO: 911887 - DNA, 13 bp, Homo sapiens
ccaatgaaggaaa

SEQ ID NO: 911888 - DNA, 18 bp, Homo sapiens
ccaatgaattattatata

SEQ ID NO: 911889 - DNA, 17 bp, Homo sapiens
ccaatgcatgcagccac

SEQ ID NO: 911890 - DNA, 15 bp, Homo sapiens
ccaatgctccagctg

SEQ ID NO: 911891 - DNA, 20 bp, Homo sapiens
ccaatgctccagctgtcgtc

SEQ ID NO: 911892 - DNA, 14 bp, Homo sapiens
ccaatgctctggag

SEQ ID NO: 911893 - DNA, 16 bp, Homo sapiens
ccaatgctgcctggga

SEQ ID NO: 911894 - DNA, 24 bp, Homo sapiens
ccaatgctttgggaggccaaggca

SEQ ID NO: 911895 - DNA, 12 bp, Homo sapiens
ccaatggaaacc

SEQ ID NO: 911896 - DNA, 22 bp, Homo sapiens
ccaatggacaagcagtgtctgt

SEQ ID NO: 911897 - DNA, 13 bp, Homo sapiens
ccaatgggaagca

SEQ ID NO: 911898 - DNA, 22 bp, Homo sapiens
ccaatgggatgaggtcactttt

SEQ ID NO: 911899 - DNA, 20 bp, Homo sapiens
ccaatgggtttttccctgta

SEQ ID NO: 911900 - DNA, 21 bp, Homo sapiens
ccaatggtgatcctctatttt

SEQ ID NO: 911901 - DNA, 15 bp, Homo sapiens
ccaatggtgcttccc

SEQ ID NO: 911902 - DNA, 12 bp, Homo sapiens
ccaatgtctccc

SEQ ID NO: 911903 - DNA, 12 bp, Homo sapiens
ccaatgtcttga

SEQ ID NO: 911904 - DNA, 14 bp, Homo sapiens
ccaatgtggcaaga

SEQ ID NO: 911905 - DNA, 13 bp, Homo sapiens
ccaattaaaatac

SEQ ID NO: 911906 - DNA, 20 bp, Homo sapiens
ccaattacagggtgactcac

SEQ ID NO: 911907 - DNA, 21 bp, Homo sapiens
ccaattacatggaacttttct

SEQ ID NO: 911908 - DNA, 17 bp, Homo sapiens
ccaattactattccctt

SEQ ID NO: 911909 - DNA, 23 bp, Homo sapiens
ccaattaggaagtgtaacagctg

SEQ ID NO: 911910 - DNA, 18 bp, Homo sapiens
ccaattagtcactgctgc

SEQ ID NO: 911911 - DNA, 14 bp, Homo sapiens
ccaattagtttcct

SEQ ID NO: 911912 - DNA, 16 bp, Homo sapiens
ccaattatcatctttt

SEQ ID NO: 911913 - DNA, 22 bp, Homo sapiens
ccaattatttgactttaattta

SEQ ID NO: 911914 - DNA, 14 bp, Homo sapiens
ccaattcagacagg

SEQ ID NO: 911915 - DNA, 14 bp, Homo sapiens
ccaattccccctta

SEQ ID NO: 911916 - DNA, 20 bp, Homo sapiens
ccaattccttgcacatagta

SEQ ID NO: 911917 - DNA, 20 bp, Homo sapiens
ccaattcggggcctgctgga

SEQ ID NO: 911918 - DNA, 23 bp, Homo sapiens
ccaattctaaatccgacttgaat

SEQ ID NO: 911919 - DNA, 14 bp, Homo sapiens
ccaattctgaaata

SEQ ID NO: 911920 - DNA, 17 bp, Homo sapiens
ccaattctggacagaca

SEQ ID NO: 911921 - DNA, 22 bp, Homo sapiens
ccaattgactctcacactgaat

SEQ ID NO: 911922 - DNA, 15 bp, Homo sapiens
ccaattgatgtatat

SEQ ID NO: 911923 - DNA, 22 bp, Homo sapiens
ccaattgcctcttgcaggctga

SEQ ID NO: 911924 - DNA, 18 bp, Homo sapiens
ccaattgggaatgcaata

SEQ ID NO: 911925 - DNA, 16 bp, Homo sapiens
ccaattggtgcttcag

SEQ ID NO: 911926 - DNA, 14 bp, Homo sapiens
ccaattgtgctgcc

SEQ ID NO: 911927 - DNA, 20 bp, Homo sapiens
ccaattgttgacagttctga

SEQ ID NO: 911928 - DNA, 11 bp, Homo sapiens
ccaatttaagg

SEQ ID NO: 911929 - DNA, 22 bp, Homo sapiens
ccaatttcccacccccacccac

SEQ ID NO: 911930 - DNA, 18 bp, Homo sapiens
ccaatttcccggagccat

SEQ ID NO: 911931 - DNA, 12 bp, Homo sapiens
ccaatttcctct

SEQ ID NO: 911932 - DNA, 23 bp, Homo sapiens
ccaatttcggattttttccaaaa

SEQ ID NO: 911933 - DNA, 14 bp, Homo sapiens
ccaatttcttcctt

SEQ ID NO: 911934 - DNA, 15 bp, Homo sapiens
ccaatttcttccttc

SEQ ID NO: 911935 - DNA, 22 bp, Homo sapiens
ccaatttggtaaaaatgctgct

SEQ ID NO: 911936 - DNA, 15 bp, Homo sapiens
ccaattttgatcttt

SEQ ID NO: 911937 - DNA, 19 bp, Homo sapiens
ccaatttttgttttcccca

SEQ ID NO: 911938 - DNA, 23 bp, Homo sapiens
ccaattttttaagtgaaaatata

SEQ ID NO: 911939 - DNA, 13 bp, Homo sapiens
ccacaaaaattga

SEQ ID NO: 911940 - DNA, 23 bp, Homo sapiens
ccacaaaataaccaatcctggac

SEQ ID NO: 911941 - DNA, 16 bp, Homo sapiens
ccacaaagcaaaggca

SEQ ID NO: 911942 - DNA, 20 bp, Homo sapiens
ccacaaagcacagtttgaac

SEQ ID NO: 911943 - DNA, 19 bp, Homo sapiens
ccacaaagcattttcattt

SEQ ID NO: 911944 - DNA, 18 bp, Homo sapiens
ccacaaaggagagctagc

SEQ ID NO: 911945 - DNA, 19 bp, Homo sapiens
ccacaaatcaaagcaaggg

SEQ ID NO: 911946 - DNA, 16 bp, Homo sapiens
ccacaacagcctgggg

SEQ ID NO: 911947 - DNA, 18 bp, Homo sapiens
ccacaacagcctggggtt

SEQ ID NO: 911948 - DNA, 18 bp, Homo sapiens
ccacaaccctgttttata

SEQ ID NO: 911949 - DNA, 23 bp, Homo sapiens
ccacaacctgtggggtctgatgt

SEQ ID NO: 911950 - DNA, 23 bp, Homo sapiens
ccacaactttgtcgtggttctta

SEQ ID NO: 911951 - DNA, 21 bp, Homo sapiens
ccacaagaaatttgatttcta

SEQ ID NO: 911952 - DNA, 15 bp, Homo sapiens
ccacaagattcccag

SEQ ID NO: 911953 - DNA, 18 bp, Homo sapiens
ccacaagattcccagaga

SEQ ID NO: 911954 - DNA, 11 bp, Homo sapiens
ccacaagcccg

SEQ ID NO: 911955 - DNA, 11 bp, Homo sapiens
ccacaagctgc

SEQ ID NO: 911956 - DNA, 13 bp, Homo sapiens
ccacaagctgcac

SEQ ID NO: 911957 - DNA, 15 bp, Homo sapiens
ccacaagctgcactg

SEQ ID NO: 911958 - DNA, 15 bp, Homo sapiens
ccacaagctgcctct

SEQ ID NO: 911959 - DNA, 17 bp, Homo sapiens
ccacaaggaaccctcag

SEQ ID NO: 911960 - DNA, 12 bp, Homo sapiens
ccacaaggctgg

SEQ ID NO: 911961 - DNA, 17 bp, Homo sapiens
ccacaaggtccactccc

SEQ ID NO: 911962 - DNA, 22 bp, Homo sapiens
ccacaaggtccactccctgctc

SEQ ID NO: 911963 - DNA, 21 bp, Homo sapiens
ccacaaggtccccccaccgct

SEQ ID NO: 911964 - DNA, 22 bp, Homo sapiens
ccacaagtcttccagaggatgc

SEQ ID NO: 911965 - DNA, 20 bp, Homo sapiens
ccacaagtgaatctttctcc

SEQ ID NO: 911966 - DNA, 23 bp, Homo sapiens
ccacaagtgaatctttctcctgg

SEQ ID NO: 911967 - DNA, 20 bp, Homo sapiens
ccacaagtgccgcaaattgt

SEQ ID NO: 911968 - DNA, 19 bp, Homo sapiens
ccacaataaactcgtgact

SEQ ID NO: 911969 - DNA, 18 bp, Homo sapiens
ccacaatgagatgcatga

SEQ ID NO: 911970 - DNA, 23 bp, Homo sapiens
ccacacacacccacacactcgcc

SEQ ID NO: 911971 - DNA, 17 bp, Homo sapiens
ccacacacagaggaaga

SEQ ID NO: 911972 - DNA, 22 bp, Homo sapiens
ccacacacagaggaagagcagg

SEQ ID NO: 911973 - DNA, 15 bp, Homo sapiens
ccacacacgcaggaa

SEQ ID NO: 911974 - DNA, 14 bp, Homo sapiens
ccacacactcgccc

SEQ ID NO: 911975 - DNA, 15 bp, Homo sapiens
ccacacagctgccct

SEQ ID NO: 911976 - DNA, 21 bp, Homo sapiens
ccacacagctgccctagctga

SEQ ID NO: 911977 - DNA, 13 bp, Homo sapiens
ataacagttatat

SEQ ID NO: 911978 - DNA, 20 bp, Homo sapiens
ataacatctttattgaaatt

SEQ ID NO: 911979 - DNA, 21 bp, Homo sapiens
ataacatctttattgaaattc

SEQ ID NO: 911980 - DNA, 15 bp, Homo sapiens
ataacatgtaaaatc

SEQ ID NO: 911981 - DNA, 12 bp, Homo sapiens
ataacatgtaat

SEQ ID NO: 911982 - DNA, 13 bp, Homo sapiens
ataacatgtaatt

SEQ ID NO: 911983 - DNA, 20 bp, Homo sapiens
ataacatgtaattaagtact

SEQ ID NO: 911984 - DNA, 16 bp, Homo sapiens
ataacattcagttccc

SEQ ID NO: 911985 - DNA, 16 bp, Homo sapiens
ccacacattccagggc

SEQ ID NO: 911986 - DNA, 12 bp, Homo sapiens
ccacacatttaa

SEQ ID NO: 911987 - DNA, 12 bp, Homo sapiens
ccacacatttta

SEQ ID NO: 911988 - DNA, 18 bp, Homo sapiens
ccacaccaatcagagagc

SEQ ID NO: 911989 - DNA, 14 bp, Homo sapiens
ccacaccaggccgt

SEQ ID NO: 911990 - DNA, 14 bp, Homo sapiens
ccacacccagggga

SEQ ID NO: 911991 - DNA, 21 bp, Homo sapiens
ccacacccaggtctcttcctt

SEQ ID NO: 911992 - DNA, 22 bp, Homo sapiens
ccacacccaggtctcttccttt

SEQ ID NO: 911993 - DNA, 21 bp, Homo sapiens
ccacacccaggtgatttcctc

SEQ ID NO: 911994 - DNA, 17 bp, Homo sapiens
ccacaccccagcccacc

SEQ ID NO: 911995 - DNA, 18 bp, Homo sapiens
ccacacccgaagtcctgt

SEQ ID NO: 911996 - DNA, 16 bp, Homo sapiens
ccacaccctgtactgt

SEQ ID NO: 911997 - DNA, 19 bp, Homo sapiens
ccacaccctgtactgttct

SEQ ID NO: 911998 - DNA, 16 bp, Homo sapiens
ccacaccgtgtaaacc

SEQ ID NO: 911999 - DNA, 18 bp, Homo sapiens
ccacaccgtgtaaaccaa

SEQ ID NO: 912000 - DNA, 20 bp, Homo sapiens
ccacaccgtgtaaaccaaag

SEQ ID NO: 912001 - DNA, 19 bp, Homo sapiens
ccacacctcagttcccttg

SEQ ID NO: 912002 - DNA, 15 bp, Homo sapiens
ccacacctccctact

SEQ ID NO: 912003 - DNA, 18 bp, Homo sapiens
ccacacctgaacttgcct

SEQ ID NO: 912004 - DNA, 19 bp, Homo sapiens
ccacacctgaacttgccta

SEQ ID NO: 912005 - DNA, 13 bp, Homo sapiens
ccacacctggcct

SEQ ID NO: 912006 - DNA, 15 bp, Homo sapiens
ccacacgcaggcggc

SEQ ID NO: 912007 - DNA, 20 bp, Homo sapiens
ccacacgcaggcggccaggg

SEQ ID NO: 912008 - DNA, 15 bp, Homo sapiens
ccacacggcagcccc

SEQ ID NO: 912009 - DNA, 14 bp, Homo sapiens
ccacacggcccctt

SEQ ID NO: 912010 - DNA, 16 bp, Homo sapiens
ccacactaacctgggt

SEQ ID NO: 912011 - DNA, 22 bp, Homo sapiens
ccacactaacctgggttccctt

SEQ ID NO: 912012 - DNA, 21 bp, Homo sapiens
ccacactcaccccagcctcat

SEQ ID NO: 912013 - DNA, 22 bp, Homo sapiens
ccacactcaccccagcctcatt

SEQ ID NO: 912014 - DNA, 11 bp, Homo sapiens
ccacactccac

SEQ ID NO: 912015 - DNA, 16 bp, Homo sapiens
ccacactccactctga

SEQ ID NO: 912016 - DNA, 17 bp, Homo sapiens
ccacactccactctgat

SEQ ID NO: 912017 - DNA, 16 bp, Homo sapiens
ccacactctccatcac

SEQ ID NO: 912018 - DNA, 20 bp, Homo sapiens
ccacactgagttctatcagt

SEQ ID NO: 912019 - DNA, 22 bp, Homo sapiens
ccacactggactccggccctcc

SEQ ID NO: 912020 - DNA, 13 bp, Homo sapiens
ccacactgggcct

SEQ ID NO: 912021 - DNA, 16 bp, Homo sapiens
ccacactgggcctgga

SEQ ID NO: 912022 - DNA, 17 bp, Homo sapiens
ccacactgggcctggag

SEQ ID NO: 912023 - DNA, 18 bp, Homo sapiens
ccacactgggcctggagc

SEQ ID NO: 912024 - DNA, 14 bp, Homo sapiens
ccacactggtgact

SEQ ID NO: 912025 - DNA, 18 bp, Homo sapiens
ccacactgtggccaggcc

SEQ ID NO: 912026 - DNA, 13 bp, Homo sapiens
ccacacttccctg

SEQ ID NO: 912027 - DNA, 14 bp, Homo sapiens
ccacacttccctgg

SEQ ID NO: 912028 - DNA, 16 bp, Homo sapiens
ccacacttccctggcg

SEQ ID NO: 912029 - DNA, 12 bp, Homo sapiens
ccacacttcctg

SEQ ID NO: 912030 - DNA, 12 bp, Homo sapiens
ccacacttcctt

SEQ ID NO: 912031 - DNA, 12 bp, Homo sapiens
ccacacttcttg

SEQ ID NO: 912032 - DNA, 23 bp, Homo sapiens
ccacacttcttgaaacagcctgg

SEQ ID NO: 912033 - DNA, 16 bp, Homo sapiens
ccacacttgctggggc

SEQ ID NO: 912034 - DNA, 18 bp, Homo sapiens
ccacacttgctggggctc

SEQ ID NO: 912035 - DNA, 17 bp, Homo sapiens
ccacacttgtgccagcc

SEQ ID NO: 912036 - DNA, 20 bp, Homo sapiens
ccacacttgtgccagcccgg

SEQ ID NO: 912037 - DNA, 20 bp, Homo sapiens
ccacagaaccttcaacccag

SEQ ID NO: 912038 - DNA, 20 bp, Homo sapiens
ccacagaagacttcccagct

SEQ ID NO: 912039 - DNA, 22 bp, Homo sapiens
ccacagaagccaggagcaaatg

SEQ ID NO: 912040 - DNA, 20 bp, Homo sapiens
ccacagacacacacacgcac

SEQ ID NO: 912041 - DNA, 21 bp, Homo sapiens
ccacagacctgctctggacac

SEQ ID NO: 912042 - DNA, 20 bp, Homo sapiens
ccacagactcttacgtggag

SEQ ID NO: 912043 - DNA, 14 bp, Homo sapiens
ccacagactgcccc

SEQ ID NO: 912044 - DNA, 16 bp, Homo sapiens
ccacagactgccccag

SEQ ID NO: 912045 - DNA, 17 bp, Homo sapiens
ccacagactgccccagc

SEQ ID NO: 912046 - DNA, 18 bp, Homo sapiens
ccacagactgccccagcc

SEQ ID NO: 912047 - DNA, 20 bp, Homo sapiens
ccacagactgccccagccaa

SEQ ID NO: 912048 - DNA, 22 bp, Homo sapiens
ccacagagaagtttgtagccag

SEQ ID NO: 912049 - DNA, 12 bp, Homo sapiens
ccacagagcaaa

SEQ ID NO: 912050 - DNA, 12 bp, Homo sapiens
ccacagagcctg

SEQ ID NO: 912051 - DNA, 16 bp, Homo sapiens
ccacagagtgagccag

SEQ ID NO: 912052 - DNA, 17 bp, Homo sapiens
ccacagagtgagccagt

SEQ ID NO: 912053 - DNA, 19 bp, Homo sapiens
ccacagagtgctggactgt

SEQ ID NO: 912054 - DNA, 16 bp, Homo sapiens
ccacagataactgaaa

SEQ ID NO: 912055 - DNA, 23 bp, Homo sapiens
ccacagatgtgtctgggagagcc

SEQ ID NO: 912056 - DNA, 19 bp, Homo sapiens
ccacagcaaccccaggctg

SEQ ID NO: 912057 - DNA, 23 bp, Homo sapiens
ccacagcaaggaaatgtcctgca

SEQ ID NO: 912058 - DNA, 23 bp, Homo sapiens
ccacagcaagtacagcggctccc

SEQ ID NO: 912059 - DNA, 22 bp, Homo sapiens
ccacagcacaaccggtcccttc

SEQ ID NO: 912060 - DNA, 19 bp, Homo sapiens
ccacagcagcctctgaagt

SEQ ID NO: 912061 - DNA, 15 bp, Homo sapiens
ccacagcatcgggag

SEQ ID NO: 912062 - DNA, 13 bp, Homo sapiens
ccacagccagagg

SEQ ID NO: 912063 - DNA, 23 bp, Homo sapiens
ccacagcccccgggacaccgtgg

SEQ ID NO: 912064 - DNA, 16 bp, Homo sapiens
ccacagcccccttgcc

SEQ ID NO: 912065 - DNA, 13 bp, Homo sapiens
ccacagccctgtc

SEQ ID NO: 912066 - DNA, 14 bp, Homo sapiens
ccacagccctgtca

SEQ ID NO: 912067 - DNA, 15 bp, Homo sapiens
ccacagccctgtcag

SEQ ID NO: 912068 - DNA, 21 bp, Homo sapiens
ccacagccctgtcagtgcagc

SEQ ID NO: 912069 - DNA, 23 bp, Homo sapiens
ccacagccctgtcagtgcagccc

SEQ ID NO: 912070 - DNA, 12 bp, Homo sapiens
ccacagccgcag

SEQ ID NO: 912071 - DNA, 20 bp, Homo sapiens
ccacagcctcccctgccagg

SEQ ID NO: 912072 - DNA, 13 bp, Homo sapiens
ccacagcctgctg

SEQ ID NO: 912073 - DNA, 14 bp, Homo sapiens
ccacagcctgctgg

SEQ ID NO: 912074 - DNA, 20 bp, Homo sapiens
ccacagcctgctggcagggc

SEQ ID NO: 912075 - DNA, 21 bp, Homo sapiens
ccacagcctgctggcagggcc

SEQ ID NO: 912076 - DNA, 15 bp, Homo sapiens
ccacagcgagcctgt

SEQ ID NO: 912077 - DNA, 15 bp, Homo sapiens
ccacagcgagggcag

SEQ ID NO: 912078 - DNA, 17 bp, Homo sapiens
ccacagcgagggcagct

SEQ ID NO: 912079 - DNA, 18 bp, Homo sapiens
ccacagcgagggcagctg

SEQ ID NO: 912080 - DNA, 12 bp, Homo sapiens
ccacagcgtccc

SEQ ID NO: 912081 - DNA, 17 bp, Homo sapiens
ccacagcgtccctggcg

SEQ ID NO: 912082 - DNA, 18 bp, Homo sapiens
ccacagctacctgagacg

SEQ ID NO: 912083 - DNA, 15 bp, Homo sapiens
ccacagctatttaga

SEQ ID NO: 912084 - DNA, 15 bp, Homo sapiens
ccacagctccaggac

SEQ ID NO: 912085 - DNA, 16 bp, Homo sapiens
ccacagctccaggaca

SEQ ID NO: 912086 - DNA, 13 bp, Homo sapiens
ccacagctcccac

SEQ ID NO: 912087 - DNA, 14 bp, Homo sapiens
ccacagctctgggc

SEQ ID NO: 912088 - DNA, 16 bp, Homo sapiens
ccacagctctgggcct

SEQ ID NO: 912089 - DNA, 14 bp, Homo sapiens
ccacagctgctcaa

SEQ ID NO: 912090 - DNA, 16 bp, Homo sapiens
ccacagctgctggaga

SEQ ID NO: 912091 - DNA, 19 bp, Homo sapiens
ccacagctgctgttctcag

SEQ ID NO: 912092 - DNA, 14 bp, Homo sapiens
ccacagctgggcag

SEQ ID NO: 912093 - DNA, 19 bp, Homo sapiens
ccacagctgggcagggtga

SEQ ID NO: 912094 - DNA, 19 bp, Homo sapiens
ccacaggaacaacagcatc

SEQ ID NO: 912095 - DNA, 18 bp, Homo sapiens
ccacaggaacggccctgc

SEQ ID NO: 912096 - DNA, 22 bp, Homo sapiens
ccacaggaagcctgcagtcctg

SEQ ID NO: 912097 - DNA, 19 bp, Homo sapiens
ccacaggaaggaggggaga

SEQ ID NO: 912098 - DNA, 16 bp, Homo sapiens
ccacaggacatttctc

SEQ ID NO: 912099 - DNA, 17 bp, Homo sapiens
ataaggccttaatatgt

SEQ ID NO: 912100 - DNA, 18 bp, Homo sapiens
ataaggccttaatatgtt

SEQ ID NO: 912101 - DNA, 13 bp, Homo sapiens
ataagggccctgc

SEQ ID NO: 912102 - DNA, 20 bp, Homo sapiens
ataagggccctgccctgtac

SEQ ID NO: 912103 - DNA, 19 bp, Homo sapiens
ataaggggccttgctctga

SEQ ID NO: 912104 - DNA, 21 bp, Homo sapiens
ataaggggtcaaaatttgctg

SEQ ID NO: 912105 - DNA, 14 bp, Homo sapiens
ataaggtaaaattt

SEQ ID NO: 912106 - DNA, 17 bp, Homo sapiens
ataaggtcaagggaaaa

SEQ ID NO: 912107 - DNA, 13 bp, Homo sapiens
ataaggtgcctca

SEQ ID NO: 912108 - DNA, 23 bp, Homo sapiens
ataaggtttcctgctccagtgta

SEQ ID NO: 912109 - DNA, 23 bp, Homo sapiens
ataaggtttcgtttctgtataca

SEQ ID NO: 912110 - DNA, 15 bp, Homo sapiens
ataaggttttattca

SEQ ID NO: 912111 - DNA, 13 bp, Homo sapiens
ataagtaaaccta

SEQ ID NO: 912112 - DNA, 14 bp, Homo sapiens
ccacagggctaaga

SEQ ID NO: 912113 - DNA, 15 bp, Homo sapiens
ccacaggggcaggcc

SEQ ID NO: 912114 - DNA, 16 bp, Homo sapiens
ccacaggggcaggcct

SEQ ID NO: 912115 - DNA, 22 bp, Homo sapiens
ccacaggtgcgggaccatctga

SEQ ID NO: 912116 - DNA, 22 bp, Homo sapiens
ccacaggttcatgccaccatgg

SEQ ID NO: 912117 - DNA, 20 bp, Homo sapiens
ccacagtagaactgtctgtg

SEQ ID NO: 912118 - DNA, 16 bp, Homo sapiens
ccacagtcaaagaagg

SEQ ID NO: 912119 - DNA, 19 bp, Homo sapiens
ccacagtcccccacccacc

SEQ ID NO: 912120 - DNA, 23 bp, Homo sapiens
ccacagtgagaggggagggctcc

SEQ ID NO: 912121 - DNA, 13 bp, Homo sapiens
ccacagtgctgct

SEQ ID NO: 912122 - DNA, 19 bp, Homo sapiens
ccacagtggggctgcaggc

SEQ ID NO: 912123 - DNA, 20 bp, Homo sapiens
ccacagtggggctgcaggca

SEQ ID NO: 912124 - DNA, 18 bp, Homo sapiens
ccacagtgttgtgcccct

SEQ ID NO: 912125 - DNA, 23 bp, Homo sapiens
ccacagtgttgtgccccttcact

SEQ ID NO: 912126 - DNA, 17 bp, Homo sapiens
ccacagtgtttatattg

SEQ ID NO: 912127 - DNA, 17 bp, Homo sapiens
ccacagttatcttagct

SEQ ID NO: 912128 - DNA, 18 bp, Homo sapiens
ccacagttatcttagctg

SEQ ID NO: 912129 - DNA, 20 bp, Homo sapiens
ccacagttgctgctcctttg

SEQ ID NO: 912130 - DNA, 15 bp, Homo sapiens
ccacagttttaataa

SEQ ID NO: 912131 - DNA, 20 bp, Homo sapiens
ccacataatttttgtacatc

SEQ ID NO: 912132 - DNA, 19 bp, Homo sapiens
ccacatacaacacaaagag

SEQ ID NO: 912133 - DNA, 13 bp, Homo sapiens
ccacatagcatgc

SEQ ID NO: 912134 - DNA, 22 bp, Homo sapiens
ccacatagcatgcttcctttct

SEQ ID NO: 912135 - DNA, 14 bp, Homo sapiens
ccacatcagcccca

SEQ ID NO: 912136 - DNA, 17 bp, Homo sapiens
ccacatcagccccacag

SEQ ID NO: 912137 - DNA, 18 bp, Homo sapiens
ccacatcccactggatct

SEQ ID NO: 912138 - DNA, 15 bp, Homo sapiens
ccacatccccagagc

SEQ ID NO: 912139 - DNA, 20 bp, Homo sapiens
ccacatccccagagcccagc

SEQ ID NO: 912140 - DNA, 19 bp, Homo sapiens
ccacatcctccgtccagcc

SEQ ID NO: 912141 - DNA, 14 bp, Homo sapiens
ccacatctgtcctc

SEQ ID NO: 912142 - DNA, 14 bp, Homo sapiens
ccacatgacctcca

SEQ ID NO: 912143 - DNA, 17 bp, Homo sapiens
ccacatgaggccatctc

SEQ ID NO: 912144 - DNA, 21 bp, Homo sapiens
ccacatgaggccatctcagga

SEQ ID NO: 912145 - DNA, 19 bp, Homo sapiens
ccacatgcctgcgcctgct

SEQ ID NO: 912146 - DNA, 21 bp, Homo sapiens
ccacatgcctgcgcctgctgc

SEQ ID NO: 912147 - DNA, 16 bp, Homo sapiens
ccacatgggaggctca

SEQ ID NO: 912148 - DNA, 14 bp, Homo sapiens
ccacatgggctggg

SEQ ID NO: 912149 - DNA, 18 bp, Homo sapiens
ccacatggtgtctcccaa

SEQ ID NO: 912150 - DNA, 22 bp, Homo sapiens
ccacatggtgtctcccaacatg

SEQ ID NO: 912151 - DNA, 16 bp, Homo sapiens
ccacatggtgtggcca

SEQ ID NO: 912152 - DNA, 21 bp, Homo sapiens
ccacatggtgtggccatcact

SEQ ID NO: 912153 - DNA, 13 bp, Homo sapiens
ccacatgtcccag

SEQ ID NO: 912154 - DNA, 16 bp, Homo sapiens
ccacatgtcccagatc

SEQ ID NO: 912155 - DNA, 14 bp, Homo sapiens
ccacattaaagaag

SEQ ID NO: 912156 - DNA, 17 bp, Homo sapiens
ccacattctacttcagc

SEQ ID NO: 912157 - DNA, 19 bp, Homo sapiens
ccacattctatagccataa

SEQ ID NO: 912158 - DNA, 14 bp, Homo sapiens
ccacattgcctcat

SEQ ID NO: 912159 - DNA, 15 bp, Homo sapiens
ccacatttagtatcc

SEQ ID NO: 912160 - DNA, 16 bp, Homo sapiens
ccacattttatattta

SEQ ID NO: 912161 - DNA, 15 bp, Homo sapiens
ccaccaaaactgctc

SEQ ID NO: 912162 - DNA, 16 bp, Homo sapiens
ccaccaaaactgctcc

SEQ ID NO: 912163 - DNA, 22 bp, Homo sapiens
ccaccaaactgcacacacagct

SEQ ID NO: 912164 - DNA, 19 bp, Homo sapiens
ccaccaaagctgcccactg

SEQ ID NO: 912165 - DNA, 14 bp, Homo sapiens
ccaccaacaaaatc

SEQ ID NO: 912166 - DNA, 19 bp, Homo sapiens
ccaccaactctgcactcca

SEQ ID NO: 912167 - DNA, 14 bp, Homo sapiens
ccaccaaggggctc

SEQ ID NO: 912168 - DNA, 17 bp, Homo sapiens
ccaccaaggtcttcagc

SEQ ID NO: 912169 - DNA, 20 bp, Homo sapiens
ccaccaataaatcagaccat

SEQ ID NO: 912170 - DNA, 21 bp, Homo sapiens
ccaccaataaatcagaccatg

SEQ ID NO: 912171 - DNA, 18 bp, Homo sapiens
ccaccacacagtcacccc

SEQ ID NO: 912172 - DNA, 13 bp, Homo sapiens
ccaccacaggcat

SEQ ID NO: 912173 - DNA, 20 bp, Homo sapiens
ccaccacatctgccagacct

SEQ ID NO: 912174 - DNA, 15 bp, Homo sapiens
ccaccaccactggcc

SEQ ID NO: 912175 - DNA, 16 bp, Homo sapiens
ccaccaccactggcca

SEQ ID NO: 912176 - DNA, 13 bp, Homo sapiens
ccaccacccctac

SEQ ID NO: 912177 - DNA, 17 bp, Homo sapiens
ccaccaccctcaggtgc

SEQ ID NO: 912178 - DNA, 18 bp, Homo sapiens
ccaccacctaggccactc

SEQ ID NO: 912179 - DNA, 12 bp, Homo sapiens
ccaccacctccc

SEQ ID NO: 912180 - DNA, 12 bp, Homo sapiens
ccaccaccttgg

SEQ ID NO: 912181 - DNA, 20 bp, Homo sapiens
ccaccacgatgtggccctgg

SEQ ID NO: 912182 - DNA, 15 bp, Homo sapiens
ccaccacgcagccgc

SEQ ID NO: 912183 - DNA, 13 bp, Homo sapiens
ccaccacgtctgc

SEQ ID NO: 912184 - DNA, 18 bp, Homo sapiens
ccaccacgtctgccaggc

SEQ ID NO: 912185 - DNA, 22 bp, Homo sapiens
ccaccacgtctgccaggcccat

SEQ ID NO: 912186 - DNA, 15 bp, Homo sapiens
ccaccacgtctggct

SEQ ID NO: 912187 - DNA, 23 bp, Homo sapiens
ccaccacgtctggctccctgccc

SEQ ID NO: 912188 - DNA, 14 bp, Homo sapiens
ccaccactagagct

SEQ ID NO: 912189 - DNA, 16 bp, Homo sapiens
ccaccactagagctga

SEQ ID NO: 912190 - DNA, 11 bp, Homo sapiens
ccaccactcag

SEQ ID NO: 912191 - DNA, 12 bp, Homo sapiens
ccaccactcagg

SEQ ID NO: 912192 - DNA, 22 bp, Homo sapiens
ccaccactctcactccacccag

SEQ ID NO: 912193 - DNA, 23 bp, Homo sapiens
ccaccagaacgcaccccactggg

SEQ ID NO: 912194 - DNA, 17 bp, Homo sapiens
ccaccagacccacctgg

SEQ ID NO: 912195 - DNA, 18 bp, Homo sapiens
ccaccagacccacctgga

SEQ ID NO: 912196 - DNA, 22 bp, Homo sapiens
ccaccagacccacctggagccc

SEQ ID NO: 912197 - DNA, 14 bp, Homo sapiens
ccaccagcacctta

SEQ ID NO: 912198 - DNA, 16 bp, Homo sapiens
ccaccagcagcacaat

SEQ ID NO: 912199 - DNA, 13 bp, Homo sapiens
ccaccagcagcat

SEQ ID NO: 912200 - DNA, 12 bp, Homo sapiens
ccaccagccagc

SEQ ID NO: 912201 - DNA, 20 bp, Homo sapiens
ccaccagccctactcctgcg

SEQ ID NO: 912202 - DNA, 23 bp, Homo sapiens
ccaccagccctactcctgcggct

SEQ ID NO: 912203 - DNA, 17 bp, Homo sapiens
ccaccagccgccccagc

SEQ ID NO: 912204 - DNA, 18 bp, Homo sapiens
ccaccagccgccccagcc

SEQ ID NO: 912205 - DNA, 16 bp, Homo sapiens
ccaccagcctgctgac

SEQ ID NO: 912206 - DNA, 23 bp, Homo sapiens
ccaccagcctgctgacagacact

SEQ ID NO: 912207 - DNA, 12 bp, Homo sapiens
ccaccagctcca

SEQ ID NO: 912208 - DNA, 13 bp, Homo sapiens
ccaccagctccac

SEQ ID NO: 912209 - DNA, 20 bp, Homo sapiens
ccaccagctccacacattcc

SEQ ID NO: 912210 - DNA, 14 bp, Homo sapiens
ccaccaggagaacc

SEQ ID NO: 912211 - DNA, 11 bp, Homo sapiens
ccaccaggagc

SEQ ID NO: 912212 - DNA, 17 bp, Homo sapiens
ccaccaggagcacctgg

SEQ ID NO: 912213 - DNA, 16 bp, Homo sapiens
ccaccaggagcagcag

SEQ ID NO: 912214 - DNA, 19 bp, Homo sapiens
ccaccaggagcagcagcca

SEQ ID NO: 912215 - DNA, 20 bp, Homo sapiens
ccaccaggagcagcagccag

SEQ ID NO: 912216 - DNA, 13 bp, Homo sapiens
ccaccaggccacc

SEQ ID NO: 912217 - DNA, 14 bp, Homo sapiens
ccaccaggcctcac

SEQ ID NO: 912218 - DNA, 18 bp, Homo sapiens
ccaccaggctggcgcagc

SEQ ID NO: 912219 - DNA, 11 bp, Homo sapiens
ccaccagggtg

SEQ ID NO: 912220 - DNA, 22 bp, Homo sapiens
ccaccagggtggaccaggcctg

SEQ ID NO: 912221 - DNA, 21 bp, Homo sapiens
ccaccctgagttgcttttcag

SEQ ID NO: 912222 - DNA, 17 bp, Homo sapiens
ccaccctgatccttttc

SEQ ID NO: 912223 - DNA, 13 bp, Homo sapiens
ccaccctgccaag

SEQ ID NO: 912224 - DNA, 19 bp, Homo sapiens
ccaccctgccaagactcct

SEQ ID NO: 912225 - DNA, 17 bp, Homo sapiens
ccaccctgcgggccagg

SEQ ID NO: 912226 - DNA, 15 bp, Homo sapiens
ccaccctgctcctcc

SEQ ID NO: 912227 - DNA, 17 bp, Homo sapiens
ccaccctgctcctcctg

SEQ ID NO: 912228 - DNA, 20 bp, Homo sapiens
ccaccctgctcctcctgccc

SEQ ID NO: 912229 - DNA, 12 bp, Homo sapiens
ccaccctggaga

SEQ ID NO: 912230 - DNA, 20 bp, Homo sapiens
ccaccctggccgagtccaag

SEQ ID NO: 912231 - DNA, 21 bp, Homo sapiens
ccaccctggccgagtccaagc

SEQ ID NO: 912232 - DNA, 22 bp, Homo sapiens
ccaccctggccgagtccaagct

SEQ ID NO: 912233 - DNA, 13 bp, Homo sapiens
ccaccctgggacc

SEQ ID NO: 912234 - DNA, 19 bp, Homo sapiens
ccaccctgtcccccagctc

SEQ ID NO: 912235 - DNA, 21 bp, Homo sapiens
ccaccctgtcccccagctctg

SEQ ID NO: 912236 - DNA, 14 bp, Homo sapiens
ccacccttcagacc

SEQ ID NO: 912237 - DNA, 13 bp, Homo sapiens
ccacccttccatc

SEQ ID NO: 912238 - DNA, 14 bp, Homo sapiens
ccacccttccatca

SEQ ID NO: 912239 - DNA, 14 bp, Homo sapiens
ccacccttcccctc

SEQ ID NO: 912240 - DNA, 14 bp, Homo sapiens
catgctacacactg

SEQ ID NO: 912241 - DNA, 16 bp, Homo sapiens
catgctatctctgtgt

SEQ ID NO: 912242 - DNA, 14 bp, Homo sapiens
catgctatgttctg

SEQ ID NO: 912243 - DNA, 16 bp, Homo sapiens
catgctatgttctgtc

SEQ ID NO: 912244 - DNA, 18 bp, Homo sapiens
catgctatgttctgtctt

SEQ ID NO: 912245 - DNA, 18 bp, Homo sapiens
catgctattcacaattat

SEQ ID NO: 912246 - DNA, 17 bp, Homo sapiens
catgctcaacccccctc

SEQ ID NO: 912247 - DNA, 18 bp, Homo sapiens
catgctcaacccccctcc

SEQ ID NO: 912248 - DNA, 23 bp, Homo sapiens
catgctcaacccccctcccagac

SEQ ID NO: 912249 - DNA, 14 bp, Homo sapiens
catgctcaatgaaa

SEQ ID NO: 912250 - DNA, 15 bp, Homo sapiens
catgctcacctctag

SEQ ID NO: 912251 - DNA, 18 bp, Homo sapiens
catgctcatctgctggtc

SEQ ID NO: 912252 - DNA, 20 bp, Homo sapiens
catgctcatgtatatttagt

SEQ ID NO: 912253 - DNA, 18 bp, Homo sapiens
catgctcctcacctgtct

SEQ ID NO: 912254 - DNA, 16 bp, Homo sapiens
catgctcctggcccac

SEQ ID NO: 912255 - DNA, 20 bp, Homo sapiens
catgctcctggcccactgca

SEQ ID NO: 912256 - DNA, 16 bp, Homo sapiens
catgctctctgcagcc

SEQ ID NO: 912257 - DNA, 19 bp, Homo sapiens
catgctctctgcagccagc

SEQ ID NO: 912258 - DNA, 20 bp, Homo sapiens
catgctctctgcagccagcc

SEQ ID NO: 912259 - DNA, 23 bp, Homo sapiens
catgctctctgcagccagcccag

SEQ ID NO: 912260 - DNA, 22 bp, Homo sapiens
catgctctgccccaagccccca

SEQ ID NO: 912261 - DNA, 12 bp, Homo sapiens
catgctctggaa

SEQ ID NO: 912262 - DNA, 13 bp, Homo sapiens
catgctctggaag

SEQ ID NO: 912263 - DNA, 14 bp, Homo sapiens
catgctctggaagc

SEQ ID NO: 912264 - DNA, 16 bp, Homo sapiens
catgctctggaagcct

SEQ ID NO: 912265 - DNA, 17 bp, Homo sapiens
catgctctggaagcctg

SEQ ID NO: 912266 - DNA, 21 bp, Homo sapiens
catgctctggaagcctggact

SEQ ID NO: 912267 - DNA, 19 bp, Homo sapiens
catgctcttgttctgttcc

SEQ ID NO: 912268 - DNA, 16 bp, Homo sapiens
catgctgaggcctggg

SEQ ID NO: 912269 - DNA, 19 bp, Homo sapiens
catgctgaggcctgggccg

SEQ ID NO: 912270 - DNA, 18 bp, Homo sapiens
catgctgataatcatttt

SEQ ID NO: 912271 - DNA, 17 bp, Homo sapiens
catgctgcccagccact

SEQ ID NO: 912272 - DNA, 12 bp, Homo sapiens
catgctgcctcc

SEQ ID NO: 912273 - DNA, 14 bp, Homo sapiens
catgctgcctccag

SEQ ID NO: 912274 - DNA, 13 bp, Homo sapiens
catgctgcctggc

SEQ ID NO: 912275 - DNA, 16 bp, Homo sapiens
catgctgcctggcaca

SEQ ID NO: 912276 - DNA, 18 bp, Homo sapiens
catgctggaacctgcaaa

SEQ ID NO: 912277 - DNA, 18 bp, Homo sapiens
catgctggagggaggctg

SEQ ID NO: 912278 - DNA, 20 bp, Homo sapiens
catgctggatactggacaca

SEQ ID NO: 912279 - DNA, 18 bp, Homo sapiens
catgctggcggcgcagag

SEQ ID NO: 912280 - DNA, 22 bp, Homo sapiens
catgctggcggcgcagagggaa

SEQ ID NO: 912281 - DNA, 20 bp, Homo sapiens
catgctgggaagacgcctga

SEQ ID NO: 912282 - DNA, 19 bp, Homo sapiens
catgctgggccactgggga

SEQ ID NO: 912283 - DNA, 20 bp, Homo sapiens
catgctggggcaagtccctg

SEQ ID NO: 912284 - DNA, 20 bp, Homo sapiens
catgctggtgggttagctaa

SEQ ID NO: 912285 - DNA, 21 bp, Homo sapiens
catgctggttacctgttccat

SEQ ID NO: 912286 - DNA, 18 bp, Homo sapiens
catgctgtccctgcactg

SEQ ID NO: 912287 - DNA, 20 bp, Homo sapiens
catgctgtgcgcccagggct

SEQ ID NO: 912288 - DNA, 13 bp, Homo sapiens
catgctgtgctct

SEQ ID NO: 912289 - DNA, 21 bp, Homo sapiens
catgctgttgcatttagaact

SEQ ID NO: 912290 - DNA, 13 bp, Homo sapiens
catgcttactttt

SEQ ID NO: 912291 - DNA, 15 bp, Homo sapiens
catgcttacttttta

SEQ ID NO: 912292 - DNA, 16 bp, Homo sapiens
catgcttactttttaa

SEQ ID NO: 912293 - DNA, 17 bp, Homo sapiens
catgcttactttttaat

SEQ ID NO: 912294 - DNA, 17 bp, Homo sapiens
catgcttagcttatctt

SEQ ID NO: 912295 - DNA, 19 bp, Homo sapiens
catgcttagtcactgcctg

SEQ ID NO: 912296 - DNA, 12 bp, Homo sapiens
catgcttcactc

SEQ ID NO: 912297 - DNA, 14 bp, Homo sapiens
catgcttcctttct

SEQ ID NO: 912298 - DNA, 15 bp, Homo sapiens
catgcttcctttctc

SEQ ID NO: 912299 - DNA, 18 bp, Homo sapiens
catgcttcctttctctcc

SEQ ID NO: 912300 - DNA, 13 bp, Homo sapiens
catgcttgacata

SEQ ID NO: 912301 - DNA, 15 bp, Homo sapiens
catgcttgggctgac

SEQ ID NO: 912302 - DNA, 13 bp, Homo sapiens
catgcttgtgtta

SEQ ID NO: 912303 - DNA, 14 bp, Homo sapiens
catgctttgctgct

SEQ ID NO: 912304 - DNA, 22 bp, Homo sapiens
catgctttgctgctatgaaaat

SEQ ID NO: 912305 - DNA, 20 bp, Homo sapiens
catgcttttctgccactcca

SEQ ID NO: 912306 - DNA, 16 bp, Homo sapiens
catggaaaaatgccat

SEQ ID NO: 912307 - DNA, 22 bp, Homo sapiens
catggaaaaatgccatcaaatg

SEQ ID NO: 912308 - DNA, 13 bp, Homo sapiens
catggaaaaatgg

SEQ ID NO: 912309 - DNA, 15 bp, Homo sapiens
catggaaatcagcca

SEQ ID NO: 912310 - DNA, 16 bp, Homo sapiens
catggaaatttaaagc

SEQ ID NO: 912311 - DNA, 17 bp, Homo sapiens
catggaaatttaaagca

SEQ ID NO: 912312 - DNA, 18 bp, Homo sapiens
catggaatcgaagtgttt

SEQ ID NO: 912313 - DNA, 18 bp, Homo sapiens
catggaatggacatcctg

SEQ ID NO: 912314 - DNA, 15 bp, Homo sapiens
catggaattccctcc

SEQ ID NO: 912315 - DNA, 21 bp, Homo sapiens
catggacaatataaactgaaa

SEQ ID NO: 912316 - DNA, 21 bp, Homo sapiens
catggacaccccttatccagg

SEQ ID NO: 912317 - DNA, 14 bp, Homo sapiens
catggacaccttgt

SEQ ID NO: 912318 - DNA, 18 bp, Homo sapiens
catggacactacacccag

SEQ ID NO: 912319 - DNA, 20 bp, Homo sapiens
catggacactacacccagca

SEQ ID NO: 912320 - DNA, 14 bp, Homo sapiens
catggacaggctgg

SEQ ID NO: 912321 - DNA, 16 bp, Homo sapiens
catggacaggctggct

SEQ ID NO: 912322 - DNA, 15 bp, Homo sapiens
catggacagggccag

SEQ ID NO: 912323 - DNA, 16 bp, Homo sapiens
catggacagggccagg

SEQ ID NO: 912324 - DNA, 21 bp, Homo sapiens
catggacatgtgtcccagcca

SEQ ID NO: 912325 - DNA, 18 bp, Homo sapiens
catggacatttagaagaa

SEQ ID NO: 912326 - DNA, 14 bp, Homo sapiens
catggaccagcatc

SEQ ID NO: 912327 - DNA, 19 bp, Homo sapiens
catggacgttcggggcatg

SEQ ID NO: 912328 - DNA, 13 bp, Homo sapiens
catggacttgtat

SEQ ID NO: 912329 - DNA, 14 bp, Homo sapiens
catggagaaaccct

SEQ ID NO: 912330 - DNA, 20 bp, Homo sapiens
catggagaagggttctgccc

SEQ ID NO: 912331 - DNA, 16 bp, Homo sapiens
catggagactcctgcc

SEQ ID NO: 912332 - DNA, 20 bp, Homo sapiens
catggagactcctgccctgt

SEQ ID NO: 912333 - DNA, 21 bp, Homo sapiens
catggagactcctgccctgtt

SEQ ID NO: 912334 - DNA, 15 bp, Homo sapiens
catggagagctgttc

SEQ ID NO: 912335 - DNA, 16 bp, Homo sapiens
catggagatctgaagg

SEQ ID NO: 912336 - DNA, 17 bp, Homo sapiens
catggagatctgaaggg

SEQ ID NO: 912337 - DNA, 10 bp, Homo sapiens
catggagcca

SEQ ID NO: 912338 - DNA, 13 bp, Homo sapiens
catggagcctgga

SEQ ID NO: 912339 - DNA, 15 bp, Homo sapiens
catggagctgggcta

SEQ ID NO: 912340 - DNA, 14 bp, Homo sapiens
catggaggagcttg

SEQ ID NO: 912341 - DNA, 20 bp, Homo sapiens
catggaggccctcctgtgct

SEQ ID NO: 912342 - DNA, 14 bp, Homo sapiens
catggagtgtgtat

SEQ ID NO: 912343 - DNA, 17 bp, Homo sapiens
catggagtgtgtattgt

SEQ ID NO: 912344 - DNA, 22 bp, Homo sapiens
catggagtgtgtattgttccca

SEQ ID NO: 912345 - DNA, 20 bp, Homo sapiens
catggagtgttggcttctca

SEQ ID NO: 912346 - DNA, 16 bp, Homo sapiens
catggatacttcctgg

SEQ ID NO: 912347 - DNA, 12 bp, Homo sapiens
catggatgtttt

SEQ ID NO: 912348 - DNA, 19 bp, Homo sapiens
catggattacttctctata

SEQ ID NO: 912349 - DNA, 15 bp, Homo sapiens
catggattgccacag

SEQ ID NO: 912350 - DNA, 13 bp, Homo sapiens
catggatttcttt

SEQ ID NO: 912351 - DNA, 20 bp, Homo sapiens
catggattttggataaatca

SEQ ID NO: 912352 - DNA, 21 bp, Homo sapiens
catggcaaatcaggggccaga

SEQ ID NO: 912353 - DNA, 14 bp, Homo sapiens
catggcaattctgg

SEQ ID NO: 912354 - DNA, 19 bp, Homo sapiens
catggcaattctggaagct

SEQ ID NO: 912355 - DNA, 18 bp, Homo sapiens
catggcaattgcactcat

SEQ ID NO: 912356 - DNA, 21 bp, Homo sapiens
catggcaattttgtaaattga

SEQ ID NO: 912357 - DNA, 22 bp, Homo sapiens
catggcacaggcccgccctctg

SEQ ID NO: 912358 - DNA, 19 bp, Homo sapiens
catggcaccaaagccacca

SEQ ID NO: 912359 - DNA, 18 bp, Homo sapiens
catggcaccagccccctg

SEQ ID NO: 912360 - DNA, 18 bp, Homo sapiens
catggcactaaaccactt

SEQ ID NO: 912361 - DNA, 19 bp, Homo sapiens
catggcactaaaccacttc

SEQ ID NO: 912362 - DNA, 13 bp, Homo sapiens
catggcagaaggc

SEQ ID NO: 912363 - DNA, 23 bp, Homo sapiens
catggcagctggttgctccattt

SEQ ID NO: 912364 - DNA, 12 bp, Homo sapiens
catggcagctgt

SEQ ID NO: 912365 - DNA, 22 bp, Homo sapiens
agtctccagggacccttgcctg

SEQ ID NO: 912366 - DNA, 19 bp, Homo sapiens
agtctccagtggttgctgt

SEQ ID NO: 912367 - DNA, 22 bp, Homo sapiens
agtctccagtggttgctgttga

SEQ ID NO: 912368 - DNA, 19 bp, Homo sapiens
agtctccatgaagagcttg

SEQ ID NO: 912369 - DNA, 20 bp, Homo sapiens
agtctccccactccaccctg

SEQ ID NO: 912370 - DNA, 18 bp, Homo sapiens
agtctccccttgcagcct

SEQ ID NO: 912371 - DNA, 19 bp, Homo sapiens
agtctccctccgactccag

SEQ ID NO: 912372 - DNA, 23 bp, Homo sapiens
agtctcctcaatttttgtctcag

SEQ ID NO: 912373 - DNA, 15 bp, Homo sapiens
agtctcctcactctg

SEQ ID NO: 912374 - DNA, 23 bp, Homo sapiens
agtctcctcactctgtccctgtc

SEQ ID NO: 912375 - DNA, 17 bp, Homo sapiens
agtctcctttgcactga

SEQ ID NO: 912376 - DNA, 18 bp, Homo sapiens
agtctcctttgcactgag

SEQ ID NO: 912377 - DNA, 15 bp, Homo sapiens
agtctcgaatgtaat

SEQ ID NO: 912378 - DNA, 23 bp, Homo sapiens
agtctcgaatgtaattggaatct

SEQ ID NO: 912379 - DNA, 19 bp, Homo sapiens
agtctcgctctgttgccca

SEQ ID NO: 912380 - DNA, 16 bp, Homo sapiens
agtctctaggttctga

SEQ ID NO: 912381 - DNA, 14 bp, Homo sapiens
agtctctctgtgaa

SEQ ID NO: 912382 - DNA, 23 bp, Homo sapiens
agtctctctgtgaatacaattaa

SEQ ID NO: 912383 - DNA, 16 bp, Homo sapiens
agtctctcttctctcc

SEQ ID NO: 912384 - DNA, 11 bp, Homo sapiens
agtctctgagc

SEQ ID NO: 912385 - DNA, 22 bp, Homo sapiens
agtctctgaggggctaccagga

SEQ ID NO: 912386 - DNA, 17 bp, Homo sapiens
agtctctgccacccact

SEQ ID NO: 912387 - DNA, 22 bp, Homo sapiens
agtctctgccacccactcagga

SEQ ID NO: 912388 - DNA, 17 bp, Homo sapiens
agtctcttacaaaagct

SEQ ID NO: 912389 - DNA, 17 bp, Homo sapiens
agtctcttctccactgg

SEQ ID NO: 912390 - DNA, 18 bp, Homo sapiens
agtctcttctccactgga

SEQ ID NO: 912391 - DNA, 19 bp, Homo sapiens
agtctcttctccactggat

SEQ ID NO: 912392 - DNA, 23 bp, Homo sapiens
agtctctttaatcttcagtttta

SEQ ID NO: 912393 - DNA, 14 bp, Homo sapiens
agtctctttcttcc

SEQ ID NO: 912394 - DNA, 17 bp, Homo sapiens
agtctctttcttccttt

SEQ ID NO: 912395 - DNA, 15 bp, Homo sapiens
agtctgaacagctgt

SEQ ID NO: 912396 - DNA, 16 bp, Homo sapiens
agtctgagatgccccg

SEQ ID NO: 912397 - DNA, 22 bp, Homo sapiens
agtctgaggactgtcctcccac

SEQ ID NO: 912398 - DNA, 23 bp, Homo sapiens
agtctgagtcctgtctctgcctg

SEQ ID NO: 912399 - DNA, 21 bp, Homo sapiens
agtctgattataccatgtgtg

SEQ ID NO: 912400 - DNA, 12 bp, Homo sapiens
agtctgatttaa

SEQ ID NO: 912401 - DNA, 16 bp, Homo sapiens
agtctgccgcccacct

SEQ ID NO: 912402 - DNA, 14 bp, Homo sapiens
agtctgctccacca

SEQ ID NO: 912403 - DNA, 16 bp, Homo sapiens
agtctgctgccctcca

SEQ ID NO: 912404 - DNA, 21 bp, Homo sapiens
agtctggacctccatccctgc

SEQ ID NO: 912405 - DNA, 22 bp, Homo sapiens
agtctggacctccatccctgct

SEQ ID NO: 912406 - DNA, 15 bp, Homo sapiens
agtctggatctggga

SEQ ID NO: 912407 - DNA, 22 bp, Homo sapiens
agtctggctaggttaaaggcca

SEQ ID NO: 912408 - DNA, 17 bp, Homo sapiens
agtctgggatgtagaac

SEQ ID NO: 912409 - DNA, 14 bp, Homo sapiens
agtctgggcctctg

SEQ ID NO: 912410 - DNA, 20 bp, Homo sapiens
agtctgggcctctgactctg

SEQ ID NO: 912411 - DNA, 16 bp, Homo sapiens
agtctgggctgccggg

SEQ ID NO: 912412 - DNA, 15 bp, Homo sapiens
agtctggggacctgg

SEQ ID NO: 912413 - DNA, 16 bp, Homo sapiens
agtctggtggaggagc

SEQ ID NO: 912414 - DNA, 15 bp, Homo sapiens
agtctggtttctaga

SEQ ID NO: 912415 - DNA, 15 bp, Homo sapiens
agtctgtaaaaccag

SEQ ID NO: 912416 - DNA, 15 bp, Homo sapiens
agtctgtaaaataca

SEQ ID NO: 912417 - DNA, 22 bp, Homo sapiens
agtctgtagggagtgaagccac

SEQ ID NO: 912418 - DNA, 21 bp, Homo sapiens
agtctgtatcaaacccacgat

SEQ ID NO: 912419 - DNA, 23 bp, Homo sapiens
agtctgtcatgaacatgttcctg

SEQ ID NO: 912420 - DNA, 15 bp, Homo sapiens
agtctgtcctgtgac

SEQ ID NO: 912421 - DNA, 16 bp, Homo sapiens
agtctgtcctgtgacg

SEQ ID NO: 912422 - DNA, 12 bp, Homo sapiens
agtctgtccttg

SEQ ID NO: 912423 - DNA, 14 bp, Homo sapiens
agtctgtctactgt

SEQ ID NO: 912424 - DNA, 15 bp, Homo sapiens
agtctgtctactgtg

SEQ ID NO: 912425 - DNA, 20 bp, Homo sapiens
agtctgtctactgtggtgat

SEQ ID NO: 912426 - DNA, 21 bp, Homo sapiens
agtctgtctactgtggtgatc

SEQ ID NO: 912427 - DNA, 14 bp, Homo sapiens
agtctgtggatcag

SEQ ID NO: 912428 - DNA, 17 bp, Homo sapiens
agtctgtgtaactttaa

SEQ ID NO: 912429 - DNA, 11 bp, Homo sapiens
agtctgtgtga

SEQ ID NO: 912430 - DNA, 14 bp, Homo sapiens
agtctgtgtgactg

SEQ ID NO: 912431 - DNA, 13 bp, Homo sapiens
agtctgttatgca

SEQ ID NO: 912432 - DNA, 20 bp, Homo sapiens
agtctgttatttattattaa

SEQ ID NO: 912433 - DNA, 15 bp, Homo sapiens
agtcttaacaaacca

SEQ ID NO: 912434 - DNA, 18 bp, Homo sapiens
agtcttaactgtatttca

SEQ ID NO: 912435 - DNA, 19 bp, Homo sapiens
agtcttaactgtatttcag

SEQ ID NO: 912436 - DNA, 13 bp, Homo sapiens
agtcttaagaact

SEQ ID NO: 912437 - DNA, 15 bp, Homo sapiens
agtcttaataaaata

SEQ ID NO: 912438 - DNA, 22 bp, Homo sapiens
agtcttaataaaataaactaga

SEQ ID NO: 912439 - DNA, 20 bp, Homo sapiens
agtcttacaatcaaatctcc

SEQ ID NO: 912440 - DNA, 22 bp, Homo sapiens
agtcttacataaaccatttttg

SEQ ID NO: 912441 - DNA, 18 bp, Homo sapiens
agtcttactctgtctccc

SEQ ID NO: 912442 - DNA, 22 bp, Homo sapiens
agtcttatcttctgcagtgagt

SEQ ID NO: 912443 - DNA, 16 bp, Homo sapiens
agtcttatgtaaagta

SEQ ID NO: 912444 - DNA, 23 bp, Homo sapiens
agtcttatgtaaagtatgttttt

SEQ ID NO: 912445 - DNA, 16 bp, Homo sapiens
agtcttcactctctga

SEQ ID NO: 912446 - DNA, 17 bp, Homo sapiens
agtcttcactctctgaa

SEQ ID NO: 912447 - DNA, 15 bp, Homo sapiens
agtcttcagacccag

SEQ ID NO: 912448 - DNA, 17 bp, Homo sapiens
agtcttcagacccagag

SEQ ID NO: 912449 - DNA, 19 bp, Homo sapiens
agtcttccacaaagaaaat

SEQ ID NO: 912450 - DNA, 20 bp, Homo sapiens
agtcttccacaaagaaaatt

SEQ ID NO: 912451 - DNA, 13 bp, Homo sapiens
agtcttccctcag

SEQ ID NO: 912452 - DNA, 14 bp, Homo sapiens
agtcttccctcaga

SEQ ID NO: 912453 - DNA, 21 bp, Homo sapiens
agtcttccctcagatttccat

SEQ ID NO: 912454 - DNA, 18 bp, Homo sapiens
agtcttcctgacacttta

SEQ ID NO: 912455 - DNA, 19 bp, Homo sapiens
agtcttcctgacactttaa

SEQ ID NO: 912456 - DNA, 15 bp, Homo sapiens
agtcttccttagcta

SEQ ID NO: 912457 - DNA, 23 bp, Homo sapiens
agtcttccttagctaaatgcaat

SEQ ID NO: 912458 - DNA, 18 bp, Homo sapiens
agtcttctgactgtcacc

SEQ ID NO: 912459 - DNA, 19 bp, Homo sapiens
agtcttgaagttgggtgtt

SEQ ID NO: 912460 - DNA, 23 bp, Homo sapiens
agtcttgaagttgggtgtttcca

SEQ ID NO: 912461 - DNA, 13 bp, Homo sapiens
agtcttgcctagg

SEQ ID NO: 912462 - DNA, 23 bp, Homo sapiens
agtcttgctctgttacccaggct

SEQ ID NO: 912463 - DNA, 15 bp, Homo sapiens
agtcttggcggcagc

SEQ ID NO: 912464 - DNA, 21 bp, Homo sapiens
agtcttggcggcagcagccat

SEQ ID NO: 912465 - DNA, 16 bp, Homo sapiens
agtcttggtaaaacat

SEQ ID NO: 912466 - DNA, 16 bp, Homo sapiens
agtcttggtggttcta

SEQ ID NO: 912467 - DNA, 16 bp, Homo sapiens
agtcttggttctaaag

SEQ ID NO: 912468 - DNA, 21 bp, Homo sapiens
agtcttggttctaaaggtacc

SEQ ID NO: 912469 - DNA, 17 bp, Homo sapiens
agtcttggtttctctct

SEQ ID NO: 912470 - DNA, 23 bp, Homo sapiens
agtcttggtttctctctacagtg

SEQ ID NO: 912471 - DNA, 18 bp, Homo sapiens
agtcttgtattaagttgt

SEQ ID NO: 912472 - DNA, 22 bp, Homo sapiens
agtcttgtattaagttgttaat

SEQ ID NO: 912473 - DNA, 19 bp, Homo sapiens
agtctttaaaggcccagcc

SEQ ID NO: 912474 - DNA, 23 bp, Homo sapiens
agtctttaaaggcccagccccta

SEQ ID NO: 912475 - DNA, 13 bp, Homo sapiens
agtctttcccaat

SEQ ID NO: 912476 - DNA, 17 bp, Homo sapiens
agtctttgccagtcatt

SEQ ID NO: 912477 - DNA, 22 bp, Homo sapiens
agtctttgccagtcattcagca

SEQ ID NO: 912478 - DNA, 14 bp, Homo sapiens
agtctttgccttct

SEQ ID NO: 912479 - DNA, 15 bp, Homo sapiens
agtctttgccttctc

SEQ ID NO: 912480 - DNA, 12 bp, Homo sapiens
agtctttgtgtg

SEQ ID NO: 912481 - DNA, 15 bp, Homo sapiens
agtctttgtgtgtta

SEQ ID NO: 912482 - DNA, 18 bp, Homo sapiens
agtctttgtgtgttatat

SEQ ID NO: 912483 - DNA, 19 bp, Homo sapiens
agtctttgtgtgttatatt

SEQ ID NO: 912484 - DNA, 20 bp, Homo sapiens
agtcttttgtaatatcaagc

SEQ ID NO: 912485 - DNA, 17 bp, Homo sapiens
agtcttttgttcgcatg

SEQ ID NO: 912486 - DNA, 19 bp, Homo sapiens
agtcttttttttttccaaa

SEQ ID NO: 912487 - DNA, 20 bp, Homo sapiens
agtcttttttttttccaaat

SEQ ID NO: 912488 - DNA, 14 bp, Homo sapiens
agtgaaaaaaagaa

SEQ ID NO: 912489 - DNA, 14 bp, Homo sapiens
catggcaggctggg

SEQ ID NO: 912490 - DNA, 17 bp, Homo sapiens
catggcaggctgggtga

SEQ ID NO: 912491 - DNA, 16 bp, Homo sapiens
catggcagggcctcat

SEQ ID NO: 912492 - DNA, 22 bp, Homo sapiens
catggcagggcctcatctcacc

SEQ ID NO: 912493 - DNA, 17 bp, Homo sapiens
catggcatagccccggc

SEQ ID NO: 912494 - DNA, 19 bp, Homo sapiens
catggcatgcttaaatttt

SEQ ID NO: 912495 - DNA, 12 bp, Homo sapiens
catggccacccc

SEQ ID NO: 912496 - DNA, 16 bp, Homo sapiens
catggccatagaggcc

SEQ ID NO: 912497 - DNA, 21 bp, Homo sapiens
catggccatagaggcccaggc

SEQ ID NO: 912498 - DNA, 20 bp, Homo sapiens
catggcccccaataaaggca

SEQ ID NO: 912499 - DNA, 23 bp, Homo sapiens
catggcccccaataaaggcagct

SEQ ID NO: 912500 - DNA, 17 bp, Homo sapiens
catggccccccactccc

SEQ ID NO: 912501 - DNA, 17 bp, Homo sapiens
catggcccctctgacct

SEQ ID NO: 912502 - DNA, 17 bp, Homo sapiens
catggcccgcagtggct

SEQ ID NO: 912503 - DNA, 16 bp, Homo sapiens
catggccctgtcccag

SEQ ID NO: 912504 - DNA, 21 bp, Homo sapiens
catggccgaagccccttggag

SEQ ID NO: 912505 - DNA, 23 bp, Homo sapiens
catggccgaagccccttggagag

SEQ ID NO: 912506 - DNA, 14 bp, Homo sapiens
catggcctctgcaa

SEQ ID NO: 912507 - DNA, 15 bp, Homo sapiens
catggcgccctgcct

SEQ ID NO: 912508 - DNA, 18 bp, Homo sapiens
catggcgtaatgggcctg

SEQ ID NO: 912509 - DNA, 19 bp, Homo sapiens
catggcgtaatgggcctgc

SEQ ID NO: 912510 - DNA, 21 bp, Homo sapiens
catggcgtaatgggcctgccc

SEQ ID NO: 912511 - DNA, 15 bp, Homo sapiens
catggctattttata

SEQ ID NO: 912512 - DNA, 22 bp, Homo sapiens
catggctcagatcggccacagg

SEQ ID NO: 912513 - DNA, 13 bp, Homo sapiens
catggctcaggca

SEQ ID NO: 912514 - DNA, 20 bp, Homo sapiens
catggctcaggcaagcccct

SEQ ID NO: 912515 - DNA, 14 bp, Homo sapiens
catggctccagtct

SEQ ID NO: 912516 - DNA, 13 bp, Homo sapiens
catggctcctgtc

SEQ ID NO: 912517 - DNA, 16 bp, Homo sapiens
catggctcctgtctgg

SEQ ID NO: 912518 - DNA, 19 bp, Homo sapiens
catggctgaagctggagca

SEQ ID NO: 912519 - DNA, 22 bp, Homo sapiens
catggctgaagctggagcagcg

SEQ ID NO: 912520 - DNA, 16 bp, Homo sapiens
catggctgaagttggc

SEQ ID NO: 912521 - DNA, 22 bp, Homo sapiens
catggctgggaacatgacccag

SEQ ID NO: 912522 - DNA, 15 bp, Homo sapiens
catggcttcctcctc

SEQ ID NO: 912523 - DNA, 16 bp, Homo sapiens
catggcttcctcctcc

SEQ ID NO: 912524 - DNA, 18 bp, Homo sapiens
catggcttcctcctccct

SEQ ID NO: 912525 - DNA, 23 bp, Homo sapiens
catggcttgttctctggaacctg

SEQ ID NO: 912526 - DNA, 22 bp, Homo sapiens
catggctttcatcctgtgtccc

SEQ ID NO: 912527 - DNA, 23 bp, Homo sapiens
catgggaaactgttgtgggcgct

SEQ ID NO: 912528 - DNA, 15 bp, Homo sapiens
catgggaacctcata

SEQ ID NO: 912529 - DNA, 17 bp, Homo sapiens
catgggaacctcatatg

SEQ ID NO: 912530 - DNA, 18 bp, Homo sapiens
catgggaagatgtctcag

SEQ ID NO: 912531 - DNA, 13 bp, Homo sapiens
catgggaagggga

SEQ ID NO: 912532 - DNA, 17 bp, Homo sapiens
catgggaaggggaggac

SEQ ID NO: 912533 - DNA, 16 bp, Homo sapiens
catgggacctcctccc

SEQ ID NO: 912534 - DNA, 22 bp, Homo sapiens
catgggagccagctgctttttg

SEQ ID NO: 912535 - DNA, 14 bp, Homo sapiens
catgggagggatca

SEQ ID NO: 912536 - DNA, 22 bp, Homo sapiens
catgggagggggcttgaagcca

SEQ ID NO: 912537 - DNA, 16 bp, Homo sapiens
catgggattattagaa

SEQ ID NO: 912538 - DNA, 16 bp, Homo sapiens
catgggcattgcagcc

SEQ ID NO: 912539 - DNA, 15 bp, Homo sapiens
catgggccagagcct

SEQ ID NO: 912540 - DNA, 13 bp, Homo sapiens
catgggcctctct

SEQ ID NO: 912541 - DNA, 20 bp, Homo sapiens
catgggcctctctgggggag

SEQ ID NO: 912542 - DNA, 22 bp, Homo sapiens
catgggcctctctgggggaggc

SEQ ID NO: 912543 - DNA, 13 bp, Homo sapiens
catgggcctgggc

SEQ ID NO: 912544 - DNA, 18 bp, Homo sapiens
catgggcgcaggcccagt

SEQ ID NO: 912545 - DNA, 22 bp, Homo sapiens
catgggctgagtggggagcagt

SEQ ID NO: 912546 - DNA, 13 bp, Homo sapiens
catgggctggggg

SEQ ID NO: 912547 - DNA, 23 bp, Homo sapiens
catgggcttggacttcctggggc

SEQ ID NO: 912548 - DNA, 17 bp, Homo sapiens
catggggaaaccctgga

SEQ ID NO: 912549 - DNA, 17 bp, Homo sapiens
catggggaaggcagagg

SEQ ID NO: 912550 - DNA, 22 bp, Homo sapiens
catggggaaggcagaggctggc

SEQ ID NO: 912551 - DNA, 24 bp, Homo sapiens
catggggaaggcagaggctggcac

SEQ ID NO: 912552 - DNA, 11 bp, Homo sapiens
catggggagga

SEQ ID NO: 912553 - DNA, 13 bp, Homo sapiens
catggggaggcag

SEQ ID NO: 912554 - DNA, 14 bp, Homo sapiens
catggggaggcagc

SEQ ID NO: 912555 - DNA, 15 bp, Homo sapiens
catggggaggcagca

SEQ ID NO: 912556 - DNA, 16 bp, Homo sapiens
catggggaggcagcag

SEQ ID NO: 912557 - DNA, 20 bp, Homo sapiens
catggggaggcagcagagcg

SEQ ID NO: 912558 - DNA, 17 bp, Homo sapiens
catggggatctgggggg

SEQ ID NO: 912559 - DNA, 13 bp, Homo sapiens
catggggcaagcc

SEQ ID NO: 912560 - DNA, 23 bp, Homo sapiens
catggggcagaggcttccgtgtc

SEQ ID NO: 912561 - DNA, 12 bp, Homo sapiens
catgggggagag

SEQ ID NO: 912562 - DNA, 18 bp, Homo sapiens
catgggggctgtctttgc

SEQ ID NO: 912563 - DNA, 16 bp, Homo sapiens
catgggggtgagaccc

SEQ ID NO: 912564 - DNA, 23 bp, Homo sapiens
catgggggtgagaccctcgcaga

SEQ ID NO: 912565 - DNA, 14 bp, Homo sapiens
catggggtcagccc

SEQ ID NO: 912566 - DNA, 17 bp, Homo sapiens
catggggtcagccccaa

SEQ ID NO: 912567 - DNA, 19 bp, Homo sapiens
catggggtccttggagtga

SEQ ID NO: 912568 - DNA, 19 bp, Homo sapiens
catggggtcggctcctgat

SEQ ID NO: 912569 - DNA, 20 bp, Homo sapiens
catggggtcggctcctgatg

SEQ ID NO: 912570 - DNA, 14 bp, Homo sapiens
catggggttcgaga

SEQ ID NO: 912571 - DNA, 20 bp, Homo sapiens
catggggttggctgggccca

SEQ ID NO: 912572 - DNA, 14 bp, Homo sapiens
catgggtccaagag

SEQ ID NO: 912573 - DNA, 18 bp, Homo sapiens
catgggtccaagagacat

SEQ ID NO: 912574 - DNA, 15 bp, Homo sapiens
catgggtccagggcc

SEQ ID NO: 912575 - DNA, 16 bp, Homo sapiens
catgggtccagggcct

SEQ ID NO: 912576 - DNA, 22 bp, Homo sapiens
catgggtccttgatgccagagg

SEQ ID NO: 912577 - DNA, 15 bp, Homo sapiens
catgggtctggcctg

SEQ ID NO: 912578 - DNA, 21 bp, Homo sapiens
catgggtgcagaccctgaacc

SEQ ID NO: 912579 - DNA, 23 bp, Homo sapiens
catgggtggctgtgacaaccctg

SEQ ID NO: 912580 - DNA, 22 bp, Homo sapiens
catggtaatgacagatgcaagt

SEQ ID NO: 912581 - DNA, 17 bp, Homo sapiens
catggtactaccccagc

SEQ ID NO: 912582 - DNA, 20 bp, Homo sapiens
catggtagagaatctctccc

SEQ ID NO: 912583 - DNA, 21 bp, Homo sapiens
catggtagatttttttcatag

SEQ ID NO: 912584 - DNA, 16 bp, Homo sapiens
catggtatttgaccat

SEQ ID NO: 912585 - DNA, 23 bp, Homo sapiens
catggtatttgaccattttagtt

SEQ ID NO: 912586 - DNA, 16 bp, Homo sapiens
catggtcagccctagg

SEQ ID NO: 912587 - DNA, 19 bp, Homo sapiens
catggtcagccctagggtg

SEQ ID NO: 912588 - DNA, 22 bp, Homo sapiens
catggtcccgaagtgtagggca

SEQ ID NO: 912589 - DNA, 12 bp, Homo sapiens
catggtcctgtc

SEQ ID NO: 912590 - DNA, 15 bp, Homo sapiens
catggtcctgtctgt

SEQ ID NO: 912591 - DNA, 22 bp, Homo sapiens
catggtcctgtctgtccttctg

SEQ ID NO: 912592 - DNA, 23 bp, Homo sapiens
catggtcctgtctgtccttctga

SEQ ID NO: 912593 - DNA, 23 bp, Homo sapiens
catggtcggaaaacatgctacac

SEQ ID NO: 912594 - DNA, 15 bp, Homo sapiens
catggtgaaaagctc

SEQ ID NO: 912595 - DNA, 16 bp, Homo sapiens
catggtgactgccaca

SEQ ID NO: 912596 - DNA, 16 bp, Homo sapiens
catggtgatcagtgca

SEQ ID NO: 912597 - DNA, 21 bp, Homo sapiens
catggtgcagttgacagcagg

SEQ ID NO: 912598 - DNA, 16 bp, Homo sapiens
catggtgcctgagagg

SEQ ID NO: 912599 - DNA, 19 bp, Homo sapiens
catggtgcctgagaggcag

SEQ ID NO: 912600 - DNA, 21 bp, Homo sapiens
catggtgcctgagaggcaggc

SEQ ID NO: 912601 - DNA, 22 bp, Homo sapiens
catggtggacccagcgggcagg

SEQ ID NO: 912602 - DNA, 14 bp, Homo sapiens
catggtggagggca

SEQ ID NO: 912603 - DNA, 15 bp, Homo sapiens
catggtggagggcac

SEQ ID NO: 912604 - DNA, 20 bp, Homo sapiens
catggtggagggcacttcag

SEQ ID NO: 912605 - DNA, 12 bp, Homo sapiens
catggtggcgca

SEQ ID NO: 912606 - DNA, 17 bp, Homo sapiens
catggtggcgcaagcct

SEQ ID NO: 912607 - DNA, 19 bp, Homo sapiens
catggtgggttcaggggac

SEQ ID NO: 912608 - DNA, 17 bp, Homo sapiens
catggtgtctcccaaca

SEQ ID NO: 912609 - DNA, 22 bp, Homo sapiens
catggtgtgaaagtcagatgcc

SEQ ID NO: 912610 - DNA, 13 bp, Homo sapiens
catggtgtggggg

SEQ ID NO: 912611 - DNA, 21 bp, Homo sapiens
catggtgtggggggctggggg

SEQ ID NO: 912612 - DNA, 22 bp, Homo sapiens
catggtgtggggggctggggga

SEQ ID NO: 912613 - DNA, 15 bp, Homo sapiens
agtgaaaaaaagaaa

SEQ ID NO: 912614 - DNA, 15 bp, Homo sapiens
agtgaaaactttgta

SEQ ID NO: 912615 - DNA, 16 bp, Homo sapiens
agtgaaaactttgtag

SEQ ID NO: 912616 - DNA, 14 bp, Homo sapiens
agtgaaaatatagc

SEQ ID NO: 912617 - DNA, 22 bp, Homo sapiens
agtgaaaatcttggagaccctg

SEQ ID NO: 912618 - DNA, 21 bp, Homo sapiens
agtgaaaatttttacattcat

SEQ ID NO: 912619 - DNA, 15 bp, Homo sapiens
agtgaaacagagaaa

SEQ ID NO: 912620 - DNA, 20 bp, Homo sapiens
agtgaaaccaacatccagat

SEQ ID NO: 912621 - DNA, 19 bp, Homo sapiens
agtgaaacctttagggcag

SEQ ID NO: 912622 - DNA, 12 bp, Homo sapiens
agtgaaactttt

SEQ ID NO: 912623 - DNA, 16 bp, Homo sapiens
agtgaaagctagagat

SEQ ID NO: 912624 - DNA, 18 bp, Homo sapiens
agtgaaagggctatggca

SEQ ID NO: 912625 - DNA, 20 bp, Homo sapiens
agtgaaataatttgtgtctg

SEQ ID NO: 912626 - DNA, 15 bp, Homo sapiens
agtgaaatggatact

SEQ ID NO: 912627 - DNA, 16 bp, Homo sapiens
agtgaacactagccag

SEQ ID NO: 912628 - DNA, 17 bp, Homo sapiens
agtgaacactagccaga

SEQ ID NO: 912629 - DNA, 15 bp, Homo sapiens
agtgaaccaaagaga

SEQ ID NO: 912630 - DNA, 21 bp, Homo sapiens
agtgaaccatcattataaacg

SEQ ID NO: 912631 - DNA, 17 bp, Homo sapiens
agtgaaccgtcctttca

SEQ ID NO: 912632 - DNA, 20 bp, Homo sapiens
agtgaactacgcttgctcat

SEQ ID NO: 912633 - DNA, 20 bp, Homo sapiens
agtgaactcctgccaggcac

SEQ ID NO: 912634 - DNA, 16 bp, Homo sapiens
agtgaacttttgtaat

SEQ ID NO: 912635 - DNA, 22 bp, Homo sapiens
agtgaagaatacttctcatttt

SEQ ID NO: 912636 - DNA, 21 bp, Homo sapiens
agtgaagactagaaaattaga

SEQ ID NO: 912637 - DNA, 16 bp, Homo sapiens
agtgaagactggaagc

SEQ ID NO: 912638 - DNA, 19 bp, Homo sapiens
agtgaagaggggcagccct

SEQ ID NO: 912639 - DNA, 20 bp, Homo sapiens
agtgaagatgcaatcagaca

SEQ ID NO: 912640 - DNA, 12 bp, Homo sapiens
agtgaagcagca

SEQ ID NO: 912641 - DNA, 14 bp, Homo sapiens
agtgaagccacaga

SEQ ID NO: 912642 - DNA, 16 bp, Homo sapiens
agtgaagggttttgtg

SEQ ID NO: 912643 - DNA, 23 bp, Homo sapiens
agtgaaggtctttgttatgacag

SEQ ID NO: 912644 - DNA, 22 bp, Homo sapiens
agtgaaggtggggagaagctga

SEQ ID NO: 912645 - DNA, 19 bp, Homo sapiens
agtgaaggttcccaaggac

SEQ ID NO: 912646 - DNA, 21 bp, Homo sapiens
agtgaaggttcccaaggacat

SEQ ID NO: 912647 - DNA, 22 bp, Homo sapiens
agtgaaggttcccaaggacatg

SEQ ID NO: 912648 - DNA, 18 bp, Homo sapiens
agtgaagtctagaatcat

SEQ ID NO: 912649 - DNA, 18 bp, Homo sapiens
agtgaataactgcaaagt

SEQ ID NO: 912650 - DNA, 20 bp, Homo sapiens
agtgaatacattaacggtgc

SEQ ID NO: 912651 - DNA, 23 bp, Homo sapiens
agtgaatacattaacggtgctaa

SEQ ID NO: 912652 - DNA, 21 bp, Homo sapiens
agtgaatacttactataattt

SEQ ID NO: 912653 - DNA, 16 bp, Homo sapiens
agtgaatagctttcag

SEQ ID NO: 912654 - DNA, 15 bp, Homo sapiens
agtgaatccctggga

SEQ ID NO: 912655 - DNA, 21 bp, Homo sapiens
agtgaatctaaggataatgaa

SEQ ID NO: 912656 - DNA, 19 bp, Homo sapiens
agtgaatctttctcctggt

SEQ ID NO: 912657 - DNA, 23 bp, Homo sapiens
agtgaatctttctcctggtgact

SEQ ID NO: 912658 - DNA, 13 bp, Homo sapiens
agtgaatgattca

SEQ ID NO: 912659 - DNA, 16 bp, Homo sapiens
agtgaatgtaggctgg

SEQ ID NO: 912660 - DNA, 16 bp, Homo sapiens
agtgaattagaccttt

SEQ ID NO: 912661 - DNA, 22 bp, Homo sapiens
agtgaattgtacctatttctga

SEQ ID NO: 912662 - DNA, 17 bp, Homo sapiens
agtgaatttatgagatt

SEQ ID NO: 912663 - DNA, 12 bp, Homo sapiens
agtgaatttcag

SEQ ID NO: 912664 - DNA, 15 bp, Homo sapiens
agtgaatttcagtat

SEQ ID NO: 912665 - DNA, 19 bp, Homo sapiens
agtgaatttgaatgaaaaa

SEQ ID NO: 912666 - DNA, 14 bp, Homo sapiens
agtgaatttgcctg

SEQ ID NO: 912667 - DNA, 15 bp, Homo sapiens
agtgaatttgtccat

SEQ ID NO: 912668 - DNA, 19 bp, Homo sapiens
agtgaatttgtccattgta

SEQ ID NO: 912669 - DNA, 16 bp, Homo sapiens
agtgaatttttctcta

SEQ ID NO: 912670 - DNA, 16 bp, Homo sapiens
agtgacaaaagcagca

SEQ ID NO: 912671 - DNA, 20 bp, Homo sapiens
agtgacaaaatgggaggagg

SEQ ID NO: 912672 - DNA, 18 bp, Homo sapiens
agtgacaaggccccagag

SEQ ID NO: 912673 - DNA, 20 bp, Homo sapiens
agtgacaaggccccagagac

SEQ ID NO: 912674 - DNA, 14 bp, Homo sapiens
agtgacacacactg

SEQ ID NO: 912675 - DNA, 13 bp, Homo sapiens
agtgacacagcag

SEQ ID NO: 912676 - DNA, 22 bp, Homo sapiens
agtgacaccaataaatgtttgt

SEQ ID NO: 912677 - DNA, 23 bp, Homo sapiens
agtgacacccagagggagtagaa

SEQ ID NO: 912678 - DNA, 17 bp, Homo sapiens
agtgacacctcagtcat

SEQ ID NO: 912679 - DNA, 18 bp, Homo sapiens
agtgacacttcagagagc

SEQ ID NO: 912680 - DNA, 23 bp, Homo sapiens
agtgacacttcagagagctggta

SEQ ID NO: 912681 - DNA, 16 bp, Homo sapiens
agtgacagacaggctc

SEQ ID NO: 912682 - DNA, 20 bp, Homo sapiens
agtgacagctaggatgtgca

SEQ ID NO: 912683 - DNA, 18 bp, Homo sapiens
agtgacagctttctggga

SEQ ID NO: 912684 - DNA, 21 bp, Homo sapiens
agtgacagctttctgggatgt

SEQ ID NO: 912685 - DNA, 15 bp, Homo sapiens
agtgacagtattttg

SEQ ID NO: 912686 - DNA, 13 bp, Homo sapiens
agtgacagtttct

SEQ ID NO: 912687 - DNA, 22 bp, Homo sapiens
agtgacataatatattctattt

SEQ ID NO: 912688 - DNA, 16 bp, Homo sapiens
agtgacataattgtcc

SEQ ID NO: 912689 - DNA, 12 bp, Homo sapiens
agtgacccagct

SEQ ID NO: 912690 - DNA, 21 bp, Homo sapiens
agtgaccccagggcctgtctc

SEQ ID NO: 912691 - DNA, 13 bp, Homo sapiens
agtgaccctcagc

SEQ ID NO: 912692 - DNA, 23 bp, Homo sapiens
agtgaccgggggctgctgggcgt

SEQ ID NO: 912693 - DNA, 14 bp, Homo sapiens
agtgacgtgcacct

SEQ ID NO: 912694 - DNA, 14 bp, Homo sapiens
agtgactccctggg

SEQ ID NO: 912695 - DNA, 15 bp, Homo sapiens
agtgactccctggga

SEQ ID NO: 912696 - DNA, 16 bp, Homo sapiens
agtgactccctgggag

SEQ ID NO: 912697 - DNA, 14 bp, Homo sapiens
agtgactcgagggt

SEQ ID NO: 912698 - DNA, 18 bp, Homo sapiens
agtgactgaaaccatttt

SEQ ID NO: 912699 - DNA, 22 bp, Homo sapiens
agtgactgaaaccattttccca

SEQ ID NO: 912700 - DNA, 19 bp, Homo sapiens
agtgactgaacgatccttc

SEQ ID NO: 912701 - DNA, 16 bp, Homo sapiens
agtgactgaattctgc

SEQ ID NO: 912702 - DNA, 18 bp, Homo sapiens
agtgactgaattctgcct

SEQ ID NO: 912703 - DNA, 13 bp, Homo sapiens
agtgactggcagg

SEQ ID NO: 912704 - DNA, 15 bp, Homo sapiens
agtgactggcaggtg

SEQ ID NO: 912705 - DNA, 15 bp, Homo sapiens
agtgactgtatctgt

SEQ ID NO: 912706 - DNA, 18 bp, Homo sapiens
agtgactgtatctgtgta

SEQ ID NO: 912707 - DNA, 17 bp, Homo sapiens
agtgactgtttggctta

SEQ ID NO: 912708 - DNA, 23 bp, Homo sapiens
agtgactgtttggcttataaaca

SEQ ID NO: 912709 - DNA, 13 bp, Homo sapiens
agtgacttcctgg

SEQ ID NO: 912710 - DNA, 15 bp, Homo sapiens
agtgacttcctggtg

SEQ ID NO: 912711 - DNA, 18 bp, Homo sapiens
agtgacttcctggtgagg

SEQ ID NO: 912712 - DNA, 19 bp, Homo sapiens
agtgacttgttctgagtaa

SEQ ID NO: 912713 - DNA, 20 bp, Homo sapiens
agtgagaactctctccctgg

SEQ ID NO: 912714 - DNA, 13 bp, Homo sapiens
agtgagacagact

SEQ ID NO: 912715 - DNA, 19 bp, Homo sapiens
agtgagaccatgtttcaaa

SEQ ID NO: 912716 - DNA, 16 bp, Homo sapiens
agtgagaccctgtctc

SEQ ID NO: 912717 - DNA, 17 bp, Homo sapiens
agtgagactccacctca

SEQ ID NO: 912718 - DNA, 21 bp, Homo sapiens
agtgagagacattaactcatt

SEQ ID NO: 912719 - DNA, 19 bp, Homo sapiens
agtgagagacctctgccta

SEQ ID NO: 912720 - DNA, 22 bp, Homo sapiens
agtgagagacgccctatttcta

SEQ ID NO: 912721 - DNA, 13 bp, Homo sapiens
agtgagagaggag

SEQ ID NO: 912722 - DNA, 20 bp, Homo sapiens
agtgagagaggaggcctgga

SEQ ID NO: 912723 - DNA, 17 bp, Homo sapiens
agtgagagccagcagca

SEQ ID NO: 912724 - DNA, 17 bp, Homo sapiens
agtgagagcctttgcct

SEQ ID NO: 912725 - DNA, 13 bp, Homo sapiens
agtgagagggcat

SEQ ID NO: 912726 - DNA, 14 bp, Homo sapiens
agtgagagggcatg

SEQ ID NO: 912727 - DNA, 13 bp, Homo sapiens
agtgagaggggag

SEQ ID NO: 912728 - DNA, 16 bp, Homo sapiens
agtgagaggggaggga

SEQ ID NO: 912729 - DNA, 18 bp, Homo sapiens
agtgagaggggagggagg

SEQ ID NO: 912730 - DNA, 20 bp, Homo sapiens
agtgagaggggagggctcct

SEQ ID NO: 912731 - DNA, 15 bp, Homo sapiens
agtgagcagaacagg

SEQ ID NO: 912732 - DNA, 17 bp, Homo sapiens
agtgagcagaacaggta

SEQ ID NO: 912733 - DNA, 17 bp, Homo sapiens
agtgagcagctactgta

SEQ ID NO: 912734 - DNA, 20 bp, Homo sapiens
agtgagcagctactgtaact

SEQ ID NO: 912735 - DNA, 14 bp, Homo sapiens
agtgagcatatctg

SEQ ID NO: 912736 - DNA, 21 bp, Homo sapiens
agtgagccgagattgcaccac

SEQ ID NO: 912737 - DNA, 23 bp, Homo sapiens
catggtgtgtggtgctacaggga

SEQ ID NO: 912738 - DNA, 16 bp, Homo sapiens
catggttccttccctg

SEQ ID NO: 912739 - DNA, 14 bp, Homo sapiens
catggttgggggaa

SEQ ID NO: 912740 - DNA, 18 bp, Homo sapiens
catggtttaaaagaaaaa

SEQ ID NO: 912741 - DNA, 20 bp, Homo sapiens
catggttttggctctcccac

SEQ ID NO: 912742 - DNA, 22 bp, Homo sapiens
catggttttggctctcccaccc

SEQ ID NO: 912743 - DNA, 15 bp, Homo sapiens
catgtaaaacagaaa

SEQ ID NO: 912744 - DNA, 14 bp, Homo sapiens
catgtaaaagagtc

SEQ ID NO: 912745 - DNA, 13 bp, Homo sapiens
catgtaaagaaaa

SEQ ID NO: 912746 - DNA, 21 bp, Homo sapiens
catgtaaatccccactgggac

SEQ ID NO: 912747 - DNA, 16 bp, Homo sapiens
catgtaaattttgtat

SEQ ID NO: 912748 - DNA, 9 bp, Homo sapiens
catgtaaca

SEQ ID NO: 912749 - DNA, 14 bp, Homo sapiens
catgtaacagttgt

SEQ ID NO: 912750 - DNA, 21 bp, Homo sapiens
catgtaacagttgtgtcataa

SEQ ID NO: 912751 - DNA, 22 bp, Homo sapiens
catgtaacattggtgaaggatc

SEQ ID NO: 912752 - DNA, 15 bp, Homo sapiens
catgtaactatttct

SEQ ID NO: 912753 - DNA, 16 bp, Homo sapiens
catgtaagaaaatgtt

SEQ ID NO: 912754 - DNA, 20 bp, Homo sapiens
catgtaaggttgtgcagggt

SEQ ID NO: 912755 - DNA, 21 bp, Homo sapiens
catgtaaggttgtgcagggtg

SEQ ID NO: 912756 - DNA, 12 bp, Homo sapiens
catgtaataaaa

SEQ ID NO: 912757 - DNA, 21 bp, Homo sapiens
catgtaataaaaagtatatgt

SEQ ID NO: 912758 - DNA, 22 bp, Homo sapiens
catgtaataaaaagtatatgtt

SEQ ID NO: 912759 - DNA, 22 bp, Homo sapiens
catgtaataagcacttgcctgg

SEQ ID NO: 912760 - DNA, 21 bp, Homo sapiens
catgtaatggtatcttaaagt

SEQ ID NO: 912761 - DNA, 21 bp, Homo sapiens
catgtacaaaatcgattggct

SEQ ID NO: 912762 - DNA, 15 bp, Homo sapiens
catgtaccatcaata

SEQ ID NO: 912763 - DNA, 18 bp, Homo sapiens
catgtaccccctttccct

SEQ ID NO: 912764 - DNA, 21 bp, Homo sapiens
catgtaccccctttcccttct

SEQ ID NO: 912765 - DNA, 13 bp, Homo sapiens
catgtacctcccc

SEQ ID NO: 912766 - DNA, 18 bp, Homo sapiens
catgtacctcccctgcct

SEQ ID NO: 912767 - DNA, 22 bp, Homo sapiens
catgtacctcccctgccttgct

SEQ ID NO: 912768 - DNA, 16 bp, Homo sapiens
catgtactagtcctct

SEQ ID NO: 912769 - DNA, 19 bp, Homo sapiens
catgtactgagccttgtaa

SEQ ID NO: 912770 - DNA, 12 bp, Homo sapiens
catgtacttgaa

SEQ ID NO: 912771 - DNA, 14 bp, Homo sapiens
catgtacttgaagg

SEQ ID NO: 912772 - DNA, 18 bp, Homo sapiens
catgtacttgaaggatgg

SEQ ID NO: 912773 - DNA, 22 bp, Homo sapiens
catgtactttttagtaatttct

SEQ ID NO: 912774 - DNA, 16 bp, Homo sapiens
catgtagaactcagca

SEQ ID NO: 912775 - DNA, 21 bp, Homo sapiens
catgtagaactcagcagttga

SEQ ID NO: 912776 - DNA, 18 bp, Homo sapiens
catgtagaataaatgaag

SEQ ID NO: 912777 - DNA, 19 bp, Homo sapiens
catgtagaataaatgaaga

SEQ ID NO: 912778 - DNA, 16 bp, Homo sapiens
catgtagagaaaagca

SEQ ID NO: 912779 - DNA, 16 bp, Homo sapiens
catgtagccacccaac

SEQ ID NO: 912780 - DNA, 18 bp, Homo sapiens
catgtagccccctggcct

SEQ ID NO: 912781 - DNA, 17 bp, Homo sapiens
catgtaggtgagcctgg

SEQ ID NO: 912782 - DNA, 19 bp, Homo sapiens
catgtaggtgagcctgggc

SEQ ID NO: 912783 - DNA, 22 bp, Homo sapiens
catgtaggtgagcctgggcagc

SEQ ID NO: 912784 - DNA, 22 bp, Homo sapiens
catgtagtaacactaatatatt

SEQ ID NO: 912785 - DNA, 17 bp, Homo sapiens
catgtatattttctcta

SEQ ID NO: 912786 - DNA, 18 bp, Homo sapiens
catgtatgaatgtaagga

SEQ ID NO: 912787 - DNA, 22 bp, Homo sapiens
catgtatgcaagttttgtgact

SEQ ID NO: 912788 - DNA, 14 bp, Homo sapiens
catgtatgttatga

SEQ ID NO: 912789 - DNA, 17 bp, Homo sapiens
catgtatgttatgatat

SEQ ID NO: 912790 - DNA, 12 bp, Homo sapiens
catgtatgtttc

SEQ ID NO: 912791 - DNA, 13 bp, Homo sapiens
catgtatgtttct

SEQ ID NO: 912792 - DNA, 15 bp, Homo sapiens
catgtattagctcac

SEQ ID NO: 912793 - DNA, 13 bp, Homo sapiens
catgtattatgaa

SEQ ID NO: 912794 - DNA, 15 bp, Homo sapiens
catgtattatgaaaa

SEQ ID NO: 912795 - DNA, 17 bp, Homo sapiens
catgtattatgaaaaag

SEQ ID NO: 912796 - DNA, 21 bp, Homo sapiens
catgtattgcacattgtaaaa

SEQ ID NO: 912797 - DNA, 14 bp, Homo sapiens
catgtattggcctg

SEQ ID NO: 912798 - DNA, 13 bp, Homo sapiens
catgtattttgtt

SEQ ID NO: 912799 - DNA, 14 bp, Homo sapiens
catgtcaaacaaat

SEQ ID NO: 912800 - DNA, 15 bp, Homo sapiens
catgtcaaacaaata

SEQ ID NO: 912801 - DNA, 22 bp, Homo sapiens
catgtcaacttctggctcctca

SEQ ID NO: 912802 - DNA, 19 bp, Homo sapiens
catgtcaacttttgactaa

SEQ ID NO: 912803 - DNA, 21 bp, Homo sapiens
catgtcaccggtcagtgcctt

SEQ ID NO: 912804 - DNA, 23 bp, Homo sapiens
catgtcaccggtcagtgcctttt

SEQ ID NO: 912805 - DNA, 22 bp, Homo sapiens
catgtcaccgtggaccttcctg

SEQ ID NO: 912806 - DNA, 16 bp, Homo sapiens
catgtcacctcagctg

SEQ ID NO: 912807 - DNA, 13 bp, Homo sapiens
catgtcacctggc

SEQ ID NO: 912808 - DNA, 20 bp, Homo sapiens
catgtcacctggctgctagg

SEQ ID NO: 912809 - DNA, 22 bp, Homo sapiens
catgtcacctggctgctaggcc

SEQ ID NO: 912810 - DNA, 20 bp, Homo sapiens
catgtcactaaacaagaaat

SEQ ID NO: 912811 - DNA, 13 bp, Homo sapiens
catgtcactgtgg

SEQ ID NO: 912812 - DNA, 17 bp, Homo sapiens
catgtcagaggacccca

SEQ ID NO: 912813 - DNA, 22 bp, Homo sapiens
catgtcagaggaccccagggtg

SEQ ID NO: 912814 - DNA, 20 bp, Homo sapiens
catgtcagcaaaaagcaaaa

SEQ ID NO: 912815 - DNA, 16 bp, Homo sapiens
catgtcaggcctgtgt

SEQ ID NO: 912816 - DNA, 19 bp, Homo sapiens
catgtcagtctgcttagaa

SEQ ID NO: 912817 - DNA, 23 bp, Homo sapiens
catgtcatttgactgtctcactt

SEQ ID NO: 912818 - DNA, 12 bp, Homo sapiens
catgtccaaaga

SEQ ID NO: 912819 - DNA, 18 bp, Homo sapiens
catgtccaaagaggctgc

SEQ ID NO: 912820 - DNA, 22 bp, Homo sapiens
catgtccaagttcttcacctct

SEQ ID NO: 912821 - DNA, 23 bp, Homo sapiens
catgtccaagttcttcacctcta

SEQ ID NO: 912822 - DNA, 22 bp, Homo sapiens
catgtccatacactttgttgca

SEQ ID NO: 912823 - DNA, 13 bp, Homo sapiens
catgtccatacta

SEQ ID NO: 912824 - DNA, 14 bp, Homo sapiens
catgtcccacccac

SEQ ID NO: 912825 - DNA, 20 bp, Homo sapiens
catgtcccagatcgtctcca

SEQ ID NO: 912826 - DNA, 16 bp, Homo sapiens
catgtccccttcctgt

SEQ ID NO: 912827 - DNA, 22 bp, Homo sapiens
catgtccctaccgagtctcttc

SEQ ID NO: 912828 - DNA, 15 bp, Homo sapiens
catgtccctccaggg

SEQ ID NO: 912829 - DNA, 18 bp, Homo sapiens
catgtcctaattcttctg

SEQ ID NO: 912830 - DNA, 19 bp, Homo sapiens
catgtcctaattcttctgt

SEQ ID NO: 912831 - DNA, 14 bp, Homo sapiens
catgtcctgtaaag

SEQ ID NO: 912832 - DNA, 15 bp, Homo sapiens
catgtcctgtaaagg

SEQ ID NO: 912833 - DNA, 17 bp, Homo sapiens
catgtccttctgagccc

SEQ ID NO: 912834 - DNA, 22 bp, Homo sapiens
catgtccttgtgtgttttgaga

SEQ ID NO: 912835 - DNA, 16 bp, Homo sapiens
catgtcgcacaatgtt

SEQ ID NO: 912836 - DNA, 19 bp, Homo sapiens
catgtcgccaaaaatacag

SEQ ID NO: 912837 - DNA, 17 bp, Homo sapiens
catgtcgcgctcagcat

SEQ ID NO: 912838 - DNA, 21 bp, Homo sapiens
catgtcgctagccagtgctcc

SEQ ID NO: 912839 - DNA, 21 bp, Homo sapiens
catgtcgtggacacacacaga

SEQ ID NO: 912840 - DNA, 17 bp, Homo sapiens
catgtctcctatcctgg

SEQ ID NO: 912841 - DNA, 17 bp, Homo sapiens
catgtctctcagaattc

SEQ ID NO: 912842 - DNA, 15 bp, Homo sapiens
catgtctctctgcca

SEQ ID NO: 912843 - DNA, 17 bp, Homo sapiens
catgtctctgcttccat

SEQ ID NO: 912844 - DNA, 11 bp, Homo sapiens
catgtctgcac

SEQ ID NO: 912845 - DNA, 13 bp, Homo sapiens
catgtctgcacct

SEQ ID NO: 912846 - DNA, 15 bp, Homo sapiens
catgtctgcacctcc

SEQ ID NO: 912847 - DNA, 14 bp, Homo sapiens
catgtctgcatttc

SEQ ID NO: 912848 - DNA, 18 bp, Homo sapiens
catgtctgtaatcccagc

SEQ ID NO: 912849 - DNA, 13 bp, Homo sapiens
catgtctgtatac

SEQ ID NO: 912850 - DNA, 19 bp, Homo sapiens
catgtctgtatactcctgt

SEQ ID NO: 912851 - DNA, 14 bp, Homo sapiens
catgtcttaaatgc

SEQ ID NO: 912852 - DNA, 18 bp, Homo sapiens
catgtcttaaatgctcat

SEQ ID NO: 912853 - DNA, 13 bp, Homo sapiens
catgtcttctgct

SEQ ID NO: 912854 - DNA, 13 bp, Homo sapiens
catgtcttgtcat

SEQ ID NO: 912855 - DNA, 21 bp, Homo sapiens
catgtcttgtcatacaaattt

SEQ ID NO: 912856 - DNA, 15 bp, Homo sapiens
catgtcttgtgcata

SEQ ID NO: 912857 - DNA, 13 bp, Homo sapiens
catgtgaagaggg

SEQ ID NO: 912858 - DNA, 12 bp, Homo sapiens
catgtgacattt

SEQ ID NO: 912859 - DNA, 14 bp, Homo sapiens
catgtgacatttat

SEQ ID NO: 912860 - DNA, 16 bp, Homo sapiens
catgtgacatttatat

SEQ ID NO: 912861 - DNA, 20 bp, Homo sapiens
catgtgaccattctgcctct

SEQ ID NO: 912862 - DNA, 22 bp, Homo sapiens
agtgagccgcatcttctccatc

SEQ ID NO: 912863 - DNA, 19 bp, Homo sapiens
agtgagcctcctgtgcctg

SEQ ID NO: 912864 - DNA, 21 bp, Homo sapiens
agtgagcctcctgtgcctggc

SEQ ID NO: 912865 - DNA, 21 bp, Homo sapiens
agtgagcctgaattttgttgc

SEQ ID NO: 912866 - DNA, 23 bp, Homo sapiens
agtgagcggtgctgtcctcaggt

SEQ ID NO: 912867 - DNA, 20 bp, Homo sapiens
agtgagcgtgtagcgtcctg

SEQ ID NO: 912868 - DNA, 16 bp, Homo sapiens
agtgagctttgctgct

SEQ ID NO: 912869 - DNA, 21 bp, Homo sapiens
agtgaggaaccctgatctctc

SEQ ID NO: 912870 - DNA, 19 bp, Homo sapiens
agtgaggaagccaggtcca

SEQ ID NO: 912871 - DNA, 20 bp, Homo sapiens
agtgaggaatagttgagccc

SEQ ID NO: 912872 - DNA, 23 bp, Homo sapiens
agtgaggactcggccactgtgtc

SEQ ID NO: 912873 - DNA, 14 bp, Homo sapiens
agtgaggagatgcg

SEQ ID NO: 912874 - DNA, 18 bp, Homo sapiens
agtgaggagggtggagga

SEQ ID NO: 912875 - DNA, 18 bp, Homo sapiens
agtgaggatgctgcagtg

SEQ ID NO: 912876 - DNA, 17 bp, Homo sapiens
agtgaggcccaaggagc

SEQ ID NO: 912877 - DNA, 18 bp, Homo sapiens
agtgaggcccaaggagct

SEQ ID NO: 912878 - DNA, 13 bp, Homo sapiens
agtgaggcccagg

SEQ ID NO: 912879 - DNA, 15 bp, Homo sapiens
agtgaggcttccagg

SEQ ID NO: 912880 - DNA, 16 bp, Homo sapiens
agtgaggcttccaggc

SEQ ID NO: 912881 - DNA, 18 bp, Homo sapiens
agtgagggcctcagagcc

SEQ ID NO: 912882 - DNA, 21 bp, Homo sapiens
agtgagggcctcagagcctga

SEQ ID NO: 912883 - DNA, 12 bp, Homo sapiens
agtgagggctgg

SEQ ID NO: 912884 - DNA, 20 bp, Homo sapiens
agtgaggggttacctccctc

SEQ ID NO: 912885 - DNA, 20 bp, Homo sapiens
agtgagtaattttggatttt

SEQ ID NO: 912886 - DNA, 19 bp, Homo sapiens
agtgagtcacctgctccag

SEQ ID NO: 912887 - DNA, 19 bp, Homo sapiens
agtgagtcagcaccttggc

SEQ ID NO: 912888 - DNA, 14 bp, Homo sapiens
agtgagtgaggttc

SEQ ID NO: 912889 - DNA, 16 bp, Homo sapiens
agtgagtgatcactgg

SEQ ID NO: 912890 - DNA, 17 bp, Homo sapiens
agtgagtgtatgtgtgt

SEQ ID NO: 912891 - DNA, 22 bp, Homo sapiens
agtgagttacagcgagaggcag

SEQ ID NO: 912892 - DNA, 22 bp, Homo sapiens
agtgagttttactcttaaatca

SEQ ID NO: 912893 - DNA, 19 bp, Homo sapiens
agtgataatttctggaatt

SEQ ID NO: 912894 - DNA, 16 bp, Homo sapiens
agtgataggcccaagg

SEQ ID NO: 912895 - DNA, 17 bp, Homo sapiens
agtgatatgatccagag

SEQ ID NO: 912896 - DNA, 19 bp, Homo sapiens
agtgatatgatccagagca

SEQ ID NO: 912897 - DNA, 19 bp, Homo sapiens
agtgatcaataaaatgtga

SEQ ID NO: 912898 - DNA, 20 bp, Homo sapiens
agtgatcaataaaatgtgat

SEQ ID NO: 912899 - DNA, 20 bp, Homo sapiens
agtgatcatttaaaaagctc

SEQ ID NO: 912900 - DNA, 15 bp, Homo sapiens
agtgatcctcacgcc

SEQ ID NO: 912901 - DNA, 20 bp, Homo sapiens
agtgatcctcacgccttggc

SEQ ID NO: 912902 - DNA, 18 bp, Homo sapiens
agtgatccttccacctca

SEQ ID NO: 912903 - DNA, 22 bp, Homo sapiens
agtgatctatgtttgtgtgatt

SEQ ID NO: 912904 - DNA, 14 bp, Homo sapiens
agtgatctccatat

SEQ ID NO: 912905 - DNA, 21 bp, Homo sapiens
agtgatctccatatgttacac

SEQ ID NO: 912906 - DNA, 21 bp, Homo sapiens
agtgatctgtccacctcggcc

SEQ ID NO: 912907 - DNA, 14 bp, Homo sapiens
agtgatgaatgtac

SEQ ID NO: 912908 - DNA, 15 bp, Homo sapiens
agtgatgacttgctg

SEQ ID NO: 912909 - DNA, 16 bp, Homo sapiens
agtgatgacttgctgt

SEQ ID NO: 912910 - DNA, 20 bp, Homo sapiens
agtgatgccgggcgccagga

SEQ ID NO: 912911 - DNA, 21 bp, Homo sapiens
agtgatgccgggcgccaggac

SEQ ID NO: 912912 - DNA, 18 bp, Homo sapiens
agtgatggtgtccttccc

SEQ ID NO: 912913 - DNA, 21 bp, Homo sapiens
agtgatggtgtccttccctgc

SEQ ID NO: 912914 - DNA, 22 bp, Homo sapiens
agtgatggtgtccttccctgcc

SEQ ID NO: 912915 - DNA, 17 bp, Homo sapiens
agtgatgttagcagacc

SEQ ID NO: 912916 - DNA, 12 bp, Homo sapiens
agtgattctgat

SEQ ID NO: 912917 - DNA, 16 bp, Homo sapiens
agtgattctgatttca

SEQ ID NO: 912918 - DNA, 18 bp, Homo sapiens
agtgattctgatttcagt

SEQ ID NO: 912919 - DNA, 20 bp, Homo sapiens
agtgattctgatttcagttt

SEQ ID NO: 912920 - DNA, 20 bp, Homo sapiens
agtgattgcagctttatgtt

SEQ ID NO: 912921 - DNA, 15 bp, Homo sapiens
agtgattgtcttaat

SEQ ID NO: 912922 - DNA, 24 bp, Homo sapiens
agtgattgtgtctgcattgttatt

SEQ ID NO: 912923 - DNA, 19 bp, Homo sapiens
agtgatttagttgtggaaa

SEQ ID NO: 912924 - DNA, 19 bp, Homo sapiens
agtgcaaaactgtgtcaca

SEQ ID NO: 912925 - DNA, 18 bp, Homo sapiens
agtgcaaatcatagctgg

SEQ ID NO: 912926 - DNA, 18 bp, Homo sapiens
agtgcaacatctctgaat

SEQ ID NO: 912927 - DNA, 16 bp, Homo sapiens
agtgcaacatttctgt

SEQ ID NO: 912928 - DNA, 18 bp, Homo sapiens
agtgcaacatttctgtat

SEQ ID NO: 912929 - DNA, 15 bp, Homo sapiens
agtgcaagcccctgc

SEQ ID NO: 912930 - DNA, 17 bp, Homo sapiens
agtgcaattccaagaaa

SEQ ID NO: 912931 - DNA, 20 bp, Homo sapiens
agtgcaattccaagaaaata

SEQ ID NO: 912932 - DNA, 21 bp, Homo sapiens
agtgcaattccaagaaaatat

SEQ ID NO: 912933 - DNA, 13 bp, Homo sapiens
agtgcaccaaaga

SEQ ID NO: 912934 - DNA, 20 bp, Homo sapiens
agtgcaccaaagagaatgcc

SEQ ID NO: 912935 - DNA, 19 bp, Homo sapiens
agtgcacctccctccccag

SEQ ID NO: 912936 - DNA, 19 bp, Homo sapiens
agtgcacctgcctcagcta

SEQ ID NO: 912937 - DNA, 14 bp, Homo sapiens
agtgcactgactgt

SEQ ID NO: 912938 - DNA, 20 bp, Homo sapiens
agtgcactgcattcctgtgc

SEQ ID NO: 912939 - DNA, 22 bp, Homo sapiens
agtgcactgcattcctgtgccc

SEQ ID NO: 912940 - DNA, 14 bp, Homo sapiens
agtgcactttctaa

SEQ ID NO: 912941 - DNA, 18 bp, Homo sapiens
agtgcactttctaatgtt

SEQ ID NO: 912942 - DNA, 15 bp, Homo sapiens
agtgcacttttttat

SEQ ID NO: 912943 - DNA, 16 bp, Homo sapiens
agtgcagaacacctgg

SEQ ID NO: 912944 - DNA, 12 bp, Homo sapiens
agtgcagagaaa

SEQ ID NO: 912945 - DNA, 22 bp, Homo sapiens
agtgcagagaaagaaagggaaa

SEQ ID NO: 912946 - DNA, 19 bp, Homo sapiens
agtgcagagccttctcaga

SEQ ID NO: 912947 - DNA, 21 bp, Homo sapiens
agtgcagagccttctcagaag

SEQ ID NO: 912948 - DNA, 23 bp, Homo sapiens
agtgcagccaaaggggagccaga

SEQ ID NO: 912949 - DNA, 21 bp, Homo sapiens
agtgcagccaagtagcctctc

SEQ ID NO: 912950 - DNA, 14 bp, Homo sapiens
agtgcagccactgg

SEQ ID NO: 912951 - DNA, 15 bp, Homo sapiens
agtgcagccactggc

SEQ ID NO: 912952 - DNA, 21 bp, Homo sapiens
agtgcagcccgtgtggcccct

SEQ ID NO: 912953 - DNA, 14 bp, Homo sapiens
agtgcagccttctc

SEQ ID NO: 912954 - DNA, 14 bp, Homo sapiens
agtgcagctgattt

SEQ ID NO: 912955 - DNA, 16 bp, Homo sapiens
agtgcagctgatttta

SEQ ID NO: 912956 - DNA, 13 bp, Homo sapiens
agtgcagggagga

SEQ ID NO: 912957 - DNA, 19 bp, Homo sapiens
agtgcagtggcacaatctt

SEQ ID NO: 912958 - DNA, 14 bp, Homo sapiens
agtgcatatgcaat

SEQ ID NO: 912959 - DNA, 14 bp, Homo sapiens
agtgcatcattact

SEQ ID NO: 912960 - DNA, 21 bp, Homo sapiens
agtgcatccaaaggtgctcag

SEQ ID NO: 912961 - DNA, 21 bp, Homo sapiens
agtgcatccccacgacccctg

SEQ ID NO: 912962 - DNA, 15 bp, Homo sapiens
agtgcatctcagccc

SEQ ID NO: 912963 - DNA, 12 bp, Homo sapiens
agtgcatgcatg

SEQ ID NO: 912964 - DNA, 17 bp, Homo sapiens
agtgcatgctctctgca

SEQ ID NO: 912965 - DNA, 20 bp, Homo sapiens
agtgcatgctctctgcagcc

SEQ ID NO: 912966 - DNA, 18 bp, Homo sapiens
agtgcatgtgaagcatgc

SEQ ID NO: 912967 - DNA, 20 bp, Homo sapiens
agtgcatgtgaagcatgctt

SEQ ID NO: 912968 - DNA, 17 bp, Homo sapiens
agtgcattatgtacaca

SEQ ID NO: 912969 - DNA, 21 bp, Homo sapiens
agtgcatttaaggagattggg

SEQ ID NO: 912970 - DNA, 13 bp, Homo sapiens
agtgcatttttct

SEQ ID NO: 912971 - DNA, 14 bp, Homo sapiens
agtgccaaataatt

SEQ ID NO: 912972 - DNA, 15 bp, Homo sapiens
agtgccaagtttgtt

SEQ ID NO: 912973 - DNA, 18 bp, Homo sapiens
agtgccaatgatgtgacc

SEQ ID NO: 912974 - DNA, 15 bp, Homo sapiens
agtgccacagcctgc

SEQ ID NO: 912975 - DNA, 17 bp, Homo sapiens
agtgccacagcctgctg

SEQ ID NO: 912976 - DNA, 21 bp, Homo sapiens
agtgccacagcctgctggcag

SEQ ID NO: 912977 - DNA, 13 bp, Homo sapiens
agtgccactgccc

SEQ ID NO: 912978 - DNA, 21 bp, Homo sapiens
agtgccactgcccgagctggt

SEQ ID NO: 912979 - DNA, 20 bp, Homo sapiens
agtgccagaattttaggaac

SEQ ID NO: 912980 - DNA, 16 bp, Homo sapiens
agtgccagaggtgggc

SEQ ID NO: 912981 - DNA, 12 bp, Homo sapiens
agtgccagctcc

SEQ ID NO: 912982 - DNA, 16 bp, Homo sapiens
agtgccagctccagtg

SEQ ID NO: 912983 - DNA, 12 bp, Homo sapiens
agtgccaggacc

SEQ ID NO: 912984 - DNA, 19 bp, Homo sapiens
agtgccaggactccccagg

SEQ ID NO: 912985 - DNA, 12 bp, Homo sapiens
agtgccagggtg

SEQ ID NO: 912986 - DNA, 16 bp, Homo sapiens
catgtgactagcgcct

SEQ ID NO: 912987 - DNA, 20 bp, Homo sapiens
catgtgactagcgcctggcc

SEQ ID NO: 912988 - DNA, 22 bp, Homo sapiens
catgtgacttctcccctgccct

SEQ ID NO: 912989 - DNA, 20 bp, Homo sapiens
catgtgagcatgtcacttcc

SEQ ID NO: 912990 - DNA, 18 bp, Homo sapiens
catgtgagccaccgctgc

SEQ ID NO: 912991 - DNA, 20 bp, Homo sapiens
catgtgagccaccgctgcca

SEQ ID NO: 912992 - DNA, 19 bp, Homo sapiens
catgtgaggaggaaaagga

SEQ ID NO: 912993 - DNA, 23 bp, Homo sapiens
catgtgaggaggaaaaggaaaaa

SEQ ID NO: 912994 - DNA, 19 bp, Homo sapiens
catgtgatggacactccag

SEQ ID NO: 912995 - DNA, 22 bp, Homo sapiens
catgtgatggacactccaggga

SEQ ID NO: 912996 - DNA, 15 bp, Homo sapiens
catgtgattaatgtt

SEQ ID NO: 912997 - DNA, 11 bp, Homo sapiens
catgtgcaata

SEQ ID NO: 912998 - DNA, 21 bp, Homo sapiens
catgtgcaattgtgagggaca

SEQ ID NO: 912999 - DNA, 13 bp, Homo sapiens
catgtgccaccac

SEQ ID NO: 913000 - DNA, 12 bp, Homo sapiens
catgtgccctcc

SEQ ID NO: 913001 - DNA, 18 bp, Homo sapiens
catgtgctcagaagagga

SEQ ID NO: 913002 - DNA, 18 bp, Homo sapiens
catgtgctgatgtttaca

SEQ ID NO: 913003 - DNA, 22 bp, Homo sapiens
catgtgctgggaaatgcagaaa

SEQ ID NO: 913004 - DNA, 19 bp, Homo sapiens
catgtgctgtgaccattta

SEQ ID NO: 913005 - DNA, 16 bp, Homo sapiens
catgtggaaagtgaat

SEQ ID NO: 913006 - DNA, 19 bp, Homo sapiens
catgtggagaaaggagtga

SEQ ID NO: 913007 - DNA, 19 bp, Homo sapiens
catgtggaggggcagcctg

SEQ ID NO: 913008 - DNA, 22 bp, Homo sapiens
catgtggccacaactgctgtgg

SEQ ID NO: 913009 - DNA, 23 bp, Homo sapiens
catgtggccacaactgctgtggc

SEQ ID NO: 913010 - DNA, 15 bp, Homo sapiens
catgtggccatggcc

SEQ ID NO: 913011 - DNA, 18 bp, Homo sapiens
catgtggccatggcctct

SEQ ID NO: 913012 - DNA, 15 bp, Homo sapiens
catgtggccccaccc

SEQ ID NO: 913013 - DNA, 15 bp, Homo sapiens
catgtggcctgccca

SEQ ID NO: 913014 - DNA, 17 bp, Homo sapiens
catgtggcctgcccagc

SEQ ID NO: 913015 - DNA, 23 bp, Homo sapiens
catgtggcctttatctcaacgga

SEQ ID NO: 913016 - DNA, 19 bp, Homo sapiens
catgtggctcctcccagcc

SEQ ID NO: 913017 - DNA, 12 bp, Homo sapiens
catgtggctgga

SEQ ID NO: 913018 - DNA, 20 bp, Homo sapiens
catgtggcttctctgtctct

SEQ ID NO: 913019 - DNA, 22 bp, Homo sapiens
catgtgggaaaaaaatgaatga

SEQ ID NO: 913020 - DNA, 17 bp, Homo sapiens
catgtggggccaggtca

SEQ ID NO: 913021 - DNA, 17 bp, Homo sapiens
catgtgggtgagccagt

SEQ ID NO: 913022 - DNA, 18 bp, Homo sapiens
catgtgggtgagccagtg

SEQ ID NO: 913023 - DNA, 21 bp, Homo sapiens
catgtggtgggacagggaccc

SEQ ID NO: 913024 - DNA, 20 bp, Homo sapiens
catgtggttactagtacagg

SEQ ID NO: 913025 - DNA, 11 bp, Homo sapiens
catgtgtatgt

SEQ ID NO: 913026 - DNA, 18 bp, Homo sapiens
catgtgtcacttgtgctt

SEQ ID NO: 913027 - DNA, 14 bp, Homo sapiens
catgtgtcagagtg

SEQ ID NO: 913028 - DNA, 14 bp, Homo sapiens
catgtgtcccctca

SEQ ID NO: 913029 - DNA, 16 bp, Homo sapiens
catgtgtcccctcact

SEQ ID NO: 913030 - DNA, 15 bp, Homo sapiens
catgtgtgagtgtgt

SEQ ID NO: 913031 - DNA, 17 bp, Homo sapiens
catgtgtgagtgtgtgc

SEQ ID NO: 913032 - DNA, 13 bp, Homo sapiens
catgtgtgcatgt

SEQ ID NO: 913033 - DNA, 12 bp, Homo sapiens
catgtgtgcctg

SEQ ID NO: 913034 - DNA, 17 bp, Homo sapiens
catgtgtgcctggccgc

SEQ ID NO: 913035 - DNA, 20 bp, Homo sapiens
catgtgtgcgtgtctccatg

SEQ ID NO: 913036 - DNA, 14 bp, Homo sapiens
catgtgtggactca

SEQ ID NO: 913037 - DNA, 14 bp, Homo sapiens
catgtgtgggtgct

SEQ ID NO: 913038 - DNA, 14 bp, Homo sapiens
catgtgtggtggtg

SEQ ID NO: 913039 - DNA, 12 bp, Homo sapiens
catgtgtgtcca

SEQ ID NO: 913040 - DNA, 21 bp, Homo sapiens
catgtgtgtccacgactgtct

SEQ ID NO: 913041 - DNA, 22 bp, Homo sapiens
catgtgtgtccacgactgtctc

SEQ ID NO: 913042 - DNA, 19 bp, Homo sapiens
catgtgtgtgagtttgctg

SEQ ID NO: 913043 - DNA, 21 bp, Homo sapiens
catgtgtgtgcaagtgtgtgc

SEQ ID NO: 913044 - DNA, 11 bp, Homo sapiens
catgtgtgtgt

SEQ ID NO: 913045 - DNA, 16 bp, Homo sapiens
catgtgtgtgtctgtc

SEQ ID NO: 913046 - DNA, 13 bp, Homo sapiens
catgtgttaaaat

SEQ ID NO: 913047 - DNA, 15 bp, Homo sapiens
catgtgttatgtttt

SEQ ID NO: 913048 - DNA, 14 bp, Homo sapiens
catgtgtttctgac

SEQ ID NO: 913049 - DNA, 20 bp, Homo sapiens
catgtgttttaattccaata

SEQ ID NO: 913050 - DNA, 18 bp, Homo sapiens
catgttaaaatgtacttt

SEQ ID NO: 913051 - DNA, 14 bp, Homo sapiens
catgttaaatgact

SEQ ID NO: 913052 - DNA, 18 bp, Homo sapiens
catgttaaatgacttgat

SEQ ID NO: 913053 - DNA, 21 bp, Homo sapiens
catgttaaatgacttgattgt

SEQ ID NO: 913054 - DNA, 14 bp, Homo sapiens
catgttaagtgcca

SEQ ID NO: 913055 - DNA, 17 bp, Homo sapiens
catgttacataagataa

SEQ ID NO: 913056 - DNA, 15 bp, Homo sapiens
catgttactcagtgt

SEQ ID NO: 913057 - DNA, 17 bp, Homo sapiens
catgttactggataaat

SEQ ID NO: 913058 - DNA, 21 bp, Homo sapiens
catgttactggataaattgtt

SEQ ID NO: 913059 - DNA, 18 bp, Homo sapiens
catgttagcaaacgcagc

SEQ ID NO: 913060 - DNA, 14 bp, Homo sapiens
catgttaggaaaat

SEQ ID NO: 913061 - DNA, 18 bp, Homo sapiens
catgttaggaaaatttca

SEQ ID NO: 913062 - DNA, 14 bp, Homo sapiens
catgttagttacct

SEQ ID NO: 913063 - DNA, 13 bp, Homo sapiens
catgttatatatt

SEQ ID NO: 913064 - DNA, 14 bp, Homo sapiens
catgttatttgtaa

SEQ ID NO: 913065 - DNA, 18 bp, Homo sapiens
catgttcattataatctc

SEQ ID NO: 913066 - DNA, 14 bp, Homo sapiens
catgttccttttga

SEQ ID NO: 913067 - DNA, 16 bp, Homo sapiens
catgttccttttgaaa

SEQ ID NO: 913068 - DNA, 18 bp, Homo sapiens
catgttccttttgaaatt

SEQ ID NO: 913069 - DNA, 20 bp, Homo sapiens
catgttctcttcccaggcct

SEQ ID NO: 913070 - DNA, 21 bp, Homo sapiens
catgttctcttcccaggcctt

SEQ ID NO: 913071 - DNA, 16 bp, Homo sapiens
catgttctgcccccag

SEQ ID NO: 913072 - DNA, 14 bp, Homo sapiens
catgttctgctttc

SEQ ID NO: 913073 - DNA, 16 bp, Homo sapiens
catgttcttaattctt

SEQ ID NO: 913074 - DNA, 18 bp, Homo sapiens
catgttcttaattcttag

SEQ ID NO: 913075 - DNA, 20 bp, Homo sapiens
catgttgatgactcgaaact

SEQ ID NO: 913076 - DNA, 15 bp, Homo sapiens
catgttgctgaattt

SEQ ID NO: 913077 - DNA, 15 bp, Homo sapiens
catgttgctgaggag

SEQ ID NO: 913078 - DNA, 21 bp, Homo sapiens
catgttggccaggctggtctt

SEQ ID NO: 913079 - DNA, 19 bp, Homo sapiens
catgttgggaaacttggct

SEQ ID NO: 913080 - DNA, 21 bp, Homo sapiens
catgttgggaaacttggctcg

SEQ ID NO: 913081 - DNA, 19 bp, Homo sapiens
catgttgggttgttacaga

SEQ ID NO: 913082 - DNA, 16 bp, Homo sapiens
catgttgtaatgctgc

SEQ ID NO: 913083 - DNA, 17 bp, Homo sapiens
catgttgtaatgctgca

SEQ ID NO: 913084 - DNA, 21 bp, Homo sapiens
catgttgtcctttttatctga

SEQ ID NO: 913085 - DNA, 23 bp, Homo sapiens
catgttgttgtgtgtatatgtat

SEQ ID NO: 913086 - DNA, 21 bp, Homo sapiens
catgttgttttttcatagtgc

SEQ ID NO: 913087 - DNA, 20 bp, Homo sapiens
catgtttaaactttgtgcct

SEQ ID NO: 913088 - DNA, 14 bp, Homo sapiens
catgtttaaattgt

SEQ ID NO: 913089 - DNA, 9 bp, Homo sapiens
catgtttac

SEQ ID NO: 913090 - DNA, 19 bp, Homo sapiens
catgtttacaggtttgaat

SEQ ID NO: 913091 - DNA, 21 bp, Homo sapiens
catgtttacttttcagggcat

SEQ ID NO: 913092 - DNA, 18 bp, Homo sapiens
catgtttagattccagga

SEQ ID NO: 913093 - DNA, 12 bp, Homo sapiens
catgtttataaa

SEQ ID NO: 913094 - DNA, 14 bp, Homo sapiens
catgtttcactcct

SEQ ID NO: 913095 - DNA, 22 bp, Homo sapiens
catgtttcatgttttgtgacta

SEQ ID NO: 913096 - DNA, 20 bp, Homo sapiens
catgtttccatcatttctgt

SEQ ID NO: 913097 - DNA, 16 bp, Homo sapiens
catgtttctgagacca

SEQ ID NO: 913098 - DNA, 10 bp, Homo sapiens
catgtttctt

SEQ ID NO: 913099 - DNA, 21 bp, Homo sapiens
catgtttgagaaccccctaac

SEQ ID NO: 913100 - DNA, 23 bp, Homo sapiens
catgtttgatgtatctgagcagg

SEQ ID NO: 913101 - DNA, 22 bp, Homo sapiens
catgtttggtgtttgtctgtgt

SEQ ID NO: 913102 - DNA, 15 bp, Homo sapiens
catgtttgtgattga

SEQ ID NO: 913103 - DNA, 15 bp, Homo sapiens
catgttttataattt

SEQ ID NO: 913104 - DNA, 17 bp, Homo sapiens
catgttttcaactgcca

SEQ ID NO: 913105 - DNA, 14 bp, Homo sapiens
catgttttccgtga

SEQ ID NO: 913106 - DNA, 21 bp, Homo sapiens
catgttttctttgtttcctgg

SEQ ID NO: 913107 - DNA, 15 bp, Homo sapiens
catgttttgtgacta

SEQ ID NO: 913108 - DNA, 17 bp, Homo sapiens
catgttttgtgactata

SEQ ID NO: 913109 - DNA, 23 bp, Homo sapiens
catgtttttgttttctttgaatg

SEQ ID NO: 913110 - DNA, 21 bp, Homo sapiens
cattaaaaaatgaaatatttt

SEQ ID NO: 913111 - DNA, 19 bp, Homo sapiens
agtgccagggtgggctggg

SEQ ID NO: 913112 - DNA, 22 bp, Homo sapiens
agtgccagggtgggctggggac

SEQ ID NO: 913113 - DNA, 21 bp, Homo sapiens
agtgccaggtggctcagtgcc

SEQ ID NO: 913114 - DNA, 12 bp, Homo sapiens
agtgccatgctt

SEQ ID NO: 913115 - DNA, 12 bp, Homo sapiens
agtgccattact

SEQ ID NO: 913116 - DNA, 19 bp, Homo sapiens
agtgcccaccaacatccca

SEQ ID NO: 913117 - DNA, 17 bp, Homo sapiens
agtgcccaccgccctcc

SEQ ID NO: 913118 - DNA, 21 bp, Homo sapiens
agtgcccaccgccctcctcca

SEQ ID NO: 913119 - DNA, 13 bp, Homo sapiens
agtgcccagcaga

SEQ ID NO: 913120 - DNA, 15 bp, Homo sapiens
agtgcccatgaatgg

SEQ ID NO: 913121 - DNA, 20 bp, Homo sapiens
agtgccccacttctggccac

SEQ ID NO: 913122 - DNA, 16 bp, Homo sapiens
agtgccccagactgag

SEQ ID NO: 913123 - DNA, 19 bp, Homo sapiens
agtgccccagactgagctc

SEQ ID NO: 913124 - DNA, 20 bp, Homo sapiens
agtgccccagactgagctct

SEQ ID NO: 913125 - DNA, 21 bp, Homo sapiens
agtgccccagggagtccaggg

SEQ ID NO: 913126 - DNA, 13 bp, Homo sapiens
agtgcccctgtcc

SEQ ID NO: 913127 - DNA, 16 bp, Homo sapiens
agtgcccctgtcccac

SEQ ID NO: 913128 - DNA, 21 bp, Homo sapiens
agtgcccgtgaagcgtgtttt

SEQ ID NO: 913129 - DNA, 21 bp, Homo sapiens
agtgcccgttttaccaataaa

SEQ ID NO: 913130 - DNA, 23 bp, Homo sapiens
agtgcccgttttaccaataaact

SEQ ID NO: 913131 - DNA, 14 bp, Homo sapiens
agtgccctgcaggc

SEQ ID NO: 913132 - DNA, 17 bp, Homo sapiens
agtgccctttgagatct

SEQ ID NO: 913133 - DNA, 22 bp, Homo sapiens
agtgccgaatgactatgtccag

SEQ ID NO: 913134 - DNA, 21 bp, Homo sapiens
agtgccgctcctgcttcccct

SEQ ID NO: 913135 - DNA, 22 bp, Homo sapiens
agtgccggaggccttggggtgg

SEQ ID NO: 913136 - DNA, 19 bp, Homo sapiens
agtgccggctgtggagcaa

SEQ ID NO: 913137 - DNA, 15 bp, Homo sapiens
agtgccgtagggagt

SEQ ID NO: 913138 - DNA, 23 bp, Homo sapiens
agtgcctaaaattgtatgaaaat

SEQ ID NO: 913139 - DNA, 15 bp, Homo sapiens
agtgcctcgaggcac

SEQ ID NO: 913140 - DNA, 21 bp, Homo sapiens
agtgcctcttccagtgaacat

SEQ ID NO: 913141 - DNA, 19 bp, Homo sapiens
agtgcctcttgttgcagag

SEQ ID NO: 913142 - DNA, 18 bp, Homo sapiens
agtgcctctttcatccac

SEQ ID NO: 913143 - DNA, 20 bp, Homo sapiens
agtgcctgccactctctggg

SEQ ID NO: 913144 - DNA, 17 bp, Homo sapiens
agtgcctgctctgctgt

SEQ ID NO: 913145 - DNA, 13 bp, Homo sapiens
agtgcctggccca

SEQ ID NO: 913146 - DNA, 13 bp, Homo sapiens
agtgcctgggaat

SEQ ID NO: 913147 - DNA, 17 bp, Homo sapiens
agtgcctgggaatgtat

SEQ ID NO: 913148 - DNA, 17 bp, Homo sapiens
agtgcctgtacaggaag

SEQ ID NO: 913149 - DNA, 18 bp, Homo sapiens
agtgcctgtacaggaagg

SEQ ID NO: 913150 - DNA, 20 bp, Homo sapiens
agtgccttaatagtagggta

SEQ ID NO: 913151 - DNA, 16 bp, Homo sapiens
agtgccttacctcctg

SEQ ID NO: 913152 - DNA, 18 bp, Homo sapiens
agtgccttacctcctgcc

SEQ ID NO: 913153 - DNA, 13 bp, Homo sapiens
agtgccttccata

SEQ ID NO: 913154 - DNA, 16 bp, Homo sapiens
agtgccttccataatt

SEQ ID NO: 913155 - DNA, 16 bp, Homo sapiens
agtgccttctaaaggt

SEQ ID NO: 913156 - DNA, 21 bp, Homo sapiens
agtgccttggatgagaagtgt

SEQ ID NO: 913157 - DNA, 21 bp, Homo sapiens
agtgccttggggaatttcctc

SEQ ID NO: 913158 - DNA, 20 bp, Homo sapiens
agtgcctttatctcagccat

SEQ ID NO: 913159 - DNA, 22 bp, Homo sapiens
agtgccttttgcagaagagggt

SEQ ID NO: 913160 - DNA, 14 bp, Homo sapiens
agtgccttttggaa

SEQ ID NO: 913161 - DNA, 18 bp, Homo sapiens
agtgcgcagatctgtgcc

SEQ ID NO: 913162 - DNA, 14 bp, Homo sapiens
agtgcgcctcacca

SEQ ID NO: 913163 - DNA, 21 bp, Homo sapiens
agtgcgctcttggtccctggt

SEQ ID NO: 913164 - DNA, 21 bp, Homo sapiens
agtgcgggctgaggccagagt

SEQ ID NO: 913165 - DNA, 23 bp, Homo sapiens
agtgcgggctgaggccagagtca

SEQ ID NO: 913166 - DNA, 14 bp, Homo sapiens
agtgcggttcctca

SEQ ID NO: 913167 - DNA, 15 bp, Homo sapiens
agtgcggttcctcat

SEQ ID NO: 913168 - DNA, 16 bp, Homo sapiens
agtgcggttcctcatc

SEQ ID NO: 913169 - DNA, 22 bp, Homo sapiens
agtgcggttcctcatctgagag

SEQ ID NO: 913170 - DNA, 19 bp, Homo sapiens
agtgcggtttactcactgc

SEQ ID NO: 913171 - DNA, 15 bp, Homo sapiens
agtgcgtccacgagc

SEQ ID NO: 913172 - DNA, 13 bp, Homo sapiens
agtgcgtgaatgt

SEQ ID NO: 913173 - DNA, 15 bp, Homo sapiens
agtgcgtgatttctc

SEQ ID NO: 913174 - DNA, 16 bp, Homo sapiens
agtgcgtgccgtgtga

SEQ ID NO: 913175 - DNA, 19 bp, Homo sapiens
agtgctaaagttttcttcc

SEQ ID NO: 913176 - DNA, 14 bp, Homo sapiens
agtgctatgcggag

SEQ ID NO: 913177 - DNA, 16 bp, Homo sapiens
agtgctcaccagccct

SEQ ID NO: 913178 - DNA, 15 bp, Homo sapiens
agtgctcattcatca

SEQ ID NO: 913179 - DNA, 11 bp, Homo sapiens
agtgctccctc

SEQ ID NO: 913180 - DNA, 17 bp, Homo sapiens
agtgctcgaccttgata

SEQ ID NO: 913181 - DNA, 21 bp, Homo sapiens
agtgctcgagtcacattctgc

SEQ ID NO: 913182 - DNA, 17 bp, Homo sapiens
agtgctctgatccctct

SEQ ID NO: 913183 - DNA, 15 bp, Homo sapiens
agtgctctgcctcag

SEQ ID NO: 913184 - DNA, 14 bp, Homo sapiens
agtgctgaacagtg

SEQ ID NO: 913185 - DNA, 15 bp, Homo sapiens
agtgctgaacagtgg

SEQ ID NO: 913186 - DNA, 19 bp, Homo sapiens
agtgctgaggccagggctg

SEQ ID NO: 913187 - DNA, 21 bp, Homo sapiens
agtgctgaggccagggctgat

SEQ ID NO: 913188 - DNA, 21 bp, Homo sapiens
agtgctgaggggcactctccc

SEQ ID NO: 913189 - DNA, 21 bp, Homo sapiens
agtgctgattcaaaccaaagc

SEQ ID NO: 913190 - DNA, 22 bp, Homo sapiens
agtgctgattcaaaccaaagct

SEQ ID NO: 913191 - DNA, 12 bp, Homo sapiens
agtgctgccatg

SEQ ID NO: 913192 - DNA, 14 bp, Homo sapiens
agtgctgccatgcc

SEQ ID NO: 913193 - DNA, 24 bp, Homo sapiens
agtgctgccatgccactgccaggc

SEQ ID NO: 913194 - DNA, 16 bp, Homo sapiens
agtgctgccccttgca

SEQ ID NO: 913195 - DNA, 21 bp, Homo sapiens
agtgctgccccttgcaagcca

SEQ ID NO: 913196 - DNA, 22 bp, Homo sapiens
agtgctgccccttgcaagccat

SEQ ID NO: 913197 - DNA, 16 bp, Homo sapiens
agtgctgcctgtcccc

SEQ ID NO: 913198 - DNA, 21 bp, Homo sapiens
agtgctgcctgtccccatgct

SEQ ID NO: 913199 - DNA, 13 bp, Homo sapiens
agtgctgcttctt

SEQ ID NO: 913200 - DNA, 19 bp, Homo sapiens
agtgctgcttgtgcctccc

SEQ ID NO: 913201 - DNA, 21 bp, Homo sapiens
agtgctgcttgtgcctccctt

SEQ ID NO: 913202 - DNA, 16 bp, Homo sapiens
agtgctggaactttag

SEQ ID NO: 913203 - DNA, 17 bp, Homo sapiens
agtgctggaactttagt

SEQ ID NO: 913204 - DNA, 13 bp, Homo sapiens
agtgctggaaggg

SEQ ID NO: 913205 - DNA, 13 bp, Homo sapiens
agtgctggactgt

SEQ ID NO: 913206 - DNA, 19 bp, Homo sapiens
agtgctggctcacagtaca

SEQ ID NO: 913207 - DNA, 20 bp, Homo sapiens
agtgctggctcacagtacag

SEQ ID NO: 913208 - DNA, 21 bp, Homo sapiens
agtgctggctcacagtacagc

SEQ ID NO: 913209 - DNA, 21 bp, Homo sapiens
agtgctgggatgacaggtgtg

SEQ ID NO: 913210 - DNA, 20 bp, Homo sapiens
agtgctgggattacaggtgt

SEQ ID NO: 913211 - DNA, 18 bp, Homo sapiens
agtgctgggcaagtttac

SEQ ID NO: 913212 - DNA, 21 bp, Homo sapiens
agtgctgggggaggccatcca

SEQ ID NO: 913213 - DNA, 13 bp, Homo sapiens
agtgctggtcaga

SEQ ID NO: 913214 - DNA, 18 bp, Homo sapiens
agtgctgtaatattgtaa

SEQ ID NO: 913215 - DNA, 17 bp, Homo sapiens
agtgctgtacccttcca

SEQ ID NO: 913216 - DNA, 22 bp, Homo sapiens
agtgctgtcgggaccacatctg

SEQ ID NO: 913217 - DNA, 18 bp, Homo sapiens
agtgctgtcttgatgact

SEQ ID NO: 913218 - DNA, 14 bp, Homo sapiens
agtgctgtgaaaaa

SEQ ID NO: 913219 - DNA, 16 bp, Homo sapiens
agtgctgtgaaaaaaa

SEQ ID NO: 913220 - DNA, 16 bp, Homo sapiens
agtgctgtggcctggg

SEQ ID NO: 913221 - DNA, 15 bp, Homo sapiens
agtgctgttggtggc

SEQ ID NO: 913222 - DNA, 16 bp, Homo sapiens
agtgctgtttaagcta

SEQ ID NO: 913223 - DNA, 20 bp, Homo sapiens
agtgctgtttattaatctta

SEQ ID NO: 913224 - DNA, 15 bp, Homo sapiens
agtgctgttttgtta

SEQ ID NO: 913225 - DNA, 16 bp, Homo sapiens
agtgctgttttgttat

SEQ ID NO: 913226 - DNA, 22 bp, Homo sapiens
agtgctgttttgttatataatt

SEQ ID NO: 913227 - DNA, 16 bp, Homo sapiens
agtgcttaaaaatcat

SEQ ID NO: 913228 - DNA, 18 bp, Homo sapiens
agtgcttaacattttccc

SEQ ID NO: 913229 - DNA, 15 bp, Homo sapiens
agtgcttagcaaaaa

SEQ ID NO: 913230 - DNA, 14 bp, Homo sapiens
agtgcttcacattt

SEQ ID NO: 913231 - DNA, 15 bp, Homo sapiens
agtgcttcagagttt

SEQ ID NO: 913232 - DNA, 21 bp, Homo sapiens
agtgcttcagagtttgtgtgt

SEQ ID NO: 913233 - DNA, 16 bp, Homo sapiens
agtgcttcagcctgag

SEQ ID NO: 913234 - DNA, 17 bp, Homo sapiens
agtgcttcagcctgagg

SEQ ID NO: 913235 - DNA, 22 bp, Homo sapiens
cattaaaaaatgaaatattttt

SEQ ID NO: 913236 - DNA, 14 bp, Homo sapiens
cattaaaagaaaat

SEQ ID NO: 913237 - DNA, 17 bp, Homo sapiens
cattaaaagaaaataaa

SEQ ID NO: 913238 - DNA, 20 bp, Homo sapiens
cattaaaagaaaataaaaaa

SEQ ID NO: 913239 - DNA, 13 bp, Homo sapiens
cattaaaagaata

SEQ ID NO: 913240 - DNA, 15 bp, Homo sapiens
cattaaaataaaaca

SEQ ID NO: 913241 - DNA, 17 bp, Homo sapiens
cattaaaataaaacaag

SEQ ID NO: 913242 - DNA, 21 bp, Homo sapiens
cattaaaataaaacaagcctt

SEQ ID NO: 913243 - DNA, 19 bp, Homo sapiens
cattaaaatatagagacag

SEQ ID NO: 913244 - DNA, 15 bp, Homo sapiens
cattaaaatgaattt

SEQ ID NO: 913245 - DNA, 14 bp, Homo sapiens
cattaaacaaataa

SEQ ID NO: 913246 - DNA, 21 bp, Homo sapiens
cattaaacactgtaatcttaa

SEQ ID NO: 913247 - DNA, 20 bp, Homo sapiens
cattaaaccacatcatggac

SEQ ID NO: 913248 - DNA, 14 bp, Homo sapiens
cattaaacctgtct

SEQ ID NO: 913249 - DNA, 13 bp, Homo sapiens
cattaaacttttt

SEQ ID NO: 913250 - DNA, 11 bp, Homo sapiens
cattaaagaag

SEQ ID NO: 913251 - DNA, 18 bp, Homo sapiens
cattaaagccctgtgtta

SEQ ID NO: 913252 - DNA, 19 bp, Homo sapiens
cattaaagccctgtgttaa

SEQ ID NO: 913253 - DNA, 20 bp, Homo sapiens
cattaaaggcataaatgact

SEQ ID NO: 913254 - DNA, 18 bp, Homo sapiens
cattaaagtcagaagttt

SEQ ID NO: 913255 - DNA, 13 bp, Homo sapiens
cattaaagtctga

SEQ ID NO: 913256 - DNA, 19 bp, Homo sapiens
cattaaagttaatagaact

SEQ ID NO: 913257 - DNA, 20 bp, Homo sapiens
cattaaagttaatagaactt

SEQ ID NO: 913258 - DNA, 19 bp, Homo sapiens
cattaaatgcaataatttt

SEQ ID NO: 913259 - DNA, 13 bp, Homo sapiens
cattaacaaataa

SEQ ID NO: 913260 - DNA, 16 bp, Homo sapiens
cattaacaaataaaaa

SEQ ID NO: 913261 - DNA, 23 bp, Homo sapiens
cattaacagttttccatgaaaac

SEQ ID NO: 913262 - DNA, 15 bp, Homo sapiens
cattaactaaatgct

SEQ ID NO: 913263 - DNA, 16 bp, Homo sapiens
cattaactaatctatt

SEQ ID NO: 913264 - DNA, 20 bp, Homo sapiens
cattaactccctccaccagc

SEQ ID NO: 913265 - DNA, 17 bp, Homo sapiens
cattaacttagcatgtg

SEQ ID NO: 913266 - DNA, 11 bp, Homo sapiens
cattaagaaaa

SEQ ID NO: 913267 - DNA, 15 bp, Homo sapiens
cattaagaaaatcat

SEQ ID NO: 913268 - DNA, 13 bp, Homo sapiens
cattaagaggttt

SEQ ID NO: 913269 - DNA, 22 bp, Homo sapiens
cattaagctttttttttttgaa

SEQ ID NO: 913270 - DNA, 14 bp, Homo sapiens
cattaagtaatcaa

SEQ ID NO: 913271 - DNA, 20 bp, Homo sapiens
cattaagtaatcaataaaga

SEQ ID NO: 913272 - DNA, 21 bp, Homo sapiens
cattaagtaatcaataaagaa

SEQ ID NO: 913273 - DNA, 15 bp, Homo sapiens
cattaagtggctttt

SEQ ID NO: 913274 - DNA, 17 bp, Homo sapiens
cattaatatttgctgac

SEQ ID NO: 913275 - DNA, 18 bp, Homo sapiens
cattaatcaatcatctgt

SEQ ID NO: 913276 - DNA, 16 bp, Homo sapiens
cattaatcaccaaagt

SEQ ID NO: 913277 - DNA, 17 bp, Homo sapiens
cattaatcaccaaagta

SEQ ID NO: 913278 - DNA, 20 bp, Homo sapiens
cattaatcagttcattagaa

SEQ ID NO: 913279 - DNA, 16 bp, Homo sapiens
cattaatcatttcccc

SEQ ID NO: 913280 - DNA, 17 bp, Homo sapiens
cattaatccacatgttt

SEQ ID NO: 913281 - DNA, 17 bp, Homo sapiens
cattaatctcaaagaga

SEQ ID NO: 913282 - DNA, 23 bp, Homo sapiens
cattaatgaatgaccagcagcag

SEQ ID NO: 913283 - DNA, 22 bp, Homo sapiens
cattaatgataaactcagatct

SEQ ID NO: 913284 - DNA, 16 bp, Homo sapiens
cattaatgcccagcca

SEQ ID NO: 913285 - DNA, 13 bp, Homo sapiens
cattaatgttaat

SEQ ID NO: 913286 - DNA, 12 bp, Homo sapiens
cattaatgtttc

SEQ ID NO: 913287 - DNA, 21 bp, Homo sapiens
cattaattagttccagtttct

SEQ ID NO: 913288 - DNA, 12 bp, Homo sapiens
cattaattatta

SEQ ID NO: 913289 - DNA, 19 bp, Homo sapiens
cattaattattattgctgt

SEQ ID NO: 913290 - DNA, 21 bp, Homo sapiens
cattaattcaggcatatttta

SEQ ID NO: 913291 - DNA, 17 bp, Homo sapiens
cattaatttcaaaattt

SEQ ID NO: 913292 - DNA, 15 bp, Homo sapiens
cattaattttgtgca

SEQ ID NO: 913293 - DNA, 15 bp, Homo sapiens
agtggaggttgctgt

SEQ ID NO: 913294 - DNA, 23 bp, Homo sapiens
agtggagtctgagtctgagtcct

SEQ ID NO: 913295 - DNA, 20 bp, Homo sapiens
agtggagttgaaactgctat

SEQ ID NO: 913296 - DNA, 21 bp, Homo sapiens
agtggatatgacccacactgc

SEQ ID NO: 913297 - DNA, 22 bp, Homo sapiens
agtggatatgacccacactgcc

SEQ ID NO: 913298 - DNA, 15 bp, Homo sapiens
agtggatcacaaagt

SEQ ID NO: 913299 - DNA, 14 bp, Homo sapiens
agtggatctccaag

SEQ ID NO: 913300 - DNA, 16 bp, Homo sapiens
agtggatgactgttga

SEQ ID NO: 913301 - DNA, 13 bp, Homo sapiens
agtggatgatgtt

SEQ ID NO: 913302 - DNA, 14 bp, Homo sapiens
agtggatggaatat

SEQ ID NO: 913303 - DNA, 14 bp, Homo sapiens
agtggatggcccag

SEQ ID NO: 913304 - DNA, 20 bp, Homo sapiens
agtggatggcccagcaggca

SEQ ID NO: 913305 - DNA, 16 bp, Homo sapiens
agtggatgggaatttg

SEQ ID NO: 913306 - DNA, 17 bp, Homo sapiens
agtggatgggaatttgt

SEQ ID NO: 913307 - DNA, 12 bp, Homo sapiens
agtggatgtata

SEQ ID NO: 913308 - DNA, 16 bp, Homo sapiens
agtggatgtttttaat

SEQ ID NO: 913309 - DNA, 15 bp, Homo sapiens
agtggattaatgcat

SEQ ID NO: 913310 - DNA, 14 bp, Homo sapiens
agtggattgcattt

SEQ ID NO: 913311 - DNA, 23 bp, Homo sapiens
agtggcaagaccaaaatgacaat

SEQ ID NO: 913312 - DNA, 12 bp, Homo sapiens
agtggcacagga

SEQ ID NO: 913313 - DNA, 16 bp, Homo sapiens
agtggcagacaaacag

SEQ ID NO: 913314 - DNA, 17 bp, Homo sapiens
agtggcagacaaacaga

SEQ ID NO: 913315 - DNA, 23 bp, Homo sapiens
agtggcagccatgcctcatgcca

SEQ ID NO: 913316 - DNA, 19 bp, Homo sapiens
agtggcaggtgggctgcct

SEQ ID NO: 913317 - DNA, 23 bp, Homo sapiens
agtggcaggtgggctgcctgctg

SEQ ID NO: 913318 - DNA, 20 bp, Homo sapiens
agtggcagtgaaaaatatgt

SEQ ID NO: 913319 - DNA, 22 bp, Homo sapiens
agtggcatttctatgcaggcag

SEQ ID NO: 913320 - DNA, 16 bp, Homo sapiens
agtggccaagcctgct

SEQ ID NO: 913321 - DNA, 23 bp, Homo sapiens
agtggccaagcctgctgtgtcct

SEQ ID NO: 913322 - DNA, 24 bp, Homo sapiens
agtggccaagcctgctgtgtcctt

SEQ ID NO: 913323 - DNA, 22 bp, Homo sapiens
agtggccacgttcagggagggg

SEQ ID NO: 913324 - DNA, 19 bp, Homo sapiens
agtggccactaagcagagg

SEQ ID NO: 913325 - DNA, 22 bp, Homo sapiens
agtggccactaagcagaggagg

SEQ ID NO: 913326 - DNA, 19 bp, Homo sapiens
agtggccagccagtgccat

SEQ ID NO: 913327 - DNA, 22 bp, Homo sapiens
agtggcccccgggcctgcacag

SEQ ID NO: 913328 - DNA, 18 bp, Homo sapiens
agtggcccctcacctggg

SEQ ID NO: 913329 - DNA, 21 bp, Homo sapiens
agtggcctacaaatcagtaat

SEQ ID NO: 913330 - DNA, 15 bp, Homo sapiens
agtggcctccctgct

SEQ ID NO: 913331 - DNA, 17 bp, Homo sapiens
agtggcctccctgctgt

SEQ ID NO: 913332 - DNA, 14 bp, Homo sapiens
agtggcctcttgga

SEQ ID NO: 913333 - DNA, 20 bp, Homo sapiens
agtggcctcttggataccag

SEQ ID NO: 913334 - DNA, 18 bp, Homo sapiens
agtggcctggccaggagc

SEQ ID NO: 913335 - DNA, 19 bp, Homo sapiens
agtggcctggccaggagct

SEQ ID NO: 913336 - DNA, 19 bp, Homo sapiens
agtggcgggtgatggccag

SEQ ID NO: 913337 - DNA, 20 bp, Homo sapiens
agtggcgggtgatggccagc

SEQ ID NO: 913338 - DNA, 14 bp, Homo sapiens
agtggcgtgagctg

SEQ ID NO: 913339 - DNA, 16 bp, Homo sapiens
agtggcgtggcctccc

SEQ ID NO: 913340 - DNA, 20 bp, Homo sapiens
agtggctcactggctgggag

SEQ ID NO: 913341 - DNA, 21 bp, Homo sapiens
agtggctcactggctgggagt

SEQ ID NO: 913342 - DNA, 12 bp, Homo sapiens
agtggctcccca

SEQ ID NO: 913343 - DNA, 16 bp, Homo sapiens
agtggctccccacctg

SEQ ID NO: 913344 - DNA, 20 bp, Homo sapiens
agtggctccccacctggaca

SEQ ID NO: 913345 - DNA, 13 bp, Homo sapiens
agtggctcctccc

SEQ ID NO: 913346 - DNA, 17 bp, Homo sapiens
agtggctcctcccggtg

SEQ ID NO: 913347 - DNA, 21 bp, Homo sapiens
agtggctcctcccggtgccca

SEQ ID NO: 913348 - DNA, 15 bp, Homo sapiens
agtggctctcagagc

SEQ ID NO: 913349 - DNA, 14 bp, Homo sapiens
agtggctgccacac

SEQ ID NO: 913350 - DNA, 17 bp, Homo sapiens
agtggctgggtgccctc

SEQ ID NO: 913351 - DNA, 14 bp, Homo sapiens
agtggctgggtggg

SEQ ID NO: 913352 - DNA, 18 bp, Homo sapiens
agtggctggtccagggct

SEQ ID NO: 913353 - DNA, 15 bp, Homo sapiens
agtggctggtctgga

SEQ ID NO: 913354 - DNA, 16 bp, Homo sapiens
agtggctgtcatcagc

SEQ ID NO: 913355 - DNA, 17 bp, Homo sapiens
agtggctgtcatcagcc

SEQ ID NO: 913356 - DNA, 22 bp, Homo sapiens
agtggctgttcatgctccaaga

SEQ ID NO: 913357 - DNA, 15 bp, Homo sapiens
agtggcttcaaaata

SEQ ID NO: 913358 - DNA, 18 bp, Homo sapiens
agtggcttcccagctctg

SEQ ID NO: 913359 - DNA, 20 bp, Homo sapiens
agtggcttcttttgaactgt

SEQ ID NO: 913360 - DNA, 16 bp, Homo sapiens
agtggcttttgcccca

SEQ ID NO: 913361 - DNA, 16 bp, Homo sapiens
agtgggaaaaaataga

SEQ ID NO: 913362 - DNA, 13 bp, Homo sapiens
cattattatcaac

SEQ ID NO: 913363 - DNA, 15 bp, Homo sapiens
cattattatgatgtt

SEQ ID NO: 913364 - DNA, 15 bp, Homo sapiens
cattattatttctgt

SEQ ID NO: 913365 - DNA, 16 bp, Homo sapiens
cattattcataaaaaa

SEQ ID NO: 913366 - DNA, 13 bp, Homo sapiens
cattattcctcag

SEQ ID NO: 913367 - DNA, 22 bp, Homo sapiens
cattattcctcagattgctgaa

SEQ ID NO: 913368 - DNA, 14 bp, Homo sapiens
cattattcctccag

SEQ ID NO: 913369 - DNA, 12 bp, Homo sapiens
cattattgagtt

SEQ ID NO: 913370 - DNA, 16 bp, Homo sapiens
cattatttaatttgta

SEQ ID NO: 913371 - DNA, 20 bp, Homo sapiens
cattatttattaaaaatgtt

SEQ ID NO: 913372 - DNA, 17 bp, Homo sapiens
cattatttattgttaaa

SEQ ID NO: 913373 - DNA, 14 bp, Homo sapiens
cattatttcagtgt

SEQ ID NO: 913374 - DNA, 13 bp, Homo sapiens
cattatttgcatg

SEQ ID NO: 913375 - DNA, 14 bp, Homo sapiens
cattatttgcatgt

SEQ ID NO: 913376 - DNA, 19 bp, Homo sapiens
cattatttgcatgttacct

SEQ ID NO: 913377 - DNA, 15 bp, Homo sapiens
cattatttgtcaaat

SEQ ID NO: 913378 - DNA, 15 bp, Homo sapiens
cattattttctgtca

SEQ ID NO: 913379 - DNA, 16 bp, Homo sapiens
cattattttctgtcag

SEQ ID NO: 913380 - DNA, 15 bp, Homo sapiens
cattattttgtggtt

SEQ ID NO: 913381 - DNA, 21 bp, Homo sapiens
cattattttgtggttctattt

SEQ ID NO: 913382 - DNA, 22 bp, Homo sapiens
cattattttgtggttctatttt

SEQ ID NO: 913383 - DNA, 15 bp, Homo sapiens
cattatttttagatt

SEQ ID NO: 913384 - DNA, 13 bp, Homo sapiens
cattcaaaaattt

SEQ ID NO: 913385 - DNA, 14 bp, Homo sapiens
cattcaaaacgtga

SEQ ID NO: 913386 - DNA, 12 bp, Homo sapiens
cattcaaattaa

SEQ ID NO: 913387 - DNA, 12 bp, Homo sapiens
cattcaacaaga

SEQ ID NO: 913388 - DNA, 12 bp, Homo sapiens
cattcaagctat

SEQ ID NO: 913389 - DNA, 16 bp, Homo sapiens
cattcaaggcttattt

SEQ ID NO: 913390 - DNA, 21 bp, Homo sapiens
cattcaatattgacatttgta

SEQ ID NO: 913391 - DNA, 21 bp, Homo sapiens
cattcaattagtggtcataaa

SEQ ID NO: 913392 - DNA, 10 bp, Homo sapiens
cattcacagc

SEQ ID NO: 913393 - DNA, 14 bp, Homo sapiens
cattcactgctgat

SEQ ID NO: 913394 - DNA, 15 bp, Homo sapiens
cattcacttgcattt

SEQ ID NO: 913395 - DNA, 15 bp, Homo sapiens
cattcacttttgtta

SEQ ID NO: 913396 - DNA, 13 bp, Homo sapiens
cattcagaaagct

SEQ ID NO: 913397 - DNA, 13 bp, Homo sapiens
cattcagaagaaa

SEQ ID NO: 913398 - DNA, 12 bp, Homo sapiens
cattcagagagc

SEQ ID NO: 913399 - DNA, 15 bp, Homo sapiens
cattcagagagcagc

SEQ ID NO: 913400 - DNA, 16 bp, Homo sapiens
cattcagatcactgaa

SEQ ID NO: 913401 - DNA, 13 bp, Homo sapiens
cattcagcacaca

SEQ ID NO: 913402 - DNA, 19 bp, Homo sapiens
cattcagcagcaaattttc

SEQ ID NO: 913403 - DNA, 23 bp, Homo sapiens
cattcaggaaaactgacagagga

SEQ ID NO: 913404 - DNA, 17 bp, Homo sapiens
cattcaggaagatgaaa

SEQ ID NO: 913405 - DNA, 17 bp, Homo sapiens
cattcaggcagcactga

SEQ ID NO: 913406 - DNA, 14 bp, Homo sapiens
cattcagtcccaaa

SEQ ID NO: 913407 - DNA, 21 bp, Homo sapiens
cattcagtgattactgtcaag

SEQ ID NO: 913408 - DNA, 22 bp, Homo sapiens
cattcatacttaaaaatttatt

SEQ ID NO: 913409 - DNA, 18 bp, Homo sapiens
cattcatagggaaaggtt

SEQ ID NO: 913410 - DNA, 19 bp, Homo sapiens
cattcatattaagacagtg

SEQ ID NO: 913411 - DNA, 22 bp, Homo sapiens
cattcatattaagacagtgtac

SEQ ID NO: 913412 - DNA, 17 bp, Homo sapiens
cattcatgtaactctcc

SEQ ID NO: 913413 - DNA, 21 bp, Homo sapiens
cattcatgtaactctccagcc

SEQ ID NO: 913414 - DNA, 15 bp, Homo sapiens
cattcattcttagct

SEQ ID NO: 913415 - DNA, 20 bp, Homo sapiens
cattcatttagctaaacgga

SEQ ID NO: 913416 - DNA, 13 bp, Homo sapiens
caggggctccagc

SEQ ID NO: 913417 - DNA, 16 bp, Homo sapiens
caggggctccctacat

SEQ ID NO: 913418 - DNA, 12 bp, Homo sapiens
caggggctcctg

SEQ ID NO: 913419 - DNA, 13 bp, Homo sapiens
caggggctcctgg

SEQ ID NO: 913420 - DNA, 16 bp, Homo sapiens
caggggctcctgggtt

SEQ ID NO: 913421 - DNA, 11 bp, Homo sapiens
caggggctctg

SEQ ID NO: 913422 - DNA, 14 bp, Homo sapiens
caggggctctgtgt

SEQ ID NO: 913423 - DNA, 16 bp, Homo sapiens
caggggctctgtgtta

SEQ ID NO: 913424 - DNA, 13 bp, Homo sapiens
caggggctgggca

SEQ ID NO: 913425 - DNA, 18 bp, Homo sapiens
caggggctgggcatccca

SEQ ID NO: 913426 - DNA, 22 bp, Homo sapiens
caggggctgggcatcccagctt

SEQ ID NO: 913427 - DNA, 12 bp, Homo sapiens
caggggctgttt

SEQ ID NO: 913428 - DNA, 17 bp, Homo sapiens
caggggcttgagaaggt

SEQ ID NO: 913429 - DNA, 17 bp, Homo sapiens
caggggctttgggccca

SEQ ID NO: 913430 - DNA, 15 bp, Homo sapiens
cagggggaagaagca

SEQ ID NO: 913431 - DNA, 12 bp, Homo sapiens
cagggggaggag

SEQ ID NO: 913432 - DNA, 18 bp, Homo sapiens
cagggggcaactgacatt

SEQ ID NO: 913433 - DNA, 16 bp, Homo sapiens
cagggggccagctggg

SEQ ID NO: 913434 - DNA, 17 bp, Homo sapiens
cagggggccagctgggg

SEQ ID NO: 913435 - DNA, 13 bp, Homo sapiens
cagggggccctgc

SEQ ID NO: 913436 - DNA, 15 bp, Homo sapiens
cagggggccctgccc

SEQ ID NO: 913437 - DNA, 13 bp, Homo sapiens
caggggggagaag

SEQ ID NO: 913438 - DNA, 15 bp, Homo sapiens
caggggggctgtgcc

SEQ ID NO: 913439 - DNA, 21 bp, Homo sapiens
caggggggtcggaagcctgtc

SEQ ID NO: 913440 - DNA, 20 bp, Homo sapiens
caggggggttgtgaggcctg

SEQ ID NO: 913441 - DNA, 20 bp, Homo sapiens
cagggggtaggagagcactg

SEQ ID NO: 913442 - DNA, 22 bp, Homo sapiens
cagggggtaggagagcactgcc

SEQ ID NO: 913443 - DNA, 20 bp, Homo sapiens
cagggggtgggaaggggatg

SEQ ID NO: 913444 - DNA, 23 bp, Homo sapiens
cagggggtgggaaggggatggac

SEQ ID NO: 913445 - DNA, 20 bp, Homo sapiens
caggggtcaggtgtcaggcc

SEQ ID NO: 913446 - DNA, 14 bp, Homo sapiens
caggggtcccccct

SEQ ID NO: 913447 - DNA, 13 bp, Homo sapiens
caggggtctccct

SEQ ID NO: 913448 - DNA, 15 bp, Homo sapiens
caggggtctccctgg

SEQ ID NO: 913449 - DNA, 18 bp, Homo sapiens
caggggtctccctggctc

SEQ ID NO: 913450 - DNA, 20 bp, Homo sapiens
caggggtctccctggctccc

SEQ ID NO: 913451 - DNA, 13 bp, Homo sapiens
caggggtgagagc

SEQ ID NO: 913452 - DNA, 21 bp, Homo sapiens
caggggtgagagcacccactg

SEQ ID NO: 913453 - DNA, 18 bp, Homo sapiens
caggggtgcacagtccac

SEQ ID NO: 913454 - DNA, 21 bp, Homo sapiens
caggggtgcacagtccacagc

SEQ ID NO: 913455 - DNA, 20 bp, Homo sapiens
caggggtgccccctcctctc

SEQ ID NO: 913456 - DNA, 16 bp, Homo sapiens
caggggttgagagctt

SEQ ID NO: 913457 - DNA, 16 bp, Homo sapiens
caggggttggctggga

SEQ ID NO: 913458 - DNA, 22 bp, Homo sapiens
caggggtttgggtgggggctgt

SEQ ID NO: 913459 - DNA, 19 bp, Homo sapiens
cagggtacctcaagcccca

SEQ ID NO: 913460 - DNA, 19 bp, Homo sapiens
cagggtagagcaaaggaga

SEQ ID NO: 913461 - DNA, 14 bp, Homo sapiens
cagggtaggaaagg

SEQ ID NO: 913462 - DNA, 15 bp, Homo sapiens
cagggtagtgcaggg

SEQ ID NO: 913463 - DNA, 17 bp, Homo sapiens
cagggtatcccagaccc

SEQ ID NO: 913464 - DNA, 15 bp, Homo sapiens
cagggtcccaggaag

SEQ ID NO: 913465 - DNA, 16 bp, Homo sapiens
cagggtcccaggaagc

SEQ ID NO: 913466 - DNA, 17 bp, Homo sapiens
cagggtcccaggaagcc

SEQ ID NO: 913467 - DNA, 21 bp, Homo sapiens
cagggtccccgagtgcctagg

SEQ ID NO: 913468 - DNA, 14 bp, Homo sapiens
cagggtcccctgcc

SEQ ID NO: 913469 - DNA, 16 bp, Homo sapiens
cagggtccgcaccagc

SEQ ID NO: 913470 - DNA, 18 bp, Homo sapiens
cagggtccgcaccagctg

SEQ ID NO: 913471 - DNA, 19 bp, Homo sapiens
cagggtcctaaaacttgga

SEQ ID NO: 913472 - DNA, 19 bp, Homo sapiens
cagggtcctctagcccact

SEQ ID NO: 913473 - DNA, 22 bp, Homo sapiens
cagggtcctgccctccggagga

SEQ ID NO: 913474 - DNA, 11 bp, Homo sapiens
cagggtctcac

SEQ ID NO: 913475 - DNA, 15 bp, Homo sapiens
cagggtctcactctg

SEQ ID NO: 913476 - DNA, 17 bp, Homo sapiens
cagggtctcactctgtc

SEQ ID NO: 913477 - DNA, 19 bp, Homo sapiens
cagggtctctagtgctgtg

SEQ ID NO: 913478 - DNA, 21 bp, Homo sapiens
cagggtctctagtgctgtgaa

SEQ ID NO: 913479 - DNA, 21 bp, Homo sapiens
cagggtctctccctcaggtgt

SEQ ID NO: 913480 - DNA, 21 bp, Homo sapiens
cagggtctgctctttctctgc

SEQ ID NO: 913481 - DNA, 18 bp, Homo sapiens
cagggtctggcagagcct

SEQ ID NO: 913482 - DNA, 23 bp, Homo sapiens
cagggtctggcagagcctctgag

SEQ ID NO: 913483 - DNA, 13 bp, Homo sapiens
cagggtctgggct

SEQ ID NO: 913484 - DNA, 18 bp, Homo sapiens
cagggtctgggctgggca

SEQ ID NO: 913485 - DNA, 22 bp, Homo sapiens
cagggtctgggctgggcacctg

SEQ ID NO: 913486 - DNA, 23 bp, Homo sapiens
cagggtctgtgtgaatgtgggca

SEQ ID NO: 913487 - DNA, 23 bp, Homo sapiens
cagggtcttacctctctgggacc

SEQ ID NO: 913488 - DNA, 22 bp, Homo sapiens
cagggtcttccctacctcaggc

SEQ ID NO: 913489 - DNA, 23 bp, Homo sapiens
cagggtcttgctctgtcccccag

SEQ ID NO: 913490 - DNA, 20 bp, Homo sapiens
cagggtcttgggctactggc

SEQ ID NO: 913491 - DNA, 22 bp, Homo sapiens
cagggtcttttcatctgggaaa

SEQ ID NO: 913492 - DNA, 20 bp, Homo sapiens
cagggtgaactgcaaagctt

SEQ ID NO: 913493 - DNA, 13 bp, Homo sapiens
cagggtgacgcct

SEQ ID NO: 913494 - DNA, 15 bp, Homo sapiens
cagggtgacgcctga

SEQ ID NO: 913495 - DNA, 20 bp, Homo sapiens
cagggtgacgcctgagacag

SEQ ID NO: 913496 - DNA, 14 bp, Homo sapiens
cagggtgagagctg

SEQ ID NO: 913497 - DNA, 21 bp, Homo sapiens
cagggtgagagctgctctgga

SEQ ID NO: 913498 - DNA, 13 bp, Homo sapiens
cagggtgcagagg

SEQ ID NO: 913499 - DNA, 23 bp, Homo sapiens
cagggtgcttagttggctttgcc

SEQ ID NO: 913500 - DNA, 19 bp, Homo sapiens
cagggtggaccaggcctgg

SEQ ID NO: 913501 - DNA, 21 bp, Homo sapiens
cagggtggaccaggcctggag

SEQ ID NO: 913502 - DNA, 22 bp, Homo sapiens
cagggtggaccaggcctggagg

SEQ ID NO: 913503 - DNA, 17 bp, Homo sapiens
cagggtggacttcagtg

SEQ ID NO: 913504 - DNA, 14 bp, Homo sapiens
cagggtggagctga

SEQ ID NO: 913505 - DNA, 17 bp, Homo sapiens
cagggtggctgccagcc

SEQ ID NO: 913506 - DNA, 18 bp, Homo sapiens
cagggtggctgccagccc

SEQ ID NO: 913507 - DNA, 14 bp, Homo sapiens
cagggtgggagccg

SEQ ID NO: 913508 - DNA, 17 bp, Homo sapiens
cagggtgggcagcctat

SEQ ID NO: 913509 - DNA, 15 bp, Homo sapiens
cagggtgggccactc

SEQ ID NO: 913510 - DNA, 17 bp, Homo sapiens
cagggtgggccactctc

SEQ ID NO: 913511 - DNA, 16 bp, Homo sapiens
cagggtgggctgggga

SEQ ID NO: 913512 - DNA, 22 bp, Homo sapiens
cagggtgggctggggactctgg

SEQ ID NO: 913513 - DNA, 16 bp, Homo sapiens
cagggtgggcttcctg

SEQ ID NO: 913514 - DNA, 20 bp, Homo sapiens
cagggtggggggtgacagtg

SEQ ID NO: 913515 - DNA, 17 bp, Homo sapiens
cagggtggggtctggga

SEQ ID NO: 913516 - DNA, 19 bp, Homo sapiens
cagggtggggtctgggagg

SEQ ID NO: 913517 - DNA, 20 bp, Homo sapiens
cagggtggggtctgggaggg

SEQ ID NO: 913518 - DNA, 18 bp, Homo sapiens
cagggtggtgctgggact

SEQ ID NO: 913519 - DNA, 21 bp, Homo sapiens
cagggtgtgactcgggagctg

SEQ ID NO: 913520 - DNA, 13 bp, Homo sapiens
cagggtgtgtgct

SEQ ID NO: 913521 - DNA, 15 bp, Homo sapiens
cagggttaagaagac

SEQ ID NO: 913522 - DNA, 20 bp, Homo sapiens
cagggttaggaatctcttca

SEQ ID NO: 913523 - DNA, 17 bp, Homo sapiens
cagggttcccccagccc

SEQ ID NO: 913524 - DNA, 21 bp, Homo sapiens
cagggttcccccagccctgtg

SEQ ID NO: 913525 - DNA, 19 bp, Homo sapiens
cagggttgaccccagagga

SEQ ID NO: 913526 - DNA, 18 bp, Homo sapiens
cagggttgatcacactct

SEQ ID NO: 913527 - DNA, 17 bp, Homo sapiens
cagggtttacccagtgg

SEQ ID NO: 913528 - DNA, 22 bp, Homo sapiens
cagggtttacccagtgggacag

SEQ ID NO: 913529 - DNA, 14 bp, Homo sapiens
cagggtttctctgc

SEQ ID NO: 913530 - DNA, 12 bp, Homo sapiens
caggtaactttc

SEQ ID NO: 913531 - DNA, 23 bp, Homo sapiens
caggtaagatgttaatctcccag

SEQ ID NO: 913532 - DNA, 14 bp, Homo sapiens
caggtaatatacct

SEQ ID NO: 913533 - DNA, 15 bp, Homo sapiens
caggtaatgagggac

SEQ ID NO: 913534 - DNA, 13 bp, Homo sapiens
caggtacaggaga

SEQ ID NO: 913535 - DNA, 17 bp, Homo sapiens
caggtacaggagaggca

SEQ ID NO: 913536 - DNA, 20 bp, Homo sapiens
caggtacaggagaggcagca

SEQ ID NO: 913537 - DNA, 15 bp, Homo sapiens
caggtaccaaggaaa

SEQ ID NO: 913538 - DNA, 18 bp, Homo sapiens
caggtaccacccttcaga

SEQ ID NO: 913539 - DNA, 15 bp, Homo sapiens
caggtaccagctgcg

SEQ ID NO: 913540 - DNA, 20 bp, Homo sapiens
aggcccctggcccagcggcc

SEQ ID NO: 913541 - DNA, 20 bp, Homo sapiens
aggcccgccctctgcctcct

SEQ ID NO: 913542 - DNA, 15 bp, Homo sapiens
aggcccgcgggcaca

SEQ ID NO: 913543 - DNA, 16 bp, Homo sapiens
aggcccgcgggcacag

SEQ ID NO: 913544 - DNA, 21 bp, Homo sapiens
aggcccggaagcgccaggctg

SEQ ID NO: 913545 - DNA, 21 bp, Homo sapiens
aggcccggcccagcctaggcc

SEQ ID NO: 913546 - DNA, 16 bp, Homo sapiens
aggcccgtcggagctg

SEQ ID NO: 913547 - DNA, 18 bp, Homo sapiens
aggcccgtcggagctgcc

SEQ ID NO: 913548 - DNA, 19 bp, Homo sapiens
aggcccgtcggagctgcct

SEQ ID NO: 913549 - DNA, 21 bp, Homo sapiens
aggcccgtcggagctgcctgc

SEQ ID NO: 913550 - DNA, 17 bp, Homo sapiens
aggccctcactgagcct

SEQ ID NO: 913551 - DNA, 13 bp, Homo sapiens
aggccctccagtg

SEQ ID NO: 913552 - DNA, 15 bp, Homo sapiens
aggccctccctgtct

SEQ ID NO: 913553 - DNA, 21 bp, Homo sapiens
aggccctcctctcccatcctt

SEQ ID NO: 913554 - DNA, 15 bp, Homo sapiens
aggccctcctgtgct

SEQ ID NO: 913555 - DNA, 15 bp, Homo sapiens
aggccctcgctgcca

SEQ ID NO: 913556 - DNA, 20 bp, Homo sapiens
aggccctcggagctggctgt

SEQ ID NO: 913557 - DNA, 14 bp, Homo sapiens
aggccctctgcctg

SEQ ID NO: 913558 - DNA, 17 bp, Homo sapiens
aggccctctgcctgcac

SEQ ID NO: 913559 - DNA, 18 bp, Homo sapiens
aggccctctgcctgcact

SEQ ID NO: 913560 - DNA, 15 bp, Homo sapiens
aggccctctggagtg

SEQ ID NO: 913561 - DNA, 20 bp, Homo sapiens
aggccctctggagtggccac

SEQ ID NO: 913562 - DNA, 21 bp, Homo sapiens
aggccctctggagtggccact

SEQ ID NO: 913563 - DNA, 14 bp, Homo sapiens
aggccctctgtggc

SEQ ID NO: 913564 - DNA, 16 bp, Homo sapiens
aggccctctgtggcct

SEQ ID NO: 913565 - DNA, 16 bp, Homo sapiens
aggccctgactcctct

SEQ ID NO: 913566 - DNA, 21 bp, Homo sapiens
aggccctgactcctctggctt

SEQ ID NO: 913567 - DNA, 14 bp, Homo sapiens
aggccctgcctccg

SEQ ID NO: 913568 - DNA, 16 bp, Homo sapiens
aggccctgcctgaccc

SEQ ID NO: 913569 - DNA, 18 bp, Homo sapiens
aggccctgctcctgcagc

SEQ ID NO: 913570 - DNA, 21 bp, Homo sapiens
aggccctgctcctgcagcatg

SEQ ID NO: 913571 - DNA, 19 bp, Homo sapiens
aggccctgctttttttctt

SEQ ID NO: 913572 - DNA, 22 bp, Homo sapiens
aggccctgctttttttcttaaa

SEQ ID NO: 913573 - DNA, 22 bp, Homo sapiens
aggccctgggctgggtgctggg

SEQ ID NO: 913574 - DNA, 13 bp, Homo sapiens
aggccctgtccag

SEQ ID NO: 913575 - DNA, 14 bp, Homo sapiens
aggccctgtctgta

SEQ ID NO: 913576 - DNA, 17 bp, Homo sapiens
aggcccttcctctttgg

SEQ ID NO: 913577 - DNA, 17 bp, Homo sapiens
aggcccttggctgcagg

SEQ ID NO: 913578 - DNA, 19 bp, Homo sapiens
aggcccttggctgcaggca

SEQ ID NO: 913579 - DNA, 18 bp, Homo sapiens
aggcccttgtcctgccag

SEQ ID NO: 913580 - DNA, 16 bp, Homo sapiens
aggccctttcctttgg

SEQ ID NO: 913581 - DNA, 24 bp, Homo sapiens
aggccctttgaagcctcagctacc

SEQ ID NO: 913582 - DNA, 24 bp, Homo sapiens
aggccgaagctctggctgaaccct

SEQ ID NO: 913583 - DNA, 13 bp, Homo sapiens
aggccgagggcca

SEQ ID NO: 913584 - DNA, 18 bp, Homo sapiens
aggccgagggccaggcag

SEQ ID NO: 913585 - DNA, 12 bp, Homo sapiens
aggccgccagcg

SEQ ID NO: 913586 - DNA, 20 bp, Homo sapiens
aggccgccagcgtgtggagc

SEQ ID NO: 913587 - DNA, 15 bp, Homo sapiens
aggccgccgtgacct

SEQ ID NO: 913588 - DNA, 16 bp, Homo sapiens
aggccgccgtgaccta

SEQ ID NO: 913589 - DNA, 15 bp, Homo sapiens
aggccgcggcctccc

SEQ ID NO: 913590 - DNA, 16 bp, Homo sapiens
aggccgcggcctcccc

SEQ ID NO: 913591 - DNA, 20 bp, Homo sapiens
aggccgcggcctccccgagg

SEQ ID NO: 913592 - DNA, 14 bp, Homo sapiens
aggccgctagaggc

SEQ ID NO: 913593 - DNA, 17 bp, Homo sapiens
aggccgctagaggcctg

SEQ ID NO: 913594 - DNA, 21 bp, Homo sapiens
aggccgctagaggcctgagga

SEQ ID NO: 913595 - DNA, 19 bp, Homo sapiens
aggccgcttagtgctgctt

SEQ ID NO: 913596 - DNA, 16 bp, Homo sapiens
aggccggagagctggt

SEQ ID NO: 913597 - DNA, 16 bp, Homo sapiens
aggccggagcccagat

SEQ ID NO: 913598 - DNA, 12 bp, Homo sapiens
aggccggcccag

SEQ ID NO: 913599 - DNA, 14 bp, Homo sapiens
aggccggcccagat

SEQ ID NO: 913600 - DNA, 20 bp, Homo sapiens
aggccggcttgccacacccc

SEQ ID NO: 913601 - DNA, 20 bp, Homo sapiens
aggccgggaagagccacctg

SEQ ID NO: 913602 - DNA, 15 bp, Homo sapiens
aggccggggtccagg

SEQ ID NO: 913603 - DNA, 22 bp, Homo sapiens
aggccgtggactggctcatgcc

SEQ ID NO: 913604 - DNA, 14 bp, Homo sapiens
aggcctaaggaagc

SEQ ID NO: 913605 - DNA, 14 bp, Homo sapiens
aggcctacagagga

SEQ ID NO: 913606 - DNA, 18 bp, Homo sapiens
aggcctaggtgcagctcc

SEQ ID NO: 913607 - DNA, 21 bp, Homo sapiens
aggcctataaaattaaatgcc

SEQ ID NO: 913608 - DNA, 16 bp, Homo sapiens
aggcctataaccccag

SEQ ID NO: 913609 - DNA, 13 bp, Homo sapiens
aggcctatttcat

SEQ ID NO: 913610 - DNA, 20 bp, Homo sapiens
aggcctcaaagcaacccgct

SEQ ID NO: 913611 - DNA, 19 bp, Homo sapiens
aggcctcacctctacccaa

SEQ ID NO: 913612 - DNA, 15 bp, Homo sapiens
aggcctcagccagag

SEQ ID NO: 913613 - DNA, 14 bp, Homo sapiens
aggcctcaggtgct

SEQ ID NO: 913614 - DNA, 21 bp, Homo sapiens
aggcctcaggtgctgtccatg

SEQ ID NO: 913615 - DNA, 23 bp, Homo sapiens
aggcctcagtggactttccaccc

SEQ ID NO: 913616 - DNA, 14 bp, Homo sapiens
aggcctcatccctc

SEQ ID NO: 913617 - DNA, 18 bp, Homo sapiens
aggcctccaacgcccctg

SEQ ID NO: 913618 - DNA, 19 bp, Homo sapiens
aggcctccaacgcccctgt

SEQ ID NO: 913619 - DNA, 11 bp, Homo sapiens
aggcctccagc

SEQ ID NO: 913620 - DNA, 13 bp, Homo sapiens
aggcctccagcct

SEQ ID NO: 913621 - DNA, 18 bp, Homo sapiens
aggcctccagcctctccc

SEQ ID NO: 913622 - DNA, 15 bp, Homo sapiens
aggcctccctagcca

SEQ ID NO: 913623 - DNA, 19 bp, Homo sapiens
aggcctcctaggggaaggg

SEQ ID NO: 913624 - DNA, 15 bp, Homo sapiens
aggcctcgaggggcc

SEQ ID NO: 913625 - DNA, 22 bp, Homo sapiens
aggcctcgcacttgcagaggag

SEQ ID NO: 913626 - DNA, 14 bp, Homo sapiens
aggcctcggcagaa

SEQ ID NO: 913627 - DNA, 22 bp, Homo sapiens
aggcctcggcagaactctctgt

SEQ ID NO: 913628 - DNA, 23 bp, Homo sapiens
aggcctcggcagaactctctgtc

SEQ ID NO: 913629 - DNA, 21 bp, Homo sapiens
aggcctctccagtttgcacct

SEQ ID NO: 913630 - DNA, 24 bp, Homo sapiens
aggcctctccagtttgcacctgtc

SEQ ID NO: 913631 - DNA, 13 bp, Homo sapiens
aggcctctctctg

SEQ ID NO: 913632 - DNA, 18 bp, Homo sapiens
aggcctctggttgcctcc

SEQ ID NO: 913633 - DNA, 21 bp, Homo sapiens
aggcctctggttgcctccccc

SEQ ID NO: 913634 - DNA, 22 bp, Homo sapiens
aggcctctgtgtccttccctgc

SEQ ID NO: 913635 - DNA, 20 bp, Homo sapiens
aggcctcttgctgaaagcca

SEQ ID NO: 913636 - DNA, 18 bp, Homo sapiens
aggcctcttggacctctg

SEQ ID NO: 913637 - DNA, 17 bp, Homo sapiens
aggcctgaaagaggctg

SEQ ID NO: 913638 - DNA, 13 bp, Homo sapiens
aggcctgaagcca

SEQ ID NO: 913639 - DNA, 19 bp, Homo sapiens
aggcctgaagccagctgcc

SEQ ID NO: 913640 - DNA, 21 bp, Homo sapiens
aggcctgaagccagctgccct

SEQ ID NO: 913641 - DNA, 14 bp, Homo sapiens
aggcctgaagtctt

SEQ ID NO: 913642 - DNA, 20 bp, Homo sapiens
aggcctgacccacggggcag

SEQ ID NO: 913643 - DNA, 21 bp, Homo sapiens
aggcctgacctcaagcaacca

SEQ ID NO: 913644 - DNA, 17 bp, Homo sapiens
aggcctgacttctgctg

SEQ ID NO: 913645 - DNA, 14 bp, Homo sapiens
aggcctgagaatga

SEQ ID NO: 913646 - DNA, 23 bp, Homo sapiens
aggcctgagaatgagtgggaatc

SEQ ID NO: 913647 - DNA, 14 bp, Homo sapiens
aggcctgaggatga

SEQ ID NO: 913648 - DNA, 19 bp, Homo sapiens
aggcctgaggatgagctgg

SEQ ID NO: 913649 - DNA, 15 bp, Homo sapiens
aggcctgatgctgcc

SEQ ID NO: 913650 - DNA, 18 bp, Homo sapiens
aggcctgcaaaccttcct

SEQ ID NO: 913651 - DNA, 21 bp, Homo sapiens
aggcctgcaaaccttcctggg

SEQ ID NO: 913652 - DNA, 22 bp, Homo sapiens
aggcctgcaaaccttcctggga

SEQ ID NO: 913653 - DNA, 17 bp, Homo sapiens
aggcctgccccctgggc

SEQ ID NO: 913654 - DNA, 18 bp, Homo sapiens
aggcctgccccctgggct

SEQ ID NO: 913655 - DNA, 22 bp, Homo sapiens
aggcctgccctcagggatcttg

SEQ ID NO: 913656 - DNA, 13 bp, Homo sapiens
aggcctgcctgtt

SEQ ID NO: 913657 - DNA, 22 bp, Homo sapiens
aggcctgctggcatcaggtctg

SEQ ID NO: 913658 - DNA, 14 bp, Homo sapiens
aggcctggaaccag

SEQ ID NO: 913659 - DNA, 17 bp, Homo sapiens
aggcctggaaccaggga

SEQ ID NO: 913660 - DNA, 16 bp, Homo sapiens
aggcctggaccgagat

SEQ ID NO: 913661 - DNA, 17 bp, Homo sapiens
aggcctggacgggccct

SEQ ID NO: 913662 - DNA, 20 bp, Homo sapiens
aggcctggacgggccctcct

SEQ ID NO: 913663 - DNA, 13 bp, Homo sapiens
aggcctggagggc

SEQ ID NO: 913664 - DNA, 18 bp, Homo sapiens
caggtaccagctgcgctt

SEQ ID NO: 913665 - DNA, 19 bp, Homo sapiens
caggtacttcctcctgatg

SEQ ID NO: 913666 - DNA, 23 bp, Homo sapiens
caggtacttcctcctgatggcca

SEQ ID NO: 913667 - DNA, 22 bp, Homo sapiens
caggtagatcgcttgagcccag

SEQ ID NO: 913668 - DNA, 14 bp, Homo sapiens
caggtagcaagaga

SEQ ID NO: 913669 - DNA, 19 bp, Homo sapiens
caggtaggaagcaacagct

SEQ ID NO: 913670 - DNA, 12 bp, Homo sapiens
caggtaggccct

SEQ ID NO: 913671 - DNA, 14 bp, Homo sapiens
caggtaggcccttg

SEQ ID NO: 913672 - DNA, 23 bp, Homo sapiens
caggtaggcccttgtcctgccag

SEQ ID NO: 913673 - DNA, 22 bp, Homo sapiens
caggtagtattacaccaccggc

SEQ ID NO: 913674 - DNA, 18 bp, Homo sapiens
caggtagttgcaattgaa

SEQ ID NO: 913675 - DNA, 17 bp, Homo sapiens
caggtagtttgtaccat

SEQ ID NO: 913676 - DNA, 14 bp, Homo sapiens
caggtatgttgcct

SEQ ID NO: 913677 - DNA, 20 bp, Homo sapiens
caggtatgttgcctttatgg

SEQ ID NO: 913678 - DNA, 20 bp, Homo sapiens
caggtatttttttaaatcaa

SEQ ID NO: 913679 - DNA, 22 bp, Homo sapiens
caggtatttttttaaatcaagg

SEQ ID NO: 913680 - DNA, 23 bp, Homo sapiens
caggtatttttttaaatcaagga

SEQ ID NO: 913681 - DNA, 21 bp, Homo sapiens
caggtcaccatcctcagaggc

SEQ ID NO: 913682 - DNA, 24 bp, Homo sapiens
caggtcaccatcctcagaggctga

SEQ ID NO: 913683 - DNA, 11 bp, Homo sapiens
caggtcactgt

SEQ ID NO: 913684 - DNA, 12 bp, Homo sapiens
caggtcagccct

SEQ ID NO: 913685 - DNA, 13 bp, Homo sapiens
caggtcagccctg

SEQ ID NO: 913686 - DNA, 14 bp, Homo sapiens
caggtcagctggga

SEQ ID NO: 913687 - DNA, 17 bp, Homo sapiens
caggtcagctgggagcc

SEQ ID NO: 913688 - DNA, 21 bp, Homo sapiens
caggtcagctgggagccagtg

SEQ ID NO: 913689 - DNA, 13 bp, Homo sapiens
caggtcagggctc

SEQ ID NO: 913690 - DNA, 17 bp, Homo sapiens
caggtcagggctcagag

SEQ ID NO: 913691 - DNA, 16 bp, Homo sapiens
caggtcatcagatgcc

SEQ ID NO: 913692 - DNA, 19 bp, Homo sapiens
caggtcatgcagttcctgg

SEQ ID NO: 913693 - DNA, 17 bp, Homo sapiens
caggtccaaacccttca

SEQ ID NO: 913694 - DNA, 22 bp, Homo sapiens
caggtccaaacccttcaactcc

SEQ ID NO: 913695 - DNA, 22 bp, Homo sapiens
caggtccacggtctgttcttga

SEQ ID NO: 913696 - DNA, 15 bp, Homo sapiens
caggtccagatgtgc

SEQ ID NO: 913697 - DNA, 13 bp, Homo sapiens
caggtccagctct

SEQ ID NO: 913698 - DNA, 17 bp, Homo sapiens
caggtccagctctggag

SEQ ID NO: 913699 - DNA, 19 bp, Homo sapiens
caggtccagctctggaggg

SEQ ID NO: 913700 - DNA, 19 bp, Homo sapiens
caggtccaggccagtgggc

SEQ ID NO: 913701 - DNA, 20 bp, Homo sapiens
caggtcccacctccagcccg

SEQ ID NO: 913702 - DNA, 18 bp, Homo sapiens
caggtcccacgtctggcc

SEQ ID NO: 913703 - DNA, 13 bp, Homo sapiens
caggtccccatgg

SEQ ID NO: 913704 - DNA, 14 bp, Homo sapiens
caggtccccatggc

SEQ ID NO: 913705 - DNA, 15 bp, Homo sapiens
caggtccccatggct

SEQ ID NO: 913706 - DNA, 17 bp, Homo sapiens
caggtcccccgactgcc

SEQ ID NO: 913707 - DNA, 13 bp, Homo sapiens
caggtccgtgggc

SEQ ID NO: 913708 - DNA, 19 bp, Homo sapiens
caggtcctagtcgggcagg

SEQ ID NO: 913709 - DNA, 22 bp, Homo sapiens
caggtcctctgatacccagagc

SEQ ID NO: 913710 - DNA, 21 bp, Homo sapiens
caggtcctgcccatgtgtccc

SEQ ID NO: 913711 - DNA, 14 bp, Homo sapiens
caggtcctgtctct

SEQ ID NO: 913712 - DNA, 22 bp, Homo sapiens
caggtccttcctttaggtctgg

SEQ ID NO: 913713 - DNA, 15 bp, Homo sapiens
caggtctagactttc

SEQ ID NO: 913714 - DNA, 14 bp, Homo sapiens
caggtctcacgggc

SEQ ID NO: 913715 - DNA, 17 bp, Homo sapiens
caggtctcattgcttct

SEQ ID NO: 913716 - DNA, 12 bp, Homo sapiens
caggtctcccac

SEQ ID NO: 913717 - DNA, 22 bp, Homo sapiens
caggtctcccacgtgggagaca

SEQ ID NO: 913718 - DNA, 14 bp, Homo sapiens
caggtctcctctta

SEQ ID NO: 913719 - DNA, 15 bp, Homo sapiens
caggtctcctcttaa

SEQ ID NO: 913720 - DNA, 22 bp, Homo sapiens
caggtctcctcttaaaaaataa

SEQ ID NO: 913721 - DNA, 13 bp, Homo sapiens
caggtctgcaagg

SEQ ID NO: 913722 - DNA, 16 bp, Homo sapiens
caggtctgcaagggcc

SEQ ID NO: 913723 - DNA, 14 bp, Homo sapiens
caggtctgggcaag

SEQ ID NO: 913724 - DNA, 20 bp, Homo sapiens
caggtctgtaactgcccagc

SEQ ID NO: 913725 - DNA, 18 bp, Homo sapiens
caggtcttcatatttttg

SEQ ID NO: 913726 - DNA, 22 bp, Homo sapiens
caggtcttcatatttttgatca

SEQ ID NO: 913727 - DNA, 20 bp, Homo sapiens
caggtcttcatcgaatctac

SEQ ID NO: 913728 - DNA, 22 bp, Homo sapiens
caggtcttccggggccatgggc

SEQ ID NO: 913729 - DNA, 23 bp, Homo sapiens
caggtcttccggggccatgggca

SEQ ID NO: 913730 - DNA, 19 bp, Homo sapiens
caggtcttgactcatggca

SEQ ID NO: 913731 - DNA, 19 bp, Homo sapiens
caggtcttggagctgagcc

SEQ ID NO: 913732 - DNA, 20 bp, Homo sapiens
caggtcttggagctgagcct

SEQ ID NO: 913733 - DNA, 23 bp, Homo sapiens
caggtcttggggtcatgaagggc

SEQ ID NO: 913734 - DNA, 14 bp, Homo sapiens
caggtctttcctaa

SEQ ID NO: 913735 - DNA, 13 bp, Homo sapiens
caggtgaacactt

SEQ ID NO: 913736 - DNA, 18 bp, Homo sapiens
caggtgaacacttagtga

SEQ ID NO: 913737 - DNA, 21 bp, Homo sapiens
caggtgacttctagcagagac

SEQ ID NO: 913738 - DNA, 20 bp, Homo sapiens
caggtgagaagcagaggaag

SEQ ID NO: 913739 - DNA, 19 bp, Homo sapiens
caggtgagaagtgagggag

SEQ ID NO: 913740 - DNA, 16 bp, Homo sapiens
caggtgaggtctgttc

SEQ ID NO: 913741 - DNA, 15 bp, Homo sapiens
caggtgagtgtgagg

SEQ ID NO: 913742 - DNA, 20 bp, Homo sapiens
caggtgagtgtgagggcagc

SEQ ID NO: 913743 - DNA, 21 bp, Homo sapiens
caggtgagtgtgagggcagca

SEQ ID NO: 913744 - DNA, 20 bp, Homo sapiens
caggtgattggaccaggcca

SEQ ID NO: 913745 - DNA, 22 bp, Homo sapiens
caggtgatttcctctaaagaaa

SEQ ID NO: 913746 - DNA, 24 bp, Homo sapiens
caggtgcacacatcaccaggtgca

SEQ ID NO: 913747 - DNA, 16 bp, Homo sapiens
caggtgcagaccttgg

SEQ ID NO: 913748 - DNA, 13 bp, Homo sapiens
caggtgccactcc

SEQ ID NO: 913749 - DNA, 16 bp, Homo sapiens
caggtgccactccctg

SEQ ID NO: 913750 - DNA, 16 bp, Homo sapiens
caggtgcctccaggtg

SEQ ID NO: 913751 - DNA, 18 bp, Homo sapiens
caggtgcctccaggtgtg

SEQ ID NO: 913752 - DNA, 19 bp, Homo sapiens
caggtgcctccaggtgtgc

SEQ ID NO: 913753 - DNA, 12 bp, Homo sapiens
caggtgcctgga

SEQ ID NO: 913754 - DNA, 23 bp, Homo sapiens
caggtgcctgtccttgaaaaaca

SEQ ID NO: 913755 - DNA, 22 bp, Homo sapiens
caggtgcggcctggggggaacg

SEQ ID NO: 913756 - DNA, 17 bp, Homo sapiens
caggtgcgtgtgtctct

SEQ ID NO: 913757 - DNA, 20 bp, Homo sapiens
caggtgcgtgtgtctctgtc

SEQ ID NO: 913758 - DNA, 21 bp, Homo sapiens
caggtgctacacccttttcca

SEQ ID NO: 913759 - DNA, 22 bp, Homo sapiens
caggtgctatgtcccaagagcc

SEQ ID NO: 913760 - DNA, 19 bp, Homo sapiens
caggtgctcaataaatgat

SEQ ID NO: 913761 - DNA, 14 bp, Homo sapiens
caggtgctcccctg

SEQ ID NO: 913762 - DNA, 23 bp, Homo sapiens
caggtgctcccctgacagtccct

SEQ ID NO: 913763 - DNA, 15 bp, Homo sapiens
caggtgctgggctgg

SEQ ID NO: 913764 - DNA, 13 bp, Homo sapiens
caggtgctgtcca

SEQ ID NO: 913765 - DNA, 14 bp, Homo sapiens
caggtgctgtccat

SEQ ID NO: 913766 - DNA, 23 bp, Homo sapiens
caggtgcttttccctatccacag

SEQ ID NO: 913767 - DNA, 16 bp, Homo sapiens
caggtgcttttgatgt

SEQ ID NO: 913768 - DNA, 18 bp, Homo sapiens
caggtggaaggcagacag

SEQ ID NO: 913769 - DNA, 16 bp, Homo sapiens
caggtggactctggga

SEQ ID NO: 913770 - DNA, 18 bp, Homo sapiens
caggtggatcacgaggtc

SEQ ID NO: 913771 - DNA, 22 bp, Homo sapiens
caggtggatctatttcatgttt

SEQ ID NO: 913772 - DNA, 16 bp, Homo sapiens
caggtggatgaggaga

SEQ ID NO: 913773 - DNA, 17 bp, Homo sapiens
caggtggatgaggagac

SEQ ID NO: 913774 - DNA, 18 bp, Homo sapiens
caggtggatgaggagaca

SEQ ID NO: 913775 - DNA, 24 bp, Homo sapiens
caggtggattttgtggaggtgaga

SEQ ID NO: 913776 - DNA, 16 bp, Homo sapiens
caggtggcaaagtact

SEQ ID NO: 913777 - DNA, 16 bp, Homo sapiens
caggtggcaggaccag

SEQ ID NO: 913778 - DNA, 18 bp, Homo sapiens
caggtggcaggaccagga

SEQ ID NO: 913779 - DNA, 16 bp, Homo sapiens
caggtggccactccag

SEQ ID NO: 913780 - DNA, 20 bp, Homo sapiens
caggtggccgcccctgaggc

SEQ ID NO: 913781 - DNA, 21 bp, Homo sapiens
caggtggccgcccctgaggct

SEQ ID NO: 913782 - DNA, 14 bp, Homo sapiens
caggtggcctcctg

SEQ ID NO: 913783 - DNA, 17 bp, Homo sapiens
caggtggcctcctggcc

SEQ ID NO: 913784 - DNA, 20 bp, Homo sapiens
caggtggctcagtgccacct

SEQ ID NO: 913785 - DNA, 22 bp, Homo sapiens
caggtggctctgaggtgcctgt

SEQ ID NO: 913786 - DNA, 16 bp, Homo sapiens
caggtggctgacccag

SEQ ID NO: 913787 - DNA, 16 bp, Homo sapiens
aggcctggagggcact

SEQ ID NO: 913788 - DNA, 13 bp, Homo sapiens
aggcctggccagg

SEQ ID NO: 913789 - DNA, 13 bp, Homo sapiens
aggcctggcctcg

SEQ ID NO: 913790 - DNA, 15 bp, Homo sapiens
aggcctggctccccg

SEQ ID NO: 913791 - DNA, 16 bp, Homo sapiens
aggcctggctccccga

SEQ ID NO: 913792 - DNA, 18 bp, Homo sapiens
aggcctggctccccgagg

SEQ ID NO: 913793 - DNA, 21 bp, Homo sapiens
aggcctggctggaggagcagc

SEQ ID NO: 913794 - DNA, 15 bp, Homo sapiens
aggcctgggacccag

SEQ ID NO: 913795 - DNA, 18 bp, Homo sapiens
aggcctgggacccagcta

SEQ ID NO: 913796 - DNA, 20 bp, Homo sapiens
aggcctgggacccagctact

SEQ ID NO: 913797 - DNA, 23 bp, Homo sapiens
aggcctgggacccagctactctg

SEQ ID NO: 913798 - DNA, 18 bp, Homo sapiens
aggcctgggatgcagtga

SEQ ID NO: 913799 - DNA, 21 bp, Homo sapiens
aggcctgggccgctgccacgt

SEQ ID NO: 913800 - DNA, 16 bp, Homo sapiens
aggcctgggctgggaa

SEQ ID NO: 913801 - DNA, 12 bp, Homo sapiens
aggcctggggac

SEQ ID NO: 913802 - DNA, 23 bp, Homo sapiens
aggcctgggggacccctggctct

SEQ ID NO: 913803 - DNA, 17 bp, Homo sapiens
aggcctgggtctgtgtc

SEQ ID NO: 913804 - DNA, 19 bp, Homo sapiens
aggcctgggtctgtgtctc

SEQ ID NO: 913805 - DNA, 21 bp, Homo sapiens
aggcctgggtctgtgtctctt

SEQ ID NO: 913806 - DNA, 16 bp, Homo sapiens
aggcctgggtgctggc

SEQ ID NO: 913807 - DNA, 22 bp, Homo sapiens
aggcctgttcccttgtggcttg

SEQ ID NO: 913808 - DNA, 22 bp, Homo sapiens
aggccttaatggacattgactt

SEQ ID NO: 913809 - DNA, 18 bp, Homo sapiens
aggccttatcattcattc

SEQ ID NO: 913810 - DNA, 19 bp, Homo sapiens
aggccttatctccaagacc

SEQ ID NO: 913811 - DNA, 16 bp, Homo sapiens
aggccttcagacacat

SEQ ID NO: 913812 - DNA, 14 bp, Homo sapiens
aggccttcagttta

SEQ ID NO: 913813 - DNA, 13 bp, Homo sapiens
aggccttccactg

SEQ ID NO: 913814 - DNA, 15 bp, Homo sapiens
aggccttccagctgc

SEQ ID NO: 913815 - DNA, 20 bp, Homo sapiens
aggccttccagctgctgtct

SEQ ID NO: 913816 - DNA, 18 bp, Homo sapiens
aggccttcccatggccat

SEQ ID NO: 913817 - DNA, 14 bp, Homo sapiens
aggccttccctgtc

SEQ ID NO: 913818 - DNA, 19 bp, Homo sapiens
aggccttcctctctccaga

SEQ ID NO: 913819 - DNA, 12 bp, Homo sapiens
aggccttctgtg

SEQ ID NO: 913820 - DNA, 23 bp, Homo sapiens
aggccttgagacttgaaaccaga

SEQ ID NO: 913821 - DNA, 14 bp, Homo sapiens
aggccttgctgact

SEQ ID NO: 913822 - DNA, 16 bp, Homo sapiens
aggccttgctgactct

SEQ ID NO: 913823 - DNA, 18 bp, Homo sapiens
aggccttggggtgggggc

SEQ ID NO: 913824 - DNA, 20 bp, Homo sapiens
aggccttggtggagcagcca

SEQ ID NO: 913825 - DNA, 21 bp, Homo sapiens
aggccttggtggagcagccag

SEQ ID NO: 913826 - DNA, 13 bp, Homo sapiens
aggccttgtccta

SEQ ID NO: 913827 - DNA, 20 bp, Homo sapiens
aggccttgtgtgtcaggccc

SEQ ID NO: 913828 - DNA, 14 bp, Homo sapiens
aggcctttaaccat

SEQ ID NO: 913829 - DNA, 18 bp, Homo sapiens
aggcctttcttctgtgtt

SEQ ID NO: 913830 - DNA, 19 bp, Homo sapiens
aggcctttcttctgtgtta

SEQ ID NO: 913831 - DNA, 20 bp, Homo sapiens
aggcctttggaggggaaatg

SEQ ID NO: 913832 - DNA, 13 bp, Homo sapiens
aggccttttcacg

SEQ ID NO: 913833 - DNA, 16 bp, Homo sapiens
aggccttttggaatgt

SEQ ID NO: 913834 - DNA, 15 bp, Homo sapiens
aggcgaccaccgccc

SEQ ID NO: 913835 - DNA, 16 bp, Homo sapiens
aggcgagcctgactct

SEQ ID NO: 913836 - DNA, 16 bp, Homo sapiens
aggcgagtctggggac

SEQ ID NO: 913837 - DNA, 20 bp, Homo sapiens
aggcgatggggcaagacaga

SEQ ID NO: 913838 - DNA, 19 bp, Homo sapiens
aggcgcagaggtcccagcc

SEQ ID NO: 913839 - DNA, 20 bp, Homo sapiens
aggcgcatgagtatctgtgg

SEQ ID NO: 913840 - DNA, 21 bp, Homo sapiens
aggcgcatgagtatctgtggg

SEQ ID NO: 913841 - DNA, 13 bp, Homo sapiens
aggcgcatgtctg

SEQ ID NO: 913842 - DNA, 16 bp, Homo sapiens
aggcgcatgtctgcac

SEQ ID NO: 913843 - DNA, 19 bp, Homo sapiens
aggcgcatgtctgcacctc

SEQ ID NO: 913844 - DNA, 19 bp, Homo sapiens
aggcgcccccgccccaggc

SEQ ID NO: 913845 - DNA, 14 bp, Homo sapiens
aggcgccccttccc

SEQ ID NO: 913846 - DNA, 21 bp, Homo sapiens
aggcgcggcggctctgcccac

SEQ ID NO: 913847 - DNA, 19 bp, Homo sapiens
aggcgcgtctgccccaccc

SEQ ID NO: 913848 - DNA, 20 bp, Homo sapiens
aggcgcgtctgccccaccct

SEQ ID NO: 913849 - DNA, 15 bp, Homo sapiens
aggcgcttcccaact

SEQ ID NO: 913850 - DNA, 22 bp, Homo sapiens
aggcggaggctgtgctccgcca

SEQ ID NO: 913851 - DNA, 14 bp, Homo sapiens
aggcggcagctctt

SEQ ID NO: 913852 - DNA, 12 bp, Homo sapiens
aggcggccaggg

SEQ ID NO: 913853 - DNA, 19 bp, Homo sapiens
aggcggccagggcggccag

SEQ ID NO: 913854 - DNA, 13 bp, Homo sapiens
aggcggccctggg

SEQ ID NO: 913855 - DNA, 14 bp, Homo sapiens
aggcgggaaggagg

SEQ ID NO: 913856 - DNA, 14 bp, Homo sapiens
aggcgggaggaggt

SEQ ID NO: 913857 - DNA, 12 bp, Homo sapiens
aggcgggccagc

SEQ ID NO: 913858 - DNA, 14 bp, Homo sapiens
aggcgggccagcca

SEQ ID NO: 913859 - DNA, 16 bp, Homo sapiens
aggcgggccagccagg

SEQ ID NO: 913860 - DNA, 17 bp, Homo sapiens
aggcgggccagccaggc

SEQ ID NO: 913861 - DNA, 14 bp, Homo sapiens
aggcgggcttggaa

SEQ ID NO: 913862 - DNA, 20 bp, Homo sapiens
aggcggtcatgtgtgcatgt

SEQ ID NO: 913863 - DNA, 21 bp, Homo sapiens
aggcggtcatgtgtgcatgtg

SEQ ID NO: 913864 - DNA, 20 bp, Homo sapiens
aggcggtccccatccccacc

SEQ ID NO: 913865 - DNA, 21 bp, Homo sapiens
aggcggtccccatccccacca

SEQ ID NO: 913866 - DNA, 23 bp, Homo sapiens
aggcggtccccatccccaccagc

SEQ ID NO: 913867 - DNA, 19 bp, Homo sapiens
aggcggtgcactcactcct

SEQ ID NO: 913868 - DNA, 14 bp, Homo sapiens
aggcggtgggcacc

SEQ ID NO: 913869 - DNA, 19 bp, Homo sapiens
aggcgtcaacgtgcatttt

SEQ ID NO: 913870 - DNA, 18 bp, Homo sapiens
aggcgtctgtatattttg

SEQ ID NO: 913871 - DNA, 20 bp, Homo sapiens
aggcgtcttcatctccctgc

SEQ ID NO: 913872 - DNA, 12 bp, Homo sapiens
aggcgtgatcca

SEQ ID NO: 913873 - DNA, 15 bp, Homo sapiens
aggcgtggaggagag

SEQ ID NO: 913874 - DNA, 17 bp, Homo sapiens
aggcgtgtgcaggccga

SEQ ID NO: 913875 - DNA, 14 bp, Homo sapiens
aggcgttggtgcca

SEQ ID NO: 913876 - DNA, 18 bp, Homo sapiens
aggctaaaaggtcttgca

SEQ ID NO: 913877 - DNA, 21 bp, Homo sapiens
aggctaagatgagatttgcca

SEQ ID NO: 913878 - DNA, 23 bp, Homo sapiens
aggctaagatgagatttgccagc

SEQ ID NO: 913879 - DNA, 18 bp, Homo sapiens
aggctaagttcagttctg

SEQ ID NO: 913880 - DNA, 13 bp, Homo sapiens
aggctaagttggg

SEQ ID NO: 913881 - DNA, 22 bp, Homo sapiens
aggctaatttttttgtatttta

SEQ ID NO: 913882 - DNA, 18 bp, Homo sapiens
aggctacaattttctccc

SEQ ID NO: 913883 - DNA, 23 bp, Homo sapiens
aggctacaattttctcccaggaa

SEQ ID NO: 913884 - DNA, 21 bp, Homo sapiens
aggctacctcacctgggcagg

SEQ ID NO: 913885 - DNA, 14 bp, Homo sapiens
aggctacctttgta

SEQ ID NO: 913886 - DNA, 13 bp, Homo sapiens
aggctagatcccc

SEQ ID NO: 913887 - DNA, 15 bp, Homo sapiens
aggctagcttctgct

SEQ ID NO: 913888 - DNA, 18 bp, Homo sapiens
aggctagcttctgctttt

SEQ ID NO: 913889 - DNA, 15 bp, Homo sapiens
aggctattaaaaaag

SEQ ID NO: 913890 - DNA, 16 bp, Homo sapiens
aggctattatttattg

SEQ ID NO: 913891 - DNA, 15 bp, Homo sapiens
aggctattcctgaga

SEQ ID NO: 913892 - DNA, 20 bp, Homo sapiens
aggctattcctgagagctgc

SEQ ID NO: 913893 - DNA, 17 bp, Homo sapiens
aggctatttgtaaatct

SEQ ID NO: 913894 - DNA, 21 bp, Homo sapiens
aggctatttgtaaatctgcca

SEQ ID NO: 913895 - DNA, 15 bp, Homo sapiens
aggctcaaggctgtg

SEQ ID NO: 913896 - DNA, 23 bp, Homo sapiens
aggctcacccccttctccatcca

SEQ ID NO: 913897 - DNA, 12 bp, Homo sapiens
aggctcactgcc

SEQ ID NO: 913898 - DNA, 23 bp, Homo sapiens
aggctcactgccaggccagcctc

SEQ ID NO: 913899 - DNA, 18 bp, Homo sapiens
aggctcagtggtgggaga

SEQ ID NO: 913900 - DNA, 13 bp, Homo sapiens
aggctcatttaaa

SEQ ID NO: 913901 - DNA, 17 bp, Homo sapiens
aggctcatttaaaacag

SEQ ID NO: 913902 - DNA, 18 bp, Homo sapiens
aggctccaagaggctgag

SEQ ID NO: 913903 - DNA, 13 bp, Homo sapiens
aggctccagaggg

SEQ ID NO: 913904 - DNA, 15 bp, Homo sapiens
aggctccagagggca

SEQ ID NO: 913905 - DNA, 14 bp, Homo sapiens
aggctccattagga

SEQ ID NO: 913906 - DNA, 20 bp, Homo sapiens
aggctccccagaactggctg

SEQ ID NO: 913907 - DNA, 21 bp, Homo sapiens
aggctccccagaactggctgg

SEQ ID NO: 913908 - DNA, 22 bp, Homo sapiens
aggctccccagaactggctggg

SEQ ID NO: 913909 - DNA, 19 bp, Homo sapiens
aggctcccgagtggggcct

SEQ ID NO: 913910 - DNA, 12 bp, Homo sapiens
aggctcctcctt

SEQ ID NO: 913911 - DNA, 18 bp, Homo sapiens
aggctcctggctgtgccc

SEQ ID NO: 913912 - DNA, 23 bp, Homo sapiens
caggtggctgacccagtccctgg

SEQ ID NO: 913913 - DNA, 12 bp, Homo sapiens
caggtgggactt

SEQ ID NO: 913914 - DNA, 14 bp, Homo sapiens
caggtgggcctggc

SEQ ID NO: 913915 - DNA, 23 bp, Homo sapiens
caggtgggcctggcggcctgtgg

SEQ ID NO: 913916 - DNA, 14 bp, Homo sapiens
caggtgggcggtgt

SEQ ID NO: 913917 - DNA, 22 bp, Homo sapiens
caggtgggctggacttctacct

SEQ ID NO: 913918 - DNA, 15 bp, Homo sapiens
caggtgggctgggcc

SEQ ID NO: 913919 - DNA, 21 bp, Homo sapiens
caggtgggctgggcccaccca

SEQ ID NO: 913920 - DNA, 19 bp, Homo sapiens
caggtggggagactgggct

SEQ ID NO: 913921 - DNA, 22 bp, Homo sapiens
caggtggggagactgggctgag

SEQ ID NO: 913922 - DNA, 12 bp, Homo sapiens
caggtggggagg

SEQ ID NO: 913923 - DNA, 17 bp, Homo sapiens
caggtggggcctcagcc

SEQ ID NO: 913924 - DNA, 22 bp, Homo sapiens
caggtggggcctcagcctgggg

SEQ ID NO: 913925 - DNA, 23 bp, Homo sapiens
caggtggggtgatggccagagga

SEQ ID NO: 913926 - DNA, 19 bp, Homo sapiens
caggtggggttcgagggga

SEQ ID NO: 913927 - DNA, 14 bp, Homo sapiens
caggtggtggaggg

SEQ ID NO: 913928 - DNA, 15 bp, Homo sapiens
caggtggtggagggg

SEQ ID NO: 913929 - DNA, 20 bp, Homo sapiens
caggtggtggcactgagccc

SEQ ID NO: 913930 - DNA, 18 bp, Homo sapiens
caggtggttatggagagg

SEQ ID NO: 913931 - DNA, 15 bp, Homo sapiens
caggtgtagctgagc

SEQ ID NO: 913932 - DNA, 16 bp, Homo sapiens
caggtgtagctgagct

SEQ ID NO: 913933 - DNA, 17 bp, Homo sapiens
caggtgtagctgagctg

SEQ ID NO: 913934 - DNA, 23 bp, Homo sapiens
caggtgtagctgagctgtgacat

SEQ ID NO: 913935 - DNA, 15 bp, Homo sapiens
caggtgtataaatgt

SEQ ID NO: 913936 - DNA, 17 bp, Homo sapiens
caggtgtctgcctagat

SEQ ID NO: 913937 - DNA, 14 bp, Homo sapiens
caggtgtgagccac

SEQ ID NO: 913938 - DNA, 18 bp, Homo sapiens
caggtgtgcacagaaaac

SEQ ID NO: 913939 - DNA, 16 bp, Homo sapiens
caggtgtggtggctca

SEQ ID NO: 913940 - DNA, 15 bp, Homo sapiens
caggtgtgtgtgaac

SEQ ID NO: 913941 - DNA, 12 bp, Homo sapiens
caggtgtttgac

SEQ ID NO: 913942 - DNA, 17 bp, Homo sapiens
caggtgttttaagactg

SEQ ID NO: 913943 - DNA, 22 bp, Homo sapiens
caggttagggtgtgtgccacac

SEQ ID NO: 913944 - DNA, 15 bp, Homo sapiens
caggttataacagtg

SEQ ID NO: 913945 - DNA, 21 bp, Homo sapiens
caggttattgcaataaagtat

SEQ ID NO: 913946 - DNA, 19 bp, Homo sapiens
caggttcaacccacagcta

SEQ ID NO: 913947 - DNA, 13 bp, Homo sapiens
caggttcatggat

SEQ ID NO: 913948 - DNA, 14 bp, Homo sapiens
caggttcccaagct

SEQ ID NO: 913949 - DNA, 15 bp, Homo sapiens
caggttcccaagctc

SEQ ID NO: 913950 - DNA, 18 bp, Homo sapiens
caggttcccccagcaagc

SEQ ID NO: 913951 - DNA, 18 bp, Homo sapiens
caggttccctcccagagg

SEQ ID NO: 913952 - DNA, 23 bp, Homo sapiens
caggttccctcccagaggagcca

SEQ ID NO: 913953 - DNA, 13 bp, Homo sapiens
caggttcctgggg

SEQ ID NO: 913954 - DNA, 14 bp, Homo sapiens
caggttcctggggc

SEQ ID NO: 913955 - DNA, 15 bp, Homo sapiens
caggttcctggggcc

SEQ ID NO: 913956 - DNA, 15 bp, Homo sapiens
caggttcctgtggag

SEQ ID NO: 913957 - DNA, 17 bp, Homo sapiens
caggttcctgtggagac

SEQ ID NO: 913958 - DNA, 15 bp, Homo sapiens
caggttcctttttca

SEQ ID NO: 913959 - DNA, 21 bp, Homo sapiens
caggttctccgttagctcctg

SEQ ID NO: 913960 - DNA, 18 bp, Homo sapiens
caggttcttgatgtcatg

SEQ ID NO: 913961 - DNA, 16 bp, Homo sapiens
caggttcttgcctttc

SEQ ID NO: 913962 - DNA, 17 bp, Homo sapiens
caggttcttgcctttct

SEQ ID NO: 913963 - DNA, 18 bp, Homo sapiens
caggttgaagccatgtct

SEQ ID NO: 913964 - DNA, 22 bp, Homo sapiens
caggttgaggggctcctggaaa

SEQ ID NO: 913965 - DNA, 21 bp, Homo sapiens
caggttggatgggagtgggca

SEQ ID NO: 913966 - DNA, 22 bp, Homo sapiens
caggttggatgggagtgggcac

SEQ ID NO: 913967 - DNA, 12 bp, Homo sapiens
caggtttaacat

SEQ ID NO: 913968 - DNA, 16 bp, Homo sapiens
caggtttaagctgtta

SEQ ID NO: 913969 - DNA, 21 bp, Homo sapiens
caggtttaagtagatttcatg

SEQ ID NO: 913970 - DNA, 19 bp, Homo sapiens
caggtttcactattcctat

SEQ ID NO: 913971 - DNA, 23 bp, Homo sapiens
caggtttgcccacttgattgaga

SEQ ID NO: 913972 - DNA, 20 bp, Homo sapiens
caggtttggtttttttgtac

SEQ ID NO: 913973 - DNA, 13 bp, Homo sapiens
caggtttgttaca

SEQ ID NO: 913974 - DNA, 14 bp, Homo sapiens
caggtttgttacat

SEQ ID NO: 913975 - DNA, 19 bp, Homo sapiens
caggttttcttttaagaat

SEQ ID NO: 913976 - DNA, 19 bp, Homo sapiens
cagtaaaaaaaaaaaatgg

SEQ ID NO: 913977 - DNA, 22 bp, Homo sapiens
cagtaaaaacttgtactatgtt

SEQ ID NO: 913978 - DNA, 20 bp, Homo sapiens
cagtaaaagataaatttgtt

SEQ ID NO: 913979 - DNA, 23 bp, Homo sapiens
cagtaaaagccttattctaaggt

SEQ ID NO: 913980 - DNA, 17 bp, Homo sapiens
cagtaaaattatactgt

SEQ ID NO: 913981 - DNA, 10 bp, Homo sapiens
cagtaaacat

SEQ ID NO: 913982 - DNA, 16 bp, Homo sapiens
cagtaaaccactgaaa

SEQ ID NO: 913983 - DNA, 21 bp, Homo sapiens
cagtaaacgggaacatgcccc

SEQ ID NO: 913984 - DNA, 23 bp, Homo sapiens
cagtaaacgggaacatgccccct

SEQ ID NO: 913985 - DNA, 15 bp, Homo sapiens
cagtaaagcacttgc

SEQ ID NO: 913986 - DNA, 16 bp, Homo sapiens
cagtaaataactggaa

SEQ ID NO: 913987 - DNA, 19 bp, Homo sapiens
cagtaaatacttgcagttg

SEQ ID NO: 913988 - DNA, 20 bp, Homo sapiens
cagtaaatagtgtcatataa

SEQ ID NO: 913989 - DNA, 20 bp, Homo sapiens
cagtaaatcttttacaactg

SEQ ID NO: 913990 - DNA, 20 bp, Homo sapiens
cagtaaatgggggtgcattt

SEQ ID NO: 913991 - DNA, 21 bp, Homo sapiens
cagtaaatgggggtgcatttg

SEQ ID NO: 913992 - DNA, 15 bp, Homo sapiens
cagtaaatttgctag

SEQ ID NO: 913993 - DNA, 20 bp, Homo sapiens
cagtaacataactgcttctt

SEQ ID NO: 913994 - DNA, 15 bp, Homo sapiens
cagtaaccaagagtt

SEQ ID NO: 913995 - DNA, 16 bp, Homo sapiens
cagtaaccaagagtta

SEQ ID NO: 913996 - DNA, 18 bp, Homo sapiens
cagtaacgcgtcttcctg

SEQ ID NO: 913997 - DNA, 18 bp, Homo sapiens
cagtaactgttttttaag

SEQ ID NO: 913998 - DNA, 19 bp, Homo sapiens
cagtaactttatgtgtaaa

SEQ ID NO: 913999 - DNA, 20 bp, Homo sapiens
cagtaactttatgtgtaaat

SEQ ID NO: 914000 - DNA, 17 bp, Homo sapiens
cagtaagtaaagtggtt

SEQ ID NO: 914001 - DNA, 15 bp, Homo sapiens
cagtaagttatcttt

SEQ ID NO: 914002 - DNA, 21 bp, Homo sapiens
cagtaataaatgaatgtcact

SEQ ID NO: 914003 - DNA, 20 bp, Homo sapiens
cagtaatatttatatattta

SEQ ID NO: 914004 - DNA, 21 bp, Homo sapiens
cagtaatcagagttaccatta

SEQ ID NO: 914005 - DNA, 20 bp, Homo sapiens
cagtaatctaggtgtggctg

SEQ ID NO: 914006 - DNA, 20 bp, Homo sapiens
cagtaatctatgtgtttctg

SEQ ID NO: 914007 - DNA, 14 bp, Homo sapiens
cagtaatctttata

SEQ ID NO: 914008 - DNA, 15 bp, Homo sapiens
cagtaatgaaatgtt

SEQ ID NO: 914009 - DNA, 14 bp, Homo sapiens
cagtaatttagaaa

SEQ ID NO: 914010 - DNA, 12 bp, Homo sapiens
cagtaatttata

SEQ ID NO: 914011 - DNA, 17 bp, Homo sapiens
cagtaatttgaggacaa

SEQ ID NO: 914012 - DNA, 21 bp, Homo sapiens
cagtacagagaaattctgtgg

SEQ ID NO: 914013 - DNA, 22 bp, Homo sapiens
cagtacagagaaattctgtggt

SEQ ID NO: 914014 - DNA, 23 bp, Homo sapiens
cagtaccatttaatggggaggac

SEQ ID NO: 914015 - DNA, 22 bp, Homo sapiens
cagtacccctggtaaaccaagc

SEQ ID NO: 914016 - DNA, 16 bp, Homo sapiens
cagtaccctccattgg

SEQ ID NO: 914017 - DNA, 15 bp, Homo sapiens
cagtaccctctcagc

SEQ ID NO: 914018 - DNA, 16 bp, Homo sapiens
cagtaccctctcagct

SEQ ID NO: 914019 - DNA, 20 bp, Homo sapiens
cagtaccctctcagctccag

SEQ ID NO: 914020 - DNA, 24 bp, Homo sapiens
cagtaccctctcagctccaggtgg

SEQ ID NO: 914021 - DNA, 13 bp, Homo sapiens
cagtacctccaag

SEQ ID NO: 914022 - DNA, 15 bp, Homo sapiens
cagtacctccaagca

SEQ ID NO: 914023 - DNA, 21 bp, Homo sapiens
cagtacctctgtatagaaatc

SEQ ID NO: 914024 - DNA, 13 bp, Homo sapiens
cagtacctgggaa

SEQ ID NO: 914025 - DNA, 21 bp, Homo sapiens
cagtacctgggaaaggaccca

SEQ ID NO: 914026 - DNA, 16 bp, Homo sapiens
cagtacctttgtcaca

SEQ ID NO: 914027 - DNA, 17 bp, Homo sapiens
cagtacctttgtcacaa

SEQ ID NO: 914028 - DNA, 12 bp, Homo sapiens
cagtactcactt

SEQ ID NO: 914029 - DNA, 19 bp, Homo sapiens
cagtactcactttttccaa

SEQ ID NO: 914030 - DNA, 16 bp, Homo sapiens
cagtactttgtgcatt

SEQ ID NO: 914031 - DNA, 15 bp, Homo sapiens
cagtacttttttaaa

SEQ ID NO: 914032 - DNA, 14 bp, Homo sapiens
cagtagaactccag

SEQ ID NO: 914033 - DNA, 12 bp, Homo sapiens
cagtagaactgt

SEQ ID NO: 914034 - DNA, 12 bp, Homo sapiens
cagtagaatttc

SEQ ID NO: 914035 - DNA, 14 bp, Homo sapiens
cagtagaattttag

SEQ ID NO: 914036 - DNA, 22 bp, Homo sapiens
aggctcctgttttgcacagcca

SEQ ID NO: 914037 - DNA, 14 bp, Homo sapiens
aggctcgattttgt

SEQ ID NO: 914038 - DNA, 19 bp, Homo sapiens
aggctcgattttgtatctg

SEQ ID NO: 914039 - DNA, 18 bp, Homo sapiens
aggctcgccttccctcct

SEQ ID NO: 914040 - DNA, 20 bp, Homo sapiens
aggctcgccttccctcctgc

SEQ ID NO: 914041 - DNA, 24 bp, Homo sapiens
aggctcgccttccctcctgctttg

SEQ ID NO: 914042 - DNA, 22 bp, Homo sapiens
aggctcggccgtgggccgggag

SEQ ID NO: 914043 - DNA, 16 bp, Homo sapiens
aggctcgtcagccacc

SEQ ID NO: 914044 - DNA, 18 bp, Homo sapiens
aggctcgtcagccacctg

SEQ ID NO: 914045 - DNA, 21 bp, Homo sapiens
aggctcgtcagccacctggga

SEQ ID NO: 914046 - DNA, 18 bp, Homo sapiens
aggctcgtggactgagtg

SEQ ID NO: 914047 - DNA, 21 bp, Homo sapiens
aggctctagagagagggagaa

SEQ ID NO: 914048 - DNA, 22 bp, Homo sapiens
aggctctcactaccgtggacca

SEQ ID NO: 914049 - DNA, 23 bp, Homo sapiens
aggctctctctttctagaggtgc

SEQ ID NO: 914050 - DNA, 18 bp, Homo sapiens
aggctctctgtaggcaca

SEQ ID NO: 914051 - DNA, 18 bp, Homo sapiens
aggctctgaaagccagct

SEQ ID NO: 914052 - DNA, 18 bp, Homo sapiens
aggctctgaaataaaatg

SEQ ID NO: 914053 - DNA, 17 bp, Homo sapiens
aggctctgagacacacc

SEQ ID NO: 914054 - DNA, 15 bp, Homo sapiens
aggctctgcacagat

SEQ ID NO: 914055 - DNA, 18 bp, Homo sapiens
aggctctgcgcctgcccc

SEQ ID NO: 914056 - DNA, 15 bp, Homo sapiens
aggctctggacagca

SEQ ID NO: 914057 - DNA, 16 bp, Homo sapiens
aggctctggagccaga

SEQ ID NO: 914058 - DNA, 16 bp, Homo sapiens
aggctctgggcacagt

SEQ ID NO: 914059 - DNA, 23 bp, Homo sapiens
aggctctgggcacagtgctgccc

SEQ ID NO: 914060 - DNA, 12 bp, Homo sapiens
aggctctgggct

SEQ ID NO: 914061 - DNA, 18 bp, Homo sapiens
aggctctgggctcagggc

SEQ ID NO: 914062 - DNA, 14 bp, Homo sapiens
aggctctgttcctc

SEQ ID NO: 914063 - DNA, 17 bp, Homo sapiens
aggctcttcctggacct

SEQ ID NO: 914064 - DNA, 15 bp, Homo sapiens
aggctctttctgggc

SEQ ID NO: 914065 - DNA, 17 bp, Homo sapiens
aggctgaaagaggccaa

SEQ ID NO: 914066 - DNA, 22 bp, Homo sapiens
aggctgaaatatccacccagca

SEQ ID NO: 914067 - DNA, 23 bp, Homo sapiens
aggctgaaatatccacccagcag

SEQ ID NO: 914068 - DNA, 19 bp, Homo sapiens
aggctgaagagagggacag

SEQ ID NO: 914069 - DNA, 17 bp, Homo sapiens
aggctgaattacagtga

SEQ ID NO: 914070 - DNA, 15 bp, Homo sapiens
aggctgacacagcca

SEQ ID NO: 914071 - DNA, 22 bp, Homo sapiens
aggctgaccaagagagaaagaa

SEQ ID NO: 914072 - DNA, 14 bp, Homo sapiens
aggctgaccacagc

SEQ ID NO: 914073 - DNA, 17 bp, Homo sapiens
aggctgaccacagcaca

SEQ ID NO: 914074 - DNA, 18 bp, Homo sapiens
aggctgaccacagcacag

SEQ ID NO: 914075 - DNA, 15 bp, Homo sapiens
aggctgacttctctg

SEQ ID NO: 914076 - DNA, 22 bp, Homo sapiens
aggctgacttctctgaatcaga

SEQ ID NO: 914077 - DNA, 18 bp, Homo sapiens
aggctgagacagtgaatt

SEQ ID NO: 914078 - DNA, 18 bp, Homo sapiens
aggctgagccctgtaccc

SEQ ID NO: 914079 - DNA, 23 bp, Homo sapiens
aggctgagccctgtacccacccc

SEQ ID NO: 914080 - DNA, 15 bp, Homo sapiens
aggctgaggcagaag

SEQ ID NO: 914081 - DNA, 17 bp, Homo sapiens
aggctgaggcagaagaa

SEQ ID NO: 914082 - DNA, 17 bp, Homo sapiens
aggctgaggcaggagga

SEQ ID NO: 914083 - DNA, 15 bp, Homo sapiens
aggctgaggcctgga

SEQ ID NO: 914084 - DNA, 16 bp, Homo sapiens
aggctgaggctggcac

SEQ ID NO: 914085 - DNA, 15 bp, Homo sapiens
aggctgaggtgggga

SEQ ID NO: 914086 - DNA, 18 bp, Homo sapiens
aggctgaggtggggaagg

SEQ ID NO: 914087 - DNA, 17 bp, Homo sapiens
aggctgagtccagagct

SEQ ID NO: 914088 - DNA, 21 bp, Homo sapiens
aggctgatgtcaatttctgtg

SEQ ID NO: 914089 - DNA, 15 bp, Homo sapiens
aggctgatttctagg

SEQ ID NO: 914090 - DNA, 20 bp, Homo sapiens
aggctgcaaaattaaatcta

SEQ ID NO: 914091 - DNA, 21 bp, Homo sapiens
aggctgcaaggtttaggctgg

SEQ ID NO: 914092 - DNA, 16 bp, Homo sapiens
aggctgcactgcagtg

SEQ ID NO: 914093 - DNA, 21 bp, Homo sapiens
aggctgcactgcagtgatggc

SEQ ID NO: 914094 - DNA, 18 bp, Homo sapiens
aggctgcagaaggccaag

SEQ ID NO: 914095 - DNA, 16 bp, Homo sapiens
aggctgcagagcccgg

SEQ ID NO: 914096 - DNA, 18 bp, Homo sapiens
aggctgcagaggcacctc

SEQ ID NO: 914097 - DNA, 19 bp, Homo sapiens
aggctgcagaggcacctca

SEQ ID NO: 914098 - DNA, 19 bp, Homo sapiens
aggctgcagcaggtgctgg

SEQ ID NO: 914099 - DNA, 21 bp, Homo sapiens
aggctgcagcaggtgctgggc

SEQ ID NO: 914100 - DNA, 15 bp, Homo sapiens
aggctgcagcgagct

SEQ ID NO: 914101 - DNA, 19 bp, Homo sapiens
aggctgcagctggacagag

SEQ ID NO: 914102 - DNA, 20 bp, Homo sapiens
aggctgcagctggacagagg

SEQ ID NO: 914103 - DNA, 21 bp, Homo sapiens
aggctgcagctggacagaggg

SEQ ID NO: 914104 - DNA, 15 bp, Homo sapiens
aggctgccccaggcc

SEQ ID NO: 914105 - DNA, 22 bp, Homo sapiens
aggctgccccaggccggagccc

SEQ ID NO: 914106 - DNA, 17 bp, Homo sapiens
aggctgcccccatccag

SEQ ID NO: 914107 - DNA, 17 bp, Homo sapiens
aggctgcccctctcacc

SEQ ID NO: 914108 - DNA, 15 bp, Homo sapiens
aggctgccctgaggg

SEQ ID NO: 914109 - DNA, 16 bp, Homo sapiens
aggctgccctgagggg

SEQ ID NO: 914110 - DNA, 23 bp, Homo sapiens
aggctgccctgaggggctgggga

SEQ ID NO: 914111 - DNA, 12 bp, Homo sapiens
aggctgcctcag

SEQ ID NO: 914112 - DNA, 15 bp, Homo sapiens
aggctgcctcagcca

SEQ ID NO: 914113 - DNA, 22 bp, Homo sapiens
aggctgcctcagccagtggcac

SEQ ID NO: 914114 - DNA, 19 bp, Homo sapiens
aggctgcgtccctccgagc

SEQ ID NO: 914115 - DNA, 15 bp, Homo sapiens
aggctgctaacctgg

SEQ ID NO: 914116 - DNA, 13 bp, Homo sapiens
aggctgctgccgg

SEQ ID NO: 914117 - DNA, 15 bp, Homo sapiens
aggctgctggcttca

SEQ ID NO: 914118 - DNA, 21 bp, Homo sapiens
aggctgctggcttcagggagg

SEQ ID NO: 914119 - DNA, 22 bp, Homo sapiens
aggctgcttcccagaggagcag

SEQ ID NO: 914120 - DNA, 14 bp, Homo sapiens
aggctggagaagct

SEQ ID NO: 914121 - DNA, 12 bp, Homo sapiens
aggctggagacc

SEQ ID NO: 914122 - DNA, 13 bp, Homo sapiens
aggctggaggcag

SEQ ID NO: 914123 - DNA, 16 bp, Homo sapiens
aggctggaggcagggc

SEQ ID NO: 914124 - DNA, 13 bp, Homo sapiens
aggctggagtgca

SEQ ID NO: 914125 - DNA, 20 bp, Homo sapiens
aggctggagtggagtggcgt

SEQ ID NO: 914126 - DNA, 22 bp, Homo sapiens
aggctggatcctagccttatcc

SEQ ID NO: 914127 - DNA, 21 bp, Homo sapiens
aggctggcaaaccctcccaga

SEQ ID NO: 914128 - DNA, 15 bp, Homo sapiens
aggctggcaccatgg

SEQ ID NO: 914129 - DNA, 16 bp, Homo sapiens
aggctggcagctctcc

SEQ ID NO: 914130 - DNA, 17 bp, Homo sapiens
aggctggcagctctcca

SEQ ID NO: 914131 - DNA, 18 bp, Homo sapiens
aggctggcagctctccag

SEQ ID NO: 914132 - DNA, 18 bp, Homo sapiens
aggctggccaaggtgtcc

SEQ ID NO: 914133 - DNA, 13 bp, Homo sapiens
aggctggccagca

SEQ ID NO: 914134 - DNA, 17 bp, Homo sapiens
aggctggccagtccagg

SEQ ID NO: 914135 - DNA, 17 bp, Homo sapiens
aggctggcgcagccaag

SEQ ID NO: 914136 - DNA, 11 bp, Homo sapiens
aggctggctga

SEQ ID NO: 914137 - DNA, 13 bp, Homo sapiens
aggctggctggcc

SEQ ID NO: 914138 - DNA, 22 bp, Homo sapiens
aggctggctggcccgtcatgtt

SEQ ID NO: 914139 - DNA, 19 bp, Homo sapiens
aggctggctttcagagtag

SEQ ID NO: 914140 - DNA, 22 bp, Homo sapiens
aggctgggaatggaggggcaga

SEQ ID NO: 914141 - DNA, 16 bp, Homo sapiens
aggctgggcccctggg

SEQ ID NO: 914142 - DNA, 19 bp, Homo sapiens
aggctgggcctcccctggg

SEQ ID NO: 914143 - DNA, 22 bp, Homo sapiens
aggctgggcctcccctgggcag

SEQ ID NO: 914144 - DNA, 18 bp, Homo sapiens
aggctggggatggtagga

SEQ ID NO: 914145 - DNA, 13 bp, Homo sapiens
aggctggggcatg

SEQ ID NO: 914146 - DNA, 17 bp, Homo sapiens
aggctgggggaagaagc

SEQ ID NO: 914147 - DNA, 22 bp, Homo sapiens
aggctgggggaagaagctctct

SEQ ID NO: 914148 - DNA, 21 bp, Homo sapiens
aggctgggtcaaaagagccct

SEQ ID NO: 914149 - DNA, 22 bp, Homo sapiens
aggctgggtcaaaagagccctg

SEQ ID NO: 914150 - DNA, 23 bp, Homo sapiens
aggctgggtcaaaagagccctgg

SEQ ID NO: 914151 - DNA, 23 bp, Homo sapiens
aggctgggtgaccgactacccca

SEQ ID NO: 914152 - DNA, 23 bp, Homo sapiens
aggctggtctcaaactcctgacc

SEQ ID NO: 914153 - DNA, 15 bp, Homo sapiens
aggctggtctgaaac

SEQ ID NO: 914154 - DNA, 13 bp, Homo sapiens
aggctggtcttga

SEQ ID NO: 914155 - DNA, 22 bp, Homo sapiens
aggctggtgctgtggccagggt

SEQ ID NO: 914156 - DNA, 22 bp, Homo sapiens
aggctggtggttttcagagcag

SEQ ID NO: 914157 - DNA, 23 bp, Homo sapiens
aggctggtggttttcagagcagg

SEQ ID NO: 914158 - DNA, 20 bp, Homo sapiens
aggctgtaactgagagaaag

SEQ ID NO: 914159 - DNA, 16 bp, Homo sapiens
cagtagagccagcttg

SEQ ID NO: 914160 - DNA, 15 bp, Homo sapiens
cagtagagtcatctc

SEQ ID NO: 914161 - DNA, 12 bp, Homo sapiens
cagtagagttag

SEQ ID NO: 914162 - DNA, 16 bp, Homo sapiens
cagtagagttagctga

SEQ ID NO: 914163 - DNA, 18 bp, Homo sapiens
cagtagattttccaaatg

SEQ ID NO: 914164 - DNA, 20 bp, Homo sapiens
cagtagccaagttatattga

SEQ ID NO: 914165 - DNA, 22 bp, Homo sapiens
cagtagcccctaatcacatgtg

SEQ ID NO: 914166 - DNA, 15 bp, Homo sapiens
cagtagctccaacac

SEQ ID NO: 914167 - DNA, 14 bp, Homo sapiens
cagtagctcctgga

SEQ ID NO: 914168 - DNA, 13 bp, Homo sapiens
cagtagctgctac

SEQ ID NO: 914169 - DNA, 22 bp, Homo sapiens
cagtagctgctacctaaaaaaa

SEQ ID NO: 914170 - DNA, 17 bp, Homo sapiens
cagtaggaacaagctgg

SEQ ID NO: 914171 - DNA, 18 bp, Homo sapiens
cagtaggaacaagctggc

SEQ ID NO: 914172 - DNA, 22 bp, Homo sapiens
cagtaggatttatgtattttga

SEQ ID NO: 914173 - DNA, 23 bp, Homo sapiens
cagtaggatttatgtattttgaa

SEQ ID NO: 914174 - DNA, 22 bp, Homo sapiens
cagtaggggcttataataaagg

SEQ ID NO: 914175 - DNA, 18 bp, Homo sapiens
cagtaggtccaagggcca

SEQ ID NO: 914176 - DNA, 19 bp, Homo sapiens
cagtaggtccaagggccat

SEQ ID NO: 914177 - DNA, 22 bp, Homo sapiens
cagtaggtgcccagaataagtt

SEQ ID NO: 914178 - DNA, 21 bp, Homo sapiens
cagtagtcacaaactgatcta

SEQ ID NO: 914179 - DNA, 15 bp, Homo sapiens
cagtagtcagaagca

SEQ ID NO: 914180 - DNA, 17 bp, Homo sapiens
cagtagtctctgtgctt

SEQ ID NO: 914181 - DNA, 23 bp, Homo sapiens
cagtagtctctgtgctttgactc

SEQ ID NO: 914182 - DNA, 19 bp, Homo sapiens
cagtagtttctcagggtca

SEQ ID NO: 914183 - DNA, 23 bp, Homo sapiens
cagtagtttctcagggtcactgt

SEQ ID NO: 914184 - DNA, 15 bp, Homo sapiens
cagtagttttcaaaa

SEQ ID NO: 914185 - DNA, 14 bp, Homo sapiens
cagtataaaagaca

SEQ ID NO: 914186 - DNA, 19 bp, Homo sapiens
cagtataagatttttgaaa

SEQ ID NO: 914187 - DNA, 17 bp, Homo sapiens
cagtatactgtgtggga

SEQ ID NO: 914188 - DNA, 12 bp, Homo sapiens
cagtatagaata

SEQ ID NO: 914189 - DNA, 22 bp, Homo sapiens
cagtatagaataggcactttaa

SEQ ID NO: 914190 - DNA, 18 bp, Homo sapiens
cagtatagcattgaacat

SEQ ID NO: 914191 - DNA, 18 bp, Homo sapiens
cagtatataataacttta

SEQ ID NO: 914192 - DNA, 19 bp, Homo sapiens
cagtatataataactttat

SEQ ID NO: 914193 - DNA, 22 bp, Homo sapiens
cagtatataataactttattgc

SEQ ID NO: 914194 - DNA, 14 bp, Homo sapiens
cagtatattagtat

SEQ ID NO: 914195 - DNA, 16 bp, Homo sapiens
cagtatattagtatta

SEQ ID NO: 914196 - DNA, 13 bp, Homo sapiens
cagtatatttata

SEQ ID NO: 914197 - DNA, 22 bp, Homo sapiens
cagtatatttatagtcacaaga

SEQ ID NO: 914198 - DNA, 18 bp, Homo sapiens
cagtatatttgaaactgt

SEQ ID NO: 914199 - DNA, 14 bp, Homo sapiens
cagtatattttatt

SEQ ID NO: 914200 - DNA, 17 bp, Homo sapiens
cagtatattttatttca

SEQ ID NO: 914201 - DNA, 19 bp, Homo sapiens
cagtatcatgccctgtgca

SEQ ID NO: 914202 - DNA, 24 bp, Homo sapiens
cagtatccatgctcttgaccttgt

SEQ ID NO: 914203 - DNA, 13 bp, Homo sapiens
cagtatcccacat

SEQ ID NO: 914204 - DNA, 16 bp, Homo sapiens
cagtatcccacatcca

SEQ ID NO: 914205 - DNA, 16 bp, Homo sapiens
cagtatctatatatgt

SEQ ID NO: 914206 - DNA, 18 bp, Homo sapiens
cagtatctatatatgtgt

SEQ ID NO: 914207 - DNA, 13 bp, Homo sapiens
cagtatctcttac

SEQ ID NO: 914208 - DNA, 18 bp, Homo sapiens
cagtatcttagagtttac

SEQ ID NO: 914209 - DNA, 19 bp, Homo sapiens
cagtatcttagagtttaca

SEQ ID NO: 914210 - DNA, 21 bp, Homo sapiens
cagtatcttagagtttacagt

SEQ ID NO: 914211 - DNA, 21 bp, Homo sapiens
cagtatgaaaatcagcatgcc

SEQ ID NO: 914212 - DNA, 13 bp, Homo sapiens
cagtatgaactat

SEQ ID NO: 914213 - DNA, 20 bp, Homo sapiens
cagtatgagtcaatgtgcag

SEQ ID NO: 914214 - DNA, 21 bp, Homo sapiens
cagtatgagtcaatgtgcagt

SEQ ID NO: 914215 - DNA, 23 bp, Homo sapiens
cagtatgagtcaatgtgcagtgt

SEQ ID NO: 914216 - DNA, 18 bp, Homo sapiens
cagtatgatgaaaataat

SEQ ID NO: 914217 - DNA, 20 bp, Homo sapiens
cagtatgatgaaaataattt

SEQ ID NO: 914218 - DNA, 15 bp, Homo sapiens
cagtatgatttataa

SEQ ID NO: 914219 - DNA, 18 bp, Homo sapiens
cagtatgctttccctgag

SEQ ID NO: 914220 - DNA, 18 bp, Homo sapiens
cagtatgggggttgtaaa

SEQ ID NO: 914221 - DNA, 19 bp, Homo sapiens
cagtatgggggttgtaaat

SEQ ID NO: 914222 - DNA, 21 bp, Homo sapiens
cagtatgggggttgtaaattg

SEQ ID NO: 914223 - DNA, 21 bp, Homo sapiens
cagtatggtctaacactggca

SEQ ID NO: 914224 - DNA, 18 bp, Homo sapiens
cagtatgttgtcaaagag

SEQ ID NO: 914225 - DNA, 19 bp, Homo sapiens
cagtattactgctgctgtg

SEQ ID NO: 914226 - DNA, 19 bp, Homo sapiens
cagtattatctaaatgaat

SEQ ID NO: 914227 - DNA, 20 bp, Homo sapiens
cagtattatctaaatgaatg

SEQ ID NO: 914228 - DNA, 21 bp, Homo sapiens
cagtattatctaaatgaatga

SEQ ID NO: 914229 - DNA, 19 bp, Homo sapiens
cagtattatgcatatataa

SEQ ID NO: 914230 - DNA, 18 bp, Homo sapiens
cagtattattgagctcta

SEQ ID NO: 914231 - DNA, 15 bp, Homo sapiens
cagtattctgacatg

SEQ ID NO: 914232 - DNA, 18 bp, Homo sapiens
cagtattctgacatgtaa

SEQ ID NO: 914233 - DNA, 19 bp, Homo sapiens
cagtattgaaaacttcaaa

SEQ ID NO: 914234 - DNA, 22 bp, Homo sapiens
cagtattgaaaacttcaaagct

SEQ ID NO: 914235 - DNA, 16 bp, Homo sapiens
cagtattgctgatttt

SEQ ID NO: 914236 - DNA, 17 bp, Homo sapiens
cagtattgctgatttta

SEQ ID NO: 914237 - DNA, 15 bp, Homo sapiens
cagtatttatgtaat

SEQ ID NO: 914238 - DNA, 12 bp, Homo sapiens
cagtatttcctt

SEQ ID NO: 914239 - DNA, 14 bp, Homo sapiens
cagtatttccttcc

SEQ ID NO: 914240 - DNA, 15 bp, Homo sapiens
cagtatttccttcca

SEQ ID NO: 914241 - DNA, 20 bp, Homo sapiens
cagtatttctcttttattct

SEQ ID NO: 914242 - DNA, 12 bp, Homo sapiens
cagtatttgtaa

SEQ ID NO: 914243 - DNA, 14 bp, Homo sapiens
cagtatttgtaatt

SEQ ID NO: 914244 - DNA, 18 bp, Homo sapiens
cagtatttgtaattaaaa

SEQ ID NO: 914245 - DNA, 23 bp, Homo sapiens
cagtatttgtaattaaaagcaaa

SEQ ID NO: 914246 - DNA, 22 bp, Homo sapiens
cagtattttaaatgaagtgatt

SEQ ID NO: 914247 - DNA, 19 bp, Homo sapiens
cagtattttggagaaatta

SEQ ID NO: 914248 - DNA, 14 bp, Homo sapiens
cagtattttgtgtc

SEQ ID NO: 914249 - DNA, 18 bp, Homo sapiens
cagtattttgtgtcctcc

SEQ ID NO: 914250 - DNA, 14 bp, Homo sapiens
cagtatttttaaag

SEQ ID NO: 914251 - DNA, 18 bp, Homo sapiens
cagtatttttaaaggcat

SEQ ID NO: 914252 - DNA, 19 bp, Homo sapiens
cagtatttttaaaggcatt

SEQ ID NO: 914253 - DNA, 20 bp, Homo sapiens
cagtatttttgctgcttctg

SEQ ID NO: 914254 - DNA, 18 bp, Homo sapiens
cagtatttttttttaatt

SEQ ID NO: 914255 - DNA, 22 bp, Homo sapiens
cagtatttttttttaattttga

SEQ ID NO: 914256 - DNA, 15 bp, Homo sapiens
cagtcaaaacagaga

SEQ ID NO: 914257 - DNA, 19 bp, Homo sapiens
cagtcaaaacagagatgtg

SEQ ID NO: 914258 - DNA, 17 bp, Homo sapiens
cagtcaaatctgggctc

SEQ ID NO: 914259 - DNA, 14 bp, Homo sapiens
cagtcaacctgggc

SEQ ID NO: 914260 - DNA, 16 bp, Homo sapiens
cagtcaacctgggcaa

SEQ ID NO: 914261 - DNA, 16 bp, Homo sapiens
cagtcaagctgttgaa

SEQ ID NO: 914262 - DNA, 17 bp, Homo sapiens
cagtcaattctgatgtt

SEQ ID NO: 914263 - DNA, 23 bp, Homo sapiens
cagtcacacatcagctcaaaatt

SEQ ID NO: 914264 - DNA, 14 bp, Homo sapiens
cagtcacactcccc

SEQ ID NO: 914265 - DNA, 12 bp, Homo sapiens
cagtcacagcca

SEQ ID NO: 914266 - DNA, 14 bp, Homo sapiens
cagtcacagccacc

SEQ ID NO: 914267 - DNA, 12 bp, Homo sapiens
cagtcacattga

SEQ ID NO: 914268 - DNA, 14 bp, Homo sapiens
cagtcaccacccag

SEQ ID NO: 914269 - DNA, 21 bp, Homo sapiens
cagtcaccacccagcccttcc

SEQ ID NO: 914270 - DNA, 16 bp, Homo sapiens
cagtcacccccacttc

SEQ ID NO: 914271 - DNA, 21 bp, Homo sapiens
cagtcacccccacttcccact

SEQ ID NO: 914272 - DNA, 18 bp, Homo sapiens
cagtcacccctccctccc

SEQ ID NO: 914273 - DNA, 21 bp, Homo sapiens
cagtcacccctccctccctct

SEQ ID NO: 914274 - DNA, 15 bp, Homo sapiens
cagtcacccttctgg

SEQ ID NO: 914275 - DNA, 17 bp, Homo sapiens
cagtcacccttctgggc

SEQ ID NO: 914276 - DNA, 22 bp, Homo sapiens
cagtcacctcgtctccctggtg

SEQ ID NO: 914277 - DNA, 21 bp, Homo sapiens
cagtcactccctctgccttca

SEQ ID NO: 914278 - DNA, 13 bp, Homo sapiens
cagtcactcctct

SEQ ID NO: 914279 - DNA, 19 bp, Homo sapiens
cagtcactcctctctaggg

SEQ ID NO: 914280 - DNA, 17 bp, Homo sapiens
cagtcactgctgcaagg

SEQ ID NO: 914281 - DNA, 20 bp, Homo sapiens
cagtcactgctgcaaggtgg

SEQ ID NO: 914282 - DNA, 14 bp, Homo sapiens
cagtcactggaggt

SEQ ID NO: 914283 - DNA, 21 bp, Homo sapiens
aggccaccccctatcctctga

SEQ ID NO: 914284 - DNA, 23 bp, Homo sapiens
aggccaccccctatcctctgagt

SEQ ID NO: 914285 - DNA, 18 bp, Homo sapiens
aggccacccgggctgcct

SEQ ID NO: 914286 - DNA, 15 bp, Homo sapiens
aggccacctccccag

SEQ ID NO: 914287 - DNA, 19 bp, Homo sapiens
aggccacctctccaagggc

SEQ ID NO: 914288 - DNA, 13 bp, Homo sapiens
aggccacctgccc

SEQ ID NO: 914289 - DNA, 15 bp, Homo sapiens
aggccacctgccccc

SEQ ID NO: 914290 - DNA, 17 bp, Homo sapiens
aggccacctgccccctt

SEQ ID NO: 914291 - DNA, 18 bp, Homo sapiens
aggccaccttggaggagg

SEQ ID NO: 914292 - DNA, 19 bp, Homo sapiens
aggccaccttggaggagga

SEQ ID NO: 914293 - DNA, 19 bp, Homo sapiens
aggccacgtatagtcctag

SEQ ID NO: 914294 - DNA, 20 bp, Homo sapiens
aggccacgtatagtcctagc

SEQ ID NO: 914295 - DNA, 15 bp, Homo sapiens
aggccacgtcccacc

SEQ ID NO: 914296 - DNA, 16 bp, Homo sapiens
aggccacgtcccaccc

SEQ ID NO: 914297 - DNA, 18 bp, Homo sapiens
aggccacgtcccacccca

SEQ ID NO: 914298 - DNA, 22 bp, Homo sapiens
aggccacgtcccaccccacctc

SEQ ID NO: 914299 - DNA, 23 bp, Homo sapiens
aggccactcagaggcccccagtg

SEQ ID NO: 914300 - DNA, 19 bp, Homo sapiens
aggccactcctccaaagga

SEQ ID NO: 914301 - DNA, 19 bp, Homo sapiens
aggccactgtggccagagc

SEQ ID NO: 914302 - DNA, 21 bp, Homo sapiens
aggccactgtggccagagctg

SEQ ID NO: 914303 - DNA, 16 bp, Homo sapiens
aggccactgtgggtga

SEQ ID NO: 914304 - DNA, 20 bp, Homo sapiens
aggccactgtgggtgaagcg

SEQ ID NO: 914305 - DNA, 17 bp, Homo sapiens
aggccagaaggaggggg

SEQ ID NO: 914306 - DNA, 18 bp, Homo sapiens
aggccagaaggaggggga

SEQ ID NO: 914307 - DNA, 18 bp, Homo sapiens
aggccagaccatggacac

SEQ ID NO: 914308 - DNA, 15 bp, Homo sapiens
aggccagagccatgc

SEQ ID NO: 914309 - DNA, 18 bp, Homo sapiens
aggccagaggcccccagc

SEQ ID NO: 914310 - DNA, 22 bp, Homo sapiens
aggccagaggcccccagcccag

SEQ ID NO: 914311 - DNA, 20 bp, Homo sapiens
aggccagagtctcccagtgg

SEQ ID NO: 914312 - DNA, 19 bp, Homo sapiens
aggccagagtggcctggcc

SEQ ID NO: 914313 - DNA, 22 bp, Homo sapiens
aggccagagtggcctggccagg

SEQ ID NO: 914314 - DNA, 15 bp, Homo sapiens
aggccagatggcccc

SEQ ID NO: 914315 - DNA, 17 bp, Homo sapiens
aggccagcaacgcttgt

SEQ ID NO: 914316 - DNA, 13 bp, Homo sapiens
aggccagcccagc

SEQ ID NO: 914317 - DNA, 14 bp, Homo sapiens
aggccagcccagcc

SEQ ID NO: 914318 - DNA, 18 bp, Homo sapiens
aggccagcccagccaggc

SEQ ID NO: 914319 - DNA, 14 bp, Homo sapiens
aggccagccccacc

SEQ ID NO: 914320 - DNA, 23 bp, Homo sapiens
aggccagcccccccacccacccc

SEQ ID NO: 914321 - DNA, 14 bp, Homo sapiens
aggccagcctccga

SEQ ID NO: 914322 - DNA, 16 bp, Homo sapiens
aggccagcctgtccct

SEQ ID NO: 914323 - DNA, 17 bp, Homo sapiens
aggccagcggtgaccag

SEQ ID NO: 914324 - DNA, 24 bp, Homo sapiens
aggccagcggtgaccagcctgtca

SEQ ID NO: 914325 - DNA, 22 bp, Homo sapiens
aggccagcttcgtgctggagga

SEQ ID NO: 914326 - DNA, 17 bp, Homo sapiens
aggccaggacgtctggg

SEQ ID NO: 914327 - DNA, 21 bp, Homo sapiens
aggccaggagtttgagaccag

SEQ ID NO: 914328 - DNA, 18 bp, Homo sapiens
aggccaggccaccaggat

SEQ ID NO: 914329 - DNA, 20 bp, Homo sapiens
aggccaggcgcggtggctca

SEQ ID NO: 914330 - DNA, 16 bp, Homo sapiens
aggccaggctgcctcg

SEQ ID NO: 914331 - DNA, 13 bp, Homo sapiens
aggccagggcagc

SEQ ID NO: 914332 - DNA, 14 bp, Homo sapiens
aggccagggcagca

SEQ ID NO: 914333 - DNA, 15 bp, Homo sapiens
aggccagggcatgtg

SEQ ID NO: 914334 - DNA, 14 bp, Homo sapiens
aggccagggcctct

SEQ ID NO: 914335 - DNA, 23 bp, Homo sapiens
aggccagggctatagctcaggac

SEQ ID NO: 914336 - DNA, 9 bp, Homo sapiens
aggccaggt

SEQ ID NO: 914337 - DNA, 17 bp, Homo sapiens
aggccaggtgaggtcca

SEQ ID NO: 914338 - DNA, 23 bp, Homo sapiens
aggccaggtgggaacggctgatg

SEQ ID NO: 914339 - DNA, 14 bp, Homo sapiens
aggccagtccccat

SEQ ID NO: 914340 - DNA, 18 bp, Homo sapiens
aggccagtgggcctggta

SEQ ID NO: 914341 - DNA, 14 bp, Homo sapiens
aggccagtgtggtg

SEQ ID NO: 914342 - DNA, 16 bp, Homo sapiens
aggccataaaacaggt

SEQ ID NO: 914343 - DNA, 17 bp, Homo sapiens
aggccatcagggccctg

SEQ ID NO: 914344 - DNA, 19 bp, Homo sapiens
aggccatcagggccctgcc

SEQ ID NO: 914345 - DNA, 14 bp, Homo sapiens
aggccatctcagga

SEQ ID NO: 914346 - DNA, 16 bp, Homo sapiens
aggccatctcaggaga

SEQ ID NO: 914347 - DNA, 19 bp, Homo sapiens
aggccatctcaggagatgg

SEQ ID NO: 914348 - DNA, 13 bp, Homo sapiens
aggccatctgtaa

SEQ ID NO: 914349 - DNA, 14 bp, Homo sapiens
aggccatctgtaaa

SEQ ID NO: 914350 - DNA, 15 bp, Homo sapiens
aggccatctgtaaat

SEQ ID NO: 914351 - DNA, 21 bp, Homo sapiens
aggccatctgtaaatatccca

SEQ ID NO: 914352 - DNA, 23 bp, Homo sapiens
aggccatctgtaaatatcccaga

SEQ ID NO: 914353 - DNA, 18 bp, Homo sapiens
aggccatgggtggaaagt

SEQ ID NO: 914354 - DNA, 16 bp, Homo sapiens
aggccatgtgagccac

SEQ ID NO: 914355 - DNA, 22 bp, Homo sapiens
aggccatgtgagccaccgctgc

SEQ ID NO: 914356 - DNA, 16 bp, Homo sapiens
aggccatgtggcctgc

SEQ ID NO: 914357 - DNA, 23 bp, Homo sapiens
aggccatgtggcctgcccagcct

SEQ ID NO: 914358 - DNA, 15 bp, Homo sapiens
aggccattgggtttg

SEQ ID NO: 914359 - DNA, 22 bp, Homo sapiens
aggccattgggtttggggccat

SEQ ID NO: 914360 - DNA, 17 bp, Homo sapiens
aggccattgtgaaccaa

SEQ ID NO: 914361 - DNA, 12 bp, Homo sapiens
aggcccaagaga

SEQ ID NO: 914362 - DNA, 21 bp, Homo sapiens
aggcccaagagcagagtctgg

SEQ ID NO: 914363 - DNA, 13 bp, Homo sapiens
aggcccaaggagc

SEQ ID NO: 914364 - DNA, 22 bp, Homo sapiens
aggcccaaggagcttacccaag

SEQ ID NO: 914365 - DNA, 14 bp, Homo sapiens
aggcccaaggaggg

SEQ ID NO: 914366 - DNA, 15 bp, Homo sapiens
aggcccaaggctccc

SEQ ID NO: 914367 - DNA, 17 bp, Homo sapiens
aggcccaaggtcccctc

SEQ ID NO: 914368 - DNA, 19 bp, Homo sapiens
aggcccaaggtcccctcca

SEQ ID NO: 914369 - DNA, 20 bp, Homo sapiens
aggcccaaggtcccctccac

SEQ ID NO: 914370 - DNA, 10 bp, Homo sapiens
aggcccacca

SEQ ID NO: 914371 - DNA, 16 bp, Homo sapiens
aggcccacgaggagca

SEQ ID NO: 914372 - DNA, 18 bp, Homo sapiens
aggcccacgaggagcagc

SEQ ID NO: 914373 - DNA, 20 bp, Homo sapiens
aggcccacgcgcttccctgg

SEQ ID NO: 914374 - DNA, 20 bp, Homo sapiens
aggcccactagagggcccat

SEQ ID NO: 914375 - DNA, 16 bp, Homo sapiens
aggcccagagcgagga

SEQ ID NO: 914376 - DNA, 17 bp, Homo sapiens
aggcccagatccaaggc

SEQ ID NO: 914377 - DNA, 18 bp, Homo sapiens
aggcccagcattgctggt

SEQ ID NO: 914378 - DNA, 21 bp, Homo sapiens
aggcccagcattgctggttct

SEQ ID NO: 914379 - DNA, 17 bp, Homo sapiens
aggcccagcccctagaa

SEQ ID NO: 914380 - DNA, 14 bp, Homo sapiens
aggcccagcctgtc

SEQ ID NO: 914381 - DNA, 18 bp, Homo sapiens
aggcccagcctgtcctgg

SEQ ID NO: 914382 - DNA, 14 bp, Homo sapiens
aggcccaggcacca

SEQ ID NO: 914383 - DNA, 14 bp, Homo sapiens
aggcccaggccagc

SEQ ID NO: 914384 - DNA, 16 bp, Homo sapiens
aggcccaggccagccc

SEQ ID NO: 914385 - DNA, 13 bp, Homo sapiens
aggcccaggctgg

SEQ ID NO: 914386 - DNA, 13 bp, Homo sapiens
aggcccagggagg

SEQ ID NO: 914387 - DNA, 13 bp, Homo sapiens
aggcccatgcccc

SEQ ID NO: 914388 - DNA, 14 bp, Homo sapiens
aggcccatgccccc

SEQ ID NO: 914389 - DNA, 19 bp, Homo sapiens
aggcccatttgagaagctg

SEQ ID NO: 914390 - DNA, 18 bp, Homo sapiens
aggccccaaaaccacagc

SEQ ID NO: 914391 - DNA, 15 bp, Homo sapiens
aggccccaaccctgt

SEQ ID NO: 914392 - DNA, 19 bp, Homo sapiens
aggccccagagagaccctg

SEQ ID NO: 914393 - DNA, 13 bp, Homo sapiens
aggccccagcctc

SEQ ID NO: 914394 - DNA, 18 bp, Homo sapiens
aggccccagcctccaggc

SEQ ID NO: 914395 - DNA, 21 bp, Homo sapiens
aggccccagggacagaggcca

SEQ ID NO: 914396 - DNA, 21 bp, Homo sapiens
aggcccccaaacatagcccct

SEQ ID NO: 914397 - DNA, 22 bp, Homo sapiens
aggcccccaaacatagcccctg

SEQ ID NO: 914398 - DNA, 13 bp, Homo sapiens
aggcccccacttg

SEQ ID NO: 914399 - DNA, 22 bp, Homo sapiens
aggcccccagcccagggctcct

SEQ ID NO: 914400 - DNA, 19 bp, Homo sapiens
aggcccccgtcagggagag

SEQ ID NO: 914401 - DNA, 23 bp, Homo sapiens
aggccccctaggattccccctgc

SEQ ID NO: 914402 - DNA, 13 bp, Homo sapiens
aggccccctgcat

SEQ ID NO: 914403 - DNA, 21 bp, Homo sapiens
aggccccgcttgtccagcgcc

SEQ ID NO: 914404 - DNA, 17 bp, Homo sapiens
aggccccggtatgtgat

SEQ ID NO: 914405 - DNA, 16 bp, Homo sapiens
aggcccctggagttgt

SEQ ID NO: 914406 - DNA, 12 bp, Homo sapiens
aggcccctggcc

SEQ ID NO: 914407 - DNA, 14 bp, Homo sapiens
aggcccctggccca

SEQ ID NO: 914408 - DNA, 23 bp, Homo sapiens
agctgggcctgtgcactgggcag

SEQ ID NO: 914409 - DNA, 20 bp, Homo sapiens
agctgggcttggcctggaga

SEQ ID NO: 914410 - DNA, 15 bp, Homo sapiens
agctggggccagagg

SEQ ID NO: 914411 - DNA, 20 bp, Homo sapiens
agctggggccagaggctggg

SEQ ID NO: 914412 - DNA, 21 bp, Homo sapiens
agctggggccagaggctggga

SEQ ID NO: 914413 - DNA, 18 bp, Homo sapiens
agctggggcgtggggagg

SEQ ID NO: 914414 - DNA, 20 bp, Homo sapiens
agctggggcgtggggagggc

SEQ ID NO: 914415 - DNA, 17 bp, Homo sapiens
agctggggctgccagcc

SEQ ID NO: 914416 - DNA, 19 bp, Homo sapiens
agctggggcttatgggtgg

SEQ ID NO: 914417 - DNA, 15 bp, Homo sapiens
agctgggggaagggt

SEQ ID NO: 914418 - DNA, 18 bp, Homo sapiens
agctgggggaagggtggt

SEQ ID NO: 914419 - DNA, 16 bp, Homo sapiens
agctgggggccatgag

SEQ ID NO: 914420 - DNA, 18 bp, Homo sapiens
agctgggggccatgagct

SEQ ID NO: 914421 - DNA, 20 bp, Homo sapiens
agctgggggccatgagctcc

SEQ ID NO: 914422 - DNA, 19 bp, Homo sapiens
agctgggggtgggccaggc

SEQ ID NO: 914423 - DNA, 20 bp, Homo sapiens
agctgggggtgggccaggct

SEQ ID NO: 914424 - DNA, 22 bp, Homo sapiens
agctggggtaggctgtctgtgc

SEQ ID NO: 914425 - DNA, 17 bp, Homo sapiens
agctggggtctgggcag

SEQ ID NO: 914426 - DNA, 20 bp, Homo sapiens
agctggggtctgggcagtgc

SEQ ID NO: 914427 - DNA, 15 bp, Homo sapiens
agctgggtcaggcag

SEQ ID NO: 914428 - DNA, 13 bp, Homo sapiens
agctgggtggggc

SEQ ID NO: 914429 - DNA, 19 bp, Homo sapiens
agctgggttccgggaggca

SEQ ID NO: 914430 - DNA, 21 bp, Homo sapiens
agctggtcagtctttgctcag

SEQ ID NO: 914431 - DNA, 22 bp, Homo sapiens
agctggtcctccactttgctgg

SEQ ID NO: 914432 - DNA, 15 bp, Homo sapiens
agctggtctgccagg

SEQ ID NO: 914433 - DNA, 19 bp, Homo sapiens
agctggtgactttggggac

SEQ ID NO: 914434 - DNA, 21 bp, Homo sapiens
agctggtgactttggggacag

SEQ ID NO: 914435 - DNA, 12 bp, Homo sapiens
agctggtgcatt

SEQ ID NO: 914436 - DNA, 21 bp, Homo sapiens
agctggtgcattacagagagg

SEQ ID NO: 914437 - DNA, 22 bp, Homo sapiens
agctggtgcattacagagagga

SEQ ID NO: 914438 - DNA, 14 bp, Homo sapiens
agctggtgcccgga

SEQ ID NO: 914439 - DNA, 17 bp, Homo sapiens
agctggtggaacatatg

SEQ ID NO: 914440 - DNA, 12 bp, Homo sapiens
agctggtggccc

SEQ ID NO: 914441 - DNA, 20 bp, Homo sapiens
agctggtggccctgtgcctg

SEQ ID NO: 914442 - DNA, 18 bp, Homo sapiens
agctggtggcctctgcag

SEQ ID NO: 914443 - DNA, 22 bp, Homo sapiens
agctggtggtgcagccttcccc

SEQ ID NO: 914444 - DNA, 17 bp, Homo sapiens
agctggtggttgtgcct

SEQ ID NO: 914445 - DNA, 20 bp, Homo sapiens
agctggtggttgtgcctttt

SEQ ID NO: 914446 - DNA, 23 bp, Homo sapiens
agctggtggtttgatcatttctg

SEQ ID NO: 914447 - DNA, 22 bp, Homo sapiens
agctggtgtcagcccctcttcc

SEQ ID NO: 914448 - DNA, 20 bp, Homo sapiens
agctggtttaatgttttggc

SEQ ID NO: 914449 - DNA, 15 bp, Homo sapiens
agctggtttcctcat

SEQ ID NO: 914450 - DNA, 21 bp, Homo sapiens
agctggtttcctcattcctga

SEQ ID NO: 914451 - DNA, 16 bp, Homo sapiens
agctgtaaaaatgtta

SEQ ID NO: 914452 - DNA, 17 bp, Homo sapiens
agctgtaaaaatgttac

SEQ ID NO: 914453 - DNA, 17 bp, Homo sapiens
agctgtaaggcatgaag

SEQ ID NO: 914454 - DNA, 14 bp, Homo sapiens
agctgtaagggcag

SEQ ID NO: 914455 - DNA, 15 bp, Homo sapiens
agctgtaagggcagt

SEQ ID NO: 914456 - DNA, 22 bp, Homo sapiens
agctgtacaaatataagaataa

SEQ ID NO: 914457 - DNA, 16 bp, Homo sapiens
agctgtacccttgaga

SEQ ID NO: 914458 - DNA, 16 bp, Homo sapiens
agctgtacgaaaaaga

SEQ ID NO: 914459 - DNA, 23 bp, Homo sapiens
agctgtacgaaaaagagcatata

SEQ ID NO: 914460 - DNA, 18 bp, Homo sapiens
agctgtactagtgccatt

SEQ ID NO: 914461 - DNA, 13 bp, Homo sapiens
agctgtactataa

SEQ ID NO: 914462 - DNA, 19 bp, Homo sapiens
agctgtacttcgtcttcta

SEQ ID NO: 914463 - DNA, 19 bp, Homo sapiens
agctgtagaaatgtatcct

SEQ ID NO: 914464 - DNA, 14 bp, Homo sapiens
agctgtagccatgg

SEQ ID NO: 914465 - DNA, 21 bp, Homo sapiens
agctgtagccatggctcaggc

SEQ ID NO: 914466 - DNA, 23 bp, Homo sapiens
agctgtagtagccctttctgtgt

SEQ ID NO: 914467 - DNA, 22 bp, Homo sapiens
agctgtatcttgatgtttagaa

SEQ ID NO: 914468 - DNA, 15 bp, Homo sapiens
agctgtatgatttgt

SEQ ID NO: 914469 - DNA, 11 bp, Homo sapiens
agctgtattaa

SEQ ID NO: 914470 - DNA, 13 bp, Homo sapiens
agctgtattaagt

SEQ ID NO: 914471 - DNA, 16 bp, Homo sapiens
agctgtattgtctgaa

SEQ ID NO: 914472 - DNA, 20 bp, Homo sapiens
agctgtattttggctttctc

SEQ ID NO: 914473 - DNA, 23 bp, Homo sapiens
agctgtattttggctttctccct

SEQ ID NO: 914474 - DNA, 20 bp, Homo sapiens
agctgtcacctgctcacagg

SEQ ID NO: 914475 - DNA, 22 bp, Homo sapiens
agctgtcacctgctcacaggga

SEQ ID NO: 914476 - DNA, 15 bp, Homo sapiens
agctgtcccctctcc

SEQ ID NO: 914477 - DNA, 19 bp, Homo sapiens
agctgtcccctctccctgg

SEQ ID NO: 914478 - DNA, 14 bp, Homo sapiens
agctgtccctgtca

SEQ ID NO: 914479 - DNA, 15 bp, Homo sapiens
agctgtccctgtcac

SEQ ID NO: 914480 - DNA, 20 bp, Homo sapiens
agctgtccctgtcaccaagc

SEQ ID NO: 914481 - DNA, 12 bp, Homo sapiens
agctgtcctgaa

SEQ ID NO: 914482 - DNA, 15 bp, Homo sapiens
agctgtcctgcagca

SEQ ID NO: 914483 - DNA, 14 bp, Homo sapiens
agctgtctcttcgg

SEQ ID NO: 914484 - DNA, 18 bp, Homo sapiens
agctgtctcttcggcagg

SEQ ID NO: 914485 - DNA, 14 bp, Homo sapiens
agctgtctgccagg

SEQ ID NO: 914486 - DNA, 13 bp, Homo sapiens
agctgtctgctgc

SEQ ID NO: 914487 - DNA, 13 bp, Homo sapiens
agctgtctgtgaa

SEQ ID NO: 914488 - DNA, 13 bp, Homo sapiens
agctgtcttcccc

SEQ ID NO: 914489 - DNA, 17 bp, Homo sapiens
agctgtgacattgctgg

SEQ ID NO: 914490 - DNA, 21 bp, Homo sapiens
agctgtgacattgctggtcat

SEQ ID NO: 914491 - DNA, 17 bp, Homo sapiens
agctgtgccagcagggg

SEQ ID NO: 914492 - DNA, 17 bp, Homo sapiens
agctgtgccccctctgg

SEQ ID NO: 914493 - DNA, 18 bp, Homo sapiens
agctgtgcctgctcagca

SEQ ID NO: 914494 - DNA, 20 bp, Homo sapiens
agctgtgcctgctcagcagc

SEQ ID NO: 914495 - DNA, 17 bp, Homo sapiens
agctgtgctgtggagag

SEQ ID NO: 914496 - DNA, 18 bp, Homo sapiens
agctgtggcagagttaca

SEQ ID NO: 914497 - DNA, 13 bp, Homo sapiens
agctgtggcagcc

SEQ ID NO: 914498 - DNA, 20 bp, Homo sapiens
agctgtggcagccgtcccag

SEQ ID NO: 914499 - DNA, 15 bp, Homo sapiens
agctgtgtccttgca

SEQ ID NO: 914500 - DNA, 21 bp, Homo sapiens
agctgtgtctgccaaacacat

SEQ ID NO: 914501 - DNA, 22 bp, Homo sapiens
agctgtgtctgccaaacacatt

SEQ ID NO: 914502 - DNA, 13 bp, Homo sapiens
agctgtgtgaaat

SEQ ID NO: 914503 - DNA, 23 bp, Homo sapiens
agctgtgtgaaataccagtgtgg

SEQ ID NO: 914504 - DNA, 21 bp, Homo sapiens
agctgtgtgaatacctgctca

SEQ ID NO: 914505 - DNA, 11 bp, Homo sapiens
agctgtgttta

SEQ ID NO: 914506 - DNA, 14 bp, Homo sapiens
agctgttactgtct

SEQ ID NO: 914507 - DNA, 19 bp, Homo sapiens
agctgttactgtcttcagt

SEQ ID NO: 914508 - DNA, 17 bp, Homo sapiens
agctgttactttctttc

SEQ ID NO: 914509 - DNA, 17 bp, Homo sapiens
agctgttatttgcagtc

SEQ ID NO: 914510 - DNA, 13 bp, Homo sapiens
agctgttcagctg

SEQ ID NO: 914511 - DNA, 14 bp, Homo sapiens
agctgttcagctgg

SEQ ID NO: 914512 - DNA, 18 bp, Homo sapiens
agctgttcagttgccact

SEQ ID NO: 914513 - DNA, 19 bp, Homo sapiens
agctgttcttttttgtact

SEQ ID NO: 914514 - DNA, 14 bp, Homo sapiens
agctgttgagaaaa

SEQ ID NO: 914515 - DNA, 14 bp, Homo sapiens
agctgttgagctgt

SEQ ID NO: 914516 - DNA, 15 bp, Homo sapiens
agctgttgagctgtt

SEQ ID NO: 914517 - DNA, 17 bp, Homo sapiens
agctgttgagctgtttt

SEQ ID NO: 914518 - DNA, 14 bp, Homo sapiens
agctgttgtaaaga

SEQ ID NO: 914519 - DNA, 16 bp, Homo sapiens
agctgttgtaaagaat

SEQ ID NO: 914520 - DNA, 21 bp, Homo sapiens
agctgttgtgagctttgaagt

SEQ ID NO: 914521 - DNA, 12 bp, Homo sapiens
agctgtttaaga

SEQ ID NO: 914522 - DNA, 19 bp, Homo sapiens
agctgtttatggcctcagc

SEQ ID NO: 914523 - DNA, 20 bp, Homo sapiens
agctgtttatggcctcagct

SEQ ID NO: 914524 - DNA, 22 bp, Homo sapiens
agctgtttatttattcactgta

SEQ ID NO: 914525 - DNA, 22 bp, Homo sapiens
agctgtttctcatgaagctaat

SEQ ID NO: 914526 - DNA, 13 bp, Homo sapiens
agctgtttggaaa

SEQ ID NO: 914527 - DNA, 14 bp, Homo sapiens
agctgttttcaaag

SEQ ID NO: 914528 - DNA, 17 bp, Homo sapiens
agctgttttcaaagccc

SEQ ID NO: 914529 - DNA, 14 bp, Homo sapiens
agctgttttcttct

SEQ ID NO: 914530 - DNA, 15 bp, Homo sapiens
agctgttttgtgtat

SEQ ID NO: 914531 - DNA, 14 bp, Homo sapiens
agctgttttgttga

SEQ ID NO: 914532 - DNA, 23 bp, Homo sapiens
aggatattatctacctgttctgt

SEQ ID NO: 914533 - DNA, 20 bp, Homo sapiens
aggatattggttcttcccct

SEQ ID NO: 914534 - DNA, 21 bp, Homo sapiens
aggatattggttcttcccctc

SEQ ID NO: 914535 - DNA, 14 bp, Homo sapiens
aggatcactggagc

SEQ ID NO: 914536 - DNA, 15 bp, Homo sapiens
aggatcactggagcc

SEQ ID NO: 914537 - DNA, 18 bp, Homo sapiens
aggatcactggagcccag

SEQ ID NO: 914538 - DNA, 13 bp, Homo sapiens
aggatcagatgac

SEQ ID NO: 914539 - DNA, 20 bp, Homo sapiens
aggatcagatgactctctcc

SEQ ID NO: 914540 - DNA, 21 bp, Homo sapiens
aggatcagatgactctctcca

SEQ ID NO: 914541 - DNA, 18 bp, Homo sapiens
aggatcagggctcctagg

SEQ ID NO: 914542 - DNA, 22 bp, Homo sapiens
aggatcagttttttgttttaca

SEQ ID NO: 914543 - DNA, 21 bp, Homo sapiens
aggatcatttgttggaatgaa

SEQ ID NO: 914544 - DNA, 14 bp, Homo sapiens
aggatccagagagc

SEQ ID NO: 914545 - DNA, 21 bp, Homo sapiens
aggatccagagagcagctccc

SEQ ID NO: 914546 - DNA, 14 bp, Homo sapiens
aggatccagtgaca

SEQ ID NO: 914547 - DNA, 16 bp, Homo sapiens
aggatccccctctttg

SEQ ID NO: 914548 - DNA, 22 bp, Homo sapiens
aggatccccctctttgcacagc

SEQ ID NO: 914549 - DNA, 12 bp, Homo sapiens
aggatccgctgc

SEQ ID NO: 914550 - DNA, 15 bp, Homo sapiens
aggatccgctgccac

SEQ ID NO: 914551 - DNA, 16 bp, Homo sapiens
aggatccggaaagaag

SEQ ID NO: 914552 - DNA, 20 bp, Homo sapiens
aggatcctattctcaccagg

SEQ ID NO: 914553 - DNA, 13 bp, Homo sapiens
aggatcctctcca

SEQ ID NO: 914554 - DNA, 19 bp, Homo sapiens
aggatcctgagctgctgtt

SEQ ID NO: 914555 - DNA, 14 bp, Homo sapiens
aggatcctggaggc

SEQ ID NO: 914556 - DNA, 18 bp, Homo sapiens
aggatccttttcctaatt

SEQ ID NO: 914557 - DNA, 23 bp, Homo sapiens
aggatcgaagggtttttagagaa

SEQ ID NO: 914558 - DNA, 22 bp, Homo sapiens
aggatctagaatgtgttttctg

SEQ ID NO: 914559 - DNA, 19 bp, Homo sapiens
aggatctataggcagcttc

SEQ ID NO: 914560 - DNA, 23 bp, Homo sapiens
aggatctataggcagcttctaag

SEQ ID NO: 914561 - DNA, 21 bp, Homo sapiens
aggatctcctgtttttttcag

SEQ ID NO: 914562 - DNA, 14 bp, Homo sapiens
aggatctctaaaga

SEQ ID NO: 914563 - DNA, 22 bp, Homo sapiens
aggatctcttgagcctgggagg

SEQ ID NO: 914564 - DNA, 18 bp, Homo sapiens
aggatctgctgaggccca

SEQ ID NO: 914565 - DNA, 19 bp, Homo sapiens
aggatctgctgaggcccag

SEQ ID NO: 914566 - DNA, 22 bp, Homo sapiens
aggatctgctgaggcccagtgc

SEQ ID NO: 914567 - DNA, 20 bp, Homo sapiens
aggatcttattttgtgaact

SEQ ID NO: 914568 - DNA, 13 bp, Homo sapiens
aggatctttgtgg

SEQ ID NO: 914569 - DNA, 17 bp, Homo sapiens
aggatctttgtggccaa

SEQ ID NO: 914570 - DNA, 19 bp, Homo sapiens
aggatgaagaacacagcat

SEQ ID NO: 914571 - DNA, 12 bp, Homo sapiens
aggatgaatgta

SEQ ID NO: 914572 - DNA, 18 bp, Homo sapiens
aggatgaattctttcaat

SEQ ID NO: 914573 - DNA, 20 bp, Homo sapiens
aggatgacctggataactta

SEQ ID NO: 914574 - DNA, 19 bp, Homo sapiens
aggatgagaatgtgacctt

SEQ ID NO: 914575 - DNA, 15 bp, Homo sapiens
aggatgagctggaag

SEQ ID NO: 914576 - DNA, 23 bp, Homo sapiens
aggatgaggccgctagaggcctg

SEQ ID NO: 914577 - DNA, 14 bp, Homo sapiens
aggatgagggaagc

SEQ ID NO: 914578 - DNA, 23 bp, Homo sapiens
aggatgatgtctttttattaaaa

SEQ ID NO: 914579 - DNA, 15 bp, Homo sapiens
aggatgatttcagaa

SEQ ID NO: 914580 - DNA, 15 bp, Homo sapiens
aggatgcacatttct

SEQ ID NO: 914581 - DNA, 23 bp, Homo sapiens
aggatgcattctgataggagggg

SEQ ID NO: 914582 - DNA, 20 bp, Homo sapiens
aggatgcggctttctctgcc

SEQ ID NO: 914583 - DNA, 21 bp, Homo sapiens
aggatgcggctttctctgcct

SEQ ID NO: 914584 - DNA, 16 bp, Homo sapiens
aggatgctaacatcta

SEQ ID NO: 914585 - DNA, 14 bp, Homo sapiens
aggatgctgcagtg

SEQ ID NO: 914586 - DNA, 12 bp, Homo sapiens
aggatgctggcc

SEQ ID NO: 914587 - DNA, 18 bp, Homo sapiens
aggatgctgtgttgtcaa

SEQ ID NO: 914588 - DNA, 21 bp, Homo sapiens
aggatgcttgattccagtggt

SEQ ID NO: 914589 - DNA, 18 bp, Homo sapiens
aggatgcttgtacataat

SEQ ID NO: 914590 - DNA, 14 bp, Homo sapiens
aggatggagagagg

SEQ ID NO: 914591 - DNA, 15 bp, Homo sapiens
aggatggagagaggg

SEQ ID NO: 914592 - DNA, 14 bp, Homo sapiens
aggatggcctttcc

SEQ ID NO: 914593 - DNA, 21 bp, Homo sapiens
aggatggcctttccttccctc

SEQ ID NO: 914594 - DNA, 21 bp, Homo sapiens
aggatgggaatcaggcatgtg

SEQ ID NO: 914595 - DNA, 21 bp, Homo sapiens
aggatgggatgggttccagag

SEQ ID NO: 914596 - DNA, 21 bp, Homo sapiens
aggatgggccaaacccagaca

SEQ ID NO: 914597 - DNA, 16 bp, Homo sapiens
aggatgggctgagcta

SEQ ID NO: 914598 - DNA, 17 bp, Homo sapiens
aggatggggctcccagc

SEQ ID NO: 914599 - DNA, 18 bp, Homo sapiens
aggatggggctcccagct

SEQ ID NO: 914600 - DNA, 22 bp, Homo sapiens
aggatggggctcccagctcctt

SEQ ID NO: 914601 - DNA, 23 bp, Homo sapiens
aggatggttttgggactagaggc

SEQ ID NO: 914602 - DNA, 18 bp, Homo sapiens
aggatgtaaacagtgcct

SEQ ID NO: 914603 - DNA, 20 bp, Homo sapiens
aggatgtaaacagtgcctgc

SEQ ID NO: 914604 - DNA, 22 bp, Homo sapiens
aggatgtagttctgccaggcaa

SEQ ID NO: 914605 - DNA, 16 bp, Homo sapiens
aggatgtatattttat

SEQ ID NO: 914606 - DNA, 18 bp, Homo sapiens
aggatgtcacagggccaa

SEQ ID NO: 914607 - DNA, 20 bp, Homo sapiens
aggatgtccctgggccaggg

SEQ ID NO: 914608 - DNA, 21 bp, Homo sapiens
aggatgtgatatataagtgta

SEQ ID NO: 914609 - DNA, 16 bp, Homo sapiens
aggatgtggaagagca

SEQ ID NO: 914610 - DNA, 15 bp, Homo sapiens
aggatgtgtgcatgt

SEQ ID NO: 914611 - DNA, 19 bp, Homo sapiens
aggatgttacaagtttgct

SEQ ID NO: 914612 - DNA, 20 bp, Homo sapiens
aggatgttacaagtttgcta

SEQ ID NO: 914613 - DNA, 21 bp, Homo sapiens
aggatgttacaagtttgctaa

SEQ ID NO: 914614 - DNA, 20 bp, Homo sapiens
aggatgtttagcagtggctg

SEQ ID NO: 914615 - DNA, 14 bp, Homo sapiens
aggatgtttttcat

SEQ ID NO: 914616 - DNA, 15 bp, Homo sapiens
aggattatggaaaaa

SEQ ID NO: 914617 - DNA, 21 bp, Homo sapiens
aggattattactaattctatt

SEQ ID NO: 914618 - DNA, 19 bp, Homo sapiens
aggattatttagaatatgt

SEQ ID NO: 914619 - DNA, 14 bp, Homo sapiens
aggattccccctgc

SEQ ID NO: 914620 - DNA, 16 bp, Homo sapiens
aggattcccttctggg

SEQ ID NO: 914621 - DNA, 18 bp, Homo sapiens
aggattcccttctgggct

SEQ ID NO: 914622 - DNA, 17 bp, Homo sapiens
aggattctttccccaga

SEQ ID NO: 914623 - DNA, 21 bp, Homo sapiens
aggattctttccccagaggct

SEQ ID NO: 914624 - DNA, 24 bp, Homo sapiens
aggattgaaaatgtccaggaaagt

SEQ ID NO: 914625 - DNA, 13 bp, Homo sapiens
aggattgaagagc

SEQ ID NO: 914626 - DNA, 14 bp, Homo sapiens
aggattgctatctg

SEQ ID NO: 914627 - DNA, 18 bp, Homo sapiens
aggattgcttgagcccag

SEQ ID NO: 914628 - DNA, 21 bp, Homo sapiens
aggattgcttgagcccaggag

SEQ ID NO: 914629 - DNA, 12 bp, Homo sapiens
aggattgtggaa

SEQ ID NO: 914630 - DNA, 18 bp, Homo sapiens
aggatttaaaaactggaa

SEQ ID NO: 914631 - DNA, 13 bp, Homo sapiens
aggatttaaggag

SEQ ID NO: 914632 - DNA, 20 bp, Homo sapiens
aggatttaaggaggtgaagt

SEQ ID NO: 914633 - DNA, 17 bp, Homo sapiens
aggatttatttaaaata

SEQ ID NO: 914634 - DNA, 15 bp, Homo sapiens
aggatttcaagcctg

SEQ ID NO: 914635 - DNA, 16 bp, Homo sapiens
aggatttcaagcctgc

SEQ ID NO: 914636 - DNA, 18 bp, Homo sapiens
aggatttcaccagaagtt

SEQ ID NO: 914637 - DNA, 20 bp, Homo sapiens
aggatttcatgatttcattt

SEQ ID NO: 914638 - DNA, 15 bp, Homo sapiens
aggatttcctacccc

SEQ ID NO: 914639 - DNA, 19 bp, Homo sapiens
aggatttctttatgaggca

SEQ ID NO: 914640 - DNA, 14 bp, Homo sapiens
aggattttaaacat

SEQ ID NO: 914641 - DNA, 23 bp, Homo sapiens
aggattttaacttaactgaaatg

SEQ ID NO: 914642 - DNA, 13 bp, Homo sapiens
aggattttaccaa

SEQ ID NO: 914643 - DNA, 19 bp, Homo sapiens
aggattttaccaaagcatc

SEQ ID NO: 914644 - DNA, 13 bp, Homo sapiens
aggattttatacc

SEQ ID NO: 914645 - DNA, 18 bp, Homo sapiens
aggattttggcttaaaaa

SEQ ID NO: 914646 - DNA, 16 bp, Homo sapiens
aggattttgtgttttt

SEQ ID NO: 914647 - DNA, 17 bp, Homo sapiens
aggattttgtgtttttt

SEQ ID NO: 914648 - DNA, 13 bp, Homo sapiens
aggcaaaagactg

SEQ ID NO: 914649 - DNA, 17 bp, Homo sapiens
aggcaaaattgcaaatc

SEQ ID NO: 914650 - DNA, 19 bp, Homo sapiens
aggcaaaattgcaaatctt

SEQ ID NO: 914651 - DNA, 21 bp, Homo sapiens
aggcaaacaatcccaatcttt

SEQ ID NO: 914652 - DNA, 23 bp, Homo sapiens
aggcaaaggaggggaaacaatga

SEQ ID NO: 914653 - DNA, 17 bp, Homo sapiens
aggcaaaggcagaggaa

SEQ ID NO: 914654 - DNA, 13 bp, Homo sapiens
aggcaaagtacaa

SEQ ID NO: 914655 - DNA, 13 bp, Homo sapiens
cagggcctccagg

SEQ ID NO: 914656 - DNA, 23 bp, Homo sapiens
cagggcctcccgcatcaaggtca

SEQ ID NO: 914657 - DNA, 16 bp, Homo sapiens
cagggcctccctgttc

SEQ ID NO: 914658 - DNA, 12 bp, Homo sapiens
cagggcctcctg

SEQ ID NO: 914659 - DNA, 17 bp, Homo sapiens
cagggcctgaaacccgc

SEQ ID NO: 914660 - DNA, 18 bp, Homo sapiens
cagggcctgaaacccgcc

SEQ ID NO: 914661 - DNA, 23 bp, Homo sapiens
cagggcctgcatgggggcaccgg

SEQ ID NO: 914662 - DNA, 15 bp, Homo sapiens
cagggcctggagccc

SEQ ID NO: 914663 - DNA, 16 bp, Homo sapiens
cagggcctggagcccc

SEQ ID NO: 914664 - DNA, 18 bp, Homo sapiens
cagggcctggagccccat

SEQ ID NO: 914665 - DNA, 15 bp, Homo sapiens
cagggcctggggcct

SEQ ID NO: 914666 - DNA, 22 bp, Homo sapiens
cagggcctggggcctgagagaa

SEQ ID NO: 914667 - DNA, 13 bp, Homo sapiens
cagggcctggggg

SEQ ID NO: 914668 - DNA, 16 bp, Homo sapiens
cagggcctgggggcag

SEQ ID NO: 914669 - DNA, 12 bp, Homo sapiens
cagggcctgtct

SEQ ID NO: 914670 - DNA, 13 bp, Homo sapiens
cagggcctgtctc

SEQ ID NO: 914671 - DNA, 16 bp, Homo sapiens
cagggcctgtctccct

SEQ ID NO: 914672 - DNA, 13 bp, Homo sapiens
cagggccttgccc

SEQ ID NO: 914673 - DNA, 18 bp, Homo sapiens
cagggccttgcccagaga

SEQ ID NO: 914674 - DNA, 15 bp, Homo sapiens
cagggcctttctcct

SEQ ID NO: 914675 - DNA, 20 bp, Homo sapiens
cagggcgagactctgtctca

SEQ ID NO: 914676 - DNA, 16 bp, Homo sapiens
cagggcgcccctggga

SEQ ID NO: 914677 - DNA, 17 bp, Homo sapiens
cagggcggccagggacc

SEQ ID NO: 914678 - DNA, 13 bp, Homo sapiens
cagggcggctgcc

SEQ ID NO: 914679 - DNA, 22 bp, Homo sapiens
cagggcgggcagagggctggag

SEQ ID NO: 914680 - DNA, 17 bp, Homo sapiens
cagggctaaggccccca

SEQ ID NO: 914681 - DNA, 14 bp, Homo sapiens
cagggctagtataa

SEQ ID NO: 914682 - DNA, 17 bp, Homo sapiens
cagggctagtataaaca

SEQ ID NO: 914683 - DNA, 16 bp, Homo sapiens
cagggctcacactcct

SEQ ID NO: 914684 - DNA, 18 bp, Homo sapiens
cagggctcacactcctgg

SEQ ID NO: 914685 - DNA, 19 bp, Homo sapiens
cagggctcacactcctggg

SEQ ID NO: 914686 - DNA, 20 bp, Homo sapiens
cagggctcacactcctgggc

SEQ ID NO: 914687 - DNA, 13 bp, Homo sapiens
cagggctcacagg

SEQ ID NO: 914688 - DNA, 14 bp, Homo sapiens
cagggctcacaggg

SEQ ID NO: 914689 - DNA, 16 bp, Homo sapiens
cagggctcacagggca

SEQ ID NO: 914690 - DNA, 20 bp, Homo sapiens
cagggctcacagggcaggcc

SEQ ID NO: 914691 - DNA, 22 bp, Homo sapiens
cagggctcacagggcaggcctt

SEQ ID NO: 914692 - DNA, 17 bp, Homo sapiens
cagggctcaccagctgg

SEQ ID NO: 914693 - DNA, 19 bp, Homo sapiens
cagggctcagcctggtggg

SEQ ID NO: 914694 - DNA, 22 bp, Homo sapiens
cagggctccagcccctcttgga

SEQ ID NO: 914695 - DNA, 21 bp, Homo sapiens
cagggctcccaggggtctccc

SEQ ID NO: 914696 - DNA, 14 bp, Homo sapiens
cagggctcctaggc

SEQ ID NO: 914697 - DNA, 13 bp, Homo sapiens
cagggctcctccc

SEQ ID NO: 914698 - DNA, 14 bp, Homo sapiens
cagggctcctccca

SEQ ID NO: 914699 - DNA, 19 bp, Homo sapiens
cagggctcctcccagcttg

SEQ ID NO: 914700 - DNA, 12 bp, Homo sapiens
cagggctcctgc

SEQ ID NO: 914701 - DNA, 17 bp, Homo sapiens
cagggctctgcaggcca

SEQ ID NO: 914702 - DNA, 15 bp, Homo sapiens
cagggctctgcccca

SEQ ID NO: 914703 - DNA, 21 bp, Homo sapiens
cagggctgcaaaactggaagc

SEQ ID NO: 914704 - DNA, 23 bp, Homo sapiens
cagggctgcaaaactggaagcac

SEQ ID NO: 914705 - DNA, 14 bp, Homo sapiens
cagggctgctcccc

SEQ ID NO: 914706 - DNA, 23 bp, Homo sapiens
cagggctgctccccaacacctgc

SEQ ID NO: 914707 - DNA, 10 bp, Homo sapiens
cagggctgga

SEQ ID NO: 914708 - DNA, 12 bp, Homo sapiens
cagggctggaga

SEQ ID NO: 914709 - DNA, 12 bp, Homo sapiens
cagggctggagc

SEQ ID NO: 914710 - DNA, 18 bp, Homo sapiens
cagggctggagtgcgctc

SEQ ID NO: 914711 - DNA, 18 bp, Homo sapiens
cagggctggatggacaga

SEQ ID NO: 914712 - DNA, 13 bp, Homo sapiens
cagggctgggagg

SEQ ID NO: 914713 - DNA, 14 bp, Homo sapiens
cagggctgggagga

SEQ ID NO: 914714 - DNA, 19 bp, Homo sapiens
cagggctgggaggaaggac

SEQ ID NO: 914715 - DNA, 12 bp, Homo sapiens
cagggctgggga

SEQ ID NO: 914716 - DNA, 22 bp, Homo sapiens
cagggctggggtgagcctgact

SEQ ID NO: 914717 - DNA, 15 bp, Homo sapiens
cagggctggtcttgg

SEQ ID NO: 914718 - DNA, 12 bp, Homo sapiens
cagggctgtccc

SEQ ID NO: 914719 - DNA, 16 bp, Homo sapiens
cagggctgtccttaga

SEQ ID NO: 914720 - DNA, 19 bp, Homo sapiens
cagggctgtgcttgaaggc

SEQ ID NO: 914721 - DNA, 23 bp, Homo sapiens
cagggctgtgcttgaaggccctg

SEQ ID NO: 914722 - DNA, 23 bp, Homo sapiens
cagggcttccccatcagctccca

SEQ ID NO: 914723 - DNA, 18 bp, Homo sapiens
cagggcttgctcctgcca

SEQ ID NO: 914724 - DNA, 18 bp, Homo sapiens
cagggcttttcccaggaa

SEQ ID NO: 914725 - DNA, 17 bp, Homo sapiens
caggggaaaatcagcct

SEQ ID NO: 914726 - DNA, 19 bp, Homo sapiens
caggggaaaatcagcctgc

SEQ ID NO: 914727 - DNA, 14 bp, Homo sapiens
caggggaacctgcc

SEQ ID NO: 914728 - DNA, 19 bp, Homo sapiens
caggggaaggaaataacat

SEQ ID NO: 914729 - DNA, 16 bp, Homo sapiens
caggggaaggaaggag

SEQ ID NO: 914730 - DNA, 17 bp, Homo sapiens
caggggaaggccctgag

SEQ ID NO: 914731 - DNA, 19 bp, Homo sapiens
caggggaaggccctgaggc

SEQ ID NO: 914732 - DNA, 20 bp, Homo sapiens
caggggaattccctccccct

SEQ ID NO: 914733 - DNA, 17 bp, Homo sapiens
caggggacaagggaggc

SEQ ID NO: 914734 - DNA, 21 bp, Homo sapiens
caggggacaagggaggcagtg

SEQ ID NO: 914735 - DNA, 15 bp, Homo sapiens
caggggacactggcc

SEQ ID NO: 914736 - DNA, 16 bp, Homo sapiens
caggggacaggagtcc

SEQ ID NO: 914737 - DNA, 22 bp, Homo sapiens
caggggacaggagtccactttg

SEQ ID NO: 914738 - DNA, 15 bp, Homo sapiens
caggggaccacacct

SEQ ID NO: 914739 - DNA, 14 bp, Homo sapiens
caggggaccccact

SEQ ID NO: 914740 - DNA, 17 bp, Homo sapiens
caggggaccccactccc

SEQ ID NO: 914741 - DNA, 17 bp, Homo sapiens
caggggacgtgggccct

SEQ ID NO: 914742 - DNA, 22 bp, Homo sapiens
caggggacgtgggccctgcagg

SEQ ID NO: 914743 - DNA, 17 bp, Homo sapiens
caggggactcagccctg

SEQ ID NO: 914744 - DNA, 20 bp, Homo sapiens
caggggactcagccctgagg

SEQ ID NO: 914745 - DNA, 21 bp, Homo sapiens
caggggactcagccctgaggt

SEQ ID NO: 914746 - DNA, 22 bp, Homo sapiens
caggggagaagctgaagccccc

SEQ ID NO: 914747 - DNA, 23 bp, Homo sapiens
caggggagaagctgaagcccccc

SEQ ID NO: 914748 - DNA, 17 bp, Homo sapiens
caggggagaatgcagcc

SEQ ID NO: 914749 - DNA, 16 bp, Homo sapiens
caggggagacaggagc

SEQ ID NO: 914750 - DNA, 18 bp, Homo sapiens
caggggagatggggagga

SEQ ID NO: 914751 - DNA, 14 bp, Homo sapiens
caggggagccagct

SEQ ID NO: 914752 - DNA, 15 bp, Homo sapiens
caggggagccagctg

SEQ ID NO: 914753 - DNA, 17 bp, Homo sapiens
caggggagccagctgct

SEQ ID NO: 914754 - DNA, 14 bp, Homo sapiens
caggggagccaggg

SEQ ID NO: 914755 - DNA, 17 bp, Homo sapiens
caggggagccagggtag

SEQ ID NO: 914756 - DNA, 20 bp, Homo sapiens
caggggagcttgggactcag

SEQ ID NO: 914757 - DNA, 13 bp, Homo sapiens
caggggaggaaaa

SEQ ID NO: 914758 - DNA, 13 bp, Homo sapiens
caggggaggggtg

SEQ ID NO: 914759 - DNA, 20 bp, Homo sapiens
caggggatgcccagaagagt

SEQ ID NO: 914760 - DNA, 14 bp, Homo sapiens
caggggattgaagc

SEQ ID NO: 914761 - DNA, 23 bp, Homo sapiens
caggggcacctccggctgcctag

SEQ ID NO: 914762 - DNA, 13 bp, Homo sapiens
caggggcaccttc

SEQ ID NO: 914763 - DNA, 14 bp, Homo sapiens
caggggcaggcagg

SEQ ID NO: 914764 - DNA, 15 bp, Homo sapiens
caggggcaggcaggg

SEQ ID NO: 914765 - DNA, 15 bp, Homo sapiens
caggggcaggcgcag

SEQ ID NO: 914766 - DNA, 18 bp, Homo sapiens
caggggcaggcgcagagg

SEQ ID NO: 914767 - DNA, 18 bp, Homo sapiens
caggggcaggtggtggag

SEQ ID NO: 914768 - DNA, 21 bp, Homo sapiens
caggggcatgtattggcctgg

SEQ ID NO: 914769 - DNA, 19 bp, Homo sapiens
caggggccactccaaactc

SEQ ID NO: 914770 - DNA, 22 bp, Homo sapiens
caggggccagagagcaggggag

SEQ ID NO: 914771 - DNA, 18 bp, Homo sapiens
caggggccatgccccacc

SEQ ID NO: 914772 - DNA, 12 bp, Homo sapiens
caggggccccag

SEQ ID NO: 914773 - DNA, 24 bp, Homo sapiens
caggggccccagatctgcctgggc

SEQ ID NO: 914774 - DNA, 21 bp, Homo sapiens
caggggcctctctcctgcctg

SEQ ID NO: 914775 - DNA, 15 bp, Homo sapiens
caggggcctggagga

SEQ ID NO: 914776 - DNA, 13 bp, Homo sapiens
caggggcctgggc

SEQ ID NO: 914777 - DNA, 15 bp, Homo sapiens
caggggcggggcagg

SEQ ID NO: 914778 - DNA, 19 bp, Homo sapiens
caggggcggggcaggaatg

SEQ ID NO: 914779 - DNA, 11 bp, Homo sapiens
caggggctcca

SEQ ID NO: 914780 - DNA, 17 bp, Homo sapiens
aggcaaagtacaaaatt

SEQ ID NO: 914781 - DNA, 20 bp, Homo sapiens
aggcaaagtttacagatgtt

SEQ ID NO: 914782 - DNA, 19 bp, Homo sapiens
aggcaaagttttacagaga

SEQ ID NO: 914783 - DNA, 20 bp, Homo sapiens
aggcaaatattgaagttgtt

SEQ ID NO: 914784 - DNA, 21 bp, Homo sapiens
aggcaaatattgaagttgttt

SEQ ID NO: 914785 - DNA, 18 bp, Homo sapiens
aggcaacactgctgtcca

SEQ ID NO: 914786 - DNA, 13 bp, Homo sapiens
aggcaacattcct

SEQ ID NO: 914787 - DNA, 19 bp, Homo sapiens
aggcaacttttaaagctca

SEQ ID NO: 914788 - DNA, 14 bp, Homo sapiens
aggcaagagggagg

SEQ ID NO: 914789 - DNA, 15 bp, Homo sapiens
aggcaagagggaggg

SEQ ID NO: 914790 - DNA, 13 bp, Homo sapiens
aggcaagaggggt

SEQ ID NO: 914791 - DNA, 19 bp, Homo sapiens
aggcaagattggaaagaca

SEQ ID NO: 914792 - DNA, 22 bp, Homo sapiens
aggcaagattggaaagacagga

SEQ ID NO: 914793 - DNA, 15 bp, Homo sapiens
aggcaagcccctcag

SEQ ID NO: 914794 - DNA, 16 bp, Homo sapiens
aggcaagcccctcagc

SEQ ID NO: 914795 - DNA, 20 bp, Homo sapiens
aggcaagcccctcagccctt

SEQ ID NO: 914796 - DNA, 13 bp, Homo sapiens
aggcaagcccttc

SEQ ID NO: 914797 - DNA, 20 bp, Homo sapiens
aggcaaggctatgtgattac

SEQ ID NO: 914798 - DNA, 12 bp, Homo sapiens
aggcaaggggca

SEQ ID NO: 914799 - DNA, 20 bp, Homo sapiens
aggcaagtggtagggatgag

SEQ ID NO: 914800 - DNA, 22 bp, Homo sapiens
aggcaatgattgttaatttaca

SEQ ID NO: 914801 - DNA, 18 bp, Homo sapiens
aggcaatggtttgtgtca

SEQ ID NO: 914802 - DNA, 17 bp, Homo sapiens
aggcaatgtcaggaaca

SEQ ID NO: 914803 - DNA, 19 bp, Homo sapiens
aggcaatgtcaggaacaga

SEQ ID NO: 914804 - DNA, 22 bp, Homo sapiens
aggcaatgtcaggaacagaagg

SEQ ID NO: 914805 - DNA, 21 bp, Homo sapiens
aggcaattttaatcccctgca

SEQ ID NO: 914806 - DNA, 17 bp, Homo sapiens
aggcacacaaggggccc

SEQ ID NO: 914807 - DNA, 18 bp, Homo sapiens
aggcacacacagccccta

SEQ ID NO: 914808 - DNA, 19 bp, Homo sapiens
aggcacacagagattctgg

SEQ ID NO: 914809 - DNA, 14 bp, Homo sapiens
aggcacacagcagc

SEQ ID NO: 914810 - DNA, 20 bp, Homo sapiens
aggcacacagcagcccccca

SEQ ID NO: 914811 - DNA, 13 bp, Homo sapiens
aggcacacagcta

SEQ ID NO: 914812 - DNA, 15 bp, Homo sapiens
aggcacacagggccc

SEQ ID NO: 914813 - DNA, 20 bp, Homo sapiens
aggcacacttcttcttggtc

SEQ ID NO: 914814 - DNA, 12 bp, Homo sapiens
aggcacagagct

SEQ ID NO: 914815 - DNA, 14 bp, Homo sapiens
aggcacagtgggag

SEQ ID NO: 914816 - DNA, 13 bp, Homo sapiens
aggcacatggagg

SEQ ID NO: 914817 - DNA, 18 bp, Homo sapiens
aggcaccaaaagaagtaa

SEQ ID NO: 914818 - DNA, 13 bp, Homo sapiens
aggcaccaccagg

SEQ ID NO: 914819 - DNA, 14 bp, Homo sapiens
aggcaccaccagga

SEQ ID NO: 914820 - DNA, 15 bp, Homo sapiens
aggcaccaccaggag

SEQ ID NO: 914821 - DNA, 14 bp, Homo sapiens
aggcaccagctctg

SEQ ID NO: 914822 - DNA, 12 bp, Homo sapiens
aggcaccaggaa

SEQ ID NO: 914823 - DNA, 17 bp, Homo sapiens
aggcaccccctggagag

SEQ ID NO: 914824 - DNA, 15 bp, Homo sapiens
aggcaccctcaggga

SEQ ID NO: 914825 - DNA, 22 bp, Homo sapiens
aggcaccctcagggagcctccc

SEQ ID NO: 914826 - DNA, 16 bp, Homo sapiens
aggcaccgagaatgtt

SEQ ID NO: 914827 - DNA, 22 bp, Homo sapiens
aggcaccgccacgtcccagcat

SEQ ID NO: 914828 - DNA, 14 bp, Homo sapiens
aggcaccggcgctg

SEQ ID NO: 914829 - DNA, 15 bp, Homo sapiens
aggcaccggcgctgc

SEQ ID NO: 914830 - DNA, 17 bp, Homo sapiens
aggcaccggcgctgcag

SEQ ID NO: 914831 - DNA, 19 bp, Homo sapiens
aggcaccgggctggctgct

SEQ ID NO: 914832 - DNA, 21 bp, Homo sapiens
aggcacctacactcacctgca

SEQ ID NO: 914833 - DNA, 13 bp, Homo sapiens
aggcacctcttcc

SEQ ID NO: 914834 - DNA, 13 bp, Homo sapiens
aggcacctgctgg

SEQ ID NO: 914835 - DNA, 18 bp, Homo sapiens
aggcacctggcctgctgg

SEQ ID NO: 914836 - DNA, 20 bp, Homo sapiens
aggcaccttcttaaaagaaa

SEQ ID NO: 914837 - DNA, 14 bp, Homo sapiens
aggcacgaacccac

SEQ ID NO: 914838 - DNA, 21 bp, Homo sapiens
aggcacgaacccacctgctga

SEQ ID NO: 914839 - DNA, 14 bp, Homo sapiens
aggcacggccacgt

SEQ ID NO: 914840 - DNA, 22 bp, Homo sapiens
aggcactcagtgagcctcctgt

SEQ ID NO: 914841 - DNA, 23 bp, Homo sapiens
aggcactctcatcaccccagagg

SEQ ID NO: 914842 - DNA, 20 bp, Homo sapiens
aggcactctgttatttagac

SEQ ID NO: 914843 - DNA, 15 bp, Homo sapiens
aggcactgccttctc

SEQ ID NO: 914844 - DNA, 14 bp, Homo sapiens
aggcactgctgccc

SEQ ID NO: 914845 - DNA, 16 bp, Homo sapiens
aggcactgctgcccag

SEQ ID NO: 914846 - DNA, 22 bp, Homo sapiens
aggcactgctgcccagcctcca

SEQ ID NO: 914847 - DNA, 14 bp, Homo sapiens
aggcactgtggccc

SEQ ID NO: 914848 - DNA, 17 bp, Homo sapiens
aggcacttttattttca

SEQ ID NO: 914849 - DNA, 20 bp, Homo sapiens
aggcagaaacctatctcagg

SEQ ID NO: 914850 - DNA, 23 bp, Homo sapiens
aggcagaaacctatctcagggag

SEQ ID NO: 914851 - DNA, 14 bp, Homo sapiens
aggcagaaagcaaa

SEQ ID NO: 914852 - DNA, 16 bp, Homo sapiens
aggcagacaaccttgt

SEQ ID NO: 914853 - DNA, 21 bp, Homo sapiens
aggcagacaaccttgtcccaa

SEQ ID NO: 914854 - DNA, 17 bp, Homo sapiens
aggcagacaagagctgc

SEQ ID NO: 914855 - DNA, 20 bp, Homo sapiens
aggcagacaagagctgctgt

SEQ ID NO: 914856 - DNA, 11 bp, Homo sapiens
aggcagacaca

SEQ ID NO: 914857 - DNA, 15 bp, Homo sapiens
aggcagacacaggga

SEQ ID NO: 914858 - DNA, 18 bp, Homo sapiens
aggcagacacggatctga

SEQ ID NO: 914859 - DNA, 20 bp, Homo sapiens
aggcagacacggatctgaga

SEQ ID NO: 914860 - DNA, 13 bp, Homo sapiens
aggcagacagcag

SEQ ID NO: 914861 - DNA, 19 bp, Homo sapiens
aggcagacagcagctcagg

SEQ ID NO: 914862 - DNA, 13 bp, Homo sapiens
aggcagagaaaga

SEQ ID NO: 914863 - DNA, 17 bp, Homo sapiens
aggcagagaaagaagag

SEQ ID NO: 914864 - DNA, 22 bp, Homo sapiens
aggcagagaaagaagagacagg

SEQ ID NO: 914865 - DNA, 16 bp, Homo sapiens
aggcagagagtacaga

SEQ ID NO: 914866 - DNA, 21 bp, Homo sapiens
aggcagagagtacagactgca

SEQ ID NO: 914867 - DNA, 19 bp, Homo sapiens
aggcagagcgggagggagt

SEQ ID NO: 914868 - DNA, 20 bp, Homo sapiens
aggcagaggaatttggctgc

SEQ ID NO: 914869 - DNA, 23 bp, Homo sapiens
aggcagaggaatttggctgcttc

SEQ ID NO: 914870 - DNA, 17 bp, Homo sapiens
aggcagaggcctgggct

SEQ ID NO: 914871 - DNA, 13 bp, Homo sapiens
aggcagaggctgg

SEQ ID NO: 914872 - DNA, 20 bp, Homo sapiens
aggcagagtggcgtggcctc

SEQ ID NO: 914873 - DNA, 19 bp, Homo sapiens
aggcagagttctgtgaaga

SEQ ID NO: 914874 - DNA, 17 bp, Homo sapiens
aggcagataagaaggtg

SEQ ID NO: 914875 - DNA, 21 bp, Homo sapiens
aggcagatctgtgccccatgc

SEQ ID NO: 914876 - DNA, 22 bp, Homo sapiens
aggcagatctgtgccccatgcc

SEQ ID NO: 914877 - DNA, 17 bp, Homo sapiens
aggcagatggagcccat

SEQ ID NO: 914878 - DNA, 18 bp, Homo sapiens
aggcagatgtggggctga

SEQ ID NO: 914879 - DNA, 16 bp, Homo sapiens
aggcagattgaaaagg

SEQ ID NO: 914880 - DNA, 22 bp, Homo sapiens
aggcagattttacagagcgcac

SEQ ID NO: 914881 - DNA, 22 bp, Homo sapiens
aggcagcaccaccacacagtca

SEQ ID NO: 914882 - DNA, 20 bp, Homo sapiens
aggcagcagtgtgaggccag

SEQ ID NO: 914883 - DNA, 20 bp, Homo sapiens
aggcagccaccagtggacct

SEQ ID NO: 914884 - DNA, 12 bp, Homo sapiens
aggcagccagac

SEQ ID NO: 914885 - DNA, 22 bp, Homo sapiens
aggcagcccagcagtgtggaga

SEQ ID NO: 914886 - DNA, 12 bp, Homo sapiens
aggcagccccct

SEQ ID NO: 914887 - DNA, 15 bp, Homo sapiens
aggcagccctcacct

SEQ ID NO: 914888 - DNA, 11 bp, Homo sapiens
aggcagcctcc

SEQ ID NO: 914889 - DNA, 13 bp, Homo sapiens
aggcagcctccag

SEQ ID NO: 914890 - DNA, 16 bp, Homo sapiens
aggcagcctccagagc

SEQ ID NO: 914891 - DNA, 17 bp, Homo sapiens
aggcagcctccagagcc

SEQ ID NO: 914892 - DNA, 20 bp, Homo sapiens
aggcagcctccagagccagc

SEQ ID NO: 914893 - DNA, 17 bp, Homo sapiens
aggcagcctcctttgtg

SEQ ID NO: 914894 - DNA, 11 bp, Homo sapiens
aggcagcctgc

SEQ ID NO: 914895 - DNA, 16 bp, Homo sapiens
aggcagcctgcaggga

SEQ ID NO: 914896 - DNA, 20 bp, Homo sapiens
aggcagcctggacatagaga

SEQ ID NO: 914897 - DNA, 16 bp, Homo sapiens
aggcagcgcagggctg

SEQ ID NO: 914898 - DNA, 17 bp, Homo sapiens
aggcagcgcagggctgg

SEQ ID NO: 914899 - DNA, 16 bp, Homo sapiens
aggcagcgtgggctct

SEQ ID NO: 914900 - DNA, 19 bp, Homo sapiens
aggcagcgtgggctctgcc

SEQ ID NO: 914901 - DNA, 20 bp, Homo sapiens
aggcagcgtgggctctgcca

SEQ ID NO: 914902 - DNA, 23 bp, Homo sapiens
aggcagcgtgggctctgccaatg

SEQ ID NO: 914903 - DNA, 16 bp, Homo sapiens
aggcagctcacccctg

SEQ ID NO: 914904 - DNA, 16 bp, Homo sapiens
aggcagctcttctgga

SEQ ID NO: 914905 - DNA, 19 bp, Homo sapiens
aggcagctcttctggagtt

SEQ ID NO: 914906 - DNA, 16 bp, Homo sapiens
aggcagctgagaccag

SEQ ID NO: 914907 - DNA, 20 bp, Homo sapiens
aggcagctgagaccagggtc

SEQ ID NO: 914908 - DNA, 12 bp, Homo sapiens
aggcagctgcct

SEQ ID NO: 914909 - DNA, 13 bp, Homo sapiens
aggcagctgcctc

SEQ ID NO: 914910 - DNA, 19 bp, Homo sapiens
aggcagctgcctctgctcc

SEQ ID NO: 914911 - DNA, 18 bp, Homo sapiens
aggcagctggatgagact

SEQ ID NO: 914912 - DNA, 22 bp, Homo sapiens
aggcagctggatgagacttcca

SEQ ID NO: 914913 - DNA, 13 bp, Homo sapiens
aggcagcttctaa

SEQ ID NO: 914914 - DNA, 19 bp, Homo sapiens
aggcaggaacaaacagggc

SEQ ID NO: 914915 - DNA, 13 bp, Homo sapiens
aggcaggaagccc

SEQ ID NO: 914916 - DNA, 16 bp, Homo sapiens
aggcaggaagggcagg

SEQ ID NO: 914917 - DNA, 15 bp, Homo sapiens
aggcaggaatggggg

SEQ ID NO: 914918 - DNA, 17 bp, Homo sapiens
aggcaggaatgggggtc

SEQ ID NO: 914919 - DNA, 20 bp, Homo sapiens
aggcaggaatgggggtcaga

SEQ ID NO: 914920 - DNA, 21 bp, Homo sapiens
aggcaggagaatcactcgaac

SEQ ID NO: 914921 - DNA, 18 bp, Homo sapiens
aggcaggagactggcgtg

SEQ ID NO: 914922 - DNA, 22 bp, Homo sapiens
aggcaggcatagaggcttctcc

SEQ ID NO: 914923 - DNA, 13 bp, Homo sapiens
aggcaggcctccg

SEQ ID NO: 914924 - DNA, 14 bp, Homo sapiens
aggcaggcggctcc

SEQ ID NO: 914925 - DNA, 17 bp, Homo sapiens
aggcaggctgggacgga

SEQ ID NO: 914926 - DNA, 20 bp, Homo sapiens
aggcaggctggggaggccag

SEQ ID NO: 914927 - DNA, 18 bp, Homo sapiens
aggcagggaaaggaaaag

SEQ ID NO: 914928 - DNA, 21 bp, Homo sapiens
aggcagggaaaggaaaagaag

SEQ ID NO: 914929 - DNA, 19 bp, Homo sapiens
aggcagggaatgcctggag

SEQ ID NO: 914930 - DNA, 20 bp, Homo sapiens
aggcagggaatgcctggagg

SEQ ID NO: 914931 - DNA, 15 bp, Homo sapiens
aggcagggagaaggg

SEQ ID NO: 914932 - DNA, 19 bp, Homo sapiens
aggcagggcagagggaatg

SEQ ID NO: 914933 - DNA, 22 bp, Homo sapiens
aggcagggccttgcccagagat

SEQ ID NO: 914934 - DNA, 23 bp, Homo sapiens
aggcagggccttgcccagagatg

SEQ ID NO: 914935 - DNA, 16 bp, Homo sapiens
aggcagggctctcccg

SEQ ID NO: 914936 - DNA, 16 bp, Homo sapiens
aggcaggggcatctgt

SEQ ID NO: 914937 - DNA, 19 bp, Homo sapiens
aggcaggggcatctgtctg

SEQ ID NO: 914938 - DNA, 15 bp, Homo sapiens
aggcaggggctgctg

SEQ ID NO: 914939 - DNA, 20 bp, Homo sapiens
aggcagggggccctgcccca

SEQ ID NO: 914940 - DNA, 14 bp, Homo sapiens
aggcaggggtgaga

SEQ ID NO: 914941 - DNA, 23 bp, Homo sapiens
aggcaggggtgagagcacccact

SEQ ID NO: 914942 - DNA, 15 bp, Homo sapiens
aggcaggggtgggag

SEQ ID NO: 914943 - DNA, 18 bp, Homo sapiens
aggcaggggtgggagagc

SEQ ID NO: 914944 - DNA, 19 bp, Homo sapiens
aggcaggggtgggagagcc

SEQ ID NO: 914945 - DNA, 23 bp, Homo sapiens
aggcaggggtgggagagccagct

SEQ ID NO: 914946 - DNA, 22 bp, Homo sapiens
aggcaggggtgggggtggaggc

SEQ ID NO: 914947 - DNA, 16 bp, Homo sapiens
aggcaggtaataataa

SEQ ID NO: 914948 - DNA, 13 bp, Homo sapiens
aggcaggtcacag

SEQ ID NO: 914949 - DNA, 14 bp, Homo sapiens
aggcaggtgcctcc

SEQ ID NO: 914950 - DNA, 15 bp, Homo sapiens
aggcaggtgcctcca

SEQ ID NO: 914951 - DNA, 12 bp, Homo sapiens
aggcaggtttca

SEQ ID NO: 914952 - DNA, 19 bp, Homo sapiens
aggcagtccaggcctctct

SEQ ID NO: 914953 - DNA, 20 bp, Homo sapiens
aggcagtccaggcctctctc

SEQ ID NO: 914954 - DNA, 23 bp, Homo sapiens
aggcagtccaggcctctctctgc

SEQ ID NO: 914955 - DNA, 15 bp, Homo sapiens
aggcagtcccgggag

SEQ ID NO: 914956 - DNA, 22 bp, Homo sapiens
aggcagtcccgggagaaaagac

SEQ ID NO: 914957 - DNA, 19 bp, Homo sapiens
aggcagtcgggggctggcc

SEQ ID NO: 914958 - DNA, 23 bp, Homo sapiens
aggcagtcgggggctggcctagg

SEQ ID NO: 914959 - DNA, 21 bp, Homo sapiens
aggcagtctctatattatgtc

SEQ ID NO: 914960 - DNA, 24 bp, Homo sapiens
aggcagtgatgacttgctgtccag

SEQ ID NO: 914961 - DNA, 16 bp, Homo sapiens
aggcagtgcatgcatg

SEQ ID NO: 914962 - DNA, 17 bp, Homo sapiens
aggcataaattaaaatg

SEQ ID NO: 914963 - DNA, 20 bp, Homo sapiens
aggcatacgagagcagaggt

SEQ ID NO: 914964 - DNA, 16 bp, Homo sapiens
aggcataggcctgggt

SEQ ID NO: 914965 - DNA, 17 bp, Homo sapiens
aggcataggcctgggtg

SEQ ID NO: 914966 - DNA, 14 bp, Homo sapiens
aggcataggtctct

SEQ ID NO: 914967 - DNA, 20 bp, Homo sapiens
aggcatattgctttttctaa

SEQ ID NO: 914968 - DNA, 17 bp, Homo sapiens
aggcatcccaggggacc

SEQ ID NO: 914969 - DNA, 15 bp, Homo sapiens
aggcatccttgtctt

SEQ ID NO: 914970 - DNA, 16 bp, Homo sapiens
aggcatccttgtcttt

SEQ ID NO: 914971 - DNA, 17 bp, Homo sapiens
aggcatcgcaatgtaag

SEQ ID NO: 914972 - DNA, 13 bp, Homo sapiens
aggcatctccctt

SEQ ID NO: 914973 - DNA, 21 bp, Homo sapiens
aggcatctctgtactttgctt

SEQ ID NO: 914974 - DNA, 18 bp, Homo sapiens
aggcatgactaatgcttt

SEQ ID NO: 914975 - DNA, 20 bp, Homo sapiens
aggcatgactaatgcttttt

SEQ ID NO: 914976 - DNA, 13 bp, Homo sapiens
aggcatgagccac

SEQ ID NO: 914977 - DNA, 22 bp, Homo sapiens
aggcatgagccactgcacctga

SEQ ID NO: 914978 - DNA, 15 bp, Homo sapiens
aggcatgagggatca

SEQ ID NO: 914979 - DNA, 23 bp, Homo sapiens
aggcatgagggatcacagggccc

SEQ ID NO: 914980 - DNA, 13 bp, Homo sapiens
aggcatgcagctg

SEQ ID NO: 914981 - DNA, 16 bp, Homo sapiens
aggcatgcagctgcct

SEQ ID NO: 914982 - DNA, 22 bp, Homo sapiens
aggcatgcagctgcctggggcc

SEQ ID NO: 914983 - DNA, 14 bp, Homo sapiens
aggcatgcctgtgt

SEQ ID NO: 914984 - DNA, 20 bp, Homo sapiens
aggcatgcgaaatgttctca

SEQ ID NO: 914985 - DNA, 18 bp, Homo sapiens
aggcatggacttctggat

SEQ ID NO: 914986 - DNA, 15 bp, Homo sapiens
aggcatggcaattct

SEQ ID NO: 914987 - DNA, 16 bp, Homo sapiens
aggcatggcaattctg

SEQ ID NO: 914988 - DNA, 21 bp, Homo sapiens
aggcatggcaattctggaagc

SEQ ID NO: 914989 - DNA, 22 bp, Homo sapiens
aggcatggcaattctggaagct

SEQ ID NO: 914990 - DNA, 18 bp, Homo sapiens
aggcatggggcatgtcct

SEQ ID NO: 914991 - DNA, 21 bp, Homo sapiens
aggcatggggggtggggggag

SEQ ID NO: 914992 - DNA, 21 bp, Homo sapiens
aggcatgggtgcaaggaaaat

SEQ ID NO: 914993 - DNA, 20 bp, Homo sapiens
aggcatggtcccttaaggca

SEQ ID NO: 914994 - DNA, 18 bp, Homo sapiens
aggcatgtcccacccacc

SEQ ID NO: 914995 - DNA, 12 bp, Homo sapiens
aggcatgtcctg

SEQ ID NO: 914996 - DNA, 22 bp, Homo sapiens
aggcatgtgccacccacccaac

SEQ ID NO: 914997 - DNA, 17 bp, Homo sapiens
aggcatgtgtcccttcc

SEQ ID NO: 914998 - DNA, 15 bp, Homo sapiens
aggcattatttaatg

SEQ ID NO: 914999 - DNA, 12 bp, Homo sapiens
aggcattcaagt

SEQ ID NO: 915000 - DNA, 14 bp, Homo sapiens
aggcattcctcatc

SEQ ID NO: 915001 - DNA, 18 bp, Homo sapiens
aggcattcctgaagggaa

SEQ ID NO: 915002 - DNA, 17 bp, Homo sapiens
aggcattcggggaagct

SEQ ID NO: 915003 - DNA, 19 bp, Homo sapiens
aggcattgaggaagagtct

SEQ ID NO: 915004 - DNA, 16 bp, Homo sapiens
aggcattgccaagggc

SEQ ID NO: 915005 - DNA, 18 bp, Homo sapiens
aggcattgccaagggctt

SEQ ID NO: 915006 - DNA, 20 bp, Homo sapiens
aggcattgccaagggctttg

SEQ ID NO: 915007 - DNA, 14 bp, Homo sapiens
aggcattggatatt

SEQ ID NO: 915008 - DNA, 21 bp, Homo sapiens
aggcatttgccaagggaggcg

SEQ ID NO: 915009 - DNA, 13 bp, Homo sapiens
aggccaaaacaga

SEQ ID NO: 915010 - DNA, 17 bp, Homo sapiens
aggccaaaatcaagagt

SEQ ID NO: 915011 - DNA, 15 bp, Homo sapiens
aggccaaagataaaa

SEQ ID NO: 915012 - DNA, 12 bp, Homo sapiens
aggccaaagccc

SEQ ID NO: 915013 - DNA, 20 bp, Homo sapiens
aggccaaagccccatgtgcc

SEQ ID NO: 915014 - DNA, 17 bp, Homo sapiens
aggccaaaggctggtgg

SEQ ID NO: 915015 - DNA, 22 bp, Homo sapiens
aggccaaatgcacaagctcaga

SEQ ID NO: 915016 - DNA, 17 bp, Homo sapiens
aggccaagaaacgtctt

SEQ ID NO: 915017 - DNA, 21 bp, Homo sapiens
aggccaagaaacgtcttctaa

SEQ ID NO: 915018 - DNA, 21 bp, Homo sapiens
aggccaagcagtgcctgccta

SEQ ID NO: 915019 - DNA, 17 bp, Homo sapiens
aggccaaggccttctcc

SEQ ID NO: 915020 - DNA, 13 bp, Homo sapiens
aggccaaggggag

SEQ ID NO: 915021 - DNA, 16 bp, Homo sapiens
aggccaaggtgggagg

SEQ ID NO: 915022 - DNA, 15 bp, Homo sapiens
aggccaagtgcaggc

SEQ ID NO: 915023 - DNA, 22 bp, Homo sapiens
aggccaagtgtgataaataaac

SEQ ID NO: 915024 - DNA, 15 bp, Homo sapiens
aggccacaaaaacaa

SEQ ID NO: 915025 - DNA, 15 bp, Homo sapiens
aggccacatgtcacc

SEQ ID NO: 915026 - DNA, 13 bp, Homo sapiens
aggccaccaggat

SEQ ID NO: 915027 - DNA, 14 bp, Homo sapiens
aggccaccccaaac

SEQ ID NO: 915028 - DNA, 21 bp, Homo sapiens
aggccaccccaaaccccagcc

SEQ ID NO: 915029 - DNA, 13 bp, Homo sapiens
aggaccaggactc

SEQ ID NO: 915030 - DNA, 21 bp, Homo sapiens
aggaccaggactccctcctca

SEQ ID NO: 915031 - DNA, 20 bp, Homo sapiens
aggaccagggccctgggcag

SEQ ID NO: 915032 - DNA, 14 bp, Homo sapiens
aggaccagggtgga

SEQ ID NO: 915033 - DNA, 13 bp, Homo sapiens
aggacccagagga

SEQ ID NO: 915034 - DNA, 17 bp, Homo sapiens
aggacccaggccctcca

SEQ ID NO: 915035 - DNA, 13 bp, Homo sapiens
aggacccagggtc

SEQ ID NO: 915036 - DNA, 14 bp, Homo sapiens
aggaccccacatcc

SEQ ID NO: 915037 - DNA, 17 bp, Homo sapiens
aggaccccacatccttc

SEQ ID NO: 915038 - DNA, 13 bp, Homo sapiens
aggaccccagctc

SEQ ID NO: 915039 - DNA, 12 bp, Homo sapiens
aggaccccaggt

SEQ ID NO: 915040 - DNA, 16 bp, Homo sapiens
aggaccccgagggctg

SEQ ID NO: 915041 - DNA, 17 bp, Homo sapiens
aggaccccgagggctga

SEQ ID NO: 915042 - DNA, 12 bp, Homo sapiens
aggacccctcac

SEQ ID NO: 915043 - DNA, 22 bp, Homo sapiens
aggacccctcaccacccccact

SEQ ID NO: 915044 - DNA, 14 bp, Homo sapiens
aggacccctgcctt

SEQ ID NO: 915045 - DNA, 16 bp, Homo sapiens
aggacccctgccttcc

SEQ ID NO: 915046 - DNA, 21 bp, Homo sapiens
aggacccggaggggcctggca

SEQ ID NO: 915047 - DNA, 22 bp, Homo sapiens
aggacccggaggggcctggcag

SEQ ID NO: 915048 - DNA, 18 bp, Homo sapiens
aggaccctaacacagtat

SEQ ID NO: 915049 - DNA, 12 bp, Homo sapiens
aggaccctcagc

SEQ ID NO: 915050 - DNA, 21 bp, Homo sapiens
aggaccctccactcactgctg

SEQ ID NO: 915051 - DNA, 13 bp, Homo sapiens
aggaccctgacct

SEQ ID NO: 915052 - DNA, 14 bp, Homo sapiens
aggaccctgcacct

SEQ ID NO: 915053 - DNA, 13 bp, Homo sapiens
aggaccctgtcct

SEQ ID NO: 915054 - DNA, 16 bp, Homo sapiens
aggaccctgtcctgca

SEQ ID NO: 915055 - DNA, 18 bp, Homo sapiens
aggaccctgtcctgcagt

SEQ ID NO: 915056 - DNA, 15 bp, Homo sapiens
aggaccctgtttctg

SEQ ID NO: 915057 - DNA, 17 bp, Homo sapiens
aggaccgctgataagca

SEQ ID NO: 915058 - DNA, 23 bp, Homo sapiens
aggacctccctgtctcccggctc

SEQ ID NO: 915059 - DNA, 15 bp, Homo sapiens
aggacctgcctagca

SEQ ID NO: 915060 - DNA, 19 bp, Homo sapiens
aggaccttcgggctgtgcc

SEQ ID NO: 915061 - DNA, 22 bp, Homo sapiens
aggacctttaggtcaaactccc

SEQ ID NO: 915062 - DNA, 18 bp, Homo sapiens
aggacgcacgctcgctgc

SEQ ID NO: 915063 - DNA, 22 bp, Homo sapiens
aggacgccaacttctcccaccc

SEQ ID NO: 915064 - DNA, 12 bp, Homo sapiens
aggacgccactc

SEQ ID NO: 915065 - DNA, 14 bp, Homo sapiens
aggacgcctgcagg

SEQ ID NO: 915066 - DNA, 22 bp, Homo sapiens
aggacgcctgcaggagagagca

SEQ ID NO: 915067 - DNA, 17 bp, Homo sapiens
aggacggccctgcctgc

SEQ ID NO: 915068 - DNA, 22 bp, Homo sapiens
aggacggccctgcctgcctctt

SEQ ID NO: 915069 - DNA, 23 bp, Homo sapiens
aggacggctcctcagagcgccag

SEQ ID NO: 915070 - DNA, 17 bp, Homo sapiens
aggacggtgccaagggc

SEQ ID NO: 915071 - DNA, 16 bp, Homo sapiens
aggacggttgtaagca

SEQ ID NO: 915072 - DNA, 19 bp, Homo sapiens
aggacgtaaaatttacagt

SEQ ID NO: 915073 - DNA, 22 bp, Homo sapiens
aggacgtccttccatatccctg

SEQ ID NO: 915074 - DNA, 23 bp, Homo sapiens
aggacgtccttccatatccctgc

SEQ ID NO: 915075 - DNA, 13 bp, Homo sapiens
aggactaatagaa

SEQ ID NO: 915076 - DNA, 14 bp, Homo sapiens
aggactaccgcagg

SEQ ID NO: 915077 - DNA, 20 bp, Homo sapiens
aggactaccgcaggcccgga

SEQ ID NO: 915078 - DNA, 17 bp, Homo sapiens
aggactaggcatgtcag

SEQ ID NO: 915079 - DNA, 13 bp, Homo sapiens
aggactccccagg

SEQ ID NO: 915080 - DNA, 17 bp, Homo sapiens
aggactccccaggccag

SEQ ID NO: 915081 - DNA, 18 bp, Homo sapiens
aggactccccaggccagg

SEQ ID NO: 915082 - DNA, 19 bp, Homo sapiens
aggactccccaggccaggc

SEQ ID NO: 915083 - DNA, 15 bp, Homo sapiens
aggactccccgaggt

SEQ ID NO: 915084 - DNA, 12 bp, Homo sapiens
aggactccctcc

SEQ ID NO: 915085 - DNA, 14 bp, Homo sapiens
aggactccctcctc

SEQ ID NO: 915086 - DNA, 17 bp, Homo sapiens
aggactccctcctcacc

SEQ ID NO: 915087 - DNA, 18 bp, Homo sapiens
aggactccctcctcacct

SEQ ID NO: 915088 - DNA, 14 bp, Homo sapiens
aggactcctggcag

SEQ ID NO: 915089 - DNA, 15 bp, Homo sapiens
aggactcctggcagg

SEQ ID NO: 915090 - DNA, 18 bp, Homo sapiens
aggactcctggcagggcc

SEQ ID NO: 915091 - DNA, 19 bp, Homo sapiens
aggactcctggcagggcca

SEQ ID NO: 915092 - DNA, 14 bp, Homo sapiens
aggactctgaggct

SEQ ID NO: 915093 - DNA, 18 bp, Homo sapiens
aggactctgcccagacca

SEQ ID NO: 915094 - DNA, 12 bp, Homo sapiens
aggactctgcct

SEQ ID NO: 915095 - DNA, 18 bp, Homo sapiens
aggactctgcctcctctt

SEQ ID NO: 915096 - DNA, 13 bp, Homo sapiens
aggactctgcctt

SEQ ID NO: 915097 - DNA, 22 bp, Homo sapiens
aggactctgcgggaggctgggg

SEQ ID NO: 915098 - DNA, 11 bp, Homo sapiens
aggactctggc

SEQ ID NO: 915099 - DNA, 13 bp, Homo sapiens
aggactctttgaa

SEQ ID NO: 915100 - DNA, 20 bp, Homo sapiens
aggactgaattgtccccagt

SEQ ID NO: 915101 - DNA, 15 bp, Homo sapiens
aggactgagactggc

SEQ ID NO: 915102 - DNA, 14 bp, Homo sapiens
aggactgagccccc

SEQ ID NO: 915103 - DNA, 17 bp, Homo sapiens
aggactgagccctctca

SEQ ID NO: 915104 - DNA, 21 bp, Homo sapiens
aggactgagccctctcactcc

SEQ ID NO: 915105 - DNA, 22 bp, Homo sapiens
aggactgagccctctcactcca

SEQ ID NO: 915106 - DNA, 14 bp, Homo sapiens
aggactgaggagtg

SEQ ID NO: 915107 - DNA, 13 bp, Homo sapiens
aggactgagggca

SEQ ID NO: 915108 - DNA, 21 bp, Homo sapiens
aggactgagggcagtgccctt

SEQ ID NO: 915109 - DNA, 18 bp, Homo sapiens
aggactgatttcagagtg

SEQ ID NO: 915110 - DNA, 15 bp, Homo sapiens
aggactgcagtgtgg

SEQ ID NO: 915111 - DNA, 16 bp, Homo sapiens
aggactgcagtgtgga

SEQ ID NO: 915112 - DNA, 13 bp, Homo sapiens
aggactgccgacc

SEQ ID NO: 915113 - DNA, 17 bp, Homo sapiens
aggactgccgaccgagg

SEQ ID NO: 915114 - DNA, 15 bp, Homo sapiens
aggactgtataagta

SEQ ID NO: 915115 - DNA, 18 bp, Homo sapiens
aggactgtataggtagat

SEQ ID NO: 915116 - DNA, 18 bp, Homo sapiens
aggactgttttttcctga

SEQ ID NO: 915117 - DNA, 17 bp, Homo sapiens
aggacttaacggctcca

SEQ ID NO: 915118 - DNA, 21 bp, Homo sapiens
aggacttacccagtattactg

SEQ ID NO: 915119 - DNA, 14 bp, Homo sapiens
aggacttctgcagc

SEQ ID NO: 915120 - DNA, 21 bp, Homo sapiens
aggacttgaaagcatccatgt

SEQ ID NO: 915121 - DNA, 23 bp, Homo sapiens
aggacttggagagaatcatgctg

SEQ ID NO: 915122 - DNA, 22 bp, Homo sapiens
aggacttggagggtctgggggc

SEQ ID NO: 915123 - DNA, 23 bp, Homo sapiens
aggacttggtaagatgactctga

SEQ ID NO: 915124 - DNA, 20 bp, Homo sapiens
aggacttggtctgatttcag

SEQ ID NO: 915125 - DNA, 16 bp, Homo sapiens
aggacttgtgtctctg

SEQ ID NO: 915126 - DNA, 21 bp, Homo sapiens
aggactttcctaaatgtttaa

SEQ ID NO: 915127 - DNA, 11 bp, Homo sapiens
aggactttgca

SEQ ID NO: 915128 - DNA, 13 bp, Homo sapiens
aggactttgtaca

SEQ ID NO: 915129 - DNA, 13 bp, Homo sapiens
aggacttttttga

SEQ ID NO: 915130 - DNA, 20 bp, Homo sapiens
aggagaaaaaaaaagtgaaa

SEQ ID NO: 915131 - DNA, 21 bp, Homo sapiens
aggagaaaaaaaaagtgaaaa

SEQ ID NO: 915132 - DNA, 15 bp, Homo sapiens
aggagaaaaaaaacc

SEQ ID NO: 915133 - DNA, 14 bp, Homo sapiens
aggagaaacagaga

SEQ ID NO: 915134 - DNA, 16 bp, Homo sapiens
aggagaaacagagaca

SEQ ID NO: 915135 - DNA, 18 bp, Homo sapiens
aggagaaacagagacagg

SEQ ID NO: 915136 - DNA, 18 bp, Homo sapiens
aggagaaatgcaataact

SEQ ID NO: 915137 - DNA, 16 bp, Homo sapiens
aggagaaattttggtt

SEQ ID NO: 915138 - DNA, 19 bp, Homo sapiens
aggagaaccaaatctggaa

SEQ ID NO: 915139 - DNA, 13 bp, Homo sapiens
aggagaagagaca

SEQ ID NO: 915140 - DNA, 17 bp, Homo sapiens
aggagaagcacagctcc

SEQ ID NO: 915141 - DNA, 14 bp, Homo sapiens
aggagaagctcagc

SEQ ID NO: 915142 - DNA, 15 bp, Homo sapiens
aggagaagctcagct

SEQ ID NO: 915143 - DNA, 19 bp, Homo sapiens
aggagaagctcagctgcat

SEQ ID NO: 915144 - DNA, 15 bp, Homo sapiens
aggagaaggaaaaag

SEQ ID NO: 915145 - DNA, 12 bp, Homo sapiens
aggagaaggaag

SEQ ID NO: 915146 - DNA, 15 bp, Homo sapiens
aggagaaggaggaga

SEQ ID NO: 915147 - DNA, 15 bp, Homo sapiens
aggagaagggctggg

SEQ ID NO: 915148 - DNA, 20 bp, Homo sapiens
aggagaatagcctgaacctg

SEQ ID NO: 915149 - DNA, 20 bp, Homo sapiens
aggagaatcacttgaaccca

SEQ ID NO: 915150 - DNA, 16 bp, Homo sapiens
aggagaatctcttgaa

SEQ ID NO: 915151 - DNA, 20 bp, Homo sapiens
aggagaatctcttgaacctg

SEQ ID NO: 915152 - DNA, 20 bp, Homo sapiens
aggagaatggcgtgaacccg

SEQ ID NO: 915153 - DNA, 21 bp, Homo sapiens
aggagaatggggttcctgctg

SEQ ID NO: 915154 - DNA, 16 bp, Homo sapiens
aggagaattcacagaa

SEQ ID NO: 915155 - DNA, 13 bp, Homo sapiens
aggagacaaaaga

SEQ ID NO: 915156 - DNA, 18 bp, Homo sapiens
aggagacaaagcaggagt

SEQ ID NO: 915157 - DNA, 22 bp, Homo sapiens
aggagacaaagcaggagtggaa

SEQ ID NO: 915158 - DNA, 20 bp, Homo sapiens
aggagacacgtgtggcgggc

SEQ ID NO: 915159 - DNA, 14 bp, Homo sapiens
aggagaccagcggt

SEQ ID NO: 915160 - DNA, 20 bp, Homo sapiens
aggagaccttttcacaatgg

SEQ ID NO: 915161 - DNA, 16 bp, Homo sapiens
aggagactcacctctg

SEQ ID NO: 915162 - DNA, 17 bp, Homo sapiens
aggagactcacctctgc

SEQ ID NO: 915163 - DNA, 18 bp, Homo sapiens
aggagactcacctctgcc

SEQ ID NO: 915164 - DNA, 14 bp, Homo sapiens
aggagacttgtgaa

SEQ ID NO: 915165 - DNA, 15 bp, Homo sapiens
aggagagaaaatata

SEQ ID NO: 915166 - DNA, 17 bp, Homo sapiens
aggagagaaaatatatg

SEQ ID NO: 915167 - DNA, 12 bp, Homo sapiens
aggagagaagaa

SEQ ID NO: 915168 - DNA, 14 bp, Homo sapiens
aggagagaagaatg

SEQ ID NO: 915169 - DNA, 15 bp, Homo sapiens
aggagagaagaatga

SEQ ID NO: 915170 - DNA, 19 bp, Homo sapiens
aggagagactgaaagcagc

SEQ ID NO: 915171 - DNA, 22 bp, Homo sapiens
aggagagactgagcagccgcca

SEQ ID NO: 915172 - DNA, 18 bp, Homo sapiens
aggagagagtcccagagc

SEQ ID NO: 915173 - DNA, 13 bp, Homo sapiens
aggagagcactgc

SEQ ID NO: 915174 - DNA, 15 bp, Homo sapiens
aggagagcactgcct

SEQ ID NO: 915175 - DNA, 24 bp, Homo sapiens
aggagagccaacctcggcttgtgg

SEQ ID NO: 915176 - DNA, 18 bp, Homo sapiens
aggagagccactgggccc

SEQ ID NO: 915177 - DNA, 22 bp, Homo sapiens
aggagagccactgggcccctgt

SEQ ID NO: 915178 - DNA, 14 bp, Homo sapiens
aggagagccagccc

SEQ ID NO: 915179 - DNA, 12 bp, Homo sapiens
aggagagcctgc

SEQ ID NO: 915180 - DNA, 16 bp, Homo sapiens
aggagagcggaggagg

SEQ ID NO: 915181 - DNA, 15 bp, Homo sapiens
aggagagctagcagc

SEQ ID NO: 915182 - DNA, 21 bp, Homo sapiens
aggagaggcaacatccaaaat

SEQ ID NO: 915183 - DNA, 13 bp, Homo sapiens
aggagaggcagca

SEQ ID NO: 915184 - DNA, 15 bp, Homo sapiens
aggagaggcagcatg

SEQ ID NO: 915185 - DNA, 16 bp, Homo sapiens
aggagaggcagcatgc

SEQ ID NO: 915186 - DNA, 20 bp, Homo sapiens
aggagaggcgggagaactga

SEQ ID NO: 915187 - DNA, 22 bp, Homo sapiens
aggagaggggaagggccagtct

SEQ ID NO: 915188 - DNA, 19 bp, Homo sapiens
aggagaggggcagaacagc

SEQ ID NO: 915189 - DNA, 20 bp, Homo sapiens
aggagagtcccagagcagga

SEQ ID NO: 915190 - DNA, 12 bp, Homo sapiens
aggagagtgtgc

SEQ ID NO: 915191 - DNA, 14 bp, Homo sapiens
aggagatatctgag

SEQ ID NO: 915192 - DNA, 23 bp, Homo sapiens
aggagatcgagaccatcctggct

SEQ ID NO: 915193 - DNA, 19 bp, Homo sapiens
aggagatgaccagggatgc

SEQ ID NO: 915194 - DNA, 22 bp, Homo sapiens
aggagatgaccagggatgctgg

SEQ ID NO: 915195 - DNA, 22 bp, Homo sapiens
aggagatggccataggagagga

SEQ ID NO: 915196 - DNA, 15 bp, Homo sapiens
aggagatggccccaa

SEQ ID NO: 915197 - DNA, 22 bp, Homo sapiens
aggagatgttgaggggaggagg

SEQ ID NO: 915198 - DNA, 19 bp, Homo sapiens
aggagattggccagtgaga

SEQ ID NO: 915199 - DNA, 22 bp, Homo sapiens
aggagattgggagacaattagc

SEQ ID NO: 915200 - DNA, 15 bp, Homo sapiens
aggagcaaacactga

SEQ ID NO: 915201 - DNA, 22 bp, Homo sapiens
aggagcacaggcagctggatga

SEQ ID NO: 915202 - DNA, 19 bp, Homo sapiens
aggagcacctggaccccct

SEQ ID NO: 915203 - DNA, 22 bp, Homo sapiens
aggagcacctggaccccctgcc

SEQ ID NO: 915204 - DNA, 17 bp, Homo sapiens
aggagcagagaggtggc

SEQ ID NO: 915205 - DNA, 15 bp, Homo sapiens
aggagcagcagccag

SEQ ID NO: 915206 - DNA, 16 bp, Homo sapiens
aggagcagcagccagc

SEQ ID NO: 915207 - DNA, 17 bp, Homo sapiens
aggagcagcagccagca

SEQ ID NO: 915208 - DNA, 16 bp, Homo sapiens
aggagcagcagcgctc

SEQ ID NO: 915209 - DNA, 13 bp, Homo sapiens
aggagcagcattg

SEQ ID NO: 915210 - DNA, 11 bp, Homo sapiens
aggagcagcct

SEQ ID NO: 915211 - DNA, 19 bp, Homo sapiens
aggagcagcctcgaggctg

SEQ ID NO: 915212 - DNA, 20 bp, Homo sapiens
aggagcagcctcgaggctgg

SEQ ID NO: 915213 - DNA, 22 bp, Homo sapiens
aggagcagcctcgaggctggtg

SEQ ID NO: 915214 - DNA, 22 bp, Homo sapiens
aggagcagcttccttctgggac

SEQ ID NO: 915215 - DNA, 23 bp, Homo sapiens
aggagcagcttccttctgggact

SEQ ID NO: 915216 - DNA, 19 bp, Homo sapiens
aggagcaggagcctgagcc

SEQ ID NO: 915217 - DNA, 19 bp, Homo sapiens
aggagcagtatcatgaagc

SEQ ID NO: 915218 - DNA, 16 bp, Homo sapiens
aggagcatagaagcca

SEQ ID NO: 915219 - DNA, 23 bp, Homo sapiens
aggagccagtttgccggatacaa

SEQ ID NO: 915220 - DNA, 11 bp, Homo sapiens
aggagcccagt

SEQ ID NO: 915221 - DNA, 23 bp, Homo sapiens
aggagcccagtgggctgcacgct

SEQ ID NO: 915222 - DNA, 19 bp, Homo sapiens
aggagccccattcctggga

SEQ ID NO: 915223 - DNA, 21 bp, Homo sapiens
aggagccccattcctgggaaa

SEQ ID NO: 915224 - DNA, 14 bp, Homo sapiens
aggagccccgccac

SEQ ID NO: 915225 - DNA, 21 bp, Homo sapiens
aggagcctagcggagcccagc

SEQ ID NO: 915226 - DNA, 16 bp, Homo sapiens
aggagcctccctgcac

SEQ ID NO: 915227 - DNA, 15 bp, Homo sapiens
aggagcctctggctt

SEQ ID NO: 915228 - DNA, 17 bp, Homo sapiens
aggagccttgctgggcc

SEQ ID NO: 915229 - DNA, 19 bp, Homo sapiens
aggagccttgctgggccag

SEQ ID NO: 915230 - DNA, 15 bp, Homo sapiens
aggagcgagcatgtc

SEQ ID NO: 915231 - DNA, 17 bp, Homo sapiens
aggagcgcaagatagat

SEQ ID NO: 915232 - DNA, 16 bp, Homo sapiens
aggagcgctagtgcct

SEQ ID NO: 915233 - DNA, 18 bp, Homo sapiens
aggagcgctagtgccttg

SEQ ID NO: 915234 - DNA, 20 bp, Homo sapiens
aggagcgctagtgccttgcc

SEQ ID NO: 915235 - DNA, 22 bp, Homo sapiens
aggagcgctagtgccttgccca

SEQ ID NO: 915236 - DNA, 13 bp, Homo sapiens
aggagcgggcagg

SEQ ID NO: 915237 - DNA, 16 bp, Homo sapiens
aggagctcaccctgcc

SEQ ID NO: 915238 - DNA, 18 bp, Homo sapiens
aggagctcaccctgcccg

SEQ ID NO: 915239 - DNA, 12 bp, Homo sapiens
aggagctctgcg

SEQ ID NO: 915240 - DNA, 20 bp, Homo sapiens
aggagctctgcgccaggcag

SEQ ID NO: 915241 - DNA, 24 bp, Homo sapiens
aggagctctgcgccaggcagagct

SEQ ID NO: 915242 - DNA, 17 bp, Homo sapiens
aggagctcttcaggcct

SEQ ID NO: 915243 - DNA, 15 bp, Homo sapiens
aggagctgagggagg

SEQ ID NO: 915244 - DNA, 18 bp, Homo sapiens
aggagctgatggcagctg

SEQ ID NO: 915245 - DNA, 14 bp, Homo sapiens
aggagctgcccaga

SEQ ID NO: 915246 - DNA, 20 bp, Homo sapiens
aggagctgctatagcctggg

SEQ ID NO: 915247 - DNA, 12 bp, Homo sapiens
aggagctgctgg

SEQ ID NO: 915248 - DNA, 21 bp, Homo sapiens
aggagctgctggcttgcagtg

SEQ ID NO: 915249 - DNA, 20 bp, Homo sapiens
aggagctgggcccctgcaca

SEQ ID NO: 915250 - DNA, 22 bp, Homo sapiens
aggagcttacccaagctgtggc

SEQ ID NO: 915251 - DNA, 18 bp, Homo sapiens
aggaggaaaacacagcct

SEQ ID NO: 915252 - DNA, 19 bp, Homo sapiens
aggaggaaaacacagcctc

SEQ ID NO: 915253 - DNA, 14 bp, Homo sapiens
aggaggaaaaggaa

SEQ ID NO: 915254 - DNA, 21 bp, Homo sapiens
aggaggaacgggcagccacag

SEQ ID NO: 915255 - DNA, 11 bp, Homo sapiens
aggaggaagcc

SEQ ID NO: 915256 - DNA, 17 bp, Homo sapiens
aggaggaaggcaagagg

SEQ ID NO: 915257 - DNA, 15 bp, Homo sapiens
aggaggaagtcatgg

SEQ ID NO: 915258 - DNA, 14 bp, Homo sapiens
aggaggaatactga

SEQ ID NO: 915259 - DNA, 17 bp, Homo sapiens
aggaggaatgctggact

SEQ ID NO: 915260 - DNA, 17 bp, Homo sapiens
aggaggacacagcacaa

SEQ ID NO: 915261 - DNA, 13 bp, Homo sapiens
aggaggacccagg

SEQ ID NO: 915262 - DNA, 15 bp, Homo sapiens
aggaggacccaggac

SEQ ID NO: 915263 - DNA, 18 bp, Homo sapiens
aggaggacccctgccttc

SEQ ID NO: 915264 - DNA, 20 bp, Homo sapiens
aggaggacttggagggtctg

SEQ ID NO: 915265 - DNA, 22 bp, Homo sapiens
aggaggagccttgctgggccag

SEQ ID NO: 915266 - DNA, 23 bp, Homo sapiens
aggaggagccttgctgggccagg

SEQ ID NO: 915267 - DNA, 14 bp, Homo sapiens
aggaggaggacaca

SEQ ID NO: 915268 - DNA, 18 bp, Homo sapiens
aggaggaggctgccctga

SEQ ID NO: 915269 - DNA, 22 bp, Homo sapiens
aggaggagggaggcgctgctgg

SEQ ID NO: 915270 - DNA, 15 bp, Homo sapiens
aggaggatgtccctg

SEQ ID NO: 915271 - DNA, 23 bp, Homo sapiens
aggaggattgcttgagcccagga

SEQ ID NO: 915272 - DNA, 14 bp, Homo sapiens
aggaggcagccccc

SEQ ID NO: 915273 - DNA, 14 bp, Homo sapiens
aggaggcaggacct

SEQ ID NO: 915274 - DNA, 18 bp, Homo sapiens
aggaggccaataaaaagt

SEQ ID NO: 915275 - DNA, 18 bp, Homo sapiens
aggaggccacctctccaa

SEQ ID NO: 915276 - DNA, 20 bp, Homo sapiens
aggaggccacctctccaagg

SEQ ID NO: 915277 - DNA, 23 bp, Homo sapiens
aggaggccacctctccaagggct

SEQ ID NO: 915278 - DNA, 18 bp, Homo sapiens
aggaggcccctggcccag

SEQ ID NO: 915279 - DNA, 19 bp, Homo sapiens
cagggaggggctggggcag

SEQ ID NO: 915280 - DNA, 18 bp, Homo sapiens
cagggagggttagcctgc

SEQ ID NO: 915281 - DNA, 21 bp, Homo sapiens
cagggagggttagcctgcacc

SEQ ID NO: 915282 - DNA, 21 bp, Homo sapiens
cagggaggtgggggcctcctc

SEQ ID NO: 915283 - DNA, 23 bp, Homo sapiens
cagggagtccagggtttctctgc

SEQ ID NO: 915284 - DNA, 15 bp, Homo sapiens
cagggagtgagcagc

SEQ ID NO: 915285 - DNA, 16 bp, Homo sapiens
cagggagtgagcagct

SEQ ID NO: 915286 - DNA, 19 bp, Homo sapiens
cagggagtgagcagctact

SEQ ID NO: 915287 - DNA, 15 bp, Homo sapiens
cagggagtgatgatt

SEQ ID NO: 915288 - DNA, 16 bp, Homo sapiens
cagggagtgctggctc

SEQ ID NO: 915289 - DNA, 23 bp, Homo sapiens
cagggatgatggcagagccaggc

SEQ ID NO: 915290 - DNA, 13 bp, Homo sapiens
cagggatgccctg

SEQ ID NO: 915291 - DNA, 19 bp, Homo sapiens
cagggatgctgggctgggc

SEQ ID NO: 915292 - DNA, 19 bp, Homo sapiens
cagggatgctggtggctgg

SEQ ID NO: 915293 - DNA, 18 bp, Homo sapiens
cagggatggagatgggaa

SEQ ID NO: 915294 - DNA, 13 bp, Homo sapiens
cagggatggggga

SEQ ID NO: 915295 - DNA, 23 bp, Homo sapiens
cagggatgggggatgggccaggg

SEQ ID NO: 915296 - DNA, 15 bp, Homo sapiens
cagggatgttcctta

SEQ ID NO: 915297 - DNA, 19 bp, Homo sapiens
cagggattaacctctgcac

SEQ ID NO: 915298 - DNA, 21 bp, Homo sapiens
cagggattacaggcgtgagcc

SEQ ID NO: 915299 - DNA, 21 bp, Homo sapiens
cagggatttccaactggcact

SEQ ID NO: 915300 - DNA, 21 bp, Homo sapiens
cagggcaaaagggcagctgtg

SEQ ID NO: 915301 - DNA, 22 bp, Homo sapiens
cagggcaaaagggcagctgtga

SEQ ID NO: 915302 - DNA, 21 bp, Homo sapiens
cagggcaactcttggaagaaa

SEQ ID NO: 915303 - DNA, 20 bp, Homo sapiens
cagggcaaggacacagcgcg

SEQ ID NO: 915304 - DNA, 22 bp, Homo sapiens
cagggcaagggttaaggcctga

SEQ ID NO: 915305 - DNA, 18 bp, Homo sapiens
cagggcaatgatgaatga

SEQ ID NO: 915306 - DNA, 13 bp, Homo sapiens
cagggcaatgcca

SEQ ID NO: 915307 - DNA, 14 bp, Homo sapiens
cagggcaatgccat

SEQ ID NO: 915308 - DNA, 19 bp, Homo sapiens
cagggcaatgccatcagcc

SEQ ID NO: 915309 - DNA, 23 bp, Homo sapiens
cagggcacagctgccctgctgcc

SEQ ID NO: 915310 - DNA, 16 bp, Homo sapiens
cagggcacgcaggacc

SEQ ID NO: 915311 - DNA, 18 bp, Homo sapiens
cagggcacggggacctgg

SEQ ID NO: 915312 - DNA, 14 bp, Homo sapiens
cagggcagacagcc

SEQ ID NO: 915313 - DNA, 12 bp, Homo sapiens
cagggcagagcc

SEQ ID NO: 915314 - DNA, 15 bp, Homo sapiens
cagggcagagccggg

SEQ ID NO: 915315 - DNA, 16 bp, Homo sapiens
cagggcagagccggga

SEQ ID NO: 915316 - DNA, 12 bp, Homo sapiens
cagggcagaggg

SEQ ID NO: 915317 - DNA, 13 bp, Homo sapiens
cagggcagaggga

SEQ ID NO: 915318 - DNA, 13 bp, Homo sapiens
cagggcagagtga

SEQ ID NO: 915319 - DNA, 19 bp, Homo sapiens
cagggcagagtgagaccca

SEQ ID NO: 915320 - DNA, 13 bp, Homo sapiens
cagggcagatgtg

SEQ ID NO: 915321 - DNA, 14 bp, Homo sapiens
cagggcagcagtgg

SEQ ID NO: 915322 - DNA, 18 bp, Homo sapiens
cagggcagcagtggggtg

SEQ ID NO: 915323 - DNA, 20 bp, Homo sapiens
cagggcagcagtggggtgaa

SEQ ID NO: 915324 - DNA, 11 bp, Homo sapiens
cagggcagcct

SEQ ID NO: 915325 - DNA, 13 bp, Homo sapiens
cagggcagcgcca

SEQ ID NO: 915326 - DNA, 18 bp, Homo sapiens
cagggcagcgccaggctg

SEQ ID NO: 915327 - DNA, 22 bp, Homo sapiens
cagggcagcgccaggctgacca

SEQ ID NO: 915328 - DNA, 13 bp, Homo sapiens
cagggcagcggct

SEQ ID NO: 915329 - DNA, 16 bp, Homo sapiens
cagggcagctgcctgg

SEQ ID NO: 915330 - DNA, 19 bp, Homo sapiens
cagggcagctgcctggcca

SEQ ID NO: 915331 - DNA, 17 bp, Homo sapiens
cagggcaggaaggggaa

SEQ ID NO: 915332 - DNA, 10 bp, Homo sapiens
cagggcaggc

SEQ ID NO: 915333 - DNA, 12 bp, Homo sapiens
cagggcaggcct

SEQ ID NO: 915334 - DNA, 19 bp, Homo sapiens
cagggcaggccttgctggg

SEQ ID NO: 915335 - DNA, 15 bp, Homo sapiens
cagggcagggcagcc

SEQ ID NO: 915336 - DNA, 15 bp, Homo sapiens
cagggcagggctctg

SEQ ID NO: 915337 - DNA, 17 bp, Homo sapiens
cagggcagggtagtgca

SEQ ID NO: 915338 - DNA, 16 bp, Homo sapiens
cagggcagggtctggg

SEQ ID NO: 915339 - DNA, 22 bp, Homo sapiens
cagggcagggtgggcagcctat

SEQ ID NO: 915340 - DNA, 23 bp, Homo sapiens
cagggcagggtgggcagcctatg

SEQ ID NO: 915341 - DNA, 12 bp, Homo sapiens
cagggcagtggc

SEQ ID NO: 915342 - DNA, 14 bp, Homo sapiens
cagggcagtggcca

SEQ ID NO: 915343 - DNA, 22 bp, Homo sapiens
cagggcagtggccaagcctgct

SEQ ID NO: 915344 - DNA, 14 bp, Homo sapiens
cagggcatcggcag

SEQ ID NO: 915345 - DNA, 15 bp, Homo sapiens
cagggcatctcctgt

SEQ ID NO: 915346 - DNA, 18 bp, Homo sapiens
cagggcatcttgctggct

SEQ ID NO: 915347 - DNA, 20 bp, Homo sapiens
cagggcatcttgctggctac

SEQ ID NO: 915348 - DNA, 15 bp, Homo sapiens
cagggcatgccacgt

SEQ ID NO: 915349 - DNA, 18 bp, Homo sapiens
cagggccaagcgggggcg

SEQ ID NO: 915350 - DNA, 22 bp, Homo sapiens
cagggccaagcgggggcgtggc

SEQ ID NO: 915351 - DNA, 17 bp, Homo sapiens
cagggccacgctccagc

SEQ ID NO: 915352 - DNA, 18 bp, Homo sapiens
cagggccacgctccagct

SEQ ID NO: 915353 - DNA, 21 bp, Homo sapiens
cagggccacgtgccaggcccg

SEQ ID NO: 915354 - DNA, 15 bp, Homo sapiens
cagggccacttttga

SEQ ID NO: 915355 - DNA, 11 bp, Homo sapiens
cagggccagaa

SEQ ID NO: 915356 - DNA, 16 bp, Homo sapiens
cagggccagaaggagg

SEQ ID NO: 915357 - DNA, 19 bp, Homo sapiens
cagggccagaaggagggca

SEQ ID NO: 915358 - DNA, 17 bp, Homo sapiens
cagggccagactggaag

SEQ ID NO: 915359 - DNA, 12 bp, Homo sapiens
cagggccagggc

SEQ ID NO: 915360 - DNA, 13 bp, Homo sapiens
cagggccagggca

SEQ ID NO: 915361 - DNA, 20 bp, Homo sapiens
cagggccagggcaatgccat

SEQ ID NO: 915362 - DNA, 13 bp, Homo sapiens
cagggccagggcc

SEQ ID NO: 915363 - DNA, 16 bp, Homo sapiens
cagggccagggccctg

SEQ ID NO: 915364 - DNA, 18 bp, Homo sapiens
cagggccagggccctgca

SEQ ID NO: 915365 - DNA, 23 bp, Homo sapiens
cagggccaggtgcagaccttggg

SEQ ID NO: 915366 - DNA, 16 bp, Homo sapiens
cagggccagtgcagtt

SEQ ID NO: 915367 - DNA, 16 bp, Homo sapiens
cagggccagtggggcc

SEQ ID NO: 915368 - DNA, 17 bp, Homo sapiens
cagggccagtggggcct

SEQ ID NO: 915369 - DNA, 22 bp, Homo sapiens
cagggccagtggggcctgtgga

SEQ ID NO: 915370 - DNA, 18 bp, Homo sapiens
cagggccatgcagacctc

SEQ ID NO: 915371 - DNA, 14 bp, Homo sapiens
cagggccatgctga

SEQ ID NO: 915372 - DNA, 21 bp, Homo sapiens
cagggccatgctgaggcctgg

SEQ ID NO: 915373 - DNA, 18 bp, Homo sapiens
cagggcccaagtccctgt

SEQ ID NO: 915374 - DNA, 19 bp, Homo sapiens
cagggcccaagtccctgtt

SEQ ID NO: 915375 - DNA, 15 bp, Homo sapiens
cagggcccaccttgg

SEQ ID NO: 915376 - DNA, 14 bp, Homo sapiens
cagggcccagagcc

SEQ ID NO: 915377 - DNA, 15 bp, Homo sapiens
cagggcccagagccc

SEQ ID NO: 915378 - DNA, 17 bp, Homo sapiens
cagggcccagagccctt

SEQ ID NO: 915379 - DNA, 15 bp, Homo sapiens
cagggcccaggccat

SEQ ID NO: 915380 - DNA, 14 bp, Homo sapiens
cagggcccaggcct

SEQ ID NO: 915381 - DNA, 16 bp, Homo sapiens
cagggcccaggcctgg

SEQ ID NO: 915382 - DNA, 20 bp, Homo sapiens
cagggcccaggttcgagacc

SEQ ID NO: 915383 - DNA, 14 bp, Homo sapiens
cagggccccagcac

SEQ ID NO: 915384 - DNA, 16 bp, Homo sapiens
cagggccccagcacta

SEQ ID NO: 915385 - DNA, 21 bp, Homo sapiens
cagggcccccagcgagagtcc

SEQ ID NO: 915386 - DNA, 22 bp, Homo sapiens
cagggccccccaaatcccaggg

SEQ ID NO: 915387 - DNA, 11 bp, Homo sapiens
cagggcccctc

SEQ ID NO: 915388 - DNA, 20 bp, Homo sapiens
cagggcccctccctctgccc

SEQ ID NO: 915389 - DNA, 22 bp, Homo sapiens
cagggcccctccctctgcccca

SEQ ID NO: 915390 - DNA, 18 bp, Homo sapiens
cagggcccctgaccctcc

SEQ ID NO: 915391 - DNA, 15 bp, Homo sapiens
cagggcccctggatc

SEQ ID NO: 915392 - DNA, 15 bp, Homo sapiens
cagggcccggccaca

SEQ ID NO: 915393 - DNA, 22 bp, Homo sapiens
cagggcccggccacacccagcg

SEQ ID NO: 915394 - DNA, 18 bp, Homo sapiens
cagggcccgggcacccac

SEQ ID NO: 915395 - DNA, 14 bp, Homo sapiens
cagggccctcccag

SEQ ID NO: 915396 - DNA, 15 bp, Homo sapiens
cagggccctcccagc

SEQ ID NO: 915397 - DNA, 16 bp, Homo sapiens
cagggccctcccagcc

SEQ ID NO: 915398 - DNA, 15 bp, Homo sapiens
cagggccctgcagag

SEQ ID NO: 915399 - DNA, 15 bp, Homo sapiens
cagggccctgcccca

SEQ ID NO: 915400 - DNA, 18 bp, Homo sapiens
cagggccctgccccaggc

SEQ ID NO: 915401 - DNA, 23 bp, Homo sapiens
cagggccctgccccaggcctgga

SEQ ID NO: 915402 - DNA, 13 bp, Homo sapiens
cagggccctgggc

SEQ ID NO: 915403 - DNA, 14 bp, Homo sapiens
cagggcctcatctc

SEQ ID NO: 915404 - DNA, 19 bp, Homo sapiens
aggaggccctgttccctgg

SEQ ID NO: 915405 - DNA, 23 bp, Homo sapiens
aggaggcccttgtcgtgggatgg

SEQ ID NO: 915406 - DNA, 14 bp, Homo sapiens
aggaggcctggacc

SEQ ID NO: 915407 - DNA, 21 bp, Homo sapiens
aggaggcgtctcgggagagga

SEQ ID NO: 915408 - DNA, 19 bp, Homo sapiens
aggaggctccagagggcac

SEQ ID NO: 915409 - DNA, 13 bp, Homo sapiens
aggaggctgaggg

SEQ ID NO: 915410 - DNA, 21 bp, Homo sapiens
aggaggctgcatgctctggaa

SEQ ID NO: 915411 - DNA, 13 bp, Homo sapiens
aggaggctgccct

SEQ ID NO: 915412 - DNA, 15 bp, Homo sapiens
aggaggctgccctga

SEQ ID NO: 915413 - DNA, 12 bp, Homo sapiens
aggaggctggag

SEQ ID NO: 915414 - DNA, 18 bp, Homo sapiens
aggaggctggaggaaggg

SEQ ID NO: 915415 - DNA, 16 bp, Homo sapiens
aggaggctggtgacag

SEQ ID NO: 915416 - DNA, 20 bp, Homo sapiens
aggaggcttggaaagcatca

SEQ ID NO: 915417 - DNA, 15 bp, Homo sapiens
aggagggaaaccttt

SEQ ID NO: 915418 - DNA, 14 bp, Homo sapiens
aggagggacttggc

SEQ ID NO: 915419 - DNA, 18 bp, Homo sapiens
aggagggagaaaggagaa

SEQ ID NO: 915420 - DNA, 13 bp, Homo sapiens
aggagggagactg

SEQ ID NO: 915421 - DNA, 14 bp, Homo sapiens
aggagggagactgt

SEQ ID NO: 915422 - DNA, 13 bp, Homo sapiens
aggagggagaggg

SEQ ID NO: 915423 - DNA, 17 bp, Homo sapiens
aggagggagccttgtga

SEQ ID NO: 915424 - DNA, 19 bp, Homo sapiens
aggagggatgctgcctgag

SEQ ID NO: 915425 - DNA, 16 bp, Homo sapiens
aggagggcaagggcca

SEQ ID NO: 915426 - DNA, 12 bp, Homo sapiens
aggagggcactg

SEQ ID NO: 915427 - DNA, 22 bp, Homo sapiens
aggagggcactggagctgggag

SEQ ID NO: 915428 - DNA, 14 bp, Homo sapiens
aggagggcagagcc

SEQ ID NO: 915429 - DNA, 17 bp, Homo sapiens
aggagggcagagccatg

SEQ ID NO: 915430 - DNA, 14 bp, Homo sapiens
aggagggcagaggg

SEQ ID NO: 915431 - DNA, 18 bp, Homo sapiens
aggagggcatgggttggc

SEQ ID NO: 915432 - DNA, 13 bp, Homo sapiens
aggagggcccgga

SEQ ID NO: 915433 - DNA, 17 bp, Homo sapiens
aggagggcgtgactcac

SEQ ID NO: 915434 - DNA, 18 bp, Homo sapiens
aggaggggaaacaatgaa

SEQ ID NO: 915435 - DNA, 15 bp, Homo sapiens
aggaggggaagctgg

SEQ ID NO: 915436 - DNA, 14 bp, Homo sapiens
aggaggggcctggg

SEQ ID NO: 915437 - DNA, 16 bp, Homo sapiens
aggaggggcctgggca

SEQ ID NO: 915438 - DNA, 20 bp, Homo sapiens
aggaggggcctgggcagccc

SEQ ID NO: 915439 - DNA, 23 bp, Homo sapiens
aggaggggcctgggcagccccac

SEQ ID NO: 915440 - DNA, 16 bp, Homo sapiens
aggagggtgacgccca

SEQ ID NO: 915441 - DNA, 19 bp, Homo sapiens
aggagggtgacgcccagct

SEQ ID NO: 915442 - DNA, 18 bp, Homo sapiens
aggagggtggaggaaggt

SEQ ID NO: 915443 - DNA, 21 bp, Homo sapiens
aggagggtggaggaaggtgct

SEQ ID NO: 915444 - DNA, 21 bp, Homo sapiens
aggagggtgggggagggaggt

SEQ ID NO: 915445 - DNA, 18 bp, Homo sapiens
aggagggttagggagggg

SEQ ID NO: 915446 - DNA, 22 bp, Homo sapiens
aggaggtaatgaccatgaaaga

SEQ ID NO: 915447 - DNA, 21 bp, Homo sapiens
aggaggtcatctgaccttcac

SEQ ID NO: 915448 - DNA, 13 bp, Homo sapiens
aggaggtggagaa

SEQ ID NO: 915449 - DNA, 14 bp, Homo sapiens
aggaggtggcagcc

SEQ ID NO: 915450 - DNA, 18 bp, Homo sapiens
aggaggtggcagccctgt

SEQ ID NO: 915451 - DNA, 21 bp, Homo sapiens
aggaggtggcagccctgtagg

SEQ ID NO: 915452 - DNA, 23 bp, Homo sapiens
aggaggtggcagccctgtaggga

SEQ ID NO: 915453 - DNA, 13 bp, Homo sapiens
aggaggtgggcca

SEQ ID NO: 915454 - DNA, 19 bp, Homo sapiens
aggaggttctgggcctctg

SEQ ID NO: 915455 - DNA, 22 bp, Homo sapiens
aggaggttgggagggggttggg

SEQ ID NO: 915456 - DNA, 16 bp, Homo sapiens
aggaggttggtgactg

SEQ ID NO: 915457 - DNA, 17 bp, Homo sapiens
aggaggttggtgactga

SEQ ID NO: 915458 - DNA, 19 bp, Homo sapiens
aggaggttggtgactgaaa

SEQ ID NO: 915459 - DNA, 21 bp, Homo sapiens
aggaggttgtggatgctccag

SEQ ID NO: 915460 - DNA, 23 bp, Homo sapiens
aggaggttgtggatgctccaggg

SEQ ID NO: 915461 - DNA, 16 bp, Homo sapiens
aggaggtttgcctgtg

SEQ ID NO: 915462 - DNA, 14 bp, Homo sapiens
aggaggtttggatg

SEQ ID NO: 915463 - DNA, 23 bp, Homo sapiens
aggaggtttggggtctgccacca

SEQ ID NO: 915464 - DNA, 14 bp, Homo sapiens
aggagtaaaattca

SEQ ID NO: 915465 - DNA, 19 bp, Homo sapiens
aggagtaacaatacaaatg

SEQ ID NO: 915466 - DNA, 22 bp, Homo sapiens
aggagtaccgccagcagctgtc

SEQ ID NO: 915467 - DNA, 16 bp, Homo sapiens
aggagtcaactggctg

SEQ ID NO: 915468 - DNA, 21 bp, Homo sapiens
aggagtcaactggctggccag

SEQ ID NO: 915469 - DNA, 17 bp, Homo sapiens
aggagtcactgagacca

SEQ ID NO: 915470 - DNA, 20 bp, Homo sapiens
aggagtcaggggctctgtgt

SEQ ID NO: 915471 - DNA, 20 bp, Homo sapiens
aggagtccactttgtttcgt

SEQ ID NO: 915472 - DNA, 16 bp, Homo sapiens
aggagtcccaaggaaa

SEQ ID NO: 915473 - DNA, 15 bp, Homo sapiens
aggagtctctgccac

SEQ ID NO: 915474 - DNA, 18 bp, Homo sapiens
aggagtctctgccaccca

SEQ ID NO: 915475 - DNA, 20 bp, Homo sapiens
aggagtctctgccacccact

SEQ ID NO: 915476 - DNA, 20 bp, Homo sapiens
aggagtctgaggactgtcct

SEQ ID NO: 915477 - DNA, 17 bp, Homo sapiens
aggagtctgccacttgt

SEQ ID NO: 915478 - DNA, 21 bp, Homo sapiens
aggagtgagatcattttctta

SEQ ID NO: 915479 - DNA, 12 bp, Homo sapiens
aggagtgaggaa

SEQ ID NO: 915480 - DNA, 15 bp, Homo sapiens
aggagtgccaggacc

SEQ ID NO: 915481 - DNA, 17 bp, Homo sapiens
aggagtgccaggaccag

SEQ ID NO: 915482 - DNA, 18 bp, Homo sapiens
aggagtgccaggaccagc

SEQ ID NO: 915483 - DNA, 16 bp, Homo sapiens
aggagtgcccccggga

SEQ ID NO: 915484 - DNA, 14 bp, Homo sapiens
aggagtggccacag

SEQ ID NO: 915485 - DNA, 17 bp, Homo sapiens
aggagtggccacagcac

SEQ ID NO: 915486 - DNA, 18 bp, Homo sapiens
aggagtggccacagcacc

SEQ ID NO: 915487 - DNA, 12 bp, Homo sapiens
aggagtggttct

SEQ ID NO: 915488 - DNA, 14 bp, Homo sapiens
aggagtgtcctctt

SEQ ID NO: 915489 - DNA, 16 bp, Homo sapiens
aggagtgtgagaatca

SEQ ID NO: 915490 - DNA, 16 bp, Homo sapiens
aggagttaagagtagc

SEQ ID NO: 915491 - DNA, 19 bp, Homo sapiens
aggagttcctaaccagcct

SEQ ID NO: 915492 - DNA, 17 bp, Homo sapiens
aggagttcgaggctgca

SEQ ID NO: 915493 - DNA, 19 bp, Homo sapiens
aggagttctctgatgcaga

SEQ ID NO: 915494 - DNA, 20 bp, Homo sapiens
aggagttctctgatgcagaa

SEQ ID NO: 915495 - DNA, 14 bp, Homo sapiens
aggagttctcttcc

SEQ ID NO: 915496 - DNA, 23 bp, Homo sapiens
aggagttctcttccgcagcccct

SEQ ID NO: 915497 - DNA, 16 bp, Homo sapiens
aggagttgcctgactc

SEQ ID NO: 915498 - DNA, 22 bp, Homo sapiens
aggagttgcctgactcctgggt

SEQ ID NO: 915499 - DNA, 14 bp, Homo sapiens
aggagttgctgttt

SEQ ID NO: 915500 - DNA, 22 bp, Homo sapiens
aggagttgtttctgacccactg

SEQ ID NO: 915501 - DNA, 18 bp, Homo sapiens
aggagtttattacaatgt

SEQ ID NO: 915502 - DNA, 23 bp, Homo sapiens
aggagtttgagacaagccctggc

SEQ ID NO: 915503 - DNA, 14 bp, Homo sapiens
aggagtttggagga

SEQ ID NO: 915504 - DNA, 15 bp, Homo sapiens
aggagttttgcaaag

SEQ ID NO: 915505 - DNA, 19 bp, Homo sapiens
aggataaaaagccagggct

SEQ ID NO: 915506 - DNA, 22 bp, Homo sapiens
aggataaaaagccagggctgga

SEQ ID NO: 915507 - DNA, 17 bp, Homo sapiens
aggataaaaaggaagga

SEQ ID NO: 915508 - DNA, 12 bp, Homo sapiens
aggataaaataa

SEQ ID NO: 915509 - DNA, 18 bp, Homo sapiens
aggataacacaagtaaaa

SEQ ID NO: 915510 - DNA, 17 bp, Homo sapiens
aggataacttgctttct

SEQ ID NO: 915511 - DNA, 13 bp, Homo sapiens
aggataagaaagc

SEQ ID NO: 915512 - DNA, 16 bp, Homo sapiens
aggatacatttaataa

SEQ ID NO: 915513 - DNA, 22 bp, Homo sapiens
aggatacatttaataaaactgc

SEQ ID NO: 915514 - DNA, 20 bp, Homo sapiens
aggatacgacagtacactgt

SEQ ID NO: 915515 - DNA, 16 bp, Homo sapiens
aggatactctgtcaga

SEQ ID NO: 915516 - DNA, 18 bp, Homo sapiens
aggatactgtaacacttt

SEQ ID NO: 915517 - DNA, 22 bp, Homo sapiens
aggatactgtaacactttacaa

SEQ ID NO: 915518 - DNA, 15 bp, Homo sapiens
aggatagacactgga

SEQ ID NO: 915519 - DNA, 17 bp, Homo sapiens
aggatagacactggaca

SEQ ID NO: 915520 - DNA, 18 bp, Homo sapiens
aggatagacactggacat

SEQ ID NO: 915521 - DNA, 14 bp, Homo sapiens
aggatagcattttt

SEQ ID NO: 915522 - DNA, 23 bp, Homo sapiens
aggatagctaactgtaaatcatg

SEQ ID NO: 915523 - DNA, 20 bp, Homo sapiens
aggatagtagttaaataact

SEQ ID NO: 915524 - DNA, 18 bp, Homo sapiens
aggatatactgcagcttt

SEQ ID NO: 915525 - DNA, 15 bp, Homo sapiens
aggatatcagagctg

SEQ ID NO: 915526 - DNA, 23 bp, Homo sapiens
aggatatccttatcagagctaag

SEQ ID NO: 915527 - DNA, 17 bp, Homo sapiens
aggatatcggcatttgt

SEQ ID NO: 915528 - DNA, 23 bp, Homo sapiens
cagtcactggaggttgaagccaa

SEQ ID NO: 915529 - DNA, 21 bp, Homo sapiens
cagtcactgtccctcaaatga

SEQ ID NO: 915530 - DNA, 13 bp, Homo sapiens
cagtcactgtgat

SEQ ID NO: 915531 - DNA, 14 bp, Homo sapiens
cagtcaggcccagg

SEQ ID NO: 915532 - DNA, 13 bp, Homo sapiens
cagtcaggggctg

SEQ ID NO: 915533 - DNA, 23 bp, Homo sapiens
cagtcaggggctgggcatcccag

SEQ ID NO: 915534 - DNA, 21 bp, Homo sapiens
cagtcaggtagttgcaattga

SEQ ID NO: 915535 - DNA, 16 bp, Homo sapiens
cagtcagtaattgcca

SEQ ID NO: 915536 - DNA, 20 bp, Homo sapiens
cagtcagttcccggagcaca

SEQ ID NO: 915537 - DNA, 21 bp, Homo sapiens
cagtcagttcccggagcacag

SEQ ID NO: 915538 - DNA, 18 bp, Homo sapiens
cagtcataaatactgtca

SEQ ID NO: 915539 - DNA, 14 bp, Homo sapiens
cagtcatcctgccc

SEQ ID NO: 915540 - DNA, 17 bp, Homo sapiens
cagtcatcctgccctgc

SEQ ID NO: 915541 - DNA, 19 bp, Homo sapiens
cagtcatcctgccctgcag

SEQ ID NO: 915542 - DNA, 14 bp, Homo sapiens
cagtcatctgtctt

SEQ ID NO: 915543 - DNA, 24 bp, Homo sapiens
cagtcatggcaccaaagccaccag

SEQ ID NO: 915544 - DNA, 21 bp, Homo sapiens
cagtcatggcctgagatgcag

SEQ ID NO: 915545 - DNA, 17 bp, Homo sapiens
cagtcatgtatgcaagt

SEQ ID NO: 915546 - DNA, 13 bp, Homo sapiens
cagtcattatgag

SEQ ID NO: 915547 - DNA, 22 bp, Homo sapiens
cagtcattcagcagcaaatttt

SEQ ID NO: 915548 - DNA, 17 bp, Homo sapiens
cagtcattggctgtctc

SEQ ID NO: 915549 - DNA, 16 bp, Homo sapiens
cagtcatttgtggtta

SEQ ID NO: 915550 - DNA, 21 bp, Homo sapiens
cagtccaaatgtcctccagaa

SEQ ID NO: 915551 - DNA, 11 bp, Homo sapiens
cagtccacagc

SEQ ID NO: 915552 - DNA, 13 bp, Homo sapiens
cagtccacagctg

SEQ ID NO: 915553 - DNA, 21 bp, Homo sapiens
cagtccacagctgaagagcaa

SEQ ID NO: 915554 - DNA, 14 bp, Homo sapiens
cagtccacaggggc

SEQ ID NO: 915555 - DNA, 20 bp, Homo sapiens
cagtccacaggggccaccac

SEQ ID NO: 915556 - DNA, 20 bp, Homo sapiens
cagtccacctgaggaactgt

SEQ ID NO: 915557 - DNA, 23 bp, Homo sapiens
cagtccacctgaggaactgtctc

SEQ ID NO: 915558 - DNA, 12 bp, Homo sapiens
cagtccactgtt

SEQ ID NO: 915559 - DNA, 10 bp, Homo sapiens
cagtccagag

SEQ ID NO: 915560 - DNA, 12 bp, Homo sapiens
cagtccagagct

SEQ ID NO: 915561 - DNA, 13 bp, Homo sapiens
cagtccagagctt

SEQ ID NO: 915562 - DNA, 18 bp, Homo sapiens
cagtccaggctgccgtgg

SEQ ID NO: 915563 - DNA, 19 bp, Homo sapiens
cagtcccatcagagagcga

SEQ ID NO: 915564 - DNA, 12 bp, Homo sapiens
cagtccccaccc

SEQ ID NO: 915565 - DNA, 18 bp, Homo sapiens
cagtccccacccctgccc

SEQ ID NO: 915566 - DNA, 21 bp, Homo sapiens
cagtccccacccctgccccca

SEQ ID NO: 915567 - DNA, 14 bp, Homo sapiens
cagtccccagccct

SEQ ID NO: 915568 - DNA, 15 bp, Homo sapiens
cagtccccagccctt

SEQ ID NO: 915569 - DNA, 17 bp, Homo sapiens
cagtccccagcccttct

SEQ ID NO: 915570 - DNA, 20 bp, Homo sapiens
cagtccccatttctgcctcg

SEQ ID NO: 915571 - DNA, 20 bp, Homo sapiens
cagtcccccaccacactgaa

SEQ ID NO: 915572 - DNA, 19 bp, Homo sapiens
cagtcccccacccacctcc

SEQ ID NO: 915573 - DNA, 22 bp, Homo sapiens
cagtcccccacccacctcctgc

SEQ ID NO: 915574 - DNA, 23 bp, Homo sapiens
cagtcccccacccacctcctgcg

SEQ ID NO: 915575 - DNA, 17 bp, Homo sapiens
cagtccccctgccccag

SEQ ID NO: 915576 - DNA, 13 bp, Homo sapiens
cagtccccgagga

SEQ ID NO: 915577 - DNA, 12 bp, Homo sapiens
cagtcccctccc

SEQ ID NO: 915578 - DNA, 15 bp, Homo sapiens
cagtcccctcccatc

SEQ ID NO: 915579 - DNA, 20 bp, Homo sapiens
cagtccctgggggaagccct

SEQ ID NO: 915580 - DNA, 15 bp, Homo sapiens
cagtcctactcaagc

SEQ ID NO: 915581 - DNA, 20 bp, Homo sapiens
cagtcctactcaagcgggtg

SEQ ID NO: 915582 - DNA, 17 bp, Homo sapiens
cagtcctatgtacagag

SEQ ID NO: 915583 - DNA, 20 bp, Homo sapiens
cagtcctccagaccaccagc

SEQ ID NO: 915584 - DNA, 15 bp, Homo sapiens
cagtcctccatccac

SEQ ID NO: 915585 - DNA, 16 bp, Homo sapiens
cagtcctcctgggagc

SEQ ID NO: 915586 - DNA, 12 bp, Homo sapiens
cagtcctgcctg

SEQ ID NO: 915587 - DNA, 14 bp, Homo sapiens
cagtcctgcctggc

SEQ ID NO: 915588 - DNA, 18 bp, Homo sapiens
cagtcctgcctggccagg

SEQ ID NO: 915589 - DNA, 13 bp, Homo sapiens
cagtcctgctcca

SEQ ID NO: 915590 - DNA, 17 bp, Homo sapiens
cagtcctggaagccagc

SEQ ID NO: 915591 - DNA, 22 bp, Homo sapiens
cagtcctggaagccagctttcc

SEQ ID NO: 915592 - DNA, 12 bp, Homo sapiens
cagtcctgggag

SEQ ID NO: 915593 - DNA, 11 bp, Homo sapiens
cagtcctgggt

SEQ ID NO: 915594 - DNA, 23 bp, Homo sapiens
cagtcctgggttgtttccaggag

SEQ ID NO: 915595 - DNA, 18 bp, Homo sapiens
cagtcctggtcctggctg

SEQ ID NO: 915596 - DNA, 22 bp, Homo sapiens
cagtcctggtcctggctgcact

SEQ ID NO: 915597 - DNA, 23 bp, Homo sapiens
cagtcctggtcctggctgcactc

SEQ ID NO: 915598 - DNA, 13 bp, Homo sapiens
cagtcctgttcaa

SEQ ID NO: 915599 - DNA, 15 bp, Homo sapiens
cagtcctgttcagaa

SEQ ID NO: 915600 - DNA, 20 bp, Homo sapiens
cagtccttactcccccacca

SEQ ID NO: 915601 - DNA, 15 bp, Homo sapiens
cagtccttccacctc

SEQ ID NO: 915602 - DNA, 16 bp, Homo sapiens
cagtcctttcccacca

SEQ ID NO: 915603 - DNA, 15 bp, Homo sapiens
cagtcgatagagctg

SEQ ID NO: 915604 - DNA, 16 bp, Homo sapiens
cagtcgatagagctgt

SEQ ID NO: 915605 - DNA, 21 bp, Homo sapiens
cagtcgcaggatccgctgcca

SEQ ID NO: 915606 - DNA, 16 bp, Homo sapiens
cagtcgctcagtctgt

SEQ ID NO: 915607 - DNA, 20 bp, Homo sapiens
cagtcgctcagtctgttcac

SEQ ID NO: 915608 - DNA, 16 bp, Homo sapiens
cagtcggcatgccagg

SEQ ID NO: 915609 - DNA, 18 bp, Homo sapiens
cagtcggcatgccaggac

SEQ ID NO: 915610 - DNA, 19 bp, Homo sapiens
cagtcggtgaccccatcac

SEQ ID NO: 915611 - DNA, 18 bp, Homo sapiens
cagtcgtgatgtggagga

SEQ ID NO: 915612 - DNA, 13 bp, Homo sapiens
cagtcgtgcctgt

SEQ ID NO: 915613 - DNA, 17 bp, Homo sapiens
cagtcgtgcctgtgtcc

SEQ ID NO: 915614 - DNA, 14 bp, Homo sapiens
cagtcgttcccagt

SEQ ID NO: 915615 - DNA, 18 bp, Homo sapiens
cagtctaaaaattgatag

SEQ ID NO: 915616 - DNA, 21 bp, Homo sapiens
cagtctaacagtttgcctgct

SEQ ID NO: 915617 - DNA, 21 bp, Homo sapiens
cagtctacattgagcatttga

SEQ ID NO: 915618 - DNA, 16 bp, Homo sapiens
cagtctaccctgtcct

SEQ ID NO: 915619 - DNA, 18 bp, Homo sapiens
cagtctaccctgtccttt

SEQ ID NO: 915620 - DNA, 22 bp, Homo sapiens
cagtctcactgcagtcttattt

SEQ ID NO: 915621 - DNA, 23 bp, Homo sapiens
cagtctcactgtgggaaggccag

SEQ ID NO: 915622 - DNA, 12 bp, Homo sapiens
cagtctcagaga

SEQ ID NO: 915623 - DNA, 15 bp, Homo sapiens
cagtctcagagacca

SEQ ID NO: 915624 - DNA, 18 bp, Homo sapiens
cagtctcagagaccagca

SEQ ID NO: 915625 - DNA, 20 bp, Homo sapiens
cagtctcagagaccagcact

SEQ ID NO: 915626 - DNA, 17 bp, Homo sapiens
cagtctcatctcctgac

SEQ ID NO: 915627 - DNA, 23 bp, Homo sapiens
cagtctcatctcctgaccctccc

SEQ ID NO: 915628 - DNA, 16 bp, Homo sapiens
cagtctccagggaccc

SEQ ID NO: 915629 - DNA, 22 bp, Homo sapiens
cagtctccagggacccttgcct

SEQ ID NO: 915630 - DNA, 13 bp, Homo sapiens
cagtctcccaggc

SEQ ID NO: 915631 - DNA, 14 bp, Homo sapiens
cagtctcccaggcc

SEQ ID NO: 915632 - DNA, 23 bp, Homo sapiens
cagtctcccaggccccctgcatc

SEQ ID NO: 915633 - DNA, 21 bp, Homo sapiens
cagtctccctgatggaccctc

SEQ ID NO: 915634 - DNA, 15 bp, Homo sapiens
cagtctcctcactct

SEQ ID NO: 915635 - DNA, 19 bp, Homo sapiens
cagtctcctcactctgtcc

SEQ ID NO: 915636 - DNA, 18 bp, Homo sapiens
cagtctctcttaaagttg

SEQ ID NO: 915637 - DNA, 17 bp, Homo sapiens
cagtctctcttctctcc

SEQ ID NO: 915638 - DNA, 20 bp, Homo sapiens
cagtctctttcttcctttct

SEQ ID NO: 915639 - DNA, 21 bp, Homo sapiens
cagtctctttcttcctttcta

SEQ ID NO: 915640 - DNA, 16 bp, Homo sapiens
cagtctgaatgctgcc

SEQ ID NO: 915641 - DNA, 18 bp, Homo sapiens
cagtctgaatgctgccac

SEQ ID NO: 915642 - DNA, 12 bp, Homo sapiens
cagtctgaccct

SEQ ID NO: 915643 - DNA, 15 bp, Homo sapiens
cagtctgatctgtga

SEQ ID NO: 915644 - DNA, 21 bp, Homo sapiens
cagtctgattataccatgtgt

SEQ ID NO: 915645 - DNA, 20 bp, Homo sapiens
cagtctgcccacgcagagga

SEQ ID NO: 915646 - DNA, 21 bp, Homo sapiens
cagtctgcccacgcagaggac

SEQ ID NO: 915647 - DNA, 18 bp, Homo sapiens
cagtctgctccaccaagg

SEQ ID NO: 915648 - DNA, 12 bp, Homo sapiens
cagtctgctgcc

SEQ ID NO: 915649 - DNA, 18 bp, Homo sapiens
cagtctgctgccctccat

SEQ ID NO: 915650 - DNA, 14 bp, Homo sapiens
cagtctggagagct

SEQ ID NO: 915651 - DNA, 18 bp, Homo sapiens
cagtctgggtctgggttt

SEQ ID NO: 915652 - DNA, 23 bp, Homo sapiens
cagtctgggtctgggtttggatc

SEQ ID NO: 915653 - DNA, 16 bp, Homo sapiens
aggctgtcctgtacat

SEQ ID NO: 915654 - DNA, 21 bp, Homo sapiens
aggctgtcctgtacattgtgg

SEQ ID NO: 915655 - DNA, 15 bp, Homo sapiens
aggctgtctggggcc

SEQ ID NO: 915656 - DNA, 17 bp, Homo sapiens
aggctgtctgtgccatg

SEQ ID NO: 915657 - DNA, 22 bp, Homo sapiens
aggctgtctgtgccatggcccc

SEQ ID NO: 915658 - DNA, 13 bp, Homo sapiens
aggctgtggagag

SEQ ID NO: 915659 - DNA, 15 bp, Homo sapiens
aggctgtgggcctca

SEQ ID NO: 915660 - DNA, 12 bp, Homo sapiens
aggctgtggggt

SEQ ID NO: 915661 - DNA, 22 bp, Homo sapiens
aggctgtggggtctggctgtgt

SEQ ID NO: 915662 - DNA, 14 bp, Homo sapiens
aggctgtggggtgg

SEQ ID NO: 915663 - DNA, 16 bp, Homo sapiens
aggctgtggggtgggc

SEQ ID NO: 915664 - DNA, 15 bp, Homo sapiens
aggctgtgtggccaa

SEQ ID NO: 915665 - DNA, 22 bp, Homo sapiens
aggctgtgtggccaaccaggac

SEQ ID NO: 915666 - DNA, 15 bp, Homo sapiens
aggctgttaccattt

SEQ ID NO: 915667 - DNA, 21 bp, Homo sapiens
aggctgttccatgttctattt

SEQ ID NO: 915668 - DNA, 22 bp, Homo sapiens
aggctgttccatgttctatttt

SEQ ID NO: 915669 - DNA, 13 bp, Homo sapiens
aggctgttccctt

SEQ ID NO: 915670 - DNA, 15 bp, Homo sapiens
aggctgttccctttg

SEQ ID NO: 915671 - DNA, 19 bp, Homo sapiens
aggctgttccctttgcctt

SEQ ID NO: 915672 - DNA, 17 bp, Homo sapiens
aggctgttctcgaactc

SEQ ID NO: 915673 - DNA, 23 bp, Homo sapiens
aggctgttggaaaatccagaact

SEQ ID NO: 915674 - DNA, 18 bp, Homo sapiens
aggcttaatacctgggtg

SEQ ID NO: 915675 - DNA, 15 bp, Homo sapiens
aggcttaggcctctc

SEQ ID NO: 915676 - DNA, 23 bp, Homo sapiens
aggcttagggacaggaccccagc

SEQ ID NO: 915677 - DNA, 16 bp, Homo sapiens
aggcttaggtgccagg

SEQ ID NO: 915678 - DNA, 15 bp, Homo sapiens
aggcttagtttgtgt

SEQ ID NO: 915679 - DNA, 13 bp, Homo sapiens
aggcttccagaga

SEQ ID NO: 915680 - DNA, 13 bp, Homo sapiens
aggcttccaggct

SEQ ID NO: 915681 - DNA, 14 bp, Homo sapiens
aggcttccaggctc

SEQ ID NO: 915682 - DNA, 16 bp, Homo sapiens
aggcttccaggctctt

SEQ ID NO: 915683 - DNA, 18 bp, Homo sapiens
aggcttccaggctcttcc

SEQ ID NO: 915684 - DNA, 10 bp, Homo sapiens
aggcttccgc

SEQ ID NO: 915685 - DNA, 18 bp, Homo sapiens
aggcttccgtgtcctctc

SEQ ID NO: 915686 - DNA, 21 bp, Homo sapiens
aggcttcctgcgtcctcctca

SEQ ID NO: 915687 - DNA, 22 bp, Homo sapiens
aggcttcctgcgtcctcctcac

SEQ ID NO: 915688 - DNA, 13 bp, Homo sapiens
aggcttctaataa

SEQ ID NO: 915689 - DNA, 15 bp, Homo sapiens
aggcttctccgccag

SEQ ID NO: 915690 - DNA, 18 bp, Homo sapiens
aggcttctccgccagcct

SEQ ID NO: 915691 - DNA, 12 bp, Homo sapiens
aggcttctcctt

SEQ ID NO: 915692 - DNA, 16 bp, Homo sapiens
aggcttctccttctcc

SEQ ID NO: 915693 - DNA, 12 bp, Homo sapiens
aggcttctctcc

SEQ ID NO: 915694 - DNA, 13 bp, Homo sapiens
aggcttctctcca

SEQ ID NO: 915695 - DNA, 16 bp, Homo sapiens
aggcttctctctgtgg

SEQ ID NO: 915696 - DNA, 16 bp, Homo sapiens
aggcttcttcagatca

SEQ ID NO: 915697 - DNA, 22 bp, Homo sapiens
aggcttcttcagatcagtgctt

SEQ ID NO: 915698 - DNA, 20 bp, Homo sapiens
aggcttcttccttcttgtca

SEQ ID NO: 915699 - DNA, 15 bp, Homo sapiens
aggcttgcctgggct

SEQ ID NO: 915700 - DNA, 16 bp, Homo sapiens
aggcttgcctgggctg

SEQ ID NO: 915701 - DNA, 15 bp, Homo sapiens
aggcttgtcagagct

SEQ ID NO: 915702 - DNA, 18 bp, Homo sapiens
aggcttgtcagagctggg

SEQ ID NO: 915703 - DNA, 20 bp, Homo sapiens
aggcttgtcagagctgggag

SEQ ID NO: 915704 - DNA, 17 bp, Homo sapiens
aggctttaagctccagc

SEQ ID NO: 915705 - DNA, 18 bp, Homo sapiens
aggctttagtgtatttat

SEQ ID NO: 915706 - DNA, 19 bp, Homo sapiens
aggctttgccatgggcctg

SEQ ID NO: 915707 - DNA, 21 bp, Homo sapiens
aggctttgccatgggcctgct

SEQ ID NO: 915708 - DNA, 19 bp, Homo sapiens
aggctttggatttgacatt

SEQ ID NO: 915709 - DNA, 23 bp, Homo sapiens
aggctttgggtggctcactactg

SEQ ID NO: 915710 - DNA, 20 bp, Homo sapiens
aggcttttatatatgaagtt

SEQ ID NO: 915711 - DNA, 20 bp, Homo sapiens
aggcttttctgcctgctcct

SEQ ID NO: 915712 - DNA, 22 bp, Homo sapiens
aggcttttgtttcctttttcag

SEQ ID NO: 915713 - DNA, 11 bp, Homo sapiens
agggaaaaaag

SEQ ID NO: 915714 - DNA, 19 bp, Homo sapiens
agggaaaaaagaaagaaaa

SEQ ID NO: 915715 - DNA, 12 bp, Homo sapiens
agggaaaaagag

SEQ ID NO: 915716 - DNA, 14 bp, Homo sapiens
agggaaaaatatat

SEQ ID NO: 915717 - DNA, 22 bp, Homo sapiens
agggaaaagataaagaccagaa

SEQ ID NO: 915718 - DNA, 16 bp, Homo sapiens
agggaaaagcagctct

SEQ ID NO: 915719 - DNA, 14 bp, Homo sapiens
agggaaaagggaag

SEQ ID NO: 915720 - DNA, 17 bp, Homo sapiens
agggaaaatgcagcagg

SEQ ID NO: 915721 - DNA, 18 bp, Homo sapiens
agggaaaattatttgcat

SEQ ID NO: 915722 - DNA, 11 bp, Homo sapiens
agggaaacctt

SEQ ID NO: 915723 - DNA, 15 bp, Homo sapiens
agggaaaccttggag

SEQ ID NO: 915724 - DNA, 19 bp, Homo sapiens
agggaaaccttggagagga

SEQ ID NO: 915725 - DNA, 19 bp, Homo sapiens
agggaaactaagattcttt

SEQ ID NO: 915726 - DNA, 16 bp, Homo sapiens
agggaaactattgtcc

SEQ ID NO: 915727 - DNA, 19 bp, Homo sapiens
agggaaactcagatgtcca

SEQ ID NO: 915728 - DNA, 15 bp, Homo sapiens
agggaaacttcccgt

SEQ ID NO: 915729 - DNA, 12 bp, Homo sapiens
agggaaagaaaa

SEQ ID NO: 915730 - DNA, 13 bp, Homo sapiens
agggaaagcgggc

SEQ ID NO: 915731 - DNA, 18 bp, Homo sapiens
agggaaaggatattttct

SEQ ID NO: 915732 - DNA, 15 bp, Homo sapiens
agggaaaggttttgt

SEQ ID NO: 915733 - DNA, 17 bp, Homo sapiens
agggaaaggttttgtat

SEQ ID NO: 915734 - DNA, 15 bp, Homo sapiens
agggaaatatcattt

SEQ ID NO: 915735 - DNA, 23 bp, Homo sapiens
agggaacaatttggcaattttgt

SEQ ID NO: 915736 - DNA, 10 bp, Homo sapiens
agggaacaca

SEQ ID NO: 915737 - DNA, 18 bp, Homo sapiens
agggaacactcatccctg

SEQ ID NO: 915738 - DNA, 14 bp, Homo sapiens
agggaacagacagg

SEQ ID NO: 915739 - DNA, 18 bp, Homo sapiens
agggaacagacaggagaa

SEQ ID NO: 915740 - DNA, 20 bp, Homo sapiens
agggaacagacaggagaaat

SEQ ID NO: 915741 - DNA, 16 bp, Homo sapiens
agggaaccaccagcgt

SEQ ID NO: 915742 - DNA, 19 bp, Homo sapiens
agggaactgcttgcccagg

SEQ ID NO: 915743 - DNA, 13 bp, Homo sapiens
agggaactgggga

SEQ ID NO: 915744 - DNA, 12 bp, Homo sapiens
agggaagaaact

SEQ ID NO: 915745 - DNA, 13 bp, Homo sapiens
agggaagaacatt

SEQ ID NO: 915746 - DNA, 15 bp, Homo sapiens
agggaagacaggtct

SEQ ID NO: 915747 - DNA, 12 bp, Homo sapiens
agggaagaccag

SEQ ID NO: 915748 - DNA, 14 bp, Homo sapiens
agggaagagacagc

SEQ ID NO: 915749 - DNA, 14 bp, Homo sapiens
agggaagagggaga

SEQ ID NO: 915750 - DNA, 13 bp, Homo sapiens
agggaagagggca

SEQ ID NO: 915751 - DNA, 16 bp, Homo sapiens
agggaagagggcagta

SEQ ID NO: 915752 - DNA, 14 bp, Homo sapiens
agggaagcagggac

SEQ ID NO: 915753 - DNA, 23 bp, Homo sapiens
agggaagctggcctgagagggga

SEQ ID NO: 915754 - DNA, 13 bp, Homo sapiens
agggaaggagccc

SEQ ID NO: 915755 - DNA, 15 bp, Homo sapiens
agggaaggatttaag

SEQ ID NO: 915756 - DNA, 15 bp, Homo sapiens
agggaaggcaaaggc

SEQ ID NO: 915757 - DNA, 18 bp, Homo sapiens
agggaagggccaccctgc

SEQ ID NO: 915758 - DNA, 19 bp, Homo sapiens
agggaagggccaccctgct

SEQ ID NO: 915759 - DNA, 20 bp, Homo sapiens
agggaagggccaccctgctg

SEQ ID NO: 915760 - DNA, 13 bp, Homo sapiens
agggaagggcctg

SEQ ID NO: 915761 - DNA, 17 bp, Homo sapiens
agggaaggggatggagg

SEQ ID NO: 915762 - DNA, 22 bp, Homo sapiens
agggaaggggatggaggccaga

SEQ ID NO: 915763 - DNA, 13 bp, Homo sapiens
agggaaggtggcc

SEQ ID NO: 915764 - DNA, 15 bp, Homo sapiens
agggaagtgaggccc

SEQ ID NO: 915765 - DNA, 16 bp, Homo sapiens
agggaagtgaggccca

SEQ ID NO: 915766 - DNA, 13 bp, Homo sapiens
agggaagtggagg

SEQ ID NO: 915767 - DNA, 15 bp, Homo sapiens
agggaatccaagcct

SEQ ID NO: 915768 - DNA, 18 bp, Homo sapiens
agggaatcctcctccagg

SEQ ID NO: 915769 - DNA, 18 bp, Homo sapiens
agggaatgcctggagggt

SEQ ID NO: 915770 - DNA, 23 bp, Homo sapiens
agggaatgttccctgcaccctgg

SEQ ID NO: 915771 - DNA, 20 bp, Homo sapiens
agggaattcgatgcccccct

SEQ ID NO: 915772 - DNA, 21 bp, Homo sapiens
agggaatttcttcaactccct

SEQ ID NO: 915773 - DNA, 18 bp, Homo sapiens
agggacacatgcccctcc

SEQ ID NO: 915774 - DNA, 19 bp, Homo sapiens
agggacacatgcccctccc

SEQ ID NO: 915775 - DNA, 21 bp, Homo sapiens
agggacacatgcccctccccc

SEQ ID NO: 915776 - DNA, 20 bp, Homo sapiens
agggacagaaaccaaggccc

SEQ ID NO: 915777 - DNA, 20 bp, Homo sapiens
agggacagagacacctgcac

SEQ ID NO: 915778 - DNA, 12 bp, Homo sapiens
agggacagaggc

SEQ ID NO: 915779 - DNA, 23 bp, Homo sapiens
cagtctgtagggagtgaagccac

SEQ ID NO: 915780 - DNA, 12 bp, Homo sapiens
cagtctgtcatg

SEQ ID NO: 915781 - DNA, 23 bp, Homo sapiens
cagtctgtcatgaacatgttcct

SEQ ID NO: 915782 - DNA, 15 bp, Homo sapiens
cagtctgttcactgc

SEQ ID NO: 915783 - DNA, 21 bp, Homo sapiens
cagtctgttcactgcattcac

SEQ ID NO: 915784 - DNA, 23 bp, Homo sapiens
cagtcttatagcaagactgttag

SEQ ID NO: 915785 - DNA, 21 bp, Homo sapiens
cagtcttccacaaagaaaatt

SEQ ID NO: 915786 - DNA, 13 bp, Homo sapiens
cagtcttcctgac

SEQ ID NO: 915787 - DNA, 17 bp, Homo sapiens
cagtcttccttgtctct

SEQ ID NO: 915788 - DNA, 16 bp, Homo sapiens
cagtcttctcatgaat

SEQ ID NO: 915789 - DNA, 15 bp, Homo sapiens
cagtcttgaatttct

SEQ ID NO: 915790 - DNA, 13 bp, Homo sapiens
cagtcttgcctag

SEQ ID NO: 915791 - DNA, 15 bp, Homo sapiens
cagtcttgcctaggc

SEQ ID NO: 915792 - DNA, 18 bp, Homo sapiens
cagtcttgcctaggccaa

SEQ ID NO: 915793 - DNA, 13 bp, Homo sapiens
cagtcttgtgctt

SEQ ID NO: 915794 - DNA, 21 bp, Homo sapiens
cagtctttaaaggcccagccc

SEQ ID NO: 915795 - DNA, 22 bp, Homo sapiens
cagtctttaaaggcccagcccc

SEQ ID NO: 915796 - DNA, 23 bp, Homo sapiens
cagtctttaaaggcccagcccct

SEQ ID NO: 915797 - DNA, 23 bp, Homo sapiens
cagtcttttgaggtaagtggaat

SEQ ID NO: 915798 - DNA, 14 bp, Homo sapiens
cagtcttttgtcct

SEQ ID NO: 915799 - DNA, 19 bp, Homo sapiens
cagtgaaacgcaattttac

SEQ ID NO: 915800 - DNA, 15 bp, Homo sapiens
cagtgaaattttcag

SEQ ID NO: 915801 - DNA, 14 bp, Homo sapiens
cagtgaacattccc

SEQ ID NO: 915802 - DNA, 14 bp, Homo sapiens
cagtgaaccaaaga

SEQ ID NO: 915803 - DNA, 20 bp, Homo sapiens
cagtgaactcctgccaggca

SEQ ID NO: 915804 - DNA, 21 bp, Homo sapiens
cagtgaactcctgccaggcac

SEQ ID NO: 915805 - DNA, 17 bp, Homo sapiens
cagtgaagcagcactgt

SEQ ID NO: 915806 - DNA, 18 bp, Homo sapiens
cagtgaagcagcactgtg

SEQ ID NO: 915807 - DNA, 22 bp, Homo sapiens
cagtgaaggagccacgtgaatg

SEQ ID NO: 915808 - DNA, 24 bp, Homo sapiens
cagtgaaggtctttgttatgacag

SEQ ID NO: 915809 - DNA, 23 bp, Homo sapiens
cagtgaaggtggggagaagctga

SEQ ID NO: 915810 - DNA, 17 bp, Homo sapiens
cagtgaatgattcagtg

SEQ ID NO: 915811 - DNA, 17 bp, Homo sapiens
cagtgaatttgtccatt

SEQ ID NO: 915812 - DNA, 14 bp, Homo sapiens
cagtgacacccaga

SEQ ID NO: 915813 - DNA, 22 bp, Homo sapiens
cagtgacactaaaacaagagga

SEQ ID NO: 915814 - DNA, 19 bp, Homo sapiens
cagtgacacttcagagagc

SEQ ID NO: 915815 - DNA, 22 bp, Homo sapiens
cagtgacacttcagagagctgg

SEQ ID NO: 915816 - DNA, 16 bp, Homo sapiens
cagtgacagacaggct

SEQ ID NO: 915817 - DNA, 19 bp, Homo sapiens
cagtgacctttgacctcgg

SEQ ID NO: 915818 - DNA, 16 bp, Homo sapiens
cagtgacgtgcacctg

SEQ ID NO: 915819 - DNA, 17 bp, Homo sapiens
cagtgacgtgcacctgt

SEQ ID NO: 915820 - DNA, 18 bp, Homo sapiens
cagtgactccctgggagc

SEQ ID NO: 915821 - DNA, 22 bp, Homo sapiens
cagtgacttggccccagacgca

SEQ ID NO: 915822 - DNA, 15 bp, Homo sapiens
cagtgacttgttctg

SEQ ID NO: 915823 - DNA, 11 bp, Homo sapiens
cagtgactttg

SEQ ID NO: 915824 - DNA, 22 bp, Homo sapiens
cagtgactttgtatagagaatt

SEQ ID NO: 915825 - DNA, 20 bp, Homo sapiens
cagtgactttttctgagctt

SEQ ID NO: 915826 - DNA, 18 bp, Homo sapiens
cagtgagaagctgaggcc

SEQ ID NO: 915827 - DNA, 22 bp, Homo sapiens
cagtgagaagctgaggcctatg

SEQ ID NO: 915828 - DNA, 16 bp, Homo sapiens
cagtgagacagtctgg

SEQ ID NO: 915829 - DNA, 20 bp, Homo sapiens
cagtgagactgcaggtgggc

SEQ ID NO: 915830 - DNA, 18 bp, Homo sapiens
cagtgagaggggagggct

SEQ ID NO: 915831 - DNA, 19 bp, Homo sapiens
cagtgagaggggagggctc

SEQ ID NO: 915832 - DNA, 23 bp, Homo sapiens
cagtgagaggggagggctcctgg

SEQ ID NO: 915833 - DNA, 21 bp, Homo sapiens
cagtgagatagaatacatgta

SEQ ID NO: 915834 - DNA, 14 bp, Homo sapiens
cagtgagatgaggg

SEQ ID NO: 915835 - DNA, 20 bp, Homo sapiens
cagtgagatgagggatgggc

SEQ ID NO: 915836 - DNA, 17 bp, Homo sapiens
cagtgagcagggtgggg

SEQ ID NO: 915837 - DNA, 22 bp, Homo sapiens
cagtgagcagggtggggtctgg

SEQ ID NO: 915838 - DNA, 14 bp, Homo sapiens
cagtgagcatatct

SEQ ID NO: 915839 - DNA, 15 bp, Homo sapiens
cagtgagcatatctg

SEQ ID NO: 915840 - DNA, 18 bp, Homo sapiens
cagtgagcccctccccag

SEQ ID NO: 915841 - DNA, 21 bp, Homo sapiens
cagtgaggaaccctgatctct

SEQ ID NO: 915842 - DNA, 20 bp, Homo sapiens
cagtgaggactcggccactg

SEQ ID NO: 915843 - DNA, 23 bp, Homo sapiens
cagtgaggactcggccactgtgt

SEQ ID NO: 915844 - DNA, 13 bp, Homo sapiens
cagtgaggagggt

SEQ ID NO: 915845 - DNA, 21 bp, Homo sapiens
cagtgaggagggtggaggaag

SEQ ID NO: 915846 - DNA, 21 bp, Homo sapiens
cagtgaggcccagggagaggc

SEQ ID NO: 915847 - DNA, 23 bp, Homo sapiens
cagtgagggtcttcttacatgca

SEQ ID NO: 915848 - DNA, 18 bp, Homo sapiens
cagtgagtctcttcagaa

SEQ ID NO: 915849 - DNA, 13 bp, Homo sapiens
cagtgagtgccat

SEQ ID NO: 915850 - DNA, 17 bp, Homo sapiens
cagtgagtgccatgctt

SEQ ID NO: 915851 - DNA, 19 bp, Homo sapiens
cagtgagtgtaaataattt

SEQ ID NO: 915852 - DNA, 18 bp, Homo sapiens
cagtgagttgggattgga

SEQ ID NO: 915853 - DNA, 15 bp, Homo sapiens
cagtgataggcccaa

SEQ ID NO: 915854 - DNA, 17 bp, Homo sapiens
cagtgatctcagggcag

SEQ ID NO: 915855 - DNA, 16 bp, Homo sapiens
cagtgatctccatatg

SEQ ID NO: 915856 - DNA, 17 bp, Homo sapiens
cagtgatgaatgtacta

SEQ ID NO: 915857 - DNA, 17 bp, Homo sapiens
cagtgatgccgggcgcc

SEQ ID NO: 915858 - DNA, 18 bp, Homo sapiens
cagtgatgccgggcgcca

SEQ ID NO: 915859 - DNA, 22 bp, Homo sapiens
cagtgatgcttttagttttaaa

SEQ ID NO: 915860 - DNA, 21 bp, Homo sapiens
cagtgatggcgcgggaggcac

SEQ ID NO: 915861 - DNA, 22 bp, Homo sapiens
cagtgatggcgcgggaggcacc

SEQ ID NO: 915862 - DNA, 16 bp, Homo sapiens
cagtgattgtcttaat

SEQ ID NO: 915863 - DNA, 11 bp, Homo sapiens
cagtgatttcc

SEQ ID NO: 915864 - DNA, 15 bp, Homo sapiens
cagtgcaaaccactt

SEQ ID NO: 915865 - DNA, 17 bp, Homo sapiens
cagtgcaacagcactgg

SEQ ID NO: 915866 - DNA, 21 bp, Homo sapiens
cagtgcacctccctccccagc

SEQ ID NO: 915867 - DNA, 16 bp, Homo sapiens
cagtgcacctgcctca

SEQ ID NO: 915868 - DNA, 13 bp, Homo sapiens
cagtgcagcaata

SEQ ID NO: 915869 - DNA, 20 bp, Homo sapiens
cagtgcagcttgcagtccgt

SEQ ID NO: 915870 - DNA, 14 bp, Homo sapiens
cagtgcagtataga

SEQ ID NO: 915871 - DNA, 20 bp, Homo sapiens
cagtgcagtttctaagcatg

SEQ ID NO: 915872 - DNA, 22 bp, Homo sapiens
cagtgcagtttcttttcacatt

SEQ ID NO: 915873 - DNA, 23 bp, Homo sapiens
cagtgcatagttgtagacaaagt

SEQ ID NO: 915874 - DNA, 22 bp, Homo sapiens
cagtgcatccccacgacccctg

SEQ ID NO: 915875 - DNA, 16 bp, Homo sapiens
cagtgcatctcagccc

SEQ ID NO: 915876 - DNA, 17 bp, Homo sapiens
cagtgcatctcagccca

SEQ ID NO: 915877 - DNA, 18 bp, Homo sapiens
cagtgcatctcagcccac

SEQ ID NO: 915878 - DNA, 22 bp, Homo sapiens
cagtgcatgacgtttaaggcca

SEQ ID NO: 915879 - DNA, 17 bp, Homo sapiens
cagtgcattatgtacac

SEQ ID NO: 915880 - DNA, 18 bp, Homo sapiens
cagtgcattttgtttctg

SEQ ID NO: 915881 - DNA, 17 bp, Homo sapiens
cagtgccaactcctcac

SEQ ID NO: 915882 - DNA, 13 bp, Homo sapiens
cagtgccacagcc

SEQ ID NO: 915883 - DNA, 14 bp, Homo sapiens
cagtgccacagcct

SEQ ID NO: 915884 - DNA, 17 bp, Homo sapiens
cagtgccacagcctgct

SEQ ID NO: 915885 - DNA, 22 bp, Homo sapiens
cagtgccacagcctgctggcag

SEQ ID NO: 915886 - DNA, 19 bp, Homo sapiens
cagtgccacctatgcctgt

SEQ ID NO: 915887 - DNA, 20 bp, Homo sapiens
cagtgccacttgacattcct

SEQ ID NO: 915888 - DNA, 14 bp, Homo sapiens
cagtgccagcaatg

SEQ ID NO: 915889 - DNA, 15 bp, Homo sapiens
cagtgccagcaatga

SEQ ID NO: 915890 - DNA, 14 bp, Homo sapiens
cagtgccagggtgg

SEQ ID NO: 915891 - DNA, 18 bp, Homo sapiens
cagtgccagggtgggctg

SEQ ID NO: 915892 - DNA, 20 bp, Homo sapiens
cagtgccagggtgggctggg

SEQ ID NO: 915893 - DNA, 22 bp, Homo sapiens
cagtgccagggtgggctgggga

SEQ ID NO: 915894 - DNA, 20 bp, Homo sapiens
cagtgccatccccaccttca

SEQ ID NO: 915895 - DNA, 20 bp, Homo sapiens
cagtgccatgtaaatcccca

SEQ ID NO: 915896 - DNA, 10 bp, Homo sapiens
cagtgccatt

SEQ ID NO: 915897 - DNA, 21 bp, Homo sapiens
cagtgcccaccaacatcccat

SEQ ID NO: 915898 - DNA, 16 bp, Homo sapiens
cagtgcccaccgccct

SEQ ID NO: 915899 - DNA, 17 bp, Homo sapiens
cagtgcccaccgccctc

SEQ ID NO: 915900 - DNA, 18 bp, Homo sapiens
cagtgcccaccgccctcc

SEQ ID NO: 915901 - DNA, 23 bp, Homo sapiens
cagtgcccaccgccctcctccac

SEQ ID NO: 915902 - DNA, 20 bp, Homo sapiens
agggacagaggccaaggact

SEQ ID NO: 915903 - DNA, 21 bp, Homo sapiens
agggacagaggccaaggactg

SEQ ID NO: 915904 - DNA, 22 bp, Homo sapiens
agggacagatgaatgccgtgga

SEQ ID NO: 915905 - DNA, 17 bp, Homo sapiens
agggacagcaagtgagc

SEQ ID NO: 915906 - DNA, 21 bp, Homo sapiens
agggacaggaccccagctctg

SEQ ID NO: 915907 - DNA, 15 bp, Homo sapiens
agggacaggagaaga

SEQ ID NO: 915908 - DNA, 17 bp, Homo sapiens
agggacaggagaagaga

SEQ ID NO: 915909 - DNA, 13 bp, Homo sapiens
agggacaggctga

SEQ ID NO: 915910 - DNA, 14 bp, Homo sapiens
agggacagggcagg

SEQ ID NO: 915911 - DNA, 15 bp, Homo sapiens
agggacagggcaggc

SEQ ID NO: 915912 - DNA, 17 bp, Homo sapiens
agggacaggtgggcctg

SEQ ID NO: 915913 - DNA, 18 bp, Homo sapiens
agggacaggtgggcctgg

SEQ ID NO: 915914 - DNA, 22 bp, Homo sapiens
agggacaggtgggcctggcggc

SEQ ID NO: 915915 - DNA, 18 bp, Homo sapiens
agggacatgctcacctct

SEQ ID NO: 915916 - DNA, 12 bp, Homo sapiens
agggacatgggg

SEQ ID NO: 915917 - DNA, 18 bp, Homo sapiens
agggacatggggcaagcc

SEQ ID NO: 915918 - DNA, 21 bp, Homo sapiens
agggacatggggcaagccagg

SEQ ID NO: 915919 - DNA, 19 bp, Homo sapiens
agggaccaaattgcttcta

SEQ ID NO: 915920 - DNA, 17 bp, Homo sapiens
agggaccaactgggccc

SEQ ID NO: 915921 - DNA, 19 bp, Homo sapiens
agggaccaactgggcccaa

SEQ ID NO: 915922 - DNA, 20 bp, Homo sapiens
agggaccaagcgaccaagga

SEQ ID NO: 915923 - DNA, 21 bp, Homo sapiens
agggaccaaggacccctcacc

SEQ ID NO: 915924 - DNA, 13 bp, Homo sapiens
agggaccaaggca

SEQ ID NO: 915925 - DNA, 21 bp, Homo sapiens
agggaccaaggcaaggcaggt

SEQ ID NO: 915926 - DNA, 21 bp, Homo sapiens
agggaccactgggtgagagag

SEQ ID NO: 915927 - DNA, 23 bp, Homo sapiens
agggaccactgggtgagagagga

SEQ ID NO: 915928 - DNA, 20 bp, Homo sapiens
agggaccatctgctgcagtt

SEQ ID NO: 915929 - DNA, 13 bp, Homo sapiens
agggaccatgtgt

SEQ ID NO: 915930 - DNA, 23 bp, Homo sapiens
agggaccctttgcctttcttctg

SEQ ID NO: 915931 - DNA, 15 bp, Homo sapiens
agggaccggtgctgc

SEQ ID NO: 915932 - DNA, 17 bp, Homo sapiens
agggaccgtccagggga

SEQ ID NO: 915933 - DNA, 13 bp, Homo sapiens
agggacctcaggg

SEQ ID NO: 915934 - DNA, 15 bp, Homo sapiens
agggacctcaggggc

SEQ ID NO: 915935 - DNA, 15 bp, Homo sapiens
agggacctctcccag

SEQ ID NO: 915936 - DNA, 16 bp, Homo sapiens
agggacctctcccagg

SEQ ID NO: 915937 - DNA, 22 bp, Homo sapiens
agggacgcctgggggtgccagg

SEQ ID NO: 915938 - DNA, 18 bp, Homo sapiens
agggacgcggaggaggaa

SEQ ID NO: 915939 - DNA, 17 bp, Homo sapiens
agggacgctttgtctgt

SEQ ID NO: 915940 - DNA, 23 bp, Homo sapiens
agggactgccagtccccctgccc

SEQ ID NO: 915941 - DNA, 15 bp, Homo sapiens
agggactggaaccag

SEQ ID NO: 915942 - DNA, 16 bp, Homo sapiens
agggacttaacttgtt

SEQ ID NO: 915943 - DNA, 15 bp, Homo sapiens
agggacttgaagttg

SEQ ID NO: 915944 - DNA, 15 bp, Homo sapiens
agggacttggctgtc

SEQ ID NO: 915945 - DNA, 14 bp, Homo sapiens
agggagaaaagaga

SEQ ID NO: 915946 - DNA, 15 bp, Homo sapiens
agggagaaaagagaa

SEQ ID NO: 915947 - DNA, 16 bp, Homo sapiens
agggagaaagaaaact

SEQ ID NO: 915948 - DNA, 14 bp, Homo sapiens
agggagaaaggaga

SEQ ID NO: 915949 - DNA, 12 bp, Homo sapiens
agggagaaatgc

SEQ ID NO: 915950 - DNA, 14 bp, Homo sapiens
agggagaaatgcca

SEQ ID NO: 915951 - DNA, 15 bp, Homo sapiens
agggagaagaagtca

SEQ ID NO: 915952 - DNA, 11 bp, Homo sapiens
agggagaagga

SEQ ID NO: 915953 - DNA, 17 bp, Homo sapiens
agggagaaggaagggca

SEQ ID NO: 915954 - DNA, 12 bp, Homo sapiens
agggagaatata

SEQ ID NO: 915955 - DNA, 19 bp, Homo sapiens
agggagacggccctgctgg

SEQ ID NO: 915956 - DNA, 22 bp, Homo sapiens
agggagacggccctgctggggc

SEQ ID NO: 915957 - DNA, 14 bp, Homo sapiens
agggagactcctgg

SEQ ID NO: 915958 - DNA, 16 bp, Homo sapiens
agggagagacctcatc

SEQ ID NO: 915959 - DNA, 16 bp, Homo sapiens
agggagagcggggcag

SEQ ID NO: 915960 - DNA, 12 bp, Homo sapiens
agggagaggaag

SEQ ID NO: 915961 - DNA, 13 bp, Homo sapiens
agggagagggagg

SEQ ID NO: 915962 - DNA, 18 bp, Homo sapiens
agggagaggtcaccagct

SEQ ID NO: 915963 - DNA, 17 bp, Homo sapiens
agggagaggtggcagga

SEQ ID NO: 915964 - DNA, 20 bp, Homo sapiens
agggagagttggggaaggca

SEQ ID NO: 915965 - DNA, 20 bp, Homo sapiens
agggagatgagttgcagttt

SEQ ID NO: 915966 - DNA, 22 bp, Homo sapiens
agggagcaacggcccatagcct

SEQ ID NO: 915967 - DNA, 18 bp, Homo sapiens
agggagcaagacagagac

SEQ ID NO: 915968 - DNA, 13 bp, Homo sapiens
agggagcactggg

SEQ ID NO: 915969 - DNA, 19 bp, Homo sapiens
agggagcagggaaggcctg

SEQ ID NO: 915970 - DNA, 17 bp, Homo sapiens
agggagcccctttgatg

SEQ ID NO: 915971 - DNA, 15 bp, Homo sapiens
agggagcgaggtcag

SEQ ID NO: 915972 - DNA, 16 bp, Homo sapiens
agggagcgaggtcaga

SEQ ID NO: 915973 - DNA, 22 bp, Homo sapiens
agggagcggccggccagcccct

SEQ ID NO: 915974 - DNA, 13 bp, Homo sapiens
agggagctgctgg

SEQ ID NO: 915975 - DNA, 17 bp, Homo sapiens
agggagctgctggctga

SEQ ID NO: 915976 - DNA, 13 bp, Homo sapiens
agggagctgggac

SEQ ID NO: 915977 - DNA, 14 bp, Homo sapiens
agggagcttcctgg

SEQ ID NO: 915978 - DNA, 12 bp, Homo sapiens
agggaggaagat

SEQ ID NO: 915979 - DNA, 15 bp, Homo sapiens
agggaggaaggcctt

SEQ ID NO: 915980 - DNA, 19 bp, Homo sapiens
agggaggaaggcctttctt

SEQ ID NO: 915981 - DNA, 21 bp, Homo sapiens
agggaggaaggcctttcttct

SEQ ID NO: 915982 - DNA, 23 bp, Homo sapiens
agggaggagaggaaatgctattg

SEQ ID NO: 915983 - DNA, 19 bp, Homo sapiens
agggaggaggccacctctc

SEQ ID NO: 915984 - DNA, 22 bp, Homo sapiens
agggaggcaacactgctgtcca

SEQ ID NO: 915985 - DNA, 13 bp, Homo sapiens
agggaggcaagcc

SEQ ID NO: 915986 - DNA, 15 bp, Homo sapiens
agggaggcagagcgg

SEQ ID NO: 915987 - DNA, 18 bp, Homo sapiens
agggaggcagcgtgggct

SEQ ID NO: 915988 - DNA, 23 bp, Homo sapiens
agggaggcagcgtgggctctgcc

SEQ ID NO: 915989 - DNA, 13 bp, Homo sapiens
agggaggcagtgg

SEQ ID NO: 915990 - DNA, 15 bp, Homo sapiens
agggaggcagtggct

SEQ ID NO: 915991 - DNA, 13 bp, Homo sapiens
agggaggccgggc

SEQ ID NO: 915992 - DNA, 16 bp, Homo sapiens
agggaggccgggcggt

SEQ ID NO: 915993 - DNA, 13 bp, Homo sapiens
agggaggcgggga

SEQ ID NO: 915994 - DNA, 17 bp, Homo sapiens
agggaggcggggaggag

SEQ ID NO: 915995 - DNA, 23 bp, Homo sapiens
agggagggaaggggatggaggcc

SEQ ID NO: 915996 - DNA, 12 bp, Homo sapiens
agggagggagcc

SEQ ID NO: 915997 - DNA, 13 bp, Homo sapiens
agggagggagcca

SEQ ID NO: 915998 - DNA, 14 bp, Homo sapiens
agggagggagccat

SEQ ID NO: 915999 - DNA, 23 bp, Homo sapiens
agggagggcagctggcccccagc

SEQ ID NO: 916000 - DNA, 18 bp, Homo sapiens
agggagggccagggaggc

SEQ ID NO: 916001 - DNA, 21 bp, Homo sapiens
agggagggccggcggctctga

SEQ ID NO: 916002 - DNA, 23 bp, Homo sapiens
agggagggccggcggctctgagc

SEQ ID NO: 916003 - DNA, 15 bp, Homo sapiens
agggagggctgtcat

SEQ ID NO: 916004 - DNA, 15 bp, Homo sapiens
agggagggcttctgc

SEQ ID NO: 916005 - DNA, 13 bp, Homo sapiens
agggaggggaaat

SEQ ID NO: 916006 - DNA, 12 bp, Homo sapiens
agggaggggact

SEQ ID NO: 916007 - DNA, 10 bp, Homo sapiens
agggaggggc

SEQ ID NO: 916008 - DNA, 20 bp, Homo sapiens
agggaggggccggctggcct

SEQ ID NO: 916009 - DNA, 21 bp, Homo sapiens
agggaggggccggctggcctg

SEQ ID NO: 916010 - DNA, 20 bp, Homo sapiens
agggaggggcctaggcctca

SEQ ID NO: 916011 - DNA, 19 bp, Homo sapiens
agggagggggcgctcagga

SEQ ID NO: 916012 - DNA, 24 bp, Homo sapiens
agggagggggcgctcaggacccag

SEQ ID NO: 916013 - DNA, 14 bp, Homo sapiens
agggagggtgcagc

SEQ ID NO: 916014 - DNA, 21 bp, Homo sapiens
agggaggtcactggaaagggg

SEQ ID NO: 916015 - DNA, 22 bp, Homo sapiens
agggaggtgaatactcttgaaa

SEQ ID NO: 916016 - DNA, 22 bp, Homo sapiens
agggaggtgtttaaagagaggt

SEQ ID NO: 916017 - DNA, 15 bp, Homo sapiens
agggagtacctgctg

SEQ ID NO: 916018 - DNA, 13 bp, Homo sapiens
agggagtccaggg

SEQ ID NO: 916019 - DNA, 21 bp, Homo sapiens
agggagtccagggtttctctg

SEQ ID NO: 916020 - DNA, 17 bp, Homo sapiens
agggagtcccagagccc

SEQ ID NO: 916021 - DNA, 19 bp, Homo sapiens
agggagtccttgcgtccca

SEQ ID NO: 916022 - DNA, 19 bp, Homo sapiens
agggagtctcaggaggagg

SEQ ID NO: 916023 - DNA, 13 bp, Homo sapiens
agggagtgagcag

SEQ ID NO: 916024 - DNA, 15 bp, Homo sapiens
agggagtgagcagct

SEQ ID NO: 916025 - DNA, 18 bp, Homo sapiens
agggagtgagcagctact

SEQ ID NO: 916026 - DNA, 19 bp, Homo sapiens
agggagtgaggggctgtga

SEQ ID NO: 916027 - DNA, 13 bp, Homo sapiens
cagtgccccaggg

SEQ ID NO: 916028 - DNA, 19 bp, Homo sapiens
cagtgccccagggagtcca

SEQ ID NO: 916029 - DNA, 17 bp, Homo sapiens
cagtgccctcattttat

SEQ ID NO: 916030 - DNA, 13 bp, Homo sapiens
cagtgccctccag

SEQ ID NO: 916031 - DNA, 14 bp, Homo sapiens
cagtgccctccagc

SEQ ID NO: 916032 - DNA, 13 bp, Homo sapiens
cagtgccgctcct

SEQ ID NO: 916033 - DNA, 18 bp, Homo sapiens
cagtgccgctcctgcttc

SEQ ID NO: 916034 - DNA, 13 bp, Homo sapiens
cagtgccggaggc

SEQ ID NO: 916035 - DNA, 15 bp, Homo sapiens
cagtgcctattgata

SEQ ID NO: 916036 - DNA, 13 bp, Homo sapiens
cagtgcctccaca

SEQ ID NO: 916037 - DNA, 16 bp, Homo sapiens
cagtgcctcctggccg

SEQ ID NO: 916038 - DNA, 19 bp, Homo sapiens
cagtgcctcgaggcaccgg

SEQ ID NO: 916039 - DNA, 20 bp, Homo sapiens
cagtgcctcttccagtgaac

SEQ ID NO: 916040 - DNA, 18 bp, Homo sapiens
cagtgcctgccactctct

SEQ ID NO: 916041 - DNA, 18 bp, Homo sapiens
cagtgcctgctctgctgt

SEQ ID NO: 916042 - DNA, 13 bp, Homo sapiens
cagtgcctgctga

SEQ ID NO: 916043 - DNA, 18 bp, Homo sapiens
cagtgcctgggaatgtat

SEQ ID NO: 916044 - DNA, 18 bp, Homo sapiens
cagtgccttacctcctgc

SEQ ID NO: 916045 - DNA, 20 bp, Homo sapiens
cagtgccttacctcctgccc

SEQ ID NO: 916046 - DNA, 14 bp, Homo sapiens
cagtgccttccata

SEQ ID NO: 916047 - DNA, 12 bp, Homo sapiens
cagtgccttctc

SEQ ID NO: 916048 - DNA, 13 bp, Homo sapiens
cagtgccttctct

SEQ ID NO: 916049 - DNA, 16 bp, Homo sapiens
cagtgctcaccagccc

SEQ ID NO: 916050 - DNA, 21 bp, Homo sapiens
cagtgctcaccagccctgcag

SEQ ID NO: 916051 - DNA, 16 bp, Homo sapiens
cagtgctctgcctcag

SEQ ID NO: 916052 - DNA, 23 bp, Homo sapiens
cagtgctgatccggctgctcctc

SEQ ID NO: 916053 - DNA, 12 bp, Homo sapiens
cagtgctgccat

SEQ ID NO: 916054 - DNA, 13 bp, Homo sapiens
cagtgctgccatg

SEQ ID NO: 916055 - DNA, 15 bp, Homo sapiens
cagtgctgccatgcc

SEQ ID NO: 916056 - DNA, 16 bp, Homo sapiens
cagtgctgccatgcca

SEQ ID NO: 916057 - DNA, 22 bp, Homo sapiens
cagtgctgccatgccactgcca

SEQ ID NO: 916058 - DNA, 23 bp, Homo sapiens
cagtgctgccccttgcaagccat

SEQ ID NO: 916059 - DNA, 14 bp, Homo sapiens
cagtgctgccctgc

SEQ ID NO: 916060 - DNA, 15 bp, Homo sapiens
cagtgctgcctgtcc

SEQ ID NO: 916061 - DNA, 22 bp, Homo sapiens
cagtgctgcctgtccccatgct

SEQ ID NO: 916062 - DNA, 14 bp, Homo sapiens
cagtgctgcttctc

SEQ ID NO: 916063 - DNA, 14 bp, Homo sapiens
cagtgctgcttctt

SEQ ID NO: 916064 - DNA, 12 bp, Homo sapiens
cagtgctgtggc

SEQ ID NO: 916065 - DNA, 13 bp, Homo sapiens
cagtgctgtggcc

SEQ ID NO: 916066 - DNA, 15 bp, Homo sapiens
cagtgctgtggcctg

SEQ ID NO: 916067 - DNA, 17 bp, Homo sapiens
cagtgctgtggcctggg

SEQ ID NO: 916068 - DNA, 14 bp, Homo sapiens
cagtgcttcagcct

SEQ ID NO: 916069 - DNA, 15 bp, Homo sapiens
cagtgcttcagcctg

SEQ ID NO: 916070 - DNA, 23 bp, Homo sapiens
cagtgcttctccaacactgaagt

SEQ ID NO: 916071 - DNA, 20 bp, Homo sapiens
cagtgctttttccttttcat

SEQ ID NO: 916072 - DNA, 16 bp, Homo sapiens
cagtggaaagtcctga

SEQ ID NO: 916073 - DNA, 12 bp, Homo sapiens
cagtggaagaaa

SEQ ID NO: 916074 - DNA, 13 bp, Homo sapiens
cagtggaagaaac

SEQ ID NO: 916075 - DNA, 23 bp, Homo sapiens
cagtggaattccaacttgaagga

SEQ ID NO: 916076 - DNA, 20 bp, Homo sapiens
cagtggaattgtacaagagt

SEQ ID NO: 916077 - DNA, 13 bp, Homo sapiens
cagtggacaccag

SEQ ID NO: 916078 - DNA, 21 bp, Homo sapiens
cagtggaccgaaatctgtatt

SEQ ID NO: 916079 - DNA, 12 bp, Homo sapiens
cagtggacggag

SEQ ID NO: 916080 - DNA, 14 bp, Homo sapiens
cagtggactctgag

SEQ ID NO: 916081 - DNA, 18 bp, Homo sapiens
cagtggactttccacccc

SEQ ID NO: 916082 - DNA, 20 bp, Homo sapiens
cagtggactttccaccccct

SEQ ID NO: 916083 - DNA, 22 bp, Homo sapiens
cagtggactttccaccccctcc

SEQ ID NO: 916084 - DNA, 23 bp, Homo sapiens
cagtggactttccaccccctccc

SEQ ID NO: 916085 - DNA, 13 bp, Homo sapiens
cagtggagaatta

SEQ ID NO: 916086 - DNA, 16 bp, Homo sapiens
cagtggatatgaccca

SEQ ID NO: 916087 - DNA, 17 bp, Homo sapiens
cagtggatatgacccac

SEQ ID NO: 916088 - DNA, 15 bp, Homo sapiens
cagtggatcttcaga

SEQ ID NO: 916089 - DNA, 18 bp, Homo sapiens
cagtggatcttcagaact

SEQ ID NO: 916090 - DNA, 23 bp, Homo sapiens
cagtggatcttcagaactgccct

SEQ ID NO: 916091 - DNA, 16 bp, Homo sapiens
cagtggattgcatttc

SEQ ID NO: 916092 - DNA, 18 bp, Homo sapiens
cagtggcagacaaacaga

SEQ ID NO: 916093 - DNA, 15 bp, Homo sapiens
cagtggcatggctcc

SEQ ID NO: 916094 - DNA, 16 bp, Homo sapiens
cagtggcatggctcca

SEQ ID NO: 916095 - DNA, 17 bp, Homo sapiens
cagtggcatggctccag

SEQ ID NO: 916096 - DNA, 20 bp, Homo sapiens
cagtggccacgttcagggag

SEQ ID NO: 916097 - DNA, 23 bp, Homo sapiens
cagtggccacgttcagggagggg

SEQ ID NO: 916098 - DNA, 21 bp, Homo sapiens
cagtggcccatggcattttat

SEQ ID NO: 916099 - DNA, 19 bp, Homo sapiens
cagtggcccccgggcctgc

SEQ ID NO: 916100 - DNA, 21 bp, Homo sapiens
cagtggcccccgggcctgcac

SEQ ID NO: 916101 - DNA, 22 bp, Homo sapiens
cagtggcccccgggcctgcaca

SEQ ID NO: 916102 - DNA, 14 bp, Homo sapiens
cagtggcctacaaa

SEQ ID NO: 916103 - DNA, 23 bp, Homo sapiens
cagtggcctacaaatcagtaatt

SEQ ID NO: 916104 - DNA, 16 bp, Homo sapiens
cagtggcctcaaccct

SEQ ID NO: 916105 - DNA, 11 bp, Homo sapiens
cagtggcctct

SEQ ID NO: 916106 - DNA, 11 bp, Homo sapiens
cagtggcctta

SEQ ID NO: 916107 - DNA, 18 bp, Homo sapiens
cagtggccttccccagca

SEQ ID NO: 916108 - DNA, 11 bp, Homo sapiens
cagtggccttt

SEQ ID NO: 916109 - DNA, 15 bp, Homo sapiens
cagtggctctcagag

SEQ ID NO: 916110 - DNA, 17 bp, Homo sapiens
cagtggctctcagagca

SEQ ID NO: 916111 - DNA, 19 bp, Homo sapiens
cagtggctggaattaaaac

SEQ ID NO: 916112 - DNA, 12 bp, Homo sapiens
cagtggctgggt

SEQ ID NO: 916113 - DNA, 13 bp, Homo sapiens
cagtggctgggtg

SEQ ID NO: 916114 - DNA, 14 bp, Homo sapiens
cagtggctgggtgg

SEQ ID NO: 916115 - DNA, 18 bp, Homo sapiens
cagtggctggtccagggc

SEQ ID NO: 916116 - DNA, 15 bp, Homo sapiens
cagtggctggtgccc

SEQ ID NO: 916117 - DNA, 18 bp, Homo sapiens
cagtggctggtgcccatg

SEQ ID NO: 916118 - DNA, 21 bp, Homo sapiens
cagtggctggtgcccatgaag

SEQ ID NO: 916119 - DNA, 23 bp, Homo sapiens
cagtggcttttgccccagaaagg

SEQ ID NO: 916120 - DNA, 22 bp, Homo sapiens
cagtgggaacgtgactgcccca

SEQ ID NO: 916121 - DNA, 15 bp, Homo sapiens
cagtgggaactgtgc

SEQ ID NO: 916122 - DNA, 13 bp, Homo sapiens
cagtgggagaaaa

SEQ ID NO: 916123 - DNA, 17 bp, Homo sapiens
cagtgggagatgttaga

SEQ ID NO: 916124 - DNA, 22 bp, Homo sapiens
cagtgggagccctgaccttggc

SEQ ID NO: 916125 - DNA, 12 bp, Homo sapiens
cagtgggagggg

SEQ ID NO: 916126 - DNA, 16 bp, Homo sapiens
cagtgggaggggcagg

SEQ ID NO: 916127 - DNA, 17 bp, Homo sapiens
cagtgggaggggcaggc

SEQ ID NO: 916128 - DNA, 18 bp, Homo sapiens
cagtgggaggggcaggct

SEQ ID NO: 916129 - DNA, 19 bp, Homo sapiens
cagtgggaggggcaggctg

SEQ ID NO: 916130 - DNA, 22 bp, Homo sapiens
cagtgggattatcgagcatgtt

SEQ ID NO: 916131 - DNA, 16 bp, Homo sapiens
cagtgggcaggtggcc

SEQ ID NO: 916132 - DNA, 15 bp, Homo sapiens
cagtgggcctgctga

SEQ ID NO: 916133 - DNA, 20 bp, Homo sapiens
cagtgggcctgctgaggcct

SEQ ID NO: 916134 - DNA, 12 bp, Homo sapiens
cagtgggcctgg

SEQ ID NO: 916135 - DNA, 19 bp, Homo sapiens
cagtgggcctggtagcaca

SEQ ID NO: 916136 - DNA, 18 bp, Homo sapiens
cagtgggcgttgggagcc

SEQ ID NO: 916137 - DNA, 23 bp, Homo sapiens
cagtgggcgttgggagcctagct

SEQ ID NO: 916138 - DNA, 19 bp, Homo sapiens
cagtgggctgcacgctccc

SEQ ID NO: 916139 - DNA, 20 bp, Homo sapiens
cagtgggctgcacgctcccc

SEQ ID NO: 916140 - DNA, 21 bp, Homo sapiens
cagtgggctgtgttgactgct

SEQ ID NO: 916141 - DNA, 14 bp, Homo sapiens
cagtggggcctgtg

SEQ ID NO: 916142 - DNA, 16 bp, Homo sapiens
cagtggggctgcaggc

SEQ ID NO: 916143 - DNA, 19 bp, Homo sapiens
cagtggggctgcaggcagg

SEQ ID NO: 916144 - DNA, 11 bp, Homo sapiens
cagtggggtga

SEQ ID NO: 916145 - DNA, 13 bp, Homo sapiens
cagtgggtgcccc

SEQ ID NO: 916146 - DNA, 15 bp, Homo sapiens
cagtgggtggcacct

SEQ ID NO: 916147 - DNA, 19 bp, Homo sapiens
cagtgggtggcacctcctg

SEQ ID NO: 916148 - DNA, 23 bp, Homo sapiens
cagtgggtggcacctcctgagaa

SEQ ID NO: 916149 - DNA, 16 bp, Homo sapiens
cagtggtaagaatagt

SEQ ID NO: 916150 - DNA, 17 bp, Homo sapiens
cagtggtaagctctggc

SEQ ID NO: 916151 - DNA, 15 bp, Homo sapiens
cagtggtagctctgg

SEQ ID NO: 916152 - DNA, 17 bp, Homo sapiens
cagtggtagctctggct

SEQ ID NO: 916153 - DNA, 19 bp, Homo sapiens
agggagtgcagaacacctg

SEQ ID NO: 916154 - DNA, 24 bp, Homo sapiens
agggagtgctggctcacagtacag

SEQ ID NO: 916155 - DNA, 18 bp, Homo sapiens
agggagtggttcctgtgg

SEQ ID NO: 916156 - DNA, 20 bp, Homo sapiens
agggagttttgtctgtctcc

SEQ ID NO: 916157 - DNA, 10 bp, Homo sapiens
agggataatt

SEQ ID NO: 916158 - DNA, 16 bp, Homo sapiens
agggatatatatatat

SEQ ID NO: 916159 - DNA, 21 bp, Homo sapiens
agggatatctactgtggtctg

SEQ ID NO: 916160 - DNA, 20 bp, Homo sapiens
agggatattgccttatttgt

SEQ ID NO: 916161 - DNA, 22 bp, Homo sapiens
agggatctggtcctacccatcc

SEQ ID NO: 916162 - DNA, 21 bp, Homo sapiens
agggatctgtttgaacactta

SEQ ID NO: 916163 - DNA, 18 bp, Homo sapiens
agggatgaagggcgagtg

SEQ ID NO: 916164 - DNA, 15 bp, Homo sapiens
agggatgactaaaat

SEQ ID NO: 916165 - DNA, 22 bp, Homo sapiens
agggatgatggcagagccaggc

SEQ ID NO: 916166 - DNA, 18 bp, Homo sapiens
agggatgattcaagccat

SEQ ID NO: 916167 - DNA, 14 bp, Homo sapiens
agggatgcccccag

SEQ ID NO: 916168 - DNA, 19 bp, Homo sapiens
agggatgccctggaggtgg

SEQ ID NO: 916169 - DNA, 17 bp, Homo sapiens
agggatgctgcctgagt

SEQ ID NO: 916170 - DNA, 18 bp, Homo sapiens
agggatgctgcctgagtc

SEQ ID NO: 916171 - DNA, 11 bp, Homo sapiens
agggatgctgg

SEQ ID NO: 916172 - DNA, 16 bp, Homo sapiens
agggatgctgggctgg

SEQ ID NO: 916173 - DNA, 17 bp, Homo sapiens
agggatgctgggctggg

SEQ ID NO: 916174 - DNA, 17 bp, Homo sapiens
agggatgctggtggctg

SEQ ID NO: 916175 - DNA, 13 bp, Homo sapiens
agggatggagaaa

SEQ ID NO: 916176 - DNA, 21 bp, Homo sapiens
agggatggagaaagaagtgga

SEQ ID NO: 916177 - DNA, 19 bp, Homo sapiens
agggatggcaccacttatt

SEQ ID NO: 916178 - DNA, 12 bp, Homo sapiens
agggatgtattt

SEQ ID NO: 916179 - DNA, 23 bp, Homo sapiens
agggatgtgaattgcctgcagag

SEQ ID NO: 916180 - DNA, 19 bp, Homo sapiens
agggattaacctctgcact

SEQ ID NO: 916181 - DNA, 17 bp, Homo sapiens
agggattacaggcgtga

SEQ ID NO: 916182 - DNA, 20 bp, Homo sapiens
agggattctgggcttggggt

SEQ ID NO: 916183 - DNA, 18 bp, Homo sapiens
agggattgaggagttgcc

SEQ ID NO: 916184 - DNA, 22 bp, Homo sapiens
agggattgaggagttgcctgac

SEQ ID NO: 916185 - DNA, 17 bp, Homo sapiens
agggattgtccctgtgt

SEQ ID NO: 916186 - DNA, 14 bp, Homo sapiens
agggatttccctgc

SEQ ID NO: 916187 - DNA, 19 bp, Homo sapiens
agggattttagcctcttcc

SEQ ID NO: 916188 - DNA, 21 bp, Homo sapiens
agggcaaagtagggcgtgtgg

SEQ ID NO: 916189 - DNA, 22 bp, Homo sapiens
agggcaacaatacatgctgcta

SEQ ID NO: 916190 - DNA, 18 bp, Homo sapiens
agggcaacagatcagtaa

SEQ ID NO: 916191 - DNA, 17 bp, Homo sapiens
agggcaactcttggaag

SEQ ID NO: 916192 - DNA, 20 bp, Homo sapiens
agggcaagaacccaagtgcc

SEQ ID NO: 916193 - DNA, 20 bp, Homo sapiens
agggcaaggagtttattaca

SEQ ID NO: 916194 - DNA, 16 bp, Homo sapiens
agggcaaggggttccc

SEQ ID NO: 916195 - DNA, 20 bp, Homo sapiens
agggcaagggttaaggcctg

SEQ ID NO: 916196 - DNA, 21 bp, Homo sapiens
agggcaagggttaaggcctga

SEQ ID NO: 916197 - DNA, 19 bp, Homo sapiens
agggcaagtggatgggaat

SEQ ID NO: 916198 - DNA, 22 bp, Homo sapiens
agggcaagtggatgggaatttg

SEQ ID NO: 916199 - DNA, 17 bp, Homo sapiens
agggcaatgccatcagc

SEQ ID NO: 916200 - DNA, 19 bp, Homo sapiens
agggcaatgccatcagccc

SEQ ID NO: 916201 - DNA, 20 bp, Homo sapiens
agggcaatgccatcagcccc

SEQ ID NO: 916202 - DNA, 22 bp, Homo sapiens
agggcaatgccatcagcccctg

SEQ ID NO: 916203 - DNA, 17 bp, Homo sapiens
agggcacaaactgcagc

SEQ ID NO: 916204 - DNA, 16 bp, Homo sapiens
agggcacaaagatgga

SEQ ID NO: 916205 - DNA, 14 bp, Homo sapiens
agggcacagatgac

SEQ ID NO: 916206 - DNA, 20 bp, Homo sapiens
agggcacattaactccctcc

SEQ ID NO: 916207 - DNA, 22 bp, Homo sapiens
agggcacattaactccctccac

SEQ ID NO: 916208 - DNA, 22 bp, Homo sapiens
agggcacattgcccatggctgg

SEQ ID NO: 916209 - DNA, 19 bp, Homo sapiens
agggcaccaggggtttctc

SEQ ID NO: 916210 - DNA, 18 bp, Homo sapiens
agggcacccaccagaaat

SEQ ID NO: 916211 - DNA, 17 bp, Homo sapiens
agggcacgcaggaccag

SEQ ID NO: 916212 - DNA, 14 bp, Homo sapiens
agggcacggggacc

SEQ ID NO: 916213 - DNA, 14 bp, Homo sapiens
agggcactgggctg

SEQ ID NO: 916214 - DNA, 21 bp, Homo sapiens
agggcacttaatttgtaaact

SEQ ID NO: 916215 - DNA, 13 bp, Homo sapiens
agggcacttcagg

SEQ ID NO: 916216 - DNA, 18 bp, Homo sapiens
agggcacttcctccacag

SEQ ID NO: 916217 - DNA, 19 bp, Homo sapiens
agggcacttcctccacagt

SEQ ID NO: 916218 - DNA, 20 bp, Homo sapiens
agggcacttcctccacagtc

SEQ ID NO: 916219 - DNA, 15 bp, Homo sapiens
agggcagaatgaatc

SEQ ID NO: 916220 - DNA, 21 bp, Homo sapiens
agggcagacaatagtatagaa

SEQ ID NO: 916221 - DNA, 17 bp, Homo sapiens
agggcagacatgccttg

SEQ ID NO: 916222 - DNA, 18 bp, Homo sapiens
agggcagagaatggctgg

SEQ ID NO: 916223 - DNA, 19 bp, Homo sapiens
agggcagagccatgggcct

SEQ ID NO: 916224 - DNA, 21 bp, Homo sapiens
agggcagagccatgggcctgg

SEQ ID NO: 916225 - DNA, 18 bp, Homo sapiens
agggcagaggaagagaca

SEQ ID NO: 916226 - DNA, 23 bp, Homo sapiens
agggcagaggaatgtagggcctg

SEQ ID NO: 916227 - DNA, 22 bp, Homo sapiens
agggcagagggaatgttccctg

SEQ ID NO: 916228 - DNA, 14 bp, Homo sapiens
agggcagagggaga

SEQ ID NO: 916229 - DNA, 19 bp, Homo sapiens
agggcagagggagaatcca

SEQ ID NO: 916230 - DNA, 23 bp, Homo sapiens
agggcagatgtggggatgttttg

SEQ ID NO: 916231 - DNA, 15 bp, Homo sapiens
agggcagcaagggac

SEQ ID NO: 916232 - DNA, 12 bp, Homo sapiens
agggcagcactg

SEQ ID NO: 916233 - DNA, 22 bp, Homo sapiens
agggcagcactgggaagctgga

SEQ ID NO: 916234 - DNA, 12 bp, Homo sapiens
agggcagccctc

SEQ ID NO: 916235 - DNA, 16 bp, Homo sapiens
agggcagccctccatg

SEQ ID NO: 916236 - DNA, 14 bp, Homo sapiens
agggcagcggctcc

SEQ ID NO: 916237 - DNA, 15 bp, Homo sapiens
agggcagctgcctgg

SEQ ID NO: 916238 - DNA, 13 bp, Homo sapiens
agggcagctggcc

SEQ ID NO: 916239 - DNA, 14 bp, Homo sapiens
agggcagctggccc

SEQ ID NO: 916240 - DNA, 22 bp, Homo sapiens
agggcagctggcccccagccct

SEQ ID NO: 916241 - DNA, 20 bp, Homo sapiens
agggcaggatggcctttcct

SEQ ID NO: 916242 - DNA, 23 bp, Homo sapiens
agggcaggctgaggtggggaagg

SEQ ID NO: 916243 - DNA, 15 bp, Homo sapiens
agggcaggcttgggg

SEQ ID NO: 916244 - DNA, 14 bp, Homo sapiens
agggcagggcccac

SEQ ID NO: 916245 - DNA, 21 bp, Homo sapiens
agggcagggtgggcagcctat

SEQ ID NO: 916246 - DNA, 15 bp, Homo sapiens
agggcagtaccctcc

SEQ ID NO: 916247 - DNA, 20 bp, Homo sapiens
agggcagtcattggctgtct

SEQ ID NO: 916248 - DNA, 21 bp, Homo sapiens
agggcagtccttactccccca

SEQ ID NO: 916249 - DNA, 15 bp, Homo sapiens
agggcagtgcccatg

SEQ ID NO: 916250 - DNA, 13 bp, Homo sapiens
agggcagtgccct

SEQ ID NO: 916251 - DNA, 15 bp, Homo sapiens
agggcagtggccaag

SEQ ID NO: 916252 - DNA, 19 bp, Homo sapiens
agggcagtggccaagcctg

SEQ ID NO: 916253 - DNA, 20 bp, Homo sapiens
agggcagtggccaagcctgc

SEQ ID NO: 916254 - DNA, 20 bp, Homo sapiens
agggcagtggcttctttcca

SEQ ID NO: 916255 - DNA, 15 bp, Homo sapiens
agggcagtgtttcct

SEQ ID NO: 916256 - DNA, 13 bp, Homo sapiens
agggcagttttct

SEQ ID NO: 916257 - DNA, 13 bp, Homo sapiens
agggcataaagta

SEQ ID NO: 916258 - DNA, 18 bp, Homo sapiens
agggcataccttgtgcat

SEQ ID NO: 916259 - DNA, 19 bp, Homo sapiens
agggcataccttgtgcatt

SEQ ID NO: 916260 - DNA, 15 bp, Homo sapiens
agggcatcaggcact

SEQ ID NO: 916261 - DNA, 21 bp, Homo sapiens
agggcatctcctgtgcatggg

SEQ ID NO: 916262 - DNA, 23 bp, Homo sapiens
agggcatctcctgtgcatgggtg

SEQ ID NO: 916263 - DNA, 22 bp, Homo sapiens
agggcatgccacgtgggctcat

SEQ ID NO: 916264 - DNA, 17 bp, Homo sapiens
agggcatgcgcacaagg

SEQ ID NO: 916265 - DNA, 17 bp, Homo sapiens
agggcatggccaggtgg

SEQ ID NO: 916266 - DNA, 20 bp, Homo sapiens
agggcatttttatactcaga

SEQ ID NO: 916267 - DNA, 20 bp, Homo sapiens
agggccaaacccacttctgg

SEQ ID NO: 916268 - DNA, 13 bp, Homo sapiens
agggccaaagaac

SEQ ID NO: 916269 - DNA, 16 bp, Homo sapiens
agggccaaagaaccaa

SEQ ID NO: 916270 - DNA, 17 bp, Homo sapiens
agggccaacccttctcc

SEQ ID NO: 916271 - DNA, 22 bp, Homo sapiens
agggccaagcgggggcgtggct

SEQ ID NO: 916272 - DNA, 19 bp, Homo sapiens
agggccaataccctactgt

SEQ ID NO: 916273 - DNA, 23 bp, Homo sapiens
agggccaataccctactgtgggg

SEQ ID NO: 916274 - DNA, 16 bp, Homo sapiens
agggccaatccccagc

SEQ ID NO: 916275 - DNA, 20 bp, Homo sapiens
agggccacatgggaggctca

SEQ ID NO: 916276 - DNA, 19 bp, Homo sapiens
cagtggtctggaaacagct

SEQ ID NO: 916277 - DNA, 17 bp, Homo sapiens
cagtggtgaagaaaact

SEQ ID NO: 916278 - DNA, 21 bp, Homo sapiens
cagtggtggttttctgttctt

SEQ ID NO: 916279 - DNA, 20 bp, Homo sapiens
cagtggtttctacttcccct

SEQ ID NO: 916280 - DNA, 22 bp, Homo sapiens
cagtggtttctacttcccctgg

SEQ ID NO: 916281 - DNA, 15 bp, Homo sapiens
cagtggttttatact

SEQ ID NO: 916282 - DNA, 15 bp, Homo sapiens
cagtgtaaagtgtgt

SEQ ID NO: 916283 - DNA, 19 bp, Homo sapiens
cagtgtacacgtctggacc

SEQ ID NO: 916284 - DNA, 12 bp, Homo sapiens
cagtgtacagtc

SEQ ID NO: 916285 - DNA, 17 bp, Homo sapiens
cagtgtacagtcttgta

SEQ ID NO: 916286 - DNA, 17 bp, Homo sapiens
cagtgtagacctgagct

SEQ ID NO: 916287 - DNA, 18 bp, Homo sapiens
cagtgtagacctgagctg

SEQ ID NO: 916288 - DNA, 21 bp, Homo sapiens
cagtgtagacctgagctggga

SEQ ID NO: 916289 - DNA, 19 bp, Homo sapiens
cagtgtagccttgcccgga

SEQ ID NO: 916290 - DNA, 16 bp, Homo sapiens
cagtgtagcgggagga

SEQ ID NO: 916291 - DNA, 16 bp, Homo sapiens
cagtgtatggggcagc

SEQ ID NO: 916292 - DNA, 16 bp, Homo sapiens
cagtgtattgtttatt

SEQ ID NO: 916293 - DNA, 21 bp, Homo sapiens
cagtgtatttttgtaaaaaat

SEQ ID NO: 916294 - DNA, 13 bp, Homo sapiens
cagtgtcagcggg

SEQ ID NO: 916295 - DNA, 18 bp, Homo sapiens
cagtgtcagcgggtgacg

SEQ ID NO: 916296 - DNA, 14 bp, Homo sapiens
cagtgtcagtattt

SEQ ID NO: 916297 - DNA, 22 bp, Homo sapiens
cagtgtccagcttccaaagcct

SEQ ID NO: 916298 - DNA, 16 bp, Homo sapiens
cagtgtcccaggcagc

SEQ ID NO: 916299 - DNA, 16 bp, Homo sapiens
cagtgtcccagggccc

SEQ ID NO: 916300 - DNA, 14 bp, Homo sapiens
cagtgtcccgggcc

SEQ ID NO: 916301 - DNA, 21 bp, Homo sapiens
cagtgtcctgtgctttctgca

SEQ ID NO: 916302 - DNA, 19 bp, Homo sapiens
cagtgtcgggaattttccc

SEQ ID NO: 916303 - DNA, 12 bp, Homo sapiens
cagtgtctccac

SEQ ID NO: 916304 - DNA, 17 bp, Homo sapiens
cagtgtctccacctaca

SEQ ID NO: 916305 - DNA, 11 bp, Homo sapiens
cagtgtctctg

SEQ ID NO: 916306 - DNA, 24 bp, Homo sapiens
cagtgtctgtatcggagacagtga

SEQ ID NO: 916307 - DNA, 13 bp, Homo sapiens
cagtgtctgtcag

SEQ ID NO: 916308 - DNA, 21 bp, Homo sapiens
cagtgtctgtgccatggattt

SEQ ID NO: 916309 - DNA, 14 bp, Homo sapiens
cagtgtctgttcag

SEQ ID NO: 916310 - DNA, 15 bp, Homo sapiens
cagtgtctttctagc

SEQ ID NO: 916311 - DNA, 12 bp, Homo sapiens
cagtgtcttttt

SEQ ID NO: 916312 - DNA, 23 bp, Homo sapiens
cagtgtctttttttgtatagtta

SEQ ID NO: 916313 - DNA, 14 bp, Homo sapiens
cagtgtgagtcaga

SEQ ID NO: 916314 - DNA, 17 bp, Homo sapiens
cagtgtgagtcagaatg

SEQ ID NO: 916315 - DNA, 18 bp, Homo sapiens
cagtgtgcacgagtggga

SEQ ID NO: 916316 - DNA, 15 bp, Homo sapiens
cagtgtgcactaagg

SEQ ID NO: 916317 - DNA, 21 bp, Homo sapiens
cagtgtgcccaaaagccatgt

SEQ ID NO: 916318 - DNA, 14 bp, Homo sapiens
cagtgtgcccatct

SEQ ID NO: 916319 - DNA, 11 bp, Homo sapiens
cagtgtggaac

SEQ ID NO: 916320 - DNA, 14 bp, Homo sapiens
cagtgtggagaccc

SEQ ID NO: 916321 - DNA, 15 bp, Homo sapiens
cagtgtggagaccct

SEQ ID NO: 916322 - DNA, 14 bp, Homo sapiens
cagtgtggagaggg

SEQ ID NO: 916323 - DNA, 17 bp, Homo sapiens
cagtgtgggcttgacca

SEQ ID NO: 916324 - DNA, 14 bp, Homo sapiens
cagtgtgtaaataa

SEQ ID NO: 916325 - DNA, 14 bp, Homo sapiens
cagtgtgtggggga

SEQ ID NO: 916326 - DNA, 17 bp, Homo sapiens
cagtgtgtttgtgattg

SEQ ID NO: 916327 - DNA, 17 bp, Homo sapiens
cagtgttaaatgaaatt

SEQ ID NO: 916328 - DNA, 14 bp, Homo sapiens
cagtgttacctgtg

SEQ ID NO: 916329 - DNA, 17 bp, Homo sapiens
cagtgttagtattcacc

SEQ ID NO: 916330 - DNA, 14 bp, Homo sapiens
cagtgttccccatc

SEQ ID NO: 916331 - DNA, 20 bp, Homo sapiens
cagtgttcctgaagctgctg

SEQ ID NO: 916332 - DNA, 21 bp, Homo sapiens
cagtgttcctgaagctgctgt

SEQ ID NO: 916333 - DNA, 22 bp, Homo sapiens
cagtgttcctgaagctgctgtg

SEQ ID NO: 916334 - DNA, 14 bp, Homo sapiens
cagtgttggctgtg

SEQ ID NO: 916335 - DNA, 17 bp, Homo sapiens
cagtgttgggttttttt

SEQ ID NO: 916336 - DNA, 14 bp, Homo sapiens
cagtgttgtttgta

SEQ ID NO: 916337 - DNA, 19 bp, Homo sapiens
cagtgttgtttgtaaataa

SEQ ID NO: 916338 - DNA, 13 bp, Homo sapiens
cagtgtttcaatt

SEQ ID NO: 916339 - DNA, 18 bp, Homo sapiens
cagtgtttcaattctgta

SEQ ID NO: 916340 - DNA, 14 bp, Homo sapiens
cagtgtttctttta

SEQ ID NO: 916341 - DNA, 15 bp, Homo sapiens
cagtgttttctggga

SEQ ID NO: 916342 - DNA, 15 bp, Homo sapiens
cagtgttttctttga

SEQ ID NO: 916343 - DNA, 18 bp, Homo sapiens
cagtgttttgcaagtgct

SEQ ID NO: 916344 - DNA, 21 bp, Homo sapiens
cagtgttttgcaagtgctgga

SEQ ID NO: 916345 - DNA, 20 bp, Homo sapiens
cagtgttttggactccatct

SEQ ID NO: 916346 - DNA, 16 bp, Homo sapiens
cagtgtttttattgct

SEQ ID NO: 916347 - DNA, 20 bp, Homo sapiens
cagtgtttttattgctcgcc

SEQ ID NO: 916348 - DNA, 19 bp, Homo sapiens
cagttaaaaaaaattttaa

SEQ ID NO: 916349 - DNA, 19 bp, Homo sapiens
cagttaaaatcacatttta

SEQ ID NO: 916350 - DNA, 22 bp, Homo sapiens
cagttaaaatcacattttaagt

SEQ ID NO: 916351 - DNA, 12 bp, Homo sapiens
cagttaaagcca

SEQ ID NO: 916352 - DNA, 19 bp, Homo sapiens
cagttaactttaagactga

SEQ ID NO: 916353 - DNA, 15 bp, Homo sapiens
cagttaagaaatttc

SEQ ID NO: 916354 - DNA, 16 bp, Homo sapiens
cagttaagaagccctg

SEQ ID NO: 916355 - DNA, 17 bp, Homo sapiens
cagttaagaagccctgc

SEQ ID NO: 916356 - DNA, 13 bp, Homo sapiens
cagttaaggaaag

SEQ ID NO: 916357 - DNA, 14 bp, Homo sapiens
cagttaaggaaaga

SEQ ID NO: 916358 - DNA, 16 bp, Homo sapiens
cagttaagtattttga

SEQ ID NO: 916359 - DNA, 14 bp, Homo sapiens
cagttaatttttcc

SEQ ID NO: 916360 - DNA, 22 bp, Homo sapiens
cagttactaagaagaaaattgc

SEQ ID NO: 916361 - DNA, 20 bp, Homo sapiens
cagttactcagaattctcta

SEQ ID NO: 916362 - DNA, 16 bp, Homo sapiens
cagttactcagccctg

SEQ ID NO: 916363 - DNA, 19 bp, Homo sapiens
cagttactcagccctgggc

SEQ ID NO: 916364 - DNA, 15 bp, Homo sapiens
cagttactcaggagg

SEQ ID NO: 916365 - DNA, 16 bp, Homo sapiens
cagttactctgaaggg

SEQ ID NO: 916366 - DNA, 20 bp, Homo sapiens
cagttacttatgatttaaaa

SEQ ID NO: 916367 - DNA, 16 bp, Homo sapiens
cagttacttttttaca

SEQ ID NO: 916368 - DNA, 20 bp, Homo sapiens
cagttagagcagcctcgtgg

SEQ ID NO: 916369 - DNA, 21 bp, Homo sapiens
cagttagagcagcctcgtgga

SEQ ID NO: 916370 - DNA, 22 bp, Homo sapiens
cagttagagcagcctcgtggag

SEQ ID NO: 916371 - DNA, 20 bp, Homo sapiens
cagttagggttttgcaataa

SEQ ID NO: 916372 - DNA, 23 bp, Homo sapiens
cagttagggttttgcaataactt

SEQ ID NO: 916373 - DNA, 20 bp, Homo sapiens
cagttaggtgctgaatgaag

SEQ ID NO: 916374 - DNA, 23 bp, Homo sapiens
cagttagtatagctttatactct

SEQ ID NO: 916375 - DNA, 20 bp, Homo sapiens
cagttagttgtgaaagaaag

SEQ ID NO: 916376 - DNA, 19 bp, Homo sapiens
cagttataaaattaaaagt

SEQ ID NO: 916377 - DNA, 14 bp, Homo sapiens
cagttatcaaaaag

SEQ ID NO: 916378 - DNA, 16 bp, Homo sapiens
cagttatcctttgtga

SEQ ID NO: 916379 - DNA, 17 bp, Homo sapiens
cagttatggtgatgact

SEQ ID NO: 916380 - DNA, 19 bp, Homo sapiens
cagttatggtgatgactta

SEQ ID NO: 916381 - DNA, 16 bp, Homo sapiens
cagttatgttcagtca

SEQ ID NO: 916382 - DNA, 18 bp, Homo sapiens
cagttattacatgtaatt

SEQ ID NO: 916383 - DNA, 17 bp, Homo sapiens
cagttattttgataaca

SEQ ID NO: 916384 - DNA, 21 bp, Homo sapiens
cagttcaaaattctaaatgta

SEQ ID NO: 916385 - DNA, 18 bp, Homo sapiens
cagttcaaatcctcacca

SEQ ID NO: 916386 - DNA, 17 bp, Homo sapiens
cagttcaacctggtggc

SEQ ID NO: 916387 - DNA, 14 bp, Homo sapiens
cagttcaactttca

SEQ ID NO: 916388 - DNA, 15 bp, Homo sapiens
cagttcaactttcag

SEQ ID NO: 916389 - DNA, 14 bp, Homo sapiens
cagttcaagaaagc

SEQ ID NO: 916390 - DNA, 22 bp, Homo sapiens
cagttcaatctcccgctgctgc

SEQ ID NO: 916391 - DNA, 20 bp, Homo sapiens
cagttcacagaggtctttca

SEQ ID NO: 916392 - DNA, 23 bp, Homo sapiens
cagttcagtaataaactgtgttt

SEQ ID NO: 916393 - DNA, 23 bp, Homo sapiens
cagttcatcaccatttcctcctt

SEQ ID NO: 916394 - DNA, 14 bp, Homo sapiens
cagttcccagctcc

SEQ ID NO: 916395 - DNA, 16 bp, Homo sapiens
cagttcccagctcccc

SEQ ID NO: 916396 - DNA, 20 bp, Homo sapiens
cagttcccatggtgtatgtg

SEQ ID NO: 916397 - DNA, 20 bp, Homo sapiens
cagttcccccagtacctcca

SEQ ID NO: 916398 - DNA, 20 bp, Homo sapiens
cagttcccggagcacagccc

SEQ ID NO: 916399 - DNA, 21 bp, Homo sapiens
cagttcccggagcacagccct

SEQ ID NO: 916400 - DNA, 22 bp, Homo sapiens
cagttcccggagcacagccctg

SEQ ID NO: 916401 - DNA, 13 bp, Homo sapiens
agggccaccctgc

SEQ ID NO: 916402 - DNA, 14 bp, Homo sapiens
agggccaccctgct

SEQ ID NO: 916403 - DNA, 14 bp, Homo sapiens
agggccacctgcag

SEQ ID NO: 916404 - DNA, 15 bp, Homo sapiens
agggccacctgcagg

SEQ ID NO: 916405 - DNA, 15 bp, Homo sapiens
agggccacgctccag

SEQ ID NO: 916406 - DNA, 18 bp, Homo sapiens
agggccacgtgccaggcc

SEQ ID NO: 916407 - DNA, 18 bp, Homo sapiens
agggccagaaggagggca

SEQ ID NO: 916408 - DNA, 13 bp, Homo sapiens
agggccagagcta

SEQ ID NO: 916409 - DNA, 21 bp, Homo sapiens
agggccaggcaggtgcctgga

SEQ ID NO: 916410 - DNA, 13 bp, Homo sapiens
agggccagggcaa

SEQ ID NO: 916411 - DNA, 18 bp, Homo sapiens
agggccagggcaatgcca

SEQ ID NO: 916412 - DNA, 14 bp, Homo sapiens
agggccagggccct

SEQ ID NO: 916413 - DNA, 13 bp, Homo sapiens
agggccagggttg

SEQ ID NO: 916414 - DNA, 18 bp, Homo sapiens
agggccaggtgcagacct

SEQ ID NO: 916415 - DNA, 20 bp, Homo sapiens
agggccaggtgcggcctggg

SEQ ID NO: 916416 - DNA, 17 bp, Homo sapiens
agggccagtcctgcctg

SEQ ID NO: 916417 - DNA, 23 bp, Homo sapiens
agggccagtcctgcctggccagg

SEQ ID NO: 916418 - DNA, 17 bp, Homo sapiens
agggccagtgatgatgt

SEQ ID NO: 916419 - DNA, 18 bp, Homo sapiens
agggccagtgatgatgtt

SEQ ID NO: 916420 - DNA, 20 bp, Homo sapiens
agggccagtggggcctgtgg

SEQ ID NO: 916421 - DNA, 23 bp, Homo sapiens
agggccagtggggcctgtggaat

SEQ ID NO: 916422 - DNA, 23 bp, Homo sapiens
agggccatacttttgagaggggt

SEQ ID NO: 916423 - DNA, 20 bp, Homo sapiens
agggccatgctgaggcctgg

SEQ ID NO: 916424 - DNA, 21 bp, Homo sapiens
agggccatgctgaggcctggg

SEQ ID NO: 916425 - DNA, 21 bp, Homo sapiens
agggcccaaagaattggaatc

SEQ ID NO: 916426 - DNA, 16 bp, Homo sapiens
agggcccaagtccctg

SEQ ID NO: 916427 - DNA, 19 bp, Homo sapiens
agggcccaagtccctgttt

SEQ ID NO: 916428 - DNA, 18 bp, Homo sapiens
agggcccacccatgtcac

SEQ ID NO: 916429 - DNA, 19 bp, Homo sapiens
agggcccacccatgtcacc

SEQ ID NO: 916430 - DNA, 21 bp, Homo sapiens
agggcccaccttggaccctgg

SEQ ID NO: 916431 - DNA, 13 bp, Homo sapiens
agggcccagagca

SEQ ID NO: 916432 - DNA, 14 bp, Homo sapiens
agggcccagagcag

SEQ ID NO: 916433 - DNA, 18 bp, Homo sapiens
agggcccagagcaggaag

SEQ ID NO: 916434 - DNA, 14 bp, Homo sapiens
agggcccagagccc

SEQ ID NO: 916435 - DNA, 15 bp, Homo sapiens
agggcccagagccct

SEQ ID NO: 916436 - DNA, 18 bp, Homo sapiens
agggcccagagcccttga

SEQ ID NO: 916437 - DNA, 12 bp, Homo sapiens
agggcccagagt

SEQ ID NO: 916438 - DNA, 18 bp, Homo sapiens
agggcccagcccagagcc

SEQ ID NO: 916439 - DNA, 15 bp, Homo sapiens
agggcccaggcaggc

SEQ ID NO: 916440 - DNA, 17 bp, Homo sapiens
agggcccaggcaggcca

SEQ ID NO: 916441 - DNA, 23 bp, Homo sapiens
agggcccccaccgaggttcccag

SEQ ID NO: 916442 - DNA, 19 bp, Homo sapiens
agggcccctcaccctgcct

SEQ ID NO: 916443 - DNA, 18 bp, Homo sapiens
agggcccctccctctgcc

SEQ ID NO: 916444 - DNA, 19 bp, Homo sapiens
agggcccctccctctgccc

SEQ ID NO: 916445 - DNA, 23 bp, Homo sapiens
agggcccctctgcccagcttggg

SEQ ID NO: 916446 - DNA, 15 bp, Homo sapiens
agggcccctggatct

SEQ ID NO: 916447 - DNA, 22 bp, Homo sapiens
agggcccctggatctcctccct

SEQ ID NO: 916448 - DNA, 17 bp, Homo sapiens
agggcccgcaccgacca

SEQ ID NO: 916449 - DNA, 19 bp, Homo sapiens
agggcccgggcacccacaa

SEQ ID NO: 916450 - DNA, 16 bp, Homo sapiens
agggccctgagctcgg

SEQ ID NO: 916451 - DNA, 19 bp, Homo sapiens
agggccctgccccaggcct

SEQ ID NO: 916452 - DNA, 22 bp, Homo sapiens
agggccctgccccaggcctgga

SEQ ID NO: 916453 - DNA, 15 bp, Homo sapiens
agggccctgccctgt

SEQ ID NO: 916454 - DNA, 12 bp, Homo sapiens
agggccctggag

SEQ ID NO: 916455 - DNA, 13 bp, Homo sapiens
agggccctggagg

SEQ ID NO: 916456 - DNA, 13 bp, Homo sapiens
agggccctgggca

SEQ ID NO: 916457 - DNA, 14 bp, Homo sapiens
agggccctgtggag

SEQ ID NO: 916458 - DNA, 21 bp, Homo sapiens
agggccctgtggagtccagct

SEQ ID NO: 916459 - DNA, 22 bp, Homo sapiens
agggccctgtggagtccagctc

SEQ ID NO: 916460 - DNA, 14 bp, Homo sapiens
agggcccttcccct

SEQ ID NO: 916461 - DNA, 20 bp, Homo sapiens
agggccgactaagagaagtt

SEQ ID NO: 916462 - DNA, 13 bp, Homo sapiens
agggccgcctgcc

SEQ ID NO: 916463 - DNA, 23 bp, Homo sapiens
agggccgctcgatgcctttgctg

SEQ ID NO: 916464 - DNA, 17 bp, Homo sapiens
agggccggcggctctga

SEQ ID NO: 916465 - DNA, 18 bp, Homo sapiens
agggccggcggctctgag

SEQ ID NO: 916466 - DNA, 16 bp, Homo sapiens
agggccgtaccccacc

SEQ ID NO: 916467 - DNA, 17 bp, Homo sapiens
agggccgtgcccttgcc

SEQ ID NO: 916468 - DNA, 13 bp, Homo sapiens
agggcctcagagc

SEQ ID NO: 916469 - DNA, 17 bp, Homo sapiens
agggcctcagagcctga

SEQ ID NO: 916470 - DNA, 16 bp, Homo sapiens
agggcctcatctcacc

SEQ ID NO: 916471 - DNA, 24 bp, Homo sapiens
agggcctcatctcacctctcgcaa

SEQ ID NO: 916472 - DNA, 19 bp, Homo sapiens
agggcctcccaccagagac

SEQ ID NO: 916473 - DNA, 11 bp, Homo sapiens
agggcctcctg

SEQ ID NO: 916474 - DNA, 22 bp, Homo sapiens
agggcctgaaacccgccctcag

SEQ ID NO: 916475 - DNA, 17 bp, Homo sapiens
agggcctgacaccccct

SEQ ID NO: 916476 - DNA, 18 bp, Homo sapiens
agggcctgacaccccctc

SEQ ID NO: 916477 - DNA, 20 bp, Homo sapiens
agggcctgacaccccctccc

SEQ ID NO: 916478 - DNA, 19 bp, Homo sapiens
agggcctgacttgagccac

SEQ ID NO: 916479 - DNA, 22 bp, Homo sapiens
agggcctgacttgagccactcc

SEQ ID NO: 916480 - DNA, 18 bp, Homo sapiens
agggcctgctggaggcct

SEQ ID NO: 916481 - DNA, 21 bp, Homo sapiens
agggcctgctggaggcctcag

SEQ ID NO: 916482 - DNA, 23 bp, Homo sapiens
agggcctgcttccccttcctaag

SEQ ID NO: 916483 - DNA, 17 bp, Homo sapiens
agggcctggagccccat

SEQ ID NO: 916484 - DNA, 21 bp, Homo sapiens
agggcctggagccccatcggc

SEQ ID NO: 916485 - DNA, 11 bp, Homo sapiens
agggcctggcc

SEQ ID NO: 916486 - DNA, 14 bp, Homo sapiens
agggcctggccagt

SEQ ID NO: 916487 - DNA, 23 bp, Homo sapiens
agggcctggccagtcctggtcct

SEQ ID NO: 916488 - DNA, 16 bp, Homo sapiens
agggcctggggcctga

SEQ ID NO: 916489 - DNA, 19 bp, Homo sapiens
agggcctggggcctgagag

SEQ ID NO: 916490 - DNA, 22 bp, Homo sapiens
agggcctggggcctgagagaat

SEQ ID NO: 916491 - DNA, 21 bp, Homo sapiens
agggcctgggggcagtgactg

SEQ ID NO: 916492 - DNA, 13 bp, Homo sapiens
agggcctgtctcc

SEQ ID NO: 916493 - DNA, 19 bp, Homo sapiens
agggccttgcccagagatg

SEQ ID NO: 916494 - DNA, 14 bp, Homo sapiens
agggccttgcttct

SEQ ID NO: 916495 - DNA, 16 bp, Homo sapiens
agggcctttctcctcc

SEQ ID NO: 916496 - DNA, 22 bp, Homo sapiens
agggcctttctcctccccacct

SEQ ID NO: 916497 - DNA, 13 bp, Homo sapiens
agggcgaaggcca

SEQ ID NO: 916498 - DNA, 22 bp, Homo sapiens
agggcgataaaactaaatatat

SEQ ID NO: 916499 - DNA, 22 bp, Homo sapiens
agggcgcccattcgtctgtccc

SEQ ID NO: 916500 - DNA, 17 bp, Homo sapiens
agggcgccgccggccct

SEQ ID NO: 916501 - DNA, 14 bp, Homo sapiens
agggcgcctactct

SEQ ID NO: 916502 - DNA, 15 bp, Homo sapiens
agggcgctgggaagg

SEQ ID NO: 916503 - DNA, 15 bp, Homo sapiens
agggcggcaggggcc

SEQ ID NO: 916504 - DNA, 14 bp, Homo sapiens
agggcggccaggga

SEQ ID NO: 916505 - DNA, 12 bp, Homo sapiens
agggcggctgcc

SEQ ID NO: 916506 - DNA, 14 bp, Homo sapiens
agggcggggtgggg

SEQ ID NO: 916507 - DNA, 17 bp, Homo sapiens
agggcgtgactcaccca

SEQ ID NO: 916508 - DNA, 20 bp, Homo sapiens
agggcgtgtggtttccctgc

SEQ ID NO: 916509 - DNA, 21 bp, Homo sapiens
agggcgtgtggtttccctgcc

SEQ ID NO: 916510 - DNA, 13 bp, Homo sapiens
agggctaagagct

SEQ ID NO: 916511 - DNA, 13 bp, Homo sapiens
agggctaattaga

SEQ ID NO: 916512 - DNA, 21 bp, Homo sapiens
agggctaattctgggaaggga

SEQ ID NO: 916513 - DNA, 17 bp, Homo sapiens
agggctaccctgagctg

SEQ ID NO: 916514 - DNA, 18 bp, Homo sapiens
agggctaccctgagctga

SEQ ID NO: 916515 - DNA, 20 bp, Homo sapiens
agggctaccctgagctgagg

SEQ ID NO: 916516 - DNA, 16 bp, Homo sapiens
agggctagcatccctg

SEQ ID NO: 916517 - DNA, 22 bp, Homo sapiens
agggctagccctgagcccggcc

SEQ ID NO: 916518 - DNA, 19 bp, Homo sapiens
agggctatagctcaggacc

SEQ ID NO: 916519 - DNA, 14 bp, Homo sapiens
agggctatggcaag

SEQ ID NO: 916520 - DNA, 19 bp, Homo sapiens
agggctcacactcctgggc

SEQ ID NO: 916521 - DNA, 14 bp, Homo sapiens
agggctcacagggc

SEQ ID NO: 916522 - DNA, 17 bp, Homo sapiens
agggctcaccagctggg

SEQ ID NO: 916523 - DNA, 12 bp, Homo sapiens
agggctcagcct

SEQ ID NO: 916524 - DNA, 15 bp, Homo sapiens
agggctcagcctggt

SEQ ID NO: 916525 - DNA, 19 bp, Homo sapiens
agggctcagggcagtggct

SEQ ID NO: 916526 - DNA, 23 bp, Homo sapiens
cagttcccggagcacagccctgg

SEQ ID NO: 916527 - DNA, 13 bp, Homo sapiens
cagttccctcctg

SEQ ID NO: 916528 - DNA, 20 bp, Homo sapiens
cagttccctcctgcccagga

SEQ ID NO: 916529 - DNA, 15 bp, Homo sapiens
cagttcccttggcct

SEQ ID NO: 916530 - DNA, 17 bp, Homo sapiens
cagttcccttggcctca

SEQ ID NO: 916531 - DNA, 18 bp, Homo sapiens
cagttcccttggcctcag

SEQ ID NO: 916532 - DNA, 20 bp, Homo sapiens
cagttcccttggcctcagaa

SEQ ID NO: 916533 - DNA, 18 bp, Homo sapiens
cagttcctatgacacagt

SEQ ID NO: 916534 - DNA, 14 bp, Homo sapiens
cagttcctgctctc

SEQ ID NO: 916535 - DNA, 17 bp, Homo sapiens
cagttcctgctctctgc

SEQ ID NO: 916536 - DNA, 18 bp, Homo sapiens
cagttcctgctctctgct

SEQ ID NO: 916537 - DNA, 15 bp, Homo sapiens
cagttcctgggaaca

SEQ ID NO: 916538 - DNA, 18 bp, Homo sapiens
cagttcgtgtttgattcc

SEQ ID NO: 916539 - DNA, 21 bp, Homo sapiens
cagttcgttggtagagccctc

SEQ ID NO: 916540 - DNA, 17 bp, Homo sapiens
cagttctacagaaaaac

SEQ ID NO: 916541 - DNA, 12 bp, Homo sapiens
cagttctcccag

SEQ ID NO: 916542 - DNA, 13 bp, Homo sapiens
cagttctcccagg

SEQ ID NO: 916543 - DNA, 14 bp, Homo sapiens
cagttctcccaggg

SEQ ID NO: 916544 - DNA, 15 bp, Homo sapiens
cagttctcccaggga

SEQ ID NO: 916545 - DNA, 12 bp, Homo sapiens
cagttctctggg

SEQ ID NO: 916546 - DNA, 16 bp, Homo sapiens
cagttctgaactggaa

SEQ ID NO: 916547 - DNA, 20 bp, Homo sapiens
cagttctgaataacttgaag

SEQ ID NO: 916548 - DNA, 15 bp, Homo sapiens
cagttctgagctgta

SEQ ID NO: 916549 - DNA, 17 bp, Homo sapiens
cagttctgagctgtaat

SEQ ID NO: 916550 - DNA, 18 bp, Homo sapiens
cagttctgcaaatagaaa

SEQ ID NO: 916551 - DNA, 15 bp, Homo sapiens
cagttctgctcctct

SEQ ID NO: 916552 - DNA, 17 bp, Homo sapiens
cagttctgctcctctcc

SEQ ID NO: 916553 - DNA, 18 bp, Homo sapiens
cagttctgctcctctcca

SEQ ID NO: 916554 - DNA, 22 bp, Homo sapiens
cagttctgctcctctccaggca

SEQ ID NO: 916555 - DNA, 19 bp, Homo sapiens
cagttcttggacccctgaa

SEQ ID NO: 916556 - DNA, 13 bp, Homo sapiens
cagttctttcctc

SEQ ID NO: 916557 - DNA, 19 bp, Homo sapiens
cagttctttcctctttctg

SEQ ID NO: 916558 - DNA, 16 bp, Homo sapiens
cagttgaaaacttgta

SEQ ID NO: 916559 - DNA, 22 bp, Homo sapiens
cagttgaacactagtctgtgta

SEQ ID NO: 916560 - DNA, 19 bp, Homo sapiens
cagttgactttaagtgaaa

SEQ ID NO: 916561 - DNA, 18 bp, Homo sapiens
cagttgagagagaatctc

SEQ ID NO: 916562 - DNA, 20 bp, Homo sapiens
cagttgagtcgtcatcactt

SEQ ID NO: 916563 - DNA, 14 bp, Homo sapiens
cagttgatctgctc

SEQ ID NO: 916564 - DNA, 15 bp, Homo sapiens
cagttgatctgctct

SEQ ID NO: 916565 - DNA, 16 bp, Homo sapiens
cagttgatctgctctg

SEQ ID NO: 916566 - DNA, 12 bp, Homo sapiens
cagttgccacca

SEQ ID NO: 916567 - DNA, 15 bp, Homo sapiens
cagttgccaccacct

SEQ ID NO: 916568 - DNA, 16 bp, Homo sapiens
cagttgccaccacctc

SEQ ID NO: 916569 - DNA, 22 bp, Homo sapiens
cagttgcccgaaactaagccag

SEQ ID NO: 916570 - DNA, 12 bp, Homo sapiens
cagttgctgtga

SEQ ID NO: 916571 - DNA, 15 bp, Homo sapiens
cagttggactctcag

SEQ ID NO: 916572 - DNA, 17 bp, Homo sapiens
cagttggactctcaggg

SEQ ID NO: 916573 - DNA, 22 bp, Homo sapiens
cagttggagtttgtgtctgttg

SEQ ID NO: 916574 - DNA, 15 bp, Homo sapiens
cagttggcagagaag

SEQ ID NO: 916575 - DNA, 21 bp, Homo sapiens
cagttggcagagaaggcctct

SEQ ID NO: 916576 - DNA, 18 bp, Homo sapiens
cagttggccaagcagaaa

SEQ ID NO: 916577 - DNA, 16 bp, Homo sapiens
cagttggccagagagc

SEQ ID NO: 916578 - DNA, 19 bp, Homo sapiens
cagttggggccctcttgcc

SEQ ID NO: 916579 - DNA, 16 bp, Homo sapiens
cagttggtaacttttg

SEQ ID NO: 916580 - DNA, 22 bp, Homo sapiens
cagttggtgactgggaaagtta

SEQ ID NO: 916581 - DNA, 16 bp, Homo sapiens
cagttgtatgtttgct

SEQ ID NO: 916582 - DNA, 14 bp, Homo sapiens
cagttgtatttaac

SEQ ID NO: 916583 - DNA, 14 bp, Homo sapiens
cagttgtatttaat

SEQ ID NO: 916584 - DNA, 17 bp, Homo sapiens
cagttgtcctatggaca

SEQ ID NO: 916585 - DNA, 20 bp, Homo sapiens
cagttgtctattctgagcct

SEQ ID NO: 916586 - DNA, 21 bp, Homo sapiens
cagttgtctctgatgcagctt

SEQ ID NO: 916587 - DNA, 15 bp, Homo sapiens
cagttgtgtcataaa

SEQ ID NO: 916588 - DNA, 13 bp, Homo sapiens
cagttgttctttt

SEQ ID NO: 916589 - DNA, 15 bp, Homo sapiens
cagttgttggcctcc

SEQ ID NO: 916590 - DNA, 13 bp, Homo sapiens
cagttgtttgatg

SEQ ID NO: 916591 - DNA, 14 bp, Homo sapiens
cagttgtttgcttc

SEQ ID NO: 916592 - DNA, 20 bp, Homo sapiens
cagtttaagattttaagtat

SEQ ID NO: 916593 - DNA, 19 bp, Homo sapiens
cagtttaatattccaatac

SEQ ID NO: 916594 - DNA, 21 bp, Homo sapiens
cagtttaatccttctagtttc

SEQ ID NO: 916595 - DNA, 23 bp, Homo sapiens
cagtttacagacgctgctgtcac

SEQ ID NO: 916596 - DNA, 21 bp, Homo sapiens
cagtttagaacagagggacca

SEQ ID NO: 916597 - DNA, 19 bp, Homo sapiens
cagtttatacagaactcac

SEQ ID NO: 916598 - DNA, 23 bp, Homo sapiens
cagtttatattgtggaataaatc

SEQ ID NO: 916599 - DNA, 19 bp, Homo sapiens
cagtttatatttaactctc

SEQ ID NO: 916600 - DNA, 15 bp, Homo sapiens
cagtttatcattcaa

SEQ ID NO: 916601 - DNA, 16 bp, Homo sapiens
cagtttatcattcaag

SEQ ID NO: 916602 - DNA, 18 bp, Homo sapiens
cagtttatcattcaagtg

SEQ ID NO: 916603 - DNA, 18 bp, Homo sapiens
cagtttatcctgacatat

SEQ ID NO: 916604 - DNA, 19 bp, Homo sapiens
cagtttatcctgacatatt

SEQ ID NO: 916605 - DNA, 13 bp, Homo sapiens
cagtttatcctgt

SEQ ID NO: 916606 - DNA, 15 bp, Homo sapiens
cagtttattctgtgg

SEQ ID NO: 916607 - DNA, 22 bp, Homo sapiens
cagtttattctgtggttctata

SEQ ID NO: 916608 - DNA, 18 bp, Homo sapiens
cagtttattgatattcaa

SEQ ID NO: 916609 - DNA, 19 bp, Homo sapiens
cagtttatttccactattt

SEQ ID NO: 916610 - DNA, 22 bp, Homo sapiens
cagtttatttccactattttca

SEQ ID NO: 916611 - DNA, 14 bp, Homo sapiens
cagtttatttgttg

SEQ ID NO: 916612 - DNA, 23 bp, Homo sapiens
cagtttcactttcacatagatgt

SEQ ID NO: 916613 - DNA, 21 bp, Homo sapiens
cagtttcagagagtcaatgtc

SEQ ID NO: 916614 - DNA, 22 bp, Homo sapiens
cagtttcaggtgtttagttgca

SEQ ID NO: 916615 - DNA, 14 bp, Homo sapiens
cagtttctaaaatt

SEQ ID NO: 916616 - DNA, 16 bp, Homo sapiens
cagtttctccatcagc

SEQ ID NO: 916617 - DNA, 11 bp, Homo sapiens
cagtttctcct

SEQ ID NO: 916618 - DNA, 17 bp, Homo sapiens
cagtttctctgccttct

SEQ ID NO: 916619 - DNA, 22 bp, Homo sapiens
cagtttcttctgcgcctcaggc

SEQ ID NO: 916620 - DNA, 23 bp, Homo sapiens
cagtttcttgcttggaagccagg

SEQ ID NO: 916621 - DNA, 15 bp, Homo sapiens
cagtttgaagtcaaa

SEQ ID NO: 916622 - DNA, 20 bp, Homo sapiens
cagtttgattgaggagctgc

SEQ ID NO: 916623 - DNA, 11 bp, Homo sapiens
cagtttgcaaa

SEQ ID NO: 916624 - DNA, 15 bp, Homo sapiens
cagtttgcaaaaaat

SEQ ID NO: 916625 - DNA, 19 bp, Homo sapiens
cagtttgcatgattcttct

SEQ ID NO: 916626 - DNA, 17 bp, Homo sapiens
cagtttgcctgctgtat

SEQ ID NO: 916627 - DNA, 12 bp, Homo sapiens
cagtttgctttg

SEQ ID NO: 916628 - DNA, 21 bp, Homo sapiens
cagtttgctttgtatgcactt

SEQ ID NO: 916629 - DNA, 21 bp, Homo sapiens
cagtttggccctggagccagg

SEQ ID NO: 916630 - DNA, 22 bp, Homo sapiens
cagtttggccctggagccaggg

SEQ ID NO: 916631 - DNA, 12 bp, Homo sapiens
cagtttggggtg

SEQ ID NO: 916632 - DNA, 22 bp, Homo sapiens
cagtttgggtaaaatactttta

SEQ ID NO: 916633 - DNA, 18 bp, Homo sapiens
cagtttggtagtgcccca

SEQ ID NO: 916634 - DNA, 13 bp, Homo sapiens
cagtttggttggg

SEQ ID NO: 916635 - DNA, 13 bp, Homo sapiens
cagtttgtcagac

SEQ ID NO: 916636 - DNA, 15 bp, Homo sapiens
cagtttgtgtgtctt

SEQ ID NO: 916637 - DNA, 23 bp, Homo sapiens
cagtttgtgtgtcttaattatta

SEQ ID NO: 916638 - DNA, 21 bp, Homo sapiens
cagtttgttagtatgaggcat

SEQ ID NO: 916639 - DNA, 23 bp, Homo sapiens
cagttttaactgtggatattgtt

SEQ ID NO: 916640 - DNA, 13 bp, Homo sapiens
cagttttcagaaa

SEQ ID NO: 916641 - DNA, 13 bp, Homo sapiens
cagttttccatga

SEQ ID NO: 916642 - DNA, 17 bp, Homo sapiens
cagttttccatgaaaac

SEQ ID NO: 916643 - DNA, 13 bp, Homo sapiens
cagttttcccctg

SEQ ID NO: 916644 - DNA, 18 bp, Homo sapiens
cagttttcccctggcctc

SEQ ID NO: 916645 - DNA, 14 bp, Homo sapiens
cagttttctcctct

SEQ ID NO: 916646 - DNA, 20 bp, Homo sapiens
cagttttctggctggagcct

SEQ ID NO: 916647 - DNA, 13 bp, Homo sapiens
cagttttgacatt

SEQ ID NO: 916648 - DNA, 11 bp, Homo sapiens
cagttttggaa

SEQ ID NO: 916649 - DNA, 12 bp, Homo sapiens
cagttttgtaag

SEQ ID NO: 916650 - DNA, 19 bp, Homo sapiens
cagttttgtaagccctctt

SEQ ID NO: 916651 - DNA, 17 bp, Homo sapiens
agggctcagtcttttga

SEQ ID NO: 916652 - DNA, 22 bp, Homo sapiens
agggctccaaatctgcctagaa

SEQ ID NO: 916653 - DNA, 15 bp, Homo sapiens
agggctccagcatcc

SEQ ID NO: 916654 - DNA, 23 bp, Homo sapiens
agggctccagcatccagcctgtg

SEQ ID NO: 916655 - DNA, 14 bp, Homo sapiens
agggctccagcccc

SEQ ID NO: 916656 - DNA, 20 bp, Homo sapiens
agggctccagcccctcttgg

SEQ ID NO: 916657 - DNA, 12 bp, Homo sapiens
agggctcccatg

SEQ ID NO: 916658 - DNA, 16 bp, Homo sapiens
agggctccctcctgga

SEQ ID NO: 916659 - DNA, 17 bp, Homo sapiens
agggctccctcctggag

SEQ ID NO: 916660 - DNA, 19 bp, Homo sapiens
agggctccctcctggagca

SEQ ID NO: 916661 - DNA, 16 bp, Homo sapiens
agggctcctatctttc

SEQ ID NO: 916662 - DNA, 14 bp, Homo sapiens
agggctcctcccag

SEQ ID NO: 916663 - DNA, 13 bp, Homo sapiens
agggctcctgggg

SEQ ID NO: 916664 - DNA, 14 bp, Homo sapiens
agggctcctggggc

SEQ ID NO: 916665 - DNA, 15 bp, Homo sapiens
agggctcctggggca

SEQ ID NO: 916666 - DNA, 17 bp, Homo sapiens
agggctcctggggcaga

SEQ ID NO: 916667 - DNA, 23 bp, Homo sapiens
agggctctaaaaaaagccccaaa

SEQ ID NO: 916668 - DNA, 17 bp, Homo sapiens
agggctctgatattcca

SEQ ID NO: 916669 - DNA, 22 bp, Homo sapiens
agggctctgatattccatgaat

SEQ ID NO: 916670 - DNA, 16 bp, Homo sapiens
agggctctgcaggcca

SEQ ID NO: 916671 - DNA, 14 bp, Homo sapiens
agggctctgtttgt

SEQ ID NO: 916672 - DNA, 14 bp, Homo sapiens
agggctgaaagcca

SEQ ID NO: 916673 - DNA, 17 bp, Homo sapiens
agggctgagcctggtcc

SEQ ID NO: 916674 - DNA, 16 bp, Homo sapiens
agggctgagctgggga

SEQ ID NO: 916675 - DNA, 17 bp, Homo sapiens
agggctgaggagcagcc

SEQ ID NO: 916676 - DNA, 19 bp, Homo sapiens
agggctgaggagcagccag

SEQ ID NO: 916677 - DNA, 15 bp, Homo sapiens
agggctgaggggcct

SEQ ID NO: 916678 - DNA, 20 bp, Homo sapiens
agggctgcaaaactggaagc

SEQ ID NO: 916679 - DNA, 23 bp, Homo sapiens
agggctgcaaaactggaagcaca

SEQ ID NO: 916680 - DNA, 15 bp, Homo sapiens
agggctgcatgatgt

SEQ ID NO: 916681 - DNA, 15 bp, Homo sapiens
agggctgccctgaga

SEQ ID NO: 916682 - DNA, 23 bp, Homo sapiens
agggctgccctgagaagctgctc

SEQ ID NO: 916683 - DNA, 12 bp, Homo sapiens
agggctgctgct

SEQ ID NO: 916684 - DNA, 22 bp, Homo sapiens
agggctgctgcttctgctccag

SEQ ID NO: 916685 - DNA, 21 bp, Homo sapiens
agggctgctgggagcctctcc

SEQ ID NO: 916686 - DNA, 14 bp, Homo sapiens
agggctgcttttct

SEQ ID NO: 916687 - DNA, 22 bp, Homo sapiens
agggctggacctatgtcctaag

SEQ ID NO: 916688 - DNA, 21 bp, Homo sapiens
agggctggagacttcctctgg

SEQ ID NO: 916689 - DNA, 15 bp, Homo sapiens
agggctggagcctgg

SEQ ID NO: 916690 - DNA, 16 bp, Homo sapiens
agggctggaggcccag

SEQ ID NO: 916691 - DNA, 18 bp, Homo sapiens
agggctggaggcccaggc

SEQ ID NO: 916692 - DNA, 19 bp, Homo sapiens
agggctggagtgcgctctt

SEQ ID NO: 916693 - DNA, 14 bp, Homo sapiens
agggctggatggac

SEQ ID NO: 916694 - DNA, 20 bp, Homo sapiens
agggctggatggacagacac

SEQ ID NO: 916695 - DNA, 23 bp, Homo sapiens
agggctggatggacagacacctc

SEQ ID NO: 916696 - DNA, 20 bp, Homo sapiens
agggctggcacgtgacaggc

SEQ ID NO: 916697 - DNA, 14 bp, Homo sapiens
agggctggctcccc

SEQ ID NO: 916698 - DNA, 22 bp, Homo sapiens
agggctggctccccctccccag

SEQ ID NO: 916699 - DNA, 13 bp, Homo sapiens
agggctggctggc

SEQ ID NO: 916700 - DNA, 20 bp, Homo sapiens
agggctggctggcctcaccc

SEQ ID NO: 916701 - DNA, 12 bp, Homo sapiens
agggctgggagg

SEQ ID NO: 916702 - DNA, 14 bp, Homo sapiens
agggctgggaggaa

SEQ ID NO: 916703 - DNA, 14 bp, Homo sapiens
agggctgggcccac

SEQ ID NO: 916704 - DNA, 14 bp, Homo sapiens
agggctggggactg

SEQ ID NO: 916705 - DNA, 19 bp, Homo sapiens
agggctgtcatctgtgcac

SEQ ID NO: 916706 - DNA, 22 bp, Homo sapiens
agggctgtgcttgaaggccctg

SEQ ID NO: 916707 - DNA, 23 bp, Homo sapiens
agggctgtgcttgaaggccctgc

SEQ ID NO: 916708 - DNA, 18 bp, Homo sapiens
agggctgttgctagggag

SEQ ID NO: 916709 - DNA, 17 bp, Homo sapiens
agggctgttggacagct

SEQ ID NO: 916710 - DNA, 21 bp, Homo sapiens
agggctgttggacagctgctt

SEQ ID NO: 916711 - DNA, 22 bp, Homo sapiens
agggctgttggacagctgcttg

SEQ ID NO: 916712 - DNA, 24 bp, Homo sapiens
agggctgttggacagctgcttgtg

SEQ ID NO: 916713 - DNA, 21 bp, Homo sapiens
agggcttccccatcagctccc

SEQ ID NO: 916714 - DNA, 13 bp, Homo sapiens
agggcttcctctt

SEQ ID NO: 916715 - DNA, 15 bp, Homo sapiens
agggcttctgcaccc

SEQ ID NO: 916716 - DNA, 18 bp, Homo sapiens
agggcttctgcaccctcc

SEQ ID NO: 916717 - DNA, 22 bp, Homo sapiens
agggcttctgcaccctccaccc

SEQ ID NO: 916718 - DNA, 18 bp, Homo sapiens
agggctttggttccttct

SEQ ID NO: 916719 - DNA, 20 bp, Homo sapiens
agggctttggttccttctct

SEQ ID NO: 916720 - DNA, 18 bp, Homo sapiens
agggctttgttttgcaca

SEQ ID NO: 916721 - DNA, 12 bp, Homo sapiens
agggctttttaa

SEQ ID NO: 916722 - DNA, 20 bp, Homo sapiens
aggggaaaccagtgtagcct

SEQ ID NO: 916723 - DNA, 13 bp, Homo sapiens
aggggaaatgtaa

SEQ ID NO: 916724 - DNA, 23 bp, Homo sapiens
aggggaacatcaccctatatata

SEQ ID NO: 916725 - DNA, 15 bp, Homo sapiens
aggggaacctgccat

SEQ ID NO: 916726 - DNA, 22 bp, Homo sapiens
aggggaagaaacactttctctt

SEQ ID NO: 916727 - DNA, 15 bp, Homo sapiens
aggggaagaaggaaa

SEQ ID NO: 916728 - DNA, 22 bp, Homo sapiens
aggggaagagacaaagtgggtg

SEQ ID NO: 916729 - DNA, 15 bp, Homo sapiens
aggggaagccagtga

SEQ ID NO: 916730 - DNA, 15 bp, Homo sapiens
aggggaagctgggcc

SEQ ID NO: 916731 - DNA, 15 bp, Homo sapiens
aggggaaggaaggag

SEQ ID NO: 916732 - DNA, 19 bp, Homo sapiens
aggggaaggaaggagggca

SEQ ID NO: 916733 - DNA, 12 bp, Homo sapiens
aggggaagggca

SEQ ID NO: 916734 - DNA, 15 bp, Homo sapiens
aggggaagggcaggc

SEQ ID NO: 916735 - DNA, 15 bp, Homo sapiens
aggggaaggggccgg

SEQ ID NO: 916736 - DNA, 16 bp, Homo sapiens
aggggaagggggtgca

SEQ ID NO: 916737 - DNA, 19 bp, Homo sapiens
aggggaataatagaagaac

SEQ ID NO: 916738 - DNA, 20 bp, Homo sapiens
aggggaatatacacattgct

SEQ ID NO: 916739 - DNA, 21 bp, Homo sapiens
aggggaattccctccccctcc

SEQ ID NO: 916740 - DNA, 18 bp, Homo sapiens
aggggacacctgtacatt

SEQ ID NO: 916741 - DNA, 20 bp, Homo sapiens
aggggacactggccccacag

SEQ ID NO: 916742 - DNA, 22 bp, Homo sapiens
aggggacactggccccacagga

SEQ ID NO: 916743 - DNA, 19 bp, Homo sapiens
aggggacaggcctcacctc

SEQ ID NO: 916744 - DNA, 21 bp, Homo sapiens
aggggacaggcctcacctcta

SEQ ID NO: 916745 - DNA, 24 bp, Homo sapiens
aggggaccaattctggacagacag

SEQ ID NO: 916746 - DNA, 13 bp, Homo sapiens
aggggacccaaga

SEQ ID NO: 916747 - DNA, 12 bp, Homo sapiens
aggggacccagc

SEQ ID NO: 916748 - DNA, 16 bp, Homo sapiens
aggggacccagctcct

SEQ ID NO: 916749 - DNA, 17 bp, Homo sapiens
aggggacccagctcctc

SEQ ID NO: 916750 - DNA, 11 bp, Homo sapiens
aggggacccca

SEQ ID NO: 916751 - DNA, 13 bp, Homo sapiens
aggggaccccact

SEQ ID NO: 916752 - DNA, 15 bp, Homo sapiens
aggggacccccgccc

SEQ ID NO: 916753 - DNA, 18 bp, Homo sapiens
aggggacccccgccccct

SEQ ID NO: 916754 - DNA, 24 bp, Homo sapiens
aggggaccttggcgctctcagctt

SEQ ID NO: 916755 - DNA, 14 bp, Homo sapiens
aggggacgggcaag

SEQ ID NO: 916756 - DNA, 17 bp, Homo sapiens
aggggactcagccctga

SEQ ID NO: 916757 - DNA, 12 bp, Homo sapiens
aggggactgggg

SEQ ID NO: 916758 - DNA, 21 bp, Homo sapiens
aggggagaaactgaaagtgtt

SEQ ID NO: 916759 - DNA, 16 bp, Homo sapiens
aggggagaagagccct

SEQ ID NO: 916760 - DNA, 16 bp, Homo sapiens
aggggagaatgcagcc

SEQ ID NO: 916761 - DNA, 17 bp, Homo sapiens
aggggagaatgcagccc

SEQ ID NO: 916762 - DNA, 12 bp, Homo sapiens
aggggagagaga

SEQ ID NO: 916763 - DNA, 17 bp, Homo sapiens
aggggagagcctgctgg

SEQ ID NO: 916764 - DNA, 22 bp, Homo sapiens
aggggagagcctgctggcaccc

SEQ ID NO: 916765 - DNA, 19 bp, Homo sapiens
aggggagagtccagtgagt

SEQ ID NO: 916766 - DNA, 20 bp, Homo sapiens
aggggagatactctccctga

SEQ ID NO: 916767 - DNA, 17 bp, Homo sapiens
aggggagcacggagccg

SEQ ID NO: 916768 - DNA, 21 bp, Homo sapiens
aggggagcagcggctctggtc

SEQ ID NO: 916769 - DNA, 11 bp, Homo sapiens
aggggagccag

SEQ ID NO: 916770 - DNA, 16 bp, Homo sapiens
aggggagccagaaatg

SEQ ID NO: 916771 - DNA, 22 bp, Homo sapiens
aggggagccagaaatgggcagt

SEQ ID NO: 916772 - DNA, 13 bp, Homo sapiens
aggggagccagct

SEQ ID NO: 916773 - DNA, 17 bp, Homo sapiens
aggggagccagctgctt

SEQ ID NO: 916774 - DNA, 19 bp, Homo sapiens
aggggagccagctgcttga

SEQ ID NO: 916775 - DNA, 15 bp, Homo sapiens
cagtttttatatagt

SEQ ID NO: 916776 - DNA, 12 bp, Homo sapiens
cagtttttcagg

SEQ ID NO: 916777 - DNA, 14 bp, Homo sapiens
cagtttttgtatct

SEQ ID NO: 916778 - DNA, 15 bp, Homo sapiens
cagtttttgtatctt

SEQ ID NO: 916779 - DNA, 19 bp, Homo sapiens
cagttttttcacctggaag

SEQ ID NO: 916780 - DNA, 20 bp, Homo sapiens
cagttttttttttcttgtct

SEQ ID NO: 916781 - DNA, 13 bp, Homo sapiens
cataaaaaaatga

SEQ ID NO: 916782 - DNA, 20 bp, Homo sapiens
cataaaaaagaagcactttg

SEQ ID NO: 916783 - DNA, 22 bp, Homo sapiens
cataaaaaagaagcactttgat

SEQ ID NO: 916784 - DNA, 23 bp, Homo sapiens
cataaaaagcaaaacaaaaatta

SEQ ID NO: 916785 - DNA, 19 bp, Homo sapiens
cataaaaagcagaatttta

SEQ ID NO: 916786 - DNA, 13 bp, Homo sapiens
cataaaaaggaca

SEQ ID NO: 916787 - DNA, 20 bp, Homo sapiens
cataaaaaggacatcagcaa

SEQ ID NO: 916788 - DNA, 22 bp, Homo sapiens
cataaaacaaaaccaagccttg

SEQ ID NO: 916789 - DNA, 12 bp, Homo sapiens
cataaaacttta

SEQ ID NO: 916790 - DNA, 15 bp, Homo sapiens
cataaaactttaaaa

SEQ ID NO: 916791 - DNA, 16 bp, Homo sapiens
cataaaactttaaaag

SEQ ID NO: 916792 - DNA, 19 bp, Homo sapiens
cataaaactttaaaaggca

SEQ ID NO: 916793 - DNA, 21 bp, Homo sapiens
cataaaagatcaccttgtatt

SEQ ID NO: 916794 - DNA, 19 bp, Homo sapiens
cataaaataaagtatatat

SEQ ID NO: 916795 - DNA, 21 bp, Homo sapiens
cataaaatccaatattgtaat

SEQ ID NO: 916796 - DNA, 17 bp, Homo sapiens
cataaaatctgtgaatt

SEQ ID NO: 916797 - DNA, 22 bp, Homo sapiens
cataaaattttctactcttttt

SEQ ID NO: 916798 - DNA, 13 bp, Homo sapiens
cataaactgactt

SEQ ID NO: 916799 - DNA, 15 bp, Homo sapiens
cataaactgacttta

SEQ ID NO: 916800 - DNA, 10 bp, Homo sapiens
cataaagact

SEQ ID NO: 916801 - DNA, 21 bp, Homo sapiens
cataaagcctttaaaaccagt

SEQ ID NO: 916802 - DNA, 20 bp, Homo sapiens
cataaagccttttgctttat

SEQ ID NO: 916803 - DNA, 21 bp, Homo sapiens
cataaagctcaaatgaaatgt

SEQ ID NO: 916804 - DNA, 15 bp, Homo sapiens
cataaagctcccttg

SEQ ID NO: 916805 - DNA, 21 bp, Homo sapiens
cataaagggtgtaggggccac

SEQ ID NO: 916806 - DNA, 16 bp, Homo sapiens
cataaagggttgaaaa

SEQ ID NO: 916807 - DNA, 17 bp, Homo sapiens
cataaagtctgagaaat

SEQ ID NO: 916808 - DNA, 18 bp, Homo sapiens
cataaagtctgagaaata

SEQ ID NO: 916809 - DNA, 19 bp, Homo sapiens
cataaagtctgagaaatag

SEQ ID NO: 916810 - DNA, 14 bp, Homo sapiens
cataaataaaactg

SEQ ID NO: 916811 - DNA, 18 bp, Homo sapiens
cataaataaaactgaatc

SEQ ID NO: 916812 - DNA, 20 bp, Homo sapiens
cataaataaaggtgtagaaa

SEQ ID NO: 916813 - DNA, 18 bp, Homo sapiens
cataaatcagaaagttta

SEQ ID NO: 916814 - DNA, 13 bp, Homo sapiens
cataaatgaagca

SEQ ID NO: 916815 - DNA, 14 bp, Homo sapiens
cataaatgaagcag

SEQ ID NO: 916816 - DNA, 13 bp, Homo sapiens
cataaatgtgttc

SEQ ID NO: 916817 - DNA, 14 bp, Homo sapiens
cataaatgtgttcc

SEQ ID NO: 916818 - DNA, 14 bp, Homo sapiens
cataaattaaaatg

SEQ ID NO: 916819 - DNA, 12 bp, Homo sapiens
cataaattacag

SEQ ID NO: 916820 - DNA, 12 bp, Homo sapiens
cataaattattt

SEQ ID NO: 916821 - DNA, 15 bp, Homo sapiens
cataacaacttcata

SEQ ID NO: 916822 - DNA, 17 bp, Homo sapiens
cataacatttaaagaga

SEQ ID NO: 916823 - DNA, 19 bp, Homo sapiens
cataacatttaaagagatt

SEQ ID NO: 916824 - DNA, 20 bp, Homo sapiens
cataaccaacattaaaactc

SEQ ID NO: 916825 - DNA, 22 bp, Homo sapiens
cataacggaaaaataattgcca

SEQ ID NO: 916826 - DNA, 18 bp, Homo sapiens
cataacgtgcccccagag

SEQ ID NO: 916827 - DNA, 11 bp, Homo sapiens
cataactgaaa

SEQ ID NO: 916828 - DNA, 14 bp, Homo sapiens
cataactgaacatc

SEQ ID NO: 916829 - DNA, 18 bp, Homo sapiens
cataactgcttcttggag

SEQ ID NO: 916830 - DNA, 18 bp, Homo sapiens
cataactggattttgaac

SEQ ID NO: 916831 - DNA, 12 bp, Homo sapiens
cataacttgaaa

SEQ ID NO: 916832 - DNA, 15 bp, Homo sapiens
cataacttgctgaat

SEQ ID NO: 916833 - DNA, 19 bp, Homo sapiens
cataacttgctgaatttca

SEQ ID NO: 916834 - DNA, 12 bp, Homo sapiens
cataagaatgaa

SEQ ID NO: 916835 - DNA, 21 bp, Homo sapiens
cataagaatgaataataatta

SEQ ID NO: 916836 - DNA, 20 bp, Homo sapiens
cataagaccataacagccaa

SEQ ID NO: 916837 - DNA, 21 bp, Homo sapiens
cataagaccataacagccaac

SEQ ID NO: 916838 - DNA, 15 bp, Homo sapiens
cataagaccgtgtcc

SEQ ID NO: 916839 - DNA, 18 bp, Homo sapiens
cataagactttgggatag

SEQ ID NO: 916840 - DNA, 16 bp, Homo sapiens
cataagagagatgaga

SEQ ID NO: 916841 - DNA, 18 bp, Homo sapiens
cataagagagatgagaaa

SEQ ID NO: 916842 - DNA, 12 bp, Homo sapiens
cataagattaaa

SEQ ID NO: 916843 - DNA, 20 bp, Homo sapiens
cataagattaaaggaaggaa

SEQ ID NO: 916844 - DNA, 22 bp, Homo sapiens
cataagattaaaggaaggaaaa

SEQ ID NO: 916845 - DNA, 20 bp, Homo sapiens
cataagccaaaactgagcat

SEQ ID NO: 916846 - DNA, 16 bp, Homo sapiens
cataagctaagcctta

SEQ ID NO: 916847 - DNA, 22 bp, Homo sapiens
cataagctatcacctagcagcc

SEQ ID NO: 916848 - DNA, 22 bp, Homo sapiens
cataagcttggtgacaaaattc

SEQ ID NO: 916849 - DNA, 14 bp, Homo sapiens
cataaggagaatgt

SEQ ID NO: 916850 - DNA, 19 bp, Homo sapiens
cataaggagaatgtatctc

SEQ ID NO: 916851 - DNA, 21 bp, Homo sapiens
cataaggccagaaactccttt

SEQ ID NO: 916852 - DNA, 22 bp, Homo sapiens
cataaggccagaaactcctttt

SEQ ID NO: 916853 - DNA, 15 bp, Homo sapiens
cataaggtttcgttt

SEQ ID NO: 916854 - DNA, 15 bp, Homo sapiens
cataagtaactttta

SEQ ID NO: 916855 - DNA, 21 bp, Homo sapiens
cataagtaacttttaaaattt

SEQ ID NO: 916856 - DNA, 16 bp, Homo sapiens
cataagtttaactgta

SEQ ID NO: 916857 - DNA, 21 bp, Homo sapiens
cataataaaaaattatgacaa

SEQ ID NO: 916858 - DNA, 23 bp, Homo sapiens
cataataaaaaattatgacaatg

SEQ ID NO: 916859 - DNA, 14 bp, Homo sapiens
cataataaaagtga

SEQ ID NO: 916860 - DNA, 13 bp, Homo sapiens
cataataaagttg

SEQ ID NO: 916861 - DNA, 15 bp, Homo sapiens
cataataaccctgcc

SEQ ID NO: 916862 - DNA, 17 bp, Homo sapiens
cataataagctaaagag

SEQ ID NO: 916863 - DNA, 22 bp, Homo sapiens
cataataggtagtttggatatt

SEQ ID NO: 916864 - DNA, 18 bp, Homo sapiens
cataatagttagccctca

SEQ ID NO: 916865 - DNA, 15 bp, Homo sapiens
cataatcatgtaaat

SEQ ID NO: 916866 - DNA, 15 bp, Homo sapiens
cataatgaagacata

SEQ ID NO: 916867 - DNA, 18 bp, Homo sapiens
cataatgataaaataaat

SEQ ID NO: 916868 - DNA, 23 bp, Homo sapiens
cataatgataaaataaataattt

SEQ ID NO: 916869 - DNA, 21 bp, Homo sapiens
cataatgcattcttctctgtt

SEQ ID NO: 916870 - DNA, 14 bp, Homo sapiens
cataatgcgtgcat

SEQ ID NO: 916871 - DNA, 21 bp, Homo sapiens
cataatgcgtgcataccactt

SEQ ID NO: 916872 - DNA, 20 bp, Homo sapiens
cataatgctaatttaaagag

SEQ ID NO: 916873 - DNA, 21 bp, Homo sapiens
cataatgctaatttaaagaga

SEQ ID NO: 916874 - DNA, 20 bp, Homo sapiens
cataatgctcccatctcctg

SEQ ID NO: 916875 - DNA, 14 bp, Homo sapiens
cataatggggtcct

SEQ ID NO: 916876 - DNA, 15 bp, Homo sapiens
cataatggttgtgaa

SEQ ID NO: 916877 - DNA, 16 bp, Homo sapiens
cataatggttgtgaaa

SEQ ID NO: 916878 - DNA, 17 bp, Homo sapiens
cataatggttgtgaaat

SEQ ID NO: 916879 - DNA, 21 bp, Homo sapiens
cataatggttgtgaaatgtaa

SEQ ID NO: 916880 - DNA, 20 bp, Homo sapiens
cataatgtactgatttcagt

SEQ ID NO: 916881 - DNA, 14 bp, Homo sapiens
cataatgtattgtt

SEQ ID NO: 916882 - DNA, 18 bp, Homo sapiens
cataatgtttctggattt

SEQ ID NO: 916883 - DNA, 16 bp, Homo sapiens
cataatgtttttcctt

SEQ ID NO: 916884 - DNA, 19 bp, Homo sapiens
cataatgtttttcctttct

SEQ ID NO: 916885 - DNA, 20 bp, Homo sapiens
cataatgtttttcctttctt

SEQ ID NO: 916886 - DNA, 21 bp, Homo sapiens
cataattacattcctaactag

SEQ ID NO: 916887 - DNA, 19 bp, Homo sapiens
cataattagatccattaat

SEQ ID NO: 916888 - DNA, 14 bp, Homo sapiens
cataattatgaaaa

SEQ ID NO: 916889 - DNA, 22 bp, Homo sapiens
cataattatgaaaactcatgat

SEQ ID NO: 916890 - DNA, 15 bp, Homo sapiens
cataattatgacagt

SEQ ID NO: 916891 - DNA, 17 bp, Homo sapiens
cataattattttgttga

SEQ ID NO: 916892 - DNA, 16 bp, Homo sapiens
cataattcctacagca

SEQ ID NO: 916893 - DNA, 22 bp, Homo sapiens
cataattctaagttatttactt

SEQ ID NO: 916894 - DNA, 16 bp, Homo sapiens
cataattcttgtatat

SEQ ID NO: 916895 - DNA, 20 bp, Homo sapiens
cataattgattaaaatctct

SEQ ID NO: 916896 - DNA, 15 bp, Homo sapiens
cataatttaaaaata

SEQ ID NO: 916897 - DNA, 18 bp, Homo sapiens
cataatttagttgtttct

SEQ ID NO: 916898 - DNA, 20 bp, Homo sapiens
cataatttagttgtttctag

SEQ ID NO: 916899 - DNA, 22 bp, Homo sapiens
aggggagcctttggggggccac

SEQ ID NO: 916900 - DNA, 14 bp, Homo sapiens
aggggagcttggga

SEQ ID NO: 916901 - DNA, 20 bp, Homo sapiens
aggggagcttgggactcagg

SEQ ID NO: 916902 - DNA, 12 bp, Homo sapiens
aggggaggaaaa

SEQ ID NO: 916903 - DNA, 20 bp, Homo sapiens
aggggaggaaaaaagaacca

SEQ ID NO: 916904 - DNA, 23 bp, Homo sapiens
aggggaggaaaaaagaaccaaaa

SEQ ID NO: 916905 - DNA, 16 bp, Homo sapiens
aggggaggacactggt

SEQ ID NO: 916906 - DNA, 12 bp, Homo sapiens
aggggaggagaa

SEQ ID NO: 916907 - DNA, 20 bp, Homo sapiens
aggggaggatagcgagaaga

SEQ ID NO: 916908 - DNA, 19 bp, Homo sapiens
aggggaggatcactggagc

SEQ ID NO: 916909 - DNA, 17 bp, Homo sapiens
aggggaggcacctccag

SEQ ID NO: 916910 - DNA, 13 bp, Homo sapiens
aggggaggcagcc

SEQ ID NO: 916911 - DNA, 17 bp, Homo sapiens
aggggaggcatcagtgt

SEQ ID NO: 916912 - DNA, 17 bp, Homo sapiens
aggggagggcaggcttg

SEQ ID NO: 916913 - DNA, 11 bp, Homo sapiens
aggggaggggc

SEQ ID NO: 916914 - DNA, 14 bp, Homo sapiens
aggggaggggccta

SEQ ID NO: 916915 - DNA, 18 bp, Homo sapiens
aggggagtcaccttccct

SEQ ID NO: 916916 - DNA, 22 bp, Homo sapiens
aggggagtcaccttcccttgcc

SEQ ID NO: 916917 - DNA, 16 bp, Homo sapiens
aggggagttgtgtctg

SEQ ID NO: 916918 - DNA, 14 bp, Homo sapiens
aggggatatttaag

SEQ ID NO: 916919 - DNA, 19 bp, Homo sapiens
aggggatgcccagaagagt

SEQ ID NO: 916920 - DNA, 21 bp, Homo sapiens
aggggatggacacccccagct

SEQ ID NO: 916921 - DNA, 13 bp, Homo sapiens
aggggatggaggc

SEQ ID NO: 916922 - DNA, 15 bp, Homo sapiens
aggggatggaggcca

SEQ ID NO: 916923 - DNA, 22 bp, Homo sapiens
aggggatgtttacctggtgctc

SEQ ID NO: 916924 - DNA, 17 bp, Homo sapiens
aggggcaaattcttttg

SEQ ID NO: 916925 - DNA, 20 bp, Homo sapiens
aggggcaaccaactgcccca

SEQ ID NO: 916926 - DNA, 21 bp, Homo sapiens
aggggcaaccaactgccccag

SEQ ID NO: 916927 - DNA, 18 bp, Homo sapiens
aggggcaacgaagaaaaa

SEQ ID NO: 916928 - DNA, 19 bp, Homo sapiens
aggggcaacgaagaaaaaa

SEQ ID NO: 916929 - DNA, 11 bp, Homo sapiens
aggggcacacc

SEQ ID NO: 916930 - DNA, 16 bp, Homo sapiens
aggggcacaccactgc

SEQ ID NO: 916931 - DNA, 22 bp, Homo sapiens
aggggcacaccactgccctgcc

SEQ ID NO: 916932 - DNA, 15 bp, Homo sapiens
aggggcacagggtct

SEQ ID NO: 916933 - DNA, 20 bp, Homo sapiens
aggggcacctccggctgcct

SEQ ID NO: 916934 - DNA, 14 bp, Homo sapiens
aggggcactctccc

SEQ ID NO: 916935 - DNA, 19 bp, Homo sapiens
aggggcacttcattgagag

SEQ ID NO: 916936 - DNA, 14 bp, Homo sapiens
aggggcagaacagc

SEQ ID NO: 916937 - DNA, 14 bp, Homo sapiens
aggggcagagccag

SEQ ID NO: 916938 - DNA, 15 bp, Homo sapiens
aggggcagagccagg

SEQ ID NO: 916939 - DNA, 15 bp, Homo sapiens
aggggcagcaaggcc

SEQ ID NO: 916940 - DNA, 18 bp, Homo sapiens
aggggcagcaaggccttg

SEQ ID NO: 916941 - DNA, 11 bp, Homo sapiens
aggggcagccc

SEQ ID NO: 916942 - DNA, 13 bp, Homo sapiens
aggggcagccctg

SEQ ID NO: 916943 - DNA, 13 bp, Homo sapiens
aggggcagccgct

SEQ ID NO: 916944 - DNA, 12 bp, Homo sapiens
aggggcaggcct

SEQ ID NO: 916945 - DNA, 21 bp, Homo sapiens
aggggcaggcctgggacccag

SEQ ID NO: 916946 - DNA, 14 bp, Homo sapiens
aggggcaggcgcag

SEQ ID NO: 916947 - DNA, 17 bp, Homo sapiens
aggggcaggcgcagagg

SEQ ID NO: 916948 - DNA, 20 bp, Homo sapiens
aggggcaggcgcagaggtcc

SEQ ID NO: 916949 - DNA, 15 bp, Homo sapiens
aggggcagggagagc

SEQ ID NO: 916950 - DNA, 17 bp, Homo sapiens
aggggcagggagagcgc

SEQ ID NO: 916951 - DNA, 15 bp, Homo sapiens
aggggcagggccttg

SEQ ID NO: 916952 - DNA, 17 bp, Homo sapiens
aggggcaggtggtggag

SEQ ID NO: 916953 - DNA, 19 bp, Homo sapiens
aggggcaggtggtggaggg

SEQ ID NO: 916954 - DNA, 16 bp, Homo sapiens
aggggcagtcttgcaa

SEQ ID NO: 916955 - DNA, 21 bp, Homo sapiens
aggggcatccaaggcaaacaa

SEQ ID NO: 916956 - DNA, 14 bp, Homo sapiens
aggggcatctgccc

SEQ ID NO: 916957 - DNA, 21 bp, Homo sapiens
aggggcatctgcccctccccc

SEQ ID NO: 916958 - DNA, 23 bp, Homo sapiens
aggggcatttagggagcagatga

SEQ ID NO: 916959 - DNA, 14 bp, Homo sapiens
aggggccacctcct

SEQ ID NO: 916960 - DNA, 15 bp, Homo sapiens
aggggccacctcctc

SEQ ID NO: 916961 - DNA, 16 bp, Homo sapiens
aggggccacctcctcc

SEQ ID NO: 916962 - DNA, 21 bp, Homo sapiens
aggggccacctcctccccctg

SEQ ID NO: 916963 - DNA, 20 bp, Homo sapiens
aggggccagagagcagggga

SEQ ID NO: 916964 - DNA, 17 bp, Homo sapiens
aggggccagaggctcgt

SEQ ID NO: 916965 - DNA, 16 bp, Homo sapiens
aggggccagcagaggg

SEQ ID NO: 916966 - DNA, 17 bp, Homo sapiens
aggggccaggggcaggc

SEQ ID NO: 916967 - DNA, 23 bp, Homo sapiens
aggggccaggggcaggcagggct

SEQ ID NO: 916968 - DNA, 18 bp, Homo sapiens
aggggccagtgagggctg

SEQ ID NO: 916969 - DNA, 21 bp, Homo sapiens
aggggccagtgagggctgggc

SEQ ID NO: 916970 - DNA, 24 bp, Homo sapiens
aggggccagtgagggctgggccca

SEQ ID NO: 916971 - DNA, 12 bp, Homo sapiens
aggggccatgcc

SEQ ID NO: 916972 - DNA, 18 bp, Homo sapiens
aggggcccaagccccatc

SEQ ID NO: 916973 - DNA, 14 bp, Homo sapiens
aggggcccacaggg

SEQ ID NO: 916974 - DNA, 21 bp, Homo sapiens
aggggccccagatctgcctgg

SEQ ID NO: 916975 - DNA, 20 bp, Homo sapiens
aggggccccagcgtctgcag

SEQ ID NO: 916976 - DNA, 19 bp, Homo sapiens
aggggcccccgtgttcagg

SEQ ID NO: 916977 - DNA, 16 bp, Homo sapiens
aggggccccggggctg

SEQ ID NO: 916978 - DNA, 19 bp, Homo sapiens
aggggccccggggctggca

SEQ ID NO: 916979 - DNA, 10 bp, Homo sapiens
aggggccctc

SEQ ID NO: 916980 - DNA, 14 bp, Homo sapiens
aggggccctcaggc

SEQ ID NO: 916981 - DNA, 15 bp, Homo sapiens
aggggccctgagcca

SEQ ID NO: 916982 - DNA, 12 bp, Homo sapiens
aggggccctggt

SEQ ID NO: 916983 - DNA, 13 bp, Homo sapiens
aggggcccttgga

SEQ ID NO: 916984 - DNA, 20 bp, Homo sapiens
aggggcccttggagcgtgga

SEQ ID NO: 916985 - DNA, 19 bp, Homo sapiens
aggggcccttgggacagcc

SEQ ID NO: 916986 - DNA, 22 bp, Homo sapiens
aggggccctttgcatagctctc

SEQ ID NO: 916987 - DNA, 22 bp, Homo sapiens
aggggccgctgccacccacctc

SEQ ID NO: 916988 - DNA, 22 bp, Homo sapiens
aggggccggggagggggcacgg

SEQ ID NO: 916989 - DNA, 23 bp, Homo sapiens
aggggccggggagggggcacggc

SEQ ID NO: 916990 - DNA, 19 bp, Homo sapiens
aggggcctaggcctcagcc

SEQ ID NO: 916991 - DNA, 14 bp, Homo sapiens
aggggcctagggag

SEQ ID NO: 916992 - DNA, 21 bp, Homo sapiens
aggggcctcccccagcacaga

SEQ ID NO: 916993 - DNA, 17 bp, Homo sapiens
aggggcctcccggggcc

SEQ ID NO: 916994 - DNA, 13 bp, Homo sapiens
aggggcctgagtg

SEQ ID NO: 916995 - DNA, 14 bp, Homo sapiens
aggggcctgagtgg

SEQ ID NO: 916996 - DNA, 13 bp, Homo sapiens
aggggcctgcgcc

SEQ ID NO: 916997 - DNA, 14 bp, Homo sapiens
aggggcctgcgccc

SEQ ID NO: 916998 - DNA, 16 bp, Homo sapiens
aggggcctgcgcccag

SEQ ID NO: 916999 - DNA, 13 bp, Homo sapiens
aggggcctggaga

SEQ ID NO: 917000 - DNA, 14 bp, Homo sapiens
aggggcctggagat

SEQ ID NO: 917001 - DNA, 18 bp, Homo sapiens
aggggcctggagatcctc

SEQ ID NO: 917002 - DNA, 15 bp, Homo sapiens
aggggcctggaggaa

SEQ ID NO: 917003 - DNA, 12 bp, Homo sapiens
aggggcctggca

SEQ ID NO: 917004 - DNA, 14 bp, Homo sapiens
aggggcctgggcag

SEQ ID NO: 917005 - DNA, 17 bp, Homo sapiens
aggggcctgggcagccc

SEQ ID NO: 917006 - DNA, 19 bp, Homo sapiens
aggggcctgggcagcccca

SEQ ID NO: 917007 - DNA, 18 bp, Homo sapiens
aggggccttagggagccc

SEQ ID NO: 917008 - DNA, 21 bp, Homo sapiens
aggggccttagggcactgggc

SEQ ID NO: 917009 - DNA, 22 bp, Homo sapiens
aggggccttagggcactgggct

SEQ ID NO: 917010 - DNA, 11 bp, Homo sapiens
aggggccttgc

SEQ ID NO: 917011 - DNA, 17 bp, Homo sapiens
aggggccttgctctgag

SEQ ID NO: 917012 - DNA, 14 bp, Homo sapiens
aggggcgcccaggg

SEQ ID NO: 917013 - DNA, 13 bp, Homo sapiens
aggggcgctggcc

SEQ ID NO: 917014 - DNA, 21 bp, Homo sapiens
aggggcgctggcccagccggc

SEQ ID NO: 917015 - DNA, 22 bp, Homo sapiens
aggggcgctggcccagccggcc

SEQ ID NO: 917016 - DNA, 23 bp, Homo sapiens
aggggcgctggcccagccggcct

SEQ ID NO: 917017 - DNA, 17 bp, Homo sapiens
aggggcggcaggaggga

SEQ ID NO: 917018 - DNA, 20 bp, Homo sapiens
aggggcggcaggagggaggt

SEQ ID NO: 917019 - DNA, 15 bp, Homo sapiens
aggggcgggctcaga

SEQ ID NO: 917020 - DNA, 19 bp, Homo sapiens
aggggcgggggcggaggag

SEQ ID NO: 917021 - DNA, 20 bp, Homo sapiens
aggggcgggggcggaggagg

SEQ ID NO: 917022 - DNA, 18 bp, Homo sapiens
aggggcggtgcccacacc

SEQ ID NO: 917023 - DNA, 19 bp, Homo sapiens
aggggcgtctgttccccct

SEQ ID NO: 917024 - DNA, 15 bp, Homo sapiens
cataatttgtacata

SEQ ID NO: 917025 - DNA, 16 bp, Homo sapiens
cataatttgtttaaaa

SEQ ID NO: 917026 - DNA, 19 bp, Homo sapiens
cataatttgtttaaaattc

SEQ ID NO: 917027 - DNA, 14 bp, Homo sapiens
cataattttcttca

SEQ ID NO: 917028 - DNA, 13 bp, Homo sapiens
cataattttgcat

SEQ ID NO: 917029 - DNA, 13 bp, Homo sapiens
cataatttttgta

SEQ ID NO: 917030 - DNA, 16 bp, Homo sapiens
cataatttttgtacat

SEQ ID NO: 917031 - DNA, 16 bp, Homo sapiens
catacaaaataaatgg

SEQ ID NO: 917032 - DNA, 17 bp, Homo sapiens
catacaaactctcacca

SEQ ID NO: 917033 - DNA, 17 bp, Homo sapiens
catacaaatttataaag

SEQ ID NO: 917034 - DNA, 14 bp, Homo sapiens
catacaacagaggg

SEQ ID NO: 917035 - DNA, 22 bp, Homo sapiens
catacaagaaaatgtatccaag

SEQ ID NO: 917036 - DNA, 13 bp, Homo sapiens
catacaataaaag

SEQ ID NO: 917037 - DNA, 18 bp, Homo sapiens
catacaataaaagagctt

SEQ ID NO: 917038 - DNA, 21 bp, Homo sapiens
catacaataaaagagctttat

SEQ ID NO: 917039 - DNA, 14 bp, Homo sapiens
catacaatgtatgt

SEQ ID NO: 917040 - DNA, 14 bp, Homo sapiens
catacacacagcag

SEQ ID NO: 917041 - DNA, 19 bp, Homo sapiens
catacacctcgtcaagagc

SEQ ID NO: 917042 - DNA, 21 bp, Homo sapiens
catacactgtagtttttgaaa

SEQ ID NO: 917043 - DNA, 19 bp, Homo sapiens
catacagagctctctgagg

SEQ ID NO: 917044 - DNA, 23 bp, Homo sapiens
catacagaggatgccttttctgt

SEQ ID NO: 917045 - DNA, 14 bp, Homo sapiens
catacagcctctac

SEQ ID NO: 917046 - DNA, 13 bp, Homo sapiens
catacagctgcct

SEQ ID NO: 917047 - DNA, 23 bp, Homo sapiens
catacaggaaggtagaaatatct

SEQ ID NO: 917048 - DNA, 22 bp, Homo sapiens
catacataatgtttttcctttc

SEQ ID NO: 917049 - DNA, 15 bp, Homo sapiens
catacatacatacat

SEQ ID NO: 917050 - DNA, 17 bp, Homo sapiens
catacatacatacatac

SEQ ID NO: 917051 - DNA, 17 bp, Homo sapiens
catacatacatacatat

SEQ ID NO: 917052 - DNA, 15 bp, Homo sapiens
catacatacatatat

SEQ ID NO: 917053 - DNA, 16 bp, Homo sapiens
catacatacatatata

SEQ ID NO: 917054 - DNA, 17 bp, Homo sapiens
catacatacatatatat

SEQ ID NO: 917055 - DNA, 19 bp, Homo sapiens
catacatagacatttcaaa

SEQ ID NO: 917056 - DNA, 13 bp, Homo sapiens
catacatatatat

SEQ ID NO: 917057 - DNA, 20 bp, Homo sapiens
catacatatatatctgataa

SEQ ID NO: 917058 - DNA, 22 bp, Homo sapiens
catacattgtataggccatctg

SEQ ID NO: 917059 - DNA, 17 bp, Homo sapiens
catacatttataatgtt

SEQ ID NO: 917060 - DNA, 21 bp, Homo sapiens
catacatttataatgtttgct

SEQ ID NO: 917061 - DNA, 22 bp, Homo sapiens
catacatttataatgtttgcta

SEQ ID NO: 917062 - DNA, 15 bp, Homo sapiens
catacattttctggt

SEQ ID NO: 917063 - DNA, 13 bp, Homo sapiens
cataccacttttg

SEQ ID NO: 917064 - DNA, 18 bp, Homo sapiens
cataccacttttgttctt

SEQ ID NO: 917065 - DNA, 17 bp, Homo sapiens
cataccattattatgta

SEQ ID NO: 917066 - DNA, 20 bp, Homo sapiens
catacccacccttacttcct

SEQ ID NO: 917067 - DNA, 22 bp, Homo sapiens
catacccacccttacttcctgg

SEQ ID NO: 917068 - DNA, 20 bp, Homo sapiens
cataccccttattgctgcca

SEQ ID NO: 917069 - DNA, 20 bp, Homo sapiens
catacccgcctagctgctgt

SEQ ID NO: 917070 - DNA, 16 bp, Homo sapiens
cataccgcctcgtgcc

SEQ ID NO: 917071 - DNA, 24 bp, Homo sapiens
cataccgcctcgtgccagcagcct

SEQ ID NO: 917072 - DNA, 17 bp, Homo sapiens
catacctgcccctgcct

SEQ ID NO: 917073 - DNA, 13 bp, Homo sapiens
cataccttccttc

SEQ ID NO: 917074 - DNA, 21 bp, Homo sapiens
cataccttccttccctgggct

SEQ ID NO: 917075 - DNA, 23 bp, Homo sapiens
cataccttgtttttaatctcctg

SEQ ID NO: 917076 - DNA, 14 bp, Homo sapiens
catacctttccagg

SEQ ID NO: 917077 - DNA, 22 bp, Homo sapiens
catacgcttttaatgaaaagga

SEQ ID NO: 917078 - DNA, 15 bp, Homo sapiens
catacgtacacattt

SEQ ID NO: 917079 - DNA, 16 bp, Homo sapiens
catacgtacacatttt

SEQ ID NO: 917080 - DNA, 14 bp, Homo sapiens
catactaatgatga

SEQ ID NO: 917081 - DNA, 20 bp, Homo sapiens
catactaattataccccctg

SEQ ID NO: 917082 - DNA, 20 bp, Homo sapiens
catactactgaaacagattt

SEQ ID NO: 917083 - DNA, 22 bp, Homo sapiens
catactactgaaacagatttca

SEQ ID NO: 917084 - DNA, 15 bp, Homo sapiens
catactcaaatggtg

SEQ ID NO: 917085 - DNA, 24 bp, Homo sapiens
catactcaaatggtgtcatggctg

SEQ ID NO: 917086 - DNA, 18 bp, Homo sapiens
catactcaagctgtctct

SEQ ID NO: 917087 - DNA, 23 bp, Homo sapiens
catactcaaggtgagaattaagt

SEQ ID NO: 917088 - DNA, 15 bp, Homo sapiens
catactcagcctgct

SEQ ID NO: 917089 - DNA, 23 bp, Homo sapiens
catactccttttggctggggagt

SEQ ID NO: 917090 - DNA, 22 bp, Homo sapiens
catactgagccaagtataattt

SEQ ID NO: 917091 - DNA, 15 bp, Homo sapiens
catactgagggacca

SEQ ID NO: 917092 - DNA, 12 bp, Homo sapiens
catactgctgga

SEQ ID NO: 917093 - DNA, 11 bp, Homo sapiens
catactgctgt

SEQ ID NO: 917094 - DNA, 13 bp, Homo sapiens
catactggcctct

SEQ ID NO: 917095 - DNA, 14 bp, Homo sapiens
catactggcctctg

SEQ ID NO: 917096 - DNA, 22 bp, Homo sapiens
catactggcctggactgttttc

SEQ ID NO: 917097 - DNA, 17 bp, Homo sapiens
catactgtctctggagt

SEQ ID NO: 917098 - DNA, 15 bp, Homo sapiens
catactgtctgggat

SEQ ID NO: 917099 - DNA, 17 bp, Homo sapiens
catactgtgtatgtttt

SEQ ID NO: 917100 - DNA, 16 bp, Homo sapiens
catacttaacatttca

SEQ ID NO: 917101 - DNA, 15 bp, Homo sapiens
catacttaagcaaaa

SEQ ID NO: 917102 - DNA, 15 bp, Homo sapiens
catacttacatttca

SEQ ID NO: 917103 - DNA, 18 bp, Homo sapiens
catacttacctagtgaaa

SEQ ID NO: 917104 - DNA, 21 bp, Homo sapiens
catacttggctgcttcctgtg

SEQ ID NO: 917105 - DNA, 17 bp, Homo sapiens
catactttaagtaggga

SEQ ID NO: 917106 - DNA, 14 bp, Homo sapiens
catactttcctgta

SEQ ID NO: 917107 - DNA, 23 bp, Homo sapiens
catactttgacaaggaaaatcta

SEQ ID NO: 917108 - DNA, 22 bp, Homo sapiens
catactttgtaaataggatttt

SEQ ID NO: 917109 - DNA, 12 bp, Homo sapiens
catactttgtct

SEQ ID NO: 917110 - DNA, 17 bp, Homo sapiens
catacttttgagagggg

SEQ ID NO: 917111 - DNA, 20 bp, Homo sapiens
catagaaatggaaattttgc

SEQ ID NO: 917112 - DNA, 15 bp, Homo sapiens
catagaagccacatc

SEQ ID NO: 917113 - DNA, 16 bp, Homo sapiens
catagaagccacatcg

SEQ ID NO: 917114 - DNA, 16 bp, Homo sapiens
catagaaggaagtgtg

SEQ ID NO: 917115 - DNA, 22 bp, Homo sapiens
catagaaggaagtgtgtttgcc

SEQ ID NO: 917116 - DNA, 17 bp, Homo sapiens
catagaattaattttca

SEQ ID NO: 917117 - DNA, 13 bp, Homo sapiens
catagaattttga

SEQ ID NO: 917118 - DNA, 14 bp, Homo sapiens
catagaattttgag

SEQ ID NO: 917119 - DNA, 19 bp, Homo sapiens
catagacagaagaaacaag

SEQ ID NO: 917120 - DNA, 20 bp, Homo sapiens
catagacagaagaaacaagg

SEQ ID NO: 917121 - DNA, 22 bp, Homo sapiens
catagactgaggtataaagaca

SEQ ID NO: 917122 - DNA, 23 bp, Homo sapiens
catagactgaggtataaagacaa

SEQ ID NO: 917123 - DNA, 15 bp, Homo sapiens
catagagaggcctgc

SEQ ID NO: 917124 - DNA, 19 bp, Homo sapiens
catagagagggagaagaag

SEQ ID NO: 917125 - DNA, 22 bp, Homo sapiens
catagagagggagaagaagtca

SEQ ID NO: 917126 - DNA, 14 bp, Homo sapiens
catagaggcccagg

SEQ ID NO: 917127 - DNA, 18 bp, Homo sapiens
catagaggcccaggcacc

SEQ ID NO: 917128 - DNA, 12 bp, Homo sapiens
catagaggcttc

SEQ ID NO: 917129 - DNA, 19 bp, Homo sapiens
catagaggcttctccgcca

SEQ ID NO: 917130 - DNA, 14 bp, Homo sapiens
catagagtttaaca

SEQ ID NO: 917131 - DNA, 18 bp, Homo sapiens
catagagtttaacacaag

SEQ ID NO: 917132 - DNA, 14 bp, Homo sapiens
catagataaagctg

SEQ ID NO: 917133 - DNA, 13 bp, Homo sapiens
catagatcagcca

SEQ ID NO: 917134 - DNA, 23 bp, Homo sapiens
catagatcagccattaaaataaa

SEQ ID NO: 917135 - DNA, 14 bp, Homo sapiens
catagatcttctga

SEQ ID NO: 917136 - DNA, 23 bp, Homo sapiens
catagatgtccctttcttggcca

SEQ ID NO: 917137 - DNA, 14 bp, Homo sapiens
catagattattata

SEQ ID NO: 917138 - DNA, 15 bp, Homo sapiens
catagattcacctgt

SEQ ID NO: 917139 - DNA, 16 bp, Homo sapiens
catagattcacctgta

SEQ ID NO: 917140 - DNA, 22 bp, Homo sapiens
catagattcacctgtaaaactt

SEQ ID NO: 917141 - DNA, 15 bp, Homo sapiens
catagcaacaggaaa

SEQ ID NO: 917142 - DNA, 16 bp, Homo sapiens
catagcaacaggaaaa

SEQ ID NO: 917143 - DNA, 15 bp, Homo sapiens
catagcaagacacat

SEQ ID NO: 917144 - DNA, 20 bp, Homo sapiens
catagcaagacacatcccta

SEQ ID NO: 917145 - DNA, 23 bp, Homo sapiens
catagcaccctgccctcatggga

SEQ ID NO: 917146 - DNA, 22 bp, Homo sapiens
catagcacctaacaacattgta

SEQ ID NO: 917147 - DNA, 16 bp, Homo sapiens
catagcagatctgttt

SEQ ID NO: 917148 - DNA, 21 bp, Homo sapiens
aggggcgtctgttcccccttc

SEQ ID NO: 917149 - DNA, 14 bp, Homo sapiens
aggggcgtgtggct

SEQ ID NO: 917150 - DNA, 17 bp, Homo sapiens
aggggcgtgtggctcac

SEQ ID NO: 917151 - DNA, 21 bp, Homo sapiens
aggggcgttctcccaaagatt

SEQ ID NO: 917152 - DNA, 13 bp, Homo sapiens
aggggctcctgga

SEQ ID NO: 917153 - DNA, 14 bp, Homo sapiens
aggggctcctgggt

SEQ ID NO: 917154 - DNA, 17 bp, Homo sapiens
aggggctcctgggttgg

SEQ ID NO: 917155 - DNA, 21 bp, Homo sapiens
aggggctcctgggttggaggg

SEQ ID NO: 917156 - DNA, 22 bp, Homo sapiens
aggggctcctgggttggaggga

SEQ ID NO: 917157 - DNA, 18 bp, Homo sapiens
aggggctctgtgttagga

SEQ ID NO: 917158 - DNA, 11 bp, Homo sapiens
aggggctgctg

SEQ ID NO: 917159 - DNA, 16 bp, Homo sapiens
aggggctgctgccttg

SEQ ID NO: 917160 - DNA, 18 bp, Homo sapiens
aggggctgctggggcatg

SEQ ID NO: 917161 - DNA, 19 bp, Homo sapiens
aggggctgcttgcttttgc

SEQ ID NO: 917162 - DNA, 19 bp, Homo sapiens
aggggctggccttcctgcc

SEQ ID NO: 917163 - DNA, 21 bp, Homo sapiens
aggggctggggacttgtgtct

SEQ ID NO: 917164 - DNA, 15 bp, Homo sapiens
aggggctgtcctcct

SEQ ID NO: 917165 - DNA, 20 bp, Homo sapiens
aggggctgtcctccttcctg

SEQ ID NO: 917166 - DNA, 21 bp, Homo sapiens
aggggcttataataaaggact

SEQ ID NO: 917167 - DNA, 23 bp, Homo sapiens
aggggcttgagaaggttactgag

SEQ ID NO: 917168 - DNA, 16 bp, Homo sapiens
aggggctttctcttcc

SEQ ID NO: 917169 - DNA, 23 bp, Homo sapiens
aggggctttctcttccccttcct

SEQ ID NO: 917170 - DNA, 17 bp, Homo sapiens
aggggctttctggagag

SEQ ID NO: 917171 - DNA, 14 bp, Homo sapiens
aggggctttgggcc

SEQ ID NO: 917172 - DNA, 15 bp, Homo sapiens
aggggctttgggccc

SEQ ID NO: 917173 - DNA, 19 bp, Homo sapiens
aggggctttgggcccaaga

SEQ ID NO: 917174 - DNA, 19 bp, Homo sapiens
agggggaagaagcagagag

SEQ ID NO: 917175 - DNA, 12 bp, Homo sapiens
agggggaagcaa

SEQ ID NO: 917176 - DNA, 22 bp, Homo sapiens
agggggaaggtggggtcctgga

SEQ ID NO: 917177 - DNA, 18 bp, Homo sapiens
agggggacggggctcagc

SEQ ID NO: 917178 - DNA, 16 bp, Homo sapiens
agggggacggggctga

SEQ ID NO: 917179 - DNA, 15 bp, Homo sapiens
agggggagtctttgc

SEQ ID NO: 917180 - DNA, 16 bp, Homo sapiens
agggggagtgaaacag

SEQ ID NO: 917181 - DNA, 23 bp, Homo sapiens
agggggagtgaaacagagaaaga

SEQ ID NO: 917182 - DNA, 16 bp, Homo sapiens
agggggatgccactcc

SEQ ID NO: 917183 - DNA, 16 bp, Homo sapiens
agggggcaagaggaat

SEQ ID NO: 917184 - DNA, 12 bp, Homo sapiens
agggggccagct

SEQ ID NO: 917185 - DNA, 18 bp, Homo sapiens
agggggccagctggggag

SEQ ID NO: 917186 - DNA, 13 bp, Homo sapiens
agggggccccgcc

SEQ ID NO: 917187 - DNA, 18 bp, Homo sapiens
agggggccccgccagggc

SEQ ID NO: 917188 - DNA, 19 bp, Homo sapiens
agggggccctgccccaccc

SEQ ID NO: 917189 - DNA, 24 bp, Homo sapiens
agggggccttgcggaagccatagg

SEQ ID NO: 917190 - DNA, 22 bp, Homo sapiens
agggggcggcagggctgggcct

SEQ ID NO: 917191 - DNA, 13 bp, Homo sapiens
agggggctcctgg

SEQ ID NO: 917192 - DNA, 15 bp, Homo sapiens
agggggctctgccca

SEQ ID NO: 917193 - DNA, 18 bp, Homo sapiens
agggggctctgccccagg

SEQ ID NO: 917194 - DNA, 20 bp, Homo sapiens
agggggctctgccccaggcc

SEQ ID NO: 917195 - DNA, 16 bp, Homo sapiens
agggggctgcacggga

SEQ ID NO: 917196 - DNA, 19 bp, Homo sapiens
agggggcttgaagccaaag

SEQ ID NO: 917197 - DNA, 18 bp, Homo sapiens
agggggctttctggggcc

SEQ ID NO: 917198 - DNA, 12 bp, Homo sapiens
aggggggagggt

SEQ ID NO: 917199 - DNA, 15 bp, Homo sapiens
aggggggcgggtgac

SEQ ID NO: 917200 - DNA, 16 bp, Homo sapiens
agggggtccacccagc

SEQ ID NO: 917201 - DNA, 15 bp, Homo sapiens
agggggtccgtggaa

SEQ ID NO: 917202 - DNA, 13 bp, Homo sapiens
agggggtctctgt

SEQ ID NO: 917203 - DNA, 18 bp, Homo sapiens
agggggtgacagtcctcc

SEQ ID NO: 917204 - DNA, 14 bp, Homo sapiens
agggggtgactgga

SEQ ID NO: 917205 - DNA, 15 bp, Homo sapiens
agggggtgactggaa

SEQ ID NO: 917206 - DNA, 17 bp, Homo sapiens
agggggtgagaggcagg

SEQ ID NO: 917207 - DNA, 23 bp, Homo sapiens
agggggtgattagagggaggaga

SEQ ID NO: 917208 - DNA, 14 bp, Homo sapiens
agggggttacaaac

SEQ ID NO: 917209 - DNA, 23 bp, Homo sapiens
aggggtacattctagctgagaag

SEQ ID NO: 917210 - DNA, 18 bp, Homo sapiens
aggggtagctggtggttg

SEQ ID NO: 917211 - DNA, 16 bp, Homo sapiens
aggggtcaaagaaatg

SEQ ID NO: 917212 - DNA, 15 bp, Homo sapiens
aggggtcaggctcca

SEQ ID NO: 917213 - DNA, 23 bp, Homo sapiens
aggggtccagcacagccctaccc

SEQ ID NO: 917214 - DNA, 16 bp, Homo sapiens
aggggtccttggtgtg

SEQ ID NO: 917215 - DNA, 16 bp, Homo sapiens
aggggtctccctggag

SEQ ID NO: 917216 - DNA, 17 bp, Homo sapiens
aggggtctccctggctc

SEQ ID NO: 917217 - DNA, 19 bp, Homo sapiens
aggggtctccctggctccc

SEQ ID NO: 917218 - DNA, 21 bp, Homo sapiens
aggggtctgtatatacatttc

SEQ ID NO: 917219 - DNA, 13 bp, Homo sapiens
aggggtctgtctg

SEQ ID NO: 917220 - DNA, 19 bp, Homo sapiens
aggggtgagtcccctactc

SEQ ID NO: 917221 - DNA, 17 bp, Homo sapiens
aggggtgatttcagaga

SEQ ID NO: 917222 - DNA, 21 bp, Homo sapiens
aggggtgcggcggtcccagct

SEQ ID NO: 917223 - DNA, 23 bp, Homo sapiens
aggggtgcggcggtcccagctcc

SEQ ID NO: 917224 - DNA, 20 bp, Homo sapiens
aggggtgcttcctcctcagg

SEQ ID NO: 917225 - DNA, 20 bp, Homo sapiens
aggggtggagactgcttccc

SEQ ID NO: 917226 - DNA, 17 bp, Homo sapiens
aggggtggcgctcagac

SEQ ID NO: 917227 - DNA, 19 bp, Homo sapiens
aggggtggcgctcagaccc

SEQ ID NO: 917228 - DNA, 21 bp, Homo sapiens
aggggtggcgctcagacccca

SEQ ID NO: 917229 - DNA, 19 bp, Homo sapiens
aggggtgggcctgtgaatc

SEQ ID NO: 917230 - DNA, 11 bp, Homo sapiens
aggggtggggg

SEQ ID NO: 917231 - DNA, 16 bp, Homo sapiens
aggggtgtccgagagg

SEQ ID NO: 917232 - DNA, 14 bp, Homo sapiens
aggggtgtcttggg

SEQ ID NO: 917233 - DNA, 24 bp, Homo sapiens
aggggtgtcttgggcagagctggc

SEQ ID NO: 917234 - DNA, 16 bp, Homo sapiens
aggggtgtggcagtgg

SEQ ID NO: 917235 - DNA, 15 bp, Homo sapiens
aggggtgtgggaaga

SEQ ID NO: 917236 - DNA, 21 bp, Homo sapiens
aggggtgtttgtgtgtgtgcg

SEQ ID NO: 917237 - DNA, 15 bp, Homo sapiens
aggggttacctccct

SEQ ID NO: 917238 - DNA, 20 bp, Homo sapiens
aggggttcgagaccagtctg

SEQ ID NO: 917239 - DNA, 21 bp, Homo sapiens
aggggttggggtgacagtcat

SEQ ID NO: 917240 - DNA, 15 bp, Homo sapiens
aggggtttacagtga

SEQ ID NO: 917241 - DNA, 21 bp, Homo sapiens
aggggtttgggagtcaggcct

SEQ ID NO: 917242 - DNA, 23 bp, Homo sapiens
aggggttttcccatgactcttgg

SEQ ID NO: 917243 - DNA, 22 bp, Homo sapiens
aggggttttcgaagctcagccc

SEQ ID NO: 917244 - DNA, 14 bp, Homo sapiens
agggtacagtttgg

SEQ ID NO: 917245 - DNA, 15 bp, Homo sapiens
agggtaccagcagaa

SEQ ID NO: 917246 - DNA, 23 bp, Homo sapiens
agggtaccttgaacactggggga

SEQ ID NO: 917247 - DNA, 16 bp, Homo sapiens
agggtagatttctctt

SEQ ID NO: 917248 - DNA, 17 bp, Homo sapiens
agggtagatttctcttg

SEQ ID NO: 917249 - DNA, 18 bp, Homo sapiens
agggtagatttctcttgg

SEQ ID NO: 917250 - DNA, 22 bp, Homo sapiens
agggtagatttctcttgggcag

SEQ ID NO: 917251 - DNA, 14 bp, Homo sapiens
agggtagccttgat

SEQ ID NO: 917252 - DNA, 13 bp, Homo sapiens
agggtaggaaagg

SEQ ID NO: 917253 - DNA, 21 bp, Homo sapiens
agggtatatacaaattaaaac

SEQ ID NO: 917254 - DNA, 21 bp, Homo sapiens
agggtatccaagttggactgg

SEQ ID NO: 917255 - DNA, 16 bp, Homo sapiens
agggtatgaagagctg

SEQ ID NO: 917256 - DNA, 23 bp, Homo sapiens
agggtcaaagacagaatggtgga

SEQ ID NO: 917257 - DNA, 14 bp, Homo sapiens
agggtcaaagtaca

SEQ ID NO: 917258 - DNA, 19 bp, Homo sapiens
agggtcagacgcctgagga

SEQ ID NO: 917259 - DNA, 16 bp, Homo sapiens
agggtcatgtttgcag

SEQ ID NO: 917260 - DNA, 19 bp, Homo sapiens
agggtccagaagtccctcc

SEQ ID NO: 917261 - DNA, 15 bp, Homo sapiens
agggtcccaccccca

SEQ ID NO: 917262 - DNA, 17 bp, Homo sapiens
agggtcccacccccaac

SEQ ID NO: 917263 - DNA, 19 bp, Homo sapiens
agggtcccacccccaaccc

SEQ ID NO: 917264 - DNA, 23 bp, Homo sapiens
agggtcccacccccaacccccag

SEQ ID NO: 917265 - DNA, 14 bp, Homo sapiens
agggtcccagggct

SEQ ID NO: 917266 - DNA, 20 bp, Homo sapiens
agggtccccgagtgcctagg

SEQ ID NO: 917267 - DNA, 16 bp, Homo sapiens
agggtcccctgccacc

SEQ ID NO: 917268 - DNA, 17 bp, Homo sapiens
agggtcccctgccaccg

SEQ ID NO: 917269 - DNA, 16 bp, Homo sapiens
agggtccctcgcgccc

SEQ ID NO: 917270 - DNA, 15 bp, Homo sapiens
agggtccgcaccagc

SEQ ID NO: 917271 - DNA, 17 bp, Homo sapiens
agggtccgcaccagctg

SEQ ID NO: 917272 - DNA, 17 bp, Homo sapiens
catagcagattttaatt

SEQ ID NO: 917273 - DNA, 17 bp, Homo sapiens
catagcataatatgaag

SEQ ID NO: 917274 - DNA, 23 bp, Homo sapiens
catagcataatatgaagcctttg

SEQ ID NO: 917275 - DNA, 15 bp, Homo sapiens
catagcatgcttcct

SEQ ID NO: 917276 - DNA, 17 bp, Homo sapiens
catagcatgcttccttt

SEQ ID NO: 917277 - DNA, 18 bp, Homo sapiens
catagcatgtcaactttt

SEQ ID NO: 917278 - DNA, 15 bp, Homo sapiens
catagccaggaaact

SEQ ID NO: 917279 - DNA, 17 bp, Homo sapiens
catagccataaatgatg

SEQ ID NO: 917280 - DNA, 15 bp, Homo sapiens
catagcccagtagac

SEQ ID NO: 917281 - DNA, 19 bp, Homo sapiens
catagccccggccccccgc

SEQ ID NO: 917282 - DNA, 20 bp, Homo sapiens
catagccctggtgctcctgc

SEQ ID NO: 917283 - DNA, 22 bp, Homo sapiens
catagccctggtgctcctgccc

SEQ ID NO: 917284 - DNA, 17 bp, Homo sapiens
catagccgattctctgc

SEQ ID NO: 917285 - DNA, 19 bp, Homo sapiens
catagccgattctctgccc

SEQ ID NO: 917286 - DNA, 19 bp, Homo sapiens
catagcctaatccctgggc

SEQ ID NO: 917287 - DNA, 14 bp, Homo sapiens
catagcctcatgtt

SEQ ID NO: 917288 - DNA, 17 bp, Homo sapiens
catagcctcatgttctg

SEQ ID NO: 917289 - DNA, 19 bp, Homo sapiens
catagcctcatgttctgtg

SEQ ID NO: 917290 - DNA, 15 bp, Homo sapiens
catagcgccgtgctg

SEQ ID NO: 917291 - DNA, 21 bp, Homo sapiens
catagcgccgtgctgtaaata

SEQ ID NO: 917292 - DNA, 16 bp, Homo sapiens
catagcgtcctgccct

SEQ ID NO: 917293 - DNA, 19 bp, Homo sapiens
catagcgtcctgccctgcc

SEQ ID NO: 917294 - DNA, 20 bp, Homo sapiens
catagctatcaagtgtgctt

SEQ ID NO: 917295 - DNA, 15 bp, Homo sapiens
catagctattttcct

SEQ ID NO: 917296 - DNA, 19 bp, Homo sapiens
catagctattttccttgct

SEQ ID NO: 917297 - DNA, 15 bp, Homo sapiens
catagctcactgcag

SEQ ID NO: 917298 - DNA, 14 bp, Homo sapiens
catagctccttgga

SEQ ID NO: 917299 - DNA, 21 bp, Homo sapiens
catagctccttggagcaggca

SEQ ID NO: 917300 - DNA, 21 bp, Homo sapiens
catagctctaatctaatatat

SEQ ID NO: 917301 - DNA, 13 bp, Homo sapiens
catagctctattt

SEQ ID NO: 917302 - DNA, 21 bp, Homo sapiens
catagctgtacttcttgaata

SEQ ID NO: 917303 - DNA, 13 bp, Homo sapiens
catagcttccatg

SEQ ID NO: 917304 - DNA, 20 bp, Homo sapiens
cataggaagacataaaactt

SEQ ID NO: 917305 - DNA, 14 bp, Homo sapiens
cataggaagtggct

SEQ ID NO: 917306 - DNA, 15 bp, Homo sapiens
cataggaagtggctg

SEQ ID NO: 917307 - DNA, 19 bp, Homo sapiens
cataggaagtggctggtct

SEQ ID NO: 917308 - DNA, 21 bp, Homo sapiens
cataggaagtggctggtctgg

SEQ ID NO: 917309 - DNA, 17 bp, Homo sapiens
cataggacatactgcat

SEQ ID NO: 917310 - DNA, 20 bp, Homo sapiens
cataggacatactgcatgta

SEQ ID NO: 917311 - DNA, 18 bp, Homo sapiens
cataggaggggtctggac

SEQ ID NO: 917312 - DNA, 17 bp, Homo sapiens
cataggagtttggagga

SEQ ID NO: 917313 - DNA, 20 bp, Homo sapiens
cataggagtttggaggaagt

SEQ ID NO: 917314 - DNA, 19 bp, Homo sapiens
cataggccaaggcccaact

SEQ ID NO: 917315 - DNA, 13 bp, Homo sapiens
cataggcccagcc

SEQ ID NO: 917316 - DNA, 17 bp, Homo sapiens
cataggcctgggtgctg

SEQ ID NO: 917317 - DNA, 20 bp, Homo sapiens
cataggcggtcatgtgtgca

SEQ ID NO: 917318 - DNA, 21 bp, Homo sapiens
cataggcggtcatgtgtgcat

SEQ ID NO: 917319 - DNA, 19 bp, Homo sapiens
cataggctcttaagcagca

SEQ ID NO: 917320 - DNA, 18 bp, Homo sapiens
catagggattgtccctgt

SEQ ID NO: 917321 - DNA, 14 bp, Homo sapiens
catagggctgggga

SEQ ID NO: 917322 - DNA, 19 bp, Homo sapiens
catagggctggggactggg

SEQ ID NO: 917323 - DNA, 11 bp, Homo sapiens
cataggggcag

SEQ ID NO: 917324 - DNA, 15 bp, Homo sapiens
catagggtctcttca

SEQ ID NO: 917325 - DNA, 23 bp, Homo sapiens
catagggtctgcagcctgctggg

SEQ ID NO: 917326 - DNA, 13 bp, Homo sapiens
catagggtgctct

SEQ ID NO: 917327 - DNA, 15 bp, Homo sapiens
cataggtcactggct

SEQ ID NO: 917328 - DNA, 23 bp, Homo sapiens
cataggtctaaataggatcctgg

SEQ ID NO: 917329 - DNA, 19 bp, Homo sapiens
cataggtctctttgctttc

SEQ ID NO: 917330 - DNA, 15 bp, Homo sapiens
cataggttaaaaaaa

SEQ ID NO: 917331 - DNA, 22 bp, Homo sapiens
cataggttcacaccattttgtt

SEQ ID NO: 917332 - DNA, 22 bp, Homo sapiens
catagtaacttcttatggaatt

SEQ ID NO: 917333 - DNA, 19 bp, Homo sapiens
catagtaataagatggctg

SEQ ID NO: 917334 - DNA, 20 bp, Homo sapiens
catagtaataagatggctgt

SEQ ID NO: 917335 - DNA, 23 bp, Homo sapiens
catagtaattagtagaaatgcca

SEQ ID NO: 917336 - DNA, 18 bp, Homo sapiens
catagtaccaatcatttt

SEQ ID NO: 917337 - DNA, 23 bp, Homo sapiens
catagtactggcacaaaaacaca

SEQ ID NO: 917338 - DNA, 21 bp, Homo sapiens
catagtaggcactaaatacat

SEQ ID NO: 917339 - DNA, 20 bp, Homo sapiens
catagtagtatgatgataca

SEQ ID NO: 917340 - DNA, 19 bp, Homo sapiens
catagtatccatattttat

SEQ ID NO: 917341 - DNA, 18 bp, Homo sapiens
catagtattccattgtgt

SEQ ID NO: 917342 - DNA, 21 bp, Homo sapiens
catagtattccattgtgtgag

SEQ ID NO: 917343 - DNA, 15 bp, Homo sapiens
catagtattggagca

SEQ ID NO: 917344 - DNA, 22 bp, Homo sapiens
catagtcacctgactaagaaat

SEQ ID NO: 917345 - DNA, 15 bp, Homo sapiens
catagtgaacacact

SEQ ID NO: 917346 - DNA, 19 bp, Homo sapiens
catagtgatggttcccctg

SEQ ID NO: 917347 - DNA, 16 bp, Homo sapiens
catagtgcaaaactgt

SEQ ID NO: 917348 - DNA, 11 bp, Homo sapiens
catagtgctgg

SEQ ID NO: 917349 - DNA, 18 bp, Homo sapiens
catagtggggcctgggag

SEQ ID NO: 917350 - DNA, 13 bp, Homo sapiens
catagtgtcctgc

SEQ ID NO: 917351 - DNA, 20 bp, Homo sapiens
catagttggtaatgcttgga

SEQ ID NO: 917352 - DNA, 16 bp, Homo sapiens
catagttgtgttaagc

SEQ ID NO: 917353 - DNA, 21 bp, Homo sapiens
catagtttgggcttgtaccac

SEQ ID NO: 917354 - DNA, 15 bp, Homo sapiens
catagttttgtttaa

SEQ ID NO: 917355 - DNA, 17 bp, Homo sapiens
catataaaagttgcgtt

SEQ ID NO: 917356 - DNA, 18 bp, Homo sapiens
catataaaagttgcgttt

SEQ ID NO: 917357 - DNA, 22 bp, Homo sapiens
catataaaagttgcgtttaagt

SEQ ID NO: 917358 - DNA, 19 bp, Homo sapiens
catataaacatcacacaca

SEQ ID NO: 917359 - DNA, 20 bp, Homo sapiens
catataaatgaatctggtgt

SEQ ID NO: 917360 - DNA, 18 bp, Homo sapiens
catataaattttttgtga

SEQ ID NO: 917361 - DNA, 13 bp, Homo sapiens
catataacactta

SEQ ID NO: 917362 - DNA, 23 bp, Homo sapiens
catataacttatattgtaagaaa

SEQ ID NO: 917363 - DNA, 23 bp, Homo sapiens
catataagattcatatttacttc

SEQ ID NO: 917364 - DNA, 14 bp, Homo sapiens
catataagtttgaa

SEQ ID NO: 917365 - DNA, 15 bp, Homo sapiens
catataagtttgaag

SEQ ID NO: 917366 - DNA, 20 bp, Homo sapiens
catataagtttgaaggaaac

SEQ ID NO: 917367 - DNA, 21 bp, Homo sapiens
catataagtttgaaggaaaca

SEQ ID NO: 917368 - DNA, 16 bp, Homo sapiens
catataatgaataaat

SEQ ID NO: 917369 - DNA, 18 bp, Homo sapiens
catataatgttgttattt

SEQ ID NO: 917370 - DNA, 16 bp, Homo sapiens
catatacatatatata

SEQ ID NO: 917371 - DNA, 18 bp, Homo sapiens
catatacatatatatata

SEQ ID NO: 917372 - DNA, 15 bp, Homo sapiens
catatacattagttt

SEQ ID NO: 917373 - DNA, 16 bp, Homo sapiens
catatactataattgt

SEQ ID NO: 917374 - DNA, 20 bp, Homo sapiens
catatagcattgataatctt

SEQ ID NO: 917375 - DNA, 19 bp, Homo sapiens
catataggtgatgtttgct

SEQ ID NO: 917376 - DNA, 14 bp, Homo sapiens
catatagtctattc

SEQ ID NO: 917377 - DNA, 20 bp, Homo sapiens
catatagtttttgcagggtt

SEQ ID NO: 917378 - DNA, 18 bp, Homo sapiens
catatatatagttatgca

SEQ ID NO: 917379 - DNA, 21 bp, Homo sapiens
catatatatatacacatacat

SEQ ID NO: 917380 - DNA, 15 bp, Homo sapiens
catatatatatttgt

SEQ ID NO: 917381 - DNA, 16 bp, Homo sapiens
catatatatatttgta

SEQ ID NO: 917382 - DNA, 18 bp, Homo sapiens
catatatatatttgtaac

SEQ ID NO: 917383 - DNA, 12 bp, Homo sapiens
catatatatctg

SEQ ID NO: 917384 - DNA, 14 bp, Homo sapiens
catatatatctgat

SEQ ID NO: 917385 - DNA, 12 bp, Homo sapiens
catatatattac

SEQ ID NO: 917386 - DNA, 19 bp, Homo sapiens
catatatgaccagaagcct

SEQ ID NO: 917387 - DNA, 15 bp, Homo sapiens
catatatgctgtatt

SEQ ID NO: 917388 - DNA, 16 bp, Homo sapiens
catatatgctgtattt

SEQ ID NO: 917389 - DNA, 17 bp, Homo sapiens
catatatgctgtatttc

SEQ ID NO: 917390 - DNA, 22 bp, Homo sapiens
catatatggggggccaacacca

SEQ ID NO: 917391 - DNA, 19 bp, Homo sapiens
catatattgaggttcattg

SEQ ID NO: 917392 - DNA, 21 bp, Homo sapiens
catatatttgcagtatgaact

SEQ ID NO: 917393 - DNA, 20 bp, Homo sapiens
catatcattaaacaaataaa

SEQ ID NO: 917394 - DNA, 23 bp, Homo sapiens
catatcatttcactgtctaggct

SEQ ID NO: 917395 - DNA, 18 bp, Homo sapiens
catatcatttgtgaagaa

SEQ ID NO: 917396 - DNA, 18 bp, Homo sapiens
agggtccgcaccagctgc

SEQ ID NO: 917397 - DNA, 20 bp, Homo sapiens
agggtccgtggaccaggagg

SEQ ID NO: 917398 - DNA, 16 bp, Homo sapiens
agggtcctctagccca

SEQ ID NO: 917399 - DNA, 14 bp, Homo sapiens
agggtcctgccggt

SEQ ID NO: 917400 - DNA, 16 bp, Homo sapiens
agggtcctggctcctg

SEQ ID NO: 917401 - DNA, 21 bp, Homo sapiens
agggtcctggctcctgagggg

SEQ ID NO: 917402 - DNA, 15 bp, Homo sapiens
agggtcctgtcgcca

SEQ ID NO: 917403 - DNA, 14 bp, Homo sapiens
agggtcctgtgcct

SEQ ID NO: 917404 - DNA, 19 bp, Homo sapiens
agggtcgtctttgtgtatg

SEQ ID NO: 917405 - DNA, 15 bp, Homo sapiens
agggtctagggagag

SEQ ID NO: 917406 - DNA, 23 bp, Homo sapiens
agggtctagggagagacccttgt

SEQ ID NO: 917407 - DNA, 23 bp, Homo sapiens
agggtctcccctcctgcacacag

SEQ ID NO: 917408 - DNA, 20 bp, Homo sapiens
agggtctctagtgctgtgaa

SEQ ID NO: 917409 - DNA, 22 bp, Homo sapiens
agggtctctagtgctgtgaaaa

SEQ ID NO: 917410 - DNA, 21 bp, Homo sapiens
agggtctgcagcctgctgggg

SEQ ID NO: 917411 - DNA, 21 bp, Homo sapiens
agggtctgctctttctctgcc

SEQ ID NO: 917412 - DNA, 17 bp, Homo sapiens
agggtctggcagagcct

SEQ ID NO: 917413 - DNA, 16 bp, Homo sapiens
agggtctgggggcagc

SEQ ID NO: 917414 - DNA, 21 bp, Homo sapiens
agggtctgggggcagctgtcc

SEQ ID NO: 917415 - DNA, 23 bp, Homo sapiens
agggtctgggggcagctgtcctg

SEQ ID NO: 917416 - DNA, 15 bp, Homo sapiens
agggtctgtgtgaat

SEQ ID NO: 917417 - DNA, 19 bp, Homo sapiens
agggtctgtttggactgca

SEQ ID NO: 917418 - DNA, 22 bp, Homo sapiens
agggtcttacctctctgggacc

SEQ ID NO: 917419 - DNA, 17 bp, Homo sapiens
agggtcttcttggcagc

SEQ ID NO: 917420 - DNA, 22 bp, Homo sapiens
agggtcttgctctgtcccccag

SEQ ID NO: 917421 - DNA, 13 bp, Homo sapiens
agggtcttgctgt

SEQ ID NO: 917422 - DNA, 16 bp, Homo sapiens
agggtcttgggaaata

SEQ ID NO: 917423 - DNA, 18 bp, Homo sapiens
agggtcttgggctactgg

SEQ ID NO: 917424 - DNA, 23 bp, Homo sapiens
agggtcttgggctactggcagct

SEQ ID NO: 917425 - DNA, 15 bp, Homo sapiens
agggtgacccacagc

SEQ ID NO: 917426 - DNA, 13 bp, Homo sapiens
agggtgacgccca

SEQ ID NO: 917427 - DNA, 18 bp, Homo sapiens
agggtgacgcccagctcc

SEQ ID NO: 917428 - DNA, 14 bp, Homo sapiens
agggtgcccagaac

SEQ ID NO: 917429 - DNA, 23 bp, Homo sapiens
agggtgccctctgctcaggcctc

SEQ ID NO: 917430 - DNA, 24 bp, Homo sapiens
agggtgcccttttccagcctcagc

SEQ ID NO: 917431 - DNA, 15 bp, Homo sapiens
agggtgccgtgtccc

SEQ ID NO: 917432 - DNA, 17 bp, Homo sapiens
agggtgcctcaggacct

SEQ ID NO: 917433 - DNA, 23 bp, Homo sapiens
agggtgctaaagccaaccagcct

SEQ ID NO: 917434 - DNA, 13 bp, Homo sapiens
agggtggaccagg

SEQ ID NO: 917435 - DNA, 21 bp, Homo sapiens
agggtggagactaagccctgt

SEQ ID NO: 917436 - DNA, 19 bp, Homo sapiens
agggtggaggaaggtgact

SEQ ID NO: 917437 - DNA, 21 bp, Homo sapiens
agggtggaggaaggtgctgag

SEQ ID NO: 917438 - DNA, 23 bp, Homo sapiens
agggtggaggaaggtgctgagct

SEQ ID NO: 917439 - DNA, 20 bp, Homo sapiens
agggtggatgacagggcaga

SEQ ID NO: 917440 - DNA, 16 bp, Homo sapiens
agggtggcagcaacaa

SEQ ID NO: 917441 - DNA, 14 bp, Homo sapiens
agggtggcaggtca

SEQ ID NO: 917442 - DNA, 15 bp, Homo sapiens
agggtggcaggtcac

SEQ ID NO: 917443 - DNA, 20 bp, Homo sapiens
agggtggcaggtcactgtca

SEQ ID NO: 917444 - DNA, 18 bp, Homo sapiens
agggtggcccttgcagtt

SEQ ID NO: 917445 - DNA, 16 bp, Homo sapiens
agggtggctttaattg

SEQ ID NO: 917446 - DNA, 20 bp, Homo sapiens
agggtggctttaattgtata

SEQ ID NO: 917447 - DNA, 12 bp, Homo sapiens
agggtgggaaga

SEQ ID NO: 917448 - DNA, 14 bp, Homo sapiens
agggtgggcagcct

SEQ ID NO: 917449 - DNA, 23 bp, Homo sapiens
agggtgggccactctcccctccc

SEQ ID NO: 917450 - DNA, 14 bp, Homo sapiens
agggtgggccagca

SEQ ID NO: 917451 - DNA, 16 bp, Homo sapiens
agggtgggctggggac

SEQ ID NO: 917452 - DNA, 22 bp, Homo sapiens
agggtgggctggggactctggc

SEQ ID NO: 917453 - DNA, 17 bp, Homo sapiens
agggtgggcttcctgcc

SEQ ID NO: 917454 - DNA, 18 bp, Homo sapiens
agggtgggcttcctgccc

SEQ ID NO: 917455 - DNA, 19 bp, Homo sapiens
agggtgggggccacctgcc

SEQ ID NO: 917456 - DNA, 21 bp, Homo sapiens
agggtgggggccacctgcctg

SEQ ID NO: 917457 - DNA, 11 bp, Homo sapiens
agggtgggggg

SEQ ID NO: 917458 - DNA, 17 bp, Homo sapiens
agggtggtaaatatttt

SEQ ID NO: 917459 - DNA, 14 bp, Homo sapiens
agggtggtgctggg

SEQ ID NO: 917460 - DNA, 16 bp, Homo sapiens
agggtggtgctgggac

SEQ ID NO: 917461 - DNA, 21 bp, Homo sapiens
agggtgtaggggccacctcct

SEQ ID NO: 917462 - DNA, 14 bp, Homo sapiens
agggtgtatagtgt

SEQ ID NO: 917463 - DNA, 14 bp, Homo sapiens
agggtgtcctgagg

SEQ ID NO: 917464 - DNA, 22 bp, Homo sapiens
agggtgtgactcgggagctgca

SEQ ID NO: 917465 - DNA, 18 bp, Homo sapiens
agggtgtggccctgccat

SEQ ID NO: 917466 - DNA, 15 bp, Homo sapiens
agggtgtggctccta

SEQ ID NO: 917467 - DNA, 21 bp, Homo sapiens
agggtgtggctttccaggcac

SEQ ID NO: 917468 - DNA, 22 bp, Homo sapiens
agggtgtggggccatgcctcct

SEQ ID NO: 917469 - DNA, 20 bp, Homo sapiens
agggtgtgtgccacacccca

SEQ ID NO: 917470 - DNA, 14 bp, Homo sapiens
agggtgtgtgttca

SEQ ID NO: 917471 - DNA, 13 bp, Homo sapiens
agggttaagaaaa

SEQ ID NO: 917472 - DNA, 15 bp, Homo sapiens
agggttaaggcctga

SEQ ID NO: 917473 - DNA, 18 bp, Homo sapiens
agggttactatgcacaat

SEQ ID NO: 917474 - DNA, 15 bp, Homo sapiens
agggttagggagggg

SEQ ID NO: 917475 - DNA, 13 bp, Homo sapiens
agggttataataa

SEQ ID NO: 917476 - DNA, 18 bp, Homo sapiens
agggttcaaaatgtctgt

SEQ ID NO: 917477 - DNA, 22 bp, Homo sapiens
agggttcaaaatgtctgtagct

SEQ ID NO: 917478 - DNA, 19 bp, Homo sapiens
agggttcccccagccctgt

SEQ ID NO: 917479 - DNA, 12 bp, Homo sapiens
agggttcccctg

SEQ ID NO: 917480 - DNA, 21 bp, Homo sapiens
agggttcctgtagacctaggg

SEQ ID NO: 917481 - DNA, 13 bp, Homo sapiens
agggttctgccct

SEQ ID NO: 917482 - DNA, 18 bp, Homo sapiens
agggttctgccctgcctg

SEQ ID NO: 917483 - DNA, 14 bp, Homo sapiens
agggttctgcctct

SEQ ID NO: 917484 - DNA, 18 bp, Homo sapiens
agggttgaaaatgtgttt

SEQ ID NO: 917485 - DNA, 16 bp, Homo sapiens
agggttgaccccagag

SEQ ID NO: 917486 - DNA, 18 bp, Homo sapiens
agggttgaccccagagga

SEQ ID NO: 917487 - DNA, 21 bp, Homo sapiens
agggttgagttacttcctatc

SEQ ID NO: 917488 - DNA, 14 bp, Homo sapiens
agggttgatcacac

SEQ ID NO: 917489 - DNA, 20 bp, Homo sapiens
agggttgctgcctttcaagc

SEQ ID NO: 917490 - DNA, 17 bp, Homo sapiens
agggttgcttctgagtg

SEQ ID NO: 917491 - DNA, 15 bp, Homo sapiens
agggttgggcccaga

SEQ ID NO: 917492 - DNA, 18 bp, Homo sapiens
agggttggtgggctggcc

SEQ ID NO: 917493 - DNA, 14 bp, Homo sapiens
agggtttcgactgg

SEQ ID NO: 917494 - DNA, 21 bp, Homo sapiens
agggtttcgactggtccagct

SEQ ID NO: 917495 - DNA, 14 bp, Homo sapiens
agggtttctctatt

SEQ ID NO: 917496 - DNA, 16 bp, Homo sapiens
agggtttctctgcaga

SEQ ID NO: 917497 - DNA, 22 bp, Homo sapiens
agggtttgaattgttttcttta

SEQ ID NO: 917498 - DNA, 23 bp, Homo sapiens
agggtttgaattgttttctttaa

SEQ ID NO: 917499 - DNA, 16 bp, Homo sapiens
agggtttgtgcccagt

SEQ ID NO: 917500 - DNA, 15 bp, Homo sapiens
agggttttcttttct

SEQ ID NO: 917501 - DNA, 17 bp, Homo sapiens
agggttttgcaataact

SEQ ID NO: 917502 - DNA, 12 bp, Homo sapiens
agggttttgccc

SEQ ID NO: 917503 - DNA, 13 bp, Homo sapiens
agggttttgtatt

SEQ ID NO: 917504 - DNA, 14 bp, Homo sapiens
agggttttttttaa

SEQ ID NO: 917505 - DNA, 21 bp, Homo sapiens
agggttttttttaatgtgaat

SEQ ID NO: 917506 - DNA, 12 bp, Homo sapiens
aggtaaaaaccc

SEQ ID NO: 917507 - DNA, 15 bp, Homo sapiens
aggtaaaatcacttc

SEQ ID NO: 917508 - DNA, 16 bp, Homo sapiens
aggtaaaatcacttca

SEQ ID NO: 917509 - DNA, 20 bp, Homo sapiens
aggtaaaatcacttcagatc

SEQ ID NO: 917510 - DNA, 14 bp, Homo sapiens
aggtaaactcctgt

SEQ ID NO: 917511 - DNA, 15 bp, Homo sapiens
aggtaaactcctgtc

SEQ ID NO: 917512 - DNA, 14 bp, Homo sapiens
aggtaaataaaaag

SEQ ID NO: 917513 - DNA, 20 bp, Homo sapiens
aggtaaataaaaagaaaggc

SEQ ID NO: 917514 - DNA, 14 bp, Homo sapiens
aggtaaatggttaa

SEQ ID NO: 917515 - DNA, 18 bp, Homo sapiens
aggtaaatggttaaattt

SEQ ID NO: 917516 - DNA, 12 bp, Homo sapiens
aggtaacactac

SEQ ID NO: 917517 - DNA, 23 bp, Homo sapiens
aggtaagaagtaataatgagtaa

SEQ ID NO: 917518 - DNA, 17 bp, Homo sapiens
aggtaagctcaggatat

SEQ ID NO: 917519 - DNA, 20 bp, Homo sapiens
aggtaataacattttataca

SEQ ID NO: 917520 - DNA, 16 bp, Homo sapiens
catatccaccacctcc

SEQ ID NO: 917521 - DNA, 12 bp, Homo sapiens
catatcccacca

SEQ ID NO: 917522 - DNA, 14 bp, Homo sapiens
catatcctgagcca

SEQ ID NO: 917523 - DNA, 13 bp, Homo sapiens
catatcctgcctc

SEQ ID NO: 917524 - DNA, 14 bp, Homo sapiens
catatcctgcctca

SEQ ID NO: 917525 - DNA, 17 bp, Homo sapiens
catatcgctgacttcat

SEQ ID NO: 917526 - DNA, 13 bp, Homo sapiens
catatctctgccg

SEQ ID NO: 917527 - DNA, 23 bp, Homo sapiens
catatctgatattaaagatttct

SEQ ID NO: 917528 - DNA, 18 bp, Homo sapiens
catatcttaaagaaacag

SEQ ID NO: 917529 - DNA, 14 bp, Homo sapiens
catatcttgccttc

SEQ ID NO: 917530 - DNA, 22 bp, Homo sapiens
catatcttgcgaatccaagctc

SEQ ID NO: 917531 - DNA, 11 bp, Homo sapiens
catatgaaaaa

SEQ ID NO: 917532 - DNA, 18 bp, Homo sapiens
catatgaaaatacaactt

SEQ ID NO: 917533 - DNA, 13 bp, Homo sapiens
catatgaaatcct

SEQ ID NO: 917534 - DNA, 23 bp, Homo sapiens
catatgaccattgagtccctgct

SEQ ID NO: 917535 - DNA, 22 bp, Homo sapiens
catatgactcacatgatgcata

SEQ ID NO: 917536 - DNA, 19 bp, Homo sapiens
catatgaggacctttatat

SEQ ID NO: 917537 - DNA, 23 bp, Homo sapiens
catatgaggacctttatatctgt

SEQ ID NO: 917538 - DNA, 15 bp, Homo sapiens
catatgatctgtctg

SEQ ID NO: 917539 - DNA, 13 bp, Homo sapiens
catatgcagaaat

SEQ ID NO: 917540 - DNA, 13 bp, Homo sapiens
catatgcatgcca

SEQ ID NO: 917541 - DNA, 15 bp, Homo sapiens
catatgcatgccagg

SEQ ID NO: 917542 - DNA, 13 bp, Homo sapiens
catatgctctgct

SEQ ID NO: 917543 - DNA, 15 bp, Homo sapiens
catatgctctgcttt

SEQ ID NO: 917544 - DNA, 15 bp, Homo sapiens
catatggagctcatg

SEQ ID NO: 917545 - DNA, 21 bp, Homo sapiens
catatggaggactgtgacaga

SEQ ID NO: 917546 - DNA, 12 bp, Homo sapiens
catatggatgtt

SEQ ID NO: 917547 - DNA, 18 bp, Homo sapiens
catatggattttctattg

SEQ ID NO: 917548 - DNA, 18 bp, Homo sapiens
catatggttgaataaata

SEQ ID NO: 917549 - DNA, 17 bp, Homo sapiens
catatgtaacagtcaaa

SEQ ID NO: 917550 - DNA, 21 bp, Homo sapiens
catatgtaccatgtacatgaa

SEQ ID NO: 917551 - DNA, 17 bp, Homo sapiens
catatgtattcctgatc

SEQ ID NO: 917552 - DNA, 15 bp, Homo sapiens
catatgtctgcttct

SEQ ID NO: 917553 - DNA, 20 bp, Homo sapiens
catatgtctgcttctgtcca

SEQ ID NO: 917554 - DNA, 18 bp, Homo sapiens
catatgttaaagcttatt

SEQ ID NO: 917555 - DNA, 23 bp, Homo sapiens
catatgttaaagcttatttttat

SEQ ID NO: 917556 - DNA, 18 bp, Homo sapiens
catatgttaagcagctaa

SEQ ID NO: 917557 - DNA, 15 bp, Homo sapiens
catatgttacactaa

SEQ ID NO: 917558 - DNA, 17 bp, Homo sapiens
catatgttgaatacttt

SEQ ID NO: 917559 - DNA, 18 bp, Homo sapiens
catatgttgaatactttt

SEQ ID NO: 917560 - DNA, 15 bp, Homo sapiens
catatgttgctcagt

SEQ ID NO: 917561 - DNA, 22 bp, Homo sapiens
catatgtttcgctgatatatgt

SEQ ID NO: 917562 - DNA, 16 bp, Homo sapiens
catattaaacaaaaac

SEQ ID NO: 917563 - DNA, 20 bp, Homo sapiens
catattaagacagtgtacaa

SEQ ID NO: 917564 - DNA, 20 bp, Homo sapiens
catattaccacagacatact

SEQ ID NO: 917565 - DNA, 21 bp, Homo sapiens
catattaccacagacatacta

SEQ ID NO: 917566 - DNA, 18 bp, Homo sapiens
catattactgttgcattt

SEQ ID NO: 917567 - DNA, 19 bp, Homo sapiens
catattactgttgcattta

SEQ ID NO: 917568 - DNA, 21 bp, Homo sapiens
catattactgttgcatttact

SEQ ID NO: 917569 - DNA, 14 bp, Homo sapiens
catattaggaaaat

SEQ ID NO: 917570 - DNA, 21 bp, Homo sapiens
catattataaaggataaagaa

SEQ ID NO: 917571 - DNA, 22 bp, Homo sapiens
catattataaaggataaagaag

SEQ ID NO: 917572 - DNA, 16 bp, Homo sapiens
catattcaatgcaagt

SEQ ID NO: 917573 - DNA, 16 bp, Homo sapiens
catattcagacatcaa

SEQ ID NO: 917574 - DNA, 17 bp, Homo sapiens
catattcatgaaatgtg

SEQ ID NO: 917575 - DNA, 20 bp, Homo sapiens
catattcatgaaatgtggaa

SEQ ID NO: 917576 - DNA, 12 bp, Homo sapiens
catattcctttg

SEQ ID NO: 917577 - DNA, 13 bp, Homo sapiens
catattctattgt

SEQ ID NO: 917578 - DNA, 16 bp, Homo sapiens
catattgaaaagcaca

SEQ ID NO: 917579 - DNA, 12 bp, Homo sapiens
catattgacttt

SEQ ID NO: 917580 - DNA, 21 bp, Homo sapiens
catattgatttccgttaaaat

SEQ ID NO: 917581 - DNA, 17 bp, Homo sapiens
catattgctgagagaaa

SEQ ID NO: 917582 - DNA, 19 bp, Homo sapiens
catattgctttttctaatg

SEQ ID NO: 917583 - DNA, 14 bp, Homo sapiens
catattggtattca

SEQ ID NO: 917584 - DNA, 16 bp, Homo sapiens
catattggtattcact

SEQ ID NO: 917585 - DNA, 20 bp, Homo sapiens
catattgtgattctgccttt

SEQ ID NO: 917586 - DNA, 20 bp, Homo sapiens
catattgtgccaatatgtat

SEQ ID NO: 917587 - DNA, 21 bp, Homo sapiens
catattgtgccaatatgtatt

SEQ ID NO: 917588 - DNA, 21 bp, Homo sapiens
catattgtgcttcacagtaga

SEQ ID NO: 917589 - DNA, 19 bp, Homo sapiens
catattgttagggtcagcc

SEQ ID NO: 917590 - DNA, 22 bp, Homo sapiens
catattgttagggtcagccatt

SEQ ID NO: 917591 - DNA, 13 bp, Homo sapiens
catattgttgaaa

SEQ ID NO: 917592 - DNA, 13 bp, Homo sapiens
catatttaactgg

SEQ ID NO: 917593 - DNA, 14 bp, Homo sapiens
catatttaactggt

SEQ ID NO: 917594 - DNA, 14 bp, Homo sapiens
catatttaatgttt

SEQ ID NO: 917595 - DNA, 23 bp, Homo sapiens
catatttaatgttttaaatgtac

SEQ ID NO: 917596 - DNA, 21 bp, Homo sapiens
catatttatattgtatattct

SEQ ID NO: 917597 - DNA, 12 bp, Homo sapiens
catatttatcca

SEQ ID NO: 917598 - DNA, 21 bp, Homo sapiens
catatttatccaaaatgtgta

SEQ ID NO: 917599 - DNA, 13 bp, Homo sapiens
catatttcatttt

SEQ ID NO: 917600 - DNA, 15 bp, Homo sapiens
catatttcattttaa

SEQ ID NO: 917601 - DNA, 17 bp, Homo sapiens
catatttcattttaaca

SEQ ID NO: 917602 - DNA, 13 bp, Homo sapiens
catatttctgtat

SEQ ID NO: 917603 - DNA, 15 bp, Homo sapiens
catatttctgtatat

SEQ ID NO: 917604 - DNA, 16 bp, Homo sapiens
catatttctgtatatt

SEQ ID NO: 917605 - DNA, 21 bp, Homo sapiens
catatttctgtatatttgtca

SEQ ID NO: 917606 - DNA, 22 bp, Homo sapiens
catatttgatttctaattgtaa

SEQ ID NO: 917607 - DNA, 18 bp, Homo sapiens
catatttgtatagttgct

SEQ ID NO: 917608 - DNA, 17 bp, Homo sapiens
catattttattctttta

SEQ ID NO: 917609 - DNA, 14 bp, Homo sapiens
catattttgccact

SEQ ID NO: 917610 - DNA, 13 bp, Homo sapiens
catattttgtata

SEQ ID NO: 917611 - DNA, 14 bp, Homo sapiens
catatttttatact

SEQ ID NO: 917612 - DNA, 18 bp, Homo sapiens
catatttttctaaagaaa

SEQ ID NO: 917613 - DNA, 13 bp, Homo sapiens
catcaaaatgctt

SEQ ID NO: 917614 - DNA, 23 bp, Homo sapiens
catcaaagcagaagtctggcttt

SEQ ID NO: 917615 - DNA, 17 bp, Homo sapiens
catcaaaggaatataag

SEQ ID NO: 917616 - DNA, 21 bp, Homo sapiens
catcaaaggaatataagaaaa

SEQ ID NO: 917617 - DNA, 19 bp, Homo sapiens
catcaaagtggtaaatact

SEQ ID NO: 917618 - DNA, 21 bp, Homo sapiens
catcaaatgaataatgccttt

SEQ ID NO: 917619 - DNA, 18 bp, Homo sapiens
catcaaatttgccaccac

SEQ ID NO: 917620 - DNA, 22 bp, Homo sapiens
catcaacatggcaattgcactc

SEQ ID NO: 917621 - DNA, 17 bp, Homo sapiens
catcaagaagggctgca

SEQ ID NO: 917622 - DNA, 18 bp, Homo sapiens
catcaagactatctacaa

SEQ ID NO: 917623 - DNA, 21 bp, Homo sapiens
catcaagactatctacaaaaa

SEQ ID NO: 917624 - DNA, 17 bp, Homo sapiens
catcaagagactgagtc

SEQ ID NO: 917625 - DNA, 12 bp, Homo sapiens
catcaagccact

SEQ ID NO: 917626 - DNA, 15 bp, Homo sapiens
catcaagcttttctg

SEQ ID NO: 917627 - DNA, 21 bp, Homo sapiens
catcaagtccatctgacaaaa

SEQ ID NO: 917628 - DNA, 21 bp, Homo sapiens
catcaatatccctcttgtaag

SEQ ID NO: 917629 - DNA, 13 bp, Homo sapiens
catcaatcttgtt

SEQ ID NO: 917630 - DNA, 16 bp, Homo sapiens
catcaatcttgttact

SEQ ID NO: 917631 - DNA, 22 bp, Homo sapiens
catcaatggggccagtcaggcc

SEQ ID NO: 917632 - DNA, 15 bp, Homo sapiens
catcaatgttcattg

SEQ ID NO: 917633 - DNA, 16 bp, Homo sapiens
catcaatgttcattgt

SEQ ID NO: 917634 - DNA, 14 bp, Homo sapiens
catcacaagaacac

SEQ ID NO: 917635 - DNA, 12 bp, Homo sapiens
catcacacacac

SEQ ID NO: 917636 - DNA, 19 bp, Homo sapiens
catcacactgggtggtggc

SEQ ID NO: 917637 - DNA, 14 bp, Homo sapiens
catcacacttatat

SEQ ID NO: 917638 - DNA, 20 bp, Homo sapiens
catcacagggcagagccggg

SEQ ID NO: 917639 - DNA, 17 bp, Homo sapiens
catcacattcccatggt

SEQ ID NO: 917640 - DNA, 21 bp, Homo sapiens
catcacattcccatggtggcc

SEQ ID NO: 917641 - DNA, 22 bp, Homo sapiens
catcacattcccatggtggcct

SEQ ID NO: 917642 - DNA, 16 bp, Homo sapiens
catcaccaccgcctct

SEQ ID NO: 917643 - DNA, 22 bp, Homo sapiens
catcaccaggtgcatctgcagg

SEQ ID NO: 917644 - DNA, 12 bp, Homo sapiens
catcaccccaga

SEQ ID NO: 917645 - DNA, 13 bp, Homo sapiens
aggtaatatacct

SEQ ID NO: 917646 - DNA, 17 bp, Homo sapiens
aggtaatatacctggtt

SEQ ID NO: 917647 - DNA, 15 bp, Homo sapiens
aggtaatcattttaa

SEQ ID NO: 917648 - DNA, 13 bp, Homo sapiens
aggtaatgaggga

SEQ ID NO: 917649 - DNA, 17 bp, Homo sapiens
aggtaatgagggactgg

SEQ ID NO: 917650 - DNA, 20 bp, Homo sapiens
aggtaatggttggtttttgt

SEQ ID NO: 917651 - DNA, 16 bp, Homo sapiens
aggtaatgtgaataaa

SEQ ID NO: 917652 - DNA, 22 bp, Homo sapiens
aggtaattctccctaaggaatc

SEQ ID NO: 917653 - DNA, 20 bp, Homo sapiens
aggtaattgttttttaaagc

SEQ ID NO: 917654 - DNA, 21 bp, Homo sapiens
aggtaattgttttttaaagca

SEQ ID NO: 917655 - DNA, 18 bp, Homo sapiens
aggtacagcgggctgtgc

SEQ ID NO: 917656 - DNA, 14 bp, Homo sapiens
aggtacaggagagg

SEQ ID NO: 917657 - DNA, 18 bp, Homo sapiens
aggtacaggagaggcagc

SEQ ID NO: 917658 - DNA, 21 bp, Homo sapiens
aggtaccaaacaaggaagcca

SEQ ID NO: 917659 - DNA, 22 bp, Homo sapiens
aggtaccagcaatatgtaaata

SEQ ID NO: 917660 - DNA, 13 bp, Homo sapiens
aggtaccagctgc

SEQ ID NO: 917661 - DNA, 16 bp, Homo sapiens
aggtaccttgtagcag

SEQ ID NO: 917662 - DNA, 13 bp, Homo sapiens
aggtactctcctg

SEQ ID NO: 917663 - DNA, 21 bp, Homo sapiens
aggtactgcattctctcccat

SEQ ID NO: 917664 - DNA, 20 bp, Homo sapiens
aggtacttcctcctgatggc

SEQ ID NO: 917665 - DNA, 23 bp, Homo sapiens
aggtagaaatatctgaaaatgta

SEQ ID NO: 917666 - DNA, 21 bp, Homo sapiens
aggtagaatgtaaagcttgtc

SEQ ID NO: 917667 - DNA, 19 bp, Homo sapiens
aggtagacttttatgagaa

SEQ ID NO: 917668 - DNA, 16 bp, Homo sapiens
aggtagagtcttacaa

SEQ ID NO: 917669 - DNA, 14 bp, Homo sapiens
aggtagagtggtca

SEQ ID NO: 917670 - DNA, 21 bp, Homo sapiens
aggtagagtggtcagttgaac

SEQ ID NO: 917671 - DNA, 17 bp, Homo sapiens
aggtagagtttgaagga

SEQ ID NO: 917672 - DNA, 23 bp, Homo sapiens
aggtagagtttgaaggaggtgag

SEQ ID NO: 917673 - DNA, 16 bp, Homo sapiens
aggtagcaagagagca

SEQ ID NO: 917674 - DNA, 21 bp, Homo sapiens
aggtagcatgggtccaagaga

SEQ ID NO: 917675 - DNA, 16 bp, Homo sapiens
aggtagcattgaaaaa

SEQ ID NO: 917676 - DNA, 21 bp, Homo sapiens
aggtagccgagtcacacccgg

SEQ ID NO: 917677 - DNA, 13 bp, Homo sapiens
aggtagcctgctg

SEQ ID NO: 917678 - DNA, 16 bp, Homo sapiens
aggtagcctgctgtgg

SEQ ID NO: 917679 - DNA, 14 bp, Homo sapiens
aggtagcgagctgc

SEQ ID NO: 917680 - DNA, 21 bp, Homo sapiens
aggtagcgagctgctctgcta

SEQ ID NO: 917681 - DNA, 12 bp, Homo sapiens
aggtaggccctt

SEQ ID NO: 917682 - DNA, 13 bp, Homo sapiens
aggtaggcccttg

SEQ ID NO: 917683 - DNA, 20 bp, Homo sapiens
aggtaggcccttgtcctgcc

SEQ ID NO: 917684 - DNA, 21 bp, Homo sapiens
aggtagtttggatatttttgt

SEQ ID NO: 917685 - DNA, 23 bp, Homo sapiens
aggtagtttggatatttttgtac

SEQ ID NO: 917686 - DNA, 21 bp, Homo sapiens
aggtatactttagtagacatt

SEQ ID NO: 917687 - DNA, 14 bp, Homo sapiens
aggtatatactttg

SEQ ID NO: 917688 - DNA, 19 bp, Homo sapiens
aggtatcagttatatgata

SEQ ID NO: 917689 - DNA, 13 bp, Homo sapiens
aggtatctccagg

SEQ ID NO: 917690 - DNA, 14 bp, Homo sapiens
aggtatctccagga

SEQ ID NO: 917691 - DNA, 20 bp, Homo sapiens
aggtatggaagggtttgtgg

SEQ ID NO: 917692 - DNA, 22 bp, Homo sapiens
aggtatggaagggtttgtggct

SEQ ID NO: 917693 - DNA, 12 bp, Homo sapiens
aggtatggccat

SEQ ID NO: 917694 - DNA, 17 bp, Homo sapiens
aggtatggccatgccct

SEQ ID NO: 917695 - DNA, 20 bp, Homo sapiens
aggtatggccatgccctaga

SEQ ID NO: 917696 - DNA, 20 bp, Homo sapiens
aggtatgttgcctttatggt

SEQ ID NO: 917697 - DNA, 14 bp, Homo sapiens
aggtattacactct

SEQ ID NO: 917698 - DNA, 13 bp, Homo sapiens
aggtattggcctg

SEQ ID NO: 917699 - DNA, 13 bp, Homo sapiens
aggtatttaagac

SEQ ID NO: 917700 - DNA, 14 bp, Homo sapiens
aggtatttcaaaac

SEQ ID NO: 917701 - DNA, 20 bp, Homo sapiens
aggtatttcgaaactgccaa

SEQ ID NO: 917702 - DNA, 13 bp, Homo sapiens
aggtatttgaaaa

SEQ ID NO: 917703 - DNA, 21 bp, Homo sapiens
aggtatttttccaatcacagt

SEQ ID NO: 917704 - DNA, 17 bp, Homo sapiens
aggtatttttttaaatc

SEQ ID NO: 917705 - DNA, 14 bp, Homo sapiens
aggtcaacacaggt

SEQ ID NO: 917706 - DNA, 20 bp, Homo sapiens
aggtcaagggcttactattt

SEQ ID NO: 917707 - DNA, 17 bp, Homo sapiens
aggtcaagtaagaagac

SEQ ID NO: 917708 - DNA, 22 bp, Homo sapiens
aggtcaagtaagaagacatgaa

SEQ ID NO: 917709 - DNA, 14 bp, Homo sapiens
aggtcaataaactt

SEQ ID NO: 917710 - DNA, 17 bp, Homo sapiens
aggtcaataaagcagag

SEQ ID NO: 917711 - DNA, 19 bp, Homo sapiens
aggtcaataaagcagagcc

SEQ ID NO: 917712 - DNA, 22 bp, Homo sapiens
aggtcaataaagcagagccaag

SEQ ID NO: 917713 - DNA, 17 bp, Homo sapiens
aggtcaataaggtcaag

SEQ ID NO: 917714 - DNA, 15 bp, Homo sapiens
aggtcacattcagga

SEQ ID NO: 917715 - DNA, 12 bp, Homo sapiens
aggtcaccagct

SEQ ID NO: 917716 - DNA, 15 bp, Homo sapiens
aggtcaccatcctca

SEQ ID NO: 917717 - DNA, 17 bp, Homo sapiens
aggtcaccatcctcaga

SEQ ID NO: 917718 - DNA, 21 bp, Homo sapiens
aggtcaccatcctcagaggct

SEQ ID NO: 917719 - DNA, 22 bp, Homo sapiens
aggtcaccatcctcagaggctg

SEQ ID NO: 917720 - DNA, 23 bp, Homo sapiens
aggtcaccatcctcagaggctga

SEQ ID NO: 917721 - DNA, 14 bp, Homo sapiens
aggtcactcctggg

SEQ ID NO: 917722 - DNA, 15 bp, Homo sapiens
aggtcactcctgggg

SEQ ID NO: 917723 - DNA, 18 bp, Homo sapiens
aggtcactcctggggcct

SEQ ID NO: 917724 - DNA, 19 bp, Homo sapiens
aggtcactcctggggcctc

SEQ ID NO: 917725 - DNA, 13 bp, Homo sapiens
aggtcactcttgg

SEQ ID NO: 917726 - DNA, 15 bp, Homo sapiens
aggtcactcttggtc

SEQ ID NO: 917727 - DNA, 20 bp, Homo sapiens
aggtcactggaaaggggaga

SEQ ID NO: 917728 - DNA, 18 bp, Homo sapiens
aggtcactggctctccaa

SEQ ID NO: 917729 - DNA, 21 bp, Homo sapiens
aggtcactggctctccaagtg

SEQ ID NO: 917730 - DNA, 15 bp, Homo sapiens
aggtcactgtcactg

SEQ ID NO: 917731 - DNA, 23 bp, Homo sapiens
aggtcagatggaggttctcagag

SEQ ID NO: 917732 - DNA, 14 bp, Homo sapiens
aggtcagctgggag

SEQ ID NO: 917733 - DNA, 20 bp, Homo sapiens
aggtcagctgggagccagtg

SEQ ID NO: 917734 - DNA, 15 bp, Homo sapiens
aggtcaggagttcct

SEQ ID NO: 917735 - DNA, 21 bp, Homo sapiens
aggtcaggagttcgagaccag

SEQ ID NO: 917736 - DNA, 17 bp, Homo sapiens
aggtcaggatgcacatt

SEQ ID NO: 917737 - DNA, 16 bp, Homo sapiens
aggtcagggagtgctg

SEQ ID NO: 917738 - DNA, 13 bp, Homo sapiens
aggtcagggctca

SEQ ID NO: 917739 - DNA, 16 bp, Homo sapiens
aggtcagggctcagag

SEQ ID NO: 917740 - DNA, 18 bp, Homo sapiens
aggtcagggctcagagtg

SEQ ID NO: 917741 - DNA, 19 bp, Homo sapiens
aggtcatcagatgcctgct

SEQ ID NO: 917742 - DNA, 21 bp, Homo sapiens
aggtcatcagatgcctgcttg

SEQ ID NO: 917743 - DNA, 16 bp, Homo sapiens
aggtcatgctggtggg

SEQ ID NO: 917744 - DNA, 18 bp, Homo sapiens
aggtcatttctttgctta

SEQ ID NO: 917745 - DNA, 17 bp, Homo sapiens
aggtccaacaagaatgc

SEQ ID NO: 917746 - DNA, 16 bp, Homo sapiens
aggtccaagcagagtg

SEQ ID NO: 917747 - DNA, 13 bp, Homo sapiens
aggtccaagggcc

SEQ ID NO: 917748 - DNA, 16 bp, Homo sapiens
aggtccaccggcccct

SEQ ID NO: 917749 - DNA, 22 bp, Homo sapiens
aggtccaccggcccctggcagc

SEQ ID NO: 917750 - DNA, 16 bp, Homo sapiens
aggtccactccctgct

SEQ ID NO: 917751 - DNA, 11 bp, Homo sapiens
aggtccagccc

SEQ ID NO: 917752 - DNA, 12 bp, Homo sapiens
aggtccagccca

SEQ ID NO: 917753 - DNA, 18 bp, Homo sapiens
aggtccagctctggaggg

SEQ ID NO: 917754 - DNA, 16 bp, Homo sapiens
aggtccattattttgt

SEQ ID NO: 917755 - DNA, 18 bp, Homo sapiens
aggtccattcattaatta

SEQ ID NO: 917756 - DNA, 21 bp, Homo sapiens
aggtcccaattcggggcctgc

SEQ ID NO: 917757 - DNA, 14 bp, Homo sapiens
aggtcccacctcca

SEQ ID NO: 917758 - DNA, 16 bp, Homo sapiens
aggtcccacctccagc

SEQ ID NO: 917759 - DNA, 18 bp, Homo sapiens
aggtcccacgtctggcca

SEQ ID NO: 917760 - DNA, 13 bp, Homo sapiens
aggtcccagcccc

SEQ ID NO: 917761 - DNA, 22 bp, Homo sapiens
aggtcccagccccaggcctggc

SEQ ID NO: 917762 - DNA, 18 bp, Homo sapiens
aggtcccagcgagccaca

SEQ ID NO: 917763 - DNA, 13 bp, Homo sapiens
aggtcccaggcag

SEQ ID NO: 917764 - DNA, 14 bp, Homo sapiens
aggtcccaggcaga

SEQ ID NO: 917765 - DNA, 13 bp, Homo sapiens
aggtccccatggc

SEQ ID NO: 917766 - DNA, 15 bp, Homo sapiens
aggtccccccaccgc

SEQ ID NO: 917767 - DNA, 13 bp, Homo sapiens
aggtcccccgact

SEQ ID NO: 917768 - DNA, 21 bp, Homo sapiens
aggtccccggttgctggtcag

SEQ ID NO: 917769 - DNA, 17 bp, Homo sapiens
aggtcccttcaaggcct

SEQ ID NO: 917770 - DNA, 19 bp, Homo sapiens
catcacccgcccctggact

SEQ ID NO: 917771 - DNA, 14 bp, Homo sapiens
catcaccctatata

SEQ ID NO: 917772 - DNA, 13 bp, Homo sapiens
catcaccctcacc

SEQ ID NO: 917773 - DNA, 15 bp, Homo sapiens
catcaccctcaccca

SEQ ID NO: 917774 - DNA, 16 bp, Homo sapiens
catcaccctcacccac

SEQ ID NO: 917775 - DNA, 14 bp, Homo sapiens
catcaccctcttcc

SEQ ID NO: 917776 - DNA, 22 bp, Homo sapiens
catcaccctgggagtttcctga

SEQ ID NO: 917777 - DNA, 23 bp, Homo sapiens
catcaccgtcccgcacagtggac

SEQ ID NO: 917778 - DNA, 15 bp, Homo sapiens
catcacctcaggcca

SEQ ID NO: 917779 - DNA, 21 bp, Homo sapiens
catcacctctaatagaggcag

SEQ ID NO: 917780 - DNA, 23 bp, Homo sapiens
catcacctgaaacactggacctg

SEQ ID NO: 917781 - DNA, 21 bp, Homo sapiens
catcacctttttgacttttcc

SEQ ID NO: 917782 - DNA, 16 bp, Homo sapiens
catcacgacacatttg

SEQ ID NO: 917783 - DNA, 19 bp, Homo sapiens
catcacgttagctgtccca

SEQ ID NO: 917784 - DNA, 18 bp, Homo sapiens
catcactagaagaaaagc

SEQ ID NO: 917785 - DNA, 16 bp, Homo sapiens
catcactcactcactc

SEQ ID NO: 917786 - DNA, 23 bp, Homo sapiens
catcactcactcactccccactc

SEQ ID NO: 917787 - DNA, 23 bp, Homo sapiens
catcactcagcccctacccctgc

SEQ ID NO: 917788 - DNA, 12 bp, Homo sapiens
catcactgcctt

SEQ ID NO: 917789 - DNA, 18 bp, Homo sapiens
catcactgcgccactgct

SEQ ID NO: 917790 - DNA, 17 bp, Homo sapiens
catcactggactgcatg

SEQ ID NO: 917791 - DNA, 14 bp, Homo sapiens
catcactgtaaaga

SEQ ID NO: 917792 - DNA, 15 bp, Homo sapiens
catcactgtaaagac

SEQ ID NO: 917793 - DNA, 14 bp, Homo sapiens
catcacttccctac

SEQ ID NO: 917794 - DNA, 14 bp, Homo sapiens
catcacttctcccc

SEQ ID NO: 917795 - DNA, 19 bp, Homo sapiens
catcacttcttccactgtg

SEQ ID NO: 917796 - DNA, 13 bp, Homo sapiens
catcactttgtga

SEQ ID NO: 917797 - DNA, 14 bp, Homo sapiens
catcactttgtgaa

SEQ ID NO: 917798 - DNA, 15 bp, Homo sapiens
catcactttgtgaat

SEQ ID NO: 917799 - DNA, 17 bp, Homo sapiens
catcactttgtgaatta

SEQ ID NO: 917800 - DNA, 18 bp, Homo sapiens
catcactttgtgaattaa

SEQ ID NO: 917801 - DNA, 23 bp, Homo sapiens
catcagacctgtcttccaaggag

SEQ ID NO: 917802 - DNA, 22 bp, Homo sapiens
catcagagaacagtcatgtatg

SEQ ID NO: 917803 - DNA, 17 bp, Homo sapiens
catcagaggggagcagc

SEQ ID NO: 917804 - DNA, 18 bp, Homo sapiens
catcagaggtttgcttcc

SEQ ID NO: 917805 - DNA, 21 bp, Homo sapiens
catcagaggtttgcttcctca

SEQ ID NO: 917806 - DNA, 16 bp, Homo sapiens
catcagataacaactg

SEQ ID NO: 917807 - DNA, 16 bp, Homo sapiens
catcagatgcctgctt

SEQ ID NO: 917808 - DNA, 18 bp, Homo sapiens
catcagatgcctgcttga

SEQ ID NO: 917809 - DNA, 13 bp, Homo sapiens
catcagattgtta

SEQ ID NO: 917810 - DNA, 19 bp, Homo sapiens
catcagattgttaagggca

SEQ ID NO: 917811 - DNA, 23 bp, Homo sapiens
catcagcaaatgtgtacgtgcat

SEQ ID NO: 917812 - DNA, 23 bp, Homo sapiens
catcagcattgtctcgtgtacag

SEQ ID NO: 917813 - DNA, 13 bp, Homo sapiens
catcagcccctgg

SEQ ID NO: 917814 - DNA, 18 bp, Homo sapiens
catcagcgggtctcctcc

SEQ ID NO: 917815 - DNA, 11 bp, Homo sapiens
catcagctccc

SEQ ID NO: 917816 - DNA, 21 bp, Homo sapiens
catcaggagactgggctctgg

SEQ ID NO: 917817 - DNA, 17 bp, Homo sapiens
catcaggatgaacccag

SEQ ID NO: 917818 - DNA, 14 bp, Homo sapiens
catcagggacagga

SEQ ID NO: 917819 - DNA, 11 bp, Homo sapiens
catcagggcct

SEQ ID NO: 917820 - DNA, 16 bp, Homo sapiens
catcagggcctggggc

SEQ ID NO: 917821 - DNA, 21 bp, Homo sapiens
catcagggcctggggcctgag

SEQ ID NO: 917822 - DNA, 21 bp, Homo sapiens
catcagggcctttctcctccc

SEQ ID NO: 917823 - DNA, 12 bp, Homo sapiens
catcagggggaa

SEQ ID NO: 917824 - DNA, 17 bp, Homo sapiens
catcagggggaagaagc

SEQ ID NO: 917825 - DNA, 20 bp, Homo sapiens
catcagggtgggccactctc

SEQ ID NO: 917826 - DNA, 16 bp, Homo sapiens
catcaggtctgggcaa

SEQ ID NO: 917827 - DNA, 17 bp, Homo sapiens
catcaggtctgggcaag

SEQ ID NO: 917828 - DNA, 16 bp, Homo sapiens
catcaggttccatccc

SEQ ID NO: 917829 - DNA, 18 bp, Homo sapiens
catcagtagcatttttct

SEQ ID NO: 917830 - DNA, 15 bp, Homo sapiens
catcagtgcctcttt

SEQ ID NO: 917831 - DNA, 15 bp, Homo sapiens
catcagtgctccctc

SEQ ID NO: 917832 - DNA, 18 bp, Homo sapiens
catcagttcccccagtac

SEQ ID NO: 917833 - DNA, 13 bp, Homo sapiens
catcataattaca

SEQ ID NO: 917834 - DNA, 17 bp, Homo sapiens
catcataattacattcc

SEQ ID NO: 917835 - DNA, 16 bp, Homo sapiens
catcatattatacaga

SEQ ID NO: 917836 - DNA, 22 bp, Homo sapiens
catcatattccaacccagccac

SEQ ID NO: 917837 - DNA, 21 bp, Homo sapiens
catcatattctattgtttact

SEQ ID NO: 917838 - DNA, 16 bp, Homo sapiens
catcatattgtatgta

SEQ ID NO: 917839 - DNA, 13 bp, Homo sapiens
catcatcactgta

SEQ ID NO: 917840 - DNA, 15 bp, Homo sapiens
catcatcactgtaaa

SEQ ID NO: 917841 - DNA, 14 bp, Homo sapiens
catcatcacttttt

SEQ ID NO: 917842 - DNA, 13 bp, Homo sapiens
catcatcagagcc

SEQ ID NO: 917843 - DNA, 16 bp, Homo sapiens
catcatcagggcctgg

SEQ ID NO: 917844 - DNA, 12 bp, Homo sapiens
catcatccaccc

SEQ ID NO: 917845 - DNA, 18 bp, Homo sapiens
catcatccggtttagtca

SEQ ID NO: 917846 - DNA, 21 bp, Homo sapiens
catcatctcctgccttcctcc

SEQ ID NO: 917847 - DNA, 18 bp, Homo sapiens
catcatgatggaaaaaat

SEQ ID NO: 917848 - DNA, 20 bp, Homo sapiens
catcatgcggtgggtgctgc

SEQ ID NO: 917849 - DNA, 21 bp, Homo sapiens
catcatgctggaacctgcaaa

SEQ ID NO: 917850 - DNA, 22 bp, Homo sapiens
catcatgctggaacctgcaaaa

SEQ ID NO: 917851 - DNA, 21 bp, Homo sapiens
catcatggactgagctggggg

SEQ ID NO: 917852 - DNA, 14 bp, Homo sapiens
catcatgtctattg

SEQ ID NO: 917853 - DNA, 17 bp, Homo sapiens
catcatgtctgtatact

SEQ ID NO: 917854 - DNA, 19 bp, Homo sapiens
catcattactgttccagat

SEQ ID NO: 917855 - DNA, 13 bp, Homo sapiens
catcattagaaca

SEQ ID NO: 917856 - DNA, 23 bp, Homo sapiens
catcattccctctcatctcaggt

SEQ ID NO: 917857 - DNA, 16 bp, Homo sapiens
catcattccttctggc

SEQ ID NO: 917858 - DNA, 17 bp, Homo sapiens
catcattccttctggcc

SEQ ID NO: 917859 - DNA, 22 bp, Homo sapiens
catcattccttgagaaaaacaa

SEQ ID NO: 917860 - DNA, 17 bp, Homo sapiens
catcattctctgtctca

SEQ ID NO: 917861 - DNA, 14 bp, Homo sapiens
catcattgcactct

SEQ ID NO: 917862 - DNA, 13 bp, Homo sapiens
catcattgtttct

SEQ ID NO: 917863 - DNA, 16 bp, Homo sapiens
catcatttcagccaaa

SEQ ID NO: 917864 - DNA, 20 bp, Homo sapiens
catcattttgcattcaaatt

SEQ ID NO: 917865 - DNA, 22 bp, Homo sapiens
catcattttgcattcaaattaa

SEQ ID NO: 917866 - DNA, 17 bp, Homo sapiens
catccaaaatatttttt

SEQ ID NO: 917867 - DNA, 17 bp, Homo sapiens
catccaaagcagacagc

SEQ ID NO: 917868 - DNA, 18 bp, Homo sapiens
catccaaagcagacagct

SEQ ID NO: 917869 - DNA, 19 bp, Homo sapiens
catccaaccccccacctgc

SEQ ID NO: 917870 - DNA, 18 bp, Homo sapiens
catccaactccagcaact

SEQ ID NO: 917871 - DNA, 22 bp, Homo sapiens
catccaactggaaattccagga

SEQ ID NO: 917872 - DNA, 14 bp, Homo sapiens
catccaaggagaaa

SEQ ID NO: 917873 - DNA, 17 bp, Homo sapiens
catccaatcctcactgg

SEQ ID NO: 917874 - DNA, 14 bp, Homo sapiens
catccacccagtgc

SEQ ID NO: 917875 - DNA, 17 bp, Homo sapiens
catccacccagtgctgc

SEQ ID NO: 917876 - DNA, 22 bp, Homo sapiens
catccacccagtgctgccatgc

SEQ ID NO: 917877 - DNA, 18 bp, Homo sapiens
catccacccgctgcccct

SEQ ID NO: 917878 - DNA, 20 bp, Homo sapiens
catccacccgctgcccctcc

SEQ ID NO: 917879 - DNA, 21 bp, Homo sapiens
catccacccgctgcccctccc

SEQ ID NO: 917880 - DNA, 23 bp, Homo sapiens
catccaccctcatttttccttta

SEQ ID NO: 917881 - DNA, 17 bp, Homo sapiens
catccaccttcccttct

SEQ ID NO: 917882 - DNA, 14 bp, Homo sapiens
catccactagtgca

SEQ ID NO: 917883 - DNA, 14 bp, Homo sapiens
catccactctaccc

SEQ ID NO: 917884 - DNA, 15 bp, Homo sapiens
catccactctaccct

SEQ ID NO: 917885 - DNA, 12 bp, Homo sapiens
catccacttaag

SEQ ID NO: 917886 - DNA, 15 bp, Homo sapiens
catccagatgtggct

SEQ ID NO: 917887 - DNA, 15 bp, Homo sapiens
catccagccacggag

SEQ ID NO: 917888 - DNA, 12 bp, Homo sapiens
catccagcctgt

SEQ ID NO: 917889 - DNA, 13 bp, Homo sapiens
catccagcctgtg

SEQ ID NO: 917890 - DNA, 15 bp, Homo sapiens
catccagcctgtgtg

SEQ ID NO: 917891 - DNA, 16 bp, Homo sapiens
catccagcctgtgtgt

SEQ ID NO: 917892 - DNA, 22 bp, Homo sapiens
catccagcgagagagtttcaaa

SEQ ID NO: 917893 - DNA, 20 bp, Homo sapiens
catccagctgcccctccctc

SEQ ID NO: 917894 - DNA, 21 bp, Homo sapiens
catccagggcccccatctcat

SEQ ID NO: 917895 - DNA, 20 bp, Homo sapiens
aggtcccttcaaggcctccc

SEQ ID NO: 917896 - DNA, 22 bp, Homo sapiens
aggtcccttcccgacccagcca

SEQ ID NO: 917897 - DNA, 16 bp, Homo sapiens
aggtcctacagggcca

SEQ ID NO: 917898 - DNA, 13 bp, Homo sapiens
aggtcctcaggtc

SEQ ID NO: 917899 - DNA, 14 bp, Homo sapiens
aggtcctcaggtca

SEQ ID NO: 917900 - DNA, 21 bp, Homo sapiens
aggtcctctacttaatgagat

SEQ ID NO: 917901 - DNA, 15 bp, Homo sapiens
aggtcctctgaggca

SEQ ID NO: 917902 - DNA, 20 bp, Homo sapiens
aggtcctctgatacccagag

SEQ ID NO: 917903 - DNA, 20 bp, Homo sapiens
aggtcctctggagccctaac

SEQ ID NO: 917904 - DNA, 14 bp, Homo sapiens
aggtcctctgtcag

SEQ ID NO: 917905 - DNA, 23 bp, Homo sapiens
aggtcctctgtcagtcacagcca

SEQ ID NO: 917906 - DNA, 21 bp, Homo sapiens
aggtcctgaaagtaactcata

SEQ ID NO: 917907 - DNA, 17 bp, Homo sapiens
aggtcctgcccatgtgt

SEQ ID NO: 917908 - DNA, 16 bp, Homo sapiens
aggtcctgtctctgca

SEQ ID NO: 917909 - DNA, 18 bp, Homo sapiens
aggtcctgtctctgcaca

SEQ ID NO: 917910 - DNA, 20 bp, Homo sapiens
aggtccttaggcctctgaga

SEQ ID NO: 917911 - DNA, 14 bp, Homo sapiens
aggtccttgcctcc

SEQ ID NO: 917912 - DNA, 19 bp, Homo sapiens
aggtccttgcctcctggaa

SEQ ID NO: 917913 - DNA, 21 bp, Homo sapiens
aggtcgaccccaaagcccctt

SEQ ID NO: 917914 - DNA, 20 bp, Homo sapiens
aggtcgcttgggaattttat

SEQ ID NO: 917915 - DNA, 18 bp, Homo sapiens
aggtcgttttccaaagag

SEQ ID NO: 917916 - DNA, 12 bp, Homo sapiens
aggtctaactgt

SEQ ID NO: 917917 - DNA, 16 bp, Homo sapiens
aggtctagactttctc

SEQ ID NO: 917918 - DNA, 15 bp, Homo sapiens
aggtctcatctcttc

SEQ ID NO: 917919 - DNA, 22 bp, Homo sapiens
aggtctcatctcttcaggttct

SEQ ID NO: 917920 - DNA, 18 bp, Homo sapiens
aggtctccaagggagggt

SEQ ID NO: 917921 - DNA, 20 bp, Homo sapiens
aggtctccaagggagggtgc

SEQ ID NO: 917922 - DNA, 21 bp, Homo sapiens
aggtctccagttggctttact

SEQ ID NO: 917923 - DNA, 14 bp, Homo sapiens
aggtctcctcttaa

SEQ ID NO: 917924 - DNA, 23 bp, Homo sapiens
aggtctcctcttaaaaaataaaa

SEQ ID NO: 917925 - DNA, 22 bp, Homo sapiens
aggtctccttactctgagccca

SEQ ID NO: 917926 - DNA, 16 bp, Homo sapiens
aggtctcttctcccag

SEQ ID NO: 917927 - DNA, 21 bp, Homo sapiens
aggtctgaaatggaggtcctt

SEQ ID NO: 917928 - DNA, 20 bp, Homo sapiens
aggtctgacacgtctgccta

SEQ ID NO: 917929 - DNA, 14 bp, Homo sapiens
aggtctgagccctg

SEQ ID NO: 917930 - DNA, 15 bp, Homo sapiens
aggtctgagccctgg

SEQ ID NO: 917931 - DNA, 22 bp, Homo sapiens
aggtctgagccctggtgtgttt

SEQ ID NO: 917932 - DNA, 23 bp, Homo sapiens
aggtctgagccctggtgtgtttc

SEQ ID NO: 917933 - DNA, 20 bp, Homo sapiens
aggtctgcaagggcccagag

SEQ ID NO: 917934 - DNA, 21 bp, Homo sapiens
aggtctgcaagggcccagagt

SEQ ID NO: 917935 - DNA, 12 bp, Homo sapiens
aggtctgggatg

SEQ ID NO: 917936 - DNA, 16 bp, Homo sapiens
aggtctgggatggaca

SEQ ID NO: 917937 - DNA, 23 bp, Homo sapiens
aggtctgggcaagtagcaggact

SEQ ID NO: 917938 - DNA, 12 bp, Homo sapiens
aggtctgtaact

SEQ ID NO: 917939 - DNA, 11 bp, Homo sapiens
aggtctgtgct

SEQ ID NO: 917940 - DNA, 14 bp, Homo sapiens
aggtctgtgctgag

SEQ ID NO: 917941 - DNA, 13 bp, Homo sapiens
aggtctgttcttt

SEQ ID NO: 917942 - DNA, 22 bp, Homo sapiens
aggtctgttctttccaaagtac

SEQ ID NO: 917943 - DNA, 20 bp, Homo sapiens
aggtctgtttaaagtggcaa

SEQ ID NO: 917944 - DNA, 14 bp, Homo sapiens
aggtctgtttttat

SEQ ID NO: 917945 - DNA, 16 bp, Homo sapiens
aggtcttcagggctct

SEQ ID NO: 917946 - DNA, 18 bp, Homo sapiens
aggtcttcttgtgtcctg

SEQ ID NO: 917947 - DNA, 18 bp, Homo sapiens
aggtcttgactcatggca

SEQ ID NO: 917948 - DNA, 22 bp, Homo sapiens
aggtcttgactcatggcagctg

SEQ ID NO: 917949 - DNA, 19 bp, Homo sapiens
aggtcttggagctgagcct

SEQ ID NO: 917950 - DNA, 21 bp, Homo sapiens
aggtcttggagctgagcctct

SEQ ID NO: 917951 - DNA, 22 bp, Homo sapiens
aggtcttggagctgagcctctc

SEQ ID NO: 917952 - DNA, 21 bp, Homo sapiens
aggtctttaaacctttcataa

SEQ ID NO: 917953 - DNA, 16 bp, Homo sapiens
aggtctttgcacatgt

SEQ ID NO: 917954 - DNA, 19 bp, Homo sapiens
aggtctttgtaaaatcttg

SEQ ID NO: 917955 - DNA, 19 bp, Homo sapiens
aggtcttttgacatgtgga

SEQ ID NO: 917956 - DNA, 20 bp, Homo sapiens
aggtgaaactccagatgcca

SEQ ID NO: 917957 - DNA, 13 bp, Homo sapiens
aggtgaaagaaaa

SEQ ID NO: 917958 - DNA, 14 bp, Homo sapiens
aggtgaaagggagc

SEQ ID NO: 917959 - DNA, 15 bp, Homo sapiens
aggtgaagggatggg

SEQ ID NO: 917960 - DNA, 22 bp, Homo sapiens
aggtgaatttcattaaatggaa

SEQ ID NO: 917961 - DNA, 15 bp, Homo sapiens
aggtgacatatacat

SEQ ID NO: 917962 - DNA, 13 bp, Homo sapiens
aggtgaccgccca

SEQ ID NO: 917963 - DNA, 22 bp, Homo sapiens
aggtgaccgcccagctctccca

SEQ ID NO: 917964 - DNA, 13 bp, Homo sapiens
aggtgactgtgct

SEQ ID NO: 917965 - DNA, 15 bp, Homo sapiens
aggtgactgtgctgt

SEQ ID NO: 917966 - DNA, 14 bp, Homo sapiens
aggtgactgtgtgt

SEQ ID NO: 917967 - DNA, 16 bp, Homo sapiens
aggtgagaacatccat

SEQ ID NO: 917968 - DNA, 20 bp, Homo sapiens
aggtgagaactcagaagaga

SEQ ID NO: 917969 - DNA, 21 bp, Homo sapiens
aggtgagaagcagaggaagga

SEQ ID NO: 917970 - DNA, 12 bp, Homo sapiens
aggtgagaggcg

SEQ ID NO: 917971 - DNA, 23 bp, Homo sapiens
aggtgagaggcgagtcaccctcc

SEQ ID NO: 917972 - DNA, 13 bp, Homo sapiens
aggtgagcctggg

SEQ ID NO: 917973 - DNA, 16 bp, Homo sapiens
aggtgaggattccaaa

SEQ ID NO: 917974 - DNA, 22 bp, Homo sapiens
aggtgaggcatggcaattctgg

SEQ ID NO: 917975 - DNA, 15 bp, Homo sapiens
aggtgaggggcagga

SEQ ID NO: 917976 - DNA, 17 bp, Homo sapiens
aggtgaggtctgttcct

SEQ ID NO: 917977 - DNA, 20 bp, Homo sapiens
aggtgagtttgagctgcctt

SEQ ID NO: 917978 - DNA, 21 bp, Homo sapiens
aggtgagtttgagctgccttc

SEQ ID NO: 917979 - DNA, 16 bp, Homo sapiens
aggtgatatatttaaa

SEQ ID NO: 917980 - DNA, 19 bp, Homo sapiens
aggtgatatttttatgtgc

SEQ ID NO: 917981 - DNA, 23 bp, Homo sapiens
aggtgatatttttatgtgcagcg

SEQ ID NO: 917982 - DNA, 13 bp, Homo sapiens
aggtgatgctgct

SEQ ID NO: 917983 - DNA, 19 bp, Homo sapiens
aggtgattcttacatatga

SEQ ID NO: 917984 - DNA, 20 bp, Homo sapiens
aggtgattcttacatatgat

SEQ ID NO: 917985 - DNA, 17 bp, Homo sapiens
aggtgatttcctctaaa

SEQ ID NO: 917986 - DNA, 16 bp, Homo sapiens
aggtgcagaccttggg

SEQ ID NO: 917987 - DNA, 15 bp, Homo sapiens
aggtgcagatgggct

SEQ ID NO: 917988 - DNA, 16 bp, Homo sapiens
aggtgcagatgggctg

SEQ ID NO: 917989 - DNA, 13 bp, Homo sapiens
aggtgcagctcct

SEQ ID NO: 917990 - DNA, 11 bp, Homo sapiens
aggtgcagtgg

SEQ ID NO: 917991 - DNA, 14 bp, Homo sapiens
aggtgcatctgcag

SEQ ID NO: 917992 - DNA, 16 bp, Homo sapiens
aggtgcatctgcaggc

SEQ ID NO: 917993 - DNA, 18 bp, Homo sapiens
aggtgcatctgcaggcac

SEQ ID NO: 917994 - DNA, 21 bp, Homo sapiens
aggtgcatctggggaactaga

SEQ ID NO: 917995 - DNA, 19 bp, Homo sapiens
aggtgcatctttccctgcc

SEQ ID NO: 917996 - DNA, 15 bp, Homo sapiens
aggtgccactgaccg

SEQ ID NO: 917997 - DNA, 13 bp, Homo sapiens
aggtgccagaagg

SEQ ID NO: 917998 - DNA, 20 bp, Homo sapiens
aggtgccagcaactgaataa

SEQ ID NO: 917999 - DNA, 15 bp, Homo sapiens
aggtgccatctcagg

SEQ ID NO: 918000 - DNA, 16 bp, Homo sapiens
aggtgcctcatagcat

SEQ ID NO: 918001 - DNA, 14 bp, Homo sapiens
aggtgcctccaggt

SEQ ID NO: 918002 - DNA, 19 bp, Homo sapiens
aggtgcctgctcaggtgct

SEQ ID NO: 918003 - DNA, 12 bp, Homo sapiens
aggtgcctggcc

SEQ ID NO: 918004 - DNA, 18 bp, Homo sapiens
aggtgcctgtcccacccc

SEQ ID NO: 918005 - DNA, 17 bp, Homo sapiens
aggtgcctgtgaggcag

SEQ ID NO: 918006 - DNA, 18 bp, Homo sapiens
aggtgcctgtgaggcagg

SEQ ID NO: 918007 - DNA, 20 bp, Homo sapiens
aggtgcctgtgaggcagggg

SEQ ID NO: 918008 - DNA, 20 bp, Homo sapiens
aggtgccttacatcttttct

SEQ ID NO: 918009 - DNA, 23 bp, Homo sapiens
aggtgccttacatcttttctaat

SEQ ID NO: 918010 - DNA, 23 bp, Homo sapiens
aggtgccttcttattctcactcc

SEQ ID NO: 918011 - DNA, 15 bp, Homo sapiens
aggtgcctttcaaat

SEQ ID NO: 918012 - DNA, 19 bp, Homo sapiens
aggtgcctttcaaatttag

SEQ ID NO: 918013 - DNA, 15 bp, Homo sapiens
aggtgctaacataga

SEQ ID NO: 918014 - DNA, 21 bp, Homo sapiens
aggtgctacacccttttccag

SEQ ID NO: 918015 - DNA, 21 bp, Homo sapiens
aggtgctatctgttcagtgat

SEQ ID NO: 918016 - DNA, 17 bp, Homo sapiens
aggtgctcccctgacag

SEQ ID NO: 918017 - DNA, 18 bp, Homo sapiens
aggtgctgaactgtgcat

SEQ ID NO: 918018 - DNA, 17 bp, Homo sapiens
aggtgctgagcttagcc

SEQ ID NO: 918019 - DNA, 12 bp, Homo sapiens
catccagggtct

SEQ ID NO: 918020 - DNA, 14 bp, Homo sapiens
catccagggtctgg

SEQ ID NO: 918021 - DNA, 17 bp, Homo sapiens
catccagggtctggcag

SEQ ID NO: 918022 - DNA, 17 bp, Homo sapiens
catccagtggactctgg

SEQ ID NO: 918023 - DNA, 23 bp, Homo sapiens
catccataatttggggccctgag

SEQ ID NO: 918024 - DNA, 20 bp, Homo sapiens
catccatagtgcactagcat

SEQ ID NO: 918025 - DNA, 16 bp, Homo sapiens
catccatcaatacctg

SEQ ID NO: 918026 - DNA, 13 bp, Homo sapiens
catccatctccag

SEQ ID NO: 918027 - DNA, 14 bp, Homo sapiens
catccatgcacttt

SEQ ID NO: 918028 - DNA, 22 bp, Homo sapiens
catccatgcactttaattgaag

SEQ ID NO: 918029 - DNA, 17 bp, Homo sapiens
catccatgccctcccag

SEQ ID NO: 918030 - DNA, 22 bp, Homo sapiens
catccatgccctcccaggaccc

SEQ ID NO: 918031 - DNA, 16 bp, Homo sapiens
catccatgtgtggact

SEQ ID NO: 918032 - DNA, 20 bp, Homo sapiens
catccattaggccagcaacg

SEQ ID NO: 918033 - DNA, 14 bp, Homo sapiens
catccattcctcag

SEQ ID NO: 918034 - DNA, 15 bp, Homo sapiens
catccattcctcagg

SEQ ID NO: 918035 - DNA, 17 bp, Homo sapiens
catccattcctcaggga

SEQ ID NO: 918036 - DNA, 18 bp, Homo sapiens
catccattcctcagggac

SEQ ID NO: 918037 - DNA, 17 bp, Homo sapiens
catccatttactgacac

SEQ ID NO: 918038 - DNA, 19 bp, Homo sapiens
catccatttcatctatttc

SEQ ID NO: 918039 - DNA, 13 bp, Homo sapiens
catccatttcttt

SEQ ID NO: 918040 - DNA, 16 bp, Homo sapiens
catccatttgaacaca

SEQ ID NO: 918041 - DNA, 18 bp, Homo sapiens
catccatttgaacacatt

SEQ ID NO: 918042 - DNA, 12 bp, Homo sapiens
catcccaaactt

SEQ ID NO: 918043 - DNA, 13 bp, Homo sapiens
catcccaaacttt

SEQ ID NO: 918044 - DNA, 23 bp, Homo sapiens
catcccaaaggatgagaatgtga

SEQ ID NO: 918045 - DNA, 20 bp, Homo sapiens
catcccaaccaggcacctct

SEQ ID NO: 918046 - DNA, 13 bp, Homo sapiens
catcccaactgtc

SEQ ID NO: 918047 - DNA, 15 bp, Homo sapiens
catcccaccagcccc

SEQ ID NO: 918048 - DNA, 19 bp, Homo sapiens
catcccacgcactccatga

SEQ ID NO: 918049 - DNA, 15 bp, Homo sapiens
catcccactggatct

SEQ ID NO: 918050 - DNA, 16 bp, Homo sapiens
catcccagaccagcca

SEQ ID NO: 918051 - DNA, 14 bp, Homo sapiens
catcccagccttga

SEQ ID NO: 918052 - DNA, 15 bp, Homo sapiens
catcccagcttgccc

SEQ ID NO: 918053 - DNA, 19 bp, Homo sapiens
catcccaggggaccacacc

SEQ ID NO: 918054 - DNA, 11 bp, Homo sapiens
catcccagggt

SEQ ID NO: 918055 - DNA, 19 bp, Homo sapiens
catcccagggtcccacccc

SEQ ID NO: 918056 - DNA, 23 bp, Homo sapiens
catcccagtggcctcaaccctcc

SEQ ID NO: 918057 - DNA, 24 bp, Homo sapiens
catcccatctctcccacttcctcc

SEQ ID NO: 918058 - DNA, 20 bp, Homo sapiens
catcccatgatgtagtgcct

SEQ ID NO: 918059 - DNA, 15 bp, Homo sapiens
catcccattgccctg

SEQ ID NO: 918060 - DNA, 17 bp, Homo sapiens
catcccattgccctggt

SEQ ID NO: 918061 - DNA, 18 bp, Homo sapiens
catcccattttcatcctg

SEQ ID NO: 918062 - DNA, 21 bp, Homo sapiens
catcccattttcatcctgagc

SEQ ID NO: 918063 - DNA, 17 bp, Homo sapiens
catccccaccagctcgt

SEQ ID NO: 918064 - DNA, 21 bp, Homo sapiens
catccccacgacccctgcctc

SEQ ID NO: 918065 - DNA, 13 bp, Homo sapiens
catccccagagcc

SEQ ID NO: 918066 - DNA, 17 bp, Homo sapiens
catccccagagcccagc

SEQ ID NO: 918067 - DNA, 18 bp, Homo sapiens
catccccagagcccagct

SEQ ID NO: 918068 - DNA, 11 bp, Homo sapiens
catccccaggg

SEQ ID NO: 918069 - DNA, 15 bp, Homo sapiens
catccccatcctcca

SEQ ID NO: 918070 - DNA, 17 bp, Homo sapiens
catccccatcctccagc

SEQ ID NO: 918071 - DNA, 12 bp, Homo sapiens
catcccccaaag

SEQ ID NO: 918072 - DNA, 14 bp, Homo sapiens
catcccccaaagtt

SEQ ID NO: 918073 - DNA, 13 bp, Homo sapiens
catcccccctgct

SEQ ID NO: 918074 - DNA, 16 bp, Homo sapiens
catcccccctgctcag

SEQ ID NO: 918075 - DNA, 17 bp, Homo sapiens
catcccccctgctcagc

SEQ ID NO: 918076 - DNA, 14 bp, Homo sapiens
catcccccctgctg

SEQ ID NO: 918077 - DNA, 21 bp, Homo sapiens
catccccctctcacgccaccc

SEQ ID NO: 918078 - DNA, 13 bp, Homo sapiens
catccccctgtgg

SEQ ID NO: 918079 - DNA, 21 bp, Homo sapiens
catcccccttcttcctcccct

SEQ ID NO: 918080 - DNA, 22 bp, Homo sapiens
catcccctcaacaccctgcttc

SEQ ID NO: 918081 - DNA, 19 bp, Homo sapiens
catcccctcgtcctgtccc

SEQ ID NO: 918082 - DNA, 16 bp, Homo sapiens
catcccctctcaggag

SEQ ID NO: 918083 - DNA, 19 bp, Homo sapiens
catcccctggactgggagg

SEQ ID NO: 918084 - DNA, 22 bp, Homo sapiens
catccccttcccccatccctac

SEQ ID NO: 918085 - DNA, 21 bp, Homo sapiens
catcccgcttagcctgcctca

SEQ ID NO: 918086 - DNA, 13 bp, Homo sapiens
catcccggcctct

SEQ ID NO: 918087 - DNA, 17 bp, Homo sapiens
catcccgtatcacagtg

SEQ ID NO: 918088 - DNA, 16 bp, Homo sapiens
catcccgtgttctcct

SEQ ID NO: 918089 - DNA, 21 bp, Homo sapiens
catcccgtgttctccttttcc

SEQ ID NO: 918090 - DNA, 13 bp, Homo sapiens
catccctaccact

SEQ ID NO: 918091 - DNA, 16 bp, Homo sapiens
catccctaccactgtg

SEQ ID NO: 918092 - DNA, 12 bp, Homo sapiens
catccctacccc

SEQ ID NO: 918093 - DNA, 22 bp, Homo sapiens
catccctaccccctaagagcca

SEQ ID NO: 918094 - DNA, 15 bp, Homo sapiens
catccctcctgcttt

SEQ ID NO: 918095 - DNA, 14 bp, Homo sapiens
catccctccttaag

SEQ ID NO: 918096 - DNA, 16 bp, Homo sapiens
catccctccttgccta

SEQ ID NO: 918097 - DNA, 16 bp, Homo sapiens
catccctgactggcca

SEQ ID NO: 918098 - DNA, 17 bp, Homo sapiens
catccctgactggccaa

SEQ ID NO: 918099 - DNA, 22 bp, Homo sapiens
catccctgcttgcccgctccca

SEQ ID NO: 918100 - DNA, 20 bp, Homo sapiens
catccctggagcaggagccc

SEQ ID NO: 918101 - DNA, 13 bp, Homo sapiens
catccctgggcaa

SEQ ID NO: 918102 - DNA, 17 bp, Homo sapiens
catccctgggcccctcc

SEQ ID NO: 918103 - DNA, 19 bp, Homo sapiens
catccctgggcccctccac

SEQ ID NO: 918104 - DNA, 22 bp, Homo sapiens
catccctgggcccctccacgcc

SEQ ID NO: 918105 - DNA, 12 bp, Homo sapiens
catcccttccca

SEQ ID NO: 918106 - DNA, 17 bp, Homo sapiens
catcccttcccacatgc

SEQ ID NO: 918107 - DNA, 11 bp, Homo sapiens
catcccttcct

SEQ ID NO: 918108 - DNA, 14 bp, Homo sapiens
catcccttcctgga

SEQ ID NO: 918109 - DNA, 14 bp, Homo sapiens
catccctttctccc

SEQ ID NO: 918110 - DNA, 21 bp, Homo sapiens
catccctttctcccagtgaaa

SEQ ID NO: 918111 - DNA, 19 bp, Homo sapiens
catccctttgaaacaagat

SEQ ID NO: 918112 - DNA, 16 bp, Homo sapiens
catccctttgcccaga

SEQ ID NO: 918113 - DNA, 17 bp, Homo sapiens
catccctttttgaagtg

SEQ ID NO: 918114 - DNA, 20 bp, Homo sapiens
catccctttttgaagtgtag

SEQ ID NO: 918115 - DNA, 16 bp, Homo sapiens
catccgactgcccctg

SEQ ID NO: 918116 - DNA, 20 bp, Homo sapiens
catccgactgcccctgctgt

SEQ ID NO: 918117 - DNA, 13 bp, Homo sapiens
catccgaggcagg

SEQ ID NO: 918118 - DNA, 19 bp, Homo sapiens
catccgcagactgcttggc

SEQ ID NO: 918119 - DNA, 22 bp, Homo sapiens
catccgcagactgcttggccag

SEQ ID NO: 918120 - DNA, 15 bp, Homo sapiens
catccgcctgtgggc

SEQ ID NO: 918121 - DNA, 16 bp, Homo sapiens
catccggtcccctgcc

SEQ ID NO: 918122 - DNA, 17 bp, Homo sapiens
catccgtcattgctgct

SEQ ID NO: 918123 - DNA, 18 bp, Homo sapiens
catccgtctgtctgtcgc

SEQ ID NO: 918124 - DNA, 21 bp, Homo sapiens
catccgtctgtctgtcgccct

SEQ ID NO: 918125 - DNA, 23 bp, Homo sapiens
catccgtgtatttggctgggcta

SEQ ID NO: 918126 - DNA, 16 bp, Homo sapiens
catcctacaagacaca

SEQ ID NO: 918127 - DNA, 18 bp, Homo sapiens
catcctaccaatgcatgc

SEQ ID NO: 918128 - DNA, 14 bp, Homo sapiens
catcctcacccaga

SEQ ID NO: 918129 - DNA, 21 bp, Homo sapiens
catcctcagaggctgagccct

SEQ ID NO: 918130 - DNA, 17 bp, Homo sapiens
catcctcatccctgact

SEQ ID NO: 918131 - DNA, 17 bp, Homo sapiens
catcctcattgcctcct

SEQ ID NO: 918132 - DNA, 13 bp, Homo sapiens
catcctccagcag

SEQ ID NO: 918133 - DNA, 15 bp, Homo sapiens
catcctccagccctg

SEQ ID NO: 918134 - DNA, 15 bp, Homo sapiens
catcctccagcttct

SEQ ID NO: 918135 - DNA, 19 bp, Homo sapiens
catcctccagtaccttgct

SEQ ID NO: 918136 - DNA, 16 bp, Homo sapiens
catcctccccaggacc

SEQ ID NO: 918137 - DNA, 12 bp, Homo sapiens
catcctcccctt

SEQ ID NO: 918138 - DNA, 13 bp, Homo sapiens
catcctccccttc

SEQ ID NO: 918139 - DNA, 21 bp, Homo sapiens
catcctccccttccctgcaaa

SEQ ID NO: 918140 - DNA, 19 bp, Homo sapiens
catcctccctccacctcaa

SEQ ID NO: 918141 - DNA, 24 bp, Homo sapiens
catcctcccttgccccaggccagg

SEQ ID NO: 918142 - DNA, 16 bp, Homo sapiens
catcctccgtccagcc

SEQ ID NO: 918143 - DNA, 16 bp, Homo sapiens
catcctcctcagcccc

SEQ ID NO: 918144 - DNA, 23 bp, Homo sapiens
aggtgctgggctggactggccat

SEQ ID NO: 918145 - DNA, 19 bp, Homo sapiens
aggtgctggtagctgaggg

SEQ ID NO: 918146 - DNA, 20 bp, Homo sapiens
aggtgctggtagctgagggg

SEQ ID NO: 918147 - DNA, 22 bp, Homo sapiens
aggtgctggtgggtctgagctg

SEQ ID NO: 918148 - DNA, 14 bp, Homo sapiens
aggtgctgtccatg

SEQ ID NO: 918149 - DNA, 20 bp, Homo sapiens
aggtgcttaagcagaagcat

SEQ ID NO: 918150 - DNA, 18 bp, Homo sapiens
aggtggaaaaacatctga

SEQ ID NO: 918151 - DNA, 24 bp, Homo sapiens
aggtggaaattttatatgtaaatg

SEQ ID NO: 918152 - DNA, 15 bp, Homo sapiens
aggtggaagccctcc

SEQ ID NO: 918153 - DNA, 20 bp, Homo sapiens
aggtggaagccctccttcca

SEQ ID NO: 918154 - DNA, 21 bp, Homo sapiens
aggtggaagccctccttccac

SEQ ID NO: 918155 - DNA, 14 bp, Homo sapiens
aggtggaaggcagg

SEQ ID NO: 918156 - DNA, 17 bp, Homo sapiens
aggtggaataaacatta

SEQ ID NO: 918157 - DNA, 14 bp, Homo sapiens
aggtggacacacaa

SEQ ID NO: 918158 - DNA, 17 bp, Homo sapiens
aggtggagaaaattgga

SEQ ID NO: 918159 - DNA, 17 bp, Homo sapiens
aggtggagagcactaga

SEQ ID NO: 918160 - DNA, 20 bp, Homo sapiens
aggtggagattgcagtgagc

SEQ ID NO: 918161 - DNA, 20 bp, Homo sapiens
aggtggagcttgcagtgagc

SEQ ID NO: 918162 - DNA, 20 bp, Homo sapiens
aggtggaggctgcagtgagc

SEQ ID NO: 918163 - DNA, 19 bp, Homo sapiens
aggtggaggttgcagtgag

SEQ ID NO: 918164 - DNA, 18 bp, Homo sapiens
aggtggaggttgtgcatg

SEQ ID NO: 918165 - DNA, 16 bp, Homo sapiens
aggtggagtttctctg

SEQ ID NO: 918166 - DNA, 15 bp, Homo sapiens
aggtggatggcccca

SEQ ID NO: 918167 - DNA, 16 bp, Homo sapiens
aggtggatggccccag

SEQ ID NO: 918168 - DNA, 23 bp, Homo sapiens
aggtggatggccccagcacagct

SEQ ID NO: 918169 - DNA, 17 bp, Homo sapiens
aggtggcaatgcttaaa

SEQ ID NO: 918170 - DNA, 20 bp, Homo sapiens
aggtggcagatgtcttccct

SEQ ID NO: 918171 - DNA, 13 bp, Homo sapiens
aggtggcaggaca

SEQ ID NO: 918172 - DNA, 13 bp, Homo sapiens
aggtggccaccgg

SEQ ID NO: 918173 - DNA, 19 bp, Homo sapiens
aggtggccatgcctcagcc

SEQ ID NO: 918174 - DNA, 15 bp, Homo sapiens
aggtggcccaggccc

SEQ ID NO: 918175 - DNA, 11 bp, Homo sapiens
aggtggccctt

SEQ ID NO: 918176 - DNA, 15 bp, Homo sapiens
aggtggccgcccctg

SEQ ID NO: 918177 - DNA, 15 bp, Homo sapiens
aggtggccgctcctc

SEQ ID NO: 918178 - DNA, 21 bp, Homo sapiens
aggtggccgctcctccctgct

SEQ ID NO: 918179 - DNA, 13 bp, Homo sapiens
aggtggcctcctg

SEQ ID NO: 918180 - DNA, 17 bp, Homo sapiens
aggtggcctctgcctgg

SEQ ID NO: 918181 - DNA, 19 bp, Homo sapiens
aggtggcctttgtgctgcg

SEQ ID NO: 918182 - DNA, 17 bp, Homo sapiens
aggtggctatggccacc

SEQ ID NO: 918183 - DNA, 15 bp, Homo sapiens
aggtggctctccagt

SEQ ID NO: 918184 - DNA, 19 bp, Homo sapiens
aggtggctctccagttagt

SEQ ID NO: 918185 - DNA, 23 bp, Homo sapiens
aggtggctgacccagtccctggg

SEQ ID NO: 918186 - DNA, 19 bp, Homo sapiens
aggtggctgagcccctgtc

SEQ ID NO: 918187 - DNA, 13 bp, Homo sapiens
aggtggctgcgcc

SEQ ID NO: 918188 - DNA, 23 bp, Homo sapiens
aggtgggagcggggctgggagga

SEQ ID NO: 918189 - DNA, 14 bp, Homo sapiens
aggtgggagctgaa

SEQ ID NO: 918190 - DNA, 19 bp, Homo sapiens
aggtgggaggccaggcgag

SEQ ID NO: 918191 - DNA, 17 bp, Homo sapiens
aggtgggatcctccctc

SEQ ID NO: 918192 - DNA, 19 bp, Homo sapiens
aggtgggcaaagggaagta

SEQ ID NO: 918193 - DNA, 19 bp, Homo sapiens
aggtgggcagctgggcccc

SEQ ID NO: 918194 - DNA, 13 bp, Homo sapiens
aggtgggcaggtg

SEQ ID NO: 918195 - DNA, 22 bp, Homo sapiens
aggtgggcaggtggtggcactg

SEQ ID NO: 918196 - DNA, 19 bp, Homo sapiens
aggtgggcatgccaccctc

SEQ ID NO: 918197 - DNA, 16 bp, Homo sapiens
aggtgggccacaccca

SEQ ID NO: 918198 - DNA, 14 bp, Homo sapiens
aggtgggccagccc

SEQ ID NO: 918199 - DNA, 21 bp, Homo sapiens
aggtgggccagcccctcccac

SEQ ID NO: 918200 - DNA, 22 bp, Homo sapiens
aggtgggccagcccctcccacc

SEQ ID NO: 918201 - DNA, 18 bp, Homo sapiens
aggtgggcccaggaccag

SEQ ID NO: 918202 - DNA, 13 bp, Homo sapiens
aggtgggcctggc

SEQ ID NO: 918203 - DNA, 21 bp, Homo sapiens
aggtgggccttgctacctcaa

SEQ ID NO: 918204 - DNA, 15 bp, Homo sapiens
aggtgggctgagccc

SEQ ID NO: 918205 - DNA, 16 bp, Homo sapiens
aggtgggctgagccct

SEQ ID NO: 918206 - DNA, 17 bp, Homo sapiens
aggtgggctgagccctg

SEQ ID NO: 918207 - DNA, 20 bp, Homo sapiens
aggtgggctgagccctggca

SEQ ID NO: 918208 - DNA, 23 bp, Homo sapiens
aggtgggctgatggcctggctgc

SEQ ID NO: 918209 - DNA, 15 bp, Homo sapiens
aggtgggctgcctgc

SEQ ID NO: 918210 - DNA, 15 bp, Homo sapiens
aggtgggctggggct

SEQ ID NO: 918211 - DNA, 21 bp, Homo sapiens
aggtgggctggggctgctccc

SEQ ID NO: 918212 - DNA, 13 bp, Homo sapiens
aggtggggaagga

SEQ ID NO: 918213 - DNA, 20 bp, Homo sapiens
aggtggggaaggagggactt

SEQ ID NO: 918214 - DNA, 19 bp, Homo sapiens
aggtggggacctgggggga

SEQ ID NO: 918215 - DNA, 11 bp, Homo sapiens
aggtggggagg

SEQ ID NO: 918216 - DNA, 17 bp, Homo sapiens
aggtggggatcctgcct

SEQ ID NO: 918217 - DNA, 17 bp, Homo sapiens
aggtggggccctgcccc

SEQ ID NO: 918218 - DNA, 17 bp, Homo sapiens
aggtggggcctcagcct

SEQ ID NO: 918219 - DNA, 20 bp, Homo sapiens
aggtggggcctcagcctggg

SEQ ID NO: 918220 - DNA, 23 bp, Homo sapiens
aggtggggcctcagcctggggct

SEQ ID NO: 918221 - DNA, 16 bp, Homo sapiens
aggtgggggaaaatga

SEQ ID NO: 918222 - DNA, 17 bp, Homo sapiens
aggtgggggcctcctca

SEQ ID NO: 918223 - DNA, 18 bp, Homo sapiens
aggtgggggcggggagta

SEQ ID NO: 918224 - DNA, 21 bp, Homo sapiens
aggtggggtacatttctctga

SEQ ID NO: 918225 - DNA, 22 bp, Homo sapiens
aggtggggtatttaccacagca

SEQ ID NO: 918226 - DNA, 23 bp, Homo sapiens
aggtggggtatttaccacagcag

SEQ ID NO: 918227 - DNA, 16 bp, Homo sapiens
aggtgggtgggcctga

SEQ ID NO: 918228 - DNA, 21 bp, Homo sapiens
aggtgggttttcttcccatca

SEQ ID NO: 918229 - DNA, 20 bp, Homo sapiens
aggtggtatgtaatttatgc

SEQ ID NO: 918230 - DNA, 19 bp, Homo sapiens
aggtggtcctgagacctga

SEQ ID NO: 918231 - DNA, 18 bp, Homo sapiens
aggtggtctgaatgttct

SEQ ID NO: 918232 - DNA, 19 bp, Homo sapiens
aggtggtctgaatgttctg

SEQ ID NO: 918233 - DNA, 23 bp, Homo sapiens
aggtggtctgaatgttctgacat

SEQ ID NO: 918234 - DNA, 18 bp, Homo sapiens
aggtggtggaggggcgcc

SEQ ID NO: 918235 - DNA, 21 bp, Homo sapiens
aggtggtggcacgggccctcc

SEQ ID NO: 918236 - DNA, 23 bp, Homo sapiens
aggtggtgggacactgggcagca

SEQ ID NO: 918237 - DNA, 19 bp, Homo sapiens
aggtggtggggctgccgga

SEQ ID NO: 918238 - DNA, 23 bp, Homo sapiens
aggtgtatgccacacctggcctt

SEQ ID NO: 918239 - DNA, 20 bp, Homo sapiens
aggtgtcaccctgcagagct

SEQ ID NO: 918240 - DNA, 21 bp, Homo sapiens
aggtgtcaccctgcagagcta

SEQ ID NO: 918241 - DNA, 22 bp, Homo sapiens
aggtgtcaggcccgtcggagct

SEQ ID NO: 918242 - DNA, 14 bp, Homo sapiens
aggtgtcatgcttt

SEQ ID NO: 918243 - DNA, 20 bp, Homo sapiens
aggtgtccagggtcctctag

SEQ ID NO: 918244 - DNA, 11 bp, Homo sapiens
aggtgtcccca

SEQ ID NO: 918245 - DNA, 12 bp, Homo sapiens
aggtgtccccaa

SEQ ID NO: 918246 - DNA, 15 bp, Homo sapiens
aggtgtccttttcct

SEQ ID NO: 918247 - DNA, 18 bp, Homo sapiens
aggtgtcgggacatggtt

SEQ ID NO: 918248 - DNA, 17 bp, Homo sapiens
aggtgtctgcacccagg

SEQ ID NO: 918249 - DNA, 21 bp, Homo sapiens
aggtgtctgcacccaggggtg

SEQ ID NO: 918250 - DNA, 16 bp, Homo sapiens
aggtgtctgcctagat

SEQ ID NO: 918251 - DNA, 22 bp, Homo sapiens
aggtgtctgccttcacaaatgt

SEQ ID NO: 918252 - DNA, 20 bp, Homo sapiens
aggtgtgactgaatttcttt

SEQ ID NO: 918253 - DNA, 14 bp, Homo sapiens
aggtgtgagactgg

SEQ ID NO: 918254 - DNA, 13 bp, Homo sapiens
aggtgtgaggagg

SEQ ID NO: 918255 - DNA, 18 bp, Homo sapiens
aggtgtgcacagaaaacc

SEQ ID NO: 918256 - DNA, 20 bp, Homo sapiens
aggtgtggagccgaggccta

SEQ ID NO: 918257 - DNA, 14 bp, Homo sapiens
aggtgtgggggctg

SEQ ID NO: 918258 - DNA, 19 bp, Homo sapiens
aggtgtgtccttgaactga

SEQ ID NO: 918259 - DNA, 16 bp, Homo sapiens
aggtgtgtgagactac

SEQ ID NO: 918260 - DNA, 16 bp, Homo sapiens
aggtgtgtgtgaactg

SEQ ID NO: 918261 - DNA, 15 bp, Homo sapiens
aggtgttactgtaat

SEQ ID NO: 918262 - DNA, 16 bp, Homo sapiens
aggtgttactgtaatt

SEQ ID NO: 918263 - DNA, 12 bp, Homo sapiens
aggtgttatttg

SEQ ID NO: 918264 - DNA, 22 bp, Homo sapiens
aggtgttcaagaccagcctgac

SEQ ID NO: 918265 - DNA, 20 bp, Homo sapiens
aggtgttgccatttctctgc

SEQ ID NO: 918266 - DNA, 17 bp, Homo sapiens
aggtgttggctgcacgt

SEQ ID NO: 918267 - DNA, 20 bp, Homo sapiens
catcctcctcagcccccagg

SEQ ID NO: 918268 - DNA, 21 bp, Homo sapiens
catcctcctcagcccccaggc

SEQ ID NO: 918269 - DNA, 16 bp, Homo sapiens
catcctcctcccaccc

SEQ ID NO: 918270 - DNA, 22 bp, Homo sapiens
catcctcctgcccagctcctca

SEQ ID NO: 918271 - DNA, 23 bp, Homo sapiens
catcctcctgcccagctcctcac

SEQ ID NO: 918272 - DNA, 23 bp, Homo sapiens
catcctcctggaaccttgctgtc

SEQ ID NO: 918273 - DNA, 16 bp, Homo sapiens
catcctcctggtgccc

SEQ ID NO: 918274 - DNA, 20 bp, Homo sapiens
catcctctgcctcccgggtt

SEQ ID NO: 918275 - DNA, 14 bp, Homo sapiens
catcctcttctgct

SEQ ID NO: 918276 - DNA, 18 bp, Homo sapiens
catcctgaccaagactga

SEQ ID NO: 918277 - DNA, 20 bp, Homo sapiens
catcctgaccaagactgagc

SEQ ID NO: 918278 - DNA, 14 bp, Homo sapiens
catcctgagccccg

SEQ ID NO: 918279 - DNA, 18 bp, Homo sapiens
catcctgaggccagtggc

SEQ ID NO: 918280 - DNA, 20 bp, Homo sapiens
catcctgaggccagtggccc

SEQ ID NO: 918281 - DNA, 21 bp, Homo sapiens
catcctgaggccagtggcccc

SEQ ID NO: 918282 - DNA, 18 bp, Homo sapiens
catcctgcaaaggccctt

SEQ ID NO: 918283 - DNA, 22 bp, Homo sapiens
catcctgcaaggtgaaacgact

SEQ ID NO: 918284 - DNA, 21 bp, Homo sapiens
catcctgcagggcttctcctc

SEQ ID NO: 918285 - DNA, 14 bp, Homo sapiens
catcctgccctgca

SEQ ID NO: 918286 - DNA, 12 bp, Homo sapiens
catcctgctctt

SEQ ID NO: 918287 - DNA, 14 bp, Homo sapiens
catcctgcttctct

SEQ ID NO: 918288 - DNA, 17 bp, Homo sapiens
catcctggcccctccag

SEQ ID NO: 918289 - DNA, 23 bp, Homo sapiens
catcctggcccctccagaccctg

SEQ ID NO: 918290 - DNA, 12 bp, Homo sapiens
catcctggcctc

SEQ ID NO: 918291 - DNA, 17 bp, Homo sapiens
catcctggcctcctttt

SEQ ID NO: 918292 - DNA, 14 bp, Homo sapiens
catcctggcctggc

SEQ ID NO: 918293 - DNA, 18 bp, Homo sapiens
catcctggcctggcacat

SEQ ID NO: 918294 - DNA, 12 bp, Homo sapiens
catcctggctgc

SEQ ID NO: 918295 - DNA, 15 bp, Homo sapiens
catcctggctgcggc

SEQ ID NO: 918296 - DNA, 18 bp, Homo sapiens
catcctggggcagcactc

SEQ ID NO: 918297 - DNA, 19 bp, Homo sapiens
catcctggggcagcactcc

SEQ ID NO: 918298 - DNA, 19 bp, Homo sapiens
catcctgtataagcactga

SEQ ID NO: 918299 - DNA, 10 bp, Homo sapiens
catcctgtgt

SEQ ID NO: 918300 - DNA, 17 bp, Homo sapiens
catcctgtgtcccctga

SEQ ID NO: 918301 - DNA, 22 bp, Homo sapiens
catcctgtgtcccctgacctgt

SEQ ID NO: 918302 - DNA, 21 bp, Homo sapiens
catcctgtgtttctagggaaa

SEQ ID NO: 918303 - DNA, 14 bp, Homo sapiens
catcctgtttgaaa

SEQ ID NO: 918304 - DNA, 17 bp, Homo sapiens
catcctgtttgtatgaa

SEQ ID NO: 918305 - DNA, 13 bp, Homo sapiens
catccttcccttt

SEQ ID NO: 918306 - DNA, 14 bp, Homo sapiens
catccttccttccc

SEQ ID NO: 918307 - DNA, 16 bp, Homo sapiens
catccttccttcccac

SEQ ID NO: 918308 - DNA, 14 bp, Homo sapiens
catccttctcactg

SEQ ID NO: 918309 - DNA, 20 bp, Homo sapiens
catccttgcctgtctaaagc

SEQ ID NO: 918310 - DNA, 16 bp, Homo sapiens
catccttgctgcagct

SEQ ID NO: 918311 - DNA, 17 bp, Homo sapiens
catccttggtgctcttg

SEQ ID NO: 918312 - DNA, 20 bp, Homo sapiens
catccttggtgctcttgctt

SEQ ID NO: 918313 - DNA, 15 bp, Homo sapiens
catccttgtaatacc

SEQ ID NO: 918314 - DNA, 14 bp, Homo sapiens
catccttgtctttt

SEQ ID NO: 918315 - DNA, 16 bp, Homo sapiens
catccttgtcttttga

SEQ ID NO: 918316 - DNA, 20 bp, Homo sapiens
catccttgtcttttgagcta

SEQ ID NO: 918317 - DNA, 19 bp, Homo sapiens
catcctttacgtgtttaaa

SEQ ID NO: 918318 - DNA, 14 bp, Homo sapiens
catcctttccctct

SEQ ID NO: 918319 - DNA, 17 bp, Homo sapiens
catcctttccctctccc

SEQ ID NO: 918320 - DNA, 19 bp, Homo sapiens
catccttttctgcagaggg

SEQ ID NO: 918321 - DNA, 13 bp, Homo sapiens
catcgaatgtgta

SEQ ID NO: 918322 - DNA, 19 bp, Homo sapiens
catcgcaccattctgactc

SEQ ID NO: 918323 - DNA, 15 bp, Homo sapiens
catcgcagcttcctg

SEQ ID NO: 918324 - DNA, 12 bp, Homo sapiens
catcgcaggagt

SEQ ID NO: 918325 - DNA, 17 bp, Homo sapiens
catcgcaggagtctctg

SEQ ID NO: 918326 - DNA, 22 bp, Homo sapiens
catcgcaggagtctctgccacc

SEQ ID NO: 918327 - DNA, 20 bp, Homo sapiens
catcgccatcttcttccctt

SEQ ID NO: 918328 - DNA, 14 bp, Homo sapiens
catcggaaaaataa

SEQ ID NO: 918329 - DNA, 16 bp, Homo sapiens
catcggacaggaggat

SEQ ID NO: 918330 - DNA, 21 bp, Homo sapiens
catcggaggctgggcccctgg

SEQ ID NO: 918331 - DNA, 22 bp, Homo sapiens
catcggagggagtcccagagcc

SEQ ID NO: 918332 - DNA, 14 bp, Homo sapiens
catcggccctgtcc

SEQ ID NO: 918333 - DNA, 13 bp, Homo sapiens
catcgggaaagaa

SEQ ID NO: 918334 - DNA, 17 bp, Homo sapiens
catcggtgtccatttat

SEQ ID NO: 918335 - DNA, 19 bp, Homo sapiens
catcgtctcatcctccttt

SEQ ID NO: 918336 - DNA, 20 bp, Homo sapiens
catcgtgacccttcagggcc

SEQ ID NO: 918337 - DNA, 21 bp, Homo sapiens
catcgtgacccttcagggcca

SEQ ID NO: 918338 - DNA, 22 bp, Homo sapiens
catcgtggtgggggaggagcct

SEQ ID NO: 918339 - DNA, 16 bp, Homo sapiens
catcgttccccacccc

SEQ ID NO: 918340 - DNA, 23 bp, Homo sapiens
catctaaaaatagacttaaatct

SEQ ID NO: 918341 - DNA, 21 bp, Homo sapiens
catctaaactggagtgatgtt

SEQ ID NO: 918342 - DNA, 18 bp, Homo sapiens
catctaacctcatcttct

SEQ ID NO: 918343 - DNA, 19 bp, Homo sapiens
catctaacctcatcttctt

SEQ ID NO: 918344 - DNA, 23 bp, Homo sapiens
catctaagaccacgaaaaaaggc

SEQ ID NO: 918345 - DNA, 12 bp, Homo sapiens
catctaagcctg

SEQ ID NO: 918346 - DNA, 23 bp, Homo sapiens
catctaatagcgggttactttca

SEQ ID NO: 918347 - DNA, 17 bp, Homo sapiens
catctaatgaaaaacaa

SEQ ID NO: 918348 - DNA, 20 bp, Homo sapiens
catctaatgaaaaacaaaaa

SEQ ID NO: 918349 - DNA, 14 bp, Homo sapiens
catctaatgtatta

SEQ ID NO: 918350 - DNA, 21 bp, Homo sapiens
catctaatgtattatgagcca

SEQ ID NO: 918351 - DNA, 14 bp, Homo sapiens
catctactcccaag

SEQ ID NO: 918352 - DNA, 19 bp, Homo sapiens
catctactcccaagtatgg

SEQ ID NO: 918353 - DNA, 20 bp, Homo sapiens
catctactctaaagaaaaat

SEQ ID NO: 918354 - DNA, 18 bp, Homo sapiens
catctactgaatgacctc

SEQ ID NO: 918355 - DNA, 18 bp, Homo sapiens
catctagcaaatgttatg

SEQ ID NO: 918356 - DNA, 15 bp, Homo sapiens
catctagcagctggc

SEQ ID NO: 918357 - DNA, 19 bp, Homo sapiens
catctagcagtaaatactt

SEQ ID NO: 918358 - DNA, 17 bp, Homo sapiens
catctagcctaaagtat

SEQ ID NO: 918359 - DNA, 15 bp, Homo sapiens
catctatttctgaga

SEQ ID NO: 918360 - DNA, 16 bp, Homo sapiens
catctatttctgagaa

SEQ ID NO: 918361 - DNA, 14 bp, Homo sapiens
catctcagaccttt

SEQ ID NO: 918362 - DNA, 15 bp, Homo sapiens
catctcagattctgt

SEQ ID NO: 918363 - DNA, 13 bp, Homo sapiens
catctcagcccac

SEQ ID NO: 918364 - DNA, 20 bp, Homo sapiens
catctcagcctaccatgaga

SEQ ID NO: 918365 - DNA, 18 bp, Homo sapiens
catctcagcctcctgagc

SEQ ID NO: 918366 - DNA, 20 bp, Homo sapiens
catctcaggacacttccgta

SEQ ID NO: 918367 - DNA, 13 bp, Homo sapiens
catctcaggagat

SEQ ID NO: 918368 - DNA, 17 bp, Homo sapiens
catctcaggccacctgc

SEQ ID NO: 918369 - DNA, 21 bp, Homo sapiens
catctcaggccacctgccccc

SEQ ID NO: 918370 - DNA, 15 bp, Homo sapiens
catctcaggggccag

SEQ ID NO: 918371 - DNA, 17 bp, Homo sapiens
catctcaggtgccactc

SEQ ID NO: 918372 - DNA, 22 bp, Homo sapiens
catctcaggtgccactccctga

SEQ ID NO: 918373 - DNA, 22 bp, Homo sapiens
catctcagtgaagaatacttct

SEQ ID NO: 918374 - DNA, 12 bp, Homo sapiens
catctcatcatg

SEQ ID NO: 918375 - DNA, 21 bp, Homo sapiens
catctcatcatgtctattgtc

SEQ ID NO: 918376 - DNA, 14 bp, Homo sapiens
catctcatcctggc

SEQ ID NO: 918377 - DNA, 16 bp, Homo sapiens
catctcatcctggcac

SEQ ID NO: 918378 - DNA, 21 bp, Homo sapiens
catctcatcctggcacgccct

SEQ ID NO: 918379 - DNA, 22 bp, Homo sapiens
catctcattcaaaccccaccct

SEQ ID NO: 918380 - DNA, 19 bp, Homo sapiens
catctcatttaagggaaaa

SEQ ID NO: 918381 - DNA, 21 bp, Homo sapiens
catctcatttaagggaaaaat

SEQ ID NO: 918382 - DNA, 19 bp, Homo sapiens
catctccagaaaaatgaaa

SEQ ID NO: 918383 - DNA, 14 bp, Homo sapiens
catctccagggaag

SEQ ID NO: 918384 - DNA, 15 bp, Homo sapiens
catctccagggaagc

SEQ ID NO: 918385 - DNA, 16 bp, Homo sapiens
catctccagggagcaa

SEQ ID NO: 918386 - DNA, 20 bp, Homo sapiens
catctccagggagcaagaca

SEQ ID NO: 918387 - DNA, 20 bp, Homo sapiens
catctccagggagtcccctc

SEQ ID NO: 918388 - DNA, 21 bp, Homo sapiens
catctccatgtagaataaatg

SEQ ID NO: 918389 - DNA, 14 bp, Homo sapiens
catctccccaggcc

SEQ ID NO: 918390 - DNA, 17 bp, Homo sapiens
catctccccaggcctcc

SEQ ID NO: 918391 - DNA, 17 bp, Homo sapiens
aggtgttgtcagcaggc

SEQ ID NO: 918392 - DNA, 18 bp, Homo sapiens
aggtgtttccatttctca

SEQ ID NO: 918393 - DNA, 16 bp, Homo sapiens
aggttaaaaagaaaag

SEQ ID NO: 918394 - DNA, 19 bp, Homo sapiens
aggttaaacggtgcccatc

SEQ ID NO: 918395 - DNA, 17 bp, Homo sapiens
aggttaaagaagctgca

SEQ ID NO: 918396 - DNA, 19 bp, Homo sapiens
aggttaaagctaaactgaa

SEQ ID NO: 918397 - DNA, 16 bp, Homo sapiens
aggttaaggtgggtcc

SEQ ID NO: 918398 - DNA, 21 bp, Homo sapiens
aggttacaagcctgcacaata

SEQ ID NO: 918399 - DNA, 16 bp, Homo sapiens
aggttacgaagacaaa

SEQ ID NO: 918400 - DNA, 18 bp, Homo sapiens
aggttactcagcagcaga

SEQ ID NO: 918401 - DNA, 22 bp, Homo sapiens
aggttagaaaggcagccctcac

SEQ ID NO: 918402 - DNA, 19 bp, Homo sapiens
aggttataattttttttaa

SEQ ID NO: 918403 - DNA, 20 bp, Homo sapiens
aggttataattttttttaaa

SEQ ID NO: 918404 - DNA, 12 bp, Homo sapiens
aggttatacaat

SEQ ID NO: 918405 - DNA, 20 bp, Homo sapiens
aggttatacaataacccagt

SEQ ID NO: 918406 - DNA, 22 bp, Homo sapiens
aggttatacaataacccagtta

SEQ ID NO: 918407 - DNA, 17 bp, Homo sapiens
aggttataggtcactcc

SEQ ID NO: 918408 - DNA, 16 bp, Homo sapiens
aggttatatgaatata

SEQ ID NO: 918409 - DNA, 15 bp, Homo sapiens
aggttatcagtgctt

SEQ ID NO: 918410 - DNA, 17 bp, Homo sapiens
aggttatctgcctggcc

SEQ ID NO: 918411 - DNA, 18 bp, Homo sapiens
aggttatctgcctggcct

SEQ ID NO: 918412 - DNA, 19 bp, Homo sapiens
aggttatctgcctggcctg

SEQ ID NO: 918413 - DNA, 23 bp, Homo sapiens
aggttatctttttaaaaactctt

SEQ ID NO: 918414 - DNA, 19 bp, Homo sapiens
aggttatgaaacatatcat

SEQ ID NO: 918415 - DNA, 18 bp, Homo sapiens
aggttatggtttaatgtt

SEQ ID NO: 918416 - DNA, 16 bp, Homo sapiens
aggttattgcaataaa

SEQ ID NO: 918417 - DNA, 21 bp, Homo sapiens
aggttattgcaataaagtata

SEQ ID NO: 918418 - DNA, 15 bp, Homo sapiens
aggttattttgcttt

SEQ ID NO: 918419 - DNA, 14 bp, Homo sapiens
aggttcaaagatat

SEQ ID NO: 918420 - DNA, 16 bp, Homo sapiens
aggttcactaaagcag

SEQ ID NO: 918421 - DNA, 12 bp, Homo sapiens
aggttcatggat

SEQ ID NO: 918422 - DNA, 18 bp, Homo sapiens
aggttccaactgtatata

SEQ ID NO: 918423 - DNA, 16 bp, Homo sapiens
aggttccatcctttac

SEQ ID NO: 918424 - DNA, 20 bp, Homo sapiens
aggttcccaaggacatgagt

SEQ ID NO: 918425 - DNA, 17 bp, Homo sapiens
aggttccccagagagca

SEQ ID NO: 918426 - DNA, 22 bp, Homo sapiens
aggttccccagagagcaggcag

SEQ ID NO: 918427 - DNA, 17 bp, Homo sapiens
aggttcccccagcaagc

SEQ ID NO: 918428 - DNA, 14 bp, Homo sapiens
aggttccctcccag

SEQ ID NO: 918429 - DNA, 17 bp, Homo sapiens
aggttcctctgcctgcc

SEQ ID NO: 918430 - DNA, 19 bp, Homo sapiens
aggttcctctgcctgcccc

SEQ ID NO: 918431 - DNA, 14 bp, Homo sapiens
aggttcctggggcc

SEQ ID NO: 918432 - DNA, 18 bp, Homo sapiens
aggttcctggggccgcct

SEQ ID NO: 918433 - DNA, 21 bp, Homo sapiens
aggttcgagacccaaaccccc

SEQ ID NO: 918434 - DNA, 15 bp, Homo sapiens
aggttctcagagcca

SEQ ID NO: 918435 - DNA, 23 bp, Homo sapiens
aggttctcattaggttttgcttg

SEQ ID NO: 918436 - DNA, 22 bp, Homo sapiens
aggttctccaacatcacagccc

SEQ ID NO: 918437 - DNA, 20 bp, Homo sapiens
aggttctccgttagctcctg

SEQ ID NO: 918438 - DNA, 16 bp, Homo sapiens
aggttctgggttttct

SEQ ID NO: 918439 - DNA, 18 bp, Homo sapiens
aggttctgggttttctga

SEQ ID NO: 918440 - DNA, 16 bp, Homo sapiens
aggttctggttccatt

SEQ ID NO: 918441 - DNA, 19 bp, Homo sapiens
aggttctgtattttaagaa

SEQ ID NO: 918442 - DNA, 22 bp, Homo sapiens
aggttctgtttatggccacatt

SEQ ID NO: 918443 - DNA, 23 bp, Homo sapiens
aggttcttcccttttacatactg

SEQ ID NO: 918444 - DNA, 19 bp, Homo sapiens
aggttcttcttcctgaagc

SEQ ID NO: 918445 - DNA, 19 bp, Homo sapiens
aggttcttcttgttctgag

SEQ ID NO: 918446 - DNA, 18 bp, Homo sapiens
aggttcttgatgtcatgt

SEQ ID NO: 918447 - DNA, 19 bp, Homo sapiens
aggttcttttccattgtca

SEQ ID NO: 918448 - DNA, 13 bp, Homo sapiens
aggttgaaaaaca

SEQ ID NO: 918449 - DNA, 13 bp, Homo sapiens
aggttgaagccaa

SEQ ID NO: 918450 - DNA, 20 bp, Homo sapiens
aggttgaagctaaaaggaaa

SEQ ID NO: 918451 - DNA, 17 bp, Homo sapiens
aggttgagctcttctta

SEQ ID NO: 918452 - DNA, 24 bp, Homo sapiens
aggttgagctcttcttaaagtatt

SEQ ID NO: 918453 - DNA, 12 bp, Homo sapiens
aggttgcaggga

SEQ ID NO: 918454 - DNA, 17 bp, Homo sapiens
aggttgcagtgagctga

SEQ ID NO: 918455 - DNA, 19 bp, Homo sapiens
aggttgctgtacaggaaaa

SEQ ID NO: 918456 - DNA, 16 bp, Homo sapiens
aggttggaatctttta

SEQ ID NO: 918457 - DNA, 17 bp, Homo sapiens
aggttggaatcttttat

SEQ ID NO: 918458 - DNA, 16 bp, Homo sapiens
aggttggcgggggcac

SEQ ID NO: 918459 - DNA, 16 bp, Homo sapiens
aggttgggaggctgtg

SEQ ID NO: 918460 - DNA, 23 bp, Homo sapiens
aggttggggagacttggggccag

SEQ ID NO: 918461 - DNA, 14 bp, Homo sapiens
aggttggtgaattt

SEQ ID NO: 918462 - DNA, 13 bp, Homo sapiens
aggttggtgactg

SEQ ID NO: 918463 - DNA, 14 bp, Homo sapiens
aggttggtgggggc

SEQ ID NO: 918464 - DNA, 21 bp, Homo sapiens
aggttggtgtggagttggggc

SEQ ID NO: 918465 - DNA, 14 bp, Homo sapiens
aggttgtctccagg

SEQ ID NO: 918466 - DNA, 21 bp, Homo sapiens
aggttgtgaaataatttttaa

SEQ ID NO: 918467 - DNA, 14 bp, Homo sapiens
aggttgtgcagggt

SEQ ID NO: 918468 - DNA, 23 bp, Homo sapiens
aggttgtgcagggtgtgtactgc

SEQ ID NO: 918469 - DNA, 15 bp, Homo sapiens
aggttgtggggaggc

SEQ ID NO: 918470 - DNA, 16 bp, Homo sapiens
aggttgtggggaggct

SEQ ID NO: 918471 - DNA, 18 bp, Homo sapiens
aggttgtggggaggctgc

SEQ ID NO: 918472 - DNA, 20 bp, Homo sapiens
aggttgtggggaggctgcac

SEQ ID NO: 918473 - DNA, 24 bp, Homo sapiens
aggttgtggggaggctgcactgga

SEQ ID NO: 918474 - DNA, 13 bp, Homo sapiens
aggtttaaagttt

SEQ ID NO: 918475 - DNA, 16 bp, Homo sapiens
aggtttaacatttgcc

SEQ ID NO: 918476 - DNA, 14 bp, Homo sapiens
aggtttaagctgtt

SEQ ID NO: 918477 - DNA, 20 bp, Homo sapiens
aggtttaagtagatttcatg

SEQ ID NO: 918478 - DNA, 22 bp, Homo sapiens
aggtttacaatttacaaagtgt

SEQ ID NO: 918479 - DNA, 20 bp, Homo sapiens
aggtttaggctggtggccca

SEQ ID NO: 918480 - DNA, 21 bp, Homo sapiens
aggtttaggctggtggcccag

SEQ ID NO: 918481 - DNA, 16 bp, Homo sapiens
aggtttataaagcaga

SEQ ID NO: 918482 - DNA, 14 bp, Homo sapiens
aggtttatctgaag

SEQ ID NO: 918483 - DNA, 14 bp, Homo sapiens
aggtttatgaaaaa

SEQ ID NO: 918484 - DNA, 22 bp, Homo sapiens
aggtttatttatctgagcaata

SEQ ID NO: 918485 - DNA, 19 bp, Homo sapiens
aggtttcactattcctatg

SEQ ID NO: 918486 - DNA, 18 bp, Homo sapiens
aggtttcctgctccagtg

SEQ ID NO: 918487 - DNA, 23 bp, Homo sapiens
aggtttccttttggaacatttct

SEQ ID NO: 918488 - DNA, 15 bp, Homo sapiens
aggtttcgtggcagc

SEQ ID NO: 918489 - DNA, 18 bp, Homo sapiens
aggtttctccttgaagca

SEQ ID NO: 918490 - DNA, 12 bp, Homo sapiens
aggtttcttgaa

SEQ ID NO: 918491 - DNA, 19 bp, Homo sapiens
aggtttctttttttttcct

SEQ ID NO: 918492 - DNA, 13 bp, Homo sapiens
aggtttgaaaagc

SEQ ID NO: 918493 - DNA, 22 bp, Homo sapiens
aggtttgaagacacagcctccc

SEQ ID NO: 918494 - DNA, 19 bp, Homo sapiens
aggtttgcggatgagggca

SEQ ID NO: 918495 - DNA, 14 bp, Homo sapiens
aggtttggaaggag

SEQ ID NO: 918496 - DNA, 22 bp, Homo sapiens
aggtttggaaggagcagaaaac

SEQ ID NO: 918497 - DNA, 21 bp, Homo sapiens
aggtttggggagggggaagag

SEQ ID NO: 918498 - DNA, 22 bp, Homo sapiens
aggtttggggagggggaagaga

SEQ ID NO: 918499 - DNA, 16 bp, Homo sapiens
aggtttggtgtgtgga

SEQ ID NO: 918500 - DNA, 20 bp, Homo sapiens
aggtttgtatattgtcagat

SEQ ID NO: 918501 - DNA, 17 bp, Homo sapiens
aggtttgtcctggtcat

SEQ ID NO: 918502 - DNA, 10 bp, Homo sapiens
aggtttgtga

SEQ ID NO: 918503 - DNA, 15 bp, Homo sapiens
aggtttgtgttttct

SEQ ID NO: 918504 - DNA, 17 bp, Homo sapiens
aggttttaaagtgatta

SEQ ID NO: 918505 - DNA, 17 bp, Homo sapiens
aggttttataaggctga

SEQ ID NO: 918506 - DNA, 22 bp, Homo sapiens
aggttttcaaccggaaggaggc

SEQ ID NO: 918507 - DNA, 17 bp, Homo sapiens
aggttttgaataaaaag

SEQ ID NO: 918508 - DNA, 21 bp, Homo sapiens
aggttttgaataaaaagtgaa

SEQ ID NO: 918509 - DNA, 23 bp, Homo sapiens
aggttttgaataaaaagtgaact

SEQ ID NO: 918510 - DNA, 21 bp, Homo sapiens
aggttttggttatggagtctt

SEQ ID NO: 918511 - DNA, 13 bp, Homo sapiens
aggttttgtattt

SEQ ID NO: 918512 - DNA, 22 bp, Homo sapiens
aggttttgtattttttaaaaca

SEQ ID NO: 918513 - DNA, 14 bp, Homo sapiens
aggttttgttgcta

SEQ ID NO: 918514 - DNA, 12 bp, Homo sapiens
aggttttgttgt

SEQ ID NO: 918515 - DNA, 20 bp, Homo sapiens
catctccccaggcctccagc

SEQ ID NO: 918516 - DNA, 21 bp, Homo sapiens
catctccccaggcctccagcc

SEQ ID NO: 918517 - DNA, 20 bp, Homo sapiens
catctcccccatagcaccct

SEQ ID NO: 918518 - DNA, 21 bp, Homo sapiens
catctcccccatagcaccctg

SEQ ID NO: 918519 - DNA, 17 bp, Homo sapiens
catctcccctcctggcg

SEQ ID NO: 918520 - DNA, 11 bp, Homo sapiens
catctccctgc

SEQ ID NO: 918521 - DNA, 19 bp, Homo sapiens
catctccctgccatccccc

SEQ ID NO: 918522 - DNA, 20 bp, Homo sapiens
catctccctgccatccccct

SEQ ID NO: 918523 - DNA, 23 bp, Homo sapiens
catctccctgccatccccctctc

SEQ ID NO: 918524 - DNA, 22 bp, Homo sapiens
catctcccttcattagctgctc

SEQ ID NO: 918525 - DNA, 18 bp, Homo sapiens
catctcctataatctgtc

SEQ ID NO: 918526 - DNA, 22 bp, Homo sapiens
catctcctgaccctcccactcc

SEQ ID NO: 918527 - DNA, 14 bp, Homo sapiens
catctcctgatttc

SEQ ID NO: 918528 - DNA, 15 bp, Homo sapiens
catctcctgatttct

SEQ ID NO: 918529 - DNA, 13 bp, Homo sapiens
catctcctgtgca

SEQ ID NO: 918530 - DNA, 20 bp, Homo sapiens
catctcctgtgcatgggtga

SEQ ID NO: 918531 - DNA, 18 bp, Homo sapiens
catctccttacctctgga

SEQ ID NO: 918532 - DNA, 16 bp, Homo sapiens
catctcgagccccctg

SEQ ID NO: 918533 - DNA, 15 bp, Homo sapiens
catctcggagcatcc

SEQ ID NO: 918534 - DNA, 21 bp, Homo sapiens
catctctaccatcatccggtt

SEQ ID NO: 918535 - DNA, 14 bp, Homo sapiens
catctctattaaaa

SEQ ID NO: 918536 - DNA, 17 bp, Homo sapiens
catctctcccacttcct

SEQ ID NO: 918537 - DNA, 23 bp, Homo sapiens
catctctccctcccctgccattt

SEQ ID NO: 918538 - DNA, 13 bp, Homo sapiens
catctctcctaag

SEQ ID NO: 918539 - DNA, 19 bp, Homo sapiens
catctctgaaaattctgga

SEQ ID NO: 918540 - DNA, 14 bp, Homo sapiens
catctctgactttc

SEQ ID NO: 918541 - DNA, 11 bp, Homo sapiens
catctctgagt

SEQ ID NO: 918542 - DNA, 20 bp, Homo sapiens
catctctggaaggggcagcc

SEQ ID NO: 918543 - DNA, 21 bp, Homo sapiens
catctctggaaggggcagccc

SEQ ID NO: 918544 - DNA, 13 bp, Homo sapiens
catctctgtccca

SEQ ID NO: 918545 - DNA, 19 bp, Homo sapiens
catctctgtcccattccct

SEQ ID NO: 918546 - DNA, 13 bp, Homo sapiens
catctctgtctgg

SEQ ID NO: 918547 - DNA, 16 bp, Homo sapiens
catctctgtctggggc

SEQ ID NO: 918548 - DNA, 17 bp, Homo sapiens
catctctgtctggggct

SEQ ID NO: 918549 - DNA, 13 bp, Homo sapiens
catctcttaaatt

SEQ ID NO: 918550 - DNA, 14 bp, Homo sapiens
catctcttaaattt

SEQ ID NO: 918551 - DNA, 15 bp, Homo sapiens
catctcttccccaga

SEQ ID NO: 918552 - DNA, 22 bp, Homo sapiens
catctcttctgggttccttcct

SEQ ID NO: 918553 - DNA, 15 bp, Homo sapiens
catctcttgaggcca

SEQ ID NO: 918554 - DNA, 20 bp, Homo sapiens
catctcttgaggccaggagt

SEQ ID NO: 918555 - DNA, 19 bp, Homo sapiens
catctgaaacccacagatg

SEQ ID NO: 918556 - DNA, 12 bp, Homo sapiens
catctgaaagcc

SEQ ID NO: 918557 - DNA, 16 bp, Homo sapiens
catctgacacaaaaaa

SEQ ID NO: 918558 - DNA, 15 bp, Homo sapiens
catctgaccacgtgc

SEQ ID NO: 918559 - DNA, 14 bp, Homo sapiens
catctgaccagcag

SEQ ID NO: 918560 - DNA, 15 bp, Homo sapiens
catctgaccagcagc

SEQ ID NO: 918561 - DNA, 21 bp, Homo sapiens
catctgaccccggggggctgg

SEQ ID NO: 918562 - DNA, 24 bp, Homo sapiens
catctgaccgttttcacttgtctc

SEQ ID NO: 918563 - DNA, 13 bp, Homo sapiens
catctgaccttca

SEQ ID NO: 918564 - DNA, 18 bp, Homo sapiens
catctgagaggctctccg

SEQ ID NO: 918565 - DNA, 18 bp, Homo sapiens
catctgagcaagagctgg

SEQ ID NO: 918566 - DNA, 11 bp, Homo sapiens
catctgaggag

SEQ ID NO: 918567 - DNA, 15 bp, Homo sapiens
catctgaggttttat

SEQ ID NO: 918568 - DNA, 21 bp, Homo sapiens
catctgaggttttatttcatt

SEQ ID NO: 918569 - DNA, 16 bp, Homo sapiens
catctgagtccagctc

SEQ ID NO: 918570 - DNA, 21 bp, Homo sapiens
catctgagtcctggatgatac

SEQ ID NO: 918571 - DNA, 20 bp, Homo sapiens
catctgatcacttcatgttt

SEQ ID NO: 918572 - DNA, 18 bp, Homo sapiens
catctgatgccgtgatcc

SEQ ID NO: 918573 - DNA, 13 bp, Homo sapiens
catctgattaaaa

SEQ ID NO: 918574 - DNA, 22 bp, Homo sapiens
catctgcaaaaggcctcttgta

SEQ ID NO: 918575 - DNA, 17 bp, Homo sapiens
catctgcaatatgaatt

SEQ ID NO: 918576 - DNA, 17 bp, Homo sapiens
catctgcacccctgagt

SEQ ID NO: 918577 - DNA, 16 bp, Homo sapiens
catctgcaccccttct

SEQ ID NO: 918578 - DNA, 19 bp, Homo sapiens
catctgcaccccttctctc

SEQ ID NO: 918579 - DNA, 23 bp, Homo sapiens
catctgcaccccttctctcctcc

SEQ ID NO: 918580 - DNA, 23 bp, Homo sapiens
catctgcaccctcgatgaagccc

SEQ ID NO: 918581 - DNA, 16 bp, Homo sapiens
catctgcacccttctt

SEQ ID NO: 918582 - DNA, 21 bp, Homo sapiens
catctgcacccttcttttctc

SEQ ID NO: 918583 - DNA, 13 bp, Homo sapiens
catctgcaggcac

SEQ ID NO: 918584 - DNA, 13 bp, Homo sapiens
catctgcatgtct

SEQ ID NO: 918585 - DNA, 15 bp, Homo sapiens
catctgcattcctga

SEQ ID NO: 918586 - DNA, 19 bp, Homo sapiens
catctgcattttcacccca

SEQ ID NO: 918587 - DNA, 20 bp, Homo sapiens
catctgcattttcaccccac

SEQ ID NO: 918588 - DNA, 13 bp, Homo sapiens
catctgccagacc

SEQ ID NO: 918589 - DNA, 14 bp, Homo sapiens
catctgccagacct

SEQ ID NO: 918590 - DNA, 16 bp, Homo sapiens
catctgcccaggggtg

SEQ ID NO: 918591 - DNA, 14 bp, Homo sapiens
catctgcccctccc

SEQ ID NO: 918592 - DNA, 16 bp, Homo sapiens
catctgcccctccccc

SEQ ID NO: 918593 - DNA, 15 bp, Homo sapiens
catctgcctcctctc

SEQ ID NO: 918594 - DNA, 15 bp, Homo sapiens
catctgcctgtaatt

SEQ ID NO: 918595 - DNA, 18 bp, Homo sapiens
catctgccttaaaaccaa

SEQ ID NO: 918596 - DNA, 19 bp, Homo sapiens
catctgcgtgacaataaaa

SEQ ID NO: 918597 - DNA, 22 bp, Homo sapiens
catctgcgtgacaataaaacat

SEQ ID NO: 918598 - DNA, 14 bp, Homo sapiens
catctgctctaggg

SEQ ID NO: 918599 - DNA, 22 bp, Homo sapiens
catctgctctagggaatctgga

SEQ ID NO: 918600 - DNA, 14 bp, Homo sapiens
catctgctggtccg

SEQ ID NO: 918601 - DNA, 11 bp, Homo sapiens
catctgctgtg

SEQ ID NO: 918602 - DNA, 12 bp, Homo sapiens
catctgctgtgt

SEQ ID NO: 918603 - DNA, 17 bp, Homo sapiens
catctgctgttatcacc

SEQ ID NO: 918604 - DNA, 22 bp, Homo sapiens
catctgcttggttggctggcag

SEQ ID NO: 918605 - DNA, 16 bp, Homo sapiens
catctgcttttattaa

SEQ ID NO: 918606 - DNA, 12 bp, Homo sapiens
catctggccctg

SEQ ID NO: 918607 - DNA, 13 bp, Homo sapiens
catctggccctga

SEQ ID NO: 918608 - DNA, 18 bp, Homo sapiens
catctggctgcacaggct

SEQ ID NO: 918609 - DNA, 19 bp, Homo sapiens
catctggctgcacaggctg

SEQ ID NO: 918610 - DNA, 16 bp, Homo sapiens
catctggctgtctaga

SEQ ID NO: 918611 - DNA, 17 bp, Homo sapiens
catctggctgtctagaa

SEQ ID NO: 918612 - DNA, 22 bp, Homo sapiens
catctggctgtctagaatgtgg

SEQ ID NO: 918613 - DNA, 14 bp, Homo sapiens
catctgggaaagac

SEQ ID NO: 918614 - DNA, 17 bp, Homo sapiens
catctgggacaaaactg

SEQ ID NO: 918615 - DNA, 17 bp, Homo sapiens
catctgggatcatgata

SEQ ID NO: 918616 - DNA, 18 bp, Homo sapiens
catctgggatcatgatag

SEQ ID NO: 918617 - DNA, 15 bp, Homo sapiens
catctgggattccca

SEQ ID NO: 918618 - DNA, 16 bp, Homo sapiens
catctgggctcctcca

SEQ ID NO: 918619 - DNA, 20 bp, Homo sapiens
catctgggtctcccaggaca

SEQ ID NO: 918620 - DNA, 14 bp, Homo sapiens
catctgggtgccct

SEQ ID NO: 918621 - DNA, 16 bp, Homo sapiens
catctgggtgccctga

SEQ ID NO: 918622 - DNA, 19 bp, Homo sapiens
catctgggtgccctgaaag

SEQ ID NO: 918623 - DNA, 15 bp, Homo sapiens
catctgggtggtctg

SEQ ID NO: 918624 - DNA, 12 bp, Homo sapiens
catctgtaaaga

SEQ ID NO: 918625 - DNA, 16 bp, Homo sapiens
catctgtaaagaaaac

SEQ ID NO: 918626 - DNA, 12 bp, Homo sapiens
catctgtaaata

SEQ ID NO: 918627 - DNA, 15 bp, Homo sapiens
catctgtaaatatcc

SEQ ID NO: 918628 - DNA, 16 bp, Homo sapiens
catctgtaagagcttg

SEQ ID NO: 918629 - DNA, 22 bp, Homo sapiens
catctgtaagagcttgctccag

SEQ ID NO: 918630 - DNA, 19 bp, Homo sapiens
catctgtataccctctgtt

SEQ ID NO: 918631 - DNA, 20 bp, Homo sapiens
catctgtataccctctgttt

SEQ ID NO: 918632 - DNA, 21 bp, Homo sapiens
catctgtccacatccccagag

SEQ ID NO: 918633 - DNA, 20 bp, Homo sapiens
catctgtccagctggggcca

SEQ ID NO: 918634 - DNA, 20 bp, Homo sapiens
catctgtccctccgggacct

SEQ ID NO: 918635 - DNA, 17 bp, Homo sapiens
catctgtcctcaccctg

SEQ ID NO: 918636 - DNA, 13 bp, Homo sapiens
catctgtctgtcc

SEQ ID NO: 918637 - DNA, 23 bp, Homo sapiens
catctgtctgtcctacccgcccg

SEQ ID NO: 918638 - DNA, 21 bp, Homo sapiens
catctgtctgtctgtgggctt

SEQ ID NO: 918639 - DNA, 23 bp, Homo sapiens
catctgtctgtctgtgggcttca

SEQ ID NO: 918640 - DNA, 22 bp, Homo sapiens
aggtttttaggagtctgagcat

SEQ ID NO: 918641 - DNA, 12 bp, Homo sapiens
aggtttttcctt

SEQ ID NO: 918642 - DNA, 20 bp, Homo sapiens
aggtttttccttatttgctt

SEQ ID NO: 918643 - DNA, 20 bp, Homo sapiens
aggtttttggaattatgtct

SEQ ID NO: 918644 - DNA, 17 bp, Homo sapiens
aggttttttttcagttg

SEQ ID NO: 918645 - DNA, 14 bp, Homo sapiens
agtaaaaaggctaa

SEQ ID NO: 918646 - DNA, 14 bp, Homo sapiens
agtaaaaattaaaa

SEQ ID NO: 918647 - DNA, 13 bp, Homo sapiens
agtaaaacacatt

SEQ ID NO: 918648 - DNA, 18 bp, Homo sapiens
agtaaaaccttgttctat

SEQ ID NO: 918649 - DNA, 19 bp, Homo sapiens
agtaaaagtggtctctgct

SEQ ID NO: 918650 - DNA, 18 bp, Homo sapiens
agtaaaattatactgtgt

SEQ ID NO: 918651 - DNA, 12 bp, Homo sapiens
agtaaaattcag

SEQ ID NO: 918652 - DNA, 18 bp, Homo sapiens
agtaaaattcagtttttt

SEQ ID NO: 918653 - DNA, 21 bp, Homo sapiens
agtaaacattaagtaaatgct

SEQ ID NO: 918654 - DNA, 16 bp, Homo sapiens
agtaaacgggaacatg

SEQ ID NO: 918655 - DNA, 21 bp, Homo sapiens
agtaaacgggaacatgccccc

SEQ ID NO: 918656 - DNA, 23 bp, Homo sapiens
agtaaacgggaacatgccccctg

SEQ ID NO: 918657 - DNA, 14 bp, Homo sapiens
agtaaactgaggcc

SEQ ID NO: 918658 - DNA, 22 bp, Homo sapiens
agtaaagactattctgtttcta

SEQ ID NO: 918659 - DNA, 22 bp, Homo sapiens
agtaaagatatttgaatatgta

SEQ ID NO: 918660 - DNA, 22 bp, Homo sapiens
agtaaaggaaataagagcagtc

SEQ ID NO: 918661 - DNA, 19 bp, Homo sapiens
agtaaaggagtaagaacct

SEQ ID NO: 918662 - DNA, 18 bp, Homo sapiens
agtaaagtgataatttct

SEQ ID NO: 918663 - DNA, 15 bp, Homo sapiens
agtaaagttaaaaga

SEQ ID NO: 918664 - DNA, 13 bp, Homo sapiens
agtaaagtttgtt

SEQ ID NO: 918665 - DNA, 17 bp, Homo sapiens
agtaaataaaattaaca

SEQ ID NO: 918666 - DNA, 17 bp, Homo sapiens
agtaaatatatatgtca

SEQ ID NO: 918667 - DNA, 14 bp, Homo sapiens
agtaaatatgtgaa

SEQ ID NO: 918668 - DNA, 17 bp, Homo sapiens
agtaaatatgtgaagaa

SEQ ID NO: 918669 - DNA, 18 bp, Homo sapiens
agtaaatatgtgaagaaa

SEQ ID NO: 918670 - DNA, 14 bp, Homo sapiens
agtaaatcaaagat

SEQ ID NO: 918671 - DNA, 19 bp, Homo sapiens
agtaaatcacgctttttga

SEQ ID NO: 918672 - DNA, 20 bp, Homo sapiens
agtaaatcacgctttttgaa

SEQ ID NO: 918673 - DNA, 15 bp, Homo sapiens
agtaaatcagaaagt

SEQ ID NO: 918674 - DNA, 17 bp, Homo sapiens
agtaaatcagaaagtaa

SEQ ID NO: 918675 - DNA, 20 bp, Homo sapiens
agtaaatgggggtgcatttg

SEQ ID NO: 918676 - DNA, 20 bp, Homo sapiens
agtaaatgtgattcacctct

SEQ ID NO: 918677 - DNA, 12 bp, Homo sapiens
agtaacaaaaat

SEQ ID NO: 918678 - DNA, 20 bp, Homo sapiens
agtaacaatacaaatggatt

SEQ ID NO: 918679 - DNA, 21 bp, Homo sapiens
agtaacaatacatgagaaaga

SEQ ID NO: 918680 - DNA, 19 bp, Homo sapiens
agtaacacagattattcat

SEQ ID NO: 918681 - DNA, 12 bp, Homo sapiens
agtaacactaat

SEQ ID NO: 918682 - DNA, 13 bp, Homo sapiens
agtaacactaata

SEQ ID NO: 918683 - DNA, 20 bp, Homo sapiens
agtaacactgtgatttatct

SEQ ID NO: 918684 - DNA, 17 bp, Homo sapiens
agtaacagggcagaaat

SEQ ID NO: 918685 - DNA, 17 bp, Homo sapiens
agtaacatttgctgttt

SEQ ID NO: 918686 - DNA, 20 bp, Homo sapiens
agtaaccaggccccagcctc

SEQ ID NO: 918687 - DNA, 21 bp, Homo sapiens
agtaaccatttcagtgtattg

SEQ ID NO: 918688 - DNA, 11 bp, Homo sapiens
agtaacccagc

SEQ ID NO: 918689 - DNA, 21 bp, Homo sapiens
agtaaccttttgcacctgctc

SEQ ID NO: 918690 - DNA, 17 bp, Homo sapiens
agtaacgcgtcttcctg

SEQ ID NO: 918691 - DNA, 18 bp, Homo sapiens
agtaacgcgtcttcctga

SEQ ID NO: 918692 - DNA, 16 bp, Homo sapiens
agtaacgtgctgctca

SEQ ID NO: 918693 - DNA, 19 bp, Homo sapiens
agtaactaattttgttgaa

SEQ ID NO: 918694 - DNA, 19 bp, Homo sapiens
agtaactactttttatact

SEQ ID NO: 918695 - DNA, 18 bp, Homo sapiens
agtaactggttgctgtgt

SEQ ID NO: 918696 - DNA, 14 bp, Homo sapiens
agtaacttggcttt

SEQ ID NO: 918697 - DNA, 18 bp, Homo sapiens
agtaacttggctttcatt

SEQ ID NO: 918698 - DNA, 20 bp, Homo sapiens
agtaacttttttgtgtatgt

SEQ ID NO: 918699 - DNA, 13 bp, Homo sapiens
agtaagaaaagtg

SEQ ID NO: 918700 - DNA, 12 bp, Homo sapiens
agtaagaaaata

SEQ ID NO: 918701 - DNA, 16 bp, Homo sapiens
agtaagaaaatatttt

SEQ ID NO: 918702 - DNA, 23 bp, Homo sapiens
agtaagaaaatattttgtctaaa

SEQ ID NO: 918703 - DNA, 21 bp, Homo sapiens
agtaagaacatccctgtctta

SEQ ID NO: 918704 - DNA, 17 bp, Homo sapiens
agtaagaaccttgcctg

SEQ ID NO: 918705 - DNA, 16 bp, Homo sapiens
agtaagaagacatgaa

SEQ ID NO: 918706 - DNA, 12 bp, Homo sapiens
agtaagagctgg

SEQ ID NO: 918707 - DNA, 14 bp, Homo sapiens
agtaagagctggtg

SEQ ID NO: 918708 - DNA, 16 bp, Homo sapiens
agtaagatgcactgaa

SEQ ID NO: 918709 - DNA, 14 bp, Homo sapiens
agtaagcatttcca

SEQ ID NO: 918710 - DNA, 13 bp, Homo sapiens
agtaagcccctgt

SEQ ID NO: 918711 - DNA, 19 bp, Homo sapiens
agtaagtaccactcaggcc

SEQ ID NO: 918712 - DNA, 20 bp, Homo sapiens
agtaagtaccactcaggcca

SEQ ID NO: 918713 - DNA, 20 bp, Homo sapiens
agtaagtcttttttttttcc

SEQ ID NO: 918714 - DNA, 13 bp, Homo sapiens
agtaagtgtacaa

SEQ ID NO: 918715 - DNA, 15 bp, Homo sapiens
agtaagtgtacaatt

SEQ ID NO: 918716 - DNA, 22 bp, Homo sapiens
agtaagttaataatgtattgta

SEQ ID NO: 918717 - DNA, 16 bp, Homo sapiens
agtaagttatctttga

SEQ ID NO: 918718 - DNA, 16 bp, Homo sapiens
agtaagtttcttcctg

SEQ ID NO: 918719 - DNA, 13 bp, Homo sapiens
agtaatacaaact

SEQ ID NO: 918720 - DNA, 22 bp, Homo sapiens
agtaataccaaagactatttca

SEQ ID NO: 918721 - DNA, 17 bp, Homo sapiens
agtaataggaccagagc

SEQ ID NO: 918722 - DNA, 18 bp, Homo sapiens
agtaataggaccagagcg

SEQ ID NO: 918723 - DNA, 17 bp, Homo sapiens
agtaataggcattttaa

SEQ ID NO: 918724 - DNA, 14 bp, Homo sapiens
agtaatcaataaag

SEQ ID NO: 918725 - DNA, 15 bp, Homo sapiens
agtaatcaatacaga

SEQ ID NO: 918726 - DNA, 22 bp, Homo sapiens
agtaatcaatctactcaaagca

SEQ ID NO: 918727 - DNA, 22 bp, Homo sapiens
agtaatcagattactgctttaa

SEQ ID NO: 918728 - DNA, 22 bp, Homo sapiens
agtaatcccgccacctatctcg

SEQ ID NO: 918729 - DNA, 19 bp, Homo sapiens
agtaatctaatatggccac

SEQ ID NO: 918730 - DNA, 21 bp, Homo sapiens
agtaatctatgtgtttctgta

SEQ ID NO: 918731 - DNA, 23 bp, Homo sapiens
agtaatctgcattattggaatat

SEQ ID NO: 918732 - DNA, 14 bp, Homo sapiens
agtaatctgtataa

SEQ ID NO: 918733 - DNA, 12 bp, Homo sapiens
agtaatcttttt

SEQ ID NO: 918734 - DNA, 15 bp, Homo sapiens
agtaatctttttaca

SEQ ID NO: 918735 - DNA, 14 bp, Homo sapiens
agtaatgaaatgtt

SEQ ID NO: 918736 - DNA, 21 bp, Homo sapiens
agtaatgaatttttatgatat

SEQ ID NO: 918737 - DNA, 22 bp, Homo sapiens
agtaatgaatttttatgatatt

SEQ ID NO: 918738 - DNA, 22 bp, Homo sapiens
agtaatgatactgtgtgttttc

SEQ ID NO: 918739 - DNA, 22 bp, Homo sapiens
agtaatgatgtaacagtgcaag

SEQ ID NO: 918740 - DNA, 15 bp, Homo sapiens
agtaatgggtttcat

SEQ ID NO: 918741 - DNA, 12 bp, Homo sapiens
agtaatgtatta

SEQ ID NO: 918742 - DNA, 14 bp, Homo sapiens
agtaatgtattagt

SEQ ID NO: 918743 - DNA, 13 bp, Homo sapiens
agtaattcataca

SEQ ID NO: 918744 - DNA, 20 bp, Homo sapiens
agtaattcatacaaagtact

SEQ ID NO: 918745 - DNA, 17 bp, Homo sapiens
agtaattgcatttctgc

SEQ ID NO: 918746 - DNA, 18 bp, Homo sapiens
agtaattgccacagctgt

SEQ ID NO: 918747 - DNA, 12 bp, Homo sapiens
agtaatttcagt

SEQ ID NO: 918748 - DNA, 19 bp, Homo sapiens
agtaatttcagtgtaaagt

SEQ ID NO: 918749 - DNA, 22 bp, Homo sapiens
agtaatttcagtgtaaagtgtg

SEQ ID NO: 918750 - DNA, 21 bp, Homo sapiens
agtaatttctttttttccttt

SEQ ID NO: 918751 - DNA, 17 bp, Homo sapiens
agtaattttcatattaa

SEQ ID NO: 918752 - DNA, 13 bp, Homo sapiens
agtacaaaacaat

SEQ ID NO: 918753 - DNA, 17 bp, Homo sapiens
agtacaaacatgaaaaa

SEQ ID NO: 918754 - DNA, 12 bp, Homo sapiens
agtacaatcagc

SEQ ID NO: 918755 - DNA, 15 bp, Homo sapiens
agtacaattcttact

SEQ ID NO: 918756 - DNA, 18 bp, Homo sapiens
agtacacaataagcaaaa

SEQ ID NO: 918757 - DNA, 19 bp, Homo sapiens
agtacacaattgttttacc

SEQ ID NO: 918758 - DNA, 14 bp, Homo sapiens
agtacactgtttca

SEQ ID NO: 918759 - DNA, 16 bp, Homo sapiens
agtacactgtttcaaa

SEQ ID NO: 918760 - DNA, 23 bp, Homo sapiens
agtacactgtttcaaactttact

SEQ ID NO: 918761 - DNA, 12 bp, Homo sapiens
agtacagaattt

SEQ ID NO: 918762 - DNA, 16 bp, Homo sapiens
agtacagaatttgaat

SEQ ID NO: 918763 - DNA, 21 bp, Homo sapiens
agtacagagaaattctgtggt

SEQ ID NO: 918764 - DNA, 18 bp, Homo sapiens
agtacagcggctcccctc

SEQ ID NO: 918765 - DNA, 22 bp, Homo sapiens
catctgtctttcactggaatga

SEQ ID NO: 918766 - DNA, 14 bp, Homo sapiens
catctgtgaataag

SEQ ID NO: 918767 - DNA, 19 bp, Homo sapiens
catctgtggagctgccaca

SEQ ID NO: 918768 - DNA, 11 bp, Homo sapiens
catctgtgtct

SEQ ID NO: 918769 - DNA, 13 bp, Homo sapiens
catctgtgtcttg

SEQ ID NO: 918770 - DNA, 14 bp, Homo sapiens
catctgtgtcttgt

SEQ ID NO: 918771 - DNA, 16 bp, Homo sapiens
catctgttagggcctt

SEQ ID NO: 918772 - DNA, 16 bp, Homo sapiens
catctgttgttctgtg

SEQ ID NO: 918773 - DNA, 12 bp, Homo sapiens
catctgttgttt

SEQ ID NO: 918774 - DNA, 20 bp, Homo sapiens
catctgttgttttgttttaa

SEQ ID NO: 918775 - DNA, 18 bp, Homo sapiens
catctgtttacctggcag

SEQ ID NO: 918776 - DNA, 15 bp, Homo sapiens
catcttaaatgacag

SEQ ID NO: 918777 - DNA, 23 bp, Homo sapiens
catcttacatttctcaccctact

SEQ ID NO: 918778 - DNA, 15 bp, Homo sapiens
catcttactgaaggt

SEQ ID NO: 918779 - DNA, 22 bp, Homo sapiens
catcttactgtacctgttcctt

SEQ ID NO: 918780 - DNA, 16 bp, Homo sapiens
catcttagactttgca

SEQ ID NO: 918781 - DNA, 17 bp, Homo sapiens
catcttagactttgcaa

SEQ ID NO: 918782 - DNA, 14 bp, Homo sapiens
catcttagtgcctg

SEQ ID NO: 918783 - DNA, 20 bp, Homo sapiens
catcttattttcatgtatat

SEQ ID NO: 918784 - DNA, 13 bp, Homo sapiens
catcttcaatatg

SEQ ID NO: 918785 - DNA, 15 bp, Homo sapiens
catcttcaatatgaa

SEQ ID NO: 918786 - DNA, 16 bp, Homo sapiens
catcttcaatatgaat

SEQ ID NO: 918787 - DNA, 19 bp, Homo sapiens
catcttcaatatgaatcta

SEQ ID NO: 918788 - DNA, 19 bp, Homo sapiens
catcttcactcttcacttg

SEQ ID NO: 918789 - DNA, 16 bp, Homo sapiens
catcttcactgcaatt

SEQ ID NO: 918790 - DNA, 14 bp, Homo sapiens
catcttcagttgtc

SEQ ID NO: 918791 - DNA, 23 bp, Homo sapiens
catcttccacctcacctctttgt

SEQ ID NO: 918792 - DNA, 21 bp, Homo sapiens
catcttccacctgtgccctca

SEQ ID NO: 918793 - DNA, 13 bp, Homo sapiens
catcttcctctgc

SEQ ID NO: 918794 - DNA, 16 bp, Homo sapiens
catcttcctgctgctg

SEQ ID NO: 918795 - DNA, 18 bp, Homo sapiens
catcttcctgctgctgta

SEQ ID NO: 918796 - DNA, 12 bp, Homo sapiens
catcttcctgtg

SEQ ID NO: 918797 - DNA, 21 bp, Homo sapiens
catcttctaaacccaatccaa

SEQ ID NO: 918798 - DNA, 14 bp, Homo sapiens
catcttctccatct

SEQ ID NO: 918799 - DNA, 22 bp, Homo sapiens
catcttctccccgaggctgccc

SEQ ID NO: 918800 - DNA, 19 bp, Homo sapiens
catcttcttcccttaactc

SEQ ID NO: 918801 - DNA, 22 bp, Homo sapiens
catcttgaaaatattgaagaat

SEQ ID NO: 918802 - DNA, 17 bp, Homo sapiens
catcttgcaagcaaatc

SEQ ID NO: 918803 - DNA, 24 bp, Homo sapiens
catcttgcaagcaaatcccatttc

SEQ ID NO: 918804 - DNA, 21 bp, Homo sapiens
catcttgcctacttttcttta

SEQ ID NO: 918805 - DNA, 22 bp, Homo sapiens
catcttgctaccagtatttaga

SEQ ID NO: 918806 - DNA, 23 bp, Homo sapiens
catcttgctaccagtatttagaa

SEQ ID NO: 918807 - DNA, 14 bp, Homo sapiens
catcttgctggcta

SEQ ID NO: 918808 - DNA, 13 bp, Homo sapiens
catcttgcttccc

SEQ ID NO: 918809 - DNA, 15 bp, Homo sapiens
catcttggggacatc

SEQ ID NO: 918810 - DNA, 16 bp, Homo sapiens
catcttggggacatct

SEQ ID NO: 918811 - DNA, 19 bp, Homo sapiens
catcttggtagttctgtgc

SEQ ID NO: 918812 - DNA, 15 bp, Homo sapiens
catctttaatttata

SEQ ID NO: 918813 - DNA, 20 bp, Homo sapiens
catctttacgtactgtaact

SEQ ID NO: 918814 - DNA, 16 bp, Homo sapiens
catctttatctgttct

SEQ ID NO: 918815 - DNA, 21 bp, Homo sapiens
catctttattgaaattctatt

SEQ ID NO: 918816 - DNA, 13 bp, Homo sapiens
catctttcacatt

SEQ ID NO: 918817 - DNA, 23 bp, Homo sapiens
catctttcaccaagatgggtggc

SEQ ID NO: 918818 - DNA, 23 bp, Homo sapiens
catctttcttctattttattccc

SEQ ID NO: 918819 - DNA, 14 bp, Homo sapiens
catctttctttgga

SEQ ID NO: 918820 - DNA, 18 bp, Homo sapiens
catctttgatccttctga

SEQ ID NO: 918821 - DNA, 21 bp, Homo sapiens
catctttgccatatggaggac

SEQ ID NO: 918822 - DNA, 23 bp, Homo sapiens
catctttgccttgggctgctcct

SEQ ID NO: 918823 - DNA, 17 bp, Homo sapiens
catctttgcgaaaagat

SEQ ID NO: 918824 - DNA, 15 bp, Homo sapiens
catcttttattcttt

SEQ ID NO: 918825 - DNA, 15 bp, Homo sapiens
catcttttctacttc

SEQ ID NO: 918826 - DNA, 20 bp, Homo sapiens
catcttttctagagacacat

SEQ ID NO: 918827 - DNA, 22 bp, Homo sapiens
catcttttctagagacacattg

SEQ ID NO: 918828 - DNA, 14 bp, Homo sapiens
catctttttctaga

SEQ ID NO: 918829 - DNA, 14 bp, Homo sapiens
catctttttctttt

SEQ ID NO: 918830 - DNA, 21 bp, Homo sapiens
catgaaaaacacggcagctgt

SEQ ID NO: 918831 - DNA, 22 bp, Homo sapiens
catgaaaaacacggcagctgta

SEQ ID NO: 918832 - DNA, 15 bp, Homo sapiens
catgaaaaagcagct

SEQ ID NO: 918833 - DNA, 19 bp, Homo sapiens
catgaaaaagcagctacca

SEQ ID NO: 918834 - DNA, 14 bp, Homo sapiens
catgaaaaagctgc

SEQ ID NO: 918835 - DNA, 21 bp, Homo sapiens
catgaaaaatcatgggccaga

SEQ ID NO: 918836 - DNA, 21 bp, Homo sapiens
catgaaaacacatttttctta

SEQ ID NO: 918837 - DNA, 16 bp, Homo sapiens
catgaaaacgttttat

SEQ ID NO: 918838 - DNA, 17 bp, Homo sapiens
catgaaaacgttttatt

SEQ ID NO: 918839 - DNA, 19 bp, Homo sapiens
catgaaaacgttttattgt

SEQ ID NO: 918840 - DNA, 14 bp, Homo sapiens
catgaaaagtgcat

SEQ ID NO: 918841 - DNA, 15 bp, Homo sapiens
catgaaacagaaaca

SEQ ID NO: 918842 - DNA, 23 bp, Homo sapiens
catgaaacatttcagaaggtatc

SEQ ID NO: 918843 - DNA, 22 bp, Homo sapiens
catgaaaccttattttttccca

SEQ ID NO: 918844 - DNA, 21 bp, Homo sapiens
catgaaactaggcttctgtaa

SEQ ID NO: 918845 - DNA, 21 bp, Homo sapiens
catgaaataaaatatatctta

SEQ ID NO: 918846 - DNA, 13 bp, Homo sapiens
catgaaatatgca

SEQ ID NO: 918847 - DNA, 14 bp, Homo sapiens
catgaaatatgcat

SEQ ID NO: 918848 - DNA, 18 bp, Homo sapiens
catgaaattgtatctcag

SEQ ID NO: 918849 - DNA, 17 bp, Homo sapiens
catgaacacactgtgtc

SEQ ID NO: 918850 - DNA, 21 bp, Homo sapiens
catgaaccctcttgccatcct

SEQ ID NO: 918851 - DNA, 18 bp, Homo sapiens
catgaactcatcattttt

SEQ ID NO: 918852 - DNA, 18 bp, Homo sapiens
catgaagaatagaaacaa

SEQ ID NO: 918853 - DNA, 12 bp, Homo sapiens
catgaagaatgt

SEQ ID NO: 918854 - DNA, 12 bp, Homo sapiens
catgaagagaag

SEQ ID NO: 918855 - DNA, 16 bp, Homo sapiens
catgaagagaagcaat

SEQ ID NO: 918856 - DNA, 23 bp, Homo sapiens
catgaagatgttaaaatcggttt

SEQ ID NO: 918857 - DNA, 18 bp, Homo sapiens
catgaagattctttccca

SEQ ID NO: 918858 - DNA, 16 bp, Homo sapiens
catgaagcatgagtta

SEQ ID NO: 918859 - DNA, 22 bp, Homo sapiens
catgaagcccaagtgaaatcaa

SEQ ID NO: 918860 - DNA, 22 bp, Homo sapiens
catgaaggatgccaagaagttt

SEQ ID NO: 918861 - DNA, 21 bp, Homo sapiens
catgaagtaaattatgtaact

SEQ ID NO: 918862 - DNA, 23 bp, Homo sapiens
catgaagtaatatgcacacattt

SEQ ID NO: 918863 - DNA, 20 bp, Homo sapiens
catgaataacatttaaattc

SEQ ID NO: 918864 - DNA, 22 bp, Homo sapiens
catgaatatggttggagagccc

SEQ ID NO: 918865 - DNA, 16 bp, Homo sapiens
catgaatccagtccag

SEQ ID NO: 918866 - DNA, 22 bp, Homo sapiens
catgaatcgggctaaggtccct

SEQ ID NO: 918867 - DNA, 17 bp, Homo sapiens
catgaatctttcataca

SEQ ID NO: 918868 - DNA, 18 bp, Homo sapiens
catgaatctttcatacat

SEQ ID NO: 918869 - DNA, 18 bp, Homo sapiens
catgaattactgtatata

SEQ ID NO: 918870 - DNA, 20 bp, Homo sapiens
catgaattattacagtgttt

SEQ ID NO: 918871 - DNA, 18 bp, Homo sapiens
catgaatttattgcacat

SEQ ID NO: 918872 - DNA, 15 bp, Homo sapiens
catgaattttaaaat

SEQ ID NO: 918873 - DNA, 15 bp, Homo sapiens
catgaattttaaagt

SEQ ID NO: 918874 - DNA, 19 bp, Homo sapiens
catgacaaaaataacactg

SEQ ID NO: 918875 - DNA, 14 bp, Homo sapiens
catgacaaacctag

SEQ ID NO: 918876 - DNA, 21 bp, Homo sapiens
catgacaactttgccagcttt

SEQ ID NO: 918877 - DNA, 23 bp, Homo sapiens
catgacaacttttaaagaaaaat

SEQ ID NO: 918878 - DNA, 14 bp, Homo sapiens
catgacaagcccca

SEQ ID NO: 918879 - DNA, 13 bp, Homo sapiens
catgacagaggct

SEQ ID NO: 918880 - DNA, 13 bp, Homo sapiens
catgacagcctgc

SEQ ID NO: 918881 - DNA, 18 bp, Homo sapiens
catgacagcctgcagcag

SEQ ID NO: 918882 - DNA, 14 bp, Homo sapiens
catgacaggctgtt

SEQ ID NO: 918883 - DNA, 24 bp, Homo sapiens
catgacagtgcttgcatcctattt

SEQ ID NO: 918884 - DNA, 16 bp, Homo sapiens
catgacatcaaaatga

SEQ ID NO: 918885 - DNA, 12 bp, Homo sapiens
catgacatgtta

SEQ ID NO: 918886 - DNA, 13 bp, Homo sapiens
catgaccactggg

SEQ ID NO: 918887 - DNA, 14 bp, Homo sapiens
catgaccagtaaag

SEQ ID NO: 918888 - DNA, 12 bp, Homo sapiens
catgacccaccc

SEQ ID NO: 918889 - DNA, 22 bp, Homo sapiens
agtacaggggtgctgcaggtgg

SEQ ID NO: 918890 - DNA, 16 bp, Homo sapiens
agtacagtattctttt

SEQ ID NO: 918891 - DNA, 20 bp, Homo sapiens
agtacagtgaggagggtgga

SEQ ID NO: 918892 - DNA, 22 bp, Homo sapiens
agtacataattgattaaaatct

SEQ ID NO: 918893 - DNA, 18 bp, Homo sapiens
agtacatattaggaaaat

SEQ ID NO: 918894 - DNA, 12 bp, Homo sapiens
agtacattgctt

SEQ ID NO: 918895 - DNA, 19 bp, Homo sapiens
agtacattgcttaaaatat

SEQ ID NO: 918896 - DNA, 14 bp, Homo sapiens
agtacattgttacc

SEQ ID NO: 918897 - DNA, 21 bp, Homo sapiens
agtaccaaatccacaagccat

SEQ ID NO: 918898 - DNA, 14 bp, Homo sapiens
agtaccaatgctgt

SEQ ID NO: 918899 - DNA, 19 bp, Homo sapiens
agtaccaatgctgttgtaa

SEQ ID NO: 918900 - DNA, 17 bp, Homo sapiens
agtaccaatgggaagca

SEQ ID NO: 918901 - DNA, 18 bp, Homo sapiens
agtaccaatgggaagcag

SEQ ID NO: 918902 - DNA, 21 bp, Homo sapiens
agtaccaatgggaagcaggga

SEQ ID NO: 918903 - DNA, 15 bp, Homo sapiens
agtaccactcaggcc

SEQ ID NO: 918904 - DNA, 19 bp, Homo sapiens
agtaccatagtaccattta

SEQ ID NO: 918905 - DNA, 23 bp, Homo sapiens
agtaccatagtaccatttataca

SEQ ID NO: 918906 - DNA, 23 bp, Homo sapiens
agtacccactctggagcatttct

SEQ ID NO: 918907 - DNA, 20 bp, Homo sapiens
agtacccctggtaaaccaag

SEQ ID NO: 918908 - DNA, 18 bp, Homo sapiens
agtaccctctcagctcca

SEQ ID NO: 918909 - DNA, 21 bp, Homo sapiens
agtacctagctggctctgtga

SEQ ID NO: 918910 - DNA, 23 bp, Homo sapiens
agtacctatattgatttaaaagt

SEQ ID NO: 918911 - DNA, 19 bp, Homo sapiens
agtacctcaaagtaaaaat

SEQ ID NO: 918912 - DNA, 15 bp, Homo sapiens
agtacctcctgcccc

SEQ ID NO: 918913 - DNA, 23 bp, Homo sapiens
agtacctctcaagctagtgtttc

SEQ ID NO: 918914 - DNA, 22 bp, Homo sapiens
agtacctctgtatagaaatcta

SEQ ID NO: 918915 - DNA, 18 bp, Homo sapiens
agtacctgattgtatttt

SEQ ID NO: 918916 - DNA, 17 bp, Homo sapiens
agtacctgctgccccag

SEQ ID NO: 918917 - DNA, 19 bp, Homo sapiens
agtacctgctgccccagct

SEQ ID NO: 918918 - DNA, 17 bp, Homo sapiens
agtacctgtagtgagaa

SEQ ID NO: 918919 - DNA, 18 bp, Homo sapiens
agtacctgtagtgagaaa

SEQ ID NO: 918920 - DNA, 14 bp, Homo sapiens
agtaccttgaactc

SEQ ID NO: 918921 - DNA, 13 bp, Homo sapiens
agtaccttgcttc

SEQ ID NO: 918922 - DNA, 14 bp, Homo sapiens
agtaccttgcttct

SEQ ID NO: 918923 - DNA, 18 bp, Homo sapiens
agtacgttgtgcatttgg

SEQ ID NO: 918924 - DNA, 19 bp, Homo sapiens
agtactagagatattttgt

SEQ ID NO: 918925 - DNA, 23 bp, Homo sapiens
agtactagatgcatcactgggtg

SEQ ID NO: 918926 - DNA, 12 bp, Homo sapiens
agtactatgtat

SEQ ID NO: 918927 - DNA, 14 bp, Homo sapiens
agtactatgtatca

SEQ ID NO: 918928 - DNA, 17 bp, Homo sapiens
agtactcagtatagcat

SEQ ID NO: 918929 - DNA, 20 bp, Homo sapiens
agtactcctcacttttcaat

SEQ ID NO: 918930 - DNA, 20 bp, Homo sapiens
agtactctctgctctagcca

SEQ ID NO: 918931 - DNA, 14 bp, Homo sapiens
agtactctttaaca

SEQ ID NO: 918932 - DNA, 19 bp, Homo sapiens
agtactggaataaacagtg

SEQ ID NO: 918933 - DNA, 15 bp, Homo sapiens
agtactggcatggta

SEQ ID NO: 918934 - DNA, 12 bp, Homo sapiens
agtactgtacta

SEQ ID NO: 918935 - DNA, 22 bp, Homo sapiens
agtactgttttgaagctgggct

SEQ ID NO: 918936 - DNA, 23 bp, Homo sapiens
agtacttggtttttttttttctt

SEQ ID NO: 918937 - DNA, 17 bp, Homo sapiens
agtactttaaaaaggaa

SEQ ID NO: 918938 - DNA, 21 bp, Homo sapiens
agtactttaaaaaggaaattt

SEQ ID NO: 918939 - DNA, 15 bp, Homo sapiens
agtactttattgtac

SEQ ID NO: 918940 - DNA, 22 bp, Homo sapiens
agtactttattgtacagactgt

SEQ ID NO: 918941 - DNA, 13 bp, Homo sapiens
agtactttgtgca

SEQ ID NO: 918942 - DNA, 15 bp, Homo sapiens
agtactttgtgcatt

SEQ ID NO: 918943 - DNA, 15 bp, Homo sapiens
agtacttttttaaat

SEQ ID NO: 918944 - DNA, 19 bp, Homo sapiens
agtagaaaaatctcattcc

SEQ ID NO: 918945 - DNA, 18 bp, Homo sapiens
agtagaaaatgtgaccct

SEQ ID NO: 918946 - DNA, 22 bp, Homo sapiens
agtagaaaatgtgaccctccaa

SEQ ID NO: 918947 - DNA, 22 bp, Homo sapiens
agtagaaagacatctgcctgta

SEQ ID NO: 918948 - DNA, 18 bp, Homo sapiens
agtagaaataatatgcat

SEQ ID NO: 918949 - DNA, 22 bp, Homo sapiens
agtagaactcttaaatactttt

SEQ ID NO: 918950 - DNA, 21 bp, Homo sapiens
agtagaagtcttagatgtata

SEQ ID NO: 918951 - DNA, 14 bp, Homo sapiens
agtagacatttata

SEQ ID NO: 918952 - DNA, 20 bp, Homo sapiens
agtagaccaaatcttgttat

SEQ ID NO: 918953 - DNA, 20 bp, Homo sapiens
agtagaccttgttacttctg

SEQ ID NO: 918954 - DNA, 16 bp, Homo sapiens
agtagagtcatctcca

SEQ ID NO: 918955 - DNA, 15 bp, Homo sapiens
agtagatcatgcata

SEQ ID NO: 918956 - DNA, 15 bp, Homo sapiens
agtagatctatatta

SEQ ID NO: 918957 - DNA, 18 bp, Homo sapiens
agtagatgaacctgcagc

SEQ ID NO: 918958 - DNA, 21 bp, Homo sapiens
agtagatgtggcctttgaatt

SEQ ID NO: 918959 - DNA, 21 bp, Homo sapiens
agtagattcttacaaggccct

SEQ ID NO: 918960 - DNA, 15 bp, Homo sapiens
agtagattttccaaa

SEQ ID NO: 918961 - DNA, 16 bp, Homo sapiens
agtagatttttaacaa

SEQ ID NO: 918962 - DNA, 19 bp, Homo sapiens
agtagatttttaacaaaaa

SEQ ID NO: 918963 - DNA, 16 bp, Homo sapiens
agtagcaagttctaga

SEQ ID NO: 918964 - DNA, 22 bp, Homo sapiens
agtagcaagttctagagaagag

SEQ ID NO: 918965 - DNA, 14 bp, Homo sapiens
agtagcaatgtgcc

SEQ ID NO: 918966 - DNA, 14 bp, Homo sapiens
agtagcagtgattg

SEQ ID NO: 918967 - DNA, 14 bp, Homo sapiens
agtagcatgagaga

SEQ ID NO: 918968 - DNA, 20 bp, Homo sapiens
agtagcatgttgagccaggc

SEQ ID NO: 918969 - DNA, 21 bp, Homo sapiens
agtagccctttctgtgtgcac

SEQ ID NO: 918970 - DNA, 16 bp, Homo sapiens
agtagccgagagcctg

SEQ ID NO: 918971 - DNA, 17 bp, Homo sapiens
agtagccgagagcctgc

SEQ ID NO: 918972 - DNA, 16 bp, Homo sapiens
agtagcgctatagtta

SEQ ID NO: 918973 - DNA, 21 bp, Homo sapiens
agtagcgctatagttactgtc

SEQ ID NO: 918974 - DNA, 19 bp, Homo sapiens
agtagcgttttttaaatgt

SEQ ID NO: 918975 - DNA, 20 bp, Homo sapiens
agtagcgttttttaaatgta

SEQ ID NO: 918976 - DNA, 19 bp, Homo sapiens
agtagctagtttgcttttt

SEQ ID NO: 918977 - DNA, 15 bp, Homo sapiens
agtagctctcctgac

SEQ ID NO: 918978 - DNA, 16 bp, Homo sapiens
agtagctgaaatgcaa

SEQ ID NO: 918979 - DNA, 15 bp, Homo sapiens
agtagctgctaccta

SEQ ID NO: 918980 - DNA, 21 bp, Homo sapiens
agtagctgggactacaggtgt

SEQ ID NO: 918981 - DNA, 13 bp, Homo sapiens
agtagctgggatg

SEQ ID NO: 918982 - DNA, 21 bp, Homo sapiens
agtagctgggattacaggcat

SEQ ID NO: 918983 - DNA, 14 bp, Homo sapiens
agtagctgggcctg

SEQ ID NO: 918984 - DNA, 13 bp, Homo sapiens
agtagcttgctcc

SEQ ID NO: 918985 - DNA, 17 bp, Homo sapiens
agtagcttgctccctgt

SEQ ID NO: 918986 - DNA, 23 bp, Homo sapiens
agtagcttgctccctgtgtccac

SEQ ID NO: 918987 - DNA, 22 bp, Homo sapiens
agtaggaacaagctggcttctg

SEQ ID NO: 918988 - DNA, 22 bp, Homo sapiens
agtaggatttatgtattttgaa

SEQ ID NO: 918989 - DNA, 21 bp, Homo sapiens
agtaggcggcgatttttgtat

SEQ ID NO: 918990 - DNA, 23 bp, Homo sapiens
agtaggggaggagcacagtttgt

SEQ ID NO: 918991 - DNA, 16 bp, Homo sapiens
agtaggggttgaagaa

SEQ ID NO: 918992 - DNA, 17 bp, Homo sapiens
agtaggggttgaagaaa

SEQ ID NO: 918993 - DNA, 22 bp, Homo sapiens
agtaggtggcttgagctagaga

SEQ ID NO: 918994 - DNA, 17 bp, Homo sapiens
agtagtacttcttctgt

SEQ ID NO: 918995 - DNA, 23 bp, Homo sapiens
agtagtacttcttctgtaatatt

SEQ ID NO: 918996 - DNA, 20 bp, Homo sapiens
agtagtatgttattcctggt

SEQ ID NO: 918997 - DNA, 17 bp, Homo sapiens
agtagtcacaaactgat

SEQ ID NO: 918998 - DNA, 20 bp, Homo sapiens
agtagtcagaagcaggttct

SEQ ID NO: 918999 - DNA, 21 bp, Homo sapiens
agtagtccctgcacagtgact

SEQ ID NO: 919000 - DNA, 13 bp, Homo sapiens
agtagtcctgtga

SEQ ID NO: 919001 - DNA, 14 bp, Homo sapiens
agtagtcctgtgaa

SEQ ID NO: 919002 - DNA, 13 bp, Homo sapiens
agtagtctctgtg

SEQ ID NO: 919003 - DNA, 19 bp, Homo sapiens
agtagtcttatgtaaagta

SEQ ID NO: 919004 - DNA, 13 bp, Homo sapiens
agtagtgtggcct

SEQ ID NO: 919005 - DNA, 13 bp, Homo sapiens
agtagttatataa

SEQ ID NO: 919006 - DNA, 14 bp, Homo sapiens
agtagttattagta

SEQ ID NO: 919007 - DNA, 12 bp, Homo sapiens
agtagttcacat

SEQ ID NO: 919008 - DNA, 14 bp, Homo sapiens
agtagtttctcagg

SEQ ID NO: 919009 - DNA, 14 bp, Homo sapiens
agtataaaagacaa

SEQ ID NO: 919010 - DNA, 17 bp, Homo sapiens
agtataaaatacaacaa

SEQ ID NO: 919011 - DNA, 17 bp, Homo sapiens
agtataaacaaagttac

SEQ ID NO: 919012 - DNA, 19 bp, Homo sapiens
agtataaacaaagttacta

SEQ ID NO: 919013 - DNA, 16 bp, Homo sapiens
catgacccacccctgt

SEQ ID NO: 919014 - DNA, 19 bp, Homo sapiens
catgacccacccctgtgct

SEQ ID NO: 919015 - DNA, 16 bp, Homo sapiens
catgacccagcctgaa

SEQ ID NO: 919016 - DNA, 21 bp, Homo sapiens
catgaccccttctctctccag

SEQ ID NO: 919017 - DNA, 20 bp, Homo sapiens
catgaccctctgtccccagg

SEQ ID NO: 919018 - DNA, 23 bp, Homo sapiens
catgaccctctgtccccaggcct

SEQ ID NO: 919019 - DNA, 17 bp, Homo sapiens
catgacctcagtcaggc

SEQ ID NO: 919020 - DNA, 14 bp, Homo sapiens
catgactaatgctt

SEQ ID NO: 919021 - DNA, 18 bp, Homo sapiens
catgactctttattgtct

SEQ ID NO: 919022 - DNA, 21 bp, Homo sapiens
catgactgcacccagctccag

SEQ ID NO: 919023 - DNA, 23 bp, Homo sapiens
catgactgcattttactgtacag

SEQ ID NO: 919024 - DNA, 18 bp, Homo sapiens
catgactgcccagctctg

SEQ ID NO: 919025 - DNA, 17 bp, Homo sapiens
catgactgggcctccct

SEQ ID NO: 919026 - DNA, 20 bp, Homo sapiens
catgactgtttcttttgtaa

SEQ ID NO: 919027 - DNA, 14 bp, Homo sapiens
catgacttattatg

SEQ ID NO: 919028 - DNA, 23 bp, Homo sapiens
catgagaaaaactgttcttttgc

SEQ ID NO: 919029 - DNA, 16 bp, Homo sapiens
catgagaagagggcct

SEQ ID NO: 919030 - DNA, 22 bp, Homo sapiens
catgagaagagggcctgtggga

SEQ ID NO: 919031 - DNA, 14 bp, Homo sapiens
catgagaagccaag

SEQ ID NO: 919032 - DNA, 21 bp, Homo sapiens
catgagaagccaagcgctcat

SEQ ID NO: 919033 - DNA, 19 bp, Homo sapiens
catgagacaattttgcttc

SEQ ID NO: 919034 - DNA, 19 bp, Homo sapiens
catgagacacatctcctcc

SEQ ID NO: 919035 - DNA, 19 bp, Homo sapiens
catgagactgatccctggc

SEQ ID NO: 919036 - DNA, 22 bp, Homo sapiens
catgagatgatacatccaaagc

SEQ ID NO: 919037 - DNA, 22 bp, Homo sapiens
catgagatggagaggctgaggg

SEQ ID NO: 919038 - DNA, 21 bp, Homo sapiens
catgagcaccccaaggctgcg

SEQ ID NO: 919039 - DNA, 12 bp, Homo sapiens
catgagcctgcc

SEQ ID NO: 919040 - DNA, 16 bp, Homo sapiens
catgagcctgcccgct

SEQ ID NO: 919041 - DNA, 12 bp, Homo sapiens
catgagcctgct

SEQ ID NO: 919042 - DNA, 16 bp, Homo sapiens
catgagcctgctggaa

SEQ ID NO: 919043 - DNA, 18 bp, Homo sapiens
catgagcctgctggaagc

SEQ ID NO: 919044 - DNA, 22 bp, Homo sapiens
catgagctatttccattccaga

SEQ ID NO: 919045 - DNA, 13 bp, Homo sapiens
catgagctccaga

SEQ ID NO: 919046 - DNA, 15 bp, Homo sapiens
catgagctccagacc

SEQ ID NO: 919047 - DNA, 16 bp, Homo sapiens
catgagctccagaccc

SEQ ID NO: 919048 - DNA, 21 bp, Homo sapiens
catgagctccagacccccagc

SEQ ID NO: 919049 - DNA, 17 bp, Homo sapiens
catgagctgctgtgccc

SEQ ID NO: 919050 - DNA, 13 bp, Homo sapiens
catgaggagggtg

SEQ ID NO: 919051 - DNA, 23 bp, Homo sapiens
catgaggcaatgtcaggaacaga

SEQ ID NO: 919052 - DNA, 22 bp, Homo sapiens
catgaggccactgctgcttctc

SEQ ID NO: 919053 - DNA, 18 bp, Homo sapiens
catgaggccatctcagga

SEQ ID NO: 919054 - DNA, 19 bp, Homo sapiens
catgaggccatctcaggag

SEQ ID NO: 919055 - DNA, 20 bp, Homo sapiens
catgaggccatctcaggaga

SEQ ID NO: 919056 - DNA, 20 bp, Homo sapiens
catgagggatcacagggccc

SEQ ID NO: 919057 - DNA, 13 bp, Homo sapiens
catgaggggagag

SEQ ID NO: 919058 - DNA, 14 bp, Homo sapiens
catgaggtatctaa

SEQ ID NO: 919059 - DNA, 23 bp, Homo sapiens
catgagtagtgggctatgcagga

SEQ ID NO: 919060 - DNA, 16 bp, Homo sapiens
catgagtatctgtggg

SEQ ID NO: 919061 - DNA, 18 bp, Homo sapiens
catgagtatctgtgggag

SEQ ID NO: 919062 - DNA, 18 bp, Homo sapiens
catgagtccttgaaaata

SEQ ID NO: 919063 - DNA, 22 bp, Homo sapiens
catgagtctacctgagcattca

SEQ ID NO: 919064 - DNA, 15 bp, Homo sapiens
catgagtctgtagga

SEQ ID NO: 919065 - DNA, 16 bp, Homo sapiens
catgagtctgtaggag

SEQ ID NO: 919066 - DNA, 17 bp, Homo sapiens
catgagtctgtaggagc

SEQ ID NO: 919067 - DNA, 14 bp, Homo sapiens
catgagtgaataaa

SEQ ID NO: 919068 - DNA, 16 bp, Homo sapiens
catgagttatcatgaa

SEQ ID NO: 919069 - DNA, 19 bp, Homo sapiens
catgagttttttctcttgg

SEQ ID NO: 919070 - DNA, 14 bp, Homo sapiens
catgataagaacag

SEQ ID NO: 919071 - DNA, 19 bp, Homo sapiens
catgataccacctttactg

SEQ ID NO: 919072 - DNA, 22 bp, Homo sapiens
catgataccacctttactgtgc

SEQ ID NO: 919073 - DNA, 14 bp, Homo sapiens
catgatcaagatat

SEQ ID NO: 919074 - DNA, 17 bp, Homo sapiens
catgatcacttatcagt

SEQ ID NO: 919075 - DNA, 22 bp, Homo sapiens
catgatcagacatacagctgcc

SEQ ID NO: 919076 - DNA, 23 bp, Homo sapiens
catgatcagacatacagctgcct

SEQ ID NO: 919077 - DNA, 21 bp, Homo sapiens
catgatcatagctcactgcag

SEQ ID NO: 919078 - DNA, 22 bp, Homo sapiens
catgatccctgtgttgtctcta

SEQ ID NO: 919079 - DNA, 20 bp, Homo sapiens
catgatctccctgccgcctc

SEQ ID NO: 919080 - DNA, 21 bp, Homo sapiens
catgatctccctgccgcctca

SEQ ID NO: 919081 - DNA, 14 bp, Homo sapiens
catgatgatagttg

SEQ ID NO: 919082 - DNA, 19 bp, Homo sapiens
catgatgatagttgaatgt

SEQ ID NO: 919083 - DNA, 21 bp, Homo sapiens
catgatggacaaaggcctggc

SEQ ID NO: 919084 - DNA, 12 bp, Homo sapiens
catgatggagtc

SEQ ID NO: 919085 - DNA, 23 bp, Homo sapiens
catgatggattcccccccctttc

SEQ ID NO: 919086 - DNA, 16 bp, Homo sapiens
catgatgggaaaatat

SEQ ID NO: 919087 - DNA, 20 bp, Homo sapiens
catgatgggaaaatatttcc

SEQ ID NO: 919088 - DNA, 23 bp, Homo sapiens
catgatgggaaaatatttcctga

SEQ ID NO: 919089 - DNA, 22 bp, Homo sapiens
catgatggttattttcttttct

SEQ ID NO: 919090 - DNA, 12 bp, Homo sapiens
catgatgtatat

SEQ ID NO: 919091 - DNA, 13 bp, Homo sapiens
catgatgtatatc

SEQ ID NO: 919092 - DNA, 15 bp, Homo sapiens
catgatgtccttgga

SEQ ID NO: 919093 - DNA, 21 bp, Homo sapiens
catgatgtgaagagtttcaca

SEQ ID NO: 919094 - DNA, 13 bp, Homo sapiens
catgatgtttaca

SEQ ID NO: 919095 - DNA, 14 bp, Homo sapiens
catgattatagcaa

SEQ ID NO: 919096 - DNA, 15 bp, Homo sapiens
catgattcaacctga

SEQ ID NO: 919097 - DNA, 21 bp, Homo sapiens
catgattcatgccaattagca

SEQ ID NO: 919098 - DNA, 21 bp, Homo sapiens
catgattccatgcccgagtcc

SEQ ID NO: 919099 - DNA, 21 bp, Homo sapiens
catgattctttaatagaagtt

SEQ ID NO: 919100 - DNA, 19 bp, Homo sapiens
catgattggcttaaagtga

SEQ ID NO: 919101 - DNA, 20 bp, Homo sapiens
catgattggcttaaagtgaa

SEQ ID NO: 919102 - DNA, 21 bp, Homo sapiens
catgatttagggaagcaggga

SEQ ID NO: 919103 - DNA, 15 bp, Homo sapiens
catgatttatatatg

SEQ ID NO: 919104 - DNA, 18 bp, Homo sapiens
catgatttatatatggca

SEQ ID NO: 919105 - DNA, 12 bp, Homo sapiens
catgatttcaaa

SEQ ID NO: 919106 - DNA, 16 bp, Homo sapiens
catgatttccttgaat

SEQ ID NO: 919107 - DNA, 18 bp, Homo sapiens
catgatttgtcccagcct

SEQ ID NO: 919108 - DNA, 21 bp, Homo sapiens
catgatttgtcccagcctggg

SEQ ID NO: 919109 - DNA, 13 bp, Homo sapiens
catgattttctaa

SEQ ID NO: 919110 - DNA, 15 bp, Homo sapiens
catgattttctaaaa

SEQ ID NO: 919111 - DNA, 23 bp, Homo sapiens
catgatttttggtatttatgtaa

SEQ ID NO: 919112 - DNA, 23 bp, Homo sapiens
catgcaaaatcaggaaaggctgt

SEQ ID NO: 919113 - DNA, 23 bp, Homo sapiens
catgcaaactgctttattttccc

SEQ ID NO: 919114 - DNA, 21 bp, Homo sapiens
catgcaaatgtcttccaggtc

SEQ ID NO: 919115 - DNA, 16 bp, Homo sapiens
catgcaacagaagtga

SEQ ID NO: 919116 - DNA, 22 bp, Homo sapiens
catgcaaccgggccctctctct

SEQ ID NO: 919117 - DNA, 20 bp, Homo sapiens
catgcaaggggaaaatctca

SEQ ID NO: 919118 - DNA, 12 bp, Homo sapiens
catgcaaggtca

SEQ ID NO: 919119 - DNA, 17 bp, Homo sapiens
catgcaataatgtgcaa

SEQ ID NO: 919120 - DNA, 18 bp, Homo sapiens
catgcaatttattaaaat

SEQ ID NO: 919121 - DNA, 22 bp, Homo sapiens
catgcacacaattagatttctc

SEQ ID NO: 919122 - DNA, 12 bp, Homo sapiens
catgcacactca

SEQ ID NO: 919123 - DNA, 13 bp, Homo sapiens
catgcacagctgc

SEQ ID NO: 919124 - DNA, 16 bp, Homo sapiens
catgcacagctgcttg

SEQ ID NO: 919125 - DNA, 14 bp, Homo sapiens
catgcacagctgta

SEQ ID NO: 919126 - DNA, 21 bp, Homo sapiens
catgcacatgctgtctggccc

SEQ ID NO: 919127 - DNA, 22 bp, Homo sapiens
catgcacatgctgtctggccct

SEQ ID NO: 919128 - DNA, 14 bp, Homo sapiens
catgcaccacgggc

SEQ ID NO: 919129 - DNA, 22 bp, Homo sapiens
catgcaccaggactggctgtgt

SEQ ID NO: 919130 - DNA, 16 bp, Homo sapiens
catgcaccctcataca

SEQ ID NO: 919131 - DNA, 14 bp, Homo sapiens
catgcacctcaggg

SEQ ID NO: 919132 - DNA, 17 bp, Homo sapiens
catgcacctcagggcca

SEQ ID NO: 919133 - DNA, 22 bp, Homo sapiens
catgcactatatttgtatatat

SEQ ID NO: 919134 - DNA, 16 bp, Homo sapiens
catgcactcagctctt

SEQ ID NO: 919135 - DNA, 15 bp, Homo sapiens
catgcactgaggtcc

SEQ ID NO: 919136 - DNA, 17 bp, Homo sapiens
agtataaccatatgata

SEQ ID NO: 919137 - DNA, 19 bp, Homo sapiens
agtataaccatatgatact

SEQ ID NO: 919138 - DNA, 13 bp, Homo sapiens
agtataagatttt

SEQ ID NO: 919139 - DNA, 15 bp, Homo sapiens
agtataagatttttg

SEQ ID NO: 919140 - DNA, 16 bp, Homo sapiens
agtataagatttttga

SEQ ID NO: 919141 - DNA, 15 bp, Homo sapiens
agtataatctcctct

SEQ ID NO: 919142 - DNA, 10 bp, Homo sapiens
agtataattg

SEQ ID NO: 919143 - DNA, 18 bp, Homo sapiens
agtataattttttgtaat

SEQ ID NO: 919144 - DNA, 20 bp, Homo sapiens
agtatacaacaggagagaga

SEQ ID NO: 919145 - DNA, 20 bp, Homo sapiens
agtatacagacaggaagatg

SEQ ID NO: 919146 - DNA, 17 bp, Homo sapiens
agtatacgtataaatat

SEQ ID NO: 919147 - DNA, 19 bp, Homo sapiens
agtatacgtataaatatca

SEQ ID NO: 919148 - DNA, 23 bp, Homo sapiens
agtatactagggagccatttgag

SEQ ID NO: 919149 - DNA, 16 bp, Homo sapiens
agtatactgtgtggga

SEQ ID NO: 919150 - DNA, 22 bp, Homo sapiens
agtatacttttcccctgttaaa

SEQ ID NO: 919151 - DNA, 15 bp, Homo sapiens
agtatagtagaaaga

SEQ ID NO: 919152 - DNA, 14 bp, Homo sapiens
agtatagtgcaaat

SEQ ID NO: 919153 - DNA, 14 bp, Homo sapiens
agtatataataact

SEQ ID NO: 919154 - DNA, 23 bp, Homo sapiens
agtatataataactttattgcat

SEQ ID NO: 919155 - DNA, 18 bp, Homo sapiens
agtatataatatgtcacc

SEQ ID NO: 919156 - DNA, 22 bp, Homo sapiens
agtatatctggacaagccaact

SEQ ID NO: 919157 - DNA, 21 bp, Homo sapiens
agtatattcttattggaaatg

SEQ ID NO: 919158 - DNA, 14 bp, Homo sapiens
agtatattgttgaa

SEQ ID NO: 919159 - DNA, 22 bp, Homo sapiens
agtatattgttgaagagacaga

SEQ ID NO: 919160 - DNA, 13 bp, Homo sapiens
agtatatttaatt

SEQ ID NO: 919161 - DNA, 15 bp, Homo sapiens
agtatatttatactc

SEQ ID NO: 919162 - DNA, 22 bp, Homo sapiens
agtatatttcttcgttcttttt

SEQ ID NO: 919163 - DNA, 13 bp, Homo sapiens
agtatattttctt

SEQ ID NO: 919164 - DNA, 17 bp, Homo sapiens
agtatcacgatttgcag

SEQ ID NO: 919165 - DNA, 14 bp, Homo sapiens
agtatcacttttct

SEQ ID NO: 919166 - DNA, 23 bp, Homo sapiens
agtatcagagatgtccattttta

SEQ ID NO: 919167 - DNA, 18 bp, Homo sapiens
agtatcaggtctcccacg

SEQ ID NO: 919168 - DNA, 15 bp, Homo sapiens
agtatcatgccctgt

SEQ ID NO: 919169 - DNA, 14 bp, Homo sapiens
agtatccttccttc

SEQ ID NO: 919170 - DNA, 23 bp, Homo sapiens
agtatctatatatgtgtatgtac

SEQ ID NO: 919171 - DNA, 20 bp, Homo sapiens
agtatctgggattattcttt

SEQ ID NO: 919172 - DNA, 18 bp, Homo sapiens
agtatctgtatctctctc

SEQ ID NO: 919173 - DNA, 24 bp, Homo sapiens
agtatcttcaaactttcactttga

SEQ ID NO: 919174 - DNA, 20 bp, Homo sapiens
agtatcttctatttttatca

SEQ ID NO: 919175 - DNA, 18 bp, Homo sapiens
agtatcttgtttggcctc

SEQ ID NO: 919176 - DNA, 16 bp, Homo sapiens
agtatgaataaagaca

SEQ ID NO: 919177 - DNA, 13 bp, Homo sapiens
agtatgaatatta

SEQ ID NO: 919178 - DNA, 20 bp, Homo sapiens
agtatgaatattactctcaa

SEQ ID NO: 919179 - DNA, 15 bp, Homo sapiens
agtatgaatctatgc

SEQ ID NO: 919180 - DNA, 17 bp, Homo sapiens
agtatgaattattcaat

SEQ ID NO: 919181 - DNA, 22 bp, Homo sapiens
agtatgaattattcaatttatt

SEQ ID NO: 919182 - DNA, 14 bp, Homo sapiens
agtatgagccctaa

SEQ ID NO: 919183 - DNA, 16 bp, Homo sapiens
agtatgaggcatttgt

SEQ ID NO: 919184 - DNA, 17 bp, Homo sapiens
agtatgaggcatttgtt

SEQ ID NO: 919185 - DNA, 20 bp, Homo sapiens
agtatgaggcatttgtttga

SEQ ID NO: 919186 - DNA, 23 bp, Homo sapiens
agtatgagtcttctgtaattcat

SEQ ID NO: 919187 - DNA, 17 bp, Homo sapiens
agtatgagtgctgattc

SEQ ID NO: 919188 - DNA, 17 bp, Homo sapiens
agtatgatggcaggaga

SEQ ID NO: 919189 - DNA, 14 bp, Homo sapiens
agtatgcaaaataa

SEQ ID NO: 919190 - DNA, 21 bp, Homo sapiens
agtatgcaaaataaagaatat

SEQ ID NO: 919191 - DNA, 16 bp, Homo sapiens
agtatgcattattaaa

SEQ ID NO: 919192 - DNA, 21 bp, Homo sapiens
agtatgcattattaaattgta

SEQ ID NO: 919193 - DNA, 22 bp, Homo sapiens
agtatgccaaaaatatatgcta

SEQ ID NO: 919194 - DNA, 13 bp, Homo sapiens
agtatgccttaag

SEQ ID NO: 919195 - DNA, 17 bp, Homo sapiens
agtatgccttaagcaga

SEQ ID NO: 919196 - DNA, 21 bp, Homo sapiens
agtatgccttaagcagaacaa

SEQ ID NO: 919197 - DNA, 23 bp, Homo sapiens
agtatgctttccctgaggaatga

SEQ ID NO: 919198 - DNA, 17 bp, Homo sapiens
agtatggaatattcatt

SEQ ID NO: 919199 - DNA, 14 bp, Homo sapiens
agtatggttcaaga

SEQ ID NO: 919200 - DNA, 15 bp, Homo sapiens
agtatggttcaagat

SEQ ID NO: 919201 - DNA, 15 bp, Homo sapiens
agtatggttctcaga

SEQ ID NO: 919202 - DNA, 22 bp, Homo sapiens
agtatgtatattaaaaaagaga

SEQ ID NO: 919203 - DNA, 23 bp, Homo sapiens
agtatgtatattaaaaaagagac

SEQ ID NO: 919204 - DNA, 14 bp, Homo sapiens
agtatgtccttcag

SEQ ID NO: 919205 - DNA, 22 bp, Homo sapiens
agtatgtctgtttttgtatctt

SEQ ID NO: 919206 - DNA, 14 bp, Homo sapiens
agtatgtgactttt

SEQ ID NO: 919207 - DNA, 22 bp, Homo sapiens
agtatgtgctatacacacacac

SEQ ID NO: 919208 - DNA, 22 bp, Homo sapiens
agtatgttctaacctttacatg

SEQ ID NO: 919209 - DNA, 11 bp, Homo sapiens
agtatgttgta

SEQ ID NO: 919210 - DNA, 15 bp, Homo sapiens
agtatgttgtcaaag

SEQ ID NO: 919211 - DNA, 17 bp, Homo sapiens
agtatgttgtcataaca

SEQ ID NO: 919212 - DNA, 19 bp, Homo sapiens
agtatgttgtcataacatt

SEQ ID NO: 919213 - DNA, 21 bp, Homo sapiens
agtatgttgtcataacattta

SEQ ID NO: 919214 - DNA, 16 bp, Homo sapiens
agtatgttttagcatg

SEQ ID NO: 919215 - DNA, 19 bp, Homo sapiens
agtatgttttagcatgtgt

SEQ ID NO: 919216 - DNA, 17 bp, Homo sapiens
agtatgtttttacatta

SEQ ID NO: 919217 - DNA, 18 bp, Homo sapiens
agtatgtttttacattat

SEQ ID NO: 919218 - DNA, 19 bp, Homo sapiens
agtattaaaagttgcattt

SEQ ID NO: 919219 - DNA, 22 bp, Homo sapiens
agtattaagggtaggatgttgc

SEQ ID NO: 919220 - DNA, 17 bp, Homo sapiens
agtattaccaccctttc

SEQ ID NO: 919221 - DNA, 21 bp, Homo sapiens
agtattactaaattgaccttt

SEQ ID NO: 919222 - DNA, 14 bp, Homo sapiens
agtattactgctgc

SEQ ID NO: 919223 - DNA, 15 bp, Homo sapiens
agtattactgctgct

SEQ ID NO: 919224 - DNA, 17 bp, Homo sapiens
agtattactttctgccg

SEQ ID NO: 919225 - DNA, 18 bp, Homo sapiens
agtattatctaaatgaat

SEQ ID NO: 919226 - DNA, 12 bp, Homo sapiens
agtattatgcat

SEQ ID NO: 919227 - DNA, 20 bp, Homo sapiens
agtattcaataccgctcagt

SEQ ID NO: 919228 - DNA, 15 bp, Homo sapiens
agtattcagaaatta

SEQ ID NO: 919229 - DNA, 22 bp, Homo sapiens
agtattcagaaattaaaatatt

SEQ ID NO: 919230 - DNA, 21 bp, Homo sapiens
agtattccaccttaaattaaa

SEQ ID NO: 919231 - DNA, 21 bp, Homo sapiens
agtattccatgagctgctcat

SEQ ID NO: 919232 - DNA, 20 bp, Homo sapiens
agtattccattgtgtgagtg

SEQ ID NO: 919233 - DNA, 22 bp, Homo sapiens
agtattcctttatacacagtgg

SEQ ID NO: 919234 - DNA, 21 bp, Homo sapiens
agtattctaaagttttgcaac

SEQ ID NO: 919235 - DNA, 19 bp, Homo sapiens
agtattctcaaagatgcat

SEQ ID NO: 919236 - DNA, 13 bp, Homo sapiens
agtattctcagag

SEQ ID NO: 919237 - DNA, 15 bp, Homo sapiens
agtattctcagagca

SEQ ID NO: 919238 - DNA, 19 bp, Homo sapiens
agtattctgacatgtaaga

SEQ ID NO: 919239 - DNA, 18 bp, Homo sapiens
agtattctgtaaagctta

SEQ ID NO: 919240 - DNA, 19 bp, Homo sapiens
agtattcttatttaatgaa

SEQ ID NO: 919241 - DNA, 12 bp, Homo sapiens
agtattcttctc

SEQ ID NO: 919242 - DNA, 18 bp, Homo sapiens
agtattcttgtcaaaaaa

SEQ ID NO: 919243 - DNA, 21 bp, Homo sapiens
agtattgaaagccaacaactc

SEQ ID NO: 919244 - DNA, 17 bp, Homo sapiens
agtattgcatctgtata

SEQ ID NO: 919245 - DNA, 18 bp, Homo sapiens
agtattgccacctctggc

SEQ ID NO: 919246 - DNA, 24 bp, Homo sapiens
agtattggacggtttctagcctct

SEQ ID NO: 919247 - DNA, 14 bp, Homo sapiens
agtattgtaaatta

SEQ ID NO: 919248 - DNA, 19 bp, Homo sapiens
agtattgttgtccttttca

SEQ ID NO: 919249 - DNA, 20 bp, Homo sapiens
agtattgttgtccttttcat

SEQ ID NO: 919250 - DNA, 21 bp, Homo sapiens
agtattgttgtccttttcata

SEQ ID NO: 919251 - DNA, 19 bp, Homo sapiens
agtatttaatttggatctg

SEQ ID NO: 919252 - DNA, 15 bp, Homo sapiens
agtatttagaagcca

SEQ ID NO: 919253 - DNA, 19 bp, Homo sapiens
agtatttataaaaatataa

SEQ ID NO: 919254 - DNA, 16 bp, Homo sapiens
agtatttatatattta

SEQ ID NO: 919255 - DNA, 20 bp, Homo sapiens
agtatttatatatttataac

SEQ ID NO: 919256 - DNA, 13 bp, Homo sapiens
agtatttatgtaa

SEQ ID NO: 919257 - DNA, 14 bp, Homo sapiens
agtatttatgtaat

SEQ ID NO: 919258 - DNA, 15 bp, Homo sapiens
agtatttatgtaatt

SEQ ID NO: 919259 - DNA, 12 bp, Homo sapiens
agtatttattgt

SEQ ID NO: 919260 - DNA, 18 bp, Homo sapiens
catgcactgaggtccaca

SEQ ID NO: 919261 - DNA, 15 bp, Homo sapiens
catgcactgtaaata

SEQ ID NO: 919262 - DNA, 19 bp, Homo sapiens
catgcactgttccccctgt

SEQ ID NO: 919263 - DNA, 16 bp, Homo sapiens
catgcacttaaagaag

SEQ ID NO: 919264 - DNA, 16 bp, Homo sapiens
catgcagacctcatgc

SEQ ID NO: 919265 - DNA, 18 bp, Homo sapiens
catgcagactcctcagat

SEQ ID NO: 919266 - DNA, 19 bp, Homo sapiens
catgcagactcctcagatc

SEQ ID NO: 919267 - DNA, 17 bp, Homo sapiens
catgcagcccctgggcc

SEQ ID NO: 919268 - DNA, 19 bp, Homo sapiens
catgcagcccctgggccct

SEQ ID NO: 919269 - DNA, 14 bp, Homo sapiens
catgcagccttggg

SEQ ID NO: 919270 - DNA, 17 bp, Homo sapiens
catgcagctgcctgggg

SEQ ID NO: 919271 - DNA, 21 bp, Homo sapiens
catgcagctgcctggggccca

SEQ ID NO: 919272 - DNA, 17 bp, Homo sapiens
catgcaggaagaggccc

SEQ ID NO: 919273 - DNA, 19 bp, Homo sapiens
catgcaggaagaggcccac

SEQ ID NO: 919274 - DNA, 22 bp, Homo sapiens
catgcaggaagaggcccactag

SEQ ID NO: 919275 - DNA, 14 bp, Homo sapiens
catgcaggaggtgg

SEQ ID NO: 919276 - DNA, 18 bp, Homo sapiens
catgcagggggctcctgg

SEQ ID NO: 919277 - DNA, 19 bp, Homo sapiens
catgcaggtggtgggacac

SEQ ID NO: 919278 - DNA, 21 bp, Homo sapiens
catgcaggtggtgggacactg

SEQ ID NO: 919279 - DNA, 17 bp, Homo sapiens
catgcagttcattattt

SEQ ID NO: 919280 - DNA, 23 bp, Homo sapiens
catgcagttcattattttgtggt

SEQ ID NO: 919281 - DNA, 15 bp, Homo sapiens
catgcagttcctggc

SEQ ID NO: 919282 - DNA, 16 bp, Homo sapiens
catgcatactttattg

SEQ ID NO: 919283 - DNA, 17 bp, Homo sapiens
catgcatagtcccagct

SEQ ID NO: 919284 - DNA, 18 bp, Homo sapiens
catgcatagtcccagcta

SEQ ID NO: 919285 - DNA, 20 bp, Homo sapiens
catgcatataatgaataaat

SEQ ID NO: 919286 - DNA, 22 bp, Homo sapiens
catgcatataatgaataaatca

SEQ ID NO: 919287 - DNA, 23 bp, Homo sapiens
catgcatatcattaaacaaataa

SEQ ID NO: 919288 - DNA, 21 bp, Homo sapiens
catgcatccatttactgacac

SEQ ID NO: 919289 - DNA, 16 bp, Homo sapiens
catgcatcttactgaa

SEQ ID NO: 919290 - DNA, 17 bp, Homo sapiens
catgcatgtcctgtaaa

SEQ ID NO: 919291 - DNA, 21 bp, Homo sapiens
catgcatgtcctgtaaaggtt

SEQ ID NO: 919292 - DNA, 17 bp, Homo sapiens
catgcattgttgaggtg

SEQ ID NO: 919293 - DNA, 19 bp, Homo sapiens
catgcattttgcagcagtg

SEQ ID NO: 919294 - DNA, 12 bp, Homo sapiens
catgccaataaa

SEQ ID NO: 919295 - DNA, 21 bp, Homo sapiens
catgccaataaagtgatctgt

SEQ ID NO: 919296 - DNA, 16 bp, Homo sapiens
catgccactgccaggc

SEQ ID NO: 919297 - DNA, 18 bp, Homo sapiens
catgccactgccaggcac

SEQ ID NO: 919298 - DNA, 19 bp, Homo sapiens
catgccactgccaggcacc

SEQ ID NO: 919299 - DNA, 23 bp, Homo sapiens
catgccactgccaggcacctggc

SEQ ID NO: 919300 - DNA, 16 bp, Homo sapiens
catgccagacccactg

SEQ ID NO: 919301 - DNA, 21 bp, Homo sapiens
catgccagattctgcctctct

SEQ ID NO: 919302 - DNA, 16 bp, Homo sapiens
catgccagctggcctt

SEQ ID NO: 919303 - DNA, 20 bp, Homo sapiens
catgccagcttatctcaggg

SEQ ID NO: 919304 - DNA, 13 bp, Homo sapiens
catgccaggaccc

SEQ ID NO: 919305 - DNA, 21 bp, Homo sapiens
catgccaggacccgccagccc

SEQ ID NO: 919306 - DNA, 18 bp, Homo sapiens
catgccaggctaattttt

SEQ ID NO: 919307 - DNA, 14 bp, Homo sapiens
catgccaggctggg

SEQ ID NO: 919308 - DNA, 21 bp, Homo sapiens
catgccaggctgggcacggct

SEQ ID NO: 919309 - DNA, 20 bp, Homo sapiens
catgccagggccatgtcaga

SEQ ID NO: 919310 - DNA, 19 bp, Homo sapiens
catgccagtatttttaaag

SEQ ID NO: 919311 - DNA, 10 bp, Homo sapiens
catgccatct

SEQ ID NO: 919312 - DNA, 13 bp, Homo sapiens
catgcccaccccc

SEQ ID NO: 919313 - DNA, 19 bp, Homo sapiens
catgcccaccccctgccct

SEQ ID NO: 919314 - DNA, 20 bp, Homo sapiens
catgcccaccccctgccctg

SEQ ID NO: 919315 - DNA, 23 bp, Homo sapiens
catgcccaccccctgccctgcac

SEQ ID NO: 919316 - DNA, 17 bp, Homo sapiens
catgcccacctgcccat

SEQ ID NO: 919317 - DNA, 18 bp, Homo sapiens
catgcccagattcccaga

SEQ ID NO: 919318 - DNA, 17 bp, Homo sapiens
catgcccagctctctga

SEQ ID NO: 919319 - DNA, 19 bp, Homo sapiens
catgcccagctctctgacg

SEQ ID NO: 919320 - DNA, 14 bp, Homo sapiens
catgccccaccccc

SEQ ID NO: 919321 - DNA, 16 bp, Homo sapiens
catgccccacccccct

SEQ ID NO: 919322 - DNA, 18 bp, Homo sapiens
catgccccacccccctcc

SEQ ID NO: 919323 - DNA, 20 bp, Homo sapiens
catgccccacccccctcctc

SEQ ID NO: 919324 - DNA, 22 bp, Homo sapiens
catgccccacccccctcctccc

SEQ ID NO: 919325 - DNA, 15 bp, Homo sapiens
catgccccagctctg

SEQ ID NO: 919326 - DNA, 18 bp, Homo sapiens
catgccccagctctggat

SEQ ID NO: 919327 - DNA, 12 bp, Homo sapiens
catgccccagtc

SEQ ID NO: 919328 - DNA, 14 bp, Homo sapiens
catgcccccctcaa

SEQ ID NO: 919329 - DNA, 21 bp, Homo sapiens
catgcccccctcaaacctcct

SEQ ID NO: 919330 - DNA, 23 bp, Homo sapiens
catgcccccctcaaacctcctct

SEQ ID NO: 919331 - DNA, 14 bp, Homo sapiens
catgccccctccct

SEQ ID NO: 919332 - DNA, 16 bp, Homo sapiens
catgccccctcccttc

SEQ ID NO: 919333 - DNA, 19 bp, Homo sapiens
catgccccctcccttcaca

SEQ ID NO: 919334 - DNA, 11 bp, Homo sapiens
catgccccctt

SEQ ID NO: 919335 - DNA, 15 bp, Homo sapiens
catgccccctttcag

SEQ ID NO: 919336 - DNA, 11 bp, Homo sapiens
catgcccctcc

SEQ ID NO: 919337 - DNA, 18 bp, Homo sapiens
catgcccctcccccagct

SEQ ID NO: 919338 - DNA, 21 bp, Homo sapiens
catgcccctcccccagctgcg

SEQ ID NO: 919339 - DNA, 22 bp, Homo sapiens
catgcccctcccccagctgcgt

SEQ ID NO: 919340 - DNA, 13 bp, Homo sapiens
catgccccttggc

SEQ ID NO: 919341 - DNA, 21 bp, Homo sapiens
catgcccgagtccgcccatcc

SEQ ID NO: 919342 - DNA, 22 bp, Homo sapiens
catgcccgagtccgcccatccc

SEQ ID NO: 919343 - DNA, 23 bp, Homo sapiens
catgcccgagtccgcccatccct

SEQ ID NO: 919344 - DNA, 17 bp, Homo sapiens
catgcccggctaatttt

SEQ ID NO: 919345 - DNA, 21 bp, Homo sapiens
catgcccggctaatttttgta

SEQ ID NO: 919346 - DNA, 19 bp, Homo sapiens
catgccctcccaggaccct

SEQ ID NO: 919347 - DNA, 20 bp, Homo sapiens
catgccctcccttctccctg

SEQ ID NO: 919348 - DNA, 21 bp, Homo sapiens
catgccctcccttctccctgg

SEQ ID NO: 919349 - DNA, 17 bp, Homo sapiens
catgccctcctctccca

SEQ ID NO: 919350 - DNA, 20 bp, Homo sapiens
catgccctcctctcccattg

SEQ ID NO: 919351 - DNA, 19 bp, Homo sapiens
catgccctgggatgcctca

SEQ ID NO: 919352 - DNA, 21 bp, Homo sapiens
catgccctgggatgcctcacc

SEQ ID NO: 919353 - DNA, 18 bp, Homo sapiens
catgccctgtgcaacctc

SEQ ID NO: 919354 - DNA, 14 bp, Homo sapiens
catgccgggcgcag

SEQ ID NO: 919355 - DNA, 18 bp, Homo sapiens
catgcctcactttcttct

SEQ ID NO: 919356 - DNA, 11 bp, Homo sapiens
catgcctcagc

SEQ ID NO: 919357 - DNA, 16 bp, Homo sapiens
catgcctcatgccaca

SEQ ID NO: 919358 - DNA, 19 bp, Homo sapiens
catgcctcatgccacacct

SEQ ID NO: 919359 - DNA, 20 bp, Homo sapiens
catgcctccctgggccacct

SEQ ID NO: 919360 - DNA, 22 bp, Homo sapiens
catgcctccctgggccacctcc

SEQ ID NO: 919361 - DNA, 13 bp, Homo sapiens
catgcctgagggt

SEQ ID NO: 919362 - DNA, 15 bp, Homo sapiens
catgcctgagggtgg

SEQ ID NO: 919363 - DNA, 13 bp, Homo sapiens
catgcctgccaaa

SEQ ID NO: 919364 - DNA, 14 bp, Homo sapiens
catgcctgccaaag

SEQ ID NO: 919365 - DNA, 20 bp, Homo sapiens
catgcctgcccccctcatct

SEQ ID NO: 919366 - DNA, 19 bp, Homo sapiens
catgcctgcgcctgctgcc

SEQ ID NO: 919367 - DNA, 19 bp, Homo sapiens
catgcctggacaaaccctt

SEQ ID NO: 919368 - DNA, 20 bp, Homo sapiens
catgcctgtccagcctgggc

SEQ ID NO: 919369 - DNA, 14 bp, Homo sapiens
catgccttaaattt

SEQ ID NO: 919370 - DNA, 13 bp, Homo sapiens
catgccttgataa

SEQ ID NO: 919371 - DNA, 15 bp, Homo sapiens
catgcctttgtaagt

SEQ ID NO: 919372 - DNA, 15 bp, Homo sapiens
catgcgaggggccag

SEQ ID NO: 919373 - DNA, 20 bp, Homo sapiens
catgcgaggggccagcagag

SEQ ID NO: 919374 - DNA, 14 bp, Homo sapiens
catgcgcaggctca

SEQ ID NO: 919375 - DNA, 16 bp, Homo sapiens
catgcggagccagcag

SEQ ID NO: 919376 - DNA, 15 bp, Homo sapiens
catgcgggctcgccc

SEQ ID NO: 919377 - DNA, 18 bp, Homo sapiens
catgcggtgggtgctgcc

SEQ ID NO: 919378 - DNA, 23 bp, Homo sapiens
catgcggtttccaaggtgcacat

SEQ ID NO: 919379 - DNA, 17 bp, Homo sapiens
catgcgtatatgtgcgt

SEQ ID NO: 919380 - DNA, 18 bp, Homo sapiens
catgcgtgtgtcagggat

SEQ ID NO: 919381 - DNA, 16 bp, Homo sapiens
catgcgtgtttctgac

SEQ ID NO: 919382 - DNA, 17 bp, Homo sapiens
catgcgtgtttctgact

SEQ ID NO: 919383 - DNA, 17 bp, Homo sapiens
catgctaacctctctga

SEQ ID NO: 919384 - DNA, 16 bp, Homo sapiens
agtatttcaaattgga

SEQ ID NO: 919385 - DNA, 20 bp, Homo sapiens
agtatttcaaattggagctt

SEQ ID NO: 919386 - DNA, 19 bp, Homo sapiens
agtatttcagatgctttag

SEQ ID NO: 919387 - DNA, 16 bp, Homo sapiens
agtatttcatgctggg

SEQ ID NO: 919388 - DNA, 21 bp, Homo sapiens
agtatttcattgcctgtgtat

SEQ ID NO: 919389 - DNA, 18 bp, Homo sapiens
agtatttcccttccaaag

SEQ ID NO: 919390 - DNA, 16 bp, Homo sapiens
agtatttccttccact

SEQ ID NO: 919391 - DNA, 15 bp, Homo sapiens
agtatttctcaggaa

SEQ ID NO: 919392 - DNA, 13 bp, Homo sapiens
agtatttctcttt

SEQ ID NO: 919393 - DNA, 23 bp, Homo sapiens
agtatttctcttttattctgtta

SEQ ID NO: 919394 - DNA, 22 bp, Homo sapiens
agtatttctgggttaaatgaaa

SEQ ID NO: 919395 - DNA, 19 bp, Homo sapiens
agtatttgattcaaaatat

SEQ ID NO: 919396 - DNA, 23 bp, Homo sapiens
agtatttggcttgtcacaggaat

SEQ ID NO: 919397 - DNA, 15 bp, Homo sapiens
agtatttgttaattt

SEQ ID NO: 919398 - DNA, 18 bp, Homo sapiens
agtattttatctggaaca

SEQ ID NO: 919399 - DNA, 18 bp, Homo sapiens
agtattttccagccttat

SEQ ID NO: 919400 - DNA, 14 bp, Homo sapiens
agtatttttaaagg

SEQ ID NO: 919401 - DNA, 13 bp, Homo sapiens
agtatttttaaca

SEQ ID NO: 919402 - DNA, 14 bp, Homo sapiens
agtatttttaacac

SEQ ID NO: 919403 - DNA, 12 bp, Homo sapiens
agtatttttgcc

SEQ ID NO: 919404 - DNA, 14 bp, Homo sapiens
agtatttttgctgc

SEQ ID NO: 919405 - DNA, 16 bp, Homo sapiens
agtatttttgctgctt

SEQ ID NO: 919406 - DNA, 19 bp, Homo sapiens
agtatttttgctgcttctg

SEQ ID NO: 919407 - DNA, 24 bp, Homo sapiens
agtattttttacattttacacact

SEQ ID NO: 919408 - DNA, 14 bp, Homo sapiens
agtattttttcaag

SEQ ID NO: 919409 - DNA, 22 bp, Homo sapiens
agtattttttgtataattggat

SEQ ID NO: 919410 - DNA, 20 bp, Homo sapiens
agtatttttttatcttggga

SEQ ID NO: 919411 - DNA, 20 bp, Homo sapiens
agtatttttttcttaccaaa

SEQ ID NO: 919412 - DNA, 16 bp, Homo sapiens
agtatttttttttaat

SEQ ID NO: 919413 - DNA, 17 bp, Homo sapiens
agtcaaaactacaaatc

SEQ ID NO: 919414 - DNA, 13 bp, Homo sapiens
agtcaaaacttta

SEQ ID NO: 919415 - DNA, 17 bp, Homo sapiens
agtcaaaaggtgcctgt

SEQ ID NO: 919416 - DNA, 21 bp, Homo sapiens
agtcaaacgactaacctatct

SEQ ID NO: 919417 - DNA, 18 bp, Homo sapiens
agtcaaaggcatctccct

SEQ ID NO: 919418 - DNA, 20 bp, Homo sapiens
agtcaaaggcatctcccttc

SEQ ID NO: 919419 - DNA, 12 bp, Homo sapiens
agtcaaagtaaa

SEQ ID NO: 919420 - DNA, 21 bp, Homo sapiens
agtcaaagtaaaacttgctgc

SEQ ID NO: 919421 - DNA, 14 bp, Homo sapiens
agtcaaatgccaaa

SEQ ID NO: 919422 - DNA, 13 bp, Homo sapiens
agtcaaatgggaa

SEQ ID NO: 919423 - DNA, 14 bp, Homo sapiens
agtcaaattaataa

SEQ ID NO: 919424 - DNA, 15 bp, Homo sapiens
agtcaaattaataat

SEQ ID NO: 919425 - DNA, 15 bp, Homo sapiens
agtcaacactcttct

SEQ ID NO: 919426 - DNA, 21 bp, Homo sapiens
agtcaacactcttcttgagca

SEQ ID NO: 919427 - DNA, 15 bp, Homo sapiens
agtcaacagtaaacc

SEQ ID NO: 919428 - DNA, 16 bp, Homo sapiens
agtcaacagtaaacca

SEQ ID NO: 919429 - DNA, 15 bp, Homo sapiens
agtcaagaagaaaaa

SEQ ID NO: 919430 - DNA, 17 bp, Homo sapiens
agtcaagatagaaaggg

SEQ ID NO: 919431 - DNA, 17 bp, Homo sapiens
agtcaagatcaacattc

SEQ ID NO: 919432 - DNA, 15 bp, Homo sapiens
agtcaagcacatgta

SEQ ID NO: 919433 - DNA, 16 bp, Homo sapiens
agtcaagcacatgtaa

SEQ ID NO: 919434 - DNA, 19 bp, Homo sapiens
agtcaagcacatgtaataa

SEQ ID NO: 919435 - DNA, 18 bp, Homo sapiens
agtcaaggtgatatataa

SEQ ID NO: 919436 - DNA, 20 bp, Homo sapiens
agtcaataaaagagctgtct

SEQ ID NO: 919437 - DNA, 15 bp, Homo sapiens
agtcaatcagccttt

SEQ ID NO: 919438 - DNA, 17 bp, Homo sapiens
agtcaatcagcctttag

SEQ ID NO: 919439 - DNA, 18 bp, Homo sapiens
agtcaatcccctcattca

SEQ ID NO: 919440 - DNA, 18 bp, Homo sapiens
agtcaatggcaaagaaaa

SEQ ID NO: 919441 - DNA, 14 bp, Homo sapiens
agtcaatgtgcagt

SEQ ID NO: 919442 - DNA, 21 bp, Homo sapiens
agtcaattctgatgttactga

SEQ ID NO: 919443 - DNA, 15 bp, Homo sapiens
agtcaatttgctgaa

SEQ ID NO: 919444 - DNA, 16 bp, Homo sapiens
agtcaatttgctgaaa

SEQ ID NO: 919445 - DNA, 16 bp, Homo sapiens
agtcacaaactgatct

SEQ ID NO: 919446 - DNA, 20 bp, Homo sapiens
agtcacaaactgatctaaaa

SEQ ID NO: 919447 - DNA, 16 bp, Homo sapiens
agtcacaagagcccag

SEQ ID NO: 919448 - DNA, 17 bp, Homo sapiens
agtcacacagtgttgga

SEQ ID NO: 919449 - DNA, 21 bp, Homo sapiens
agtcacaccagggcaactctt

SEQ ID NO: 919450 - DNA, 16 bp, Homo sapiens
agtcacactgctagca

SEQ ID NO: 919451 - DNA, 12 bp, Homo sapiens
agtcacagctgc

SEQ ID NO: 919452 - DNA, 17 bp, Homo sapiens
agtcacagctgcagctg

SEQ ID NO: 919453 - DNA, 19 bp, Homo sapiens
agtcacagctgcagctggg

SEQ ID NO: 919454 - DNA, 22 bp, Homo sapiens
agtcacagctgcagctgggccc

SEQ ID NO: 919455 - DNA, 21 bp, Homo sapiens
agtcacattgatgtaaggact

SEQ ID NO: 919456 - DNA, 16 bp, Homo sapiens
agtcaccacccagccc

SEQ ID NO: 919457 - DNA, 14 bp, Homo sapiens
agtcaccagagact

SEQ ID NO: 919458 - DNA, 22 bp, Homo sapiens
agtcacccaaacacttctgctt

SEQ ID NO: 919459 - DNA, 16 bp, Homo sapiens
agtcacccagagcaca

SEQ ID NO: 919460 - DNA, 20 bp, Homo sapiens
agtcacccctccctccctct

SEQ ID NO: 919461 - DNA, 19 bp, Homo sapiens
agtcaccctacctgtgcct

SEQ ID NO: 919462 - DNA, 21 bp, Homo sapiens
agtcaccctcctcacagacct

SEQ ID NO: 919463 - DNA, 16 bp, Homo sapiens
agtcacccttctgggc

SEQ ID NO: 919464 - DNA, 17 bp, Homo sapiens
agtcaccgacagcggcc

SEQ ID NO: 919465 - DNA, 13 bp, Homo sapiens
agtcacctcctcc

SEQ ID NO: 919466 - DNA, 14 bp, Homo sapiens
agtcacctgcaagc

SEQ ID NO: 919467 - DNA, 23 bp, Homo sapiens
agtcacctgcaagccccagggcc

SEQ ID NO: 919468 - DNA, 18 bp, Homo sapiens
agtcacctgctccagaag

SEQ ID NO: 919469 - DNA, 21 bp, Homo sapiens
agtcacctgctccagaagatg

SEQ ID NO: 919470 - DNA, 18 bp, Homo sapiens
agtcaccttcccttgcca

SEQ ID NO: 919471 - DNA, 17 bp, Homo sapiens
agtcacctttctgggct

SEQ ID NO: 919472 - DNA, 18 bp, Homo sapiens
agtcacctttctgggctt

SEQ ID NO: 919473 - DNA, 16 bp, Homo sapiens
agtcactaaaaggaag

SEQ ID NO: 919474 - DNA, 21 bp, Homo sapiens
agtcactaaaaggaagacagt

SEQ ID NO: 919475 - DNA, 13 bp, Homo sapiens
agtcactaagact

SEQ ID NO: 919476 - DNA, 19 bp, Homo sapiens
agtcactaggatgcagatg

SEQ ID NO: 919477 - DNA, 13 bp, Homo sapiens
agtcactcctctc

SEQ ID NO: 919478 - DNA, 16 bp, Homo sapiens
agtcactgaacaaaac

SEQ ID NO: 919479 - DNA, 13 bp, Homo sapiens
agtcactgcacag

SEQ ID NO: 919480 - DNA, 14 bp, Homo sapiens
agtcactgcctgca

SEQ ID NO: 919481 - DNA, 17 bp, Homo sapiens
agtcactgctgcaaggt

SEQ ID NO: 919482 - DNA, 23 bp, Homo sapiens
agtcactggaggttgaagccaag

SEQ ID NO: 919483 - DNA, 23 bp, Homo sapiens
agtcactggtctgtttgcatttg

SEQ ID NO: 919484 - DNA, 10 bp, Homo sapiens
agtcactgtc

SEQ ID NO: 919485 - DNA, 23 bp, Homo sapiens
agtcacttaactataaggtgcct

SEQ ID NO: 919486 - DNA, 20 bp, Homo sapiens
agtcacttgatgtgccattt

SEQ ID NO: 919487 - DNA, 21 bp, Homo sapiens
agtcacttgatgtgccatttt

SEQ ID NO: 919488 - DNA, 23 bp, Homo sapiens
agtcacttgggagctgctgggct

SEQ ID NO: 919489 - DNA, 15 bp, Homo sapiens
agtcagaacagcaga

SEQ ID NO: 919490 - DNA, 22 bp, Homo sapiens
agtcagaacagcagactcagct

SEQ ID NO: 919491 - DNA, 15 bp, Homo sapiens
agtcagactgctggg

SEQ ID NO: 919492 - DNA, 11 bp, Homo sapiens
agtcagagccc

SEQ ID NO: 919493 - DNA, 22 bp, Homo sapiens
agtcagagcccctacagcattg

SEQ ID NO: 919494 - DNA, 15 bp, Homo sapiens
agtcagagtccagtg

SEQ ID NO: 919495 - DNA, 18 bp, Homo sapiens
agtcagagtccagtgctc

SEQ ID NO: 919496 - DNA, 14 bp, Homo sapiens
agtcagatgcccag

SEQ ID NO: 919497 - DNA, 23 bp, Homo sapiens
agtcagatggaaaattcattttt

SEQ ID NO: 919498 - DNA, 13 bp, Homo sapiens
agtcagcaccttg

SEQ ID NO: 919499 - DNA, 16 bp, Homo sapiens
agtcagcaccttggcc

SEQ ID NO: 919500 - DNA, 16 bp, Homo sapiens
agtcagccacactggg

SEQ ID NO: 919501 - DNA, 21 bp, Homo sapiens
agtcagccacactgggcctgg

SEQ ID NO: 919502 - DNA, 20 bp, Homo sapiens
agtcagccccgacttcctga

SEQ ID NO: 919503 - DNA, 21 bp, Homo sapiens
agtcagccccgacttcctgac

SEQ ID NO: 919504 - DNA, 11 bp, Homo sapiens
agtcagccctt

SEQ ID NO: 919505 - DNA, 23 bp, Homo sapiens
agtcagccttccccctcccaggg

SEQ ID NO: 919506 - DNA, 14 bp, Homo sapiens
agtcagctctctgc

SEQ ID NO: 919507 - DNA, 12 bp, Homo sapiens
agtcaggaaagg

SEQ ID NO: 919508 - DNA, 13 bp, Homo sapiens
agtcaggccaggt

SEQ ID NO: 919509 - DNA, 14 bp, Homo sapiens
agtcaggccaggtg

SEQ ID NO: 919510 - DNA, 17 bp, Homo sapiens
agtcaggcccaggcact

SEQ ID NO: 919511 - DNA, 15 bp, Homo sapiens
agtcaggcctgggca

SEQ ID NO: 919512 - DNA, 18 bp, Homo sapiens
agtcaggcctgggcagga

SEQ ID NO: 919513 - DNA, 20 bp, Homo sapiens
agtcaggcctgggcaggacc

SEQ ID NO: 919514 - DNA, 23 bp, Homo sapiens
agtcaggcctgggcaggaccctg

SEQ ID NO: 919515 - DNA, 16 bp, Homo sapiens
agtcaggctgcagagg

SEQ ID NO: 919516 - DNA, 17 bp, Homo sapiens
agtcaggggctctgtgt

SEQ ID NO: 919517 - DNA, 18 bp, Homo sapiens
agtcaggggtcaggtgtc

SEQ ID NO: 919518 - DNA, 15 bp, Homo sapiens
agtcaggtaatatac

SEQ ID NO: 919519 - DNA, 19 bp, Homo sapiens
agtcagtaggactccttat

SEQ ID NO: 919520 - DNA, 22 bp, Homo sapiens
agtcagtaggtccaagggccat

SEQ ID NO: 919521 - DNA, 19 bp, Homo sapiens
agtcagttcccggagcaca

SEQ ID NO: 919522 - DNA, 23 bp, Homo sapiens
agtcagttcccggagcacagccc

SEQ ID NO: 919523 - DNA, 18 bp, Homo sapiens
agtcataaaatagtatgt

SEQ ID NO: 919524 - DNA, 17 bp, Homo sapiens
agtcataccaatgaaaa

SEQ ID NO: 919525 - DNA, 15 bp, Homo sapiens
agtcatcaaagcaga

SEQ ID NO: 919526 - DNA, 15 bp, Homo sapiens
agtcatcatcagggc

SEQ ID NO: 919527 - DNA, 16 bp, Homo sapiens
agtcatcatcagggcc

SEQ ID NO: 919528 - DNA, 17 bp, Homo sapiens
agtcatcatcagggcct

SEQ ID NO: 919529 - DNA, 21 bp, Homo sapiens
agtcatcatcagggcctgggg

SEQ ID NO: 919530 - DNA, 16 bp, Homo sapiens
agtcatcatgggtgtt

SEQ ID NO: 919531 - DNA, 21 bp, Homo sapiens
agtcatccaacaagaagaaat

SEQ ID NO: 919532 - DNA, 22 bp, Homo sapiens
agtcatccaacaagaagaaata

SEQ ID NO: 919533 - DNA, 14 bp, Homo sapiens
agtcatcccctctc

SEQ ID NO: 919534 - DNA, 19 bp, Homo sapiens
agtcatcccctctcaggag

SEQ ID NO: 919535 - DNA, 22 bp, Homo sapiens
agtcatcccctctcaggagagt

SEQ ID NO: 919536 - DNA, 18 bp, Homo sapiens
agtcatcctgccctgcag

SEQ ID NO: 919537 - DNA, 17 bp, Homo sapiens
agtcatctccatcagct

SEQ ID NO: 919538 - DNA, 19 bp, Homo sapiens
agtcatctgtaagagcttg

SEQ ID NO: 919539 - DNA, 20 bp, Homo sapiens
agtcatctgtaagagcttgc

SEQ ID NO: 919540 - DNA, 14 bp, Homo sapiens
agtcatctgtttaa

SEQ ID NO: 919541 - DNA, 11 bp, Homo sapiens
agtcatcttgc

SEQ ID NO: 919542 - DNA, 13 bp, Homo sapiens
agtcatcttgcta

SEQ ID NO: 919543 - DNA, 21 bp, Homo sapiens
agtcatgaagcccaagtgaaa

SEQ ID NO: 919544 - DNA, 23 bp, Homo sapiens
agtcatgatctccctgccgcctc

SEQ ID NO: 919545 - DNA, 20 bp, Homo sapiens
agtcatggaatcttgctgca

SEQ ID NO: 919546 - DNA, 19 bp, Homo sapiens
agtcatggcctgagatgca

SEQ ID NO: 919547 - DNA, 22 bp, Homo sapiens
agtcatgggaacgcagcctcca

SEQ ID NO: 919548 - DNA, 10 bp, Homo sapiens
agtcatggta

SEQ ID NO: 919549 - DNA, 18 bp, Homo sapiens
agtcatggtactacccca

SEQ ID NO: 919550 - DNA, 15 bp, Homo sapiens
agtcatggtgttgcg

SEQ ID NO: 919551 - DNA, 17 bp, Homo sapiens
agtcatggtgttgcgta

SEQ ID NO: 919552 - DNA, 14 bp, Homo sapiens
agtcatgtatgcaa

SEQ ID NO: 919553 - DNA, 16 bp, Homo sapiens
agtcatgtatgcaagt

SEQ ID NO: 919554 - DNA, 13 bp, Homo sapiens
agtcatgtatgtt

SEQ ID NO: 919555 - DNA, 15 bp, Homo sapiens
agtcatgtatgtttc

SEQ ID NO: 919556 - DNA, 23 bp, Homo sapiens
agtcattaaagacaggagacaaa

SEQ ID NO: 919557 - DNA, 17 bp, Homo sapiens
agtcattaaattactat

SEQ ID NO: 919558 - DNA, 18 bp, Homo sapiens
agtcattatccttgctat

SEQ ID NO: 919559 - DNA, 22 bp, Homo sapiens
agtcattcagcagcaaattttc

SEQ ID NO: 919560 - DNA, 23 bp, Homo sapiens
agtcattcagcagcaaattttca

SEQ ID NO: 919561 - DNA, 22 bp, Homo sapiens
agtcattcgcgtggctcgggac

SEQ ID NO: 919562 - DNA, 17 bp, Homo sapiens
agtcattcgttctgtgg

SEQ ID NO: 919563 - DNA, 14 bp, Homo sapiens
agtcattgatagaa

SEQ ID NO: 919564 - DNA, 17 bp, Homo sapiens
agtcattgatagaacta

SEQ ID NO: 919565 - DNA, 13 bp, Homo sapiens
agtcattgtatgt

SEQ ID NO: 919566 - DNA, 19 bp, Homo sapiens
agtcatttccgtccccccc

SEQ ID NO: 919567 - DNA, 16 bp, Homo sapiens
agtcatttgagtctct

SEQ ID NO: 919568 - DNA, 18 bp, Homo sapiens
agtcatttgagtctctta

SEQ ID NO: 919569 - DNA, 15 bp, Homo sapiens
agtcatttgtggtta

SEQ ID NO: 919570 - DNA, 19 bp, Homo sapiens
agtcattttaactttatca

SEQ ID NO: 919571 - DNA, 12 bp, Homo sapiens
agtcattttggg

SEQ ID NO: 919572 - DNA, 14 bp, Homo sapiens
agtcatttttagca

SEQ ID NO: 919573 - DNA, 20 bp, Homo sapiens
agtccaaatgtgatcaactg

SEQ ID NO: 919574 - DNA, 15 bp, Homo sapiens
agtccaacctgcctg

SEQ ID NO: 919575 - DNA, 17 bp, Homo sapiens
agtccaactcacttcca

SEQ ID NO: 919576 - DNA, 12 bp, Homo sapiens
agtccaatattt

SEQ ID NO: 919577 - DNA, 14 bp, Homo sapiens
agtccaatgtggca

SEQ ID NO: 919578 - DNA, 14 bp, Homo sapiens
agtccaatttaagg

SEQ ID NO: 919579 - DNA, 14 bp, Homo sapiens
agtccaattttaat

SEQ ID NO: 919580 - DNA, 17 bp, Homo sapiens
agtccacagctgaagag

SEQ ID NO: 919581 - DNA, 13 bp, Homo sapiens
agtccacaggggc

SEQ ID NO: 919582 - DNA, 15 bp, Homo sapiens
agtccacctgaggaa

SEQ ID NO: 919583 - DNA, 14 bp, Homo sapiens
agtccacggacccc

SEQ ID NO: 919584 - DNA, 13 bp, Homo sapiens
agtccactgtcct

SEQ ID NO: 919585 - DNA, 15 bp, Homo sapiens
agtccactgtcctcc

SEQ ID NO: 919586 - DNA, 17 bp, Homo sapiens
agtccactgtcctcctt

SEQ ID NO: 919587 - DNA, 21 bp, Homo sapiens
agtccactgtcctccttggcg

SEQ ID NO: 919588 - DNA, 14 bp, Homo sapiens
agtccactttgttt

SEQ ID NO: 919589 - DNA, 11 bp, Homo sapiens
agtccagacac

SEQ ID NO: 919590 - DNA, 18 bp, Homo sapiens
agtccagacccaagtcaa

SEQ ID NO: 919591 - DNA, 18 bp, Homo sapiens
agtccagatttacactgg

SEQ ID NO: 919592 - DNA, 23 bp, Homo sapiens
agtccagatttacactgggagag

SEQ ID NO: 919593 - DNA, 11 bp, Homo sapiens
agtccagctcc

SEQ ID NO: 919594 - DNA, 14 bp, Homo sapiens
agtccagctctact

SEQ ID NO: 919595 - DNA, 14 bp, Homo sapiens
agtccaggagctca

SEQ ID NO: 919596 - DNA, 21 bp, Homo sapiens
agtccaggcctctctctgctc

SEQ ID NO: 919597 - DNA, 14 bp, Homo sapiens
agtccaggctgccg

SEQ ID NO: 919598 - DNA, 17 bp, Homo sapiens
agtccaggctgccgtgg

SEQ ID NO: 919599 - DNA, 17 bp, Homo sapiens
agtccaggtaaatggta

SEQ ID NO: 919600 - DNA, 17 bp, Homo sapiens
agtccagtgctctgcct

SEQ ID NO: 919601 - DNA, 15 bp, Homo sapiens
agtccataccttata

SEQ ID NO: 919602 - DNA, 18 bp, Homo sapiens
agtccatcaccatttctt

SEQ ID NO: 919603 - DNA, 15 bp, Homo sapiens
agtccatgaaaatac

SEQ ID NO: 919604 - DNA, 13 bp, Homo sapiens
agtccattaactg

SEQ ID NO: 919605 - DNA, 19 bp, Homo sapiens
agtccattttttaaaaatg

SEQ ID NO: 919606 - DNA, 14 bp, Homo sapiens
agtcccaaggaaag

SEQ ID NO: 919607 - DNA, 21 bp, Homo sapiens
agtcccaaggaaagccccagc

SEQ ID NO: 919608 - DNA, 12 bp, Homo sapiens
agtcccacactg

SEQ ID NO: 919609 - DNA, 13 bp, Homo sapiens
agtcccacactgt

SEQ ID NO: 919610 - DNA, 16 bp, Homo sapiens
agtcccacactgtgca

SEQ ID NO: 919611 - DNA, 14 bp, Homo sapiens
agtcccacccggac

SEQ ID NO: 919612 - DNA, 12 bp, Homo sapiens
agtcccagagca

SEQ ID NO: 919613 - DNA, 13 bp, Homo sapiens
agtcccagagccc

SEQ ID NO: 919614 - DNA, 20 bp, Homo sapiens
agtcccaggagctgcccaga

SEQ ID NO: 919615 - DNA, 18 bp, Homo sapiens
agtcccaggctgagcctc

SEQ ID NO: 919616 - DNA, 17 bp, Homo sapiens
agtcccagtattctcag

SEQ ID NO: 919617 - DNA, 20 bp, Homo sapiens
agtcccagtattctcagagc

SEQ ID NO: 919618 - DNA, 21 bp, Homo sapiens
agtcccattcatattaagaca

SEQ ID NO: 919619 - DNA, 18 bp, Homo sapiens
agtcccattcctccactc

SEQ ID NO: 919620 - DNA, 16 bp, Homo sapiens
agtccccacccctgcc

SEQ ID NO: 919621 - DNA, 12 bp, Homo sapiens
agtccccagccc

SEQ ID NO: 919622 - DNA, 18 bp, Homo sapiens
agtccccagccctgggct

SEQ ID NO: 919623 - DNA, 15 bp, Homo sapiens
agtccccagcccttc

SEQ ID NO: 919624 - DNA, 18 bp, Homo sapiens
agtccccatttctgcctc

SEQ ID NO: 919625 - DNA, 22 bp, Homo sapiens
agtcccccaacagatgcttttc

SEQ ID NO: 919626 - DNA, 22 bp, Homo sapiens
agtcccccaactctgagcccat

SEQ ID NO: 919627 - DNA, 18 bp, Homo sapiens
agtcccccaccacactga

SEQ ID NO: 919628 - DNA, 23 bp, Homo sapiens
agtccccgagggcgaaggccatt

SEQ ID NO: 919629 - DNA, 20 bp, Homo sapiens
agtccccgtgccccgcctcc

SEQ ID NO: 919630 - DNA, 23 bp, Homo sapiens
agtccccgtgccccgcctccccg

SEQ ID NO: 919631 - DNA, 13 bp, Homo sapiens
agtcccctcccat

SEQ ID NO: 919632 - DNA, 13 bp, Homo sapiens
agtcccctctctc

SEQ ID NO: 919633 - DNA, 13 bp, Homo sapiens
agtcccgtcagga

SEQ ID NO: 919634 - DNA, 19 bp, Homo sapiens
agtcccgtcgtgcagtcag

SEQ ID NO: 919635 - DNA, 20 bp, Homo sapiens
gcggctctgagcaggggcag

SEQ ID NO: 919636 - DNA, 20 bp, Homo sapiens
gcggctgaactgagaaggca

SEQ ID NO: 919637 - DNA, 22 bp, Homo sapiens
gcggctgagtcatgatctccct

SEQ ID NO: 919638 - DNA, 14 bp, Homo sapiens
gcggctgcacaaca

SEQ ID NO: 919639 - DNA, 19 bp, Homo sapiens
gcggctgggagcctcgccc

SEQ ID NO: 919640 - DNA, 12 bp, Homo sapiens
gcggctgtgctt

SEQ ID NO: 919641 - DNA, 19 bp, Homo sapiens
gcggcttcctgtccactct

SEQ ID NO: 919642 - DNA, 15 bp, Homo sapiens
gcggctttctctgcc

SEQ ID NO: 919643 - DNA, 17 bp, Homo sapiens
gcggctttctctgcctc

SEQ ID NO: 919644 - DNA, 19 bp, Homo sapiens
gcggctttctctgcctctg

SEQ ID NO: 919645 - DNA, 23 bp, Homo sapiens
gcggctttctctgcctctgggca

SEQ ID NO: 919646 - DNA, 14 bp, Homo sapiens
gcgggaaggagggt

SEQ ID NO: 919647 - DNA, 19 bp, Homo sapiens
gcgggaatggcagctgcca

SEQ ID NO: 919648 - DNA, 15 bp, Homo sapiens
gcgggagaactgaag

SEQ ID NO: 919649 - DNA, 14 bp, Homo sapiens
gcgggagacagctt

SEQ ID NO: 919650 - DNA, 21 bp, Homo sapiens
gcgggagccatgcgccccctc

SEQ ID NO: 919651 - DNA, 12 bp, Homo sapiens
gcgggaggaagc

SEQ ID NO: 919652 - DNA, 13 bp, Homo sapiens
gcgggaggaagcc

SEQ ID NO: 919653 - DNA, 21 bp, Homo sapiens
ctcacgtatttcacagagcac

SEQ ID NO: 919654 - DNA, 16 bp, Homo sapiens
ctcacgtccaggttca

SEQ ID NO: 919655 - DNA, 14 bp, Homo sapiens
ctcacgtcctgaga

SEQ ID NO: 919656 - DNA, 17 bp, Homo sapiens
ctcacgtgcaggacagc

SEQ ID NO: 919657 - DNA, 23 bp, Homo sapiens
ctcactaatttttgtattatttt

SEQ ID NO: 919658 - DNA, 16 bp, Homo sapiens
ctcactactgaacaca

SEQ ID NO: 919659 - DNA, 23 bp, Homo sapiens
ctcactaggcccccacttgcctc

SEQ ID NO: 919660 - DNA, 18 bp, Homo sapiens
ctcactaggctaaactca

SEQ ID NO: 919661 - DNA, 23 bp, Homo sapiens
ctcactatggtatgctggccagc

SEQ ID NO: 919662 - DNA, 12 bp, Homo sapiens
ctcactcactcc

SEQ ID NO: 919663 - DNA, 13 bp, Homo sapiens
ctcactcactcca

SEQ ID NO: 919664 - DNA, 18 bp, Homo sapiens
ctcactcactccccactc

SEQ ID NO: 919665 - DNA, 18 bp, Homo sapiens
ctcactcagccaccctga

SEQ ID NO: 919666 - DNA, 14 bp, Homo sapiens
ctcactccaagacc

SEQ ID NO: 919667 - DNA, 14 bp, Homo sapiens
ctcactccacagag

SEQ ID NO: 919668 - DNA, 16 bp, Homo sapiens
ctcactccaccaccca

SEQ ID NO: 919669 - DNA, 17 bp, Homo sapiens
ctcactccaccacccaa

SEQ ID NO: 919670 - DNA, 16 bp, Homo sapiens
ctcactccagccaaag

SEQ ID NO: 919671 - DNA, 19 bp, Homo sapiens
ctcactccagccaaagaaa

SEQ ID NO: 919672 - DNA, 12 bp, Homo sapiens
ctcactccccag

SEQ ID NO: 919673 - DNA, 16 bp, Homo sapiens
ctcactccccagggag

SEQ ID NO: 919674 - DNA, 19 bp, Homo sapiens
ctcactcctacctggtaat

SEQ ID NO: 919675 - DNA, 13 bp, Homo sapiens
ctcactcctagga

SEQ ID NO: 919676 - DNA, 19 bp, Homo sapiens
ctcactcctaggagagcca

SEQ ID NO: 919677 - DNA, 11 bp, Homo sapiens
ctcactcctgc

SEQ ID NO: 919678 - DNA, 20 bp, Homo sapiens
ctcactcctgttacttacct

SEQ ID NO: 919679 - DNA, 14 bp, Homo sapiens
ctcactccttttaa

SEQ ID NO: 919680 - DNA, 14 bp, Homo sapiens
ctcactctgggctg

SEQ ID NO: 919681 - DNA, 14 bp, Homo sapiens
ctcactctgtccct

SEQ ID NO: 919682 - DNA, 17 bp, Homo sapiens
ctcactctgttgcccag

SEQ ID NO: 919683 - DNA, 18 bp, Homo sapiens
ctcactgaaaacatctgg

SEQ ID NO: 919684 - DNA, 15 bp, Homo sapiens
ctcactgaagcctgc

SEQ ID NO: 919685 - DNA, 22 bp, Homo sapiens
ctcactgaggccatcagggccc

SEQ ID NO: 919686 - DNA, 23 bp, Homo sapiens
ctcactgaggccatcagggccct

SEQ ID NO: 919687 - DNA, 21 bp, Homo sapiens
ctcactgcaacctccgcctct

SEQ ID NO: 919688 - DNA, 22 bp, Homo sapiens
ctcactgcagcctcaacctcct

SEQ ID NO: 919689 - DNA, 15 bp, Homo sapiens
ctcactgcagccttg

SEQ ID NO: 919690 - DNA, 15 bp, Homo sapiens
ctcactgcagtctta

SEQ ID NO: 919691 - DNA, 13 bp, Homo sapiens
ctcactgccaggc

SEQ ID NO: 919692 - DNA, 14 bp, Homo sapiens
ctcactgccaggcc

SEQ ID NO: 919693 - DNA, 12 bp, Homo sapiens
ctcactgccctc

SEQ ID NO: 919694 - DNA, 12 bp, Homo sapiens
ctcactgcctag

SEQ ID NO: 919695 - DNA, 17 bp, Homo sapiens
ctcactgcctggtaaaa

SEQ ID NO: 919696 - DNA, 16 bp, Homo sapiens
ctcactgctcaagaag

SEQ ID NO: 919697 - DNA, 14 bp, Homo sapiens
ctcactggaggagc

SEQ ID NO: 919698 - DNA, 18 bp, Homo sapiens
ctcactggctctcctggc

SEQ ID NO: 919699 - DNA, 13 bp, Homo sapiens
ctcactggctggg

SEQ ID NO: 919700 - DNA, 14 bp, Homo sapiens
ctcactggctgggg

SEQ ID NO: 919701 - DNA, 16 bp, Homo sapiens
ctcactggctggggca

SEQ ID NO: 919702 - DNA, 20 bp, Homo sapiens
ctcactggctggggcagagg

SEQ ID NO: 919703 - DNA, 22 bp, Homo sapiens
ctcactggctggggcagagggg

SEQ ID NO: 919704 - DNA, 18 bp, Homo sapiens
ctcactgggaagctccca

SEQ ID NO: 919705 - DNA, 12 bp, Homo sapiens
ctcactgggtgg

SEQ ID NO: 919706 - DNA, 23 bp, Homo sapiens
ctcactgtgggaaggccagctgc

SEQ ID NO: 919707 - DNA, 15 bp, Homo sapiens
ctcactgttctgcaa

SEQ ID NO: 919708 - DNA, 20 bp, Homo sapiens
ctcacttacataaagctccc

SEQ ID NO: 919709 - DNA, 13 bp, Homo sapiens
ctcacttatacca

SEQ ID NO: 919710 - DNA, 14 bp, Homo sapiens
ctcacttataccaa

SEQ ID NO: 919711 - DNA, 15 bp, Homo sapiens
ctcacttatctgata

SEQ ID NO: 919712 - DNA, 13 bp, Homo sapiens
ctcacttctaaat

SEQ ID NO: 919713 - DNA, 19 bp, Homo sapiens
ctcacttctcagctgaaat

SEQ ID NO: 919714 - DNA, 20 bp, Homo sapiens
ctcactttcctcctgaggct

SEQ ID NO: 919715 - DNA, 23 bp, Homo sapiens
ctcacttttcaatttgtcatgtt

SEQ ID NO: 919716 - DNA, 23 bp, Homo sapiens
ctcacttttcacttgtcttgctc

SEQ ID NO: 919717 - DNA, 14 bp, Homo sapiens
ctcacttttctcca

SEQ ID NO: 919718 - DNA, 19 bp, Homo sapiens
ctcactttttacccagaac

SEQ ID NO: 919719 - DNA, 21 bp, Homo sapiens
ctcactttttacccagaacag

SEQ ID NO: 919720 - DNA, 19 bp, Homo sapiens
ctcagaaaaaggcagtggc

SEQ ID NO: 919721 - DNA, 16 bp, Homo sapiens
ctcagaaactcccctg

SEQ ID NO: 919722 - DNA, 20 bp, Homo sapiens
ctcagaaagtcaccaggact

SEQ ID NO: 919723 - DNA, 21 bp, Homo sapiens
ctcagaaagtcaccaggactt

SEQ ID NO: 919724 - DNA, 15 bp, Homo sapiens
ctcagaaagtgcctg

SEQ ID NO: 919725 - DNA, 21 bp, Homo sapiens
ctcagaaatggacaaagaaaa

SEQ ID NO: 919726 - DNA, 21 bp, Homo sapiens
ctcagaacatactgattggga

SEQ ID NO: 919727 - DNA, 23 bp, Homo sapiens
ctcagaaccatttaagagactct

SEQ ID NO: 919728 - DNA, 20 bp, Homo sapiens
ctcagaacccacagtgagag

SEQ ID NO: 919729 - DNA, 13 bp, Homo sapiens
ctcagaacccagg

SEQ ID NO: 919730 - DNA, 16 bp, Homo sapiens
ctcagaacccagggct

SEQ ID NO: 919731 - DNA, 23 bp, Homo sapiens
ctcagaacccagggctctgcccc

SEQ ID NO: 919732 - DNA, 20 bp, Homo sapiens
ctcagaacctgttattttat

SEQ ID NO: 919733 - DNA, 19 bp, Homo sapiens
ctcagaacttgctgctgtc

SEQ ID NO: 919734 - DNA, 13 bp, Homo sapiens
ctcagaagagcag

SEQ ID NO: 919735 - DNA, 11 bp, Homo sapiens
ctcagaagcct

SEQ ID NO: 919736 - DNA, 13 bp, Homo sapiens
ctcagaaggtatt

SEQ ID NO: 919737 - DNA, 15 bp, Homo sapiens
ctcagaagtactttt

SEQ ID NO: 919738 - DNA, 17 bp, Homo sapiens
ctcagaataaggcaggc

SEQ ID NO: 919739 - DNA, 18 bp, Homo sapiens
ctcagaatattgtctgcc

SEQ ID NO: 919740 - DNA, 16 bp, Homo sapiens
ctcagaatctcaaata

SEQ ID NO: 919741 - DNA, 17 bp, Homo sapiens
ctcagaatctcaaataa

SEQ ID NO: 919742 - DNA, 20 bp, Homo sapiens
ctcagaatgggggctttcgg

SEQ ID NO: 919743 - DNA, 17 bp, Homo sapiens
ctcagaatgtaaaagaa

SEQ ID NO: 919744 - DNA, 17 bp, Homo sapiens
ctcagaattatttttaa

SEQ ID NO: 919745 - DNA, 14 bp, Homo sapiens
ctcagacatctcca

SEQ ID NO: 919746 - DNA, 19 bp, Homo sapiens
ctcagacatctccagtgtg

SEQ ID NO: 919747 - DNA, 19 bp, Homo sapiens
ctcagacatgttttccgtg

SEQ ID NO: 919748 - DNA, 14 bp, Homo sapiens
ctcagacattccaa

SEQ ID NO: 919749 - DNA, 16 bp, Homo sapiens
ctcagaccagctcttc

SEQ ID NO: 919750 - DNA, 14 bp, Homo sapiens
ctcagaccctttct

SEQ ID NO: 919751 - DNA, 15 bp, Homo sapiens
ctcagacgttgcctg

SEQ ID NO: 919752 - DNA, 16 bp, Homo sapiens
ctcagacgttgcctga

SEQ ID NO: 919753 - DNA, 18 bp, Homo sapiens
ctcagacgttgcctgaga

SEQ ID NO: 919754 - DNA, 14 bp, Homo sapiens
ctcagactccattt

SEQ ID NO: 919755 - DNA, 16 bp, Homo sapiens
ctcagacttaccagga

SEQ ID NO: 919756 - DNA, 19 bp, Homo sapiens
ctcagagaaaaatgctccc

SEQ ID NO: 919757 - DNA, 20 bp, Homo sapiens
ctcagagaaaaatgctcccc

SEQ ID NO: 919758 - DNA, 23 bp, Homo sapiens
ctcagagaaaaatgctccccaca

SEQ ID NO: 919759 - DNA, 19 bp, Homo sapiens
ctcagagaaccagtgcaga

SEQ ID NO: 919760 - DNA, 22 bp, Homo sapiens
ctcagagacactgttgataaaa

SEQ ID NO: 919761 - DNA, 16 bp, Homo sapiens
ctcagagaccagcact

SEQ ID NO: 919762 - DNA, 21 bp, Homo sapiens
ctcagagaccagcactcagcc

SEQ ID NO: 919763 - DNA, 24 bp, Homo sapiens
ctcagagaccagcactcagcctca

SEQ ID NO: 919764 - DNA, 21 bp, Homo sapiens
ctcagagaccagggctccagc

SEQ ID NO: 919765 - DNA, 20 bp, Homo sapiens
ctcagagagttgtctgtcca

SEQ ID NO: 919766 - DNA, 14 bp, Homo sapiens
ctcagagcaggctc

SEQ ID NO: 919767 - DNA, 14 bp, Homo sapiens
ctcagagcatgtgt

SEQ ID NO: 919768 - DNA, 19 bp, Homo sapiens
ctcagagccctgccctgca

SEQ ID NO: 919769 - DNA, 15 bp, Homo sapiens
ctcagagcctgacct

SEQ ID NO: 919770 - DNA, 22 bp, Homo sapiens
gctaagtctttcccaatctcta

SEQ ID NO: 919771 - DNA, 14 bp, Homo sapiens
gctaagtgcttatt

SEQ ID NO: 919772 - DNA, 20 bp, Homo sapiens
gctaataaaattcgctttct

SEQ ID NO: 919773 - DNA, 12 bp, Homo sapiens
gctaataaactg

SEQ ID NO: 919774 - DNA, 15 bp, Homo sapiens
gctaataaactgtat

SEQ ID NO: 919775 - DNA, 14 bp, Homo sapiens
gctcaggcaagccc

SEQ ID NO: 919776 - DNA, 21 bp, Homo sapiens
gctcaggcaagcccctcagcc

SEQ ID NO: 919777 - DNA, 23 bp, Homo sapiens
gctcaggcagacaagagctgctg

SEQ ID NO: 919778 - DNA, 17 bp, Homo sapiens
gctcaggcctccctagc

SEQ ID NO: 919779 - DNA, 12 bp, Homo sapiens
gctcaggctgca

SEQ ID NO: 919780 - DNA, 20 bp, Homo sapiens
gctcaggctggagtgcagtg

SEQ ID NO: 919781 - DNA, 17 bp, Homo sapiens
gctcagggaaaagcagc

SEQ ID NO: 919782 - DNA, 15 bp, Homo sapiens
gctcagggcagtggc

SEQ ID NO: 919783 - DNA, 23 bp, Homo sapiens
gctcagggcagtggcttctttcc

SEQ ID NO: 919784 - DNA, 11 bp, Homo sapiens
ctcaggggcag

SEQ ID NO: 919785 - DNA, 19 bp, Homo sapiens
ctcaggggcaggtggtgga

SEQ ID NO: 919786 - DNA, 13 bp, Homo sapiens
ctcaggggccaga

SEQ ID NO: 919787 - DNA, 18 bp, Homo sapiens
ctcaggggccagaggaac

SEQ ID NO: 919788 - DNA, 22 bp, Homo sapiens
ctcaggggccagtgagggctgg

SEQ ID NO: 919789 - DNA, 14 bp, Homo sapiens
ctcaggggctgttt

SEQ ID NO: 919790 - DNA, 14 bp, Homo sapiens
ctcagggggccagc

SEQ ID NO: 919791 - DNA, 19 bp, Homo sapiens
ctcagggggccagctgggg

SEQ ID NO: 919792 - DNA, 18 bp, Homo sapiens
ctcagggggtaggagagc

SEQ ID NO: 919793 - DNA, 23 bp, Homo sapiens
ctcagggggtaggagagcactgc

SEQ ID NO: 919794 - DNA, 21 bp, Homo sapiens
ctcagggtcactgtccttgaa

SEQ ID NO: 919795 - DNA, 16 bp, Homo sapiens
ctcagggtcctgccct

SEQ ID NO: 919796 - DNA, 17 bp, Homo sapiens
ctcagggtcctgccctc

SEQ ID NO: 919797 - DNA, 15 bp, Homo sapiens
ctcagggtgcagagg

SEQ ID NO: 919798 - DNA, 16 bp, Homo sapiens
ctcagggtgcagaggt

SEQ ID NO: 919799 - DNA, 13 bp, Homo sapiens
ctcagggtggggg

SEQ ID NO: 919800 - DNA, 17 bp, Homo sapiens
ctcagggtggggggtga

SEQ ID NO: 919801 - DNA, 16 bp, Homo sapiens
ctcagggttggccatt

SEQ ID NO: 919802 - DNA, 17 bp, Homo sapiens
ctcaggtaatcatttta

SEQ ID NO: 919803 - DNA, 16 bp, Homo sapiens
ctcaggtacagcgggc

SEQ ID NO: 919804 - DNA, 20 bp, Homo sapiens
ctcaggtacagcgggctgtg

SEQ ID NO: 919805 - DNA, 21 bp, Homo sapiens
ctcaggtaggaagcaacagct

SEQ ID NO: 919806 - DNA, 15 bp, Homo sapiens
ctcaggtcagctggg

SEQ ID NO: 919807 - DNA, 19 bp, Homo sapiens
ctcaggtctgtaactgccc

SEQ ID NO: 919808 - DNA, 21 bp, Homo sapiens
ctcaggtctgtaactgcccag

SEQ ID NO: 919809 - DNA, 20 bp, Homo sapiens
ctcaggtgagaagcagagga

SEQ ID NO: 919810 - DNA, 21 bp, Homo sapiens
ctcaggtgatctgcccgcctc

SEQ ID NO: 919811 - DNA, 13 bp, Homo sapiens
ctcaggtgcacac

SEQ ID NO: 919812 - DNA, 13 bp, Homo sapiens
ctcaggtgccact

SEQ ID NO: 919813 - DNA, 11 bp, Homo sapiens
ctcaggtgcct

SEQ ID NO: 919814 - DNA, 14 bp, Homo sapiens
ctcaggtgcctcca

SEQ ID NO: 919815 - DNA, 21 bp, Homo sapiens
ctcaggtggccatgcctcagc

SEQ ID NO: 919816 - DNA, 14 bp, Homo sapiens
ctcaggtgggccct

SEQ ID NO: 919817 - DNA, 17 bp, Homo sapiens
ctcaggtgtagctgagc

SEQ ID NO: 919818 - DNA, 14 bp, Homo sapiens
ctcaggtgttgcca

SEQ ID NO: 919819 - DNA, 13 bp, Homo sapiens
ctcaggttccaga

SEQ ID NO: 919820 - DNA, 19 bp, Homo sapiens
ctcaggttgtagtaaagaa

SEQ ID NO: 919821 - DNA, 20 bp, Homo sapiens
ctcaggtttgcctgagggcg

SEQ ID NO: 919822 - DNA, 16 bp, Homo sapiens
ctcaggtttgtcctgg

SEQ ID NO: 919823 - DNA, 20 bp, Homo sapiens
ctcaggtttgtcctggtcat

SEQ ID NO: 919824 - DNA, 23 bp, Homo sapiens
ctcaggtttgtcctggtcatgca

SEQ ID NO: 919825 - DNA, 15 bp, Homo sapiens
ctcaggtttgttttg

SEQ ID NO: 919826 - DNA, 14 bp, Homo sapiens
ctcagtaaaatgaa

SEQ ID NO: 919827 - DNA, 21 bp, Homo sapiens
ctcagtaaacgggaacatgcc

SEQ ID NO: 919828 - DNA, 16 bp, Homo sapiens
ctcagtaacatttctg

SEQ ID NO: 919829 - DNA, 18 bp, Homo sapiens
ctcagtaacatttctgtt

SEQ ID NO: 919830 - DNA, 19 bp, Homo sapiens
ctcagtaacatttctgttc

SEQ ID NO: 919831 - DNA, 22 bp, Homo sapiens
ctcagtaacatttctgttctca

SEQ ID NO: 919832 - DNA, 22 bp, Homo sapiens
ctcagtaatttagaaatcattt

SEQ ID NO: 919833 - DNA, 13 bp, Homo sapiens
ctcagtaatttgt

SEQ ID NO: 919834 - DNA, 16 bp, Homo sapiens
ctcagtactgtacagg

SEQ ID NO: 919835 - DNA, 17 bp, Homo sapiens
ctcagtactttggaggc

SEQ ID NO: 919836 - DNA, 20 bp, Homo sapiens
ctcagtactttggaggcccc

SEQ ID NO: 919837 - DNA, 16 bp, Homo sapiens
ctcagtagtccctgca

SEQ ID NO: 919838 - DNA, 18 bp, Homo sapiens
ctcagtatatttaaactc

SEQ ID NO: 919839 - DNA, 21 bp, Homo sapiens
ctcagtattactttctgccgc

SEQ ID NO: 919840 - DNA, 15 bp, Homo sapiens
ctcagtcacccccac

SEQ ID NO: 919841 - DNA, 22 bp, Homo sapiens
ctcagtcagttcccggagcaca

SEQ ID NO: 919842 - DNA, 17 bp, Homo sapiens
ctcagtcatcaaagcag

SEQ ID NO: 919843 - DNA, 23 bp, Homo sapiens
ctcagtccactgttgagccccag

SEQ ID NO: 919844 - DNA, 15 bp, Homo sapiens
ctcagtctcaggagc

SEQ ID NO: 919845 - DNA, 16 bp, Homo sapiens
ctcagtctcaggagca

SEQ ID NO: 919846 - DNA, 16 bp, Homo sapiens
ctcagtctccctccct

SEQ ID NO: 919847 - DNA, 15 bp, Homo sapiens
ctcagtctccctttc

SEQ ID NO: 919848 - DNA, 17 bp, Homo sapiens
ctcagtctctcttctct

SEQ ID NO: 919849 - DNA, 14 bp, Homo sapiens
ctcagtctcttcca

SEQ ID NO: 919850 - DNA, 16 bp, Homo sapiens
ctcagtctcttccaca

SEQ ID NO: 919851 - DNA, 14 bp, Homo sapiens
ctcagtctgttcac

SEQ ID NO: 919852 - DNA, 15 bp, Homo sapiens
ctcagtgaagaatac

SEQ ID NO: 919853 - DNA, 13 bp, Homo sapiens
ctcagtgactgtt

SEQ ID NO: 919854 - DNA, 14 bp, Homo sapiens
ctcagtgactgttg

SEQ ID NO: 919855 - DNA, 17 bp, Homo sapiens
ctcagtgagcctcctgt

SEQ ID NO: 919856 - DNA, 16 bp, Homo sapiens
ctcagtgcatttgtgc

SEQ ID NO: 919857 - DNA, 13 bp, Homo sapiens
ctcagtgccacct

SEQ ID NO: 919858 - DNA, 22 bp, Homo sapiens
ctcagtgccacttgacattcct

SEQ ID NO: 919859 - DNA, 15 bp, Homo sapiens
ctcagtgccctccag

SEQ ID NO: 919860 - DNA, 16 bp, Homo sapiens
ctcagtgccctccagc

SEQ ID NO: 919861 - DNA, 13 bp, Homo sapiens
ctcagtgcctcca

SEQ ID NO: 919862 - DNA, 18 bp, Homo sapiens
ctcagtgcttgggctcca

SEQ ID NO: 919863 - DNA, 19 bp, Homo sapiens
ctcagtgcttgggctccac

SEQ ID NO: 919864 - DNA, 16 bp, Homo sapiens
ctcagtggactttcca

SEQ ID NO: 919865 - DNA, 19 bp, Homo sapiens
ctcagtggactttccaccc

SEQ ID NO: 919866 - DNA, 21 bp, Homo sapiens
ctcagtggatcttcagaactg

SEQ ID NO: 919867 - DNA, 20 bp, Homo sapiens
ctcagtgggacaaaccagag

SEQ ID NO: 919868 - DNA, 17 bp, Homo sapiens
ctcagtggtagctctgg

SEQ ID NO: 919869 - DNA, 12 bp, Homo sapiens
ctcagtgtattt

SEQ ID NO: 919870 - DNA, 16 bp, Homo sapiens
ctcagtgtatttgtat

SEQ ID NO: 919871 - DNA, 10 bp, Homo sapiens
ctcagtgtca

SEQ ID NO: 919872 - DNA, 17 bp, Homo sapiens
ctcagtgtcatttatga

SEQ ID NO: 919873 - DNA, 20 bp, Homo sapiens
ctcagtgtccagcttccaaa

SEQ ID NO: 919874 - DNA, 22 bp, Homo sapiens
ctcagtgtccagcttccaaagc

SEQ ID NO: 919875 - DNA, 16 bp, Homo sapiens
ctcagtgttagagaaa

SEQ ID NO: 919876 - DNA, 23 bp, Homo sapiens
ctcagtgttttggactccatctc

SEQ ID NO: 919877 - DNA, 13 bp, Homo sapiens
ctcagttacacag

SEQ ID NO: 919878 - DNA, 14 bp, Homo sapiens
ctcagttacacagg

SEQ ID NO: 919879 - DNA, 14 bp, Homo sapiens
ctcagttcccagct

SEQ ID NO: 919880 - DNA, 18 bp, Homo sapiens
ctcagttcccagctcccc

SEQ ID NO: 919881 - DNA, 20 bp, Homo sapiens
ctcagttcccagctcccccc

SEQ ID NO: 919882 - DNA, 17 bp, Homo sapiens
ctcagttcccttggcct

SEQ ID NO: 919883 - DNA, 21 bp, Homo sapiens
ctcagttcccttggcctcaga

SEQ ID NO: 919884 - DNA, 22 bp, Homo sapiens
ctcagttcccttggcctcagaa

SEQ ID NO: 919885 - DNA, 24 bp, Homo sapiens
ctcagttccttcatttccaccagg

SEQ ID NO: 919886 - DNA, 19 bp, Homo sapiens
ctcagttctagtctctctg

SEQ ID NO: 919887 - DNA, 15 bp, Homo sapiens
ctcagttctctccct

SEQ ID NO: 919888 - DNA, 16 bp, Homo sapiens
ctcagttctctccctt

SEQ ID NO: 919889 - DNA, 22 bp, Homo sapiens
ctcagttctctcccttcctctc

SEQ ID NO: 919890 - DNA, 23 bp, Homo sapiens
ctcagttctctcccttcctctct

SEQ ID NO: 919891 - DNA, 18 bp, Homo sapiens
ctcagttctcttgctttc

SEQ ID NO: 919892 - DNA, 17 bp, Homo sapiens
ctcagttgtttgcttct

SEQ ID NO: 919893 - DNA, 17 bp, Homo sapiens
ctcagtttaatccttct

SEQ ID NO: 919894 - DNA, 22 bp, Homo sapiens
ctcagtttggtagtgccccacc

SEQ ID NO: 919895 - DNA, 13 bp, Homo sapiens
ctcagtttgtcag

SEQ ID NO: 919896 - DNA, 22 bp, Homo sapiens
ctcagtttgtgtgtcttaatta

SEQ ID NO: 919897 - DNA, 21 bp, Homo sapiens
ctcatggcgtaatgggcctgc

SEQ ID NO: 919898 - DNA, 23 bp, Homo sapiens
ctcatggcgtaatgggcctgccc

SEQ ID NO: 919899 - DNA, 12 bp, Homo sapiens
ctcatgggaagc

SEQ ID NO: 919900 - DNA, 21 bp, Homo sapiens
ctcatgggaagcaggacctag

SEQ ID NO: 919901 - DNA, 22 bp, Homo sapiens
ctcatgggaagcaggacctaga

SEQ ID NO: 919902 - DNA, 15 bp, Homo sapiens
ctcatgggtggctgt

SEQ ID NO: 919903 - DNA, 12 bp, Homo sapiens
ctcatgtaacat

SEQ ID NO: 919904 - DNA, 16 bp, Homo sapiens
ctcatgtaacattggt

SEQ ID NO: 919905 - DNA, 15 bp, Homo sapiens
ctcatgtaatttgca

SEQ ID NO: 919906 - DNA, 18 bp, Homo sapiens
ctcatgtaggtgagcctg

SEQ ID NO: 919907 - DNA, 22 bp, Homo sapiens
ctcatgtaggtgagcctgggca

SEQ ID NO: 919908 - DNA, 23 bp, Homo sapiens
ctcatgtaggtgagcctgggcag

SEQ ID NO: 919909 - DNA, 12 bp, Homo sapiens
ctcatgtatctt

SEQ ID NO: 919910 - DNA, 19 bp, Homo sapiens
ctcatgtccccttcctgtt

SEQ ID NO: 919911 - DNA, 13 bp, Homo sapiens
ctcatgtccctcc

SEQ ID NO: 919912 - DNA, 14 bp, Homo sapiens
ctcatgtccctcca

SEQ ID NO: 919913 - DNA, 20 bp, Homo sapiens
ctcatgtgcaataggtgaga

SEQ ID NO: 919914 - DNA, 15 bp, Homo sapiens
ctcatgtggctggaa

SEQ ID NO: 919915 - DNA, 18 bp, Homo sapiens
gctcccaccccaccccct

SEQ ID NO: 919916 - DNA, 13 bp, Homo sapiens
gctcccaccccag

SEQ ID NO: 919917 - DNA, 16 bp, Homo sapiens
gctcccaccgccccca

SEQ ID NO: 919918 - DNA, 17 bp, Homo sapiens
gctcccaccgcccccac

SEQ ID NO: 919919 - DNA, 23 bp, Homo sapiens
gctcccaccgcccccaccccttc

SEQ ID NO: 919920 - DNA, 15 bp, Homo sapiens
gctcccacctagtgc

SEQ ID NO: 919921 - DNA, 18 bp, Homo sapiens
gctcccacctagtgcccc

SEQ ID NO: 919922 - DNA, 16 bp, Homo sapiens
gctcccacctcccttc

SEQ ID NO: 919923 - DNA, 18 bp, Homo sapiens
gctcccacctcccttccc

SEQ ID NO: 919924 - DNA, 23 bp, Homo sapiens
gctcccagcagccctaaggatct

SEQ ID NO: 919925 - DNA, 12 bp, Homo sapiens
gctcccagcctg

SEQ ID NO: 919926 - DNA, 14 bp, Homo sapiens
gctcccagcctgct

SEQ ID NO: 919927 - DNA, 12 bp, Homo sapiens
gctcccagctcc

SEQ ID NO: 919928 - DNA, 13 bp, Homo sapiens
gctcccagctgtg

SEQ ID NO: 919929 - DNA, 13 bp, Homo sapiens
gctcccagggtgg

SEQ ID NO: 919930 - DNA, 20 bp, Homo sapiens
gctcccaggttcccccagca

SEQ ID NO: 919931 - DNA, 21 bp, Homo sapiens
gctcccaggttcccccagcaa

SEQ ID NO: 919932 - DNA, 15 bp, Homo sapiens
gctcccatcattcct

SEQ ID NO: 919933 - DNA, 15 bp, Homo sapiens
gctcccattcctccc

SEQ ID NO: 919934 - DNA, 20 bp, Homo sapiens
gctccccaacacctgcctct

SEQ ID NO: 919935 - DNA, 21 bp, Homo sapiens
gctccccacagcgtccctggc

SEQ ID NO: 919936 - DNA, 22 bp, Homo sapiens
gctccccacagcgtccctggcg

SEQ ID NO: 919937 - DNA, 13 bp, Homo sapiens
gctccccacagct

SEQ ID NO: 919938 - DNA, 17 bp, Homo sapiens
gctccccacctggacac

SEQ ID NO: 919939 - DNA, 12 bp, Homo sapiens
gctccccacgag

SEQ ID NO: 919940 - DNA, 21 bp, Homo sapiens
gctccccacgagtcacctgca

SEQ ID NO: 919941 - DNA, 14 bp, Homo sapiens
gctccccagccctg

SEQ ID NO: 919942 - DNA, 15 bp, Homo sapiens
gctccccagccctgg

SEQ ID NO: 919943 - DNA, 22 bp, Homo sapiens
gctccccagccctggctctgca

SEQ ID NO: 919944 - DNA, 12 bp, Homo sapiens
gctccccatgtg

SEQ ID NO: 919945 - DNA, 20 bp, Homo sapiens
gctcccccaccccctcccca

SEQ ID NO: 919946 - DNA, 22 bp, Homo sapiens
gctcccccaccccctccccagg

SEQ ID NO: 919947 - DNA, 18 bp, Homo sapiens
gctcccccatcctcccct

SEQ ID NO: 919948 - DNA, 13 bp, Homo sapiens
gctccccccgccc

SEQ ID NO: 919949 - DNA, 14 bp, Homo sapiens
gctccccctctgct

SEQ ID NO: 919950 - DNA, 23 bp, Homo sapiens
gctccccgagggctcagaagagc

SEQ ID NO: 919951 - DNA, 17 bp, Homo sapiens
gctccccgcctccactc

SEQ ID NO: 919952 - DNA, 20 bp, Homo sapiens
gctccccgcctccactctag

SEQ ID NO: 919953 - DNA, 11 bp, Homo sapiens
gctcccctcca

SEQ ID NO: 919954 - DNA, 16 bp, Homo sapiens
gctcccctccacagct

SEQ ID NO: 919955 - DNA, 17 bp, Homo sapiens
gctcccctccatcccca

SEQ ID NO: 919956 - DNA, 23 bp, Homo sapiens
gctcccctccatccccatcggcc

SEQ ID NO: 919957 - DNA, 21 bp, Homo sapiens
gctcccctcccaggggagcca

SEQ ID NO: 919958 - DNA, 21 bp, Homo sapiens
gctcccctctgcttctcatcc

SEQ ID NO: 919959 - DNA, 14 bp, Homo sapiens
gctcccctctggaa

SEQ ID NO: 919960 - DNA, 13 bp, Homo sapiens
gctcccctcttcc

SEQ ID NO: 919961 - DNA, 15 bp, Homo sapiens
gctcccctcttcctc

SEQ ID NO: 919962 - DNA, 16 bp, Homo sapiens
gctcccctcttcctct

SEQ ID NO: 919963 - DNA, 22 bp, Homo sapiens
gctccccttggacctccagggg

SEQ ID NO: 919964 - DNA, 21 bp, Homo sapiens
gctcccgcatttctcatgctt

SEQ ID NO: 919965 - DNA, 15 bp, Homo sapiens
gctcccgctcccagg

SEQ ID NO: 919966 - DNA, 18 bp, Homo sapiens
gctcccggcccgcctgcc

SEQ ID NO: 919967 - DNA, 18 bp, Homo sapiens
gctccctaaactttggcc

SEQ ID NO: 919968 - DNA, 23 bp, Homo sapiens
gctccctaagccagcctggtcca

SEQ ID NO: 919969 - DNA, 17 bp, Homo sapiens
gctccctacattcccca

SEQ ID NO: 919970 - DNA, 22 bp, Homo sapiens
gctccctacattccccagagtg

SEQ ID NO: 919971 - DNA, 16 bp, Homo sapiens
gctccctagactgcat

SEQ ID NO: 919972 - DNA, 21 bp, Homo sapiens
gctccctagactgcatcccgt

SEQ ID NO: 919973 - DNA, 20 bp, Homo sapiens
gctccctcccctgccctggt

SEQ ID NO: 919974 - DNA, 23 bp, Homo sapiens
gctccctcccgtagtctcctggg

SEQ ID NO: 919975 - DNA, 18 bp, Homo sapiens
gctccctcctccaggcct

SEQ ID NO: 919976 - DNA, 22 bp, Homo sapiens
gctccctcctccaggcctgcct

SEQ ID NO: 919977 - DNA, 14 bp, Homo sapiens
gctccctcctctgg

SEQ ID NO: 919978 - DNA, 13 bp, Homo sapiens
gctccctcctgga

SEQ ID NO: 919979 - DNA, 16 bp, Homo sapiens
gctccctcctggagca

SEQ ID NO: 919980 - DNA, 19 bp, Homo sapiens
gctccctcctggagcatcc

SEQ ID NO: 919981 - DNA, 14 bp, Homo sapiens
gctccctctctggt

SEQ ID NO: 919982 - DNA, 15 bp, Homo sapiens
gctccctctgggttc

SEQ ID NO: 919983 - DNA, 13 bp, Homo sapiens
gctccctctgtta

SEQ ID NO: 919984 - DNA, 18 bp, Homo sapiens
gctccctcttcctctcca

SEQ ID NO: 919985 - DNA, 13 bp, Homo sapiens
gctccctgacttc

SEQ ID NO: 919986 - DNA, 18 bp, Homo sapiens
gctccctgacttctcccc

SEQ ID NO: 919987 - DNA, 13 bp, Homo sapiens
gctccctgcaccg

SEQ ID NO: 919988 - DNA, 15 bp, Homo sapiens
gctccctgcaccgcc

SEQ ID NO: 919989 - DNA, 11 bp, Homo sapiens
gctccctggag

SEQ ID NO: 919990 - DNA, 13 bp, Homo sapiens
gctccctggagcc

SEQ ID NO: 919991 - DNA, 16 bp, Homo sapiens
gctccctggagccctg

SEQ ID NO: 919992 - DNA, 15 bp, Homo sapiens
gctccctgggcagtg

SEQ ID NO: 919993 - DNA, 16 bp, Homo sapiens
gctccctgtggcactc

SEQ ID NO: 919994 - DNA, 22 bp, Homo sapiens
gctccctgtgtccacctgtggg

SEQ ID NO: 919995 - DNA, 16 bp, Homo sapiens
gctcccttccctccat

SEQ ID NO: 919996 - DNA, 16 bp, Homo sapiens
gctcccttcctgccac

SEQ ID NO: 919997 - DNA, 16 bp, Homo sapiens
gctcccttctctgtag

SEQ ID NO: 919998 - DNA, 15 bp, Homo sapiens
gctcccttgatgggg

SEQ ID NO: 919999 - DNA, 19 bp, Homo sapiens
gctccgacctctctcagcc

SEQ ID NO: 920000 - DNA, 17 bp, Homo sapiens
gctccgcctggcctggc

SEQ ID NO: 920001 - DNA, 16 bp, Homo sapiens
gctccgctcccaccgc

SEQ ID NO: 920002 - DNA, 12 bp, Homo sapiens
gctccgctgctc

SEQ ID NO: 920003 - DNA, 23 bp, Homo sapiens
gctccggaggactcaccactgcc

SEQ ID NO: 920004 - DNA, 20 bp, Homo sapiens
gctccggaggggacccagct

SEQ ID NO: 920005 - DNA, 17 bp, Homo sapiens
gctccgggtcactgctg

SEQ ID NO: 920006 - DNA, 16 bp, Homo sapiens
gctccggtttgggctg

SEQ ID NO: 920007 - DNA, 20 bp, Homo sapiens
gctccggtttgggctgtctt

SEQ ID NO: 920008 - DNA, 23 bp, Homo sapiens
gctccgtccaggagcctgtgcct

SEQ ID NO: 920009 - DNA, 12 bp, Homo sapiens
gctccgtctctg

SEQ ID NO: 920010 - DNA, 22 bp, Homo sapiens
gctccgtgagtgaaccatcatt

SEQ ID NO: 920011 - DNA, 14 bp, Homo sapiens
gctccgtggactgc

SEQ ID NO: 920012 - DNA, 13 bp, Homo sapiens
gctcctagaggga

SEQ ID NO: 920013 - DNA, 14 bp, Homo sapiens
gctcctagagggag

SEQ ID NO: 920014 - DNA, 17 bp, Homo sapiens
gctcctagcagacagaa

SEQ ID NO: 920015 - DNA, 19 bp, Homo sapiens
gctcctagcagacagaaac

SEQ ID NO: 920016 - DNA, 15 bp, Homo sapiens
gctcctatctgtgtt

SEQ ID NO: 920017 - DNA, 11 bp, Homo sapiens
gctcctcaccc

SEQ ID NO: 920018 - DNA, 13 bp, Homo sapiens
gctcctcagagcg

SEQ ID NO: 920019 - DNA, 9 bp, Homo sapiens
gctcctcat

SEQ ID NO: 920020 - DNA, 22 bp, Homo sapiens
gctcgctccctgtagctctgcc

SEQ ID NO: 920021 - DNA, 23 bp, Homo sapiens
gctcgctccctgtagctctgcct

SEQ ID NO: 920022 - DNA, 15 bp, Homo sapiens
gctcgctgccatcac

SEQ ID NO: 920023 - DNA, 21 bp, Homo sapiens
gctcgctgccatcaccgctgg

SEQ ID NO: 920024 - DNA, 16 bp, Homo sapiens
gctcggacccacccca

SEQ ID NO: 920025 - DNA, 17 bp, Homo sapiens
gctcggacccaccccaa

SEQ ID NO: 920026 - DNA, 23 bp, Homo sapiens
gctcggagaagagcgcagtgttt

SEQ ID NO: 920027 - DNA, 15 bp, Homo sapiens
gctcggaggaagccc

SEQ ID NO: 920028 - DNA, 16 bp, Homo sapiens
gctcggaggaccctgg

SEQ ID NO: 920029 - DNA, 14 bp, Homo sapiens
gctcggcaccaact

SEQ ID NO: 920030 - DNA, 20 bp, Homo sapiens
gctcggcccggagcagcagg

SEQ ID NO: 920031 - DNA, 18 bp, Homo sapiens
gctcggggtaaaaagtgg

SEQ ID NO: 920032 - DNA, 22 bp, Homo sapiens
gctcggggtaaaaagtggctgc

SEQ ID NO: 920033 - DNA, 17 bp, Homo sapiens
gctcggtggacccaggg

SEQ ID NO: 920034 - DNA, 13 bp, Homo sapiens
gctcgtatcccaa

SEQ ID NO: 920035 - DNA, 16 bp, Homo sapiens
gctcgtcagccacctg

SEQ ID NO: 920036 - DNA, 19 bp, Homo sapiens
gctcgtcagccacctggga

SEQ ID NO: 920037 - DNA, 20 bp, Homo sapiens
gctcgtcagccacctgggaa

SEQ ID NO: 920038 - DNA, 16 bp, Homo sapiens
gctcgtggactgtgct

SEQ ID NO: 920039 - DNA, 13 bp, Homo sapiens
gctcgtggccttc

SEQ ID NO: 920040 - DNA, 15 bp, Homo sapiens
gctcgtggccttccc

SEQ ID NO: 920041 - DNA, 22 bp, Homo sapiens
gctcgtggccttccccttttgc

SEQ ID NO: 920042 - DNA, 16 bp, Homo sapiens
gctcgtgtatcctggg

SEQ ID NO: 920043 - DNA, 17 bp, Homo sapiens
gctcgtgtatcctgggg

SEQ ID NO: 920044 - DNA, 18 bp, Homo sapiens
gctcgtgtatcctggggc

SEQ ID NO: 920045 - DNA, 19 bp, Homo sapiens
gctcgtgtatcctggggct

SEQ ID NO: 920046 - DNA, 18 bp, Homo sapiens
gctctaagcagccaggag

SEQ ID NO: 920047 - DNA, 18 bp, Homo sapiens
ctcatgttccttttgaaa

SEQ ID NO: 920048 - DNA, 21 bp, Homo sapiens
ctcatgttccttttgaaattg

SEQ ID NO: 920049 - DNA, 21 bp, Homo sapiens
ctcatgttctcttcccaggcc

SEQ ID NO: 920050 - DNA, 18 bp, Homo sapiens
ctcatgttcttaattctt

SEQ ID NO: 920051 - DNA, 19 bp, Homo sapiens
ctcatgttcttaattctta

SEQ ID NO: 920052 - DNA, 17 bp, Homo sapiens
ctcatgttgagccagtg

SEQ ID NO: 920053 - DNA, 17 bp, Homo sapiens
ctcatgttgctgaattt

SEQ ID NO: 920054 - DNA, 13 bp, Homo sapiens
ctcattaaaaaaa

SEQ ID NO: 920055 - DNA, 17 bp, Homo sapiens
ctcattaaaatccagta

SEQ ID NO: 920056 - DNA, 18 bp, Homo sapiens
ctcattaaactgattcca

SEQ ID NO: 920057 - DNA, 17 bp, Homo sapiens
ctcattacagttctttc

SEQ ID NO: 920058 - DNA, 21 bp, Homo sapiens
ctcattacagttctttcctct

SEQ ID NO: 920059 - DNA, 15 bp, Homo sapiens
ctcattactgggcct

SEQ ID NO: 920060 - DNA, 18 bp, Homo sapiens
ctcattactgggccttag

SEQ ID NO: 920061 - DNA, 12 bp, Homo sapiens
ctcattagactg

SEQ ID NO: 920062 - DNA, 14 bp, Homo sapiens
ctcattagactgga

SEQ ID NO: 920063 - DNA, 20 bp, Homo sapiens
ctcattataaaatgggaaga

SEQ ID NO: 920064 - DNA, 13 bp, Homo sapiens
ctcattatgaaaa

SEQ ID NO: 920065 - DNA, 18 bp, Homo sapiens
ctcattatgaaaaacatc

SEQ ID NO: 920066 - DNA, 15 bp, Homo sapiens
ctcattcaaaagttg

SEQ ID NO: 920067 - DNA, 20 bp, Homo sapiens
ctcattcagagactgccctt

SEQ ID NO: 920068 - DNA, 14 bp, Homo sapiens
ctcattcagtatta

SEQ ID NO: 920069 - DNA, 19 bp, Homo sapiens
ctcattcagtattaaaggg

SEQ ID NO: 920070 - DNA, 13 bp, Homo sapiens
ctcattcatcttg

SEQ ID NO: 920071 - DNA, 18 bp, Homo sapiens
ctcattccaccttcccat

SEQ ID NO: 920072 - DNA, 13 bp, Homo sapiens
ctcattccccagg

SEQ ID NO: 920073 - DNA, 12 bp, Homo sapiens
ctcattcccctc

SEQ ID NO: 920074 - DNA, 22 bp, Homo sapiens
ctcattctccttgtgttactaa

SEQ ID NO: 920075 - DNA, 11 bp, Homo sapiens
ctcattctgaa

SEQ ID NO: 920076 - DNA, 17 bp, Homo sapiens
ctcattcttgaggagca

SEQ ID NO: 920077 - DNA, 15 bp, Homo sapiens
ctcattgctgagcct

SEQ ID NO: 920078 - DNA, 20 bp, Homo sapiens
ctcattgctgagcctctgct

SEQ ID NO: 920079 - DNA, 17 bp, Homo sapiens
ctcattggacccttcca

SEQ ID NO: 920080 - DNA, 18 bp, Homo sapiens
ctcattggacccttccat

SEQ ID NO: 920081 - DNA, 13 bp, Homo sapiens
ctcattgtcttgt

SEQ ID NO: 920082 - DNA, 22 bp, Homo sapiens
ctcattgtcttgttatgtacaa

SEQ ID NO: 920083 - DNA, 23 bp, Homo sapiens
ctcattgtcttgttatgtacaaa

SEQ ID NO: 920084 - DNA, 13 bp, Homo sapiens
ctcattgtgccaa

SEQ ID NO: 920085 - DNA, 16 bp, Homo sapiens
ctcattgtgccaagcc

SEQ ID NO: 920086 - DNA, 13 bp, Homo sapiens
ctcatttaaaaca

SEQ ID NO: 920087 - DNA, 16 bp, Homo sapiens
ctcatttcatctcatt

SEQ ID NO: 920088 - DNA, 21 bp, Homo sapiens
ctcatttccaaaccatcagct

SEQ ID NO: 920089 - DNA, 17 bp, Homo sapiens
ctcatttcttcctctgc

SEQ ID NO: 920090 - DNA, 13 bp, Homo sapiens
ctcatttctttct

SEQ ID NO: 920091 - DNA, 20 bp, Homo sapiens
ctcatttctttgtctttttc

SEQ ID NO: 920092 - DNA, 23 bp, Homo sapiens
ctcatttctttgtctttttccta

SEQ ID NO: 920093 - DNA, 17 bp, Homo sapiens
ctcatttgttaaaatta

SEQ ID NO: 920094 - DNA, 16 bp, Homo sapiens
ctcatttgttctcaca

SEQ ID NO: 920095 - DNA, 13 bp, Homo sapiens
ctcattttcttta

SEQ ID NO: 920096 - DNA, 16 bp, Homo sapiens
ctcattttggtctgtt

SEQ ID NO: 920097 - DNA, 19 bp, Homo sapiens
ctccaaaaagaaaagtgtt

SEQ ID NO: 920098 - DNA, 16 bp, Homo sapiens
ctccaaaagcacttac

SEQ ID NO: 920099 - DNA, 15 bp, Homo sapiens
ctccaaaataaaact

SEQ ID NO: 920100 - DNA, 16 bp, Homo sapiens
ctccaaaataaaactt

SEQ ID NO: 920101 - DNA, 16 bp, Homo sapiens
ctccaaaatattaaca

SEQ ID NO: 920102 - DNA, 22 bp, Homo sapiens
ctccaaaatgttggtcatttta

SEQ ID NO: 920103 - DNA, 16 bp, Homo sapiens
ctccaaacctccagcc

SEQ ID NO: 920104 - DNA, 15 bp, Homo sapiens
ctccaaacctgtctt

SEQ ID NO: 920105 - DNA, 23 bp, Homo sapiens
ctccaaactcgcttaggtagaaa

SEQ ID NO: 920106 - DNA, 14 bp, Homo sapiens
ctccaaaggaaatc

SEQ ID NO: 920107 - DNA, 15 bp, Homo sapiens
ctccaaaggctctgt

SEQ ID NO: 920108 - DNA, 19 bp, Homo sapiens
ctccaaaggggctgctggg

SEQ ID NO: 920109 - DNA, 22 bp, Homo sapiens
ctccaaaggggctgctggggca

SEQ ID NO: 920110 - DNA, 18 bp, Homo sapiens
ctccaaagtggagctggg

SEQ ID NO: 920111 - DNA, 19 bp, Homo sapiens
ctccaaatccaaggaaaca

SEQ ID NO: 920112 - DNA, 20 bp, Homo sapiens
ctccaaatggagaagctgca

SEQ ID NO: 920113 - DNA, 13 bp, Homo sapiens
ctccaaatttaac

SEQ ID NO: 920114 - DNA, 22 bp, Homo sapiens
ctccaacaccaagcacagcagc

SEQ ID NO: 920115 - DNA, 19 bp, Homo sapiens
ctccaacatcacagcccag

SEQ ID NO: 920116 - DNA, 22 bp, Homo sapiens
ctccaaccaaataagacttcca

SEQ ID NO: 920117 - DNA, 12 bp, Homo sapiens
ctccaaccactg

SEQ ID NO: 920118 - DNA, 17 bp, Homo sapiens
ctccaaccactgtgcca

SEQ ID NO: 920119 - DNA, 21 bp, Homo sapiens
ctccaaccactgtgccactga

SEQ ID NO: 920120 - DNA, 18 bp, Homo sapiens
ctccaaccctagcaaaag

SEQ ID NO: 920121 - DNA, 13 bp, Homo sapiens
ctccaaccctgcc

SEQ ID NO: 920122 - DNA, 14 bp, Homo sapiens
ctccaaccctgccg

SEQ ID NO: 920123 - DNA, 23 bp, Homo sapiens
ctccaaccctgccgtcaccacca

SEQ ID NO: 920124 - DNA, 13 bp, Homo sapiens
ctccaacctctcg

SEQ ID NO: 920125 - DNA, 17 bp, Homo sapiens
ctccaacctgtggcgct

SEQ ID NO: 920126 - DNA, 13 bp, Homo sapiens
ctccaagaaactg

SEQ ID NO: 920127 - DNA, 18 bp, Homo sapiens
ctccaagaaactgaatga

SEQ ID NO: 920128 - DNA, 19 bp, Homo sapiens
ctccaagaatggaagcctg

SEQ ID NO: 920129 - DNA, 12 bp, Homo sapiens
ctccaagacctg

SEQ ID NO: 920130 - DNA, 14 bp, Homo sapiens
ctccaagagctaca

SEQ ID NO: 920131 - DNA, 17 bp, Homo sapiens
ctccaagaggctgagga

SEQ ID NO: 920132 - DNA, 23 bp, Homo sapiens
ctccaagcaagtagctttccaca

SEQ ID NO: 920133 - DNA, 15 bp, Homo sapiens
ctccaagcagactcc

SEQ ID NO: 920134 - DNA, 20 bp, Homo sapiens
ctccaagcagactccagccc

SEQ ID NO: 920135 - DNA, 23 bp, Homo sapiens
ctccaagcagactccagcccctg

SEQ ID NO: 920136 - DNA, 22 bp, Homo sapiens
ctccaagcatttcatgaaaaag

SEQ ID NO: 920137 - DNA, 13 bp, Homo sapiens
ctccaagccagcg

SEQ ID NO: 920138 - DNA, 15 bp, Homo sapiens
ctccaagccccctgg

SEQ ID NO: 920139 - DNA, 22 bp, Homo sapiens
ctccaagccccctggcagctgc

SEQ ID NO: 920140 - DNA, 23 bp, Homo sapiens
ctccaagccccctggcagctgcc

SEQ ID NO: 920141 - DNA, 17 bp, Homo sapiens
ctccaagcctgcctccc

SEQ ID NO: 920142 - DNA, 18 bp, Homo sapiens
ctccaagcctgcctccca

SEQ ID NO: 920143 - DNA, 15 bp, Homo sapiens
ctccaagcctggcac

SEQ ID NO: 920144 - DNA, 21 bp, Homo sapiens
ctccaagcctggcacccaccg

SEQ ID NO: 920145 - DNA, 22 bp, Homo sapiens
ctccaagcctggcacccaccgt

SEQ ID NO: 920146 - DNA, 18 bp, Homo sapiens
ctccaagctccatctcca

SEQ ID NO: 920147 - DNA, 12 bp, Homo sapiens
ctccaaggacca

SEQ ID NO: 920148 - DNA, 14 bp, Homo sapiens
ctccaaggaccagg

SEQ ID NO: 920149 - DNA, 19 bp, Homo sapiens
ctccaaggaggggctgtaa

SEQ ID NO: 920150 - DNA, 16 bp, Homo sapiens
ctccaagggacaggtg

SEQ ID NO: 920151 - DNA, 23 bp, Homo sapiens
ctccaagggacaggtgggcctgg

SEQ ID NO: 920152 - DNA, 19 bp, Homo sapiens
ctccaagggaccctttgcc

SEQ ID NO: 920153 - DNA, 22 bp, Homo sapiens
ctccaagggcttctgcaccctc

SEQ ID NO: 920154 - DNA, 21 bp, Homo sapiens
ctccaagggtttcgactggtc

SEQ ID NO: 920155 - DNA, 15 bp, Homo sapiens
ctccaaggtggggtc

SEQ ID NO: 920156 - DNA, 17 bp, Homo sapiens
ctccaaggtttataaag

SEQ ID NO: 920157 - DNA, 20 bp, Homo sapiens
ctccaaggtttataaagcag

SEQ ID NO: 920158 - DNA, 13 bp, Homo sapiens
ctccaagtctctc

SEQ ID NO: 920159 - DNA, 20 bp, Homo sapiens
ctccaagtctctctgtgaat

SEQ ID NO: 920160 - DNA, 20 bp, Homo sapiens
ctccaagtgccagaggtggg

SEQ ID NO: 920161 - DNA, 21 bp, Homo sapiens
ctccaagtgccagaggtgggc

SEQ ID NO: 920162 - DNA, 19 bp, Homo sapiens
ctccaataaagtgccttct

SEQ ID NO: 920163 - DNA, 21 bp, Homo sapiens
ctccaataaagtgccttctgg

SEQ ID NO: 920164 - DNA, 14 bp, Homo sapiens
ctccaatgctctgg

SEQ ID NO: 920165 - DNA, 12 bp, Homo sapiens
ctccaatgtcta

SEQ ID NO: 920166 - DNA, 15 bp, Homo sapiens
ctccaatgtctaatt

SEQ ID NO: 920167 - DNA, 23 bp, Homo sapiens
ctccaattttttaagtgaaaata

SEQ ID NO: 920168 - DNA, 18 bp, Homo sapiens
ctccacaaagcaaaggca

SEQ ID NO: 920169 - DNA, 21 bp, Homo sapiens
ctccacaaagcaaaggcagtc

SEQ ID NO: 920170 - DNA, 16 bp, Homo sapiens
ctccacaacagcctgg

SEQ ID NO: 920171 - DNA, 22 bp, Homo sapiens
gctctaagcagccaggagggac

SEQ ID NO: 920172 - DNA, 14 bp, Homo sapiens
gctctaataagttt

SEQ ID NO: 920173 - DNA, 19 bp, Homo sapiens
gctctaataagtttgtgtt

SEQ ID NO: 920174 - DNA, 16 bp, Homo sapiens
gctctaattcacagtg

SEQ ID NO: 920175 - DNA, 17 bp, Homo sapiens
gctctacatcttctgcc

SEQ ID NO: 920176 - DNA, 16 bp, Homo sapiens
gctctacccatgagcc

SEQ ID NO: 920177 - DNA, 12 bp, Homo sapiens
gctctaccctgt

SEQ ID NO: 920178 - DNA, 13 bp, Homo sapiens
gctctaccctgtc

SEQ ID NO: 920179 - DNA, 14 bp, Homo sapiens
gctctaccctgtct

SEQ ID NO: 920180 - DNA, 16 bp, Homo sapiens
gctctaccctgtctgt

SEQ ID NO: 920181 - DNA, 20 bp, Homo sapiens
gctctaccctgtctgtccct

SEQ ID NO: 920182 - DNA, 11 bp, Homo sapiens
gctctacctct

SEQ ID NO: 920183 - DNA, 16 bp, Homo sapiens
gctctacctctctttc

SEQ ID NO: 920184 - DNA, 21 bp, Homo sapiens
gctctaccttcctgtccctga

SEQ ID NO: 920185 - DNA, 21 bp, Homo sapiens
gctctactggtcttgtggaat

SEQ ID NO: 920186 - DNA, 15 bp, Homo sapiens
gctctagccaggagt

SEQ ID NO: 920187 - DNA, 18 bp, Homo sapiens
gctctagccaggagtctg

SEQ ID NO: 920188 - DNA, 22 bp, Homo sapiens
gctctagccaggagtctgtgct

SEQ ID NO: 920189 - DNA, 21 bp, Homo sapiens
gctctagcctgggcaacaaca

SEQ ID NO: 920190 - DNA, 14 bp, Homo sapiens
gctctagctggcag

SEQ ID NO: 920191 - DNA, 15 bp, Homo sapiens
gctctagctttgcag

SEQ ID NO: 920192 - DNA, 13 bp, Homo sapiens
gctctagggcagg

SEQ ID NO: 920193 - DNA, 12 bp, Homo sapiens
gctctagtgcct

SEQ ID NO: 920194 - DNA, 15 bp, Homo sapiens
gctctagtgggacag

SEQ ID NO: 920195 - DNA, 19 bp, Homo sapiens
gctctagttttcagccttg

SEQ ID NO: 920196 - DNA, 16 bp, Homo sapiens
gctctatgtctgcctt

SEQ ID NO: 920197 - DNA, 20 bp, Homo sapiens
gctctatgtttgtatttgga

SEQ ID NO: 920198 - DNA, 16 bp, Homo sapiens
gctctatttccccacc

SEQ ID NO: 920199 - DNA, 14 bp, Homo sapiens
gctctcaattaaag

SEQ ID NO: 920200 - DNA, 13 bp, Homo sapiens
gctctcaatttta

SEQ ID NO: 920201 - DNA, 16 bp, Homo sapiens
gctctcacccccatcc

SEQ ID NO: 920202 - DNA, 17 bp, Homo sapiens
gctctcacccccatccc

SEQ ID NO: 920203 - DNA, 15 bp, Homo sapiens
gctctcagagcagca

SEQ ID NO: 920204 - DNA, 11 bp, Homo sapiens
gctctcagcca

SEQ ID NO: 920205 - DNA, 16 bp, Homo sapiens
gctctcagcctcccac

SEQ ID NO: 920206 - DNA, 19 bp, Homo sapiens
gctctcaggggccagtgag

SEQ ID NO: 920207 - DNA, 20 bp, Homo sapiens
gctctcaggggccagtgagg

SEQ ID NO: 920208 - DNA, 17 bp, Homo sapiens
gctctccaaaggggctg

SEQ ID NO: 920209 - DNA, 20 bp, Homo sapiens
gctctccaaaggggctgctg

SEQ ID NO: 920210 - DNA, 22 bp, Homo sapiens
gctctccaaaggggctgctggg

SEQ ID NO: 920211 - DNA, 23 bp, Homo sapiens
gctctccaaaggggctgctgggg

SEQ ID NO: 920212 - DNA, 18 bp, Homo sapiens
gctctccaagtgccagag

SEQ ID NO: 920213 - DNA, 19 bp, Homo sapiens
gctctccaagtgccagagg

SEQ ID NO: 920214 - DNA, 11 bp, Homo sapiens
gctctccacca

SEQ ID NO: 920215 - DNA, 13 bp, Homo sapiens
gctctccaccacc

SEQ ID NO: 920216 - DNA, 14 bp, Homo sapiens
gctctccacctcag

SEQ ID NO: 920217 - DNA, 17 bp, Homo sapiens
gctctccacctcagcct

SEQ ID NO: 920218 - DNA, 13 bp, Homo sapiens
gctctccaggccc

SEQ ID NO: 920219 - DNA, 13 bp, Homo sapiens
gctctcccacccc

SEQ ID NO: 920220 - DNA, 14 bp, Homo sapiens
gctctcccaccccg

SEQ ID NO: 920221 - DNA, 16 bp, Homo sapiens
gctctcccctgccctg

SEQ ID NO: 920222 - DNA, 18 bp, Homo sapiens
gctctcccggttcttcca

SEQ ID NO: 920223 - DNA, 23 bp, Homo sapiens
gctctcccgtgcatcccccctgc

SEQ ID NO: 920224 - DNA, 14 bp, Homo sapiens
gctctccctctggc

SEQ ID NO: 920225 - DNA, 19 bp, Homo sapiens
gctctccctctggccctgc

SEQ ID NO: 920226 - DNA, 21 bp, Homo sapiens
gctctccctctggccctgcct

SEQ ID NO: 920227 - DNA, 19 bp, Homo sapiens
gctctccggggccatttgc

SEQ ID NO: 920228 - DNA, 21 bp, Homo sapiens
gctctccggggccatttgcaa

SEQ ID NO: 920229 - DNA, 15 bp, Homo sapiens
gctctcctcgagccc

SEQ ID NO: 920230 - DNA, 14 bp, Homo sapiens
gctctcctggctcc

SEQ ID NO: 920231 - DNA, 15 bp, Homo sapiens
gctctcctggctccc

SEQ ID NO: 920232 - DNA, 18 bp, Homo sapiens
gctctctaggcctctcca

SEQ ID NO: 920233 - DNA, 12 bp, Homo sapiens
gctctctccagg

SEQ ID NO: 920234 - DNA, 23 bp, Homo sapiens
gctctctctacccggcccagaga

SEQ ID NO: 920235 - DNA, 16 bp, Homo sapiens
gctctctctagctccc

SEQ ID NO: 920236 - DNA, 18 bp, Homo sapiens
gctctctctagctcccca

SEQ ID NO: 920237 - DNA, 18 bp, Homo sapiens
gctctctgacgcttgtga

SEQ ID NO: 920238 - DNA, 20 bp, Homo sapiens
gctctctgtgggctggcagt

SEQ ID NO: 920239 - DNA, 21 bp, Homo sapiens
gctctctgttgcgctcccgca

SEQ ID NO: 920240 - DNA, 22 bp, Homo sapiens
gctctcttccagaagatgccct

SEQ ID NO: 920241 - DNA, 23 bp, Homo sapiens
gctctcttccagaagatgccctc

SEQ ID NO: 920242 - DNA, 21 bp, Homo sapiens
gctctcttcctgcccctcttt

SEQ ID NO: 920243 - DNA, 21 bp, Homo sapiens
gctctcttgtgacgtgcactg

SEQ ID NO: 920244 - DNA, 23 bp, Homo sapiens
gctctcttgtgacgtgcactgtg

SEQ ID NO: 920245 - DNA, 15 bp, Homo sapiens
gctctctttctgtct

SEQ ID NO: 920246 - DNA, 14 bp, Homo sapiens
gctctgaaaacaag

SEQ ID NO: 920247 - DNA, 17 bp, Homo sapiens
gctctgaaagagaaaca

SEQ ID NO: 920248 - DNA, 17 bp, Homo sapiens
gctctgaaagccagctg

SEQ ID NO: 920249 - DNA, 20 bp, Homo sapiens
gctctgaacacacacgccag

SEQ ID NO: 920250 - DNA, 23 bp, Homo sapiens
gctctgaacacacacgccagctc

SEQ ID NO: 920251 - DNA, 16 bp, Homo sapiens
gctctgaacttccaag

SEQ ID NO: 920252 - DNA, 22 bp, Homo sapiens
gctctgaagtcacatcacagga

SEQ ID NO: 920253 - DNA, 12 bp, Homo sapiens
gctctgaatctg

SEQ ID NO: 920254 - DNA, 17 bp, Homo sapiens
gctctgaatctgtacat

SEQ ID NO: 920255 - DNA, 16 bp, Homo sapiens
gctctgacaagatggt

SEQ ID NO: 920256 - DNA, 15 bp, Homo sapiens
gctctgacccagtga

SEQ ID NO: 920257 - DNA, 14 bp, Homo sapiens
gctctgaccctggg

SEQ ID NO: 920258 - DNA, 16 bp, Homo sapiens
gctctgacgtagaaag

SEQ ID NO: 920259 - DNA, 10 bp, Homo sapiens
gctctgagaa

SEQ ID NO: 920260 - DNA, 11 bp, Homo sapiens
gctctgagaat

SEQ ID NO: 920261 - DNA, 20 bp, Homo sapiens
gctctgagcaaatgtggctc

SEQ ID NO: 920262 - DNA, 18 bp, Homo sapiens
gctctgagcacaggtgac

SEQ ID NO: 920263 - DNA, 23 bp, Homo sapiens
gctctgaggcaaccccctcggag

SEQ ID NO: 920264 - DNA, 18 bp, Homo sapiens
gctctgaggcccgatctc

SEQ ID NO: 920265 - DNA, 16 bp, Homo sapiens
gctctgaggcttccag

SEQ ID NO: 920266 - DNA, 18 bp, Homo sapiens
gctctgaggcttccagag

SEQ ID NO: 920267 - DNA, 19 bp, Homo sapiens
gctctgaggcttccagaga

SEQ ID NO: 920268 - DNA, 21 bp, Homo sapiens
gctctgaggcttccagagagt

SEQ ID NO: 920269 - DNA, 22 bp, Homo sapiens
gctctgaggggaggcacctcca

SEQ ID NO: 920270 - DNA, 23 bp, Homo sapiens
gctctgaggggaggcacctccag

SEQ ID NO: 920271 - DNA, 17 bp, Homo sapiens
gctctgaggtcaataaa

SEQ ID NO: 920272 - DNA, 20 bp, Homo sapiens
gctctgaggtcaataaagca

SEQ ID NO: 920273 - DNA, 20 bp, Homo sapiens
gctctgatttcaggcagcag

SEQ ID NO: 920274 - DNA, 16 bp, Homo sapiens
gctctgatttccttcc

SEQ ID NO: 920275 - DNA, 17 bp, Homo sapiens
gctctgatttccttcca

SEQ ID NO: 920276 - DNA, 21 bp, Homo sapiens
gctctgcagtcctactcaagc

SEQ ID NO: 920277 - DNA, 21 bp, Homo sapiens
gctctgccaatgtgggctgcc

SEQ ID NO: 920278 - DNA, 23 bp, Homo sapiens
gctctgccaccctacctgttcag

SEQ ID NO: 920279 - DNA, 16 bp, Homo sapiens
gctctgccatcttcag

SEQ ID NO: 920280 - DNA, 16 bp, Homo sapiens
gctctgcccacctctc

SEQ ID NO: 920281 - DNA, 22 bp, Homo sapiens
gctctgcccacctctcttttcc

SEQ ID NO: 920282 - DNA, 14 bp, Homo sapiens
gctctgccccaagc

SEQ ID NO: 920283 - DNA, 23 bp, Homo sapiens
gctctgccccaccttgccagggc

SEQ ID NO: 920284 - DNA, 13 bp, Homo sapiens
gctctgccccagc

SEQ ID NO: 920285 - DNA, 15 bp, Homo sapiens
gctctgccccagctc

SEQ ID NO: 920286 - DNA, 19 bp, Homo sapiens
gctctgccccagctctggc

SEQ ID NO: 920287 - DNA, 20 bp, Homo sapiens
gctctgccccagctctggct

SEQ ID NO: 920288 - DNA, 17 bp, Homo sapiens
gctctgccccaggccct

SEQ ID NO: 920289 - DNA, 22 bp, Homo sapiens
gctctgcccccgcgggttctag

SEQ ID NO: 920290 - DNA, 23 bp, Homo sapiens
gctctgcccccgcgggttctaga

SEQ ID NO: 920291 - DNA, 12 bp, Homo sapiens
gctctgcccctc

SEQ ID NO: 920292 - DNA, 15 bp, Homo sapiens
gctctgcccctcagg

SEQ ID NO: 920293 - DNA, 16 bp, Homo sapiens
gctctgcccctcaggg

SEQ ID NO: 920294 - DNA, 23 bp, Homo sapiens
gctctgcccctcagggggccagc

SEQ ID NO: 920295 - DNA, 14 bp, Homo sapiens
ctccacaaggtccc

SEQ ID NO: 920296 - DNA, 15 bp, Homo sapiens
ctccacaaggtcccc

SEQ ID NO: 920297 - DNA, 23 bp, Homo sapiens
ctccacacattccagccaggccc

SEQ ID NO: 920298 - DNA, 15 bp, Homo sapiens
ctccacaccagtggc

SEQ ID NO: 920299 - DNA, 14 bp, Homo sapiens
ctccacagcgaggg

SEQ ID NO: 920300 - DNA, 19 bp, Homo sapiens
ctccacagcgagggcagct

SEQ ID NO: 920301 - DNA, 15 bp, Homo sapiens
ctccacagctgcagc

SEQ ID NO: 920302 - DNA, 12 bp, Homo sapiens
ctccacagggcc

SEQ ID NO: 920303 - DNA, 20 bp, Homo sapiens
ctccacagtcccccacccac

SEQ ID NO: 920304 - DNA, 21 bp, Homo sapiens
ctccacagtcccccacccacc

SEQ ID NO: 920305 - DNA, 12 bp, Homo sapiens
ctccacagtgtt

SEQ ID NO: 920306 - DNA, 16 bp, Homo sapiens
ctccacagtgttcatt

SEQ ID NO: 920307 - DNA, 18 bp, Homo sapiens
ctccacagtgttgtgccc

SEQ ID NO: 920308 - DNA, 17 bp, Homo sapiens
ctccacatcctccacgt

SEQ ID NO: 920309 - DNA, 22 bp, Homo sapiens
ctccacatcctttctaaacaag

SEQ ID NO: 920310 - DNA, 17 bp, Homo sapiens
ctccacatgctgcctgg

SEQ ID NO: 920311 - DNA, 19 bp, Homo sapiens
ctccacatgctgcctggca

SEQ ID NO: 920312 - DNA, 20 bp, Homo sapiens
ctccacatgctgcctggcac

SEQ ID NO: 920313 - DNA, 22 bp, Homo sapiens
ctccaccaaccccgcggcccag

SEQ ID NO: 920314 - DNA, 15 bp, Homo sapiens
ctccaccaccactgg

SEQ ID NO: 920315 - DNA, 17 bp, Homo sapiens
ctccaccaccactggcc

SEQ ID NO: 920316 - DNA, 14 bp, Homo sapiens
ctccaccagcagca

SEQ ID NO: 920317 - DNA, 21 bp, Homo sapiens
ctccaccagccctactcctgc

SEQ ID NO: 920318 - DNA, 22 bp, Homo sapiens
ctccaccagccctactcctgcg

SEQ ID NO: 920319 - DNA, 18 bp, Homo sapiens
ctccaccagcctgctgac

SEQ ID NO: 920320 - DNA, 16 bp, Homo sapiens
ctccaccatccccacc

SEQ ID NO: 920321 - DNA, 14 bp, Homo sapiens
ctccacccactgtc

SEQ ID NO: 920322 - DNA, 15 bp, Homo sapiens
ctccacccagcccct

SEQ ID NO: 920323 - DNA, 16 bp, Homo sapiens
ctccacccagcccctg

SEQ ID NO: 920324 - DNA, 17 bp, Homo sapiens
ctccacccagcccctgg

SEQ ID NO: 920325 - DNA, 18 bp, Homo sapiens
ctccacccatccagtgga

SEQ ID NO: 920326 - DNA, 15 bp, Homo sapiens
ctccacccccagagg

SEQ ID NO: 920327 - DNA, 14 bp, Homo sapiens
ctccacccccatgt

SEQ ID NO: 920328 - DNA, 23 bp, Homo sapiens
ctccaccccccactcagtgcctc

SEQ ID NO: 920329 - DNA, 20 bp, Homo sapiens
ctccacccccgccacggcca

SEQ ID NO: 920330 - DNA, 18 bp, Homo sapiens
ctccacccgtcctccctc

SEQ ID NO: 920331 - DNA, 20 bp, Homo sapiens
ctccacccgtcctccctcag

SEQ ID NO: 920332 - DNA, 14 bp, Homo sapiens
ctccaccctccacc

SEQ ID NO: 920333 - DNA, 22 bp, Homo sapiens
ctccaccctcctctagccatcc

SEQ ID NO: 920334 - DNA, 22 bp, Homo sapiens
ctccaccctgcattttcctctt

SEQ ID NO: 920335 - DNA, 15 bp, Homo sapiens
ctccaccctggccga

SEQ ID NO: 920336 - DNA, 20 bp, Homo sapiens
ctccaccctgtcccccagct

SEQ ID NO: 920337 - DNA, 23 bp, Homo sapiens
ctccaccctgtcccccagctctg

SEQ ID NO: 920338 - DNA, 13 bp, Homo sapiens
ctccaccctgtta

SEQ ID NO: 920339 - DNA, 12 bp, Homo sapiens
ctccacccttgg

SEQ ID NO: 920340 - DNA, 14 bp, Homo sapiens
ctccacccttggcc

SEQ ID NO: 920341 - DNA, 21 bp, Homo sapiens
ctccacccttggcctgtctca

SEQ ID NO: 920342 - DNA, 18 bp, Homo sapiens
ctccaccgaccaactgcc

SEQ ID NO: 920343 - DNA, 14 bp, Homo sapiens
ctccaccgctgcct

SEQ ID NO: 920344 - DNA, 14 bp, Homo sapiens
ctccacctcagcct

SEQ ID NO: 920345 - DNA, 15 bp, Homo sapiens
ctccacctcagcctt

SEQ ID NO: 920346 - DNA, 14 bp, Homo sapiens
ctccacctctggtg

SEQ ID NO: 920347 - DNA, 22 bp, Homo sapiens
ctccacctcttcaccccccact

SEQ ID NO: 920348 - DNA, 12 bp, Homo sapiens
ctccaccttcca

SEQ ID NO: 920349 - DNA, 21 bp, Homo sapiens
ctccacgaagccttaagccat

SEQ ID NO: 920350 - DNA, 17 bp, Homo sapiens
ctccacgccactgcctc

SEQ ID NO: 920351 - DNA, 15 bp, Homo sapiens
ctccacgcctcctgg

SEQ ID NO: 920352 - DNA, 18 bp, Homo sapiens
ctccacgcctcctggcca

SEQ ID NO: 920353 - DNA, 21 bp, Homo sapiens
ctccacgcctcctggccagac

SEQ ID NO: 920354 - DNA, 22 bp, Homo sapiens
ctccacgggcaggggtcagagc

SEQ ID NO: 920355 - DNA, 20 bp, Homo sapiens
ctccacggtccgcggcctgc

SEQ ID NO: 920356 - DNA, 21 bp, Homo sapiens
ctccacggtccgcggcctgca

SEQ ID NO: 920357 - DNA, 22 bp, Homo sapiens
ctccacggtccgcggcctgcac

SEQ ID NO: 920358 - DNA, 21 bp, Homo sapiens
ctccacgtctttcctgctaca

SEQ ID NO: 920359 - DNA, 20 bp, Homo sapiens
ctccacgtgtccgtccaccc

SEQ ID NO: 920360 - DNA, 19 bp, Homo sapiens
ctccactcaccacaagctg

SEQ ID NO: 920361 - DNA, 23 bp, Homo sapiens
ctccactcaccacaagctgagca

SEQ ID NO: 920362 - DNA, 13 bp, Homo sapiens
ctccactcactgc

SEQ ID NO: 920363 - DNA, 21 bp, Homo sapiens
ctccactcagctgtcctgcag

SEQ ID NO: 920364 - DNA, 15 bp, Homo sapiens
ctccactcaggtgca

SEQ ID NO: 920365 - DNA, 17 bp, Homo sapiens
ctccactcctccagcca

SEQ ID NO: 920366 - DNA, 14 bp, Homo sapiens
ctccactcgaccca

SEQ ID NO: 920367 - DNA, 17 bp, Homo sapiens
ctccactctagttctag

SEQ ID NO: 920368 - DNA, 19 bp, Homo sapiens
ctccactctagttctagat

SEQ ID NO: 920369 - DNA, 15 bp, Homo sapiens
ctccactctgattca

SEQ ID NO: 920370 - DNA, 23 bp, Homo sapiens
ctccactctgattcacctcttcc

SEQ ID NO: 920371 - DNA, 16 bp, Homo sapiens
ctccactctgcttctc

SEQ ID NO: 920372 - DNA, 20 bp, Homo sapiens
ctccactcttctctcctttc

SEQ ID NO: 920373 - DNA, 13 bp, Homo sapiens
ctccactgccttc

SEQ ID NO: 920374 - DNA, 16 bp, Homo sapiens
ctccactgctggacat

SEQ ID NO: 920375 - DNA, 14 bp, Homo sapiens
ctccactggatgga

SEQ ID NO: 920376 - DNA, 17 bp, Homo sapiens
ctccactggggaatgct

SEQ ID NO: 920377 - DNA, 12 bp, Homo sapiens
ctccactgtcac

SEQ ID NO: 920378 - DNA, 13 bp, Homo sapiens
ctccactgtcaca

SEQ ID NO: 920379 - DNA, 22 bp, Homo sapiens
ctccactgtgcctttgcaaatc

SEQ ID NO: 920380 - DNA, 20 bp, Homo sapiens
ctccacttcccgtctcagaa

SEQ ID NO: 920381 - DNA, 13 bp, Homo sapiens
ctccacttctggt

SEQ ID NO: 920382 - DNA, 15 bp, Homo sapiens
ctccacttgtatata

SEQ ID NO: 920383 - DNA, 21 bp, Homo sapiens
ctccactttctcaatgcttag

SEQ ID NO: 920384 - DNA, 23 bp, Homo sapiens
ctccagaaaaatgaaaagcaata

SEQ ID NO: 920385 - DNA, 21 bp, Homo sapiens
ctccagaaacagctgcttctc

SEQ ID NO: 920386 - DNA, 23 bp, Homo sapiens
ctccagaaacagctgcttctccc

SEQ ID NO: 920387 - DNA, 22 bp, Homo sapiens
ctccagaaatgtctaaatgctg

SEQ ID NO: 920388 - DNA, 23 bp, Homo sapiens
ctccagaagatagcttcacccca

SEQ ID NO: 920389 - DNA, 16 bp, Homo sapiens
ctccagaagatgccag

SEQ ID NO: 920390 - DNA, 14 bp, Homo sapiens
ctccagaagcctct

SEQ ID NO: 920391 - DNA, 19 bp, Homo sapiens
ctccagaagcctctggcta

SEQ ID NO: 920392 - DNA, 19 bp, Homo sapiens
ctccagaagctgctccttt

SEQ ID NO: 920393 - DNA, 18 bp, Homo sapiens
ctccagaataccttcttc

SEQ ID NO: 920394 - DNA, 18 bp, Homo sapiens
ctccagaatctgctgttg

SEQ ID NO: 920395 - DNA, 16 bp, Homo sapiens
ctccagaatgtaagaa

SEQ ID NO: 920396 - DNA, 19 bp, Homo sapiens
ctccagaatgtaagaaaac

SEQ ID NO: 920397 - DNA, 22 bp, Homo sapiens
ctccagaatttggaaatcctag

SEQ ID NO: 920398 - DNA, 17 bp, Homo sapiens
ctccagacccaccacac

SEQ ID NO: 920399 - DNA, 16 bp, Homo sapiens
ctccagacccagaggc

SEQ ID NO: 920400 - DNA, 18 bp, Homo sapiens
ctccagacccccacccct

SEQ ID NO: 920401 - DNA, 15 bp, Homo sapiens
ctccagacccctggc

SEQ ID NO: 920402 - DNA, 15 bp, Homo sapiens
ctccagaccctgcct

SEQ ID NO: 920403 - DNA, 17 bp, Homo sapiens
ctccagaccctgcctga

SEQ ID NO: 920404 - DNA, 24 bp, Homo sapiens
ctccagagaagccccgcacgggct

SEQ ID NO: 920405 - DNA, 19 bp, Homo sapiens
ctccagagccagcctggga

SEQ ID NO: 920406 - DNA, 15 bp, Homo sapiens
ctccagaggagggga

SEQ ID NO: 920407 - DNA, 15 bp, Homo sapiens
ctccagagtctgagc

SEQ ID NO: 920408 - DNA, 16 bp, Homo sapiens
ctccagagtctgagcc

SEQ ID NO: 920409 - DNA, 18 bp, Homo sapiens
ctccagagtctgagcccc

SEQ ID NO: 920410 - DNA, 20 bp, Homo sapiens
ctccagagtggggatgacat

SEQ ID NO: 920411 - DNA, 16 bp, Homo sapiens
ctccagagtgtgcaga

SEQ ID NO: 920412 - DNA, 20 bp, Homo sapiens
ctccagagtgtgcagactga

SEQ ID NO: 920413 - DNA, 20 bp, Homo sapiens
ctccagataactctctttcc

SEQ ID NO: 920414 - DNA, 19 bp, Homo sapiens
ctccagattagagcctgta

SEQ ID NO: 920415 - DNA, 23 bp, Homo sapiens
ctccagcaccttctttctggact

SEQ ID NO: 920416 - DNA, 22 bp, Homo sapiens
ctccagcaggaaggaccccaca

SEQ ID NO: 920417 - DNA, 15 bp, Homo sapiens
ctccagcatccagcc

SEQ ID NO: 920418 - DNA, 16 bp, Homo sapiens
ctccagccaccaccca

SEQ ID NO: 920419 - DNA, 14 bp, Homo sapiens
gctctgccccttgg

SEQ ID NO: 920420 - DNA, 18 bp, Homo sapiens
gctctgcccttgttccct

SEQ ID NO: 920421 - DNA, 16 bp, Homo sapiens
gctctgccgtctctgg

SEQ ID NO: 920422 - DNA, 14 bp, Homo sapiens
gctctgcctcagac

SEQ ID NO: 920423 - DNA, 12 bp, Homo sapiens
gctctgcctgga

SEQ ID NO: 920424 - DNA, 15 bp, Homo sapiens
gctctgcctggagtg

SEQ ID NO: 920425 - DNA, 14 bp, Homo sapiens
gctctgcctgtctg

SEQ ID NO: 920426 - DNA, 14 bp, Homo sapiens
gctctgcgccaggc

SEQ ID NO: 920427 - DNA, 15 bp, Homo sapiens
gctctgcgccaggca

SEQ ID NO: 920428 - DNA, 17 bp, Homo sapiens
gctctgcgccaggcaga

SEQ ID NO: 920429 - DNA, 19 bp, Homo sapiens
gctctgcgccaggcagagc

SEQ ID NO: 920430 - DNA, 21 bp, Homo sapiens
gctctgcgccaggcagagctg

SEQ ID NO: 920431 - DNA, 20 bp, Homo sapiens
gctctgcgtcggtcctggtg

SEQ ID NO: 920432 - DNA, 15 bp, Homo sapiens
gctctggaagagagg

SEQ ID NO: 920433 - DNA, 22 bp, Homo sapiens
gctctggaagaggccttcccat

SEQ ID NO: 920434 - DNA, 15 bp, Homo sapiens
gctctggaagcctgg

SEQ ID NO: 920435 - DNA, 20 bp, Homo sapiens
gctctggaataaagttgcag

SEQ ID NO: 920436 - DNA, 13 bp, Homo sapiens
gctctggacagat

SEQ ID NO: 920437 - DNA, 18 bp, Homo sapiens
gctctggacagcagaagc

SEQ ID NO: 920438 - DNA, 23 bp, Homo sapiens
gctctggacagcagaagcctcca

SEQ ID NO: 920439 - DNA, 12 bp, Homo sapiens
gctctggagcag

SEQ ID NO: 920440 - DNA, 13 bp, Homo sapiens
gctctggagcagc

SEQ ID NO: 920441 - DNA, 17 bp, Homo sapiens
gctctggaggaagttct

SEQ ID NO: 920442 - DNA, 20 bp, Homo sapiens
gctctggaggaagttctcca

SEQ ID NO: 920443 - DNA, 17 bp, Homo sapiens
gctctggaggtgctgct

SEQ ID NO: 920444 - DNA, 19 bp, Homo sapiens
gctctggaggtgctgctct

SEQ ID NO: 920445 - DNA, 15 bp, Homo sapiens
gctctggatcctgca

SEQ ID NO: 920446 - DNA, 15 bp, Homo sapiens
gctctggatgaaggc

SEQ ID NO: 920447 - DNA, 16 bp, Homo sapiens
gctctggatgaaggca

SEQ ID NO: 920448 - DNA, 18 bp, Homo sapiens
gctctggcttcctgctga

SEQ ID NO: 920449 - DNA, 21 bp, Homo sapiens
gctctggcttgccccaggact

SEQ ID NO: 920450 - DNA, 21 bp, Homo sapiens
gctctgggatagctgacccag

SEQ ID NO: 920451 - DNA, 14 bp, Homo sapiens
gctctgggccattc

SEQ ID NO: 920452 - DNA, 23 bp, Homo sapiens
gctctgggccattctccacagca

SEQ ID NO: 920453 - DNA, 12 bp, Homo sapiens
gctctgggcctc

SEQ ID NO: 920454 - DNA, 12 bp, Homo sapiens
gctctgggctca

SEQ ID NO: 920455 - DNA, 19 bp, Homo sapiens
gctctgggctcagggctgg

SEQ ID NO: 920456 - DNA, 23 bp, Homo sapiens
gctctgggctcagggctggagtg

SEQ ID NO: 920457 - DNA, 21 bp, Homo sapiens
gctctggggatgggtggggag

SEQ ID NO: 920458 - DNA, 17 bp, Homo sapiens
gctctggggatttctgg

SEQ ID NO: 920459 - DNA, 21 bp, Homo sapiens
gctctgggggacccaggtggg

SEQ ID NO: 920460 - DNA, 21 bp, Homo sapiens
gctctggggtgggcagttttt

SEQ ID NO: 920461 - DNA, 14 bp, Homo sapiens
gctctggtgcacgc

SEQ ID NO: 920462 - DNA, 14 bp, Homo sapiens
gctctgtaacttac

SEQ ID NO: 920463 - DNA, 23 bp, Homo sapiens
gctctgtaacttacacctggaat

SEQ ID NO: 920464 - DNA, 18 bp, Homo sapiens
gctctgtcccccaggctg

SEQ ID NO: 920465 - DNA, 20 bp, Homo sapiens
gctctgtcccccaggctgga

SEQ ID NO: 920466 - DNA, 19 bp, Homo sapiens
gctctgtcttggtaggttt

SEQ ID NO: 920467 - DNA, 22 bp, Homo sapiens
gctctgtgagggtgctgactgg

SEQ ID NO: 920468 - DNA, 15 bp, Homo sapiens
gctctgtggaattca

SEQ ID NO: 920469 - DNA, 20 bp, Homo sapiens
gctctgtggcctgtgtccag

SEQ ID NO: 920470 - DNA, 15 bp, Homo sapiens
gctctgtgggtctct

SEQ ID NO: 920471 - DNA, 22 bp, Homo sapiens
gctctgtgttcccagaggcagg

SEQ ID NO: 920472 - DNA, 17 bp, Homo sapiens
gctctgttacccaggct

SEQ ID NO: 920473 - DNA, 20 bp, Homo sapiens
gctctgttacccaggctgga

SEQ ID NO: 920474 - DNA, 21 bp, Homo sapiens
gctctgttatcagctgggcag

SEQ ID NO: 920475 - DNA, 22 bp, Homo sapiens
gctctgttatcagctgggcagt

SEQ ID NO: 920476 - DNA, 17 bp, Homo sapiens
gctctgtttgtgggact

SEQ ID NO: 920477 - DNA, 13 bp, Homo sapiens
gctcttaaaatat

SEQ ID NO: 920478 - DNA, 14 bp, Homo sapiens
gctcttaaaatatc

SEQ ID NO: 920479 - DNA, 19 bp, Homo sapiens
gctcttaaaatatcttcct

SEQ ID NO: 920480 - DNA, 17 bp, Homo sapiens
gctcttaagcagcatgg

SEQ ID NO: 920481 - DNA, 19 bp, Homo sapiens
gctcttaagcagcatggaa

SEQ ID NO: 920482 - DNA, 23 bp, Homo sapiens
gctcttaagcagcatggaaaaat

SEQ ID NO: 920483 - DNA, 16 bp, Homo sapiens
gctcttagtcccaagc

SEQ ID NO: 920484 - DNA, 17 bp, Homo sapiens
gctcttatgtgtgcctt

SEQ ID NO: 920485 - DNA, 19 bp, Homo sapiens
gctcttatgtgtgcctttg

SEQ ID NO: 920486 - DNA, 16 bp, Homo sapiens
gctcttcaagctgtcc

SEQ ID NO: 920487 - DNA, 23 bp, Homo sapiens
gctcttcaagctgtcccctctgt

SEQ ID NO: 920488 - DNA, 24 bp, Homo sapiens
gctcttcaagctgtcccctctgtc

SEQ ID NO: 920489 - DNA, 19 bp, Homo sapiens
gctcttcagtgggagaaaa

SEQ ID NO: 920490 - DNA, 15 bp, Homo sapiens
gctcttcatctgcct

SEQ ID NO: 920491 - DNA, 17 bp, Homo sapiens
gctcttccaaagctcct

SEQ ID NO: 920492 - DNA, 21 bp, Homo sapiens
gctcttcccctagacctcccc

SEQ ID NO: 920493 - DNA, 13 bp, Homo sapiens
gctcttcctggac

SEQ ID NO: 920494 - DNA, 15 bp, Homo sapiens
gctcttcctggacct

SEQ ID NO: 920495 - DNA, 20 bp, Homo sapiens
gctcttccttgaatcttctc

SEQ ID NO: 920496 - DNA, 15 bp, Homo sapiens
gctcttctccacgtc

SEQ ID NO: 920497 - DNA, 13 bp, Homo sapiens
gctcttctgggca

SEQ ID NO: 920498 - DNA, 17 bp, Homo sapiens
gctcttctgtgcccagg

SEQ ID NO: 920499 - DNA, 16 bp, Homo sapiens
gctcttctttctgaga

SEQ ID NO: 920500 - DNA, 19 bp, Homo sapiens
gctcttgatacccccctct

SEQ ID NO: 920501 - DNA, 16 bp, Homo sapiens
gctcttgcccttccct

SEQ ID NO: 920502 - DNA, 17 bp, Homo sapiens
gctcttggaagagctct

SEQ ID NO: 920503 - DNA, 19 bp, Homo sapiens
gctcttggctgacccctct

SEQ ID NO: 920504 - DNA, 23 bp, Homo sapiens
gctcttggggttcataggggcag

SEQ ID NO: 920505 - DNA, 18 bp, Homo sapiens
gctcttggtacctgtggg

SEQ ID NO: 920506 - DNA, 15 bp, Homo sapiens
gctcttggtccctgg

SEQ ID NO: 920507 - DNA, 14 bp, Homo sapiens
gctcttgtcccacg

SEQ ID NO: 920508 - DNA, 22 bp, Homo sapiens
gctcttgtcccacgtgtcttcc

SEQ ID NO: 920509 - DNA, 16 bp, Homo sapiens
gctcttgttctgttcc

SEQ ID NO: 920510 - DNA, 19 bp, Homo sapiens
gctcttgtttcactccacc

SEQ ID NO: 920511 - DNA, 19 bp, Homo sapiens
gctctttattgcagaatgt

SEQ ID NO: 920512 - DNA, 15 bp, Homo sapiens
gctctttcagagagg

SEQ ID NO: 920513 - DNA, 12 bp, Homo sapiens
gctctttcaggg

SEQ ID NO: 920514 - DNA, 13 bp, Homo sapiens
gctctttccaaat

SEQ ID NO: 920515 - DNA, 16 bp, Homo sapiens
gctctttcccggcagc

SEQ ID NO: 920516 - DNA, 20 bp, Homo sapiens
gctctttctacatgactggg

SEQ ID NO: 920517 - DNA, 14 bp, Homo sapiens
gctctttctctgcc

SEQ ID NO: 920518 - DNA, 21 bp, Homo sapiens
gctctttctctgccagtgaca

SEQ ID NO: 920519 - DNA, 23 bp, Homo sapiens
gctctttgagaactgcttctaag

SEQ ID NO: 920520 - DNA, 20 bp, Homo sapiens
gctctttggggtcagccagg

SEQ ID NO: 920521 - DNA, 21 bp, Homo sapiens
gctctttggggtcagccaggg

SEQ ID NO: 920522 - DNA, 23 bp, Homo sapiens
gctctttggggtcagccagggcc

SEQ ID NO: 920523 - DNA, 23 bp, Homo sapiens
gctcttttaaaataagctttctc

SEQ ID NO: 920524 - DNA, 19 bp, Homo sapiens
gctcttttagggtaagaag

SEQ ID NO: 920525 - DNA, 15 bp, Homo sapiens
gctcttttccactcc

SEQ ID NO: 920526 - DNA, 20 bp, Homo sapiens
gctcttttccactccaagat

SEQ ID NO: 920527 - DNA, 20 bp, Homo sapiens
gctcttttttgtttgtttct

SEQ ID NO: 920528 - DNA, 16 bp, Homo sapiens
gctctttttttaaaag

SEQ ID NO: 920529 - DNA, 21 bp, Homo sapiens
gctgaaacaactccttttact

SEQ ID NO: 920530 - DNA, 23 bp, Homo sapiens
gctgaaagaacatggacttgtat

SEQ ID NO: 920531 - DNA, 15 bp, Homo sapiens
gctgaaattctcctg

SEQ ID NO: 920532 - DNA, 16 bp, Homo sapiens
gctgaaattctcctgg

SEQ ID NO: 920533 - DNA, 21 bp, Homo sapiens
gctgaaattgcttatttttgg

SEQ ID NO: 920534 - DNA, 17 bp, Homo sapiens
gctgaaattttatatgc

SEQ ID NO: 920535 - DNA, 13 bp, Homo sapiens
gctgaacagtgga

SEQ ID NO: 920536 - DNA, 15 bp, Homo sapiens
gctgaacattgcata

SEQ ID NO: 920537 - DNA, 15 bp, Homo sapiens
gctgaaccacagaaa

SEQ ID NO: 920538 - DNA, 21 bp, Homo sapiens
gctgaaccctgtgctggtgtc

SEQ ID NO: 920539 - DNA, 15 bp, Homo sapiens
gctgaactcttcaga

SEQ ID NO: 920540 - DNA, 16 bp, Homo sapiens
gctgaactcttcagaa

SEQ ID NO: 920541 - DNA, 16 bp, Homo sapiens
gctgaactgagaaggc

SEQ ID NO: 920542 - DNA, 19 bp, Homo sapiens
gctgaagaaaaaatcagaa

SEQ ID NO: 920543 - DNA, 11 bp, Homo sapiens
ctccagccagc

SEQ ID NO: 920544 - DNA, 24 bp, Homo sapiens
ctccagccagcaatgatgtccaga

SEQ ID NO: 920545 - DNA, 15 bp, Homo sapiens
ctccagccagcgcct

SEQ ID NO: 920546 - DNA, 17 bp, Homo sapiens
ctccagccagcgcctcc

SEQ ID NO: 920547 - DNA, 21 bp, Homo sapiens
ctccagccagcgcctccctcc

SEQ ID NO: 920548 - DNA, 23 bp, Homo sapiens
ctccagccagcgcctccctccac

SEQ ID NO: 920549 - DNA, 23 bp, Homo sapiens
ctccagccatcaagagactgagt

SEQ ID NO: 920550 - DNA, 18 bp, Homo sapiens
ctccagcccctcttggag

SEQ ID NO: 920551 - DNA, 13 bp, Homo sapiens
ctccagcccctgg

SEQ ID NO: 920552 - DNA, 23 bp, Homo sapiens
ctccagccccttctcagaatcta

SEQ ID NO: 920553 - DNA, 20 bp, Homo sapiens
ctccagcccctttgcctctg

SEQ ID NO: 920554 - DNA, 14 bp, Homo sapiens
ctccagcccgcagc

SEQ ID NO: 920555 - DNA, 15 bp, Homo sapiens
ctccagcccgggagc

SEQ ID NO: 920556 - DNA, 20 bp, Homo sapiens
ctccagccctgcccaccctc

SEQ ID NO: 920557 - DNA, 21 bp, Homo sapiens
ctccagccctgcccaccctcc

SEQ ID NO: 920558 - DNA, 14 bp, Homo sapiens
ctccagcctcccct

SEQ ID NO: 920559 - DNA, 15 bp, Homo sapiens
ctccagcctcccctc

SEQ ID NO: 920560 - DNA, 21 bp, Homo sapiens
ctccagcctcccctcccctgg

SEQ ID NO: 920561 - DNA, 16 bp, Homo sapiens
ctccagcctccctgtc

SEQ ID NO: 920562 - DNA, 20 bp, Homo sapiens
ctccagcctccctgtctcca

SEQ ID NO: 920563 - DNA, 22 bp, Homo sapiens
ctccagcctccctgtctccagc

SEQ ID NO: 920564 - DNA, 24 bp, Homo sapiens
ctccagcctccctgtctccagctg

SEQ ID NO: 920565 - DNA, 15 bp, Homo sapiens
ctccagcctctcccg

SEQ ID NO: 920566 - DNA, 17 bp, Homo sapiens
ctccagcctctcccggc

SEQ ID NO: 920567 - DNA, 18 bp, Homo sapiens
ctccagcctctcccggct

SEQ ID NO: 920568 - DNA, 23 bp, Homo sapiens
ctccagcctctcccggctgcctg

SEQ ID NO: 920569 - DNA, 14 bp, Homo sapiens
ctccagcctgggca

SEQ ID NO: 920570 - DNA, 23 bp, Homo sapiens
ctccagcctttgctccctccccg

SEQ ID NO: 920571 - DNA, 19 bp, Homo sapiens
ctccagcgtcagctgctcc

SEQ ID NO: 920572 - DNA, 23 bp, Homo sapiens
ctccagcgtcagctgctccctgg

SEQ ID NO: 920573 - DNA, 19 bp, Homo sapiens
ctccagctcagaacccagg

SEQ ID NO: 920574 - DNA, 23 bp, Homo sapiens
ctccagctcagaacccagggctc

SEQ ID NO: 920575 - DNA, 19 bp, Homo sapiens
ctccagctcatgacactgt

SEQ ID NO: 920576 - DNA, 11 bp, Homo sapiens
ctccagctcct

SEQ ID NO: 920577 - DNA, 21 bp, Homo sapiens
ctccagctcgtgtgtcctcat

SEQ ID NO: 920578 - DNA, 14 bp, Homo sapiens
ctccagctgccccg

SEQ ID NO: 920579 - DNA, 21 bp, Homo sapiens
ctccagctgcctgggcccgga

SEQ ID NO: 920580 - DNA, 22 bp, Homo sapiens
ctccagctggccgggagcctga

SEQ ID NO: 920581 - DNA, 23 bp, Homo sapiens
ctccagctggccgggagcctgat

SEQ ID NO: 920582 - DNA, 19 bp, Homo sapiens
ctccagctgggctctgcaa

SEQ ID NO: 920583 - DNA, 18 bp, Homo sapiens
ctccagctgttcagctgg

SEQ ID NO: 920584 - DNA, 18 bp, Homo sapiens
ctccagcttcggagggcc

SEQ ID NO: 920585 - DNA, 20 bp, Homo sapiens
ctccagcttttcctcagggt

SEQ ID NO: 920586 - DNA, 19 bp, Homo sapiens
ctccagcttttctttttct

SEQ ID NO: 920587 - DNA, 12 bp, Homo sapiens
ctccaggaaaga

SEQ ID NO: 920588 - DNA, 21 bp, Homo sapiens
ctccaggaaagagcagtcaga

SEQ ID NO: 920589 - DNA, 18 bp, Homo sapiens
ctccaggaaccacaccac

SEQ ID NO: 920590 - DNA, 11 bp, Homo sapiens
ctccaggacca

SEQ ID NO: 920591 - DNA, 17 bp, Homo sapiens
ctccaggagcttcttgt

SEQ ID NO: 920592 - DNA, 16 bp, Homo sapiens
ctccaggatttataaa

SEQ ID NO: 920593 - DNA, 17 bp, Homo sapiens
ctccaggatttataaag

SEQ ID NO: 920594 - DNA, 21 bp, Homo sapiens
ctccaggattttaatttcagg

SEQ ID NO: 920595 - DNA, 15 bp, Homo sapiens
ctccaggcaggccag

SEQ ID NO: 920596 - DNA, 20 bp, Homo sapiens
ctccaggcaggccaggctgc

SEQ ID NO: 920597 - DNA, 21 bp, Homo sapiens
ctccaggcatatgtttcccca

SEQ ID NO: 920598 - DNA, 20 bp, Homo sapiens
ctccaggcatttagccctca

SEQ ID NO: 920599 - DNA, 23 bp, Homo sapiens
ctccaggccaggtgggaacggct

SEQ ID NO: 920600 - DNA, 17 bp, Homo sapiens
ctccaggcccaaggctc

SEQ ID NO: 920601 - DNA, 19 bp, Homo sapiens
ctccaggcccaaggctccc

SEQ ID NO: 920602 - DNA, 18 bp, Homo sapiens
ctccaggcccccaactcc

SEQ ID NO: 920603 - DNA, 15 bp, Homo sapiens
ctccaggcctgcagc

SEQ ID NO: 920604 - DNA, 17 bp, Homo sapiens
ctccaggcctgcagcag

SEQ ID NO: 920605 - DNA, 18 bp, Homo sapiens
ctccaggcgccggcgggc

SEQ ID NO: 920606 - DNA, 15 bp, Homo sapiens
ctccaggctttctgg

SEQ ID NO: 920607 - DNA, 10 bp, Homo sapiens
ctccagggaa

SEQ ID NO: 920608 - DNA, 12 bp, Homo sapiens
ctccagggaagc

SEQ ID NO: 920609 - DNA, 13 bp, Homo sapiens
ctccagggaagcg

SEQ ID NO: 920610 - DNA, 15 bp, Homo sapiens
ctccagggaagcgtc

SEQ ID NO: 920611 - DNA, 16 bp, Homo sapiens
ctccagggaatccaag

SEQ ID NO: 920612 - DNA, 22 bp, Homo sapiens
ctccagggaatccaagcctcca

SEQ ID NO: 920613 - DNA, 20 bp, Homo sapiens
ctccagggagcaagacagag

SEQ ID NO: 920614 - DNA, 22 bp, Homo sapiens
ctccagggagcctagaagctgg

SEQ ID NO: 920615 - DNA, 21 bp, Homo sapiens
ctccagggagtcccctccccg

SEQ ID NO: 920616 - DNA, 19 bp, Homo sapiens
ctccagggccacgtgccag

SEQ ID NO: 920617 - DNA, 14 bp, Homo sapiens
ctccagggcccagg

SEQ ID NO: 920618 - DNA, 18 bp, Homo sapiens
ctccagggcccccaccga

SEQ ID NO: 920619 - DNA, 14 bp, Homo sapiens
ctccaggggctcct

SEQ ID NO: 920620 - DNA, 15 bp, Homo sapiens
ctccaggggctcctg

SEQ ID NO: 920621 - DNA, 17 bp, Homo sapiens
ctccaggggctcctggg

SEQ ID NO: 920622 - DNA, 18 bp, Homo sapiens
ctccaggggctcctgggt

SEQ ID NO: 920623 - DNA, 23 bp, Homo sapiens
ctccaggggctgcttcctcctgg

SEQ ID NO: 920624 - DNA, 15 bp, Homo sapiens
ctccagggtcccctg

SEQ ID NO: 920625 - DNA, 18 bp, Homo sapiens
ctccagggtcccctgcca

SEQ ID NO: 920626 - DNA, 19 bp, Homo sapiens
ctccagggtcccctgccac

SEQ ID NO: 920627 - DNA, 13 bp, Homo sapiens
ctccagggtcttg

SEQ ID NO: 920628 - DNA, 21 bp, Homo sapiens
ctccagggtcttgggctactg

SEQ ID NO: 920629 - DNA, 12 bp, Homo sapiens
ctccagggtgct

SEQ ID NO: 920630 - DNA, 18 bp, Homo sapiens
ctccaggtctcacgggca

SEQ ID NO: 920631 - DNA, 24 bp, Homo sapiens
ctccagtacgtcccgctgctgtgc

SEQ ID NO: 920632 - DNA, 18 bp, Homo sapiens
ctccagtataatctcctc

SEQ ID NO: 920633 - DNA, 15 bp, Homo sapiens
ctccagtatgaaatt

SEQ ID NO: 920634 - DNA, 16 bp, Homo sapiens
ctccagtcaggaggca

SEQ ID NO: 920635 - DNA, 17 bp, Homo sapiens
ctccagtcgttatttct

SEQ ID NO: 920636 - DNA, 20 bp, Homo sapiens
ctccagtcgttatttctgtt

SEQ ID NO: 920637 - DNA, 17 bp, Homo sapiens
ctccagtctgctgccct

SEQ ID NO: 920638 - DNA, 12 bp, Homo sapiens
ctccagtgcagt

SEQ ID NO: 920639 - DNA, 13 bp, Homo sapiens
ctccagtgcagtc

SEQ ID NO: 920640 - DNA, 15 bp, Homo sapiens
ctccagtgcagtcca

SEQ ID NO: 920641 - DNA, 18 bp, Homo sapiens
ctccagtgccagcaatga

SEQ ID NO: 920642 - DNA, 20 bp, Homo sapiens
ctccagtgggctgatgctgg

SEQ ID NO: 920643 - DNA, 21 bp, Homo sapiens
ctccagtgggctgatgctggg

SEQ ID NO: 920644 - DNA, 15 bp, Homo sapiens
ctccagtggttgctg

SEQ ID NO: 920645 - DNA, 16 bp, Homo sapiens
ctccagtggttgctgt

SEQ ID NO: 920646 - DNA, 15 bp, Homo sapiens
ctccagttgaacact

SEQ ID NO: 920647 - DNA, 19 bp, Homo sapiens
ctccagttgggactcagga

SEQ ID NO: 920648 - DNA, 16 bp, Homo sapiens
ctccagtttgcacctg

SEQ ID NO: 920649 - DNA, 18 bp, Homo sapiens
ctccagttttctcctctg

SEQ ID NO: 920650 - DNA, 14 bp, Homo sapiens
ctccagtttttgtt

SEQ ID NO: 920651 - DNA, 15 bp, Homo sapiens
ctccataaacagact

SEQ ID NO: 920652 - DNA, 22 bp, Homo sapiens
ctccataaacatgaaaacactt

SEQ ID NO: 920653 - DNA, 13 bp, Homo sapiens
ctccataagttta

SEQ ID NO: 920654 - DNA, 14 bp, Homo sapiens
ctccataagtttaa

SEQ ID NO: 920655 - DNA, 14 bp, Homo sapiens
ctccatacagcctc

SEQ ID NO: 920656 - DNA, 16 bp, Homo sapiens
ctccatacagcctcta

SEQ ID NO: 920657 - DNA, 17 bp, Homo sapiens
ctccatagctccttccc

SEQ ID NO: 920658 - DNA, 18 bp, Homo sapiens
ctccatagctccttccca

SEQ ID NO: 920659 - DNA, 17 bp, Homo sapiens
ctccatatctccttccc

SEQ ID NO: 920660 - DNA, 22 bp, Homo sapiens
ctccatatgctgtacatgacat

SEQ ID NO: 920661 - DNA, 23 bp, Homo sapiens
ctccatattaaaacatatgacca

SEQ ID NO: 920662 - DNA, 19 bp, Homo sapiens
ctccatatttgatttctaa

SEQ ID NO: 920663 - DNA, 22 bp, Homo sapiens
ctccatcaccctcttcctgtga

SEQ ID NO: 920664 - DNA, 19 bp, Homo sapiens
ctccatcacctgaaacact

SEQ ID NO: 920665 - DNA, 22 bp, Homo sapiens
ctccatcacctgaaacactgga

SEQ ID NO: 920666 - DNA, 22 bp, Homo sapiens
ctccatcagatgtgttcctcca

SEQ ID NO: 920667 - DNA, 13 bp, Homo sapiens
gctgaagacattc

SEQ ID NO: 920668 - DNA, 18 bp, Homo sapiens
gctgaagagagggacagg

SEQ ID NO: 920669 - DNA, 11 bp, Homo sapiens
gctgaagagca

SEQ ID NO: 920670 - DNA, 14 bp, Homo sapiens
gctgaagagcaagg

SEQ ID NO: 920671 - DNA, 18 bp, Homo sapiens
gctgaagatgaatcaatg

SEQ ID NO: 920672 - DNA, 18 bp, Homo sapiens
gctgaagatggcatcctg

SEQ ID NO: 920673 - DNA, 19 bp, Homo sapiens
gctgaaggaaaccagtgca

SEQ ID NO: 920674 - DNA, 23 bp, Homo sapiens
gctgaaggtccaggcttgcctca

SEQ ID NO: 920675 - DNA, 14 bp, Homo sapiens
gctgaagttctgag

SEQ ID NO: 920676 - DNA, 17 bp, Homo sapiens
gctgaatacagaggcaa

SEQ ID NO: 920677 - DNA, 14 bp, Homo sapiens
gctgaatatctgtt

SEQ ID NO: 920678 - DNA, 23 bp, Homo sapiens
gctgaatcccatcaggctgttat

SEQ ID NO: 920679 - DNA, 21 bp, Homo sapiens
gctgaatgaagctgccatcct

SEQ ID NO: 920680 - DNA, 22 bp, Homo sapiens
gctgaattaaaatggtttttgt

SEQ ID NO: 920681 - DNA, 14 bp, Homo sapiens
gctgaattgagaat

SEQ ID NO: 920682 - DNA, 21 bp, Homo sapiens
gctgacaaccaccgctcccca

SEQ ID NO: 920683 - DNA, 22 bp, Homo sapiens
gctgacaaccaccgctccccag

SEQ ID NO: 920684 - DNA, 19 bp, Homo sapiens
gctgacaaccattaaagtc

SEQ ID NO: 920685 - DNA, 20 bp, Homo sapiens
gctgacaaccattaaagtca

SEQ ID NO: 920686 - DNA, 22 bp, Homo sapiens
gctgacaaccattaaagtcaga

SEQ ID NO: 920687 - DNA, 15 bp, Homo sapiens
gctgacaagggacta

SEQ ID NO: 920688 - DNA, 22 bp, Homo sapiens
gctgacacctaccatgctgctt

SEQ ID NO: 920689 - DNA, 22 bp, Homo sapiens
gctgacaggtgatgctctggct

SEQ ID NO: 920690 - DNA, 19 bp, Homo sapiens
gctgacagtttgtggcatc

SEQ ID NO: 920691 - DNA, 17 bp, Homo sapiens
gctgacatgaagctgtt

SEQ ID NO: 920692 - DNA, 15 bp, Homo sapiens
gctgaccaagagaga

SEQ ID NO: 920693 - DNA, 16 bp, Homo sapiens
gctgaccaattgtgct

SEQ ID NO: 920694 - DNA, 19 bp, Homo sapiens
gctgaccaattgtgctgcc

SEQ ID NO: 920695 - DNA, 20 bp, Homo sapiens
gctgaccaattgtgctgcca

SEQ ID NO: 920696 - DNA, 13 bp, Homo sapiens
gctgaccacagca

SEQ ID NO: 920697 - DNA, 12 bp, Homo sapiens
gctgaccagaca

SEQ ID NO: 920698 - DNA, 21 bp, Homo sapiens
gctgaccatgctcatctgctg

SEQ ID NO: 920699 - DNA, 20 bp, Homo sapiens
gctgacccagcatctcccag

SEQ ID NO: 920700 - DNA, 13 bp, Homo sapiens
gctgacccagtcc

SEQ ID NO: 920701 - DNA, 15 bp, Homo sapiens
gctgacccagtccct

SEQ ID NO: 920702 - DNA, 16 bp, Homo sapiens
gctgacccagtccctg

SEQ ID NO: 920703 - DNA, 18 bp, Homo sapiens
gctgaccccaaagagcct

SEQ ID NO: 920704 - DNA, 12 bp, Homo sapiens
gctgaccccagg

SEQ ID NO: 920705 - DNA, 20 bp, Homo sapiens
gctgaccccaggtcagccct

SEQ ID NO: 920706 - DNA, 21 bp, Homo sapiens
gctgaccccaggtcagccctg

SEQ ID NO: 920707 - DNA, 19 bp, Homo sapiens
gctgaccccgagaagtgct

SEQ ID NO: 920708 - DNA, 21 bp, Homo sapiens
gctgaccccgagaagtgctct

SEQ ID NO: 920709 - DNA, 21 bp, Homo sapiens
gctgacccctctggtgtgtgg

SEQ ID NO: 920710 - DNA, 18 bp, Homo sapiens
gctgacctctgttgtcct

SEQ ID NO: 920711 - DNA, 13 bp, Homo sapiens
gctgacctgctga

SEQ ID NO: 920712 - DNA, 22 bp, Homo sapiens
gctgacctgggcccacagagcc

SEQ ID NO: 920713 - DNA, 21 bp, Homo sapiens
gctgacgccaataataaaaaa

SEQ ID NO: 920714 - DNA, 20 bp, Homo sapiens
gctgactgatgttgagggaa

SEQ ID NO: 920715 - DNA, 14 bp, Homo sapiens
gctgactgggccac

SEQ ID NO: 920716 - DNA, 17 bp, Homo sapiens
gctgactggggctgggg

SEQ ID NO: 920717 - DNA, 18 bp, Homo sapiens
gctgactgtactcctccc

SEQ ID NO: 920718 - DNA, 13 bp, Homo sapiens
gctgactgtggcc

SEQ ID NO: 920719 - DNA, 23 bp, Homo sapiens
gctgactgtggccccctccgtga

SEQ ID NO: 920720 - DNA, 17 bp, Homo sapiens
gctgactgtttcattca

SEQ ID NO: 920721 - DNA, 19 bp, Homo sapiens
gctgacttcatctcccacc

SEQ ID NO: 920722 - DNA, 24 bp, Homo sapiens
gctgacttcatctcccacctagca

SEQ ID NO: 920723 - DNA, 12 bp, Homo sapiens
gctgagaaaagt

SEQ ID NO: 920724 - DNA, 21 bp, Homo sapiens
gctgagaaaagtattctcaaa

SEQ ID NO: 920725 - DNA, 16 bp, Homo sapiens
gctgagaagaggagga

SEQ ID NO: 920726 - DNA, 17 bp, Homo sapiens
gctgagaatctgggggt

SEQ ID NO: 920727 - DNA, 16 bp, Homo sapiens
gctgagaatgtggaat

SEQ ID NO: 920728 - DNA, 15 bp, Homo sapiens
gctgagacaggagaa

SEQ ID NO: 920729 - DNA, 14 bp, Homo sapiens
gctgagactgcggg

SEQ ID NO: 920730 - DNA, 19 bp, Homo sapiens
gctgagactggatactgcc

SEQ ID NO: 920731 - DNA, 15 bp, Homo sapiens
gctgagagacccaag

SEQ ID NO: 920732 - DNA, 17 bp, Homo sapiens
gctgagagacccaagga

SEQ ID NO: 920733 - DNA, 15 bp, Homo sapiens
gctgagagaccctgg

SEQ ID NO: 920734 - DNA, 19 bp, Homo sapiens
gctgagagaccctggcctc

SEQ ID NO: 920735 - DNA, 20 bp, Homo sapiens
gctgagagaccctggcctca

SEQ ID NO: 920736 - DNA, 14 bp, Homo sapiens
gctgagagactttt

SEQ ID NO: 920737 - DNA, 17 bp, Homo sapiens
gctgagagcccccacct

SEQ ID NO: 920738 - DNA, 17 bp, Homo sapiens
gctgagagccctgctgt

SEQ ID NO: 920739 - DNA, 22 bp, Homo sapiens
gctgagaggcagacttccctga

SEQ ID NO: 920740 - DNA, 21 bp, Homo sapiens
gctgagcacccagctctgtct

SEQ ID NO: 920741 - DNA, 14 bp, Homo sapiens
gctgagcagcctct

SEQ ID NO: 920742 - DNA, 16 bp, Homo sapiens
gctgagcagcctctgg

SEQ ID NO: 920743 - DNA, 23 bp, Homo sapiens
gctgagccacggataccgccacg

SEQ ID NO: 920744 - DNA, 13 bp, Homo sapiens
gctgagccactcg

SEQ ID NO: 920745 - DNA, 22 bp, Homo sapiens
gctgagccattgagtgctgggg

SEQ ID NO: 920746 - DNA, 21 bp, Homo sapiens
gctgagcccctaccccacacc

SEQ ID NO: 920747 - DNA, 14 bp, Homo sapiens
gctgagcccctggt

SEQ ID NO: 920748 - DNA, 14 bp, Homo sapiens
ctcccaatcagctt

SEQ ID NO: 920749 - DNA, 14 bp, Homo sapiens
ctcccacaatctgg

SEQ ID NO: 920750 - DNA, 15 bp, Homo sapiens
ctcccacacccaccc

SEQ ID NO: 920751 - DNA, 14 bp, Homo sapiens
ctcccacagacctg

SEQ ID NO: 920752 - DNA, 15 bp, Homo sapiens
ctcccacagacctgc

SEQ ID NO: 920753 - DNA, 20 bp, Homo sapiens
ctcccacagacctgcagtga

SEQ ID NO: 920754 - DNA, 16 bp, Homo sapiens
ctcccacagagtgctg

SEQ ID NO: 920755 - DNA, 20 bp, Homo sapiens
ctcccacagagtgctggact

SEQ ID NO: 920756 - DNA, 22 bp, Homo sapiens
ctcccacagagtgctggactgt

SEQ ID NO: 920757 - DNA, 21 bp, Homo sapiens
ctcccacatcccactggatct

SEQ ID NO: 920758 - DNA, 13 bp, Homo sapiens
ctcccaccacagc

SEQ ID NO: 920759 - DNA, 17 bp, Homo sapiens
ctcccaccactccactc

SEQ ID NO: 920760 - DNA, 22 bp, Homo sapiens
ctcccaccactccactcctcca

SEQ ID NO: 920761 - DNA, 22 bp, Homo sapiens
ctcccaccagaacgcaccccac

SEQ ID NO: 920762 - DNA, 14 bp, Homo sapiens
ctcccaccagagac

SEQ ID NO: 920763 - DNA, 13 bp, Homo sapiens
ctcccaccccacc

SEQ ID NO: 920764 - DNA, 20 bp, Homo sapiens
ctcccaccccactcagggga

SEQ ID NO: 920765 - DNA, 13 bp, Homo sapiens
ctcccacccccag

SEQ ID NO: 920766 - DNA, 22 bp, Homo sapiens
ctcccacccccatctctccctc

SEQ ID NO: 920767 - DNA, 18 bp, Homo sapiens
ctcccacccccttctctg

SEQ ID NO: 920768 - DNA, 23 bp, Homo sapiens
ctcccacccccttctctgctcca

SEQ ID NO: 920769 - DNA, 20 bp, Homo sapiens
ctcccaccccgccgttccct

SEQ ID NO: 920770 - DNA, 19 bp, Homo sapiens
ctcccaccccttggcccct

SEQ ID NO: 920771 - DNA, 15 bp, Homo sapiens
ctcccacccgatgct

SEQ ID NO: 920772 - DNA, 17 bp, Homo sapiens
ctcccacccgatgctgc

SEQ ID NO: 920773 - DNA, 20 bp, Homo sapiens
ctcccacccgatgctgcttt

SEQ ID NO: 920774 - DNA, 17 bp, Homo sapiens
ctcccacccggctgcag

SEQ ID NO: 920775 - DNA, 19 bp, Homo sapiens
ctcccaccctaagggcagc

SEQ ID NO: 920776 - DNA, 22 bp, Homo sapiens
ctcccaccctaagggcagccct

SEQ ID NO: 920777 - DNA, 15 bp, Homo sapiens
ctcccacctcccttc

SEQ ID NO: 920778 - DNA, 16 bp, Homo sapiens
ctcccacctcccttcc

SEQ ID NO: 920779 - DNA, 17 bp, Homo sapiens
ctcccacctcccttccc

SEQ ID NO: 920780 - DNA, 16 bp, Homo sapiens
ctcccacctgtttctg

SEQ ID NO: 920781 - DNA, 12 bp, Homo sapiens
ctcccactccca

SEQ ID NO: 920782 - DNA, 20 bp, Homo sapiens
ctcccactgcaacttgtgaa

SEQ ID NO: 920783 - DNA, 19 bp, Homo sapiens
ctcccactgggactcccag

SEQ ID NO: 920784 - DNA, 16 bp, Homo sapiens
ctcccacttcctccta

SEQ ID NO: 920785 - DNA, 19 bp, Homo sapiens
ctcccacttcctcctacct

SEQ ID NO: 920786 - DNA, 12 bp, Homo sapiens
ctcccactttgc

SEQ ID NO: 920787 - DNA, 17 bp, Homo sapiens
ctcccagaatcccagcc

SEQ ID NO: 920788 - DNA, 19 bp, Homo sapiens
ctcccagaatcccagccgg

SEQ ID NO: 920789 - DNA, 17 bp, Homo sapiens
ctcccagacaggccctc

SEQ ID NO: 920790 - DNA, 23 bp, Homo sapiens
ctcccagacaggccctccctgtc

SEQ ID NO: 920791 - DNA, 14 bp, Homo sapiens
ctcccagaggtcca

SEQ ID NO: 920792 - DNA, 16 bp, Homo sapiens
ctcccagaggtccagc

SEQ ID NO: 920793 - DNA, 23 bp, Homo sapiens
gctgaggggcctgcgcccagagc

SEQ ID NO: 920794 - DNA, 19 bp, Homo sapiens
gctgagggtgtttcttcct

SEQ ID NO: 920795 - DNA, 17 bp, Homo sapiens
gctgaggtttcaccctt

SEQ ID NO: 920796 - DNA, 14 bp, Homo sapiens
gctgagtactggaa

SEQ ID NO: 920797 - DNA, 19 bp, Homo sapiens
gctgagtcacctcctccac

SEQ ID NO: 920798 - DNA, 21 bp, Homo sapiens
gctgagtcatgatctccctgc

SEQ ID NO: 920799 - DNA, 17 bp, Homo sapiens
gctgagtccagagcttg

SEQ ID NO: 920800 - DNA, 21 bp, Homo sapiens
gctgagtcccaggctgagcct

SEQ ID NO: 920801 - DNA, 22 bp, Homo sapiens
gctgagtcccaggctgagcctc

SEQ ID NO: 920802 - DNA, 14 bp, Homo sapiens
gctgagtgctgggc

SEQ ID NO: 920803 - DNA, 17 bp, Homo sapiens
gctgagtgctgggcact

SEQ ID NO: 920804 - DNA, 18 bp, Homo sapiens
gctgagtggaatgcaggg

SEQ ID NO: 920805 - DNA, 16 bp, Homo sapiens
gctgagtggccagcca

SEQ ID NO: 920806 - DNA, 23 bp, Homo sapiens
gctgagtggccagccagtgccat

SEQ ID NO: 920807 - DNA, 17 bp, Homo sapiens
gctgagtgggagaaggc

SEQ ID NO: 920808 - DNA, 22 bp, Homo sapiens
gctgagtgggagaaggcagtga

SEQ ID NO: 920809 - DNA, 13 bp, Homo sapiens
gctgagtttccta

SEQ ID NO: 920810 - DNA, 17 bp, Homo sapiens
gctgataagcattgact

SEQ ID NO: 920811 - DNA, 12 bp, Homo sapiens
gctgataatttt

SEQ ID NO: 920812 - DNA, 13 bp, Homo sapiens
gctgataatttta

SEQ ID NO: 920813 - DNA, 19 bp, Homo sapiens
gctgataattttaaattct

SEQ ID NO: 920814 - DNA, 14 bp, Homo sapiens
gctgatacttcatt

SEQ ID NO: 920815 - DNA, 18 bp, Homo sapiens
gctgatatatgtgttttt

SEQ ID NO: 920816 - DNA, 15 bp, Homo sapiens
gctgatattatttct

SEQ ID NO: 920817 - DNA, 19 bp, Homo sapiens
gctgatattatttcttctc

SEQ ID NO: 920818 - DNA, 16 bp, Homo sapiens
gctgatcagtgggcct

SEQ ID NO: 920819 - DNA, 22 bp, Homo sapiens
gctgatcatcgccagaggtgct

SEQ ID NO: 920820 - DNA, 17 bp, Homo sapiens
gctgatgaaactcctga

SEQ ID NO: 920821 - DNA, 21 bp, Homo sapiens
gctgatgaacttattctgtag

SEQ ID NO: 920822 - DNA, 15 bp, Homo sapiens
gctgatggcagctgg

SEQ ID NO: 920823 - DNA, 13 bp, Homo sapiens
gctgatggctgct

SEQ ID NO: 920824 - DNA, 20 bp, Homo sapiens
gctgatgggaaggaggggag

SEQ ID NO: 920825 - DNA, 16 bp, Homo sapiens
gctgatgtggactgtc

SEQ ID NO: 920826 - DNA, 19 bp, Homo sapiens
gctgatgtttataaactga

SEQ ID NO: 920827 - DNA, 19 bp, Homo sapiens
gctgattcaaaccaaagct

SEQ ID NO: 920828 - DNA, 16 bp, Homo sapiens
gctgattcttgtaaat

SEQ ID NO: 920829 - DNA, 19 bp, Homo sapiens
gctgattcttgtaaatctt

SEQ ID NO: 920830 - DNA, 19 bp, Homo sapiens
gctgatttccaggcccctg

SEQ ID NO: 920831 - DNA, 20 bp, Homo sapiens
gctgatttccaggcccctga

SEQ ID NO: 920832 - DNA, 23 bp, Homo sapiens
gctgatttccaggcccctgagga

SEQ ID NO: 920833 - DNA, 12 bp, Homo sapiens
gctgatttctag

SEQ ID NO: 920834 - DNA, 17 bp, Homo sapiens
gctgatttggtgaccaa

SEQ ID NO: 920835 - DNA, 14 bp, Homo sapiens
gctgattttaacaa

SEQ ID NO: 920836 - DNA, 18 bp, Homo sapiens
gctgcaaaactggaagca

SEQ ID NO: 920837 - DNA, 22 bp, Homo sapiens
gctgcaaaactggaagcacagc

SEQ ID NO: 920838 - DNA, 14 bp, Homo sapiens
gctgcaaaattaaa

SEQ ID NO: 920839 - DNA, 14 bp, Homo sapiens
gctgcaacaaaatg

SEQ ID NO: 920840 - DNA, 18 bp, Homo sapiens
gctgcaagcacagccctt

SEQ ID NO: 920841 - DNA, 21 bp, Homo sapiens
gctgcaaggtttaggctggtg

SEQ ID NO: 920842 - DNA, 18 bp, Homo sapiens
gctgcacaaagtcagcag

SEQ ID NO: 920843 - DNA, 20 bp, Homo sapiens
gctgcacacacctgggtgga

SEQ ID NO: 920844 - DNA, 14 bp, Homo sapiens
gctgcacagaaggg

SEQ ID NO: 920845 - DNA, 20 bp, Homo sapiens
gctgcacagaagggctcttt

SEQ ID NO: 920846 - DNA, 18 bp, Homo sapiens
gctgcacagcaggacctg

SEQ ID NO: 920847 - DNA, 13 bp, Homo sapiens
gctgcacatgtgc

SEQ ID NO: 920848 - DNA, 19 bp, Homo sapiens
gctgcacattgcctgttct

SEQ ID NO: 920849 - DNA, 12 bp, Homo sapiens
gctgcaccaacc

SEQ ID NO: 920850 - DNA, 12 bp, Homo sapiens
gctgcaccagag

SEQ ID NO: 920851 - DNA, 22 bp, Homo sapiens
gctgcaccagagtgaaagggct

SEQ ID NO: 920852 - DNA, 19 bp, Homo sapiens
gctgcaccccagcgtcagg

SEQ ID NO: 920853 - DNA, 14 bp, Homo sapiens
gctgcacccctggg

SEQ ID NO: 920854 - DNA, 15 bp, Homo sapiens
gctgcaccctcaggc

SEQ ID NO: 920855 - DNA, 18 bp, Homo sapiens
gctgcaccctcaggcagg

SEQ ID NO: 920856 - DNA, 15 bp, Homo sapiens
gctgcaccctgcgcc

SEQ ID NO: 920857 - DNA, 22 bp, Homo sapiens
gctgcaccctgcgcctccagag

SEQ ID NO: 920858 - DNA, 19 bp, Homo sapiens
gctgcacctgccagcctgg

SEQ ID NO: 920859 - DNA, 16 bp, Homo sapiens
gctgcacgctcccctc

SEQ ID NO: 920860 - DNA, 21 bp, Homo sapiens
gctgcacgtaggttccccaga

SEQ ID NO: 920861 - DNA, 23 bp, Homo sapiens
gctgcacgtaggttccccagaga

SEQ ID NO: 920862 - DNA, 18 bp, Homo sapiens
gctgcactggagccacag

SEQ ID NO: 920863 - DNA, 20 bp, Homo sapiens
gctgcactggagccacaggc

SEQ ID NO: 920864 - DNA, 13 bp, Homo sapiens
gctgcactgtgaa

SEQ ID NO: 920865 - DNA, 14 bp, Homo sapiens
gctgcactgtgaac

SEQ ID NO: 920866 - DNA, 15 bp, Homo sapiens
gctgcactgtgaacc

SEQ ID NO: 920867 - DNA, 21 bp, Homo sapiens
gctgcactgtgaacctgggca

SEQ ID NO: 920868 - DNA, 20 bp, Homo sapiens
gctgcagagaaacttaagca

SEQ ID NO: 920869 - DNA, 18 bp, Homo sapiens
gctgcagaggcacctcaa

SEQ ID NO: 920870 - DNA, 16 bp, Homo sapiens
ctccccaccttcccca

SEQ ID NO: 920871 - DNA, 17 bp, Homo sapiens
ctccccaccttccccag

SEQ ID NO: 920872 - DNA, 16 bp, Homo sapiens
ctccccacgagggctg

SEQ ID NO: 920873 - DNA, 18 bp, Homo sapiens
ctccccacgagggctggc

SEQ ID NO: 920874 - DNA, 22 bp, Homo sapiens
ctccccacgagtcacctgcaag

SEQ ID NO: 920875 - DNA, 23 bp, Homo sapiens
ctccccacggggcctcgggacct

SEQ ID NO: 920876 - DNA, 20 bp, Homo sapiens
ctccccactgaaaacatttc

SEQ ID NO: 920877 - DNA, 16 bp, Homo sapiens
ctccccagagcactgg

SEQ ID NO: 920878 - DNA, 16 bp, Homo sapiens
ctccccagagctgtgc

SEQ ID NO: 920879 - DNA, 18 bp, Homo sapiens
ctccccagagctgtgcca

SEQ ID NO: 920880 - DNA, 22 bp, Homo sapiens
ctccccagcccagggttccccc

SEQ ID NO: 920881 - DNA, 15 bp, Homo sapiens
ctccccaggcctcca

SEQ ID NO: 920882 - DNA, 13 bp, Homo sapiens
ctccccagggagc

SEQ ID NO: 920883 - DNA, 18 bp, Homo sapiens
ctccccagggagctctgg

SEQ ID NO: 920884 - DNA, 20 bp, Homo sapiens
ctccccagggagctctgggg

SEQ ID NO: 920885 - DNA, 18 bp, Homo sapiens
ctccccaggtccagctct

SEQ ID NO: 920886 - DNA, 19 bp, Homo sapiens
ctccccaggtccagctctg

SEQ ID NO: 920887 - DNA, 20 bp, Homo sapiens
ctccccaggtccagctctgg

SEQ ID NO: 920888 - DNA, 23 bp, Homo sapiens
ctccccaggtccagctctggagg

SEQ ID NO: 920889 - DNA, 12 bp, Homo sapiens
ctccccagtgcc

SEQ ID NO: 920890 - DNA, 17 bp, Homo sapiens
ctccccagtgcctgcca

SEQ ID NO: 920891 - DNA, 22 bp, Homo sapiens
ctccccagtgcctgccactctc

SEQ ID NO: 920892 - DNA, 16 bp, Homo sapiens
ctccccatcaccatgg

SEQ ID NO: 920893 - DNA, 21 bp, Homo sapiens
ctccccatctcggggctgctg

SEQ ID NO: 920894 - DNA, 17 bp, Homo sapiens
ctccccatctgtccagc

SEQ ID NO: 920895 - DNA, 18 bp, Homo sapiens
ctccccatgtgtcctggt

SEQ ID NO: 920896 - DNA, 17 bp, Homo sapiens
ctccccatttcccatct

SEQ ID NO: 920897 - DNA, 22 bp, Homo sapiens
ctccccatttcccatctgcacc

SEQ ID NO: 920898 - DNA, 17 bp, Homo sapiens
ctcccccaacacctgct

SEQ ID NO: 920899 - DNA, 19 bp, Homo sapiens
ctcccccaacacctgctgc

SEQ ID NO: 920900 - DNA, 13 bp, Homo sapiens
ctcccccaaccaa

SEQ ID NO: 920901 - DNA, 19 bp, Homo sapiens
ctcccccaaccaaggaagg

SEQ ID NO: 920902 - DNA, 20 bp, Homo sapiens
ctcccccaaccaaggaagga

SEQ ID NO: 920903 - DNA, 21 bp, Homo sapiens
ctcccccaaccaaggaaggag

SEQ ID NO: 920904 - DNA, 21 bp, Homo sapiens
ctcccccaacccccaccccac

SEQ ID NO: 920905 - DNA, 19 bp, Homo sapiens
ctcccccaaccccctgcaa

SEQ ID NO: 920906 - DNA, 16 bp, Homo sapiens
ctcccccacctgacaa

SEQ ID NO: 920907 - DNA, 13 bp, Homo sapiens
ctcccccagagtg

SEQ ID NO: 920908 - DNA, 21 bp, Homo sapiens
ctcccccagagtgctgtcggg

SEQ ID NO: 920909 - DNA, 14 bp, Homo sapiens
ctcccccagctcct

SEQ ID NO: 920910 - DNA, 21 bp, Homo sapiens
ctcccccataaaatgatcctg

SEQ ID NO: 920911 - DNA, 16 bp, Homo sapiens
ctcccccatagcaccc

SEQ ID NO: 920912 - DNA, 17 bp, Homo sapiens
ctcccccatcctcccct

SEQ ID NO: 920913 - DNA, 13 bp, Homo sapiens
ctcccccatctct

SEQ ID NO: 920914 - DNA, 13 bp, Homo sapiens
ctccccccactgc

SEQ ID NO: 920915 - DNA, 15 bp, Homo sapiens
ctccccccactgcag

SEQ ID NO: 920916 - DNA, 12 bp, Homo sapiens
ctccccccactt

SEQ ID NO: 920917 - DNA, 14 bp, Homo sapiens
ctccccccagaccc

SEQ ID NO: 920918 - DNA, 23 bp, Homo sapiens
ctccccccagaccccgcccctgg

SEQ ID NO: 920919 - DNA, 15 bp, Homo sapiens
ctccccccagactct

SEQ ID NO: 920920 - DNA, 20 bp, Homo sapiens
gctgccaggcgttggtgcca

SEQ ID NO: 920921 - DNA, 22 bp, Homo sapiens
gctgccaggcgttggtgccact

SEQ ID NO: 920922 - DNA, 12 bp, Homo sapiens
gctgccagggct

SEQ ID NO: 920923 - DNA, 13 bp, Homo sapiens
gctgccagggctt

SEQ ID NO: 920924 - DNA, 17 bp, Homo sapiens
gctgccagtgcagccac

SEQ ID NO: 920925 - DNA, 19 bp, Homo sapiens
gctgccagtgcagccactg

SEQ ID NO: 920926 - DNA, 20 bp, Homo sapiens
gctgccagtgcagccactgg

SEQ ID NO: 920927 - DNA, 16 bp, Homo sapiens
gctgccataattctaa

SEQ ID NO: 920928 - DNA, 17 bp, Homo sapiens
gctgccataattctaag

SEQ ID NO: 920929 - DNA, 20 bp, Homo sapiens
gctgccatagggtctgcagc

SEQ ID NO: 920930 - DNA, 22 bp, Homo sapiens
gctgccatagggtctgcagcct

SEQ ID NO: 920931 - DNA, 13 bp, Homo sapiens
gctgccatcaccg

SEQ ID NO: 920932 - DNA, 19 bp, Homo sapiens
gctgccatgacagaggctg

SEQ ID NO: 920933 - DNA, 12 bp, Homo sapiens
gctgccatgcca

SEQ ID NO: 920934 - DNA, 15 bp, Homo sapiens
gctgccatgccactg

SEQ ID NO: 920935 - DNA, 22 bp, Homo sapiens
gctgccatgccactgccaggca

SEQ ID NO: 920936 - DNA, 23 bp, Homo sapiens
gctgccatggcgtgtccctctcg

SEQ ID NO: 920937 - DNA, 21 bp, Homo sapiens
gctgccatgtgaagagggaga

SEQ ID NO: 920938 - DNA, 17 bp, Homo sapiens
gctgccattggtccacc

SEQ ID NO: 920939 - DNA, 20 bp, Homo sapiens
gctgcccacgctcctgccct

SEQ ID NO: 920940 - DNA, 23 bp, Homo sapiens
gctgcccacgctcctgccctcgt

SEQ ID NO: 920941 - DNA, 21 bp, Homo sapiens
gctgcccagacacagactggc

SEQ ID NO: 920942 - DNA, 19 bp, Homo sapiens
gctgcccagccactccagg

SEQ ID NO: 920943 - DNA, 17 bp, Homo sapiens
gctgccccaacctgctg

SEQ ID NO: 920944 - DNA, 20 bp, Homo sapiens
gctgccccaacctgctgaag

SEQ ID NO: 920945 - DNA, 19 bp, Homo sapiens
gctgccccacaggtgtgtt

SEQ ID NO: 920946 - DNA, 14 bp, Homo sapiens
gctgccccagccag

SEQ ID NO: 920947 - DNA, 22 bp, Homo sapiens
gctgccccagctgactgtggcc

SEQ ID NO: 920948 - DNA, 12 bp, Homo sapiens
gctgccccaggc

SEQ ID NO: 920949 - DNA, 13 bp, Homo sapiens
gctgccccaggcc

SEQ ID NO: 920950 - DNA, 19 bp, Homo sapiens
gctgccccaggccggagcc

SEQ ID NO: 920951 - DNA, 17 bp, Homo sapiens
gctgccccggcctcctc

SEQ ID NO: 920952 - DNA, 22 bp, Homo sapiens
gctgccccgttccctgtcagag

SEQ ID NO: 920953 - DNA, 19 bp, Homo sapiens
gctgcccctaatctctgta

SEQ ID NO: 920954 - DNA, 22 bp, Homo sapiens
gctgcccctaatctctgtagga

SEQ ID NO: 920955 - DNA, 14 bp, Homo sapiens
gctgcccctccccg

SEQ ID NO: 920956 - DNA, 20 bp, Homo sapiens
gctgcccctccccgtccctg

SEQ ID NO: 920957 - DNA, 23 bp, Homo sapiens
gctgcccctccccgtccctgtcc

SEQ ID NO: 920958 - DNA, 13 bp, Homo sapiens
gctgcccctcctg

SEQ ID NO: 920959 - DNA, 18 bp, Homo sapiens
gctgcccctcctggagca

SEQ ID NO: 920960 - DNA, 23 bp, Homo sapiens
gctgcccctcgcacacagggctc

SEQ ID NO: 920961 - DNA, 13 bp, Homo sapiens
gctgcccctctca

SEQ ID NO: 920962 - DNA, 14 bp, Homo sapiens
gctgcccctctcac

SEQ ID NO: 920963 - DNA, 18 bp, Homo sapiens
gctgcccctctcaccaaa

SEQ ID NO: 920964 - DNA, 17 bp, Homo sapiens
gctgcccgccgcccctc

SEQ ID NO: 920965 - DNA, 19 bp, Homo sapiens
gctgcccgccgcccctcca

SEQ ID NO: 920966 - DNA, 17 bp, Homo sapiens
gctgcccggcgcctgcc

SEQ ID NO: 920967 - DNA, 20 bp, Homo sapiens
gctgcccggggtggggtgca

SEQ ID NO: 920968 - DNA, 20 bp, Homo sapiens
gctgcccgtcttcagcctag

SEQ ID NO: 920969 - DNA, 21 bp, Homo sapiens
gctgcccgtcttcagcctagc

SEQ ID NO: 920970 - DNA, 20 bp, Homo sapiens
gctgccctagctgaccccga

SEQ ID NO: 920971 - DNA, 16 bp, Homo sapiens
gctgccctatgggcct

SEQ ID NO: 920972 - DNA, 17 bp, Homo sapiens
gctgccctatgggcctg

SEQ ID NO: 920973 - DNA, 21 bp, Homo sapiens
gctgccctcagggactgcacc

SEQ ID NO: 920974 - DNA, 14 bp, Homo sapiens
gctgccctccatcc

SEQ ID NO: 920975 - DNA, 13 bp, Homo sapiens
gctgccctgagaa

SEQ ID NO: 920976 - DNA, 16 bp, Homo sapiens
gctgccctgagaagct

SEQ ID NO: 920977 - DNA, 18 bp, Homo sapiens
gctgccctgagaagctgc

SEQ ID NO: 920978 - DNA, 22 bp, Homo sapiens
gctgccctgagaagctgctcca

SEQ ID NO: 920979 - DNA, 22 bp, Homo sapiens
gctgccctgcatgctgcccagc

SEQ ID NO: 920980 - DNA, 12 bp, Homo sapiens
gctgccctgctg

SEQ ID NO: 920981 - DNA, 13 bp, Homo sapiens
gctgccctgctgc

SEQ ID NO: 920982 - DNA, 14 bp, Homo sapiens
gctgccctggccct

SEQ ID NO: 920983 - DNA, 18 bp, Homo sapiens
gctgccctggtgctgcca

SEQ ID NO: 920984 - DNA, 22 bp, Homo sapiens
gctgccctggtgctgccacact

SEQ ID NO: 920985 - DNA, 15 bp, Homo sapiens
gctgccctttggcca

SEQ ID NO: 920986 - DNA, 16 bp, Homo sapiens
gctgccctttggccaa

SEQ ID NO: 920987 - DNA, 14 bp, Homo sapiens
gctgccgactcccc

SEQ ID NO: 920988 - DNA, 22 bp, Homo sapiens
gctgccgagacagaccctctgc

SEQ ID NO: 920989 - DNA, 13 bp, Homo sapiens
gctgccgagccac

SEQ ID NO: 920990 - DNA, 15 bp, Homo sapiens
gctgccgagccacca

SEQ ID NO: 920991 - DNA, 15 bp, Homo sapiens
ctaggtgggccagcc

SEQ ID NO: 920992 - DNA, 17 bp, Homo sapiens
ctaggtgggccagcccc

SEQ ID NO: 920993 - DNA, 18 bp, Homo sapiens
ctaggtgggttgaaagcc

SEQ ID NO: 920994 - DNA, 15 bp, Homo sapiens
ctaggtgtccccaac

SEQ ID NO: 920995 - DNA, 18 bp, Homo sapiens
ctaggtgtggctgtgaag

SEQ ID NO: 920996 - DNA, 17 bp, Homo sapiens
ctaggtgtttcaacaga

SEQ ID NO: 920997 - DNA, 19 bp, Homo sapiens
ctaggttaaagctaaactg

SEQ ID NO: 920998 - DNA, 14 bp, Homo sapiens
ctaggttatacaat

SEQ ID NO: 920999 - DNA, 22 bp, Homo sapiens
ctaggttatacaataacccagt

SEQ ID NO: 921000 - DNA, 23 bp, Homo sapiens
ctaggttatacaataacccagtt

SEQ ID NO: 921001 - DNA, 11 bp, Homo sapiens
ctaggttcaaa

SEQ ID NO: 921002 - DNA, 20 bp, Homo sapiens
ctaggttcccggtcccgagt

SEQ ID NO: 921003 - DNA, 13 bp, Homo sapiens
ctaggttctaaaa

SEQ ID NO: 921004 - DNA, 15 bp, Homo sapiens
ctaggttcttttcca

SEQ ID NO: 921005 - DNA, 18 bp, Homo sapiens
ctaggttggacagccccc

SEQ ID NO: 921006 - DNA, 21 bp, Homo sapiens
ctaggtttcagcaacaagact

SEQ ID NO: 921007 - DNA, 14 bp, Homo sapiens
ctagtaaaaccttg

SEQ ID NO: 921008 - DNA, 23 bp, Homo sapiens
ctagtaacaatacatgagaaaga

SEQ ID NO: 921009 - DNA, 14 bp, Homo sapiens
ctagtacataattg

SEQ ID NO: 921010 - DNA, 19 bp, Homo sapiens
ctagtacataattgattaa

SEQ ID NO: 921011 - DNA, 21 bp, Homo sapiens
ctagtacataattgattaaaa

SEQ ID NO: 921012 - DNA, 22 bp, Homo sapiens
ctagtacataattgattaaaat

SEQ ID NO: 921013 - DNA, 15 bp, Homo sapiens
ctagtactagaaact

SEQ ID NO: 921014 - DNA, 15 bp, Homo sapiens
ctagtactctctgct

SEQ ID NO: 921015 - DNA, 18 bp, Homo sapiens
ctagtactctctgctcta

SEQ ID NO: 921016 - DNA, 16 bp, Homo sapiens
ctagtacttgaaaaag

SEQ ID NO: 921017 - DNA, 22 bp, Homo sapiens
ctagtacttgggagacctgtaa

SEQ ID NO: 921018 - DNA, 19 bp, Homo sapiens
ctagtagctgggattacag

SEQ ID NO: 921019 - DNA, 14 bp, Homo sapiens
ctagtagtgtggcc

SEQ ID NO: 921020 - DNA, 23 bp, Homo sapiens
ctagtataaacatgaccctgggc

SEQ ID NO: 921021 - DNA, 23 bp, Homo sapiens
ctagtatcttcaaactttcactt

SEQ ID NO: 921022 - DNA, 21 bp, Homo sapiens
ctagtatttcatgctgggaat

SEQ ID NO: 921023 - DNA, 11 bp, Homo sapiens
ctagtattttt

SEQ ID NO: 921024 - DNA, 19 bp, Homo sapiens
ctagtcaagctcctcctcc

SEQ ID NO: 921025 - DNA, 22 bp, Homo sapiens
ctagtcaccgacagcggccttg

SEQ ID NO: 921026 - DNA, 21 bp, Homo sapiens
ctagtcacgcatgcagtgttg

SEQ ID NO: 921027 - DNA, 18 bp, Homo sapiens
ctagtcagagagagtgtt

SEQ ID NO: 921028 - DNA, 14 bp, Homo sapiens
ctagtcagggcaca

SEQ ID NO: 921029 - DNA, 14 bp, Homo sapiens
ctagtccagtgacc

SEQ ID NO: 921030 - DNA, 20 bp, Homo sapiens
ctagtccttggctggactgt

SEQ ID NO: 921031 - DNA, 13 bp, Homo sapiens
ctagtctctctgg

SEQ ID NO: 921032 - DNA, 16 bp, Homo sapiens
ctagtctctctggggc

SEQ ID NO: 921033 - DNA, 23 bp, Homo sapiens
ctagtctttccagtcaacatcgt

SEQ ID NO: 921034 - DNA, 17 bp, Homo sapiens
ctagtcttttgcttttg

SEQ ID NO: 921035 - DNA, 15 bp, Homo sapiens
ctagtgaacaattcg

SEQ ID NO: 921036 - DNA, 21 bp, Homo sapiens
ctagtgaagtggcctcttgga

SEQ ID NO: 921037 - DNA, 16 bp, Homo sapiens
ctagtgacagcttgtg

SEQ ID NO: 921038 - DNA, 15 bp, Homo sapiens
ctagtgacagtttct

SEQ ID NO: 921039 - DNA, 20 bp, Homo sapiens
ctagtgaccccttccctgtc

SEQ ID NO: 921040 - DNA, 14 bp, Homo sapiens
ctagtgacttcctg

SEQ ID NO: 921041 - DNA, 19 bp, Homo sapiens
ctagtgacttgtgtcccat

SEQ ID NO: 921042 - DNA, 22 bp, Homo sapiens
ctagtgagcaaaatatgcccct

SEQ ID NO: 921043 - DNA, 14 bp, Homo sapiens
ctagtgagcctggg

SEQ ID NO: 921044 - DNA, 19 bp, Homo sapiens
ctagtgagcctgggccagg

SEQ ID NO: 921045 - DNA, 18 bp, Homo sapiens
ctagtgagtcagcacctt

SEQ ID NO: 921046 - DNA, 22 bp, Homo sapiens
ctagtgcagctgattttaacaa

SEQ ID NO: 921047 - DNA, 14 bp, Homo sapiens
ctagtgccccagac

SEQ ID NO: 921048 - DNA, 15 bp, Homo sapiens
ctagtgccccagact

SEQ ID NO: 921049 - DNA, 21 bp, Homo sapiens
ctagtgccccagactgagctc

SEQ ID NO: 921050 - DNA, 23 bp, Homo sapiens
ctagtgccccagactgagctctc

SEQ ID NO: 921051 - DNA, 13 bp, Homo sapiens
gcctcggactcca

SEQ ID NO: 921052 - DNA, 21 bp, Homo sapiens
gcctcggcagaactctctgtc

SEQ ID NO: 921053 - DNA, 22 bp, Homo sapiens
gcctcgggacacctgccctgcc

SEQ ID NO: 921054 - DNA, 14 bp, Homo sapiens
gcctcggtggccct

SEQ ID NO: 921055 - DNA, 18 bp, Homo sapiens
gcctcgtgccagcagcct

SEQ ID NO: 921056 - DNA, 24 bp, Homo sapiens
gcctcgtgccagcagcctcgcaca

SEQ ID NO: 921057 - DNA, 14 bp, Homo sapiens
gcctcgtgccatga

SEQ ID NO: 921058 - DNA, 19 bp, Homo sapiens
gcctcgtggagctcgcccc

SEQ ID NO: 921059 - DNA, 21 bp, Homo sapiens
gcctcgtggagctcgcccctc

SEQ ID NO: 921060 - DNA, 22 bp, Homo sapiens
gcctcgtggagctcgcccctcc

SEQ ID NO: 921061 - DNA, 22 bp, Homo sapiens
gcctcgtggttattagcaaggc

SEQ ID NO: 921062 - DNA, 23 bp, Homo sapiens
gcctcgtggttattagcaaggct

SEQ ID NO: 921063 - DNA, 19 bp, Homo sapiens
gcctcgtgtccagactcag

SEQ ID NO: 921064 - DNA, 19 bp, Homo sapiens
gcctcgttggagagcagca

SEQ ID NO: 921065 - DNA, 14 bp, Homo sapiens
gcctctacacaggg

SEQ ID NO: 921066 - DNA, 20 bp, Homo sapiens
gcctctacacaggggccctg

SEQ ID NO: 921067 - DNA, 17 bp, Homo sapiens
gcctctacagccgtccc

SEQ ID NO: 921068 - DNA, 16 bp, Homo sapiens
gcctctatgccctgca

SEQ ID NO: 921069 - DNA, 15 bp, Homo sapiens
gcctctcagacccag

SEQ ID NO: 921070 - DNA, 22 bp, Homo sapiens
gcctctcagtgccctccagccc

SEQ ID NO: 921071 - DNA, 16 bp, Homo sapiens
gcctctccaaccactg

SEQ ID NO: 921072 - DNA, 13 bp, Homo sapiens
gcctctcccaggc

SEQ ID NO: 921073 - DNA, 20 bp, Homo sapiens
gcctctccccaggtccagct

SEQ ID NO: 921074 - DNA, 20 bp, Homo sapiens
gcctctcccggctgcctgcc

SEQ ID NO: 921075 - DNA, 19 bp, Homo sapiens
gcctctcccgtcagggccc

SEQ ID NO: 921076 - DNA, 20 bp, Homo sapiens
gcctctccctctggtcccac

SEQ ID NO: 921077 - DNA, 16 bp, Homo sapiens
gcctctccctgggtct

SEQ ID NO: 921078 - DNA, 23 bp, Homo sapiens
gcctctccctttagtggagccag

SEQ ID NO: 921079 - DNA, 14 bp, Homo sapiens
gcctctcctgccct

SEQ ID NO: 921080 - DNA, 23 bp, Homo sapiens
gcctctctatcctctcttcctct

SEQ ID NO: 921081 - DNA, 14 bp, Homo sapiens
gcctctctcaggag

SEQ ID NO: 921082 - DNA, 14 bp, Homo sapiens
gcctctctctccct

SEQ ID NO: 921083 - DNA, 15 bp, Homo sapiens
gcctctctctctctc

SEQ ID NO: 921084 - DNA, 16 bp, Homo sapiens
gcctctctctgctcca

SEQ ID NO: 921085 - DNA, 15 bp, Homo sapiens
gcctctctggcctcc

SEQ ID NO: 921086 - DNA, 16 bp, Homo sapiens
gcctctctggcctccc

SEQ ID NO: 921087 - DNA, 17 bp, Homo sapiens
gcctctctggcctccca

SEQ ID NO: 921088 - DNA, 19 bp, Homo sapiens
gcctctctgggggaggcag

SEQ ID NO: 921089 - DNA, 20 bp, Homo sapiens
gcctctctgggggaggcagg

SEQ ID NO: 921090 - DNA, 16 bp, Homo sapiens
gcctctcttgcccctt

SEQ ID NO: 921091 - DNA, 19 bp, Homo sapiens
gcctctcttgccccttgtc

SEQ ID NO: 921092 - DNA, 22 bp, Homo sapiens
gcctctcttgccccttgtcctg

SEQ ID NO: 921093 - DNA, 19 bp, Homo sapiens
gcctctgacagcagcctgt

SEQ ID NO: 921094 - DNA, 21 bp, Homo sapiens
gcctctgacagcagcctgtga

SEQ ID NO: 921095 - DNA, 22 bp, Homo sapiens
gcctctgacagtccacaggggc

SEQ ID NO: 921096 - DNA, 19 bp, Homo sapiens
gcctctgagaagctctgaa

SEQ ID NO: 921097 - DNA, 20 bp, Homo sapiens
gcctctgagatgctaattta

SEQ ID NO: 921098 - DNA, 20 bp, Homo sapiens
gcctctgagttttgatgctg

SEQ ID NO: 921099 - DNA, 20 bp, Homo sapiens
gcctctgcaactgctcagct

SEQ ID NO: 921100 - DNA, 18 bp, Homo sapiens
gcctctgcccaagcagcc

SEQ ID NO: 921101 - DNA, 22 bp, Homo sapiens
gcctctgcccaagcagcctgga

SEQ ID NO: 921102 - DNA, 13 bp, Homo sapiens
gcctctgcccgca

SEQ ID NO: 921103 - DNA, 15 bp, Homo sapiens
gcctctgccctgcct

SEQ ID NO: 921104 - DNA, 12 bp, Homo sapiens
gcctctgcctgg

SEQ ID NO: 921105 - DNA, 20 bp, Homo sapiens
gcctctgcctggggcctcca

SEQ ID NO: 921106 - DNA, 12 bp, Homo sapiens
gcctctgcctgt

SEQ ID NO: 921107 - DNA, 17 bp, Homo sapiens
gcctctgcttacttttt

SEQ ID NO: 921108 - DNA, 15 bp, Homo sapiens
gcctctggaaagcaa

SEQ ID NO: 921109 - DNA, 18 bp, Homo sapiens
gcctctggacagccagtg

SEQ ID NO: 921110 - DNA, 19 bp, Homo sapiens
gcctctggacagccagtga

SEQ ID NO: 921111 - DNA, 22 bp, Homo sapiens
gcctctggaggcctctggccct

SEQ ID NO: 921112 - DNA, 13 bp, Homo sapiens
ctatcctacccca

SEQ ID NO: 921113 - DNA, 17 bp, Homo sapiens
ctatcctacttcccctt

SEQ ID NO: 921114 - DNA, 14 bp, Homo sapiens
ctatcctcactgcc

SEQ ID NO: 921115 - DNA, 11 bp, Homo sapiens
ctatcctcatc

SEQ ID NO: 921116 - DNA, 23 bp, Homo sapiens
ctatcctccccttttaccactcc

SEQ ID NO: 921117 - DNA, 13 bp, Homo sapiens
ctatcctctctct

SEQ ID NO: 921118 - DNA, 20 bp, Homo sapiens
ctatcctctcttcctcttcc

SEQ ID NO: 921119 - DNA, 12 bp, Homo sapiens
ctatcctctgta

SEQ ID NO: 921120 - DNA, 16 bp, Homo sapiens
ctatccttccagtggc

SEQ ID NO: 921121 - DNA, 12 bp, Homo sapiens
ctatccttcgtg

SEQ ID NO: 921122 - DNA, 22 bp, Homo sapiens
ctatccttggctttcagagcca

SEQ ID NO: 921123 - DNA, 16 bp, Homo sapiens
ctatcgccctcctttc

SEQ ID NO: 921124 - DNA, 18 bp, Homo sapiens
ctatcgccctcctttccc

SEQ ID NO: 921125 - DNA, 19 bp, Homo sapiens
ctatcgccctcctttccct

SEQ ID NO: 921126 - DNA, 20 bp, Homo sapiens
ctatcgccctcctttccctt

SEQ ID NO: 921127 - DNA, 22 bp, Homo sapiens
ctatcgccctcctttcccttat

SEQ ID NO: 921128 - DNA, 17 bp, Homo sapiens
ctatctagcatttattt

SEQ ID NO: 921129 - DNA, 17 bp, Homo sapiens
ctatctatacctgcctt

SEQ ID NO: 921130 - DNA, 18 bp, Homo sapiens
ctatctattaaagtgact

SEQ ID NO: 921131 - DNA, 19 bp, Homo sapiens
ctatctattaaagtgactt

SEQ ID NO: 921132 - DNA, 21 bp, Homo sapiens
ctatctattaaagtgactttc

SEQ ID NO: 921133 - DNA, 13 bp, Homo sapiens
ctatctatttgag

SEQ ID NO: 921134 - DNA, 14 bp, Homo sapiens
ctatctatttgagg

SEQ ID NO: 921135 - DNA, 16 bp, Homo sapiens
ctatctcacttccaga

SEQ ID NO: 921136 - DNA, 12 bp, Homo sapiens
ctatctcagcca

SEQ ID NO: 921137 - DNA, 13 bp, Homo sapiens
ctatctcagccat

SEQ ID NO: 921138 - DNA, 12 bp, Homo sapiens
ctatctcaggga

SEQ ID NO: 921139 - DNA, 19 bp, Homo sapiens
ctatctcagggagggaagg

SEQ ID NO: 921140 - DNA, 21 bp, Homo sapiens
ctatctcagggagggaagggg

SEQ ID NO: 921141 - DNA, 21 bp, Homo sapiens
ctatctccagcggccctgtca

SEQ ID NO: 921142 - DNA, 21 bp, Homo sapiens
ctatctcctaactttggacct

SEQ ID NO: 921143 - DNA, 15 bp, Homo sapiens
ctatctcctgacaga

SEQ ID NO: 921144 - DNA, 19 bp, Homo sapiens
ctatctcctgacagaaggt

SEQ ID NO: 921145 - DNA, 15 bp, Homo sapiens
ctatctgcactctaa

SEQ ID NO: 921146 - DNA, 15 bp, Homo sapiens
ctatctgcattatct

SEQ ID NO: 921147 - DNA, 16 bp, Homo sapiens
ctatctggggagctcc

SEQ ID NO: 921148 - DNA, 20 bp, Homo sapiens
ctatctggtattaaatgcca

SEQ ID NO: 921149 - DNA, 21 bp, Homo sapiens
ctatctggtattaaatgccaa

SEQ ID NO: 921150 - DNA, 12 bp, Homo sapiens
ctatctgtattc

SEQ ID NO: 921151 - DNA, 11 bp, Homo sapiens
ctatctgtctg

SEQ ID NO: 921152 - DNA, 17 bp, Homo sapiens
ctatctgtctggtggcc

SEQ ID NO: 921153 - DNA, 21 bp, Homo sapiens
ctatctgtctggtggccccgt

SEQ ID NO: 921154 - DNA, 16 bp, Homo sapiens
ctatctgttcctatct

SEQ ID NO: 921155 - DNA, 16 bp, Homo sapiens
ctatcttcatgtaaat

SEQ ID NO: 921156 - DNA, 15 bp, Homo sapiens
ctatcttgtcctgga

SEQ ID NO: 921157 - DNA, 17 bp, Homo sapiens
ctatcttgtcctggaat

SEQ ID NO: 921158 - DNA, 12 bp, Homo sapiens
ctatctttaaac

SEQ ID NO: 921159 - DNA, 15 bp, Homo sapiens
ctatctttaaacatt

SEQ ID NO: 921160 - DNA, 18 bp, Homo sapiens
ctatcttttgtttccttt

SEQ ID NO: 921161 - DNA, 16 bp, Homo sapiens
ctatgaaaatgagccc

SEQ ID NO: 921162 - DNA, 19 bp, Homo sapiens
ctatgaaaatgagccctgg

SEQ ID NO: 921163 - DNA, 13 bp, Homo sapiens
ctatgaaattggt

SEQ ID NO: 921164 - DNA, 15 bp, Homo sapiens
ctatgaacaacagta

SEQ ID NO: 921165 - DNA, 22 bp, Homo sapiens
ctatgaacagaaactacatttc

SEQ ID NO: 921166 - DNA, 18 bp, Homo sapiens
ctatgaagttgctgttta

SEQ ID NO: 921167 - DNA, 14 bp, Homo sapiens
ctatgacaaattca

SEQ ID NO: 921168 - DNA, 12 bp, Homo sapiens
ctatgacacagt

SEQ ID NO: 921169 - DNA, 13 bp, Homo sapiens
ctatgacagctgg

SEQ ID NO: 921170 - DNA, 16 bp, Homo sapiens
ctatgactctctgcta

SEQ ID NO: 921171 - DNA, 16 bp, Homo sapiens
ctatgactgctcccca

SEQ ID NO: 921172 - DNA, 18 bp, Homo sapiens
ctatgacttttttaaact

SEQ ID NO: 921173 - DNA, 21 bp, Homo sapiens
ctatgagaacaagtcacagct

SEQ ID NO: 921174 - DNA, 21 bp, Homo sapiens
ctatgagaattgggattacat

SEQ ID NO: 921175 - DNA, 21 bp, Homo sapiens
ctatgagcatcctgagccccg

SEQ ID NO: 921176 - DNA, 15 bp, Homo sapiens
ctatgataaagttgt

SEQ ID NO: 921177 - DNA, 18 bp, Homo sapiens
ctatgataaagttgtaaa

SEQ ID NO: 921178 - DNA, 17 bp, Homo sapiens
ctatgatcacagtgact

SEQ ID NO: 921179 - DNA, 21 bp, Homo sapiens
ctatgatcccagcactttggg

SEQ ID NO: 921180 - DNA, 22 bp, Homo sapiens
ctatgatcccagcactttggga

SEQ ID NO: 921181 - DNA, 19 bp, Homo sapiens
ctatgatccttttttgtca

SEQ ID NO: 921182 - DNA, 18 bp, Homo sapiens
ctatgatggatggcagac

SEQ ID NO: 921183 - DNA, 17 bp, Homo sapiens
gcctgcctgttcccatt

SEQ ID NO: 921184 - DNA, 16 bp, Homo sapiens
gcctgccttgaagcca

SEQ ID NO: 921185 - DNA, 14 bp, Homo sapiens
gcctgcgagaccca

SEQ ID NO: 921186 - DNA, 16 bp, Homo sapiens
gcctgcgagacccaag

SEQ ID NO: 921187 - DNA, 21 bp, Homo sapiens
gcctgcgccaccgcccagaga

SEQ ID NO: 921188 - DNA, 15 bp, Homo sapiens
gcctgcgcccagagc

SEQ ID NO: 921189 - DNA, 17 bp, Homo sapiens
gcctgcgcccagagctg

SEQ ID NO: 921190 - DNA, 18 bp, Homo sapiens
gcctgcgcccagagctgg

SEQ ID NO: 921191 - DNA, 19 bp, Homo sapiens
gcctgcgcccagagctggc

SEQ ID NO: 921192 - DNA, 15 bp, Homo sapiens
gcctgcgcctccatc

SEQ ID NO: 921193 - DNA, 16 bp, Homo sapiens
gcctgcgcctccatcc

SEQ ID NO: 921194 - DNA, 17 bp, Homo sapiens
gcctgcgcctgctgcct

SEQ ID NO: 921195 - DNA, 18 bp, Homo sapiens
gcctgcgcctgctgcctg

SEQ ID NO: 921196 - DNA, 17 bp, Homo sapiens
gcctgcggcgccagcct

SEQ ID NO: 921197 - DNA, 16 bp, Homo sapiens
gcctgcgtcttccgcc

SEQ ID NO: 921198 - DNA, 18 bp, Homo sapiens
gcctgcgtcttccgcccc

SEQ ID NO: 921199 - DNA, 18 bp, Homo sapiens
gcctgcgttggtccagag

SEQ ID NO: 921200 - DNA, 17 bp, Homo sapiens
gcctgctaaggctcctc

SEQ ID NO: 921201 - DNA, 19 bp, Homo sapiens
gcctgctaaggctcctcct

SEQ ID NO: 921202 - DNA, 16 bp, Homo sapiens
gcctgctagagcaacc

SEQ ID NO: 921203 - DNA, 13 bp, Homo sapiens
gcctgctcagcag

SEQ ID NO: 921204 - DNA, 18 bp, Homo sapiens
gcctgctcagcagccagt

SEQ ID NO: 921205 - DNA, 19 bp, Homo sapiens
gcctgctcagcagccagtc

SEQ ID NO: 921206 - DNA, 15 bp, Homo sapiens
gcctgctccagctgt

SEQ ID NO: 921207 - DNA, 16 bp, Homo sapiens
gcctgctcccagcagc

SEQ ID NO: 921208 - DNA, 15 bp, Homo sapiens
gcctgctcccatcct

SEQ ID NO: 921209 - DNA, 16 bp, Homo sapiens
gcctgctcccatcctc

SEQ ID NO: 921210 - DNA, 20 bp, Homo sapiens
gcctgctcccatcctcaccc

SEQ ID NO: 921211 - DNA, 21 bp, Homo sapiens
gcctgctcccatcctcaccca

SEQ ID NO: 921212 - DNA, 22 bp, Homo sapiens
gcctgctcccatcctcacccag

SEQ ID NO: 921213 - DNA, 22 bp, Homo sapiens
gcctgctcctgcttaaacacaa

SEQ ID NO: 921214 - DNA, 19 bp, Homo sapiens
gcctgctctagtgggacag

SEQ ID NO: 921215 - DNA, 20 bp, Homo sapiens
gcctgctgaggccttctctt

SEQ ID NO: 921216 - DNA, 23 bp, Homo sapiens
gcctgctgattgatttttttctc

SEQ ID NO: 921217 - DNA, 14 bp, Homo sapiens
gcctgctgccagtg

SEQ ID NO: 921218 - DNA, 19 bp, Homo sapiens
gcctgctgccagtgcagcc

SEQ ID NO: 921219 - DNA, 23 bp, Homo sapiens
gcctgctgccagtgcagccactg

SEQ ID NO: 921220 - DNA, 13 bp, Homo sapiens
gcctgctgcctgc

SEQ ID NO: 921221 - DNA, 17 bp, Homo sapiens
gcctgctgcctgctgag

SEQ ID NO: 921222 - DNA, 18 bp, Homo sapiens
gcctgctggaagcccagc

SEQ ID NO: 921223 - DNA, 19 bp, Homo sapiens
gcctgctggaagcccagcc

SEQ ID NO: 921224 - DNA, 17 bp, Homo sapiens
gcctgctggaggcctca

SEQ ID NO: 921225 - DNA, 23 bp, Homo sapiens
gcctgctggaggcctcaggtgct

SEQ ID NO: 921226 - DNA, 23 bp, Homo sapiens
gcctgctggagttccggcctggg

SEQ ID NO: 921227 - DNA, 10 bp, Homo sapiens
gcctgctggc

SEQ ID NO: 921228 - DNA, 18 bp, Homo sapiens
gcctgctggcagggccag

SEQ ID NO: 921229 - DNA, 23 bp, Homo sapiens
gcctgctggcagggccagggcaa

SEQ ID NO: 921230 - DNA, 21 bp, Homo sapiens
gcctgctggccgacccactga

SEQ ID NO: 921231 - DNA, 22 bp, Homo sapiens
gcctgctggctcccttacttta

SEQ ID NO: 921232 - DNA, 18 bp, Homo sapiens
gcctgctggctgcggccc

SEQ ID NO: 921233 - DNA, 13 bp, Homo sapiens
gcctgctgggaac

SEQ ID NO: 921234 - DNA, 17 bp, Homo sapiens
gcctgggcaggaccctg

SEQ ID NO: 921235 - DNA, 16 bp, Homo sapiens
gcctgggccagagaag

SEQ ID NO: 921236 - DNA, 21 bp, Homo sapiens
gcctgggccatgcgaggggcc

SEQ ID NO: 921237 - DNA, 15 bp, Homo sapiens
gcctgggcccatctc

SEQ ID NO: 921238 - DNA, 21 bp, Homo sapiens
gcctgggcccatctccctgct

SEQ ID NO: 921239 - DNA, 21 bp, Homo sapiens
gcctgggcccctcccctcaga

SEQ ID NO: 921240 - DNA, 15 bp, Homo sapiens
gcctgggccctgggc

SEQ ID NO: 921241 - DNA, 12 bp, Homo sapiens
gcctgggcctgc

SEQ ID NO: 921242 - DNA, 15 bp, Homo sapiens
gcctgggcctgtgca

SEQ ID NO: 921243 - DNA, 17 bp, Homo sapiens
gcctgggcctgtgcagc

SEQ ID NO: 921244 - DNA, 20 bp, Homo sapiens
gcctgggccttggctgggcc

SEQ ID NO: 921245 - DNA, 15 bp, Homo sapiens
gcctgggctcactgt

SEQ ID NO: 921246 - DNA, 16 bp, Homo sapiens
gcctgggctgggcagc

SEQ ID NO: 921247 - DNA, 18 bp, Homo sapiens
gcctgggctgggcagcct

SEQ ID NO: 921248 - DNA, 20 bp, Homo sapiens
gcctgggctgggcagccttg

SEQ ID NO: 921249 - DNA, 20 bp, Homo sapiens
gcctgggctgttggcactca

SEQ ID NO: 921250 - DNA, 20 bp, Homo sapiens
gcctggggatgtaaccaagc

SEQ ID NO: 921251 - DNA, 13 bp, Homo sapiens
gcctggggcccaa

SEQ ID NO: 921252 - DNA, 17 bp, Homo sapiens
gcctggggcctgagaga

SEQ ID NO: 921253 - DNA, 18 bp, Homo sapiens
gcctggggcctgagagaa

SEQ ID NO: 921254 - DNA, 16 bp, Homo sapiens
gcctggggctccctct

SEQ ID NO: 921255 - DNA, 23 bp, Homo sapiens
gcctggggctcctttctccagcc

SEQ ID NO: 921256 - DNA, 17 bp, Homo sapiens
gcctggggctctctgac

SEQ ID NO: 921257 - DNA, 20 bp, Homo sapiens
gcctggggctctctgacccg

SEQ ID NO: 921258 - DNA, 22 bp, Homo sapiens
gcctggggctgaggctgaggca

SEQ ID NO: 921259 - DNA, 23 bp, Homo sapiens
gcctgggggacccctggctctgg

SEQ ID NO: 921260 - DNA, 19 bp, Homo sapiens
gcctgggggagttttcctc

SEQ ID NO: 921261 - DNA, 15 bp, Homo sapiens
gcctgggggcagtga

SEQ ID NO: 921262 - DNA, 19 bp, Homo sapiens
gcctgggggcagtgactgg

SEQ ID NO: 921263 - DNA, 17 bp, Homo sapiens
gcctgggggtgccagga

SEQ ID NO: 921264 - DNA, 23 bp, Homo sapiens
gcctgggggtggggggactgcct

SEQ ID NO: 921265 - DNA, 19 bp, Homo sapiens
gcctggggtggcctggccc

SEQ ID NO: 921266 - DNA, 21 bp, Homo sapiens
gcctggggtgggacagggagg

SEQ ID NO: 921267 - DNA, 18 bp, Homo sapiens
gcctggggtgtcctacag

SEQ ID NO: 921268 - DNA, 23 bp, Homo sapiens
gcctggggtgtcctacagtgact

SEQ ID NO: 921269 - DNA, 23 bp, Homo sapiens
gcctggggttcccgagggagctg

SEQ ID NO: 921270 - DNA, 18 bp, Homo sapiens
gcctggggttgtccccgc

SEQ ID NO: 921271 - DNA, 17 bp, Homo sapiens
gcctgggtctggatggg

SEQ ID NO: 921272 - DNA, 20 bp, Homo sapiens
gcctgggtctggatgggagg

SEQ ID NO: 921273 - DNA, 16 bp, Homo sapiens
gcctgggtctgtgtct

SEQ ID NO: 921274 - DNA, 23 bp, Homo sapiens
gcctgggtctgtgtctcttttct

SEQ ID NO: 921275 - DNA, 23 bp, Homo sapiens
gcctgggtgagaatcctgcctct

SEQ ID NO: 921276 - DNA, 14 bp, Homo sapiens
gcctgggtgctggc

SEQ ID NO: 921277 - DNA, 24 bp, Homo sapiens
gcctgggtggggctgctcctccag

SEQ ID NO: 921278 - DNA, 15 bp, Homo sapiens
gcctggtagaaacta

SEQ ID NO: 921279 - DNA, 20 bp, Homo sapiens
gcctggtccttccctgatgg

SEQ ID NO: 921280 - DNA, 13 bp, Homo sapiens
gcctggtctctag

SEQ ID NO: 921281 - DNA, 13 bp, Homo sapiens
gcctggtgcagtg

SEQ ID NO: 921282 - DNA, 20 bp, Homo sapiens
gcctggtgcttccaaatatt

SEQ ID NO: 921283 - DNA, 20 bp, Homo sapiens
gcctggtgggtcagggggag

SEQ ID NO: 921284 - DNA, 14 bp, Homo sapiens
gcctggttagaggc

SEQ ID NO: 921285 - DNA, 21 bp, Homo sapiens
gcctggtttgcaaagaccacc

SEQ ID NO: 921286 - DNA, 13 bp, Homo sapiens
gcctggtttttct

SEQ ID NO: 921287 - DNA, 15 bp, Homo sapiens
gcctgtaatcccagc

SEQ ID NO: 921288 - DNA, 16 bp, Homo sapiens
gcctgtaatcccagca

SEQ ID NO: 921289 - DNA, 18 bp, Homo sapiens
gcctgtaatcccagcact

SEQ ID NO: 921290 - DNA, 18 bp, Homo sapiens
gcctgtaatctttttctc

SEQ ID NO: 921291 - DNA, 21 bp, Homo sapiens
gcctgtactaaggagcatgat

SEQ ID NO: 921292 - DNA, 21 bp, Homo sapiens
gcctgtagccccagtgacagc

SEQ ID NO: 921293 - DNA, 22 bp, Homo sapiens
gcctgtagtcccagctactcag

SEQ ID NO: 921294 - DNA, 14 bp, Homo sapiens
gcctgtagttagga

SEQ ID NO: 921295 - DNA, 22 bp, Homo sapiens
gcctgtagttaggaaataaaac

SEQ ID NO: 921296 - DNA, 23 bp, Homo sapiens
gcctgtagttaggaaataaaacc

SEQ ID NO: 921297 - DNA, 22 bp, Homo sapiens
gcctgtatcctccctggcagac

SEQ ID NO: 921298 - DNA, 15 bp, Homo sapiens
gcctgtcacaataaa

SEQ ID NO: 921299 - DNA, 14 bp, Homo sapiens
gcctgtcaccagac

SEQ ID NO: 921300 - DNA, 18 bp, Homo sapiens
gcctgtcacccagctcct

SEQ ID NO: 921301 - DNA, 18 bp, Homo sapiens
gcctgtccaccctgccaa

SEQ ID NO: 921302 - DNA, 22 bp, Homo sapiens
gcctgtccacctgtgctgctgc

SEQ ID NO: 921303 - DNA, 14 bp, Homo sapiens
gcctgtccagcctg

SEQ ID NO: 921304 - DNA, 15 bp, Homo sapiens
gcctgtccagcctgg

SEQ ID NO: 921305 - DNA, 12 bp, Homo sapiens
gcctgtcccagg

SEQ ID NO: 921306 - DNA, 17 bp, Homo sapiens
gcctgtcccaggactca

SEQ ID NO: 921307 - DNA, 14 bp, Homo sapiens
gcctgtccccagac

SEQ ID NO: 921308 - DNA, 18 bp, Homo sapiens
gcctgtccccgccttccc

SEQ ID NO: 921309 - DNA, 21 bp, Homo sapiens
gcctgtccccgccttccctca

SEQ ID NO: 921310 - DNA, 14 bp, Homo sapiens
gcctgtccctctca

SEQ ID NO: 921311 - DNA, 22 bp, Homo sapiens
gcctgtcctccaacaccaagca

SEQ ID NO: 921312 - DNA, 20 bp, Homo sapiens
gcctgtcctggtacagcagg

SEQ ID NO: 921313 - DNA, 21 bp, Homo sapiens
gcctgtcgtgccagtcctggg

SEQ ID NO: 921314 - DNA, 14 bp, Homo sapiens
gcctgtctaaagcc

SEQ ID NO: 921315 - DNA, 21 bp, Homo sapiens
gcctgtctaaagccttaacta

SEQ ID NO: 921316 - DNA, 22 bp, Homo sapiens
gcctgtctcatccccaggggtc

SEQ ID NO: 921317 - DNA, 14 bp, Homo sapiens
gcctgtctccctag

SEQ ID NO: 921318 - DNA, 20 bp, Homo sapiens
gcctgtctctattagctggg

SEQ ID NO: 921319 - DNA, 14 bp, Homo sapiens
gcctgtctctgttc

SEQ ID NO: 921320 - DNA, 23 bp, Homo sapiens
gcctgtctgagactcacaggaag

SEQ ID NO: 921321 - DNA, 21 bp, Homo sapiens
gcctgtctgccccagcccaga

SEQ ID NO: 921322 - DNA, 17 bp, Homo sapiens
gcctgtctgtctctcca

SEQ ID NO: 921323 - DNA, 23 bp, Homo sapiens
gcctgtgaagcagtcagccctta

SEQ ID NO: 921324 - DNA, 22 bp, Homo sapiens
gcctgtgaataaaaaccctgta

SEQ ID NO: 921325 - DNA, 15 bp, Homo sapiens
gcctgtgagccattg

SEQ ID NO: 921326 - DNA, 15 bp, Homo sapiens
gcctgtgattaactt

SEQ ID NO: 921327 - DNA, 18 bp, Homo sapiens
gcctgtgcactgggcagg

SEQ ID NO: 921328 - DNA, 23 bp, Homo sapiens
gcctgtgcactgggcaggttcct

SEQ ID NO: 921329 - DNA, 21 bp, Homo sapiens
gcctgtgcagcagcccagctt

SEQ ID NO: 921330 - DNA, 22 bp, Homo sapiens
gcctgtgcagcagcccagcttc

SEQ ID NO: 921331 - DNA, 18 bp, Homo sapiens
gcctgtgccagcaccaca

SEQ ID NO: 921332 - DNA, 16 bp, Homo sapiens
gcctgtgccagcacct

SEQ ID NO: 921333 - DNA, 19 bp, Homo sapiens
gcctgtgcctcctcacccc

SEQ ID NO: 921334 - DNA, 18 bp, Homo sapiens
gcctgtgcctctgggact

SEQ ID NO: 921335 - DNA, 15 bp, Homo sapiens
gcctgtgctgcccgt

SEQ ID NO: 921336 - DNA, 16 bp, Homo sapiens
gcctgtgctgcccgtc

SEQ ID NO: 921337 - DNA, 17 bp, Homo sapiens
gcctgtggaatgagtgt

SEQ ID NO: 921338 - DNA, 18 bp, Homo sapiens
gcctgtggagctcagccc

SEQ ID NO: 921339 - DNA, 16 bp, Homo sapiens
gcctgtggcctgtgtc

SEQ ID NO: 921340 - DNA, 17 bp, Homo sapiens
gcctgtggcctgtgtcc

SEQ ID NO: 921341 - DNA, 21 bp, Homo sapiens
gcctgtggcgccgtctccagg

SEQ ID NO: 921342 - DNA, 18 bp, Homo sapiens
gcctgtggcggtgcctgg

SEQ ID NO: 921343 - DNA, 19 bp, Homo sapiens
gcctgtggcggtgcctggg

SEQ ID NO: 921344 - DNA, 20 bp, Homo sapiens
gcctgtggcttggagtggcc

SEQ ID NO: 921345 - DNA, 11 bp, Homo sapiens
gcctgtgggag

SEQ ID NO: 921346 - DNA, 12 bp, Homo sapiens
gcctgtgggcct

SEQ ID NO: 921347 - DNA, 21 bp, Homo sapiens
gcctgtgggcctcacctgccc

SEQ ID NO: 921348 - DNA, 21 bp, Homo sapiens
gcctgtgggcgcatactacag

SEQ ID NO: 921349 - DNA, 19 bp, Homo sapiens
gcctgtgggtctctgaagg

SEQ ID NO: 921350 - DNA, 19 bp, Homo sapiens
gcctgtgggtttgggtgcc

SEQ ID NO: 921351 - DNA, 23 bp, Homo sapiens
gcctgtgggtttgggtgcctcct

SEQ ID NO: 921352 - DNA, 12 bp, Homo sapiens
gcctgtggtgaa

SEQ ID NO: 921353 - DNA, 22 bp, Homo sapiens
gcctgtggtgaagtgtggctgg

SEQ ID NO: 921354 - DNA, 19 bp, Homo sapiens
gccttctcctctctgggcc

SEQ ID NO: 921355 - DNA, 21 bp, Homo sapiens
gccttctctattgggcacagc

SEQ ID NO: 921356 - DNA, 17 bp, Homo sapiens
gccttctctgcccacag

SEQ ID NO: 921357 - DNA, 14 bp, Homo sapiens
gccttctcttgagg

SEQ ID NO: 921358 - DNA, 16 bp, Homo sapiens
gccttctgaactccat

SEQ ID NO: 921359 - DNA, 13 bp, Homo sapiens
gccttctgccaac

SEQ ID NO: 921360 - DNA, 18 bp, Homo sapiens
gccttctggagctgggag

SEQ ID NO: 921361 - DNA, 11 bp, Homo sapiens
gccttctgtat

SEQ ID NO: 921362 - DNA, 14 bp, Homo sapiens
gccttctgtggggc

SEQ ID NO: 921363 - DNA, 18 bp, Homo sapiens
gccttctgtggggctggg

SEQ ID NO: 921364 - DNA, 20 bp, Homo sapiens
gccttcttattctcactcca

SEQ ID NO: 921365 - DNA, 21 bp, Homo sapiens
gccttcttattctcactccac

SEQ ID NO: 921366 - DNA, 23 bp, Homo sapiens
gccttcttattctcactccacca

SEQ ID NO: 921367 - DNA, 15 bp, Homo sapiens
gccttcttcacccag

SEQ ID NO: 921368 - DNA, 13 bp, Homo sapiens
gccttcttccagg

SEQ ID NO: 921369 - DNA, 14 bp, Homo sapiens
gccttcttctgcca

SEQ ID NO: 921370 - DNA, 17 bp, Homo sapiens
gccttcttctgccactt

SEQ ID NO: 921371 - DNA, 19 bp, Homo sapiens
gccttcttggtttcagcca

SEQ ID NO: 921372 - DNA, 22 bp, Homo sapiens
gccttcttttgattatgttttt

SEQ ID NO: 921373 - DNA, 17 bp, Homo sapiens
gccttctttttctggac

SEQ ID NO: 921374 - DNA, 23 bp, Homo sapiens
gccttgaactttgacctctgcag

SEQ ID NO: 921375 - DNA, 21 bp, Homo sapiens
gccttgaagaaaatgacttta

SEQ ID NO: 921376 - DNA, 23 bp, Homo sapiens
gccttgaagaaaatgactttatt

SEQ ID NO: 921377 - DNA, 19 bp, Homo sapiens
gccttgagagacccagctg

SEQ ID NO: 921378 - DNA, 18 bp, Homo sapiens
gccttgagatgcttcact

SEQ ID NO: 921379 - DNA, 15 bp, Homo sapiens
gccttgagccctggc

SEQ ID NO: 921380 - DNA, 18 bp, Homo sapiens
gccttgagtccccagggg

SEQ ID NO: 921381 - DNA, 21 bp, Homo sapiens
gccttgagtgacatgcggctg

SEQ ID NO: 921382 - DNA, 19 bp, Homo sapiens
gccttgatttgttcttaca

SEQ ID NO: 921383 - DNA, 18 bp, Homo sapiens
gccttgcacacccactgc

SEQ ID NO: 921384 - DNA, 19 bp, Homo sapiens
gccttgcacacccactgcc

SEQ ID NO: 921385 - DNA, 20 bp, Homo sapiens
gccttgcacacccactgccc

SEQ ID NO: 921386 - DNA, 22 bp, Homo sapiens
gccttgcacacccactgccccg

SEQ ID NO: 921387 - DNA, 13 bp, Homo sapiens
gccttgcagaact

SEQ ID NO: 921388 - DNA, 14 bp, Homo sapiens
gccttgcataccca

SEQ ID NO: 921389 - DNA, 21 bp, Homo sapiens
gccttgcatgtacttgaagga

SEQ ID NO: 921390 - DNA, 14 bp, Homo sapiens
gccttgcccagaga

SEQ ID NO: 921391 - DNA, 19 bp, Homo sapiens
gccttgcccgtcgtgtgct

SEQ ID NO: 921392 - DNA, 14 bp, Homo sapiens
gccttgcgctgtcc

SEQ ID NO: 921393 - DNA, 16 bp, Homo sapiens
gccttgcgctgtccca

SEQ ID NO: 921394 - DNA, 18 bp, Homo sapiens
gccttgcgctgtcccagg

SEQ ID NO: 921395 - DNA, 12 bp, Homo sapiens
gccttgcggaag

SEQ ID NO: 921396 - DNA, 20 bp, Homo sapiens
gccttgcggaagccataggg

SEQ ID NO: 921397 - DNA, 19 bp, Homo sapiens
gccttgctacctcaagggg

SEQ ID NO: 921398 - DNA, 19 bp, Homo sapiens
gccttgctcctagcagaca

SEQ ID NO: 921399 - DNA, 23 bp, Homo sapiens
gccttgctcctagcagacagaaa

SEQ ID NO: 921400 - DNA, 12 bp, Homo sapiens
gccttgctctga

SEQ ID NO: 921401 - DNA, 13 bp, Homo sapiens
gccttgctctgag

SEQ ID NO: 921402 - DNA, 23 bp, Homo sapiens
gccttgctgactctctgagctgg

SEQ ID NO: 921403 - DNA, 14 bp, Homo sapiens
gccttgctgggcca

SEQ ID NO: 921404 - DNA, 17 bp, Homo sapiens
gccttgctgggccaggg

SEQ ID NO: 921405 - DNA, 19 bp, Homo sapiens
gccttgctggggtccaggg

SEQ ID NO: 921406 - DNA, 12 bp, Homo sapiens
gccttgcttctc

SEQ ID NO: 921407 - DNA, 15 bp, Homo sapiens
gccttgcttctccca

SEQ ID NO: 921408 - DNA, 22 bp, Homo sapiens
gccttgcttctcccatttcctg

SEQ ID NO: 921409 - DNA, 15 bp, Homo sapiens
gccttgcttctcttc

SEQ ID NO: 921410 - DNA, 17 bp, Homo sapiens
gccttgctttgggcttt

SEQ ID NO: 921411 - DNA, 21 bp, Homo sapiens
gccttgctttgtctggcctca

SEQ ID NO: 921412 - DNA, 23 bp, Homo sapiens
gccttggaaatagaaagaagcca

SEQ ID NO: 921413 - DNA, 23 bp, Homo sapiens
gccttggaaccagccccatcaga

SEQ ID NO: 921414 - DNA, 16 bp, Homo sapiens
gccttggacaccatcc

SEQ ID NO: 921415 - DNA, 21 bp, Homo sapiens
gccttggataatgctgttgcc

SEQ ID NO: 921416 - DNA, 12 bp, Homo sapiens
gccttggctcag

SEQ ID NO: 921417 - DNA, 13 bp, Homo sapiens
gccttggctgggc

SEQ ID NO: 921418 - DNA, 21 bp, Homo sapiens
gccttgggaaggaaggcagtg

SEQ ID NO: 921419 - DNA, 13 bp, Homo sapiens
gccttgggccggt

SEQ ID NO: 921420 - DNA, 19 bp, Homo sapiens
gccttgggccggtgctggg

SEQ ID NO: 921421 - DNA, 23 bp, Homo sapiens
gccttgggccggtgctgggggca

SEQ ID NO: 921422 - DNA, 14 bp, Homo sapiens
gccttgggctgctc

SEQ ID NO: 921423 - DNA, 16 bp, Homo sapiens
gccttgggctgctcct

SEQ ID NO: 921424 - DNA, 24 bp, Homo sapiens
gccttggggctcagccacagcctg

SEQ ID NO: 921425 - DNA, 17 bp, Homo sapiens
gccttggggtgggggcc

SEQ ID NO: 921426 - DNA, 22 bp, Homo sapiens
gccttggggtgggggccaggcc

SEQ ID NO: 921427 - DNA, 23 bp, Homo sapiens
gccttggggtgggggccaggcct

SEQ ID NO: 921428 - DNA, 20 bp, Homo sapiens
gccttggtatgtgccaggct

SEQ ID NO: 921429 - DNA, 19 bp, Homo sapiens
gccttggtgtccacctggc

SEQ ID NO: 921430 - DNA, 17 bp, Homo sapiens
gccttggttctggccac

SEQ ID NO: 921431 - DNA, 17 bp, Homo sapiens
gccttggtttttactgc

SEQ ID NO: 921432 - DNA, 18 bp, Homo sapiens
gccttgtacttgcttgta

SEQ ID NO: 921433 - DNA, 19 bp, Homo sapiens
gccttgtataatattgaaa

SEQ ID NO: 921434 - DNA, 19 bp, Homo sapiens
gccttgtcatcctcccttg

SEQ ID NO: 921435 - DNA, 22 bp, Homo sapiens
gccttgtcctacgtccaaggtg

SEQ ID NO: 921436 - DNA, 18 bp, Homo sapiens
gccttgtcctcagccagt

SEQ ID NO: 921437 - DNA, 14 bp, Homo sapiens
gccttgtctgggtg

SEQ ID NO: 921438 - DNA, 15 bp, Homo sapiens
gccttgtctgggtgc

SEQ ID NO: 921439 - DNA, 22 bp, Homo sapiens
ctcaaagatgcgtttgcctcct

SEQ ID NO: 921440 - DNA, 13 bp, Homo sapiens
ctcaaagcacaat

SEQ ID NO: 921441 - DNA, 19 bp, Homo sapiens
ctcaaagcacaatgtggat

SEQ ID NO: 921442 - DNA, 20 bp, Homo sapiens
ctcaaagcatgggattatta

SEQ ID NO: 921443 - DNA, 16 bp, Homo sapiens
ctcaaaggagaaaaaa

SEQ ID NO: 921444 - DNA, 17 bp, Homo sapiens
ctcaaaggagctttctc

SEQ ID NO: 921445 - DNA, 19 bp, Homo sapiens
ctcaaaggagctttctcaa

SEQ ID NO: 921446 - DNA, 23 bp, Homo sapiens
ctcaaaggtttggaaggagcaga

SEQ ID NO: 921447 - DNA, 16 bp, Homo sapiens
ctcaaagtataatctt

SEQ ID NO: 921448 - DNA, 18 bp, Homo sapiens
ctcaaagtcccttgagac

SEQ ID NO: 921449 - DNA, 21 bp, Homo sapiens
ctcaaagtcccttgagactcc

SEQ ID NO: 921450 - DNA, 21 bp, Homo sapiens
ctcaaataggctattaaaaaa

SEQ ID NO: 921451 - DNA, 15 bp, Homo sapiens
ctcaaatctattcag

SEQ ID NO: 921452 - DNA, 22 bp, Homo sapiens
ctcaaatgagtaacatttgctg

SEQ ID NO: 921453 - DNA, 11 bp, Homo sapiens
ctcaaatggtg

SEQ ID NO: 921454 - DNA, 21 bp, Homo sapiens
ctcaaatggtgtcatggctga

SEQ ID NO: 921455 - DNA, 17 bp, Homo sapiens
ctcaaatgtcagagcta

SEQ ID NO: 921456 - DNA, 18 bp, Homo sapiens
ctcaaatgtcagagctat

SEQ ID NO: 921457 - DNA, 15 bp, Homo sapiens
ctcaacaaagcacag

SEQ ID NO: 921458 - DNA, 15 bp, Homo sapiens
ctcaacaagggagag

SEQ ID NO: 921459 - DNA, 23 bp, Homo sapiens
ctcaacaagggagagacctcatc

SEQ ID NO: 921460 - DNA, 12 bp, Homo sapiens
ctcaacaccctg

SEQ ID NO: 921461 - DNA, 13 bp, Homo sapiens
ctcaacaccctgc

SEQ ID NO: 921462 - DNA, 18 bp, Homo sapiens
ctcaacaccctgcttctc

SEQ ID NO: 921463 - DNA, 18 bp, Homo sapiens
ctcaacatgtgtttctga

SEQ ID NO: 921464 - DNA, 20 bp, Homo sapiens
ctcaacccattgttgtcaag

SEQ ID NO: 921465 - DNA, 22 bp, Homo sapiens
ctcaacccccctcccagacagg

SEQ ID NO: 921466 - DNA, 19 bp, Homo sapiens
ctcaaccctccctcagccc

SEQ ID NO: 921467 - DNA, 22 bp, Homo sapiens
ctcaaccctccctcagcccctc

SEQ ID NO: 921468 - DNA, 20 bp, Homo sapiens
ctcaacctaccaccccttcc

SEQ ID NO: 921469 - DNA, 12 bp, Homo sapiens
ctcaacctcttc

SEQ ID NO: 921470 - DNA, 17 bp, Homo sapiens
ctcaaccttatcaagga

SEQ ID NO: 921471 - DNA, 22 bp, Homo sapiens
ctcaacggaagccccctcttcc

SEQ ID NO: 921472 - DNA, 15 bp, Homo sapiens
ctcaacgtattgttt

SEQ ID NO: 921473 - DNA, 16 bp, Homo sapiens
ctcaacgtattgtttc

SEQ ID NO: 921474 - DNA, 19 bp, Homo sapiens
ctcaactaacccttaaaaa

SEQ ID NO: 921475 - DNA, 19 bp, Homo sapiens
gcgcagatgaggggccact

SEQ ID NO: 921476 - DNA, 20 bp, Homo sapiens
gcgcagatgaggggccactg

SEQ ID NO: 921477 - DNA, 18 bp, Homo sapiens
gcgcagctggactctgca

SEQ ID NO: 921478 - DNA, 20 bp, Homo sapiens
gcgcaggcagcgcagggctg

SEQ ID NO: 921479 - DNA, 16 bp, Homo sapiens
gcgcaggcccagtgac

SEQ ID NO: 921480 - DNA, 16 bp, Homo sapiens
gcgcaggctcctttgt

SEQ ID NO: 921481 - DNA, 14 bp, Homo sapiens
gcgcaggctgcaga

SEQ ID NO: 921482 - DNA, 21 bp, Homo sapiens
gcgcaggctgcagagcccggc

SEQ ID NO: 921483 - DNA, 23 bp, Homo sapiens
gcgcagggacatggggcaagcca

SEQ ID NO: 921484 - DNA, 12 bp, Homo sapiens
gcgcagggctgg

SEQ ID NO: 921485 - DNA, 16 bp, Homo sapiens
gcgcagggctggcacg

SEQ ID NO: 921486 - DNA, 22 bp, Homo sapiens
gcgcagtgcttctctacagact

SEQ ID NO: 921487 - DNA, 22 bp, Homo sapiens
gcgcagttttttttttcttgtc

SEQ ID NO: 921488 - DNA, 15 bp, Homo sapiens
gcgcatggtgcagtg

SEQ ID NO: 921489 - DNA, 13 bp, Homo sapiens
gcgcatgtctgca

SEQ ID NO: 921490 - DNA, 18 bp, Homo sapiens
gcgcatgtctgcacctcc

SEQ ID NO: 921491 - DNA, 13 bp, Homo sapiens
gcgccaccatgcc

SEQ ID NO: 921492 - DNA, 15 bp, Homo sapiens
gcgccaccatgccct

SEQ ID NO: 921493 - DNA, 17 bp, Homo sapiens
gcgccaccgtgcctggc

SEQ ID NO: 921494 - DNA, 21 bp, Homo sapiens
gcgccactacactccagcctg

SEQ ID NO: 921495 - DNA, 11 bp, Homo sapiens
gcgccactgct

SEQ ID NO: 921496 - DNA, 23 bp, Homo sapiens
gcgccactgtgctccagcctggg

SEQ ID NO: 921497 - DNA, 20 bp, Homo sapiens
gcgccaggaagccagagccc

SEQ ID NO: 921498 - DNA, 13 bp, Homo sapiens
gcgccaggacagc

SEQ ID NO: 921499 - DNA, 22 bp, Homo sapiens
gcgccaggatggaacacggcca

SEQ ID NO: 921500 - DNA, 21 bp, Homo sapiens
gcgccaggcagagctgagggc

SEQ ID NO: 921501 - DNA, 15 bp, Homo sapiens
gcgccaggctgacca

SEQ ID NO: 921502 - DNA, 20 bp, Homo sapiens
gcgccaggctgaccacagca

SEQ ID NO: 921503 - DNA, 22 bp, Homo sapiens
gcgccaggctgaccacagcaca

SEQ ID NO: 921504 - DNA, 15 bp, Homo sapiens
gcgccagggcccagg

SEQ ID NO: 921505 - DNA, 16 bp, Homo sapiens
gcgccagggcccaggc

SEQ ID NO: 921506 - DNA, 16 bp, Homo sapiens
gcgcccacccaggtcc

SEQ ID NO: 921507 - DNA, 15 bp, Homo sapiens
gcgcccagagctggc

SEQ ID NO: 921508 - DNA, 18 bp, Homo sapiens
gcgcccagagctggcctc

SEQ ID NO: 921509 - DNA, 12 bp, Homo sapiens
gcgcccaggcct

SEQ ID NO: 921510 - DNA, 15 bp, Homo sapiens
gcgcccaggcctgct

SEQ ID NO: 921511 - DNA, 17 bp, Homo sapiens
gcgcccaggcctgctgg

SEQ ID NO: 921512 - DNA, 19 bp, Homo sapiens
gcgcccagtccttccacct

SEQ ID NO: 921513 - DNA, 19 bp, Homo sapiens
gcgcccattcgtctgtccc

SEQ ID NO: 921514 - DNA, 13 bp, Homo sapiens
gcgcccccagctt

SEQ ID NO: 921515 - DNA, 15 bp, Homo sapiens
gcgcccccagcttct

SEQ ID NO: 921516 - DNA, 13 bp, Homo sapiens
gcgcccccagtgt

SEQ ID NO: 921517 - DNA, 14 bp, Homo sapiens
gcgcccccgagccc

SEQ ID NO: 921518 - DNA, 16 bp, Homo sapiens
gcgcccccgagccctg

SEQ ID NO: 921519 - DNA, 20 bp, Homo sapiens
gcgcccccgagccctgactc

SEQ ID NO: 921520 - DNA, 20 bp, Homo sapiens
gcgcccccgccccaggcttc

SEQ ID NO: 921521 - DNA, 19 bp, Homo sapiens
gcgcccctctttttcccct

SEQ ID NO: 921522 - DNA, 13 bp, Homo sapiens
gcgcccgcgcccg

SEQ ID NO: 921523 - DNA, 13 bp, Homo sapiens
gcgccctccctcc

SEQ ID NO: 921524 - DNA, 19 bp, Homo sapiens
gcgccctccgacctctctc

SEQ ID NO: 921525 - DNA, 20 bp, Homo sapiens
gcgccctccgacctctctcg

SEQ ID NO: 921526 - DNA, 16 bp, Homo sapiens
gcgccctcctgcccac

SEQ ID NO: 921527 - DNA, 14 bp, Homo sapiens
gcgccctctctgct

SEQ ID NO: 921528 - DNA, 15 bp, Homo sapiens
gcgccctctctgctc

SEQ ID NO: 921529 - DNA, 17 bp, Homo sapiens
gcgccctctctgctcct

SEQ ID NO: 921530 - DNA, 21 bp, Homo sapiens
gcgccctctctgctccttcac

SEQ ID NO: 921531 - DNA, 17 bp, Homo sapiens
gcgccgatgccaccggc

SEQ ID NO: 921532 - DNA, 18 bp, Homo sapiens
gcgccgcaaaccacactg

SEQ ID NO: 921533 - DNA, 19 bp, Homo sapiens
gcgccggtccggcgccccg

SEQ ID NO: 921534 - DNA, 22 bp, Homo sapiens
gcgccggtccggcgccccgcac

SEQ ID NO: 921535 - DNA, 18 bp, Homo sapiens
gcgccgtgctgggcagcc

SEQ ID NO: 921536 - DNA, 24 bp, Homo sapiens
gcgcctacccttcccgcctccctc

SEQ ID NO: 921537 - DNA, 12 bp, Homo sapiens
gcgcctcagccc

SEQ ID NO: 921538 - DNA, 16 bp, Homo sapiens
gcgcctcagccctcag

SEQ ID NO: 921539 - DNA, 12 bp, Homo sapiens
gcgcctccatcc

SEQ ID NO: 921540 - DNA, 18 bp, Homo sapiens
gcgcctccctccacccca

SEQ ID NO: 921541 - DNA, 22 bp, Homo sapiens
gcgcctccctccaccccaggac

SEQ ID NO: 921542 - DNA, 21 bp, Homo sapiens
gcgcctcgccggatctgaggg

SEQ ID NO: 921543 - DNA, 18 bp, Homo sapiens
gcgcctcgttctctgggt

SEQ ID NO: 921544 - DNA, 19 bp, Homo sapiens
gcgcctgagtgagtgtgtg

SEQ ID NO: 921545 - DNA, 16 bp, Homo sapiens
gcgcctgcaggcagag

SEQ ID NO: 921546 - DNA, 18 bp, Homo sapiens
gcgcctgcaggcagagct

SEQ ID NO: 921547 - DNA, 12 bp, Homo sapiens
gcgcctgccctg

SEQ ID NO: 921548 - DNA, 13 bp, Homo sapiens
gcgcctgccctgc

SEQ ID NO: 921549 - DNA, 14 bp, Homo sapiens
gcgcctgccctgcc

SEQ ID NO: 921550 - DNA, 14 bp, Homo sapiens
gcgcctgctgcctg

SEQ ID NO: 921551 - DNA, 18 bp, Homo sapiens
gcgcctgctgcctgctga

SEQ ID NO: 921552 - DNA, 16 bp, Homo sapiens
gcgcctggagggatgc

SEQ ID NO: 921553 - DNA, 17 bp, Homo sapiens
gcgcctggagggatgcc

SEQ ID NO: 921554 - DNA, 21 bp, Homo sapiens
gcgcctggagggatgccccca

SEQ ID NO: 921555 - DNA, 16 bp, Homo sapiens
gcgcctggccttgtgt

SEQ ID NO: 921556 - DNA, 16 bp, Homo sapiens
gcgcctgtagtcccag

SEQ ID NO: 921557 - DNA, 20 bp, Homo sapiens
gcgcgagggcctcaaaggcc

SEQ ID NO: 921558 - DNA, 21 bp, Homo sapiens
gcgcgatcccacacaggctgg

SEQ ID NO: 921559 - DNA, 12 bp, Homo sapiens
gcgcgatctcag

SEQ ID NO: 921560 - DNA, 17 bp, Homo sapiens
gcgcgcaggcagggaga

SEQ ID NO: 921561 - DNA, 17 bp, Homo sapiens
gcgcggacgtgctgggc

SEQ ID NO: 921562 - DNA, 15 bp, Homo sapiens
gcgcggcggctctgc

SEQ ID NO: 921563 - DNA, 18 bp, Homo sapiens
gcgcggcggctctgccca

SEQ ID NO: 921564 - DNA, 16 bp, Homo sapiens
gcgcgggcagccaccc

SEQ ID NO: 921565 - DNA, 17 bp, Homo sapiens
gcgcgggcagccaccca

SEQ ID NO: 921566 - DNA, 13 bp, Homo sapiens
gcgcggtggctca

SEQ ID NO: 921567 - DNA, 13 bp, Homo sapiens
gcgcgtctgcccc

SEQ ID NO: 921568 - DNA, 19 bp, Homo sapiens
gcgcgtgcatgtgtgcgtg

SEQ ID NO: 921569 - DNA, 22 bp, Homo sapiens
gcgcgtttgtgcatatctgcct

SEQ ID NO: 921570 - DNA, 15 bp, Homo sapiens
gcgctaacccccagc

SEQ ID NO: 921571 - DNA, 19 bp, Homo sapiens
gcgctaacccccagcccac

SEQ ID NO: 921572 - DNA, 16 bp, Homo sapiens
gcgctacccacttcta

SEQ ID NO: 921573 - DNA, 11 bp, Homo sapiens
gcgctcaggac

SEQ ID NO: 921574 - DNA, 12 bp, Homo sapiens
gcgctcaggacc

SEQ ID NO: 921575 - DNA, 13 bp, Homo sapiens
gcgctcaggaccc

SEQ ID NO: 921576 - DNA, 17 bp, Homo sapiens
gcgctcaggacccaggc

SEQ ID NO: 921577 - DNA, 13 bp, Homo sapiens
gcgctcagggcca

SEQ ID NO: 921578 - DNA, 22 bp, Homo sapiens
gcgctcagggccatgctgaggc

SEQ ID NO: 921579 - DNA, 20 bp, Homo sapiens
gcgctcccgggcctcagggt

SEQ ID NO: 921580 - DNA, 24 bp, Homo sapiens
gcgctcccgggcctcagggtcctg

SEQ ID NO: 921581 - DNA, 18 bp, Homo sapiens
gcgctccgaaccccgggc

SEQ ID NO: 921582 - DNA, 14 bp, Homo sapiens
gcgctccgggcttt

SEQ ID NO: 921583 - DNA, 13 bp, Homo sapiens
gcgctcctctgcc

SEQ ID NO: 921584 - DNA, 16 bp, Homo sapiens
gcgctccttggcggac

SEQ ID NO: 921585 - DNA, 18 bp, Homo sapiens
gcgctcgccacgctcagt

SEQ ID NO: 921586 - DNA, 20 bp, Homo sapiens
gcgctcgccacgctcagtgc

SEQ ID NO: 921587 - DNA, 21 bp, Homo sapiens
gcgctcgccacgctcagtgcc

SEQ ID NO: 921588 - DNA, 15 bp, Homo sapiens
gcgctcgctcaggtg

SEQ ID NO: 921589 - DNA, 14 bp, Homo sapiens
gcgctcggcccgga

SEQ ID NO: 921590 - DNA, 16 bp, Homo sapiens
gcgctctagcctgggc

SEQ ID NO: 921591 - DNA, 17 bp, Homo sapiens
gcgctctcaagaccaga

SEQ ID NO: 921592 - DNA, 20 bp, Homo sapiens
gcgctctcaagaccagagac

SEQ ID NO: 921593 - DNA, 16 bp, Homo sapiens
gcgctctctttgcaac

SEQ ID NO: 921594 - DNA, 16 bp, Homo sapiens
gcgctcttggtccctg

SEQ ID NO: 921595 - DNA, 18 bp, Homo sapiens
gcgctcttggtccctggt

SEQ ID NO: 921596 - DNA, 23 bp, Homo sapiens
gcgctgacaaccaccgctcccca

SEQ ID NO: 921597 - DNA, 17 bp, Homo sapiens
ctaacactggcccctag

SEQ ID NO: 921598 - DNA, 17 bp, Homo sapiens
ctaacagatcagaacat

SEQ ID NO: 921599 - DNA, 22 bp, Homo sapiens
ctaacagccctcctctgcactc

SEQ ID NO: 921600 - DNA, 19 bp, Homo sapiens
ctaacagggagaagtagct

SEQ ID NO: 921601 - DNA, 12 bp, Homo sapiens
ctaacagtcctt

SEQ ID NO: 921602 - DNA, 15 bp, Homo sapiens
ctaacagtccttgct

SEQ ID NO: 921603 - DNA, 16 bp, Homo sapiens
ctaacagtccttgctt

SEQ ID NO: 921604 - DNA, 21 bp, Homo sapiens
ctaacagtttgcctgctgtat

SEQ ID NO: 921605 - DNA, 17 bp, Homo sapiens
ctaacataaaatctgtg

SEQ ID NO: 921606 - DNA, 18 bp, Homo sapiens
ctaacataaaatctgtga

SEQ ID NO: 921607 - DNA, 12 bp, Homo sapiens
ctaacatataat

SEQ ID NO: 921608 - DNA, 18 bp, Homo sapiens
ctaacatatgatactgat

SEQ ID NO: 921609 - DNA, 19 bp, Homo sapiens
ctaacatattcaatgcaag

SEQ ID NO: 921610 - DNA, 20 bp, Homo sapiens
gccctgcctgagggcccctc

SEQ ID NO: 921611 - DNA, 22 bp, Homo sapiens
gccctgcctgagggcccctctg

SEQ ID NO: 921612 - DNA, 23 bp, Homo sapiens
gccctgcctgagggcccctctgc

SEQ ID NO: 921613 - DNA, 21 bp, Homo sapiens
gccctgccttgccgctcccct

SEQ ID NO: 921614 - DNA, 17 bp, Homo sapiens
gccctgcgggccacagg

SEQ ID NO: 921615 - DNA, 18 bp, Homo sapiens
gccctgcggtagatggga

SEQ ID NO: 921616 - DNA, 17 bp, Homo sapiens
gccctgcgttggagcca

SEQ ID NO: 921617 - DNA, 21 bp, Homo sapiens
gccctgcgttggagccactcc

SEQ ID NO: 921618 - DNA, 22 bp, Homo sapiens
gccctgctactaacttttcaac

SEQ ID NO: 921619 - DNA, 21 bp, Homo sapiens
gccctgctcctccctggctgc

SEQ ID NO: 921620 - DNA, 17 bp, Homo sapiens
gccctgctcctgcagca

SEQ ID NO: 921621 - DNA, 19 bp, Homo sapiens
gccctgctgagtcatctgt

SEQ ID NO: 921622 - DNA, 23 bp, Homo sapiens
gccctgctgagtcccaggctgag

SEQ ID NO: 921623 - DNA, 16 bp, Homo sapiens
gccctgctgccacagc

SEQ ID NO: 921624 - DNA, 22 bp, Homo sapiens
gccctgctgccgcctcccagcc

SEQ ID NO: 921625 - DNA, 14 bp, Homo sapiens
gccctgctggcctg

SEQ ID NO: 921626 - DNA, 15 bp, Homo sapiens
gccctgctggcctgt

SEQ ID NO: 921627 - DNA, 11 bp, Homo sapiens
gccctgctggg

SEQ ID NO: 921628 - DNA, 17 bp, Homo sapiens
gccctgctgtgggagag

SEQ ID NO: 921629 - DNA, 22 bp, Homo sapiens
gccctgctgtgggagagcgaag

SEQ ID NO: 921630 - DNA, 22 bp, Homo sapiens
gccctgctttgggctgccctgg

SEQ ID NO: 921631 - DNA, 23 bp, Homo sapiens
gccctgctttgggctgccctggt

SEQ ID NO: 921632 - DNA, 11 bp, Homo sapiens
gccctgctttt

SEQ ID NO: 921633 - DNA, 16 bp, Homo sapiens
gccctgctttttttct

SEQ ID NO: 921634 - DNA, 20 bp, Homo sapiens
gccctgctttttttcttaaa

SEQ ID NO: 921635 - DNA, 17 bp, Homo sapiens
gccctggaagagtcctc

SEQ ID NO: 921636 - DNA, 17 bp, Homo sapiens
gccctggacagatggcc

SEQ ID NO: 921637 - DNA, 21 bp, Homo sapiens
gccctggacagatggcccaag

SEQ ID NO: 921638 - DNA, 22 bp, Homo sapiens
gccctggacagatggcccaagg

SEQ ID NO: 921639 - DNA, 23 bp, Homo sapiens
gccctggacagatggcccaaggg

SEQ ID NO: 921640 - DNA, 15 bp, Homo sapiens
gccctggagccaggg

SEQ ID NO: 921641 - DNA, 16 bp, Homo sapiens
gccctggagccagggc

SEQ ID NO: 921642 - DNA, 22 bp, Homo sapiens
gccctggaggcggtgcggcagg

SEQ ID NO: 921643 - DNA, 18 bp, Homo sapiens
gccctggaggctgacaca

SEQ ID NO: 921644 - DNA, 14 bp, Homo sapiens
gccctggagggagg

SEQ ID NO: 921645 - DNA, 10 bp, Homo sapiens
gccctggcaa

SEQ ID NO: 921646 - DNA, 14 bp, Homo sapiens
gccctggcagcagc

SEQ ID NO: 921647 - DNA, 12 bp, Homo sapiens
gccctggcagga

SEQ ID NO: 921648 - DNA, 13 bp, Homo sapiens
gccctggccagga

SEQ ID NO: 921649 - DNA, 17 bp, Homo sapiens
gccctggccctgaggtg

SEQ ID NO: 921650 - DNA, 18 bp, Homo sapiens
gccctggccctgaggtgt

SEQ ID NO: 921651 - DNA, 17 bp, Homo sapiens
gccctggcctcccctgc

SEQ ID NO: 921652 - DNA, 21 bp, Homo sapiens
gccctggcctcccctgccacc

SEQ ID NO: 921653 - DNA, 14 bp, Homo sapiens
gccctggcctgctg

SEQ ID NO: 921654 - DNA, 13 bp, Homo sapiens
gccctggcctggc

SEQ ID NO: 921655 - DNA, 19 bp, Homo sapiens
gccctggctcccacaggcc

SEQ ID NO: 921656 - DNA, 15 bp, Homo sapiens
gccctggctctgccc

SEQ ID NO: 921657 - DNA, 16 bp, Homo sapiens
gccctggctctgcccc

SEQ ID NO: 921658 - DNA, 14 bp, Homo sapiens
gccctggctgctgc

SEQ ID NO: 921659 - DNA, 13 bp, Homo sapiens
gccctggctgggt

SEQ ID NO: 921660 - DNA, 15 bp, Homo sapiens
gccctggctgttctg

SEQ ID NO: 921661 - DNA, 20 bp, Homo sapiens
gccctgggcacccacctcca

SEQ ID NO: 921662 - DNA, 22 bp, Homo sapiens
gccctgggcacccacctccacc

SEQ ID NO: 921663 - DNA, 14 bp, Homo sapiens
gccctgggccaggc

SEQ ID NO: 921664 - DNA, 21 bp, Homo sapiens
gccctgggccaggcaggcgat

SEQ ID NO: 921665 - DNA, 19 bp, Homo sapiens
gccctgggccccaccacct

SEQ ID NO: 921666 - DNA, 20 bp, Homo sapiens
gccctgggccccaccaccta

SEQ ID NO: 921667 - DNA, 14 bp, Homo sapiens
gccctgggcctcag

SEQ ID NO: 921668 - DNA, 12 bp, Homo sapiens
gccctgggctgg

SEQ ID NO: 921669 - DNA, 14 bp, Homo sapiens
gccctgggctggaa

SEQ ID NO: 921670 - DNA, 16 bp, Homo sapiens
gccctgggctggactg

SEQ ID NO: 921671 - DNA, 17 bp, Homo sapiens
gccctgggctggactgg

SEQ ID NO: 921672 - DNA, 15 bp, Homo sapiens
gccctgggctgggtg

SEQ ID NO: 921673 - DNA, 22 bp, Homo sapiens
gccctgggctgtctgtcaccag

SEQ ID NO: 921674 - DNA, 14 bp, Homo sapiens
gccctgggcttggc

SEQ ID NO: 921675 - DNA, 16 bp, Homo sapiens
gccctgggcttggctc

SEQ ID NO: 921676 - DNA, 13 bp, Homo sapiens
gccctggggagaa

SEQ ID NO: 921677 - DNA, 21 bp, Homo sapiens
gccctggggatcttcccacag

SEQ ID NO: 921678 - DNA, 22 bp, Homo sapiens
gccctggggatcttcccacagg

SEQ ID NO: 921679 - DNA, 20 bp, Homo sapiens
gccctgggggattcctgagc

SEQ ID NO: 921680 - DNA, 16 bp, Homo sapiens
gccctggggtaccatg

SEQ ID NO: 921681 - DNA, 23 bp, Homo sapiens
gccctggtaaaagggatacacag

SEQ ID NO: 921682 - DNA, 14 bp, Homo sapiens
gccctggtccaggg

SEQ ID NO: 921683 - DNA, 18 bp, Homo sapiens
gccctggtccagggaagc

SEQ ID NO: 921684 - DNA, 14 bp, Homo sapiens
gccctggtcctggc

SEQ ID NO: 921685 - DNA, 17 bp, Homo sapiens
gccctggtcctggcctc

SEQ ID NO: 921686 - DNA, 18 bp, Homo sapiens
gccctggtcctggcctcc

SEQ ID NO: 921687 - DNA, 19 bp, Homo sapiens
gccctggtcctggcctcct

SEQ ID NO: 921688 - DNA, 18 bp, Homo sapiens
gccctggtccttccaggc

SEQ ID NO: 921689 - DNA, 13 bp, Homo sapiens
gccctggtggaga

SEQ ID NO: 921690 - DNA, 16 bp, Homo sapiens
gccctggtgtgtttcc

SEQ ID NO: 921691 - DNA, 20 bp, Homo sapiens
gccctggttctggctgtggt

SEQ ID NO: 921692 - DNA, 14 bp, Homo sapiens
gccctgtacagtga

SEQ ID NO: 921693 - DNA, 16 bp, Homo sapiens
gccctgtacccacccc

SEQ ID NO: 921694 - DNA, 15 bp, Homo sapiens
gccctgtcagtgcag

SEQ ID NO: 921695 - DNA, 16 bp, Homo sapiens
gccctgtccctgtccc

SEQ ID NO: 921696 - DNA, 13 bp, Homo sapiens
gccctgtcctggt

SEQ ID NO: 921697 - DNA, 17 bp, Homo sapiens
gccctgtcgagacactt

SEQ ID NO: 921698 - DNA, 11 bp, Homo sapiens
gccctgtctgt

SEQ ID NO: 921699 - DNA, 21 bp, Homo sapiens
gccctgtgcaacctcttggcc

SEQ ID NO: 921700 - DNA, 12 bp, Homo sapiens
gccctgtgcctg

SEQ ID NO: 921701 - DNA, 17 bp, Homo sapiens
gccctgtggaagggact

SEQ ID NO: 921702 - DNA, 23 bp, Homo sapiens
gccctgtggaagggactaggagc

SEQ ID NO: 921703 - DNA, 17 bp, Homo sapiens
gccctgtggagtccagc

SEQ ID NO: 921704 - DNA, 18 bp, Homo sapiens
gccctgtggagtccagct

SEQ ID NO: 921705 - DNA, 19 bp, Homo sapiens
gccctgtggagtccagctc

SEQ ID NO: 921706 - DNA, 21 bp, Homo sapiens
gccctgtggagtccagctcta

SEQ ID NO: 921707 - DNA, 18 bp, Homo sapiens
gccctgtggccgccacct

SEQ ID NO: 921708 - DNA, 16 bp, Homo sapiens
gccctgtgtctgtcac

SEQ ID NO: 921709 - DNA, 23 bp, Homo sapiens
gccctgtgtctgtcacaggctgg

SEQ ID NO: 921710 - DNA, 20 bp, Homo sapiens
gccctgtgtgtgtcccctca

SEQ ID NO: 921711 - DNA, 23 bp, Homo sapiens
gccctgtgtgtttgacatgtgaa

SEQ ID NO: 921712 - DNA, 21 bp, Homo sapiens
gccctgttccctggagtcagg

SEQ ID NO: 921713 - DNA, 20 bp, Homo sapiens
gccctgttgaattttgttct

SEQ ID NO: 921714 - DNA, 19 bp, Homo sapiens
gccctgttgacacaggtct

SEQ ID NO: 921715 - DNA, 15 bp, Homo sapiens
gccctgttggcagct

SEQ ID NO: 921716 - DNA, 13 bp, Homo sapiens
gcccttaccttcc

SEQ ID NO: 921717 - DNA, 20 bp, Homo sapiens
gcccttacctttcctgatgc

SEQ ID NO: 921718 - DNA, 16 bp, Homo sapiens
gcccttagcacagaga

SEQ ID NO: 921719 - DNA, 22 bp, Homo sapiens
ctaagctgatattatttcttct

SEQ ID NO: 921720 - DNA, 13 bp, Homo sapiens
ctaagctggagct

SEQ ID NO: 921721 - DNA, 19 bp, Homo sapiens
ctaagctggagctcttgga

SEQ ID NO: 921722 - DNA, 24 bp, Homo sapiens
ctaagctggagctcttggaagagc

SEQ ID NO: 921723 - DNA, 22 bp, Homo sapiens
ctaagctggagtgcttatccct

SEQ ID NO: 921724 - DNA, 13 bp, Homo sapiens
ctaagctggctct

SEQ ID NO: 921725 - DNA, 17 bp, Homo sapiens
ctaagctggctctgttt

SEQ ID NO: 921726 - DNA, 16 bp, Homo sapiens
ctaagctgtttgccaa

SEQ ID NO: 921727 - DNA, 22 bp, Homo sapiens
ctaagctttgccagctgctgct

SEQ ID NO: 921728 - DNA, 23 bp, Homo sapiens
ctaaggagcgctagtgccttgcc

SEQ ID NO: 921729 - DNA, 23 bp, Homo sapiens
ctaaggagtgtagcaactacagt

SEQ ID NO: 921730 - DNA, 14 bp, Homo sapiens
ctaaggagttaaat

SEQ ID NO: 921731 - DNA, 20 bp, Homo sapiens
ctaaggataatgaaataatc

SEQ ID NO: 921732 - DNA, 22 bp, Homo sapiens
ctaaggataatgaaataatcag

SEQ ID NO: 921733 - DNA, 20 bp, Homo sapiens
ctaaggatctctcaggagca

SEQ ID NO: 921734 - DNA, 20 bp, Homo sapiens
ctaaggatgtcacagggcca

SEQ ID NO: 921735 - DNA, 20 bp, Homo sapiens
ctaaggatttttcaagagat

SEQ ID NO: 921736 - DNA, 15 bp, Homo sapiens
gcccttccctgtccc

SEQ ID NO: 921737 - DNA, 14 bp, Homo sapiens
gcccttcctcaggg

SEQ ID NO: 921738 - DNA, 14 bp, Homo sapiens
gcccttcctcctga

SEQ ID NO: 921739 - DNA, 18 bp, Homo sapiens
gcccttccttccattttt

SEQ ID NO: 921740 - DNA, 17 bp, Homo sapiens
gcccttccttgggcgtc

SEQ ID NO: 921741 - DNA, 18 bp, Homo sapiens
gcccttctcccggccctc

SEQ ID NO: 921742 - DNA, 21 bp, Homo sapiens
gcccttctgtccaccagaccc

SEQ ID NO: 921743 - DNA, 16 bp, Homo sapiens
gcccttcttgctgccc

SEQ ID NO: 921744 - DNA, 23 bp, Homo sapiens
gcccttcttgctgccctgcccca

SEQ ID NO: 921745 - DNA, 20 bp, Homo sapiens
gcccttgactgtacagagac

SEQ ID NO: 921746 - DNA, 21 bp, Homo sapiens
gcccttgcagttcagcaccac

SEQ ID NO: 921747 - DNA, 19 bp, Homo sapiens
gcccttgcccccatccctc

SEQ ID NO: 921748 - DNA, 14 bp, Homo sapiens
gcccttgccctgac

SEQ ID NO: 921749 - DNA, 18 bp, Homo sapiens
gcccttgccctgacctcc

SEQ ID NO: 921750 - DNA, 20 bp, Homo sapiens
gcccttgcccttggagctgc

SEQ ID NO: 921751 - DNA, 13 bp, Homo sapiens
gcccttgcctccc

SEQ ID NO: 921752 - DNA, 16 bp, Homo sapiens
gcccttgcctccccat

SEQ ID NO: 921753 - DNA, 17 bp, Homo sapiens
gcccttggaataaagtt

SEQ ID NO: 921754 - DNA, 15 bp, Homo sapiens
gcccttggagcgtgg

SEQ ID NO: 921755 - DNA, 14 bp, Homo sapiens
gcccttggcaccac

SEQ ID NO: 921756 - DNA, 22 bp, Homo sapiens
gcccttggcaccaccagggtgg

SEQ ID NO: 921757 - DNA, 12 bp, Homo sapiens
gcccttggctgc

SEQ ID NO: 921758 - DNA, 13 bp, Homo sapiens
gcccttggctgca

SEQ ID NO: 921759 - DNA, 14 bp, Homo sapiens
gcccttggctgcag

SEQ ID NO: 921760 - DNA, 18 bp, Homo sapiens
gcccttgggacagccaga

SEQ ID NO: 921761 - DNA, 21 bp, Homo sapiens
gcccttgggacagccagagct

SEQ ID NO: 921762 - DNA, 23 bp, Homo sapiens
gcccttgggacagccagagctgg

SEQ ID NO: 921763 - DNA, 13 bp, Homo sapiens
gcccttgggcagt

SEQ ID NO: 921764 - DNA, 15 bp, Homo sapiens
gcccttgggcagttc

SEQ ID NO: 921765 - DNA, 15 bp, Homo sapiens
gcccttggggcctgg

SEQ ID NO: 921766 - DNA, 19 bp, Homo sapiens
gcccttggggcctggcttg

SEQ ID NO: 921767 - DNA, 13 bp, Homo sapiens
gcccttgtatagt

SEQ ID NO: 921768 - DNA, 20 bp, Homo sapiens
gcccttgtcgtgggatggca

SEQ ID NO: 921769 - DNA, 13 bp, Homo sapiens
gcccttgtgctcc

SEQ ID NO: 921770 - DNA, 15 bp, Homo sapiens
gcccttgtgctcctc

SEQ ID NO: 921771 - DNA, 18 bp, Homo sapiens
gcccttgtgtgtgccctg

SEQ ID NO: 921772 - DNA, 19 bp, Homo sapiens
gcccttgtgtgtgccctgg

SEQ ID NO: 921773 - DNA, 21 bp, Homo sapiens
gcccttgtgtgtgccctgggc

SEQ ID NO: 921774 - DNA, 13 bp, Homo sapiens
gcccttgtttaca

SEQ ID NO: 921775 - DNA, 18 bp, Homo sapiens
gcccttgtttacagtgag

SEQ ID NO: 921776 - DNA, 22 bp, Homo sapiens
gcccttgtttacagtgaggact

SEQ ID NO: 921777 - DNA, 19 bp, Homo sapiens
gccctttcataaaaaccaa

SEQ ID NO: 921778 - DNA, 18 bp, Homo sapiens
gccctttcctaggcccag

SEQ ID NO: 921779 - DNA, 13 bp, Homo sapiens
gccctttctgtgt

SEQ ID NO: 921780 - DNA, 19 bp, Homo sapiens
gccctttgaagcctcagct

SEQ ID NO: 921781 - DNA, 23 bp, Homo sapiens
gccctttgagatctggggaggca

SEQ ID NO: 921782 - DNA, 14 bp, Homo sapiens
gccctttgctctgg

SEQ ID NO: 921783 - DNA, 13 bp, Homo sapiens
gccctttggagaa

SEQ ID NO: 921784 - DNA, 24 bp, Homo sapiens
gccctttggagaacgccagtctcc

SEQ ID NO: 921785 - DNA, 14 bp, Homo sapiens
gccctttggccaac

SEQ ID NO: 921786 - DNA, 21 bp, Homo sapiens
gcccttttcaggaagctctct

SEQ ID NO: 921787 - DNA, 17 bp, Homo sapiens
gccgaacattaggaatt

SEQ ID NO: 921788 - DNA, 16 bp, Homo sapiens
gccgaagccccttgga

SEQ ID NO: 921789 - DNA, 17 bp, Homo sapiens
gccgaagccccttggag

SEQ ID NO: 921790 - DNA, 17 bp, Homo sapiens
gccgaagctctggctga

SEQ ID NO: 921791 - DNA, 20 bp, Homo sapiens
gccgaatcccctccctgtca

SEQ ID NO: 921792 - DNA, 14 bp, Homo sapiens
gccgacatcagcat

SEQ ID NO: 921793 - DNA, 15 bp, Homo sapiens
gccgacatccctccc

SEQ ID NO: 921794 - DNA, 15 bp, Homo sapiens
gccgacattgtctcc

SEQ ID NO: 921795 - DNA, 17 bp, Homo sapiens
gccgacattgtctcccg

SEQ ID NO: 921796 - DNA, 16 bp, Homo sapiens
gccgaccctcctggcc

SEQ ID NO: 921797 - DNA, 15 bp, Homo sapiens
gccgaccctgcggcc

SEQ ID NO: 921798 - DNA, 16 bp, Homo sapiens
gccgaccctgcggcct

SEQ ID NO: 921799 - DNA, 17 bp, Homo sapiens
gccgaccctgcggcctc

SEQ ID NO: 921800 - DNA, 12 bp, Homo sapiens
gccgacctcagc

SEQ ID NO: 921801 - DNA, 15 bp, Homo sapiens
gccgacctcagcctt

SEQ ID NO: 921802 - DNA, 13 bp, Homo sapiens
gccgaccttccct

SEQ ID NO: 921803 - DNA, 22 bp, Homo sapiens
gccgaccttccctccgccttct

SEQ ID NO: 921804 - DNA, 18 bp, Homo sapiens
gccgacgcttgcacgacc

SEQ ID NO: 921805 - DNA, 21 bp, Homo sapiens
gccgactcccccaaccaagga

SEQ ID NO: 921806 - DNA, 23 bp, Homo sapiens
gccgactcccccaaccaaggaag

SEQ ID NO: 921807 - DNA, 12 bp, Homo sapiens
gccgactccctg

SEQ ID NO: 921808 - DNA, 19 bp, Homo sapiens
gccgactccctgagtctgg

SEQ ID NO: 921809 - DNA, 20 bp, Homo sapiens
gccgactccctgagtctgga

SEQ ID NO: 921810 - DNA, 18 bp, Homo sapiens
gccgactctggccctggc

SEQ ID NO: 921811 - DNA, 17 bp, Homo sapiens
gccgagaccgcagaggg

SEQ ID NO: 921812 - DNA, 18 bp, Homo sapiens
gccgagaccgcagaggga

SEQ ID NO: 921813 - DNA, 12 bp, Homo sapiens
gccgagagcctg

SEQ ID NO: 921814 - DNA, 22 bp, Homo sapiens
gccgagagcctgctcccccacc

SEQ ID NO: 921815 - DNA, 20 bp, Homo sapiens
gccgagccgggcctggggct

SEQ ID NO: 921816 - DNA, 13 bp, Homo sapiens
gccgagcctaatg

SEQ ID NO: 921817 - DNA, 24 bp, Homo sapiens
gccgagctcctggggagctcctgg

SEQ ID NO: 921818 - DNA, 21 bp, Homo sapiens
gccgagctcgtgtatcctggg

SEQ ID NO: 921819 - DNA, 22 bp, Homo sapiens
gccgagctcgtgtatcctgggg

SEQ ID NO: 921820 - DNA, 23 bp, Homo sapiens
gccgagctcgtgtatcctggggc

SEQ ID NO: 921821 - DNA, 15 bp, Homo sapiens
gccgaggactttgat

SEQ ID NO: 921822 - DNA, 16 bp, Homo sapiens
gccgagggtcctggct

SEQ ID NO: 921823 - DNA, 18 bp, Homo sapiens
gccgagggtcctggctcc

SEQ ID NO: 921824 - DNA, 20 bp, Homo sapiens
gccgagggtcctggctcctg

SEQ ID NO: 921825 - DNA, 16 bp, Homo sapiens
gccgagtcacacccgg

SEQ ID NO: 921826 - DNA, 15 bp, Homo sapiens
gccgagtccaagctg

SEQ ID NO: 921827 - DNA, 18 bp, Homo sapiens
gccgagtccaagctggga

SEQ ID NO: 921828 - DNA, 14 bp, Homo sapiens
gccgatcccaggtg

SEQ ID NO: 921829 - DNA, 13 bp, Homo sapiens
gccgatggaaaat

SEQ ID NO: 921830 - DNA, 21 bp, Homo sapiens
gccgcaaaccacactggactc

SEQ ID NO: 921831 - DNA, 22 bp, Homo sapiens
gccgcaaaccacactggactcc

SEQ ID NO: 921832 - DNA, 15 bp, Homo sapiens
gccgcaccccagagt

SEQ ID NO: 921833 - DNA, 13 bp, Homo sapiens
gccgcaccctgca

SEQ ID NO: 921834 - DNA, 15 bp, Homo sapiens
gccgcacgcctctcc

SEQ ID NO: 921835 - DNA, 16 bp, Homo sapiens
gccgcagaagcagccc

SEQ ID NO: 921836 - DNA, 14 bp, Homo sapiens
gccgcagctcttgc

SEQ ID NO: 921837 - DNA, 19 bp, Homo sapiens
gccgcagctcttgcccttc

SEQ ID NO: 921838 - DNA, 20 bp, Homo sapiens
gccgcagctcttgcccttcc

SEQ ID NO: 921839 - DNA, 15 bp, Homo sapiens
gccgcaggagggagg

SEQ ID NO: 921840 - DNA, 16 bp, Homo sapiens
gccgcaggagggaggc

SEQ ID NO: 921841 - DNA, 14 bp, Homo sapiens
ctacagacattaaa

SEQ ID NO: 921842 - DNA, 12 bp, Homo sapiens
ctacagagctgt

SEQ ID NO: 921843 - DNA, 14 bp, Homo sapiens
ctacagagctgtgg

SEQ ID NO: 921844 - DNA, 16 bp, Homo sapiens
ctacagagcttccctg

SEQ ID NO: 921845 - DNA, 20 bp, Homo sapiens
ctacagagcttccctgactc

SEQ ID NO: 921846 - DNA, 20 bp, Homo sapiens
ctacagaggaggcctcaaag

SEQ ID NO: 921847 - DNA, 15 bp, Homo sapiens
ctacagcactactgg

SEQ ID NO: 921848 - DNA, 19 bp, Homo sapiens
ctacagcactactgggtgt

SEQ ID NO: 921849 - DNA, 20 bp, Homo sapiens
ctacagcactactgggtgtc

SEQ ID NO: 921850 - DNA, 20 bp, Homo sapiens
ctacagccgtcccgcgttca

SEQ ID NO: 921851 - DNA, 21 bp, Homo sapiens
ctacagcctagggcagacaat

SEQ ID NO: 921852 - DNA, 18 bp, Homo sapiens
ctacagctaatcagcatt

SEQ ID NO: 921853 - DNA, 21 bp, Homo sapiens
ctacagctaatcagcattctc

SEQ ID NO: 921854 - DNA, 19 bp, Homo sapiens
ctacagctttgatccctga

SEQ ID NO: 921855 - DNA, 20 bp, Homo sapiens
ctacaggaagcaccccatgc

SEQ ID NO: 921856 - DNA, 23 bp, Homo sapiens
ctacaggatggtgggcaggatct

SEQ ID NO: 921857 - DNA, 20 bp, Homo sapiens
ctacaggcccggcccagcct

SEQ ID NO: 921858 - DNA, 21 bp, Homo sapiens
ctacaggggttagcctggact

SEQ ID NO: 921859 - DNA, 22 bp, Homo sapiens
ctacaggttgtgaaataatttt

SEQ ID NO: 921860 - DNA, 15 bp, Homo sapiens
ctacagtaatgaaat

SEQ ID NO: 921861 - DNA, 14 bp, Homo sapiens
ctacagtagctgct

SEQ ID NO: 921862 - DNA, 19 bp, Homo sapiens
ctacagtcgtaaaagagat

SEQ ID NO: 921863 - DNA, 20 bp, Homo sapiens
ctacagtcgtaaaagagata

SEQ ID NO: 921864 - DNA, 21 bp, Homo sapiens
ctacagtcgtaaaagagataa

SEQ ID NO: 921865 - DNA, 17 bp, Homo sapiens
ctacagtgactccctgg

SEQ ID NO: 921866 - DNA, 18 bp, Homo sapiens
ctacagtgactccctggg

SEQ ID NO: 921867 - DNA, 20 bp, Homo sapiens
ctacagtgccaactcctcac

SEQ ID NO: 921868 - DNA, 15 bp, Homo sapiens
ctacagttcacagag

SEQ ID NO: 921869 - DNA, 17 bp, Homo sapiens
gccgtctcctccctcag

SEQ ID NO: 921870 - DNA, 12 bp, Homo sapiens
gccgtctctgga

SEQ ID NO: 921871 - DNA, 16 bp, Homo sapiens
gccgtctgactccaga

SEQ ID NO: 921872 - DNA, 17 bp, Homo sapiens
gccgtctgactccagag

SEQ ID NO: 921873 - DNA, 18 bp, Homo sapiens
gccgtctgcaggggcctg

SEQ ID NO: 921874 - DNA, 11 bp, Homo sapiens
gccgtctgtcc

SEQ ID NO: 921875 - DNA, 13 bp, Homo sapiens
gccgtctgtcctc

SEQ ID NO: 921876 - DNA, 22 bp, Homo sapiens
gccgtgcatggctcctgtctgg

SEQ ID NO: 921877 - DNA, 13 bp, Homo sapiens
gccgtgcccttgc

SEQ ID NO: 921878 - DNA, 20 bp, Homo sapiens
gccgtgcccttgcccttgga

SEQ ID NO: 921879 - DNA, 17 bp, Homo sapiens
gccgtgctcgccccagc

SEQ ID NO: 921880 - DNA, 21 bp, Homo sapiens
gccgtgctcgccccagcaggt

SEQ ID NO: 921881 - DNA, 18 bp, Homo sapiens
gccgtgctgggcagcccg

SEQ ID NO: 921882 - DNA, 12 bp, Homo sapiens
gccgtggatgcg

SEQ ID NO: 921883 - DNA, 23 bp, Homo sapiens
gccgtggattgcacgtggcctct

SEQ ID NO: 921884 - DNA, 14 bp, Homo sapiens
gccgtggcacagct

SEQ ID NO: 921885 - DNA, 15 bp, Homo sapiens
gccgtggcttcccgc

SEQ ID NO: 921886 - DNA, 19 bp, Homo sapiens
gccgtggcttcccgctcag

SEQ ID NO: 921887 - DNA, 18 bp, Homo sapiens
gccgtggcttgggctggt

SEQ ID NO: 921888 - DNA, 21 bp, Homo sapiens
gccgtggcttgggctggtcag

SEQ ID NO: 921889 - DNA, 23 bp, Homo sapiens
gccgtggtccaaccaggagctga

SEQ ID NO: 921890 - DNA, 14 bp, Homo sapiens
gccgtggtccctga

SEQ ID NO: 921891 - DNA, 15 bp, Homo sapiens
gccgtgtctcagcct

SEQ ID NO: 921892 - DNA, 18 bp, Homo sapiens
gccgtgtctcagcctctg

SEQ ID NO: 921893 - DNA, 19 bp, Homo sapiens
gccgtgtgagtgtgacagg

SEQ ID NO: 921894 - DNA, 23 bp, Homo sapiens
gccgtgtgagtgtgacagggcca

SEQ ID NO: 921895 - DNA, 21 bp, Homo sapiens
gccgtgtgtctgtcagcccaa

SEQ ID NO: 921896 - DNA, 14 bp, Homo sapiens
gccgttactctcca

SEQ ID NO: 921897 - DNA, 15 bp, Homo sapiens
gccgttccccttggc

SEQ ID NO: 921898 - DNA, 22 bp, Homo sapiens
gccgttgaatctgggagggaag

SEQ ID NO: 921899 - DNA, 21 bp, Homo sapiens
gccgttttcttacacaccccc

SEQ ID NO: 921900 - DNA, 17 bp, Homo sapiens
gcctaaaaatgcaactt

SEQ ID NO: 921901 - DNA, 19 bp, Homo sapiens
gcctaaaaattcccttcct

SEQ ID NO: 921902 - DNA, 20 bp, Homo sapiens
gcctaaaaattcccttcctg

SEQ ID NO: 921903 - DNA, 18 bp, Homo sapiens
gcctaaagctaaaaatat

SEQ ID NO: 921904 - DNA, 13 bp, Homo sapiens
gcctaaagggcag

SEQ ID NO: 921905 - DNA, 14 bp, Homo sapiens
gcctaaagggcagg

SEQ ID NO: 921906 - DNA, 22 bp, Homo sapiens
gcctaaagtatacaactgcctg

SEQ ID NO: 921907 - DNA, 12 bp, Homo sapiens
gcctaaatgatg

SEQ ID NO: 921908 - DNA, 18 bp, Homo sapiens
gcctaaatttaatgctgc

SEQ ID NO: 921909 - DNA, 20 bp, Homo sapiens
gcctaaatttaatgctgcct

SEQ ID NO: 921910 - DNA, 18 bp, Homo sapiens
gcctaaatttattaaata

SEQ ID NO: 921911 - DNA, 16 bp, Homo sapiens
gcctaacaccagcgtt

SEQ ID NO: 921912 - DNA, 18 bp, Homo sapiens
gcctaactaactggcagg

SEQ ID NO: 921913 - DNA, 14 bp, Homo sapiens
gcctaacttgtaaa

SEQ ID NO: 921914 - DNA, 23 bp, Homo sapiens
gcctaagggatcctgcctgcccc

SEQ ID NO: 921915 - DNA, 22 bp, Homo sapiens
gcctaaggttgtctacgggggc

SEQ ID NO: 921916 - DNA, 23 bp, Homo sapiens
gcctaatccctgggcattgcttt

SEQ ID NO: 921917 - DNA, 16 bp, Homo sapiens
gcctaatggagaagac

SEQ ID NO: 921918 - DNA, 16 bp, Homo sapiens
gcctacaaatcagtaa

SEQ ID NO: 921919 - DNA, 17 bp, Homo sapiens
gcctacaaatcagtaat

SEQ ID NO: 921920 - DNA, 16 bp, Homo sapiens
gcctacaataaaaaga

SEQ ID NO: 921921 - DNA, 17 bp, Homo sapiens
gcctacaataaaaagaa

SEQ ID NO: 921922 - DNA, 16 bp, Homo sapiens
gcctacagaggaggcc

SEQ ID NO: 921923 - DNA, 23 bp, Homo sapiens
gcctacagctttgatccctgaca

SEQ ID NO: 921924 - DNA, 14 bp, Homo sapiens
gcctaccccgcaga

SEQ ID NO: 921925 - DNA, 17 bp, Homo sapiens
gcctaccccgcagacac

SEQ ID NO: 921926 - DNA, 16 bp, Homo sapiens
gcctaccgtatttcag

SEQ ID NO: 921927 - DNA, 17 bp, Homo sapiens
gcctacctcaagttctt

SEQ ID NO: 921928 - DNA, 20 bp, Homo sapiens
gcctacctcaagttcttgga

SEQ ID NO: 921929 - DNA, 17 bp, Homo sapiens
gcctaccttcaccacct

SEQ ID NO: 921930 - DNA, 17 bp, Homo sapiens
gcctactccaaaatgtt

SEQ ID NO: 921931 - DNA, 18 bp, Homo sapiens
gcctactggacgctgccc

SEQ ID NO: 921932 - DNA, 21 bp, Homo sapiens
gcctactggggggctttggcc

SEQ ID NO: 921933 - DNA, 12 bp, Homo sapiens
gcctacttttct

SEQ ID NO: 921934 - DNA, 16 bp, Homo sapiens
gcctagaacatccctg

SEQ ID NO: 921935 - DNA, 19 bp, Homo sapiens
gcctagaacatccctgggc

SEQ ID NO: 921936 - DNA, 22 bp, Homo sapiens
gcctagaacatccctgggcaag

SEQ ID NO: 921937 - DNA, 18 bp, Homo sapiens
gcctagacaacctttctg

SEQ ID NO: 921938 - DNA, 16 bp, Homo sapiens
gcctagaccagcagac

SEQ ID NO: 921939 - DNA, 23 bp, Homo sapiens
gcctagaccagcagacagagcca

SEQ ID NO: 921940 - DNA, 13 bp, Homo sapiens
gcctagactctgt

SEQ ID NO: 921941 - DNA, 16 bp, Homo sapiens
gcctagagcactctca

SEQ ID NO: 921942 - DNA, 20 bp, Homo sapiens
gcctagagcactctcacccc

SEQ ID NO: 921943 - DNA, 12 bp, Homo sapiens
gcctagagtgta

SEQ ID NO: 921944 - DNA, 15 bp, Homo sapiens
gcctagagtgtagcc

SEQ ID NO: 921945 - DNA, 17 bp, Homo sapiens
gcctagatccacacaca

SEQ ID NO: 921946 - DNA, 22 bp, Homo sapiens
gcctagatccacgtgtggcctc

SEQ ID NO: 921947 - DNA, 12 bp, Homo sapiens
gcctagcacagc

SEQ ID NO: 921948 - DNA, 15 bp, Homo sapiens
gcctagcacagcagc

SEQ ID NO: 921949 - DNA, 20 bp, Homo sapiens
gcctagcatacgtacacatt

SEQ ID NO: 921950 - DNA, 18 bp, Homo sapiens
gcctagcatggggtcagc

SEQ ID NO: 921951 - DNA, 21 bp, Homo sapiens
gcctagcatggggtcagcccc

SEQ ID NO: 921952 - DNA, 18 bp, Homo sapiens
gcctagccctccccccag

SEQ ID NO: 921953 - DNA, 20 bp, Homo sapiens
gcctagccctccccccagct

SEQ ID NO: 921954 - DNA, 16 bp, Homo sapiens
gcctagccgacctcag

SEQ ID NO: 921955 - DNA, 17 bp, Homo sapiens
gcctagcgatctctcct

SEQ ID NO: 921956 - DNA, 21 bp, Homo sapiens
gcctagcgatctctcctggcc

SEQ ID NO: 921957 - DNA, 18 bp, Homo sapiens
gcctagcggagcccagcc

SEQ ID NO: 921958 - DNA, 15 bp, Homo sapiens
gcctagctcctgcca

SEQ ID NO: 921959 - DNA, 23 bp, Homo sapiens
gcctaggacgccaacttctccca

SEQ ID NO: 921960 - DNA, 14 bp, Homo sapiens
gcctaggaggcccc

SEQ ID NO: 921961 - DNA, 18 bp, Homo sapiens
gcctaggaggctggccaa

SEQ ID NO: 921962 - DNA, 15 bp, Homo sapiens
gcctccaccaccact

SEQ ID NO: 921963 - DNA, 16 bp, Homo sapiens
gcctccaccaccactg

SEQ ID NO: 921964 - DNA, 23 bp, Homo sapiens
gcctccaccaccactggccacca

SEQ ID NO: 921965 - DNA, 21 bp, Homo sapiens
gcctccacccgtcctccctca

SEQ ID NO: 921966 - DNA, 12 bp, Homo sapiens
gcctccaccgct

SEQ ID NO: 921967 - DNA, 18 bp, Homo sapiens
gcctccaccgctgcctaa

SEQ ID NO: 921968 - DNA, 15 bp, Homo sapiens
gcctccactccccca

SEQ ID NO: 921969 - DNA, 22 bp, Homo sapiens
gcctccactcccccacctgaca

SEQ ID NO: 921970 - DNA, 12 bp, Homo sapiens
gcctccactcta

SEQ ID NO: 921971 - DNA, 21 bp, Homo sapiens
gcctccactctagttctagat

SEQ ID NO: 921972 - DNA, 22 bp, Homo sapiens
gcctccactctagttctagatg

SEQ ID NO: 921973 - DNA, 17 bp, Homo sapiens
gcctccagaactcactg

SEQ ID NO: 921974 - DNA, 16 bp, Homo sapiens
gcctccagaagctgct

SEQ ID NO: 921975 - DNA, 21 bp, Homo sapiens
gcctccagaagctgctccttt

SEQ ID NO: 921976 - DNA, 20 bp, Homo sapiens
gcctccagagaagccccgca

SEQ ID NO: 921977 - DNA, 22 bp, Homo sapiens
gcctccagagccagcctgggac

SEQ ID NO: 921978 - DNA, 24 bp, Homo sapiens
gcctccagagccagcctgggactc

SEQ ID NO: 921979 - DNA, 17 bp, Homo sapiens
gcctccagaggtcctcc

SEQ ID NO: 921980 - DNA, 20 bp, Homo sapiens
gcctccagcctctcccggct

SEQ ID NO: 921981 - DNA, 23 bp, Homo sapiens
gcctccagcctctcccggctgcc

SEQ ID NO: 921982 - DNA, 17 bp, Homo sapiens
gcctccagctgttctta

SEQ ID NO: 921983 - DNA, 12 bp, Homo sapiens
gcctccaggagg

SEQ ID NO: 921984 - DNA, 22 bp, Homo sapiens
gcctccaggaggggcctgggca

SEQ ID NO: 921985 - DNA, 18 bp, Homo sapiens
gcctccagggcccaggtt

SEQ ID NO: 921986 - DNA, 13 bp, Homo sapiens
gcctccaggtgtg

SEQ ID NO: 921987 - DNA, 14 bp, Homo sapiens
gcctccaggtgtgc

SEQ ID NO: 921988 - DNA, 16 bp, Homo sapiens
gcctccagtcatggta

SEQ ID NO: 921989 - DNA, 19 bp, Homo sapiens
gcctccatccatctgtccg

SEQ ID NO: 921990 - DNA, 16 bp, Homo sapiens
gcctccattctgacca

SEQ ID NO: 921991 - DNA, 17 bp, Homo sapiens
gcctccatttagttctt

SEQ ID NO: 921992 - DNA, 15 bp, Homo sapiens
gcctccatttctgtc

SEQ ID NO: 921993 - DNA, 17 bp, Homo sapiens
gcctcccaaagtgctgg

SEQ ID NO: 921994 - DNA, 18 bp, Homo sapiens
gcctcccaaagtgctggg

SEQ ID NO: 921995 - DNA, 20 bp, Homo sapiens
gcctcccaaagtgctgggat

SEQ ID NO: 921996 - DNA, 20 bp, Homo sapiens
gcctcccaaggtcctctcag

SEQ ID NO: 921997 - DNA, 18 bp, Homo sapiens
gcctcccaagtagctggg

SEQ ID NO: 921998 - DNA, 20 bp, Homo sapiens
gcctcccaagtagctgggat

SEQ ID NO: 921999 - DNA, 14 bp, Homo sapiens
ctacgtatttaata

SEQ ID NO: 922000 - DNA, 14 bp, Homo sapiens
ctacgtcatgtatt

SEQ ID NO: 922001 - DNA, 16 bp, Homo sapiens
ctacgtgcctcccgag

SEQ ID NO: 922002 - DNA, 16 bp, Homo sapiens
ctacgttaagggaagg

SEQ ID NO: 922003 - DNA, 14 bp, Homo sapiens
ctactaaaaatgca

SEQ ID NO: 922004 - DNA, 19 bp, Homo sapiens
ctactaacaaatgtaaaat

SEQ ID NO: 922005 - DNA, 20 bp, Homo sapiens
ctactaagttcacattagaa

SEQ ID NO: 922006 - DNA, 13 bp, Homo sapiens
ctactaatgatgt

SEQ ID NO: 922007 - DNA, 14 bp, Homo sapiens
ctactaatgatgtt

SEQ ID NO: 922008 - DNA, 22 bp, Homo sapiens
ctactaatgtgatgctttcatt

SEQ ID NO: 922009 - DNA, 12 bp, Homo sapiens
ctactaattcca

SEQ ID NO: 922010 - DNA, 17 bp, Homo sapiens
ctactaattccacacct

SEQ ID NO: 922011 - DNA, 19 bp, Homo sapiens
ctactaccacaaggaaaat

SEQ ID NO: 922012 - DNA, 13 bp, Homo sapiens
ctactaccagaag

SEQ ID NO: 922013 - DNA, 16 bp, Homo sapiens
ctactaccagaagggc

SEQ ID NO: 922014 - DNA, 18 bp, Homo sapiens
ctactacccccacagacc

SEQ ID NO: 922015 - DNA, 17 bp, Homo sapiens
ctactacccgagcccag

SEQ ID NO: 922016 - DNA, 18 bp, Homo sapiens
ctactacccgagcccagc

SEQ ID NO: 922017 - DNA, 13 bp, Homo sapiens
ctactactctgcc

SEQ ID NO: 922018 - DNA, 22 bp, Homo sapiens
ctactagagtctgaacagctgt

SEQ ID NO: 922019 - DNA, 16 bp, Homo sapiens
ctactagcaaaataaa

SEQ ID NO: 922020 - DNA, 19 bp, Homo sapiens
ctactagcaaaataaaaca

SEQ ID NO: 922021 - DNA, 15 bp, Homo sapiens
ctactataaagagaa

SEQ ID NO: 922022 - DNA, 13 bp, Homo sapiens
ctactatatacat

SEQ ID NO: 922023 - DNA, 16 bp, Homo sapiens
ctactatcatctctta

SEQ ID NO: 922024 - DNA, 16 bp, Homo sapiens
ctactatgtgctgggt

SEQ ID NO: 922025 - DNA, 20 bp, Homo sapiens
ctactatgtgctgggtgcct

SEQ ID NO: 922026 - DNA, 22 bp, Homo sapiens
ctactcaagcgggtggctctgg

SEQ ID NO: 922027 - DNA, 18 bp, Homo sapiens
ctactcacagtctcttta

SEQ ID NO: 922028 - DNA, 22 bp, Homo sapiens
ctactcagaaatggacaaagaa

SEQ ID NO: 922029 - DNA, 13 bp, Homo sapiens
ctactcagaagcc

SEQ ID NO: 922030 - DNA, 19 bp, Homo sapiens
ctactcagaagcctgaggc

SEQ ID NO: 922031 - DNA, 18 bp, Homo sapiens
ctactcagcagccctcct

SEQ ID NO: 922032 - DNA, 20 bp, Homo sapiens
ctactcagcagccctcctca

SEQ ID NO: 922033 - DNA, 21 bp, Homo sapiens
ctactcagcagccctcctcac

SEQ ID NO: 922034 - DNA, 23 bp, Homo sapiens
ctactcaggaggctgaggcagga

SEQ ID NO: 922035 - DNA, 14 bp, Homo sapiens
ctactccactgccc

SEQ ID NO: 922036 - DNA, 14 bp, Homo sapiens
ctactccctgcaga

SEQ ID NO: 922037 - DNA, 16 bp, Homo sapiens
ctactccggagacagg

SEQ ID NO: 922038 - DNA, 16 bp, Homo sapiens
ctactcctagaagaac

SEQ ID NO: 922039 - DNA, 18 bp, Homo sapiens
ctactcctagaagaacca

SEQ ID NO: 922040 - DNA, 14 bp, Homo sapiens
ctactcctgcggct

SEQ ID NO: 922041 - DNA, 17 bp, Homo sapiens
ctactcgatagcctgag

SEQ ID NO: 922042 - DNA, 23 bp, Homo sapiens
ctactctaaagaaaaatgcctgt

SEQ ID NO: 922043 - DNA, 15 bp, Homo sapiens
ctactctagttctgt

SEQ ID NO: 922044 - DNA, 23 bp, Homo sapiens
ctactctcacactggttctcaat

SEQ ID NO: 922045 - DNA, 17 bp, Homo sapiens
ctactctccccacgagg

SEQ ID NO: 922046 - DNA, 19 bp, Homo sapiens
ctactctccccacgagggc

SEQ ID NO: 922047 - DNA, 22 bp, Homo sapiens
ctactctccccacgagggctgg

SEQ ID NO: 922048 - DNA, 17 bp, Homo sapiens
ctactctcctcggcccc

SEQ ID NO: 922049 - DNA, 22 bp, Homo sapiens
ctactctgccaatcggctaccc

SEQ ID NO: 922050 - DNA, 13 bp, Homo sapiens
ctactctggaatg

SEQ ID NO: 922051 - DNA, 23 bp, Homo sapiens
ctactctggaatgtttttccctc

SEQ ID NO: 922052 - DNA, 16 bp, Homo sapiens
ctactctgtccaggcc

SEQ ID NO: 922053 - DNA, 17 bp, Homo sapiens
ctactcttcctgtccta

SEQ ID NO: 922054 - DNA, 12 bp, Homo sapiens
ctactctttgat

SEQ ID NO: 922055 - DNA, 14 bp, Homo sapiens
ctactctttgattt

SEQ ID NO: 922056 - DNA, 18 bp, Homo sapiens
ctactgaaacagatttca

SEQ ID NO: 922057 - DNA, 22 bp, Homo sapiens
ctactgaaacagatttcatacc

SEQ ID NO: 922058 - DNA, 21 bp, Homo sapiens
ctactgaataatgctaccagg

SEQ ID NO: 922059 - DNA, 15 bp, Homo sapiens
ctactgacagggagc

SEQ ID NO: 922060 - DNA, 19 bp, Homo sapiens
ctactgacatatctacact

SEQ ID NO: 922061 - DNA, 15 bp, Homo sapiens
ctactgacatgtggg

SEQ ID NO: 922062 - DNA, 21 bp, Homo sapiens
ctactgagcatttgcacctct

SEQ ID NO: 922063 - DNA, 14 bp, Homo sapiens
ctactgaggtgcta

SEQ ID NO: 922064 - DNA, 16 bp, Homo sapiens
ctactgattgtttcat

SEQ ID NO: 922065 - DNA, 21 bp, Homo sapiens
ctactgattttaaaatgaata

SEQ ID NO: 922066 - DNA, 17 bp, Homo sapiens
ctactgcactccagcct

SEQ ID NO: 922067 - DNA, 23 bp, Homo sapiens
ctactgcactccagcctggggga

SEQ ID NO: 922068 - DNA, 18 bp, Homo sapiens
ctactgcactttccccct

SEQ ID NO: 922069 - DNA, 19 bp, Homo sapiens
ctactgcactttccccctt

SEQ ID NO: 922070 - DNA, 22 bp, Homo sapiens
ctactgcactttcccccttccc

SEQ ID NO: 922071 - DNA, 23 bp, Homo sapiens
ctactgcactttcccccttcccg

SEQ ID NO: 922072 - DNA, 21 bp, Homo sapiens
ctactgccactgtgtgccttc

SEQ ID NO: 922073 - DNA, 11 bp, Homo sapiens
ctactgcccac

SEQ ID NO: 922074 - DNA, 14 bp, Homo sapiens
ctactgctcctgtg

SEQ ID NO: 922075 - DNA, 20 bp, Homo sapiens
ctactgctgtgaaccctggg

SEQ ID NO: 922076 - DNA, 20 bp, Homo sapiens
ctactggaaatgtagcactt

SEQ ID NO: 922077 - DNA, 14 bp, Homo sapiens
ctactggacaatct

SEQ ID NO: 922078 - DNA, 16 bp, Homo sapiens
ctactggattcttatt

SEQ ID NO: 922079 - DNA, 22 bp, Homo sapiens
ctactggcagctcctctccttg

SEQ ID NO: 922080 - DNA, 14 bp, Homo sapiens
ctactgggtgtcat

SEQ ID NO: 922081 - DNA, 23 bp, Homo sapiens
ctactgggtgtcatttcattcca

SEQ ID NO: 922082 - DNA, 17 bp, Homo sapiens
ctactggtcttgtggaa

SEQ ID NO: 922083 - DNA, 21 bp, Homo sapiens
gcctcctcagggggtaggaga

SEQ ID NO: 922084 - DNA, 23 bp, Homo sapiens
gcctcctcagggggtaggagagc

SEQ ID NO: 922085 - DNA, 15 bp, Homo sapiens
gcctcctcagtgaag

SEQ ID NO: 922086 - DNA, 23 bp, Homo sapiens
gcctcctcatcagtgtgtaaata

SEQ ID NO: 922087 - DNA, 17 bp, Homo sapiens
gcctcctcatcccgtgt

SEQ ID NO: 922088 - DNA, 19 bp, Homo sapiens
gcctcctcccactgggact

SEQ ID NO: 922089 - DNA, 14 bp, Homo sapiens
gcctcctccccagg

SEQ ID NO: 922090 - DNA, 19 bp, Homo sapiens
gcctcctccctcccagctg

SEQ ID NO: 922091 - DNA, 22 bp, Homo sapiens
gcctcctccctcccagctgcac

SEQ ID NO: 922092 - DNA, 23 bp, Homo sapiens
gcctcctccctcccagctgcact

SEQ ID NO: 922093 - DNA, 15 bp, Homo sapiens
gcctcctcctgacca

SEQ ID NO: 922094 - DNA, 22 bp, Homo sapiens
gcctcctcggagagcagcagca

SEQ ID NO: 922095 - DNA, 23 bp, Homo sapiens
gcctcctcggagagcagcagcac

SEQ ID NO: 922096 - DNA, 19 bp, Homo sapiens
gcctcctcgttcctttctc

SEQ ID NO: 922097 - DNA, 23 bp, Homo sapiens
gcctcctctctcagtttttatat

SEQ ID NO: 922098 - DNA, 16 bp, Homo sapiens
gcctcctctgtccagg

SEQ ID NO: 922099 - DNA, 16 bp, Homo sapiens
gcctcctgagcctgtg

SEQ ID NO: 922100 - DNA, 21 bp, Homo sapiens
gcctcctgagggctccatgct

SEQ ID NO: 922101 - DNA, 10 bp, Homo sapiens
gcctcctgca

SEQ ID NO: 922102 - DNA, 13 bp, Homo sapiens
gcctcctgcagtt

SEQ ID NO: 922103 - DNA, 13 bp, Homo sapiens
gcctcctgccacc

SEQ ID NO: 922104 - DNA, 14 bp, Homo sapiens
gcctcctgccaccc

SEQ ID NO: 922105 - DNA, 18 bp, Homo sapiens
gcctcctgccaccccttc

SEQ ID NO: 922106 - DNA, 19 bp, Homo sapiens
gcctcctgccaccccttcc

SEQ ID NO: 922107 - DNA, 12 bp, Homo sapiens
gcctcctgctct

SEQ ID NO: 922108 - DNA, 16 bp, Homo sapiens
gcctcctgctctctgg

SEQ ID NO: 922109 - DNA, 17 bp, Homo sapiens
gcctcctggaggaccag

SEQ ID NO: 922110 - DNA, 11 bp, Homo sapiens
gcctcctggcc

SEQ ID NO: 922111 - DNA, 12 bp, Homo sapiens
gcctcctggcca

SEQ ID NO: 922112 - DNA, 15 bp, Homo sapiens
gcctcctggccagac

SEQ ID NO: 922113 - DNA, 16 bp, Homo sapiens
gcctcctggccagacg

SEQ ID NO: 922114 - DNA, 19 bp, Homo sapiens
gcctcctggccagacgctg

SEQ ID NO: 922115 - DNA, 21 bp, Homo sapiens
gcctcctggtttcctttctca

SEQ ID NO: 922116 - DNA, 19 bp, Homo sapiens
gcctcctgtgcctcccttt

SEQ ID NO: 922117 - DNA, 18 bp, Homo sapiens
gcctcctgtgcctggccc

SEQ ID NO: 922118 - DNA, 20 bp, Homo sapiens
gcctcctgtgcctggcccca

SEQ ID NO: 922119 - DNA, 12 bp, Homo sapiens
gcctcctgtggg

SEQ ID NO: 922120 - DNA, 20 bp, Homo sapiens
gcctcctgttttctccctct

SEQ ID NO: 922121 - DNA, 22 bp, Homo sapiens
gcctcctgttttctccctctca

SEQ ID NO: 922122 - DNA, 20 bp, Homo sapiens
gcctccttccacctccctcc

SEQ ID NO: 922123 - DNA, 17 bp, Homo sapiens
gcctccttcccatgcct

SEQ ID NO: 922124 - DNA, 19 bp, Homo sapiens
gcctccttcccatgcctgt

SEQ ID NO: 922125 - DNA, 22 bp, Homo sapiens
gcctccttcttccacttctcca

SEQ ID NO: 922126 - DNA, 17 bp, Homo sapiens
gcctcgacaccccccca

SEQ ID NO: 922127 - DNA, 23 bp, Homo sapiens
gcctcgaggcaccggcgctgcag

SEQ ID NO: 922128 - DNA, 22 bp, Homo sapiens
gcctcgagggccgcctgcctta

SEQ ID NO: 922129 - DNA, 18 bp, Homo sapiens
gcctcgcacttgcagagg

SEQ ID NO: 922130 - DNA, 14 bp, Homo sapiens
gcctcgcccctcca

SEQ ID NO: 922131 - DNA, 21 bp, Homo sapiens
gcctcgcccctccagtgttgc

SEQ ID NO: 922132 - DNA, 19 bp, Homo sapiens
gcctcgctcaccgctggcc

SEQ ID NO: 922133 - DNA, 18 bp, Homo sapiens
ctagatggctcctctcag

SEQ ID NO: 922134 - DNA, 20 bp, Homo sapiens
ctagatgtagtattttttgt

SEQ ID NO: 922135 - DNA, 23 bp, Homo sapiens
ctagatgtagtattttttgtata

SEQ ID NO: 922136 - DNA, 17 bp, Homo sapiens
ctagatgtttaacaaat

SEQ ID NO: 922137 - DNA, 11 bp, Homo sapiens
ctagattacag

SEQ ID NO: 922138 - DNA, 16 bp, Homo sapiens
ctagattcactgtctt

SEQ ID NO: 922139 - DNA, 24 bp, Homo sapiens
ctagattgagagaagagacaaaca

SEQ ID NO: 922140 - DNA, 14 bp, Homo sapiens
ctagatttgtcctt

SEQ ID NO: 922141 - DNA, 15 bp, Homo sapiens
ctagatttgtccttt

SEQ ID NO: 922142 - DNA, 16 bp, Homo sapiens
ctagattttaatttat

SEQ ID NO: 922143 - DNA, 19 bp, Homo sapiens
ctagattttaatttatttg

SEQ ID NO: 922144 - DNA, 23 bp, Homo sapiens
ctagattttaatttatttgtttc

SEQ ID NO: 922145 - DNA, 16 bp, Homo sapiens
ctagcaaaactcacag

SEQ ID NO: 922146 - DNA, 17 bp, Homo sapiens
ctagcaaaagtgcaaga

SEQ ID NO: 922147 - DNA, 15 bp, Homo sapiens
ctagcaaaataaaac

SEQ ID NO: 922148 - DNA, 17 bp, Homo sapiens
ctagcaaaataaaacat

SEQ ID NO: 922149 - DNA, 15 bp, Homo sapiens
ctagcaaattagaaa

SEQ ID NO: 922150 - DNA, 21 bp, Homo sapiens
ctagcaagctgccgaaccaaa

SEQ ID NO: 922151 - DNA, 22 bp, Homo sapiens
ctagcaatcacaacactggctg

SEQ ID NO: 922152 - DNA, 19 bp, Homo sapiens
ctagcaatctcttcattat

SEQ ID NO: 922153 - DNA, 14 bp, Homo sapiens
ctagcaattttctt

SEQ ID NO: 922154 - DNA, 20 bp, Homo sapiens
ctagcaattttctttgtttc

SEQ ID NO: 922155 - DNA, 12 bp, Homo sapiens
ctagcacacctg

SEQ ID NO: 922156 - DNA, 22 bp, Homo sapiens
ctagcacacctgaatcagctgg

SEQ ID NO: 922157 - DNA, 16 bp, Homo sapiens
ctagcacttggagcca

SEQ ID NO: 922158 - DNA, 12 bp, Homo sapiens
ctagcagcaccg

SEQ ID NO: 922159 - DNA, 21 bp, Homo sapiens
ctagcagcaccgttctgtgca

SEQ ID NO: 922160 - DNA, 22 bp, Homo sapiens
ctagcagcagggagggcttctg

SEQ ID NO: 922161 - DNA, 19 bp, Homo sapiens
ctagcaggcaggaagtcct

SEQ ID NO: 922162 - DNA, 13 bp, Homo sapiens
ctagcaggccccc

SEQ ID NO: 922163 - DNA, 19 bp, Homo sapiens
ctagcaggccccctaggat

SEQ ID NO: 922164 - DNA, 14 bp, Homo sapiens
ctagcaggcctaag

SEQ ID NO: 922165 - DNA, 15 bp, Homo sapiens
ctagcaggctgttcc

SEQ ID NO: 922166 - DNA, 16 bp, Homo sapiens
ctagcaggctgttcca

SEQ ID NO: 922167 - DNA, 17 bp, Homo sapiens
ctagcaggctgttccat

SEQ ID NO: 922168 - DNA, 17 bp, Homo sapiens
ctagcagggaacactaa

SEQ ID NO: 922169 - DNA, 23 bp, Homo sapiens
ctagcatacgtacacattttatt

SEQ ID NO: 922170 - DNA, 13 bp, Homo sapiens
ctagcatccctga

SEQ ID NO: 922171 - DNA, 23 bp, Homo sapiens
ctagcattgtaaaattatttcat

SEQ ID NO: 922172 - DNA, 15 bp, Homo sapiens
ctagcatttatttct

SEQ ID NO: 922173 - DNA, 14 bp, Homo sapiens
ctagccaaggctag

SEQ ID NO: 922174 - DNA, 16 bp, Homo sapiens
ctagccactccctccc

SEQ ID NO: 922175 - DNA, 19 bp, Homo sapiens
ctagccagacactctgctc

SEQ ID NO: 922176 - DNA, 13 bp, Homo sapiens
ctagccagagaat

SEQ ID NO: 922177 - DNA, 16 bp, Homo sapiens
ctagccagcattccat

SEQ ID NO: 922178 - DNA, 12 bp, Homo sapiens
ctagccagccaa

SEQ ID NO: 922179 - DNA, 17 bp, Homo sapiens
ctagccaggagtctgtg

SEQ ID NO: 922180 - DNA, 19 bp, Homo sapiens
ctagccagtgctccaggca

SEQ ID NO: 922181 - DNA, 21 bp, Homo sapiens
ctagccattcctggtacccag

SEQ ID NO: 922182 - DNA, 15 bp, Homo sapiens
ctagcccagactctg

SEQ ID NO: 922183 - DNA, 16 bp, Homo sapiens
ctagcccagactctga

SEQ ID NO: 922184 - DNA, 19 bp, Homo sapiens
ctagcccagactctgagct

SEQ ID NO: 922185 - DNA, 14 bp, Homo sapiens
ctagcccatggact

SEQ ID NO: 922186 - DNA, 20 bp, Homo sapiens
ctagccccaggtcttttctt

SEQ ID NO: 922187 - DNA, 21 bp, Homo sapiens
ctagccccaggtcttttcttt

SEQ ID NO: 922188 - DNA, 18 bp, Homo sapiens
ctagcccctctctcacac

SEQ ID NO: 922189 - DNA, 18 bp, Homo sapiens
ctagccctcctttttcca

SEQ ID NO: 922190 - DNA, 13 bp, Homo sapiens
ctagccctctcac

SEQ ID NO: 922191 - DNA, 14 bp, Homo sapiens
ctagcccttccagc

SEQ ID NO: 922192 - DNA, 18 bp, Homo sapiens
ctagcccttccagcctgg

SEQ ID NO: 922193 - DNA, 19 bp, Homo sapiens
ctagcccttccagcctggg

SEQ ID NO: 922194 - DNA, 21 bp, Homo sapiens
ctagcccttccagcctgggac

SEQ ID NO: 922195 - DNA, 22 bp, Homo sapiens
ctagcccttccagcctgggaca

SEQ ID NO: 922196 - DNA, 18 bp, Homo sapiens
ctagccgacctcagcctt

SEQ ID NO: 922197 - DNA, 20 bp, Homo sapiens
ctagccgacctcagccttcc

SEQ ID NO: 922198 - DNA, 22 bp, Homo sapiens
ctagcctaaagtatacaactgc

SEQ ID NO: 922199 - DNA, 20 bp, Homo sapiens
ctagcctgatgagattttta

SEQ ID NO: 922200 - DNA, 22 bp, Homo sapiens
ctagcctggatggcccctcctt

SEQ ID NO: 922201 - DNA, 22 bp, Homo sapiens
ctagccttagacaaatgatcac

SEQ ID NO: 922202 - DNA, 18 bp, Homo sapiens
ctagccttatcctctgat

SEQ ID NO: 922203 - DNA, 19 bp, Homo sapiens
ctagccttgaggagtgtga

SEQ ID NO: 922204 - DNA, 20 bp, Homo sapiens
ctagcgaacgtatttctcca

SEQ ID NO: 922205 - DNA, 16 bp, Homo sapiens
ctagcgatctctcctg

SEQ ID NO: 922206 - DNA, 18 bp, Homo sapiens
ctagcgatctctcctggc

SEQ ID NO: 922207 - DNA, 20 bp, Homo sapiens
ctagcgatctctcctggcct

SEQ ID NO: 922208 - DNA, 14 bp, Homo sapiens
ctagcgcctggcct

SEQ ID NO: 922209 - DNA, 16 bp, Homo sapiens
ctagcgctctcttcca

SEQ ID NO: 922210 - DNA, 19 bp, Homo sapiens
ctagctacaaaaaatattt

SEQ ID NO: 922211 - DNA, 15 bp, Homo sapiens
ctagctagaaatatg

SEQ ID NO: 922212 - DNA, 14 bp, Homo sapiens
ctagctagccagcc

SEQ ID NO: 922213 - DNA, 19 bp, Homo sapiens
ctagctatgctgtatctgt

SEQ ID NO: 922214 - DNA, 12 bp, Homo sapiens
ctagctccccaa

SEQ ID NO: 922215 - DNA, 15 bp, Homo sapiens
ctagctctctaggcc

SEQ ID NO: 922216 - DNA, 23 bp, Homo sapiens
ctagctctggaggtgctgctcta

SEQ ID NO: 922217 - DNA, 19 bp, Homo sapiens
ctagctctttgggcctctc

SEQ ID NO: 922218 - DNA, 13 bp, Homo sapiens
ctagctgaccccg

SEQ ID NO: 922219 - DNA, 14 bp, Homo sapiens
ctagctggcaggac

SEQ ID NO: 922220 - DNA, 20 bp, Homo sapiens
ctagctgggggtgggccagg

SEQ ID NO: 922221 - DNA, 16 bp, Homo sapiens
ctagctgtatgatttg

SEQ ID NO: 922222 - DNA, 17 bp, Homo sapiens
ctagctgtatgatttgt

SEQ ID NO: 922223 - DNA, 14 bp, Homo sapiens
ctagctgtgccccc

SEQ ID NO: 922224 - DNA, 14 bp, Homo sapiens
ctagctgtgggggt

SEQ ID NO: 922225 - DNA, 16 bp, Homo sapiens
ctagctgttctggact

SEQ ID NO: 922226 - DNA, 19 bp, Homo sapiens
ctagctgttctggactaca

SEQ ID NO: 922227 - DNA, 18 bp, Homo sapiens
ctagctgttgtaaagaat

SEQ ID NO: 922228 - DNA, 20 bp, Homo sapiens
ctagcttaagtgtaaatgaa

SEQ ID NO: 922229 - DNA, 21 bp, Homo sapiens
ctagcttaagtgtaaatgaag

SEQ ID NO: 922230 - DNA, 13 bp, Homo sapiens
ctagcttctgctt

SEQ ID NO: 922231 - DNA, 14 bp, Homo sapiens
ctagcttctgcttt

SEQ ID NO: 922232 - DNA, 21 bp, Homo sapiens
ctagcttctgcttttctgccc

SEQ ID NO: 922233 - DNA, 14 bp, Homo sapiens
ctagcttgaggcaa

SEQ ID NO: 922234 - DNA, 22 bp, Homo sapiens
ctagcttgaggcaattttaatc

SEQ ID NO: 922235 - DNA, 20 bp, Homo sapiens
ctagcttgggaggcttcccc

SEQ ID NO: 922236 - DNA, 13 bp, Homo sapiens
ctagcttttaaaa

SEQ ID NO: 922237 - DNA, 19 bp, Homo sapiens
ctagcttttaaaaaatatt

SEQ ID NO: 922238 - DNA, 15 bp, Homo sapiens
ctagcttttaggaaa

SEQ ID NO: 922239 - DNA, 14 bp, Homo sapiens
ctaggaaattcttg

SEQ ID NO: 922240 - DNA, 22 bp, Homo sapiens
ctaggaacattttttaaggact

SEQ ID NO: 922241 - DNA, 15 bp, Homo sapiens
ctaggaagaggagtg

SEQ ID NO: 922242 - DNA, 19 bp, Homo sapiens
ctaggacacagttcctggg

SEQ ID NO: 922243 - DNA, 19 bp, Homo sapiens
ctaggactcagaaacgaga

SEQ ID NO: 922244 - DNA, 16 bp, Homo sapiens
ctaggactctgaggct

SEQ ID NO: 922245 - DNA, 14 bp, Homo sapiens
ctaggactgaggag

SEQ ID NO: 922246 - DNA, 16 bp, Homo sapiens
ctaggagaccaaggcg

SEQ ID NO: 922247 - DNA, 20 bp, Homo sapiens
ctaggagaccaaggcgggag

SEQ ID NO: 922248 - DNA, 20 bp, Homo sapiens
ctaggagagactgaaagcag

SEQ ID NO: 922249 - DNA, 21 bp, Homo sapiens
ctaggagagactgaaagcagc

SEQ ID NO: 922250 - DNA, 22 bp, Homo sapiens
ctaggagagccaacctcggctt

SEQ ID NO: 922251 - DNA, 19 bp, Homo sapiens
ctaggagaggagaaccaga

SEQ ID NO: 922252 - DNA, 15 bp, Homo sapiens
ctaggagaggggggc

SEQ ID NO: 922253 - DNA, 18 bp, Homo sapiens
ctaggagatatctgaggg

SEQ ID NO: 922254 - DNA, 21 bp, Homo sapiens
ctaggagatatctgagggagg

SEQ ID NO: 922255 - DNA, 16 bp, Homo sapiens
ctaggagctgggagga

SEQ ID NO: 922256 - DNA, 13 bp, Homo sapiens
ctaggaggctggc

SEQ ID NO: 922257 - DNA, 20 bp, Homo sapiens
cgcaagatagatttggaata

SEQ ID NO: 922258 - DNA, 12 bp, Homo sapiens
cgcaaggaagga

SEQ ID NO: 922259 - DNA, 12 bp, Homo sapiens
cgcaaggcactt

SEQ ID NO: 922260 - DNA, 14 bp, Homo sapiens
cgcaagtctgcagc

SEQ ID NO: 922261 - DNA, 15 bp, Homo sapiens
cgcaagtctgcagcc

SEQ ID NO: 922262 - DNA, 20 bp, Homo sapiens
cgcaatgtggagcagcagcc

SEQ ID NO: 922263 - DNA, 18 bp, Homo sapiens
cgcacaatgcatgtgctg

SEQ ID NO: 922264 - DNA, 21 bp, Homo sapiens
cgcacaatgcatgtgctgtct

SEQ ID NO: 922265 - DNA, 15 bp, Homo sapiens
cgcacacagggctca

SEQ ID NO: 922266 - DNA, 22 bp, Homo sapiens
cgcacacagggctcacagggca

SEQ ID NO: 922267 - DNA, 18 bp, Homo sapiens
cgcacaccctgcccctgg

SEQ ID NO: 922268 - DNA, 16 bp, Homo sapiens
cgcacacgcacacatc

SEQ ID NO: 922269 - DNA, 12 bp, Homo sapiens
cgcacagccacc

SEQ ID NO: 922270 - DNA, 16 bp, Homo sapiens
cgcacagccacccgtg

SEQ ID NO: 922271 - DNA, 13 bp, Homo sapiens
cgcacaggtggga

SEQ ID NO: 922272 - DNA, 17 bp, Homo sapiens
cgcacagtggacggagg

SEQ ID NO: 922273 - DNA, 12 bp, Homo sapiens
cgcaccaagcag

SEQ ID NO: 922274 - DNA, 13 bp, Homo sapiens
cgcaccaagcaga

SEQ ID NO: 922275 - DNA, 18 bp, Homo sapiens
cgcaccagctgctctgcc

SEQ ID NO: 922276 - DNA, 19 bp, Homo sapiens
cgcaccagctgctctgccc

SEQ ID NO: 922277 - DNA, 21 bp, Homo sapiens
cgcaccattctcctgcctcag

SEQ ID NO: 922278 - DNA, 20 bp, Homo sapiens
cgcacccagagaaaattaat

SEQ ID NO: 922279 - DNA, 13 bp, Homo sapiens
cgcaccccatccc

SEQ ID NO: 922280 - DNA, 17 bp, Homo sapiens
cgcaccccccaagctgt

SEQ ID NO: 922281 - DNA, 16 bp, Homo sapiens
cgcacccccgccaggc

SEQ ID NO: 922282 - DNA, 17 bp, Homo sapiens
cgcacccccgccaggcg

SEQ ID NO: 922283 - DNA, 19 bp, Homo sapiens
cgcacccccgccaggcgca

SEQ ID NO: 922284 - DNA, 18 bp, Homo sapiens
cgcaccctgcacctgctg

SEQ ID NO: 922285 - DNA, 17 bp, Homo sapiens
cgcacctgccccctggt

SEQ ID NO: 922286 - DNA, 14 bp, Homo sapiens
cgcacctgcctcag

SEQ ID NO: 922287 - DNA, 16 bp, Homo sapiens
cgcacctgcctcagga

SEQ ID NO: 922288 - DNA, 13 bp, Homo sapiens
cgcaccttcctcc

SEQ ID NO: 922289 - DNA, 13 bp, Homo sapiens
cgcaccttgctgt

SEQ ID NO: 922290 - DNA, 11 bp, Homo sapiens
cgcacgcacac

SEQ ID NO: 922291 - DNA, 16 bp, Homo sapiens
cgcacggcagccacag

SEQ ID NO: 922292 - DNA, 17 bp, Homo sapiens
cgcacgggctgtctggg

SEQ ID NO: 922293 - DNA, 19 bp, Homo sapiens
cgcacgggctgtctgggtg

SEQ ID NO: 922294 - DNA, 18 bp, Homo sapiens
cgcactcacccatgtgcc

SEQ ID NO: 922295 - DNA, 16 bp, Homo sapiens
cgcactccatgagcac

SEQ ID NO: 922296 - DNA, 13 bp, Homo sapiens
cgcactgcagacg

SEQ ID NO: 922297 - DNA, 17 bp, Homo sapiens
cgcactgtgacccccag

SEQ ID NO: 922298 - DNA, 22 bp, Homo sapiens
cgcactgtgacccccagctccg

SEQ ID NO: 922299 - DNA, 13 bp, Homo sapiens
cgcacttacaagt

SEQ ID NO: 922300 - DNA, 14 bp, Homo sapiens
cgcacttacaagtg

SEQ ID NO: 922301 - DNA, 22 bp, Homo sapiens
cgcacttaccgccctgcgggcc

SEQ ID NO: 922302 - DNA, 15 bp, Homo sapiens
cgcactttccacttc

SEQ ID NO: 922303 - DNA, 19 bp, Homo sapiens
cgcactttccacttcttcc

SEQ ID NO: 922304 - DNA, 17 bp, Homo sapiens
cgcagacaccttggaca

SEQ ID NO: 922305 - DNA, 18 bp, Homo sapiens
cgcagacggtctgtgtgc

SEQ ID NO: 922306 - DNA, 23 bp, Homo sapiens
cgcagacggtctgtgtgctgttt

SEQ ID NO: 922307 - DNA, 23 bp, Homo sapiens
cgcagaggtcccagccccaggcc

SEQ ID NO: 922308 - DNA, 14 bp, Homo sapiens
cgcagatctgtgcc

SEQ ID NO: 922309 - DNA, 15 bp, Homo sapiens
cgcagatctgtgcct

SEQ ID NO: 922310 - DNA, 18 bp, Homo sapiens
cgcagatctgtgcctggg

SEQ ID NO: 922311 - DNA, 16 bp, Homo sapiens
cgcagatgaggggcca

SEQ ID NO: 922312 - DNA, 21 bp, Homo sapiens
cgcagcacagagtcgctggca

SEQ ID NO: 922313 - DNA, 17 bp, Homo sapiens
cgcagcacatttccgct

SEQ ID NO: 922314 - DNA, 12 bp, Homo sapiens
cgcagccaaggc

SEQ ID NO: 922315 - DNA, 19 bp, Homo sapiens
cgcagcccccgcgccctcc

SEQ ID NO: 922316 - DNA, 12 bp, Homo sapiens
cgcagcccgtga

SEQ ID NO: 922317 - DNA, 19 bp, Homo sapiens
cgcagcccgtgaagcagtg

SEQ ID NO: 922318 - DNA, 20 bp, Homo sapiens
cgcagcccgtgaagcagtgc

SEQ ID NO: 922319 - DNA, 21 bp, Homo sapiens
cgcagcccgtgaagcagtgcc

SEQ ID NO: 922320 - DNA, 23 bp, Homo sapiens
cgcagcccgtgaagcagtgcctc

SEQ ID NO: 922321 - DNA, 10 bp, Homo sapiens
cgcagccctg

SEQ ID NO: 922322 - DNA, 21 bp, Homo sapiens
cgcagccgccgccgcccacgc

SEQ ID NO: 922323 - DNA, 21 bp, Homo sapiens
cgcagccgccgggcaggcctg

SEQ ID NO: 922324 - DNA, 17 bp, Homo sapiens
cgcagccggagggaggc

SEQ ID NO: 922325 - DNA, 18 bp, Homo sapiens
cgcagccggagggaggca

SEQ ID NO: 922326 - DNA, 12 bp, Homo sapiens
cgcagcctccag

SEQ ID NO: 922327 - DNA, 13 bp, Homo sapiens
cgcagcctccagt

SEQ ID NO: 922328 - DNA, 14 bp, Homo sapiens
cgcagcctccagtt

SEQ ID NO: 922329 - DNA, 16 bp, Homo sapiens
cgcagcctccctctga

SEQ ID NO: 922330 - DNA, 14 bp, Homo sapiens
cgcagcctgaagcc

SEQ ID NO: 922331 - DNA, 17 bp, Homo sapiens
cgcagcgcccccatctg

SEQ ID NO: 922332 - DNA, 20 bp, Homo sapiens
cgcagcggtgggaaggaaag

SEQ ID NO: 922333 - DNA, 20 bp, Homo sapiens
cgcagctcttgcccttccct

SEQ ID NO: 922334 - DNA, 23 bp, Homo sapiens
cgcagctcttgcccttccctgtc

SEQ ID NO: 922335 - DNA, 17 bp, Homo sapiens
cgcagctggactctgca

SEQ ID NO: 922336 - DNA, 22 bp, Homo sapiens
cgcaggaccagtttgattgagg

SEQ ID NO: 922337 - DNA, 18 bp, Homo sapiens
cgcaggagggaggcgggg

SEQ ID NO: 922338 - DNA, 22 bp, Homo sapiens
cgcaggagggaggcggggagga

SEQ ID NO: 922339 - DNA, 15 bp, Homo sapiens
cgcaggatccgctgc

SEQ ID NO: 922340 - DNA, 20 bp, Homo sapiens
cgcaggatccgctgccacca

SEQ ID NO: 922341 - DNA, 21 bp, Homo sapiens
cgcaggcagcgcagggctggc

SEQ ID NO: 922342 - DNA, 11 bp, Homo sapiens
cgcaggcccag

SEQ ID NO: 922343 - DNA, 13 bp, Homo sapiens
cgcaggccctgtc

SEQ ID NO: 922344 - DNA, 20 bp, Homo sapiens
cgcaggcggccagggcggcc

SEQ ID NO: 922345 - DNA, 21 bp, Homo sapiens
cgcaggctatttgttcagaga

SEQ ID NO: 922346 - DNA, 17 bp, Homo sapiens
cgcaggctgagtccaga

SEQ ID NO: 922347 - DNA, 13 bp, Homo sapiens
cgcaggctgcaga

SEQ ID NO: 922348 - DNA, 16 bp, Homo sapiens
cgcaggctgcagagcc

SEQ ID NO: 922349 - DNA, 18 bp, Homo sapiens
cgcaggctgcagagcccg

SEQ ID NO: 922350 - DNA, 19 bp, Homo sapiens
cgcaggctgcagagcccgg

SEQ ID NO: 922351 - DNA, 14 bp, Homo sapiens
cgcagggccatgca

SEQ ID NO: 922352 - DNA, 18 bp, Homo sapiens
cgcaggtgggctggactt

SEQ ID NO: 922353 - DNA, 23 bp, Homo sapiens
cgcaggtgggtgctgccctgtgt

SEQ ID NO: 922354 - DNA, 16 bp, Homo sapiens
cgcagtcgcaggatcc

SEQ ID NO: 922355 - DNA, 22 bp, Homo sapiens
cgcagtggcttttgccccagaa

SEQ ID NO: 922356 - DNA, 16 bp, Homo sapiens
cgcagtgtctccacct

SEQ ID NO: 922357 - DNA, 22 bp, Homo sapiens
cgcagtgtgcactaaggggccc

SEQ ID NO: 922358 - DNA, 16 bp, Homo sapiens
cgcagtgttttgcaag

SEQ ID NO: 922359 - DNA, 20 bp, Homo sapiens
cgcagttttttttttcttgt

SEQ ID NO: 922360 - DNA, 23 bp, Homo sapiens
cgcatacacacatgccctcctgg

SEQ ID NO: 922361 - DNA, 18 bp, Homo sapiens
cgcatatgcatgccaggc

SEQ ID NO: 922362 - DNA, 18 bp, Homo sapiens
cgcatattaagcacttta

SEQ ID NO: 922363 - DNA, 14 bp, Homo sapiens
cgcatccagacagt

SEQ ID NO: 922364 - DNA, 19 bp, Homo sapiens
cgcatcccatctctcccac

SEQ ID NO: 922365 - DNA, 15 bp, Homo sapiens
cgcatcttctccatc

SEQ ID NO: 922366 - DNA, 19 bp, Homo sapiens
cgcatgagtatctgtggga

SEQ ID NO: 922367 - DNA, 15 bp, Homo sapiens
cgcatgccctcaatc

SEQ ID NO: 922368 - DNA, 17 bp, Homo sapiens
cgcatgggcattgcagc

SEQ ID NO: 922369 - DNA, 20 bp, Homo sapiens
cgcatgggcattgcagcctt

SEQ ID NO: 922370 - DNA, 14 bp, Homo sapiens
cgcatgtctgcacc

SEQ ID NO: 922371 - DNA, 16 bp, Homo sapiens
cgcattaagcacacac

SEQ ID NO: 922372 - DNA, 21 bp, Homo sapiens
cgcattcagtgcacctgcctc

SEQ ID NO: 922373 - DNA, 22 bp, Homo sapiens
cgcattcagtgcacctgcctca

SEQ ID NO: 922374 - DNA, 17 bp, Homo sapiens
cgcatttctcatgcttc

SEQ ID NO: 922375 - DNA, 16 bp, Homo sapiens
cgccaaagtgcagccc

SEQ ID NO: 922376 - DNA, 14 bp, Homo sapiens
cgccaacttctccc

SEQ ID NO: 922377 - DNA, 15 bp, Homo sapiens
cgccaacttctccca

SEQ ID NO: 922378 - DNA, 19 bp, Homo sapiens
cgccaacttctcccacccc

SEQ ID NO: 922379 - DNA, 12 bp, Homo sapiens
cgccaaggctgg

SEQ ID NO: 922380 - DNA, 17 bp, Homo sapiens
cgccacatggtgtggcc

SEQ ID NO: 922381 - DNA, 14 bp, Homo sapiens
cgccacccccatct

SEQ ID NO: 922382 - DNA, 13 bp, Homo sapiens
gccaggcttgcct

SEQ ID NO: 922383 - DNA, 17 bp, Homo sapiens
gccaggcttgcctgggc

SEQ ID NO: 922384 - DNA, 18 bp, Homo sapiens
gccaggcttgcctgggct

SEQ ID NO: 922385 - DNA, 12 bp, Homo sapiens
gccagggaccca

SEQ ID NO: 922386 - DNA, 19 bp, Homo sapiens
gccagggacccaaagcagg

SEQ ID NO: 922387 - DNA, 22 bp, Homo sapiens
gccagggagcttgccacactct

SEQ ID NO: 922388 - DNA, 13 bp, Homo sapiens
gccagggaggcgc

SEQ ID NO: 922389 - DNA, 16 bp, Homo sapiens
gccagggaggcgcagg

SEQ ID NO: 922390 - DNA, 21 bp, Homo sapiens
gccagggaggcgcagggacat

SEQ ID NO: 922391 - DNA, 22 bp, Homo sapiens
gccagggaggcgcagggacatg

SEQ ID NO: 922392 - DNA, 14 bp, Homo sapiens
gccagggcaatgcc

SEQ ID NO: 922393 - DNA, 15 bp, Homo sapiens
gccagggcaatgcca

SEQ ID NO: 922394 - DNA, 19 bp, Homo sapiens
gccagggcaatgccatcag

SEQ ID NO: 922395 - DNA, 11 bp, Homo sapiens
gccagggcaga

SEQ ID NO: 922396 - DNA, 14 bp, Homo sapiens
gccagggcagggcc

SEQ ID NO: 922397 - DNA, 15 bp, Homo sapiens
gccagggcagggtct

SEQ ID NO: 922398 - DNA, 16 bp, Homo sapiens
gccagggcagggtctg

SEQ ID NO: 922399 - DNA, 19 bp, Homo sapiens
gccagggcagggtctgggc

SEQ ID NO: 922400 - DNA, 20 bp, Homo sapiens
gccagggcagggtctgggct

SEQ ID NO: 922401 - DNA, 14 bp, Homo sapiens
gccagggcatgtgt

SEQ ID NO: 922402 - DNA, 15 bp, Homo sapiens
gccagggcccagagc

SEQ ID NO: 922403 - DNA, 16 bp, Homo sapiens
gccagggcccagagcc

SEQ ID NO: 922404 - DNA, 15 bp, Homo sapiens
gccagggcccaggcc

SEQ ID NO: 922405 - DNA, 19 bp, Homo sapiens
gccagggcccctggatctc

SEQ ID NO: 922406 - DNA, 13 bp, Homo sapiens
gccagggcccgca

SEQ ID NO: 922407 - DNA, 16 bp, Homo sapiens
gccagggccctgcaga

SEQ ID NO: 922408 - DNA, 13 bp, Homo sapiens
gccagggcctctc

SEQ ID NO: 922409 - DNA, 22 bp, Homo sapiens
gccagggcctctccaaccactg

SEQ ID NO: 922410 - DNA, 20 bp, Homo sapiens
gccagggcggccagggaccc

SEQ ID NO: 922411 - DNA, 16 bp, Homo sapiens
gccagggctgccccta

SEQ ID NO: 922412 - DNA, 17 bp, Homo sapiens
gccagggctgccctgag

SEQ ID NO: 922413 - DNA, 16 bp, Homo sapiens
gccagggctggatgga

SEQ ID NO: 922414 - DNA, 19 bp, Homo sapiens
gccagggctggatggacag

SEQ ID NO: 922415 - DNA, 22 bp, Homo sapiens
gccagggctggatggacagaca

SEQ ID NO: 922416 - DNA, 15 bp, Homo sapiens
gccagggctggggac

SEQ ID NO: 922417 - DNA, 13 bp, Homo sapiens
gccagggctgtcc

SEQ ID NO: 922418 - DNA, 14 bp, Homo sapiens
gccagggctgtcct

SEQ ID NO: 922419 - DNA, 23 bp, Homo sapiens
gccagggcttcctcttccgggca

SEQ ID NO: 922420 - DNA, 23 bp, Homo sapiens
gccaggggaaaatcagcctgctc

SEQ ID NO: 922421 - DNA, 23 bp, Homo sapiens
gccaggggattgtctcagggccg

SEQ ID NO: 922422 - DNA, 19 bp, Homo sapiens
gccaggggcaggcagggct

SEQ ID NO: 922423 - DNA, 20 bp, Homo sapiens
gccaggggcttcccactttg

SEQ ID NO: 922424 - DNA, 18 bp, Homo sapiens
gccaggggtaacctggcc

SEQ ID NO: 922425 - DNA, 13 bp, Homo sapiens
gccaggggtggga

SEQ ID NO: 922426 - DNA, 22 bp, Homo sapiens
gccagggtagagcaaaggagac

SEQ ID NO: 922427 - DNA, 18 bp, Homo sapiens
gccagggtctctccctca

SEQ ID NO: 922428 - DNA, 23 bp, Homo sapiens
gccagggtctctccctcaggtgt

SEQ ID NO: 922429 - DNA, 19 bp, Homo sapiens
gccagggtctgtgtgaatg

SEQ ID NO: 922430 - DNA, 16 bp, Homo sapiens
gccagggtgagagctg

SEQ ID NO: 922431 - DNA, 15 bp, Homo sapiens
gccagggtgggaaga

SEQ ID NO: 922432 - DNA, 19 bp, Homo sapiens
gccagggtgggaagagaag

SEQ ID NO: 922433 - DNA, 20 bp, Homo sapiens
gccagggtgggaagagaaga

SEQ ID NO: 922434 - DNA, 17 bp, Homo sapiens
gccagggtgggctgggg

SEQ ID NO: 922435 - DNA, 15 bp, Homo sapiens
gccaggtaatgtgaa

SEQ ID NO: 922436 - DNA, 19 bp, Homo sapiens
gccaggtacaggagaggca

SEQ ID NO: 922437 - DNA, 20 bp, Homo sapiens
gccaggtacaggagaggcag

SEQ ID NO: 922438 - DNA, 21 bp, Homo sapiens
gccaggtacaggagaggcagc

SEQ ID NO: 922439 - DNA, 22 bp, Homo sapiens
gccaggtcaccctttgctgtga

SEQ ID NO: 922440 - DNA, 16 bp, Homo sapiens
gccaggtgagaaactg

SEQ ID NO: 922441 - DNA, 15 bp, Homo sapiens
gccaggtgaggtcca

SEQ ID NO: 922442 - DNA, 16 bp, Homo sapiens
gccaggtgaggtccac

SEQ ID NO: 922443 - DNA, 17 bp, Homo sapiens
gccaggtgaggtccacc

SEQ ID NO: 922444 - DNA, 15 bp, Homo sapiens
gccaggtgcagacct

SEQ ID NO: 922445 - DNA, 13 bp, Homo sapiens
gccaggtgcagtg

SEQ ID NO: 922446 - DNA, 15 bp, Homo sapiens
gccaggtgcggcctg

SEQ ID NO: 922447 - DNA, 22 bp, Homo sapiens
gccaggtggctcagtgccacct

SEQ ID NO: 922448 - DNA, 18 bp, Homo sapiens
gccaggttgggggcagtg

SEQ ID NO: 922449 - DNA, 16 bp, Homo sapiens
gccaggttgtgtccca

SEQ ID NO: 922450 - DNA, 22 bp, Homo sapiens
gccagtaacgcgtcttcctgag

SEQ ID NO: 922451 - DNA, 15 bp, Homo sapiens
gccagtaatctttat

SEQ ID NO: 922452 - DNA, 16 bp, Homo sapiens
gccagtaggagaaatc

SEQ ID NO: 922453 - DNA, 14 bp, Homo sapiens
gccagtattttaaa

SEQ ID NO: 922454 - DNA, 17 bp, Homo sapiens
gccagtcaagaagaaaa

SEQ ID NO: 922455 - DNA, 18 bp, Homo sapiens
gccagtcaagaagaaaaa

SEQ ID NO: 922456 - DNA, 14 bp, Homo sapiens
gccagtcaccttct

SEQ ID NO: 922457 - DNA, 16 bp, Homo sapiens
gccagtcaccttctgg

SEQ ID NO: 922458 - DNA, 15 bp, Homo sapiens
gccagtcactgctgc

SEQ ID NO: 922459 - DNA, 13 bp, Homo sapiens
gccagtcccaggg

SEQ ID NO: 922460 - DNA, 21 bp, Homo sapiens
gccagtccccatttctgcctc

SEQ ID NO: 922461 - DNA, 23 bp, Homo sapiens
gccagtccccgaggagctgggcc

SEQ ID NO: 922462 - DNA, 15 bp, Homo sapiens
gccagtcctcctggg

SEQ ID NO: 922463 - DNA, 18 bp, Homo sapiens
gccagtcctcctgggagc

SEQ ID NO: 922464 - DNA, 14 bp, Homo sapiens
cgccccctgtgact

SEQ ID NO: 922465 - DNA, 18 bp, Homo sapiens
cgccccgctgtgtcctcc

SEQ ID NO: 922466 - DNA, 20 bp, Homo sapiens
cgccccgggctggccctgtg

SEQ ID NO: 922467 - DNA, 14 bp, Homo sapiens
cgcccctccagtgt

SEQ ID NO: 922468 - DNA, 14 bp, Homo sapiens
cgcccctcccaagc

SEQ ID NO: 922469 - DNA, 18 bp, Homo sapiens
cgcccctcccctcagcct

SEQ ID NO: 922470 - DNA, 15 bp, Homo sapiens
cgcccctgcctgtgc

SEQ ID NO: 922471 - DNA, 13 bp, Homo sapiens
cgcccctgtggcc

SEQ ID NO: 922472 - DNA, 15 bp, Homo sapiens
cgcccctgtggccaa

SEQ ID NO: 922473 - DNA, 16 bp, Homo sapiens
cgcccgcccacacggc

SEQ ID NO: 922474 - DNA, 18 bp, Homo sapiens
cgcccgcccactgtcctg

SEQ ID NO: 922475 - DNA, 19 bp, Homo sapiens
cgcccgcccactgtcctgg

SEQ ID NO: 922476 - DNA, 14 bp, Homo sapiens
cgcccgcggcgcga

SEQ ID NO: 922477 - DNA, 20 bp, Homo sapiens
cgcccggctaatgtttgtat

SEQ ID NO: 922478 - DNA, 17 bp, Homo sapiens
cgcccggggtggccaca

SEQ ID NO: 922479 - DNA, 15 bp, Homo sapiens
cgcccgtcctgcctg

SEQ ID NO: 922480 - DNA, 17 bp, Homo sapiens
cgcccgtcctgcctgtg

SEQ ID NO: 922481 - DNA, 18 bp, Homo sapiens
cgccctactccactgccc

SEQ ID NO: 922482 - DNA, 14 bp, Homo sapiens
cgccctcacctctg

SEQ ID NO: 922483 - DNA, 15 bp, Homo sapiens
cgccctcacctctga

SEQ ID NO: 922484 - DNA, 13 bp, Homo sapiens
cgccctccatccg

SEQ ID NO: 922485 - DNA, 13 bp, Homo sapiens
cgccctcccaggc

SEQ ID NO: 922486 - DNA, 15 bp, Homo sapiens
cgccctcctgcccac

SEQ ID NO: 922487 - DNA, 16 bp, Homo sapiens
cgccctcctttccctt

SEQ ID NO: 922488 - DNA, 22 bp, Homo sapiens
cgccctctctgctccttcactg

SEQ ID NO: 922489 - DNA, 13 bp, Homo sapiens
cgccctctgaaat

SEQ ID NO: 922490 - DNA, 14 bp, Homo sapiens
cgccctcttcctga

SEQ ID NO: 922491 - DNA, 11 bp, Homo sapiens
cgccctgccac

SEQ ID NO: 922492 - DNA, 12 bp, Homo sapiens
cgccctgccccg

SEQ ID NO: 922493 - DNA, 13 bp, Homo sapiens
cgccctgcctcct

SEQ ID NO: 922494 - DNA, 19 bp, Homo sapiens
cgccctgcgttggagccac

SEQ ID NO: 922495 - DNA, 15 bp, Homo sapiens
cgccctgctcctccc

SEQ ID NO: 922496 - DNA, 17 bp, Homo sapiens
cgccctgctcctccctg

SEQ ID NO: 922497 - DNA, 22 bp, Homo sapiens
cgccctggaagccggcggccca

SEQ ID NO: 922498 - DNA, 13 bp, Homo sapiens
cgccctgggctgg

SEQ ID NO: 922499 - DNA, 21 bp, Homo sapiens
cgccctgggctggactggagg

SEQ ID NO: 922500 - DNA, 18 bp, Homo sapiens
cgccctgggctgtctgtc

SEQ ID NO: 922501 - DNA, 11 bp, Homo sapiens
cgcccttggct

SEQ ID NO: 922502 - DNA, 20 bp, Homo sapiens
cgcccttggcttctgtgatg

SEQ ID NO: 922503 - DNA, 14 bp, Homo sapiens
cgccctttcctcct

SEQ ID NO: 922504 - DNA, 20 bp, Homo sapiens
cgccctttcctcctcaggca

SEQ ID NO: 922505 - DNA, 23 bp, Homo sapiens
cgccgcaaaccacactggactcc

SEQ ID NO: 922506 - DNA, 16 bp, Homo sapiens
cgccgcagaagcagcc

SEQ ID NO: 922507 - DNA, 14 bp, Homo sapiens
cgccgccaccctgc

SEQ ID NO: 922508 - DNA, 15 bp, Homo sapiens
cgccgccaggactgt

SEQ ID NO: 922509 - DNA, 22 bp, Homo sapiens
cgccgcccacgccggcctctgc

SEQ ID NO: 922510 - DNA, 16 bp, Homo sapiens
cgccgccctggacaga

SEQ ID NO: 922511 - DNA, 23 bp, Homo sapiens
cgaccctctgggaacctcccaga

SEQ ID NO: 922512 - DNA, 13 bp, Homo sapiens
cgaccgccccctc

SEQ ID NO: 922513 - DNA, 22 bp, Homo sapiens
cgacctacgttcctggccccct

SEQ ID NO: 922514 - DNA, 15 bp, Homo sapiens
cgacctcagccttcc

SEQ ID NO: 922515 - DNA, 14 bp, Homo sapiens
cgacctcgtcctcc

SEQ ID NO: 922516 - DNA, 19 bp, Homo sapiens
cgacctcgtcctccccctg

SEQ ID NO: 922517 - DNA, 14 bp, Homo sapiens
cgacctctctgcct

SEQ ID NO: 922518 - DNA, 16 bp, Homo sapiens
cgacctctctgcctct

SEQ ID NO: 922519 - DNA, 21 bp, Homo sapiens
cgacgctcccctgagaggttt

SEQ ID NO: 922520 - DNA, 13 bp, Homo sapiens
cgacggcctccag

SEQ ID NO: 922521 - DNA, 16 bp, Homo sapiens
cgacggcctccaggag

SEQ ID NO: 922522 - DNA, 14 bp, Homo sapiens
cgacggctcctccc

SEQ ID NO: 922523 - DNA, 14 bp, Homo sapiens
cgacggctgtgacg

SEQ ID NO: 922524 - DNA, 16 bp, Homo sapiens
cgacgttttctccgca

SEQ ID NO: 922525 - DNA, 14 bp, Homo sapiens
cgactaatttcaaa

SEQ ID NO: 922526 - DNA, 18 bp, Homo sapiens
cgactactgctcctgtgg

SEQ ID NO: 922527 - DNA, 13 bp, Homo sapiens
cgactagcaggca

SEQ ID NO: 922528 - DNA, 17 bp, Homo sapiens
cgactagcaggcatgcc

SEQ ID NO: 922529 - DNA, 13 bp, Homo sapiens
cgactcagcacca

SEQ ID NO: 922530 - DNA, 11 bp, Homo sapiens
cgactcaggat

SEQ ID NO: 922531 - DNA, 10 bp, Homo sapiens
cgactccagc

SEQ ID NO: 922532 - DNA, 11 bp, Homo sapiens
cgactccagcc

SEQ ID NO: 922533 - DNA, 12 bp, Homo sapiens
cgactccagcca

SEQ ID NO: 922534 - DNA, 13 bp, Homo sapiens
cgactccagccag

SEQ ID NO: 922535 - DNA, 21 bp, Homo sapiens
cgactcccccaaccaaggaag

SEQ ID NO: 922536 - DNA, 18 bp, Homo sapiens
cgactctatagactctag

SEQ ID NO: 922537 - DNA, 20 bp, Homo sapiens
cgactctgctgctcatggga

SEQ ID NO: 922538 - DNA, 13 bp, Homo sapiens
cgactcttcctgc

SEQ ID NO: 922539 - DNA, 15 bp, Homo sapiens
cgactgaccctgagg

SEQ ID NO: 922540 - DNA, 17 bp, Homo sapiens
cgactgaccctgaggag

SEQ ID NO: 922541 - DNA, 16 bp, Homo sapiens
cgactgcacagcggcc

SEQ ID NO: 922542 - DNA, 20 bp, Homo sapiens
cgactgcacagcggcccctg

SEQ ID NO: 922543 - DNA, 14 bp, Homo sapiens
cgactgcctgtctc

SEQ ID NO: 922544 - DNA, 12 bp, Homo sapiens
cgactggtccag

SEQ ID NO: 922545 - DNA, 17 bp, Homo sapiens
cgactggtccagctctg

SEQ ID NO: 922546 - DNA, 20 bp, Homo sapiens
cgactggtccagctctgaca

SEQ ID NO: 922547 - DNA, 17 bp, Homo sapiens
cgactgtgacctgtggg

SEQ ID NO: 922548 - DNA, 15 bp, Homo sapiens
cgacttcttggtttt

SEQ ID NO: 922549 - DNA, 18 bp, Homo sapiens
cgacttcttggttttctc

SEQ ID NO: 922550 - DNA, 15 bp, Homo sapiens
cgacttgaccctttc

SEQ ID NO: 922551 - DNA, 17 bp, Homo sapiens
cgacttgcatacctgct

SEQ ID NO: 922552 - DNA, 21 bp, Homo sapiens
cgacttgctgttttgttctgt

SEQ ID NO: 922553 - DNA, 17 bp, Homo sapiens
cgacttttgttctcttc

SEQ ID NO: 922554 - DNA, 20 bp, Homo sapiens
cgagaaataaagtttgctta

SEQ ID NO: 922555 - DNA, 24 bp, Homo sapiens
cgagaagggtggatgacagggcag

SEQ ID NO: 922556 - DNA, 13 bp, Homo sapiens
cgagaagtgctct

SEQ ID NO: 922557 - DNA, 14 bp, Homo sapiens
cgagacacttgcct

SEQ ID NO: 922558 - DNA, 14 bp, Homo sapiens
cgagaccagcctgg

SEQ ID NO: 922559 - DNA, 17 bp, Homo sapiens
cgagaccatcctggccc

SEQ ID NO: 922560 - DNA, 20 bp, Homo sapiens
cgagaccatcctggcccctc

SEQ ID NO: 922561 - DNA, 21 bp, Homo sapiens
cgagaccatcctggcccctcc

SEQ ID NO: 922562 - DNA, 17 bp, Homo sapiens
cgagaccatcctggcta

SEQ ID NO: 922563 - DNA, 16 bp, Homo sapiens
cgagaccgcagaggga

SEQ ID NO: 922564 - DNA, 15 bp, Homo sapiens
cgagactctgtctca

SEQ ID NO: 922565 - DNA, 22 bp, Homo sapiens
cgagagaggcgcgtctgcccca

SEQ ID NO: 922566 - DNA, 16 bp, Homo sapiens
cgagagatcaaagatg

SEQ ID NO: 922567 - DNA, 16 bp, Homo sapiens
cgagagcagtgggcag

SEQ ID NO: 922568 - DNA, 13 bp, Homo sapiens
cgagagcctgctc

SEQ ID NO: 922569 - DNA, 19 bp, Homo sapiens
cgagagcctgctcccccac

SEQ ID NO: 922570 - DNA, 14 bp, Homo sapiens
cgagaggcagagaa

SEQ ID NO: 922571 - DNA, 15 bp, Homo sapiens
cgagaggcagagaaa

SEQ ID NO: 922572 - DNA, 13 bp, Homo sapiens
cgagagggagaga

SEQ ID NO: 922573 - DNA, 23 bp, Homo sapiens
cgagaggtgggccagtctgtgga

SEQ ID NO: 922574 - DNA, 20 bp, Homo sapiens
cgagagtagccgagagcctg

SEQ ID NO: 922575 - DNA, 15 bp, Homo sapiens
cgagataatgtatat

SEQ ID NO: 922576 - DNA, 21 bp, Homo sapiens
cgagatagggggaagacagat

SEQ ID NO: 922577 - DNA, 21 bp, Homo sapiens
cgagatcacaccactgtactc

SEQ ID NO: 922578 - DNA, 20 bp, Homo sapiens
cgagatcacgccactgcact

SEQ ID NO: 922579 - DNA, 16 bp, Homo sapiens
cgagatcgggaagcag

SEQ ID NO: 922580 - DNA, 17 bp, Homo sapiens
cgagatcgggaagcaga

SEQ ID NO: 922581 - DNA, 16 bp, Homo sapiens
cgagatcggggtagaa

SEQ ID NO: 922582 - DNA, 21 bp, Homo sapiens
cgagatgttcgctcgtgcagt

SEQ ID NO: 922583 - DNA, 21 bp, Homo sapiens
cgagattatcgttttcttaaa

SEQ ID NO: 922584 - DNA, 14 bp, Homo sapiens
cgagattgcaccac

SEQ ID NO: 922585 - DNA, 16 bp, Homo sapiens
cgagattgctggaaac

SEQ ID NO: 922586 - DNA, 23 bp, Homo sapiens
cgagattgctggaaaccaagtca

SEQ ID NO: 922587 - DNA, 23 bp, Homo sapiens
cgagcaaagatcaaaataaaaag

SEQ ID NO: 922588 - DNA, 18 bp, Homo sapiens
cgagcacatagagctttt

SEQ ID NO: 922589 - DNA, 23 bp, Homo sapiens
cgagcacatagagctttttaata

SEQ ID NO: 922590 - DNA, 21 bp, Homo sapiens
cgagcactggccagagagggc

SEQ ID NO: 922591 - DNA, 15 bp, Homo sapiens
cgagcagtcctgcct

SEQ ID NO: 922592 - DNA, 17 bp, Homo sapiens
cgagcagtcctgcctca

SEQ ID NO: 922593 - DNA, 23 bp, Homo sapiens
cgagcagtcctgcctcagcctcc

SEQ ID NO: 922594 - DNA, 14 bp, Homo sapiens
cgagcatcccccaa

SEQ ID NO: 922595 - DNA, 18 bp, Homo sapiens
cgagcatgcggagccagc

SEQ ID NO: 922596 - DNA, 22 bp, Homo sapiens
cgagccacaagctgcactgtga

SEQ ID NO: 922597 - DNA, 12 bp, Homo sapiens
cgagcccagatg

SEQ ID NO: 922598 - DNA, 13 bp, Homo sapiens
cgagcccagctac

SEQ ID NO: 922599 - DNA, 14 bp, Homo sapiens
cgagccccctggat

SEQ ID NO: 922600 - DNA, 20 bp, Homo sapiens
cgagcccctcggctctggag

SEQ ID NO: 922601 - DNA, 22 bp, Homo sapiens
cgagcctcctcagggggtagga

SEQ ID NO: 922602 - DNA, 16 bp, Homo sapiens
cgagcgacggctcctc

SEQ ID NO: 922603 - DNA, 17 bp, Homo sapiens
cgagcgacggctcctcc

SEQ ID NO: 922604 - DNA, 20 bp, Homo sapiens
cgagcgacggctcctccccg

SEQ ID NO: 922605 - DNA, 23 bp, Homo sapiens
cgagcgacggctcctccccgatc

SEQ ID NO: 922606 - DNA, 18 bp, Homo sapiens
cgagcgctttctggaaaa

SEQ ID NO: 922607 - DNA, 22 bp, Homo sapiens
cgagctactctcttgccagcat

SEQ ID NO: 922608 - DNA, 12 bp, Homo sapiens
cgagctcctggg

SEQ ID NO: 922609 - DNA, 13 bp, Homo sapiens
cgagctcctgggg

SEQ ID NO: 922610 - DNA, 21 bp, Homo sapiens
cgagctcgtgtatcctggggc

SEQ ID NO: 922611 - DNA, 22 bp, Homo sapiens
cgagctcgtgtatcctggggct

SEQ ID NO: 922612 - DNA, 12 bp, Homo sapiens
cgagctgggggc

SEQ ID NO: 922613 - DNA, 15 bp, Homo sapiens
cgagctgggggccat

SEQ ID NO: 922614 - DNA, 20 bp, Homo sapiens
cgagctgggggccatgagct

SEQ ID NO: 922615 - DNA, 22 bp, Homo sapiens
cgagctggtgcattacagagag

SEQ ID NO: 922616 - DNA, 23 bp, Homo sapiens
cgagctggtgcattacagagagg

SEQ ID NO: 922617 - DNA, 12 bp, Homo sapiens
cgagctgtcccc

SEQ ID NO: 922618 - DNA, 14 bp, Homo sapiens
cgagcttggccttg

SEQ ID NO: 922619 - DNA, 23 bp, Homo sapiens
cgaggaaaggattttaccaaagc

SEQ ID NO: 922620 - DNA, 14 bp, Homo sapiens
cgaggaaccagagc

SEQ ID NO: 922621 - DNA, 15 bp, Homo sapiens
cgaggaaccagagcc

SEQ ID NO: 922622 - DNA, 14 bp, Homo sapiens
cgaggactggactg

SEQ ID NO: 922623 - DNA, 14 bp, Homo sapiens
cgaggagctgggcc

SEQ ID NO: 922624 - DNA, 15 bp, Homo sapiens
cgaggccactcagag

SEQ ID NO: 922625 - DNA, 23 bp, Homo sapiens
cgaggccactcagaggcccccag

SEQ ID NO: 922626 - DNA, 19 bp, Homo sapiens
cgaggccagtacctttcca

SEQ ID NO: 922627 - DNA, 17 bp, Homo sapiens
cgaggccggagagctgg

SEQ ID NO: 922628 - DNA, 20 bp, Homo sapiens
cgaggccggagagctggtga

SEQ ID NO: 922629 - DNA, 14 bp, Homo sapiens
cgaggcctacagag

SEQ ID NO: 922630 - DNA, 20 bp, Homo sapiens
cgaggcctacagaggaggcc

SEQ ID NO: 922631 - DNA, 15 bp, Homo sapiens
cgaggcgatgccacg

SEQ ID NO: 922632 - DNA, 17 bp, Homo sapiens
cgaggcgatgccacgct

SEQ ID NO: 922633 - DNA, 18 bp, Homo sapiens
cgaggcgatgccacgctt

SEQ ID NO: 922634 - DNA, 15 bp, Homo sapiens
cgaggctccccgcct

SEQ ID NO: 922635 - DNA, 18 bp, Homo sapiens
cgaggctccccgcctcca

SEQ ID NO: 922636 - DNA, 13 bp, Homo sapiens
gccagcctcctct

SEQ ID NO: 922637 - DNA, 14 bp, Homo sapiens
gccagcctcctctg

SEQ ID NO: 922638 - DNA, 13 bp, Homo sapiens
gccagcctgacct

SEQ ID NO: 922639 - DNA, 17 bp, Homo sapiens
gccagcctgaccttcct

SEQ ID NO: 922640 - DNA, 22 bp, Homo sapiens
gccagcctgaccttccttcctg

SEQ ID NO: 922641 - DNA, 12 bp, Homo sapiens
gccagcctgagc

SEQ ID NO: 922642 - DNA, 12 bp, Homo sapiens
gccagcctggct

SEQ ID NO: 922643 - DNA, 19 bp, Homo sapiens
gccagcctggctctgcccc

SEQ ID NO: 922644 - DNA, 22 bp, Homo sapiens
gccagcctggctctgccccctc

SEQ ID NO: 922645 - DNA, 17 bp, Homo sapiens
gccagcctggcttctgg

SEQ ID NO: 922646 - DNA, 18 bp, Homo sapiens
gccagcctggcttctgga

SEQ ID NO: 922647 - DNA, 22 bp, Homo sapiens
gccagcctggcttctggagccc

SEQ ID NO: 922648 - DNA, 20 bp, Homo sapiens
gccagcctgtcccatggaca

SEQ ID NO: 922649 - DNA, 15 bp, Homo sapiens
gccagcctgtccctg

SEQ ID NO: 922650 - DNA, 13 bp, Homo sapiens
gccagcgccaggg

SEQ ID NO: 922651 - DNA, 16 bp, Homo sapiens
gccagcgccagggccc

SEQ ID NO: 922652 - DNA, 18 bp, Homo sapiens
gccagcgccagggcccag

SEQ ID NO: 922653 - DNA, 19 bp, Homo sapiens
gccagcgccagggcccagg

SEQ ID NO: 922654 - DNA, 14 bp, Homo sapiens
gccagcgcctccct

SEQ ID NO: 922655 - DNA, 15 bp, Homo sapiens
gccagcgcctccctc

SEQ ID NO: 922656 - DNA, 18 bp, Homo sapiens
gccagcgcctccctccac

SEQ ID NO: 922657 - DNA, 20 bp, Homo sapiens
gccagcgcctccctccaccc

SEQ ID NO: 922658 - DNA, 13 bp, Homo sapiens
gccagcgctgtgg

SEQ ID NO: 922659 - DNA, 22 bp, Homo sapiens
gccagcgctgtggaccttacaa

SEQ ID NO: 922660 - DNA, 19 bp, Homo sapiens
gccagcgggaatggcagct

SEQ ID NO: 922661 - DNA, 15 bp, Homo sapiens
gccagcggggctgct

SEQ ID NO: 922662 - DNA, 16 bp, Homo sapiens
gccagcggggctgctc

SEQ ID NO: 922663 - DNA, 18 bp, Homo sapiens
gccagcggggctgctcac

SEQ ID NO: 922664 - DNA, 17 bp, Homo sapiens
gccagcggtgaccagcc

SEQ ID NO: 922665 - DNA, 22 bp, Homo sapiens
gccagcgtcctcctctgtgacc

SEQ ID NO: 922666 - DNA, 21 bp, Homo sapiens
gccagctaccccttgtgggca

SEQ ID NO: 922667 - DNA, 16 bp, Homo sapiens
gccagctactcaggag

SEQ ID NO: 922668 - DNA, 23 bp, Homo sapiens
gccagctacttcctcctccccac

SEQ ID NO: 922669 - DNA, 23 bp, Homo sapiens
gccagctccagtgccgctcctgc

SEQ ID NO: 922670 - DNA, 15 bp, Homo sapiens
gccagctctaccagt

SEQ ID NO: 922671 - DNA, 21 bp, Homo sapiens
gccagctctagttttcagcct

SEQ ID NO: 922672 - DNA, 13 bp, Homo sapiens
gccagctctcagc

SEQ ID NO: 922673 - DNA, 13 bp, Homo sapiens
gccagctctgagg

SEQ ID NO: 922674 - DNA, 14 bp, Homo sapiens
gccagctctgaggg

SEQ ID NO: 922675 - DNA, 23 bp, Homo sapiens
gccagctctgtatcaggacccag

SEQ ID NO: 922676 - DNA, 13 bp, Homo sapiens
gccagctgcaggg

SEQ ID NO: 922677 - DNA, 17 bp, Homo sapiens
gccagctgccccagcca

SEQ ID NO: 922678 - DNA, 18 bp, Homo sapiens
gccagctgccccagccag

SEQ ID NO: 922679 - DNA, 20 bp, Homo sapiens
gccagctgccgaccagagcc

SEQ ID NO: 922680 - DNA, 13 bp, Homo sapiens
gccagctgcctcc

SEQ ID NO: 922681 - DNA, 12 bp, Homo sapiens
gccagctgcctt

SEQ ID NO: 922682 - DNA, 14 bp, Homo sapiens
gccagctgccttcc

SEQ ID NO: 922683 - DNA, 15 bp, Homo sapiens
gccagctgccttcct

SEQ ID NO: 922684 - DNA, 15 bp, Homo sapiens
gccagctgcttgacc

SEQ ID NO: 922685 - DNA, 13 bp, Homo sapiens
gccagctggagaa

SEQ ID NO: 922686 - DNA, 12 bp, Homo sapiens
gccagctgggga

SEQ ID NO: 922687 - DNA, 14 bp, Homo sapiens
gccagctggggaga

SEQ ID NO: 922688 - DNA, 18 bp, Homo sapiens
gccagctggggagatggg

SEQ ID NO: 922689 - DNA, 12 bp, Homo sapiens
gccagctgtgca

SEQ ID NO: 922690 - DNA, 13 bp, Homo sapiens
gccagcttaaacc

SEQ ID NO: 922691 - DNA, 18 bp, Homo sapiens
gccagcttctctctccag

SEQ ID NO: 922692 - DNA, 20 bp, Homo sapiens
gccagcttctctctccaggg

SEQ ID NO: 922693 - DNA, 21 bp, Homo sapiens
gccagcttctctctccagggt

SEQ ID NO: 922694 - DNA, 22 bp, Homo sapiens
gccagcttggggccaccaaagc

SEQ ID NO: 922695 - DNA, 17 bp, Homo sapiens
gccaggaaaagccctca

SEQ ID NO: 922696 - DNA, 15 bp, Homo sapiens
gccaggaacctgtcc

SEQ ID NO: 922697 - DNA, 16 bp, Homo sapiens
gccaggaagccagagc

SEQ ID NO: 922698 - DNA, 17 bp, Homo sapiens
gccaggaagccagagcc

SEQ ID NO: 922699 - DNA, 19 bp, Homo sapiens
gccaggacagcagcactcc

SEQ ID NO: 922700 - DNA, 16 bp, Homo sapiens
gccaggacagtcagct

SEQ ID NO: 922701 - DNA, 12 bp, Homo sapiens
gccaggaccagc

SEQ ID NO: 922702 - DNA, 16 bp, Homo sapiens
gccaggaccagcctgt

SEQ ID NO: 922703 - DNA, 23 bp, Homo sapiens
gccaggaccccaggtcaggggct

SEQ ID NO: 922704 - DNA, 17 bp, Homo sapiens
gccaggacccgcctgct

SEQ ID NO: 922705 - DNA, 23 bp, Homo sapiens
gccaggaccctgacctccgcccc

SEQ ID NO: 922706 - DNA, 14 bp, Homo sapiens
gccaggactgtgtt

SEQ ID NO: 922707 - DNA, 9 bp, Homo sapiens
gccaggaga

SEQ ID NO: 922708 - DNA, 13 bp, Homo sapiens
gccaggagaagct

SEQ ID NO: 922709 - DNA, 14 bp, Homo sapiens
gccaggagaagctc

SEQ ID NO: 922710 - DNA, 15 bp, Homo sapiens
gccaggagaagctca

SEQ ID NO: 922711 - DNA, 17 bp, Homo sapiens
gccaggagaagctcagc

SEQ ID NO: 922712 - DNA, 22 bp, Homo sapiens
gccaggagaagctcagctgcat

SEQ ID NO: 922713 - DNA, 17 bp, Homo sapiens
gccaggagatggcccca

SEQ ID NO: 922714 - DNA, 19 bp, Homo sapiens
gccaggagatggccccaac

SEQ ID NO: 922715 - DNA, 22 bp, Homo sapiens
gccaggagcaaatgtttctgca

SEQ ID NO: 922716 - DNA, 21 bp, Homo sapiens
gccaggagcaggcacgggtgg

SEQ ID NO: 922717 - DNA, 23 bp, Homo sapiens
gccaggagctgtcaccaaggaaa

SEQ ID NO: 922718 - DNA, 19 bp, Homo sapiens
gccaggaggcggcagctct

SEQ ID NO: 922719 - DNA, 12 bp, Homo sapiens
gccaggagggac

SEQ ID NO: 922720 - DNA, 16 bp, Homo sapiens
gccaggatccccctct

SEQ ID NO: 922721 - DNA, 22 bp, Homo sapiens
gccaggatggaacacggccaca

SEQ ID NO: 922722 - DNA, 19 bp, Homo sapiens
gccaggcaccccctggaga

SEQ ID NO: 922723 - DNA, 21 bp, Homo sapiens
gccaggcaccccctggagaga

SEQ ID NO: 922724 - DNA, 17 bp, Homo sapiens
gccaggcacctggcctg

SEQ ID NO: 922725 - DNA, 19 bp, Homo sapiens
gccaggcacctggcctgct

SEQ ID NO: 922726 - DNA, 20 bp, Homo sapiens
gccaggcacctggcctgctg

SEQ ID NO: 922727 - DNA, 12 bp, Homo sapiens
gccaggcactct

SEQ ID NO: 922728 - DNA, 20 bp, Homo sapiens
gccaggcactgcccttttca

SEQ ID NO: 922729 - DNA, 23 bp, Homo sapiens
gccaggcactgcccttttcagga

SEQ ID NO: 922730 - DNA, 17 bp, Homo sapiens
gccaggcagaatggctg

SEQ ID NO: 922731 - DNA, 12 bp, Homo sapiens
gccaggcagagg

SEQ ID NO: 922732 - DNA, 15 bp, Homo sapiens
gccaggcagatctgt

SEQ ID NO: 922733 - DNA, 11 bp, Homo sapiens
gccaggcaggc

SEQ ID NO: 922734 - DNA, 17 bp, Homo sapiens
gccaggcaggggtgggg

SEQ ID NO: 922735 - DNA, 19 bp, Homo sapiens
gccaggcattggctcagcc

SEQ ID NO: 922736 - DNA, 19 bp, Homo sapiens
gccaggcccaggccagccc

SEQ ID NO: 922737 - DNA, 13 bp, Homo sapiens
gccaggccccagg

SEQ ID NO: 922738 - DNA, 14 bp, Homo sapiens
gccaggccccaggc

SEQ ID NO: 922739 - DNA, 13 bp, Homo sapiens
gccaggccgggcc

SEQ ID NO: 922740 - DNA, 11 bp, Homo sapiens
gccaggcctgg

SEQ ID NO: 922741 - DNA, 14 bp, Homo sapiens
gccaggcctgggtc

SEQ ID NO: 922742 - DNA, 22 bp, Homo sapiens
gccaggccttacatctggctgg

SEQ ID NO: 922743 - DNA, 15 bp, Homo sapiens
gccaggcgcatgtct

SEQ ID NO: 922744 - DNA, 22 bp, Homo sapiens
gccaggcgcatgtctgcacctc

SEQ ID NO: 922745 - DNA, 23 bp, Homo sapiens
gccaggcgcatgtctgcacctcc

SEQ ID NO: 922746 - DNA, 15 bp, Homo sapiens
gccaggcggccctgg

SEQ ID NO: 922747 - DNA, 23 bp, Homo sapiens
gccaggcgggagatggacccctc

SEQ ID NO: 922748 - DNA, 16 bp, Homo sapiens
gccaggcgggctcaag

SEQ ID NO: 922749 - DNA, 17 bp, Homo sapiens
gccaggctatggttgcc

SEQ ID NO: 922750 - DNA, 21 bp, Homo sapiens
gccaggctatggttgccaccc

SEQ ID NO: 922751 - DNA, 17 bp, Homo sapiens
gccaggctgaccacagc

SEQ ID NO: 922752 - DNA, 18 bp, Homo sapiens
gccaggctgaccacagca

SEQ ID NO: 922753 - DNA, 20 bp, Homo sapiens
gccaggctgaccacagcaca

SEQ ID NO: 922754 - DNA, 18 bp, Homo sapiens
gccaggctggagtgcagt

SEQ ID NO: 922755 - DNA, 19 bp, Homo sapiens
gccaggctggagtgcagtg

SEQ ID NO: 922756 - DNA, 13 bp, Homo sapiens
gccaggctgggcc

SEQ ID NO: 922757 - DNA, 14 bp, Homo sapiens
gccaggctgggccg

SEQ ID NO: 922758 - DNA, 15 bp, Homo sapiens
gccaggctgggccgc

SEQ ID NO: 922759 - DNA, 16 bp, Homo sapiens
gccaggctgggccgca

SEQ ID NO: 922760 - DNA, 13 bp, Homo sapiens
gccaggctgttct

SEQ ID NO: 922761 - DNA, 16 bp, Homo sapiens
cgaggctccctcttcc

SEQ ID NO: 922762 - DNA, 16 bp, Homo sapiens
cgaggctgccccaggc

SEQ ID NO: 922763 - DNA, 18 bp, Homo sapiens
cgaggctgccccaggccg

SEQ ID NO: 922764 - DNA, 16 bp, Homo sapiens
cgaggctgcccccatc

SEQ ID NO: 922765 - DNA, 17 bp, Homo sapiens
cgagggagctgctggct

SEQ ID NO: 922766 - DNA, 22 bp, Homo sapiens
cgagggagctgctggctgacct

SEQ ID NO: 922767 - DNA, 13 bp, Homo sapiens
cgagggcagctgc

SEQ ID NO: 922768 - DNA, 14 bp, Homo sapiens
cgagggccaggcag

SEQ ID NO: 922769 - DNA, 16 bp, Homo sapiens
cgagggccaggcagaa

SEQ ID NO: 922770 - DNA, 18 bp, Homo sapiens
cgagggccgcccgctccc

SEQ ID NO: 922771 - DNA, 20 bp, Homo sapiens
cgagggccgcctgccttagc

SEQ ID NO: 922772 - DNA, 18 bp, Homo sapiens
cgagggcgaaggccattg

SEQ ID NO: 922773 - DNA, 13 bp, Homo sapiens
cgagggcggccag

SEQ ID NO: 922774 - DNA, 19 bp, Homo sapiens
cgagggcggccagggacag

SEQ ID NO: 922775 - DNA, 15 bp, Homo sapiens
cgagggctgaggagc

SEQ ID NO: 922776 - DNA, 16 bp, Homo sapiens
cgagggctgaggagca

SEQ ID NO: 922777 - DNA, 17 bp, Homo sapiens
cgagggctgaggagcag

SEQ ID NO: 922778 - DNA, 23 bp, Homo sapiens
cgagggctgaggagcagccagga

SEQ ID NO: 922779 - DNA, 15 bp, Homo sapiens
cgagggctggctggc

SEQ ID NO: 922780 - DNA, 17 bp, Homo sapiens
cgagggctggctggcct

SEQ ID NO: 922781 - DNA, 16 bp, Homo sapiens
cgaggggctcaggaaa

SEQ ID NO: 922782 - DNA, 19 bp, Homo sapiens
cgaggggtgtcttgggcag

SEQ ID NO: 922783 - DNA, 14 bp, Homo sapiens
cgagggtcctggct

SEQ ID NO: 922784 - DNA, 14 bp, Homo sapiens
cgaggtcagaggag

SEQ ID NO: 922785 - DNA, 16 bp, Homo sapiens
cgaggtcagccaggct

SEQ ID NO: 922786 - DNA, 20 bp, Homo sapiens
cgaggtggatcacagaggct

SEQ ID NO: 922787 - DNA, 22 bp, Homo sapiens
cgaggtggatcacagaggcttc

SEQ ID NO: 922788 - DNA, 18 bp, Homo sapiens
cgaggtgtcaccctgcag

SEQ ID NO: 922789 - DNA, 21 bp, Homo sapiens
cgaggtgtcaccctgcagagc

SEQ ID NO: 922790 - DNA, 23 bp, Homo sapiens
cgaggtgtcaccctgcagagcta

SEQ ID NO: 922791 - DNA, 19 bp, Homo sapiens
cgaggttaaagaagctgca

SEQ ID NO: 922792 - DNA, 20 bp, Homo sapiens
cgaggttaaagaagctgcat

SEQ ID NO: 922793 - DNA, 13 bp, Homo sapiens
cgaggttgagagg

SEQ ID NO: 922794 - DNA, 16 bp, Homo sapiens
cgaggttgtggggagg

SEQ ID NO: 922795 - DNA, 22 bp, Homo sapiens
cgagtacctccagtcacactcc

SEQ ID NO: 922796 - DNA, 22 bp, Homo sapiens
cgagtagaaaatgtgaccctcc

SEQ ID NO: 922797 - DNA, 16 bp, Homo sapiens
cgagtagagaggcccg

SEQ ID NO: 922798 - DNA, 18 bp, Homo sapiens
cgagtatctgtaaccctt

SEQ ID NO: 922799 - DNA, 20 bp, Homo sapiens
cgagtcaattaaacagctgg

SEQ ID NO: 922800 - DNA, 20 bp, Homo sapiens
cgagtcacctgcaagcccca

SEQ ID NO: 922801 - DNA, 18 bp, Homo sapiens
cgagtcattcgttctgtg

SEQ ID NO: 922802 - DNA, 15 bp, Homo sapiens
cgagtccaagctggg

SEQ ID NO: 922803 - DNA, 13 bp, Homo sapiens
cgagtcctcaggt

SEQ ID NO: 922804 - DNA, 15 bp, Homo sapiens
cgagtcctcaggtac

SEQ ID NO: 922805 - DNA, 17 bp, Homo sapiens
cgagtcctcaggtacag

SEQ ID NO: 922806 - DNA, 17 bp, Homo sapiens
cgagtctcttctccact

SEQ ID NO: 922807 - DNA, 20 bp, Homo sapiens
cgagtctcttctccactgga

SEQ ID NO: 922808 - DNA, 21 bp, Homo sapiens
cgagtctcttctccactggat

SEQ ID NO: 922809 - DNA, 22 bp, Homo sapiens
cgagtgcactgcattcctgtgc

SEQ ID NO: 922810 - DNA, 16 bp, Homo sapiens
cgagtgtagctgtgaa

SEQ ID NO: 922811 - DNA, 22 bp, Homo sapiens
cgagtgtgagagtgtgagcagg

SEQ ID NO: 922812 - DNA, 16 bp, Homo sapiens
cgagtgtgctgtatgg

SEQ ID NO: 922813 - DNA, 21 bp, Homo sapiens
cgagtgtgctgtatggcccag

SEQ ID NO: 922814 - DNA, 18 bp, Homo sapiens
cgagtgtgtgcatgtgtg

SEQ ID NO: 922815 - DNA, 20 bp, Homo sapiens
cgagttcctctgggtttcta

SEQ ID NO: 922816 - DNA, 17 bp, Homo sapiens
cgagttctctttggaaa

SEQ ID NO: 922817 - DNA, 16 bp, Homo sapiens
cgagttggcaaaatgg

SEQ ID NO: 922818 - DNA, 22 bp, Homo sapiens
cgatactgcgactttctgcctg

SEQ ID NO: 922819 - DNA, 13 bp, Homo sapiens
cgatattctccct

SEQ ID NO: 922820 - DNA, 13 bp, Homo sapiens
cgatcaacattta

SEQ ID NO: 922821 - DNA, 16 bp, Homo sapiens
cgatcaagagaatcaa

SEQ ID NO: 922822 - DNA, 16 bp, Homo sapiens
cgatcatttatttcat

SEQ ID NO: 922823 - DNA, 17 bp, Homo sapiens
cgatcatttatttcatg

SEQ ID NO: 922824 - DNA, 20 bp, Homo sapiens
cgatcatttatttcatgatt

SEQ ID NO: 922825 - DNA, 15 bp, Homo sapiens
cgatccacctgtctc

SEQ ID NO: 922826 - DNA, 20 bp, Homo sapiens
cgatccacctgtctcagcct

SEQ ID NO: 922827 - DNA, 16 bp, Homo sapiens
cgatccaggggaagcc

SEQ ID NO: 922828 - DNA, 13 bp, Homo sapiens
cgatcccctcccc

SEQ ID NO: 922829 - DNA, 14 bp, Homo sapiens
cgatcccctccccc

SEQ ID NO: 922830 - DNA, 15 bp, Homo sapiens
cgatccttcaaagtc

SEQ ID NO: 922831 - DNA, 16 bp, Homo sapiens
cgatctctcctggcct

SEQ ID NO: 922832 - DNA, 14 bp, Homo sapiens
cgatgaaggctgcc

SEQ ID NO: 922833 - DNA, 21 bp, Homo sapiens
cgatgaatttggagactctgt

SEQ ID NO: 922834 - DNA, 19 bp, Homo sapiens
cgatgagcgccacctcttt

SEQ ID NO: 922835 - DNA, 14 bp, Homo sapiens
cgatgcatttaata

SEQ ID NO: 922836 - DNA, 15 bp, Homo sapiens
cgatgcatttaataa

SEQ ID NO: 922837 - DNA, 17 bp, Homo sapiens
cgatgcatttaataaag

SEQ ID NO: 922838 - DNA, 13 bp, Homo sapiens
cgatgcctgattc

SEQ ID NO: 922839 - DNA, 16 bp, Homo sapiens
cgatgcctggcctgcc

SEQ ID NO: 922840 - DNA, 22 bp, Homo sapiens
cgatgcctggcctgccagacac

SEQ ID NO: 922841 - DNA, 14 bp, Homo sapiens
cgatgcctttgctg

SEQ ID NO: 922842 - DNA, 20 bp, Homo sapiens
cgatgcgtattctgtggccg

SEQ ID NO: 922843 - DNA, 20 bp, Homo sapiens
cgatgctccagccaacccct

SEQ ID NO: 922844 - DNA, 20 bp, Homo sapiens
cgatgctgctttcccctgtg

SEQ ID NO: 922845 - DNA, 15 bp, Homo sapiens
cgatggagcccccag

SEQ ID NO: 922846 - DNA, 17 bp, Homo sapiens
cgatggagcccccagat

SEQ ID NO: 922847 - DNA, 12 bp, Homo sapiens
cgatggcaggcc

SEQ ID NO: 922848 - DNA, 17 bp, Homo sapiens
cgatggggactctgccg

SEQ ID NO: 922849 - DNA, 19 bp, Homo sapiens
cgatggggcaagacagaaa

SEQ ID NO: 922850 - DNA, 18 bp, Homo sapiens
cgatgggggatgcttcat

SEQ ID NO: 922851 - DNA, 21 bp, Homo sapiens
cgatgggggatgcttcatgtg

SEQ ID NO: 922852 - DNA, 15 bp, Homo sapiens
cgatgggtgttgctg

SEQ ID NO: 922853 - DNA, 16 bp, Homo sapiens
cgatggtctctctccc

SEQ ID NO: 922854 - DNA, 19 bp, Homo sapiens
cgatggtctctctccctct

SEQ ID NO: 922855 - DNA, 20 bp, Homo sapiens
cgatgtatgcagctatctgg

SEQ ID NO: 922856 - DNA, 13 bp, Homo sapiens
cgatgtgctcagc

SEQ ID NO: 922857 - DNA, 15 bp, Homo sapiens
cgatgtggccctggc

SEQ ID NO: 922858 - DNA, 17 bp, Homo sapiens
cgatgtggccctggcct

SEQ ID NO: 922859 - DNA, 18 bp, Homo sapiens
cgatgtggccctggcctg

SEQ ID NO: 922860 - DNA, 15 bp, Homo sapiens
cgatgtgtctcccag

SEQ ID NO: 922861 - DNA, 17 bp, Homo sapiens
cgatgtgtctcccagaa

SEQ ID NO: 922862 - DNA, 14 bp, Homo sapiens
cgatgttgaacttt

SEQ ID NO: 922863 - DNA, 16 bp, Homo sapiens
cgatgttgaacttttt

SEQ ID NO: 922864 - DNA, 18 bp, Homo sapiens
cgattaataacctgccag

SEQ ID NO: 922865 - DNA, 21 bp, Homo sapiens
cgattctctgcccgggcccct

SEQ ID NO: 922866 - DNA, 19 bp, Homo sapiens
cgattgacctgtcctcttt

SEQ ID NO: 922867 - DNA, 12 bp, Homo sapiens
cgattggagaat

SEQ ID NO: 922868 - DNA, 17 bp, Homo sapiens
cgattggagaatacttt

SEQ ID NO: 922869 - DNA, 13 bp, Homo sapiens
cgattggctttaa

SEQ ID NO: 922870 - DNA, 15 bp, Homo sapiens
cgattggctttaaac

SEQ ID NO: 922871 - DNA, 12 bp, Homo sapiens
cgattgtatttg

SEQ ID NO: 922872 - DNA, 12 bp, Homo sapiens
cgatttctgttt

SEQ ID NO: 922873 - DNA, 12 bp, Homo sapiens
cgatttgaaaca

SEQ ID NO: 922874 - DNA, 15 bp, Homo sapiens
cgatttgggggctcg

SEQ ID NO: 922875 - DNA, 22 bp, Homo sapiens
cgatttgggggctcggggaggc

SEQ ID NO: 922876 - DNA, 17 bp, Homo sapiens
cgattttcaagattcta

SEQ ID NO: 922877 - DNA, 18 bp, Homo sapiens
cgattttcaagattctaa

SEQ ID NO: 922878 - DNA, 17 bp, Homo sapiens
cgattttgtatctgcag

SEQ ID NO: 922879 - DNA, 22 bp, Homo sapiens
cgatttttgtatgttatgaaca

SEQ ID NO: 922880 - DNA, 17 bp, Homo sapiens
cgcaaaaacttccttta

SEQ ID NO: 922881 - DNA, 16 bp, Homo sapiens
cgcaaaccacactgga

SEQ ID NO: 922882 - DNA, 18 bp, Homo sapiens
cgcaaaccacactggact

SEQ ID NO: 922883 - DNA, 14 bp, Homo sapiens
cgcaaccctgcctg

SEQ ID NO: 922884 - DNA, 15 bp, Homo sapiens
cgcaacctgcaggct

SEQ ID NO: 922885 - DNA, 12 bp, Homo sapiens
cgcaactcttgt

SEQ ID NO: 922886 - DNA, 13 bp, Homo sapiens
cctttcgaggcct

SEQ ID NO: 922887 - DNA, 23 bp, Homo sapiens
cctttctaaacaagattttaaag

SEQ ID NO: 922888 - DNA, 15 bp, Homo sapiens
cctttctagccttag

SEQ ID NO: 922889 - DNA, 22 bp, Homo sapiens
cctttctagtcctattctattg

SEQ ID NO: 922890 - DNA, 10 bp, Homo sapiens
cctttctccc

SEQ ID NO: 922891 - DNA, 13 bp, Homo sapiens
cctttctccctgc

SEQ ID NO: 922892 - DNA, 15 bp, Homo sapiens
cctttctcctcccca

SEQ ID NO: 922893 - DNA, 13 bp, Homo sapiens
cctttctcctgtg

SEQ ID NO: 922894 - DNA, 17 bp, Homo sapiens
cctttctcctgtgaatg

SEQ ID NO: 922895 - DNA, 22 bp, Homo sapiens
cctttctcgtggtagaagccag

SEQ ID NO: 922896 - DNA, 16 bp, Homo sapiens
cctttctctcctggct

SEQ ID NO: 922897 - DNA, 17 bp, Homo sapiens
cctttctctcctggctc

SEQ ID NO: 922898 - DNA, 16 bp, Homo sapiens
cctttctctctcctct

SEQ ID NO: 922899 - DNA, 19 bp, Homo sapiens
cctttctctctcctctctg

SEQ ID NO: 922900 - DNA, 12 bp, Homo sapiens
cctttctctgag

SEQ ID NO: 922901 - DNA, 13 bp, Homo sapiens
cctttctctgaga

SEQ ID NO: 922902 - DNA, 12 bp, Homo sapiens
cctttctctttc

SEQ ID NO: 922903 - DNA, 14 bp, Homo sapiens
cctttctctttctc

SEQ ID NO: 922904 - DNA, 14 bp, Homo sapiens
cctttctgcccccc

SEQ ID NO: 922905 - DNA, 22 bp, Homo sapiens
cctttctgccccccagggctag

SEQ ID NO: 922906 - DNA, 12 bp, Homo sapiens
cctttctggccc

SEQ ID NO: 922907 - DNA, 15 bp, Homo sapiens
cctttctggcctgtt

SEQ ID NO: 922908 - DNA, 20 bp, Homo sapiens
cctttctgggctttctcctg

SEQ ID NO: 922909 - DNA, 13 bp, Homo sapiens
cctttctgtgaag

SEQ ID NO: 922910 - DNA, 12 bp, Homo sapiens
cctttctgtgcc

SEQ ID NO: 922911 - DNA, 16 bp, Homo sapiens
cctttcttcctattta

SEQ ID NO: 922912 - DNA, 12 bp, Homo sapiens
cctttcttctgt

SEQ ID NO: 922913 - DNA, 23 bp, Homo sapiens
cctttcttgacaaaacctaactt

SEQ ID NO: 922914 - DNA, 23 bp, Homo sapiens
cctttcttgtagccatggctggg

SEQ ID NO: 922915 - DNA, 17 bp, Homo sapiens
cctttcttgtgccctgg

SEQ ID NO: 922916 - DNA, 19 bp, Homo sapiens
cctttcttgtgccctgggc

SEQ ID NO: 922917 - DNA, 23 bp, Homo sapiens
cctttctttttcttcttccctcc

SEQ ID NO: 922918 - DNA, 14 bp, Homo sapiens
cctttgaagcctca

SEQ ID NO: 922919 - DNA, 14 bp, Homo sapiens
cctttgaatatttt

SEQ ID NO: 922920 - DNA, 20 bp, Homo sapiens
cctttgaatattttttgaag

SEQ ID NO: 922921 - DNA, 15 bp, Homo sapiens
cctttgaccttcccc

SEQ ID NO: 922922 - DNA, 13 bp, Homo sapiens
cctttgacttcag

SEQ ID NO: 922923 - DNA, 15 bp, Homo sapiens
cctttgacttcagct

SEQ ID NO: 922924 - DNA, 20 bp, Homo sapiens
cctttgacttcagctgcctg

SEQ ID NO: 922925 - DNA, 18 bp, Homo sapiens
cctttgagatctggggag

SEQ ID NO: 922926 - DNA, 19 bp, Homo sapiens
cctttgagtgcagtcctga

SEQ ID NO: 922927 - DNA, 18 bp, Homo sapiens
cctttgcaaatcagtgtt

SEQ ID NO: 922928 - DNA, 17 bp, Homo sapiens
cctttgcaagatgcttg

SEQ ID NO: 922929 - DNA, 16 bp, Homo sapiens
cctttgcactgagggc

SEQ ID NO: 922930 - DNA, 18 bp, Homo sapiens
cctttgcactgagggcca

SEQ ID NO: 922931 - DNA, 18 bp, Homo sapiens
cctttgcagttggactct

SEQ ID NO: 922932 - DNA, 22 bp, Homo sapiens
cctttgcagttggactctcagg

SEQ ID NO: 922933 - DNA, 18 bp, Homo sapiens
cctttgcatagctctcct

SEQ ID NO: 922934 - DNA, 19 bp, Homo sapiens
cctttgcatggcagggcct

SEQ ID NO: 922935 - DNA, 20 bp, Homo sapiens
cctttgcatggcagggcctc

SEQ ID NO: 922936 - DNA, 21 bp, Homo sapiens
cctttgccccacctttattaa

SEQ ID NO: 922937 - DNA, 18 bp, Homo sapiens
cctttgccttaaacctga

SEQ ID NO: 922938 - DNA, 22 bp, Homo sapiens
cctttgcctttcttctgccctt

SEQ ID NO: 922939 - DNA, 16 bp, Homo sapiens
cctttgcgtggatcaa

SEQ ID NO: 922940 - DNA, 20 bp, Homo sapiens
cctttgctctgatttccttc

SEQ ID NO: 922941 - DNA, 13 bp, Homo sapiens
cctttgctctttc

SEQ ID NO: 922942 - DNA, 17 bp, Homo sapiens
cctttgctggaagaaac

SEQ ID NO: 922943 - DNA, 13 bp, Homo sapiens
cctttgctgtgag

SEQ ID NO: 922944 - DNA, 23 bp, Homo sapiens
cctttgctgtttagcttcctcca

SEQ ID NO: 922945 - DNA, 18 bp, Homo sapiens
cctttggacccagggcct

SEQ ID NO: 922946 - DNA, 15 bp, Homo sapiens
cctttggagatgctg

SEQ ID NO: 922947 - DNA, 19 bp, Homo sapiens
cctttggatgaccagaaca

SEQ ID NO: 922948 - DNA, 18 bp, Homo sapiens
cctttggggaagtttatt

SEQ ID NO: 922949 - DNA, 18 bp, Homo sapiens
cctttggggggccacccg

SEQ ID NO: 922950 - DNA, 19 bp, Homo sapiens
cctttggtgaattccttct

SEQ ID NO: 922951 - DNA, 14 bp, Homo sapiens
cctttggtgcagag

SEQ ID NO: 922952 - DNA, 20 bp, Homo sapiens
cctttggttctggccagaat

SEQ ID NO: 922953 - DNA, 14 bp, Homo sapiens
cctttgtaagtgca

SEQ ID NO: 922954 - DNA, 14 bp, Homo sapiens
cctttgtattataa

SEQ ID NO: 922955 - DNA, 21 bp, Homo sapiens
cctttgtattataattgttga

SEQ ID NO: 922956 - DNA, 23 bp, Homo sapiens
cctttgtcatctttcttctattt

SEQ ID NO: 922957 - DNA, 21 bp, Homo sapiens
cctttgtccccacacagcctc

SEQ ID NO: 922958 - DNA, 22 bp, Homo sapiens
cctttgtccccacacagcctct

SEQ ID NO: 922959 - DNA, 19 bp, Homo sapiens
cctttgtctgtcaatcaca

SEQ ID NO: 922960 - DNA, 21 bp, Homo sapiens
cctttgtgctgcgcctgcagg

SEQ ID NO: 922961 - DNA, 19 bp, Homo sapiens
cctttgtgtggctcctggt

SEQ ID NO: 922962 - DNA, 22 bp, Homo sapiens
cctttgtgtgtattcagaggca

SEQ ID NO: 922963 - DNA, 16 bp, Homo sapiens
cctttgtgtgtgtgtc

SEQ ID NO: 922964 - DNA, 21 bp, Homo sapiens
cctttgttaaccttaaataca

SEQ ID NO: 922965 - DNA, 22 bp, Homo sapiens
cctttgttaccatactgtctct

SEQ ID NO: 922966 - DNA, 13 bp, Homo sapiens
ccttttaaataaa

SEQ ID NO: 922967 - DNA, 20 bp, Homo sapiens
ccttttaatctagagaaggc

SEQ ID NO: 922968 - DNA, 23 bp, Homo sapiens
ccttttaattttgtatgaggtcc

SEQ ID NO: 922969 - DNA, 18 bp, Homo sapiens
ccttttacatactgctgt

SEQ ID NO: 922970 - DNA, 11 bp, Homo sapiens
ccttttactgg

SEQ ID NO: 922971 - DNA, 18 bp, Homo sapiens
ccttttactggttgcatg

SEQ ID NO: 922972 - DNA, 20 bp, Homo sapiens
ccttttactggttgcatgga

SEQ ID NO: 922973 - DNA, 21 bp, Homo sapiens
ccttttagcctagttcatcca

SEQ ID NO: 922974 - DNA, 16 bp, Homo sapiens
ccttttataaccttgt

SEQ ID NO: 922975 - DNA, 11 bp, Homo sapiens
ccttttatagc

SEQ ID NO: 922976 - DNA, 16 bp, Homo sapiens
ccttttatagctatta

SEQ ID NO: 922977 - DNA, 22 bp, Homo sapiens
ccttttataggtgagaaaaaaa

SEQ ID NO: 922978 - DNA, 19 bp, Homo sapiens
ccttttatcccaaagttgt

SEQ ID NO: 922979 - DNA, 17 bp, Homo sapiens
ccttttatctgcagaac

SEQ ID NO: 922980 - DNA, 15 bp, Homo sapiens
ccttttattgacaca

SEQ ID NO: 922981 - DNA, 19 bp, Homo sapiens
ccttttcactttattgcta

SEQ ID NO: 922982 - DNA, 18 bp, Homo sapiens
ccttttcagccctttgct

SEQ ID NO: 922983 - DNA, 12 bp, Homo sapiens
ccttttcaggaa

SEQ ID NO: 922984 - DNA, 18 bp, Homo sapiens
ccttttcataggtctgaa

SEQ ID NO: 922985 - DNA, 22 bp, Homo sapiens
ccttttcataggtctgaaattt

SEQ ID NO: 922986 - DNA, 16 bp, Homo sapiens
ccttttcatctgttgt

SEQ ID NO: 922987 - DNA, 12 bp, Homo sapiens
ccttttcattta

SEQ ID NO: 922988 - DNA, 20 bp, Homo sapiens
ccttttccagaaatacctgt

SEQ ID NO: 922989 - DNA, 19 bp, Homo sapiens
ccttttcccctacagaatt

SEQ ID NO: 922990 - DNA, 14 bp, Homo sapiens
ccttttccctgctt

SEQ ID NO: 922991 - DNA, 10 bp, Homo sapiens
ccttttccta

SEQ ID NO: 922992 - DNA, 16 bp, Homo sapiens
ccttttctataagttg

SEQ ID NO: 922993 - DNA, 9 bp, Homo sapiens
ccttttctc

SEQ ID NO: 922994 - DNA, 19 bp, Homo sapiens
ccttttctcacaaaaaggc

SEQ ID NO: 922995 - DNA, 12 bp, Homo sapiens
ccttttctcagg

SEQ ID NO: 922996 - DNA, 19 bp, Homo sapiens
ccttttctctcctgtgtgc

SEQ ID NO: 922997 - DNA, 20 bp, Homo sapiens
ccttttctggtccctcttct

SEQ ID NO: 922998 - DNA, 23 bp, Homo sapiens
ccttttgaagtagtttgtataac

SEQ ID NO: 922999 - DNA, 16 bp, Homo sapiens
ccttttgactcttccg

SEQ ID NO: 923000 - DNA, 16 bp, Homo sapiens
ccttttgatggggaga

SEQ ID NO: 923001 - DNA, 17 bp, Homo sapiens
ccttttgatggggagaa

SEQ ID NO: 923002 - DNA, 18 bp, Homo sapiens
ccttttgatggggagaaa

SEQ ID NO: 923003 - DNA, 17 bp, Homo sapiens
ccttttgcacccctccc

SEQ ID NO: 923004 - DNA, 18 bp, Homo sapiens
ccttttgcacccctccca

SEQ ID NO: 923005 - DNA, 19 bp, Homo sapiens
ccttttgcagaagagggtg

SEQ ID NO: 923006 - DNA, 18 bp, Homo sapiens
ccttttggaacatttctt

SEQ ID NO: 923007 - DNA, 22 bp, Homo sapiens
ccttttggataagtttctattc

SEQ ID NO: 923008 - DNA, 12 bp, Homo sapiens
ccttttggcact

SEQ ID NO: 923009 - DNA, 12 bp, Homo sapiens
ccttttggcccc

SEQ ID NO: 923010 - DNA, 18 bp, Homo sapiens
ccttttgtatcttccttt

SEQ ID NO: 923011 - DNA, 14 bp, Homo sapiens
gccagacatgtggt

SEQ ID NO: 923012 - DNA, 23 bp, Homo sapiens
gccagaccaacgttactcagggc

SEQ ID NO: 923013 - DNA, 13 bp, Homo sapiens
gccagaccatgga

SEQ ID NO: 923014 - DNA, 20 bp, Homo sapiens
gccagaccccacgctgacca

SEQ ID NO: 923015 - DNA, 23 bp, Homo sapiens
gccagaccccgtggctctgggag

SEQ ID NO: 923016 - DNA, 16 bp, Homo sapiens
gccagacctagcaggc

SEQ ID NO: 923017 - DNA, 19 bp, Homo sapiens
gccagacctagcaggctgt

SEQ ID NO: 923018 - DNA, 17 bp, Homo sapiens
gccagacttctggagga

SEQ ID NO: 923019 - DNA, 16 bp, Homo sapiens
gccagagaagataatg

SEQ ID NO: 923020 - DNA, 13 bp, Homo sapiens
gccagagaagcta

SEQ ID NO: 923021 - DNA, 20 bp, Homo sapiens
gccagagaatagatcagtat

SEQ ID NO: 923022 - DNA, 12 bp, Homo sapiens
gccagagagcag

SEQ ID NO: 923023 - DNA, 13 bp, Homo sapiens
gccagagagcagg

SEQ ID NO: 923024 - DNA, 22 bp, Homo sapiens
gccagagagcaggggagcttgg

SEQ ID NO: 923025 - DNA, 17 bp, Homo sapiens
gccagagaggagcacct

SEQ ID NO: 923026 - DNA, 14 bp, Homo sapiens
gccagagagggccc

SEQ ID NO: 923027 - DNA, 19 bp, Homo sapiens
gccagagcaggagcccctg

SEQ ID NO: 923028 - DNA, 12 bp, Homo sapiens
gccagagccaaa

SEQ ID NO: 923029 - DNA, 18 bp, Homo sapiens
gccagagccccaagcagg

SEQ ID NO: 923030 - DNA, 20 bp, Homo sapiens
gccagagcccttcactgcca

SEQ ID NO: 923031 - DNA, 22 bp, Homo sapiens
gccagagcccttcactgccatg

SEQ ID NO: 923032 - DNA, 12 bp, Homo sapiens
gccagagcctct

SEQ ID NO: 923033 - DNA, 14 bp, Homo sapiens
gccagagcctctgg

SEQ ID NO: 923034 - DNA, 20 bp, Homo sapiens
gccagagcctctggcccctc

SEQ ID NO: 923035 - DNA, 16 bp, Homo sapiens
gccagagcctggggtg

SEQ ID NO: 923036 - DNA, 19 bp, Homo sapiens
gccagagctagggctgctg

SEQ ID NO: 923037 - DNA, 21 bp, Homo sapiens
gccagagctagggctgctgct

SEQ ID NO: 923038 - DNA, 22 bp, Homo sapiens
gccagagctagggctgctgctt

SEQ ID NO: 923039 - DNA, 14 bp, Homo sapiens
gccagagctgaacc

SEQ ID NO: 923040 - DNA, 22 bp, Homo sapiens
gccagagctggaaggcagggca

SEQ ID NO: 923041 - DNA, 14 bp, Homo sapiens
gccagagctgggtg

SEQ ID NO: 923042 - DNA, 16 bp, Homo sapiens
gccagagctgggtggg

SEQ ID NO: 923043 - DNA, 13 bp, Homo sapiens
gccagagctgtgc

SEQ ID NO: 923044 - DNA, 21 bp, Homo sapiens
gccagaggaactgtccagaga

SEQ ID NO: 923045 - DNA, 17 bp, Homo sapiens
gccagaggaatcctggc

SEQ ID NO: 923046 - DNA, 22 bp, Homo sapiens
gccagaggaatcctggcagccc

SEQ ID NO: 923047 - DNA, 20 bp, Homo sapiens
gccagaggagggcagaggga

SEQ ID NO: 923048 - DNA, 22 bp, Homo sapiens
gccagaggagggcagagggaga

SEQ ID NO: 923049 - DNA, 14 bp, Homo sapiens
gccagaggccccca

SEQ ID NO: 923050 - DNA, 24 bp, Homo sapiens
gccagaggcccccagcccagggct

SEQ ID NO: 923051 - DNA, 12 bp, Homo sapiens
gccagaggctgg

SEQ ID NO: 923052 - DNA, 13 bp, Homo sapiens
gccagagggccag

SEQ ID NO: 923053 - DNA, 16 bp, Homo sapiens
gccagagggccagcag

SEQ ID NO: 923054 - DNA, 19 bp, Homo sapiens
gccagagggccagcaggct

SEQ ID NO: 923055 - DNA, 22 bp, Homo sapiens
gccagagggccagcaggctcct

SEQ ID NO: 923056 - DNA, 15 bp, Homo sapiens
gccagaggtgcttca

SEQ ID NO: 923057 - DNA, 20 bp, Homo sapiens
gccagaggtgggcaggtggt

SEQ ID NO: 923058 - DNA, 22 bp, Homo sapiens
gccagaggtgggcaggtggtgg

SEQ ID NO: 923059 - DNA, 13 bp, Homo sapiens
gccagagtcacct

SEQ ID NO: 923060 - DNA, 18 bp, Homo sapiens
gccagagtctcccagtgg

SEQ ID NO: 923061 - DNA, 13 bp, Homo sapiens
gccagagtggcct

SEQ ID NO: 923062 - DNA, 17 bp, Homo sapiens
gccagagtggcctggcc

SEQ ID NO: 923063 - DNA, 23 bp, Homo sapiens
gccagagtggcctggccaggagc

SEQ ID NO: 923064 - DNA, 24 bp, Homo sapiens
gccagagtggcctggccaggagct

SEQ ID NO: 923065 - DNA, 24 bp, Homo sapiens
gccagagttcctgcggagtgaaga

SEQ ID NO: 923066 - DNA, 21 bp, Homo sapiens
gccagcaaaaactgtgggaag

SEQ ID NO: 923067 - DNA, 22 bp, Homo sapiens
gccagcaaaaactgtgggaaga

SEQ ID NO: 923068 - DNA, 11 bp, Homo sapiens
gccagcaaata

SEQ ID NO: 923069 - DNA, 12 bp, Homo sapiens
gccagcaacgct

SEQ ID NO: 923070 - DNA, 13 bp, Homo sapiens
gccagcaacgctt

SEQ ID NO: 923071 - DNA, 14 bp, Homo sapiens
gccagcaacgcttg

SEQ ID NO: 923072 - DNA, 13 bp, Homo sapiens
gccagcaactgaa

SEQ ID NO: 923073 - DNA, 19 bp, Homo sapiens
gccagcaagagttaggggc

SEQ ID NO: 923074 - DNA, 23 bp, Homo sapiens
gccagcaataaaaactgtctgtc

SEQ ID NO: 923075 - DNA, 13 bp, Homo sapiens
gccagcaatgaca

SEQ ID NO: 923076 - DNA, 21 bp, Homo sapiens
gccagcaatgatgtccagaag

SEQ ID NO: 923077 - DNA, 22 bp, Homo sapiens
gccagcaatgatgtccagaaga

SEQ ID NO: 923078 - DNA, 15 bp, Homo sapiens
gccagcacacagggc

SEQ ID NO: 923079 - DNA, 16 bp, Homo sapiens
gccagcacacagggca

SEQ ID NO: 923080 - DNA, 22 bp, Homo sapiens
gccagcacacagggcagtgagg

SEQ ID NO: 923081 - DNA, 20 bp, Homo sapiens
gccagcacagaaacagagga

SEQ ID NO: 923082 - DNA, 14 bp, Homo sapiens
gccagcaccacagc

SEQ ID NO: 923083 - DNA, 13 bp, Homo sapiens
gccagcaccctct

SEQ ID NO: 923084 - DNA, 17 bp, Homo sapiens
gccagcaccctctcctg

SEQ ID NO: 923085 - DNA, 21 bp, Homo sapiens
gccagcaccctctcctggggg

SEQ ID NO: 923086 - DNA, 20 bp, Homo sapiens
gccagcacttgtccagctga

SEQ ID NO: 923087 - DNA, 22 bp, Homo sapiens
gccagcagaagcagggtaccct

SEQ ID NO: 923088 - DNA, 11 bp, Homo sapiens
gccagcagagg

SEQ ID NO: 923089 - DNA, 16 bp, Homo sapiens
gccagcagcagcaggt

SEQ ID NO: 923090 - DNA, 19 bp, Homo sapiens
gccagcagcagcaggtgat

SEQ ID NO: 923091 - DNA, 17 bp, Homo sapiens
gccagcagcaggatggg

SEQ ID NO: 923092 - DNA, 13 bp, Homo sapiens
gccagcagccagc

SEQ ID NO: 923093 - DNA, 15 bp, Homo sapiens
gccagcagccagctc

SEQ ID NO: 923094 - DNA, 17 bp, Homo sapiens
gccagcagccagctctc

SEQ ID NO: 923095 - DNA, 18 bp, Homo sapiens
gccagcagccagctctca

SEQ ID NO: 923096 - DNA, 19 bp, Homo sapiens
gccagcagccagctctcag

SEQ ID NO: 923097 - DNA, 23 bp, Homo sapiens
gccagcagccagctctcagccaa

SEQ ID NO: 923098 - DNA, 12 bp, Homo sapiens
gccagcagcctc

SEQ ID NO: 923099 - DNA, 15 bp, Homo sapiens
gccagcagctgaagt

SEQ ID NO: 923100 - DNA, 21 bp, Homo sapiens
gccagcagctgaagtctcttt

SEQ ID NO: 923101 - DNA, 13 bp, Homo sapiens
gccagcaggctcc

SEQ ID NO: 923102 - DNA, 15 bp, Homo sapiens
gccagcaggctcctg

SEQ ID NO: 923103 - DNA, 22 bp, Homo sapiens
gccagcaggctcctggctgtgc

SEQ ID NO: 923104 - DNA, 19 bp, Homo sapiens
gccagcaggggggctgtgc

SEQ ID NO: 923105 - DNA, 17 bp, Homo sapiens
gccagcataggggggag

SEQ ID NO: 923106 - DNA, 13 bp, Homo sapiens
gccagcattcagc

SEQ ID NO: 923107 - DNA, 21 bp, Homo sapiens
gccagcattttcacattttgc

SEQ ID NO: 923108 - DNA, 17 bp, Homo sapiens
gccagccaatttcccgg

SEQ ID NO: 923109 - DNA, 14 bp, Homo sapiens
gccagccacccctg

SEQ ID NO: 923110 - DNA, 14 bp, Homo sapiens
gccagccagcagcc

SEQ ID NO: 923111 - DNA, 13 bp, Homo sapiens
gccagccaggcgg

SEQ ID NO: 923112 - DNA, 19 bp, Homo sapiens
gccagccagtcttgcctag

SEQ ID NO: 923113 - DNA, 22 bp, Homo sapiens
gccagcccaaaccttgggccct

SEQ ID NO: 923114 - DNA, 15 bp, Homo sapiens
gccagcccagccagg

SEQ ID NO: 923115 - DNA, 14 bp, Homo sapiens
gccagcccagccca

SEQ ID NO: 923116 - DNA, 19 bp, Homo sapiens
gccagcccccccacccacc

SEQ ID NO: 923117 - DNA, 17 bp, Homo sapiens
gccagcccctcccacca

SEQ ID NO: 923118 - DNA, 21 bp, Homo sapiens
gccagcccctcccaccacagc

SEQ ID NO: 923119 - DNA, 20 bp, Homo sapiens
gccagcccctcttccccaat

SEQ ID NO: 923120 - DNA, 14 bp, Homo sapiens
gccagcccctggcc

SEQ ID NO: 923121 - DNA, 16 bp, Homo sapiens
gccagcccctggggcc

SEQ ID NO: 923122 - DNA, 17 bp, Homo sapiens
gccagcccctggggccc

SEQ ID NO: 923123 - DNA, 16 bp, Homo sapiens
gccagcccgtcctcct

SEQ ID NO: 923124 - DNA, 17 bp, Homo sapiens
gccagccctccctgtcc

SEQ ID NO: 923125 - DNA, 20 bp, Homo sapiens
gccagccctccctgtcctcc

SEQ ID NO: 923126 - DNA, 15 bp, Homo sapiens
gccagccctgcagcc

SEQ ID NO: 923127 - DNA, 20 bp, Homo sapiens
gccagccgccctgggctgtc

SEQ ID NO: 923128 - DNA, 20 bp, Homo sapiens
gccagccgtgatgctcaggc

SEQ ID NO: 923129 - DNA, 16 bp, Homo sapiens
gccagcctcagaaggc

SEQ ID NO: 923130 - DNA, 19 bp, Homo sapiens
gccagcctcagaaggcccc

SEQ ID NO: 923131 - DNA, 20 bp, Homo sapiens
gccagcctcagaaggcccca

SEQ ID NO: 923132 - DNA, 23 bp, Homo sapiens
gccagcctcagaaggccccagag

SEQ ID NO: 923133 - DNA, 15 bp, Homo sapiens
gccagcctcagactg

SEQ ID NO: 923134 - DNA, 18 bp, Homo sapiens
gccagcctcagtgccact

SEQ ID NO: 923135 - DNA, 15 bp, Homo sapiens
ccttttgtccccagg

SEQ ID NO: 923136 - DNA, 20 bp, Homo sapiens
ccttttgtccccagggcccc

SEQ ID NO: 923137 - DNA, 11 bp, Homo sapiens
ccttttgtgta

SEQ ID NO: 923138 - DNA, 21 bp, Homo sapiens
ccttttgtgtgatgcgccttg

SEQ ID NO: 923139 - DNA, 19 bp, Homo sapiens
ccttttgttgagccaggcc

SEQ ID NO: 923140 - DNA, 19 bp, Homo sapiens
cctttttaaaaaataccat

SEQ ID NO: 923141 - DNA, 21 bp, Homo sapiens
cctttttaaaaaataccattg

SEQ ID NO: 923142 - DNA, 22 bp, Homo sapiens
cctttttatttttttgtacaga

SEQ ID NO: 923143 - DNA, 13 bp, Homo sapiens
cctttttccttcc

SEQ ID NO: 923144 - DNA, 12 bp, Homo sapiens
cctttttgaagt

SEQ ID NO: 923145 - DNA, 13 bp, Homo sapiens
cctttttgacact

SEQ ID NO: 923146 - DNA, 16 bp, Homo sapiens
cctttttgacactgaa

SEQ ID NO: 923147 - DNA, 21 bp, Homo sapiens
cctttttggtacttattactg

SEQ ID NO: 923148 - DNA, 17 bp, Homo sapiens
cctttttgtaaatactg

SEQ ID NO: 923149 - DNA, 20 bp, Homo sapiens
ccttttttaaaagtaaatgt

SEQ ID NO: 923150 - DNA, 21 bp, Homo sapiens
ccttttttagagttgatacta

SEQ ID NO: 923151 - DNA, 22 bp, Homo sapiens
ccttttttaggaagcaagctta

SEQ ID NO: 923152 - DNA, 15 bp, Homo sapiens
ccttttttcacagcc

SEQ ID NO: 923153 - DNA, 11 bp, Homo sapiens
ccttttttccc

SEQ ID NO: 923154 - DNA, 21 bp, Homo sapiens
ccttttttcccataagacaat

SEQ ID NO: 923155 - DNA, 23 bp, Homo sapiens
ccttttttgtcccccaacttgag

SEQ ID NO: 923156 - DNA, 13 bp, Homo sapiens
ccttttttgtcta

SEQ ID NO: 923157 - DNA, 19 bp, Homo sapiens
ccttttttgtctatgaagt

SEQ ID NO: 923158 - DNA, 19 bp, Homo sapiens
ccttttttgtcttattgaa

SEQ ID NO: 923159 - DNA, 23 bp, Homo sapiens
ccttttttgttttttcaaaatag

SEQ ID NO: 923160 - DNA, 17 bp, Homo sapiens
cctttttttatagctgg

SEQ ID NO: 923161 - DNA, 20 bp, Homo sapiens
cctttttttggggtgcctag

SEQ ID NO: 923162 - DNA, 19 bp, Homo sapiens
cgaaaaatcctcttcctct

SEQ ID NO: 923163 - DNA, 15 bp, Homo sapiens
cgaaaatcccatgag

SEQ ID NO: 923164 - DNA, 22 bp, Homo sapiens
cgaaacaggctactctcctcgg

SEQ ID NO: 923165 - DNA, 18 bp, Homo sapiens
cgaaacctgggattcagg

SEQ ID NO: 923166 - DNA, 15 bp, Homo sapiens
cgaaactaagccagg

SEQ ID NO: 923167 - DNA, 13 bp, Homo sapiens
cgaaactgccaag

SEQ ID NO: 923168 - DNA, 12 bp, Homo sapiens
cgaaagaaggca

SEQ ID NO: 923169 - DNA, 18 bp, Homo sapiens
cgaaagcatcactgcctt

SEQ ID NO: 923170 - DNA, 20 bp, Homo sapiens
cgaaaggatgaaagtgacca

SEQ ID NO: 923171 - DNA, 22 bp, Homo sapiens
cgaaaggatgtaaacagtgcct

SEQ ID NO: 923172 - DNA, 14 bp, Homo sapiens
cgaaaggcgagtcc

SEQ ID NO: 923173 - DNA, 20 bp, Homo sapiens
cgaaataattgttgttctgt

SEQ ID NO: 923174 - DNA, 15 bp, Homo sapiens
cgaaatatcaaagtc

SEQ ID NO: 923175 - DNA, 20 bp, Homo sapiens
cgaaatcagcccccagcctt

SEQ ID NO: 923176 - DNA, 20 bp, Homo sapiens
cgaaatctgtattctgtttg

SEQ ID NO: 923177 - DNA, 14 bp, Homo sapiens
cgaaatgttatttt

SEQ ID NO: 923178 - DNA, 19 bp, Homo sapiens
cgaacatatcatttgtgaa

SEQ ID NO: 923179 - DNA, 23 bp, Homo sapiens
cgaacattaggaattgtttatac

SEQ ID NO: 923180 - DNA, 12 bp, Homo sapiens
cgaaccaaggca

SEQ ID NO: 923181 - DNA, 16 bp, Homo sapiens
cgaaccacccaaaaca

SEQ ID NO: 923182 - DNA, 14 bp, Homo sapiens
cgaacccacctgct

SEQ ID NO: 923183 - DNA, 17 bp, Homo sapiens
cgaacccctagaaagga

SEQ ID NO: 923184 - DNA, 15 bp, Homo sapiens
cgaacgctcttagct

SEQ ID NO: 923185 - DNA, 15 bp, Homo sapiens
cgaacgtatttctcc

SEQ ID NO: 923186 - DNA, 16 bp, Homo sapiens
cgaacgtatttctcca

SEQ ID NO: 923187 - DNA, 20 bp, Homo sapiens
cgaacgtatttctccagacc

SEQ ID NO: 923188 - DNA, 14 bp, Homo sapiens
cgaactcctgacct

SEQ ID NO: 923189 - DNA, 22 bp, Homo sapiens
cgaactcctgacctcaagtgat

SEQ ID NO: 923190 - DNA, 14 bp, Homo sapiens
cgaacttcacaact

SEQ ID NO: 923191 - DNA, 13 bp, Homo sapiens
cgaagacacagac

SEQ ID NO: 923192 - DNA, 18 bp, Homo sapiens
cgaagaccctcttgccca

SEQ ID NO: 923193 - DNA, 22 bp, Homo sapiens
cgaagagggaatggatggggag

SEQ ID NO: 923194 - DNA, 20 bp, Homo sapiens
cgaagagtttaaagagaaaa

SEQ ID NO: 923195 - DNA, 16 bp, Homo sapiens
cgaagcccaggggccg

SEQ ID NO: 923196 - DNA, 13 bp, Homo sapiens
cgaagctcagccc

SEQ ID NO: 923197 - DNA, 15 bp, Homo sapiens
cgaagctcagcccac

SEQ ID NO: 923198 - DNA, 17 bp, Homo sapiens
cgaagctcagcccaccc

SEQ ID NO: 923199 - DNA, 20 bp, Homo sapiens
cgaagctctggctgaaccct

SEQ ID NO: 923200 - DNA, 12 bp, Homo sapiens
cgaagggagcat

SEQ ID NO: 923201 - DNA, 19 bp, Homo sapiens
cgaaggggccccggggctg

SEQ ID NO: 923202 - DNA, 18 bp, Homo sapiens
cgaagtctcatgggaagc

SEQ ID NO: 923203 - DNA, 21 bp, Homo sapiens
cgaagtctcatgggaagcagg

SEQ ID NO: 923204 - DNA, 17 bp, Homo sapiens
cgaagtctttgccttct

SEQ ID NO: 923205 - DNA, 19 bp, Homo sapiens
cgaagtctttgccttctct

SEQ ID NO: 923206 - DNA, 10 bp, Homo sapiens
cgaataaatg

SEQ ID NO: 923207 - DNA, 14 bp, Homo sapiens
cgaatacaaaattg

SEQ ID NO: 923208 - DNA, 14 bp, Homo sapiens
cgaatagacatcaa

SEQ ID NO: 923209 - DNA, 16 bp, Homo sapiens
cgaatatattactgat

SEQ ID NO: 923210 - DNA, 21 bp, Homo sapiens
cgaatatattactgatttaga

SEQ ID NO: 923211 - DNA, 14 bp, Homo sapiens
cgaatcaaacctga

SEQ ID NO: 923212 - DNA, 18 bp, Homo sapiens
cgaatcccctccctgtca

SEQ ID NO: 923213 - DNA, 19 bp, Homo sapiens
cgaatcccctccctgtcaa

SEQ ID NO: 923214 - DNA, 12 bp, Homo sapiens
cgaatctctgtg

SEQ ID NO: 923215 - DNA, 22 bp, Homo sapiens
cgaatctctttttgctttcgaa

SEQ ID NO: 923216 - DNA, 24 bp, Homo sapiens
cgaatgcctgtcagtttcatggag

SEQ ID NO: 923217 - DNA, 19 bp, Homo sapiens
cgaatggggtagaaacatt

SEQ ID NO: 923218 - DNA, 14 bp, Homo sapiens
cgaatggtctttgc

SEQ ID NO: 923219 - DNA, 15 bp, Homo sapiens
cgaatggtctttgct

SEQ ID NO: 923220 - DNA, 23 bp, Homo sapiens
cgaatgtgtacaacttaagttgg

SEQ ID NO: 923221 - DNA, 13 bp, Homo sapiens
cgaatgtgtcttt

SEQ ID NO: 923222 - DNA, 16 bp, Homo sapiens
cgaatgtgtctttaga

SEQ ID NO: 923223 - DNA, 18 bp, Homo sapiens
cgaatgtgtctttagata

SEQ ID NO: 923224 - DNA, 14 bp, Homo sapiens
cgaattaatagctt

SEQ ID NO: 923225 - DNA, 16 bp, Homo sapiens
cgaattcatcccctcc

SEQ ID NO: 923226 - DNA, 21 bp, Homo sapiens
cgacaaaaacaagactgcctc

SEQ ID NO: 923227 - DNA, 15 bp, Homo sapiens
cgacaaccgatgctc

SEQ ID NO: 923228 - DNA, 21 bp, Homo sapiens
cgacaaccgatgctccagcca

SEQ ID NO: 923229 - DNA, 22 bp, Homo sapiens
cgacaatgtcgagtatattatt

SEQ ID NO: 923230 - DNA, 18 bp, Homo sapiens
cgacacacggggctcggg

SEQ ID NO: 923231 - DNA, 22 bp, Homo sapiens
cgacactcagggcagctgcctg

SEQ ID NO: 923232 - DNA, 17 bp, Homo sapiens
cgacactctctggaagc

SEQ ID NO: 923233 - DNA, 20 bp, Homo sapiens
cgacagagcgagactccatc

SEQ ID NO: 923234 - DNA, 14 bp, Homo sapiens
cgacagcctggcac

SEQ ID NO: 923235 - DNA, 19 bp, Homo sapiens
cgacaggtgggcctgggag

SEQ ID NO: 923236 - DNA, 16 bp, Homo sapiens
cgacagtgccatcccc

SEQ ID NO: 923237 - DNA, 12 bp, Homo sapiens
cgacagtggctc

SEQ ID NO: 923238 - DNA, 20 bp, Homo sapiens
cgacatccgtcattgctgct

SEQ ID NO: 923239 - DNA, 14 bp, Homo sapiens
cgacattgtctccc

SEQ ID NO: 923240 - DNA, 13 bp, Homo sapiens
cgaccaccaaagt

SEQ ID NO: 923241 - DNA, 21 bp, Homo sapiens
cgaccaccgcccctggccgcg

SEQ ID NO: 923242 - DNA, 14 bp, Homo sapiens
cgaccacctgccca

SEQ ID NO: 923243 - DNA, 14 bp, Homo sapiens
cgaccacttccagg

SEQ ID NO: 923244 - DNA, 15 bp, Homo sapiens
cgaccatcgtccagc

SEQ ID NO: 923245 - DNA, 20 bp, Homo sapiens
cgaccatcgtccagccctcc

SEQ ID NO: 923246 - DNA, 21 bp, Homo sapiens
cgaccatcgtccagccctcct

SEQ ID NO: 923247 - DNA, 14 bp, Homo sapiens
cgaccatgtggcca

SEQ ID NO: 923248 - DNA, 16 bp, Homo sapiens
cgaccatgtggccaca

SEQ ID NO: 923249 - DNA, 20 bp, Homo sapiens
cgacccagaatggagcctgc

SEQ ID NO: 923250 - DNA, 13 bp, Homo sapiens
cgacccagccagc

SEQ ID NO: 923251 - DNA, 17 bp, Homo sapiens
cgacccccgcagaggca

SEQ ID NO: 923252 - DNA, 16 bp, Homo sapiens
cgacccgaggcccaga

SEQ ID NO: 923253 - DNA, 19 bp, Homo sapiens
cgacccgaggcccagatcc

SEQ ID NO: 923254 - DNA, 13 bp, Homo sapiens
cgaccctccccgg

SEQ ID NO: 923255 - DNA, 14 bp, Homo sapiens
cgaccctccccggc

SEQ ID NO: 923256 - DNA, 15 bp, Homo sapiens
cgaccctcctggcct

SEQ ID NO: 923257 - DNA, 16 bp, Homo sapiens
cgaccctctgggaacc

SEQ ID NO: 923258 - DNA, 18 bp, Homo sapiens
cgaccctctgggaacctc

SEQ ID NO: 923259 - DNA, 21 bp, Homo sapiens
cgaccctctgggaacctccca

SEQ ID NO: 923260 - DNA, 16 bp, Homo sapiens
gcacccccaagcctgg

SEQ ID NO: 923261 - DNA, 12 bp, Homo sapiens
gcacccccaccc

SEQ ID NO: 923262 - DNA, 14 bp, Homo sapiens
gcacccccacccac

SEQ ID NO: 923263 - DNA, 14 bp, Homo sapiens
gcacccccaccctt

SEQ ID NO: 923264 - DNA, 14 bp, Homo sapiens
gcaccccccaagct

SEQ ID NO: 923265 - DNA, 14 bp, Homo sapiens
gcacccccgccagg

SEQ ID NO: 923266 - DNA, 17 bp, Homo sapiens
gcaccccctcattcccc

SEQ ID NO: 923267 - DNA, 20 bp, Homo sapiens
gcaccccctcattcccctcg

SEQ ID NO: 923268 - DNA, 23 bp, Homo sapiens
gcaccccctgctccaccagcagc

SEQ ID NO: 923269 - DNA, 21 bp, Homo sapiens
gcaccccgaagggagcatctg

SEQ ID NO: 923270 - DNA, 13 bp, Homo sapiens
gcacccctcccat

SEQ ID NO: 923271 - DNA, 14 bp, Homo sapiens
gcacccctccctgc

SEQ ID NO: 923272 - DNA, 22 bp, Homo sapiens
gcacccctccgtgtggagcacg

SEQ ID NO: 923273 - DNA, 21 bp, Homo sapiens
gcacccctgagttgggcagcc

SEQ ID NO: 923274 - DNA, 14 bp, Homo sapiens
gcacccctgggcca

SEQ ID NO: 923275 - DNA, 21 bp, Homo sapiens
gcaccccttctctcctcccca

SEQ ID NO: 923276 - DNA, 22 bp, Homo sapiens
gcaccccttctctcctccccaa

SEQ ID NO: 923277 - DNA, 21 bp, Homo sapiens
gcacccggggccagagacata

SEQ ID NO: 923278 - DNA, 16 bp, Homo sapiens
gcaccctaggcagcct

SEQ ID NO: 923279 - DNA, 17 bp, Homo sapiens
gcaccctaggcagcctg

SEQ ID NO: 923280 - DNA, 16 bp, Homo sapiens
gcaccctccaccctgt

SEQ ID NO: 923281 - DNA, 18 bp, Homo sapiens
gcaccctccaccctgtcc

SEQ ID NO: 923282 - DNA, 16 bp, Homo sapiens
gcaccctcccccgcag

SEQ ID NO: 923283 - DNA, 13 bp, Homo sapiens
gcaccctccctcc

SEQ ID NO: 923284 - DNA, 16 bp, Homo sapiens
gcaccctccgccttca

SEQ ID NO: 923285 - DNA, 15 bp, Homo sapiens
gcaccctcctagggc

SEQ ID NO: 923286 - DNA, 15 bp, Homo sapiens
gcaccctctatccca

SEQ ID NO: 923287 - DNA, 18 bp, Homo sapiens
gcaccctctcctgggggt

SEQ ID NO: 923288 - DNA, 13 bp, Homo sapiens
gcaccctgcacct

SEQ ID NO: 923289 - DNA, 23 bp, Homo sapiens
gcaccctggaaaggggagttgag

SEQ ID NO: 923290 - DNA, 16 bp, Homo sapiens
gcacccttctttcctc

SEQ ID NO: 923291 - DNA, 13 bp, Homo sapiens
gcaccgaccacgg

SEQ ID NO: 923292 - DNA, 15 bp, Homo sapiens
gcaccgaccccgggc

SEQ ID NO: 923293 - DNA, 16 bp, Homo sapiens
gcaccgaccccgggcc

SEQ ID NO: 923294 - DNA, 17 bp, Homo sapiens
gcaccgaccccgggccg

SEQ ID NO: 923295 - DNA, 19 bp, Homo sapiens
gcaccgaccccgggccgga

SEQ ID NO: 923296 - DNA, 12 bp, Homo sapiens
gcaccgccacgt

SEQ ID NO: 923297 - DNA, 20 bp, Homo sapiens
gcaccgccacgtcccagcat

SEQ ID NO: 923298 - DNA, 17 bp, Homo sapiens
gcaccgccgcagaagca

SEQ ID NO: 923299 - DNA, 20 bp, Homo sapiens
gcaccgccgcagaagcagcc

SEQ ID NO: 923300 - DNA, 21 bp, Homo sapiens
gcaccgccgcagaagcagccc

SEQ ID NO: 923301 - DNA, 22 bp, Homo sapiens
gcaccgccgccaccctgcccct

SEQ ID NO: 923302 - DNA, 23 bp, Homo sapiens
gcaccgcctgccctcccgcacct

SEQ ID NO: 923303 - DNA, 22 bp, Homo sapiens
gcaccgcggcgcttcccagcac

SEQ ID NO: 923304 - DNA, 15 bp, Homo sapiens
gcaccggcgctgcag

SEQ ID NO: 923305 - DNA, 23 bp, Homo sapiens
gcaccgggctccatgcctctgga

SEQ ID NO: 923306 - DNA, 17 bp, Homo sapiens
gcaccgggctggctgct

SEQ ID NO: 923307 - DNA, 15 bp, Homo sapiens
gcaccgtcctcagca

SEQ ID NO: 923308 - DNA, 22 bp, Homo sapiens
gcaccgtgtcctcctctgagga

SEQ ID NO: 923309 - DNA, 15 bp, Homo sapiens
gcacctaccatcagg

SEQ ID NO: 923310 - DNA, 20 bp, Homo sapiens
gcacctaccatcagggacag

SEQ ID NO: 923311 - DNA, 23 bp, Homo sapiens
gcacctaccatcagggacaggat

SEQ ID NO: 923312 - DNA, 17 bp, Homo sapiens
gcacctatagtcccagc

SEQ ID NO: 923313 - DNA, 21 bp, Homo sapiens
gcacctatgagatggccatgc

SEQ ID NO: 923314 - DNA, 24 bp, Homo sapiens
gcacctatgagatggccatgctca

SEQ ID NO: 923315 - DNA, 10 bp, Homo sapiens
gcacctcaga

SEQ ID NO: 923316 - DNA, 24 bp, Homo sapiens
gcacctcagaaagtcaccaggact

SEQ ID NO: 923317 - DNA, 19 bp, Homo sapiens
gcacctccaggcaggccag

SEQ ID NO: 923318 - DNA, 16 bp, Homo sapiens
gcacctccaggcctgt

SEQ ID NO: 923319 - DNA, 20 bp, Homo sapiens
gcacctccaggcctgttgct

SEQ ID NO: 923320 - DNA, 14 bp, Homo sapiens
gcacctcctaccct

SEQ ID NO: 923321 - DNA, 18 bp, Homo sapiens
gcacctcctaccctccca

SEQ ID NO: 923322 - DNA, 22 bp, Homo sapiens
gcacctcctaccctcccaccag

SEQ ID NO: 923323 - DNA, 15 bp, Homo sapiens
gcacctcctgagaag

SEQ ID NO: 923324 - DNA, 19 bp, Homo sapiens
gcacctctgttcatttcac

SEQ ID NO: 923325 - DNA, 20 bp, Homo sapiens
gcacctgaaccccatgggct

SEQ ID NO: 923326 - DNA, 12 bp, Homo sapiens
gcacctgagacc

SEQ ID NO: 923327 - DNA, 18 bp, Homo sapiens
gcacctgattagttgaaa

SEQ ID NO: 923328 - DNA, 22 bp, Homo sapiens
gcacctgcagcgcgcacacgca

SEQ ID NO: 923329 - DNA, 23 bp, Homo sapiens
gcacctgcatccgtagttccctg

SEQ ID NO: 923330 - DNA, 22 bp, Homo sapiens
gcacctgccagcctggcttctg

SEQ ID NO: 923331 - DNA, 16 bp, Homo sapiens
gcacctgccccctggt

SEQ ID NO: 923332 - DNA, 19 bp, Homo sapiens
gcacctgccgacctcgtcc

SEQ ID NO: 923333 - DNA, 21 bp, Homo sapiens
gcacctgccgacctcgtcctc

SEQ ID NO: 923334 - DNA, 14 bp, Homo sapiens
gcacctgcctcagc

SEQ ID NO: 923335 - DNA, 15 bp, Homo sapiens
gcacctgcctcagga

SEQ ID NO: 923336 - DNA, 21 bp, Homo sapiens
gcacctgcctgccgctgcagg

SEQ ID NO: 923337 - DNA, 11 bp, Homo sapiens
gcacctgctgc

SEQ ID NO: 923338 - DNA, 14 bp, Homo sapiens
gcacctgctgcgtc

SEQ ID NO: 923339 - DNA, 20 bp, Homo sapiens
gcacctgctgcgtccccact

SEQ ID NO: 923340 - DNA, 23 bp, Homo sapiens
gcacctgctgcgtccccactccc

SEQ ID NO: 923341 - DNA, 21 bp, Homo sapiens
gcacctggaatatataaccag

SEQ ID NO: 923342 - DNA, 18 bp, Homo sapiens
gcacctggaccccctgcc

SEQ ID NO: 923343 - DNA, 21 bp, Homo sapiens
gcacctggaccccctgcccgc

SEQ ID NO: 923344 - DNA, 16 bp, Homo sapiens
gcacctggcctgctgg

SEQ ID NO: 923345 - DNA, 17 bp, Homo sapiens
gcacctggcctgctggg

SEQ ID NO: 923346 - DNA, 13 bp, Homo sapiens
gcacctggcctgg

SEQ ID NO: 923347 - DNA, 16 bp, Homo sapiens
gcacctgggcagctcc

SEQ ID NO: 923348 - DNA, 17 bp, Homo sapiens
gcacctgggcagctcct

SEQ ID NO: 923349 - DNA, 22 bp, Homo sapiens
gcacctgggcagctcctccctg

SEQ ID NO: 923350 - DNA, 17 bp, Homo sapiens
gcacctgggccccactg

SEQ ID NO: 923351 - DNA, 16 bp, Homo sapiens
cctggtgccctgagac

SEQ ID NO: 923352 - DNA, 20 bp, Homo sapiens
cctggtgcctctgtgcacag

SEQ ID NO: 923353 - DNA, 19 bp, Homo sapiens
cctggtgctctctgccact

SEQ ID NO: 923354 - DNA, 13 bp, Homo sapiens
cctggtgctggat

SEQ ID NO: 923355 - DNA, 22 bp, Homo sapiens
cctggtggagaaagcactgacc

SEQ ID NO: 923356 - DNA, 15 bp, Homo sapiens
cctggtggcaccaga

SEQ ID NO: 923357 - DNA, 23 bp, Homo sapiens
cctggtggcaccagatgcaacct

SEQ ID NO: 923358 - DNA, 19 bp, Homo sapiens
cctggtgggtcagggggag

SEQ ID NO: 923359 - DNA, 20 bp, Homo sapiens
cctggtgtgaaggtcctgct

SEQ ID NO: 923360 - DNA, 16 bp, Homo sapiens
cctggtgtgcggaggc

SEQ ID NO: 923361 - DNA, 17 bp, Homo sapiens
cctggtgtgcggaggca

SEQ ID NO: 923362 - DNA, 20 bp, Homo sapiens
cctggtgtgcggaggcagga

SEQ ID NO: 923363 - DNA, 13 bp, Homo sapiens
cctggtgtgggta

SEQ ID NO: 923364 - DNA, 22 bp, Homo sapiens
cctggtgtgggtaaagggacag

SEQ ID NO: 923365 - DNA, 20 bp, Homo sapiens
cctggttgacccaaaaatgt

SEQ ID NO: 923366 - DNA, 12 bp, Homo sapiens
cctggttgcctc

SEQ ID NO: 923367 - DNA, 13 bp, Homo sapiens
cctggttgcctct

SEQ ID NO: 923368 - DNA, 14 bp, Homo sapiens
cctggttgcctctc

SEQ ID NO: 923369 - DNA, 21 bp, Homo sapiens
cctggtttacttctttagcat

SEQ ID NO: 923370 - DNA, 21 bp, Homo sapiens
cctggtttcataacttcctgt

SEQ ID NO: 923371 - DNA, 13 bp, Homo sapiens
cctggtttccttt

SEQ ID NO: 923372 - DNA, 22 bp, Homo sapiens
cctggtttgactcagttccagg

SEQ ID NO: 923373 - DNA, 16 bp, Homo sapiens
cctggttttatttata

SEQ ID NO: 923374 - DNA, 15 bp, Homo sapiens
cctggtttttctcaa

SEQ ID NO: 923375 - DNA, 19 bp, Homo sapiens
cctggtttttggattaaat

SEQ ID NO: 923376 - DNA, 12 bp, Homo sapiens
cctgtaaacctg

SEQ ID NO: 923377 - DNA, 19 bp, Homo sapiens
cctgtaaactttatcactt

SEQ ID NO: 923378 - DNA, 19 bp, Homo sapiens
cctgtaacacaagccacag

SEQ ID NO: 923379 - DNA, 22 bp, Homo sapiens
cctgtaacacaagccacagaag

SEQ ID NO: 923380 - DNA, 19 bp, Homo sapiens
cctgtaacaggtgtgggga

SEQ ID NO: 923381 - DNA, 19 bp, Homo sapiens
cctgtaagcctgcaagcct

SEQ ID NO: 923382 - DNA, 19 bp, Homo sapiens
cctgtaatcagctctcctg

SEQ ID NO: 923383 - DNA, 21 bp, Homo sapiens
cctgtaatcagctctcctggc

SEQ ID NO: 923384 - DNA, 13 bp, Homo sapiens
cctgtaatcccag

SEQ ID NO: 923385 - DNA, 22 bp, Homo sapiens
cctgtaatcccagcactttggg

SEQ ID NO: 923386 - DNA, 16 bp, Homo sapiens
cctgtaatcccagcag

SEQ ID NO: 923387 - DNA, 18 bp, Homo sapiens
cctgtaatcccagctact

SEQ ID NO: 923388 - DNA, 20 bp, Homo sapiens
cctgtaatcctagcactttg

SEQ ID NO: 923389 - DNA, 21 bp, Homo sapiens
cctgtaatctttttctccacc

SEQ ID NO: 923390 - DNA, 23 bp, Homo sapiens
cctgtacaatcatgaacagctct

SEQ ID NO: 923391 - DNA, 22 bp, Homo sapiens
cctgtacacattcctgcattca

SEQ ID NO: 923392 - DNA, 21 bp, Homo sapiens
cctgtacactgaatatttata

SEQ ID NO: 923393 - DNA, 22 bp, Homo sapiens
cctgtacaggaaggtgcctggc

SEQ ID NO: 923394 - DNA, 20 bp, Homo sapiens
cctgtacagtagattttcca

SEQ ID NO: 923395 - DNA, 22 bp, Homo sapiens
cctgtacagtagattttccaaa

SEQ ID NO: 923396 - DNA, 14 bp, Homo sapiens
cctgtacagtgtta

SEQ ID NO: 923397 - DNA, 19 bp, Homo sapiens
cctgtacatacattgtata

SEQ ID NO: 923398 - DNA, 16 bp, Homo sapiens
cctgtacattcttcca

SEQ ID NO: 923399 - DNA, 17 bp, Homo sapiens
cctgtacccaccccagc

SEQ ID NO: 923400 - DNA, 19 bp, Homo sapiens
cctgtactatgatgggctt

SEQ ID NO: 923401 - DNA, 22 bp, Homo sapiens
cctgtactatgatgggcttctg

SEQ ID NO: 923402 - DNA, 14 bp, Homo sapiens
cctgtactcaggag

SEQ ID NO: 923403 - DNA, 21 bp, Homo sapiens
cctgtactcaggaggctgagg

SEQ ID NO: 923404 - DNA, 22 bp, Homo sapiens
cctgtactcaggaggctgaggg

SEQ ID NO: 923405 - DNA, 15 bp, Homo sapiens
cctgtactcatcggc

SEQ ID NO: 923406 - DNA, 16 bp, Homo sapiens
cctgtactcttccgaa

SEQ ID NO: 923407 - DNA, 18 bp, Homo sapiens
cctgtactgttctgtgtc

SEQ ID NO: 923408 - DNA, 22 bp, Homo sapiens
cctgtagacctagggaggacct

SEQ ID NO: 923409 - DNA, 19 bp, Homo sapiens
cctgtagagtgggagctga

SEQ ID NO: 923410 - DNA, 21 bp, Homo sapiens
cctgtagattcaggtaataca

SEQ ID NO: 923411 - DNA, 20 bp, Homo sapiens
cctgtagcaatggccagagc

SEQ ID NO: 923412 - DNA, 17 bp, Homo sapiens
cctgtagcacgctgcct

SEQ ID NO: 923413 - DNA, 17 bp, Homo sapiens
cctgtagcacttactgg

SEQ ID NO: 923414 - DNA, 21 bp, Homo sapiens
cctgtagggaaaccttggaga

SEQ ID NO: 923415 - DNA, 18 bp, Homo sapiens
cctgtagtcccagccact

SEQ ID NO: 923416 - DNA, 19 bp, Homo sapiens
cctgtagtcccagccactc

SEQ ID NO: 923417 - DNA, 16 bp, Homo sapiens
cctgtagtcccagcta

SEQ ID NO: 923418 - DNA, 13 bp, Homo sapiens
cctgtagtcctag

SEQ ID NO: 923419 - DNA, 16 bp, Homo sapiens
cctgtagttaggaaat

SEQ ID NO: 923420 - DNA, 21 bp, Homo sapiens
cctgtagttaggaaataaaac

SEQ ID NO: 923421 - DNA, 20 bp, Homo sapiens
cctgtagttgacaattctgc

SEQ ID NO: 923422 - DNA, 24 bp, Homo sapiens
cctgtagttgacaattctgcatgt

SEQ ID NO: 923423 - DNA, 13 bp, Homo sapiens
cctgtataagcac

SEQ ID NO: 923424 - DNA, 17 bp, Homo sapiens
cctgtataagcactgaa

SEQ ID NO: 923425 - DNA, 18 bp, Homo sapiens
cctgtataagtggaggca

SEQ ID NO: 923426 - DNA, 22 bp, Homo sapiens
cctgtataagtggaggcacttt

SEQ ID NO: 923427 - DNA, 21 bp, Homo sapiens
cctgtatacagtgcagagcct

SEQ ID NO: 923428 - DNA, 12 bp, Homo sapiens
cctgtatagtta

SEQ ID NO: 923429 - DNA, 22 bp, Homo sapiens
cctgtatgtcaataaacaacag

SEQ ID NO: 923430 - DNA, 14 bp, Homo sapiens
cctgtatgttgtcc

SEQ ID NO: 923431 - DNA, 15 bp, Homo sapiens
cctgtcaagttaaca

SEQ ID NO: 923432 - DNA, 11 bp, Homo sapiens
cctgtcacaat

SEQ ID NO: 923433 - DNA, 15 bp, Homo sapiens
cctgtcacacactgg

SEQ ID NO: 923434 - DNA, 14 bp, Homo sapiens
cctgtcaccaagct

SEQ ID NO: 923435 - DNA, 18 bp, Homo sapiens
cctgtcaccctgcaggac

SEQ ID NO: 923436 - DNA, 20 bp, Homo sapiens
cctgtcacctagaacgtgca

SEQ ID NO: 923437 - DNA, 18 bp, Homo sapiens
cctgtcactgagcacagt

SEQ ID NO: 923438 - DNA, 17 bp, Homo sapiens
cctgtcactgatggaag

SEQ ID NO: 923439 - DNA, 21 bp, Homo sapiens
cctgtcagcctgactcttccc

SEQ ID NO: 923440 - DNA, 14 bp, Homo sapiens
cctgtcagtgcagc

SEQ ID NO: 923441 - DNA, 17 bp, Homo sapiens
cctgtcagtttcatgga

SEQ ID NO: 923442 - DNA, 17 bp, Homo sapiens
cctgtcagtttcccctc

SEQ ID NO: 923443 - DNA, 20 bp, Homo sapiens
cctgtcatccagctcactca

SEQ ID NO: 923444 - DNA, 22 bp, Homo sapiens
gcatgactaatgctttttagaa

SEQ ID NO: 923445 - DNA, 16 bp, Homo sapiens
gcatgagctgctgtgc

SEQ ID NO: 923446 - DNA, 20 bp, Homo sapiens
gcatgagggatcacagggcc

SEQ ID NO: 923447 - DNA, 17 bp, Homo sapiens
gcatgagtatctgtggg

SEQ ID NO: 923448 - DNA, 20 bp, Homo sapiens
gcatgatcatagctcactgc

SEQ ID NO: 923449 - DNA, 21 bp, Homo sapiens
gcatgatgccctcccctcagc

SEQ ID NO: 923450 - DNA, 15 bp, Homo sapiens
gcatgatgggaaaat

SEQ ID NO: 923451 - DNA, 16 bp, Homo sapiens
gcatgatgggaaaata

SEQ ID NO: 923452 - DNA, 18 bp, Homo sapiens
gcatgatgggaaaatatt

SEQ ID NO: 923453 - DNA, 20 bp, Homo sapiens
gcatgatgggaaaatatttc

SEQ ID NO: 923454 - DNA, 21 bp, Homo sapiens
gcatgatgggaaaatatttcc

SEQ ID NO: 923455 - DNA, 22 bp, Homo sapiens
gcatgatgtttgcccaaaattt

SEQ ID NO: 923456 - DNA, 15 bp, Homo sapiens
gcatgattcttctct

SEQ ID NO: 923457 - DNA, 14 bp, Homo sapiens
gcatgattctttaa

SEQ ID NO: 923458 - DNA, 15 bp, Homo sapiens
gcatgatttatatat

SEQ ID NO: 923459 - DNA, 18 bp, Homo sapiens
gcatgcaataatgtgcaa

SEQ ID NO: 923460 - DNA, 15 bp, Homo sapiens
gcatgcacacggctg

SEQ ID NO: 923461 - DNA, 15 bp, Homo sapiens
gcatgcacagctgct

SEQ ID NO: 923462 - DNA, 17 bp, Homo sapiens
gcatgcacagctgcttg

SEQ ID NO: 923463 - DNA, 19 bp, Homo sapiens
gcatgcacatgctgtctgg

SEQ ID NO: 923464 - DNA, 19 bp, Homo sapiens
gcatgcacgggcatgcaca

SEQ ID NO: 923465 - DNA, 21 bp, Homo sapiens
gcatgcacgggcatgcacacg

SEQ ID NO: 923466 - DNA, 23 bp, Homo sapiens
gcatgcacgggcatgcacacggc

SEQ ID NO: 923467 - DNA, 16 bp, Homo sapiens
gcatgcactgttcccc

SEQ ID NO: 923468 - DNA, 18 bp, Homo sapiens
gcatgcagctgcctgggg

SEQ ID NO: 923469 - DNA, 14 bp, Homo sapiens
gcatgcattttgca

SEQ ID NO: 923470 - DNA, 15 bp, Homo sapiens
gcatgccaggctggg

SEQ ID NO: 923471 - DNA, 19 bp, Homo sapiens
gcatgcccagattcccaga

SEQ ID NO: 923472 - DNA, 23 bp, Homo sapiens
gcattaaggtatttcgaaactgc

SEQ ID NO: 923473 - DNA, 16 bp, Homo sapiens
gcattaataaaaatca

SEQ ID NO: 923474 - DNA, 12 bp, Homo sapiens
gcattacattat

SEQ ID NO: 923475 - DNA, 19 bp, Homo sapiens
gcattaccgcgttgtaaaa

SEQ ID NO: 923476 - DNA, 20 bp, Homo sapiens
gcattaccgcgttgtaaaat

SEQ ID NO: 923477 - DNA, 17 bp, Homo sapiens
gcattacgtgagccagg

SEQ ID NO: 923478 - DNA, 18 bp, Homo sapiens
gcattacttgctttcaat

SEQ ID NO: 923479 - DNA, 13 bp, Homo sapiens
gcattagaaatta

SEQ ID NO: 923480 - DNA, 17 bp, Homo sapiens
gcattagaattatttaa

SEQ ID NO: 923481 - DNA, 18 bp, Homo sapiens
gcattagaattatttaaa

SEQ ID NO: 923482 - DNA, 19 bp, Homo sapiens
gcattatctagatactgta

SEQ ID NO: 923483 - DNA, 19 bp, Homo sapiens
gcattatgtatttataatt

SEQ ID NO: 923484 - DNA, 19 bp, Homo sapiens
gcattatgtccactgtgta

SEQ ID NO: 923485 - DNA, 18 bp, Homo sapiens
gcattattaaattgtaaa

SEQ ID NO: 923486 - DNA, 16 bp, Homo sapiens
gcattattcctccagg

SEQ ID NO: 923487 - DNA, 22 bp, Homo sapiens
gcattattggaatataattgtt

SEQ ID NO: 923488 - DNA, 15 bp, Homo sapiens
gcattatttaatgtt

SEQ ID NO: 923489 - DNA, 17 bp, Homo sapiens
gcattatttaatgtttg

SEQ ID NO: 923490 - DNA, 18 bp, Homo sapiens
gcattatttaatgtttga

SEQ ID NO: 923491 - DNA, 15 bp, Homo sapiens
gcattcaataaatat

SEQ ID NO: 923492 - DNA, 18 bp, Homo sapiens
gcattcaggcagcactga

SEQ ID NO: 923493 - DNA, 23 bp, Homo sapiens
gcattcaggcagcactgacaata

SEQ ID NO: 923494 - DNA, 23 bp, Homo sapiens
gcattcagtgcacctgcctcagc

SEQ ID NO: 923495 - DNA, 17 bp, Homo sapiens
gcattccacacctaaga

SEQ ID NO: 923496 - DNA, 11 bp, Homo sapiens
gcattccagaa

SEQ ID NO: 923497 - DNA, 15 bp, Homo sapiens
gcattccagcccctc

SEQ ID NO: 923498 - DNA, 12 bp, Homo sapiens
gcattcccacca

SEQ ID NO: 923499 - DNA, 14 bp, Homo sapiens
gcattcccaggaaa

SEQ ID NO: 923500 - DNA, 21 bp, Homo sapiens
gcattccctgagtcaccagga

SEQ ID NO: 923501 - DNA, 16 bp, Homo sapiens
gcattcctacaaagat

SEQ ID NO: 923502 - DNA, 19 bp, Homo sapiens
gcattcctacaaagatgtt

SEQ ID NO: 923503 - DNA, 20 bp, Homo sapiens
gcattcctcaggaaggacat

SEQ ID NO: 923504 - DNA, 14 bp, Homo sapiens
gcattcctgtgccc

SEQ ID NO: 923505 - DNA, 17 bp, Homo sapiens
gcattccttacttgcac

SEQ ID NO: 923506 - DNA, 20 bp, Homo sapiens
gcattccttacttgcactgt

SEQ ID NO: 923507 - DNA, 16 bp, Homo sapiens
gcattctacacctgga

SEQ ID NO: 923508 - DNA, 19 bp, Homo sapiens
gcattctctcccatcctgg

SEQ ID NO: 923509 - DNA, 15 bp, Homo sapiens
gcattctgagctggg

SEQ ID NO: 923510 - DNA, 18 bp, Homo sapiens
gcattctgataggagggg

SEQ ID NO: 923511 - DNA, 20 bp, Homo sapiens
gcattctgataggagggggc

SEQ ID NO: 923512 - DNA, 21 bp, Homo sapiens
gcattctgataggagggggcg

SEQ ID NO: 923513 - DNA, 17 bp, Homo sapiens
gcattctgtttcctctt

SEQ ID NO: 923514 - DNA, 19 bp, Homo sapiens
gcattctgtttcctcttga

SEQ ID NO: 923515 - DNA, 22 bp, Homo sapiens
gcattcttgtcacaataaatgt

SEQ ID NO: 923516 - DNA, 15 bp, Homo sapiens
gcattctttggtaat

SEQ ID NO: 923517 - DNA, 16 bp, Homo sapiens
gcattcttttaaaaga

SEQ ID NO: 923518 - DNA, 20 bp, Homo sapiens
gcattcttttaaagttttat

SEQ ID NO: 923519 - DNA, 17 bp, Homo sapiens
gcattgaaatgagcacc

SEQ ID NO: 923520 - DNA, 16 bp, Homo sapiens
gcattgaacacaaact

SEQ ID NO: 923521 - DNA, 18 bp, Homo sapiens
gcattgaacacaaactgt

SEQ ID NO: 923522 - DNA, 21 bp, Homo sapiens
gcattgaagagaactgcaact

SEQ ID NO: 923523 - DNA, 16 bp, Homo sapiens
gcattgaatatattat

SEQ ID NO: 923524 - DNA, 22 bp, Homo sapiens
gcattgactggtttacaggccc

SEQ ID NO: 923525 - DNA, 12 bp, Homo sapiens
gcattgagaact

SEQ ID NO: 923526 - DNA, 22 bp, Homo sapiens
gcattgagaactgcatatgttt

SEQ ID NO: 923527 - DNA, 17 bp, Homo sapiens
gcattgagcatattttc

SEQ ID NO: 923528 - DNA, 18 bp, Homo sapiens
gcattgaggaagagtctt

SEQ ID NO: 923529 - DNA, 16 bp, Homo sapiens
gcattgataatcttca

SEQ ID NO: 923530 - DNA, 21 bp, Homo sapiens
gcattgataatcttcaggtga

SEQ ID NO: 923531 - DNA, 14 bp, Homo sapiens
gcattgcagccttg

SEQ ID NO: 923532 - DNA, 16 bp, Homo sapiens
gcattgcagccttgcg

SEQ ID NO: 923533 - DNA, 22 bp, Homo sapiens
gcattgccacggaaacatacag

SEQ ID NO: 923534 - DNA, 15 bp, Homo sapiens
gcattgctagataaa

SEQ ID NO: 923535 - DNA, 13 bp, Homo sapiens
gcattgctggttc

SEQ ID NO: 923536 - DNA, 15 bp, Homo sapiens
gcattgctttccact

SEQ ID NO: 923537 - DNA, 12 bp, Homo sapiens
gcattggatatt

SEQ ID NO: 923538 - DNA, 18 bp, Homo sapiens
gcattggatattttttac

SEQ ID NO: 923539 - DNA, 16 bp, Homo sapiens
gcattgggctgacacc

SEQ ID NO: 923540 - DNA, 18 bp, Homo sapiens
gcattggggggccgggca

SEQ ID NO: 923541 - DNA, 14 bp, Homo sapiens
gcattggtgactca

SEQ ID NO: 923542 - DNA, 15 bp, Homo sapiens
gcattggtgactcac

SEQ ID NO: 923543 - DNA, 18 bp, Homo sapiens
gcattgtatctgtctttc

SEQ ID NO: 923544 - DNA, 14 bp, Homo sapiens
gcattgtcctgtga

SEQ ID NO: 923545 - DNA, 12 bp, Homo sapiens
gcattgtctctc

SEQ ID NO: 923546 - DNA, 17 bp, Homo sapiens
gcattgtctttgctgta

SEQ ID NO: 923547 - DNA, 17 bp, Homo sapiens
gcattgtgattggcctg

SEQ ID NO: 923548 - DNA, 20 bp, Homo sapiens
gcattgtgtcagaaacatga

SEQ ID NO: 923549 - DNA, 15 bp, Homo sapiens
gcattgttagtttag

SEQ ID NO: 923550 - DNA, 21 bp, Homo sapiens
gcattgttagtttagtgtgtg

SEQ ID NO: 923551 - DNA, 19 bp, Homo sapiens
gcattgttattgtggaaga

SEQ ID NO: 923552 - DNA, 14 bp, Homo sapiens
gcattgttccacac

SEQ ID NO: 923553 - DNA, 22 bp, Homo sapiens
gcattgtttgcttattgttcca

SEQ ID NO: 923554 - DNA, 18 bp, Homo sapiens
gcatttaaaatggaaaat

SEQ ID NO: 923555 - DNA, 21 bp, Homo sapiens
gcatttaacccccctgtacac

SEQ ID NO: 923556 - DNA, 22 bp, Homo sapiens
gcatttaacccccctgtacaca

SEQ ID NO: 923557 - DNA, 23 bp, Homo sapiens
gcatttaacttacatttgtactt

SEQ ID NO: 923558 - DNA, 13 bp, Homo sapiens
gcatttaataaag

SEQ ID NO: 923559 - DNA, 17 bp, Homo sapiens
gcatttaataaagatga

SEQ ID NO: 923560 - DNA, 19 bp, Homo sapiens
gcatttaataaagatgagt

SEQ ID NO: 923561 - DNA, 22 bp, Homo sapiens
gcatttagttttatggcatgat

SEQ ID NO: 923562 - DNA, 15 bp, Homo sapiens
gcatttatttctctg

SEQ ID NO: 923563 - DNA, 13 bp, Homo sapiens
gcatttattttat

SEQ ID NO: 923564 - DNA, 17 bp, Homo sapiens
gcatttcaaagccctgc

SEQ ID NO: 923565 - DNA, 23 bp, Homo sapiens
gcatttcaaagccctgcctctgt

SEQ ID NO: 923566 - DNA, 18 bp, Homo sapiens
gcatttcacgaactgttc

SEQ ID NO: 923567 - DNA, 21 bp, Homo sapiens
gcatttcagcttgaacctgct

SEQ ID NO: 923568 - DNA, 18 bp, Homo sapiens
gcatttcaggccagtgtg

SEQ ID NO: 923569 - DNA, 22 bp, Homo sapiens
gcatttcatgaaaaagctgctt

SEQ ID NO: 923570 - DNA, 20 bp, Homo sapiens
gcatttcattatgctttgaa

SEQ ID NO: 923571 - DNA, 22 bp, Homo sapiens
gcatttcattcaaatcagtgat

SEQ ID NO: 923572 - DNA, 21 bp, Homo sapiens
gcatttccaacaccacagaca

SEQ ID NO: 923573 - DNA, 18 bp, Homo sapiens
cctgtgcctgggccctgg

SEQ ID NO: 923574 - DNA, 13 bp, Homo sapiens
cctgtgccttcct

SEQ ID NO: 923575 - DNA, 16 bp, Homo sapiens
cctgtgcctttcctat

SEQ ID NO: 923576 - DNA, 21 bp, Homo sapiens
cctgtgcctttcctatcacct

SEQ ID NO: 923577 - DNA, 13 bp, Homo sapiens
cctgtgctagttt

SEQ ID NO: 923578 - DNA, 22 bp, Homo sapiens
cctgtgctccgtgcctccacca

SEQ ID NO: 923579 - DNA, 23 bp, Homo sapiens
cctgtgctgcccgtcttcagcct

SEQ ID NO: 923580 - DNA, 13 bp, Homo sapiens
cctgtgctgctgc

SEQ ID NO: 923581 - DNA, 14 bp, Homo sapiens
cctgtgctggtgtc

SEQ ID NO: 923582 - DNA, 17 bp, Homo sapiens
cctgtgctggtgtcctg

SEQ ID NO: 923583 - DNA, 22 bp, Homo sapiens
cctgtgctggtgtcctgaccac

SEQ ID NO: 923584 - DNA, 23 bp, Homo sapiens
cctgtgcttgcttagagtgccca

SEQ ID NO: 923585 - DNA, 14 bp, Homo sapiens
cctgtgctttctgc

SEQ ID NO: 923586 - DNA, 18 bp, Homo sapiens
cctgtgctttctgcatgc

SEQ ID NO: 923587 - DNA, 15 bp, Homo sapiens
cctgtgctttgagat

SEQ ID NO: 923588 - DNA, 19 bp, Homo sapiens
cctgtggaaggcagagaaa

SEQ ID NO: 923589 - DNA, 20 bp, Homo sapiens
cctgtggaagggactaggag

SEQ ID NO: 923590 - DNA, 24 bp, Homo sapiens
cctgtggaagggactaggagcact

SEQ ID NO: 923591 - DNA, 15 bp, Homo sapiens
cctgtggagctcagc

SEQ ID NO: 923592 - DNA, 17 bp, Homo sapiens
cctgtggagtccagctc

SEQ ID NO: 923593 - DNA, 16 bp, Homo sapiens
cctgttttgtacatag

SEQ ID NO: 923594 - DNA, 18 bp, Homo sapiens
cctgttttgttggaaggt

SEQ ID NO: 923595 - DNA, 18 bp, Homo sapiens
cctgtttttaagctgttt

SEQ ID NO: 923596 - DNA, 19 bp, Homo sapiens
cctgtttttaagctgtttc

SEQ ID NO: 923597 - DNA, 13 bp, Homo sapiens
cctgtttttcaca

SEQ ID NO: 923598 - DNA, 13 bp, Homo sapiens
cctgttttttgta

SEQ ID NO: 923599 - DNA, 16 bp, Homo sapiens
ccttaaaaaatgtttc

SEQ ID NO: 923600 - DNA, 23 bp, Homo sapiens
ccttaaaaactggcccgtggaga

SEQ ID NO: 923601 - DNA, 12 bp, Homo sapiens
ccttaaaaatgc

SEQ ID NO: 923602 - DNA, 16 bp, Homo sapiens
ccttaaaaccaaagag

SEQ ID NO: 923603 - DNA, 17 bp, Homo sapiens
ccttaaaaccaaagagg

SEQ ID NO: 923604 - DNA, 18 bp, Homo sapiens
ccttaaaattaccagaca

SEQ ID NO: 923605 - DNA, 20 bp, Homo sapiens
ccttaaacaaaaattaaaat

SEQ ID NO: 923606 - DNA, 23 bp, Homo sapiens
ccttaaacctgaagatgtctcct

SEQ ID NO: 923607 - DNA, 23 bp, Homo sapiens
ccttaaagaaagtcgaattaata

SEQ ID NO: 923608 - DNA, 22 bp, Homo sapiens
ccttaaagagggacaggctgaa

SEQ ID NO: 923609 - DNA, 22 bp, Homo sapiens
ccttaaaggcaccatctaatag

SEQ ID NO: 923610 - DNA, 12 bp, Homo sapiens
ccttaaatacac

SEQ ID NO: 923611 - DNA, 14 bp, Homo sapiens
ccttaaatacactg

SEQ ID NO: 923612 - DNA, 21 bp, Homo sapiens
ccttaaatacactgaattgaa

SEQ ID NO: 923613 - DNA, 22 bp, Homo sapiens
ccttaaatacagataattcatt

SEQ ID NO: 923614 - DNA, 12 bp, Homo sapiens
ccttaaattttt

SEQ ID NO: 923615 - DNA, 22 bp, Homo sapiens
ccttaaatttttagccatttct

SEQ ID NO: 923616 - DNA, 13 bp, Homo sapiens
ccttaaatttttg

SEQ ID NO: 923617 - DNA, 13 bp, Homo sapiens
ccttaacccaagg

SEQ ID NO: 923618 - DNA, 15 bp, Homo sapiens
ccttaacccaaggag

SEQ ID NO: 923619 - DNA, 17 bp, Homo sapiens
ccttaacccaaggagca

SEQ ID NO: 923620 - DNA, 14 bp, Homo sapiens
ccttaactccaaga

SEQ ID NO: 923621 - DNA, 15 bp, Homo sapiens
ccttaagaactgtgt

SEQ ID NO: 923622 - DNA, 12 bp, Homo sapiens
ccttaagcaaat

SEQ ID NO: 923623 - DNA, 19 bp, Homo sapiens
ccttaagccataggcccag

SEQ ID NO: 923624 - DNA, 22 bp, Homo sapiens
ccttaagccataggcccaggat

SEQ ID NO: 923625 - DNA, 14 bp, Homo sapiens
ccttaaggtctcca

SEQ ID NO: 923626 - DNA, 11 bp, Homo sapiens
ccttaatattt

SEQ ID NO: 923627 - DNA, 12 bp, Homo sapiens
ccttaatatttc

SEQ ID NO: 923628 - DNA, 15 bp, Homo sapiens
ccttaatatttcttc

SEQ ID NO: 923629 - DNA, 13 bp, Homo sapiens
ccttaatcttgct

SEQ ID NO: 923630 - DNA, 16 bp, Homo sapiens
ccttaatcttgctttc

SEQ ID NO: 923631 - DNA, 16 bp, Homo sapiens
ccttaatgacaacact

SEQ ID NO: 923632 - DNA, 17 bp, Homo sapiens
ccttaatgacaacactt

SEQ ID NO: 923633 - DNA, 12 bp, Homo sapiens
ccttaatttaat

SEQ ID NO: 923634 - DNA, 16 bp, Homo sapiens
ccttaatttaattgct

SEQ ID NO: 923635 - DNA, 22 bp, Homo sapiens
ccttaatttaattgctttgaag

SEQ ID NO: 923636 - DNA, 21 bp, Homo sapiens
ccttacagagcatacaacaga

SEQ ID NO: 923637 - DNA, 14 bp, Homo sapiens
ccttacagcctctg

SEQ ID NO: 923638 - DNA, 12 bp, Homo sapiens
ccttacatctgg

SEQ ID NO: 923639 - DNA, 16 bp, Homo sapiens
ccttaccctcctctgc

SEQ ID NO: 923640 - DNA, 19 bp, Homo sapiens
ccttaccctcctctgctgg

SEQ ID NO: 923641 - DNA, 15 bp, Homo sapiens
ccttacctatttcct

SEQ ID NO: 923642 - DNA, 14 bp, Homo sapiens
ccttacctcgggga

SEQ ID NO: 923643 - DNA, 16 bp, Homo sapiens
ccttacctcggggaga

SEQ ID NO: 923644 - DNA, 20 bp, Homo sapiens
ccttacctcggtgccttcct

SEQ ID NO: 923645 - DNA, 13 bp, Homo sapiens
ccttacctctgga

SEQ ID NO: 923646 - DNA, 15 bp, Homo sapiens
ccttaccttggggct

SEQ ID NO: 923647 - DNA, 18 bp, Homo sapiens
ccttacctttcctgatgc

SEQ ID NO: 923648 - DNA, 14 bp, Homo sapiens
ccttactaattata

SEQ ID NO: 923649 - DNA, 20 bp, Homo sapiens
ccttactcaggggatgttta

SEQ ID NO: 923650 - DNA, 15 bp, Homo sapiens
ccttactctgagccc

SEQ ID NO: 923651 - DNA, 19 bp, Homo sapiens
ccttactctgagcccaggc

SEQ ID NO: 923652 - DNA, 22 bp, Homo sapiens
ccttactcttcttgaaatttta

SEQ ID NO: 923653 - DNA, 17 bp, Homo sapiens
ccttactggtttcccca

SEQ ID NO: 923654 - DNA, 19 bp, Homo sapiens
ccttactggtttccccagg

SEQ ID NO: 923655 - DNA, 18 bp, Homo sapiens
ccttactgtttacagttt

SEQ ID NO: 923656 - DNA, 20 bp, Homo sapiens
ccttacttccagcaagcaaa

SEQ ID NO: 923657 - DNA, 17 bp, Homo sapiens
ccttacttgcactgtta

SEQ ID NO: 923658 - DNA, 16 bp, Homo sapiens
ccttagaaaatgtgtc

SEQ ID NO: 923659 - DNA, 19 bp, Homo sapiens
ccttagaaatgtaaactgc

SEQ ID NO: 923660 - DNA, 14 bp, Homo sapiens
ccttagaacctttc

SEQ ID NO: 923661 - DNA, 18 bp, Homo sapiens
ccttagaacctttcttac

SEQ ID NO: 923662 - DNA, 23 bp, Homo sapiens
ccttagactccttctccccaatc

SEQ ID NO: 923663 - DNA, 17 bp, Homo sapiens
ccttagactcttttcct

SEQ ID NO: 923664 - DNA, 16 bp, Homo sapiens
ccttagcaaattctgt

SEQ ID NO: 923665 - DNA, 15 bp, Homo sapiens
ccttagcacagagag

SEQ ID NO: 923666 - DNA, 20 bp, Homo sapiens
ccttagcacagagagggaca

SEQ ID NO: 923667 - DNA, 22 bp, Homo sapiens
ccttagcaccttcagggctgag

SEQ ID NO: 923668 - DNA, 18 bp, Homo sapiens
ccttagccagttgtatat

SEQ ID NO: 923669 - DNA, 15 bp, Homo sapiens
ccttagccctgtctg

SEQ ID NO: 923670 - DNA, 14 bp, Homo sapiens
ccttagcctccctg

SEQ ID NO: 923671 - DNA, 12 bp, Homo sapiens
ccttagcctctc

SEQ ID NO: 923672 - DNA, 16 bp, Homo sapiens
ccttagcctctcccac

SEQ ID NO: 923673 - DNA, 21 bp, Homo sapiens
ccttagctatttatccctttc

SEQ ID NO: 923674 - DNA, 19 bp, Homo sapiens
ccttagctggcattacagc

SEQ ID NO: 923675 - DNA, 22 bp, Homo sapiens
ccttagctggcattacagctgg

SEQ ID NO: 923676 - DNA, 22 bp, Homo sapiens
ccttagcttagacctcagcctg

SEQ ID NO: 923677 - DNA, 20 bp, Homo sapiens
ccttaggaaaatgcttctgt

SEQ ID NO: 923678 - DNA, 15 bp, Homo sapiens
ccttaggatggggct

SEQ ID NO: 923679 - DNA, 19 bp, Homo sapiens
ccttaggatggggctccca

SEQ ID NO: 923680 - DNA, 18 bp, Homo sapiens
ccttaggcattatttaat

SEQ ID NO: 923681 - DNA, 19 bp, Homo sapiens
ccttaggcctacctgatgg

SEQ ID NO: 923682 - DNA, 16 bp, Homo sapiens
ccttaggcctctgaga

SEQ ID NO: 923683 - DNA, 13 bp, Homo sapiens
ccttaggccttcc

SEQ ID NO: 923684 - DNA, 15 bp, Homo sapiens
ccttaggccttcctc

SEQ ID NO: 923685 - DNA, 18 bp, Homo sapiens
ccttagggaagctggcct

SEQ ID NO: 923686 - DNA, 16 bp, Homo sapiens
ccttagggcactgggc

SEQ ID NO: 923687 - DNA, 15 bp, Homo sapiens
ccttagtagtcaaaa

SEQ ID NO: 923688 - DNA, 14 bp, Homo sapiens
ccttagtcttctca

SEQ ID NO: 923689 - DNA, 14 bp, Homo sapiens
ccttagtctttcct

SEQ ID NO: 923690 - DNA, 16 bp, Homo sapiens
ccttagtgccaggagg

SEQ ID NO: 923691 - DNA, 20 bp, Homo sapiens
ccttagtgccaggagggcac

SEQ ID NO: 923692 - DNA, 19 bp, Homo sapiens
ccttagtgggccagggctg

SEQ ID NO: 923693 - DNA, 15 bp, Homo sapiens
ccttagttggctgga

SEQ ID NO: 923694 - DNA, 16 bp, Homo sapiens
ccttatatttctgtgt

SEQ ID NO: 923695 - DNA, 14 bp, Homo sapiens
ccttatcaaaggac

SEQ ID NO: 923696 - DNA, 15 bp, Homo sapiens
ccttatcaagtgtct

SEQ ID NO: 923697 - DNA, 16 bp, Homo sapiens
ccttatcagcttcctg

SEQ ID NO: 923698 - DNA, 15 bp, Homo sapiens
ccttatccaggactc

SEQ ID NO: 923699 - DNA, 21 bp, Homo sapiens
ccttatctgtgcgtgaaacac

SEQ ID NO: 923700 - DNA, 23 bp, Homo sapiens
ccttatctttctaaaactgcctt

SEQ ID NO: 923701 - DNA, 14 bp, Homo sapiens
ccttatcttttact

SEQ ID NO: 923702 - DNA, 18 bp, Homo sapiens
ccttatgagcgtcactgc

SEQ ID NO: 923703 - DNA, 22 bp, Homo sapiens
ccttatgcccggcgccgggcac

SEQ ID NO: 923704 - DNA, 17 bp, Homo sapiens
gccaagctaatctgcct

SEQ ID NO: 923705 - DNA, 15 bp, Homo sapiens
gccaagctccctgga

SEQ ID NO: 923706 - DNA, 15 bp, Homo sapiens
gccaagctgaagcta

SEQ ID NO: 923707 - DNA, 12 bp, Homo sapiens
gccaagctgcac

SEQ ID NO: 923708 - DNA, 15 bp, Homo sapiens
gccaagctgcacaat

SEQ ID NO: 923709 - DNA, 15 bp, Homo sapiens
gccaagcttcctgtg

SEQ ID NO: 923710 - DNA, 17 bp, Homo sapiens
gccaagcttcctgtgcc

SEQ ID NO: 923711 - DNA, 23 bp, Homo sapiens
gccaagcttcctgtgccctcacc

SEQ ID NO: 923712 - DNA, 15 bp, Homo sapiens
gccaagctttaaatt

SEQ ID NO: 923713 - DNA, 19 bp, Homo sapiens
gccaagctttgaggctctg

SEQ ID NO: 923714 - DNA, 17 bp, Homo sapiens
gccaaggactgccgacc

SEQ ID NO: 923715 - DNA, 12 bp, Homo sapiens
gccaaggagctg

SEQ ID NO: 923716 - DNA, 19 bp, Homo sapiens
ccttattgctgtcctggag

SEQ ID NO: 923717 - DNA, 19 bp, Homo sapiens
ccttatttctctctcctgg

SEQ ID NO: 923718 - DNA, 23 bp, Homo sapiens
ccttatttctctctcctggtgtg

SEQ ID NO: 923719 - DNA, 18 bp, Homo sapiens
ccttattttgataaaatg

SEQ ID NO: 923720 - DNA, 14 bp, Homo sapiens
ccttattttgtatt

SEQ ID NO: 923721 - DNA, 22 bp, Homo sapiens
ccttcaaagtctcaatgaaata

SEQ ID NO: 923722 - DNA, 15 bp, Homo sapiens
ccttcaaataaagaa

SEQ ID NO: 923723 - DNA, 24 bp, Homo sapiens
ccttcaaataaagaaatttggtac

SEQ ID NO: 923724 - DNA, 14 bp, Homo sapiens
ccttcaaccattcc

SEQ ID NO: 923725 - DNA, 15 bp, Homo sapiens
ccttcaactcctggc

SEQ ID NO: 923726 - DNA, 18 bp, Homo sapiens
ccttcaactcctggctcc

SEQ ID NO: 923727 - DNA, 15 bp, Homo sapiens
ccttcaaggcctccc

SEQ ID NO: 923728 - DNA, 17 bp, Homo sapiens
ccttcaagttagctcag

SEQ ID NO: 923729 - DNA, 21 bp, Homo sapiens
ccttcaatgaattaattcaga

SEQ ID NO: 923730 - DNA, 13 bp, Homo sapiens
ccttcacaaatgt

SEQ ID NO: 923731 - DNA, 20 bp, Homo sapiens
ccttcacatcctgtgtttct

SEQ ID NO: 923732 - DNA, 18 bp, Homo sapiens
ccttcaccgctccccaca

SEQ ID NO: 923733 - DNA, 17 bp, Homo sapiens
ccttcacctttggtgca

SEQ ID NO: 923734 - DNA, 15 bp, Homo sapiens
ccttcactgaacatg

SEQ ID NO: 923735 - DNA, 14 bp, Homo sapiens
ccttcactgccatg

SEQ ID NO: 923736 - DNA, 14 bp, Homo sapiens
ccttcactgcccca

SEQ ID NO: 923737 - DNA, 19 bp, Homo sapiens
ccttcactgttccctctgg

SEQ ID NO: 923738 - DNA, 14 bp, Homo sapiens
ccttcacttaggaa

SEQ ID NO: 923739 - DNA, 18 bp, Homo sapiens
ccttcacttttctgagtt

SEQ ID NO: 923740 - DNA, 18 bp, Homo sapiens
ccttcagaacagaggcat

SEQ ID NO: 923741 - DNA, 13 bp, Homo sapiens
ccttcagacacat

SEQ ID NO: 923742 - DNA, 17 bp, Homo sapiens
ccttcagacaccctcaa

SEQ ID NO: 923743 - DNA, 15 bp, Homo sapiens
ccttcagaccccagt

SEQ ID NO: 923744 - DNA, 21 bp, Homo sapiens
ccttcagactttgcttcccat

SEQ ID NO: 923745 - DNA, 19 bp, Homo sapiens
ccttcagagccagccggct

SEQ ID NO: 923746 - DNA, 12 bp, Homo sapiens
ccttcagagctc

SEQ ID NO: 923747 - DNA, 16 bp, Homo sapiens
ccttcagatggaaact

SEQ ID NO: 923748 - DNA, 12 bp, Homo sapiens
ccttcagccctg

SEQ ID NO: 923749 - DNA, 16 bp, Homo sapiens
ccttcagccctggcca

SEQ ID NO: 923750 - DNA, 12 bp, Homo sapiens
ccttcagctcca

SEQ ID NO: 923751 - DNA, 17 bp, Homo sapiens
ccttcagctcctgagta

SEQ ID NO: 923752 - DNA, 18 bp, Homo sapiens
ccttcaggactctgcggg

SEQ ID NO: 923753 - DNA, 24 bp, Homo sapiens
ccttcaggactctgcgggaggctg

SEQ ID NO: 923754 - DNA, 18 bp, Homo sapiens
ccttcagggagacaggca

SEQ ID NO: 923755 - DNA, 21 bp, Homo sapiens
ccttcagggagacaggcaggg

SEQ ID NO: 923756 - DNA, 20 bp, Homo sapiens
ccttcagggattccctgtcc

SEQ ID NO: 923757 - DNA, 22 bp, Homo sapiens
ccttcagggattccctgtcccc

SEQ ID NO: 923758 - DNA, 19 bp, Homo sapiens
ccttcagggccagaaggag

SEQ ID NO: 923759 - DNA, 11 bp, Homo sapiens
ccttcaggttt

SEQ ID NO: 923760 - DNA, 19 bp, Homo sapiens
ccttcagtaccctctcagc

SEQ ID NO: 923761 - DNA, 20 bp, Homo sapiens
ccttcagtaccctctcagct

SEQ ID NO: 923762 - DNA, 15 bp, Homo sapiens
ccttcagtctgctcc

SEQ ID NO: 923763 - DNA, 16 bp, Homo sapiens
ccttcagtctgctcca

SEQ ID NO: 923764 - DNA, 19 bp, Homo sapiens
ccttcagtgagcccctccc

SEQ ID NO: 923765 - DNA, 23 bp, Homo sapiens
ccttcagtgagcccctccccagc

SEQ ID NO: 923766 - DNA, 16 bp, Homo sapiens
ccttcagttttagcta

SEQ ID NO: 923767 - DNA, 20 bp, Homo sapiens
ccttcataccgcctcgtgcc

SEQ ID NO: 923768 - DNA, 15 bp, Homo sapiens
ccttcatctccaggg

SEQ ID NO: 923769 - DNA, 16 bp, Homo sapiens
ccttcatcttcctgtg

SEQ ID NO: 923770 - DNA, 17 bp, Homo sapiens
ccttcatcttcctgtgt

SEQ ID NO: 923771 - DNA, 22 bp, Homo sapiens
ccttcatcttcctgtgtcctga

SEQ ID NO: 923772 - DNA, 18 bp, Homo sapiens
ccttcatgacagcctcca

SEQ ID NO: 923773 - DNA, 21 bp, Homo sapiens
ccttcatgtggctcagtgcct

SEQ ID NO: 923774 - DNA, 21 bp, Homo sapiens
ccttcatgtggttcagtgcct

SEQ ID NO: 923775 - DNA, 22 bp, Homo sapiens
ccttcatttaaactaaattact

SEQ ID NO: 923776 - DNA, 15 bp, Homo sapiens
ccttcatttgcaatt

SEQ ID NO: 923777 - DNA, 21 bp, Homo sapiens
ccttccaaaacctgcttcctt

SEQ ID NO: 923778 - DNA, 14 bp, Homo sapiens
ccttccaagactga

SEQ ID NO: 923779 - DNA, 17 bp, Homo sapiens
ccttccacagttatctt

SEQ ID NO: 923780 - DNA, 17 bp, Homo sapiens
ccttccacctcctagag

SEQ ID NO: 923781 - DNA, 13 bp, Homo sapiens
ccttccactgtag

SEQ ID NO: 923782 - DNA, 16 bp, Homo sapiens
ccttccagagcccaag

SEQ ID NO: 923783 - DNA, 20 bp, Homo sapiens
ccttccagatcactgccaca

SEQ ID NO: 923784 - DNA, 12 bp, Homo sapiens
ccttccagcctg

SEQ ID NO: 923785 - DNA, 16 bp, Homo sapiens
ccttccagcctgggac

SEQ ID NO: 923786 - DNA, 23 bp, Homo sapiens
ccttccagcctgggacacacaca

SEQ ID NO: 923787 - DNA, 16 bp, Homo sapiens
ccttccagctcctgta

SEQ ID NO: 923788 - DNA, 12 bp, Homo sapiens
ccttccagctgc

SEQ ID NO: 923789 - DNA, 13 bp, Homo sapiens
ccttccagctgct

SEQ ID NO: 923790 - DNA, 15 bp, Homo sapiens
ccttccagctgctgt

SEQ ID NO: 923791 - DNA, 20 bp, Homo sapiens
ccttccaggaatgctgggcc

SEQ ID NO: 923792 - DNA, 13 bp, Homo sapiens
ccttccaggtggg

SEQ ID NO: 923793 - DNA, 15 bp, Homo sapiens
ccttccagtggctcg

SEQ ID NO: 923794 - DNA, 23 bp, Homo sapiens
ccttccatagcctaatccctggg

SEQ ID NO: 923795 - DNA, 19 bp, Homo sapiens
ccttccatccctaccccct

SEQ ID NO: 923796 - DNA, 23 bp, Homo sapiens
ccttccatcttgtggggccagga

SEQ ID NO: 923797 - DNA, 23 bp, Homo sapiens
ccttccatggtgtgatcgtctga

SEQ ID NO: 923798 - DNA, 21 bp, Homo sapiens
ccttccatgtcaggccagcct

SEQ ID NO: 923799 - DNA, 15 bp, Homo sapiens
ccttccattcagatg

SEQ ID NO: 923800 - DNA, 21 bp, Homo sapiens
ccttcccaaggttactcagca

SEQ ID NO: 923801 - DNA, 14 bp, Homo sapiens
ccttcccagccctc

SEQ ID NO: 923802 - DNA, 15 bp, Homo sapiens
ccttcccagccctca

SEQ ID NO: 923803 - DNA, 17 bp, Homo sapiens
ccttcccagctctccct

SEQ ID NO: 923804 - DNA, 18 bp, Homo sapiens
ccttcccagctctccctc

SEQ ID NO: 923805 - DNA, 21 bp, Homo sapiens
ccttcccagctctccctctgg

SEQ ID NO: 923806 - DNA, 15 bp, Homo sapiens
ccttcccaggacccc

SEQ ID NO: 923807 - DNA, 20 bp, Homo sapiens
ccttcccagtgggctgtgtt

SEQ ID NO: 923808 - DNA, 14 bp, Homo sapiens
ccttcccatcgctg

SEQ ID NO: 923809 - DNA, 15 bp, Homo sapiens
ccttcccatcgctgt

SEQ ID NO: 923810 - DNA, 15 bp, Homo sapiens
ccttcccatgcctgt

SEQ ID NO: 923811 - DNA, 14 bp, Homo sapiens
ccttccccagactc

SEQ ID NO: 923812 - DNA, 19 bp, Homo sapiens
ccttccccagactcagctc

SEQ ID NO: 923813 - DNA, 12 bp, Homo sapiens
ccttccccagcc

SEQ ID NO: 923814 - DNA, 18 bp, Homo sapiens
ccttccccaggcccacca

SEQ ID NO: 923815 - DNA, 17 bp, Homo sapiens
ccttcccccagcccatc

SEQ ID NO: 923816 - DNA, 20 bp, Homo sapiens
ccttcccccatcccctttcc

SEQ ID NO: 923817 - DNA, 16 bp, Homo sapiens
ccttccccccatctct

SEQ ID NO: 923818 - DNA, 17 bp, Homo sapiens
ccttccccccatctctg

SEQ ID NO: 923819 - DNA, 16 bp, Homo sapiens
ccttccccctcccagg

SEQ ID NO: 923820 - DNA, 19 bp, Homo sapiens
ccttccccctgtagactag

SEQ ID NO: 923821 - DNA, 15 bp, Homo sapiens
ccttccccgtcccct

SEQ ID NO: 923822 - DNA, 20 bp, Homo sapiens
ccttccccgtcccctgcagc

SEQ ID NO: 923823 - DNA, 15 bp, Homo sapiens
ccttcccctacacct

SEQ ID NO: 923824 - DNA, 12 bp, Homo sapiens
ccttcccctccc

SEQ ID NO: 923825 - DNA, 15 bp, Homo sapiens
ccttcccctccctgg

SEQ ID NO: 923826 - DNA, 15 bp, Homo sapiens
ccttcccctccctgt

SEQ ID NO: 923827 - DNA, 20 bp, Homo sapiens
ccttcccctgcacctggcct

SEQ ID NO: 923828 - DNA, 18 bp, Homo sapiens
ccttccccttgcccaggg

SEQ ID NO: 923829 - DNA, 22 bp, Homo sapiens
ccttccccttgcccagggctca

SEQ ID NO: 923830 - DNA, 18 bp, Homo sapiens
ccttccccttttgcctgg

SEQ ID NO: 923831 - DNA, 18 bp, Homo sapiens
ccttcccgacccagccag

SEQ ID NO: 923832 - DNA, 20 bp, Homo sapiens
gccaccaaagctgcccactg

SEQ ID NO: 923833 - DNA, 18 bp, Homo sapiens
gccaccaacttacaaaaa

SEQ ID NO: 923834 - DNA, 19 bp, Homo sapiens
gccaccaagagggacgcct

SEQ ID NO: 923835 - DNA, 16 bp, Homo sapiens
gccaccaccacctgac

SEQ ID NO: 923836 - DNA, 17 bp, Homo sapiens
gccaccaccacgcagcc

SEQ ID NO: 923837 - DNA, 17 bp, Homo sapiens
gccaccaccctcaggtg

SEQ ID NO: 923838 - DNA, 17 bp, Homo sapiens
gccacgttcagggaggg

SEQ ID NO: 923839 - DNA, 18 bp, Homo sapiens
gccactaaagcttcagac

SEQ ID NO: 923840 - DNA, 22 bp, Homo sapiens
gccactaaagcttcagactcaa

SEQ ID NO: 923841 - DNA, 20 bp, Homo sapiens
gccactaagaacccctctgc

SEQ ID NO: 923842 - DNA, 13 bp, Homo sapiens
gccactaagcaga

SEQ ID NO: 923843 - DNA, 14 bp, Homo sapiens
gccactaagcagag

SEQ ID NO: 923844 - DNA, 16 bp, Homo sapiens
gccactaagcagagga

SEQ ID NO: 923845 - DNA, 23 bp, Homo sapiens
gccactaattttagtattcattc

SEQ ID NO: 923846 - DNA, 19 bp, Homo sapiens
gccactacactccagcctg

SEQ ID NO: 923847 - DNA, 20 bp, Homo sapiens
gccactacactccagcctga

SEQ ID NO: 923848 - DNA, 21 bp, Homo sapiens
gccactacactccagcctgag

SEQ ID NO: 923849 - DNA, 22 bp, Homo sapiens
gccactacactccagcctgagc

SEQ ID NO: 923850 - DNA, 23 bp, Homo sapiens
gccactacatttgctccatcctc

SEQ ID NO: 923851 - DNA, 17 bp, Homo sapiens
gccactaggtgtcccca

SEQ ID NO: 923852 - DNA, 12 bp, Homo sapiens
gccactcaccct

SEQ ID NO: 923853 - DNA, 22 bp, Homo sapiens
gccactcacccttcctggccca

SEQ ID NO: 923854 - DNA, 19 bp, Homo sapiens
gccactcactaggccccca

SEQ ID NO: 923855 - DNA, 23 bp, Homo sapiens
gccactcactaggcccccacttg

SEQ ID NO: 923856 - DNA, 16 bp, Homo sapiens
gccactcagaggcccc

SEQ ID NO: 923857 - DNA, 18 bp, Homo sapiens
gccactcagaggccccca

SEQ ID NO: 923858 - DNA, 20 bp, Homo sapiens
gccactcagaggcccccagt

SEQ ID NO: 923859 - DNA, 23 bp, Homo sapiens
gccactcagaggcccccagtggg

SEQ ID NO: 923860 - DNA, 18 bp, Homo sapiens
gccactcagccatttccc

SEQ ID NO: 923861 - DNA, 14 bp, Homo sapiens
gccactcatttcat

SEQ ID NO: 923862 - DNA, 20 bp, Homo sapiens
gccactcatttcatctcatt

SEQ ID NO: 923863 - DNA, 12 bp, Homo sapiens
gccactccaaac

SEQ ID NO: 923864 - DNA, 14 bp, Homo sapiens
gccactccaaactc

SEQ ID NO: 923865 - DNA, 17 bp, Homo sapiens
gccactccaagccccct

SEQ ID NO: 923866 - DNA, 21 bp, Homo sapiens
gccactccaagccccctggca

SEQ ID NO: 923867 - DNA, 18 bp, Homo sapiens
gccactccagacccctgg

SEQ ID NO: 923868 - DNA, 19 bp, Homo sapiens
gccactccagacccctggc

SEQ ID NO: 923869 - DNA, 20 bp, Homo sapiens
gccactccagacccctggct

SEQ ID NO: 923870 - DNA, 21 bp, Homo sapiens
gccactcccctaaactccagg

SEQ ID NO: 923871 - DNA, 22 bp, Homo sapiens
gccactcccggcactccatgct

SEQ ID NO: 923872 - DNA, 19 bp, Homo sapiens
gccactcccgggccaagac

SEQ ID NO: 923873 - DNA, 22 bp, Homo sapiens
gccactccctacccaatgtctc

SEQ ID NO: 923874 - DNA, 13 bp, Homo sapiens
gccactccctccc

SEQ ID NO: 923875 - DNA, 16 bp, Homo sapiens
gccactccctgagctt

SEQ ID NO: 923876 - DNA, 15 bp, Homo sapiens
gccactccctgggac

SEQ ID NO: 923877 - DNA, 16 bp, Homo sapiens
gccactcctccctccg

SEQ ID NO: 923878 - DNA, 23 bp, Homo sapiens
gccactcctctgactcagggctc

SEQ ID NO: 923879 - DNA, 18 bp, Homo sapiens
gccactcctgccaggccg

SEQ ID NO: 923880 - DNA, 13 bp, Homo sapiens
gccactcctgtcc

SEQ ID NO: 923881 - DNA, 18 bp, Homo sapiens
gccactcctgtcccgcct

SEQ ID NO: 923882 - DNA, 22 bp, Homo sapiens
gccactcctgtcccgccttcct

SEQ ID NO: 923883 - DNA, 18 bp, Homo sapiens
gccactcgcagtcgcagg

SEQ ID NO: 923884 - DNA, 15 bp, Homo sapiens
gccactctcccctcc

SEQ ID NO: 923885 - DNA, 15 bp, Homo sapiens
gccactgaaaagctt

SEQ ID NO: 923886 - DNA, 21 bp, Homo sapiens
gccactgaaaagctttcctga

SEQ ID NO: 923887 - DNA, 15 bp, Homo sapiens
gccactgaagctggg

SEQ ID NO: 923888 - DNA, 12 bp, Homo sapiens
gccactgaccca

SEQ ID NO: 923889 - DNA, 15 bp, Homo sapiens
gccactgacccacct

SEQ ID NO: 923890 - DNA, 18 bp, Homo sapiens
gccactgacttgctgtgt

SEQ ID NO: 923891 - DNA, 20 bp, Homo sapiens
gccactgacttgctgtgtga

SEQ ID NO: 923892 - DNA, 19 bp, Homo sapiens
gccactgatggtgacaggt

SEQ ID NO: 923893 - DNA, 18 bp, Homo sapiens
gccactgcacctgcccag

SEQ ID NO: 923894 - DNA, 18 bp, Homo sapiens
gccactgcactccagcct

SEQ ID NO: 923895 - DNA, 20 bp, Homo sapiens
gccactgcactccagcctgg

SEQ ID NO: 923896 - DNA, 22 bp, Homo sapiens
gccactgcactccagcctgggc

SEQ ID NO: 923897 - DNA, 14 bp, Homo sapiens
gccactgccaagct

SEQ ID NO: 923898 - DNA, 12 bp, Homo sapiens
gccactgccagg

SEQ ID NO: 923899 - DNA, 13 bp, Homo sapiens
gccactgccaggc

SEQ ID NO: 923900 - DNA, 14 bp, Homo sapiens
gccactgccaggca

SEQ ID NO: 923901 - DNA, 16 bp, Homo sapiens
gccactgccaggcacc

SEQ ID NO: 923902 - DNA, 19 bp, Homo sapiens
gccactgccaggcacctgg

SEQ ID NO: 923903 - DNA, 20 bp, Homo sapiens
gccactgccaggcacctggc

SEQ ID NO: 923904 - DNA, 22 bp, Homo sapiens
gccactgccccccgaggctgct

SEQ ID NO: 923905 - DNA, 18 bp, Homo sapiens
gccactgcccgagctggt

SEQ ID NO: 923906 - DNA, 14 bp, Homo sapiens
gccactgccgccta

SEQ ID NO: 923907 - DNA, 13 bp, Homo sapiens
gccactgcctctc

SEQ ID NO: 923908 - DNA, 16 bp, Homo sapiens
gccactgcctcttcct

SEQ ID NO: 923909 - DNA, 19 bp, Homo sapiens
gccactgcgccactgccat

SEQ ID NO: 923910 - DNA, 14 bp, Homo sapiens
gccactgcgcccag

SEQ ID NO: 923911 - DNA, 19 bp, Homo sapiens
gccactgctccgtggagga

SEQ ID NO: 923912 - DNA, 13 bp, Homo sapiens
gccactgctgctt

SEQ ID NO: 923913 - DNA, 10 bp, Homo sapiens
gccactgggc

SEQ ID NO: 923914 - DNA, 22 bp, Homo sapiens
gccactgggcacctgcgcacag

SEQ ID NO: 923915 - DNA, 13 bp, Homo sapiens
gccactgggcccc

SEQ ID NO: 923916 - DNA, 16 bp, Homo sapiens
gccactgggcccctgt

SEQ ID NO: 923917 - DNA, 18 bp, Homo sapiens
gccactgggctctggacc

SEQ ID NO: 923918 - DNA, 20 bp, Homo sapiens
gccactgggtctcactcctg

SEQ ID NO: 923919 - DNA, 15 bp, Homo sapiens
gccactgtccctgtc

SEQ ID NO: 923920 - DNA, 19 bp, Homo sapiens
gccactgtccctgtccttc

SEQ ID NO: 923921 - DNA, 20 bp, Homo sapiens
gccactgtccctgtccttct

SEQ ID NO: 923922 - DNA, 18 bp, Homo sapiens
gccactgtgaagagaacc

SEQ ID NO: 923923 - DNA, 18 bp, Homo sapiens
gccactgtggccagagct

SEQ ID NO: 923924 - DNA, 19 bp, Homo sapiens
gccactgtggccagagctg

SEQ ID NO: 923925 - DNA, 21 bp, Homo sapiens
gccactgtggccagagctgga

SEQ ID NO: 923926 - DNA, 12 bp, Homo sapiens
gccactgtgggt

SEQ ID NO: 923927 - DNA, 16 bp, Homo sapiens
gccactgtggtggcag

SEQ ID NO: 923928 - DNA, 17 bp, Homo sapiens
gccactgtgtctctgtt

SEQ ID NO: 923929 - DNA, 19 bp, Homo sapiens
gccactgtgtgccttctgc

SEQ ID NO: 923930 - DNA, 18 bp, Homo sapiens
gccacttaaaatgttcac

SEQ ID NO: 923931 - DNA, 19 bp, Homo sapiens
gccacttaatgtatgttac

SEQ ID NO: 923932 - DNA, 23 bp, Homo sapiens
gccacttcattccagcagctgca

SEQ ID NO: 923933 - DNA, 21 bp, Homo sapiens
gccacttctcactcaccacta

SEQ ID NO: 923934 - DNA, 24 bp, Homo sapiens
gccacttctcactcaccactacca

SEQ ID NO: 923935 - DNA, 19 bp, Homo sapiens
gccacttcttaaaggcctg

SEQ ID NO: 923936 - DNA, 15 bp, Homo sapiens
gccacttgaaatgtt

SEQ ID NO: 923937 - DNA, 23 bp, Homo sapiens
gccacttgacattccttgtcacc

SEQ ID NO: 923938 - DNA, 14 bp, Homo sapiens
gccacttggcccag

SEQ ID NO: 923939 - DNA, 18 bp, Homo sapiens
gccactttacccacctag

SEQ ID NO: 923940 - DNA, 23 bp, Homo sapiens
gccactttacccacctagaacac

SEQ ID NO: 923941 - DNA, 21 bp, Homo sapiens
gccactttgcacgacgccctc

SEQ ID NO: 923942 - DNA, 21 bp, Homo sapiens
gccactttggtacatggccag

SEQ ID NO: 923943 - DNA, 22 bp, Homo sapiens
gccacttttgaagtcttccctc

SEQ ID NO: 923944 - DNA, 21 bp, Homo sapiens
gccagaaacagtgggagccct

SEQ ID NO: 923945 - DNA, 22 bp, Homo sapiens
gccagaaacagtgggagccctg

SEQ ID NO: 923946 - DNA, 23 bp, Homo sapiens
gccagaaatgggcagttctccca

SEQ ID NO: 923947 - DNA, 18 bp, Homo sapiens
gccagaacgtggctctgc

SEQ ID NO: 923948 - DNA, 22 bp, Homo sapiens
gccagaacgtggctctgctggc

SEQ ID NO: 923949 - DNA, 16 bp, Homo sapiens
gccagaagagaattca

SEQ ID NO: 923950 - DNA, 14 bp, Homo sapiens
gccagaaggaaggt

SEQ ID NO: 923951 - DNA, 16 bp, Homo sapiens
gccagaaggagggcag

SEQ ID NO: 923952 - DNA, 18 bp, Homo sapiens
gccagaaggagggcagag

SEQ ID NO: 923953 - DNA, 23 bp, Homo sapiens
gccagaaggagggcagagccatg

SEQ ID NO: 923954 - DNA, 17 bp, Homo sapiens
gccagaaggagggggac

SEQ ID NO: 923955 - DNA, 18 bp, Homo sapiens
gccagaaggggctgcttg

SEQ ID NO: 923956 - DNA, 19 bp, Homo sapiens
gccagaaggtgcaggggcc

SEQ ID NO: 923957 - DNA, 17 bp, Homo sapiens
gccagaagtaccagact

SEQ ID NO: 923958 - DNA, 21 bp, Homo sapiens
gccagaagtttgtcaagtcaa

SEQ ID NO: 923959 - DNA, 19 bp, Homo sapiens
ccttggtgtgaccctctga

SEQ ID NO: 923960 - DNA, 19 bp, Homo sapiens
ccttggtgtttcccttcct

SEQ ID NO: 923961 - DNA, 20 bp, Homo sapiens
ccttggtgtttcccttcctc

SEQ ID NO: 923962 - DNA, 16 bp, Homo sapiens
ccttggttcccccact

SEQ ID NO: 923963 - DNA, 21 bp, Homo sapiens
ccttggttctgcactgttgcc

SEQ ID NO: 923964 - DNA, 16 bp, Homo sapiens
gaattgggaagctggg

SEQ ID NO: 923965 - DNA, 17 bp, Homo sapiens
gaattgggagcttggga

SEQ ID NO: 923966 - DNA, 15 bp, Homo sapiens
gaattggtgtatatc

SEQ ID NO: 923967 - DNA, 22 bp, Homo sapiens
gaattgtacctatttctgatga

SEQ ID NO: 923968 - DNA, 14 bp, Homo sapiens
gaattgtatcattt

SEQ ID NO: 923969 - DNA, 15 bp, Homo sapiens
gaattgtctctgggc

SEQ ID NO: 923970 - DNA, 19 bp, Homo sapiens
gaattgtgctttcaccaga

SEQ ID NO: 923971 - DNA, 18 bp, Homo sapiens
gaattgtggctatcctga

SEQ ID NO: 923972 - DNA, 20 bp, Homo sapiens
gaattgtgtattgatgcaat

SEQ ID NO: 923973 - DNA, 13 bp, Homo sapiens
gaattgttatgaa

SEQ ID NO: 923974 - DNA, 12 bp, Homo sapiens
gaatttaaataa

SEQ ID NO: 923975 - DNA, 16 bp, Homo sapiens
gaatttaaataaagtt

SEQ ID NO: 923976 - DNA, 17 bp, Homo sapiens
gaatttaaatataattc

SEQ ID NO: 923977 - DNA, 19 bp, Homo sapiens
gaatttaaggcaaaaaagg

SEQ ID NO: 923978 - DNA, 19 bp, Homo sapiens
gaatttactttcttcacca

SEQ ID NO: 923979 - DNA, 18 bp, Homo sapiens
gaatttagaaatattcaa

SEQ ID NO: 923980 - DNA, 21 bp, Homo sapiens
gaatttagggagaaatgttgt

SEQ ID NO: 923981 - DNA, 19 bp, Homo sapiens
gaatttaggtttttattag

SEQ ID NO: 923982 - DNA, 21 bp, Homo sapiens
gaatttatccaattttgatct

SEQ ID NO: 923983 - DNA, 17 bp, Homo sapiens
gaatttatctttaccaa

SEQ ID NO: 923984 - DNA, 21 bp, Homo sapiens
gaatttatgagatttactgct

SEQ ID NO: 923985 - DNA, 22 bp, Homo sapiens
gaatttattagtttaaaatgca

SEQ ID NO: 923986 - DNA, 17 bp, Homo sapiens
gaatttattcaattcct

SEQ ID NO: 923987 - DNA, 22 bp, Homo sapiens
gaatttattggcagccaaggaa

SEQ ID NO: 923988 - DNA, 12 bp, Homo sapiens
gaatttcacctg

SEQ ID NO: 923989 - DNA, 16 bp, Homo sapiens
gaatttcactgtcttt

SEQ ID NO: 923990 - DNA, 17 bp, Homo sapiens
gaatttcagtataaaga

SEQ ID NO: 923991 - DNA, 17 bp, Homo sapiens
gaatttctaaaaaacag

SEQ ID NO: 923992 - DNA, 16 bp, Homo sapiens
gaatttctagacagta

SEQ ID NO: 923993 - DNA, 20 bp, Homo sapiens
gaatttctagacagtattgc

SEQ ID NO: 923994 - DNA, 12 bp, Homo sapiens
gaatttctggcc

SEQ ID NO: 923995 - DNA, 16 bp, Homo sapiens
gaatttctggcctcct

SEQ ID NO: 923996 - DNA, 14 bp, Homo sapiens
gaatttcttaactt

SEQ ID NO: 923997 - DNA, 15 bp, Homo sapiens
gaatttcttaacttc

SEQ ID NO: 923998 - DNA, 16 bp, Homo sapiens
gaatttcttaacttct

SEQ ID NO: 923999 - DNA, 21 bp, Homo sapiens
gaatttcttaacttcttgctt

SEQ ID NO: 924000 - DNA, 22 bp, Homo sapiens
gaatttcttttgccgttattaa

SEQ ID NO: 924001 - DNA, 22 bp, Homo sapiens
gaatttgacctaggcaagtttg

SEQ ID NO: 924002 - DNA, 9 bp, Homo sapiens
gaatttgag

SEQ ID NO: 924003 - DNA, 17 bp, Homo sapiens
gaatttgagtgctctga

SEQ ID NO: 924004 - DNA, 13 bp, Homo sapiens
gaatttgattgct

SEQ ID NO: 924005 - DNA, 14 bp, Homo sapiens
gaatttgattgctt

SEQ ID NO: 924006 - DNA, 17 bp, Homo sapiens
gaatttgcatacttacc

SEQ ID NO: 924007 - DNA, 13 bp, Homo sapiens
gaatttgggcctc

SEQ ID NO: 924008 - DNA, 16 bp, Homo sapiens
gaatttgtaacctcag

SEQ ID NO: 924009 - DNA, 21 bp, Homo sapiens
gaatttgtaacctcagctctg

SEQ ID NO: 924010 - DNA, 19 bp, Homo sapiens
gaatttgtccattgtaaat

SEQ ID NO: 924011 - DNA, 21 bp, Homo sapiens
gaatttgtccattgtaaatct

SEQ ID NO: 924012 - DNA, 23 bp, Homo sapiens
gaattttaaaatctgagggaaat

SEQ ID NO: 924013 - DNA, 13 bp, Homo sapiens
gaattttaatgtg

SEQ ID NO: 924014 - DNA, 15 bp, Homo sapiens
gaattttatctgtgg

SEQ ID NO: 924015 - DNA, 15 bp, Homo sapiens
gaattttattttgct

SEQ ID NO: 924016 - DNA, 18 bp, Homo sapiens
gaattttatttttctgtg

SEQ ID NO: 924017 - DNA, 23 bp, Homo sapiens
gaattttcagaccccagcggctg

SEQ ID NO: 924018 - DNA, 13 bp, Homo sapiens
gaattttctctcc

SEQ ID NO: 924019 - DNA, 17 bp, Homo sapiens
gaattttctgtgttttg

SEQ ID NO: 924020 - DNA, 21 bp, Homo sapiens
gaattttctttgtgtagcttt

SEQ ID NO: 924021 - DNA, 15 bp, Homo sapiens
gaattttgagtgaat

SEQ ID NO: 924022 - DNA, 22 bp, Homo sapiens
gaattttgagtgaattagacct

SEQ ID NO: 924023 - DNA, 20 bp, Homo sapiens
gaattttgttctctgggaga

SEQ ID NO: 924024 - DNA, 23 bp, Homo sapiens
gaattttgttctctgggagaaaa

SEQ ID NO: 924025 - DNA, 22 bp, Homo sapiens
gaattttgtttggacttctttt

SEQ ID NO: 924026 - DNA, 19 bp, Homo sapiens
gaattttgttttacttttt

SEQ ID NO: 924027 - DNA, 17 bp, Homo sapiens
gaatttttaaacaagta

SEQ ID NO: 924028 - DNA, 18 bp, Homo sapiens
gaatttttaacaaaactt

SEQ ID NO: 924029 - DNA, 13 bp, Homo sapiens
gaatttttctgta

SEQ ID NO: 924030 - DNA, 15 bp, Homo sapiens
gaatttttgtttgga

SEQ ID NO: 924031 - DNA, 22 bp, Homo sapiens
gaattttttgaaatgggcattt

SEQ ID NO: 924032 - DNA, 14 bp, Homo sapiens
gaatttttttgtaa

SEQ ID NO: 924033 - DNA, 22 bp, Homo sapiens
gaattttttttttaaatgattc

SEQ ID NO: 924034 - DNA, 23 bp, Homo sapiens
gacaaaaaaaaaatagagagaga

SEQ ID NO: 924035 - DNA, 20 bp, Homo sapiens
gacaaaaaaatttaaaatta

SEQ ID NO: 924036 - DNA, 18 bp, Homo sapiens
gacaaaaaatgttttaaa

SEQ ID NO: 924037 - DNA, 20 bp, Homo sapiens
gacaaaaacaagactgcctc

SEQ ID NO: 924038 - DNA, 17 bp, Homo sapiens
gacaaaaacagcctcac

SEQ ID NO: 924039 - DNA, 18 bp, Homo sapiens
gacaaaaagtatattaaa

SEQ ID NO: 924040 - DNA, 18 bp, Homo sapiens
gacaaaaagtttccatat

SEQ ID NO: 924041 - DNA, 12 bp, Homo sapiens
gacaaaaataac

SEQ ID NO: 924042 - DNA, 13 bp, Homo sapiens
gacaaaaataaca

SEQ ID NO: 924043 - DNA, 15 bp, Homo sapiens
gacaaaaataacact

SEQ ID NO: 924044 - DNA, 17 bp, Homo sapiens
gacaaaaataacactgt

SEQ ID NO: 924045 - DNA, 21 bp, Homo sapiens
gacaaaaatgaactgaagttt

SEQ ID NO: 924046 - DNA, 14 bp, Homo sapiens
gacaaaagaaactt

SEQ ID NO: 924047 - DNA, 14 bp, Homo sapiens
gacaaaagggccag

SEQ ID NO: 924048 - DNA, 13 bp, Homo sapiens
gacaaaagtaaat

SEQ ID NO: 924049 - DNA, 16 bp, Homo sapiens
gacaaaatatttccca

SEQ ID NO: 924050 - DNA, 20 bp, Homo sapiens
gacaaaattaatacattcta

SEQ ID NO: 924051 - DNA, 24 bp, Homo sapiens
gacaaaatttgagaatacataaac

SEQ ID NO: 924052 - DNA, 17 bp, Homo sapiens
gacaaacaagggagaag

SEQ ID NO: 924053 - DNA, 17 bp, Homo sapiens
gacaaacacctcccagg

SEQ ID NO: 924054 - DNA, 14 bp, Homo sapiens
gacaaacagctcag

SEQ ID NO: 924055 - DNA, 16 bp, Homo sapiens
gacaaaccagagcaga

SEQ ID NO: 924056 - DNA, 19 bp, Homo sapiens
gacaaaccataactgacaa

SEQ ID NO: 924057 - DNA, 22 bp, Homo sapiens
gacaaaccataactgacaagag

SEQ ID NO: 924058 - DNA, 20 bp, Homo sapiens
gacaaactgccagttttgtt

SEQ ID NO: 924059 - DNA, 15 bp, Homo sapiens
gacaaactttgcatc

SEQ ID NO: 924060 - DNA, 21 bp, Homo sapiens
gacaaagaattccaaagcaaa

SEQ ID NO: 924061 - DNA, 14 bp, Homo sapiens
gacaaagacaaatt

SEQ ID NO: 924062 - DNA, 14 bp, Homo sapiens
gacaaagcaggagt

SEQ ID NO: 924063 - DNA, 11 bp, Homo sapiens
gacaaagccat

SEQ ID NO: 924064 - DNA, 20 bp, Homo sapiens
gacaaagccttaagcaaatt

SEQ ID NO: 924065 - DNA, 17 bp, Homo sapiens
gacaaaggagccttgat

SEQ ID NO: 924066 - DNA, 18 bp, Homo sapiens
gacaaaggagccttgata

SEQ ID NO: 924067 - DNA, 20 bp, Homo sapiens
gacaaaggccacaggcagtc

SEQ ID NO: 924068 - DNA, 18 bp, Homo sapiens
gacaaaggttttcctctt

SEQ ID NO: 924069 - DNA, 16 bp, Homo sapiens
gacaaagtcatcccct

SEQ ID NO: 924070 - DNA, 16 bp, Homo sapiens
gacaaagtcccagaat

SEQ ID NO: 924071 - DNA, 14 bp, Homo sapiens
gacaaagtgcctca

SEQ ID NO: 924072 - DNA, 23 bp, Homo sapiens
gacaaagttactgattcactgca

SEQ ID NO: 924073 - DNA, 14 bp, Homo sapiens
gacaaataggagtg

SEQ ID NO: 924074 - DNA, 11 bp, Homo sapiens
gacaaatattc

SEQ ID NO: 924075 - DNA, 19 bp, Homo sapiens
gacaaatcaacagaagcat

SEQ ID NO: 924076 - DNA, 20 bp, Homo sapiens
gacaaatcacatattttaaa

SEQ ID NO: 924077 - DNA, 19 bp, Homo sapiens
gacaaatcctttctgcccc

SEQ ID NO: 924078 - DNA, 21 bp, Homo sapiens
gacaaatgttgtcctgttaat

SEQ ID NO: 924079 - DNA, 14 bp, Homo sapiens
gacaaattagcatg

SEQ ID NO: 924080 - DNA, 19 bp, Homo sapiens
gacaaattagcatgcaagc

SEQ ID NO: 924081 - DNA, 15 bp, Homo sapiens
gacaaattctgtttc

SEQ ID NO: 924082 - DNA, 17 bp, Homo sapiens
gacaaattctgtttctt

SEQ ID NO: 924083 - DNA, 15 bp, Homo sapiens
gacaacaccttcctc

SEQ ID NO: 924084 - DNA, 18 bp, Homo sapiens
gacaacaccttcctcctg

SEQ ID NO: 924085 - DNA, 17 bp, Homo sapiens
gacaacacttaatagca

SEQ ID NO: 924086 - DNA, 12 bp, Homo sapiens
gacaacagaagc

SEQ ID NO: 924087 - DNA, 12 bp, Homo sapiens
gacaacagaagt

SEQ ID NO: 924088 - DNA, 13 bp, Homo sapiens
gacaacagactga

SEQ ID NO: 924089 - DNA, 12 bp, Homo sapiens
gacaacagctct

SEQ ID NO: 924090 - DNA, 15 bp, Homo sapiens
gacaacagtgctttg

SEQ ID NO: 924091 - DNA, 20 bp, Homo sapiens
gacaacagttctgagctgta

SEQ ID NO: 924092 - DNA, 22 bp, Homo sapiens
gacaacagttctgagctgtaat

SEQ ID NO: 924093 - DNA, 19 bp, Homo sapiens
gacaacatgaaacctattg

SEQ ID NO: 924094 - DNA, 20 bp, Homo sapiens
gacaacatgtttaataaata

SEQ ID NO: 924095 - DNA, 15 bp, Homo sapiens
gacaaccattaaagt

SEQ ID NO: 924096 - DNA, 18 bp, Homo sapiens
gacaaccattaaagtcag

SEQ ID NO: 924097 - DNA, 23 bp, Homo sapiens
gacaaccccccaagaccatccct

SEQ ID NO: 924098 - DNA, 20 bp, Homo sapiens
gacaaccctgcaaaggactg

SEQ ID NO: 924099 - DNA, 19 bp, Homo sapiens
gacaaccgatgctccagcc

SEQ ID NO: 924100 - DNA, 17 bp, Homo sapiens
gacaacgtttcagcgac

SEQ ID NO: 924101 - DNA, 21 bp, Homo sapiens
gacaactatcaattcttgaga

SEQ ID NO: 924102 - DNA, 16 bp, Homo sapiens
gacaacttatttaaaa

SEQ ID NO: 924103 - DNA, 18 bp, Homo sapiens
gacaagaatggaatagaa

SEQ ID NO: 924104 - DNA, 16 bp, Homo sapiens
gacaagacttcagtat

SEQ ID NO: 924105 - DNA, 20 bp, Homo sapiens
gacaagacttcagtatgttg

SEQ ID NO: 924106 - DNA, 24 bp, Homo sapiens
gacaagacttcagtatgttgtcaa

SEQ ID NO: 924107 - DNA, 16 bp, Homo sapiens
gacaagagagatgaaa

SEQ ID NO: 924108 - DNA, 14 bp, Homo sapiens
gacaagagctgctg

SEQ ID NO: 924109 - DNA, 15 bp, Homo sapiens
gacaagagctgctgt

SEQ ID NO: 924110 - DNA, 22 bp, Homo sapiens
gacaagagttggggacagaact

SEQ ID NO: 924111 - DNA, 23 bp, Homo sapiens
gacaagatggtccatttgttcct

SEQ ID NO: 924112 - DNA, 20 bp, Homo sapiens
gacaagattttttaattgtt

SEQ ID NO: 924113 - DNA, 14 bp, Homo sapiens
gacaagccctggca

SEQ ID NO: 924114 - DNA, 17 bp, Homo sapiens
gacaagcctgtccattg

SEQ ID NO: 924115 - DNA, 16 bp, Homo sapiens
gacaagcgtcacttct

SEQ ID NO: 924116 - DNA, 19 bp, Homo sapiens
gacaagctgacttggcact

SEQ ID NO: 924117 - DNA, 20 bp, Homo sapiens
gacaaggaaaatctatattt

SEQ ID NO: 924118 - DNA, 19 bp, Homo sapiens
gacaaggagaagagcaagg

SEQ ID NO: 924119 - DNA, 14 bp, Homo sapiens
gacaaggagagcgg

SEQ ID NO: 924120 - DNA, 21 bp, Homo sapiens
gacaaggagagcggaggagga

SEQ ID NO: 924121 - DNA, 16 bp, Homo sapiens
gacaagggaggcagtg

SEQ ID NO: 924122 - DNA, 17 bp, Homo sapiens
gacaagggaggcagtgg

SEQ ID NO: 924123 - DNA, 13 bp, Homo sapiens
gacaaggtgctaa

SEQ ID NO: 924124 - DNA, 16 bp, Homo sapiens
gacaagtgaagaacac

SEQ ID NO: 924125 - DNA, 20 bp, Homo sapiens
gacaagtgctgaacagtgga

SEQ ID NO: 924126 - DNA, 14 bp, Homo sapiens
gacaataacttctt

SEQ ID NO: 924127 - DNA, 14 bp, Homo sapiens
gacaataagtttga

SEQ ID NO: 924128 - DNA, 16 bp, Homo sapiens
gacaatactgctgcct

SEQ ID NO: 924129 - DNA, 14 bp, Homo sapiens
gacaatataaactg

SEQ ID NO: 924130 - DNA, 19 bp, Homo sapiens
gacaatatgtgagtgcctt

SEQ ID NO: 924131 - DNA, 21 bp, Homo sapiens
gacaatccccacataccatct

SEQ ID NO: 924132 - DNA, 18 bp, Homo sapiens
gacaatgaaatactccag

SEQ ID NO: 924133 - DNA, 20 bp, Homo sapiens
gacaatgatgatgataatga

SEQ ID NO: 924134 - DNA, 20 bp, Homo sapiens
gacaatgccctgctggcctg

SEQ ID NO: 924135 - DNA, 15 bp, Homo sapiens
gacaatggcaatagg

SEQ ID NO: 924136 - DNA, 16 bp, Homo sapiens
gacaatggcaatagga

SEQ ID NO: 924137 - DNA, 14 bp, Homo sapiens
gacaatggcagcta

SEQ ID NO: 924138 - DNA, 15 bp, Homo sapiens
gacaatggcagctag

SEQ ID NO: 924139 - DNA, 18 bp, Homo sapiens
gacaatgtgaaaagaaaa

SEQ ID NO: 924140 - DNA, 20 bp, Homo sapiens
gacaatgtgaaaagaaaaat

SEQ ID NO: 924141 - DNA, 14 bp, Homo sapiens
gacaatgttgcatt

SEQ ID NO: 924142 - DNA, 17 bp, Homo sapiens
gacaatgttttcttcaa

SEQ ID NO: 924143 - DNA, 16 bp, Homo sapiens
gacaattactcaggtt

SEQ ID NO: 924144 - DNA, 13 bp, Homo sapiens
gacaattagcaga

SEQ ID NO: 924145 - DNA, 14 bp, Homo sapiens
gacaattagcagaa

SEQ ID NO: 924146 - DNA, 21 bp, Homo sapiens
gacaattcctagataaaaaga

SEQ ID NO: 924147 - DNA, 19 bp, Homo sapiens
gacaatttattatggcaca

SEQ ID NO: 924148 - DNA, 18 bp, Homo sapiens
gacaatttgatacataat

SEQ ID NO: 924149 - DNA, 18 bp, Homo sapiens
gacacaaaactccgcccc

SEQ ID NO: 924150 - DNA, 15 bp, Homo sapiens
gacacaaattttcaa

SEQ ID NO: 924151 - DNA, 13 bp, Homo sapiens
gacacaacacaga

SEQ ID NO: 924152 - DNA, 22 bp, Homo sapiens
gacacaactgtgtgattaaaag

SEQ ID NO: 924153 - DNA, 14 bp, Homo sapiens
gacacaagcacttt

SEQ ID NO: 924154 - DNA, 16 bp, Homo sapiens
gacacaaggcacggcc

SEQ ID NO: 924155 - DNA, 20 bp, Homo sapiens
gacacaataggtctttctct

SEQ ID NO: 924156 - DNA, 20 bp, Homo sapiens
gacacaatatgtatgctttt

SEQ ID NO: 924157 - DNA, 22 bp, Homo sapiens
gacacaatatgtatgcttttta

SEQ ID NO: 924158 - DNA, 18 bp, Homo sapiens
gacacaatggcacctctg

SEQ ID NO: 924159 - DNA, 19 bp, Homo sapiens
gacacaatggcacctctgc

SEQ ID NO: 924160 - DNA, 12 bp, Homo sapiens
gacacacacaca

SEQ ID NO: 924161 - DNA, 13 bp, Homo sapiens
gacacacacacgc

SEQ ID NO: 924162 - DNA, 18 bp, Homo sapiens
gacacacacacgcacgca

SEQ ID NO: 924163 - DNA, 20 bp, Homo sapiens
gacacacacacgcacgcaca

SEQ ID NO: 924164 - DNA, 21 bp, Homo sapiens
gacacacacacgcacgcacac

SEQ ID NO: 924165 - DNA, 23 bp, Homo sapiens
gacacacacacgcacgcacacac

SEQ ID NO: 924166 - DNA, 14 bp, Homo sapiens
gacacacagcctag

SEQ ID NO: 924167 - DNA, 22 bp, Homo sapiens
gacacaccccaacatgcctgca

SEQ ID NO: 924168 - DNA, 13 bp, Homo sapiens
gacacacctctgc

SEQ ID NO: 924169 - DNA, 17 bp, Homo sapiens
gacacacggggctcggg

SEQ ID NO: 924170 - DNA, 18 bp, Homo sapiens
gacacactaaactctggg

SEQ ID NO: 924171 - DNA, 23 bp, Homo sapiens
gacacactaaactctggggcttg

SEQ ID NO: 924172 - DNA, 19 bp, Homo sapiens
gacacactaaccaagctga

SEQ ID NO: 924173 - DNA, 11 bp, Homo sapiens
gacacagaaaa

SEQ ID NO: 924174 - DNA, 16 bp, Homo sapiens
gacacagaaaatgttg

SEQ ID NO: 924175 - DNA, 13 bp, Homo sapiens
gacacagaattat

SEQ ID NO: 924176 - DNA, 15 bp, Homo sapiens
gacacagacccagga

SEQ ID NO: 924177 - DNA, 19 bp, Homo sapiens
gacacagaggctggcactg

SEQ ID NO: 924178 - DNA, 21 bp, Homo sapiens
gacacagatcccactggaaga

SEQ ID NO: 924179 - DNA, 18 bp, Homo sapiens
gacacagcacaagggcac

SEQ ID NO: 924180 - DNA, 15 bp, Homo sapiens
gacacagcagcttca

SEQ ID NO: 924181 - DNA, 18 bp, Homo sapiens
gacacagcagcttcacca

SEQ ID NO: 924182 - DNA, 23 bp, Homo sapiens
gacacagcagcttcaccagagca

SEQ ID NO: 924183 - DNA, 15 bp, Homo sapiens
gacacagcagtattg

SEQ ID NO: 924184 - DNA, 15 bp, Homo sapiens
gacacagcctccccc

SEQ ID NO: 924185 - DNA, 17 bp, Homo sapiens
gacacaggaaaaataaa

SEQ ID NO: 924186 - DNA, 23 bp, Homo sapiens
gacacaggaaaaataaacgtgga

SEQ ID NO: 924187 - DNA, 16 bp, Homo sapiens
gacacagggacttgaa

SEQ ID NO: 924188 - DNA, 19 bp, Homo sapiens
gacacagggacttgaagtt

SEQ ID NO: 924189 - DNA, 17 bp, Homo sapiens
gacacaggtcagggctc

SEQ ID NO: 924190 - DNA, 22 bp, Homo sapiens
gacacaggtcagggctcagagt

SEQ ID NO: 924191 - DNA, 18 bp, Homo sapiens
gacacagtgatgaatgta

SEQ ID NO: 924192 - DNA, 19 bp, Homo sapiens
gacacatactcatttttca

SEQ ID NO: 924193 - DNA, 18 bp, Homo sapiens
gacacatatgaacacaga

SEQ ID NO: 924194 - DNA, 16 bp, Homo sapiens
gacacatcaaatgccc

SEQ ID NO: 924195 - DNA, 13 bp, Homo sapiens
gacacatcccggc

SEQ ID NO: 924196 - DNA, 21 bp, Homo sapiens
gacacatctattgcagagact

SEQ ID NO: 924197 - DNA, 17 bp, Homo sapiens
gacacatgccagggcca

SEQ ID NO: 924198 - DNA, 18 bp, Homo sapiens
gacacatgcccctccccc

SEQ ID NO: 924199 - DNA, 23 bp, Homo sapiens
gacacatgctgaggttttgaata

SEQ ID NO: 924200 - DNA, 23 bp, Homo sapiens
gacacatggattttggcagggcg

SEQ ID NO: 924201 - DNA, 18 bp, Homo sapiens
gacacattaatgataaac

SEQ ID NO: 924202 - DNA, 23 bp, Homo sapiens
gacacattaatgataaactcaga

SEQ ID NO: 924203 - DNA, 16 bp, Homo sapiens
gacacattgactcctt

SEQ ID NO: 924204 - DNA, 14 bp, Homo sapiens
gacacatttaccaa

SEQ ID NO: 924205 - DNA, 17 bp, Homo sapiens
gacacatttaccaaatt

SEQ ID NO: 924206 - DNA, 16 bp, Homo sapiens
gacaccacctggagtg

SEQ ID NO: 924207 - DNA, 20 bp, Homo sapiens
gacaccaggagtccctggta

SEQ ID NO: 924208 - DNA, 16 bp, Homo sapiens
gacaccatcccctcct

SEQ ID NO: 924209 - DNA, 14 bp, Homo sapiens
gacacccaaagggt

SEQ ID NO: 924210 - DNA, 19 bp, Homo sapiens
gacacccatgccagagagg

SEQ ID NO: 924211 - DNA, 19 bp, Homo sapiens
gacaccccagacctgcgaa

SEQ ID NO: 924212 - DNA, 21 bp, Homo sapiens
gacacccccagctgactgttg

SEQ ID NO: 924213 - DNA, 16 bp, Homo sapiens
cccaggcccttggctg

SEQ ID NO: 924214 - DNA, 17 bp, Homo sapiens
cccaggccgcagctctt

SEQ ID NO: 924215 - DNA, 18 bp, Homo sapiens
cccaggccgcagctcttg

SEQ ID NO: 924216 - DNA, 13 bp, Homo sapiens
cccaggccggagc

SEQ ID NO: 924217 - DNA, 15 bp, Homo sapiens
cccaggccggagccc

SEQ ID NO: 924218 - DNA, 17 bp, Homo sapiens
cccaggccggagcccag

SEQ ID NO: 924219 - DNA, 18 bp, Homo sapiens
cccaggccggagcccaga

SEQ ID NO: 924220 - DNA, 16 bp, Homo sapiens
cccaggccggcccaga

SEQ ID NO: 924221 - DNA, 17 bp, Homo sapiens
cccaggccggcccagat

SEQ ID NO: 924222 - DNA, 20 bp, Homo sapiens
cccaggccggcccagatgtg

SEQ ID NO: 924223 - DNA, 21 bp, Homo sapiens
cccaggccggggtggagcatg

SEQ ID NO: 924224 - DNA, 18 bp, Homo sapiens
cccaggcctccagcctct

SEQ ID NO: 924225 - DNA, 15 bp, Homo sapiens
cccaggcctcctagg

SEQ ID NO: 924226 - DNA, 16 bp, Homo sapiens
cccaggcctcctaggg

SEQ ID NO: 924227 - DNA, 13 bp, Homo sapiens
cccaggcctgcct

SEQ ID NO: 924228 - DNA, 15 bp, Homo sapiens
cccaggcctgctggc

SEQ ID NO: 924229 - DNA, 11 bp, Homo sapiens
cccaggcctgg

SEQ ID NO: 924230 - DNA, 15 bp, Homo sapiens
cccaggcctggagcg

SEQ ID NO: 924231 - DNA, 18 bp, Homo sapiens
cccaggcctgggatgcag

SEQ ID NO: 924232 - DNA, 19 bp, Homo sapiens
cccaggcctgggatgcagt

SEQ ID NO: 924233 - DNA, 13 bp, Homo sapiens
cccaggcctgtcc

SEQ ID NO: 924234 - DNA, 16 bp, Homo sapiens
cccaggcctgtccacc

SEQ ID NO: 924235 - DNA, 21 bp, Homo sapiens
cccaggcctgtccaccctgcc

SEQ ID NO: 924236 - DNA, 14 bp, Homo sapiens
cccaggccttgctg

SEQ ID NO: 924237 - DNA, 19 bp, Homo sapiens
cccaggccttgctgactct

SEQ ID NO: 924238 - DNA, 18 bp, Homo sapiens
cccaggctagagtgcaat

SEQ ID NO: 924239 - DNA, 14 bp, Homo sapiens
cccaggctccgccc

SEQ ID NO: 924240 - DNA, 22 bp, Homo sapiens
cccaggctcggaggaccctgga

SEQ ID NO: 924241 - DNA, 22 bp, Homo sapiens
cccaggctgctggagtgcagtg

SEQ ID NO: 924242 - DNA, 12 bp, Homo sapiens
cccaggctggag

SEQ ID NO: 924243 - DNA, 18 bp, Homo sapiens
cccaggctggagtgcagt

SEQ ID NO: 924244 - DNA, 20 bp, Homo sapiens
cccaggctggagtgcagtgg

SEQ ID NO: 924245 - DNA, 13 bp, Homo sapiens
cccaggctgggaa

SEQ ID NO: 924246 - DNA, 16 bp, Homo sapiens
cccaggcttccgcgcc

SEQ ID NO: 924247 - DNA, 17 bp, Homo sapiens
cccagggaaggaaaaat

SEQ ID NO: 924248 - DNA, 18 bp, Homo sapiens
cccagggaaggtggggcc

SEQ ID NO: 924249 - DNA, 20 bp, Homo sapiens
cccagggaaggtggggccct

SEQ ID NO: 924250 - DNA, 21 bp, Homo sapiens
cccagggaaggtggggccctg

SEQ ID NO: 924251 - DNA, 17 bp, Homo sapiens
cccagggacagaggcca

SEQ ID NO: 924252 - DNA, 20 bp, Homo sapiens
cccagggacagaggccaagg

SEQ ID NO: 924253 - DNA, 13 bp, Homo sapiens
cccagggagctct

SEQ ID NO: 924254 - DNA, 16 bp, Homo sapiens
cccagggagctctggg

SEQ ID NO: 924255 - DNA, 19 bp, Homo sapiens
cccagggagctctggggac

SEQ ID NO: 924256 - DNA, 15 bp, Homo sapiens
cccagggagtccagg

SEQ ID NO: 924257 - DNA, 16 bp, Homo sapiens
cccagggagtccaggg

SEQ ID NO: 924258 - DNA, 22 bp, Homo sapiens
cccagggagtccttgcgtccca

SEQ ID NO: 924259 - DNA, 16 bp, Homo sapiens
cccagggagtgagcag

SEQ ID NO: 924260 - DNA, 17 bp, Homo sapiens
cccagggagtgagcagc

SEQ ID NO: 924261 - DNA, 22 bp, Homo sapiens
cccagggagtgagcagctactg

SEQ ID NO: 924262 - DNA, 17 bp, Homo sapiens
cccagggcatcttgctg

SEQ ID NO: 924263 - DNA, 22 bp, Homo sapiens
cccagggccagggccctgcaga

SEQ ID NO: 924264 - DNA, 21 bp, Homo sapiens
cccagggcccccctcccccca

SEQ ID NO: 924265 - DNA, 20 bp, Homo sapiens
cccagggcccctccctctgc

SEQ ID NO: 924266 - DNA, 21 bp, Homo sapiens
cccagggcccctccctctgcc

SEQ ID NO: 924267 - DNA, 22 bp, Homo sapiens
cccagggcccgggcacccacaa

SEQ ID NO: 924268 - DNA, 14 bp, Homo sapiens
cccagggcctccag

SEQ ID NO: 924269 - DNA, 16 bp, Homo sapiens
cccagggcctccaggg

SEQ ID NO: 924270 - DNA, 16 bp, Homo sapiens
cccagggcctcctggg

SEQ ID NO: 924271 - DNA, 22 bp, Homo sapiens
cccagggcctgacttgagccac

SEQ ID NO: 924272 - DNA, 12 bp, Homo sapiens
cccagggcctgt

SEQ ID NO: 924273 - DNA, 16 bp, Homo sapiens
cccagggcctgtctcc

SEQ ID NO: 924274 - DNA, 14 bp, Homo sapiens
cccagggctcagcc

SEQ ID NO: 924275 - DNA, 15 bp, Homo sapiens
cccagggctcagcct

SEQ ID NO: 924276 - DNA, 19 bp, Homo sapiens
cccagggctccctcctgga

SEQ ID NO: 924277 - DNA, 12 bp, Homo sapiens
cccagggctctg

SEQ ID NO: 924278 - DNA, 16 bp, Homo sapiens
cccagggctctgcagg

SEQ ID NO: 924279 - DNA, 20 bp, Homo sapiens
cccagggctctgcaggccac

SEQ ID NO: 924280 - DNA, 18 bp, Homo sapiens
cccagggctctgccccag

SEQ ID NO: 924281 - DNA, 10 bp, Homo sapiens
cccagggctg

SEQ ID NO: 924282 - DNA, 16 bp, Homo sapiens
cccagggctgggagga

SEQ ID NO: 924283 - DNA, 17 bp, Homo sapiens
cccagggctgggaggaa

SEQ ID NO: 924284 - DNA, 13 bp, Homo sapiens
cccaggggagagg

SEQ ID NO: 924285 - DNA, 24 bp, Homo sapiens
cccaggggagagggtctggagaag

SEQ ID NO: 924286 - DNA, 15 bp, Homo sapiens
cccaggggagccagc

SEQ ID NO: 924287 - DNA, 16 bp, Homo sapiens
cccaggggagccagct

SEQ ID NO: 924288 - DNA, 20 bp, Homo sapiens
cccaggggagccagctgctt

SEQ ID NO: 924289 - DNA, 13 bp, Homo sapiens
cccaggggcagca

SEQ ID NO: 924290 - DNA, 16 bp, Homo sapiens
cccaggggcagcaagg

SEQ ID NO: 924291 - DNA, 23 bp, Homo sapiens
cccaggggcagcaaggccttggt

SEQ ID NO: 924292 - DNA, 22 bp, Homo sapiens
cccaggggcatgtattggcctg

SEQ ID NO: 924293 - DNA, 17 bp, Homo sapiens
cccaggggcccacaggg

SEQ ID NO: 924294 - DNA, 15 bp, Homo sapiens
cccaggggtcccagc

SEQ ID NO: 924295 - DNA, 21 bp, Homo sapiens
cccaggggtctccctggctcc

SEQ ID NO: 924296 - DNA, 18 bp, Homo sapiens
cccagggtcccaccccca

SEQ ID NO: 924297 - DNA, 22 bp, Homo sapiens
cccagggtcccacccccaaccc

SEQ ID NO: 924298 - DNA, 14 bp, Homo sapiens
cccagggtcccctc

SEQ ID NO: 924299 - DNA, 18 bp, Homo sapiens
cccagggtcccctcccca

SEQ ID NO: 924300 - DNA, 17 bp, Homo sapiens
cccagggtcctgtgcct

SEQ ID NO: 924301 - DNA, 20 bp, Homo sapiens
cccagggtcgtctttgtgta

SEQ ID NO: 924302 - DNA, 15 bp, Homo sapiens
cccagggtggaggaa

SEQ ID NO: 924303 - DNA, 19 bp, Homo sapiens
cccagggttaatagggcct

SEQ ID NO: 924304 - DNA, 18 bp, Homo sapiens
cccagggttcccccagcc

SEQ ID NO: 924305 - DNA, 14 bp, Homo sapiens
cccaggtaccagct

SEQ ID NO: 924306 - DNA, 15 bp, Homo sapiens
cccaggtaccagctg

SEQ ID NO: 924307 - DNA, 15 bp, Homo sapiens
cccaggtcagccctg

SEQ ID NO: 924308 - DNA, 17 bp, Homo sapiens
cccaggtcagccctgtg

SEQ ID NO: 924309 - DNA, 18 bp, Homo sapiens
cccaggtcagccctgtgt

SEQ ID NO: 924310 - DNA, 20 bp, Homo sapiens
cccaggtcagccctgtgtct

SEQ ID NO: 924311 - DNA, 19 bp, Homo sapiens
cccaggtcagctgttactt

SEQ ID NO: 924312 - DNA, 15 bp, Homo sapiens
cccaggtcaggggct

SEQ ID NO: 924313 - DNA, 17 bp, Homo sapiens
cccaggtccagctctgg

SEQ ID NO: 924314 - DNA, 18 bp, Homo sapiens
cccaggtccagctctgga

SEQ ID NO: 924315 - DNA, 22 bp, Homo sapiens
cccaggtcccccgactgcctgt

SEQ ID NO: 924316 - DNA, 14 bp, Homo sapiens
cccaggtcctgtct

SEQ ID NO: 924317 - DNA, 16 bp, Homo sapiens
cccaggtcctgtctct

SEQ ID NO: 924318 - DNA, 23 bp, Homo sapiens
cccaggtcctgtctctgcacaga

SEQ ID NO: 924319 - DNA, 12 bp, Homo sapiens
cccaggtctttt

SEQ ID NO: 924320 - DNA, 13 bp, Homo sapiens
cccaggtcttttc

SEQ ID NO: 924321 - DNA, 23 bp, Homo sapiens
cccaggtcttttctttgggaccc

SEQ ID NO: 924322 - DNA, 19 bp, Homo sapiens
cccaggtggctgacccagt

SEQ ID NO: 924323 - DNA, 22 bp, Homo sapiens
cccaggtggctgacccagtccc

SEQ ID NO: 924324 - DNA, 20 bp, Homo sapiens
cccaggttcccccagcaagc

SEQ ID NO: 924325 - DNA, 18 bp, Homo sapiens
cccaggttcgagacccaa

SEQ ID NO: 924326 - DNA, 18 bp, Homo sapiens
cccagtacctccaagcaa

SEQ ID NO: 924327 - DNA, 16 bp, Homo sapiens
cccagtagaccttgtt

SEQ ID NO: 924328 - DNA, 13 bp, Homo sapiens
cccagtagtcaga

SEQ ID NO: 924329 - DNA, 24 bp, Homo sapiens
cccagtagtcagaagcaggttctt

SEQ ID NO: 924330 - DNA, 19 bp, Homo sapiens
cccagtattactgctgctg

SEQ ID NO: 924331 - DNA, 22 bp, Homo sapiens
cccagtattactgctgctgtgc

SEQ ID NO: 924332 - DNA, 12 bp, Homo sapiens
cccagtcagaaa

SEQ ID NO: 924333 - DNA, 14 bp, Homo sapiens
cccagtcagaaata

SEQ ID NO: 924334 - DNA, 13 bp, Homo sapiens
cccagtccatttc

SEQ ID NO: 924335 - DNA, 15 bp, Homo sapiens
cccagtccccagccc

SEQ ID NO: 924336 - DNA, 13 bp, Homo sapiens
cccagtccctggg

SEQ ID NO: 924337 - DNA, 15 bp, Homo sapiens
cccagtcctcactgt

SEQ ID NO: 924338 - DNA, 14 bp, Homo sapiens
gaaggcagaggctg

SEQ ID NO: 924339 - DNA, 14 bp, Homo sapiens
gaaggcagcaaaga

SEQ ID NO: 924340 - DNA, 15 bp, Homo sapiens
gaaggcaggcctccg

SEQ ID NO: 924341 - DNA, 21 bp, Homo sapiens
gaaggcagggaatgcctggag

SEQ ID NO: 924342 - DNA, 22 bp, Homo sapiens
gaaggcagggaatgcctggagg

SEQ ID NO: 924343 - DNA, 21 bp, Homo sapiens
gaaggcagggggaaggtgggg

SEQ ID NO: 924344 - DNA, 17 bp, Homo sapiens
gaaggcagtctgaaccc

SEQ ID NO: 924345 - DNA, 22 bp, Homo sapiens
gaaggcagtgcctgctctgctg

SEQ ID NO: 924346 - DNA, 14 bp, Homo sapiens
gaaggcatgagaaa

SEQ ID NO: 924347 - DNA, 20 bp, Homo sapiens
gaaggcatggacttctggat

SEQ ID NO: 924348 - DNA, 18 bp, Homo sapiens
gaaggcattgtcctgtga

SEQ ID NO: 924349 - DNA, 23 bp, Homo sapiens
gaaggcccaagagcagagtctgg

SEQ ID NO: 924350 - DNA, 20 bp, Homo sapiens
gaaggcctccctagccagca

SEQ ID NO: 924351 - DNA, 14 bp, Homo sapiens
gaaggcctccctct

SEQ ID NO: 924352 - DNA, 15 bp, Homo sapiens
gaaggccttccactg

SEQ ID NO: 924353 - DNA, 13 bp, Homo sapiens
gaaggcctttctt

SEQ ID NO: 924354 - DNA, 17 bp, Homo sapiens
gaaggcctttcttctgt

SEQ ID NO: 924355 - DNA, 13 bp, Homo sapiens
gaaggctgcccct

SEQ ID NO: 924356 - DNA, 14 bp, Homo sapiens
gaaggctggctgag

SEQ ID NO: 924357 - DNA, 12 bp, Homo sapiens
gaaggctgtacg

SEQ ID NO: 924358 - DNA, 13 bp, Homo sapiens
gaaggcttcactc

SEQ ID NO: 924359 - DNA, 13 bp, Homo sapiens
gaaggcttctctc

SEQ ID NO: 924360 - DNA, 14 bp, Homo sapiens
gaatagcctggcca

SEQ ID NO: 924361 - DNA, 20 bp, Homo sapiens
gaatagctgttttgtgtata

SEQ ID NO: 924362 - DNA, 19 bp, Homo sapiens
gaatagcttgtttctgtca

SEQ ID NO: 924363 - DNA, 12 bp, Homo sapiens
gaataggaaaac

SEQ ID NO: 924364 - DNA, 14 bp, Homo sapiens
gaataggaaaacat

SEQ ID NO: 924365 - DNA, 20 bp, Homo sapiens
gaatagtggacatggtcaca

SEQ ID NO: 924366 - DNA, 18 bp, Homo sapiens
gaatataaaaactcctgg

SEQ ID NO: 924367 - DNA, 15 bp, Homo sapiens
gaatataaaacagtc

SEQ ID NO: 924368 - DNA, 14 bp, Homo sapiens
gaatataaatagct

SEQ ID NO: 924369 - DNA, 11 bp, Homo sapiens
gaatataagaa

SEQ ID NO: 924370 - DNA, 15 bp, Homo sapiens
gaatataagaaaagt

SEQ ID NO: 924371 - DNA, 22 bp, Homo sapiens
gaatataagaaaagtaatgaag

SEQ ID NO: 924372 - DNA, 20 bp, Homo sapiens
gaatataattgttttatctg

SEQ ID NO: 924373 - DNA, 22 bp, Homo sapiens
gaatatacatgaagaatagaaa

SEQ ID NO: 924374 - DNA, 20 bp, Homo sapiens
gaatatactcattagaatta

SEQ ID NO: 924375 - DNA, 20 bp, Homo sapiens
gaatataggtctcttctccc

SEQ ID NO: 924376 - DNA, 22 bp, Homo sapiens
gaatataggtctcttctcccag

SEQ ID NO: 924377 - DNA, 23 bp, Homo sapiens
gaatatatcagaatctgtgtgaa

SEQ ID NO: 924378 - DNA, 13 bp, Homo sapiens
gaatatattactg

SEQ ID NO: 924379 - DNA, 14 bp, Homo sapiens
gaatatattactga

SEQ ID NO: 924380 - DNA, 11 bp, Homo sapiens
gaatatattat

SEQ ID NO: 924381 - DNA, 16 bp, Homo sapiens
gaatatatttaagcaa

SEQ ID NO: 924382 - DNA, 13 bp, Homo sapiens
gaatatcaatata

SEQ ID NO: 924383 - DNA, 17 bp, Homo sapiens
gaatatcattgatttta

SEQ ID NO: 924384 - DNA, 16 bp, Homo sapiens
gaatatccatgaccta

SEQ ID NO: 924385 - DNA, 19 bp, Homo sapiens
gaatatccatgtacttgtt

SEQ ID NO: 924386 - DNA, 14 bp, Homo sapiens
gaatatctgggatt

SEQ ID NO: 924387 - DNA, 15 bp, Homo sapiens
gaatatctgtaatgg

SEQ ID NO: 924388 - DNA, 15 bp, Homo sapiens
gaatatgacggaaga

SEQ ID NO: 924389 - DNA, 16 bp, Homo sapiens
gaatatggaggctgga

SEQ ID NO: 924390 - DNA, 17 bp, Homo sapiens
gaatatggtggaaaata

SEQ ID NO: 924391 - DNA, 21 bp, Homo sapiens
gaatatggttggagagccctg

SEQ ID NO: 924392 - DNA, 22 bp, Homo sapiens
gaatatgtaatacttaaataaa

SEQ ID NO: 924393 - DNA, 19 bp, Homo sapiens
gaatatgtagtatctatat

SEQ ID NO: 924394 - DNA, 23 bp, Homo sapiens
gaatatgtagtatctatatgact

SEQ ID NO: 924395 - DNA, 15 bp, Homo sapiens
gaatatgtatgtata

SEQ ID NO: 924396 - DNA, 23 bp, Homo sapiens
gaatattaaagctcttcatttct

SEQ ID NO: 924397 - DNA, 12 bp, Homo sapiens
gaatattcagga

SEQ ID NO: 924398 - DNA, 16 bp, Homo sapiens
gaatattcctggactt

SEQ ID NO: 924399 - DNA, 20 bp, Homo sapiens
gaatattcctggacttacaa

SEQ ID NO: 924400 - DNA, 22 bp, Homo sapiens
gaatattcctggacttacaaaa

SEQ ID NO: 924401 - DNA, 20 bp, Homo sapiens
gaatattgagcaatatgtca

SEQ ID NO: 924402 - DNA, 17 bp, Homo sapiens
gaatattgatgttaaca

SEQ ID NO: 924403 - DNA, 20 bp, Homo sapiens
gaatattgcaaaatacatga

SEQ ID NO: 924404 - DNA, 13 bp, Homo sapiens
gaatattgccaat

SEQ ID NO: 924405 - DNA, 18 bp, Homo sapiens
gaatattgtgattctgtt

SEQ ID NO: 924406 - DNA, 15 bp, Homo sapiens
gaatatttagaaaaa

SEQ ID NO: 924407 - DNA, 16 bp, Homo sapiens
gaatatttataacagc

SEQ ID NO: 924408 - DNA, 18 bp, Homo sapiens
gaatatttataacagcat

SEQ ID NO: 924409 - DNA, 15 bp, Homo sapiens
gaatatttattacct

SEQ ID NO: 924410 - DNA, 17 bp, Homo sapiens
gaatatttattacctct

SEQ ID NO: 924411 - DNA, 11 bp, Homo sapiens
gaatatttgaa

SEQ ID NO: 924412 - DNA, 22 bp, Homo sapiens
gaatatttgttatgtagataac

SEQ ID NO: 924413 - DNA, 14 bp, Homo sapiens
gaatatttgtttta

SEQ ID NO: 924414 - DNA, 18 bp, Homo sapiens
gaatatttgttttaatac

SEQ ID NO: 924415 - DNA, 12 bp, Homo sapiens
gaatattttatc

SEQ ID NO: 924416 - DNA, 16 bp, Homo sapiens
gaatattttatcctgt

SEQ ID NO: 924417 - DNA, 20 bp, Homo sapiens
gaatattttcattaaaagct

SEQ ID NO: 924418 - DNA, 19 bp, Homo sapiens
gaatattttgatgcagata

SEQ ID NO: 924419 - DNA, 16 bp, Homo sapiens
gaatattttggaaact

SEQ ID NO: 924420 - DNA, 23 bp, Homo sapiens
gaatattttgttttgtgcagaga

SEQ ID NO: 924421 - DNA, 21 bp, Homo sapiens
gaatatttttatatttccttt

SEQ ID NO: 924422 - DNA, 17 bp, Homo sapiens
gaatattttttgaaggt

SEQ ID NO: 924423 - DNA, 14 bp, Homo sapiens
gaatcaaaactctc

SEQ ID NO: 924424 - DNA, 17 bp, Homo sapiens
gaatcaaatcttacaaa

SEQ ID NO: 924425 - DNA, 14 bp, Homo sapiens
gaatcaacagatga

SEQ ID NO: 924426 - DNA, 14 bp, Homo sapiens
gaatcaattattta

SEQ ID NO: 924427 - DNA, 21 bp, Homo sapiens
gaatcacggtggtaaagaaag

SEQ ID NO: 924428 - DNA, 22 bp, Homo sapiens
gaatcacggtggtaaagaaagt

SEQ ID NO: 924429 - DNA, 21 bp, Homo sapiens
gaatcacgttagaggaaaaat

SEQ ID NO: 924430 - DNA, 20 bp, Homo sapiens
gaatcactaggtaacttatt

SEQ ID NO: 924431 - DNA, 20 bp, Homo sapiens
gaatcactgtttagaacaca

SEQ ID NO: 924432 - DNA, 13 bp, Homo sapiens
gaatcagaaacag

SEQ ID NO: 924433 - DNA, 19 bp, Homo sapiens
gaatcagaatcatggagaa

SEQ ID NO: 924434 - DNA, 23 bp, Homo sapiens
gaatcagaatcatggagaaaatg

SEQ ID NO: 924435 - DNA, 13 bp, Homo sapiens
gaatcaggaaact

SEQ ID NO: 924436 - DNA, 20 bp, Homo sapiens
gaatcagtgttaaattcatt

SEQ ID NO: 924437 - DNA, 19 bp, Homo sapiens
gaatcagtttccaattatt

SEQ ID NO: 924438 - DNA, 22 bp, Homo sapiens
gaatcagtttccaattatttga

SEQ ID NO: 924439 - DNA, 15 bp, Homo sapiens
gaatcagttttggaa

SEQ ID NO: 924440 - DNA, 16 bp, Homo sapiens
gaatcatactgcctac

SEQ ID NO: 924441 - DNA, 19 bp, Homo sapiens
gaatcatacttagcaaagt

SEQ ID NO: 924442 - DNA, 19 bp, Homo sapiens
gaatcatatgattctgctt

SEQ ID NO: 924443 - DNA, 13 bp, Homo sapiens
gaatcatggagaa

SEQ ID NO: 924444 - DNA, 16 bp, Homo sapiens
gaatcatggagaaaat

SEQ ID NO: 924445 - DNA, 20 bp, Homo sapiens
gaatcattgtatgtggtcat

SEQ ID NO: 924446 - DNA, 14 bp, Homo sapiens
gaatcatttgttca

SEQ ID NO: 924447 - DNA, 20 bp, Homo sapiens
gaatccaaatctgtcctctg

SEQ ID NO: 924448 - DNA, 18 bp, Homo sapiens
gaatccagctccctagac

SEQ ID NO: 924449 - DNA, 19 bp, Homo sapiens
gaatccagctccctagact

SEQ ID NO: 924450 - DNA, 16 bp, Homo sapiens
gaatccagtttctttc

SEQ ID NO: 924451 - DNA, 15 bp, Homo sapiens
gaatccataaatgtg

SEQ ID NO: 924452 - DNA, 18 bp, Homo sapiens
gaatccataaatgtgttc

SEQ ID NO: 924453 - DNA, 20 bp, Homo sapiens
gaatccataaatgtgttcct

SEQ ID NO: 924454 - DNA, 20 bp, Homo sapiens
gaatccattgaactggaaga

SEQ ID NO: 924455 - DNA, 16 bp, Homo sapiens
gaatcccactgtatga

SEQ ID NO: 924456 - DNA, 15 bp, Homo sapiens
gaatcccagccggcc

SEQ ID NO: 924457 - DNA, 16 bp, Homo sapiens
gaatcccctccctgtc

SEQ ID NO: 924458 - DNA, 12 bp, Homo sapiens
gaatccctgcag

SEQ ID NO: 924459 - DNA, 14 bp, Homo sapiens
gaatccctgttcat

SEQ ID NO: 924460 - DNA, 16 bp, Homo sapiens
gaatcctctcctttct

SEQ ID NO: 924461 - DNA, 19 bp, Homo sapiens
gaatcctggcaagaaagct

SEQ ID NO: 924462 - DNA, 13 bp, Homo sapiens
gaatcctttgaga

SEQ ID NO: 924463 - DNA, 18 bp, Homo sapiens
gaatcgaggaaccagagc

SEQ ID NO: 924464 - DNA, 16 bp, Homo sapiens
gaatcgatttcctccc

SEQ ID NO: 924465 - DNA, 20 bp, Homo sapiens
gaatcgctcctgcagcccca

SEQ ID NO: 924466 - DNA, 13 bp, Homo sapiens
gaatctaaaataa

SEQ ID NO: 924467 - DNA, 22 bp, Homo sapiens
gaatctaaacgtggtcaccttc

SEQ ID NO: 924468 - DNA, 18 bp, Homo sapiens
gaatctaagctgtttgcc

SEQ ID NO: 924469 - DNA, 23 bp, Homo sapiens
gaatctaaggataatgaaataat

SEQ ID NO: 924470 - DNA, 17 bp, Homo sapiens
gaatctaattcagacag

SEQ ID NO: 924471 - DNA, 18 bp, Homo sapiens
gaatctacccccagatcc

SEQ ID NO: 924472 - DNA, 22 bp, Homo sapiens
ctgattagtattcaggcactga

SEQ ID NO: 924473 - DNA, 21 bp, Homo sapiens
ctgattattacttctgtttct

SEQ ID NO: 924474 - DNA, 18 bp, Homo sapiens
ctgattatttagagccat

SEQ ID NO: 924475 - DNA, 12 bp, Homo sapiens
ctgattatttat

SEQ ID NO: 924476 - DNA, 21 bp, Homo sapiens
ctgattcaaaccaaagctgcc

SEQ ID NO: 924477 - DNA, 16 bp, Homo sapiens
ctgattcacctcttcc

SEQ ID NO: 924478 - DNA, 18 bp, Homo sapiens
ctgattcacctcttcctc

SEQ ID NO: 924479 - DNA, 16 bp, Homo sapiens
ctgattccctgattta

SEQ ID NO: 924480 - DNA, 15 bp, Homo sapiens
ctgattcctggagag

SEQ ID NO: 924481 - DNA, 17 bp, Homo sapiens
ctgattcgaatgacact

SEQ ID NO: 924482 - DNA, 12 bp, Homo sapiens
ctgattctctac

SEQ ID NO: 924483 - DNA, 20 bp, Homo sapiens
ctgattcttgattcctggct

SEQ ID NO: 924484 - DNA, 13 bp, Homo sapiens
ctgattgattttt

SEQ ID NO: 924485 - DNA, 12 bp, Homo sapiens
caggccagcctc

SEQ ID NO: 924486 - DNA, 16 bp, Homo sapiens
caggccagcctccgag

SEQ ID NO: 924487 - DNA, 15 bp, Homo sapiens
caggccagcttcgtg

SEQ ID NO: 924488 - DNA, 20 bp, Homo sapiens
caggccagcttcgtgctgga

SEQ ID NO: 924489 - DNA, 14 bp, Homo sapiens
caggccaggccacc

SEQ ID NO: 924490 - DNA, 18 bp, Homo sapiens
caggccaggccaccagga

SEQ ID NO: 924491 - DNA, 15 bp, Homo sapiens
caggccaggtgcagt

SEQ ID NO: 924492 - DNA, 19 bp, Homo sapiens
caggccaggtgggcggaca

SEQ ID NO: 924493 - DNA, 15 bp, Homo sapiens
caggccagtgggcct

SEQ ID NO: 924494 - DNA, 14 bp, Homo sapiens
caggccatgtggcc

SEQ ID NO: 924495 - DNA, 15 bp, Homo sapiens
caggccattgtgaac

SEQ ID NO: 924496 - DNA, 15 bp, Homo sapiens
caggccatttttggt

SEQ ID NO: 924497 - DNA, 22 bp, Homo sapiens
caggcccaactgtgagcaagga

SEQ ID NO: 924498 - DNA, 19 bp, Homo sapiens
caggcccaaggagggtcca

SEQ ID NO: 924499 - DNA, 16 bp, Homo sapiens
caggcccaaggctccc

SEQ ID NO: 924500 - DNA, 11 bp, Homo sapiens
caggcccaccg

SEQ ID NO: 924501 - DNA, 24 bp, Homo sapiens
caggcccaccggatgctgtgcctg

SEQ ID NO: 924502 - DNA, 18 bp, Homo sapiens
caggcccacgaggagcag

SEQ ID NO: 924503 - DNA, 12 bp, Homo sapiens
caggcccactcc

SEQ ID NO: 924504 - DNA, 19 bp, Homo sapiens
caggcccactccccagccc

SEQ ID NO: 924505 - DNA, 11 bp, Homo sapiens
caggcccagca

SEQ ID NO: 924506 - DNA, 17 bp, Homo sapiens
caggcccagcatgcagg

SEQ ID NO: 924507 - DNA, 21 bp, Homo sapiens
caggcccagcattgctggttc

SEQ ID NO: 924508 - DNA, 16 bp, Homo sapiens
caggcccagccctcct

SEQ ID NO: 924509 - DNA, 17 bp, Homo sapiens
caggcccagccctcctt

SEQ ID NO: 924510 - DNA, 17 bp, Homo sapiens
caggcccagctgctccc

SEQ ID NO: 924511 - DNA, 14 bp, Homo sapiens
caggcccaggccag

SEQ ID NO: 924512 - DNA, 22 bp, Homo sapiens
gactgtgggtggggaggccctg

SEQ ID NO: 924513 - DNA, 20 bp, Homo sapiens
gactgtggtaggggcaggga

SEQ ID NO: 924514 - DNA, 21 bp, Homo sapiens
gactgttccaggccctccagt

SEQ ID NO: 924515 - DNA, 14 bp, Homo sapiens
gactgttgcccccc

SEQ ID NO: 924516 - DNA, 14 bp, Homo sapiens
gactgttgtagcat

SEQ ID NO: 924517 - DNA, 15 bp, Homo sapiens
gactgtttcagtgtg

SEQ ID NO: 924518 - DNA, 16 bp, Homo sapiens
gactgttttactgttt

SEQ ID NO: 924519 - DNA, 21 bp, Homo sapiens
gactgttttctctcggctccc

SEQ ID NO: 924520 - DNA, 18 bp, Homo sapiens
gactgttttctcttgaga

SEQ ID NO: 924521 - DNA, 18 bp, Homo sapiens
gactgtttttcggacagt

SEQ ID NO: 924522 - DNA, 19 bp, Homo sapiens
gactgtttttcggacagtt

SEQ ID NO: 924523 - DNA, 20 bp, Homo sapiens
gactgttttttcctgagctt

SEQ ID NO: 924524 - DNA, 16 bp, Homo sapiens
gacttaaaaaaaccat

SEQ ID NO: 924525 - DNA, 19 bp, Homo sapiens
gacttaaaggacaggagga

SEQ ID NO: 924526 - DNA, 16 bp, Homo sapiens
gacttaactccttcca

SEQ ID NO: 924527 - DNA, 20 bp, Homo sapiens
gacttaagcaaaagaaaaag

SEQ ID NO: 924528 - DNA, 23 bp, Homo sapiens
gacttaatgagactttaaaagca

SEQ ID NO: 924529 - DNA, 15 bp, Homo sapiens
gacttaatgtgatta

SEQ ID NO: 924530 - DNA, 11 bp, Homo sapiens
gacttacaatt

SEQ ID NO: 924531 - DNA, 12 bp, Homo sapiens
gacttacaattt

SEQ ID NO: 924532 - DNA, 14 bp, Homo sapiens
gacttacaatttgc

SEQ ID NO: 924533 - DNA, 16 bp, Homo sapiens
gacttacctgttcagt

SEQ ID NO: 924534 - DNA, 13 bp, Homo sapiens
gacttactgcagt

SEQ ID NO: 924535 - DNA, 23 bp, Homo sapiens
gacttacttgcattgctggacta

SEQ ID NO: 924536 - DNA, 18 bp, Homo sapiens
gacttagaatagtgccta

SEQ ID NO: 924537 - DNA, 13 bp, Homo sapiens
gacttagagctgg

SEQ ID NO: 924538 - DNA, 16 bp, Homo sapiens
gacttagatattaaaa

SEQ ID NO: 924539 - DNA, 18 bp, Homo sapiens
gacttagatattaaaatt

SEQ ID NO: 924540 - DNA, 17 bp, Homo sapiens
gacttagcgtcaagaca

SEQ ID NO: 924541 - DNA, 21 bp, Homo sapiens
gacttagcgtcaagacatttg

SEQ ID NO: 924542 - DNA, 16 bp, Homo sapiens
gacttatagtacatga

SEQ ID NO: 924543 - DNA, 17 bp, Homo sapiens
gacttattatgcataaa

SEQ ID NO: 924544 - DNA, 13 bp, Homo sapiens
gacttatttctgc

SEQ ID NO: 924545 - DNA, 20 bp, Homo sapiens
gacttatttctgctctggaa

SEQ ID NO: 924546 - DNA, 14 bp, Homo sapiens
gacttcagggcagg

SEQ ID NO: 924547 - DNA, 13 bp, Homo sapiens
gacttcaggtgga

SEQ ID NO: 924548 - DNA, 23 bp, Homo sapiens
gacttcattgtccctcttcactc

SEQ ID NO: 924549 - DNA, 19 bp, Homo sapiens
gacttccaaatcctggaag

SEQ ID NO: 924550 - DNA, 20 bp, Homo sapiens
gacttccaaatcctggaagg

SEQ ID NO: 924551 - DNA, 17 bp, Homo sapiens
gacttcccaacagcctt

SEQ ID NO: 924552 - DNA, 11 bp, Homo sapiens
gacttccccat

SEQ ID NO: 924553 - DNA, 14 bp, Homo sapiens
gacttccccatccc

SEQ ID NO: 924554 - DNA, 15 bp, Homo sapiens
gacttccccatcccg

SEQ ID NO: 924555 - DNA, 15 bp, Homo sapiens
gacttcccctgggca

SEQ ID NO: 924556 - DNA, 16 bp, Homo sapiens
gacttcccctgggcaa

SEQ ID NO: 924557 - DNA, 17 bp, Homo sapiens
gagcccatactcagcct

SEQ ID NO: 924558 - DNA, 20 bp, Homo sapiens
gagcccatactcagcctgct

SEQ ID NO: 924559 - DNA, 23 bp, Homo sapiens
gagcccatgttctgcccccagcc

SEQ ID NO: 924560 - DNA, 13 bp, Homo sapiens
gagccccaagcag

SEQ ID NO: 924561 - DNA, 14 bp, Homo sapiens
gagccccactcccg

SEQ ID NO: 924562 - DNA, 13 bp, Homo sapiens
gagccccaggcct

SEQ ID NO: 924563 - DNA, 19 bp, Homo sapiens
gagccccagggtcttccct

SEQ ID NO: 924564 - DNA, 14 bp, Homo sapiens
gagccccagtgctg

SEQ ID NO: 924565 - DNA, 16 bp, Homo sapiens
gagccccagtgctgga

SEQ ID NO: 924566 - DNA, 17 bp, Homo sapiens
gagccccattcctggga

SEQ ID NO: 924567 - DNA, 17 bp, Homo sapiens
gagcccccaacacaggc

SEQ ID NO: 924568 - DNA, 18 bp, Homo sapiens
gagcccccaccagcagca

SEQ ID NO: 924569 - DNA, 15 bp, Homo sapiens
gagcccccagccctg

SEQ ID NO: 924570 - DNA, 17 bp, Homo sapiens
gagcccccagccctggg

SEQ ID NO: 924571 - DNA, 20 bp, Homo sapiens
gagcccccagccctgggaac

SEQ ID NO: 924572 - DNA, 22 bp, Homo sapiens
gagcccccccaacactgtgccc

SEQ ID NO: 924573 - DNA, 13 bp, Homo sapiens
gagcccccccctt

SEQ ID NO: 924574 - DNA, 22 bp, Homo sapiens
gagcccccgccccgccccacat

SEQ ID NO: 924575 - DNA, 13 bp, Homo sapiens
gagccccctggat

SEQ ID NO: 924576 - DNA, 15 bp, Homo sapiens
gagcccctaccccac

SEQ ID NO: 924577 - DNA, 17 bp, Homo sapiens
gagcccctaccccacac

SEQ ID NO: 924578 - DNA, 20 bp, Homo sapiens
gagcccctaccccacaccag

SEQ ID NO: 924579 - DNA, 12 bp, Homo sapiens
gagcccctcctg

SEQ ID NO: 924580 - DNA, 13 bp, Homo sapiens
gagcccctcggct

SEQ ID NO: 924581 - DNA, 19 bp, Homo sapiens
gagcccctcggctctggag

SEQ ID NO: 924582 - DNA, 13 bp, Homo sapiens
gagcccctgaaag

SEQ ID NO: 924583 - DNA, 12 bp, Homo sapiens
gagcccctgagt

SEQ ID NO: 924584 - DNA, 23 bp, Homo sapiens
gagcccctgagtccgcctgcgcc

SEQ ID NO: 924585 - DNA, 12 bp, Homo sapiens
gagcccctgggt

SEQ ID NO: 924586 - DNA, 19 bp, Homo sapiens
gagcccctgggtgggtggt

SEQ ID NO: 924587 - DNA, 20 bp, Homo sapiens
gagcccctggtcctgagggt

SEQ ID NO: 924588 - DNA, 21 bp, Homo sapiens
gagcccctgtctagagaggga

SEQ ID NO: 924589 - DNA, 21 bp, Homo sapiens
gagccccttccttgctctgca

SEQ ID NO: 924590 - DNA, 21 bp, Homo sapiens
gagccccttctgctcagctct

SEQ ID NO: 924591 - DNA, 14 bp, Homo sapiens
gagcccgcagccca

SEQ ID NO: 924592 - DNA, 22 bp, Homo sapiens
gagcccgccgtctgcaggggcc

SEQ ID NO: 924593 - DNA, 23 bp, Homo sapiens
gagcccgccgtctgcaggggcct

SEQ ID NO: 924594 - DNA, 18 bp, Homo sapiens
gagcccgcttcaagctct

SEQ ID NO: 924595 - DNA, 19 bp, Homo sapiens
gagcccgcttcaagctctc

SEQ ID NO: 924596 - DNA, 20 bp, Homo sapiens
gagcccgcttcaagctctct

SEQ ID NO: 924597 - DNA, 14 bp, Homo sapiens
gagcccggccccac

SEQ ID NO: 924598 - DNA, 21 bp, Homo sapiens
gagcccggccctcccccagct

SEQ ID NO: 924599 - DNA, 17 bp, Homo sapiens
gagcccgggctgcctgg

SEQ ID NO: 924600 - DNA, 20 bp, Homo sapiens
gagcccgggctgcctgggct

SEQ ID NO: 924601 - DNA, 22 bp, Homo sapiens
gagcccgggctgcctgggctgt

SEQ ID NO: 924602 - DNA, 19 bp, Homo sapiens
gagccctactccctgcaga

SEQ ID NO: 924603 - DNA, 18 bp, Homo sapiens
gagccctcaggctcccca

SEQ ID NO: 924604 - DNA, 19 bp, Homo sapiens
gagccctcaggctccccag

SEQ ID NO: 924605 - DNA, 16 bp, Homo sapiens
gagccctctagggcag

SEQ ID NO: 924606 - DNA, 20 bp, Homo sapiens
gagccctctagggcagggtg

SEQ ID NO: 924607 - DNA, 13 bp, Homo sapiens
gagccctctcact

SEQ ID NO: 924608 - DNA, 16 bp, Homo sapiens
gagccctctcactcca

SEQ ID NO: 924609 - DNA, 18 bp, Homo sapiens
gagccctctcactccagc

SEQ ID NO: 924610 - DNA, 19 bp, Homo sapiens
gagccctctcactccagcc

SEQ ID NO: 924611 - DNA, 22 bp, Homo sapiens
gagccctctcactccagccaaa

SEQ ID NO: 924612 - DNA, 14 bp, Homo sapiens
gagccctctgagcc

SEQ ID NO: 924613 - DNA, 16 bp, Homo sapiens
gagccctctgagccgc

SEQ ID NO: 924614 - DNA, 17 bp, Homo sapiens
gagccctgaccttggct

SEQ ID NO: 924615 - DNA, 13 bp, Homo sapiens
gagccctgactcc

SEQ ID NO: 924616 - DNA, 17 bp, Homo sapiens
gagccctgaggcctaga

SEQ ID NO: 924617 - DNA, 17 bp, Homo sapiens
gagccctgaggggctgg

SEQ ID NO: 924618 - DNA, 20 bp, Homo sapiens
gagccctgaggggctgggct

SEQ ID NO: 924619 - DNA, 15 bp, Homo sapiens
gagccctgccctgca

SEQ ID NO: 924620 - DNA, 15 bp, Homo sapiens
gagccctgctgtggg

SEQ ID NO: 924621 - DNA, 16 bp, Homo sapiens
gagccctgctgtggga

SEQ ID NO: 924622 - DNA, 19 bp, Homo sapiens
gagccctggacacccctgc

SEQ ID NO: 924623 - DNA, 13 bp, Homo sapiens
gagccctggcagg

SEQ ID NO: 924624 - DNA, 23 bp, Homo sapiens
gagccctggcaggatgaccctgc

SEQ ID NO: 924625 - DNA, 13 bp, Homo sapiens
gagccctggctcc

SEQ ID NO: 924626 - DNA, 14 bp, Homo sapiens
gagccctggctggg

SEQ ID NO: 924627 - DNA, 13 bp, Homo sapiens
gagccctgggtga

SEQ ID NO: 924628 - DNA, 16 bp, Homo sapiens
gagccctgtacccacc

SEQ ID NO: 924629 - DNA, 18 bp, Homo sapiens
gagccctgtacccacccc

SEQ ID NO: 924630 - DNA, 19 bp, Homo sapiens
gagccctgtacccacccca

SEQ ID NO: 924631 - DNA, 21 bp, Homo sapiens
gagccctgtacccaccccagc

SEQ ID NO: 924632 - DNA, 23 bp, Homo sapiens
gagccctgtacccaccccagcac

SEQ ID NO: 924633 - DNA, 19 bp, Homo sapiens
gagccctgtggccgccacc

SEQ ID NO: 924634 - DNA, 22 bp, Homo sapiens
gagccctgtggccgccacctga

SEQ ID NO: 924635 - DNA, 19 bp, Homo sapiens
gagccctgttggcagctct

SEQ ID NO: 924636 - DNA, 12 bp, Homo sapiens
gagcccttcact

SEQ ID NO: 924637 - DNA, 15 bp, Homo sapiens
gagcccttcactgcc

SEQ ID NO: 924638 - DNA, 20 bp, Homo sapiens
gagcccttcactgccatgat

SEQ ID NO: 924639 - DNA, 12 bp, Homo sapiens
gagcccttctct

SEQ ID NO: 924640 - DNA, 18 bp, Homo sapiens
gagcccttgactgtacag

SEQ ID NO: 924641 - DNA, 23 bp, Homo sapiens
gagccgacaatgccctgctggcc

SEQ ID NO: 924642 - DNA, 15 bp, Homo sapiens
gagccgagattgcac

SEQ ID NO: 924643 - DNA, 22 bp, Homo sapiens
gagccgcatcttctccatctgg

SEQ ID NO: 924644 - DNA, 19 bp, Homo sapiens
gagccgctgtgagcccctg

SEQ ID NO: 924645 - DNA, 20 bp, Homo sapiens
gagccggcatccttgcctgt

SEQ ID NO: 924646 - DNA, 22 bp, Homo sapiens
gagccggcatccttgcctgtct

SEQ ID NO: 924647 - DNA, 23 bp, Homo sapiens
gagccggccccaggctcgtggac

SEQ ID NO: 924648 - DNA, 17 bp, Homo sapiens
gagccgggaccctcagg

SEQ ID NO: 924649 - DNA, 14 bp, Homo sapiens
gagccgggcctggg

SEQ ID NO: 924650 - DNA, 17 bp, Homo sapiens
gagccgggtctgcctct

SEQ ID NO: 924651 - DNA, 20 bp, Homo sapiens
gagccgggtctgcctcttct

SEQ ID NO: 924652 - DNA, 21 bp, Homo sapiens
gagccgggtctgcctcttctg

SEQ ID NO: 924653 - DNA, 18 bp, Homo sapiens
gagccggtaactgtcctg

SEQ ID NO: 924654 - DNA, 19 bp, Homo sapiens
gagccgtggtccctgagga

SEQ ID NO: 924655 - DNA, 13 bp, Homo sapiens
gagccgtggtcct

SEQ ID NO: 924656 - DNA, 19 bp, Homo sapiens
gagcctaccttcaccacct

SEQ ID NO: 924657 - DNA, 21 bp, Homo sapiens
gagcctagaacatccctgggc

SEQ ID NO: 924658 - DNA, 15 bp, Homo sapiens
gagcctagaagctgg

SEQ ID NO: 924659 - DNA, 18 bp, Homo sapiens
gagcctagcggagcccag

SEQ ID NO: 924660 - DNA, 21 bp, Homo sapiens
gagcctagcggagcccagcct

SEQ ID NO: 924661 - DNA, 16 bp, Homo sapiens
gagcctagctcctgcc

SEQ ID NO: 924662 - DNA, 22 bp, Homo sapiens
gagcctaggaccactcagcccc

SEQ ID NO: 924663 - DNA, 13 bp, Homo sapiens
gagcctcacagca

SEQ ID NO: 924664 - DNA, 15 bp, Homo sapiens
gagcctcacagcagt

SEQ ID NO: 924665 - DNA, 18 bp, Homo sapiens
gagcctcatccgaggcag

SEQ ID NO: 924666 - DNA, 12 bp, Homo sapiens
gagcctccccct

SEQ ID NO: 924667 - DNA, 13 bp, Homo sapiens
gagcctccctgca

SEQ ID NO: 924668 - DNA, 22 bp, Homo sapiens
gagcctcctctctcaaactggg

SEQ ID NO: 924669 - DNA, 22 bp, Homo sapiens
gagcctcctgaagttgctgctg

SEQ ID NO: 924670 - DNA, 13 bp, Homo sapiens
gagcctcctggga

SEQ ID NO: 924671 - DNA, 15 bp, Homo sapiens
gagcctcctgtgcct

SEQ ID NO: 924672 - DNA, 20 bp, Homo sapiens
gagcctcgtgtccagactca

SEQ ID NO: 924673 - DNA, 17 bp, Homo sapiens
gagcctctgctccccag

SEQ ID NO: 924674 - DNA, 15 bp, Homo sapiens
gagcctctggcccct

SEQ ID NO: 924675 - DNA, 15 bp, Homo sapiens
gagcctctggcttcc

SEQ ID NO: 924676 - DNA, 13 bp, Homo sapiens
ccctctgcctgtc

SEQ ID NO: 924677 - DNA, 14 bp, Homo sapiens
ccctctgcctgtcc

SEQ ID NO: 924678 - DNA, 12 bp, Homo sapiens
ccctctgcggct

SEQ ID NO: 924679 - DNA, 18 bp, Homo sapiens
gagctcctctgggcagga

SEQ ID NO: 924680 - DNA, 14 bp, Homo sapiens
gagctcctcttcca

SEQ ID NO: 924681 - DNA, 23 bp, Homo sapiens
ccctgagtctggacctccatccc

SEQ ID NO: 924682 - DNA, 15 bp, Homo sapiens
ccctgagtgcgggct

SEQ ID NO: 924683 - DNA, 22 bp, Homo sapiens
ccctgagtggatctccaaggac

SEQ ID NO: 924684 - DNA, 15 bp, Homo sapiens
ccctgagtggtcact

SEQ ID NO: 924685 - DNA, 22 bp, Homo sapiens
ccctgagtggtcactggtcagg

SEQ ID NO: 924686 - DNA, 16 bp, Homo sapiens
ccctgagttggagctc

SEQ ID NO: 924687 - DNA, 22 bp, Homo sapiens
ccctgagttggagctcattctg

SEQ ID NO: 924688 - DNA, 18 bp, Homo sapiens
ccctgagttgggcagcca

SEQ ID NO: 924689 - DNA, 20 bp, Homo sapiens
ccctgatcaagtcaccggag

SEQ ID NO: 924690 - DNA, 18 bp, Homo sapiens
ccctgatcccaccccctc

SEQ ID NO: 924691 - DNA, 20 bp, Homo sapiens
ccctgatctctgacctctgc

SEQ ID NO: 924692 - DNA, 15 bp, Homo sapiens
ccctgatgcagcctg

SEQ ID NO: 924693 - DNA, 13 bp, Homo sapiens
ccctgatgccttt

SEQ ID NO: 924694 - DNA, 18 bp, Homo sapiens
ccctgatgccttttggac

SEQ ID NO: 924695 - DNA, 15 bp, Homo sapiens
ccctgatggaccctc

SEQ ID NO: 924696 - DNA, 18 bp, Homo sapiens
ccctgatggaccctcagt

SEQ ID NO: 924697 - DNA, 23 bp, Homo sapiens
ccctgatggcctttggacccagg

SEQ ID NO: 924698 - DNA, 17 bp, Homo sapiens
ccctgattgacctgctc

SEQ ID NO: 924699 - DNA, 20 bp, Homo sapiens
ccctgcaaaaggactctcag

SEQ ID NO: 924700 - DNA, 22 bp, Homo sapiens
ccctgcaaacagaacagggtca

SEQ ID NO: 924701 - DNA, 16 bp, Homo sapiens
ccctgcaaagcccagc

SEQ ID NO: 924702 - DNA, 19 bp, Homo sapiens
ccctgcaaagcccagcttg

SEQ ID NO: 924703 - DNA, 20 bp, Homo sapiens
ccctgcaaagcccagcttga

SEQ ID NO: 924704 - DNA, 21 bp, Homo sapiens
ccctgcaacttccgctgaggg

SEQ ID NO: 924705 - DNA, 23 bp, Homo sapiens
ccctgcaacttccgctgaggggt

SEQ ID NO: 924706 - DNA, 22 bp, Homo sapiens
ccctgcaagaagcgccgactcc

SEQ ID NO: 924707 - DNA, 23 bp, Homo sapiens
ccctgcacaaagcccttccatgt

SEQ ID NO: 924708 - DNA, 16 bp, Homo sapiens
ccctgcacaggtggct

SEQ ID NO: 924709 - DNA, 13 bp, Homo sapiens
ccctgcaccctcc

SEQ ID NO: 924710 - DNA, 14 bp, Homo sapiens
ccctgcaccctcct

SEQ ID NO: 924711 - DNA, 14 bp, Homo sapiens
ccctgcaccctgga

SEQ ID NO: 924712 - DNA, 18 bp, Homo sapiens
ccctgcaccctggaaagg

SEQ ID NO: 924713 - DNA, 14 bp, Homo sapiens
ccctgcacccttgt

SEQ ID NO: 924714 - DNA, 21 bp, Homo sapiens
ccctgcaccgccgcagaagca

SEQ ID NO: 924715 - DNA, 16 bp, Homo sapiens
ccctgcacctgctgcg

SEQ ID NO: 924716 - DNA, 20 bp, Homo sapiens
ccctgcactaaagccagcct

SEQ ID NO: 924717 - DNA, 18 bp, Homo sapiens
ccctgcactaggcaggta

SEQ ID NO: 924718 - DNA, 17 bp, Homo sapiens
ccctgcactcccgacct

SEQ ID NO: 924719 - DNA, 14 bp, Homo sapiens
ccctgcagaaccca

SEQ ID NO: 924720 - DNA, 18 bp, Homo sapiens
ccctgcagaagccagaag

SEQ ID NO: 924721 - DNA, 12 bp, Homo sapiens
ccctgcagagca

SEQ ID NO: 924722 - DNA, 13 bp, Homo sapiens
ccctgcagagcaa

SEQ ID NO: 924723 - DNA, 19 bp, Homo sapiens
ccctgcagagcaataacac

SEQ ID NO: 924724 - DNA, 20 bp, Homo sapiens
ccctgcagagcaataacact

SEQ ID NO: 924725 - DNA, 13 bp, Homo sapiens
ccctgcagagcta

SEQ ID NO: 924726 - DNA, 21 bp, Homo sapiens
ccctgcagagctatggtgagg

SEQ ID NO: 924727 - DNA, 22 bp, Homo sapiens
ccctgcagcacgcggccttgtc

SEQ ID NO: 924728 - DNA, 14 bp, Homo sapiens
ccctgcagccagct

SEQ ID NO: 924729 - DNA, 13 bp, Homo sapiens
ccctgcagcccac

SEQ ID NO: 924730 - DNA, 12 bp, Homo sapiens
ccctgcagcctg

SEQ ID NO: 924731 - DNA, 13 bp, Homo sapiens
ccctgcagcctgg

SEQ ID NO: 924732 - DNA, 15 bp, Homo sapiens
ccctgcagcctgggt

SEQ ID NO: 924733 - DNA, 14 bp, Homo sapiens
ccctgcaggcacag

SEQ ID NO: 924734 - DNA, 18 bp, Homo sapiens
ccctgcaggcacagagga

SEQ ID NO: 924735 - DNA, 19 bp, Homo sapiens
ccctgcaggcacagaggag

SEQ ID NO: 924736 - DNA, 21 bp, Homo sapiens
ccctgcagggcgcccctggga

SEQ ID NO: 924737 - DNA, 18 bp, Homo sapiens
ccctgcagtttggccctg

SEQ ID NO: 924738 - DNA, 20 bp, Homo sapiens
ccctgcagtttggccctgga

SEQ ID NO: 924739 - DNA, 12 bp, Homo sapiens
ccctgcatcccc

SEQ ID NO: 924740 - DNA, 13 bp, Homo sapiens
ccctgcatcccct

SEQ ID NO: 924741 - DNA, 13 bp, Homo sapiens
ccctgcatcctga

SEQ ID NO: 924742 - DNA, 15 bp, Homo sapiens
ccctgcatcctgagg

SEQ ID NO: 924743 - DNA, 21 bp, Homo sapiens
ccctgcatcctgaggccagtg

SEQ ID NO: 924744 - DNA, 16 bp, Homo sapiens
ccctgcatctgaccag

SEQ ID NO: 924745 - DNA, 21 bp, Homo sapiens
ccctgcatctgaccagcagcg

SEQ ID NO: 924746 - DNA, 18 bp, Homo sapiens
ccctgcattttcctcttg

SEQ ID NO: 924747 - DNA, 18 bp, Homo sapiens
ccctgccaatgctccagc

SEQ ID NO: 924748 - DNA, 10 bp, Homo sapiens
ccctgccaca

SEQ ID NO: 924749 - DNA, 18 bp, Homo sapiens
ccctgccacactcagtcc

SEQ ID NO: 924750 - DNA, 16 bp, Homo sapiens
ccctgccacagccaga

SEQ ID NO: 924751 - DNA, 17 bp, Homo sapiens
ccctgccacagccagag

SEQ ID NO: 924752 - DNA, 19 bp, Homo sapiens
ccctgccacagccagagga

SEQ ID NO: 924753 - DNA, 13 bp, Homo sapiens
ccctgccaccgac

SEQ ID NO: 924754 - DNA, 17 bp, Homo sapiens
ccctgccaccgactgcc

SEQ ID NO: 924755 - DNA, 14 bp, Homo sapiens
ccctgccacctccc

SEQ ID NO: 924756 - DNA, 16 bp, Homo sapiens
ccctgccactcaccct

SEQ ID NO: 924757 - DNA, 18 bp, Homo sapiens
ccctgccactcacccttc

SEQ ID NO: 924758 - DNA, 21 bp, Homo sapiens
ccctgccactcacccttcctg

SEQ ID NO: 924759 - DNA, 18 bp, Homo sapiens
ccctgccactcactaggc

SEQ ID NO: 924760 - DNA, 13 bp, Homo sapiens
ccctgccactggg

SEQ ID NO: 924761 - DNA, 19 bp, Homo sapiens
ccctgccactgggctctgg

SEQ ID NO: 924762 - DNA, 20 bp, Homo sapiens
ccctgccactgggctctgga

SEQ ID NO: 924763 - DNA, 18 bp, Homo sapiens
ccctgccagccgaccctc

SEQ ID NO: 924764 - DNA, 22 bp, Homo sapiens
ccctgccaggagctttggacct

SEQ ID NO: 924765 - DNA, 12 bp, Homo sapiens
ccctgccagggc

SEQ ID NO: 924766 - DNA, 17 bp, Homo sapiens
ccctgccagtgccaggg

SEQ ID NO: 924767 - DNA, 12 bp, Homo sapiens
ccctgccatccc

SEQ ID NO: 924768 - DNA, 13 bp, Homo sapiens
ccctgccatcttc

SEQ ID NO: 924769 - DNA, 19 bp, Homo sapiens
ccctgccatcttcccagca

SEQ ID NO: 924770 - DNA, 17 bp, Homo sapiens
ccctgccattggcctct

SEQ ID NO: 924771 - DNA, 19 bp, Homo sapiens
ccctgccattggcctcttg

SEQ ID NO: 924772 - DNA, 18 bp, Homo sapiens
ccctgcccaaactcccct

SEQ ID NO: 924773 - DNA, 19 bp, Homo sapiens
ccctgcccaagtgaccagg

SEQ ID NO: 924774 - DNA, 20 bp, Homo sapiens
ccctgcccaagtgaccaggg

SEQ ID NO: 924775 - DNA, 21 bp, Homo sapiens
ccctgcccaagtgaccaggga

SEQ ID NO: 924776 - DNA, 12 bp, Homo sapiens
ccctgcccaccc

SEQ ID NO: 924777 - DNA, 13 bp, Homo sapiens
ccctgcccacccc

SEQ ID NO: 924778 - DNA, 20 bp, Homo sapiens
ccctgcccagcctgtggtgc

SEQ ID NO: 924779 - DNA, 20 bp, Homo sapiens
ccctgcccatccgtctgtct

SEQ ID NO: 924780 - DNA, 12 bp, Homo sapiens
ccctgcccatgt

SEQ ID NO: 924781 - DNA, 19 bp, Homo sapiens
ccctgccccacacctcctc

SEQ ID NO: 924782 - DNA, 24 bp, Homo sapiens
ccctgccccaccacgcatgctcag

SEQ ID NO: 924783 - DNA, 17 bp, Homo sapiens
ccctgccccaccccatc

SEQ ID NO: 924784 - DNA, 22 bp, Homo sapiens
ccctgccccaccccatccagcc

SEQ ID NO: 924785 - DNA, 15 bp, Homo sapiens
ccctgccccaggcct

SEQ ID NO: 924786 - DNA, 16 bp, Homo sapiens
ccctgccccaggcctg

SEQ ID NO: 924787 - DNA, 19 bp, Homo sapiens
ccctgccccaggcctggac

SEQ ID NO: 924788 - DNA, 17 bp, Homo sapiens
ccctgcccccacttcct

SEQ ID NO: 924789 - DNA, 18 bp, Homo sapiens
ccctgcccccacttcctg

SEQ ID NO: 924790 - DNA, 18 bp, Homo sapiens
ccctgcccccagccccgg

SEQ ID NO: 924791 - DNA, 16 bp, Homo sapiens
ccctgcccccatctcc

SEQ ID NO: 924792 - DNA, 21 bp, Homo sapiens
ccctgcccccatctccccagg

SEQ ID NO: 924793 - DNA, 15 bp, Homo sapiens
ccctgccccccagcc

SEQ ID NO: 924794 - DNA, 17 bp, Homo sapiens
ccctgccccctgccagc

SEQ ID NO: 924795 - DNA, 14 bp, Homo sapiens
ccctgccccgcccc

SEQ ID NO: 924796 - DNA, 21 bp, Homo sapiens
ccctgccccgccccccagagc

SEQ ID NO: 924797 - DNA, 23 bp, Homo sapiens
ccctgccccgccccccagagcca

SEQ ID NO: 924798 - DNA, 18 bp, Homo sapiens
ccctgccccggaggaagc

SEQ ID NO: 924799 - DNA, 12 bp, Homo sapiens
ccctgccccggg

SEQ ID NO: 924800 - DNA, 23 bp, Homo sapiens
ccctgcccctcccttcaaccatt

SEQ ID NO: 924801 - DNA, 11 bp, Homo sapiens
ccctgcccctg

SEQ ID NO: 924802 - DNA, 12 bp, Homo sapiens
ccctgcccctgc

SEQ ID NO: 924803 - DNA, 17 bp, Homo sapiens
ccctgcccctgccccgt

SEQ ID NO: 924804 - DNA, 18 bp, Homo sapiens
ccctgcccctgccccgtc

SEQ ID NO: 924805 - DNA, 15 bp, Homo sapiens
ccctgcccgctccca

SEQ ID NO: 924806 - DNA, 19 bp, Homo sapiens
gagctcctcttccatgctg

SEQ ID NO: 924807 - DNA, 12 bp, Homo sapiens
gagctcctggcc

SEQ ID NO: 924808 - DNA, 12 bp, Homo sapiens
gagctcctggga

SEQ ID NO: 924809 - DNA, 13 bp, Homo sapiens
gagctcctgggga

SEQ ID NO: 924810 - DNA, 13 bp, Homo sapiens
gagctcgcagccc

SEQ ID NO: 924811 - DNA, 17 bp, Homo sapiens
gagctcgcagcccccgc

SEQ ID NO: 924812 - DNA, 20 bp, Homo sapiens
gagctcgcagcccccgcgcc

SEQ ID NO: 924813 - DNA, 23 bp, Homo sapiens
gagctcgcccctcccctcagcct

SEQ ID NO: 924814 - DNA, 15 bp, Homo sapiens
gagctcggggtccac

SEQ ID NO: 924815 - DNA, 15 bp, Homo sapiens
gagctcggtggaccc

SEQ ID NO: 924816 - DNA, 19 bp, Homo sapiens
gagctcgtgtatcctgggg

SEQ ID NO: 924817 - DNA, 23 bp, Homo sapiens
gagctctcaaatccctctccaac

SEQ ID NO: 924818 - DNA, 16 bp, Homo sapiens
gagctctcccctcctg

SEQ ID NO: 924819 - DNA, 15 bp, Homo sapiens
gagctctcgaggaaa

SEQ ID NO: 924820 - DNA, 17 bp, Homo sapiens
gagctctctgcccttga

SEQ ID NO: 924821 - DNA, 23 bp, Homo sapiens
gagctctgcgccaggcagagctg

SEQ ID NO: 924822 - DNA, 20 bp, Homo sapiens
gagctctggggacagcttcc

SEQ ID NO: 924823 - DNA, 21 bp, Homo sapiens
gagctctggggacagcttcct

SEQ ID NO: 924824 - DNA, 22 bp, Homo sapiens
gagctctggggacagcttcctc

SEQ ID NO: 924825 - DNA, 19 bp, Homo sapiens
gagctctgtgggtctctgg

SEQ ID NO: 924826 - DNA, 20 bp, Homo sapiens
gagctcttcaagctgtcccc

SEQ ID NO: 924827 - DNA, 19 bp, Homo sapiens
gagctcttcaggcctccct

SEQ ID NO: 924828 - DNA, 22 bp, Homo sapiens
gagctcttcaggcctccctctc

SEQ ID NO: 924829 - DNA, 17 bp, Homo sapiens
gagctgaaatgctgcat

SEQ ID NO: 924830 - DNA, 18 bp, Homo sapiens
gagctgaaccacagaaat

SEQ ID NO: 924831 - DNA, 23 bp, Homo sapiens
gagctgaacccattttgagtgac

SEQ ID NO: 924832 - DNA, 15 bp, Homo sapiens
gagctgactgcatga

SEQ ID NO: 924833 - DNA, 14 bp, Homo sapiens
gagctgagaagagg

SEQ ID NO: 924834 - DNA, 17 bp, Homo sapiens
gagctgagaagaggagg

SEQ ID NO: 924835 - DNA, 13 bp, Homo sapiens
gagctgagatcgt

SEQ ID NO: 924836 - DNA, 21 bp, Homo sapiens
gagctgagatcgtgctactgc

SEQ ID NO: 924837 - DNA, 18 bp, Homo sapiens
gagctgagcagcctctgg

SEQ ID NO: 924838 - DNA, 19 bp, Homo sapiens
gagctgagcagcctctgga

SEQ ID NO: 924839 - DNA, 16 bp, Homo sapiens
gagctgaggcagcagt

SEQ ID NO: 924840 - DNA, 21 bp, Homo sapiens
gagctgagggagggagccatg

SEQ ID NO: 924841 - DNA, 23 bp, Homo sapiens
gagctgaggggggccgtgcccag

SEQ ID NO: 924842 - DNA, 21 bp, Homo sapiens
gagctgagtcacctcctccac

SEQ ID NO: 924843 - DNA, 17 bp, Homo sapiens
gagctgagtggccagcc

SEQ ID NO: 924844 - DNA, 16 bp, Homo sapiens
gagctgatccagagca

SEQ ID NO: 924845 - DNA, 18 bp, Homo sapiens
gagctgatgccccttctc

SEQ ID NO: 924846 - DNA, 14 bp, Homo sapiens
gagctgatggcagc

SEQ ID NO: 924847 - DNA, 19 bp, Homo sapiens
gagctgatttccaggcccc

SEQ ID NO: 924848 - DNA, 20 bp, Homo sapiens
gagctgatttccaggcccct

SEQ ID NO: 924849 - DNA, 21 bp, Homo sapiens
gagctgatttccaggcccctg

SEQ ID NO: 924850 - DNA, 13 bp, Homo sapiens
gagctgcagagca

SEQ ID NO: 924851 - DNA, 13 bp, Homo sapiens
gagctgcagcccc

SEQ ID NO: 924852 - DNA, 19 bp, Homo sapiens
gagctgcagccccccagag

SEQ ID NO: 924853 - DNA, 11 bp, Homo sapiens
gagctgcaggg

SEQ ID NO: 924854 - DNA, 12 bp, Homo sapiens
gagctgccaaga

SEQ ID NO: 924855 - DNA, 11 bp, Homo sapiens
gagctgccact

SEQ ID NO: 924856 - DNA, 15 bp, Homo sapiens
gagctgccactgggc

SEQ ID NO: 924857 - DNA, 19 bp, Homo sapiens
gagctgccactgggcacct

SEQ ID NO: 924858 - DNA, 12 bp, Homo sapiens
gagctgccagcc

SEQ ID NO: 924859 - DNA, 17 bp, Homo sapiens
gagctgcccggcgcctg

SEQ ID NO: 924860 - DNA, 21 bp, Homo sapiens
gagctgcccggcgcctgccct

SEQ ID NO: 924861 - DNA, 11 bp, Homo sapiens
gagctgccttc

SEQ ID NO: 924862 - DNA, 21 bp, Homo sapiens
gagctgccttggctcagacat

SEQ ID NO: 924863 - DNA, 13 bp, Homo sapiens
gagctgctctgct

SEQ ID NO: 924864 - DNA, 14 bp, Homo sapiens
gagctgctctgcta

SEQ ID NO: 924865 - DNA, 23 bp, Homo sapiens
gagctgctggctgacctgggccc

SEQ ID NO: 924866 - DNA, 16 bp, Homo sapiens
gagctgctggcttgca

SEQ ID NO: 924867 - DNA, 12 bp, Homo sapiens
gagctgctgggc

SEQ ID NO: 924868 - DNA, 14 bp, Homo sapiens
gagctgctgggcta

SEQ ID NO: 924869 - DNA, 12 bp, Homo sapiens
gagctgctgtgc

SEQ ID NO: 924870 - DNA, 14 bp, Homo sapiens
gagctggaaggcag

SEQ ID NO: 924871 - DNA, 17 bp, Homo sapiens
gagctggaaggcagggc

SEQ ID NO: 924872 - DNA, 21 bp, Homo sapiens
gagctggaaggcagggcagag

SEQ ID NO: 924873 - DNA, 14 bp, Homo sapiens
gagctggagccccc

SEQ ID NO: 924874 - DNA, 15 bp, Homo sapiens
gagctggagccccca

SEQ ID NO: 924875 - DNA, 19 bp, Homo sapiens
gagctggagcccccagcag

SEQ ID NO: 924876 - DNA, 22 bp, Homo sapiens
gagctggatagacttgggatgg

SEQ ID NO: 924877 - DNA, 19 bp, Homo sapiens
gagctggccaaagagcctt

SEQ ID NO: 924878 - DNA, 17 bp, Homo sapiens
gagctggccccgccgcc

SEQ ID NO: 924879 - DNA, 18 bp, Homo sapiens
gagctggcggcggcggct

SEQ ID NO: 924880 - DNA, 22 bp, Homo sapiens
gagctggctctgagcgcctcca

SEQ ID NO: 924881 - DNA, 15 bp, Homo sapiens
gagctggctgtgcct

SEQ ID NO: 924882 - DNA, 16 bp, Homo sapiens
gagctggctgtgcctg

SEQ ID NO: 924883 - DNA, 17 bp, Homo sapiens
gagctggctgtgcctgc

SEQ ID NO: 924884 - DNA, 19 bp, Homo sapiens
gagctgggaagctgtactc

SEQ ID NO: 924885 - DNA, 23 bp, Homo sapiens
gagctgggaagctgtactcagag

SEQ ID NO: 924886 - DNA, 21 bp, Homo sapiens
gagctgggacacttaacagat

SEQ ID NO: 924887 - DNA, 16 bp, Homo sapiens
gagctgggagacaaag

SEQ ID NO: 924888 - DNA, 18 bp, Homo sapiens
gagctgggagccaggctc

SEQ ID NO: 924889 - DNA, 16 bp, Homo sapiens
gagctgggaggaaaag

SEQ ID NO: 924890 - DNA, 17 bp, Homo sapiens
gagctgggaggaaaaga

SEQ ID NO: 924891 - DNA, 12 bp, Homo sapiens
gagctgggaggc

SEQ ID NO: 924892 - DNA, 21 bp, Homo sapiens
gagctgggaggtagaagggga

SEQ ID NO: 924893 - DNA, 13 bp, Homo sapiens
gagctggggacct

SEQ ID NO: 924894 - DNA, 18 bp, Homo sapiens
gagctggggactcaggga

SEQ ID NO: 924895 - DNA, 19 bp, Homo sapiens
gagctggggactcagggac

SEQ ID NO: 924896 - DNA, 13 bp, Homo sapiens
gagctggggaggt

SEQ ID NO: 924897 - DNA, 19 bp, Homo sapiens
gagctggggaggtgggagg

SEQ ID NO: 924898 - DNA, 21 bp, Homo sapiens
gagctggggaggtgggaggcc

SEQ ID NO: 924899 - DNA, 19 bp, Homo sapiens
gagctggggctgccagcct

SEQ ID NO: 924900 - DNA, 22 bp, Homo sapiens
gagctggggctgccagcctgag

SEQ ID NO: 924901 - DNA, 24 bp, Homo sapiens
gagctgggggccatgagctccaga

SEQ ID NO: 924902 - DNA, 19 bp, Homo sapiens
gagctggggtacaggtttg

SEQ ID NO: 924903 - DNA, 19 bp, Homo sapiens
gagctggggtctgggcagt

SEQ ID NO: 924904 - DNA, 24 bp, Homo sapiens
gagctgggtggcctgtttctgcag

SEQ ID NO: 924905 - DNA, 19 bp, Homo sapiens
gagctggtgactttgggga

SEQ ID NO: 924906 - DNA, 14 bp, Homo sapiens
gagctggtgcatta

SEQ ID NO: 924907 - DNA, 14 bp, Homo sapiens
gagctggtgtctga

SEQ ID NO: 924908 - DNA, 15 bp, Homo sapiens
gagctgtcttcccct

SEQ ID NO: 924909 - DNA, 19 bp, Homo sapiens
gagctgtggaggattgcta

SEQ ID NO: 924910 - DNA, 16 bp, Homo sapiens
gagctgtttatggcct

SEQ ID NO: 924911 - DNA, 17 bp, Homo sapiens
gagctgtttatggcctc

SEQ ID NO: 924912 - DNA, 21 bp, Homo sapiens
gagcttaatctttgaaaggtt

SEQ ID NO: 924913 - DNA, 16 bp, Homo sapiens
gagcttagcatatctg

SEQ ID NO: 924914 - DNA, 18 bp, Homo sapiens
gagcttagtgaaattact

SEQ ID NO: 924915 - DNA, 19 bp, Homo sapiens
gagcttattggccactggg

SEQ ID NO: 924916 - DNA, 16 bp, Homo sapiens
gagcttcatggcagaa

SEQ ID NO: 924917 - DNA, 19 bp, Homo sapiens
gagcttcatggcagaaggc

SEQ ID NO: 924918 - DNA, 15 bp, Homo sapiens
gagcttccaaatgtg

SEQ ID NO: 924919 - DNA, 20 bp, Homo sapiens
gagcttccaaatgtgtcaga

SEQ ID NO: 924920 - DNA, 13 bp, Homo sapiens
gagcttccctgac

SEQ ID NO: 924921 - DNA, 19 bp, Homo sapiens
gagcttcggttctccagaa

SEQ ID NO: 924922 - DNA, 16 bp, Homo sapiens
gagcttctctgtgaac

SEQ ID NO: 924923 - DNA, 18 bp, Homo sapiens
gaggagatgaccagggat

SEQ ID NO: 924924 - DNA, 17 bp, Homo sapiens
gaggagatgctccttgg

SEQ ID NO: 924925 - DNA, 13 bp, Homo sapiens
gaggagcacctga

SEQ ID NO: 924926 - DNA, 14 bp, Homo sapiens
gaggagcagccagg

SEQ ID NO: 924927 - DNA, 17 bp, Homo sapiens
gaggagcagccaggacc

SEQ ID NO: 924928 - DNA, 12 bp, Homo sapiens
gaggagcagcct

SEQ ID NO: 924929 - DNA, 15 bp, Homo sapiens
gaggagcagcctcga

SEQ ID NO: 924930 - DNA, 22 bp, Homo sapiens
gaggagcagcctcgaggctggt

SEQ ID NO: 924931 - DNA, 14 bp, Homo sapiens
gaggagcagctctc

SEQ ID NO: 924932 - DNA, 14 bp, Homo sapiens
gaggagcagctggg

SEQ ID NO: 924933 - DNA, 15 bp, Homo sapiens
gaggagcagcttcct

SEQ ID NO: 924934 - DNA, 12 bp, Homo sapiens
gaggagcccagt

SEQ ID NO: 924935 - DNA, 14 bp, Homo sapiens
gaggagcccagtgg

SEQ ID NO: 924936 - DNA, 21 bp, Homo sapiens
ccctggatgtgtggggcatgg

SEQ ID NO: 924937 - DNA, 17 bp, Homo sapiens
ccctggcagctgcccct

SEQ ID NO: 924938 - DNA, 23 bp, Homo sapiens
ccctggcagctgcccctcctgga

SEQ ID NO: 924939 - DNA, 20 bp, Homo sapiens
ccctggcatgatggacaaag

SEQ ID NO: 924940 - DNA, 23 bp, Homo sapiens
ccctggcatgatggacaaaggcc

SEQ ID NO: 924941 - DNA, 20 bp, Homo sapiens
ccctggcccaccccccagcc

SEQ ID NO: 924942 - DNA, 14 bp, Homo sapiens
ccctggcccagagt

SEQ ID NO: 924943 - DNA, 21 bp, Homo sapiens
ccctggcccagcggcccctcc

SEQ ID NO: 924944 - DNA, 19 bp, Homo sapiens
ccctggcccatctcagcct

SEQ ID NO: 924945 - DNA, 14 bp, Homo sapiens
ccctggccccagga

SEQ ID NO: 924946 - DNA, 14 bp, Homo sapiens
ccctggccccgccg

SEQ ID NO: 924947 - DNA, 16 bp, Homo sapiens
ccctggcccgcccctc

SEQ ID NO: 924948 - DNA, 14 bp, Homo sapiens
ccctggccctgagg

SEQ ID NO: 924949 - DNA, 20 bp, Homo sapiens
ccctggccgcgctccgggct

SEQ ID NO: 924950 - DNA, 10 bp, Homo sapiens
ccctggcctc

SEQ ID NO: 924951 - DNA, 11 bp, Homo sapiens
ccctggcctca

SEQ ID NO: 924952 - DNA, 21 bp, Homo sapiens
ccctggcctcagttcccagct

SEQ ID NO: 924953 - DNA, 20 bp, Homo sapiens
ccctggcctcccctgccacc

SEQ ID NO: 924954 - DNA, 13 bp, Homo sapiens
ccctggcctctgt

SEQ ID NO: 924955 - DNA, 15 bp, Homo sapiens
ccctggcctctgtgc

SEQ ID NO: 924956 - DNA, 12 bp, Homo sapiens
ccctggcctggc

SEQ ID NO: 924957 - DNA, 15 bp, Homo sapiens
ccctggcctgttctg

SEQ ID NO: 924958 - DNA, 19 bp, Homo sapiens
ccctggcctgttctgtttt

SEQ ID NO: 924959 - DNA, 16 bp, Homo sapiens
ccctggccttgcccgt

SEQ ID NO: 924960 - DNA, 13 bp, Homo sapiens
ccctggctcccat

SEQ ID NO: 924961 - DNA, 15 bp, Homo sapiens
ccctggctcccatga

SEQ ID NO: 924962 - DNA, 23 bp, Homo sapiens
ccctggctcccatgaccatactg

SEQ ID NO: 924963 - DNA, 12 bp, Homo sapiens
ccctggctccct

SEQ ID NO: 924964 - DNA, 23 bp, Homo sapiens
ccctggctccctcctccaggcct

SEQ ID NO: 924965 - DNA, 15 bp, Homo sapiens
ccctggctccttgca

SEQ ID NO: 924966 - DNA, 19 bp, Homo sapiens
ccctggctccttgcagcag

SEQ ID NO: 924967 - DNA, 19 bp, Homo sapiens
ccctggctctcagaaggta

SEQ ID NO: 924968 - DNA, 11 bp, Homo sapiens
ccctggctctg

SEQ ID NO: 924969 - DNA, 18 bp, Homo sapiens
ccctggctctgcccctca

SEQ ID NO: 924970 - DNA, 19 bp, Homo sapiens
ccctggctctgcccctcag

SEQ ID NO: 924971 - DNA, 20 bp, Homo sapiens
ccctggctctgcccctcagg

SEQ ID NO: 924972 - DNA, 14 bp, Homo sapiens
ccctggctctgggc

SEQ ID NO: 924973 - DNA, 16 bp, Homo sapiens
ccctggctctgggccg

SEQ ID NO: 924974 - DNA, 15 bp, Homo sapiens
ccctggctgccctgg

SEQ ID NO: 924975 - DNA, 17 bp, Homo sapiens
ccctggctgccctggcc

SEQ ID NO: 924976 - DNA, 20 bp, Homo sapiens
ccctggctgccctggccctg

SEQ ID NO: 924977 - DNA, 22 bp, Homo sapiens
ccctggctgccctggccctgag

SEQ ID NO: 924978 - DNA, 13 bp, Homo sapiens
ccctggctgctgc

SEQ ID NO: 924979 - DNA, 13 bp, Homo sapiens
ccctggcttttca

SEQ ID NO: 924980 - DNA, 22 bp, Homo sapiens
ccctgggaagcctgtgccagca

SEQ ID NO: 924981 - DNA, 23 bp, Homo sapiens
ccctgggacctatacagaacaga

SEQ ID NO: 924982 - DNA, 17 bp, Homo sapiens
ccctgggagccagtcct

SEQ ID NO: 924983 - DNA, 19 bp, Homo sapiens
ccctgggagccagtcctcc

SEQ ID NO: 924984 - DNA, 18 bp, Homo sapiens
ccctgggatgcctcacca

SEQ ID NO: 924985 - DNA, 16 bp, Homo sapiens
ccctgggatgctgacc

SEQ ID NO: 924986 - DNA, 23 bp, Homo sapiens
ccctgggatgctgacccaggaat

SEQ ID NO: 924987 - DNA, 21 bp, Homo sapiens
ccctgggatggaacctcagga

SEQ ID NO: 924988 - DNA, 19 bp, Homo sapiens
ccctgggatgggaccaggg

SEQ ID NO: 924989 - DNA, 12 bp, Homo sapiens
ccctgggcaggg

SEQ ID NO: 924990 - DNA, 15 bp, Homo sapiens
ccctgggccacctcc

SEQ ID NO: 924991 - DNA, 18 bp, Homo sapiens
ccctgggccacctcctac

SEQ ID NO: 924992 - DNA, 19 bp, Homo sapiens
ccctgggccacctcctacc

SEQ ID NO: 924993 - DNA, 16 bp, Homo sapiens
ccctgggccaggcagg

SEQ ID NO: 924994 - DNA, 17 bp, Homo sapiens
ccctgggccagggtctg

SEQ ID NO: 924995 - DNA, 16 bp, Homo sapiens
ccctgggccccaccac

SEQ ID NO: 924996 - DNA, 18 bp, Homo sapiens
ccctgggccccaccacct

SEQ ID NO: 924997 - DNA, 15 bp, Homo sapiens
ccctgggcccttgtg

SEQ ID NO: 924998 - DNA, 14 bp, Homo sapiens
ccctgggcctcagt

SEQ ID NO: 924999 - DNA, 14 bp, Homo sapiens
ccctgggctaagca

SEQ ID NO: 925000 - DNA, 24 bp, Homo sapiens
ccctgggctgatggaagatggtcc

SEQ ID NO: 925001 - DNA, 15 bp, Homo sapiens
ccctgggctggactg

SEQ ID NO: 925002 - DNA, 17 bp, Homo sapiens
ccctgggctggactgga

SEQ ID NO: 925003 - DNA, 14 bp, Homo sapiens
ccctgggctgggga

SEQ ID NO: 925004 - DNA, 17 bp, Homo sapiens
ccctgggctggggcctc

SEQ ID NO: 925005 - DNA, 19 bp, Homo sapiens
ccctgggctgggtgctggg

SEQ ID NO: 925006 - DNA, 13 bp, Homo sapiens
ccctgggctgtcc

SEQ ID NO: 925007 - DNA, 16 bp, Homo sapiens
ccctgggctgtctgtc

SEQ ID NO: 925008 - DNA, 19 bp, Homo sapiens
ccctgggctgtctgtcacc

SEQ ID NO: 925009 - DNA, 22 bp, Homo sapiens
ccctgggcttggcctgctgtga

SEQ ID NO: 925010 - DNA, 17 bp, Homo sapiens
ccctgggcttggctctt

SEQ ID NO: 925011 - DNA, 12 bp, Homo sapiens
ccctggggacag

SEQ ID NO: 925012 - DNA, 16 bp, Homo sapiens
ccctggggacagagcc

SEQ ID NO: 925013 - DNA, 20 bp, Homo sapiens
ccctggggatcttcccacag

SEQ ID NO: 925014 - DNA, 21 bp, Homo sapiens
ccctggggatcttcccacagg

SEQ ID NO: 925015 - DNA, 17 bp, Homo sapiens
ccctggggcccagcccc

SEQ ID NO: 925016 - DNA, 20 bp, Homo sapiens
ccctggggcctgactgctca

SEQ ID NO: 925017 - DNA, 21 bp, Homo sapiens
ccctggggcctgactgctcag

SEQ ID NO: 925018 - DNA, 14 bp, Homo sapiens
ccctggggcctgga

SEQ ID NO: 925019 - DNA, 13 bp, Homo sapiens
ccctggggctgta

SEQ ID NO: 925020 - DNA, 21 bp, Homo sapiens
ccctgggggtttcacctgggc

SEQ ID NO: 925021 - DNA, 22 bp, Homo sapiens
ccctggggtaccatgtggccac

SEQ ID NO: 925022 - DNA, 12 bp, Homo sapiens
ccctggggtggc

SEQ ID NO: 925023 - DNA, 16 bp, Homo sapiens
ccctggggtggccagg

SEQ ID NO: 925024 - DNA, 18 bp, Homo sapiens
ccctggggtggccagggc

SEQ ID NO: 925025 - DNA, 20 bp, Homo sapiens
ccctggggtgggatctgagc

SEQ ID NO: 925026 - DNA, 20 bp, Homo sapiens
ccctgggtgccattcccagc

SEQ ID NO: 925027 - DNA, 14 bp, Homo sapiens
ccctgggtgggagc

SEQ ID NO: 925028 - DNA, 18 bp, Homo sapiens
ccctgggtgggctctgtg

SEQ ID NO: 925029 - DNA, 20 bp, Homo sapiens
ccctgggtgggctctgtgca

SEQ ID NO: 925030 - DNA, 21 bp, Homo sapiens
ccctgggtgggtggtggggag

SEQ ID NO: 925031 - DNA, 22 bp, Homo sapiens
ccctgggtgggtggtggggagg

SEQ ID NO: 925032 - DNA, 22 bp, Homo sapiens
ccctgggttcagaaatgctgcc

SEQ ID NO: 925033 - DNA, 15 bp, Homo sapiens
ccctggtaagcagag

SEQ ID NO: 925034 - DNA, 23 bp, Homo sapiens
ccctggtaataagtactgtgtac

SEQ ID NO: 925035 - DNA, 18 bp, Homo sapiens
ccctggtccagggaagct

SEQ ID NO: 925036 - DNA, 13 bp, Homo sapiens
ccctggtccttcc

SEQ ID NO: 925037 - DNA, 17 bp, Homo sapiens
ccctggtccttccaggc

SEQ ID NO: 925038 - DNA, 15 bp, Homo sapiens
ccctggtctgtggag

SEQ ID NO: 925039 - DNA, 15 bp, Homo sapiens
ccctggtgacctcct

SEQ ID NO: 925040 - DNA, 14 bp, Homo sapiens
ccctggtgcctctg

SEQ ID NO: 925041 - DNA, 16 bp, Homo sapiens
ccctggtgcctctgtg

SEQ ID NO: 925042 - DNA, 21 bp, Homo sapiens
ccctggtgctcctgcccagcc

SEQ ID NO: 925043 - DNA, 20 bp, Homo sapiens
ccctggtggacagtcctggg

SEQ ID NO: 925044 - DNA, 20 bp, Homo sapiens
ccctggtggagaaagcactg

SEQ ID NO: 925045 - DNA, 22 bp, Homo sapiens
ccctgttttcccacgaggaatc

SEQ ID NO: 925046 - DNA, 22 bp, Homo sapiens
ccctgttttctgagcccgggct

SEQ ID NO: 925047 - DNA, 18 bp, Homo sapiens
ccctgttttctgtttctt

SEQ ID NO: 925048 - DNA, 14 bp, Homo sapiens
cccttaaacttcca

SEQ ID NO: 925049 - DNA, 21 bp, Homo sapiens
cccttaaagggaattcgatgc

SEQ ID NO: 925050 - DNA, 20 bp, Homo sapiens
cccttaacccaaggagcaca

SEQ ID NO: 925051 - DNA, 21 bp, Homo sapiens
cccttaactctaaccctgtgg

SEQ ID NO: 925052 - DNA, 22 bp, Homo sapiens
cccttaactctaaccctgtgga

SEQ ID NO: 925053 - DNA, 18 bp, Homo sapiens
cccttaacttttccttgt

SEQ ID NO: 925054 - DNA, 20 bp, Homo sapiens
cccttaagggttgaaggcag

SEQ ID NO: 925055 - DNA, 18 bp, Homo sapiens
cccttaatattgaggctg

SEQ ID NO: 925056 - DNA, 15 bp, Homo sapiens
cccttaatcttgctt

SEQ ID NO: 925057 - DNA, 15 bp, Homo sapiens
cccttacacgtacct

SEQ ID NO: 925058 - DNA, 12 bp, Homo sapiens
cccttacctcaa

SEQ ID NO: 925059 - DNA, 20 bp, Homo sapiens
cccttacttcctggcctctt

SEQ ID NO: 925060 - DNA, 23 bp, Homo sapiens
cccttacttcctggcctcttctg

SEQ ID NO: 925061 - DNA, 12 bp, Homo sapiens
cccttagcacag

SEQ ID NO: 925062 - DNA, 19 bp, Homo sapiens
cccttagcacagagaggga

SEQ ID NO: 925063 - DNA, 21 bp, Homo sapiens
cccttaggatggggctcccag

SEQ ID NO: 925064 - DNA, 23 bp, Homo sapiens
cccttaggatggggctcccagct

SEQ ID NO: 925065 - DNA, 19 bp, Homo sapiens
cccttaggcattatttaat

SEQ ID NO: 925066 - DNA, 12 bp, Homo sapiens
cccttatccagg

SEQ ID NO: 925067 - DNA, 18 bp, Homo sapiens
gaggccaaaggctggtgg

SEQ ID NO: 925068 - DNA, 20 bp, Homo sapiens
gaggccaaccagcccgacag

SEQ ID NO: 925069 - DNA, 21 bp, Homo sapiens
gaggccaagcagtgcctgcct

SEQ ID NO: 925070 - DNA, 15 bp, Homo sapiens
gaggccaaggactga

SEQ ID NO: 925071 - DNA, 23 bp, Homo sapiens
gaggccaaggactgactttgcca

SEQ ID NO: 925072 - DNA, 15 bp, Homo sapiens
gaggccaaggcaggt

SEQ ID NO: 925073 - DNA, 12 bp, Homo sapiens
gaggccaaggtg

SEQ ID NO: 925074 - DNA, 17 bp, Homo sapiens
gaggccaaggtgggcgg

SEQ ID NO: 925075 - DNA, 12 bp, Homo sapiens
gaggccacccca

SEQ ID NO: 925076 - DNA, 12 bp, Homo sapiens
gaggccacctct

SEQ ID NO: 925077 - DNA, 17 bp, Homo sapiens
gaggccacctctccaag

SEQ ID NO: 925078 - DNA, 20 bp, Homo sapiens
gaggccacctctccaagggc

SEQ ID NO: 925079 - DNA, 15 bp, Homo sapiens
gaggccactcagagg

SEQ ID NO: 925080 - DNA, 21 bp, Homo sapiens
gaggccactcagaggccccca

SEQ ID NO: 925081 - DNA, 18 bp, Homo sapiens
gaggccagaccatggaca

SEQ ID NO: 925082 - DNA, 18 bp, Homo sapiens
gaggccagagtctcccag

SEQ ID NO: 925083 - DNA, 13 bp, Homo sapiens
gaggccagcccca

SEQ ID NO: 925084 - DNA, 20 bp, Homo sapiens
gaggccagccccacccagga

SEQ ID NO: 925085 - DNA, 22 bp, Homo sapiens
gaggccagccccacccaggagg

SEQ ID NO: 925086 - DNA, 11 bp, Homo sapiens
gaggccaggcg

SEQ ID NO: 925087 - DNA, 18 bp, Homo sapiens
gaggccaggcgagcctga

SEQ ID NO: 925088 - DNA, 13 bp, Homo sapiens
gaggccagggcag

SEQ ID NO: 925089 - DNA, 20 bp, Homo sapiens
gaggccagggcagcaaggga

SEQ ID NO: 925090 - DNA, 17 bp, Homo sapiens
gaggccagtacctttcc

SEQ ID NO: 925091 - DNA, 14 bp, Homo sapiens
gaggccagtggccc

SEQ ID NO: 925092 - DNA, 20 bp, Homo sapiens
gaggccagttgatctgctct

SEQ ID NO: 925093 - DNA, 22 bp, Homo sapiens
gaggccagttgatctgctctgt

SEQ ID NO: 925094 - DNA, 15 bp, Homo sapiens
gaggccatcagggcc

SEQ ID NO: 925095 - DNA, 18 bp, Homo sapiens
gaggccatcagggccctg

SEQ ID NO: 925096 - DNA, 20 bp, Homo sapiens
gaggccatcagggccctgcc

SEQ ID NO: 925097 - DNA, 14 bp, Homo sapiens
gaggcccaaggagc

SEQ ID NO: 925098 - DNA, 23 bp, Homo sapiens
gaggcccaaggagcttacccaag

SEQ ID NO: 925099 - DNA, 19 bp, Homo sapiens
gaggcccactagagggccc

SEQ ID NO: 925100 - DNA, 11 bp, Homo sapiens
gaggcccagcc

SEQ ID NO: 925101 - DNA, 13 bp, Homo sapiens
gaggcccaggcac

SEQ ID NO: 925102 - DNA, 19 bp, Homo sapiens
gaggcccaggcaccaccag

SEQ ID NO: 925103 - DNA, 22 bp, Homo sapiens
gaggcccaggcaccaccaggag

SEQ ID NO: 925104 - DNA, 13 bp, Homo sapiens
gaggcccaggctg

SEQ ID NO: 925105 - DNA, 15 bp, Homo sapiens
gaggcccaggctggg

SEQ ID NO: 925106 - DNA, 12 bp, Homo sapiens
gaggcccaggga

SEQ ID NO: 925107 - DNA, 17 bp, Homo sapiens
gaggcccccagcccagg

SEQ ID NO: 925108 - DNA, 20 bp, Homo sapiens
gaggcccccagcccagggct

SEQ ID NO: 925109 - DNA, 20 bp, Homo sapiens
gaggcccccagtggggacag

SEQ ID NO: 925110 - DNA, 13 bp, Homo sapiens
gaggcccccgacc

SEQ ID NO: 925111 - DNA, 24 bp, Homo sapiens
gaggcccctatgtagtccgtgctg

SEQ ID NO: 925112 - DNA, 18 bp, Homo sapiens
gaggcccctggagccaga

SEQ ID NO: 925113 - DNA, 24 bp, Homo sapiens
gaggcccctgggtccttctagctt

SEQ ID NO: 925114 - DNA, 14 bp, Homo sapiens
gaggccctcctgtg

SEQ ID NO: 925115 - DNA, 16 bp, Homo sapiens
gaggccctcctgtgct

SEQ ID NO: 925116 - DNA, 21 bp, Homo sapiens
gaggccctcctgtgctggggg

SEQ ID NO: 925117 - DNA, 13 bp, Homo sapiens
gaggccctgaagc

SEQ ID NO: 925118 - DNA, 21 bp, Homo sapiens
gaggccctgaagcctccgtgg

SEQ ID NO: 925119 - DNA, 19 bp, Homo sapiens
gaggccctggtcctggcct

SEQ ID NO: 925120 - DNA, 14 bp, Homo sapiens
gaggccctggtgtc

SEQ ID NO: 925121 - DNA, 12 bp, Homo sapiens
gaggcccttcct

SEQ ID NO: 925122 - DNA, 12 bp, Homo sapiens
gaggcccttgtc

SEQ ID NO: 925123 - DNA, 23 bp, Homo sapiens
gaggcccttgtcgtgggatggca

SEQ ID NO: 925124 - DNA, 18 bp, Homo sapiens
gaggccgcggcctccccg

SEQ ID NO: 925125 - DNA, 20 bp, Homo sapiens
gaggccgctagaggcctgag

SEQ ID NO: 925126 - DNA, 19 bp, Homo sapiens
gaggccgcttagtgctgct

SEQ ID NO: 925127 - DNA, 19 bp, Homo sapiens
gaggccggagagctggtga

SEQ ID NO: 925128 - DNA, 19 bp, Homo sapiens
gaggccgggcggtcacagc

SEQ ID NO: 925129 - DNA, 17 bp, Homo sapiens
gaggccggggtccaggc

SEQ ID NO: 925130 - DNA, 14 bp, Homo sapiens
gaggcctcaggtgc

SEQ ID NO: 925131 - DNA, 15 bp, Homo sapiens
gaggcctcaggtgct

SEQ ID NO: 925132 - DNA, 20 bp, Homo sapiens
gaggcctcaggtgctgtcca

SEQ ID NO: 925133 - DNA, 16 bp, Homo sapiens
gaggcctcagtggact

SEQ ID NO: 925134 - DNA, 19 bp, Homo sapiens
gaggcctcagtttctccat

SEQ ID NO: 925135 - DNA, 17 bp, Homo sapiens
gaggcctcatccagggc

SEQ ID NO: 925136 - DNA, 15 bp, Homo sapiens
gaggcctctggccct

SEQ ID NO: 925137 - DNA, 22 bp, Homo sapiens
gaggcctcttggacctctgctc

SEQ ID NO: 925138 - DNA, 24 bp, Homo sapiens
gaggcctcttggacctctgctctg

SEQ ID NO: 925139 - DNA, 13 bp, Homo sapiens
gaggcctgaagcc

SEQ ID NO: 925140 - DNA, 20 bp, Homo sapiens
gaggcctgaggatgagctgg

SEQ ID NO: 925141 - DNA, 13 bp, Homo sapiens
gaggcctgatgct

SEQ ID NO: 925142 - DNA, 15 bp, Homo sapiens
gaggcctgatgctgc

SEQ ID NO: 925143 - DNA, 17 bp, Homo sapiens
gaggcctgatgctgccc

SEQ ID NO: 925144 - DNA, 20 bp, Homo sapiens
gaggcctgcaaaccttcctg

SEQ ID NO: 925145 - DNA, 19 bp, Homo sapiens
gaggcctggaccgagatgt

SEQ ID NO: 925146 - DNA, 19 bp, Homo sapiens
gaggcctggactttcctgc

SEQ ID NO: 925147 - DNA, 22 bp, Homo sapiens
gaggcctgggccgctgccacgt

SEQ ID NO: 925148 - DNA, 18 bp, Homo sapiens
gaggcctggggaggccct

SEQ ID NO: 925149 - DNA, 19 bp, Homo sapiens
gaggcctgtttggcctctc

SEQ ID NO: 925150 - DNA, 15 bp, Homo sapiens
gaggccttccagctg

SEQ ID NO: 925151 - DNA, 18 bp, Homo sapiens
gaggccttccagctgctg

SEQ ID NO: 925152 - DNA, 17 bp, Homo sapiens
gaggccttgtgtgtcag

SEQ ID NO: 925153 - DNA, 18 bp, Homo sapiens
gaggccttgtgtgtcagg

SEQ ID NO: 925154 - DNA, 19 bp, Homo sapiens
gaggccttgtgtgtcaggc

SEQ ID NO: 925155 - DNA, 22 bp, Homo sapiens
gaggcgcccttggcttctgtga

SEQ ID NO: 925156 - DNA, 20 bp, Homo sapiens
gaggcgggagaatcatgtga

SEQ ID NO: 925157 - DNA, 15 bp, Homo sapiens
gaggcgggccagcca

SEQ ID NO: 925158 - DNA, 17 bp, Homo sapiens
gaggcgggccagccagg

SEQ ID NO: 925159 - DNA, 19 bp, Homo sapiens
gaggcgggccagccaggcg

SEQ ID NO: 925160 - DNA, 20 bp, Homo sapiens
gaggcgggccagccaggcgg

SEQ ID NO: 925161 - DNA, 18 bp, Homo sapiens
gaggcggggaggaggaac

SEQ ID NO: 925162 - DNA, 12 bp, Homo sapiens
gaggcgggtgga

SEQ ID NO: 925163 - DNA, 19 bp, Homo sapiens
gaggcgggtggatcacctg

SEQ ID NO: 925164 - DNA, 20 bp, Homo sapiens
gaggcgtcttcatctccctg

SEQ ID NO: 925165 - DNA, 18 bp, Homo sapiens
gaggcgtgcccccctcct

SEQ ID NO: 925166 - DNA, 16 bp, Homo sapiens
gagggattgaggggcc

SEQ ID NO: 925167 - DNA, 19 bp, Homo sapiens
gagggattggccgcttggc

SEQ ID NO: 925168 - DNA, 18 bp, Homo sapiens
gagggatttccctgcaga

SEQ ID NO: 925169 - DNA, 20 bp, Homo sapiens
gagggattttagcctcttcc

SEQ ID NO: 925170 - DNA, 15 bp, Homo sapiens
gagggcaagccacca

SEQ ID NO: 925171 - DNA, 20 bp, Homo sapiens
gagggcaagtggatgggaat

SEQ ID NO: 925172 - DNA, 19 bp, Homo sapiens
gagggcactggagctggga

SEQ ID NO: 925173 - DNA, 15 bp, Homo sapiens
gagggcacttcaggt

SEQ ID NO: 925174 - DNA, 17 bp, Homo sapiens
gagggcacttcaggtcc

SEQ ID NO: 925175 - DNA, 18 bp, Homo sapiens
gagggcacttcaggtccg

SEQ ID NO: 925176 - DNA, 22 bp, Homo sapiens
gagggcacttcaggtccgtggg

SEQ ID NO: 925177 - DNA, 18 bp, Homo sapiens
gagggcacttcctccaca

SEQ ID NO: 925178 - DNA, 21 bp, Homo sapiens
gagggcagactggggcatcct

SEQ ID NO: 925179 - DNA, 13 bp, Homo sapiens
gagggcagagcca

SEQ ID NO: 925180 - DNA, 14 bp, Homo sapiens
gagggcagagccat

SEQ ID NO: 925181 - DNA, 20 bp, Homo sapiens
gagggcagagccatgggcct

SEQ ID NO: 925182 - DNA, 15 bp, Homo sapiens
gagggcagcagggct

SEQ ID NO: 925183 - DNA, 13 bp, Homo sapiens
gagggcagctggc

SEQ ID NO: 925184 - DNA, 13 bp, Homo sapiens
gagggcaggctga

SEQ ID NO: 925185 - DNA, 22 bp, Homo sapiens
gagggcaggctgaggtggggaa

SEQ ID NO: 925186 - DNA, 14 bp, Homo sapiens
gagggcaggcttgg

SEQ ID NO: 925187 - DNA, 18 bp, Homo sapiens
gagggcaggcttggggaa

SEQ ID NO: 925188 - DNA, 20 bp, Homo sapiens
gagggcaggcttggggaaaa

SEQ ID NO: 925189 - DNA, 15 bp, Homo sapiens
gagggcagtacctgg

SEQ ID NO: 925190 - DNA, 16 bp, Homo sapiens
gagggcagtgtttcct

SEQ ID NO: 925191 - DNA, 16 bp, Homo sapiens
gagggccacatgggag

SEQ ID NO: 925192 - DNA, 16 bp, Homo sapiens
gagggccagagctagg

SEQ ID NO: 925193 - DNA, 12 bp, Homo sapiens
gagggccagcag

SEQ ID NO: 925194 - DNA, 11 bp, Homo sapiens
gagggccaggc

SEQ ID NO: 925195 - DNA, 13 bp, Homo sapiens
gagggccaggcag

SEQ ID NO: 925196 - DNA, 17 bp, Homo sapiens
gagggcccaaagaattg

SEQ ID NO: 925197 - DNA, 13 bp, Homo sapiens
gagggcccagagc

SEQ ID NO: 925198 - DNA, 16 bp, Homo sapiens
cccttgccccaggcca

SEQ ID NO: 925199 - DNA, 17 bp, Homo sapiens
cccttgccccaggccag

SEQ ID NO: 925200 - DNA, 18 bp, Homo sapiens
cccttgcccccatccctc

SEQ ID NO: 925201 - DNA, 12 bp, Homo sapiens
cccttgccctcc

SEQ ID NO: 925202 - DNA, 17 bp, Homo sapiens
cccttgccctccgcctg

SEQ ID NO: 925203 - DNA, 13 bp, Homo sapiens
cccttgccctgac

SEQ ID NO: 925204 - DNA, 16 bp, Homo sapiens
cccttgccctgacctc

SEQ ID NO: 925205 - DNA, 20 bp, Homo sapiens
cccttgccctgacctcccag

SEQ ID NO: 925206 - DNA, 14 bp, Homo sapiens
cccttgcccttgga

SEQ ID NO: 925207 - DNA, 20 bp, Homo sapiens
cccttgcctccccatttccc

SEQ ID NO: 925208 - DNA, 23 bp, Homo sapiens
cccttgcctccccatttcccatc

SEQ ID NO: 925209 - DNA, 20 bp, Homo sapiens
cccttgcctttcgaggcctg

SEQ ID NO: 925210 - DNA, 21 bp, Homo sapiens
cccttgcctttcgaggcctga

SEQ ID NO: 925211 - DNA, 20 bp, Homo sapiens
cccttgctcagtgcctcctg

SEQ ID NO: 925212 - DNA, 12 bp, Homo sapiens
cccttgctgctt

SEQ ID NO: 925213 - DNA, 15 bp, Homo sapiens
cccttgctggcccca

SEQ ID NO: 925214 - DNA, 21 bp, Homo sapiens
cccttgctggccccagccctg

SEQ ID NO: 925215 - DNA, 23 bp, Homo sapiens
cccttgctggccccagccctgct

SEQ ID NO: 925216 - DNA, 24 bp, Homo sapiens
cccttgctggccccagccctgctg

SEQ ID NO: 925217 - DNA, 13 bp, Homo sapiens
cccttgctttcct

SEQ ID NO: 925218 - DNA, 17 bp, Homo sapiens
cccttgcttttccctct

SEQ ID NO: 925219 - DNA, 21 bp, Homo sapiens
cccttgcttttccctcttttc

SEQ ID NO: 925220 - DNA, 13 bp, Homo sapiens
cccttggaaacct

SEQ ID NO: 925221 - DNA, 22 bp, Homo sapiens
cccttggaaacctgccctgcct

SEQ ID NO: 925222 - DNA, 23 bp, Homo sapiens
cccttggaaacctgccctgcctg

SEQ ID NO: 925223 - DNA, 19 bp, Homo sapiens
cccttggaaatgtctgctg

SEQ ID NO: 925224 - DNA, 15 bp, Homo sapiens
cccttggacacttgg

SEQ ID NO: 925225 - DNA, 15 bp, Homo sapiens
cccttggacctccag

SEQ ID NO: 925226 - DNA, 19 bp, Homo sapiens
cccttggagcgtggactgg

SEQ ID NO: 925227 - DNA, 19 bp, Homo sapiens
cccttggagggagaggtgg

SEQ ID NO: 925228 - DNA, 12 bp, Homo sapiens
cccttggcacca

SEQ ID NO: 925229 - DNA, 18 bp, Homo sapiens
cccttggcaccaccaggg

SEQ ID NO: 925230 - DNA, 14 bp, Homo sapiens
cccttggcagtgtc

SEQ ID NO: 925231 - DNA, 16 bp, Homo sapiens
cccttggccccagagg

SEQ ID NO: 925232 - DNA, 13 bp, Homo sapiens
cccttggctgcag

SEQ ID NO: 925233 - DNA, 14 bp, Homo sapiens
cccttggctgtgag

SEQ ID NO: 925234 - DNA, 22 bp, Homo sapiens
cccttggctgtgaggcccctgg

SEQ ID NO: 925235 - DNA, 23 bp, Homo sapiens
cccttggctgtgaggcccctgga

SEQ ID NO: 925236 - DNA, 15 bp, Homo sapiens
cccttggcttctgct

SEQ ID NO: 925237 - DNA, 22 bp, Homo sapiens
cccttgggaaggacacagcagt

SEQ ID NO: 925238 - DNA, 17 bp, Homo sapiens
cccttgggacagccaga

SEQ ID NO: 925239 - DNA, 12 bp, Homo sapiens
cccttgggcagt

SEQ ID NO: 925240 - DNA, 13 bp, Homo sapiens
cccttgggcagtt

SEQ ID NO: 925241 - DNA, 16 bp, Homo sapiens
cccttgggccagaagt

SEQ ID NO: 925242 - DNA, 21 bp, Homo sapiens
cccttgggccagaagtaccag

SEQ ID NO: 925243 - DNA, 15 bp, Homo sapiens
cccttggggcctggc

SEQ ID NO: 925244 - DNA, 20 bp, Homo sapiens
cccttggggtaagccagagc

SEQ ID NO: 925245 - DNA, 22 bp, Homo sapiens
cccttggggtaagccagagcct

SEQ ID NO: 925246 - DNA, 17 bp, Homo sapiens
cccttggtggcaagagc

SEQ ID NO: 925247 - DNA, 21 bp, Homo sapiens
cccttggtgtttcccttcctc

SEQ ID NO: 925248 - DNA, 17 bp, Homo sapiens
cccttgtacagtgtctg

SEQ ID NO: 925249 - DNA, 12 bp, Homo sapiens
cccttgtatagt

SEQ ID NO: 925250 - DNA, 11 bp, Homo sapiens
cccttgtattt

SEQ ID NO: 925251 - DNA, 15 bp, Homo sapiens
cccttgtcctgccag

SEQ ID NO: 925252 - DNA, 17 bp, Homo sapiens
cccttgtcctgccagct

SEQ ID NO: 925253 - DNA, 19 bp, Homo sapiens
cccttgtcctgccagctgc

SEQ ID NO: 925254 - DNA, 20 bp, Homo sapiens
cccttgtcgcgcgtctccca

SEQ ID NO: 925255 - DNA, 24 bp, Homo sapiens
cccttgtcgcgcgtctcccatcct

SEQ ID NO: 925256 - DNA, 15 bp, Homo sapiens
cccttgtctccctgg

SEQ ID NO: 925257 - DNA, 18 bp, Homo sapiens
cccttgtctccctggttg

SEQ ID NO: 925258 - DNA, 23 bp, Homo sapiens
cccttgtcttttcaagtaatttt

SEQ ID NO: 925259 - DNA, 17 bp, Homo sapiens
cccttgtgagagcccat

SEQ ID NO: 925260 - DNA, 17 bp, Homo sapiens
cccttgtgcgtgggtga

SEQ ID NO: 925261 - DNA, 23 bp, Homo sapiens
cccttgtgcgtgggtgaagccgc

SEQ ID NO: 925262 - DNA, 12 bp, Homo sapiens
cccttgtgtgtg

SEQ ID NO: 925263 - DNA, 23 bp, Homo sapiens
cccttgtgtgtgccctgggccag

SEQ ID NO: 925264 - DNA, 23 bp, Homo sapiens
cccttgttgcactgccccctgct

SEQ ID NO: 925265 - DNA, 15 bp, Homo sapiens
cccttgtttacagtg

SEQ ID NO: 925266 - DNA, 22 bp, Homo sapiens
cccttgtttacagtgaggactc

SEQ ID NO: 925267 - DNA, 22 bp, Homo sapiens
ccctttaaccctgattcatact

SEQ ID NO: 925268 - DNA, 19 bp, Homo sapiens
ccctttaggatgttttcct

SEQ ID NO: 925269 - DNA, 17 bp, Homo sapiens
ccctttcagatgtcttc

SEQ ID NO: 925270 - DNA, 19 bp, Homo sapiens
ccctttcagatgtcttctg

SEQ ID NO: 925271 - DNA, 19 bp, Homo sapiens
ccctttcatcggtgcctgg

SEQ ID NO: 925272 - DNA, 20 bp, Homo sapiens
ccctttccccacgcccaccc

SEQ ID NO: 925273 - DNA, 12 bp, Homo sapiens
ccctttcccggg

SEQ ID NO: 925274 - DNA, 18 bp, Homo sapiens
ccctttcctccccataca

SEQ ID NO: 925275 - DNA, 21 bp, Homo sapiens
ccctttcctccccatacacac

SEQ ID NO: 925276 - DNA, 14 bp, Homo sapiens
ccctttcctcctca

SEQ ID NO: 925277 - DNA, 13 bp, Homo sapiens
ccctttcctggtt

SEQ ID NO: 925278 - DNA, 18 bp, Homo sapiens
ccctttccttccatccct

SEQ ID NO: 925279 - DNA, 22 bp, Homo sapiens
ccctttctatcgttctctcttt

SEQ ID NO: 925280 - DNA, 14 bp, Homo sapiens
ccctttctctctcc

SEQ ID NO: 925281 - DNA, 22 bp, Homo sapiens
ccctttctctctcctctctgct

SEQ ID NO: 925282 - DNA, 20 bp, Homo sapiens
ccctttgacttcagctgcct

SEQ ID NO: 925283 - DNA, 14 bp, Homo sapiens
ccctttgagtgcag

SEQ ID NO: 925284 - DNA, 21 bp, Homo sapiens
ccctttgcagtgtgcagggtg

SEQ ID NO: 925285 - DNA, 17 bp, Homo sapiens
ccctttgcccagaaaga

SEQ ID NO: 925286 - DNA, 24 bp, Homo sapiens
ccctttggagaacgccagtctccc

SEQ ID NO: 925287 - DNA, 23 bp, Homo sapiens
ccctttggagatgctgagggtgt

SEQ ID NO: 925288 - DNA, 22 bp, Homo sapiens
ccgagtctgggacacaaaactc

SEQ ID NO: 925289 - DNA, 16 bp, Homo sapiens
ccgagtgaacctacct

SEQ ID NO: 925290 - DNA, 18 bp, Homo sapiens
ccgagtggggcctgcctg

SEQ ID NO: 925291 - DNA, 23 bp, Homo sapiens
ccgataaagacggattctaagga

SEQ ID NO: 925292 - DNA, 14 bp, Homo sapiens
ccgatattctccct

SEQ ID NO: 925293 - DNA, 12 bp, Homo sapiens
ccgatcaacatt

SEQ ID NO: 925294 - DNA, 13 bp, Homo sapiens
ccgatccttcctc

SEQ ID NO: 925295 - DNA, 14 bp, Homo sapiens
ccgatccttcctcc

SEQ ID NO: 925296 - DNA, 20 bp, Homo sapiens
ccgatgagggaaggagccca

SEQ ID NO: 925297 - DNA, 21 bp, Homo sapiens
ccgatgatactgtttcttgca

SEQ ID NO: 925298 - DNA, 13 bp, Homo sapiens
ccgatgccaccgg

SEQ ID NO: 925299 - DNA, 15 bp, Homo sapiens
ccgatgctccagcca

SEQ ID NO: 925300 - DNA, 21 bp, Homo sapiens
ccgatgctgctttcccctgtg

SEQ ID NO: 925301 - DNA, 23 bp, Homo sapiens
ccgatgctgctttcccctgtggg

SEQ ID NO: 925302 - DNA, 13 bp, Homo sapiens
ccgatggagcccc

SEQ ID NO: 925303 - DNA, 17 bp, Homo sapiens
ccgatgtgtctcccaga

SEQ ID NO: 925304 - DNA, 18 bp, Homo sapiens
ccgatgtgtctcccagaa

SEQ ID NO: 925305 - DNA, 21 bp, Homo sapiens
ccgcaatgtggagcagcagcc

SEQ ID NO: 925306 - DNA, 14 bp, Homo sapiens
ccgcacagccaccc

SEQ ID NO: 925307 - DNA, 13 bp, Homo sapiens
ccgcacagctcag

SEQ ID NO: 925308 - DNA, 14 bp, Homo sapiens
ccgcacagctcagg

SEQ ID NO: 925309 - DNA, 16 bp, Homo sapiens
ccgcacagctcaggag

SEQ ID NO: 925310 - DNA, 17 bp, Homo sapiens
ccgcaccagctgctctg

SEQ ID NO: 925311 - DNA, 13 bp, Homo sapiens
ccgcacccccgcc

SEQ ID NO: 925312 - DNA, 15 bp, Homo sapiens
ccgcacccctccctg

SEQ ID NO: 925313 - DNA, 23 bp, Homo sapiens
ccgcaccgaccacggggccgaca

SEQ ID NO: 925314 - DNA, 20 bp, Homo sapiens
ccgcaccttcctcctccccg

SEQ ID NO: 925315 - DNA, 18 bp, Homo sapiens
ccgcacgcctctccctgc

SEQ ID NO: 925316 - DNA, 22 bp, Homo sapiens
ccgcactttccacttcttcctt

SEQ ID NO: 925317 - DNA, 15 bp, Homo sapiens
ccgcagaagcagccc

SEQ ID NO: 925318 - DNA, 15 bp, Homo sapiens
ccgcagacaccttgg

SEQ ID NO: 925319 - DNA, 20 bp, Homo sapiens
ccgcagactgcttggccaga

SEQ ID NO: 925320 - DNA, 12 bp, Homo sapiens
ccgcagaggcag

SEQ ID NO: 925321 - DNA, 21 bp, Homo sapiens
ccgcagccagccggtgcctgg

SEQ ID NO: 925322 - DNA, 16 bp, Homo sapiens
ccgcagcccgcctgcc

SEQ ID NO: 925323 - DNA, 21 bp, Homo sapiens
ccgcagcccgtgaagcagtgc

SEQ ID NO: 925324 - DNA, 22 bp, Homo sapiens
ccgcagcccgtgaagcagtgcc

SEQ ID NO: 925325 - DNA, 20 bp, Homo sapiens
ccgcagctcttgcccttccc

SEQ ID NO: 925326 - DNA, 14 bp, Homo sapiens
ccgcaggaaggcag

SEQ ID NO: 925327 - DNA, 12 bp, Homo sapiens
ccgcaggaggga

SEQ ID NO: 925328 - DNA, 13 bp, Homo sapiens
gagggtgggccag

SEQ ID NO: 925329 - DNA, 15 bp, Homo sapiens
gagggtgggggaggg

SEQ ID NO: 925330 - DNA, 17 bp, Homo sapiens
gagggtgggggagggag

SEQ ID NO: 925331 - DNA, 16 bp, Homo sapiens
gagggtgttcagaggc

SEQ ID NO: 925332 - DNA, 13 bp, Homo sapiens
gagggttcccctg

SEQ ID NO: 925333 - DNA, 15 bp, Homo sapiens
gagggttcccctggc

SEQ ID NO: 925334 - DNA, 18 bp, Homo sapiens
gagggttcccctggcctt

SEQ ID NO: 925335 - DNA, 14 bp, Homo sapiens
gagggttgctgcct

SEQ ID NO: 925336 - DNA, 17 bp, Homo sapiens
gagggttggggaggggc

SEQ ID NO: 925337 - DNA, 13 bp, Homo sapiens
gagggttgtgcta

SEQ ID NO: 925338 - DNA, 21 bp, Homo sapiens
gagggttttaggtagaaaaac

SEQ ID NO: 925339 - DNA, 22 bp, Homo sapiens
gaggtaaaagtgtgagcagtga

SEQ ID NO: 925340 - DNA, 20 bp, Homo sapiens
gaggtactggtcccttcctt

SEQ ID NO: 925341 - DNA, 18 bp, Homo sapiens
gaggtagagtttgaagga

SEQ ID NO: 925342 - DNA, 23 bp, Homo sapiens
gaggtagagtttgaaggaggtga

SEQ ID NO: 925343 - DNA, 19 bp, Homo sapiens
gaggtagccgagtcacacc

SEQ ID NO: 925344 - DNA, 15 bp, Homo sapiens
gaggtaggctgtggg

SEQ ID NO: 925345 - DNA, 15 bp, Homo sapiens
gaggtataaagacaa

SEQ ID NO: 925346 - DNA, 17 bp, Homo sapiens
gaggtataaagacaagt

SEQ ID NO: 925347 - DNA, 19 bp, Homo sapiens
gaggtatttatctttactt

SEQ ID NO: 925348 - DNA, 16 bp, Homo sapiens
gaggtcaacagagaag

SEQ ID NO: 925349 - DNA, 16 bp, Homo sapiens
gaggtcaagtaagaag

SEQ ID NO: 925350 - DNA, 11 bp, Homo sapiens
gaggtcaataa

SEQ ID NO: 925351 - DNA, 15 bp, Homo sapiens
gaggtcaataaagca

SEQ ID NO: 925352 - DNA, 16 bp, Homo sapiens
gaggtcaataaagcag

SEQ ID NO: 925353 - DNA, 18 bp, Homo sapiens
gaggtcaataaagcagag

SEQ ID NO: 925354 - DNA, 23 bp, Homo sapiens
gaggtcaataaagcagagccaag

SEQ ID NO: 925355 - DNA, 16 bp, Homo sapiens
gaggtcacattcagga

SEQ ID NO: 925356 - DNA, 15 bp, Homo sapiens
gaggtcactggaaag

SEQ ID NO: 925357 - DNA, 22 bp, Homo sapiens
gaggtcaggaaacttttaactg

SEQ ID NO: 925358 - DNA, 17 bp, Homo sapiens
gaggtcaggacggctcc

SEQ ID NO: 925359 - DNA, 18 bp, Homo sapiens
gaggtcaggacggctcct

SEQ ID NO: 925360 - DNA, 14 bp, Homo sapiens
gaggtcaggcccca

SEQ ID NO: 925361 - DNA, 11 bp, Homo sapiens
gaggtcaggga

SEQ ID NO: 925362 - DNA, 18 bp, Homo sapiens
gaggtccacaacacacag

SEQ ID NO: 925363 - DNA, 23 bp, Homo sapiens
gaggtccaccggcccctggcagc

SEQ ID NO: 925364 - DNA, 15 bp, Homo sapiens
gaggtcccagcccca

SEQ ID NO: 925365 - DNA, 21 bp, Homo sapiens
gaggtcccagccccaggcctg

SEQ ID NO: 925366 - DNA, 23 bp, Homo sapiens
gaggtcccagccccaggcctggc

SEQ ID NO: 925367 - DNA, 20 bp, Homo sapiens
gaggtcccttcaaggcctcc

SEQ ID NO: 925368 - DNA, 14 bp, Homo sapiens
gaggtcctcaggtc

SEQ ID NO: 925369 - DNA, 18 bp, Homo sapiens
gaggtcctcaggtcagct

SEQ ID NO: 925370 - DNA, 22 bp, Homo sapiens
gaggtcctcaggtcagctggga

SEQ ID NO: 925371 - DNA, 23 bp, Homo sapiens
gaggtcctccgtagggtctttct

SEQ ID NO: 925372 - DNA, 14 bp, Homo sapiens
gaggtcctctggag

SEQ ID NO: 925373 - DNA, 16 bp, Homo sapiens
gaggtcctctggagcc

SEQ ID NO: 925374 - DNA, 20 bp, Homo sapiens
gaggtcctctggagccctaa

SEQ ID NO: 925375 - DNA, 15 bp, Homo sapiens
gaggtcgaggcagga

SEQ ID NO: 925376 - DNA, 20 bp, Homo sapiens
gaggtcgggagttcgagacc

SEQ ID NO: 925377 - DNA, 22 bp, Homo sapiens
gaggtcggtaggttcagccaag

SEQ ID NO: 925378 - DNA, 23 bp, Homo sapiens
gaggtcggtaggttcagccaagg

SEQ ID NO: 925379 - DNA, 13 bp, Homo sapiens
gaggtctaatcta

SEQ ID NO: 925380 - DNA, 12 bp, Homo sapiens
gaggtctatttt

SEQ ID NO: 925381 - DNA, 14 bp, Homo sapiens
gaggtctcttgagg

SEQ ID NO: 925382 - DNA, 13 bp, Homo sapiens
gaggtctgagccc

SEQ ID NO: 925383 - DNA, 16 bp, Homo sapiens
gaggtctgagccctgg

SEQ ID NO: 925384 - DNA, 19 bp, Homo sapiens
gaggtctgctcggccgtct

SEQ ID NO: 925385 - DNA, 23 bp, Homo sapiens
gaggtctgctcggccgtcttcac

SEQ ID NO: 925386 - DNA, 14 bp, Homo sapiens
gaggtctgttcctt

SEQ ID NO: 925387 - DNA, 14 bp, Homo sapiens
gaggtctgttcttt

SEQ ID NO: 925388 - DNA, 12 bp, Homo sapiens
gaggtctgttta

SEQ ID NO: 925389 - DNA, 16 bp, Homo sapiens
gaggtcttcagggctc

SEQ ID NO: 925390 - DNA, 12 bp, Homo sapiens
gaggtcttgcta

SEQ ID NO: 925391 - DNA, 22 bp, Homo sapiens
gaggtcttgctagaatgggaag

SEQ ID NO: 925392 - DNA, 15 bp, Homo sapiens
gaggtctttctcctc

SEQ ID NO: 925393 - DNA, 15 bp, Homo sapiens
gaggtgaaagggagc

SEQ ID NO: 925394 - DNA, 19 bp, Homo sapiens
gaggtgaatactcttgaaa

SEQ ID NO: 925395 - DNA, 20 bp, Homo sapiens
gaggtgacaaaccatttcca

SEQ ID NO: 925396 - DNA, 14 bp, Homo sapiens
gaggtgatagcatt

SEQ ID NO: 925397 - DNA, 22 bp, Homo sapiens
gaggtgatatttttatgtgcag

SEQ ID NO: 925398 - DNA, 18 bp, Homo sapiens
gaggtgattctcagggct

SEQ ID NO: 925399 - DNA, 19 bp, Homo sapiens
gaggtgcaaggagtgtaaa

SEQ ID NO: 925400 - DNA, 22 bp, Homo sapiens
gaggtgccggggaggggcagag

SEQ ID NO: 925401 - DNA, 13 bp, Homo sapiens
gaggtgcctgtcc

SEQ ID NO: 925402 - DNA, 20 bp, Homo sapiens
gaggtgcgtgttcagcagaa

SEQ ID NO: 925403 - DNA, 12 bp, Homo sapiens
gaggtgcttcac

SEQ ID NO: 925404 - DNA, 13 bp, Homo sapiens
gaggtggaagaag

SEQ ID NO: 925405 - DNA, 15 bp, Homo sapiens
gaggtggaagaaggg

SEQ ID NO: 925406 - DNA, 18 bp, Homo sapiens
gaggtggaagaagggaga

SEQ ID NO: 925407 - DNA, 13 bp, Homo sapiens
gaggtggagaaaa

SEQ ID NO: 925408 - DNA, 15 bp, Homo sapiens
gaggtggagaaaatt

SEQ ID NO: 925409 - DNA, 19 bp, Homo sapiens
gaggtggagattgcagtga

SEQ ID NO: 925410 - DNA, 23 bp, Homo sapiens
gagtcacctcctccactcactcc

SEQ ID NO: 925411 - DNA, 22 bp, Homo sapiens
gagtcacctgcaagccccaggg

SEQ ID NO: 925412 - DNA, 16 bp, Homo sapiens
gagtcacctgctccag

SEQ ID NO: 925413 - DNA, 18 bp, Homo sapiens
gagtcacctgctccagaa

SEQ ID NO: 925414 - DNA, 14 bp, Homo sapiens
gagtcaccttccct

SEQ ID NO: 925415 - DNA, 14 bp, Homo sapiens
gagtcactgagacc

SEQ ID NO: 925416 - DNA, 20 bp, Homo sapiens
gagtcagaatgtgaaaaagg

SEQ ID NO: 925417 - DNA, 13 bp, Homo sapiens
gagtcagagccct

SEQ ID NO: 925418 - DNA, 17 bp, Homo sapiens
gagtcagagccctggct

SEQ ID NO: 925419 - DNA, 13 bp, Homo sapiens
gagtcagaggaga

SEQ ID NO: 925420 - DNA, 16 bp, Homo sapiens
gagtcagaggagaaga

SEQ ID NO: 925421 - DNA, 17 bp, Homo sapiens
gagtcagcaccttggcc

SEQ ID NO: 925422 - DNA, 18 bp, Homo sapiens
gagtcagctctctgccct

SEQ ID NO: 925423 - DNA, 23 bp, Homo sapiens
gagtcaggagttttactgcctgt

SEQ ID NO: 925424 - DNA, 16 bp, Homo sapiens
gagtcaggcaattgat

SEQ ID NO: 925425 - DNA, 17 bp, Homo sapiens
gagtcaggcctgggcag

SEQ ID NO: 925426 - DNA, 24 bp, Homo sapiens
gagtcaggcctgggcaggaccctg

SEQ ID NO: 925427 - DNA, 16 bp, Homo sapiens
gagtcagggtgaactg

SEQ ID NO: 925428 - DNA, 16 bp, Homo sapiens
gagtcatgatctccct

SEQ ID NO: 925429 - DNA, 14 bp, Homo sapiens
gagtcatttaaatg

SEQ ID NO: 925430 - DNA, 20 bp, Homo sapiens
gagtcatttaaatgtgtaca

SEQ ID NO: 925431 - DNA, 18 bp, Homo sapiens
gagtcatttgtttaaaca

SEQ ID NO: 925432 - DNA, 12 bp, Homo sapiens
gagtccaagctg

SEQ ID NO: 925433 - DNA, 14 bp, Homo sapiens
gagtccaagctggg

SEQ ID NO: 925434 - DNA, 16 bp, Homo sapiens
gagtccagctcccccc

SEQ ID NO: 925435 - DNA, 18 bp, Homo sapiens
gagtccaggagctcagga

SEQ ID NO: 925436 - DNA, 13 bp, Homo sapiens
gagtccaggcccc

SEQ ID NO: 925437 - DNA, 16 bp, Homo sapiens
gagtccagtgctctgc

SEQ ID NO: 925438 - DNA, 14 bp, Homo sapiens
gagtccatgaaaat

SEQ ID NO: 925439 - DNA, 17 bp, Homo sapiens
gagtccatgaaaatacc

SEQ ID NO: 925440 - DNA, 15 bp, Homo sapiens
gagtccattctccca

SEQ ID NO: 925441 - DNA, 17 bp, Homo sapiens
gagtccattctcccagg

SEQ ID NO: 925442 - DNA, 20 bp, Homo sapiens
gagtccattctcccaggtac

SEQ ID NO: 925443 - DNA, 18 bp, Homo sapiens
gagtccatttcccacatc

SEQ ID NO: 925444 - DNA, 15 bp, Homo sapiens
gagtcccaaggaaag

SEQ ID NO: 925445 - DNA, 18 bp, Homo sapiens
gagtcccaaggaaagccc

SEQ ID NO: 925446 - DNA, 18 bp, Homo sapiens
gagtcccagagcaggagg

SEQ ID NO: 925447 - DNA, 19 bp, Homo sapiens
gagtcccagagcaggaggc

SEQ ID NO: 925448 - DNA, 19 bp, Homo sapiens
gagtcccaggagctgccca

SEQ ID NO: 925449 - DNA, 17 bp, Homo sapiens
gagtcccaggcccctgg

SEQ ID NO: 925450 - DNA, 18 bp, Homo sapiens
gagtcccaggctgagcct

SEQ ID NO: 925451 - DNA, 19 bp, Homo sapiens
gagtcccaggctgagcctc

SEQ ID NO: 925452 - DNA, 17 bp, Homo sapiens
gagtcccctactccctc

SEQ ID NO: 925453 - DNA, 18 bp, Homo sapiens
gagtcccctcacctcctc

SEQ ID NO: 925454 - DNA, 18 bp, Homo sapiens
gagtcccctccccggccc

SEQ ID NO: 925455 - DNA, 14 bp, Homo sapiens
gagtcccgtcagga

SEQ ID NO: 925456 - DNA, 17 bp, Homo sapiens
gagtccctacctgcttc

SEQ ID NO: 925457 - DNA, 20 bp, Homo sapiens
gagtccctacctgcttcacg

SEQ ID NO: 925458 - DNA, 23 bp, Homo sapiens
ccgctccccacagctttgcaccc

SEQ ID NO: 925459 - DNA, 14 bp, Homo sapiens
ccgctccccagccc

SEQ ID NO: 925460 - DNA, 16 bp, Homo sapiens
ccgctccccagcccag

SEQ ID NO: 925461 - DNA, 21 bp, Homo sapiens
ccgctccccttggacctccag

SEQ ID NO: 925462 - DNA, 15 bp, Homo sapiens
ccgctcccgctccca

SEQ ID NO: 925463 - DNA, 14 bp, Homo sapiens
ccgctccctggata

SEQ ID NO: 925464 - DNA, 20 bp, Homo sapiens
ccgctcccttcctgccactg

SEQ ID NO: 925465 - DNA, 17 bp, Homo sapiens
ccgctccgtctctgtcc

SEQ ID NO: 925466 - DNA, 18 bp, Homo sapiens
ccgctccgtctctgtcct

SEQ ID NO: 925467 - DNA, 23 bp, Homo sapiens
ccgctcctgcttcccctccctac

SEQ ID NO: 925468 - DNA, 13 bp, Homo sapiens
ccgctctgaggca

SEQ ID NO: 925469 - DNA, 15 bp, Homo sapiens
ccgctgagcttggag

SEQ ID NO: 925470 - DNA, 13 bp, Homo sapiens
ccgctgataagca

SEQ ID NO: 925471 - DNA, 14 bp, Homo sapiens
ccgctgcacacaga

SEQ ID NO: 925472 - DNA, 18 bp, Homo sapiens
ccgctgcacacagacggc

SEQ ID NO: 925473 - DNA, 12 bp, Homo sapiens
ccgctgccacca

SEQ ID NO: 925474 - DNA, 12 bp, Homo sapiens
ccgctgccaccc

SEQ ID NO: 925475 - DNA, 15 bp, Homo sapiens
ccgctgccacccacc

SEQ ID NO: 925476 - DNA, 16 bp, Homo sapiens
ccgctgccacccacct

SEQ ID NO: 925477 - DNA, 23 bp, Homo sapiens
ccgctgccacccacctccctgcc

SEQ ID NO: 925478 - DNA, 20 bp, Homo sapiens
ccgctgccacgttggagaag

SEQ ID NO: 925479 - DNA, 13 bp, Homo sapiens
ccgctgccagcac

SEQ ID NO: 925480 - DNA, 15 bp, Homo sapiens
ccgctgcctcctgct

SEQ ID NO: 925481 - DNA, 11 bp, Homo sapiens
ccgctgcctct

SEQ ID NO: 925482 - DNA, 14 bp, Homo sapiens
ccgctgcctgcact

SEQ ID NO: 925483 - DNA, 15 bp, Homo sapiens
ccgctgctgtgctct

SEQ ID NO: 925484 - DNA, 23 bp, Homo sapiens
ccgctgcttccaggctgggcagc

SEQ ID NO: 925485 - DNA, 15 bp, Homo sapiens
ccgctggagcccaca

SEQ ID NO: 925486 - DNA, 16 bp, Homo sapiens
ccgctggagcccacag

SEQ ID NO: 925487 - DNA, 23 bp, Homo sapiens
ccgctggctcacgcgttctggga

SEQ ID NO: 925488 - DNA, 21 bp, Homo sapiens
ccgctggctggtgggccccca

SEQ ID NO: 925489 - DNA, 24 bp, Homo sapiens
ccgctgtcaaggccgagggccagg

SEQ ID NO: 925490 - DNA, 19 bp, Homo sapiens
ccgctgtcgccccaggccc

SEQ ID NO: 925491 - DNA, 15 bp, Homo sapiens
ccgctgttcacccac

SEQ ID NO: 925492 - DNA, 18 bp, Homo sapiens
ccgctgttcacccacagg

SEQ ID NO: 925493 - DNA, 13 bp, Homo sapiens
ccgcttagcctgc

SEQ ID NO: 925494 - DNA, 17 bp, Homo sapiens
ccgcttagcctgcctca

SEQ ID NO: 925495 - DNA, 19 bp, Homo sapiens
ccgcttagcctgcctcacc

SEQ ID NO: 925496 - DNA, 16 bp, Homo sapiens
ccgcttagcgctctgg

SEQ ID NO: 925497 - DNA, 19 bp, Homo sapiens
ccgcttcaagctctctgtt

SEQ ID NO: 925498 - DNA, 12 bp, Homo sapiens
ccgcttccttag

SEQ ID NO: 925499 - DNA, 13 bp, Homo sapiens
ccgcttccttaga

SEQ ID NO: 925500 - DNA, 17 bp, Homo sapiens
ccgcttgtccagcgcct

SEQ ID NO: 925501 - DNA, 19 bp, Homo sapiens
ccgcttttgcagcagagga

SEQ ID NO: 925502 - DNA, 11 bp, Homo sapiens
ccggaaagaag

SEQ ID NO: 925503 - DNA, 12 bp, Homo sapiens
ccggaagggctt

SEQ ID NO: 925504 - DNA, 17 bp, Homo sapiens
ccggaattgtatttatt

SEQ ID NO: 925505 - DNA, 16 bp, Homo sapiens
ccggacaggtggggcc

SEQ ID NO: 925506 - DNA, 19 bp, Homo sapiens
ccggacctacctccctccc

SEQ ID NO: 925507 - DNA, 12 bp, Homo sapiens
ccggacctctga

SEQ ID NO: 925508 - DNA, 13 bp, Homo sapiens
ccggacctctgag

SEQ ID NO: 925509 - DNA, 16 bp, Homo sapiens
ccggacctgagcccgc

SEQ ID NO: 925510 - DNA, 23 bp, Homo sapiens
ccggacctgagcccgcagcccag

SEQ ID NO: 925511 - DNA, 14 bp, Homo sapiens
ccggagaaactgag

SEQ ID NO: 925512 - DNA, 21 bp, Homo sapiens
ccggagagctggtgactttgg

SEQ ID NO: 925513 - DNA, 14 bp, Homo sapiens
ccggagatgtagca

SEQ ID NO: 925514 - DNA, 16 bp, Homo sapiens
ccggagcacagccctg

SEQ ID NO: 925515 - DNA, 17 bp, Homo sapiens
ccggagcacagccctgg

SEQ ID NO: 925516 - DNA, 20 bp, Homo sapiens
ccggagcacagccctgggag

SEQ ID NO: 925517 - DNA, 21 bp, Homo sapiens
ccggagcacagccctgggagg

SEQ ID NO: 925518 - DNA, 13 bp, Homo sapiens
ccggagcccagat

SEQ ID NO: 925519 - DNA, 13 bp, Homo sapiens
ccggagcctcatg

SEQ ID NO: 925520 - DNA, 16 bp, Homo sapiens
ccggagctaacactgg

SEQ ID NO: 925521 - DNA, 17 bp, Homo sapiens
ccggagctaacactggc

SEQ ID NO: 925522 - DNA, 22 bp, Homo sapiens
ccggagctaacactggccccta

SEQ ID NO: 925523 - DNA, 24 bp, Homo sapiens
ccggagctaagtcacccagagcac

SEQ ID NO: 925524 - DNA, 21 bp, Homo sapiens
ccggagctttcaaagaaggaa

SEQ ID NO: 925525 - DNA, 15 bp, Homo sapiens
ccggaggactgagcc

SEQ ID NO: 925526 - DNA, 16 bp, Homo sapiens
ccggaggagcagcctc

SEQ ID NO: 925527 - DNA, 19 bp, Homo sapiens
ccggaggcgtggaggagag

SEQ ID NO: 925528 - DNA, 18 bp, Homo sapiens
ccggaggggacccagctc

SEQ ID NO: 925529 - DNA, 14 bp, Homo sapiens
ccggaggggcctgg

SEQ ID NO: 925530 - DNA, 17 bp, Homo sapiens
ccggaggtagaggttgt

SEQ ID NO: 925531 - DNA, 18 bp, Homo sapiens
ccggagtaatcaggcagc

SEQ ID NO: 925532 - DNA, 15 bp, Homo sapiens
ccggatgtgcttttc

SEQ ID NO: 925533 - DNA, 22 bp, Homo sapiens
gagtgagtcacctgctccagaa

SEQ ID NO: 925534 - DNA, 13 bp, Homo sapiens
gagtgagtcagtg

SEQ ID NO: 925535 - DNA, 19 bp, Homo sapiens
gagtgagtcagtgatgagg

SEQ ID NO: 925536 - DNA, 15 bp, Homo sapiens
gagtgagtgtgtgtg

SEQ ID NO: 925537 - DNA, 19 bp, Homo sapiens
gagtgatagtcttttgctt

SEQ ID NO: 925538 - DNA, 19 bp, Homo sapiens
gagtgatgatttgggggag

SEQ ID NO: 925539 - DNA, 19 bp, Homo sapiens
gagtgatggtgtccttccc

SEQ ID NO: 925540 - DNA, 22 bp, Homo sapiens
gagtgatggtgtccttccctgc

SEQ ID NO: 925541 - DNA, 24 bp, Homo sapiens
gagtgattgaaccagctcatctcc

SEQ ID NO: 925542 - DNA, 12 bp, Homo sapiens
gagtgattgcag

SEQ ID NO: 925543 - DNA, 15 bp, Homo sapiens
gagtgattgcagctt

SEQ ID NO: 925544 - DNA, 19 bp, Homo sapiens
gagtgcaatgacacagtct

SEQ ID NO: 925545 - DNA, 14 bp, Homo sapiens
gagtgcaccaaaga

SEQ ID NO: 925546 - DNA, 15 bp, Homo sapiens
gagtgcaccaaagag

SEQ ID NO: 925547 - DNA, 18 bp, Homo sapiens
gagtgcagaacacctggc

SEQ ID NO: 925548 - DNA, 20 bp, Homo sapiens
gagtgcagaacacctggccg

SEQ ID NO: 925549 - DNA, 13 bp, Homo sapiens
gagtgcagccaaa

SEQ ID NO: 925550 - DNA, 16 bp, Homo sapiens
gagtgccaggaccagc

SEQ ID NO: 925551 - DNA, 18 bp, Homo sapiens
gagtgccaggaccagcct

SEQ ID NO: 925552 - DNA, 21 bp, Homo sapiens
gagtgcccctgtcccacctgg

SEQ ID NO: 925553 - DNA, 23 bp, Homo sapiens
gagtgcgctcttggtccctggtc

SEQ ID NO: 925554 - DNA, 23 bp, Homo sapiens
gagtgcgggctgaggccagagtc

SEQ ID NO: 925555 - DNA, 11 bp, Homo sapiens
gagtgctctga

SEQ ID NO: 925556 - DNA, 18 bp, Homo sapiens
gagtgctgaggccagggc

SEQ ID NO: 925557 - DNA, 20 bp, Homo sapiens
gagtgctgcttgtgcctccc

SEQ ID NO: 925558 - DNA, 16 bp, Homo sapiens
gagtgctgggggaggc

SEQ ID NO: 925559 - DNA, 12 bp, Homo sapiens
gagtgctgtttt

SEQ ID NO: 925560 - DNA, 18 bp, Homo sapiens
gagtgcttgttagagaga

SEQ ID NO: 925561 - DNA, 20 bp, Homo sapiens
gagtgcttgttagagagaaa

SEQ ID NO: 925562 - DNA, 13 bp, Homo sapiens
gagtgctttaaaa

SEQ ID NO: 925563 - DNA, 16 bp, Homo sapiens
gagtggaagggaggag

SEQ ID NO: 925564 - DNA, 13 bp, Homo sapiens
gagtggaatgcag

SEQ ID NO: 925565 - DNA, 16 bp, Homo sapiens
gagtggaatgcaggga

SEQ ID NO: 925566 - DNA, 13 bp, Homo sapiens
gagtggaggaagc

SEQ ID NO: 925567 - DNA, 17 bp, Homo sapiens
gagtggaggaagcccac

SEQ ID NO: 925568 - DNA, 23 bp, Homo sapiens
gagtggagtctgagtctgagtcc

SEQ ID NO: 925569 - DNA, 16 bp, Homo sapiens
gagtggatctccaagg

SEQ ID NO: 925570 - DNA, 17 bp, Homo sapiens
gagtggatctccaagga

SEQ ID NO: 925571 - DNA, 19 bp, Homo sapiens
gagtggatctccaaggacc

SEQ ID NO: 925572 - DNA, 17 bp, Homo sapiens
gagtggcacttctgcct

SEQ ID NO: 925573 - DNA, 16 bp, Homo sapiens
gagtggcaggggacag

SEQ ID NO: 925574 - DNA, 17 bp, Homo sapiens
gagtggcaggtgggctg

SEQ ID NO: 925575 - DNA, 15 bp, Homo sapiens
gagtggccacagcac

SEQ ID NO: 925576 - DNA, 19 bp, Homo sapiens
gagtggccagccagtgcca

SEQ ID NO: 925577 - DNA, 20 bp, Homo sapiens
gagtggccagccagtgccat

SEQ ID NO: 925578 - DNA, 15 bp, Homo sapiens
gagtggccagcgcca

SEQ ID NO: 925579 - DNA, 18 bp, Homo sapiens
gagtggcctcatttcact

SEQ ID NO: 925580 - DNA, 16 bp, Homo sapiens
gagtggcctccctgct

SEQ ID NO: 925581 - DNA, 17 bp, Homo sapiens
gagtggcctccctgctg

SEQ ID NO: 925582 - DNA, 14 bp, Homo sapiens
gagtggcctggcca

SEQ ID NO: 925583 - DNA, 18 bp, Homo sapiens
gagtggcgtgagctgccc

SEQ ID NO: 925584 - DNA, 15 bp, Homo sapiens
gagtggctcactggc

SEQ ID NO: 925585 - DNA, 18 bp, Homo sapiens
gagtggctcactggctgg

SEQ ID NO: 925586 - DNA, 22 bp, Homo sapiens
gagtggctcactggctgggagt

SEQ ID NO: 925587 - DNA, 13 bp, Homo sapiens
gagtggctcctcc

SEQ ID NO: 925588 - DNA, 11 bp, Homo sapiens
gagtgggaagc

SEQ ID NO: 925589 - DNA, 13 bp, Homo sapiens
ccggtgtccctgg

SEQ ID NO: 925590 - DNA, 17 bp, Homo sapiens
ccggtgtgcctgcagcc

SEQ ID NO: 925591 - DNA, 19 bp, Homo sapiens
ccggttcagacccctgcct

SEQ ID NO: 925592 - DNA, 20 bp, Homo sapiens
ccggttcagacccctgcctg

SEQ ID NO: 925593 - DNA, 18 bp, Homo sapiens
ccggttgcagtcactgtg

SEQ ID NO: 925594 - DNA, 23 bp, Homo sapiens
ccggtttagtcatccaacaagaa

SEQ ID NO: 925595 - DNA, 17 bp, Homo sapiens
ccggtttgggctgtctt

SEQ ID NO: 925596 - DNA, 12 bp, Homo sapiens
ccgtaatttaac

SEQ ID NO: 925597 - DNA, 14 bp, Homo sapiens
ccgtaatttaactt

SEQ ID NO: 925598 - DNA, 17 bp, Homo sapiens
ccgtacaaactcagatc

SEQ ID NO: 925599 - DNA, 18 bp, Homo sapiens
ccgtacaacgtgtcctca

SEQ ID NO: 925600 - DNA, 18 bp, Homo sapiens
ccgtacattcaatgttta

SEQ ID NO: 925601 - DNA, 15 bp, Homo sapiens
ccgtaccccaccctc

SEQ ID NO: 925602 - DNA, 16 bp, Homo sapiens
ccgtaccccaccctca

SEQ ID NO: 925603 - DNA, 17 bp, Homo sapiens
ccgtactccctgcaccg

SEQ ID NO: 925604 - DNA, 14 bp, Homo sapiens
ccgtaggcagcctc

SEQ ID NO: 925605 - DNA, 14 bp, Homo sapiens
ccgtagtctcctgg

SEQ ID NO: 925606 - DNA, 15 bp, Homo sapiens
ccgtagtctcctggg

SEQ ID NO: 925607 - DNA, 19 bp, Homo sapiens
ccgtagtctcctgggtgtg

SEQ ID NO: 925608 - DNA, 15 bp, Homo sapiens
ccgtatatgtctaca

SEQ ID NO: 925609 - DNA, 17 bp, Homo sapiens
ccgtatctccctggaga

SEQ ID NO: 925610 - DNA, 21 bp, Homo sapiens
ccgtatctgtcacaataaatg

SEQ ID NO: 925611 - DNA, 22 bp, Homo sapiens
ccgtcaaaacagattgtttgca

SEQ ID NO: 925612 - DNA, 18 bp, Homo sapiens
ccgtcagctgcttctgct

SEQ ID NO: 925613 - DNA, 23 bp, Homo sapiens
ccgtcagggagaggtcaccagct

SEQ ID NO: 925614 - DNA, 23 bp, Homo sapiens
ccgtcatccatgccctcccagga

SEQ ID NO: 925615 - DNA, 16 bp, Homo sapiens
ccgtcatgttcctcaa

SEQ ID NO: 925616 - DNA, 16 bp, Homo sapiens
ccgtcattgctgctgc

SEQ ID NO: 925617 - DNA, 13 bp, Homo sapiens
ccgtccacccagg

SEQ ID NO: 925618 - DNA, 23 bp, Homo sapiens
ccgtccacccaggctgcactgca

SEQ ID NO: 925619 - DNA, 14 bp, Homo sapiens
ccgtccagagccgg

SEQ ID NO: 925620 - DNA, 16 bp, Homo sapiens
ccgtccagagccggca

SEQ ID NO: 925621 - DNA, 22 bp, Homo sapiens
ccgtccagccgccattgccacc

SEQ ID NO: 925622 - DNA, 23 bp, Homo sapiens
ccgtccatatcagaactgtgcca

SEQ ID NO: 925623 - DNA, 13 bp, Homo sapiens
ccgtccatggcac

SEQ ID NO: 925624 - DNA, 14 bp, Homo sapiens
ccgtccatggcacc

SEQ ID NO: 925625 - DNA, 19 bp, Homo sapiens
ccgtccattcttcagtgtc

SEQ ID NO: 925626 - DNA, 12 bp, Homo sapiens
ccgtcccaggcc

SEQ ID NO: 925627 - DNA, 14 bp, Homo sapiens
ccgtcccaggccac

SEQ ID NO: 925628 - DNA, 17 bp, Homo sapiens
ccgtccccccccaggcc

SEQ ID NO: 925629 - DNA, 14 bp, Homo sapiens
ccgtccccctctgg

SEQ ID NO: 925630 - DNA, 13 bp, Homo sapiens
ccgtcccctaacc

SEQ ID NO: 925631 - DNA, 18 bp, Homo sapiens
ccgtcccctaacccccag

SEQ ID NO: 925632 - DNA, 16 bp, Homo sapiens
ccgtcccctctcccct

SEQ ID NO: 925633 - DNA, 19 bp, Homo sapiens
ccgtcccgcacagtggacg

SEQ ID NO: 925634 - DNA, 13 bp, Homo sapiens
ccgtccctgtccc

SEQ ID NO: 925635 - DNA, 13 bp, Homo sapiens
ccgtccgccctgc

SEQ ID NO: 925636 - DNA, 17 bp, Homo sapiens
ccgtcctgctggagtga

SEQ ID NO: 925637 - DNA, 17 bp, Homo sapiens
ccgtcggactgccccca

SEQ ID NO: 925638 - DNA, 19 bp, Homo sapiens
ccgtcggactgcccccaga

SEQ ID NO: 925639 - DNA, 13 bp, Homo sapiens
ccgtcggagctgc

SEQ ID NO: 925640 - DNA, 17 bp, Homo sapiens
ccgtcggagctgcctgc

SEQ ID NO: 925641 - DNA, 18 bp, Homo sapiens
ccgtcggagctgcctgca

SEQ ID NO: 925642 - DNA, 19 bp, Homo sapiens
ccgtcggagctgcctgcag

SEQ ID NO: 925643 - DNA, 13 bp, Homo sapiens
ccgtcggccctgc

SEQ ID NO: 925644 - DNA, 11 bp, Homo sapiens
ccgtctacatt

SEQ ID NO: 925645 - DNA, 14 bp, Homo sapiens
ccgtctacatttca

SEQ ID NO: 925646 - DNA, 13 bp, Homo sapiens
ccgtctcctccct

SEQ ID NO: 925647 - DNA, 13 bp, Homo sapiens
ccgtctcggccct

SEQ ID NO: 925648 - DNA, 17 bp, Homo sapiens
ccgtctctctgcccact

SEQ ID NO: 925649 - DNA, 16 bp, Homo sapiens
ccgtctgactccagag

SEQ ID NO: 925650 - DNA, 17 bp, Homo sapiens
ccgtctgactccagagt

SEQ ID NO: 925651 - DNA, 21 bp, Homo sapiens
ccgtctggggttcagcccctc

SEQ ID NO: 925652 - DNA, 22 bp, Homo sapiens
ccgtctggggttcagcccctcc

SEQ ID NO: 925653 - DNA, 23 bp, Homo sapiens
ccgtctggggttcagcccctcct

SEQ ID NO: 925654 - DNA, 11 bp, Homo sapiens
ccgtctgtcct

SEQ ID NO: 925655 - DNA, 23 bp, Homo sapiens
ccgtctgtgtggggttctcagtg

SEQ ID NO: 925656 - DNA, 23 bp, Homo sapiens
cctaagacatgtgaggaggaaaa

SEQ ID NO: 925657 - DNA, 14 bp, Homo sapiens
cctaagactgcctt

SEQ ID NO: 925658 - DNA, 16 bp, Homo sapiens
cctaagactgccttca

SEQ ID NO: 925659 - DNA, 21 bp, Homo sapiens
cctaagactgccttcagtagg

SEQ ID NO: 925660 - DNA, 19 bp, Homo sapiens
cctaagagtggaggaggag

SEQ ID NO: 925661 - DNA, 12 bp, Homo sapiens
cctaagagtgtt

SEQ ID NO: 925662 - DNA, 17 bp, Homo sapiens
cctaagcacttctagaa

SEQ ID NO: 925663 - DNA, 16 bp, Homo sapiens
cctaagcccccagggc

SEQ ID NO: 925664 - DNA, 23 bp, Homo sapiens
cctaagcccccagggcctccagg

SEQ ID NO: 925665 - DNA, 12 bp, Homo sapiens
cctaagccctgc

SEQ ID NO: 925666 - DNA, 13 bp, Homo sapiens
cctaagggcagcc

SEQ ID NO: 925667 - DNA, 14 bp, Homo sapiens
cctaagggcagccc

SEQ ID NO: 925668 - DNA, 16 bp, Homo sapiens
cctaagggcagccctc

SEQ ID NO: 925669 - DNA, 21 bp, Homo sapiens
cctaagtagaccaaatcttgt

SEQ ID NO: 925670 - DNA, 15 bp, Homo sapiens
cctaagtcaggtaat

SEQ ID NO: 925671 - DNA, 16 bp, Homo sapiens
cctaagtcctttatgt

SEQ ID NO: 925672 - DNA, 14 bp, Homo sapiens
cctaagtggctgct

SEQ ID NO: 925673 - DNA, 19 bp, Homo sapiens
cctaataatatcccactgg

SEQ ID NO: 925674 - DNA, 22 bp, Homo sapiens
cctaatccctgggcattgcttt

SEQ ID NO: 925675 - DNA, 17 bp, Homo sapiens
cctaatctgctgccaga

SEQ ID NO: 925676 - DNA, 23 bp, Homo sapiens
cctaatgtctcactgttctgcaa

SEQ ID NO: 925677 - DNA, 18 bp, Homo sapiens
cctaatgtttatgagcca

SEQ ID NO: 925678 - DNA, 14 bp, Homo sapiens
cctaatttatgtgc

SEQ ID NO: 925679 - DNA, 14 bp, Homo sapiens
cctaatttctcctc

SEQ ID NO: 925680 - DNA, 15 bp, Homo sapiens
cctaatttctcctcc

SEQ ID NO: 925681 - DNA, 20 bp, Homo sapiens
cctaatttctcctcccttcc

SEQ ID NO: 925682 - DNA, 14 bp, Homo sapiens
cctacaaatcagta

SEQ ID NO: 925683 - DNA, 15 bp, Homo sapiens
cctacaaatcagtaa

SEQ ID NO: 925684 - DNA, 20 bp, Homo sapiens
cctacaactaaaaataaatt

SEQ ID NO: 925685 - DNA, 15 bp, Homo sapiens
cctacaagacacagt

SEQ ID NO: 925686 - DNA, 18 bp, Homo sapiens
cctacaagatttagaaaa

SEQ ID NO: 925687 - DNA, 14 bp, Homo sapiens
cctacaagatttcc

SEQ ID NO: 925688 - DNA, 18 bp, Homo sapiens
cctacacacacagcctat

SEQ ID NO: 925689 - DNA, 21 bp, Homo sapiens
cctacacacgtaccttcatgt

SEQ ID NO: 925690 - DNA, 15 bp, Homo sapiens
cctacacactgtcat

SEQ ID NO: 925691 - DNA, 13 bp, Homo sapiens
cctacacaggagt

SEQ ID NO: 925692 - DNA, 21 bp, Homo sapiens
cctacaccattatcttggaaa

SEQ ID NO: 925693 - DNA, 13 bp, Homo sapiens
cctacacccctgt

SEQ ID NO: 925694 - DNA, 14 bp, Homo sapiens
cctacacctccctc

SEQ ID NO: 925695 - DNA, 20 bp, Homo sapiens
cctacagaaatactgctctg

SEQ ID NO: 925696 - DNA, 15 bp, Homo sapiens
cctacagaaattgaa

SEQ ID NO: 925697 - DNA, 13 bp, Homo sapiens
cctacagagctgt

SEQ ID NO: 925698 - DNA, 14 bp, Homo sapiens
cctacagatgaact

SEQ ID NO: 925699 - DNA, 19 bp, Homo sapiens
cctacagcactactgggtg

SEQ ID NO: 925700 - DNA, 21 bp, Homo sapiens
cctacagcactactgggtgtc

SEQ ID NO: 925701 - DNA, 12 bp, Homo sapiens
cctacagcattg

SEQ ID NO: 925702 - DNA, 14 bp, Homo sapiens
cctacagccccttt

SEQ ID NO: 925703 - DNA, 21 bp, Homo sapiens
cctacaggctgacgttccggg

SEQ ID NO: 925704 - DNA, 15 bp, Homo sapiens
cctacagtgtacagt

SEQ ID NO: 925705 - DNA, 20 bp, Homo sapiens
cctacagtgtacagtcttgt

SEQ ID NO: 925706 - DNA, 21 bp, Homo sapiens
cctacagttgaaaaacagctg

SEQ ID NO: 925707 - DNA, 20 bp, Homo sapiens
cctacagttttaactgtgga

SEQ ID NO: 925708 - DNA, 21 bp, Homo sapiens
cctacatatgctgatctttta

SEQ ID NO: 925709 - DNA, 24 bp, Homo sapiens
cctacatccagctcctctaggggc

SEQ ID NO: 925710 - DNA, 16 bp, Homo sapiens
cctacattccccagag

SEQ ID NO: 925711 - DNA, 18 bp, Homo sapiens
cctacattccccagagtg

SEQ ID NO: 925712 - DNA, 16 bp, Homo sapiens
cctacattccctctcc

SEQ ID NO: 925713 - DNA, 15 bp, Homo sapiens
cctaccaatgcatgc

SEQ ID NO: 925714 - DNA, 15 bp, Homo sapiens
cctaccacagtgtct

SEQ ID NO: 925715 - DNA, 16 bp, Homo sapiens
cctaccacagtgtctg

SEQ ID NO: 925716 - DNA, 13 bp, Homo sapiens
cctaccacccctt

SEQ ID NO: 925717 - DNA, 19 bp, Homo sapiens
cctaccacttttctgctgt

SEQ ID NO: 925718 - DNA, 14 bp, Homo sapiens
cctaccagctcctc

SEQ ID NO: 925719 - DNA, 18 bp, Homo sapiens
cctaccaggacagaactt

SEQ ID NO: 925720 - DNA, 20 bp, Homo sapiens
gataaaaacccaaaatacag

SEQ ID NO: 925721 - DNA, 15 bp, Homo sapiens
gataaaaaggaagga

SEQ ID NO: 925722 - DNA, 16 bp, Homo sapiens
gataaaaataaagctg

SEQ ID NO: 925723 - DNA, 18 bp, Homo sapiens
gataaaaccttttttgaa

SEQ ID NO: 925724 - DNA, 20 bp, Homo sapiens
gataaaactaaatatatgtc

SEQ ID NO: 925725 - DNA, 15 bp, Homo sapiens
gataaaactgggttg

SEQ ID NO: 925726 - DNA, 16 bp, Homo sapiens
gataaaactgtgtaaa

SEQ ID NO: 925727 - DNA, 22 bp, Homo sapiens
gataaaagcaattctgactgtc

SEQ ID NO: 925728 - DNA, 22 bp, Homo sapiens
gataaaaggtggagtttctctg

SEQ ID NO: 925729 - DNA, 17 bp, Homo sapiens
gataaaatactaaacta

SEQ ID NO: 925730 - DNA, 18 bp, Homo sapiens
gataaaattgtgatgttt

SEQ ID NO: 925731 - DNA, 15 bp, Homo sapiens
gataaacattaaaca

SEQ ID NO: 925732 - DNA, 18 bp, Homo sapiens
gataaagaaaagacattt

SEQ ID NO: 925733 - DNA, 16 bp, Homo sapiens
gataaagaccagaaat

SEQ ID NO: 925734 - DNA, 21 bp, Homo sapiens
gataaagacttttatgtgaga

SEQ ID NO: 925735 - DNA, 14 bp, Homo sapiens
gataaagagacagt

SEQ ID NO: 925736 - DNA, 22 bp, Homo sapiens
gataaagatgcaaggaccagga

SEQ ID NO: 925737 - DNA, 17 bp, Homo sapiens
gataaagattttttaat

SEQ ID NO: 925738 - DNA, 19 bp, Homo sapiens
gataaagttggccatgtat

SEQ ID NO: 925739 - DNA, 21 bp, Homo sapiens
gataaataacttttttttaag

SEQ ID NO: 925740 - DNA, 13 bp, Homo sapiens
gataaatatatat

SEQ ID NO: 925741 - DNA, 12 bp, Homo sapiens
gataaatattta

SEQ ID NO: 925742 - DNA, 13 bp, Homo sapiens
gataaatatttga

SEQ ID NO: 925743 - DNA, 16 bp, Homo sapiens
gataaatatttgactt

SEQ ID NO: 925744 - DNA, 18 bp, Homo sapiens
gataaatcataaagtcag

SEQ ID NO: 925745 - DNA, 18 bp, Homo sapiens
gataaatcatttcagtat

SEQ ID NO: 925746 - DNA, 17 bp, Homo sapiens
gataaatgcacatttca

SEQ ID NO: 925747 - DNA, 22 bp, Homo sapiens
gataaattaacctctcacagtt

SEQ ID NO: 925748 - DNA, 19 bp, Homo sapiens
gataaatttgttgaatatt

SEQ ID NO: 925749 - DNA, 21 bp, Homo sapiens
gataaccccaggcactgtttg

SEQ ID NO: 925750 - DNA, 23 bp, Homo sapiens
gataacctatatgatttatagtt

SEQ ID NO: 925751 - DNA, 21 bp, Homo sapiens
gataacctgtacttcaagtta

SEQ ID NO: 925752 - DNA, 22 bp, Homo sapiens
gataacctgtacttcaagttaa

SEQ ID NO: 925753 - DNA, 14 bp, Homo sapiens
gataactagccaga

SEQ ID NO: 925754 - DNA, 21 bp, Homo sapiens
gataactgaaaattatttaaa

SEQ ID NO: 925755 - DNA, 21 bp, Homo sapiens
gataacttaggtggcaagctg

SEQ ID NO: 925756 - DNA, 15 bp, Homo sapiens
gataacttcttgaaa

SEQ ID NO: 925757 - DNA, 16 bp, Homo sapiens
gataacttcttgaaaa

SEQ ID NO: 925758 - DNA, 18 bp, Homo sapiens
gataacttcttgaaaaag

SEQ ID NO: 925759 - DNA, 16 bp, Homo sapiens
gataacttggggaggc

SEQ ID NO: 925760 - DNA, 19 bp, Homo sapiens
gataagaacccagggtgga

SEQ ID NO: 925761 - DNA, 21 bp, Homo sapiens
gataagaataaacgaggaaaa

SEQ ID NO: 925762 - DNA, 17 bp, Homo sapiens
gataagaatgctggttt

SEQ ID NO: 925763 - DNA, 19 bp, Homo sapiens
gataagaattgtctctggg

SEQ ID NO: 925764 - DNA, 16 bp, Homo sapiens
gataagactgttttta

SEQ ID NO: 925765 - DNA, 16 bp, Homo sapiens
gataagcacattaaag

SEQ ID NO: 925766 - DNA, 21 bp, Homo sapiens
gataaggaaacacttctattt

SEQ ID NO: 925767 - DNA, 17 bp, Homo sapiens
gataaggaattatagac

SEQ ID NO: 925768 - DNA, 19 bp, Homo sapiens
gataaggagactgaggctt

SEQ ID NO: 925769 - DNA, 13 bp, Homo sapiens
gataaggggcctt

SEQ ID NO: 925770 - DNA, 20 bp, Homo sapiens
gataaggggccttgctctga

SEQ ID NO: 925771 - DNA, 15 bp, Homo sapiens
gataaggggtggggg

SEQ ID NO: 925772 - DNA, 14 bp, Homo sapiens
gataataagattag

SEQ ID NO: 925773 - DNA, 22 bp, Homo sapiens
gataataatactgacctacctc

SEQ ID NO: 925774 - DNA, 23 bp, Homo sapiens
gataatacaccactacattctgt

SEQ ID NO: 925775 - DNA, 13 bp, Homo sapiens
gataatacttgac

SEQ ID NO: 925776 - DNA, 15 bp, Homo sapiens
gataataggaattca

SEQ ID NO: 925777 - DNA, 12 bp, Homo sapiens
gataatatataa

SEQ ID NO: 925778 - DNA, 22 bp, Homo sapiens
gatataatcttggcttcttaaa

SEQ ID NO: 925779 - DNA, 23 bp, Homo sapiens
gatataatcttggcttcttaaaa

SEQ ID NO: 925780 - DNA, 18 bp, Homo sapiens
gatatacaaagtgtacca

SEQ ID NO: 925781 - DNA, 14 bp, Homo sapiens
gatatacatgaaaa

SEQ ID NO: 925782 - DNA, 13 bp, Homo sapiens
gatatacattgtg

SEQ ID NO: 925783 - DNA, 15 bp, Homo sapiens
gatatacattgtgtg

SEQ ID NO: 925784 - DNA, 15 bp, Homo sapiens
gatatactccaggac

SEQ ID NO: 925785 - DNA, 22 bp, Homo sapiens
gatatactccaggacttagaat

SEQ ID NO: 925786 - DNA, 17 bp, Homo sapiens
gatatactctagatgaa

SEQ ID NO: 925787 - DNA, 22 bp, Homo sapiens
gatatagcagaggtttaaatgt

SEQ ID NO: 925788 - DNA, 21 bp, Homo sapiens
gatataggtttttctcatgta

SEQ ID NO: 925789 - DNA, 19 bp, Homo sapiens
gatatagttttacttttaa

SEQ ID NO: 925790 - DNA, 15 bp, Homo sapiens
gatatataagtgtac

SEQ ID NO: 925791 - DNA, 19 bp, Homo sapiens
gatatataggctattttct

SEQ ID NO: 925792 - DNA, 18 bp, Homo sapiens
gatatatggaggattctt

SEQ ID NO: 925793 - DNA, 21 bp, Homo sapiens
gatatatgtgtatacatacat

SEQ ID NO: 925794 - DNA, 19 bp, Homo sapiens
gatatatgtttttgaaggc

SEQ ID NO: 925795 - DNA, 14 bp, Homo sapiens
gatatattaaaaat

SEQ ID NO: 925796 - DNA, 17 bp, Homo sapiens
gatatattaaaaatata

SEQ ID NO: 925797 - DNA, 18 bp, Homo sapiens
gatatattaaaaatataa

SEQ ID NO: 925798 - DNA, 20 bp, Homo sapiens
gatatattaaaaatataaaa

SEQ ID NO: 925799 - DNA, 14 bp, Homo sapiens
gatatattttacaa

SEQ ID NO: 925800 - DNA, 15 bp, Homo sapiens
gatatatttttcaca

SEQ ID NO: 925801 - DNA, 17 bp, Homo sapiens
gatatatttttcacagt

SEQ ID NO: 925802 - DNA, 12 bp, Homo sapiens
gatatcaaaatt

SEQ ID NO: 925803 - DNA, 17 bp, Homo sapiens
gatatcaaaattctagc

SEQ ID NO: 925804 - DNA, 12 bp, Homo sapiens
gatatcacctct

SEQ ID NO: 925805 - DNA, 17 bp, Homo sapiens
gatatcagaatttgtgt

SEQ ID NO: 925806 - DNA, 13 bp, Homo sapiens
gatatcattttaa

SEQ ID NO: 925807 - DNA, 18 bp, Homo sapiens
gatatccacataaatgct

SEQ ID NO: 925808 - DNA, 20 bp, Homo sapiens
gatatccacataaatgctcc

SEQ ID NO: 925809 - DNA, 14 bp, Homo sapiens
gatatccatctttt

SEQ ID NO: 925810 - DNA, 23 bp, Homo sapiens
gatatcctctccccctcctccag

SEQ ID NO: 925811 - DNA, 18 bp, Homo sapiens
gatatctcaatctgcagc

SEQ ID NO: 925812 - DNA, 20 bp, Homo sapiens
gatatctcaatctgcagcca

SEQ ID NO: 925813 - DNA, 16 bp, Homo sapiens
gatatctgagggagga

SEQ ID NO: 925814 - DNA, 14 bp, Homo sapiens
gatatctgcatgtg

SEQ ID NO: 925815 - DNA, 15 bp, Homo sapiens
gatatctgcatgtgt

SEQ ID NO: 925816 - DNA, 15 bp, Homo sapiens
gatatcttgaaatga

SEQ ID NO: 925817 - DNA, 17 bp, Homo sapiens
gatatcttgaaatgaaa

SEQ ID NO: 925818 - DNA, 15 bp, Homo sapiens
gatatgaaagctgat

SEQ ID NO: 925819 - DNA, 23 bp, Homo sapiens
gatatgaacagggcccaggcctg

SEQ ID NO: 925820 - DNA, 20 bp, Homo sapiens
gatatgagggtggtttatga

SEQ ID NO: 925821 - DNA, 21 bp, Homo sapiens
gatatgagttgttttcagact

SEQ ID NO: 925822 - DNA, 12 bp, Homo sapiens
gatatggcagga

SEQ ID NO: 925823 - DNA, 15 bp, Homo sapiens
gatatggcaggactc

SEQ ID NO: 925824 - DNA, 22 bp, Homo sapiens
gatatggcaggactcctggcag

SEQ ID NO: 925825 - DNA, 22 bp, Homo sapiens
gatatggcattgcactgcttat

SEQ ID NO: 925826 - DNA, 16 bp, Homo sapiens
gatatggcggcctgca

SEQ ID NO: 925827 - DNA, 17 bp, Homo sapiens
gatatggcggcctgcag

SEQ ID NO: 925828 - DNA, 15 bp, Homo sapiens
gatatggctgcccag

SEQ ID NO: 925829 - DNA, 16 bp, Homo sapiens
gatatggctgcccagg

SEQ ID NO: 925830 - DNA, 18 bp, Homo sapiens
gatatggctgcccaggag

SEQ ID NO: 925831 - DNA, 19 bp, Homo sapiens
gatatggctgcccaggaga

SEQ ID NO: 925832 - DNA, 17 bp, Homo sapiens
gatatgggtagtatttt

SEQ ID NO: 925833 - DNA, 18 bp, Homo sapiens
gatatgggtcctctgggg

SEQ ID NO: 925834 - DNA, 19 bp, Homo sapiens
gatatgtaaaacatttatt

SEQ ID NO: 925835 - DNA, 19 bp, Homo sapiens
gatatgtaaacataattct

SEQ ID NO: 925836 - DNA, 18 bp, Homo sapiens
gatatgtatattttaata

SEQ ID NO: 925837 - DNA, 19 bp, Homo sapiens
gatatgtccagtcatcctg

SEQ ID NO: 925838 - DNA, 23 bp, Homo sapiens
gatatgttttatttcattggtta

SEQ ID NO: 925839 - DNA, 20 bp, Homo sapiens
gatattaaaatttggtgctt

SEQ ID NO: 925840 - DNA, 18 bp, Homo sapiens
gatattaaacgtgtaaat

SEQ ID NO: 925841 - DNA, 16 bp, Homo sapiens
gatattaaatttcaaa

SEQ ID NO: 925842 - DNA, 22 bp, Homo sapiens
gatattatctacctgttctgta

SEQ ID NO: 925843 - DNA, 15 bp, Homo sapiens
gatattatttcttct

SEQ ID NO: 925844 - DNA, 19 bp, Homo sapiens
gatattatttcttctctta

SEQ ID NO: 925845 - DNA, 16 bp, Homo sapiens
gatattccatgaatgt

SEQ ID NO: 925846 - DNA, 16 bp, Homo sapiens
gatattctgttgcttt

SEQ ID NO: 925847 - DNA, 19 bp, Homo sapiens
gatattgccttatttgtct

SEQ ID NO: 925848 - DNA, 22 bp, Homo sapiens
gatattgccttatttgtctgta

SEQ ID NO: 925849 - DNA, 24 bp, Homo sapiens
gatattgctgaagaatctacttaa

SEQ ID NO: 925850 - DNA, 13 bp, Homo sapiens
cctaggagggtgt

SEQ ID NO: 925851 - DNA, 22 bp, Homo sapiens
cctaggagttgagtacagtgag

SEQ ID NO: 925852 - DNA, 15 bp, Homo sapiens
cctaggatgctgcag

SEQ ID NO: 925853 - DNA, 23 bp, Homo sapiens
cctaggccaaatgcacaagctca

SEQ ID NO: 925854 - DNA, 23 bp, Homo sapiens
cctaggccacaccatctcctttc

SEQ ID NO: 925855 - DNA, 14 bp, Homo sapiens
cctaggccactcct

SEQ ID NO: 925856 - DNA, 15 bp, Homo sapiens
cctaggccactcctc

SEQ ID NO: 925857 - DNA, 20 bp, Homo sapiens
cctaggcctcagccagagaa

SEQ ID NO: 925858 - DNA, 12 bp, Homo sapiens
cctaggggaagg

SEQ ID NO: 925859 - DNA, 20 bp, Homo sapiens
cctagggggtgtcagaagct

SEQ ID NO: 925860 - DNA, 17 bp, Homo sapiens
cctaggggtggcgctca

SEQ ID NO: 925861 - DNA, 20 bp, Homo sapiens
cctagggtcttgggggtcag

SEQ ID NO: 925862 - DNA, 14 bp, Homo sapiens
cctaggtccaagcc

SEQ ID NO: 925863 - DNA, 19 bp, Homo sapiens
cctaggtcctctgaggcac

SEQ ID NO: 925864 - DNA, 14 bp, Homo sapiens
cctaggtctccagt

SEQ ID NO: 925865 - DNA, 14 bp, Homo sapiens
cctaggtggaggca

SEQ ID NO: 925866 - DNA, 17 bp, Homo sapiens
cctaggtggaggcaagt

SEQ ID NO: 925867 - DNA, 20 bp, Homo sapiens
cctaggtgttgtcagcaggc

SEQ ID NO: 925868 - DNA, 21 bp, Homo sapiens
cctaggttcccggtcccgagt

SEQ ID NO: 925869 - DNA, 20 bp, Homo sapiens
cctaggttccctgttcttcc

SEQ ID NO: 925870 - DNA, 22 bp, Homo sapiens
cctagtaaaaccttgttctatt

SEQ ID NO: 925871 - DNA, 17 bp, Homo sapiens
cctagtaattgcctaga

SEQ ID NO: 925872 - DNA, 19 bp, Homo sapiens
cctagtactctctgctcta

SEQ ID NO: 925873 - DNA, 22 bp, Homo sapiens
cctagtactctctgctctagcc

SEQ ID NO: 925874 - DNA, 20 bp, Homo sapiens
cctagtagctgggatgacag

SEQ ID NO: 925875 - DNA, 17 bp, Homo sapiens
cctagtcccctttcctc

SEQ ID NO: 925876 - DNA, 14 bp, Homo sapiens
cctagtgaaacttt

SEQ ID NO: 925877 - DNA, 14 bp, Homo sapiens
cctagtgccccaga

SEQ ID NO: 925878 - DNA, 16 bp, Homo sapiens
cctagtgccccagact

SEQ ID NO: 925879 - DNA, 17 bp, Homo sapiens
cctagtgccccagactg

SEQ ID NO: 925880 - DNA, 22 bp, Homo sapiens
cctagtgccccagactgagctc

SEQ ID NO: 925881 - DNA, 24 bp, Homo sapiens
cctagtgccccagactgagctctc

SEQ ID NO: 925882 - DNA, 17 bp, Homo sapiens
cctagtggggtctccct

SEQ ID NO: 925883 - DNA, 18 bp, Homo sapiens
cctagtggggtctccctc

SEQ ID NO: 925884 - DNA, 19 bp, Homo sapiens
cctagtggggtctccctct

SEQ ID NO: 925885 - DNA, 24 bp, Homo sapiens
cctagtggggtctccctctcctgc

SEQ ID NO: 925886 - DNA, 15 bp, Homo sapiens
cctagttaaagaaag

SEQ ID NO: 925887 - DNA, 12 bp, Homo sapiens
cctagttttcca

SEQ ID NO: 925888 - DNA, 15 bp, Homo sapiens
cctagttttcctact

SEQ ID NO: 925889 - DNA, 12 bp, Homo sapiens
cctataaggaag

SEQ ID NO: 925890 - DNA, 17 bp, Homo sapiens
cctataataaaatggca

SEQ ID NO: 925891 - DNA, 22 bp, Homo sapiens
cctataataaaatggcaccttc

SEQ ID NO: 925892 - DNA, 17 bp, Homo sapiens
cctataatcttatacaa

SEQ ID NO: 925893 - DNA, 21 bp, Homo sapiens
cctatacagaacagagggcca

SEQ ID NO: 925894 - DNA, 19 bp, Homo sapiens
cctatacgtttctgtggag

SEQ ID NO: 925895 - DNA, 20 bp, Homo sapiens
cctatacgtttctgtggagt

SEQ ID NO: 925896 - DNA, 11 bp, Homo sapiens
cctatactgaa

SEQ ID NO: 925897 - DNA, 15 bp, Homo sapiens
cctatagagaggggg

SEQ ID NO: 925898 - DNA, 17 bp, Homo sapiens
cctatagcactgagctc

SEQ ID NO: 925899 - DNA, 18 bp, Homo sapiens
cctcaccccaatccctgc

SEQ ID NO: 925900 - DNA, 20 bp, Homo sapiens
cctcaccccaatccctgcca

SEQ ID NO: 925901 - DNA, 23 bp, Homo sapiens
cctcaccccaatccctgccactg

SEQ ID NO: 925902 - DNA, 17 bp, Homo sapiens
cctcacccccagctttg

SEQ ID NO: 925903 - DNA, 17 bp, Homo sapiens
cctcacccccaggtgtt

SEQ ID NO: 925904 - DNA, 17 bp, Homo sapiens
cctcaccccctcccacc

SEQ ID NO: 925905 - DNA, 20 bp, Homo sapiens
cctcaccccctcccaccccc

SEQ ID NO: 925906 - DNA, 15 bp, Homo sapiens
cctcaccctgcctta

SEQ ID NO: 925907 - DNA, 22 bp, Homo sapiens
cctcaccctgtgggaccgcctg

SEQ ID NO: 925908 - DNA, 23 bp, Homo sapiens
cctcaccctgtgggaccgcctgg

SEQ ID NO: 925909 - DNA, 14 bp, Homo sapiens
cctcaccctttacc

SEQ ID NO: 925910 - DNA, 22 bp, Homo sapiens
cctcacctaataggctgggaga

SEQ ID NO: 925911 - DNA, 16 bp, Homo sapiens
cctcacctcatgccca

SEQ ID NO: 925912 - DNA, 17 bp, Homo sapiens
cctcacctcatgcccac

SEQ ID NO: 925913 - DNA, 19 bp, Homo sapiens
cctcacctcatgcccaccc

SEQ ID NO: 925914 - DNA, 14 bp, Homo sapiens
cctcacctctaccc

SEQ ID NO: 925915 - DNA, 16 bp, Homo sapiens
cctcacctctacccaa

SEQ ID NO: 925916 - DNA, 14 bp, Homo sapiens
cctcacctctgagg

SEQ ID NO: 925917 - DNA, 13 bp, Homo sapiens
cctcacctctgat

SEQ ID NO: 925918 - DNA, 12 bp, Homo sapiens
cctcacctctgg

SEQ ID NO: 925919 - DNA, 18 bp, Homo sapiens
cctcacctgcccctctgt

SEQ ID NO: 925920 - DNA, 15 bp, Homo sapiens
cctcacctgggcctt

SEQ ID NO: 925921 - DNA, 22 bp, Homo sapiens
cctcacgcaagtgccagggctg

SEQ ID NO: 925922 - DNA, 13 bp, Homo sapiens
cctcacgctgggt

SEQ ID NO: 925923 - DNA, 21 bp, Homo sapiens
cctcacgtatttcacagagca

SEQ ID NO: 925924 - DNA, 22 bp, Homo sapiens
cctcacgtatttcacagagcac

SEQ ID NO: 925925 - DNA, 16 bp, Homo sapiens
cctcacgtgcaggaca

SEQ ID NO: 925926 - DNA, 17 bp, Homo sapiens
cctcacgtgcaggacag

SEQ ID NO: 925927 - DNA, 20 bp, Homo sapiens
cctcactatggtatgctggc

SEQ ID NO: 925928 - DNA, 19 bp, Homo sapiens
cctcactccccagggagct

SEQ ID NO: 925929 - DNA, 15 bp, Homo sapiens
cctcactctgtccct

SEQ ID NO: 925930 - DNA, 15 bp, Homo sapiens
cctcactcttcctca

SEQ ID NO: 925931 - DNA, 18 bp, Homo sapiens
cctcactgaaaacatctg

SEQ ID NO: 925932 - DNA, 17 bp, Homo sapiens
cctcactgctggggagt

SEQ ID NO: 925933 - DNA, 22 bp, Homo sapiens
cctcactggctcatgccccttg

SEQ ID NO: 925934 - DNA, 18 bp, Homo sapiens
cctcactggctctcctgg

SEQ ID NO: 925935 - DNA, 13 bp, Homo sapiens
cctcactggctgg

SEQ ID NO: 925936 - DNA, 14 bp, Homo sapiens
cctcactgggcctt

SEQ ID NO: 925937 - DNA, 23 bp, Homo sapiens
cctcactggggtcctggggcctc

SEQ ID NO: 925938 - DNA, 21 bp, Homo sapiens
cctcactgggtggggtgagga

SEQ ID NO: 925939 - DNA, 19 bp, Homo sapiens
cctcacttgattcatctct

SEQ ID NO: 925940 - DNA, 22 bp, Homo sapiens
cctcacttgattcatctctggt

SEQ ID NO: 925941 - DNA, 14 bp, Homo sapiens
cctcacttggggga

SEQ ID NO: 925942 - DNA, 16 bp, Homo sapiens
cctcagaaaggatttt

SEQ ID NO: 925943 - DNA, 15 bp, Homo sapiens
cctcagaaagtcacc

SEQ ID NO: 925944 - DNA, 21 bp, Homo sapiens
cctcagaaagtcaccaggact

SEQ ID NO: 925945 - DNA, 22 bp, Homo sapiens
cctcagaaagtcaccaggactt

SEQ ID NO: 925946 - DNA, 22 bp, Homo sapiens
cctcagaacccacagtgagagg

SEQ ID NO: 925947 - DNA, 14 bp, Homo sapiens
cctcagaaggcccc

SEQ ID NO: 925948 - DNA, 19 bp, Homo sapiens
cctcagaaggccccagaga

SEQ ID NO: 925949 - DNA, 16 bp, Homo sapiens
cctcagacgttgcctg

SEQ ID NO: 925950 - DNA, 14 bp, Homo sapiens
cctcagagcaggct

SEQ ID NO: 925951 - DNA, 19 bp, Homo sapiens
cctcagagcaggggccaga

SEQ ID NO: 925952 - DNA, 14 bp, Homo sapiens
cctcagagcccatg

SEQ ID NO: 925953 - DNA, 19 bp, Homo sapiens
cctcagagccctgccctgc

SEQ ID NO: 925954 - DNA, 11 bp, Homo sapiens
cctcagagcct

SEQ ID NO: 925955 - DNA, 16 bp, Homo sapiens
cctcagagcctgacct

SEQ ID NO: 925956 - DNA, 20 bp, Homo sapiens
cctcagagcctgacctgaga

SEQ ID NO: 925957 - DNA, 22 bp, Homo sapiens
cctcagagcgccaggaagccag

SEQ ID NO: 925958 - DNA, 23 bp, Homo sapiens
cctcagagcgccaggaagccaga

SEQ ID NO: 925959 - DNA, 17 bp, Homo sapiens
cctcagaggctgagccc

SEQ ID NO: 925960 - DNA, 22 bp, Homo sapiens
cctcagaggctgagccctgtac

SEQ ID NO: 925961 - DNA, 13 bp, Homo sapiens
cctcagagtccag

SEQ ID NO: 925962 - DNA, 13 bp, Homo sapiens
cctcagagtggag

SEQ ID NO: 925963 - DNA, 14 bp, Homo sapiens
cctcagatgatctc

SEQ ID NO: 925964 - DNA, 22 bp, Homo sapiens
cctcagatgcgttcgcctctgg

SEQ ID NO: 925965 - DNA, 12 bp, Homo sapiens
cctcagatgggg

SEQ ID NO: 925966 - DNA, 17 bp, Homo sapiens
cctcagatttccattgt

SEQ ID NO: 925967 - DNA, 13 bp, Homo sapiens
cctcagcacccct

SEQ ID NO: 925968 - DNA, 17 bp, Homo sapiens
cctcagcaccccttcca

SEQ ID NO: 925969 - DNA, 17 bp, Homo sapiens
cctcagccagagaagct

SEQ ID NO: 925970 - DNA, 16 bp, Homo sapiens
cctcagccatgaggag

SEQ ID NO: 925971 - DNA, 23 bp, Homo sapiens
cctcagccattcactgcccccag

SEQ ID NO: 925972 - DNA, 14 bp, Homo sapiens
cctcagcccccagg

SEQ ID NO: 925973 - DNA, 15 bp, Homo sapiens
cctcagcccccagga

SEQ ID NO: 925974 - DNA, 17 bp, Homo sapiens
cctcagcccccaggcca

SEQ ID NO: 925975 - DNA, 16 bp, Homo sapiens
cctcagcccctcttgc

SEQ ID NO: 925976 - DNA, 20 bp, Homo sapiens
cctcagcccctcttgccccc

SEQ ID NO: 925977 - DNA, 12 bp, Homo sapiens
cctcagccctca

SEQ ID NO: 925978 - DNA, 15 bp, Homo sapiens
cctcagccctcagtt

SEQ ID NO: 925979 - DNA, 15 bp, Homo sapiens
gatcccagtcactcc

SEQ ID NO: 925980 - DNA, 18 bp, Homo sapiens
gatcccatgtcacctcag

SEQ ID NO: 925981 - DNA, 22 bp, Homo sapiens
gatcccatgtcacctcagctga

SEQ ID NO: 925982 - DNA, 14 bp, Homo sapiens
gatccccaagtgtg

SEQ ID NO: 925983 - DNA, 15 bp, Homo sapiens
gatccccactgtcct

SEQ ID NO: 925984 - DNA, 17 bp, Homo sapiens
gatccccagggcagcct

SEQ ID NO: 925985 - DNA, 21 bp, Homo sapiens
gatccccagggcagcctggat

SEQ ID NO: 925986 - DNA, 13 bp, Homo sapiens
gatccccgcctgg

SEQ ID NO: 925987 - DNA, 15 bp, Homo sapiens
gatccccgcctggcc

SEQ ID NO: 925988 - DNA, 22 bp, Homo sapiens
gatccccgcctggccaggagca

SEQ ID NO: 925989 - DNA, 16 bp, Homo sapiens
gatccccgcttcccct

SEQ ID NO: 925990 - DNA, 14 bp, Homo sapiens
gatcccctccccca

SEQ ID NO: 925991 - DNA, 16 bp, Homo sapiens
gatcccctctcctgcc

SEQ ID NO: 925992 - DNA, 13 bp, Homo sapiens
gatcccctgagcc

SEQ ID NO: 925993 - DNA, 14 bp, Homo sapiens
gatccctcatctgt

SEQ ID NO: 925994 - DNA, 17 bp, Homo sapiens
gatccctccacccccat

SEQ ID NO: 925995 - DNA, 19 bp, Homo sapiens
gatccctgaacccctggcc

SEQ ID NO: 925996 - DNA, 18 bp, Homo sapiens
gatccctgttacccagag

SEQ ID NO: 925997 - DNA, 20 bp, Homo sapiens
gatccgcctacctcagcctc

SEQ ID NO: 925998 - DNA, 16 bp, Homo sapiens
gatccgctgccaccac

SEQ ID NO: 925999 - DNA, 17 bp, Homo sapiens
gatccggctgctcctcc

SEQ ID NO: 926000 - DNA, 19 bp, Homo sapiens
gatccggctgctcctccag

SEQ ID NO: 926001 - DNA, 21 bp, Homo sapiens
gatccggctgctcctccagcc

SEQ ID NO: 926002 - DNA, 12 bp, Homo sapiens
gatcctaaactc

SEQ ID NO: 926003 - DNA, 22 bp, Homo sapiens
gatcctaagaatttttcattct

SEQ ID NO: 926004 - DNA, 23 bp, Homo sapiens
gatcctagccttatcctctgatc

SEQ ID NO: 926005 - DNA, 20 bp, Homo sapiens
gatcctattctcaccaggaa

SEQ ID NO: 926006 - DNA, 18 bp, Homo sapiens
gatcctcacactacagat

SEQ ID NO: 926007 - DNA, 18 bp, Homo sapiens
gatcctcacgccttggcc

SEQ ID NO: 926008 - DNA, 23 bp, Homo sapiens
gatcctcatatggcccagtgtca

SEQ ID NO: 926009 - DNA, 16 bp, Homo sapiens
gatcctccaatgtcta

SEQ ID NO: 926010 - DNA, 20 bp, Homo sapiens
gatcctccaatgtctaattt

SEQ ID NO: 926011 - DNA, 13 bp, Homo sapiens
gatcctccacaga

SEQ ID NO: 926012 - DNA, 15 bp, Homo sapiens
gatcctctattttgt

SEQ ID NO: 926013 - DNA, 16 bp, Homo sapiens
gatcctctcacctcag

SEQ ID NO: 926014 - DNA, 19 bp, Homo sapiens
gatcctctccaccctcctc

SEQ ID NO: 926015 - DNA, 16 bp, Homo sapiens
gatcctctttactctg

SEQ ID NO: 926016 - DNA, 22 bp, Homo sapiens
gatcctgaatctgtgcaaacag

SEQ ID NO: 926017 - DNA, 11 bp, Homo sapiens
gatcctgcagg

SEQ ID NO: 926018 - DNA, 18 bp, Homo sapiens
gatcctggattcactcac

SEQ ID NO: 926019 - DNA, 17 bp, Homo sapiens
gatcctgggctgggtgg

SEQ ID NO: 926020 - DNA, 19 bp, Homo sapiens
gatcctgggggcctgggtt

SEQ ID NO: 926021 - DNA, 14 bp, Homo sapiens
gatctttgagccca

SEQ ID NO: 926022 - DNA, 15 bp, Homo sapiens
gatctttgagcccat

SEQ ID NO: 926023 - DNA, 13 bp, Homo sapiens
gatcttttaaagt

SEQ ID NO: 926024 - DNA, 17 bp, Homo sapiens
gatcttttaaagtgtta

SEQ ID NO: 926025 - DNA, 21 bp, Homo sapiens
gatgaaaagtatattgataac

SEQ ID NO: 926026 - DNA, 16 bp, Homo sapiens
gatgaaagttccccca

SEQ ID NO: 926027 - DNA, 16 bp, Homo sapiens
gatgaaatgcactgta

SEQ ID NO: 926028 - DNA, 15 bp, Homo sapiens
gatgaacatattcat

SEQ ID NO: 926029 - DNA, 13 bp, Homo sapiens
gatgaacatttca

SEQ ID NO: 926030 - DNA, 13 bp, Homo sapiens
gatgaacccagga

SEQ ID NO: 926031 - DNA, 13 bp, Homo sapiens
gatgaacctgcag

SEQ ID NO: 926032 - DNA, 17 bp, Homo sapiens
gatgaacttattctgta

SEQ ID NO: 926033 - DNA, 18 bp, Homo sapiens
gatgaacttgagctctgt

SEQ ID NO: 926034 - DNA, 20 bp, Homo sapiens
gatgaagaaaagtgggccag

SEQ ID NO: 926035 - DNA, 20 bp, Homo sapiens
gatgaagaacacagcatgtg

SEQ ID NO: 926036 - DNA, 22 bp, Homo sapiens
gatgaagaacacagcatgtgcc

SEQ ID NO: 926037 - DNA, 18 bp, Homo sapiens
gatgaagagaaggcacac

SEQ ID NO: 926038 - DNA, 18 bp, Homo sapiens
gatgaaggctgtatctat

SEQ ID NO: 926039 - DNA, 16 bp, Homo sapiens
gatgaagttttacatt

SEQ ID NO: 926040 - DNA, 17 bp, Homo sapiens
gatgaagttttacattg

SEQ ID NO: 926041 - DNA, 14 bp, Homo sapiens
gatgaatacatttt

SEQ ID NO: 926042 - DNA, 15 bp, Homo sapiens
gatgaatagatgtga

SEQ ID NO: 926043 - DNA, 18 bp, Homo sapiens
gatgaatgtaaactcggg

SEQ ID NO: 926044 - DNA, 14 bp, Homo sapiens
gatgaatgtatgtg

SEQ ID NO: 926045 - DNA, 14 bp, Homo sapiens
gatgaatgtattta

SEQ ID NO: 926046 - DNA, 18 bp, Homo sapiens
gatgaattcttcctctcc

SEQ ID NO: 926047 - DNA, 19 bp, Homo sapiens
gatgaattcttcctctcct

SEQ ID NO: 926048 - DNA, 23 bp, Homo sapiens
gatgaattcttcctctccttccc

SEQ ID NO: 926049 - DNA, 23 bp, Homo sapiens
gatgacaacctgtgtgagagaat

SEQ ID NO: 926050 - DNA, 16 bp, Homo sapiens
gatgacaccctggcct

SEQ ID NO: 926051 - DNA, 19 bp, Homo sapiens
gatgacaggcgcctgccat

SEQ ID NO: 926052 - DNA, 13 bp, Homo sapiens
gatgacagggcag

SEQ ID NO: 926053 - DNA, 21 bp, Homo sapiens
gatgacatagcagttacagag

SEQ ID NO: 926054 - DNA, 20 bp, Homo sapiens
gatgacatgcactcagctct

SEQ ID NO: 926055 - DNA, 23 bp, Homo sapiens
gatgacattctggtctcgtcttc

SEQ ID NO: 926056 - DNA, 23 bp, Homo sapiens
gatgaccacacccgaagtcctgt

SEQ ID NO: 926057 - DNA, 23 bp, Homo sapiens
gatgaccagggatgctgggctgg

SEQ ID NO: 926058 - DNA, 20 bp, Homo sapiens
gatgacccctaccccctcat

SEQ ID NO: 926059 - DNA, 23 bp, Homo sapiens
gatgaccctgcgaaggggccctg

SEQ ID NO: 926060 - DNA, 15 bp, Homo sapiens
gatgaccgtgtacaa

SEQ ID NO: 926061 - DNA, 14 bp, Homo sapiens
gatgacgcctgtct

SEQ ID NO: 926062 - DNA, 16 bp, Homo sapiens
gatgactagaggcagg

SEQ ID NO: 926063 - DNA, 21 bp, Homo sapiens
gatgactatgcagaggcctgg

SEQ ID NO: 926064 - DNA, 22 bp, Homo sapiens
gatgactatgcagaggcctggg

SEQ ID NO: 926065 - DNA, 18 bp, Homo sapiens
gatgactcccttaaaata

SEQ ID NO: 926066 - DNA, 16 bp, Homo sapiens
gatgactcgaaactga

SEQ ID NO: 926067 - DNA, 13 bp, Homo sapiens
gatgactctgaga

SEQ ID NO: 926068 - DNA, 12 bp, Homo sapiens
gatgactgagtc

SEQ ID NO: 926069 - DNA, 17 bp, Homo sapiens
gatgacttgctgtccag

SEQ ID NO: 926070 - DNA, 13 bp, Homo sapiens
gatgactttagaa

SEQ ID NO: 926071 - DNA, 12 bp, Homo sapiens
gatgagaaaaaa

SEQ ID NO: 926072 - DNA, 20 bp, Homo sapiens
gatgagatttgccagcacag

SEQ ID NO: 926073 - DNA, 14 bp, Homo sapiens
gatgagcttagggt

SEQ ID NO: 926074 - DNA, 20 bp, Homo sapiens
gatgagcttagggtgttttt

SEQ ID NO: 926075 - DNA, 22 bp, Homo sapiens
gatgaggagtaaaattcagttt

SEQ ID NO: 926076 - DNA, 19 bp, Homo sapiens
gatgaggccgctagaggcc

SEQ ID NO: 926077 - DNA, 22 bp, Homo sapiens
gatgaggccgctagaggcctga

SEQ ID NO: 926078 - DNA, 13 bp, Homo sapiens
gatgaggtctgat

SEQ ID NO: 926079 - DNA, 23 bp, Homo sapiens
gatgagtcagacacgattgagaa

SEQ ID NO: 926080 - DNA, 13 bp, Homo sapiens
gatgagttattat

SEQ ID NO: 926081 - DNA, 15 bp, Homo sapiens
gatgataaatattta

SEQ ID NO: 926082 - DNA, 21 bp, Homo sapiens
gatgataaatatttatgctta

SEQ ID NO: 926083 - DNA, 22 bp, Homo sapiens
gatgataaatatttatgcttaa

SEQ ID NO: 926084 - DNA, 15 bp, Homo sapiens
gatgatactgtttct

SEQ ID NO: 926085 - DNA, 14 bp, Homo sapiens
gatgatatacacag

SEQ ID NO: 926086 - DNA, 13 bp, Homo sapiens
gatgatccagaac

SEQ ID NO: 926087 - DNA, 16 bp, Homo sapiens
gatgatccagaacagt

SEQ ID NO: 926088 - DNA, 15 bp, Homo sapiens
gatgatcccagtcac

SEQ ID NO: 926089 - DNA, 15 bp, Homo sapiens
gatgatctactcaga

SEQ ID NO: 926090 - DNA, 16 bp, Homo sapiens
gatgatgaaaactaag

SEQ ID NO: 926091 - DNA, 22 bp, Homo sapiens
gatgatgcttgtaacaagaaaa

SEQ ID NO: 926092 - DNA, 19 bp, Homo sapiens
gatgatggcagagccaggc

SEQ ID NO: 926093 - DNA, 14 bp, Homo sapiens
gatgatgtctcttg

SEQ ID NO: 926094 - DNA, 17 bp, Homo sapiens
gatgatgttttgatatt

SEQ ID NO: 926095 - DNA, 23 bp, Homo sapiens
gatgattctggattctaaacaac

SEQ ID NO: 926096 - DNA, 14 bp, Homo sapiens
gatgattgaggtgg

SEQ ID NO: 926097 - DNA, 19 bp, Homo sapiens
gatgattgcgcagggaggg

SEQ ID NO: 926098 - DNA, 13 bp, Homo sapiens
gatgattgtacag

SEQ ID NO: 926099 - DNA, 19 bp, Homo sapiens
gatgatttctagcaggcag

SEQ ID NO: 926100 - DNA, 18 bp, Homo sapiens
gatgatttgggggaggct

SEQ ID NO: 926101 - DNA, 19 bp, Homo sapiens
gatgattttcatttcatga

SEQ ID NO: 926102 - DNA, 14 bp, Homo sapiens
gatgatttttgtca

SEQ ID NO: 926103 - DNA, 18 bp, Homo sapiens
gatgattttttgaaagtt

SEQ ID NO: 926104 - DNA, 18 bp, Homo sapiens
gatgcaagttattttatt

SEQ ID NO: 926105 - DNA, 21 bp, Homo sapiens
gatgcaatcggtttaaacatg

SEQ ID NO: 926106 - DNA, 21 bp, Homo sapiens
gatgcacagagaagctgggga

SEQ ID NO: 926107 - DNA, 13 bp, Homo sapiens
gatgcacatttct

SEQ ID NO: 926108 - DNA, 19 bp, Homo sapiens
gatgcacatttctggattg

SEQ ID NO: 926109 - DNA, 19 bp, Homo sapiens
cctcatctccagcctcccc

SEQ ID NO: 926110 - DNA, 13 bp, Homo sapiens
cctcatctccttt

SEQ ID NO: 926111 - DNA, 14 bp, Homo sapiens
cctcatctccttta

SEQ ID NO: 926112 - DNA, 13 bp, Homo sapiens
cctcatctgagag

SEQ ID NO: 926113 - DNA, 24 bp, Homo sapiens
cctcatctgagaggctctccgtgc

SEQ ID NO: 926114 - DNA, 23 bp, Homo sapiens
cctcatctgggtctcccaggaca

SEQ ID NO: 926115 - DNA, 22 bp, Homo sapiens
cctcatctgtggagctgccaca

SEQ ID NO: 926116 - DNA, 18 bp, Homo sapiens
cctcatcttcttcaccat

SEQ ID NO: 926117 - DNA, 11 bp, Homo sapiens
cctcatgagga

SEQ ID NO: 926118 - DNA, 17 bp, Homo sapiens
cctcatgccatggtctt

SEQ ID NO: 926119 - DNA, 20 bp, Homo sapiens
cctcatgcccaccccctgcc

SEQ ID NO: 926120 - DNA, 21 bp, Homo sapiens
cctcatgcccaccccctgccc

SEQ ID NO: 926121 - DNA, 22 bp, Homo sapiens
cctcatgcccaccccctgccct

SEQ ID NO: 926122 - DNA, 23 bp, Homo sapiens
cctcatgcccaccccctgccctg

SEQ ID NO: 926123 - DNA, 16 bp, Homo sapiens
cctcatgcccagctct

SEQ ID NO: 926124 - DNA, 17 bp, Homo sapiens
cctcatgcccagctctc

SEQ ID NO: 926125 - DNA, 18 bp, Homo sapiens
cctcatgctggagggagg

SEQ ID NO: 926126 - DNA, 17 bp, Homo sapiens
cctcatggattgccaca

SEQ ID NO: 926127 - DNA, 20 bp, Homo sapiens
cctcatggattgccacagct

SEQ ID NO: 926128 - DNA, 22 bp, Homo sapiens
cctcatggattgccacagctca

SEQ ID NO: 926129 - DNA, 16 bp, Homo sapiens
cctcatggcccctctg

SEQ ID NO: 926130 - DNA, 16 bp, Homo sapiens
cctcatgtggctggaa

SEQ ID NO: 926131 - DNA, 12 bp, Homo sapiens
cctcattaaatt

SEQ ID NO: 926132 - DNA, 18 bp, Homo sapiens
cctcattaatagctgcct

SEQ ID NO: 926133 - DNA, 20 bp, Homo sapiens
cctcattaatagctgccttc

SEQ ID NO: 926134 - DNA, 16 bp, Homo sapiens
cctcattactgggcct

SEQ ID NO: 926135 - DNA, 18 bp, Homo sapiens
cctcattagcattttgct

SEQ ID NO: 926136 - DNA, 15 bp, Homo sapiens
cctcattcagcatgg

SEQ ID NO: 926137 - DNA, 16 bp, Homo sapiens
cctcattcaggaaaac

SEQ ID NO: 926138 - DNA, 14 bp, Homo sapiens
cctcattcccctcg

SEQ ID NO: 926139 - DNA, 21 bp, Homo sapiens
cctcattctactaatgtgatg

SEQ ID NO: 926140 - DNA, 17 bp, Homo sapiens
cctcattctgaggcctg

SEQ ID NO: 926141 - DNA, 15 bp, Homo sapiens
cctcattgctgtctt

SEQ ID NO: 926142 - DNA, 21 bp, Homo sapiens
cctcattgctgtcttgcccca

SEQ ID NO: 926143 - DNA, 16 bp, Homo sapiens
gatggctgtcgcctgt

SEQ ID NO: 926144 - DNA, 20 bp, Homo sapiens
gatggctgtggcatttccaa

SEQ ID NO: 926145 - DNA, 14 bp, Homo sapiens
gatggcttatgtca

SEQ ID NO: 926146 - DNA, 19 bp, Homo sapiens
gatggcttcggagggccgc

SEQ ID NO: 926147 - DNA, 20 bp, Homo sapiens
gatggcttcggagggccgca

SEQ ID NO: 926148 - DNA, 12 bp, Homo sapiens
gatgggaaaata

SEQ ID NO: 926149 - DNA, 18 bp, Homo sapiens
gatgggaaaatatttcct

SEQ ID NO: 926150 - DNA, 21 bp, Homo sapiens
gatgggaaagcggcgccacag

SEQ ID NO: 926151 - DNA, 23 bp, Homo sapiens
gatgggactagagctttctttca

SEQ ID NO: 926152 - DNA, 20 bp, Homo sapiens
gatgggagggaggctcaggt

SEQ ID NO: 926153 - DNA, 18 bp, Homo sapiens
gatgggagtgggcacctc

SEQ ID NO: 926154 - DNA, 20 bp, Homo sapiens
gatgggagtgggcacctcag

SEQ ID NO: 926155 - DNA, 22 bp, Homo sapiens
gatgggatgtatttttcttgct

SEQ ID NO: 926156 - DNA, 21 bp, Homo sapiens
gatgggcattgggctgacacc

SEQ ID NO: 926157 - DNA, 14 bp, Homo sapiens
gatgggcctggcat

SEQ ID NO: 926158 - DNA, 17 bp, Homo sapiens
gatgggctcccaccctc

SEQ ID NO: 926159 - DNA, 18 bp, Homo sapiens
gatgggctctacctctct

SEQ ID NO: 926160 - DNA, 14 bp, Homo sapiens
gatgggctggggca

SEQ ID NO: 926161 - DNA, 18 bp, Homo sapiens
gatgggctggggcagggg

SEQ ID NO: 926162 - DNA, 21 bp, Homo sapiens
gatgggctgtttcgtgtagtg

SEQ ID NO: 926163 - DNA, 18 bp, Homo sapiens
gatgggcttgttttcttg

SEQ ID NO: 926164 - DNA, 15 bp, Homo sapiens
gatggggactctgcc

SEQ ID NO: 926165 - DNA, 17 bp, Homo sapiens
gatggggactctgccgc

SEQ ID NO: 926166 - DNA, 12 bp, Homo sapiens
gatggggagaaa

SEQ ID NO: 926167 - DNA, 18 bp, Homo sapiens
gatggggatagaggaaag

SEQ ID NO: 926168 - DNA, 16 bp, Homo sapiens
gatggggcaagacaga

SEQ ID NO: 926169 - DNA, 16 bp, Homo sapiens
gatggggctgagcagg

SEQ ID NO: 926170 - DNA, 14 bp, Homo sapiens
gatgggggaaaaaa

SEQ ID NO: 926171 - DNA, 17 bp, Homo sapiens
gatgggggatgggccag

SEQ ID NO: 926172 - DNA, 17 bp, Homo sapiens
gatgggggcagggctgt

SEQ ID NO: 926173 - DNA, 20 bp, Homo sapiens
gatgggggtgcaggcagcct

SEQ ID NO: 926174 - DNA, 20 bp, Homo sapiens
gatggggtctgtgactggat

SEQ ID NO: 926175 - DNA, 18 bp, Homo sapiens
gatgggtcaacctttgtg

SEQ ID NO: 926176 - DNA, 18 bp, Homo sapiens
gatgggtcccctccgcca

SEQ ID NO: 926177 - DNA, 22 bp, Homo sapiens
gatgggtcctggccttgtgtca

SEQ ID NO: 926178 - DNA, 18 bp, Homo sapiens
gatgggtggggagggggg

SEQ ID NO: 926179 - DNA, 19 bp, Homo sapiens
gatgggtgtgggagtgagg

SEQ ID NO: 926180 - DNA, 15 bp, Homo sapiens
gatgggtgttgctgt

SEQ ID NO: 926181 - DNA, 14 bp, Homo sapiens
gatgggttccagag

SEQ ID NO: 926182 - DNA, 22 bp, Homo sapiens
gatgggttctaattttggatgg

SEQ ID NO: 926183 - DNA, 15 bp, Homo sapiens
gatggtaagagaaaa

SEQ ID NO: 926184 - DNA, 14 bp, Homo sapiens
gatggtactgctga

SEQ ID NO: 926185 - DNA, 17 bp, Homo sapiens
gatggtagttttttcat

SEQ ID NO: 926186 - DNA, 22 bp, Homo sapiens
gatggtattaatcttgtgtagt

SEQ ID NO: 926187 - DNA, 14 bp, Homo sapiens
gatggtcagctccc

SEQ ID NO: 926188 - DNA, 16 bp, Homo sapiens
gatggtcccaggaagc

SEQ ID NO: 926189 - DNA, 18 bp, Homo sapiens
gatggtccgtgcccaggc

SEQ ID NO: 926190 - DNA, 17 bp, Homo sapiens
gatggtcctcacaagcc

SEQ ID NO: 926191 - DNA, 13 bp, Homo sapiens
gatggtcgtgtgt

SEQ ID NO: 926192 - DNA, 16 bp, Homo sapiens
gatggtgacattgaaa

SEQ ID NO: 926193 - DNA, 17 bp, Homo sapiens
gatggtgacattgaaac

SEQ ID NO: 926194 - DNA, 19 bp, Homo sapiens
gatggtgacattgaaacta

SEQ ID NO: 926195 - DNA, 16 bp, Homo sapiens
gatggtgagctgggaa

SEQ ID NO: 926196 - DNA, 17 bp, Homo sapiens
gatggtggactacaaaa

SEQ ID NO: 926197 - DNA, 21 bp, Homo sapiens
gatggtggactacaaaataca

SEQ ID NO: 926198 - DNA, 14 bp, Homo sapiens
gatggtggagggcc

SEQ ID NO: 926199 - DNA, 13 bp, Homo sapiens
gatggtggctgtg

SEQ ID NO: 926200 - DNA, 19 bp, Homo sapiens
gatggtggctttaggggaa

SEQ ID NO: 926201 - DNA, 17 bp, Homo sapiens
gatggtgggcaggatct

SEQ ID NO: 926202 - DNA, 20 bp, Homo sapiens
gatggtgtagccctcccact

SEQ ID NO: 926203 - DNA, 21 bp, Homo sapiens
gatggtgtctcttctttagaa

SEQ ID NO: 926204 - DNA, 18 bp, Homo sapiens
gatggtgtgggtgtcctg

SEQ ID NO: 926205 - DNA, 21 bp, Homo sapiens
gatggtgttaaagctgtacac

SEQ ID NO: 926206 - DNA, 23 bp, Homo sapiens
gatggttattttcttttctttca

SEQ ID NO: 926207 - DNA, 13 bp, Homo sapiens
gatggttcccctg

SEQ ID NO: 926208 - DNA, 21 bp, Homo sapiens
gatggttcccctgttcactct

SEQ ID NO: 926209 - DNA, 18 bp, Homo sapiens
gatggttcttcacctcct

SEQ ID NO: 926210 - DNA, 16 bp, Homo sapiens
gatggttttaaacttt

SEQ ID NO: 926211 - DNA, 15 bp, Homo sapiens
gatgtaaaatgagtt

SEQ ID NO: 926212 - DNA, 13 bp, Homo sapiens
gatgtaaacaatg

SEQ ID NO: 926213 - DNA, 21 bp, Homo sapiens
gatgtaaacagtgcctgctga

SEQ ID NO: 926214 - DNA, 15 bp, Homo sapiens
gatgtaaccaagctg

SEQ ID NO: 926215 - DNA, 12 bp, Homo sapiens
gatgtaaggact

SEQ ID NO: 926216 - DNA, 22 bp, Homo sapiens
gatgtaatctctctgcagctgc

SEQ ID NO: 926217 - DNA, 16 bp, Homo sapiens
gatgtacaattaaaaa

SEQ ID NO: 926218 - DNA, 16 bp, Homo sapiens
gatgtacatttaataa

SEQ ID NO: 926219 - DNA, 19 bp, Homo sapiens
gatgtaccagtttgtccat

SEQ ID NO: 926220 - DNA, 12 bp, Homo sapiens
gatgtagaactt

SEQ ID NO: 926221 - DNA, 17 bp, Homo sapiens
gatgtagagagaacagg

SEQ ID NO: 926222 - DNA, 17 bp, Homo sapiens
gatgtagatttatttca

SEQ ID NO: 926223 - DNA, 19 bp, Homo sapiens
gatgtagtgattaaatata

SEQ ID NO: 926224 - DNA, 15 bp, Homo sapiens
gatgtagttctgcca

SEQ ID NO: 926225 - DNA, 17 bp, Homo sapiens
gatgtatatttgcatat

SEQ ID NO: 926226 - DNA, 21 bp, Homo sapiens
gatgtatctgagttgccaaga

SEQ ID NO: 926227 - DNA, 20 bp, Homo sapiens
gatgtatgaaggcttttggt

SEQ ID NO: 926228 - DNA, 20 bp, Homo sapiens
gatgtatgcacacacatata

SEQ ID NO: 926229 - DNA, 20 bp, Homo sapiens
gatgtatgtgtgaaacaatg

SEQ ID NO: 926230 - DNA, 21 bp, Homo sapiens
gatgtatgtgtgaaacaatgt

SEQ ID NO: 926231 - DNA, 19 bp, Homo sapiens
gatgtatttttgatgtata

SEQ ID NO: 926232 - DNA, 14 bp, Homo sapiens
gatgtcatatcatt

SEQ ID NO: 926233 - DNA, 22 bp, Homo sapiens
gatgtcccagtgctcaccagcc

SEQ ID NO: 926234 - DNA, 14 bp, Homo sapiens
gatgtccccaaagt

SEQ ID NO: 926235 - DNA, 12 bp, Homo sapiens
gatgtcccccac

SEQ ID NO: 926236 - DNA, 22 bp, Homo sapiens
gatgtcccctgtcccaccaact

SEQ ID NO: 926237 - DNA, 22 bp, Homo sapiens
gatgtccctgggccagggtctg

SEQ ID NO: 926238 - DNA, 20 bp, Homo sapiens
gatgtccctttcttggccag

SEQ ID NO: 926239 - DNA, 22 bp, Homo sapiens
gatgtccttggactccatcgct

SEQ ID NO: 926240 - DNA, 15 bp, Homo sapiens
gatgtcgacatgttt

SEQ ID NO: 926241 - DNA, 16 bp, Homo sapiens
cctcccccagcgtcag

SEQ ID NO: 926242 - DNA, 19 bp, Homo sapiens
cctcccccagcgtcagttt

SEQ ID NO: 926243 - DNA, 12 bp, Homo sapiens
cctcccccagct

SEQ ID NO: 926244 - DNA, 15 bp, Homo sapiens
cctcccccagctcct

SEQ ID NO: 926245 - DNA, 14 bp, Homo sapiens
cctcccccagctgc

SEQ ID NO: 926246 - DNA, 12 bp, Homo sapiens
cctcccccagtg

SEQ ID NO: 926247 - DNA, 16 bp, Homo sapiens
cctccccccactgcag

SEQ ID NO: 926248 - DNA, 22 bp, Homo sapiens
cctccccccagaccccgcccct

SEQ ID NO: 926249 - DNA, 21 bp, Homo sapiens
cctccccccagctccctgcac

SEQ ID NO: 926250 - DNA, 19 bp, Homo sapiens
cctcccccggctgggcctc

SEQ ID NO: 926251 - DNA, 15 bp, Homo sapiens
cctccccctcaacct

SEQ ID NO: 926252 - DNA, 12 bp, Homo sapiens
cctccccctcct

SEQ ID NO: 926253 - DNA, 16 bp, Homo sapiens
cctccccctcctaggg

SEQ ID NO: 926254 - DNA, 12 bp, Homo sapiens
cctccccctgca

SEQ ID NO: 926255 - DNA, 16 bp, Homo sapiens
cctccccctgccagga

SEQ ID NO: 926256 - DNA, 15 bp, Homo sapiens
cctccccctgttctg

SEQ ID NO: 926257 - DNA, 15 bp, Homo sapiens
cctcccccttctccc

SEQ ID NO: 926258 - DNA, 22 bp, Homo sapiens
cctcccccttctcccacccctg

SEQ ID NO: 926259 - DNA, 19 bp, Homo sapiens
cctccccctttcacactgg

SEQ ID NO: 926260 - DNA, 21 bp, Homo sapiens
cctccccgaggttgtggggag

SEQ ID NO: 926261 - DNA, 15 bp, Homo sapiens
cctccccgcaccccc

SEQ ID NO: 926262 - DNA, 21 bp, Homo sapiens
cctccccgcaccccccaagct

SEQ ID NO: 926263 - DNA, 21 bp, Homo sapiens
cctccccgcagtgggaagtga

SEQ ID NO: 926264 - DNA, 23 bp, Homo sapiens
cctccccgcccctgtggccctgg

SEQ ID NO: 926265 - DNA, 17 bp, Homo sapiens
cctccggagcctcatgt

SEQ ID NO: 926266 - DNA, 15 bp, Homo sapiens
cctccggaggagcag

SEQ ID NO: 926267 - DNA, 16 bp, Homo sapiens
cctccggaggagcagc

SEQ ID NO: 926268 - DNA, 21 bp, Homo sapiens
cctccggcgtcttgcccagca

SEQ ID NO: 926269 - DNA, 23 bp, Homo sapiens
cctccggcgtcttgcccagcagc

SEQ ID NO: 926270 - DNA, 21 bp, Homo sapiens
cctccgggcaggggagccagg

SEQ ID NO: 926271 - DNA, 15 bp, Homo sapiens
cctccggggtgggtg

SEQ ID NO: 926272 - DNA, 18 bp, Homo sapiens
cctccgtagggtctttct

SEQ ID NO: 926273 - DNA, 22 bp, Homo sapiens
cctccgtagggtctttcttggg

SEQ ID NO: 926274 - DNA, 23 bp, Homo sapiens
cctccgtagggtctttcttggga

SEQ ID NO: 926275 - DNA, 13 bp, Homo sapiens
cctccgtcatcca

SEQ ID NO: 926276 - DNA, 17 bp, Homo sapiens
cctccgtcatccatgcc

SEQ ID NO: 926277 - DNA, 13 bp, Homo sapiens
cctccgtccaccc

SEQ ID NO: 926278 - DNA, 16 bp, Homo sapiens
cctccgtccacccagg

SEQ ID NO: 926279 - DNA, 14 bp, Homo sapiens
cctccgtcctgtca

SEQ ID NO: 926280 - DNA, 20 bp, Homo sapiens
cctccgtctgaccctctgcg

SEQ ID NO: 926281 - DNA, 17 bp, Homo sapiens
cctccgtgatccatcca

SEQ ID NO: 926282 - DNA, 16 bp, Homo sapiens
cctccgtggaacattc

SEQ ID NO: 926283 - DNA, 18 bp, Homo sapiens
cctccgtggaacattctg

SEQ ID NO: 926284 - DNA, 20 bp, Homo sapiens
cctccgtggaacattctgga

SEQ ID NO: 926285 - DNA, 18 bp, Homo sapiens
cctccgtttatgggcctt

SEQ ID NO: 926286 - DNA, 22 bp, Homo sapiens
cctccgtttatgggccttgctt

SEQ ID NO: 926287 - DNA, 19 bp, Homo sapiens
cctcctaaggctccccacc

SEQ ID NO: 926288 - DNA, 17 bp, Homo sapiens
cctcctaagtcccttcc

SEQ ID NO: 926289 - DNA, 17 bp, Homo sapiens
cctcctacgcagatgct

SEQ ID NO: 926290 - DNA, 18 bp, Homo sapiens
cctcctagaggtgggcag

SEQ ID NO: 926291 - DNA, 19 bp, Homo sapiens
cctcctagaggtgggcagc

SEQ ID NO: 926292 - DNA, 18 bp, Homo sapiens
cctcctagctctcccagt

SEQ ID NO: 926293 - DNA, 14 bp, Homo sapiens
cctcctagggggtg

SEQ ID NO: 926294 - DNA, 19 bp, Homo sapiens
cctcctatcagaagtttct

SEQ ID NO: 926295 - DNA, 16 bp, Homo sapiens
cctcctatccttggag

SEQ ID NO: 926296 - DNA, 23 bp, Homo sapiens
cctcctatccttggagagcagct

SEQ ID NO: 926297 - DNA, 19 bp, Homo sapiens
cctcctcacccacctctgg

SEQ ID NO: 926298 - DNA, 14 bp, Homo sapiens
cctcctcaccccca

SEQ ID NO: 926299 - DNA, 13 bp, Homo sapiens
cctcctcaccccg

SEQ ID NO: 926300 - DNA, 13 bp, Homo sapiens
cctcctcacctct

SEQ ID NO: 926301 - DNA, 14 bp, Homo sapiens
cctcctcacctctg

SEQ ID NO: 926302 - DNA, 16 bp, Homo sapiens
cctcctcagcccccag

SEQ ID NO: 926303 - DNA, 18 bp, Homo sapiens
cctcctcagcccccaggc

SEQ ID NO: 926304 - DNA, 20 bp, Homo sapiens
cctcctcagcgagaggcagc

SEQ ID NO: 926305 - DNA, 16 bp, Homo sapiens
cctcctcagctgcatg

SEQ ID NO: 926306 - DNA, 21 bp, Homo sapiens
cctcctcaggcacacagctac

SEQ ID NO: 926307 - DNA, 14 bp, Homo sapiens
cctcctcaggggca

SEQ ID NO: 926308 - DNA, 23 bp, Homo sapiens
cctcctcagggggtaggagagca

SEQ ID NO: 926309 - DNA, 14 bp, Homo sapiens
cctcctccacagtg

SEQ ID NO: 926310 - DNA, 20 bp, Homo sapiens
cctcctccacagtgctgctt

SEQ ID NO: 926311 - DNA, 12 bp, Homo sapiens
cctcctccagcc

SEQ ID NO: 926312 - DNA, 20 bp, Homo sapiens
cctcctccagggtgatttta

SEQ ID NO: 926313 - DNA, 15 bp, Homo sapiens
cctcctccatcacct

SEQ ID NO: 926314 - DNA, 16 bp, Homo sapiens
cctcctcccacccggc

SEQ ID NO: 926315 - DNA, 19 bp, Homo sapiens
cctcctcccacccggctgc

SEQ ID NO: 926316 - DNA, 13 bp, Homo sapiens
cctcctcccaggg

SEQ ID NO: 926317 - DNA, 13 bp, Homo sapiens
cctcctcccatgt

SEQ ID NO: 926318 - DNA, 18 bp, Homo sapiens
cctcctcccatgtcactg

SEQ ID NO: 926319 - DNA, 12 bp, Homo sapiens
cctcctccccct

SEQ ID NO: 926320 - DNA, 13 bp, Homo sapiens
cctcctcccctcc

SEQ ID NO: 926321 - DNA, 18 bp, Homo sapiens
cctcctcccctcctcttc

SEQ ID NO: 926322 - DNA, 20 bp, Homo sapiens
cctcctccctcattcatctt

SEQ ID NO: 926323 - DNA, 17 bp, Homo sapiens
cctcctccctcccagct

SEQ ID NO: 926324 - DNA, 13 bp, Homo sapiens
cctcctccttttt

SEQ ID NO: 926325 - DNA, 23 bp, Homo sapiens
cctcctcggaaccgctcacctag

SEQ ID NO: 926326 - DNA, 21 bp, Homo sapiens
cctcctcggagagcagcagca

SEQ ID NO: 926327 - DNA, 18 bp, Homo sapiens
cctcctcgttcctttctc

SEQ ID NO: 926328 - DNA, 13 bp, Homo sapiens
cctcctctacctc

SEQ ID NO: 926329 - DNA, 14 bp, Homo sapiens
cctcctctcactcc

SEQ ID NO: 926330 - DNA, 15 bp, Homo sapiens
cctcctctcccatcc

SEQ ID NO: 926331 - DNA, 14 bp, Homo sapiens
cctcctctgccacc

SEQ ID NO: 926332 - DNA, 20 bp, Homo sapiens
cctcctctgccacctcccct

SEQ ID NO: 926333 - DNA, 21 bp, Homo sapiens
cctcctctgccacctccccta

SEQ ID NO: 926334 - DNA, 17 bp, Homo sapiens
cctcctctgcctacagc

SEQ ID NO: 926335 - DNA, 19 bp, Homo sapiens
cctcctctgcctacagcca

SEQ ID NO: 926336 - DNA, 17 bp, Homo sapiens
cctcctctgctgggact

SEQ ID NO: 926337 - DNA, 20 bp, Homo sapiens
cctcctctggacggcaggct

SEQ ID NO: 926338 - DNA, 21 bp, Homo sapiens
cctcctctggacggcaggctc

SEQ ID NO: 926339 - DNA, 12 bp, Homo sapiens
cctcctctgtga

SEQ ID NO: 926340 - DNA, 14 bp, Homo sapiens
cctcctctttctct

SEQ ID NO: 926341 - DNA, 20 bp, Homo sapiens
cctcctgagaaggcgaggag

SEQ ID NO: 926342 - DNA, 19 bp, Homo sapiens
cctcctgagggaggacctg

SEQ ID NO: 926343 - DNA, 19 bp, Homo sapiens
cctcctgagggctccatgc

SEQ ID NO: 926344 - DNA, 19 bp, Homo sapiens
cctcctgagtagctgggat

SEQ ID NO: 926345 - DNA, 16 bp, Homo sapiens
cctcctgagtgcccca

SEQ ID NO: 926346 - DNA, 16 bp, Homo sapiens
cctcctgatggccaag

SEQ ID NO: 926347 - DNA, 20 bp, Homo sapiens
cctcctgcagacacctggac

SEQ ID NO: 926348 - DNA, 12 bp, Homo sapiens
cctcctgcagtt

SEQ ID NO: 926349 - DNA, 15 bp, Homo sapiens
cctcctgcagtttgg

SEQ ID NO: 926350 - DNA, 10 bp, Homo sapiens
cctcctgccc

SEQ ID NO: 926351 - DNA, 12 bp, Homo sapiens
cctcctgcccac

SEQ ID NO: 926352 - DNA, 20 bp, Homo sapiens
cctcctgcccagctcctcac

SEQ ID NO: 926353 - DNA, 15 bp, Homo sapiens
cctcctgcccaggag

SEQ ID NO: 926354 - DNA, 16 bp, Homo sapiens
cctcctgccccctgcc

SEQ ID NO: 926355 - DNA, 17 bp, Homo sapiens
cctcctgccccctgcca

SEQ ID NO: 926356 - DNA, 12 bp, Homo sapiens
cctcctgcctca

SEQ ID NO: 926357 - DNA, 15 bp, Homo sapiens
cctcctgcctcagcc

SEQ ID NO: 926358 - DNA, 18 bp, Homo sapiens
cctcctgcctcagccttc

SEQ ID NO: 926359 - DNA, 18 bp, Homo sapiens
cctcctgcggctcagcct

SEQ ID NO: 926360 - DNA, 23 bp, Homo sapiens
cctcctgcggctcagccttgcac

SEQ ID NO: 926361 - DNA, 15 bp, Homo sapiens
cctcctgctactctg

SEQ ID NO: 926362 - DNA, 15 bp, Homo sapiens
cctcctgctcctcac

SEQ ID NO: 926363 - DNA, 12 bp, Homo sapiens
cctcctgctttg

SEQ ID NO: 926364 - DNA, 20 bp, Homo sapiens
cctcctggaaccttgctgtc

SEQ ID NO: 926365 - DNA, 22 bp, Homo sapiens
cctcctggaaccttgctgtcct

SEQ ID NO: 926366 - DNA, 20 bp, Homo sapiens
cctcctggaatcagtatttc

SEQ ID NO: 926367 - DNA, 16 bp, Homo sapiens
cctcctggcaatcaat

SEQ ID NO: 926368 - DNA, 23 bp, Homo sapiens
cctcctggccggggcccctcacc

SEQ ID NO: 926369 - DNA, 19 bp, Homo sapiens
cctcctggccttcctcgtt

SEQ ID NO: 926370 - DNA, 11 bp, Homo sapiens
cctcctgggaa

SEQ ID NO: 926371 - DNA, 12 bp, Homo sapiens
cctcctgggagc

SEQ ID NO: 926372 - DNA, 18 bp, Homo sapiens
cctcctgggggctggctc

SEQ ID NO: 926373 - DNA, 21 bp, Homo sapiens
gattagtataatatttcttaa

SEQ ID NO: 926374 - DNA, 22 bp, Homo sapiens
gattataaaaaatgtaacatca

SEQ ID NO: 926375 - DNA, 12 bp, Homo sapiens
gattataaatgt

SEQ ID NO: 926376 - DNA, 23 bp, Homo sapiens
gattataagccctgcataatgtt

SEQ ID NO: 926377 - DNA, 14 bp, Homo sapiens
gattataatcagaa

SEQ ID NO: 926378 - DNA, 14 bp, Homo sapiens
gattatatgaagtt

SEQ ID NO: 926379 - DNA, 17 bp, Homo sapiens
gattatatgaagtttaa

SEQ ID NO: 926380 - DNA, 13 bp, Homo sapiens
gattatattcaca

SEQ ID NO: 926381 - DNA, 20 bp, Homo sapiens
gattatctgattcctttaaa

SEQ ID NO: 926382 - DNA, 13 bp, Homo sapiens
gattatcttcagc

SEQ ID NO: 926383 - DNA, 20 bp, Homo sapiens
gattatcttcagcccaggct

SEQ ID NO: 926384 - DNA, 14 bp, Homo sapiens
gattatgatgcata

SEQ ID NO: 926385 - DNA, 22 bp, Homo sapiens
gattatgatgcatacagttttc

SEQ ID NO: 926386 - DNA, 14 bp, Homo sapiens
gattatggagcttt

SEQ ID NO: 926387 - DNA, 20 bp, Homo sapiens
cctcctgtgcctggccccag

SEQ ID NO: 926388 - DNA, 16 bp, Homo sapiens
cctcctgttctgccca

SEQ ID NO: 926389 - DNA, 19 bp, Homo sapiens
cctcctgttctgcccacga

SEQ ID NO: 926390 - DNA, 14 bp, Homo sapiens
cctccttaatttaa

SEQ ID NO: 926391 - DNA, 18 bp, Homo sapiens
cctccttagccctgtctg

SEQ ID NO: 926392 - DNA, 12 bp, Homo sapiens
cctccttcagac

SEQ ID NO: 926393 - DNA, 14 bp, Homo sapiens
cctccttcagacac

SEQ ID NO: 926394 - DNA, 16 bp, Homo sapiens
cctccttcatttcagc

SEQ ID NO: 926395 - DNA, 11 bp, Homo sapiens
cctccttccac

SEQ ID NO: 926396 - DNA, 13 bp, Homo sapiens
cctccttcccagg

SEQ ID NO: 926397 - DNA, 16 bp, Homo sapiens
cctccttcccagggac

SEQ ID NO: 926398 - DNA, 17 bp, Homo sapiens
cctccttcccagggacc

SEQ ID NO: 926399 - DNA, 14 bp, Homo sapiens
cctccttcccccca

SEQ ID NO: 926400 - DNA, 23 bp, Homo sapiens
cctccttccccccatctctgagt

SEQ ID NO: 926401 - DNA, 21 bp, Homo sapiens
cctccttcccgccgcccgacc

SEQ ID NO: 926402 - DNA, 16 bp, Homo sapiens
cctccttcctgggacc

SEQ ID NO: 926403 - DNA, 17 bp, Homo sapiens
cctccttcctgggaccc

SEQ ID NO: 926404 - DNA, 14 bp, Homo sapiens
cctccttctatttt

SEQ ID NO: 926405 - DNA, 15 bp, Homo sapiens
cctccttctcccttt

SEQ ID NO: 926406 - DNA, 14 bp, Homo sapiens
cctccttcttccac

SEQ ID NO: 926407 - DNA, 14 bp, Homo sapiens
cctccttgcctcct

SEQ ID NO: 926408 - DNA, 17 bp, Homo sapiens
cctccttgcctcctgtg

SEQ ID NO: 926409 - DNA, 20 bp, Homo sapiens
cctccttgcctcctgtgtaa

SEQ ID NO: 926410 - DNA, 22 bp, Homo sapiens
cctccttggcggcaaaagccca

SEQ ID NO: 926411 - DNA, 16 bp, Homo sapiens
cctcctttcagttcgt

SEQ ID NO: 926412 - DNA, 15 bp, Homo sapiens
cctcctttgtctttt

SEQ ID NO: 926413 - DNA, 19 bp, Homo sapiens
cctccttttcactttattg

SEQ ID NO: 926414 - DNA, 20 bp, Homo sapiens
cctccttttcactttattgc

SEQ ID NO: 926415 - DNA, 21 bp, Homo sapiens
cctcctttttaagggtttttt

SEQ ID NO: 926416 - DNA, 13 bp, Homo sapiens
cctcctttttatt

SEQ ID NO: 926417 - DNA, 16 bp, Homo sapiens
cctcgaaacacagaaa

SEQ ID NO: 926418 - DNA, 15 bp, Homo sapiens
cctcgaaccaaggca

SEQ ID NO: 926419 - DNA, 20 bp, Homo sapiens
cctcgaaccaaggcagcctc

SEQ ID NO: 926420 - DNA, 20 bp, Homo sapiens
cctcgaattttatctgtgga

SEQ ID NO: 926421 - DNA, 21 bp, Homo sapiens
cctcgaattttatctgtggag

SEQ ID NO: 926422 - DNA, 17 bp, Homo sapiens
cctcgacagggcctgga

SEQ ID NO: 926423 - DNA, 22 bp, Homo sapiens
cctcgacagggcctggagcccc

SEQ ID NO: 926424 - DNA, 14 bp, Homo sapiens
cctcgagccctccc

SEQ ID NO: 926425 - DNA, 16 bp, Homo sapiens
cctcgagccctccccc

SEQ ID NO: 926426 - DNA, 20 bp, Homo sapiens
cctcgagccctcccccaaac

SEQ ID NO: 926427 - DNA, 24 bp, Homo sapiens
cctcgaggaactccaggacgagga

SEQ ID NO: 926428 - DNA, 13 bp, Homo sapiens
cctcgaggcaccg

SEQ ID NO: 926429 - DNA, 15 bp, Homo sapiens
cctcgaggcaccggc

SEQ ID NO: 926430 - DNA, 20 bp, Homo sapiens
cctcgaggcaccggcgctgc

SEQ ID NO: 926431 - DNA, 22 bp, Homo sapiens
cctcgaggcctacagaggaggc

SEQ ID NO: 926432 - DNA, 15 bp, Homo sapiens
cctcgcaaccctgcc

SEQ ID NO: 926433 - DNA, 17 bp, Homo sapiens
cctcgcaaccctgcctg

SEQ ID NO: 926434 - DNA, 15 bp, Homo sapiens
cctcgcacacagggc

SEQ ID NO: 926435 - DNA, 20 bp, Homo sapiens
cctcgcacacagggctcaca

SEQ ID NO: 926436 - DNA, 14 bp, Homo sapiens
cctcgcacttgcag

SEQ ID NO: 926437 - DNA, 15 bp, Homo sapiens
cctcgccagcttggc

SEQ ID NO: 926438 - DNA, 20 bp, Homo sapiens
cctcgcccccaccagtgtag

SEQ ID NO: 926439 - DNA, 14 bp, Homo sapiens
cctcgccctgggtc

SEQ ID NO: 926440 - DNA, 12 bp, Homo sapiens
cctcgcctgtgg

SEQ ID NO: 926441 - DNA, 14 bp, Homo sapiens
cctcgctcaccgct

SEQ ID NO: 926442 - DNA, 20 bp, Homo sapiens
cctcgctcaccgctggccct

SEQ ID NO: 926443 - DNA, 17 bp, Homo sapiens
cctcgctcccctctgga

SEQ ID NO: 926444 - DNA, 18 bp, Homo sapiens
cctcgctcctccttccca

SEQ ID NO: 926445 - DNA, 19 bp, Homo sapiens
cctcgctcctccttcccag

SEQ ID NO: 926446 - DNA, 21 bp, Homo sapiens
cctcgctcctccttcccaggg

SEQ ID NO: 926447 - DNA, 19 bp, Homo sapiens
cctcgctgccagctctgta

SEQ ID NO: 926448 - DNA, 20 bp, Homo sapiens
cctcgctgccagctctgtat

SEQ ID NO: 926449 - DNA, 17 bp, Homo sapiens
cctcgctgctgctacta

SEQ ID NO: 926450 - DNA, 17 bp, Homo sapiens
cctcgctggactctcag

SEQ ID NO: 926451 - DNA, 23 bp, Homo sapiens
cctcgctgttggagcaaaccatt

SEQ ID NO: 926452 - DNA, 18 bp, Homo sapiens
cctcggaaatcagtgcga

SEQ ID NO: 926453 - DNA, 13 bp, Homo sapiens
cctcggactccat

SEQ ID NO: 926454 - DNA, 16 bp, Homo sapiens
cctcggactccatggc

SEQ ID NO: 926455 - DNA, 17 bp, Homo sapiens
cctcggagagcagcagc

SEQ ID NO: 926456 - DNA, 13 bp, Homo sapiens
cctcggagcctca

SEQ ID NO: 926457 - DNA, 13 bp, Homo sapiens
cctcggagcctgt

SEQ ID NO: 926458 - DNA, 14 bp, Homo sapiens
cctcggagctggct

SEQ ID NO: 926459 - DNA, 16 bp, Homo sapiens
cctcggagctggctgt

SEQ ID NO: 926460 - DNA, 19 bp, Homo sapiens
cctcggcagaactctctgt

SEQ ID NO: 926461 - DNA, 20 bp, Homo sapiens
cctcggcagaactctctgtc

SEQ ID NO: 926462 - DNA, 21 bp, Homo sapiens
cctcggcagaactctctgtct

SEQ ID NO: 926463 - DNA, 15 bp, Homo sapiens
cctcggccccaccca

SEQ ID NO: 926464 - DNA, 18 bp, Homo sapiens
cctcgggccccatcctca

SEQ ID NO: 926465 - DNA, 13 bp, Homo sapiens
cctcgggcctgct

SEQ ID NO: 926466 - DNA, 13 bp, Homo sapiens
cctcggggagagg

SEQ ID NO: 926467 - DNA, 20 bp, Homo sapiens
cctcggggagagggggaggt

SEQ ID NO: 926468 - DNA, 16 bp, Homo sapiens
cctcggggatggggag

SEQ ID NO: 926469 - DNA, 17 bp, Homo sapiens
cctcggggatggggagg

SEQ ID NO: 926470 - DNA, 17 bp, Homo sapiens
cctcgggggcctgtggt

SEQ ID NO: 926471 - DNA, 23 bp, Homo sapiens
cctcggtctcccaaagtgctggg

SEQ ID NO: 926472 - DNA, 17 bp, Homo sapiens
cctcggtggctctgggg

SEQ ID NO: 926473 - DNA, 18 bp, Homo sapiens
cctcggtggctctggggt

SEQ ID NO: 926474 - DNA, 18 bp, Homo sapiens
cctcggtgtggagaagcg

SEQ ID NO: 926475 - DNA, 14 bp, Homo sapiens
cctcgtccacaggg

SEQ ID NO: 926476 - DNA, 18 bp, Homo sapiens
cctcgtccacaggggcag

SEQ ID NO: 926477 - DNA, 14 bp, Homo sapiens
cctcgtcccatcca

SEQ ID NO: 926478 - DNA, 14 bp, Homo sapiens
cctcgtccgtctgt

SEQ ID NO: 926479 - DNA, 15 bp, Homo sapiens
cctcgtcctccccct

SEQ ID NO: 926480 - DNA, 16 bp, Homo sapiens
cctcgtcctccccctg

SEQ ID NO: 926481 - DNA, 17 bp, Homo sapiens
cctcgtcctccccctgc

SEQ ID NO: 926482 - DNA, 20 bp, Homo sapiens
cctcgtcctccccctgccag

SEQ ID NO: 926483 - DNA, 21 bp, Homo sapiens
cctcgtcctccccctgccagt

SEQ ID NO: 926484 - DNA, 16 bp, Homo sapiens
cctcgtcctgtcccag

SEQ ID NO: 926485 - DNA, 19 bp, Homo sapiens
cctcgtctccctggccacc

SEQ ID NO: 926486 - DNA, 20 bp, Homo sapiens
cctcgtctccctggtgcctc

SEQ ID NO: 926487 - DNA, 22 bp, Homo sapiens
cctcgtctccctggtgcctctg

SEQ ID NO: 926488 - DNA, 17 bp, Homo sapiens
cctcgtctcttgtgact

SEQ ID NO: 926489 - DNA, 20 bp, Homo sapiens
cctcgtctcttgtgactcag

SEQ ID NO: 926490 - DNA, 22 bp, Homo sapiens
cctcgtctgtcccttccccttc

SEQ ID NO: 926491 - DNA, 12 bp, Homo sapiens
cctcgtgccagc

SEQ ID NO: 926492 - DNA, 14 bp, Homo sapiens
cctcgtgccagcag

SEQ ID NO: 926493 - DNA, 18 bp, Homo sapiens
cctcgtgccagcagcctc

SEQ ID NO: 926494 - DNA, 17 bp, Homo sapiens
cctcgtgcctgggggag

SEQ ID NO: 926495 - DNA, 19 bp, Homo sapiens
cctcgtgcctgggggagag

SEQ ID NO: 926496 - DNA, 20 bp, Homo sapiens
cctcgtgcctgggggagaga

SEQ ID NO: 926497 - DNA, 12 bp, Homo sapiens
cctcgtgcgccc

SEQ ID NO: 926498 - DNA, 21 bp, Homo sapiens
cctcgtggagctcgcccctcc

SEQ ID NO: 926499 - DNA, 15 bp, Homo sapiens
cctcgtggccagccc

SEQ ID NO: 926500 - DNA, 22 bp, Homo sapiens
cctcgtggttattagcaaggct

SEQ ID NO: 926501 - DNA, 16 bp, Homo sapiens
cctcgtgtcagctcag

SEQ ID NO: 926502 - DNA, 13 bp, Homo sapiens
cctcgtgtccaga

SEQ ID NO: 926503 - DNA, 15 bp, Homo sapiens
cctcgttctctgggt

SEQ ID NO: 926504 - DNA, 14 bp, Homo sapiens
cctcgttgcccagc

SEQ ID NO: 926505 - DNA, 15 bp, Homo sapiens
cctcgttggaagagg

SEQ ID NO: 926506 - DNA, 21 bp, Homo sapiens
cctcgttgggccgctctgatt

SEQ ID NO: 926507 - DNA, 22 bp, Homo sapiens
cctcgttgggccgctctgattt

SEQ ID NO: 926508 - DNA, 14 bp, Homo sapiens
cctctaaagcagag

SEQ ID NO: 926509 - DNA, 13 bp, Homo sapiens
cctctcctgccta

SEQ ID NO: 926510 - DNA, 14 bp, Homo sapiens
cctctcctgcctac

SEQ ID NO: 926511 - DNA, 17 bp, Homo sapiens
cctctcctgcctactca

SEQ ID NO: 926512 - DNA, 12 bp, Homo sapiens
cctctcctgggg

SEQ ID NO: 926513 - DNA, 18 bp, Homo sapiens
cctctccttcccacaaaa

SEQ ID NO: 926514 - DNA, 11 bp, Homo sapiens
cctctccttct

SEQ ID NO: 926515 - DNA, 22 bp, Homo sapiens
cctctccttgggctcctggctg

SEQ ID NO: 926516 - DNA, 16 bp, Homo sapiens
cctctcgagcccagat

SEQ ID NO: 926517 - DNA, 21 bp, Homo sapiens
cctctcgcacaatgcatgtgc

SEQ ID NO: 926518 - DNA, 21 bp, Homo sapiens
cctctcggaaggctggctggg

SEQ ID NO: 926519 - DNA, 16 bp, Homo sapiens
cctctctaccccccac

SEQ ID NO: 926520 - DNA, 19 bp, Homo sapiens
cctctctaccccccacctt

SEQ ID NO: 926521 - DNA, 19 bp, Homo sapiens
cctctctactggagtggaa

SEQ ID NO: 926522 - DNA, 21 bp, Homo sapiens
cctctctacttccccttcttg

SEQ ID NO: 926523 - DNA, 19 bp, Homo sapiens
cctctctatcctctcttcc

SEQ ID NO: 926524 - DNA, 21 bp, Homo sapiens
cctctctatcctctcttcctc

SEQ ID NO: 926525 - DNA, 15 bp, Homo sapiens
cctctctcagcccca

SEQ ID NO: 926526 - DNA, 18 bp, Homo sapiens
cctctctcaggagcaggg

SEQ ID NO: 926527 - DNA, 18 bp, Homo sapiens
cctctctccttggccaca

SEQ ID NO: 926528 - DNA, 23 bp, Homo sapiens
cctctctccttggccacagactg

SEQ ID NO: 926529 - DNA, 16 bp, Homo sapiens
cctctctctccctccc

SEQ ID NO: 926530 - DNA, 15 bp, Homo sapiens
cctctctctcttcta

SEQ ID NO: 926531 - DNA, 18 bp, Homo sapiens
cctctctctcttctaggc

SEQ ID NO: 926532 - DNA, 13 bp, Homo sapiens
cctctctctgctc

SEQ ID NO: 926533 - DNA, 12 bp, Homo sapiens
cctctctctggg

SEQ ID NO: 926534 - DNA, 13 bp, Homo sapiens
cctctctctgggc

SEQ ID NO: 926535 - DNA, 23 bp, Homo sapiens
cctctctctgggcccaggggctg

SEQ ID NO: 926536 - DNA, 18 bp, Homo sapiens
cctctctcttctgctcca

SEQ ID NO: 926537 - DNA, 21 bp, Homo sapiens
cctctctcttctgctccaccc

SEQ ID NO: 926538 - DNA, 21 bp, Homo sapiens
cctctctgaactgcaacactg

SEQ ID NO: 926539 - DNA, 23 bp, Homo sapiens
cctctctgaagcgactctcctgt

SEQ ID NO: 926540 - DNA, 22 bp, Homo sapiens
cctctctgatcttgtgctcagc

SEQ ID NO: 926541 - DNA, 16 bp, Homo sapiens
cctctctgatgtccca

SEQ ID NO: 926542 - DNA, 19 bp, Homo sapiens
cctctctgatgtcccagtg

SEQ ID NO: 926543 - DNA, 14 bp, Homo sapiens
cctctctgcctctc

SEQ ID NO: 926544 - DNA, 12 bp, Homo sapiens
cctctctgctat

SEQ ID NO: 926545 - DNA, 14 bp, Homo sapiens
cctctctgctccag

SEQ ID NO: 926546 - DNA, 13 bp, Homo sapiens
cctctctgctcct

SEQ ID NO: 926547 - DNA, 22 bp, Homo sapiens
cctctctggaaagaggctctgg

SEQ ID NO: 926548 - DNA, 23 bp, Homo sapiens
cctctctggatactgcaaaggct

SEQ ID NO: 926549 - DNA, 16 bp, Homo sapiens
cctctctggcctccca

SEQ ID NO: 926550 - DNA, 17 bp, Homo sapiens
cctctctggcctcccac

SEQ ID NO: 926551 - DNA, 12 bp, Homo sapiens
cctctctggctg

SEQ ID NO: 926552 - DNA, 14 bp, Homo sapiens
cctctctgggacct

SEQ ID NO: 926553 - DNA, 19 bp, Homo sapiens
cctctctgggggaggcagg

SEQ ID NO: 926554 - DNA, 23 bp, Homo sapiens
cctctctgtagtttatggcagaa

SEQ ID NO: 926555 - DNA, 17 bp, Homo sapiens
cctctctgtctgtctct

SEQ ID NO: 926556 - DNA, 18 bp, Homo sapiens
cctctctgtctgtctctc

SEQ ID NO: 926557 - DNA, 20 bp, Homo sapiens
cctctcttatagaatattta

SEQ ID NO: 926558 - DNA, 20 bp, Homo sapiens
cctctcttccgggagctggt

SEQ ID NO: 926559 - DNA, 11 bp, Homo sapiens
cctctcttcct

SEQ ID NO: 926560 - DNA, 21 bp, Homo sapiens
cctctcttcgtcctgatccct

SEQ ID NO: 926561 - DNA, 23 bp, Homo sapiens
cctctcttgcacccgcctctccc

SEQ ID NO: 926562 - DNA, 21 bp, Homo sapiens
cctctcttgccccttgtcctg

SEQ ID NO: 926563 - DNA, 20 bp, Homo sapiens
cctctcttggctctactcca

SEQ ID NO: 926564 - DNA, 14 bp, Homo sapiens
cctctctttctctg

SEQ ID NO: 926565 - DNA, 15 bp, Homo sapiens
cctctctttctctgg

SEQ ID NO: 926566 - DNA, 18 bp, Homo sapiens
cctctcttttcctctctg

SEQ ID NO: 926567 - DNA, 23 bp, Homo sapiens
cctctcttttcctctctgtctgt

SEQ ID NO: 926568 - DNA, 23 bp, Homo sapiens
cctctgaaaaccaatgttctctc

SEQ ID NO: 926569 - DNA, 13 bp, Homo sapiens
cctctgaagagac

SEQ ID NO: 926570 - DNA, 20 bp, Homo sapiens
cctctgaatgaaccttctgg

SEQ ID NO: 926571 - DNA, 15 bp, Homo sapiens
cctctgacagtccac

SEQ ID NO: 926572 - DNA, 17 bp, Homo sapiens
cctctgacagtccacag

SEQ ID NO: 926573 - DNA, 18 bp, Homo sapiens
cctctgacagtccacagg

SEQ ID NO: 926574 - DNA, 19 bp, Homo sapiens
cctctgacagtccacaggg

SEQ ID NO: 926575 - DNA, 17 bp, Homo sapiens
cctctgacctgcactgg

SEQ ID NO: 926576 - DNA, 20 bp, Homo sapiens
cctctgacctgcaggccaag

SEQ ID NO: 926577 - DNA, 20 bp, Homo sapiens
cctctgacgcaccactgcca

SEQ ID NO: 926578 - DNA, 23 bp, Homo sapiens
cctctgacgcaccactgccaatg

SEQ ID NO: 926579 - DNA, 20 bp, Homo sapiens
cctctgactagtagatttct

SEQ ID NO: 926580 - DNA, 17 bp, Homo sapiens
cctctgactcagggctc

SEQ ID NO: 926581 - DNA, 19 bp, Homo sapiens
cctctgactcagggctcct

SEQ ID NO: 926582 - DNA, 21 bp, Homo sapiens
cctctgactcagggctcctgg

SEQ ID NO: 926583 - DNA, 22 bp, Homo sapiens
cctctgactcagggctcctggg

SEQ ID NO: 926584 - DNA, 22 bp, Homo sapiens
cctctgacttaagctgcctcaa

SEQ ID NO: 926585 - DNA, 20 bp, Homo sapiens
cctctgagaagctctgaaga

SEQ ID NO: 926586 - DNA, 21 bp, Homo sapiens
cctctgagatgatgcatgatg

SEQ ID NO: 926587 - DNA, 14 bp, Homo sapiens
cctctgagatgcta

SEQ ID NO: 926588 - DNA, 20 bp, Homo sapiens
cctctgagatgctaatttat

SEQ ID NO: 926589 - DNA, 23 bp, Homo sapiens
cctctgagcacatagtgtcctgc

SEQ ID NO: 926590 - DNA, 14 bp, Homo sapiens
cctctgagccgcca

SEQ ID NO: 926591 - DNA, 16 bp, Homo sapiens
cctctgaggaagaagg

SEQ ID NO: 926592 - DNA, 21 bp, Homo sapiens
cctctgaggaagcagttgggg

SEQ ID NO: 926593 - DNA, 21 bp, Homo sapiens
cctctgaggacagaggccggg

SEQ ID NO: 926594 - DNA, 18 bp, Homo sapiens
cctctgaggctggatcct

SEQ ID NO: 926595 - DNA, 15 bp, Homo sapiens
cctctgatacccaga

SEQ ID NO: 926596 - DNA, 19 bp, Homo sapiens
cctctgatacccagagcat

SEQ ID NO: 926597 - DNA, 14 bp, Homo sapiens
cctctgatacctca

SEQ ID NO: 926598 - DNA, 20 bp, Homo sapiens
cctctgatagctgtttcaaa

SEQ ID NO: 926599 - DNA, 21 bp, Homo sapiens
cctctgatcacattcttcaaa

SEQ ID NO: 926600 - DNA, 15 bp, Homo sapiens
cctctgcacaagctg

SEQ ID NO: 926601 - DNA, 17 bp, Homo sapiens
cctctgcacaagctgca

SEQ ID NO: 926602 - DNA, 20 bp, Homo sapiens
cctctgcactactgacatgt

SEQ ID NO: 926603 - DNA, 18 bp, Homo sapiens
cctctgcagcaataaagc

SEQ ID NO: 926604 - DNA, 14 bp, Homo sapiens
cctctgcagcactt

SEQ ID NO: 926605 - DNA, 16 bp, Homo sapiens
cctctgcagctgacct

SEQ ID NO: 926606 - DNA, 19 bp, Homo sapiens
cctctgcagctgacctctg

SEQ ID NO: 926607 - DNA, 12 bp, Homo sapiens
cctctgcagttt

SEQ ID NO: 926608 - DNA, 19 bp, Homo sapiens
cctctgccaaaggatgtga

SEQ ID NO: 926609 - DNA, 16 bp, Homo sapiens
cctctgccacctcccc

SEQ ID NO: 926610 - DNA, 18 bp, Homo sapiens
cctctgcccagcttgggc

SEQ ID NO: 926611 - DNA, 14 bp, Homo sapiens
cctctgccccaagc

SEQ ID NO: 926612 - DNA, 17 bp, Homo sapiens
cctctgccccaagcagc

SEQ ID NO: 926613 - DNA, 22 bp, Homo sapiens
cctctgccccaagcagccagcc

SEQ ID NO: 926614 - DNA, 17 bp, Homo sapiens
cctctgccctgcctccc

SEQ ID NO: 926615 - DNA, 18 bp, Homo sapiens
cctctgccctgcctccct

SEQ ID NO: 926616 - DNA, 19 bp, Homo sapiens
cctctgcccttcccctccc

SEQ ID NO: 926617 - DNA, 22 bp, Homo sapiens
cctctgccgctgcttccaggct

SEQ ID NO: 926618 - DNA, 19 bp, Homo sapiens
cctctgccggtcgggcagc

SEQ ID NO: 926619 - DNA, 22 bp, Homo sapiens
cctctgccggtcgggcagccag

SEQ ID NO: 926620 - DNA, 23 bp, Homo sapiens
cctctgccggtcgggcagccagc

SEQ ID NO: 926621 - DNA, 15 bp, Homo sapiens
cctctgcctgcactc

SEQ ID NO: 926622 - DNA, 18 bp, Homo sapiens
cctctgcctgcactccct

SEQ ID NO: 926623 - DNA, 13 bp, Homo sapiens
cctctgcctgccc

SEQ ID NO: 926624 - DNA, 21 bp, Homo sapiens
cctctgcctgccccgccccca

SEQ ID NO: 926625 - DNA, 17 bp, Homo sapiens
cctctgcctgtccctct

SEQ ID NO: 926626 - DNA, 21 bp, Homo sapiens
cctctgctacgttcctattgt

SEQ ID NO: 926627 - DNA, 13 bp, Homo sapiens
cctctgctcaccg

SEQ ID NO: 926628 - DNA, 16 bp, Homo sapiens
cctctgctcaggcctc

SEQ ID NO: 926629 - DNA, 15 bp, Homo sapiens
gatttctctgaacag

SEQ ID NO: 926630 - DNA, 19 bp, Homo sapiens
cctcttgagttcctctgca

SEQ ID NO: 926631 - DNA, 22 bp, Homo sapiens
cctcttgccactgcctcttcct

SEQ ID NO: 926632 - DNA, 19 bp, Homo sapiens
cctcttgccagcctccttg

SEQ ID NO: 926633 - DNA, 13 bp, Homo sapiens
cctcttgccatcc

SEQ ID NO: 926634 - DNA, 14 bp, Homo sapiens
cctcttgccatcct

SEQ ID NO: 926635 - DNA, 18 bp, Homo sapiens
gcaaaaaattctttagag

SEQ ID NO: 926636 - DNA, 22 bp, Homo sapiens
gcaaaaatgtccagccaccccc

SEQ ID NO: 926637 - DNA, 22 bp, Homo sapiens
gcaaaacaaaaccctcagcact

SEQ ID NO: 926638 - DNA, 16 bp, Homo sapiens
gcaaaaccattgcttc

SEQ ID NO: 926639 - DNA, 17 bp, Homo sapiens
gcaaaaccattgcttca

SEQ ID NO: 926640 - DNA, 15 bp, Homo sapiens
gcaaaaccttttact

SEQ ID NO: 926641 - DNA, 19 bp, Homo sapiens
gcaaaactcccaatggata

SEQ ID NO: 926642 - DNA, 11 bp, Homo sapiens
gcaaaactgtg

SEQ ID NO: 926643 - DNA, 12 bp, Homo sapiens
gcaaaagaaaaa

SEQ ID NO: 926644 - DNA, 14 bp, Homo sapiens
gcaaaagaaactat

SEQ ID NO: 926645 - DNA, 10 bp, Homo sapiens
gcaaaagact

SEQ ID NO: 926646 - DNA, 23 bp, Homo sapiens
gcaaaagagggtttattttcagt

SEQ ID NO: 926647 - DNA, 15 bp, Homo sapiens
gcaaaagatgcttct

SEQ ID NO: 926648 - DNA, 22 bp, Homo sapiens
gcaaaagatgcttctcactgcc

SEQ ID NO: 926649 - DNA, 21 bp, Homo sapiens
gcaaaaggatctttgtggcca

SEQ ID NO: 926650 - DNA, 23 bp, Homo sapiens
gcaaaaggatctttgtggccaag

SEQ ID NO: 926651 - DNA, 12 bp, Homo sapiens
gcaaaaggcagc

SEQ ID NO: 926652 - DNA, 13 bp, Homo sapiens
gcaaaaggcagct

SEQ ID NO: 926653 - DNA, 20 bp, Homo sapiens
gcaaaaggccctctggaggg

SEQ ID NO: 926654 - DNA, 16 bp, Homo sapiens
gcaaaaggcctcttgt

SEQ ID NO: 926655 - DNA, 17 bp, Homo sapiens
gcaaaaggcctcttgta

SEQ ID NO: 926656 - DNA, 19 bp, Homo sapiens
gcaaaaggctgattactga

SEQ ID NO: 926657 - DNA, 21 bp, Homo sapiens
gcaaaaggttcactaaagcag

SEQ ID NO: 926658 - DNA, 23 bp, Homo sapiens
gcaaaagtcagcgtgacaatata

SEQ ID NO: 926659 - DNA, 21 bp, Homo sapiens
gcaaaagtggggctaaatgaa

SEQ ID NO: 926660 - DNA, 13 bp, Homo sapiens
gcaaaataaaaca

SEQ ID NO: 926661 - DNA, 21 bp, Homo sapiens
gcaaaataaaacatagcaaat

SEQ ID NO: 926662 - DNA, 13 bp, Homo sapiens
gcaaaataatttt

SEQ ID NO: 926663 - DNA, 15 bp, Homo sapiens
gcaaaataattttaa

SEQ ID NO: 926664 - DNA, 14 bp, Homo sapiens
gcaaaatacatgaa

SEQ ID NO: 926665 - DNA, 10 bp, Homo sapiens
gcaaaatatg

SEQ ID NO: 926666 - DNA, 18 bp, Homo sapiens
gcaaaatatgccccttct

SEQ ID NO: 926667 - DNA, 16 bp, Homo sapiens
gcaaaatcaacatgac

SEQ ID NO: 926668 - DNA, 15 bp, Homo sapiens
gcaaaatcaggaaag

SEQ ID NO: 926669 - DNA, 12 bp, Homo sapiens
gcaaaattaaat

SEQ ID NO: 926670 - DNA, 14 bp, Homo sapiens
gcaaaattaaatct

SEQ ID NO: 926671 - DNA, 21 bp, Homo sapiens
gcaaaatttgatgccaggaca

SEQ ID NO: 926672 - DNA, 18 bp, Homo sapiens
gcaaacaacctgaatctt

SEQ ID NO: 926673 - DNA, 15 bp, Homo sapiens
gcaaacaatcccaat

SEQ ID NO: 926674 - DNA, 24 bp, Homo sapiens
gcaaacaatgaagaattatgtaat

SEQ ID NO: 926675 - DNA, 16 bp, Homo sapiens
gcaaacaatggtgtct

SEQ ID NO: 926676 - DNA, 13 bp, Homo sapiens
gcaaacatcaaat

SEQ ID NO: 926677 - DNA, 21 bp, Homo sapiens
gcaaaccaatggtgatcctct

SEQ ID NO: 926678 - DNA, 17 bp, Homo sapiens
gcaaaccacactggact

SEQ ID NO: 926679 - DNA, 22 bp, Homo sapiens
gcaaaccacactggactccggc

SEQ ID NO: 926680 - DNA, 14 bp, Homo sapiens
gcaaaccacttctc

SEQ ID NO: 926681 - DNA, 17 bp, Homo sapiens
gcaaaccattatacctt

SEQ ID NO: 926682 - DNA, 20 bp, Homo sapiens
gcaaaccctcccagaaacat

SEQ ID NO: 926683 - DNA, 23 bp, Homo sapiens
gcaaaccctcccagaaacatctc

SEQ ID NO: 926684 - DNA, 21 bp, Homo sapiens
gcaaacctgacccctgctcag

SEQ ID NO: 926685 - DNA, 22 bp, Homo sapiens
gcaaacggcaacgtagcctggg

SEQ ID NO: 926686 - DNA, 15 bp, Homo sapiens
gcaaactgatgctga

SEQ ID NO: 926687 - DNA, 22 bp, Homo sapiens
gcaaagaaagtgggaggtcagg

SEQ ID NO: 926688 - DNA, 23 bp, Homo sapiens
gcaaagaaagtgggaggtcagga

SEQ ID NO: 926689 - DNA, 17 bp, Homo sapiens
gcaaagaaggagctgag

SEQ ID NO: 926690 - DNA, 20 bp, Homo sapiens
gcaaagacaaaagaaactta

SEQ ID NO: 926691 - DNA, 14 bp, Homo sapiens
gcaaagactctgag

SEQ ID NO: 926692 - DNA, 17 bp, Homo sapiens
gcaaagactctgagcca

SEQ ID NO: 926693 - DNA, 16 bp, Homo sapiens
gcaaagagctcccgag

SEQ ID NO: 926694 - DNA, 12 bp, Homo sapiens
gcaaagaggggc

SEQ ID NO: 926695 - DNA, 20 bp, Homo sapiens
gcaaagaggggcgctgtcct

SEQ ID NO: 926696 - DNA, 16 bp, Homo sapiens
gcaaagatcaaaataa

SEQ ID NO: 926697 - DNA, 21 bp, Homo sapiens
gcaaagatggtggctgtgtct

SEQ ID NO: 926698 - DNA, 22 bp, Homo sapiens
gcaaagatggtggctgtgtctc

SEQ ID NO: 926699 - DNA, 14 bp, Homo sapiens
gcaaagatttcagt

SEQ ID NO: 926700 - DNA, 22 bp, Homo sapiens
gcaaagcaccagcttctccagg

SEQ ID NO: 926701 - DNA, 17 bp, Homo sapiens
gcaaagcactctctgca

SEQ ID NO: 926702 - DNA, 19 bp, Homo sapiens
gcaaagccacaaggctggc

SEQ ID NO: 926703 - DNA, 23 bp, Homo sapiens
gcaaagccacaaggctggccagc

SEQ ID NO: 926704 - DNA, 16 bp, Homo sapiens
gcaaagcgacagattc

SEQ ID NO: 926705 - DNA, 17 bp, Homo sapiens
gcaaagctaaaataaaa

SEQ ID NO: 926706 - DNA, 17 bp, Homo sapiens
gcaaagctttggctgag

SEQ ID NO: 926707 - DNA, 20 bp, Homo sapiens
gcaaagctttggctgagacc

SEQ ID NO: 926708 - DNA, 20 bp, Homo sapiens
gcaaaggaaggtggatggcc

SEQ ID NO: 926709 - DNA, 23 bp, Homo sapiens
gcaaaggactgttttttcctgag

SEQ ID NO: 926710 - DNA, 12 bp, Homo sapiens
gcaaaggagaca

SEQ ID NO: 926711 - DNA, 18 bp, Homo sapiens
gcaaaggagacaaagcag

SEQ ID NO: 926712 - DNA, 20 bp, Homo sapiens
gcaaaggagacaaagcagga

SEQ ID NO: 926713 - DNA, 14 bp, Homo sapiens
gcaaaggcagggcc

SEQ ID NO: 926714 - DNA, 17 bp, Homo sapiens
gcaaaggcccatgcccc

SEQ ID NO: 926715 - DNA, 12 bp, Homo sapiens
gcaaaggccctt

SEQ ID NO: 926716 - DNA, 14 bp, Homo sapiens
gcaaaggcccttgt

SEQ ID NO: 926717 - DNA, 18 bp, Homo sapiens
gcaaaggcccttgtcatt

SEQ ID NO: 926718 - DNA, 15 bp, Homo sapiens
gcaaaggcctgggct

SEQ ID NO: 926719 - DNA, 20 bp, Homo sapiens
gcaaagggagcactgggttg

SEQ ID NO: 926720 - DNA, 13 bp, Homo sapiens
gcaaaggggacag

SEQ ID NO: 926721 - DNA, 20 bp, Homo sapiens
gcaaaggggctgaaagaaca

SEQ ID NO: 926722 - DNA, 14 bp, Homo sapiens
gcaaaggggggagg

SEQ ID NO: 926723 - DNA, 17 bp, Homo sapiens
gcaaaggtcttgaatag

SEQ ID NO: 926724 - DNA, 14 bp, Homo sapiens
gcaaaggtgcctca

SEQ ID NO: 926725 - DNA, 18 bp, Homo sapiens
gcaaaggtggctctccag

SEQ ID NO: 926726 - DNA, 18 bp, Homo sapiens
gcaaaggtgtgcttcctg

SEQ ID NO: 926727 - DNA, 21 bp, Homo sapiens
gcaaagtattgtaaattatat

SEQ ID NO: 926728 - DNA, 23 bp, Homo sapiens
gcaaagttccctacttcctgtga

SEQ ID NO: 926729 - DNA, 16 bp, Homo sapiens
gcaaataaagcctttt

SEQ ID NO: 926730 - DNA, 21 bp, Homo sapiens
gcaaataagtgtattttgaaa

SEQ ID NO: 926731 - DNA, 18 bp, Homo sapiens
gcaaataatggaaaaata

SEQ ID NO: 926732 - DNA, 19 bp, Homo sapiens
gcaaataatttcctggtgt

SEQ ID NO: 926733 - DNA, 21 bp, Homo sapiens
gcaaatagaaaacaggaaaaa

SEQ ID NO: 926734 - DNA, 17 bp, Homo sapiens
gcaaatataagctggga

SEQ ID NO: 926735 - DNA, 19 bp, Homo sapiens
gcaaatataagctgggaaa

SEQ ID NO: 926736 - DNA, 20 bp, Homo sapiens
gcaaatatcatactgttcaa

SEQ ID NO: 926737 - DNA, 18 bp, Homo sapiens
gcaaatattgaagttgtt

SEQ ID NO: 926738 - DNA, 15 bp, Homo sapiens
gcaaatcagaaactt

SEQ ID NO: 926739 - DNA, 13 bp, Homo sapiens
gcaaatcaggggc

SEQ ID NO: 926740 - DNA, 15 bp, Homo sapiens
gcaaatcaggggcca

SEQ ID NO: 926741 - DNA, 17 bp, Homo sapiens
gcaaatcaggggccaga

SEQ ID NO: 926742 - DNA, 12 bp, Homo sapiens
gcaaatcttgaa

SEQ ID NO: 926743 - DNA, 20 bp, Homo sapiens
gcaaatctttctgtaaacag

SEQ ID NO: 926744 - DNA, 12 bp, Homo sapiens
gcaaatgaatca

SEQ ID NO: 926745 - DNA, 15 bp, Homo sapiens
gcaaatgaatcattg

SEQ ID NO: 926746 - DNA, 16 bp, Homo sapiens
gcaaatgaatcattgt

SEQ ID NO: 926747 - DNA, 20 bp, Homo sapiens
gcaaatggcagttttaatct

SEQ ID NO: 926748 - DNA, 14 bp, Homo sapiens
gcaaatggcctcat

SEQ ID NO: 926749 - DNA, 12 bp, Homo sapiens
gcaaatgggagc

SEQ ID NO: 926750 - DNA, 22 bp, Homo sapiens
gcaaattaaaacatatttcatt

SEQ ID NO: 926751 - DNA, 15 bp, Homo sapiens
gcaaattaactgtat

SEQ ID NO: 926752 - DNA, 22 bp, Homo sapiens
gcaagctgccgaaccaaaagaa

SEQ ID NO: 926753 - DNA, 20 bp, Homo sapiens
gcaagcttacacaagaagtg

SEQ ID NO: 926754 - DNA, 14 bp, Homo sapiens
gcaaggaaggactt

SEQ ID NO: 926755 - DNA, 15 bp, Homo sapiens
gcaaggaccaggact

SEQ ID NO: 926756 - DNA, 20 bp, Homo sapiens
gcaaggaccaggactccctc

SEQ ID NO: 926757 - DNA, 22 bp, Homo sapiens
gcaaggactacgttaagggaag

SEQ ID NO: 926758 - DNA, 14 bp, Homo sapiens
gcaaggactttgta

SEQ ID NO: 926759 - DNA, 19 bp, Homo sapiens
gcaaggactttgtacattt

SEQ ID NO: 926760 - DNA, 23 bp, Homo sapiens
gcaaggagtttattacaatgtat

SEQ ID NO: 926761 - DNA, 20 bp, Homo sapiens
gcaaggcaggtgcctccagg

SEQ ID NO: 926762 - DNA, 22 bp, Homo sapiens
gcaaggcaggtgcctccaggtg

SEQ ID NO: 926763 - DNA, 20 bp, Homo sapiens
gcaaggcctctcagacccag

SEQ ID NO: 926764 - DNA, 20 bp, Homo sapiens
gcaaggcctggtgtttcttg

SEQ ID NO: 926765 - DNA, 18 bp, Homo sapiens
cctgacacaccaggcgct

SEQ ID NO: 926766 - DNA, 23 bp, Homo sapiens
cctgacacagtgctcgaccttga

SEQ ID NO: 926767 - DNA, 15 bp, Homo sapiens
cctgacaccccctcc

SEQ ID NO: 926768 - DNA, 18 bp, Homo sapiens
cctgacaccccctccccg

SEQ ID NO: 926769 - DNA, 19 bp, Homo sapiens
cctgacactgagccccacc

SEQ ID NO: 926770 - DNA, 13 bp, Homo sapiens
cctgacactttaa

SEQ ID NO: 926771 - DNA, 15 bp, Homo sapiens
cctgacagaaggtgc

SEQ ID NO: 926772 - DNA, 20 bp, Homo sapiens
cctgacagatgtcagccgag

SEQ ID NO: 926773 - DNA, 13 bp, Homo sapiens
cctgacattgtct

SEQ ID NO: 926774 - DNA, 19 bp, Homo sapiens
cctgaccaacatggagaaa

SEQ ID NO: 926775 - DNA, 13 bp, Homo sapiens
cctgaccaccctc

SEQ ID NO: 926776 - DNA, 14 bp, Homo sapiens
cctgaccaccctcc

SEQ ID NO: 926777 - DNA, 15 bp, Homo sapiens
cctgaccagctgctc

SEQ ID NO: 926778 - DNA, 20 bp, Homo sapiens
cctgaccagctgctccgagg

SEQ ID NO: 926779 - DNA, 13 bp, Homo sapiens
cctgacccaacac

SEQ ID NO: 926780 - DNA, 14 bp, Homo sapiens
cctgacccaggccg

SEQ ID NO: 926781 - DNA, 19 bp, Homo sapiens
cctgacccaggccgcagct

SEQ ID NO: 926782 - DNA, 12 bp, Homo sapiens
cctgaccctccc

SEQ ID NO: 926783 - DNA, 23 bp, Homo sapiens
cctgaccctcccggcctggcttc

SEQ ID NO: 926784 - DNA, 17 bp, Homo sapiens
cctgaccctgtatatag

SEQ ID NO: 926785 - DNA, 19 bp, Homo sapiens
cctgaccctgtatatagcc

SEQ ID NO: 926786 - DNA, 21 bp, Homo sapiens
cctgacccttctctcacttct

SEQ ID NO: 926787 - DNA, 14 bp, Homo sapiens
cctgacctccatat

SEQ ID NO: 926788 - DNA, 15 bp, Homo sapiens
cctgacctccatatg

SEQ ID NO: 926789 - DNA, 13 bp, Homo sapiens
cctgacctcccag

SEQ ID NO: 926790 - DNA, 15 bp, Homo sapiens
cctgacctcccagcc

SEQ ID NO: 926791 - DNA, 18 bp, Homo sapiens
cctgacctcccagcccta

SEQ ID NO: 926792 - DNA, 14 bp, Homo sapiens
cctgacctcttgct

SEQ ID NO: 926793 - DNA, 16 bp, Homo sapiens
cctgacctcttgctgt

SEQ ID NO: 926794 - DNA, 20 bp, Homo sapiens
cctgacctcttgctgtctct

SEQ ID NO: 926795 - DNA, 13 bp, Homo sapiens
cctgacctgcggg

SEQ ID NO: 926796 - DNA, 17 bp, Homo sapiens
cctgacctgctgaattg

SEQ ID NO: 926797 - DNA, 14 bp, Homo sapiens
cctgacctgtccag

SEQ ID NO: 926798 - DNA, 18 bp, Homo sapiens
cctgacgccctgcgttgg

SEQ ID NO: 926799 - DNA, 19 bp, Homo sapiens
cctgacggcgcccccagtg

SEQ ID NO: 926800 - DNA, 20 bp, Homo sapiens
cctgactcctctaagccact

SEQ ID NO: 926801 - DNA, 17 bp, Homo sapiens
cctgactcctctggctt

SEQ ID NO: 926802 - DNA, 19 bp, Homo sapiens
cctgactcctctggctttc

SEQ ID NO: 926803 - DNA, 17 bp, Homo sapiens
cctgactcctggactcc

SEQ ID NO: 926804 - DNA, 18 bp, Homo sapiens
cctgactctgaaatctga

SEQ ID NO: 926805 - DNA, 15 bp, Homo sapiens
cctgactgccaggac

SEQ ID NO: 926806 - DNA, 21 bp, Homo sapiens
cctgactgcccgctcctcggg

SEQ ID NO: 926807 - DNA, 20 bp, Homo sapiens
cctgactggttgtcagaatg

SEQ ID NO: 926808 - DNA, 23 bp, Homo sapiens
cctgactggttgtcagaatggaa

SEQ ID NO: 926809 - DNA, 16 bp, Homo sapiens
cctgactgtcagggag

SEQ ID NO: 926810 - DNA, 14 bp, Homo sapiens
cctgacttctcccc

SEQ ID NO: 926811 - DNA, 13 bp, Homo sapiens
cctgacttctgga

SEQ ID NO: 926812 - DNA, 16 bp, Homo sapiens
cctgacttctggagat

SEQ ID NO: 926813 - DNA, 15 bp, Homo sapiens
cctgacttgagccac

SEQ ID NO: 926814 - DNA, 17 bp, Homo sapiens
cctgacttgagccactc

SEQ ID NO: 926815 - DNA, 14 bp, Homo sapiens
cctgacttgcttta

SEQ ID NO: 926816 - DNA, 24 bp, Homo sapiens
cctgacttggctggggaggaccag

SEQ ID NO: 926817 - DNA, 22 bp, Homo sapiens
cctgactttgcccccttgccca

SEQ ID NO: 926818 - DNA, 15 bp, Homo sapiens
cctgagaaagcccac

SEQ ID NO: 926819 - DNA, 18 bp, Homo sapiens
cctgagaaagcccacctg

SEQ ID NO: 926820 - DNA, 14 bp, Homo sapiens
cctgagaaatgtta

SEQ ID NO: 926821 - DNA, 19 bp, Homo sapiens
cctgagaagaagtggctgc

SEQ ID NO: 926822 - DNA, 23 bp, Homo sapiens
cctgagaagaagtggctgccaca

SEQ ID NO: 926823 - DNA, 22 bp, Homo sapiens
cctgagaagctgctccaggcct

SEQ ID NO: 926824 - DNA, 22 bp, Homo sapiens
cctgagaataagaaagtttcac

SEQ ID NO: 926825 - DNA, 13 bp, Homo sapiens
cctgagacagcac

SEQ ID NO: 926826 - DNA, 16 bp, Homo sapiens
cctgagacagcaccac

SEQ ID NO: 926827 - DNA, 22 bp, Homo sapiens
cctgagacagcaccactgctga

SEQ ID NO: 926828 - DNA, 22 bp, Homo sapiens
cctgagaccagttgggagcact

SEQ ID NO: 926829 - DNA, 18 bp, Homo sapiens
cctgagaccctactgaag

SEQ ID NO: 926830 - DNA, 19 bp, Homo sapiens
cctgagaccctactgaagt

SEQ ID NO: 926831 - DNA, 20 bp, Homo sapiens
cctgagaccctgggagagaa

SEQ ID NO: 926832 - DNA, 21 bp, Homo sapiens
cctgagaccctgggagagaag

SEQ ID NO: 926833 - DNA, 21 bp, Homo sapiens
cctgagactcacactctctgc

SEQ ID NO: 926834 - DNA, 23 bp, Homo sapiens
cctgagactccagaatctgctgt

SEQ ID NO: 926835 - DNA, 18 bp, Homo sapiens
cctgagagaattggctca

SEQ ID NO: 926836 - DNA, 21 bp, Homo sapiens
cctgagagagaatagagctgc

SEQ ID NO: 926837 - DNA, 23 bp, Homo sapiens
cctgagagagaatagagctgcca

SEQ ID NO: 926838 - DNA, 12 bp, Homo sapiens
cctgagagctgc

SEQ ID NO: 926839 - DNA, 18 bp, Homo sapiens
cctgagagctgcatgtgt

SEQ ID NO: 926840 - DNA, 12 bp, Homo sapiens
cctgagaggcag

SEQ ID NO: 926841 - DNA, 14 bp, Homo sapiens
cctgagaggcaggc

SEQ ID NO: 926842 - DNA, 15 bp, Homo sapiens
cctgagaggggaagc

SEQ ID NO: 926843 - DNA, 20 bp, Homo sapiens
cctgagagtcagctctctgc

SEQ ID NO: 926844 - DNA, 23 bp, Homo sapiens
cctgagagtcagctctctgccct

SEQ ID NO: 926845 - DNA, 18 bp, Homo sapiens
cctgagagtttcctcaga

SEQ ID NO: 926846 - DNA, 19 bp, Homo sapiens
cctgagagtttcctcagaa

SEQ ID NO: 926847 - DNA, 18 bp, Homo sapiens
cctgagatcccctgagcc

SEQ ID NO: 926848 - DNA, 21 bp, Homo sapiens
cctgagcaacagagtgagacc

SEQ ID NO: 926849 - DNA, 19 bp, Homo sapiens
cctgagcaatgtctgtgct

SEQ ID NO: 926850 - DNA, 20 bp, Homo sapiens
cctgagcaatgtctgtgcta

SEQ ID NO: 926851 - DNA, 23 bp, Homo sapiens
cctgagcagaatactggtctcag

SEQ ID NO: 926852 - DNA, 12 bp, Homo sapiens
cctgagcagggc

SEQ ID NO: 926853 - DNA, 17 bp, Homo sapiens
cctgagcattcaggcag

SEQ ID NO: 926854 - DNA, 21 bp, Homo sapiens
cctgagcccaaccaggccctg

SEQ ID NO: 926855 - DNA, 16 bp, Homo sapiens
cctgagcccgcagccc

SEQ ID NO: 926856 - DNA, 21 bp, Homo sapiens
cctgagcccgcagcccagacc

SEQ ID NO: 926857 - DNA, 19 bp, Homo sapiens
cctgagccctactccctgc

SEQ ID NO: 926858 - DNA, 19 bp, Homo sapiens
cctgagcggaggctcggcc

SEQ ID NO: 926859 - DNA, 16 bp, Homo sapiens
cctgagcgtcctccat

SEQ ID NO: 926860 - DNA, 18 bp, Homo sapiens
cctgagctaggaagagtc

SEQ ID NO: 926861 - DNA, 17 bp, Homo sapiens
cctgagctattttcctc

SEQ ID NO: 926862 - DNA, 16 bp, Homo sapiens
cctgagctcacagagt

SEQ ID NO: 926863 - DNA, 20 bp, Homo sapiens
cctgagctcggtggacccag

SEQ ID NO: 926864 - DNA, 18 bp, Homo sapiens
cctgagctgaggcagcag

SEQ ID NO: 926865 - DNA, 14 bp, Homo sapiens
cctgagctggcctg

SEQ ID NO: 926866 - DNA, 16 bp, Homo sapiens
cctgagctggggaagc

SEQ ID NO: 926867 - DNA, 18 bp, Homo sapiens
cctgagcttggccagaag

SEQ ID NO: 926868 - DNA, 21 bp, Homo sapiens
cctgagcttggccagaagggg

SEQ ID NO: 926869 - DNA, 18 bp, Homo sapiens
cctgaggaacccttacag

SEQ ID NO: 926870 - DNA, 12 bp, Homo sapiens
cctgaggaatga

SEQ ID NO: 926871 - DNA, 15 bp, Homo sapiens
cctgaggacagctgt

SEQ ID NO: 926872 - DNA, 23 bp, Homo sapiens
cctgaggactgatttcagagtga

SEQ ID NO: 926873 - DNA, 22 bp, Homo sapiens
gcaattaaacttccaaagaaag

SEQ ID NO: 926874 - DNA, 19 bp, Homo sapiens
gcaattatatctattatgt

SEQ ID NO: 926875 - DNA, 12 bp, Homo sapiens
gcaattatgaaa

SEQ ID NO: 926876 - DNA, 16 bp, Homo sapiens
gcaattatgaaaataa

SEQ ID NO: 926877 - DNA, 19 bp, Homo sapiens
gcaattatgaaaataatct

SEQ ID NO: 926878 - DNA, 14 bp, Homo sapiens
gcaattatttaaag

SEQ ID NO: 926879 - DNA, 16 bp, Homo sapiens
gcaattcatgtaacag

SEQ ID NO: 926880 - DNA, 18 bp, Homo sapiens
gcaattcatgtaacagtt

SEQ ID NO: 926881 - DNA, 15 bp, Homo sapiens
gcaattccagaaatc

SEQ ID NO: 926882 - DNA, 13 bp, Homo sapiens
gcaattctgactg

SEQ ID NO: 926883 - DNA, 15 bp, Homo sapiens
gcaattctgactgtc

SEQ ID NO: 926884 - DNA, 16 bp, Homo sapiens
gcaattctggaagctg

SEQ ID NO: 926885 - DNA, 14 bp, Homo sapiens
gcaattgccctgta

SEQ ID NO: 926886 - DNA, 13 bp, Homo sapiens
gcaattgtctatt

SEQ ID NO: 926887 - DNA, 22 bp, Homo sapiens
gcaattgtctatttatctttta

SEQ ID NO: 926888 - DNA, 13 bp, Homo sapiens
gcaatttaaatgt

SEQ ID NO: 926889 - DNA, 17 bp, Homo sapiens
gcaatttaacaatgtct

SEQ ID NO: 926890 - DNA, 19 bp, Homo sapiens
gcaatttacctggtactaa

SEQ ID NO: 926891 - DNA, 19 bp, Homo sapiens
gcaatttatacaatatcat

SEQ ID NO: 926892 - DNA, 14 bp, Homo sapiens
cctgaggcttatct

SEQ ID NO: 926893 - DNA, 22 bp, Homo sapiens
cctgaggctttggatttgacat

SEQ ID NO: 926894 - DNA, 12 bp, Homo sapiens
cctgagggcagt

SEQ ID NO: 926895 - DNA, 15 bp, Homo sapiens
cctgagggctccatg

SEQ ID NO: 926896 - DNA, 23 bp, Homo sapiens
cctgaggggcatctgcccctccc

SEQ ID NO: 926897 - DNA, 16 bp, Homo sapiens
cctgaggggctgggct

SEQ ID NO: 926898 - DNA, 13 bp, Homo sapiens
cctgagggtggag

SEQ ID NO: 926899 - DNA, 20 bp, Homo sapiens
cctgaggtcagggagtgctg

SEQ ID NO: 926900 - DNA, 14 bp, Homo sapiens
cctgaggtcccctc

SEQ ID NO: 926901 - DNA, 20 bp, Homo sapiens
cctgaggtgaaagggagcta

SEQ ID NO: 926902 - DNA, 17 bp, Homo sapiens
cctgaggtgggcccagg

SEQ ID NO: 926903 - DNA, 18 bp, Homo sapiens
cctgaggtgggcccagga

SEQ ID NO: 926904 - DNA, 19 bp, Homo sapiens
cctgaggtgggcccaggac

SEQ ID NO: 926905 - DNA, 18 bp, Homo sapiens
cctgaggtgggctggggc

SEQ ID NO: 926906 - DNA, 23 bp, Homo sapiens
cctgagtaccttctacaggcccg

SEQ ID NO: 926907 - DNA, 14 bp, Homo sapiens
cctgagtagctggg

SEQ ID NO: 926908 - DNA, 15 bp, Homo sapiens
cctgagtagctgggc

SEQ ID NO: 926909 - DNA, 16 bp, Homo sapiens
cctgagtagctgggcc

SEQ ID NO: 926910 - DNA, 17 bp, Homo sapiens
cctgagtcaactggagc

SEQ ID NO: 926911 - DNA, 18 bp, Homo sapiens
cctgagtcaactggagca

SEQ ID NO: 926912 - DNA, 14 bp, Homo sapiens
cctgagtcaccagg

SEQ ID NO: 926913 - DNA, 12 bp, Homo sapiens
cctgagtcagtg

SEQ ID NO: 926914 - DNA, 13 bp, Homo sapiens
cctgagtcagtgc

SEQ ID NO: 926915 - DNA, 21 bp, Homo sapiens
cctgagtcagtgctctcagct

SEQ ID NO: 926916 - DNA, 23 bp, Homo sapiens
cctgagtccaagagggtccttta

SEQ ID NO: 926917 - DNA, 14 bp, Homo sapiens
cctgagtccgcctg

SEQ ID NO: 926918 - DNA, 19 bp, Homo sapiens
cctgagtcggccccacatg

SEQ ID NO: 926919 - DNA, 21 bp, Homo sapiens
cctgagtcggccccacatggg

SEQ ID NO: 926920 - DNA, 22 bp, Homo sapiens
cctgagtcggccccacatggga

SEQ ID NO: 926921 - DNA, 19 bp, Homo sapiens
cctgagtcgtacagaaagc

SEQ ID NO: 926922 - DNA, 15 bp, Homo sapiens
cctgagtctggacct

SEQ ID NO: 926923 - DNA, 14 bp, Homo sapiens
cctgagtgcgggct

SEQ ID NO: 926924 - DNA, 21 bp, Homo sapiens
cctgagtgcgggctgaggcca

SEQ ID NO: 926925 - DNA, 22 bp, Homo sapiens
cctgagtgcgggctgaggccag

SEQ ID NO: 926926 - DNA, 14 bp, Homo sapiens
cctgagtgcgtgga

SEQ ID NO: 926927 - DNA, 14 bp, Homo sapiens
cctgagtggatctc

SEQ ID NO: 926928 - DNA, 19 bp, Homo sapiens
cctgagtggatctccaagg

SEQ ID NO: 926929 - DNA, 14 bp, Homo sapiens
cctgagtggtcact

SEQ ID NO: 926930 - DNA, 16 bp, Homo sapiens
cctgagtggtcactgg

SEQ ID NO: 926931 - DNA, 17 bp, Homo sapiens
cctgagtggtcactggt

SEQ ID NO: 926932 - DNA, 21 bp, Homo sapiens
cctgagtggtcactggtcagg

SEQ ID NO: 926933 - DNA, 22 bp, Homo sapiens
cctgagtggtcactggtcaggg

SEQ ID NO: 926934 - DNA, 19 bp, Homo sapiens
cctgagttgggcagccagg

SEQ ID NO: 926935 - DNA, 24 bp, Homo sapiens
cctgagttgggcagccaggagtgc

SEQ ID NO: 926936 - DNA, 17 bp, Homo sapiens
cctgagtttccagcctg

SEQ ID NO: 926937 - DNA, 16 bp, Homo sapiens
cctgagtttgggagag

SEQ ID NO: 926938 - DNA, 17 bp, Homo sapiens
cctgagtttgggagagt

SEQ ID NO: 926939 - DNA, 17 bp, Homo sapiens
cctgataaagcacagct

SEQ ID NO: 926940 - DNA, 19 bp, Homo sapiens
cctgataacaagcaaggat

SEQ ID NO: 926941 - DNA, 17 bp, Homo sapiens
cctgataataattgatc

SEQ ID NO: 926942 - DNA, 18 bp, Homo sapiens
cctgatcagaccacggct

SEQ ID NO: 926943 - DNA, 20 bp, Homo sapiens
cctgatcattacatggctgt

SEQ ID NO: 926944 - DNA, 22 bp, Homo sapiens
cctgatcattacatggctgtgg

SEQ ID NO: 926945 - DNA, 13 bp, Homo sapiens
cctgatcccagac

SEQ ID NO: 926946 - DNA, 21 bp, Homo sapiens
cctgatcccattttcctctga

SEQ ID NO: 926947 - DNA, 20 bp, Homo sapiens
cctgatccctccacccccat

SEQ ID NO: 926948 - DNA, 21 bp, Homo sapiens
cctgatccctgaacccctggc

SEQ ID NO: 926949 - DNA, 22 bp, Homo sapiens
cctgatccgtccgaggctgctt

SEQ ID NO: 926950 - DNA, 20 bp, Homo sapiens
cctgatctctgacctctgct

SEQ ID NO: 926951 - DNA, 16 bp, Homo sapiens
cctgatctcttcctgt

SEQ ID NO: 926952 - DNA, 17 bp, Homo sapiens
cctgatctcttcctgtt

SEQ ID NO: 926953 - DNA, 16 bp, Homo sapiens
cctgatgacagagcga

SEQ ID NO: 926954 - DNA, 21 bp, Homo sapiens
cctgatgccataaatacaaga

SEQ ID NO: 926955 - DNA, 16 bp, Homo sapiens
cctgatgcccctgaca

SEQ ID NO: 926956 - DNA, 14 bp, Homo sapiens
cctgatgctccctc

SEQ ID NO: 926957 - DNA, 19 bp, Homo sapiens
cctgatgctccctcccctg

SEQ ID NO: 926958 - DNA, 23 bp, Homo sapiens
cctgatgctccctcccctgccct

SEQ ID NO: 926959 - DNA, 21 bp, Homo sapiens
cctgatgctgacattcacctg

SEQ ID NO: 926960 - DNA, 14 bp, Homo sapiens
cctgatgctgcccc

SEQ ID NO: 926961 - DNA, 15 bp, Homo sapiens
cctgatgctgccccg

SEQ ID NO: 926962 - DNA, 23 bp, Homo sapiens
cctgatgctgccccgttccctgt

SEQ ID NO: 926963 - DNA, 21 bp, Homo sapiens
cctgatggcacttagctatca

SEQ ID NO: 926964 - DNA, 12 bp, Homo sapiens
cctgatggccaa

SEQ ID NO: 926965 - DNA, 13 bp, Homo sapiens
cctgatggccaag

SEQ ID NO: 926966 - DNA, 19 bp, Homo sapiens
cctgatggccaagagcatc

SEQ ID NO: 926967 - DNA, 17 bp, Homo sapiens
cctgatggccaggccag

SEQ ID NO: 926968 - DNA, 16 bp, Homo sapiens
cctgatggcctttgga

SEQ ID NO: 926969 - DNA, 21 bp, Homo sapiens
cctgatggtacaggaaagctc

SEQ ID NO: 926970 - DNA, 23 bp, Homo sapiens
cctgatggtcagctcccttctct

SEQ ID NO: 926971 - DNA, 18 bp, Homo sapiens
cctgatggtgctgctcag

SEQ ID NO: 926972 - DNA, 17 bp, Homo sapiens
cctgatgtgggagctga

SEQ ID NO: 926973 - DNA, 16 bp, Homo sapiens
cctgatgttaaaattc

SEQ ID NO: 926974 - DNA, 13 bp, Homo sapiens
cctgattaaatgt

SEQ ID NO: 926975 - DNA, 20 bp, Homo sapiens
cctgattcatactccttttg

SEQ ID NO: 926976 - DNA, 23 bp, Homo sapiens
cctgattcatactccttttggct

SEQ ID NO: 926977 - DNA, 15 bp, Homo sapiens
cctgattcttgattc

SEQ ID NO: 926978 - DNA, 14 bp, Homo sapiens
cctgattgatcaca

SEQ ID NO: 926979 - DNA, 20 bp, Homo sapiens
cctgattgtgtatattcata

SEQ ID NO: 926980 - DNA, 23 bp, Homo sapiens
cctgatttaatatgcaaagtcta

SEQ ID NO: 926981 - DNA, 19 bp, Homo sapiens
cctgatttcagaagagact

SEQ ID NO: 926982 - DNA, 16 bp, Homo sapiens
cctgatttctctgaac

SEQ ID NO: 926983 - DNA, 22 bp, Homo sapiens
cctgattttttttccttttaat

SEQ ID NO: 926984 - DNA, 17 bp, Homo sapiens
cctgcaaaaggactctc

SEQ ID NO: 926985 - DNA, 18 bp, Homo sapiens
cctgcaaacagaacaggg

SEQ ID NO: 926986 - DNA, 19 bp, Homo sapiens
cctgcaaacagaacagggt

SEQ ID NO: 926987 - DNA, 18 bp, Homo sapiens
cctgcaaaccttcctggg

SEQ ID NO: 926988 - DNA, 19 bp, Homo sapiens
cctgcaaaccttcctggga

SEQ ID NO: 926989 - DNA, 20 bp, Homo sapiens
cctgcaaaccttcctgggag

SEQ ID NO: 926990 - DNA, 16 bp, Homo sapiens
cctgcaaactcactgc

SEQ ID NO: 926991 - DNA, 15 bp, Homo sapiens
cctgcaaagcccagc

SEQ ID NO: 926992 - DNA, 16 bp, Homo sapiens
cctgcaaagcccagct

SEQ ID NO: 926993 - DNA, 17 bp, Homo sapiens
cctgcaaagcccagctt

SEQ ID NO: 926994 - DNA, 15 bp, Homo sapiens
gcacagagcctggcc

SEQ ID NO: 926995 - DNA, 16 bp, Homo sapiens
gcacagaggatttctt

SEQ ID NO: 926996 - DNA, 16 bp, Homo sapiens
gcacagagggaagcca

SEQ ID NO: 926997 - DNA, 20 bp, Homo sapiens
gcacagagggaagccatgtg

SEQ ID NO: 926998 - DNA, 16 bp, Homo sapiens
gcacagagttgttaca

SEQ ID NO: 926999 - DNA, 18 bp, Homo sapiens
gcacagagttgttacatt

SEQ ID NO: 927000 - DNA, 22 bp, Homo sapiens
gcacagagttgttacattttta

SEQ ID NO: 927001 - DNA, 15 bp, Homo sapiens
gcacagatggatttg

SEQ ID NO: 927002 - DNA, 24 bp, Homo sapiens
gcacagatggatttgcctgtgcca

SEQ ID NO: 927003 - DNA, 23 bp, Homo sapiens
gcacagattgaagaatctgcccc

SEQ ID NO: 927004 - DNA, 17 bp, Homo sapiens
gcacagattgctgaaac

SEQ ID NO: 927005 - DNA, 15 bp, Homo sapiens
gcacagcagcctggg

SEQ ID NO: 927006 - DNA, 22 bp, Homo sapiens
gcacagcagcctggggctggcc

SEQ ID NO: 927007 - DNA, 14 bp, Homo sapiens
gcacagcaggggag

SEQ ID NO: 927008 - DNA, 18 bp, Homo sapiens
gcacagccaacgagacac

SEQ ID NO: 927009 - DNA, 23 bp, Homo sapiens
gcacagccacccgtggggtgctg

SEQ ID NO: 927010 - DNA, 13 bp, Homo sapiens
gcacagccacctc

SEQ ID NO: 927011 - DNA, 14 bp, Homo sapiens
gcacagccacctcc

SEQ ID NO: 927012 - DNA, 11 bp, Homo sapiens
gcacagccagc

SEQ ID NO: 927013 - DNA, 23 bp, Homo sapiens
gcacagcctcggggatggggagg

SEQ ID NO: 927014 - DNA, 21 bp, Homo sapiens
gcacagcggggccccagggct

SEQ ID NO: 927015 - DNA, 17 bp, Homo sapiens
gcacagctcctgccagg

SEQ ID NO: 927016 - DNA, 13 bp, Homo sapiens
gcacagctgccct

SEQ ID NO: 927017 - DNA, 15 bp, Homo sapiens
gcacagctgccctgc

SEQ ID NO: 927018 - DNA, 18 bp, Homo sapiens
gcacagctgccctgctgc

SEQ ID NO: 927019 - DNA, 23 bp, Homo sapiens
gcacagctgcttgtcctgctctc

SEQ ID NO: 927020 - DNA, 17 bp, Homo sapiens
gcacagctgtctgccag

SEQ ID NO: 927021 - DNA, 23 bp, Homo sapiens
gcacagctgtctgccaggcactc

SEQ ID NO: 927022 - DNA, 19 bp, Homo sapiens
gcacagcttgacctgaggc

SEQ ID NO: 927023 - DNA, 21 bp, Homo sapiens
gcacagcttgacctgaggctg

SEQ ID NO: 927024 - DNA, 13 bp, Homo sapiens
gcacaggaggagg

SEQ ID NO: 927025 - DNA, 16 bp, Homo sapiens
gcacaggatgctggcc

SEQ ID NO: 927026 - DNA, 14 bp, Homo sapiens
gcacaggcagctgg

SEQ ID NO: 927027 - DNA, 12 bp, Homo sapiens
gcacaggcccgc

SEQ ID NO: 927028 - DNA, 12 bp, Homo sapiens
gcacaggggccc

SEQ ID NO: 927029 - DNA, 15 bp, Homo sapiens
gcacaggggccccag

SEQ ID NO: 927030 - DNA, 16 bp, Homo sapiens
gcacaggggccccaga

SEQ ID NO: 927031 - DNA, 18 bp, Homo sapiens
gcacagggtctgctcttt

SEQ ID NO: 927032 - DNA, 17 bp, Homo sapiens
gcacaggtcccacctcc

SEQ ID NO: 927033 - DNA, 23 bp, Homo sapiens
gcacaggtggctgtttcttgtct

SEQ ID NO: 927034 - DNA, 13 bp, Homo sapiens
gcacaggtgggag

SEQ ID NO: 927035 - DNA, 14 bp, Homo sapiens
gcacaggtgggagg

SEQ ID NO: 927036 - DNA, 18 bp, Homo sapiens
gcacagtaaaagtaaaga

SEQ ID NO: 927037 - DNA, 14 bp, Homo sapiens
gcacagtccacagc

SEQ ID NO: 927038 - DNA, 16 bp, Homo sapiens
gcacagtgaagtgctg

SEQ ID NO: 927039 - DNA, 21 bp, Homo sapiens
gcacagtgatgccgggcgcca

SEQ ID NO: 927040 - DNA, 13 bp, Homo sapiens
gcacagtgcatct

SEQ ID NO: 927041 - DNA, 19 bp, Homo sapiens
gcacagtgcatctcagccc

SEQ ID NO: 927042 - DNA, 16 bp, Homo sapiens
gcacagtgctgcccct

SEQ ID NO: 927043 - DNA, 17 bp, Homo sapiens
gcacagtgctgcccctt

SEQ ID NO: 927044 - DNA, 13 bp, Homo sapiens
gcacagtggcaca

SEQ ID NO: 927045 - DNA, 20 bp, Homo sapiens
gcacagtgggagctgagctg

SEQ ID NO: 927046 - DNA, 22 bp, Homo sapiens
gcacagtgggagctgagctgga

SEQ ID NO: 927047 - DNA, 18 bp, Homo sapiens
gcacagtgtaatccaggg

SEQ ID NO: 927048 - DNA, 21 bp, Homo sapiens
gcacagttgaagggaggggct

SEQ ID NO: 927049 - DNA, 21 bp, Homo sapiens
gcacagttgtctattctgagc

SEQ ID NO: 927050 - DNA, 22 bp, Homo sapiens
gcacagttgtctattctgagcc

SEQ ID NO: 927051 - DNA, 23 bp, Homo sapiens
gcacagttgtctattctgagcct

SEQ ID NO: 927052 - DNA, 22 bp, Homo sapiens
gcacagtttagaacagagggac

SEQ ID NO: 927053 - DNA, 12 bp, Homo sapiens
gcacagtttgaa

SEQ ID NO: 927054 - DNA, 14 bp, Homo sapiens
gcacagtttgaaca

SEQ ID NO: 927055 - DNA, 23 bp, Homo sapiens
gcacatacacctcgtcaagagca

SEQ ID NO: 927056 - DNA, 16 bp, Homo sapiens
gcacatagtgtcctgc

SEQ ID NO: 927057 - DNA, 17 bp, Homo sapiens
gcacatagtgtcctgcc

SEQ ID NO: 927058 - DNA, 20 bp, Homo sapiens
gcacatattagtgcagccaa

SEQ ID NO: 927059 - DNA, 12 bp, Homo sapiens
gcacatcacctc

SEQ ID NO: 927060 - DNA, 13 bp, Homo sapiens
gcacatcacctct

SEQ ID NO: 927061 - DNA, 19 bp, Homo sapiens
gcacatcagcacgatttct

SEQ ID NO: 927062 - DNA, 20 bp, Homo sapiens
gcacatcagcacgatttctg

SEQ ID NO: 927063 - DNA, 16 bp, Homo sapiens
gcacatgaaaaatttt

SEQ ID NO: 927064 - DNA, 13 bp, Homo sapiens
gcacatgaaagtt

SEQ ID NO: 927065 - DNA, 13 bp, Homo sapiens
gcacatgactcgg

SEQ ID NO: 927066 - DNA, 22 bp, Homo sapiens
gcacatgcagatggggctcccg

SEQ ID NO: 927067 - DNA, 16 bp, Homo sapiens
gcacatgctgtctggc

SEQ ID NO: 927068 - DNA, 19 bp, Homo sapiens
gcacatggccatagaggcc

SEQ ID NO: 927069 - DNA, 22 bp, Homo sapiens
gcacatggccatagaggcccag

SEQ ID NO: 927070 - DNA, 20 bp, Homo sapiens
gcacatgtaataaattcaaa

SEQ ID NO: 927071 - DNA, 23 bp, Homo sapiens
gcacatgtctgtcctcagagcag

SEQ ID NO: 927072 - DNA, 17 bp, Homo sapiens
gcacatgtgtatttata

SEQ ID NO: 927073 - DNA, 12 bp, Homo sapiens
gcacatgtttcc

SEQ ID NO: 927074 - DNA, 18 bp, Homo sapiens
gcacattaactccctcca

SEQ ID NO: 927075 - DNA, 21 bp, Homo sapiens
gcacattaactccctccacca

SEQ ID NO: 927076 - DNA, 23 bp, Homo sapiens
gcacattaactccctccaccagc

SEQ ID NO: 927077 - DNA, 13 bp, Homo sapiens
gcacattcctggc

SEQ ID NO: 927078 - DNA, 17 bp, Homo sapiens
gcacattcctggccccg

SEQ ID NO: 927079 - DNA, 21 bp, Homo sapiens
gcacattcgggaccaatatat

SEQ ID NO: 927080 - DNA, 17 bp, Homo sapiens
gcacattgcctgttctg

SEQ ID NO: 927081 - DNA, 21 bp, Homo sapiens
gcacattgcctgttctgcttc

SEQ ID NO: 927082 - DNA, 22 bp, Homo sapiens
gcacattgcctgttctgcttcg

SEQ ID NO: 927083 - DNA, 14 bp, Homo sapiens
gcacatttatatat

SEQ ID NO: 927084 - DNA, 14 bp, Homo sapiens
gcacatttctggat

SEQ ID NO: 927085 - DNA, 17 bp, Homo sapiens
gcacatttttttctatg

SEQ ID NO: 927086 - DNA, 20 bp, Homo sapiens
gcaccaaaataagaaaagat

SEQ ID NO: 927087 - DNA, 10 bp, Homo sapiens
gcaccaaaga

SEQ ID NO: 927088 - DNA, 13 bp, Homo sapiens
gcaccaaagacat

SEQ ID NO: 927089 - DNA, 13 bp, Homo sapiens
gcaccaaccacag

SEQ ID NO: 927090 - DNA, 15 bp, Homo sapiens
gcaccaaccacagca

SEQ ID NO: 927091 - DNA, 17 bp, Homo sapiens
gcaccaacctcactgcc

SEQ ID NO: 927092 - DNA, 15 bp, Homo sapiens
gcaccaagcaggaaa

SEQ ID NO: 927093 - DNA, 15 bp, Homo sapiens
gcaccacactgggtg

SEQ ID NO: 927094 - DNA, 17 bp, Homo sapiens
gcaccaccaagccaagg

SEQ ID NO: 927095 - DNA, 18 bp, Homo sapiens
gcaccaccaagccaaggg

SEQ ID NO: 927096 - DNA, 15 bp, Homo sapiens
gcaccaccaggagca

SEQ ID NO: 927097 - DNA, 16 bp, Homo sapiens
gcaccaccaggagcag

SEQ ID NO: 927098 - DNA, 17 bp, Homo sapiens
gcaccaccaggagcagc

SEQ ID NO: 927099 - DNA, 19 bp, Homo sapiens
gcaccaccaggagcagcag

SEQ ID NO: 927100 - DNA, 22 bp, Homo sapiens
gcaccaccaggagcagcagcca

SEQ ID NO: 927101 - DNA, 13 bp, Homo sapiens
gcaccaccagggt

SEQ ID NO: 927102 - DNA, 15 bp, Homo sapiens
gcaccaccagggtgg

SEQ ID NO: 927103 - DNA, 22 bp, Homo sapiens
gcaccaccagggtggaccaggc

SEQ ID NO: 927104 - DNA, 15 bp, Homo sapiens
gcaccaccatgccca

SEQ ID NO: 927105 - DNA, 23 bp, Homo sapiens
gcaccaccctagtcccttcccct

SEQ ID NO: 927106 - DNA, 19 bp, Homo sapiens
gcaccacctacacaggagt

SEQ ID NO: 927107 - DNA, 22 bp, Homo sapiens
gcaccactgcactccagcctgg

SEQ ID NO: 927108 - DNA, 14 bp, Homo sapiens
gcaccactgctgag

SEQ ID NO: 927109 - DNA, 18 bp, Homo sapiens
gcaccagcaattctcttt

SEQ ID NO: 927110 - DNA, 16 bp, Homo sapiens
gcaccagcagcctgga

SEQ ID NO: 927111 - DNA, 17 bp, Homo sapiens
gcaccagccccctggat

SEQ ID NO: 927112 - DNA, 18 bp, Homo sapiens
gcaccagcgcccccagaa

SEQ ID NO: 927113 - DNA, 14 bp, Homo sapiens
gcaccagctctgtg

SEQ ID NO: 927114 - DNA, 15 bp, Homo sapiens
gcaccagctctgtgg

SEQ ID NO: 927115 - DNA, 17 bp, Homo sapiens
gcaccagctctgtggcc

SEQ ID NO: 927116 - DNA, 14 bp, Homo sapiens
gacagagcaggggc

SEQ ID NO: 927117 - DNA, 21 bp, Homo sapiens
gacagagcaggggctccagca

SEQ ID NO: 927118 - DNA, 13 bp, Homo sapiens
gacagagccaccc

SEQ ID NO: 927119 - DNA, 21 bp, Homo sapiens
gacagagccaccccatgagct

SEQ ID NO: 927120 - DNA, 13 bp, Homo sapiens
gacagagccagga

SEQ ID NO: 927121 - DNA, 15 bp, Homo sapiens
gacagagccaggaga

SEQ ID NO: 927122 - DNA, 17 bp, Homo sapiens
gacagaggaaagggctg

SEQ ID NO: 927123 - DNA, 21 bp, Homo sapiens
gacagaggaaagggctggctc

SEQ ID NO: 927124 - DNA, 16 bp, Homo sapiens
gacagaggccaaggac

SEQ ID NO: 927125 - DNA, 17 bp, Homo sapiens
gacagaggccaaggact

SEQ ID NO: 927126 - DNA, 11 bp, Homo sapiens
gacagaggccc

SEQ ID NO: 927127 - DNA, 12 bp, Homo sapiens
gacagaggccct

SEQ ID NO: 927128 - DNA, 15 bp, Homo sapiens
gacagaggccggggt

SEQ ID NO: 927129 - DNA, 13 bp, Homo sapiens
gacagaggctgca

SEQ ID NO: 927130 - DNA, 18 bp, Homo sapiens
gacagagggagacagggc

SEQ ID NO: 927131 - DNA, 20 bp, Homo sapiens
gacagagggagacagggctg

SEQ ID NO: 927132 - DNA, 20 bp, Homo sapiens
gacagaggggactctgggct

SEQ ID NO: 927133 - DNA, 18 bp, Homo sapiens
gacagagtgaatttcagt

SEQ ID NO: 927134 - DNA, 16 bp, Homo sapiens
gacagagttgattttt

SEQ ID NO: 927135 - DNA, 15 bp, Homo sapiens
gacagatacctccaa

SEQ ID NO: 927136 - DNA, 18 bp, Homo sapiens
cccagtcctcactgtcct

SEQ ID NO: 927137 - DNA, 23 bp, Homo sapiens
cccagtcgtgatgtggaggaaga

SEQ ID NO: 927138 - DNA, 13 bp, Homo sapiens
cccagtctcatct

SEQ ID NO: 927139 - DNA, 15 bp, Homo sapiens
cccagtctccaggga

SEQ ID NO: 927140 - DNA, 14 bp, Homo sapiens
cccagtctcctctc

SEQ ID NO: 927141 - DNA, 21 bp, Homo sapiens
cccagtctctcttaaagttgg

SEQ ID NO: 927142 - DNA, 15 bp, Homo sapiens
cccagtctctggcag

SEQ ID NO: 927143 - DNA, 11 bp, Homo sapiens
cccagtctgtc

SEQ ID NO: 927144 - DNA, 13 bp, Homo sapiens
cccagtcttcctt

SEQ ID NO: 927145 - DNA, 15 bp, Homo sapiens
cccagtcttccttgt

SEQ ID NO: 927146 - DNA, 19 bp, Homo sapiens
cccagtgaatccctgggag

SEQ ID NO: 927147 - DNA, 23 bp, Homo sapiens
cccagtgacaaagactcctctgg

SEQ ID NO: 927148 - DNA, 18 bp, Homo sapiens
cccagtgacacttcagag

SEQ ID NO: 927149 - DNA, 18 bp, Homo sapiens
cccagtgagactgcccca

SEQ ID NO: 927150 - DNA, 18 bp, Homo sapiens
cccagtgaggatgctgca

SEQ ID NO: 927151 - DNA, 21 bp, Homo sapiens
cccagtgcaaaccacttctcc

SEQ ID NO: 927152 - DNA, 22 bp, Homo sapiens
cccagtgcacctccctccccag

SEQ ID NO: 927153 - DNA, 21 bp, Homo sapiens
cccagtgcagggctggtcttg

SEQ ID NO: 927154 - DNA, 17 bp, Homo sapiens
cccagtgccactgcccc

SEQ ID NO: 927155 - DNA, 18 bp, Homo sapiens
cccagtgccactgccccc

SEQ ID NO: 927156 - DNA, 12 bp, Homo sapiens
cccagtgccagc

SEQ ID NO: 927157 - DNA, 14 bp, Homo sapiens
cccagtgccagctc

SEQ ID NO: 927158 - DNA, 13 bp, Homo sapiens
cccagtgcctgcc

SEQ ID NO: 927159 - DNA, 15 bp, Homo sapiens
cccagtgcctgccac

SEQ ID NO: 927160 - DNA, 17 bp, Homo sapiens
cccagtgcctgccactc

SEQ ID NO: 927161 - DNA, 21 bp, Homo sapiens
cccagtgcggttcctcatctg

SEQ ID NO: 927162 - DNA, 17 bp, Homo sapiens
cccagtgctcaccagcc

SEQ ID NO: 927163 - DNA, 18 bp, Homo sapiens
cccagtgctcaccagccc

SEQ ID NO: 927164 - DNA, 20 bp, Homo sapiens
cccagtgctgccatgccact

SEQ ID NO: 927165 - DNA, 19 bp, Homo sapiens
cccagtgctgctgtaaata

SEQ ID NO: 927166 - DNA, 12 bp, Homo sapiens
cccagtgctgga

SEQ ID NO: 927167 - DNA, 19 bp, Homo sapiens
cccagtggcctcaaccctc

SEQ ID NO: 927168 - DNA, 14 bp, Homo sapiens
cccagtgggagggg

SEQ ID NO: 927169 - DNA, 19 bp, Homo sapiens
cccagtgggaggggcaggc

SEQ ID NO: 927170 - DNA, 16 bp, Homo sapiens
cccagtgggctgtgtt

SEQ ID NO: 927171 - DNA, 19 bp, Homo sapiens
cccagtggggacagggagg

SEQ ID NO: 927172 - DNA, 22 bp, Homo sapiens
cccagtggggacagggaggggg

SEQ ID NO: 927173 - DNA, 19 bp, Homo sapiens
cccagtgggtgatgctttt

SEQ ID NO: 927174 - DNA, 13 bp, Homo sapiens
cccagtggtgagg

SEQ ID NO: 927175 - DNA, 14 bp, Homo sapiens
cccagtgtgcacgc

SEQ ID NO: 927176 - DNA, 12 bp, Homo sapiens
cccagtgtggct

SEQ ID NO: 927177 - DNA, 17 bp, Homo sapiens
cccagtgttgtttgtaa

SEQ ID NO: 927178 - DNA, 16 bp, Homo sapiens
cccagtgttttctttg

SEQ ID NO: 927179 - DNA, 12 bp, Homo sapiens
cccagttacttt

SEQ ID NO: 927180 - DNA, 16 bp, Homo sapiens
cccagttcagtctgta

SEQ ID NO: 927181 - DNA, 22 bp, Homo sapiens
cccagttctgaataacttgaag

SEQ ID NO: 927182 - DNA, 19 bp, Homo sapiens
cccagttgcactcaggtga

SEQ ID NO: 927183 - DNA, 20 bp, Homo sapiens
cccagttgcactcaggtgac

SEQ ID NO: 927184 - DNA, 15 bp, Homo sapiens
cccagttgccatctg

SEQ ID NO: 927185 - DNA, 17 bp, Homo sapiens
cccagttgccatctgcg

SEQ ID NO: 927186 - DNA, 14 bp, Homo sapiens
cccagtttcttctt

SEQ ID NO: 927187 - DNA, 17 bp, Homo sapiens
cccataaggccagaaac

SEQ ID NO: 927188 - DNA, 21 bp, Homo sapiens
cccatacaatgtatgtacaat

SEQ ID NO: 927189 - DNA, 15 bp, Homo sapiens
cccatacctttccag

SEQ ID NO: 927190 - DNA, 14 bp, Homo sapiens
cccatactcagcct

SEQ ID NO: 927191 - DNA, 20 bp, Homo sapiens
cccatacttgcatacaccac

SEQ ID NO: 927192 - DNA, 16 bp, Homo sapiens
cccatagatcttctga

SEQ ID NO: 927193 - DNA, 20 bp, Homo sapiens
cccatagctattttccttgc

SEQ ID NO: 927194 - DNA, 13 bp, Homo sapiens
cccatagcttcca

SEQ ID NO: 927195 - DNA, 15 bp, Homo sapiens
cccatagtggggcct

SEQ ID NO: 927196 - DNA, 15 bp, Homo sapiens
cccatattgtaaaac

SEQ ID NO: 927197 - DNA, 18 bp, Homo sapiens
cccatattgtaaaacagg

SEQ ID NO: 927198 - DNA, 16 bp, Homo sapiens
cccatatttcatcgtg

SEQ ID NO: 927199 - DNA, 13 bp, Homo sapiens
cccatcacctcta

SEQ ID NO: 927200 - DNA, 22 bp, Homo sapiens
cccatcactgcgccactgctcc

SEQ ID NO: 927201 - DNA, 13 bp, Homo sapiens
cccatcactggag

SEQ ID NO: 927202 - DNA, 12 bp, Homo sapiens
cccatcagctcc

SEQ ID NO: 927203 - DNA, 15 bp, Homo sapiens
cccatcagctcccaa

SEQ ID NO: 927204 - DNA, 17 bp, Homo sapiens
cccatcagctcccaacg

SEQ ID NO: 927205 - DNA, 14 bp, Homo sapiens
cccatcagctgcca

SEQ ID NO: 927206 - DNA, 22 bp, Homo sapiens
cccatcattacccttccctgca

SEQ ID NO: 927207 - DNA, 14 bp, Homo sapiens
cccatccaaccact

SEQ ID NO: 927208 - DNA, 14 bp, Homo sapiens
cccatccagccacg

SEQ ID NO: 927209 - DNA, 16 bp, Homo sapiens
cccatccagccacgga

SEQ ID NO: 927210 - DNA, 20 bp, Homo sapiens
cccatccagccacggaggga

SEQ ID NO: 927211 - DNA, 13 bp, Homo sapiens
cccatccagccag

SEQ ID NO: 927212 - DNA, 12 bp, Homo sapiens
cccatccagcgt

SEQ ID NO: 927213 - DNA, 15 bp, Homo sapiens
cccatccagctacca

SEQ ID NO: 927214 - DNA, 14 bp, Homo sapiens
cccatccattaggc

SEQ ID NO: 927215 - DNA, 20 bp, Homo sapiens
cccatcccagggtcccaccc

SEQ ID NO: 927216 - DNA, 21 bp, Homo sapiens
cccatcccattttcatcctga

SEQ ID NO: 927217 - DNA, 13 bp, Homo sapiens
cccatccccacca

SEQ ID NO: 927218 - DNA, 13 bp, Homo sapiens
cccatccccaggt

SEQ ID NO: 927219 - DNA, 16 bp, Homo sapiens
cccatccccaggtccc

SEQ ID NO: 927220 - DNA, 14 bp, Homo sapiens
cccatccccctgcc

SEQ ID NO: 927221 - DNA, 20 bp, Homo sapiens
cccatcccctcaacaccctg

SEQ ID NO: 927222 - DNA, 17 bp, Homo sapiens
cccatcccgaagccatc

SEQ ID NO: 927223 - DNA, 16 bp, Homo sapiens
cccatccctccccagt

SEQ ID NO: 927224 - DNA, 17 bp, Homo sapiens
cccatccctcggaccca

SEQ ID NO: 927225 - DNA, 17 bp, Homo sapiens
cccatcctaccctcggg

SEQ ID NO: 927226 - DNA, 18 bp, Homo sapiens
cccatcctaccctcgggc

SEQ ID NO: 927227 - DNA, 23 bp, Homo sapiens
cccatcctaccctcgggcccacc

SEQ ID NO: 927228 - DNA, 16 bp, Homo sapiens
cccatcctcacccaga

SEQ ID NO: 927229 - DNA, 17 bp, Homo sapiens
cccatcctcatccctga

SEQ ID NO: 927230 - DNA, 14 bp, Homo sapiens
cccatcctccagca

SEQ ID NO: 927231 - DNA, 15 bp, Homo sapiens
cccatcctccagcag

SEQ ID NO: 927232 - DNA, 16 bp, Homo sapiens
cccatcctccagcagg

SEQ ID NO: 927233 - DNA, 19 bp, Homo sapiens
cccatcctccagcttctgg

SEQ ID NO: 927234 - DNA, 13 bp, Homo sapiens
cccatcctcccct

SEQ ID NO: 927235 - DNA, 17 bp, Homo sapiens
cccatcctgccatcctc

SEQ ID NO: 927236 - DNA, 21 bp, Homo sapiens
cccatcctggggcagcactcc

SEQ ID NO: 927237 - DNA, 16 bp, Homo sapiens
cccatctcaggtgcca

SEQ ID NO: 927238 - DNA, 14 bp, Homo sapiens
cccatctcatcctg

SEQ ID NO: 927239 - DNA, 14 bp, Homo sapiens
gacagggtgggctt

SEQ ID NO: 927240 - DNA, 16 bp, Homo sapiens
gacagggtgggcttcc

SEQ ID NO: 927241 - DNA, 17 bp, Homo sapiens
gacagggtgggcttcct

SEQ ID NO: 927242 - DNA, 23 bp, Homo sapiens
gacagggtttggctgtgtctaaa

SEQ ID NO: 927243 - DNA, 14 bp, Homo sapiens
gacaggtaaattaa

SEQ ID NO: 927244 - DNA, 21 bp, Homo sapiens
gacaggtacttggagggctca

SEQ ID NO: 927245 - DNA, 17 bp, Homo sapiens
gacaggtgatgctctgg

SEQ ID NO: 927246 - DNA, 16 bp, Homo sapiens
gacaggtgggcctggc

SEQ ID NO: 927247 - DNA, 21 bp, Homo sapiens
gacaggtgggcctggcggcct

SEQ ID NO: 927248 - DNA, 17 bp, Homo sapiens
gacaggtgggcctggga

SEQ ID NO: 927249 - DNA, 19 bp, Homo sapiens
gacaggttacgaagacaaa

SEQ ID NO: 927250 - DNA, 20 bp, Homo sapiens
gacagtaagtttattgttaa

SEQ ID NO: 927251 - DNA, 16 bp, Homo sapiens
gacagtatcccacatc

SEQ ID NO: 927252 - DNA, 18 bp, Homo sapiens
gacagtatcccacatcca

SEQ ID NO: 927253 - DNA, 14 bp, Homo sapiens
gacagtatgagaaa

SEQ ID NO: 927254 - DNA, 20 bp, Homo sapiens
gacagtcatcatcagggcct

SEQ ID NO: 927255 - DNA, 17 bp, Homo sapiens
gacagtcctccatccac

SEQ ID NO: 927256 - DNA, 15 bp, Homo sapiens
gacagtcctgggaga

SEQ ID NO: 927257 - DNA, 22 bp, Homo sapiens
gacagtccttggggttaagtct

SEQ ID NO: 927258 - DNA, 15 bp, Homo sapiens
gacagtcctttccca

SEQ ID NO: 927259 - DNA, 20 bp, Homo sapiens
gacagtcctttcccaccatt

SEQ ID NO: 927260 - DNA, 13 bp, Homo sapiens
gacagtctcactt

SEQ ID NO: 927261 - DNA, 13 bp, Homo sapiens
gacagtctggaaa

SEQ ID NO: 927262 - DNA, 17 bp, Homo sapiens
gacagtctgttatgcac

SEQ ID NO: 927263 - DNA, 19 bp, Homo sapiens
gacagtgagacagtctgga

SEQ ID NO: 927264 - DNA, 20 bp, Homo sapiens
gacagtgccatccccacctt

SEQ ID NO: 927265 - DNA, 22 bp, Homo sapiens
cccatctttgatccttctgagc

SEQ ID NO: 927266 - DNA, 24 bp, Homo sapiens
cccatctttgatccttctgagctc

SEQ ID NO: 927267 - DNA, 20 bp, Homo sapiens
cccatgaacacactgtgtcc

SEQ ID NO: 927268 - DNA, 17 bp, Homo sapiens
cccatgaagaaagcccc

SEQ ID NO: 927269 - DNA, 22 bp, Homo sapiens
cccatgaagacaggacagtgct

SEQ ID NO: 927270 - DNA, 19 bp, Homo sapiens
cccatgaccatactgaggg

SEQ ID NO: 927271 - DNA, 16 bp, Homo sapiens
cccatgacccacccct

SEQ ID NO: 927272 - DNA, 17 bp, Homo sapiens
cccatgacccacccctg

SEQ ID NO: 927273 - DNA, 22 bp, Homo sapiens
cccatgacccacccctgtgctc

SEQ ID NO: 927274 - DNA, 23 bp, Homo sapiens
cccatgacccacccctgtgctcc

SEQ ID NO: 927275 - DNA, 17 bp, Homo sapiens
cccatgactgcacccag

SEQ ID NO: 927276 - DNA, 20 bp, Homo sapiens
cccatgactgcacccagctc

SEQ ID NO: 927277 - DNA, 21 bp, Homo sapiens
cccatgagcctgcccgctgca

SEQ ID NO: 927278 - DNA, 16 bp, Homo sapiens
cccatgagctcggggt

SEQ ID NO: 927279 - DNA, 15 bp, Homo sapiens
cccatgatccctgtg

SEQ ID NO: 927280 - DNA, 19 bp, Homo sapiens
cccatgcacctcagggcca

SEQ ID NO: 927281 - DNA, 21 bp, Homo sapiens
cccatgcacctcagggccaag

SEQ ID NO: 927282 - DNA, 14 bp, Homo sapiens
cccatgcccacctg

SEQ ID NO: 927283 - DNA, 18 bp, Homo sapiens
cccatgcccacctgccca

SEQ ID NO: 927284 - DNA, 19 bp, Homo sapiens
cccatgcccccttcgctcc

SEQ ID NO: 927285 - DNA, 20 bp, Homo sapiens
cccatgcccccttcgctcct

SEQ ID NO: 927286 - DNA, 23 bp, Homo sapiens
cccatgcgtgccgcctgctcctc

SEQ ID NO: 927287 - DNA, 20 bp, Homo sapiens
cccatgctctgccccaagcc

SEQ ID NO: 927288 - DNA, 16 bp, Homo sapiens
cccatgctgccttcag

SEQ ID NO: 927289 - DNA, 17 bp, Homo sapiens
cccatggaaaaatgcca

SEQ ID NO: 927290 - DNA, 20 bp, Homo sapiens
cccatggacactccagtgcc

SEQ ID NO: 927291 - DNA, 22 bp, Homo sapiens
cccatggacaggctggctccag

SEQ ID NO: 927292 - DNA, 15 bp, Homo sapiens
cccatggcattttat

SEQ ID NO: 927293 - DNA, 20 bp, Homo sapiens
cccatggcccccaataaagg

SEQ ID NO: 927294 - DNA, 21 bp, Homo sapiens
cccatggcccccaataaaggc

SEQ ID NO: 927295 - DNA, 15 bp, Homo sapiens
cccatggctgaagct

SEQ ID NO: 927296 - DNA, 23 bp, Homo sapiens
cccatggctgaagctggagcagc

SEQ ID NO: 927297 - DNA, 20 bp, Homo sapiens
cccatgggatatgtggtgta

SEQ ID NO: 927298 - DNA, 22 bp, Homo sapiens
cccatggggaaaccctggagcc

SEQ ID NO: 927299 - DNA, 19 bp, Homo sapiens
cccatggggagggattctg

SEQ ID NO: 927300 - DNA, 20 bp, Homo sapiens
cccatgggggtgagaccctc

SEQ ID NO: 927301 - DNA, 14 bp, Homo sapiens
cccatggggtcctt

SEQ ID NO: 927302 - DNA, 23 bp, Homo sapiens
cccatgggttgtgtgtttatttc

SEQ ID NO: 927303 - DNA, 15 bp, Homo sapiens
cccatggtgtatgtg

SEQ ID NO: 927304 - DNA, 16 bp, Homo sapiens
cccatggtgtatgtgg

SEQ ID NO: 927305 - DNA, 21 bp, Homo sapiens
cccatgtaatccttttgttta

SEQ ID NO: 927306 - DNA, 14 bp, Homo sapiens
cccatgtcacctca

SEQ ID NO: 927307 - DNA, 18 bp, Homo sapiens
cccatgtcgcgctcagca

SEQ ID NO: 927308 - DNA, 21 bp, Homo sapiens
cccatgtcttctgctgttctt

SEQ ID NO: 927309 - DNA, 13 bp, Homo sapiens
cccatgtgccttg

SEQ ID NO: 927310 - DNA, 17 bp, Homo sapiens
cccatgtgccttgtcca

SEQ ID NO: 927311 - DNA, 14 bp, Homo sapiens
cccatgtgccttta

SEQ ID NO: 927312 - DNA, 16 bp, Homo sapiens
cccatgtgctgggaaa

SEQ ID NO: 927313 - DNA, 13 bp, Homo sapiens
cccatgtggctga

SEQ ID NO: 927314 - DNA, 15 bp, Homo sapiens
cccatgtggctgaag

SEQ ID NO: 927315 - DNA, 16 bp, Homo sapiens
cccatgtggctgaaga

SEQ ID NO: 927316 - DNA, 17 bp, Homo sapiens
cccatgtggctgaagac

SEQ ID NO: 927317 - DNA, 14 bp, Homo sapiens
cccatgtgtgagtg

SEQ ID NO: 927318 - DNA, 20 bp, Homo sapiens
cccatgtgtgagtgtgtgca

SEQ ID NO: 927319 - DNA, 20 bp, Homo sapiens
cccatgttgcatgcctatgt

SEQ ID NO: 927320 - DNA, 18 bp, Homo sapiens
cccatgttgtaatgctgc

SEQ ID NO: 927321 - DNA, 19 bp, Homo sapiens
cccatgttgtaatgctgca

SEQ ID NO: 927322 - DNA, 24 bp, Homo sapiens
cccatgtttaaactttgtgccttt

SEQ ID NO: 927323 - DNA, 16 bp, Homo sapiens
cccattaggacaatca

SEQ ID NO: 927324 - DNA, 21 bp, Homo sapiens
cccattatattgttttctcct

SEQ ID NO: 927325 - DNA, 13 bp, Homo sapiens
cccattcccacca

SEQ ID NO: 927326 - DNA, 13 bp, Homo sapiens
cccattccctggg

SEQ ID NO: 927327 - DNA, 13 bp, Homo sapiens
cccattcctaaga

SEQ ID NO: 927328 - DNA, 19 bp, Homo sapiens
cccattcctccactctgta

SEQ ID NO: 927329 - DNA, 14 bp, Homo sapiens
cccattcctgggaa

SEQ ID NO: 927330 - DNA, 13 bp, Homo sapiens
cccattccttagc

SEQ ID NO: 927331 - DNA, 22 bp, Homo sapiens
cccattccttgcgcctcagccc

SEQ ID NO: 927332 - DNA, 21 bp, Homo sapiens
cccattcggtgtggtgcagtg

SEQ ID NO: 927333 - DNA, 18 bp, Homo sapiens
cccattctacacagagca

SEQ ID NO: 927334 - DNA, 12 bp, Homo sapiens
cccattctagat

SEQ ID NO: 927335 - DNA, 15 bp, Homo sapiens
cccattctcatctgc

SEQ ID NO: 927336 - DNA, 16 bp, Homo sapiens
cccattctcatctgca

SEQ ID NO: 927337 - DNA, 19 bp, Homo sapiens
cccattctcccagtctctg

SEQ ID NO: 927338 - DNA, 20 bp, Homo sapiens
cccattctcccagtctctgt

SEQ ID NO: 927339 - DNA, 18 bp, Homo sapiens
cccattctctctcctgtc

SEQ ID NO: 927340 - DNA, 15 bp, Homo sapiens
cccattctgcaccac

SEQ ID NO: 927341 - DNA, 12 bp, Homo sapiens
cccattcttcct

SEQ ID NO: 927342 - DNA, 20 bp, Homo sapiens
cccattcttcctagttttct

SEQ ID NO: 927343 - DNA, 21 bp, Homo sapiens
cccattcttcctagttttctc

SEQ ID NO: 927344 - DNA, 14 bp, Homo sapiens
cccattcttttgta

SEQ ID NO: 927345 - DNA, 17 bp, Homo sapiens
cccattcttttgtaatt

SEQ ID NO: 927346 - DNA, 22 bp, Homo sapiens
cccattggagcaagcttgccct

SEQ ID NO: 927347 - DNA, 20 bp, Homo sapiens
cccattgtccctctgcccca

SEQ ID NO: 927348 - DNA, 19 bp, Homo sapiens
cccattgtggctcctatct

SEQ ID NO: 927349 - DNA, 19 bp, Homo sapiens
cccattgttgtcaaggaag

SEQ ID NO: 927350 - DNA, 20 bp, Homo sapiens
cccattgttgtcaaggaaga

SEQ ID NO: 927351 - DNA, 21 bp, Homo sapiens
cccattgttgtcaaggaagaa

SEQ ID NO: 927352 - DNA, 20 bp, Homo sapiens
cccatttagaggatgtggct

SEQ ID NO: 927353 - DNA, 14 bp, Homo sapiens
cccatttcaatgtg

SEQ ID NO: 927354 - DNA, 13 bp, Homo sapiens
cccatttcaggaa

SEQ ID NO: 927355 - DNA, 23 bp, Homo sapiens
cccatttcaggaatttaaaatta

SEQ ID NO: 927356 - DNA, 15 bp, Homo sapiens
cccatttcccatctg

SEQ ID NO: 927357 - DNA, 17 bp, Homo sapiens
cccatttcccatctgca

SEQ ID NO: 927358 - DNA, 11 bp, Homo sapiens
cccatttcctg

SEQ ID NO: 927359 - DNA, 14 bp, Homo sapiens
cccatttcctgatc

SEQ ID NO: 927360 - DNA, 16 bp, Homo sapiens
gacatggtgcctgaga

SEQ ID NO: 927361 - DNA, 18 bp, Homo sapiens
gacatggtgcctgagagg

SEQ ID NO: 927362 - DNA, 21 bp, Homo sapiens
gacatggtgcctgagaggcag

SEQ ID NO: 927363 - DNA, 22 bp, Homo sapiens
gacatggtgcctgagaggcagg

SEQ ID NO: 927364 - DNA, 22 bp, Homo sapiens
gacatgtaccccctttcccttc

SEQ ID NO: 927365 - DNA, 15 bp, Homo sapiens
gacatgtctgttcta

SEQ ID NO: 927366 - DNA, 19 bp, Homo sapiens
gacatgtgaagctatttga

SEQ ID NO: 927367 - DNA, 20 bp, Homo sapiens
gacatgtgacatttatatat

SEQ ID NO: 927368 - DNA, 16 bp, Homo sapiens
gacatgtgaggaggaa

SEQ ID NO: 927369 - DNA, 20 bp, Homo sapiens
gacatgtgaggaggaaaagg

SEQ ID NO: 927370 - DNA, 16 bp, Homo sapiens
gacatgtggtgggaca

SEQ ID NO: 927371 - DNA, 19 bp, Homo sapiens
gacatgtttgtgctctgtt

SEQ ID NO: 927372 - DNA, 14 bp, Homo sapiens
gacatgtttttgtt

SEQ ID NO: 927373 - DNA, 18 bp, Homo sapiens
gacatgtttttgttttct

SEQ ID NO: 927374 - DNA, 17 bp, Homo sapiens
gacattaacagttttcc

SEQ ID NO: 927375 - DNA, 19 bp, Homo sapiens
gacattaacagttttccat

SEQ ID NO: 927376 - DNA, 14 bp, Homo sapiens
gacattaactcatt

SEQ ID NO: 927377 - DNA, 14 bp, Homo sapiens
gacattatgtgagt

SEQ ID NO: 927378 - DNA, 14 bp, Homo sapiens
gacattcacctgcc

SEQ ID NO: 927379 - DNA, 15 bp, Homo sapiens
gacattcacctgccc

SEQ ID NO: 927380 - DNA, 15 bp, Homo sapiens
gacattcccctccca

SEQ ID NO: 927381 - DNA, 20 bp, Homo sapiens
gacattctcgcttccctgaa

SEQ ID NO: 927382 - DNA, 12 bp, Homo sapiens
gacattctgaat

SEQ ID NO: 927383 - DNA, 15 bp, Homo sapiens
gacattctgaatgct

SEQ ID NO: 927384 - DNA, 19 bp, Homo sapiens
gacattctgaatgcttcta

SEQ ID NO: 927385 - DNA, 22 bp, Homo sapiens
gacattctgattcgaatgacac

SEQ ID NO: 927386 - DNA, 14 bp, Homo sapiens
gacattcttttaat

SEQ ID NO: 927387 - DNA, 16 bp, Homo sapiens
gacattcttttaatgc

SEQ ID NO: 927388 - DNA, 16 bp, Homo sapiens
gacattgaaactacac

SEQ ID NO: 927389 - DNA, 23 bp, Homo sapiens
gacattgacctatttccagaaat

SEQ ID NO: 927390 - DNA, 13 bp, Homo sapiens
gacattgctctct

SEQ ID NO: 927391 - DNA, 18 bp, Homo sapiens
gacattgtatgcagggag

SEQ ID NO: 927392 - DNA, 14 bp, Homo sapiens
ccccaaccacagag

SEQ ID NO: 927393 - DNA, 13 bp, Homo sapiens
ccccaacccccac

SEQ ID NO: 927394 - DNA, 16 bp, Homo sapiens
ccccaaccccgcggtg

SEQ ID NO: 927395 - DNA, 18 bp, Homo sapiens
ccccaaccctgcccctgc

SEQ ID NO: 927396 - DNA, 14 bp, Homo sapiens
ccccaacctcaggg

SEQ ID NO: 927397 - DNA, 14 bp, Homo sapiens
ccccaacctgctga

SEQ ID NO: 927398 - DNA, 15 bp, Homo sapiens
ccccaacctttccct

SEQ ID NO: 927399 - DNA, 17 bp, Homo sapiens
ccccaacgtcccctccg

SEQ ID NO: 927400 - DNA, 20 bp, Homo sapiens
ccccaacgtcccctccgccg

SEQ ID NO: 927401 - DNA, 17 bp, Homo sapiens
ccccaactccaggaaag

SEQ ID NO: 927402 - DNA, 17 bp, Homo sapiens
ccccaactccctgccat

SEQ ID NO: 927403 - DNA, 14 bp, Homo sapiens
ccccaactcctgga

SEQ ID NO: 927404 - DNA, 14 bp, Homo sapiens
ccccaactctcccc

SEQ ID NO: 927405 - DNA, 16 bp, Homo sapiens
ccccaactctccccag

SEQ ID NO: 927406 - DNA, 17 bp, Homo sapiens
ccccaactctccccagt

SEQ ID NO: 927407 - DNA, 18 bp, Homo sapiens
ccccaactctgagcccat

SEQ ID NO: 927408 - DNA, 17 bp, Homo sapiens
ccccaacttcaccaccc

SEQ ID NO: 927409 - DNA, 20 bp, Homo sapiens
ccccaacttcaccaccccct

SEQ ID NO: 927410 - DNA, 22 bp, Homo sapiens
ccccaagattgagctctctgcc

SEQ ID NO: 927411 - DNA, 18 bp, Homo sapiens
ccccaagcagccagccag

SEQ ID NO: 927412 - DNA, 13 bp, Homo sapiens
ccccaagcctggc

SEQ ID NO: 927413 - DNA, 17 bp, Homo sapiens
ccccaagcgcctggctg

SEQ ID NO: 927414 - DNA, 11 bp, Homo sapiens
ccccaagctgg

SEQ ID NO: 927415 - DNA, 16 bp, Homo sapiens
ccccaagctgttttct

SEQ ID NO: 927416 - DNA, 17 bp, Homo sapiens
ccccaagctgttttctt

SEQ ID NO: 927417 - DNA, 12 bp, Homo sapiens
ccccaagcttct

SEQ ID NO: 927418 - DNA, 17 bp, Homo sapiens
ccccaaggccccaggga

SEQ ID NO: 927419 - DNA, 22 bp, Homo sapiens
ccccaagggctggggcggagct

SEQ ID NO: 927420 - DNA, 13 bp, Homo sapiens
ccccaaggttctc

SEQ ID NO: 927421 - DNA, 14 bp, Homo sapiens
ccccaagtgcctgc

SEQ ID NO: 927422 - DNA, 21 bp, Homo sapiens
ccccaagttgggggtcagtgc

SEQ ID NO: 927423 - DNA, 12 bp, Homo sapiens
ccccaataaagg

SEQ ID NO: 927424 - DNA, 15 bp, Homo sapiens
ccccaatccatgctt

SEQ ID NO: 927425 - DNA, 13 bp, Homo sapiens
ccccaatcccagc

SEQ ID NO: 927426 - DNA, 17 bp, Homo sapiens
ccccaatccctgccact

SEQ ID NO: 927427 - DNA, 18 bp, Homo sapiens
ccccaatcgggtccagag

SEQ ID NO: 927428 - DNA, 19 bp, Homo sapiens
ccccaatcttgcccactgg

SEQ ID NO: 927429 - DNA, 19 bp, Homo sapiens
ccccaattctgcctgcctc

SEQ ID NO: 927430 - DNA, 19 bp, Homo sapiens
ccccacaaggaaccctcag

SEQ ID NO: 927431 - DNA, 15 bp, Homo sapiens
ccccacacacaggcc

SEQ ID NO: 927432 - DNA, 15 bp, Homo sapiens
ccccacacagcctct

SEQ ID NO: 927433 - DNA, 16 bp, Homo sapiens
ccccacaccccagccc

SEQ ID NO: 927434 - DNA, 23 bp, Homo sapiens
ccccacaccccagcccaccctgc

SEQ ID NO: 927435 - DNA, 14 bp, Homo sapiens
ccccacacctcagt

SEQ ID NO: 927436 - DNA, 17 bp, Homo sapiens
ccccacacctccctact

SEQ ID NO: 927437 - DNA, 13 bp, Homo sapiens
ccccacacggact

SEQ ID NO: 927438 - DNA, 20 bp, Homo sapiens
ccccacacggactcccgggc

SEQ ID NO: 927439 - DNA, 18 bp, Homo sapiens
ccccacactccactctga

SEQ ID NO: 927440 - DNA, 14 bp, Homo sapiens
ccccacacttccct

SEQ ID NO: 927441 - DNA, 17 bp, Homo sapiens
ccccacacttccctggc

SEQ ID NO: 927442 - DNA, 18 bp, Homo sapiens
ccccacacttccctggcg

SEQ ID NO: 927443 - DNA, 13 bp, Homo sapiens
ccccacagaacct

SEQ ID NO: 927444 - DNA, 17 bp, Homo sapiens
ccccacagcgtccctgg

SEQ ID NO: 927445 - DNA, 14 bp, Homo sapiens
ccccacagctacct

SEQ ID NO: 927446 - DNA, 14 bp, Homo sapiens
ccccacagctggct

SEQ ID NO: 927447 - DNA, 14 bp, Homo sapiens
ccccacagctttgc

SEQ ID NO: 927448 - DNA, 15 bp, Homo sapiens
ccccaccacactgaa

SEQ ID NO: 927449 - DNA, 23 bp, Homo sapiens
ccccaccacgatgtggccctggc

SEQ ID NO: 927450 - DNA, 17 bp, Homo sapiens
ccccaccactcaggcca

SEQ ID NO: 927451 - DNA, 13 bp, Homo sapiens
ccccaccagctcg

SEQ ID NO: 927452 - DNA, 17 bp, Homo sapiens
ccccacccaagagagga

SEQ ID NO: 927453 - DNA, 16 bp, Homo sapiens
ccccacccaagcttgg

SEQ ID NO: 927454 - DNA, 20 bp, Homo sapiens
ccccacccaagcttggcagc

SEQ ID NO: 927455 - DNA, 20 bp, Homo sapiens
ccccacccacccccaggcct

SEQ ID NO: 927456 - DNA, 20 bp, Homo sapiens
ccccacccacctccacccag

SEQ ID NO: 927457 - DNA, 16 bp, Homo sapiens
ccccacccacctcctg

SEQ ID NO: 927458 - DNA, 23 bp, Homo sapiens
ccccacccacctcctgcggctca

SEQ ID NO: 927459 - DNA, 15 bp, Homo sapiens
ccccacccagctcca

SEQ ID NO: 927460 - DNA, 13 bp, Homo sapiens
ccccacccaggag

SEQ ID NO: 927461 - DNA, 14 bp, Homo sapiens
ccccaccccacact

SEQ ID NO: 927462 - DNA, 17 bp, Homo sapiens
ccccacccccagccagg

SEQ ID NO: 927463 - DNA, 13 bp, Homo sapiens
ccccacccccagt

SEQ ID NO: 927464 - DNA, 15 bp, Homo sapiens
ccccacccccctcct

SEQ ID NO: 927465 - DNA, 17 bp, Homo sapiens
ccccacccccttcagtg

SEQ ID NO: 927466 - DNA, 21 bp, Homo sapiens
ccccacccccttcagtgccca

SEQ ID NO: 927467 - DNA, 20 bp, Homo sapiens
ccccaccccgaaatcagccc

SEQ ID NO: 927468 - DNA, 13 bp, Homo sapiens
ccccacccctcca

SEQ ID NO: 927469 - DNA, 15 bp, Homo sapiens
ccccacccctccacg

SEQ ID NO: 927470 - DNA, 14 bp, Homo sapiens
ccccacccctccag

SEQ ID NO: 927471 - DNA, 23 bp, Homo sapiens
ccccacccctggaagagcccagt

SEQ ID NO: 927472 - DNA, 17 bp, Homo sapiens
ccccaccccttccccac

SEQ ID NO: 927473 - DNA, 18 bp, Homo sapiens
ccccaccccttccccact

SEQ ID NO: 927474 - DNA, 17 bp, Homo sapiens
ccccaccctactccctc

SEQ ID NO: 927475 - DNA, 17 bp, Homo sapiens
ccccaccctccactcag

SEQ ID NO: 927476 - DNA, 15 bp, Homo sapiens
ccccaccctgggccc

SEQ ID NO: 927477 - DNA, 14 bp, Homo sapiens
ccccaccctttggg

SEQ ID NO: 927478 - DNA, 20 bp, Homo sapiens
ccccaccgaggttcccaggg

SEQ ID NO: 927479 - DNA, 17 bp, Homo sapiens
ccccaccgccgtggagt

SEQ ID NO: 927480 - DNA, 18 bp, Homo sapiens
ccccaccgctcagtgtca

SEQ ID NO: 927481 - DNA, 18 bp, Homo sapiens
ccccaccggaactgggct

SEQ ID NO: 927482 - DNA, 19 bp, Homo sapiens
ccccaccggaactgggctg

SEQ ID NO: 927483 - DNA, 16 bp, Homo sapiens
gaccagaaacagggac

SEQ ID NO: 927484 - DNA, 21 bp, Homo sapiens
gaccagaaatcaaaaagggaa

SEQ ID NO: 927485 - DNA, 13 bp, Homo sapiens
gaccagaagcctt

SEQ ID NO: 927486 - DNA, 15 bp, Homo sapiens
gaccagaagccttgg

SEQ ID NO: 927487 - DNA, 17 bp, Homo sapiens
gaccagaagccttggaa

SEQ ID NO: 927488 - DNA, 17 bp, Homo sapiens
gaccagacttttgctta

SEQ ID NO: 927489 - DNA, 21 bp, Homo sapiens
gaccagagacccaacagcagt

SEQ ID NO: 927490 - DNA, 14 bp, Homo sapiens
gaccagagctgtct

SEQ ID NO: 927491 - DNA, 16 bp, Homo sapiens
gaccagagctgtctga

SEQ ID NO: 927492 - DNA, 16 bp, Homo sapiens
gaccagataaatagaa

SEQ ID NO: 927493 - DNA, 17 bp, Homo sapiens
gaccagatctttctctt

SEQ ID NO: 927494 - DNA, 21 bp, Homo sapiens
gaccagatctttctcttccct

SEQ ID NO: 927495 - DNA, 23 bp, Homo sapiens
gaccagatctttctcttccctga

SEQ ID NO: 927496 - DNA, 15 bp, Homo sapiens
gaccagcagacagag

SEQ ID NO: 927497 - DNA, 18 bp, Homo sapiens
gaccagcagacagagcca

SEQ ID NO: 927498 - DNA, 14 bp, Homo sapiens
gaccagcagcgcct

SEQ ID NO: 927499 - DNA, 14 bp, Homo sapiens
gaccagcatctggt

SEQ ID NO: 927500 - DNA, 16 bp, Homo sapiens
gaccagccagcagcag

SEQ ID NO: 927501 - DNA, 21 bp, Homo sapiens
gaccagcctccatgctgcctc

SEQ ID NO: 927502 - DNA, 11 bp, Homo sapiens
gaccagcctgg

SEQ ID NO: 927503 - DNA, 15 bp, Homo sapiens
gaccagcggaaacag

SEQ ID NO: 927504 - DNA, 21 bp, Homo sapiens
gaccagcggtccatgggtctg

SEQ ID NO: 927505 - DNA, 15 bp, Homo sapiens
gaccagctgctccga

SEQ ID NO: 927506 - DNA, 15 bp, Homo sapiens
gaccagctggagtga

SEQ ID NO: 927507 - DNA, 17 bp, Homo sapiens
gaccaggaaagccacac

SEQ ID NO: 927508 - DNA, 20 bp, Homo sapiens
gaccaggaaagccacacgga

SEQ ID NO: 927509 - DNA, 12 bp, Homo sapiens
gaccaggatccc

SEQ ID NO: 927510 - DNA, 16 bp, Homo sapiens
gaccaggcccaaggag

SEQ ID NO: 927511 - DNA, 15 bp, Homo sapiens
gaccaggcctggagg

SEQ ID NO: 927512 - DNA, 18 bp, Homo sapiens
gaccaggcctggagggca

SEQ ID NO: 927513 - DNA, 21 bp, Homo sapiens
gaccaggcttttgtagatggc

SEQ ID NO: 927514 - DNA, 16 bp, Homo sapiens
gaccagggaagtgtgt

SEQ ID NO: 927515 - DNA, 16 bp, Homo sapiens
gaccagggatgctggg

SEQ ID NO: 927516 - DNA, 17 bp, Homo sapiens
gaccagggatgctgggc

SEQ ID NO: 927517 - DNA, 22 bp, Homo sapiens
gaccagggatgctgggctgggc

SEQ ID NO: 927518 - DNA, 18 bp, Homo sapiens
gaccagggccctgggcag

SEQ ID NO: 927519 - DNA, 13 bp, Homo sapiens
gaccaggggagag

SEQ ID NO: 927520 - DNA, 16 bp, Homo sapiens
gaccaggggagaggca

SEQ ID NO: 927521 - DNA, 18 bp, Homo sapiens
ccccactggacaacactg

SEQ ID NO: 927522 - DNA, 17 bp, Homo sapiens
ccccactggctgagaat

SEQ ID NO: 927523 - DNA, 13 bp, Homo sapiens
ccccactggctgg

SEQ ID NO: 927524 - DNA, 17 bp, Homo sapiens
ccccactgggagagctg

SEQ ID NO: 927525 - DNA, 21 bp, Homo sapiens
ccccactgggccagccctgca

SEQ ID NO: 927526 - DNA, 22 bp, Homo sapiens
ccccactgggccagccctgcag

SEQ ID NO: 927527 - DNA, 16 bp, Homo sapiens
ccccacttatgctgct

SEQ ID NO: 927528 - DNA, 19 bp, Homo sapiens
ccccacttatgctgctgtg

SEQ ID NO: 927529 - DNA, 22 bp, Homo sapiens
ccccacttatgctgctgtgaat

SEQ ID NO: 927530 - DNA, 14 bp, Homo sapiens
ccccacttcacccc

SEQ ID NO: 927531 - DNA, 16 bp, Homo sapiens
ccccacttctggcatg

SEQ ID NO: 927532 - DNA, 13 bp, Homo sapiens
ccccacttctgtg

SEQ ID NO: 927533 - DNA, 14 bp, Homo sapiens
ccccacttgcctct

SEQ ID NO: 927534 - DNA, 16 bp, Homo sapiens
ccccacttgcctcttc

SEQ ID NO: 927535 - DNA, 21 bp, Homo sapiens
ccccagaaagctgccagagcc

SEQ ID NO: 927536 - DNA, 22 bp, Homo sapiens
ccccagaactggctgggcccct

SEQ ID NO: 927537 - DNA, 13 bp, Homo sapiens
ccccagacactgg

SEQ ID NO: 927538 - DNA, 21 bp, Homo sapiens
ccccagacccatgtgctggga

SEQ ID NO: 927539 - DNA, 18 bp, Homo sapiens
ccccagactagatgtagt

SEQ ID NO: 927540 - DNA, 14 bp, Homo sapiens
ccccagactgagct

SEQ ID NO: 927541 - DNA, 15 bp, Homo sapiens
ccccagactgagctc

SEQ ID NO: 927542 - DNA, 20 bp, Homo sapiens
ccccagactgagctctccag

SEQ ID NO: 927543 - DNA, 22 bp, Homo sapiens
ccccagactgagctctccaggc

SEQ ID NO: 927544 - DNA, 11 bp, Homo sapiens
ccccagactgg

SEQ ID NO: 927545 - DNA, 12 bp, Homo sapiens
ccccagactgta

SEQ ID NO: 927546 - DNA, 10 bp, Homo sapiens
ccccagagac

SEQ ID NO: 927547 - DNA, 21 bp, Homo sapiens
ccccagagactcagagggagg

SEQ ID NO: 927548 - DNA, 12 bp, Homo sapiens
ccccagagagac

SEQ ID NO: 927549 - DNA, 14 bp, Homo sapiens
ccccagagagcagg

SEQ ID NO: 927550 - DNA, 22 bp, Homo sapiens
ccccagagcacccccaagcctg

SEQ ID NO: 927551 - DNA, 23 bp, Homo sapiens
ccccagagcacccccaagcctgg

SEQ ID NO: 927552 - DNA, 16 bp, Homo sapiens
ccccagagccagggct

SEQ ID NO: 927553 - DNA, 22 bp, Homo sapiens
ccccagagccagggctgtcctt

SEQ ID NO: 927554 - DNA, 16 bp, Homo sapiens
ccccagagcccccggg

SEQ ID NO: 927555 - DNA, 12 bp, Homo sapiens
ccccagagctgt

SEQ ID NO: 927556 - DNA, 22 bp, Homo sapiens
ccccagagctgtttatggcctc

SEQ ID NO: 927557 - DNA, 17 bp, Homo sapiens
ccccagaggtggccctt

SEQ ID NO: 927558 - DNA, 15 bp, Homo sapiens
ccccagagtgctgtc

SEQ ID NO: 927559 - DNA, 22 bp, Homo sapiens
ccccagagtgggatccacttct

SEQ ID NO: 927560 - DNA, 20 bp, Homo sapiens
ccccagagtgtagggggcct

SEQ ID NO: 927561 - DNA, 22 bp, Homo sapiens
ccccagagtgtgggaagggaga

SEQ ID NO: 927562 - DNA, 18 bp, Homo sapiens
ccccagataccagcccct

SEQ ID NO: 927563 - DNA, 18 bp, Homo sapiens
ccccagatagagctgggt

SEQ ID NO: 927564 - DNA, 19 bp, Homo sapiens
ccccagcaacgcccctcca

SEQ ID NO: 927565 - DNA, 17 bp, Homo sapiens
ccccagcaagcgggagc

SEQ ID NO: 927566 - DNA, 22 bp, Homo sapiens
ccccagcaattatgaaaataat

SEQ ID NO: 927567 - DNA, 15 bp, Homo sapiens
ccccagcacagccac

SEQ ID NO: 927568 - DNA, 19 bp, Homo sapiens
ccccagcacagccacctcc

SEQ ID NO: 927569 - DNA, 14 bp, Homo sapiens
ccccagcagaatgg

SEQ ID NO: 927570 - DNA, 12 bp, Homo sapiens
ccccagcaggtg

SEQ ID NO: 927571 - DNA, 20 bp, Homo sapiens
ccccagcatcgggggcctgc

SEQ ID NO: 927572 - DNA, 21 bp, Homo sapiens
ccccagcatcgggggcctgca

SEQ ID NO: 927573 - DNA, 19 bp, Homo sapiens
ccccagcattccagctctg

SEQ ID NO: 927574 - DNA, 22 bp, Homo sapiens
ccccagcattccagctctgccc

SEQ ID NO: 927575 - DNA, 19 bp, Homo sapiens
ccccagcatttccagagca

SEQ ID NO: 927576 - DNA, 11 bp, Homo sapiens
ccccagccaga

SEQ ID NO: 927577 - DNA, 14 bp, Homo sapiens
ccccagccagccct

SEQ ID NO: 927578 - DNA, 23 bp, Homo sapiens
ccccagccatgccagctggcctt

SEQ ID NO: 927579 - DNA, 22 bp, Homo sapiens
ccccagcccaaaggggacaggc

SEQ ID NO: 927580 - DNA, 13 bp, Homo sapiens
ccccagcccacag

SEQ ID NO: 927581 - DNA, 12 bp, Homo sapiens
ccccagcccagg

SEQ ID NO: 927582 - DNA, 20 bp, Homo sapiens
ccccagcccagggctcctgc

SEQ ID NO: 927583 - DNA, 17 bp, Homo sapiens
ccccagccccagcccct

SEQ ID NO: 927584 - DNA, 18 bp, Homo sapiens
ccccagccccgactccag

SEQ ID NO: 927585 - DNA, 19 bp, Homo sapiens
ccccagccccgactccagc

SEQ ID NO: 927586 - DNA, 13 bp, Homo sapiens
ccccagccccggg

SEQ ID NO: 927587 - DNA, 21 bp, Homo sapiens
ccccagccccttctcccagca

SEQ ID NO: 927588 - DNA, 20 bp, Homo sapiens
ccccagccctaatctcaccc

SEQ ID NO: 927589 - DNA, 14 bp, Homo sapiens
ccccagccctcagt

SEQ ID NO: 927590 - DNA, 11 bp, Homo sapiens
ccccagccctg

SEQ ID NO: 927591 - DNA, 14 bp, Homo sapiens
ccccagccctgctg

SEQ ID NO: 927592 - DNA, 16 bp, Homo sapiens
ccccagccctgctggg

SEQ ID NO: 927593 - DNA, 20 bp, Homo sapiens
ccccagccctgctggggatc

SEQ ID NO: 927594 - DNA, 15 bp, Homo sapiens
ccccagccctgggaa

SEQ ID NO: 927595 - DNA, 16 bp, Homo sapiens
ccccagccctgggaac

SEQ ID NO: 927596 - DNA, 23 bp, Homo sapiens
ccccagcccttagcacagagagg

SEQ ID NO: 927597 - DNA, 15 bp, Homo sapiens
ccccagcccttctgc

SEQ ID NO: 927598 - DNA, 21 bp, Homo sapiens
ccccagcctaagatgaagagg

SEQ ID NO: 927599 - DNA, 23 bp, Homo sapiens
ccccagcctatgagcatcctgag

SEQ ID NO: 927600 - DNA, 17 bp, Homo sapiens
ccccagcctcattgtgc

SEQ ID NO: 927601 - DNA, 22 bp, Homo sapiens
ccccagcctcattgtgccaagc

SEQ ID NO: 927602 - DNA, 23 bp, Homo sapiens
ccccagcctcattgtgccaagcc

SEQ ID NO: 927603 - DNA, 11 bp, Homo sapiens
ccccagcctcc

SEQ ID NO: 927604 - DNA, 15 bp, Homo sapiens
ccccagcctccagag

SEQ ID NO: 927605 - DNA, 14 bp, Homo sapiens
gacccagtcccaca

SEQ ID NO: 927606 - DNA, 16 bp, Homo sapiens
gacccagtcccacact

SEQ ID NO: 927607 - DNA, 23 bp, Homo sapiens
gacccagtcccacactgtggcca

SEQ ID NO: 927608 - DNA, 15 bp, Homo sapiens
gacccagtccctggg

SEQ ID NO: 927609 - DNA, 12 bp, Homo sapiens
gacccagtgaga

SEQ ID NO: 927610 - DNA, 19 bp, Homo sapiens
gacccagtgcactccggtc

SEQ ID NO: 927611 - DNA, 20 bp, Homo sapiens
gacccatgtaatccttttgt

SEQ ID NO: 927612 - DNA, 14 bp, Homo sapiens
gacccatgtgctgg

SEQ ID NO: 927613 - DNA, 15 bp, Homo sapiens
gacccatgtgctggg

SEQ ID NO: 927614 - DNA, 19 bp, Homo sapiens
gaccccaaagagcctggag

SEQ ID NO: 927615 - DNA, 15 bp, Homo sapiens
gaccccacatccttc

SEQ ID NO: 927616 - DNA, 23 bp, Homo sapiens
gaccccacgtgcgacagagagag

SEQ ID NO: 927617 - DNA, 18 bp, Homo sapiens
gaccccacttatgctgct

SEQ ID NO: 927618 - DNA, 19 bp, Homo sapiens
gaccccacttatgctgctg

SEQ ID NO: 927619 - DNA, 20 bp, Homo sapiens
gaccccacttatgctgctgt

SEQ ID NO: 927620 - DNA, 18 bp, Homo sapiens
gaccccagactgtagaga

SEQ ID NO: 927621 - DNA, 14 bp, Homo sapiens
gaccccagctctgc

SEQ ID NO: 927622 - DNA, 13 bp, Homo sapiens
gaccccagggcag

SEQ ID NO: 927623 - DNA, 13 bp, Homo sapiens
gaccccagggcct

SEQ ID NO: 927624 - DNA, 15 bp, Homo sapiens
gaccccagggcctgt

SEQ ID NO: 927625 - DNA, 17 bp, Homo sapiens
gaccccaggtcagccct

SEQ ID NO: 927626 - DNA, 18 bp, Homo sapiens
gaccccaggtcagccctg

SEQ ID NO: 927627 - DNA, 22 bp, Homo sapiens
gaccccaggtcaggggctccct

SEQ ID NO: 927628 - DNA, 13 bp, Homo sapiens
gaccccagtttct

SEQ ID NO: 927629 - DNA, 22 bp, Homo sapiens
gaccccatcactcgcaggacca

SEQ ID NO: 927630 - DNA, 20 bp, Homo sapiens
gaccccattctgagctcccc

SEQ ID NO: 927631 - DNA, 13 bp, Homo sapiens
gacccccacacct

SEQ ID NO: 927632 - DNA, 13 bp, Homo sapiens
gacccccacccct

SEQ ID NO: 927633 - DNA, 14 bp, Homo sapiens
gacccccacccctt

SEQ ID NO: 927634 - DNA, 16 bp, Homo sapiens
gacccccaccccttcc

SEQ ID NO: 927635 - DNA, 18 bp, Homo sapiens
gacccccaccccttcccc

SEQ ID NO: 927636 - DNA, 18 bp, Homo sapiens
gacccccactctcattcc

SEQ ID NO: 927637 - DNA, 20 bp, Homo sapiens
gacccccagcaaccctccta

SEQ ID NO: 927638 - DNA, 13 bp, Homo sapiens
gacccccagctcc

SEQ ID NO: 927639 - DNA, 24 bp, Homo sapiens
gacccccaggcctgtccaccctgc

SEQ ID NO: 927640 - DNA, 18 bp, Homo sapiens
gacccccatttgtcccag

SEQ ID NO: 927641 - DNA, 23 bp, Homo sapiens
gaccccccccattagaatgtgat

SEQ ID NO: 927642 - DNA, 21 bp, Homo sapiens
gacccccccccaactccagga

SEQ ID NO: 927643 - DNA, 11 bp, Homo sapiens
gacccccgccc

SEQ ID NO: 927644 - DNA, 15 bp, Homo sapiens
gacccccgccccctg

SEQ ID NO: 927645 - DNA, 19 bp, Homo sapiens
gacccccgccccctgccct

SEQ ID NO: 927646 - DNA, 14 bp, Homo sapiens
gaccccctcgccag

SEQ ID NO: 927647 - DNA, 14 bp, Homo sapiens
gaccccgcactgca

SEQ ID NO: 927648 - DNA, 15 bp, Homo sapiens
gaccccgtggctctg

SEQ ID NO: 927649 - DNA, 15 bp, Homo sapiens
ccccaggcctctgtg

SEQ ID NO: 927650 - DNA, 13 bp, Homo sapiens
ccccaggcctgga

SEQ ID NO: 927651 - DNA, 19 bp, Homo sapiens
ccccaggcctggctccccg

SEQ ID NO: 927652 - DNA, 15 bp, Homo sapiens
ccccaggcctgtcca

SEQ ID NO: 927653 - DNA, 16 bp, Homo sapiens
ccccaggcctgtccac

SEQ ID NO: 927654 - DNA, 18 bp, Homo sapiens
ccccaggctcgtggactg

SEQ ID NO: 927655 - DNA, 21 bp, Homo sapiens
ccccaggcttccgcgcccagc

SEQ ID NO: 927656 - DNA, 18 bp, Homo sapiens
ccccagggaaggaaaaat

SEQ ID NO: 927657 - DNA, 20 bp, Homo sapiens
ccccagggacagaggccaag

SEQ ID NO: 927658 - DNA, 21 bp, Homo sapiens
ccccagggacagaggccaagg

SEQ ID NO: 927659 - DNA, 14 bp, Homo sapiens
ccccagggagctct

SEQ ID NO: 927660 - DNA, 18 bp, Homo sapiens
ccccagggagctctgggg

SEQ ID NO: 927661 - DNA, 22 bp, Homo sapiens
ccccagggcccctccctctgcc

SEQ ID NO: 927662 - DNA, 11 bp, Homo sapiens
ccccagggcct

SEQ ID NO: 927663 - DNA, 14 bp, Homo sapiens
ccccagggcctcca

SEQ ID NO: 927664 - DNA, 22 bp, Homo sapiens
ccccagggcctgcttccccttc

SEQ ID NO: 927665 - DNA, 17 bp, Homo sapiens
ccccagggcctgggggc

SEQ ID NO: 927666 - DNA, 14 bp, Homo sapiens
ccccagggctagtg

SEQ ID NO: 927667 - DNA, 19 bp, Homo sapiens
ccccagggctatagcagaa

SEQ ID NO: 927668 - DNA, 17 bp, Homo sapiens
ccccaggggaaaatgaa

SEQ ID NO: 927669 - DNA, 20 bp, Homo sapiens
ccccaggggaaagatgagct

SEQ ID NO: 927670 - DNA, 22 bp, Homo sapiens
ccccaggggacgtgggccctgc

SEQ ID NO: 927671 - DNA, 13 bp, Homo sapiens
ccccaggggcagc

SEQ ID NO: 927672 - DNA, 17 bp, Homo sapiens
ccccaggggtcccagcc

SEQ ID NO: 927673 - DNA, 19 bp, Homo sapiens
ccccaggggtcccagccac

SEQ ID NO: 927674 - DNA, 22 bp, Homo sapiens
ccccaggggtcccagccacccc

SEQ ID NO: 927675 - DNA, 18 bp, Homo sapiens
ccccagggtagccatggc

SEQ ID NO: 927676 - DNA, 19 bp, Homo sapiens
ccccagggtcctaaaactt

SEQ ID NO: 927677 - DNA, 16 bp, Homo sapiens
ccccaggtcagccctg

SEQ ID NO: 927678 - DNA, 18 bp, Homo sapiens
ccccaggtcaggggctcc

SEQ ID NO: 927679 - DNA, 14 bp, Homo sapiens
ccccaggtccccaa

SEQ ID NO: 927680 - DNA, 20 bp, Homo sapiens
ccccaggtcttcctgctttc

SEQ ID NO: 927681 - DNA, 13 bp, Homo sapiens
ccccaggtggctg

SEQ ID NO: 927682 - DNA, 21 bp, Homo sapiens
ccccaggtggctgacccagtc

SEQ ID NO: 927683 - DNA, 20 bp, Homo sapiens
ccccagtacctccaagcaag

SEQ ID NO: 927684 - DNA, 17 bp, Homo sapiens
ccccagtccccagccct

SEQ ID NO: 927685 - DNA, 19 bp, Homo sapiens
ccccagtccccagccctgg

SEQ ID NO: 927686 - DNA, 14 bp, Homo sapiens
ccccagtctcccca

SEQ ID NO: 927687 - DNA, 14 bp, Homo sapiens
ccccagtcttcctt

SEQ ID NO: 927688 - DNA, 15 bp, Homo sapiens
ccccagtgcctgcca

SEQ ID NO: 927689 - DNA, 16 bp, Homo sapiens
ccccagtgcctgccac

SEQ ID NO: 927690 - DNA, 17 bp, Homo sapiens
ccccagtgcctgccact

SEQ ID NO: 927691 - DNA, 19 bp, Homo sapiens
ccccagtgcctgccactct

SEQ ID NO: 927692 - DNA, 13 bp, Homo sapiens
ccccagtgcgctc

SEQ ID NO: 927693 - DNA, 20 bp, Homo sapiens
ccccagtgcggacccttccc

SEQ ID NO: 927694 - DNA, 15 bp, Homo sapiens
ccccagtgctggaag

SEQ ID NO: 927695 - DNA, 13 bp, Homo sapiens
ccccagtggggac

SEQ ID NO: 927696 - DNA, 15 bp, Homo sapiens
ccccagtggggacag

SEQ ID NO: 927697 - DNA, 16 bp, Homo sapiens
ccccagtgtattttgt

SEQ ID NO: 927698 - DNA, 21 bp, Homo sapiens
ccccagttcagtctgtaggga

SEQ ID NO: 927699 - DNA, 15 bp, Homo sapiens
ccccagttcctatga

SEQ ID NO: 927700 - DNA, 17 bp, Homo sapiens
ccccagttctgctcctc

SEQ ID NO: 927701 - DNA, 19 bp, Homo sapiens
ccccagttctgctcctctc

SEQ ID NO: 927702 - DNA, 20 bp, Homo sapiens
ccccagttctgctcctctcc

SEQ ID NO: 927703 - DNA, 18 bp, Homo sapiens
ccccagtttggggtgcca

SEQ ID NO: 927704 - DNA, 15 bp, Homo sapiens
ccccatacacacaca

SEQ ID NO: 927705 - DNA, 13 bp, Homo sapiens
ccccatcagctcc

SEQ ID NO: 927706 - DNA, 16 bp, Homo sapiens
ccccatcagctcccaa

SEQ ID NO: 927707 - DNA, 13 bp, Homo sapiens
ccccatcccaggg

SEQ ID NO: 927708 - DNA, 19 bp, Homo sapiens
ccccatccccttcctaaat

SEQ ID NO: 927709 - DNA, 17 bp, Homo sapiens
ccccatcccctttacta

SEQ ID NO: 927710 - DNA, 15 bp, Homo sapiens
ccccatcccctttcc

SEQ ID NO: 927711 - DNA, 18 bp, Homo sapiens
ccccatccctaccactgt

SEQ ID NO: 927712 - DNA, 12 bp, Homo sapiens
ccccatccctcg

SEQ ID NO: 927713 - DNA, 14 bp, Homo sapiens
ccccatccctgctt

SEQ ID NO: 927714 - DNA, 14 bp, Homo sapiens
ccccatcctcatcc

SEQ ID NO: 927715 - DNA, 16 bp, Homo sapiens
ccccatcctcatccct

SEQ ID NO: 927716 - DNA, 15 bp, Homo sapiens
ccccatcctccagca

SEQ ID NO: 927717 - DNA, 15 bp, Homo sapiens
ccccatcggccctgt

SEQ ID NO: 927718 - DNA, 22 bp, Homo sapiens
ccccatcggccctgtcccctgg

SEQ ID NO: 927719 - DNA, 17 bp, Homo sapiens
ccccatctcatcctggc

SEQ ID NO: 927720 - DNA, 23 bp, Homo sapiens
ccccatctcatgcccctggctgg

SEQ ID NO: 927721 - DNA, 17 bp, Homo sapiens
ccccatctccctgcctg

SEQ ID NO: 927722 - DNA, 14 bp, Homo sapiens
ccccatctctacta

SEQ ID NO: 927723 - DNA, 12 bp, Homo sapiens
ccccatctctcc

SEQ ID NO: 927724 - DNA, 13 bp, Homo sapiens
ccccatctctgtc

SEQ ID NO: 927725 - DNA, 15 bp, Homo sapiens
ccccatctctgtctg

SEQ ID NO: 927726 - DNA, 13 bp, Homo sapiens
ccccatctgtctt

SEQ ID NO: 927727 - DNA, 16 bp, Homo sapiens
ccccatcttccacctg

SEQ ID NO: 927728 - DNA, 16 bp, Homo sapiens
gaccctgggagagaag

SEQ ID NO: 927729 - DNA, 14 bp, Homo sapiens
gaccctgggcaagt

SEQ ID NO: 927730 - DNA, 18 bp, Homo sapiens
gaccctggggcaggggtg

SEQ ID NO: 927731 - DNA, 20 bp, Homo sapiens
gaccctggtgacctcctgtc

SEQ ID NO: 927732 - DNA, 21 bp, Homo sapiens
gaccctggtttttttcctgtg

SEQ ID NO: 927733 - DNA, 12 bp, Homo sapiens
gaccctgtctca

SEQ ID NO: 927734 - DNA, 20 bp, Homo sapiens
gaccctgtgacatggtgcct

SEQ ID NO: 927735 - DNA, 21 bp, Homo sapiens
gaccctgtgacatggtgcctg

SEQ ID NO: 927736 - DNA, 16 bp, Homo sapiens
gaccctgtttctgtag

SEQ ID NO: 927737 - DNA, 21 bp, Homo sapiens
gacccttgacacctgctgaga

SEQ ID NO: 927738 - DNA, 14 bp, Homo sapiens
gacccttgcctgcc

SEQ ID NO: 927739 - DNA, 19 bp, Homo sapiens
gacccttgcctgcctccta

SEQ ID NO: 927740 - DNA, 16 bp, Homo sapiens
gacccttggaaaacaa

SEQ ID NO: 927741 - DNA, 14 bp, Homo sapiens
gaccctttcctccc

SEQ ID NO: 927742 - DNA, 21 bp, Homo sapiens
gaccctttccttccttccctg

SEQ ID NO: 927743 - DNA, 23 bp, Homo sapiens
gaccctttccttccttccctggc

SEQ ID NO: 927744 - DNA, 22 bp, Homo sapiens
gaccctttgcctttcttctgcc

SEQ ID NO: 927745 - DNA, 19 bp, Homo sapiens
gaccgaactgttgtataaa

SEQ ID NO: 927746 - DNA, 14 bp, Homo sapiens
gaccgactacccca

SEQ ID NO: 927747 - DNA, 15 bp, Homo sapiens
gaccgactttcccca

SEQ ID NO: 927748 - DNA, 17 bp, Homo sapiens
gaccgaggctggagctg

SEQ ID NO: 927749 - DNA, 19 bp, Homo sapiens
gaccgatgtgtctcccaga

SEQ ID NO: 927750 - DNA, 19 bp, Homo sapiens
gaccgattatgctttcttt

SEQ ID NO: 927751 - DNA, 21 bp, Homo sapiens
gaccgattatgctttctttgg

SEQ ID NO: 927752 - DNA, 13 bp, Homo sapiens
gaccgcagaggga

SEQ ID NO: 927753 - DNA, 14 bp, Homo sapiens
gaccgcccagctct

SEQ ID NO: 927754 - DNA, 14 bp, Homo sapiens
gaccgccccagggc

SEQ ID NO: 927755 - DNA, 14 bp, Homo sapiens
gaccgccccctcct

SEQ ID NO: 927756 - DNA, 16 bp, Homo sapiens
gaccgccgatcccagg

SEQ ID NO: 927757 - DNA, 12 bp, Homo sapiens
gaccgcctggcc

SEQ ID NO: 927758 - DNA, 18 bp, Homo sapiens
gaccgcctggccctccct

SEQ ID NO: 927759 - DNA, 16 bp, Homo sapiens
gaccgcgtagagagcc

SEQ ID NO: 927760 - DNA, 18 bp, Homo sapiens
gaccgcttcacccctgca

SEQ ID NO: 927761 - DNA, 18 bp, Homo sapiens
gaccgcttgtttcttgtt

SEQ ID NO: 927762 - DNA, 18 bp, Homo sapiens
gaccgggggctgctgggc

SEQ ID NO: 927763 - DNA, 20 bp, Homo sapiens
gaccgggggctgctgggcgt

SEQ ID NO: 927764 - DNA, 18 bp, Homo sapiens
gaccgggtgggcctggcc

SEQ ID NO: 927765 - DNA, 16 bp, Homo sapiens
gaccggtgctgcagga

SEQ ID NO: 927766 - DNA, 14 bp, Homo sapiens
gaccgtactctcac

SEQ ID NO: 927767 - DNA, 22 bp, Homo sapiens
gaccgtatacttaaaatgacaa

SEQ ID NO: 927768 - DNA, 21 bp, Homo sapiens
gaccgtgccccacctccccac

SEQ ID NO: 927769 - DNA, 13 bp, Homo sapiens
gaccgtgtacaat

SEQ ID NO: 927770 - DNA, 19 bp, Homo sapiens
gaccgttttcatcctggcc

SEQ ID NO: 927771 - DNA, 17 bp, Homo sapiens
gaccgttttgtattgct

SEQ ID NO: 927772 - DNA, 22 bp, Homo sapiens
gacctaaagcattttttaaaag

SEQ ID NO: 927773 - DNA, 16 bp, Homo sapiens
gacctaaatggcctca

SEQ ID NO: 927774 - DNA, 13 bp, Homo sapiens
gacctaaattcgt

SEQ ID NO: 927775 - DNA, 16 bp, Homo sapiens
gacctaagtcaggtaa

SEQ ID NO: 927776 - DNA, 21 bp, Homo sapiens
gacctacagacagacatacat

SEQ ID NO: 927777 - DNA, 23 bp, Homo sapiens
cccccaataaaggcagctgcctc

SEQ ID NO: 927778 - DNA, 13 bp, Homo sapiens
cccccaatgtctg

SEQ ID NO: 927779 - DNA, 15 bp, Homo sapiens
cccccaccacactga

SEQ ID NO: 927780 - DNA, 15 bp, Homo sapiens
cccccaccactagga

SEQ ID NO: 927781 - DNA, 20 bp, Homo sapiens
cccccaccaggggaaggaag

SEQ ID NO: 927782 - DNA, 11 bp, Homo sapiens
cccccacccac

SEQ ID NO: 927783 - DNA, 16 bp, Homo sapiens
cccccacccaccccca

SEQ ID NO: 927784 - DNA, 19 bp, Homo sapiens
cccccacccacccccaggc

SEQ ID NO: 927785 - DNA, 21 bp, Homo sapiens
cccccacccacccccaggcct

SEQ ID NO: 927786 - DNA, 22 bp, Homo sapiens
cccccacccacccccaggcctc

SEQ ID NO: 927787 - DNA, 13 bp, Homo sapiens
cccccacccacct

SEQ ID NO: 927788 - DNA, 15 bp, Homo sapiens
cccccacccccagct

SEQ ID NO: 927789 - DNA, 20 bp, Homo sapiens
cccccaccccggggaccctg

SEQ ID NO: 927790 - DNA, 17 bp, Homo sapiens
cccccaccccttcccca

SEQ ID NO: 927791 - DNA, 20 bp, Homo sapiens
cccccaccggtccagctggc

SEQ ID NO: 927792 - DNA, 21 bp, Homo sapiens
cccccaccggtccagctggcc

SEQ ID NO: 927793 - DNA, 17 bp, Homo sapiens
cccccactcagtgcctc

SEQ ID NO: 927794 - DNA, 21 bp, Homo sapiens
cccccactctcattccccagg

SEQ ID NO: 927795 - DNA, 22 bp, Homo sapiens
cccccactctctcacccaccag

SEQ ID NO: 927796 - DNA, 20 bp, Homo sapiens
cccccactggtgagacagtt

SEQ ID NO: 927797 - DNA, 16 bp, Homo sapiens
cccccagaaagcctcc

SEQ ID NO: 927798 - DNA, 17 bp, Homo sapiens
cccccagaaagctgcca

SEQ ID NO: 927799 - DNA, 15 bp, Homo sapiens
cccccagactctttt

SEQ ID NO: 927800 - DNA, 22 bp, Homo sapiens
cccccagagccagggctgtcct

SEQ ID NO: 927801 - DNA, 17 bp, Homo sapiens
cccccagaggtggccct

SEQ ID NO: 927802 - DNA, 21 bp, Homo sapiens
cccccagatagagctgggtgg

SEQ ID NO: 927803 - DNA, 16 bp, Homo sapiens
cccccagcaaccctcc

SEQ ID NO: 927804 - DNA, 11 bp, Homo sapiens
cccccagcact

SEQ ID NO: 927805 - DNA, 12 bp, Homo sapiens
cccccagcatcg

SEQ ID NO: 927806 - DNA, 21 bp, Homo sapiens
cccccagcatcgggggcctgc

SEQ ID NO: 927807 - DNA, 15 bp, Homo sapiens
cccccagccaaactg

SEQ ID NO: 927808 - DNA, 14 bp, Homo sapiens
cccccagccaggct

SEQ ID NO: 927809 - DNA, 21 bp, Homo sapiens
cccccagccatgccagctggc

SEQ ID NO: 927810 - DNA, 21 bp, Homo sapiens
cccccagcccagggctcctgc

SEQ ID NO: 927811 - DNA, 16 bp, Homo sapiens
cccccagccctgggaa

SEQ ID NO: 927812 - DNA, 14 bp, Homo sapiens
cccccagccctgtg

SEQ ID NO: 927813 - DNA, 23 bp, Homo sapiens
cccccagcctatgagcatcctga

SEQ ID NO: 927814 - DNA, 16 bp, Homo sapiens
cccccagcctccagag

SEQ ID NO: 927815 - DNA, 11 bp, Homo sapiens
cccccagcctg

SEQ ID NO: 927816 - DNA, 14 bp, Homo sapiens
cccccagcctggcc

SEQ ID NO: 927817 - DNA, 22 bp, Homo sapiens
cccccagcgtcagtttcactcc

SEQ ID NO: 927818 - DNA, 12 bp, Homo sapiens
cccccagctccc

SEQ ID NO: 927819 - DNA, 15 bp, Homo sapiens
cccccagctccggcc

SEQ ID NO: 927820 - DNA, 14 bp, Homo sapiens
cccccagctctggt

SEQ ID NO: 927821 - DNA, 23 bp, Homo sapiens
cccccagctgactgttggctctc

SEQ ID NO: 927822 - DNA, 12 bp, Homo sapiens
cccccagctgcg

SEQ ID NO: 927823 - DNA, 11 bp, Homo sapiens
cccccagctgg

SEQ ID NO: 927824 - DNA, 16 bp, Homo sapiens
cccccaggattccccc

SEQ ID NO: 927825 - DNA, 15 bp, Homo sapiens
cccccaggcagccac

SEQ ID NO: 927826 - DNA, 16 bp, Homo sapiens
cccccaggcagccacc

SEQ ID NO: 927827 - DNA, 12 bp, Homo sapiens
cccccaggccag

SEQ ID NO: 927828 - DNA, 14 bp, Homo sapiens
cccccaggccctac

SEQ ID NO: 927829 - DNA, 20 bp, Homo sapiens
cccccaggtcttcctgcttt

SEQ ID NO: 927830 - DNA, 21 bp, Homo sapiens
cccccaggtcttcctgctttc

SEQ ID NO: 927831 - DNA, 22 bp, Homo sapiens
cccccaggtcttcctgctttcc

SEQ ID NO: 927832 - DNA, 18 bp, Homo sapiens
cccccaggtgttgccatt

SEQ ID NO: 927833 - DNA, 14 bp, Homo sapiens
cccccagtacctcc

SEQ ID NO: 927834 - DNA, 15 bp, Homo sapiens
cccccagtacctcca

SEQ ID NO: 927835 - DNA, 15 bp, Homo sapiens
cccccagtccccacc

SEQ ID NO: 927836 - DNA, 14 bp, Homo sapiens
cccccagtgcgctc

SEQ ID NO: 927837 - DNA, 22 bp, Homo sapiens
cccccagtgtattttgtccaag

SEQ ID NO: 927838 - DNA, 22 bp, Homo sapiens
cccccagttcagtctgtaggga

SEQ ID NO: 927839 - DNA, 21 bp, Homo sapiens
cccccatagcaccctgccctc

SEQ ID NO: 927840 - DNA, 11 bp, Homo sapiens
cccccatccca

SEQ ID NO: 927841 - DNA, 17 bp, Homo sapiens
cccccatctccccaggc

SEQ ID NO: 927842 - DNA, 15 bp, Homo sapiens
cccccatctctgagt

SEQ ID NO: 927843 - DNA, 11 bp, Homo sapiens
cccccatgctg

SEQ ID NO: 927844 - DNA, 15 bp, Homo sapiens
cccccatgctgcctt

SEQ ID NO: 927845 - DNA, 19 bp, Homo sapiens
cccccatggggtccttgga

SEQ ID NO: 927846 - DNA, 13 bp, Homo sapiens
cccccatgtggca

SEQ ID NO: 927847 - DNA, 14 bp, Homo sapiens
cccccatgtggctg

SEQ ID NO: 927848 - DNA, 23 bp, Homo sapiens
cccccatgttgtaatgctgcact

SEQ ID NO: 927849 - DNA, 13 bp, Homo sapiens
cccccattctccc

SEQ ID NO: 927850 - DNA, 16 bp, Homo sapiens
gacctgagtcggcccc

SEQ ID NO: 927851 - DNA, 21 bp, Homo sapiens
gacctgagtcggccccacatg

SEQ ID NO: 927852 - DNA, 20 bp, Homo sapiens
gacctgcactggggagcccg

SEQ ID NO: 927853 - DNA, 20 bp, Homo sapiens
gacctgcaggccaagagcag

SEQ ID NO: 927854 - DNA, 19 bp, Homo sapiens
gacctgccaccagggagct

SEQ ID NO: 927855 - DNA, 17 bp, Homo sapiens
gacctgccaggcagggg

SEQ ID NO: 927856 - DNA, 19 bp, Homo sapiens
gacctgccaggcaggggtg

SEQ ID NO: 927857 - DNA, 21 bp, Homo sapiens
gacctgccccgcccagctgca

SEQ ID NO: 927858 - DNA, 21 bp, Homo sapiens
gacctgccccggacctacctc

SEQ ID NO: 927859 - DNA, 23 bp, Homo sapiens
gacctgccccggacctacctccc

SEQ ID NO: 927860 - DNA, 22 bp, Homo sapiens
gacctgcctcctgcctgcccct

SEQ ID NO: 927861 - DNA, 23 bp, Homo sapiens
gacctgcctcctgcctgcccctc

SEQ ID NO: 927862 - DNA, 20 bp, Homo sapiens
gacctgcgggtcctcagctg

SEQ ID NO: 927863 - DNA, 21 bp, Homo sapiens
gacctgcgggtcctcagctgc

SEQ ID NO: 927864 - DNA, 20 bp, Homo sapiens
gacctgctcatcatattcca

SEQ ID NO: 927865 - DNA, 19 bp, Homo sapiens
gacctgctccgccaggaaa

SEQ ID NO: 927866 - DNA, 19 bp, Homo sapiens
gacctgctccgctgctcct

SEQ ID NO: 927867 - DNA, 21 bp, Homo sapiens
gacctgctccgctgctccttg

SEQ ID NO: 927868 - DNA, 15 bp, Homo sapiens
gacctgctgaattgt

SEQ ID NO: 927869 - DNA, 19 bp, Homo sapiens
gacctgctgacctgtgcac

SEQ ID NO: 927870 - DNA, 17 bp, Homo sapiens
gacctgcttagctgcct

SEQ ID NO: 927871 - DNA, 14 bp, Homo sapiens
gacctggaaccaga

SEQ ID NO: 927872 - DNA, 17 bp, Homo sapiens
gacctggaaccagagcc

SEQ ID NO: 927873 - DNA, 11 bp, Homo sapiens
gacctggacaa

SEQ ID NO: 927874 - DNA, 13 bp, Homo sapiens
gacctggagcccc

SEQ ID NO: 927875 - DNA, 17 bp, Homo sapiens
gacctggagcccctggg

SEQ ID NO: 927876 - DNA, 20 bp, Homo sapiens
gacctggagcccctgggtgg

SEQ ID NO: 927877 - DNA, 15 bp, Homo sapiens
gacctggataactta

SEQ ID NO: 927878 - DNA, 20 bp, Homo sapiens
gacctggatagttaagggct

SEQ ID NO: 927879 - DNA, 22 bp, Homo sapiens
gacctggcactggatgcagaaa

SEQ ID NO: 927880 - DNA, 17 bp, Homo sapiens
gacctggcactgggagg

SEQ ID NO: 927881 - DNA, 20 bp, Homo sapiens
gacctggccccaggctgtca

SEQ ID NO: 927882 - DNA, 17 bp, Homo sapiens
gacctgggaacgactgg

SEQ ID NO: 927883 - DNA, 16 bp, Homo sapiens
gacctgggatttgaga

SEQ ID NO: 927884 - DNA, 18 bp, Homo sapiens
gacctgggcccacagagc

SEQ ID NO: 927885 - DNA, 20 bp, Homo sapiens
gacctgggcccacagagcct

SEQ ID NO: 927886 - DNA, 21 bp, Homo sapiens
gacctgggcccacagagcctg

SEQ ID NO: 927887 - DNA, 22 bp, Homo sapiens
gacctgggcccacagagcctgg

SEQ ID NO: 927888 - DNA, 21 bp, Homo sapiens
gacctggggcacagtccagga

SEQ ID NO: 927889 - DNA, 22 bp, Homo sapiens
gacctgggtatcccctgcctcc

SEQ ID NO: 927890 - DNA, 17 bp, Homo sapiens
gacctggtaccctcctg

SEQ ID NO: 927891 - DNA, 19 bp, Homo sapiens
gacctggtaccctcctggc

SEQ ID NO: 927892 - DNA, 21 bp, Homo sapiens
gacctggtaccctcctggctc

SEQ ID NO: 927893 - DNA, 23 bp, Homo sapiens
gacctggtaccctcctggctctt

SEQ ID NO: 927894 - DNA, 18 bp, Homo sapiens
gacctggtgtgcggaggc

SEQ ID NO: 927895 - DNA, 16 bp, Homo sapiens
gacctggttcccactg

SEQ ID NO: 927896 - DNA, 18 bp, Homo sapiens
gacctggttcccactgag

SEQ ID NO: 927897 - DNA, 12 bp, Homo sapiens
gacctgtaatca

SEQ ID NO: 927898 - DNA, 19 bp, Homo sapiens
gacctgtcaccctgcagga

SEQ ID NO: 927899 - DNA, 12 bp, Homo sapiens
gacctgtccccc

SEQ ID NO: 927900 - DNA, 15 bp, Homo sapiens
gacctgtcccccact

SEQ ID NO: 927901 - DNA, 20 bp, Homo sapiens
gacctgtcccccactctctc

SEQ ID NO: 927902 - DNA, 21 bp, Homo sapiens
gacctgtcccccactctctca

SEQ ID NO: 927903 - DNA, 13 bp, Homo sapiens
gacctgtcttcca

SEQ ID NO: 927904 - DNA, 17 bp, Homo sapiens
ccccctcgccagcttgg

SEQ ID NO: 927905 - DNA, 19 bp, Homo sapiens
ccccctcggagcctgtgtt

SEQ ID NO: 927906 - DNA, 19 bp, Homo sapiens
ccccctctcacgccacccc

SEQ ID NO: 927907 - DNA, 13 bp, Homo sapiens
ccccctctcctcc

SEQ ID NO: 927908 - DNA, 24 bp, Homo sapiens
ccccctctccttctcctagctctg

SEQ ID NO: 927909 - DNA, 23 bp, Homo sapiens
ccccctctgccggtcgggcagcc

SEQ ID NO: 927910 - DNA, 19 bp, Homo sapiens
ccccctctggctccagctg

SEQ ID NO: 927911 - DNA, 21 bp, Homo sapiens
ccccctctggctccagctggc

SEQ ID NO: 927912 - DNA, 19 bp, Homo sapiens
ccccctcttcctccctggg

SEQ ID NO: 927913 - DNA, 21 bp, Homo sapiens
ccccctgcaaagcccagcttg

SEQ ID NO: 927914 - DNA, 14 bp, Homo sapiens
ccccctgccagccg

SEQ ID NO: 927915 - DNA, 21 bp, Homo sapiens
ccccctgccccccagcctctg

SEQ ID NO: 927916 - DNA, 12 bp, Homo sapiens
ccccctgccctc

SEQ ID NO: 927917 - DNA, 19 bp, Homo sapiens
ccccctgccctcgtggcca

SEQ ID NO: 927918 - DNA, 22 bp, Homo sapiens
ccccctgccctcgtggccagcc

SEQ ID NO: 927919 - DNA, 13 bp, Homo sapiens
ccccctgccctgt

SEQ ID NO: 927920 - DNA, 13 bp, Homo sapiens
ccccctgctgccc

SEQ ID NO: 927921 - DNA, 12 bp, Homo sapiens
ccccctggagag

SEQ ID NO: 927922 - DNA, 10 bp, Homo sapiens
ccccctgggc

SEQ ID NO: 927923 - DNA, 13 bp, Homo sapiens
ccccctgggctct

SEQ ID NO: 927924 - DNA, 22 bp, Homo sapiens
ccccctgggctggggcctcaga

SEQ ID NO: 927925 - DNA, 20 bp, Homo sapiens
ccccctggggcttctcctga

SEQ ID NO: 927926 - DNA, 21 bp, Homo sapiens
ccccctggggcttctcctgac

SEQ ID NO: 927927 - DNA, 12 bp, Homo sapiens
ccccctgtacac

SEQ ID NO: 927928 - DNA, 17 bp, Homo sapiens
ccccctgtcccattcta

SEQ ID NO: 927929 - DNA, 21 bp, Homo sapiens
ccccctgtgcagccgctgagc

SEQ ID NO: 927930 - DNA, 14 bp, Homo sapiens
cccccttctcccac

SEQ ID NO: 927931 - DNA, 17 bp, Homo sapiens
cccccttctctgctcca

SEQ ID NO: 927932 - DNA, 20 bp, Homo sapiens
cccccttgaagcaataactc

SEQ ID NO: 927933 - DNA, 15 bp, Homo sapiens
ccccctttgctgtga

SEQ ID NO: 927934 - DNA, 18 bp, Homo sapiens
ccccctttgctgtgagga

SEQ ID NO: 927935 - DNA, 18 bp, Homo sapiens
cccccttttctccccacg

SEQ ID NO: 927936 - DNA, 21 bp, Homo sapiens
ccccgaaatcagcccccagcc

SEQ ID NO: 927937 - DNA, 19 bp, Homo sapiens
ccccgaagggagcatctgt

SEQ ID NO: 927938 - DNA, 14 bp, Homo sapiens
ccccgacactgctg

SEQ ID NO: 927939 - DNA, 18 bp, Homo sapiens
ccccgacccccgcagagg

SEQ ID NO: 927940 - DNA, 12 bp, Homo sapiens
ccccgacggctg

SEQ ID NO: 927941 - DNA, 13 bp, Homo sapiens
ccccgacggctgt

SEQ ID NO: 927942 - DNA, 13 bp, Homo sapiens
ccccgactgcctg

SEQ ID NO: 927943 - DNA, 18 bp, Homo sapiens
ccccgagaagtgctcttg

SEQ ID NO: 927944 - DNA, 21 bp, Homo sapiens
ccccgagccctgactcctgga

SEQ ID NO: 927945 - DNA, 14 bp, Homo sapiens
ccccgaggctgccc

SEQ ID NO: 927946 - DNA, 19 bp, Homo sapiens
ccccgagggctcagaagag

SEQ ID NO: 927947 - DNA, 22 bp, Homo sapiens
ccccgagggctgaggagcagcc

SEQ ID NO: 927948 - DNA, 17 bp, Homo sapiens
ccccgaggtaggggtgg

SEQ ID NO: 927949 - DNA, 19 bp, Homo sapiens
ccccgaggttgtggggagg

SEQ ID NO: 927950 - DNA, 16 bp, Homo sapiens
ccccgcaccaagcaga

SEQ ID NO: 927951 - DNA, 14 bp, Homo sapiens
ccccgcacccccgc

SEQ ID NO: 927952 - DNA, 19 bp, Homo sapiens
ccccgcacccccgccaggc

SEQ ID NO: 927953 - DNA, 13 bp, Homo sapiens
ccccgcagcccgc

SEQ ID NO: 927954 - DNA, 12 bp, Homo sapiens
ccccgcagtccc

SEQ ID NO: 927955 - DNA, 18 bp, Homo sapiens
ccccgcagtccccagccc

SEQ ID NO: 927956 - DNA, 16 bp, Homo sapiens
ccccgccagggctggg

SEQ ID NO: 927957 - DNA, 15 bp, Homo sapiens
ccccgcccacccacg

SEQ ID NO: 927958 - DNA, 13 bp, Homo sapiens
ccccgccccaggc

SEQ ID NO: 927959 - DNA, 13 bp, Homo sapiens
ccccgccccccag

SEQ ID NO: 927960 - DNA, 14 bp, Homo sapiens
ccccgccccccaga

SEQ ID NO: 927961 - DNA, 15 bp, Homo sapiens
ccccgccccccagag

SEQ ID NO: 927962 - DNA, 13 bp, Homo sapiens
ccccgccccgccc

SEQ ID NO: 927963 - DNA, 16 bp, Homo sapiens
ccccgccccgccccac

SEQ ID NO: 927964 - DNA, 17 bp, Homo sapiens
ccccgccctcttcctga

SEQ ID NO: 927965 - DNA, 15 bp, Homo sapiens
ccccgcctccactct

SEQ ID NO: 927966 - DNA, 15 bp, Homo sapiens
ccccgcctgccaccg

SEQ ID NO: 927967 - DNA, 16 bp, Homo sapiens
ccccgcctggccagga

SEQ ID NO: 927968 - DNA, 12 bp, Homo sapiens
ccccgcctgtca

SEQ ID NO: 927969 - DNA, 15 bp, Homo sapiens
ccccgccttccctca

SEQ ID NO: 927970 - DNA, 15 bp, Homo sapiens
ccccgccttcctggg

SEQ ID NO: 927971 - DNA, 20 bp, Homo sapiens
ccccgccttcgtgtgctgct

SEQ ID NO: 927972 - DNA, 21 bp, Homo sapiens
ccccgccttcgtgtgctgctg

SEQ ID NO: 927973 - DNA, 18 bp, Homo sapiens
ccccgcgctcgcccagca

SEQ ID NO: 927974 - DNA, 22 bp, Homo sapiens
ccccgcgctcgcccagcaggag

SEQ ID NO: 927975 - DNA, 13 bp, Homo sapiens
ccccgcgggcttt

SEQ ID NO: 927976 - DNA, 18 bp, Homo sapiens
ccccgcggtgctctggcg

SEQ ID NO: 927977 - DNA, 12 bp, Homo sapiens
ccccgctcccac

SEQ ID NO: 927978 - DNA, 15 bp, Homo sapiens
ccccgcttgtccagc

SEQ ID NO: 927979 - DNA, 17 bp, Homo sapiens
ccccgcttgtccagcgc

SEQ ID NO: 927980 - DNA, 18 bp, Homo sapiens
ccccgcttgtccagcgcc

SEQ ID NO: 927981 - DNA, 22 bp, Homo sapiens
ccccggaggcgtggaggagagg

SEQ ID NO: 927982 - DNA, 13 bp, Homo sapiens
ccccggcaagcca

SEQ ID NO: 927983 - DNA, 16 bp, Homo sapiens
ccccggccccagccag

SEQ ID NO: 927984 - DNA, 18 bp, Homo sapiens
ccccggccccggccccag

SEQ ID NO: 927985 - DNA, 13 bp, Homo sapiens
ccccggccctacc

SEQ ID NO: 927986 - DNA, 16 bp, Homo sapiens
ccccggcctctctctt

SEQ ID NO: 927987 - DNA, 16 bp, Homo sapiens
ccccggcctttatgtt

SEQ ID NO: 927988 - DNA, 13 bp, Homo sapiens
ccccggctgggcc

SEQ ID NO: 927989 - DNA, 18 bp, Homo sapiens
ccccggctttcctccgga

SEQ ID NO: 927990 - DNA, 18 bp, Homo sapiens
ccccgggatcctgccccc

SEQ ID NO: 927991 - DNA, 19 bp, Homo sapiens
ccccgggatcctgccccca

SEQ ID NO: 927992 - DNA, 14 bp, Homo sapiens
ccccgggcctgcac

SEQ ID NO: 927993 - DNA, 15 bp, Homo sapiens
ccccgggctctctgc

SEQ ID NO: 927994 - DNA, 16 bp, Homo sapiens
ccccgggctctctgct

SEQ ID NO: 927995 - DNA, 17 bp, Homo sapiens
ccccgggctctggccac

SEQ ID NO: 927996 - DNA, 15 bp, Homo sapiens
ccccgggctggccct

SEQ ID NO: 927997 - DNA, 18 bp, Homo sapiens
ccccgggctggccctgtg

SEQ ID NO: 927998 - DNA, 21 bp, Homo sapiens
ccccgggctggccctgtgcag

SEQ ID NO: 927999 - DNA, 17 bp, Homo sapiens
ccccggggaccctgtga

SEQ ID NO: 928000 - DNA, 16 bp, Homo sapiens
ccccggggctggcaag

SEQ ID NO: 928001 - DNA, 22 bp, Homo sapiens
ccccggggtgagtccattctcc

SEQ ID NO: 928002 - DNA, 17 bp, Homo sapiens
ccccgggtgcctcagag

SEQ ID NO: 928003 - DNA, 20 bp, Homo sapiens
ccccggtcacctagcaagct

SEQ ID NO: 928004 - DNA, 21 bp, Homo sapiens
ccccgtcaccatctcaggcca

SEQ ID NO: 928005 - DNA, 14 bp, Homo sapiens
ccccgtcagctgct

SEQ ID NO: 928006 - DNA, 20 bp, Homo sapiens
ccccgtccccctctggctcc

SEQ ID NO: 928007 - DNA, 15 bp, Homo sapiens
ccccgtcccctaacc

SEQ ID NO: 928008 - DNA, 22 bp, Homo sapiens
ccccgtcccctaacccccagtc

SEQ ID NO: 928009 - DNA, 20 bp, Homo sapiens
ccccgtctggggttcagccc

SEQ ID NO: 928010 - DNA, 15 bp, Homo sapiens
ccccgtggctctggg

SEQ ID NO: 928011 - DNA, 16 bp, Homo sapiens
ccccgtggctctggga

SEQ ID NO: 928012 - DNA, 17 bp, Homo sapiens
ccccgtgttcccctctt

SEQ ID NO: 928013 - DNA, 22 bp, Homo sapiens
ccccgttggaagcgcagcagcg

SEQ ID NO: 928014 - DNA, 17 bp, Homo sapiens
cccctaaagatgggagg

SEQ ID NO: 928015 - DNA, 20 bp, Homo sapiens
cccctaaccctactttgctt

SEQ ID NO: 928016 - DNA, 15 bp, Homo sapiens
cccctaagactgcct

SEQ ID NO: 928017 - DNA, 18 bp, Homo sapiens
cccctaagactgccttca

SEQ ID NO: 928018 - DNA, 14 bp, Homo sapiens
cccctaatgtcagc

SEQ ID NO: 928019 - DNA, 12 bp, Homo sapiens
cccctacccacc

SEQ ID NO: 928020 - DNA, 15 bp, Homo sapiens
cccctacccatatcc

SEQ ID NO: 928021 - DNA, 20 bp, Homo sapiens
cccctaccccacaccaggcc

SEQ ID NO: 928022 - DNA, 14 bp, Homo sapiens
cccctaccccctca

SEQ ID NO: 928023 - DNA, 22 bp, Homo sapiens
cccctaccccctcctctctgcc

SEQ ID NO: 928024 - DNA, 16 bp, Homo sapiens
cccctacccctgccct

SEQ ID NO: 928025 - DNA, 12 bp, Homo sapiens
cccctactccct

SEQ ID NO: 928026 - DNA, 13 bp, Homo sapiens
cccctactgctgt

SEQ ID NO: 928027 - DNA, 13 bp, Homo sapiens
cccctagaaaccc

SEQ ID NO: 928028 - DNA, 16 bp, Homo sapiens
cccctagaaacccaag

SEQ ID NO: 928029 - DNA, 19 bp, Homo sapiens
cccctagaaacccaagctc

SEQ ID NO: 928030 - DNA, 20 bp, Homo sapiens
gacctgtcttccaaggagac

SEQ ID NO: 928031 - DNA, 15 bp, Homo sapiens
gacctgtgaccagca

SEQ ID NO: 928032 - DNA, 13 bp, Homo sapiens
gacctgtgctttg

SEQ ID NO: 928033 - DNA, 19 bp, Homo sapiens
gacctgttagcagacaggc

SEQ ID NO: 928034 - DNA, 17 bp, Homo sapiens
gacctgtttatgagatg

SEQ ID NO: 928035 - DNA, 14 bp, Homo sapiens
gaccttacaaatga

SEQ ID NO: 928036 - DNA, 21 bp, Homo sapiens
gaccttagaaatcattgtaga

SEQ ID NO: 928037 - DNA, 12 bp, Homo sapiens
gaccttagcgtt

SEQ ID NO: 928038 - DNA, 13 bp, Homo sapiens
gaccttaggcctt

SEQ ID NO: 928039 - DNA, 23 bp, Homo sapiens
gaccttccctccgccttctccca

SEQ ID NO: 928040 - DNA, 12 bp, Homo sapiens
gaccttcctgcc

SEQ ID NO: 928041 - DNA, 16 bp, Homo sapiens
gaccttcctgccacca

SEQ ID NO: 928042 - DNA, 15 bp, Homo sapiens
gaccttgacagagca

SEQ ID NO: 928043 - DNA, 15 bp, Homo sapiens
gaccttgagggtggg

SEQ ID NO: 928044 - DNA, 16 bp, Homo sapiens
gaccttgagggtgggc

SEQ ID NO: 928045 - DNA, 20 bp, Homo sapiens
gaccttgagggtgggccagc

SEQ ID NO: 928046 - DNA, 16 bp, Homo sapiens
gaccttgcaacttcat

SEQ ID NO: 928047 - DNA, 23 bp, Homo sapiens
gaccttgcaacttcatgtcaact

SEQ ID NO: 928048 - DNA, 13 bp, Homo sapiens
gaccttgctgcca

SEQ ID NO: 928049 - DNA, 17 bp, Homo sapiens
gaccttgggcacatctg

SEQ ID NO: 928050 - DNA, 13 bp, Homo sapiens
gaccttgggccaa

SEQ ID NO: 928051 - DNA, 13 bp, Homo sapiens
gaccttgggccta

SEQ ID NO: 928052 - DNA, 18 bp, Homo sapiens
gaccttggggtacaattg

SEQ ID NO: 928053 - DNA, 21 bp, Homo sapiens
gacctttaagaaaaatgaaaa

SEQ ID NO: 928054 - DNA, 21 bp, Homo sapiens
gacctttaggtcaaactccct

SEQ ID NO: 928055 - DNA, 15 bp, Homo sapiens
gacctttatttttct

SEQ ID NO: 928056 - DNA, 21 bp, Homo sapiens
gacctttcatcgtaaagtgct

SEQ ID NO: 928057 - DNA, 17 bp, Homo sapiens
gacctttccaccacagc

SEQ ID NO: 928058 - DNA, 18 bp, Homo sapiens
gacctttccaccacagcc

SEQ ID NO: 928059 - DNA, 19 bp, Homo sapiens
gacctttgggttctttctg

SEQ ID NO: 928060 - DNA, 20 bp, Homo sapiens
gacctttgggttctttctgg

SEQ ID NO: 928061 - DNA, 15 bp, Homo sapiens
gaccttttggtcttc

SEQ ID NO: 928062 - DNA, 19 bp, Homo sapiens
gaccttttggtcttcagcc

SEQ ID NO: 928063 - DNA, 20 bp, Homo sapiens
gacgagcatccccctcctct

SEQ ID NO: 928064 - DNA, 21 bp, Homo sapiens
gacgaggccactcagaggccc

SEQ ID NO: 928065 - DNA, 18 bp, Homo sapiens
gacgatcgcccaggctgg

SEQ ID NO: 928066 - DNA, 16 bp, Homo sapiens
gacgcacacagctgag

SEQ ID NO: 928067 - DNA, 19 bp, Homo sapiens
gacgcacacagctgagcac

SEQ ID NO: 928068 - DNA, 14 bp, Homo sapiens
gacgcagacagagg

SEQ ID NO: 928069 - DNA, 14 bp, Homo sapiens
gacgcagcagctgg

SEQ ID NO: 928070 - DNA, 22 bp, Homo sapiens
gacgcagcagctgggacccctc

SEQ ID NO: 928071 - DNA, 14 bp, Homo sapiens
gacgcaggccctgt

SEQ ID NO: 928072 - DNA, 18 bp, Homo sapiens
gacgcaggccctgtccag

SEQ ID NO: 928073 - DNA, 14 bp, Homo sapiens
gacgccaacttctc

SEQ ID NO: 928074 - DNA, 17 bp, Homo sapiens
gacgccaacttctccca

SEQ ID NO: 928075 - DNA, 16 bp, Homo sapiens
gacgccactcatttca

SEQ ID NO: 928076 - DNA, 19 bp, Homo sapiens
gacgccactcatttcatct

SEQ ID NO: 928077 - DNA, 23 bp, Homo sapiens
gacgccactcatttcatctcatt

SEQ ID NO: 928078 - DNA, 17 bp, Homo sapiens
gacgccactccctggga

SEQ ID NO: 928079 - DNA, 20 bp, Homo sapiens
gacgccactccctgggacac

SEQ ID NO: 928080 - DNA, 13 bp, Homo sapiens
gacgcccagctcc

SEQ ID NO: 928081 - DNA, 23 bp, Homo sapiens
gacgccctctccccacccctacc

SEQ ID NO: 928082 - DNA, 16 bp, Homo sapiens
gacgcctgagacagca

SEQ ID NO: 928083 - DNA, 19 bp, Homo sapiens
gacgcctgagacagcacca

SEQ ID NO: 928084 - DNA, 17 bp, Homo sapiens
gacgcctgcaggagaga

SEQ ID NO: 928085 - DNA, 18 bp, Homo sapiens
gacgcctgccctccccag

SEQ ID NO: 928086 - DNA, 23 bp, Homo sapiens
gacgcctgccctccccagagcac

SEQ ID NO: 928087 - DNA, 20 bp, Homo sapiens
gacgccttcatctgggacaa

SEQ ID NO: 928088 - DNA, 18 bp, Homo sapiens
gacgccttccaggtcagg

SEQ ID NO: 928089 - DNA, 13 bp, Homo sapiens
gacgcggaggagg

SEQ ID NO: 928090 - DNA, 14 bp, Homo sapiens
gacgcggaggagga

SEQ ID NO: 928091 - DNA, 14 bp, Homo sapiens
gacgcgtctcctgt

SEQ ID NO: 928092 - DNA, 14 bp, Homo sapiens
gacgctcttttcta

SEQ ID NO: 928093 - DNA, 18 bp, Homo sapiens
gacgctgccgctgccgct

SEQ ID NO: 928094 - DNA, 16 bp, Homo sapiens
cccctcccctggggac

SEQ ID NO: 928095 - DNA, 20 bp, Homo sapiens
cccctccctaccctcggaaa

SEQ ID NO: 928096 - DNA, 14 bp, Homo sapiens
cccctccctcgtgg

SEQ ID NO: 928097 - DNA, 15 bp, Homo sapiens
cccctccctcgtggg

SEQ ID NO: 928098 - DNA, 16 bp, Homo sapiens
cccctccctctgcccc

SEQ ID NO: 928099 - DNA, 17 bp, Homo sapiens
cccctccctctgcccca

SEQ ID NO: 928100 - DNA, 15 bp, Homo sapiens
cccctccctgcccaa

SEQ ID NO: 928101 - DNA, 14 bp, Homo sapiens
cccctccctgcctg

SEQ ID NO: 928102 - DNA, 14 bp, Homo sapiens
cccctccctgcttg

SEQ ID NO: 928103 - DNA, 18 bp, Homo sapiens
cccctccctgcttgcaca

SEQ ID NO: 928104 - DNA, 14 bp, Homo sapiens
cccctccctggctc

SEQ ID NO: 928105 - DNA, 12 bp, Homo sapiens
cccctccctggg

SEQ ID NO: 928106 - DNA, 14 bp, Homo sapiens
cccctccctgggtt

SEQ ID NO: 928107 - DNA, 13 bp, Homo sapiens
cccctccctgtcc

SEQ ID NO: 928108 - DNA, 15 bp, Homo sapiens
cccctcccttcaacc

SEQ ID NO: 928109 - DNA, 22 bp, Homo sapiens
cccctcctcacagttgccatgt

SEQ ID NO: 928110 - DNA, 17 bp, Homo sapiens
cccctcctccagcccct

SEQ ID NO: 928111 - DNA, 13 bp, Homo sapiens
cccctcctccagt

SEQ ID NO: 928112 - DNA, 14 bp, Homo sapiens
cccctcctccagta

SEQ ID NO: 928113 - DNA, 17 bp, Homo sapiens
cccctcctctagctgtg

SEQ ID NO: 928114 - DNA, 19 bp, Homo sapiens
cccctcctctagctgtggg

SEQ ID NO: 928115 - DNA, 18 bp, Homo sapiens
cccctcctctcccatccc

SEQ ID NO: 928116 - DNA, 13 bp, Homo sapiens
cccctcctctgcc

SEQ ID NO: 928117 - DNA, 23 bp, Homo sapiens
cccctcctcttcccttagcctct

SEQ ID NO: 928118 - DNA, 12 bp, Homo sapiens
cccctcctgcac

SEQ ID NO: 928119 - DNA, 12 bp, Homo sapiens
cccctcctgctc

SEQ ID NO: 928120 - DNA, 14 bp, Homo sapiens
cccctcctgctcct

SEQ ID NO: 928121 - DNA, 19 bp, Homo sapiens
cccctcctgctcctccctg

SEQ ID NO: 928122 - DNA, 15 bp, Homo sapiens
cccctcctgctgggc

SEQ ID NO: 928123 - DNA, 13 bp, Homo sapiens
cccctcctggcaa

SEQ ID NO: 928124 - DNA, 13 bp, Homo sapiens
cccctccttcaga

SEQ ID NO: 928125 - DNA, 22 bp, Homo sapiens
cccctccttgcaaccaggcagc

SEQ ID NO: 928126 - DNA, 15 bp, Homo sapiens
cccctccttgcctcc

SEQ ID NO: 928127 - DNA, 20 bp, Homo sapiens
cccctccttgcctcctgtgt

SEQ ID NO: 928128 - DNA, 15 bp, Homo sapiens
cccctcgaggcctac

SEQ ID NO: 928129 - DNA, 16 bp, Homo sapiens
cccctcgcaaccctgc

SEQ ID NO: 928130 - DNA, 20 bp, Homo sapiens
cccctcgcaaccctgcctgt

SEQ ID NO: 928131 - DNA, 14 bp, Homo sapiens
cccctcgcacacag

SEQ ID NO: 928132 - DNA, 15 bp, Homo sapiens
cccctcgcacacagg

SEQ ID NO: 928133 - DNA, 23 bp, Homo sapiens
cccctcgcacacagggctcacag

SEQ ID NO: 928134 - DNA, 15 bp, Homo sapiens
cccctcgccagcttg

SEQ ID NO: 928135 - DNA, 13 bp, Homo sapiens
cccctcgctgctg

SEQ ID NO: 928136 - DNA, 17 bp, Homo sapiens
cccctcggctctggagg

SEQ ID NO: 928137 - DNA, 17 bp, Homo sapiens
cccctcgggggcctgtg

SEQ ID NO: 928138 - DNA, 18 bp, Homo sapiens
cccctcgtcctgtcccag

SEQ ID NO: 928139 - DNA, 21 bp, Homo sapiens
cccctcgtcctgtcccagagg

SEQ ID NO: 928140 - DNA, 16 bp, Homo sapiens
cccctcgttagccttc

SEQ ID NO: 928141 - DNA, 12 bp, Homo sapiens
cccctctcagga

SEQ ID NO: 928142 - DNA, 13 bp, Homo sapiens
cccctctcaggag

SEQ ID NO: 928143 - DNA, 18 bp, Homo sapiens
cccctctccaccagccct

SEQ ID NO: 928144 - DNA, 12 bp, Homo sapiens
cccctctcctcc

SEQ ID NO: 928145 - DNA, 14 bp, Homo sapiens
cccctctcctccca

SEQ ID NO: 928146 - DNA, 14 bp, Homo sapiens
cccctctcctccgc

SEQ ID NO: 928147 - DNA, 19 bp, Homo sapiens
cccctctcctccgccaccc

SEQ ID NO: 928148 - DNA, 12 bp, Homo sapiens
cccctctctcac

SEQ ID NO: 928149 - DNA, 19 bp, Homo sapiens
cccctctctcacacatcac

SEQ ID NO: 928150 - DNA, 19 bp, Homo sapiens
cccctctctgcatctgacc

SEQ ID NO: 928151 - DNA, 15 bp, Homo sapiens
cccctctctgctcca

SEQ ID NO: 928152 - DNA, 15 bp, Homo sapiens
cccctctgacctgca

SEQ ID NO: 928153 - DNA, 18 bp, Homo sapiens
cccctctgacctgcactg

SEQ ID NO: 928154 - DNA, 12 bp, Homo sapiens
cccctctgattg

SEQ ID NO: 928155 - DNA, 18 bp, Homo sapiens
cccctctgcacccagaac

SEQ ID NO: 928156 - DNA, 14 bp, Homo sapiens
cccctctgcagccg

SEQ ID NO: 928157 - DNA, 15 bp, Homo sapiens
cccctctgcccagct

SEQ ID NO: 928158 - DNA, 21 bp, Homo sapiens
cccctctgccggtcgggcagc

SEQ ID NO: 928159 - DNA, 15 bp, Homo sapiens
gactaattttacatg

SEQ ID NO: 928160 - DNA, 21 bp, Homo sapiens
gactaattttttaaatatttg

SEQ ID NO: 928161 - DNA, 14 bp, Homo sapiens
gactaccccagtcc

SEQ ID NO: 928162 - DNA, 15 bp, Homo sapiens
gactaccccagtccc

SEQ ID NO: 928163 - DNA, 14 bp, Homo sapiens
gactaccgcaggcc

SEQ ID NO: 928164 - DNA, 15 bp, Homo sapiens
gactaccgcaggccc

SEQ ID NO: 928165 - DNA, 15 bp, Homo sapiens
gactactactctgcc

SEQ ID NO: 928166 - DNA, 20 bp, Homo sapiens
gactactgctcctgtggcag

SEQ ID NO: 928167 - DNA, 15 bp, Homo sapiens
gactagaagggccag

SEQ ID NO: 928168 - DNA, 22 bp, Homo sapiens
gactagaattctagtgctgctg

SEQ ID NO: 928169 - DNA, 18 bp, Homo sapiens
gactagaggccagggcag

SEQ ID NO: 928170 - DNA, 16 bp, Homo sapiens
gactagaggcttgcat

SEQ ID NO: 928171 - DNA, 19 bp, Homo sapiens
gactagagggacctctccc

SEQ ID NO: 928172 - DNA, 23 bp, Homo sapiens
gactagagggacctctcccaggg

SEQ ID NO: 928173 - DNA, 21 bp, Homo sapiens
gactagatgatggatgccaat

SEQ ID NO: 928174 - DNA, 18 bp, Homo sapiens
gactagatgtagtatttt

SEQ ID NO: 928175 - DNA, 17 bp, Homo sapiens
gactagcaatctcttca

SEQ ID NO: 928176 - DNA, 16 bp, Homo sapiens
gactagcaggctactg

SEQ ID NO: 928177 - DNA, 17 bp, Homo sapiens
gactagccactcctgcc

SEQ ID NO: 928178 - DNA, 15 bp, Homo sapiens
gactagctgccttcg

SEQ ID NO: 928179 - DNA, 16 bp, Homo sapiens
gactaggcatgtcaga

SEQ ID NO: 928180 - DNA, 17 bp, Homo sapiens
gactagggattcaggct

SEQ ID NO: 928181 - DNA, 18 bp, Homo sapiens
gactagggattcaggctg

SEQ ID NO: 928182 - DNA, 19 bp, Homo sapiens
gactagtgagtcagcacct

SEQ ID NO: 928183 - DNA, 19 bp, Homo sapiens
gactagtgccgtagggagt

SEQ ID NO: 928184 - DNA, 19 bp, Homo sapiens
gactagttctcttgtcctg

SEQ ID NO: 928185 - DNA, 15 bp, Homo sapiens
gactataaataaaaa

SEQ ID NO: 928186 - DNA, 12 bp, Homo sapiens
gactataaatgt

SEQ ID NO: 928187 - DNA, 16 bp, Homo sapiens
gactatataatttatt

SEQ ID NO: 928188 - DNA, 19 bp, Homo sapiens
gactatatagagatgtttt

SEQ ID NO: 928189 - DNA, 23 bp, Homo sapiens
gactatatagagatgtttttaaa

SEQ ID NO: 928190 - DNA, 18 bp, Homo sapiens
gactatcaaactgaagcc

SEQ ID NO: 928191 - DNA, 13 bp, Homo sapiens
gactatggcctcg

SEQ ID NO: 928192 - DNA, 13 bp, Homo sapiens
gactatttatgaa

SEQ ID NO: 928193 - DNA, 19 bp, Homo sapiens
gactatttcaaaatgtcca

SEQ ID NO: 928194 - DNA, 15 bp, Homo sapiens
gactattttatatga

SEQ ID NO: 928195 - DNA, 17 bp, Homo sapiens
gactcaaaacctggaga

SEQ ID NO: 928196 - DNA, 19 bp, Homo sapiens
gactcaaatctccagtatt

SEQ ID NO: 928197 - DNA, 22 bp, Homo sapiens
gactcaaatgctcagaccagct

SEQ ID NO: 928198 - DNA, 22 bp, Homo sapiens
gactcaagagacaccccttcct

SEQ ID NO: 928199 - DNA, 17 bp, Homo sapiens
gactcaagggtccagaa

SEQ ID NO: 928200 - DNA, 18 bp, Homo sapiens
gactcaagggtccagaag

SEQ ID NO: 928201 - DNA, 14 bp, Homo sapiens
gactcaagtaccca

SEQ ID NO: 928202 - DNA, 17 bp, Homo sapiens
gactcaagtccttacct

SEQ ID NO: 928203 - DNA, 15 bp, Homo sapiens
gactcaatccctagg

SEQ ID NO: 928204 - DNA, 19 bp, Homo sapiens
gactcacaacctgaaccta

SEQ ID NO: 928205 - DNA, 22 bp, Homo sapiens
gactcacaagaagaccagactg

SEQ ID NO: 928206 - DNA, 19 bp, Homo sapiens
gactcacactctctgcagc

SEQ ID NO: 928207 - DNA, 20 bp, Homo sapiens
gactcacactctctgcagcc

SEQ ID NO: 928208 - DNA, 19 bp, Homo sapiens
gactcacaggccctggaga

SEQ ID NO: 928209 - DNA, 17 bp, Homo sapiens
gactcaccaacttgcca

SEQ ID NO: 928210 - DNA, 15 bp, Homo sapiens
gactcacctccccca

SEQ ID NO: 928211 - DNA, 22 bp, Homo sapiens
gactcacctcccccatctcttc

SEQ ID NO: 928212 - DNA, 13 bp, Homo sapiens
gactcacctctgc

SEQ ID NO: 928213 - DNA, 18 bp, Homo sapiens
gactcacctctgcctcaa

SEQ ID NO: 928214 - DNA, 20 bp, Homo sapiens
gactcacttcaatgtgtcat

SEQ ID NO: 928215 - DNA, 22 bp, Homo sapiens
gactcacttgccattgccagga

SEQ ID NO: 928216 - DNA, 17 bp, Homo sapiens
gactcagaaagccaaca

SEQ ID NO: 928217 - DNA, 16 bp, Homo sapiens
cccctgcctcctgcca

SEQ ID NO: 928218 - DNA, 18 bp, Homo sapiens
cccctgcctcctgccacc

SEQ ID NO: 928219 - DNA, 13 bp, Homo sapiens
cccctgccttcct

SEQ ID NO: 928220 - DNA, 12 bp, Homo sapiens
cccctgccttgc

SEQ ID NO: 928221 - DNA, 14 bp, Homo sapiens
cccctgctcagcaa

SEQ ID NO: 928222 - DNA, 15 bp, Homo sapiens
cccctgctcccattc

SEQ ID NO: 928223 - DNA, 12 bp, Homo sapiens
cccctgctgccc

SEQ ID NO: 928224 - DNA, 13 bp, Homo sapiens
cccctgctgcctc

SEQ ID NO: 928225 - DNA, 17 bp, Homo sapiens
cccctgctgtctctctg

SEQ ID NO: 928226 - DNA, 19 bp, Homo sapiens
cccctgctgtctctctggg

SEQ ID NO: 928227 - DNA, 14 bp, Homo sapiens
cccctggaaccagc

SEQ ID NO: 928228 - DNA, 17 bp, Homo sapiens
cccctggaaccagcaag

SEQ ID NO: 928229 - DNA, 23 bp, Homo sapiens
cccctggaaccagcaagtcccag

SEQ ID NO: 928230 - DNA, 17 bp, Homo sapiens
cccctggaagagcccag

SEQ ID NO: 928231 - DNA, 18 bp, Homo sapiens
cccctggaagagcccagt

SEQ ID NO: 928232 - DNA, 19 bp, Homo sapiens
cccctggacccctggggtg

SEQ ID NO: 928233 - DNA, 23 bp, Homo sapiens
cccctggagtgtgtcagagccca

SEQ ID NO: 928234 - DNA, 22 bp, Homo sapiens
cccctggatgtcccctgtccca

SEQ ID NO: 928235 - DNA, 20 bp, Homo sapiens
cccctggcagcacagcccag

SEQ ID NO: 928236 - DNA, 19 bp, Homo sapiens
cccctggccagctctgagg

SEQ ID NO: 928237 - DNA, 14 bp, Homo sapiens
cccctggcccagag

SEQ ID NO: 928238 - DNA, 13 bp, Homo sapiens
cccctggcccagc

SEQ ID NO: 928239 - DNA, 14 bp, Homo sapiens
cccctggcccagcg

SEQ ID NO: 928240 - DNA, 19 bp, Homo sapiens
cccctggcccatctcagcc

SEQ ID NO: 928241 - DNA, 21 bp, Homo sapiens
cccctggcccatctcagcctc

SEQ ID NO: 928242 - DNA, 16 bp, Homo sapiens
cccctggccccgcctg

SEQ ID NO: 928243 - DNA, 19 bp, Homo sapiens
cccctggccccgcctgcct

SEQ ID NO: 928244 - DNA, 13 bp, Homo sapiens
cccctggcctcag

SEQ ID NO: 928245 - DNA, 11 bp, Homo sapiens
cccctggcctt

SEQ ID NO: 928246 - DNA, 14 bp, Homo sapiens
cccctggctctggg

SEQ ID NO: 928247 - DNA, 18 bp, Homo sapiens
cccctggcttttcactgc

SEQ ID NO: 928248 - DNA, 20 bp, Homo sapiens
cccctggcttttcactgctg

SEQ ID NO: 928249 - DNA, 17 bp, Homo sapiens
cccctgggaacaggccc

SEQ ID NO: 928250 - DNA, 22 bp, Homo sapiens
cccctgggagacaactggacaa

SEQ ID NO: 928251 - DNA, 18 bp, Homo sapiens
cccctgggatgctgaccc

SEQ ID NO: 928252 - DNA, 12 bp, Homo sapiens
cccctgggcagg

SEQ ID NO: 928253 - DNA, 11 bp, Homo sapiens
cccctgggctc

SEQ ID NO: 928254 - DNA, 20 bp, Homo sapiens
cccctgggcttggcctgctg

SEQ ID NO: 928255 - DNA, 22 bp, Homo sapiens
cccctgggcttggcctgctgtg

SEQ ID NO: 928256 - DNA, 18 bp, Homo sapiens
cccctggggacagagcca

SEQ ID NO: 928257 - DNA, 19 bp, Homo sapiens
cccctggggacagagccac

SEQ ID NO: 928258 - DNA, 21 bp, Homo sapiens
cccctggggacagagccaccc

SEQ ID NO: 928259 - DNA, 22 bp, Homo sapiens
cccctggggacagagccacccc

SEQ ID NO: 928260 - DNA, 18 bp, Homo sapiens
cccctggggcttctcctg

SEQ ID NO: 928261 - DNA, 19 bp, Homo sapiens
cccctgggggctctcatgt

SEQ ID NO: 928262 - DNA, 20 bp, Homo sapiens
cccctggggtggccaccagt

SEQ ID NO: 928263 - DNA, 21 bp, Homo sapiens
cccctggggtgggatctgagc

SEQ ID NO: 928264 - DNA, 19 bp, Homo sapiens
cccctggtggacagtcctg

SEQ ID NO: 928265 - DNA, 21 bp, Homo sapiens
cccctggtggacagtcctggg

SEQ ID NO: 928266 - DNA, 21 bp, Homo sapiens
cccctgtcccaccaactctgc

SEQ ID NO: 928267 - DNA, 22 bp, Homo sapiens
cccctgtcccaccaactctgca

SEQ ID NO: 928268 - DNA, 20 bp, Homo sapiens
cccctgtcccacccacacag

SEQ ID NO: 928269 - DNA, 20 bp, Homo sapiens
cccctgtcccacctggctcc

SEQ ID NO: 928270 - DNA, 22 bp, Homo sapiens
cccctgtccccaagacacttcc

SEQ ID NO: 928271 - DNA, 23 bp, Homo sapiens
cccctgtctccttattcggcagc

SEQ ID NO: 928272 - DNA, 15 bp, Homo sapiens
cccctgtctggaaga

SEQ ID NO: 928273 - DNA, 19 bp, Homo sapiens
cccctgtgaccctctcact

SEQ ID NO: 928274 - DNA, 11 bp, Homo sapiens
cccctgtgcag

SEQ ID NO: 928275 - DNA, 11 bp, Homo sapiens
cccctgtgctc

SEQ ID NO: 928276 - DNA, 13 bp, Homo sapiens
cccctgtgctgcg

SEQ ID NO: 928277 - DNA, 18 bp, Homo sapiens
cccctgtggggatctcag

SEQ ID NO: 928278 - DNA, 20 bp, Homo sapiens
cccctgtggggatctcaggg

SEQ ID NO: 928279 - DNA, 20 bp, Homo sapiens
cccctgtgtattcaccacca

SEQ ID NO: 928280 - DNA, 15 bp, Homo sapiens
cccctgttccctgtt

SEQ ID NO: 928281 - DNA, 15 bp, Homo sapiens
cccctgtttgcatga

SEQ ID NO: 928282 - DNA, 20 bp, Homo sapiens
ccccttagaggacctgagtt

SEQ ID NO: 928283 - DNA, 15 bp, Homo sapiens
ccccttatccaggac

SEQ ID NO: 928284 - DNA, 19 bp, Homo sapiens
ccccttattaaggccccag

SEQ ID NO: 928285 - DNA, 13 bp, Homo sapiens
gactcctcctttt

SEQ ID NO: 928286 - DNA, 16 bp, Homo sapiens
gactcctcctttttcc

SEQ ID NO: 928287 - DNA, 12 bp, Homo sapiens
gactcctctggg

SEQ ID NO: 928288 - DNA, 15 bp, Homo sapiens
gactcctctgggcct

SEQ ID NO: 928289 - DNA, 16 bp, Homo sapiens
gactcctctgggcctg

SEQ ID NO: 928290 - DNA, 19 bp, Homo sapiens
gactcctgaggacagctgt

SEQ ID NO: 928291 - DNA, 14 bp, Homo sapiens
gactcctgccctgt

SEQ ID NO: 928292 - DNA, 13 bp, Homo sapiens
gactcctggactc

SEQ ID NO: 928293 - DNA, 20 bp, Homo sapiens
gactcctggactccggagga

SEQ ID NO: 928294 - DNA, 11 bp, Homo sapiens
gactcctgggt

SEQ ID NO: 928295 - DNA, 17 bp, Homo sapiens
gactcctgggttgagct

SEQ ID NO: 928296 - DNA, 17 bp, Homo sapiens
gactccttctccccaat

SEQ ID NO: 928297 - DNA, 18 bp, Homo sapiens
gactccttctccccaatc

SEQ ID NO: 928298 - DNA, 23 bp, Homo sapiens
gactccttctccccaatcacgag

SEQ ID NO: 928299 - DNA, 13 bp, Homo sapiens
gactcgcagcacc

SEQ ID NO: 928300 - DNA, 13 bp, Homo sapiens
gactcggagacta

SEQ ID NO: 928301 - DNA, 21 bp, Homo sapiens
gactcggagactatggcctcg

SEQ ID NO: 928302 - DNA, 18 bp, Homo sapiens
gactcggccactgtgtct

SEQ ID NO: 928303 - DNA, 14 bp, Homo sapiens
gactcgggagctgc

SEQ ID NO: 928304 - DNA, 19 bp, Homo sapiens
gactcgggagctgcacaca

SEQ ID NO: 928305 - DNA, 14 bp, Homo sapiens
gactcgggggtggg

SEQ ID NO: 928306 - DNA, 16 bp, Homo sapiens
gactcggtgagccggg

SEQ ID NO: 928307 - DNA, 13 bp, Homo sapiens
gactcggtttctc

SEQ ID NO: 928308 - DNA, 19 bp, Homo sapiens
gactcgtggcgcgggagct

SEQ ID NO: 928309 - DNA, 15 bp, Homo sapiens
gactctaaatgcagt

SEQ ID NO: 928310 - DNA, 22 bp, Homo sapiens
gactctaaatgcagttttaaga

SEQ ID NO: 928311 - DNA, 16 bp, Homo sapiens
gactctacactgtgaa

SEQ ID NO: 928312 - DNA, 14 bp, Homo sapiens
gactctagtattta

SEQ ID NO: 928313 - DNA, 18 bp, Homo sapiens
gactctattctttaactc

SEQ ID NO: 928314 - DNA, 22 bp, Homo sapiens
gactctattttaatgtatattt

SEQ ID NO: 928315 - DNA, 23 bp, Homo sapiens
gactctattttaatgtatatttg

SEQ ID NO: 928316 - DNA, 12 bp, Homo sapiens
gactctcacctg

SEQ ID NO: 928317 - DNA, 14 bp, Homo sapiens
gactctcagtctct

SEQ ID NO: 928318 - DNA, 15 bp, Homo sapiens
gactctcccaggcct

SEQ ID NO: 928319 - DNA, 14 bp, Homo sapiens
gactctcctcctcc

SEQ ID NO: 928320 - DNA, 15 bp, Homo sapiens
gactctcctcctccc

SEQ ID NO: 928321 - DNA, 17 bp, Homo sapiens
gactctcctcctcccct

SEQ ID NO: 928322 - DNA, 18 bp, Homo sapiens
gactctcctgcctcagcc

SEQ ID NO: 928323 - DNA, 15 bp, Homo sapiens
gactctctgtgacct

SEQ ID NO: 928324 - DNA, 14 bp, Homo sapiens
gactctgaaatctg

SEQ ID NO: 928325 - DNA, 15 bp, Homo sapiens
gactctgaaatctga

SEQ ID NO: 928326 - DNA, 12 bp, Homo sapiens
gactctgagaaa

SEQ ID NO: 928327 - DNA, 24 bp, Homo sapiens
gactctgagccaagggagggaagg

SEQ ID NO: 928328 - DNA, 21 bp, Homo sapiens
gactctgagcgggaggcagag

SEQ ID NO: 928329 - DNA, 22 bp, Homo sapiens
gactctgagcgggaggcagagt

SEQ ID NO: 928330 - DNA, 20 bp, Homo sapiens
gactctgaggactcctgagg

SEQ ID NO: 928331 - DNA, 22 bp, Homo sapiens
gactctgaggctctttctgggc

SEQ ID NO: 928332 - DNA, 13 bp, Homo sapiens
gactctgatggaa

SEQ ID NO: 928333 - DNA, 12 bp, Homo sapiens
gactctgcctcc

SEQ ID NO: 928334 - DNA, 23 bp, Homo sapiens
gactctgcgggaggctggggccc

SEQ ID NO: 928335 - DNA, 18 bp, Homo sapiens
gactctggacaatctcac

SEQ ID NO: 928336 - DNA, 12 bp, Homo sapiens
gactctggcaca

SEQ ID NO: 928337 - DNA, 13 bp, Homo sapiens
gactctggcacag

SEQ ID NO: 928338 - DNA, 19 bp, Homo sapiens
gactctggcacagtgatgc

SEQ ID NO: 928339 - DNA, 19 bp, Homo sapiens
ctttgcatggcagggcctc

SEQ ID NO: 928340 - DNA, 21 bp, Homo sapiens
ctttgcattccttacttgcac

SEQ ID NO: 928341 - DNA, 19 bp, Homo sapiens
ctttgccaacttgccatgt

SEQ ID NO: 928342 - DNA, 17 bp, Homo sapiens
ctttgccaaggctctcc

SEQ ID NO: 928343 - DNA, 22 bp, Homo sapiens
ctttgccaaggctctcccctct

SEQ ID NO: 928344 - DNA, 13 bp, Homo sapiens
ctttgccagagca

SEQ ID NO: 928345 - DNA, 23 bp, Homo sapiens
ctttgccagagcaggagcccctg

SEQ ID NO: 928346 - DNA, 18 bp, Homo sapiens
ctttgccagctgctgctg

SEQ ID NO: 928347 - DNA, 13 bp, Homo sapiens
ctttgccagcttt

SEQ ID NO: 928348 - DNA, 20 bp, Homo sapiens
ctttgccagcttttcctccc

SEQ ID NO: 928349 - DNA, 16 bp, Homo sapiens
ctttgccagtctttaa

SEQ ID NO: 928350 - DNA, 20 bp, Homo sapiens
ctttgccatgggcctgctgc

SEQ ID NO: 928351 - DNA, 23 bp, Homo sapiens
ctttgcccaagataggagttctc

SEQ ID NO: 928352 - DNA, 12 bp, Homo sapiens
ctttgcccaccc

SEQ ID NO: 928353 - DNA, 14 bp, Homo sapiens
ctttgcccacccct

SEQ ID NO: 928354 - DNA, 15 bp, Homo sapiens
ctttgcccagaaaga

SEQ ID NO: 928355 - DNA, 18 bp, Homo sapiens
ctttgcccagggtcctgt

SEQ ID NO: 928356 - DNA, 21 bp, Homo sapiens
ctttgcccagggtcctgtgcc

SEQ ID NO: 928357 - DNA, 19 bp, Homo sapiens
ctttgcccccgacggctgt

SEQ ID NO: 928358 - DNA, 19 bp, Homo sapiens
ctttgcccccttgcccatc

SEQ ID NO: 928359 - DNA, 21 bp, Homo sapiens
ctttgccctggagcagctatt

SEQ ID NO: 928360 - DNA, 10 bp, Homo sapiens
ctttgcctca

SEQ ID NO: 928361 - DNA, 14 bp, Homo sapiens
ctttgcctcaagac

SEQ ID NO: 928362 - DNA, 15 bp, Homo sapiens
ctttgcctcaagact

SEQ ID NO: 928363 - DNA, 19 bp, Homo sapiens
ctttgcctctgtcctccca

SEQ ID NO: 928364 - DNA, 15 bp, Homo sapiens
ctttgccttaaacct

SEQ ID NO: 928365 - DNA, 15 bp, Homo sapiens
ctttgccttcttttg

SEQ ID NO: 928366 - DNA, 22 bp, Homo sapiens
ctttgcctttatctctgaggct

SEQ ID NO: 928367 - DNA, 19 bp, Homo sapiens
ctttgcgtgcccggggcag

SEQ ID NO: 928368 - DNA, 21 bp, Homo sapiens
ctttgcgtgcccggggcagca

SEQ ID NO: 928369 - DNA, 19 bp, Homo sapiens
ctttgcgtggatcaagctt

SEQ ID NO: 928370 - DNA, 14 bp, Homo sapiens
ctttgctacaaatt

SEQ ID NO: 928371 - DNA, 20 bp, Homo sapiens
ctttgctacaaatttatgca

SEQ ID NO: 928372 - DNA, 13 bp, Homo sapiens
ctttgctatgtaa

SEQ ID NO: 928373 - DNA, 20 bp, Homo sapiens
ctttgctattcccattgtga

SEQ ID NO: 928374 - DNA, 19 bp, Homo sapiens
ctttgctcagtgtccagct

SEQ ID NO: 928375 - DNA, 13 bp, Homo sapiens
ctttgctccagat

SEQ ID NO: 928376 - DNA, 13 bp, Homo sapiens
ctttgctccgctc

SEQ ID NO: 928377 - DNA, 17 bp, Homo sapiens
ctttgctccgctcccac

SEQ ID NO: 928378 - DNA, 13 bp, Homo sapiens
ctttgctctgggt

SEQ ID NO: 928379 - DNA, 17 bp, Homo sapiens
ctttgctgcattccttt

SEQ ID NO: 928380 - DNA, 14 bp, Homo sapiens
ctttgctgccttaa

SEQ ID NO: 928381 - DNA, 23 bp, Homo sapiens
ctttgctgctatgaaaatgagca

SEQ ID NO: 928382 - DNA, 11 bp, Homo sapiens
ctttgctgctg

SEQ ID NO: 928383 - DNA, 15 bp, Homo sapiens
ctttgctgctgctct

SEQ ID NO: 928384 - DNA, 16 bp, Homo sapiens
ctttgctgctgctctc

SEQ ID NO: 928385 - DNA, 14 bp, Homo sapiens
ctttgctggaagaa

SEQ ID NO: 928386 - DNA, 16 bp, Homo sapiens
ctttgctggaagaaac

SEQ ID NO: 928387 - DNA, 18 bp, Homo sapiens
ctttgctggaagaaacta

SEQ ID NO: 928388 - DNA, 21 bp, Homo sapiens
ctttgctgtactcttgctgat

SEQ ID NO: 928389 - DNA, 19 bp, Homo sapiens
ctttgcttatgaatattta

SEQ ID NO: 928390 - DNA, 20 bp, Homo sapiens
ctttgcttatgaatatttat

SEQ ID NO: 928391 - DNA, 15 bp, Homo sapiens
ctttgcttcccattg

SEQ ID NO: 928392 - DNA, 22 bp, Homo sapiens
ctttgcttccgccactcagcca

SEQ ID NO: 928393 - DNA, 19 bp, Homo sapiens
ctttgcttgctttgaagta

SEQ ID NO: 928394 - DNA, 12 bp, Homo sapiens
ctttgctttctg

SEQ ID NO: 928395 - DNA, 14 bp, Homo sapiens
ctttgctttctgct

SEQ ID NO: 928396 - DNA, 16 bp, Homo sapiens
ctttgctttctgctca

SEQ ID NO: 928397 - DNA, 17 bp, Homo sapiens
ctttgctttctgctcag

SEQ ID NO: 928398 - DNA, 20 bp, Homo sapiens
ctttggaaatagcatgacag

SEQ ID NO: 928399 - DNA, 17 bp, Homo sapiens
ctttggaacaagacagc

SEQ ID NO: 928400 - DNA, 18 bp, Homo sapiens
ctttggaacaagacagcc

SEQ ID NO: 928401 - DNA, 22 bp, Homo sapiens
ctttggaacaagacagccttca

SEQ ID NO: 928402 - DNA, 21 bp, Homo sapiens
ctttggaaccagactcttgcc

SEQ ID NO: 928403 - DNA, 15 bp, Homo sapiens
ctttggaaggagtga

SEQ ID NO: 928404 - DNA, 17 bp, Homo sapiens
ctttggaagtttgtgtt

SEQ ID NO: 928405 - DNA, 21 bp, Homo sapiens
ctttggaatgaaattcctcct

SEQ ID NO: 928406 - DNA, 23 bp, Homo sapiens
ctttggaatgaaattcctccttc

SEQ ID NO: 928407 - DNA, 18 bp, Homo sapiens
ctttggacagtggcctct

SEQ ID NO: 928408 - DNA, 20 bp, Homo sapiens
ctttggacctaaatggcctc

SEQ ID NO: 928409 - DNA, 21 bp, Homo sapiens
ctttggactgttcaagcaaaa

SEQ ID NO: 928410 - DNA, 18 bp, Homo sapiens
ctttggagatgctgaggg

SEQ ID NO: 928411 - DNA, 22 bp, Homo sapiens
ctttggagtcccctcacctcct

SEQ ID NO: 928412 - DNA, 14 bp, Homo sapiens
ctttggagttaaaa

SEQ ID NO: 928413 - DNA, 19 bp, Homo sapiens
ctttggataataggaattc

SEQ ID NO: 928414 - DNA, 20 bp, Homo sapiens
ctttggataataggaattca

SEQ ID NO: 928415 - DNA, 16 bp, Homo sapiens
ctttggatttgacatt

SEQ ID NO: 928416 - DNA, 12 bp, Homo sapiens
ctttggcactgg

SEQ ID NO: 928417 - DNA, 17 bp, Homo sapiens
ctttggcactggggcac

SEQ ID NO: 928418 - DNA, 15 bp, Homo sapiens
ctttggcagtgtttt

SEQ ID NO: 928419 - DNA, 14 bp, Homo sapiens
ctttggcctttcct

SEQ ID NO: 928420 - DNA, 17 bp, Homo sapiens
ctttggcctttccttgt

SEQ ID NO: 928421 - DNA, 13 bp, Homo sapiens
ctttggctcccct

SEQ ID NO: 928422 - DNA, 15 bp, Homo sapiens
ctttggctcccctgt

SEQ ID NO: 928423 - DNA, 20 bp, Homo sapiens
ctttggctggtagcagcagg

SEQ ID NO: 928424 - DNA, 15 bp, Homo sapiens
ctttggcttctcctg

SEQ ID NO: 928425 - DNA, 17 bp, Homo sapiens
ctttgggagacagtcta

SEQ ID NO: 928426 - DNA, 19 bp, Homo sapiens
ctttgggagagcaggaatg

SEQ ID NO: 928427 - DNA, 18 bp, Homo sapiens
ctttgggagcaaaataag

SEQ ID NO: 928428 - DNA, 18 bp, Homo sapiens
ctttgggaggccgaggca

SEQ ID NO: 928429 - DNA, 20 bp, Homo sapiens
ctttgggaggccgaggcggg

SEQ ID NO: 928430 - DNA, 14 bp, Homo sapiens
ctttgggaggctga

SEQ ID NO: 928431 - DNA, 17 bp, Homo sapiens
ctttgggaggctgaggc

SEQ ID NO: 928432 - DNA, 17 bp, Homo sapiens
ctttgggaggctgaggt

SEQ ID NO: 928433 - DNA, 18 bp, Homo sapiens
ctttgggatatggtcttg

SEQ ID NO: 928434 - DNA, 15 bp, Homo sapiens
ctttgggatttaatt

SEQ ID NO: 928435 - DNA, 19 bp, Homo sapiens
ctttgggcccaagaactgc

SEQ ID NO: 928436 - DNA, 22 bp, Homo sapiens
ctttgggcccaagaactgcaga

SEQ ID NO: 928437 - DNA, 18 bp, Homo sapiens
ctttgggcctctcctgcc

SEQ ID NO: 928438 - DNA, 19 bp, Homo sapiens
ctttgggctgccctggtgc

SEQ ID NO: 928439 - DNA, 12 bp, Homo sapiens
ctttggggacag

SEQ ID NO: 928440 - DNA, 20 bp, Homo sapiens
ctttggggacagggggtggg

SEQ ID NO: 928441 - DNA, 19 bp, Homo sapiens
ctttggggacagttggcag

SEQ ID NO: 928442 - DNA, 21 bp, Homo sapiens
ctttggggacagttggcagag

SEQ ID NO: 928443 - DNA, 22 bp, Homo sapiens
ctttggggacagttggcagaga

SEQ ID NO: 928444 - DNA, 20 bp, Homo sapiens
ctttggggagcaggaggcca

SEQ ID NO: 928445 - DNA, 16 bp, Homo sapiens
ctttgggtcctgggca

SEQ ID NO: 928446 - DNA, 14 bp, Homo sapiens
ctttgggtggctca

SEQ ID NO: 928447 - DNA, 23 bp, Homo sapiens
ctttgggtggctcactactgaac

SEQ ID NO: 928448 - DNA, 19 bp, Homo sapiens
ctttgggttctttctgggg

SEQ ID NO: 928449 - DNA, 15 bp, Homo sapiens
ctttggtacccccaa

SEQ ID NO: 928450 - DNA, 19 bp, Homo sapiens
ctttggtacccccaaaccc

SEQ ID NO: 928451 - DNA, 18 bp, Homo sapiens
ctttggtgaacagttttg

SEQ ID NO: 928452 - DNA, 16 bp, Homo sapiens
ctttggtgaattcctt

SEQ ID NO: 928453 - DNA, 23 bp, Homo sapiens
ctttggtgccaactggtgtttga

SEQ ID NO: 928454 - DNA, 17 bp, Homo sapiens
ctttggtggagataaag

SEQ ID NO: 928455 - DNA, 20 bp, Homo sapiens
ctttggttaaaaatggctca

SEQ ID NO: 928456 - DNA, 14 bp, Homo sapiens
ctttggttctggcc

SEQ ID NO: 928457 - DNA, 14 bp, Homo sapiens
ccaggatgcccaga

SEQ ID NO: 928458 - DNA, 15 bp, Homo sapiens
ccaggatggaattct

SEQ ID NO: 928459 - DNA, 14 bp, Homo sapiens
ccaggatggagggg

SEQ ID NO: 928460 - DNA, 18 bp, Homo sapiens
ccaggatggagggtccaa

SEQ ID NO: 928461 - DNA, 23 bp, Homo sapiens
ccaggatggcccttcccactgga

SEQ ID NO: 928462 - DNA, 23 bp, Homo sapiens
ccaggatggtctcgatctcctga

SEQ ID NO: 928463 - DNA, 15 bp, Homo sapiens
ccaggatttataaag

SEQ ID NO: 928464 - DNA, 17 bp, Homo sapiens
ccaggcacacacagccc

SEQ ID NO: 928465 - DNA, 15 bp, Homo sapiens
ccaggcacagctgag

SEQ ID NO: 928466 - DNA, 16 bp, Homo sapiens
ccaggcacagctgagt

SEQ ID NO: 928467 - DNA, 23 bp, Homo sapiens
ccaggcacagctgagttatgatg

SEQ ID NO: 928468 - DNA, 16 bp, Homo sapiens
ccaggcaccaccagga

SEQ ID NO: 928469 - DNA, 17 bp, Homo sapiens
ccaggcaccaggactag

SEQ ID NO: 928470 - DNA, 18 bp, Homo sapiens
cttttagttgtatctctt

SEQ ID NO: 928471 - DNA, 20 bp, Homo sapiens
cttttagttgtatctctttt

SEQ ID NO: 928472 - DNA, 22 bp, Homo sapiens
cttttagttttagttgcagaaa

SEQ ID NO: 928473 - DNA, 15 bp, Homo sapiens
cttttagtttttccc

SEQ ID NO: 928474 - DNA, 20 bp, Homo sapiens
cttttataaattaaatatat

SEQ ID NO: 928475 - DNA, 24 bp, Homo sapiens
cttttataaattaaatatatgtat

SEQ ID NO: 928476 - DNA, 21 bp, Homo sapiens
cttttataataaaaggaaaag

SEQ ID NO: 928477 - DNA, 18 bp, Homo sapiens
cttttataccagagacct

SEQ ID NO: 928478 - DNA, 17 bp, Homo sapiens
cttttatactctttctg

SEQ ID NO: 928479 - DNA, 19 bp, Homo sapiens
cttttatactctttctgta

SEQ ID NO: 928480 - DNA, 20 bp, Homo sapiens
cttttatactctttctgtat

SEQ ID NO: 928481 - DNA, 14 bp, Homo sapiens
cttttatagctatt

SEQ ID NO: 928482 - DNA, 17 bp, Homo sapiens
cttttatagctattact

SEQ ID NO: 928483 - DNA, 20 bp, Homo sapiens
cttttataggtgagaaaaaa

SEQ ID NO: 928484 - DNA, 21 bp, Homo sapiens
cttttataggtgagaaaaaaa

SEQ ID NO: 928485 - DNA, 17 bp, Homo sapiens
cttttatatatgaagtt

SEQ ID NO: 928486 - DNA, 21 bp, Homo sapiens
cttttatatggcccagccttg

SEQ ID NO: 928487 - DNA, 19 bp, Homo sapiens
cttttatgattttgtttat

SEQ ID NO: 928488 - DNA, 15 bp, Homo sapiens
cttttatgtagtaat

SEQ ID NO: 928489 - DNA, 22 bp, Homo sapiens
cttttatgtagtaattgacatg

SEQ ID NO: 928490 - DNA, 13 bp, Homo sapiens
cttttatgtgaga

SEQ ID NO: 928491 - DNA, 15 bp, Homo sapiens
cttttatgtgagatt

SEQ ID NO: 928492 - DNA, 18 bp, Homo sapiens
cttttatgtgagatttcc

SEQ ID NO: 928493 - DNA, 21 bp, Homo sapiens
cttttatgtgagatttcctta

SEQ ID NO: 928494 - DNA, 16 bp, Homo sapiens
cttttattaatgcact

SEQ ID NO: 928495 - DNA, 12 bp, Homo sapiens
cttttattattt

SEQ ID NO: 928496 - DNA, 17 bp, Homo sapiens
cttttattcctttgaat

SEQ ID NO: 928497 - DNA, 18 bp, Homo sapiens
cttttattcctttgaata

SEQ ID NO: 928498 - DNA, 14 bp, Homo sapiens
cttttattctgtta

SEQ ID NO: 928499 - DNA, 17 bp, Homo sapiens
cttttattgacacagaa

SEQ ID NO: 928500 - DNA, 22 bp, Homo sapiens
cttttattgcaccattttcaat

SEQ ID NO: 928501 - DNA, 19 bp, Homo sapiens
cttttattgtataaactat

SEQ ID NO: 928502 - DNA, 21 bp, Homo sapiens
cttttattgtataaactatca

SEQ ID NO: 928503 - DNA, 18 bp, Homo sapiens
cttttatttctccatctt

SEQ ID NO: 928504 - DNA, 13 bp, Homo sapiens
cttttattttttc

SEQ ID NO: 928505 - DNA, 13 bp, Homo sapiens
cttttcaaatgtt

SEQ ID NO: 928506 - DNA, 18 bp, Homo sapiens
cttttcaagtaattttca

SEQ ID NO: 928507 - DNA, 19 bp, Homo sapiens
cttttcaatttgtcatgtt

SEQ ID NO: 928508 - DNA, 20 bp, Homo sapiens
cttttcacattaggctgttg

SEQ ID NO: 928509 - DNA, 21 bp, Homo sapiens
cttttcaccaaaatttctaca

SEQ ID NO: 928510 - DNA, 21 bp, Homo sapiens
cttttcacctccaactggatg

SEQ ID NO: 928511 - DNA, 12 bp, Homo sapiens
cttttcacggga

SEQ ID NO: 928512 - DNA, 19 bp, Homo sapiens
cttttcacgggaactctcc

SEQ ID NO: 928513 - DNA, 16 bp, Homo sapiens
cttttcactgcctgta

SEQ ID NO: 928514 - DNA, 17 bp, Homo sapiens
cttttcactgctggctg

SEQ ID NO: 928515 - DNA, 15 bp, Homo sapiens
cttttcacttgtctt

SEQ ID NO: 928516 - DNA, 20 bp, Homo sapiens
cttttcacttgtcttgctct

SEQ ID NO: 928517 - DNA, 16 bp, Homo sapiens
cttttcagattgtgga

SEQ ID NO: 928518 - DNA, 22 bp, Homo sapiens
cttttcagccaatttgtctcct

SEQ ID NO: 928519 - DNA, 16 bp, Homo sapiens
cttttcaggaagctct

SEQ ID NO: 928520 - DNA, 17 bp, Homo sapiens
cttttcagggctggctc

SEQ ID NO: 928521 - DNA, 23 bp, Homo sapiens
cttttcagggctggctcctgatc

SEQ ID NO: 928522 - DNA, 16 bp, Homo sapiens
cttttcatatcatttc

SEQ ID NO: 928523 - DNA, 18 bp, Homo sapiens
cttttcatatctcttgcc

SEQ ID NO: 928524 - DNA, 23 bp, Homo sapiens
cttttcatatctcttgcccttcc

SEQ ID NO: 928525 - DNA, 20 bp, Homo sapiens
cttttcatctgttgttctgt

SEQ ID NO: 928526 - DNA, 15 bp, Homo sapiens
cttttcatgtacagc

SEQ ID NO: 928527 - DNA, 13 bp, Homo sapiens
cttttcatgtaga

SEQ ID NO: 928528 - DNA, 17 bp, Homo sapiens
cttttccaaatgcccaa

SEQ ID NO: 928529 - DNA, 19 bp, Homo sapiens
cttttccactccattgtcg

SEQ ID NO: 928530 - DNA, 16 bp, Homo sapiens
cttttccaggatcctg

SEQ ID NO: 928531 - DNA, 19 bp, Homo sapiens
cttttccaggatcctgcag

SEQ ID NO: 928532 - DNA, 20 bp, Homo sapiens
cttttccaggatcctgcagg

SEQ ID NO: 928533 - DNA, 21 bp, Homo sapiens
cttttccaggatcctgcagga

SEQ ID NO: 928534 - DNA, 19 bp, Homo sapiens
cttttccagttgctgtgga

SEQ ID NO: 928535 - DNA, 16 bp, Homo sapiens
cttttccattatgctg

SEQ ID NO: 928536 - DNA, 22 bp, Homo sapiens
cttttcccaaaatgttgaaata

SEQ ID NO: 928537 - DNA, 20 bp, Homo sapiens
cttttcccaggaatatccca

SEQ ID NO: 928538 - DNA, 21 bp, Homo sapiens
cttttcccatttatctaaata

SEQ ID NO: 928539 - DNA, 14 bp, Homo sapiens
cttttccccggtcc

SEQ ID NO: 928540 - DNA, 20 bp, Homo sapiens
cttttcccctacagaatttt

SEQ ID NO: 928541 - DNA, 14 bp, Homo sapiens
cttttcccctgtta

SEQ ID NO: 928542 - DNA, 19 bp, Homo sapiens
cttttcccctgttaaacag

SEQ ID NO: 928543 - DNA, 15 bp, Homo sapiens
cttttcccctttcct

SEQ ID NO: 928544 - DNA, 16 bp, Homo sapiens
cttttcccctttcctg

SEQ ID NO: 928545 - DNA, 17 bp, Homo sapiens
cttttcccctttcctgt

SEQ ID NO: 928546 - DNA, 18 bp, Homo sapiens
cttttcccctttcctgtc

SEQ ID NO: 928547 - DNA, 20 bp, Homo sapiens
cttttcccctttcctgtccc

SEQ ID NO: 928548 - DNA, 19 bp, Homo sapiens
cttttccctcttttcttac

SEQ ID NO: 928549 - DNA, 18 bp, Homo sapiens
cttttccctgcttccagg

SEQ ID NO: 928550 - DNA, 17 bp, Homo sapiens
cttttcccttaaataca

SEQ ID NO: 928551 - DNA, 16 bp, Homo sapiens
cttttcctatttgttt

SEQ ID NO: 928552 - DNA, 19 bp, Homo sapiens
cttttcctattttcagccc

SEQ ID NO: 928553 - DNA, 15 bp, Homo sapiens
cttttcctcaagcaa

SEQ ID NO: 928554 - DNA, 16 bp, Homo sapiens
cttttcctcaagcaat

SEQ ID NO: 928555 - DNA, 18 bp, Homo sapiens
cttttcctctctcccgga

SEQ ID NO: 928556 - DNA, 16 bp, Homo sapiens
cttttcctctctgtct

SEQ ID NO: 928557 - DNA, 19 bp, Homo sapiens
cttttcctcttagaagaat

SEQ ID NO: 928558 - DNA, 22 bp, Homo sapiens
cttttcctgataaagcacagct

SEQ ID NO: 928559 - DNA, 19 bp, Homo sapiens
cttttccttcattcatagg

SEQ ID NO: 928560 - DNA, 11 bp, Homo sapiens
cttttccttta

SEQ ID NO: 928561 - DNA, 17 bp, Homo sapiens
cttttcctttatccact

SEQ ID NO: 928562 - DNA, 23 bp, Homo sapiens
cttttcgagcatgcggagccagc

SEQ ID NO: 928563 - DNA, 15 bp, Homo sapiens
cttttctaaactgca

SEQ ID NO: 928564 - DNA, 19 bp, Homo sapiens
cttttctaaactgcatctg

SEQ ID NO: 928565 - DNA, 22 bp, Homo sapiens
cttttctaaccaagaggctggt

SEQ ID NO: 928566 - DNA, 19 bp, Homo sapiens
cttttctaagaaaagcatt

SEQ ID NO: 928567 - DNA, 16 bp, Homo sapiens
cttttctaccctagcc

SEQ ID NO: 928568 - DNA, 16 bp, Homo sapiens
cttttctagagacaca

SEQ ID NO: 928569 - DNA, 18 bp, Homo sapiens
cttttctagagacacatt

SEQ ID NO: 928570 - DNA, 11 bp, Homo sapiens
cttttctataa

SEQ ID NO: 928571 - DNA, 17 bp, Homo sapiens
cttttctataagttgta

SEQ ID NO: 928572 - DNA, 20 bp, Homo sapiens
cttttctataagttgtacca

SEQ ID NO: 928573 - DNA, 15 bp, Homo sapiens
cttttctcacaaaaa

SEQ ID NO: 928574 - DNA, 15 bp, Homo sapiens
cttttctccatgagt

SEQ ID NO: 928575 - DNA, 17 bp, Homo sapiens
cttttctcctccgcctg

SEQ ID NO: 928576 - DNA, 13 bp, Homo sapiens
cttttctctgctt

SEQ ID NO: 928577 - DNA, 14 bp, Homo sapiens
cttttctctttctc

SEQ ID NO: 928578 - DNA, 22 bp, Homo sapiens
ccagggcccctcaccctgcctt

SEQ ID NO: 928579 - DNA, 17 bp, Homo sapiens
ccagggcccctccctct

SEQ ID NO: 928580 - DNA, 23 bp, Homo sapiens
ccagggcccctccctctgcccca

SEQ ID NO: 928581 - DNA, 14 bp, Homo sapiens
ccagggcccgcacc

SEQ ID NO: 928582 - DNA, 17 bp, Homo sapiens
ccagggccctcccagcc

SEQ ID NO: 928583 - DNA, 14 bp, Homo sapiens
ccagggccctgcag

SEQ ID NO: 928584 - DNA, 15 bp, Homo sapiens
ccagggccctgcaga

SEQ ID NO: 928585 - DNA, 12 bp, Homo sapiens
ccagggccctgg

SEQ ID NO: 928586 - DNA, 14 bp, Homo sapiens
ccagggccctggat

SEQ ID NO: 928587 - DNA, 13 bp, Homo sapiens
ccagggccctggg

SEQ ID NO: 928588 - DNA, 14 bp, Homo sapiens
ccagggcctccagg

SEQ ID NO: 928589 - DNA, 17 bp, Homo sapiens
ccagggcctccctgttc

SEQ ID NO: 928590 - DNA, 18 bp, Homo sapiens
ccagggcctgaaacccgc

SEQ ID NO: 928591 - DNA, 16 bp, Homo sapiens
ccagggcctgacaccc

SEQ ID NO: 928592 - DNA, 13 bp, Homo sapiens
ccagggcctgact

SEQ ID NO: 928593 - DNA, 16 bp, Homo sapiens
ccagggcctgcatggg

SEQ ID NO: 928594 - DNA, 14 bp, Homo sapiens
ccagggcctgcgga

SEQ ID NO: 928595 - DNA, 15 bp, Homo sapiens
ccagggcctgcggag

SEQ ID NO: 928596 - DNA, 16 bp, Homo sapiens
ccagggcctgggggca

SEQ ID NO: 928597 - DNA, 14 bp, Homo sapiens
ccagggcctgtctc

SEQ ID NO: 928598 - DNA, 20 bp, Homo sapiens
ccagggcggccagggaccca

SEQ ID NO: 928599 - DNA, 19 bp, Homo sapiens
ccagggctagtgaagtggc

SEQ ID NO: 928600 - DNA, 21 bp, Homo sapiens
ccagggctagtgaagtggcct

SEQ ID NO: 928601 - DNA, 16 bp, Homo sapiens
ccagggctagtgactt

SEQ ID NO: 928602 - DNA, 19 bp, Homo sapiens
ccagggctatagcagaaag

SEQ ID NO: 928603 - DNA, 16 bp, Homo sapiens
cttttgttctgcttta

SEQ ID NO: 928604 - DNA, 12 bp, Homo sapiens
cttttgttcttg

SEQ ID NO: 928605 - DNA, 17 bp, Homo sapiens
cttttgttgtgactttt

SEQ ID NO: 928606 - DNA, 14 bp, Homo sapiens
cttttgttgtttat

SEQ ID NO: 928607 - DNA, 13 bp, Homo sapiens
cttttgtttattt

SEQ ID NO: 928608 - DNA, 12 bp, Homo sapiens
cttttgtttcca

SEQ ID NO: 928609 - DNA, 16 bp, Homo sapiens
cttttgtttccttttt

SEQ ID NO: 928610 - DNA, 16 bp, Homo sapiens
cttttgttttttgggg

SEQ ID NO: 928611 - DNA, 15 bp, Homo sapiens
ctttttaaaaaatac

SEQ ID NO: 928612 - DNA, 20 bp, Homo sapiens
ctttttaaaaactcttcagt

SEQ ID NO: 928613 - DNA, 18 bp, Homo sapiens
ctttttaaaatatatgta

SEQ ID NO: 928614 - DNA, 23 bp, Homo sapiens
ctttttaaagagatagcttctct

SEQ ID NO: 928615 - DNA, 21 bp, Homo sapiens
ctttttaaagtaaattattaa

SEQ ID NO: 928616 - DNA, 16 bp, Homo sapiens
ctttttaaagtgtttc

SEQ ID NO: 928617 - DNA, 19 bp, Homo sapiens
ctttttaaagtgtttctgt

SEQ ID NO: 928618 - DNA, 20 bp, Homo sapiens
ctttttaaagtttgttcact

SEQ ID NO: 928619 - DNA, 23 bp, Homo sapiens
ctttttaacaaaaaacagattct

SEQ ID NO: 928620 - DNA, 16 bp, Homo sapiens
ctttttaagagatact

SEQ ID NO: 928621 - DNA, 14 bp, Homo sapiens
ctttttaagggatt

SEQ ID NO: 928622 - DNA, 16 bp, Homo sapiens
ctttttaatcatgaat

SEQ ID NO: 928623 - DNA, 14 bp, Homo sapiens
ctttttagccagtg

SEQ ID NO: 928624 - DNA, 19 bp, Homo sapiens
ctttttagggccaggcagg

SEQ ID NO: 928625 - DNA, 16 bp, Homo sapiens
ctttttagtaatttct

SEQ ID NO: 928626 - DNA, 18 bp, Homo sapiens
ctttttatgcaaaagtca

SEQ ID NO: 928627 - DNA, 13 bp, Homo sapiens
ctttttattgaat

SEQ ID NO: 928628 - DNA, 21 bp, Homo sapiens
ctttttatttaaatgtgaatt

SEQ ID NO: 928629 - DNA, 13 bp, Homo sapiens
ctttttatttgca

SEQ ID NO: 928630 - DNA, 11 bp, Homo sapiens
ctttttcaatg

SEQ ID NO: 928631 - DNA, 20 bp, Homo sapiens
ctttttcaatgaattttata

SEQ ID NO: 928632 - DNA, 22 bp, Homo sapiens
ctttttcagaaacagggcagca

SEQ ID NO: 928633 - DNA, 17 bp, Homo sapiens
ctttttcatatgttgct

SEQ ID NO: 928634 - DNA, 15 bp, Homo sapiens
ctttttcatttatct

SEQ ID NO: 928635 - DNA, 22 bp, Homo sapiens
ctttttcatttttttctctctg

SEQ ID NO: 928636 - DNA, 13 bp, Homo sapiens
ctttttccagagg

SEQ ID NO: 928637 - DNA, 12 bp, Homo sapiens
ctttttcctcct

SEQ ID NO: 928638 - DNA, 17 bp, Homo sapiens
ctttttccttcttcagc

SEQ ID NO: 928639 - DNA, 22 bp, Homo sapiens
ctttttctaatgaggagagaaa

SEQ ID NO: 928640 - DNA, 18 bp, Homo sapiens
ctttttctaatgtggtta

SEQ ID NO: 928641 - DNA, 13 bp, Homo sapiens
ctttttctcttct

SEQ ID NO: 928642 - DNA, 14 bp, Homo sapiens
ctttttctggaaat

SEQ ID NO: 928643 - DNA, 13 bp, Homo sapiens
ctttttcttcact

SEQ ID NO: 928644 - DNA, 18 bp, Homo sapiens
ctttttcttcctctcggc

SEQ ID NO: 928645 - DNA, 15 bp, Homo sapiens
ctttttcttcttccc

SEQ ID NO: 928646 - DNA, 22 bp, Homo sapiens
ctttttcttgatcttaaagatc

SEQ ID NO: 928647 - DNA, 17 bp, Homo sapiens
ctttttctttaaggtcc

SEQ ID NO: 928648 - DNA, 12 bp, Homo sapiens
ctttttctttat

SEQ ID NO: 928649 - DNA, 18 bp, Homo sapiens
ctttttctttataaactt

SEQ ID NO: 928650 - DNA, 14 bp, Homo sapiens
ctttttctttttaa

SEQ ID NO: 928651 - DNA, 21 bp, Homo sapiens
ctttttgaagtgtaggcagac

SEQ ID NO: 928652 - DNA, 13 bp, Homo sapiens
ctttttgacactg

SEQ ID NO: 928653 - DNA, 17 bp, Homo sapiens
ctttttgcttctacttt

SEQ ID NO: 928654 - DNA, 13 bp, Homo sapiens
ctttttgctttcg

SEQ ID NO: 928655 - DNA, 12 bp, Homo sapiens
ctttttggaatc

SEQ ID NO: 928656 - DNA, 17 bp, Homo sapiens
ctttttgtaaatactgc

SEQ ID NO: 928657 - DNA, 11 bp, Homo sapiens
ctttttgtagg

SEQ ID NO: 928658 - DNA, 18 bp, Homo sapiens
ctttttgtattttttcct

SEQ ID NO: 928659 - DNA, 17 bp, Homo sapiens
ctttttgttgtaaaaca

SEQ ID NO: 928660 - DNA, 21 bp, Homo sapiens
ctttttgttgtaaaacaaaat

SEQ ID NO: 928661 - DNA, 16 bp, Homo sapiens
cttttttagagttgat

SEQ ID NO: 928662 - DNA, 15 bp, Homo sapiens
cttttttataactaa

SEQ ID NO: 928663 - DNA, 15 bp, Homo sapiens
cttttttatacataa

SEQ ID NO: 928664 - DNA, 17 bp, Homo sapiens
cttttttatacataaac

SEQ ID NO: 928665 - DNA, 18 bp, Homo sapiens
cttttttatacataaaca

SEQ ID NO: 928666 - DNA, 13 bp, Homo sapiens
cttttttatgtta

SEQ ID NO: 928667 - DNA, 17 bp, Homo sapiens
cttttttcaatatgcaa

SEQ ID NO: 928668 - DNA, 13 bp, Homo sapiens
cttttttcagtta

SEQ ID NO: 928669 - DNA, 17 bp, Homo sapiens
cttttttcagttatttt

SEQ ID NO: 928670 - DNA, 14 bp, Homo sapiens
cttttttcattttg

SEQ ID NO: 928671 - DNA, 22 bp, Homo sapiens
cttttttcccataagacaatga

SEQ ID NO: 928672 - DNA, 13 bp, Homo sapiens
cttttttcctaat

SEQ ID NO: 928673 - DNA, 14 bp, Homo sapiens
cttttttcttttct

SEQ ID NO: 928674 - DNA, 13 bp, Homo sapiens
cttttttgaacca

SEQ ID NO: 928675 - DNA, 15 bp, Homo sapiens
cttttttgctttctt

SEQ ID NO: 928676 - DNA, 10 bp, Homo sapiens
cttttttgtc

SEQ ID NO: 928677 - DNA, 11 bp, Homo sapiens
cttttttgtcc

SEQ ID NO: 928678 - DNA, 11 bp, Homo sapiens
cttttttgtct

SEQ ID NO: 928679 - DNA, 20 bp, Homo sapiens
cttttttgtgtttttaaaag

SEQ ID NO: 928680 - DNA, 18 bp, Homo sapiens
cttttttgtttgtttctt

SEQ ID NO: 928681 - DNA, 21 bp, Homo sapiens
cttttttgttttttcaaaata

SEQ ID NO: 928682 - DNA, 21 bp, Homo sapiens
ctttttttaagtgcttacatt

SEQ ID NO: 928683 - DNA, 22 bp, Homo sapiens
ctttttttataagcaaaaacgt

SEQ ID NO: 928684 - DNA, 20 bp, Homo sapiens
ctttttttctgtgacattta

SEQ ID NO: 928685 - DNA, 15 bp, Homo sapiens
ctttttttggggtgc

SEQ ID NO: 928686 - DNA, 15 bp, Homo sapiens
ctttttttggtaaat

SEQ ID NO: 928687 - DNA, 13 bp, Homo sapiens
ctttttttgtaga

SEQ ID NO: 928688 - DNA, 12 bp, Homo sapiens
ctttttttgtat

SEQ ID NO: 928689 - DNA, 13 bp, Homo sapiens
ctttttttgtata

SEQ ID NO: 928690 - DNA, 16 bp, Homo sapiens
ctttttttgtatgtgt

SEQ ID NO: 928691 - DNA, 12 bp, Homo sapiens
ctttttttgtta

SEQ ID NO: 928692 - DNA, 12 bp, Homo sapiens
cttttttttcct

SEQ ID NO: 928693 - DNA, 14 bp, Homo sapiens
ctttttttttaagt

SEQ ID NO: 928694 - DNA, 23 bp, Homo sapiens
ctttttttttatactgcacagtg

SEQ ID NO: 928695 - DNA, 15 bp, Homo sapiens
ctttttttttgaaac

SEQ ID NO: 928696 - DNA, 17 bp, Homo sapiens
ctttttttttgaaacag

SEQ ID NO: 928697 - DNA, 20 bp, Homo sapiens
ctttttttttgaaacagcag

SEQ ID NO: 928698 - DNA, 21 bp, Homo sapiens
ctttttttttgaaacagcagt

SEQ ID NO: 928699 - DNA, 16 bp, Homo sapiens
ctttttttttttttcc

SEQ ID NO: 928700 - DNA, 20 bp, Homo sapiens
ctttttttttttttttgaaa

SEQ ID NO: 928701 - DNA, 15 bp, Homo sapiens
gaaaaaaaaaaaagc

SEQ ID NO: 928702 - DNA, 13 bp, Homo sapiens
ccagtgatgatgt

SEQ ID NO: 928703 - DNA, 22 bp, Homo sapiens
ccagtgatgatgttttgatatt

SEQ ID NO: 928704 - DNA, 14 bp, Homo sapiens
ccagtgcaacagca

SEQ ID NO: 928705 - DNA, 20 bp, Homo sapiens
ccagtgcacctccctcccca

SEQ ID NO: 928706 - DNA, 23 bp, Homo sapiens
ccagtgcactccggtcccaaatg

SEQ ID NO: 928707 - DNA, 14 bp, Homo sapiens
ccagtgcagccact

SEQ ID NO: 928708 - DNA, 15 bp, Homo sapiens
ccagtgcatatgcaa

SEQ ID NO: 928709 - DNA, 18 bp, Homo sapiens
ccagtgcattttgtttct

SEQ ID NO: 928710 - DNA, 13 bp, Homo sapiens
ccagtgccactgc

SEQ ID NO: 928711 - DNA, 18 bp, Homo sapiens
ccagtgccactgcccccc

SEQ ID NO: 928712 - DNA, 14 bp, Homo sapiens
ccagtgccagctcc

SEQ ID NO: 928713 - DNA, 11 bp, Homo sapiens
ccagtgccagg

SEQ ID NO: 928714 - DNA, 23 bp, Homo sapiens
ccagtgccattccactccactca

SEQ ID NO: 928715 - DNA, 20 bp, Homo sapiens
ccagtgccgagaaggaagcc

SEQ ID NO: 928716 - DNA, 16 bp, Homo sapiens
ccagtgccgctcctgc

SEQ ID NO: 928717 - DNA, 13 bp, Homo sapiens
ccagtgcctgcca

SEQ ID NO: 928718 - DNA, 21 bp, Homo sapiens
ccagtgcctgccactctctgg

SEQ ID NO: 928719 - DNA, 19 bp, Homo sapiens
ccagtgccttacctcctgc

SEQ ID NO: 928720 - DNA, 22 bp, Homo sapiens
ccagtgctcaccagccctgcag

SEQ ID NO: 928721 - DNA, 20 bp, Homo sapiens
ccagtgctccaggcacccag

SEQ ID NO: 928722 - DNA, 13 bp, Homo sapiens
ccagtgctctgcc

SEQ ID NO: 928723 - DNA, 14 bp, Homo sapiens
ccagtgctgccatg

SEQ ID NO: 928724 - DNA, 12 bp, Homo sapiens
ccagtgctgctt

SEQ ID NO: 928725 - DNA, 14 bp, Homo sapiens
ccagtgctgcttct

SEQ ID NO: 928726 - DNA, 22 bp, Homo sapiens
ccagtggaacagcgggagacct

SEQ ID NO: 928727 - DNA, 21 bp, Homo sapiens
ccagtggaattccaacttgaa

SEQ ID NO: 928728 - DNA, 16 bp, Homo sapiens
ccagtggaccctggac

SEQ ID NO: 928729 - DNA, 19 bp, Homo sapiens
ccagtggacctagcctgga

SEQ ID NO: 928730 - DNA, 20 bp, Homo sapiens
ccagtggacctagcctggat

SEQ ID NO: 928731 - DNA, 16 bp, Homo sapiens
ccagtggagctggtct

SEQ ID NO: 928732 - DNA, 19 bp, Homo sapiens
ccagtggatgccacagccc

SEQ ID NO: 928733 - DNA, 14 bp, Homo sapiens
ccagtggcacagga

SEQ ID NO: 928734 - DNA, 13 bp, Homo sapiens
ccagtggcccccg

SEQ ID NO: 928735 - DNA, 24 bp, Homo sapiens
ccagtggcctcaaccctccctcag

SEQ ID NO: 928736 - DNA, 19 bp, Homo sapiens
ccagtggccttccccagca

SEQ ID NO: 928737 - DNA, 16 bp, Homo sapiens
ccagtgggaggggcag

SEQ ID NO: 928738 - DNA, 16 bp, Homo sapiens
gaaaagcaacattcat

SEQ ID NO: 928739 - DNA, 19 bp, Homo sapiens
gaaaagcaacttcatttga

SEQ ID NO: 928740 - DNA, 16 bp, Homo sapiens
gaaaagcaatacaact

SEQ ID NO: 928741 - DNA, 18 bp, Homo sapiens
gaaaagcaattgccctgt

SEQ ID NO: 928742 - DNA, 19 bp, Homo sapiens
gaaaagcaattgccctgta

SEQ ID NO: 928743 - DNA, 18 bp, Homo sapiens
gaaaagcacacacaataa

SEQ ID NO: 928744 - DNA, 14 bp, Homo sapiens
gaaaagcacagagg

SEQ ID NO: 928745 - DNA, 19 bp, Homo sapiens
gaaaagcagtcccattcat

SEQ ID NO: 928746 - DNA, 14 bp, Homo sapiens
gaaaagcattttca

SEQ ID NO: 928747 - DNA, 16 bp, Homo sapiens
gaaaagcattttcagt

SEQ ID NO: 928748 - DNA, 22 bp, Homo sapiens
gaaaagcattttcagtcttgta

SEQ ID NO: 928749 - DNA, 20 bp, Homo sapiens
gaaaagcctccgcctgctgt

SEQ ID NO: 928750 - DNA, 23 bp, Homo sapiens
gaaaagctagaattgagtgttta

SEQ ID NO: 928751 - DNA, 12 bp, Homo sapiens
gaaaaggaaaaa

SEQ ID NO: 928752 - DNA, 15 bp, Homo sapiens
gaaaaggaagactag

SEQ ID NO: 928753 - DNA, 16 bp, Homo sapiens
gaaaaggcaaaagact

SEQ ID NO: 928754 - DNA, 18 bp, Homo sapiens
gaaaaggcaaaagactgg

SEQ ID NO: 928755 - DNA, 20 bp, Homo sapiens
gaaaaggctggagagagatt

SEQ ID NO: 928756 - DNA, 16 bp, Homo sapiens
gaaaagggaaaaaaga

SEQ ID NO: 928757 - DNA, 17 bp, Homo sapiens
gaaaagggagaaaaaga

SEQ ID NO: 928758 - DNA, 17 bp, Homo sapiens
gaaaagggagtttaaaa

SEQ ID NO: 928759 - DNA, 13 bp, Homo sapiens
gaaaaggggagca

SEQ ID NO: 928760 - DNA, 20 bp, Homo sapiens
gaaaaggggagcacaaggcc

SEQ ID NO: 928761 - DNA, 21 bp, Homo sapiens
gaaaagggtcttgggaaatat

SEQ ID NO: 928762 - DNA, 20 bp, Homo sapiens
gaaaaggtgtccttttcctt

SEQ ID NO: 928763 - DNA, 23 bp, Homo sapiens
gaaaaggttcttcttgggagtat

SEQ ID NO: 928764 - DNA, 17 bp, Homo sapiens
gaaaaggtttatgaaaa

SEQ ID NO: 928765 - DNA, 19 bp, Homo sapiens
gaaaagtaattttgtcaca

SEQ ID NO: 928766 - DNA, 15 bp, Homo sapiens
gaaaagtatgttcta

SEQ ID NO: 928767 - DNA, 12 bp, Homo sapiens
gaaaagtattgg

SEQ ID NO: 928768 - DNA, 12 bp, Homo sapiens
gaaaagtgatgt

SEQ ID NO: 928769 - DNA, 17 bp, Homo sapiens
gaaaagtgcctgagctg

SEQ ID NO: 928770 - DNA, 19 bp, Homo sapiens
gaaaagtgcctgagctggg

SEQ ID NO: 928771 - DNA, 19 bp, Homo sapiens
gaaaagtggcaagaccaaa

SEQ ID NO: 928772 - DNA, 23 bp, Homo sapiens
gaaaagtggcgtgggagccagcc

SEQ ID NO: 928773 - DNA, 14 bp, Homo sapiens
gaaaagtgggctgc

SEQ ID NO: 928774 - DNA, 20 bp, Homo sapiens
gaaaagtgggctgcagcagc

SEQ ID NO: 928775 - DNA, 19 bp, Homo sapiens
gaaaagtgtgtatctagct

SEQ ID NO: 928776 - DNA, 15 bp, Homo sapiens
gaaaagttaaactaa

SEQ ID NO: 928777 - DNA, 19 bp, Homo sapiens
gaaaagttaaactaaaaaa

SEQ ID NO: 928778 - DNA, 22 bp, Homo sapiens
gaaaagttcaatactcttgaaa

SEQ ID NO: 928779 - DNA, 12 bp, Homo sapiens
gaaaagttcata

SEQ ID NO: 928780 - DNA, 14 bp, Homo sapiens
gaaaagttggaagg

SEQ ID NO: 928781 - DNA, 23 bp, Homo sapiens
gaaaagtttcgacttatttctta

SEQ ID NO: 928782 - DNA, 16 bp, Homo sapiens
gaaaataaaaaaaaga

SEQ ID NO: 928783 - DNA, 17 bp, Homo sapiens
gaaaataaaaaaaagaa

SEQ ID NO: 928784 - DNA, 22 bp, Homo sapiens
gaaaataaaaaaaagaaaaaag

SEQ ID NO: 928785 - DNA, 13 bp, Homo sapiens
gaaaataaaacac

SEQ ID NO: 928786 - DNA, 18 bp, Homo sapiens
gaaaataaaacacacctc

SEQ ID NO: 928787 - DNA, 12 bp, Homo sapiens
gaaaataaacat

SEQ ID NO: 928788 - DNA, 23 bp, Homo sapiens
gaaaataaatcttagtgttcaaa

SEQ ID NO: 928789 - DNA, 16 bp, Homo sapiens
gaaaataacagatgct

SEQ ID NO: 928790 - DNA, 15 bp, Homo sapiens
gaaaataactgaatt

SEQ ID NO: 928791 - DNA, 13 bp, Homo sapiens
gaaaataattgtt

SEQ ID NO: 928792 - DNA, 11 bp, Homo sapiens
gaaaataattt

SEQ ID NO: 928793 - DNA, 15 bp, Homo sapiens
gaaaatacaataaac

SEQ ID NO: 928794 - DNA, 16 bp, Homo sapiens
gaaaatacaataaact

SEQ ID NO: 928795 - DNA, 22 bp, Homo sapiens
gaaaataccataggaagacata

SEQ ID NO: 928796 - DNA, 19 bp, Homo sapiens
gaaaatagctctttcaggg

SEQ ID NO: 928797 - DNA, 13 bp, Homo sapiens
gaaaataggcttt

SEQ ID NO: 928798 - DNA, 14 bp, Homo sapiens
gaaaatagtgttcc

SEQ ID NO: 928799 - DNA, 19 bp, Homo sapiens
gaaaatatgtctgcaggtt

SEQ ID NO: 928800 - DNA, 13 bp, Homo sapiens
gaaaatattctct

SEQ ID NO: 928801 - DNA, 19 bp, Homo sapiens
gaaaatattctctatttga

SEQ ID NO: 928802 - DNA, 18 bp, Homo sapiens
gaaaatattttgtctaaa

SEQ ID NO: 928803 - DNA, 21 bp, Homo sapiens
gaaaatcatcaagaagggctg

SEQ ID NO: 928804 - DNA, 22 bp, Homo sapiens
gaaaatcatcaagaagggctgc

SEQ ID NO: 928805 - DNA, 23 bp, Homo sapiens
gaaaatcatcaagaagggctgca

SEQ ID NO: 928806 - DNA, 16 bp, Homo sapiens
gaaaatcctatatctg

SEQ ID NO: 928807 - DNA, 14 bp, Homo sapiens
gaaaatccttttaa

SEQ ID NO: 928808 - DNA, 14 bp, Homo sapiens
gaaaatgaaatgca

SEQ ID NO: 928809 - DNA, 12 bp, Homo sapiens
gaaaatgactta

SEQ ID NO: 928810 - DNA, 20 bp, Homo sapiens
gaaaatgactttatttttct

SEQ ID NO: 928811 - DNA, 16 bp, Homo sapiens
gaaaatgagcatcaga

SEQ ID NO: 928812 - DNA, 12 bp, Homo sapiens
gaaaatgagccc

SEQ ID NO: 928813 - DNA, 13 bp, Homo sapiens
gaaaatgagccct

SEQ ID NO: 928814 - DNA, 14 bp, Homo sapiens
gaaaatgcagcagg

SEQ ID NO: 928815 - DNA, 23 bp, Homo sapiens
gaaaatgcagcagggatgccctg

SEQ ID NO: 928816 - DNA, 22 bp, Homo sapiens
gaaaatgcagtcctgaggagag

SEQ ID NO: 928817 - DNA, 21 bp, Homo sapiens
gaaaatgccatgaaaattgct

SEQ ID NO: 928818 - DNA, 18 bp, Homo sapiens
gaaaatgctcttaaaata

SEQ ID NO: 928819 - DNA, 19 bp, Homo sapiens
gaaaatggatatagaaaat

SEQ ID NO: 928820 - DNA, 22 bp, Homo sapiens
gaaaatggccatgcaggaggtg

SEQ ID NO: 928821 - DNA, 20 bp, Homo sapiens
gaaaatggctaataaactgt

SEQ ID NO: 928822 - DNA, 21 bp, Homo sapiens
gaaaatggctaataaactgta

SEQ ID NO: 928823 - DNA, 16 bp, Homo sapiens
gaaaatgtaaaggttt

SEQ ID NO: 928824 - DNA, 18 bp, Homo sapiens
ccatcccctttcctcccc

SEQ ID NO: 928825 - DNA, 22 bp, Homo sapiens
ccatcccgaagccatcacttct

SEQ ID NO: 928826 - DNA, 22 bp, Homo sapiens
ccatcccgacatggacccggag

SEQ ID NO: 928827 - DNA, 20 bp, Homo sapiens
ccatcccgcttagcctgcct

SEQ ID NO: 928828 - DNA, 15 bp, Homo sapiens
ccatccctaccactg

SEQ ID NO: 928829 - DNA, 13 bp, Homo sapiens
ccatccctgaaga

SEQ ID NO: 928830 - DNA, 22 bp, Homo sapiens
ccatccctgctctggtcccctc

SEQ ID NO: 928831 - DNA, 18 bp, Homo sapiens
ccatccctgggcccctcc

SEQ ID NO: 928832 - DNA, 17 bp, Homo sapiens
ccatccctttttttaca

SEQ ID NO: 928833 - DNA, 22 bp, Homo sapiens
ccatccgactgcccctgctgtg

SEQ ID NO: 928834 - DNA, 23 bp, Homo sapiens
ccatccgcagactgcttggccag

SEQ ID NO: 928835 - DNA, 22 bp, Homo sapiens
ccatccggtcccctgcctggaa

SEQ ID NO: 928836 - DNA, 23 bp, Homo sapiens
ccatccggtttgccatgttgcca

SEQ ID NO: 928837 - DNA, 16 bp, Homo sapiens
ccatcctacccagcgt

SEQ ID NO: 928838 - DNA, 23 bp, Homo sapiens
ccatcctaccctcgggcccacct

SEQ ID NO: 928839 - DNA, 14 bp, Homo sapiens
ccatcctcacccag

SEQ ID NO: 928840 - DNA, 15 bp, Homo sapiens
ccatcctcacccaga

SEQ ID NO: 928841 - DNA, 22 bp, Homo sapiens
ccatcctcagaggctgagccct

SEQ ID NO: 928842 - DNA, 13 bp, Homo sapiens
ccatcctccagca

SEQ ID NO: 928843 - DNA, 14 bp, Homo sapiens
ccatcctccagcag

SEQ ID NO: 928844 - DNA, 15 bp, Homo sapiens
ccatcctccagcagg

SEQ ID NO: 928845 - DNA, 23 bp, Homo sapiens
ccatcctccagccctgcccaccc

SEQ ID NO: 928846 - DNA, 13 bp, Homo sapiens
ccatcctcccctt

SEQ ID NO: 928847 - DNA, 14 bp, Homo sapiens
ccatcctccccttc

SEQ ID NO: 928848 - DNA, 12 bp, Homo sapiens
ccatcctgatgg

SEQ ID NO: 928849 - DNA, 13 bp, Homo sapiens
ccatcctggctaa

SEQ ID NO: 928850 - DNA, 17 bp, Homo sapiens
ccatcctgtattcttca

SEQ ID NO: 928851 - DNA, 15 bp, Homo sapiens
ccatccttccctttg

SEQ ID NO: 928852 - DNA, 17 bp, Homo sapiens
ccatccttgctgcagct

SEQ ID NO: 928853 - DNA, 20 bp, Homo sapiens
ccatccttggggccttgtgt

SEQ ID NO: 928854 - DNA, 13 bp, Homo sapiens
ccatcgccccacc

SEQ ID NO: 928855 - DNA, 15 bp, Homo sapiens
ccatcggccaagaat

SEQ ID NO: 928856 - DNA, 14 bp, Homo sapiens
ccatcggccctgtc

SEQ ID NO: 928857 - DNA, 15 bp, Homo sapiens
ccatcggccctgtcc

SEQ ID NO: 928858 - DNA, 16 bp, Homo sapiens
ccatcggccctgtccc

SEQ ID NO: 928859 - DNA, 17 bp, Homo sapiens
ccatcgtccagccctcc

SEQ ID NO: 928860 - DNA, 17 bp, Homo sapiens
ccatcgtcctgggactc

SEQ ID NO: 928861 - DNA, 21 bp, Homo sapiens
ccatctagactagcaatctct

SEQ ID NO: 928862 - DNA, 17 bp, Homo sapiens
ccatctagcagctggcc

SEQ ID NO: 928863 - DNA, 14 bp, Homo sapiens
ccatctagccagcc

SEQ ID NO: 928864 - DNA, 23 bp, Homo sapiens
ccatctagccagcccctcttccc

SEQ ID NO: 928865 - DNA, 14 bp, Homo sapiens
ccatctcacaccag

SEQ ID NO: 928866 - DNA, 14 bp, Homo sapiens
ccatctcagcctcc

SEQ ID NO: 928867 - DNA, 21 bp, Homo sapiens
ccatctcagcctcctgagcct

SEQ ID NO: 928868 - DNA, 12 bp, Homo sapiens
ccatctcaggag

SEQ ID NO: 928869 - DNA, 13 bp, Homo sapiens
ccatctcaggaga

SEQ ID NO: 928870 - DNA, 17 bp, Homo sapiens
ccatctcaggagatgga

SEQ ID NO: 928871 - DNA, 14 bp, Homo sapiens
gaaacttacacaca

SEQ ID NO: 928872 - DNA, 15 bp, Homo sapiens
gaaacttacacacaa

SEQ ID NO: 928873 - DNA, 22 bp, Homo sapiens
gaaacttaccaattgatgtttt

SEQ ID NO: 928874 - DNA, 17 bp, Homo sapiens
gaaacttgaactccagg

SEQ ID NO: 928875 - DNA, 16 bp, Homo sapiens
gaaacttggctggaat

SEQ ID NO: 928876 - DNA, 13 bp, Homo sapiens
gaaacttgttatt

SEQ ID NO: 928877 - DNA, 15 bp, Homo sapiens
gaaacttgttattgt

SEQ ID NO: 928878 - DNA, 20 bp, Homo sapiens
gaaacttgttattgtgaatg

SEQ ID NO: 928879 - DNA, 19 bp, Homo sapiens
gaaactttatttaaatgca

SEQ ID NO: 928880 - DNA, 16 bp, Homo sapiens
gaaactttctttctca

SEQ ID NO: 928881 - DNA, 14 bp, Homo sapiens
gaaacttttctaga

SEQ ID NO: 928882 - DNA, 16 bp, Homo sapiens
gaaagaaaagaccctg

SEQ ID NO: 928883 - DNA, 21 bp, Homo sapiens
gaaagaaaagaccctgagact

SEQ ID NO: 928884 - DNA, 14 bp, Homo sapiens
gaaagaaaaggcaa

SEQ ID NO: 928885 - DNA, 9 bp, Homo sapiens
gaaagaaag

SEQ ID NO: 928886 - DNA, 16 bp, Homo sapiens
gaaagaaagctgagaa

SEQ ID NO: 928887 - DNA, 21 bp, Homo sapiens
gaaagaaagggaaaagggaga

SEQ ID NO: 928888 - DNA, 17 bp, Homo sapiens
gaaagaagaacagctgt

SEQ ID NO: 928889 - DNA, 12 bp, Homo sapiens
gaaagaagcagt

SEQ ID NO: 928890 - DNA, 13 bp, Homo sapiens
gaaagaagccata

SEQ ID NO: 928891 - DNA, 11 bp, Homo sapiens
gaaagaaggaa

SEQ ID NO: 928892 - DNA, 16 bp, Homo sapiens
gaaagaagtattaaaa

SEQ ID NO: 928893 - DNA, 20 bp, Homo sapiens
gaaagaagtgtggggatttt

SEQ ID NO: 928894 - DNA, 13 bp, Homo sapiens
gaaagaatagaac

SEQ ID NO: 928895 - DNA, 22 bp, Homo sapiens
gaaagaatgttactgccttaat

SEQ ID NO: 928896 - DNA, 17 bp, Homo sapiens
gaaagaattaaaaactt

SEQ ID NO: 928897 - DNA, 21 bp, Homo sapiens
gaaagacatccataaagaagc

SEQ ID NO: 928898 - DNA, 20 bp, Homo sapiens
gaaagactgggacagcccag

SEQ ID NO: 928899 - DNA, 10 bp, Homo sapiens
gaaagagacc

SEQ ID NO: 928900 - DNA, 13 bp, Homo sapiens
gaaagagagtacc

SEQ ID NO: 928901 - DNA, 16 bp, Homo sapiens
gaaagagatacagagg

SEQ ID NO: 928902 - DNA, 22 bp, Homo sapiens
gaaagagcacttaagagaatat

SEQ ID NO: 928903 - DNA, 19 bp, Homo sapiens
gaaagagcagtcagagtcc

SEQ ID NO: 928904 - DNA, 16 bp, Homo sapiens
gaaagaggcaccagga

SEQ ID NO: 928905 - DNA, 20 bp, Homo sapiens
gaaagaggctgaggcctgga

SEQ ID NO: 928906 - DNA, 21 bp, Homo sapiens
gaaagaggctgaggcctggac

SEQ ID NO: 928907 - DNA, 17 bp, Homo sapiens
gaaagagggaaaaagag

SEQ ID NO: 928908 - DNA, 19 bp, Homo sapiens
gaaagagggtcccagggct

SEQ ID NO: 928909 - DNA, 18 bp, Homo sapiens
gaaagaggttaggagtag

SEQ ID NO: 928910 - DNA, 15 bp, Homo sapiens
gaaagatacagggga

SEQ ID NO: 928911 - DNA, 15 bp, Homo sapiens
gaaagatccaccctc

SEQ ID NO: 928912 - DNA, 14 bp, Homo sapiens
gaaagatgcagtgg

SEQ ID NO: 928913 - DNA, 17 bp, Homo sapiens
gaaagattttattgtat

SEQ ID NO: 928914 - DNA, 13 bp, Homo sapiens
gaaagattttctc

SEQ ID NO: 928915 - DNA, 21 bp, Homo sapiens
gaaagcactacaatcatggtc

SEQ ID NO: 928916 - DNA, 18 bp, Homo sapiens
gaaagcagagcctcctgg

SEQ ID NO: 928917 - DNA, 12 bp, Homo sapiens
gaaagcagcagc

SEQ ID NO: 928918 - DNA, 22 bp, Homo sapiens
gaaagcataaagctcaaatgaa

SEQ ID NO: 928919 - DNA, 17 bp, Homo sapiens
gaaagcatatcccacca

SEQ ID NO: 928920 - DNA, 15 bp, Homo sapiens
gaaagcatatgcagc

SEQ ID NO: 928921 - DNA, 15 bp, Homo sapiens
gaaagcatcactgcc

SEQ ID NO: 928922 - DNA, 15 bp, Homo sapiens
gaaagcatccatgtg

SEQ ID NO: 928923 - DNA, 17 bp, Homo sapiens
gaaagcatccatgtgtg

SEQ ID NO: 928924 - DNA, 20 bp, Homo sapiens
gaaagcatgtctctgcttcc

SEQ ID NO: 928925 - DNA, 21 bp, Homo sapiens
gaaagcatgtggcatgttcat

SEQ ID NO: 928926 - DNA, 22 bp, Homo sapiens
gaaagcatgtggcatgttcatc

SEQ ID NO: 928927 - DNA, 11 bp, Homo sapiens
gaaagccacat

SEQ ID NO: 928928 - DNA, 18 bp, Homo sapiens
gaaagccacctctccctc

SEQ ID NO: 928929 - DNA, 17 bp, Homo sapiens
gaaagccaccttgttac

SEQ ID NO: 928930 - DNA, 13 bp, Homo sapiens
gaaagccagacaa

SEQ ID NO: 928931 - DNA, 20 bp, Homo sapiens
gaaagcccacctgggctggg

SEQ ID NO: 928932 - DNA, 14 bp, Homo sapiens
gaaagccccagcac

SEQ ID NO: 928933 - DNA, 21 bp, Homo sapiens
gaaagccctcccccttcccct

SEQ ID NO: 928934 - DNA, 14 bp, Homo sapiens
gaaagccgggggag

SEQ ID NO: 928935 - DNA, 16 bp, Homo sapiens
gaaagccgggggaggg

SEQ ID NO: 928936 - DNA, 21 bp, Homo sapiens
gaaagccgggggaggggccct

SEQ ID NO: 928937 - DNA, 15 bp, Homo sapiens
gaaagcctaaaattg

SEQ ID NO: 928938 - DNA, 20 bp, Homo sapiens
gaaagcctctctctccctcc

SEQ ID NO: 928939 - DNA, 14 bp, Homo sapiens
gaaagcctctggaa

SEQ ID NO: 928940 - DNA, 15 bp, Homo sapiens
gaaagcctctggaaa

SEQ ID NO: 928941 - DNA, 19 bp, Homo sapiens
gaaagcctgtctctttcca

SEQ ID NO: 928942 - DNA, 21 bp, Homo sapiens
gaaagcctgtctctttccact

SEQ ID NO: 928943 - DNA, 21 bp, Homo sapiens
gaaagcctgttcccctcactg

SEQ ID NO: 928944 - DNA, 14 bp, Homo sapiens
gaaagcctttcctc

SEQ ID NO: 928945 - DNA, 22 bp, Homo sapiens
gaaagcgcctccaaccctagca

SEQ ID NO: 928946 - DNA, 20 bp, Homo sapiens
gaaagcgcggacgtgctggg

SEQ ID NO: 928947 - DNA, 20 bp, Homo sapiens
gaaattaggttgaaacatat

SEQ ID NO: 928948 - DNA, 15 bp, Homo sapiens
gaaattagtcttttt

SEQ ID NO: 928949 - DNA, 18 bp, Homo sapiens
gaaattatgtatgtttac

SEQ ID NO: 928950 - DNA, 13 bp, Homo sapiens
gaaattattggtt

SEQ ID NO: 928951 - DNA, 17 bp, Homo sapiens
gaaattatttaataaaa

SEQ ID NO: 928952 - DNA, 19 bp, Homo sapiens
gaaattcagaacagcctgc

SEQ ID NO: 928953 - DNA, 20 bp, Homo sapiens
gaaattcagttataaagtca

SEQ ID NO: 928954 - DNA, 19 bp, Homo sapiens
gaaattccaactcctgatg

SEQ ID NO: 928955 - DNA, 19 bp, Homo sapiens
gaaattccagcaataagaa

SEQ ID NO: 928956 - DNA, 20 bp, Homo sapiens
gaaattccagcaataagaaa

SEQ ID NO: 928957 - DNA, 18 bp, Homo sapiens
gaaattccagtaaatcct

SEQ ID NO: 928958 - DNA, 20 bp, Homo sapiens
gaaattctatttataataca

SEQ ID NO: 928959 - DNA, 17 bp, Homo sapiens
gaaattctcctggaggt

SEQ ID NO: 928960 - DNA, 12 bp, Homo sapiens
gaaattctgtgg

SEQ ID NO: 928961 - DNA, 20 bp, Homo sapiens
gaaattctttatacattcta

SEQ ID NO: 928962 - DNA, 22 bp, Homo sapiens
gaaattctttcccagtctgtcg

SEQ ID NO: 928963 - DNA, 18 bp, Homo sapiens
gaaattcttttataaata

SEQ ID NO: 928964 - DNA, 23 bp, Homo sapiens
gaaattgaagtgtcttctgttcc

SEQ ID NO: 928965 - DNA, 13 bp, Homo sapiens
gaaattgctattt

SEQ ID NO: 928966 - DNA, 22 bp, Homo sapiens
gaaattggaacagaatgtttta

SEQ ID NO: 928967 - DNA, 15 bp, Homo sapiens
gaaattggctggatg

SEQ ID NO: 928968 - DNA, 19 bp, Homo sapiens
gaaattgttacaatagaat

SEQ ID NO: 928969 - DNA, 20 bp, Homo sapiens
gaaattgttttaccagctcc

SEQ ID NO: 928970 - DNA, 13 bp, Homo sapiens
gaaatttaaacta

SEQ ID NO: 928971 - DNA, 16 bp, Homo sapiens
gaaatttaaataatag

SEQ ID NO: 928972 - DNA, 20 bp, Homo sapiens
gaaatttactgtgagactgt

SEQ ID NO: 928973 - DNA, 19 bp, Homo sapiens
gaaatttattagttaatat

SEQ ID NO: 928974 - DNA, 11 bp, Homo sapiens
gaaatttcaga

SEQ ID NO: 928975 - DNA, 13 bp, Homo sapiens
gaaatttccagag

SEQ ID NO: 928976 - DNA, 14 bp, Homo sapiens
gaaatttgatttct

SEQ ID NO: 928977 - DNA, 16 bp, Homo sapiens
gaaatttgcaactcac

SEQ ID NO: 928978 - DNA, 16 bp, Homo sapiens
gaaatttgcctctgtc

SEQ ID NO: 928979 - DNA, 17 bp, Homo sapiens
gaaatttgttataatga

SEQ ID NO: 928980 - DNA, 19 bp, Homo sapiens
gaaattttatatgcttact

SEQ ID NO: 928981 - DNA, 22 bp, Homo sapiens
gaaattttatatgcttactgat

SEQ ID NO: 928982 - DNA, 16 bp, Homo sapiens
gaaattttatatgtaa

SEQ ID NO: 928983 - DNA, 22 bp, Homo sapiens
gaaattttatatgtaaatgtgt

SEQ ID NO: 928984 - DNA, 21 bp, Homo sapiens
gaaattttcaagagtctaata

SEQ ID NO: 928985 - DNA, 21 bp, Homo sapiens
gaaattttctagactttctgt

SEQ ID NO: 928986 - DNA, 13 bp, Homo sapiens
gaaattttgctat

SEQ ID NO: 928987 - DNA, 18 bp, Homo sapiens
gaaattttggtttttcaa

SEQ ID NO: 928988 - DNA, 19 bp, Homo sapiens
gaaattttgtaagaaggca

SEQ ID NO: 928989 - DNA, 13 bp, Homo sapiens
gaaattttgtcca

SEQ ID NO: 928990 - DNA, 18 bp, Homo sapiens
gaaattttgtccatttta

SEQ ID NO: 928991 - DNA, 18 bp, Homo sapiens
gaaatttttaatgtttat

SEQ ID NO: 928992 - DNA, 20 bp, Homo sapiens
gaaatttttcagatgcttct

SEQ ID NO: 928993 - DNA, 22 bp, Homo sapiens
gaaatttttcagatgcttctgg

SEQ ID NO: 928994 - DNA, 20 bp, Homo sapiens
gaaattttttagtatgttca

SEQ ID NO: 928995 - DNA, 16 bp, Homo sapiens
gaacaaaaaaatctgc

SEQ ID NO: 928996 - DNA, 19 bp, Homo sapiens
gaacaaaaaaatctgcaga

SEQ ID NO: 928997 - DNA, 15 bp, Homo sapiens
gaacaaaaagaaatc

SEQ ID NO: 928998 - DNA, 20 bp, Homo sapiens
gaacaaaaagaaatcttgtc

SEQ ID NO: 928999 - DNA, 19 bp, Homo sapiens
gaacaaaaatgtttccact

SEQ ID NO: 929000 - DNA, 13 bp, Homo sapiens
gaacaaaactgtt

SEQ ID NO: 929001 - DNA, 23 bp, Homo sapiens
gaacaaaagattggagctgaaga

SEQ ID NO: 929002 - DNA, 17 bp, Homo sapiens
gaacaaacactgaatca

SEQ ID NO: 929003 - DNA, 15 bp, Homo sapiens
gaacaaagcagccac

SEQ ID NO: 929004 - DNA, 22 bp, Homo sapiens
gaacaaaggacagagtatgaac

SEQ ID NO: 929005 - DNA, 15 bp, Homo sapiens
gaacaaatatgcttt

SEQ ID NO: 929006 - DNA, 15 bp, Homo sapiens
gaacaaatgtgtttt

SEQ ID NO: 929007 - DNA, 13 bp, Homo sapiens
ccatgtctttctc

SEQ ID NO: 929008 - DNA, 17 bp, Homo sapiens
ccatgtgagccaccgct

SEQ ID NO: 929009 - DNA, 21 bp, Homo sapiens
ccatgtgatggacactccagg

SEQ ID NO: 929010 - DNA, 18 bp, Homo sapiens
ccatgtgattaatgtttt

SEQ ID NO: 929011 - DNA, 12 bp, Homo sapiens
ccatgtgcatat

SEQ ID NO: 929012 - DNA, 22 bp, Homo sapiens
ccatgtgccatctgtacatatt

SEQ ID NO: 929013 - DNA, 17 bp, Homo sapiens
ccatgtgccttgtccag

SEQ ID NO: 929014 - DNA, 22 bp, Homo sapiens
ccatgtgctgggaaatgcagaa

SEQ ID NO: 929015 - DNA, 13 bp, Homo sapiens
ccatgtggcagcc

SEQ ID NO: 929016 - DNA, 21 bp, Homo sapiens
ccatgtggcctgcccagcctc

SEQ ID NO: 929017 - DNA, 16 bp, Homo sapiens
ccatgtgggcacggag

SEQ ID NO: 929018 - DNA, 17 bp, Homo sapiens
ccatgtggggttgctga

SEQ ID NO: 929019 - DNA, 13 bp, Homo sapiens
ccatgtgtacatt

SEQ ID NO: 929020 - DNA, 22 bp, Homo sapiens
ccatgtgtcccctcactctgtc

SEQ ID NO: 929021 - DNA, 17 bp, Homo sapiens
ccatgtgtcctggttcc

SEQ ID NO: 929022 - DNA, 17 bp, Homo sapiens
ccatgtgtgagtgtgtg

SEQ ID NO: 929023 - DNA, 18 bp, Homo sapiens
ccatgtgtgagtgtgtgc

SEQ ID NO: 929024 - DNA, 15 bp, Homo sapiens
ccatgtgtggactca

SEQ ID NO: 929025 - DNA, 10 bp, Homo sapiens
ccatgtgtgt

SEQ ID NO: 929026 - DNA, 16 bp, Homo sapiens
ccatgttaaatgactt

SEQ ID NO: 929027 - DNA, 14 bp, Homo sapiens
ccatgttagcctta

SEQ ID NO: 929028 - DNA, 21 bp, Homo sapiens
ccatgttagggttatgttttt

SEQ ID NO: 929029 - DNA, 16 bp, Homo sapiens
ccatgttatgctggtg

SEQ ID NO: 929030 - DNA, 17 bp, Homo sapiens
ccatgttctatttttga

SEQ ID NO: 929031 - DNA, 18 bp, Homo sapiens
ccatgttctgcccccagc

SEQ ID NO: 929032 - DNA, 15 bp, Homo sapiens
ccatgttgcatgcct

SEQ ID NO: 929033 - DNA, 13 bp, Homo sapiens
ccatgttgcgttc

SEQ ID NO: 929034 - DNA, 13 bp, Homo sapiens
ccatgttgctgcc

SEQ ID NO: 929035 - DNA, 17 bp, Homo sapiens
ccatgttggccaggctg

SEQ ID NO: 929036 - DNA, 18 bp, Homo sapiens
ccatgttgtaatgctgca

SEQ ID NO: 929037 - DNA, 23 bp, Homo sapiens
ccatgtttaaactttgtgccttt

SEQ ID NO: 929038 - DNA, 13 bp, Homo sapiens
ccatgtttagtga

SEQ ID NO: 929039 - DNA, 21 bp, Homo sapiens
ccatgtttagtgaatgacttt

SEQ ID NO: 929040 - DNA, 22 bp, Homo sapiens
ccatgtttattgttttttaaag

SEQ ID NO: 929041 - DNA, 23 bp, Homo sapiens
ccatgtttattgttttttaaaga

SEQ ID NO: 929042 - DNA, 16 bp, Homo sapiens
ccatgtttgagctcag

SEQ ID NO: 929043 - DNA, 21 bp, Homo sapiens
ccatgtttgagctcagacccc

SEQ ID NO: 929044 - DNA, 20 bp, Homo sapiens
ccatgtttgctctaaattaa

SEQ ID NO: 929045 - DNA, 23 bp, Homo sapiens
ccatgtttggtgtttgtctgtgt

SEQ ID NO: 929046 - DNA, 22 bp, Homo sapiens
ccatgtttggttgtaaatgctc

SEQ ID NO: 929047 - DNA, 14 bp, Homo sapiens
ccatgtttgtaaaa

SEQ ID NO: 929048 - DNA, 15 bp, Homo sapiens
ccatgtttgtaaaac

SEQ ID NO: 929049 - DNA, 18 bp, Homo sapiens
ccatgttttgtttacggt

SEQ ID NO: 929050 - DNA, 17 bp, Homo sapiens
ccatgtttttgccaaaa

SEQ ID NO: 929051 - DNA, 15 bp, Homo sapiens
ccattaaaactgctt

SEQ ID NO: 929052 - DNA, 16 bp, Homo sapiens
ccattaaaactgcttt

SEQ ID NO: 929053 - DNA, 13 bp, Homo sapiens
ccattaaaataaa

SEQ ID NO: 929054 - DNA, 16 bp, Homo sapiens
ccattaaaataaaaca

SEQ ID NO: 929055 - DNA, 13 bp, Homo sapiens
ccattaaagtctg

SEQ ID NO: 929056 - DNA, 14 bp, Homo sapiens
ccattaaagtctga

SEQ ID NO: 929057 - DNA, 14 bp, Homo sapiens
ccattaactgcttt

SEQ ID NO: 929058 - DNA, 16 bp, Homo sapiens
ccattaatcatttccc

SEQ ID NO: 929059 - DNA, 12 bp, Homo sapiens
ccattaattaca

SEQ ID NO: 929060 - DNA, 15 bp, Homo sapiens
ccattacatgtttaa

SEQ ID NO: 929061 - DNA, 21 bp, Homo sapiens
ccattactgaggggattctct

SEQ ID NO: 929062 - DNA, 18 bp, Homo sapiens
ccattacttgtataaata

SEQ ID NO: 929063 - DNA, 23 bp, Homo sapiens
ccattagagcacagcttcttctg

SEQ ID NO: 929064 - DNA, 13 bp, Homo sapiens
ccattaggccagc

SEQ ID NO: 929065 - DNA, 16 bp, Homo sapiens
ccattataaaaacact

SEQ ID NO: 929066 - DNA, 20 bp, Homo sapiens
ccattataaccttaatttat

SEQ ID NO: 929067 - DNA, 17 bp, Homo sapiens
ccattatattgttttct

SEQ ID NO: 929068 - DNA, 16 bp, Homo sapiens
ccattatatttgcatt

SEQ ID NO: 929069 - DNA, 14 bp, Homo sapiens
cccaaggaaagccc

SEQ ID NO: 929070 - DNA, 12 bp, Homo sapiens
cccaaggaagct

SEQ ID NO: 929071 - DNA, 15 bp, Homo sapiens
cccaaggagcacagg

SEQ ID NO: 929072 - DNA, 12 bp, Homo sapiens
cccaaggagctg

SEQ ID NO: 929073 - DNA, 14 bp, Homo sapiens
cccaaggagctgat

SEQ ID NO: 929074 - DNA, 12 bp, Homo sapiens
cccaaggaggaa

SEQ ID NO: 929075 - DNA, 20 bp, Homo sapiens
cccaaggagggtccaggcgg

SEQ ID NO: 929076 - DNA, 21 bp, Homo sapiens
cccaaggccccagggacagag

SEQ ID NO: 929077 - DNA, 22 bp, Homo sapiens
cccaaggcgtccgcgcgccagc

SEQ ID NO: 929078 - DNA, 21 bp, Homo sapiens
cccaagggacagcaagtgagc

SEQ ID NO: 929079 - DNA, 18 bp, Homo sapiens
cccaagggatggcaccac

SEQ ID NO: 929080 - DNA, 19 bp, Homo sapiens
cccaaggtcccctccacat

SEQ ID NO: 929081 - DNA, 14 bp, Homo sapiens
cccaaggtcctctc

SEQ ID NO: 929082 - DNA, 23 bp, Homo sapiens
cccaaggttactcagcagcagag

SEQ ID NO: 929083 - DNA, 17 bp, Homo sapiens
cccaagtagctgggatt

SEQ ID NO: 929084 - DNA, 14 bp, Homo sapiens
cccaagtcatttcc

SEQ ID NO: 929085 - DNA, 19 bp, Homo sapiens
cccaagtcccagagcacct

SEQ ID NO: 929086 - DNA, 23 bp, Homo sapiens
cccaagtccctgttttctgagcc

SEQ ID NO: 929087 - DNA, 13 bp, Homo sapiens
cccaagtcctgaa

SEQ ID NO: 929088 - DNA, 17 bp, Homo sapiens
cccaagtcctgaagagg

SEQ ID NO: 929089 - DNA, 23 bp, Homo sapiens
cccaagtcctgaagaggcgggcc

SEQ ID NO: 929090 - DNA, 23 bp, Homo sapiens
cccaagtgaaggttcccaaggac

SEQ ID NO: 929091 - DNA, 18 bp, Homo sapiens
cccaagtgccagtcttgt

SEQ ID NO: 929092 - DNA, 13 bp, Homo sapiens
cccaagtgcctgc

SEQ ID NO: 929093 - DNA, 12 bp, Homo sapiens
cccaagtgggca

SEQ ID NO: 929094 - DNA, 21 bp, Homo sapiens
cccaagtgggcagtcaccacc

SEQ ID NO: 929095 - DNA, 22 bp, Homo sapiens
cccaagtgggcagtcaccaccc

SEQ ID NO: 929096 - DNA, 19 bp, Homo sapiens
cccaagtgggggcagaggg

SEQ ID NO: 929097 - DNA, 22 bp, Homo sapiens
cccaagttgcagtgagcagggt

SEQ ID NO: 929098 - DNA, 16 bp, Homo sapiens
cccaagtttatttctc

SEQ ID NO: 929099 - DNA, 22 bp, Homo sapiens
cccaagttttaggacaaacagc

SEQ ID NO: 929100 - DNA, 19 bp, Homo sapiens
cccaataaaagtgactctc

SEQ ID NO: 929101 - DNA, 12 bp, Homo sapiens
cccaataaaggc

SEQ ID NO: 929102 - DNA, 18 bp, Homo sapiens
cccaataaaggcagctgc

SEQ ID NO: 929103 - DNA, 19 bp, Homo sapiens
cccaataaaggcagctgcc

SEQ ID NO: 929104 - DNA, 16 bp, Homo sapiens
cccaatacaaagatga

SEQ ID NO: 929105 - DNA, 22 bp, Homo sapiens
cccaatacctaataaggcatgc

SEQ ID NO: 929106 - DNA, 11 bp, Homo sapiens
cccaatattat

SEQ ID NO: 929107 - DNA, 15 bp, Homo sapiens
cccaatattataatt

SEQ ID NO: 929108 - DNA, 21 bp, Homo sapiens
cccaatcacgagatcttcctt

SEQ ID NO: 929109 - DNA, 21 bp, Homo sapiens
cccaatcagcttttgttctag

SEQ ID NO: 929110 - DNA, 22 bp, Homo sapiens
cccaatcagcttttgttctaga

SEQ ID NO: 929111 - DNA, 16 bp, Homo sapiens
cccaatccatgcttca

SEQ ID NO: 929112 - DNA, 23 bp, Homo sapiens
cccaatcccagctacctcaacca

SEQ ID NO: 929113 - DNA, 17 bp, Homo sapiens
cccaatccctgccactg

SEQ ID NO: 929114 - DNA, 17 bp, Homo sapiens
cccaatcggactgccaa

SEQ ID NO: 929115 - DNA, 18 bp, Homo sapiens
cccaatcggactgccaaa

SEQ ID NO: 929116 - DNA, 19 bp, Homo sapiens
cccaatcggactgccaaat

SEQ ID NO: 929117 - DNA, 17 bp, Homo sapiens
cccaatcgggtccagag

SEQ ID NO: 929118 - DNA, 19 bp, Homo sapiens
cccaatcgggtccagagac

SEQ ID NO: 929119 - DNA, 12 bp, Homo sapiens
cccaatcttgcc

SEQ ID NO: 929120 - DNA, 16 bp, Homo sapiens
cccaatcttgcccact

SEQ ID NO: 929121 - DNA, 20 bp, Homo sapiens
cccaatcttgcccactggcc

SEQ ID NO: 929122 - DNA, 14 bp, Homo sapiens
cccaatctttctat

SEQ ID NO: 929123 - DNA, 13 bp, Homo sapiens
cccaatgaaatac

SEQ ID NO: 929124 - DNA, 12 bp, Homo sapiens
cccaatgcctgt

SEQ ID NO: 929125 - DNA, 20 bp, Homo sapiens
cccaatgcgacaagtagttc

SEQ ID NO: 929126 - DNA, 14 bp, Homo sapiens
cccaattaaaatac

SEQ ID NO: 929127 - DNA, 17 bp, Homo sapiens
cccaattcggggcctgc

SEQ ID NO: 929128 - DNA, 18 bp, Homo sapiens
cccaattcggggcctgct

SEQ ID NO: 929129 - DNA, 19 bp, Homo sapiens
cccaattcggggcctgctg

SEQ ID NO: 929130 - DNA, 21 bp, Homo sapiens
cccaattcggggcctgctgga

SEQ ID NO: 929131 - DNA, 14 bp, Homo sapiens
cccaattgctggag

SEQ ID NO: 929132 - DNA, 22 bp, Homo sapiens
cccacaaaagacagacccagtg

SEQ ID NO: 929133 - DNA, 18 bp, Homo sapiens
cccacaaccttcggctcc

SEQ ID NO: 929134 - DNA, 11 bp, Homo sapiens
cccacaagccc

SEQ ID NO: 929135 - DNA, 19 bp, Homo sapiens
cccacaaggaaccctcagg

SEQ ID NO: 929136 - DNA, 22 bp, Homo sapiens
cccacaagtggtggtaaccctg

SEQ ID NO: 929137 - DNA, 22 bp, Homo sapiens
cccacaatataaaactgtactt

SEQ ID NO: 929138 - DNA, 14 bp, Homo sapiens
cccacaatgccaga

SEQ ID NO: 929139 - DNA, 18 bp, Homo sapiens
cccacacacaggccttct

SEQ ID NO: 929140 - DNA, 21 bp, Homo sapiens
cccacacacaggccttctgtg

SEQ ID NO: 929141 - DNA, 13 bp, Homo sapiens
cccacacagctgc

SEQ ID NO: 929142 - DNA, 15 bp, Homo sapiens
cccacacagctgccc

SEQ ID NO: 929143 - DNA, 15 bp, Homo sapiens
gaactattggagggt

SEQ ID NO: 929144 - DNA, 22 bp, Homo sapiens
gaactattggagggtgggagag

SEQ ID NO: 929145 - DNA, 20 bp, Homo sapiens
gaactatttaaaataaagag

SEQ ID NO: 929146 - DNA, 20 bp, Homo sapiens
gaactattttcaaagactta

SEQ ID NO: 929147 - DNA, 21 bp, Homo sapiens
gaactcaatctccagggctcc

SEQ ID NO: 929148 - DNA, 23 bp, Homo sapiens
gaactcacagtacctatgacttt

SEQ ID NO: 929149 - DNA, 15 bp, Homo sapiens
gaactcactctgggc

SEQ ID NO: 929150 - DNA, 16 bp, Homo sapiens
gaactcactctgggct

SEQ ID NO: 929151 - DNA, 17 bp, Homo sapiens
gaactcactctgggctg

SEQ ID NO: 929152 - DNA, 16 bp, Homo sapiens
gaactcactggggcct

SEQ ID NO: 929153 - DNA, 17 bp, Homo sapiens
gaactcagcagttgaca

SEQ ID NO: 929154 - DNA, 21 bp, Homo sapiens
gaactcagcagttgacatcca

SEQ ID NO: 929155 - DNA, 14 bp, Homo sapiens
gaactccaggccct

SEQ ID NO: 929156 - DNA, 17 bp, Homo sapiens
gaactccaggccctcct

SEQ ID NO: 929157 - DNA, 16 bp, Homo sapiens
gaactccatacagcct

SEQ ID NO: 929158 - DNA, 11 bp, Homo sapiens
gaactcccagc

SEQ ID NO: 929159 - DNA, 19 bp, Homo sapiens
gaactcccagcaacacaag

SEQ ID NO: 929160 - DNA, 15 bp, Homo sapiens
gaactcctgacctca

SEQ ID NO: 929161 - DNA, 20 bp, Homo sapiens
gaactcctggaaatatcagt

SEQ ID NO: 929162 - DNA, 16 bp, Homo sapiens
gaactcgatgcactga

SEQ ID NO: 929163 - DNA, 18 bp, Homo sapiens
gaactcgcgctcagtaaa

SEQ ID NO: 929164 - DNA, 17 bp, Homo sapiens
gaactctcaaaagtcta

SEQ ID NO: 929165 - DNA, 17 bp, Homo sapiens
gaactctctccacccta

SEQ ID NO: 929166 - DNA, 13 bp, Homo sapiens
gaactctctgtct

SEQ ID NO: 929167 - DNA, 17 bp, Homo sapiens
gaactctggcttccagg

SEQ ID NO: 929168 - DNA, 19 bp, Homo sapiens
gaactctggcttccaggta

SEQ ID NO: 929169 - DNA, 13 bp, Homo sapiens
gaactcttaatca

SEQ ID NO: 929170 - DNA, 20 bp, Homo sapiens
gaactcttaatcaaatagca

SEQ ID NO: 929171 - DNA, 15 bp, Homo sapiens
gaactcttagaaatg

SEQ ID NO: 929172 - DNA, 13 bp, Homo sapiens
gaactcttcagaa

SEQ ID NO: 929173 - DNA, 21 bp, Homo sapiens
gaactcttcagaacacacaga

SEQ ID NO: 929174 - DNA, 18 bp, Homo sapiens
gaactctttctggcctgc

SEQ ID NO: 929175 - DNA, 16 bp, Homo sapiens
gaactgaaacttttct

SEQ ID NO: 929176 - DNA, 20 bp, Homo sapiens
gaactgaaacttttctaaag

SEQ ID NO: 929177 - DNA, 22 bp, Homo sapiens
gaactgaacaccattgaaggct

SEQ ID NO: 929178 - DNA, 22 bp, Homo sapiens
gaactgaagccacttggcccag

SEQ ID NO: 929179 - DNA, 17 bp, Homo sapiens
gaactgaagtccaaatt

SEQ ID NO: 929180 - DNA, 17 bp, Homo sapiens
gaactgaagtttcacat

SEQ ID NO: 929181 - DNA, 19 bp, Homo sapiens
gaactgacaaaggagcctt

SEQ ID NO: 929182 - DNA, 17 bp, Homo sapiens
gaactgagctcctctgg

SEQ ID NO: 929183 - DNA, 21 bp, Homo sapiens
gaactgagctcctctgggcag

SEQ ID NO: 929184 - DNA, 17 bp, Homo sapiens
gaactgagctgggcagg

SEQ ID NO: 929185 - DNA, 13 bp, Homo sapiens
gaactgaggccct

SEQ ID NO: 929186 - DNA, 15 bp, Homo sapiens
gaactgaggccctgt

SEQ ID NO: 929187 - DNA, 16 bp, Homo sapiens
gaactgaggccctgtg

SEQ ID NO: 929188 - DNA, 15 bp, Homo sapiens
gaactgaggccttgt

SEQ ID NO: 929189 - DNA, 22 bp, Homo sapiens
gaactgaggccttgtgtgtcag

SEQ ID NO: 929190 - DNA, 19 bp, Homo sapiens
gaactgagggctctgtttg

SEQ ID NO: 929191 - DNA, 11 bp, Homo sapiens
gaagcaataac

SEQ ID NO: 929192 - DNA, 14 bp, Homo sapiens
gaagcaataactcc

SEQ ID NO: 929193 - DNA, 19 bp, Homo sapiens
gaagcaataactccaagca

SEQ ID NO: 929194 - DNA, 19 bp, Homo sapiens
gaagcaatctttgaaataa

SEQ ID NO: 929195 - DNA, 19 bp, Homo sapiens
gaagcaattatttaaagaa

SEQ ID NO: 929196 - DNA, 16 bp, Homo sapiens
gaagcaccataacttt

SEQ ID NO: 929197 - DNA, 20 bp, Homo sapiens
gaagcacccattatgcgctg

SEQ ID NO: 929198 - DNA, 20 bp, Homo sapiens
gaagcactacaccttgcctt

SEQ ID NO: 929199 - DNA, 21 bp, Homo sapiens
gaagcactacaccttgccttg

SEQ ID NO: 929200 - DNA, 16 bp, Homo sapiens
gaagcacttaagtctt

SEQ ID NO: 929201 - DNA, 17 bp, Homo sapiens
gaagcagcccctcgagg

SEQ ID NO: 929202 - DNA, 12 bp, Homo sapiens
gaagcagcctct

SEQ ID NO: 929203 - DNA, 13 bp, Homo sapiens
gaagcaggctgga

SEQ ID NO: 929204 - DNA, 12 bp, Homo sapiens
gaagcaggttcc

SEQ ID NO: 929205 - DNA, 18 bp, Homo sapiens
gaagcaggttgaggggct

SEQ ID NO: 929206 - DNA, 22 bp, Homo sapiens
gaagcaggttgaggggctcctg

SEQ ID NO: 929207 - DNA, 23 bp, Homo sapiens
gaagcaggttgaggggctcctgg

SEQ ID NO: 929208 - DNA, 22 bp, Homo sapiens
gaagcagtgcctcgaggcaccg

SEQ ID NO: 929209 - DNA, 14 bp, Homo sapiens
gaagcagttggggc

SEQ ID NO: 929210 - DNA, 18 bp, Homo sapiens
gaagcagttggggccctc

SEQ ID NO: 929211 - DNA, 16 bp, Homo sapiens
gaagcagttgtgtcag

SEQ ID NO: 929212 - DNA, 23 bp, Homo sapiens
gaagcataatttgtttaaaattc

SEQ ID NO: 929213 - DNA, 17 bp, Homo sapiens
gaagcatagtgaacaca

SEQ ID NO: 929214 - DNA, 13 bp, Homo sapiens
gaagcatgaaaaa

SEQ ID NO: 929215 - DNA, 22 bp, Homo sapiens
gaagcatgaataacatttaaat

SEQ ID NO: 929216 - DNA, 18 bp, Homo sapiens
gaagcatgctttgctgct

SEQ ID NO: 929217 - DNA, 15 bp, Homo sapiens
gaagcattcagagag

SEQ ID NO: 929218 - DNA, 20 bp, Homo sapiens
gaagcatttcaaagccctgc

SEQ ID NO: 929219 - DNA, 18 bp, Homo sapiens
gaagcatttgatattatc

SEQ ID NO: 929220 - DNA, 18 bp, Homo sapiens
gaagcatttgtattttgt

SEQ ID NO: 929221 - DNA, 18 bp, Homo sapiens
gaagccaagctccctgga

SEQ ID NO: 929222 - DNA, 21 bp, Homo sapiens
gaagccaagctccctggagcc

SEQ ID NO: 929223 - DNA, 17 bp, Homo sapiens
gaagccaagggaaaggg

SEQ ID NO: 929224 - DNA, 21 bp, Homo sapiens
gaagccaagggaaaggggtgc

SEQ ID NO: 929225 - DNA, 13 bp, Homo sapiens
gaagccaagtggg

SEQ ID NO: 929226 - DNA, 18 bp, Homo sapiens
gaagccaattcagacagg

SEQ ID NO: 929227 - DNA, 19 bp, Homo sapiens
gaagccacgctgtcctctc

SEQ ID NO: 929228 - DNA, 17 bp, Homo sapiens
gaagccacttggcccag

SEQ ID NO: 929229 - DNA, 19 bp, Homo sapiens
gaagccagaaggtgcaggg

SEQ ID NO: 929230 - DNA, 18 bp, Homo sapiens
gaagccagagccccaagc

SEQ ID NO: 929231 - DNA, 12 bp, Homo sapiens
gaagccagctgc

SEQ ID NO: 929232 - DNA, 15 bp, Homo sapiens
gaagccagctgccct

SEQ ID NO: 929233 - DNA, 22 bp, Homo sapiens
gaagccagctttccctgcctct

SEQ ID NO: 929234 - DNA, 13 bp, Homo sapiens
gaagccaggagca

SEQ ID NO: 929235 - DNA, 22 bp, Homo sapiens
gaagccaggagcaaatgtttct

SEQ ID NO: 929236 - DNA, 19 bp, Homo sapiens
gaagccaggtacaggagag

SEQ ID NO: 929237 - DNA, 20 bp, Homo sapiens
gaagccaggtacaggagagg

SEQ ID NO: 929238 - DNA, 21 bp, Homo sapiens
gaagccagtcaccttctgggc

SEQ ID NO: 929239 - DNA, 15 bp, Homo sapiens
gaagccagtgacact

SEQ ID NO: 929240 - DNA, 17 bp, Homo sapiens
gaagccagtggagctgg

SEQ ID NO: 929241 - DNA, 16 bp, Homo sapiens
gaagccatagggggct

SEQ ID NO: 929242 - DNA, 18 bp, Homo sapiens
gaagccatagggggctgc

SEQ ID NO: 929243 - DNA, 19 bp, Homo sapiens
gaagccatagggggctgca

SEQ ID NO: 929244 - DNA, 21 bp, Homo sapiens
gaagccatagggggctgcacg

SEQ ID NO: 929245 - DNA, 14 bp, Homo sapiens
gaagccatggtccc

SEQ ID NO: 929246 - DNA, 12 bp, Homo sapiens
gaagccatgtct

SEQ ID NO: 929247 - DNA, 16 bp, Homo sapiens
gaagcccaccaatctg

SEQ ID NO: 929248 - DNA, 20 bp, Homo sapiens
gaagcccaccaatctgccct

SEQ ID NO: 929249 - DNA, 22 bp, Homo sapiens
gaagcccagcccctactgctgt

SEQ ID NO: 929250 - DNA, 15 bp, Homo sapiens
gaagcccagctctgg

SEQ ID NO: 929251 - DNA, 16 bp, Homo sapiens
gaagcccaggggccgg

SEQ ID NO: 929252 - DNA, 16 bp, Homo sapiens
gaagcccatcctgacc

SEQ ID NO: 929253 - DNA, 17 bp, Homo sapiens
gaagcccatcctgacca

SEQ ID NO: 929254 - DNA, 18 bp, Homo sapiens
gaagccccctcttcctcc

SEQ ID NO: 929255 - DNA, 22 bp, Homo sapiens
gaagcccctgtcgcccacccag

SEQ ID NO: 929256 - DNA, 15 bp, Homo sapiens
gaagccccttatttt

SEQ ID NO: 929257 - DNA, 13 bp, Homo sapiens
gaagccccttgga

SEQ ID NO: 929258 - DNA, 14 bp, Homo sapiens
gaagccctccttcc

SEQ ID NO: 929259 - DNA, 18 bp, Homo sapiens
gaagccctggatttcaga

SEQ ID NO: 929260 - DNA, 15 bp, Homo sapiens
gaagccgactctggc

SEQ ID NO: 929261 - DNA, 16 bp, Homo sapiens
gaagccgactctggcc

SEQ ID NO: 929262 - DNA, 17 bp, Homo sapiens
gaagccgactctggccc

SEQ ID NO: 929263 - DNA, 18 bp, Homo sapiens
gaagccggcggcccaagc

SEQ ID NO: 929264 - DNA, 22 bp, Homo sapiens
gaagccggggtgtaacttcctg

SEQ ID NO: 929265 - DNA, 23 bp, Homo sapiens
gaagccggggtgtaacttcctgc

SEQ ID NO: 929266 - DNA, 16 bp, Homo sapiens
gaagccggtgcctggg

SEQ ID NO: 929267 - DNA, 22 bp, Homo sapiens
gaagccgtcctggcgcctggca

SEQ ID NO: 929268 - DNA, 19 bp, Homo sapiens
gaagccgtctgactccaga

SEQ ID NO: 929269 - DNA, 20 bp, Homo sapiens
gaagccgtctgactccagag

SEQ ID NO: 929270 - DNA, 24 bp, Homo sapiens
gaagccgtctgactccagagtctg

SEQ ID NO: 929271 - DNA, 20 bp, Homo sapiens
gaagccgtgctcgccccagc

SEQ ID NO: 929272 - DNA, 17 bp, Homo sapiens
gaagcctcagctaccca

SEQ ID NO: 929273 - DNA, 17 bp, Homo sapiens
gaagcctccaagcacag

SEQ ID NO: 929274 - DNA, 18 bp, Homo sapiens
gaagcctccaagcacaga

SEQ ID NO: 929275 - DNA, 22 bp, Homo sapiens
gaagcctccaagcctgcctccc

SEQ ID NO: 929276 - DNA, 15 bp, Homo sapiens
gaagcctgaactgag

SEQ ID NO: 929277 - DNA, 17 bp, Homo sapiens
cccagaactgcccccac

SEQ ID NO: 929278 - DNA, 14 bp, Homo sapiens
cccagaactggctg

SEQ ID NO: 929279 - DNA, 18 bp, Homo sapiens
cccagaactggctgggcc

SEQ ID NO: 929280 - DNA, 19 bp, Homo sapiens
cccagaactggctgggccc

SEQ ID NO: 929281 - DNA, 20 bp, Homo sapiens
cccagaactggctgggcccc

SEQ ID NO: 929282 - DNA, 15 bp, Homo sapiens
cccagaacttccctg

SEQ ID NO: 929283 - DNA, 20 bp, Homo sapiens
cccagaagtggctactgact

SEQ ID NO: 929284 - DNA, 15 bp, Homo sapiens
cccagaatcccagcc

SEQ ID NO: 929285 - DNA, 19 bp, Homo sapiens
cccagaatcccagccggcc

SEQ ID NO: 929286 - DNA, 20 bp, Homo sapiens
cccagaatcccagccggcca

SEQ ID NO: 929287 - DNA, 14 bp, Homo sapiens
cccagaatggagcc

SEQ ID NO: 929288 - DNA, 18 bp, Homo sapiens
cccagaatggagcctgct

SEQ ID NO: 929289 - DNA, 21 bp, Homo sapiens
cccagaatggagcctgctctc

SEQ ID NO: 929290 - DNA, 19 bp, Homo sapiens
cccagacaaccaaaacata

SEQ ID NO: 929291 - DNA, 14 bp, Homo sapiens
cccagacacagact

SEQ ID NO: 929292 - DNA, 18 bp, Homo sapiens
cccagacacagactggca

SEQ ID NO: 929293 - DNA, 17 bp, Homo sapiens
cccagacaccatgtgca

SEQ ID NO: 929294 - DNA, 14 bp, Homo sapiens
cccagacaggccct

SEQ ID NO: 929295 - DNA, 17 bp, Homo sapiens
cccagaccactgtctcc

SEQ ID NO: 929296 - DNA, 14 bp, Homo sapiens
cccagaccccaggg

SEQ ID NO: 929297 - DNA, 16 bp, Homo sapiens
cccagaccccagggca

SEQ ID NO: 929298 - DNA, 19 bp, Homo sapiens
cccagacccctctggccag

SEQ ID NO: 929299 - DNA, 20 bp, Homo sapiens
cccagacccctctggccagg

SEQ ID NO: 929300 - DNA, 21 bp, Homo sapiens
cccagacccctctggccagga

SEQ ID NO: 929301 - DNA, 18 bp, Homo sapiens
cccagaccttaagacact

SEQ ID NO: 929302 - DNA, 24 bp, Homo sapiens
cccagactaaaggatccagagagc

SEQ ID NO: 929303 - DNA, 13 bp, Homo sapiens
cccagactacagg

SEQ ID NO: 929304 - DNA, 15 bp, Homo sapiens
cccagactacagggc

SEQ ID NO: 929305 - DNA, 20 bp, Homo sapiens
cccagactagatgtagtatt

SEQ ID NO: 929306 - DNA, 16 bp, Homo sapiens
cccagactcagctcca

SEQ ID NO: 929307 - DNA, 14 bp, Homo sapiens
cccagactgagctc

SEQ ID NO: 929308 - DNA, 23 bp, Homo sapiens
cccagactgagctctccaggcca

SEQ ID NO: 929309 - DNA, 13 bp, Homo sapiens
cccagactgatga

SEQ ID NO: 929310 - DNA, 16 bp, Homo sapiens
cccagactgatgagca

SEQ ID NO: 929311 - DNA, 19 bp, Homo sapiens
cccagactgatgagcacat

SEQ ID NO: 929312 - DNA, 24 bp, Homo sapiens
cagtttgggagacatggaccagca

SEQ ID NO: 929313 - DNA, 17 bp, Homo sapiens
cagtttggggtgccaag

SEQ ID NO: 929314 - DNA, 20 bp, Homo sapiens
cagtttgggtaaaatacttt

SEQ ID NO: 929315 - DNA, 20 bp, Homo sapiens
cagtttggtagtgccccacc

SEQ ID NO: 929316 - DNA, 12 bp, Homo sapiens
cagtttggtttt

SEQ ID NO: 929317 - DNA, 13 bp, Homo sapiens
cagtttgtaaagt

SEQ ID NO: 929318 - DNA, 13 bp, Homo sapiens
cagtttgtatata

SEQ ID NO: 929319 - DNA, 14 bp, Homo sapiens
cagtttgtatatac

SEQ ID NO: 929320 - DNA, 16 bp, Homo sapiens
cagtttgtcttggata

SEQ ID NO: 929321 - DNA, 16 bp, Homo sapiens
cagtttgtgtgtctta

SEQ ID NO: 929322 - DNA, 20 bp, Homo sapiens
cagtttgtgttttaaaaaaa

SEQ ID NO: 929323 - DNA, 23 bp, Homo sapiens
cagtttgttagtatgaggcattt

SEQ ID NO: 929324 - DNA, 16 bp, Homo sapiens
cagtttgttctccggg

SEQ ID NO: 929325 - DNA, 13 bp, Homo sapiens
cagttttaactgt

SEQ ID NO: 929326 - DNA, 15 bp, Homo sapiens
cagttttaactgtgg

SEQ ID NO: 929327 - DNA, 16 bp, Homo sapiens
cagttttaactgtgga

SEQ ID NO: 929328 - DNA, 13 bp, Homo sapiens
cagttttaagaat

SEQ ID NO: 929329 - DNA, 11 bp, Homo sapiens
cagttttaata

SEQ ID NO: 929330 - DNA, 17 bp, Homo sapiens
cagttttaataagaaca

SEQ ID NO: 929331 - DNA, 18 bp, Homo sapiens
cagttttaataagaacag

SEQ ID NO: 929332 - DNA, 17 bp, Homo sapiens
cagttttagcagcactt

SEQ ID NO: 929333 - DNA, 15 bp, Homo sapiens
cagttttatcatttt

SEQ ID NO: 929334 - DNA, 15 bp, Homo sapiens
cagttttatttttgc

SEQ ID NO: 929335 - DNA, 23 bp, Homo sapiens
cagttttcaagtcaaattaataa

SEQ ID NO: 929336 - DNA, 12 bp, Homo sapiens
cagttttccatg

SEQ ID NO: 929337 - DNA, 16 bp, Homo sapiens
cagttttcccctggcc

SEQ ID NO: 929338 - DNA, 20 bp, Homo sapiens
cagttttcccctggcctcag

SEQ ID NO: 929339 - DNA, 11 bp, Homo sapiens
cagttttcctt

SEQ ID NO: 929340 - DNA, 22 bp, Homo sapiens
cagttttccttctcatctgtga

SEQ ID NO: 929341 - DNA, 18 bp, Homo sapiens
cagttttctcctctgctt

SEQ ID NO: 929342 - DNA, 17 bp, Homo sapiens
cagttttgagtgtactg

SEQ ID NO: 929343 - DNA, 14 bp, Homo sapiens
cagttttggaatct

SEQ ID NO: 929344 - DNA, 22 bp, Homo sapiens
cagtttttaaaatatattgctg

SEQ ID NO: 929345 - DNA, 16 bp, Homo sapiens
cagtttttactgagga

SEQ ID NO: 929346 - DNA, 20 bp, Homo sapiens
cagtttttataatagatttt

SEQ ID NO: 929347 - DNA, 16 bp, Homo sapiens
cagtttttcatttgtt

SEQ ID NO: 929348 - DNA, 22 bp, Homo sapiens
cagtttttgtttttgcatgaaa

SEQ ID NO: 929349 - DNA, 19 bp, Homo sapiens
cagttttttttttcttgtc

SEQ ID NO: 929350 - DNA, 14 bp, Homo sapiens
cataaaaaaatgat

SEQ ID NO: 929351 - DNA, 15 bp, Homo sapiens
cataaaaaaatgatg

SEQ ID NO: 929352 - DNA, 21 bp, Homo sapiens
cataaaaaagaagcactttga

SEQ ID NO: 929353 - DNA, 19 bp, Homo sapiens
cataaaaacattttaaaaa

SEQ ID NO: 929354 - DNA, 14 bp, Homo sapiens
cataaaaaccaaac

SEQ ID NO: 929355 - DNA, 14 bp, Homo sapiens
cataaaaagcagaa

SEQ ID NO: 929356 - DNA, 19 bp, Homo sapiens
cataaaaaggacatcagca

SEQ ID NO: 929357 - DNA, 22 bp, Homo sapiens
cataaaaaggacatcagcaaac

SEQ ID NO: 929358 - DNA, 23 bp, Homo sapiens
cataaaacaaaaccaagccttgg

SEQ ID NO: 929359 - DNA, 11 bp, Homo sapiens
cataaaacatt

SEQ ID NO: 929360 - DNA, 18 bp, Homo sapiens
cataaaacattaagaaaa

SEQ ID NO: 929361 - DNA, 22 bp, Homo sapiens
cataaaacattaagaaaatcat

SEQ ID NO: 929362 - DNA, 23 bp, Homo sapiens
cataaaacattaagaaaatcata

SEQ ID NO: 929363 - DNA, 19 bp, Homo sapiens
cataaaagaatatttagaa

SEQ ID NO: 929364 - DNA, 14 bp, Homo sapiens
cataaaagaatttt

SEQ ID NO: 929365 - DNA, 16 bp, Homo sapiens
cataaaagcattgtct

SEQ ID NO: 929366 - DNA, 17 bp, Homo sapiens
cataaaagcattgtctc

SEQ ID NO: 929367 - DNA, 23 bp, Homo sapiens
cataaaaggcttcacttttgact

SEQ ID NO: 929368 - DNA, 12 bp, Homo sapiens
cataaaatctgt

SEQ ID NO: 929369 - DNA, 17 bp, Homo sapiens
cataaaattgcagtttc

SEQ ID NO: 929370 - DNA, 21 bp, Homo sapiens
cataaacaagaccacgtttct

SEQ ID NO: 929371 - DNA, 22 bp, Homo sapiens
cataaacaagaccacgtttcta

SEQ ID NO: 929372 - DNA, 19 bp, Homo sapiens
cataaaccaatgagctgta

SEQ ID NO: 929373 - DNA, 22 bp, Homo sapiens
cataaaccaatgagctgtatct

SEQ ID NO: 929374 - DNA, 23 bp, Homo sapiens
cataaaccaatgagctgtatctg

SEQ ID NO: 929375 - DNA, 14 bp, Homo sapiens
cataaactgtcact

SEQ ID NO: 929376 - DNA, 22 bp, Homo sapiens
cataaactttctccatttaaga

SEQ ID NO: 929377 - DNA, 12 bp, Homo sapiens
cataaagaagca

SEQ ID NO: 929378 - DNA, 21 bp, Homo sapiens
cataaagactgtgctgagaag

SEQ ID NO: 929379 - DNA, 17 bp, Homo sapiens
cataaagatgttaaatg

SEQ ID NO: 929380 - DNA, 13 bp, Homo sapiens
cataaagccttta

SEQ ID NO: 929381 - DNA, 17 bp, Homo sapiens
cataaagctcaaatgaa

SEQ ID NO: 929382 - DNA, 20 bp, Homo sapiens
cataaagctcaaatgaaatg

SEQ ID NO: 929383 - DNA, 19 bp, Homo sapiens
cataaagggtgtaggggcc

SEQ ID NO: 929384 - DNA, 15 bp, Homo sapiens
cataaagggttgaaa

SEQ ID NO: 929385 - DNA, 20 bp, Homo sapiens
cataaagggttgaaaatgtg

SEQ ID NO: 929386 - DNA, 18 bp, Homo sapiens
cataaagtacaaatgaag

SEQ ID NO: 929387 - DNA, 16 bp, Homo sapiens
cataaagtctgagaaa

SEQ ID NO: 929388 - DNA, 14 bp, Homo sapiens
cataaagtgagaaa

SEQ ID NO: 929389 - DNA, 12 bp, Homo sapiens
cataaataaagt

SEQ ID NO: 929390 - DNA, 15 bp, Homo sapiens
cataaataaagtttc

SEQ ID NO: 929391 - DNA, 14 bp, Homo sapiens
cataaatactgtca

SEQ ID NO: 929392 - DNA, 15 bp, Homo sapiens
cataaatactgtcaa

SEQ ID NO: 929393 - DNA, 21 bp, Homo sapiens
cataaatcaattcatgtttaa

SEQ ID NO: 929394 - DNA, 16 bp, Homo sapiens
cataaatcatgttgtt

SEQ ID NO: 929395 - DNA, 13 bp, Homo sapiens
cataaatgaattt

SEQ ID NO: 929396 - DNA, 16 bp, Homo sapiens
cataaatgtgttcctg

SEQ ID NO: 929397 - DNA, 14 bp, Homo sapiens
cataaattacagtc

SEQ ID NO: 929398 - DNA, 17 bp, Homo sapiens
cataaattatttgatta

SEQ ID NO: 929399 - DNA, 20 bp, Homo sapiens
cataaattccagaggactct

SEQ ID NO: 929400 - DNA, 16 bp, Homo sapiens
cataacaattcctcta

SEQ ID NO: 929401 - DNA, 17 bp, Homo sapiens
cataacaattcctctac

SEQ ID NO: 929402 - DNA, 20 bp, Homo sapiens
cataacagattttttttgga

SEQ ID NO: 929403 - DNA, 23 bp, Homo sapiens
cataaccaacattaaaactcata

SEQ ID NO: 929404 - DNA, 22 bp, Homo sapiens
cataaccatgtgaaaaggcaaa

SEQ ID NO: 929405 - DNA, 12 bp, Homo sapiens
cataacctgtct

SEQ ID NO: 929406 - DNA, 17 bp, Homo sapiens
cataacgtgcccccaga

SEQ ID NO: 929407 - DNA, 14 bp, Homo sapiens
cataactgcttctt

SEQ ID NO: 929408 - DNA, 16 bp, Homo sapiens
cataactgcttcttgg

SEQ ID NO: 929409 - DNA, 20 bp, Homo sapiens
cataactgcttcttggagct

SEQ ID NO: 929410 - DNA, 16 bp, Homo sapiens
cataactggattttga

SEQ ID NO: 929411 - DNA, 17 bp, Homo sapiens
cataactggattttgaa

SEQ ID NO: 929412 - DNA, 14 bp, Homo sapiens
cataacttcctgta

SEQ ID NO: 929413 - DNA, 14 bp, Homo sapiens
cataagaaggcaat

SEQ ID NO: 929414 - DNA, 11 bp, Homo sapiens
cataagaccat

SEQ ID NO: 929415 - DNA, 17 bp, Homo sapiens
cataagattaaaggaag

SEQ ID NO: 929416 - DNA, 23 bp, Homo sapiens
cataagcctccatttagttcttt

SEQ ID NO: 929417 - DNA, 19 bp, Homo sapiens
cataagcggcgtaagttta

SEQ ID NO: 929418 - DNA, 12 bp, Homo sapiens
cataaggcctgc

SEQ ID NO: 929419 - DNA, 15 bp, Homo sapiens
cataaggcctgccct

SEQ ID NO: 929420 - DNA, 20 bp, Homo sapiens
cataaggtgctatctgttca

SEQ ID NO: 929421 - DNA, 15 bp, Homo sapiens
cataagtaagaaatt

SEQ ID NO: 929422 - DNA, 19 bp, Homo sapiens
cataagttatgcctctgac

SEQ ID NO: 929423 - DNA, 21 bp, Homo sapiens
cataagtttaactttaaaact

SEQ ID NO: 929424 - DNA, 17 bp, Homo sapiens
ctgggaaagcataaagc

SEQ ID NO: 929425 - DNA, 17 bp, Homo sapiens
ctgggaaaggacccacc

SEQ ID NO: 929426 - DNA, 20 bp, Homo sapiens
ctgggaaaggacccacccat

SEQ ID NO: 929427 - DNA, 12 bp, Homo sapiens
ctgggaaagtta

SEQ ID NO: 929428 - DNA, 16 bp, Homo sapiens
ctgggaaataagagag

SEQ ID NO: 929429 - DNA, 17 bp, Homo sapiens
ctgggaaataagagaga

SEQ ID NO: 929430 - DNA, 18 bp, Homo sapiens
ctgggaaatattccctag

SEQ ID NO: 929431 - DNA, 16 bp, Homo sapiens
ctgggaaatgaggttt

SEQ ID NO: 929432 - DNA, 21 bp, Homo sapiens
ctgggaaattgaagtgtcttc

SEQ ID NO: 929433 - DNA, 17 bp, Homo sapiens
ctgggaacacagttctg

SEQ ID NO: 929434 - DNA, 20 bp, Homo sapiens
ctgggattataggcatgagc

SEQ ID NO: 929435 - DNA, 14 bp, Homo sapiens
ctgggattattctt

SEQ ID NO: 929436 - DNA, 15 bp, Homo sapiens
ctgggattattcttt

SEQ ID NO: 929437 - DNA, 18 bp, Homo sapiens
ctgggattattctttgaa

SEQ ID NO: 929438 - DNA, 14 bp, Homo sapiens
ctgggattggctgt

SEQ ID NO: 929439 - DNA, 20 bp, Homo sapiens
ctgggattgtgggcatgagc

SEQ ID NO: 929440 - DNA, 21 bp, Homo sapiens
ctgggatttatgctcatgaac

SEQ ID NO: 929441 - DNA, 22 bp, Homo sapiens
ctgggatttcttcgctgctcta

SEQ ID NO: 929442 - DNA, 19 bp, Homo sapiens
ctgggcaaagccacaaggc

SEQ ID NO: 929443 - DNA, 18 bp, Homo sapiens
ctgggcaacactgcagga

SEQ ID NO: 929444 - DNA, 13 bp, Homo sapiens
ctgggcaagagat

SEQ ID NO: 929445 - DNA, 20 bp, Homo sapiens
ctgggcaatgtgataaaacc

SEQ ID NO: 929446 - DNA, 16 bp, Homo sapiens
ctgggcacacgcctcc

SEQ ID NO: 929447 - DNA, 17 bp, Homo sapiens
ctgggcacacgcctccc

SEQ ID NO: 929448 - DNA, 22 bp, Homo sapiens
ctgggcacacgcctcccactgg

SEQ ID NO: 929449 - DNA, 23 bp, Homo sapiens
ctgggcacacgcctcccactggg

SEQ ID NO: 929450 - DNA, 17 bp, Homo sapiens
ctgggcacagattgaag

SEQ ID NO: 929451 - DNA, 21 bp, Homo sapiens
ctgggcacagattgaagaatc

SEQ ID NO: 929452 - DNA, 16 bp, Homo sapiens
ctgggcacagtgctgc

SEQ ID NO: 929453 - DNA, 20 bp, Homo sapiens
ctgggcacagtgctgcccct

SEQ ID NO: 929454 - DNA, 22 bp, Homo sapiens
ctgggcacagtggactcagcag

SEQ ID NO: 929455 - DNA, 18 bp, Homo sapiens
ctgggcaccacaaaatat

SEQ ID NO: 929456 - DNA, 17 bp, Homo sapiens
ctgggcacccacctcca

SEQ ID NO: 929457 - DNA, 16 bp, Homo sapiens
ctgggcaccgtgtcct

SEQ ID NO: 929458 - DNA, 20 bp, Homo sapiens
ctgggcaccgtgtcctcctc

SEQ ID NO: 929459 - DNA, 22 bp, Homo sapiens
ctgggcaccgtgtcctcctctg

SEQ ID NO: 929460 - DNA, 14 bp, Homo sapiens
ctgggcacctgact

SEQ ID NO: 929461 - DNA, 16 bp, Homo sapiens
ctgggcacctgcgcac

SEQ ID NO: 929462 - DNA, 19 bp, Homo sapiens
ctgggcacctgcgcacagg

SEQ ID NO: 929463 - DNA, 22 bp, Homo sapiens
ctgggcacctgcgcacaggtgg

SEQ ID NO: 929464 - DNA, 16 bp, Homo sapiens
ctgggcacgcctgctg

SEQ ID NO: 929465 - DNA, 19 bp, Homo sapiens
ctgggcacggctccgaggg

SEQ ID NO: 929466 - DNA, 13 bp, Homo sapiens
ctgggcactgctc

SEQ ID NO: 929467 - DNA, 16 bp, Homo sapiens
ctgggcactgctccaa

SEQ ID NO: 929468 - DNA, 21 bp, Homo sapiens
ctgggcagaagtgagcccccc

SEQ ID NO: 929469 - DNA, 13 bp, Homo sapiens
ctgggcagagcct

SEQ ID NO: 929470 - DNA, 13 bp, Homo sapiens
ctgggcagatgtc

SEQ ID NO: 929471 - DNA, 19 bp, Homo sapiens
ctgggcagatgtcccccac

SEQ ID NO: 929472 - DNA, 23 bp, Homo sapiens
ctgggcagatgtcccccactgct

SEQ ID NO: 929473 - DNA, 22 bp, Homo sapiens
ctgggcagcaaggctgctgccg

SEQ ID NO: 929474 - DNA, 21 bp, Homo sapiens
ctgggcagcacaaggccttgc

SEQ ID NO: 929475 - DNA, 13 bp, Homo sapiens
ctgggcagcccca

SEQ ID NO: 929476 - DNA, 14 bp, Homo sapiens
ctgggcagccccac

SEQ ID NO: 929477 - DNA, 12 bp, Homo sapiens
ctgggcagcccg

SEQ ID NO: 929478 - DNA, 13 bp, Homo sapiens
ctgggcagcccgc

SEQ ID NO: 929479 - DNA, 19 bp, Homo sapiens
ctgggcagcctgctttggc

SEQ ID NO: 929480 - DNA, 20 bp, Homo sapiens
ctgggcagcctgctttggcc

SEQ ID NO: 929481 - DNA, 14 bp, Homo sapiens
ctgggcaggaccct

SEQ ID NO: 929482 - DNA, 21 bp, Homo sapiens
ctgggcaggaccctgctgact

SEQ ID NO: 929483 - DNA, 13 bp, Homo sapiens
ctgggcaggtggg

SEQ ID NO: 929484 - DNA, 18 bp, Homo sapiens
ctgggcaggtgggagctg

SEQ ID NO: 929485 - DNA, 13 bp, Homo sapiens
ctgggcaggttcc

SEQ ID NO: 929486 - DNA, 14 bp, Homo sapiens
ctgggcagtgagtg

SEQ ID NO: 929487 - DNA, 19 bp, Homo sapiens
ctgggcagtgccacagcct

SEQ ID NO: 929488 - DNA, 15 bp, Homo sapiens
ctgggcatcccagct

SEQ ID NO: 929489 - DNA, 22 bp, Homo sapiens
ctgggcatcccagcttgccccc

SEQ ID NO: 929490 - DNA, 17 bp, Homo sapiens
ctgggcatgggtccagg

SEQ ID NO: 929491 - DNA, 18 bp, Homo sapiens
ctgggcatgggtccaggg

SEQ ID NO: 929492 - DNA, 12 bp, Homo sapiens
ctgggcattgct

SEQ ID NO: 929493 - DNA, 14 bp, Homo sapiens
ctgggcattgcttt

SEQ ID NO: 929494 - DNA, 15 bp, Homo sapiens
ctgggcattttcctc

SEQ ID NO: 929495 - DNA, 16 bp, Homo sapiens
ctgggcattttcctcc

SEQ ID NO: 929496 - DNA, 15 bp, Homo sapiens
ctgggccaagttcct

SEQ ID NO: 929497 - DNA, 13 bp, Homo sapiens
ctgggccacacct

SEQ ID NO: 929498 - DNA, 17 bp, Homo sapiens
ctgggccacacctgagc

SEQ ID NO: 929499 - DNA, 22 bp, Homo sapiens
ctgggccacacctgagcgctgt

SEQ ID NO: 929500 - DNA, 23 bp, Homo sapiens
ctgggccacacctgagcgctgtg

SEQ ID NO: 929501 - DNA, 15 bp, Homo sapiens
ctgggccacctccta

SEQ ID NO: 929502 - DNA, 16 bp, Homo sapiens
ctgggccacctcctac

SEQ ID NO: 929503 - DNA, 18 bp, Homo sapiens
ctgggccagccctgcagc

SEQ ID NO: 929504 - DNA, 17 bp, Homo sapiens
ctgggccagcggggctg

SEQ ID NO: 929505 - DNA, 19 bp, Homo sapiens
ctgggccagcggggctgct

SEQ ID NO: 929506 - DNA, 19 bp, Homo sapiens
ctgggccaggagcccacag

SEQ ID NO: 929507 - DNA, 18 bp, Homo sapiens
ctgggccaggcaggcgat

SEQ ID NO: 929508 - DNA, 12 bp, Homo sapiens
ctgggccaggga

SEQ ID NO: 929509 - DNA, 21 bp, Homo sapiens
ctgggccagggaaacaaagtt

SEQ ID NO: 929510 - DNA, 17 bp, Homo sapiens
ctgggccagggtctgtg

SEQ ID NO: 929511 - DNA, 13 bp, Homo sapiens
ctgggccatctct

SEQ ID NO: 929512 - DNA, 19 bp, Homo sapiens
ctgggccattctccacagc

SEQ ID NO: 929513 - DNA, 21 bp, Homo sapiens
ctgggccattctccacagcaa

SEQ ID NO: 929514 - DNA, 12 bp, Homo sapiens
ctgggcccaagt

SEQ ID NO: 929515 - DNA, 20 bp, Homo sapiens
ctgggcccacagagatgcat

SEQ ID NO: 929516 - DNA, 17 bp, Homo sapiens
ctgggcccacagagcct

SEQ ID NO: 929517 - DNA, 17 bp, Homo sapiens
ctgggcccacccaggga

SEQ ID NO: 929518 - DNA, 15 bp, Homo sapiens
ctgggcccagcccct

SEQ ID NO: 929519 - DNA, 20 bp, Homo sapiens
ctgggcccagcccctccacg

SEQ ID NO: 929520 - DNA, 15 bp, Homo sapiens
ctgggcccaggcagg

SEQ ID NO: 929521 - DNA, 17 bp, Homo sapiens
ctgggcccaggcaggtc

SEQ ID NO: 929522 - DNA, 19 bp, Homo sapiens
ctgggcccaggcaggtctg

SEQ ID NO: 929523 - DNA, 13 bp, Homo sapiens
ctgggcccagggg

SEQ ID NO: 929524 - DNA, 15 bp, Homo sapiens
ctgggccccacctac

SEQ ID NO: 929525 - DNA, 15 bp, Homo sapiens
ctgggccccactgga

SEQ ID NO: 929526 - DNA, 20 bp, Homo sapiens
ctgggccccactggacaaca

SEQ ID NO: 929527 - DNA, 22 bp, Homo sapiens
ctgggccccactggacaacact

SEQ ID NO: 929528 - DNA, 21 bp, Homo sapiens
ctgggccccatgctctgcccc

SEQ ID NO: 929529 - DNA, 12 bp, Homo sapiens
ctgggcccccag

SEQ ID NO: 929530 - DNA, 16 bp, Homo sapiens
ctgggcccccagcctg

SEQ ID NO: 929531 - DNA, 15 bp, Homo sapiens
ctgggcccctccacg

SEQ ID NO: 929532 - DNA, 17 bp, Homo sapiens
ctgggcccctccacgcc

SEQ ID NO: 929533 - DNA, 13 bp, Homo sapiens
ctgggcccctccc

SEQ ID NO: 929534 - DNA, 19 bp, Homo sapiens
ctgggcccctcccctcaga

SEQ ID NO: 929535 - DNA, 12 bp, Homo sapiens
ctgggcccctgc

SEQ ID NO: 929536 - DNA, 14 bp, Homo sapiens
ctgggcccctgcac

SEQ ID NO: 929537 - DNA, 14 bp, Homo sapiens
ctgggcccctggga

SEQ ID NO: 929538 - DNA, 16 bp, Homo sapiens
ctgggcccctggggac

SEQ ID NO: 929539 - DNA, 14 bp, Homo sapiens
ctgggcccctgtcc

SEQ ID NO: 929540 - DNA, 21 bp, Homo sapiens
ctgggcccctgtccccagtcc

SEQ ID NO: 929541 - DNA, 18 bp, Homo sapiens
ctgggcccggaagggctt

SEQ ID NO: 929542 - DNA, 20 bp, Homo sapiens
ctgggcccgggcaggccagc

SEQ ID NO: 929543 - DNA, 14 bp, Homo sapiens
ctgggccctctctg

SEQ ID NO: 929544 - DNA, 18 bp, Homo sapiens
ctgggccctctctgctct

SEQ ID NO: 929545 - DNA, 20 bp, Homo sapiens
ctgggccctctttccctgcg

SEQ ID NO: 929546 - DNA, 11 bp, Homo sapiens
ctgggccctgg

SEQ ID NO: 929547 - DNA, 13 bp, Homo sapiens
ctgggccctggag

SEQ ID NO: 929548 - DNA, 15 bp, Homo sapiens
ctgggccctggagga

SEQ ID NO: 929549 - DNA, 15 bp, Homo sapiens
ctgggccctgggctg

SEQ ID NO: 929550 - DNA, 17 bp, Homo sapiens
ctgggcccttgtgctcc

SEQ ID NO: 929551 - DNA, 14 bp, Homo sapiens
ctgggccgcaaggg

SEQ ID NO: 929552 - DNA, 17 bp, Homo sapiens
ctgggccgcaagggcct

SEQ ID NO: 929553 - DNA, 18 bp, Homo sapiens
ctgggccgcaagggcctg

SEQ ID NO: 929554 - DNA, 16 bp, Homo sapiens
catacttacatttcag

SEQ ID NO: 929555 - DNA, 14 bp, Homo sapiens
catacttacctagt

SEQ ID NO: 929556 - DNA, 16 bp, Homo sapiens
catacttagaaacaaa

SEQ ID NO: 929557 - DNA, 14 bp, Homo sapiens
catagttttatatc

SEQ ID NO: 929558 - DNA, 16 bp, Homo sapiens
catagtttttcagtct

SEQ ID NO: 929559 - DNA, 19 bp, Homo sapiens
catataaaaagcagcagag

SEQ ID NO: 929560 - DNA, 14 bp, Homo sapiens
catataaaggttat

SEQ ID NO: 929561 - DNA, 17 bp, Homo sapiens
catataaaggttatgaa

SEQ ID NO: 929562 - DNA, 22 bp, Homo sapiens
catataaaggttatgaaacata

SEQ ID NO: 929563 - DNA, 22 bp, Homo sapiens
catataacttatattgtaagaa

SEQ ID NO: 929564 - DNA, 20 bp, Homo sapiens
catataagacaaatattcct

SEQ ID NO: 929565 - DNA, 14 bp, Homo sapiens
catataatgaataa

SEQ ID NO: 929566 - DNA, 15 bp, Homo sapiens
catataatgttgtta

SEQ ID NO: 929567 - DNA, 13 bp, Homo sapiens
catatagaaaaca

SEQ ID NO: 929568 - DNA, 23 bp, Homo sapiens
catatagcattgataatcttcag

SEQ ID NO: 929569 - DNA, 20 bp, Homo sapiens
catatagttgaggccgagga

SEQ ID NO: 929570 - DNA, 22 bp, Homo sapiens
catatatatagttatgcataca

SEQ ID NO: 929571 - DNA, 13 bp, Homo sapiens
catatatattaca

SEQ ID NO: 929572 - DNA, 18 bp, Homo sapiens
catatatattttttgctt

SEQ ID NO: 929573 - DNA, 19 bp, Homo sapiens
catatatctacacatacag

SEQ ID NO: 929574 - DNA, 18 bp, Homo sapiens
catatatgaccagaagcc

SEQ ID NO: 929575 - DNA, 18 bp, Homo sapiens
catatatgctgtatttct

SEQ ID NO: 929576 - DNA, 23 bp, Homo sapiens
catatatttgtttcatttctgca

SEQ ID NO: 929577 - DNA, 15 bp, Homo sapiens
catatattttttaaa

SEQ ID NO: 929578 - DNA, 20 bp, Homo sapiens
catatattttttaaaataag

SEQ ID NO: 929579 - DNA, 20 bp, Homo sapiens
catatcaagtccatgttatt

SEQ ID NO: 929580 - DNA, 21 bp, Homo sapiens
catatcaattggcagtgactt

SEQ ID NO: 929581 - DNA, 14 bp, Homo sapiens
catatcatggtaat

SEQ ID NO: 929582 - DNA, 14 bp, Homo sapiens
catatcattaaaca

SEQ ID NO: 929583 - DNA, 18 bp, Homo sapiens
catatcattaaacaaata

SEQ ID NO: 929584 - DNA, 16 bp, Homo sapiens
catatcatttcactgt

SEQ ID NO: 929585 - DNA, 21 bp, Homo sapiens
catatcatttcactgtctagg

SEQ ID NO: 929586 - DNA, 15 bp, Homo sapiens
catatcatttcttaa

SEQ ID NO: 929587 - DNA, 15 bp, Homo sapiens
catatcatttgtgaa

SEQ ID NO: 929588 - DNA, 14 bp, Homo sapiens
catatccaagtttg

SEQ ID NO: 929589 - DNA, 18 bp, Homo sapiens
catatcccctatttaaca

SEQ ID NO: 929590 - DNA, 13 bp, Homo sapiens
catatccctgccc

SEQ ID NO: 929591 - DNA, 12 bp, Homo sapiens
catatcctgcct

SEQ ID NO: 929592 - DNA, 14 bp, Homo sapiens
catatccttgccct

SEQ ID NO: 929593 - DNA, 22 bp, Homo sapiens
catatcgctgacttcatggaat

SEQ ID NO: 929594 - DNA, 23 bp, Homo sapiens
catatctccatggccctgtccca

SEQ ID NO: 929595 - DNA, 15 bp, Homo sapiens
catatctccttcccc

SEQ ID NO: 929596 - DNA, 12 bp, Homo sapiens
catatctctgcc

SEQ ID NO: 929597 - DNA, 23 bp, Homo sapiens
catatctcttatcttacgaaaaa

SEQ ID NO: 929598 - DNA, 15 bp, Homo sapiens
catatctgcctcccc

SEQ ID NO: 929599 - DNA, 19 bp, Homo sapiens
catatctggtatatgtcat

SEQ ID NO: 929600 - DNA, 22 bp, Homo sapiens
catatctggtatatgtcattat

SEQ ID NO: 929601 - DNA, 20 bp, Homo sapiens
catatcttaaagaaacagct

SEQ ID NO: 929602 - DNA, 15 bp, Homo sapiens
catatcttgccttca

SEQ ID NO: 929603 - DNA, 21 bp, Homo sapiens
catatcttgcgaatccaagct

SEQ ID NO: 929604 - DNA, 22 bp, Homo sapiens
catatgaaaaaaatgcatttta

SEQ ID NO: 929605 - DNA, 17 bp, Homo sapiens
catatgagaatatacct

SEQ ID NO: 929606 - DNA, 16 bp, Homo sapiens
catatgagcctgccct

SEQ ID NO: 929607 - DNA, 17 bp, Homo sapiens
catatgaggacctttat

SEQ ID NO: 929608 - DNA, 14 bp, Homo sapiens
catatgattctgct

SEQ ID NO: 929609 - DNA, 18 bp, Homo sapiens
catatgatttcttgcttt

SEQ ID NO: 929610 - DNA, 20 bp, Homo sapiens
catatgcagccaaccaagat

SEQ ID NO: 929611 - DNA, 12 bp, Homo sapiens
catatgcatgcc

SEQ ID NO: 929612 - DNA, 19 bp, Homo sapiens
catatgcatgccaggctgg

SEQ ID NO: 929613 - DNA, 20 bp, Homo sapiens
catatgcgtcccaagcagcc

SEQ ID NO: 929614 - DNA, 21 bp, Homo sapiens
catatgcgtcccaagcagccg

SEQ ID NO: 929615 - DNA, 18 bp, Homo sapiens
catatggagctcatgtca

SEQ ID NO: 929616 - DNA, 16 bp, Homo sapiens
catatggaggactgtg

SEQ ID NO: 929617 - DNA, 15 bp, Homo sapiens
catatggatgttact

SEQ ID NO: 929618 - DNA, 16 bp, Homo sapiens
catatggcccagtgtc

SEQ ID NO: 929619 - DNA, 21 bp, Homo sapiens
catatgggatattcccaagcc

SEQ ID NO: 929620 - DNA, 21 bp, Homo sapiens
catatgtaacagtcaaatatc

SEQ ID NO: 929621 - DNA, 15 bp, Homo sapiens
catatgtaccatgta

SEQ ID NO: 929622 - DNA, 24 bp, Homo sapiens
catatgtagccttcacacagatag

SEQ ID NO: 929623 - DNA, 19 bp, Homo sapiens
catatgtgtaaagatttat

SEQ ID NO: 929624 - DNA, 13 bp, Homo sapiens
catatgttaagca

SEQ ID NO: 929625 - DNA, 14 bp, Homo sapiens
catatgtttggtaa

SEQ ID NO: 929626 - DNA, 21 bp, Homo sapiens
catattaacatattctaaata

SEQ ID NO: 929627 - DNA, 23 bp, Homo sapiens
catattaagacagtgtacaaaac

SEQ ID NO: 929628 - DNA, 22 bp, Homo sapiens
catattaccacagacatactaa

SEQ ID NO: 929629 - DNA, 17 bp, Homo sapiens
catattataaaggataa

SEQ ID NO: 929630 - DNA, 14 bp, Homo sapiens
catattcaaagcag

SEQ ID NO: 929631 - DNA, 21 bp, Homo sapiens
catattcaaagcagcagccac

SEQ ID NO: 929632 - DNA, 19 bp, Homo sapiens
catattcatggttgttttt

SEQ ID NO: 929633 - DNA, 16 bp, Homo sapiens
catattccatatttat

SEQ ID NO: 929634 - DNA, 17 bp, Homo sapiens
catattccatatttatt

SEQ ID NO: 929635 - DNA, 17 bp, Homo sapiens
catattctaaaaccatt

SEQ ID NO: 929636 - DNA, 21 bp, Homo sapiens
catattctattgtattatttg

SEQ ID NO: 929637 - DNA, 17 bp, Homo sapiens
catattctattgtttac

SEQ ID NO: 929638 - DNA, 15 bp, Homo sapiens
catattctgttggaa

SEQ ID NO: 929639 - DNA, 15 bp, Homo sapiens
catattcttgtgctt

SEQ ID NO: 929640 - DNA, 20 bp, Homo sapiens
catattgaaaagcacagagg

SEQ ID NO: 929641 - DNA, 13 bp, Homo sapiens
catattgactttt

SEQ ID NO: 929642 - DNA, 22 bp, Homo sapiens
catattgctatctaatggggaa

SEQ ID NO: 929643 - DNA, 16 bp, Homo sapiens
catattggaaagtgat

SEQ ID NO: 929644 - DNA, 20 bp, Homo sapiens
catattggattgcgcctttg

SEQ ID NO: 929645 - DNA, 16 bp, Homo sapiens
catattgtaaaacagg

SEQ ID NO: 929646 - DNA, 14 bp, Homo sapiens
catattgtatgtaa

SEQ ID NO: 929647 - DNA, 18 bp, Homo sapiens
catattgtgattctgcct

SEQ ID NO: 929648 - DNA, 21 bp, Homo sapiens
catattgttagggtcagccat

SEQ ID NO: 929649 - DNA, 12 bp, Homo sapiens
catattgtttga

SEQ ID NO: 929650 - DNA, 14 bp, Homo sapiens
catatttaaagaca

SEQ ID NO: 929651 - DNA, 17 bp, Homo sapiens
catatttaaagatcttt

SEQ ID NO: 929652 - DNA, 10 bp, Homo sapiens
catatttaat

SEQ ID NO: 929653 - DNA, 21 bp, Homo sapiens
catatttaatgttttaaatgt

SEQ ID NO: 929654 - DNA, 14 bp, Homo sapiens
catatttacttctt

SEQ ID NO: 929655 - DNA, 17 bp, Homo sapiens
catatttacttcttata

SEQ ID NO: 929656 - DNA, 16 bp, Homo sapiens
catatttattgcattg

SEQ ID NO: 929657 - DNA, 20 bp, Homo sapiens
catatttattgcattgctgg

SEQ ID NO: 929658 - DNA, 14 bp, Homo sapiens
catatttcatttta

SEQ ID NO: 929659 - DNA, 20 bp, Homo sapiens
catatttctgtatatttgtc

SEQ ID NO: 929660 - DNA, 10 bp, Homo sapiens
catatttgag

SEQ ID NO: 929661 - DNA, 15 bp, Homo sapiens
catatttgatttcta

SEQ ID NO: 929662 - DNA, 17 bp, Homo sapiens
catatttgatttctaat

SEQ ID NO: 929663 - DNA, 23 bp, Homo sapiens
catatttgatttctaattgtaag

SEQ ID NO: 929664 - DNA, 18 bp, Homo sapiens
catatttgtctttgaatc

SEQ ID NO: 929665 - DNA, 19 bp, Homo sapiens
catattttaaaatttgttc

SEQ ID NO: 929666 - DNA, 16 bp, Homo sapiens
catattttaaacagag

SEQ ID NO: 929667 - DNA, 17 bp, Homo sapiens
catattttcttactttt

SEQ ID NO: 929668 - DNA, 20 bp, Homo sapiens
catattttcttacttttatt

SEQ ID NO: 929669 - DNA, 20 bp, Homo sapiens
catattttgccactgccttt

SEQ ID NO: 929670 - DNA, 17 bp, Homo sapiens
catatttttatacttta

SEQ ID NO: 929671 - DNA, 23 bp, Homo sapiens
catatttttatactttattgaaa

SEQ ID NO: 929672 - DNA, 12 bp, Homo sapiens
catcaaacattt

SEQ ID NO: 929673 - DNA, 11 bp, Homo sapiens
catcaaagagg

SEQ ID NO: 929674 - DNA, 18 bp, Homo sapiens
catcaaagcagaagtctg

SEQ ID NO: 929675 - DNA, 18 bp, Homo sapiens
catcaaaggaatataaga

SEQ ID NO: 929676 - DNA, 14 bp, Homo sapiens
catcaaataaattt

SEQ ID NO: 929677 - DNA, 18 bp, Homo sapiens
catcaaataaatttctgg

SEQ ID NO: 929678 - DNA, 13 bp, Homo sapiens
catcaacaaaaat

SEQ ID NO: 929679 - DNA, 13 bp, Homo sapiens
catcatggaccaa

SEQ ID NO: 929680 - DNA, 13 bp, Homo sapiens
catcatgtctgta

SEQ ID NO: 929681 - DNA, 16 bp, Homo sapiens
catcatgtctgtatac

SEQ ID NO: 929682 - DNA, 19 bp, Homo sapiens
catcatgtggcccaactct

SEQ ID NO: 929683 - DNA, 16 bp, Homo sapiens
catcatgttattttat

SEQ ID NO: 929684 - DNA, 17 bp, Homo sapiens
catcattactggtaaag

SEQ ID NO: 929685 - DNA, 14 bp, Homo sapiens
catcattactgttc

SEQ ID NO: 929686 - DNA, 16 bp, Homo sapiens
catcattactgttcca

SEQ ID NO: 929687 - DNA, 14 bp, Homo sapiens
catcattagaacaa

SEQ ID NO: 929688 - DNA, 22 bp, Homo sapiens
catcattcatccaggactgaga

SEQ ID NO: 929689 - DNA, 14 bp, Homo sapiens
catcattctctgtc

SEQ ID NO: 929690 - DNA, 15 bp, Homo sapiens
catcattctctgtct

SEQ ID NO: 929691 - DNA, 16 bp, Homo sapiens
catcattctctgtctc

SEQ ID NO: 929692 - DNA, 21 bp, Homo sapiens
catcattctctgtctcatcca

SEQ ID NO: 929693 - DNA, 22 bp, Homo sapiens
catcattctctgtctcatccat

SEQ ID NO: 929694 - DNA, 24 bp, Homo sapiens
catcattctctgtctcatccatca

SEQ ID NO: 929695 - DNA, 19 bp, Homo sapiens
catcattctgtgtctctgc

SEQ ID NO: 929696 - DNA, 17 bp, Homo sapiens
catcattgtttctgcat

SEQ ID NO: 929697 - DNA, 14 bp, Homo sapiens
catcatttcagcca

SEQ ID NO: 929698 - DNA, 20 bp, Homo sapiens
catcatttctgtctttaaga

SEQ ID NO: 929699 - DNA, 19 bp, Homo sapiens
catcattttaacaggtgcc

SEQ ID NO: 929700 - DNA, 22 bp, Homo sapiens
catcattttccatatcctggtg

SEQ ID NO: 929701 - DNA, 19 bp, Homo sapiens
catcattttctacttgttt

SEQ ID NO: 929702 - DNA, 14 bp, Homo sapiens
catcattttttact

SEQ ID NO: 929703 - DNA, 23 bp, Homo sapiens
catccaaaatagttaagacatga

SEQ ID NO: 929704 - DNA, 17 bp, Homo sapiens
catccaaaatcttgatc

SEQ ID NO: 929705 - DNA, 15 bp, Homo sapiens
catccaaagcagaca

SEQ ID NO: 929706 - DNA, 13 bp, Homo sapiens
catccaaatctag

SEQ ID NO: 929707 - DNA, 14 bp, Homo sapiens
catccaacaagaag

SEQ ID NO: 929708 - DNA, 16 bp, Homo sapiens
catccaacaagaagaa

SEQ ID NO: 929709 - DNA, 18 bp, Homo sapiens
catccaacaagaagaaat

SEQ ID NO: 929710 - DNA, 19 bp, Homo sapiens
catccaacaagaagaaata

SEQ ID NO: 929711 - DNA, 16 bp, Homo sapiens
catccaaccccccacc

SEQ ID NO: 929712 - DNA, 16 bp, Homo sapiens
catccaaccttcccaa

SEQ ID NO: 929713 - DNA, 17 bp, Homo sapiens
catccaactccagcaac

SEQ ID NO: 929714 - DNA, 15 bp, Homo sapiens
catccaactccagga

SEQ ID NO: 929715 - DNA, 15 bp, Homo sapiens
catccaactggaaat

SEQ ID NO: 929716 - DNA, 17 bp, Homo sapiens
catccaaggcaaacaat

SEQ ID NO: 929717 - DNA, 19 bp, Homo sapiens
catccaatcctcactgggt

SEQ ID NO: 929718 - DNA, 19 bp, Homo sapiens
catccacccagtgctgcca

SEQ ID NO: 929719 - DNA, 21 bp, Homo sapiens
catccacccagtgctgccatg

SEQ ID NO: 929720 - DNA, 19 bp, Homo sapiens
catccacccgggggagccc

SEQ ID NO: 929721 - DNA, 22 bp, Homo sapiens
catccacccgggggagcccagt

SEQ ID NO: 929722 - DNA, 20 bp, Homo sapiens
catccacctcatcactggac

SEQ ID NO: 929723 - DNA, 16 bp, Homo sapiens
catccaccttcccttc

SEQ ID NO: 929724 - DNA, 13 bp, Homo sapiens
catccacgtggcc

SEQ ID NO: 929725 - DNA, 15 bp, Homo sapiens
catccacgtggcctc

SEQ ID NO: 929726 - DNA, 22 bp, Homo sapiens
catccactagtgcaaatcatag

SEQ ID NO: 929727 - DNA, 19 bp, Homo sapiens
catccactctaccctccca

SEQ ID NO: 929728 - DNA, 18 bp, Homo sapiens
catccacttaagttcttt

SEQ ID NO: 929729 - DNA, 15 bp, Homo sapiens
catccagaggagctg

SEQ ID NO: 929730 - DNA, 22 bp, Homo sapiens
catccagccacggagggaggca

SEQ ID NO: 929731 - DNA, 14 bp, Homo sapiens
catccagcctgtgt

SEQ ID NO: 929732 - DNA, 23 bp, Homo sapiens
catccagcgagagagtttcaaaa

SEQ ID NO: 929733 - DNA, 18 bp, Homo sapiens
catccagctaccaccacg

SEQ ID NO: 929734 - DNA, 15 bp, Homo sapiens
catccaggactgaga

SEQ ID NO: 929735 - DNA, 13 bp, Homo sapiens
catccagggtctg

SEQ ID NO: 929736 - DNA, 19 bp, Homo sapiens
catccagggtctggcagag

SEQ ID NO: 929737 - DNA, 20 bp, Homo sapiens
catccagggtctggcagagc

SEQ ID NO: 929738 - DNA, 21 bp, Homo sapiens
catccagggtctggcagagcc

SEQ ID NO: 929739 - DNA, 23 bp, Homo sapiens
catccagggtctggcagagcctc

SEQ ID NO: 929740 - DNA, 14 bp, Homo sapiens
catccagtttgttc

SEQ ID NO: 929741 - DNA, 15 bp, Homo sapiens
catccagtttgttct

SEQ ID NO: 929742 - DNA, 14 bp, Homo sapiens
catccataaagaag

SEQ ID NO: 929743 - DNA, 16 bp, Homo sapiens
catccataaagaagca

SEQ ID NO: 929744 - DNA, 15 bp, Homo sapiens
catccatccctagaa

SEQ ID NO: 929745 - DNA, 21 bp, Homo sapiens
catccatccctagaagagcac

SEQ ID NO: 929746 - DNA, 14 bp, Homo sapiens
catccatctccagg

SEQ ID NO: 929747 - DNA, 22 bp, Homo sapiens
catccatctccagggagcaaga

SEQ ID NO: 929748 - DNA, 13 bp, Homo sapiens
catccatgccctc

SEQ ID NO: 929749 - DNA, 19 bp, Homo sapiens
catccatgccctcccagga

SEQ ID NO: 929750 - DNA, 17 bp, Homo sapiens
catccatgtgtggactc

SEQ ID NO: 929751 - DNA, 18 bp, Homo sapiens
catccatgtgtggactca

SEQ ID NO: 929752 - DNA, 18 bp, Homo sapiens
catccatgttccgagaag

SEQ ID NO: 929753 - DNA, 19 bp, Homo sapiens
catccatgtttgtaaaact

SEQ ID NO: 929754 - DNA, 13 bp, Homo sapiens
catccattaggcc

SEQ ID NO: 929755 - DNA, 17 bp, Homo sapiens
catccattaggccagca

SEQ ID NO: 929756 - DNA, 20 bp, Homo sapiens
catccatttcatctatttct

SEQ ID NO: 929757 - DNA, 20 bp, Homo sapiens
catccatttgttttcacact

SEQ ID NO: 929758 - DNA, 23 bp, Homo sapiens
catcccaaactttaaaatgcgaa

SEQ ID NO: 929759 - DNA, 14 bp, Homo sapiens
catcccacaccctg

SEQ ID NO: 929760 - DNA, 19 bp, Homo sapiens
catcccactggatctggct

SEQ ID NO: 929761 - DNA, 18 bp, Homo sapiens
catcccacttagccgcac

SEQ ID NO: 929762 - DNA, 23 bp, Homo sapiens
catcccacttagccgcaccctgc

SEQ ID NO: 929763 - DNA, 15 bp, Homo sapiens
catcccagcctgtgg

SEQ ID NO: 929764 - DNA, 16 bp, Homo sapiens
catcccagcctgtggt

SEQ ID NO: 929765 - DNA, 17 bp, Homo sapiens
catcccagcctgtggtt

SEQ ID NO: 929766 - DNA, 16 bp, Homo sapiens
catcccagcttgcccc

SEQ ID NO: 929767 - DNA, 19 bp, Homo sapiens
catcccaggcttcaccctg

SEQ ID NO: 929768 - DNA, 13 bp, Homo sapiens
catcccaggggac

SEQ ID NO: 929769 - DNA, 12 bp, Homo sapiens
catcccatcatc

SEQ ID NO: 929770 - DNA, 14 bp, Homo sapiens
catcccatctctcc

SEQ ID NO: 929771 - DNA, 15 bp, Homo sapiens
catcccatctctccc

SEQ ID NO: 929772 - DNA, 16 bp, Homo sapiens
catcccatctctccca

SEQ ID NO: 929773 - DNA, 19 bp, Homo sapiens
catcccatctctcccactt

SEQ ID NO: 929774 - DNA, 21 bp, Homo sapiens
catcccatctctcccacttcc

SEQ ID NO: 929775 - DNA, 23 bp, Homo sapiens
catcccatctctcccacttcctc

SEQ ID NO: 929776 - DNA, 13 bp, Homo sapiens
catcccattgccc

SEQ ID NO: 929777 - DNA, 22 bp, Homo sapiens
catcccattttcatcctgagcc

SEQ ID NO: 929778 - DNA, 13 bp, Homo sapiens
catccccaccagc

SEQ ID NO: 929779 - DNA, 16 bp, Homo sapiens
catccccaccagctcg

SEQ ID NO: 929780 - DNA, 20 bp, Homo sapiens
catccccacgacccctgcct

SEQ ID NO: 929781 - DNA, 12 bp, Homo sapiens
catccccagagc

SEQ ID NO: 929782 - DNA, 16 bp, Homo sapiens
catccccagagcccag

SEQ ID NO: 929783 - DNA, 12 bp, Homo sapiens
catccccagggg

SEQ ID NO: 929784 - DNA, 21 bp, Homo sapiens
catccccaggggtcccagcca

SEQ ID NO: 929785 - DNA, 16 bp, Homo sapiens
catccccatcggccct

SEQ ID NO: 929786 - DNA, 19 bp, Homo sapiens
catccccatcggccctgtc

SEQ ID NO: 929787 - DNA, 20 bp, Homo sapiens
catccccatcggccctgtcc

SEQ ID NO: 929788 - DNA, 17 bp, Homo sapiens
catccccccacccgact

SEQ ID NO: 929789 - DNA, 20 bp, Homo sapiens
catccccccacccgacttct

SEQ ID NO: 929790 - DNA, 18 bp, Homo sapiens
catcccccctgctgccca

SEQ ID NO: 929791 - DNA, 20 bp, Homo sapiens
catcccccctgctgcccagt

SEQ ID NO: 929792 - DNA, 11 bp, Homo sapiens
catccccctcc

SEQ ID NO: 929793 - DNA, 22 bp, Homo sapiens
catccccctcctctccctgtta

SEQ ID NO: 929794 - DNA, 16 bp, Homo sapiens
catccccctctcacgc

SEQ ID NO: 929795 - DNA, 20 bp, Homo sapiens
catccccctctcacgccacc

SEQ ID NO: 929796 - DNA, 14 bp, Homo sapiens
catccccctgccct

SEQ ID NO: 929797 - DNA, 14 bp, Homo sapiens
catcccctcccatc

SEQ ID NO: 929798 - DNA, 16 bp, Homo sapiens
catcccctccctgcct

SEQ ID NO: 929799 - DNA, 21 bp, Homo sapiens
catcccctcgtcctgtcccag

SEQ ID NO: 929800 - DNA, 13 bp, Homo sapiens
catcccctctcag

SEQ ID NO: 929801 - DNA, 14 bp, Homo sapiens
catcgcactgtgga

SEQ ID NO: 929802 - DNA, 18 bp, Homo sapiens
catcgcagcttcctgtct

SEQ ID NO: 929803 - DNA, 18 bp, Homo sapiens
catcgcatccgtcctggg

SEQ ID NO: 929804 - DNA, 13 bp, Homo sapiens
catcgccagacaa

SEQ ID NO: 929805 - DNA, 18 bp, Homo sapiens
catcgccatcttcttccc

SEQ ID NO: 929806 - DNA, 19 bp, Homo sapiens
catcgccatcttcttccct

SEQ ID NO: 929807 - DNA, 16 bp, Homo sapiens
catcggaaaaataatc

SEQ ID NO: 929808 - DNA, 20 bp, Homo sapiens
catcggagggagtcccagag

SEQ ID NO: 929809 - DNA, 20 bp, Homo sapiens
catcggcagctgaaccctgc

SEQ ID NO: 929810 - DNA, 15 bp, Homo sapiens
catcggccctgtccc

SEQ ID NO: 929811 - DNA, 16 bp, Homo sapiens
catcgggaaagaagaa

SEQ ID NO: 929812 - DNA, 17 bp, Homo sapiens
catcgggaaagaagaaa

SEQ ID NO: 929813 - DNA, 21 bp, Homo sapiens
catcggtgaaactaacagata

SEQ ID NO: 929814 - DNA, 22 bp, Homo sapiens
catcggtgaaactaacagataa

SEQ ID NO: 929815 - DNA, 14 bp, Homo sapiens
catcggtgcctggt

SEQ ID NO: 929816 - DNA, 12 bp, Homo sapiens
catcgtccagcc

SEQ ID NO: 929817 - DNA, 20 bp, Homo sapiens
ctggggccacctttgtgcag

SEQ ID NO: 929818 - DNA, 13 bp, Homo sapiens
ctggggccagagg

SEQ ID NO: 929819 - DNA, 13 bp, Homo sapiens
ctggggccagggc

SEQ ID NO: 929820 - DNA, 23 bp, Homo sapiens
ctggggcccaagttgcagtgagc

SEQ ID NO: 929821 - DNA, 14 bp, Homo sapiens
ctggggcccagccc

SEQ ID NO: 929822 - DNA, 17 bp, Homo sapiens
ctggggccccgctggga

SEQ ID NO: 929823 - DNA, 13 bp, Homo sapiens
ctggggccctggg

SEQ ID NO: 929824 - DNA, 16 bp, Homo sapiens
ctggggccctgggcct

SEQ ID NO: 929825 - DNA, 18 bp, Homo sapiens
ctggggccgcctgccctg

SEQ ID NO: 929826 - DNA, 22 bp, Homo sapiens
ctggggccgcctgccctgcctt

SEQ ID NO: 929827 - DNA, 23 bp, Homo sapiens
ctggggccgcctgccctgccttg

SEQ ID NO: 929828 - DNA, 22 bp, Homo sapiens
ctggggcctagcgatctctcct

SEQ ID NO: 929829 - DNA, 14 bp, Homo sapiens
ctggggcctcagac

SEQ ID NO: 929830 - DNA, 19 bp, Homo sapiens
ctggggcctcagaccccct

SEQ ID NO: 929831 - DNA, 15 bp, Homo sapiens
ctggggcctcagacg

SEQ ID NO: 929832 - DNA, 15 bp, Homo sapiens
ctggggcctccagaa

SEQ ID NO: 929833 - DNA, 24 bp, Homo sapiens
ctggggcctccagaagctgctcct

SEQ ID NO: 929834 - DNA, 19 bp, Homo sapiens
ctggggcctgactgctcag

SEQ ID NO: 929835 - DNA, 15 bp, Homo sapiens
ctggggcctgagaga

SEQ ID NO: 929836 - DNA, 17 bp, Homo sapiens
ctggggcctggacctgc

SEQ ID NO: 929837 - DNA, 18 bp, Homo sapiens
ctggggcctggacctgcc

SEQ ID NO: 929838 - DNA, 19 bp, Homo sapiens
ctggggcctggacctgcct

SEQ ID NO: 929839 - DNA, 19 bp, Homo sapiens
ctggggcggcatgaaccct

SEQ ID NO: 929840 - DNA, 21 bp, Homo sapiens
ctggggcgggcagccaggctg

SEQ ID NO: 929841 - DNA, 15 bp, Homo sapiens
ctggggcgtggggag

SEQ ID NO: 929842 - DNA, 16 bp, Homo sapiens
ctggggcgtggggagg

SEQ ID NO: 929843 - DNA, 18 bp, Homo sapiens
ctggggctagggggagcc

SEQ ID NO: 929844 - DNA, 18 bp, Homo sapiens
ctggggctccctctctgg

SEQ ID NO: 929845 - DNA, 14 bp, Homo sapiens
ctggggctcccttc

SEQ ID NO: 929846 - DNA, 20 bp, Homo sapiens
ctggggctcctttctccagc

SEQ ID NO: 929847 - DNA, 23 bp, Homo sapiens
ctggggctcctttctccagccag

SEQ ID NO: 929848 - DNA, 14 bp, Homo sapiens
ctggggctctctga

SEQ ID NO: 929849 - DNA, 17 bp, Homo sapiens
ctggggctctgtgcagg

SEQ ID NO: 929850 - DNA, 20 bp, Homo sapiens
ctggggctgaacatgcctgc

SEQ ID NO: 929851 - DNA, 16 bp, Homo sapiens
ctggggctgccagcct

SEQ ID NO: 929852 - DNA, 18 bp, Homo sapiens
ctggggctggggtgagag

SEQ ID NO: 929853 - DNA, 17 bp, Homo sapiens
ctggggcttatgggtgg

SEQ ID NO: 929854 - DNA, 18 bp, Homo sapiens
ctggggcttcaccagtct

SEQ ID NO: 929855 - DNA, 20 bp, Homo sapiens
ctggggcttctcctgaccca

SEQ ID NO: 929856 - DNA, 21 bp, Homo sapiens
ctgggggaatgagcccagaga

SEQ ID NO: 929857 - DNA, 15 bp, Homo sapiens
ctgggggacagagaa

SEQ ID NO: 929858 - DNA, 17 bp, Homo sapiens
ctgggggacccctggct

SEQ ID NO: 929859 - DNA, 12 bp, Homo sapiens
ctgggggacctt

SEQ ID NO: 929860 - DNA, 15 bp, Homo sapiens
ctgggggactgggag

SEQ ID NO: 929861 - DNA, 16 bp, Homo sapiens
ctgggggactgggagt

SEQ ID NO: 929862 - DNA, 18 bp, Homo sapiens
ctgggggaggcagggctg

SEQ ID NO: 929863 - DNA, 17 bp, Homo sapiens
ctgggggaggccatcca

SEQ ID NO: 929864 - DNA, 21 bp, Homo sapiens
ctgggggatggtcagagccca

SEQ ID NO: 929865 - DNA, 18 bp, Homo sapiens
ctgggggattcctgagct

SEQ ID NO: 929866 - DNA, 23 bp, Homo sapiens
ctgggggattcctgagctggcct

SEQ ID NO: 929867 - DNA, 21 bp, Homo sapiens
ctgggggcaaaggtttgaaga

SEQ ID NO: 929868 - DNA, 15 bp, Homo sapiens
ctgggggcacagctg

SEQ ID NO: 929869 - DNA, 19 bp, Homo sapiens
ctgggggcacagctgtctg

SEQ ID NO: 929870 - DNA, 13 bp, Homo sapiens
ctgggggcagctg

SEQ ID NO: 929871 - DNA, 15 bp, Homo sapiens
ctgggggcagctgtc

SEQ ID NO: 929872 - DNA, 19 bp, Homo sapiens
ctgggggcaggagggccct

SEQ ID NO: 929873 - DNA, 12 bp, Homo sapiens
ctgggggcagtg

SEQ ID NO: 929874 - DNA, 13 bp, Homo sapiens
ctgggggcagtga

SEQ ID NO: 929875 - DNA, 22 bp, Homo sapiens
ctgggggccagggctggatgga

SEQ ID NO: 929876 - DNA, 21 bp, Homo sapiens
ctgggggcccgacaggtgggc

SEQ ID NO: 929877 - DNA, 19 bp, Homo sapiens
ctgggggccttgggtgagt

SEQ ID NO: 929878 - DNA, 20 bp, Homo sapiens
ctgggggctggctcccaggg

SEQ ID NO: 929879 - DNA, 18 bp, Homo sapiens
ctggggggatatttccta

SEQ ID NO: 929880 - DNA, 12 bp, Homo sapiens
ctggggggccac

SEQ ID NO: 929881 - DNA, 13 bp, Homo sapiens
ctggggggccacc

SEQ ID NO: 929882 - DNA, 15 bp, Homo sapiens
ctggggggccaccat

SEQ ID NO: 929883 - DNA, 16 bp, Homo sapiens
ctggggggtggggagg

SEQ ID NO: 929884 - DNA, 23 bp, Homo sapiens
ctggggggtggggaggaggaagc

SEQ ID NO: 929885 - DNA, 16 bp, Homo sapiens
ctgggggtagcctgga

SEQ ID NO: 929886 - DNA, 16 bp, Homo sapiens
ctgggggtcccttgct

SEQ ID NO: 929887 - DNA, 18 bp, Homo sapiens
ctgggggtgaggaggaca

SEQ ID NO: 929888 - DNA, 14 bp, Homo sapiens
ctgggggtgccagg

SEQ ID NO: 929889 - DNA, 19 bp, Homo sapiens
ctgggggtgccaggaccag

SEQ ID NO: 929890 - DNA, 17 bp, Homo sapiens
ctgggggtggcaggcac

SEQ ID NO: 929891 - DNA, 14 bp, Homo sapiens
ctgggggtgggcca

SEQ ID NO: 929892 - DNA, 17 bp, Homo sapiens
ctgggggtgggccaggc

SEQ ID NO: 929893 - DNA, 20 bp, Homo sapiens
ctgggggttctttcttcctc

SEQ ID NO: 929894 - DNA, 19 bp, Homo sapiens
ctggggtacacagtgagag

SEQ ID NO: 929895 - DNA, 20 bp, Homo sapiens
ctggggtaggctgtctgtgc

SEQ ID NO: 929896 - DNA, 21 bp, Homo sapiens
ctggggtaggctgtctgtgcc

SEQ ID NO: 929897 - DNA, 22 bp, Homo sapiens
ctggggtaggctgtctgtgcca

SEQ ID NO: 929898 - DNA, 20 bp, Homo sapiens
ctggggtataaaactttcct

SEQ ID NO: 929899 - DNA, 20 bp, Homo sapiens
ctggggtatgtgtgtgtggg

SEQ ID NO: 929900 - DNA, 13 bp, Homo sapiens
ctggggtccaggg

SEQ ID NO: 929901 - DNA, 15 bp, Homo sapiens
ctggggtccagggct

SEQ ID NO: 929902 - DNA, 16 bp, Homo sapiens
ctggggtccagggctg

SEQ ID NO: 929903 - DNA, 17 bp, Homo sapiens
ctggggtccagggctgt

SEQ ID NO: 929904 - DNA, 14 bp, Homo sapiens
ctggggtctctctc

SEQ ID NO: 929905 - DNA, 17 bp, Homo sapiens
ctggggtctctctccct

SEQ ID NO: 929906 - DNA, 18 bp, Homo sapiens
ctggggtctctctcccta

SEQ ID NO: 929907 - DNA, 13 bp, Homo sapiens
ctggggtctgagc

SEQ ID NO: 929908 - DNA, 14 bp, Homo sapiens
ctggggtctgggca

SEQ ID NO: 929909 - DNA, 15 bp, Homo sapiens
ctggggtctgggcag

SEQ ID NO: 929910 - DNA, 13 bp, Homo sapiens
ctggggtgcatcc

SEQ ID NO: 929911 - DNA, 11 bp, Homo sapiens
ctggggtggcc

SEQ ID NO: 929912 - DNA, 14 bp, Homo sapiens
ctggggtggccagg

SEQ ID NO: 929913 - DNA, 18 bp, Homo sapiens
ctggggtggccagggctt

SEQ ID NO: 929914 - DNA, 20 bp, Homo sapiens
ctggggtgggacagggaggg

SEQ ID NO: 929915 - DNA, 14 bp, Homo sapiens
ctggggtgggaggt

SEQ ID NO: 929916 - DNA, 20 bp, Homo sapiens
ctggggtgggaggtcttgct

SEQ ID NO: 929917 - DNA, 17 bp, Homo sapiens
ctggggttcagcccctc

SEQ ID NO: 929918 - DNA, 19 bp, Homo sapiens
ctggggttcagcccctcct

SEQ ID NO: 929919 - DNA, 20 bp, Homo sapiens
ctggggttcagcccctcctc

SEQ ID NO: 929920 - DNA, 23 bp, Homo sapiens
ctgggtaatttataaagaaaaat

SEQ ID NO: 929921 - DNA, 17 bp, Homo sapiens
ctgggtacccaagtgaa

SEQ ID NO: 929922 - DNA, 18 bp, Homo sapiens
ctgggtacccaagtgaag

SEQ ID NO: 929923 - DNA, 12 bp, Homo sapiens
catctgcaaagg

SEQ ID NO: 929924 - DNA, 15 bp, Homo sapiens
catctgcaacaaaaa

SEQ ID NO: 929925 - DNA, 19 bp, Homo sapiens
catctgcaacaaaaagtca

SEQ ID NO: 929926 - DNA, 22 bp, Homo sapiens
catctgcaccccttctctcctc

SEQ ID NO: 929927 - DNA, 20 bp, Homo sapiens
catctgcacccttcttttct

SEQ ID NO: 929928 - DNA, 22 bp, Homo sapiens
catctgcacccttcttttctca

SEQ ID NO: 929929 - DNA, 18 bp, Homo sapiens
catctgcaggcaccgggc

SEQ ID NO: 929930 - DNA, 12 bp, Homo sapiens
catctgccagac

SEQ ID NO: 929931 - DNA, 11 bp, Homo sapiens
catctgcccag

SEQ ID NO: 929932 - DNA, 11 bp, Homo sapiens
catctgcccct

SEQ ID NO: 929933 - DNA, 19 bp, Homo sapiens
catctgcccctcccccaac

SEQ ID NO: 929934 - DNA, 11 bp, Homo sapiens
catctgccctc

SEQ ID NO: 929935 - DNA, 11 bp, Homo sapiens
catctgcctcc

SEQ ID NO: 929936 - DNA, 16 bp, Homo sapiens
catctgcctcctctcc

SEQ ID NO: 929937 - DNA, 17 bp, Homo sapiens
catctgcctgcgctctc

SEQ ID NO: 929938 - DNA, 16 bp, Homo sapiens
catctgcgtgacaata

SEQ ID NO: 929939 - DNA, 18 bp, Homo sapiens
catctgcgtgacaataaa

SEQ ID NO: 929940 - DNA, 14 bp, Homo sapiens
catctgctgtgtgg

SEQ ID NO: 929941 - DNA, 21 bp, Homo sapiens
catctgctgtgtggaaaaaaa

SEQ ID NO: 929942 - DNA, 14 bp, Homo sapiens
catctgctgttatc

SEQ ID NO: 929943 - DNA, 22 bp, Homo sapiens
catctgcttacaattccctgct

SEQ ID NO: 929944 - DNA, 21 bp, Homo sapiens
catctggaatctggagaccag

SEQ ID NO: 929945 - DNA, 19 bp, Homo sapiens
ctgggtcggccctgcccaa

SEQ ID NO: 929946 - DNA, 23 bp, Homo sapiens
ctgggtctcaccggctctcacct

SEQ ID NO: 929947 - DNA, 15 bp, Homo sapiens
ctgggtctcactcct

SEQ ID NO: 929948 - DNA, 19 bp, Homo sapiens
ctgggtctccctttccatg

SEQ ID NO: 929949 - DNA, 22 bp, Homo sapiens
ctgggtctcgctttgttgccca

SEQ ID NO: 929950 - DNA, 18 bp, Homo sapiens
ctgggtctggggacaggc

SEQ ID NO: 929951 - DNA, 15 bp, Homo sapiens
ctgggtctgtgtctc

SEQ ID NO: 929952 - DNA, 16 bp, Homo sapiens
ctgggtctgtgtctct

SEQ ID NO: 929953 - DNA, 16 bp, Homo sapiens
ctgggtcttggccatg

SEQ ID NO: 929954 - DNA, 19 bp, Homo sapiens
ctgggtgacagagtgagtg

SEQ ID NO: 929955 - DNA, 14 bp, Homo sapiens
ctgggtgacagtga

SEQ ID NO: 929956 - DNA, 16 bp, Homo sapiens
ctgggtgagaatcctg

SEQ ID NO: 929957 - DNA, 19 bp, Homo sapiens
ctgggtgagaatcctgcct

SEQ ID NO: 929958 - DNA, 16 bp, Homo sapiens
ctgggtgagctcttcc

SEQ ID NO: 929959 - DNA, 13 bp, Homo sapiens
ctgggtgccctga

SEQ ID NO: 929960 - DNA, 17 bp, Homo sapiens
ctgggtgccctgaaagg

SEQ ID NO: 929961 - DNA, 22 bp, Homo sapiens
ctgggtgccctgaaagggccct

SEQ ID NO: 929962 - DNA, 15 bp, Homo sapiens
ctgggtgcctgcagc

SEQ ID NO: 929963 - DNA, 16 bp, Homo sapiens
ctgggtgcgtctccag

SEQ ID NO: 929964 - DNA, 17 bp, Homo sapiens
ctgggtgcgtctccagt

SEQ ID NO: 929965 - DNA, 21 bp, Homo sapiens
ctgggtggcaccagcagcctg

SEQ ID NO: 929966 - DNA, 15 bp, Homo sapiens
ctgggtggccatcct

SEQ ID NO: 929967 - DNA, 21 bp, Homo sapiens
ctgggtggccatcctacccag

SEQ ID NO: 929968 - DNA, 11 bp, Homo sapiens
ctgggtggcct

SEQ ID NO: 929969 - DNA, 16 bp, Homo sapiens
ctgggtggcctcggga

SEQ ID NO: 929970 - DNA, 15 bp, Homo sapiens
ctgggtgggcccaga

SEQ ID NO: 929971 - DNA, 22 bp, Homo sapiens
ctgggtggggcagcacacctct

SEQ ID NO: 929972 - DNA, 23 bp, Homo sapiens
ctgggtggggcagcacacctctg

SEQ ID NO: 929973 - DNA, 17 bp, Homo sapiens
ctgggtggggctgctcc

SEQ ID NO: 929974 - DNA, 18 bp, Homo sapiens
ctgggtggggctgctcct

SEQ ID NO: 929975 - DNA, 20 bp, Homo sapiens
ctgggtggggctgctcctcc

SEQ ID NO: 929976 - DNA, 19 bp, Homo sapiens
ctgggtgggtggtggggag

SEQ ID NO: 929977 - DNA, 20 bp, Homo sapiens
ctgggtgggtggtggggagg

SEQ ID NO: 929978 - DNA, 22 bp, Homo sapiens
ctgggtgggtggtggggagggg

SEQ ID NO: 929979 - DNA, 16 bp, Homo sapiens
ctgggtggtctgaata

SEQ ID NO: 929980 - DNA, 14 bp, Homo sapiens
ctgggtggtggcct

SEQ ID NO: 929981 - DNA, 20 bp, Homo sapiens
ctgggtgtccgccatccagg

SEQ ID NO: 929982 - DNA, 22 bp, Homo sapiens
ctgggtgtgtttggcttggcct

SEQ ID NO: 929983 - DNA, 19 bp, Homo sapiens
ctgggtgttgaccactcca

SEQ ID NO: 929984 - DNA, 22 bp, Homo sapiens
ctgggttaatggctagtactgt

SEQ ID NO: 929985 - DNA, 22 bp, Homo sapiens
ctgggttcagaaatgctgcctg

SEQ ID NO: 929986 - DNA, 20 bp, Homo sapiens
ctgggttccctttccttcca

SEQ ID NO: 929987 - DNA, 14 bp, Homo sapiens
ctgggttccgggag

SEQ ID NO: 929988 - DNA, 17 bp, Homo sapiens
ctgggttccgggaggca

SEQ ID NO: 929989 - DNA, 17 bp, Homo sapiens
ctgggttctggggcatc

SEQ ID NO: 929990 - DNA, 17 bp, Homo sapiens
ctgggttgcctttattt

SEQ ID NO: 929991 - DNA, 23 bp, Homo sapiens
ctgggttgggggctagggagacg

SEQ ID NO: 929992 - DNA, 15 bp, Homo sapiens
ctgggttggtgcaca

SEQ ID NO: 929993 - DNA, 18 bp, Homo sapiens
ctgggttgtttccaggag

SEQ ID NO: 929994 - DNA, 21 bp, Homo sapiens
ctgggttgtttccaggagaaa

SEQ ID NO: 929995 - DNA, 17 bp, Homo sapiens
ctgggtttctagaggtc

SEQ ID NO: 929996 - DNA, 13 bp, Homo sapiens
ctgggtttctagc

SEQ ID NO: 929997 - DNA, 19 bp, Homo sapiens
ctgggtttgcccagtcctg

SEQ ID NO: 929998 - DNA, 15 bp, Homo sapiens
ctgggtttggcccaa

SEQ ID NO: 929999 - DNA, 17 bp, Homo sapiens
ctggtaaaagggataca

SEQ ID NO: 930000 - DNA, 19 bp, Homo sapiens
ctggtaaaagggatacaca

SEQ ID NO: 930001 - DNA, 20 bp, Homo sapiens
ctggtaaacattcctccagc

SEQ ID NO: 930002 - DNA, 23 bp, Homo sapiens
ctggtaaaccaagcctcccacac

SEQ ID NO: 930003 - DNA, 12 bp, Homo sapiens
ctggtaaatatg

SEQ ID NO: 930004 - DNA, 14 bp, Homo sapiens
ctggtaacagtggc

SEQ ID NO: 930005 - DNA, 20 bp, Homo sapiens
ctggtaagcgatttgaaaca

SEQ ID NO: 930006 - DNA, 15 bp, Homo sapiens
ctggtaatattgact

SEQ ID NO: 930007 - DNA, 19 bp, Homo sapiens
ctggtacccagccatctgc

SEQ ID NO: 930008 - DNA, 21 bp, Homo sapiens
ctggtacccagccatctgccc

SEQ ID NO: 930009 - DNA, 15 bp, Homo sapiens
ctggtaccctcctgg

SEQ ID NO: 930010 - DNA, 19 bp, Homo sapiens
ctggtacttagagtttctg

SEQ ID NO: 930011 - DNA, 16 bp, Homo sapiens
ctggtacttcctttct

SEQ ID NO: 930012 - DNA, 20 bp, Homo sapiens
ctggtagaattgggaagctg

SEQ ID NO: 930013 - DNA, 16 bp, Homo sapiens
ctggtagagaccccca

SEQ ID NO: 930014 - DNA, 19 bp, Homo sapiens
ctggtagagacccccaggc

SEQ ID NO: 930015 - DNA, 20 bp, Homo sapiens
ctggtagagacccccaggcc

SEQ ID NO: 930016 - DNA, 21 bp, Homo sapiens
ctggtagcacatgtctgtcct

SEQ ID NO: 930017 - DNA, 21 bp, Homo sapiens
ctggtagcagcaggctcaggc

SEQ ID NO: 930018 - DNA, 20 bp, Homo sapiens
ctggtagcataaataaaact

SEQ ID NO: 930019 - DNA, 18 bp, Homo sapiens
ctggtaggaccaagcatc

SEQ ID NO: 930020 - DNA, 17 bp, Homo sapiens
ctggtaggggagaaatg

SEQ ID NO: 930021 - DNA, 17 bp, Homo sapiens
ctggtaggttgggacac

SEQ ID NO: 930022 - DNA, 20 bp, Homo sapiens
ctggtaggttgggacaccag

SEQ ID NO: 930023 - DNA, 19 bp, Homo sapiens
ctggtagttagtagcatgt

SEQ ID NO: 930024 - DNA, 20 bp, Homo sapiens
ctggtatatccaaaagcttt

SEQ ID NO: 930025 - DNA, 14 bp, Homo sapiens
ctggtatctcagaa

SEQ ID NO: 930026 - DNA, 12 bp, Homo sapiens
ctggtattaaat

SEQ ID NO: 930027 - DNA, 18 bp, Homo sapiens
ctggtattagttaaaaca

SEQ ID NO: 930028 - DNA, 15 bp, Homo sapiens
ctggtattgttctca

SEQ ID NO: 930029 - DNA, 21 bp, Homo sapiens
ctggtatttctaattccacag

SEQ ID NO: 930030 - DNA, 23 bp, Homo sapiens
ctggtcaaacaaactctctgaac

SEQ ID NO: 930031 - DNA, 21 bp, Homo sapiens
ctggtcaccaaggcagtgcat

SEQ ID NO: 930032 - DNA, 23 bp, Homo sapiens
ctggtcaccaaggcagtgcatgc

SEQ ID NO: 930033 - DNA, 12 bp, Homo sapiens
ctggtcaccctg

SEQ ID NO: 930034 - DNA, 14 bp, Homo sapiens
ctggtcactctgcc

SEQ ID NO: 930035 - DNA, 15 bp, Homo sapiens
ctggtcactctgccc

SEQ ID NO: 930036 - DNA, 16 bp, Homo sapiens
ctggtcactctgccct

SEQ ID NO: 930037 - DNA, 17 bp, Homo sapiens
ctggtcactctgccctc

SEQ ID NO: 930038 - DNA, 19 bp, Homo sapiens
ctggtcactctgccctctg

SEQ ID NO: 930039 - DNA, 21 bp, Homo sapiens
ctggtcagaactgcagggcct

SEQ ID NO: 930040 - DNA, 13 bp, Homo sapiens
ctggtcagagaga

SEQ ID NO: 930041 - DNA, 16 bp, Homo sapiens
ctggtcagggcagtgg

SEQ ID NO: 930042 - DNA, 23 bp, Homo sapiens
ctggtcagggcagtggccaagcc

SEQ ID NO: 930043 - DNA, 16 bp, Homo sapiens
ctggtcagtctttgct

SEQ ID NO: 930044 - DNA, 20 bp, Homo sapiens
cagggaccactgggtgagag

SEQ ID NO: 930045 - DNA, 24 bp, Homo sapiens
cagggaccactgggtgagagagga

SEQ ID NO: 930046 - DNA, 15 bp, Homo sapiens
cagggacccaaagca

SEQ ID NO: 930047 - DNA, 22 bp, Homo sapiens
cagggacccttgcctgcctcct

SEQ ID NO: 930048 - DNA, 15 bp, Homo sapiens
cagggaccggtgctg

SEQ ID NO: 930049 - DNA, 18 bp, Homo sapiens
cagggaccggtgctgcag

SEQ ID NO: 930050 - DNA, 19 bp, Homo sapiens
cagggaccggtgctgcagg

SEQ ID NO: 930051 - DNA, 16 bp, Homo sapiens
cagggacctcaggggc

SEQ ID NO: 930052 - DNA, 21 bp, Homo sapiens
cagggacctcaggggcacctc

SEQ ID NO: 930053 - DNA, 21 bp, Homo sapiens
cagggacttcaggatcaagtc

SEQ ID NO: 930054 - DNA, 15 bp, Homo sapiens
cagggacttgaagtt

SEQ ID NO: 930055 - DNA, 19 bp, Homo sapiens
cagggacttgaagttgtta

SEQ ID NO: 930056 - DNA, 12 bp, Homo sapiens
cagggagaaggg

SEQ ID NO: 930057 - DNA, 21 bp, Homo sapiens
cagggagaagtagctagtagc

SEQ ID NO: 930058 - DNA, 18 bp, Homo sapiens
cagggagacatctgcacc

SEQ ID NO: 930059 - DNA, 21 bp, Homo sapiens
cagggagagcgcctcttcctc

SEQ ID NO: 930060 - DNA, 15 bp, Homo sapiens
cagggagcaagacag

SEQ ID NO: 930061 - DNA, 17 bp, Homo sapiens
cagggagcaagacagag

SEQ ID NO: 930062 - DNA, 17 bp, Homo sapiens
cagggagcacctgtctg

SEQ ID NO: 930063 - DNA, 15 bp, Homo sapiens
cagggagcagccccc

SEQ ID NO: 930064 - DNA, 22 bp, Homo sapiens
cagggagcatttaatggcagct

SEQ ID NO: 930065 - DNA, 15 bp, Homo sapiens
cagggagcctcccca

SEQ ID NO: 930066 - DNA, 15 bp, Homo sapiens
cagggagcggccggc

SEQ ID NO: 930067 - DNA, 21 bp, Homo sapiens
cagggagcggccggccagccc

SEQ ID NO: 930068 - DNA, 12 bp, Homo sapiens
cagggagctcaa

SEQ ID NO: 930069 - DNA, 15 bp, Homo sapiens
cagggagcttcctgg

SEQ ID NO: 930070 - DNA, 17 bp, Homo sapiens
cagggagcttcctggct

SEQ ID NO: 930071 - DNA, 19 bp, Homo sapiens
cagggagcttcctggctct

SEQ ID NO: 930072 - DNA, 20 bp, Homo sapiens
cagggagcttgccacactct

SEQ ID NO: 930073 - DNA, 22 bp, Homo sapiens
cagggaggagaggggaagggcc

SEQ ID NO: 930074 - DNA, 18 bp, Homo sapiens
cagggaggaggtggcagc

SEQ ID NO: 930075 - DNA, 22 bp, Homo sapiens
cagggaggaggtggcagccctg

SEQ ID NO: 930076 - DNA, 14 bp, Homo sapiens
cagggaggagtcag

SEQ ID NO: 930077 - DNA, 21 bp, Homo sapiens
cagggaggcagagcgggaggg

SEQ ID NO: 930078 - DNA, 14 bp, Homo sapiens
cagggaggcagcgt

SEQ ID NO: 930079 - DNA, 19 bp, Homo sapiens
cagggaggcagcgtgggct

SEQ ID NO: 930080 - DNA, 21 bp, Homo sapiens
cagggaggcagcgtgggctct

SEQ ID NO: 930081 - DNA, 15 bp, Homo sapiens
cagggaggccacgtc

SEQ ID NO: 930082 - DNA, 22 bp, Homo sapiens
cagggaggccacgtcccacccc

SEQ ID NO: 930083 - DNA, 13 bp, Homo sapiens
cagggaggcgcag

SEQ ID NO: 930084 - DNA, 14 bp, Homo sapiens
cagggaggcgcagg

SEQ ID NO: 930085 - DNA, 21 bp, Homo sapiens
cagggaggcgcagggacatgg

SEQ ID NO: 930086 - DNA, 12 bp, Homo sapiens
cagggagggaag

SEQ ID NO: 930087 - DNA, 14 bp, Homo sapiens
cagggagggccagg

SEQ ID NO: 930088 - DNA, 15 bp, Homo sapiens
cagggagggccaggg

SEQ ID NO: 930089 - DNA, 24 bp, Homo sapiens
cagggagggccggcggctctgagc

SEQ ID NO: 930090 - DNA, 12 bp, Homo sapiens
cagggagggctt

SEQ ID NO: 930091 - DNA, 16 bp, Homo sapiens
cagggaggggaggcag

SEQ ID NO: 930092 - DNA, 15 bp, Homo sapiens
cagggaggggctggg

SEQ ID NO: 930093 - DNA, 18 bp, Homo sapiens
cagggaggggctggggca

SEQ ID NO: 930094 - DNA, 22 bp, Homo sapiens
cagggaggggctggggcaggct

SEQ ID NO: 930095 - DNA, 23 bp, Homo sapiens
cagggaggggctggggcaggctc

SEQ ID NO: 930096 - DNA, 23 bp, Homo sapiens
cagggagggggacctgtccccca

SEQ ID NO: 930097 - DNA, 19 bp, Homo sapiens
cagggagggttagcctgca

SEQ ID NO: 930098 - DNA, 16 bp, Homo sapiens
cagggaggtcattttg

SEQ ID NO: 930099 - DNA, 14 bp, Homo sapiens
cagggagtccaggg

SEQ ID NO: 930100 - DNA, 22 bp, Homo sapiens
cagggagtccagggtttctctg

SEQ ID NO: 930101 - DNA, 23 bp, Homo sapiens
cagggagtcccctccccggccct

SEQ ID NO: 930102 - DNA, 13 bp, Homo sapiens
cagggagtgagca

SEQ ID NO: 930103 - DNA, 14 bp, Homo sapiens
cagggagtgagcag

SEQ ID NO: 930104 - DNA, 17 bp, Homo sapiens
cagggagtgagcagcta

SEQ ID NO: 930105 - DNA, 22 bp, Homo sapiens
cagggagtgagcagctactgta

SEQ ID NO: 930106 - DNA, 14 bp, Homo sapiens
cagggatattgcct

SEQ ID NO: 930107 - DNA, 17 bp, Homo sapiens
cagggatgagttgaggt

SEQ ID NO: 930108 - DNA, 19 bp, Homo sapiens
cagggatgatggcagagcc

SEQ ID NO: 930109 - DNA, 20 bp, Homo sapiens
cagggatgatggcagagcca

SEQ ID NO: 930110 - DNA, 21 bp, Homo sapiens
cagggatgccctggaggtggc

SEQ ID NO: 930111 - DNA, 15 bp, Homo sapiens
cagggatgctgggct

SEQ ID NO: 930112 - DNA, 14 bp, Homo sapiens
cagggatgctggtg

SEQ ID NO: 930113 - DNA, 17 bp, Homo sapiens
cagggatgggggatggg

SEQ ID NO: 930114 - DNA, 21 bp, Homo sapiens
cagggatgggggatgggccag

SEQ ID NO: 930115 - DNA, 22 bp, Homo sapiens
cagggatgggggatgggccagg

SEQ ID NO: 930116 - DNA, 17 bp, Homo sapiens
cagggattaacctctgc

SEQ ID NO: 930117 - DNA, 12 bp, Homo sapiens
cagggattacag

SEQ ID NO: 930118 - DNA, 20 bp, Homo sapiens
cagggcaaaagggcagctgt

SEQ ID NO: 930119 - DNA, 22 bp, Homo sapiens
cagggcaaaatcgccataggcc

SEQ ID NO: 930120 - DNA, 15 bp, Homo sapiens
cagggcaacaagccc

SEQ ID NO: 930121 - DNA, 21 bp, Homo sapiens
cagggcaaggacacagcgcgg

SEQ ID NO: 930122 - DNA, 15 bp, Homo sapiens
cagggcaaggccatt

SEQ ID NO: 930123 - DNA, 21 bp, Homo sapiens
cagggcaagggttaaggcctg

SEQ ID NO: 930124 - DNA, 21 bp, Homo sapiens
cagggcaatgccatcagcccc

SEQ ID NO: 930125 - DNA, 22 bp, Homo sapiens
cagggcaatgccatcagcccct

SEQ ID NO: 930126 - DNA, 23 bp, Homo sapiens
cagggcaatgccatcagcccctg

SEQ ID NO: 930127 - DNA, 17 bp, Homo sapiens
cagggcacagctgccct

SEQ ID NO: 930128 - DNA, 18 bp, Homo sapiens
cagggcacagctgccctg

SEQ ID NO: 930129 - DNA, 17 bp, Homo sapiens
cagggcacgcaggacca

SEQ ID NO: 930130 - DNA, 18 bp, Homo sapiens
cagggcacgcaggaccag

SEQ ID NO: 930131 - DNA, 17 bp, Homo sapiens
cagggcacggggacctg

SEQ ID NO: 930132 - DNA, 16 bp, Homo sapiens
cagggcagaaatgatt

SEQ ID NO: 930133 - DNA, 13 bp, Homo sapiens
cagggcagaggaa

SEQ ID NO: 930134 - DNA, 15 bp, Homo sapiens
cagggcagaggaatg

SEQ ID NO: 930135 - DNA, 15 bp, Homo sapiens
cagggcagcaaggga

SEQ ID NO: 930136 - DNA, 18 bp, Homo sapiens
cagggcagcaagggacct

SEQ ID NO: 930137 - DNA, 15 bp, Homo sapiens
cagggcagcagtggg

SEQ ID NO: 930138 - DNA, 22 bp, Homo sapiens
cagggcagcctcgcggtcttgg

SEQ ID NO: 930139 - DNA, 14 bp, Homo sapiens
cagggcagcgccag

SEQ ID NO: 930140 - DNA, 15 bp, Homo sapiens
cagggcagcgccagg

SEQ ID NO: 930141 - DNA, 16 bp, Homo sapiens
cagggcagcgccaggc

SEQ ID NO: 930142 - DNA, 17 bp, Homo sapiens
cagggcagctgcctggc

SEQ ID NO: 930143 - DNA, 21 bp, Homo sapiens
cagggcagctgcctggccatg

SEQ ID NO: 930144 - DNA, 14 bp, Homo sapiens
cagggcaggccttg

SEQ ID NO: 930145 - DNA, 17 bp, Homo sapiens
cagggcagggctctgat

SEQ ID NO: 930146 - DNA, 15 bp, Homo sapiens
cagggcagggtctgg

SEQ ID NO: 930147 - DNA, 18 bp, Homo sapiens
cagggcagtggccaagcc

SEQ ID NO: 930148 - DNA, 21 bp, Homo sapiens
cagggcagtggccaagcctgc

SEQ ID NO: 930149 - DNA, 21 bp, Homo sapiens
cagggcagtggcttctttcca

SEQ ID NO: 930150 - DNA, 19 bp, Homo sapiens
cagggcatgcattttgcag

SEQ ID NO: 930151 - DNA, 18 bp, Homo sapiens
cagggccaacccttctcc

SEQ ID NO: 930152 - DNA, 12 bp, Homo sapiens
cagggccacctg

SEQ ID NO: 930153 - DNA, 16 bp, Homo sapiens
cagggccacctgcagg

SEQ ID NO: 930154 - DNA, 17 bp, Homo sapiens
cagggccacctgcagga

SEQ ID NO: 930155 - DNA, 21 bp, Homo sapiens
cagggccacctgcaggaccct

SEQ ID NO: 930156 - DNA, 16 bp, Homo sapiens
cagggccacgctccag

SEQ ID NO: 930157 - DNA, 15 bp, Homo sapiens
cagggccacgtgcca

SEQ ID NO: 930158 - DNA, 17 bp, Homo sapiens
cagggccacgtgccagg

SEQ ID NO: 930159 - DNA, 20 bp, Homo sapiens
cagggccacgtgccaggccc

SEQ ID NO: 930160 - DNA, 19 bp, Homo sapiens
cagggccactcccggcact

SEQ ID NO: 930161 - DNA, 14 bp, Homo sapiens
cagggccagaagga

SEQ ID NO: 930162 - DNA, 18 bp, Homo sapiens
cagggccagactggaaga

SEQ ID NO: 930163 - DNA, 14 bp, Homo sapiens
cagggccagggcaa

SEQ ID NO: 930164 - DNA, 15 bp, Homo sapiens
cagggccagggcaat

SEQ ID NO: 930165 - DNA, 15 bp, Homo sapiens
cagggccagggccct

SEQ ID NO: 930166 - DNA, 14 bp, Homo sapiens
cagggccagggttg

SEQ ID NO: 930167 - DNA, 21 bp, Homo sapiens
cagggccagtcctcctgggag

SEQ ID NO: 930168 - DNA, 16 bp, Homo sapiens
caggccttgctgactc

SEQ ID NO: 930169 - DNA, 21 bp, Homo sapiens
caggccttgctgactctctga

SEQ ID NO: 930170 - DNA, 19 bp, Homo sapiens
caggccttgctggggtcca

SEQ ID NO: 930171 - DNA, 20 bp, Homo sapiens
caggccttgctggggtccag

SEQ ID NO: 930172 - DNA, 21 bp, Homo sapiens
caggccttgctggggtccagg

SEQ ID NO: 930173 - DNA, 22 bp, Homo sapiens
caggccttgctggggtccaggg

SEQ ID NO: 930174 - DNA, 23 bp, Homo sapiens
caggccttgctggggtccagggc

SEQ ID NO: 930175 - DNA, 16 bp, Homo sapiens
caggcctttggagggg

SEQ ID NO: 930176 - DNA, 16 bp, Homo sapiens
caggcgatccacctgt

SEQ ID NO: 930177 - DNA, 19 bp, Homo sapiens
caggcgatccacctgtctc

SEQ ID NO: 930178 - DNA, 20 bp, Homo sapiens
caggcgatccccgcttcccc

SEQ ID NO: 930179 - DNA, 21 bp, Homo sapiens
caggcgatccccgcttcccct

SEQ ID NO: 930180 - DNA, 14 bp, Homo sapiens
caggcgcagaggtc

SEQ ID NO: 930181 - DNA, 17 bp, Homo sapiens
caggcgcagaggtccca

SEQ ID NO: 930182 - DNA, 21 bp, Homo sapiens
caggcgcatgagtatctgtgg

SEQ ID NO: 930183 - DNA, 15 bp, Homo sapiens
caggcgcatgtctgc

SEQ ID NO: 930184 - DNA, 23 bp, Homo sapiens
caggcgcttctccaatgctctgg

SEQ ID NO: 930185 - DNA, 19 bp, Homo sapiens
caggcggccagggcggcca

SEQ ID NO: 930186 - DNA, 21 bp, Homo sapiens
caggcggccctcagtgcatcc

SEQ ID NO: 930187 - DNA, 21 bp, Homo sapiens
caggcggctcctcctcaccca

SEQ ID NO: 930188 - DNA, 14 bp, Homo sapiens
caggcgggcgagcc

SEQ ID NO: 930189 - DNA, 18 bp, Homo sapiens
caggcgggcgagccgcgg

SEQ ID NO: 930190 - DNA, 15 bp, Homo sapiens
caggcgggctcaagg

SEQ ID NO: 930191 - DNA, 14 bp, Homo sapiens
caggcggggcagta

SEQ ID NO: 930192 - DNA, 19 bp, Homo sapiens
caggcggggcagtatgtga

SEQ ID NO: 930193 - DNA, 18 bp, Homo sapiens
caggcggtccccatcccc

SEQ ID NO: 930194 - DNA, 21 bp, Homo sapiens
caggcggtccccatccccacc

SEQ ID NO: 930195 - DNA, 22 bp, Homo sapiens
caggcggtccccatccccacca

SEQ ID NO: 930196 - DNA, 23 bp, Homo sapiens
caggcggtccccatccccaccag

SEQ ID NO: 930197 - DNA, 17 bp, Homo sapiens
caggcggtgggcaccca

SEQ ID NO: 930198 - DNA, 18 bp, Homo sapiens
caggcgtgtggcagccac

SEQ ID NO: 930199 - DNA, 19 bp, Homo sapiens
caggcgtgtggcagccaca

SEQ ID NO: 930200 - DNA, 20 bp, Homo sapiens
caggcgtgtggcagccacac

SEQ ID NO: 930201 - DNA, 20 bp, Homo sapiens
caggcgttggtgccacttct

SEQ ID NO: 930202 - DNA, 22 bp, Homo sapiens
caggctaaatgcaccaagaaag

SEQ ID NO: 930203 - DNA, 18 bp, Homo sapiens
caggctactctcctcggc

SEQ ID NO: 930204 - DNA, 17 bp, Homo sapiens
caggctatggttgccac

SEQ ID NO: 930205 - DNA, 15 bp, Homo sapiens
caggctatttgttca

SEQ ID NO: 930206 - DNA, 18 bp, Homo sapiens
caggctcaagctatcctt

SEQ ID NO: 930207 - DNA, 13 bp, Homo sapiens
caggctcactgcc

SEQ ID NO: 930208 - DNA, 14 bp, Homo sapiens
caggctcactgcca

SEQ ID NO: 930209 - DNA, 20 bp, Homo sapiens
caggctcactgccaggccag

SEQ ID NO: 930210 - DNA, 14 bp, Homo sapiens
caggctcagactct

SEQ ID NO: 930211 - DNA, 15 bp, Homo sapiens
caggctcagactctg

SEQ ID NO: 930212 - DNA, 16 bp, Homo sapiens
caggctcagactctgg

SEQ ID NO: 930213 - DNA, 20 bp, Homo sapiens
caggctccaagaggctgagg

SEQ ID NO: 930214 - DNA, 15 bp, Homo sapiens
caggctccagttgaa

SEQ ID NO: 930215 - DNA, 15 bp, Homo sapiens
caggctccccagaac

SEQ ID NO: 930216 - DNA, 16 bp, Homo sapiens
caggctcctggctgtg

SEQ ID NO: 930217 - DNA, 20 bp, Homo sapiens
caggctcgtcagccacctgg

SEQ ID NO: 930218 - DNA, 16 bp, Homo sapiens
caggctctagagagag

SEQ ID NO: 930219 - DNA, 17 bp, Homo sapiens
caggctctagagagagg

SEQ ID NO: 930220 - DNA, 20 bp, Homo sapiens
caggctctagagagagggag

SEQ ID NO: 930221 - DNA, 14 bp, Homo sapiens
caggctctctcctc

SEQ ID NO: 930222 - DNA, 16 bp, Homo sapiens
caggctctgagacaca

SEQ ID NO: 930223 - DNA, 21 bp, Homo sapiens
caggctctgggcacagtgctg

SEQ ID NO: 930224 - DNA, 13 bp, Homo sapiens
caggctctgggct

SEQ ID NO: 930225 - DNA, 20 bp, Homo sapiens
caggctctgggctcagggct

SEQ ID NO: 930226 - DNA, 15 bp, Homo sapiens
caggctctgttcctc

SEQ ID NO: 930227 - DNA, 15 bp, Homo sapiens
caggctcttagcagc

SEQ ID NO: 930228 - DNA, 13 bp, Homo sapiens
caggctcttcctg

SEQ ID NO: 930229 - DNA, 14 bp, Homo sapiens
caggctcttcctgg

SEQ ID NO: 930230 - DNA, 21 bp, Homo sapiens
caggctcttcctggacctgag

SEQ ID NO: 930231 - DNA, 22 bp, Homo sapiens
caggctcttcctggacctgagt

SEQ ID NO: 930232 - DNA, 23 bp, Homo sapiens
caggctcttcctggacctgagtc

SEQ ID NO: 930233 - DNA, 21 bp, Homo sapiens
caggctcttccttgaatcttc

SEQ ID NO: 930234 - DNA, 15 bp, Homo sapiens
caggctcttctcctt

SEQ ID NO: 930235 - DNA, 22 bp, Homo sapiens
caggctgaaatatccacccagc

SEQ ID NO: 930236 - DNA, 23 bp, Homo sapiens
caggctgaaatatccacccagca

SEQ ID NO: 930237 - DNA, 19 bp, Homo sapiens
caggctgaattacagtgaa

SEQ ID NO: 930238 - DNA, 17 bp, Homo sapiens
caggctgaccacagcac

SEQ ID NO: 930239 - DNA, 18 bp, Homo sapiens
caggctgacgttccgggc

SEQ ID NO: 930240 - DNA, 14 bp, Homo sapiens
caggctgactggca

SEQ ID NO: 930241 - DNA, 23 bp, Homo sapiens
caggctgagaactcgttcacctc

SEQ ID NO: 930242 - DNA, 21 bp, Homo sapiens
caggctgagcctcagtctccc

SEQ ID NO: 930243 - DNA, 16 bp, Homo sapiens
caggctgatttctagg

SEQ ID NO: 930244 - DNA, 15 bp, Homo sapiens
caggctgcactgcag

SEQ ID NO: 930245 - DNA, 23 bp, Homo sapiens
caggctgcagagcccggccccac

SEQ ID NO: 930246 - DNA, 17 bp, Homo sapiens
caggctgcagctggaca

SEQ ID NO: 930247 - DNA, 16 bp, Homo sapiens
caggctgccgtggggc

SEQ ID NO: 930248 - DNA, 15 bp, Homo sapiens
caggctgcctcggac

SEQ ID NO: 930249 - DNA, 19 bp, Homo sapiens
caggctgctaacctggaaa

SEQ ID NO: 930250 - DNA, 21 bp, Homo sapiens
caggctgctggggcctcagac

SEQ ID NO: 930251 - DNA, 20 bp, Homo sapiens
caggctggaatgagggaggc

SEQ ID NO: 930252 - DNA, 21 bp, Homo sapiens
caggctggagataacagcctc

SEQ ID NO: 930253 - DNA, 20 bp, Homo sapiens
caggctggaggtaaggcctt

SEQ ID NO: 930254 - DNA, 14 bp, Homo sapiens
caggctggagtgca

SEQ ID NO: 930255 - DNA, 16 bp, Homo sapiens
caggctggagtgcagt

SEQ ID NO: 930256 - DNA, 18 bp, Homo sapiens
caggctggagtgcagtgg

SEQ ID NO: 930257 - DNA, 21 bp, Homo sapiens
caggctggcaccgccttctct

SEQ ID NO: 930258 - DNA, 12 bp, Homo sapiens
caggctggccag

SEQ ID NO: 930259 - DNA, 19 bp, Homo sapiens
caggctggccagtccaggc

SEQ ID NO: 930260 - DNA, 20 bp, Homo sapiens
caggctggcgcagccaaggc

SEQ ID NO: 930261 - DNA, 12 bp, Homo sapiens
caggctgggaac

SEQ ID NO: 930262 - DNA, 11 bp, Homo sapiens
caggctgggcc

SEQ ID NO: 930263 - DNA, 18 bp, Homo sapiens
caggctgggccatgtcca

SEQ ID NO: 930264 - DNA, 21 bp, Homo sapiens
caggctgggccgcaagggcct

SEQ ID NO: 930265 - DNA, 23 bp, Homo sapiens
caggctgggccgcaagggcctgg

SEQ ID NO: 930266 - DNA, 16 bp, Homo sapiens
caggctggggaggcca

SEQ ID NO: 930267 - DNA, 19 bp, Homo sapiens
caggctggggaggccagtg

SEQ ID NO: 930268 - DNA, 20 bp, Homo sapiens
caggctggggaggccagtgt

SEQ ID NO: 930269 - DNA, 14 bp, Homo sapiens
caggctggggaggt

SEQ ID NO: 930270 - DNA, 17 bp, Homo sapiens
caggctggggaggtgct

SEQ ID NO: 930271 - DNA, 12 bp, Homo sapiens
caggctgggtca

SEQ ID NO: 930272 - DNA, 21 bp, Homo sapiens
caggctgggtcaaaagagccc

SEQ ID NO: 930273 - DNA, 13 bp, Homo sapiens
caggctggtctca

SEQ ID NO: 930274 - DNA, 22 bp, Homo sapiens
caggctggtctcaaactcctga

SEQ ID NO: 930275 - DNA, 16 bp, Homo sapiens
caggctggtctgaaac

SEQ ID NO: 930276 - DNA, 15 bp, Homo sapiens
caggctgtaagcatt

SEQ ID NO: 930277 - DNA, 21 bp, Homo sapiens
caggctgtaggaaatctagtt

SEQ ID NO: 930278 - DNA, 17 bp, Homo sapiens
caggctgtctggccagg

SEQ ID NO: 930279 - DNA, 16 bp, Homo sapiens
caggctgtgggcctca

SEQ ID NO: 930280 - DNA, 13 bp, Homo sapiens
caggctgtggggt

SEQ ID NO: 930281 - DNA, 14 bp, Homo sapiens
caggctgttccatg

SEQ ID NO: 930282 - DNA, 20 bp, Homo sapiens
caggctgttctcgaactcct

SEQ ID NO: 930283 - DNA, 15 bp, Homo sapiens
caggcttcaccctga

SEQ ID NO: 930284 - DNA, 20 bp, Homo sapiens
caggcttccctgacttgctt

SEQ ID NO: 930285 - DNA, 14 bp, Homo sapiens
caggcttccgcgcc

SEQ ID NO: 930286 - DNA, 17 bp, Homo sapiens
caggcttgagggagggc

SEQ ID NO: 930287 - DNA, 13 bp, Homo sapiens
caggcttgcctca

SEQ ID NO: 930288 - DNA, 16 bp, Homo sapiens
caggcttgcctgggct

SEQ ID NO: 930289 - DNA, 18 bp, Homo sapiens
caggcttgcctgggctgg

SEQ ID NO: 930290 - DNA, 13 bp, Homo sapiens
caggcttggggaa

SEQ ID NO: 930291 - DNA, 19 bp, Homo sapiens
caggcttttccaggaagat

SEQ ID NO: 930292 - DNA, 15 bp, Homo sapiens
cagggaaaagcagct

SEQ ID NO: 930293 - DNA, 20 bp, Homo sapiens
cagggaaaagcagctctccc

SEQ ID NO: 930294 - DNA, 21 bp, Homo sapiens
cagggaaaagcagctctcccc

SEQ ID NO: 930295 - DNA, 20 bp, Homo sapiens
cagggaaaattatttgcata

SEQ ID NO: 930296 - DNA, 18 bp, Homo sapiens
cagggaaacaaagtttac

SEQ ID NO: 930297 - DNA, 17 bp, Homo sapiens
cagggaaagctccacgg

SEQ ID NO: 930298 - DNA, 14 bp, Homo sapiens
cagggaaattaatc

SEQ ID NO: 930299 - DNA, 22 bp, Homo sapiens
cagggaagagcagaacggagcc

SEQ ID NO: 930300 - DNA, 14 bp, Homo sapiens
cagggaagaggggt

SEQ ID NO: 930301 - DNA, 19 bp, Homo sapiens
cagggaagcgtcgccccag

SEQ ID NO: 930302 - DNA, 13 bp, Homo sapiens
cagggaagctggc

SEQ ID NO: 930303 - DNA, 12 bp, Homo sapiens
cagggaaggaaa

SEQ ID NO: 930304 - DNA, 15 bp, Homo sapiens
cagggaaggcctgac

SEQ ID NO: 930305 - DNA, 23 bp, Homo sapiens
cagggaaggcctgacttctgctg

SEQ ID NO: 930306 - DNA, 21 bp, Homo sapiens
cagggaaggtggggccctgcc

SEQ ID NO: 930307 - DNA, 22 bp, Homo sapiens
cagggaaggtggggccctgccc

SEQ ID NO: 930308 - DNA, 18 bp, Homo sapiens
cagggaatccaagcctcc

SEQ ID NO: 930309 - DNA, 16 bp, Homo sapiens
cagggaatgcctggag

SEQ ID NO: 930310 - DNA, 23 bp, Homo sapiens
cagggaatttcaggaactagaga

SEQ ID NO: 930311 - DNA, 13 bp, Homo sapiens
cagggacaaagaa

SEQ ID NO: 930312 - DNA, 17 bp, Homo sapiens
cagggacaaagaggcct

SEQ ID NO: 930313 - DNA, 18 bp, Homo sapiens
cagggacaaagaggcctt

SEQ ID NO: 930314 - DNA, 22 bp, Homo sapiens
cagggacagagacacctgcacc

SEQ ID NO: 930315 - DNA, 15 bp, Homo sapiens
cagggacagagccat

SEQ ID NO: 930316 - DNA, 17 bp, Homo sapiens
cagggacagagccatgc

SEQ ID NO: 930317 - DNA, 13 bp, Homo sapiens
cagggacagaggc

SEQ ID NO: 930318 - DNA, 20 bp, Homo sapiens
cagggacagaggccaaggac

SEQ ID NO: 930319 - DNA, 17 bp, Homo sapiens
cagggacatgccctgtg

SEQ ID NO: 930320 - DNA, 22 bp, Homo sapiens
cagggacatgccctgtgtggct

SEQ ID NO: 930321 - DNA, 16 bp, Homo sapiens
cagggacatggggcaa

SEQ ID NO: 930322 - DNA, 23 bp, Homo sapiens
cagggacatggggcaagccaggg

SEQ ID NO: 930323 - DNA, 18 bp, Homo sapiens
cagggacattgcagagtg

SEQ ID NO: 930324 - DNA, 16 bp, Homo sapiens
ctgccttagtctcagt

SEQ ID NO: 930325 - DNA, 13 bp, Homo sapiens
ctgccttccagcc

SEQ ID NO: 930326 - DNA, 17 bp, Homo sapiens
ctgccttccagcccaga

SEQ ID NO: 930327 - DNA, 12 bp, Homo sapiens
ctgccttcccta

SEQ ID NO: 930328 - DNA, 15 bp, Homo sapiens
ctgccttccctagct

SEQ ID NO: 930329 - DNA, 16 bp, Homo sapiens
ctgccttcctcatccc

SEQ ID NO: 930330 - DNA, 13 bp, Homo sapiens
ctgccttcctcct

SEQ ID NO: 930331 - DNA, 14 bp, Homo sapiens
ctgccttcctcctg

SEQ ID NO: 930332 - DNA, 15 bp, Homo sapiens
ctgccttcctcctta

SEQ ID NO: 930333 - DNA, 21 bp, Homo sapiens
ctgccttcgcttcttgcctct

SEQ ID NO: 930334 - DNA, 19 bp, Homo sapiens
ctgccttcgttaactgtgt

SEQ ID NO: 930335 - DNA, 21 bp, Homo sapiens
ctgccttctcctctctgggcc

SEQ ID NO: 930336 - DNA, 18 bp, Homo sapiens
ctgccttctggccttgta

SEQ ID NO: 930337 - DNA, 16 bp, Homo sapiens
ctgccttgaagccact

SEQ ID NO: 930338 - DNA, 22 bp, Homo sapiens
ctgccttgaagccactgaagct

SEQ ID NO: 930339 - DNA, 13 bp, Homo sapiens
ctgccttgagcta

SEQ ID NO: 930340 - DNA, 14 bp, Homo sapiens
ctgccttgagctaa

SEQ ID NO: 930341 - DNA, 21 bp, Homo sapiens
ctgccttgagctaaccccaag

SEQ ID NO: 930342 - DNA, 21 bp, Homo sapiens
ctgccttgccgctccccttgg

SEQ ID NO: 930343 - DNA, 23 bp, Homo sapiens
ctgccttgccgctccccttggac

SEQ ID NO: 930344 - DNA, 23 bp, Homo sapiens
ctgccttggactgtgtttttcct

SEQ ID NO: 930345 - DNA, 14 bp, Homo sapiens
ctgccttggcctcc

SEQ ID NO: 930346 - DNA, 15 bp, Homo sapiens
ctgccttggcctccc

SEQ ID NO: 930347 - DNA, 16 bp, Homo sapiens
ctgccttggcctccca

SEQ ID NO: 930348 - DNA, 17 bp, Homo sapiens
ctgccttggctcagaca

SEQ ID NO: 930349 - DNA, 18 bp, Homo sapiens
ctgccttggctcagacat

SEQ ID NO: 930350 - DNA, 19 bp, Homo sapiens
ctgccttggttctggccac

SEQ ID NO: 930351 - DNA, 19 bp, Homo sapiens
ctgcctttaaatgaaacaa

SEQ ID NO: 930352 - DNA, 14 bp, Homo sapiens
ctgcctttaagcca

SEQ ID NO: 930353 - DNA, 19 bp, Homo sapiens
ctgcctttaagccaaagaa

SEQ ID NO: 930354 - DNA, 20 bp, Homo sapiens
ctgcctttaagccaaagaaa

SEQ ID NO: 930355 - DNA, 17 bp, Homo sapiens
ctgcctttagcctggac

SEQ ID NO: 930356 - DNA, 19 bp, Homo sapiens
ctgcctttagcctggacca

SEQ ID NO: 930357 - DNA, 19 bp, Homo sapiens
ctgcctttgatcacaggag

SEQ ID NO: 930358 - DNA, 20 bp, Homo sapiens
ctgcctttgcagttggactc

SEQ ID NO: 930359 - DNA, 21 bp, Homo sapiens
ctgcctttgtccccacacagc

SEQ ID NO: 930360 - DNA, 15 bp, Homo sapiens
ctgccttttctggag

SEQ ID NO: 930361 - DNA, 17 bp, Homo sapiens
ctgccttttttcacagc

SEQ ID NO: 930362 - DNA, 21 bp, Homo sapiens
ctgcgaagaccctcttgccca

SEQ ID NO: 930363 - DNA, 22 bp, Homo sapiens
ctgcgaagaccctcttgcccat

SEQ ID NO: 930364 - DNA, 20 bp, Homo sapiens
ctgcgaatgggatcctgatg

SEQ ID NO: 930365 - DNA, 15 bp, Homo sapiens
ctgcgacagcttgtg

SEQ ID NO: 930366 - DNA, 19 bp, Homo sapiens
ctgcgactttctgcctgga

SEQ ID NO: 930367 - DNA, 23 bp, Homo sapiens
ctgcgaggacatcaaagtggtaa

SEQ ID NO: 930368 - DNA, 23 bp, Homo sapiens
ctgcgagtagatgaacctgcagc

SEQ ID NO: 930369 - DNA, 14 bp, Homo sapiens
ctgcgatcttcaga

SEQ ID NO: 930370 - DNA, 16 bp, Homo sapiens
ctgcgcagggtggtgg

SEQ ID NO: 930371 - DNA, 13 bp, Homo sapiens
ctgcgccactgct

SEQ ID NO: 930372 - DNA, 20 bp, Homo sapiens
ctgcgccactgctccgtgga

SEQ ID NO: 930373 - DNA, 12 bp, Homo sapiens
ctgcgccaggca

SEQ ID NO: 930374 - DNA, 15 bp, Homo sapiens
ctgcgccaggcagag

SEQ ID NO: 930375 - DNA, 17 bp, Homo sapiens
ctgcgccaggcagagct

SEQ ID NO: 930376 - DNA, 20 bp, Homo sapiens
ctgcgccaggcagagctgag

SEQ ID NO: 930377 - DNA, 16 bp, Homo sapiens
ctgcgccagtcctgct

SEQ ID NO: 930378 - DNA, 20 bp, Homo sapiens
ctgcgcccagagctggcctc

SEQ ID NO: 930379 - DNA, 18 bp, Homo sapiens
ctgcgcccagtccttcca

SEQ ID NO: 930380 - DNA, 13 bp, Homo sapiens
ctgcgcccccagc

SEQ ID NO: 930381 - DNA, 20 bp, Homo sapiens
ctgcgccccgcctgacctgg

SEQ ID NO: 930382 - DNA, 17 bp, Homo sapiens
ctgcgcccttaccttcc

SEQ ID NO: 930383 - DNA, 21 bp, Homo sapiens
ctgcgcccttgaggggcccca

SEQ ID NO: 930384 - DNA, 19 bp, Homo sapiens
ctgcgccggacagagtggg

SEQ ID NO: 930385 - DNA, 12 bp, Homo sapiens
ctgcgcctcagg

SEQ ID NO: 930386 - DNA, 13 bp, Homo sapiens
ctgcgcctccaga

SEQ ID NO: 930387 - DNA, 14 bp, Homo sapiens
ctgcgcctccagag

SEQ ID NO: 930388 - DNA, 15 bp, Homo sapiens
ctgcgcctccagagg

SEQ ID NO: 930389 - DNA, 19 bp, Homo sapiens
ctgcgcctccatccatctg

SEQ ID NO: 930390 - DNA, 13 bp, Homo sapiens
ctgcgcctgcagg

SEQ ID NO: 930391 - DNA, 17 bp, Homo sapiens
ctgcgcctgcaggcaga

SEQ ID NO: 930392 - DNA, 17 bp, Homo sapiens
ctgcgcctgctgcctgc

SEQ ID NO: 930393 - DNA, 18 bp, Homo sapiens
ctgcgctagcagcccttg

SEQ ID NO: 930394 - DNA, 22 bp, Homo sapiens
ctgcgctagcagcccttgtgtg

SEQ ID NO: 930395 - DNA, 18 bp, Homo sapiens
ctgcggagtgaagagggg

SEQ ID NO: 930396 - DNA, 20 bp, Homo sapiens
ctgcggagtgaagaggggca

SEQ ID NO: 930397 - DNA, 21 bp, Homo sapiens
ctgcggagtgaagaggggcag

SEQ ID NO: 930398 - DNA, 22 bp, Homo sapiens
ctgcggagtgaagaggggcagc

SEQ ID NO: 930399 - DNA, 16 bp, Homo sapiens
ctgcggcgccagcctc

SEQ ID NO: 930400 - DNA, 17 bp, Homo sapiens
ctgcgggatggtcctgg

SEQ ID NO: 930401 - DNA, 18 bp, Homo sapiens
ctgcgggccacagggcaa

SEQ ID NO: 930402 - DNA, 16 bp, Homo sapiens
ctgcgggccagggtcc

SEQ ID NO: 930403 - DNA, 19 bp, Homo sapiens
ctgcgggccagggtcctgt

SEQ ID NO: 930404 - DNA, 20 bp, Homo sapiens
ctgcgggcgcgggcagccac

SEQ ID NO: 930405 - DNA, 22 bp, Homo sapiens
ctgcgggcgcgggcagccaccc

SEQ ID NO: 930406 - DNA, 23 bp, Homo sapiens
ctgcgggcgcgggcagccaccca

SEQ ID NO: 930407 - DNA, 15 bp, Homo sapiens
ctgcgggctccctcc

SEQ ID NO: 930408 - DNA, 16 bp, Homo sapiens
ctgcgggctccctcct

SEQ ID NO: 930409 - DNA, 17 bp, Homo sapiens
ctgcgggctccctcctc

SEQ ID NO: 930410 - DNA, 14 bp, Homo sapiens
ctgcggggagacag

SEQ ID NO: 930411 - DNA, 15 bp, Homo sapiens
ctgcggggagacaga

SEQ ID NO: 930412 - DNA, 19 bp, Homo sapiens
ctgcggggagacagaagcc

SEQ ID NO: 930413 - DNA, 16 bp, Homo sapiens
ctgcgggtctgaagga

SEQ ID NO: 930414 - DNA, 22 bp, Homo sapiens
ctgcgggtgaacaaagcagcca

SEQ ID NO: 930415 - DNA, 13 bp, Homo sapiens
ctgcgggtggggc

SEQ ID NO: 930416 - DNA, 19 bp, Homo sapiens
ctgcgtcatgcttgtgtta

SEQ ID NO: 930417 - DNA, 15 bp, Homo sapiens
ctgcgtccccactcc

SEQ ID NO: 930418 - DNA, 18 bp, Homo sapiens
ctgcgtccctccgagctt

SEQ ID NO: 930419 - DNA, 20 bp, Homo sapiens
ctgcgtccctccgagcttgg

SEQ ID NO: 930420 - DNA, 14 bp, Homo sapiens
ctgcgtcctcctca

SEQ ID NO: 930421 - DNA, 18 bp, Homo sapiens
ctgcgtcctgacgccctg

SEQ ID NO: 930422 - DNA, 17 bp, Homo sapiens
ctgcgtcggtcctggtg

SEQ ID NO: 930423 - DNA, 18 bp, Homo sapiens
ctgcgtctccatatgtgt

SEQ ID NO: 930424 - DNA, 17 bp, Homo sapiens
ctgcgtctgctcttctg

SEQ ID NO: 930425 - DNA, 17 bp, Homo sapiens
ctgcgtcttccgcccct

SEQ ID NO: 930426 - DNA, 23 bp, Homo sapiens
ctgcgtcttccgcccctgcctgc

SEQ ID NO: 930427 - DNA, 20 bp, Homo sapiens
ctgcgtgcagggacaaagag

SEQ ID NO: 930428 - DNA, 19 bp, Homo sapiens
ctgcgtgtcacctgtgctt

SEQ ID NO: 930429 - DNA, 16 bp, Homo sapiens
ctgcgttcagcccctg

SEQ ID NO: 930430 - DNA, 14 bp, Homo sapiens
ctgcgttggagcca

SEQ ID NO: 930431 - DNA, 23 bp, Homo sapiens
ctgcgttggagccactcctgtcc

SEQ ID NO: 930432 - DNA, 19 bp, Homo sapiens
ctgcgttggtccagagcgg

SEQ ID NO: 930433 - DNA, 15 bp, Homo sapiens
ctgcgtttttttata

SEQ ID NO: 930434 - DNA, 20 bp, Homo sapiens
ctgcgtttttttatagtaga

SEQ ID NO: 930435 - DNA, 21 bp, Homo sapiens
ctgctaaagggagaaatgcca

SEQ ID NO: 930436 - DNA, 17 bp, Homo sapiens
ctgctaaattctatgtt

SEQ ID NO: 930437 - DNA, 14 bp, Homo sapiens
ctgctaacctggaa

SEQ ID NO: 930438 - DNA, 13 bp, Homo sapiens
ctgctaagaagct

SEQ ID NO: 930439 - DNA, 13 bp, Homo sapiens
ctgctaaggctgc

SEQ ID NO: 930440 - DNA, 17 bp, Homo sapiens
ctgctaaggctgctggc

SEQ ID NO: 930441 - DNA, 18 bp, Homo sapiens
ctgctaaggctgctggct

SEQ ID NO: 930442 - DNA, 19 bp, Homo sapiens
ctgctaaggctgctggctt

SEQ ID NO: 930443 - DNA, 22 bp, Homo sapiens
ctgctaagtaatttagaagata

SEQ ID NO: 930444 - DNA, 18 bp, Homo sapiens
ctgctaagtatttcccag

SEQ ID NO: 930445 - DNA, 16 bp, Homo sapiens
ctgctaataaaaccca

SEQ ID NO: 930446 - DNA, 23 bp, Homo sapiens
ctgctaatcatgtgggtgagcca

SEQ ID NO: 930447 - DNA, 20 bp, Homo sapiens
ctgctaatgcaaattaaaac

SEQ ID NO: 930448 - DNA, 20 bp, Homo sapiens
cagggccagtggggcctgtg

SEQ ID NO: 930449 - DNA, 12 bp, Homo sapiens
cagggccatgca

SEQ ID NO: 930450 - DNA, 17 bp, Homo sapiens
cagggccatgctgaggc

SEQ ID NO: 930451 - DNA, 23 bp, Homo sapiens
cagggccatgctgaggcctgggc

SEQ ID NO: 930452 - DNA, 17 bp, Homo sapiens
cagggccatgtcagaca

SEQ ID NO: 930453 - DNA, 20 bp, Homo sapiens
cagggccatgtcagacacag

SEQ ID NO: 930454 - DNA, 12 bp, Homo sapiens
cagggcccacct

SEQ ID NO: 930455 - DNA, 17 bp, Homo sapiens
cagggcccaccttggac

SEQ ID NO: 930456 - DNA, 16 bp, Homo sapiens
cagggcccagagccct

SEQ ID NO: 930457 - DNA, 20 bp, Homo sapiens
cagggcccagagcccttgac

SEQ ID NO: 930458 - DNA, 19 bp, Homo sapiens
cagggcccagcggtccctg

SEQ ID NO: 930459 - DNA, 14 bp, Homo sapiens
cagggcccaggcca

SEQ ID NO: 930460 - DNA, 14 bp, Homo sapiens
cagggcccaggttc

SEQ ID NO: 930461 - DNA, 15 bp, Homo sapiens
cagggccccagcact

SEQ ID NO: 930462 - DNA, 21 bp, Homo sapiens
cagggcccccatctcatgccc

SEQ ID NO: 930463 - DNA, 21 bp, Homo sapiens
cagggccccccaaatcccagg

SEQ ID NO: 930464 - DNA, 15 bp, Homo sapiens
cagggcccctccctc

SEQ ID NO: 930465 - DNA, 16 bp, Homo sapiens
cagggcccctggatct

SEQ ID NO: 930466 - DNA, 19 bp, Homo sapiens
cagggcccgggcacccaca

SEQ ID NO: 930467 - DNA, 15 bp, Homo sapiens
cagggccctgagctc

SEQ ID NO: 930468 - DNA, 13 bp, Homo sapiens
cagggccctgccc

SEQ ID NO: 930469 - DNA, 14 bp, Homo sapiens
cagggccctgggca

SEQ ID NO: 930470 - DNA, 15 bp, Homo sapiens
cagggccctgggcag

SEQ ID NO: 930471 - DNA, 17 bp, Homo sapiens
cagggccctgggcaggg

SEQ ID NO: 930472 - DNA, 16 bp, Homo sapiens
cagggccgctcgatgc

SEQ ID NO: 930473 - DNA, 21 bp, Homo sapiens
cagggcctactgccacccgct

SEQ ID NO: 930474 - DNA, 14 bp, Homo sapiens
cagggcctccaggg

SEQ ID NO: 930475 - DNA, 22 bp, Homo sapiens
cagggcctccctgttcacggtg

SEQ ID NO: 930476 - DNA, 16 bp, Homo sapiens
cagggcctcctggggg

SEQ ID NO: 930477 - DNA, 21 bp, Homo sapiens
cagggcctcctgggggacctt

SEQ ID NO: 930478 - DNA, 20 bp, Homo sapiens
cagggcctctccaaccactg

SEQ ID NO: 930479 - DNA, 13 bp, Homo sapiens
cagggcctgactt

SEQ ID NO: 930480 - DNA, 18 bp, Homo sapiens
cagggcctgacttgagcc

SEQ ID NO: 930481 - DNA, 22 bp, Homo sapiens
cagggcctgacttgagccactc

SEQ ID NO: 930482 - DNA, 13 bp, Homo sapiens
cagggcctgcgga

SEQ ID NO: 930483 - DNA, 22 bp, Homo sapiens
cagggcctgcggaggcggtggc

SEQ ID NO: 930484 - DNA, 17 bp, Homo sapiens
cagggcctggagcccca

SEQ ID NO: 930485 - DNA, 14 bp, Homo sapiens
cagggcctggggcc

SEQ ID NO: 930486 - DNA, 18 bp, Homo sapiens
cagggcctggggcctgag

SEQ ID NO: 930487 - DNA, 21 bp, Homo sapiens
cagggcctggggcctgagaga

SEQ ID NO: 930488 - DNA, 19 bp, Homo sapiens
cagggcctgggggcagtga

SEQ ID NO: 930489 - DNA, 21 bp, Homo sapiens
cagggcctgggggcagtgact

SEQ ID NO: 930490 - DNA, 23 bp, Homo sapiens
cagggcctgggggcagtgactgg

SEQ ID NO: 930491 - DNA, 14 bp, Homo sapiens
cagggcctgtctcc

SEQ ID NO: 930492 - DNA, 19 bp, Homo sapiens
cagggcctttctcctcccc

SEQ ID NO: 930493 - DNA, 21 bp, Homo sapiens
cagggcctttctcctccccac

SEQ ID NO: 930494 - DNA, 22 bp, Homo sapiens
cagggcctttctcctccccacc

SEQ ID NO: 930495 - DNA, 13 bp, Homo sapiens
cagggcgagactc

SEQ ID NO: 930496 - DNA, 16 bp, Homo sapiens
cagggcgctgggaagg

SEQ ID NO: 930497 - DNA, 22 bp, Homo sapiens
cagggcggccagggacccaaag

SEQ ID NO: 930498 - DNA, 19 bp, Homo sapiens
cagggcgggcagagggctg

SEQ ID NO: 930499 - DNA, 20 bp, Homo sapiens
cagggcgggcagagggctgg

SEQ ID NO: 930500 - DNA, 14 bp, Homo sapiens
cagggctaccctga

SEQ ID NO: 930501 - DNA, 22 bp, Homo sapiens
cagggctaccctgagctgaggc

SEQ ID NO: 930502 - DNA, 23 bp, Homo sapiens
cagggctaccctgagctgaggca

SEQ ID NO: 930503 - DNA, 20 bp, Homo sapiens
cagggctagtgaagtggcct

SEQ ID NO: 930504 - DNA, 14 bp, Homo sapiens
cagggctagtgact

SEQ ID NO: 930505 - DNA, 15 bp, Homo sapiens
cagggctagtgactt

SEQ ID NO: 930506 - DNA, 21 bp, Homo sapiens
cagggctcacactcctgggct

SEQ ID NO: 930507 - DNA, 15 bp, Homo sapiens
cagggctcacagggc

SEQ ID NO: 930508 - DNA, 14 bp, Homo sapiens
cagggctcagagtg

SEQ ID NO: 930509 - DNA, 21 bp, Homo sapiens
cagggctcagagtgaccctca

SEQ ID NO: 930510 - DNA, 22 bp, Homo sapiens
cagggctcagagtgaccctcag

SEQ ID NO: 930511 - DNA, 12 bp, Homo sapiens
cagggctcagcc

SEQ ID NO: 930512 - DNA, 13 bp, Homo sapiens
cagggctcagcct

SEQ ID NO: 930513 - DNA, 16 bp, Homo sapiens
cagggctcagcctggt

SEQ ID NO: 930514 - DNA, 18 bp, Homo sapiens
cagggctcagtcttttga

SEQ ID NO: 930515 - DNA, 13 bp, Homo sapiens
cagggctccagcc

SEQ ID NO: 930516 - DNA, 14 bp, Homo sapiens
cagggctccctcct

SEQ ID NO: 930517 - DNA, 16 bp, Homo sapiens
cagggctccctcctgg

SEQ ID NO: 930518 - DNA, 18 bp, Homo sapiens
cagggctccctcctggag

SEQ ID NO: 930519 - DNA, 23 bp, Homo sapiens
cagggctccctcctggagcatcc

SEQ ID NO: 930520 - DNA, 16 bp, Homo sapiens
cagggctcctcccagc

SEQ ID NO: 930521 - DNA, 20 bp, Homo sapiens
cagggctcctcccagcttgt

SEQ ID NO: 930522 - DNA, 12 bp, Homo sapiens
cagggctcctgg

SEQ ID NO: 930523 - DNA, 18 bp, Homo sapiens
cagggctctgcaggccac

SEQ ID NO: 930524 - DNA, 16 bp, Homo sapiens
cagggctctgccccag

SEQ ID NO: 930525 - DNA, 17 bp, Homo sapiens
cagggctctgccccagt

SEQ ID NO: 930526 - DNA, 18 bp, Homo sapiens
cagggctctttgatggac

SEQ ID NO: 930527 - DNA, 17 bp, Homo sapiens
cagggctgagcgtggaa

SEQ ID NO: 930528 - DNA, 16 bp, Homo sapiens
cagggctgccctgaga

SEQ ID NO: 930529 - DNA, 22 bp, Homo sapiens
cagggctgccctgagaagctgc

SEQ ID NO: 930530 - DNA, 18 bp, Homo sapiens
cagggctggaatgggaga

SEQ ID NO: 930531 - DNA, 13 bp, Homo sapiens
cagggctggagaa

SEQ ID NO: 930532 - DNA, 16 bp, Homo sapiens
cagggctggagcctgg

SEQ ID NO: 930533 - DNA, 19 bp, Homo sapiens
cagggctggagcctggggt

SEQ ID NO: 930534 - DNA, 14 bp, Homo sapiens
cagggctggatgga

SEQ ID NO: 930535 - DNA, 21 bp, Homo sapiens
cagggctggatggacagacac

SEQ ID NO: 930536 - DNA, 21 bp, Homo sapiens
cagggctggcacgtgacaggc

SEQ ID NO: 930537 - DNA, 18 bp, Homo sapiens
cagggctggctcctgatc

SEQ ID NO: 930538 - DNA, 16 bp, Homo sapiens
cagggctgggaggaag

SEQ ID NO: 930539 - DNA, 16 bp, Homo sapiens
cagggctgggcctgcg

SEQ ID NO: 930540 - DNA, 20 bp, Homo sapiens
cagggctggggtgagcctga

SEQ ID NO: 930541 - DNA, 20 bp, Homo sapiens
cagggctgttggaggacccc

SEQ ID NO: 930542 - DNA, 18 bp, Homo sapiens
cagggcttacctgtacac

SEQ ID NO: 930543 - DNA, 21 bp, Homo sapiens
cagggcttacctgtacactga

SEQ ID NO: 930544 - DNA, 17 bp, Homo sapiens
cagggcttccccatcag

SEQ ID NO: 930545 - DNA, 20 bp, Homo sapiens
cagggcttccccatcagctc

SEQ ID NO: 930546 - DNA, 21 bp, Homo sapiens
cagggcttccccatcagctcc

SEQ ID NO: 930547 - DNA, 16 bp, Homo sapiens
cagggcttgctcctgc

SEQ ID NO: 930548 - DNA, 22 bp, Homo sapiens
cagggctttactccgtaacaga

SEQ ID NO: 930549 - DNA, 20 bp, Homo sapiens
caggggaaaatcagcctgct

SEQ ID NO: 930550 - DNA, 14 bp, Homo sapiens
caggggaaaatgaa

SEQ ID NO: 930551 - DNA, 16 bp, Homo sapiens
caggggaacctgccat

SEQ ID NO: 930552 - DNA, 15 bp, Homo sapiens
caggggaagagaaga

SEQ ID NO: 930553 - DNA, 15 bp, Homo sapiens
caggggaagccagtg

SEQ ID NO: 930554 - DNA, 16 bp, Homo sapiens
caggggaagccagtga

SEQ ID NO: 930555 - DNA, 20 bp, Homo sapiens
caggggaagccagtgacact

SEQ ID NO: 930556 - DNA, 22 bp, Homo sapiens
caggggaagccagtgacactaa

SEQ ID NO: 930557 - DNA, 11 bp, Homo sapiens
caggggaaggg

SEQ ID NO: 930558 - DNA, 12 bp, Homo sapiens
caggggaagggc

SEQ ID NO: 930559 - DNA, 13 bp, Homo sapiens
caggggaagggca

SEQ ID NO: 930560 - DNA, 15 bp, Homo sapiens
caggggaagggcagg

SEQ ID NO: 930561 - DNA, 18 bp, Homo sapiens
caggggaagggcaggcac

SEQ ID NO: 930562 - DNA, 17 bp, Homo sapiens
caggggaattccctccc

SEQ ID NO: 930563 - DNA, 23 bp, Homo sapiens
caggggaattccctccccctcct

SEQ ID NO: 930564 - DNA, 22 bp, Homo sapiens
caggggacactggccccacagg

SEQ ID NO: 930565 - DNA, 13 bp, Homo sapiens
caggggaccccac

SEQ ID NO: 930566 - DNA, 18 bp, Homo sapiens
caggggacgtgggccctg

SEQ ID NO: 930567 - DNA, 23 bp, Homo sapiens
caggggactcagccctgaggtga

SEQ ID NO: 930568 - DNA, 18 bp, Homo sapiens
caggggagaatgcagccc

SEQ ID NO: 930569 - DNA, 22 bp, Homo sapiens
caggggagaatgcagcccacca

SEQ ID NO: 930570 - DNA, 17 bp, Homo sapiens
caggggagacaggagcc

SEQ ID NO: 930571 - DNA, 16 bp, Homo sapiens
caggggagatggggag

SEQ ID NO: 930572 - DNA, 16 bp, Homo sapiens
ctgctacatcagactc

SEQ ID NO: 930573 - DNA, 21 bp, Homo sapiens
ctgctacattataatgtacag

SEQ ID NO: 930574 - DNA, 22 bp, Homo sapiens
ctgctacattataatgtacaga

SEQ ID NO: 930575 - DNA, 17 bp, Homo sapiens
ctgctaccgccctgggc

SEQ ID NO: 930576 - DNA, 15 bp, Homo sapiens
ctgctacctcactgg

SEQ ID NO: 930577 - DNA, 17 bp, Homo sapiens
ctgctacctcactgggg

SEQ ID NO: 930578 - DNA, 18 bp, Homo sapiens
ctgctacctcccttgcct

SEQ ID NO: 930579 - DNA, 16 bp, Homo sapiens
ctgctactacccgagc

SEQ ID NO: 930580 - DNA, 19 bp, Homo sapiens
ctgctactacccgagccca

SEQ ID NO: 930581 - DNA, 21 bp, Homo sapiens
ctgctactacccgagcccagc

SEQ ID NO: 930582 - DNA, 22 bp, Homo sapiens
ctgctactacccgagcccagct

SEQ ID NO: 930583 - DNA, 12 bp, Homo sapiens
ctgctactgccc

SEQ ID NO: 930584 - DNA, 19 bp, Homo sapiens
ctgctactgcccctctccg

SEQ ID NO: 930585 - DNA, 19 bp, Homo sapiens
ctgctacttaaatttgaat

SEQ ID NO: 930586 - DNA, 13 bp, Homo sapiens
ctgctagaaagtt

SEQ ID NO: 930587 - DNA, 15 bp, Homo sapiens
ctgctagaacatggt

SEQ ID NO: 930588 - DNA, 16 bp, Homo sapiens
ctgctagagcaacccc

SEQ ID NO: 930589 - DNA, 21 bp, Homo sapiens
ctgctagagcagacaggcctg

SEQ ID NO: 930590 - DNA, 14 bp, Homo sapiens
ctgctagattttaa

SEQ ID NO: 930591 - DNA, 20 bp, Homo sapiens
ctgctagattttaatttatt

SEQ ID NO: 930592 - DNA, 14 bp, Homo sapiens
ctgctagcacttgg

SEQ ID NO: 930593 - DNA, 21 bp, Homo sapiens
ctgctagcacttggagccaag

SEQ ID NO: 930594 - DNA, 14 bp, Homo sapiens
ctgctagcaggccc

SEQ ID NO: 930595 - DNA, 15 bp, Homo sapiens
ctgctagcaggcccc

SEQ ID NO: 930596 - DNA, 16 bp, Homo sapiens
ctgctagcaggccccc

SEQ ID NO: 930597 - DNA, 14 bp, Homo sapiens
ctgctaggccagag

SEQ ID NO: 930598 - DNA, 20 bp, Homo sapiens
ctgctaggcgagtgccagga

SEQ ID NO: 930599 - DNA, 20 bp, Homo sapiens
ctgctaggtgggccagcccc

SEQ ID NO: 930600 - DNA, 21 bp, Homo sapiens
ctgctaggtgggccagcccct

SEQ ID NO: 930601 - DNA, 21 bp, Homo sapiens
ctgctataaataggtttatat

SEQ ID NO: 930602 - DNA, 15 bp, Homo sapiens
ctgctatagcctggg

SEQ ID NO: 930603 - DNA, 17 bp, Homo sapiens
ctgctatcaaagaggtt

SEQ ID NO: 930604 - DNA, 23 bp, Homo sapiens
ctgctatccccatctccctgcct

SEQ ID NO: 930605 - DNA, 15 bp, Homo sapiens
ctgctatgacagctg

SEQ ID NO: 930606 - DNA, 16 bp, Homo sapiens
ctgctatgacagctgg

SEQ ID NO: 930607 - DNA, 17 bp, Homo sapiens
ctgctatgacagctggc

SEQ ID NO: 930608 - DNA, 16 bp, Homo sapiens
ctgctatgcattttct

SEQ ID NO: 930609 - DNA, 19 bp, Homo sapiens
ctgctatgcattttcttca

SEQ ID NO: 930610 - DNA, 17 bp, Homo sapiens
ctgctattatgtaacat

SEQ ID NO: 930611 - DNA, 17 bp, Homo sapiens
ctgctatttattttcct

SEQ ID NO: 930612 - DNA, 21 bp, Homo sapiens
ctgctcaactctacccctgct

SEQ ID NO: 930613 - DNA, 22 bp, Homo sapiens
ctgctcaactctacccctgctc

SEQ ID NO: 930614 - DNA, 17 bp, Homo sapiens
ctgctcaaggaccaaga

SEQ ID NO: 930615 - DNA, 19 bp, Homo sapiens
ctgctcaaggaccaagagc

SEQ ID NO: 930616 - DNA, 18 bp, Homo sapiens
ctgctcacaggcaggctt

SEQ ID NO: 930617 - DNA, 20 bp, Homo sapiens
ctgctcaccgcccatcaggg

SEQ ID NO: 930618 - DNA, 14 bp, Homo sapiens
ctgctcactgtcca

SEQ ID NO: 930619 - DNA, 19 bp, Homo sapiens
ctgctcagaacttgctgct

SEQ ID NO: 930620 - DNA, 22 bp, Homo sapiens
ctgctcagagctttaaaagtat

SEQ ID NO: 930621 - DNA, 18 bp, Homo sapiens
ctgctcagcaacctttca

SEQ ID NO: 930622 - DNA, 13 bp, Homo sapiens
ctgctcagcagcc

SEQ ID NO: 930623 - DNA, 20 bp, Homo sapiens
ctgctcagcagccagtctca

SEQ ID NO: 930624 - DNA, 15 bp, Homo sapiens
ctgctcagctctggt

SEQ ID NO: 930625 - DNA, 14 bp, Homo sapiens
ctgctcaggcctcc

SEQ ID NO: 930626 - DNA, 15 bp, Homo sapiens
ctgctcaggcctccc

SEQ ID NO: 930627 - DNA, 18 bp, Homo sapiens
ctgctcaggctgcagctg

SEQ ID NO: 930628 - DNA, 22 bp, Homo sapiens
ctgctcaggctgcagctggaca

SEQ ID NO: 930629 - DNA, 13 bp, Homo sapiens
ctgctcaggtgct

SEQ ID NO: 930630 - DNA, 18 bp, Homo sapiens
ctgctcagtaaagcactt

SEQ ID NO: 930631 - DNA, 18 bp, Homo sapiens
ctgctcagtgcttgggct

SEQ ID NO: 930632 - DNA, 19 bp, Homo sapiens
ctgctcagtgcttgggctc

SEQ ID NO: 930633 - DNA, 15 bp, Homo sapiens
ctgctcatattgtga

SEQ ID NO: 930634 - DNA, 19 bp, Homo sapiens
ctgctcatattgtgattct

SEQ ID NO: 930635 - DNA, 17 bp, Homo sapiens
ctgctcatccaaagttg

SEQ ID NO: 930636 - DNA, 13 bp, Homo sapiens
ctgctcatccact

SEQ ID NO: 930637 - DNA, 20 bp, Homo sapiens
ctgctcattaaactgattcc

SEQ ID NO: 930638 - DNA, 19 bp, Homo sapiens
ctgctcattactacactgg

SEQ ID NO: 930639 - DNA, 13 bp, Homo sapiens
ctgctccaaattt

SEQ ID NO: 930640 - DNA, 23 bp, Homo sapiens
ctgctccaacccccgccacctca

SEQ ID NO: 930641 - DNA, 16 bp, Homo sapiens
ctgctccaagggacag

SEQ ID NO: 930642 - DNA, 18 bp, Homo sapiens
ctgctccaagggacaggt

SEQ ID NO: 930643 - DNA, 22 bp, Homo sapiens
ctgctccaagggacaggtgggc

SEQ ID NO: 930644 - DNA, 16 bp, Homo sapiens
ctgctccaatttcccc

SEQ ID NO: 930645 - DNA, 11 bp, Homo sapiens
ctgctccacca

SEQ ID NO: 930646 - DNA, 13 bp, Homo sapiens
ctgctccaccaca

SEQ ID NO: 930647 - DNA, 22 bp, Homo sapiens
ctgctccaccagcagcatggca

SEQ ID NO: 930648 - DNA, 11 bp, Homo sapiens
ctgctccaccc

SEQ ID NO: 930649 - DNA, 13 bp, Homo sapiens
ctgctccaccctt

SEQ ID NO: 930650 - DNA, 18 bp, Homo sapiens
ctgctccacccttggcct

SEQ ID NO: 930651 - DNA, 19 bp, Homo sapiens
ctgctccacccttggcctg

SEQ ID NO: 930652 - DNA, 18 bp, Homo sapiens
ctgctccacgaagcctta

SEQ ID NO: 930653 - DNA, 11 bp, Homo sapiens
ctgctccagaa

SEQ ID NO: 930654 - DNA, 15 bp, Homo sapiens
ctgctccagaagatg

SEQ ID NO: 930655 - DNA, 18 bp, Homo sapiens
ctgctccagaatttggaa

SEQ ID NO: 930656 - DNA, 12 bp, Homo sapiens
ctgctccagccc

SEQ ID NO: 930657 - DNA, 22 bp, Homo sapiens
ctgctccagcccctttgcctct

SEQ ID NO: 930658 - DNA, 19 bp, Homo sapiens
ctgctccagctgttcagct

SEQ ID NO: 930659 - DNA, 13 bp, Homo sapiens
ctgctccaggcct

SEQ ID NO: 930660 - DNA, 15 bp, Homo sapiens
ctgctccaggcctgc

SEQ ID NO: 930661 - DNA, 19 bp, Homo sapiens
ctgctccaggcctgcagca

SEQ ID NO: 930662 - DNA, 19 bp, Homo sapiens
ctgctccatgactggctgt

SEQ ID NO: 930663 - DNA, 12 bp, Homo sapiens
ctgctcccaccc

SEQ ID NO: 930664 - DNA, 15 bp, Homo sapiens
ctgctcccaccccag

SEQ ID NO: 930665 - DNA, 15 bp, Homo sapiens
ctgctcccagcagcc

SEQ ID NO: 930666 - DNA, 15 bp, Homo sapiens
ctgctcccagcctgc

SEQ ID NO: 930667 - DNA, 20 bp, Homo sapiens
ctgctcccagcctgctgaga

SEQ ID NO: 930668 - DNA, 14 bp, Homo sapiens
ctgctcccatcctc

SEQ ID NO: 930669 - DNA, 19 bp, Homo sapiens
ctgctcccatcctcaccca

SEQ ID NO: 930670 - DNA, 17 bp, Homo sapiens
ctgctcccattcctccc

SEQ ID NO: 930671 - DNA, 18 bp, Homo sapiens
ctgctcccattcctccct

SEQ ID NO: 930672 - DNA, 22 bp, Homo sapiens
ctgctccccaacacctgcctct

SEQ ID NO: 930673 - DNA, 20 bp, Homo sapiens
ctgctccccacccctaccga

SEQ ID NO: 930674 - DNA, 18 bp, Homo sapiens
ctgctccccagccctggc

SEQ ID NO: 930675 - DNA, 16 bp, Homo sapiens
ctgctccccaggggag

SEQ ID NO: 930676 - DNA, 14 bp, Homo sapiens
ctgctcccccaccc

SEQ ID NO: 930677 - DNA, 22 bp, Homo sapiens
ctgctcccccaccccctcccca

SEQ ID NO: 930678 - DNA, 23 bp, Homo sapiens
ctgctcccccaccccctccccag

SEQ ID NO: 930679 - DNA, 13 bp, Homo sapiens
ctgctcccctgcc

SEQ ID NO: 930680 - DNA, 17 bp, Homo sapiens
ctgctcccctgccacgc

SEQ ID NO: 930681 - DNA, 14 bp, Homo sapiens
ctgctcccctttgg

SEQ ID NO: 930682 - DNA, 15 bp, Homo sapiens
ctgctccctggcatt

SEQ ID NO: 930683 - DNA, 14 bp, Homo sapiens
ctgctccctggggt

SEQ ID NO: 930684 - DNA, 22 bp, Homo sapiens
ctgctccctggggttctctaca

SEQ ID NO: 930685 - DNA, 14 bp, Homo sapiens
ctgctccgccagga

SEQ ID NO: 930686 - DNA, 20 bp, Homo sapiens
ctgctccgtggactgcagtc

SEQ ID NO: 930687 - DNA, 13 bp, Homo sapiens
ctgctcctaaggg

SEQ ID NO: 930688 - DNA, 17 bp, Homo sapiens
ctgctcctacatccagc

SEQ ID NO: 930689 - DNA, 21 bp, Homo sapiens
ctgctcctacatccagctcct

SEQ ID NO: 930690 - DNA, 22 bp, Homo sapiens
ctgctcctagagggaggggcct

SEQ ID NO: 930691 - DNA, 14 bp, Homo sapiens
ctgctcctcactgg

SEQ ID NO: 930692 - DNA, 13 bp, Homo sapiens
ctgctcctcatgg

SEQ ID NO: 930693 - DNA, 15 bp, Homo sapiens
ctgctcctcatggga

SEQ ID NO: 930694 - DNA, 14 bp, Homo sapiens
ctgctcctccagcc

SEQ ID NO: 930695 - DNA, 15 bp, Homo sapiens
ctgctcctccagccc

SEQ ID NO: 930696 - DNA, 17 bp, Homo sapiens
ctgctcctccagccctt

SEQ ID NO: 930697 - DNA, 13 bp, Homo sapiens
caggggagcaagc

SEQ ID NO: 930698 - DNA, 16 bp, Homo sapiens
caggggagccagctgc

SEQ ID NO: 930699 - DNA, 18 bp, Homo sapiens
caggggagccagctgctt

SEQ ID NO: 930700 - DNA, 18 bp, Homo sapiens
caggggagccagggtaga

SEQ ID NO: 930701 - DNA, 19 bp, Homo sapiens
caggggagccagggtagag

SEQ ID NO: 930702 - DNA, 18 bp, Homo sapiens
caggggagcttgggactc

SEQ ID NO: 930703 - DNA, 21 bp, Homo sapiens
caggggagcttgggactcagg

SEQ ID NO: 930704 - DNA, 14 bp, Homo sapiens
caggggaggaaaaa

SEQ ID NO: 930705 - DNA, 18 bp, Homo sapiens
caggggagtcccgtcagg

SEQ ID NO: 930706 - DNA, 16 bp, Homo sapiens
caggggatgcccagaa

SEQ ID NO: 930707 - DNA, 18 bp, Homo sapiens
caggggatgtttacctgg

SEQ ID NO: 930708 - DNA, 13 bp, Homo sapiens
caggggcagcaag

SEQ ID NO: 930709 - DNA, 14 bp, Homo sapiens
caggggcagcaagg

SEQ ID NO: 930710 - DNA, 16 bp, Homo sapiens
caggggcagcaaggcc

SEQ ID NO: 930711 - DNA, 17 bp, Homo sapiens
caggggcagcaaggcct

SEQ ID NO: 930712 - DNA, 20 bp, Homo sapiens
caggggcagcaaggccttgg

SEQ ID NO: 930713 - DNA, 12 bp, Homo sapiens
caggggcaggcc

SEQ ID NO: 930714 - DNA, 13 bp, Homo sapiens
caggggcaggcct

SEQ ID NO: 930715 - DNA, 17 bp, Homo sapiens
caggggcaggcctggga

SEQ ID NO: 930716 - DNA, 11 bp, Homo sapiens
caggggcaggt

SEQ ID NO: 930717 - DNA, 13 bp, Homo sapiens
caggggcaggtgg

SEQ ID NO: 930718 - DNA, 23 bp, Homo sapiens
caggggcaggtggtggaggggcg

SEQ ID NO: 930719 - DNA, 20 bp, Homo sapiens
caggggcagttttagcagca

SEQ ID NO: 930720 - DNA, 21 bp, Homo sapiens
caggggcagttttagcagcac

SEQ ID NO: 930721 - DNA, 20 bp, Homo sapiens
caggggcatgtattggcctg

SEQ ID NO: 930722 - DNA, 22 bp, Homo sapiens
caggggcatgtattggcctgga

SEQ ID NO: 930723 - DNA, 17 bp, Homo sapiens
caggggccagagagcag

SEQ ID NO: 930724 - DNA, 15 bp, Homo sapiens
caggggccagaggaa

SEQ ID NO: 930725 - DNA, 11 bp, Homo sapiens
caggggccatg

SEQ ID NO: 930726 - DNA, 14 bp, Homo sapiens
caggggccatgccc

SEQ ID NO: 930727 - DNA, 17 bp, Homo sapiens
caggggccatgccccac

SEQ ID NO: 930728 - DNA, 16 bp, Homo sapiens
caggggcccacaggga

SEQ ID NO: 930729 - DNA, 15 bp, Homo sapiens
caggggccccagatc

SEQ ID NO: 930730 - DNA, 22 bp, Homo sapiens
caggggccccagatctgcctgg

SEQ ID NO: 930731 - DNA, 16 bp, Homo sapiens
caggggccctgagcca

SEQ ID NO: 930732 - DNA, 17 bp, Homo sapiens
caggggccctgagccaa

SEQ ID NO: 930733 - DNA, 17 bp, Homo sapiens
caggggcccttgggaca

SEQ ID NO: 930734 - DNA, 22 bp, Homo sapiens
caggggcccttgggacagccag

SEQ ID NO: 930735 - DNA, 14 bp, Homo sapiens
caggggcctggaga

SEQ ID NO: 930736 - DNA, 15 bp, Homo sapiens
caggggcctggagat

SEQ ID NO: 930737 - DNA, 23 bp, Homo sapiens
caggggcctggagatcctcctgc

SEQ ID NO: 930738 - DNA, 16 bp, Homo sapiens
caggggcctggaggaa

SEQ ID NO: 930739 - DNA, 15 bp, Homo sapiens
caggggcctgggccg

SEQ ID NO: 930740 - DNA, 14 bp, Homo sapiens
caggggctccagca

SEQ ID NO: 930741 - DNA, 13 bp, Homo sapiens
caggggctcccta

SEQ ID NO: 930742 - DNA, 17 bp, Homo sapiens
caggggctccctacatt

SEQ ID NO: 930743 - DNA, 15 bp, Homo sapiens
caggggctcctgggt

SEQ ID NO: 930744 - DNA, 17 bp, Homo sapiens
caggggctcctgggttg

SEQ ID NO: 930745 - DNA, 17 bp, Homo sapiens
caggggctctgagcccg

SEQ ID NO: 930746 - DNA, 13 bp, Homo sapiens
caggggctgcttc

SEQ ID NO: 930747 - DNA, 19 bp, Homo sapiens
caggggctgcttcctcctg

SEQ ID NO: 930748 - DNA, 13 bp, Homo sapiens
caggggctggccc

SEQ ID NO: 930749 - DNA, 21 bp, Homo sapiens
caggggctgggcatcccagct

SEQ ID NO: 930750 - DNA, 15 bp, Homo sapiens
caggggctgtttgag

SEQ ID NO: 930751 - DNA, 15 bp, Homo sapiens
caggggcttgagaag

SEQ ID NO: 930752 - DNA, 16 bp, Homo sapiens
caggggctttgggccc

SEQ ID NO: 930753 - DNA, 21 bp, Homo sapiens
caggggctttgggcccaagaa

SEQ ID NO: 930754 - DNA, 21 bp, Homo sapiens
cagggggaagaagcagagaga

SEQ ID NO: 930755 - DNA, 16 bp, Homo sapiens
cagggggaaggcttgg

SEQ ID NO: 930756 - DNA, 19 bp, Homo sapiens
cagggggaaggtggggtcc

SEQ ID NO: 930757 - DNA, 16 bp, Homo sapiens
cagggggagaatgggt

SEQ ID NO: 930758 - DNA, 16 bp, Homo sapiens
cagggggagtctttgc

SEQ ID NO: 930759 - DNA, 11 bp, Homo sapiens
cagggggccag

SEQ ID NO: 930760 - DNA, 14 bp, Homo sapiens
cagggggccagctg

SEQ ID NO: 930761 - DNA, 20 bp, Homo sapiens
cagggggccccgccagggct

SEQ ID NO: 930762 - DNA, 22 bp, Homo sapiens
cagggggccccgccagggctgg

SEQ ID NO: 930763 - DNA, 17 bp, Homo sapiens
cagggggccctgcccca

SEQ ID NO: 930764 - DNA, 23 bp, Homo sapiens
cagggggccctgccccaccccat

SEQ ID NO: 930765 - DNA, 14 bp, Homo sapiens
caggggggctgtgc

SEQ ID NO: 930766 - DNA, 17 bp, Homo sapiens
caggggggctgtgccaa

SEQ ID NO: 930767 - DNA, 22 bp, Homo sapiens
caggggggctgtgccaacctgt

SEQ ID NO: 930768 - DNA, 21 bp, Homo sapiens
cagggggtaggagagcactgc

SEQ ID NO: 930769 - DNA, 23 bp, Homo sapiens
cagggggtaggagagcactgcct

SEQ ID NO: 930770 - DNA, 22 bp, Homo sapiens
cagggggtgggaaggggatgga

SEQ ID NO: 930771 - DNA, 17 bp, Homo sapiens
caggggtaacctggcca

SEQ ID NO: 930772 - DNA, 21 bp, Homo sapiens
caggggtcaggtgtcaggccc

SEQ ID NO: 930773 - DNA, 23 bp, Homo sapiens
caggggtcaggtgtcaggcccgt

SEQ ID NO: 930774 - DNA, 18 bp, Homo sapiens
caggggtccagcacagcc

SEQ ID NO: 930775 - DNA, 18 bp, Homo sapiens
caggggtcgtcaccacct

SEQ ID NO: 930776 - DNA, 21 bp, Homo sapiens
caggggtcgtcaccacctctc

SEQ ID NO: 930777 - DNA, 14 bp, Homo sapiens
caggggtctgtctg

SEQ ID NO: 930778 - DNA, 16 bp, Homo sapiens
caggggtgcacagtcc

SEQ ID NO: 930779 - DNA, 15 bp, Homo sapiens
caggggtgccccctc

SEQ ID NO: 930780 - DNA, 15 bp, Homo sapiens
caggggtgggagagc

SEQ ID NO: 930781 - DNA, 20 bp, Homo sapiens
caggggtgggggtggaggct

SEQ ID NO: 930782 - DNA, 22 bp, Homo sapiens
caggggtgggggtggaggcttc

SEQ ID NO: 930783 - DNA, 18 bp, Homo sapiens
caggggttagcctggact

SEQ ID NO: 930784 - DNA, 13 bp, Homo sapiens
caggggttcgaga

SEQ ID NO: 930785 - DNA, 19 bp, Homo sapiens
cagggtaccctttggggag

SEQ ID NO: 930786 - DNA, 22 bp, Homo sapiens
cagggtaccctttggggagcag

SEQ ID NO: 930787 - DNA, 22 bp, Homo sapiens
cagggtagatttctcttgggca

SEQ ID NO: 930788 - DNA, 15 bp, Homo sapiens
cagggtataaattat

SEQ ID NO: 930789 - DNA, 20 bp, Homo sapiens
cagggtattccagagtgggg

SEQ ID NO: 930790 - DNA, 21 bp, Homo sapiens
cagggtattccagagtgggga

SEQ ID NO: 930791 - DNA, 16 bp, Homo sapiens
cagggtcaaagacaga

SEQ ID NO: 930792 - DNA, 20 bp, Homo sapiens
cagggtcaaagacagaatgg

SEQ ID NO: 930793 - DNA, 14 bp, Homo sapiens
cagggtcaagcctc

SEQ ID NO: 930794 - DNA, 19 bp, Homo sapiens
cagggtcactgaaccactg

SEQ ID NO: 930795 - DNA, 16 bp, Homo sapiens
cagggtcactgtcctt

SEQ ID NO: 930796 - DNA, 18 bp, Homo sapiens
cagggtcactgtccttga

SEQ ID NO: 930797 - DNA, 14 bp, Homo sapiens
cagggtcaggagag

SEQ ID NO: 930798 - DNA, 18 bp, Homo sapiens
cagggtccaggagagcct

SEQ ID NO: 930799 - DNA, 20 bp, Homo sapiens
cagggtccaggagagcctgg

SEQ ID NO: 930800 - DNA, 14 bp, Homo sapiens
cagggtcccacccc

SEQ ID NO: 930801 - DNA, 17 bp, Homo sapiens
cagggtcccacccccaa

SEQ ID NO: 930802 - DNA, 17 bp, Homo sapiens
cagggtcccatttctca

SEQ ID NO: 930803 - DNA, 20 bp, Homo sapiens
cagggtccccgagtgcctag

SEQ ID NO: 930804 - DNA, 19 bp, Homo sapiens
cagggtcccctccccagct

SEQ ID NO: 930805 - DNA, 13 bp, Homo sapiens
cagggtccctctg

SEQ ID NO: 930806 - DNA, 15 bp, Homo sapiens
cagggtccctctgtg

SEQ ID NO: 930807 - DNA, 17 bp, Homo sapiens
cagggtccgcaccagct

SEQ ID NO: 930808 - DNA, 20 bp, Homo sapiens
cagggtccgcaccagctgct

SEQ ID NO: 930809 - DNA, 23 bp, Homo sapiens
cagggtcctctagcccactccct

SEQ ID NO: 930810 - DNA, 20 bp, Homo sapiens
cagggtcctcttctgggcct

SEQ ID NO: 930811 - DNA, 20 bp, Homo sapiens
cagggtcctgccctccggag

SEQ ID NO: 930812 - DNA, 13 bp, Homo sapiens
cagggtcctgtgc

SEQ ID NO: 930813 - DNA, 22 bp, Homo sapiens
cagggtccttttgacactgctc

SEQ ID NO: 930814 - DNA, 23 bp, Homo sapiens
cagggtccttttgacactgctct

SEQ ID NO: 930815 - DNA, 24 bp, Homo sapiens
cagggtctaaggagcgctagtgcc

SEQ ID NO: 930816 - DNA, 12 bp, Homo sapiens
cagggtctcact

SEQ ID NO: 930817 - DNA, 21 bp, Homo sapiens
cagggtctctaccatcccctg

SEQ ID NO: 930818 - DNA, 20 bp, Homo sapiens
cagggtctctagtgctgtga

SEQ ID NO: 930819 - DNA, 22 bp, Homo sapiens
cagggtctctagtgctgtgaaa

SEQ ID NO: 930820 - DNA, 16 bp, Homo sapiens
cagggtctctccctca

SEQ ID NO: 930821 - DNA, 14 bp, Homo sapiens
ctgctcctccaggg

SEQ ID NO: 930822 - DNA, 24 bp, Homo sapiens
ctgctcctccagggccacgtgcca

SEQ ID NO: 930823 - DNA, 12 bp, Homo sapiens
ctgctcctccct

SEQ ID NO: 930824 - DNA, 14 bp, Homo sapiens
ctgctcctccctgc

SEQ ID NO: 930825 - DNA, 19 bp, Homo sapiens
ctgctcctccctgcccccc

SEQ ID NO: 930826 - DNA, 15 bp, Homo sapiens
ctgctcctccctggc

SEQ ID NO: 930827 - DNA, 18 bp, Homo sapiens
ctgctcctccctggctgc

SEQ ID NO: 930828 - DNA, 14 bp, Homo sapiens
ctgctcctctccag

SEQ ID NO: 930829 - DNA, 16 bp, Homo sapiens
ctgctcctctccaggc

SEQ ID NO: 930830 - DNA, 15 bp, Homo sapiens
ctgctcctctttccc

SEQ ID NO: 930831 - DNA, 13 bp, Homo sapiens
ctgctcctgcagc

SEQ ID NO: 930832 - DNA, 14 bp, Homo sapiens
ctgctcctgcagca

SEQ ID NO: 930833 - DNA, 16 bp, Homo sapiens
ctgctcctgcagcatg

SEQ ID NO: 930834 - DNA, 14 bp, Homo sapiens
ctgctcctgctttt

SEQ ID NO: 930835 - DNA, 15 bp, Homo sapiens
ctgctcctggagcct

SEQ ID NO: 930836 - DNA, 19 bp, Homo sapiens
ctgctcctggagcctttga

SEQ ID NO: 930837 - DNA, 20 bp, Homo sapiens
ctgctcctggagcctttgaa

SEQ ID NO: 930838 - DNA, 22 bp, Homo sapiens
ctgctcctgtacttgtcctcag

SEQ ID NO: 930839 - DNA, 19 bp, Homo sapiens
ctgctcctgtggcaggagg

SEQ ID NO: 930840 - DNA, 20 bp, Homo sapiens
ctgctcctgtttgtctgatg

SEQ ID NO: 930841 - DNA, 21 bp, Homo sapiens
ctgctccttcactgttccctc

SEQ ID NO: 930842 - DNA, 22 bp, Homo sapiens
ctgctccttcactgttccctct

SEQ ID NO: 930843 - DNA, 19 bp, Homo sapiens
ctgctccttggcaccccca

SEQ ID NO: 930844 - DNA, 19 bp, Homo sapiens
ctgctccttggcttacctg

SEQ ID NO: 930845 - DNA, 23 bp, Homo sapiens
ctgctccttttgtatcttccttt

SEQ ID NO: 930846 - DNA, 18 bp, Homo sapiens
ctgctcgccctcctttct

SEQ ID NO: 930847 - DNA, 18 bp, Homo sapiens
ctgctcggcttcttggac

SEQ ID NO: 930848 - DNA, 14 bp, Homo sapiens
ctgctctagccagg

SEQ ID NO: 930849 - DNA, 23 bp, Homo sapiens
ctgctctagccaggagtctgtgc

SEQ ID NO: 930850 - DNA, 16 bp, Homo sapiens
ctgctctagctggcag

SEQ ID NO: 930851 - DNA, 14 bp, Homo sapiens
ctgctctcctcttg

SEQ ID NO: 930852 - DNA, 18 bp, Homo sapiens
ctgctctctgctcatggg

SEQ ID NO: 930853 - DNA, 20 bp, Homo sapiens
ctgctctctgctcatgggtg

SEQ ID NO: 930854 - DNA, 16 bp, Homo sapiens
ctgctctgagccacag

SEQ ID NO: 930855 - DNA, 13 bp, Homo sapiens
ctgctctgaggct

SEQ ID NO: 930856 - DNA, 20 bp, Homo sapiens
ctgctctgcaggctggggag

SEQ ID NO: 930857 - DNA, 12 bp, Homo sapiens
ctgctctgccat

SEQ ID NO: 930858 - DNA, 19 bp, Homo sapiens
ctgctctgccatcttcagg

SEQ ID NO: 930859 - DNA, 21 bp, Homo sapiens
ctgctctgcgtgtcacctgtg

SEQ ID NO: 930860 - DNA, 13 bp, Homo sapiens
ctgctctggtccc

SEQ ID NO: 930861 - DNA, 23 bp, Homo sapiens
ctgctctggtgcacgcctgagcg

SEQ ID NO: 930862 - DNA, 21 bp, Homo sapiens
ctgctctggtggcttaagtga

SEQ ID NO: 930863 - DNA, 22 bp, Homo sapiens
ctgctctgtccagaggctttaa

SEQ ID NO: 930864 - DNA, 17 bp, Homo sapiens
ctgctcttagtgcccgc

SEQ ID NO: 930865 - DNA, 13 bp, Homo sapiens
ctgctcttgaaca

SEQ ID NO: 930866 - DNA, 15 bp, Homo sapiens
ctgctcttgaacatt

SEQ ID NO: 930867 - DNA, 18 bp, Homo sapiens
ctgctcttgtttcactcc

SEQ ID NO: 930868 - DNA, 20 bp, Homo sapiens
ctgctcttgtttcactccac

SEQ ID NO: 930869 - DNA, 14 bp, Homo sapiens
ctgctcttgtttct

SEQ ID NO: 930870 - DNA, 16 bp, Homo sapiens
ctgctctttattgcag

SEQ ID NO: 930871 - DNA, 21 bp, Homo sapiens
ctgctctttattgcagaatgt

SEQ ID NO: 930872 - DNA, 18 bp, Homo sapiens
ctgctctttctctgccag

SEQ ID NO: 930873 - DNA, 20 bp, Homo sapiens
ctgctctttctctgccagtg

SEQ ID NO: 930874 - DNA, 17 bp, Homo sapiens
ctgctgaaagtcctgct

SEQ ID NO: 930875 - DNA, 18 bp, Homo sapiens
ctgctgaacacagtgtct

SEQ ID NO: 930876 - DNA, 21 bp, Homo sapiens
ctgctgaagccagttgcttct

SEQ ID NO: 930877 - DNA, 18 bp, Homo sapiens
ctgctgaaggaataaatt

SEQ ID NO: 930878 - DNA, 16 bp, Homo sapiens
ctgctgaataataaac

SEQ ID NO: 930879 - DNA, 22 bp, Homo sapiens
ctgctgaccaaatggccagttt

SEQ ID NO: 930880 - DNA, 20 bp, Homo sapiens
ctgctgaccaattgtgctgc

SEQ ID NO: 930881 - DNA, 13 bp, Homo sapiens
ctgctgacctgct

SEQ ID NO: 930882 - DNA, 15 bp, Homo sapiens
ctgctgacctgctga

SEQ ID NO: 930883 - DNA, 23 bp, Homo sapiens
ctgctgaccttggaggaatgaca

SEQ ID NO: 930884 - DNA, 24 bp, Homo sapiens
ctgctgaccttggaggaatgacaa

SEQ ID NO: 930885 - DNA, 18 bp, Homo sapiens
ctgctgactgttttctct

SEQ ID NO: 930886 - DNA, 13 bp, Homo sapiens
ctgctgagccact

SEQ ID NO: 930887 - DNA, 14 bp, Homo sapiens
ctgctgagccactc

SEQ ID NO: 930888 - DNA, 17 bp, Homo sapiens
ctgctgagccactcgca

SEQ ID NO: 930889 - DNA, 13 bp, Homo sapiens
ctgctgagctggc

SEQ ID NO: 930890 - DNA, 20 bp, Homo sapiens
ctgctgagctgggcccagcc

SEQ ID NO: 930891 - DNA, 15 bp, Homo sapiens
ctgctgaggcccagt

SEQ ID NO: 930892 - DNA, 19 bp, Homo sapiens
ctgctgaggcccagtgcat

SEQ ID NO: 930893 - DNA, 13 bp, Homo sapiens
ctgctgaggcctt

SEQ ID NO: 930894 - DNA, 14 bp, Homo sapiens
ctgctgaggccttc

SEQ ID NO: 930895 - DNA, 16 bp, Homo sapiens
ctgctgaggtcccggg

SEQ ID NO: 930896 - DNA, 17 bp, Homo sapiens
ctgctgaggtcccgggc

SEQ ID NO: 930897 - DNA, 13 bp, Homo sapiens
ctgctgagtaagg

SEQ ID NO: 930898 - DNA, 23 bp, Homo sapiens
ctgctgagtcccaggctgagcct

SEQ ID NO: 930899 - DNA, 18 bp, Homo sapiens
ctgctgagtgctgggcac

SEQ ID NO: 930900 - DNA, 19 bp, Homo sapiens
ctgctgagtgctgggcact

SEQ ID NO: 930901 - DNA, 13 bp, Homo sapiens
ctgctgataaaat

SEQ ID NO: 930902 - DNA, 14 bp, Homo sapiens
ctgctgatattttc

SEQ ID NO: 930903 - DNA, 18 bp, Homo sapiens
ctgctgatattttctcta

SEQ ID NO: 930904 - DNA, 17 bp, Homo sapiens
ctgctgatgcgctggga

SEQ ID NO: 930905 - DNA, 14 bp, Homo sapiens
ctgctgattcttgt

SEQ ID NO: 930906 - DNA, 15 bp, Homo sapiens
ctgctgcaccagagt

SEQ ID NO: 930907 - DNA, 21 bp, Homo sapiens
ctgctgcaccagagtgaaagg

SEQ ID NO: 930908 - DNA, 13 bp, Homo sapiens
ctgctgcaccctg

SEQ ID NO: 930909 - DNA, 14 bp, Homo sapiens
ctgctgcaccctgc

SEQ ID NO: 930910 - DNA, 22 bp, Homo sapiens
ctgctgcaccctgcgcctccag

SEQ ID NO: 930911 - DNA, 19 bp, Homo sapiens
ctgctgcactaggacttgg

SEQ ID NO: 930912 - DNA, 11 bp, Homo sapiens
ctgctgcagtt

SEQ ID NO: 930913 - DNA, 14 bp, Homo sapiens
ctgctgccacagca

SEQ ID NO: 930914 - DNA, 15 bp, Homo sapiens
ctgctgccagggctt

SEQ ID NO: 930915 - DNA, 17 bp, Homo sapiens
ctgctgcccatgtttca

SEQ ID NO: 930916 - DNA, 14 bp, Homo sapiens
ctgctgccccagct

SEQ ID NO: 930917 - DNA, 22 bp, Homo sapiens
ctgctgccccagctgactgtgg

SEQ ID NO: 930918 - DNA, 14 bp, Homo sapiens
ctgctgcccccttc

SEQ ID NO: 930919 - DNA, 19 bp, Homo sapiens
ctgctgcccccttccccag

SEQ ID NO: 930920 - DNA, 14 bp, Homo sapiens
ctgctgccctccat

SEQ ID NO: 930921 - DNA, 20 bp, Homo sapiens
ctgctgccgcctcccagcct

SEQ ID NO: 930922 - DNA, 14 bp, Homo sapiens
ctgctgcctcccca

SEQ ID NO: 930923 - DNA, 15 bp, Homo sapiens
ctgctgcctccccaa

SEQ ID NO: 930924 - DNA, 14 bp, Homo sapiens
ctgctgcctctgtg

SEQ ID NO: 930925 - DNA, 15 bp, Homo sapiens
ctgctgcctctgtgg

SEQ ID NO: 930926 - DNA, 18 bp, Homo sapiens
ctgctgcctctgtggaag

SEQ ID NO: 930927 - DNA, 21 bp, Homo sapiens
ctgctgcctctgtggaagaga

SEQ ID NO: 930928 - DNA, 13 bp, Homo sapiens
ctgctgcctcttt

SEQ ID NO: 930929 - DNA, 17 bp, Homo sapiens
ctgctgcctctttccct

SEQ ID NO: 930930 - DNA, 22 bp, Homo sapiens
ctgctgcctctttccctaggaa

SEQ ID NO: 930931 - DNA, 14 bp, Homo sapiens
ctgctgcctggcca

SEQ ID NO: 930932 - DNA, 23 bp, Homo sapiens
ctgctgcctggccactgctccct

SEQ ID NO: 930933 - DNA, 14 bp, Homo sapiens
ctgctgccttgttt

SEQ ID NO: 930934 - DNA, 17 bp, Homo sapiens
ctgctgccttttctgga

SEQ ID NO: 930935 - DNA, 16 bp, Homo sapiens
ctgctgcgtcagacca

SEQ ID NO: 930936 - DNA, 20 bp, Homo sapiens
ctgctgcgtcagaccagtac

SEQ ID NO: 930937 - DNA, 17 bp, Homo sapiens
ctgctgcgtccccactc

SEQ ID NO: 930938 - DNA, 22 bp, Homo sapiens
ctgctgctactacccgagccca

SEQ ID NO: 930939 - DNA, 19 bp, Homo sapiens
ctgctgctccccaccccta

SEQ ID NO: 930940 - DNA, 12 bp, Homo sapiens
ctgctgctcctc

SEQ ID NO: 930941 - DNA, 11 bp, Homo sapiens
ctgctgctctc

SEQ ID NO: 930942 - DNA, 15 bp, Homo sapiens
ctgctgctctcaggc

SEQ ID NO: 930943 - DNA, 16 bp, Homo sapiens
ctgctgctctcaggcg

SEQ ID NO: 930944 - DNA, 19 bp, Homo sapiens
ctgctgctgccagggcttc

SEQ ID NO: 930945 - DNA, 14 bp, Homo sapiens
ctgctgctgcccgg

SEQ ID NO: 930946 - DNA, 20 bp, Homo sapiens
cagggtctgctctttctctg

SEQ ID NO: 930947 - DNA, 23 bp, Homo sapiens
cagggtctgctctttctctgcca

SEQ ID NO: 930948 - DNA, 19 bp, Homo sapiens
cagggtctggcagagcctc

SEQ ID NO: 930949 - DNA, 20 bp, Homo sapiens
cagggtctggcagagcctct

SEQ ID NO: 930950 - DNA, 16 bp, Homo sapiens
cagggtcttacctctc

SEQ ID NO: 930951 - DNA, 18 bp, Homo sapiens
cagggtcttacctctctg

SEQ ID NO: 930952 - DNA, 19 bp, Homo sapiens
cagggtcttacctctctgg

SEQ ID NO: 930953 - DNA, 14 bp, Homo sapiens
cagggtcttgctct

SEQ ID NO: 930954 - DNA, 15 bp, Homo sapiens
cagggtcttgctctg

SEQ ID NO: 930955 - DNA, 20 bp, Homo sapiens
cagggtcttgctctgtcccc

SEQ ID NO: 930956 - DNA, 13 bp, Homo sapiens
cagggtcttgggc

SEQ ID NO: 930957 - DNA, 14 bp, Homo sapiens
cagggtcttgggct

SEQ ID NO: 930958 - DNA, 21 bp, Homo sapiens
cagggtcttgggctactggca

SEQ ID NO: 930959 - DNA, 23 bp, Homo sapiens
cagggtcttgggctactggcagc

SEQ ID NO: 930960 - DNA, 23 bp, Homo sapiens
cagggtcttttcatctgggaaag

SEQ ID NO: 930961 - DNA, 21 bp, Homo sapiens
cagggtgacgcctgagacagc

SEQ ID NO: 930962 - DNA, 15 bp, Homo sapiens
cagggtgagagctgc

SEQ ID NO: 930963 - DNA, 19 bp, Homo sapiens
cagggtgagagtctgggtc

SEQ ID NO: 930964 - DNA, 23 bp, Homo sapiens
cagggtgcagcccaatctgccag

SEQ ID NO: 930965 - DNA, 15 bp, Homo sapiens
cagggtgcaggagag

SEQ ID NO: 930966 - DNA, 20 bp, Homo sapiens
cagggtgcagtatcatgccc

SEQ ID NO: 930967 - DNA, 22 bp, Homo sapiens
cagggtgcccagaacttccctg

SEQ ID NO: 930968 - DNA, 14 bp, Homo sapiens
cagggtggaccagg

SEQ ID NO: 930969 - DNA, 20 bp, Homo sapiens
cagggtggaccaggcctgga

SEQ ID NO: 930970 - DNA, 17 bp, Homo sapiens
cagggtgggagccggga

SEQ ID NO: 930971 - DNA, 20 bp, Homo sapiens
cagggtgggatggaggagaa

SEQ ID NO: 930972 - DNA, 15 bp, Homo sapiens
cagggtgggctgggg

SEQ ID NO: 930973 - DNA, 23 bp, Homo sapiens
cagggtgggctggggactctggc

SEQ ID NO: 930974 - DNA, 15 bp, Homo sapiens
cagggtggggaggga

SEQ ID NO: 930975 - DNA, 15 bp, Homo sapiens
cagggtggggggtga

SEQ ID NO: 930976 - DNA, 16 bp, Homo sapiens
cagggtggggggtgac

SEQ ID NO: 930977 - DNA, 18 bp, Homo sapiens
cagggtggggtctgggag

SEQ ID NO: 930978 - DNA, 20 bp, Homo sapiens
cagggtggtggtattctgtc

SEQ ID NO: 930979 - DNA, 17 bp, Homo sapiens
cagggtggttagaggaa

SEQ ID NO: 930980 - DNA, 18 bp, Homo sapiens
cagggtgtggccctgcca

SEQ ID NO: 930981 - DNA, 19 bp, Homo sapiens
cagggttaggaatctcttc

SEQ ID NO: 930982 - DNA, 18 bp, Homo sapiens
cagggttcccccagccct

SEQ ID NO: 930983 - DNA, 21 bp, Homo sapiens
cagggttgatcacactctggg

SEQ ID NO: 930984 - DNA, 15 bp, Homo sapiens
cagggttgggcccag

SEQ ID NO: 930985 - DNA, 16 bp, Homo sapiens
cagggttgggcccaga

SEQ ID NO: 930986 - DNA, 21 bp, Homo sapiens
cagggttgggcccagatctgg

SEQ ID NO: 930987 - DNA, 15 bp, Homo sapiens
cagggttggtgtgct

SEQ ID NO: 930988 - DNA, 18 bp, Homo sapiens
cagggttggtgtgctgag

SEQ ID NO: 930989 - DNA, 14 bp, Homo sapiens
cagggtttaataga

SEQ ID NO: 930990 - DNA, 16 bp, Homo sapiens
cagggtttaatagact

SEQ ID NO: 930991 - DNA, 19 bp, Homo sapiens
cagggtttacccagtggga

SEQ ID NO: 930992 - DNA, 22 bp, Homo sapiens
cagggtttctctgcagatgtgc

SEQ ID NO: 930993 - DNA, 21 bp, Homo sapiens
cagggtttggctgtgtctaaa

SEQ ID NO: 930994 - DNA, 22 bp, Homo sapiens
cagggtttggctgtgtctaaac

SEQ ID NO: 930995 - DNA, 15 bp, Homo sapiens
cagggttttgtattc

SEQ ID NO: 930996 - DNA, 15 bp, Homo sapiens
caggtaaaacagggc

SEQ ID NO: 930997 - DNA, 15 bp, Homo sapiens
caggtaaactcctgt

SEQ ID NO: 930998 - DNA, 22 bp, Homo sapiens
caggtaaagggcaaataatgat

SEQ ID NO: 930999 - DNA, 17 bp, Homo sapiens
caggtaaattaagacat

SEQ ID NO: 931000 - DNA, 14 bp, Homo sapiens
caggtaacactaca

SEQ ID NO: 931001 - DNA, 16 bp, Homo sapiens
caggtaagatgttaat

SEQ ID NO: 931002 - DNA, 22 bp, Homo sapiens
caggtaagatgttaatctccca

SEQ ID NO: 931003 - DNA, 18 bp, Homo sapiens
caggtaataaaagctttg

SEQ ID NO: 931004 - DNA, 15 bp, Homo sapiens
caggtaatacaaact

SEQ ID NO: 931005 - DNA, 18 bp, Homo sapiens
caggtaatatacctggtt

SEQ ID NO: 931006 - DNA, 17 bp, Homo sapiens
caggtaatgagggactg

SEQ ID NO: 931007 - DNA, 22 bp, Homo sapiens
caggtaatgagggactggaacc

SEQ ID NO: 931008 - DNA, 13 bp, Homo sapiens
caggtaatgtgaa

SEQ ID NO: 931009 - DNA, 19 bp, Homo sapiens
caggtaatgtgaataaatt

SEQ ID NO: 931010 - DNA, 12 bp, Homo sapiens
caggtacagcgg

SEQ ID NO: 931011 - DNA, 15 bp, Homo sapiens
caggtacaggagagg

SEQ ID NO: 931012 - DNA, 21 bp, Homo sapiens
caggtaccacccttcagaccc

SEQ ID NO: 931013 - DNA, 14 bp, Homo sapiens
caggtaccagctgc

SEQ ID NO: 931014 - DNA, 16 bp, Homo sapiens
caggtaccagctgcgc

SEQ ID NO: 931015 - DNA, 17 bp, Homo sapiens
caggtaccagctgcgct

SEQ ID NO: 931016 - DNA, 19 bp, Homo sapiens
caggtaccagctgcgcttg

SEQ ID NO: 931017 - DNA, 21 bp, Homo sapiens
caggtaccagctgcgcttgct

SEQ ID NO: 931018 - DNA, 21 bp, Homo sapiens
caggtacccttctcgcttttg

SEQ ID NO: 931019 - DNA, 16 bp, Homo sapiens
caggtacttcctcctg

SEQ ID NO: 931020 - DNA, 17 bp, Homo sapiens
caggtacttcctcctga

SEQ ID NO: 931021 - DNA, 21 bp, Homo sapiens
caggtacttcctcctgatggc

SEQ ID NO: 931022 - DNA, 22 bp, Homo sapiens
caggtacttcctcctgatggcc

SEQ ID NO: 931023 - DNA, 14 bp, Homo sapiens
caggtacttggagg

SEQ ID NO: 931024 - DNA, 18 bp, Homo sapiens
caggtagaccatattcta

SEQ ID NO: 931025 - DNA, 18 bp, Homo sapiens
caggtagatcgcttgagc

SEQ ID NO: 931026 - DNA, 20 bp, Homo sapiens
caggtagatcgcttgagccc

SEQ ID NO: 931027 - DNA, 23 bp, Homo sapiens
caggtagatcgcttgagcccagg

SEQ ID NO: 931028 - DNA, 21 bp, Homo sapiens
caggtagcacagattttgaat

SEQ ID NO: 931029 - DNA, 22 bp, Homo sapiens
caggtaggcccttgtcctgcca

SEQ ID NO: 931030 - DNA, 16 bp, Homo sapiens
caggtagtttgtacca

SEQ ID NO: 931031 - DNA, 15 bp, Homo sapiens
caggtatccaaaaat

SEQ ID NO: 931032 - DNA, 14 bp, Homo sapiens
caggtatctccagg

SEQ ID NO: 931033 - DNA, 18 bp, Homo sapiens
caggtatctccaggattg

SEQ ID NO: 931034 - DNA, 13 bp, Homo sapiens
caggtcaataaac

SEQ ID NO: 931035 - DNA, 21 bp, Homo sapiens
caggtcaataaacttagagga

SEQ ID NO: 931036 - DNA, 22 bp, Homo sapiens
caggtcaataaacttagaggaa

SEQ ID NO: 931037 - DNA, 23 bp, Homo sapiens
caggtcaataaacttagaggaaa

SEQ ID NO: 931038 - DNA, 12 bp, Homo sapiens
caggtcacagaa

SEQ ID NO: 931039 - DNA, 14 bp, Homo sapiens
caggtcaccaagca

SEQ ID NO: 931040 - DNA, 14 bp, Homo sapiens
caggtcaccatcct

SEQ ID NO: 931041 - DNA, 15 bp, Homo sapiens
caggtcaccatcctc

SEQ ID NO: 931042 - DNA, 16 bp, Homo sapiens
caggtcaccatcctca

SEQ ID NO: 931043 - DNA, 17 bp, Homo sapiens
caggtcaccatcctcag

SEQ ID NO: 931044 - DNA, 18 bp, Homo sapiens
caggtcaccatcctcaga

SEQ ID NO: 931045 - DNA, 22 bp, Homo sapiens
caggtcaccatcctcagaggct

SEQ ID NO: 931046 - DNA, 12 bp, Homo sapiens
caggtcactgtc

SEQ ID NO: 931047 - DNA, 13 bp, Homo sapiens
caggtcactgtca

SEQ ID NO: 931048 - DNA, 16 bp, Homo sapiens
caggtcactgtcactg

SEQ ID NO: 931049 - DNA, 18 bp, Homo sapiens
caggtcactgtcactgcc

SEQ ID NO: 931050 - DNA, 19 bp, Homo sapiens
caggtcactgtcactgccg

SEQ ID NO: 931051 - DNA, 14 bp, Homo sapiens
caggtcagccctgt

SEQ ID NO: 931052 - DNA, 12 bp, Homo sapiens
caggtcagctgg

SEQ ID NO: 931053 - DNA, 13 bp, Homo sapiens
caggtcagctggg

SEQ ID NO: 931054 - DNA, 18 bp, Homo sapiens
caggtcagctgggagcca

SEQ ID NO: 931055 - DNA, 19 bp, Homo sapiens
caggtcagctgggagccag

SEQ ID NO: 931056 - DNA, 20 bp, Homo sapiens
caggtcagctgggagccagt

SEQ ID NO: 931057 - DNA, 21 bp, Homo sapiens
caggtcagctgttactttctt

SEQ ID NO: 931058 - DNA, 15 bp, Homo sapiens
caggtcaggatgcac

SEQ ID NO: 931059 - DNA, 12 bp, Homo sapiens
caggtcagggct

SEQ ID NO: 931060 - DNA, 16 bp, Homo sapiens
caggtcaggggctccc

SEQ ID NO: 931061 - DNA, 14 bp, Homo sapiens
caggtcagtagtca

SEQ ID NO: 931062 - DNA, 17 bp, Homo sapiens
caggtcagttgtaataa

SEQ ID NO: 931063 - DNA, 12 bp, Homo sapiens
caggtcatcaga

SEQ ID NO: 931064 - DNA, 14 bp, Homo sapiens
caggtcatcagatg

SEQ ID NO: 931065 - DNA, 17 bp, Homo sapiens
caggtcatcagatgcct

SEQ ID NO: 931066 - DNA, 13 bp, Homo sapiens
caggtcatgcagt

SEQ ID NO: 931067 - DNA, 23 bp, Homo sapiens
caggtcatgcagttcctggccca

SEQ ID NO: 931068 - DNA, 18 bp, Homo sapiens
caggtcccacctccagcc

SEQ ID NO: 931069 - DNA, 13 bp, Homo sapiens
caggtcccagcga

SEQ ID NO: 931070 - DNA, 12 bp, Homo sapiens
ctgctgctgcct

SEQ ID NO: 931071 - DNA, 15 bp, Homo sapiens
ctgctgctgcctggc

SEQ ID NO: 931072 - DNA, 16 bp, Homo sapiens
ctgctgctgcgccctt

SEQ ID NO: 931073 - DNA, 14 bp, Homo sapiens
ctgctgctgctatt

SEQ ID NO: 931074 - DNA, 17 bp, Homo sapiens
ctgctgctgctattgct

SEQ ID NO: 931075 - DNA, 13 bp, Homo sapiens
ctgctgctggggc

SEQ ID NO: 931076 - DNA, 10 bp, Homo sapiens
ctgctgctgt

SEQ ID NO: 931077 - DNA, 20 bp, Homo sapiens
ctgctgctgtaactgctgag

SEQ ID NO: 931078 - DNA, 21 bp, Homo sapiens
ctgctgctgtaactgctgagc

SEQ ID NO: 931079 - DNA, 14 bp, Homo sapiens
ctgctgctgtgctt

SEQ ID NO: 931080 - DNA, 15 bp, Homo sapiens
ctgctgcttctgctc

SEQ ID NO: 931081 - DNA, 17 bp, Homo sapiens
ctgctgcttctgctcca

SEQ ID NO: 931082 - DNA, 20 bp, Homo sapiens
ctgctgcttctgctccagcc

SEQ ID NO: 931083 - DNA, 21 bp, Homo sapiens
ctgctgcttctgctccagccc

SEQ ID NO: 931084 - DNA, 12 bp, Homo sapiens
ctgctgcttctt

SEQ ID NO: 931085 - DNA, 18 bp, Homo sapiens
ctgctgcttcttgcttcc

SEQ ID NO: 931086 - DNA, 18 bp, Homo sapiens
ctgctgcttgggacgtgt

SEQ ID NO: 931087 - DNA, 13 bp, Homo sapiens
ctgctggaagccc

SEQ ID NO: 931088 - DNA, 14 bp, Homo sapiens
ctgctggaagccca

SEQ ID NO: 931089 - DNA, 21 bp, Homo sapiens
ctgctggaagctgtcaggctg

SEQ ID NO: 931090 - DNA, 23 bp, Homo sapiens
ctgctggaagctgtcaggctggg

SEQ ID NO: 931091 - DNA, 18 bp, Homo sapiens
ctgctggaaggggcagca

SEQ ID NO: 931092 - DNA, 20 bp, Homo sapiens
ctgctggaaggggcagcagg

SEQ ID NO: 931093 - DNA, 21 bp, Homo sapiens
ctgctggaaggggcagcagga

SEQ ID NO: 931094 - DNA, 11 bp, Homo sapiens
ctgctggacat

SEQ ID NO: 931095 - DNA, 18 bp, Homo sapiens
ctgctggaggaggggaag

SEQ ID NO: 931096 - DNA, 21 bp, Homo sapiens
ctgctggaggaggggaagctg

SEQ ID NO: 931097 - DNA, 18 bp, Homo sapiens
ctgctggaggcctcaggt

SEQ ID NO: 931098 - DNA, 21 bp, Homo sapiens
ctgctggaggcctcaggtgct

SEQ ID NO: 931099 - DNA, 18 bp, Homo sapiens
ctgctggagtccagtgct

SEQ ID NO: 931100 - DNA, 20 bp, Homo sapiens
ctgctggagtttcatgtaca

SEQ ID NO: 931101 - DNA, 21 bp, Homo sapiens
ctgctggagtttcatgtacaa

SEQ ID NO: 931102 - DNA, 16 bp, Homo sapiens
ctgctggcacccaccg

SEQ ID NO: 931103 - DNA, 17 bp, Homo sapiens
ctgctggcacccaccgt

SEQ ID NO: 931104 - DNA, 18 bp, Homo sapiens
ctgctggcagggccaggg

SEQ ID NO: 931105 - DNA, 20 bp, Homo sapiens
ctgctggcagggccagggca

SEQ ID NO: 931106 - DNA, 15 bp, Homo sapiens
ctgctggcatcaggt

SEQ ID NO: 931107 - DNA, 18 bp, Homo sapiens
ctgctggcatcaggtctg

SEQ ID NO: 931108 - DNA, 12 bp, Homo sapiens
ctgctggccaaa

SEQ ID NO: 931109 - DNA, 16 bp, Homo sapiens
ctgctggccggagcaa

SEQ ID NO: 931110 - DNA, 13 bp, Homo sapiens
ctgctggcctgga

SEQ ID NO: 931111 - DNA, 16 bp, Homo sapiens
ctgctggctcacgccc

SEQ ID NO: 931112 - DNA, 16 bp, Homo sapiens
ctgctggctgacctgg

SEQ ID NO: 931113 - DNA, 19 bp, Homo sapiens
ctgctggctgacctgggcc

SEQ ID NO: 931114 - DNA, 11 bp, Homo sapiens
ctgctggctgc

SEQ ID NO: 931115 - DNA, 14 bp, Homo sapiens
ctgctggctgcctt

SEQ ID NO: 931116 - DNA, 17 bp, Homo sapiens
ctgctggcttcagggag

SEQ ID NO: 931117 - DNA, 20 bp, Homo sapiens
ctgctgggaaccccgcagcc

SEQ ID NO: 931118 - DNA, 21 bp, Homo sapiens
ctgctgggaaccccgcagccc

SEQ ID NO: 931119 - DNA, 22 bp, Homo sapiens
ctgctgggaaccccgcagcccg

SEQ ID NO: 931120 - DNA, 12 bp, Homo sapiens
ctgctgggactc

SEQ ID NO: 931121 - DNA, 17 bp, Homo sapiens
ctgctgggactgagaag

SEQ ID NO: 931122 - DNA, 22 bp, Homo sapiens
ctgctgggaggttaaaaagaaa

SEQ ID NO: 931123 - DNA, 13 bp, Homo sapiens
ctgctgggcgtct

SEQ ID NO: 931124 - DNA, 22 bp, Homo sapiens
ctgctgggcgtgtgtgacactg

SEQ ID NO: 931125 - DNA, 14 bp, Homo sapiens
ctgctgggctctcc

SEQ ID NO: 931126 - DNA, 18 bp, Homo sapiens
ctgctgggctctccacct

SEQ ID NO: 931127 - DNA, 22 bp, Homo sapiens
ctgctgggctctccacctcagc

SEQ ID NO: 931128 - DNA, 13 bp, Homo sapiens
ctgctgggctctg

SEQ ID NO: 931129 - DNA, 18 bp, Homo sapiens
ctgctgggctgagtgaca

SEQ ID NO: 931130 - DNA, 19 bp, Homo sapiens
ctgctggggaagggttttc

SEQ ID NO: 931131 - DNA, 22 bp, Homo sapiens
caggtggatgtttaccgtgtgt

SEQ ID NO: 931132 - DNA, 15 bp, Homo sapiens
caggtggccactcca

SEQ ID NO: 931133 - DNA, 19 bp, Homo sapiens
caggtggccactccagacc

SEQ ID NO: 931134 - DNA, 21 bp, Homo sapiens
caggtggccactccagacccc

SEQ ID NO: 931135 - DNA, 19 bp, Homo sapiens
caggtggccagcctggatc

SEQ ID NO: 931136 - DNA, 13 bp, Homo sapiens
caggtggccatgc

SEQ ID NO: 931137 - DNA, 19 bp, Homo sapiens
caggtggccatgcctcagc

SEQ ID NO: 931138 - DNA, 22 bp, Homo sapiens
caggtggctagcaaattagaaa

SEQ ID NO: 931139 - DNA, 20 bp, Homo sapiens
caggtggctgacccagtccc

SEQ ID NO: 931140 - DNA, 15 bp, Homo sapiens
caggtgggacttagc

SEQ ID NO: 931141 - DNA, 21 bp, Homo sapiens
caggtgggaggaaagggcctg

SEQ ID NO: 931142 - DNA, 13 bp, Homo sapiens
caggtgggcctgg

SEQ ID NO: 931143 - DNA, 15 bp, Homo sapiens
caggtgggcctggcg

SEQ ID NO: 931144 - DNA, 20 bp, Homo sapiens
caggtgggcctggcggcctg

SEQ ID NO: 931145 - DNA, 21 bp, Homo sapiens
caggtgggcctggcggcctgt

SEQ ID NO: 931146 - DNA, 14 bp, Homo sapiens
caggtgggcctggg

SEQ ID NO: 931147 - DNA, 15 bp, Homo sapiens
caggtgggcggtgtg

SEQ ID NO: 931148 - DNA, 16 bp, Homo sapiens
caggtgggctgcctgc

SEQ ID NO: 931149 - DNA, 14 bp, Homo sapiens
caggtgggctgggc

SEQ ID NO: 931150 - DNA, 19 bp, Homo sapiens
caggtggggcatgtcctca

SEQ ID NO: 931151 - DNA, 14 bp, Homo sapiens
caggtggggcctca

SEQ ID NO: 931152 - DNA, 15 bp, Homo sapiens
caggtggggcctcag

SEQ ID NO: 931153 - DNA, 19 bp, Homo sapiens
caggtggggcctcagcctg

SEQ ID NO: 931154 - DNA, 20 bp, Homo sapiens
caggtggggcctcagcctgg

SEQ ID NO: 931155 - DNA, 23 bp, Homo sapiens
caggtggggcctcagcctggggc

SEQ ID NO: 931156 - DNA, 21 bp, Homo sapiens
caggtgggtgtgggacacctg

SEQ ID NO: 931157 - DNA, 16 bp, Homo sapiens
caggtggtcctgagac

SEQ ID NO: 931158 - DNA, 21 bp, Homo sapiens
caggtggtggcactgagcccc

SEQ ID NO: 931159 - DNA, 19 bp, Homo sapiens
caggtggtgtcgggccctt

SEQ ID NO: 931160 - DNA, 21 bp, Homo sapiens
caggtgtagctgagctgtgac

SEQ ID NO: 931161 - DNA, 14 bp, Homo sapiens
caggtgtataaatg

SEQ ID NO: 931162 - DNA, 15 bp, Homo sapiens
caggtgtgcacgtgg

SEQ ID NO: 931163 - DNA, 19 bp, Homo sapiens
caggtgtggtggctcatgg

SEQ ID NO: 931164 - DNA, 21 bp, Homo sapiens
caggtgtgtccacctgggcat

SEQ ID NO: 931165 - DNA, 14 bp, Homo sapiens
caggtgtgtgtgaa

SEQ ID NO: 931166 - DNA, 21 bp, Homo sapiens
caggtgtgtgtgaactgggca

SEQ ID NO: 931167 - DNA, 15 bp, Homo sapiens
caggtgttactagaa

SEQ ID NO: 931168 - DNA, 20 bp, Homo sapiens
caggtgttctacactcatct

SEQ ID NO: 931169 - DNA, 23 bp, Homo sapiens
caggtgttgccatttctctgctt

SEQ ID NO: 931170 - DNA, 16 bp, Homo sapiens
caggtgtttagttgca

SEQ ID NO: 931171 - DNA, 21 bp, Homo sapiens
caggtgttttttatgaagtgc

SEQ ID NO: 931172 - DNA, 16 bp, Homo sapiens
caggttaggaaggcag

SEQ ID NO: 931173 - DNA, 18 bp, Homo sapiens
caggttaggaaggcagca

SEQ ID NO: 931174 - DNA, 15 bp, Homo sapiens
caggttccacagagg

SEQ ID NO: 931175 - DNA, 19 bp, Homo sapiens
caggttccacagaggacac

SEQ ID NO: 931176 - DNA, 12 bp, Homo sapiens
caggttccagaa

SEQ ID NO: 931177 - DNA, 14 bp, Homo sapiens
caggttccatcccg

SEQ ID NO: 931178 - DNA, 17 bp, Homo sapiens
caggttcccaagctcag

SEQ ID NO: 931179 - DNA, 17 bp, Homo sapiens
caggttcctggggccgc

SEQ ID NO: 931180 - DNA, 20 bp, Homo sapiens
caggttcctggggccgcctg

SEQ ID NO: 931181 - DNA, 21 bp, Homo sapiens
caggttcctgtggagacactg

SEQ ID NO: 931182 - DNA, 14 bp, Homo sapiens
caggttcctttttc

SEQ ID NO: 931183 - DNA, 20 bp, Homo sapiens
caggttctccgttagctcct

SEQ ID NO: 931184 - DNA, 23 bp, Homo sapiens
caggttctccgttagctcctgtg

SEQ ID NO: 931185 - DNA, 12 bp, Homo sapiens
caggttcttgtt

SEQ ID NO: 931186 - DNA, 18 bp, Homo sapiens
caggttcttgttggtgca

SEQ ID NO: 931187 - DNA, 21 bp, Homo sapiens
caggttcttgttggtgcacag

SEQ ID NO: 931188 - DNA, 16 bp, Homo sapiens
caggttgaagccatgt

SEQ ID NO: 931189 - DNA, 19 bp, Homo sapiens
caggttggcggcagacaca

SEQ ID NO: 931190 - DNA, 21 bp, Homo sapiens
caggttggcggcagacacatt

SEQ ID NO: 931191 - DNA, 21 bp, Homo sapiens
caggttggtgggggcctcggt

SEQ ID NO: 931192 - DNA, 18 bp, Homo sapiens
caggttgtagtaaagaaa

SEQ ID NO: 931193 - DNA, 22 bp, Homo sapiens
caggttgtctgaagtcactgca

SEQ ID NO: 931194 - DNA, 18 bp, Homo sapiens
caggtttaagctgttact

SEQ ID NO: 931195 - DNA, 14 bp, Homo sapiens
caggtttatctgaa

SEQ ID NO: 931196 - DNA, 13 bp, Homo sapiens
caggtttccccaa

SEQ ID NO: 931197 - DNA, 15 bp, Homo sapiens
ctgcttctcccccca

SEQ ID NO: 931198 - DNA, 19 bp, Homo sapiens
ctgcttctccccccatccc

SEQ ID NO: 931199 - DNA, 17 bp, Homo sapiens
ctgcttctcggccagcc

SEQ ID NO: 931200 - DNA, 22 bp, Homo sapiens
ctgcttctcggggtccagtgca

SEQ ID NO: 931201 - DNA, 14 bp, Homo sapiens
ctgcttctctcagc

SEQ ID NO: 931202 - DNA, 13 bp, Homo sapiens
ctgcttctctgac

SEQ ID NO: 931203 - DNA, 14 bp, Homo sapiens
ctgcttctctgact

SEQ ID NO: 931204 - DNA, 16 bp, Homo sapiens
ctgcttctctgacttc

SEQ ID NO: 931205 - DNA, 12 bp, Homo sapiens
ctgcttctcttt

SEQ ID NO: 931206 - DNA, 15 bp, Homo sapiens
ctgcttctgctccag

SEQ ID NO: 931207 - DNA, 15 bp, Homo sapiens
ctgcttctgtccagg

SEQ ID NO: 931208 - DNA, 16 bp, Homo sapiens
ctgcttctgtccagga

SEQ ID NO: 931209 - DNA, 17 bp, Homo sapiens
ctgcttctgtccaggac

SEQ ID NO: 931210 - DNA, 14 bp, Homo sapiens
ctgcttctgtgtac

SEQ ID NO: 931211 - DNA, 16 bp, Homo sapiens
ctgcttcttcttccaa

SEQ ID NO: 931212 - DNA, 18 bp, Homo sapiens
ctgcttcttcttccaaat

SEQ ID NO: 931213 - DNA, 13 bp, Homo sapiens
ctgcttcttgctt

SEQ ID NO: 931214 - DNA, 15 bp, Homo sapiens
ctgcttcttgcttcc

SEQ ID NO: 931215 - DNA, 17 bp, Homo sapiens
ctgcttgacctagctct

SEQ ID NO: 931216 - DNA, 13 bp, Homo sapiens
ctgcttgaggaaa

SEQ ID NO: 931217 - DNA, 20 bp, Homo sapiens
ctgcttgagttcccagatgg

SEQ ID NO: 931218 - DNA, 16 bp, Homo sapiens
ctgcttgagttgcctg

SEQ ID NO: 931219 - DNA, 17 bp, Homo sapiens
ctgcttgagttgcctga

SEQ ID NO: 931220 - DNA, 17 bp, Homo sapiens
ctgcttgatgaagcaag

SEQ ID NO: 931221 - DNA, 21 bp, Homo sapiens
ctgcttgatgaagcaaggaag

SEQ ID NO: 931222 - DNA, 20 bp, Homo sapiens
ctgcttgcacacttccccat

SEQ ID NO: 931223 - DNA, 22 bp, Homo sapiens
ctgcttgcagccaggagaaggt

SEQ ID NO: 931224 - DNA, 16 bp, Homo sapiens
ctgcttgcccgctccc

SEQ ID NO: 931225 - DNA, 17 bp, Homo sapiens
ctgcttgcccgctccca

SEQ ID NO: 931226 - DNA, 18 bp, Homo sapiens
ctgcttgcccgctcccac

SEQ ID NO: 931227 - DNA, 11 bp, Homo sapiens
ctgcttgcttt

SEQ ID NO: 931228 - DNA, 23 bp, Homo sapiens
ctgcttgcttttgcctctgccca

SEQ ID NO: 931229 - DNA, 22 bp, Homo sapiens
ctgcttggatgcgagcttggcc

SEQ ID NO: 931230 - DNA, 15 bp, Homo sapiens
ctgcttggccagatg

SEQ ID NO: 931231 - DNA, 17 bp, Homo sapiens
ctgcttgtactaagcca

SEQ ID NO: 931232 - DNA, 20 bp, Homo sapiens
ctgcttgtgcctcccttccc

SEQ ID NO: 931233 - DNA, 21 bp, Homo sapiens
ctgcttgtgcctcccttccca

SEQ ID NO: 931234 - DNA, 17 bp, Homo sapiens
ctgctttaaagggcctg

SEQ ID NO: 931235 - DNA, 12 bp, Homo sapiens
ctgctttcaagt

SEQ ID NO: 931236 - DNA, 14 bp, Homo sapiens
ctgctttcccctgt

SEQ ID NO: 931237 - DNA, 19 bp, Homo sapiens
ctgctttcccctgtgggga

SEQ ID NO: 931238 - DNA, 21 bp, Homo sapiens
ctgctttcccctgtggggatc

SEQ ID NO: 931239 - DNA, 17 bp, Homo sapiens
ctgctttccttttctct

SEQ ID NO: 931240 - DNA, 11 bp, Homo sapiens
ctgctttctgt

SEQ ID NO: 931241 - DNA, 17 bp, Homo sapiens
ctgctttctgttccaaa

SEQ ID NO: 931242 - DNA, 18 bp, Homo sapiens
ctgctttctgttccaaat

SEQ ID NO: 931243 - DNA, 18 bp, Homo sapiens
ctgctttgacaaggcaga

SEQ ID NO: 931244 - DNA, 16 bp, Homo sapiens
ctgctttggcagtgcc

SEQ ID NO: 931245 - DNA, 14 bp, Homo sapiens
ctgctttggccttt

SEQ ID NO: 931246 - DNA, 15 bp, Homo sapiens
ctgctttggcctttc

SEQ ID NO: 931247 - DNA, 16 bp, Homo sapiens
ctgctttgggctgccc

SEQ ID NO: 931248 - DNA, 16 bp, Homo sapiens
ctgctttgtgcatatg

SEQ ID NO: 931249 - DNA, 17 bp, Homo sapiens
ctgcttttagttcatat

SEQ ID NO: 931250 - DNA, 20 bp, Homo sapiens
ctgcttttagttcatatata

SEQ ID NO: 931251 - DNA, 15 bp, Homo sapiens
ctgcttttatctcag

SEQ ID NO: 931252 - DNA, 22 bp, Homo sapiens
ctgcttttatgtagtttaggct

SEQ ID NO: 931253 - DNA, 11 bp, Homo sapiens
ctggacagaac

SEQ ID NO: 931254 - DNA, 19 bp, Homo sapiens
ctggacagaggggactctg

SEQ ID NO: 931255 - DNA, 10 bp, Homo sapiens
ctggacagat

SEQ ID NO: 931256 - DNA, 12 bp, Homo sapiens
ctggacagatgg

SEQ ID NO: 931257 - DNA, 17 bp, Homo sapiens
ctggacagatggacgca

SEQ ID NO: 931258 - DNA, 19 bp, Homo sapiens
ctggacagatggcccaagg

SEQ ID NO: 931259 - DNA, 15 bp, Homo sapiens
ctggacagcagaagc

SEQ ID NO: 931260 - DNA, 14 bp, Homo sapiens
ctggacagccagtg

SEQ ID NO: 931261 - DNA, 14 bp, Homo sapiens
ctggacagcttgtg

SEQ ID NO: 931262 - DNA, 17 bp, Homo sapiens
ctggacagctttgctcc

SEQ ID NO: 931263 - DNA, 21 bp, Homo sapiens
ctggacagctttgctccgctc

SEQ ID NO: 931264 - DNA, 20 bp, Homo sapiens
ctggacaggctctgcttctc

SEQ ID NO: 931265 - DNA, 20 bp, Homo sapiens
ctggacagtatcccacatcc

SEQ ID NO: 931266 - DNA, 17 bp, Homo sapiens
ctggacatactgctgga

SEQ ID NO: 931267 - DNA, 18 bp, Homo sapiens
ctggacatcctcttctgc

SEQ ID NO: 931268 - DNA, 22 bp, Homo sapiens
ctggaccaccagccccagcaag

SEQ ID NO: 931269 - DNA, 15 bp, Homo sapiens
ctggaccagagactt

SEQ ID NO: 931270 - DNA, 15 bp, Homo sapiens
ctggaccagctggcc

SEQ ID NO: 931271 - DNA, 18 bp, Homo sapiens
ctggaccccatctgtgaa

SEQ ID NO: 931272 - DNA, 22 bp, Homo sapiens
ctggaccccatctgtgaataag

SEQ ID NO: 931273 - DNA, 15 bp, Homo sapiens
ctggaccccctgccc

SEQ ID NO: 931274 - DNA, 15 bp, Homo sapiens
ctggacccctggacc

SEQ ID NO: 931275 - DNA, 19 bp, Homo sapiens
ctggacccctggggtggcc

SEQ ID NO: 931276 - DNA, 21 bp, Homo sapiens
ctggacccctggggtggccag

SEQ ID NO: 931277 - DNA, 15 bp, Homo sapiens
ctggaccgctgactg

SEQ ID NO: 931278 - DNA, 19 bp, Homo sapiens
ctggacctagggtggcctg

SEQ ID NO: 931279 - DNA, 20 bp, Homo sapiens
ctggacctatgcagggaggc

SEQ ID NO: 931280 - DNA, 20 bp, Homo sapiens
ctggacctatgtcctaagga

SEQ ID NO: 931281 - DNA, 20 bp, Homo sapiens
ctggacctcaggagggcagg

SEQ ID NO: 931282 - DNA, 17 bp, Homo sapiens
ctggacctccatccctg

SEQ ID NO: 931283 - DNA, 22 bp, Homo sapiens
ctggacctccatccctgctctg

SEQ ID NO: 931284 - DNA, 13 bp, Homo sapiens
ctggacctggaac

SEQ ID NO: 931285 - DNA, 13 bp, Homo sapiens
ctggacctgggat

SEQ ID NO: 931286 - DNA, 12 bp, Homo sapiens
ctggacctgggg

SEQ ID NO: 931287 - DNA, 15 bp, Homo sapiens
ctggacctgggggta

SEQ ID NO: 931288 - DNA, 15 bp, Homo sapiens
ctggacctggtggct

SEQ ID NO: 931289 - DNA, 14 bp, Homo sapiens
ctggaccttgacag

SEQ ID NO: 931290 - DNA, 18 bp, Homo sapiens
ctggaccttgacagagca

SEQ ID NO: 931291 - DNA, 19 bp, Homo sapiens
ctggacgatagcttggagg

SEQ ID NO: 931292 - DNA, 17 bp, Homo sapiens
ctggacgctgccctgca

SEQ ID NO: 931293 - DNA, 21 bp, Homo sapiens
ctggacggcaggctcactgcc

SEQ ID NO: 931294 - DNA, 15 bp, Homo sapiens
ctggacggggactgg

SEQ ID NO: 931295 - DNA, 18 bp, Homo sapiens
ctggacggggactgggga

SEQ ID NO: 931296 - DNA, 23 bp, Homo sapiens
ctggacggggactggggatgtgg

SEQ ID NO: 931297 - DNA, 19 bp, Homo sapiens
ctggactacacccaagcct

SEQ ID NO: 931298 - DNA, 15 bp, Homo sapiens
ctggactatagctgt

SEQ ID NO: 931299 - DNA, 16 bp, Homo sapiens
ctggactcacctcccc

SEQ ID NO: 931300 - DNA, 12 bp, Homo sapiens
ctggactccgga

SEQ ID NO: 931301 - DNA, 14 bp, Homo sapiens
ctggactccggagg

SEQ ID NO: 931302 - DNA, 13 bp, Homo sapiens
ctggactccggcc

SEQ ID NO: 931303 - DNA, 15 bp, Homo sapiens
ctggactccggccct

SEQ ID NO: 931304 - DNA, 14 bp, Homo sapiens
ctggactcctctgt

SEQ ID NO: 931305 - DNA, 22 bp, Homo sapiens
ctggactcctctgtccaggcac

SEQ ID NO: 931306 - DNA, 23 bp, Homo sapiens
ctggactcctctgtccaggcact

SEQ ID NO: 931307 - DNA, 19 bp, Homo sapiens
ctggactcctgccaccagc

SEQ ID NO: 931308 - DNA, 24 bp, Homo sapiens
ctggactcctgccaccagcatcca

SEQ ID NO: 931309 - DNA, 23 bp, Homo sapiens
ctggactctaaagtctgttgatt

SEQ ID NO: 931310 - DNA, 14 bp, Homo sapiens
ctggactctcagtc

SEQ ID NO: 931311 - DNA, 19 bp, Homo sapiens
ctggactctcagtctctga

SEQ ID NO: 931312 - DNA, 18 bp, Homo sapiens
ctggactctgcatcccag

SEQ ID NO: 931313 - DNA, 15 bp, Homo sapiens
ctggactctgcccca

SEQ ID NO: 931314 - DNA, 17 bp, Homo sapiens
ctggactctgccccaat

SEQ ID NO: 931315 - DNA, 21 bp, Homo sapiens
ctggactctggactttctcta

SEQ ID NO: 931316 - DNA, 16 bp, Homo sapiens
ctggactgaagcctgc

SEQ ID NO: 931317 - DNA, 16 bp, Homo sapiens
ctggactgacagcatg

SEQ ID NO: 931318 - DNA, 17 bp, Homo sapiens
ctggactgacagcatgt

SEQ ID NO: 931319 - DNA, 20 bp, Homo sapiens
ctggactgcatggggaggca

SEQ ID NO: 931320 - DNA, 22 bp, Homo sapiens
ctggactgcatggggaggcagc

SEQ ID NO: 931321 - DNA, 23 bp, Homo sapiens
ctggactgcatggggaggcagca

SEQ ID NO: 931322 - DNA, 22 bp, Homo sapiens
ctggactggccatttttctggg

SEQ ID NO: 931323 - DNA, 13 bp, Homo sapiens
ctggactgggagg

SEQ ID NO: 931324 - DNA, 16 bp, Homo sapiens
ctggactgggaggtag

SEQ ID NO: 931325 - DNA, 12 bp, Homo sapiens
ctggactgtaga

SEQ ID NO: 931326 - DNA, 22 bp, Homo sapiens
ctggactgtagaaggtgagagg

SEQ ID NO: 931327 - DNA, 19 bp, Homo sapiens
cagtatttcattgcctgtg

SEQ ID NO: 931328 - DNA, 13 bp, Homo sapiens
cagtatttgtaat

SEQ ID NO: 931329 - DNA, 12 bp, Homo sapiens
cagtattttcca

SEQ ID NO: 931330 - DNA, 17 bp, Homo sapiens
cagtattttggagaaat

SEQ ID NO: 931331 - DNA, 20 bp, Homo sapiens
cagtattttggagaaattat

SEQ ID NO: 931332 - DNA, 19 bp, Homo sapiens
cagtattttggttcttagt

SEQ ID NO: 931333 - DNA, 17 bp, Homo sapiens
cagtattttgtgtcctc

SEQ ID NO: 931334 - DNA, 20 bp, Homo sapiens
cagtatttttttttaatttt

SEQ ID NO: 931335 - DNA, 21 bp, Homo sapiens
cagtcaacctgggcaaagcct

SEQ ID NO: 931336 - DNA, 14 bp, Homo sapiens
cagtcaagaagaaa

SEQ ID NO: 931337 - DNA, 15 bp, Homo sapiens
cagtcaatattttta

SEQ ID NO: 931338 - DNA, 22 bp, Homo sapiens
cagtcacaacagagtgaaaaat

SEQ ID NO: 931339 - DNA, 16 bp, Homo sapiens
cagtcacagccacccc

SEQ ID NO: 931340 - DNA, 14 bp, Homo sapiens
cagtcacattgcca

SEQ ID NO: 931341 - DNA, 19 bp, Homo sapiens
cagtcaccacccagccctt

SEQ ID NO: 931342 - DNA, 19 bp, Homo sapiens
cagtcacccccacttccca

SEQ ID NO: 931343 - DNA, 20 bp, Homo sapiens
cagtcacctcgtctccctgg

SEQ ID NO: 931344 - DNA, 22 bp, Homo sapiens
cagtcactcctctctagggcag

SEQ ID NO: 931345 - DNA, 14 bp, Homo sapiens
cagtcactgctgca

SEQ ID NO: 931346 - DNA, 23 bp, Homo sapiens
cagtcacttgggagctgctgggc

SEQ ID NO: 931347 - DNA, 18 bp, Homo sapiens
cagtcagagtccagtgct

SEQ ID NO: 931348 - DNA, 22 bp, Homo sapiens
cagtcagagtccagtgctctgc

SEQ ID NO: 931349 - DNA, 18 bp, Homo sapiens
cagtcagcagatgctgtt

SEQ ID NO: 931350 - DNA, 20 bp, Homo sapiens
cagtcaggctgcagaggcac

SEQ ID NO: 931351 - DNA, 19 bp, Homo sapiens
cagtcaggtgggcggtgtg

SEQ ID NO: 931352 - DNA, 11 bp, Homo sapiens
cagtcagtgac

SEQ ID NO: 931353 - DNA, 19 bp, Homo sapiens
cagtcagttcccggagcac

SEQ ID NO: 931354 - DNA, 22 bp, Homo sapiens
cagtcagttcccggagcacagc

SEQ ID NO: 931355 - DNA, 15 bp, Homo sapiens
cagtcataaatactg

SEQ ID NO: 931356 - DNA, 15 bp, Homo sapiens
cagtcataactaaat

SEQ ID NO: 931357 - DNA, 13 bp, Homo sapiens
cagtcatcaaagc

SEQ ID NO: 931358 - DNA, 16 bp, Homo sapiens
cagtcatcatcagggc

SEQ ID NO: 931359 - DNA, 19 bp, Homo sapiens
cagtcatcatcagggcctg

SEQ ID NO: 931360 - DNA, 20 bp, Homo sapiens
cagtcatcatcagggcctgg

SEQ ID NO: 931361 - DNA, 22 bp, Homo sapiens
cagtcatcatcagggcctgggg

SEQ ID NO: 931362 - DNA, 18 bp, Homo sapiens
cagtcatcctgccctgca

SEQ ID NO: 931363 - DNA, 20 bp, Homo sapiens
cagtcatcctgccctgcagc

SEQ ID NO: 931364 - DNA, 19 bp, Homo sapiens
cagtcatctcccctcctgg

SEQ ID NO: 931365 - DNA, 20 bp, Homo sapiens
cagtcatggaatcttgctgc

SEQ ID NO: 931366 - DNA, 12 bp, Homo sapiens
cagtcatggtac

SEQ ID NO: 931367 - DNA, 18 bp, Homo sapiens
cagtcatggtactacccc

SEQ ID NO: 931368 - DNA, 21 bp, Homo sapiens
cagtcatggtactaccccagc

SEQ ID NO: 931369 - DNA, 19 bp, Homo sapiens
cagtcattaaattactata

SEQ ID NO: 931370 - DNA, 18 bp, Homo sapiens
cagtcattctaggatgtg

SEQ ID NO: 931371 - DNA, 21 bp, Homo sapiens
cagtcattggctgtctcctag

SEQ ID NO: 931372 - DNA, 13 bp, Homo sapiens
cagtcatttgtgg

SEQ ID NO: 931373 - DNA, 20 bp, Homo sapiens
cagtcatttgtggttagaat

SEQ ID NO: 931374 - DNA, 16 bp, Homo sapiens
cagtcttccttgtctc

SEQ ID NO: 931375 - DNA, 18 bp, Homo sapiens
cagtcttccttgtggaat

SEQ ID NO: 931376 - DNA, 14 bp, Homo sapiens
cagtcttctgactg

SEQ ID NO: 931377 - DNA, 23 bp, Homo sapiens
cagtcttgaatttctaaaaaaca

SEQ ID NO: 931378 - DNA, 17 bp, Homo sapiens
cagtcttgcctaggcca

SEQ ID NO: 931379 - DNA, 11 bp, Homo sapiens
cagtcttgctc

SEQ ID NO: 931380 - DNA, 19 bp, Homo sapiens
cagtctttaaaggcccagc

SEQ ID NO: 931381 - DNA, 13 bp, Homo sapiens
cagtctttaagat

SEQ ID NO: 931382 - DNA, 17 bp, Homo sapiens
cagtctttaagatcttg

SEQ ID NO: 931383 - DNA, 21 bp, Homo sapiens
cagtgaaaagattttatttat

SEQ ID NO: 931384 - DNA, 13 bp, Homo sapiens
cagtgaaattttc

SEQ ID NO: 931385 - DNA, 23 bp, Homo sapiens
cagtgaacattcccagcccagcc

SEQ ID NO: 931386 - DNA, 21 bp, Homo sapiens
cagtgaaccaaagagactgga

SEQ ID NO: 931387 - DNA, 16 bp, Homo sapiens
cagtgaactcctgcca

SEQ ID NO: 931388 - DNA, 17 bp, Homo sapiens
cagtgaactcctgccag

SEQ ID NO: 931389 - DNA, 20 bp, Homo sapiens
cagtgaacttacacttggag

SEQ ID NO: 931390 - DNA, 23 bp, Homo sapiens
cagtgaacttacacttggagccc

SEQ ID NO: 931391 - DNA, 14 bp, Homo sapiens
cagtgaagaaagcc

SEQ ID NO: 931392 - DNA, 15 bp, Homo sapiens
cagtgaagactatga

SEQ ID NO: 931393 - DNA, 13 bp, Homo sapiens
cagtgaagatgca

SEQ ID NO: 931394 - DNA, 19 bp, Homo sapiens
cagtgaagatgcaatcaga

SEQ ID NO: 931395 - DNA, 19 bp, Homo sapiens
cagtgaagcagcactgtga

SEQ ID NO: 931396 - DNA, 12 bp, Homo sapiens
cagtgaagcctc

SEQ ID NO: 931397 - DNA, 16 bp, Homo sapiens
cagtgaatctgtttca

SEQ ID NO: 931398 - DNA, 18 bp, Homo sapiens
cagtgaatgattcagtgt

SEQ ID NO: 931399 - DNA, 20 bp, Homo sapiens
cagtgaatgattcagtgtta

SEQ ID NO: 931400 - DNA, 21 bp, Homo sapiens
cagtgaatggtgccattttcg

SEQ ID NO: 931401 - DNA, 14 bp, Homo sapiens
cagtgaattgtctt

SEQ ID NO: 931402 - DNA, 15 bp, Homo sapiens
cagtgaattgtcttt

SEQ ID NO: 931403 - DNA, 20 bp, Homo sapiens
cagtgaatttgaataaatga

SEQ ID NO: 931404 - DNA, 14 bp, Homo sapiens
cagtgaatttgtcc

SEQ ID NO: 931405 - DNA, 20 bp, Homo sapiens
cagtgacaaaatgggaggag

SEQ ID NO: 931406 - DNA, 20 bp, Homo sapiens
cagtgacaaagactcctctg

SEQ ID NO: 931407 - DNA, 13 bp, Homo sapiens
cagtgacaacatc

SEQ ID NO: 931408 - DNA, 13 bp, Homo sapiens
cagtgacacccag

SEQ ID NO: 931409 - DNA, 18 bp, Homo sapiens
cagtgacacttcagagag

SEQ ID NO: 931410 - DNA, 16 bp, Homo sapiens
cagtgacagagttcac

SEQ ID NO: 931411 - DNA, 15 bp, Homo sapiens
cagtgacagctagga

SEQ ID NO: 931412 - DNA, 18 bp, Homo sapiens
cagtgacgtgcacctgta

SEQ ID NO: 931413 - DNA, 14 bp, Homo sapiens
cagtgactccctgg

SEQ ID NO: 931414 - DNA, 16 bp, Homo sapiens
cagtgactccctggga

SEQ ID NO: 931415 - DNA, 18 bp, Homo sapiens
cagtgactgaaaccattt

SEQ ID NO: 931416 - DNA, 23 bp, Homo sapiens
cagtgactgaattctgccttggt

SEQ ID NO: 931417 - DNA, 17 bp, Homo sapiens
cagtgactggcaggtgc

SEQ ID NO: 931418 - DNA, 19 bp, Homo sapiens
cagtgactgttgtagcatt

SEQ ID NO: 931419 - DNA, 17 bp, Homo sapiens
cagtgacttctgagatc

SEQ ID NO: 931420 - DNA, 16 bp, Homo sapiens
cagtgacttgttctga

SEQ ID NO: 931421 - DNA, 18 bp, Homo sapiens
cagtgacttgttctgagt

SEQ ID NO: 931422 - DNA, 19 bp, Homo sapiens
cagtgactttttctgagct

SEQ ID NO: 931423 - DNA, 14 bp, Homo sapiens
cagtgagaaaaagc

SEQ ID NO: 931424 - DNA, 20 bp, Homo sapiens
cagtgagaaaaagctcctgt

SEQ ID NO: 931425 - DNA, 20 bp, Homo sapiens
cagtgagacagtctggaaag

SEQ ID NO: 931426 - DNA, 17 bp, Homo sapiens
cagtgagactgcaggtg

SEQ ID NO: 931427 - DNA, 21 bp, Homo sapiens
cagtgagagacgccctatttc

SEQ ID NO: 931428 - DNA, 14 bp, Homo sapiens
cagtgagaggggag

SEQ ID NO: 931429 - DNA, 21 bp, Homo sapiens
cagtgagaggggagggctcct

SEQ ID NO: 931430 - DNA, 21 bp, Homo sapiens
cagtgagagtactcacttttc

SEQ ID NO: 931431 - DNA, 18 bp, Homo sapiens
cagtgagattacagagga

SEQ ID NO: 931432 - DNA, 20 bp, Homo sapiens
cagtgagcagggtggggtct

SEQ ID NO: 931433 - DNA, 17 bp, Homo sapiens
cagtgagcccctcccca

SEQ ID NO: 931434 - DNA, 19 bp, Homo sapiens
cagtgagccgcatcttctc

SEQ ID NO: 931435 - DNA, 16 bp, Homo sapiens
cagtgagcctcctgtg

SEQ ID NO: 931436 - DNA, 18 bp, Homo sapiens
cagtgagcctcctgtgcc

SEQ ID NO: 931437 - DNA, 19 bp, Homo sapiens
cagtgagcctcctgtgcct

SEQ ID NO: 931438 - DNA, 13 bp, Homo sapiens
cagtgagctgaga

SEQ ID NO: 931439 - DNA, 13 bp, Homo sapiens
cagtgagctgtgt

SEQ ID NO: 931440 - DNA, 14 bp, Homo sapiens
cagtgaggagggtg

SEQ ID NO: 931441 - DNA, 18 bp, Homo sapiens
cagtgaggatgacagtga

SEQ ID NO: 931442 - DNA, 16 bp, Homo sapiens
cagtgaggcccaggga

SEQ ID NO: 931443 - DNA, 21 bp, Homo sapiens
cagtgaggctgtaaagtggcc

SEQ ID NO: 931444 - DNA, 14 bp, Homo sapiens
cagtgagggctggg

SEQ ID NO: 931445 - DNA, 19 bp, Homo sapiens
cagtgagggctgggcccac

SEQ ID NO: 931446 - DNA, 14 bp, Homo sapiens
cagtgaggggccct

SEQ ID NO: 931447 - DNA, 17 bp, Homo sapiens
cagtgaggggccctcca

SEQ ID NO: 931448 - DNA, 21 bp, Homo sapiens
cagtgaggggccctccatgcg

SEQ ID NO: 931449 - DNA, 24 bp, Homo sapiens
cagtgaggggccctccatgcgcag

SEQ ID NO: 931450 - DNA, 16 bp, Homo sapiens
cagtgagggtcttctt

SEQ ID NO: 931451 - DNA, 16 bp, Homo sapiens
cagtgagtgaatcagg

SEQ ID NO: 931452 - DNA, 21 bp, Homo sapiens
cagtgagtgccatgctttttg

SEQ ID NO: 931453 - DNA, 18 bp, Homo sapiens
cagtgagttacagcgaga

SEQ ID NO: 931454 - DNA, 23 bp, Homo sapiens
cagtgatacatgtactccagagg

SEQ ID NO: 931455 - DNA, 14 bp, Homo sapiens
cagtgatctatgtt

SEQ ID NO: 931456 - DNA, 15 bp, Homo sapiens
cagtgatctccatat

SEQ ID NO: 931457 - DNA, 14 bp, Homo sapiens
ctggaggtgggcat

SEQ ID NO: 931458 - DNA, 16 bp, Homo sapiens
ctggaggtgggcatgc

SEQ ID NO: 931459 - DNA, 22 bp, Homo sapiens
ctggaggtgggcatgccaccct

SEQ ID NO: 931460 - DNA, 22 bp, Homo sapiens
ctggaggtggggttgggattgg

SEQ ID NO: 931461 - DNA, 14 bp, Homo sapiens
ctggaggtgtggga

SEQ ID NO: 931462 - DNA, 19 bp, Homo sapiens
ctggagtcactgcagaggg

SEQ ID NO: 931463 - DNA, 15 bp, Homo sapiens
ctggagtcagggtga

SEQ ID NO: 931464 - DNA, 20 bp, Homo sapiens
ctggagtcccacccggacag

SEQ ID NO: 931465 - DNA, 14 bp, Homo sapiens
ctggagtcctctcc

SEQ ID NO: 931466 - DNA, 16 bp, Homo sapiens
ctggagtctatgctta

SEQ ID NO: 931467 - DNA, 13 bp, Homo sapiens
ctggagtctcctg

SEQ ID NO: 931468 - DNA, 15 bp, Homo sapiens
ctggagtgaaccaga

SEQ ID NO: 931469 - DNA, 16 bp, Homo sapiens
ctggagtgagcactca

SEQ ID NO: 931470 - DNA, 13 bp, Homo sapiens
ctggagtgaggct

SEQ ID NO: 931471 - DNA, 22 bp, Homo sapiens
ctggagtgaggcttccaggctc

SEQ ID NO: 931472 - DNA, 23 bp, Homo sapiens
ctggagtgaggcttccaggctct

SEQ ID NO: 931473 - DNA, 20 bp, Homo sapiens
ctggagtgagggcctcagag

SEQ ID NO: 931474 - DNA, 22 bp, Homo sapiens
ctggagtgagggcctcagagcc

SEQ ID NO: 931475 - DNA, 23 bp, Homo sapiens
ctggagtgagggcctcagagcct

SEQ ID NO: 931476 - DNA, 22 bp, Homo sapiens
ctggagtgatggtgtccttccc

SEQ ID NO: 931477 - DNA, 23 bp, Homo sapiens
ctggagtgatggtgtccttccct

SEQ ID NO: 931478 - DNA, 12 bp, Homo sapiens
ctggagtgcagg

SEQ ID NO: 931479 - DNA, 16 bp, Homo sapiens
ctggagtgcagggagg

SEQ ID NO: 931480 - DNA, 14 bp, Homo sapiens
ctggagtgcagtgg

SEQ ID NO: 931481 - DNA, 15 bp, Homo sapiens
ctggagtgcagtggc

SEQ ID NO: 931482 - DNA, 19 bp, Homo sapiens
ctggagtgcagtggcacaa

SEQ ID NO: 931483 - DNA, 21 bp, Homo sapiens
ctggagtgccctgcaggcaca

SEQ ID NO: 931484 - DNA, 18 bp, Homo sapiens
ctggagtgcgctcttggt

SEQ ID NO: 931485 - DNA, 23 bp, Homo sapiens
ctggagtgcgctcttggtccctg

SEQ ID NO: 931486 - DNA, 15 bp, Homo sapiens
ctggagtgctgcttg

SEQ ID NO: 931487 - DNA, 13 bp, Homo sapiens
ctggagtggccac

SEQ ID NO: 931488 - DNA, 14 bp, Homo sapiens
ctggagtggccact

SEQ ID NO: 931489 - DNA, 24 bp, Homo sapiens
ctggagtggccactaagcagagga

SEQ ID NO: 931490 - DNA, 21 bp, Homo sapiens
ctggagtgtgtcagagcccag

SEQ ID NO: 931491 - DNA, 17 bp, Homo sapiens
ctggagttcccacccaa

SEQ ID NO: 931492 - DNA, 22 bp, Homo sapiens
ctggagttccggcctgggcacc

SEQ ID NO: 931493 - DNA, 22 bp, Homo sapiens
ctggagttgactgactgagcag

SEQ ID NO: 931494 - DNA, 13 bp, Homo sapiens
ctggagtttcatg

SEQ ID NO: 931495 - DNA, 23 bp, Homo sapiens
ctggcaggggagacaggagccta

SEQ ID NO: 931496 - DNA, 20 bp, Homo sapiens
ctggcaggtgcagatgggct

SEQ ID NO: 931497 - DNA, 22 bp, Homo sapiens
ctggcaggtgcagatgggctgt

SEQ ID NO: 931498 - DNA, 21 bp, Homo sapiens
ctggcagtaacctagtgaatt

SEQ ID NO: 931499 - DNA, 19 bp, Homo sapiens
ctggcagtccgtgggacgg

SEQ ID NO: 931500 - DNA, 19 bp, Homo sapiens
ctggcagtgcaatgcttgt

SEQ ID NO: 931501 - DNA, 18 bp, Homo sapiens
ctggcagtggctctcaga

SEQ ID NO: 931502 - DNA, 16 bp, Homo sapiens
ctggcagttgaacaga

SEQ ID NO: 931503 - DNA, 20 bp, Homo sapiens
ctggcagttgaacagaggga

SEQ ID NO: 931504 - DNA, 21 bp, Homo sapiens
ctggcatcaggtctgggcaag

SEQ ID NO: 931505 - DNA, 19 bp, Homo sapiens
ctggcatcgcaccattctg

SEQ ID NO: 931506 - DNA, 20 bp, Homo sapiens
ctggcatcgcaccattctga

SEQ ID NO: 931507 - DNA, 22 bp, Homo sapiens
ctggcatcgcaccattctgact

SEQ ID NO: 931508 - DNA, 19 bp, Homo sapiens
ctggcatctgacacaaaaa

SEQ ID NO: 931509 - DNA, 15 bp, Homo sapiens
ctggcatctgtgtgc

SEQ ID NO: 931510 - DNA, 16 bp, Homo sapiens
ctggcatctgtgtgcg

SEQ ID NO: 931511 - DNA, 19 bp, Homo sapiens
ctggcatggtgcagggaga

SEQ ID NO: 931512 - DNA, 16 bp, Homo sapiens
ctggcattaattatta

SEQ ID NO: 931513 - DNA, 15 bp, Homo sapiens
ctggcattacagctg

SEQ ID NO: 931514 - DNA, 20 bp, Homo sapiens
ctggcattagaattatttaa

SEQ ID NO: 931515 - DNA, 19 bp, Homo sapiens
ctggcattctacacctgga

SEQ ID NO: 931516 - DNA, 17 bp, Homo sapiens
ctggcattctagattac

SEQ ID NO: 931517 - DNA, 16 bp, Homo sapiens
ctggcattgtccctgt

SEQ ID NO: 931518 - DNA, 17 bp, Homo sapiens
ctggccaaatagcaaag

SEQ ID NO: 931519 - DNA, 13 bp, Homo sapiens
ctggccaaatatg

SEQ ID NO: 931520 - DNA, 21 bp, Homo sapiens
ctggccaaatatgcactttcc

SEQ ID NO: 931521 - DNA, 23 bp, Homo sapiens
ctggccaacatcgtgaaaccctg

SEQ ID NO: 931522 - DNA, 14 bp, Homo sapiens
ctggccaaggggtg

SEQ ID NO: 931523 - DNA, 16 bp, Homo sapiens
ctggccacatcagccc

SEQ ID NO: 931524 - DNA, 22 bp, Homo sapiens
ctggccacatcagccccacagg

SEQ ID NO: 931525 - DNA, 15 bp, Homo sapiens
ctggccaccagccat

SEQ ID NO: 931526 - DNA, 21 bp, Homo sapiens
ctggccaccaggctggcgcag

SEQ ID NO: 931527 - DNA, 20 bp, Homo sapiens
ctggccacccctccccagta

SEQ ID NO: 931528 - DNA, 12 bp, Homo sapiens
ctggccaccctg

SEQ ID NO: 931529 - DNA, 13 bp, Homo sapiens
ctggccaccctgg

SEQ ID NO: 931530 - DNA, 14 bp, Homo sapiens
ctggccaccctggc

SEQ ID NO: 931531 - DNA, 11 bp, Homo sapiens
ctggccacctg

SEQ ID NO: 931532 - DNA, 22 bp, Homo sapiens
ctggccacctgaggtgggccca

SEQ ID NO: 931533 - DNA, 14 bp, Homo sapiens
ctggccactaaagc

SEQ ID NO: 931534 - DNA, 15 bp, Homo sapiens
ctggccactaaagct

SEQ ID NO: 931535 - DNA, 17 bp, Homo sapiens
ctggccactaaagcttc

SEQ ID NO: 931536 - DNA, 14 bp, Homo sapiens
ctggccagagaggg

SEQ ID NO: 931537 - DNA, 17 bp, Homo sapiens
ctggccagagagggccc

SEQ ID NO: 931538 - DNA, 21 bp, Homo sapiens
ctggccagagagggcccagct

SEQ ID NO: 931539 - DNA, 11 bp, Homo sapiens
ctggccagatt

SEQ ID NO: 931540 - DNA, 15 bp, Homo sapiens
ctggccagcaaggca

SEQ ID NO: 931541 - DNA, 19 bp, Homo sapiens
ctggccagcaaggcaggtt

SEQ ID NO: 931542 - DNA, 20 bp, Homo sapiens
ctggccagcaccctctcctg

SEQ ID NO: 931543 - DNA, 21 bp, Homo sapiens
ctggccagcaccctctcctgg

SEQ ID NO: 931544 - DNA, 15 bp, Homo sapiens
ctggccagctctgag

SEQ ID NO: 931545 - DNA, 13 bp, Homo sapiens
ctggccaggagca

SEQ ID NO: 931546 - DNA, 15 bp, Homo sapiens
ctggccaggagcagg

SEQ ID NO: 931547 - DNA, 14 bp, Homo sapiens
ctggccaggcagat

SEQ ID NO: 931548 - DNA, 21 bp, Homo sapiens
ctggccaggcagatctgtgcc

SEQ ID NO: 931549 - DNA, 22 bp, Homo sapiens
ctggccaggcagatctgtgccc

SEQ ID NO: 931550 - DNA, 13 bp, Homo sapiens
ctggccagggcca

SEQ ID NO: 931551 - DNA, 19 bp, Homo sapiens
ctggccagtccaggctgcc

SEQ ID NO: 931552 - DNA, 21 bp, Homo sapiens
ctggccagtccaggctgccgt

SEQ ID NO: 931553 - DNA, 13 bp, Homo sapiens
ctggccagtcctg

SEQ ID NO: 931554 - DNA, 21 bp, Homo sapiens
ctggccagtcctggtcctggc

SEQ ID NO: 931555 - DNA, 13 bp, Homo sapiens
ctggccagtgtca

SEQ ID NO: 931556 - DNA, 15 bp, Homo sapiens
ctggccagtgtttaa

SEQ ID NO: 931557 - DNA, 18 bp, Homo sapiens
ctggccatcccacaagtg

SEQ ID NO: 931558 - DNA, 20 bp, Homo sapiens
ctggccatgaatctctgcct

SEQ ID NO: 931559 - DNA, 13 bp, Homo sapiens
ctggccatgctgt

SEQ ID NO: 931560 - DNA, 23 bp, Homo sapiens
ctggccatgctgtccctgcactg

SEQ ID NO: 931561 - DNA, 19 bp, Homo sapiens
ctggccatgtcacctggct

SEQ ID NO: 931562 - DNA, 20 bp, Homo sapiens
ctggccatgtcacctggctg

SEQ ID NO: 931563 - DNA, 22 bp, Homo sapiens
ctggccatgtggccctccagtg

SEQ ID NO: 931564 - DNA, 14 bp, Homo sapiens
ctggcccaccaggg

SEQ ID NO: 931565 - DNA, 15 bp, Homo sapiens
ctggcccacccccca

SEQ ID NO: 931566 - DNA, 17 bp, Homo sapiens
ctggcccagaaagcctc

SEQ ID NO: 931567 - DNA, 18 bp, Homo sapiens
ctggcccagaaagcctct

SEQ ID NO: 931568 - DNA, 11 bp, Homo sapiens
ctggcccagcc

SEQ ID NO: 931569 - DNA, 13 bp, Homo sapiens
ctggcccagccaa

SEQ ID NO: 931570 - DNA, 20 bp, Homo sapiens
ctggcccagccaaaccctgt

SEQ ID NO: 931571 - DNA, 19 bp, Homo sapiens
ctggcccagccggcctctc

SEQ ID NO: 931572 - DNA, 23 bp, Homo sapiens
ctggcccagccggcctctctggc

SEQ ID NO: 931573 - DNA, 12 bp, Homo sapiens
ctggcccagcgg

SEQ ID NO: 931574 - DNA, 19 bp, Homo sapiens
ctggcccagcggcccctcc

SEQ ID NO: 931575 - DNA, 22 bp, Homo sapiens
ctggcccatctcagcctcctga

SEQ ID NO: 931576 - DNA, 13 bp, Homo sapiens
ctggccccacagg

SEQ ID NO: 931577 - DNA, 12 bp, Homo sapiens
ctggccccagcc

SEQ ID NO: 931578 - DNA, 19 bp, Homo sapiens
ctggccccagccctgctgg

SEQ ID NO: 931579 - DNA, 14 bp, Homo sapiens
ctggccccagcctg

SEQ ID NO: 931580 - DNA, 16 bp, Homo sapiens
ctggccccagcctggg

SEQ ID NO: 931581 - DNA, 13 bp, Homo sapiens
ctggccccaggac

SEQ ID NO: 931582 - DNA, 16 bp, Homo sapiens
ctggccccaggacctg

SEQ ID NO: 931583 - DNA, 12 bp, Homo sapiens
ctggccccaggc

SEQ ID NO: 931584 - DNA, 15 bp, Homo sapiens
ctggccccaggcccc

SEQ ID NO: 931585 - DNA, 17 bp, Homo sapiens
ctggccccaggccccag

SEQ ID NO: 931586 - DNA, 18 bp, Homo sapiens
ctggccccaggccccaga

SEQ ID NO: 931587 - DNA, 20 bp, Homo sapiens
cagtggctggtgcccatgaa

SEQ ID NO: 931588 - DNA, 12 bp, Homo sapiens
cagtggcttttc

SEQ ID NO: 931589 - DNA, 14 bp, Homo sapiens
cagtgggaaatatt

SEQ ID NO: 931590 - DNA, 21 bp, Homo sapiens
cagtgggaacgtgactgcccc

SEQ ID NO: 931591 - DNA, 16 bp, Homo sapiens
cagtgggaactgtgca

SEQ ID NO: 931592 - DNA, 22 bp, Homo sapiens
cagtgggacaaaccagagcaga

SEQ ID NO: 931593 - DNA, 14 bp, Homo sapiens
cagtgggagaaaac

SEQ ID NO: 931594 - DNA, 15 bp, Homo sapiens
cagtgggagccctga

SEQ ID NO: 931595 - DNA, 17 bp, Homo sapiens
cagtgggagccctgacc

SEQ ID NO: 931596 - DNA, 17 bp, Homo sapiens
cagtgggagctgagctg

SEQ ID NO: 931597 - DNA, 15 bp, Homo sapiens
cagtgggaggggcag

SEQ ID NO: 931598 - DNA, 21 bp, Homo sapiens
cagtgggaggggcaggctgac

SEQ ID NO: 931599 - DNA, 21 bp, Homo sapiens
cagtgggatgaaccagccggg

SEQ ID NO: 931600 - DNA, 16 bp, Homo sapiens
cagtgggatgggctct

SEQ ID NO: 931601 - DNA, 20 bp, Homo sapiens
cagtgggatgggctctacct

SEQ ID NO: 931602 - DNA, 13 bp, Homo sapiens
cagtgggcaggtg

SEQ ID NO: 931603 - DNA, 16 bp, Homo sapiens
cagtgggcctgctgag

SEQ ID NO: 931604 - DNA, 23 bp, Homo sapiens
cagtgggcctgctgaggccttct

SEQ ID NO: 931605 - DNA, 13 bp, Homo sapiens
cagtgggcctggt

SEQ ID NO: 931606 - DNA, 16 bp, Homo sapiens
cagtggggacagggag

SEQ ID NO: 931607 - DNA, 19 bp, Homo sapiens
cagtggggacagggagggg

SEQ ID NO: 931608 - DNA, 18 bp, Homo sapiens
cagtggggacccctcgca

SEQ ID NO: 931609 - DNA, 16 bp, Homo sapiens
cagtggggcctgtgga

SEQ ID NO: 931610 - DNA, 17 bp, Homo sapiens
cagtggggcctgtggaa

SEQ ID NO: 931611 - DNA, 15 bp, Homo sapiens
cagtggggctgcagg

SEQ ID NO: 931612 - DNA, 13 bp, Homo sapiens
cagtgggtggcac

SEQ ID NO: 931613 - DNA, 16 bp, Homo sapiens
cagtgggtggcacctc

SEQ ID NO: 931614 - DNA, 21 bp, Homo sapiens
cagtgggtggcacctcctgag

SEQ ID NO: 931615 - DNA, 16 bp, Homo sapiens
cagtggtcattgggca

SEQ ID NO: 931616 - DNA, 14 bp, Homo sapiens
cagtggtgaagaaa

SEQ ID NO: 931617 - DNA, 15 bp, Homo sapiens
ctgataccactgcac

SEQ ID NO: 931618 - DNA, 15 bp, Homo sapiens
ctgatacgtgtatga

SEQ ID NO: 931619 - DNA, 18 bp, Homo sapiens
ctgatactttagccatca

SEQ ID NO: 931620 - DNA, 20 bp, Homo sapiens
ctgatactttgacagtgttt

SEQ ID NO: 931621 - DNA, 14 bp, Homo sapiens
ctgatagaaagcaa

SEQ ID NO: 931622 - DNA, 23 bp, Homo sapiens
ctgatagaaatggtttcctctgg

SEQ ID NO: 931623 - DNA, 19 bp, Homo sapiens
ctgatagctgtttcaaatg

SEQ ID NO: 931624 - DNA, 17 bp, Homo sapiens
ctgatagcttacactga

SEQ ID NO: 931625 - DNA, 21 bp, Homo sapiens
ctgatatatgtgtttttcaca

SEQ ID NO: 931626 - DNA, 18 bp, Homo sapiens
ctgatattaaagatttct

SEQ ID NO: 931627 - DNA, 12 bp, Homo sapiens
ctgatattaatc

SEQ ID NO: 931628 - DNA, 16 bp, Homo sapiens
ctgatattaatcaaaa

SEQ ID NO: 931629 - DNA, 17 bp, Homo sapiens
ctgatattaatcaaaat

SEQ ID NO: 931630 - DNA, 21 bp, Homo sapiens
ctgatattaatcaaaattgtc

SEQ ID NO: 931631 - DNA, 16 bp, Homo sapiens
ctgatattatggcaag

SEQ ID NO: 931632 - DNA, 18 bp, Homo sapiens
ctgatattatttcttctc

SEQ ID NO: 931633 - DNA, 19 bp, Homo sapiens
ctgatattgccgcactagg

SEQ ID NO: 931634 - DNA, 23 bp, Homo sapiens
ctgatcaagagtccggatttcta

SEQ ID NO: 931635 - DNA, 18 bp, Homo sapiens
ctgatcaagtcaccggag

SEQ ID NO: 931636 - DNA, 20 bp, Homo sapiens
cagattcccagaccttaaga

SEQ ID NO: 931637 - DNA, 17 bp, Homo sapiens
cagattcccagagcaaa

SEQ ID NO: 931638 - DNA, 18 bp, Homo sapiens
cagattcctgggcctgtc

SEQ ID NO: 931639 - DNA, 21 bp, Homo sapiens
cagattctgacatttatattt

SEQ ID NO: 931640 - DNA, 14 bp, Homo sapiens
cagattctgcctct

SEQ ID NO: 931641 - DNA, 12 bp, Homo sapiens
cagattcttcag

SEQ ID NO: 931642 - DNA, 17 bp, Homo sapiens
cagattgctctgcccca

SEQ ID NO: 931643 - DNA, 18 bp, Homo sapiens
cagattgctgaaactgtg

SEQ ID NO: 931644 - DNA, 17 bp, Homo sapiens
cagattgtggaatgttg

SEQ ID NO: 931645 - DNA, 13 bp, Homo sapiens
cagattgtttcct

SEQ ID NO: 931646 - DNA, 13 bp, Homo sapiens
cagatttacactg

SEQ ID NO: 931647 - DNA, 22 bp, Homo sapiens
cagatttagtgaaagctagaga

SEQ ID NO: 931648 - DNA, 19 bp, Homo sapiens
cagatttccattgtgtggc

SEQ ID NO: 931649 - DNA, 20 bp, Homo sapiens
cagatttccattgtgtggcc

SEQ ID NO: 931650 - DNA, 15 bp, Homo sapiens
cagatttctgaggaa

SEQ ID NO: 931651 - DNA, 14 bp, Homo sapiens
cagatttgagctca

SEQ ID NO: 931652 - DNA, 18 bp, Homo sapiens
cagatttggcttgacaaa

SEQ ID NO: 931653 - DNA, 14 bp, Homo sapiens
cagatttgtgttat

SEQ ID NO: 931654 - DNA, 15 bp, Homo sapiens
cagattttaattttg

SEQ ID NO: 931655 - DNA, 23 bp, Homo sapiens
cagattttaattttgaataaata

SEQ ID NO: 931656 - DNA, 14 bp, Homo sapiens
cagattttacaaaa

SEQ ID NO: 931657 - DNA, 17 bp, Homo sapiens
cagattttacaaaagat

SEQ ID NO: 931658 - DNA, 22 bp, Homo sapiens
cagattttcagcaaactctttt

SEQ ID NO: 931659 - DNA, 16 bp, Homo sapiens
cagattttgctgtata

SEQ ID NO: 931660 - DNA, 17 bp, Homo sapiens
cagattttgctgtatat

SEQ ID NO: 931661 - DNA, 23 bp, Homo sapiens
cagattttgctgtatatttgtga

SEQ ID NO: 931662 - DNA, 20 bp, Homo sapiens
cagattttggggttgtgttg

SEQ ID NO: 931663 - DNA, 21 bp, Homo sapiens
cagattttggggttgtgttgt

SEQ ID NO: 931664 - DNA, 22 bp, Homo sapiens
cagatttttacactaatatatg

SEQ ID NO: 931665 - DNA, 16 bp, Homo sapiens
cagattttttaaaatt

SEQ ID NO: 931666 - DNA, 19 bp, Homo sapiens
cagattttttacagctgcc

SEQ ID NO: 931667 - DNA, 16 bp, Homo sapiens
cagcaaaaactgtggg

SEQ ID NO: 931668 - DNA, 14 bp, Homo sapiens
cagcaaaaagcaaa

SEQ ID NO: 931669 - DNA, 13 bp, Homo sapiens
cagcaaaaccatt

SEQ ID NO: 931670 - DNA, 17 bp, Homo sapiens
cagcaaaaccattgctt

SEQ ID NO: 931671 - DNA, 15 bp, Homo sapiens
cagcaaaactccatc

SEQ ID NO: 931672 - DNA, 18 bp, Homo sapiens
cagcaaaagatgcttctc

SEQ ID NO: 931673 - DNA, 22 bp, Homo sapiens
cagcaaaatggaagcaaagaca

SEQ ID NO: 931674 - DNA, 14 bp, Homo sapiens
cagcaaacagctga

SEQ ID NO: 931675 - DNA, 14 bp, Homo sapiens
cagcaaacaggtgc

SEQ ID NO: 931676 - DNA, 24 bp, Homo sapiens
cagcaaaccatttttaaagtagaa

SEQ ID NO: 931677 - DNA, 14 bp, Homo sapiens
cagcaaaccggggc

SEQ ID NO: 931678 - DNA, 20 bp, Homo sapiens
cagcaaactcttttcccact

SEQ ID NO: 931679 - DNA, 11 bp, Homo sapiens
cagcaaagaat

SEQ ID NO: 931680 - DNA, 19 bp, Homo sapiens
cagcaaagctacaggactg

SEQ ID NO: 931681 - DNA, 18 bp, Homo sapiens
cagcaaaggtcttgaata

SEQ ID NO: 931682 - DNA, 14 bp, Homo sapiens
cagcaaataaatac

SEQ ID NO: 931683 - DNA, 13 bp, Homo sapiens
cagcaaattttca

SEQ ID NO: 931684 - DNA, 17 bp, Homo sapiens
cagcaacaagactgcca

SEQ ID NO: 931685 - DNA, 20 bp, Homo sapiens
cagcaacaagactgccaggt

SEQ ID NO: 931686 - DNA, 22 bp, Homo sapiens
cagcaacaagactgccaggtgg

SEQ ID NO: 931687 - DNA, 16 bp, Homo sapiens
cagcaacacaagctgg

SEQ ID NO: 931688 - DNA, 16 bp, Homo sapiens
cagcaacactccggtc

SEQ ID NO: 931689 - DNA, 16 bp, Homo sapiens
cagcaaccccaggctg

SEQ ID NO: 931690 - DNA, 21 bp, Homo sapiens
cagcaacctgtaactcacatt

SEQ ID NO: 931691 - DNA, 15 bp, Homo sapiens
cagcaacgcccctcc

SEQ ID NO: 931692 - DNA, 16 bp, Homo sapiens
cagcaacgcccctcca

SEQ ID NO: 931693 - DNA, 19 bp, Homo sapiens
cagcaacgcccctccaaac

SEQ ID NO: 931694 - DNA, 15 bp, Homo sapiens
cagcaactgaataaa

SEQ ID NO: 931695 - DNA, 21 bp, Homo sapiens
cagcaactgaataaatacctc

SEQ ID NO: 931696 - DNA, 14 bp, Homo sapiens
cagcaactgacctg

SEQ ID NO: 931697 - DNA, 20 bp, Homo sapiens
cagcaacttcttctccatcc

SEQ ID NO: 931698 - DNA, 15 bp, Homo sapiens
cagcaacttgtcttt

SEQ ID NO: 931699 - DNA, 15 bp, Homo sapiens
cagcaagaatattgt

SEQ ID NO: 931700 - DNA, 13 bp, Homo sapiens
cagcaagacctca

SEQ ID NO: 931701 - DNA, 17 bp, Homo sapiens
cagcaagagcacaagag

SEQ ID NO: 931702 - DNA, 20 bp, Homo sapiens
cagcaaggaaatgtcctgca

SEQ ID NO: 931703 - DNA, 22 bp, Homo sapiens
cagcaaggaaatgtcctgcatg

SEQ ID NO: 931704 - DNA, 18 bp, Homo sapiens
cagcaaggagatttacaa

SEQ ID NO: 931705 - DNA, 10 bp, Homo sapiens
cagcaaggcc

SEQ ID NO: 931706 - DNA, 22 bp, Homo sapiens
cagcaaggccttggtggagcag

SEQ ID NO: 931707 - DNA, 13 bp, Homo sapiens
cagcaagggacct

SEQ ID NO: 931708 - DNA, 17 bp, Homo sapiens
cagcaagggacctgctc

SEQ ID NO: 931709 - DNA, 18 bp, Homo sapiens
cagcaagggacctgctca

SEQ ID NO: 931710 - DNA, 13 bp, Homo sapiens
cagcaagtcccag

SEQ ID NO: 931711 - DNA, 14 bp, Homo sapiens
cagcaagtcccaga

SEQ ID NO: 931712 - DNA, 20 bp, Homo sapiens
cagcaagtcccagacaagga

SEQ ID NO: 931713 - DNA, 21 bp, Homo sapiens
cagcaagtcccagacaaggag

SEQ ID NO: 931714 - DNA, 22 bp, Homo sapiens
cagcaagtcccagacaaggaga

SEQ ID NO: 931715 - DNA, 13 bp, Homo sapiens
cagcaataaaaac

SEQ ID NO: 931716 - DNA, 22 bp, Homo sapiens
cagcaataaagcagcgtttcta

SEQ ID NO: 931717 - DNA, 13 bp, Homo sapiens
cagcaataagaaa

SEQ ID NO: 931718 - DNA, 19 bp, Homo sapiens
cagcaataagaaatgaaca

SEQ ID NO: 931719 - DNA, 21 bp, Homo sapiens
cagcaataagaaatgaacaaa

SEQ ID NO: 931720 - DNA, 15 bp, Homo sapiens
cagcaatagagacgg

SEQ ID NO: 931721 - DNA, 21 bp, Homo sapiens
cagcaatattgcctgtgcttc

SEQ ID NO: 931722 - DNA, 21 bp, Homo sapiens
cagcaatctgcattttaacaa

SEQ ID NO: 931723 - DNA, 18 bp, Homo sapiens
cagcaatgatgtccagaa

SEQ ID NO: 931724 - DNA, 20 bp, Homo sapiens
cagcaatgatgtccagaaga

SEQ ID NO: 931725 - DNA, 15 bp, Homo sapiens
cagcaattctctttc

SEQ ID NO: 931726 - DNA, 15 bp, Homo sapiens
cagcaatttaaatgt

SEQ ID NO: 931727 - DNA, 16 bp, Homo sapiens
cagcaatttaaatgtt

SEQ ID NO: 931728 - DNA, 12 bp, Homo sapiens
cagcaatttaga

SEQ ID NO: 931729 - DNA, 15 bp, Homo sapiens
cagcaatttcagaac

SEQ ID NO: 931730 - DNA, 13 bp, Homo sapiens
cagcaatttctaa

SEQ ID NO: 931731 - DNA, 13 bp, Homo sapiens
cagcacaaggaat

SEQ ID NO: 931732 - DNA, 22 bp, Homo sapiens
cagcacaaggccttgcctggcc

SEQ ID NO: 931733 - DNA, 15 bp, Homo sapiens
cagcacaattctgtc

SEQ ID NO: 931734 - DNA, 20 bp, Homo sapiens
cagcacaattctgtccctgt

SEQ ID NO: 931735 - DNA, 24 bp, Homo sapiens
cagcacaattctgtccctgtccct

SEQ ID NO: 931736 - DNA, 20 bp, Homo sapiens
cagcacacacttacagagca

SEQ ID NO: 931737 - DNA, 18 bp, Homo sapiens
ctctgctgcctctgtgga

SEQ ID NO: 931738 - DNA, 14 bp, Homo sapiens
ctctgctgctctga

SEQ ID NO: 931739 - DNA, 16 bp, Homo sapiens
ctctgctgctctgacc

SEQ ID NO: 931740 - DNA, 22 bp, Homo sapiens
ctctgctgctgtccctccccct

SEQ ID NO: 931741 - DNA, 13 bp, Homo sapiens
ctctgctgcttag

SEQ ID NO: 931742 - DNA, 12 bp, Homo sapiens
ctctgctggaag

SEQ ID NO: 931743 - DNA, 23 bp, Homo sapiens
ctctgctggaaggggcagcagga

SEQ ID NO: 931744 - DNA, 13 bp, Homo sapiens
ctctgctggcctg

SEQ ID NO: 931745 - DNA, 14 bp, Homo sapiens
ctctgctggcctgg

SEQ ID NO: 931746 - DNA, 17 bp, Homo sapiens
ctctgctggcctggccg

SEQ ID NO: 931747 - DNA, 13 bp, Homo sapiens
ctctgctgggtct

SEQ ID NO: 931748 - DNA, 23 bp, Homo sapiens
ctctgctgtacatatttgagact

SEQ ID NO: 931749 - DNA, 13 bp, Homo sapiens
ctctgcttaaaca

SEQ ID NO: 931750 - DNA, 16 bp, Homo sapiens
ctctgcttcagtccac

SEQ ID NO: 931751 - DNA, 21 bp, Homo sapiens
ctctgcttccatggcttcctg

SEQ ID NO: 931752 - DNA, 18 bp, Homo sapiens
ctctgcttctccaaggaa

SEQ ID NO: 931753 - DNA, 14 bp, Homo sapiens
ctctgcttctctga

SEQ ID NO: 931754 - DNA, 16 bp, Homo sapiens
ctctgcttctttgcct

SEQ ID NO: 931755 - DNA, 21 bp, Homo sapiens
ctctgctttccttttctctgc

SEQ ID NO: 931756 - DNA, 18 bp, Homo sapiens
ctctggaaaactattgag

SEQ ID NO: 931757 - DNA, 22 bp, Homo sapiens
ctctggaaagaggctctggaca

SEQ ID NO: 931758 - DNA, 13 bp, Homo sapiens
ctctggaaagcaa

SEQ ID NO: 931759 - DNA, 14 bp, Homo sapiens
ctctggaacccccc

SEQ ID NO: 931760 - DNA, 19 bp, Homo sapiens
ctctggaaccccccaggcc

SEQ ID NO: 931761 - DNA, 21 bp, Homo sapiens
ctctggaaccccccaggccct

SEQ ID NO: 931762 - DNA, 18 bp, Homo sapiens
ctctggaagccctggaga

SEQ ID NO: 931763 - DNA, 15 bp, Homo sapiens
ctctggaaggggcag

SEQ ID NO: 931764 - DNA, 17 bp, Homo sapiens
ctctggaaggggcagcc

SEQ ID NO: 931765 - DNA, 18 bp, Homo sapiens
ctctggaaggggcagccc

SEQ ID NO: 931766 - DNA, 15 bp, Homo sapiens
ctctggaataaagtt

SEQ ID NO: 931767 - DNA, 22 bp, Homo sapiens
ctctggaataaagttgcagatg

SEQ ID NO: 931768 - DNA, 17 bp, Homo sapiens
ctctgaaagagaaacac

SEQ ID NO: 931769 - DNA, 15 bp, Homo sapiens
ctctgaaataaaatg

SEQ ID NO: 931770 - DNA, 22 bp, Homo sapiens
ctctgaaatctgaagacctcga

SEQ ID NO: 931771 - DNA, 21 bp, Homo sapiens
ctctgaaattaaagaaatgaa

SEQ ID NO: 931772 - DNA, 22 bp, Homo sapiens
ctctgaacacacacgccagctc

SEQ ID NO: 931773 - DNA, 12 bp, Homo sapiens
ctctgaacacat

SEQ ID NO: 931774 - DNA, 18 bp, Homo sapiens
ctctgaactgcaacactg

SEQ ID NO: 931775 - DNA, 15 bp, Homo sapiens
ctctgaacttgcctt

SEQ ID NO: 931776 - DNA, 22 bp, Homo sapiens
ctctgaagagtgggtttcacaa

SEQ ID NO: 931777 - DNA, 20 bp, Homo sapiens
ctctgaagcatgtttcatgt

SEQ ID NO: 931778 - DNA, 17 bp, Homo sapiens
ctctgaagcgactctcc

SEQ ID NO: 931779 - DNA, 20 bp, Homo sapiens
ctctgaagctaattgtacta

SEQ ID NO: 931780 - DNA, 17 bp, Homo sapiens
ctctgaagggcatcatg

SEQ ID NO: 931781 - DNA, 13 bp, Homo sapiens
ctctgaagtcaca

SEQ ID NO: 931782 - DNA, 17 bp, Homo sapiens
ctctgaagttggacagc

SEQ ID NO: 931783 - DNA, 15 bp, Homo sapiens
ctctgaatacacagt

SEQ ID NO: 931784 - DNA, 18 bp, Homo sapiens
ctctgaatacacagtatt

SEQ ID NO: 931785 - DNA, 17 bp, Homo sapiens
ctctgaatcagaaaagc

SEQ ID NO: 931786 - DNA, 16 bp, Homo sapiens
ctctgaatctgtacat

SEQ ID NO: 931787 - DNA, 17 bp, Homo sapiens
ctctgaatctgtacatg

SEQ ID NO: 931788 - DNA, 17 bp, Homo sapiens
ctctgaattttcagaga

SEQ ID NO: 931789 - DNA, 15 bp, Homo sapiens
ctctgacagcagcct

SEQ ID NO: 931790 - DNA, 12 bp, Homo sapiens
ctctgacagctc

SEQ ID NO: 931791 - DNA, 17 bp, Homo sapiens
ctctgacagtccacagg

SEQ ID NO: 931792 - DNA, 20 bp, Homo sapiens
ctctgacagtccacaggggc

SEQ ID NO: 931793 - DNA, 13 bp, Homo sapiens
ctctgacatccct

SEQ ID NO: 931794 - DNA, 15 bp, Homo sapiens
ctctgacatcccttc

SEQ ID NO: 931795 - DNA, 17 bp, Homo sapiens
ctctgacatcccttcct

SEQ ID NO: 931796 - DNA, 20 bp, Homo sapiens
ctctgacatcccttcctgga

SEQ ID NO: 931797 - DNA, 21 bp, Homo sapiens
ctctgacatcccttcctggaa

SEQ ID NO: 931798 - DNA, 16 bp, Homo sapiens
ctctgaccacagcccg

SEQ ID NO: 931799 - DNA, 13 bp, Homo sapiens
ctctgaccccagc

SEQ ID NO: 931800 - DNA, 22 bp, Homo sapiens
ctctgacccggttgcagtcact

SEQ ID NO: 931801 - DNA, 15 bp, Homo sapiens
ctctgacctctgctg

SEQ ID NO: 931802 - DNA, 16 bp, Homo sapiens
ctctgacctctgctga

SEQ ID NO: 931803 - DNA, 20 bp, Homo sapiens
ctctgacctctgctgagtgc

SEQ ID NO: 931804 - DNA, 14 bp, Homo sapiens
ctctgacctgcact

SEQ ID NO: 931805 - DNA, 13 bp, Homo sapiens
ctctgacctgcag

SEQ ID NO: 931806 - DNA, 14 bp, Homo sapiens
ctctgacctgcagg

SEQ ID NO: 931807 - DNA, 13 bp, Homo sapiens
ctctgacctgcct

SEQ ID NO: 931808 - DNA, 19 bp, Homo sapiens
ctctgaccttccagagccc

SEQ ID NO: 931809 - DNA, 17 bp, Homo sapiens
ctctgacgcaccactgc

SEQ ID NO: 931810 - DNA, 23 bp, Homo sapiens
ctctgacgcttgtgacagtgcct

SEQ ID NO: 931811 - DNA, 16 bp, Homo sapiens
ctctgacgtagaaaga

SEQ ID NO: 931812 - DNA, 14 bp, Homo sapiens
ctctgactcagggc

SEQ ID NO: 931813 - DNA, 15 bp, Homo sapiens
ctctgactcagggct

SEQ ID NO: 931814 - DNA, 20 bp, Homo sapiens
ctctgactcagggctcctgg

SEQ ID NO: 931815 - DNA, 21 bp, Homo sapiens
ctctgactcagggctcctggg

SEQ ID NO: 931816 - DNA, 19 bp, Homo sapiens
ctctgacttaagcaaaaga

SEQ ID NO: 931817 - DNA, 22 bp, Homo sapiens
ctctgacttaagcaaaagaaaa

SEQ ID NO: 931818 - DNA, 23 bp, Homo sapiens
ctctgagaaaatgcgagactctg

SEQ ID NO: 931819 - DNA, 13 bp, Homo sapiens
ctctgagaatcac

SEQ ID NO: 931820 - DNA, 20 bp, Homo sapiens
ctctgagaattgttgagata

SEQ ID NO: 931821 - DNA, 21 bp, Homo sapiens
ctctgagcacatagtgtcctg

SEQ ID NO: 931822 - DNA, 22 bp, Homo sapiens
ctctgagcacatagtgtcctgc

SEQ ID NO: 931823 - DNA, 12 bp, Homo sapiens
ctctgagcaggg

SEQ ID NO: 931824 - DNA, 13 bp, Homo sapiens
ctctgagcagggg

SEQ ID NO: 931825 - DNA, 15 bp, Homo sapiens
ctctgagcaggggca

SEQ ID NO: 931826 - DNA, 22 bp, Homo sapiens
ctctgagcaggggcaggcgcag

SEQ ID NO: 931827 - DNA, 14 bp, Homo sapiens
ctctgagcagtcag

SEQ ID NO: 931828 - DNA, 22 bp, Homo sapiens
ctctgagccaagggagggaagg

SEQ ID NO: 931829 - DNA, 14 bp, Homo sapiens
ctctgagcccaggc

SEQ ID NO: 931830 - DNA, 17 bp, Homo sapiens
ctctgagcccaggccgt

SEQ ID NO: 931831 - DNA, 13 bp, Homo sapiens
ctctgagcccatg

SEQ ID NO: 931832 - DNA, 13 bp, Homo sapiens
ctctgagcgcctc

SEQ ID NO: 931833 - DNA, 15 bp, Homo sapiens
ctctgagcgggaggc

SEQ ID NO: 931834 - DNA, 15 bp, Homo sapiens
ctctgagctgctcac

SEQ ID NO: 931835 - DNA, 17 bp, Homo sapiens
ctctgagctgctcaccg

SEQ ID NO: 931836 - DNA, 19 bp, Homo sapiens
ctctgaggatgatgtactt

SEQ ID NO: 931837 - DNA, 13 bp, Homo sapiens
ctctgaggcactc

SEQ ID NO: 931838 - DNA, 20 bp, Homo sapiens
ctctgaggcactcatctact

SEQ ID NO: 931839 - DNA, 19 bp, Homo sapiens
ctctgaggctctttctggg

SEQ ID NO: 931840 - DNA, 16 bp, Homo sapiens
ctctgaggcttccaga

SEQ ID NO: 931841 - DNA, 18 bp, Homo sapiens
ctctgaggcttccagaga

SEQ ID NO: 931842 - DNA, 21 bp, Homo sapiens
ctctgaggcttccagagagtc

SEQ ID NO: 931843 - DNA, 18 bp, Homo sapiens
ctctgaggggaggcacct

SEQ ID NO: 931844 - DNA, 21 bp, Homo sapiens
ctctgaggggctaccaggaaa

SEQ ID NO: 931845 - DNA, 22 bp, Homo sapiens
ctctgagggtgatggggctgag

SEQ ID NO: 931846 - DNA, 15 bp, Homo sapiens
ctctgaggtcaataa

SEQ ID NO: 931847 - DNA, 19 bp, Homo sapiens
ctctgaggtcaataaagca

SEQ ID NO: 931848 - DNA, 15 bp, Homo sapiens
ctctgaggtgcctgt

SEQ ID NO: 931849 - DNA, 12 bp, Homo sapiens
ctctgagtgtga

SEQ ID NO: 931850 - DNA, 16 bp, Homo sapiens
ctctgagtttaccatt

SEQ ID NO: 931851 - DNA, 18 bp, Homo sapiens
ctctgagtttaccatttg

SEQ ID NO: 931852 - DNA, 13 bp, Homo sapiens
ctctgagtttttg

SEQ ID NO: 931853 - DNA, 16 bp, Homo sapiens
ctctgagtttttgtat

SEQ ID NO: 931854 - DNA, 21 bp, Homo sapiens
ctctgataatatattttcaag

SEQ ID NO: 931855 - DNA, 23 bp, Homo sapiens
ctctgatacagacagcagtctag

SEQ ID NO: 931856 - DNA, 19 bp, Homo sapiens
ctctgatattccatgaatg

SEQ ID NO: 931857 - DNA, 15 bp, Homo sapiens
ctctgatctccatgg

SEQ ID NO: 931858 - DNA, 16 bp, Homo sapiens
ctctgatgcagaaatt

SEQ ID NO: 931859 - DNA, 13 bp, Homo sapiens
ctctgatgcagct

SEQ ID NO: 931860 - DNA, 22 bp, Homo sapiens
ctctgatggaatgtgccacctg

SEQ ID NO: 931861 - DNA, 14 bp, Homo sapiens
ctctgatgtcccag

SEQ ID NO: 931862 - DNA, 16 bp, Homo sapiens
ctctgatgtcccagtg

SEQ ID NO: 931863 - DNA, 14 bp, Homo sapiens
ctctgattcacctc

SEQ ID NO: 931864 - DNA, 16 bp, Homo sapiens
ctctgattcacctctt

SEQ ID NO: 931865 - DNA, 19 bp, Homo sapiens
ctctgattcacctcttcct

SEQ ID NO: 931866 - DNA, 21 bp, Homo sapiens
ctctgattggaatttctggcc

SEQ ID NO: 931867 - DNA, 14 bp, Homo sapiens
ctctgattgttccc

SEQ ID NO: 931868 - DNA, 14 bp, Homo sapiens
ctctgatttccttc

SEQ ID NO: 931869 - DNA, 14 bp, Homo sapiens
ctctgatttgcaaa

SEQ ID NO: 931870 - DNA, 18 bp, Homo sapiens
ctctgatttgcaaaaaaa

SEQ ID NO: 931871 - DNA, 18 bp, Homo sapiens
ctctgattttcaaagctt

SEQ ID NO: 931872 - DNA, 18 bp, Homo sapiens
ctctgcaaaggcctgggc

SEQ ID NO: 931873 - DNA, 20 bp, Homo sapiens
ctctgcaattcccctctgct

SEQ ID NO: 931874 - DNA, 21 bp, Homo sapiens
ctctgcaattcccctctgctg

SEQ ID NO: 931875 - DNA, 22 bp, Homo sapiens
ctctgcaattcccctctgctgc

SEQ ID NO: 931876 - DNA, 13 bp, Homo sapiens
ctctgcacccctc

SEQ ID NO: 931877 - DNA, 13 bp, Homo sapiens
ctctgcactactc

SEQ ID NO: 931878 - DNA, 22 bp, Homo sapiens
ctctgcactactcctctgcagt

SEQ ID NO: 931879 - DNA, 16 bp, Homo sapiens
ctctgcactactgaca

SEQ ID NO: 931880 - DNA, 14 bp, Homo sapiens
ctctgcactccatg

SEQ ID NO: 931881 - DNA, 23 bp, Homo sapiens
ctctgcactcccacctgacacac

SEQ ID NO: 931882 - DNA, 18 bp, Homo sapiens
ctctgcagacttcccagc

SEQ ID NO: 931883 - DNA, 14 bp, Homo sapiens
ctctgcagccagcc

SEQ ID NO: 931884 - DNA, 13 bp, Homo sapiens
ctctgcagcccag

SEQ ID NO: 931885 - DNA, 14 bp, Homo sapiens
ctctgcagcccagc

SEQ ID NO: 931886 - DNA, 14 bp, Homo sapiens
ctctgcagctgacc

SEQ ID NO: 931887 - DNA, 15 bp, Homo sapiens
ctctgcagctgacct

SEQ ID NO: 931888 - DNA, 12 bp, Homo sapiens
ctctgcaggcca

SEQ ID NO: 931889 - DNA, 19 bp, Homo sapiens
ctctgcagtaaaacacatt

SEQ ID NO: 931890 - DNA, 15 bp, Homo sapiens
ctctgcagtgccttg

SEQ ID NO: 931891 - DNA, 14 bp, Homo sapiens
ctctgcatcccagc

SEQ ID NO: 931892 - DNA, 17 bp, Homo sapiens
ctctgcatcccagcacc

SEQ ID NO: 931893 - DNA, 21 bp, Homo sapiens
cagaggttcggactaacattt

SEQ ID NO: 931894 - DNA, 17 bp, Homo sapiens
cagaggtttgctgacag

SEQ ID NO: 931895 - DNA, 18 bp, Homo sapiens
cagaggtttgcttcctca

SEQ ID NO: 931896 - DNA, 22 bp, Homo sapiens
cagagtaggctattcctgagag

SEQ ID NO: 931897 - DNA, 22 bp, Homo sapiens
cagagtatgtttttaagtgtat

SEQ ID NO: 931898 - DNA, 22 bp, Homo sapiens
cagagtcaccttttctgtggct

SEQ ID NO: 931899 - DNA, 17 bp, Homo sapiens
cagagtcagaggagaag

SEQ ID NO: 931900 - DNA, 23 bp, Homo sapiens
cagagtcagaggagaagagacat

SEQ ID NO: 931901 - DNA, 18 bp, Homo sapiens
cagagtccaatttaagga

SEQ ID NO: 931902 - DNA, 14 bp, Homo sapiens
cagagtccaggccc

SEQ ID NO: 931903 - DNA, 15 bp, Homo sapiens
cagagtccaggcccc

SEQ ID NO: 931904 - DNA, 15 bp, Homo sapiens
cagagtccagtgctc

SEQ ID NO: 931905 - DNA, 17 bp, Homo sapiens
cagagtccagtgctctg

SEQ ID NO: 931906 - DNA, 20 bp, Homo sapiens
cagagtccagtgctctgcct

SEQ ID NO: 931907 - DNA, 13 bp, Homo sapiens
cagagtcccaggc

SEQ ID NO: 931908 - DNA, 23 bp, Homo sapiens
cagagtccttagtggaggggttt

SEQ ID NO: 931909 - DNA, 15 bp, Homo sapiens
cagagtcctttccaa

SEQ ID NO: 931910 - DNA, 17 bp, Homo sapiens
cagagtctcccagtggg

SEQ ID NO: 931911 - DNA, 14 bp, Homo sapiens
cagagtctgagccc

SEQ ID NO: 931912 - DNA, 19 bp, Homo sapiens
cagagtctgggcctctgac

SEQ ID NO: 931913 - DNA, 20 bp, Homo sapiens
cagagtctggtgaagctcac

SEQ ID NO: 931914 - DNA, 13 bp, Homo sapiens
cagagtctgtctc

SEQ ID NO: 931915 - DNA, 14 bp, Homo sapiens
cagagtctgtctct

SEQ ID NO: 931916 - DNA, 11 bp, Homo sapiens
cagagtgaacc

SEQ ID NO: 931917 - DNA, 15 bp, Homo sapiens
cagagtgacagtcat

SEQ ID NO: 931918 - DNA, 16 bp, Homo sapiens
cagagtgacagtcata

SEQ ID NO: 931919 - DNA, 14 bp, Homo sapiens
cagagtgaccctca

SEQ ID NO: 931920 - DNA, 21 bp, Homo sapiens
cagagtgaccctcagctgtca

SEQ ID NO: 931921 - DNA, 20 bp, Homo sapiens
cagagtgagaccctgtctct

SEQ ID NO: 931922 - DNA, 11 bp, Homo sapiens
cagagtgagcc

SEQ ID NO: 931923 - DNA, 17 bp, Homo sapiens
cagagtgaggatgtgtt

SEQ ID NO: 931924 - DNA, 20 bp, Homo sapiens
cagagtgcaagcccctgctc

SEQ ID NO: 931925 - DNA, 15 bp, Homo sapiens
cagagtgctggactg

SEQ ID NO: 931926 - DNA, 16 bp, Homo sapiens
cagagtgctggactgt

SEQ ID NO: 931927 - DNA, 16 bp, Homo sapiens
cagagtgctgtcggga

SEQ ID NO: 931928 - DNA, 20 bp, Homo sapiens
cagagtgctgtcgggaccac

SEQ ID NO: 931929 - DNA, 23 bp, Homo sapiens
cagagtgctgtcgggaccacatc

SEQ ID NO: 931930 - DNA, 15 bp, Homo sapiens
cagagtggactgcat

SEQ ID NO: 931931 - DNA, 15 bp, Homo sapiens
cagagtggagtctga

SEQ ID NO: 931932 - DNA, 13 bp, Homo sapiens
cagagtggcccac

SEQ ID NO: 931933 - DNA, 16 bp, Homo sapiens
cagagtggcctagagc

SEQ ID NO: 931934 - DNA, 16 bp, Homo sapiens
cagagtggcctccctg

SEQ ID NO: 931935 - DNA, 12 bp, Homo sapiens
cagagtggcctg

SEQ ID NO: 931936 - DNA, 17 bp, Homo sapiens
cagagtggcctggccag

SEQ ID NO: 931937 - DNA, 21 bp, Homo sapiens
cagagtggcctggccaggagc

SEQ ID NO: 931938 - DNA, 12 bp, Homo sapiens
cagagtggctca

SEQ ID NO: 931939 - DNA, 23 bp, Homo sapiens
cagagtgggacttggagagcaaa

SEQ ID NO: 931940 - DNA, 20 bp, Homo sapiens
cagagtgggagaggctggga

SEQ ID NO: 931941 - DNA, 21 bp, Homo sapiens
cagagtgggagaggctgggag

SEQ ID NO: 931942 - DNA, 20 bp, Homo sapiens
cagagtggtttccaatgtgt

SEQ ID NO: 931943 - DNA, 19 bp, Homo sapiens
cagagtgtagggggccttg

SEQ ID NO: 931944 - DNA, 14 bp, Homo sapiens
cagagtgtattaca

SEQ ID NO: 931945 - DNA, 19 bp, Homo sapiens
cagagtgtgcagactgatg

SEQ ID NO: 931946 - DNA, 16 bp, Homo sapiens
cagagtgtgctgctat

SEQ ID NO: 931947 - DNA, 13 bp, Homo sapiens
cagagttaaagca

SEQ ID NO: 931948 - DNA, 15 bp, Homo sapiens
cagagttaaagcata

SEQ ID NO: 931949 - DNA, 14 bp, Homo sapiens
cagagttacagttc

SEQ ID NO: 931950 - DNA, 15 bp, Homo sapiens
cagagttacagttct

SEQ ID NO: 931951 - DNA, 19 bp, Homo sapiens
cagagttacagttctgtgg

SEQ ID NO: 931952 - DNA, 21 bp, Homo sapiens
cagagttaggttgtctccagg

SEQ ID NO: 931953 - DNA, 21 bp, Homo sapiens
cagagttattgaatcttaatt

SEQ ID NO: 931954 - DNA, 22 bp, Homo sapiens
cagagttattgaatcttaattt

SEQ ID NO: 931955 - DNA, 17 bp, Homo sapiens
cagagttcctgcggagt

SEQ ID NO: 931956 - DNA, 22 bp, Homo sapiens
cagagttcctgcggagtgaaga

SEQ ID NO: 931957 - DNA, 23 bp, Homo sapiens
cagagttcctgcggagtgaagag

SEQ ID NO: 931958 - DNA, 15 bp, Homo sapiens
cagagttctgctcta

SEQ ID NO: 931959 - DNA, 20 bp, Homo sapiens
cagagttgctgcaaacctga

SEQ ID NO: 931960 - DNA, 20 bp, Homo sapiens
cagagttgctgggagctgaa

SEQ ID NO: 931961 - DNA, 17 bp, Homo sapiens
cagagttgcttaatgaa

SEQ ID NO: 931962 - DNA, 13 bp, Homo sapiens
cagagttgtaaat

SEQ ID NO: 931963 - DNA, 17 bp, Homo sapiens
cagagttgtaaatatat

SEQ ID NO: 931964 - DNA, 19 bp, Homo sapiens
cagagttgttacattttta

SEQ ID NO: 931965 - DNA, 15 bp, Homo sapiens
cagagtttctgcagt

SEQ ID NO: 931966 - DNA, 22 bp, Homo sapiens
cagagtttgccttcctttctcc

SEQ ID NO: 931967 - DNA, 14 bp, Homo sapiens
cagagtttgtgtgt

SEQ ID NO: 931968 - DNA, 19 bp, Homo sapiens
cagagtttgtgtgttgtct

SEQ ID NO: 931969 - DNA, 22 bp, Homo sapiens
cagataaaatattttgttaact

SEQ ID NO: 931970 - DNA, 16 bp, Homo sapiens
cagataaaatgttcag

SEQ ID NO: 931971 - DNA, 13 bp, Homo sapiens
cagataaatagaa

SEQ ID NO: 931972 - DNA, 14 bp, Homo sapiens
cagataaatagaac

SEQ ID NO: 931973 - DNA, 17 bp, Homo sapiens
cagataaatagaactat

SEQ ID NO: 931974 - DNA, 18 bp, Homo sapiens
cagataactctctttcct

SEQ ID NO: 931975 - DNA, 19 bp, Homo sapiens
cagataagaatgctggttt

SEQ ID NO: 931976 - DNA, 20 bp, Homo sapiens
cagataagcaagagagatgt

SEQ ID NO: 931977 - DNA, 15 bp, Homo sapiens
cagataagtgtaaat

SEQ ID NO: 931978 - DNA, 16 bp, Homo sapiens
cagataagtgtaaata

SEQ ID NO: 931979 - DNA, 18 bp, Homo sapiens
cagataagtgtaaataga

SEQ ID NO: 931980 - DNA, 15 bp, Homo sapiens
cagataatccctgta

SEQ ID NO: 931981 - DNA, 13 bp, Homo sapiens
cagataatgtgaa

SEQ ID NO: 931982 - DNA, 14 bp, Homo sapiens
cagataatgtgaaa

SEQ ID NO: 931983 - DNA, 16 bp, Homo sapiens
cagataatgtgaaaat

SEQ ID NO: 931984 - DNA, 15 bp, Homo sapiens
cagataattcatttg

SEQ ID NO: 931985 - DNA, 18 bp, Homo sapiens
cagataattcatttgtat

SEQ ID NO: 931986 - DNA, 17 bp, Homo sapiens
cagatacatatgagtgt

SEQ ID NO: 931987 - DNA, 15 bp, Homo sapiens
cagatacatttccct

SEQ ID NO: 931988 - DNA, 16 bp, Homo sapiens
cagatacccagtggaa

SEQ ID NO: 931989 - DNA, 13 bp, Homo sapiens
cagatacctcatc

SEQ ID NO: 931990 - DNA, 21 bp, Homo sapiens
cagatacctccaaccctgccg

SEQ ID NO: 931991 - DNA, 21 bp, Homo sapiens
cagatactggaagttttgcat

SEQ ID NO: 931992 - DNA, 22 bp, Homo sapiens
cagatactggaagttttgcatt

SEQ ID NO: 931993 - DNA, 18 bp, Homo sapiens
cagatagacagtgctgcc

SEQ ID NO: 931994 - DNA, 19 bp, Homo sapiens
cagatagacagtgctgccc

SEQ ID NO: 931995 - DNA, 13 bp, Homo sapiens
cagatagatctgt

SEQ ID NO: 931996 - DNA, 13 bp, Homo sapiens
cagatagcccagg

SEQ ID NO: 931997 - DNA, 14 bp, Homo sapiens
cagatagcccagga

SEQ ID NO: 931998 - DNA, 16 bp, Homo sapiens
cagatagcccaggagc

SEQ ID NO: 931999 - DNA, 20 bp, Homo sapiens
cagatataaatggctggttt

SEQ ID NO: 932000 - DNA, 22 bp, Homo sapiens
cagatataaatggctggttttt

SEQ ID NO: 932001 - DNA, 13 bp, Homo sapiens
cagatataactgt

SEQ ID NO: 932002 - DNA, 15 bp, Homo sapiens
cagatataactgtct

SEQ ID NO: 932003 - DNA, 23 bp, Homo sapiens
ctcactgtaacctcaaactctgg

SEQ ID NO: 932004 - DNA, 16 bp, Homo sapiens
ctcactgtctatttaa

SEQ ID NO: 932005 - DNA, 20 bp, Homo sapiens
ctcactgtctatttaagtgc

SEQ ID NO: 932006 - DNA, 12 bp, Homo sapiens
ctcactgtgatc

SEQ ID NO: 932007 - DNA, 17 bp, Homo sapiens
ctcactgtgttactgct

SEQ ID NO: 932008 - DNA, 21 bp, Homo sapiens
ctcactgtgttactgctttgc

SEQ ID NO: 932009 - DNA, 23 bp, Homo sapiens
ctcactgtgttactgctttgcaa

SEQ ID NO: 932010 - DNA, 14 bp, Homo sapiens
ctcactgttctgca

SEQ ID NO: 932011 - DNA, 15 bp, Homo sapiens
ctcactgttgaattt

SEQ ID NO: 932012 - DNA, 21 bp, Homo sapiens
ctcactgttgaattttctcta

SEQ ID NO: 932013 - DNA, 21 bp, Homo sapiens
ctcacttaccccgagacctca

SEQ ID NO: 932014 - DNA, 15 bp, Homo sapiens
ctcacttagtccttt

SEQ ID NO: 932015 - DNA, 18 bp, Homo sapiens
ctcacttcaatgtgtcat

SEQ ID NO: 932016 - DNA, 14 bp, Homo sapiens
ctcacttcaccctg

SEQ ID NO: 932017 - DNA, 18 bp, Homo sapiens
ctcacttccatacagctc

SEQ ID NO: 932018 - DNA, 18 bp, Homo sapiens
ctcacttgattcatctct

SEQ ID NO: 932019 - DNA, 21 bp, Homo sapiens
ctcacttgattcatctctggt

SEQ ID NO: 932020 - DNA, 17 bp, Homo sapiens
ctcacttgccattgcca

SEQ ID NO: 932021 - DNA, 21 bp, Homo sapiens
ctcacttgccattgccaggag

SEQ ID NO: 932022 - DNA, 22 bp, Homo sapiens
ctcacttgccattgccaggaga

SEQ ID NO: 932023 - DNA, 12 bp, Homo sapiens
ctcacttggggg

SEQ ID NO: 932024 - DNA, 16 bp, Homo sapiens
ctcactttattatccc

SEQ ID NO: 932025 - DNA, 22 bp, Homo sapiens
ctcactttccaccaagtgtcta

SEQ ID NO: 932026 - DNA, 13 bp, Homo sapiens
ctcactttcttct

SEQ ID NO: 932027 - DNA, 14 bp, Homo sapiens
ctcactttcttcta

SEQ ID NO: 932028 - DNA, 22 bp, Homo sapiens
ctcacttttaatgaacaaatgg

SEQ ID NO: 932029 - DNA, 15 bp, Homo sapiens
ctcacttttctccat

SEQ ID NO: 932030 - DNA, 18 bp, Homo sapiens
ctcactttttacccagaa

SEQ ID NO: 932031 - DNA, 21 bp, Homo sapiens
ctcagaaacgagatcgggaag

SEQ ID NO: 932032 - DNA, 10 bp, Homo sapiens
ctcagaaagt

SEQ ID NO: 932033 - DNA, 17 bp, Homo sapiens
ctcagaaagtcaccagg

SEQ ID NO: 932034 - DNA, 14 bp, Homo sapiens
ctcagaaatgctgt

SEQ ID NO: 932035 - DNA, 23 bp, Homo sapiens
ctcagaaatggacaaagaaaacg

SEQ ID NO: 932036 - DNA, 10 bp, Homo sapiens
ctcagaacat

SEQ ID NO: 932037 - DNA, 14 bp, Homo sapiens
ctcagaacatactg

SEQ ID NO: 932038 - DNA, 17 bp, Homo sapiens
ctcagaacatactgatt

SEQ ID NO: 932039 - DNA, 13 bp, Homo sapiens
ctcagaacatgag

SEQ ID NO: 932040 - DNA, 14 bp, Homo sapiens
ctcagaaccttgtc

SEQ ID NO: 932041 - DNA, 12 bp, Homo sapiens
ctcagaactgtc

SEQ ID NO: 932042 - DNA, 20 bp, Homo sapiens
ctcagaacttgctgctgtct

SEQ ID NO: 932043 - DNA, 23 bp, Homo sapiens
ctcagaacttgctgctgtcttgt

SEQ ID NO: 932044 - DNA, 13 bp, Homo sapiens
ctcagaagaaaga

SEQ ID NO: 932045 - DNA, 14 bp, Homo sapiens
ctcagaagagaaat

SEQ ID NO: 932046 - DNA, 12 bp, Homo sapiens
ctcagaagagca

SEQ ID NO: 932047 - DNA, 13 bp, Homo sapiens
ctcagaagcacag

SEQ ID NO: 932048 - DNA, 17 bp, Homo sapiens
ctcagaagcctcgactg

SEQ ID NO: 932049 - DNA, 14 bp, Homo sapiens
ctcagaagcctgag

SEQ ID NO: 932050 - DNA, 16 bp, Homo sapiens
ctcagaagcctgaggc

SEQ ID NO: 932051 - DNA, 18 bp, Homo sapiens
ctcagaagcctgaggctg

SEQ ID NO: 932052 - DNA, 15 bp, Homo sapiens
ctcagaaggccccag

SEQ ID NO: 932053 - DNA, 16 bp, Homo sapiens
ctcagaaggccccaga

SEQ ID NO: 932054 - DNA, 18 bp, Homo sapiens
ctcagaaggccccagaga

SEQ ID NO: 932055 - DNA, 21 bp, Homo sapiens
ctcagaaggccccagagagac

SEQ ID NO: 932056 - DNA, 12 bp, Homo sapiens
ctcagaagtact

SEQ ID NO: 932057 - DNA, 21 bp, Homo sapiens
ctcagaagtacttttctgttc

SEQ ID NO: 932058 - DNA, 15 bp, Homo sapiens
ctcagaatgggggct

SEQ ID NO: 932059 - DNA, 19 bp, Homo sapiens
ctcagaatttatctccctt

SEQ ID NO: 932060 - DNA, 23 bp, Homo sapiens
ctcagaatttatctcccttagaa

SEQ ID NO: 932061 - DNA, 23 bp, Homo sapiens
ctcagacactgccgacatcagca

SEQ ID NO: 932062 - DNA, 14 bp, Homo sapiens
ctcagaccagctct

SEQ ID NO: 932063 - DNA, 15 bp, Homo sapiens
ctcagaccagctctt

SEQ ID NO: 932064 - DNA, 22 bp, Homo sapiens
ctcagacccccactctcattcc

SEQ ID NO: 932065 - DNA, 23 bp, Homo sapiens
ctcagacccccactctcattccc

SEQ ID NO: 932066 - DNA, 16 bp, Homo sapiens
ctcagaccccctcagc

SEQ ID NO: 932067 - DNA, 18 bp, Homo sapiens
ctcagaccccctcagcct

SEQ ID NO: 932068 - DNA, 19 bp, Homo sapiens
ctcagaccccctcagcctt

SEQ ID NO: 932069 - DNA, 17 bp, Homo sapiens
ctcagacctttactgat

SEQ ID NO: 932070 - DNA, 17 bp, Homo sapiens
ctcagacgttgcctgag

SEQ ID NO: 932071 - DNA, 15 bp, Homo sapiens
ctcagacttgccagg

SEQ ID NO: 932072 - DNA, 17 bp, Homo sapiens
ctcagagaaggaaaaga

SEQ ID NO: 932073 - DNA, 20 bp, Homo sapiens
ctcagagaaggaaaagactg

SEQ ID NO: 932074 - DNA, 13 bp, Homo sapiens
ctcagagaccagc

SEQ ID NO: 932075 - DNA, 14 bp, Homo sapiens
ctcagagaccagca

SEQ ID NO: 932076 - DNA, 19 bp, Homo sapiens
ctcagagaccagcactcag

SEQ ID NO: 932077 - DNA, 19 bp, Homo sapiens
ctcagagagttgtctgtcc

SEQ ID NO: 932078 - DNA, 12 bp, Homo sapiens
ctcagagcagca

SEQ ID NO: 932079 - DNA, 22 bp, Homo sapiens
ctcagagcaggctcagactctg

SEQ ID NO: 932080 - DNA, 23 bp, Homo sapiens
ctcagagcaggctcagactctgg

SEQ ID NO: 932081 - DNA, 17 bp, Homo sapiens
ctcagagcaggggccag

SEQ ID NO: 932082 - DNA, 16 bp, Homo sapiens
ctcagagcatgtgtca

SEQ ID NO: 932083 - DNA, 15 bp, Homo sapiens
ctcagagccaagtcc

SEQ ID NO: 932084 - DNA, 14 bp, Homo sapiens
ctcagagcccatgg

SEQ ID NO: 932085 - DNA, 18 bp, Homo sapiens
ctcagagccctgccctgc

SEQ ID NO: 932086 - DNA, 12 bp, Homo sapiens
ctcagagcctga

SEQ ID NO: 932087 - DNA, 14 bp, Homo sapiens
ctcagagcctgacc

SEQ ID NO: 932088 - DNA, 11 bp, Homo sapiens
ctcagagcctt

SEQ ID NO: 932089 - DNA, 23 bp, Homo sapiens
ctcagagcgccaggaagccagag

SEQ ID NO: 932090 - DNA, 21 bp, Homo sapiens
ctcagagcggatgggcacaca

SEQ ID NO: 932091 - DNA, 23 bp, Homo sapiens
ctcagagcggatgggcacacaca

SEQ ID NO: 932092 - DNA, 10 bp, Homo sapiens
ctcagagctc

SEQ ID NO: 932093 - DNA, 10 bp, Homo sapiens
ctcagagctt

SEQ ID NO: 932094 - DNA, 16 bp, Homo sapiens
ctcagagcttgaagat

SEQ ID NO: 932095 - DNA, 12 bp, Homo sapiens
ctcagagctttg

SEQ ID NO: 932096 - DNA, 15 bp, Homo sapiens
ctcagagctttgtca

SEQ ID NO: 932097 - DNA, 17 bp, Homo sapiens
ctcagagctttgtcact

SEQ ID NO: 932098 - DNA, 18 bp, Homo sapiens
ctcagagctttgtcactt

SEQ ID NO: 932099 - DNA, 15 bp, Homo sapiens
ctcagaggcccccag

SEQ ID NO: 932100 - DNA, 18 bp, Homo sapiens
ctcagaggcccccagtgg

SEQ ID NO: 932101 - DNA, 15 bp, Homo sapiens
ctcagaggcctgctg

SEQ ID NO: 932102 - DNA, 14 bp, Homo sapiens
ctcagaggctgagc

SEQ ID NO: 932103 - DNA, 20 bp, Homo sapiens
ctcagaggctgagccctgta

SEQ ID NO: 932104 - DNA, 23 bp, Homo sapiens
ctcagaggctgagccctgtaccc

SEQ ID NO: 932105 - DNA, 19 bp, Homo sapiens
ctcagagggggactgctgc

SEQ ID NO: 932106 - DNA, 14 bp, Homo sapiens
ctcagagtccaggc

SEQ ID NO: 932107 - DNA, 21 bp, Homo sapiens
ctcagagtggtgggggaaggc

SEQ ID NO: 932108 - DNA, 18 bp, Homo sapiens
ctcagatacccagtggaa

SEQ ID NO: 932109 - DNA, 12 bp, Homo sapiens
ctcagatataag

SEQ ID NO: 932110 - DNA, 22 bp, Homo sapiens
ctcagatataagagaagtctca

SEQ ID NO: 932111 - DNA, 22 bp, Homo sapiens
ctcagatatagatcctgagctc

SEQ ID NO: 932112 - DNA, 14 bp, Homo sapiens
ctcagatatttata

SEQ ID NO: 932113 - DNA, 17 bp, Homo sapiens
ctcagatatttatattt

SEQ ID NO: 932114 - DNA, 17 bp, Homo sapiens
ctcagatcagtgtacca

SEQ ID NO: 932115 - DNA, 14 bp, Homo sapiens
ctcagatccttggt

SEQ ID NO: 932116 - DNA, 19 bp, Homo sapiens
ctcagatcggccacagggc

SEQ ID NO: 932117 - DNA, 14 bp, Homo sapiens
ctcagatctgatca

SEQ ID NO: 932118 - DNA, 16 bp, Homo sapiens
ctcagatggggcacca

SEQ ID NO: 932119 - DNA, 12 bp, Homo sapiens
aaatgtttggat

SEQ ID NO: 932120 - DNA, 19 bp, Homo sapiens
aaatgtttgttatttacac

SEQ ID NO: 932121 - DNA, 22 bp, Homo sapiens
aaatgttttattcggcatttaa

SEQ ID NO: 932122 - DNA, 12 bp, Homo sapiens
aaatgtttttgg

SEQ ID NO: 932123 - DNA, 14 bp, Homo sapiens
aaatgtttttggtc

SEQ ID NO: 932124 - DNA, 21 bp, Homo sapiens
aaatgtttttggtcttttata

SEQ ID NO: 932125 - DNA, 17 bp, Homo sapiens
aaattaaaaaaaaattg

SEQ ID NO: 932126 - DNA, 12 bp, Homo sapiens
aaattaaaacaa

SEQ ID NO: 932127 - DNA, 19 bp, Homo sapiens
aaattaaaacaaatataca

SEQ ID NO: 932128 - DNA, 22 bp, Homo sapiens
aaattaaaacaaatatacattt

SEQ ID NO: 932129 - DNA, 18 bp, Homo sapiens
aaattaaaacatatttca

SEQ ID NO: 932130 - DNA, 20 bp, Homo sapiens
aaattaaaacatatttcatt

SEQ ID NO: 932131 - DNA, 15 bp, Homo sapiens
aaattaaaataggca

SEQ ID NO: 932132 - DNA, 13 bp, Homo sapiens
aaattaaaatatt

SEQ ID NO: 932133 - DNA, 20 bp, Homo sapiens
aaattaaaatattatttgat

SEQ ID NO: 932134 - DNA, 13 bp, Homo sapiens
aaattaaacatgc

SEQ ID NO: 932135 - DNA, 15 bp, Homo sapiens
aaattaaacattttt

SEQ ID NO: 932136 - DNA, 23 bp, Homo sapiens
aaattaaatatatgtatgtaaaa

SEQ ID NO: 932137 - DNA, 20 bp, Homo sapiens
aaattaaatctagacattct

SEQ ID NO: 932138 - DNA, 19 bp, Homo sapiens
aaattaaatgccttgtata

SEQ ID NO: 932139 - DNA, 20 bp, Homo sapiens
aaattaaccatagatgtaga

SEQ ID NO: 932140 - DNA, 17 bp, Homo sapiens
aaattaacttgagtttt

SEQ ID NO: 932141 - DNA, 13 bp, Homo sapiens
aaattaactttta

SEQ ID NO: 932142 - DNA, 21 bp, Homo sapiens
aaattaacttttataaacttt

SEQ ID NO: 932143 - DNA, 22 bp, Homo sapiens
aaattaacttttataaacttta

SEQ ID NO: 932144 - DNA, 13 bp, Homo sapiens
aaattaagaagaa

SEQ ID NO: 932145 - DNA, 16 bp, Homo sapiens
aaattaagaagaaact

SEQ ID NO: 932146 - DNA, 20 bp, Homo sapiens
aaattaagatcctaaactct

SEQ ID NO: 932147 - DNA, 13 bp, Homo sapiens
aaattaagttgaa

SEQ ID NO: 932148 - DNA, 14 bp, Homo sapiens
aaattaagttgaaa

SEQ ID NO: 932149 - DNA, 21 bp, Homo sapiens
aaattaatacattctatgaca

SEQ ID NO: 932150 - DNA, 20 bp, Homo sapiens
aaattaatagcttttgatta

SEQ ID NO: 932151 - DNA, 12 bp, Homo sapiens
aaattaatatct

SEQ ID NO: 932152 - DNA, 17 bp, Homo sapiens
aaattaatatctttctg

SEQ ID NO: 932153 - DNA, 14 bp, Homo sapiens
aaattaattatatt

SEQ ID NO: 932154 - DNA, 14 bp, Homo sapiens
aaattaattttact

SEQ ID NO: 932155 - DNA, 22 bp, Homo sapiens
aaattacacccaaagaggtatt

SEQ ID NO: 932156 - DNA, 14 bp, Homo sapiens
aaattacagcttca

SEQ ID NO: 932157 - DNA, 13 bp, Homo sapiens
aaattacagtcat

SEQ ID NO: 932158 - DNA, 13 bp, Homo sapiens
aaattacattttt

SEQ ID NO: 932159 - DNA, 18 bp, Homo sapiens
aaattacctgtggatatt

SEQ ID NO: 932160 - DNA, 16 bp, Homo sapiens
aaattacctttaattt

SEQ ID NO: 932161 - DNA, 21 bp, Homo sapiens
aaattacctttaattttaatg

SEQ ID NO: 932162 - DNA, 23 bp, Homo sapiens
aaattacgtttgttattcctagt

SEQ ID NO: 932163 - DNA, 22 bp, Homo sapiens
aaattactaataaattgacata

SEQ ID NO: 932164 - DNA, 15 bp, Homo sapiens
aaattactacaaaat

SEQ ID NO: 932165 - DNA, 15 bp, Homo sapiens
aaattactctttctc

SEQ ID NO: 932166 - DNA, 14 bp, Homo sapiens
aaattactgtgtaa

SEQ ID NO: 932167 - DNA, 15 bp, Homo sapiens
aaattactgtgtaaa

SEQ ID NO: 932168 - DNA, 19 bp, Homo sapiens
aaattagaaaatattctct

SEQ ID NO: 932169 - DNA, 23 bp, Homo sapiens
aaattagaaaggacaacagttct

SEQ ID NO: 932170 - DNA, 20 bp, Homo sapiens
aaattagaatgaatttatct

SEQ ID NO: 932171 - DNA, 14 bp, Homo sapiens
aaattagatgaact

SEQ ID NO: 932172 - DNA, 16 bp, Homo sapiens
aaattagcatgcaagc

SEQ ID NO: 932173 - DNA, 18 bp, Homo sapiens
aaattagcatgcaagctt

SEQ ID NO: 932174 - DNA, 13 bp, Homo sapiens
aaattagctgggc

SEQ ID NO: 932175 - DNA, 17 bp, Homo sapiens
aaattagctgtgtgaaa

SEQ ID NO: 932176 - DNA, 14 bp, Homo sapiens
aaattaggaataaa

SEQ ID NO: 932177 - DNA, 16 bp, Homo sapiens
aaattaggaataaata

SEQ ID NO: 932178 - DNA, 18 bp, Homo sapiens
aaattaggtattttgtcc

SEQ ID NO: 932179 - DNA, 18 bp, Homo sapiens
aaattaggttgaaacata

SEQ ID NO: 932180 - DNA, 12 bp, Homo sapiens
aaattagtcttt

SEQ ID NO: 932181 - DNA, 20 bp, Homo sapiens
aaattagtgaccattattca

SEQ ID NO: 932182 - DNA, 22 bp, Homo sapiens
aaattataacttaaaatatttt

SEQ ID NO: 932183 - DNA, 23 bp, Homo sapiens
aaattataagagacagacacttg

SEQ ID NO: 932184 - DNA, 17 bp, Homo sapiens
aaattataagggccctg

SEQ ID NO: 932185 - DNA, 18 bp, Homo sapiens
aaattatatttgtgctat

SEQ ID NO: 932186 - DNA, 16 bp, Homo sapiens
aaattatcaatatcta

SEQ ID NO: 932187 - DNA, 14 bp, Homo sapiens
aaattatcttcacc

SEQ ID NO: 932188 - DNA, 22 bp, Homo sapiens
aaattatcttgatacattcaaa

SEQ ID NO: 932189 - DNA, 20 bp, Homo sapiens
aaattatgagtgattaagaa

SEQ ID NO: 932190 - DNA, 16 bp, Homo sapiens
aaattatgcaaaagca

SEQ ID NO: 932191 - DNA, 21 bp, Homo sapiens
aaattatgcaaaagcagctaa

SEQ ID NO: 932192 - DNA, 16 bp, Homo sapiens
aaattatggcatttct

SEQ ID NO: 932193 - DNA, 13 bp, Homo sapiens
aaattatgtaact

SEQ ID NO: 932194 - DNA, 19 bp, Homo sapiens
aaattatgtatgtttacat

SEQ ID NO: 932195 - DNA, 13 bp, Homo sapiens
aaattatgtgaaa

SEQ ID NO: 932196 - DNA, 18 bp, Homo sapiens
aaattatgtgaaatgctt

SEQ ID NO: 932197 - DNA, 20 bp, Homo sapiens
aaattatgtgacattttaca

SEQ ID NO: 932198 - DNA, 22 bp, Homo sapiens
aaattatgtgacattttacatt

SEQ ID NO: 932199 - DNA, 20 bp, Homo sapiens
aaattatgttacatctgttt

SEQ ID NO: 932200 - DNA, 13 bp, Homo sapiens
ctcctagaagaac

SEQ ID NO: 932201 - DNA, 15 bp, Homo sapiens
ctcctagaagaacca

SEQ ID NO: 932202 - DNA, 22 bp, Homo sapiens
ctcctagaagaaccaaatacct

SEQ ID NO: 932203 - DNA, 13 bp, Homo sapiens
ctcctagaggtgg

SEQ ID NO: 932204 - DNA, 16 bp, Homo sapiens
ctcctagaggtgggca

SEQ ID NO: 932205 - DNA, 17 bp, Homo sapiens
ctcctagaggtgggcag

SEQ ID NO: 932206 - DNA, 23 bp, Homo sapiens
ctcctagaggtgggcagctgggc

SEQ ID NO: 932207 - DNA, 21 bp, Homo sapiens
ctcctagcacaaggagtgccc

SEQ ID NO: 932208 - DNA, 18 bp, Homo sapiens
ctcctagcagacagaaac

SEQ ID NO: 932209 - DNA, 19 bp, Homo sapiens
ctcctagcagacagaaact

SEQ ID NO: 932210 - DNA, 23 bp, Homo sapiens
ctcctagcagacagaaactggat

SEQ ID NO: 932211 - DNA, 13 bp, Homo sapiens
ctcctagcccctc

SEQ ID NO: 932212 - DNA, 14 bp, Homo sapiens
ctcctagcccctct

SEQ ID NO: 932213 - DNA, 12 bp, Homo sapiens
ctcctagctctc

SEQ ID NO: 932214 - DNA, 20 bp, Homo sapiens
ctcctaggagagccaacctc

SEQ ID NO: 932215 - DNA, 23 bp, Homo sapiens
ctcctaggagagccaacctcggc

SEQ ID NO: 932216 - DNA, 20 bp, Homo sapiens
ctcctagggaaaagttcata

SEQ ID NO: 932217 - DNA, 22 bp, Homo sapiens
ctcctagggggtgtcagaagct

SEQ ID NO: 932218 - DNA, 15 bp, Homo sapiens
ctcctataatctgtc

SEQ ID NO: 932219 - DNA, 15 bp, Homo sapiens
ctcctatatatttct

SEQ ID NO: 932220 - DNA, 18 bp, Homo sapiens
ctcctatatatttctatt

SEQ ID NO: 932221 - DNA, 14 bp, Homo sapiens
ctcctatctgtgtt

SEQ ID NO: 932222 - DNA, 13 bp, Homo sapiens
ctcctatctttcc

SEQ ID NO: 932223 - DNA, 22 bp, Homo sapiens
ctcctatgtactatccccaaac

SEQ ID NO: 932224 - DNA, 12 bp, Homo sapiens
ctcctatgtgta

SEQ ID NO: 932225 - DNA, 15 bp, Homo sapiens
ctcctatttatgaaa

SEQ ID NO: 932226 - DNA, 18 bp, Homo sapiens
ctcctcaaaccacttgcc

SEQ ID NO: 932227 - DNA, 20 bp, Homo sapiens
ctcctcaaaccacttgcctg

SEQ ID NO: 932228 - DNA, 16 bp, Homo sapiens
ctcctcaaacccagtc

SEQ ID NO: 932229 - DNA, 20 bp, Homo sapiens
ctcctcaagactttgatcct

SEQ ID NO: 932230 - DNA, 13 bp, Homo sapiens
ctcctcaagcctg

SEQ ID NO: 932231 - DNA, 18 bp, Homo sapiens
ctcctcaagcctgtgggc

SEQ ID NO: 932232 - DNA, 19 bp, Homo sapiens
ctcctcaagcctgtgggca

SEQ ID NO: 932233 - DNA, 19 bp, Homo sapiens
ctcctcaatgctgggccct

SEQ ID NO: 932234 - DNA, 21 bp, Homo sapiens
ctcctcaatttttgtctcaga

SEQ ID NO: 932235 - DNA, 15 bp, Homo sapiens
ctcctcacacagaat

SEQ ID NO: 932236 - DNA, 20 bp, Homo sapiens
ctcctcacagacctctgctt

SEQ ID NO: 932237 - DNA, 16 bp, Homo sapiens
cagaactgtgccacaa

SEQ ID NO: 932238 - DNA, 19 bp, Homo sapiens
cagaacttcagaaagactt

SEQ ID NO: 932239 - DNA, 9 bp, Homo sapiens
cagaacttg

SEQ ID NO: 932240 - DNA, 17 bp, Homo sapiens
cagaacttgaagggtta

SEQ ID NO: 932241 - DNA, 15 bp, Homo sapiens
cagaacttgaatgtg

SEQ ID NO: 932242 - DNA, 19 bp, Homo sapiens
cagaagaaaatagaattga

SEQ ID NO: 932243 - DNA, 14 bp, Homo sapiens
cagaagaaacaagg

SEQ ID NO: 932244 - DNA, 11 bp, Homo sapiens
cagaagaaaga

SEQ ID NO: 932245 - DNA, 17 bp, Homo sapiens
cagaagaagagaagctg

SEQ ID NO: 932246 - DNA, 14 bp, Homo sapiens
cagaagaagtggga

SEQ ID NO: 932247 - DNA, 17 bp, Homo sapiens
cagaagaagtgggagca

SEQ ID NO: 932248 - DNA, 20 bp, Homo sapiens
cagaagaagtgggagcagct

SEQ ID NO: 932249 - DNA, 18 bp, Homo sapiens
cagaagaatattcaggac

SEQ ID NO: 932250 - DNA, 19 bp, Homo sapiens
cagaagaatattcaggact

SEQ ID NO: 932251 - DNA, 20 bp, Homo sapiens
cagaagaattgaacccagga

SEQ ID NO: 932252 - DNA, 22 bp, Homo sapiens
cagaagaattgaacccaggagg

SEQ ID NO: 932253 - DNA, 18 bp, Homo sapiens
cagaagacaaaaagacaa

SEQ ID NO: 932254 - DNA, 19 bp, Homo sapiens
cagaagacactgcaaaggc

SEQ ID NO: 932255 - DNA, 23 bp, Homo sapiens
cagaagacagcagcaagtgtgct

SEQ ID NO: 932256 - DNA, 16 bp, Homo sapiens
cagaagagaggggaag

SEQ ID NO: 932257 - DNA, 13 bp, Homo sapiens
cagaagaggaaat

SEQ ID NO: 932258 - DNA, 22 bp, Homo sapiens
cagaagataacttgagcaccgt

SEQ ID NO: 932259 - DNA, 16 bp, Homo sapiens
cagaagatgccagctt

SEQ ID NO: 932260 - DNA, 20 bp, Homo sapiens
cagaagatgccagcttctct

SEQ ID NO: 932261 - DNA, 14 bp, Homo sapiens
cagaagcaagccag

SEQ ID NO: 932262 - DNA, 15 bp, Homo sapiens
cagaagcaagccaga

SEQ ID NO: 932263 - DNA, 20 bp, Homo sapiens
cagaagcacagaatattttt

SEQ ID NO: 932264 - DNA, 14 bp, Homo sapiens
cagaagcagcccct

SEQ ID NO: 932265 - DNA, 19 bp, Homo sapiens
cagaagcagcccctcgagg

SEQ ID NO: 932266 - DNA, 24 bp, Homo sapiens
cagaagcagcccctcgaggcctac

SEQ ID NO: 932267 - DNA, 23 bp, Homo sapiens
cagaagcagcttcttttgtctcc

SEQ ID NO: 932268 - DNA, 18 bp, Homo sapiens
cagaagcaggttcttgat

SEQ ID NO: 932269 - DNA, 14 bp, Homo sapiens
cagaagcatttgta

SEQ ID NO: 932270 - DNA, 20 bp, Homo sapiens
cagaagcatttgtattttgt

SEQ ID NO: 932271 - DNA, 12 bp, Homo sapiens
cagaagccagaa

SEQ ID NO: 932272 - DNA, 16 bp, Homo sapiens
cagaagccagaaggtg

SEQ ID NO: 932273 - DNA, 15 bp, Homo sapiens
cagaagccaggagca

SEQ ID NO: 932274 - DNA, 16 bp, Homo sapiens
cagaagccaggagcaa

SEQ ID NO: 932275 - DNA, 17 bp, Homo sapiens
cagaagccaggagcaaa

SEQ ID NO: 932276 - DNA, 15 bp, Homo sapiens
cagaagcccatgtct

SEQ ID NO: 932277 - DNA, 18 bp, Homo sapiens
cagaagcccatgtcttct

SEQ ID NO: 932278 - DNA, 23 bp, Homo sapiens
cagaagcccatgtcttctgctgt

SEQ ID NO: 932279 - DNA, 15 bp, Homo sapiens
cagaagcctccaagc

SEQ ID NO: 932280 - DNA, 19 bp, Homo sapiens
cagaagcctccaagcacag

SEQ ID NO: 932281 - DNA, 20 bp, Homo sapiens
cagaagcctccaagcacaga

SEQ ID NO: 932282 - DNA, 13 bp, Homo sapiens
cagaagcctctgg

SEQ ID NO: 932283 - DNA, 19 bp, Homo sapiens
cagaagcctctggctagag

SEQ ID NO: 932284 - DNA, 15 bp, Homo sapiens
cagaagcctgaggct

SEQ ID NO: 932285 - DNA, 17 bp, Homo sapiens
cagaagcctggactctg

SEQ ID NO: 932286 - DNA, 21 bp, Homo sapiens
cagaagccttggaaccagccc

SEQ ID NO: 932287 - DNA, 14 bp, Homo sapiens
cagaagctattttt

SEQ ID NO: 932288 - DNA, 22 bp, Homo sapiens
cagaagctcttactctttccta

SEQ ID NO: 932289 - DNA, 22 bp, Homo sapiens
cagaagcttggcatgacctcat

SEQ ID NO: 932290 - DNA, 10 bp, Homo sapiens
cagaaggaaa

SEQ ID NO: 932291 - DNA, 15 bp, Homo sapiens
cagaaggaaatgatg

SEQ ID NO: 932292 - DNA, 17 bp, Homo sapiens
cagaaggaaatgatgga

SEQ ID NO: 932293 - DNA, 21 bp, Homo sapiens
cagaaggagggcagagccatg

SEQ ID NO: 932294 - DNA, 13 bp, Homo sapiens
cagaaggaggggg

SEQ ID NO: 932295 - DNA, 14 bp, Homo sapiens
cagaaggaggggga

SEQ ID NO: 932296 - DNA, 18 bp, Homo sapiens
cagaaggcaaacccatca

SEQ ID NO: 932297 - DNA, 11 bp, Homo sapiens
cagaaggcaat

SEQ ID NO: 932298 - DNA, 13 bp, Homo sapiens
cagaaggcaggga

SEQ ID NO: 932299 - DNA, 12 bp, Homo sapiens
cagaaggcccca

SEQ ID NO: 932300 - DNA, 18 bp, Homo sapiens
cagaaggccccagagaga

SEQ ID NO: 932301 - DNA, 15 bp, Homo sapiens
cagaagggaattgct

SEQ ID NO: 932302 - DNA, 13 bp, Homo sapiens
cagaagggctctt

SEQ ID NO: 932303 - DNA, 22 bp, Homo sapiens
cagaagggctctttctctctgc

SEQ ID NO: 932304 - DNA, 16 bp, Homo sapiens
cagaaggggctgcttg

SEQ ID NO: 932305 - DNA, 17 bp, Homo sapiens
cagaaggggctgcttgc

SEQ ID NO: 932306 - DNA, 22 bp, Homo sapiens
cagaaggggctgcttgcttttg

SEQ ID NO: 932307 - DNA, 18 bp, Homo sapiens
cagaagggggccatgagg

SEQ ID NO: 932308 - DNA, 15 bp, Homo sapiens
cagaaggtattcctt

SEQ ID NO: 932309 - DNA, 22 bp, Homo sapiens
cagaaggtgccactttacccac

SEQ ID NO: 932310 - DNA, 17 bp, Homo sapiens
cagaaggttcacccagc

SEQ ID NO: 932311 - DNA, 16 bp, Homo sapiens
cagaaggttgtgatga

SEQ ID NO: 932312 - DNA, 22 bp, Homo sapiens
cagaagtcagcccgaatgcctg

SEQ ID NO: 932313 - DNA, 16 bp, Homo sapiens
cagaagtcatgaagcc

SEQ ID NO: 932314 - DNA, 21 bp, Homo sapiens
cagaagtccctcccatctcta

SEQ ID NO: 932315 - DNA, 17 bp, Homo sapiens
cagaagtgagccccccc

SEQ ID NO: 932316 - DNA, 12 bp, Homo sapiens
cagaagtgattt

SEQ ID NO: 932317 - DNA, 13 bp, Homo sapiens
cagaagtgattta

SEQ ID NO: 932318 - DNA, 19 bp, Homo sapiens
cagaagtgccacttaagga

SEQ ID NO: 932319 - DNA, 14 bp, Homo sapiens
cagaagtggagctg

SEQ ID NO: 932320 - DNA, 18 bp, Homo sapiens
cagaagtgtcaccctgtg

SEQ ID NO: 932321 - DNA, 19 bp, Homo sapiens
cagaagtgtttcagatttt

SEQ ID NO: 932322 - DNA, 22 bp, Homo sapiens
cagaagtttgagatcagcctgg

SEQ ID NO: 932323 - DNA, 19 bp, Homo sapiens
cagaagttttaacttccag

SEQ ID NO: 932324 - DNA, 21 bp, Homo sapiens
cagaagttttaacttccagtg

SEQ ID NO: 932325 - DNA, 22 bp, Homo sapiens
cagaataaagttctgagtgttt

SEQ ID NO: 932326 - DNA, 17 bp, Homo sapiens
cagaataagttattgca

SEQ ID NO: 932327 - DNA, 23 bp, Homo sapiens
cagaataagttattgcagtttat

SEQ ID NO: 932328 - DNA, 12 bp, Homo sapiens
ctcctcctcagc

SEQ ID NO: 932329 - DNA, 14 bp, Homo sapiens
ctcctcctccccca

SEQ ID NO: 932330 - DNA, 13 bp, Homo sapiens
ctcctcctcggaa

SEQ ID NO: 932331 - DNA, 12 bp, Homo sapiens
ctcctcctctca

SEQ ID NO: 932332 - DNA, 12 bp, Homo sapiens
ctcctcctcttt

SEQ ID NO: 932333 - DNA, 13 bp, Homo sapiens
ctcctcctgccct

SEQ ID NO: 932334 - DNA, 13 bp, Homo sapiens
ctcctcctggggg

SEQ ID NO: 932335 - DNA, 12 bp, Homo sapiens
ctcctccttccc

SEQ ID NO: 932336 - DNA, 14 bp, Homo sapiens
ctcctccttcccag

SEQ ID NO: 932337 - DNA, 18 bp, Homo sapiens
ctcctccttgcccagact

SEQ ID NO: 932338 - DNA, 13 bp, Homo sapiens
ctcctcgccccca

SEQ ID NO: 932339 - DNA, 17 bp, Homo sapiens
ctcctcgcccccaccag

SEQ ID NO: 932340 - DNA, 18 bp, Homo sapiens
ctcctcgcccccaccagt

SEQ ID NO: 932341 - DNA, 21 bp, Homo sapiens
ctcctcgcccccaccagtgta

SEQ ID NO: 932342 - DNA, 12 bp, Homo sapiens
ctcctcgctcct

SEQ ID NO: 932343 - DNA, 22 bp, Homo sapiens
ctcctcgctcctccttcccagg

SEQ ID NO: 932344 - DNA, 19 bp, Homo sapiens
ctcctcggaaccgctcacc

SEQ ID NO: 932345 - DNA, 22 bp, Homo sapiens
ctcctcggaaccgctcacctag

SEQ ID NO: 932346 - DNA, 20 bp, Homo sapiens
ctcctcggagagcagcagca

SEQ ID NO: 932347 - DNA, 23 bp, Homo sapiens
ctcctcggagagcagcagcacca

SEQ ID NO: 932348 - DNA, 16 bp, Homo sapiens
ctcctctagccatccc

SEQ ID NO: 932349 - DNA, 18 bp, Homo sapiens
ctcctctagctgtggggg

SEQ ID NO: 932350 - DNA, 19 bp, Homo sapiens
ctcctctagctgtgggggt

SEQ ID NO: 932351 - DNA, 15 bp, Homo sapiens
ctcctctaggggcag

SEQ ID NO: 932352 - DNA, 21 bp, Homo sapiens
ctcctctaggggcagcctccg

SEQ ID NO: 932353 - DNA, 14 bp, Homo sapiens
ctcctctcactccc

SEQ ID NO: 932354 - DNA, 15 bp, Homo sapiens
ctcctctcagagtga

SEQ ID NO: 932355 - DNA, 22 bp, Homo sapiens
ctcctctcagagtgacagtcat

SEQ ID NO: 932356 - DNA, 15 bp, Homo sapiens
ctcctctcagtgttt

SEQ ID NO: 932357 - DNA, 20 bp, Homo sapiens
ctcctctccaccagacgcct

SEQ ID NO: 932358 - DNA, 21 bp, Homo sapiens
ctcctctcccatccccctgcc

SEQ ID NO: 932359 - DNA, 18 bp, Homo sapiens
cagaatgctgcaggactt

SEQ ID NO: 932360 - DNA, 18 bp, Homo sapiens
cagaatgctgtacatcta

SEQ ID NO: 932361 - DNA, 21 bp, Homo sapiens
cagaatgctgtacatctattt

SEQ ID NO: 932362 - DNA, 14 bp, Homo sapiens
cagaatggaaaaat

SEQ ID NO: 932363 - DNA, 17 bp, Homo sapiens
cagaatggaaaaatcct

SEQ ID NO: 932364 - DNA, 22 bp, Homo sapiens
cagaatggaaaaatccttgaag

SEQ ID NO: 932365 - DNA, 17 bp, Homo sapiens
cagaatggaatccatct

SEQ ID NO: 932366 - DNA, 22 bp, Homo sapiens
cagaatggaatccatctgtctc

SEQ ID NO: 932367 - DNA, 17 bp, Homo sapiens
cagaatggagaaagtaa

SEQ ID NO: 932368 - DNA, 20 bp, Homo sapiens
cagaatggagaaagtaagtc

SEQ ID NO: 932369 - DNA, 15 bp, Homo sapiens
cagaatggaggcagg

SEQ ID NO: 932370 - DNA, 23 bp, Homo sapiens
cagaatggaggcaggggacaagg

SEQ ID NO: 932371 - DNA, 16 bp, Homo sapiens
cagaatggctgcacgt

SEQ ID NO: 932372 - DNA, 20 bp, Homo sapiens
cagaatgtaagaaaacaaaa

SEQ ID NO: 932373 - DNA, 13 bp, Homo sapiens
cagaatgtatctg

SEQ ID NO: 932374 - DNA, 12 bp, Homo sapiens
cagaatgtgttc

SEQ ID NO: 932375 - DNA, 14 bp, Homo sapiens
cagaatgtgttctt

SEQ ID NO: 932376 - DNA, 20 bp, Homo sapiens
cagaatgtgttcttttctcc

SEQ ID NO: 932377 - DNA, 21 bp, Homo sapiens
cagaatgttaatttattttgc

SEQ ID NO: 932378 - DNA, 18 bp, Homo sapiens
cagaatgttgtacttgaa

SEQ ID NO: 932379 - DNA, 19 bp, Homo sapiens
cagaatgttgtacttgaaa

SEQ ID NO: 932380 - DNA, 20 bp, Homo sapiens
cagaatgttttactgtgaaa

SEQ ID NO: 932381 - DNA, 15 bp, Homo sapiens
cagaattaaaatgtc

SEQ ID NO: 932382 - DNA, 14 bp, Homo sapiens
cagaattaaacttt

SEQ ID NO: 932383 - DNA, 16 bp, Homo sapiens
cagaattaaactttta

SEQ ID NO: 932384 - DNA, 16 bp, Homo sapiens
cagaattaaagaccta

SEQ ID NO: 932385 - DNA, 20 bp, Homo sapiens
cagaattagatggcttattt

SEQ ID NO: 932386 - DNA, 13 bp, Homo sapiens
cagaattatccat

SEQ ID NO: 932387 - DNA, 22 bp, Homo sapiens
cagaattatccattacgtgcat

SEQ ID NO: 932388 - DNA, 21 bp, Homo sapiens
cagaattatttttaaaaagaa

SEQ ID NO: 932389 - DNA, 17 bp, Homo sapiens
cagaattgactgcagtt

SEQ ID NO: 932390 - DNA, 13 bp, Homo sapiens
cagaattgatcat

SEQ ID NO: 932391 - DNA, 14 bp, Homo sapiens
cagaattggcataa

SEQ ID NO: 932392 - DNA, 20 bp, Homo sapiens
cagaattggtaaaaacagca

SEQ ID NO: 932393 - DNA, 21 bp, Homo sapiens
cagaattgtatctcatactgt

SEQ ID NO: 932394 - DNA, 14 bp, Homo sapiens
cagaatttatctcc

SEQ ID NO: 932395 - DNA, 17 bp, Homo sapiens
cagaatttatctccctt

SEQ ID NO: 932396 - DNA, 20 bp, Homo sapiens
cagaatttattagtttaaaa

SEQ ID NO: 932397 - DNA, 21 bp, Homo sapiens
cagaatttattagtttaaaat

SEQ ID NO: 932398 - DNA, 13 bp, Homo sapiens
cagaatttgagaa

SEQ ID NO: 932399 - DNA, 21 bp, Homo sapiens
cagaatttgagaaccttggac

SEQ ID NO: 932400 - DNA, 16 bp, Homo sapiens
cagaatttggaaatcc

SEQ ID NO: 932401 - DNA, 22 bp, Homo sapiens
cagaatttgtgttgaaggaact

SEQ ID NO: 932402 - DNA, 17 bp, Homo sapiens
cagaattttaatgtgaa

SEQ ID NO: 932403 - DNA, 18 bp, Homo sapiens
cagaattttaatgtgaag

SEQ ID NO: 932404 - DNA, 19 bp, Homo sapiens
cagaattttaatgtgaaga

SEQ ID NO: 932405 - DNA, 23 bp, Homo sapiens
cagaattttaatgtgaagacatt

SEQ ID NO: 932406 - DNA, 13 bp, Homo sapiens
cagaattttgtat

SEQ ID NO: 932407 - DNA, 14 bp, Homo sapiens
cagaattttgtata

SEQ ID NO: 932408 - DNA, 19 bp, Homo sapiens
cagacaaaaaaatttaaaa

SEQ ID NO: 932409 - DNA, 18 bp, Homo sapiens
cagacaaaaacagcctca

SEQ ID NO: 932410 - DNA, 19 bp, Homo sapiens
cagacaaaaacagcctcac

SEQ ID NO: 932411 - DNA, 20 bp, Homo sapiens
cagacaaaaacagcctcaca

SEQ ID NO: 932412 - DNA, 11 bp, Homo sapiens
cagacaaaatg

SEQ ID NO: 932413 - DNA, 14 bp, Homo sapiens
cagacaaaatgaaa

SEQ ID NO: 932414 - DNA, 17 bp, Homo sapiens
cagacaaaatttgagaa

SEQ ID NO: 932415 - DNA, 18 bp, Homo sapiens
cagacaaaatttgagaat

SEQ ID NO: 932416 - DNA, 21 bp, Homo sapiens
cagacaaagtaattcctctca

SEQ ID NO: 932417 - DNA, 21 bp, Homo sapiens
cagacaacaccttcctcctgc

SEQ ID NO: 932418 - DNA, 15 bp, Homo sapiens
cagacaacagaagtc

SEQ ID NO: 932419 - DNA, 18 bp, Homo sapiens
cagacaacagcccaggca

SEQ ID NO: 932420 - DNA, 16 bp, Homo sapiens
cagacaaccaaaacat

SEQ ID NO: 932421 - DNA, 15 bp, Homo sapiens
cagacaagagctgct

SEQ ID NO: 932422 - DNA, 18 bp, Homo sapiens
cagacaagagctgctgtc

SEQ ID NO: 932423 - DNA, 21 bp, Homo sapiens
cagacaagagctgctgtcctt

SEQ ID NO: 932424 - DNA, 15 bp, Homo sapiens
cagacaagcactatt

SEQ ID NO: 932425 - DNA, 16 bp, Homo sapiens
cagacaaggagagcgg

SEQ ID NO: 932426 - DNA, 22 bp, Homo sapiens
cagacaaggagagcggaggagg

SEQ ID NO: 932427 - DNA, 20 bp, Homo sapiens
cagacaagtgttttggaaag

SEQ ID NO: 932428 - DNA, 17 bp, Homo sapiens
cagacaatatgtgagtg

SEQ ID NO: 932429 - DNA, 20 bp, Homo sapiens
cagacacaacccaataggag

SEQ ID NO: 932430 - DNA, 17 bp, Homo sapiens
cagacacaatatgtatg

SEQ ID NO: 932431 - DNA, 19 bp, Homo sapiens
cagacacaatatgtatgct

SEQ ID NO: 932432 - DNA, 11 bp, Homo sapiens
cagacacacac

SEQ ID NO: 932433 - DNA, 13 bp, Homo sapiens
cagacacacacac

SEQ ID NO: 932434 - DNA, 15 bp, Homo sapiens
cagacacacacacgc

SEQ ID NO: 932435 - DNA, 21 bp, Homo sapiens
cagacacagactggcaataaa

SEQ ID NO: 932436 - DNA, 22 bp, Homo sapiens
cagacacagactggcaataaac

SEQ ID NO: 932437 - DNA, 12 bp, Homo sapiens
cagacacagctc

SEQ ID NO: 932438 - DNA, 21 bp, Homo sapiens
cagacacagctcttccagggc

SEQ ID NO: 932439 - DNA, 21 bp, Homo sapiens
cagacacaggaaaaataaacg

SEQ ID NO: 932440 - DNA, 18 bp, Homo sapiens
cagacacagggacttgaa

SEQ ID NO: 932441 - DNA, 22 bp, Homo sapiens
cagacacagggacttgaagttg

SEQ ID NO: 932442 - DNA, 13 bp, Homo sapiens
cagacacatgcta

SEQ ID NO: 932443 - DNA, 17 bp, Homo sapiens
cagacacatgctatgtt

SEQ ID NO: 932444 - DNA, 14 bp, Homo sapiens
cagacaccctcaac

SEQ ID NO: 932445 - DNA, 18 bp, Homo sapiens
cagacaccctctccttaa

SEQ ID NO: 932446 - DNA, 10 bp, Homo sapiens
cagacacctc

SEQ ID NO: 932447 - DNA, 12 bp, Homo sapiens
cagacacctccc

SEQ ID NO: 932448 - DNA, 17 bp, Homo sapiens
cagacacctccccctac

SEQ ID NO: 932449 - DNA, 18 bp, Homo sapiens
cagacacctccccctacc

SEQ ID NO: 932450 - DNA, 16 bp, Homo sapiens
cagacacctggactga

SEQ ID NO: 932451 - DNA, 19 bp, Homo sapiens
cagacacctggactgagcc

SEQ ID NO: 932452 - DNA, 19 bp, Homo sapiens
cagacacgagccacctcac

SEQ ID NO: 932453 - DNA, 16 bp, Homo sapiens
cagacacgttctgatt

SEQ ID NO: 932454 - DNA, 19 bp, Homo sapiens
cagacactaaatgcagaca

SEQ ID NO: 932455 - DNA, 20 bp, Homo sapiens
ctcctgccttcctcctgggc

SEQ ID NO: 932456 - DNA, 23 bp, Homo sapiens
ctcctgcctttaggccatgggtg

SEQ ID NO: 932457 - DNA, 20 bp, Homo sapiens
ctcctgcggctcagccttgc

SEQ ID NO: 932458 - DNA, 22 bp, Homo sapiens
ctcctgcggctcagccttgcac

SEQ ID NO: 932459 - DNA, 19 bp, Homo sapiens
ctcctgcgtctgtttttaa

SEQ ID NO: 932460 - DNA, 18 bp, Homo sapiens
ctcctgctactctgttcc

SEQ ID NO: 932461 - DNA, 20 bp, Homo sapiens
ctcctgctcctccctgcccc

SEQ ID NO: 932462 - DNA, 13 bp, Homo sapiens
ctcctgctctctg

SEQ ID NO: 932463 - DNA, 17 bp, Homo sapiens
ctcctgctgtctacctc

SEQ ID NO: 932464 - DNA, 12 bp, Homo sapiens
ctcctgcttccc

SEQ ID NO: 932465 - DNA, 14 bp, Homo sapiens
ctcctgcttttctg

SEQ ID NO: 932466 - DNA, 21 bp, Homo sapiens
ctcctgcttttctgtcctggg

SEQ ID NO: 932467 - DNA, 22 bp, Homo sapiens
ctcctggaaaggctcagtctca

SEQ ID NO: 932468 - DNA, 14 bp, Homo sapiens
ctcctggaaatatt

SEQ ID NO: 932469 - DNA, 23 bp, Homo sapiens
ctcctggaagctgtgtccttgca

SEQ ID NO: 932470 - DNA, 23 bp, Homo sapiens
ctcctggaccttgacagagcagc

SEQ ID NO: 932471 - DNA, 18 bp, Homo sapiens
ctcctggactccggagga

SEQ ID NO: 932472 - DNA, 21 bp, Homo sapiens
ctcctggactccggaggactg

SEQ ID NO: 932473 - DNA, 16 bp, Homo sapiens
ctcctggagatagctg

SEQ ID NO: 932474 - DNA, 21 bp, Homo sapiens
ctcctggagatagctggggct

SEQ ID NO: 932475 - DNA, 21 bp, Homo sapiens
ctcctggagcagaaagtgcct

SEQ ID NO: 932476 - DNA, 19 bp, Homo sapiens
ctcctggagcctttgaata

SEQ ID NO: 932477 - DNA, 14 bp, Homo sapiens
ctcctggaggctgg

SEQ ID NO: 932478 - DNA, 17 bp, Homo sapiens
ctcctggcaatcaatac

SEQ ID NO: 932479 - DNA, 11 bp, Homo sapiens
ctcctggcagg

SEQ ID NO: 932480 - DNA, 21 bp, Homo sapiens
ctccttgggctcctggctgcc

SEQ ID NO: 932481 - DNA, 17 bp, Homo sapiens
ctccttggttatatttt

SEQ ID NO: 932482 - DNA, 16 bp, Homo sapiens
ctccttgttagccctt

SEQ ID NO: 932483 - DNA, 13 bp, Homo sapiens
ctcctttaattgt

SEQ ID NO: 932484 - DNA, 11 bp, Homo sapiens
ctcctttacca

SEQ ID NO: 932485 - DNA, 17 bp, Homo sapiens
ctcctttcacaaccttc

SEQ ID NO: 932486 - DNA, 13 bp, Homo sapiens
ctcctttccctta

SEQ ID NO: 932487 - DNA, 16 bp, Homo sapiens
ctcctttctcctgtga

SEQ ID NO: 932488 - DNA, 14 bp, Homo sapiens
ctcctttctgactg

SEQ ID NO: 932489 - DNA, 19 bp, Homo sapiens
ctcctttcttattaatttc

SEQ ID NO: 932490 - DNA, 21 bp, Homo sapiens
ctcctttctttttcttcttcc

SEQ ID NO: 932491 - DNA, 14 bp, Homo sapiens
ctcctttgcactga

SEQ ID NO: 932492 - DNA, 11 bp, Homo sapiens
ctcctttggag

SEQ ID NO: 932493 - DNA, 20 bp, Homo sapiens
ctcctttgtcttttttttca

SEQ ID NO: 932494 - DNA, 14 bp, Homo sapiens
ctccttttaaagaa

SEQ ID NO: 932495 - DNA, 20 bp, Homo sapiens
ctccttttatctggtgcctc

SEQ ID NO: 932496 - DNA, 23 bp, Homo sapiens
ctccttttatctggtgcctcctc

SEQ ID NO: 932497 - DNA, 13 bp, Homo sapiens
ctccttttcccaa

SEQ ID NO: 932498 - DNA, 20 bp, Homo sapiens
ctccttttgtatcttccttt

SEQ ID NO: 932499 - DNA, 23 bp, Homo sapiens
ctccttttgtatcttcctttctt

SEQ ID NO: 932500 - DNA, 19 bp, Homo sapiens
ctccttttgtccccagggc

SEQ ID NO: 932501 - DNA, 14 bp, Homo sapiens
ctcctttttctccc

SEQ ID NO: 932502 - DNA, 18 bp, Homo sapiens
ctcctttttctccctctg

SEQ ID NO: 932503 - DNA, 14 bp, Homo sapiens
ctcgaaacacagaa

SEQ ID NO: 932504 - DNA, 15 bp, Homo sapiens
ctcgaaacacagaaa

SEQ ID NO: 932505 - DNA, 14 bp, Homo sapiens
ctcgaaccaaggca

SEQ ID NO: 932506 - DNA, 16 bp, Homo sapiens
ctcgaaccaaggcagc

SEQ ID NO: 932507 - DNA, 19 bp, Homo sapiens
ctcgaaccaaggcagcctc

SEQ ID NO: 932508 - DNA, 23 bp, Homo sapiens
ctcgaaccaaggcagcctccaga

SEQ ID NO: 932509 - DNA, 15 bp, Homo sapiens
ctcgaatctctgtgc

SEQ ID NO: 932510 - DNA, 21 bp, Homo sapiens
ctcgaatgaaaagctgctggt

SEQ ID NO: 932511 - DNA, 15 bp, Homo sapiens
ctcgaattctcagac

SEQ ID NO: 932512 - DNA, 16 bp, Homo sapiens
ctcgacacccccccaa

SEQ ID NO: 932513 - DNA, 17 bp, Homo sapiens
ctcgacacccccccaac

SEQ ID NO: 932514 - DNA, 20 bp, Homo sapiens
ctcgacacgtgggctcccct

SEQ ID NO: 932515 - DNA, 19 bp, Homo sapiens
ctcgacagggcctggagcc

SEQ ID NO: 932516 - DNA, 13 bp, Homo sapiens
ctcgactcagcac

SEQ ID NO: 932517 - DNA, 22 bp, Homo sapiens
ctcgactctgctgctcatggga

SEQ ID NO: 932518 - DNA, 14 bp, Homo sapiens
ctcgagaccatcct

SEQ ID NO: 932519 - DNA, 15 bp, Homo sapiens
ctcgagaccatcctg

SEQ ID NO: 932520 - DNA, 16 bp, Homo sapiens
ctcgagaccatcctgg

SEQ ID NO: 932521 - DNA, 19 bp, Homo sapiens
ctcgagaccatcctggccc

SEQ ID NO: 932522 - DNA, 22 bp, Homo sapiens
ctcgagaccatcctggcccctc

SEQ ID NO: 932523 - DNA, 23 bp, Homo sapiens
ctcgagagggctggtccttattt

SEQ ID NO: 932524 - DNA, 17 bp, Homo sapiens
ctcgagcagtcctgcct

SEQ ID NO: 932525 - DNA, 16 bp, Homo sapiens
ctcgagccccctggat

SEQ ID NO: 932526 - DNA, 17 bp, Homo sapiens
ctcgaggaactccagga

SEQ ID NO: 932527 - DNA, 20 bp, Homo sapiens
ctcgaggaactccaggacga

SEQ ID NO: 932528 - DNA, 19 bp, Homo sapiens
ctcgaggcaccggcgctgc

SEQ ID NO: 932529 - DNA, 21 bp, Homo sapiens
ctcgaggcaccggcgctgcag

SEQ ID NO: 932530 - DNA, 14 bp, Homo sapiens
ctcgagggccgcct

SEQ ID NO: 932531 - DNA, 19 bp, Homo sapiens
ctcgagggccgcctgcctt

SEQ ID NO: 932532 - DNA, 14 bp, Homo sapiens
ctcgaggggtgggc

SEQ ID NO: 932533 - DNA, 17 bp, Homo sapiens
ctcgaggggtgggctgg

SEQ ID NO: 932534 - DNA, 23 bp, Homo sapiens
ctcgatcatatttccccttggac

SEQ ID NO: 932535 - DNA, 13 bp, Homo sapiens
ctcgatctcctga

SEQ ID NO: 932536 - DNA, 16 bp, Homo sapiens
ctcgatgcctgattcg

SEQ ID NO: 932537 - DNA, 15 bp, Homo sapiens
ctcgatgcctttgct

SEQ ID NO: 932538 - DNA, 14 bp, Homo sapiens
ctcgatttctccag

SEQ ID NO: 932539 - DNA, 16 bp, Homo sapiens
ctcgcacaatgcatgt

SEQ ID NO: 932540 - DNA, 17 bp, Homo sapiens
ctcgcacacagggctca

SEQ ID NO: 932541 - DNA, 14 bp, Homo sapiens
ctcgcacttgcaga

SEQ ID NO: 932542 - DNA, 18 bp, Homo sapiens
ctcgcagacctaagccct

SEQ ID NO: 932543 - DNA, 19 bp, Homo sapiens
ctcgcagcctctcagtgcc

SEQ ID NO: 932544 - DNA, 22 bp, Homo sapiens
ctcgcataggacctttccacca

SEQ ID NO: 932545 - DNA, 23 bp, Homo sapiens
ctcgcatcctatgcttaataaaa

SEQ ID NO: 932546 - DNA, 21 bp, Homo sapiens
ctcgcatttgtcaatgacagt

SEQ ID NO: 932547 - DNA, 15 bp, Homo sapiens
ctcgccagcttggct

SEQ ID NO: 932548 - DNA, 18 bp, Homo sapiens
ctcgccagcttggctcga

SEQ ID NO: 932549 - DNA, 12 bp, Homo sapiens
ctcgccatgccg

SEQ ID NO: 932550 - DNA, 12 bp, Homo sapiens
ctcgcccagcag

SEQ ID NO: 932551 - DNA, 13 bp, Homo sapiens
ctcgcccagcagg

SEQ ID NO: 932552 - DNA, 19 bp, Homo sapiens
ctcgccccaaggttccaga

SEQ ID NO: 932553 - DNA, 14 bp, Homo sapiens
ctcgccccacccag

SEQ ID NO: 932554 - DNA, 15 bp, Homo sapiens
ctcgccccatccctg

SEQ ID NO: 932555 - DNA, 17 bp, Homo sapiens
ctcgcccccaccagtgt

SEQ ID NO: 932556 - DNA, 15 bp, Homo sapiens
ctcgcccctccagtg

SEQ ID NO: 932557 - DNA, 19 bp, Homo sapiens
ctcgcccctccagtgttgc

SEQ ID NO: 932558 - DNA, 21 bp, Homo sapiens
ctcgcccctcccctcagcctg

SEQ ID NO: 932559 - DNA, 14 bp, Homo sapiens
ctcgcccgcccact

SEQ ID NO: 932560 - DNA, 15 bp, Homo sapiens
ctcgcccgcccactg

SEQ ID NO: 932561 - DNA, 21 bp, Homo sapiens
ctcgcccgcccactgtcctgg

SEQ ID NO: 932562 - DNA, 23 bp, Homo sapiens
ctcgcccgcccactgtcctgggc

SEQ ID NO: 932563 - DNA, 19 bp, Homo sapiens
ctcgccctcctttctgtgc

SEQ ID NO: 932564 - DNA, 12 bp, Homo sapiens
ctcgccctgggt

SEQ ID NO: 932565 - DNA, 13 bp, Homo sapiens
ctcgccctgggtc

SEQ ID NO: 932566 - DNA, 18 bp, Homo sapiens
ctcgccgtgtctcagcct

SEQ ID NO: 932567 - DNA, 22 bp, Homo sapiens
ctcgccgtgtctcagcctctgc

SEQ ID NO: 932568 - DNA, 12 bp, Homo sapiens
ctcgcctaggcc

SEQ ID NO: 932569 - DNA, 21 bp, Homo sapiens
ctcgcctgtggacggggaggc

SEQ ID NO: 932570 - DNA, 15 bp, Homo sapiens
ctcgccttccctcct

SEQ ID NO: 932571 - DNA, 16 bp, Homo sapiens
ctcgcgcgactgagaa

SEQ ID NO: 932572 - DNA, 15 bp, Homo sapiens
ctcgcggccctcagt

SEQ ID NO: 932573 - DNA, 18 bp, Homo sapiens
ctcgctcaccgctggccc

SEQ ID NO: 932574 - DNA, 12 bp, Homo sapiens
ctcgctcccctc

SEQ ID NO: 932575 - DNA, 15 bp, Homo sapiens
ctcgctcctccttcc

SEQ ID NO: 932576 - DNA, 22 bp, Homo sapiens
ctcgctgagggcagactggggc

SEQ ID NO: 932577 - DNA, 18 bp, Homo sapiens
ctcgctgcacaaatactc

SEQ ID NO: 932578 - DNA, 13 bp, Homo sapiens
ctcgctgccagct

SEQ ID NO: 932579 - DNA, 16 bp, Homo sapiens
ctcgctgccagctctg

SEQ ID NO: 932580 - DNA, 19 bp, Homo sapiens
ctcgctgccatcaccgctg

SEQ ID NO: 932581 - DNA, 22 bp, Homo sapiens
ctcgctgccatcaccgctgggt

SEQ ID NO: 932582 - DNA, 16 bp, Homo sapiens
ctcgctgctgctacta

SEQ ID NO: 932583 - DNA, 24 bp, Homo sapiens
ctcgctgctgctactacccgagcc

SEQ ID NO: 932584 - DNA, 19 bp, Homo sapiens
ctcgctggactctcagtct

SEQ ID NO: 932585 - DNA, 15 bp, Homo sapiens
cagactatttttaga

SEQ ID NO: 932586 - DNA, 22 bp, Homo sapiens
cagactatttttagattttctt

SEQ ID NO: 932587 - DNA, 22 bp, Homo sapiens
cagactcaaatgctcagaccag

SEQ ID NO: 932588 - DNA, 17 bp, Homo sapiens
cagactcaaggggctgg

SEQ ID NO: 932589 - DNA, 20 bp, Homo sapiens
cagactcaagtacccattct

SEQ ID NO: 932590 - DNA, 21 bp, Homo sapiens
cagactcacaacctgaaccta

SEQ ID NO: 932591 - DNA, 16 bp, Homo sapiens
cagactcacttgccat

SEQ ID NO: 932592 - DNA, 20 bp, Homo sapiens
cagactcacttgccattgcc

SEQ ID NO: 932593 - DNA, 14 bp, Homo sapiens
cagactcagctctg

SEQ ID NO: 932594 - DNA, 15 bp, Homo sapiens
cagactcagctctga

SEQ ID NO: 932595 - DNA, 16 bp, Homo sapiens
cagactcaggttccag

SEQ ID NO: 932596 - DNA, 17 bp, Homo sapiens
cagactcagtttgtcag

SEQ ID NO: 932597 - DNA, 18 bp, Homo sapiens
cagactcagtttgtcaga

SEQ ID NO: 932598 - DNA, 20 bp, Homo sapiens
cagactccggcctgtaatca

SEQ ID NO: 932599 - DNA, 21 bp, Homo sapiens
cagactcctgaggacagctgt

SEQ ID NO: 932600 - DNA, 18 bp, Homo sapiens
cagactctgagctgctca

SEQ ID NO: 932601 - DNA, 18 bp, Homo sapiens
cagactctgcctcctggt

SEQ ID NO: 932602 - DNA, 16 bp, Homo sapiens
cagagatgcctccacc

SEQ ID NO: 932603 - DNA, 22 bp, Homo sapiens
cagagatggtaatctacagctc

SEQ ID NO: 932604 - DNA, 13 bp, Homo sapiens
cagagatgtactg

SEQ ID NO: 932605 - DNA, 14 bp, Homo sapiens
cagagattcatttt

SEQ ID NO: 932606 - DNA, 21 bp, Homo sapiens
cagagattcattttctagata

SEQ ID NO: 932607 - DNA, 14 bp, Homo sapiens
cagagattctggat

SEQ ID NO: 932608 - DNA, 16 bp, Homo sapiens
cagagcaaagcgccca

SEQ ID NO: 932609 - DNA, 20 bp, Homo sapiens
cagagcaagtgagaccctgt

SEQ ID NO: 932610 - DNA, 20 bp, Homo sapiens
cagagcaataacactatatt

SEQ ID NO: 932611 - DNA, 23 bp, Homo sapiens
cagagcaataacactatatttat

SEQ ID NO: 932612 - DNA, 19 bp, Homo sapiens
cagagcacaaacttcagaa

SEQ ID NO: 932613 - DNA, 18 bp, Homo sapiens
cagagcacagcagcccct

SEQ ID NO: 932614 - DNA, 13 bp, Homo sapiens
cagagcacagccc

SEQ ID NO: 932615 - DNA, 18 bp, Homo sapiens
cagagcacagcccacggg

SEQ ID NO: 932616 - DNA, 16 bp, Homo sapiens
cagagcaccccctgct

SEQ ID NO: 932617 - DNA, 19 bp, Homo sapiens
cagagcaccccctgctcca

SEQ ID NO: 932618 - DNA, 14 bp, Homo sapiens
cagagcacctgtag

SEQ ID NO: 932619 - DNA, 15 bp, Homo sapiens
cagagcacgcctgcc

SEQ ID NO: 932620 - DNA, 13 bp, Homo sapiens
cagagcagagagc

SEQ ID NO: 932621 - DNA, 13 bp, Homo sapiens
cagagcagagcct

SEQ ID NO: 932622 - DNA, 22 bp, Homo sapiens
cagagcagaggaaggctacttg

SEQ ID NO: 932623 - DNA, 19 bp, Homo sapiens
cagagcagctaactccgag

SEQ ID NO: 932624 - DNA, 21 bp, Homo sapiens
cagagcaggaaggacaggaag

SEQ ID NO: 932625 - DNA, 12 bp, Homo sapiens
cagagcaggacc

SEQ ID NO: 932626 - DNA, 15 bp, Homo sapiens
cagagcaggacctcc

SEQ ID NO: 932627 - DNA, 19 bp, Homo sapiens
cagagcaggacctcccttc

SEQ ID NO: 932628 - DNA, 15 bp, Homo sapiens
cagagcaggagcccc

SEQ ID NO: 932629 - DNA, 21 bp, Homo sapiens
cagagcaggagcccctggggc

SEQ ID NO: 932630 - DNA, 12 bp, Homo sapiens
cagagcaggagg

SEQ ID NO: 932631 - DNA, 14 bp, Homo sapiens
cagagcaggaggcc

SEQ ID NO: 932632 - DNA, 14 bp, Homo sapiens
cagagcaggggcag

SEQ ID NO: 932633 - DNA, 23 bp, Homo sapiens
cagagcaggggtccttggtgtga

SEQ ID NO: 932634 - DNA, 14 bp, Homo sapiens
cagagcatacaaca

SEQ ID NO: 932635 - DNA, 20 bp, Homo sapiens
cagagcatacaacagagggg

SEQ ID NO: 932636 - DNA, 15 bp, Homo sapiens
cagagcatgtgtcag

SEQ ID NO: 932637 - DNA, 18 bp, Homo sapiens
cagagcatgtgtcagagt

SEQ ID NO: 932638 - DNA, 23 bp, Homo sapiens
cagagcattacgtgagccaggta

SEQ ID NO: 932639 - DNA, 21 bp, Homo sapiens
cagagcatttccaacaccaca

SEQ ID NO: 932640 - DNA, 13 bp, Homo sapiens
cagagccaaggcc

SEQ ID NO: 932641 - DNA, 14 bp, Homo sapiens
cagagccaaggcca

SEQ ID NO: 932642 - DNA, 11 bp, Homo sapiens
cagagccaagt

SEQ ID NO: 932643 - DNA, 14 bp, Homo sapiens
cagagccagcctgg

SEQ ID NO: 932644 - DNA, 21 bp, Homo sapiens
cagagccagcctggctctgcc

SEQ ID NO: 932645 - DNA, 15 bp, Homo sapiens
cagagccagcctggg

SEQ ID NO: 932646 - DNA, 16 bp, Homo sapiens
cagagccagcctggga

SEQ ID NO: 932647 - DNA, 10 bp, Homo sapiens
cagagccagg

SEQ ID NO: 932648 - DNA, 13 bp, Homo sapiens
cagagccaggaag

SEQ ID NO: 932649 - DNA, 14 bp, Homo sapiens
cagagccaggaaga

SEQ ID NO: 932650 - DNA, 18 bp, Homo sapiens
cagagccaggctgttgga

SEQ ID NO: 932651 - DNA, 19 bp, Homo sapiens
cagagccaggctgttggaa

SEQ ID NO: 932652 - DNA, 15 bp, Homo sapiens
cagagccatgccagg

SEQ ID NO: 932653 - DNA, 18 bp, Homo sapiens
cagagccatgggcctggg

SEQ ID NO: 932654 - DNA, 20 bp, Homo sapiens
cagagccatgggcctgggcc

SEQ ID NO: 932655 - DNA, 21 bp, Homo sapiens
cagagcccaaggtcagggagg

SEQ ID NO: 932656 - DNA, 17 bp, Homo sapiens
cagagcccaccagccag

SEQ ID NO: 932657 - DNA, 12 bp, Homo sapiens
cagagcccaggg

SEQ ID NO: 932658 - DNA, 15 bp, Homo sapiens
cagagcccaggggag

SEQ ID NO: 932659 - DNA, 16 bp, Homo sapiens
cagagccccacacgga

SEQ ID NO: 932660 - DNA, 15 bp, Homo sapiens
cagagccccactccc

SEQ ID NO: 932661 - DNA, 18 bp, Homo sapiens
cagagcccccagccctgg

SEQ ID NO: 932662 - DNA, 21 bp, Homo sapiens
cagagcccctacagcattgtt

SEQ ID NO: 932663 - DNA, 17 bp, Homo sapiens
cagagccctctgagccg

SEQ ID NO: 932664 - DNA, 19 bp, Homo sapiens
cagagccctgaggggctgg

SEQ ID NO: 932665 - DNA, 14 bp, Homo sapiens
cagagccctggctg

SEQ ID NO: 932666 - DNA, 16 bp, Homo sapiens
cagagccctggctggg

SEQ ID NO: 932667 - DNA, 18 bp, Homo sapiens
cagagcccttcactgcca

SEQ ID NO: 932668 - DNA, 15 bp, Homo sapiens
cagagcccttgactg

SEQ ID NO: 932669 - DNA, 20 bp, Homo sapiens
cagagccggcatccttgcct

SEQ ID NO: 932670 - DNA, 23 bp, Homo sapiens
cagagccggcatccttgcctgtc

SEQ ID NO: 932671 - DNA, 18 bp, Homo sapiens
cagagccggcccgcctct

SEQ ID NO: 932672 - DNA, 20 bp, Homo sapiens
cagagccggcccgcctctcc

SEQ ID NO: 932673 - DNA, 14 bp, Homo sapiens
cagagccgggagga

SEQ ID NO: 932674 - DNA, 20 bp, Homo sapiens
cagagccgtggtcctttggg

SEQ ID NO: 932675 - DNA, 14 bp, Homo sapiens
cagagcctcctggg

SEQ ID NO: 932676 - DNA, 15 bp, Homo sapiens
cagagcctcctggga

SEQ ID NO: 932677 - DNA, 13 bp, Homo sapiens
cagagcctctgag

SEQ ID NO: 932678 - DNA, 14 bp, Homo sapiens
cagagcctctgaga

SEQ ID NO: 932679 - DNA, 13 bp, Homo sapiens
cagagcctctggc

SEQ ID NO: 932680 - DNA, 15 bp, Homo sapiens
cagagcctctggccc

SEQ ID NO: 932681 - DNA, 21 bp, Homo sapiens
cagagcctctggcccctcacc

SEQ ID NO: 932682 - DNA, 17 bp, Homo sapiens
cagagcctgacctgaga

SEQ ID NO: 932683 - DNA, 11 bp, Homo sapiens
cagagcctggc

SEQ ID NO: 932684 - DNA, 13 bp, Homo sapiens
cagagcctggccc

SEQ ID NO: 932685 - DNA, 15 bp, Homo sapiens
cagagcctggcccca

SEQ ID NO: 932686 - DNA, 17 bp, Homo sapiens
cagagcctggctgccca

SEQ ID NO: 932687 - DNA, 19 bp, Homo sapiens
cagagcctggggtgttctc

SEQ ID NO: 932688 - DNA, 20 bp, Homo sapiens
cagagccttccatgacctcc

SEQ ID NO: 932689 - DNA, 15 bp, Homo sapiens
cagagccttctcaga

SEQ ID NO: 932690 - DNA, 16 bp, Homo sapiens
cagagcctttggatga

SEQ ID NO: 932691 - DNA, 20 bp, Homo sapiens
cagagccttttacccctgca

SEQ ID NO: 932692 - DNA, 17 bp, Homo sapiens
cagagcggaggctgtgt

SEQ ID NO: 932693 - DNA, 20 bp, Homo sapiens
cagagcggggtcccctctgt

SEQ ID NO: 932694 - DNA, 22 bp, Homo sapiens
cagagcggggtcccctctgtgc

SEQ ID NO: 932695 - DNA, 19 bp, Homo sapiens
cagagctaaactccttcct

SEQ ID NO: 932696 - DNA, 17 bp, Homo sapiens
cagagctagggctgctg

SEQ ID NO: 932697 - DNA, 18 bp, Homo sapiens
cagagctagggctgctgc

SEQ ID NO: 932698 - DNA, 16 bp, Homo sapiens
cagagctatggtgagg

SEQ ID NO: 932699 - DNA, 24 bp, Homo sapiens
cagagctcatcccccctgctgccc

SEQ ID NO: 932700 - DNA, 23 bp, Homo sapiens
cagagctctcccctcctgctggg

SEQ ID NO: 932701 - DNA, 24 bp, Homo sapiens
cagagctctcccctcctgctgggc

SEQ ID NO: 932702 - DNA, 18 bp, Homo sapiens
cagagctgagggccctgt

SEQ ID NO: 932703 - DNA, 22 bp, Homo sapiens
cagagctgagggccctgtggag

SEQ ID NO: 932704 - DNA, 22 bp, Homo sapiens
cagagctgccgacttggagact

SEQ ID NO: 932705 - DNA, 14 bp, Homo sapiens
cagagctggaaggc

SEQ ID NO: 932706 - DNA, 16 bp, Homo sapiens
cagagctggaaggcag

SEQ ID NO: 932707 - DNA, 21 bp, Homo sapiens
cagagctggaaggcagggcag

SEQ ID NO: 932708 - DNA, 22 bp, Homo sapiens
cagagctggagatgaggccaga

SEQ ID NO: 932709 - DNA, 14 bp, Homo sapiens
cagagctggcctcc

SEQ ID NO: 932710 - DNA, 17 bp, Homo sapiens
cagagctggcctccccc

SEQ ID NO: 932711 - DNA, 17 bp, Homo sapiens
cagagctggctctgagc

SEQ ID NO: 932712 - DNA, 14 bp, Homo sapiens
cagagctgggaggc

SEQ ID NO: 932713 - DNA, 14 bp, Homo sapiens
cagagctggggctg

SEQ ID NO: 932714 - DNA, 14 bp, Homo sapiens
cagagctgtgccag

SEQ ID NO: 932715 - DNA, 14 bp, Homo sapiens
ctctaaggagcagc

SEQ ID NO: 932716 - DNA, 16 bp, Homo sapiens
ctctaaggcaggatgt

SEQ ID NO: 932717 - DNA, 18 bp, Homo sapiens
ctctaataagtttgtgtt

SEQ ID NO: 932718 - DNA, 19 bp, Homo sapiens
ctctaatatggcaaccatt

SEQ ID NO: 932719 - DNA, 14 bp, Homo sapiens
ctctaattagagaa

SEQ ID NO: 932720 - DNA, 19 bp, Homo sapiens
ctctaattagagaactgga

SEQ ID NO: 932721 - DNA, 17 bp, Homo sapiens
ctctaattcacagtgct

SEQ ID NO: 932722 - DNA, 20 bp, Homo sapiens
ctctaattcccattttgcaa

SEQ ID NO: 932723 - DNA, 16 bp, Homo sapiens
ctctacaaactcccac

SEQ ID NO: 932724 - DNA, 22 bp, Homo sapiens
cagagctgtgcctgctcagcag

SEQ ID NO: 932725 - DNA, 20 bp, Homo sapiens
cagagctgtttatggcctca

SEQ ID NO: 932726 - DNA, 21 bp, Homo sapiens
cagagctgtttatggcctcag

SEQ ID NO: 932727 - DNA, 19 bp, Homo sapiens
cagagctgtttggatacag

SEQ ID NO: 932728 - DNA, 18 bp, Homo sapiens
cagagcttattggccact

SEQ ID NO: 932729 - DNA, 19 bp, Homo sapiens
cagagcttattggccactg

SEQ ID NO: 932730 - DNA, 21 bp, Homo sapiens
cagagcttattggccactggg

SEQ ID NO: 932731 - DNA, 13 bp, Homo sapiens
cagagcttccctg

SEQ ID NO: 932732 - DNA, 13 bp, Homo sapiens
cagagctttaaaa

SEQ ID NO: 932733 - DNA, 18 bp, Homo sapiens
cagagctttaaaagtatc

SEQ ID NO: 932734 - DNA, 19 bp, Homo sapiens
cagagctttaaaagtatct

SEQ ID NO: 932735 - DNA, 13 bp, Homo sapiens
cagagctttgtca

SEQ ID NO: 932736 - DNA, 16 bp, Homo sapiens
cagagctttgtcactt

SEQ ID NO: 932737 - DNA, 13 bp, Homo sapiens
cagagcttttcag

SEQ ID NO: 932738 - DNA, 15 bp, Homo sapiens
cagagcttttcagat

SEQ ID NO: 932739 - DNA, 13 bp, Homo sapiens
cagagctttttgg

SEQ ID NO: 932740 - DNA, 17 bp, Homo sapiens
cagaggaactgtccaga

SEQ ID NO: 932741 - DNA, 22 bp, Homo sapiens
cagaggaactgtccagagagca

SEQ ID NO: 932742 - DNA, 13 bp, Homo sapiens
cagaggaaggaga

SEQ ID NO: 932743 - DNA, 16 bp, Homo sapiens
cagaggaaggggccag

SEQ ID NO: 932744 - DNA, 19 bp, Homo sapiens
cagaggaaggggccagagg

SEQ ID NO: 932745 - DNA, 16 bp, Homo sapiens
cagaggaatcctggca

SEQ ID NO: 932746 - DNA, 19 bp, Homo sapiens
cagaggaatcctggcagcc

SEQ ID NO: 932747 - DNA, 18 bp, Homo sapiens
cagaggaatgtagggcct

SEQ ID NO: 932748 - DNA, 23 bp, Homo sapiens
cagaggaattgattgtcagccac

SEQ ID NO: 932749 - DNA, 16 bp, Homo sapiens
cagaggacacaggcag

SEQ ID NO: 932750 - DNA, 14 bp, Homo sapiens
cagaggacagctct

SEQ ID NO: 932751 - DNA, 13 bp, Homo sapiens
cagaggaccacag

SEQ ID NO: 932752 - DNA, 15 bp, Homo sapiens
cagaggaccacagtg

SEQ ID NO: 932753 - DNA, 18 bp, Homo sapiens
cagaggaccccagggtgg

SEQ ID NO: 932754 - DNA, 21 bp, Homo sapiens
cagaggactcccaaccctggc

SEQ ID NO: 932755 - DNA, 13 bp, Homo sapiens
cagaggactctgc

SEQ ID NO: 932756 - DNA, 12 bp, Homo sapiens
cagaggagaaga

SEQ ID NO: 932757 - DNA, 15 bp, Homo sapiens
cagaggagaagacaa

SEQ ID NO: 932758 - DNA, 16 bp, Homo sapiens
cagaggagcagctctc

SEQ ID NO: 932759 - DNA, 11 bp, Homo sapiens
cagaggagccc

SEQ ID NO: 932760 - DNA, 15 bp, Homo sapiens
cagaggagcccagtg

SEQ ID NO: 932761 - DNA, 16 bp, Homo sapiens
cagaggagcccagtgg

SEQ ID NO: 932762 - DNA, 18 bp, Homo sapiens
cagaggagcccagtgggc

SEQ ID NO: 932763 - DNA, 22 bp, Homo sapiens
cagaggagcccagtgggctgca

SEQ ID NO: 932764 - DNA, 23 bp, Homo sapiens
cagaggagcccagtgggctgcac

SEQ ID NO: 932765 - DNA, 15 bp, Homo sapiens
cagaggagcgcaggc

SEQ ID NO: 932766 - DNA, 17 bp, Homo sapiens
cagaggagcgcaggcag

SEQ ID NO: 932767 - DNA, 11 bp, Homo sapiens
cagaggagctt

SEQ ID NO: 932768 - DNA, 20 bp, Homo sapiens
cagaggagcttttctggaat

SEQ ID NO: 932769 - DNA, 13 bp, Homo sapiens
cagaggaggcctc

SEQ ID NO: 932770 - DNA, 14 bp, Homo sapiens
cagaggaggcctca

SEQ ID NO: 932771 - DNA, 15 bp, Homo sapiens
cagaggaggcctcaa

SEQ ID NO: 932772 - DNA, 23 bp, Homo sapiens
cagaggagtaaataattggaaaa

SEQ ID NO: 932773 - DNA, 22 bp, Homo sapiens
cagaggagtgattgaaccagct

SEQ ID NO: 932774 - DNA, 16 bp, Homo sapiens
cagaggagtgcagcct

SEQ ID NO: 932775 - DNA, 16 bp, Homo sapiens
cagaggagtggatctg

SEQ ID NO: 932776 - DNA, 18 bp, Homo sapiens
cagaggatgccttttctg

SEQ ID NO: 932777 - DNA, 23 bp, Homo sapiens
cagaggcagcaccaccacacagt

SEQ ID NO: 932778 - DNA, 18 bp, Homo sapiens
cagaggcaggagtggcag

SEQ ID NO: 932779 - DNA, 21 bp, Homo sapiens
cagaggcaggctgggacggac

SEQ ID NO: 932780 - DNA, 16 bp, Homo sapiens
cagaggcagtggccac

SEQ ID NO: 932781 - DNA, 17 bp, Homo sapiens
cagaggccaaggactga

SEQ ID NO: 932782 - DNA, 23 bp, Homo sapiens
cagaggcccccagcccagggctc

SEQ ID NO: 932783 - DNA, 14 bp, Homo sapiens
cagaggcccccagt

SEQ ID NO: 932784 - DNA, 20 bp, Homo sapiens
cagaggcccccagtggggac

SEQ ID NO: 932785 - DNA, 20 bp, Homo sapiens
cagaggccctcgctgccagc

SEQ ID NO: 932786 - DNA, 17 bp, Homo sapiens
cagaggccctgaagcct

SEQ ID NO: 932787 - DNA, 18 bp, Homo sapiens
cagaggccctgaagcctc

SEQ ID NO: 932788 - DNA, 15 bp, Homo sapiens
cagaggccctgccac

SEQ ID NO: 932789 - DNA, 20 bp, Homo sapiens
cagaggccctgccacgtccc

SEQ ID NO: 932790 - DNA, 21 bp, Homo sapiens
cagaggcctgctgccagtgca

SEQ ID NO: 932791 - DNA, 14 bp, Homo sapiens
cagaggcctgggct

SEQ ID NO: 932792 - DNA, 19 bp, Homo sapiens
cagaggcctgggctgggaa

SEQ ID NO: 932793 - DNA, 17 bp, Homo sapiens
cagaggcgcactgtgac

SEQ ID NO: 932794 - DNA, 16 bp, Homo sapiens
cagaggctaagatgag

SEQ ID NO: 932795 - DNA, 14 bp, Homo sapiens
cagaggctgagccc

SEQ ID NO: 932796 - DNA, 15 bp, Homo sapiens
cagaggctgagccct

SEQ ID NO: 932797 - DNA, 13 bp, Homo sapiens
cagaggctggagg

SEQ ID NO: 932798 - DNA, 14 bp, Homo sapiens
cagaggctggaggc

SEQ ID NO: 932799 - DNA, 13 bp, Homo sapiens
cagaggctggcac

SEQ ID NO: 932800 - DNA, 14 bp, Homo sapiens
cagaggctggcact

SEQ ID NO: 932801 - DNA, 13 bp, Homo sapiens
cagaggctgggtt

SEQ ID NO: 932802 - DNA, 17 bp, Homo sapiens
cagaggctgtggctggt

SEQ ID NO: 932803 - DNA, 16 bp, Homo sapiens
cagagggaagccatgt

SEQ ID NO: 932804 - DNA, 20 bp, Homo sapiens
cagagggaaggggcctacac

SEQ ID NO: 932805 - DNA, 17 bp, Homo sapiens
cagagggaatgttccct

SEQ ID NO: 932806 - DNA, 21 bp, Homo sapiens
cagagggaatgttccctgcac

SEQ ID NO: 932807 - DNA, 23 bp, Homo sapiens
cagagggaatgttccctgcaccc

SEQ ID NO: 932808 - DNA, 20 bp, Homo sapiens
cagagggaccaaattgcttc

SEQ ID NO: 932809 - DNA, 22 bp, Homo sapiens
cagagggaggaatcgaggaacc

SEQ ID NO: 932810 - DNA, 23 bp, Homo sapiens
cagagggaggaatcgaggaacca

SEQ ID NO: 932811 - DNA, 12 bp, Homo sapiens
cagagggagttt

SEQ ID NO: 932812 - DNA, 14 bp, Homo sapiens
cagagggcactctg

SEQ ID NO: 932813 - DNA, 16 bp, Homo sapiens
cagagggcagaggctg

SEQ ID NO: 932814 - DNA, 13 bp, Homo sapiens
cagagggccagag

SEQ ID NO: 932815 - DNA, 17 bp, Homo sapiens
cagagggccagagctag

SEQ ID NO: 932816 - DNA, 13 bp, Homo sapiens
cagagggccagca

SEQ ID NO: 932817 - DNA, 10 bp, Homo sapiens
cagagggctg

SEQ ID NO: 932818 - DNA, 19 bp, Homo sapiens
cagagggctggaggcccag

SEQ ID NO: 932819 - DNA, 21 bp, Homo sapiens
cagagggctggaggcccaggc

SEQ ID NO: 932820 - DNA, 17 bp, Homo sapiens
cagaggggactctgacc

SEQ ID NO: 932821 - DNA, 15 bp, Homo sapiens
cagaggggactctgg

SEQ ID NO: 932822 - DNA, 17 bp, Homo sapiens
cagaggggactctgggc

SEQ ID NO: 932823 - DNA, 15 bp, Homo sapiens
cagaggggcagccgc

SEQ ID NO: 932824 - DNA, 18 bp, Homo sapiens
cagaggggctttctggag

SEQ ID NO: 932825 - DNA, 15 bp, Homo sapiens
cagaggggtaggcag

SEQ ID NO: 932826 - DNA, 21 bp, Homo sapiens
cagaggggtaggcagagcctt

SEQ ID NO: 932827 - DNA, 21 bp, Homo sapiens
cagagggtcccattgtgcaga

SEQ ID NO: 932828 - DNA, 21 bp, Homo sapiens
cagaggtaaaagtgtgagcag

SEQ ID NO: 932829 - DNA, 14 bp, Homo sapiens
cagaggtccagccc

SEQ ID NO: 932830 - DNA, 17 bp, Homo sapiens
cagaggtccagcccatc

SEQ ID NO: 932831 - DNA, 15 bp, Homo sapiens
cagaggtcccagccc

SEQ ID NO: 932832 - DNA, 17 bp, Homo sapiens
cagaggtctagattaat

SEQ ID NO: 932833 - DNA, 20 bp, Homo sapiens
cagaggtctctgccggctct

SEQ ID NO: 932834 - DNA, 15 bp, Homo sapiens
cagaggtctgtgctg

SEQ ID NO: 932835 - DNA, 16 bp, Homo sapiens
cagaggtctgtgctga

SEQ ID NO: 932836 - DNA, 16 bp, Homo sapiens
cagaggtcttcagggc

SEQ ID NO: 932837 - DNA, 17 bp, Homo sapiens
cagaggtcttcagggct

SEQ ID NO: 932838 - DNA, 22 bp, Homo sapiens
cagaggtgattcttacatatga

SEQ ID NO: 932839 - DNA, 20 bp, Homo sapiens
cagaggtggatgttatgaac

SEQ ID NO: 932840 - DNA, 22 bp, Homo sapiens
cagaggtggatgttatgaacag

SEQ ID NO: 932841 - DNA, 19 bp, Homo sapiens
cagaggtggccagagctgg

SEQ ID NO: 932842 - DNA, 12 bp, Homo sapiens
cagaggtggccc

SEQ ID NO: 932843 - DNA, 19 bp, Homo sapiens
cagaggtgggatcctccct

SEQ ID NO: 932844 - DNA, 16 bp, Homo sapiens
cagaggtgggcaggtg

SEQ ID NO: 932845 - DNA, 20 bp, Homo sapiens
cagaggtgggcaggtggtgg

SEQ ID NO: 932846 - DNA, 14 bp, Homo sapiens
ctctgggctgagga

SEQ ID NO: 932847 - DNA, 17 bp, Homo sapiens
ctctgggctgccatgtg

SEQ ID NO: 932848 - DNA, 11 bp, Homo sapiens
ctctgggctgt

SEQ ID NO: 932849 - DNA, 12 bp, Homo sapiens
ctctggggacag

SEQ ID NO: 932850 - DNA, 22 bp, Homo sapiens
ctctggggaccctccagaggtg

SEQ ID NO: 932851 - DNA, 17 bp, Homo sapiens
ctctggggccacacaga

SEQ ID NO: 932852 - DNA, 14 bp, Homo sapiens
ctctggggccctgg

SEQ ID NO: 932853 - DNA, 15 bp, Homo sapiens
ctctgggggacccag

SEQ ID NO: 932854 - DNA, 16 bp, Homo sapiens
ctctgggggacccagg

SEQ ID NO: 932855 - DNA, 13 bp, Homo sapiens
ctctgggggaggc

SEQ ID NO: 932856 - DNA, 16 bp, Homo sapiens
ctctgggggaggcagg

SEQ ID NO: 932857 - DNA, 21 bp, Homo sapiens
ctctgggggaggcagggctgg

SEQ ID NO: 932858 - DNA, 22 bp, Homo sapiens
ctctgggggaggcagggctgga

SEQ ID NO: 932859 - DNA, 14 bp, Homo sapiens
ctctgggtcccggg

SEQ ID NO: 932860 - DNA, 22 bp, Homo sapiens
ctctgggtcccggggtgcattt

SEQ ID NO: 932861 - DNA, 16 bp, Homo sapiens
ctctgggtccctcctc

SEQ ID NO: 932862 - DNA, 17 bp, Homo sapiens
ctctgggtcttggccat

SEQ ID NO: 932863 - DNA, 19 bp, Homo sapiens
ctctgggttccagcagagg

SEQ ID NO: 932864 - DNA, 21 bp, Homo sapiens
ctctgggttcgttggggacat

SEQ ID NO: 932865 - DNA, 21 bp, Homo sapiens
ctctgggtttcatatccagct

SEQ ID NO: 932866 - DNA, 20 bp, Homo sapiens
ctctggtaaacattcctcca

SEQ ID NO: 932867 - DNA, 21 bp, Homo sapiens
ctctggtggccacttcattcc

SEQ ID NO: 932868 - DNA, 18 bp, Homo sapiens
ctctggtggcttaagtga

SEQ ID NO: 932869 - DNA, 18 bp, Homo sapiens
ctctggtggtcttccttc

SEQ ID NO: 932870 - DNA, 15 bp, Homo sapiens
ctctggtgtctttga

SEQ ID NO: 932871 - DNA, 18 bp, Homo sapiens
ctctggtgtgtggtgagg

SEQ ID NO: 932872 - DNA, 13 bp, Homo sapiens
ctctggttctttg

SEQ ID NO: 932873 - DNA, 12 bp, Homo sapiens
ctctggttgcct

SEQ ID NO: 932874 - DNA, 23 bp, Homo sapiens
ctctgtaaaaacactgaaaaatt

SEQ ID NO: 932875 - DNA, 18 bp, Homo sapiens
ctctgtagggaactctgg

SEQ ID NO: 932876 - DNA, 21 bp, Homo sapiens
ctctgtagtctcagttcgtgt

SEQ ID NO: 932877 - DNA, 14 bp, Homo sapiens
ctctgtagtttatg

SEQ ID NO: 932878 - DNA, 17 bp, Homo sapiens
ctctgtagtttatggca

SEQ ID NO: 932879 - DNA, 21 bp, Homo sapiens
ctctgtataatagagataagt

SEQ ID NO: 932880 - DNA, 15 bp, Homo sapiens
ctctgtcaatgaaaa

SEQ ID NO: 932881 - DNA, 19 bp, Homo sapiens
ctctgtcacatccaactgg

SEQ ID NO: 932882 - DNA, 16 bp, Homo sapiens
ctctgtcacccttgtc

SEQ ID NO: 932883 - DNA, 12 bp, Homo sapiens
cagcacccccac

SEQ ID NO: 932884 - DNA, 16 bp, Homo sapiens
cagcacccccacccac

SEQ ID NO: 932885 - DNA, 20 bp, Homo sapiens
cagcacccccacccacctcc

SEQ ID NO: 932886 - DNA, 13 bp, Homo sapiens
cagcaccccttcc

SEQ ID NO: 932887 - DNA, 23 bp, Homo sapiens
cagcaccccttccatgtggagaa

SEQ ID NO: 932888 - DNA, 14 bp, Homo sapiens
cagcaccctccccc

SEQ ID NO: 932889 - DNA, 19 bp, Homo sapiens
cagcaccctcccccgcagc

SEQ ID NO: 932890 - DNA, 13 bp, Homo sapiens
cagcaccctgggt

SEQ ID NO: 932891 - DNA, 17 bp, Homo sapiens
cagcaccctgggtgcca

SEQ ID NO: 932892 - DNA, 18 bp, Homo sapiens
cagcaccgttctgtgcac

SEQ ID NO: 932893 - DNA, 15 bp, Homo sapiens
cagcacctacagtgt

SEQ ID NO: 932894 - DNA, 19 bp, Homo sapiens
cagcacctattgaattacc

SEQ ID NO: 932895 - DNA, 13 bp, Homo sapiens
cagcacctgcctc

SEQ ID NO: 932896 - DNA, 21 bp, Homo sapiens
cagcaccttctttctggactg

SEQ ID NO: 932897 - DNA, 17 bp, Homo sapiens
cagcaccttggcccagg

SEQ ID NO: 932898 - DNA, 17 bp, Homo sapiens
cagcacctttctctgag

SEQ ID NO: 932899 - DNA, 18 bp, Homo sapiens
cagcacctttctctgaga

SEQ ID NO: 932900 - DNA, 18 bp, Homo sapiens
cagcacgatttctgttta

SEQ ID NO: 932901 - DNA, 19 bp, Homo sapiens
cagcacgatttctgtttag

SEQ ID NO: 932902 - DNA, 23 bp, Homo sapiens
cagcacgcggccttgtctgggtg

SEQ ID NO: 932903 - DNA, 19 bp, Homo sapiens
cagcacggcccggcccctc

SEQ ID NO: 932904 - DNA, 18 bp, Homo sapiens
cagcacgggggccaagga

SEQ ID NO: 932905 - DNA, 20 bp, Homo sapiens
cagcactaaagcagtggaca

SEQ ID NO: 932906 - DNA, 11 bp, Homo sapiens
cagcactactc

SEQ ID NO: 932907 - DNA, 20 bp, Homo sapiens
cagcactactgggtgtcatt

SEQ ID NO: 932908 - DNA, 20 bp, Homo sapiens
cagcactatgctttccttct

SEQ ID NO: 932909 - DNA, 15 bp, Homo sapiens
cagcactcagcctca

SEQ ID NO: 932910 - DNA, 19 bp, Homo sapiens
cagcactcagcctcattca

SEQ ID NO: 932911 - DNA, 23 bp, Homo sapiens
cagcactccccagagctgtgcca

SEQ ID NO: 932912 - DNA, 20 bp, Homo sapiens
cagcactcccgctgcacaca

SEQ ID NO: 932913 - DNA, 22 bp, Homo sapiens
cagcactcccgctgcacacaga

SEQ ID NO: 932914 - DNA, 17 bp, Homo sapiens
cagcactccgcatcacc

SEQ ID NO: 932915 - DNA, 21 bp, Homo sapiens
cagcactccgcatcacctcac

SEQ ID NO: 932916 - DNA, 20 bp, Homo sapiens
cagcactgcccatcagtgac

SEQ ID NO: 932917 - DNA, 16 bp, Homo sapiens
cagcactgcctcctgt

SEQ ID NO: 932918 - DNA, 19 bp, Homo sapiens
cagcactggctctctccag

SEQ ID NO: 932919 - DNA, 23 bp, Homo sapiens
cagcactggctctctccaggatc

SEQ ID NO: 932920 - DNA, 13 bp, Homo sapiens
cagcactgtccct

SEQ ID NO: 932921 - DNA, 14 bp, Homo sapiens
cagcactgtctcag

SEQ ID NO: 932922 - DNA, 13 bp, Homo sapiens
cagcacttattta

SEQ ID NO: 932923 - DNA, 18 bp, Homo sapiens
cagcacttgtccagctga

SEQ ID NO: 932924 - DNA, 17 bp, Homo sapiens
cagcactttaaccctct

SEQ ID NO: 932925 - DNA, 18 bp, Homo sapiens
cagcactttaaccctctc

SEQ ID NO: 932926 - DNA, 18 bp, Homo sapiens
cagcactttgggaggccg

SEQ ID NO: 932927 - DNA, 18 bp, Homo sapiens
cagcactttgggaggctg

SEQ ID NO: 932928 - DNA, 22 bp, Homo sapiens
cagcactttgggaggctgaggt

SEQ ID NO: 932929 - DNA, 19 bp, Homo sapiens
cagcactttggtaggcaaa

SEQ ID NO: 932930 - DNA, 16 bp, Homo sapiens
cagcagaaatgccccc

SEQ ID NO: 932931 - DNA, 20 bp, Homo sapiens
cagcagaacaagtgcctcct

SEQ ID NO: 932932 - DNA, 20 bp, Homo sapiens
cagcagaagcctccaagcac

SEQ ID NO: 932933 - DNA, 15 bp, Homo sapiens
cagcagaatggaggc

SEQ ID NO: 932934 - DNA, 12 bp, Homo sapiens
cagcagacagag

SEQ ID NO: 932935 - DNA, 21 bp, Homo sapiens
cagcagactcagctctgacat

SEQ ID NO: 932936 - DNA, 13 bp, Homo sapiens
cagcagagagccc

SEQ ID NO: 932937 - DNA, 16 bp, Homo sapiens
cagcagagagccctgg

SEQ ID NO: 932938 - DNA, 17 bp, Homo sapiens
cagcagagagccctggg

SEQ ID NO: 932939 - DNA, 16 bp, Homo sapiens
cagcagagcccaccag

SEQ ID NO: 932940 - DNA, 20 bp, Homo sapiens
cagcagagcccaccagccag

SEQ ID NO: 932941 - DNA, 21 bp, Homo sapiens
cagcagagcccaccagccagc

SEQ ID NO: 932942 - DNA, 22 bp, Homo sapiens
cagcagagcggggtcccctctg

SEQ ID NO: 932943 - DNA, 10 bp, Homo sapiens
cagcagagga

SEQ ID NO: 932944 - DNA, 13 bp, Homo sapiens
cagcagaggcagg

SEQ ID NO: 932945 - DNA, 16 bp, Homo sapiens
cagcagaggcaggctg

SEQ ID NO: 932946 - DNA, 23 bp, Homo sapiens
cagcagagggggagtagccaagc

SEQ ID NO: 932947 - DNA, 15 bp, Homo sapiens
cagcagaggtgagaa

SEQ ID NO: 932948 - DNA, 20 bp, Homo sapiens
cagcagagttattgaatctt

SEQ ID NO: 932949 - DNA, 15 bp, Homo sapiens
cagcagatgccagtg

SEQ ID NO: 932950 - DNA, 17 bp, Homo sapiens
cagcagatgccagtgaa

SEQ ID NO: 932951 - DNA, 17 bp, Homo sapiens
cagcagattccacagga

SEQ ID NO: 932952 - DNA, 20 bp, Homo sapiens
cagcagattccacaggacac

SEQ ID NO: 932953 - DNA, 15 bp, Homo sapiens
cagcagcaaattttc

SEQ ID NO: 932954 - DNA, 21 bp, Homo sapiens
cagcagcacaattctgtccct

SEQ ID NO: 932955 - DNA, 16 bp, Homo sapiens
cagcagcacctttctc

SEQ ID NO: 932956 - DNA, 17 bp, Homo sapiens
cagcagcacctttctct

SEQ ID NO: 932957 - DNA, 19 bp, Homo sapiens
cagcagcacctttctctga

SEQ ID NO: 932958 - DNA, 22 bp, Homo sapiens
cagcagcactcccgctgcacac

SEQ ID NO: 932959 - DNA, 12 bp, Homo sapiens
cagcagcagcag

SEQ ID NO: 932960 - DNA, 15 bp, Homo sapiens
cagcagcagcagcag

SEQ ID NO: 932961 - DNA, 15 bp, Homo sapiens
cagcagcagcaggtg

SEQ ID NO: 932962 - DNA, 13 bp, Homo sapiens
cagcagcagccct

SEQ ID NO: 932963 - DNA, 16 bp, Homo sapiens
cagcagcagccctgcc

SEQ ID NO: 932964 - DNA, 12 bp, Homo sapiens
cagcagcaggtg

SEQ ID NO: 932965 - DNA, 14 bp, Homo sapiens
cagcagccagcacc

SEQ ID NO: 932966 - DNA, 15 bp, Homo sapiens
cagcagccagcacca

SEQ ID NO: 932967 - DNA, 15 bp, Homo sapiens
cagcagccagctctc

SEQ ID NO: 932968 - DNA, 19 bp, Homo sapiens
ctcttctggagtttctcta

SEQ ID NO: 932969 - DNA, 20 bp, Homo sapiens
ctcttctggagtttctctaa

SEQ ID NO: 932970 - DNA, 22 bp, Homo sapiens
ctcttctgggcagagcctgtcc

SEQ ID NO: 932971 - DNA, 23 bp, Homo sapiens
ctcttctggggcaggctgggcca

SEQ ID NO: 932972 - DNA, 16 bp, Homo sapiens
ctcttctgtccatcag

SEQ ID NO: 932973 - DNA, 15 bp, Homo sapiens
ctcttctgtgcccag

SEQ ID NO: 932974 - DNA, 18 bp, Homo sapiens
ctcttctgtgcccagggt

SEQ ID NO: 932975 - DNA, 16 bp, Homo sapiens
ctcttctgtgggtgac

SEQ ID NO: 932976 - DNA, 23 bp, Homo sapiens
ctcttctgtgggtgacccaggtc

SEQ ID NO: 932977 - DNA, 12 bp, Homo sapiens
ctcttcttcccc

SEQ ID NO: 932978 - DNA, 15 bp, Homo sapiens
ctcttcttcttcaga

SEQ ID NO: 932979 - DNA, 18 bp, Homo sapiens
ctcttctttaagccatag

SEQ ID NO: 932980 - DNA, 18 bp, Homo sapiens
ctcttctttattgcacta

SEQ ID NO: 932981 - DNA, 13 bp, Homo sapiens
ctcttctttctga

SEQ ID NO: 932982 - DNA, 14 bp, Homo sapiens
ctcttctttctgaa

SEQ ID NO: 932983 - DNA, 13 bp, Homo sapiens
ctcttgaaaagtt

SEQ ID NO: 932984 - DNA, 21 bp, Homo sapiens
ctcttgaaaagttcagggacc

SEQ ID NO: 932985 - DNA, 15 bp, Homo sapiens
ctcttgaccctgcac

SEQ ID NO: 932986 - DNA, 17 bp, Homo sapiens
ctcttgaccctgcaccc

SEQ ID NO: 932987 - DNA, 22 bp, Homo sapiens
ctcttgacttagacctatactg

SEQ ID NO: 932988 - DNA, 15 bp, Homo sapiens
ctcttgagcagtggc

SEQ ID NO: 932989 - DNA, 22 bp, Homo sapiens
ctcttgagcagtggctggtcca

SEQ ID NO: 932990 - DNA, 22 bp, Homo sapiens
ctcttgagcatcaatcttgtta

SEQ ID NO: 932991 - DNA, 16 bp, Homo sapiens
ctcttgagcctgggag

SEQ ID NO: 932992 - DNA, 18 bp, Homo sapiens
ctcttgagccttgaactt

SEQ ID NO: 932993 - DNA, 23 bp, Homo sapiens
ctcttgagccttgaactttgacc

SEQ ID NO: 932994 - DNA, 16 bp, Homo sapiens
ctcttgagctggcctc

SEQ ID NO: 932995 - DNA, 17 bp, Homo sapiens
ctcttgagttcctctgc

SEQ ID NO: 932996 - DNA, 20 bp, Homo sapiens
ctcttgagttcctctgcagt

SEQ ID NO: 932997 - DNA, 23 bp, Homo sapiens
ctcttgagtttgtcgctcatgtg

SEQ ID NO: 932998 - DNA, 19 bp, Homo sapiens
ctcttgatacccccctctg

SEQ ID NO: 932999 - DNA, 21 bp, Homo sapiens
ctcttgatacccccctctgtc

SEQ ID NO: 933000 - DNA, 20 bp, Homo sapiens
ctcttgatggtggactaagc

SEQ ID NO: 933001 - DNA, 13 bp, Homo sapiens
ctcttgatgtgaa

SEQ ID NO: 933002 - DNA, 23 bp, Homo sapiens
ctcttgatgtgaagataatttgc

SEQ ID NO: 933003 - DNA, 15 bp, Homo sapiens
ctcttgattataaat

SEQ ID NO: 933004 - DNA, 14 bp, Homo sapiens
ctcttgattcctgg

SEQ ID NO: 933005 - DNA, 21 bp, Homo sapiens
ctcttgattcctggtttgact

SEQ ID NO: 933006 - DNA, 17 bp, Homo sapiens
ctcttgatttgggtgga

SEQ ID NO: 933007 - DNA, 13 bp, Homo sapiens
ctcttgcaggctg

SEQ ID NO: 933008 - DNA, 18 bp, Homo sapiens
ctcttgcaggctgagtcc

SEQ ID NO: 933009 - DNA, 16 bp, Homo sapiens
ctcttgccactgcctc

SEQ ID NO: 933010 - DNA, 20 bp, Homo sapiens
ctcttgccactgcctcttcc

SEQ ID NO: 933011 - DNA, 14 bp, Homo sapiens
ctcttgccagcctc

SEQ ID NO: 933012 - DNA, 15 bp, Homo sapiens
ctcttgccagcctcc

SEQ ID NO: 933013 - DNA, 19 bp, Homo sapiens
ctcttgccagcctccttgc

SEQ ID NO: 933014 - DNA, 14 bp, Homo sapiens
ctcttgcccatcct

SEQ ID NO: 933015 - DNA, 14 bp, Homo sapiens
cagccacacctgga

SEQ ID NO: 933016 - DNA, 18 bp, Homo sapiens
cagccacacctggactga

SEQ ID NO: 933017 - DNA, 13 bp, Homo sapiens
cagccacactggg

SEQ ID NO: 933018 - DNA, 15 bp, Homo sapiens
cagccacacttcctt

SEQ ID NO: 933019 - DNA, 12 bp, Homo sapiens
cagccacaggac

SEQ ID NO: 933020 - DNA, 20 bp, Homo sapiens
cagccacaggactgagccct

SEQ ID NO: 933021 - DNA, 23 bp, Homo sapiens
cagccacattgagactttcttct

SEQ ID NO: 933022 - DNA, 16 bp, Homo sapiens
cagccaccaccctcag

SEQ ID NO: 933023 - DNA, 23 bp, Homo sapiens
cagccaccaccctcaggtgcctc

SEQ ID NO: 933024 - DNA, 14 bp, Homo sapiens
cagccaccagtgga

SEQ ID NO: 933025 - DNA, 21 bp, Homo sapiens
cagccaccagtggacctagcc

SEQ ID NO: 933026 - DNA, 17 bp, Homo sapiens
cagccacccaagcctgc

SEQ ID NO: 933027 - DNA, 21 bp, Homo sapiens
cagccacccaagcctgctggc

SEQ ID NO: 933028 - DNA, 11 bp, Homo sapiens
cagccaccccg

SEQ ID NO: 933029 - DNA, 17 bp, Homo sapiens
cagccaccccgggctct

SEQ ID NO: 933030 - DNA, 20 bp, Homo sapiens
cagccaccccgggctctctg

SEQ ID NO: 933031 - DNA, 18 bp, Homo sapiens
cagccacccctgccactc

SEQ ID NO: 933032 - DNA, 14 bp, Homo sapiens
cagccaccctgagt

SEQ ID NO: 933033 - DNA, 16 bp, Homo sapiens
cagccacctaaacggt

SEQ ID NO: 933034 - DNA, 10 bp, Homo sapiens
cagccacctc

SEQ ID NO: 933035 - DNA, 17 bp, Homo sapiens
cagccacctccctctgc

SEQ ID NO: 933036 - DNA, 16 bp, Homo sapiens
cagccacgactgccat

SEQ ID NO: 933037 - DNA, 20 bp, Homo sapiens
cagccacggagggaggcacc

SEQ ID NO: 933038 - DNA, 14 bp, Homo sapiens
cagccactccaagc

SEQ ID NO: 933039 - DNA, 10 bp, Homo sapiens
cagccactgc

SEQ ID NO: 933040 - DNA, 15 bp, Homo sapiens
cagccactgcttagc

SEQ ID NO: 933041 - DNA, 13 bp, Homo sapiens
cagccacttggtt

SEQ ID NO: 933042 - DNA, 20 bp, Homo sapiens
cagccagaaagcactacaat

SEQ ID NO: 933043 - DNA, 17 bp, Homo sapiens
cagccagaacgtggctc

SEQ ID NO: 933044 - DNA, 22 bp, Homo sapiens
cagccagaacgtggctctgctg

SEQ ID NO: 933045 - DNA, 12 bp, Homo sapiens
cagccagagctg

SEQ ID NO: 933046 - DNA, 24 bp, Homo sapiens
cagccagagctgtgcctgctcagc

SEQ ID NO: 933047 - DNA, 15 bp, Homo sapiens
cagccagagttcctg

SEQ ID NO: 933048 - DNA, 13 bp, Homo sapiens
cagccagcaatga

SEQ ID NO: 933049 - DNA, 14 bp, Homo sapiens
cagccagcaccacc

SEQ ID NO: 933050 - DNA, 13 bp, Homo sapiens
cagccagcagcag

SEQ ID NO: 933051 - DNA, 18 bp, Homo sapiens
cagccagcagccagctct

SEQ ID NO: 933052 - DNA, 19 bp, Homo sapiens
cagccagcagccagctctc

SEQ ID NO: 933053 - DNA, 11 bp, Homo sapiens
cagccagccca

SEQ ID NO: 933054 - DNA, 13 bp, Homo sapiens
cagccagcccagc

SEQ ID NO: 933055 - DNA, 15 bp, Homo sapiens
cagccagcccagccc

SEQ ID NO: 933056 - DNA, 16 bp, Homo sapiens
cagccagcccagccca

SEQ ID NO: 933057 - DNA, 21 bp, Homo sapiens
cagccagcccatggcccccaa

SEQ ID NO: 933058 - DNA, 12 bp, Homo sapiens
cagccagccctg

SEQ ID NO: 933059 - DNA, 17 bp, Homo sapiens
cagccagccgccctggg

SEQ ID NO: 933060 - DNA, 18 bp, Homo sapiens
cagccagccgccctgggc

SEQ ID NO: 933061 - DNA, 19 bp, Homo sapiens
cagccagccgccctgggct

SEQ ID NO: 933062 - DNA, 23 bp, Homo sapiens
cagccagccgccctgggctgtct

SEQ ID NO: 933063 - DNA, 20 bp, Homo sapiens
cagccagccggtgcctggcg

SEQ ID NO: 933064 - DNA, 12 bp, Homo sapiens
cagccagcctca

SEQ ID NO: 933065 - DNA, 20 bp, Homo sapiens
cagccagcgcctccctccac

SEQ ID NO: 933066 - DNA, 16 bp, Homo sapiens
cagccagctctcagcc

SEQ ID NO: 933067 - DNA, 18 bp, Homo sapiens
cagccagctctcagccaa

SEQ ID NO: 933068 - DNA, 19 bp, Homo sapiens
cagccagctgcagggcacg

SEQ ID NO: 933069 - DNA, 11 bp, Homo sapiens
cagccaggacc

SEQ ID NO: 933070 - DNA, 21 bp, Homo sapiens
cagccaggacccgcctgctcc

SEQ ID NO: 933071 - DNA, 22 bp, Homo sapiens
cagccaggagcagatggacagc

SEQ ID NO: 933072 - DNA, 18 bp, Homo sapiens
cagccaggagctgtcacc

SEQ ID NO: 933073 - DNA, 12 bp, Homo sapiens
cagccaggaggg

SEQ ID NO: 933074 - DNA, 21 bp, Homo sapiens
cagccaggcagaggttttaat

SEQ ID NO: 933075 - DNA, 23 bp, Homo sapiens
cagccaggccaacagcacctccc

SEQ ID NO: 933076 - DNA, 12 bp, Homo sapiens
cagccaggccca

SEQ ID NO: 933077 - DNA, 14 bp, Homo sapiens
cagccaggcccagg

SEQ ID NO: 933078 - DNA, 16 bp, Homo sapiens
cagccaggcccaggcc

SEQ ID NO: 933079 - DNA, 19 bp, Homo sapiens
cagccaggcccaggccagc

SEQ ID NO: 933080 - DNA, 15 bp, Homo sapiens
cagccaggccctgcc

SEQ ID NO: 933081 - DNA, 14 bp, Homo sapiens
cagccaggcgggct

SEQ ID NO: 933082 - DNA, 18 bp, Homo sapiens
cagccaggcgggctcaag

SEQ ID NO: 933083 - DNA, 20 bp, Homo sapiens
cagccaggcgggctcaagga

SEQ ID NO: 933084 - DNA, 21 bp, Homo sapiens
cagccaggctatggttgccac

SEQ ID NO: 933085 - DNA, 12 bp, Homo sapiens
cagccaggctgc

SEQ ID NO: 933086 - DNA, 16 bp, Homo sapiens
cagccaggctgggccg

SEQ ID NO: 933087 - DNA, 17 bp, Homo sapiens
cagccaggctgggccgc

SEQ ID NO: 933088 - DNA, 18 bp, Homo sapiens
cagccagggagcttgcca

SEQ ID NO: 933089 - DNA, 11 bp, Homo sapiens
cagccagggcc

SEQ ID NO: 933090 - DNA, 15 bp, Homo sapiens
cagccagggccaggg

SEQ ID NO: 933091 - DNA, 18 bp, Homo sapiens
cagccaggtttagcggca

SEQ ID NO: 933092 - DNA, 13 bp, Homo sapiens
cagccagtaaatg

SEQ ID NO: 933093 - DNA, 22 bp, Homo sapiens
cagccagtcccgtttcatttag

SEQ ID NO: 933094 - DNA, 12 bp, Homo sapiens
cagccagtctca

SEQ ID NO: 933095 - DNA, 16 bp, Homo sapiens
cagccagtctcagaga

SEQ ID NO: 933096 - DNA, 21 bp, Homo sapiens
cagccagtctcagagaccagc

SEQ ID NO: 933097 - DNA, 17 bp, Homo sapiens
cagccagtctcagatgc

SEQ ID NO: 933098 - DNA, 16 bp, Homo sapiens
cagccagtcttgccta

SEQ ID NO: 933099 - DNA, 22 bp, Homo sapiens
cagccagtgacctttgacctcg

SEQ ID NO: 933100 - DNA, 17 bp, Homo sapiens
cagccataaaagcattg

SEQ ID NO: 933101 - DNA, 22 bp, Homo sapiens
cagccataaaagcattgtctct

SEQ ID NO: 933102 - DNA, 16 bp, Homo sapiens
cagccataggtgcagt

SEQ ID NO: 933103 - DNA, 22 bp, Homo sapiens
cagccatatggaaaagattgaa

SEQ ID NO: 933104 - DNA, 20 bp, Homo sapiens
cagccatcccgcttagcctg

SEQ ID NO: 933105 - DNA, 21 bp, Homo sapiens
cagccatcccgcttagcctgc

SEQ ID NO: 933106 - DNA, 23 bp, Homo sapiens
cagccatcccgcttagcctgcct

SEQ ID NO: 933107 - DNA, 16 bp, Homo sapiens
cagccatgaagtcacc

SEQ ID NO: 933108 - DNA, 18 bp, Homo sapiens
cagccatgaggagttgct

SEQ ID NO: 933109 - DNA, 13 bp, Homo sapiens
cagccatgcctca

SEQ ID NO: 933110 - DNA, 14 bp, Homo sapiens
cagccatgcctcat

SEQ ID NO: 933111 - DNA, 16 bp, Homo sapiens
cagccatgcctcatgc

SEQ ID NO: 933112 - DNA, 19 bp, Homo sapiens
cagccatgcctcatgccac

SEQ ID NO: 933113 - DNA, 17 bp, Homo sapiens
cagccatgtctgcattt

SEQ ID NO: 933114 - DNA, 12 bp, Homo sapiens
cagccattaaaa

SEQ ID NO: 933115 - DNA, 18 bp, Homo sapiens
cagccattaaaataaaac

SEQ ID NO: 933116 - DNA, 20 bp, Homo sapiens
cagccattaaaataaaacaa

SEQ ID NO: 933117 - DNA, 23 bp, Homo sapiens
cagccattaaaataaaacaagcc

SEQ ID NO: 933118 - DNA, 19 bp, Homo sapiens
cagccattggctatttaaa

SEQ ID NO: 933119 - DNA, 20 bp, Homo sapiens
cagccattggctatttaaaa

SEQ ID NO: 933120 - DNA, 20 bp, Homo sapiens
cagcccaaaggggacaggcc

SEQ ID NO: 933121 - DNA, 22 bp, Homo sapiens
cagcccaaaggggacaggcctc

SEQ ID NO: 933122 - DNA, 16 bp, Homo sapiens
cagcccaacttccaga

SEQ ID NO: 933123 - DNA, 19 bp, Homo sapiens
cagcccaacttcttacccg

SEQ ID NO: 933124 - DNA, 12 bp, Homo sapiens
cagcccacagag

SEQ ID NO: 933125 - DNA, 16 bp, Homo sapiens
cagcccacagagcctg

SEQ ID NO: 933126 - DNA, 19 bp, Homo sapiens
cagcccacccccctcattt

SEQ ID NO: 933127 - DNA, 17 bp, Homo sapiens
cagcccaccctgctcct

SEQ ID NO: 933128 - DNA, 21 bp, Homo sapiens
cagcccacctcaacccagagg

SEQ ID NO: 933129 - DNA, 17 bp, Homo sapiens
cagcccagaaccacaga

SEQ ID NO: 933130 - DNA, 14 bp, Homo sapiens
cagcccagagactt

SEQ ID NO: 933131 - DNA, 15 bp, Homo sapiens
cagcccagagcctgg

SEQ ID NO: 933132 - DNA, 18 bp, Homo sapiens
cagcccagagcctggctg

SEQ ID NO: 933133 - DNA, 15 bp, Homo sapiens
cagcccagccaggcc

SEQ ID NO: 933134 - DNA, 14 bp, Homo sapiens
cagcccagcccagc

SEQ ID NO: 933135 - DNA, 16 bp, Homo sapiens
cagcccagccccactc

SEQ ID NO: 933136 - DNA, 20 bp, Homo sapiens
cagcccagcccgcccactgg

SEQ ID NO: 933137 - DNA, 12 bp, Homo sapiens
cagcccagcctg

SEQ ID NO: 933138 - DNA, 15 bp, Homo sapiens
cagcccagcttcctg

SEQ ID NO: 933139 - DNA, 20 bp, Homo sapiens
cagcccaggcatctccttgg

SEQ ID NO: 933140 - DNA, 19 bp, Homo sapiens
ctcttgcccatcctgactg

SEQ ID NO: 933141 - DNA, 20 bp, Homo sapiens
ctcttgccccactccctggc

SEQ ID NO: 933142 - DNA, 22 bp, Homo sapiens
ctcttgccccccaccccagcct

SEQ ID NO: 933143 - DNA, 12 bp, Homo sapiens
ctcttgcccctt

SEQ ID NO: 933144 - DNA, 14 bp, Homo sapiens
ctcttgccccttgt

SEQ ID NO: 933145 - DNA, 16 bp, Homo sapiens
ctcttgccccttgtcc

SEQ ID NO: 933146 - DNA, 19 bp, Homo sapiens
ctcttgccccttgtcctga

SEQ ID NO: 933147 - DNA, 17 bp, Homo sapiens
ctcttgcccgcacccct

SEQ ID NO: 933148 - DNA, 22 bp, Homo sapiens
ctcttgcccgcacccctccctg

SEQ ID NO: 933149 - DNA, 16 bp, Homo sapiens
ctcttgcccttccctg

SEQ ID NO: 933150 - DNA, 19 bp, Homo sapiens
ctcttgcccttccctgtcc

SEQ ID NO: 933151 - DNA, 20 bp, Homo sapiens
ctcttgcccttccctgtccc

SEQ ID NO: 933152 - DNA, 21 bp, Homo sapiens
ctcttgcccttccctgtccct

SEQ ID NO: 933153 - DNA, 15 bp, Homo sapiens
ctcttgcctctctca

SEQ ID NO: 933154 - DNA, 16 bp, Homo sapiens
ctcttgcgggcctgga

SEQ ID NO: 933155 - DNA, 12 bp, Homo sapiens
ctcttgctcaaa

SEQ ID NO: 933156 - DNA, 20 bp, Homo sapiens
ctcttgctcaaaaatctgtt

SEQ ID NO: 933157 - DNA, 17 bp, Homo sapiens
ctcttgctctcttgtga

SEQ ID NO: 933158 - DNA, 14 bp, Homo sapiens
ctcttgctctttct

SEQ ID NO: 933159 - DNA, 14 bp, Homo sapiens
ctcttgctgtctct

SEQ ID NO: 933160 - DNA, 17 bp, Homo sapiens
ctcttgctgtctctgct

SEQ ID NO: 933161 - DNA, 22 bp, Homo sapiens
ctcttggaattacaagccctgg

SEQ ID NO: 933162 - DNA, 18 bp, Homo sapiens
ctcttggacaacagctct

SEQ ID NO: 933163 - DNA, 13 bp, Homo sapiens
ctcttggagaagt

SEQ ID NO: 933164 - DNA, 18 bp, Homo sapiens
ctcttggagaagtctcag

SEQ ID NO: 933165 - DNA, 15 bp, Homo sapiens
ctcttggagctgtga

SEQ ID NO: 933166 - DNA, 19 bp, Homo sapiens
ctcttggataccagctcag

SEQ ID NO: 933167 - DNA, 20 bp, Homo sapiens
ctcttggcaagatgtttctt

SEQ ID NO: 933168 - DNA, 21 bp, Homo sapiens
ctcttggcattttcctcgcct

SEQ ID NO: 933169 - DNA, 13 bp, Homo sapiens
ctcttggcttcca

SEQ ID NO: 933170 - DNA, 19 bp, Homo sapiens
ctcttggcttccagaaggc

SEQ ID NO: 933171 - DNA, 16 bp, Homo sapiens
ctcttggcttctcagc

SEQ ID NO: 933172 - DNA, 18 bp, Homo sapiens
ctcttggcttctcagccc

SEQ ID NO: 933173 - DNA, 20 bp, Homo sapiens
ctcttggcttctcagcccct

SEQ ID NO: 933174 - DNA, 22 bp, Homo sapiens
ctcttggcttctcagccccttt

SEQ ID NO: 933175 - DNA, 23 bp, Homo sapiens
ctcttggctttgtcacttttcct

SEQ ID NO: 933176 - DNA, 15 bp, Homo sapiens
ctcttgggcaggcag

SEQ ID NO: 933177 - DNA, 16 bp, Homo sapiens
ctcttgggcaggcaga

SEQ ID NO: 933178 - DNA, 17 bp, Homo sapiens
ctcttgggctgagactg

SEQ ID NO: 933179 - DNA, 19 bp, Homo sapiens
ctcttggggaccctgccta

SEQ ID NO: 933180 - DNA, 15 bp, Homo sapiens
ctcttggtacctgtg

SEQ ID NO: 933181 - DNA, 17 bp, Homo sapiens
ctcttggtccctggaag

SEQ ID NO: 933182 - DNA, 18 bp, Homo sapiens
ctcttggtccctggaagc

SEQ ID NO: 933183 - DNA, 15 bp, Homo sapiens
ctcttggtgaaataa

SEQ ID NO: 933184 - DNA, 19 bp, Homo sapiens
ctcttggtgaaataataaa

SEQ ID NO: 933185 - DNA, 14 bp, Homo sapiens
ctcttgtaaagact

SEQ ID NO: 933186 - DNA, 14 bp, Homo sapiens
ctcttgtaaataaa

SEQ ID NO: 933187 - DNA, 18 bp, Homo sapiens
ctcttgtaaataaagccc

SEQ ID NO: 933188 - DNA, 20 bp, Homo sapiens
ctcttgtaaataaagccctg

SEQ ID NO: 933189 - DNA, 21 bp, Homo sapiens
ctcttgtaatccgaatctctt

SEQ ID NO: 933190 - DNA, 23 bp, Homo sapiens
ctcttgtaatgatatagccagaa

SEQ ID NO: 933191 - DNA, 13 bp, Homo sapiens
ctcttgtcatttt

SEQ ID NO: 933192 - DNA, 21 bp, Homo sapiens
ctcttgtcccacgtgtcttcc

SEQ ID NO: 933193 - DNA, 23 bp, Homo sapiens
ctcttgtcccacgtgtcttccac

SEQ ID NO: 933194 - DNA, 14 bp, Homo sapiens
ctcttgtcccttgg

SEQ ID NO: 933195 - DNA, 21 bp, Homo sapiens
ctcttgtccctttccctacct

SEQ ID NO: 933196 - DNA, 14 bp, Homo sapiens
ctcttgtcctggcc

SEQ ID NO: 933197 - DNA, 19 bp, Homo sapiens
ctcttgtcctggcccttca

SEQ ID NO: 933198 - DNA, 13 bp, Homo sapiens
ctcttgtctcccc

SEQ ID NO: 933199 - DNA, 16 bp, Homo sapiens
ctcttgtctcccctgt

SEQ ID NO: 933200 - DNA, 19 bp, Homo sapiens
ctcttgtgctcacgctccc

SEQ ID NO: 933201 - DNA, 17 bp, Homo sapiens
ctcttgtgtccctggaa

SEQ ID NO: 933202 - DNA, 19 bp, Homo sapiens
ctcttgtttcactccacca

SEQ ID NO: 933203 - DNA, 15 bp, Homo sapiens
ctcttgtttctgtgc

SEQ ID NO: 933204 - DNA, 20 bp, Homo sapiens
ctctttaaactatgttccta

SEQ ID NO: 933205 - DNA, 21 bp, Homo sapiens
ctctttaacacattctttata

SEQ ID NO: 933206 - DNA, 21 bp, Homo sapiens
ctctttaactgtgtgaccagc

SEQ ID NO: 933207 - DNA, 15 bp, Homo sapiens
ctctttaacttctcg

SEQ ID NO: 933208 - DNA, 19 bp, Homo sapiens
ctctttaagttttgattaa

SEQ ID NO: 933209 - DNA, 16 bp, Homo sapiens
ctctttaatcttcagt

SEQ ID NO: 933210 - DNA, 16 bp, Homo sapiens
ctctttactcccttcc

SEQ ID NO: 933211 - DNA, 14 bp, Homo sapiens
ctctttactctggg

SEQ ID NO: 933212 - DNA, 21 bp, Homo sapiens
ctgaaacattcacacagggct

SEQ ID NO: 933213 - DNA, 20 bp, Homo sapiens
ctgaaacattccgaagaggg

SEQ ID NO: 933214 - DNA, 22 bp, Homo sapiens
ctgaaacattccgaagagggaa

SEQ ID NO: 933215 - DNA, 13 bp, Homo sapiens
ctgaaacatttca

SEQ ID NO: 933216 - DNA, 12 bp, Homo sapiens
ctgaaaccaaaa

SEQ ID NO: 933217 - DNA, 19 bp, Homo sapiens
ctgaaacccaaagccctgg

SEQ ID NO: 933218 - DNA, 22 bp, Homo sapiens
ctgaaacccgccctcaggggcc

SEQ ID NO: 933219 - DNA, 20 bp, Homo sapiens
ctgaaacctagtactgcccc

SEQ ID NO: 933220 - DNA, 13 bp, Homo sapiens
ctgaaacctgaga

SEQ ID NO: 933221 - DNA, 20 bp, Homo sapiens
ctgaaacgctcctttgtgtg

SEQ ID NO: 933222 - DNA, 23 bp, Homo sapiens
ctgaaactgtggggcttacagaa

SEQ ID NO: 933223 - DNA, 17 bp, Homo sapiens
ctgaaacttttctaaag

SEQ ID NO: 933224 - DNA, 16 bp, Homo sapiens
ctgaaagaaacagtta

SEQ ID NO: 933225 - DNA, 12 bp, Homo sapiens
ctgaaagaagaa

SEQ ID NO: 933226 - DNA, 13 bp, Homo sapiens
ctgaaagacagaa

SEQ ID NO: 933227 - DNA, 18 bp, Homo sapiens
ctgaaagacagaatgtca

SEQ ID NO: 933228 - DNA, 14 bp, Homo sapiens
ctgaaagacttgaa

SEQ ID NO: 933229 - DNA, 20 bp, Homo sapiens
ctgaaagagaagatggccat

SEQ ID NO: 933230 - DNA, 14 bp, Homo sapiens
ctgaaagaggccaa

SEQ ID NO: 933231 - DNA, 19 bp, Homo sapiens
ctgaaagatctctgtcaca

SEQ ID NO: 933232 - DNA, 15 bp, Homo sapiens
ctgaaagcagcagct

SEQ ID NO: 933233 - DNA, 19 bp, Homo sapiens
ctgaaagcagcagctagga

SEQ ID NO: 933234 - DNA, 12 bp, Homo sapiens
ctgaaagccacg

SEQ ID NO: 933235 - DNA, 16 bp, Homo sapiens
ctgaaagccatggaga

SEQ ID NO: 933236 - DNA, 17 bp, Homo sapiens
ctgaaagccctgagctt

SEQ ID NO: 933237 - DNA, 19 bp, Homo sapiens
ctgaaagccctgagctttc

SEQ ID NO: 933238 - DNA, 14 bp, Homo sapiens
ctgaaagcctgtct

SEQ ID NO: 933239 - DNA, 18 bp, Homo sapiens
ctgaaagcctgtctcttt

SEQ ID NO: 933240 - DNA, 21 bp, Homo sapiens
ctgaaagcctgtctctttcca

SEQ ID NO: 933241 - DNA, 20 bp, Homo sapiens
ctgaaagccttagggaagct

SEQ ID NO: 933242 - DNA, 13 bp, Homo sapiens
ctgaaaggagaca

SEQ ID NO: 933243 - DNA, 22 bp, Homo sapiens
ctgaaaggagacattgctctat

SEQ ID NO: 933244 - DNA, 20 bp, Homo sapiens
ctgaaagggcccttcccctc

SEQ ID NO: 933245 - DNA, 21 bp, Homo sapiens
ctgaaagggggcatgtatgca

SEQ ID NO: 933246 - DNA, 17 bp, Homo sapiens
ctgaaaggtagactttt

SEQ ID NO: 933247 - DNA, 19 bp, Homo sapiens
ctgaaagtcctgctttcct

SEQ ID NO: 933248 - DNA, 11 bp, Homo sapiens
ctgaaagtgtt

SEQ ID NO: 933249 - DNA, 12 bp, Homo sapiens
ctgaaagtgttt

SEQ ID NO: 933250 - DNA, 15 bp, Homo sapiens
ctgaaagtgttttac

SEQ ID NO: 933251 - DNA, 16 bp, Homo sapiens
ctgaaagtgttttact

SEQ ID NO: 933252 - DNA, 19 bp, Homo sapiens
ctgaaataaacctgcactg

SEQ ID NO: 933253 - DNA, 22 bp, Homo sapiens
ctgaaataaacctgcactgaaa

SEQ ID NO: 933254 - DNA, 14 bp, Homo sapiens
ctgaaataaatgtt

SEQ ID NO: 933255 - DNA, 15 bp, Homo sapiens
ctgaaataaatgttt

SEQ ID NO: 933256 - DNA, 18 bp, Homo sapiens
ctgaaataatatatttct

SEQ ID NO: 933257 - DNA, 21 bp, Homo sapiens
ctgaaataatatatttcttct

SEQ ID NO: 933258 - DNA, 15 bp, Homo sapiens
ctgaaatataaactg

SEQ ID NO: 933259 - DNA, 16 bp, Homo sapiens
ctgaaatgctgcattt

SEQ ID NO: 933260 - DNA, 20 bp, Homo sapiens
ctgaaatgttcttaaatttt

SEQ ID NO: 933261 - DNA, 13 bp, Homo sapiens
ctgaaatgtttgg

SEQ ID NO: 933262 - DNA, 16 bp, Homo sapiens
ctgaaattaaagaaat

SEQ ID NO: 933263 - DNA, 20 bp, Homo sapiens
ctgaaattaaagtatgcaaa

SEQ ID NO: 933264 - DNA, 19 bp, Homo sapiens
ctgaaattaatttgtgaat

SEQ ID NO: 933265 - DNA, 20 bp, Homo sapiens
ctgaaattaatttgtgaatt

SEQ ID NO: 933266 - DNA, 22 bp, Homo sapiens
ctgaaattaatttgtgaatttg

SEQ ID NO: 933267 - DNA, 12 bp, Homo sapiens
ctgaaattcaga

SEQ ID NO: 933268 - DNA, 23 bp, Homo sapiens
ctgaaattcagatttttacaagt

SEQ ID NO: 933269 - DNA, 15 bp, Homo sapiens
ctgaaattctcctgg

SEQ ID NO: 933270 - DNA, 16 bp, Homo sapiens
cagcccagggctcctg

SEQ ID NO: 933271 - DNA, 11 bp, Homo sapiens
cagcccagggt

SEQ ID NO: 933272 - DNA, 12 bp, Homo sapiens
cagcccatccat

SEQ ID NO: 933273 - DNA, 24 bp, Homo sapiens
cagcccatgcccacctgcccatca

SEQ ID NO: 933274 - DNA, 16 bp, Homo sapiens
cagcccatggccccca

SEQ ID NO: 933275 - DNA, 17 bp, Homo sapiens
cagcccatggcccccaa

SEQ ID NO: 933276 - DNA, 19 bp, Homo sapiens
cagcccatggcccccaata

SEQ ID NO: 933277 - DNA, 18 bp, Homo sapiens
cagcccattctctctcct

SEQ ID NO: 933278 - DNA, 18 bp, Homo sapiens
cagcccattggccgagct

SEQ ID NO: 933279 - DNA, 21 bp, Homo sapiens
cagccccaactccaggggcac

SEQ ID NO: 933280 - DNA, 13 bp, Homo sapiens
cagccccaagctg

SEQ ID NO: 933281 - DNA, 12 bp, Homo sapiens
cagccccaaggg

SEQ ID NO: 933282 - DNA, 13 bp, Homo sapiens
cagccccaagggc

SEQ ID NO: 933283 - DNA, 16 bp, Homo sapiens
cagccccaagggctgg

SEQ ID NO: 933284 - DNA, 12 bp, Homo sapiens
cagccccaccca

SEQ ID NO: 933285 - DNA, 21 bp, Homo sapiens
cagccccacccaggagggagg

SEQ ID NO: 933286 - DNA, 18 bp, Homo sapiens
cagccccacccccagcca

SEQ ID NO: 933287 - DNA, 18 bp, Homo sapiens
cagccccaccctggccta

SEQ ID NO: 933288 - DNA, 15 bp, Homo sapiens
cagccccactcctct

SEQ ID NO: 933289 - DNA, 16 bp, Homo sapiens
cagccccactcctctg

SEQ ID NO: 933290 - DNA, 21 bp, Homo sapiens
cagccccactcctctgctgac

SEQ ID NO: 933291 - DNA, 15 bp, Homo sapiens
cagccccactgccag

SEQ ID NO: 933292 - DNA, 18 bp, Homo sapiens
cagccccactgccagcag

SEQ ID NO: 933293 - DNA, 21 bp, Homo sapiens
cagccccactgccagcagcag

SEQ ID NO: 933294 - DNA, 18 bp, Homo sapiens
cagccccacttcaccccc

SEQ ID NO: 933295 - DNA, 15 bp, Homo sapiens
cagccccagaagaaa

SEQ ID NO: 933296 - DNA, 21 bp, Homo sapiens
cagccccagacaacagcccag

SEQ ID NO: 933297 - DNA, 13 bp, Homo sapiens
cagccccaggcct

SEQ ID NO: 933298 - DNA, 15 bp, Homo sapiens
cagccccaggcctgg

SEQ ID NO: 933299 - DNA, 17 bp, Homo sapiens
cagccccaggcctggcc

SEQ ID NO: 933300 - DNA, 13 bp, Homo sapiens
cagccccatcaga

SEQ ID NO: 933301 - DNA, 22 bp, Homo sapiens
cagccccatcagaacctgagct

SEQ ID NO: 933302 - DNA, 12 bp, Homo sapiens
cagcccccaggc

SEQ ID NO: 933303 - DNA, 17 bp, Homo sapiens
cagcccccaggccaggt

SEQ ID NO: 933304 - DNA, 15 bp, Homo sapiens
cagcccccagggccc

SEQ ID NO: 933305 - DNA, 18 bp, Homo sapiens
cagcccccccacccaccc

SEQ ID NO: 933306 - DNA, 13 bp, Homo sapiens
cagcccccccctc

SEQ ID NO: 933307 - DNA, 16 bp, Homo sapiens
cagcccccgccccaga

SEQ ID NO: 933308 - DNA, 19 bp, Homo sapiens
cagcccccgcgccctccct

SEQ ID NO: 933309 - DNA, 22 bp, Homo sapiens
cagcccccgggacaccgtgggg

SEQ ID NO: 933310 - DNA, 22 bp, Homo sapiens
cagcccccgggccgctggctgg

SEQ ID NO: 933311 - DNA, 12 bp, Homo sapiens
cagccccctcca

SEQ ID NO: 933312 - DNA, 13 bp, Homo sapiens
cagccccctccac

SEQ ID NO: 933313 - DNA, 14 bp, Homo sapiens
cagccccctccagc

SEQ ID NO: 933314 - DNA, 15 bp, Homo sapiens
cagccccctccagct

SEQ ID NO: 933315 - DNA, 17 bp, Homo sapiens
cagccccctccagctca

SEQ ID NO: 933316 - DNA, 19 bp, Homo sapiens
cagccccctccagctcatg

SEQ ID NO: 933317 - DNA, 14 bp, Homo sapiens
cagcccccttgccc

SEQ ID NO: 933318 - DNA, 17 bp, Homo sapiens
cagcccccttgccctcc

SEQ ID NO: 933319 - DNA, 23 bp, Homo sapiens
cagcccccttgccctccgcctgg

SEQ ID NO: 933320 - DNA, 18 bp, Homo sapiens
cagccccgactccagcca

SEQ ID NO: 933321 - DNA, 19 bp, Homo sapiens
cagccccgacttcctgact

SEQ ID NO: 933322 - DNA, 13 bp, Homo sapiens
cagccccgcctgt

SEQ ID NO: 933323 - DNA, 16 bp, Homo sapiens
cagccccgctcaggcc

SEQ ID NO: 933324 - DNA, 22 bp, Homo sapiens
cagccccgctcaggcctaggag

SEQ ID NO: 933325 - DNA, 14 bp, Homo sapiens
cagccccgctccca

SEQ ID NO: 933326 - DNA, 20 bp, Homo sapiens
cagccccgctcctcccctct

SEQ ID NO: 933327 - DNA, 12 bp, Homo sapiens
cagcccctaccc

SEQ ID NO: 933328 - DNA, 17 bp, Homo sapiens
cagcccctacccctgcc

SEQ ID NO: 933329 - DNA, 19 bp, Homo sapiens
cagcccctacccctgccct

SEQ ID NO: 933330 - DNA, 15 bp, Homo sapiens
cagcccctactgctg

SEQ ID NO: 933331 - DNA, 12 bp, Homo sapiens
cagcccctagaa

SEQ ID NO: 933332 - DNA, 13 bp, Homo sapiens
cagcccctagaaa

SEQ ID NO: 933333 - DNA, 16 bp, Homo sapiens
cagcccctagaaaccc

SEQ ID NO: 933334 - DNA, 20 bp, Homo sapiens
cagcccctagaaacccaagc

SEQ ID NO: 933335 - DNA, 14 bp, Homo sapiens
ctgaactgaggcct

SEQ ID NO: 933336 - DNA, 18 bp, Homo sapiens
ctgaactgaggccttgtg

SEQ ID NO: 933337 - DNA, 15 bp, Homo sapiens
ctgaactgctctact

SEQ ID NO: 933338 - DNA, 11 bp, Homo sapiens
ctgaactgttt

SEQ ID NO: 933339 - DNA, 12 bp, Homo sapiens
ctgaactgtttg

SEQ ID NO: 933340 - DNA, 14 bp, Homo sapiens
ctgaactgtttggt

SEQ ID NO: 933341 - DNA, 18 bp, Homo sapiens
ctgaacttgcattgtgat

SEQ ID NO: 933342 - DNA, 14 bp, Homo sapiens
ctgaactttctccc

SEQ ID NO: 933343 - DNA, 16 bp, Homo sapiens
ctgaactttctccctc

SEQ ID NO: 933344 - DNA, 21 bp, Homo sapiens
ctgaacttttggctaacagaa

SEQ ID NO: 933345 - DNA, 13 bp, Homo sapiens
ctgaagaaaaaat

SEQ ID NO: 933346 - DNA, 21 bp, Homo sapiens
ctgaagaaaaaatcagaacta

SEQ ID NO: 933347 - DNA, 14 bp, Homo sapiens
ctgaagaactattt

SEQ ID NO: 933348 - DNA, 21 bp, Homo sapiens
ctgaagaagtcactgaacaaa

SEQ ID NO: 933349 - DNA, 20 bp, Homo sapiens
ctgaagaattaagatacaaa

SEQ ID NO: 933350 - DNA, 16 bp, Homo sapiens
ctgaagacctccacat

SEQ ID NO: 933351 - DNA, 22 bp, Homo sapiens
ctgaagacgagcatccccctcc

SEQ ID NO: 933352 - DNA, 18 bp, Homo sapiens
ctgaagagcctgaagctg

SEQ ID NO: 933353 - DNA, 19 bp, Homo sapiens
ctgaagagcgctcctctgc

SEQ ID NO: 933354 - DNA, 20 bp, Homo sapiens
ctgaagagctattatataaa

SEQ ID NO: 933355 - DNA, 15 bp, Homo sapiens
ctgaagaggcgggcc

SEQ ID NO: 933356 - DNA, 19 bp, Homo sapiens
ctgaagaggcgggccagcc

SEQ ID NO: 933357 - DNA, 21 bp, Homo sapiens
ctgaagaggcgggccagccag

SEQ ID NO: 933358 - DNA, 16 bp, Homo sapiens
ctgaagatcaatttct

SEQ ID NO: 933359 - DNA, 17 bp, Homo sapiens
ctgaagatcaatttctc

SEQ ID NO: 933360 - DNA, 16 bp, Homo sapiens
ctgaagatgatcattt

SEQ ID NO: 933361 - DNA, 17 bp, Homo sapiens
ctgaagatgatcatttg

SEQ ID NO: 933362 - DNA, 13 bp, Homo sapiens
ctgaagatgtctc

SEQ ID NO: 933363 - DNA, 15 bp, Homo sapiens
ctgaagatgtctcct

SEQ ID NO: 933364 - DNA, 18 bp, Homo sapiens
ctgaagcaagagtgatat

SEQ ID NO: 933365 - DNA, 16 bp, Homo sapiens
ctgaagcagcctctcc

SEQ ID NO: 933366 - DNA, 21 bp, Homo sapiens
ctgaagcaggttcccaagctc

SEQ ID NO: 933367 - DNA, 15 bp, Homo sapiens
ctgaagcatgtttca

SEQ ID NO: 933368 - DNA, 20 bp, Homo sapiens
ctgaagcatgtttcatgttt

SEQ ID NO: 933369 - DNA, 23 bp, Homo sapiens
ctgaagcatgtttcatgttttgt

SEQ ID NO: 933370 - DNA, 16 bp, Homo sapiens
ctgaagccacttggcc

SEQ ID NO: 933371 - DNA, 11 bp, Homo sapiens
ctgaagccaga

SEQ ID NO: 933372 - DNA, 16 bp, Homo sapiens
ctgaagccagatccac

SEQ ID NO: 933373 - DNA, 17 bp, Homo sapiens
ctgaagccagctgccct

SEQ ID NO: 933374 - DNA, 20 bp, Homo sapiens
ctgaagccatgtagccaccc

SEQ ID NO: 933375 - DNA, 15 bp, Homo sapiens
ctgaagccccccttt

SEQ ID NO: 933376 - DNA, 13 bp, Homo sapiens
ctgaagcctccgt

SEQ ID NO: 933377 - DNA, 20 bp, Homo sapiens
ctgaagcctccgtggaacat

SEQ ID NO: 933378 - DNA, 20 bp, Homo sapiens
ctgaagcctctgccctgcct

SEQ ID NO: 933379 - DNA, 13 bp, Homo sapiens
ctgaagcctgcag

SEQ ID NO: 933380 - DNA, 15 bp, Homo sapiens
ctgaagcctgcagga

SEQ ID NO: 933381 - DNA, 19 bp, Homo sapiens
ctgaagccttcttctgcca

SEQ ID NO: 933382 - DNA, 15 bp, Homo sapiens
ctgaagcgactctcc

SEQ ID NO: 933383 - DNA, 14 bp, Homo sapiens
ctgaagctgctgtg

SEQ ID NO: 933384 - DNA, 17 bp, Homo sapiens
ctgaagctgctgtgtcc

SEQ ID NO: 933385 - DNA, 15 bp, Homo sapiens
ctgaagctggagcag

SEQ ID NO: 933386 - DNA, 21 bp, Homo sapiens
ctgaagcttgactcccaagtt

SEQ ID NO: 933387 - DNA, 18 bp, Homo sapiens
ctgaaggaaaaacacaag

SEQ ID NO: 933388 - DNA, 22 bp, Homo sapiens
ctgaaggaataaattgctcctt

SEQ ID NO: 933389 - DNA, 17 bp, Homo sapiens
ctgaaggaatagccaga

SEQ ID NO: 933390 - DNA, 21 bp, Homo sapiens
ctgaaggaatagccagagagg

SEQ ID NO: 933391 - DNA, 20 bp, Homo sapiens
ctgaaggacacttcctgcct

SEQ ID NO: 933392 - DNA, 14 bp, Homo sapiens
ctgaaggaccccag

SEQ ID NO: 933393 - DNA, 15 bp, Homo sapiens
ctgaaggaccccagg

SEQ ID NO: 933394 - DNA, 12 bp, Homo sapiens
ctgaaggactgg

SEQ ID NO: 933395 - DNA, 20 bp, Homo sapiens
ctgaaggagatcaatggttt

SEQ ID NO: 933396 - DNA, 21 bp, Homo sapiens
ctgaaggagccccattcctgg

SEQ ID NO: 933397 - DNA, 15 bp, Homo sapiens
ctgaagggaactaga

SEQ ID NO: 933398 - DNA, 20 bp, Homo sapiens
ctgaagggaactagaggtgt

SEQ ID NO: 933399 - DNA, 17 bp, Homo sapiens
cagccctgcctgagaag

SEQ ID NO: 933400 - DNA, 12 bp, Homo sapiens
cagccctgctgg

SEQ ID NO: 933401 - DNA, 13 bp, Homo sapiens
cagccctgctggg

SEQ ID NO: 933402 - DNA, 11 bp, Homo sapiens
cagccctgctt

SEQ ID NO: 933403 - DNA, 23 bp, Homo sapiens
cagccctgctttgggctgccctg

SEQ ID NO: 933404 - DNA, 15 bp, Homo sapiens
cagccctggcctggc

SEQ ID NO: 933405 - DNA, 14 bp, Homo sapiens
cagccctggccttt

SEQ ID NO: 933406 - DNA, 11 bp, Homo sapiens
cagccctgggc

SEQ ID NO: 933407 - DNA, 12 bp, Homo sapiens
cagccctgggcc

SEQ ID NO: 933408 - DNA, 13 bp, Homo sapiens
cagccctgggccc

SEQ ID NO: 933409 - DNA, 19 bp, Homo sapiens
cagccctgggcttggctct

SEQ ID NO: 933410 - DNA, 20 bp, Homo sapiens
cagccctgggcttggctctt

SEQ ID NO: 933411 - DNA, 20 bp, Homo sapiens
cagccctgtcagtgcagccc

SEQ ID NO: 933412 - DNA, 15 bp, Homo sapiens
cagccctgtcctggt

SEQ ID NO: 933413 - DNA, 21 bp, Homo sapiens
cagccctgtctgaaggacact

SEQ ID NO: 933414 - DNA, 12 bp, Homo sapiens
cagccctgtgtc

SEQ ID NO: 933415 - DNA, 15 bp, Homo sapiens
cagccctgtgtctgt

SEQ ID NO: 933416 - DNA, 16 bp, Homo sapiens
cagccctgtgtctgtc

SEQ ID NO: 933417 - DNA, 22 bp, Homo sapiens
cagcccttcagacgagatcctg

SEQ ID NO: 933418 - DNA, 16 bp, Homo sapiens
cagcccttcctcctga

SEQ ID NO: 933419 - DNA, 12 bp, Homo sapiens
cagcccttcctt

SEQ ID NO: 933420 - DNA, 13 bp, Homo sapiens
cagcccttccttg

SEQ ID NO: 933421 - DNA, 13 bp, Homo sapiens
cagcccttgggca

SEQ ID NO: 933422 - DNA, 13 bp, Homo sapiens
cagccctttgctc

SEQ ID NO: 933423 - DNA, 23 bp, Homo sapiens
cagccctttgggaggctgaggcg

SEQ ID NO: 933424 - DNA, 23 bp, Homo sapiens
cagcccttttgttgagccaggcc

SEQ ID NO: 933425 - DNA, 16 bp, Homo sapiens
cagccgaccctcctgg

SEQ ID NO: 933426 - DNA, 14 bp, Homo sapiens
cagccgagccgggc

SEQ ID NO: 933427 - DNA, 18 bp, Homo sapiens
cagccgagccgggcctgg

SEQ ID NO: 933428 - DNA, 23 bp, Homo sapiens
cagccgagctcgtgtatcctggg

SEQ ID NO: 933429 - DNA, 17 bp, Homo sapiens
cagccgcaggaaggcag

SEQ ID NO: 933430 - DNA, 17 bp, Homo sapiens
cagccgcattggtgact

SEQ ID NO: 933431 - DNA, 13 bp, Homo sapiens
cagccgccagctg

SEQ ID NO: 933432 - DNA, 18 bp, Homo sapiens
cagccgccagctgggagc

SEQ ID NO: 933433 - DNA, 18 bp, Homo sapiens
cagccgccattgccacca

SEQ ID NO: 933434 - DNA, 19 bp, Homo sapiens
cagccgccattgccaccag

SEQ ID NO: 933435 - DNA, 23 bp, Homo sapiens
cagccgcccacccccacccccag

SEQ ID NO: 933436 - DNA, 13 bp, Homo sapiens
cagccgccccagc

SEQ ID NO: 933437 - DNA, 18 bp, Homo sapiens
cagccgccccagcccctt

SEQ ID NO: 933438 - DNA, 13 bp, Homo sapiens
cagccgccctggg

SEQ ID NO: 933439 - DNA, 18 bp, Homo sapiens
cagccgccgggcaggcct

SEQ ID NO: 933440 - DNA, 19 bp, Homo sapiens
cagccgcctgaaagccaca

SEQ ID NO: 933441 - DNA, 16 bp, Homo sapiens
cagccgctaggagaga

SEQ ID NO: 933442 - DNA, 17 bp, Homo sapiens
cagccgctaggagagac

SEQ ID NO: 933443 - DNA, 21 bp, Homo sapiens
cagccgctcctgtctgccagc

SEQ ID NO: 933444 - DNA, 22 bp, Homo sapiens
cagccgctcctgtctgccagcc

SEQ ID NO: 933445 - DNA, 21 bp, Homo sapiens
cagccgctgcagggctcccat

SEQ ID NO: 933446 - DNA, 17 bp, Homo sapiens
cagccggaatagagcct

SEQ ID NO: 933447 - DNA, 21 bp, Homo sapiens
cagccggaatagagcctcgtc

SEQ ID NO: 933448 - DNA, 16 bp, Homo sapiens
cagccggcctctctgg

SEQ ID NO: 933449 - DNA, 15 bp, Homo sapiens
cagccgggccctgag

SEQ ID NO: 933450 - DNA, 16 bp, Homo sapiens
cagccgtattttacat

SEQ ID NO: 933451 - DNA, 19 bp, Homo sapiens
cagccgtcagccaaatgta

SEQ ID NO: 933452 - DNA, 14 bp, Homo sapiens
cagccgtcccaggc

SEQ ID NO: 933453 - DNA, 17 bp, Homo sapiens
cagccgtcccaggccac

SEQ ID NO: 933454 - DNA, 22 bp, Homo sapiens
cagccgtcccgcgttcaagact

SEQ ID NO: 933455 - DNA, 23 bp, Homo sapiens
cagccgtcccgcgttcaagactt

SEQ ID NO: 933456 - DNA, 19 bp, Homo sapiens
cagccgtgatgctcaggct

SEQ ID NO: 933457 - DNA, 18 bp, Homo sapiens
cagccgtgccttcagctc

SEQ ID NO: 933458 - DNA, 17 bp, Homo sapiens
ctgaatgcctcctgtgg

SEQ ID NO: 933459 - DNA, 19 bp, Homo sapiens
ctgaatggactaagatgaa

SEQ ID NO: 933460 - DNA, 18 bp, Homo sapiens
ctgaatggtccagggttg

SEQ ID NO: 933461 - DNA, 18 bp, Homo sapiens
ctgaatggttccatgcct

SEQ ID NO: 933462 - DNA, 22 bp, Homo sapiens
ctgaatggttccatgcctgagg

SEQ ID NO: 933463 - DNA, 23 bp, Homo sapiens
ctgaatgtgcctaatggagaaga

SEQ ID NO: 933464 - DNA, 12 bp, Homo sapiens
ctgaatgttctg

SEQ ID NO: 933465 - DNA, 22 bp, Homo sapiens
ctgaatgtttaaagatcatgac

SEQ ID NO: 933466 - DNA, 16 bp, Homo sapiens
ctgaatgtttattcct

SEQ ID NO: 933467 - DNA, 18 bp, Homo sapiens
ctgaatgtttgtttcagt

SEQ ID NO: 933468 - DNA, 12 bp, Homo sapiens
ctgaatgtttta

SEQ ID NO: 933469 - DNA, 20 bp, Homo sapiens
ctgaatgttttatttatcaa

SEQ ID NO: 933470 - DNA, 14 bp, Homo sapiens
ctgaattaaaatgg

SEQ ID NO: 933471 - DNA, 15 bp, Homo sapiens
ctgaattaaaatggt

SEQ ID NO: 933472 - DNA, 14 bp, Homo sapiens
ctgaattaaataaa

SEQ ID NO: 933473 - DNA, 15 bp, Homo sapiens
ctgaattaaataaat

SEQ ID NO: 933474 - DNA, 14 bp, Homo sapiens
ctgaattaattaat

SEQ ID NO: 933475 - DNA, 16 bp, Homo sapiens
ctgaattaattaattt

SEQ ID NO: 933476 - DNA, 18 bp, Homo sapiens
ctgaattatctatttcat

SEQ ID NO: 933477 - DNA, 16 bp, Homo sapiens
ctgaattcctttacaa

SEQ ID NO: 933478 - DNA, 23 bp, Homo sapiens
ctgaattgacatgaccctctgtc

SEQ ID NO: 933479 - DNA, 14 bp, Homo sapiens
ctgaattgttgggg

SEQ ID NO: 933480 - DNA, 22 bp, Homo sapiens
ctgaatttcaggcattttgttc

SEQ ID NO: 933481 - DNA, 14 bp, Homo sapiens
ctgaatttcctttt

SEQ ID NO: 933482 - DNA, 12 bp, Homo sapiens
ctgaatttcttt

SEQ ID NO: 933483 - DNA, 15 bp, Homo sapiens
ctgaatttgggcctc

SEQ ID NO: 933484 - DNA, 17 bp, Homo sapiens
ctgaattttataaataa

SEQ ID NO: 933485 - DNA, 20 bp, Homo sapiens
ctgaattttggggattttca

SEQ ID NO: 933486 - DNA, 22 bp, Homo sapiens
ctgaatttttaaacaagtattt

SEQ ID NO: 933487 - DNA, 21 bp, Homo sapiens
ctgacaaaatggggcagaaga

SEQ ID NO: 933488 - DNA, 14 bp, Homo sapiens
ctgacaaaggagcc

SEQ ID NO: 933489 - DNA, 19 bp, Homo sapiens
ctgacaaaggagccttgat

SEQ ID NO: 933490 - DNA, 21 bp, Homo sapiens
ctgacaaatattttagaagct

SEQ ID NO: 933491 - DNA, 19 bp, Homo sapiens
ctgacaaccattaaagtca

SEQ ID NO: 933492 - DNA, 22 bp, Homo sapiens
ctgacaaccattaaagtcagaa

SEQ ID NO: 933493 - DNA, 21 bp, Homo sapiens
ctgacaacttagctcaggtgc

SEQ ID NO: 933494 - DNA, 22 bp, Homo sapiens
ctgacaacttagctcaggtgcc

SEQ ID NO: 933495 - DNA, 23 bp, Homo sapiens
ctgacaacttagctcaggtgcct

SEQ ID NO: 933496 - DNA, 16 bp, Homo sapiens
ctgacaatgaagggaa

SEQ ID NO: 933497 - DNA, 23 bp, Homo sapiens
ctgacaatggcagctagactgga

SEQ ID NO: 933498 - DNA, 18 bp, Homo sapiens
ctgacacaaaaaaagttg

SEQ ID NO: 933499 - DNA, 19 bp, Homo sapiens
ctgacacaccaggcgctaa

SEQ ID NO: 933500 - DNA, 19 bp, Homo sapiens
ctgacacactaaccaagct

SEQ ID NO: 933501 - DNA, 22 bp, Homo sapiens
ctgacacactaaccaagctgag

SEQ ID NO: 933502 - DNA, 14 bp, Homo sapiens
ctgacacagtaaaa

SEQ ID NO: 933503 - DNA, 22 bp, Homo sapiens
ctgacacagtgctcgaccttga

SEQ ID NO: 933504 - DNA, 13 bp, Homo sapiens
ctgacaccccctc

SEQ ID NO: 933505 - DNA, 17 bp, Homo sapiens
ctgacaccccctccccg

SEQ ID NO: 933506 - DNA, 19 bp, Homo sapiens
ctgacaccgtccctcagtg

SEQ ID NO: 933507 - DNA, 20 bp, Homo sapiens
ctgacaccgtccctcagtga

SEQ ID NO: 933508 - DNA, 18 bp, Homo sapiens
ctgacaccgtcgaccagg

SEQ ID NO: 933509 - DNA, 15 bp, Homo sapiens
ctgacacctaccatg

SEQ ID NO: 933510 - DNA, 21 bp, Homo sapiens
ctgacacctaccatgctgctt

SEQ ID NO: 933511 - DNA, 18 bp, Homo sapiens
ctgacacgcagcctgctc

SEQ ID NO: 933512 - DNA, 17 bp, Homo sapiens
ctgacactcccttgggc

SEQ ID NO: 933513 - DNA, 14 bp, Homo sapiens
ctgacactgagccc

SEQ ID NO: 933514 - DNA, 17 bp, Homo sapiens
ctgacactgagccccac

SEQ ID NO: 933515 - DNA, 19 bp, Homo sapiens
ctgacactgagccccacct

SEQ ID NO: 933516 - DNA, 17 bp, Homo sapiens
ctgacacttcctgtcct

SEQ ID NO: 933517 - DNA, 19 bp, Homo sapiens
ctgacactttaattaccaa

SEQ ID NO: 933518 - DNA, 13 bp, Homo sapiens
ctgacagaaacca

SEQ ID NO: 933519 - DNA, 18 bp, Homo sapiens
ctgacagatgtcagccga

SEQ ID NO: 933520 - DNA, 17 bp, Homo sapiens
ctgacagcagcctgtga

SEQ ID NO: 933521 - DNA, 20 bp, Homo sapiens
ctgacagcagcctgtgaggg

SEQ ID NO: 933522 - DNA, 20 bp, Homo sapiens
ctgacagcccaacttccaga

SEQ ID NO: 933523 - DNA, 13 bp, Homo sapiens
ctgacagcctccc

SEQ ID NO: 933524 - DNA, 17 bp, Homo sapiens
ctgacagcctcccaccc

SEQ ID NO: 933525 - DNA, 19 bp, Homo sapiens
ctgacagccttccccagct

SEQ ID NO: 933526 - DNA, 14 bp, Homo sapiens
cagcctcctctgga

SEQ ID NO: 933527 - DNA, 22 bp, Homo sapiens
cagcctcctctggacggcaggc

SEQ ID NO: 933528 - DNA, 15 bp, Homo sapiens
cagcctcctgagcct

SEQ ID NO: 933529 - DNA, 20 bp, Homo sapiens
cagcctcctgagcctgtggg

SEQ ID NO: 933530 - DNA, 13 bp, Homo sapiens
cagcctcctgggt

SEQ ID NO: 933531 - DNA, 13 bp, Homo sapiens
cagcctccttgct

SEQ ID NO: 933532 - DNA, 19 bp, Homo sapiens
cagcctccttgctgacccc

SEQ ID NO: 933533 - DNA, 14 bp, Homo sapiens
cagcctcctttgtg

SEQ ID NO: 933534 - DNA, 16 bp, Homo sapiens
cagcctcctttgtgtg

SEQ ID NO: 933535 - DNA, 19 bp, Homo sapiens
cagcctcgaggctggtggt

SEQ ID NO: 933536 - DNA, 23 bp, Homo sapiens
cagcctcgaggctggtggttttc

SEQ ID NO: 933537 - DNA, 15 bp, Homo sapiens
cagcctcgcacaggc

SEQ ID NO: 933538 - DNA, 17 bp, Homo sapiens
cagcctcgcacaggccc

SEQ ID NO: 933539 - DNA, 18 bp, Homo sapiens
cagcctcgcacaggccct

SEQ ID NO: 933540 - DNA, 22 bp, Homo sapiens
cagcctcgcacaggccctagct

SEQ ID NO: 933541 - DNA, 22 bp, Homo sapiens
cagcctcgcggtcttgggcact

SEQ ID NO: 933542 - DNA, 20 bp, Homo sapiens
cagcctcggggatggggagg

SEQ ID NO: 933543 - DNA, 20 bp, Homo sapiens
cagcctcgtggagctcgccc

SEQ ID NO: 933544 - DNA, 14 bp, Homo sapiens
cagcctctccccag

SEQ ID NO: 933545 - DNA, 19 bp, Homo sapiens
cagcctctccccaggtcca

SEQ ID NO: 933546 - DNA, 16 bp, Homo sapiens
cagcctctcccggctg

SEQ ID NO: 933547 - DNA, 22 bp, Homo sapiens
cagcctctcccggctgcctgcc

SEQ ID NO: 933548 - DNA, 12 bp, Homo sapiens
cagcctctctgg

SEQ ID NO: 933549 - DNA, 19 bp, Homo sapiens
cagcctctctggctggtct

SEQ ID NO: 933550 - DNA, 13 bp, Homo sapiens
cagcctctgcaac

SEQ ID NO: 933551 - DNA, 14 bp, Homo sapiens
cagcctctgcaact

SEQ ID NO: 933552 - DNA, 23 bp, Homo sapiens
cagcctctgcactcccacgcctg

SEQ ID NO: 933553 - DNA, 11 bp, Homo sapiens
cagcctctgcc

SEQ ID NO: 933554 - DNA, 12 bp, Homo sapiens
cagcctctggac

SEQ ID NO: 933555 - DNA, 19 bp, Homo sapiens
cagcctctggacagccagt

SEQ ID NO: 933556 - DNA, 20 bp, Homo sapiens
cagcctctggacagccagtg

SEQ ID NO: 933557 - DNA, 13 bp, Homo sapiens
cagcctctggcat

SEQ ID NO: 933558 - DNA, 11 bp, Homo sapiens
cagcctcttaa

SEQ ID NO: 933559 - DNA, 21 bp, Homo sapiens
cagcctcttaaagctgcctgt

SEQ ID NO: 933560 - DNA, 14 bp, Homo sapiens
cagcctcttgcccg

SEQ ID NO: 933561 - DNA, 23 bp, Homo sapiens
cagcctcttgcccgtcggccctg

SEQ ID NO: 933562 - DNA, 18 bp, Homo sapiens
cagcctgaaagatacagg

SEQ ID NO: 933563 - DNA, 15 bp, Homo sapiens
cagcctgaatcattt

SEQ ID NO: 933564 - DNA, 13 bp, Homo sapiens
cagcctgacctga

SEQ ID NO: 933565 - DNA, 16 bp, Homo sapiens
cagcctgacctgagac

SEQ ID NO: 933566 - DNA, 22 bp, Homo sapiens
cagcctgacctgagactgtcgg

SEQ ID NO: 933567 - DNA, 18 bp, Homo sapiens
cagcctgagcggaggctc

SEQ ID NO: 933568 - DNA, 20 bp, Homo sapiens
cagcctgagcggaggctcgg

SEQ ID NO: 933569 - DNA, 18 bp, Homo sapiens
cagcctgaggctgagact

SEQ ID NO: 933570 - DNA, 10 bp, Homo sapiens
cagcctgagt

SEQ ID NO: 933571 - DNA, 16 bp, Homo sapiens
cagcctgctccagctg

SEQ ID NO: 933572 - DNA, 23 bp, Homo sapiens
cagcctgctctagtgggacagcc

SEQ ID NO: 933573 - DNA, 15 bp, Homo sapiens
cagcctgctgagagc

SEQ ID NO: 933574 - DNA, 23 bp, Homo sapiens
cagcctgctggcagggccagggc

SEQ ID NO: 933575 - DNA, 12 bp, Homo sapiens
cagcctgctggg

SEQ ID NO: 933576 - DNA, 16 bp, Homo sapiens
cagcctggacatagag

SEQ ID NO: 933577 - DNA, 15 bp, Homo sapiens
cagcctggaccctgt

SEQ ID NO: 933578 - DNA, 14 bp, Homo sapiens
cagcctggagaggc

SEQ ID NO: 933579 - DNA, 19 bp, Homo sapiens
cagcctggagaggcctggg

SEQ ID NO: 933580 - DNA, 22 bp, Homo sapiens
ctgaccatgctcatctgctggt

SEQ ID NO: 933581 - DNA, 21 bp, Homo sapiens
ctgaccattttggatgtcatt

SEQ ID NO: 933582 - DNA, 16 bp, Homo sapiens
ctgacccaactggggg

SEQ ID NO: 933583 - DNA, 17 bp, Homo sapiens
ctgacccaactgggggc

SEQ ID NO: 933584 - DNA, 15 bp, Homo sapiens
ctgacccactgatct

SEQ ID NO: 933585 - DNA, 12 bp, Homo sapiens
ctgacccagcat

SEQ ID NO: 933586 - DNA, 22 bp, Homo sapiens
ctgacccaggaatagtggacat

SEQ ID NO: 933587 - DNA, 14 bp, Homo sapiens
ctgacccaggccgc

SEQ ID NO: 933588 - DNA, 16 bp, Homo sapiens
ctgacccaggccgcag

SEQ ID NO: 933589 - DNA, 23 bp, Homo sapiens
ctgacccaggccgcagctcttgc

SEQ ID NO: 933590 - DNA, 11 bp, Homo sapiens
ctgacccagtc

SEQ ID NO: 933591 - DNA, 17 bp, Homo sapiens
ctgacccagtccctggg

SEQ ID NO: 933592 - DNA, 14 bp, Homo sapiens
ctgacccagtgaga

SEQ ID NO: 933593 - DNA, 20 bp, Homo sapiens
ctgaccccaaagagcctgga

SEQ ID NO: 933594 - DNA, 23 bp, Homo sapiens
ctgaccccacttatgctgctgtg

SEQ ID NO: 933595 - DNA, 21 bp, Homo sapiens
ctgaccccaggtcagccctgt

SEQ ID NO: 933596 - DNA, 20 bp, Homo sapiens
ctgaccccagtggaaaacaa

SEQ ID NO: 933597 - DNA, 21 bp, Homo sapiens
ctgaccccagtggtatcctgt

SEQ ID NO: 933598 - DNA, 16 bp, Homo sapiens
ctgacccccatctgag

SEQ ID NO: 933599 - DNA, 22 bp, Homo sapiens
ctgaccccgagaagtgctcttg

SEQ ID NO: 933600 - DNA, 15 bp, Homo sapiens
ctgacccctctggtg

SEQ ID NO: 933601 - DNA, 16 bp, Homo sapiens
ctgacccctctggtgt

SEQ ID NO: 933602 - DNA, 22 bp, Homo sapiens
ctgacccctgcctgttggcagg

SEQ ID NO: 933603 - DNA, 13 bp, Homo sapiens
ctgacccctgctc

SEQ ID NO: 933604 - DNA, 19 bp, Homo sapiens
ctgacccggttgcagtcac

SEQ ID NO: 933605 - DNA, 17 bp, Homo sapiens
ctgaccctatgggtcta

SEQ ID NO: 933606 - DNA, 20 bp, Homo sapiens
ctgaccctcctccactccac

SEQ ID NO: 933607 - DNA, 16 bp, Homo sapiens
ctgaccctctgcggcc

SEQ ID NO: 933608 - DNA, 16 bp, Homo sapiens
ctgaccctgaggaggc

SEQ ID NO: 933609 - DNA, 12 bp, Homo sapiens
ctgaccctgtat

SEQ ID NO: 933610 - DNA, 13 bp, Homo sapiens
ctgaccctgtata

SEQ ID NO: 933611 - DNA, 15 bp, Homo sapiens
ctgaccctgtatata

SEQ ID NO: 933612 - DNA, 18 bp, Homo sapiens
ctgaccctgtatatagcc

SEQ ID NO: 933613 - DNA, 19 bp, Homo sapiens
ctgaccctgtatatagccc

SEQ ID NO: 933614 - DNA, 13 bp, Homo sapiens
ctgaccctgtgga

SEQ ID NO: 933615 - DNA, 19 bp, Homo sapiens
ctgacccttctccaaaggc

SEQ ID NO: 933616 - DNA, 11 bp, Homo sapiens
ctgaccgtgac

SEQ ID NO: 933617 - DNA, 22 bp, Homo sapiens
ctgacctacctcaaagggcagt

SEQ ID NO: 933618 - DNA, 22 bp, Homo sapiens
ctgacctagaccagtttgcatg

SEQ ID NO: 933619 - DNA, 17 bp, Homo sapiens
ctgacctcccagcccta

SEQ ID NO: 933620 - DNA, 22 bp, Homo sapiens
ctgacctcccagccctatggat

SEQ ID NO: 933621 - DNA, 20 bp, Homo sapiens
ctgacctccctctaatttat

SEQ ID NO: 933622 - DNA, 18 bp, Homo sapiens
ctgacctccgcccctgcc

SEQ ID NO: 933623 - DNA, 18 bp, Homo sapiens
ctgacctctgctgagtgc

SEQ ID NO: 933624 - DNA, 19 bp, Homo sapiens
ctgacctctgctgagtgct

SEQ ID NO: 933625 - DNA, 17 bp, Homo sapiens
ctgacctcttgctgcca

SEQ ID NO: 933626 - DNA, 19 bp, Homo sapiens
ctgacctcttgctgtctct

SEQ ID NO: 933627 - DNA, 22 bp, Homo sapiens
ctgacctcttgctgtctctgct

SEQ ID NO: 933628 - DNA, 14 bp, Homo sapiens
ctgacctgagactg

SEQ ID NO: 933629 - DNA, 14 bp, Homo sapiens
ctgacctgccagcc

SEQ ID NO: 933630 - DNA, 19 bp, Homo sapiens
ctgacctgctccgccagga

SEQ ID NO: 933631 - DNA, 22 bp, Homo sapiens
ctgacctgctccgccaggaaag

SEQ ID NO: 933632 - DNA, 13 bp, Homo sapiens
ctgacctgctgac

SEQ ID NO: 933633 - DNA, 12 bp, Homo sapiens
ctgacctgggcc

SEQ ID NO: 933634 - DNA, 19 bp, Homo sapiens
ctgacctgggcccacagag

SEQ ID NO: 933635 - DNA, 22 bp, Homo sapiens
ctgacctgggcccacagagcct

SEQ ID NO: 933636 - DNA, 23 bp, Homo sapiens
ctgacctgggcccacagagcctg

SEQ ID NO: 933637 - DNA, 19 bp, Homo sapiens
ctgacctgtaggtcaggac

SEQ ID NO: 933638 - DNA, 19 bp, Homo sapiens
ctgacctgtcatgcccccc

SEQ ID NO: 933639 - DNA, 15 bp, Homo sapiens
ctgaccttaaatgca

SEQ ID NO: 933640 - DNA, 17 bp, Homo sapiens
ctgaccttccagagccc

SEQ ID NO: 933641 - DNA, 18 bp, Homo sapiens
ctgacctttgtcatcttt

SEQ ID NO: 933642 - DNA, 21 bp, Homo sapiens
ctgacgaaactggccccggat

SEQ ID NO: 933643 - DNA, 17 bp, Homo sapiens
ctgacgcaccactgcca

SEQ ID NO: 933644 - DNA, 21 bp, Homo sapiens
ctgacgcaccactgccaatgc

SEQ ID NO: 933645 - DNA, 15 bp, Homo sapiens
ctgacgccaataata

SEQ ID NO: 933646 - DNA, 13 bp, Homo sapiens
ctgacgccctgcg

SEQ ID NO: 933647 - DNA, 14 bp, Homo sapiens
ctgacgccctgcgt

SEQ ID NO: 933648 - DNA, 14 bp, Homo sapiens
ctgacgctggagat

SEQ ID NO: 933649 - DNA, 13 bp, Homo sapiens
ctgacgcttgtga

SEQ ID NO: 933650 - DNA, 15 bp, Homo sapiens
ctgacgcttgtgaca

SEQ ID NO: 933651 - DNA, 22 bp, Homo sapiens
ctgacgcttgtgacagtgcctc

SEQ ID NO: 933652 - DNA, 14 bp, Homo sapiens
ctgacggcgccccc

SEQ ID NO: 933653 - DNA, 20 bp, Homo sapiens
ctgacggcgcccccagtgtg

SEQ ID NO: 933654 - DNA, 23 bp, Homo sapiens
cagccttttctggtccctcttct

SEQ ID NO: 933655 - DNA, 20 bp, Homo sapiens
cagcgaagtctcatgggaag

SEQ ID NO: 933656 - DNA, 22 bp, Homo sapiens
cagcgaagtctcatgggaagca

SEQ ID NO: 933657 - DNA, 16 bp, Homo sapiens
cagcgacccttggtgt

SEQ ID NO: 933658 - DNA, 20 bp, Homo sapiens
cagcgacctctctgcctctc

SEQ ID NO: 933659 - DNA, 21 bp, Homo sapiens
cagcgacctctctgcctctct

SEQ ID NO: 933660 - DNA, 18 bp, Homo sapiens
cagcgaccttcctcatcc

SEQ ID NO: 933661 - DNA, 21 bp, Homo sapiens
cagcgactccgttggccactc

SEQ ID NO: 933662 - DNA, 22 bp, Homo sapiens
cagcgactccgttggccactcc

SEQ ID NO: 933663 - DNA, 12 bp, Homo sapiens
cagcgactggat

SEQ ID NO: 933664 - DNA, 18 bp, Homo sapiens
cagcgagaggcagagaaa

SEQ ID NO: 933665 - DNA, 20 bp, Homo sapiens
cagcgagaggcagagaaaga

SEQ ID NO: 933666 - DNA, 14 bp, Homo sapiens
cagcgagccacagg

SEQ ID NO: 933667 - DNA, 13 bp, Homo sapiens
cagcgagcctgtg

SEQ ID NO: 933668 - DNA, 17 bp, Homo sapiens
cagcgagcctgtgcctt

SEQ ID NO: 933669 - DNA, 22 bp, Homo sapiens
cagcgagcctgtgccttcctcc

SEQ ID NO: 933670 - DNA, 18 bp, Homo sapiens
cagcgaggaggctccaga

SEQ ID NO: 933671 - DNA, 17 bp, Homo sapiens
cagcgagggcagctgct

SEQ ID NO: 933672 - DNA, 14 bp, Homo sapiens
cagcgatggcaggc

SEQ ID NO: 933673 - DNA, 17 bp, Homo sapiens
cagcgatggcaggcctg

SEQ ID NO: 933674 - DNA, 18 bp, Homo sapiens
cagcgatggcaggcctga

SEQ ID NO: 933675 - DNA, 22 bp, Homo sapiens
cagcgatggcaggcctgaccca

SEQ ID NO: 933676 - DNA, 18 bp, Homo sapiens
cagcgatttcaagaagga

SEQ ID NO: 933677 - DNA, 21 bp, Homo sapiens
cagcgcagccgccgggcaggc

SEQ ID NO: 933678 - DNA, 17 bp, Homo sapiens
cagcgcaggctgcagag

SEQ ID NO: 933679 - DNA, 22 bp, Homo sapiens
cagcgcaggctgcagagcccgg

SEQ ID NO: 933680 - DNA, 18 bp, Homo sapiens
cagcgcagggctggcacg

SEQ ID NO: 933681 - DNA, 16 bp, Homo sapiens
cagcgcatcctgcagg

SEQ ID NO: 933682 - DNA, 23 bp, Homo sapiens
cagcgccaagtgcgtgccgtgtg

SEQ ID NO: 933683 - DNA, 24 bp, Homo sapiens
cagcgccaagtgcgtgccgtgtga

SEQ ID NO: 933684 - DNA, 14 bp, Homo sapiens
cagcgccaagtggc

SEQ ID NO: 933685 - DNA, 17 bp, Homo sapiens
cagcgccaagtggccac

SEQ ID NO: 933686 - DNA, 14 bp, Homo sapiens
cagcgccagcctgt

SEQ ID NO: 933687 - DNA, 22 bp, Homo sapiens
cagcgccaggctgaccacagca

SEQ ID NO: 933688 - DNA, 12 bp, Homo sapiens
cagcgccagggc

SEQ ID NO: 933689 - DNA, 16 bp, Homo sapiens
cagcgccagggcccag

SEQ ID NO: 933690 - DNA, 19 bp, Homo sapiens
cagcgccagggcccaggcc

SEQ ID NO: 933691 - DNA, 20 bp, Homo sapiens
cagcgcccaggcctgctggc

SEQ ID NO: 933692 - DNA, 20 bp, Homo sapiens
cagcgcccccatctgtcttc

SEQ ID NO: 933693 - DNA, 14 bp, Homo sapiens
cagcgcccgctggg

SEQ ID NO: 933694 - DNA, 12 bp, Homo sapiens
cagcgcctccct

SEQ ID NO: 933695 - DNA, 20 bp, Homo sapiens
cagcgcctccctccacccca

SEQ ID NO: 933696 - DNA, 22 bp, Homo sapiens
cagcgcctccctccaccccagg

SEQ ID NO: 933697 - DNA, 23 bp, Homo sapiens
cagcgcctccctccaccccagga

SEQ ID NO: 933698 - DNA, 20 bp, Homo sapiens
cagcgcggaggaggagggag

SEQ ID NO: 933699 - DNA, 13 bp, Homo sapiens
cagcgctcgccac

SEQ ID NO: 933700 - DNA, 13 bp, Homo sapiens
cagcggaaacagg

SEQ ID NO: 933701 - DNA, 20 bp, Homo sapiens
ctgacttctagctgtctgtg

SEQ ID NO: 933702 - DNA, 15 bp, Homo sapiens
ctgacttctcccccg

SEQ ID NO: 933703 - DNA, 20 bp, Homo sapiens
ctgacttctcccccgccctg

SEQ ID NO: 933704 - DNA, 13 bp, Homo sapiens
ctgacttctctga

SEQ ID NO: 933705 - DNA, 18 bp, Homo sapiens
ctgacttctctgaatcag

SEQ ID NO: 933706 - DNA, 12 bp, Homo sapiens
ctgacttctgcc

SEQ ID NO: 933707 - DNA, 15 bp, Homo sapiens
ctgacttctgcctgg

SEQ ID NO: 933708 - DNA, 16 bp, Homo sapiens
ctgacttctgcctgga

SEQ ID NO: 933709 - DNA, 18 bp, Homo sapiens
ctgacttctgcctggaga

SEQ ID NO: 933710 - DNA, 19 bp, Homo sapiens
ctgacttctgcctggagac

SEQ ID NO: 933711 - DNA, 15 bp, Homo sapiens
ctgacttgagccact

SEQ ID NO: 933712 - DNA, 17 bp, Homo sapiens
ctgacttgagccactcc

SEQ ID NO: 933713 - DNA, 22 bp, Homo sapiens
ctgacttgagccactccttcct

SEQ ID NO: 933714 - DNA, 13 bp, Homo sapiens
ctgacttgagtgt

SEQ ID NO: 933715 - DNA, 15 bp, Homo sapiens
ctgacttgagtgttc

SEQ ID NO: 933716 - DNA, 19 bp, Homo sapiens
ctgacttggttctgaagcc

SEQ ID NO: 933717 - DNA, 20 bp, Homo sapiens
ctgacttggttctgaagcca

SEQ ID NO: 933718 - DNA, 21 bp, Homo sapiens
ctgacttggttctgaagccat

SEQ ID NO: 933719 - DNA, 15 bp, Homo sapiens
ctgactttgcttgct

SEQ ID NO: 933720 - DNA, 17 bp, Homo sapiens
ctgactttgcttgcttt

SEQ ID NO: 933721 - DNA, 19 bp, Homo sapiens
ctgactttgcttgctttga

SEQ ID NO: 933722 - DNA, 21 bp, Homo sapiens
ctgacttttaatgtcatttgt

SEQ ID NO: 933723 - DNA, 17 bp, Homo sapiens
ctgagaaagcccacctg

SEQ ID NO: 933724 - DNA, 21 bp, Homo sapiens
ctgagaaagcccacctgggct

SEQ ID NO: 933725 - DNA, 16 bp, Homo sapiens
ctgagaaagctcaaag

SEQ ID NO: 933726 - DNA, 19 bp, Homo sapiens
ctgagaaataggtatcaaa

SEQ ID NO: 933727 - DNA, 18 bp, Homo sapiens
ctgagaagaagtggctgc

SEQ ID NO: 933728 - DNA, 17 bp, Homo sapiens
ctgagaagaggtccttg

SEQ ID NO: 933729 - DNA, 23 bp, Homo sapiens
ctgagaagatctaccccagggag

SEQ ID NO: 933730 - DNA, 17 bp, Homo sapiens
ctgagaagattgtgaat

SEQ ID NO: 933731 - DNA, 13 bp, Homo sapiens
ctgagaagctctg

SEQ ID NO: 933732 - DNA, 17 bp, Homo sapiens
ctgagaagctgctccag

SEQ ID NO: 933733 - DNA, 17 bp, Homo sapiens
ctgagaaggcgaggaga

SEQ ID NO: 933734 - DNA, 21 bp, Homo sapiens
ctgagaaggcgaggagagtgg

SEQ ID NO: 933735 - DNA, 20 bp, Homo sapiens
ctgagaatataatactgtat

SEQ ID NO: 933736 - DNA, 19 bp, Homo sapiens
ctgagaatctgggggtgag

SEQ ID NO: 933737 - DNA, 14 bp, Homo sapiens
ctgagaatctttat

SEQ ID NO: 933738 - DNA, 18 bp, Homo sapiens
ctgagaatgagtgggaat

SEQ ID NO: 933739 - DNA, 22 bp, Homo sapiens
ctgagaatgagtgggaatccgg

SEQ ID NO: 933740 - DNA, 16 bp, Homo sapiens
ctgagaattccaagga

SEQ ID NO: 933741 - DNA, 14 bp, Homo sapiens
ctgagacagcacca

SEQ ID NO: 933742 - DNA, 12 bp, Homo sapiens
ctgagaccaggg

SEQ ID NO: 933743 - DNA, 14 bp, Homo sapiens
ctgagaccagttgg

SEQ ID NO: 933744 - DNA, 22 bp, Homo sapiens
ctgagaccctactgaagtggct

SEQ ID NO: 933745 - DNA, 20 bp, Homo sapiens
ctgagacctgacaagcactg

SEQ ID NO: 933746 - DNA, 17 bp, Homo sapiens
ctgagactccagaatct

SEQ ID NO: 933747 - DNA, 22 bp, Homo sapiens
ctgagactccagaatctgctgt

SEQ ID NO: 933748 - DNA, 14 bp, Homo sapiens
ctgagactgcggga

SEQ ID NO: 933749 - DNA, 20 bp, Homo sapiens
ctgagactggcacttagccc

SEQ ID NO: 933750 - DNA, 19 bp, Homo sapiens
ctgagactgtcggagaggc

SEQ ID NO: 933751 - DNA, 19 bp, Homo sapiens
ctgagacttgttcttggtt

SEQ ID NO: 933752 - DNA, 22 bp, Homo sapiens
ctgagacttgttcttggttcct

SEQ ID NO: 933753 - DNA, 23 bp, Homo sapiens
ctgagacttgttcttggttcctg

SEQ ID NO: 933754 - DNA, 20 bp, Homo sapiens
ctgagagaattggctcaata

SEQ ID NO: 933755 - DNA, 15 bp, Homo sapiens
ctgagagacccaagg

SEQ ID NO: 933756 - DNA, 19 bp, Homo sapiens
ctgagagaccctggcctca

SEQ ID NO: 933757 - DNA, 21 bp, Homo sapiens
ctgagagaccctggcctcaag

SEQ ID NO: 933758 - DNA, 20 bp, Homo sapiens
ctgagagagaatagagctgc

SEQ ID NO: 933759 - DNA, 21 bp, Homo sapiens
ctgagagagaatagagctgcc

SEQ ID NO: 933760 - DNA, 23 bp, Homo sapiens
ctgagagagaatagagctgccac

SEQ ID NO: 933761 - DNA, 13 bp, Homo sapiens
ctgagagccccag

SEQ ID NO: 933762 - DNA, 14 bp, Homo sapiens
ctgagagccccagc

SEQ ID NO: 933763 - DNA, 15 bp, Homo sapiens
ctgagagccccagct

SEQ ID NO: 933764 - DNA, 16 bp, Homo sapiens
ctgagagccccagctg

SEQ ID NO: 933765 - DNA, 13 bp, Homo sapiens
ctgagagccccca

SEQ ID NO: 933766 - DNA, 16 bp, Homo sapiens
ctgagagccctgctgt

SEQ ID NO: 933767 - DNA, 16 bp, Homo sapiens
ctgagagctgcctcct

SEQ ID NO: 933768 - DNA, 17 bp, Homo sapiens
ctgagaggcaggcatag

SEQ ID NO: 933769 - DNA, 16 bp, Homo sapiens
ctgagaggcctggagc

SEQ ID NO: 933770 - DNA, 17 bp, Homo sapiens
ctgagaggcgagctcct

SEQ ID NO: 933771 - DNA, 22 bp, Homo sapiens
ctgagaggctctccgtgcaggc

SEQ ID NO: 933772 - DNA, 14 bp, Homo sapiens
ctgagagtcagctc

SEQ ID NO: 933773 - DNA, 22 bp, Homo sapiens
ctgagagtcagctctctgccct

SEQ ID NO: 933774 - DNA, 22 bp, Homo sapiens
ctgagagtctgaaagacagaat

SEQ ID NO: 933775 - DNA, 15 bp, Homo sapiens
ctgagagtgaaacca

SEQ ID NO: 933776 - DNA, 20 bp, Homo sapiens
ctgagagttggctcaggcag

SEQ ID NO: 933777 - DNA, 21 bp, Homo sapiens
ctgagagttggctcaggcaga

SEQ ID NO: 933778 - DNA, 18 bp, Homo sapiens
ctgagataccagcgagga

SEQ ID NO: 933779 - DNA, 20 bp, Homo sapiens
ctgagatacttcccaaagcc

SEQ ID NO: 933780 - DNA, 18 bp, Homo sapiens
cagctatgggagccccag

SEQ ID NO: 933781 - DNA, 16 bp, Homo sapiens
cagctatgtagcaaag

SEQ ID NO: 933782 - DNA, 21 bp, Homo sapiens
cagctatgttatattgaaaaa

SEQ ID NO: 933783 - DNA, 15 bp, Homo sapiens
cagctcaactcacag

SEQ ID NO: 933784 - DNA, 16 bp, Homo sapiens
cagctcaactcacagc

SEQ ID NO: 933785 - DNA, 20 bp, Homo sapiens
cagctcaactcacagcttct

SEQ ID NO: 933786 - DNA, 22 bp, Homo sapiens
cagctcaactcacagcttctcc

SEQ ID NO: 933787 - DNA, 21 bp, Homo sapiens
cagctcaactcgggggcgcct

SEQ ID NO: 933788 - DNA, 23 bp, Homo sapiens
cagctcaactcgggggcgcctgg

SEQ ID NO: 933789 - DNA, 19 bp, Homo sapiens
cagctcaagtcttccctga

SEQ ID NO: 933790 - DNA, 16 bp, Homo sapiens
cagctcaatggactgg

SEQ ID NO: 933791 - DNA, 20 bp, Homo sapiens
cagctcacccctgggcaggc

SEQ ID NO: 933792 - DNA, 21 bp, Homo sapiens
cagctcacccctgggcaggcg

SEQ ID NO: 933793 - DNA, 18 bp, Homo sapiens
cagctcacctcaacctcc

SEQ ID NO: 933794 - DNA, 19 bp, Homo sapiens
cagctcacctctgaaggca

SEQ ID NO: 933795 - DNA, 16 bp, Homo sapiens
cagctcactgcagcct

SEQ ID NO: 933796 - DNA, 14 bp, Homo sapiens
cagctcagaaccca

SEQ ID NO: 933797 - DNA, 17 bp, Homo sapiens
cagctcagaacccaggg

SEQ ID NO: 933798 - DNA, 11 bp, Homo sapiens
cagctcagaga

SEQ ID NO: 933799 - DNA, 13 bp, Homo sapiens
cagctcagagatg

SEQ ID NO: 933800 - DNA, 13 bp, Homo sapiens
cagctcagccctg

SEQ ID NO: 933801 - DNA, 14 bp, Homo sapiens
cagctcagccctgg

SEQ ID NO: 933802 - DNA, 13 bp, Homo sapiens
cagctcagcgcca

SEQ ID NO: 933803 - DNA, 12 bp, Homo sapiens
cagctcaggcac

SEQ ID NO: 933804 - DNA, 20 bp, Homo sapiens
cagctcagtctcagccttgt

SEQ ID NO: 933805 - DNA, 20 bp, Homo sapiens
cagctcatagaattttgagt

SEQ ID NO: 933806 - DNA, 23 bp, Homo sapiens
cagctcatgacactgtttggcct

SEQ ID NO: 933807 - DNA, 20 bp, Homo sapiens
cagctcatgtaggtgagcct

SEQ ID NO: 933808 - DNA, 16 bp, Homo sapiens
cagctcattaaacttt

SEQ ID NO: 933809 - DNA, 14 bp, Homo sapiens
cagctcattatgaa

SEQ ID NO: 933810 - DNA, 18 bp, Homo sapiens
cagctcatttaatcccag

SEQ ID NO: 933811 - DNA, 13 bp, Homo sapiens
cagctccaggaca

SEQ ID NO: 933812 - DNA, 15 bp, Homo sapiens
cagctccaggcccac

SEQ ID NO: 933813 - DNA, 16 bp, Homo sapiens
cagctccaggcccacc

SEQ ID NO: 933814 - DNA, 20 bp, Homo sapiens
cagctccagggaatccaagc

SEQ ID NO: 933815 - DNA, 22 bp, Homo sapiens
cagctccagggaatccaagcct

SEQ ID NO: 933816 - DNA, 21 bp, Homo sapiens
cagctccaggggcccttggga

SEQ ID NO: 933817 - DNA, 14 bp, Homo sapiens
cagctccatcctct

SEQ ID NO: 933818 - DNA, 17 bp, Homo sapiens
cagctccatcctcttga

SEQ ID NO: 933819 - DNA, 23 bp, Homo sapiens
cagctcccaacgagcctcctcag

SEQ ID NO: 933820 - DNA, 12 bp, Homo sapiens
cagctcccaccc

SEQ ID NO: 933821 - DNA, 22 bp, Homo sapiens
cagctcccaccccacccccttc

SEQ ID NO: 933822 - DNA, 21 bp, Homo sapiens
cagctgccaagcactcgagac

SEQ ID NO: 933823 - DNA, 13 bp, Homo sapiens
cagctgccagaga

SEQ ID NO: 933824 - DNA, 11 bp, Homo sapiens
cagctgccagg

SEQ ID NO: 933825 - DNA, 16 bp, Homo sapiens
cagctgcccctccctc

SEQ ID NO: 933826 - DNA, 17 bp, Homo sapiens
cagctgcccctcctgga

SEQ ID NO: 933827 - DNA, 21 bp, Homo sapiens
cagctgcccctcctggagcag

SEQ ID NO: 933828 - DNA, 22 bp, Homo sapiens
cagctgcccctcctggagcaga

SEQ ID NO: 933829 - DNA, 15 bp, Homo sapiens
cagctgccctatggg

SEQ ID NO: 933830 - DNA, 19 bp, Homo sapiens
cagctgccctatgggcctg

SEQ ID NO: 933831 - DNA, 20 bp, Homo sapiens
cagctgccctatgggcctgc

SEQ ID NO: 933832 - DNA, 19 bp, Homo sapiens
cagctgccctgctgccaca

SEQ ID NO: 933833 - DNA, 21 bp, Homo sapiens
cagctgccctgctgccacagc

SEQ ID NO: 933834 - DNA, 21 bp, Homo sapiens
cagctgcccttccgcagtgtg

SEQ ID NO: 933835 - DNA, 18 bp, Homo sapiens
cagctgccgaccagagcc

SEQ ID NO: 933836 - DNA, 19 bp, Homo sapiens
cagctgccgaccagagccc

SEQ ID NO: 933837 - DNA, 14 bp, Homo sapiens
cagctgcctaccta

SEQ ID NO: 933838 - DNA, 14 bp, Homo sapiens
cagctgcctcactt

SEQ ID NO: 933839 - DNA, 19 bp, Homo sapiens
cagctgcctctgctccctc

SEQ ID NO: 933840 - DNA, 13 bp, Homo sapiens
cagctgcctcttc

SEQ ID NO: 933841 - DNA, 15 bp, Homo sapiens
cagctgcctggccat

SEQ ID NO: 933842 - DNA, 16 bp, Homo sapiens
cagctgcctggccatg

SEQ ID NO: 933843 - DNA, 17 bp, Homo sapiens
cagctgcctggccatgc

SEQ ID NO: 933844 - DNA, 22 bp, Homo sapiens
cagctgcctggccatgctgtcc

SEQ ID NO: 933845 - DNA, 13 bp, Homo sapiens
cagctgcctgggc

SEQ ID NO: 933846 - DNA, 19 bp, Homo sapiens
cagctgcctggggcccaag

SEQ ID NO: 933847 - DNA, 10 bp, Homo sapiens
cagctgcctt

SEQ ID NO: 933848 - DNA, 23 bp, Homo sapiens
cagctgccttttaagaggtctta

SEQ ID NO: 933849 - DNA, 19 bp, Homo sapiens
cagctgcgggtctgaagga

SEQ ID NO: 933850 - DNA, 17 bp, Homo sapiens
cagctgctactactcct

SEQ ID NO: 933851 - DNA, 20 bp, Homo sapiens
cagctgctatttattttcct

SEQ ID NO: 933852 - DNA, 12 bp, Homo sapiens
cagctgctccca

SEQ ID NO: 933853 - DNA, 18 bp, Homo sapiens
cagctgctcccctgccac

SEQ ID NO: 933854 - DNA, 19 bp, Homo sapiens
cagctgctcccctgccacg

SEQ ID NO: 933855 - DNA, 16 bp, Homo sapiens
cagctgctcccctgga

SEQ ID NO: 933856 - DNA, 23 bp, Homo sapiens
cagctgctccgaggacccaggaa

SEQ ID NO: 933857 - DNA, 13 bp, Homo sapiens
cagctgctctgcc

SEQ ID NO: 933858 - DNA, 16 bp, Homo sapiens
cagctgctctgcccct

SEQ ID NO: 933859 - DNA, 21 bp, Homo sapiens
cagctgctctgccccttgggc

SEQ ID NO: 933860 - DNA, 13 bp, Homo sapiens
cagctgctggaga

SEQ ID NO: 933861 - DNA, 14 bp, Homo sapiens
cagctgctggagaa

SEQ ID NO: 933862 - DNA, 13 bp, Homo sapiens
cagctgctgtctt

SEQ ID NO: 933863 - DNA, 14 bp, Homo sapiens
cagctgctgtgccc

SEQ ID NO: 933864 - DNA, 9 bp, Homo sapiens
cagctgctt

SEQ ID NO: 933865 - DNA, 14 bp, Homo sapiens
cagctgcttctccc

SEQ ID NO: 933866 - DNA, 15 bp, Homo sapiens
cagctgcttctcccc

SEQ ID NO: 933867 - DNA, 16 bp, Homo sapiens
cagctgcttctccccc

SEQ ID NO: 933868 - DNA, 18 bp, Homo sapiens
cagctgcttctcccccca

SEQ ID NO: 933869 - DNA, 21 bp, Homo sapiens
cagctgcttctccccccatcc

SEQ ID NO: 933870 - DNA, 10 bp, Homo sapiens
cagctgcttg

SEQ ID NO: 933871 - DNA, 15 bp, Homo sapiens
cagctgctttcttct

SEQ ID NO: 933872 - DNA, 14 bp, Homo sapiens
cagctgctttgagc

SEQ ID NO: 933873 - DNA, 14 bp, Homo sapiens
cagctgctttttgt

SEQ ID NO: 933874 - DNA, 23 bp, Homo sapiens
cagctggacagaggggactctgg

SEQ ID NO: 933875 - DNA, 21 bp, Homo sapiens
cagctggacatactgctggag

SEQ ID NO: 933876 - DNA, 19 bp, Homo sapiens
cagctggaccatctctgta

SEQ ID NO: 933877 - DNA, 15 bp, Homo sapiens
cagctggactctgca

SEQ ID NO: 933878 - DNA, 19 bp, Homo sapiens
cagctggactctgcatccc

SEQ ID NO: 933879 - DNA, 16 bp, Homo sapiens
cagctggagaagaccc

SEQ ID NO: 933880 - DNA, 19 bp, Homo sapiens
cagctggaggaatacattt

SEQ ID NO: 933881 - DNA, 20 bp, Homo sapiens
cagctggaggaatacatttt

SEQ ID NO: 933882 - DNA, 16 bp, Homo sapiens
cagctggagtgagggc

SEQ ID NO: 933883 - DNA, 23 bp, Homo sapiens
cagctggatgagaatttgagtgc

SEQ ID NO: 933884 - DNA, 21 bp, Homo sapiens
cagctggatgagacttccaaa

SEQ ID NO: 933885 - DNA, 18 bp, Homo sapiens
cagctggcccccagccct

SEQ ID NO: 933886 - DNA, 20 bp, Homo sapiens
cagctggcccccagccctgg

SEQ ID NO: 933887 - DNA, 18 bp, Homo sapiens
cagctggcccgtgacaga

SEQ ID NO: 933888 - DNA, 12 bp, Homo sapiens
cagctggcctgg

SEQ ID NO: 933889 - DNA, 15 bp, Homo sapiens
cagctggcctggaca

SEQ ID NO: 933890 - DNA, 13 bp, Homo sapiens
cagctggcctggg

SEQ ID NO: 933891 - DNA, 18 bp, Homo sapiens
cagctggctagcattcct

SEQ ID NO: 933892 - DNA, 16 bp, Homo sapiens
cagctggctctccacc

SEQ ID NO: 933893 - DNA, 18 bp, Homo sapiens
cagctggctctccacctt

SEQ ID NO: 933894 - DNA, 14 bp, Homo sapiens
cagctgggacctaa

SEQ ID NO: 933895 - DNA, 17 bp, Homo sapiens
cagctgggacctaatgc

SEQ ID NO: 933896 - DNA, 18 bp, Homo sapiens
cagctgggacctaatgct

SEQ ID NO: 933897 - DNA, 20 bp, Homo sapiens
cagctgggacctaatgctgg

SEQ ID NO: 933898 - DNA, 22 bp, Homo sapiens
cagctgggacctaatgctggcc

SEQ ID NO: 933899 - DNA, 14 bp, Homo sapiens
cagctgggagccag

SEQ ID NO: 933900 - DNA, 17 bp, Homo sapiens
cagctgggagccagtgt

SEQ ID NO: 933901 - DNA, 22 bp, Homo sapiens
cagctgggagccagtgtgccca

SEQ ID NO: 933902 - DNA, 14 bp, Homo sapiens
cagctgggaggcaa

SEQ ID NO: 933903 - DNA, 13 bp, Homo sapiens
cagctgggcagtg

SEQ ID NO: 933904 - DNA, 12 bp, Homo sapiens
cagctgggcccc

SEQ ID NO: 933905 - DNA, 13 bp, Homo sapiens
cagctgggcccca

SEQ ID NO: 933906 - DNA, 20 bp, Homo sapiens
cagctgggccccatgctctg

SEQ ID NO: 933907 - DNA, 16 bp, Homo sapiens
cagctgggctctgcca

SEQ ID NO: 933908 - DNA, 21 bp, Homo sapiens
cagctgggcttggcctggaga

SEQ ID NO: 933909 - DNA, 17 bp, Homo sapiens
cagctggggagatgggg

SEQ ID NO: 933910 - DNA, 15 bp, Homo sapiens
cagctggggccagag

SEQ ID NO: 933911 - DNA, 16 bp, Homo sapiens
cagctggggccagagg

SEQ ID NO: 933912 - DNA, 18 bp, Homo sapiens
cagctggggcgtggggag

SEQ ID NO: 933913 - DNA, 20 bp, Homo sapiens
cagctggggcgtggggaggg

SEQ ID NO: 933914 - DNA, 21 bp, Homo sapiens
cagctggggcgtggggagggc

SEQ ID NO: 933915 - DNA, 16 bp, Homo sapiens
cagctggggtcctgtc

SEQ ID NO: 933916 - DNA, 16 bp, Homo sapiens
cagctgggtcaggcag

SEQ ID NO: 933917 - DNA, 15 bp, Homo sapiens
cagctggtcctgtgg

SEQ ID NO: 933918 - DNA, 21 bp, Homo sapiens
cagctggtcctgtggatggga

SEQ ID NO: 933919 - DNA, 22 bp, Homo sapiens
cagctggtgggaagcgtctgtc

SEQ ID NO: 933920 - DNA, 16 bp, Homo sapiens
cagctggttcgtggtt

SEQ ID NO: 933921 - DNA, 13 bp, Homo sapiens
cagctggttgctc

SEQ ID NO: 933922 - DNA, 20 bp, Homo sapiens
cagctgtaacacagctgaga

SEQ ID NO: 933923 - DNA, 20 bp, Homo sapiens
cagctgtaagaagagactgg

SEQ ID NO: 933924 - DNA, 20 bp, Homo sapiens
cagctgtagccatggctcag

SEQ ID NO: 933925 - DNA, 23 bp, Homo sapiens
cagctgtagccatggctcaggca

SEQ ID NO: 933926 - DNA, 14 bp, Homo sapiens
cagctgtattttgg

SEQ ID NO: 933927 - DNA, 21 bp, Homo sapiens
cagctgtcccctctccctggg

SEQ ID NO: 933928 - DNA, 12 bp, Homo sapiens
cagctgtccctg

SEQ ID NO: 933929 - DNA, 14 bp, Homo sapiens
cagctgtccctgtc

SEQ ID NO: 933930 - DNA, 16 bp, Homo sapiens
cagctgtccctgtcac

SEQ ID NO: 933931 - DNA, 16 bp, Homo sapiens
cagctgtcctcttctg

SEQ ID NO: 933932 - DNA, 16 bp, Homo sapiens
cagctgtcctgcagca

SEQ ID NO: 933933 - DNA, 18 bp, Homo sapiens
cagctgtcgtctgactct

SEQ ID NO: 933934 - DNA, 17 bp, Homo sapiens
cagctgtctgccaggca

SEQ ID NO: 933935 - DNA, 22 bp, Homo sapiens
cagctgtgagccatgcctccct

SEQ ID NO: 933936 - DNA, 15 bp, Homo sapiens
cagctgtgcccctcc

SEQ ID NO: 933937 - DNA, 16 bp, Homo sapiens
cagctgtgcccctccc

SEQ ID NO: 933938 - DNA, 18 bp, Homo sapiens
cagctgtgctgtggagag

SEQ ID NO: 933939 - DNA, 16 bp, Homo sapiens
cagctgtggcagagtt

SEQ ID NO: 933940 - DNA, 19 bp, Homo sapiens
cagctgtggtacaaatgtg

SEQ ID NO: 933941 - DNA, 11 bp, Homo sapiens
cagctgtgtct

SEQ ID NO: 933942 - DNA, 15 bp, Homo sapiens
cagctgttcagctgg

SEQ ID NO: 933943 - DNA, 16 bp, Homo sapiens
cagctgttcagctggt

SEQ ID NO: 933944 - DNA, 13 bp, Homo sapiens
cagctgttcctgt

SEQ ID NO: 933945 - DNA, 15 bp, Homo sapiens
ctgaggacctctcag

SEQ ID NO: 933946 - DNA, 19 bp, Homo sapiens
ctgaggactttgcccagga

SEQ ID NO: 933947 - DNA, 13 bp, Homo sapiens
ctgaggagacatc

SEQ ID NO: 933948 - DNA, 19 bp, Homo sapiens
ctgaggagatgaccaggga

SEQ ID NO: 933949 - DNA, 13 bp, Homo sapiens
ctgaggagcagcc

SEQ ID NO: 933950 - DNA, 15 bp, Homo sapiens
ctgaggagcagccag

SEQ ID NO: 933951 - DNA, 17 bp, Homo sapiens
ctgaggagcagccagga

SEQ ID NO: 933952 - DNA, 23 bp, Homo sapiens
ctgaggagcagccaggacccgcc

SEQ ID NO: 933953 - DNA, 23 bp, Homo sapiens
ctgaggagccctgaggacctctc

SEQ ID NO: 933954 - DNA, 11 bp, Homo sapiens
ctgaggaggag

SEQ ID NO: 933955 - DNA, 23 bp, Homo sapiens
ctgaggaggaggacacagcacaa

SEQ ID NO: 933956 - DNA, 15 bp, Homo sapiens
ctgaggaggccgctt

SEQ ID NO: 933957 - DNA, 19 bp, Homo sapiens
ctgaggaggccgcttagtg

SEQ ID NO: 933958 - DNA, 21 bp, Homo sapiens
ctgaggagtattaagaatgca

SEQ ID NO: 933959 - DNA, 22 bp, Homo sapiens
ctgaggagtattaagaatgcag

SEQ ID NO: 933960 - DNA, 16 bp, Homo sapiens
ctgaggagtctgagga

SEQ ID NO: 933961 - DNA, 18 bp, Homo sapiens
ctgaggagtctgaggact

SEQ ID NO: 933962 - DNA, 17 bp, Homo sapiens
ctgaggatttcctggag

SEQ ID NO: 933963 - DNA, 18 bp, Homo sapiens
ctgaggatttcctggagt

SEQ ID NO: 933964 - DNA, 23 bp, Homo sapiens
ctgaggcaaccccctcggagcct

SEQ ID NO: 933965 - DNA, 14 bp, Homo sapiens
ctgaggcagacagc

SEQ ID NO: 933966 - DNA, 15 bp, Homo sapiens
ctgaggcagacagca

SEQ ID NO: 933967 - DNA, 16 bp, Homo sapiens
ctgaggcagacagcag

SEQ ID NO: 933968 - DNA, 22 bp, Homo sapiens
ctgaggcagcagtgtgaggcca

SEQ ID NO: 933969 - DNA, 24 bp, Homo sapiens
ctgaggcagcagtgtgaggccagg

SEQ ID NO: 933970 - DNA, 12 bp, Homo sapiens
ctgaggcaggag

SEQ ID NO: 933971 - DNA, 14 bp, Homo sapiens
ctgaggcaggagaa

SEQ ID NO: 933972 - DNA, 18 bp, Homo sapiens
ctgaggcaggagactggc

SEQ ID NO: 933973 - DNA, 12 bp, Homo sapiens
ctgaggccagag

SEQ ID NO: 933974 - DNA, 15 bp, Homo sapiens
ctgaggccagagtca

SEQ ID NO: 933975 - DNA, 13 bp, Homo sapiens
ctgaggccagtgg

SEQ ID NO: 933976 - DNA, 15 bp, Homo sapiens
ctgaggccagtggcc

SEQ ID NO: 933977 - DNA, 17 bp, Homo sapiens
ctgaggccagtggcccc

SEQ ID NO: 933978 - DNA, 14 bp, Homo sapiens
ctgaggccatcagg

SEQ ID NO: 933979 - DNA, 20 bp, Homo sapiens
ctgaggccctcactgagcct

SEQ ID NO: 933980 - DNA, 13 bp, Homo sapiens
ctgaggccctgtg

SEQ ID NO: 933981 - DNA, 19 bp, Homo sapiens
ctgaggcctaaaagtaaac

SEQ ID NO: 933982 - DNA, 21 bp, Homo sapiens
ctgaggcctaaaagtaaacat

SEQ ID NO: 933983 - DNA, 23 bp, Homo sapiens
ctgaggcctaaaagtaaacatta

SEQ ID NO: 933984 - DNA, 19 bp, Homo sapiens
ctgaggcctagactctgtc

SEQ ID NO: 933985 - DNA, 18 bp, Homo sapiens
ctgaggcctatgcagaca

SEQ ID NO: 933986 - DNA, 15 bp, Homo sapiens
ctgaggcctcgaggg

SEQ ID NO: 933987 - DNA, 18 bp, Homo sapiens
ctgaggcctgccccctgg

SEQ ID NO: 933988 - DNA, 12 bp, Homo sapiens
ctgaggcctgga

SEQ ID NO: 933989 - DNA, 18 bp, Homo sapiens
ctgaggccttatcattca

SEQ ID NO: 933990 - DNA, 15 bp, Homo sapiens
ctgaggcggaggctg

SEQ ID NO: 933991 - DNA, 16 bp, Homo sapiens
ctgaggcggaggctgt

SEQ ID NO: 933992 - DNA, 23 bp, Homo sapiens
ctgaggcggaggctgtgctccgc

SEQ ID NO: 933993 - DNA, 17 bp, Homo sapiens
ctgaggcgggagaatca

SEQ ID NO: 933994 - DNA, 18 bp, Homo sapiens
ctgaggctctttctgggc

SEQ ID NO: 933995 - DNA, 21 bp, Homo sapiens
ctgaggctggatcctagcctt

SEQ ID NO: 933996 - DNA, 17 bp, Homo sapiens
ctgaggctgtggtcaca

SEQ ID NO: 933997 - DNA, 15 bp, Homo sapiens
ctgaggcttagagag

SEQ ID NO: 933998 - DNA, 22 bp, Homo sapiens
ctgaggcttagagagaggaggc

SEQ ID NO: 933999 - DNA, 18 bp, Homo sapiens
ctgaggcttccagagagt

SEQ ID NO: 934000 - DNA, 20 bp, Homo sapiens
ctgaggctttggtaccccca

SEQ ID NO: 934001 - DNA, 16 bp, Homo sapiens
ctgagggacaggatct

SEQ ID NO: 934002 - DNA, 12 bp, Homo sapiens
ctgagggaccaa

SEQ ID NO: 934003 - DNA, 16 bp, Homo sapiens
ctgagggaccaactgg

SEQ ID NO: 934004 - DNA, 21 bp, Homo sapiens
ctgagggaccaactgggccca

SEQ ID NO: 934005 - DNA, 13 bp, Homo sapiens
ctgagggaccctt

SEQ ID NO: 934006 - DNA, 17 bp, Homo sapiens
ctgagggacgtggtgcc

SEQ ID NO: 934007 - DNA, 16 bp, Homo sapiens
ctgagggaggacctgg

SEQ ID NO: 934008 - DNA, 21 bp, Homo sapiens
ctgagggaggaggccacctct

SEQ ID NO: 934009 - DNA, 18 bp, Homo sapiens
ctgagggattgaggggcc

SEQ ID NO: 934010 - DNA, 23 bp, Homo sapiens
ctgagggattgaggggccctggc

SEQ ID NO: 934011 - DNA, 11 bp, Homo sapiens
ctgagggcagt

SEQ ID NO: 934012 - DNA, 15 bp, Homo sapiens
ctgagggcagtaccc

SEQ ID NO: 934013 - DNA, 13 bp, Homo sapiens
ctgagggcagtgc

SEQ ID NO: 934014 - DNA, 14 bp, Homo sapiens
ctgagggcagtgcc

SEQ ID NO: 934015 - DNA, 17 bp, Homo sapiens
ctgagggcagtgccctt

SEQ ID NO: 934016 - DNA, 18 bp, Homo sapiens
ctgagggcagtgcccttt

SEQ ID NO: 934017 - DNA, 23 bp, Homo sapiens
ctgagggccaataccctactgtg

SEQ ID NO: 934018 - DNA, 18 bp, Homo sapiens
ctgagggcccctctgccc

SEQ ID NO: 934019 - DNA, 14 bp, Homo sapiens
ctgagggccctgtg

SEQ ID NO: 934020 - DNA, 15 bp, Homo sapiens
ctgagggcctgctgg

SEQ ID NO: 934021 - DNA, 16 bp, Homo sapiens
ctgagggcctgctgga

SEQ ID NO: 934022 - DNA, 16 bp, Homo sapiens
ctgagggcgaggggag

SEQ ID NO: 934023 - DNA, 14 bp, Homo sapiens
ctgagggctctgtt

SEQ ID NO: 934024 - DNA, 21 bp, Homo sapiens
ctgaggggaggatcactggag

SEQ ID NO: 934025 - DNA, 22 bp, Homo sapiens
ctgaggggaggatcactggagc

SEQ ID NO: 934026 - DNA, 18 bp, Homo sapiens
ctgaggggaggcacctcc

SEQ ID NO: 934027 - DNA, 19 bp, Homo sapiens
ctgaggggaggcacctcca

SEQ ID NO: 934028 - DNA, 22 bp, Homo sapiens
ctgaggggaggcacctccaggc

SEQ ID NO: 934029 - DNA, 23 bp, Homo sapiens
ctgaggggaggcacctccaggca

SEQ ID NO: 934030 - DNA, 17 bp, Homo sapiens
ctgaggggattctctac

SEQ ID NO: 934031 - DNA, 14 bp, Homo sapiens
ctgaggggcaggga

SEQ ID NO: 934032 - DNA, 18 bp, Homo sapiens
ctgaggggcagggagagc

SEQ ID NO: 934033 - DNA, 20 bp, Homo sapiens
ctgaggggcatctgcccctc

SEQ ID NO: 934034 - DNA, 11 bp, Homo sapiens
ctgaggggcct

SEQ ID NO: 934035 - DNA, 17 bp, Homo sapiens
ctgaggggcctgcgccc

SEQ ID NO: 934036 - DNA, 21 bp, Homo sapiens
ctgaggggcctgcgcccagag

SEQ ID NO: 934037 - DNA, 13 bp, Homo sapiens
ctgaggggctggg

SEQ ID NO: 934038 - DNA, 16 bp, Homo sapiens
ctgaggggctgggctg

SEQ ID NO: 934039 - DNA, 18 bp, Homo sapiens
ctgaggggctggggaggg

SEQ ID NO: 934040 - DNA, 20 bp, Homo sapiens
ctgaggggggccgtgcccag

SEQ ID NO: 934041 - DNA, 21 bp, Homo sapiens
ctgaggggggccgtgcccagg

SEQ ID NO: 934042 - DNA, 22 bp, Homo sapiens
ctgaggggggccgtgcccaggg

SEQ ID NO: 934043 - DNA, 23 bp, Homo sapiens
ctgaggggggccgtgcccagggg

SEQ ID NO: 934044 - DNA, 19 bp, Homo sapiens
ctgaggggtgtccgagagg

SEQ ID NO: 934045 - DNA, 21 bp, Homo sapiens
ctgagggtccccacctgggac

SEQ ID NO: 934046 - DNA, 20 bp, Homo sapiens
ctgagggtgtttcttcctgc

SEQ ID NO: 934047 - DNA, 18 bp, Homo sapiens
ctgaggtatggccatgcc

SEQ ID NO: 934048 - DNA, 20 bp, Homo sapiens
ctgaggtcaataaagcagag

SEQ ID NO: 934049 - DNA, 23 bp, Homo sapiens
ctgaggtcaataaagcagagcca

SEQ ID NO: 934050 - DNA, 20 bp, Homo sapiens
ctgaggtcccctcgtcccat

SEQ ID NO: 934051 - DNA, 16 bp, Homo sapiens
ctgaggtctcttgagg

SEQ ID NO: 934052 - DNA, 19 bp, Homo sapiens
ctgaggtgaaagggagcta

SEQ ID NO: 934053 - DNA, 17 bp, Homo sapiens
ctgaggtgcctgtccca

SEQ ID NO: 934054 - DNA, 12 bp, Homo sapiens
ctgaggtgggag

SEQ ID NO: 934055 - DNA, 14 bp, Homo sapiens
ctgaggtgggcaga

SEQ ID NO: 934056 - DNA, 20 bp, Homo sapiens
ctgaggtgggcagatcacga

SEQ ID NO: 934057 - DNA, 23 bp, Homo sapiens
ctgaggtgggcccaggaccagct

SEQ ID NO: 934058 - DNA, 18 bp, Homo sapiens
ctgaggtgggctggggct

SEQ ID NO: 934059 - DNA, 14 bp, Homo sapiens
ctgaggtggggaag

SEQ ID NO: 934060 - DNA, 22 bp, Homo sapiens
ctgaggtgtgggggctgcagca

SEQ ID NO: 934061 - DNA, 15 bp, Homo sapiens
ctgaggttcctctgc

SEQ ID NO: 934062 - DNA, 14 bp, Homo sapiens
ctgaggtttcaccc

SEQ ID NO: 934063 - DNA, 15 bp, Homo sapiens
ctgaggttttgaata

SEQ ID NO: 934064 - DNA, 17 bp, Homo sapiens
ctgagtaattaataaag

SEQ ID NO: 934065 - DNA, 22 bp, Homo sapiens
ctgagtacatattgtggtgatg

SEQ ID NO: 934066 - DNA, 23 bp, Homo sapiens
ctcacccttcctggcccaggcct

SEQ ID NO: 934067 - DNA, 13 bp, Homo sapiens
cctgctggctgcg

SEQ ID NO: 934068 - DNA, 17 bp, Homo sapiens
cctgctggctgcggccc

SEQ ID NO: 934069 - DNA, 18 bp, Homo sapiens
cctgctggctgcggcccc

SEQ ID NO: 934070 - DNA, 21 bp, Homo sapiens
cctgctggctgcggccccctc

SEQ ID NO: 934071 - DNA, 19 bp, Homo sapiens
cctgctgggaaccccgcag

SEQ ID NO: 934072 - DNA, 20 bp, Homo sapiens
cctgctgggaaccccgcagc

SEQ ID NO: 934073 - DNA, 23 bp, Homo sapiens
cctgctgggactgagaaggctca

SEQ ID NO: 934074 - DNA, 23 bp, Homo sapiens
cctgctgggctctccacctcagc

SEQ ID NO: 934075 - DNA, 19 bp, Homo sapiens
cctgcaggctgcaggaggg

SEQ ID NO: 934076 - DNA, 20 bp, Homo sapiens
cctgcaggctgcaggagggc

SEQ ID NO: 934077 - DNA, 15 bp, Homo sapiens
cctgcaggctggaga

SEQ ID NO: 934078 - DNA, 19 bp, Homo sapiens
cctgcaggctggagactgg

SEQ ID NO: 934079 - DNA, 23 bp, Homo sapiens
cctgcaggggagcacggagccgc

SEQ ID NO: 934080 - DNA, 20 bp, Homo sapiens
cctgcaggtcagttgtaata

SEQ ID NO: 934081 - DNA, 14 bp, Homo sapiens
cctgcagtcccaca

SEQ ID NO: 934082 - DNA, 17 bp, Homo sapiens
cctgcagtcccacactg

SEQ ID NO: 934083 - DNA, 19 bp, Homo sapiens
cctgcagtcccacactgtg

SEQ ID NO: 934084 - DNA, 23 bp, Homo sapiens
cctgcagtcccacactgtgcaga

SEQ ID NO: 934085 - DNA, 17 bp, Homo sapiens
cctgcagtgaatttgaa

SEQ ID NO: 934086 - DNA, 16 bp, Homo sapiens
cctgcagtgaggggcc

SEQ ID NO: 934087 - DNA, 13 bp, Homo sapiens
cctgcagtttctt

SEQ ID NO: 934088 - DNA, 21 bp, Homo sapiens
cctgcagtttcttgtgtagat

SEQ ID NO: 934089 - DNA, 23 bp, Homo sapiens
cctgcagtttggccctggagcca

SEQ ID NO: 934090 - DNA, 22 bp, Homo sapiens
cctgcatagtctgttcctttct

SEQ ID NO: 934091 - DNA, 14 bp, Homo sapiens
cctgcatcatcttg

SEQ ID NO: 934092 - DNA, 23 bp, Homo sapiens
cctgcatccccttggctgtgagg

SEQ ID NO: 934093 - DNA, 19 bp, Homo sapiens
cctgcatccgtagttccct

SEQ ID NO: 934094 - DNA, 22 bp, Homo sapiens
cctgcatccgtagttccctgaa

SEQ ID NO: 934095 - DNA, 14 bp, Homo sapiens
cctgcatcctgagg

SEQ ID NO: 934096 - DNA, 18 bp, Homo sapiens
cctgcatcctgaggccag

SEQ ID NO: 934097 - DNA, 22 bp, Homo sapiens
cctgcatcctgaggccagtggc

SEQ ID NO: 934098 - DNA, 22 bp, Homo sapiens
aaattttagttatagtgtttaa

SEQ ID NO: 934099 - DNA, 18 bp, Homo sapiens
aaattttatatgtaaatg

SEQ ID NO: 934100 - DNA, 22 bp, Homo sapiens
aaattttatatgtaaatgtgtt

SEQ ID NO: 934101 - DNA, 22 bp, Homo sapiens
aaattttattaaacaattttgt

SEQ ID NO: 934102 - DNA, 13 bp, Homo sapiens
aaattttcagcat

SEQ ID NO: 934103 - DNA, 20 bp, Homo sapiens
aaattttcatgaatgtgctg

SEQ ID NO: 934104 - DNA, 19 bp, Homo sapiens
aaattttctagactttctg

SEQ ID NO: 934105 - DNA, 21 bp, Homo sapiens
aaattttcttcctttgaagct

SEQ ID NO: 934106 - DNA, 20 bp, Homo sapiens
aaattttcttttaagcattt

SEQ ID NO: 934107 - DNA, 23 bp, Homo sapiens
aaattttgatgttttaaggatgc

SEQ ID NO: 934108 - DNA, 12 bp, Homo sapiens
aaattttgcatt

SEQ ID NO: 934109 - DNA, 13 bp, Homo sapiens
aaattttgcattt

SEQ ID NO: 934110 - DNA, 22 bp, Homo sapiens
aaattttgcttttaattaaata

SEQ ID NO: 934111 - DNA, 13 bp, Homo sapiens
aaattttgtttca

SEQ ID NO: 934112 - DNA, 22 bp, Homo sapiens
aaattttgtttcagaattttgt

SEQ ID NO: 934113 - DNA, 16 bp, Homo sapiens
aaatttttaagttttt

SEQ ID NO: 934114 - DNA, 21 bp, Homo sapiens
aaatttttaagtttttcactt

SEQ ID NO: 934115 - DNA, 18 bp, Homo sapiens
aaatttttacctgtttaa

SEQ ID NO: 934116 - DNA, 16 bp, Homo sapiens
aaatttttatttttga

SEQ ID NO: 934117 - DNA, 17 bp, Homo sapiens
aaatttttcagatgctt

SEQ ID NO: 934118 - DNA, 12 bp, Homo sapiens
aaatttttcata

SEQ ID NO: 934119 - DNA, 13 bp, Homo sapiens
aaatttttcatag

SEQ ID NO: 934120 - DNA, 15 bp, Homo sapiens
aaatttttgaaaaat

SEQ ID NO: 934121 - DNA, 12 bp, Homo sapiens
aaatttttggtt

SEQ ID NO: 934122 - DNA, 17 bp, Homo sapiens
aaatttttgtcatttta

SEQ ID NO: 934123 - DNA, 13 bp, Homo sapiens
aaattttttgact

SEQ ID NO: 934124 - DNA, 23 bp, Homo sapiens
aaattttttgactttttttgtat

SEQ ID NO: 934125 - DNA, 19 bp, Homo sapiens
aaattttttgatgtcagcc

SEQ ID NO: 934126 - DNA, 13 bp, Homo sapiens
aaattttttggca

SEQ ID NO: 934127 - DNA, 15 bp, Homo sapiens
aaattttttgttgac

SEQ ID NO: 934128 - DNA, 16 bp, Homo sapiens
aaatttttttcctaag

SEQ ID NO: 934129 - DNA, 15 bp, Homo sapiens
aaatttttttcttag

SEQ ID NO: 934130 - DNA, 15 bp, Homo sapiens
aaatttttttttaac

SEQ ID NO: 934131 - DNA, 17 bp, Homo sapiens
aaatttttttttaacca

SEQ ID NO: 934132 - DNA, 17 bp, Homo sapiens
aacaaaaaaaatgttaa

SEQ ID NO: 934133 - DNA, 15 bp, Homo sapiens
aacaaaaaaagacaa

SEQ ID NO: 934134 - DNA, 17 bp, Homo sapiens
aacaaaaaacagattct

SEQ ID NO: 934135 - DNA, 19 bp, Homo sapiens
aacaaaaacagaatttgag

SEQ ID NO: 934136 - DNA, 12 bp, Homo sapiens
aacaaaaagaac

SEQ ID NO: 934137 - DNA, 13 bp, Homo sapiens
aacaaaaagatgt

SEQ ID NO: 934138 - DNA, 15 bp, Homo sapiens
aacaaaaagctaaca

SEQ ID NO: 934139 - DNA, 17 bp, Homo sapiens
aacaaaaagctaacatc

SEQ ID NO: 934140 - DNA, 16 bp, Homo sapiens
aacaaaaagcttcccc

SEQ ID NO: 934141 - DNA, 13 bp, Homo sapiens
aacaaaaattagg

SEQ ID NO: 934142 - DNA, 21 bp, Homo sapiens
aacaaaaccgcattcagtgca

SEQ ID NO: 934143 - DNA, 15 bp, Homo sapiens
aacaaaagagagaat

SEQ ID NO: 934144 - DNA, 22 bp, Homo sapiens
aacaaaagggttcatagaaact

SEQ ID NO: 934145 - DNA, 19 bp, Homo sapiens
aacaaaagtacattgctta

SEQ ID NO: 934146 - DNA, 15 bp, Homo sapiens
aacaaaatagaaagt

SEQ ID NO: 934147 - DNA, 17 bp, Homo sapiens
aacaaaatgtatgtctg

SEQ ID NO: 934148 - DNA, 18 bp, Homo sapiens
aacaaacatttgctgaat

SEQ ID NO: 934149 - DNA, 21 bp, Homo sapiens
aacaaaccgaaaatggacatt

SEQ ID NO: 934150 - DNA, 17 bp, Homo sapiens
aacaaacctcactgaga

SEQ ID NO: 934151 - DNA, 18 bp, Homo sapiens
aacaaacgtgttttttaa

SEQ ID NO: 934152 - DNA, 23 bp, Homo sapiens
aacaaagccaaacaaaactgaac

SEQ ID NO: 934153 - DNA, 17 bp, Homo sapiens
aacaaagctgttaaact

SEQ ID NO: 934154 - DNA, 16 bp, Homo sapiens
aacaaaggttgagatg

SEQ ID NO: 934155 - DNA, 13 bp, Homo sapiens
aacaaagttacta

SEQ ID NO: 934156 - DNA, 16 bp, Homo sapiens
aacaaatagtctatca

SEQ ID NO: 934157 - DNA, 13 bp, Homo sapiens
aacaaatatgaaa

SEQ ID NO: 934158 - DNA, 19 bp, Homo sapiens
aacaaatatgaaaaatgta

SEQ ID NO: 934159 - DNA, 18 bp, Homo sapiens
aacaaatcgtttctcaga

SEQ ID NO: 934160 - DNA, 15 bp, Homo sapiens
aacaaattatttttg

SEQ ID NO: 934161 - DNA, 15 bp, Homo sapiens
aacaaattcaaataa

SEQ ID NO: 934162 - DNA, 13 bp, Homo sapiens
aacaacaaaaacc

SEQ ID NO: 934163 - DNA, 22 bp, Homo sapiens
aacaacattaggggattcttct

SEQ ID NO: 934164 - DNA, 17 bp, Homo sapiens
aacaacatttatatgta

SEQ ID NO: 934165 - DNA, 22 bp, Homo sapiens
aacaaccgtcctgctgtccctg

SEQ ID NO: 934166 - DNA, 23 bp, Homo sapiens
aacaaccgtcctgctgtccctgt

SEQ ID NO: 934167 - DNA, 14 bp, Homo sapiens
aacaacctcaactg

SEQ ID NO: 934168 - DNA, 15 bp, Homo sapiens
aacaacctgaatctt

SEQ ID NO: 934169 - DNA, 14 bp, Homo sapiens
aacaacgaaagaag

SEQ ID NO: 934170 - DNA, 15 bp, Homo sapiens
aacaactaaaaaaat

SEQ ID NO: 934171 - DNA, 20 bp, Homo sapiens
aacacccagtctgttcccca

SEQ ID NO: 934172 - DNA, 21 bp, Homo sapiens
aacacccatgaatcaaagaca

SEQ ID NO: 934173 - DNA, 17 bp, Homo sapiens
aacacccccgacggcct

SEQ ID NO: 934174 - DNA, 14 bp, Homo sapiens
aacaccctgcttct

SEQ ID NO: 934175 - DNA, 17 bp, Homo sapiens
aacaccctgcttctccc

SEQ ID NO: 934176 - DNA, 20 bp, Homo sapiens
aacaccgcttctgccttttc

SEQ ID NO: 934177 - DNA, 19 bp, Homo sapiens
aacacctagctttattctt

SEQ ID NO: 934178 - DNA, 13 bp, Homo sapiens
aacacctcccagg

SEQ ID NO: 934179 - DNA, 23 bp, Homo sapiens
aacacctcccaggagacagttca

SEQ ID NO: 934180 - DNA, 16 bp, Homo sapiens
aacacctcctcatgta

SEQ ID NO: 934181 - DNA, 19 bp, Homo sapiens
aacacctctgcacaagctg

SEQ ID NO: 934182 - DNA, 15 bp, Homo sapiens
aacacctgctgcgct

SEQ ID NO: 934183 - DNA, 19 bp, Homo sapiens
aacacctgggcttaagaaa

SEQ ID NO: 934184 - DNA, 20 bp, Homo sapiens
aacaccttcttggcttctgg

SEQ ID NO: 934185 - DNA, 12 bp, Homo sapiens
aacacgaaactt

SEQ ID NO: 934186 - DNA, 15 bp, Homo sapiens
aacacgcacctgcct

SEQ ID NO: 934187 - DNA, 21 bp, Homo sapiens
aacacgccttgttcctgctct

SEQ ID NO: 934188 - DNA, 18 bp, Homo sapiens
aacacgctgcctggtctg

SEQ ID NO: 934189 - DNA, 15 bp, Homo sapiens
aacactaaaaataaa

SEQ ID NO: 934190 - DNA, 13 bp, Homo sapiens
aacactaaaattt

SEQ ID NO: 934191 - DNA, 13 bp, Homo sapiens
aacactaatatat

SEQ ID NO: 934192 - DNA, 16 bp, Homo sapiens
aacactaattcataat

SEQ ID NO: 934193 - DNA, 20 bp, Homo sapiens
aacactacagagtacgtgaa

SEQ ID NO: 934194 - DNA, 23 bp, Homo sapiens
aacactactgctaaatcctcatg

SEQ ID NO: 934195 - DNA, 15 bp, Homo sapiens
aacactagtctgtgt

SEQ ID NO: 934196 - DNA, 18 bp, Homo sapiens
aacactagtctgtgtaac

SEQ ID NO: 934197 - DNA, 19 bp, Homo sapiens
aacactattgtaatcattt

SEQ ID NO: 934198 - DNA, 19 bp, Homo sapiens
aacactatttaagtaaata

SEQ ID NO: 934199 - DNA, 21 bp, Homo sapiens
aacactccggtcagcccctgg

SEQ ID NO: 934200 - DNA, 14 bp, Homo sapiens
aacactgaaaaaat

SEQ ID NO: 934201 - DNA, 19 bp, Homo sapiens
aacactgaatcatgttaat

SEQ ID NO: 934202 - DNA, 18 bp, Homo sapiens
aacactgattcctggaga

SEQ ID NO: 934203 - DNA, 16 bp, Homo sapiens
aacactgcagtttcct

SEQ ID NO: 934204 - DNA, 14 bp, Homo sapiens
aacactgctgtcca

SEQ ID NO: 934205 - DNA, 15 bp, Homo sapiens
aacactggcccctag

SEQ ID NO: 934206 - DNA, 16 bp, Homo sapiens
aacactgggggagggg

SEQ ID NO: 934207 - DNA, 17 bp, Homo sapiens
aacactgggggagggga

SEQ ID NO: 934208 - DNA, 17 bp, Homo sapiens
aacactgtattgtaagt

SEQ ID NO: 934209 - DNA, 14 bp, Homo sapiens
aacactgtgaccag

SEQ ID NO: 934210 - DNA, 20 bp, Homo sapiens
aacactgtgcacatctgtgt

SEQ ID NO: 934211 - DNA, 15 bp, Homo sapiens
aacactgtgccctgg

SEQ ID NO: 934212 - DNA, 18 bp, Homo sapiens
aacactgttggcacttat

SEQ ID NO: 934213 - DNA, 16 bp, Homo sapiens
aacacttaaatttctt

SEQ ID NO: 934214 - DNA, 12 bp, Homo sapiens
aacacttagtat

SEQ ID NO: 934215 - DNA, 16 bp, Homo sapiens
aacacttccagtctgg

SEQ ID NO: 934216 - DNA, 23 bp, Homo sapiens
aacacttctgtatgcatcagata

SEQ ID NO: 934217 - DNA, 19 bp, Homo sapiens
aacacttggcatacaaaat

SEQ ID NO: 934218 - DNA, 21 bp, Homo sapiens
aacacttggcatacaaaatat

SEQ ID NO: 934219 - DNA, 15 bp, Homo sapiens
aacactttaggtaga

SEQ ID NO: 934220 - DNA, 19 bp, Homo sapiens
aacactttctcttcttgtt

SEQ ID NO: 934221 - DNA, 15 bp, Homo sapiens
aacactttgtattac

SEQ ID NO: 934222 - DNA, 18 bp, Homo sapiens
aacactttgtattactta

SEQ ID NO: 934223 - DNA, 13 bp, Homo sapiens
aacagaaactaca

SEQ ID NO: 934224 - DNA, 13 bp, Homo sapiens
aacagaaatgtac

SEQ ID NO: 934225 - DNA, 15 bp, Homo sapiens
aacagaaatgtacag

SEQ ID NO: 934226 - DNA, 21 bp, Homo sapiens
aacagaaatgtacagcaagga

SEQ ID NO: 934227 - DNA, 21 bp, Homo sapiens
aacagaaattgtatattgtaa

SEQ ID NO: 934228 - DNA, 12 bp, Homo sapiens
aacagaacaggg

SEQ ID NO: 934229 - DNA, 15 bp, Homo sapiens
aacagaactcccttc

SEQ ID NO: 934230 - DNA, 20 bp, Homo sapiens
cctcctggtcctggacacct

SEQ ID NO: 934231 - DNA, 21 bp, Homo sapiens
cctcctggtctcttcaccact

SEQ ID NO: 934232 - DNA, 21 bp, Homo sapiens
cctcctggtgcccacagcagg

SEQ ID NO: 934233 - DNA, 18 bp, Homo sapiens
cctcctggtttcctttct

SEQ ID NO: 934234 - DNA, 23 bp, Homo sapiens
cctcctgtcactcactgaggcca

SEQ ID NO: 934235 - DNA, 23 bp, Homo sapiens
cctcctgtgccccagctgccagg

SEQ ID NO: 934236 - DNA, 24 bp, Homo sapiens
cctcctgtgccccagctgccaggc

SEQ ID NO: 934237 - DNA, 18 bp, Homo sapiens
cctcctgtgcctcccttt

SEQ ID NO: 934238 - DNA, 13 bp, Homo sapiens
cctcctgtgcctg

SEQ ID NO: 934239 - DNA, 17 bp, Homo sapiens
cctcctgtgcctggccc

SEQ ID NO: 934240 - DNA, 12 bp, Homo sapiens
cctcctgtgggg

SEQ ID NO: 934241 - DNA, 18 bp, Homo sapiens
cctcctgtggggaaaggg

SEQ ID NO: 934242 - DNA, 13 bp, Homo sapiens
cctcctgttctgc

SEQ ID NO: 934243 - DNA, 22 bp, Homo sapiens
cctccttagccctgtctgctag

SEQ ID NO: 934244 - DNA, 18 bp, Homo sapiens
cctccttatcaaaggaca

SEQ ID NO: 934245 - DNA, 20 bp, Homo sapiens
cctccttatcaaaggacacc

SEQ ID NO: 934246 - DNA, 23 bp, Homo sapiens
cctccttatcctacagtacaatc

SEQ ID NO: 934247 - DNA, 11 bp, Homo sapiens
cctccttccca

SEQ ID NO: 934248 - DNA, 15 bp, Homo sapiens
cctccttccccccat

SEQ ID NO: 934249 - DNA, 22 bp, Homo sapiens
cctccttccccccatctctgag

SEQ ID NO: 934250 - DNA, 12 bp, Homo sapiens
cctccttcccgc

SEQ ID NO: 934251 - DNA, 13 bp, Homo sapiens
cctccttcccgcc

SEQ ID NO: 934252 - DNA, 15 bp, Homo sapiens
cctccttccctcctg

SEQ ID NO: 934253 - DNA, 14 bp, Homo sapiens
cctccttcctggga

SEQ ID NO: 934254 - DNA, 15 bp, Homo sapiens
cctccttctattttc

SEQ ID NO: 934255 - DNA, 16 bp, Homo sapiens
cctccttctccctttt

SEQ ID NO: 934256 - DNA, 18 bp, Homo sapiens
cctccttgcaaccaggca

SEQ ID NO: 934257 - DNA, 19 bp, Homo sapiens
cctccttgcaaccaggcag

SEQ ID NO: 934258 - DNA, 17 bp, Homo sapiens
cctccttgcccagacta

SEQ ID NO: 934259 - DNA, 18 bp, Homo sapiens
cctccttgcctcctgtgt

SEQ ID NO: 934260 - DNA, 15 bp, Homo sapiens
cctccttgctgaccc

SEQ ID NO: 934261 - DNA, 19 bp, Homo sapiens
cctccttgctgaccccagg

SEQ ID NO: 934262 - DNA, 20 bp, Homo sapiens
cctccttgggcactttttaa

SEQ ID NO: 934263 - DNA, 18 bp, Homo sapiens
cctccttgtgccttcttt

SEQ ID NO: 934264 - DNA, 12 bp, Homo sapiens
cctcctttccct

SEQ ID NO: 934265 - DNA, 14 bp, Homo sapiens
cctcctttccctta

SEQ ID NO: 934266 - DNA, 18 bp, Homo sapiens
cctcctttctgtgcccta

SEQ ID NO: 934267 - DNA, 22 bp, Homo sapiens
cctcctttctgtgccctactca

SEQ ID NO: 934268 - DNA, 16 bp, Homo sapiens
cctcctttgtaaacca

SEQ ID NO: 934269 - DNA, 21 bp, Homo sapiens
cctccttttacagaattagaa

SEQ ID NO: 934270 - DNA, 17 bp, Homo sapiens
cctccttttcttcaccc

SEQ ID NO: 934271 - DNA, 10 bp, Homo sapiens
cctccttttt

SEQ ID NO: 934272 - DNA, 20 bp, Homo sapiens
cctcgaaacacagaaacctt

SEQ ID NO: 934273 - DNA, 19 bp, Homo sapiens
cctcgaaccaaggcagcct

SEQ ID NO: 934274 - DNA, 22 bp, Homo sapiens
cctcgaattttatctgtggagt

SEQ ID NO: 934275 - DNA, 19 bp, Homo sapiens
cctcgacagggcctggagc

SEQ ID NO: 934276 - DNA, 14 bp, Homo sapiens
cctcgactcagcac

SEQ ID NO: 934277 - DNA, 16 bp, Homo sapiens
cctcgactcagcacca

SEQ ID NO: 934278 - DNA, 19 bp, Homo sapiens
cctcgacttgaccctttcc

SEQ ID NO: 934279 - DNA, 20 bp, Homo sapiens
cctcgacttgaccctttcct

SEQ ID NO: 934280 - DNA, 18 bp, Homo sapiens
cctcgaggaactccagga

SEQ ID NO: 934281 - DNA, 19 bp, Homo sapiens
cctcgaggaactccaggac

SEQ ID NO: 934282 - DNA, 12 bp, Homo sapiens
cctcgaggcacc

SEQ ID NO: 934283 - DNA, 23 bp, Homo sapiens
cctcgaggcaccggcgctgcagg

SEQ ID NO: 934284 - DNA, 24 bp, Homo sapiens
cctcgaggcctacagaggaggcct

SEQ ID NO: 934285 - DNA, 17 bp, Homo sapiens
cctcgagggccgcctgc

SEQ ID NO: 934286 - DNA, 16 bp, Homo sapiens
cctcgagtgcccctgt

SEQ ID NO: 934287 - DNA, 18 bp, Homo sapiens
atttacagaagaaaagca

SEQ ID NO: 934288 - DNA, 22 bp, Homo sapiens
atttacagaagaaaagcatgca

SEQ ID NO: 934289 - DNA, 16 bp, Homo sapiens
atttacagagaagtga

SEQ ID NO: 934290 - DNA, 19 bp, Homo sapiens
atttacagatgaatgtatt

SEQ ID NO: 934291 - DNA, 19 bp, Homo sapiens
atttacagctctgtaacct

SEQ ID NO: 934292 - DNA, 17 bp, Homo sapiens
atttacaggttcttagg

SEQ ID NO: 934293 - DNA, 22 bp, Homo sapiens
atttacagtctctttcttcctt

SEQ ID NO: 934294 - DNA, 15 bp, Homo sapiens
atttacataaagact

SEQ ID NO: 934295 - DNA, 21 bp, Homo sapiens
atttacatagtgcaaaactgt

SEQ ID NO: 934296 - DNA, 22 bp, Homo sapiens
atttacatagtgcaaaactgtg

SEQ ID NO: 934297 - DNA, 13 bp, Homo sapiens
atttacatcactt

SEQ ID NO: 934298 - DNA, 21 bp, Homo sapiens
atttacatcactttgtgaatt

SEQ ID NO: 934299 - DNA, 21 bp, Homo sapiens
atttacatgaattgcatttta

SEQ ID NO: 934300 - DNA, 16 bp, Homo sapiens
atttacattcaactct

SEQ ID NO: 934301 - DNA, 17 bp, Homo sapiens
atttaccacagcagctg

SEQ ID NO: 934302 - DNA, 21 bp, Homo sapiens
atttaccacagcagctgaaca

SEQ ID NO: 934303 - DNA, 16 bp, Homo sapiens
atttaccagcttaaga

SEQ ID NO: 934304 - DNA, 14 bp, Homo sapiens
atttaccctttggc

SEQ ID NO: 934305 - DNA, 20 bp, Homo sapiens
atttaccttttctgttgtac

SEQ ID NO: 934306 - DNA, 22 bp, Homo sapiens
atttactaagccacaagaaatt

SEQ ID NO: 934307 - DNA, 23 bp, Homo sapiens
atttactaagccacaagaaattt

SEQ ID NO: 934308 - DNA, 13 bp, Homo sapiens
atttactcattat

SEQ ID NO: 934309 - DNA, 17 bp, Homo sapiens
atttactctaaaaactg

SEQ ID NO: 934310 - DNA, 20 bp, Homo sapiens
atttactgagcttctctgtg

SEQ ID NO: 934311 - DNA, 19 bp, Homo sapiens
atttactgctctagaaagt

SEQ ID NO: 934312 - DNA, 21 bp, Homo sapiens
atttactgctctttattgcag

SEQ ID NO: 934313 - DNA, 18 bp, Homo sapiens
atttactgttagaattct

SEQ ID NO: 934314 - DNA, 13 bp, Homo sapiens
atttacttaagac

SEQ ID NO: 934315 - DNA, 14 bp, Homo sapiens
atttacttcagtat

SEQ ID NO: 934316 - DNA, 17 bp, Homo sapiens
atttacttcttatacat

SEQ ID NO: 934317 - DNA, 20 bp, Homo sapiens
atttacttcttatacatttg

SEQ ID NO: 934318 - DNA, 18 bp, Homo sapiens
atttactttcttcaccaa

SEQ ID NO: 934319 - DNA, 21 bp, Homo sapiens
atttacttttaccactattta

SEQ ID NO: 934320 - DNA, 13 bp, Homo sapiens
atttagaaaaaag

SEQ ID NO: 934321 - DNA, 20 bp, Homo sapiens
atttagaaaaagtcaatgta

SEQ ID NO: 934322 - DNA, 13 bp, Homo sapiens
atttagaaaactt

SEQ ID NO: 934323 - DNA, 14 bp, Homo sapiens
atttagaagaaaga

SEQ ID NO: 934324 - DNA, 17 bp, Homo sapiens
atttagaagcaaagatt

SEQ ID NO: 934325 - DNA, 20 bp, Homo sapiens
atttagaagcaaagatttca

SEQ ID NO: 934326 - DNA, 22 bp, Homo sapiens
atttagaatatgttaatgcaaa

SEQ ID NO: 934327 - DNA, 19 bp, Homo sapiens
atttagaccccatacaagt

SEQ ID NO: 934328 - DNA, 19 bp, Homo sapiens
atttagacttggattcttt

SEQ ID NO: 934329 - DNA, 17 bp, Homo sapiens
atttagagatgaattaa

SEQ ID NO: 934330 - DNA, 22 bp, Homo sapiens
atttagagatgaattaaattta

SEQ ID NO: 934331 - DNA, 22 bp, Homo sapiens
atttagagatgctgtaacttaa

SEQ ID NO: 934332 - DNA, 23 bp, Homo sapiens
atttagataatttgaaaaagttc

SEQ ID NO: 934333 - DNA, 14 bp, Homo sapiens
atttagcacaattt

SEQ ID NO: 934334 - DNA, 18 bp, Homo sapiens
atttagcgtagctaagtg

SEQ ID NO: 934335 - DNA, 22 bp, Homo sapiens
atttagctctgtggaattcagt

SEQ ID NO: 934336 - DNA, 19 bp, Homo sapiens
atttagctgtatcaaacta

SEQ ID NO: 934337 - DNA, 17 bp, Homo sapiens
atttagctttacatatt

SEQ ID NO: 934338 - DNA, 19 bp, Homo sapiens
atttagctttacatattcc

SEQ ID NO: 934339 - DNA, 17 bp, Homo sapiens
atttaggaaacaccatt

SEQ ID NO: 934340 - DNA, 14 bp, Homo sapiens
atttagggaagcag

SEQ ID NO: 934341 - DNA, 17 bp, Homo sapiens
atttagggaagcaggga

SEQ ID NO: 934342 - DNA, 22 bp, Homo sapiens
atttagggcagcaaaacaagtg

SEQ ID NO: 934343 - DNA, 19 bp, Homo sapiens
atttaggtttttattagta

SEQ ID NO: 934344 - DNA, 14 bp, Homo sapiens
atttagtaaatgtt

SEQ ID NO: 934345 - DNA, 10 bp, Homo sapiens
atttagtgtg

SEQ ID NO: 934346 - DNA, 13 bp, Homo sapiens
atttagttatagt

SEQ ID NO: 934347 - DNA, 16 bp, Homo sapiens
atttagttatagtttc

SEQ ID NO: 934348 - DNA, 13 bp, Homo sapiens
atttagttattga

SEQ ID NO: 934349 - DNA, 19 bp, Homo sapiens
atttagttgtggaaagata

SEQ ID NO: 934350 - DNA, 17 bp, Homo sapiens
atttagttttgtaactt

SEQ ID NO: 934351 - DNA, 14 bp, Homo sapiens
cctgagccccgccc

SEQ ID NO: 934352 - DNA, 20 bp, Homo sapiens
cctgagccccttccttgctc

SEQ ID NO: 934353 - DNA, 23 bp, Homo sapiens
cctgagccccttccttgctctgc

SEQ ID NO: 934354 - DNA, 20 bp, Homo sapiens
cctgagcccgcagcccagac

SEQ ID NO: 934355 - DNA, 20 bp, Homo sapiens
cctgagcccggccctccccc

SEQ ID NO: 934356 - DNA, 23 bp, Homo sapiens
cctgagcccggccctcccccagc

SEQ ID NO: 934357 - DNA, 21 bp, Homo sapiens
cctgagccctactccctgcag

SEQ ID NO: 934358 - DNA, 22 bp, Homo sapiens
cctgagccctactccctgcaga

SEQ ID NO: 934359 - DNA, 17 bp, Homo sapiens
cctgagcctgcattctg

SEQ ID NO: 934360 - DNA, 15 bp, Homo sapiens
cctgagcctgtgggt

SEQ ID NO: 934361 - DNA, 23 bp, Homo sapiens
cctgagcctgtgggtccccactc

SEQ ID NO: 934362 - DNA, 15 bp, Homo sapiens
cctgagcgctgtgga

SEQ ID NO: 934363 - DNA, 16 bp, Homo sapiens
cctgagcgctgtggac

SEQ ID NO: 934364 - DNA, 23 bp, Homo sapiens
cctgagcgctgtggactgtcctg

SEQ ID NO: 934365 - DNA, 24 bp, Homo sapiens
cctgagcgctgtggactgtcctga

SEQ ID NO: 934366 - DNA, 15 bp, Homo sapiens
cctgagcggcaccct

SEQ ID NO: 934367 - DNA, 13 bp, Homo sapiens
cctgagctcactc

SEQ ID NO: 934368 - DNA, 13 bp, Homo sapiens
cctgagctggcct

SEQ ID NO: 934369 - DNA, 15 bp, Homo sapiens
cctgagctggcctgt

SEQ ID NO: 934370 - DNA, 17 bp, Homo sapiens
cctgagctggggccaca

SEQ ID NO: 934371 - DNA, 17 bp, Homo sapiens
cctgagcttggccagaa

SEQ ID NO: 934372 - DNA, 14 bp, Homo sapiens
cctgagctttctgc

SEQ ID NO: 934373 - DNA, 16 bp, Homo sapiens
cctgagctttctgcta

SEQ ID NO: 934374 - DNA, 16 bp, Homo sapiens
cctgagctttggggac

SEQ ID NO: 934375 - DNA, 20 bp, Homo sapiens
cctgaggacagctgtcctct

SEQ ID NO: 934376 - DNA, 16 bp, Homo sapiens
cctgaggactggagac

SEQ ID NO: 934377 - DNA, 17 bp, Homo sapiens
cctgaggactggagacc

SEQ ID NO: 934378 - DNA, 13 bp, Homo sapiens
cctgaggagagga

SEQ ID NO: 934379 - DNA, 22 bp, Homo sapiens
cctgaggaggaggacacagcac

SEQ ID NO: 934380 - DNA, 23 bp, Homo sapiens
cctgaggaggaggacacagcaca

SEQ ID NO: 934381 - DNA, 19 bp, Homo sapiens
cctgaggatgggtcagagc

SEQ ID NO: 934382 - DNA, 13 bp, Homo sapiens
cctgaggcaggag

SEQ ID NO: 934383 - DNA, 22 bp, Homo sapiens
cctgaggccctcactgagcctc

SEQ ID NO: 934384 - DNA, 20 bp, Homo sapiens
cctgaggccctgggctgggt

SEQ ID NO: 934385 - DNA, 22 bp, Homo sapiens
cctgaggccctgggctgggtgc

SEQ ID NO: 934386 - DNA, 23 bp, Homo sapiens
cctgaggccctgggctgggtgct

SEQ ID NO: 934387 - DNA, 19 bp, Homo sapiens
cctgaggcctagactctgt

SEQ ID NO: 934388 - DNA, 20 bp, Homo sapiens
cctgaggcggaggctgtgct

SEQ ID NO: 934389 - DNA, 16 bp, Homo sapiens
cctgagggaggacctg

SEQ ID NO: 934390 - DNA, 18 bp, Homo sapiens
cctgagggaggacctggg

SEQ ID NO: 934391 - DNA, 21 bp, Homo sapiens
cctgagggaggacctggggca

SEQ ID NO: 934392 - DNA, 23 bp, Homo sapiens
cctgagggaggacctggggcaca

SEQ ID NO: 934393 - DNA, 18 bp, Homo sapiens
cctgagggcccctctgcc

SEQ ID NO: 934394 - DNA, 21 bp, Homo sapiens
cctgagggcccctctgcccag

SEQ ID NO: 934395 - DNA, 22 bp, Homo sapiens
cctgaggggcatctgcccctcc

SEQ ID NO: 934396 - DNA, 13 bp, Homo sapiens
cctgaggggctgg

SEQ ID NO: 934397 - DNA, 15 bp, Homo sapiens
cctgaggggctgggc

SEQ ID NO: 934398 - DNA, 18 bp, Homo sapiens
cctgaggggctggggagg

SEQ ID NO: 934399 - DNA, 19 bp, Homo sapiens
cctgagggtccccacctgg

SEQ ID NO: 934400 - DNA, 22 bp, Homo sapiens
cctgaggttaaacggtgcccat

SEQ ID NO: 934401 - DNA, 23 bp, Homo sapiens
cctgaggttaaacggtgcccatc

SEQ ID NO: 934402 - DNA, 23 bp, Homo sapiens
cctgagtaatcgcttaaagatgt

SEQ ID NO: 934403 - DNA, 22 bp, Homo sapiens
cctgagtcaactggagcaagaa

SEQ ID NO: 934404 - DNA, 15 bp, Homo sapiens
cctgagtcagtgctc

SEQ ID NO: 934405 - DNA, 18 bp, Homo sapiens
cctgagtccgcctgcgcc

SEQ ID NO: 934406 - DNA, 20 bp, Homo sapiens
cctgagtccgcctgcgcctc

SEQ ID NO: 934407 - DNA, 18 bp, Homo sapiens
cctgagtcggccccacat

SEQ ID NO: 934408 - DNA, 21 bp, Homo sapiens
cctgagtcgtacagaaagctg

SEQ ID NO: 934409 - DNA, 22 bp, Homo sapiens
cctgagtcgtacagaaagctgc

SEQ ID NO: 934410 - DNA, 14 bp, Homo sapiens
cctgagtctcctgt

SEQ ID NO: 934411 - DNA, 12 bp, Homo sapiens
cctgagtctgga

SEQ ID NO: 934412 - DNA, 19 bp, Homo sapiens
cctgagtgagtgtgtgtgc

SEQ ID NO: 934413 - DNA, 14 bp, Homo sapiens
cctgagtggggcca

SEQ ID NO: 934414 - DNA, 18 bp, Homo sapiens
cctgagttgggcagccag

SEQ ID NO: 934415 - DNA, 20 bp, Homo sapiens
cctgagttgggcagccagga

SEQ ID NO: 934416 - DNA, 16 bp, Homo sapiens
cctgagttttacccag

SEQ ID NO: 934417 - DNA, 23 bp, Homo sapiens
cctgataaacattaaacactgta

SEQ ID NO: 934418 - DNA, 13 bp, Homo sapiens
cctgatagaagat

SEQ ID NO: 934419 - DNA, 13 bp, Homo sapiens
cctgatcagagcc

SEQ ID NO: 934420 - DNA, 21 bp, Homo sapiens
cctgatcccaccccctcctcc

SEQ ID NO: 934421 - DNA, 15 bp, Homo sapiens
cctgatccctccacc

SEQ ID NO: 934422 - DNA, 13 bp, Homo sapiens
cctgatccctgaa

SEQ ID NO: 934423 - DNA, 23 bp, Homo sapiens
cctgatcgccaacctttccccca

SEQ ID NO: 934424 - DNA, 14 bp, Homo sapiens
cctgatctagcact

SEQ ID NO: 934425 - DNA, 18 bp, Homo sapiens
cctgatctctcagcccca

SEQ ID NO: 934426 - DNA, 15 bp, Homo sapiens
cctgatctctgacct

SEQ ID NO: 934427 - DNA, 17 bp, Homo sapiens
cctgatctctgacctct

SEQ ID NO: 934428 - DNA, 19 bp, Homo sapiens
cctgatctctgacctctgc

SEQ ID NO: 934429 - DNA, 21 bp, Homo sapiens
cctgatctctgacctctgctg

SEQ ID NO: 934430 - DNA, 23 bp, Homo sapiens
cctgatctctgacctctgctgag

SEQ ID NO: 934431 - DNA, 14 bp, Homo sapiens
cctgatctcttcct

SEQ ID NO: 934432 - DNA, 16 bp, Homo sapiens
cctgatcttgcctgtc

SEQ ID NO: 934433 - DNA, 18 bp, Homo sapiens
cctgatgagactccactc

SEQ ID NO: 934434 - DNA, 17 bp, Homo sapiens
cctgatgagatttttaa

SEQ ID NO: 934435 - DNA, 15 bp, Homo sapiens
cctgatgcagcctgt

SEQ ID NO: 934436 - DNA, 18 bp, Homo sapiens
cctgatgcagcctgtggc

SEQ ID NO: 934437 - DNA, 19 bp, Homo sapiens
cctgatgcagcctgtggct

SEQ ID NO: 934438 - DNA, 10 bp, Homo sapiens
agtccctccc

SEQ ID NO: 934439 - DNA, 17 bp, Homo sapiens
agtccctccctgcctga

SEQ ID NO: 934440 - DNA, 18 bp, Homo sapiens
agtccctccctgcctgag

SEQ ID NO: 934441 - DNA, 21 bp, Homo sapiens
agtccctgccacactcagtcc

SEQ ID NO: 934442 - DNA, 14 bp, Homo sapiens
agtccctgggggaa

SEQ ID NO: 934443 - DNA, 18 bp, Homo sapiens
agtccctgtaattgttgt

SEQ ID NO: 934444 - DNA, 20 bp, Homo sapiens
agtccctgtaattgttgttt

SEQ ID NO: 934445 - DNA, 23 bp, Homo sapiens
agtccctgtaattgttgtttgta

SEQ ID NO: 934446 - DNA, 17 bp, Homo sapiens
agtccctgttttctgag

SEQ ID NO: 934447 - DNA, 18 bp, Homo sapiens
agtccctgttttctgagc

SEQ ID NO: 934448 - DNA, 19 bp, Homo sapiens
agtccctgttttctgagcc

SEQ ID NO: 934449 - DNA, 20 bp, Homo sapiens
agtccctgttttctgagccc

SEQ ID NO: 934450 - DNA, 21 bp, Homo sapiens
agtccctgttttctgagcccg

SEQ ID NO: 934451 - DNA, 23 bp, Homo sapiens
agtcccttaatcttatggggccg

SEQ ID NO: 934452 - DNA, 13 bp, Homo sapiens
agtcccttcccct

SEQ ID NO: 934453 - DNA, 15 bp, Homo sapiens
agtcccttcccctcc

SEQ ID NO: 934454 - DNA, 23 bp, Homo sapiens
agtcccttcccctccctggctcc

SEQ ID NO: 934455 - DNA, 14 bp, Homo sapiens
agtcccttcctatt

SEQ ID NO: 934456 - DNA, 18 bp, Homo sapiens
agtcccttcctgcttcct

SEQ ID NO: 934457 - DNA, 19 bp, Homo sapiens
agtcccttgagactcccca

SEQ ID NO: 934458 - DNA, 17 bp, Homo sapiens
agtccgcagaagccctg

SEQ ID NO: 934459 - DNA, 14 bp, Homo sapiens
agtccgccagtgtt

SEQ ID NO: 934460 - DNA, 20 bp, Homo sapiens
agtccgcccatccctgacca

SEQ ID NO: 934461 - DNA, 16 bp, Homo sapiens
agtccggatttctaac

SEQ ID NO: 934462 - DNA, 22 bp, Homo sapiens
agtccgtgctgacagctgctcc

SEQ ID NO: 934463 - DNA, 23 bp, Homo sapiens
agtccgtgctgacagctgctcct

SEQ ID NO: 934464 - DNA, 16 bp, Homo sapiens
agtcctagaatgtttc

SEQ ID NO: 934465 - DNA, 17 bp, Homo sapiens
agtcctagctgacgcca

SEQ ID NO: 934466 - DNA, 19 bp, Homo sapiens
agtcctatggaaaaaacca

SEQ ID NO: 934467 - DNA, 19 bp, Homo sapiens
agtcctatgtacagagctt

SEQ ID NO: 934468 - DNA, 22 bp, Homo sapiens
agtcctatgtacagagctttct

SEQ ID NO: 934469 - DNA, 17 bp, Homo sapiens
agtcctcactcccagtc

SEQ ID NO: 934470 - DNA, 17 bp, Homo sapiens
agtcctcataaaaagca

SEQ ID NO: 934471 - DNA, 14 bp, Homo sapiens
agtcctccatccac

SEQ ID NO: 934472 - DNA, 17 bp, Homo sapiens
agtcctccctgactttt

SEQ ID NO: 934473 - DNA, 13 bp, Homo sapiens
agtcctcctggga

SEQ ID NO: 934474 - DNA, 17 bp, Homo sapiens
agtcctctagcaggcct

SEQ ID NO: 934475 - DNA, 12 bp, Homo sapiens
agtcctctccag

SEQ ID NO: 934476 - DNA, 20 bp, Homo sapiens
agtcctctcccaagtccaca

SEQ ID NO: 934477 - DNA, 12 bp, Homo sapiens
agtcctctgaat

SEQ ID NO: 934478 - DNA, 15 bp, Homo sapiens
agtcctctgctccag

SEQ ID NO: 934479 - DNA, 16 bp, Homo sapiens
agtcctctgctccagc

SEQ ID NO: 934480 - DNA, 19 bp, Homo sapiens
agtcctctgctccagcaac

SEQ ID NO: 934481 - DNA, 12 bp, Homo sapiens
agtcctgaagag

SEQ ID NO: 934482 - DNA, 14 bp, Homo sapiens
agtcctgaaggaca

SEQ ID NO: 934483 - DNA, 20 bp, Homo sapiens
agtcctgcacagttttctgg

SEQ ID NO: 934484 - DNA, 17 bp, Homo sapiens
agtcctgcagaggattt

SEQ ID NO: 934485 - DNA, 14 bp, Homo sapiens
agtcctgcctggcc

SEQ ID NO: 934486 - DNA, 21 bp, Homo sapiens
agtcctgctacctcccttgcc

SEQ ID NO: 934487 - DNA, 22 bp, Homo sapiens
agtcctgctggatcttgcctaa

SEQ ID NO: 934488 - DNA, 13 bp, Homo sapiens
agtcctgctttcc

SEQ ID NO: 934489 - DNA, 16 bp, Homo sapiens
agtcctgctttcctat

SEQ ID NO: 934490 - DNA, 19 bp, Homo sapiens
agtcctgctttcctatcta

SEQ ID NO: 934491 - DNA, 17 bp, Homo sapiens
agtcctggatgatacta

SEQ ID NO: 934492 - DNA, 14 bp, Homo sapiens
agtcctgggaggat

SEQ ID NO: 934493 - DNA, 13 bp, Homo sapiens
agtcctgggaggt

SEQ ID NO: 934494 - DNA, 17 bp, Homo sapiens
agtcctggtcctggctg

SEQ ID NO: 934495 - DNA, 19 bp, Homo sapiens
agtcctggtcctggctgca

SEQ ID NO: 934496 - DNA, 16 bp, Homo sapiens
agtcctgtcactgagc

SEQ ID NO: 934497 - DNA, 13 bp, Homo sapiens
agtcctgtgaatg

SEQ ID NO: 934498 - DNA, 19 bp, Homo sapiens
agtcctgtgaatgccactg

SEQ ID NO: 934499 - DNA, 14 bp, Homo sapiens
agtcctgtgaattt

SEQ ID NO: 934500 - DNA, 16 bp, Homo sapiens
agtcctgttgaagact

SEQ ID NO: 934501 - DNA, 19 bp, Homo sapiens
agtcctgttgaagacttcc

SEQ ID NO: 934502 - DNA, 15 bp, Homo sapiens
agtccttacctcttc

SEQ ID NO: 934503 - DNA, 21 bp, Homo sapiens
agtccttacctcttccggaga

SEQ ID NO: 934504 - DNA, 19 bp, Homo sapiens
agtccttattatcccagct

SEQ ID NO: 934505 - DNA, 17 bp, Homo sapiens
agtccttcacctcactg

SEQ ID NO: 934506 - DNA, 19 bp, Homo sapiens
agtccttcagtgagcccct

SEQ ID NO: 934507 - DNA, 22 bp, Homo sapiens
agtccttcagtgagcccctccc

SEQ ID NO: 934508 - DNA, 11 bp, Homo sapiens
agtccttccac

SEQ ID NO: 934509 - DNA, 15 bp, Homo sapiens
agtccttcctggcat

SEQ ID NO: 934510 - DNA, 16 bp, Homo sapiens
agtccttcctggcatc

SEQ ID NO: 934511 - DNA, 14 bp, Homo sapiens
agtccttgaaaata

SEQ ID NO: 934512 - DNA, 22 bp, Homo sapiens
agtccttgaaaatattttttat

SEQ ID NO: 934513 - DNA, 19 bp, Homo sapiens
agtccttgcgtcccatgag

SEQ ID NO: 934514 - DNA, 13 bp, Homo sapiens
agtcctttttcca

SEQ ID NO: 934515 - DNA, 19 bp, Homo sapiens
agtcgagacctcacacacg

SEQ ID NO: 934516 - DNA, 17 bp, Homo sapiens
agtcgagagggctgttg

SEQ ID NO: 934517 - DNA, 19 bp, Homo sapiens
agtcgatagagctgtatta

SEQ ID NO: 934518 - DNA, 15 bp, Homo sapiens
agtcgctcagtctgt

SEQ ID NO: 934519 - DNA, 16 bp, Homo sapiens
agtcggagtggacacc

SEQ ID NO: 934520 - DNA, 21 bp, Homo sapiens
agtcgggggctggcctaggag

SEQ ID NO: 934521 - DNA, 17 bp, Homo sapiens
agtcgggtgccaggaca

SEQ ID NO: 934522 - DNA, 22 bp, Homo sapiens
agtcgtcatcacttttcagtga

SEQ ID NO: 934523 - DNA, 17 bp, Homo sapiens
agtcgtgatgtggagga

SEQ ID NO: 934524 - DNA, 17 bp, Homo sapiens
agtcgtggggtgtgctg

SEQ ID NO: 934525 - DNA, 19 bp, Homo sapiens
agtcgtggggtgtgctggg

SEQ ID NO: 934526 - DNA, 22 bp, Homo sapiens
agtcgttatttctgtttgttta

SEQ ID NO: 934527 - DNA, 19 bp, Homo sapiens
agtctaaaccaagattatg

SEQ ID NO: 934528 - DNA, 16 bp, Homo sapiens
agtctaaactgagctc

SEQ ID NO: 934529 - DNA, 20 bp, Homo sapiens
agtctaaactgttaaacaac

SEQ ID NO: 934530 - DNA, 18 bp, Homo sapiens
agtctaacgctgaactga

SEQ ID NO: 934531 - DNA, 18 bp, Homo sapiens
agtctaatctctaaatca

SEQ ID NO: 934532 - DNA, 17 bp, Homo sapiens
agtctacccgacataag

SEQ ID NO: 934533 - DNA, 19 bp, Homo sapiens
agtctaccctgtcctttgc

SEQ ID NO: 934534 - DNA, 17 bp, Homo sapiens
agtctagatggctcctc

SEQ ID NO: 934535 - DNA, 19 bp, Homo sapiens
agtctagatggctcctctc

SEQ ID NO: 934536 - DNA, 20 bp, Homo sapiens
agtctagatggctcctctca

SEQ ID NO: 934537 - DNA, 22 bp, Homo sapiens
agtctaggagctgggaggaaaa

SEQ ID NO: 934538 - DNA, 18 bp, Homo sapiens
agtctagggcacaaagac

SEQ ID NO: 934539 - DNA, 20 bp, Homo sapiens
agtctaggttggtagagttt

SEQ ID NO: 934540 - DNA, 18 bp, Homo sapiens
agtctatatgaaaaacaa

SEQ ID NO: 934541 - DNA, 19 bp, Homo sapiens
agtctatatggttctccaa

SEQ ID NO: 934542 - DNA, 21 bp, Homo sapiens
agtctatatggttctccaaga

SEQ ID NO: 934543 - DNA, 22 bp, Homo sapiens
agtctatatggttctccaagaa

SEQ ID NO: 934544 - DNA, 23 bp, Homo sapiens
agtctatcaaccccagacactgg

SEQ ID NO: 934545 - DNA, 12 bp, Homo sapiens
agtctatgctta

SEQ ID NO: 934546 - DNA, 16 bp, Homo sapiens
agtctatgttcaaaga

SEQ ID NO: 934547 - DNA, 21 bp, Homo sapiens
agtctatttccactgaacaaa

SEQ ID NO: 934548 - DNA, 23 bp, Homo sapiens
agtctatttccactgaacaaaac

SEQ ID NO: 934549 - DNA, 17 bp, Homo sapiens
agtctcaacatgtgttt

SEQ ID NO: 934550 - DNA, 18 bp, Homo sapiens
agtctcaacatgtgtttc

SEQ ID NO: 934551 - DNA, 19 bp, Homo sapiens
agtctcaagggtggcaggt

SEQ ID NO: 934552 - DNA, 14 bp, Homo sapiens
agtctcagagacca

SEQ ID NO: 934553 - DNA, 16 bp, Homo sapiens
agtctcagagaccagc

SEQ ID NO: 934554 - DNA, 23 bp, Homo sapiens
agtctcagagaccagcactcagc

SEQ ID NO: 934555 - DNA, 14 bp, Homo sapiens
agtctcaggaggag

SEQ ID NO: 934556 - DNA, 15 bp, Homo sapiens
agtctcaggaggagg

SEQ ID NO: 934557 - DNA, 20 bp, Homo sapiens
agtctcagtttgtgtgtctt

SEQ ID NO: 934558 - DNA, 13 bp, Homo sapiens
agtctcatctcct

SEQ ID NO: 934559 - DNA, 21 bp, Homo sapiens
agtctcatctcctgaccctcc

SEQ ID NO: 934560 - DNA, 21 bp, Homo sapiens
agtctcattcgcctttgtctt

SEQ ID NO: 934561 - DNA, 20 bp, Homo sapiens
agtctccacctgagaccctg

SEQ ID NO: 934562 - DNA, 13 bp, Homo sapiens
ctaacttctgtaa

SEQ ID NO: 934563 - DNA, 13 bp, Homo sapiens
ctaactttccttc

SEQ ID NO: 934564 - DNA, 14 bp, Homo sapiens
ctaagaaaatagca

SEQ ID NO: 934565 - DNA, 21 bp, Homo sapiens
ctaagaaagaggagtgcttgt

SEQ ID NO: 934566 - DNA, 20 bp, Homo sapiens
ctaagaaatatctgtgaaat

SEQ ID NO: 934567 - DNA, 22 bp, Homo sapiens
ctaagaaatatctgtgaaatat

SEQ ID NO: 934568 - DNA, 16 bp, Homo sapiens
ctaagaaatgctgaaa

SEQ ID NO: 934569 - DNA, 17 bp, Homo sapiens
ctaagaacccatggaaa

SEQ ID NO: 934570 - DNA, 14 bp, Homo sapiens
ctaagaacccctct

SEQ ID NO: 934571 - DNA, 16 bp, Homo sapiens
ctaagaagacattttg

SEQ ID NO: 934572 - DNA, 17 bp, Homo sapiens
ctaagaagacattttgt

SEQ ID NO: 934573 - DNA, 16 bp, Homo sapiens
ctaagaagttactttt

SEQ ID NO: 934574 - DNA, 19 bp, Homo sapiens
ctaagaataacaagaagcc

SEQ ID NO: 934575 - DNA, 17 bp, Homo sapiens
ctaagaattcaaactgg

SEQ ID NO: 934576 - DNA, 21 bp, Homo sapiens
ctaagaattttgttttacttt

SEQ ID NO: 934577 - DNA, 18 bp, Homo sapiens
ctaagaatttttttttaa

SEQ ID NO: 934578 - DNA, 22 bp, Homo sapiens
ctaagacacaaatgcatgaaca

SEQ ID NO: 934579 - DNA, 21 bp, Homo sapiens
ctaagacacctgaaccctcca

SEQ ID NO: 934580 - DNA, 22 bp, Homo sapiens
ctaagacatgtgaggaggaaaa

SEQ ID NO: 934581 - DNA, 15 bp, Homo sapiens
ctaagactcccgccc

SEQ ID NO: 934582 - DNA, 13 bp, Homo sapiens
ctaagactgcctt

SEQ ID NO: 934583 - DNA, 11 bp, Homo sapiens
ctaagagaagt

SEQ ID NO: 934584 - DNA, 19 bp, Homo sapiens
ctaagagaagtagaaatca

SEQ ID NO: 934585 - DNA, 12 bp, Homo sapiens
ctaagagattta

SEQ ID NO: 934586 - DNA, 17 bp, Homo sapiens
ctaagagatttatcttt

SEQ ID NO: 934587 - DNA, 11 bp, Homo sapiens
ctaagagccat

SEQ ID NO: 934588 - DNA, 18 bp, Homo sapiens
ctaagagctagcgctgcc

SEQ ID NO: 934589 - DNA, 19 bp, Homo sapiens
ctaagaggatacaaattta

SEQ ID NO: 934590 - DNA, 16 bp, Homo sapiens
ctaagagtggaggagg

SEQ ID NO: 934591 - DNA, 17 bp, Homo sapiens
ctaagagtggaggagga

SEQ ID NO: 934592 - DNA, 23 bp, Homo sapiens
ctaagatacactgcactttgttt

SEQ ID NO: 934593 - DNA, 24 bp, Homo sapiens
ctaagatgagatttgccagcacag

SEQ ID NO: 934594 - DNA, 20 bp, Homo sapiens
ctaagatgtgttcttatttt

SEQ ID NO: 934595 - DNA, 23 bp, Homo sapiens
ctaagattacaaatcagaagtca

SEQ ID NO: 934596 - DNA, 14 bp, Homo sapiens
ctaagattctttta

SEQ ID NO: 934597 - DNA, 21 bp, Homo sapiens
ctaagattcttttaaattaga

SEQ ID NO: 934598 - DNA, 23 bp, Homo sapiens
ctaagcaaaaagaacaaagctgg

SEQ ID NO: 934599 - DNA, 16 bp, Homo sapiens
ctaagcaactaggcct

SEQ ID NO: 934600 - DNA, 13 bp, Homo sapiens
ctaagcacttcta

SEQ ID NO: 934601 - DNA, 16 bp, Homo sapiens
ctaagcacttctagaa

SEQ ID NO: 934602 - DNA, 19 bp, Homo sapiens
ctaagcagaggaggggccg

SEQ ID NO: 934603 - DNA, 13 bp, Homo sapiens
ctaagcagccagg

SEQ ID NO: 934604 - DNA, 20 bp, Homo sapiens
ctaagccactcttccaaagg

SEQ ID NO: 934605 - DNA, 13 bp, Homo sapiens
ctaagccaggcct

SEQ ID NO: 934606 - DNA, 19 bp, Homo sapiens
cacagtgttgcccaggctg

SEQ ID NO: 934607 - DNA, 15 bp, Homo sapiens
cacagtgttgtgccc

SEQ ID NO: 934608 - DNA, 17 bp, Homo sapiens
cacagtgttgtgcccct

SEQ ID NO: 934609 - DNA, 13 bp, Homo sapiens
cacagtgtttcaa

SEQ ID NO: 934610 - DNA, 19 bp, Homo sapiens
cacagtgttttataggaga

SEQ ID NO: 934611 - DNA, 22 bp, Homo sapiens
cacagtgtttttattgctcgcc

SEQ ID NO: 934612 - DNA, 22 bp, Homo sapiens
cacagttaaataaatagaaaga

SEQ ID NO: 934613 - DNA, 16 bp, Homo sapiens
cacagttcctcgccct

SEQ ID NO: 934614 - DNA, 19 bp, Homo sapiens
cacagttcctcgccctggg

SEQ ID NO: 934615 - DNA, 23 bp, Homo sapiens
cacagttgaagggaggggctgtg

SEQ ID NO: 934616 - DNA, 17 bp, Homo sapiens
cacagttgccaccacct

SEQ ID NO: 934617 - DNA, 18 bp, Homo sapiens
cacagttgggacccaaaa

SEQ ID NO: 934618 - DNA, 20 bp, Homo sapiens
cacagttgtctattctgagc

SEQ ID NO: 934619 - DNA, 21 bp, Homo sapiens
cacagttgtctattctgagcc

SEQ ID NO: 934620 - DNA, 22 bp, Homo sapiens
cacagttgtctattctgagcct

SEQ ID NO: 934621 - DNA, 16 bp, Homo sapiens
cacagtttcaggcttt

SEQ ID NO: 934622 - DNA, 21 bp, Homo sapiens
cacagtttcaggcttttatga

SEQ ID NO: 934623 - DNA, 13 bp, Homo sapiens
cacagttttaata

SEQ ID NO: 934624 - DNA, 21 bp, Homo sapiens
cacagttttctggctggagcc

SEQ ID NO: 934625 - DNA, 15 bp, Homo sapiens
cacagttttgaaaga

SEQ ID NO: 934626 - DNA, 17 bp, Homo sapiens
cacagttttgaaagaaa

SEQ ID NO: 934627 - DNA, 21 bp, Homo sapiens
cacagttttgaaagaaaaata

SEQ ID NO: 934628 - DNA, 23 bp, Homo sapiens
cacagtttttggttcctcttttc

SEQ ID NO: 934629 - DNA, 13 bp, Homo sapiens
cacataactggat

SEQ ID NO: 934630 - DNA, 14 bp, Homo sapiens
cacataagaaggca

SEQ ID NO: 934631 - DNA, 21 bp, Homo sapiens
cacataagccaaaactgagca

SEQ ID NO: 934632 - DNA, 22 bp, Homo sapiens
cacataagccaaaactgagcat

SEQ ID NO: 934633 - DNA, 15 bp, Homo sapiens
cacatacaaaagaat

SEQ ID NO: 934634 - DNA, 12 bp, Homo sapiens
cacatacagaaa

SEQ ID NO: 934635 - DNA, 21 bp, Homo sapiens
cacatacagaaagaagcagtt

SEQ ID NO: 934636 - DNA, 12 bp, Homo sapiens
cacatacataca

SEQ ID NO: 934637 - DNA, 22 bp, Homo sapiens
cacatacccacacattccaggg

SEQ ID NO: 934638 - DNA, 20 bp, Homo sapiens
cacatacgtgttaggaggct

SEQ ID NO: 934639 - DNA, 18 bp, Homo sapiens
cacatactcatttttcat

SEQ ID NO: 934640 - DNA, 19 bp, Homo sapiens
cacatactcatttttcatg

SEQ ID NO: 934641 - DNA, 18 bp, Homo sapiens
cacatagagctttttaat

SEQ ID NO: 934642 - DNA, 13 bp, Homo sapiens
cacatagatttct

SEQ ID NO: 934643 - DNA, 23 bp, Homo sapiens
cacatagcatgcttcctttctct

SEQ ID NO: 934644 - DNA, 12 bp, Homo sapiens
cacatagcatgt

SEQ ID NO: 934645 - DNA, 20 bp, Homo sapiens
cacatagcccacttacattt

SEQ ID NO: 934646 - DNA, 18 bp, Homo sapiens
cacatagcgccgtgctgt

SEQ ID NO: 934647 - DNA, 19 bp, Homo sapiens
cacatagcgccgtgctgta

SEQ ID NO: 934648 - DNA, 23 bp, Homo sapiens
cacataggctggtggccttgggc

SEQ ID NO: 934649 - DNA, 21 bp, Homo sapiens
cacatagtgatggttcccctg

SEQ ID NO: 934650 - DNA, 18 bp, Homo sapiens
cacatagtgtcctgccca

SEQ ID NO: 934651 - DNA, 22 bp, Homo sapiens
cacatagttctgcccaaattat

SEQ ID NO: 934652 - DNA, 16 bp, Homo sapiens
cacatagtttttcagt

SEQ ID NO: 934653 - DNA, 15 bp, Homo sapiens
cacatataacactta

SEQ ID NO: 934654 - DNA, 12 bp, Homo sapiens
cacatatacata

SEQ ID NO: 934655 - DNA, 17 bp, Homo sapiens
cacatatacatatatat

SEQ ID NO: 934656 - DNA, 18 bp, Homo sapiens
cacatatacatatatata

SEQ ID NO: 934657 - DNA, 19 bp, Homo sapiens
cacatatcaaatgcttgct

SEQ ID NO: 934658 - DNA, 15 bp, Homo sapiens
cacatatccaggcac

SEQ ID NO: 934659 - DNA, 13 bp, Homo sapiens
cacatattgattt

SEQ ID NO: 934660 - DNA, 20 bp, Homo sapiens
cacatattgatttccgttaa

SEQ ID NO: 934661 - DNA, 17 bp, Homo sapiens
cacatatttcagtgagg

SEQ ID NO: 934662 - DNA, 15 bp, Homo sapiens
cacatatttgatagt

SEQ ID NO: 934663 - DNA, 17 bp, Homo sapiens
cacatattttaaaattt

SEQ ID NO: 934664 - DNA, 17 bp, Homo sapiens
cacatcaattaattgat

SEQ ID NO: 934665 - DNA, 13 bp, Homo sapiens
cacatcacctctt

SEQ ID NO: 934666 - DNA, 18 bp, Homo sapiens
cacatcacctctttgccc

SEQ ID NO: 934667 - DNA, 20 bp, Homo sapiens
cacatcagcaatttcagaac

SEQ ID NO: 934668 - DNA, 20 bp, Homo sapiens
cacatcagcacgatttctgt

SEQ ID NO: 934669 - DNA, 19 bp, Homo sapiens
cacatcatattctattgtt

SEQ ID NO: 934670 - DNA, 16 bp, Homo sapiens
cacatccaactccagc

SEQ ID NO: 934671 - DNA, 21 bp, Homo sapiens
cacatccacacacgcaggaac

SEQ ID NO: 934672 - DNA, 19 bp, Homo sapiens
cacatccagctgcccctcc

SEQ ID NO: 934673 - DNA, 12 bp, Homo sapiens
cacatccatcta

SEQ ID NO: 934674 - DNA, 17 bp, Homo sapiens
cacatccatctgaggct

SEQ ID NO: 934675 - DNA, 21 bp, Homo sapiens
cacatccatttcatctatttc

SEQ ID NO: 934676 - DNA, 13 bp, Homo sapiens
cacatcccactgg

SEQ ID NO: 934677 - DNA, 17 bp, Homo sapiens
cacatcccagcagccca

SEQ ID NO: 934678 - DNA, 12 bp, Homo sapiens
cacatcccaggc

SEQ ID NO: 934679 - DNA, 15 bp, Homo sapiens
cacatcccggcctct

SEQ ID NO: 934680 - DNA, 21 bp, Homo sapiens
cacatcccggcctcttccacc

SEQ ID NO: 934681 - DNA, 18 bp, Homo sapiens
cacatcctccgtccagcc

SEQ ID NO: 934682 - DNA, 12 bp, Homo sapiens
cacatcctcctg

SEQ ID NO: 934683 - DNA, 22 bp, Homo sapiens
cacatcctgggatccagtgtat

SEQ ID NO: 934684 - DNA, 13 bp, Homo sapiens
ctaataaactgta

SEQ ID NO: 934685 - DNA, 15 bp, Homo sapiens
ctaataaactgtatt

SEQ ID NO: 934686 - DNA, 20 bp, Homo sapiens
ctaataaactgtattaaatc

SEQ ID NO: 934687 - DNA, 13 bp, Homo sapiens
ctaataaataatc

SEQ ID NO: 934688 - DNA, 15 bp, Homo sapiens
ctaataaatacatac

SEQ ID NO: 934689 - DNA, 23 bp, Homo sapiens
ctaataaggcatgcgaaatgttc

SEQ ID NO: 934690 - DNA, 15 bp, Homo sapiens
ctaataataaatagt

SEQ ID NO: 934691 - DNA, 20 bp, Homo sapiens
ctaataataaatagttcttc

SEQ ID NO: 934692 - DNA, 20 bp, Homo sapiens
ctaatacctcttactttgct

SEQ ID NO: 934693 - DNA, 19 bp, Homo sapiens
ctaatacgtgccagatata

SEQ ID NO: 934694 - DNA, 22 bp, Homo sapiens
ctaatacgtgccagatataact

SEQ ID NO: 934695 - DNA, 23 bp, Homo sapiens
ctaatagaataaaggcagttttc

SEQ ID NO: 934696 - DNA, 20 bp, Homo sapiens
ctaatagactaaatgaaatc

SEQ ID NO: 934697 - DNA, 18 bp, Homo sapiens
ctaatagaggcagtgaga

SEQ ID NO: 934698 - DNA, 13 bp, Homo sapiens
ctaatagctgcta

SEQ ID NO: 934699 - DNA, 13 bp, Homo sapiens
ctaatatatatga

SEQ ID NO: 934700 - DNA, 15 bp, Homo sapiens
ctaatatatatgaat

SEQ ID NO: 934701 - DNA, 16 bp, Homo sapiens
ctaatatatttaaaaa

SEQ ID NO: 934702 - DNA, 23 bp, Homo sapiens
ctaatatcaaatgcagtatattt

SEQ ID NO: 934703 - DNA, 14 bp, Homo sapiens
ctaatattaaaaat

SEQ ID NO: 934704 - DNA, 18 bp, Homo sapiens
ctaatattaaaaatatgg

SEQ ID NO: 934705 - DNA, 13 bp, Homo sapiens
ctaatcaaagcca

SEQ ID NO: 934706 - DNA, 15 bp, Homo sapiens
ctaatcaccatgtaa

SEQ ID NO: 934707 - DNA, 23 bp, Homo sapiens
ctaatcagatgatggccatttct

SEQ ID NO: 934708 - DNA, 19 bp, Homo sapiens
ctaatcagcattctcactc

SEQ ID NO: 934709 - DNA, 15 bp, Homo sapiens
ctaatcatgagaaaa

SEQ ID NO: 934710 - DNA, 20 bp, Homo sapiens
ctaatccctgggcattgctt

SEQ ID NO: 934711 - DNA, 21 bp, Homo sapiens
ctaatccctgggcattgcttt

SEQ ID NO: 934712 - DNA, 17 bp, Homo sapiens
ctaatcctatctgggga

SEQ ID NO: 934713 - DNA, 15 bp, Homo sapiens
ctaatcgaactatga

SEQ ID NO: 934714 - DNA, 15 bp, Homo sapiens
ctaatctagtgacac

SEQ ID NO: 934715 - DNA, 21 bp, Homo sapiens
ctaatctattgggttcattat

SEQ ID NO: 934716 - DNA, 14 bp, Homo sapiens
ctaatctgaactga

SEQ ID NO: 934717 - DNA, 13 bp, Homo sapiens
ctaatctgtaggg

SEQ ID NO: 934718 - DNA, 18 bp, Homo sapiens
ctaatctgtagggctgga

SEQ ID NO: 934719 - DNA, 21 bp, Homo sapiens
ctaatctgtagggctggacct

SEQ ID NO: 934720 - DNA, 19 bp, Homo sapiens
ctaatctttcacttgaaag

SEQ ID NO: 934721 - DNA, 21 bp, Homo sapiens
ctaatgaaaaacaaaaagcta

SEQ ID NO: 934722 - DNA, 21 bp, Homo sapiens
ctaatgaacaaatatgctttg

SEQ ID NO: 934723 - DNA, 17 bp, Homo sapiens
ctaatgagcatttcctt

SEQ ID NO: 934724 - DNA, 14 bp, Homo sapiens
ctaatgagctagtg

SEQ ID NO: 934725 - DNA, 18 bp, Homo sapiens
ctaatgaggagagaaaat

SEQ ID NO: 934726 - DNA, 19 bp, Homo sapiens
ctaatgaggagagaaaata

SEQ ID NO: 934727 - DNA, 20 bp, Homo sapiens
ctaatgaggagagaaaatat

SEQ ID NO: 934728 - DNA, 21 bp, Homo sapiens
ctaatgagggaaatctgtaaa

SEQ ID NO: 934729 - DNA, 21 bp, Homo sapiens
ctaatgcagccacgattggag

SEQ ID NO: 934730 - DNA, 22 bp, Homo sapiens
ctaatgctaagaaatgctgaaa

SEQ ID NO: 934731 - DNA, 19 bp, Homo sapiens
ctaatgctcacctttatca

SEQ ID NO: 934732 - DNA, 12 bp, Homo sapiens
ctaatgctggcc

SEQ ID NO: 934733 - DNA, 13 bp, Homo sapiens
ctaatgctggcct

SEQ ID NO: 934734 - DNA, 16 bp, Homo sapiens
ctaatgtactgcatat

SEQ ID NO: 934735 - DNA, 13 bp, Homo sapiens
ctaatgtactgta

SEQ ID NO: 934736 - DNA, 20 bp, Homo sapiens
caccacgatgtggccctggc

SEQ ID NO: 934737 - DNA, 22 bp, Homo sapiens
caccacgatgtggccctggcct

SEQ ID NO: 934738 - DNA, 22 bp, Homo sapiens
caccacgcccggctaatgtttg

SEQ ID NO: 934739 - DNA, 15 bp, Homo sapiens
caccacgcctggcta

SEQ ID NO: 934740 - DNA, 17 bp, Homo sapiens
caccacggccaccactg

SEQ ID NO: 934741 - DNA, 18 bp, Homo sapiens
caccacggccaccactgc

SEQ ID NO: 934742 - DNA, 15 bp, Homo sapiens
caccacgtccagctg

SEQ ID NO: 934743 - DNA, 11 bp, Homo sapiens
caccacgtctg

SEQ ID NO: 934744 - DNA, 14 bp, Homo sapiens
caccacgtctgcca

SEQ ID NO: 934745 - DNA, 20 bp, Homo sapiens
caccacgtctggctccctgc

SEQ ID NO: 934746 - DNA, 21 bp, Homo sapiens
caccacgtctggctccctgcc

SEQ ID NO: 934747 - DNA, 22 bp, Homo sapiens
caccactaaccatccccaactc

SEQ ID NO: 934748 - DNA, 19 bp, Homo sapiens
caccactacattctgttaa

SEQ ID NO: 934749 - DNA, 20 bp, Homo sapiens
caccactaggaatcccagag

SEQ ID NO: 934750 - DNA, 20 bp, Homo sapiens
caccactaggactctgaggc

SEQ ID NO: 934751 - DNA, 22 bp, Homo sapiens
caccactatagtgtaataatgt

SEQ ID NO: 934752 - DNA, 15 bp, Homo sapiens
caccactcaggccac

SEQ ID NO: 934753 - DNA, 20 bp, Homo sapiens
caccactccactcctccagc

SEQ ID NO: 934754 - DNA, 11 bp, Homo sapiens
caccactcctc

SEQ ID NO: 934755 - DNA, 12 bp, Homo sapiens
caccactcctct

SEQ ID NO: 934756 - DNA, 13 bp, Homo sapiens
caccactcctctc

SEQ ID NO: 934757 - DNA, 12 bp, Homo sapiens
caccactgccaa

SEQ ID NO: 934758 - DNA, 23 bp, Homo sapiens
caccactgccccctgctgccatg

SEQ ID NO: 934759 - DNA, 16 bp, Homo sapiens
caccactgccctgcct

SEQ ID NO: 934760 - DNA, 18 bp, Homo sapiens
caccactgccctgcctgc

SEQ ID NO: 934761 - DNA, 14 bp, Homo sapiens
caccactgctgagg

SEQ ID NO: 934762 - DNA, 23 bp, Homo sapiens
caccactgctgaggagtctgagg

SEQ ID NO: 934763 - DNA, 13 bp, Homo sapiens
caccactggccac

SEQ ID NO: 934764 - DNA, 19 bp, Homo sapiens
caccacttagcctctttct

SEQ ID NO: 934765 - DNA, 22 bp, Homo sapiens
caccacttatttattgttgcct

SEQ ID NO: 934766 - DNA, 17 bp, Homo sapiens
caccagaaattccagta

SEQ ID NO: 934767 - DNA, 16 bp, Homo sapiens
caccagacggggctgg

SEQ ID NO: 934768 - DNA, 20 bp, Homo sapiens
caccagaggctgcagaaggc

SEQ ID NO: 934769 - DNA, 23 bp, Homo sapiens
caccagagtgaaagggctatggc

SEQ ID NO: 934770 - DNA, 16 bp, Homo sapiens
caccagatagcagagg

SEQ ID NO: 934771 - DNA, 14 bp, Homo sapiens
caccagatgagaat

SEQ ID NO: 934772 - DNA, 22 bp, Homo sapiens
caccagcagcacaattctgtcc

SEQ ID NO: 934773 - DNA, 15 bp, Homo sapiens
caccagcagcctgga

SEQ ID NO: 934774 - DNA, 12 bp, Homo sapiens
caccagccagcc

SEQ ID NO: 934775 - DNA, 15 bp, Homo sapiens
caccagccagccctg

SEQ ID NO: 934776 - DNA, 19 bp, Homo sapiens
caccagccagccctggccc

SEQ ID NO: 934777 - DNA, 14 bp, Homo sapiens
caccagccccactg

SEQ ID NO: 934778 - DNA, 22 bp, Homo sapiens
caccagccccactgccagcagc

SEQ ID NO: 934779 - DNA, 20 bp, Homo sapiens
caccagcccccgccccagag

SEQ ID NO: 934780 - DNA, 23 bp, Homo sapiens
caccagcccccgccccagagtgg

SEQ ID NO: 934781 - DNA, 22 bp, Homo sapiens
caccagccccctggatgggcat

SEQ ID NO: 934782 - DNA, 15 bp, Homo sapiens
caccagcccggcctg

SEQ ID NO: 934783 - DNA, 16 bp, Homo sapiens
caccagcccggcctgc

SEQ ID NO: 934784 - DNA, 18 bp, Homo sapiens
caccagccctagctgtcc

SEQ ID NO: 934785 - DNA, 20 bp, Homo sapiens
caccagccctagctgtccca

SEQ ID NO: 934786 - DNA, 16 bp, Homo sapiens
caccagccctgcagcc

SEQ ID NO: 934787 - DNA, 16 bp, Homo sapiens
caccagccgccccagc

SEQ ID NO: 934788 - DNA, 19 bp, Homo sapiens
caccagccgccccagcccc

SEQ ID NO: 934789 - DNA, 17 bp, Homo sapiens
caccagccgctgcaggg

SEQ ID NO: 934790 - DNA, 22 bp, Homo sapiens
caccagccgctgcagggctccc

SEQ ID NO: 934791 - DNA, 22 bp, Homo sapiens
caccagcctagcctggctctgc

SEQ ID NO: 934792 - DNA, 16 bp, Homo sapiens
caccagcctgctgaca

SEQ ID NO: 934793 - DNA, 14 bp, Homo sapiens
caccagcgccccca

SEQ ID NO: 934794 - DNA, 24 bp, Homo sapiens
caccagcgttgggtttgctcatgt

SEQ ID NO: 934795 - DNA, 21 bp, Homo sapiens
caccagcgtttgaggggctgg

SEQ ID NO: 934796 - DNA, 17 bp, Homo sapiens
caccagctcctcccttg

SEQ ID NO: 934797 - DNA, 11 bp, Homo sapiens
caccagctcgt

SEQ ID NO: 934798 - DNA, 23 bp, Homo sapiens
caccagctcgtttttcagcaccc

SEQ ID NO: 934799 - DNA, 21 bp, Homo sapiens
caccagctctgtggcctgtgt

SEQ ID NO: 934800 - DNA, 23 bp, Homo sapiens
caccagctctgtggcctgtgtcc

SEQ ID NO: 934801 - DNA, 12 bp, Homo sapiens
caccagctgcct

SEQ ID NO: 934802 - DNA, 15 bp, Homo sapiens
caccagctgcctctt

SEQ ID NO: 934803 - DNA, 12 bp, Homo sapiens
caccagctgctc

SEQ ID NO: 934804 - DNA, 15 bp, Homo sapiens
caccagctgctctgc

SEQ ID NO: 934805 - DNA, 17 bp, Homo sapiens
cacccacctctgggtcc

SEQ ID NO: 934806 - DNA, 15 bp, Homo sapiens
cacccacctcttgtg

SEQ ID NO: 934807 - DNA, 14 bp, Homo sapiens
cacccacctgtttt

SEQ ID NO: 934808 - DNA, 18 bp, Homo sapiens
cacccacctgttttctga

SEQ ID NO: 934809 - DNA, 20 bp, Homo sapiens
cacccacctgttttctgaaa

SEQ ID NO: 934810 - DNA, 19 bp, Homo sapiens
cacccacgcatacacacat

SEQ ID NO: 934811 - DNA, 16 bp, Homo sapiens
cacccactcaggattg

SEQ ID NO: 934812 - DNA, 15 bp, Homo sapiens
cacccactctggtgg

SEQ ID NO: 934813 - DNA, 14 bp, Homo sapiens
cacccactgccccg

SEQ ID NO: 934814 - DNA, 12 bp, Homo sapiens
cacccagagcac

SEQ ID NO: 934815 - DNA, 14 bp, Homo sapiens
cacccagagcacag

SEQ ID NO: 934816 - DNA, 15 bp, Homo sapiens
cacccagagcacagg

SEQ ID NO: 934817 - DNA, 16 bp, Homo sapiens
cacccagatcaggaac

SEQ ID NO: 934818 - DNA, 16 bp, Homo sapiens
cacccagcaatagaga

SEQ ID NO: 934819 - DNA, 15 bp, Homo sapiens
cacccagcaggcaga

SEQ ID NO: 934820 - DNA, 19 bp, Homo sapiens
cacccagcccctctcccct

SEQ ID NO: 934821 - DNA, 15 bp, Homo sapiens
cacccagcccctggc

SEQ ID NO: 934822 - DNA, 13 bp, Homo sapiens
cacccagcccttc

SEQ ID NO: 934823 - DNA, 18 bp, Homo sapiens
cacccagcccttccttgg

SEQ ID NO: 934824 - DNA, 11 bp, Homo sapiens
cacccagcctg

SEQ ID NO: 934825 - DNA, 15 bp, Homo sapiens
cacccagcggccccc

SEQ ID NO: 934826 - DNA, 16 bp, Homo sapiens
cacccagctccaggcc

SEQ ID NO: 934827 - DNA, 22 bp, Homo sapiens
cacccagctggtcctgtggatg

SEQ ID NO: 934828 - DNA, 11 bp, Homo sapiens
cacccaggagg

SEQ ID NO: 934829 - DNA, 15 bp, Homo sapiens
cacccaggctgcact

SEQ ID NO: 934830 - DNA, 18 bp, Homo sapiens
cacccaggctgcactgca

SEQ ID NO: 934831 - DNA, 19 bp, Homo sapiens
cacccaggtcccccgactg

SEQ ID NO: 934832 - DNA, 23 bp, Homo sapiens
cacccaggtcccccgactgcctg

SEQ ID NO: 934833 - DNA, 22 bp, Homo sapiens
cacccaggtctcttcctttgct

SEQ ID NO: 934834 - DNA, 20 bp, Homo sapiens
cacccaggtgatttcctcta

SEQ ID NO: 934835 - DNA, 17 bp, Homo sapiens
cacccagtctgttcccc

SEQ ID NO: 934836 - DNA, 13 bp, Homo sapiens
cacccagtgctgc

SEQ ID NO: 934837 - DNA, 21 bp, Homo sapiens
cacccagtgctgccatgccac

SEQ ID NO: 934838 - DNA, 14 bp, Homo sapiens
cacccatatcatgc

SEQ ID NO: 934839 - DNA, 20 bp, Homo sapiens
cacccatcgtccaccccagt

SEQ ID NO: 934840 - DNA, 14 bp, Homo sapiens
cacccatcttcctg

SEQ ID NO: 934841 - DNA, 15 bp, Homo sapiens
cacccatcttcctgc

SEQ ID NO: 934842 - DNA, 18 bp, Homo sapiens
cacccatcttcctgctgc

SEQ ID NO: 934843 - DNA, 20 bp, Homo sapiens
cacccatcttcctgctgctg

SEQ ID NO: 934844 - DNA, 15 bp, Homo sapiens
cacccatgaatcaaa

SEQ ID NO: 934845 - DNA, 19 bp, Homo sapiens
cacccatgaatcaaagaca

SEQ ID NO: 934846 - DNA, 16 bp, Homo sapiens
cacccatgcacactca

SEQ ID NO: 934847 - DNA, 16 bp, Homo sapiens
cacccatgccagagag

SEQ ID NO: 934848 - DNA, 13 bp, Homo sapiens
cacccatggggag

SEQ ID NO: 934849 - DNA, 14 bp, Homo sapiens
cacccatggggagg

SEQ ID NO: 934850 - DNA, 15 bp, Homo sapiens
cacccattcttcccg

SEQ ID NO: 934851 - DNA, 15 bp, Homo sapiens
caccccaactctccc

SEQ ID NO: 934852 - DNA, 16 bp, Homo sapiens
caccccaactctcccc

SEQ ID NO: 934853 - DNA, 19 bp, Homo sapiens
caccccaactctccccagt

SEQ ID NO: 934854 - DNA, 20 bp, Homo sapiens
caccccaactctccccagtg

SEQ ID NO: 934855 - DNA, 18 bp, Homo sapiens
caccccaacttggcagct

SEQ ID NO: 934856 - DNA, 13 bp, Homo sapiens
caccccaatccct

SEQ ID NO: 934857 - DNA, 16 bp, Homo sapiens
caccccaatccctgcc

SEQ ID NO: 934858 - DNA, 17 bp, Homo sapiens
caccccaatccctgcca

SEQ ID NO: 934859 - DNA, 20 bp, Homo sapiens
caccccaatccctgccactg

SEQ ID NO: 934860 - DNA, 21 bp, Homo sapiens
caccccaatccctgccactgg

SEQ ID NO: 934861 - DNA, 15 bp, Homo sapiens
caccccacaccccag

SEQ ID NO: 934862 - DNA, 18 bp, Homo sapiens
caccccacaccccagccc

SEQ ID NO: 934863 - DNA, 17 bp, Homo sapiens
caccccacagactccgg

SEQ ID NO: 934864 - DNA, 23 bp, Homo sapiens
caccccacagactccggcctgta

SEQ ID NO: 934865 - DNA, 15 bp, Homo sapiens
caccccacctcttgt

SEQ ID NO: 934866 - DNA, 20 bp, Homo sapiens
ctacagaacttcagaaagac

SEQ ID NO: 934867 - DNA, 23 bp, Homo sapiens
ctacagaagccaagctccctgga

SEQ ID NO: 934868 - DNA, 21 bp, Homo sapiens
ctacagaaggacatatttcct

SEQ ID NO: 934869 - DNA, 14 bp, Homo sapiens
ctacagaagtggaa

SEQ ID NO: 934870 - DNA, 12 bp, Homo sapiens
ctacagaataat

SEQ ID NO: 934871 - DNA, 14 bp, Homo sapiens
ctacagaataatgt

SEQ ID NO: 934872 - DNA, 18 bp, Homo sapiens
ctacagacctggtacact

SEQ ID NO: 934873 - DNA, 16 bp, Homo sapiens
ctacagacttctccag

SEQ ID NO: 934874 - DNA, 17 bp, Homo sapiens
ctacagagaaaatgaat

SEQ ID NO: 934875 - DNA, 17 bp, Homo sapiens
ctacagagcttccctga

SEQ ID NO: 934876 - DNA, 13 bp, Homo sapiens
ctacagaggaggc

SEQ ID NO: 934877 - DNA, 18 bp, Homo sapiens
ctacagaggaggcctcaa

SEQ ID NO: 934878 - DNA, 20 bp, Homo sapiens
ctacagagtacgtgaaatgc

SEQ ID NO: 934879 - DNA, 23 bp, Homo sapiens
ctacagatgatagaggattttat

SEQ ID NO: 934880 - DNA, 21 bp, Homo sapiens
ctacagcactactgggtgtca

SEQ ID NO: 934881 - DNA, 20 bp, Homo sapiens
ctacagccctcactaacaaa

SEQ ID NO: 934882 - DNA, 19 bp, Homo sapiens
ctacagctcttaaatgtag

SEQ ID NO: 934883 - DNA, 22 bp, Homo sapiens
ctacaggaagcaccccatgcca

SEQ ID NO: 934884 - DNA, 18 bp, Homo sapiens
ctacaggggaaggtggcc

SEQ ID NO: 934885 - DNA, 23 bp, Homo sapiens
ctacaggtgcgcgccaccgtgcc

SEQ ID NO: 934886 - DNA, 13 bp, Homo sapiens
ctacagtaataaa

SEQ ID NO: 934887 - DNA, 14 bp, Homo sapiens
ctacagtaatgaaa

SEQ ID NO: 934888 - DNA, 18 bp, Homo sapiens
ctacagtaatgaaatgtt

SEQ ID NO: 934889 - DNA, 12 bp, Homo sapiens
ctacagtacaat

SEQ ID NO: 934890 - DNA, 18 bp, Homo sapiens
ctacagtagctgctacct

SEQ ID NO: 934891 - DNA, 15 bp, Homo sapiens
ctacagtcaggaaag

SEQ ID NO: 934892 - DNA, 18 bp, Homo sapiens
ctacagtcaggaaaggaa

SEQ ID NO: 934893 - DNA, 21 bp, Homo sapiens
ctacagtcaggaaaggaatca

SEQ ID NO: 934894 - DNA, 16 bp, Homo sapiens
ctacagtcgtaaaaga

SEQ ID NO: 934895 - DNA, 19 bp, Homo sapiens
ctacagtgactccctggga

SEQ ID NO: 934896 - DNA, 13 bp, Homo sapiens
ctacagtgctgtg

SEQ ID NO: 934897 - DNA, 21 bp, Homo sapiens
ctacagtggttttatactgaa

SEQ ID NO: 934898 - DNA, 16 bp, Homo sapiens
ctacagtgtacagtct

SEQ ID NO: 934899 - DNA, 20 bp, Homo sapiens
ctacagtgtacagtcttgta

SEQ ID NO: 934900 - DNA, 21 bp, Homo sapiens
ctacagttgaaaaacagctga

SEQ ID NO: 934901 - DNA, 15 bp, Homo sapiens
ctacagttttaactg

SEQ ID NO: 934902 - DNA, 18 bp, Homo sapiens
ctacagttttaactgtgg

SEQ ID NO: 934903 - DNA, 20 bp, Homo sapiens
ctacataaactgactttatc

SEQ ID NO: 934904 - DNA, 22 bp, Homo sapiens
ctacataaactgactttatcct

SEQ ID NO: 934905 - DNA, 15 bp, Homo sapiens
ctacataatttagtt

SEQ ID NO: 934906 - DNA, 14 bp, Homo sapiens
ctacatcagactct

SEQ ID NO: 934907 - DNA, 15 bp, Homo sapiens
ctacatccagctcct

SEQ ID NO: 934908 - DNA, 17 bp, Homo sapiens
ctacatccagctcctct

SEQ ID NO: 934909 - DNA, 21 bp, Homo sapiens
ctacatccagctcctctaggg

SEQ ID NO: 934910 - DNA, 14 bp, Homo sapiens
ctacatgaaacaga

SEQ ID NO: 934911 - DNA, 16 bp, Homo sapiens
ctacatgaaacagaaa

SEQ ID NO: 934912 - DNA, 18 bp, Homo sapiens
ctacatgaaacagaaaca

SEQ ID NO: 934913 - DNA, 18 bp, Homo sapiens
ctacatgactgggcctcc

SEQ ID NO: 934914 - DNA, 20 bp, Homo sapiens
ctacatgatgactcaaggcc

SEQ ID NO: 934915 - DNA, 14 bp, Homo sapiens
ctacatgcagccca

SEQ ID NO: 934916 - DNA, 17 bp, Homo sapiens
ctacatgcagcccatgc

SEQ ID NO: 934917 - DNA, 20 bp, Homo sapiens
ctacatgccccctcccttca

SEQ ID NO: 934918 - DNA, 14 bp, Homo sapiens
ctacatgctggggt

SEQ ID NO: 934919 - DNA, 15 bp, Homo sapiens
ctacatgctggggtc

SEQ ID NO: 934920 - DNA, 17 bp, Homo sapiens
ctacatgctttgtgaac

SEQ ID NO: 934921 - DNA, 12 bp, Homo sapiens
ctacattaaaca

SEQ ID NO: 934922 - DNA, 20 bp, Homo sapiens
ctacattaaacaatgatcac

SEQ ID NO: 934923 - DNA, 17 bp, Homo sapiens
ctacattccccagagtg

SEQ ID NO: 934924 - DNA, 20 bp, Homo sapiens
ctacattccctctcctgccc

SEQ ID NO: 934925 - DNA, 14 bp, Homo sapiens
ctacattcctcagc

SEQ ID NO: 934926 - DNA, 15 bp, Homo sapiens
ctacattcctcagct

SEQ ID NO: 934927 - DNA, 18 bp, Homo sapiens
ctacattgagcatttgaa

SEQ ID NO: 934928 - DNA, 16 bp, Homo sapiens
caccctgggagccagt

SEQ ID NO: 934929 - DNA, 23 bp, Homo sapiens
caccctgggatggaacctcagga

SEQ ID NO: 934930 - DNA, 22 bp, Homo sapiens
caccctgggccctgggctggaa

SEQ ID NO: 934931 - DNA, 23 bp, Homo sapiens
caccctgggccctgggctggaat

SEQ ID NO: 934932 - DNA, 15 bp, Homo sapiens
caccctggggcctgg

SEQ ID NO: 934933 - DNA, 14 bp, Homo sapiens
caccctggggctgc

SEQ ID NO: 934934 - DNA, 18 bp, Homo sapiens
caccctgggtgccattcc

SEQ ID NO: 934935 - DNA, 17 bp, Homo sapiens
caccctgtcaagttaac

SEQ ID NO: 934936 - DNA, 22 bp, Homo sapiens
caccctgtcaagttaacaagga

SEQ ID NO: 934937 - DNA, 16 bp, Homo sapiens
caccctgtcccccagc

SEQ ID NO: 934938 - DNA, 17 bp, Homo sapiens
caccctgtctaaaaaac

SEQ ID NO: 934939 - DNA, 12 bp, Homo sapiens
caccctgtggga

SEQ ID NO: 934940 - DNA, 13 bp, Homo sapiens
caccctgtgggac

SEQ ID NO: 934941 - DNA, 20 bp, Homo sapiens
cacccttaacccaaggagca

SEQ ID NO: 934942 - DNA, 23 bp, Homo sapiens
cacccttaacccaaggagcacag

SEQ ID NO: 934943 - DNA, 16 bp, Homo sapiens
cacccttacttcctgg

SEQ ID NO: 934944 - DNA, 20 bp, Homo sapiens
cacccttacttcctggcctc

SEQ ID NO: 934945 - DNA, 19 bp, Homo sapiens
cacccttctttcctcttcc

SEQ ID NO: 934946 - DNA, 14 bp, Homo sapiens
cacccttcttttct

SEQ ID NO: 934947 - DNA, 15 bp, Homo sapiens
cacccttcttttctc

SEQ ID NO: 934948 - DNA, 20 bp, Homo sapiens
cacccttcttttctcatgtg

SEQ ID NO: 934949 - DNA, 21 bp, Homo sapiens
cacccttcttttctcatgtgt

SEQ ID NO: 934950 - DNA, 13 bp, Homo sapiens
cacccttggcctg

SEQ ID NO: 934951 - DNA, 20 bp, Homo sapiens
caccctttgctgtgaggctg

SEQ ID NO: 934952 - DNA, 22 bp, Homo sapiens
caccctttgctgtgaggctgtc

SEQ ID NO: 934953 - DNA, 17 bp, Homo sapiens
cacccttttccagctgg

SEQ ID NO: 934954 - DNA, 13 bp, Homo sapiens
caccgaccaactg

SEQ ID NO: 934955 - DNA, 15 bp, Homo sapiens
caccgaccaactgcc

SEQ ID NO: 934956 - DNA, 18 bp, Homo sapiens
caccgaccaactgcccta

SEQ ID NO: 934957 - DNA, 23 bp, Homo sapiens
caccgaccaactgccctaagccc

SEQ ID NO: 934958 - DNA, 18 bp, Homo sapiens
caccgacccgaggcccag

SEQ ID NO: 934959 - DNA, 14 bp, Homo sapiens
caccgactgcccag

SEQ ID NO: 934960 - DNA, 13 bp, Homo sapiens
caccgagcagagg

SEQ ID NO: 934961 - DNA, 12 bp, Homo sapiens
caccgagtgggg

SEQ ID NO: 934962 - DNA, 16 bp, Homo sapiens
caccgccacgtcccag

SEQ ID NO: 934963 - DNA, 22 bp, Homo sapiens
caccgcccccaccccttcccca

SEQ ID NO: 934964 - DNA, 14 bp, Homo sapiens
caccgccctcctcc

SEQ ID NO: 934965 - DNA, 18 bp, Homo sapiens
caccgccgcagaagcagc

SEQ ID NO: 934966 - DNA, 22 bp, Homo sapiens
caccgccgcagaagcagcccct

SEQ ID NO: 934967 - DNA, 15 bp, Homo sapiens
caccgccgccaccct

SEQ ID NO: 934968 - DNA, 17 bp, Homo sapiens
caccgcctctggccgcc

SEQ ID NO: 934969 - DNA, 20 bp, Homo sapiens
caccgcgccctcctgcccac

SEQ ID NO: 934970 - DNA, 20 bp, Homo sapiens
caccgcggacgtgctggcct

SEQ ID NO: 934971 - DNA, 21 bp, Homo sapiens
caccgcggcgcttcccagcac

SEQ ID NO: 934972 - DNA, 12 bp, Homo sapiens
caccgctcagtg

SEQ ID NO: 934973 - DNA, 22 bp, Homo sapiens
caccgctccccacagctttgca

SEQ ID NO: 934974 - DNA, 16 bp, Homo sapiens
caccgctccccagccc

SEQ ID NO: 934975 - DNA, 21 bp, Homo sapiens
caccgctccccagcccagggt

SEQ ID NO: 934976 - DNA, 13 bp, Homo sapiens
caccgctgccagc

SEQ ID NO: 934977 - DNA, 13 bp, Homo sapiens
caccgctgcctaa

SEQ ID NO: 934978 - DNA, 19 bp, Homo sapiens
caccgctgcctaagtggct

SEQ ID NO: 934979 - DNA, 22 bp, Homo sapiens
caccgctgcctaagtggctgct

SEQ ID NO: 934980 - DNA, 19 bp, Homo sapiens
caccggaggtcactccacc

SEQ ID NO: 934981 - DNA, 20 bp, Homo sapiens
caccggcctgtgggtctctg

SEQ ID NO: 934982 - DNA, 22 bp, Homo sapiens
caccggcctgtgggtctctgaa

SEQ ID NO: 934983 - DNA, 15 bp, Homo sapiens
caccggcgctgcagg

SEQ ID NO: 934984 - DNA, 16 bp, Homo sapiens
caccggctctcacctg

SEQ ID NO: 934985 - DNA, 14 bp, Homo sapiens
caccgggctgcagg

SEQ ID NO: 934986 - DNA, 17 bp, Homo sapiens
caccgggctgcaggtgc

SEQ ID NO: 934987 - DNA, 20 bp, Homo sapiens
caccggggacaggccgcagc

SEQ ID NO: 934988 - DNA, 14 bp, Homo sapiens
caccgggggtggct

SEQ ID NO: 934989 - DNA, 15 bp, Homo sapiens
caccggtcagtgcct

SEQ ID NO: 934990 - DNA, 16 bp, Homo sapiens
caccggtcagtgcctt

SEQ ID NO: 934991 - DNA, 15 bp, Homo sapiens
caccggtccagctgg

SEQ ID NO: 934992 - DNA, 17 bp, Homo sapiens
caccgtacaaccccctc

SEQ ID NO: 934993 - DNA, 23 bp, Homo sapiens
caccgtcatggcttaatgtttat

SEQ ID NO: 934994 - DNA, 15 bp, Homo sapiens
caccgtcccgcacag

SEQ ID NO: 934995 - DNA, 17 bp, Homo sapiens
caccgtcccgcacagtg

SEQ ID NO: 934996 - DNA, 16 bp, Homo sapiens
caccgtcccgccagtg

SEQ ID NO: 934997 - DNA, 14 bp, Homo sapiens
caccgtccgccctg

SEQ ID NO: 934998 - DNA, 15 bp, Homo sapiens
caccgtcgaccagga

SEQ ID NO: 934999 - DNA, 16 bp, Homo sapiens
caccgtcgaccaggaa

SEQ ID NO: 935000 - DNA, 14 bp, Homo sapiens
ctactgcccacatt

SEQ ID NO: 935001 - DNA, 18 bp, Homo sapiens
ctactgctcctgtggcag

SEQ ID NO: 935002 - DNA, 11 bp, Homo sapiens
ctactgctgtg

SEQ ID NO: 935003 - DNA, 21 bp, Homo sapiens
ctactggaatggtgttttgtc

SEQ ID NO: 935004 - DNA, 22 bp, Homo sapiens
ctactggaatggtgttttgtca

SEQ ID NO: 935005 - DNA, 18 bp, Homo sapiens
ctactgggtgtcatttca

SEQ ID NO: 935006 - DNA, 19 bp, Homo sapiens
ctactgggtgtcatttcat

SEQ ID NO: 935007 - DNA, 14 bp, Homo sapiens
ctactgtaactttt

SEQ ID NO: 935008 - DNA, 23 bp, Homo sapiens
ctactgtaacttttttaaattaa

SEQ ID NO: 935009 - DNA, 22 bp, Homo sapiens
ctactgtaataaagatgattgt

SEQ ID NO: 935010 - DNA, 17 bp, Homo sapiens
ctactgtaatttgtgat

SEQ ID NO: 935011 - DNA, 12 bp, Homo sapiens
ctactgtcctgg

SEQ ID NO: 935012 - DNA, 15 bp, Homo sapiens
ctactgtggaaagac

SEQ ID NO: 935013 - DNA, 19 bp, Homo sapiens
ctactgtgtgtgtgaatga

SEQ ID NO: 935014 - DNA, 20 bp, Homo sapiens
ctactgtgtgtgtgaatgaa

SEQ ID NO: 935015 - DNA, 15 bp, Homo sapiens
ctactgtgttcctgg

SEQ ID NO: 935016 - DNA, 20 bp, Homo sapiens
ctactgtgttcctggcaata

SEQ ID NO: 935017 - DNA, 18 bp, Homo sapiens
ctactgttactctaaata

SEQ ID NO: 935018 - DNA, 20 bp, Homo sapiens
ctactgttgcacagccagaa

SEQ ID NO: 935019 - DNA, 22 bp, Homo sapiens
ctacttaatgtaattcaggact

SEQ ID NO: 935020 - DNA, 22 bp, Homo sapiens
ctacttaattcctttctcatcc

SEQ ID NO: 935021 - DNA, 16 bp, Homo sapiens
ctacttagggaagaaa

SEQ ID NO: 935022 - DNA, 21 bp, Homo sapiens
ctacttagggaagaaaaagca

SEQ ID NO: 935023 - DNA, 17 bp, Homo sapiens
ctacttatcatttttgt

SEQ ID NO: 935024 - DNA, 24 bp, Homo sapiens
ctacttatcatttttgtataaaaa

SEQ ID NO: 935025 - DNA, 13 bp, Homo sapiens
ctacttccaggat

SEQ ID NO: 935026 - DNA, 17 bp, Homo sapiens
ctacttcccctgggatg

SEQ ID NO: 935027 - DNA, 15 bp, Homo sapiens
ctacttccccttcct

SEQ ID NO: 935028 - DNA, 16 bp, Homo sapiens
ctacttccccttcttg

SEQ ID NO: 935029 - DNA, 17 bp, Homo sapiens
ctacttcctcctcccca

SEQ ID NO: 935030 - DNA, 20 bp, Homo sapiens
ctacttcctcctccccactt

SEQ ID NO: 935031 - DNA, 17 bp, Homo sapiens
ctacttctgactttact

SEQ ID NO: 935032 - DNA, 17 bp, Homo sapiens
ctacttctgtaattgtg

SEQ ID NO: 935033 - DNA, 22 bp, Homo sapiens
ctacttcttttgctcttagctg

SEQ ID NO: 935034 - DNA, 16 bp, Homo sapiens
ctacttgggagcctga

SEQ ID NO: 935035 - DNA, 18 bp, Homo sapiens
ctacttgggagcctgagg

SEQ ID NO: 935036 - DNA, 14 bp, Homo sapiens
ctacttggtttgtg

SEQ ID NO: 935037 - DNA, 17 bp, Homo sapiens
ctacttggtttgtgttc

SEQ ID NO: 935038 - DNA, 21 bp, Homo sapiens
ctacttgtaaaatgcttttca

SEQ ID NO: 935039 - DNA, 18 bp, Homo sapiens
ctacttgtgactgaaggg

SEQ ID NO: 935040 - DNA, 19 bp, Homo sapiens
ctactttcatcttaaacta

SEQ ID NO: 935041 - DNA, 23 bp, Homo sapiens
ctactttcatcttaaactaatac

SEQ ID NO: 935042 - DNA, 14 bp, Homo sapiens
ctactttgaaaaca

SEQ ID NO: 935043 - DNA, 19 bp, Homo sapiens
ctactttgactttttgcat

SEQ ID NO: 935044 - DNA, 20 bp, Homo sapiens
ctactttgactttttgcatt

SEQ ID NO: 935045 - DNA, 17 bp, Homo sapiens
ctactttgatatgactg

SEQ ID NO: 935046 - DNA, 17 bp, Homo sapiens
ctacttttgcatgaaaa

SEQ ID NO: 935047 - DNA, 11 bp, Homo sapiens
ctactttttgt

SEQ ID NO: 935048 - DNA, 21 bp, Homo sapiens
ctagaaaaaagggctgagagg

SEQ ID NO: 935049 - DNA, 13 bp, Homo sapiens
ctagatggacctg

SEQ ID NO: 935050 - DNA, 21 bp, Homo sapiens
ctagatggagaaagtaacaca

SEQ ID NO: 935051 - DNA, 22 bp, Homo sapiens
ctagatgtagtattttttgtat

SEQ ID NO: 935052 - DNA, 21 bp, Homo sapiens
ctagattaccccctcattgtt

SEQ ID NO: 935053 - DNA, 19 bp, Homo sapiens
ctagattaggtagactttg

SEQ ID NO: 935054 - DNA, 22 bp, Homo sapiens
ctagattaggtagactttgctt

SEQ ID NO: 935055 - DNA, 21 bp, Homo sapiens
ctagattgctaaggagctgat

SEQ ID NO: 935056 - DNA, 12 bp, Homo sapiens
ctagatttgtcc

SEQ ID NO: 935057 - DNA, 18 bp, Homo sapiens
ctagatttgtccttttat

SEQ ID NO: 935058 - DNA, 22 bp, Homo sapiens
ctagatttgtccttttatttct

SEQ ID NO: 935059 - DNA, 18 bp, Homo sapiens
ctagattttaatttattt

SEQ ID NO: 935060 - DNA, 19 bp, Homo sapiens
ctagcaacatatctctgcc

SEQ ID NO: 935061 - DNA, 22 bp, Homo sapiens
ctagcaattttctttgtttctt

SEQ ID NO: 935062 - DNA, 18 bp, Homo sapiens
ctagcacaaggagtgccc

SEQ ID NO: 935063 - DNA, 21 bp, Homo sapiens
ctagcacacctgaatcagctg

SEQ ID NO: 935064 - DNA, 20 bp, Homo sapiens
ctagcagcaccgttctgtgc

SEQ ID NO: 935065 - DNA, 23 bp, Homo sapiens
ctagcagcagggagggcttctgc

SEQ ID NO: 935066 - DNA, 12 bp, Homo sapiens
ctagcaggcagg

SEQ ID NO: 935067 - DNA, 15 bp, Homo sapiens
ctagcaggcaggaag

SEQ ID NO: 935068 - DNA, 15 bp, Homo sapiens
ctagcaggcatgccg

SEQ ID NO: 935069 - DNA, 19 bp, Homo sapiens
ctagcaggctgttccatgt

SEQ ID NO: 935070 - DNA, 16 bp, Homo sapiens
ctagcagtaaaagatg

SEQ ID NO: 935071 - DNA, 17 bp, Homo sapiens
ctagcagtaaaagatga

SEQ ID NO: 935072 - DNA, 20 bp, Homo sapiens
ctagcatacgtacacatttt

SEQ ID NO: 935073 - DNA, 16 bp, Homo sapiens
ctagcatggggtcagc

SEQ ID NO: 935074 - DNA, 18 bp, Homo sapiens
ctagcatggggtcagccc

SEQ ID NO: 935075 - DNA, 21 bp, Homo sapiens
ctagcatggggtcagccccaa

SEQ ID NO: 935076 - DNA, 22 bp, Homo sapiens
ctagcatggggtcagccccaag

SEQ ID NO: 935077 - DNA, 16 bp, Homo sapiens
ctagcatttatttctc

SEQ ID NO: 935078 - DNA, 18 bp, Homo sapiens
ctagcatttatttctctg

SEQ ID NO: 935079 - DNA, 19 bp, Homo sapiens
ctagcatttcccaacacaa

SEQ ID NO: 935080 - DNA, 15 bp, Homo sapiens
ctagcattttcttga

SEQ ID NO: 935081 - DNA, 16 bp, Homo sapiens
ctagccaacatggtga

SEQ ID NO: 935082 - DNA, 12 bp, Homo sapiens
ctagccaaggct

SEQ ID NO: 935083 - DNA, 12 bp, Homo sapiens
ctagccactccc

SEQ ID NO: 935084 - DNA, 19 bp, Homo sapiens
ctagccactccctcccaga

SEQ ID NO: 935085 - DNA, 21 bp, Homo sapiens
ctagccactccctcccagaaa

SEQ ID NO: 935086 - DNA, 12 bp, Homo sapiens
ctagccagacaa

SEQ ID NO: 935087 - DNA, 23 bp, Homo sapiens
ctagccagagcccttcactgcca

SEQ ID NO: 935088 - DNA, 20 bp, Homo sapiens
ctagccagcacttgtatata

SEQ ID NO: 935089 - DNA, 12 bp, Homo sapiens
ctagccaggagt

SEQ ID NO: 935090 - DNA, 14 bp, Homo sapiens
ctagccaggagtct

SEQ ID NO: 935091 - DNA, 15 bp, Homo sapiens
ctagccaggagtctg

SEQ ID NO: 935092 - DNA, 20 bp, Homo sapiens
ctagccaggagtctgtgctc

SEQ ID NO: 935093 - DNA, 17 bp, Homo sapiens
ctagccattcctggtac

SEQ ID NO: 935094 - DNA, 20 bp, Homo sapiens
ctagcccactccctgcctac

SEQ ID NO: 935095 - DNA, 21 bp, Homo sapiens
ctagcccactccctgcctaca

SEQ ID NO: 935096 - DNA, 13 bp, Homo sapiens
ctagcccagtgct

SEQ ID NO: 935097 - DNA, 22 bp, Homo sapiens
ctagcccatggacttcacataa

SEQ ID NO: 935098 - DNA, 21 bp, Homo sapiens
ctagcccctctggattccctt

SEQ ID NO: 935099 - DNA, 18 bp, Homo sapiens
ctagccctccccccagct

SEQ ID NO: 935100 - DNA, 20 bp, Homo sapiens
ctagccctccccccagctcc

SEQ ID NO: 935101 - DNA, 18 bp, Homo sapiens
ctagccctctcacattta

SEQ ID NO: 935102 - DNA, 12 bp, Homo sapiens
ctagccctgagc

SEQ ID NO: 935103 - DNA, 17 bp, Homo sapiens
ctagccctgagcccggc

SEQ ID NO: 935104 - DNA, 11 bp, Homo sapiens
ctagcccttcc

SEQ ID NO: 935105 - DNA, 17 bp, Homo sapiens
ctagcccttccagcctg

SEQ ID NO: 935106 - DNA, 19 bp, Homo sapiens
ctagccgacctcagccttc

SEQ ID NO: 935107 - DNA, 18 bp, Homo sapiens
ctagccggccactttgga

SEQ ID NO: 935108 - DNA, 17 bp, Homo sapiens
ctagcctctgagatgct

SEQ ID NO: 935109 - DNA, 18 bp, Homo sapiens
ctagcctggatggcccct

SEQ ID NO: 935110 - DNA, 23 bp, Homo sapiens
ctagcctggatggcccctccttg

SEQ ID NO: 935111 - DNA, 19 bp, Homo sapiens
ctagcctgtgcctctggga

SEQ ID NO: 935112 - DNA, 22 bp, Homo sapiens
ctagccttaatcaggtcctcag

SEQ ID NO: 935113 - DNA, 21 bp, Homo sapiens
ctagccttatcctctgatctc

SEQ ID NO: 935114 - DNA, 22 bp, Homo sapiens
ctagccttatcctctgatctcc

SEQ ID NO: 935115 - DNA, 11 bp, Homo sapiens
ctagccttgct

SEQ ID NO: 935116 - DNA, 18 bp, Homo sapiens
ctagcgaacgtatttctc

SEQ ID NO: 935117 - DNA, 23 bp, Homo sapiens
ctagcgaacgtatttctccagac

SEQ ID NO: 935118 - DNA, 17 bp, Homo sapiens
ctagcgatctctcctgg

SEQ ID NO: 935119 - DNA, 14 bp, Homo sapiens
ctagcgcagttttt

SEQ ID NO: 935120 - DNA, 22 bp, Homo sapiens
ctagcgctgccgcaccccagag

SEQ ID NO: 935121 - DNA, 14 bp, Homo sapiens
ctagcggagcccag

SEQ ID NO: 935122 - DNA, 17 bp, Homo sapiens
ctagcggagcccagcct

SEQ ID NO: 935123 - DNA, 20 bp, Homo sapiens
ctagcggagcccagcctggg

SEQ ID NO: 935124 - DNA, 15 bp, Homo sapiens
ctagctaaataaatg

SEQ ID NO: 935125 - DNA, 13 bp, Homo sapiens
ctagctacactga

SEQ ID NO: 935126 - DNA, 17 bp, Homo sapiens
ctagctagaaatatgat

SEQ ID NO: 935127 - DNA, 19 bp, Homo sapiens
ctagctagaagtgggccag

SEQ ID NO: 935128 - DNA, 18 bp, Homo sapiens
ctagctatgctgtatctg

SEQ ID NO: 935129 - DNA, 20 bp, Homo sapiens
cacctcggggacaccagagc

SEQ ID NO: 935130 - DNA, 21 bp, Homo sapiens
cacctcggggacaccagagct

SEQ ID NO: 935131 - DNA, 15 bp, Homo sapiens
cacctcgtctccctg

SEQ ID NO: 935132 - DNA, 15 bp, Homo sapiens
cacctctacccaaac

SEQ ID NO: 935133 - DNA, 15 bp, Homo sapiens
cacctctactgtctc

SEQ ID NO: 935134 - DNA, 16 bp, Homo sapiens
cacctctactgtctcc

SEQ ID NO: 935135 - DNA, 15 bp, Homo sapiens
cacctctatccaaag

SEQ ID NO: 935136 - DNA, 20 bp, Homo sapiens
cacctctcacgggccctgcc

SEQ ID NO: 935137 - DNA, 11 bp, Homo sapiens
cacctctccaa

SEQ ID NO: 935138 - DNA, 13 bp, Homo sapiens
cacctctccaagg

SEQ ID NO: 935139 - DNA, 15 bp, Homo sapiens
cacctctccaagggc

SEQ ID NO: 935140 - DNA, 16 bp, Homo sapiens
cacctctccaagggct

SEQ ID NO: 935141 - DNA, 22 bp, Homo sapiens
cacctctccaagggcttctgca

SEQ ID NO: 935142 - DNA, 15 bp, Homo sapiens
cacctctccaagtct

SEQ ID NO: 935143 - DNA, 13 bp, Homo sapiens
cacctctccctca

SEQ ID NO: 935144 - DNA, 23 bp, Homo sapiens
cacctctccctcaacaagggaga

SEQ ID NO: 935145 - DNA, 12 bp, Homo sapiens
cacctctctttt

SEQ ID NO: 935146 - DNA, 22 bp, Homo sapiens
cacctctcttttcctctctgtc

SEQ ID NO: 935147 - DNA, 20 bp, Homo sapiens
cacctctgacgcaccactgc

SEQ ID NO: 935148 - DNA, 13 bp, Homo sapiens
cacctctgccctt

SEQ ID NO: 935149 - DNA, 19 bp, Homo sapiens
cacctctgcccttcccctc

SEQ ID NO: 935150 - DNA, 13 bp, Homo sapiens
cacctctgctcca

SEQ ID NO: 935151 - DNA, 17 bp, Homo sapiens
cacctctggactggcta

SEQ ID NO: 935152 - DNA, 21 bp, Homo sapiens
cacctctggccaaatatgcac

SEQ ID NO: 935153 - DNA, 24 bp, Homo sapiens
cacctctggccaaatatgcacttt

SEQ ID NO: 935154 - DNA, 24 bp, Homo sapiens
cacctctggtggctcctcctagga

SEQ ID NO: 935155 - DNA, 12 bp, Homo sapiens
cacctctgtggg

SEQ ID NO: 935156 - DNA, 20 bp, Homo sapiens
cacctcttcaccccccactc

SEQ ID NO: 935157 - DNA, 19 bp, Homo sapiens
cacctcttccactccttct

SEQ ID NO: 935158 - DNA, 23 bp, Homo sapiens
cacctcttgtttctgggtccctg

SEQ ID NO: 935159 - DNA, 12 bp, Homo sapiens
cacctctttaaa

SEQ ID NO: 935160 - DNA, 13 bp, Homo sapiens
cacctgaaacact

SEQ ID NO: 935161 - DNA, 14 bp, Homo sapiens
cacctgaaagcctg

SEQ ID NO: 935162 - DNA, 15 bp, Homo sapiens
cacctgaaagcctgt

SEQ ID NO: 935163 - DNA, 16 bp, Homo sapiens
cacctgaaagcctgtc

SEQ ID NO: 935164 - DNA, 19 bp, Homo sapiens
cacctgaaagcctgtctct

SEQ ID NO: 935165 - DNA, 21 bp, Homo sapiens
cacctgaaattaatttgtgaa

SEQ ID NO: 935166 - DNA, 13 bp, Homo sapiens
cacctgaactgaa

SEQ ID NO: 935167 - DNA, 19 bp, Homo sapiens
cacctgaatcagctggaca

SEQ ID NO: 935168 - DNA, 19 bp, Homo sapiens
cacctgacaatggcagcta

SEQ ID NO: 935169 - DNA, 17 bp, Homo sapiens
cacctgacacaccaggc

SEQ ID NO: 935170 - DNA, 20 bp, Homo sapiens
ctagtgccaatgatgtgacc

SEQ ID NO: 935171 - DNA, 13 bp, Homo sapiens
ctagtgccccaga

SEQ ID NO: 935172 - DNA, 18 bp, Homo sapiens
ctagtgccccagactgag

SEQ ID NO: 935173 - DNA, 20 bp, Homo sapiens
ctagtgccccagactgagct

SEQ ID NO: 935174 - DNA, 18 bp, Homo sapiens
ctagtgccctccacagcc

SEQ ID NO: 935175 - DNA, 19 bp, Homo sapiens
ctagtgccctccacagccg

SEQ ID NO: 935176 - DNA, 23 bp, Homo sapiens
ctagtgccctccacagccgcagc

SEQ ID NO: 935177 - DNA, 17 bp, Homo sapiens
ctagtgccttctaaagg

SEQ ID NO: 935178 - DNA, 18 bp, Homo sapiens
ctagtgctattctgtgtt

SEQ ID NO: 935179 - DNA, 20 bp, Homo sapiens
ctagtgctgtaatattgtaa

SEQ ID NO: 935180 - DNA, 21 bp, Homo sapiens
ctagtgctgtaatattgtaaa

SEQ ID NO: 935181 - DNA, 13 bp, Homo sapiens
ctagtgctgtgaa

SEQ ID NO: 935182 - DNA, 16 bp, Homo sapiens
ctagtggatgactgtt

SEQ ID NO: 935183 - DNA, 19 bp, Homo sapiens
ctagtggatgactgttgat

SEQ ID NO: 935184 - DNA, 17 bp, Homo sapiens
ctagtgggacagcccag

SEQ ID NO: 935185 - DNA, 18 bp, Homo sapiens
ctagtgggacagcccaga

SEQ ID NO: 935186 - DNA, 20 bp, Homo sapiens
ctagtgggccctctctctgg

SEQ ID NO: 935187 - DNA, 17 bp, Homo sapiens
ctagtggggtctccctc

SEQ ID NO: 935188 - DNA, 21 bp, Homo sapiens
ctagtggggtctccctctcct

SEQ ID NO: 935189 - DNA, 20 bp, Homo sapiens
ctagtggggtgaacagctgg

SEQ ID NO: 935190 - DNA, 20 bp, Homo sapiens
ctagtgggttgacctttaaa

SEQ ID NO: 935191 - DNA, 14 bp, Homo sapiens
ctagtggtctcacc

SEQ ID NO: 935192 - DNA, 21 bp, Homo sapiens
ctagtgtagagcaagccagtg

SEQ ID NO: 935193 - DNA, 17 bp, Homo sapiens
ctagtgtagctgccaca

SEQ ID NO: 935194 - DNA, 21 bp, Homo sapiens
ctagtgtctgggtttggccca

SEQ ID NO: 935195 - DNA, 22 bp, Homo sapiens
ctagtgtctgggtttggcccaa

SEQ ID NO: 935196 - DNA, 14 bp, Homo sapiens
ctagtgtgaattaa

SEQ ID NO: 935197 - DNA, 20 bp, Homo sapiens
ctagtgtgagtggcagccat

SEQ ID NO: 935198 - DNA, 18 bp, Homo sapiens
ctagtgttctgtttgtta

SEQ ID NO: 935199 - DNA, 17 bp, Homo sapiens
ctagtgtttaaaaggct

SEQ ID NO: 935200 - DNA, 18 bp, Homo sapiens
ctagtgttttcaatttta

SEQ ID NO: 935201 - DNA, 21 bp, Homo sapiens
ctagttaacctagaagtattt

SEQ ID NO: 935202 - DNA, 20 bp, Homo sapiens
ctagttaaggaaatgttgag

SEQ ID NO: 935203 - DNA, 22 bp, Homo sapiens
ctagttatcaaggggatgattt

SEQ ID NO: 935204 - DNA, 20 bp, Homo sapiens
ctagttatttacaggaactt

SEQ ID NO: 935205 - DNA, 20 bp, Homo sapiens
ctagttcaaatgatgaagac

SEQ ID NO: 935206 - DNA, 20 bp, Homo sapiens
ctagttcatccaatcctcac

SEQ ID NO: 935207 - DNA, 22 bp, Homo sapiens
ctagttcatccaatcctcactg

SEQ ID NO: 935208 - DNA, 13 bp, Homo sapiens
ctagttctgctgc

SEQ ID NO: 935209 - DNA, 16 bp, Homo sapiens
ctagttctgctgccct

SEQ ID NO: 935210 - DNA, 21 bp, Homo sapiens
ctagttctgctgccctcttaa

SEQ ID NO: 935211 - DNA, 15 bp, Homo sapiens
ctagttctgttgttt

SEQ ID NO: 935212 - DNA, 13 bp, Homo sapiens
ctagttctttcct

SEQ ID NO: 935213 - DNA, 14 bp, Homo sapiens
ctagtttacagaaa

SEQ ID NO: 935214 - DNA, 17 bp, Homo sapiens
ctagtttactgttttga

SEQ ID NO: 935215 - DNA, 18 bp, Homo sapiens
ctagtttcctctccttcg

SEQ ID NO: 935216 - DNA, 17 bp, Homo sapiens
ctagtttgattattatg

SEQ ID NO: 935217 - DNA, 19 bp, Homo sapiens
ctagttttcagtttgtata

SEQ ID NO: 935218 - DNA, 20 bp, Homo sapiens
ctagttttcagtttgtatat

SEQ ID NO: 935219 - DNA, 22 bp, Homo sapiens
ctagttttcagtttgtatatac

SEQ ID NO: 935220 - DNA, 15 bp, Homo sapiens
ctagttttttgcttc

SEQ ID NO: 935221 - DNA, 16 bp, Homo sapiens
ctataaaagctttctg

SEQ ID NO: 935222 - DNA, 17 bp, Homo sapiens
ctataaaataaacttct

SEQ ID NO: 935223 - DNA, 20 bp, Homo sapiens
ctataaaataaacttcttaa

SEQ ID NO: 935224 - DNA, 20 bp, Homo sapiens
ctataaaatgcccatttcga

SEQ ID NO: 935225 - DNA, 19 bp, Homo sapiens
ctataaagagaagacgaaa

SEQ ID NO: 935226 - DNA, 14 bp, Homo sapiens
ctataaagcagtat

SEQ ID NO: 935227 - DNA, 11 bp, Homo sapiens
ctataaagcat

SEQ ID NO: 935228 - DNA, 19 bp, Homo sapiens
ctataaagctagatgcttt

SEQ ID NO: 935229 - DNA, 15 bp, Homo sapiens
ctataaagtatatat

SEQ ID NO: 935230 - DNA, 23 bp, Homo sapiens
ctataaatatatatttttaaaat

SEQ ID NO: 935231 - DNA, 22 bp, Homo sapiens
ctataaatcaacaccttaatat

SEQ ID NO: 935232 - DNA, 16 bp, Homo sapiens
ctataaatcagtattt

SEQ ID NO: 935233 - DNA, 16 bp, Homo sapiens
ctataaatggtgtttt

SEQ ID NO: 935234 - DNA, 15 bp, Homo sapiens
ctataaattcctctt

SEQ ID NO: 935235 - DNA, 21 bp, Homo sapiens
ctataacagatcctttcaaaa

SEQ ID NO: 935236 - DNA, 22 bp, Homo sapiens
ctataaccccagctccctagga

SEQ ID NO: 935237 - DNA, 17 bp, Homo sapiens
ctataagaagccttaat

SEQ ID NO: 935238 - DNA, 21 bp, Homo sapiens
ctataagaagccttaatttgc

SEQ ID NO: 935239 - DNA, 18 bp, Homo sapiens
ctataagaataaggcttt

SEQ ID NO: 935240 - DNA, 19 bp, Homo sapiens
ctataagactataaataaa

SEQ ID NO: 935241 - DNA, 18 bp, Homo sapiens
ctataagatgacaatgtt

SEQ ID NO: 935242 - DNA, 21 bp, Homo sapiens
ctataagcaaattgctttttt

SEQ ID NO: 935243 - DNA, 22 bp, Homo sapiens
ctataagcttaaataggaaagt

SEQ ID NO: 935244 - DNA, 15 bp, Homo sapiens
ctataaggtgcctca

SEQ ID NO: 935245 - DNA, 21 bp, Homo sapiens
ctataaggtgctctctttctg

SEQ ID NO: 935246 - DNA, 23 bp, Homo sapiens
ctataaggtgctctctttctgtc

SEQ ID NO: 935247 - DNA, 16 bp, Homo sapiens
ctataagtagttggtt

SEQ ID NO: 935248 - DNA, 23 bp, Homo sapiens
ctataagtgagatggtatgaaat

SEQ ID NO: 935249 - DNA, 22 bp, Homo sapiens
ctataagttgtaccaaaacatc

SEQ ID NO: 935250 - DNA, 23 bp, Homo sapiens
ctataagttgtaccaaaacatcc

SEQ ID NO: 935251 - DNA, 22 bp, Homo sapiens
ctataataaaatggcaccttcc

SEQ ID NO: 935252 - DNA, 13 bp, Homo sapiens
ctataataagttt

SEQ ID NO: 935253 - DNA, 19 bp, Homo sapiens
ctataataagttttgatat

SEQ ID NO: 935254 - DNA, 19 bp, Homo sapiens
ctataatacttgcaactaa

SEQ ID NO: 935255 - DNA, 14 bp, Homo sapiens
ctataatcattagt

SEQ ID NO: 935256 - DNA, 19 bp, Homo sapiens
ctataatcccagcactttg

SEQ ID NO: 935257 - DNA, 14 bp, Homo sapiens
ctataatctgtcaa

SEQ ID NO: 935258 - DNA, 15 bp, Homo sapiens
ctataatcttataca

SEQ ID NO: 935259 - DNA, 16 bp, Homo sapiens
ctataatgatctaaga

SEQ ID NO: 935260 - DNA, 18 bp, Homo sapiens
cacgatgtggccctggcc

SEQ ID NO: 935261 - DNA, 12 bp, Homo sapiens
cacgatttctgt

SEQ ID NO: 935262 - DNA, 16 bp, Homo sapiens
cacgatttctgtttag

SEQ ID NO: 935263 - DNA, 19 bp, Homo sapiens
cacgattttcaagattcta

SEQ ID NO: 935264 - DNA, 17 bp, Homo sapiens
cacgcaaatacactcca

SEQ ID NO: 935265 - DNA, 17 bp, Homo sapiens
cacgcaagggcatcagg

SEQ ID NO: 935266 - DNA, 15 bp, Homo sapiens
cacgcaagtgtgtga

SEQ ID NO: 935267 - DNA, 18 bp, Homo sapiens
cacgcacacgcacacatc

SEQ ID NO: 935268 - DNA, 12 bp, Homo sapiens
cacgcacctgcc

SEQ ID NO: 935269 - DNA, 12 bp, Homo sapiens
cacgcacgcaca

SEQ ID NO: 935270 - DNA, 13 bp, Homo sapiens
cacgcacgcacac

SEQ ID NO: 935271 - DNA, 13 bp, Homo sapiens
cacgcacggcagc

SEQ ID NO: 935272 - DNA, 16 bp, Homo sapiens
cacgcactgcgcctgt

SEQ ID NO: 935273 - DNA, 19 bp, Homo sapiens
cacgcactgcgcctgtcag

SEQ ID NO: 935274 - DNA, 15 bp, Homo sapiens
cacgcacttcctctc

SEQ ID NO: 935275 - DNA, 18 bp, Homo sapiens
cacgcagcctgctctgga

SEQ ID NO: 935276 - DNA, 13 bp, Homo sapiens
cacgcaggaactc

SEQ ID NO: 935277 - DNA, 16 bp, Homo sapiens
cacgcaggaactccca

SEQ ID NO: 935278 - DNA, 20 bp, Homo sapiens
cacgcaggaactcccagcaa

SEQ ID NO: 935279 - DNA, 17 bp, Homo sapiens
cacgcaggcggccaggg

SEQ ID NO: 935280 - DNA, 19 bp, Homo sapiens
cacgcaggggctctgagcc

SEQ ID NO: 935281 - DNA, 22 bp, Homo sapiens
cacgcatacacacatgccctcc

SEQ ID NO: 935282 - DNA, 19 bp, Homo sapiens
cacgcatgggcattgcagc

SEQ ID NO: 935283 - DNA, 22 bp, Homo sapiens
cacgcatgggcattgcagcctt

SEQ ID NO: 935284 - DNA, 17 bp, Homo sapiens
cacgccactgcctcccc

SEQ ID NO: 935285 - DNA, 14 bp, Homo sapiens
cacgccccagcccg

SEQ ID NO: 935286 - DNA, 18 bp, Homo sapiens
cacgccccagcccgacaa

SEQ ID NO: 935287 - DNA, 17 bp, Homo sapiens
cacgccccctgtgactt

SEQ ID NO: 935288 - DNA, 15 bp, Homo sapiens
cacgcccgtcctgcc

SEQ ID NO: 935289 - DNA, 18 bp, Homo sapiens
cacgccctactccactgc

SEQ ID NO: 935290 - DNA, 23 bp, Homo sapiens
cacgccctactccactgccctgg

SEQ ID NO: 935291 - DNA, 16 bp, Homo sapiens
cacgtgtgtgactcag

SEQ ID NO: 935292 - DNA, 23 bp, Homo sapiens
cacgtgttttattcctgtatgtt

SEQ ID NO: 935293 - DNA, 17 bp, Homo sapiens
cacgttcagggaggggc

SEQ ID NO: 935294 - DNA, 12 bp, Homo sapiens
cacgttctgatt

SEQ ID NO: 935295 - DNA, 16 bp, Homo sapiens
cacgttgcctctactt

SEQ ID NO: 935296 - DNA, 15 bp, Homo sapiens
cacgttgctgaaggt

SEQ ID NO: 935297 - DNA, 19 bp, Homo sapiens
cactaaaacacacaggtgc

SEQ ID NO: 935298 - DNA, 13 bp, Homo sapiens
cactaaaatacat

SEQ ID NO: 935299 - DNA, 16 bp, Homo sapiens
cactaaacaagaaatc

SEQ ID NO: 935300 - DNA, 22 bp, Homo sapiens
cactaaactttacccaaaaact

SEQ ID NO: 935301 - DNA, 13 bp, Homo sapiens
cactaaactttat

SEQ ID NO: 935302 - DNA, 20 bp, Homo sapiens
cactaaactttatttgtaaa

SEQ ID NO: 935303 - DNA, 13 bp, Homo sapiens
cactaaagcagtg

SEQ ID NO: 935304 - DNA, 15 bp, Homo sapiens
cactaaagccagcct

SEQ ID NO: 935305 - DNA, 20 bp, Homo sapiens
cactaaagccagcctgacct

SEQ ID NO: 935306 - DNA, 21 bp, Homo sapiens
cactaaagccagcctgacctt

SEQ ID NO: 935307 - DNA, 16 bp, Homo sapiens
cactaaagtatgtaaa

SEQ ID NO: 935308 - DNA, 22 bp, Homo sapiens
cactaaagtgtcaaggtgtgga

SEQ ID NO: 935309 - DNA, 13 bp, Homo sapiens
cactaaatcagag

SEQ ID NO: 935310 - DNA, 16 bp, Homo sapiens
cactaaatcagagaca

SEQ ID NO: 935311 - DNA, 17 bp, Homo sapiens
cactaacagggagaagt

SEQ ID NO: 935312 - DNA, 14 bp, Homo sapiens
cactaaccatcccc

SEQ ID NO: 935313 - DNA, 20 bp, Homo sapiens
cactaaccatccccaactcc

SEQ ID NO: 935314 - DNA, 23 bp, Homo sapiens
cactaaccttgcctggtacagta

SEQ ID NO: 935315 - DNA, 19 bp, Homo sapiens
cactaacgacttcagggca

SEQ ID NO: 935316 - DNA, 19 bp, Homo sapiens
cactaagagggcagactgt

SEQ ID NO: 935317 - DNA, 13 bp, Homo sapiens
cactaagcagagg

SEQ ID NO: 935318 - DNA, 14 bp, Homo sapiens
cactaagcagagga

SEQ ID NO: 935319 - DNA, 18 bp, Homo sapiens
cactaagcagaggagggg

SEQ ID NO: 935320 - DNA, 20 bp, Homo sapiens
cactaagcagaggaggggcc

SEQ ID NO: 935321 - DNA, 23 bp, Homo sapiens
cactaaggccgtgtctctgagga

SEQ ID NO: 935322 - DNA, 12 bp, Homo sapiens
cactaaggggcc

SEQ ID NO: 935323 - DNA, 22 bp, Homo sapiens
cactaagttatagtatatctgg

SEQ ID NO: 935324 - DNA, 17 bp, Homo sapiens
cactaatatatggacct

SEQ ID NO: 935325 - DNA, 22 bp, Homo sapiens
cactaatatatggacctagctt

SEQ ID NO: 935326 - DNA, 20 bp, Homo sapiens
cactaatatatttaaaaata

SEQ ID NO: 935327 - DNA, 21 bp, Homo sapiens
cactaatatatttaaaaataa

SEQ ID NO: 935328 - DNA, 13 bp, Homo sapiens
cactaatccatta

SEQ ID NO: 935329 - DNA, 17 bp, Homo sapiens
cactaatgggaagacca

SEQ ID NO: 935330 - DNA, 19 bp, Homo sapiens
cactaatttcttctttaga

SEQ ID NO: 935331 - DNA, 20 bp, Homo sapiens
cactaatttttgtattattt

SEQ ID NO: 935332 - DNA, 14 bp, Homo sapiens
cactacacccagca

SEQ ID NO: 935333 - DNA, 15 bp, Homo sapiens
cactacacccagcaa

SEQ ID NO: 935334 - DNA, 18 bp, Homo sapiens
cactacacccagcaatag

SEQ ID NO: 935335 - DNA, 23 bp, Homo sapiens
cactacacctggctgaggttcct

SEQ ID NO: 935336 - DNA, 16 bp, Homo sapiens
cactacactccagcct

SEQ ID NO: 935337 - DNA, 17 bp, Homo sapiens
cactacactccagcctg

SEQ ID NO: 935338 - DNA, 14 bp, Homo sapiens
cactacataaactg

SEQ ID NO: 935339 - DNA, 19 bp, Homo sapiens
cactacataaactgacttt

SEQ ID NO: 935340 - DNA, 17 bp, Homo sapiens
cactacatatctaaagc

SEQ ID NO: 935341 - DNA, 15 bp, Homo sapiens
cactacatgcagccc

SEQ ID NO: 935342 - DNA, 21 bp, Homo sapiens
cactacatgcagcccatgccc

SEQ ID NO: 935343 - DNA, 23 bp, Homo sapiens
cactacatgcagcccatgcccac

SEQ ID NO: 935344 - DNA, 17 bp, Homo sapiens
cactacattctgttaat

SEQ ID NO: 935345 - DNA, 21 bp, Homo sapiens
cactacattctgttaatcatt

SEQ ID NO: 935346 - DNA, 17 bp, Homo sapiens
cactaccagccagcctc

SEQ ID NO: 935347 - DNA, 20 bp, Homo sapiens
cactaccctgattcttgatt

SEQ ID NO: 935348 - DNA, 21 bp, Homo sapiens
cactacgcatgactaattttt

SEQ ID NO: 935349 - DNA, 18 bp, Homo sapiens
cactactcctctgcagtg

SEQ ID NO: 935350 - DNA, 19 bp, Homo sapiens
cactactcctctgcagtgc

SEQ ID NO: 935351 - DNA, 12 bp, Homo sapiens
cactactgaaca

SEQ ID NO: 935352 - DNA, 13 bp, Homo sapiens
cactactgcagca

SEQ ID NO: 935353 - DNA, 19 bp, Homo sapiens
cactactgcagcacctcca

SEQ ID NO: 935354 - DNA, 21 bp, Homo sapiens
cactactgggtgtcatttcat

SEQ ID NO: 935355 - DNA, 17 bp, Homo sapiens
cactactgtatgtaata

SEQ ID NO: 935356 - DNA, 17 bp, Homo sapiens
cactagaactctccatc

SEQ ID NO: 935357 - DNA, 16 bp, Homo sapiens
cactagaagtcctgct

SEQ ID NO: 935358 - DNA, 15 bp, Homo sapiens
cactagacaaaactg

SEQ ID NO: 935359 - DNA, 20 bp, Homo sapiens
cactagagacaaatctttaa

SEQ ID NO: 935360 - DNA, 16 bp, Homo sapiens
cactagaggccaggga

SEQ ID NO: 935361 - DNA, 17 bp, Homo sapiens
cactagagggcccatca

SEQ ID NO: 935362 - DNA, 17 bp, Homo sapiens
cactagcattttcttga

SEQ ID NO: 935363 - DNA, 16 bp, Homo sapiens
cactagcctgtgatta

SEQ ID NO: 935364 - DNA, 16 bp, Homo sapiens
cactaggactcagaaa

SEQ ID NO: 935365 - DNA, 22 bp, Homo sapiens
cactaggcccccacttgcctct

SEQ ID NO: 935366 - DNA, 12 bp, Homo sapiens
cactagggctga

SEQ ID NO: 935367 - DNA, 16 bp, Homo sapiens
cactaggtaacttatt

SEQ ID NO: 935368 - DNA, 17 bp, Homo sapiens
cactaggtgtccccaac

SEQ ID NO: 935369 - DNA, 21 bp, Homo sapiens
cactaggtgtccccaacgtcc

SEQ ID NO: 935370 - DNA, 22 bp, Homo sapiens
cactagtcaccgacagcggcct

SEQ ID NO: 935371 - DNA, 23 bp, Homo sapiens
cactagtgcaattccaagaaaat

SEQ ID NO: 935372 - DNA, 12 bp, Homo sapiens
cactagttttgt

SEQ ID NO: 935373 - DNA, 20 bp, Homo sapiens
cactataatgatctaagaag

SEQ ID NO: 935374 - DNA, 16 bp, Homo sapiens
cactataatgtgaaat

SEQ ID NO: 935375 - DNA, 13 bp, Homo sapiens
cactatagtgtaa

SEQ ID NO: 935376 - DNA, 20 bp, Homo sapiens
cactatagtgtaataatgtt

SEQ ID NO: 935377 - DNA, 11 bp, Homo sapiens
cactatattta

SEQ ID NO: 935378 - DNA, 20 bp, Homo sapiens
cactatcccaatcaaagaat

SEQ ID NO: 935379 - DNA, 22 bp, Homo sapiens
cactatcccaatcaaagaatta

SEQ ID NO: 935380 - DNA, 18 bp, Homo sapiens
cactatctcacactaatc

SEQ ID NO: 935381 - DNA, 18 bp, Homo sapiens
cactatctgggtgcatga

SEQ ID NO: 935382 - DNA, 21 bp, Homo sapiens
cactatgaagatgtttcaaaa

SEQ ID NO: 935383 - DNA, 13 bp, Homo sapiens
cactatgataaag

SEQ ID NO: 935384 - DNA, 15 bp, Homo sapiens
cactatgcattttaa

SEQ ID NO: 935385 - DNA, 20 bp, Homo sapiens
cactatggtatgctggccag

SEQ ID NO: 935386 - DNA, 21 bp, Homo sapiens
cactatggtatgctggccagc

SEQ ID NO: 935387 - DNA, 17 bp, Homo sapiens
cactatggtatttgagt

SEQ ID NO: 935388 - DNA, 16 bp, Homo sapiens
cactattcttaagcac

SEQ ID NO: 935389 - DNA, 17 bp, Homo sapiens
cactattcttaagcact

SEQ ID NO: 935390 - DNA, 14 bp, Homo sapiens
ctatctaaatgttg

SEQ ID NO: 935391 - DNA, 16 bp, Homo sapiens
ctatctaaccctccca

SEQ ID NO: 935392 - DNA, 17 bp, Homo sapiens
ctatctaaccctcccat

SEQ ID NO: 935393 - DNA, 19 bp, Homo sapiens
ctatctagcatttatttct

SEQ ID NO: 935394 - DNA, 22 bp, Homo sapiens
ctatctaggtggagttgaaaga

SEQ ID NO: 935395 - DNA, 14 bp, Homo sapiens
ctatctatgaacaa

SEQ ID NO: 935396 - DNA, 18 bp, Homo sapiens
ctatctatgaacaacagt

SEQ ID NO: 935397 - DNA, 17 bp, Homo sapiens
ctatctattaaagtgac

SEQ ID NO: 935398 - DNA, 15 bp, Homo sapiens
ctatctcagccatag

SEQ ID NO: 935399 - DNA, 14 bp, Homo sapiens
ctatctcagggagg

SEQ ID NO: 935400 - DNA, 15 bp, Homo sapiens
ctatctcagggaggg

SEQ ID NO: 935401 - DNA, 22 bp, Homo sapiens
ctatctcatagggatgctgtga

SEQ ID NO: 935402 - DNA, 12 bp, Homo sapiens
ctatctcatcta

SEQ ID NO: 935403 - DNA, 14 bp, Homo sapiens
ctatctcctgacag

SEQ ID NO: 935404 - DNA, 21 bp, Homo sapiens
ctatctctgtgtgcacaaata

SEQ ID NO: 935405 - DNA, 18 bp, Homo sapiens
ctatctgattttgtgcaa

SEQ ID NO: 935406 - DNA, 19 bp, Homo sapiens
ctatctggaggccttccag

SEQ ID NO: 935407 - DNA, 20 bp, Homo sapiens
ctatctggaggccttccagc

SEQ ID NO: 935408 - DNA, 19 bp, Homo sapiens
ctatctggggagctcctgg

SEQ ID NO: 935409 - DNA, 20 bp, Homo sapiens
ctatctggggagctcctggc

SEQ ID NO: 935410 - DNA, 21 bp, Homo sapiens
ctatctggtcaacctcctgga

SEQ ID NO: 935411 - DNA, 17 bp, Homo sapiens
ctatctgtattcccaaa

SEQ ID NO: 935412 - DNA, 16 bp, Homo sapiens
ctatctgtctggtggc

SEQ ID NO: 935413 - DNA, 21 bp, Homo sapiens
ctatgtttgtgtgatttccta

SEQ ID NO: 935414 - DNA, 23 bp, Homo sapiens
ctatgtttgtgtgatttcctaaa

SEQ ID NO: 935415 - DNA, 13 bp, Homo sapiens
ctattaaaaaagt

SEQ ID NO: 935416 - DNA, 16 bp, Homo sapiens
ctattaaaaatagaca

SEQ ID NO: 935417 - DNA, 19 bp, Homo sapiens
ctattaaggtgatatattt

SEQ ID NO: 935418 - DNA, 11 bp, Homo sapiens
ctattaatata

SEQ ID NO: 935419 - DNA, 14 bp, Homo sapiens
ctattaatatatgt

SEQ ID NO: 935420 - DNA, 21 bp, Homo sapiens
ctattaatatcaactctgaag

SEQ ID NO: 935421 - DNA, 13 bp, Homo sapiens
ctattaatatttg

SEQ ID NO: 935422 - DNA, 22 bp, Homo sapiens
ctattaatatttgtttagttca

SEQ ID NO: 935423 - DNA, 13 bp, Homo sapiens
ctattaatcaaga

SEQ ID NO: 935424 - DNA, 14 bp, Homo sapiens
ctattaatcaagag

SEQ ID NO: 935425 - DNA, 15 bp, Homo sapiens
ctattaatcaagaga

SEQ ID NO: 935426 - DNA, 19 bp, Homo sapiens
ctattaatcacctctctgt

SEQ ID NO: 935427 - DNA, 17 bp, Homo sapiens
ctattaccatgagaaga

SEQ ID NO: 935428 - DNA, 23 bp, Homo sapiens
ctattactgtctggttttaacaa

SEQ ID NO: 935429 - DNA, 13 bp, Homo sapiens
ctattacttttct

SEQ ID NO: 935430 - DNA, 20 bp, Homo sapiens
ctattacttttgcaaactgt

SEQ ID NO: 935431 - DNA, 22 bp, Homo sapiens
ctattagactttagaaataaat

SEQ ID NO: 935432 - DNA, 19 bp, Homo sapiens
ctattagagtatttccctt

SEQ ID NO: 935433 - DNA, 16 bp, Homo sapiens
ctattagccacaaaat

SEQ ID NO: 935434 - DNA, 15 bp, Homo sapiens
ctattagcggctcct

SEQ ID NO: 935435 - DNA, 15 bp, Homo sapiens
ctattataatttaat

SEQ ID NO: 935436 - DNA, 18 bp, Homo sapiens
ctattatagccacatccc

SEQ ID NO: 935437 - DNA, 15 bp, Homo sapiens
ctattatggaaaact

SEQ ID NO: 935438 - DNA, 18 bp, Homo sapiens
ctattatggaaaactgtg

SEQ ID NO: 935439 - DNA, 15 bp, Homo sapiens
ctattatttattgta

SEQ ID NO: 935440 - DNA, 20 bp, Homo sapiens
ctattattttcactgtagaa

SEQ ID NO: 935441 - DNA, 23 bp, Homo sapiens
ctattcaaggtggccaaattatt

SEQ ID NO: 935442 - DNA, 17 bp, Homo sapiens
ctattcacaattattcc

SEQ ID NO: 935443 - DNA, 17 bp, Homo sapiens
ctattcaccctccactt

SEQ ID NO: 935444 - DNA, 15 bp, Homo sapiens
ctattcagacaagca

SEQ ID NO: 935445 - DNA, 19 bp, Homo sapiens
ctattcattaagtaatctt

SEQ ID NO: 935446 - DNA, 19 bp, Homo sapiens
ctattccaggaattcctct

SEQ ID NO: 935447 - DNA, 14 bp, Homo sapiens
ctattcccattgtg

SEQ ID NO: 935448 - DNA, 17 bp, Homo sapiens
ctattccgagcccttag

SEQ ID NO: 935449 - DNA, 17 bp, Homo sapiens
ctattcctgagagctgc

SEQ ID NO: 935450 - DNA, 22 bp, Homo sapiens
ctattcctgtaaataagagttg

SEQ ID NO: 935451 - DNA, 20 bp, Homo sapiens
ctattccttatgggatcatt

SEQ ID NO: 935452 - DNA, 14 bp, Homo sapiens
ctattcctttccct

SEQ ID NO: 935453 - DNA, 16 bp, Homo sapiens
ctattctcaccaggaa

SEQ ID NO: 935454 - DNA, 14 bp, Homo sapiens
ctattctgagcctt

SEQ ID NO: 935455 - DNA, 17 bp, Homo sapiens
ctattcttaagcacttt

SEQ ID NO: 935456 - DNA, 18 bp, Homo sapiens
ctattcttaagcactttg

SEQ ID NO: 935457 - DNA, 23 bp, Homo sapiens
ctattcttggaccatgccagatt

SEQ ID NO: 935458 - DNA, 13 bp, Homo sapiens
ctattgaactgta

SEQ ID NO: 935459 - DNA, 17 bp, Homo sapiens
ctattgaactgtattct

SEQ ID NO: 935460 - DNA, 15 bp, Homo sapiens
ctattgacaataaaa

SEQ ID NO: 935461 - DNA, 18 bp, Homo sapiens
ctattgacaataaaatat

SEQ ID NO: 935462 - DNA, 13 bp, Homo sapiens
ctattgacttcaa

SEQ ID NO: 935463 - DNA, 14 bp, Homo sapiens
ctattgacttcaat

SEQ ID NO: 935464 - DNA, 13 bp, Homo sapiens
ctattgagccttg

SEQ ID NO: 935465 - DNA, 18 bp, Homo sapiens
ctattgatttttacttca

SEQ ID NO: 935466 - DNA, 18 bp, Homo sapiens
ctattgcagttatagaaa

SEQ ID NO: 935467 - DNA, 19 bp, Homo sapiens
ctattgcatttatatgtac

SEQ ID NO: 935468 - DNA, 21 bp, Homo sapiens
ctattgcttcaccatggcctt

SEQ ID NO: 935469 - DNA, 16 bp, Homo sapiens
ctattgggttcattat

SEQ ID NO: 935470 - DNA, 15 bp, Homo sapiens
ctattggtgcttgac

SEQ ID NO: 935471 - DNA, 14 bp, Homo sapiens
ctattgtaaatatg

SEQ ID NO: 935472 - DNA, 14 bp, Homo sapiens
ctattgtaaggtct

SEQ ID NO: 935473 - DNA, 20 bp, Homo sapiens
ctattgtaatatagaaaaaa

SEQ ID NO: 935474 - DNA, 14 bp, Homo sapiens
ctattgtcattaaa

SEQ ID NO: 935475 - DNA, 15 bp, Homo sapiens
ctattgtcattaaag

SEQ ID NO: 935476 - DNA, 22 bp, Homo sapiens
ctattgtcccctagcaaggcat

SEQ ID NO: 935477 - DNA, 19 bp, Homo sapiens
ctattgtgaatatttggaa

SEQ ID NO: 935478 - DNA, 22 bp, Homo sapiens
ctattgtgcaatgtaaatattt

SEQ ID NO: 935479 - DNA, 16 bp, Homo sapiens
ctattgttgtgggctt

SEQ ID NO: 935480 - DNA, 21 bp, Homo sapiens
ctatttaaaaaaaaagtcaga

SEQ ID NO: 935481 - DNA, 23 bp, Homo sapiens
ctatttaaaatgctcaatttcag

SEQ ID NO: 935482 - DNA, 18 bp, Homo sapiens
ctatttaaaattggcacc

SEQ ID NO: 935483 - DNA, 15 bp, Homo sapiens
ctatttaaagcctcc

SEQ ID NO: 935484 - DNA, 20 bp, Homo sapiens
ctatttaatatctggcactg

SEQ ID NO: 935485 - DNA, 12 bp, Homo sapiens
ctatttaatatt

SEQ ID NO: 935486 - DNA, 11 bp, Homo sapiens
ctatttaatgg

SEQ ID NO: 935487 - DNA, 18 bp, Homo sapiens
ctatttagcatgacaagc

SEQ ID NO: 935488 - DNA, 17 bp, Homo sapiens
ctatttagtttttgtaa

SEQ ID NO: 935489 - DNA, 17 bp, Homo sapiens
ctatttatatgtacatg

SEQ ID NO: 935490 - DNA, 14 bp, Homo sapiens
ctatttattcctgt

SEQ ID NO: 935491 - DNA, 15 bp, Homo sapiens
ctatttattcctgtt

SEQ ID NO: 935492 - DNA, 18 bp, Homo sapiens
ctatttattgactttgac

SEQ ID NO: 935493 - DNA, 15 bp, Homo sapiens
ctatttatttacaaa

SEQ ID NO: 935494 - DNA, 16 bp, Homo sapiens
ctatttatttacaaat

SEQ ID NO: 935495 - DNA, 15 bp, Homo sapiens
ctatttatttactga

SEQ ID NO: 935496 - DNA, 18 bp, Homo sapiens
ctatttatttactgagct

SEQ ID NO: 935497 - DNA, 21 bp, Homo sapiens
ctatttattttcctaaagaga

SEQ ID NO: 935498 - DNA, 11 bp, Homo sapiens
ctatttcaata

SEQ ID NO: 935499 - DNA, 16 bp, Homo sapiens
ctatttcagcctcctg

SEQ ID NO: 935500 - DNA, 14 bp, Homo sapiens
ctatttcatcacaa

SEQ ID NO: 935501 - DNA, 17 bp, Homo sapiens
ctatttcatgtttttga

SEQ ID NO: 935502 - DNA, 23 bp, Homo sapiens
ctatttccccaggggaaaatgaa

SEQ ID NO: 935503 - DNA, 14 bp, Homo sapiens
ctatttctatgtca

SEQ ID NO: 935504 - DNA, 16 bp, Homo sapiens
ctatttctatgtcatt

SEQ ID NO: 935505 - DNA, 13 bp, Homo sapiens
ctatttctattcc

SEQ ID NO: 935506 - DNA, 14 bp, Homo sapiens
ctatttctctcccc

SEQ ID NO: 935507 - DNA, 21 bp, Homo sapiens
ctatttctctgtgtatttata

SEQ ID NO: 935508 - DNA, 13 bp, Homo sapiens
ctatttctgagaa

SEQ ID NO: 935509 - DNA, 22 bp, Homo sapiens
ctatttctgggtcttttgctac

SEQ ID NO: 935510 - DNA, 21 bp, Homo sapiens
ctatttcttgaagaataaatt

SEQ ID NO: 935511 - DNA, 12 bp, Homo sapiens
ctatttgaagaa

SEQ ID NO: 935512 - DNA, 12 bp, Homo sapiens
ctatttgtacaa

SEQ ID NO: 935513 - DNA, 15 bp, Homo sapiens
ctatttgtacaattt

SEQ ID NO: 935514 - DNA, 23 bp, Homo sapiens
ctatttgtggcaattttatgttt

SEQ ID NO: 935515 - DNA, 20 bp, Homo sapiens
ctatttgtgtgtatgctgat

SEQ ID NO: 935516 - DNA, 15 bp, Homo sapiens
ctatttgttcagaga

SEQ ID NO: 935517 - DNA, 20 bp, Homo sapiens
ctatttgttcagagaggcct

SEQ ID NO: 935518 - DNA, 16 bp, Homo sapiens
ctatttgttttcatgg

SEQ ID NO: 935519 - DNA, 13 bp, Homo sapiens
ctattttaaaata

SEQ ID NO: 935520 - DNA, 12 bp, Homo sapiens
ctattttaatgt

SEQ ID NO: 935521 - DNA, 12 bp, Homo sapiens
cctggagccatc

SEQ ID NO: 935522 - DNA, 11 bp, Homo sapiens
cctggagcccc

SEQ ID NO: 935523 - DNA, 14 bp, Homo sapiens
cctggagcccctgg

SEQ ID NO: 935524 - DNA, 17 bp, Homo sapiens
cctggagcccctgggtg

SEQ ID NO: 935525 - DNA, 12 bp, Homo sapiens
cctggagcccgc

SEQ ID NO: 935526 - DNA, 12 bp, Homo sapiens
cctggagccctg

SEQ ID NO: 935527 - DNA, 14 bp, Homo sapiens
cctggagctctgtg

SEQ ID NO: 935528 - DNA, 13 bp, Homo sapiens
cctggagctgagg

SEQ ID NO: 935529 - DNA, 14 bp, Homo sapiens
cctggagctgagga

SEQ ID NO: 935530 - DNA, 17 bp, Homo sapiens
cctggagctgaggaatc

SEQ ID NO: 935531 - DNA, 13 bp, Homo sapiens
cctggaggaccag

SEQ ID NO: 935532 - DNA, 14 bp, Homo sapiens
cctggaggcaagag

SEQ ID NO: 935533 - DNA, 19 bp, Homo sapiens
cctggaggcaagagggagg

SEQ ID NO: 935534 - DNA, 20 bp, Homo sapiens
cctggaggcaagagggaggg

SEQ ID NO: 935535 - DNA, 16 bp, Homo sapiens
cctggaggcaggggct

SEQ ID NO: 935536 - DNA, 20 bp, Homo sapiens
cctggaggcggtgcggcagg

SEQ ID NO: 935537 - DNA, 22 bp, Homo sapiens
cctggaggctcagcccaccctc

SEQ ID NO: 935538 - DNA, 17 bp, Homo sapiens
cctggaggctggggatg

SEQ ID NO: 935539 - DNA, 19 bp, Homo sapiens
cctggagggatgcccccag

SEQ ID NO: 935540 - DNA, 20 bp, Homo sapiens
cctggagggcacttcctcca

SEQ ID NO: 935541 - DNA, 23 bp, Homo sapiens
cctggagggcacttcctccacag

SEQ ID NO: 935542 - DNA, 15 bp, Homo sapiens
cctggagtataatat

SEQ ID NO: 935543 - DNA, 15 bp, Homo sapiens
cctggagtgccctgc

SEQ ID NO: 935544 - DNA, 19 bp, Homo sapiens
cctggagtgccctgcaggc

SEQ ID NO: 935545 - DNA, 16 bp, Homo sapiens
cctggagtgtgtcaga

SEQ ID NO: 935546 - DNA, 19 bp, Homo sapiens
cctggagtgtgtcagagcc

SEQ ID NO: 935547 - DNA, 23 bp, Homo sapiens
cctggagttgactgactgagcag

SEQ ID NO: 935548 - DNA, 17 bp, Homo sapiens
cctggagttgttttcgg

SEQ ID NO: 935549 - DNA, 23 bp, Homo sapiens
cctggatcacgacgctgcagagc

SEQ ID NO: 935550 - DNA, 21 bp, Homo sapiens
cctggatccatcaggccactt

SEQ ID NO: 935551 - DNA, 20 bp, Homo sapiens
cctggatctcctcccttacc

SEQ ID NO: 935552 - DNA, 20 bp, Homo sapiens
cctggatggcccctccttgc

SEQ ID NO: 935553 - DNA, 22 bp, Homo sapiens
cctggatggcccctccttgcaa

SEQ ID NO: 935554 - DNA, 23 bp, Homo sapiens
cctggatgggggtgcaggcagcc

SEQ ID NO: 935555 - DNA, 22 bp, Homo sapiens
cctggatgtcccctgtcccacc

SEQ ID NO: 935556 - DNA, 17 bp, Homo sapiens
cctggatgtgtggggca

SEQ ID NO: 935557 - DNA, 18 bp, Homo sapiens
cctggatgtgtggggcat

SEQ ID NO: 935558 - DNA, 17 bp, Homo sapiens
cctggatgttgtgtgta

SEQ ID NO: 935559 - DNA, 14 bp, Homo sapiens
cctggattaggagg

SEQ ID NO: 935560 - DNA, 16 bp, Homo sapiens
cctggattaggagggt

SEQ ID NO: 935561 - DNA, 15 bp, Homo sapiens
cctggattcatttcc

SEQ ID NO: 935562 - DNA, 18 bp, Homo sapiens
cctggattcatttcctgc

SEQ ID NO: 935563 - DNA, 20 bp, Homo sapiens
cctggattcatttcctgccc

SEQ ID NO: 935564 - DNA, 21 bp, Homo sapiens
cctggattcatttcctgccct

SEQ ID NO: 935565 - DNA, 17 bp, Homo sapiens
cctggattccagcagtg

SEQ ID NO: 935566 - DNA, 23 bp, Homo sapiens
cctggattccagcagtgaatgct

SEQ ID NO: 935567 - DNA, 13 bp, Homo sapiens
cctggatttatag

SEQ ID NO: 935568 - DNA, 20 bp, Homo sapiens
cctggatttgagtcttggtg

SEQ ID NO: 935569 - DNA, 21 bp, Homo sapiens
cctggattttttatgtacaac

SEQ ID NO: 935570 - DNA, 17 bp, Homo sapiens
cctggcaacagagcgag

SEQ ID NO: 935571 - DNA, 22 bp, Homo sapiens
cctggcaaggcattcctcatca

SEQ ID NO: 935572 - DNA, 12 bp, Homo sapiens
cctggcaatagt

SEQ ID NO: 935573 - DNA, 17 bp, Homo sapiens
cctggcaatcaatacag

SEQ ID NO: 935574 - DNA, 14 bp, Homo sapiens
cctggcaatcccac

SEQ ID NO: 935575 - DNA, 21 bp, Homo sapiens
cctggcaatcccaccaaatca

SEQ ID NO: 935576 - DNA, 12 bp, Homo sapiens
cctggcacccac

SEQ ID NO: 935577 - DNA, 15 bp, Homo sapiens
cctggcacccaccgt

SEQ ID NO: 935578 - DNA, 16 bp, Homo sapiens
cctggcacgccctact

SEQ ID NO: 935579 - DNA, 22 bp, Homo sapiens
cctggcactataatgtaagctc

SEQ ID NO: 935580 - DNA, 18 bp, Homo sapiens
cctggcactgggaggcag

SEQ ID NO: 935581 - DNA, 14 bp, Homo sapiens
cctggcagacacaa

SEQ ID NO: 935582 - DNA, 22 bp, Homo sapiens
cctggcagacttgcccaggtca

SEQ ID NO: 935583 - DNA, 13 bp, Homo sapiens
cctggcagcacag

SEQ ID NO: 935584 - DNA, 15 bp, Homo sapiens
cctggcagcacagcc

SEQ ID NO: 935585 - DNA, 21 bp, Homo sapiens
cctggcagcacagcccagggc

SEQ ID NO: 935586 - DNA, 23 bp, Homo sapiens
cctggcagcacagcccagggcct

SEQ ID NO: 935587 - DNA, 16 bp, Homo sapiens
cctggcagcagcaggt

SEQ ID NO: 935588 - DNA, 19 bp, Homo sapiens
cctggcagcagcaggtgtg

SEQ ID NO: 935589 - DNA, 13 bp, Homo sapiens
cctggcagcccag

SEQ ID NO: 935590 - DNA, 12 bp, Homo sapiens
cctggcagccgt

SEQ ID NO: 935591 - DNA, 22 bp, Homo sapiens
cctggcagccgtgccttcagct

SEQ ID NO: 935592 - DNA, 20 bp, Homo sapiens
cctggcagctgcccctcctg

SEQ ID NO: 935593 - DNA, 13 bp, Homo sapiens
cctggcagctgct

SEQ ID NO: 935594 - DNA, 17 bp, Homo sapiens
cctggcagctgctgtgg

SEQ ID NO: 935595 - DNA, 14 bp, Homo sapiens
cctggcagggccac

SEQ ID NO: 935596 - DNA, 22 bp, Homo sapiens
cctggcagggctcacactcctg

SEQ ID NO: 935597 - DNA, 23 bp, Homo sapiens
cctggcagggctcacactcctgg

SEQ ID NO: 935598 - DNA, 23 bp, Homo sapiens
cctggcagtggctctcagagcag

SEQ ID NO: 935599 - DNA, 21 bp, Homo sapiens
cctggcatcgcaccattctga

SEQ ID NO: 935600 - DNA, 23 bp, Homo sapiens
cctggcatcgcaccattctgact

SEQ ID NO: 935601 - DNA, 13 bp, Homo sapiens
cctggcatctgtg

SEQ ID NO: 935602 - DNA, 14 bp, Homo sapiens
cctggcatctgtgc

SEQ ID NO: 935603 - DNA, 16 bp, Homo sapiens
cctggcatctgtgcgt

SEQ ID NO: 935604 - DNA, 22 bp, Homo sapiens
cctggcatctgtgcgtgtggcg

SEQ ID NO: 935605 - DNA, 14 bp, Homo sapiens
cctggcatctgtgt

SEQ ID NO: 935606 - DNA, 22 bp, Homo sapiens
cctggcatctgtgtgtgtggcg

SEQ ID NO: 935607 - DNA, 22 bp, Homo sapiens
cctggcatggacaccttgtgtt

SEQ ID NO: 935608 - DNA, 19 bp, Homo sapiens
cctggcattcttgtacagt

SEQ ID NO: 935609 - DNA, 17 bp, Homo sapiens
cctggcatttgctgatt

SEQ ID NO: 935610 - DNA, 20 bp, Homo sapiens
cctggcatttgctgatttct

SEQ ID NO: 935611 - DNA, 23 bp, Homo sapiens
cctggcatttgctgatttctagt

SEQ ID NO: 935612 - DNA, 13 bp, Homo sapiens
cctggccaccagc

SEQ ID NO: 935613 - DNA, 22 bp, Homo sapiens
cctggccaccagccatcctccc

SEQ ID NO: 935614 - DNA, 14 bp, Homo sapiens
cctggccacccttg

SEQ ID NO: 935615 - DNA, 15 bp, Homo sapiens
cctggccacctctct

SEQ ID NO: 935616 - DNA, 18 bp, Homo sapiens
cctggccacctgaggtgg

SEQ ID NO: 935617 - DNA, 14 bp, Homo sapiens
cctggccactgtcc

SEQ ID NO: 935618 - DNA, 24 bp, Homo sapiens
cctggccactgtccctgtccttct

SEQ ID NO: 935619 - DNA, 11 bp, Homo sapiens
cctggccagga

SEQ ID NO: 935620 - DNA, 15 bp, Homo sapiens
cctggccaggaccct

SEQ ID NO: 935621 - DNA, 19 bp, Homo sapiens
cctggccaggagctcttca

SEQ ID NO: 935622 - DNA, 20 bp, Homo sapiens
cctggccaggagctcttcag

SEQ ID NO: 935623 - DNA, 23 bp, Homo sapiens
cctggccatgctgtccctgcact

SEQ ID NO: 935624 - DNA, 23 bp, Homo sapiens
cctggccatgtcacctggctgct

SEQ ID NO: 935625 - DNA, 20 bp, Homo sapiens
cctggccatttggccccagg

SEQ ID NO: 935626 - DNA, 22 bp, Homo sapiens
cctggccatttggccccagggg

SEQ ID NO: 935627 - DNA, 14 bp, Homo sapiens
cctggcccactgca

SEQ ID NO: 935628 - DNA, 19 bp, Homo sapiens
cctggcccatctcagcctc

SEQ ID NO: 935629 - DNA, 20 bp, Homo sapiens
cctggcccatctcagcctcc

SEQ ID NO: 935630 - DNA, 23 bp, Homo sapiens
cctggcccatctcagcctcctga

SEQ ID NO: 935631 - DNA, 16 bp, Homo sapiens
cctggcccattcttga

SEQ ID NO: 935632 - DNA, 19 bp, Homo sapiens
cctggccccagcctgggcc

SEQ ID NO: 935633 - DNA, 18 bp, Homo sapiens
cctggccccatggtcagc

SEQ ID NO: 935634 - DNA, 15 bp, Homo sapiens
cctggccccatgtct

SEQ ID NO: 935635 - DNA, 12 bp, Homo sapiens
cctggccccctc

SEQ ID NO: 935636 - DNA, 21 bp, Homo sapiens
cctggccccggcctttatgtt

SEQ ID NO: 935637 - DNA, 19 bp, Homo sapiens
cctggccccgggctctggc

SEQ ID NO: 935638 - DNA, 14 bp, Homo sapiens
cctggcccctccag

SEQ ID NO: 935639 - DNA, 14 bp, Homo sapiens
cctggcccctcgcc

SEQ ID NO: 935640 - DNA, 17 bp, Homo sapiens
cctggcccctgtgggga

SEQ ID NO: 935641 - DNA, 21 bp, Homo sapiens
cctggcccgccctcacctctg

SEQ ID NO: 935642 - DNA, 16 bp, Homo sapiens
cctggccctccccaca

SEQ ID NO: 935643 - DNA, 16 bp, Homo sapiens
cctggccctccctccc

SEQ ID NO: 935644 - DNA, 15 bp, Homo sapiens
cctggccctgaggtg

SEQ ID NO: 935645 - DNA, 13 bp, Homo sapiens
attttataagaaa

SEQ ID NO: 935646 - DNA, 15 bp, Homo sapiens
attttataagaaaaa

SEQ ID NO: 935647 - DNA, 16 bp, Homo sapiens
cctggccctgaggtgt

SEQ ID NO: 935648 - DNA, 14 bp, Homo sapiens
cctggccctgcttc

SEQ ID NO: 935649 - DNA, 18 bp, Homo sapiens
cctggccctgttctcctc

SEQ ID NO: 935650 - DNA, 23 bp, Homo sapiens
cctggccctgttctcctccccaa

SEQ ID NO: 935651 - DNA, 18 bp, Homo sapiens
cctggcccttacttgctt

SEQ ID NO: 935652 - DNA, 12 bp, Homo sapiens
cctggcccttca

SEQ ID NO: 935653 - DNA, 14 bp, Homo sapiens
cctggcccttcagt

SEQ ID NO: 935654 - DNA, 15 bp, Homo sapiens
cctggccgccccctg

SEQ ID NO: 935655 - DNA, 22 bp, Homo sapiens
cctggccggcaaccccagttct

SEQ ID NO: 935656 - DNA, 22 bp, Homo sapiens
cctggccgggtcaccctgtgac

SEQ ID NO: 935657 - DNA, 22 bp, Homo sapiens
cctggcctagcatacgtacaca

SEQ ID NO: 935658 - DNA, 21 bp, Homo sapiens
cctggcctatccgctgccagc

SEQ ID NO: 935659 - DNA, 16 bp, Homo sapiens
cctggcctcactggct

SEQ ID NO: 935660 - DNA, 19 bp, Homo sapiens
cctggcctcactggctggg

SEQ ID NO: 935661 - DNA, 23 bp, Homo sapiens
cctggcctcactggctggggcag

SEQ ID NO: 935662 - DNA, 23 bp, Homo sapiens
cctggcctcacttgattcatctc

SEQ ID NO: 935663 - DNA, 20 bp, Homo sapiens
cctggcctcccctgccacca

SEQ ID NO: 935664 - DNA, 13 bp, Homo sapiens
cctggcctccttt

SEQ ID NO: 935665 - DNA, 21 bp, Homo sapiens
cctggcctcgcctgcctttct

SEQ ID NO: 935666 - DNA, 17 bp, Homo sapiens
cctggcctgaactgagg

SEQ ID NO: 935667 - DNA, 15 bp, Homo sapiens
cctggcctgagctgg

SEQ ID NO: 935668 - DNA, 16 bp, Homo sapiens
cctggcctgagctggg

SEQ ID NO: 935669 - DNA, 18 bp, Homo sapiens
cctggcctgagctggggc

SEQ ID NO: 935670 - DNA, 13 bp, Homo sapiens
cctggcctgccag

SEQ ID NO: 935671 - DNA, 17 bp, Homo sapiens
cctggcctgccagacac

SEQ ID NO: 935672 - DNA, 20 bp, Homo sapiens
cctggcctgccggacacagc

SEQ ID NO: 935673 - DNA, 15 bp, Homo sapiens
cctggcctgctggga

SEQ ID NO: 935674 - DNA, 12 bp, Homo sapiens
cctggcctggct

SEQ ID NO: 935675 - DNA, 13 bp, Homo sapiens
cctggcctggctg

SEQ ID NO: 935676 - DNA, 15 bp, Homo sapiens
cctggcctggctggg

SEQ ID NO: 935677 - DNA, 17 bp, Homo sapiens
cctggcctggctgggtg

SEQ ID NO: 935678 - DNA, 15 bp, Homo sapiens
cctggcctgggccac

SEQ ID NO: 935679 - DNA, 17 bp, Homo sapiens
cctggcctgggccacac

SEQ ID NO: 935680 - DNA, 13 bp, Homo sapiens
cctggcctgttct

SEQ ID NO: 935681 - DNA, 14 bp, Homo sapiens
cctggccttctgaa

SEQ ID NO: 935682 - DNA, 23 bp, Homo sapiens
cctggccttgcccgtcgtgtgct

SEQ ID NO: 935683 - DNA, 22 bp, Homo sapiens
cctggccttgtcctcagccagt

SEQ ID NO: 935684 - DNA, 13 bp, Homo sapiens
cctggcctttttc

SEQ ID NO: 935685 - DNA, 19 bp, Homo sapiens
cctggcgcccctgcccccc

SEQ ID NO: 935686 - DNA, 15 bp, Homo sapiens
cctggcggccccaac

SEQ ID NO: 935687 - DNA, 14 bp, Homo sapiens
cctggcggcctgtg

SEQ ID NO: 935688 - DNA, 16 bp, Homo sapiens
cctggcggcctgtggg

SEQ ID NO: 935689 - DNA, 18 bp, Homo sapiens
cctggcggggttggccct

SEQ ID NO: 935690 - DNA, 16 bp, Homo sapiens
cctggcgtgctcagac

SEQ ID NO: 935691 - DNA, 17 bp, Homo sapiens
cctggctaacacggtga

SEQ ID NO: 935692 - DNA, 23 bp, Homo sapiens
cctggctacagggcgagactctg

SEQ ID NO: 935693 - DNA, 14 bp, Homo sapiens
cctggctacatccc

SEQ ID NO: 935694 - DNA, 14 bp, Homo sapiens
cctggctccagtga

SEQ ID NO: 935695 - DNA, 23 bp, Homo sapiens
cctggctcccacaggcccttcct

SEQ ID NO: 935696 - DNA, 15 bp, Homo sapiens
cctggctcccatgac

SEQ ID NO: 935697 - DNA, 21 bp, Homo sapiens
cctggctcccatgaccatact

SEQ ID NO: 935698 - DNA, 22 bp, Homo sapiens
cctggctcccatgaccatactg

SEQ ID NO: 935699 - DNA, 22 bp, Homo sapiens
cctggctccccacgagtcacct

SEQ ID NO: 935700 - DNA, 13 bp, Homo sapiens
cctggctccccga

SEQ ID NO: 935701 - DNA, 14 bp, Homo sapiens
cctggctccctcct

SEQ ID NO: 935702 - DNA, 15 bp, Homo sapiens
cctggctccctcctc

SEQ ID NO: 935703 - DNA, 20 bp, Homo sapiens
cctggctccctcctccaggc

SEQ ID NO: 935704 - DNA, 15 bp, Homo sapiens
cctggctccgcaggg

SEQ ID NO: 935705 - DNA, 16 bp, Homo sapiens
cctggctcctccgtct

SEQ ID NO: 935706 - DNA, 15 bp, Homo sapiens
cctggctcctgaggg

SEQ ID NO: 935707 - DNA, 14 bp, Homo sapiens
cctggctccttgca

SEQ ID NO: 935708 - DNA, 20 bp, Homo sapiens
cctggctccttgcagcaggg

SEQ ID NO: 935709 - DNA, 13 bp, Homo sapiens
cctggctcgcagg

SEQ ID NO: 935710 - DNA, 15 bp, Homo sapiens
cctggctctaccctg

SEQ ID NO: 935711 - DNA, 11 bp, Homo sapiens
cctggctctgc

SEQ ID NO: 935712 - DNA, 13 bp, Homo sapiens
cctggctctgccc

SEQ ID NO: 935713 - DNA, 15 bp, Homo sapiens
cctggctctgccccc

SEQ ID NO: 935714 - DNA, 17 bp, Homo sapiens
cctggctctgcccctca

SEQ ID NO: 935715 - DNA, 12 bp, Homo sapiens
cctggctctggg

SEQ ID NO: 935716 - DNA, 13 bp, Homo sapiens
cctggctctgggc

SEQ ID NO: 935717 - DNA, 21 bp, Homo sapiens
cctggctctgggggacccagg

SEQ ID NO: 935718 - DNA, 23 bp, Homo sapiens
cctggctgaggttcctctgcctg

SEQ ID NO: 935719 - DNA, 19 bp, Homo sapiens
cctggctgatgatccagaa

SEQ ID NO: 935720 - DNA, 12 bp, Homo sapiens
cctggctgcact

SEQ ID NO: 935721 - DNA, 13 bp, Homo sapiens
cctggctgccagg

SEQ ID NO: 935722 - DNA, 14 bp, Homo sapiens
cctggctgccaggc

SEQ ID NO: 935723 - DNA, 18 bp, Homo sapiens
cctggctgccaggcgttg

SEQ ID NO: 935724 - DNA, 14 bp, Homo sapiens
cctggctgccctgg

SEQ ID NO: 935725 - DNA, 18 bp, Homo sapiens
cctggctgccctggccct

SEQ ID NO: 935726 - DNA, 20 bp, Homo sapiens
cctggctgccctggccctga

SEQ ID NO: 935727 - DNA, 13 bp, Homo sapiens
cctggctgcctgg

SEQ ID NO: 935728 - DNA, 15 bp, Homo sapiens
cctggctgctaggcc

SEQ ID NO: 935729 - DNA, 18 bp, Homo sapiens
cctggctgctaggccaga

SEQ ID NO: 935730 - DNA, 14 bp, Homo sapiens
cctggctgctgccc

SEQ ID NO: 935731 - DNA, 15 bp, Homo sapiens
cctggctgctgcccc

SEQ ID NO: 935732 - DNA, 18 bp, Homo sapiens
cctggctggagagctgct

SEQ ID NO: 935733 - DNA, 21 bp, Homo sapiens
cctggctggaggagcagcagc

SEQ ID NO: 935734 - DNA, 22 bp, Homo sapiens
cctggctggaggagcagcagct

SEQ ID NO: 935735 - DNA, 12 bp, Homo sapiens
cctggctgtaaa

SEQ ID NO: 935736 - DNA, 22 bp, Homo sapiens
cctggctgtccaaccagacttt

SEQ ID NO: 935737 - DNA, 15 bp, Homo sapiens
cctggctgtgcccag

SEQ ID NO: 935738 - DNA, 17 bp, Homo sapiens
cctggctgtgcccagca

SEQ ID NO: 935739 - DNA, 19 bp, Homo sapiens
cctggctgtgcccagcagg

SEQ ID NO: 935740 - DNA, 18 bp, Homo sapiens
cctggctgtggaggcctg

SEQ ID NO: 935741 - DNA, 21 bp, Homo sapiens
cctggctgttctgtggttcct

SEQ ID NO: 935742 - DNA, 16 bp, Homo sapiens
cctggcttcactctcc

SEQ ID NO: 935743 - DNA, 18 bp, Homo sapiens
cctggcttcactctccct

SEQ ID NO: 935744 - DNA, 13 bp, Homo sapiens
cctggcttctgga

SEQ ID NO: 935745 - DNA, 21 bp, Homo sapiens
cctggcttctggagcccttgg

SEQ ID NO: 935746 - DNA, 14 bp, Homo sapiens
cctggcttgctcca

SEQ ID NO: 935747 - DNA, 21 bp, Homo sapiens
cctggcttgcttgccgagcct

SEQ ID NO: 935748 - DNA, 18 bp, Homo sapiens
cctggcttgtaactccac

SEQ ID NO: 935749 - DNA, 15 bp, Homo sapiens
cctggctttccagga

SEQ ID NO: 935750 - DNA, 16 bp, Homo sapiens
cctggcttttcactgc

SEQ ID NO: 935751 - DNA, 23 bp, Homo sapiens
cctggcttttcactgctggctgc

SEQ ID NO: 935752 - DNA, 24 bp, Homo sapiens
cctggcttttcactgctggctgcc

SEQ ID NO: 935753 - DNA, 15 bp, Homo sapiens
cctggctttttaaaa

SEQ ID NO: 935754 - DNA, 23 bp, Homo sapiens
cctggctttttaaaatatatgta

SEQ ID NO: 935755 - DNA, 15 bp, Homo sapiens
cctgggaaaggaccc

SEQ ID NO: 935756 - DNA, 21 bp, Homo sapiens
cctgggaaaggacccacccat

SEQ ID NO: 935757 - DNA, 17 bp, Homo sapiens
cctgggaaatattccct

SEQ ID NO: 935758 - DNA, 21 bp, Homo sapiens
cctgggaacacatctggctgc

SEQ ID NO: 935759 - DNA, 14 bp, Homo sapiens
cctgggaacaggcc

SEQ ID NO: 935760 - DNA, 17 bp, Homo sapiens
cctgggaacaggcccca

SEQ ID NO: 935761 - DNA, 22 bp, Homo sapiens
cctgggaacaggccccacgccc

SEQ ID NO: 935762 - DNA, 17 bp, Homo sapiens
cctgggaagcccaccca

SEQ ID NO: 935763 - DNA, 16 bp, Homo sapiens
cctgggaatggaataa

SEQ ID NO: 935764 - DNA, 21 bp, Homo sapiens
cctgggaatggaataactatc

SEQ ID NO: 935765 - DNA, 14 bp, Homo sapiens
cctgggaatgtatt

SEQ ID NO: 935766 - DNA, 14 bp, Homo sapiens
cctgggacacacac

SEQ ID NO: 935767 - DNA, 20 bp, Homo sapiens
attttctgtcagatgagaac

SEQ ID NO: 935768 - DNA, 23 bp, Homo sapiens
attttctgtgttttgctgtacca

SEQ ID NO: 935769 - DNA, 16 bp, Homo sapiens
attttcttacttttat

SEQ ID NO: 935770 - DNA, 19 bp, Homo sapiens
attttcttatcttctgcaa

SEQ ID NO: 935771 - DNA, 21 bp, Homo sapiens
attttcttattgcgctgctac

SEQ ID NO: 935772 - DNA, 19 bp, Homo sapiens
attttcttctctgtgaagt

SEQ ID NO: 935773 - DNA, 15 bp, Homo sapiens
attttcttgtttaac

SEQ ID NO: 935774 - DNA, 18 bp, Homo sapiens
attttctttaatgctttt

SEQ ID NO: 935775 - DNA, 17 bp, Homo sapiens
cctgggaccccctcgcc

SEQ ID NO: 935776 - DNA, 14 bp, Homo sapiens
cctgggacccttgg

SEQ ID NO: 935777 - DNA, 20 bp, Homo sapiens
cctgggacctcccctgaggc

SEQ ID NO: 935778 - DNA, 16 bp, Homo sapiens
cctgggactcccagtg

SEQ ID NO: 935779 - DNA, 13 bp, Homo sapiens
cctgggactcgga

SEQ ID NO: 935780 - DNA, 14 bp, Homo sapiens
cctgggagcccaga

SEQ ID NO: 935781 - DNA, 18 bp, Homo sapiens
cctgggagggttcccctg

SEQ ID NO: 935782 - DNA, 20 bp, Homo sapiens
cctgggagggttcccctggc

SEQ ID NO: 935783 - DNA, 18 bp, Homo sapiens
cctgggagtgggtggagg

SEQ ID NO: 935784 - DNA, 20 bp, Homo sapiens
cctgggatctggtggtcagc

SEQ ID NO: 935785 - DNA, 21 bp, Homo sapiens
cctgggatctggtggtcagcc

SEQ ID NO: 935786 - DNA, 22 bp, Homo sapiens
cctgggatgaggggtgctgggt

SEQ ID NO: 935787 - DNA, 15 bp, Homo sapiens
cctgggatgcctcac

SEQ ID NO: 935788 - DNA, 19 bp, Homo sapiens
cctgggatgctgacccagg

SEQ ID NO: 935789 - DNA, 18 bp, Homo sapiens
cctgggatgggctcccac

SEQ ID NO: 935790 - DNA, 14 bp, Homo sapiens
cctgggatttgaga

SEQ ID NO: 935791 - DNA, 15 bp, Homo sapiens
cctgggatttgagat

SEQ ID NO: 935792 - DNA, 18 bp, Homo sapiens
cctgggcacccacctcca

SEQ ID NO: 935793 - DNA, 20 bp, Homo sapiens
cctgggcacccacctccacc

SEQ ID NO: 935794 - DNA, 22 bp, Homo sapiens
cctgggcacccacctccacccc

SEQ ID NO: 935795 - DNA, 17 bp, Homo sapiens
cctgggcacctggggag

SEQ ID NO: 935796 - DNA, 22 bp, Homo sapiens
cctgggcagagggcctggacct

SEQ ID NO: 935797 - DNA, 18 bp, Homo sapiens
cctgggcagccaggctgc

SEQ ID NO: 935798 - DNA, 23 bp, Homo sapiens
cctgggcagccaggctgccaagg

SEQ ID NO: 935799 - DNA, 14 bp, Homo sapiens
cctgggcagcccca

SEQ ID NO: 935800 - DNA, 10 bp, Homo sapiens
cctgggcagg

SEQ ID NO: 935801 - DNA, 22 bp, Homo sapiens
cctgggcaggaccctgctgact

SEQ ID NO: 935802 - DNA, 20 bp, Homo sapiens
cctgggcaggtgggagctga

SEQ ID NO: 935803 - DNA, 16 bp, Homo sapiens
cctgggcatccttctt

SEQ ID NO: 935804 - DNA, 20 bp, Homo sapiens
cctgggcatcttctggcttg

SEQ ID NO: 935805 - DNA, 18 bp, Homo sapiens
cctgggcatgggtccagg

SEQ ID NO: 935806 - DNA, 14 bp, Homo sapiens
cctgggcattgctt

SEQ ID NO: 935807 - DNA, 13 bp, Homo sapiens
cctgggccagaga

SEQ ID NO: 935808 - DNA, 12 bp, Homo sapiens
cctgggccaggc

SEQ ID NO: 935809 - DNA, 17 bp, Homo sapiens
cctgggccaggcaggcg

SEQ ID NO: 935810 - DNA, 14 bp, Homo sapiens
cctgggccagggtc

SEQ ID NO: 935811 - DNA, 16 bp, Homo sapiens
cctgggccagggtctg

SEQ ID NO: 935812 - DNA, 20 bp, Homo sapiens
cctgggcccacagagcctgg

SEQ ID NO: 935813 - DNA, 20 bp, Homo sapiens
cctgggcccatctccctgct

SEQ ID NO: 935814 - DNA, 13 bp, Homo sapiens
cctgggccccacc

SEQ ID NO: 935815 - DNA, 14 bp, Homo sapiens
cctgggccccacca

SEQ ID NO: 935816 - DNA, 15 bp, Homo sapiens
cctgggccccactgg

SEQ ID NO: 935817 - DNA, 19 bp, Homo sapiens
cctgggccccactggacaa

SEQ ID NO: 935818 - DNA, 21 bp, Homo sapiens
cctgggccccactggacaaca

SEQ ID NO: 935819 - DNA, 24 bp, Homo sapiens
cctgggccccactggacaacactg

SEQ ID NO: 935820 - DNA, 13 bp, Homo sapiens
cctgggcccctcc

SEQ ID NO: 935821 - DNA, 15 bp, Homo sapiens
cctgggcccctccac

SEQ ID NO: 935822 - DNA, 21 bp, Homo sapiens
cctgggcccctcccctcagag

SEQ ID NO: 935823 - DNA, 11 bp, Homo sapiens
cctgggccctc

SEQ ID NO: 935824 - DNA, 14 bp, Homo sapiens
cctgggccctctct

SEQ ID NO: 935825 - DNA, 15 bp, Homo sapiens
cctgggccctgggct

SEQ ID NO: 935826 - DNA, 16 bp, Homo sapiens
cctgggcccttgtgct

SEQ ID NO: 935827 - DNA, 16 bp, Homo sapiens
cctgggccgctgccac

SEQ ID NO: 935828 - DNA, 17 bp, Homo sapiens
cctgggccgtggcacag

SEQ ID NO: 935829 - DNA, 12 bp, Homo sapiens
cctgggcctgtc

SEQ ID NO: 935830 - DNA, 15 bp, Homo sapiens
cctgggcctgtcccc

SEQ ID NO: 935831 - DNA, 20 bp, Homo sapiens
cctgggcctgtcccccaagg

SEQ ID NO: 935832 - DNA, 15 bp, Homo sapiens
cctgggcctgtgcag

SEQ ID NO: 935833 - DNA, 15 bp, Homo sapiens
cctgggccttggctg

SEQ ID NO: 935834 - DNA, 12 bp, Homo sapiens
cctgggcgccct

SEQ ID NO: 935835 - DNA, 22 bp, Homo sapiens
cctgggcggagtccccggggtt

SEQ ID NO: 935836 - DNA, 23 bp, Homo sapiens
cctgggctcaagcaatcctcctg

SEQ ID NO: 935837 - DNA, 22 bp, Homo sapiens
cctgggctcactgtgctggggc

SEQ ID NO: 935838 - DNA, 14 bp, Homo sapiens
cctgggctcagcct

SEQ ID NO: 935839 - DNA, 16 bp, Homo sapiens
cctgggctcagcctga

SEQ ID NO: 935840 - DNA, 14 bp, Homo sapiens
cctgggctctgaac

SEQ ID NO: 935841 - DNA, 12 bp, Homo sapiens
cctgggctctgc

SEQ ID NO: 935842 - DNA, 20 bp, Homo sapiens
cctgggctctgccccagctc

SEQ ID NO: 935843 - DNA, 22 bp, Homo sapiens
cctgggctctgccccagctctg

SEQ ID NO: 935844 - DNA, 15 bp, Homo sapiens
cctgggctctggaag

SEQ ID NO: 935845 - DNA, 14 bp, Homo sapiens
cctgggctggaatc

SEQ ID NO: 935846 - DNA, 20 bp, Homo sapiens
cctgggctggaatcaggaat

SEQ ID NO: 935847 - DNA, 15 bp, Homo sapiens
cctgggctggactgg

SEQ ID NO: 935848 - DNA, 16 bp, Homo sapiens
cctgggctggactgga

SEQ ID NO: 935849 - DNA, 18 bp, Homo sapiens
cctgggctggactggagg

SEQ ID NO: 935850 - DNA, 13 bp, Homo sapiens
cctgggctgggaa

SEQ ID NO: 935851 - DNA, 14 bp, Homo sapiens
cctgggctgggcag

SEQ ID NO: 935852 - DNA, 16 bp, Homo sapiens
cctgggctgggcagcc

SEQ ID NO: 935853 - DNA, 17 bp, Homo sapiens
cctgggctgggcagcct

SEQ ID NO: 935854 - DNA, 19 bp, Homo sapiens
cctgggctgggcagccttg

SEQ ID NO: 935855 - DNA, 22 bp, Homo sapiens
cctgggctggggcctcagaccc

SEQ ID NO: 935856 - DNA, 19 bp, Homo sapiens
cctgggctgggtggcccct

SEQ ID NO: 935857 - DNA, 19 bp, Homo sapiens
cctgggctgtccagcctta

SEQ ID NO: 935858 - DNA, 18 bp, Homo sapiens
cctgggctgtctgtcacc

SEQ ID NO: 935859 - DNA, 14 bp, Homo sapiens
cctgggctgtgcta

SEQ ID NO: 935860 - DNA, 20 bp, Homo sapiens
cctgggctgttggcactcac

SEQ ID NO: 935861 - DNA, 23 bp, Homo sapiens
cctgggcttggcccgcggcctgc

SEQ ID NO: 935862 - DNA, 19 bp, Homo sapiens
cctgggcttggcctgctgt

SEQ ID NO: 935863 - DNA, 20 bp, Homo sapiens
cctgggcttggcctgctgtg

SEQ ID NO: 935864 - DNA, 16 bp, Homo sapiens
cctgggcttggctctt

SEQ ID NO: 935865 - DNA, 20 bp, Homo sapiens
cctgggcttggtaagtgaat

SEQ ID NO: 935866 - DNA, 15 bp, Homo sapiens
cctggggacagagcc

SEQ ID NO: 935867 - DNA, 16 bp, Homo sapiens
cctggggacagagcca

SEQ ID NO: 935868 - DNA, 18 bp, Homo sapiens
cctggggacagagccacc

SEQ ID NO: 935869 - DNA, 13 bp, Homo sapiens
cctggggactcct

SEQ ID NO: 935870 - DNA, 15 bp, Homo sapiens
cctggggactcctca

SEQ ID NO: 935871 - DNA, 16 bp, Homo sapiens
cctggggactcctcaa

SEQ ID NO: 935872 - DNA, 21 bp, Homo sapiens
cctggggagaaagaggggcct

SEQ ID NO: 935873 - DNA, 15 bp, Homo sapiens
cctggggagccctca

SEQ ID NO: 935874 - DNA, 22 bp, Homo sapiens
cctggggagccctcaggctccc

SEQ ID NO: 935875 - DNA, 20 bp, Homo sapiens
cctggggagctcctgggacc

SEQ ID NO: 935876 - DNA, 14 bp, Homo sapiens
cctggggaggccct

SEQ ID NO: 935877 - DNA, 24 bp, Homo sapiens
cctggggagtgggacagagtctgg

SEQ ID NO: 935878 - DNA, 22 bp, Homo sapiens
cctggggatgtaaccaagctgt

SEQ ID NO: 935879 - DNA, 14 bp, Homo sapiens
cctggggcccaagt

SEQ ID NO: 935880 - DNA, 13 bp, Homo sapiens
cctggggcccagc

SEQ ID NO: 935881 - DNA, 17 bp, Homo sapiens
cctggggcccagcccct

SEQ ID NO: 935882 - DNA, 13 bp, Homo sapiens
cctggggccccgc

SEQ ID NO: 935883 - DNA, 18 bp, Homo sapiens
cctggggccccgctggga

SEQ ID NO: 935884 - DNA, 16 bp, Homo sapiens
cctggggccgcctgcc

SEQ ID NO: 935885 - DNA, 21 bp, Homo sapiens
cctggggcctccagaagctgc

SEQ ID NO: 935886 - DNA, 22 bp, Homo sapiens
cctggggcctcggagcctcatc

SEQ ID NO: 935887 - DNA, 16 bp, Homo sapiens
cctggggcctgactgc

SEQ ID NO: 935888 - DNA, 15 bp, Homo sapiens
cctggggcctgagag

SEQ ID NO: 935889 - DNA, 20 bp, Homo sapiens
atttttaaaaaatattttct

SEQ ID NO: 935890 - DNA, 17 bp, Homo sapiens
atttttaaaaagaaatc

SEQ ID NO: 935891 - DNA, 20 bp, Homo sapiens
atttttaaaatatttaactt

SEQ ID NO: 935892 - DNA, 12 bp, Homo sapiens
atttttaaaggt

SEQ ID NO: 935893 - DNA, 19 bp, Homo sapiens
atttttaaaggtacactgg

SEQ ID NO: 935894 - DNA, 14 bp, Homo sapiens
atttttaaagtaga

SEQ ID NO: 935895 - DNA, 13 bp, Homo sapiens
atttttaaagtct

SEQ ID NO: 935896 - DNA, 15 bp, Homo sapiens
atttttaaatgtgtt

SEQ ID NO: 935897 - DNA, 15 bp, Homo sapiens
atttttaacaaaaaa

SEQ ID NO: 935898 - DNA, 22 bp, Homo sapiens
atttttaactctggattttgaa

SEQ ID NO: 935899 - DNA, 23 bp, Homo sapiens
atttttaactctggattttgaat

SEQ ID NO: 935900 - DNA, 17 bp, Homo sapiens
atttttaagactgtaat

SEQ ID NO: 935901 - DNA, 15 bp, Homo sapiens
atttttaagctccat

SEQ ID NO: 935902 - DNA, 21 bp, Homo sapiens
atttttaagctccatgtgcat

SEQ ID NO: 935903 - DNA, 20 bp, Homo sapiens
cctgggggcagtgactggca

SEQ ID NO: 935904 - DNA, 14 bp, Homo sapiens
cctgggggctctca

SEQ ID NO: 935905 - DNA, 13 bp, Homo sapiens
cctgggggctggc

SEQ ID NO: 935906 - DNA, 14 bp, Homo sapiens
cctgggggctggct

SEQ ID NO: 935907 - DNA, 19 bp, Homo sapiens
cctggggggaacggatgct

SEQ ID NO: 935908 - DNA, 16 bp, Homo sapiens
cctgggggtgccagga

SEQ ID NO: 935909 - DNA, 18 bp, Homo sapiens
cctgggggttctttcttc

SEQ ID NO: 935910 - DNA, 21 bp, Homo sapiens
cctgggggttctttcttcctc

SEQ ID NO: 935911 - DNA, 23 bp, Homo sapiens
cctgggggttctttcttcctctg

SEQ ID NO: 935912 - DNA, 18 bp, Homo sapiens
cctggggtctctctccct

SEQ ID NO: 935913 - DNA, 15 bp, Homo sapiens
cctggggtctgagca

SEQ ID NO: 935914 - DNA, 21 bp, Homo sapiens
cctggggtgcatcctcctcag

SEQ ID NO: 935915 - DNA, 17 bp, Homo sapiens
cctggggtggccagggc

SEQ ID NO: 935916 - DNA, 19 bp, Homo sapiens
cctggggtgggacagggag

SEQ ID NO: 935917 - DNA, 19 bp, Homo sapiens
cctggggtgggatctgagc

SEQ ID NO: 935918 - DNA, 17 bp, Homo sapiens
cctggggtgtcctacag

SEQ ID NO: 935919 - DNA, 21 bp, Homo sapiens
cctggggtttgaagctgactt

SEQ ID NO: 935920 - DNA, 20 bp, Homo sapiens
cctgggtatcccctgcctcc

SEQ ID NO: 935921 - DNA, 23 bp, Homo sapiens
cctgggtatcccctgcctcctgc

SEQ ID NO: 935922 - DNA, 18 bp, Homo sapiens
cctgggtatgttcctaag

SEQ ID NO: 935923 - DNA, 16 bp, Homo sapiens
cctgggtcacttgctg

SEQ ID NO: 935924 - DNA, 23 bp, Homo sapiens
cctgggtgagaatcctgcctctc

SEQ ID NO: 935925 - DNA, 13 bp, Homo sapiens
cctgggtgccctg

SEQ ID NO: 935926 - DNA, 16 bp, Homo sapiens
cctgggtgctggctgc

SEQ ID NO: 935927 - DNA, 21 bp, Homo sapiens
cctgggtggggctgctcctcc

SEQ ID NO: 935928 - DNA, 20 bp, Homo sapiens
cctgggtgggtggggtacag

SEQ ID NO: 935929 - DNA, 16 bp, Homo sapiens
cctgggttctggggca

SEQ ID NO: 935930 - DNA, 17 bp, Homo sapiens
cctgggttggagggaac

SEQ ID NO: 935931 - DNA, 22 bp, Homo sapiens
cctgggttgtttccaggagaaa

SEQ ID NO: 935932 - DNA, 19 bp, Homo sapiens
cctgggttttgtattctct

SEQ ID NO: 935933 - DNA, 22 bp, Homo sapiens
cctgggttttgtattctctgag

SEQ ID NO: 935934 - DNA, 23 bp, Homo sapiens
cctgggttttgtattctctgagc

SEQ ID NO: 935935 - DNA, 23 bp, Homo sapiens
cctggtaaccaaatattaaagat

SEQ ID NO: 935936 - DNA, 17 bp, Homo sapiens
cctggtaagcagaggct

SEQ ID NO: 935937 - DNA, 13 bp, Homo sapiens
cctggtacccagc

SEQ ID NO: 935938 - DNA, 22 bp, Homo sapiens
cctggtacccagccatctgccc

SEQ ID NO: 935939 - DNA, 18 bp, Homo sapiens
cctggtagaattgggaag

SEQ ID NO: 935940 - DNA, 23 bp, Homo sapiens
cctggtagcacatgtctgtcctc

SEQ ID NO: 935941 - DNA, 22 bp, Homo sapiens
cctggtagtgtagctgtgtggc

SEQ ID NO: 935942 - DNA, 20 bp, Homo sapiens
cctggtatatccaaaagctt

SEQ ID NO: 935943 - DNA, 21 bp, Homo sapiens
cctggtcacaggactctgcct

SEQ ID NO: 935944 - DNA, 20 bp, Homo sapiens
cctggtcaccaaggcagtgc

SEQ ID NO: 935945 - DNA, 20 bp, Homo sapiens
cctggtcaccctggggctgc

SEQ ID NO: 935946 - DNA, 19 bp, Homo sapiens
cctggtcatacgggtcagt

SEQ ID NO: 935947 - DNA, 21 bp, Homo sapiens
cctggtccagggaagctggcc

SEQ ID NO: 935948 - DNA, 13 bp, Homo sapiens
cctggtccatgca

SEQ ID NO: 935949 - DNA, 20 bp, Homo sapiens
cctggtcccacgagggtgcc

SEQ ID NO: 935950 - DNA, 15 bp, Homo sapiens
cctggtccccactgc

SEQ ID NO: 935951 - DNA, 15 bp, Homo sapiens
cctggtccctcgtcc

SEQ ID NO: 935952 - DNA, 14 bp, Homo sapiens
cctggtccctggga

SEQ ID NO: 935953 - DNA, 15 bp, Homo sapiens
cctggtcctggacac

SEQ ID NO: 935954 - DNA, 20 bp, Homo sapiens
cctggtcctggacacctccc

SEQ ID NO: 935955 - DNA, 22 bp, Homo sapiens
cctggtcctggacacctcccag

SEQ ID NO: 935956 - DNA, 14 bp, Homo sapiens
cctggtcctggctg

SEQ ID NO: 935957 - DNA, 16 bp, Homo sapiens
cctggtcctggctgca

SEQ ID NO: 935958 - DNA, 19 bp, Homo sapiens
cctggtcctggctgcactc

SEQ ID NO: 935959 - DNA, 15 bp, Homo sapiens
cctggtccttccagg

SEQ ID NO: 935960 - DNA, 19 bp, Homo sapiens
cctggtcgtctatcccagt

SEQ ID NO: 935961 - DNA, 13 bp, Homo sapiens
cctggtctcttca

SEQ ID NO: 935962 - DNA, 15 bp, Homo sapiens
cctggtctgtctgga

SEQ ID NO: 935963 - DNA, 15 bp, Homo sapiens
cctggtgacctcctg

SEQ ID NO: 935964 - DNA, 20 bp, Homo sapiens
cctggtgaggcccagcctgt

SEQ ID NO: 935965 - DNA, 15 bp, Homo sapiens
cctggtgccctgaga

SEQ ID NO: 935966 - DNA, 18 bp, Homo sapiens
cctggtgccctggatgcc

SEQ ID NO: 935967 - DNA, 21 bp, Homo sapiens
cctggtgccctggatgcccag

SEQ ID NO: 935968 - DNA, 15 bp, Homo sapiens
cctggtgcctctgtg

SEQ ID NO: 935969 - DNA, 9 bp, Homo sapiens
cctggtgct

SEQ ID NO: 935970 - DNA, 15 bp, Homo sapiens
cctggtgctcctgcc

SEQ ID NO: 935971 - DNA, 20 bp, Homo sapiens
cctggtgctcctgcccagcc

SEQ ID NO: 935972 - DNA, 13 bp, Homo sapiens
cctggtgctctct

SEQ ID NO: 935973 - DNA, 21 bp, Homo sapiens
cctggtgctgccacacttcag

SEQ ID NO: 935974 - DNA, 12 bp, Homo sapiens
cctggtgctgct

SEQ ID NO: 935975 - DNA, 16 bp, Homo sapiens
cctggtgcttcccacg

SEQ ID NO: 935976 - DNA, 12 bp, Homo sapiens
cctggtggacag

SEQ ID NO: 935977 - DNA, 18 bp, Homo sapiens
cctggtggacagtcctgg

SEQ ID NO: 935978 - DNA, 13 bp, Homo sapiens
cctggtggcacca

SEQ ID NO: 935979 - DNA, 18 bp, Homo sapiens
cctggtgggcctcctctg

SEQ ID NO: 935980 - DNA, 20 bp, Homo sapiens
cctggtgggcctcctctgtc

SEQ ID NO: 935981 - DNA, 16 bp, Homo sapiens
cctggtgggggaaggg

SEQ ID NO: 935982 - DNA, 19 bp, Homo sapiens
cctggtgggggaaggggag

SEQ ID NO: 935983 - DNA, 17 bp, Homo sapiens
cctggtgggtcaggggg

SEQ ID NO: 935984 - DNA, 16 bp, Homo sapiens
cctggtggtattttca

SEQ ID NO: 935985 - DNA, 19 bp, Homo sapiens
cctggtggtattttcaata

SEQ ID NO: 935986 - DNA, 21 bp, Homo sapiens
cctggtgtgcggaggcaggag

SEQ ID NO: 935987 - DNA, 23 bp, Homo sapiens
cctggtgtgcggaggcaggagca

SEQ ID NO: 935988 - DNA, 23 bp, Homo sapiens
cctggttaagcaggcattgcttt

SEQ ID NO: 935989 - DNA, 15 bp, Homo sapiens
cctggttcagacaca

SEQ ID NO: 935990 - DNA, 22 bp, Homo sapiens
cctggttcccgtttctccacct

SEQ ID NO: 935991 - DNA, 19 bp, Homo sapiens
cctggttgcctctcttgcc

SEQ ID NO: 935992 - DNA, 22 bp, Homo sapiens
cctggttgcctctcttgcccct

SEQ ID NO: 935993 - DNA, 14 bp, Homo sapiens
cctggtttcctttc

SEQ ID NO: 935994 - DNA, 18 bp, Homo sapiens
cctggtttctgttctgtt

SEQ ID NO: 935995 - DNA, 22 bp, Homo sapiens
cctggtttgcaaagaccacctc

SEQ ID NO: 935996 - DNA, 23 bp, Homo sapiens
cctggtttgcaaagaccacctcc

SEQ ID NO: 935997 - DNA, 17 bp, Homo sapiens
cctggtttgcagctgtt

SEQ ID NO: 935998 - DNA, 14 bp, Homo sapiens
cctggtttttgcct

SEQ ID NO: 935999 - DNA, 18 bp, Homo sapiens
cctggtttttgtagcctt

SEQ ID NO: 936000 - DNA, 19 bp, Homo sapiens
cctggtttttgtagccttc

SEQ ID NO: 936001 - DNA, 14 bp, Homo sapiens
cctgtaaaacttta

SEQ ID NO: 936002 - DNA, 20 bp, Homo sapiens
cctgtaaactttatcactta

SEQ ID NO: 936003 - DNA, 12 bp, Homo sapiens
cctgtaaataag

SEQ ID NO: 936004 - DNA, 17 bp, Homo sapiens
cctgtaaataagagttg

SEQ ID NO: 936005 - DNA, 13 bp, Homo sapiens
cctgtaaatatat

SEQ ID NO: 936006 - DNA, 20 bp, Homo sapiens
cctgtaacacaagccacaga

SEQ ID NO: 936007 - DNA, 19 bp, Homo sapiens
cctgtaacatactggcctg

SEQ ID NO: 936008 - DNA, 17 bp, Homo sapiens
cctgtaactacaatgat

SEQ ID NO: 936009 - DNA, 19 bp, Homo sapiens
cctgtaactacaatgatgg

SEQ ID NO: 936010 - DNA, 17 bp, Homo sapiens
atttttgttttgaaagt

SEQ ID NO: 936011 - DNA, 19 bp, Homo sapiens
attttttaaaaaagcttaa

SEQ ID NO: 936012 - DNA, 13 bp, Homo sapiens
attttttaaaaag

SEQ ID NO: 936013 - DNA, 23 bp, Homo sapiens
attttttaaaacaagccaagaaa

SEQ ID NO: 936014 - DNA, 21 bp, Homo sapiens
attttttaaaacactaaaagc

SEQ ID NO: 936015 - DNA, 14 bp, Homo sapiens
attttttaaaataa

SEQ ID NO: 936016 - DNA, 19 bp, Homo sapiens
attttttaaatatttgaga

SEQ ID NO: 936017 - DNA, 17 bp, Homo sapiens
attttttaaggaaacaa

SEQ ID NO: 936018 - DNA, 14 bp, Homo sapiens
attttttaaggact

SEQ ID NO: 936019 - DNA, 20 bp, Homo sapiens
attttttaagtatttatata

SEQ ID NO: 936020 - DNA, 13 bp, Homo sapiens
attttttaattgt

SEQ ID NO: 936021 - DNA, 19 bp, Homo sapiens
attttttaatttaaagctt

SEQ ID NO: 936022 - DNA, 19 bp, Homo sapiens
attttttacagctgcctgc

SEQ ID NO: 936023 - DNA, 17 bp, Homo sapiens
attttttataaatatca

SEQ ID NO: 936024 - DNA, 13 bp, Homo sapiens
attttttatactg

SEQ ID NO: 936025 - DNA, 17 bp, Homo sapiens
attttttatgtacaacc

SEQ ID NO: 936026 - DNA, 12 bp, Homo sapiens
attttttattgt

SEQ ID NO: 936027 - DNA, 15 bp, Homo sapiens
attttttattttact

SEQ ID NO: 936028 - DNA, 13 bp, Homo sapiens
attttttcagaaa

SEQ ID NO: 936029 - DNA, 12 bp, Homo sapiens
attttttccaaa

SEQ ID NO: 936030 - DNA, 10 bp, Homo sapiens
cctgtacctc

SEQ ID NO: 936031 - DNA, 14 bp, Homo sapiens
cctgtacctcagtg

SEQ ID NO: 936032 - DNA, 16 bp, Homo sapiens
cctgtacctcagtgga

SEQ ID NO: 936033 - DNA, 17 bp, Homo sapiens
cctgtaccttgctgtgg

SEQ ID NO: 936034 - DNA, 15 bp, Homo sapiens
cctgtactaaggagc

SEQ ID NO: 936035 - DNA, 15 bp, Homo sapiens
cctgtactagctttt

SEQ ID NO: 936036 - DNA, 17 bp, Homo sapiens
cctgtactattgcagac

SEQ ID NO: 936037 - DNA, 17 bp, Homo sapiens
cctgtacttgtcctcag

SEQ ID NO: 936038 - DNA, 18 bp, Homo sapiens
cctgtacttgtcctcagc

SEQ ID NO: 936039 - DNA, 22 bp, Homo sapiens
cctgtacttgtcctcagcttgg

SEQ ID NO: 936040 - DNA, 12 bp, Homo sapiens
cctgtacttttt

SEQ ID NO: 936041 - DNA, 18 bp, Homo sapiens
cctgtagacctagggagg

SEQ ID NO: 936042 - DNA, 14 bp, Homo sapiens
cctgtagactagtg

SEQ ID NO: 936043 - DNA, 21 bp, Homo sapiens
cctgtagagtgggagctgagt

SEQ ID NO: 936044 - DNA, 22 bp, Homo sapiens
cctgtagcaatggccagagcct

SEQ ID NO: 936045 - DNA, 23 bp, Homo sapiens
cctgtagcaatggccagagcctc

SEQ ID NO: 936046 - DNA, 12 bp, Homo sapiens
cctgtagcacac

SEQ ID NO: 936047 - DNA, 13 bp, Homo sapiens
cctgtagcagtga

SEQ ID NO: 936048 - DNA, 21 bp, Homo sapiens
cctgtagcagtgagaaaaagc

SEQ ID NO: 936049 - DNA, 18 bp, Homo sapiens
cctgtagcatcttctgga

SEQ ID NO: 936050 - DNA, 22 bp, Homo sapiens
cctgtagccccagtgacagcta

SEQ ID NO: 936051 - DNA, 14 bp, Homo sapiens
cctgtagctcagtc

SEQ ID NO: 936052 - DNA, 16 bp, Homo sapiens
cctgtagctcagtcat

SEQ ID NO: 936053 - DNA, 17 bp, Homo sapiens
cctgtagctcagtcatc

SEQ ID NO: 936054 - DNA, 15 bp, Homo sapiens
cctgtagctctgcct

SEQ ID NO: 936055 - DNA, 16 bp, Homo sapiens
cctgtagctctgcctc

SEQ ID NO: 936056 - DNA, 22 bp, Homo sapiens
cctgtagctttaaaaccacagc

SEQ ID NO: 936057 - DNA, 20 bp, Homo sapiens
cctgtaggcagaggctgccg

SEQ ID NO: 936058 - DNA, 19 bp, Homo sapiens
cctgtaggtcaggaccatc

SEQ ID NO: 936059 - DNA, 15 bp, Homo sapiens
cctgtagtcccagct

SEQ ID NO: 936060 - DNA, 13 bp, Homo sapiens
cctgtagtgagaa

SEQ ID NO: 936061 - DNA, 15 bp, Homo sapiens
cctgtagttaggaaa

SEQ ID NO: 936062 - DNA, 18 bp, Homo sapiens
cctgtagttaggaaataa

SEQ ID NO: 936063 - DNA, 22 bp, Homo sapiens
cctgtagttaggaaataaaacc

SEQ ID NO: 936064 - DNA, 15 bp, Homo sapiens
cctgtataagacact

SEQ ID NO: 936065 - DNA, 23 bp, Homo sapiens
cctgtataagtggaggcacttta

SEQ ID NO: 936066 - DNA, 16 bp, Homo sapiens
cctgtatacagtgcag

SEQ ID NO: 936067 - DNA, 19 bp, Homo sapiens
cctgtatacctcctccagc

SEQ ID NO: 936068 - DNA, 13 bp, Homo sapiens
cctgtatatagcc

SEQ ID NO: 936069 - DNA, 15 bp, Homo sapiens
cctgtatcttgtctg

SEQ ID NO: 936070 - DNA, 14 bp, Homo sapiens
cctgtatgagacag

SEQ ID NO: 936071 - DNA, 16 bp, Homo sapiens
cctgtatgtctccagt

SEQ ID NO: 936072 - DNA, 17 bp, Homo sapiens
cctgtatgtctccagta

SEQ ID NO: 936073 - DNA, 19 bp, Homo sapiens
cctgtattcctgacctccg

SEQ ID NO: 936074 - DNA, 23 bp, Homo sapiens
cctgtattcctgacctccgccat

SEQ ID NO: 936075 - DNA, 14 bp, Homo sapiens
cctgtattcttgtt

SEQ ID NO: 936076 - DNA, 18 bp, Homo sapiens
cctgtattcttgtttgaa

SEQ ID NO: 936077 - DNA, 16 bp, Homo sapiens
cctgtcaagttaacaa

SEQ ID NO: 936078 - DNA, 13 bp, Homo sapiens
cctgtcacaataa

SEQ ID NO: 936079 - DNA, 15 bp, Homo sapiens
cctgtcacaataaag

SEQ ID NO: 936080 - DNA, 14 bp, Homo sapiens
cctgtcacacactg

SEQ ID NO: 936081 - DNA, 18 bp, Homo sapiens
cctgtcacacactggacc

SEQ ID NO: 936082 - DNA, 20 bp, Homo sapiens
cctgtcactcactgaggcca

SEQ ID NO: 936083 - DNA, 12 bp, Homo sapiens
cctgtcagaggc

SEQ ID NO: 936084 - DNA, 13 bp, Homo sapiens
cctgtcagaggct

SEQ ID NO: 936085 - DNA, 13 bp, Homo sapiens
cctgtcagcctga

SEQ ID NO: 936086 - DNA, 15 bp, Homo sapiens
cctgtcagtagtgga

SEQ ID NO: 936087 - DNA, 19 bp, Homo sapiens
cctgtcagtttcccctctc

SEQ ID NO: 936088 - DNA, 21 bp, Homo sapiens
cctgtcatgcccccctcaaac

SEQ ID NO: 936089 - DNA, 16 bp, Homo sapiens
cctgtcattgtattca

SEQ ID NO: 936090 - DNA, 19 bp, Homo sapiens
cctgtccaacctaacccct

SEQ ID NO: 936091 - DNA, 16 bp, Homo sapiens
cctgtccacacccagc

SEQ ID NO: 936092 - DNA, 16 bp, Homo sapiens
cctgtccagcccccag

SEQ ID NO: 936093 - DNA, 22 bp, Homo sapiens
cctgtccaggatggagggtcca

SEQ ID NO: 936094 - DNA, 11 bp, Homo sapiens
cctgtcccacc

SEQ ID NO: 936095 - DNA, 12 bp, Homo sapiens
cctgtcccaccc

SEQ ID NO: 936096 - DNA, 16 bp, Homo sapiens
cctgtcccacccacac

SEQ ID NO: 936097 - DNA, 16 bp, Homo sapiens
cctgtcccaccccctt

SEQ ID NO: 936098 - DNA, 16 bp, Homo sapiens
cctgtcccacctcttc

SEQ ID NO: 936099 - DNA, 13 bp, Homo sapiens
cctgtcccacctg

SEQ ID NO: 936100 - DNA, 23 bp, Homo sapiens
cctgtcccagaggttatctgcct

SEQ ID NO: 936101 - DNA, 13 bp, Homo sapiens
cctgtcccaggac

SEQ ID NO: 936102 - DNA, 14 bp, Homo sapiens
cctgtcccaggccg

SEQ ID NO: 936103 - DNA, 21 bp, Homo sapiens
cctgtcccagggccctcccag

SEQ ID NO: 936104 - DNA, 16 bp, Homo sapiens
cctgtcccatgcaggc

SEQ ID NO: 936105 - DNA, 17 bp, Homo sapiens
cctgtcccattctagat

SEQ ID NO: 936106 - DNA, 18 bp, Homo sapiens
cctgtcccattctagatc

SEQ ID NO: 936107 - DNA, 14 bp, Homo sapiens
cctgtccccaagac

SEQ ID NO: 936108 - DNA, 13 bp, Homo sapiens
cctgtccccaccc

SEQ ID NO: 936109 - DNA, 15 bp, Homo sapiens
cctgtccccagacca

SEQ ID NO: 936110 - DNA, 19 bp, Homo sapiens
cctgtccccaggcccagcc

SEQ ID NO: 936111 - DNA, 20 bp, Homo sapiens
cctgtccccaggcccagccc

SEQ ID NO: 936112 - DNA, 19 bp, Homo sapiens
cctgtccccagtccccagc

SEQ ID NO: 936113 - DNA, 22 bp, Homo sapiens
cctgtccccagtccccagccct

SEQ ID NO: 936114 - DNA, 23 bp, Homo sapiens
cctgtccccagtccccagccctg

SEQ ID NO: 936115 - DNA, 14 bp, Homo sapiens
cctgtcccccaagg

SEQ ID NO: 936116 - DNA, 13 bp, Homo sapiens
cctgtcccccact

SEQ ID NO: 936117 - DNA, 16 bp, Homo sapiens
cctgtcccccactctc

SEQ ID NO: 936118 - DNA, 13 bp, Homo sapiens
cctgtcccccagc

SEQ ID NO: 936119 - DNA, 22 bp, Homo sapiens
cctgtcccccagcatcgggggc

SEQ ID NO: 936120 - DNA, 14 bp, Homo sapiens
cctgtcccccagct

SEQ ID NO: 936121 - DNA, 15 bp, Homo sapiens
cctgtcccccagctc

SEQ ID NO: 936122 - DNA, 14 bp, Homo sapiens
cctgtccccgcctt

SEQ ID NO: 936123 - DNA, 12 bp, Homo sapiens
cctgtcccctgg

SEQ ID NO: 936124 - DNA, 13 bp, Homo sapiens
cctgtcccctgga

SEQ ID NO: 936125 - DNA, 15 bp, Homo sapiens
cctgtccctctcagg

SEQ ID NO: 936126 - DNA, 22 bp, Homo sapiens
cctgtccctgccccgcccccca

SEQ ID NO: 936127 - DNA, 23 bp, Homo sapiens
cctgtccctgccccgccccccag

SEQ ID NO: 936128 - DNA, 19 bp, Homo sapiens
cctgtccctgtagctcagt

SEQ ID NO: 936129 - DNA, 16 bp, Homo sapiens
cctgtccctgtccccc

SEQ ID NO: 936130 - DNA, 16 bp, Homo sapiens
cctgtcccttcctttc

SEQ ID NO: 936131 - DNA, 17 bp, Homo sapiens
cctgtcccttcctttct

SEQ ID NO: 936132 - DNA, 18 bp, Homo sapiens
cctgtcccttcctttctc

SEQ ID NO: 936133 - DNA, 19 bp, Homo sapiens
cctgtcccttcctttctcc

SEQ ID NO: 936134 - DNA, 19 bp, Homo sapiens
cctgtccggcccagtgcca

SEQ ID NO: 936135 - DNA, 21 bp, Homo sapiens
cctgtccggcccagtgccact

SEQ ID NO: 936136 - DNA, 21 bp, Homo sapiens
cctgtccggcccagtgccagc

SEQ ID NO: 936137 - DNA, 22 bp, Homo sapiens
cctgtccggcccagtgccagct

SEQ ID NO: 936138 - DNA, 23 bp, Homo sapiens
cctgtccggcccagtgccagctc

SEQ ID NO: 936139 - DNA, 21 bp, Homo sapiens
cctgtcctaaggaaccttcct

SEQ ID NO: 936140 - DNA, 22 bp, Homo sapiens
cctgtcctccaacaccaagcac

SEQ ID NO: 936141 - DNA, 17 bp, Homo sapiens
cctgtcctcccatcccc

SEQ ID NO: 936142 - DNA, 21 bp, Homo sapiens
cctgtcctcccatcccctgga

SEQ ID NO: 936143 - DNA, 22 bp, Homo sapiens
cctgtcctcccatcccctggac

SEQ ID NO: 936144 - DNA, 13 bp, Homo sapiens
cctgtcctcctcg

SEQ ID NO: 936145 - DNA, 23 bp, Homo sapiens
cctgtcctgcagtcccacactgt

SEQ ID NO: 936146 - DNA, 14 bp, Homo sapiens
cctgtccttccctg

SEQ ID NO: 936147 - DNA, 22 bp, Homo sapiens
cctgtccttctacagaacctga

SEQ ID NO: 936148 - DNA, 19 bp, Homo sapiens
cctgtccttgaaaaacaaa

SEQ ID NO: 936149 - DNA, 22 bp, Homo sapiens
cctgtcctttgcaattgctctt

SEQ ID NO: 936150 - DNA, 20 bp, Homo sapiens
cctgtcgcccacccagctgg

SEQ ID NO: 936151 - DNA, 21 bp, Homo sapiens
cctgtctaatttgcacctttg

SEQ ID NO: 936152 - DNA, 14 bp, Homo sapiens
cctgtctagagagg

SEQ ID NO: 936153 - DNA, 16 bp, Homo sapiens
cctgtctagagaggga

SEQ ID NO: 936154 - DNA, 22 bp, Homo sapiens
cctgtctaggaaggtgtgatgt

SEQ ID NO: 936155 - DNA, 14 bp, Homo sapiens
attttttccaaaat

SEQ ID NO: 936156 - DNA, 23 bp, Homo sapiens
attttttccaaaatctcccattt

SEQ ID NO: 936157 - DNA, 16 bp, Homo sapiens
attttttcccttttta

SEQ ID NO: 936158 - DNA, 13 bp, Homo sapiens
attttttccttaa

SEQ ID NO: 936159 - DNA, 23 bp, Homo sapiens
attttttccttcaaagtttaata

SEQ ID NO: 936160 - DNA, 21 bp, Homo sapiens
attttttctaaaacattcccc

SEQ ID NO: 936161 - DNA, 15 bp, Homo sapiens
attttttctacacag

SEQ ID NO: 936162 - DNA, 13 bp, Homo sapiens
attttttctatga

SEQ ID NO: 936163 - DNA, 13 bp, Homo sapiens
attttttctcttt

SEQ ID NO: 936164 - DNA, 14 bp, Homo sapiens
attttttctctttg

SEQ ID NO: 936165 - DNA, 13 bp, Homo sapiens
attttttctgaat

SEQ ID NO: 936166 - DNA, 13 bp, Homo sapiens
attttttctgtac

SEQ ID NO: 936167 - DNA, 20 bp, Homo sapiens
attttttcttttgtaattgt

SEQ ID NO: 936168 - DNA, 19 bp, Homo sapiens
attttttgaaaagcagaca

SEQ ID NO: 936169 - DNA, 13 bp, Homo sapiens
attttttgaaatg

SEQ ID NO: 936170 - DNA, 12 bp, Homo sapiens
attttttgactt

SEQ ID NO: 936171 - DNA, 19 bp, Homo sapiens
attttttgatgtcagcctt

SEQ ID NO: 936172 - DNA, 17 bp, Homo sapiens
attttttgggccattac

SEQ ID NO: 936173 - DNA, 18 bp, Homo sapiens
attttttgggccattacc

SEQ ID NO: 936174 - DNA, 19 bp, Homo sapiens
attttttgggccattaccc

SEQ ID NO: 936175 - DNA, 22 bp, Homo sapiens
attttttggtagcttgtatcaa

SEQ ID NO: 936176 - DNA, 15 bp, Homo sapiens
attttttgtataatt

SEQ ID NO: 936177 - DNA, 16 bp, Homo sapiens
attttttgtataattg

SEQ ID NO: 936178 - DNA, 18 bp, Homo sapiens
attttttgtctgtttatt

SEQ ID NO: 936179 - DNA, 18 bp, Homo sapiens
atttttttaaagtagttc

SEQ ID NO: 936180 - DNA, 14 bp, Homo sapiens
atttttttaaatca

SEQ ID NO: 936181 - DNA, 18 bp, Homo sapiens
atttttttaaccaaaggt

SEQ ID NO: 936182 - DNA, 19 bp, Homo sapiens
atttttttaactgaaaatg

SEQ ID NO: 936183 - DNA, 18 bp, Homo sapiens
atttttttaatttacaaa

SEQ ID NO: 936184 - DNA, 18 bp, Homo sapiens
atttttttactaatagac

SEQ ID NO: 936185 - DNA, 17 bp, Homo sapiens
atttttttatgctcttg

SEQ ID NO: 936186 - DNA, 16 bp, Homo sapiens
atttttttattactga

SEQ ID NO: 936187 - DNA, 15 bp, Homo sapiens
atttttttcaatatt

SEQ ID NO: 936188 - DNA, 13 bp, Homo sapiens
atttttttcctaa

SEQ ID NO: 936189 - DNA, 13 bp, Homo sapiens
atttttttctaat

SEQ ID NO: 936190 - DNA, 18 bp, Homo sapiens
atttttttctatgcataa

SEQ ID NO: 936191 - DNA, 17 bp, Homo sapiens
atttttttgcaagtgaa

SEQ ID NO: 936192 - DNA, 13 bp, Homo sapiens
atttttttgtctt

SEQ ID NO: 936193 - DNA, 15 bp, Homo sapiens
attttttttaaagtt

SEQ ID NO: 936194 - DNA, 20 bp, Homo sapiens
attttttttatcatgtcgta

SEQ ID NO: 936195 - DNA, 14 bp, Homo sapiens
attttttttggcct

SEQ ID NO: 936196 - DNA, 23 bp, Homo sapiens
attttttttggcctgtttgatgt

SEQ ID NO: 936197 - DNA, 14 bp, Homo sapiens
atttttttttcata

SEQ ID NO: 936198 - DNA, 21 bp, Homo sapiens
atttttttttcatacacttat

SEQ ID NO: 936199 - DNA, 23 bp, Homo sapiens
atttttttttcatagagatttgt

SEQ ID NO: 936200 - DNA, 13 bp, Homo sapiens
atttttttttcca

SEQ ID NO: 936201 - DNA, 18 bp, Homo sapiens
atttttttttctaagaga

SEQ ID NO: 936202 - DNA, 19 bp, Homo sapiens
atttttttttctaagagaa

SEQ ID NO: 936203 - DNA, 15 bp, Homo sapiens
atttttttttctctt

SEQ ID NO: 936204 - DNA, 16 bp, Homo sapiens
atttttttttctcttt

SEQ ID NO: 936205 - DNA, 18 bp, Homo sapiens
atttttttttctctttta

SEQ ID NO: 936206 - DNA, 22 bp, Homo sapiens
attttttttttaaataaaagca

SEQ ID NO: 936207 - DNA, 23 bp, Homo sapiens
attttttttttaaatgattccaa

SEQ ID NO: 936208 - DNA, 23 bp, Homo sapiens
atttttttttttttttttttaag

SEQ ID NO: 936209 - DNA, 22 bp, Homo sapiens
caaaaaaaaaaaaaaagactgt

SEQ ID NO: 936210 - DNA, 19 bp, Homo sapiens
caaaaaaaaaatagagaga

SEQ ID NO: 936211 - DNA, 14 bp, Homo sapiens
caaaaaaaaactta

SEQ ID NO: 936212 - DNA, 15 bp, Homo sapiens
caaaaaaaaacttaa

SEQ ID NO: 936213 - DNA, 21 bp, Homo sapiens
caaaaaaaaacttaaagcaaa

SEQ ID NO: 936214 - DNA, 14 bp, Homo sapiens
caaaaaaaaatttt

SEQ ID NO: 936215 - DNA, 21 bp, Homo sapiens
caaaaaaaaatttttttttct

SEQ ID NO: 936216 - DNA, 11 bp, Homo sapiens
caaaaaaagac

SEQ ID NO: 936217 - DNA, 15 bp, Homo sapiens
caaaaaaagcctcca

SEQ ID NO: 936218 - DNA, 16 bp, Homo sapiens
caaaaaacctcactgg

SEQ ID NO: 936219 - DNA, 13 bp, Homo sapiens
caaaaaactatgt

SEQ ID NO: 936220 - DNA, 23 bp, Homo sapiens
caaaaaagacttgagacaatgtt

SEQ ID NO: 936221 - DNA, 20 bp, Homo sapiens
caaaaaaggacgtaaaattt

SEQ ID NO: 936222 - DNA, 15 bp, Homo sapiens
caaaaaagggacagc

SEQ ID NO: 936223 - DNA, 16 bp, Homo sapiens
caaaaaaggtaactaa

SEQ ID NO: 936224 - DNA, 17 bp, Homo sapiens
caaaaaaggtaactaac

SEQ ID NO: 936225 - DNA, 19 bp, Homo sapiens
caaaaaagtcaacaaactg

SEQ ID NO: 936226 - DNA, 19 bp, Homo sapiens
caaaaaatactttttctaa

SEQ ID NO: 936227 - DNA, 18 bp, Homo sapiens
caaaaaatcatgtttatt

SEQ ID NO: 936228 - DNA, 12 bp, Homo sapiens
caaaaaatgagc

SEQ ID NO: 936229 - DNA, 18 bp, Homo sapiens
caaaaaattctttagaga

SEQ ID NO: 936230 - DNA, 12 bp, Homo sapiens
caaaaacaaaaa

SEQ ID NO: 936231 - DNA, 16 bp, Homo sapiens
caaaaacagaatttga

SEQ ID NO: 936232 - DNA, 17 bp, Homo sapiens
caaaaacagcagtttgt

SEQ ID NO: 936233 - DNA, 16 bp, Homo sapiens
caaaaacagcctcaca

SEQ ID NO: 936234 - DNA, 22 bp, Homo sapiens
caaaaacagcctcacagaagaa

SEQ ID NO: 936235 - DNA, 18 bp, Homo sapiens
caaaaacaggtttttgat

SEQ ID NO: 936236 - DNA, 18 bp, Homo sapiens
caaaaacatacttcaaaa

SEQ ID NO: 936237 - DNA, 14 bp, Homo sapiens
caaaaaccagcagg

SEQ ID NO: 936238 - DNA, 14 bp, Homo sapiens
caaaaaccagccag

SEQ ID NO: 936239 - DNA, 16 bp, Homo sapiens
caaaaaccagccaggc

SEQ ID NO: 936240 - DNA, 19 bp, Homo sapiens
caaaaaccatgttgcgttc

SEQ ID NO: 936241 - DNA, 17 bp, Homo sapiens
caaaaactgtactgtgt

SEQ ID NO: 936242 - DNA, 20 bp, Homo sapiens
caaaaagaaaaaaagaaaag

SEQ ID NO: 936243 - DNA, 12 bp, Homo sapiens
caaaaagaacaa

SEQ ID NO: 936244 - DNA, 14 bp, Homo sapiens
caaaaagaacaaaa

SEQ ID NO: 936245 - DNA, 14 bp, Homo sapiens
caaaaagacaaaca

SEQ ID NO: 936246 - DNA, 15 bp, Homo sapiens
caaaaagcaaaatca

SEQ ID NO: 936247 - DNA, 20 bp, Homo sapiens
caaaaagcaagggagaaaag

SEQ ID NO: 936248 - DNA, 21 bp, Homo sapiens
caaaaagctaatgtgcaggga

SEQ ID NO: 936249 - DNA, 15 bp, Homo sapiens
caaaaagctctgaaa

SEQ ID NO: 936250 - DNA, 14 bp, Homo sapiens
caaaaagcttcccc

SEQ ID NO: 936251 - DNA, 22 bp, Homo sapiens
caaaaagtaacacagtggactt

SEQ ID NO: 936252 - DNA, 17 bp, Homo sapiens
caaaaagtgtttatttt

SEQ ID NO: 936253 - DNA, 15 bp, Homo sapiens
caaaaagtttccata

SEQ ID NO: 936254 - DNA, 16 bp, Homo sapiens
caaaaataacactgtt

SEQ ID NO: 936255 - DNA, 23 bp, Homo sapiens
cctgtggcctgtgtcccatgacc

SEQ ID NO: 936256 - DNA, 13 bp, Homo sapiens
cctgtggccttgc

SEQ ID NO: 936257 - DNA, 19 bp, Homo sapiens
cctgtggccttgcccgcca

SEQ ID NO: 936258 - DNA, 21 bp, Homo sapiens
cctgtggcgccgtctccaggg

SEQ ID NO: 936259 - DNA, 22 bp, Homo sapiens
cctgtggcgccgtctccagggg

SEQ ID NO: 936260 - DNA, 22 bp, Homo sapiens
cctgtggcgggtaggcaggaag

SEQ ID NO: 936261 - DNA, 19 bp, Homo sapiens
cctgtggcggtgcctgggt

SEQ ID NO: 936262 - DNA, 20 bp, Homo sapiens
cctgtggcggtgcctgggtg

SEQ ID NO: 936263 - DNA, 14 bp, Homo sapiens
cctgtgggaccgcc

SEQ ID NO: 936264 - DNA, 22 bp, Homo sapiens
cctgtgggaccgcctggccctc

SEQ ID NO: 936265 - DNA, 14 bp, Homo sapiens
cctgtgggagcctg

SEQ ID NO: 936266 - DNA, 16 bp, Homo sapiens
cctgtgggagggggag

SEQ ID NO: 936267 - DNA, 19 bp, Homo sapiens
cctgtgggcctcacctgcc

SEQ ID NO: 936268 - DNA, 18 bp, Homo sapiens
cctgtggggatctcaggg

SEQ ID NO: 936269 - DNA, 22 bp, Homo sapiens
cctgtggggatctcaggggctg

SEQ ID NO: 936270 - DNA, 20 bp, Homo sapiens
cctgtggggatttctcccag

SEQ ID NO: 936271 - DNA, 22 bp, Homo sapiens
cctgtggggatttctcccagct

SEQ ID NO: 936272 - DNA, 18 bp, Homo sapiens
cctgtggggcaggagtgc

SEQ ID NO: 936273 - DNA, 14 bp, Homo sapiens
cctgtgggggtggc

SEQ ID NO: 936274 - DNA, 15 bp, Homo sapiens
cctgtgggggtggcc

SEQ ID NO: 936275 - DNA, 18 bp, Homo sapiens
cctgtgggggtggccatc

SEQ ID NO: 936276 - DNA, 21 bp, Homo sapiens
cctgtgggggtggccatccct

SEQ ID NO: 936277 - DNA, 17 bp, Homo sapiens
cctgtggggtctgatgt

SEQ ID NO: 936278 - DNA, 23 bp, Homo sapiens
cctgtgggtgtagccaggtatgg

SEQ ID NO: 936279 - DNA, 20 bp, Homo sapiens
cctgtgggtgttctttcctg

SEQ ID NO: 936280 - DNA, 17 bp, Homo sapiens
cctgtgggtttgggtgc

SEQ ID NO: 936281 - DNA, 18 bp, Homo sapiens
cctgtgggtttgggtgcc

SEQ ID NO: 936282 - DNA, 23 bp, Homo sapiens
cctgtgggtttgggtgcctcctg

SEQ ID NO: 936283 - DNA, 19 bp, Homo sapiens
caaaacatccacttaagtt

SEQ ID NO: 936284 - DNA, 22 bp, Homo sapiens
caaaacatccacttaagttctt

SEQ ID NO: 936285 - DNA, 23 bp, Homo sapiens
caaaacatccacttaagttcttt

SEQ ID NO: 936286 - DNA, 22 bp, Homo sapiens
caaaacatgtctcctatcctgg

SEQ ID NO: 936287 - DNA, 22 bp, Homo sapiens
caaaacatttaaataaaacttt

SEQ ID NO: 936288 - DNA, 23 bp, Homo sapiens
caaaacatttaaataaaactttc

SEQ ID NO: 936289 - DNA, 16 bp, Homo sapiens
caaaaccaagccttgg

SEQ ID NO: 936290 - DNA, 18 bp, Homo sapiens
caaaaccacagccctgtc

SEQ ID NO: 936291 - DNA, 19 bp, Homo sapiens
caaaaccacagccctgtca

SEQ ID NO: 936292 - DNA, 21 bp, Homo sapiens
caaaaccacagccctgtcagt

SEQ ID NO: 936293 - DNA, 15 bp, Homo sapiens
caaaaccacatgggc

SEQ ID NO: 936294 - DNA, 16 bp, Homo sapiens
caaaaccacatgggct

SEQ ID NO: 936295 - DNA, 17 bp, Homo sapiens
caaaaccacatgggctg

SEQ ID NO: 936296 - DNA, 18 bp, Homo sapiens
caaaaccacatgggctgg

SEQ ID NO: 936297 - DNA, 17 bp, Homo sapiens
caaaaccaccctaacct

SEQ ID NO: 936298 - DNA, 17 bp, Homo sapiens
caaaaccatccatccct

SEQ ID NO: 936299 - DNA, 14 bp, Homo sapiens
caaaaccatgcctg

SEQ ID NO: 936300 - DNA, 23 bp, Homo sapiens
caaaaccatgcctggtattttca

SEQ ID NO: 936301 - DNA, 15 bp, Homo sapiens
caaaaccattgcttc

SEQ ID NO: 936302 - DNA, 17 bp, Homo sapiens
caaaaccattgcttcac

SEQ ID NO: 936303 - DNA, 15 bp, Homo sapiens
caaaacccagacctg

SEQ ID NO: 936304 - DNA, 15 bp, Homo sapiens
caaaacccagggcaa

SEQ ID NO: 936305 - DNA, 18 bp, Homo sapiens
caaaacctgatgttaaaa

SEQ ID NO: 936306 - DNA, 19 bp, Homo sapiens
caaaacctgcttccttcag

SEQ ID NO: 936307 - DNA, 13 bp, Homo sapiens
caaaacctgtgcc

SEQ ID NO: 936308 - DNA, 17 bp, Homo sapiens
caaaacctgtgccaggc

SEQ ID NO: 936309 - DNA, 14 bp, Homo sapiens
caaaacgggtcagt

SEQ ID NO: 936310 - DNA, 15 bp, Homo sapiens
caaaacggttttact

SEQ ID NO: 936311 - DNA, 13 bp, Homo sapiens
caaaacgtcttat

SEQ ID NO: 936312 - DNA, 14 bp, Homo sapiens
caaaacgtcttatt

SEQ ID NO: 936313 - DNA, 15 bp, Homo sapiens
caaaacgtcttattg

SEQ ID NO: 936314 - DNA, 18 bp, Homo sapiens
caaaactgctttgtgcat

SEQ ID NO: 936315 - DNA, 21 bp, Homo sapiens
caaaactgtaaataaaatgtg

SEQ ID NO: 936316 - DNA, 21 bp, Homo sapiens
caaaactgttcttttgcattt

SEQ ID NO: 936317 - DNA, 13 bp, Homo sapiens
caaaacttaacat

SEQ ID NO: 936318 - DNA, 20 bp, Homo sapiens
caaaacttaagatgggcctg

SEQ ID NO: 936319 - DNA, 20 bp, Homo sapiens
caaaacttgaaagaagtttt

SEQ ID NO: 936320 - DNA, 17 bp, Homo sapiens
caaaactttaaacctgt

SEQ ID NO: 936321 - DNA, 23 bp, Homo sapiens
caaaactttatcagggaaactaa

SEQ ID NO: 936322 - DNA, 21 bp, Homo sapiens
caaaagaaaaaaaaaagcacc

SEQ ID NO: 936323 - DNA, 11 bp, Homo sapiens
caaaagaaaat

SEQ ID NO: 936324 - DNA, 17 bp, Homo sapiens
caaaagaaaccatgaca

SEQ ID NO: 936325 - DNA, 15 bp, Homo sapiens
caaaagaaatttaga

SEQ ID NO: 936326 - DNA, 22 bp, Homo sapiens
caaaagaaatttagagtcaatt

SEQ ID NO: 936327 - DNA, 20 bp, Homo sapiens
caaaagaagaagtttcatca

SEQ ID NO: 936328 - DNA, 13 bp, Homo sapiens
caaaagaagacat

SEQ ID NO: 936329 - DNA, 19 bp, Homo sapiens
caaaagaagtaaaagcaaa

SEQ ID NO: 936330 - DNA, 20 bp, Homo sapiens
caaaagaatggcagaaaagt

SEQ ID NO: 936331 - DNA, 12 bp, Homo sapiens
caaaagaatttt

SEQ ID NO: 936332 - DNA, 14 bp, Homo sapiens
caaaagacaaaaat

SEQ ID NO: 936333 - DNA, 15 bp, Homo sapiens
caaaagacaaaaatc

SEQ ID NO: 936334 - DNA, 19 bp, Homo sapiens
caaaagacagacccagtga

SEQ ID NO: 936335 - DNA, 21 bp, Homo sapiens
caaaagactggtttgtttgct

SEQ ID NO: 936336 - DNA, 16 bp, Homo sapiens
caaaagagagaatgag

SEQ ID NO: 936337 - DNA, 18 bp, Homo sapiens
caaaagagccctggctct

SEQ ID NO: 936338 - DNA, 19 bp, Homo sapiens
caaaagagccctggctctg

SEQ ID NO: 936339 - DNA, 16 bp, Homo sapiens
caaaagaggtgtcatg

SEQ ID NO: 936340 - DNA, 13 bp, Homo sapiens
caaaagataatat

SEQ ID NO: 936341 - DNA, 20 bp, Homo sapiens
caaaagatgctcttctgtgg

SEQ ID NO: 936342 - DNA, 19 bp, Homo sapiens
caaaagattaatctttaaa

SEQ ID NO: 936343 - DNA, 16 bp, Homo sapiens
caaaagattgctgaaa

SEQ ID NO: 936344 - DNA, 18 bp, Homo sapiens
caaaagattgctgaaaaa

SEQ ID NO: 936345 - DNA, 19 bp, Homo sapiens
caaaagattgctgaaattt

SEQ ID NO: 936346 - DNA, 14 bp, Homo sapiens
caaaagcaaaacat

SEQ ID NO: 936347 - DNA, 16 bp, Homo sapiens
caaaagcaagactgtt

SEQ ID NO: 936348 - DNA, 14 bp, Homo sapiens
caaaagcacccttg

SEQ ID NO: 936349 - DNA, 16 bp, Homo sapiens
caaaagcagcacaagg

SEQ ID NO: 936350 - DNA, 13 bp, Homo sapiens
caaaagcttttta

SEQ ID NO: 936351 - DNA, 19 bp, Homo sapiens
caaaaggatctttgtggcc

SEQ ID NO: 936352 - DNA, 20 bp, Homo sapiens
caaaaggatctttgtggcca

SEQ ID NO: 936353 - DNA, 22 bp, Homo sapiens
caaaaggatctttgtggccaag

SEQ ID NO: 936354 - DNA, 13 bp, Homo sapiens
caaaaggcagctc

SEQ ID NO: 936355 - DNA, 16 bp, Homo sapiens
caaaaggcagctcacc

SEQ ID NO: 936356 - DNA, 19 bp, Homo sapiens
caaaaggcagctcacccct

SEQ ID NO: 936357 - DNA, 16 bp, Homo sapiens
caaaagggaagagttt

SEQ ID NO: 936358 - DNA, 21 bp, Homo sapiens
caaaagggccaggtgcggcct

SEQ ID NO: 936359 - DNA, 20 bp, Homo sapiens
caaaagggggccccttgaga

SEQ ID NO: 936360 - DNA, 18 bp, Homo sapiens
caaaagggtgtatagtgt

SEQ ID NO: 936361 - DNA, 22 bp, Homo sapiens
caaaagggtttaaactgattca

SEQ ID NO: 936362 - DNA, 23 bp, Homo sapiens
caaaaggtgcctgtgaggcaggg

SEQ ID NO: 936363 - DNA, 12 bp, Homo sapiens
caaaagtaaatg

SEQ ID NO: 936364 - DNA, 13 bp, Homo sapiens
caaaagtaaatgg

SEQ ID NO: 936365 - DNA, 17 bp, Homo sapiens
caaaagtaaatgggagg

SEQ ID NO: 936366 - DNA, 22 bp, Homo sapiens
caaaagtccctccctgcctgag

SEQ ID NO: 936367 - DNA, 15 bp, Homo sapiens
caaaagtctattttt

SEQ ID NO: 936368 - DNA, 16 bp, Homo sapiens
caaaagtctgtctttc

SEQ ID NO: 936369 - DNA, 15 bp, Homo sapiens
caaaagtgaaccatc

SEQ ID NO: 936370 - DNA, 18 bp, Homo sapiens
caaaagttacatgtttgc

SEQ ID NO: 936371 - DNA, 17 bp, Homo sapiens
caaaagttagctgagcg

SEQ ID NO: 936372 - DNA, 17 bp, Homo sapiens
caaaagttctgacttga

SEQ ID NO: 936373 - DNA, 15 bp, Homo sapiens
caaaagttttcctga

SEQ ID NO: 936374 - DNA, 21 bp, Homo sapiens
caaaataaaaagcctcagtga

SEQ ID NO: 936375 - DNA, 14 bp, Homo sapiens
caaaataaaacata

SEQ ID NO: 936376 - DNA, 21 bp, Homo sapiens
caaacatgaccctaaatcttg

SEQ ID NO: 936377 - DNA, 13 bp, Homo sapiens
caaacatgcacac

SEQ ID NO: 936378 - DNA, 18 bp, Homo sapiens
caaacatggatacttcct

SEQ ID NO: 936379 - DNA, 21 bp, Homo sapiens
caaacatggatacttcctggg

SEQ ID NO: 936380 - DNA, 20 bp, Homo sapiens
caaacatggggttggctggg

SEQ ID NO: 936381 - DNA, 22 bp, Homo sapiens
caaacattcgtgagctggggac

SEQ ID NO: 936382 - DNA, 16 bp, Homo sapiens
caaacattgctgcctt

SEQ ID NO: 936383 - DNA, 14 bp, Homo sapiens
caaacatttcaaag

SEQ ID NO: 936384 - DNA, 14 bp, Homo sapiens
caaaccaaagctgc

SEQ ID NO: 936385 - DNA, 15 bp, Homo sapiens
caaaccaaagctgcc

SEQ ID NO: 936386 - DNA, 18 bp, Homo sapiens
caaaccaaagctgcctgt

SEQ ID NO: 936387 - DNA, 16 bp, Homo sapiens
caaaccaacatctttg

SEQ ID NO: 936388 - DNA, 19 bp, Homo sapiens
caaaccaacatctttgcga

SEQ ID NO: 936389 - DNA, 17 bp, Homo sapiens
caaaccaatttcttcct

SEQ ID NO: 936390 - DNA, 18 bp, Homo sapiens
caaaccaatttcttcctt

SEQ ID NO: 936391 - DNA, 15 bp, Homo sapiens
caaaccacactggac

SEQ ID NO: 936392 - DNA, 17 bp, Homo sapiens
caaaccacgcctcttga

SEQ ID NO: 936393 - DNA, 19 bp, Homo sapiens
caaaccacgcctcttgacc

SEQ ID NO: 936394 - DNA, 23 bp, Homo sapiens
caaaccacttctccatgctgcaa

SEQ ID NO: 936395 - DNA, 14 bp, Homo sapiens
caaaccacttgcct

SEQ ID NO: 936396 - DNA, 12 bp, Homo sapiens
caaaccaggatt

SEQ ID NO: 936397 - DNA, 20 bp, Homo sapiens
caaaccaggtcaccatcctc

SEQ ID NO: 936398 - DNA, 16 bp, Homo sapiens
caaaccagtttattct

SEQ ID NO: 936399 - DNA, 17 bp, Homo sapiens
caaaccatgagaatttg

SEQ ID NO: 936400 - DNA, 20 bp, Homo sapiens
caaaccattataccttactt

SEQ ID NO: 936401 - DNA, 20 bp, Homo sapiens
caaaccatttccaacagcaa

SEQ ID NO: 936402 - DNA, 23 bp, Homo sapiens
caaaccattttattttttgggcc

SEQ ID NO: 936403 - DNA, 21 bp, Homo sapiens
caaaccatttttaaagtagaa

SEQ ID NO: 936404 - DNA, 14 bp, Homo sapiens
caaacccaaaagaa

SEQ ID NO: 936405 - DNA, 17 bp, Homo sapiens
caaacccaactaagcca

SEQ ID NO: 936406 - DNA, 21 bp, Homo sapiens
caaacccacgattttctccag

SEQ ID NO: 936407 - DNA, 22 bp, Homo sapiens
caaacccacgattttctccagc

SEQ ID NO: 936408 - DNA, 19 bp, Homo sapiens
caaacccacttctggcctc

SEQ ID NO: 936409 - DNA, 22 bp, Homo sapiens
caaacccacttctggcctccag

SEQ ID NO: 936410 - DNA, 16 bp, Homo sapiens
caaacccagtctcaga

SEQ ID NO: 936411 - DNA, 16 bp, Homo sapiens
caaacccagtctcctc

SEQ ID NO: 936412 - DNA, 20 bp, Homo sapiens
ccttaataaaaatatatatt

SEQ ID NO: 936413 - DNA, 14 bp, Homo sapiens
ccttaataaatatg

SEQ ID NO: 936414 - DNA, 16 bp, Homo sapiens
ccttaataaatatgta

SEQ ID NO: 936415 - DNA, 18 bp, Homo sapiens
ccttaatcttgctttctt

SEQ ID NO: 936416 - DNA, 18 bp, Homo sapiens
ccttaatgacaacactta

SEQ ID NO: 936417 - DNA, 22 bp, Homo sapiens
ccttaatgcttcatatgaggag

SEQ ID NO: 936418 - DNA, 19 bp, Homo sapiens
ccttaatttcctttttgac

SEQ ID NO: 936419 - DNA, 16 bp, Homo sapiens
ccttaatttgcacagt

SEQ ID NO: 936420 - DNA, 19 bp, Homo sapiens
ccttacaacgccgagtgca

SEQ ID NO: 936421 - DNA, 22 bp, Homo sapiens
ccttacaacgccgagtgcactg

SEQ ID NO: 936422 - DNA, 13 bp, Homo sapiens
ccttacagagcat

SEQ ID NO: 936423 - DNA, 15 bp, Homo sapiens
ccttacatcttttct

SEQ ID NO: 936424 - DNA, 18 bp, Homo sapiens
ccttaccaactttctgta

SEQ ID NO: 936425 - DNA, 15 bp, Homo sapiens
ccttaccctcatgtt

SEQ ID NO: 936426 - DNA, 19 bp, Homo sapiens
ccttaccctcatgttctta

SEQ ID NO: 936427 - DNA, 18 bp, Homo sapiens
ccttaccctcctctgctg

SEQ ID NO: 936428 - DNA, 17 bp, Homo sapiens
ccttaccctccttggga

SEQ ID NO: 936429 - DNA, 14 bp, Homo sapiens
ccttacctctggaa

SEQ ID NO: 936430 - DNA, 16 bp, Homo sapiens
ccttacctctggaacc

SEQ ID NO: 936431 - DNA, 14 bp, Homo sapiens
ccttacctcttccg

SEQ ID NO: 936432 - DNA, 13 bp, Homo sapiens
ccttaccttgggg

SEQ ID NO: 936433 - DNA, 21 bp, Homo sapiens
ccttactcccccaccactcag

SEQ ID NO: 936434 - DNA, 17 bp, Homo sapiens
ccttactctgagcccag

SEQ ID NO: 936435 - DNA, 12 bp, Homo sapiens
ccttactgcaga

SEQ ID NO: 936436 - DNA, 21 bp, Homo sapiens
ccttacttccagcaagcaaag

SEQ ID NO: 936437 - DNA, 12 bp, Homo sapiens
ccttacttcctg

SEQ ID NO: 936438 - DNA, 22 bp, Homo sapiens
ccttacttcctggcctcttctg

SEQ ID NO: 936439 - DNA, 14 bp, Homo sapiens
ccttacttgcactg

SEQ ID NO: 936440 - DNA, 21 bp, Homo sapiens
ccttactttactgcctgaata

SEQ ID NO: 936441 - DNA, 22 bp, Homo sapiens
ccttactttactgcctgaataa

SEQ ID NO: 936442 - DNA, 23 bp, Homo sapiens
ccttactttactgcctgaataaa

SEQ ID NO: 936443 - DNA, 15 bp, Homo sapiens
ccttagaaaatgtgt

SEQ ID NO: 936444 - DNA, 21 bp, Homo sapiens
ccttagaaatcattgtagaaa

SEQ ID NO: 936445 - DNA, 18 bp, Homo sapiens
ccttagaaatgtaaactg

SEQ ID NO: 936446 - DNA, 21 bp, Homo sapiens
ccttagaaatgtaaactgcca

SEQ ID NO: 936447 - DNA, 22 bp, Homo sapiens
ccttagaaatgtaaactgccat

SEQ ID NO: 936448 - DNA, 20 bp, Homo sapiens
ccttagaacattttaattca

SEQ ID NO: 936449 - DNA, 17 bp, Homo sapiens
ccttagaagagagccag

SEQ ID NO: 936450 - DNA, 13 bp, Homo sapiens
ccttagacaaatg

SEQ ID NO: 936451 - DNA, 16 bp, Homo sapiens
ccttagactccttctc

SEQ ID NO: 936452 - DNA, 20 bp, Homo sapiens
ccttagactcttttccttcc

SEQ ID NO: 936453 - DNA, 16 bp, Homo sapiens
ccttagagacatcaaa

SEQ ID NO: 936454 - DNA, 14 bp, Homo sapiens
ccttagagaccccg

SEQ ID NO: 936455 - DNA, 23 bp, Homo sapiens
ccttagagattgccccagagccc

SEQ ID NO: 936456 - DNA, 17 bp, Homo sapiens
ccttagaggtcctctgg

SEQ ID NO: 936457 - DNA, 20 bp, Homo sapiens
ccttagaggtcctctggagc

SEQ ID NO: 936458 - DNA, 16 bp, Homo sapiens
ccttagattagctctg

SEQ ID NO: 936459 - DNA, 21 bp, Homo sapiens
ccttagcaatgggggcctccg

SEQ ID NO: 936460 - DNA, 17 bp, Homo sapiens
ccttagcacagagaggg

SEQ ID NO: 936461 - DNA, 15 bp, Homo sapiens
ccttagcctccctga

SEQ ID NO: 936462 - DNA, 18 bp, Homo sapiens
ccttagcctctcccaccc

SEQ ID NO: 936463 - DNA, 18 bp, Homo sapiens
ccttagcctcttggaaat

SEQ ID NO: 936464 - DNA, 21 bp, Homo sapiens
ccttagcgttctggactctgc

SEQ ID NO: 936465 - DNA, 22 bp, Homo sapiens
ccttagctattcccagggaacc

SEQ ID NO: 936466 - DNA, 18 bp, Homo sapiens
ccttagctatttatccct

SEQ ID NO: 936467 - DNA, 23 bp, Homo sapiens
ccttagctatttatccctttcct

SEQ ID NO: 936468 - DNA, 20 bp, Homo sapiens
ccttagctcttagtctcttt

SEQ ID NO: 936469 - DNA, 23 bp, Homo sapiens
ccttagctgccagtgctggtcac

SEQ ID NO: 936470 - DNA, 20 bp, Homo sapiens
ccttagcttagacctcagcc

SEQ ID NO: 936471 - DNA, 21 bp, Homo sapiens
ccttagcttagacctcagcct

SEQ ID NO: 936472 - DNA, 23 bp, Homo sapiens
ccttagcttagacctcagcctgt

SEQ ID NO: 936473 - DNA, 19 bp, Homo sapiens
ccttaggcattatttaatg

SEQ ID NO: 936474 - DNA, 23 bp, Homo sapiens
ccttagggaagttgtctccttcc

SEQ ID NO: 936475 - DNA, 20 bp, Homo sapiens
ccttaggggtaattggtaat

SEQ ID NO: 936476 - DNA, 23 bp, Homo sapiens
ccttagggtggctttaattgtat

SEQ ID NO: 936477 - DNA, 16 bp, Homo sapiens
ccttaggtttgacatg

SEQ ID NO: 936478 - DNA, 17 bp, Homo sapiens
ccttaggttttctttgg

SEQ ID NO: 936479 - DNA, 20 bp, Homo sapiens
ccttagtctcagtttgtgtg

SEQ ID NO: 936480 - DNA, 13 bp, Homo sapiens
ccttagtcttctc

SEQ ID NO: 936481 - DNA, 13 bp, Homo sapiens
ccttagtgccagg

SEQ ID NO: 936482 - DNA, 14 bp, Homo sapiens
ccttagtgccagga

SEQ ID NO: 936483 - DNA, 19 bp, Homo sapiens
ccttagtgccaggagggca

SEQ ID NO: 936484 - DNA, 16 bp, Homo sapiens
ccttagtttcaagagt

SEQ ID NO: 936485 - DNA, 13 bp, Homo sapiens
ccttatactgtat

SEQ ID NO: 936486 - DNA, 21 bp, Homo sapiens
ccttatagttactgtgtaatt

SEQ ID NO: 936487 - DNA, 23 bp, Homo sapiens
ccttatatttctgtgtacacatc

SEQ ID NO: 936488 - DNA, 18 bp, Homo sapiens
ccttatcaaaggacacca

SEQ ID NO: 936489 - DNA, 20 bp, Homo sapiens
ccttatcacagaaataaaat

SEQ ID NO: 936490 - DNA, 17 bp, Homo sapiens
ccttatcaccagctgcc

SEQ ID NO: 936491 - DNA, 20 bp, Homo sapiens
ccttatcaccagctgcctct

SEQ ID NO: 936492 - DNA, 14 bp, Homo sapiens
ccttatccaggact

SEQ ID NO: 936493 - DNA, 16 bp, Homo sapiens
ccttatctccaagacc

SEQ ID NO: 936494 - DNA, 22 bp, Homo sapiens
ccttatctccaagaccagagat

SEQ ID NO: 936495 - DNA, 20 bp, Homo sapiens
ccttatctgtgcgtgaaaca

SEQ ID NO: 936496 - DNA, 21 bp, Homo sapiens
ccttccccttctgtgtcacag

SEQ ID NO: 936497 - DNA, 19 bp, Homo sapiens
ccttcccgacccagccagc

SEQ ID NO: 936498 - DNA, 20 bp, Homo sapiens
ccttcccgccgcccgacccc

SEQ ID NO: 936499 - DNA, 15 bp, Homo sapiens
ccttccctagcttta

SEQ ID NO: 936500 - DNA, 18 bp, Homo sapiens
ccttccctccatagccac

SEQ ID NO: 936501 - DNA, 11 bp, Homo sapiens
ccttccctcct

SEQ ID NO: 936502 - DNA, 12 bp, Homo sapiens
ccttccctcctc

SEQ ID NO: 936503 - DNA, 13 bp, Homo sapiens
ccttccctcctcc

SEQ ID NO: 936504 - DNA, 11 bp, Homo sapiens
ccttccctctc

SEQ ID NO: 936505 - DNA, 13 bp, Homo sapiens
ccttccctctctg

SEQ ID NO: 936506 - DNA, 15 bp, Homo sapiens
ccttccctctctgat

SEQ ID NO: 936507 - DNA, 21 bp, Homo sapiens
ccttccctctctgatgtccca

SEQ ID NO: 936508 - DNA, 11 bp, Homo sapiens
ccttccctctg

SEQ ID NO: 936509 - DNA, 13 bp, Homo sapiens
ccttccctctggg

SEQ ID NO: 936510 - DNA, 22 bp, Homo sapiens
ccttccctgatggcctttggac

SEQ ID NO: 936511 - DNA, 12 bp, Homo sapiens
ccttccctgcaa

SEQ ID NO: 936512 - DNA, 13 bp, Homo sapiens
ccttccctgcaga

SEQ ID NO: 936513 - DNA, 12 bp, Homo sapiens
ccttccctggcc

SEQ ID NO: 936514 - DNA, 14 bp, Homo sapiens
ccttccctgggctg

SEQ ID NO: 936515 - DNA, 15 bp, Homo sapiens
ccttccctgggctgt

SEQ ID NO: 936516 - DNA, 19 bp, Homo sapiens
ccttccctgggctgtgcta

SEQ ID NO: 936517 - DNA, 21 bp, Homo sapiens
ccttccctggggagccctcag

SEQ ID NO: 936518 - DNA, 15 bp, Homo sapiens
ccttccctgtccctc

SEQ ID NO: 936519 - DNA, 17 bp, Homo sapiens
ccttccctgtccctcta

SEQ ID NO: 936520 - DNA, 18 bp, Homo sapiens
ccttcccttgccactttg

SEQ ID NO: 936521 - DNA, 22 bp, Homo sapiens
ccttcccttttctgttctagtt

SEQ ID NO: 936522 - DNA, 17 bp, Homo sapiens
ccttccgaccctctggg

SEQ ID NO: 936523 - DNA, 18 bp, Homo sapiens
ccttccgcagtgtggcca

SEQ ID NO: 936524 - DNA, 18 bp, Homo sapiens
ccttcctaaatatccaaa

SEQ ID NO: 936525 - DNA, 20 bp, Homo sapiens
ccttcctagaagcccctgtc

SEQ ID NO: 936526 - DNA, 22 bp, Homo sapiens
ccttcctcagtttaatccttct

SEQ ID NO: 936527 - DNA, 19 bp, Homo sapiens
ccttcctcatccaccccat

SEQ ID NO: 936528 - DNA, 16 bp, Homo sapiens
ccttcctccccacact

SEQ ID NO: 936529 - DNA, 14 bp, Homo sapiens
ccttcctccccgcc

SEQ ID NO: 936530 - DNA, 15 bp, Homo sapiens
ccttcctcctccaca

SEQ ID NO: 936531 - DNA, 23 bp, Homo sapiens
ccttcctcctccacagtgctgct

SEQ ID NO: 936532 - DNA, 13 bp, Homo sapiens
ccttcctcctgca

SEQ ID NO: 936533 - DNA, 14 bp, Homo sapiens
ccttcctcctgcag

SEQ ID NO: 936534 - DNA, 18 bp, Homo sapiens
ccttcctcggtggctctg

SEQ ID NO: 936535 - DNA, 19 bp, Homo sapiens
ccttcctcggtggctctgg

SEQ ID NO: 936536 - DNA, 21 bp, Homo sapiens
ccttcctcggtggctctgggg

SEQ ID NO: 936537 - DNA, 21 bp, Homo sapiens
ccttcctcgtgcagagctggg

SEQ ID NO: 936538 - DNA, 21 bp, Homo sapiens
ccttcctctccactgccttcg

SEQ ID NO: 936539 - DNA, 17 bp, Homo sapiens
ccttcctctctctacca

SEQ ID NO: 936540 - DNA, 16 bp, Homo sapiens
caaagaggctgcccct

SEQ ID NO: 936541 - DNA, 23 bp, Homo sapiens
caaagaggctgcccctctcacca

SEQ ID NO: 936542 - DNA, 14 bp, Homo sapiens
caaagagggcttcc

SEQ ID NO: 936543 - DNA, 16 bp, Homo sapiens
caaagagggcttcctc

SEQ ID NO: 936544 - DNA, 22 bp, Homo sapiens
caaagagggcttcctctagaag

SEQ ID NO: 936545 - DNA, 17 bp, Homo sapiens
caaagaggggcgctgtc

SEQ ID NO: 936546 - DNA, 14 bp, Homo sapiens
caaagagtagaatt

SEQ ID NO: 936547 - DNA, 17 bp, Homo sapiens
caaagagttcaagaaat

SEQ ID NO: 936548 - DNA, 22 bp, Homo sapiens
caaagataaaaggtttcttttt

SEQ ID NO: 936549 - DNA, 13 bp, Homo sapiens
caaagatcaaaat

SEQ ID NO: 936550 - DNA, 17 bp, Homo sapiens
caaagatcaaaataaaa

SEQ ID NO: 936551 - DNA, 23 bp, Homo sapiens
caaagatctgaattaaataaata

SEQ ID NO: 936552 - DNA, 17 bp, Homo sapiens
caaagatgacttctttt

SEQ ID NO: 936553 - DNA, 14 bp, Homo sapiens
caaagatgcatttt

SEQ ID NO: 936554 - DNA, 19 bp, Homo sapiens
caaagatgcgtttgcctcc

SEQ ID NO: 936555 - DNA, 23 bp, Homo sapiens
caaagatgcgtttgcctcctgga

SEQ ID NO: 936556 - DNA, 20 bp, Homo sapiens
caaagatggattaaactcag

SEQ ID NO: 936557 - DNA, 19 bp, Homo sapiens
caaagatggctcagagggg

SEQ ID NO: 936558 - DNA, 17 bp, Homo sapiens
caaagatggtggctgtg

SEQ ID NO: 936559 - DNA, 20 bp, Homo sapiens
caaagatggtggctgtgtct

SEQ ID NO: 936560 - DNA, 15 bp, Homo sapiens
caaagatgtttgaaa

SEQ ID NO: 936561 - DNA, 17 bp, Homo sapiens
caaagatgtttgaaaat

SEQ ID NO: 936562 - DNA, 18 bp, Homo sapiens
caaagatgtttgtcagat

SEQ ID NO: 936563 - DNA, 13 bp, Homo sapiens
caaagatttaatc

SEQ ID NO: 936564 - DNA, 14 bp, Homo sapiens
caaagatttcagta

SEQ ID NO: 936565 - DNA, 13 bp, Homo sapiens
caaagatttttgg

SEQ ID NO: 936566 - DNA, 19 bp, Homo sapiens
caaagcaaaacatcacatt

SEQ ID NO: 936567 - DNA, 16 bp, Homo sapiens
caaagcaacccgctgg

SEQ ID NO: 936568 - DNA, 22 bp, Homo sapiens
caaagcaacccgctggagccca

SEQ ID NO: 936569 - DNA, 23 bp, Homo sapiens
caaagcaacccgctggagcccac

SEQ ID NO: 936570 - DNA, 14 bp, Homo sapiens
caaagcaagaccct

SEQ ID NO: 936571 - DNA, 14 bp, Homo sapiens
caaagcaagggctc

SEQ ID NO: 936572 - DNA, 15 bp, Homo sapiens
caaagcaagggctcc

SEQ ID NO: 936573 - DNA, 22 bp, Homo sapiens
caaagcaatcaagcaccaggaa

SEQ ID NO: 936574 - DNA, 15 bp, Homo sapiens
caaagcacagtgtta

SEQ ID NO: 936575 - DNA, 19 bp, Homo sapiens
caaagcacagtgttaaatg

SEQ ID NO: 936576 - DNA, 22 bp, Homo sapiens
caaagcacagtgttaaatgaaa

SEQ ID NO: 936577 - DNA, 16 bp, Homo sapiens
caaagcacagtttgaa

SEQ ID NO: 936578 - DNA, 17 bp, Homo sapiens
caaagcacagtttgaac

SEQ ID NO: 936579 - DNA, 22 bp, Homo sapiens
caaagcacatgcttagcttatc

SEQ ID NO: 936580 - DNA, 24 bp, Homo sapiens
caaagcaccaaaataagaaaagat

SEQ ID NO: 936581 - DNA, 14 bp, Homo sapiens
caaagcactctctg

SEQ ID NO: 936582 - DNA, 19 bp, Homo sapiens
caaagcacttttaaaaaaa

SEQ ID NO: 936583 - DNA, 20 bp, Homo sapiens
caaagcacttttaaaaaaat

SEQ ID NO: 936584 - DNA, 16 bp, Homo sapiens
caaagcagacagctcc

SEQ ID NO: 936585 - DNA, 17 bp, Homo sapiens
caaagcagacagctcca

SEQ ID NO: 936586 - DNA, 15 bp, Homo sapiens
caaagcagcagccac

SEQ ID NO: 936587 - DNA, 13 bp, Homo sapiens
caaagcaggagtg

SEQ ID NO: 936588 - DNA, 15 bp, Homo sapiens
caaagcaggagtgga

SEQ ID NO: 936589 - DNA, 12 bp, Homo sapiens
caaagcaggatg

SEQ ID NO: 936590 - DNA, 18 bp, Homo sapiens
caaagcaggggagtatgc

SEQ ID NO: 936591 - DNA, 21 bp, Homo sapiens
caaagcaggggagtatgcaaa

SEQ ID NO: 936592 - DNA, 12 bp, Homo sapiens
caaagcagtgtt

SEQ ID NO: 936593 - DNA, 24 bp, Homo sapiens
caaagcatggacatttagaagaaa

SEQ ID NO: 936594 - DNA, 19 bp, Homo sapiens
caaagcatgggattattag

SEQ ID NO: 936595 - DNA, 14 bp, Homo sapiens
caaagccaaacaaa

SEQ ID NO: 936596 - DNA, 15 bp, Homo sapiens
caaagccaaacaaaa

SEQ ID NO: 936597 - DNA, 17 bp, Homo sapiens
caaagccacaaggctgg

SEQ ID NO: 936598 - DNA, 22 bp, Homo sapiens
caaagccacaaggctggccagc

SEQ ID NO: 936599 - DNA, 21 bp, Homo sapiens
caaagccagcgtcctcctctg

SEQ ID NO: 936600 - DNA, 14 bp, Homo sapiens
caaagccagggtct

SEQ ID NO: 936601 - DNA, 16 bp, Homo sapiens
caaagccattctttta

SEQ ID NO: 936602 - DNA, 14 bp, Homo sapiens
caaagcccaaggga

SEQ ID NO: 936603 - DNA, 16 bp, Homo sapiens
caaagccccatgtgcc

SEQ ID NO: 936604 - DNA, 15 bp, Homo sapiens
caaagccctaaaatt

SEQ ID NO: 936605 - DNA, 12 bp, Homo sapiens
caaagccctgcc

SEQ ID NO: 936606 - DNA, 15 bp, Homo sapiens
caaagccctgcctct

SEQ ID NO: 936607 - DNA, 19 bp, Homo sapiens
caaagccctgcctctgtgt

SEQ ID NO: 936608 - DNA, 14 bp, Homo sapiens
caaagcctcctttt

SEQ ID NO: 936609 - DNA, 17 bp, Homo sapiens
caaagcctgtcccagga

SEQ ID NO: 936610 - DNA, 14 bp, Homo sapiens
caaagcgacagatt

SEQ ID NO: 936611 - DNA, 15 bp, Homo sapiens
caaagcgacagattc

SEQ ID NO: 936612 - DNA, 19 bp, Homo sapiens
caaagcgcccacccaggtc

SEQ ID NO: 936613 - DNA, 17 bp, Homo sapiens
caaagcggggggagggt

SEQ ID NO: 936614 - DNA, 19 bp, Homo sapiens
caaagcggtccctgtccct

SEQ ID NO: 936615 - DNA, 15 bp, Homo sapiens
caaagcgtttcttta

SEQ ID NO: 936616 - DNA, 20 bp, Homo sapiens
caaagcgtttctttacttct

SEQ ID NO: 936617 - DNA, 15 bp, Homo sapiens
caaagctaaaataaa

SEQ ID NO: 936618 - DNA, 16 bp, Homo sapiens
caaagctacaggactg

SEQ ID NO: 936619 - DNA, 22 bp, Homo sapiens
caaagctagggtggcccttgca

SEQ ID NO: 936620 - DNA, 17 bp, Homo sapiens
caaagctgcctgtgcca

SEQ ID NO: 936621 - DNA, 19 bp, Homo sapiens
caaagctggaggcatcacg

SEQ ID NO: 936622 - DNA, 12 bp, Homo sapiens
caaagctgttaa

SEQ ID NO: 936623 - DNA, 20 bp, Homo sapiens
caaagctgttaaactgttag

SEQ ID NO: 936624 - DNA, 19 bp, Homo sapiens
caaagcttctatcccagga

SEQ ID NO: 936625 - DNA, 20 bp, Homo sapiens
caaagcttctatcccaggag

SEQ ID NO: 936626 - DNA, 21 bp, Homo sapiens
caaagcttggattaaatacat

SEQ ID NO: 936627 - DNA, 21 bp, Homo sapiens
caaagctttactactgtggaa

SEQ ID NO: 936628 - DNA, 16 bp, Homo sapiens
caaagctttcctgccc

SEQ ID NO: 936629 - DNA, 19 bp, Homo sapiens
caaagctttgctacaaatt

SEQ ID NO: 936630 - DNA, 15 bp, Homo sapiens
caaagctttggctga

SEQ ID NO: 936631 - DNA, 19 bp, Homo sapiens
caaagctttggctgagacc

SEQ ID NO: 936632 - DNA, 16 bp, Homo sapiens
caaagcttttagaaat

SEQ ID NO: 936633 - DNA, 20 bp, Homo sapiens
caaagcttttagaaatactg

SEQ ID NO: 936634 - DNA, 16 bp, Homo sapiens
caaagctttttccaga

SEQ ID NO: 936635 - DNA, 17 bp, Homo sapiens
caaaggaaaatgtctgt

SEQ ID NO: 936636 - DNA, 17 bp, Homo sapiens
caaaggaaggtggatgg

SEQ ID NO: 936637 - DNA, 19 bp, Homo sapiens
caaaggaagtctaaatatt

SEQ ID NO: 936638 - DNA, 16 bp, Homo sapiens
caaaggaagtctagga

SEQ ID NO: 936639 - DNA, 23 bp, Homo sapiens
caaaggactgttttttcctgagc

SEQ ID NO: 936640 - DNA, 12 bp, Homo sapiens
caaaggagaaaa

SEQ ID NO: 936641 - DNA, 22 bp, Homo sapiens
caaaggagaaaaaaaaccttgt

SEQ ID NO: 936642 - DNA, 10 bp, Homo sapiens
caaaggagca

SEQ ID NO: 936643 - DNA, 14 bp, Homo sapiens
caaaggagccttga

SEQ ID NO: 936644 - DNA, 16 bp, Homo sapiens
caaaggagctttctca

SEQ ID NO: 936645 - DNA, 17 bp, Homo sapiens
caaaggagctttctcaa

SEQ ID NO: 936646 - DNA, 22 bp, Homo sapiens
caaaggagctttctcaatgtct

SEQ ID NO: 936647 - DNA, 22 bp, Homo sapiens
caaaggaggggaaacaatgaaa

SEQ ID NO: 936648 - DNA, 22 bp, Homo sapiens
caaaggatagtgcgatgtttca

SEQ ID NO: 936649 - DNA, 21 bp, Homo sapiens
caaaggatgaagaacacagca

SEQ ID NO: 936650 - DNA, 19 bp, Homo sapiens
caaaggatgagaatgtgac

SEQ ID NO: 936651 - DNA, 17 bp, Homo sapiens
caaaggcagtcccggga

SEQ ID NO: 936652 - DNA, 20 bp, Homo sapiens
caaaggccacaggcagtcca

SEQ ID NO: 936653 - DNA, 16 bp, Homo sapiens
caaaggccagcggtga

SEQ ID NO: 936654 - DNA, 20 bp, Homo sapiens
caaaggccagcggtgaccag

SEQ ID NO: 936655 - DNA, 20 bp, Homo sapiens
caaaggccagtggaagaaac

SEQ ID NO: 936656 - DNA, 13 bp, Homo sapiens
caaaggcccaggg

SEQ ID NO: 936657 - DNA, 15 bp, Homo sapiens
caaaggcccagggag

SEQ ID NO: 936658 - DNA, 11 bp, Homo sapiens
caaaggcccat

SEQ ID NO: 936659 - DNA, 11 bp, Homo sapiens
caaaggccctt

SEQ ID NO: 936660 - DNA, 15 bp, Homo sapiens
caaaggcccttgtca

SEQ ID NO: 936661 - DNA, 13 bp, Homo sapiens
caaaggcctgggc

SEQ ID NO: 936662 - DNA, 18 bp, Homo sapiens
caaagggaaatatcattt

SEQ ID NO: 936663 - DNA, 20 bp, Homo sapiens
caaagggaagtaacagacac

SEQ ID NO: 936664 - DNA, 19 bp, Homo sapiens
caaagggaagtgaggccca

SEQ ID NO: 936665 - DNA, 20 bp, Homo sapiens
ccttcctctgagccttggga

SEQ ID NO: 936666 - DNA, 13 bp, Homo sapiens
ccttcctctgagg

SEQ ID NO: 936667 - DNA, 14 bp, Homo sapiens
ccttcctctgagga

SEQ ID NO: 936668 - DNA, 15 bp, Homo sapiens
ccttcctctgaggac

SEQ ID NO: 936669 - DNA, 18 bp, Homo sapiens
ccttcctcttcctgccct

SEQ ID NO: 936670 - DNA, 16 bp, Homo sapiens
ccttcctgccaccagt

SEQ ID NO: 936671 - DNA, 17 bp, Homo sapiens
ccttcctgccaccagtc

SEQ ID NO: 936672 - DNA, 13 bp, Homo sapiens
ccttcctgccact

SEQ ID NO: 936673 - DNA, 11 bp, Homo sapiens
ccttcctgccc

SEQ ID NO: 936674 - DNA, 19 bp, Homo sapiens
ccttcctggaaacagcatg

SEQ ID NO: 936675 - DNA, 20 bp, Homo sapiens
ccttcctggaaacagcatga

SEQ ID NO: 936676 - DNA, 14 bp, Homo sapiens
ccttcctggacaca

SEQ ID NO: 936677 - DNA, 21 bp, Homo sapiens
ccttcctggcccaggccttgc

SEQ ID NO: 936678 - DNA, 22 bp, Homo sapiens
ccttcctggcccaggccttgct

SEQ ID NO: 936679 - DNA, 14 bp, Homo sapiens
ccttcctggcctca

SEQ ID NO: 936680 - DNA, 21 bp, Homo sapiens
ccttcctggcgggggtgggcc

SEQ ID NO: 936681 - DNA, 22 bp, Homo sapiens
ccttcctggcgggggtgggccg

SEQ ID NO: 936682 - DNA, 12 bp, Homo sapiens
ccttcctgggag

SEQ ID NO: 936683 - DNA, 19 bp, Homo sapiens
ccttcctggggcatctggc

SEQ ID NO: 936684 - DNA, 16 bp, Homo sapiens
ccttcctgtcccacct

SEQ ID NO: 936685 - DNA, 14 bp, Homo sapiens
ccttcctgtccctg

SEQ ID NO: 936686 - DNA, 15 bp, Homo sapiens
ccttcctgtcctgcc

SEQ ID NO: 936687 - DNA, 21 bp, Homo sapiens
ccttcctgtcctgcctcctca

SEQ ID NO: 936688 - DNA, 17 bp, Homo sapiens
ccttcctgttcttcctt

SEQ ID NO: 936689 - DNA, 18 bp, Homo sapiens
ccttcctgttcttccttc

SEQ ID NO: 936690 - DNA, 20 bp, Homo sapiens
ccttcctgttcttccttcct

SEQ ID NO: 936691 - DNA, 21 bp, Homo sapiens
ccttcctgtttcagacccccc

SEQ ID NO: 936692 - DNA, 14 bp, Homo sapiens
ccttccttcaggac

SEQ ID NO: 936693 - DNA, 15 bp, Homo sapiens
ccttccttcaggact

SEQ ID NO: 936694 - DNA, 15 bp, Homo sapiens
ccttccttccctggc

SEQ ID NO: 936695 - DNA, 16 bp, Homo sapiens
ccttccttccctggct

SEQ ID NO: 936696 - DNA, 22 bp, Homo sapiens
ccttccttctgctcccacccca

SEQ ID NO: 936697 - DNA, 15 bp, Homo sapiens
ccttccttgactgtc

SEQ ID NO: 936698 - DNA, 16 bp, Homo sapiens
ccttccttgactgtct

SEQ ID NO: 936699 - DNA, 22 bp, Homo sapiens
ccttccttgactgtctagccac

SEQ ID NO: 936700 - DNA, 16 bp, Homo sapiens
ccttccttgggcgtct

SEQ ID NO: 936701 - DNA, 23 bp, Homo sapiens
ccttccttgggcgtctcccccag

SEQ ID NO: 936702 - DNA, 19 bp, Homo sapiens
ccttcctttaggtctggtt

SEQ ID NO: 936703 - DNA, 14 bp, Homo sapiens
ccttcctttctcca

SEQ ID NO: 936704 - DNA, 16 bp, Homo sapiens
ccttcctttctcccct

SEQ ID NO: 936705 - DNA, 19 bp, Homo sapiens
ccttccttttccctgcttc

SEQ ID NO: 936706 - DNA, 23 bp, Homo sapiens
ccttccttttccctgcttccagg

SEQ ID NO: 936707 - DNA, 22 bp, Homo sapiens
ccttcctttttattcagctaga

SEQ ID NO: 936708 - DNA, 14 bp, Homo sapiens
ccttcgaaaggcct

SEQ ID NO: 936709 - DNA, 16 bp, Homo sapiens
ccttcgaaaggccttc

SEQ ID NO: 936710 - DNA, 15 bp, Homo sapiens
ccttcgatacaccgg

SEQ ID NO: 936711 - DNA, 20 bp, Homo sapiens
ccttcgatacaccgggcctg

SEQ ID NO: 936712 - DNA, 22 bp, Homo sapiens
ccttcgatacaccgggcctgga

SEQ ID NO: 936713 - DNA, 23 bp, Homo sapiens
ccttcgatacaccgggcctggag

SEQ ID NO: 936714 - DNA, 16 bp, Homo sapiens
ccttcgctccatgttt

SEQ ID NO: 936715 - DNA, 15 bp, Homo sapiens
ccttcgctcctcctc

SEQ ID NO: 936716 - DNA, 17 bp, Homo sapiens
ccttcgcttcttgcctc

SEQ ID NO: 936717 - DNA, 18 bp, Homo sapiens
ccttcgcttcttgcctct

SEQ ID NO: 936718 - DNA, 19 bp, Homo sapiens
ccttcgcttcttgcctctg

SEQ ID NO: 936719 - DNA, 13 bp, Homo sapiens
ccttcggctccgg

SEQ ID NO: 936720 - DNA, 15 bp, Homo sapiens
ccttcgggctgtgcc

SEQ ID NO: 936721 - DNA, 22 bp, Homo sapiens
ccttcgtatcccgagtctggga

SEQ ID NO: 936722 - DNA, 16 bp, Homo sapiens
ccttcgtctttcccat

SEQ ID NO: 936723 - DNA, 22 bp, Homo sapiens
ccttcgtgaacatcccctccca

SEQ ID NO: 936724 - DNA, 18 bp, Homo sapiens
ccttcgtgtctctcccac

SEQ ID NO: 936725 - DNA, 20 bp, Homo sapiens
ccttcgtgtctctcccaccc

SEQ ID NO: 936726 - DNA, 14 bp, Homo sapiens
ccttcgtgtgctgc

SEQ ID NO: 936727 - DNA, 14 bp, Homo sapiens
ccttcgtgtggctc

SEQ ID NO: 936728 - DNA, 15 bp, Homo sapiens
ccttcgtgtggctcc

SEQ ID NO: 936729 - DNA, 19 bp, Homo sapiens
ccttcgtgtggctcctggt

SEQ ID NO: 936730 - DNA, 20 bp, Homo sapiens
ccttcgtgtggctcctggta

SEQ ID NO: 936731 - DNA, 17 bp, Homo sapiens
ccttcgttaactgtgta

SEQ ID NO: 936732 - DNA, 18 bp, Homo sapiens
ccttctacaaggactcca

SEQ ID NO: 936733 - DNA, 15 bp, Homo sapiens
ccttctacagaacct

SEQ ID NO: 936734 - DNA, 21 bp, Homo sapiens
ccttctacagaacctgagggc

SEQ ID NO: 936735 - DNA, 22 bp, Homo sapiens
ccttctacagaacctgagggca

SEQ ID NO: 936736 - DNA, 14 bp, Homo sapiens
ccttctactgagcc

SEQ ID NO: 936737 - DNA, 13 bp, Homo sapiens
ccttctagaacac

SEQ ID NO: 936738 - DNA, 18 bp, Homo sapiens
ccttctagtgagcctggg

SEQ ID NO: 936739 - DNA, 19 bp, Homo sapiens
ccttctagtgagcctgggc

SEQ ID NO: 936740 - DNA, 13 bp, Homo sapiens
caaatggtaggca

SEQ ID NO: 936741 - DNA, 15 bp, Homo sapiens
caaatggtatctttt

SEQ ID NO: 936742 - DNA, 19 bp, Homo sapiens
caaatggttcttacttttc

SEQ ID NO: 936743 - DNA, 17 bp, Homo sapiens
caaatgtagttttgtat

SEQ ID NO: 936744 - DNA, 14 bp, Homo sapiens
caaatgtattaatg

SEQ ID NO: 936745 - DNA, 20 bp, Homo sapiens
caaatgtcacagtaatgcaa

SEQ ID NO: 936746 - DNA, 14 bp, Homo sapiens
caaatgtcagagct

SEQ ID NO: 936747 - DNA, 13 bp, Homo sapiens
caaatgtcattgt

SEQ ID NO: 936748 - DNA, 15 bp, Homo sapiens
caaatgtcattgtct

SEQ ID NO: 936749 - DNA, 21 bp, Homo sapiens
caaatgtcctaacagagaaat

SEQ ID NO: 936750 - DNA, 19 bp, Homo sapiens
caaatgtcctccagaagcc

SEQ ID NO: 936751 - DNA, 16 bp, Homo sapiens
caaatgtctagtttct

SEQ ID NO: 936752 - DNA, 20 bp, Homo sapiens
caaatgtctagtttctagtg

SEQ ID NO: 936753 - DNA, 13 bp, Homo sapiens
caaatgtcttcca

SEQ ID NO: 936754 - DNA, 22 bp, Homo sapiens
caaatgtgaaacggaagctcat

SEQ ID NO: 936755 - DNA, 17 bp, Homo sapiens
caaatgtgtacacctgc

SEQ ID NO: 936756 - DNA, 21 bp, Homo sapiens
caaatgtgtataaactgctgt

SEQ ID NO: 936757 - DNA, 21 bp, Homo sapiens
caaatgtgtgggtttttaaaa

SEQ ID NO: 936758 - DNA, 19 bp, Homo sapiens
caaatgtgtttttctatat

SEQ ID NO: 936759 - DNA, 21 bp, Homo sapiens
caaatgtgtttttctatatag

SEQ ID NO: 936760 - DNA, 17 bp, Homo sapiens
caaatgttaactgccaa

SEQ ID NO: 936761 - DNA, 17 bp, Homo sapiens
caaatgttacagtttat

SEQ ID NO: 936762 - DNA, 20 bp, Homo sapiens
caaatgttcatatttattga

SEQ ID NO: 936763 - DNA, 23 bp, Homo sapiens
caaatgtttataactctagggat

SEQ ID NO: 936764 - DNA, 16 bp, Homo sapiens
caaatgtttatttaaa

SEQ ID NO: 936765 - DNA, 13 bp, Homo sapiens
caaatgtttcctt

SEQ ID NO: 936766 - DNA, 11 bp, Homo sapiens
caaatgtttct

SEQ ID NO: 936767 - DNA, 13 bp, Homo sapiens
caaatgttttaaa

SEQ ID NO: 936768 - DNA, 13 bp, Homo sapiens
caaattaaaaaaa

SEQ ID NO: 936769 - DNA, 19 bp, Homo sapiens
caaattaaaaaaaaattgt

SEQ ID NO: 936770 - DNA, 14 bp, Homo sapiens
caaattaaaacaaa

SEQ ID NO: 936771 - DNA, 20 bp, Homo sapiens
caaattaaaacatatttcat

SEQ ID NO: 936772 - DNA, 13 bp, Homo sapiens
caaattaacttga

SEQ ID NO: 936773 - DNA, 13 bp, Homo sapiens
caaattaatttta

SEQ ID NO: 936774 - DNA, 14 bp, Homo sapiens
caaattactccaag

SEQ ID NO: 936775 - DNA, 16 bp, Homo sapiens
caaattactctttctc

SEQ ID NO: 936776 - DNA, 19 bp, Homo sapiens
caaattagaaaatgttatt

SEQ ID NO: 936777 - DNA, 15 bp, Homo sapiens
caaattagcatgcaa

SEQ ID NO: 936778 - DNA, 15 bp, Homo sapiens
caaattagttatata

SEQ ID NO: 936779 - DNA, 24 bp, Homo sapiens
caaattataagagacagacacttg

SEQ ID NO: 936780 - DNA, 14 bp, Homo sapiens
caaattatgtgaaa

SEQ ID NO: 936781 - DNA, 15 bp, Homo sapiens
caaattatgtgaaat

SEQ ID NO: 936782 - DNA, 22 bp, Homo sapiens
caaattattaattgtcctgtgt

SEQ ID NO: 936783 - DNA, 19 bp, Homo sapiens
caaattatttattacttgt

SEQ ID NO: 936784 - DNA, 23 bp, Homo sapiens
caaattatttattacttgtgcac

SEQ ID NO: 936785 - DNA, 17 bp, Homo sapiens
caaattatttgtgtaat

SEQ ID NO: 936786 - DNA, 22 bp, Homo sapiens
caaattattttaatattttgta

SEQ ID NO: 936787 - DNA, 18 bp, Homo sapiens
caaattcaaggccttcca

SEQ ID NO: 936788 - DNA, 12 bp, Homo sapiens
caaattcagttt

SEQ ID NO: 936789 - DNA, 14 bp, Homo sapiens
caaattcagtttca

SEQ ID NO: 936790 - DNA, 17 bp, Homo sapiens
caaattcagtttcataa

SEQ ID NO: 936791 - DNA, 20 bp, Homo sapiens
caaattcagtttcataaaag

SEQ ID NO: 936792 - DNA, 20 bp, Homo sapiens
caaattcctgttagccaggt

SEQ ID NO: 936793 - DNA, 22 bp, Homo sapiens
caaattctcaacctaccacccc

SEQ ID NO: 936794 - DNA, 22 bp, Homo sapiens
caaattctgcttgcttgctttt

SEQ ID NO: 936795 - DNA, 14 bp, Homo sapiens
ccttctgtggggct

SEQ ID NO: 936796 - DNA, 19 bp, Homo sapiens
ccttctgtggggctgggca

SEQ ID NO: 936797 - DNA, 20 bp, Homo sapiens
ccttctgtggggctgggcac

SEQ ID NO: 936798 - DNA, 21 bp, Homo sapiens
ccttctgtggggctgggcacc

SEQ ID NO: 936799 - DNA, 22 bp, Homo sapiens
ccttcttattctcactccacca

SEQ ID NO: 936800 - DNA, 14 bp, Homo sapiens
ccttcttcacccag

SEQ ID NO: 936801 - DNA, 17 bp, Homo sapiens
ccttcttccaaggagca

SEQ ID NO: 936802 - DNA, 20 bp, Homo sapiens
ccttcttccaaggagcagag

SEQ ID NO: 936803 - DNA, 15 bp, Homo sapiens
ccttcttcccgcccc

SEQ ID NO: 936804 - DNA, 16 bp, Homo sapiens
ccttcttggcttctgg

SEQ ID NO: 936805 - DNA, 21 bp, Homo sapiens
ccttcttggcttctgggacct

SEQ ID NO: 936806 - DNA, 19 bp, Homo sapiens
ccttcttgggccccagacc

SEQ ID NO: 936807 - DNA, 18 bp, Homo sapiens
ccttcttgggtagggcag

SEQ ID NO: 936808 - DNA, 17 bp, Homo sapiens
ccttcttgggtctgccc

SEQ ID NO: 936809 - DNA, 19 bp, Homo sapiens
ccttcttgggtctgccctg

SEQ ID NO: 936810 - DNA, 13 bp, Homo sapiens
ccttcttggtgct

SEQ ID NO: 936811 - DNA, 19 bp, Homo sapiens
ccttcttggtttcagccaa

SEQ ID NO: 936812 - DNA, 23 bp, Homo sapiens
ccttctttcactctgtcatcttt

SEQ ID NO: 936813 - DNA, 16 bp, Homo sapiens
ccttctttctggactg

SEQ ID NO: 936814 - DNA, 17 bp, Homo sapiens
ccttctttctggactgg

SEQ ID NO: 936815 - DNA, 19 bp, Homo sapiens
ccttctttctggactggcg

SEQ ID NO: 936816 - DNA, 19 bp, Homo sapiens
ccttctttgggatagagaa

SEQ ID NO: 936817 - DNA, 12 bp, Homo sapiens
ccttcttttgta

SEQ ID NO: 936818 - DNA, 14 bp, Homo sapiens
ccttctttttctgg

SEQ ID NO: 936819 - DNA, 14 bp, Homo sapiens
ccttctttttcttc

SEQ ID NO: 936820 - DNA, 16 bp, Homo sapiens
ccttctttttcttctt

SEQ ID NO: 936821 - DNA, 14 bp, Homo sapiens
ccttgaaaaacaaa

SEQ ID NO: 936822 - DNA, 13 bp, Homo sapiens
ccttgaaaggaag

SEQ ID NO: 936823 - DNA, 13 bp, Homo sapiens
ccttgaacactgg

SEQ ID NO: 936824 - DNA, 16 bp, Homo sapiens
ccttgaaccacttccc

SEQ ID NO: 936825 - DNA, 14 bp, Homo sapiens
ccttgaacccaaca

SEQ ID NO: 936826 - DNA, 15 bp, Homo sapiens
ccttgaacccaacag

SEQ ID NO: 936827 - DNA, 13 bp, Homo sapiens
ccttgaactgagg

SEQ ID NO: 936828 - DNA, 20 bp, Homo sapiens
ccttgaactgaggccctgtg

SEQ ID NO: 936829 - DNA, 18 bp, Homo sapiens
ccttgaagaactgcaggc

SEQ ID NO: 936830 - DNA, 21 bp, Homo sapiens
ccttgaagaactgcaggccct

SEQ ID NO: 936831 - DNA, 23 bp, Homo sapiens
ccttgaagaaggggctgttcttc

SEQ ID NO: 936832 - DNA, 16 bp, Homo sapiens
ccttgaagacagagca

SEQ ID NO: 936833 - DNA, 19 bp, Homo sapiens
ccttgaagaggggaggggc

SEQ ID NO: 936834 - DNA, 13 bp, Homo sapiens
ccttgaagatatc

SEQ ID NO: 936835 - DNA, 11 bp, Homo sapiens
ccttgaagcaa

SEQ ID NO: 936836 - DNA, 15 bp, Homo sapiens
ccttgaagcaataac

SEQ ID NO: 936837 - DNA, 13 bp, Homo sapiens
ccttgaataataa

SEQ ID NO: 936838 - DNA, 18 bp, Homo sapiens
ccttgaatccagaacaca

SEQ ID NO: 936839 - DNA, 19 bp, Homo sapiens
ccttgaatctgcagggagc

SEQ ID NO: 936840 - DNA, 16 bp, Homo sapiens
ccttgaatgctgccag

SEQ ID NO: 936841 - DNA, 12 bp, Homo sapiens
ccttgaatgtgg

SEQ ID NO: 936842 - DNA, 12 bp, Homo sapiens
ccttgacagagc

SEQ ID NO: 936843 - DNA, 15 bp, Homo sapiens
ccttgacagagcagc

SEQ ID NO: 936844 - DNA, 19 bp, Homo sapiens
ccttgacctgcattgtaaa

SEQ ID NO: 936845 - DNA, 21 bp, Homo sapiens
ccttgactggacctggtggct

SEQ ID NO: 936846 - DNA, 20 bp, Homo sapiens
ccttgactgtacagagactc

SEQ ID NO: 936847 - DNA, 18 bp, Homo sapiens
ccttgagacctcagccat

SEQ ID NO: 936848 - DNA, 16 bp, Homo sapiens
ccttgagaggagaaat

SEQ ID NO: 936849 - DNA, 12 bp, Homo sapiens
ccttgagatgag

SEQ ID NO: 936850 - DNA, 17 bp, Homo sapiens
ccttgagccctggctgt

SEQ ID NO: 936851 - DNA, 14 bp, Homo sapiens
ccttgagctgagat

SEQ ID NO: 936852 - DNA, 18 bp, Homo sapiens
ccttgaggaaacaacagc

SEQ ID NO: 936853 - DNA, 22 bp, Homo sapiens
ccttgaggaggggcaggtaaac

SEQ ID NO: 936854 - DNA, 18 bp, Homo sapiens
ccttgaggggccccagcg

SEQ ID NO: 936855 - DNA, 14 bp, Homo sapiens
ccttgagggtgggc

SEQ ID NO: 936856 - DNA, 15 bp, Homo sapiens
ccttgagggtgggcc

SEQ ID NO: 936857 - DNA, 16 bp, Homo sapiens
ccttgagggtgggcca

SEQ ID NO: 936858 - DNA, 18 bp, Homo sapiens
ccttgagggtgggccagc

SEQ ID NO: 936859 - DNA, 20 bp, Homo sapiens
ccttgagggtgggccagcat

SEQ ID NO: 936860 - DNA, 12 bp, Homo sapiens
ccttgaggtctt

SEQ ID NO: 936861 - DNA, 19 bp, Homo sapiens
ccttgagtgacatgcggct

SEQ ID NO: 936862 - DNA, 23 bp, Homo sapiens
ccttgagttgattcagctctgca

SEQ ID NO: 936863 - DNA, 13 bp, Homo sapiens
ccttggagaggag

SEQ ID NO: 936864 - DNA, 15 bp, Homo sapiens
ccttggagaggagag

SEQ ID NO: 936865 - DNA, 14 bp, Homo sapiens
ccttggagcaggca

SEQ ID NO: 936866 - DNA, 16 bp, Homo sapiens
ccttggagctgccgtg

SEQ ID NO: 936867 - DNA, 14 bp, Homo sapiens
ccttggagggagag

SEQ ID NO: 936868 - DNA, 20 bp, Homo sapiens
ccttggagggagaggtggca

SEQ ID NO: 936869 - DNA, 18 bp, Homo sapiens
ccttggataatgctgttg

SEQ ID NO: 936870 - DNA, 23 bp, Homo sapiens
ccttggataatgctgttgcctca

SEQ ID NO: 936871 - DNA, 22 bp, Homo sapiens
ccttggcacccccatgctgcct

SEQ ID NO: 936872 - DNA, 16 bp, Homo sapiens
ccttggcatgggcgca

SEQ ID NO: 936873 - DNA, 20 bp, Homo sapiens
ccttggcccacactgaggct

SEQ ID NO: 936874 - DNA, 19 bp, Homo sapiens
ccttggcccaggagctctg

SEQ ID NO: 936875 - DNA, 20 bp, Homo sapiens
ccttggcccaggagctctgc

SEQ ID NO: 936876 - DNA, 15 bp, Homo sapiens
ccttggcccctcaca

SEQ ID NO: 936877 - DNA, 23 bp, Homo sapiens
ccttggcccctcacatcctctcc

SEQ ID NO: 936878 - DNA, 20 bp, Homo sapiens
ccttggccgcataggcccag

SEQ ID NO: 936879 - DNA, 21 bp, Homo sapiens
ccttggccggctgtgctcaga

SEQ ID NO: 936880 - DNA, 13 bp, Homo sapiens
ccttggcctcaga

SEQ ID NO: 936881 - DNA, 19 bp, Homo sapiens
ccttggcctccatttctgt

SEQ ID NO: 936882 - DNA, 24 bp, Homo sapiens
ccttggcctccatttctgtctcta

SEQ ID NO: 936883 - DNA, 17 bp, Homo sapiens
ccttggcctcccaaagt

SEQ ID NO: 936884 - DNA, 20 bp, Homo sapiens
ccttggcctcccaaagtgct

SEQ ID NO: 936885 - DNA, 15 bp, Homo sapiens
ccttggcctgtctca

SEQ ID NO: 936886 - DNA, 17 bp, Homo sapiens
ccttggcggacactggg

SEQ ID NO: 936887 - DNA, 22 bp, Homo sapiens
ccttggctcccgggggccccac

SEQ ID NO: 936888 - DNA, 14 bp, Homo sapiens
ccttggctgcagcc

SEQ ID NO: 936889 - DNA, 17 bp, Homo sapiens
ccttggctgcagccatc

SEQ ID NO: 936890 - DNA, 18 bp, Homo sapiens
ccttggctgctcactgtc

SEQ ID NO: 936891 - DNA, 20 bp, Homo sapiens
ccttggcttcaggggagtcc

SEQ ID NO: 936892 - DNA, 15 bp, Homo sapiens
ccttggcttctgctt

SEQ ID NO: 936893 - DNA, 16 bp, Homo sapiens
ccttggcttctgcttc

SEQ ID NO: 936894 - DNA, 22 bp, Homo sapiens
ccttggctttcagagccagcct

SEQ ID NO: 936895 - DNA, 19 bp, Homo sapiens
ccttgggataattccttgg

SEQ ID NO: 936896 - DNA, 12 bp, Homo sapiens
ccttgggcagaa

SEQ ID NO: 936897 - DNA, 18 bp, Homo sapiens
ccttgggcatccacccag

SEQ ID NO: 936898 - DNA, 15 bp, Homo sapiens
ccttgggccctggaa

SEQ ID NO: 936899 - DNA, 12 bp, Homo sapiens
ccttgggccctt

SEQ ID NO: 936900 - DNA, 14 bp, Homo sapiens
ccttgggccctttg

SEQ ID NO: 936901 - DNA, 19 bp, Homo sapiens
ccttgggccggtgctgggg

SEQ ID NO: 936902 - DNA, 14 bp, Homo sapiens
ccttgggcggctga

SEQ ID NO: 936903 - DNA, 15 bp, Homo sapiens
ccttgggctcctggc

SEQ ID NO: 936904 - DNA, 20 bp, Homo sapiens
ccttgggctcctggctgcca

SEQ ID NO: 936905 - DNA, 14 bp, Homo sapiens
ccttgggctgctcc

SEQ ID NO: 936906 - DNA, 17 bp, Homo sapiens
ccttggggaatttcctc

SEQ ID NO: 936907 - DNA, 13 bp, Homo sapiens
ccttggggcctgg

SEQ ID NO: 936908 - DNA, 14 bp, Homo sapiens
ccttggggcctggc

SEQ ID NO: 936909 - DNA, 15 bp, Homo sapiens
ccttgggggctccca

SEQ ID NO: 936910 - DNA, 19 bp, Homo sapiens
ccttgggggggctgccttt

SEQ ID NO: 936911 - DNA, 21 bp, Homo sapiens
ccttggggtaagccagagcct

SEQ ID NO: 936912 - DNA, 20 bp, Homo sapiens
ccttggggtccctccacccc

SEQ ID NO: 936913 - DNA, 20 bp, Homo sapiens
ccttggggtgggggccaggc

SEQ ID NO: 936914 - DNA, 16 bp, Homo sapiens
ccttgggtgacacctc

SEQ ID NO: 936915 - DNA, 14 bp, Homo sapiens
ccttgggtggcccc

SEQ ID NO: 936916 - DNA, 15 bp, Homo sapiens
ccttggtatgtgcca

SEQ ID NO: 936917 - DNA, 17 bp, Homo sapiens
ccttggtatgtgccagg

SEQ ID NO: 936918 - DNA, 19 bp, Homo sapiens
ccttggtatgtgccaggct

SEQ ID NO: 936919 - DNA, 20 bp, Homo sapiens
ccttggtgctcttgcttttt

SEQ ID NO: 936920 - DNA, 16 bp, Homo sapiens
ccttggtggagcagcc

SEQ ID NO: 936921 - DNA, 17 bp, Homo sapiens
ccttggtggagcagcca

SEQ ID NO: 936922 - DNA, 19 bp, Homo sapiens
ccttggtggagcagccaga

SEQ ID NO: 936923 - DNA, 20 bp, Homo sapiens
ccttggtggagcagccagag

SEQ ID NO: 936924 - DNA, 23 bp, Homo sapiens
ccttggtggagcagccagagctg

SEQ ID NO: 936925 - DNA, 14 bp, Homo sapiens
caacagcccaggca

SEQ ID NO: 936926 - DNA, 18 bp, Homo sapiens
caacagccctgcctgaga

SEQ ID NO: 936927 - DNA, 12 bp, Homo sapiens
caacagcctggg

SEQ ID NO: 936928 - DNA, 13 bp, Homo sapiens
caacagcctgggg

SEQ ID NO: 936929 - DNA, 15 bp, Homo sapiens
caacagctcaagtct

SEQ ID NO: 936930 - DNA, 23 bp, Homo sapiens
caacagctctcgttctccttccc

SEQ ID NO: 936931 - DNA, 14 bp, Homo sapiens
caacagctgaagca

SEQ ID NO: 936932 - DNA, 20 bp, Homo sapiens
caacagcttttcccaggaga

SEQ ID NO: 936933 - DNA, 23 bp, Homo sapiens
caacaggagaatggggttcctgc

SEQ ID NO: 936934 - DNA, 20 bp, Homo sapiens
caacaggcttatgaatatat

SEQ ID NO: 936935 - DNA, 22 bp, Homo sapiens
caacagggaagaaactttctgg

SEQ ID NO: 936936 - DNA, 21 bp, Homo sapiens
caacagggagcacctgtctgg

SEQ ID NO: 936937 - DNA, 22 bp, Homo sapiens
caacagggagcacctgtctgga

SEQ ID NO: 936938 - DNA, 20 bp, Homo sapiens
caacaggggaggaaaaaaga

SEQ ID NO: 936939 - DNA, 21 bp, Homo sapiens
caacaggggaggaaaaaagaa

SEQ ID NO: 936940 - DNA, 19 bp, Homo sapiens
caacagggtagatttctct

SEQ ID NO: 936941 - DNA, 22 bp, Homo sapiens
caacagggtagatttctcttgg

SEQ ID NO: 936942 - DNA, 23 bp, Homo sapiens
caacaggtggcaggaccaggact

SEQ ID NO: 936943 - DNA, 15 bp, Homo sapiens
caacagtaatcagag

SEQ ID NO: 936944 - DNA, 21 bp, Homo sapiens
caacagtaatctatgtgtttc

SEQ ID NO: 936945 - DNA, 21 bp, Homo sapiens
caacagttactatagtggtga

SEQ ID NO: 936946 - DNA, 20 bp, Homo sapiens
caacagttgtatgtttgctg

SEQ ID NO: 936947 - DNA, 22 bp, Homo sapiens
caacagttgtatgtttgctgat

SEQ ID NO: 936948 - DNA, 23 bp, Homo sapiens
caacatagtgagacccctgtctc

SEQ ID NO: 936949 - DNA, 14 bp, Homo sapiens
caacatatctctgc

SEQ ID NO: 936950 - DNA, 16 bp, Homo sapiens
caacatatctctgccg

SEQ ID NO: 936951 - DNA, 22 bp, Homo sapiens
caacatcaatgttcattgtaat

SEQ ID NO: 936952 - DNA, 19 bp, Homo sapiens
caacatcacacagtatact

SEQ ID NO: 936953 - DNA, 12 bp, Homo sapiens
caacatccagat

SEQ ID NO: 936954 - DNA, 17 bp, Homo sapiens
caacatcccacagtggc

SEQ ID NO: 936955 - DNA, 15 bp, Homo sapiens
caacatcccattgcc

SEQ ID NO: 936956 - DNA, 20 bp, Homo sapiens
caacatcccattgccctggt

SEQ ID NO: 936957 - DNA, 14 bp, Homo sapiens
caacatctctgaat

SEQ ID NO: 936958 - DNA, 13 bp, Homo sapiens
caacatcttttta

SEQ ID NO: 936959 - DNA, 16 bp, Homo sapiens
caacatcttttttatt

SEQ ID NO: 936960 - DNA, 16 bp, Homo sapiens
caacatgcattgccat

SEQ ID NO: 936961 - DNA, 20 bp, Homo sapiens
caacatggcaattgcactca

SEQ ID NO: 936962 - DNA, 12 bp, Homo sapiens
caacatgggagg

SEQ ID NO: 936963 - DNA, 14 bp, Homo sapiens
caacatgggaggga

SEQ ID NO: 936964 - DNA, 18 bp, Homo sapiens
caacatggtgaaaccccg

SEQ ID NO: 936965 - DNA, 15 bp, Homo sapiens
caacatgtgtttctg

SEQ ID NO: 936966 - DNA, 16 bp, Homo sapiens
caacatgtgtttctga

SEQ ID NO: 936967 - DNA, 18 bp, Homo sapiens
caacatgttactgaccag

SEQ ID NO: 936968 - DNA, 15 bp, Homo sapiens
caacatgttatttgt

SEQ ID NO: 936969 - DNA, 19 bp, Homo sapiens
caacatgttgggaaacttg

SEQ ID NO: 936970 - DNA, 23 bp, Homo sapiens
caacatgttgggaaacttggctc

SEQ ID NO: 936971 - DNA, 20 bp, Homo sapiens
caacattaaaacaatattgt

SEQ ID NO: 936972 - DNA, 13 bp, Homo sapiens
caacattaaaact

SEQ ID NO: 936973 - DNA, 11 bp, Homo sapiens
caacattctgc

SEQ ID NO: 936974 - DNA, 19 bp, Homo sapiens
caacattctgcaatggcag

SEQ ID NO: 936975 - DNA, 16 bp, Homo sapiens
caacattgtgatgtat

SEQ ID NO: 936976 - DNA, 23 bp, Homo sapiens
caacatttatgacctaagtcagg

SEQ ID NO: 936977 - DNA, 13 bp, Homo sapiens
caacatttctgta

SEQ ID NO: 936978 - DNA, 21 bp, Homo sapiens
caacatttctgtatactgtaa

SEQ ID NO: 936979 - DNA, 17 bp, Homo sapiens
caacatttcttaaatta

SEQ ID NO: 936980 - DNA, 19 bp, Homo sapiens
caacattttttcccagtga

SEQ ID NO: 936981 - DNA, 12 bp, Homo sapiens
caaccaactgca

SEQ ID NO: 936982 - DNA, 18 bp, Homo sapiens
caaccaagatgcaaatgt

SEQ ID NO: 936983 - DNA, 16 bp, Homo sapiens
caaccaaggaaggagc

SEQ ID NO: 936984 - DNA, 23 bp, Homo sapiens
cctttaagaaaaatgaaaacttt

SEQ ID NO: 936985 - DNA, 19 bp, Homo sapiens
cctttaagatatccatctt

SEQ ID NO: 936986 - DNA, 23 bp, Homo sapiens
cctttaagatatccatctttttc

SEQ ID NO: 936987 - DNA, 14 bp, Homo sapiens
cctttaagccaaag

SEQ ID NO: 936988 - DNA, 20 bp, Homo sapiens
cctttaatattttgtaatat

SEQ ID NO: 936989 - DNA, 18 bp, Homo sapiens
cctttaattttcttgttt

SEQ ID NO: 936990 - DNA, 21 bp, Homo sapiens
cctttacacattcggctccct

SEQ ID NO: 936991 - DNA, 18 bp, Homo sapiens
cctttacatgaggactct

SEQ ID NO: 936992 - DNA, 23 bp, Homo sapiens
cctttacattcaacttttctaag

SEQ ID NO: 936993 - DNA, 15 bp, Homo sapiens
cctttaccctcttgg

SEQ ID NO: 936994 - DNA, 19 bp, Homo sapiens
cctttaccctctttgctgc

SEQ ID NO: 936995 - DNA, 14 bp, Homo sapiens
cctttactcctggc

SEQ ID NO: 936996 - DNA, 13 bp, Homo sapiens
cctttactgcagc

SEQ ID NO: 936997 - DNA, 23 bp, Homo sapiens
cctttactttcccttgcttttcc

SEQ ID NO: 936998 - DNA, 12 bp, Homo sapiens
cctttagaaaat

SEQ ID NO: 936999 - DNA, 20 bp, Homo sapiens
cctttagagtgtaggtgaaa

SEQ ID NO: 937000 - DNA, 15 bp, Homo sapiens
cctttaggcagcctg

SEQ ID NO: 937001 - DNA, 17 bp, Homo sapiens
cctttaggcagcctgcc

SEQ ID NO: 937002 - DNA, 18 bp, Homo sapiens
cctttagtacctgaaaag

SEQ ID NO: 937003 - DNA, 19 bp, Homo sapiens
cctttagtacctgaaaagt

SEQ ID NO: 937004 - DNA, 23 bp, Homo sapiens
cctttagtccacggacccccaga

SEQ ID NO: 937005 - DNA, 13 bp, Homo sapiens
cctttagtgcttt

SEQ ID NO: 937006 - DNA, 22 bp, Homo sapiens
cctttataatgaggatgattat

SEQ ID NO: 937007 - DNA, 19 bp, Homo sapiens
cctttatatttagtgaact

SEQ ID NO: 937008 - DNA, 15 bp, Homo sapiens
cctttatctcagcca

SEQ ID NO: 937009 - DNA, 18 bp, Homo sapiens
cctttatctcagccatcc

SEQ ID NO: 937010 - DNA, 14 bp, Homo sapiens
cctttatgtgaatt

SEQ ID NO: 937011 - DNA, 17 bp, Homo sapiens
cctttatttaggaaaca

SEQ ID NO: 937012 - DNA, 13 bp, Homo sapiens
cctttattttaga

SEQ ID NO: 937013 - DNA, 19 bp, Homo sapiens
cctttattttattgaaatg

SEQ ID NO: 937014 - DNA, 21 bp, Homo sapiens
cctttatttttctatctggtt

SEQ ID NO: 937015 - DNA, 14 bp, Homo sapiens
cctttcaaatttag

SEQ ID NO: 937016 - DNA, 15 bp, Homo sapiens
cctttcaaatttaga

SEQ ID NO: 937017 - DNA, 22 bp, Homo sapiens
cctttcaaatttagaaactaat

SEQ ID NO: 937018 - DNA, 22 bp, Homo sapiens
cctttcacaaaattttattcct

SEQ ID NO: 937019 - DNA, 21 bp, Homo sapiens
cctttcacagagcagagtctg

SEQ ID NO: 937020 - DNA, 17 bp, Homo sapiens
cctttcaccctcatgaa

SEQ ID NO: 937021 - DNA, 13 bp, Homo sapiens
cctttcagatgtc

SEQ ID NO: 937022 - DNA, 17 bp, Homo sapiens
cctttcagatgtcttct

SEQ ID NO: 937023 - DNA, 19 bp, Homo sapiens
cctttcagatgtcttctgc

SEQ ID NO: 937024 - DNA, 20 bp, Homo sapiens
cctttcagggaatttcagga

SEQ ID NO: 937025 - DNA, 17 bp, Homo sapiens
cctttcaggtccaggcc

SEQ ID NO: 937026 - DNA, 22 bp, Homo sapiens
cctttcagtgcagtttcttttc

SEQ ID NO: 937027 - DNA, 19 bp, Homo sapiens
cctttcatagagaggcctg

SEQ ID NO: 937028 - DNA, 18 bp, Homo sapiens
cctttcatcggtgcctgg

SEQ ID NO: 937029 - DNA, 19 bp, Homo sapiens
cctttcatcggtgcctggt

SEQ ID NO: 937030 - DNA, 21 bp, Homo sapiens
cctttcatctctctacctcca

SEQ ID NO: 937031 - DNA, 23 bp, Homo sapiens
cctttcatctctctacctccacc

SEQ ID NO: 937032 - DNA, 16 bp, Homo sapiens
cctttccaaggcttct

SEQ ID NO: 937033 - DNA, 15 bp, Homo sapiens
cctttccaatagaaa

SEQ ID NO: 937034 - DNA, 21 bp, Homo sapiens
cctttccagagaactgcagac

SEQ ID NO: 937035 - DNA, 21 bp, Homo sapiens
cctttccagggtcaaagtaca

SEQ ID NO: 937036 - DNA, 13 bp, Homo sapiens
cctttccatctgt

SEQ ID NO: 937037 - DNA, 15 bp, Homo sapiens
cctttcccaccattc

SEQ ID NO: 937038 - DNA, 18 bp, Homo sapiens
cctttcccaccattcctg

SEQ ID NO: 937039 - DNA, 13 bp, Homo sapiens
cctttcccgggct

SEQ ID NO: 937040 - DNA, 18 bp, Homo sapiens
cctttcccgggctgtcca

SEQ ID NO: 937041 - DNA, 22 bp, Homo sapiens
cctttcccgggctgtccactag

SEQ ID NO: 937042 - DNA, 16 bp, Homo sapiens
cctttccctcaccccc

SEQ ID NO: 937043 - DNA, 17 bp, Homo sapiens
cctttccctcaccccct

SEQ ID NO: 937044 - DNA, 13 bp, Homo sapiens
cctttccctctcc

SEQ ID NO: 937045 - DNA, 15 bp, Homo sapiens
cctttccctctccca

SEQ ID NO: 937046 - DNA, 12 bp, Homo sapiens
cctttcccttcc

SEQ ID NO: 937047 - DNA, 12 bp, Homo sapiens
cctttcccttct

SEQ ID NO: 937048 - DNA, 15 bp, Homo sapiens
cctttcccttcttgg

SEQ ID NO: 937049 - DNA, 16 bp, Homo sapiens
cctttccgctgtcgcc

SEQ ID NO: 937050 - DNA, 21 bp, Homo sapiens
cctttccgctgtcgccccagg

SEQ ID NO: 937051 - DNA, 13 bp, Homo sapiens
caaccctggcctc

SEQ ID NO: 937052 - DNA, 14 bp, Homo sapiens
caaccctggcctca

SEQ ID NO: 937053 - DNA, 18 bp, Homo sapiens
caaccctgggctggggag

SEQ ID NO: 937054 - DNA, 20 bp, Homo sapiens
caaccctgggctggggagga

SEQ ID NO: 937055 - DNA, 22 bp, Homo sapiens
caaccctggggaaggagccagt

SEQ ID NO: 937056 - DNA, 23 bp, Homo sapiens
caaccctggggaaggagccagtt

SEQ ID NO: 937057 - DNA, 19 bp, Homo sapiens
caacccttaccccttagcc

SEQ ID NO: 937058 - DNA, 21 bp, Homo sapiens
caacccttagagattgcccca

SEQ ID NO: 937059 - DNA, 23 bp, Homo sapiens
caacccttagagattgccccaga

SEQ ID NO: 937060 - DNA, 10 bp, Homo sapiens
caacccttct

SEQ ID NO: 937061 - DNA, 22 bp, Homo sapiens
caaccgatgctccagccaaccc

SEQ ID NO: 937062 - DNA, 15 bp, Homo sapiens
caaccgtcctgctgt

SEQ ID NO: 937063 - DNA, 18 bp, Homo sapiens
caaccgtcctgctgtccc

SEQ ID NO: 937064 - DNA, 23 bp, Homo sapiens
caaccgtcctgctgtccctgtca

SEQ ID NO: 937065 - DNA, 13 bp, Homo sapiens
caacctaaaactc

SEQ ID NO: 937066 - DNA, 14 bp, Homo sapiens
caacctaaatactg

SEQ ID NO: 937067 - DNA, 20 bp, Homo sapiens
caacctaccaccccttcctg

SEQ ID NO: 937068 - DNA, 18 bp, Homo sapiens
caacctcaactgcctact

SEQ ID NO: 937069 - DNA, 13 bp, Homo sapiens
caacctcaccaaa

SEQ ID NO: 937070 - DNA, 14 bp, Homo sapiens
caacctcaccaaac

SEQ ID NO: 937071 - DNA, 15 bp, Homo sapiens
caacctcaccttcct

SEQ ID NO: 937072 - DNA, 16 bp, Homo sapiens
caacctcactgccctc

SEQ ID NO: 937073 - DNA, 20 bp, Homo sapiens
caacctccgcatccggggtt

SEQ ID NO: 937074 - DNA, 13 bp, Homo sapiens
caacctcctgggt

SEQ ID NO: 937075 - DNA, 21 bp, Homo sapiens
caacctcggcttgtgggctgg

SEQ ID NO: 937076 - DNA, 22 bp, Homo sapiens
caacctcggcttgtgggctggt

SEQ ID NO: 937077 - DNA, 17 bp, Homo sapiens
caacctctcactcccca

SEQ ID NO: 937078 - DNA, 15 bp, Homo sapiens
caacctctctgatct

SEQ ID NO: 937079 - DNA, 16 bp, Homo sapiens
caacctctctgatctt

SEQ ID NO: 937080 - DNA, 15 bp, Homo sapiens
caacctctgcctccc

SEQ ID NO: 937081 - DNA, 15 bp, Homo sapiens
caacctcttggcctg

SEQ ID NO: 937082 - DNA, 16 bp, Homo sapiens
caacctctttttcctc

SEQ ID NO: 937083 - DNA, 13 bp, Homo sapiens
caacctgaaccta

SEQ ID NO: 937084 - DNA, 13 bp, Homo sapiens
caacctgaatctt

SEQ ID NO: 937085 - DNA, 21 bp, Homo sapiens
caacctgaccaacatggagaa

SEQ ID NO: 937086 - DNA, 17 bp, Homo sapiens
caacctgcaggctcccg

SEQ ID NO: 937087 - DNA, 23 bp, Homo sapiens
caacctgcccaaagattgatttg

SEQ ID NO: 937088 - DNA, 18 bp, Homo sapiens
caacctgcctgtgcatga

SEQ ID NO: 937089 - DNA, 21 bp, Homo sapiens
caacctgctctcctcttgcca

SEQ ID NO: 937090 - DNA, 14 bp, Homo sapiens
caacctgctctgtc

SEQ ID NO: 937091 - DNA, 17 bp, Homo sapiens
caacctgctctgtcccc

SEQ ID NO: 937092 - DNA, 14 bp, Homo sapiens
caacctggtggcac

SEQ ID NO: 937093 - DNA, 22 bp, Homo sapiens
caacctggtggcaccagatgca

SEQ ID NO: 937094 - DNA, 13 bp, Homo sapiens
caacctgtggctc

SEQ ID NO: 937095 - DNA, 16 bp, Homo sapiens
caacctgtggctcagg

SEQ ID NO: 937096 - DNA, 20 bp, Homo sapiens
caacctgtggggtctgatgt

SEQ ID NO: 937097 - DNA, 23 bp, Homo sapiens
caacctgttacctactttgactt

SEQ ID NO: 937098 - DNA, 22 bp, Homo sapiens
caacctgttcttagagtgtagc

SEQ ID NO: 937099 - DNA, 24 bp, Homo sapiens
caacctgttcttagagtgtagctg

SEQ ID NO: 937100 - DNA, 18 bp, Homo sapiens
caaccttagatgttctaa

SEQ ID NO: 937101 - DNA, 18 bp, Homo sapiens
caaccttcggctccgggc

SEQ ID NO: 937102 - DNA, 20 bp, Homo sapiens
caaccttctgtggctcacag

SEQ ID NO: 937103 - DNA, 13 bp, Homo sapiens
caaccttgtttat

SEQ ID NO: 937104 - DNA, 15 bp, Homo sapiens
caacctttccctcac

SEQ ID NO: 937105 - DNA, 22 bp, Homo sapiens
caacttccagaggacagctctg

SEQ ID NO: 937106 - DNA, 13 bp, Homo sapiens
caacttcccacac

SEQ ID NO: 937107 - DNA, 15 bp, Homo sapiens
caacttccgctgagg

SEQ ID NO: 937108 - DNA, 18 bp, Homo sapiens
caacttcctctgccatgt

SEQ ID NO: 937109 - DNA, 14 bp, Homo sapiens
caacttctcccacc

SEQ ID NO: 937110 - DNA, 16 bp, Homo sapiens
caacttctcccacccc

SEQ ID NO: 937111 - DNA, 19 bp, Homo sapiens
caacttctcccaccccttg

SEQ ID NO: 937112 - DNA, 19 bp, Homo sapiens
caacttgaaggattgcatc

SEQ ID NO: 937113 - DNA, 22 bp, Homo sapiens
caacttgaaggattgcatcctg

SEQ ID NO: 937114 - DNA, 23 bp, Homo sapiens
caacttgaaggattgcatcctgc

SEQ ID NO: 937115 - DNA, 16 bp, Homo sapiens
caacttgagatgtatg

SEQ ID NO: 937116 - DNA, 21 bp, Homo sapiens
caacttgagggcccagagcag

SEQ ID NO: 937117 - DNA, 22 bp, Homo sapiens
caacttgatgttccacctgcca

SEQ ID NO: 937118 - DNA, 16 bp, Homo sapiens
caacttgattttttca

SEQ ID NO: 937119 - DNA, 22 bp, Homo sapiens
caacttgcatccaactccagga

SEQ ID NO: 937120 - DNA, 18 bp, Homo sapiens
caacttgccaaaatgttg

SEQ ID NO: 937121 - DNA, 20 bp, Homo sapiens
caacttgctacttatcattt

SEQ ID NO: 937122 - DNA, 23 bp, Homo sapiens
caacttgcttctaaatgcccagt

SEQ ID NO: 937123 - DNA, 20 bp, Homo sapiens
caacttggcagctttttctg

SEQ ID NO: 937124 - DNA, 18 bp, Homo sapiens
caacttggcttcctttct

SEQ ID NO: 937125 - DNA, 17 bp, Homo sapiens
caacttggttctgcttc

SEQ ID NO: 937126 - DNA, 18 bp, Homo sapiens
caacttggttctgcttca

SEQ ID NO: 937127 - DNA, 17 bp, Homo sapiens
caacttgtctttttctg

SEQ ID NO: 937128 - DNA, 13 bp, Homo sapiens
caactttactgta

SEQ ID NO: 937129 - DNA, 14 bp, Homo sapiens
caactttcacttct

SEQ ID NO: 937130 - DNA, 19 bp, Homo sapiens
caactttcacttcttccta

SEQ ID NO: 937131 - DNA, 18 bp, Homo sapiens
caactttcagaagtgcca

SEQ ID NO: 937132 - DNA, 23 bp, Homo sapiens
caactttctgtaaactcaaaact

SEQ ID NO: 937133 - DNA, 23 bp, Homo sapiens
caacttttgactaagaattttgt

SEQ ID NO: 937134 - DNA, 17 bp, Homo sapiens
caacttttgttttctga

SEQ ID NO: 937135 - DNA, 14 bp, Homo sapiens
caactttttaaagt

SEQ ID NO: 937136 - DNA, 19 bp, Homo sapiens
caactttttaaagtaaatt

SEQ ID NO: 937137 - DNA, 22 bp, Homo sapiens
caactttttaaagtaaattatt

SEQ ID NO: 937138 - DNA, 15 bp, Homo sapiens
caagaaaaaaaggga

SEQ ID NO: 937139 - DNA, 10 bp, Homo sapiens
caagaaaagg

SEQ ID NO: 937140 - DNA, 16 bp, Homo sapiens
caagaaaatctttgtt

SEQ ID NO: 937141 - DNA, 19 bp, Homo sapiens
caagaaacagccagcaaga

SEQ ID NO: 937142 - DNA, 16 bp, Homo sapiens
caagaaacagtttctt

SEQ ID NO: 937143 - DNA, 22 bp, Homo sapiens
caagaaagagggtcccagggct

SEQ ID NO: 937144 - DNA, 20 bp, Homo sapiens
caagaaagctcactgtagct

SEQ ID NO: 937145 - DNA, 16 bp, Homo sapiens
caagaaagctggtaaa

SEQ ID NO: 937146 - DNA, 17 bp, Homo sapiens
caagaaaggaaaccttt

SEQ ID NO: 937147 - DNA, 19 bp, Homo sapiens
caagaaaggggacccaaga

SEQ ID NO: 937148 - DNA, 15 bp, Homo sapiens
caagaaatccctgtt

SEQ ID NO: 937149 - DNA, 21 bp, Homo sapiens
caagaaatgattcaaattgct

SEQ ID NO: 937150 - DNA, 22 bp, Homo sapiens
caagaaatggcgtctgctctgg

SEQ ID NO: 937151 - DNA, 17 bp, Homo sapiens
caagaaatgtctctgct

SEQ ID NO: 937152 - DNA, 13 bp, Homo sapiens
caagaaatttgat

SEQ ID NO: 937153 - DNA, 16 bp, Homo sapiens
caagaaatttgatttc

SEQ ID NO: 937154 - DNA, 17 bp, Homo sapiens
caagaacacacacatat

SEQ ID NO: 937155 - DNA, 16 bp, Homo sapiens
caagaacccaagtgcc

SEQ ID NO: 937156 - DNA, 13 bp, Homo sapiens
caagaactgcaga

SEQ ID NO: 937157 - DNA, 13 bp, Homo sapiens
caagaactgcatg

SEQ ID NO: 937158 - DNA, 16 bp, Homo sapiens
caagaactgcatggac

SEQ ID NO: 937159 - DNA, 18 bp, Homo sapiens
caagaactgcatggacct

SEQ ID NO: 937160 - DNA, 18 bp, Homo sapiens
caagaagaaatatgaaat

SEQ ID NO: 937161 - DNA, 22 bp, Homo sapiens
caagaagaatttattacaaatc

SEQ ID NO: 937162 - DNA, 13 bp, Homo sapiens
caagaagaccaga

SEQ ID NO: 937163 - DNA, 21 bp, Homo sapiens
caagaagaccagactgtggag

SEQ ID NO: 937164 - DNA, 18 bp, Homo sapiens
caagaagcaattatttaa

SEQ ID NO: 937165 - DNA, 13 bp, Homo sapiens
caagaagcagtgg

SEQ ID NO: 937166 - DNA, 23 bp, Homo sapiens
caagaagcattttgtaagttgaa

SEQ ID NO: 937167 - DNA, 21 bp, Homo sapiens
caagaagcgccgactccctga

SEQ ID NO: 937168 - DNA, 23 bp, Homo sapiens
caagaaggaagatttgacgttgt

SEQ ID NO: 937169 - DNA, 19 bp, Homo sapiens
caagaaggaaggaggcaga

SEQ ID NO: 937170 - DNA, 13 bp, Homo sapiens
caagaagggactg

SEQ ID NO: 937171 - DNA, 12 bp, Homo sapiens
caagaagggctg

SEQ ID NO: 937172 - DNA, 13 bp, Homo sapiens
caagaagggctgc

SEQ ID NO: 937173 - DNA, 14 bp, Homo sapiens
caagaagggctgca

SEQ ID NO: 937174 - DNA, 14 bp, Homo sapiens
caagaagtgaagaa

SEQ ID NO: 937175 - DNA, 20 bp, Homo sapiens
caagaagtgagggaaggatg

SEQ ID NO: 937176 - DNA, 17 bp, Homo sapiens
caagaataatcacgctt

SEQ ID NO: 937177 - DNA, 20 bp, Homo sapiens
caagaataatcacgctttcc

SEQ ID NO: 937178 - DNA, 21 bp, Homo sapiens
caagaataatcacgctttcct

SEQ ID NO: 937179 - DNA, 23 bp, Homo sapiens
caagaataatcacgctttcctga

SEQ ID NO: 937180 - DNA, 21 bp, Homo sapiens
ccttttgaaattaacctctca

SEQ ID NO: 937181 - DNA, 23 bp, Homo sapiens
ccttttgaacgcccccccccacc

SEQ ID NO: 937182 - DNA, 12 bp, Homo sapiens
ccttttgaactt

SEQ ID NO: 937183 - DNA, 14 bp, Homo sapiens
ccttttgaacttgt

SEQ ID NO: 937184 - DNA, 17 bp, Homo sapiens
ccttttgaacttgtcac

SEQ ID NO: 937185 - DNA, 13 bp, Homo sapiens
ccttttgacactg

SEQ ID NO: 937186 - DNA, 18 bp, Homo sapiens
ccttttgacactgctcta

SEQ ID NO: 937187 - DNA, 21 bp, Homo sapiens
ccttttgacggccttcttggt

SEQ ID NO: 937188 - DNA, 16 bp, Homo sapiens
ccttttgaggagcccc

SEQ ID NO: 937189 - DNA, 23 bp, Homo sapiens
ccttttgaggagccccagctacc

SEQ ID NO: 937190 - DNA, 11 bp, Homo sapiens
ccttttgcaaa

SEQ ID NO: 937191 - DNA, 16 bp, Homo sapiens
ccttttgcacccctcc

SEQ ID NO: 937192 - DNA, 19 bp, Homo sapiens
ccttttgcacccctcccat

SEQ ID NO: 937193 - DNA, 20 bp, Homo sapiens
ccttttgcacccctcccatt

SEQ ID NO: 937194 - DNA, 15 bp, Homo sapiens
ccttttgcagaagag

SEQ ID NO: 937195 - DNA, 16 bp, Homo sapiens
ccttttgcctggctgt

SEQ ID NO: 937196 - DNA, 17 bp, Homo sapiens
ccttttggaacatttct

SEQ ID NO: 937197 - DNA, 19 bp, Homo sapiens
ccttttggcccccgagctg

SEQ ID NO: 937198 - DNA, 23 bp, Homo sapiens
ccttttggcccccgagctggggg

SEQ ID NO: 937199 - DNA, 17 bp, Homo sapiens
ccttttggggttctaca

SEQ ID NO: 937200 - DNA, 20 bp, Homo sapiens
ccttttggtcattatttcag

SEQ ID NO: 937201 - DNA, 16 bp, Homo sapiens
ccttttggtcttcagc

SEQ ID NO: 937202 - DNA, 19 bp, Homo sapiens
ccttttggtcttcagcctc

SEQ ID NO: 937203 - DNA, 22 bp, Homo sapiens
ccttttggtcttcagcctccct

SEQ ID NO: 937204 - DNA, 18 bp, Homo sapiens
ccttttggtttcaccttc

SEQ ID NO: 937205 - DNA, 21 bp, Homo sapiens
ccttttggtttcaccttccct

SEQ ID NO: 937206 - DNA, 15 bp, Homo sapiens
ccttttgtaggctgt

SEQ ID NO: 937207 - DNA, 23 bp, Homo sapiens
ccttttgtaggctgttccctttg

SEQ ID NO: 937208 - DNA, 17 bp, Homo sapiens
ccttttgtatcttcctt

SEQ ID NO: 937209 - DNA, 21 bp, Homo sapiens
ccttttgtatcttcctttctt

SEQ ID NO: 937210 - DNA, 23 bp, Homo sapiens
ccttttgtatcttcctttcttgt

SEQ ID NO: 937211 - DNA, 17 bp, Homo sapiens
ccttttgtccccagggc

SEQ ID NO: 937212 - DNA, 15 bp, Homo sapiens
cctttttaaaaaata

SEQ ID NO: 937213 - DNA, 11 bp, Homo sapiens
cctttttaagg

SEQ ID NO: 937214 - DNA, 14 bp, Homo sapiens
cctttttactcccc

SEQ ID NO: 937215 - DNA, 15 bp, Homo sapiens
cctttttactcccct

SEQ ID NO: 937216 - DNA, 21 bp, Homo sapiens
cctttttcaatgaattttata

SEQ ID NO: 937217 - DNA, 19 bp, Homo sapiens
cctttttcataaattattt

SEQ ID NO: 937218 - DNA, 16 bp, Homo sapiens
cctttttccaatgttt

SEQ ID NO: 937219 - DNA, 21 bp, Homo sapiens
cctttttccaatgttttattg

SEQ ID NO: 937220 - DNA, 17 bp, Homo sapiens
cctttttcccaataaat

SEQ ID NO: 937221 - DNA, 12 bp, Homo sapiens
cctttttctaaa

SEQ ID NO: 937222 - DNA, 22 bp, Homo sapiens
cctttttgaagtgtaggcagac

SEQ ID NO: 937223 - DNA, 14 bp, Homo sapiens
cctttttgacactg

SEQ ID NO: 937224 - DNA, 14 bp, Homo sapiens
cctttttgtaaata

SEQ ID NO: 937225 - DNA, 22 bp, Homo sapiens
cctttttgtaaatactgcttga

SEQ ID NO: 937226 - DNA, 22 bp, Homo sapiens
caagactctttatgatctggcc

SEQ ID NO: 937227 - DNA, 12 bp, Homo sapiens
caagactgaaga

SEQ ID NO: 937228 - DNA, 13 bp, Homo sapiens
caagactgcctcc

SEQ ID NO: 937229 - DNA, 14 bp, Homo sapiens
caagactgcctccc

SEQ ID NO: 937230 - DNA, 12 bp, Homo sapiens
caagactgggct

SEQ ID NO: 937231 - DNA, 16 bp, Homo sapiens
caagactgttgctcaa

SEQ ID NO: 937232 - DNA, 17 bp, Homo sapiens
caagactgttgctcaaa

SEQ ID NO: 937233 - DNA, 20 bp, Homo sapiens
caagacttggcaacagaagc

SEQ ID NO: 937234 - DNA, 16 bp, Homo sapiens
caagactttgatcctt

SEQ ID NO: 937235 - DNA, 13 bp, Homo sapiens
caagagaaacttc

SEQ ID NO: 937236 - DNA, 15 bp, Homo sapiens
caagagaactaaagc

SEQ ID NO: 937237 - DNA, 19 bp, Homo sapiens
caagagaactaaagctgga

SEQ ID NO: 937238 - DNA, 22 bp, Homo sapiens
caagagaattgcttgaacccag

SEQ ID NO: 937239 - DNA, 15 bp, Homo sapiens
caagagactgagtca

SEQ ID NO: 937240 - DNA, 13 bp, Homo sapiens
caagagagaaaga

SEQ ID NO: 937241 - DNA, 17 bp, Homo sapiens
caagagagaaagaagta

SEQ ID NO: 937242 - DNA, 13 bp, Homo sapiens
caagagagatgtt

SEQ ID NO: 937243 - DNA, 19 bp, Homo sapiens
caagagagcagcgcccagg

SEQ ID NO: 937244 - DNA, 21 bp, Homo sapiens
caagagagcagcgcccaggcc

SEQ ID NO: 937245 - DNA, 12 bp, Homo sapiens
caagagaggaag

SEQ ID NO: 937246 - DNA, 18 bp, Homo sapiens
caagagaggaaggacccc

SEQ ID NO: 937247 - DNA, 13 bp, Homo sapiens
caagagaggatga

SEQ ID NO: 937248 - DNA, 16 bp, Homo sapiens
caagagatgggacaag

SEQ ID NO: 937249 - DNA, 17 bp, Homo sapiens
caagagcaatttacctg

SEQ ID NO: 937250 - DNA, 22 bp, Homo sapiens
caagagcaatttacctggtact

SEQ ID NO: 937251 - DNA, 17 bp, Homo sapiens
caagagcagagtctggg

SEQ ID NO: 937252 - DNA, 19 bp, Homo sapiens
caagagcagagtctgggcc

SEQ ID NO: 937253 - DNA, 22 bp, Homo sapiens
caagagcagagtctgggcctct

SEQ ID NO: 937254 - DNA, 18 bp, Homo sapiens
caagagcagcctgtggca

SEQ ID NO: 937255 - DNA, 22 bp, Homo sapiens
caagagcatcgtgacccttcag

SEQ ID NO: 937256 - DNA, 21 bp, Homo sapiens
caagagcatgcacatgctgtc

SEQ ID NO: 937257 - DNA, 13 bp, Homo sapiens
caagagcccagca

SEQ ID NO: 937258 - DNA, 17 bp, Homo sapiens
caagagcccccttgaca

SEQ ID NO: 937259 - DNA, 22 bp, Homo sapiens
caagagcctgatctcttcctgt

SEQ ID NO: 937260 - DNA, 23 bp, Homo sapiens
caagagcctgatctcttcctgtt

SEQ ID NO: 937261 - DNA, 22 bp, Homo sapiens
caagagccttggtgtccacctg

SEQ ID NO: 937262 - DNA, 23 bp, Homo sapiens
caagagccttggtgtccacctgg

SEQ ID NO: 937263 - DNA, 19 bp, Homo sapiens
caagagctacataatttag

SEQ ID NO: 937264 - DNA, 22 bp, Homo sapiens
caagagctacgtatttaatagc

SEQ ID NO: 937265 - DNA, 14 bp, Homo sapiens
caagagctgctgtc

SEQ ID NO: 937266 - DNA, 20 bp, Homo sapiens
caagaggaatctgtttctct

SEQ ID NO: 937267 - DNA, 22 bp, Homo sapiens
caagaggaatctgtttctctgc

SEQ ID NO: 937268 - DNA, 15 bp, Homo sapiens
caagaggactgagac

SEQ ID NO: 937269 - DNA, 12 bp, Homo sapiens
caagaggctggt

SEQ ID NO: 937270 - DNA, 19 bp, Homo sapiens
caagagggacgcctggggg

SEQ ID NO: 937271 - DNA, 20 bp, Homo sapiens
caagagggaggggacagagg

SEQ ID NO: 937272 - DNA, 13 bp, Homo sapiens
caagagggcactg

SEQ ID NO: 937273 - DNA, 19 bp, Homo sapiens
caagagggcactggtggcc

SEQ ID NO: 937274 - DNA, 19 bp, Homo sapiens
caagaggggcgggctcaga

SEQ ID NO: 937275 - DNA, 14 bp, Homo sapiens
caagagggggtgga

SEQ ID NO: 937276 - DNA, 15 bp, Homo sapiens
caagagggggtggag

SEQ ID NO: 937277 - DNA, 18 bp, Homo sapiens
caagagggggtggagggg

SEQ ID NO: 937278 - DNA, 16 bp, Homo sapiens
caagaggggtggagac

SEQ ID NO: 937279 - DNA, 23 bp, Homo sapiens
caagaggggtggagactgcttcc

SEQ ID NO: 937280 - DNA, 20 bp, Homo sapiens
caagaggtctgagccctggt

SEQ ID NO: 937281 - DNA, 19 bp, Homo sapiens
caagagtcgctgtgccaca

SEQ ID NO: 937282 - DNA, 16 bp, Homo sapiens
caagataactgagaat

SEQ ID NO: 937283 - DNA, 23 bp, Homo sapiens
caagatacaggaaaaatgaaaat

SEQ ID NO: 937284 - DNA, 14 bp, Homo sapiens
caagatacctttgc

SEQ ID NO: 937285 - DNA, 15 bp, Homo sapiens
caagataggaccttg

SEQ ID NO: 937286 - DNA, 19 bp, Homo sapiens
caagataggagttctctga

SEQ ID NO: 937287 - DNA, 21 bp, Homo sapiens
caagatattgtacataaaaga

SEQ ID NO: 937288 - DNA, 21 bp, Homo sapiens
caagatattttaaaatctgtc

SEQ ID NO: 937289 - DNA, 23 bp, Homo sapiens
caagatattttaaaatctgtcac

SEQ ID NO: 937290 - DNA, 18 bp, Homo sapiens
caagatccatctaaactg

SEQ ID NO: 937291 - DNA, 12 bp, Homo sapiens
caagatctttca

SEQ ID NO: 937292 - DNA, 13 bp, Homo sapiens
caagatctttcag

SEQ ID NO: 937293 - DNA, 16 bp, Homo sapiens
caagatgaaataattt

SEQ ID NO: 937294 - DNA, 14 bp, Homo sapiens
caagatgaattatt

SEQ ID NO: 937295 - DNA, 17 bp, Homo sapiens
caagatgactggggtgg

SEQ ID NO: 937296 - DNA, 16 bp, Homo sapiens
caagatgcaaatgttt

SEQ ID NO: 937297 - DNA, 18 bp, Homo sapiens
caagatggacacgagcca

SEQ ID NO: 937298 - DNA, 21 bp, Homo sapiens
caagatggacttacctggcag

SEQ ID NO: 937299 - DNA, 20 bp, Homo sapiens
caagatggcgaccaccaaag

SEQ ID NO: 937300 - DNA, 22 bp, Homo sapiens
caagatggcgaccaccaaagtc

SEQ ID NO: 937301 - DNA, 20 bp, Homo sapiens
caagatgggggcagggctgt

SEQ ID NO: 937302 - DNA, 23 bp, Homo sapiens
caagatggtccatttgttcctgc

SEQ ID NO: 937303 - DNA, 14 bp, Homo sapiens
caagatgtgaatta

SEQ ID NO: 937304 - DNA, 18 bp, Homo sapiens
caagatgtgaattattga

SEQ ID NO: 937305 - DNA, 20 bp, Homo sapiens
caagatgtttcttatattat

SEQ ID NO: 937306 - DNA, 14 bp, Homo sapiens
caagattaaatgta

SEQ ID NO: 937307 - DNA, 16 bp, Homo sapiens
cgaatccaagctccct

SEQ ID NO: 937308 - DNA, 17 bp, Homo sapiens
cgaatctactaattcca

SEQ ID NO: 937309 - DNA, 22 bp, Homo sapiens
cgaatgaaaataactgaatttg

SEQ ID NO: 937310 - DNA, 12 bp, Homo sapiens
cgaatgacactg

SEQ ID NO: 937311 - DNA, 13 bp, Homo sapiens
cgaatgacactgt

SEQ ID NO: 937312 - DNA, 19 bp, Homo sapiens
cgaatggtctttgctccag

SEQ ID NO: 937313 - DNA, 15 bp, Homo sapiens
cgaatgtgtacaact

SEQ ID NO: 937314 - DNA, 15 bp, Homo sapiens
cgaatgtgtctttag

SEQ ID NO: 937315 - DNA, 22 bp, Homo sapiens
cgaattaatagcttttattgta

SEQ ID NO: 937316 - DNA, 20 bp, Homo sapiens
cgacaatgccctgctggcct

SEQ ID NO: 937317 - DNA, 20 bp, Homo sapiens
cgacacacggggctcgggcc

SEQ ID NO: 937318 - DNA, 13 bp, Homo sapiens
cgacacagcgacg

SEQ ID NO: 937319 - DNA, 16 bp, Homo sapiens
cgacacatatacatat

SEQ ID NO: 937320 - DNA, 19 bp, Homo sapiens
cgacacatttaccaaattg

SEQ ID NO: 937321 - DNA, 18 bp, Homo sapiens
cgacactcaccatgaagc

SEQ ID NO: 937322 - DNA, 16 bp, Homo sapiens
cgacactcagggcagc

SEQ ID NO: 937323 - DNA, 20 bp, Homo sapiens
cgacactcagggcagctgcc

SEQ ID NO: 937324 - DNA, 13 bp, Homo sapiens
cgacactgctgca

SEQ ID NO: 937325 - DNA, 15 bp, Homo sapiens
cgacactgctgcacc

SEQ ID NO: 937326 - DNA, 20 bp, Homo sapiens
cgacactgctgcaccagagt

SEQ ID NO: 937327 - DNA, 15 bp, Homo sapiens
cgacagagagagggg

SEQ ID NO: 937328 - DNA, 16 bp, Homo sapiens
cgacagagcgagactt

SEQ ID NO: 937329 - DNA, 13 bp, Homo sapiens
cgacagcctggca

SEQ ID NO: 937330 - DNA, 18 bp, Homo sapiens
cgacagcttgtgattcct

SEQ ID NO: 937331 - DNA, 14 bp, Homo sapiens
cgacagggcctgga

SEQ ID NO: 937332 - DNA, 19 bp, Homo sapiens
cgacagggcctggagcccc

SEQ ID NO: 937333 - DNA, 18 bp, Homo sapiens
cgacagtcggtgacccca

SEQ ID NO: 937334 - DNA, 16 bp, Homo sapiens
cgacagtggctctcca

SEQ ID NO: 937335 - DNA, 21 bp, Homo sapiens
cgacatccctcccccagcaga

SEQ ID NO: 937336 - DNA, 22 bp, Homo sapiens
cgacatccgtcattgctgctgc

SEQ ID NO: 937337 - DNA, 23 bp, Homo sapiens
cgacatccgtcattgctgctgct

SEQ ID NO: 937338 - DNA, 19 bp, Homo sapiens
cgacatcttctcaacctta

SEQ ID NO: 937339 - DNA, 16 bp, Homo sapiens
cgacatgctgccagga

SEQ ID NO: 937340 - DNA, 19 bp, Homo sapiens
cgacatggacccggagcta

SEQ ID NO: 937341 - DNA, 12 bp, Homo sapiens
cgaccaccaaag

SEQ ID NO: 937342 - DNA, 14 bp, Homo sapiens
cgaccaccaaagtc

SEQ ID NO: 937343 - DNA, 12 bp, Homo sapiens
cgaccacctgcc

SEQ ID NO: 937344 - DNA, 15 bp, Homo sapiens
cgaccagagccccac

SEQ ID NO: 937345 - DNA, 16 bp, Homo sapiens
cgaccatcgtccagcc

SEQ ID NO: 937346 - DNA, 17 bp, Homo sapiens
cgaccatcgtccagccc

SEQ ID NO: 937347 - DNA, 19 bp, Homo sapiens
cgaccatcgtccagccctc

SEQ ID NO: 937348 - DNA, 11 bp, Homo sapiens
caagcagccag

SEQ ID NO: 937349 - DNA, 16 bp, Homo sapiens
caagcagccagccagt

SEQ ID NO: 937350 - DNA, 18 bp, Homo sapiens
caagcagccagccagtct

SEQ ID NO: 937351 - DNA, 22 bp, Homo sapiens
caagcagccagccagtcttgcc

SEQ ID NO: 937352 - DNA, 19 bp, Homo sapiens
caagcagctgaagaaaaaa

SEQ ID NO: 937353 - DNA, 23 bp, Homo sapiens
caagcagctgaagaaaaaatcag

SEQ ID NO: 937354 - DNA, 19 bp, Homo sapiens
caagcagctggtcagtctt

SEQ ID NO: 937355 - DNA, 22 bp, Homo sapiens
caagcagctggtcagtctttgc

SEQ ID NO: 937356 - DNA, 12 bp, Homo sapiens
caagcagtccct

SEQ ID NO: 937357 - DNA, 15 bp, Homo sapiens
caagcagtcgtgcct

SEQ ID NO: 937358 - DNA, 20 bp, Homo sapiens
caagcagtcgtgcctgtgtc

SEQ ID NO: 937359 - DNA, 17 bp, Homo sapiens
caagcagtgtctgtcag

SEQ ID NO: 937360 - DNA, 21 bp, Homo sapiens
caagcatgaagataaacacag

SEQ ID NO: 937361 - DNA, 19 bp, Homo sapiens
caagcatgacaacttttaa

SEQ ID NO: 937362 - DNA, 18 bp, Homo sapiens
caagcatggctattttat

SEQ ID NO: 937363 - DNA, 21 bp, Homo sapiens
caagcatgtatttttgtcaat

SEQ ID NO: 937364 - DNA, 14 bp, Homo sapiens
caagcatgtctctc

SEQ ID NO: 937365 - DNA, 16 bp, Homo sapiens
caagcattcagaagaa

SEQ ID NO: 937366 - DNA, 19 bp, Homo sapiens
caagcatttcatgaaaaag

SEQ ID NO: 937367 - DNA, 18 bp, Homo sapiens
caagccaaaatgggagca

SEQ ID NO: 937368 - DNA, 15 bp, Homo sapiens
caagccaaagagcct

SEQ ID NO: 937369 - DNA, 16 bp, Homo sapiens
caagccaaagagcctc

SEQ ID NO: 937370 - DNA, 20 bp, Homo sapiens
caagccaacttgtaaataca

SEQ ID NO: 937371 - DNA, 21 bp, Homo sapiens
caagccaacttgtaaatacac

SEQ ID NO: 937372 - DNA, 17 bp, Homo sapiens
caagccaatcccctcct

SEQ ID NO: 937373 - DNA, 22 bp, Homo sapiens
caagccaatcccctccttgggc

SEQ ID NO: 937374 - DNA, 14 bp, Homo sapiens
caagccacagaagc

SEQ ID NO: 937375 - DNA, 15 bp, Homo sapiens
caagccacaggaagg

SEQ ID NO: 937376 - DNA, 13 bp, Homo sapiens
caagccagaccta

SEQ ID NO: 937377 - DNA, 15 bp, Homo sapiens
caagccagacctagc

SEQ ID NO: 937378 - DNA, 21 bp, Homo sapiens
caagccagacctagcaggctg

SEQ ID NO: 937379 - DNA, 22 bp, Homo sapiens
caagccagacctagcaggctgt

SEQ ID NO: 937380 - DNA, 13 bp, Homo sapiens
caagccagaggct

SEQ ID NO: 937381 - DNA, 15 bp, Homo sapiens
caagccagaggctgg

SEQ ID NO: 937382 - DNA, 19 bp, Homo sapiens
caagccagccccctccagc

SEQ ID NO: 937383 - DNA, 22 bp, Homo sapiens
caagccagggcccagagccctt

SEQ ID NO: 937384 - DNA, 23 bp, Homo sapiens
caagccagtcatggaatcttgct

SEQ ID NO: 937385 - DNA, 22 bp, Homo sapiens
caagccagttctccttccctgc

SEQ ID NO: 937386 - DNA, 12 bp, Homo sapiens
caagccccatct

SEQ ID NO: 937387 - DNA, 14 bp, Homo sapiens
caagccccatctca

SEQ ID NO: 937388 - DNA, 14 bp, Homo sapiens
caagcccctcagcc

SEQ ID NO: 937389 - DNA, 21 bp, Homo sapiens
caagcccgacttgctgttttg

SEQ ID NO: 937390 - DNA, 18 bp, Homo sapiens
caagcccgttagccccag

SEQ ID NO: 937391 - DNA, 19 bp, Homo sapiens
caagccctaagcctgtccc

SEQ ID NO: 937392 - DNA, 22 bp, Homo sapiens
caagccctaagcctgtccccag

SEQ ID NO: 937393 - DNA, 15 bp, Homo sapiens
caagccctcctttgg

SEQ ID NO: 937394 - DNA, 14 bp, Homo sapiens
caagccctgagagt

SEQ ID NO: 937395 - DNA, 10 bp, Homo sapiens
caagccctgg

SEQ ID NO: 937396 - DNA, 19 bp, Homo sapiens
caagcccttcggtcacctg

SEQ ID NO: 937397 - DNA, 16 bp, Homo sapiens
caagccgtggcttccc

SEQ ID NO: 937398 - DNA, 18 bp, Homo sapiens
caagcctaagggatcctg

SEQ ID NO: 937399 - DNA, 14 bp, Homo sapiens
caagcctccacagc

SEQ ID NO: 937400 - DNA, 14 bp, Homo sapiens
caagcctcctgtac

SEQ ID NO: 937401 - DNA, 15 bp, Homo sapiens
caagcctcttctgaa

SEQ ID NO: 937402 - DNA, 21 bp, Homo sapiens
caagcctgaccacgctttcta

SEQ ID NO: 937403 - DNA, 23 bp, Homo sapiens
caagcctgcacaataaaaatgtt

SEQ ID NO: 937404 - DNA, 14 bp, Homo sapiens
caagcctgcctagg

SEQ ID NO: 937405 - DNA, 15 bp, Homo sapiens
caagcctgcctccca

SEQ ID NO: 937406 - DNA, 13 bp, Homo sapiens
caagcctgctggc

SEQ ID NO: 937407 - DNA, 14 bp, Homo sapiens
caagcctgctggct

SEQ ID NO: 937408 - DNA, 15 bp, Homo sapiens
caagcctgctgtgtc

SEQ ID NO: 937409 - DNA, 14 bp, Homo sapiens
caagcctggcaagg

SEQ ID NO: 937410 - DNA, 16 bp, Homo sapiens
caagcctggcacccac

SEQ ID NO: 937411 - DNA, 18 bp, Homo sapiens
caagcctggcacccaccg

SEQ ID NO: 937412 - DNA, 21 bp, Homo sapiens
caagcctgtaatcccagctac

SEQ ID NO: 937413 - DNA, 23 bp, Homo sapiens
caagcctgtgggcagcatgccca

SEQ ID NO: 937414 - DNA, 17 bp, Homo sapiens
caagcctttatggctgc

SEQ ID NO: 937415 - DNA, 15 bp, Homo sapiens
caagcgaccaaggat

SEQ ID NO: 937416 - DNA, 14 bp, Homo sapiens
caagcgagcacagt

SEQ ID NO: 937417 - DNA, 20 bp, Homo sapiens
caagcgaggtcaacagagaa

SEQ ID NO: 937418 - DNA, 14 bp, Homo sapiens
caagcgctccaggg

SEQ ID NO: 937419 - DNA, 19 bp, Homo sapiens
caagcgctgggcgctcccg

SEQ ID NO: 937420 - DNA, 12 bp, Homo sapiens
caagcggtgcct

SEQ ID NO: 937421 - DNA, 15 bp, Homo sapiens
caagcgttcctggcc

SEQ ID NO: 937422 - DNA, 17 bp, Homo sapiens
caagcgttcctggcctt

SEQ ID NO: 937423 - DNA, 18 bp, Homo sapiens
caagcgttcctggccttc

SEQ ID NO: 937424 - DNA, 21 bp, Homo sapiens
caagctaatctgcctggtttt

SEQ ID NO: 937425 - DNA, 21 bp, Homo sapiens
caagctaattgggagtccagg

SEQ ID NO: 937426 - DNA, 15 bp, Homo sapiens
caagctagccagagg

SEQ ID NO: 937427 - DNA, 15 bp, Homo sapiens
caagctattcaattc

SEQ ID NO: 937428 - DNA, 17 bp, Homo sapiens
caagctattcctttccc

SEQ ID NO: 937429 - DNA, 18 bp, Homo sapiens
caagctattcctttccct

SEQ ID NO: 937430 - DNA, 23 bp, Homo sapiens
caagctattcctttcccttcctc

SEQ ID NO: 937431 - DNA, 13 bp, Homo sapiens
caagctatttaat

SEQ ID NO: 937432 - DNA, 12 bp, Homo sapiens
caagctcacagt

SEQ ID NO: 937433 - DNA, 20 bp, Homo sapiens
caagctcacagttcctcgcc

SEQ ID NO: 937434 - DNA, 22 bp, Homo sapiens
caagctcacagttcctcgccct

SEQ ID NO: 937435 - DNA, 19 bp, Homo sapiens
caagctccaagccccatct

SEQ ID NO: 937436 - DNA, 16 bp, Homo sapiens
caagctccctgcccca

SEQ ID NO: 937437 - DNA, 15 bp, Homo sapiens
caagctccctggagc

SEQ ID NO: 937438 - DNA, 22 bp, Homo sapiens
cgagtttggatgttgtaaataa

SEQ ID NO: 937439 - DNA, 19 bp, Homo sapiens
cgataatcgctcttttcca

SEQ ID NO: 937440 - DNA, 18 bp, Homo sapiens
cgatacaccgggcctgga

SEQ ID NO: 937441 - DNA, 22 bp, Homo sapiens
cgatatttttaaagatctgtaa

SEQ ID NO: 937442 - DNA, 19 bp, Homo sapiens
cgatcaacatttatgacct

SEQ ID NO: 937443 - DNA, 22 bp, Homo sapiens
cgatcaagttgttgactgtgat

SEQ ID NO: 937444 - DNA, 15 bp, Homo sapiens
cgatccaggggaagc

SEQ ID NO: 937445 - DNA, 16 bp, Homo sapiens
cgatctcattcagtat

SEQ ID NO: 937446 - DNA, 23 bp, Homo sapiens
cgatctccactgttgggtgggtg

SEQ ID NO: 937447 - DNA, 19 bp, Homo sapiens
cgatctcggctcagcctcc

SEQ ID NO: 937448 - DNA, 15 bp, Homo sapiens
cgatctctcctggcc

SEQ ID NO: 937449 - DNA, 12 bp, Homo sapiens
cgatgaatgtaa

SEQ ID NO: 937450 - DNA, 12 bp, Homo sapiens
cgatgagggaag

SEQ ID NO: 937451 - DNA, 21 bp, Homo sapiens
cgatgaggggacattttctgg

SEQ ID NO: 937452 - DNA, 17 bp, Homo sapiens
cgatgatactgtttctt

SEQ ID NO: 937453 - DNA, 16 bp, Homo sapiens
cgatgcatttaataaa

SEQ ID NO: 937454 - DNA, 19 bp, Homo sapiens
cgatgcatttaataaagat

SEQ ID NO: 937455 - DNA, 24 bp, Homo sapiens
cgatgcatttaataaagatgagtt

SEQ ID NO: 937456 - DNA, 13 bp, Homo sapiens
cgatgccaccggc

SEQ ID NO: 937457 - DNA, 12 bp, Homo sapiens
cgatgcctgatt

SEQ ID NO: 937458 - DNA, 14 bp, Homo sapiens
cgatgctccagcca

SEQ ID NO: 937459 - DNA, 22 bp, Homo sapiens
cgatgctccagccaacccctgt

SEQ ID NO: 937460 - DNA, 21 bp, Homo sapiens
cgatgctgctttcccctgtgg

SEQ ID NO: 937461 - DNA, 22 bp, Homo sapiens
cgatgctgctttcccctgtggg

SEQ ID NO: 937462 - DNA, 23 bp, Homo sapiens
cgatggaggactccaggcagcag

SEQ ID NO: 937463 - DNA, 18 bp, Homo sapiens
cgatggatatatgttttt

SEQ ID NO: 937464 - DNA, 14 bp, Homo sapiens
cgatggcaggcctg

SEQ ID NO: 937465 - DNA, 17 bp, Homo sapiens
cgatgggagtctccctc

SEQ ID NO: 937466 - DNA, 15 bp, Homo sapiens
cgatggggactctgc

SEQ ID NO: 937467 - DNA, 11 bp, Homo sapiens
cgatggggcat

SEQ ID NO: 937468 - DNA, 19 bp, Homo sapiens
cgatgggggatgcttcatg

SEQ ID NO: 937469 - DNA, 20 bp, Homo sapiens
cgatggtctctctccctctg

SEQ ID NO: 937470 - DNA, 13 bp, Homo sapiens
caaggctgacttc

SEQ ID NO: 937471 - DNA, 22 bp, Homo sapiens
caaggctgagacagtgaatttg

SEQ ID NO: 937472 - DNA, 15 bp, Homo sapiens
caaggctgcagtgag

SEQ ID NO: 937473 - DNA, 12 bp, Homo sapiens
caaggctgctgc

SEQ ID NO: 937474 - DNA, 15 bp, Homo sapiens
caaggctgctgccgg

SEQ ID NO: 937475 - DNA, 21 bp, Homo sapiens
caaggctggccagcaaggcag

SEQ ID NO: 937476 - DNA, 12 bp, Homo sapiens
caaggctggggc

SEQ ID NO: 937477 - DNA, 16 bp, Homo sapiens
caaggctggggcatgg

SEQ ID NO: 937478 - DNA, 18 bp, Homo sapiens
caaggctgggggaagaag

SEQ ID NO: 937479 - DNA, 21 bp, Homo sapiens
caaggctgggggaagaagctc

SEQ ID NO: 937480 - DNA, 13 bp, Homo sapiens
caaggcttattta

SEQ ID NO: 937481 - DNA, 20 bp, Homo sapiens
caaggcttatttatatatat

SEQ ID NO: 937482 - DNA, 16 bp, Homo sapiens
caaggctttaaagctg

SEQ ID NO: 937483 - DNA, 16 bp, Homo sapiens
caagggaaaagtctct

SEQ ID NO: 937484 - DNA, 16 bp, Homo sapiens
caagggaaaggggtgc

SEQ ID NO: 937485 - DNA, 21 bp, Homo sapiens
caagggaaaggggtgctttta

SEQ ID NO: 937486 - DNA, 17 bp, Homo sapiens
caagggaagaaacactc

SEQ ID NO: 937487 - DNA, 15 bp, Homo sapiens
caagggaaggggcct

SEQ ID NO: 937488 - DNA, 19 bp, Homo sapiens
caagggaaggggcctccct

SEQ ID NO: 937489 - DNA, 21 bp, Homo sapiens
caagggaaggggcctccctcc

SEQ ID NO: 937490 - DNA, 17 bp, Homo sapiens
caagggacaggtgggcc

SEQ ID NO: 937491 - DNA, 18 bp, Homo sapiens
caagggacaggtgggcct

SEQ ID NO: 937492 - DNA, 13 bp, Homo sapiens
caagggagaaaag

SEQ ID NO: 937493 - DNA, 17 bp, Homo sapiens
caagggagagacctcat

SEQ ID NO: 937494 - DNA, 19 bp, Homo sapiens
caagggagagacctcatca

SEQ ID NO: 937495 - DNA, 23 bp, Homo sapiens
caagggagggaagggccaccctg

SEQ ID NO: 937496 - DNA, 17 bp, Homo sapiens
caagggatctggtccta

SEQ ID NO: 937497 - DNA, 20 bp, Homo sapiens
caagggatctggtcctaccc

SEQ ID NO: 937498 - DNA, 14 bp, Homo sapiens
caagggcacaaact

SEQ ID NO: 937499 - DNA, 15 bp, Homo sapiens
caagggcacaaactg

SEQ ID NO: 937500 - DNA, 19 bp, Homo sapiens
caagggcacaaactgcagc

SEQ ID NO: 937501 - DNA, 23 bp, Homo sapiens
caagggcacattgcccatggctg

SEQ ID NO: 937502 - DNA, 17 bp, Homo sapiens
caagggcatcaggcact

SEQ ID NO: 937503 - DNA, 17 bp, Homo sapiens
caagggccaaacccact

SEQ ID NO: 937504 - DNA, 22 bp, Homo sapiens
caagggccaaacccacttctgg

SEQ ID NO: 937505 - DNA, 12 bp, Homo sapiens
caagggcccaga

SEQ ID NO: 937506 - DNA, 13 bp, Homo sapiens
caagggcccagag

SEQ ID NO: 937507 - DNA, 15 bp, Homo sapiens
caagggcccttctct

SEQ ID NO: 937508 - DNA, 13 bp, Homo sapiens
caagggcctggac

SEQ ID NO: 937509 - DNA, 20 bp, Homo sapiens
caagggctcctatctttcct

SEQ ID NO: 937510 - DNA, 22 bp, Homo sapiens
caagggcttacacgtggaggaa

SEQ ID NO: 937511 - DNA, 21 bp, Homo sapiens
caagggcttctgcaccctcca

SEQ ID NO: 937512 - DNA, 20 bp, Homo sapiens
caaggggagtcaccttccct

SEQ ID NO: 937513 - DNA, 17 bp, Homo sapiens
caaggggcccaaattct

SEQ ID NO: 937514 - DNA, 23 bp, Homo sapiens
caaggggctgcgctagcagccct

SEQ ID NO: 937515 - DNA, 13 bp, Homo sapiens
caaggggctggaa

SEQ ID NO: 937516 - DNA, 18 bp, Homo sapiens
caagggtatgggaagcca

SEQ ID NO: 937517 - DNA, 13 bp, Homo sapiens
caagggtccagaa

SEQ ID NO: 937518 - DNA, 19 bp, Homo sapiens
caagggtccgtggaccagg

SEQ ID NO: 937519 - DNA, 18 bp, Homo sapiens
caagggtgcctcaggacc

SEQ ID NO: 937520 - DNA, 17 bp, Homo sapiens
caagggttaaggcctga

SEQ ID NO: 937521 - DNA, 18 bp, Homo sapiens
caagggttaaggcctgaa

SEQ ID NO: 937522 - DNA, 20 bp, Homo sapiens
caagggttcagagactcagg

SEQ ID NO: 937523 - DNA, 19 bp, Homo sapiens
caagggttgagagccagtg

SEQ ID NO: 937524 - DNA, 21 bp, Homo sapiens
caagggttgcttctgagtggt

SEQ ID NO: 937525 - DNA, 20 bp, Homo sapiens
caagggtttcgactggtcca

SEQ ID NO: 937526 - DNA, 21 bp, Homo sapiens
caagggtttcgactggtccag

SEQ ID NO: 937527 - DNA, 19 bp, Homo sapiens
caaggtaggctgcaaaatt

SEQ ID NO: 937528 - DNA, 20 bp, Homo sapiens
caaggtatacacccagttct

SEQ ID NO: 937529 - DNA, 20 bp, Homo sapiens
caaggtcactgtttcctggg

SEQ ID NO: 937530 - DNA, 14 bp, Homo sapiens
caaggtcagggagg

SEQ ID NO: 937531 - DNA, 20 bp, Homo sapiens
caaggtccactccctgctcc

SEQ ID NO: 937532 - DNA, 14 bp, Homo sapiens
caaggtccagtgga

SEQ ID NO: 937533 - DNA, 23 bp, Homo sapiens
caaggtccattattttgtattct

SEQ ID NO: 937534 - DNA, 15 bp, Homo sapiens
caaggtcccctccac

SEQ ID NO: 937535 - DNA, 18 bp, Homo sapiens
caaggtcccctccacatc

SEQ ID NO: 937536 - DNA, 22 bp, Homo sapiens
caaggtcctctgtcagtcacag

SEQ ID NO: 937537 - DNA, 21 bp, Homo sapiens
caaggtctccttactctgagc

SEQ ID NO: 937538 - DNA, 23 bp, Homo sapiens
caaggtctccttactctgagccc

SEQ ID NO: 937539 - DNA, 14 bp, Homo sapiens
caaggtctttggtt

SEQ ID NO: 937540 - DNA, 23 bp, Homo sapiens
caaggtgaaacgactcaaaatga

SEQ ID NO: 937541 - DNA, 19 bp, Homo sapiens
caaggtgcatatagaaaac

SEQ ID NO: 937542 - DNA, 13 bp, Homo sapiens
caaggtgctaaca

SEQ ID NO: 937543 - DNA, 19 bp, Homo sapiens
caaggtgctcttgaacctg

SEQ ID NO: 937544 - DNA, 22 bp, Homo sapiens
caaggtgctggtgggtctgagc

SEQ ID NO: 937545 - DNA, 16 bp, Homo sapiens
caaggtggagggaagg

SEQ ID NO: 937546 - DNA, 14 bp, Homo sapiens
caaggtggcagatg

SEQ ID NO: 937547 - DNA, 19 bp, Homo sapiens
caaggtggccaaattattt

SEQ ID NO: 937548 - DNA, 14 bp, Homo sapiens
caaggtggcctctg

SEQ ID NO: 937549 - DNA, 22 bp, Homo sapiens
caaggtggcctctgcctggggc

SEQ ID NO: 937550 - DNA, 12 bp, Homo sapiens
caaggtgggctg

SEQ ID NO: 937551 - DNA, 17 bp, Homo sapiens
caaggtgggctgagccc

SEQ ID NO: 937552 - DNA, 19 bp, Homo sapiens
caaggtgggctgagccctg

SEQ ID NO: 937553 - DNA, 22 bp, Homo sapiens
caaggtggtatggttgtataca

SEQ ID NO: 937554 - DNA, 23 bp, Homo sapiens
caaggtggtatggttgtatacac

SEQ ID NO: 937555 - DNA, 20 bp, Homo sapiens
caaggtggtgcttctgccat

SEQ ID NO: 937556 - DNA, 18 bp, Homo sapiens
caaggtggtgtgatctta

SEQ ID NO: 937557 - DNA, 21 bp, Homo sapiens
caaggttataattttttttaa

SEQ ID NO: 937558 - DNA, 15 bp, Homo sapiens
caaggttccctctga

SEQ ID NO: 937559 - DNA, 18 bp, Homo sapiens
caaggttccctctgagaa

SEQ ID NO: 937560 - DNA, 16 bp, Homo sapiens
caaggttctcatttct

SEQ ID NO: 937561 - DNA, 13 bp, Homo sapiens
caaggttggagcc

SEQ ID NO: 937562 - DNA, 14 bp, Homo sapiens
caaggttggagccc

SEQ ID NO: 937563 - DNA, 21 bp, Homo sapiens
caaggttggagcccagggcat

SEQ ID NO: 937564 - DNA, 16 bp, Homo sapiens
caaggttggcacccca

SEQ ID NO: 937565 - DNA, 17 bp, Homo sapiens
caaggtttaagttatta

SEQ ID NO: 937566 - DNA, 22 bp, Homo sapiens
caaggtttaggctggtggccca

SEQ ID NO: 937567 - DNA, 13 bp, Homo sapiens
caaggtttataaa

SEQ ID NO: 937568 - DNA, 16 bp, Homo sapiens
caaggtttataaagca

SEQ ID NO: 937569 - DNA, 19 bp, Homo sapiens
cgcccccgagccctgactc

SEQ ID NO: 937570 - DNA, 23 bp, Homo sapiens
cgcccccgagccctgactcctgg

SEQ ID NO: 937571 - DNA, 15 bp, Homo sapiens
cgcccccgccccagg

SEQ ID NO: 937572 - DNA, 16 bp, Homo sapiens
cgcccccgccccaggc

SEQ ID NO: 937573 - DNA, 13 bp, Homo sapiens
cgccccctcccta

SEQ ID NO: 937574 - DNA, 17 bp, Homo sapiens
cgccccctccgccctgc

SEQ ID NO: 937575 - DNA, 14 bp, Homo sapiens
cgccccctcctcta

SEQ ID NO: 937576 - DNA, 15 bp, Homo sapiens
cgccccctgccctcc

SEQ ID NO: 937577 - DNA, 18 bp, Homo sapiens
cgccccgcacccccgcca

SEQ ID NO: 937578 - DNA, 13 bp, Homo sapiens
cgccccgccccac

SEQ ID NO: 937579 - DNA, 14 bp, Homo sapiens
cgccccgccccaca

SEQ ID NO: 937580 - DNA, 14 bp, Homo sapiens
cgccccgggctggc

SEQ ID NO: 937581 - DNA, 18 bp, Homo sapiens
cgccccgggctggccctg

SEQ ID NO: 937582 - DNA, 19 bp, Homo sapiens
cgccccgttgtgagctgga

SEQ ID NO: 937583 - DNA, 23 bp, Homo sapiens
cgcccctccaaacctccagcctc

SEQ ID NO: 937584 - DNA, 22 bp, Homo sapiens
cgcccctccagtgttgcctcct

SEQ ID NO: 937585 - DNA, 13 bp, Homo sapiens
cgcccctcccctc

SEQ ID NO: 937586 - DNA, 20 bp, Homo sapiens
cgcccctcgctgctgctact

SEQ ID NO: 937587 - DNA, 11 bp, Homo sapiens
cgcccctgagg

SEQ ID NO: 937588 - DNA, 15 bp, Homo sapiens
cgcccctgcctgcca

SEQ ID NO: 937589 - DNA, 14 bp, Homo sapiens
cgcccctggacttc

SEQ ID NO: 937590 - DNA, 12 bp, Homo sapiens
cgcccctgtggc

SEQ ID NO: 937591 - DNA, 14 bp, Homo sapiens
cgcccctgtggcca

SEQ ID NO: 937592 - DNA, 17 bp, Homo sapiens
cgccttcctcctccaca

SEQ ID NO: 937593 - DNA, 15 bp, Homo sapiens
cgccttcctctctgg

SEQ ID NO: 937594 - DNA, 16 bp, Homo sapiens
cgccttcctctctgga

SEQ ID NO: 937595 - DNA, 15 bp, Homo sapiens
cgccttcgtgtgctg

SEQ ID NO: 937596 - DNA, 15 bp, Homo sapiens
cgccttctcccctct

SEQ ID NO: 937597 - DNA, 22 bp, Homo sapiens
cgccttgagtgacatgcggctg

SEQ ID NO: 937598 - DNA, 18 bp, Homo sapiens
cgccttgttcctgctctt

SEQ ID NO: 937599 - DNA, 17 bp, Homo sapiens
cgcctttgtcttgtact

SEQ ID NO: 937600 - DNA, 21 bp, Homo sapiens
cgccttttcttggttcttttt

SEQ ID NO: 937601 - DNA, 21 bp, Homo sapiens
cgcgaccctccccggcggtgc

SEQ ID NO: 937602 - DNA, 19 bp, Homo sapiens
cgcgagggctgaaaacccc

SEQ ID NO: 937603 - DNA, 21 bp, Homo sapiens
cgcgccagcgacctctctgcc

SEQ ID NO: 937604 - DNA, 15 bp, Homo sapiens
cgcgccattgcactc

SEQ ID NO: 937605 - DNA, 16 bp, Homo sapiens
cgcgctccgaaccccg

SEQ ID NO: 937606 - DNA, 21 bp, Homo sapiens
cgcgctcctgacccctccctg

SEQ ID NO: 937607 - DNA, 15 bp, Homo sapiens
cgcgctcgcccagca

SEQ ID NO: 937608 - DNA, 18 bp, Homo sapiens
cgcgcttcgaactccagg

SEQ ID NO: 937609 - DNA, 11 bp, Homo sapiens
cgcggcccaga

SEQ ID NO: 937610 - DNA, 18 bp, Homo sapiens
cgcggccctggggcgggc

SEQ ID NO: 937611 - DNA, 23 bp, Homo sapiens
cgcggcctgcaccgacccgaggc

SEQ ID NO: 937612 - DNA, 21 bp, Homo sapiens
cgcggcggagctggccccgcc

SEQ ID NO: 937613 - DNA, 22 bp, Homo sapiens
cgcggcggagctggccccgccg

SEQ ID NO: 937614 - DNA, 23 bp, Homo sapiens
cgcggcggagctggccccgccgc

SEQ ID NO: 937615 - DNA, 17 bp, Homo sapiens
cgcggcggctctgccca

SEQ ID NO: 937616 - DNA, 18 bp, Homo sapiens
cgcggctcaaaaggaaac

SEQ ID NO: 937617 - DNA, 22 bp, Homo sapiens
cgcgggagacagcttctctgca

SEQ ID NO: 937618 - DNA, 17 bp, Homo sapiens
cgcgggcagccacccaa

SEQ ID NO: 937619 - DNA, 13 bp, Homo sapiens
cgcgggttctaga

SEQ ID NO: 937620 - DNA, 16 bp, Homo sapiens
cgcggtcttgggcact

SEQ ID NO: 937621 - DNA, 15 bp, Homo sapiens
cgcggtgctctggcg

SEQ ID NO: 937622 - DNA, 12 bp, Homo sapiens
cgcgtagagagc

SEQ ID NO: 937623 - DNA, 12 bp, Homo sapiens
cgcgtctcccat

SEQ ID NO: 937624 - DNA, 12 bp, Homo sapiens
cgcgtctcctgt

SEQ ID NO: 937625 - DNA, 13 bp, Homo sapiens
cgcgtctcctgtt

SEQ ID NO: 937626 - DNA, 17 bp, Homo sapiens
cgcgtctgccccaccct

SEQ ID NO: 937627 - DNA, 13 bp, Homo sapiens
cgcgtcttcctga

SEQ ID NO: 937628 - DNA, 19 bp, Homo sapiens
cgcgtgcacgtggagagct

SEQ ID NO: 937629 - DNA, 19 bp, Homo sapiens
cgcgtgccctcgctgcttc

SEQ ID NO: 937630 - DNA, 15 bp, Homo sapiens
cgctaaagagccctt

SEQ ID NO: 937631 - DNA, 23 bp, Homo sapiens
cgctaaagggaccatctgctgca

SEQ ID NO: 937632 - DNA, 14 bp, Homo sapiens
cgctaaatatttac

SEQ ID NO: 937633 - DNA, 15 bp, Homo sapiens
cgctaacccccagcc

SEQ ID NO: 937634 - DNA, 22 bp, Homo sapiens
cgctaacccccagcccacagag

SEQ ID NO: 937635 - DNA, 20 bp, Homo sapiens
cgctaagctggctctgtttg

SEQ ID NO: 937636 - DNA, 13 bp, Homo sapiens
cgctacctccctc

SEQ ID NO: 937637 - DNA, 22 bp, Homo sapiens
cgctacggggaaaatgcatttt

SEQ ID NO: 937638 - DNA, 17 bp, Homo sapiens
cgctactataaagagaa

SEQ ID NO: 937639 - DNA, 14 bp, Homo sapiens
cgctagaggcctga

SEQ ID NO: 937640 - DNA, 20 bp, Homo sapiens
cgctaggagagactgaaagc

SEQ ID NO: 937641 - DNA, 17 bp, Homo sapiens
cgctagtgtttaaaagg

SEQ ID NO: 937642 - DNA, 20 bp, Homo sapiens
cgctatagttactgtcctgt

SEQ ID NO: 937643 - DNA, 22 bp, Homo sapiens
cgctcaccgctggcccttagag

SEQ ID NO: 937644 - DNA, 18 bp, Homo sapiens
cgctcacctagagccaga

SEQ ID NO: 937645 - DNA, 22 bp, Homo sapiens
cgctcacctttgtttagaacac

SEQ ID NO: 937646 - DNA, 15 bp, Homo sapiens
cgctcaggacccagg

SEQ ID NO: 937647 - DNA, 18 bp, Homo sapiens
cgctcaggacccaggccc

SEQ ID NO: 937648 - DNA, 20 bp, Homo sapiens
cgctcaggacccaggccctc

SEQ ID NO: 937649 - DNA, 22 bp, Homo sapiens
cgctcaggacccaggccctcca

SEQ ID NO: 937650 - DNA, 14 bp, Homo sapiens
cgctcaggctggag

SEQ ID NO: 937651 - DNA, 22 bp, Homo sapiens
cgctcagggccatgctgaggcc

SEQ ID NO: 937652 - DNA, 12 bp, Homo sapiens
cgctcagtattt

SEQ ID NO: 937653 - DNA, 17 bp, Homo sapiens
cgctcagtgtcagcggg

SEQ ID NO: 937654 - DNA, 13 bp, Homo sapiens
cgctccagctgcc

SEQ ID NO: 937655 - DNA, 16 bp, Homo sapiens
cgctccagctgccccg

SEQ ID NO: 937656 - DNA, 20 bp, Homo sapiens
cgctcccaacccccctcctg

SEQ ID NO: 937657 - DNA, 22 bp, Homo sapiens
cgctcccaacccccctcctgct

SEQ ID NO: 937658 - DNA, 13 bp, Homo sapiens
cgctcccacagct

SEQ ID NO: 937659 - DNA, 18 bp, Homo sapiens
cgctcccacagcttcctg

SEQ ID NO: 937660 - DNA, 14 bp, Homo sapiens
cgctcccaccgccc

SEQ ID NO: 937661 - DNA, 15 bp, Homo sapiens
cgctcccacctagtg

SEQ ID NO: 937662 - DNA, 21 bp, Homo sapiens
cgctcccaggttcccccagca

SEQ ID NO: 937663 - DNA, 22 bp, Homo sapiens
cgctcccaggttcccccagcaa

SEQ ID NO: 937664 - DNA, 19 bp, Homo sapiens
cgctcccccgcagtcccca

SEQ ID NO: 937665 - DNA, 16 bp, Homo sapiens
cgctcccctccatccc

SEQ ID NO: 937666 - DNA, 17 bp, Homo sapiens
cgctcccctccatcccc

SEQ ID NO: 937667 - DNA, 18 bp, Homo sapiens
cgctcccctctcctccgc

SEQ ID NO: 937668 - DNA, 16 bp, Homo sapiens
cgctcccctctggaat

SEQ ID NO: 937669 - DNA, 18 bp, Homo sapiens
cgctcccctctggaatct

SEQ ID NO: 937670 - DNA, 16 bp, Homo sapiens
cgctcccctgagaggt

SEQ ID NO: 937671 - DNA, 18 bp, Homo sapiens
cgctcccctgagaggttt

SEQ ID NO: 937672 - DNA, 22 bp, Homo sapiens
cgctccccttggacctccaggg

SEQ ID NO: 937673 - DNA, 21 bp, Homo sapiens
cgctcccgcatttctcatgct

SEQ ID NO: 937674 - DNA, 22 bp, Homo sapiens
cgctcccgcatttctcatgctt

SEQ ID NO: 937675 - DNA, 10 bp, Homo sapiens
cgctccctgg

SEQ ID NO: 937676 - DNA, 20 bp, Homo sapiens
cgctccctgtagctctgcct

SEQ ID NO: 937677 - DNA, 18 bp, Homo sapiens
cgctccgaaccccgggcc

SEQ ID NO: 937678 - DNA, 15 bp, Homo sapiens
cgctcctcccagatg

SEQ ID NO: 937679 - DNA, 20 bp, Homo sapiens
cgctcctcccagatggcttc

SEQ ID NO: 937680 - DNA, 17 bp, Homo sapiens
cgctcctcccctcttga

SEQ ID NO: 937681 - DNA, 12 bp, Homo sapiens
cgctcctcctct

SEQ ID NO: 937682 - DNA, 12 bp, Homo sapiens
cgctcctccttc

SEQ ID NO: 937683 - DNA, 13 bp, Homo sapiens
cgctcctccttcc

SEQ ID NO: 937684 - DNA, 14 bp, Homo sapiens
cgctcctccttccc

SEQ ID NO: 937685 - DNA, 20 bp, Homo sapiens
cgctcctccttcccagggac

SEQ ID NO: 937686 - DNA, 17 bp, Homo sapiens
cgctcctgcttcccctc

SEQ ID NO: 937687 - DNA, 17 bp, Homo sapiens
cgctcctgtctgccagc

SEQ ID NO: 937688 - DNA, 16 bp, Homo sapiens
cgctcgatgactgtga

SEQ ID NO: 937689 - DNA, 18 bp, Homo sapiens
cgctcgccacgctcagtg

SEQ ID NO: 937690 - DNA, 14 bp, Homo sapiens
cgctcgcccagcag

SEQ ID NO: 937691 - DNA, 15 bp, Homo sapiens
cgctcgcccagcagg

SEQ ID NO: 937692 - DNA, 16 bp, Homo sapiens
cgctcgcccagcagga

SEQ ID NO: 937693 - DNA, 20 bp, Homo sapiens
cgctcgcccagcaggagaga

SEQ ID NO: 937694 - DNA, 14 bp, Homo sapiens
cgctcgctcaggtg

SEQ ID NO: 937695 - DNA, 14 bp, Homo sapiens
cgctctccaccacc

SEQ ID NO: 937696 - DNA, 20 bp, Homo sapiens
cgctctcctcgagccctccc

SEQ ID NO: 937697 - DNA, 12 bp, Homo sapiens
cgctctcttcct

SEQ ID NO: 937698 - DNA, 20 bp, Homo sapiens
cgctctgctggcctggccgg

SEQ ID NO: 937699 - DNA, 23 bp, Homo sapiens
cgctcttttctaagtggcgtgtg

SEQ ID NO: 937700 - DNA, 16 bp, Homo sapiens
caagttcgtctgttgt

SEQ ID NO: 937701 - DNA, 17 bp, Homo sapiens
caagttctaggcccccc

SEQ ID NO: 937702 - DNA, 16 bp, Homo sapiens
caagttctatttcttg

SEQ ID NO: 937703 - DNA, 18 bp, Homo sapiens
caagttcttcacctctat

SEQ ID NO: 937704 - DNA, 17 bp, Homo sapiens
caagttgaagactttgt

SEQ ID NO: 937705 - DNA, 17 bp, Homo sapiens
caagttgagatttttaa

SEQ ID NO: 937706 - DNA, 20 bp, Homo sapiens
caagttgcagtgagcagggt

SEQ ID NO: 937707 - DNA, 22 bp, Homo sapiens
caagttgcagtgagcagggtgg

SEQ ID NO: 937708 - DNA, 23 bp, Homo sapiens
caagttgcgacggagagaaaaaa

SEQ ID NO: 937709 - DNA, 16 bp, Homo sapiens
caagttgctgtcactg

SEQ ID NO: 937710 - DNA, 24 bp, Homo sapiens
caagttgggttcacttgccatgca

SEQ ID NO: 937711 - DNA, 14 bp, Homo sapiens
caagttgtaaaaat

SEQ ID NO: 937712 - DNA, 16 bp, Homo sapiens
caagttgtaaaaatga

SEQ ID NO: 937713 - DNA, 12 bp, Homo sapiens
caagttgtgctt

SEQ ID NO: 937714 - DNA, 12 bp, Homo sapiens
caatatgcttac

SEQ ID NO: 937715 - DNA, 21 bp, Homo sapiens
caatatgtaaatagtgcagaa

SEQ ID NO: 937716 - DNA, 13 bp, Homo sapiens
caatatgtattgt

SEQ ID NO: 937717 - DNA, 15 bp, Homo sapiens
caatatgtattgtaa

SEQ ID NO: 937718 - DNA, 17 bp, Homo sapiens
caatatgtgagtgcctt

SEQ ID NO: 937719 - DNA, 22 bp, Homo sapiens
caatatgtgagtgccttttgca

SEQ ID NO: 937720 - DNA, 17 bp, Homo sapiens
caatattaaaagagacc

SEQ ID NO: 937721 - DNA, 12 bp, Homo sapiens
caatattaaata

SEQ ID NO: 937722 - DNA, 14 bp, Homo sapiens
caatattaaatctg

SEQ ID NO: 937723 - DNA, 18 bp, Homo sapiens
caatattatactaagaaa

SEQ ID NO: 937724 - DNA, 21 bp, Homo sapiens
caatattatgaattcacagat

SEQ ID NO: 937725 - DNA, 13 bp, Homo sapiens
caatattcaaatg

SEQ ID NO: 937726 - DNA, 15 bp, Homo sapiens
caatattcaaatgcg

SEQ ID NO: 937727 - DNA, 17 bp, Homo sapiens
caatattcgctgtgtca

SEQ ID NO: 937728 - DNA, 16 bp, Homo sapiens
caatattctgtaacta

SEQ ID NO: 937729 - DNA, 14 bp, Homo sapiens
caatattgaatttt

SEQ ID NO: 937730 - DNA, 21 bp, Homo sapiens
caatattgaatttttcctatg

SEQ ID NO: 937731 - DNA, 17 bp, Homo sapiens
caatattgacatttgta

SEQ ID NO: 937732 - DNA, 14 bp, Homo sapiens
caatattgtacagt

SEQ ID NO: 937733 - DNA, 17 bp, Homo sapiens
caatatttactcatcag

SEQ ID NO: 937734 - DNA, 14 bp, Homo sapiens
caatatttagaaaa

SEQ ID NO: 937735 - DNA, 19 bp, Homo sapiens
caatatttagaaaattttg

SEQ ID NO: 937736 - DNA, 13 bp, Homo sapiens
caatatttattat

SEQ ID NO: 937737 - DNA, 14 bp, Homo sapiens
caatatttattatt

SEQ ID NO: 937738 - DNA, 16 bp, Homo sapiens
caatatttcttttgtt

SEQ ID NO: 937739 - DNA, 19 bp, Homo sapiens
caatatttcttttgttgta

SEQ ID NO: 937740 - DNA, 19 bp, Homo sapiens
caatatttgaattttaaat

SEQ ID NO: 937741 - DNA, 16 bp, Homo sapiens
caatatttgttactgt

SEQ ID NO: 937742 - DNA, 15 bp, Homo sapiens
caatattttatggtt

SEQ ID NO: 937743 - DNA, 17 bp, Homo sapiens
caatattttatggttat

SEQ ID NO: 937744 - DNA, 21 bp, Homo sapiens
caatattttggagtatgttaa

SEQ ID NO: 937745 - DNA, 16 bp, Homo sapiens
caatatttttatatca

SEQ ID NO: 937746 - DNA, 23 bp, Homo sapiens
caatatttttatatcatgcaaaa

SEQ ID NO: 937747 - DNA, 15 bp, Homo sapiens
caatcaaagaaaaga

SEQ ID NO: 937748 - DNA, 14 bp, Homo sapiens
caatcaaagaatta

SEQ ID NO: 937749 - DNA, 19 bp, Homo sapiens
caatcaaagaattacagta

SEQ ID NO: 937750 - DNA, 17 bp, Homo sapiens
caatcaaagcacttgga

SEQ ID NO: 937751 - DNA, 15 bp, Homo sapiens
caatcaactttactg

SEQ ID NO: 937752 - DNA, 19 bp, Homo sapiens
caatcaaggttataatttt

SEQ ID NO: 937753 - DNA, 18 bp, Homo sapiens
caatcaatacagcttcat

SEQ ID NO: 937754 - DNA, 20 bp, Homo sapiens
caatcaatggtgcaaaaaaa

SEQ ID NO: 937755 - DNA, 13 bp, Homo sapiens
caatcacaggaaa

SEQ ID NO: 937756 - DNA, 21 bp, Homo sapiens
caatcacgagatcttccttcc

SEQ ID NO: 937757 - DNA, 22 bp, Homo sapiens
caatcacgagatcttccttccg

SEQ ID NO: 937758 - DNA, 19 bp, Homo sapiens
caatcactattcttaagca

SEQ ID NO: 937759 - DNA, 21 bp, Homo sapiens
caatcactattcttaagcact

SEQ ID NO: 937760 - DNA, 15 bp, Homo sapiens
caatcagagagccta

SEQ ID NO: 937761 - DNA, 16 bp, Homo sapiens
caatcagagagcctag

SEQ ID NO: 937762 - DNA, 17 bp, Homo sapiens
caatcagagagcctaga

SEQ ID NO: 937763 - DNA, 13 bp, Homo sapiens
caatcagccttta

SEQ ID NO: 937764 - DNA, 16 bp, Homo sapiens
caatcagctccttcct

SEQ ID NO: 937765 - DNA, 16 bp, Homo sapiens
caatcaggaatgagtc

SEQ ID NO: 937766 - DNA, 15 bp, Homo sapiens
caatcagtcatcatg

SEQ ID NO: 937767 - DNA, 17 bp, Homo sapiens
caatcagtttatcctga

SEQ ID NO: 937768 - DNA, 17 bp, Homo sapiens
caatcatgaacagctct

SEQ ID NO: 937769 - DNA, 18 bp, Homo sapiens
caatcatgaacagctctg

SEQ ID NO: 937770 - DNA, 17 bp, Homo sapiens
caatcatggtcaagttc

SEQ ID NO: 937771 - DNA, 18 bp, Homo sapiens
caatccacctgccttggc

SEQ ID NO: 937772 - DNA, 14 bp, Homo sapiens
caatccagaggaac

SEQ ID NO: 937773 - DNA, 16 bp, Homo sapiens
caatccaggccaaagc

SEQ ID NO: 937774 - DNA, 22 bp, Homo sapiens
caatccatgttagtttttactt

SEQ ID NO: 937775 - DNA, 17 bp, Homo sapiens
caatcccaaagcgctcg

SEQ ID NO: 937776 - DNA, 23 bp, Homo sapiens
caatcccaccaaccctcagagcc

SEQ ID NO: 937777 - DNA, 16 bp, Homo sapiens
caatccccagcccttt

SEQ ID NO: 937778 - DNA, 16 bp, Homo sapiens
caatccccagcctagg

SEQ ID NO: 937779 - DNA, 18 bp, Homo sapiens
caatccccagcctaggac

SEQ ID NO: 937780 - DNA, 14 bp, Homo sapiens
caatcccctccttg

SEQ ID NO: 937781 - DNA, 15 bp, Homo sapiens
caatcccgtgaaaga

SEQ ID NO: 937782 - DNA, 18 bp, Homo sapiens
caatcccgtgaaagaatt

SEQ ID NO: 937783 - DNA, 14 bp, Homo sapiens
caatccctctccac

SEQ ID NO: 937784 - DNA, 24 bp, Homo sapiens
caatccctctccactcttctctcc

SEQ ID NO: 937785 - DNA, 22 bp, Homo sapiens
caatcccttaatatcctaaaca

SEQ ID NO: 937786 - DNA, 16 bp, Homo sapiens
caatcctaggacagcc

SEQ ID NO: 937787 - DNA, 22 bp, Homo sapiens
caatcctattactcttcctcta

SEQ ID NO: 937788 - DNA, 24 bp, Homo sapiens
caatcctcctacctcagcctcctg

SEQ ID NO: 937789 - DNA, 17 bp, Homo sapiens
caatcctcctgcctcag

SEQ ID NO: 937790 - DNA, 20 bp, Homo sapiens
caatcctcctgcctcagcct

SEQ ID NO: 937791 - DNA, 14 bp, Homo sapiens
caatccttaaatat

SEQ ID NO: 937792 - DNA, 16 bp, Homo sapiens
caatcctttctgccca

SEQ ID NO: 937793 - DNA, 15 bp, Homo sapiens
caatcggctacccct

SEQ ID NO: 937794 - DNA, 13 bp, Homo sapiens
caatctaaggcct

SEQ ID NO: 937795 - DNA, 14 bp, Homo sapiens
caatctaatctgaa

SEQ ID NO: 937796 - DNA, 16 bp, Homo sapiens
caatctactcaaagca

SEQ ID NO: 937797 - DNA, 14 bp, Homo sapiens
caatctactggaaa

SEQ ID NO: 937798 - DNA, 20 bp, Homo sapiens
caatctatggcttatttcta

SEQ ID NO: 937799 - DNA, 19 bp, Homo sapiens
caatctcacaccttagcta

SEQ ID NO: 937800 - DNA, 17 bp, Homo sapiens
caatctcccgctgctgc

SEQ ID NO: 937801 - DNA, 22 bp, Homo sapiens
caatctcggcccgctgcagcct

SEQ ID NO: 937802 - DNA, 19 bp, Homo sapiens
caatctctacccctttctt

SEQ ID NO: 937803 - DNA, 20 bp, Homo sapiens
caatctctacccctttcttc

SEQ ID NO: 937804 - DNA, 23 bp, Homo sapiens
caatctctacccctttcttctcg

SEQ ID NO: 937805 - DNA, 10 bp, Homo sapiens
caatctctgg

SEQ ID NO: 937806 - DNA, 14 bp, Homo sapiens
caatctctggtgcc

SEQ ID NO: 937807 - DNA, 23 bp, Homo sapiens
caatctctgttctgtttggcact

SEQ ID NO: 937808 - DNA, 15 bp, Homo sapiens
caatctcttcattat

SEQ ID NO: 937809 - DNA, 18 bp, Homo sapiens
caatctcttggtggggag

SEQ ID NO: 937810 - DNA, 22 bp, Homo sapiens
caatctgaaattcaaaatgctc

SEQ ID NO: 937811 - DNA, 11 bp, Homo sapiens
caatctgcagc

SEQ ID NO: 937812 - DNA, 16 bp, Homo sapiens
caatctggaagaaaaa

SEQ ID NO: 937813 - DNA, 20 bp, Homo sapiens
caatctggatgcctcattat

SEQ ID NO: 937814 - DNA, 17 bp, Homo sapiens
caatctgtaaactgtgt

SEQ ID NO: 937815 - DNA, 12 bp, Homo sapiens
caatctgtgggc

SEQ ID NO: 937816 - DNA, 17 bp, Homo sapiens
caatcttgcccactggc

SEQ ID NO: 937817 - DNA, 13 bp, Homo sapiens
caatctttctata

SEQ ID NO: 937818 - DNA, 15 bp, Homo sapiens
caatctttgaaataa

SEQ ID NO: 937819 - DNA, 18 bp, Homo sapiens
caatgaaaaatgtaattt

SEQ ID NO: 937820 - DNA, 13 bp, Homo sapiens
caatgaaaacaaa

SEQ ID NO: 937821 - DNA, 20 bp, Homo sapiens
caatgaaaactctttgctgc

SEQ ID NO: 937822 - DNA, 18 bp, Homo sapiens
caatgaaaggtactatat

SEQ ID NO: 937823 - DNA, 17 bp, Homo sapiens
caatgaaagtttgcact

SEQ ID NO: 937824 - DNA, 19 bp, Homo sapiens
caatgaaatattgctgtat

SEQ ID NO: 937825 - DNA, 19 bp, Homo sapiens
caatgaaatgaattaaagt

SEQ ID NO: 937826 - DNA, 17 bp, Homo sapiens
caatgaacatccctttt

SEQ ID NO: 937827 - DNA, 19 bp, Homo sapiens
caatgaactgcttttcctc

SEQ ID NO: 937828 - DNA, 20 bp, Homo sapiens
caatgaactgcttttcctca

SEQ ID NO: 937829 - DNA, 14 bp, Homo sapiens
caatgaagccagct

SEQ ID NO: 937830 - DNA, 17 bp, Homo sapiens
cggacccaccccaactc

SEQ ID NO: 937831 - DNA, 24 bp, Homo sapiens
cggacccaccccaactctccccag

SEQ ID NO: 937832 - DNA, 15 bp, Homo sapiens
cggaccccagccatc

SEQ ID NO: 937833 - DNA, 12 bp, Homo sapiens
cggacccttccc

SEQ ID NO: 937834 - DNA, 13 bp, Homo sapiens
cggaccgcgtaga

SEQ ID NO: 937835 - DNA, 23 bp, Homo sapiens
cggaccgcttgtggggacccagg

SEQ ID NO: 937836 - DNA, 18 bp, Homo sapiens
cggcccagtgccactgcc

SEQ ID NO: 937837 - DNA, 19 bp, Homo sapiens
cggcccagtgccactgccc

SEQ ID NO: 937838 - DNA, 15 bp, Homo sapiens
cggcccagtgccagc

SEQ ID NO: 937839 - DNA, 18 bp, Homo sapiens
cggccccaccccctgggc

SEQ ID NO: 937840 - DNA, 19 bp, Homo sapiens
cggccccaccccctgggca

SEQ ID NO: 937841 - DNA, 22 bp, Homo sapiens
cggccccaccccctgggcagat

SEQ ID NO: 937842 - DNA, 12 bp, Homo sapiens
cggccccagcca

SEQ ID NO: 937843 - DNA, 22 bp, Homo sapiens
cggccccagccagagttcctgc

SEQ ID NO: 937844 - DNA, 17 bp, Homo sapiens
cggccccatcgccccac

SEQ ID NO: 937845 - DNA, 21 bp, Homo sapiens
cggccccccgcacagccaccc

SEQ ID NO: 937846 - DNA, 22 bp, Homo sapiens
cggccccccgcgctcgcccagc

SEQ ID NO: 937847 - DNA, 14 bp, Homo sapiens
cggccccggcccca

SEQ ID NO: 937848 - DNA, 21 bp, Homo sapiens
cggcccgcagcctggcatctg

SEQ ID NO: 937849 - DNA, 14 bp, Homo sapiens
cggcccgcctctcc

SEQ ID NO: 937850 - DNA, 17 bp, Homo sapiens
cggcccgcctctcctcg

SEQ ID NO: 937851 - DNA, 16 bp, Homo sapiens
cggcccgcctgcccag

SEQ ID NO: 937852 - DNA, 16 bp, Homo sapiens
cggcccgctgcagcct

SEQ ID NO: 937853 - DNA, 15 bp, Homo sapiens
cggcccggcccctca

SEQ ID NO: 937854 - DNA, 21 bp, Homo sapiens
cggcccgtggacaccccagac

SEQ ID NO: 937855 - DNA, 18 bp, Homo sapiens
cggccctaccagcgcccg

SEQ ID NO: 937856 - DNA, 20 bp, Homo sapiens
cggccctaccagcgcccgct

SEQ ID NO: 937857 - DNA, 21 bp, Homo sapiens
cggccctaccagcgcccgctg

SEQ ID NO: 937858 - DNA, 15 bp, Homo sapiens
cggccctcagtgcat

SEQ ID NO: 937859 - DNA, 17 bp, Homo sapiens
cggccctcccccagctc

SEQ ID NO: 937860 - DNA, 20 bp, Homo sapiens
cggccctcctaccctgcgcc

SEQ ID NO: 937861 - DNA, 23 bp, Homo sapiens
cggccctgaaccacgaggctgcc

SEQ ID NO: 937862 - DNA, 17 bp, Homo sapiens
cggccctgcagccagct

SEQ ID NO: 937863 - DNA, 15 bp, Homo sapiens
cggccctgcctgcct

SEQ ID NO: 937864 - DNA, 23 bp, Homo sapiens
cggccctgcctgcctcttggcct

SEQ ID NO: 937865 - DNA, 20 bp, Homo sapiens
cggccctgtcccctggagtg

SEQ ID NO: 937866 - DNA, 15 bp, Homo sapiens
cggccgagctgcctg

SEQ ID NO: 937867 - DNA, 18 bp, Homo sapiens
cggccgagctgcctggcg

SEQ ID NO: 937868 - DNA, 18 bp, Homo sapiens
cggccgatgggagtctcc

SEQ ID NO: 937869 - DNA, 13 bp, Homo sapiens
cggccgcattccc

SEQ ID NO: 937870 - DNA, 16 bp, Homo sapiens
cggccgcattccctga

SEQ ID NO: 937871 - DNA, 15 bp, Homo sapiens
cggccgccttctccc

SEQ ID NO: 937872 - DNA, 16 bp, Homo sapiens
cggccggacctctgag

SEQ ID NO: 937873 - DNA, 21 bp, Homo sapiens
cggccgtgggccgggaggcag

SEQ ID NO: 937874 - DNA, 17 bp, Homo sapiens
cggcctaggggtggcgc

SEQ ID NO: 937875 - DNA, 20 bp, Homo sapiens
cggcctaggggtggcgctca

SEQ ID NO: 937876 - DNA, 23 bp, Homo sapiens
cggcctaggtcacgttggccctc

SEQ ID NO: 937877 - DNA, 14 bp, Homo sapiens
cggcctccactccc

SEQ ID NO: 937878 - DNA, 17 bp, Homo sapiens
cggcctccaggaggggc

SEQ ID NO: 937879 - DNA, 18 bp, Homo sapiens
cggcctccaggaggggcc

SEQ ID NO: 937880 - DNA, 19 bp, Homo sapiens
cggcctcccaaagtgctgg

SEQ ID NO: 937881 - DNA, 14 bp, Homo sapiens
cggcctcccagagt

SEQ ID NO: 937882 - DNA, 15 bp, Homo sapiens
cggcctccgaggctc

SEQ ID NO: 937883 - DNA, 17 bp, Homo sapiens
cggcctccgaggctccc

SEQ ID NO: 937884 - DNA, 18 bp, Homo sapiens
cggcctccgaggctcccc

SEQ ID NO: 937885 - DNA, 20 bp, Homo sapiens
cggcctccgaggctccccgc

SEQ ID NO: 937886 - DNA, 21 bp, Homo sapiens
cggcctccgtccaggagcctg

SEQ ID NO: 937887 - DNA, 17 bp, Homo sapiens
cggcctcctcggagagc

SEQ ID NO: 937888 - DNA, 22 bp, Homo sapiens
cggcctcctcggagagcagcag

SEQ ID NO: 937889 - DNA, 19 bp, Homo sapiens
cggcctcgtgccatgatct

SEQ ID NO: 937890 - DNA, 15 bp, Homo sapiens
cggcctctctggcct

SEQ ID NO: 937891 - DNA, 21 bp, Homo sapiens
cggcctctctggcctcccacc

SEQ ID NO: 937892 - DNA, 19 bp, Homo sapiens
cggcctgatgctccctccc

SEQ ID NO: 937893 - DNA, 21 bp, Homo sapiens
cggcctgcaccgacccgaggc

SEQ ID NO: 937894 - DNA, 15 bp, Homo sapiens
cggcctgcagtggtg

SEQ ID NO: 937895 - DNA, 15 bp, Homo sapiens
cggcctgctcccagc

SEQ ID NO: 937896 - DNA, 19 bp, Homo sapiens
cggcctgctcccagcagcc

SEQ ID NO: 937897 - DNA, 14 bp, Homo sapiens
cggcctgggcacca

SEQ ID NO: 937898 - DNA, 15 bp, Homo sapiens
cggcctgtcctccaa

SEQ ID NO: 937899 - DNA, 19 bp, Homo sapiens
cggcctgtgggtctctgaa

SEQ ID NO: 937900 - DNA, 20 bp, Homo sapiens
cggcctgtgggtttgggtgc

SEQ ID NO: 937901 - DNA, 19 bp, Homo sapiens
cggccttcaactgaaaaga

SEQ ID NO: 937902 - DNA, 13 bp, Homo sapiens
cggccttcttggt

SEQ ID NO: 937903 - DNA, 16 bp, Homo sapiens
cggccttcttggtttc

SEQ ID NO: 937904 - DNA, 14 bp, Homo sapiens
cggccttgaagaca

SEQ ID NO: 937905 - DNA, 16 bp, Homo sapiens
cggccttgctttgtct

SEQ ID NO: 937906 - DNA, 22 bp, Homo sapiens
cggccttgctttgtctggcctc

SEQ ID NO: 937907 - DNA, 20 bp, Homo sapiens
cggccttgtctgggtgcagc

SEQ ID NO: 937908 - DNA, 18 bp, Homo sapiens
cggccttttccaaatgcc

SEQ ID NO: 937909 - DNA, 15 bp, Homo sapiens
cggcgatttttgtat

SEQ ID NO: 937910 - DNA, 13 bp, Homo sapiens
cggcgccaccatc

SEQ ID NO: 937911 - DNA, 15 bp, Homo sapiens
cggcgccccgcaccc

SEQ ID NO: 937912 - DNA, 15 bp, Homo sapiens
cggcgcctgccctgc

SEQ ID NO: 937913 - DNA, 12 bp, Homo sapiens
cggcggcgccgg

SEQ ID NO: 937914 - DNA, 12 bp, Homo sapiens
cggcggctctga

SEQ ID NO: 937915 - DNA, 14 bp, Homo sapiens
cggcggctctgagc

SEQ ID NO: 937916 - DNA, 15 bp, Homo sapiens
cggcggctctgagca

SEQ ID NO: 937917 - DNA, 18 bp, Homo sapiens
cggcggctctgagcaggg

SEQ ID NO: 937918 - DNA, 17 bp, Homo sapiens
cggcggctctgcccacc

SEQ ID NO: 937919 - DNA, 23 bp, Homo sapiens
cggcgggatcctccacagagagg

SEQ ID NO: 937920 - DNA, 16 bp, Homo sapiens
cggcggtcccagctcc

SEQ ID NO: 937921 - DNA, 14 bp, Homo sapiens
cggctaatgtttgt

SEQ ID NO: 937922 - DNA, 13 bp, Homo sapiens
cggctactcagca

SEQ ID NO: 937923 - DNA, 14 bp, Homo sapiens
cggctactcagcag

SEQ ID NO: 937924 - DNA, 20 bp, Homo sapiens
cggctactcagcagccctcc

SEQ ID NO: 937925 - DNA, 13 bp, Homo sapiens
cggctccagctca

SEQ ID NO: 937926 - DNA, 23 bp, Homo sapiens
cggctcccctcccaggggagcca

SEQ ID NO: 937927 - DNA, 18 bp, Homo sapiens
cggctcccctctgcttct

SEQ ID NO: 937928 - DNA, 20 bp, Homo sapiens
cggctccgagggcggccagg

SEQ ID NO: 937929 - DNA, 12 bp, Homo sapiens
cggctcctcaga

SEQ ID NO: 937930 - DNA, 14 bp, Homo sapiens
cggctcctcctcac

SEQ ID NO: 937931 - DNA, 13 bp, Homo sapiens
cggctcctgatgg

SEQ ID NO: 937932 - DNA, 20 bp, Homo sapiens
cggctcgagcagtcctgcct

SEQ ID NO: 937933 - DNA, 16 bp, Homo sapiens
cggctcggaggaagcc

SEQ ID NO: 937934 - DNA, 18 bp, Homo sapiens
cggctctcacctggccct

SEQ ID NO: 937935 - DNA, 17 bp, Homo sapiens
cggctctgagcaggggc

SEQ ID NO: 937936 - DNA, 18 bp, Homo sapiens
cggctctgagcaggggca

SEQ ID NO: 937937 - DNA, 19 bp, Homo sapiens
cggctctgagcaggggcag

SEQ ID NO: 937938 - DNA, 15 bp, Homo sapiens
cggctctgcccacct

SEQ ID NO: 937939 - DNA, 11 bp, Homo sapiens
cggctctggag

SEQ ID NO: 937940 - DNA, 17 bp, Homo sapiens
cggctctggtcctcgga

SEQ ID NO: 937941 - DNA, 16 bp, Homo sapiens
cggctctttccttgct

SEQ ID NO: 937942 - DNA, 18 bp, Homo sapiens
cggctctttccttgctca

SEQ ID NO: 937943 - DNA, 11 bp, Homo sapiens
cggctgaccat

SEQ ID NO: 937944 - DNA, 15 bp, Homo sapiens
cggctgaccatgctc

SEQ ID NO: 937945 - DNA, 22 bp, Homo sapiens
cggctgaccatgctcatctgct

SEQ ID NO: 937946 - DNA, 16 bp, Homo sapiens
cggctgatgtggactg

SEQ ID NO: 937947 - DNA, 12 bp, Homo sapiens
cggctgcagagg

SEQ ID NO: 937948 - DNA, 12 bp, Homo sapiens
cggctgccccca

SEQ ID NO: 937949 - DNA, 17 bp, Homo sapiens
cggctgcccccatcacc

SEQ ID NO: 937950 - DNA, 19 bp, Homo sapiens
cggctgcctgacactgagc

SEQ ID NO: 937951 - DNA, 12 bp, Homo sapiens
cggctgcctgcc

SEQ ID NO: 937952 - DNA, 22 bp, Homo sapiens
cggctgcctgccgcccaaagag

SEQ ID NO: 937953 - DNA, 15 bp, Homo sapiens
cggctgctcctccag

SEQ ID NO: 937954 - DNA, 16 bp, Homo sapiens
cggctgggagcctcgc

SEQ ID NO: 937955 - DNA, 23 bp, Homo sapiens
cggctgggagcctcgcccctcca

SEQ ID NO: 937956 - DNA, 16 bp, Homo sapiens
cggctgggcacacgcc

SEQ ID NO: 937957 - DNA, 15 bp, Homo sapiens
cggctgggcctcctt

SEQ ID NO: 937958 - DNA, 18 bp, Homo sapiens
cgggtggctctgggatcc

SEQ ID NO: 937959 - DNA, 17 bp, Homo sapiens
cgggtgggcctggcctg

SEQ ID NO: 937960 - DNA, 20 bp, Homo sapiens
cgggtggggcttggggctca

SEQ ID NO: 937961 - DNA, 18 bp, Homo sapiens
cgggtgtgcctgccctgg

SEQ ID NO: 937962 - DNA, 20 bp, Homo sapiens
cgggtgtgcctgccctggag

SEQ ID NO: 937963 - DNA, 15 bp, Homo sapiens
cgggtgtggcctcag

SEQ ID NO: 937964 - DNA, 19 bp, Homo sapiens
cgggtgtggcctcagccct

SEQ ID NO: 937965 - DNA, 20 bp, Homo sapiens
cgggtgtggcctcagccctc

SEQ ID NO: 937966 - DNA, 22 bp, Homo sapiens
cgggtgtggcctcagccctcag

SEQ ID NO: 937967 - DNA, 13 bp, Homo sapiens
cgggttctagacg

SEQ ID NO: 937968 - DNA, 22 bp, Homo sapiens
cgggttctagacgcccctccca

SEQ ID NO: 937969 - DNA, 16 bp, Homo sapiens
cgggttgtgtgtctgt

SEQ ID NO: 937970 - DNA, 17 bp, Homo sapiens
cgggttgtgtgtctgtt

SEQ ID NO: 937971 - DNA, 16 bp, Homo sapiens
cacaatgttgctagtt

SEQ ID NO: 937972 - DNA, 14 bp, Homo sapiens
cacaattaattgtc

SEQ ID NO: 937973 - DNA, 13 bp, Homo sapiens
cacaattctgtcc

SEQ ID NO: 937974 - DNA, 23 bp, Homo sapiens
cacaattctgtccctgtccctgc

SEQ ID NO: 937975 - DNA, 19 bp, Homo sapiens
cacaattgatacttcaggt

SEQ ID NO: 937976 - DNA, 20 bp, Homo sapiens
cacaatttgagactgaaatt

SEQ ID NO: 937977 - DNA, 21 bp, Homo sapiens
cacacaaaaaggagcgggcag

SEQ ID NO: 937978 - DNA, 10 bp, Homo sapiens
cacacaaaca

SEQ ID NO: 937979 - DNA, 18 bp, Homo sapiens
cacacaaaccattttatt

SEQ ID NO: 937980 - DNA, 18 bp, Homo sapiens
cacacaaacctactgccc

SEQ ID NO: 937981 - DNA, 20 bp, Homo sapiens
cacacaaacctactgcccac

SEQ ID NO: 937982 - DNA, 20 bp, Homo sapiens
cacacaaagactccttgtgg

SEQ ID NO: 937983 - DNA, 16 bp, Homo sapiens
cacacaagaagaaggg

SEQ ID NO: 937984 - DNA, 13 bp, Homo sapiens
cacacaagctcct

SEQ ID NO: 937985 - DNA, 16 bp, Homo sapiens
cacacaaggggccctt

SEQ ID NO: 937986 - DNA, 19 bp, Homo sapiens
cacacaaggggcccttgga

SEQ ID NO: 937987 - DNA, 16 bp, Homo sapiens
cacacaagtttgtgct

SEQ ID NO: 937988 - DNA, 13 bp, Homo sapiens
cacacacaaacct

SEQ ID NO: 937989 - DNA, 14 bp, Homo sapiens
cacacacaaacctt

SEQ ID NO: 937990 - DNA, 15 bp, Homo sapiens
cacacacacacacag

SEQ ID NO: 937991 - DNA, 15 bp, Homo sapiens
cacacacacacgatg

SEQ ID NO: 937992 - DNA, 12 bp, Homo sapiens
cacacacacagg

SEQ ID NO: 937993 - DNA, 14 bp, Homo sapiens
cacacacacaggag

SEQ ID NO: 937994 - DNA, 14 bp, Homo sapiens
cacacacacataca

SEQ ID NO: 937995 - DNA, 15 bp, Homo sapiens
cacacacacatacag

SEQ ID NO: 937996 - DNA, 13 bp, Homo sapiens
cacacacacccgc

SEQ ID NO: 937997 - DNA, 14 bp, Homo sapiens
cacacacagaggaa

SEQ ID NO: 937998 - DNA, 13 bp, Homo sapiens
cacacacagctcc

SEQ ID NO: 937999 - DNA, 13 bp, Homo sapiens
cacacacatacag

SEQ ID NO: 938000 - DNA, 15 bp, Homo sapiens
cacacaccagcactt

SEQ ID NO: 938001 - DNA, 15 bp, Homo sapiens
cacacaccctgaggt

SEQ ID NO: 938002 - DNA, 15 bp, Homo sapiens
cacacacctgggtgg

SEQ ID NO: 938003 - DNA, 13 bp, Homo sapiens
cacacacctgtag

SEQ ID NO: 938004 - DNA, 22 bp, Homo sapiens
cacacacgatgcatttaataaa

SEQ ID NO: 938005 - DNA, 18 bp, Homo sapiens
cacacacgcacgcacaca

SEQ ID NO: 938006 - DNA, 16 bp, Homo sapiens
cacacacgccagctcc

SEQ ID NO: 938007 - DNA, 22 bp, Homo sapiens
cacacacgccagctcctctctg

SEQ ID NO: 938008 - DNA, 22 bp, Homo sapiens
cacacacggttttggcagctga

SEQ ID NO: 938009 - DNA, 14 bp, Homo sapiens
cacacactgatgct

SEQ ID NO: 938010 - DNA, 10 bp, Homo sapiens
cacacactgg

SEQ ID NO: 938011 - DNA, 12 bp, Homo sapiens
cacacactggac

SEQ ID NO: 938012 - DNA, 13 bp, Homo sapiens
cacacactggacc

SEQ ID NO: 938013 - DNA, 18 bp, Homo sapiens
cacacactggaccccact

SEQ ID NO: 938014 - DNA, 19 bp, Homo sapiens
cacacactggaccccactg

SEQ ID NO: 938015 - DNA, 13 bp, Homo sapiens
cacacactgtgcc

SEQ ID NO: 938016 - DNA, 18 bp, Homo sapiens
cacacactgtgccccaca

SEQ ID NO: 938017 - DNA, 16 bp, Homo sapiens
cacacactttctcttc

SEQ ID NO: 938018 - DNA, 18 bp, Homo sapiens
cacacagaggaagagcag

SEQ ID NO: 938019 - DNA, 19 bp, Homo sapiens
cacacagaggctgcctctc

SEQ ID NO: 938020 - DNA, 14 bp, Homo sapiens
cacacagagtggtc

SEQ ID NO: 938021 - DNA, 15 bp, Homo sapiens
cacacagagtggtct

SEQ ID NO: 938022 - DNA, 17 bp, Homo sapiens
cacacagatacacacac

SEQ ID NO: 938023 - DNA, 18 bp, Homo sapiens
cacacagatacacacaca

SEQ ID NO: 938024 - DNA, 18 bp, Homo sapiens
cacacagatttgagctca

SEQ ID NO: 938025 - DNA, 22 bp, Homo sapiens
cacacagatttgagctcagccc

SEQ ID NO: 938026 - DNA, 15 bp, Homo sapiens
cacacagcagcagtt

SEQ ID NO: 938027 - DNA, 12 bp, Homo sapiens
cacacagcagcc

SEQ ID NO: 938028 - DNA, 14 bp, Homo sapiens
cacacagcagcccc

SEQ ID NO: 938029 - DNA, 20 bp, Homo sapiens
cacacagcagccccccagca

SEQ ID NO: 938030 - DNA, 23 bp, Homo sapiens
cacacagcagccccccagcacta

SEQ ID NO: 938031 - DNA, 13 bp, Homo sapiens
cacacagccccta

SEQ ID NO: 938032 - DNA, 15 bp, Homo sapiens
cacacagcctagcac

SEQ ID NO: 938033 - DNA, 16 bp, Homo sapiens
cacacagctgagcact

SEQ ID NO: 938034 - DNA, 14 bp, Homo sapiens
cacacagctgccct

SEQ ID NO: 938035 - DNA, 13 bp, Homo sapiens
cacacaggcaact

SEQ ID NO: 938036 - DNA, 16 bp, Homo sapiens
cacacaggcaactgag

SEQ ID NO: 938037 - DNA, 19 bp, Homo sapiens
cacacaggcaactgaggca

SEQ ID NO: 938038 - DNA, 13 bp, Homo sapiens
cacacaggccttc

SEQ ID NO: 938039 - DNA, 21 bp, Homo sapiens
cacacaggccttctgtggggc

SEQ ID NO: 938040 - DNA, 23 bp, Homo sapiens
cacacaggccttctgtggggctg

SEQ ID NO: 938041 - DNA, 12 bp, Homo sapiens
cacacagggcag

SEQ ID NO: 938042 - DNA, 15 bp, Homo sapiens
cacacagggcagtcc

SEQ ID NO: 938043 - DNA, 17 bp, Homo sapiens
cacacagggctcacagg

SEQ ID NO: 938044 - DNA, 23 bp, Homo sapiens
cacacagggtctgcaaggtcttt

SEQ ID NO: 938045 - DNA, 18 bp, Homo sapiens
cacacatacgtgcacagg

SEQ ID NO: 938046 - DNA, 19 bp, Homo sapiens
cacacatatacatatatat

SEQ ID NO: 938047 - DNA, 20 bp, Homo sapiens
cacacatatatattacaagg

SEQ ID NO: 938048 - DNA, 17 bp, Homo sapiens
cacacatcaccaggtgc

SEQ ID NO: 938049 - DNA, 14 bp, Homo sapiens
cacacatctggccc

SEQ ID NO: 938050 - DNA, 20 bp, Homo sapiens
cacacatctgggtgccctga

SEQ ID NO: 938051 - DNA, 16 bp, Homo sapiens
cacacatgccctcctg

SEQ ID NO: 938052 - DNA, 14 bp, Homo sapiens
cacacattccagcc

SEQ ID NO: 938053 - DNA, 15 bp, Homo sapiens
cacacattccagcca

SEQ ID NO: 938054 - DNA, 17 bp, Homo sapiens
cacacattccagccagg

SEQ ID NO: 938055 - DNA, 20 bp, Homo sapiens
cacacattccagccaggccc

SEQ ID NO: 938056 - DNA, 22 bp, Homo sapiens
cacacattccagccaggcccag

SEQ ID NO: 938057 - DNA, 15 bp, Homo sapiens
cacacattccagggc

SEQ ID NO: 938058 - DNA, 19 bp, Homo sapiens
cacacattccagggctggg

SEQ ID NO: 938059 - DNA, 20 bp, Homo sapiens
cacacattgtgcttggcccc

SEQ ID NO: 938060 - DNA, 12 bp, Homo sapiens
cacacatttaaa

SEQ ID NO: 938061 - DNA, 15 bp, Homo sapiens
cacacattttatgag

SEQ ID NO: 938062 - DNA, 11 bp, Homo sapiens
cacacattttt

SEQ ID NO: 938063 - DNA, 16 bp, Homo sapiens
cacacattttttaaat

SEQ ID NO: 938064 - DNA, 14 bp, Homo sapiens
cacaccactgccct

SEQ ID NO: 938065 - DNA, 17 bp, Homo sapiens
cacaccactgccctgcc

SEQ ID NO: 938066 - DNA, 18 bp, Homo sapiens
cacaccactgccctgcct

SEQ ID NO: 938067 - DNA, 19 bp, Homo sapiens
cacaccactgccctgcctg

SEQ ID NO: 938068 - DNA, 17 bp, Homo sapiens
cacaccagccgctgcag

SEQ ID NO: 938069 - DNA, 23 bp, Homo sapiens
cacaccaggccgtcctcccgggc

SEQ ID NO: 938070 - DNA, 18 bp, Homo sapiens
cacaccaggcgctaattc

SEQ ID NO: 938071 - DNA, 19 bp, Homo sapiens
cacaccaggctgtgggcct

SEQ ID NO: 938072 - DNA, 20 bp, Homo sapiens
cacaccaggctgtgggcctc

SEQ ID NO: 938073 - DNA, 16 bp, Homo sapiens
cacacccactgccccg

SEQ ID NO: 938074 - DNA, 13 bp, Homo sapiens
cacacccaggaag

SEQ ID NO: 938075 - DNA, 23 bp, Homo sapiens
cacacccaggtgatttcctctaa

SEQ ID NO: 938076 - DNA, 14 bp, Homo sapiens
cacaccccacaccc

SEQ ID NO: 938077 - DNA, 12 bp, Homo sapiens
cacaccccactc

SEQ ID NO: 938078 - DNA, 13 bp, Homo sapiens
cacaccccagccc

SEQ ID NO: 938079 - DNA, 15 bp, Homo sapiens
cacaccccagcccac

SEQ ID NO: 938080 - DNA, 12 bp, Homo sapiens
cacacccccaga

SEQ ID NO: 938081 - DNA, 18 bp, Homo sapiens
cgtgaaaggctgtggcat

SEQ ID NO: 938082 - DNA, 19 bp, Homo sapiens
cgtgaaatttgcctctgtc

SEQ ID NO: 938083 - DNA, 17 bp, Homo sapiens
cgtgaagaaataaatga

SEQ ID NO: 938084 - DNA, 15 bp, Homo sapiens
cgtgaagcagtgcct

SEQ ID NO: 938085 - DNA, 17 bp, Homo sapiens
cgtgaagcagtgcctcg

SEQ ID NO: 938086 - DNA, 23 bp, Homo sapiens
cgtgacaacacaaatttgggagg

SEQ ID NO: 938087 - DNA, 17 bp, Homo sapiens
cgtgacagactcctgag

SEQ ID NO: 938088 - DNA, 17 bp, Homo sapiens
cgtgacccttcagggcc

SEQ ID NO: 938089 - DNA, 18 bp, Homo sapiens
cgtgacccttcagggcca

SEQ ID NO: 938090 - DNA, 13 bp, Homo sapiens
cgtgacctattca

SEQ ID NO: 938091 - DNA, 22 bp, Homo sapiens
cgtgacggagcccacactgcca

SEQ ID NO: 938092 - DNA, 15 bp, Homo sapiens
cgtgactcacccaag

SEQ ID NO: 938093 - DNA, 17 bp, Homo sapiens
cgtgactcacccaagca

SEQ ID NO: 938094 - DNA, 16 bp, Homo sapiens
cgtgactgccccaact

SEQ ID NO: 938095 - DNA, 21 bp, Homo sapiens
cgtgactgccccaactcctgg

SEQ ID NO: 938096 - DNA, 22 bp, Homo sapiens
cgtgactgccccaactcctgga

SEQ ID NO: 938097 - DNA, 23 bp, Homo sapiens
cgtgactgccccaactcctggaa

SEQ ID NO: 938098 - DNA, 23 bp, Homo sapiens
cgtgagctggggactcagggacc

SEQ ID NO: 938099 - DNA, 16 bp, Homo sapiens
cgtgagtcatttaaat

SEQ ID NO: 938100 - DNA, 19 bp, Homo sapiens
cgtgagtgacatagcctca

SEQ ID NO: 938101 - DNA, 20 bp, Homo sapiens
cgtgagtgacatagcctcat

SEQ ID NO: 938102 - DNA, 16 bp, Homo sapiens
cgtgagtgtgtgagcg

SEQ ID NO: 938103 - DNA, 14 bp, Homo sapiens
cgtgatcaaagcca

SEQ ID NO: 938104 - DNA, 21 bp, Homo sapiens
cgtgatcaaagccacactctg

SEQ ID NO: 938105 - DNA, 21 bp, Homo sapiens
cgtgatccatccatctccagg

SEQ ID NO: 938106 - DNA, 18 bp, Homo sapiens
cgtgatggagaggacaga

SEQ ID NO: 938107 - DNA, 23 bp, Homo sapiens
cgtgatgtagggtaaggtgcctt

SEQ ID NO: 938108 - DNA, 13 bp, Homo sapiens
cgtgatgtggagg

SEQ ID NO: 938109 - DNA, 16 bp, Homo sapiens
cgtgatgtggaggaag

SEQ ID NO: 938110 - DNA, 22 bp, Homo sapiens
cgtgatgtggaggaagagccac

SEQ ID NO: 938111 - DNA, 23 bp, Homo sapiens
cgtgatttggaagagaggcacct

SEQ ID NO: 938112 - DNA, 18 bp, Homo sapiens
cgtgcactctgctaatca

SEQ ID NO: 938113 - DNA, 15 bp, Homo sapiens
cgtgcactgacagcc

SEQ ID NO: 938114 - DNA, 11 bp, Homo sapiens
cgtgcagagct

SEQ ID NO: 938115 - DNA, 16 bp, Homo sapiens
cgtgcagagctggggc

SEQ ID NO: 938116 - DNA, 14 bp, Homo sapiens
cgtgcaggacagct

SEQ ID NO: 938117 - DNA, 18 bp, Homo sapiens
cgtgcataccacttttgt

SEQ ID NO: 938118 - DNA, 13 bp, Homo sapiens
cgtgcatcccaga

SEQ ID NO: 938119 - DNA, 20 bp, Homo sapiens
cgtgcatggctcctgtctgg

SEQ ID NO: 938120 - DNA, 21 bp, Homo sapiens
cgtgcattggaagaccccacc

SEQ ID NO: 938121 - DNA, 17 bp, Homo sapiens
cgtgcatttgaggggcc

SEQ ID NO: 938122 - DNA, 21 bp, Homo sapiens
cgtgccaaccccacccagctc

SEQ ID NO: 938123 - DNA, 13 bp, Homo sapiens
cgtgccagcagcc

SEQ ID NO: 938124 - DNA, 14 bp, Homo sapiens
cgtgccagcagcct

SEQ ID NO: 938125 - DNA, 21 bp, Homo sapiens
cgtgccagcagcctcgcacag

SEQ ID NO: 938126 - DNA, 17 bp, Homo sapiens
cgtgccagctctagttt

SEQ ID NO: 938127 - DNA, 15 bp, Homo sapiens
cgtgccagtcctggg

SEQ ID NO: 938128 - DNA, 21 bp, Homo sapiens
cgtgccattgtactccagcct

SEQ ID NO: 938129 - DNA, 15 bp, Homo sapiens
cgtgcccagctcttc

SEQ ID NO: 938130 - DNA, 15 bp, Homo sapiens
cgtgccccacctccc

SEQ ID NO: 938131 - DNA, 17 bp, Homo sapiens
cgtgccccacctcccca

SEQ ID NO: 938132 - DNA, 21 bp, Homo sapiens
cgtgccccacctccccacaca

SEQ ID NO: 938133 - DNA, 19 bp, Homo sapiens
cgtgcccccgcctgccacc

SEQ ID NO: 938134 - DNA, 17 bp, Homo sapiens
cgtgccccgcctccccg

SEQ ID NO: 938135 - DNA, 18 bp, Homo sapiens
cgtgcccttgcccttgga

SEQ ID NO: 938136 - DNA, 16 bp, Homo sapiens
cgtgccgcctgctcct

SEQ ID NO: 938137 - DNA, 18 bp, Homo sapiens
cgtgccgcctgctcctca

SEQ ID NO: 938138 - DNA, 22 bp, Homo sapiens
cgtgccgcctgctcctcactgg

SEQ ID NO: 938139 - DNA, 22 bp, Homo sapiens
cgtgccggcggcagccccactt

SEQ ID NO: 938140 - DNA, 19 bp, Homo sapiens
cgtgccgggagaggactct

SEQ ID NO: 938141 - DNA, 22 bp, Homo sapiens
cgtgccgtgtgagtgtgacagg

SEQ ID NO: 938142 - DNA, 17 bp, Homo sapiens
cgtgccgttactctcca

SEQ ID NO: 938143 - DNA, 13 bp, Homo sapiens
cgtgcctccacca

SEQ ID NO: 938144 - DNA, 14 bp, Homo sapiens
cgtgcctccaccac

SEQ ID NO: 938145 - DNA, 19 bp, Homo sapiens
cgtgcctccttccacctcc

SEQ ID NO: 938146 - DNA, 18 bp, Homo sapiens
cgtgcctgggcccctccc

SEQ ID NO: 938147 - DNA, 13 bp, Homo sapiens
cgtgcctgtagtc

SEQ ID NO: 938148 - DNA, 15 bp, Homo sapiens
cgtgccttcagctct

SEQ ID NO: 938149 - DNA, 23 bp, Homo sapiens
cgtgccttttgcacccctcccat

SEQ ID NO: 938150 - DNA, 15 bp, Homo sapiens
cgtgcgacagagaga

SEQ ID NO: 938151 - DNA, 16 bp, Homo sapiens
cgtgcgacagagagag

SEQ ID NO: 938152 - DNA, 13 bp, Homo sapiens
cgtgcgagctgcc

SEQ ID NO: 938153 - DNA, 19 bp, Homo sapiens
cgtgcgtgtgtgtgtgttt

SEQ ID NO: 938154 - DNA, 17 bp, Homo sapiens
cgtgcgtgttagtgtgt

SEQ ID NO: 938155 - DNA, 23 bp, Homo sapiens
cgtgctacccccatgctggaggt

SEQ ID NO: 938156 - DNA, 15 bp, Homo sapiens
cgtgctactgcactc

SEQ ID NO: 938157 - DNA, 22 bp, Homo sapiens
cgtgctccctcccatcctccag

SEQ ID NO: 938158 - DNA, 19 bp, Homo sapiens
cgtgctcgccccagcaggt

SEQ ID NO: 938159 - DNA, 20 bp, Homo sapiens
cgtgctggcgacactcaggg

SEQ ID NO: 938160 - DNA, 21 bp, Homo sapiens
cgtgctggcgacactcagggc

SEQ ID NO: 938161 - DNA, 22 bp, Homo sapiens
cgtgctggcgacactcagggca

SEQ ID NO: 938162 - DNA, 15 bp, Homo sapiens
cgtgctgggcagccc

SEQ ID NO: 938163 - DNA, 20 bp, Homo sapiens
cgtggaacgtttttcctgtt

SEQ ID NO: 938164 - DNA, 16 bp, Homo sapiens
cgtggaagggggagga

SEQ ID NO: 938165 - DNA, 22 bp, Homo sapiens
cgtggaatgcccttcactgtca

SEQ ID NO: 938166 - DNA, 13 bp, Homo sapiens
cgtggacacccca

SEQ ID NO: 938167 - DNA, 14 bp, Homo sapiens
cgtggacagcgctg

SEQ ID NO: 938168 - DNA, 17 bp, Homo sapiens
cgtggaccttcctgcca

SEQ ID NO: 938169 - DNA, 14 bp, Homo sapiens
cgtggactcctctt

SEQ ID NO: 938170 - DNA, 21 bp, Homo sapiens
cgtggactgagtgggaagccc

SEQ ID NO: 938171 - DNA, 13 bp, Homo sapiens
cgtggactgtgct

SEQ ID NO: 938172 - DNA, 15 bp, Homo sapiens
cgtggagccagggag

SEQ ID NO: 938173 - DNA, 22 bp, Homo sapiens
cgtggagcggggtatgaagagc

SEQ ID NO: 938174 - DNA, 18 bp, Homo sapiens
cgtggagctcgcccctcc

SEQ ID NO: 938175 - DNA, 14 bp, Homo sapiens
cgtggaggagagga

SEQ ID NO: 938176 - DNA, 15 bp, Homo sapiens
cgtggaggagaggag

SEQ ID NO: 938177 - DNA, 16 bp, Homo sapiens
cgtggatacagagcca

SEQ ID NO: 938178 - DNA, 19 bp, Homo sapiens
cgtggatgggcaaagcttg

SEQ ID NO: 938179 - DNA, 18 bp, Homo sapiens
cgtggcacgtattgctgt

SEQ ID NO: 938180 - DNA, 16 bp, Homo sapiens
cgtggcatgtggcctg

SEQ ID NO: 938181 - DNA, 20 bp, Homo sapiens
cgtggccacgggggcagtgt

SEQ ID NO: 938182 - DNA, 21 bp, Homo sapiens
cgtggccacgggggcagtgtg

SEQ ID NO: 938183 - DNA, 22 bp, Homo sapiens
cgtggccacgggggcagtgtga

SEQ ID NO: 938184 - DNA, 23 bp, Homo sapiens
cgtggccacgggggcagtgtgag

SEQ ID NO: 938185 - DNA, 12 bp, Homo sapiens
cgtggcctctct

SEQ ID NO: 938186 - DNA, 20 bp, Homo sapiens
cgtggcctggcatctgtgtg

SEQ ID NO: 938187 - DNA, 16 bp, Homo sapiens
cgtggccttgggagga

SEQ ID NO: 938188 - DNA, 14 bp, Homo sapiens
cgtggcgtggcccg

SEQ ID NO: 938189 - DNA, 18 bp, Homo sapiens
cgtggctcagccagcact

SEQ ID NO: 938190 - DNA, 20 bp, Homo sapiens
cgtggctcgactatagaaaa

SEQ ID NO: 938191 - DNA, 14 bp, Homo sapiens
cgtggctctgggag

SEQ ID NO: 938192 - DNA, 12 bp, Homo sapiens
cgtggctgtggc

SEQ ID NO: 938193 - DNA, 13 bp, Homo sapiens
cgtggctgtggca

SEQ ID NO: 938194 - DNA, 17 bp, Homo sapiens
cgtggcttggcatctgt

SEQ ID NO: 938195 - DNA, 18 bp, Homo sapiens
cgtggcttggcatctgtg

SEQ ID NO: 938196 - DNA, 14 bp, Homo sapiens
cgtggcttttccta

SEQ ID NO: 938197 - DNA, 17 bp, Homo sapiens
cgtgggaatttcaatgc

SEQ ID NO: 938198 - DNA, 19 bp, Homo sapiens
cgtgggacggtgcccaagc

SEQ ID NO: 938199 - DNA, 22 bp, Homo sapiens
cgtgggagacaagaaatccctg

SEQ ID NO: 938200 - DNA, 14 bp, Homo sapiens
cgtgggcagtgcca

SEQ ID NO: 938201 - DNA, 19 bp, Homo sapiens
cgtgggcagtgccacccgc

SEQ ID NO: 938202 - DNA, 14 bp, Homo sapiens
cgttggtccagagc

SEQ ID NO: 938203 - DNA, 15 bp, Homo sapiens
cgttggttctgcact

SEQ ID NO: 938204 - DNA, 13 bp, Homo sapiens
cgttgttgtcatt

SEQ ID NO: 938205 - DNA, 14 bp, Homo sapiens
cgttgttgtcattg

SEQ ID NO: 938206 - DNA, 17 bp, Homo sapiens
cgtttaagccaaaacaa

SEQ ID NO: 938207 - DNA, 14 bp, Homo sapiens
cgtttaagttgtat

SEQ ID NO: 938208 - DNA, 21 bp, Homo sapiens
cgtttagtttctagaggcctc

SEQ ID NO: 938209 - DNA, 16 bp, Homo sapiens
cgtttatgggccttgc

SEQ ID NO: 938210 - DNA, 14 bp, Homo sapiens
cgtttattttcaag

SEQ ID NO: 938211 - DNA, 12 bp, Homo sapiens
cgtttcagaagg

SEQ ID NO: 938212 - DNA, 13 bp, Homo sapiens
cgtttcatcaggc

SEQ ID NO: 938213 - DNA, 18 bp, Homo sapiens
cgtttccatcatgtctgt

SEQ ID NO: 938214 - DNA, 17 bp, Homo sapiens
cgtttcccggttcagga

SEQ ID NO: 938215 - DNA, 18 bp, Homo sapiens
cgtttctccacctagact

SEQ ID NO: 938216 - DNA, 19 bp, Homo sapiens
cgtttgcaccgcctgccct

SEQ ID NO: 938217 - DNA, 18 bp, Homo sapiens
cgtttgctgtgccaggag

SEQ ID NO: 938218 - DNA, 14 bp, Homo sapiens
cgtttggggccctc

SEQ ID NO: 938219 - DNA, 20 bp, Homo sapiens
cgtttgttcgcttcctgagt

SEQ ID NO: 938220 - DNA, 22 bp, Homo sapiens
cgttttaataatttttgctgaa

SEQ ID NO: 938221 - DNA, 14 bp, Homo sapiens
cgttttcatcctgg

SEQ ID NO: 938222 - DNA, 20 bp, Homo sapiens
cgttttctccgggtcctcct

SEQ ID NO: 938223 - DNA, 14 bp, Homo sapiens
cgttttcttaaagt

SEQ ID NO: 938224 - DNA, 15 bp, Homo sapiens
cgttttcttctttcc

SEQ ID NO: 938225 - DNA, 13 bp, Homo sapiens
cgttttgaagcta

SEQ ID NO: 938226 - DNA, 15 bp, Homo sapiens
cgttttggaagctct

SEQ ID NO: 938227 - DNA, 14 bp, Homo sapiens
cgttttgtattgct

SEQ ID NO: 938228 - DNA, 23 bp, Homo sapiens
cgtttttatattacttttgtaaa

SEQ ID NO: 938229 - DNA, 23 bp, Homo sapiens
cgtttttcagcacccccacccac

SEQ ID NO: 938230 - DNA, 19 bp, Homo sapiens
cgtttttgtgctgtgggca

SEQ ID NO: 938231 - DNA, 22 bp, Homo sapiens
cgtttttgtgctgtgggcagca

SEQ ID NO: 938232 - DNA, 17 bp, Homo sapiens
cgttttttaaatgtata

SEQ ID NO: 938233 - DNA, 20 bp, Homo sapiens
cgtttttttttttttattgt

SEQ ID NO: 938234 - DNA, 23 bp, Homo sapiens
tttttgtaccattttaaagttag

SEQ ID NO: 938235 - DNA, 18 bp, Homo sapiens
tttttgtatagttaacac

SEQ ID NO: 938236 - DNA, 21 bp, Homo sapiens
tttttgtatagttaacacact

SEQ ID NO: 938237 - DNA, 12 bp, Homo sapiens
tttttgtatgtt

SEQ ID NO: 938238 - DNA, 22 bp, Homo sapiens
tttttgtatttctctattttca

SEQ ID NO: 938239 - DNA, 19 bp, Homo sapiens
tttttgtattttttcctta

SEQ ID NO: 938240 - DNA, 17 bp, Homo sapiens
tttttgtcaacattgtg

SEQ ID NO: 938241 - DNA, 14 bp, Homo sapiens
tttttgtcatttta

SEQ ID NO: 938242 - DNA, 21 bp, Homo sapiens
tttttgtcccccaacttgaga

SEQ ID NO: 938243 - DNA, 20 bp, Homo sapiens
tttttgtctatgaagttgct

SEQ ID NO: 938244 - DNA, 13 bp, Homo sapiens
tttttgtctcaat

SEQ ID NO: 938245 - DNA, 16 bp, Homo sapiens
tttttgtcttattgaa

SEQ ID NO: 938246 - DNA, 23 bp, Homo sapiens
tttttgtgccattatatttgcat

SEQ ID NO: 938247 - DNA, 14 bp, Homo sapiens
tttttgtgtatgta

SEQ ID NO: 938248 - DNA, 17 bp, Homo sapiens
tttttgtgtatgtactt

SEQ ID NO: 938249 - DNA, 18 bp, Homo sapiens
tttttgtgtatgtactta

SEQ ID NO: 938250 - DNA, 21 bp, Homo sapiens
tttttgtgtccgctaaatatt

SEQ ID NO: 938251 - DNA, 17 bp, Homo sapiens
tttttgtgtgtatttgc

SEQ ID NO: 938252 - DNA, 13 bp, Homo sapiens
tttttgtgtttct

SEQ ID NO: 938253 - DNA, 22 bp, Homo sapiens
tttttgtgttttgttctttaaa

SEQ ID NO: 938254 - DNA, 16 bp, Homo sapiens
tttttgttattaaaca

SEQ ID NO: 938255 - DNA, 22 bp, Homo sapiens
tttttgttccacaagttaaata

SEQ ID NO: 938256 - DNA, 12 bp, Homo sapiens
tttttgttgaca

SEQ ID NO: 938257 - DNA, 14 bp, Homo sapiens
tttttgttggagtg

SEQ ID NO: 938258 - DNA, 14 bp, Homo sapiens
tttttgttttgaaa

SEQ ID NO: 938259 - DNA, 18 bp, Homo sapiens
tttttgttttgaaagttt

SEQ ID NO: 938260 - DNA, 12 bp, Homo sapiens
ttttttaaagaa

SEQ ID NO: 938261 - DNA, 11 bp, Homo sapiens
ttttttaacat

SEQ ID NO: 938262 - DNA, 15 bp, Homo sapiens
ttttttaacatcttt

SEQ ID NO: 938263 - DNA, 19 bp, Homo sapiens
ttttttaaccaaggagggg

SEQ ID NO: 938264 - DNA, 17 bp, Homo sapiens
ttttttaagtatttata

SEQ ID NO: 938265 - DNA, 18 bp, Homo sapiens
ttttttaagttcttatga

SEQ ID NO: 938266 - DNA, 14 bp, Homo sapiens
ttttttaatgtatt

SEQ ID NO: 938267 - DNA, 15 bp, Homo sapiens
ttttttaatgtattc

SEQ ID NO: 938268 - DNA, 12 bp, Homo sapiens
ttttttacattt

SEQ ID NO: 938269 - DNA, 12 bp, Homo sapiens
ttttttactaat

SEQ ID NO: 938270 - DNA, 12 bp, Homo sapiens
ttttttactttg

SEQ ID NO: 938271 - DNA, 16 bp, Homo sapiens
ttttttagatcaaata

SEQ ID NO: 938272 - DNA, 23 bp, Homo sapiens
ttttttagtaagttaatgtatat

SEQ ID NO: 938273 - DNA, 19 bp, Homo sapiens
tttccttctgttaagaaag

SEQ ID NO: 938274 - DNA, 15 bp, Homo sapiens
tttccttcttcagca

SEQ ID NO: 938275 - DNA, 20 bp, Homo sapiens
tttccttgctatttcaataa

SEQ ID NO: 938276 - DNA, 12 bp, Homo sapiens
tttccttgctca

SEQ ID NO: 938277 - DNA, 16 bp, Homo sapiens
tttccttgtttatcag

SEQ ID NO: 938278 - DNA, 20 bp, Homo sapiens
tttcctttatccacttttct

SEQ ID NO: 938279 - DNA, 23 bp, Homo sapiens
tttcctttatgtgaatttttaag

SEQ ID NO: 938280 - DNA, 9 bp, Homo sapiens
tttcctttg

SEQ ID NO: 938281 - DNA, 17 bp, Homo sapiens
tttccttttcatctgtt

SEQ ID NO: 938282 - DNA, 12 bp, Homo sapiens
tttccttttgga

SEQ ID NO: 938283 - DNA, 21 bp, Homo sapiens
tttcctttttaaggtctttca

SEQ ID NO: 938284 - DNA, 16 bp, Homo sapiens
tttcctttttgacact

SEQ ID NO: 938285 - DNA, 19 bp, Homo sapiens
tttcctttttgacactgaa

SEQ ID NO: 938286 - DNA, 21 bp, Homo sapiens
tttcctttttggggagttgtt

SEQ ID NO: 938287 - DNA, 20 bp, Homo sapiens
tttccttttttcccataaga

SEQ ID NO: 938288 - DNA, 15 bp, Homo sapiens
tttccttttttgtct

SEQ ID NO: 938289 - DNA, 20 bp, Homo sapiens
tttccttttttgtctatgaa

SEQ ID NO: 938290 - DNA, 19 bp, Homo sapiens
tttcgactggtccagctct

SEQ ID NO: 938291 - DNA, 15 bp, Homo sapiens
tttgaaggtgggaaa

SEQ ID NO: 938292 - DNA, 18 bp, Homo sapiens
tttgaaggtttcagatga

SEQ ID NO: 938293 - DNA, 20 bp, Homo sapiens
tttgaaggtttcagatgagg

SEQ ID NO: 938294 - DNA, 23 bp, Homo sapiens
tttgtttttaaactgtacagtgt

SEQ ID NO: 938295 - DNA, 18 bp, Homo sapiens
tttgtttttatttaaatt

SEQ ID NO: 938296 - DNA, 20 bp, Homo sapiens
tttgtttttcgtcattttat

SEQ ID NO: 938297 - DNA, 13 bp, Homo sapiens
tttgtttttgcat

SEQ ID NO: 938298 - DNA, 20 bp, Homo sapiens
tttgttttttgtaactacaa

SEQ ID NO: 938299 - DNA, 15 bp, Homo sapiens
tttgtttttttgcca

SEQ ID NO: 938300 - DNA, 21 bp, Homo sapiens
tttgtttttttttttttggta

SEQ ID NO: 938301 - DNA, 17 bp, Homo sapiens
ttttaaaaaaaatttgt

SEQ ID NO: 938302 - DNA, 20 bp, Homo sapiens
ttttaaaaaaactgaaggtt

SEQ ID NO: 938303 - DNA, 15 bp, Homo sapiens
ttttaaaaaaatttg

SEQ ID NO: 938304 - DNA, 21 bp, Homo sapiens
ttttaaaaaaatttttataaa

SEQ ID NO: 938305 - DNA, 22 bp, Homo sapiens
ttttaaaaaaatttttataaat

SEQ ID NO: 938306 - DNA, 18 bp, Homo sapiens
ttttaaaaaactgctgac

SEQ ID NO: 938307 - DNA, 21 bp, Homo sapiens
ttttaaaaaactgctgactgt

SEQ ID NO: 938308 - DNA, 14 bp, Homo sapiens
ttttaaaaaagaaa

SEQ ID NO: 938309 - DNA, 23 bp, Homo sapiens
ttttaaaaaagcttaaaactttg

SEQ ID NO: 938310 - DNA, 18 bp, Homo sapiens
ttttaaaaaataccattg

SEQ ID NO: 938311 - DNA, 19 bp, Homo sapiens
ttttaaaaaataccattga

SEQ ID NO: 938312 - DNA, 24 bp, Homo sapiens
ttttaaaaaataccattgaaatca

SEQ ID NO: 938313 - DNA, 15 bp, Homo sapiens
ttttaaaaaatcaat

SEQ ID NO: 938314 - DNA, 20 bp, Homo sapiens
ttttaaaaactcttcagtgc

SEQ ID NO: 938315 - DNA, 23 bp, Homo sapiens
ttttaaaaagaaactatttttgt

SEQ ID NO: 938316 - DNA, 15 bp, Homo sapiens
ttttaaaaagaaggg

SEQ ID NO: 938317 - DNA, 21 bp, Homo sapiens
ttttaaaaatacatatcgctg

SEQ ID NO: 938318 - DNA, 14 bp, Homo sapiens
ttttaaaacaaaag

SEQ ID NO: 938319 - DNA, 12 bp, Homo sapiens
ttttaaaacatt

SEQ ID NO: 938320 - DNA, 23 bp, Homo sapiens
ttttaaaagacaagacttcagta

SEQ ID NO: 938321 - DNA, 13 bp, Homo sapiens
ttttaaaagcaca

SEQ ID NO: 938322 - DNA, 22 bp, Homo sapiens
ttttaaaagcacaatcactaaa

SEQ ID NO: 938323 - DNA, 19 bp, Homo sapiens
ttttaaaaggtagagtctt

SEQ ID NO: 938324 - DNA, 22 bp, Homo sapiens
ttttaaaagttactccttttag

SEQ ID NO: 938325 - DNA, 21 bp, Homo sapiens
ttttaaaagtttcaatgtgat

SEQ ID NO: 938326 - DNA, 22 bp, Homo sapiens
ttttaaaataagtctgatttaa

SEQ ID NO: 938327 - DNA, 14 bp, Homo sapiens
ttttaaaatagaaa

SEQ ID NO: 938328 - DNA, 18 bp, Homo sapiens
ttttaaaatagaaatttt

SEQ ID NO: 938329 - DNA, 20 bp, Homo sapiens
ttttaatttgatgaaagctg

SEQ ID NO: 938330 - DNA, 21 bp, Homo sapiens
ttttaatttgatgaaagctga

SEQ ID NO: 938331 - DNA, 19 bp, Homo sapiens
ttttacaaaaaagaaaaga

SEQ ID NO: 938332 - DNA, 12 bp, Homo sapiens
ttttacaataaa

SEQ ID NO: 938333 - DNA, 14 bp, Homo sapiens
ttttacaattgaaa

SEQ ID NO: 938334 - DNA, 14 bp, Homo sapiens
ttttacacagagaa

SEQ ID NO: 938335 - DNA, 23 bp, Homo sapiens
ttttacagagaggatacatttaa

SEQ ID NO: 938336 - DNA, 16 bp, Homo sapiens
ttttacagatccagaa

SEQ ID NO: 938337 - DNA, 18 bp, Homo sapiens
ttttacagtatccaaaaa

SEQ ID NO: 938338 - DNA, 15 bp, Homo sapiens
ttttacatactgctg

SEQ ID NO: 938339 - DNA, 16 bp, Homo sapiens
ttttacatactgctgt

SEQ ID NO: 938340 - DNA, 17 bp, Homo sapiens
ttttacatgacagatat

SEQ ID NO: 938341 - DNA, 15 bp, Homo sapiens
ttttacatgtttcca

SEQ ID NO: 938342 - DNA, 17 bp, Homo sapiens
ttttacatgtttccatc

SEQ ID NO: 938343 - DNA, 16 bp, Homo sapiens
ttttacattatgcaaa

SEQ ID NO: 938344 - DNA, 15 bp, Homo sapiens
ttttacattctgtgt

SEQ ID NO: 938345 - DNA, 11 bp, Homo sapiens
ttttacattta

SEQ ID NO: 938346 - DNA, 12 bp, Homo sapiens
ttttacatttca

SEQ ID NO: 938347 - DNA, 12 bp, Homo sapiens
ttttaccaaagc

SEQ ID NO: 938348 - DNA, 13 bp, Homo sapiens
ttttaccaaagca

SEQ ID NO: 938349 - DNA, 16 bp, Homo sapiens
ttttaccaaagcatca

SEQ ID NO: 938350 - DNA, 13 bp, Homo sapiens
ttttaccaataaa

SEQ ID NO: 938351 - DNA, 18 bp, Homo sapiens
ttttaccaccgtctgtct

SEQ ID NO: 938352 - DNA, 14 bp, Homo sapiens
ttttaccagctccc

SEQ ID NO: 938353 - DNA, 14 bp, Homo sapiens
ttttaccctgtgtc

SEQ ID NO: 938354 - DNA, 17 bp, Homo sapiens
ttttaccctgtgtcaga

SEQ ID NO: 938355 - DNA, 22 bp, Homo sapiens
ttttaccgttggggcccttaac

SEQ ID NO: 938356 - DNA, 19 bp, Homo sapiens
ttttacctagctaattatt

SEQ ID NO: 938357 - DNA, 23 bp, Homo sapiens
ttttacctagctggtagcataaa

SEQ ID NO: 938358 - DNA, 15 bp, Homo sapiens
ttttacctctctctg

SEQ ID NO: 938359 - DNA, 13 bp, Homo sapiens
ttttactaaagaa

SEQ ID NO: 938360 - DNA, 17 bp, Homo sapiens
ttttactattgttacat

SEQ ID NO: 938361 - DNA, 22 bp, Homo sapiens
ttttactctgcctacagaactt

SEQ ID NO: 938362 - DNA, 16 bp, Homo sapiens
ttttactctgtgtaaa

SEQ ID NO: 938363 - DNA, 15 bp, Homo sapiens
ttttactggttgcat

SEQ ID NO: 938364 - DNA, 17 bp, Homo sapiens
ttttactggttgcatgg

SEQ ID NO: 938365 - DNA, 21 bp, Homo sapiens
ttttactggttgcatggaaat

SEQ ID NO: 938366 - DNA, 12 bp, Homo sapiens
ttttactgtttt

SEQ ID NO: 938367 - DNA, 11 bp, Homo sapiens
ttttactttgg

SEQ ID NO: 938368 - DNA, 19 bp, Homo sapiens
ttttactttgtacttgtgt

SEQ ID NO: 938369 - DNA, 17 bp, Homo sapiens
ttttacttttaaactgt

SEQ ID NO: 938370 - DNA, 18 bp, Homo sapiens
ttttacttttaaactgtg

SEQ ID NO: 938371 - DNA, 17 bp, Homo sapiens
ttttacttttcacactg

SEQ ID NO: 938372 - DNA, 17 bp, Homo sapiens
ttttagaaaaacattta

SEQ ID NO: 938373 - DNA, 14 bp, Homo sapiens
ttttagaaatgcat

SEQ ID NO: 938374 - DNA, 14 bp, Homo sapiens
ttttagaaattggt

SEQ ID NO: 938375 - DNA, 21 bp, Homo sapiens
ttttagacagtctcactttgt

SEQ ID NO: 938376 - DNA, 23 bp, Homo sapiens
ttttagagttgatactacagttt

SEQ ID NO: 938377 - DNA, 17 bp, Homo sapiens
ttttagatcaaatactt

SEQ ID NO: 938378 - DNA, 19 bp, Homo sapiens
ttttagatcaaatacttta

SEQ ID NO: 938379 - DNA, 13 bp, Homo sapiens
ttttagatgtatt

SEQ ID NO: 938380 - DNA, 12 bp, Homo sapiens
ttttagatgtta

SEQ ID NO: 938381 - DNA, 20 bp, Homo sapiens
ttttagattgagaaatgtgt

SEQ ID NO: 938382 - DNA, 20 bp, Homo sapiens
ttttagcagttctgcaaata

SEQ ID NO: 938383 - DNA, 22 bp, Homo sapiens
ttttagcatgtgtttggttctg

SEQ ID NO: 938384 - DNA, 11 bp, Homo sapiens
ttttagcattt

SEQ ID NO: 938385 - DNA, 20 bp, Homo sapiens
ttttagctgatgaacttatt

SEQ ID NO: 938386 - DNA, 20 bp, Homo sapiens
ttttagcttcagttgttctt

SEQ ID NO: 938387 - DNA, 19 bp, Homo sapiens
ttttagctttgtgtttact

SEQ ID NO: 938388 - DNA, 23 bp, Homo sapiens
ttttaggaaacttgtagaaacga

SEQ ID NO: 938389 - DNA, 16 bp, Homo sapiens
ttttaggacatcttaa

SEQ ID NO: 938390 - DNA, 23 bp, Homo sapiens
ttttaggattcccctcaatgcag

SEQ ID NO: 938391 - DNA, 17 bp, Homo sapiens
ttttaggcactcttaaa

SEQ ID NO: 938392 - DNA, 20 bp, Homo sapiens
ttttaggccaaaaaaatgta

SEQ ID NO: 938393 - DNA, 21 bp, Homo sapiens
ttttagggagtggttcctgtg

SEQ ID NO: 938394 - DNA, 14 bp, Homo sapiens
ttttagtaagttaa

SEQ ID NO: 938395 - DNA, 15 bp, Homo sapiens
ttttagtattcattc

SEQ ID NO: 938396 - DNA, 18 bp, Homo sapiens
ttttagtgtgtgcataat

SEQ ID NO: 938397 - DNA, 19 bp, Homo sapiens
ttttagtttctaaagccaa

SEQ ID NO: 938398 - DNA, 13 bp, Homo sapiens
ttttagttttagt

SEQ ID NO: 938399 - DNA, 16 bp, Homo sapiens
ttttagtttttcatta

SEQ ID NO: 938400 - DNA, 14 bp, Homo sapiens
ttttataaaaagat

SEQ ID NO: 938401 - DNA, 22 bp, Homo sapiens
ttttataaaatggctgtaatca

SEQ ID NO: 938402 - DNA, 13 bp, Homo sapiens
ttttataaacttt

SEQ ID NO: 938403 - DNA, 18 bp, Homo sapiens
ttttataaataaactgtt

SEQ ID NO: 938404 - DNA, 15 bp, Homo sapiens
ttttataaattaaat

SEQ ID NO: 938405 - DNA, 21 bp, Homo sapiens
ttttataacatctttattgaa

SEQ ID NO: 938406 - DNA, 23 bp, Homo sapiens
ttttattggggaattaaatagtg

SEQ ID NO: 938407 - DNA, 19 bp, Homo sapiens
ttttattgttgttgtttga

SEQ ID NO: 938408 - DNA, 12 bp, Homo sapiens
ttttattgtttt

SEQ ID NO: 938409 - DNA, 11 bp, Homo sapiens
ttttatttaca

SEQ ID NO: 938410 - DNA, 17 bp, Homo sapiens
ttttatttataaactag

SEQ ID NO: 938411 - DNA, 12 bp, Homo sapiens
ttttatttatca

SEQ ID NO: 938412 - DNA, 14 bp, Homo sapiens
ttttatttatcaaa

SEQ ID NO: 938413 - DNA, 14 bp, Homo sapiens
ttttatttctaagt

SEQ ID NO: 938414 - DNA, 19 bp, Homo sapiens
ttttatttctaagtattta

SEQ ID NO: 938415 - DNA, 21 bp, Homo sapiens
ttttatttctactgtcaaatg

SEQ ID NO: 938416 - DNA, 13 bp, Homo sapiens
ttttatttgtcag

SEQ ID NO: 938417 - DNA, 22 bp, Homo sapiens
ttttatttttgaacccctgtgt

SEQ ID NO: 938418 - DNA, 20 bp, Homo sapiens
ttttcaaaaaagtcaacaaa

SEQ ID NO: 938419 - DNA, 19 bp, Homo sapiens
ttttcaaaatagaaaagtt

SEQ ID NO: 938420 - DNA, 19 bp, Homo sapiens
ttttcaaattgtatctagt

SEQ ID NO: 938421 - DNA, 15 bp, Homo sapiens
ttttcaactgctttg

SEQ ID NO: 938422 - DNA, 15 bp, Homo sapiens
ttttcaagaaactga

SEQ ID NO: 938423 - DNA, 16 bp, Homo sapiens
ttttcaagaataatca

SEQ ID NO: 938424 - DNA, 18 bp, Homo sapiens
ttttcaagattctaaagc

SEQ ID NO: 938425 - DNA, 12 bp, Homo sapiens
ttttcaaggcct

SEQ ID NO: 938426 - DNA, 15 bp, Homo sapiens
ttttcaaggccttca

SEQ ID NO: 938427 - DNA, 14 bp, Homo sapiens
ttttcaatagccac

SEQ ID NO: 938428 - DNA, 16 bp, Homo sapiens
ttttcaatagccacta

SEQ ID NO: 938429 - DNA, 14 bp, Homo sapiens
ttttcaatatattg

SEQ ID NO: 938430 - DNA, 15 bp, Homo sapiens
ttttcaatatattga

SEQ ID NO: 938431 - DNA, 20 bp, Homo sapiens
ttttcaatatattgaacttt

SEQ ID NO: 938432 - DNA, 19 bp, Homo sapiens
ttttcaatatgcaagcagc

SEQ ID NO: 938433 - DNA, 22 bp, Homo sapiens
ttttcaatatgcaagcagcttt

SEQ ID NO: 938434 - DNA, 14 bp, Homo sapiens
ttttcaatatttat

SEQ ID NO: 938435 - DNA, 20 bp, Homo sapiens
ttttcaccttttcaggaaaa

SEQ ID NO: 938436 - DNA, 14 bp, Homo sapiens
ttttcactgcctgt

SEQ ID NO: 938437 - DNA, 11 bp, Homo sapiens
ttttcactgct

SEQ ID NO: 938438 - DNA, 16 bp, Homo sapiens
ttttcactgctgctcc

SEQ ID NO: 938439 - DNA, 12 bp, Homo sapiens
ttttcacttgta

SEQ ID NO: 938440 - DNA, 13 bp, Homo sapiens
ttttcacttgtct

SEQ ID NO: 938441 - DNA, 19 bp, Homo sapiens
ttttcacttgtcttgctct

SEQ ID NO: 938442 - DNA, 16 bp, Homo sapiens
ttttcactttctgtct

SEQ ID NO: 938443 - DNA, 18 bp, Homo sapiens
ttttcactttgtgattat

SEQ ID NO: 938444 - DNA, 22 bp, Homo sapiens
ttttcagaacctcttccccaga

SEQ ID NO: 938445 - DNA, 20 bp, Homo sapiens
ttttcagaagaaataaatat

SEQ ID NO: 938446 - DNA, 22 bp, Homo sapiens
ttttcagaagatggtgaagaca

SEQ ID NO: 938447 - DNA, 12 bp, Homo sapiens
ttttcagaagca

SEQ ID NO: 938448 - DNA, 22 bp, Homo sapiens
ttttcagaagcaagccagacct

SEQ ID NO: 938449 - DNA, 16 bp, Homo sapiens
ttttcagactcagact

SEQ ID NO: 938450 - DNA, 17 bp, Homo sapiens
ttttcagagcaggaggc

SEQ ID NO: 938451 - DNA, 17 bp, Homo sapiens
ttttcagatataaaaga

SEQ ID NO: 938452 - DNA, 21 bp, Homo sapiens
ttttcagatataaaagactga

SEQ ID NO: 938453 - DNA, 20 bp, Homo sapiens
ttttcagccaatttgtctcc

SEQ ID NO: 938454 - DNA, 22 bp, Homo sapiens
ttttcaggagcgcaagatagat

SEQ ID NO: 938455 - DNA, 16 bp, Homo sapiens
ttttcagtattttgga

SEQ ID NO: 938456 - DNA, 19 bp, Homo sapiens
ttttcagtcccctctctct

SEQ ID NO: 938457 - DNA, 20 bp, Homo sapiens
ttttcagtcccctctctctg

SEQ ID NO: 938458 - DNA, 13 bp, Homo sapiens
ttttcagttactt

SEQ ID NO: 938459 - DNA, 21 bp, Homo sapiens
ttttcagttccctcctgccca

SEQ ID NO: 938460 - DNA, 14 bp, Homo sapiens
ttttcagttgttta

SEQ ID NO: 938461 - DNA, 12 bp, Homo sapiens
ttttcagttttc

SEQ ID NO: 938462 - DNA, 14 bp, Homo sapiens
ttttcagttttcag

SEQ ID NO: 938463 - DNA, 14 bp, Homo sapiens
ttttcatagatttg

SEQ ID NO: 938464 - DNA, 16 bp, Homo sapiens
ttttcataggaagaca

SEQ ID NO: 938465 - DNA, 15 bp, Homo sapiens
ttttcatatctcttg

SEQ ID NO: 938466 - DNA, 14 bp, Homo sapiens
ttttcatattgtgc

SEQ ID NO: 938467 - DNA, 16 bp, Homo sapiens
ttttcatattgtgcca

SEQ ID NO: 938468 - DNA, 13 bp, Homo sapiens
ttttcatcactgg

SEQ ID NO: 938469 - DNA, 20 bp, Homo sapiens
ttttcatccataactgaaca

SEQ ID NO: 938470 - DNA, 21 bp, Homo sapiens
ttttcatcccgtatcacagtg

SEQ ID NO: 938471 - DNA, 15 bp, Homo sapiens
ttttcatctgggaaa

SEQ ID NO: 938472 - DNA, 16 bp, Homo sapiens
ttttcatctgggaaag

SEQ ID NO: 938473 - DNA, 15 bp, Homo sapiens
ttttcatctgttgtt

SEQ ID NO: 938474 - DNA, 16 bp, Homo sapiens
ttttcatcttcagttg

SEQ ID NO: 938475 - DNA, 21 bp, Homo sapiens
ttttcatcttcagttgtctct

SEQ ID NO: 938476 - DNA, 13 bp, Homo sapiens
ttttcatggaagt

SEQ ID NO: 938477 - DNA, 15 bp, Homo sapiens
ttttcatgttgatga

SEQ ID NO: 938478 - DNA, 10 bp, Homo sapiens
ttttctgagc

SEQ ID NO: 938479 - DNA, 12 bp, Homo sapiens
ttttctgagccc

SEQ ID NO: 938480 - DNA, 15 bp, Homo sapiens
ttttctgccctggct

SEQ ID NO: 938481 - DNA, 13 bp, Homo sapiens
ttttctgctgttt

SEQ ID NO: 938482 - DNA, 21 bp, Homo sapiens
ttttctggaaattttgtccat

SEQ ID NO: 938483 - DNA, 21 bp, Homo sapiens
ttttctggaatacatgaaata

SEQ ID NO: 938484 - DNA, 16 bp, Homo sapiens
ttttctggactctgga

SEQ ID NO: 938485 - DNA, 22 bp, Homo sapiens
ttttctggactctggactttct

SEQ ID NO: 938486 - DNA, 19 bp, Homo sapiens
ttttctggtagatagaaat

SEQ ID NO: 938487 - DNA, 16 bp, Homo sapiens
ttttctggttccaaac

SEQ ID NO: 938488 - DNA, 16 bp, Homo sapiens
ttttctggtttggcat

SEQ ID NO: 938489 - DNA, 14 bp, Homo sapiens
ttttctgtaattca

SEQ ID NO: 938490 - DNA, 12 bp, Homo sapiens
ttttctgtattt

SEQ ID NO: 938491 - DNA, 14 bp, Homo sapiens
ttttctgtcctggg

SEQ ID NO: 938492 - DNA, 14 bp, Homo sapiens
ttttctgtgacatt

SEQ ID NO: 938493 - DNA, 23 bp, Homo sapiens
ttttctgtgtgtcagttttcata

SEQ ID NO: 938494 - DNA, 14 bp, Homo sapiens
ttttctgtttctgt

SEQ ID NO: 938495 - DNA, 15 bp, Homo sapiens
ttttctgtttgtaaa

SEQ ID NO: 938496 - DNA, 12 bp, Homo sapiens
ttttcttaacca

SEQ ID NO: 938497 - DNA, 13 bp, Homo sapiens
ttttcttaagaca

SEQ ID NO: 938498 - DNA, 17 bp, Homo sapiens
ttttcttactcctcctc

SEQ ID NO: 938499 - DNA, 23 bp, Homo sapiens
ttttcttaggagcaagaagaaaa

SEQ ID NO: 938500 - DNA, 18 bp, Homo sapiens
ttttcttatccacaaagt

SEQ ID NO: 938501 - DNA, 11 bp, Homo sapiens
ttttcttcagg

SEQ ID NO: 938502 - DNA, 15 bp, Homo sapiens
ttttcttctctgtga

SEQ ID NO: 938503 - DNA, 14 bp, Homo sapiens
ttttcttcttccct

SEQ ID NO: 938504 - DNA, 15 bp, Homo sapiens
ttttcttcttcctgg

SEQ ID NO: 938505 - DNA, 21 bp, Homo sapiens
ttttcttgccaatgaggtctg

SEQ ID NO: 938506 - DNA, 11 bp, Homo sapiens
ttttcttggga

SEQ ID NO: 938507 - DNA, 16 bp, Homo sapiens
ttttcttggtttctgg

SEQ ID NO: 938508 - DNA, 18 bp, Homo sapiens
ttttcttggtttctggat

SEQ ID NO: 938509 - DNA, 14 bp, Homo sapiens
ttttcttgtaaatg

SEQ ID NO: 938510 - DNA, 19 bp, Homo sapiens
ttttcttgtaaatgtttct

SEQ ID NO: 938511 - DNA, 20 bp, Homo sapiens
ttttcttgtctataaagcat

SEQ ID NO: 938512 - DNA, 14 bp, Homo sapiens
ttttctttaactgc

SEQ ID NO: 938513 - DNA, 15 bp, Homo sapiens
ttttctttaatatga

SEQ ID NO: 938514 - DNA, 20 bp, Homo sapiens
ttttctttacaaaacaaact

SEQ ID NO: 938515 - DNA, 21 bp, Homo sapiens
ttttctttaggacataaagag

SEQ ID NO: 938516 - DNA, 13 bp, Homo sapiens
ttttctttatgga

SEQ ID NO: 938517 - DNA, 14 bp, Homo sapiens
ttttctttcaaaag

SEQ ID NO: 938518 - DNA, 23 bp, Homo sapiens
ttttctttcctgtaaagaaacat

SEQ ID NO: 938519 - DNA, 18 bp, Homo sapiens
ttttctttctttttctgg

SEQ ID NO: 938520 - DNA, 17 bp, Homo sapiens
ttttctttgaatgcttt

SEQ ID NO: 938521 - DNA, 17 bp, Homo sapiens
ttttcttttattatcag

SEQ ID NO: 938522 - DNA, 22 bp, Homo sapiens
ttttcttttttaaagtaaactt

SEQ ID NO: 938523 - DNA, 18 bp, Homo sapiens
ttttctttttttggtaaa

SEQ ID NO: 938524 - DNA, 12 bp, Homo sapiens
ttttgaaaaata

SEQ ID NO: 938525 - DNA, 19 bp, Homo sapiens
ttttgaaaaatattgctaa

SEQ ID NO: 938526 - DNA, 20 bp, Homo sapiens
ttttgaaaaatattgctaaa

SEQ ID NO: 938527 - DNA, 23 bp, Homo sapiens
ttttgaaaaatattgctaaaagt

SEQ ID NO: 938528 - DNA, 16 bp, Homo sapiens
ttttgaaaatcctgaa

SEQ ID NO: 938529 - DNA, 15 bp, Homo sapiens
ttttgaaacaaagta

SEQ ID NO: 938530 - DNA, 22 bp, Homo sapiens
ttttgaaacaaagtactcttta

SEQ ID NO: 938531 - DNA, 15 bp, Homo sapiens
ttttgaaagaaaaat

SEQ ID NO: 938532 - DNA, 20 bp, Homo sapiens
ttttgaaatctgtatctgta

SEQ ID NO: 938533 - DNA, 17 bp, Homo sapiens
ttttgaaatgtgaacgt

SEQ ID NO: 938534 - DNA, 22 bp, Homo sapiens
ttttgaaatgtggttttcctga

SEQ ID NO: 938535 - DNA, 21 bp, Homo sapiens
ttttgaactaataaaagcata

SEQ ID NO: 938536 - DNA, 12 bp, Homo sapiens
ttttgaactttt

SEQ ID NO: 938537 - DNA, 20 bp, Homo sapiens
ttttgaactttttatttgag

SEQ ID NO: 938538 - DNA, 19 bp, Homo sapiens
tttttaaaaaaaatttgtg

SEQ ID NO: 938539 - DNA, 15 bp, Homo sapiens
tttttaaaaaagctt

SEQ ID NO: 938540 - DNA, 17 bp, Homo sapiens
tttttaaaaaagcttaa

SEQ ID NO: 938541 - DNA, 23 bp, Homo sapiens
tttttaaaaaagcttaaaacttt

SEQ ID NO: 938542 - DNA, 19 bp, Homo sapiens
tttttaaaaaggtaaatgg

SEQ ID NO: 938543 - DNA, 22 bp, Homo sapiens
tttttaaaaatgtgtcaaaata

SEQ ID NO: 938544 - DNA, 20 bp, Homo sapiens
tttttaaaactaatgagtat

SEQ ID NO: 938545 - DNA, 22 bp, Homo sapiens
tttttaaaagtttcaatgtgat

SEQ ID NO: 938546 - DNA, 14 bp, Homo sapiens
tttttaaaatagaa

SEQ ID NO: 938547 - DNA, 22 bp, Homo sapiens
tttttaaaatagaatgatagaa

SEQ ID NO: 938548 - DNA, 14 bp, Homo sapiens
tttttaaaatatat

SEQ ID NO: 938549 - DNA, 16 bp, Homo sapiens
tttttaaacaagtatt

SEQ ID NO: 938550 - DNA, 18 bp, Homo sapiens
tttttaaactgtacagtg

SEQ ID NO: 938551 - DNA, 19 bp, Homo sapiens
tttttaaactgtacagtgt

SEQ ID NO: 938552 - DNA, 11 bp, Homo sapiens
tttttaaactt

SEQ ID NO: 938553 - DNA, 17 bp, Homo sapiens
tttttaaagacagggtc

SEQ ID NO: 938554 - DNA, 12 bp, Homo sapiens
tttttaaagcaa

SEQ ID NO: 938555 - DNA, 14 bp, Homo sapiens
tttttaaagcaagt

SEQ ID NO: 938556 - DNA, 14 bp, Homo sapiens
tttttaaagcctgg

SEQ ID NO: 938557 - DNA, 22 bp, Homo sapiens
tttttaaaggggtctgttctgc

SEQ ID NO: 938558 - DNA, 16 bp, Homo sapiens
tttttaaagtaaactt

SEQ ID NO: 938559 - DNA, 21 bp, Homo sapiens
tttttaaagtctaaactgtta

SEQ ID NO: 938560 - DNA, 18 bp, Homo sapiens
tttttaaagttactttgt

SEQ ID NO: 938561 - DNA, 20 bp, Homo sapiens
tttttaaagtttgttcactt

SEQ ID NO: 938562 - DNA, 17 bp, Homo sapiens
tttttaaataaaagcac

SEQ ID NO: 938563 - DNA, 16 bp, Homo sapiens
tttttaaatattttct

SEQ ID NO: 938564 - DNA, 11 bp, Homo sapiens
tttttaaatgc

SEQ ID NO: 938565 - DNA, 15 bp, Homo sapiens
tttttaaatgtatac

SEQ ID NO: 938566 - DNA, 14 bp, Homo sapiens
tttttaaatgtgaa

SEQ ID NO: 938567 - DNA, 12 bp, Homo sapiens
tttttaaattat

SEQ ID NO: 938568 - DNA, 13 bp, Homo sapiens
tttttaaattgtt

SEQ ID NO: 938569 - DNA, 12 bp, Homo sapiens
tttttaaatttt

SEQ ID NO: 938570 - DNA, 16 bp, Homo sapiens
tttttaaattttgtaa

SEQ ID NO: 938571 - DNA, 10 bp, Homo sapiens
tttttaacac

SEQ ID NO: 938572 - DNA, 15 bp, Homo sapiens
tttttaacatgtgtt

SEQ ID NO: 938573 - DNA, 12 bp, Homo sapiens
tttttaaccaaa

SEQ ID NO: 938574 - DNA, 17 bp, Homo sapiens
tttttaacgtggcttgt

SEQ ID NO: 938575 - DNA, 12 bp, Homo sapiens
tttttaactgat

SEQ ID NO: 938576 - DNA, 16 bp, Homo sapiens
tttttaactgattctt

SEQ ID NO: 938577 - DNA, 15 bp, Homo sapiens
tttttaactttgaaa

SEQ ID NO: 938578 - DNA, 23 bp, Homo sapiens
tttttaagaaaaaggatgcacag

SEQ ID NO: 938579 - DNA, 20 bp, Homo sapiens
tttttaagaacttcattttt

SEQ ID NO: 938580 - DNA, 15 bp, Homo sapiens
tttttaagatagtgt

SEQ ID NO: 938581 - DNA, 20 bp, Homo sapiens
tttttaagatagtgtaactt

SEQ ID NO: 938582 - DNA, 20 bp, Homo sapiens
tttttaagctgcaaatctga

SEQ ID NO: 938583 - DNA, 16 bp, Homo sapiens
tttttaagtgcaacat

SEQ ID NO: 938584 - DNA, 18 bp, Homo sapiens
tttttaagtgcaacattt

SEQ ID NO: 938585 - DNA, 20 bp, Homo sapiens
tttttaagtgcaacatttct

SEQ ID NO: 938586 - DNA, 23 bp, Homo sapiens
tttttaagtgcaacatttctgta

SEQ ID NO: 938587 - DNA, 16 bp, Homo sapiens
tttttaagtgctgcat

SEQ ID NO: 938588 - DNA, 18 bp, Homo sapiens
tttttaagtgctgcattt

SEQ ID NO: 938589 - DNA, 16 bp, Homo sapiens
tttttaagttgtcaaa

SEQ ID NO: 938590 - DNA, 19 bp, Homo sapiens
tttttaagttgtcaaagaa

SEQ ID NO: 938591 - DNA, 16 bp, Homo sapiens
tttttaatagcactaa

SEQ ID NO: 938592 - DNA, 13 bp, Homo sapiens
tttttaatcagtt

SEQ ID NO: 938593 - DNA, 13 bp, Homo sapiens
tttttaatgatat

SEQ ID NO: 938594 - DNA, 19 bp, Homo sapiens
tttttaatggttaagaact

SEQ ID NO: 938595 - DNA, 14 bp, Homo sapiens
tttttaattaattg

SEQ ID NO: 938596 - DNA, 12 bp, Homo sapiens
tttttaattatt

SEQ ID NO: 938597 - DNA, 23 bp, Homo sapiens
tttttaatttacaaaaatataaa

SEQ ID NO: 938598 - DNA, 13 bp, Homo sapiens
tttttacaaaact

SEQ ID NO: 938599 - DNA, 17 bp, Homo sapiens
tttttacaaaactgctt

SEQ ID NO: 938600 - DNA, 20 bp, Homo sapiens
tttttacaagttatagtact

SEQ ID NO: 938601 - DNA, 18 bp, Homo sapiens
tttttacaagttttaaat

SEQ ID NO: 938602 - DNA, 19 bp, Homo sapiens
tttttacaagttttaaata

SEQ ID NO: 938603 - DNA, 12 bp, Homo sapiens
tttttacatttt

SEQ ID NO: 938604 - DNA, 20 bp, Homo sapiens
tttttaccaaagtgtctttt

SEQ ID NO: 938605 - DNA, 19 bp, Homo sapiens
tttttactaagttttcaaa

SEQ ID NO: 938606 - DNA, 20 bp, Homo sapiens
tttttactaagttttcaaat

SEQ ID NO: 938607 - DNA, 11 bp, Homo sapiens
tttttactaat

SEQ ID NO: 938608 - DNA, 17 bp, Homo sapiens
tttttacttttcacact

SEQ ID NO: 938609 - DNA, 14 bp, Homo sapiens
tttttagatcaaat

SEQ ID NO: 938610 - DNA, 19 bp, Homo sapiens
tttttagattgagaaatgt

SEQ ID NO: 938611 - DNA, 19 bp, Homo sapiens
tttttagattggttctgtt

SEQ ID NO: 938612 - DNA, 17 bp, Homo sapiens
ttgtaaatatataaata

SEQ ID NO: 938613 - DNA, 18 bp, Homo sapiens
ttgtaaatatataaatat

SEQ ID NO: 938614 - DNA, 16 bp, Homo sapiens
ttgtaaatatttatgt

SEQ ID NO: 938615 - DNA, 14 bp, Homo sapiens
ttgtaaatcttttt

SEQ ID NO: 938616 - DNA, 21 bp, Homo sapiens
ttgtaaatctttttgcttcta

SEQ ID NO: 938617 - DNA, 17 bp, Homo sapiens
ttgtaaatgattttaat

SEQ ID NO: 938618 - DNA, 20 bp, Homo sapiens
ttgtaaatgattttaatttt

SEQ ID NO: 938619 - DNA, 21 bp, Homo sapiens
ttgtaaatgctcgtgtgattt

SEQ ID NO: 938620 - DNA, 12 bp, Homo sapiens
ttgtaaatgttt

SEQ ID NO: 938621 - DNA, 18 bp, Homo sapiens
ttgtaaattaacttttat

SEQ ID NO: 938622 - DNA, 23 bp, Homo sapiens
ttgtaaattaatacttcatttgg

SEQ ID NO: 938623 - DNA, 12 bp, Homo sapiens
ttgtaaattata

SEQ ID NO: 938624 - DNA, 14 bp, Homo sapiens
ttgtaaattatatt

SEQ ID NO: 938625 - DNA, 15 bp, Homo sapiens
ttgtaaattatattt

SEQ ID NO: 938626 - DNA, 16 bp, Homo sapiens
ttgtaaattatatttg

SEQ ID NO: 938627 - DNA, 17 bp, Homo sapiens
ttgtaaattattgatga

SEQ ID NO: 938628 - DNA, 15 bp, Homo sapiens
ttgtaaattatttgc

SEQ ID NO: 938629 - DNA, 22 bp, Homo sapiens
ttgtaaattatttgctaagcat

SEQ ID NO: 938630 - DNA, 12 bp, Homo sapiens
ttgtaaatttta

SEQ ID NO: 938631 - DNA, 14 bp, Homo sapiens
ttgtaaattttaga

SEQ ID NO: 938632 - DNA, 16 bp, Homo sapiens
ttgtaacctcagctct

SEQ ID NO: 938633 - DNA, 12 bp, Homo sapiens
ttgtaacctgct

SEQ ID NO: 938634 - DNA, 17 bp, Homo sapiens
ttgtaactaaaataatt

SEQ ID NO: 938635 - DNA, 21 bp, Homo sapiens
ttgtaactaaaataattttgt

SEQ ID NO: 938636 - DNA, 23 bp, Homo sapiens
ttgtaactaaaataattttgtaa

SEQ ID NO: 938637 - DNA, 11 bp, Homo sapiens
ttgtaactaca

SEQ ID NO: 938638 - DNA, 14 bp, Homo sapiens
ttgtaacttatatt

SEQ ID NO: 938639 - DNA, 11 bp, Homo sapiens
ttgtaagaaat

SEQ ID NO: 938640 - DNA, 13 bp, Homo sapiens
ttgtaagaaggca

SEQ ID NO: 938641 - DNA, 21 bp, Homo sapiens
ttgtaagacaaaggttttcct

SEQ ID NO: 938642 - DNA, 13 bp, Homo sapiens
ttgtaagatgctg

SEQ ID NO: 938643 - DNA, 15 bp, Homo sapiens
ttgtaagatgctggg

SEQ ID NO: 938644 - DNA, 23 bp, Homo sapiens
ttgtaagccctctttaatgctgt

SEQ ID NO: 938645 - DNA, 16 bp, Homo sapiens
ttgtaaggtctttgta

SEQ ID NO: 938646 - DNA, 18 bp, Homo sapiens
ttgtaaggtctttgtaaa

SEQ ID NO: 938647 - DNA, 20 bp, Homo sapiens
ttgtaaggtctttgtaaaat

SEQ ID NO: 938648 - DNA, 12 bp, Homo sapiens
ttgtaagtcatc

SEQ ID NO: 938649 - DNA, 18 bp, Homo sapiens
ttgtaagtgtaaaaaatg

SEQ ID NO: 938650 - DNA, 19 bp, Homo sapiens
ttgtaagtgtaaaaaatgt

SEQ ID NO: 938651 - DNA, 20 bp, Homo sapiens
ttgtaagtgtaaaaaatgtc

SEQ ID NO: 938652 - DNA, 19 bp, Homo sapiens
ttgtaagtttgaatttgta

SEQ ID NO: 938653 - DNA, 13 bp, Homo sapiens
ttgtaataagcaa

SEQ ID NO: 938654 - DNA, 14 bp, Homo sapiens
ttgtaataagcaat

SEQ ID NO: 938655 - DNA, 20 bp, Homo sapiens
ttgtaatacttttgtaatct

SEQ ID NO: 938656 - DNA, 12 bp, Homo sapiens
ttgtaatagtcc

SEQ ID NO: 938657 - DNA, 14 bp, Homo sapiens
ttgtaatatgtaaa

SEQ ID NO: 938658 - DNA, 15 bp, Homo sapiens
ttgtaatatgtaaat

SEQ ID NO: 938659 - DNA, 12 bp, Homo sapiens
ttgtaatattct

SEQ ID NO: 938660 - DNA, 15 bp, Homo sapiens
ttgtaatattctgtt

SEQ ID NO: 938661 - DNA, 18 bp, Homo sapiens
ttgtaatattctgttttg

SEQ ID NO: 938662 - DNA, 16 bp, Homo sapiens
ttgtaatcaagccttt

SEQ ID NO: 938663 - DNA, 18 bp, Homo sapiens
ttgtaatcctagcacttt

SEQ ID NO: 938664 - DNA, 16 bp, Homo sapiens
ttgtaatcgtgtgcca

SEQ ID NO: 938665 - DNA, 15 bp, Homo sapiens
ttgtaatctgaataa

SEQ ID NO: 938666 - DNA, 22 bp, Homo sapiens
ttgtaatgaattcctagaatta

SEQ ID NO: 938667 - DNA, 17 bp, Homo sapiens
ttgtaatgtgtgaaaaa

SEQ ID NO: 938668 - DNA, 21 bp, Homo sapiens
ttgtaatgtgtgaaaaagatg

SEQ ID NO: 938669 - DNA, 14 bp, Homo sapiens
ttgtaattctaaat

SEQ ID NO: 938670 - DNA, 14 bp, Homo sapiens
ttgtaattcttatg

SEQ ID NO: 938671 - DNA, 18 bp, Homo sapiens
ttgtaattcttatgacta

SEQ ID NO: 938672 - DNA, 18 bp, Homo sapiens
ttgtaattgcttacattt

SEQ ID NO: 938673 - DNA, 23 bp, Homo sapiens
ttgtaattgtgtaaaaaatggaa

SEQ ID NO: 938674 - DNA, 22 bp, Homo sapiens
ttgtaatttaaaaagtgctata

SEQ ID NO: 938675 - DNA, 23 bp, Homo sapiens
ttgtaatttaaacaggcccagca

SEQ ID NO: 938676 - DNA, 12 bp, Homo sapiens
ttgtaatttgaa

SEQ ID NO: 938677 - DNA, 15 bp, Homo sapiens
ttgtaatttgaagat

SEQ ID NO: 938678 - DNA, 15 bp, Homo sapiens
ttgtaattttacacg

SEQ ID NO: 938679 - DNA, 22 bp, Homo sapiens
ttgtaattttacacgcttttgt

SEQ ID NO: 938680 - DNA, 16 bp, Homo sapiens
ttgtacaaaaaaaaag

SEQ ID NO: 938681 - DNA, 20 bp, Homo sapiens
ttgtacaaagattagtttca

SEQ ID NO: 938682 - DNA, 21 bp, Homo sapiens
ttgtacaaatgtaagcaaagg

SEQ ID NO: 938683 - DNA, 18 bp, Homo sapiens
ttgtacaaggtaattgtt

SEQ ID NO: 938684 - DNA, 21 bp, Homo sapiens
ttgtacaaggtaattgttttt

SEQ ID NO: 938685 - DNA, 13 bp, Homo sapiens
ttgtacaagtatt

SEQ ID NO: 938686 - DNA, 13 bp, Homo sapiens
ttgtacaatggtt

SEQ ID NO: 938687 - DNA, 16 bp, Homo sapiens
ttgtacaatggtttat

SEQ ID NO: 938688 - DNA, 21 bp, Homo sapiens
ttgtacaatggtttattccca

SEQ ID NO: 938689 - DNA, 13 bp, Homo sapiens
ttgtacacagtct

SEQ ID NO: 938690 - DNA, 20 bp, Homo sapiens
ttgtacagaatcattgctta

SEQ ID NO: 938691 - DNA, 21 bp, Homo sapiens
ttgtacagcgttttaaaagaa

SEQ ID NO: 938692 - DNA, 21 bp, Homo sapiens
ttgtacaggactgtaaagatt

SEQ ID NO: 938693 - DNA, 17 bp, Homo sapiens
ttgtacaggggccatgc

SEQ ID NO: 938694 - DNA, 21 bp, Homo sapiens
ttgtacaggggccatgcccca

SEQ ID NO: 938695 - DNA, 22 bp, Homo sapiens
ttgtacaggggccatgccccac

SEQ ID NO: 938696 - DNA, 16 bp, Homo sapiens
ttgtacagtaatatgt

SEQ ID NO: 938697 - DNA, 11 bp, Homo sapiens
ttgtacataaa

SEQ ID NO: 938698 - DNA, 16 bp, Homo sapiens
ttgtacatagttattt

SEQ ID NO: 938699 - DNA, 13 bp, Homo sapiens
ttgtacatattgt

SEQ ID NO: 938700 - DNA, 18 bp, Homo sapiens
ttgtacattttgtaaaat

SEQ ID NO: 938701 - DNA, 18 bp, Homo sapiens
ttgtacatttttgggggg

SEQ ID NO: 938702 - DNA, 16 bp, Homo sapiens
ttgtaccaaaacatcc

SEQ ID NO: 938703 - DNA, 14 bp, Homo sapiens
ttgtacctatttct

SEQ ID NO: 938704 - DNA, 15 bp, Homo sapiens
ttgtacctatttctg

SEQ ID NO: 938705 - DNA, 23 bp, Homo sapiens
ttgtacctatttctgatgatgtc

SEQ ID NO: 938706 - DNA, 23 bp, Homo sapiens
ttgtaccttttttgttttttcaa

SEQ ID NO: 938707 - DNA, 17 bp, Homo sapiens
ttgtacgtatgaatgat

SEQ ID NO: 938708 - DNA, 22 bp, Homo sapiens
ttgtactaatctgagattgtgt

SEQ ID NO: 938709 - DNA, 13 bp, Homo sapiens
ttgtactatgtta

SEQ ID NO: 938710 - DNA, 14 bp, Homo sapiens
ttgtactatgttaa

SEQ ID NO: 938711 - DNA, 18 bp, Homo sapiens
ttgtactcaaagcccaga

SEQ ID NO: 938712 - DNA, 20 bp, Homo sapiens
ttgtactccagcctgggtga

SEQ ID NO: 938713 - DNA, 14 bp, Homo sapiens
ttgtactgaatttt

SEQ ID NO: 938714 - DNA, 18 bp, Homo sapiens
ttgtactgttgctttaat

SEQ ID NO: 938715 - DNA, 17 bp, Homo sapiens
ttgtacttctgtgttca

SEQ ID NO: 938716 - DNA, 13 bp, Homo sapiens
ttgtacttgattt

SEQ ID NO: 938717 - DNA, 18 bp, Homo sapiens
ttgtacttggagtaattg

SEQ ID NO: 938718 - DNA, 19 bp, Homo sapiens
ttgtacttggagtaattgc

SEQ ID NO: 938719 - DNA, 15 bp, Homo sapiens
ttgtactttattttt

SEQ ID NO: 938720 - DNA, 18 bp, Homo sapiens
ttgtactttgtggagaga

SEQ ID NO: 938721 - DNA, 21 bp, Homo sapiens
ttgtacttttctggttccaaa

SEQ ID NO: 938722 - DNA, 22 bp, Homo sapiens
ttgtagaataaatggtttctca

SEQ ID NO: 938723 - DNA, 14 bp, Homo sapiens
ttgtagagttgtac

SEQ ID NO: 938724 - DNA, 22 bp, Homo sapiens
ttgtagatgttagggtataagt

SEQ ID NO: 938725 - DNA, 15 bp, Homo sapiens
ttgtagattgattgt

SEQ ID NO: 938726 - DNA, 17 bp, Homo sapiens
ttgtaggggtcaaagaa

SEQ ID NO: 938727 - DNA, 22 bp, Homo sapiens
ttgtagtaaaagtggtctctgc

SEQ ID NO: 938728 - DNA, 23 bp, Homo sapiens
ttgtagtagcgttttttaaatgt

SEQ ID NO: 938729 - DNA, 18 bp, Homo sapiens
ttgtagttcttgtgcatg

SEQ ID NO: 938730 - DNA, 13 bp, Homo sapiens
ttgtataaaaagg

SEQ ID NO: 938731 - DNA, 15 bp, Homo sapiens
ttgtataaaaaggaa

SEQ ID NO: 938732 - DNA, 23 bp, Homo sapiens
ttgtataaaaaggaaattagtct

SEQ ID NO: 938733 - DNA, 23 bp, Homo sapiens
ttgtataaactgtcaaattttca

SEQ ID NO: 938734 - DNA, 20 bp, Homo sapiens
ttgtataaataaatattttt

SEQ ID NO: 938735 - DNA, 12 bp, Homo sapiens
ttgtataaattt

SEQ ID NO: 938736 - DNA, 19 bp, Homo sapiens
ttgtataagtcaagcacat

SEQ ID NO: 938737 - DNA, 24 bp, Homo sapiens
ttgtataagtcaagcacatgtaat

SEQ ID NO: 938738 - DNA, 15 bp, Homo sapiens
ttgtataatattgaa

SEQ ID NO: 938739 - DNA, 16 bp, Homo sapiens
ttgtataatattgaaa

SEQ ID NO: 938740 - DNA, 16 bp, Homo sapiens
ttgtataccaatgtgt

SEQ ID NO: 938741 - DNA, 17 bp, Homo sapiens
ttgtatagaccaaagca

SEQ ID NO: 938742 - DNA, 22 bp, Homo sapiens
ttgtatagcatgaaataaaata

SEQ ID NO: 938743 - DNA, 15 bp, Homo sapiens
ttgtataggccatct

SEQ ID NO: 938744 - DNA, 17 bp, Homo sapiens
ttgtataggccatctgt

SEQ ID NO: 938745 - DNA, 20 bp, Homo sapiens
ttgtataggccatctgtaaa

SEQ ID NO: 938746 - DNA, 23 bp, Homo sapiens
ttgtataggccatctgtaaatat

SEQ ID NO: 938747 - DNA, 19 bp, Homo sapiens
ttgtatagttaacacacta

SEQ ID NO: 938748 - DNA, 15 bp, Homo sapiens
ttgtatagttgcttg

SEQ ID NO: 938749 - DNA, 20 bp, Homo sapiens
ttgtatagttgcttgcctga

SEQ ID NO: 938750 - DNA, 11 bp, Homo sapiens
ttgtatatatc

SEQ ID NO: 938751 - DNA, 14 bp, Homo sapiens
ttgtatatatgtgt

SEQ ID NO: 938752 - DNA, 19 bp, Homo sapiens
ttgtatatattattataat

SEQ ID NO: 938753 - DNA, 15 bp, Homo sapiens
ttgtatatcatgaaa

SEQ ID NO: 938754 - DNA, 13 bp, Homo sapiens
ttgtatattacaa

SEQ ID NO: 938755 - DNA, 16 bp, Homo sapiens
ttgtatattacaatga

SEQ ID NO: 938756 - DNA, 18 bp, Homo sapiens
ttgtatattgtaggaatc

SEQ ID NO: 938757 - DNA, 16 bp, Homo sapiens
ttgtatattgtcagat

SEQ ID NO: 938758 - DNA, 19 bp, Homo sapiens
ttgtatattgtcagatatt

SEQ ID NO: 938759 - DNA, 13 bp, Homo sapiens
ttgtatattgtgt

SEQ ID NO: 938760 - DNA, 14 bp, Homo sapiens
ttgtatatttgcaa

SEQ ID NO: 938761 - DNA, 15 bp, Homo sapiens
ttgtatatttgcaaa

SEQ ID NO: 938762 - DNA, 18 bp, Homo sapiens
ttgtatatttgtacaaaa

SEQ ID NO: 938763 - DNA, 16 bp, Homo sapiens
ttgtatctacagtaat

SEQ ID NO: 938764 - DNA, 20 bp, Homo sapiens
ttgtatctagtgcagctgat

SEQ ID NO: 938765 - DNA, 20 bp, Homo sapiens
ttgtatctcttttgaatcca

SEQ ID NO: 938766 - DNA, 21 bp, Homo sapiens
ttgtatctgcaggcagacacg

SEQ ID NO: 938767 - DNA, 18 bp, Homo sapiens
ttgtatctgtctttccac

SEQ ID NO: 938768 - DNA, 17 bp, Homo sapiens
ttgtatcttcctttctt

SEQ ID NO: 938769 - DNA, 20 bp, Homo sapiens
ttgtatctttatgctgtatt

SEQ ID NO: 938770 - DNA, 17 bp, Homo sapiens
ttgtatgaaatatatgt

SEQ ID NO: 938771 - DNA, 22 bp, Homo sapiens
ttgtatgaaatatatgtgaaag

SEQ ID NO: 938772 - DNA, 19 bp, Homo sapiens
ttgtatgaataaaaggctg

SEQ ID NO: 938773 - DNA, 22 bp, Homo sapiens
ttgtatgaggtcctcaggtcag

SEQ ID NO: 938774 - DNA, 18 bp, Homo sapiens
ttgtatgatgtgttgtga

SEQ ID NO: 938775 - DNA, 20 bp, Homo sapiens
ttgtatgatgtgttgtgata

SEQ ID NO: 938776 - DNA, 13 bp, Homo sapiens
ttgtatgattcca

SEQ ID NO: 938777 - DNA, 21 bp, Homo sapiens
ttgtatgcctttaaatctgtg

SEQ ID NO: 938778 - DNA, 18 bp, Homo sapiens
ttgtatgctaaatgagga

SEQ ID NO: 938779 - DNA, 18 bp, Homo sapiens
ttgtatgctgaatttcta

SEQ ID NO: 938780 - DNA, 20 bp, Homo sapiens
ttgtatggggaggcaagtgt

SEQ ID NO: 938781 - DNA, 14 bp, Homo sapiens
ttgtatgtggaagt

SEQ ID NO: 938782 - DNA, 14 bp, Homo sapiens
ttgtattaaagaca

SEQ ID NO: 938783 - DNA, 16 bp, Homo sapiens
ttgtattaataaagca

SEQ ID NO: 938784 - DNA, 13 bp, Homo sapiens
ttgtattacagat

SEQ ID NO: 938785 - DNA, 14 bp, Homo sapiens
ttgtattaggaaaa

SEQ ID NO: 938786 - DNA, 15 bp, Homo sapiens
ttgtattaggaaaat

SEQ ID NO: 938787 - DNA, 15 bp, Homo sapiens
ttgtattataattgt

SEQ ID NO: 938788 - DNA, 16 bp, Homo sapiens
ttgtattataattgtt

SEQ ID NO: 938789 - DNA, 15 bp, Homo sapiens
ttgtattattacaaa

SEQ ID NO: 938790 - DNA, 17 bp, Homo sapiens
ttgtattatttttgtag

SEQ ID NO: 938791 - DNA, 14 bp, Homo sapiens
ttgtattctctgag

SEQ ID NO: 938792 - DNA, 16 bp, Homo sapiens
ttgtattgtttcaatt

SEQ ID NO: 938793 - DNA, 13 bp, Homo sapiens
ttgtattgttttc

SEQ ID NO: 938794 - DNA, 16 bp, Homo sapiens
ttgtatttctcttgtc

SEQ ID NO: 938795 - DNA, 23 bp, Homo sapiens
ttgtatttggaatatttgaataa

SEQ ID NO: 938796 - DNA, 16 bp, Homo sapiens
ttgtatttgtgacttt

SEQ ID NO: 938797 - DNA, 12 bp, Homo sapiens
ttgtattttgca

SEQ ID NO: 938798 - DNA, 19 bp, Homo sapiens
ttgtattttgcatctgacc

SEQ ID NO: 938799 - DNA, 19 bp, Homo sapiens
ttgtattttttatttacat

SEQ ID NO: 938800 - DNA, 14 bp, Homo sapiens
ttgtattttttcct

SEQ ID NO: 938801 - DNA, 21 bp, Homo sapiens
ttgtatttttttgcaagtgaa

SEQ ID NO: 938802 - DNA, 14 bp, Homo sapiens
ttgtcaatattaaa

SEQ ID NO: 938803 - DNA, 19 bp, Homo sapiens
ttgtcaatttatgaatata

SEQ ID NO: 938804 - DNA, 13 bp, Homo sapiens
ttgtcacaataaa

SEQ ID NO: 938805 - DNA, 14 bp, Homo sapiens
ttgtcacaataaat

SEQ ID NO: 938806 - DNA, 23 bp, Homo sapiens
ttgtcacaatcctaacacattat

SEQ ID NO: 938807 - DNA, 22 bp, Homo sapiens
ttgtcacacagtagctccaaca

SEQ ID NO: 938808 - DNA, 20 bp, Homo sapiens
ttgtcacagaaatcagagga

SEQ ID NO: 938809 - DNA, 16 bp, Homo sapiens
ttgtcacattatttat

SEQ ID NO: 938810 - DNA, 22 bp, Homo sapiens
ttgtcacattatttattaaaaa

SEQ ID NO: 938811 - DNA, 16 bp, Homo sapiens
ttgtcaccagcaacat

SEQ ID NO: 938812 - DNA, 23 bp, Homo sapiens
ttgtcacttttccttttcttaaa

SEQ ID NO: 938813 - DNA, 21 bp, Homo sapiens
ttgtcactttttatgctattt

SEQ ID NO: 938814 - DNA, 16 bp, Homo sapiens
ttgtcactttttctga

SEQ ID NO: 938815 - DNA, 12 bp, Homo sapiens
ttgtcagacttt

SEQ ID NO: 938816 - DNA, 17 bp, Homo sapiens
ttgtcagatcgttcatt

SEQ ID NO: 938817 - DNA, 19 bp, Homo sapiens
ttgtcagccatcgtcctgg

SEQ ID NO: 938818 - DNA, 20 bp, Homo sapiens
ttgtcagccatcgtcctggg

SEQ ID NO: 938819 - DNA, 15 bp, Homo sapiens
ttgtcagtgacagta

SEQ ID NO: 938820 - DNA, 17 bp, Homo sapiens
ttgtcagttttgttcac

SEQ ID NO: 938821 - DNA, 23 bp, Homo sapiens
ttgtcagttttgttcacttgtta

SEQ ID NO: 938822 - DNA, 12 bp, Homo sapiens
ttgtcataacat

SEQ ID NO: 938823 - DNA, 23 bp, Homo sapiens
ttgtcataacatttaaagagatt

SEQ ID NO: 938824 - DNA, 21 bp, Homo sapiens
ttgtcatatcactaaataaac

SEQ ID NO: 938825 - DNA, 21 bp, Homo sapiens
ttgtcatatgtagccttcaca

SEQ ID NO: 938826 - DNA, 21 bp, Homo sapiens
ttgtcatcattgtatatatgt

SEQ ID NO: 938827 - DNA, 23 bp, Homo sapiens
ttgtcatcattgtatatatgtgt

SEQ ID NO: 938828 - DNA, 16 bp, Homo sapiens
ttgtcatcctcccttg

SEQ ID NO: 938829 - DNA, 21 bp, Homo sapiens
ttgtcatcgttccccacccct

SEQ ID NO: 938830 - DNA, 17 bp, Homo sapiens
ttgtcatgagtccatga

SEQ ID NO: 938831 - DNA, 16 bp, Homo sapiens
ttgtcatgtaccatca

SEQ ID NO: 938832 - DNA, 18 bp, Homo sapiens
ttgtcatgtaccatcaat

SEQ ID NO: 938833 - DNA, 13 bp, Homo sapiens
ttgtcatttataa

SEQ ID NO: 938834 - DNA, 16 bp, Homo sapiens
ttgtcatttttaatat

SEQ ID NO: 938835 - DNA, 21 bp, Homo sapiens
ttgtccaaagttacctggaat

SEQ ID NO: 938836 - DNA, 21 bp, Homo sapiens
ttgtccacattctacttcagc

SEQ ID NO: 938837 - DNA, 13 bp, Homo sapiens
ttgtccagcgcct

SEQ ID NO: 938838 - DNA, 19 bp, Homo sapiens
ttgtccagctgagcgccag

SEQ ID NO: 938839 - DNA, 19 bp, Homo sapiens
ttgtccaggaactgcctgg

SEQ ID NO: 938840 - DNA, 17 bp, Homo sapiens
ttgtccattacttgcca

SEQ ID NO: 938841 - DNA, 19 bp, Homo sapiens
ttgtccattgtaaatctga

SEQ ID NO: 938842 - DNA, 20 bp, Homo sapiens
ttgtcccaaggaatcagcag

SEQ ID NO: 938843 - DNA, 19 bp, Homo sapiens
ttgtcccactatctgggtg

SEQ ID NO: 938844 - DNA, 16 bp, Homo sapiens
ttgtcccatctgccct

SEQ ID NO: 938845 - DNA, 24 bp, Homo sapiens
ttgtccccaatcccggtcatgctt

SEQ ID NO: 938846 - DNA, 18 bp, Homo sapiens
ttgtccccaatgaatata

SEQ ID NO: 938847 - DNA, 20 bp, Homo sapiens
ttgtccccacacagcctcta

SEQ ID NO: 938848 - DNA, 14 bp, Homo sapiens
ttgtccccagggcc

SEQ ID NO: 938849 - DNA, 20 bp, Homo sapiens
ttgtccccagggcccctccc

SEQ ID NO: 938850 - DNA, 12 bp, Homo sapiens
ttgttattgtga

SEQ ID NO: 938851 - DNA, 14 bp, Homo sapiens
ttgttattgtggaa

SEQ ID NO: 938852 - DNA, 17 bp, Homo sapiens
ttgttatttacactggt

SEQ ID NO: 938853 - DNA, 20 bp, Homo sapiens
ttgttcaaaatatgttcttt

SEQ ID NO: 938854 - DNA, 14 bp, Homo sapiens
ttgttcaaaatgca

SEQ ID NO: 938855 - DNA, 17 bp, Homo sapiens
ttgttcaatgttccatt

SEQ ID NO: 938856 - DNA, 21 bp, Homo sapiens
ttgttcactgaaggtgattca

SEQ ID NO: 938857 - DNA, 23 bp, Homo sapiens
ttgttcaggaaaaggttgaataa

SEQ ID NO: 938858 - DNA, 17 bp, Homo sapiens
ttgttcatcatccagat

SEQ ID NO: 938859 - DNA, 12 bp, Homo sapiens
ttgttcatttgg

SEQ ID NO: 938860 - DNA, 19 bp, Homo sapiens
ttgttcattttgagctgaa

SEQ ID NO: 938861 - DNA, 22 bp, Homo sapiens
ttgttccaagacattgtcaata

SEQ ID NO: 938862 - DNA, 13 bp, Homo sapiens
ttgttcccttcct

SEQ ID NO: 938863 - DNA, 23 bp, Homo sapiens
ttgttcccttcctcttcctgccc

SEQ ID NO: 938864 - DNA, 12 bp, Homo sapiens
ttgttcctcagc

SEQ ID NO: 938865 - DNA, 17 bp, Homo sapiens
ttgttcgggtgtgcaat

SEQ ID NO: 938866 - DNA, 15 bp, Homo sapiens
ttgttctagtactgt

SEQ ID NO: 938867 - DNA, 16 bp, Homo sapiens
ttgttctagttttcag

SEQ ID NO: 938868 - DNA, 13 bp, Homo sapiens
ttgttctattttt

SEQ ID NO: 938869 - DNA, 19 bp, Homo sapiens
ttgttctatttttcaatca

SEQ ID NO: 938870 - DNA, 16 bp, Homo sapiens
ttgttctcagaatccc

SEQ ID NO: 938871 - DNA, 15 bp, Homo sapiens
ttgttctctgggaga

SEQ ID NO: 938872 - DNA, 12 bp, Homo sapiens
ttgttctgaggg

SEQ ID NO: 938873 - DNA, 13 bp, Homo sapiens
ttgttctgagggg

SEQ ID NO: 938874 - DNA, 17 bp, Homo sapiens
ttgttctgttaactgaa

SEQ ID NO: 938875 - DNA, 13 bp, Homo sapiens
ttgttctgttcct

SEQ ID NO: 938876 - DNA, 12 bp, Homo sapiens
ttgttcttacag

SEQ ID NO: 938877 - DNA, 18 bp, Homo sapiens
ttgttcttattctggcat

SEQ ID NO: 938878 - DNA, 12 bp, Homo sapiens
ttgttcttggtt

SEQ ID NO: 938879 - DNA, 17 bp, Homo sapiens
ttgttcttggtttgtaa

SEQ ID NO: 938880 - DNA, 14 bp, Homo sapiens
ttgttctttaaagt

SEQ ID NO: 938881 - DNA, 13 bp, Homo sapiens
ttgttctttagag

SEQ ID NO: 938882 - DNA, 16 bp, Homo sapiens
ttgttgaaaaagtttg

SEQ ID NO: 938883 - DNA, 15 bp, Homo sapiens
ttgttgaaaatggtt

SEQ ID NO: 938884 - DNA, 21 bp, Homo sapiens
ttgttgaaaatggtttcaagt

SEQ ID NO: 938885 - DNA, 17 bp, Homo sapiens
ttgttgaacaggtgttt

SEQ ID NO: 938886 - DNA, 14 bp, Homo sapiens
ttgttgaagtttga

SEQ ID NO: 938887 - DNA, 15 bp, Homo sapiens
ttgttgacagcaaaa

SEQ ID NO: 938888 - DNA, 17 bp, Homo sapiens
ttgttgacagcaaaatg

SEQ ID NO: 938889 - DNA, 19 bp, Homo sapiens
ttgttgacagcaaaatgtt

SEQ ID NO: 938890 - DNA, 23 bp, Homo sapiens
ttgttgacagcaaaatgttgaag

SEQ ID NO: 938891 - DNA, 12 bp, Homo sapiens
ttgttgacatta

SEQ ID NO: 938892 - DNA, 15 bp, Homo sapiens
ttgttgacattctga

SEQ ID NO: 938893 - DNA, 16 bp, Homo sapiens
ttgttgacattctgaa

SEQ ID NO: 938894 - DNA, 18 bp, Homo sapiens
ttgttgaccattttgtta

SEQ ID NO: 938895 - DNA, 14 bp, Homo sapiens
ttgttgacttattt

SEQ ID NO: 938896 - DNA, 22 bp, Homo sapiens
ttgttgagcatgacagcctgca

SEQ ID NO: 938897 - DNA, 17 bp, Homo sapiens
ttgttgaggttaagttt

SEQ ID NO: 938898 - DNA, 22 bp, Homo sapiens
ttgttgatattttcccttttta

SEQ ID NO: 938899 - DNA, 23 bp, Homo sapiens
ttgttgatattttccctttttaa

SEQ ID NO: 938900 - DNA, 18 bp, Homo sapiens
ttgttgcaagatgtgaat

SEQ ID NO: 938901 - DNA, 20 bp, Homo sapiens
ttgttgcaagatgtgaatta

SEQ ID NO: 938902 - DNA, 11 bp, Homo sapiens
ttgttgcactg

SEQ ID NO: 938903 - DNA, 14 bp, Homo sapiens
ttgttgccttttca

SEQ ID NO: 938904 - DNA, 13 bp, Homo sapiens
ttgttggaatgaa

SEQ ID NO: 938905 - DNA, 20 bp, Homo sapiens
ttgttggagtgtttctaata

SEQ ID NO: 938906 - DNA, 19 bp, Homo sapiens
ttgttggcccttccagtgg

SEQ ID NO: 938907 - DNA, 22 bp, Homo sapiens
ttgttgggattcctgacccagg

SEQ ID NO: 938908 - DNA, 18 bp, Homo sapiens
ttgttggtagcatgtact

SEQ ID NO: 938909 - DNA, 14 bp, Homo sapiens
ttgttggtcagagg

SEQ ID NO: 938910 - DNA, 18 bp, Homo sapiens
ttgttggtgaattttcaa

SEQ ID NO: 938911 - DNA, 19 bp, Homo sapiens
ttgttggttgattgtttaa

SEQ ID NO: 938912 - DNA, 23 bp, Homo sapiens
ttgttgtagattgattgtattgt

SEQ ID NO: 938913 - DNA, 17 bp, Homo sapiens
ttgttgtcattgtccag

SEQ ID NO: 938914 - DNA, 16 bp, Homo sapiens
ttgttgtcccaatgaa

SEQ ID NO: 938915 - DNA, 14 bp, Homo sapiens
ttgttgtccttttc

SEQ ID NO: 938916 - DNA, 13 bp, Homo sapiens
ttgttgtgtgtat

SEQ ID NO: 938917 - DNA, 14 bp, Homo sapiens
ttgttgtgtgtata

SEQ ID NO: 938918 - DNA, 22 bp, Homo sapiens
ttgttgtgtgtatatgtattta

SEQ ID NO: 938919 - DNA, 15 bp, Homo sapiens
ttgttgtgtgtgcag

SEQ ID NO: 938920 - DNA, 21 bp, Homo sapiens
ttgttgttctgttaactgaat

SEQ ID NO: 938921 - DNA, 16 bp, Homo sapiens
ttgtttaaaattcagt

SEQ ID NO: 938922 - DNA, 14 bp, Homo sapiens
ttgtttaaaattct

SEQ ID NO: 938923 - DNA, 16 bp, Homo sapiens
ttgtttaaacccaagt

SEQ ID NO: 938924 - DNA, 22 bp, Homo sapiens
ttgtttaaacccaagtgctgca

SEQ ID NO: 938925 - DNA, 20 bp, Homo sapiens
ttgtttaaatataaatgttt

SEQ ID NO: 938926 - DNA, 13 bp, Homo sapiens
ttgtttaaatgcc

SEQ ID NO: 938927 - DNA, 14 bp, Homo sapiens
ttgtttaacaaaag

SEQ ID NO: 938928 - DNA, 23 bp, Homo sapiens
ttgtttaacacttctgtatgcat

SEQ ID NO: 938929 - DNA, 12 bp, Homo sapiens
ttgtttacaaac

SEQ ID NO: 938930 - DNA, 22 bp, Homo sapiens
ttgtttacagcactactctgtg

SEQ ID NO: 938931 - DNA, 17 bp, Homo sapiens
ttgtttatgccaaatgt

SEQ ID NO: 938932 - DNA, 20 bp, Homo sapiens
ttgtttatgtgttatgaaca

SEQ ID NO: 938933 - DNA, 16 bp, Homo sapiens
ttgtttcactccacca

SEQ ID NO: 938934 - DNA, 11 bp, Homo sapiens
ttgtttcagtg

SEQ ID NO: 938935 - DNA, 23 bp, Homo sapiens
ttgtttcctcccctatctgtatt

SEQ ID NO: 938936 - DNA, 21 bp, Homo sapiens
ttgtttcctcttccaaagtaa

SEQ ID NO: 938937 - DNA, 16 bp, Homo sapiens
ttgtttcgtggggagg

SEQ ID NO: 938938 - DNA, 16 bp, Homo sapiens
ttgtttctccccctgg

SEQ ID NO: 938939 - DNA, 23 bp, Homo sapiens
ttgtttctctagcgctgagctat

SEQ ID NO: 938940 - DNA, 17 bp, Homo sapiens
ttgtttctctgttgtaa

SEQ ID NO: 938941 - DNA, 22 bp, Homo sapiens
ttgtttctgggtccctgctccc

SEQ ID NO: 938942 - DNA, 19 bp, Homo sapiens
ttgtttctgtcaagcatat

SEQ ID NO: 938943 - DNA, 14 bp, Homo sapiens
ttgtttctgtttct

SEQ ID NO: 938944 - DNA, 15 bp, Homo sapiens
ttgtttcttaaataa

SEQ ID NO: 938945 - DNA, 19 bp, Homo sapiens
ttgtttcttccaaagcaca

SEQ ID NO: 938946 - DNA, 12 bp, Homo sapiens
ttgtttcttctt

SEQ ID NO: 938947 - DNA, 18 bp, Homo sapiens
ttgtttcttcttttcctt

SEQ ID NO: 938948 - DNA, 16 bp, Homo sapiens
ttgtttctttctctga

SEQ ID NO: 938949 - DNA, 20 bp, Homo sapiens
ttgtttctttctctgaggac

SEQ ID NO: 938950 - DNA, 15 bp, Homo sapiens
ttgtttgaatatttg

SEQ ID NO: 938951 - DNA, 16 bp, Homo sapiens
ttgtttgaatatttgt

SEQ ID NO: 938952 - DNA, 19 bp, Homo sapiens
ttgtttgaccccagtttct

SEQ ID NO: 938953 - DNA, 18 bp, Homo sapiens
ttgtttgcttaatttcct

SEQ ID NO: 938954 - DNA, 20 bp, Homo sapiens
ttgtttggactgttttcaat

SEQ ID NO: 938955 - DNA, 22 bp, Homo sapiens
ttgtttggaggagcaaagttaa

SEQ ID NO: 938956 - DNA, 16 bp, Homo sapiens
ttgtttggcaaggaaa

SEQ ID NO: 938957 - DNA, 16 bp, Homo sapiens
ttgtttgggtatcctg

SEQ ID NO: 938958 - DNA, 13 bp, Homo sapiens
ttgtttgtaaata

SEQ ID NO: 938959 - DNA, 22 bp, Homo sapiens
ttgtttgtaaataagagatttg

SEQ ID NO: 938960 - DNA, 19 bp, Homo sapiens
ttgtttgtatgtataattc

SEQ ID NO: 938961 - DNA, 13 bp, Homo sapiens
ttgtttgtttcaa

SEQ ID NO: 938962 - DNA, 21 bp, Homo sapiens
ttgtttgtttctccccctggg

SEQ ID NO: 938963 - DNA, 14 bp, Homo sapiens
ttgtttgtttcttt

SEQ ID NO: 938964 - DNA, 20 bp, Homo sapiens
ttgttttaaaattaaagcta

SEQ ID NO: 938965 - DNA, 21 bp, Homo sapiens
ttgttttaatctactttttgt

SEQ ID NO: 938966 - DNA, 13 bp, Homo sapiens
ttgttttacaata

SEQ ID NO: 938967 - DNA, 16 bp, Homo sapiens
ttgttttagaaccagc

SEQ ID NO: 938968 - DNA, 16 bp, Homo sapiens
ttgttttatatacctg

SEQ ID NO: 938969 - DNA, 23 bp, Homo sapiens
ttgttttccctttaaagcctttt

SEQ ID NO: 938970 - DNA, 17 bp, Homo sapiens
ttgttttctaagatgtt

SEQ ID NO: 938971 - DNA, 17 bp, Homo sapiens
ttgttttctgactaatt

SEQ ID NO: 938972 - DNA, 20 bp, Homo sapiens
ttgttttcttctgtatgtta

SEQ ID NO: 938973 - DNA, 14 bp, Homo sapiens
ttgttttgaaaata

SEQ ID NO: 938974 - DNA, 13 bp, Homo sapiens
ttgttttgaaagt

SEQ ID NO: 938975 - DNA, 14 bp, Homo sapiens
ttgtgactgaaggg

SEQ ID NO: 938976 - DNA, 16 bp, Homo sapiens
ttgtgacttacaattt

SEQ ID NO: 938977 - DNA, 17 bp, Homo sapiens
ttgtgacttcactgtat

SEQ ID NO: 938978 - DNA, 17 bp, Homo sapiens
ttgtgagccctctaggg

SEQ ID NO: 938979 - DNA, 12 bp, Homo sapiens
ttgtgagctgga

SEQ ID NO: 938980 - DNA, 20 bp, Homo sapiens
ttgtgaggcccatggttgag

SEQ ID NO: 938981 - DNA, 16 bp, Homo sapiens
ttgtgagggacatgct

SEQ ID NO: 938982 - DNA, 20 bp, Homo sapiens
ttgtgatacaatgctgtgcc

SEQ ID NO: 938983 - DNA, 16 bp, Homo sapiens
ttgtgatagcactttc

SEQ ID NO: 938984 - DNA, 20 bp, Homo sapiens
ttgtgatagctaacatttta

SEQ ID NO: 938985 - DNA, 17 bp, Homo sapiens
ttgtgatattaaatttc

SEQ ID NO: 938986 - DNA, 11 bp, Homo sapiens
ttgtgatgaac

SEQ ID NO: 938987 - DNA, 22 bp, Homo sapiens
ttgtgatgaatcaatgaaaaat

SEQ ID NO: 938988 - DNA, 22 bp, Homo sapiens
ttgtgattacgtgtatgtttct

SEQ ID NO: 938989 - DNA, 19 bp, Homo sapiens
ttgtgattagacagaacac

SEQ ID NO: 938990 - DNA, 18 bp, Homo sapiens
ttgtgattatttcacttt

SEQ ID NO: 938991 - DNA, 23 bp, Homo sapiens
ttgtgattcaatctgtaaactgt

SEQ ID NO: 938992 - DNA, 16 bp, Homo sapiens
ttgtgattctgtttat

SEQ ID NO: 938993 - DNA, 15 bp, Homo sapiens
ttgtgattggcctgt

SEQ ID NO: 938994 - DNA, 16 bp, Homo sapiens
ttgtgattggcctgta

SEQ ID NO: 938995 - DNA, 16 bp, Homo sapiens
ttgtgatttttgtaat

SEQ ID NO: 938996 - DNA, 16 bp, Homo sapiens
ttgtgcaaacataata

SEQ ID NO: 938997 - DNA, 17 bp, Homo sapiens
ttgtgcaatgtaaatat

SEQ ID NO: 938998 - DNA, 22 bp, Homo sapiens
ttgtgcaatgtaaatattttaa

SEQ ID NO: 938999 - DNA, 16 bp, Homo sapiens
ttgttttgaaagttta

SEQ ID NO: 939000 - DNA, 17 bp, Homo sapiens
ttgttttgaaagtttaa

SEQ ID NO: 939001 - DNA, 17 bp, Homo sapiens
ttgttttgagctttcca

SEQ ID NO: 939002 - DNA, 16 bp, Homo sapiens
ttgttttgcacttttt

SEQ ID NO: 939003 - DNA, 14 bp, Homo sapiens
ttgttttgcttttg

SEQ ID NO: 939004 - DNA, 13 bp, Homo sapiens
ttgttttgtattg

SEQ ID NO: 939005 - DNA, 16 bp, Homo sapiens
ttgttttgtgtttcat

SEQ ID NO: 939006 - DNA, 16 bp, Homo sapiens
ttgttttgttttttgg

SEQ ID NO: 939007 - DNA, 17 bp, Homo sapiens
ttgtttttaatctcctg

SEQ ID NO: 939008 - DNA, 12 bp, Homo sapiens
ttgtttttcatt

SEQ ID NO: 939009 - DNA, 22 bp, Homo sapiens
ttgtttttgagtactgtactat

SEQ ID NO: 939010 - DNA, 13 bp, Homo sapiens
ttgtttttgtaat

SEQ ID NO: 939011 - DNA, 15 bp, Homo sapiens
ttgttttttaaagca

SEQ ID NO: 939012 - DNA, 17 bp, Homo sapiens
ttgttttttcaaaatag

SEQ ID NO: 939013 - DNA, 15 bp, Homo sapiens
ttgttttttgtaact

SEQ ID NO: 939014 - DNA, 18 bp, Homo sapiens
tttaaaaaaaaagtcaga

SEQ ID NO: 939015 - DNA, 14 bp, Homo sapiens
tttaaaaaaactga

SEQ ID NO: 939016 - DNA, 15 bp, Homo sapiens
tttaaaaaaactgaa

SEQ ID NO: 939017 - DNA, 11 bp, Homo sapiens
tttaaaaaaca

SEQ ID NO: 939018 - DNA, 14 bp, Homo sapiens
tttaaaaaactaaa

SEQ ID NO: 939019 - DNA, 15 bp, Homo sapiens
tttaaaaaagactga

SEQ ID NO: 939020 - DNA, 18 bp, Homo sapiens
tttaaaaaagactgaaca

SEQ ID NO: 939021 - DNA, 22 bp, Homo sapiens
tttaaaaaagactgaacatgtt

SEQ ID NO: 939022 - DNA, 22 bp, Homo sapiens
tttaaaaaagcctggtttttct

SEQ ID NO: 939023 - DNA, 14 bp, Homo sapiens
tttaaaaaagctta

SEQ ID NO: 939024 - DNA, 17 bp, Homo sapiens
tttaaaaaagcttaaaa

SEQ ID NO: 939025 - DNA, 20 bp, Homo sapiens
tttaaaaaataccattgaaa

SEQ ID NO: 939026 - DNA, 14 bp, Homo sapiens
tttaaaaaatattt

SEQ ID NO: 939027 - DNA, 18 bp, Homo sapiens
tttaaaaaatattttaag

SEQ ID NO: 939028 - DNA, 20 bp, Homo sapiens
tttaaaaaatattttaagaa

SEQ ID NO: 939029 - DNA, 17 bp, Homo sapiens
tttaaaaaatattttct

SEQ ID NO: 939030 - DNA, 19 bp, Homo sapiens
tttaaaaaatcaatcaatg

SEQ ID NO: 939031 - DNA, 21 bp, Homo sapiens
tttaaaaaatcaatcaatggt

SEQ ID NO: 939032 - DNA, 16 bp, Homo sapiens
tttaaaaaatggtcac

SEQ ID NO: 939033 - DNA, 22 bp, Homo sapiens
tttaaaaaattaaaaatgaaaa

SEQ ID NO: 939034 - DNA, 19 bp, Homo sapiens
tttaaaaacatagaaaaat

SEQ ID NO: 939035 - DNA, 19 bp, Homo sapiens
tttaaaaaccgaataaatg

SEQ ID NO: 939036 - DNA, 13 bp, Homo sapiens
tttaaaaactgga

SEQ ID NO: 939037 - DNA, 13 bp, Homo sapiens
tttaaaaacttgt

SEQ ID NO: 939038 - DNA, 13 bp, Homo sapiens
tttaaaaagcaaa

SEQ ID NO: 939039 - DNA, 14 bp, Homo sapiens
tttaaaaagccagt

SEQ ID NO: 939040 - DNA, 21 bp, Homo sapiens
tttaaaaagctcactgctgat

SEQ ID NO: 939041 - DNA, 18 bp, Homo sapiens
tttaaaaaggaaatttgt

SEQ ID NO: 939042 - DNA, 20 bp, Homo sapiens
tttaaaaagggaagaaactg

SEQ ID NO: 939043 - DNA, 23 bp, Homo sapiens
tttaaaaagtaagttaataatgt

SEQ ID NO: 939044 - DNA, 15 bp, Homo sapiens
tttaaaaagtcttca

SEQ ID NO: 939045 - DNA, 11 bp, Homo sapiens
tttaaaaataa

SEQ ID NO: 939046 - DNA, 18 bp, Homo sapiens
tttaaaaataagtcaaca

SEQ ID NO: 939047 - DNA, 23 bp, Homo sapiens
tttaaaaataccaatcacaagga

SEQ ID NO: 939048 - DNA, 17 bp, Homo sapiens
tttaaaaatagacactc

SEQ ID NO: 939049 - DNA, 15 bp, Homo sapiens
tttaaaaatatatat

SEQ ID NO: 939050 - DNA, 12 bp, Homo sapiens
tttaaaaatatt

SEQ ID NO: 939051 - DNA, 20 bp, Homo sapiens
tttaaaaatggtatcaaaat

SEQ ID NO: 939052 - DNA, 22 bp, Homo sapiens
tttaaaaatggtatcaaaatta

SEQ ID NO: 939053 - DNA, 12 bp, Homo sapiens
tttaaaaattgt

SEQ ID NO: 939054 - DNA, 12 bp, Homo sapiens
tttaaaacaaaa

SEQ ID NO: 939055 - DNA, 15 bp, Homo sapiens
tttaaaacagacact

SEQ ID NO: 939056 - DNA, 12 bp, Homo sapiens
tttaaaacattt

SEQ ID NO: 939057 - DNA, 15 bp, Homo sapiens
tttaaaaccagttac

SEQ ID NO: 939058 - DNA, 17 bp, Homo sapiens
tttaaaaccagttaccc

SEQ ID NO: 939059 - DNA, 20 bp, Homo sapiens
tttaaaactagttagattca

SEQ ID NO: 939060 - DNA, 23 bp, Homo sapiens
tttaaaactcagaatataacatg

SEQ ID NO: 939061 - DNA, 12 bp, Homo sapiens
tttaaaactgaa

SEQ ID NO: 939062 - DNA, 15 bp, Homo sapiens
tttaaaactgttgga

SEQ ID NO: 939063 - DNA, 14 bp, Homo sapiens
tttaaaagcatgaa

SEQ ID NO: 939064 - DNA, 14 bp, Homo sapiens
tttaaaagcatttt

SEQ ID NO: 939065 - DNA, 11 bp, Homo sapiens
tttaaaaggca

SEQ ID NO: 939066 - DNA, 22 bp, Homo sapiens
tttaaaaggtattttgaatacc

SEQ ID NO: 939067 - DNA, 13 bp, Homo sapiens
tttaaaagtaaaa

SEQ ID NO: 939068 - DNA, 22 bp, Homo sapiens
tttaaaagttgtgcatgtatgt

SEQ ID NO: 939069 - DNA, 20 bp, Homo sapiens
tttaaaagtttcaatgtgat

SEQ ID NO: 939070 - DNA, 19 bp, Homo sapiens
tttaaaataaaatgaaaat

SEQ ID NO: 939071 - DNA, 22 bp, Homo sapiens
tttaaaataaaatgaaaattgt

SEQ ID NO: 939072 - DNA, 14 bp, Homo sapiens
tttaaaataaagag

SEQ ID NO: 939073 - DNA, 17 bp, Homo sapiens
tttaaaataaattccta

SEQ ID NO: 939074 - DNA, 19 bp, Homo sapiens
tttaaaataaattcctaca

SEQ ID NO: 939075 - DNA, 24 bp, Homo sapiens
tttaaaataaattcctacaactta

SEQ ID NO: 939076 - DNA, 18 bp, Homo sapiens
tttaaaataagctttctc

SEQ ID NO: 939077 - DNA, 13 bp, Homo sapiens
tttaaaatagaaa

SEQ ID NO: 939078 - DNA, 23 bp, Homo sapiens
tttaaaatagcgttcttgtaatt

SEQ ID NO: 939079 - DNA, 14 bp, Homo sapiens
tttaaaatatttaa

SEQ ID NO: 939080 - DNA, 20 bp, Homo sapiens
tttaaaatatttgaatgaaa

SEQ ID NO: 939081 - DNA, 21 bp, Homo sapiens
tttaaaatatttgaatgaaaa

SEQ ID NO: 939082 - DNA, 17 bp, Homo sapiens
tttaaaatccattttag

SEQ ID NO: 939083 - DNA, 20 bp, Homo sapiens
tttaaagtatttataaaaat

SEQ ID NO: 939084 - DNA, 17 bp, Homo sapiens
tttaaagtgattaaacg

SEQ ID NO: 939085 - DNA, 18 bp, Homo sapiens
tttaaagtgattaaacgt

SEQ ID NO: 939086 - DNA, 19 bp, Homo sapiens
tttaaagtgcagtcatttg

SEQ ID NO: 939087 - DNA, 18 bp, Homo sapiens
tttaaagtggcaatctca

SEQ ID NO: 939088 - DNA, 19 bp, Homo sapiens
tttaaagtgtttctgttat

SEQ ID NO: 939089 - DNA, 20 bp, Homo sapiens
tttaaagtgtttctgttatt

SEQ ID NO: 939090 - DNA, 13 bp, Homo sapiens
tttaaagttctta

SEQ ID NO: 939091 - DNA, 20 bp, Homo sapiens
tttaaagttcttattttagt

SEQ ID NO: 939092 - DNA, 23 bp, Homo sapiens
tttaaagttcttattttagtata

SEQ ID NO: 939093 - DNA, 17 bp, Homo sapiens
tttaaagtttaatgcct

SEQ ID NO: 939094 - DNA, 22 bp, Homo sapiens
tttaaataaaactttccaaata

SEQ ID NO: 939095 - DNA, 19 bp, Homo sapiens
tttaaataaaagcacaagt

SEQ ID NO: 939096 - DNA, 19 bp, Homo sapiens
tttaaataaaagtgatcaa

SEQ ID NO: 939097 - DNA, 14 bp, Homo sapiens
tttaaataaaatca

SEQ ID NO: 939098 - DNA, 16 bp, Homo sapiens
tttaaataaaatcacc

SEQ ID NO: 939099 - DNA, 13 bp, Homo sapiens
tttaaataaagta

SEQ ID NO: 939100 - DNA, 23 bp, Homo sapiens
tttaaataaagtatcatgcattc

SEQ ID NO: 939101 - DNA, 17 bp, Homo sapiens
tttaaataacctctggc

SEQ ID NO: 939102 - DNA, 21 bp, Homo sapiens
tttaaataacctctggccctt

SEQ ID NO: 939103 - DNA, 20 bp, Homo sapiens
tttaaatacagtcttccatt

SEQ ID NO: 939104 - DNA, 15 bp, Homo sapiens
tttaaatagcctaaa

SEQ ID NO: 939105 - DNA, 13 bp, Homo sapiens
tttaaatataatt

SEQ ID NO: 939106 - DNA, 13 bp, Homo sapiens
tttaaatatatat

SEQ ID NO: 939107 - DNA, 19 bp, Homo sapiens
tttaaatattttctatttt

SEQ ID NO: 939108 - DNA, 11 bp, Homo sapiens
tttaaatcatc

SEQ ID NO: 939109 - DNA, 16 bp, Homo sapiens
tttaaatcatgtatgt

SEQ ID NO: 939110 - DNA, 21 bp, Homo sapiens
tttaaatcatgtatgttatga

SEQ ID NO: 939111 - DNA, 14 bp, Homo sapiens
tttaaatctgtgat

SEQ ID NO: 939112 - DNA, 17 bp, Homo sapiens
tttaaatgaaaggagtt

SEQ ID NO: 939113 - DNA, 18 bp, Homo sapiens
tttaaatgatatttaggt

SEQ ID NO: 939114 - DNA, 17 bp, Homo sapiens
tttaaatgatcatgaaa

SEQ ID NO: 939115 - DNA, 16 bp, Homo sapiens
tttaaatgattccaaa

SEQ ID NO: 939116 - DNA, 19 bp, Homo sapiens
tttaaatgattccaaataa

SEQ ID NO: 939117 - DNA, 17 bp, Homo sapiens
tttaaatgcatgtctta

SEQ ID NO: 939118 - DNA, 18 bp, Homo sapiens
tttaaatgcatgtcttaa

SEQ ID NO: 939119 - DNA, 12 bp, Homo sapiens
tttaaatgccaa

SEQ ID NO: 939120 - DNA, 13 bp, Homo sapiens
tttaaatgccaaa

SEQ ID NO: 939121 - DNA, 14 bp, Homo sapiens
tttaaatgtatact

SEQ ID NO: 939122 - DNA, 15 bp, Homo sapiens
tttaaatgtatacta

SEQ ID NO: 939123 - DNA, 19 bp, Homo sapiens
tttaaatgtgtacaatgta

SEQ ID NO: 939124 - DNA, 23 bp, Homo sapiens
tttaaatgtgtacaatgtacaca

SEQ ID NO: 939125 - DNA, 17 bp, Homo sapiens
tttaaatgttctaacag

SEQ ID NO: 939126 - DNA, 14 bp, Homo sapiens
tttaaattagaaaa

SEQ ID NO: 939127 - DNA, 21 bp, Homo sapiens
tttaaattcacaatagaaact

SEQ ID NO: 939128 - DNA, 20 bp, Homo sapiens
tttaaattggtcatggtaga

SEQ ID NO: 939129 - DNA, 18 bp, Homo sapiens
tttaaattttacccttta

SEQ ID NO: 939130 - DNA, 16 bp, Homo sapiens
tttaaattttattatt

SEQ ID NO: 939131 - DNA, 16 bp, Homo sapiens
tttaacaaaaaatgta

SEQ ID NO: 939132 - DNA, 15 bp, Homo sapiens
tttaacaaaagcaag

SEQ ID NO: 939133 - DNA, 22 bp, Homo sapiens
tttaacaaacgcattaagaggt

SEQ ID NO: 939134 - DNA, 20 bp, Homo sapiens
tttaacaaatgactgtatct

SEQ ID NO: 939135 - DNA, 20 bp, Homo sapiens
tttaacaataactactgtgt

SEQ ID NO: 939136 - DNA, 21 bp, Homo sapiens
tttaacaataactactgtgtt

SEQ ID NO: 939137 - DNA, 23 bp, Homo sapiens
tttaacaataactactgtgttcc

SEQ ID NO: 939138 - DNA, 14 bp, Homo sapiens
tttaacacttaaat

SEQ ID NO: 939139 - DNA, 17 bp, Homo sapiens
tttaacacttaaatttc

SEQ ID NO: 939140 - DNA, 18 bp, Homo sapiens
tttaacactttgtattac

SEQ ID NO: 939141 - DNA, 19 bp, Homo sapiens
tttaacagaaattgtatat

SEQ ID NO: 939142 - DNA, 20 bp, Homo sapiens
tttaacagctgaattatcta

SEQ ID NO: 939143 - DNA, 17 bp, Homo sapiens
tttaacagtcatttaaa

SEQ ID NO: 939144 - DNA, 11 bp, Homo sapiens
tttaacatctt

SEQ ID NO: 939145 - DNA, 23 bp, Homo sapiens
tttaacatgaacacccttagaaa

SEQ ID NO: 939146 - DNA, 17 bp, Homo sapiens
tttaacatgatttcaaa

SEQ ID NO: 939147 - DNA, 17 bp, Homo sapiens
tttaacattcacagccc

SEQ ID NO: 939148 - DNA, 16 bp, Homo sapiens
tttaacattgtttttg

SEQ ID NO: 939149 - DNA, 13 bp, Homo sapiens
tttaacatttgcc

SEQ ID NO: 939150 - DNA, 19 bp, Homo sapiens
tttaaccaaaacatgtctc

SEQ ID NO: 939151 - DNA, 21 bp, Homo sapiens
tttaaccacagtgaaagttga

SEQ ID NO: 939152 - DNA, 17 bp, Homo sapiens
tttaaccattttaacct

SEQ ID NO: 939153 - DNA, 17 bp, Homo sapiens
tttaacccccctgtaca

SEQ ID NO: 939154 - DNA, 21 bp, Homo sapiens
tttaaccctcctgggcccaag

SEQ ID NO: 939155 - DNA, 16 bp, Homo sapiens
tttaacctatgatatt

SEQ ID NO: 939156 - DNA, 21 bp, Homo sapiens
tttaacctgccaacatacttt

SEQ ID NO: 939157 - DNA, 18 bp, Homo sapiens
tttaacctgttttgttaa

SEQ ID NO: 939158 - DNA, 22 bp, Homo sapiens
tttaacgaatgaagatgtctaa

SEQ ID NO: 939159 - DNA, 14 bp, Homo sapiens
tttaacgctgccta

SEQ ID NO: 939160 - DNA, 18 bp, Homo sapiens
tttaatctaaaatgattg

SEQ ID NO: 939161 - DNA, 22 bp, Homo sapiens
tttaatctactttttgtattta

SEQ ID NO: 939162 - DNA, 13 bp, Homo sapiens
tttaatcttcagt

SEQ ID NO: 939163 - DNA, 17 bp, Homo sapiens
tttaatctttgtgacag

SEQ ID NO: 939164 - DNA, 16 bp, Homo sapiens
tttaatgaaagactgt

SEQ ID NO: 939165 - DNA, 21 bp, Homo sapiens
tttaatgaaagactgtacaaa

SEQ ID NO: 939166 - DNA, 15 bp, Homo sapiens
tttaatgaacaaatg

SEQ ID NO: 939167 - DNA, 15 bp, Homo sapiens
tttaatgagaaaaaa

SEQ ID NO: 939168 - DNA, 17 bp, Homo sapiens
tttaatgcttcattcaa

SEQ ID NO: 939169 - DNA, 19 bp, Homo sapiens
tttaatggactgtgaattt

SEQ ID NO: 939170 - DNA, 20 bp, Homo sapiens
tttaatggatatttctcagc

SEQ ID NO: 939171 - DNA, 14 bp, Homo sapiens
tttaatggcagcta

SEQ ID NO: 939172 - DNA, 22 bp, Homo sapiens
tttaatggccggctggaaatgc

SEQ ID NO: 939173 - DNA, 22 bp, Homo sapiens
tttaatgggggtagcagctgga

SEQ ID NO: 939174 - DNA, 21 bp, Homo sapiens
tttaatgtaatagggaaaatt

SEQ ID NO: 939175 - DNA, 18 bp, Homo sapiens
tttaatgtatagtaaatc

SEQ ID NO: 939176 - DNA, 16 bp, Homo sapiens
tttaatgtatctattt

SEQ ID NO: 939177 - DNA, 22 bp, Homo sapiens
tttaatgtatctatttgtacaa

SEQ ID NO: 939178 - DNA, 17 bp, Homo sapiens
tttaatgtttattattt

SEQ ID NO: 939179 - DNA, 12 bp, Homo sapiens
tttaatgtttga

SEQ ID NO: 939180 - DNA, 13 bp, Homo sapiens
tttaatgttttct

SEQ ID NO: 939181 - DNA, 17 bp, Homo sapiens
tttaatgttttctgctg

SEQ ID NO: 939182 - DNA, 22 bp, Homo sapiens
tttaatgttttctgctgtttaa

SEQ ID NO: 939183 - DNA, 16 bp, Homo sapiens
tttaatgtttttttgt

SEQ ID NO: 939184 - DNA, 19 bp, Homo sapiens
tttaattaagcagaaacag

SEQ ID NO: 939185 - DNA, 20 bp, Homo sapiens
tttaattaattgggccagct

SEQ ID NO: 939186 - DNA, 21 bp, Homo sapiens
tttaattatgaaaactagcat

SEQ ID NO: 939187 - DNA, 14 bp, Homo sapiens
tttaattattattc

SEQ ID NO: 939188 - DNA, 12 bp, Homo sapiens
tttaattatttt

SEQ ID NO: 939189 - DNA, 14 bp, Homo sapiens
tttaattcagtaca

SEQ ID NO: 939190 - DNA, 14 bp, Homo sapiens
tttaattcatgttt

SEQ ID NO: 939191 - DNA, 23 bp, Homo sapiens
tttaattcatgtttcttaaatgg

SEQ ID NO: 939192 - DNA, 12 bp, Homo sapiens
tttaattctctc

SEQ ID NO: 939193 - DNA, 20 bp, Homo sapiens
tttaattctgtcttgttcat

SEQ ID NO: 939194 - DNA, 19 bp, Homo sapiens
tttaattgctttgaagcat

SEQ ID NO: 939195 - DNA, 22 bp, Homo sapiens
tttaattgtagttctgtgtact

SEQ ID NO: 939196 - DNA, 12 bp, Homo sapiens
tttaattgtata

SEQ ID NO: 939197 - DNA, 13 bp, Homo sapiens
tttaattgtataa

SEQ ID NO: 939198 - DNA, 15 bp, Homo sapiens
tttaattgtataagt

SEQ ID NO: 939199 - DNA, 18 bp, Homo sapiens
tttaatttagtaaatgtt

SEQ ID NO: 939200 - DNA, 21 bp, Homo sapiens
tttaatttattaattgctttg

SEQ ID NO: 939201 - DNA, 16 bp, Homo sapiens
tttaatttatttatta

SEQ ID NO: 939202 - DNA, 13 bp, Homo sapiens
tttaatttcagga

SEQ ID NO: 939203 - DNA, 16 bp, Homo sapiens
tttaatttcaggaaaa

SEQ ID NO: 939204 - DNA, 14 bp, Homo sapiens
tttaatttccaaaa

SEQ ID NO: 939205 - DNA, 21 bp, Homo sapiens
tttaatttccaaaataatcta

SEQ ID NO: 939206 - DNA, 17 bp, Homo sapiens
tttaatttgtaataaaa

SEQ ID NO: 939207 - DNA, 15 bp, Homo sapiens
tttaattttaatgct

SEQ ID NO: 939208 - DNA, 17 bp, Homo sapiens
tttaattttaatgctgt

SEQ ID NO: 939209 - DNA, 14 bp, Homo sapiens
tttaattttcactt

SEQ ID NO: 939210 - DNA, 15 bp, Homo sapiens
tttaattttgacact

SEQ ID NO: 939211 - DNA, 22 bp, Homo sapiens
tttaattttgatatacattgtg

SEQ ID NO: 939212 - DNA, 19 bp, Homo sapiens
tttacaaaactacatgaga

SEQ ID NO: 939213 - DNA, 16 bp, Homo sapiens
tttacaaaactgcttt

SEQ ID NO: 939214 - DNA, 14 bp, Homo sapiens
tttacctagagaac

SEQ ID NO: 939215 - DNA, 18 bp, Homo sapiens
tttacctccccttttcta

SEQ ID NO: 939216 - DNA, 15 bp, Homo sapiens
tttacctgtgaaata

SEQ ID NO: 939217 - DNA, 14 bp, Homo sapiens
tttaccttctaaaa

SEQ ID NO: 939218 - DNA, 19 bp, Homo sapiens
tttaccttctaaaagccat

SEQ ID NO: 939219 - DNA, 17 bp, Homo sapiens
tttaccttttctgttgt

SEQ ID NO: 939220 - DNA, 19 bp, Homo sapiens
tttaccttttttatacata

SEQ ID NO: 939221 - DNA, 21 bp, Homo sapiens
tttaccttttttatacataaa

SEQ ID NO: 939222 - DNA, 14 bp, Homo sapiens
tttacgcaaggaag

SEQ ID NO: 939223 - DNA, 16 bp, Homo sapiens
tttacgtactgtaact

SEQ ID NO: 939224 - DNA, 13 bp, Homo sapiens
tttacgtgcaaac

SEQ ID NO: 939225 - DNA, 14 bp, Homo sapiens
tttacgtgcaaaca

SEQ ID NO: 939226 - DNA, 20 bp, Homo sapiens
tttactaagccacaagaaat

SEQ ID NO: 939227 - DNA, 19 bp, Homo sapiens
tttactaattttctagatt

SEQ ID NO: 939228 - DNA, 18 bp, Homo sapiens
tttactagggatccctca

SEQ ID NO: 939229 - DNA, 20 bp, Homo sapiens
tttactataagactataaat

SEQ ID NO: 939230 - DNA, 16 bp, Homo sapiens
tttactcagaatagct

SEQ ID NO: 939231 - DNA, 22 bp, Homo sapiens
tttactccaggttattgcaata

SEQ ID NO: 939232 - DNA, 21 bp, Homo sapiens
tttactccagtggtgaagaaa

SEQ ID NO: 939233 - DNA, 20 bp, Homo sapiens
tttactcccttcctggcctc

SEQ ID NO: 939234 - DNA, 19 bp, Homo sapiens
tttactctgtgtaaagact

SEQ ID NO: 939235 - DNA, 13 bp, Homo sapiens
tttactctgtgtt

SEQ ID NO: 939236 - DNA, 17 bp, Homo sapiens
tttactctttttctaaa

SEQ ID NO: 939237 - DNA, 14 bp, Homo sapiens
tttactgacaagaa

SEQ ID NO: 939238 - DNA, 21 bp, Homo sapiens
tttactgagcttctctgtgaa

SEQ ID NO: 939239 - DNA, 16 bp, Homo sapiens
tttactgcagctttgt

SEQ ID NO: 939240 - DNA, 16 bp, Homo sapiens
tttactgctctagaaa

SEQ ID NO: 939241 - DNA, 15 bp, Homo sapiens
tttactgctctgaga

SEQ ID NO: 939242 - DNA, 17 bp, Homo sapiens
tttactgctctgagaat

SEQ ID NO: 939243 - DNA, 18 bp, Homo sapiens
tttactgtaactgtcagt

SEQ ID NO: 939244 - DNA, 13 bp, Homo sapiens
tttactgtaatat

SEQ ID NO: 939245 - DNA, 23 bp, Homo sapiens
tttactgtaatataaagtattca

SEQ ID NO: 939246 - DNA, 14 bp, Homo sapiens
tttactgtttctca

SEQ ID NO: 939247 - DNA, 19 bp, Homo sapiens
tttactgtttctcaagtgt

SEQ ID NO: 939248 - DNA, 20 bp, Homo sapiens
tttactgttttgaaatcaat

SEQ ID NO: 939249 - DNA, 12 bp, Homo sapiens
tttacttaagac

SEQ ID NO: 939250 - DNA, 16 bp, Homo sapiens
tttacttctttggaat

SEQ ID NO: 939251 - DNA, 22 bp, Homo sapiens
tttactttaaagtagtgatgaa

SEQ ID NO: 939252 - DNA, 17 bp, Homo sapiens
tttactttcttcaccaa

SEQ ID NO: 939253 - DNA, 17 bp, Homo sapiens
tttactttgcatttctt

SEQ ID NO: 939254 - DNA, 18 bp, Homo sapiens
tttacttttaaacagtga

SEQ ID NO: 939255 - DNA, 17 bp, Homo sapiens
tttacttttcacactgt

SEQ ID NO: 939256 - DNA, 13 bp, Homo sapiens
tttacttttgttt

SEQ ID NO: 939257 - DNA, 23 bp, Homo sapiens
tttactttttttagtaagttaat

SEQ ID NO: 939258 - DNA, 21 bp, Homo sapiens
tttactttttttctgatgttt

SEQ ID NO: 939259 - DNA, 21 bp, Homo sapiens
tttagaaaaaaaactgaagat

SEQ ID NO: 939260 - DNA, 16 bp, Homo sapiens
tttagaaaaacattta

SEQ ID NO: 939261 - DNA, 22 bp, Homo sapiens
tttagaaaagggagtttaaaaa

SEQ ID NO: 939262 - DNA, 16 bp, Homo sapiens
tttagaaacagaaata

SEQ ID NO: 939263 - DNA, 21 bp, Homo sapiens
tttagaaacagaaatagactt

SEQ ID NO: 939264 - DNA, 18 bp, Homo sapiens
tttagaaactgatttctt

SEQ ID NO: 939265 - DNA, 22 bp, Homo sapiens
tttagaaatactgcaagaaaat

SEQ ID NO: 939266 - DNA, 13 bp, Homo sapiens
tttagaaatgcat

SEQ ID NO: 939267 - DNA, 13 bp, Homo sapiens
tttagaacaggag

SEQ ID NO: 939268 - DNA, 17 bp, Homo sapiens
tttagaacaggagactt

SEQ ID NO: 939269 - DNA, 14 bp, Homo sapiens
tttagaagccaact

SEQ ID NO: 939270 - DNA, 21 bp, Homo sapiens
tttagaatatcttttcaagtt

SEQ ID NO: 939271 - DNA, 13 bp, Homo sapiens
tttagaattaaaa

SEQ ID NO: 939272 - DNA, 24 bp, Homo sapiens
tttagacaaagccttaagcaaatt

SEQ ID NO: 939273 - DNA, 18 bp, Homo sapiens
tttagacaacctgaaatt

SEQ ID NO: 939274 - DNA, 19 bp, Homo sapiens
tttagacaactagatttgt

SEQ ID NO: 939275 - DNA, 22 bp, Homo sapiens
tttagacaagagatgggaatga

SEQ ID NO: 939276 - DNA, 16 bp, Homo sapiens
tttagacagtctcact

SEQ ID NO: 939277 - DNA, 22 bp, Homo sapiens
tttagacttggattctttccat

SEQ ID NO: 939278 - DNA, 21 bp, Homo sapiens
tttagagatgaattaaattta

SEQ ID NO: 939279 - DNA, 16 bp, Homo sapiens
tttagaggatgtggct

SEQ ID NO: 939280 - DNA, 18 bp, Homo sapiens
tttagagtgtaggtgaaa

SEQ ID NO: 939281 - DNA, 13 bp, Homo sapiens
tttagataataca

SEQ ID NO: 939282 - DNA, 13 bp, Homo sapiens
tttagatagccct

SEQ ID NO: 939283 - DNA, 22 bp, Homo sapiens
tttagatagccctgtcctggtg

SEQ ID NO: 939284 - DNA, 23 bp, Homo sapiens
tttagatagccctgtcctggtgg

SEQ ID NO: 939285 - DNA, 22 bp, Homo sapiens
tttagatcccatgtcacctcag

SEQ ID NO: 939286 - DNA, 17 bp, Homo sapiens
tttagatgagtgaaata

SEQ ID NO: 939287 - DNA, 14 bp, Homo sapiens
tttagattccagga

SEQ ID NO: 939288 - DNA, 18 bp, Homo sapiens
tttagattggttctgttt

SEQ ID NO: 939289 - DNA, 23 bp, Homo sapiens
tttagcacaatttgagactgaaa

SEQ ID NO: 939290 - DNA, 17 bp, Homo sapiens
tttagcaggtagaagaa

SEQ ID NO: 939291 - DNA, 12 bp, Homo sapiens
tttagcagtggc

SEQ ID NO: 939292 - DNA, 21 bp, Homo sapiens
tttagcagttctgcaaataga

SEQ ID NO: 939293 - DNA, 20 bp, Homo sapiens
tttagcatgacaagccccag

SEQ ID NO: 939294 - DNA, 17 bp, Homo sapiens
tttagcatttttatgca

SEQ ID NO: 939295 - DNA, 13 bp, Homo sapiens
tttagccagtgac

SEQ ID NO: 939296 - DNA, 14 bp, Homo sapiens
tttagcccagtgtt

SEQ ID NO: 939297 - DNA, 12 bp, Homo sapiens
tttagctacctt

SEQ ID NO: 939298 - DNA, 19 bp, Homo sapiens
tttagcttcagttgttctt

SEQ ID NO: 939299 - DNA, 21 bp, Homo sapiens
tttagcttcagttgttcttta

SEQ ID NO: 939300 - DNA, 13 bp, Homo sapiens
tttagcttcattt

SEQ ID NO: 939301 - DNA, 15 bp, Homo sapiens
tttaggaacttcaga

SEQ ID NO: 939302 - DNA, 16 bp, Homo sapiens
tttaggaacttcagag

SEQ ID NO: 939303 - DNA, 17 bp, Homo sapiens
tttaggaacttcagaga

SEQ ID NO: 939304 - DNA, 22 bp, Homo sapiens
tttaggaagttgacttatagta

SEQ ID NO: 939305 - DNA, 13 bp, Homo sapiens
tttaggaataata

SEQ ID NO: 939306 - DNA, 18 bp, Homo sapiens
tttaggaatcctttggtg

SEQ ID NO: 939307 - DNA, 11 bp, Homo sapiens
tttaggagaaa

SEQ ID NO: 939308 - DNA, 16 bp, Homo sapiens
tttaggagaaaccagc

SEQ ID NO: 939309 - DNA, 20 bp, Homo sapiens
tttaggagggagttatctaa

SEQ ID NO: 939310 - DNA, 17 bp, Homo sapiens
tttaggataaaataatg

SEQ ID NO: 939311 - DNA, 11 bp, Homo sapiens
tttaggcagcc

SEQ ID NO: 939312 - DNA, 13 bp, Homo sapiens
tttaggcagcctg

SEQ ID NO: 939313 - DNA, 17 bp, Homo sapiens
tttaggcagcctgccgc

SEQ ID NO: 939314 - DNA, 21 bp, Homo sapiens
tttagggtgattttaaagaac

SEQ ID NO: 939315 - DNA, 15 bp, Homo sapiens
tttaggtaagaagtt

SEQ ID NO: 939316 - DNA, 22 bp, Homo sapiens
tttagtagcaggtcaaaaacct

SEQ ID NO: 939317 - DNA, 16 bp, Homo sapiens
tttagtatacgtataa

SEQ ID NO: 939318 - DNA, 22 bp, Homo sapiens
tttagtatacgtataaatatca

SEQ ID NO: 939319 - DNA, 14 bp, Homo sapiens
tttagtattctctt

SEQ ID NO: 939320 - DNA, 18 bp, Homo sapiens
tttagtcactaagacttt

SEQ ID NO: 939321 - DNA, 23 bp, Homo sapiens
tttagtcatccaacaagaagaaa

SEQ ID NO: 939322 - DNA, 15 bp, Homo sapiens
tttagtcatgtgacc

SEQ ID NO: 939323 - DNA, 20 bp, Homo sapiens
tttagtccacggacccccag

SEQ ID NO: 939324 - DNA, 16 bp, Homo sapiens
tttagtctgcaaaatg

SEQ ID NO: 939325 - DNA, 23 bp, Homo sapiens
tttagtctttttttccttccttt

SEQ ID NO: 939326 - DNA, 18 bp, Homo sapiens
tttagtgatttttttcat

SEQ ID NO: 939327 - DNA, 13 bp, Homo sapiens
tttagtggaaaat

SEQ ID NO: 939328 - DNA, 15 bp, Homo sapiens
tttagtggaaaatag

SEQ ID NO: 939329 - DNA, 15 bp, Homo sapiens
tttagtgtgtgtgca

SEQ ID NO: 939330 - DNA, 18 bp, Homo sapiens
tttagtgtttttttattt

SEQ ID NO: 939331 - DNA, 12 bp, Homo sapiens
tttagttcatat

SEQ ID NO: 939332 - DNA, 14 bp, Homo sapiens
tttagttctgttga

SEQ ID NO: 939333 - DNA, 18 bp, Homo sapiens
tttagttgaaaaatctag

SEQ ID NO: 939334 - DNA, 19 bp, Homo sapiens
tttagttgcagactcagtt

SEQ ID NO: 939335 - DNA, 14 bp, Homo sapiens
tttagtttactcaa

SEQ ID NO: 939336 - DNA, 13 bp, Homo sapiens
tttagttttatgg

SEQ ID NO: 939337 - DNA, 15 bp, Homo sapiens
tttagttttgtaact

SEQ ID NO: 939338 - DNA, 12 bp, Homo sapiens
tttagtttttca

SEQ ID NO: 939339 - DNA, 16 bp, Homo sapiens
tttagtttttcattaa

SEQ ID NO: 939340 - DNA, 14 bp, Homo sapiens
tttataaaaagata

SEQ ID NO: 939341 - DNA, 14 bp, Homo sapiens
tttataaaacttct

SEQ ID NO: 939342 - DNA, 23 bp, Homo sapiens
tttataaaagaataaaattgcac

SEQ ID NO: 939343 - DNA, 22 bp, Homo sapiens
tttataaaagtgttcattgttt

SEQ ID NO: 939344 - DNA, 16 bp, Homo sapiens
tttataaaatggctgt

SEQ ID NO: 939345 - DNA, 18 bp, Homo sapiens
tttataaacagacaatat

SEQ ID NO: 939346 - DNA, 14 bp, Homo sapiens
tttataaactgaga

SEQ ID NO: 939347 - DNA, 17 bp, Homo sapiens
tttataaatactgcaaa

SEQ ID NO: 939348 - DNA, 22 bp, Homo sapiens
tttataaatattaggcataaat

SEQ ID NO: 939349 - DNA, 23 bp, Homo sapiens
tttataaatattaggcataaatt

SEQ ID NO: 939350 - DNA, 17 bp, Homo sapiens
tttataacatctttatt

SEQ ID NO: 939351 - DNA, 14 bp, Homo sapiens
tttataactctagg

SEQ ID NO: 939352 - DNA, 14 bp, Homo sapiens
tttataagaaaaac

SEQ ID NO: 939353 - DNA, 13 bp, Homo sapiens
tttataagaattt

SEQ ID NO: 939354 - DNA, 20 bp, Homo sapiens
tttataagcatttgtattat

SEQ ID NO: 939355 - DNA, 13 bp, Homo sapiens
tttataagttttt

SEQ ID NO: 939356 - DNA, 18 bp, Homo sapiens
tttataatagcaactttt

SEQ ID NO: 939357 - DNA, 14 bp, Homo sapiens
tttataatctgaag

SEQ ID NO: 939358 - DNA, 17 bp, Homo sapiens
tttataatgtatttgaa

SEQ ID NO: 939359 - DNA, 21 bp, Homo sapiens
tttataatgtatttgaaaatt

SEQ ID NO: 939360 - DNA, 15 bp, Homo sapiens
tttataatgttgtat

SEQ ID NO: 939361 - DNA, 15 bp, Homo sapiens
tttataattaaagat

SEQ ID NO: 939362 - DNA, 20 bp, Homo sapiens
tttataattgtttataaaac

SEQ ID NO: 939363 - DNA, 16 bp, Homo sapiens
tttataatttaaatga

SEQ ID NO: 939364 - DNA, 18 bp, Homo sapiens
tttataatttaaatgata

SEQ ID NO: 939365 - DNA, 13 bp, Homo sapiens
tttatacaaatta

SEQ ID NO: 939366 - DNA, 17 bp, Homo sapiens
tttatacaaattagaaa

SEQ ID NO: 939367 - DNA, 20 bp, Homo sapiens
tttatacaatggaataaatt

SEQ ID NO: 939368 - DNA, 18 bp, Homo sapiens
tttatacacaactttgca

SEQ ID NO: 939369 - DNA, 22 bp, Homo sapiens
tttatacacagattctgccttg

SEQ ID NO: 939370 - DNA, 13 bp, Homo sapiens
tttatacagctgt

SEQ ID NO: 939371 - DNA, 14 bp, Homo sapiens
tttatacagctgta

SEQ ID NO: 939372 - DNA, 14 bp, Homo sapiens
tttataccagctta

SEQ ID NO: 939373 - DNA, 16 bp, Homo sapiens
tttataccattcagat

SEQ ID NO: 939374 - DNA, 16 bp, Homo sapiens
tttatactgaaggaaa

SEQ ID NO: 939375 - DNA, 16 bp, Homo sapiens
tttatactgagctttt

SEQ ID NO: 939376 - DNA, 21 bp, Homo sapiens
tttatactgggtttcaagaaa

SEQ ID NO: 939377 - DNA, 15 bp, Homo sapiens
tttatactgtgaaat

SEQ ID NO: 939378 - DNA, 15 bp, Homo sapiens
tttatactttattga

SEQ ID NO: 939379 - DNA, 17 bp, Homo sapiens
tttatactttattgaaa

SEQ ID NO: 939380 - DNA, 12 bp, Homo sapiens
tttatagaagaa

SEQ ID NO: 939381 - DNA, 19 bp, Homo sapiens
tttatagaaggaatttgta

SEQ ID NO: 939382 - DNA, 20 bp, Homo sapiens
tttatagacattatgtgagt

SEQ ID NO: 939383 - DNA, 17 bp, Homo sapiens
tttatagattatatgaa

SEQ ID NO: 939384 - DNA, 16 bp, Homo sapiens
tttatagctcagttta

SEQ ID NO: 939385 - DNA, 22 bp, Homo sapiens
tttatagtagatttttaacaaa

SEQ ID NO: 939386 - DNA, 16 bp, Homo sapiens
tttatagtatgtgact

SEQ ID NO: 939387 - DNA, 17 bp, Homo sapiens
tttatagtgtgttgtgc

SEQ ID NO: 939388 - DNA, 22 bp, Homo sapiens
tttatataagtctgttatttat

SEQ ID NO: 939389 - DNA, 15 bp, Homo sapiens
tttatataataaagt

SEQ ID NO: 939390 - DNA, 20 bp, Homo sapiens
tttatataataaagtattcc

SEQ ID NO: 939391 - DNA, 17 bp, Homo sapiens
tttatataatatctaaa

SEQ ID NO: 939392 - DNA, 13 bp, Homo sapiens
tttatatatacag

SEQ ID NO: 939393 - DNA, 15 bp, Homo sapiens
tttatatatatatgt

SEQ ID NO: 939394 - DNA, 13 bp, Homo sapiens
tttatatatgtat

SEQ ID NO: 939395 - DNA, 12 bp, Homo sapiens
tttatatctttt

SEQ ID NO: 939396 - DNA, 17 bp, Homo sapiens
tttatatgaagataagt

SEQ ID NO: 939397 - DNA, 18 bp, Homo sapiens
tttatatggcccagcctt

SEQ ID NO: 939398 - DNA, 16 bp, Homo sapiens
tttatattacactaca

SEQ ID NO: 939399 - DNA, 18 bp, Homo sapiens
tttatattacttttgtaa

SEQ ID NO: 939400 - DNA, 20 bp, Homo sapiens
tttatattctgaaaggaaat

SEQ ID NO: 939401 - DNA, 21 bp, Homo sapiens
tttatatttaaaaaattaaaa

SEQ ID NO: 939402 - DNA, 14 bp, Homo sapiens
tttatatttagtga

SEQ ID NO: 939403 - DNA, 17 bp, Homo sapiens
tttatatttcctgtatt

SEQ ID NO: 939404 - DNA, 14 bp, Homo sapiens
tttatatttccttt

SEQ ID NO: 939405 - DNA, 18 bp, Homo sapiens
tttatatttcctttatgt

SEQ ID NO: 939406 - DNA, 20 bp, Homo sapiens
tttatatttcctttatgtga

SEQ ID NO: 939407 - DNA, 18 bp, Homo sapiens
tttatatttggaaagaga

SEQ ID NO: 939408 - DNA, 15 bp, Homo sapiens
tttatattttctatt

SEQ ID NO: 939409 - DNA, 17 bp, Homo sapiens
tttatatttttgtacat

SEQ ID NO: 939410 - DNA, 14 bp, Homo sapiens
tttatcaaaatgta

SEQ ID NO: 939411 - DNA, 15 bp, Homo sapiens
tttatcaactttggt

SEQ ID NO: 939412 - DNA, 16 bp, Homo sapiens
tttatcaatgtgtctt

SEQ ID NO: 939413 - DNA, 19 bp, Homo sapiens
tttatcaatgtgtctttct

SEQ ID NO: 939414 - DNA, 14 bp, Homo sapiens
tttatcagatacat

SEQ ID NO: 939415 - DNA, 21 bp, Homo sapiens
tttatcagatacatcactgct

SEQ ID NO: 939416 - DNA, 20 bp, Homo sapiens
tttatcagggaaactaagat

SEQ ID NO: 939417 - DNA, 13 bp, Homo sapiens
tttatcagtgaca

SEQ ID NO: 939418 - DNA, 21 bp, Homo sapiens
tttatcagtgacagagttcac

SEQ ID NO: 939419 - DNA, 23 bp, Homo sapiens
tttatcatgacatgttatatatt

SEQ ID NO: 939420 - DNA, 23 bp, Homo sapiens
tttatcatgcatgtcctgtaaag

SEQ ID NO: 939421 - DNA, 16 bp, Homo sapiens
tttatccaaaatgtgt

SEQ ID NO: 939422 - DNA, 22 bp, Homo sapiens
tttatccaattttgatcttttt

SEQ ID NO: 939423 - DNA, 15 bp, Homo sapiens
tttatccctttcctg

SEQ ID NO: 939424 - DNA, 21 bp, Homo sapiens
tttatcctggccttgtacttg

SEQ ID NO: 939425 - DNA, 14 bp, Homo sapiens
tttatcctgtattc

SEQ ID NO: 939426 - DNA, 19 bp, Homo sapiens
tttatctcagatgttaaaa

SEQ ID NO: 939427 - DNA, 12 bp, Homo sapiens
tttatctcctgc

SEQ ID NO: 939428 - DNA, 21 bp, Homo sapiens
tttatctgagcaataacttct

SEQ ID NO: 939429 - DNA, 13 bp, Homo sapiens
tttatctgattaa

SEQ ID NO: 939430 - DNA, 16 bp, Homo sapiens
tttatctgcagaacat

SEQ ID NO: 939431 - DNA, 17 bp, Homo sapiens
tttatctgggattatgg

SEQ ID NO: 939432 - DNA, 22 bp, Homo sapiens
tttatctgtaattgtaattcca

SEQ ID NO: 939433 - DNA, 16 bp, Homo sapiens
tttatctgtagtaaac

SEQ ID NO: 939434 - DNA, 19 bp, Homo sapiens
tttatctgtagtaaactat

SEQ ID NO: 939435 - DNA, 14 bp, Homo sapiens
tttatctgtttcct

SEQ ID NO: 939436 - DNA, 15 bp, Homo sapiens
tttatctttgtgtaa

SEQ ID NO: 939437 - DNA, 21 bp, Homo sapiens
tttatgaaatggttaagaatt

SEQ ID NO: 939438 - DNA, 13 bp, Homo sapiens
tttatgaacaatt

SEQ ID NO: 939439 - DNA, 16 bp, Homo sapiens
tttatgaacattgtac

SEQ ID NO: 939440 - DNA, 21 bp, Homo sapiens
tttatgaacattgtactgttg

SEQ ID NO: 939441 - DNA, 21 bp, Homo sapiens
tttatgaagaaaaagtacaat

SEQ ID NO: 939442 - DNA, 13 bp, Homo sapiens
tttatgaaggttt

SEQ ID NO: 939443 - DNA, 12 bp, Homo sapiens
tttatgacctaa

SEQ ID NO: 939444 - DNA, 19 bp, Homo sapiens
tttatgacctaagtcaggt

SEQ ID NO: 939445 - DNA, 21 bp, Homo sapiens
tttatgacctaagtcaggtaa

SEQ ID NO: 939446 - DNA, 23 bp, Homo sapiens
tttatgacctgaaataatatatt

SEQ ID NO: 939447 - DNA, 22 bp, Homo sapiens
tttatgagaaactggcaaagca

SEQ ID NO: 939448 - DNA, 14 bp, Homo sapiens
tttatgagaaactt

SEQ ID NO: 939449 - DNA, 20 bp, Homo sapiens
tttatgagatgctggttttc

SEQ ID NO: 939450 - DNA, 19 bp, Homo sapiens
tttatgatacttgaatttt

SEQ ID NO: 939451 - DNA, 15 bp, Homo sapiens
tttatgatgctaagc

SEQ ID NO: 939452 - DNA, 19 bp, Homo sapiens
tttatgcaaccataagaca

SEQ ID NO: 939453 - DNA, 12 bp, Homo sapiens
tttatgcacagc

SEQ ID NO: 939454 - DNA, 23 bp, Homo sapiens
tttatgcagaagcatattttgct

SEQ ID NO: 939455 - DNA, 14 bp, Homo sapiens
tttatgcagacagt

SEQ ID NO: 939456 - DNA, 12 bp, Homo sapiens
tttatgcatttc

SEQ ID NO: 939457 - DNA, 16 bp, Homo sapiens
tttatgcatttcattc

SEQ ID NO: 939458 - DNA, 21 bp, Homo sapiens
tttatgccggatgtgcttttc

SEQ ID NO: 939459 - DNA, 19 bp, Homo sapiens
tttatgctacctagtctcc

SEQ ID NO: 939460 - DNA, 23 bp, Homo sapiens
tttatggaggatggagagagggg

SEQ ID NO: 939461 - DNA, 20 bp, Homo sapiens
tttatggattaaaaactgct

SEQ ID NO: 939462 - DNA, 22 bp, Homo sapiens
tttatggccacatttaatatct

SEQ ID NO: 939463 - DNA, 14 bp, Homo sapiens
tttatggcttttgt

SEQ ID NO: 939464 - DNA, 13 bp, Homo sapiens
tttatgggccttg

SEQ ID NO: 939465 - DNA, 21 bp, Homo sapiens
tttatggtaactgctttctgt

SEQ ID NO: 939466 - DNA, 19 bp, Homo sapiens
tttatggttatgtttttct

SEQ ID NO: 939467 - DNA, 22 bp, Homo sapiens
tttatggtttctgtctgaatta

SEQ ID NO: 939468 - DNA, 12 bp, Homo sapiens
tttatgtaatag

SEQ ID NO: 939469 - DNA, 13 bp, Homo sapiens
tttatgtaatttg

SEQ ID NO: 939470 - DNA, 19 bp, Homo sapiens
tttatgtagtaattgacat

SEQ ID NO: 939471 - DNA, 12 bp, Homo sapiens
tttatgtatctc

SEQ ID NO: 939472 - DNA, 14 bp, Homo sapiens
tttatgtattttga

SEQ ID NO: 939473 - DNA, 18 bp, Homo sapiens
tttatgtctatttaagcc

SEQ ID NO: 939474 - DNA, 13 bp, Homo sapiens
tttatgtgaattt

SEQ ID NO: 939475 - DNA, 16 bp, Homo sapiens
tttatgtgatcaattt

SEQ ID NO: 939476 - DNA, 18 bp, Homo sapiens
tttatgtgcagcgaccct

SEQ ID NO: 939477 - DNA, 22 bp, Homo sapiens
tttatgtgcagcgacccttggt

SEQ ID NO: 939478 - DNA, 13 bp, Homo sapiens
tttatgtgctata

SEQ ID NO: 939479 - DNA, 20 bp, Homo sapiens
tttatgtggtcttatgattt

SEQ ID NO: 939480 - DNA, 17 bp, Homo sapiens
tttatgttaaaagattt

SEQ ID NO: 939481 - DNA, 20 bp, Homo sapiens
tttatgttaagggaagaatt

SEQ ID NO: 939482 - DNA, 12 bp, Homo sapiens
tttatgttcagc

SEQ ID NO: 939483 - DNA, 17 bp, Homo sapiens
tttatgttcagcttata

SEQ ID NO: 939484 - DNA, 23 bp, Homo sapiens
tttatgtttgcacttgtgattat

SEQ ID NO: 939485 - DNA, 17 bp, Homo sapiens
tttatgttttgtttctg

SEQ ID NO: 939486 - DNA, 18 bp, Homo sapiens
tttatgttttgtttctga

SEQ ID NO: 939487 - DNA, 13 bp, Homo sapiens
tttattaaaaact

SEQ ID NO: 939488 - DNA, 18 bp, Homo sapiens
tttattaaaaatgttctc

SEQ ID NO: 939489 - DNA, 22 bp, Homo sapiens
tttattaaaaatgttctcaaat

SEQ ID NO: 939490 - DNA, 19 bp, Homo sapiens
tttattaaaatatttcagg

SEQ ID NO: 939491 - DNA, 11 bp, Homo sapiens
tttattaaata

SEQ ID NO: 939492 - DNA, 15 bp, Homo sapiens
tttattaaatacaaa

SEQ ID NO: 939493 - DNA, 21 bp, Homo sapiens
tttattaaatacaaaacttcc

SEQ ID NO: 939494 - DNA, 19 bp, Homo sapiens
tttattaaatagttaatat

SEQ ID NO: 939495 - DNA, 21 bp, Homo sapiens
tttattaaatttgttgacaaa

SEQ ID NO: 939496 - DNA, 18 bp, Homo sapiens
tttattaacaaattatgt

SEQ ID NO: 939497 - DNA, 12 bp, Homo sapiens
tttattaagatg

SEQ ID NO: 939498 - DNA, 14 bp, Homo sapiens
tttattaagtctgg

SEQ ID NO: 939499 - DNA, 14 bp, Homo sapiens
tttattaatagaat

SEQ ID NO: 939500 - DNA, 13 bp, Homo sapiens
tttattacaaatc

SEQ ID NO: 939501 - DNA, 11 bp, Homo sapiens
tttattacaat

SEQ ID NO: 939502 - DNA, 23 bp, Homo sapiens
tttattacaatgtatctttatta

SEQ ID NO: 939503 - DNA, 14 bp, Homo sapiens
tttattacagaaat

SEQ ID NO: 939504 - DNA, 12 bp, Homo sapiens
tttattaccagt

SEQ ID NO: 939505 - DNA, 17 bp, Homo sapiens
tttattaccccctcctt

SEQ ID NO: 939506 - DNA, 23 bp, Homo sapiens
tttattaccccctccttcagaca

SEQ ID NO: 939507 - DNA, 14 bp, Homo sapiens
tttattacctctga

SEQ ID NO: 939508 - DNA, 13 bp, Homo sapiens
tttattactgatt

SEQ ID NO: 939509 - DNA, 21 bp, Homo sapiens
tttattactgtccctatctat

SEQ ID NO: 939510 - DNA, 15 bp, Homo sapiens
tttattactgtttat

SEQ ID NO: 939511 - DNA, 20 bp, Homo sapiens
tttattacttccatgaattt

SEQ ID NO: 939512 - DNA, 15 bp, Homo sapiens
tttattacttgtgca

SEQ ID NO: 939513 - DNA, 22 bp, Homo sapiens
tttattatatttgaattgacag

SEQ ID NO: 939514 - DNA, 16 bp, Homo sapiens
tttattatgcattata

SEQ ID NO: 939515 - DNA, 17 bp, Homo sapiens
tttattattgtttatgc

SEQ ID NO: 939516 - DNA, 14 bp, Homo sapiens
tttattcacatata

SEQ ID NO: 939517 - DNA, 18 bp, Homo sapiens
tttattcagctagaattt

SEQ ID NO: 939518 - DNA, 19 bp, Homo sapiens
tttattcagcttcatttgt

SEQ ID NO: 939519 - DNA, 18 bp, Homo sapiens
tttattcataatgaatta

SEQ ID NO: 939520 - DNA, 19 bp, Homo sapiens
tttattcccaagtatgcct

SEQ ID NO: 939521 - DNA, 14 bp, Homo sapiens
tttattccctgccc

SEQ ID NO: 939522 - DNA, 15 bp, Homo sapiens
tttattcctcttatt

SEQ ID NO: 939523 - DNA, 18 bp, Homo sapiens
tttattccttctgtagtg

SEQ ID NO: 939524 - DNA, 14 bp, Homo sapiens
tttattctcatttg

SEQ ID NO: 939525 - DNA, 11 bp, Homo sapiens
ttctcaatgaa

SEQ ID NO: 939526 - DNA, 18 bp, Homo sapiens
ttctcaatgaaaaatagt

SEQ ID NO: 939527 - DNA, 21 bp, Homo sapiens
ttctcacacacaactgtccat

SEQ ID NO: 939528 - DNA, 14 bp, Homo sapiens
ttctcacacccacc

SEQ ID NO: 939529 - DNA, 22 bp, Homo sapiens
ttctcacacccaccgtccgccc

SEQ ID NO: 939530 - DNA, 22 bp, Homo sapiens
ttctcacactctaactgtatat

SEQ ID NO: 939531 - DNA, 16 bp, Homo sapiens
ttctcaccattcctgt

SEQ ID NO: 939532 - DNA, 15 bp, Homo sapiens
ttctcactaatttgt

SEQ ID NO: 939533 - DNA, 16 bp, Homo sapiens
ttctcactccaccacc

SEQ ID NO: 939534 - DNA, 18 bp, Homo sapiens
ttctcactcctacctggt

SEQ ID NO: 939535 - DNA, 20 bp, Homo sapiens
ttctcacttcaattaatgct

SEQ ID NO: 939536 - DNA, 13 bp, Homo sapiens
ttctcagaacagc

SEQ ID NO: 939537 - DNA, 17 bp, Homo sapiens
ttctcagaacagctgaa

SEQ ID NO: 939538 - DNA, 13 bp, Homo sapiens
ttctcagaagcac

SEQ ID NO: 939539 - DNA, 21 bp, Homo sapiens
ttctcagaagcacagaatatt

SEQ ID NO: 939540 - DNA, 13 bp, Homo sapiens
ttctcagaatcta

SEQ ID NO: 939541 - DNA, 23 bp, Homo sapiens
ttctcagaatctcaaataactaa

SEQ ID NO: 939542 - DNA, 21 bp, Homo sapiens
ttctcagagctctcgaggaaa

SEQ ID NO: 939543 - DNA, 19 bp, Homo sapiens
ttctcagctgaaattatat

SEQ ID NO: 939544 - DNA, 23 bp, Homo sapiens
ttctcaggacagcatcccttccc

SEQ ID NO: 939545 - DNA, 12 bp, Homo sapiens
ttctcagggctg

SEQ ID NO: 939546 - DNA, 22 bp, Homo sapiens
ttctcagggctggagcctgggg

SEQ ID NO: 939547 - DNA, 23 bp, Homo sapiens
ttctcagggctggagcctggggt

SEQ ID NO: 939548 - DNA, 23 bp, Homo sapiens
ttctcaggtaggaagcaacagct

SEQ ID NO: 939549 - DNA, 16 bp, Homo sapiens
ttctcaggtgttgcca

SEQ ID NO: 939550 - DNA, 19 bp, Homo sapiens
ttctcaggtgttgccaaat

SEQ ID NO: 939551 - DNA, 18 bp, Homo sapiens
ttctcataaatcttttta

SEQ ID NO: 939552 - DNA, 12 bp, Homo sapiens
ttctcataactt

SEQ ID NO: 939553 - DNA, 18 bp, Homo sapiens
ttctcataattcctacag

SEQ ID NO: 939554 - DNA, 23 bp, Homo sapiens
ttctcataattcctacagcacta

SEQ ID NO: 939555 - DNA, 14 bp, Homo sapiens
ttctcatagcatta

SEQ ID NO: 939556 - DNA, 17 bp, Homo sapiens
ttctcatcatattgtat

SEQ ID NO: 939557 - DNA, 17 bp, Homo sapiens
ttctcatctgcaccctt

SEQ ID NO: 939558 - DNA, 19 bp, Homo sapiens
ttctcatctgcacccttct

SEQ ID NO: 939559 - DNA, 23 bp, Homo sapiens
ttctcatgataccacctttactg

SEQ ID NO: 939560 - DNA, 13 bp, Homo sapiens
ttctcatgtgttt

SEQ ID NO: 939561 - DNA, 20 bp, Homo sapiens
ttctcatgttccttttgaaa

SEQ ID NO: 939562 - DNA, 22 bp, Homo sapiens
ttctcattaaaatccagtatta

SEQ ID NO: 939563 - DNA, 14 bp, Homo sapiens
ttctcattaaactc

SEQ ID NO: 939564 - DNA, 20 bp, Homo sapiens
ttctcattccaacagtgagt

SEQ ID NO: 939565 - DNA, 14 bp, Homo sapiens
ttctcattgtttgt

SEQ ID NO: 939566 - DNA, 11 bp, Homo sapiens
ttctcatttct

SEQ ID NO: 939567 - DNA, 20 bp, Homo sapiens
ttctcatttggtctgccaga

SEQ ID NO: 939568 - DNA, 21 bp, Homo sapiens
ttctcatttggtctgccagaa

SEQ ID NO: 939569 - DNA, 13 bp, Homo sapiens
ttctcattttctt

SEQ ID NO: 939570 - DNA, 16 bp, Homo sapiens
ttctcattttcttttc

SEQ ID NO: 939571 - DNA, 17 bp, Homo sapiens
ttctcattttttaaaaa

SEQ ID NO: 939572 - DNA, 22 bp, Homo sapiens
ttctccaacatcacagcccagc

SEQ ID NO: 939573 - DNA, 21 bp, Homo sapiens
ttctccaatatcagtgctcga

SEQ ID NO: 939574 - DNA, 20 bp, Homo sapiens
ttctccaatgctctggagtg

SEQ ID NO: 939575 - DNA, 21 bp, Homo sapiens
ttctccaattctgaaatactt

SEQ ID NO: 939576 - DNA, 24 bp, Homo sapiens
ttctccaccagcccctcacaggct

SEQ ID NO: 939577 - DNA, 23 bp, Homo sapiens
ttctccacccaaaccccttccca

SEQ ID NO: 939578 - DNA, 17 bp, Homo sapiens
ttctccactttttctta

SEQ ID NO: 939579 - DNA, 18 bp, Homo sapiens
ttctccagaatgtaagaa

SEQ ID NO: 939580 - DNA, 18 bp, Homo sapiens
ttctccagacccagaggc

SEQ ID NO: 939581 - DNA, 13 bp, Homo sapiens
ttctccagccagc

SEQ ID NO: 939582 - DNA, 13 bp, Homo sapiens
ttctccagctcag

SEQ ID NO: 939583 - DNA, 20 bp, Homo sapiens
ttctccagctgggctctgca

SEQ ID NO: 939584 - DNA, 20 bp, Homo sapiens
ttctccaggattttaatttc

SEQ ID NO: 939585 - DNA, 13 bp, Homo sapiens
ttctccagttgat

SEQ ID NO: 939586 - DNA, 19 bp, Homo sapiens
ttctccatcccctccctgc

SEQ ID NO: 939587 - DNA, 20 bp, Homo sapiens
ttctccatcccctccctgcc

SEQ ID NO: 939588 - DNA, 21 bp, Homo sapiens
ttctccatcccctccctgcct

SEQ ID NO: 939589 - DNA, 12 bp, Homo sapiens
ttctccatccct

SEQ ID NO: 939590 - DNA, 14 bp, Homo sapiens
ttctcccaaagatt

SEQ ID NO: 939591 - DNA, 22 bp, Homo sapiens
ttctcccacatgaggccatctc

SEQ ID NO: 939592 - DNA, 10 bp, Homo sapiens
ttctcccacc

SEQ ID NO: 939593 - DNA, 20 bp, Homo sapiens
ttctcccagaatcccagccg

SEQ ID NO: 939594 - DNA, 12 bp, Homo sapiens
ttctcccagcac

SEQ ID NO: 939595 - DNA, 20 bp, Homo sapiens
ttctcccagcactgcctcct

SEQ ID NO: 939596 - DNA, 13 bp, Homo sapiens
ttctcccaggaag

SEQ ID NO: 939597 - DNA, 22 bp, Homo sapiens
ttctcccagggagtgagcagct

SEQ ID NO: 939598 - DNA, 18 bp, Homo sapiens
ttctcccagtctctgtcg

SEQ ID NO: 939599 - DNA, 16 bp, Homo sapiens
ttctcccatttcctga

SEQ ID NO: 939600 - DNA, 21 bp, Homo sapiens
ttctccccacgatgatatcta

SEQ ID NO: 939601 - DNA, 17 bp, Homo sapiens
ttctccccccatcccag

SEQ ID NO: 939602 - DNA, 19 bp, Homo sapiens
ttctccccccatcccaggg

SEQ ID NO: 939603 - DNA, 20 bp, Homo sapiens
ttctcccccgacactgctgc

SEQ ID NO: 939604 - DNA, 21 bp, Homo sapiens
ttctcccccgacactgctgca

SEQ ID NO: 939605 - DNA, 17 bp, Homo sapiens
ttctcccccgccctgcc

SEQ ID NO: 939606 - DNA, 13 bp, Homo sapiens
tttatttgttgag

SEQ ID NO: 939607 - DNA, 14 bp, Homo sapiens
tttatttgttgaga

SEQ ID NO: 939608 - DNA, 17 bp, Homo sapiens
tttattttaatgtaaag

SEQ ID NO: 939609 - DNA, 14 bp, Homo sapiens
tttattttacattt

SEQ ID NO: 939610 - DNA, 14 bp, Homo sapiens
tttattttactatt

SEQ ID NO: 939611 - DNA, 18 bp, Homo sapiens
tttattttactttgcatt

SEQ ID NO: 939612 - DNA, 23 bp, Homo sapiens
tttattttagcagttctgcaaat

SEQ ID NO: 939613 - DNA, 15 bp, Homo sapiens
tttattttcctaaag

SEQ ID NO: 939614 - DNA, 22 bp, Homo sapiens
tttattttctggtagatagaaa

SEQ ID NO: 939615 - DNA, 21 bp, Homo sapiens
tttattttcttttgtaaatgt

SEQ ID NO: 939616 - DNA, 18 bp, Homo sapiens
tttattttgctccctctg

SEQ ID NO: 939617 - DNA, 22 bp, Homo sapiens
tttattttggaattggtgtata

SEQ ID NO: 939618 - DNA, 15 bp, Homo sapiens
tttattttgtatgaa

SEQ ID NO: 939619 - DNA, 16 bp, Homo sapiens
tttatttttagttaaa

SEQ ID NO: 939620 - DNA, 12 bp, Homo sapiens
tttatttttcat

SEQ ID NO: 939621 - DNA, 15 bp, Homo sapiens
tttatttttctaaaa

SEQ ID NO: 939622 - DNA, 13 bp, Homo sapiens
tttatttttctgt

SEQ ID NO: 939623 - DNA, 17 bp, Homo sapiens
tttatttttcttgtctt

SEQ ID NO: 939624 - DNA, 22 bp, Homo sapiens
tttatttttcttttcctgggaa

SEQ ID NO: 939625 - DNA, 13 bp, Homo sapiens
tttatttttgcaa

SEQ ID NO: 939626 - DNA, 21 bp, Homo sapiens
tttatttttgggtttggccag

SEQ ID NO: 939627 - DNA, 19 bp, Homo sapiens
tttatttttgtgtaggtgt

SEQ ID NO: 939628 - DNA, 17 bp, Homo sapiens
tttattttttcttttgt

SEQ ID NO: 939629 - DNA, 17 bp, Homo sapiens
tttattttttgggccat

SEQ ID NO: 939630 - DNA, 17 bp, Homo sapiens
tttattttttgtgagtg

SEQ ID NO: 939631 - DNA, 14 bp, Homo sapiens
tttatttttttcta

SEQ ID NO: 939632 - DNA, 23 bp, Homo sapiens
tttcaaaaaaaaaaaaaaagact

SEQ ID NO: 939633 - DNA, 19 bp, Homo sapiens
tttcaaaaaagtcaacaaa

SEQ ID NO: 939634 - DNA, 13 bp, Homo sapiens
tttcaaaaacatt

SEQ ID NO: 939635 - DNA, 23 bp, Homo sapiens
tttcaaaagaaatttaagttcta

SEQ ID NO: 939636 - DNA, 13 bp, Homo sapiens
tttcaaaagaaga

SEQ ID NO: 939637 - DNA, 13 bp, Homo sapiens
tttcaaaatatat

SEQ ID NO: 939638 - DNA, 21 bp, Homo sapiens
tttcaaaatcagtttttcata

SEQ ID NO: 939639 - DNA, 14 bp, Homo sapiens
tttcaaaattaata

SEQ ID NO: 939640 - DNA, 16 bp, Homo sapiens
tttcaaacaagaaaca

SEQ ID NO: 939641 - DNA, 23 bp, Homo sapiens
tttcaaacaagaaacatttcaga

SEQ ID NO: 939642 - DNA, 22 bp, Homo sapiens
tttcaaactttactatggccct

SEQ ID NO: 939643 - DNA, 22 bp, Homo sapiens
tttcaaagcaattgaaatgcat

SEQ ID NO: 939644 - DNA, 12 bp, Homo sapiens
tttcaaagcaca

SEQ ID NO: 939645 - DNA, 18 bp, Homo sapiens
tttcaaagccctgcctct

SEQ ID NO: 939646 - DNA, 17 bp, Homo sapiens
tttcaaagctttttcca

SEQ ID NO: 939647 - DNA, 21 bp, Homo sapiens
tttcaaatcattccttagata

SEQ ID NO: 939648 - DNA, 15 bp, Homo sapiens
tttcaaatctgtaat

SEQ ID NO: 939649 - DNA, 21 bp, Homo sapiens
tttcaaattggagcttcatgg

SEQ ID NO: 939650 - DNA, 14 bp, Homo sapiens
tttcaaatttcaca

SEQ ID NO: 939651 - DNA, 15 bp, Homo sapiens
tttcaacaaggcaaa

SEQ ID NO: 939652 - DNA, 14 bp, Homo sapiens
tttcaacactgaaa

SEQ ID NO: 939653 - DNA, 20 bp, Homo sapiens
tttcaacactgaaaaaatac

SEQ ID NO: 939654 - DNA, 23 bp, Homo sapiens
tttcaacagatgaccgtgtacaa

SEQ ID NO: 939655 - DNA, 21 bp, Homo sapiens
tttcaacatttttttttctcc

SEQ ID NO: 939656 - DNA, 21 bp, Homo sapiens
tttcaacgcagccctgctttg

SEQ ID NO: 939657 - DNA, 23 bp, Homo sapiens
tttcaacggaaagtgctgtctta

SEQ ID NO: 939658 - DNA, 20 bp, Homo sapiens
tttcaactagaaaattctaa

SEQ ID NO: 939659 - DNA, 14 bp, Homo sapiens
tttcaagaaaatct

SEQ ID NO: 939660 - DNA, 16 bp, Homo sapiens
tttcaagaaaatcttt

SEQ ID NO: 939661 - DNA, 17 bp, Homo sapiens
tttcaagaaactgagga

SEQ ID NO: 939662 - DNA, 19 bp, Homo sapiens
tttcaagaaactgaggaat

SEQ ID NO: 939663 - DNA, 23 bp, Homo sapiens
tttcaagaataatcacgctttcc

SEQ ID NO: 939664 - DNA, 12 bp, Homo sapiens
tttcaagattct

SEQ ID NO: 939665 - DNA, 14 bp, Homo sapiens
tttcaagattctaa

SEQ ID NO: 939666 - DNA, 17 bp, Homo sapiens
tttcaagattctaaagc

SEQ ID NO: 939667 - DNA, 17 bp, Homo sapiens
tttcaaggccctcagca

SEQ ID NO: 939668 - DNA, 18 bp, Homo sapiens
tttcaaggccctcagcat

SEQ ID NO: 939669 - DNA, 20 bp, Homo sapiens
tttcaagtcaaattaataat

SEQ ID NO: 939670 - DNA, 19 bp, Homo sapiens
tttcaagtctgactctcca

SEQ ID NO: 939671 - DNA, 17 bp, Homo sapiens
tttcaagttattcaaat

SEQ ID NO: 939672 - DNA, 16 bp, Homo sapiens
tttcaagttgtaaata

SEQ ID NO: 939673 - DNA, 12 bp, Homo sapiens
tttcaagtttac

SEQ ID NO: 939674 - DNA, 20 bp, Homo sapiens
tttcaataaagcatttataa

SEQ ID NO: 939675 - DNA, 15 bp, Homo sapiens
tttcaatagcacata

SEQ ID NO: 939676 - DNA, 14 bp, Homo sapiens
tttcaatagccact

SEQ ID NO: 939677 - DNA, 12 bp, Homo sapiens
tttcaatatgca

SEQ ID NO: 939678 - DNA, 21 bp, Homo sapiens
tttcaatatgcaagcagcttt

SEQ ID NO: 939679 - DNA, 19 bp, Homo sapiens
tttcaatcaactttactgt

SEQ ID NO: 939680 - DNA, 13 bp, Homo sapiens
tttcaatcccaat

SEQ ID NO: 939681 - DNA, 19 bp, Homo sapiens
tttcaatgcatacaataaa

SEQ ID NO: 939682 - DNA, 23 bp, Homo sapiens
tttcaatgcgttttgttgtagat

SEQ ID NO: 939683 - DNA, 23 bp, Homo sapiens
tttcaatgtgaaacacatgccag

SEQ ID NO: 939684 - DNA, 20 bp, Homo sapiens
tttcaatgtgattctaatgt

SEQ ID NO: 939685 - DNA, 14 bp, Homo sapiens
tttcaatgtgtata

SEQ ID NO: 939686 - DNA, 16 bp, Homo sapiens
tttcacttgctctttg

SEQ ID NO: 939687 - DNA, 13 bp, Homo sapiens
tttcacttgtatt

SEQ ID NO: 939688 - DNA, 19 bp, Homo sapiens
tttcacttgtattgacttt

SEQ ID NO: 939689 - DNA, 21 bp, Homo sapiens
tttcacttgtattgactttat

SEQ ID NO: 939690 - DNA, 12 bp, Homo sapiens
tttcactttaga

SEQ ID NO: 939691 - DNA, 16 bp, Homo sapiens
tttcactttctgtcta

SEQ ID NO: 939692 - DNA, 16 bp, Homo sapiens
tttcactttgaaaagt

SEQ ID NO: 939693 - DNA, 17 bp, Homo sapiens
tttcactttgtgattat

SEQ ID NO: 939694 - DNA, 17 bp, Homo sapiens
tttcacttttagttggc

SEQ ID NO: 939695 - DNA, 23 bp, Homo sapiens
tttcacttttagttggcatttgt

SEQ ID NO: 939696 - DNA, 20 bp, Homo sapiens
tttcagaaatatgtggtttc

SEQ ID NO: 939697 - DNA, 23 bp, Homo sapiens
tttcagaacctcttccccagaaa

SEQ ID NO: 939698 - DNA, 13 bp, Homo sapiens
tttcagaagaaat

SEQ ID NO: 939699 - DNA, 16 bp, Homo sapiens
tttcagaagatggtga

SEQ ID NO: 939700 - DNA, 18 bp, Homo sapiens
tttcagaagcaagccaga

SEQ ID NO: 939701 - DNA, 22 bp, Homo sapiens
tttcagaagcaagccagaccta

SEQ ID NO: 939702 - DNA, 23 bp, Homo sapiens
tttcagaagttagtttgtatata

SEQ ID NO: 939703 - DNA, 15 bp, Homo sapiens
tttcagaattttgta

SEQ ID NO: 939704 - DNA, 21 bp, Homo sapiens
tttcagactttaaaattctaa

SEQ ID NO: 939705 - DNA, 23 bp, Homo sapiens
tttcagagacagctgatacttca

SEQ ID NO: 939706 - DNA, 15 bp, Homo sapiens
tttcagagcaggagg

SEQ ID NO: 939707 - DNA, 16 bp, Homo sapiens
tttcagagcaggaggc

SEQ ID NO: 939708 - DNA, 17 bp, Homo sapiens
tttcagagcaggaggcc

SEQ ID NO: 939709 - DNA, 18 bp, Homo sapiens
tttcagagccagcctggc

SEQ ID NO: 939710 - DNA, 13 bp, Homo sapiens
tttcagagccagt

SEQ ID NO: 939711 - DNA, 19 bp, Homo sapiens
tttcagagccagtgaagga

SEQ ID NO: 939712 - DNA, 19 bp, Homo sapiens
tttcagagcccccagccct

SEQ ID NO: 939713 - DNA, 22 bp, Homo sapiens
tttcagagcccccagccctggg

SEQ ID NO: 939714 - DNA, 14 bp, Homo sapiens
tttcagagctgagg

SEQ ID NO: 939715 - DNA, 19 bp, Homo sapiens
tttcagagggtaagtaaac

SEQ ID NO: 939716 - DNA, 14 bp, Homo sapiens
tttcagatataaaa

SEQ ID NO: 939717 - DNA, 12 bp, Homo sapiens
tttcagatgagg

SEQ ID NO: 939718 - DNA, 15 bp, Homo sapiens
tttcagatgtcttct

SEQ ID NO: 939719 - DNA, 17 bp, Homo sapiens
tttcagatgtcttctgc

SEQ ID NO: 939720 - DNA, 16 bp, Homo sapiens
tttcagattttttaaa

SEQ ID NO: 939721 - DNA, 17 bp, Homo sapiens
tttcagcacccccaccc

SEQ ID NO: 939722 - DNA, 22 bp, Homo sapiens
tttcagcacccccacccacctc

SEQ ID NO: 939723 - DNA, 16 bp, Homo sapiens
tttcagccaaagtcct

SEQ ID NO: 939724 - DNA, 18 bp, Homo sapiens
tttcagccaaggggctgc

SEQ ID NO: 939725 - DNA, 15 bp, Homo sapiens
tttcagccaatttgt

SEQ ID NO: 939726 - DNA, 19 bp, Homo sapiens
tttcagccaatttgtctcc

SEQ ID NO: 939727 - DNA, 16 bp, Homo sapiens
tttcagccatgataag

SEQ ID NO: 939728 - DNA, 22 bp, Homo sapiens
tttcaggaggctggaggaaggg

SEQ ID NO: 939729 - DNA, 19 bp, Homo sapiens
tttcaggatactctgtcag

SEQ ID NO: 939730 - DNA, 21 bp, Homo sapiens
tttcaggatactctgtcagat

SEQ ID NO: 939731 - DNA, 19 bp, Homo sapiens
tttcaggcattggatattt

SEQ ID NO: 939732 - DNA, 16 bp, Homo sapiens
tttcagggaaattaat

SEQ ID NO: 939733 - DNA, 11 bp, Homo sapiens
tttcagggacc

SEQ ID NO: 939734 - DNA, 16 bp, Homo sapiens
tttcagggacctcagg

SEQ ID NO: 939735 - DNA, 15 bp, Homo sapiens
tttcagggctggctc

SEQ ID NO: 939736 - DNA, 18 bp, Homo sapiens
tttcagggctggctcctg

SEQ ID NO: 939737 - DNA, 20 bp, Homo sapiens
tttcagggtcttggctgcct

SEQ ID NO: 939738 - DNA, 18 bp, Homo sapiens
tttcagtagaattttagt

SEQ ID NO: 939739 - DNA, 21 bp, Homo sapiens
tttcagtagaattttagtcct

SEQ ID NO: 939740 - DNA, 14 bp, Homo sapiens
tttcagtatactgt

SEQ ID NO: 939741 - DNA, 15 bp, Homo sapiens
tttcagtatactgtg

SEQ ID NO: 939742 - DNA, 17 bp, Homo sapiens
tttcagtatactgtgtg

SEQ ID NO: 939743 - DNA, 15 bp, Homo sapiens
tttcagtattttcca

SEQ ID NO: 939744 - DNA, 21 bp, Homo sapiens
tttcagtcatataaaagctat

SEQ ID NO: 939745 - DNA, 20 bp, Homo sapiens
tttcagtcccctctctctgg

SEQ ID NO: 939746 - DNA, 11 bp, Homo sapiens
tttcagtgagg

SEQ ID NO: 939747 - DNA, 23 bp, Homo sapiens
tttcagtggctggaattaaaaca

SEQ ID NO: 939748 - DNA, 12 bp, Homo sapiens
tttcagttccaa

SEQ ID NO: 939749 - DNA, 17 bp, Homo sapiens
tttcagtttttcatttg

SEQ ID NO: 939750 - DNA, 20 bp, Homo sapiens
tttcagtttttcatttgttt

SEQ ID NO: 939751 - DNA, 16 bp, Homo sapiens
tttcagtttttttaaa

SEQ ID NO: 939752 - DNA, 15 bp, Homo sapiens
tttcataaagggttg

SEQ ID NO: 939753 - DNA, 22 bp, Homo sapiens
tttcataaataaaggtgtagaa

SEQ ID NO: 939754 - DNA, 18 bp, Homo sapiens
tttcataaatcatgttgt

SEQ ID NO: 939755 - DNA, 19 bp, Homo sapiens
tttcataaggcctgccctc

SEQ ID NO: 939756 - DNA, 14 bp, Homo sapiens
tttcataagtattt

SEQ ID NO: 939757 - DNA, 18 bp, Homo sapiens
tttcataagtatttcaaa

SEQ ID NO: 939758 - DNA, 19 bp, Homo sapiens
tttcataagtatttcaaat

SEQ ID NO: 939759 - DNA, 15 bp, Homo sapiens
tttcataatcagtaa

SEQ ID NO: 939760 - DNA, 23 bp, Homo sapiens
tttcataatgaaaaactatgtca

SEQ ID NO: 939761 - DNA, 16 bp, Homo sapiens
tttcataattctgaaa

SEQ ID NO: 939762 - DNA, 17 bp, Homo sapiens
tttcataattctgaaac

SEQ ID NO: 939763 - DNA, 16 bp, Homo sapiens
tttcataatttttaaa

SEQ ID NO: 939764 - DNA, 14 bp, Homo sapiens
tttcatacacttat

SEQ ID NO: 939765 - DNA, 17 bp, Homo sapiens
tttcatacatatatata

SEQ ID NO: 939766 - DNA, 16 bp, Homo sapiens
tttcataccacttgaa

SEQ ID NO: 939767 - DNA, 19 bp, Homo sapiens
tttcatactaccctttgct

SEQ ID NO: 939768 - DNA, 14 bp, Homo sapiens
tttcatacttttct

SEQ ID NO: 939769 - DNA, 23 bp, Homo sapiens
tttcatagatttgaaaaactttt

SEQ ID NO: 939770 - DNA, 22 bp, Homo sapiens
tttcatagtttcaaatctgtaa

SEQ ID NO: 939771 - DNA, 13 bp, Homo sapiens
tttcatataaagt

SEQ ID NO: 939772 - DNA, 17 bp, Homo sapiens
tttccattaacagcaat

SEQ ID NO: 939773 - DNA, 15 bp, Homo sapiens
tttccattacaagta

SEQ ID NO: 939774 - DNA, 15 bp, Homo sapiens
tttccattctgcaga

SEQ ID NO: 939775 - DNA, 14 bp, Homo sapiens
tttccattcttctt

SEQ ID NO: 939776 - DNA, 22 bp, Homo sapiens
tttccattgtgtggcctggtgg

SEQ ID NO: 939777 - DNA, 19 bp, Homo sapiens
tttccatttatttatgaaa

SEQ ID NO: 939778 - DNA, 11 bp, Homo sapiens
tttccatttct

SEQ ID NO: 939779 - DNA, 14 bp, Homo sapiens
tttccatttgcatt

SEQ ID NO: 939780 - DNA, 15 bp, Homo sapiens
tttccatttgtatta

SEQ ID NO: 939781 - DNA, 16 bp, Homo sapiens
tttcccaaagcacttt

SEQ ID NO: 939782 - DNA, 18 bp, Homo sapiens
tttcccaaagtcctctgc

SEQ ID NO: 939783 - DNA, 14 bp, Homo sapiens
tttcccaaatgtat

SEQ ID NO: 939784 - DNA, 23 bp, Homo sapiens
tttcccacaccgtgtaaaccaaa

SEQ ID NO: 939785 - DNA, 19 bp, Homo sapiens
tttcccaccaccttggact

SEQ ID NO: 939786 - DNA, 22 bp, Homo sapiens
tttcccaccaccttggactcct

SEQ ID NO: 939787 - DNA, 13 bp, Homo sapiens
tttcccaccctcc

SEQ ID NO: 939788 - DNA, 23 bp, Homo sapiens
tttcccactcattctgaattaat

SEQ ID NO: 939789 - DNA, 17 bp, Homo sapiens
tttcccaggagaccatt

SEQ ID NO: 939790 - DNA, 22 bp, Homo sapiens
tttcccaggcccactgtgcctc

SEQ ID NO: 939791 - DNA, 21 bp, Homo sapiens
tttcccatcatcctttgttct

SEQ ID NO: 939792 - DNA, 23 bp, Homo sapiens
tttccccacccccctctctttct

SEQ ID NO: 939793 - DNA, 21 bp, Homo sapiens
tttccccaggggaaaatgaag

SEQ ID NO: 939794 - DNA, 15 bp, Homo sapiens
tttccccataactca

SEQ ID NO: 939795 - DNA, 18 bp, Homo sapiens
tttccccatctctgtctg

SEQ ID NO: 939796 - DNA, 15 bp, Homo sapiens
tttctctcagaaatg

SEQ ID NO: 939797 - DNA, 13 bp, Homo sapiens
tttctctccctcc

SEQ ID NO: 939798 - DNA, 14 bp, Homo sapiens
tttctctctcctct

SEQ ID NO: 939799 - DNA, 14 bp, Homo sapiens
tttctctctggatg

SEQ ID NO: 939800 - DNA, 21 bp, Homo sapiens
tttctctctttatacagctgt

SEQ ID NO: 939801 - DNA, 13 bp, Homo sapiens
tttctctctttct

SEQ ID NO: 939802 - DNA, 11 bp, Homo sapiens
tttctctgcca

SEQ ID NO: 939803 - DNA, 14 bp, Homo sapiens
tttctctgcctctg

SEQ ID NO: 939804 - DNA, 20 bp, Homo sapiens
tttctctgcctctgggcagc

SEQ ID NO: 939805 - DNA, 12 bp, Homo sapiens
tttctctgctgt

SEQ ID NO: 939806 - DNA, 16 bp, Homo sapiens
tttctctgcttgccta

SEQ ID NO: 939807 - DNA, 16 bp, Homo sapiens
tttctctggaaataaa

SEQ ID NO: 939808 - DNA, 16 bp, Homo sapiens
tttctctggcaaactt

SEQ ID NO: 939809 - DNA, 19 bp, Homo sapiens
tttctctggtggtcttcct

SEQ ID NO: 939810 - DNA, 14 bp, Homo sapiens
tttctctgttgtaa

SEQ ID NO: 939811 - DNA, 15 bp, Homo sapiens
tttctcttccccttc

SEQ ID NO: 939812 - DNA, 14 bp, Homo sapiens
tttctcttccctga

SEQ ID NO: 939813 - DNA, 21 bp, Homo sapiens
tttctcttccttttatataaa

SEQ ID NO: 939814 - DNA, 12 bp, Homo sapiens
tttctcttgggc

SEQ ID NO: 939815 - DNA, 21 bp, Homo sapiens
tttctcttgggctgagactgg

SEQ ID NO: 939816 - DNA, 12 bp, Homo sapiens
tttctcttgtac

SEQ ID NO: 939817 - DNA, 12 bp, Homo sapiens
tttctctttctc

SEQ ID NO: 939818 - DNA, 13 bp, Homo sapiens
tttctctttctct

SEQ ID NO: 939819 - DNA, 15 bp, Homo sapiens
tttctctttgattat

SEQ ID NO: 939820 - DNA, 21 bp, Homo sapiens
tttctctttgattatttgcat

SEQ ID NO: 939821 - DNA, 22 bp, Homo sapiens
tttctctttgattatttgcatg

SEQ ID NO: 939822 - DNA, 12 bp, Homo sapiens
tttctctttgtt

SEQ ID NO: 939823 - DNA, 20 bp, Homo sapiens
tttctcttttcccctttcct

SEQ ID NO: 939824 - DNA, 18 bp, Homo sapiens
tttctcttttggtttctg

SEQ ID NO: 939825 - DNA, 14 bp, Homo sapiens
tttctgaaaacact

SEQ ID NO: 939826 - DNA, 21 bp, Homo sapiens
tttctgaaaattccagaaagg

SEQ ID NO: 939827 - DNA, 22 bp, Homo sapiens
tttctgaaaattccagaaagga

SEQ ID NO: 939828 - DNA, 15 bp, Homo sapiens
tttctgaagctttac

SEQ ID NO: 939829 - DNA, 14 bp, Homo sapiens
tttctgaaggaaga

SEQ ID NO: 939830 - DNA, 9 bp, Homo sapiens
tttctgaat

SEQ ID NO: 939831 - DNA, 19 bp, Homo sapiens
tttctgacccactgatctc

SEQ ID NO: 939832 - DNA, 15 bp, Homo sapiens
tttctgactgtccct

SEQ ID NO: 939833 - DNA, 17 bp, Homo sapiens
tttctgactgtccctgc

SEQ ID NO: 939834 - DNA, 21 bp, Homo sapiens
tttctgacttctagctgtctg

SEQ ID NO: 939835 - DNA, 22 bp, Homo sapiens
tttctgacttctagctgtctgt

SEQ ID NO: 939836 - DNA, 19 bp, Homo sapiens
tttctgagaaggtccttaa

SEQ ID NO: 939837 - DNA, 12 bp, Homo sapiens
tttctgagattt

SEQ ID NO: 939838 - DNA, 18 bp, Homo sapiens
tttctgagatttttgata

SEQ ID NO: 939839 - DNA, 17 bp, Homo sapiens
tttctgatcgtctcggc

SEQ ID NO: 939840 - DNA, 14 bp, Homo sapiens
tttctgatggccaa

SEQ ID NO: 939841 - DNA, 21 bp, Homo sapiens
tttctgatggccaaaatacca

SEQ ID NO: 939842 - DNA, 19 bp, Homo sapiens
tttctgatggtataaacag

SEQ ID NO: 939843 - DNA, 13 bp, Homo sapiens
tttctgatgtatt

SEQ ID NO: 939844 - DNA, 18 bp, Homo sapiens
tttctgatgtattacatg

SEQ ID NO: 939845 - DNA, 19 bp, Homo sapiens
tttctgatgtattacatga

SEQ ID NO: 939846 - DNA, 13 bp, Homo sapiens
tttctgcagaaat

SEQ ID NO: 939847 - DNA, 14 bp, Homo sapiens
tttctgcagaaatt

SEQ ID NO: 939848 - DNA, 13 bp, Homo sapiens
tttctgcagccct

SEQ ID NO: 939849 - DNA, 22 bp, Homo sapiens
tttctgcatgaatatcatacaa

SEQ ID NO: 939850 - DNA, 21 bp, Homo sapiens
tttctgcatgaccaaagtgat

SEQ ID NO: 939851 - DNA, 24 bp, Homo sapiens
tttctgcatgaccaaagtgataaa

SEQ ID NO: 939852 - DNA, 12 bp, Homo sapiens
tttctgccctgg

SEQ ID NO: 939853 - DNA, 13 bp, Homo sapiens
tttctgccctggc

SEQ ID NO: 939854 - DNA, 11 bp, Homo sapiens
tttctgcctcg

SEQ ID NO: 939855 - DNA, 14 bp, Homo sapiens
tttctgctctgcca

SEQ ID NO: 939856 - DNA, 15 bp, Homo sapiens
tttctgctctggaat

SEQ ID NO: 939857 - DNA, 19 bp, Homo sapiens
tttctgctggaaacagact

SEQ ID NO: 939858 - DNA, 20 bp, Homo sapiens
tttctgctgtggtctataaa

SEQ ID NO: 939859 - DNA, 11 bp, Homo sapiens
tttctggaaat

SEQ ID NO: 939860 - DNA, 18 bp, Homo sapiens
tttctggaatacatgaaa

SEQ ID NO: 939861 - DNA, 20 bp, Homo sapiens
tttctggaatacatgaaata

SEQ ID NO: 939862 - DNA, 18 bp, Homo sapiens
tttctggactctggactt

SEQ ID NO: 939863 - DNA, 18 bp, Homo sapiens
tttctggagtgaaccaga

SEQ ID NO: 939864 - DNA, 15 bp, Homo sapiens
tttctggatttcata

SEQ ID NO: 939865 - DNA, 19 bp, Homo sapiens
tttctggccagtgtttaaa

SEQ ID NO: 939866 - DNA, 16 bp, Homo sapiens
tttctggcctgccttc

SEQ ID NO: 939867 - DNA, 15 bp, Homo sapiens
tttctggctatgcat

SEQ ID NO: 939868 - DNA, 18 bp, Homo sapiens
tttctggctatgcatttg

SEQ ID NO: 939869 - DNA, 19 bp, Homo sapiens
tttctggctggagcctaga

SEQ ID NO: 939870 - DNA, 19 bp, Homo sapiens
tttctgggatgtcacagtc

SEQ ID NO: 939871 - DNA, 20 bp, Homo sapiens
tttctgggctttctcctgga

SEQ ID NO: 939872 - DNA, 23 bp, Homo sapiens
tttctgggtccctgctccccttt

SEQ ID NO: 939873 - DNA, 15 bp, Homo sapiens
tttctgggtcttttg

SEQ ID NO: 939874 - DNA, 15 bp, Homo sapiens
tttctggtagataga

SEQ ID NO: 939875 - DNA, 12 bp, Homo sapiens
tttctggtccct

SEQ ID NO: 939876 - DNA, 10 bp, Homo sapiens
tttctggtgc

SEQ ID NO: 939877 - DNA, 15 bp, Homo sapiens
tttctggtgctgtct

SEQ ID NO: 939878 - DNA, 17 bp, Homo sapiens
tttctggtggtctgttg

SEQ ID NO: 939879 - DNA, 21 bp, Homo sapiens
tttctggtgttttatttccta

SEQ ID NO: 939880 - DNA, 13 bp, Homo sapiens
tttctggttccaa

SEQ ID NO: 939881 - DNA, 15 bp, Homo sapiens
tttctggttccaaac

SEQ ID NO: 939882 - DNA, 14 bp, Homo sapiens
tttctgtaaataac

SEQ ID NO: 939883 - DNA, 14 bp, Homo sapiens
tttctgtaacaaat

SEQ ID NO: 939884 - DNA, 19 bp, Homo sapiens
tttctgtaacaaattggga

SEQ ID NO: 939885 - DNA, 15 bp, Homo sapiens
tttctgtaccagtta

SEQ ID NO: 939886 - DNA, 18 bp, Homo sapiens
tttctgtacttcagtatg

SEQ ID NO: 939887 - DNA, 22 bp, Homo sapiens
tttctgtagaaaagaaaacatt

SEQ ID NO: 939888 - DNA, 20 bp, Homo sapiens
tttctgtagactctaagata

SEQ ID NO: 939889 - DNA, 17 bp, Homo sapiens
tttctgtatactgtaaa

SEQ ID NO: 939890 - DNA, 20 bp, Homo sapiens
tttctgtcagatgagaacaa

SEQ ID NO: 939891 - DNA, 18 bp, Homo sapiens
tttctgtcctgtaactgt

SEQ ID NO: 939892 - DNA, 23 bp, Homo sapiens
tttctgtccttttggcactgaga

SEQ ID NO: 939893 - DNA, 15 bp, Homo sapiens
tttctgtctctgcct

SEQ ID NO: 939894 - DNA, 19 bp, Homo sapiens
tttctgtgaagctaataca

SEQ ID NO: 939895 - DNA, 20 bp, Homo sapiens
tttctgtgaagctaatacaa

SEQ ID NO: 939896 - DNA, 14 bp, Homo sapiens
tttctgtgacattt

SEQ ID NO: 939897 - DNA, 20 bp, Homo sapiens
tttctgtgacatttatgtct

SEQ ID NO: 939898 - DNA, 21 bp, Homo sapiens
tttctgtgataactctgcaaa

SEQ ID NO: 939899 - DNA, 18 bp, Homo sapiens
tttctgtgccctactcat

SEQ ID NO: 939900 - DNA, 21 bp, Homo sapiens
tttctgtggatacagtgccca

SEQ ID NO: 939901 - DNA, 23 bp, Homo sapiens
tttctgtggatacagtgcccacc

SEQ ID NO: 939902 - DNA, 15 bp, Homo sapiens
tttctgtgtgtcagt

SEQ ID NO: 939903 - DNA, 21 bp, Homo sapiens
tttctgtgtgtcagttttcat

SEQ ID NO: 939904 - DNA, 22 bp, Homo sapiens
tttctgttccaaattcagtttc

SEQ ID NO: 939905 - DNA, 15 bp, Homo sapiens
tttctgttccttcct

SEQ ID NO: 939906 - DNA, 14 bp, Homo sapiens
tttctgttctagtt

SEQ ID NO: 939907 - DNA, 15 bp, Homo sapiens
tttctgttctgttga

SEQ ID NO: 939908 - DNA, 20 bp, Homo sapiens
tttctgttctttctggctat

SEQ ID NO: 939909 - DNA, 15 bp, Homo sapiens
tttctgttgaagttt

SEQ ID NO: 939910 - DNA, 15 bp, Homo sapiens
tttctgttggtgtat

SEQ ID NO: 939911 - DNA, 13 bp, Homo sapiens
tttctgttgtcat

SEQ ID NO: 939912 - DNA, 13 bp, Homo sapiens
tttctgtttcaaa

SEQ ID NO: 939913 - DNA, 17 bp, Homo sapiens
tttctgtttcttgctct

SEQ ID NO: 939914 - DNA, 17 bp, Homo sapiens
tttctgtttgtaaatta

SEQ ID NO: 939915 - DNA, 14 bp, Homo sapiens
tttctgtttgttta

SEQ ID NO: 939916 - DNA, 12 bp, Homo sapiens
tttctgttttct

SEQ ID NO: 939917 - DNA, 12 bp, Homo sapiens
tttcttaaaaat

SEQ ID NO: 939918 - DNA, 14 bp, Homo sapiens
tttcttaaaagtac

SEQ ID NO: 939919 - DNA, 21 bp, Homo sapiens
tttcttaaagtgccagtattt

SEQ ID NO: 939920 - DNA, 12 bp, Homo sapiens
tttcttaaataa

SEQ ID NO: 939921 - DNA, 24 bp, Homo sapiens
tttcttaaatatgtatatgacatt

SEQ ID NO: 939922 - DNA, 14 bp, Homo sapiens
tgcattaaaagaaa

SEQ ID NO: 939923 - DNA, 19 bp, Homo sapiens
tgcattaaaagaaaataaa

SEQ ID NO: 939924 - DNA, 15 bp, Homo sapiens
tgcattaaacctgtc

SEQ ID NO: 939925 - DNA, 21 bp, Homo sapiens
tgcattaaacctgtctccact

SEQ ID NO: 939926 - DNA, 13 bp, Homo sapiens
tgcattaaattca

SEQ ID NO: 939927 - DNA, 16 bp, Homo sapiens
tgcattaaattcacaa

SEQ ID NO: 939928 - DNA, 11 bp, Homo sapiens
tgcattacaga

SEQ ID NO: 939929 - DNA, 17 bp, Homo sapiens
tgcattactctggtgga

SEQ ID NO: 939930 - DNA, 22 bp, Homo sapiens
tgcattatatcaaatctaccac

SEQ ID NO: 939931 - DNA, 18 bp, Homo sapiens
tgcattatctagatactg

SEQ ID NO: 939932 - DNA, 13 bp, Homo sapiens
tgcattatgtatt

SEQ ID NO: 939933 - DNA, 23 bp, Homo sapiens
tgcattcacatttagaaaagtga

SEQ ID NO: 939934 - DNA, 12 bp, Homo sapiens
tgcattccagaa

SEQ ID NO: 939935 - DNA, 16 bp, Homo sapiens
tgcattccagaatctt

SEQ ID NO: 939936 - DNA, 18 bp, Homo sapiens
tgcattccagaatcttga

SEQ ID NO: 939937 - DNA, 21 bp, Homo sapiens
tgcattccttacttgcactgt

SEQ ID NO: 939938 - DNA, 23 bp, Homo sapiens
tgcattcgaagaaacccttgctg

SEQ ID NO: 939939 - DNA, 21 bp, Homo sapiens
tgcattcgttgtgttttttaa

SEQ ID NO: 939940 - DNA, 16 bp, Homo sapiens
tgcattctgagctgga

SEQ ID NO: 939941 - DNA, 16 bp, Homo sapiens
tgcattctggatttta

SEQ ID NO: 939942 - DNA, 16 bp, Homo sapiens
tgcattctgtttcctc

SEQ ID NO: 939943 - DNA, 15 bp, Homo sapiens
tgcattcttctctgt

SEQ ID NO: 939944 - DNA, 20 bp, Homo sapiens
tgcattcttctgagcactgt

SEQ ID NO: 939945 - DNA, 20 bp, Homo sapiens
tgcattctttggtaattttt

SEQ ID NO: 939946 - DNA, 22 bp, Homo sapiens
tgcattcttttaaaagacaaga

SEQ ID NO: 939947 - DNA, 13 bp, Homo sapiens
tgcattgaacaca

SEQ ID NO: 939948 - DNA, 17 bp, Homo sapiens
tgcattgaacacaaact

SEQ ID NO: 939949 - DNA, 21 bp, Homo sapiens
tgcattgaacacaaactgtaa

SEQ ID NO: 939950 - DNA, 17 bp, Homo sapiens
tgcattgagaactgcat

SEQ ID NO: 939951 - DNA, 15 bp, Homo sapiens
tgcattgctagataa

SEQ ID NO: 939952 - DNA, 16 bp, Homo sapiens
tgcattgctagataaa

SEQ ID NO: 939953 - DNA, 15 bp, Homo sapiens
tgcattgctggacta

SEQ ID NO: 939954 - DNA, 15 bp, Homo sapiens
tgcattgctggtaga

SEQ ID NO: 939955 - DNA, 19 bp, Homo sapiens
tgcattgcttttttttcct

SEQ ID NO: 939956 - DNA, 18 bp, Homo sapiens
tgcattggaagaccccac

SEQ ID NO: 939957 - DNA, 14 bp, Homo sapiens
tgcattgggcatta

SEQ ID NO: 939958 - DNA, 17 bp, Homo sapiens
tgcattgtctgtctgca

SEQ ID NO: 939959 - DNA, 17 bp, Homo sapiens
tgcattgttattgtgga

SEQ ID NO: 939960 - DNA, 15 bp, Homo sapiens
tgcatttaaaacaga

SEQ ID NO: 939961 - DNA, 20 bp, Homo sapiens
tgcatttaaaagatacagtt

SEQ ID NO: 939962 - DNA, 13 bp, Homo sapiens
tgcatttaaactc

SEQ ID NO: 939963 - DNA, 17 bp, Homo sapiens
tgcatttaaagtattct

SEQ ID NO: 939964 - DNA, 24 bp, Homo sapiens
tgcatttaaatacagtcttccatt

SEQ ID NO: 939965 - DNA, 13 bp, Homo sapiens
tgcatttaaggag

SEQ ID NO: 939966 - DNA, 20 bp, Homo sapiens
tgcatttaataaagatgagt

SEQ ID NO: 939967 - DNA, 22 bp, Homo sapiens
tgcatttaataaagatgagttg

SEQ ID NO: 939968 - DNA, 12 bp, Homo sapiens
tgcatttcaagc

SEQ ID NO: 939969 - DNA, 20 bp, Homo sapiens
tgcatttcctcgcagcctct

SEQ ID NO: 939970 - DNA, 14 bp, Homo sapiens
tgcatttcctgaca

SEQ ID NO: 939971 - DNA, 18 bp, Homo sapiens
tgcatttcctgtgtttgt

SEQ ID NO: 939972 - DNA, 21 bp, Homo sapiens
tgcatttctcttctcagctct

SEQ ID NO: 939973 - DNA, 21 bp, Homo sapiens
tgcatttggcaggaagatgta

SEQ ID NO: 939974 - DNA, 16 bp, Homo sapiens
tgcatttggtcaagat

SEQ ID NO: 939975 - DNA, 23 bp, Homo sapiens
tgcatttggtggtttcagaaatg

SEQ ID NO: 939976 - DNA, 16 bp, Homo sapiens
tgcatttgtaaaaatg

SEQ ID NO: 939977 - DNA, 16 bp, Homo sapiens
tgcatttgtaaatgct

SEQ ID NO: 939978 - DNA, 22 bp, Homo sapiens
tgcatttgtgcgtatgcagtgt

SEQ ID NO: 939979 - DNA, 17 bp, Homo sapiens
tgcattttaattttaac

SEQ ID NO: 939980 - DNA, 21 bp, Homo sapiens
tgcattttaattttaaccaaa

SEQ ID NO: 939981 - DNA, 14 bp, Homo sapiens
tgcattttaccatc

SEQ ID NO: 939982 - DNA, 13 bp, Homo sapiens
tgcattttattga

SEQ ID NO: 939983 - DNA, 11 bp, Homo sapiens
tgcattttctg

SEQ ID NO: 939984 - DNA, 17 bp, Homo sapiens
tgcattttcttcacagt

SEQ ID NO: 939985 - DNA, 19 bp, Homo sapiens
tgcattttcttcacagtgc

SEQ ID NO: 939986 - DNA, 17 bp, Homo sapiens
tgcattttcttcagaat

SEQ ID NO: 939987 - DNA, 18 bp, Homo sapiens
tgcattttcttcagaatt

SEQ ID NO: 939988 - DNA, 17 bp, Homo sapiens
tgcattttgctattgta

SEQ ID NO: 939989 - DNA, 20 bp, Homo sapiens
tgcattttgctattgtaaat

SEQ ID NO: 939990 - DNA, 21 bp, Homo sapiens
tgcattttgctgcctttatta

SEQ ID NO: 939991 - DNA, 17 bp, Homo sapiens
tgcatttttgttttgaa

SEQ ID NO: 939992 - DNA, 18 bp, Homo sapiens
tgcatttttgttttgaaa

SEQ ID NO: 939993 - DNA, 20 bp, Homo sapiens
tgcatttttgttttgaaagt

SEQ ID NO: 939994 - DNA, 20 bp, Homo sapiens
tgccaaaaaggatacataat

SEQ ID NO: 939995 - DNA, 14 bp, Homo sapiens
tgccaaaaccacat

SEQ ID NO: 939996 - DNA, 18 bp, Homo sapiens
tgccaaaaccacatgggc

SEQ ID NO: 939997 - DNA, 21 bp, Homo sapiens
tgccaaaaccacatgggctgg

SEQ ID NO: 939998 - DNA, 22 bp, Homo sapiens
tgccaaaaccacatgggctggg

SEQ ID NO: 939999 - DNA, 17 bp, Homo sapiens
tgccaaacaaaaaggtt

SEQ ID NO: 940000 - DNA, 14 bp, Homo sapiens
tgccaaagatcact

SEQ ID NO: 940001 - DNA, 21 bp, Homo sapiens
tgccaaagatcacttgttgtt

SEQ ID NO: 940002 - DNA, 20 bp, Homo sapiens
tgccaaagctagggtggccc

SEQ ID NO: 940003 - DNA, 15 bp, Homo sapiens
tgccaaaggatgtga

SEQ ID NO: 940004 - DNA, 19 bp, Homo sapiens
tgccaaaggatgtgatata

SEQ ID NO: 940005 - DNA, 12 bp, Homo sapiens
tgccaaagtagt

SEQ ID NO: 940006 - DNA, 20 bp, Homo sapiens
tgccaaagtagtcctggcag

SEQ ID NO: 940007 - DNA, 16 bp, Homo sapiens
tgccaaagtgcctggg

SEQ ID NO: 940008 - DNA, 17 bp, Homo sapiens
tgccaaagtgcctggga

SEQ ID NO: 940009 - DNA, 18 bp, Homo sapiens
tgccaaagtgcctgggaa

SEQ ID NO: 940010 - DNA, 23 bp, Homo sapiens
tgccaaagtgtctacatgtgcca

SEQ ID NO: 940011 - DNA, 18 bp, Homo sapiens
tgccaaataaaaaacaga

SEQ ID NO: 940012 - DNA, 20 bp, Homo sapiens
tgccaaatagccccagactg

SEQ ID NO: 940013 - DNA, 17 bp, Homo sapiens
tgccaaatatgtcctgg

SEQ ID NO: 940014 - DNA, 22 bp, Homo sapiens
tgccaaattattctcctatgtt

SEQ ID NO: 940015 - DNA, 23 bp, Homo sapiens
tgccaaattttggccaaagtgtt

SEQ ID NO: 940016 - DNA, 16 bp, Homo sapiens
tgccaacaccttcttg

SEQ ID NO: 940017 - DNA, 20 bp, Homo sapiens
tgccaacagttgtatgtttg

SEQ ID NO: 940018 - DNA, 22 bp, Homo sapiens
tgccaacagttgtatgtttgct

SEQ ID NO: 940019 - DNA, 16 bp, Homo sapiens
tgccaaccccacccag

SEQ ID NO: 940020 - DNA, 16 bp, Homo sapiens
tgccaacctaaaactc

SEQ ID NO: 940021 - DNA, 16 bp, Homo sapiens
tgccaactaagccctc

SEQ ID NO: 940022 - DNA, 18 bp, Homo sapiens
tgccaactaagccctcga

SEQ ID NO: 940023 - DNA, 13 bp, Homo sapiens
tgccaacttccca

SEQ ID NO: 940024 - DNA, 16 bp, Homo sapiens
tgccaacttgccatgt

SEQ ID NO: 940025 - DNA, 16 bp, Homo sapiens
tgccaagaaaatgaag

SEQ ID NO: 940026 - DNA, 12 bp, Homo sapiens
tgccaagacaaa

SEQ ID NO: 940027 - DNA, 13 bp, Homo sapiens
tgccaagacaaat

SEQ ID NO: 940028 - DNA, 17 bp, Homo sapiens
tgccaagacaaatcaac

SEQ ID NO: 940029 - DNA, 23 bp, Homo sapiens
tgccaagacaaatcaacagaagc

SEQ ID NO: 940030 - DNA, 15 bp, Homo sapiens
tgccaagcagtgcac

SEQ ID NO: 940031 - DNA, 15 bp, Homo sapiens
tgccaagctgaagct

SEQ ID NO: 940032 - DNA, 18 bp, Homo sapiens
tgccaagcttcctgtgcc

SEQ ID NO: 940033 - DNA, 21 bp, Homo sapiens
tgccaagcttcctgtgccctc

SEQ ID NO: 940034 - DNA, 16 bp, Homo sapiens
tgccaaggcagaggcc

SEQ ID NO: 940035 - DNA, 16 bp, Homo sapiens
tgccaagggccccagg

SEQ ID NO: 940036 - DNA, 18 bp, Homo sapiens
tgccaagggggtgactgg

SEQ ID NO: 940037 - DNA, 15 bp, Homo sapiens
tgccaagtgcctgct

SEQ ID NO: 940038 - DNA, 19 bp, Homo sapiens
tgccaagtggacttggagc

SEQ ID NO: 940039 - DNA, 18 bp, Homo sapiens
tgccaagttgctgtcact

SEQ ID NO: 940040 - DNA, 21 bp, Homo sapiens
tgccaagttgctgtcactgtt

SEQ ID NO: 940041 - DNA, 13 bp, Homo sapiens
tgccaagtttgtt

SEQ ID NO: 940042 - DNA, 23 bp, Homo sapiens
tgccaataaaagttttctccaac

SEQ ID NO: 940043 - DNA, 14 bp, Homo sapiens
tgccaataaagtga

SEQ ID NO: 940044 - DNA, 14 bp, Homo sapiens
tgccagcaactgaa

SEQ ID NO: 940045 - DNA, 13 bp, Homo sapiens
tgccagcacagag

SEQ ID NO: 940046 - DNA, 14 bp, Homo sapiens
tgacctcttgctgt

SEQ ID NO: 940047 - DNA, 23 bp, Homo sapiens
tgacctgaggagacatctacaca

SEQ ID NO: 940048 - DNA, 13 bp, Homo sapiens
tgacctgatttca

SEQ ID NO: 940049 - DNA, 15 bp, Homo sapiens
tgacctgatttcaga

SEQ ID NO: 940050 - DNA, 16 bp, Homo sapiens
tgacctgcattgtaaa

SEQ ID NO: 940051 - DNA, 18 bp, Homo sapiens
tgacctgcattgtaaata

SEQ ID NO: 940052 - DNA, 17 bp, Homo sapiens
tgacctgctccgctgct

SEQ ID NO: 940053 - DNA, 23 bp, Homo sapiens
tgacctgctccgctgctccttgg

SEQ ID NO: 940054 - DNA, 11 bp, Homo sapiens
tgacctgctga

SEQ ID NO: 940055 - DNA, 13 bp, Homo sapiens
tgacctgctgaat

SEQ ID NO: 940056 - DNA, 20 bp, Homo sapiens
tgacctgggcccacagagcc

SEQ ID NO: 940057 - DNA, 21 bp, Homo sapiens
tgacctgggcccacagagcct

SEQ ID NO: 940058 - DNA, 22 bp, Homo sapiens
tgacctgggtatcccctgcctc

SEQ ID NO: 940059 - DNA, 12 bp, Homo sapiens
tgacctgtcacc

SEQ ID NO: 940060 - DNA, 19 bp, Homo sapiens
tgacctgtcatgcccccct

SEQ ID NO: 940061 - DNA, 22 bp, Homo sapiens
tgacctgtgaccagcactgtct

SEQ ID NO: 940062 - DNA, 19 bp, Homo sapiens
tgacctgtggggatttctc

SEQ ID NO: 940063 - DNA, 23 bp, Homo sapiens
tgacctgtggggatttctcccag

SEQ ID NO: 940064 - DNA, 15 bp, Homo sapiens
tgacctgtttctctt

SEQ ID NO: 940065 - DNA, 15 bp, Homo sapiens
tgaccttagcgttct

SEQ ID NO: 940066 - DNA, 14 bp, Homo sapiens
tgaccttccttcct

SEQ ID NO: 940067 - DNA, 15 bp, Homo sapiens
tgaccttgctgccac

SEQ ID NO: 940068 - DNA, 14 bp, Homo sapiens
tgacctttgacctc

SEQ ID NO: 940069 - DNA, 18 bp, Homo sapiens
tgacctttgacctcggtg

SEQ ID NO: 940070 - DNA, 15 bp, Homo sapiens
tgacctttgtcttct

SEQ ID NO: 940071 - DNA, 17 bp, Homo sapiens
tgaccttttatgtagta

SEQ ID NO: 940072 - DNA, 18 bp, Homo sapiens
tgaccttttatgtagtaa

SEQ ID NO: 940073 - DNA, 23 bp, Homo sapiens
tgaccttttatgtagtaattgac

SEQ ID NO: 940074 - DNA, 18 bp, Homo sapiens
tgacgaaactggccccgg

SEQ ID NO: 940075 - DNA, 15 bp, Homo sapiens
tgacgacaagtgctg

SEQ ID NO: 940076 - DNA, 20 bp, Homo sapiens
tgacgcaccactgccaatgc

SEQ ID NO: 940077 - DNA, 14 bp, Homo sapiens
tgacgcagccggag

SEQ ID NO: 940078 - DNA, 17 bp, Homo sapiens
tgacgcccaccttcggg

SEQ ID NO: 940079 - DNA, 14 bp, Homo sapiens
tgacgcccagctcc

SEQ ID NO: 940080 - DNA, 21 bp, Homo sapiens
tgacgcctgagacagcaccac

SEQ ID NO: 940081 - DNA, 18 bp, Homo sapiens
tgacgcttgtgacagtgc

SEQ ID NO: 940082 - DNA, 21 bp, Homo sapiens
tgacgcttgtgacagtgcctc

SEQ ID NO: 940083 - DNA, 14 bp, Homo sapiens
tgacggaagaacat

SEQ ID NO: 940084 - DNA, 20 bp, Homo sapiens
tgacggctggggacccaccc

SEQ ID NO: 940085 - DNA, 19 bp, Homo sapiens
tgacgggccgcaggaggga

SEQ ID NO: 940086 - DNA, 20 bp, Homo sapiens
tgacgggccgcaggagggag

SEQ ID NO: 940087 - DNA, 16 bp, Homo sapiens
tgacggggtgtgtggc

SEQ ID NO: 940088 - DNA, 21 bp, Homo sapiens
tgacggtcccacactggtgac

SEQ ID NO: 940089 - DNA, 20 bp, Homo sapiens
tgacggtcctttaggcagcc

SEQ ID NO: 940090 - DNA, 17 bp, Homo sapiens
tgacggtgcagtctggg

SEQ ID NO: 940091 - DNA, 19 bp, Homo sapiens
tgacgtctagctatgctgt

SEQ ID NO: 940092 - DNA, 14 bp, Homo sapiens
tgacgtctgaagct

SEQ ID NO: 940093 - DNA, 19 bp, Homo sapiens
tgacgtgcacctgtactca

SEQ ID NO: 940094 - DNA, 14 bp, Homo sapiens
tgacgtgcactgtg

SEQ ID NO: 940095 - DNA, 16 bp, Homo sapiens
tgacgtgccttttgca

SEQ ID NO: 940096 - DNA, 19 bp, Homo sapiens
tgacgtgccttttgcaccc

SEQ ID NO: 940097 - DNA, 13 bp, Homo sapiens
tgacgtgggcatc

SEQ ID NO: 940098 - DNA, 18 bp, Homo sapiens
tgacgtgggcatcatttt

SEQ ID NO: 940099 - DNA, 14 bp, Homo sapiens
tgacgtttcttctt

SEQ ID NO: 940100 - DNA, 19 bp, Homo sapiens
tgacgtttcttctttctag

SEQ ID NO: 940101 - DNA, 19 bp, Homo sapiens
tgactaaactttttttctg

SEQ ID NO: 940102 - DNA, 17 bp, Homo sapiens
tgactaagaattttgtt

SEQ ID NO: 940103 - DNA, 20 bp, Homo sapiens
tgactaagaattttgtttta

SEQ ID NO: 940104 - DNA, 14 bp, Homo sapiens
tgactaatgctttt

SEQ ID NO: 940105 - DNA, 11 bp, Homo sapiens
tgactaattag

SEQ ID NO: 940106 - DNA, 15 bp, Homo sapiens
tgactaattttacat

SEQ ID NO: 940107 - DNA, 22 bp, Homo sapiens
tgactaattttacatgtttata

SEQ ID NO: 940108 - DNA, 17 bp, Homo sapiens
tgactactactctgcca

SEQ ID NO: 940109 - DNA, 16 bp, Homo sapiens
tgactagcgcctggcc

SEQ ID NO: 940110 - DNA, 22 bp, Homo sapiens
tgactaggcatacactgtagtt

SEQ ID NO: 940111 - DNA, 17 bp, Homo sapiens
tgactagggattcaggc

SEQ ID NO: 940112 - DNA, 16 bp, Homo sapiens
tgactatatagagatg

SEQ ID NO: 940113 - DNA, 18 bp, Homo sapiens
tgactatatagagatgtt

SEQ ID NO: 940114 - DNA, 22 bp, Homo sapiens
tgactatcaaactgaagccaga

SEQ ID NO: 940115 - DNA, 12 bp, Homo sapiens
tgactatgtaaa

SEQ ID NO: 940116 - DNA, 20 bp, Homo sapiens
tgactattgaagttgcagat

SEQ ID NO: 940117 - DNA, 14 bp, Homo sapiens
tgactcaaagtctg

SEQ ID NO: 940118 - DNA, 14 bp, Homo sapiens
tgactcaacatgtt

SEQ ID NO: 940119 - DNA, 15 bp, Homo sapiens
tgactcaacatgtta

SEQ ID NO: 940120 - DNA, 19 bp, Homo sapiens
tgactcacaagaagaccag

SEQ ID NO: 940121 - DNA, 17 bp, Homo sapiens
tgactcagcagaggcag

SEQ ID NO: 940122 - DNA, 20 bp, Homo sapiens
tgactcagcagaggcagtgg

SEQ ID NO: 940123 - DNA, 13 bp, Homo sapiens
tgactcagggctc

SEQ ID NO: 940124 - DNA, 14 bp, Homo sapiens
tgactcatccccac

SEQ ID NO: 940125 - DNA, 18 bp, Homo sapiens
tgactcatccccacagct

SEQ ID NO: 940126 - DNA, 22 bp, Homo sapiens
tgactcatccccacagctggct

SEQ ID NO: 940127 - DNA, 23 bp, Homo sapiens
tggaggaccccgagggctgagga

SEQ ID NO: 940128 - DNA, 15 bp, Homo sapiens
tggaggaccgttctc

SEQ ID NO: 940129 - DNA, 20 bp, Homo sapiens
tggaggacctttaggtcaaa

SEQ ID NO: 940130 - DNA, 14 bp, Homo sapiens
tggaggagaagaat

SEQ ID NO: 940131 - DNA, 21 bp, Homo sapiens
tggaggagaagaattttcaga

SEQ ID NO: 940132 - DNA, 15 bp, Homo sapiens
tggaggagaggagac

SEQ ID NO: 940133 - DNA, 22 bp, Homo sapiens
tggaggagcagcttccttctgg

SEQ ID NO: 940134 - DNA, 14 bp, Homo sapiens
tggaggagctgagg

SEQ ID NO: 940135 - DNA, 14 bp, Homo sapiens
tggaggaggaggag

SEQ ID NO: 940136 - DNA, 23 bp, Homo sapiens
tggaggaggaggaggagccttgc

SEQ ID NO: 940137 - DNA, 19 bp, Homo sapiens
tggaggaggggaagctggg

SEQ ID NO: 940138 - DNA, 21 bp, Homo sapiens
tggaggatgaatagatgtgat

SEQ ID NO: 940139 - DNA, 20 bp, Homo sapiens
tggaggatggagagagggga

SEQ ID NO: 940140 - DNA, 18 bp, Homo sapiens
tggaggattatcagtatc

SEQ ID NO: 940141 - DNA, 19 bp, Homo sapiens
tggaggattctttccccag

SEQ ID NO: 940142 - DNA, 13 bp, Homo sapiens
tggaggcaagagg

SEQ ID NO: 940143 - DNA, 16 bp, Homo sapiens
tggaggcaagagggag

SEQ ID NO: 940144 - DNA, 20 bp, Homo sapiens
tggaggcaatcctaccttgc

SEQ ID NO: 940145 - DNA, 13 bp, Homo sapiens
tggaggcacttta

SEQ ID NO: 940146 - DNA, 14 bp, Homo sapiens
tggaggcagagacc

SEQ ID NO: 940147 - DNA, 20 bp, Homo sapiens
tggaggcagatgtggggctg

SEQ ID NO: 940148 - DNA, 11 bp, Homo sapiens
tggaggcaggg

SEQ ID NO: 940149 - DNA, 21 bp, Homo sapiens
tggaggcaggggacaagggag

SEQ ID NO: 940150 - DNA, 21 bp, Homo sapiens
tggatacagtgcccaccgccc

SEQ ID NO: 940151 - DNA, 17 bp, Homo sapiens
tggatacataaagacta

SEQ ID NO: 940152 - DNA, 18 bp, Homo sapiens
tggatacatacaccagca

SEQ ID NO: 940153 - DNA, 15 bp, Homo sapiens
tggatacatctgctg

SEQ ID NO: 940154 - DNA, 17 bp, Homo sapiens
tggataccagctcaggg

SEQ ID NO: 940155 - DNA, 13 bp, Homo sapiens
tggataccattat

SEQ ID NO: 940156 - DNA, 15 bp, Homo sapiens
tggatacttggattt

SEQ ID NO: 940157 - DNA, 17 bp, Homo sapiens
tggatagttaagggctt

SEQ ID NO: 940158 - DNA, 13 bp, Homo sapiens
tggatatagaaaa

SEQ ID NO: 940159 - DNA, 17 bp, Homo sapiens
tggatatagttttactt

SEQ ID NO: 940160 - DNA, 20 bp, Homo sapiens
tggatatcagggtataaatt

SEQ ID NO: 940161 - DNA, 12 bp, Homo sapiens
tggatatgaccc

SEQ ID NO: 940162 - DNA, 22 bp, Homo sapiens
tggatatttttgtacttgattt

SEQ ID NO: 940163 - DNA, 20 bp, Homo sapiens
tggatcaagcttgtgtactt

SEQ ID NO: 940164 - DNA, 20 bp, Homo sapiens
tggatcacacctcagtggga

SEQ ID NO: 940165 - DNA, 21 bp, Homo sapiens
tggatcacacctcagtgggaa

SEQ ID NO: 940166 - DNA, 23 bp, Homo sapiens
tggatcacacctcagtgggaaga

SEQ ID NO: 940167 - DNA, 15 bp, Homo sapiens
tggatcacagctgct

SEQ ID NO: 940168 - DNA, 20 bp, Homo sapiens
tggatcacagctgctttctg

SEQ ID NO: 940169 - DNA, 19 bp, Homo sapiens
tggatcacgacgctgcaga

SEQ ID NO: 940170 - DNA, 19 bp, Homo sapiens
tggatcataagacaatgga

SEQ ID NO: 940171 - DNA, 21 bp, Homo sapiens
tggatccatcttgagccacag

SEQ ID NO: 940172 - DNA, 23 bp, Homo sapiens
tggatcctagccttatcctctga

SEQ ID NO: 940173 - DNA, 18 bp, Homo sapiens
tggatcctgggctgggtg

SEQ ID NO: 940174 - DNA, 15 bp, Homo sapiens
tggatctacctggag

SEQ ID NO: 940175 - DNA, 16 bp, Homo sapiens
tggatctacctggagg

SEQ ID NO: 940176 - DNA, 16 bp, Homo sapiens
tggatctatccctgcg

SEQ ID NO: 940177 - DNA, 14 bp, Homo sapiens
tggatctccaagga

SEQ ID NO: 940178 - DNA, 15 bp, Homo sapiens
tggatttgcatattt

SEQ ID NO: 940179 - DNA, 14 bp, Homo sapiens
tggattttaaatgt

SEQ ID NO: 940180 - DNA, 16 bp, Homo sapiens
tggattttctactgta

SEQ ID NO: 940181 - DNA, 16 bp, Homo sapiens
tggattttggcagggc

SEQ ID NO: 940182 - DNA, 17 bp, Homo sapiens
tggattttggcagggcg

SEQ ID NO: 940183 - DNA, 17 bp, Homo sapiens
tggattttgtagatgtt

SEQ ID NO: 940184 - DNA, 18 bp, Homo sapiens
tggatttttctttaactg

SEQ ID NO: 940185 - DNA, 19 bp, Homo sapiens
tggatttttgactctggca

SEQ ID NO: 940186 - DNA, 17 bp, Homo sapiens
tggatttttgtcttgtg

SEQ ID NO: 940187 - DNA, 22 bp, Homo sapiens
tggattttttatgtacaaccct

SEQ ID NO: 940188 - DNA, 18 bp, Homo sapiens
tggcaaaaaaaaaaaagc

SEQ ID NO: 940189 - DNA, 17 bp, Homo sapiens
tggcaaaaatggctaga

SEQ ID NO: 940190 - DNA, 20 bp, Homo sapiens
tggcaaaaggatctttgtgg

SEQ ID NO: 940191 - DNA, 21 bp, Homo sapiens
tggcaaaaggatctttgtggc

SEQ ID NO: 940192 - DNA, 14 bp, Homo sapiens
tggcaaaccctccc

SEQ ID NO: 940193 - DNA, 16 bp, Homo sapiens
tggcaaaccctcccag

SEQ ID NO: 940194 - DNA, 17 bp, Homo sapiens
tggcaaacgctaaagag

SEQ ID NO: 940195 - DNA, 18 bp, Homo sapiens
tggcaaagcagaatgtga

SEQ ID NO: 940196 - DNA, 16 bp, Homo sapiens
tggcaaagcttttaga

SEQ ID NO: 940197 - DNA, 17 bp, Homo sapiens
tggcaaatcaggggcca

SEQ ID NO: 940198 - DNA, 23 bp, Homo sapiens
tggcaaatcctgtcggtctccag

SEQ ID NO: 940199 - DNA, 23 bp, Homo sapiens
tggcaaatgtaactgtgccagtt

SEQ ID NO: 940200 - DNA, 17 bp, Homo sapiens
tggcaaattaacttgag

SEQ ID NO: 940201 - DNA, 19 bp, Homo sapiens
tggcaaattttaaaacatt

SEQ ID NO: 940202 - DNA, 19 bp, Homo sapiens
tggcaagaaagctggtaaa

SEQ ID NO: 940203 - DNA, 17 bp, Homo sapiens
tggcaagagcagatact

SEQ ID NO: 940204 - DNA, 19 bp, Homo sapiens
tggcaagagtgtggaggct

SEQ ID NO: 940205 - DNA, 17 bp, Homo sapiens
tggcaagataaacactt

SEQ ID NO: 940206 - DNA, 17 bp, Homo sapiens
tggcaagatgaaataat

SEQ ID NO: 940207 - DNA, 18 bp, Homo sapiens
tggcaagatgaaataatt

SEQ ID NO: 940208 - DNA, 23 bp, Homo sapiens
tggcaagcagggaaagctccacg

SEQ ID NO: 940209 - DNA, 13 bp, Homo sapiens
tggcaagctgtga

SEQ ID NO: 940210 - DNA, 15 bp, Homo sapiens
tggcatggctccagt

SEQ ID NO: 940211 - DNA, 16 bp, Homo sapiens
tggcatggctccagtc

SEQ ID NO: 940212 - DNA, 17 bp, Homo sapiens
tggcatgggcgcaggcc

SEQ ID NO: 940213 - DNA, 19 bp, Homo sapiens
tggcatgggcgcaggccca

SEQ ID NO: 940214 - DNA, 20 bp, Homo sapiens
tggcatgggcgcaggcccag

SEQ ID NO: 940215 - DNA, 22 bp, Homo sapiens
tggcatgttttgtgcatttgta

SEQ ID NO: 940216 - DNA, 21 bp, Homo sapiens
tggcattaaaccacatcatgg

SEQ ID NO: 940217 - DNA, 16 bp, Homo sapiens
tggcattaattattaa

SEQ ID NO: 940218 - DNA, 13 bp, Homo sapiens
tggcattatgtcc

SEQ ID NO: 940219 - DNA, 23 bp, Homo sapiens
tggcattatgtccactgtgtata

SEQ ID NO: 940220 - DNA, 21 bp, Homo sapiens
tggcatttcaattcctggccc

SEQ ID NO: 940221 - DNA, 23 bp, Homo sapiens
tggcatttcaattcctggccctg

SEQ ID NO: 940222 - DNA, 13 bp, Homo sapiens
tggcatttccaaa

SEQ ID NO: 940223 - DNA, 14 bp, Homo sapiens
tggcatttccaaac

SEQ ID NO: 940224 - DNA, 18 bp, Homo sapiens
tggcatttccaaacatcc

SEQ ID NO: 940225 - DNA, 12 bp, Homo sapiens
tggcatttctat

SEQ ID NO: 940226 - DNA, 18 bp, Homo sapiens
tggcatttctctttaaac

SEQ ID NO: 940227 - DNA, 15 bp, Homo sapiens
tggcatttgcaataa

SEQ ID NO: 940228 - DNA, 21 bp, Homo sapiens
tggcatttgctgatttctagt

SEQ ID NO: 940229 - DNA, 18 bp, Homo sapiens
tggcatttggtctcaggc

SEQ ID NO: 940230 - DNA, 22 bp, Homo sapiens
tggcatttggtctcaggcagca

SEQ ID NO: 940231 - DNA, 17 bp, Homo sapiens
tggcatttgttatcctc

SEQ ID NO: 940232 - DNA, 22 bp, Homo sapiens
tggccaaaggaccgttttgtat

SEQ ID NO: 940233 - DNA, 14 bp, Homo sapiens
tggccaaagtgtta

SEQ ID NO: 940234 - DNA, 14 bp, Homo sapiens
tggccaaatatgca

SEQ ID NO: 940235 - DNA, 17 bp, Homo sapiens
tggccaaatatgcactt

SEQ ID NO: 940236 - DNA, 20 bp, Homo sapiens
tggccaaattatttgtgtaa

SEQ ID NO: 940237 - DNA, 23 bp, Homo sapiens
tggccaacagggtagatttctct

SEQ ID NO: 940238 - DNA, 22 bp, Homo sapiens
tggccaacatcgtgaaaccctg

SEQ ID NO: 940239 - DNA, 22 bp, Homo sapiens
tggccaacattgtaaaacccca

SEQ ID NO: 940240 - DNA, 12 bp, Homo sapiens
tggccaaccagg

SEQ ID NO: 940241 - DNA, 17 bp, Homo sapiens
tggccaaccaggaccca

SEQ ID NO: 940242 - DNA, 21 bp, Homo sapiens
tggccaaccaggacccagggt

SEQ ID NO: 940243 - DNA, 13 bp, Homo sapiens
tggccaagaagca

SEQ ID NO: 940244 - DNA, 13 bp, Homo sapiens
tggccaagcagaa

SEQ ID NO: 940245 - DNA, 13 bp, Homo sapiens
tggccaagcctgc

SEQ ID NO: 940246 - DNA, 16 bp, Homo sapiens
tggccaagggggtgga

SEQ ID NO: 940247 - DNA, 20 bp, Homo sapiens
tggccaaggtgaatagcaca

SEQ ID NO: 940248 - DNA, 21 bp, Homo sapiens
tggccaaggtgtccagggtcc

SEQ ID NO: 940249 - DNA, 22 bp, Homo sapiens
tggccaatgcacctaaagaaaa

SEQ ID NO: 940250 - DNA, 14 bp, Homo sapiens
tggccacaactgct

SEQ ID NO: 940251 - DNA, 20 bp, Homo sapiens
tggccacaactgctgtggcc

SEQ ID NO: 940252 - DNA, 22 bp, Homo sapiens
tggccacaccacagcaagccgg

SEQ ID NO: 940253 - DNA, 13 bp, Homo sapiens
tggccacagactg

SEQ ID NO: 940254 - DNA, 23 bp, Homo sapiens
tggccacagcaagtacagcggct

SEQ ID NO: 940255 - DNA, 12 bp, Homo sapiens
tggccacagcac

SEQ ID NO: 940256 - DNA, 14 bp, Homo sapiens
tggccacagccccc

SEQ ID NO: 940257 - DNA, 16 bp, Homo sapiens
tggccacagccccctt

SEQ ID NO: 940258 - DNA, 17 bp, Homo sapiens
tggccacagtagtcttg

SEQ ID NO: 940259 - DNA, 19 bp, Homo sapiens
tggccaccagccatcctcc

SEQ ID NO: 940260 - DNA, 17 bp, Homo sapiens
tggccaccaggctggcg

SEQ ID NO: 940261 - DNA, 23 bp, Homo sapiens
tggccaccaggctggcgcagcca

SEQ ID NO: 940262 - DNA, 11 bp, Homo sapiens
tggccaccagt

SEQ ID NO: 940263 - DNA, 16 bp, Homo sapiens
tggccaccccgtgcca

SEQ ID NO: 940264 - DNA, 20 bp, Homo sapiens
tggccaccccgtgccacccg

SEQ ID NO: 940265 - DNA, 19 bp, Homo sapiens
tggccacccgttctgctgg

SEQ ID NO: 940266 - DNA, 21 bp, Homo sapiens
tggccacctgaggtgggccca

SEQ ID NO: 940267 - DNA, 14 bp, Homo sapiens
tggccaccttgctt

SEQ ID NO: 940268 - DNA, 14 bp, Homo sapiens
tggccacgaggtta

SEQ ID NO: 940269 - DNA, 18 bp, Homo sapiens
tggccacgttcagggagg

SEQ ID NO: 940270 - DNA, 19 bp, Homo sapiens
tggccactaagcagaggag

SEQ ID NO: 940271 - DNA, 20 bp, Homo sapiens
tggccactatcacatatgct

SEQ ID NO: 940272 - DNA, 18 bp, Homo sapiens
tggccactccgagaggtg

SEQ ID NO: 940273 - DNA, 15 bp, Homo sapiens
tggccactgaaaagc

SEQ ID NO: 940274 - DNA, 14 bp, Homo sapiens
tggccactgctccc

SEQ ID NO: 940275 - DNA, 20 bp, Homo sapiens
tggccactgctccctaagcc

SEQ ID NO: 940276 - DNA, 19 bp, Homo sapiens
tggccactgggtctcactc

SEQ ID NO: 940277 - DNA, 21 bp, Homo sapiens
tggccactgggtctcactcct

SEQ ID NO: 940278 - DNA, 15 bp, Homo sapiens
tggccagacgctgcc

SEQ ID NO: 940279 - DNA, 13 bp, Homo sapiens
tggccagagaggg

SEQ ID NO: 940280 - DNA, 13 bp, Homo sapiens
tggccagagcctc

SEQ ID NO: 940281 - DNA, 16 bp, Homo sapiens
tggccagagcctctgg

SEQ ID NO: 940282 - DNA, 17 bp, Homo sapiens
tggccagagcctctggc

SEQ ID NO: 940283 - DNA, 18 bp, Homo sapiens
tggccagagcctctggcc

SEQ ID NO: 940284 - DNA, 19 bp, Homo sapiens
tggccagagcctctggccc

SEQ ID NO: 940285 - DNA, 21 bp, Homo sapiens
tggccagagcctctggcccct

SEQ ID NO: 940286 - DNA, 20 bp, Homo sapiens
tggccagagctggaaggcag

SEQ ID NO: 940287 - DNA, 22 bp, Homo sapiens
tggccagagctggaaggcaggg

SEQ ID NO: 940288 - DNA, 23 bp, Homo sapiens
tggccagagctggaaggcagggc

SEQ ID NO: 940289 - DNA, 17 bp, Homo sapiens
tggccagatgcggggac

SEQ ID NO: 940290 - DNA, 19 bp, Homo sapiens
tggccagatgcggggacag

SEQ ID NO: 940291 - DNA, 14 bp, Homo sapiens
tggccagcaccctc

SEQ ID NO: 940292 - DNA, 15 bp, Homo sapiens
tggccagcccctggg

SEQ ID NO: 940293 - DNA, 12 bp, Homo sapiens
tggccagcccgg

SEQ ID NO: 940294 - DNA, 16 bp, Homo sapiens
tggccagcccggctgg

SEQ ID NO: 940295 - DNA, 20 bp, Homo sapiens
tggccagcccggctggtttt

SEQ ID NO: 940296 - DNA, 16 bp, Homo sapiens
tggccagcctggatct

SEQ ID NO: 940297 - DNA, 20 bp, Homo sapiens
tggccagcgccagggcccag

SEQ ID NO: 940298 - DNA, 21 bp, Homo sapiens
tggccagcgccagggcccagg

SEQ ID NO: 940299 - DNA, 18 bp, Homo sapiens
tggccagctctgagggga

SEQ ID NO: 940300 - DNA, 23 bp, Homo sapiens
tggccagctctgaggggaggcac

SEQ ID NO: 940301 - DNA, 12 bp, Homo sapiens
tggccaggagca

SEQ ID NO: 940302 - DNA, 14 bp, Homo sapiens
tggccaggagctct

SEQ ID NO: 940303 - DNA, 18 bp, Homo sapiens
tggccaggcactgccttc

SEQ ID NO: 940304 - DNA, 22 bp, Homo sapiens
tggccagggaggcgcagggaca

SEQ ID NO: 940305 - DNA, 20 bp, Homo sapiens
tggccagggccacgctccag

SEQ ID NO: 940306 - DNA, 16 bp, Homo sapiens
tggccagggcttcccc

SEQ ID NO: 940307 - DNA, 21 bp, Homo sapiens
tggccagggcttccccatcag

SEQ ID NO: 940308 - DNA, 19 bp, Homo sapiens
tggccaggtggccactcca

SEQ ID NO: 940309 - DNA, 23 bp, Homo sapiens
tggccagtcctggtcctggctgc

SEQ ID NO: 940310 - DNA, 17 bp, Homo sapiens
tggccagtgagaagctg

SEQ ID NO: 940311 - DNA, 11 bp, Homo sapiens
tggccagtgct

SEQ ID NO: 940312 - DNA, 14 bp, Homo sapiens
tggccagtgctgct

SEQ ID NO: 940313 - DNA, 17 bp, Homo sapiens
tggccagtgctgcttct

SEQ ID NO: 940314 - DNA, 15 bp, Homo sapiens
tggccatagaggccc

SEQ ID NO: 940315 - DNA, 16 bp, Homo sapiens
tggccatagaggccca

SEQ ID NO: 940316 - DNA, 18 bp, Homo sapiens
tggccatagaggcccagg

SEQ ID NO: 940317 - DNA, 19 bp, Homo sapiens
tggccataggagaggaggg

SEQ ID NO: 940318 - DNA, 21 bp, Homo sapiens
tggccatatatgctgtatttc

SEQ ID NO: 940319 - DNA, 14 bp, Homo sapiens
tggccatcactcag

SEQ ID NO: 940320 - DNA, 18 bp, Homo sapiens
tggccatcactcagcccc

SEQ ID NO: 940321 - DNA, 13 bp, Homo sapiens
tggccatccctgg

SEQ ID NO: 940322 - DNA, 20 bp, Homo sapiens
tggccatccctgggcccctc

SEQ ID NO: 940323 - DNA, 21 bp, Homo sapiens
tggccatcctacccagcgtgg

SEQ ID NO: 940324 - DNA, 17 bp, Homo sapiens
tggccatctccctcccc

SEQ ID NO: 940325 - DNA, 20 bp, Homo sapiens
tggccatctccctccccaga

SEQ ID NO: 940326 - DNA, 14 bp, Homo sapiens
tggccatgccctag

SEQ ID NO: 940327 - DNA, 15 bp, Homo sapiens
tggccatgccctaga

SEQ ID NO: 940328 - DNA, 21 bp, Homo sapiens
tggccatgccctagaccctcc

SEQ ID NO: 940329 - DNA, 12 bp, Homo sapiens
tggccatgctca

SEQ ID NO: 940330 - DNA, 21 bp, Homo sapiens
tggcctaaacctcagttatta

SEQ ID NO: 940331 - DNA, 19 bp, Homo sapiens
tggcctacaaatcagtaat

SEQ ID NO: 940332 - DNA, 15 bp, Homo sapiens
tggcctacattcttt

SEQ ID NO: 940333 - DNA, 14 bp, Homo sapiens
tggcctagagcact

SEQ ID NO: 940334 - DNA, 21 bp, Homo sapiens
tggcctaggagatatctgagg

SEQ ID NO: 940335 - DNA, 15 bp, Homo sapiens
tggcctatccgctgc

SEQ ID NO: 940336 - DNA, 18 bp, Homo sapiens
tggcctcaaaacagaagc

SEQ ID NO: 940337 - DNA, 15 bp, Homo sapiens
tggcctcaaagcaag

SEQ ID NO: 940338 - DNA, 14 bp, Homo sapiens
tggcctcaaccctc

SEQ ID NO: 940339 - DNA, 18 bp, Homo sapiens
tggcctcaaccctccctc

SEQ ID NO: 940340 - DNA, 19 bp, Homo sapiens
tggcctcaaccctccctca

SEQ ID NO: 940341 - DNA, 23 bp, Homo sapiens
tggcctcaaccctccctcagccc

SEQ ID NO: 940342 - DNA, 15 bp, Homo sapiens
tggcctcacccaccc

SEQ ID NO: 940343 - DNA, 13 bp, Homo sapiens
tggcctcactggc

SEQ ID NO: 940344 - DNA, 23 bp, Homo sapiens
tggcctcactggctggggcagag

SEQ ID NO: 940345 - DNA, 23 bp, Homo sapiens
tggcctcacttgattcatctctg

SEQ ID NO: 940346 - DNA, 13 bp, Homo sapiens
tggcctcagccct

SEQ ID NO: 940347 - DNA, 15 bp, Homo sapiens
tggcctcagccctca

SEQ ID NO: 940348 - DNA, 16 bp, Homo sapiens
tggcctcagccctcag

SEQ ID NO: 940349 - DNA, 22 bp, Homo sapiens
tggcctcagctgaatgcctcct

SEQ ID NO: 940350 - DNA, 14 bp, Homo sapiens
tggcctcagctgcc

SEQ ID NO: 940351 - DNA, 17 bp, Homo sapiens
tggcctcagctgcctca

SEQ ID NO: 940352 - DNA, 18 bp, Homo sapiens
tggcctcagctgcctcac

SEQ ID NO: 940353 - DNA, 19 bp, Homo sapiens
tggcctcagctgcctcact

SEQ ID NO: 940354 - DNA, 18 bp, Homo sapiens
tggcctcagttcccagct

SEQ ID NO: 940355 - DNA, 19 bp, Homo sapiens
tggcctcatgtggctggaa

SEQ ID NO: 940356 - DNA, 20 bp, Homo sapiens
tggcctcatgtggctggaag

SEQ ID NO: 940357 - DNA, 15 bp, Homo sapiens
tggcctcccacccga

SEQ ID NO: 940358 - DNA, 23 bp, Homo sapiens
tggcctcccctgccaccaggcca

SEQ ID NO: 940359 - DNA, 12 bp, Homo sapiens
tggcctccctgc

SEQ ID NO: 940360 - DNA, 15 bp, Homo sapiens
tggcctccctgctgt

SEQ ID NO: 940361 - DNA, 13 bp, Homo sapiens
tggcctcctggcc

SEQ ID NO: 940362 - DNA, 14 bp, Homo sapiens
tggcctcctggccc

SEQ ID NO: 940363 - DNA, 23 bp, Homo sapiens
tggcctcgggacacctgccctgc

SEQ ID NO: 940364 - DNA, 14 bp, Homo sapiens
tggcctctctatcc

SEQ ID NO: 940365 - DNA, 19 bp, Homo sapiens
tggcctctctctctctcct

SEQ ID NO: 940366 - DNA, 21 bp, Homo sapiens
tggcctctctctctctcctca

SEQ ID NO: 940367 - DNA, 18 bp, Homo sapiens
tggcctctctgacatatg

SEQ ID NO: 940368 - DNA, 16 bp, Homo sapiens
tggcctctgcctgggg

SEQ ID NO: 940369 - DNA, 14 bp, Homo sapiens
tggcctctgctgaa

SEQ ID NO: 940370 - DNA, 19 bp, Homo sapiens
tggcctctgcttacttttt

SEQ ID NO: 940371 - DNA, 20 bp, Homo sapiens
tggcctcttgagcagtggct

SEQ ID NO: 940372 - DNA, 21 bp, Homo sapiens
tggcctcttgagttcctctgc

SEQ ID NO: 940373 - DNA, 14 bp, Homo sapiens
tggcctcttgtccc

SEQ ID NO: 940374 - DNA, 19 bp, Homo sapiens
tggcctcttgtcccttggc

SEQ ID NO: 940375 - DNA, 12 bp, Homo sapiens
tggcctgactgg

SEQ ID NO: 940376 - DNA, 15 bp, Homo sapiens
tggcctgactggttg

SEQ ID NO: 940377 - DNA, 20 bp, Homo sapiens
tggcctgactggttgtcaga

SEQ ID NO: 940378 - DNA, 18 bp, Homo sapiens
tggcctgagatgcaggtg

SEQ ID NO: 940379 - DNA, 12 bp, Homo sapiens
tggcctgagctg

SEQ ID NO: 940380 - DNA, 14 bp, Homo sapiens
tggcctgagctggg

SEQ ID NO: 940381 - DNA, 22 bp, Homo sapiens
tggcctgatcagaccacggctc

SEQ ID NO: 940382 - DNA, 22 bp, Homo sapiens
tggcctgctaaggctcctcctt

SEQ ID NO: 940383 - DNA, 12 bp, Homo sapiens
tggcctgctgtg

SEQ ID NO: 940384 - DNA, 13 bp, Homo sapiens
tggcctggagagg

SEQ ID NO: 940385 - DNA, 16 bp, Homo sapiens
tggcctggaggctcag

SEQ ID NO: 940386 - DNA, 18 bp, Homo sapiens
tggcctggaggctcagcc

SEQ ID NO: 940387 - DNA, 16 bp, Homo sapiens
tggcctggaggtgggg

SEQ ID NO: 940388 - DNA, 22 bp, Homo sapiens
tggcctggaggtggggttggga

SEQ ID NO: 940389 - DNA, 17 bp, Homo sapiens
tggcctggcatctgtgt

SEQ ID NO: 940390 - DNA, 18 bp, Homo sapiens
tggcctggcatctgtgtg

SEQ ID NO: 940391 - DNA, 12 bp, Homo sapiens
tggcctggccag

SEQ ID NO: 940392 - DNA, 16 bp, Homo sapiens
tggcctggccaggagc

SEQ ID NO: 940393 - DNA, 13 bp, Homo sapiens
tggcctggccatc

SEQ ID NO: 940394 - DNA, 19 bp, Homo sapiens
tggcctggccctcctggct

SEQ ID NO: 940395 - DNA, 18 bp, Homo sapiens
tggcctggtgggtcaggg

SEQ ID NO: 940396 - DNA, 22 bp, Homo sapiens
tggcctggtgggtcagggggag

SEQ ID NO: 940397 - DNA, 20 bp, Homo sapiens
tggcctgtctctattagctg

SEQ ID NO: 940398 - DNA, 16 bp, Homo sapiens
tggcctgtgagccatt

SEQ ID NO: 940399 - DNA, 16 bp, Homo sapiens
tggcctgtgccagcac

SEQ ID NO: 940400 - DNA, 18 bp, Homo sapiens
tggcctgtgggcctcacc

SEQ ID NO: 940401 - DNA, 13 bp, Homo sapiens
tggcctgtgtcca

SEQ ID NO: 940402 - DNA, 20 bp, Homo sapiens
tggcctgtgtccagcagctg

SEQ ID NO: 940403 - DNA, 14 bp, Homo sapiens
tggcctgtgtccca

SEQ ID NO: 940404 - DNA, 16 bp, Homo sapiens
tggcctgtgtcccatg

SEQ ID NO: 940405 - DNA, 22 bp, Homo sapiens
tggcctgtgtcccatgacccac

SEQ ID NO: 940406 - DNA, 13 bp, Homo sapiens
tggcctgttctgt

SEQ ID NO: 940407 - DNA, 22 bp, Homo sapiens
tggcctgtttctgcagcccttg

SEQ ID NO: 940408 - DNA, 17 bp, Homo sapiens
tggcctgtttgatgtat

SEQ ID NO: 940409 - DNA, 20 bp, Homo sapiens
tggcctgtttgatgtatgtg

SEQ ID NO: 940410 - DNA, 21 bp, Homo sapiens
tggcctgtttgatgtatgtgt

SEQ ID NO: 940411 - DNA, 23 bp, Homo sapiens
tggcctgtttgatgtatgtgtga

SEQ ID NO: 940412 - DNA, 15 bp, Homo sapiens
tggccttaatttcct

SEQ ID NO: 940413 - DNA, 13 bp, Homo sapiens
tggccttccccag

SEQ ID NO: 940414 - DNA, 21 bp, Homo sapiens
tggccttccccttttgcctgg

SEQ ID NO: 940415 - DNA, 14 bp, Homo sapiens
tggccttcctgccc

SEQ ID NO: 940416 - DNA, 15 bp, Homo sapiens
tggccttgaaacagt

SEQ ID NO: 940417 - DNA, 23 bp, Homo sapiens
tggccttgcccgtcgtgtgctga

SEQ ID NO: 940418 - DNA, 18 bp, Homo sapiens
tggccttgcctcggtggc

SEQ ID NO: 940419 - DNA, 13 bp, Homo sapiens
tggccttggcatg

SEQ ID NO: 940420 - DNA, 12 bp, Homo sapiens
tggccttgggag

SEQ ID NO: 940421 - DNA, 13 bp, Homo sapiens
tggccttgggagg

SEQ ID NO: 940422 - DNA, 13 bp, Homo sapiens
tggccttgggcct

SEQ ID NO: 940423 - DNA, 14 bp, Homo sapiens
tggccttggtcctt

SEQ ID NO: 940424 - DNA, 20 bp, Homo sapiens
tggccttgtcctcagccagt

SEQ ID NO: 940425 - DNA, 18 bp, Homo sapiens
tggccttgtgtcagagct

SEQ ID NO: 940426 - DNA, 12 bp, Homo sapiens
tggcctttatta

SEQ ID NO: 940427 - DNA, 11 bp, Homo sapiens
tggcctttcct

SEQ ID NO: 940428 - DNA, 12 bp, Homo sapiens
tggcctttcctt

SEQ ID NO: 940429 - DNA, 21 bp, Homo sapiens
tggcctttccttccctctctg

SEQ ID NO: 940430 - DNA, 19 bp, Homo sapiens
tggcctttccttgtatgtg

SEQ ID NO: 940431 - DNA, 18 bp, Homo sapiens
tggcctttgcttatgaat

SEQ ID NO: 940432 - DNA, 16 bp, Homo sapiens
tggcctttggacccag

SEQ ID NO: 940433 - DNA, 23 bp, Homo sapiens
tggcctttggacccagggcctga

SEQ ID NO: 940434 - DNA, 18 bp, Homo sapiens
tggcctttgtaagtgcag

SEQ ID NO: 940435 - DNA, 13 bp, Homo sapiens
tggccttttgata

SEQ ID NO: 940436 - DNA, 21 bp, Homo sapiens
tggccttttgctacgtgcctc

SEQ ID NO: 940437 - DNA, 23 bp, Homo sapiens
tggccttttgctacgtgcctccc

SEQ ID NO: 940438 - DNA, 22 bp, Homo sapiens
tggcctttttcatttatctata

SEQ ID NO: 940439 - DNA, 15 bp, Homo sapiens
tggccttttttataa

SEQ ID NO: 940440 - DNA, 18 bp, Homo sapiens
tggccttttttataacta

SEQ ID NO: 940441 - DNA, 15 bp, Homo sapiens
tggcgacaagagtga

SEQ ID NO: 940442 - DNA, 15 bp, Homo sapiens
tggcgacactcaggg

SEQ ID NO: 940443 - DNA, 16 bp, Homo sapiens
tggcgacactcagggc

SEQ ID NO: 940444 - DNA, 17 bp, Homo sapiens
tggcgacactcagggca

SEQ ID NO: 940445 - DNA, 19 bp, Homo sapiens
tggcgactctgcagagtca

SEQ ID NO: 940446 - DNA, 22 bp, Homo sapiens
tggcgaggcctctctcaggagc

SEQ ID NO: 940447 - DNA, 23 bp, Homo sapiens
tggcgatggggactctgccgctg

SEQ ID NO: 940448 - DNA, 17 bp, Homo sapiens
tggcgattccctctcac

SEQ ID NO: 940449 - DNA, 18 bp, Homo sapiens
tggcgattccctctcacc

SEQ ID NO: 940450 - DNA, 12 bp, Homo sapiens
tggcgcagccaa

SEQ ID NO: 940451 - DNA, 21 bp, Homo sapiens
tggcgccctgcctcctggagg

SEQ ID NO: 940452 - DNA, 15 bp, Homo sapiens
tggcgcgggaggcac

SEQ ID NO: 940453 - DNA, 18 bp, Homo sapiens
tggcgcgggaggcaccag

SEQ ID NO: 940454 - DNA, 13 bp, Homo sapiens
tggcgctatattg

SEQ ID NO: 940455 - DNA, 19 bp, Homo sapiens
tggcgctctcagctttccc

SEQ ID NO: 940456 - DNA, 22 bp, Homo sapiens
tggcggacactgggggaggaga

SEQ ID NO: 940457 - DNA, 15 bp, Homo sapiens
tggcggcagcagcca

SEQ ID NO: 940458 - DNA, 17 bp, Homo sapiens
tggcggctactcagcag

SEQ ID NO: 940459 - DNA, 22 bp, Homo sapiens
tggcggctactcagcagccctc

SEQ ID NO: 940460 - DNA, 23 bp, Homo sapiens
tggcggctactcagcagccctcc

SEQ ID NO: 940461 - DNA, 17 bp, Homo sapiens
tggcggctgcacaacag

SEQ ID NO: 940462 - DNA, 19 bp, Homo sapiens
tggcggcttcctgtccact

SEQ ID NO: 940463 - DNA, 14 bp, Homo sapiens
tggcgggcgcctgt

SEQ ID NO: 940464 - DNA, 17 bp, Homo sapiens
tggcgggcgcctgtagt

SEQ ID NO: 940465 - DNA, 13 bp, Homo sapiens
tggcggtgcctgg

SEQ ID NO: 940466 - DNA, 14 bp, Homo sapiens
tggcgtctccctcg

SEQ ID NO: 940467 - DNA, 14 bp, Homo sapiens
tggcgtctgctctg

SEQ ID NO: 940468 - DNA, 18 bp, Homo sapiens
tggcgtctgctctggtgg

SEQ ID NO: 940469 - DNA, 20 bp, Homo sapiens
tggcgtctgctctggtggct

SEQ ID NO: 940470 - DNA, 13 bp, Homo sapiens
tggcgtctgtctt

SEQ ID NO: 940471 - DNA, 15 bp, Homo sapiens
tggcgtgagctgccc

SEQ ID NO: 940472 - DNA, 19 bp, Homo sapiens
tggcgtgccctggaggctg

SEQ ID NO: 940473 - DNA, 15 bp, Homo sapiens
tggcgtgctcagacc

SEQ ID NO: 940474 - DNA, 21 bp, Homo sapiens
tggcgtgctcagacccaacag

SEQ ID NO: 940475 - DNA, 23 bp, Homo sapiens
tggcgttatggcagcccggctgc

SEQ ID NO: 940476 - DNA, 23 bp, Homo sapiens
tggcgttcacctccctgctcagt

SEQ ID NO: 940477 - DNA, 22 bp, Homo sapiens
tggcgtttttctcgtccccctc

SEQ ID NO: 940478 - DNA, 12 bp, Homo sapiens
tggctaaagata

SEQ ID NO: 940479 - DNA, 14 bp, Homo sapiens
tggctaacagtcta

SEQ ID NO: 940480 - DNA, 20 bp, Homo sapiens
tggctaacagtctagtgcaa

SEQ ID NO: 940481 - DNA, 16 bp, Homo sapiens
tggctaactgatgaat

SEQ ID NO: 940482 - DNA, 22 bp, Homo sapiens
tggctaagaccacagacgggca

SEQ ID NO: 940483 - DNA, 17 bp, Homo sapiens
tggctaataaactgtat

SEQ ID NO: 940484 - DNA, 19 bp, Homo sapiens
tggctaattttttgtactt

SEQ ID NO: 940485 - DNA, 18 bp, Homo sapiens
tggctacgcctcttctgt

SEQ ID NO: 940486 - DNA, 22 bp, Homo sapiens
tggctacgcctcttctgtccct

SEQ ID NO: 940487 - DNA, 22 bp, Homo sapiens
tggctagaggccagccccaccc

SEQ ID NO: 940488 - DNA, 15 bp, Homo sapiens
tggctagagtcctca

SEQ ID NO: 940489 - DNA, 16 bp, Homo sapiens
tggctagagtcctcac

SEQ ID NO: 940490 - DNA, 14 bp, Homo sapiens
tggctagcattcct

SEQ ID NO: 940491 - DNA, 17 bp, Homo sapiens
tggctagcgcaagacca

SEQ ID NO: 940492 - DNA, 14 bp, Homo sapiens
tggctagtactgta

SEQ ID NO: 940493 - DNA, 16 bp, Homo sapiens
tggctagtactgtatt

SEQ ID NO: 940494 - DNA, 17 bp, Homo sapiens
tggctagtcaagctcct

SEQ ID NO: 940495 - DNA, 21 bp, Homo sapiens
tggctagtcaagctcctcctc

SEQ ID NO: 940496 - DNA, 15 bp, Homo sapiens
tggctagtccttgtt

SEQ ID NO: 940497 - DNA, 18 bp, Homo sapiens
tggctataacatgtcttt

SEQ ID NO: 940498 - DNA, 22 bp, Homo sapiens
tggctatagatgtcttttccca

SEQ ID NO: 940499 - DNA, 21 bp, Homo sapiens
tggctatatggcaagaaagct

SEQ ID NO: 940500 - DNA, 16 bp, Homo sapiens
tggctatctactacca

SEQ ID NO: 940501 - DNA, 20 bp, Homo sapiens
tggctatctatacctgcctt

SEQ ID NO: 940502 - DNA, 18 bp, Homo sapiens
tggctatgaaaatgagcc

SEQ ID NO: 940503 - DNA, 19 bp, Homo sapiens
tggctatgaaaatgagccc

SEQ ID NO: 940504 - DNA, 19 bp, Homo sapiens
tggctctccaagtgccaga

SEQ ID NO: 940505 - DNA, 12 bp, Homo sapiens
tggctctcccac

SEQ ID NO: 940506 - DNA, 13 bp, Homo sapiens
tggctctcctggc

SEQ ID NO: 940507 - DNA, 14 bp, Homo sapiens
tggctctcctggcc

SEQ ID NO: 940508 - DNA, 15 bp, Homo sapiens
tggctctctccagga

SEQ ID NO: 940509 - DNA, 21 bp, Homo sapiens
tggctctgaggtgcctgtccc

SEQ ID NO: 940510 - DNA, 21 bp, Homo sapiens
tggctctgattggaatttctg

SEQ ID NO: 940511 - DNA, 23 bp, Homo sapiens
tggctctgcaatgggcactggga

SEQ ID NO: 940512 - DNA, 16 bp, Homo sapiens
tggctctgccccctcc

SEQ ID NO: 940513 - DNA, 21 bp, Homo sapiens
tggctctgcccctcagggggc

SEQ ID NO: 940514 - DNA, 23 bp, Homo sapiens
tggctctgcccctcagggggcca

SEQ ID NO: 940515 - DNA, 11 bp, Homo sapiens
tggctctgctg

SEQ ID NO: 940516 - DNA, 12 bp, Homo sapiens
tggctctgctgg

SEQ ID NO: 940517 - DNA, 20 bp, Homo sapiens
tggctctgggagagccagct

SEQ ID NO: 940518 - DNA, 15 bp, Homo sapiens
tggctctgggatcct

SEQ ID NO: 940519 - DNA, 20 bp, Homo sapiens
tggctctggggtatgtgtgt

SEQ ID NO: 940520 - DNA, 23 bp, Homo sapiens
tggctctggtatgaattcacccg

SEQ ID NO: 940521 - DNA, 16 bp, Homo sapiens
tggctgaaattctcct

SEQ ID NO: 940522 - DNA, 19 bp, Homo sapiens
tggctgaaattctcctgga

SEQ ID NO: 940523 - DNA, 20 bp, Homo sapiens
tggctgaaccctgtgctggt

SEQ ID NO: 940524 - DNA, 17 bp, Homo sapiens
tggctgaacttggagag

SEQ ID NO: 940525 - DNA, 13 bp, Homo sapiens
tggctgaagacat

SEQ ID NO: 940526 - DNA, 16 bp, Homo sapiens
tggctgacccagtccc

SEQ ID NO: 940527 - DNA, 20 bp, Homo sapiens
tggctgacccagtccctggg

SEQ ID NO: 940528 - DNA, 20 bp, Homo sapiens
tggctgaccccaaagagcct

SEQ ID NO: 940529 - DNA, 21 bp, Homo sapiens
tggctgaccccaaagagcctg

SEQ ID NO: 940530 - DNA, 16 bp, Homo sapiens
tggctgacctgggccc

SEQ ID NO: 940531 - DNA, 20 bp, Homo sapiens
tggctgacttacatcatgtg

SEQ ID NO: 940532 - DNA, 18 bp, Homo sapiens
tggctgagaatctggggg

SEQ ID NO: 940533 - DNA, 13 bp, Homo sapiens
tggctgagacctg

SEQ ID NO: 940534 - DNA, 14 bp, Homo sapiens
tggctgagacctgg

SEQ ID NO: 940535 - DNA, 14 bp, Homo sapiens
tggctgagatggag

SEQ ID NO: 940536 - DNA, 23 bp, Homo sapiens
tggctgagggatgacttacctgt

SEQ ID NO: 940537 - DNA, 18 bp, Homo sapiens
tggctgaggttcctctgc

SEQ ID NO: 940538 - DNA, 21 bp, Homo sapiens
tggctgaggttcctctgcctg

SEQ ID NO: 940539 - DNA, 23 bp, Homo sapiens
tggctgaggttcctctgcctgcc

SEQ ID NO: 940540 - DNA, 15 bp, Homo sapiens
tggctgagtactgga

SEQ ID NO: 940541 - DNA, 20 bp, Homo sapiens
tggctgagtggaatgcaggg

SEQ ID NO: 940542 - DNA, 22 bp, Homo sapiens
tggctgagtggaatgcagggaa

SEQ ID NO: 940543 - DNA, 17 bp, Homo sapiens
tggctgatgatccagaa

SEQ ID NO: 940544 - DNA, 21 bp, Homo sapiens
tggctgcacagaagggctctt

SEQ ID NO: 940545 - DNA, 22 bp, Homo sapiens
tggctgcaccacttccagggtt

SEQ ID NO: 940546 - DNA, 23 bp, Homo sapiens
tggctgcacgtaggttccccaga

SEQ ID NO: 940547 - DNA, 14 bp, Homo sapiens
tggctgccacaccc

SEQ ID NO: 940548 - DNA, 18 bp, Homo sapiens
tggctgccacacccaggg

SEQ ID NO: 940549 - DNA, 19 bp, Homo sapiens
tggctgccacacccagggg

SEQ ID NO: 940550 - DNA, 12 bp, Homo sapiens
tggctgccaggc

SEQ ID NO: 940551 - DNA, 20 bp, Homo sapiens
tggctgcccagacccctctg

SEQ ID NO: 940552 - DNA, 23 bp, Homo sapiens
tggctgcccagacccctctggcc

SEQ ID NO: 940553 - DNA, 18 bp, Homo sapiens
tggctgccccggcctcct

SEQ ID NO: 940554 - DNA, 13 bp, Homo sapiens
tggctgcgccccc

SEQ ID NO: 940555 - DNA, 18 bp, Homo sapiens
tggctgcgcccccagctt

SEQ ID NO: 940556 - DNA, 16 bp, Homo sapiens
tggctgcgctaacccc

SEQ ID NO: 940557 - DNA, 23 bp, Homo sapiens
tggctgctagattttaatttatt

SEQ ID NO: 940558 - DNA, 16 bp, Homo sapiens
tggctgctgcccccac

SEQ ID NO: 940559 - DNA, 20 bp, Homo sapiens
tggctgctgcccccaccccg

SEQ ID NO: 940560 - DNA, 15 bp, Homo sapiens
tggctgcttcctgtg

SEQ ID NO: 940561 - DNA, 17 bp, Homo sapiens
tggctggaaagcagagc

SEQ ID NO: 940562 - DNA, 22 bp, Homo sapiens
tggctggaaagcagagcctcct

SEQ ID NO: 940563 - DNA, 19 bp, Homo sapiens
tggctggaattaaaacaaa

SEQ ID NO: 940564 - DNA, 19 bp, Homo sapiens
tggcagaataatctttggg

SEQ ID NO: 940565 - DNA, 20 bp, Homo sapiens
tggcagaataatctttgggt

SEQ ID NO: 940566 - DNA, 14 bp, Homo sapiens
tggcagacaaacag

SEQ ID NO: 940567 - DNA, 15 bp, Homo sapiens
tggcagacaaacaga

SEQ ID NO: 940568 - DNA, 22 bp, Homo sapiens
tggcagacaaacagaccataaa

SEQ ID NO: 940569 - DNA, 21 bp, Homo sapiens
tggcagactcaaggggctgga

SEQ ID NO: 940570 - DNA, 22 bp, Homo sapiens
tggcagactcaaggggctggaa

SEQ ID NO: 940571 - DNA, 12 bp, Homo sapiens
tggcagactctt

SEQ ID NO: 940572 - DNA, 14 bp, Homo sapiens
tggcagagaaggcc

SEQ ID NO: 940573 - DNA, 12 bp, Homo sapiens
tggcagagccag

SEQ ID NO: 940574 - DNA, 14 bp, Homo sapiens
tggcagagccaggc

SEQ ID NO: 940575 - DNA, 17 bp, Homo sapiens
tggcagagcctctgaga

SEQ ID NO: 940576 - DNA, 20 bp, Homo sapiens
tggcagagttacagttctgt

SEQ ID NO: 940577 - DNA, 20 bp, Homo sapiens
tggcagagttgtaaatatat

SEQ ID NO: 940578 - DNA, 23 bp, Homo sapiens
tggcagagttgtaaatatataaa

SEQ ID NO: 940579 - DNA, 18 bp, Homo sapiens
tggcagagtttgtgtgtt

SEQ ID NO: 940580 - DNA, 20 bp, Homo sapiens
tggcagataatcagcctctt

SEQ ID NO: 940581 - DNA, 20 bp, Homo sapiens
tggcagatactccttttgcc

SEQ ID NO: 940582 - DNA, 16 bp, Homo sapiens
tggcagatgtcttccc

SEQ ID NO: 940583 - DNA, 17 bp, Homo sapiens
tggcagatgtcttccct

SEQ ID NO: 940584 - DNA, 22 bp, Homo sapiens
tggcagatttagtgaaagctag

SEQ ID NO: 940585 - DNA, 17 bp, Homo sapiens
tggcagattttacaaaa

SEQ ID NO: 940586 - DNA, 20 bp, Homo sapiens
tggcagcaatggcgctgtgc

SEQ ID NO: 940587 - DNA, 19 bp, Homo sapiens
tggcagcacagcccagggc

SEQ ID NO: 940588 - DNA, 21 bp, Homo sapiens
tggcagcacagcccagggcct

SEQ ID NO: 940589 - DNA, 18 bp, Homo sapiens
tggcagcacgcaggcggg

SEQ ID NO: 940590 - DNA, 14 bp, Homo sapiens
tggcagcagtgaag

SEQ ID NO: 940591 - DNA, 17 bp, Homo sapiens
tggcagcattcccacca

SEQ ID NO: 940592 - DNA, 20 bp, Homo sapiens
tggcagcattcccaccaaca

SEQ ID NO: 940593 - DNA, 22 bp, Homo sapiens
tggcagccaaggaatgtgtcca

SEQ ID NO: 940594 - DNA, 23 bp, Homo sapiens
tggcagccaaggaatgtgtccaa

SEQ ID NO: 940595 - DNA, 12 bp, Homo sapiens
tggcagccatgc

SEQ ID NO: 940596 - DNA, 20 bp, Homo sapiens
tggcagccatgcctcatgcc

SEQ ID NO: 940597 - DNA, 13 bp, Homo sapiens
tggcagcccggct

SEQ ID NO: 940598 - DNA, 15 bp, Homo sapiens
tggcagcccggctgc

SEQ ID NO: 940599 - DNA, 18 bp, Homo sapiens
tggcagcccggctgctgc

SEQ ID NO: 940600 - DNA, 22 bp, Homo sapiens
tggctttctccgactgctaggg

SEQ ID NO: 940601 - DNA, 17 bp, Homo sapiens
tggctttgaaacctcag

SEQ ID NO: 940602 - DNA, 18 bp, Homo sapiens
tggctttgaaacctcagg

SEQ ID NO: 940603 - DNA, 12 bp, Homo sapiens
tggctttgcata

SEQ ID NO: 940604 - DNA, 17 bp, Homo sapiens
tggctttgcccacccct

SEQ ID NO: 940605 - DNA, 22 bp, Homo sapiens
tggctttgctctattaagattg

SEQ ID NO: 940606 - DNA, 15 bp, Homo sapiens
tggctttggcagtgt

SEQ ID NO: 940607 - DNA, 14 bp, Homo sapiens
tggctttgtcactt

SEQ ID NO: 940608 - DNA, 20 bp, Homo sapiens
tggctttgtcacttttcctt

SEQ ID NO: 940609 - DNA, 12 bp, Homo sapiens
tggcttttactt

SEQ ID NO: 940610 - DNA, 21 bp, Homo sapiens
tggcttttattaatgcacttt

SEQ ID NO: 940611 - DNA, 15 bp, Homo sapiens
tggcttttcactgct

SEQ ID NO: 940612 - DNA, 18 bp, Homo sapiens
tggcttttcactgctggc

SEQ ID NO: 940613 - DNA, 21 bp, Homo sapiens
tggcttttcactgctggctgc

SEQ ID NO: 940614 - DNA, 22 bp, Homo sapiens
tggcttttcactgctggctgcc

SEQ ID NO: 940615 - DNA, 14 bp, Homo sapiens
tggcttttgtgcat

SEQ ID NO: 940616 - DNA, 16 bp, Homo sapiens
tggcttttgtgcatta

SEQ ID NO: 940617 - DNA, 15 bp, Homo sapiens
tggctttttaacatg

SEQ ID NO: 940618 - DNA, 16 bp, Homo sapiens
tgggaaaaaaacaaac

SEQ ID NO: 940619 - DNA, 15 bp, Homo sapiens
tgggaaaaaaactga

SEQ ID NO: 940620 - DNA, 19 bp, Homo sapiens
tgggaaacctgcctttgta

SEQ ID NO: 940621 - DNA, 19 bp, Homo sapiens
tgggaaactgttgtgggcg

SEQ ID NO: 940622 - DNA, 15 bp, Homo sapiens
tgggaaagcataaag

SEQ ID NO: 940623 - DNA, 20 bp, Homo sapiens
tgggaaagccacctctccct

SEQ ID NO: 940624 - DNA, 22 bp, Homo sapiens
tgggaaagccacctctccctca

SEQ ID NO: 940625 - DNA, 16 bp, Homo sapiens
tgggaaatgcagaaat

SEQ ID NO: 940626 - DNA, 23 bp, Homo sapiens
tgggaaatggtatgagctgaggg

SEQ ID NO: 940627 - DNA, 21 bp, Homo sapiens
tgggaaattgaagtgtcttct

SEQ ID NO: 940628 - DNA, 14 bp, Homo sapiens
tgggaacacagttc

SEQ ID NO: 940629 - DNA, 21 bp, Homo sapiens
tgggaacagcatggaggcaga

SEQ ID NO: 940630 - DNA, 14 bp, Homo sapiens
tgggaacaggcccc

SEQ ID NO: 940631 - DNA, 22 bp, Homo sapiens
tgggaacagtaaagaaagcaga

SEQ ID NO: 940632 - DNA, 18 bp, Homo sapiens
tgggaacatgacccagcc

SEQ ID NO: 940633 - DNA, 14 bp, Homo sapiens
tgggaacattattt

SEQ ID NO: 940634 - DNA, 20 bp, Homo sapiens
tgggaaccaagctattcctt

SEQ ID NO: 940635 - DNA, 20 bp, Homo sapiens
tgggaaccccgcagcccgtg

SEQ ID NO: 940636 - DNA, 22 bp, Homo sapiens
tgggaacctagctacactgagc

SEQ ID NO: 940637 - DNA, 23 bp, Homo sapiens
tgggaacctagctacactgagca

SEQ ID NO: 940638 - DNA, 15 bp, Homo sapiens
tgggaacctcccaga

SEQ ID NO: 940639 - DNA, 14 bp, Homo sapiens
tgggaacgcagcct

SEQ ID NO: 940640 - DNA, 17 bp, Homo sapiens
tgggaacgtgtgtccag

SEQ ID NO: 940641 - DNA, 22 bp, Homo sapiens
tgggaacgtgtgtccaggctct

SEQ ID NO: 940642 - DNA, 17 bp, Homo sapiens
tgggaacttgcgagtcc

SEQ ID NO: 940643 - DNA, 12 bp, Homo sapiens
tgggaagaaaca

SEQ ID NO: 940644 - DNA, 16 bp, Homo sapiens
tgggaagaccaaagga

SEQ ID NO: 940645 - DNA, 23 bp, Homo sapiens
tgggaagaccagctttgcagtga

SEQ ID NO: 940646 - DNA, 18 bp, Homo sapiens
tgggaagacgcctgagct

SEQ ID NO: 940647 - DNA, 21 bp, Homo sapiens
tgggaagacgcctgagctcac

SEQ ID NO: 940648 - DNA, 16 bp, Homo sapiens
tgggaagacgttttct

SEQ ID NO: 940649 - DNA, 12 bp, Homo sapiens
tgggaagagaag

SEQ ID NO: 940650 - DNA, 17 bp, Homo sapiens
tgggaagataggctctg

SEQ ID NO: 940651 - DNA, 20 bp, Homo sapiens
tgggaagataggctctgcac

SEQ ID NO: 940652 - DNA, 15 bp, Homo sapiens
tgggaagattctcta

SEQ ID NO: 940653 - DNA, 19 bp, Homo sapiens
tgggagaaggtctccaagg

SEQ ID NO: 940654 - DNA, 23 bp, Homo sapiens
tgggagaatcgctcctgcagccc

SEQ ID NO: 940655 - DNA, 22 bp, Homo sapiens
tgggagaattcttacatgtttt

SEQ ID NO: 940656 - DNA, 21 bp, Homo sapiens
tgggagacaattagcagaatg

SEQ ID NO: 940657 - DNA, 12 bp, Homo sapiens
tgggagacagca

SEQ ID NO: 940658 - DNA, 19 bp, Homo sapiens
tgggagacagcagcctgta

SEQ ID NO: 940659 - DNA, 16 bp, Homo sapiens
tgggagacatggacca

SEQ ID NO: 940660 - DNA, 14 bp, Homo sapiens
tgggagacctgttg

SEQ ID NO: 940661 - DNA, 19 bp, Homo sapiens
tgggagacctgttggcctg

SEQ ID NO: 940662 - DNA, 23 bp, Homo sapiens
tgggagacctgttggcctgtggg

SEQ ID NO: 940663 - DNA, 16 bp, Homo sapiens
tgggagagccagctct

SEQ ID NO: 940664 - DNA, 17 bp, Homo sapiens
tgggagagccagctctc

SEQ ID NO: 940665 - DNA, 18 bp, Homo sapiens
tgggagagcccagccatt

SEQ ID NO: 940666 - DNA, 13 bp, Homo sapiens
tgggagagcctgg

SEQ ID NO: 940667 - DNA, 17 bp, Homo sapiens
tgggagaggtgccagca

SEQ ID NO: 940668 - DNA, 15 bp, Homo sapiens
tgggagatggcagca

SEQ ID NO: 940669 - DNA, 12 bp, Homo sapiens
tgggagcactgg

SEQ ID NO: 940670 - DNA, 12 bp, Homo sapiens
tgggagccagaa

SEQ ID NO: 940671 - DNA, 19 bp, Homo sapiens
tgggagccagtcctccact

SEQ ID NO: 940672 - DNA, 19 bp, Homo sapiens
tgggagcccagagggtggc

SEQ ID NO: 940673 - DNA, 22 bp, Homo sapiens
tgggagccccagggtcttccct

SEQ ID NO: 940674 - DNA, 15 bp, Homo sapiens
tgggagccctttgga

SEQ ID NO: 940675 - DNA, 19 bp, Homo sapiens
tgggagccgggaccctcag

SEQ ID NO: 940676 - DNA, 20 bp, Homo sapiens
tgggagccgggaccctcagg

SEQ ID NO: 940677 - DNA, 23 bp, Homo sapiens
tgggagccgggtctgcctcttct

SEQ ID NO: 940678 - DNA, 11 bp, Homo sapiens
tgggagcctga

SEQ ID NO: 940679 - DNA, 22 bp, Homo sapiens
tgggagcctggttcagacacag

SEQ ID NO: 940680 - DNA, 19 bp, Homo sapiens
tgggagctccactctgctt

SEQ ID NO: 940681 - DNA, 22 bp, Homo sapiens
tgggagctccactctgcttctc

SEQ ID NO: 940682 - DNA, 17 bp, Homo sapiens
tgggagctgaaaaatca

SEQ ID NO: 940683 - DNA, 18 bp, Homo sapiens
tgggagctgagcagcctc

SEQ ID NO: 940684 - DNA, 15 bp, Homo sapiens
tgggagctgagctgg

SEQ ID NO: 940685 - DNA, 16 bp, Homo sapiens
tgggagctgaggccac

SEQ ID NO: 940686 - DNA, 22 bp, Homo sapiens
tgggagctgaggccacactcag

SEQ ID NO: 940687 - DNA, 16 bp, Homo sapiens
tgggagctgccaagag

SEQ ID NO: 940688 - DNA, 17 bp, Homo sapiens
tgggagctgctgggcta

SEQ ID NO: 940689 - DNA, 20 bp, Homo sapiens
tgggagctggttagaaatgc

SEQ ID NO: 940690 - DNA, 21 bp, Homo sapiens
tgggaggaaagggcctggcca

SEQ ID NO: 940691 - DNA, 13 bp, Homo sapiens
tgggaggaagcag

SEQ ID NO: 940692 - DNA, 11 bp, Homo sapiens
tgggaggacag

SEQ ID NO: 940693 - DNA, 18 bp, Homo sapiens
tgggaggacatgcgtgtg

SEQ ID NO: 940694 - DNA, 21 bp, Homo sapiens
tgggaggacatgcgtgtgtca

SEQ ID NO: 940695 - DNA, 17 bp, Homo sapiens
tgggaggagagccactg

SEQ ID NO: 940696 - DNA, 20 bp, Homo sapiens
tgggaggagagccactgggc

SEQ ID NO: 940697 - DNA, 17 bp, Homo sapiens
tgggaggaggaaagaga

SEQ ID NO: 940698 - DNA, 13 bp, Homo sapiens
tgggaggagggag

SEQ ID NO: 940699 - DNA, 18 bp, Homo sapiens
tgggaggatctcttgagc

SEQ ID NO: 940700 - DNA, 22 bp, Homo sapiens
tgggaggattgcttgagctcag

SEQ ID NO: 940701 - DNA, 15 bp, Homo sapiens
tgggcccaggcaggt

SEQ ID NO: 940702 - DNA, 21 bp, Homo sapiens
tgggcccataatagttagccc

SEQ ID NO: 940703 - DNA, 13 bp, Homo sapiens
tgggcccatctcc

SEQ ID NO: 940704 - DNA, 23 bp, Homo sapiens
tgggccccaccacctaggccact

SEQ ID NO: 940705 - DNA, 15 bp, Homo sapiens
tgggccccactggac

SEQ ID NO: 940706 - DNA, 18 bp, Homo sapiens
tgggccccagaccccagg

SEQ ID NO: 940707 - DNA, 13 bp, Homo sapiens
tgggccccatgct

SEQ ID NO: 940708 - DNA, 17 bp, Homo sapiens
tgggccccgccttcctg

SEQ ID NO: 940709 - DNA, 18 bp, Homo sapiens
tgggcccctccacgcctc

SEQ ID NO: 940710 - DNA, 22 bp, Homo sapiens
tgggcccctccacgcctcctgg

SEQ ID NO: 940711 - DNA, 23 bp, Homo sapiens
tgggcccctccacgcctcctggc

SEQ ID NO: 940712 - DNA, 12 bp, Homo sapiens
tgggcccctccc

SEQ ID NO: 940713 - DNA, 17 bp, Homo sapiens
tgggcccctcccctcag

SEQ ID NO: 940714 - DNA, 21 bp, Homo sapiens
tgggcccctcccctcagagcc

SEQ ID NO: 940715 - DNA, 15 bp, Homo sapiens
tgggcccctctccca

SEQ ID NO: 940716 - DNA, 13 bp, Homo sapiens
tgggcccctgcac

SEQ ID NO: 940717 - DNA, 13 bp, Homo sapiens
tgggcccctggga

SEQ ID NO: 940718 - DNA, 14 bp, Homo sapiens
tgggcccctgggga

SEQ ID NO: 940719 - DNA, 19 bp, Homo sapiens
tgggcccctggggacagag

SEQ ID NO: 940720 - DNA, 20 bp, Homo sapiens
tgggcccctggggacagagc

SEQ ID NO: 940721 - DNA, 21 bp, Homo sapiens
tgggcccctggggacagagcc

SEQ ID NO: 940722 - DNA, 13 bp, Homo sapiens
tgggcccctgtcc

SEQ ID NO: 940723 - DNA, 15 bp, Homo sapiens
tgggccccttccaaa

SEQ ID NO: 940724 - DNA, 18 bp, Homo sapiens
tgggcccgctgcctcttg

SEQ ID NO: 940725 - DNA, 20 bp, Homo sapiens
tgggcccgctgcctcttggc

SEQ ID NO: 940726 - DNA, 23 bp, Homo sapiens
tgggcccgctgcctcttggcttc

SEQ ID NO: 940727 - DNA, 22 bp, Homo sapiens
tgggcccggagtaatcaggcag

SEQ ID NO: 940728 - DNA, 16 bp, Homo sapiens
tgggcccgggcaggcc

SEQ ID NO: 940729 - DNA, 19 bp, Homo sapiens
tgggcccgggcaggccagc

SEQ ID NO: 940730 - DNA, 18 bp, Homo sapiens
tgggccctctctgctctg

SEQ ID NO: 940731 - DNA, 23 bp, Homo sapiens
tgggccctctttccctgcgagac

SEQ ID NO: 940732 - DNA, 14 bp, Homo sapiens
tgggccctgcaggc

SEQ ID NO: 940733 - DNA, 17 bp, Homo sapiens
tgggccctgcccgggga

SEQ ID NO: 940734 - DNA, 14 bp, Homo sapiens
tgggccctgggctg

SEQ ID NO: 940735 - DNA, 16 bp, Homo sapiens
tgggccctgggctgga

SEQ ID NO: 940736 - DNA, 17 bp, Homo sapiens
tgggccctgggctggaa

SEQ ID NO: 940737 - DNA, 20 bp, Homo sapiens
tgggccgcaagggcctggac

SEQ ID NO: 940738 - DNA, 12 bp, Homo sapiens
tgggctgagccc

SEQ ID NO: 940739 - DNA, 14 bp, Homo sapiens
tgggctgagcccct

SEQ ID NO: 940740 - DNA, 18 bp, Homo sapiens
tgggctgagccctggcag

SEQ ID NO: 940741 - DNA, 20 bp, Homo sapiens
tgggctgagctagcctccag

SEQ ID NO: 940742 - DNA, 17 bp, Homo sapiens
tgggctgagtgacacaa

SEQ ID NO: 940743 - DNA, 13 bp, Homo sapiens
tgggctgatgctg

SEQ ID NO: 940744 - DNA, 19 bp, Homo sapiens
tgggctgatgctgggaccc

SEQ ID NO: 940745 - DNA, 16 bp, Homo sapiens
tgggctgatggcctgg

SEQ ID NO: 940746 - DNA, 19 bp, Homo sapiens
tgggctgccaccagccccc

SEQ ID NO: 940747 - DNA, 21 bp, Homo sapiens
tgggctgcccctcgcacacag

SEQ ID NO: 940748 - DNA, 13 bp, Homo sapiens
tgggctgccctgg

SEQ ID NO: 940749 - DNA, 20 bp, Homo sapiens
tgggctgccctggtgctgcc

SEQ ID NO: 940750 - DNA, 15 bp, Homo sapiens
tgggctgctgcaggc

SEQ ID NO: 940751 - DNA, 19 bp, Homo sapiens
tgggctgctgcaggccgtg

SEQ ID NO: 940752 - DNA, 18 bp, Homo sapiens
tgggctggaatcaggaat

SEQ ID NO: 940753 - DNA, 16 bp, Homo sapiens
tgggctggactggagg

SEQ ID NO: 940754 - DNA, 17 bp, Homo sapiens
tgggctggactggccat

SEQ ID NO: 940755 - DNA, 12 bp, Homo sapiens
tgggctggccca

SEQ ID NO: 940756 - DNA, 21 bp, Homo sapiens
tgggctggcccagccaactgc

SEQ ID NO: 940757 - DNA, 21 bp, Homo sapiens
tgggctggcgcttggatctgg

SEQ ID NO: 940758 - DNA, 13 bp, Homo sapiens
tgggctgggcagc

SEQ ID NO: 940759 - DNA, 20 bp, Homo sapiens
tgggctgggcccacccaggg

SEQ ID NO: 940760 - DNA, 21 bp, Homo sapiens
tgggctgggcccacccaggga

SEQ ID NO: 940761 - DNA, 17 bp, Homo sapiens
tgggctggggactctgg

SEQ ID NO: 940762 - DNA, 14 bp, Homo sapiens
tgggctggggcagg

SEQ ID NO: 940763 - DNA, 15 bp, Homo sapiens
tgggctggggcaggg

SEQ ID NO: 940764 - DNA, 18 bp, Homo sapiens
tgggctggggcaggggcc

SEQ ID NO: 940765 - DNA, 13 bp, Homo sapiens
tgggctggggcca

SEQ ID NO: 940766 - DNA, 22 bp, Homo sapiens
tgggctgggggccagggctgga

SEQ ID NO: 940767 - DNA, 16 bp, Homo sapiens
tgggctgggtgctggg

SEQ ID NO: 940768 - DNA, 18 bp, Homo sapiens
tgggctgggtggcccctg

SEQ ID NO: 940769 - DNA, 18 bp, Homo sapiens
tgggctggtatctcagaa

SEQ ID NO: 940770 - DNA, 21 bp, Homo sapiens
tgggctggtatctcagaaagt

SEQ ID NO: 940771 - DNA, 17 bp, Homo sapiens
tggggagccctcaggct

SEQ ID NO: 940772 - DNA, 18 bp, Homo sapiens
tggggagctcctggccag

SEQ ID NO: 940773 - DNA, 18 bp, Homo sapiens
tggggagctcctgggacc

SEQ ID NO: 940774 - DNA, 19 bp, Homo sapiens
tggggagctcctgggaccc

SEQ ID NO: 940775 - DNA, 16 bp, Homo sapiens
tggggaggaaatagaa

SEQ ID NO: 940776 - DNA, 15 bp, Homo sapiens
tggggaggaccaggg

SEQ ID NO: 940777 - DNA, 15 bp, Homo sapiens
tggggaggaggagag

SEQ ID NO: 940778 - DNA, 14 bp, Homo sapiens
tggggaggcagcag

SEQ ID NO: 940779 - DNA, 14 bp, Homo sapiens
tggggaggcaggca

SEQ ID NO: 940780 - DNA, 21 bp, Homo sapiens
tggggaggcccaaatgatgga

SEQ ID NO: 940781 - DNA, 18 bp, Homo sapiens
tggggaggccctgcctcc

SEQ ID NO: 940782 - DNA, 22 bp, Homo sapiens
tggggaggctgcactggagcca

SEQ ID NO: 940783 - DNA, 18 bp, Homo sapiens
tggggagggaggggaaat

SEQ ID NO: 940784 - DNA, 22 bp, Homo sapiens
tggggagggattctggttccag

SEQ ID NO: 940785 - DNA, 16 bp, Homo sapiens
tggggaggggaatata

SEQ ID NO: 940786 - DNA, 21 bp, Homo sapiens
tggggaggggaatatacacat

SEQ ID NO: 940787 - DNA, 21 bp, Homo sapiens
tggggaggggcgctggcccag

SEQ ID NO: 940788 - DNA, 23 bp, Homo sapiens
tggggaggggcgctggcccagcc

SEQ ID NO: 940789 - DNA, 19 bp, Homo sapiens
tggggaggggcggcaggag

SEQ ID NO: 940790 - DNA, 12 bp, Homo sapiens
tggggagggtga

SEQ ID NO: 940791 - DNA, 20 bp, Homo sapiens
tggggaggtgggaggccagg

SEQ ID NO: 940792 - DNA, 15 bp, Homo sapiens
tggggataataatac

SEQ ID NO: 940793 - DNA, 14 bp, Homo sapiens
tggggatagaggaa

SEQ ID NO: 940794 - DNA, 23 bp, Homo sapiens
tggggatagaggaaagggatggt

SEQ ID NO: 940795 - DNA, 15 bp, Homo sapiens
tggggatataatact

SEQ ID NO: 940796 - DNA, 23 bp, Homo sapiens
tggggatccccgcctggccagga

SEQ ID NO: 940797 - DNA, 21 bp, Homo sapiens
tggggatcttcccacaggagg

SEQ ID NO: 940798 - DNA, 14 bp, Homo sapiens
tggggatgtaacca

SEQ ID NO: 940799 - DNA, 23 bp, Homo sapiens
tgggggggtggccgctgagtggc

SEQ ID NO: 940800 - DNA, 13 bp, Homo sapiens
tggggggtgggga

SEQ ID NO: 940801 - DNA, 22 bp, Homo sapiens
tgggggtagccccgccccagcc

SEQ ID NO: 940802 - DNA, 15 bp, Homo sapiens
tgggggtagcctgga

SEQ ID NO: 940803 - DNA, 19 bp, Homo sapiens
tgggggtcaggcagccagt

SEQ ID NO: 940804 - DNA, 15 bp, Homo sapiens
tgggggtgcatttga

SEQ ID NO: 940805 - DNA, 14 bp, Homo sapiens
tgggggtgccagga

SEQ ID NO: 940806 - DNA, 16 bp, Homo sapiens
tgggggtggaaaagga

SEQ ID NO: 940807 - DNA, 21 bp, Homo sapiens
tgggggtggccatccctgggc

SEQ ID NO: 940808 - DNA, 23 bp, Homo sapiens
tgggggtggccatccctgggccc

SEQ ID NO: 940809 - DNA, 19 bp, Homo sapiens
tgggggtggggggactgcc

SEQ ID NO: 940810 - DNA, 16 bp, Homo sapiens
tgggggttcaggcccg

SEQ ID NO: 940811 - DNA, 19 bp, Homo sapiens
tgggggttttcaatgtgaa

SEQ ID NO: 940812 - DNA, 19 bp, Homo sapiens
tggggtaagccagagcctg

SEQ ID NO: 940813 - DNA, 22 bp, Homo sapiens
tggggtaagccagagcctgggg

SEQ ID NO: 940814 - DNA, 19 bp, Homo sapiens
tggggtactcgttggatgt

SEQ ID NO: 940815 - DNA, 19 bp, Homo sapiens
tggggtagaaacattgtaa

SEQ ID NO: 940816 - DNA, 14 bp, Homo sapiens
tggggtagactgag

SEQ ID NO: 940817 - DNA, 16 bp, Homo sapiens
tggggtataggtctca

SEQ ID NO: 940818 - DNA, 19 bp, Homo sapiens
tggggtataggtctcatct

SEQ ID NO: 940819 - DNA, 21 bp, Homo sapiens
tggggtcaagaaacagccagc

SEQ ID NO: 940820 - DNA, 14 bp, Homo sapiens
tggggtcagccagg

SEQ ID NO: 940821 - DNA, 14 bp, Homo sapiens
tggggtcagcccca

SEQ ID NO: 940822 - DNA, 16 bp, Homo sapiens
tggggtcagccccaag

SEQ ID NO: 940823 - DNA, 22 bp, Homo sapiens
tggggtcaggaacagtggctgg

SEQ ID NO: 940824 - DNA, 13 bp, Homo sapiens
tggggtccagggc

SEQ ID NO: 940825 - DNA, 13 bp, Homo sapiens
tggggtccccatc

SEQ ID NO: 940826 - DNA, 13 bp, Homo sapiens
tggggtccctcta

SEQ ID NO: 940827 - DNA, 15 bp, Homo sapiens
tggggtcctggccat

SEQ ID NO: 940828 - DNA, 16 bp, Homo sapiens
tggggtcctggccatc

SEQ ID NO: 940829 - DNA, 13 bp, Homo sapiens
tggggtctctctc

SEQ ID NO: 940830 - DNA, 22 bp, Homo sapiens
tggggtctctctccctacctcc

SEQ ID NO: 940831 - DNA, 24 bp, Homo sapiens
tggggtctgggagggggtgagagg

SEQ ID NO: 940832 - DNA, 16 bp, Homo sapiens
tggggtctgtgactgg

SEQ ID NO: 940833 - DNA, 22 bp, Homo sapiens
tggggtcttgctatgttgccca

SEQ ID NO: 940834 - DNA, 14 bp, Homo sapiens
tggggtgacagtca

SEQ ID NO: 940835 - DNA, 15 bp, Homo sapiens
tggggtgacagtcat

SEQ ID NO: 940836 - DNA, 16 bp, Homo sapiens
tggggtgacagtcatc

SEQ ID NO: 940837 - DNA, 17 bp, Homo sapiens
tggggtgacagtcatca

SEQ ID NO: 940838 - DNA, 23 bp, Homo sapiens
tggggtgacagtcatcatcaggg

SEQ ID NO: 940839 - DNA, 13 bp, Homo sapiens
tggggtgagagag

SEQ ID NO: 940840 - DNA, 15 bp, Homo sapiens
tggggtgagcctgac

SEQ ID NO: 940841 - DNA, 17 bp, Homo sapiens
tggggtgagcctgactg

SEQ ID NO: 940842 - DNA, 16 bp, Homo sapiens
tggggtgataaggggc

SEQ ID NO: 940843 - DNA, 19 bp, Homo sapiens
tggggtgataaggggcctt

SEQ ID NO: 940844 - DNA, 19 bp, Homo sapiens
tggggtgatggccagagga

SEQ ID NO: 940845 - DNA, 18 bp, Homo sapiens
tggggtgcagctgggtgg

SEQ ID NO: 940846 - DNA, 21 bp, Homo sapiens
tggggtgcagctgggtggggc

SEQ ID NO: 940847 - DNA, 22 bp, Homo sapiens
tggggtgcagctgggtggggca

SEQ ID NO: 940848 - DNA, 23 bp, Homo sapiens
tggggtggagcactggactccgg

SEQ ID NO: 940849 - DNA, 20 bp, Homo sapiens
tggggtggcctggccctcct

SEQ ID NO: 940850 - DNA, 16 bp, Homo sapiens
tggggtgggacaggga

SEQ ID NO: 940851 - DNA, 16 bp, Homo sapiens
tggggtgggagacttt

SEQ ID NO: 940852 - DNA, 14 bp, Homo sapiens
tggggtgggagggc

SEQ ID NO: 940853 - DNA, 12 bp, Homo sapiens
tggggtgggagt

SEQ ID NO: 940854 - DNA, 13 bp, Homo sapiens
tggggtgggccca

SEQ ID NO: 940855 - DNA, 16 bp, Homo sapiens
tggggtgggggccagg

SEQ ID NO: 940856 - DNA, 17 bp, Homo sapiens
tggggtgggggccaggc

SEQ ID NO: 940857 - DNA, 19 bp, Homo sapiens
tggggttatctctgtgtta

SEQ ID NO: 940858 - DNA, 16 bp, Homo sapiens
tggggttcccgaggga

SEQ ID NO: 940859 - DNA, 12 bp, Homo sapiens
tggggttcctgc

SEQ ID NO: 940860 - DNA, 18 bp, Homo sapiens
tggggttgcgtctgaggc

SEQ ID NO: 940861 - DNA, 14 bp, Homo sapiens
tggggttgctgaag

SEQ ID NO: 940862 - DNA, 20 bp, Homo sapiens
tggggttgctgaagatgcct

SEQ ID NO: 940863 - DNA, 13 bp, Homo sapiens
tggggttggacat

SEQ ID NO: 940864 - DNA, 18 bp, Homo sapiens
tggggttggcttccctgg

SEQ ID NO: 940865 - DNA, 21 bp, Homo sapiens
tggggttggcttccctggcat

SEQ ID NO: 940866 - DNA, 15 bp, Homo sapiens
tggggttgggacagg

SEQ ID NO: 940867 - DNA, 19 bp, Homo sapiens
tggggttgggattgggggc

SEQ ID NO: 940868 - DNA, 18 bp, Homo sapiens
tggggttggggcaaagcc

SEQ ID NO: 940869 - DNA, 14 bp, Homo sapiens
tggggttgtccccg

SEQ ID NO: 940870 - DNA, 15 bp, Homo sapiens
tggggtttttattat

SEQ ID NO: 940871 - DNA, 22 bp, Homo sapiens
tggggttttttttttctgaata

SEQ ID NO: 940872 - DNA, 23 bp, Homo sapiens
tggggttttttttttctgaataa

SEQ ID NO: 940873 - DNA, 23 bp, Homo sapiens
tgggtaaaatacttttactctgc

SEQ ID NO: 940874 - DNA, 14 bp, Homo sapiens
tgggtaacgtgaga

SEQ ID NO: 940875 - DNA, 16 bp, Homo sapiens
tgggtaactagggaag

SEQ ID NO: 940876 - DNA, 13 bp, Homo sapiens
tgggtaagaaagc

SEQ ID NO: 940877 - DNA, 18 bp, Homo sapiens
tgggtaatgaaacaaaga

SEQ ID NO: 940878 - DNA, 19 bp, Homo sapiens
tgggtacctggtccccact

SEQ ID NO: 940879 - DNA, 22 bp, Homo sapiens
tgggtagctgtaaggcatgaag

SEQ ID NO: 940880 - DNA, 19 bp, Homo sapiens
tgggtaggagcccttctct

SEQ ID NO: 940881 - DNA, 17 bp, Homo sapiens
tgggtagggcagacatg

SEQ ID NO: 940882 - DNA, 16 bp, Homo sapiens
tgggtatcccctgcct

SEQ ID NO: 940883 - DNA, 18 bp, Homo sapiens
tgggtatcccctgcctcc

SEQ ID NO: 940884 - DNA, 21 bp, Homo sapiens
tgggtcaaaagagccctggct

SEQ ID NO: 940885 - DNA, 22 bp, Homo sapiens
tgggtcaaaagagccctggctc

SEQ ID NO: 940886 - DNA, 18 bp, Homo sapiens
tgggtcacccctccagga

SEQ ID NO: 940887 - DNA, 18 bp, Homo sapiens
tgggtcactacagggaga

SEQ ID NO: 940888 - DNA, 16 bp, Homo sapiens
tgggtcagaacatgtt

SEQ ID NO: 940889 - DNA, 18 bp, Homo sapiens
tgggtcagaacatgttaa

SEQ ID NO: 940890 - DNA, 14 bp, Homo sapiens
tgggtcatagaaat

SEQ ID NO: 940891 - DNA, 18 bp, Homo sapiens
tgggtccaggaaggcagc

SEQ ID NO: 940892 - DNA, 22 bp, Homo sapiens
tgggtccaggaaggcagctgct

SEQ ID NO: 940893 - DNA, 20 bp, Homo sapiens
tgggtccaggggtctgtctg

SEQ ID NO: 940894 - DNA, 14 bp, Homo sapiens
tgggtccatgggca

SEQ ID NO: 940895 - DNA, 18 bp, Homo sapiens
tgggtccatgggcagagc

SEQ ID NO: 940896 - DNA, 17 bp, Homo sapiens
tgggtccattcagatga

SEQ ID NO: 940897 - DNA, 12 bp, Homo sapiens
tgggtccctgct

SEQ ID NO: 940898 - DNA, 14 bp, Homo sapiens
tgggtccctgctcc

SEQ ID NO: 940899 - DNA, 13 bp, Homo sapiens
tgggtcctagccc

SEQ ID NO: 940900 - DNA, 18 bp, Homo sapiens
tgggtcctagcccttccc

SEQ ID NO: 940901 - DNA, 21 bp, Homo sapiens
tgggtcctagcccttccctga

SEQ ID NO: 940902 - DNA, 18 bp, Homo sapiens
tgggtcctgggcaggtgg

SEQ ID NO: 940903 - DNA, 18 bp, Homo sapiens
tgggtccttgatgccaga

SEQ ID NO: 940904 - DNA, 20 bp, Homo sapiens
tgggtccttgatgccagagg

SEQ ID NO: 940905 - DNA, 21 bp, Homo sapiens
tgggtccttgatgccagaggg

SEQ ID NO: 940906 - DNA, 21 bp, Homo sapiens
tgggtctaggacacagttcct

SEQ ID NO: 940907 - DNA, 22 bp, Homo sapiens
tgggtctaggacacagttcctg

SEQ ID NO: 940908 - DNA, 13 bp, Homo sapiens
tgggtctcactcc

SEQ ID NO: 940909 - DNA, 23 bp, Homo sapiens
tgggtctctgaagggaccccccc

SEQ ID NO: 940910 - DNA, 18 bp, Homo sapiens
tgggtctgcacagattct

SEQ ID NO: 940911 - DNA, 12 bp, Homo sapiens
tgggtctgccct

SEQ ID NO: 940912 - DNA, 17 bp, Homo sapiens
tgggtctgccctgccca

SEQ ID NO: 940913 - DNA, 17 bp, Homo sapiens
tgggtctggatgggagg

SEQ ID NO: 940914 - DNA, 19 bp, Homo sapiens
tgggtctggggacaggccc

SEQ ID NO: 940915 - DNA, 11 bp, Homo sapiens
tgggtcttcca

SEQ ID NO: 940916 - DNA, 17 bp, Homo sapiens
tgggtctttaataaaac

SEQ ID NO: 940917 - DNA, 19 bp, Homo sapiens
tgggtctttaataaaacaa

SEQ ID NO: 940918 - DNA, 20 bp, Homo sapiens
tggtccagctctgacatccc

SEQ ID NO: 940919 - DNA, 22 bp, Homo sapiens
tggtccagcttgctcttcagtg

SEQ ID NO: 940920 - DNA, 16 bp, Homo sapiens
tggtccaggagaaggc

SEQ ID NO: 940921 - DNA, 16 bp, Homo sapiens
tggtccaggccctgtg

SEQ ID NO: 940922 - DNA, 14 bp, Homo sapiens
tggtccagggttga

SEQ ID NO: 940923 - DNA, 18 bp, Homo sapiens
tggtccatgcagggggct

SEQ ID NO: 940924 - DNA, 16 bp, Homo sapiens
tggtccatttgttcct

SEQ ID NO: 940925 - DNA, 11 bp, Homo sapiens
tggtcccctcc

SEQ ID NO: 940926 - DNA, 23 bp, Homo sapiens
tgtaaaagttataataactgaac

SEQ ID NO: 940927 - DNA, 12 bp, Homo sapiens
tgtaaaataatt

SEQ ID NO: 940928 - DNA, 20 bp, Homo sapiens
tgtaaaatagcttgtatagt

SEQ ID NO: 940929 - DNA, 21 bp, Homo sapiens
tgtaaaatagcttgtatagtg

SEQ ID NO: 940930 - DNA, 13 bp, Homo sapiens
tgtaaaatatgta

SEQ ID NO: 940931 - DNA, 20 bp, Homo sapiens
tgtaaaatattttgaatcaa

SEQ ID NO: 940932 - DNA, 16 bp, Homo sapiens
tgtaaaatccacagct

SEQ ID NO: 940933 - DNA, 23 bp, Homo sapiens
tgtaaaatccacagctatatcct

SEQ ID NO: 940934 - DNA, 14 bp, Homo sapiens
tgtaaaatgaaatt

SEQ ID NO: 940935 - DNA, 13 bp, Homo sapiens
tgtaaaatgcttt

SEQ ID NO: 940936 - DNA, 23 bp, Homo sapiens
tgtaaaatgcttttcactttctg

SEQ ID NO: 940937 - DNA, 14 bp, Homo sapiens
tgtaaaatgtatat

SEQ ID NO: 940938 - DNA, 19 bp, Homo sapiens
tgtaaaatttatttatatt

SEQ ID NO: 940939 - DNA, 13 bp, Homo sapiens
tgtaaaatttgtg

SEQ ID NO: 940940 - DNA, 20 bp, Homo sapiens
tgtaaacaggagacaggaag

SEQ ID NO: 940941 - DNA, 19 bp, Homo sapiens
tgtaaacctgagtcgtaca

SEQ ID NO: 940942 - DNA, 16 bp, Homo sapiens
tgtaaacggtgctatt

SEQ ID NO: 940943 - DNA, 19 bp, Homo sapiens
tgtaaacggtgctatttct

SEQ ID NO: 940944 - DNA, 15 bp, Homo sapiens
tgtaaactcaaaata

SEQ ID NO: 940945 - DNA, 23 bp, Homo sapiens
tgtaaactcaaaatatttgtaca

SEQ ID NO: 940946 - DNA, 23 bp, Homo sapiens
tgtaaactcgggggtgctggggc

SEQ ID NO: 940947 - DNA, 18 bp, Homo sapiens
tgtaaactgcattagaaa

SEQ ID NO: 940948 - DNA, 22 bp, Homo sapiens
tgtaaactgccatatataacag

SEQ ID NO: 940949 - DNA, 14 bp, Homo sapiens
tgtaaactgtgtat

SEQ ID NO: 940950 - DNA, 19 bp, Homo sapiens
tgtaaactgtgtattccaa

SEQ ID NO: 940951 - DNA, 15 bp, Homo sapiens
tgtaaactgttgttt

SEQ ID NO: 940952 - DNA, 17 bp, Homo sapiens
tgtaaacttctgaagac

SEQ ID NO: 940953 - DNA, 22 bp, Homo sapiens
tgtaaacttctgaagactgaga

SEQ ID NO: 940954 - DNA, 17 bp, Homo sapiens
tgtaaactttatcactt

SEQ ID NO: 940955 - DNA, 18 bp, Homo sapiens
tgtaaagacaaataaatg

SEQ ID NO: 940956 - DNA, 12 bp, Homo sapiens
tgtaaagactgg

SEQ ID NO: 940957 - DNA, 16 bp, Homo sapiens
tgtaaagctaaaataa

SEQ ID NO: 940958 - DNA, 13 bp, Homo sapiens
tgtaaagcttgtc

SEQ ID NO: 940959 - DNA, 15 bp, Homo sapiens
tgtaaaggggcagct

SEQ ID NO: 940960 - DNA, 19 bp, Homo sapiens
tgtaaaggtatattgtgaa

SEQ ID NO: 940961 - DNA, 17 bp, Homo sapiens
tgtaaaggtttcatgtt

SEQ ID NO: 940962 - DNA, 19 bp, Homo sapiens
tgtaaagtatgtattattt

SEQ ID NO: 940963 - DNA, 13 bp, Homo sapiens
tgtaaagtatgtg

SEQ ID NO: 940964 - DNA, 18 bp, Homo sapiens
tgtaaagtatgtgagtag

SEQ ID NO: 940965 - DNA, 17 bp, Homo sapiens
tgtaaagtgtaaatcct

SEQ ID NO: 940966 - DNA, 20 bp, Homo sapiens
tgtaaagtgtgtgattgaag

SEQ ID NO: 940967 - DNA, 20 bp, Homo sapiens
tgtaaagttggttggataag

SEQ ID NO: 940968 - DNA, 20 bp, Homo sapiens
tgtaaataaaatgtgtacag

SEQ ID NO: 940969 - DNA, 21 bp, Homo sapiens
tgtaaataaaatgtgtacagt

SEQ ID NO: 940970 - DNA, 13 bp, Homo sapiens
tgtaaataaagcc

SEQ ID NO: 940971 - DNA, 21 bp, Homo sapiens
tgtaaataaccacaaggtcca

SEQ ID NO: 940972 - DNA, 18 bp, Homo sapiens
tgtaaataattttctaag

SEQ ID NO: 940973 - DNA, 19 bp, Homo sapiens
tgtaaataattttctaaga

SEQ ID NO: 940974 - DNA, 22 bp, Homo sapiens
tgtaaataattttctaagacag

SEQ ID NO: 940975 - DNA, 17 bp, Homo sapiens
tgtaaataccaagagca

SEQ ID NO: 940976 - DNA, 18 bp, Homo sapiens
tgtaaatactggactcag

SEQ ID NO: 940977 - DNA, 19 bp, Homo sapiens
tgtaaatactggactcagg

SEQ ID NO: 940978 - DNA, 22 bp, Homo sapiens
tgtaaatactggtgcacttctt

SEQ ID NO: 940979 - DNA, 17 bp, Homo sapiens
tgtaaataggattttta

SEQ ID NO: 940980 - DNA, 17 bp, Homo sapiens
tgtaaatataatcagac

SEQ ID NO: 940981 - DNA, 17 bp, Homo sapiens
tgtaaatatataaatat

SEQ ID NO: 940982 - DNA, 14 bp, Homo sapiens
tgtaaatatcccag

SEQ ID NO: 940983 - DNA, 13 bp, Homo sapiens
tgtaaatatccct

SEQ ID NO: 940984 - DNA, 19 bp, Homo sapiens
tgtaaatatccctcccctc

SEQ ID NO: 940985 - DNA, 15 bp, Homo sapiens
tgtaaatatgtttgt

SEQ ID NO: 940986 - DNA, 14 bp, Homo sapiens
tgtaaatattctat

SEQ ID NO: 940987 - DNA, 18 bp, Homo sapiens
tgtaaatattcttgtcca

SEQ ID NO: 940988 - DNA, 15 bp, Homo sapiens
tgtaaatattgtgtg

SEQ ID NO: 940989 - DNA, 12 bp, Homo sapiens
tgtaaatattta

SEQ ID NO: 940990 - DNA, 18 bp, Homo sapiens
tgtaaatatttatttatg

SEQ ID NO: 940991 - DNA, 14 bp, Homo sapiens
tgtaaatattttaa

SEQ ID NO: 940992 - DNA, 17 bp, Homo sapiens
tgtaaatattttaaaga

SEQ ID NO: 940993 - DNA, 22 bp, Homo sapiens
tgtaaatattttaaagaattgt

SEQ ID NO: 940994 - DNA, 21 bp, Homo sapiens
tgtaaatcatgttgatcatgt

SEQ ID NO: 940995 - DNA, 13 bp, Homo sapiens
tgtaaatctgcca

SEQ ID NO: 940996 - DNA, 16 bp, Homo sapiens
tgtaaatctttttgct

SEQ ID NO: 940997 - DNA, 15 bp, Homo sapiens
tgtaaatgctggtat

SEQ ID NO: 940998 - DNA, 17 bp, Homo sapiens
tgtaaatggtgtacata

SEQ ID NO: 940999 - DNA, 11 bp, Homo sapiens
tgtaaattatt

SEQ ID NO: 941000 - DNA, 23 bp, Homo sapiens
tgtaaattattgatgattttgta

SEQ ID NO: 941001 - DNA, 13 bp, Homo sapiens
tgtaaattattgt

SEQ ID NO: 941002 - DNA, 17 bp, Homo sapiens
tgtaaattattgtaaac

SEQ ID NO: 941003 - DNA, 15 bp, Homo sapiens
tgtaaattgcacaga

SEQ ID NO: 941004 - DNA, 23 bp, Homo sapiens
tgtaaattgcacagagcacactt

SEQ ID NO: 941005 - DNA, 18 bp, Homo sapiens
tgtaaattgcagaattca

SEQ ID NO: 941006 - DNA, 19 bp, Homo sapiens
tgtaaattgcagaattcaa

SEQ ID NO: 941007 - DNA, 21 bp, Homo sapiens
tgtaaattgcagaattcaaaa

SEQ ID NO: 941008 - DNA, 14 bp, Homo sapiens
tgtaaatttagtgt

SEQ ID NO: 941009 - DNA, 12 bp, Homo sapiens
tgtaaattttag

SEQ ID NO: 941010 - DNA, 15 bp, Homo sapiens
tgtaacaattgtgta

SEQ ID NO: 941011 - DNA, 16 bp, Homo sapiens
tgtaacacaagccaca

SEQ ID NO: 941012 - DNA, 21 bp, Homo sapiens
tgtaacacaagccacagaagc

SEQ ID NO: 941013 - DNA, 16 bp, Homo sapiens
tgtaacagtcaaatat

SEQ ID NO: 941014 - DNA, 13 bp, Homo sapiens
tgtaacagttgtg

SEQ ID NO: 941015 - DNA, 17 bp, Homo sapiens
tgtaacatactggcctg

SEQ ID NO: 941016 - DNA, 15 bp, Homo sapiens
tgtaacatcataatt

SEQ ID NO: 941017 - DNA, 16 bp, Homo sapiens
tgtaacatcataatta

SEQ ID NO: 941018 - DNA, 19 bp, Homo sapiens
tgtaacatcataattacat

SEQ ID NO: 941019 - DNA, 11 bp, Homo sapiens
tgtaacatgta

SEQ ID NO: 941020 - DNA, 16 bp, Homo sapiens
tgtaacattggtgaag

SEQ ID NO: 941021 - DNA, 16 bp, Homo sapiens
tgtaacccttgaattt

SEQ ID NO: 941022 - DNA, 14 bp, Homo sapiens
tgtaacctcagctc

SEQ ID NO: 941023 - DNA, 16 bp, Homo sapiens
tgtaacctcagctctg

SEQ ID NO: 941024 - DNA, 12 bp, Homo sapiens
tgtaacctcagt

SEQ ID NO: 941025 - DNA, 18 bp, Homo sapiens
tgtaacggttaactgtaa

SEQ ID NO: 941026 - DNA, 23 bp, Homo sapiens
tgtaactaaaataattttgtaat

SEQ ID NO: 941027 - DNA, 17 bp, Homo sapiens
tgtaactacaatgatgg

SEQ ID NO: 941028 - DNA, 16 bp, Homo sapiens
tgtaactactttataa

SEQ ID NO: 941029 - DNA, 17 bp, Homo sapiens
tgtaactactttataac

SEQ ID NO: 941030 - DNA, 16 bp, Homo sapiens
tgtaactattaacctt

SEQ ID NO: 941031 - DNA, 17 bp, Homo sapiens
tgtaactattaaccttt

SEQ ID NO: 941032 - DNA, 19 bp, Homo sapiens
tgtaactatttcttcagag

SEQ ID NO: 941033 - DNA, 13 bp, Homo sapiens
tgtaactccacca

SEQ ID NO: 941034 - DNA, 18 bp, Homo sapiens
tgtaactctaaaagatcc

SEQ ID NO: 941035 - DNA, 19 bp, Homo sapiens
tgtaactctaaaagatcct

SEQ ID NO: 941036 - DNA, 20 bp, Homo sapiens
tgtaactctaaaagatcctt

SEQ ID NO: 941037 - DNA, 14 bp, Homo sapiens
tgtaactctccagc

SEQ ID NO: 941038 - DNA, 15 bp, Homo sapiens
tgtaactctccagcc

SEQ ID NO: 941039 - DNA, 16 bp, Homo sapiens
tgtaactgagagaaag

SEQ ID NO: 941040 - DNA, 13 bp, Homo sapiens
tgtaactgcccag

SEQ ID NO: 941041 - DNA, 19 bp, Homo sapiens
tgtaactgcccagcccctt

SEQ ID NO: 941042 - DNA, 15 bp, Homo sapiens
tgtaactttaaacat

SEQ ID NO: 941043 - DNA, 16 bp, Homo sapiens
tgtaacttttgtaaga

SEQ ID NO: 941044 - DNA, 18 bp, Homo sapiens
tgtaactttttttcagtt

SEQ ID NO: 941045 - DNA, 12 bp, Homo sapiens
tgtaagaaatac

SEQ ID NO: 941046 - DNA, 20 bp, Homo sapiens
tgtaagaacaatgccagggc

SEQ ID NO: 941047 - DNA, 12 bp, Homo sapiens
tgtaagaactgt

SEQ ID NO: 941048 - DNA, 17 bp, Homo sapiens
tgtaagaagagactggg

SEQ ID NO: 941049 - DNA, 21 bp, Homo sapiens
tgtaagaagagactgggaaga

SEQ ID NO: 941050 - DNA, 14 bp, Homo sapiens
tgtaagaaggcaat

SEQ ID NO: 941051 - DNA, 18 bp, Homo sapiens
tgtaagacatttgtatat

SEQ ID NO: 941052 - DNA, 20 bp, Homo sapiens
tgtaagacatttgtatattg

SEQ ID NO: 941053 - DNA, 21 bp, Homo sapiens
tgtaagacatttgtatattgt

SEQ ID NO: 941054 - DNA, 18 bp, Homo sapiens
tgtaagacccttattgct

SEQ ID NO: 941055 - DNA, 22 bp, Homo sapiens
tgtaagacccttattgctgtcc

SEQ ID NO: 941056 - DNA, 22 bp, Homo sapiens
tgtaagagcaccttcctcactt

SEQ ID NO: 941057 - DNA, 19 bp, Homo sapiens
tgtaagagcttgctccaga

SEQ ID NO: 941058 - DNA, 22 bp, Homo sapiens
tgtaagatatttgcagtttttc

SEQ ID NO: 941059 - DNA, 12 bp, Homo sapiens
tgtaagatgctg

SEQ ID NO: 941060 - DNA, 17 bp, Homo sapiens
tgtaagatgctgggttg

SEQ ID NO: 941061 - DNA, 21 bp, Homo sapiens
tgtaagatttgtttttaaact

SEQ ID NO: 941062 - DNA, 23 bp, Homo sapiens
tgtaagatttgtttttaaactgt

SEQ ID NO: 941063 - DNA, 22 bp, Homo sapiens
tgtaagcaaaggctctgaaata

SEQ ID NO: 941064 - DNA, 18 bp, Homo sapiens
tgtaagcaacttgcttct

SEQ ID NO: 941065 - DNA, 22 bp, Homo sapiens
tgtaagcatactttgtaaatag

SEQ ID NO: 941066 - DNA, 20 bp, Homo sapiens
tgtaagcattctgagctggg

SEQ ID NO: 941067 - DNA, 22 bp, Homo sapiens
tgtaagcattctgagctgggct

SEQ ID NO: 941068 - DNA, 19 bp, Homo sapiens
tgtaaggatccggaaagaa

SEQ ID NO: 941069 - DNA, 15 bp, Homo sapiens
tgtaaggcatgaagg

SEQ ID NO: 941070 - DNA, 14 bp, Homo sapiens
tgtaagggcagtgc

SEQ ID NO: 941071 - DNA, 15 bp, Homo sapiens
tgtaagggcagtgcc

SEQ ID NO: 941072 - DNA, 16 bp, Homo sapiens
tgtaagggcagtgccc

SEQ ID NO: 941073 - DNA, 16 bp, Homo sapiens
tgtaaggtcatgctgg

SEQ ID NO: 941074 - DNA, 22 bp, Homo sapiens
tgtaaggtcttcttgtgtcctg

SEQ ID NO: 941075 - DNA, 17 bp, Homo sapiens
tgtaaggtctttgtaaa

SEQ ID NO: 941076 - DNA, 19 bp, Homo sapiens
tgtaagtaataatttgtaa

SEQ ID NO: 941077 - DNA, 15 bp, Homo sapiens
tgtaagtgaaattaa

SEQ ID NO: 941078 - DNA, 13 bp, Homo sapiens
tgtaagtgtagct

SEQ ID NO: 941079 - DNA, 16 bp, Homo sapiens
tgtaagtgtagctcaa

SEQ ID NO: 941080 - DNA, 15 bp, Homo sapiens
tgtaagtgtgtgtgt

SEQ ID NO: 941081 - DNA, 16 bp, Homo sapiens
tgtaagttgaagcaaa

SEQ ID NO: 941082 - DNA, 13 bp, Homo sapiens
tgtaagtttattt

SEQ ID NO: 941083 - DNA, 15 bp, Homo sapiens
tgtaagtttattttt

SEQ ID NO: 941084 - DNA, 20 bp, Homo sapiens
tgtaataaaaagtatatgtt

SEQ ID NO: 941085 - DNA, 15 bp, Homo sapiens
tgtaataaagtatat

SEQ ID NO: 941086 - DNA, 19 bp, Homo sapiens
tgtaataaagtatataatt

SEQ ID NO: 941087 - DNA, 12 bp, Homo sapiens
tgtaataaattc

SEQ ID NO: 941088 - DNA, 16 bp, Homo sapiens
tgtaataaattcaaaa

SEQ ID NO: 941089 - DNA, 19 bp, Homo sapiens
tgtaataataaagaatagc

SEQ ID NO: 941090 - DNA, 15 bp, Homo sapiens
tgtaatacttaaata

SEQ ID NO: 941091 - DNA, 18 bp, Homo sapiens
tgtaatagatgtttgata

SEQ ID NO: 941092 - DNA, 17 bp, Homo sapiens
tgtaatataaagtattc

SEQ ID NO: 941093 - DNA, 20 bp, Homo sapiens
tgtaatataaatttaagcaa

SEQ ID NO: 941094 - DNA, 15 bp, Homo sapiens
tgtaatatattgtac

SEQ ID NO: 941095 - DNA, 17 bp, Homo sapiens
tgtaatatattgtacaa

SEQ ID NO: 941096 - DNA, 20 bp, Homo sapiens
tgtaatatattgtacaaatg

SEQ ID NO: 941097 - DNA, 21 bp, Homo sapiens
tgtaatatattgtacaaatgt

SEQ ID NO: 941098 - DNA, 22 bp, Homo sapiens
tgtaatatggaaatcttttaca

SEQ ID NO: 941099 - DNA, 14 bp, Homo sapiens
tgtaatattctgtt

SEQ ID NO: 941100 - DNA, 14 bp, Homo sapiens
tgtaatattgtaaa

SEQ ID NO: 941101 - DNA, 21 bp, Homo sapiens
tgtaatatttacaatgtatta

SEQ ID NO: 941102 - DNA, 22 bp, Homo sapiens
tgtaatatttacataaagactg

SEQ ID NO: 941103 - DNA, 16 bp, Homo sapiens
tgtaatatttgaattt

SEQ ID NO: 941104 - DNA, 17 bp, Homo sapiens
tgtaatatttgaatttt

SEQ ID NO: 941105 - DNA, 23 bp, Homo sapiens
tgtaatcaagcctttatggctgc

SEQ ID NO: 941106 - DNA, 23 bp, Homo sapiens
tgtaatcaatatcccaacattct

SEQ ID NO: 941107 - DNA, 14 bp, Homo sapiens
tgtaatcaatgttt

SEQ ID NO: 941108 - DNA, 17 bp, Homo sapiens
tgtaatcatataataaa

SEQ ID NO: 941109 - DNA, 16 bp, Homo sapiens
tgtaatcatgtacttt

SEQ ID NO: 941110 - DNA, 21 bp, Homo sapiens
tgtaatcatttcttgggccct

SEQ ID NO: 941111 - DNA, 20 bp, Homo sapiens
tgtaatcattttaaattcca

SEQ ID NO: 941112 - DNA, 16 bp, Homo sapiens
tgtaatcccagcactt

SEQ ID NO: 941113 - DNA, 23 bp, Homo sapiens
tgtaatcccagcactttgggagg

SEQ ID NO: 941114 - DNA, 21 bp, Homo sapiens
tgtaatcccagctactcgaga

SEQ ID NO: 941115 - DNA, 17 bp, Homo sapiens
tgtaatcccagctactt

SEQ ID NO: 941116 - DNA, 22 bp, Homo sapiens
tgtaatcccagctacttgggag

SEQ ID NO: 941117 - DNA, 17 bp, Homo sapiens
tgtaatcgtgtgccatg

SEQ ID NO: 941118 - DNA, 18 bp, Homo sapiens
tgtaatctaagtatatgt

SEQ ID NO: 941119 - DNA, 14 bp, Homo sapiens
tgtaatctctctgc

SEQ ID NO: 941120 - DNA, 18 bp, Homo sapiens
tgtaatctctctgcagct

SEQ ID NO: 941121 - DNA, 20 bp, Homo sapiens
tgtaatctctctgcagctgc

SEQ ID NO: 941122 - DNA, 18 bp, Homo sapiens
tgtaatcttaaaagtgta

SEQ ID NO: 941123 - DNA, 20 bp, Homo sapiens
tgtaatcttatttaggaagt

SEQ ID NO: 941124 - DNA, 15 bp, Homo sapiens
tgtaatctttttctc

SEQ ID NO: 941125 - DNA, 15 bp, Homo sapiens
tgtaatgaaaatgaa

SEQ ID NO: 941126 - DNA, 19 bp, Homo sapiens
tgtaatgaattcctagaat

SEQ ID NO: 941127 - DNA, 12 bp, Homo sapiens
tgtaatgacagg

SEQ ID NO: 941128 - DNA, 18 bp, Homo sapiens
tgtaatgcaaaaggctga

SEQ ID NO: 941129 - DNA, 18 bp, Homo sapiens
tgtaatgcactgttttta

SEQ ID NO: 941130 - DNA, 12 bp, Homo sapiens
tgtaatgctgca

SEQ ID NO: 941131 - DNA, 22 bp, Homo sapiens
tgtaatggagcatcaagccact

SEQ ID NO: 941132 - DNA, 20 bp, Homo sapiens
tgtaatggtatcttaaagtg

SEQ ID NO: 941133 - DNA, 21 bp, Homo sapiens
tgtaatgtaggcacttttatt

SEQ ID NO: 941134 - DNA, 19 bp, Homo sapiens
tgtaatgtcaccaccttcc

SEQ ID NO: 941135 - DNA, 23 bp, Homo sapiens
tgtaatgtcaccaccttcccagc

SEQ ID NO: 941136 - DNA, 13 bp, Homo sapiens
tgtaatgtggtca

SEQ ID NO: 941137 - DNA, 18 bp, Homo sapiens
tgtaatgtgtactggtca

SEQ ID NO: 941138 - DNA, 19 bp, Homo sapiens
tgtaatgtgtgaaaaagat

SEQ ID NO: 941139 - DNA, 23 bp, Homo sapiens
tgtaatgtgtgaaaaagatgcca

SEQ ID NO: 941140 - DNA, 20 bp, Homo sapiens
tgtaatgtgtggtggcctca

SEQ ID NO: 941141 - DNA, 14 bp, Homo sapiens
tgtaatgttactga

SEQ ID NO: 941142 - DNA, 17 bp, Homo sapiens
tgtaatgttactgatca

SEQ ID NO: 941143 - DNA, 19 bp, Homo sapiens
tgtaatgttttctttgcaa

SEQ ID NO: 941144 - DNA, 14 bp, Homo sapiens
tgtaattaaaagca

SEQ ID NO: 941145 - DNA, 20 bp, Homo sapiens
tgtaattaaaagcaaatcat

SEQ ID NO: 941146 - DNA, 19 bp, Homo sapiens
tgtaattaactgtaaactt

SEQ ID NO: 941147 - DNA, 19 bp, Homo sapiens
tgtaattaagtactatgta

SEQ ID NO: 941148 - DNA, 16 bp, Homo sapiens
tgtaattatgttttca

SEQ ID NO: 941149 - DNA, 16 bp, Homo sapiens
tgtaattcagaatcat

SEQ ID NO: 941150 - DNA, 14 bp, Homo sapiens
tgtaattcaggact

SEQ ID NO: 941151 - DNA, 17 bp, Homo sapiens
tgtaattcttatgacta

SEQ ID NO: 941152 - DNA, 16 bp, Homo sapiens
tgtaattgcttacatt

SEQ ID NO: 941153 - DNA, 16 bp, Homo sapiens
tgtaattgtaattcca

SEQ ID NO: 941154 - DNA, 18 bp, Homo sapiens
tgtaattgtaattttgaa

SEQ ID NO: 941155 - DNA, 22 bp, Homo sapiens
tgtaattgtgtaaaaaatggaa

SEQ ID NO: 941156 - DNA, 17 bp, Homo sapiens
tgtaattgttgtttgta

SEQ ID NO: 941157 - DNA, 20 bp, Homo sapiens
tgtaattgttgtttgtatgt

SEQ ID NO: 941158 - DNA, 23 bp, Homo sapiens
tgtaattgttgtttgtatgtata

SEQ ID NO: 941159 - DNA, 15 bp, Homo sapiens
tgtaatttaaacagg

SEQ ID NO: 941160 - DNA, 23 bp, Homo sapiens
tgtaatttaaacaggcccagcat

SEQ ID NO: 941161 - DNA, 13 bp, Homo sapiens
tgtaatttatgca

SEQ ID NO: 941162 - DNA, 12 bp, Homo sapiens
tgtaatttcaaa

SEQ ID NO: 941163 - DNA, 17 bp, Homo sapiens
tgtaatttcaaaataca

SEQ ID NO: 941164 - DNA, 18 bp, Homo sapiens
tgtaatttcaaaatacat

SEQ ID NO: 941165 - DNA, 18 bp, Homo sapiens
tgtaatttcgccttaaac

SEQ ID NO: 941166 - DNA, 19 bp, Homo sapiens
tgtactccagcctgggtga

SEQ ID NO: 941167 - DNA, 14 bp, Homo sapiens
tgtactcccagcac

SEQ ID NO: 941168 - DNA, 12 bp, Homo sapiens
tgtactcctccc

SEQ ID NO: 941169 - DNA, 19 bp, Homo sapiens
tgtactctacgccaaagtg

SEQ ID NO: 941170 - DNA, 20 bp, Homo sapiens
tgtactctttatttctagca

SEQ ID NO: 941171 - DNA, 14 bp, Homo sapiens
tgtactgaattttt

SEQ ID NO: 941172 - DNA, 17 bp, Homo sapiens
tgtactgatttcagtaa

SEQ ID NO: 941173 - DNA, 12 bp, Homo sapiens
tgtactgcaaag

SEQ ID NO: 941174 - DNA, 12 bp, Homo sapiens
tgtactgcatgt

SEQ ID NO: 941175 - DNA, 19 bp, Homo sapiens
tgtactgggttaatggcta

SEQ ID NO: 941176 - DNA, 21 bp, Homo sapiens
tgtactggtcagcttgctcag

SEQ ID NO: 941177 - DNA, 13 bp, Homo sapiens
tgtactgtgcctg

SEQ ID NO: 941178 - DNA, 13 bp, Homo sapiens
tgtacttaaatga

SEQ ID NO: 941179 - DNA, 14 bp, Homo sapiens
tgtacttaaatgag

SEQ ID NO: 941180 - DNA, 17 bp, Homo sapiens
tgtacttagctgtacta

SEQ ID NO: 941181 - DNA, 14 bp, Homo sapiens
tgtacttcactgtc

SEQ ID NO: 941182 - DNA, 12 bp, Homo sapiens
tgtacttcctgt

SEQ ID NO: 941183 - DNA, 17 bp, Homo sapiens
tgtacttctctgtgtgc

SEQ ID NO: 941184 - DNA, 13 bp, Homo sapiens
tgtacttctgctc

SEQ ID NO: 941185 - DNA, 18 bp, Homo sapiens
tgtacttctgtgttcatt

SEQ ID NO: 941186 - DNA, 14 bp, Homo sapiens
tgtatatgtatata

SEQ ID NO: 941187 - DNA, 14 bp, Homo sapiens
tgtatatgtattcc

SEQ ID NO: 941188 - DNA, 21 bp, Homo sapiens
tgtatatgtattcccttgtat

SEQ ID NO: 941189 - DNA, 14 bp, Homo sapiens
tgtatatgtattta

SEQ ID NO: 941190 - DNA, 18 bp, Homo sapiens
tgtatattaaaatagcat

SEQ ID NO: 941191 - DNA, 19 bp, Homo sapiens
tgtatattaaaatagcata

SEQ ID NO: 941192 - DNA, 16 bp, Homo sapiens
tgtatattaaggtgtg

SEQ ID NO: 941193 - DNA, 19 bp, Homo sapiens
tgtatattaaggtgtggct

SEQ ID NO: 941194 - DNA, 19 bp, Homo sapiens
tgtatattatataactctt

SEQ ID NO: 941195 - DNA, 21 bp, Homo sapiens
tgtatattccaccattcacat

SEQ ID NO: 941196 - DNA, 17 bp, Homo sapiens
tgtatattccatgtata

SEQ ID NO: 941197 - DNA, 13 bp, Homo sapiens
tgtatattccttt

SEQ ID NO: 941198 - DNA, 23 bp, Homo sapiens
tgtatattgagaatcccttaaaa

SEQ ID NO: 941199 - DNA, 20 bp, Homo sapiens
tgtatattgggtgtagattt

SEQ ID NO: 941200 - DNA, 14 bp, Homo sapiens
tgtatattgtaatt

SEQ ID NO: 941201 - DNA, 17 bp, Homo sapiens
tgtatattgtaatttaa

SEQ ID NO: 941202 - DNA, 19 bp, Homo sapiens
tgtatattgtcagatattt

SEQ ID NO: 941203 - DNA, 20 bp, Homo sapiens
tgtatattgtggatgtgttc

SEQ ID NO: 941204 - DNA, 14 bp, Homo sapiens
tgtatatttattca

SEQ ID NO: 941205 - DNA, 16 bp, Homo sapiens
tgtatatttattcata

SEQ ID NO: 941206 - DNA, 17 bp, Homo sapiens
tgtatatttattcataa

SEQ ID NO: 941207 - DNA, 20 bp, Homo sapiens
tgtatatttattcataatga

SEQ ID NO: 941208 - DNA, 14 bp, Homo sapiens
tgtatatttgctgc

SEQ ID NO: 941209 - DNA, 16 bp, Homo sapiens
tgtatatttgctgcaa

SEQ ID NO: 941210 - DNA, 19 bp, Homo sapiens
tgtatatttgctgcaaaga

SEQ ID NO: 941211 - DNA, 16 bp, Homo sapiens
tgtatatttgtacaaa

SEQ ID NO: 941212 - DNA, 16 bp, Homo sapiens
tgtatatttgtatgat

SEQ ID NO: 941213 - DNA, 21 bp, Homo sapiens
tgtatatttgtgatagcactt

SEQ ID NO: 941214 - DNA, 12 bp, Homo sapiens
tgtatattttat

SEQ ID NO: 941215 - DNA, 17 bp, Homo sapiens
tgtatattttatataaa

SEQ ID NO: 941216 - DNA, 22 bp, Homo sapiens
tgtatatttttatctatataaa

SEQ ID NO: 941217 - DNA, 17 bp, Homo sapiens
tgtatcaaacccacgat

SEQ ID NO: 941218 - DNA, 15 bp, Homo sapiens
tgtatcaaactagtg

SEQ ID NO: 941219 - DNA, 21 bp, Homo sapiens
tgtatcaaatctgtatatgtt

SEQ ID NO: 941220 - DNA, 14 bp, Homo sapiens
tgtatcaaatgtta

SEQ ID NO: 941221 - DNA, 15 bp, Homo sapiens
tgtatcagccagcct

SEQ ID NO: 941222 - DNA, 16 bp, Homo sapiens
tgtatcataattacca

SEQ ID NO: 941223 - DNA, 19 bp, Homo sapiens
tgtatcataattaccaagt

SEQ ID NO: 941224 - DNA, 17 bp, Homo sapiens
tgtatcatagaaatgta

SEQ ID NO: 941225 - DNA, 17 bp, Homo sapiens
tgtatcatttttgtgca

SEQ ID NO: 941226 - DNA, 18 bp, Homo sapiens
tgtatccaaggaaacatt

SEQ ID NO: 941227 - DNA, 20 bp, Homo sapiens
tgtatccacacaaattcagt

SEQ ID NO: 941228 - DNA, 13 bp, Homo sapiens
tgtatccagagct

SEQ ID NO: 941229 - DNA, 14 bp, Homo sapiens
tgtatccagaggaa

SEQ ID NO: 941230 - DNA, 18 bp, Homo sapiens
tgtatccattaacctggg

SEQ ID NO: 941231 - DNA, 20 bp, Homo sapiens
tgtatcccccccctgtatag

SEQ ID NO: 941232 - DNA, 17 bp, Homo sapiens
tgtatcctggaacaata

SEQ ID NO: 941233 - DNA, 18 bp, Homo sapiens
tgtatcctggaacaatat

SEQ ID NO: 941234 - DNA, 15 bp, Homo sapiens
tgtatcggagacagt

SEQ ID NO: 941235 - DNA, 17 bp, Homo sapiens
tgtatcggagacagtga

SEQ ID NO: 941236 - DNA, 19 bp, Homo sapiens
tgtatctaagaataataaa

SEQ ID NO: 941237 - DNA, 19 bp, Homo sapiens
tgtatctacagtaatgaaa

SEQ ID NO: 941238 - DNA, 16 bp, Homo sapiens
tgtatctagaaagaga

SEQ ID NO: 941239 - DNA, 15 bp, Homo sapiens
tgtatctagcttctt

SEQ ID NO: 941240 - DNA, 16 bp, Homo sapiens
tgtatctatttgtaca

SEQ ID NO: 941241 - DNA, 17 bp, Homo sapiens
tgtatctatttgtacaa

SEQ ID NO: 941242 - DNA, 21 bp, Homo sapiens
tgtatctatttttttttcttt

SEQ ID NO: 941243 - DNA, 18 bp, Homo sapiens
tgtatctcatactgtctg

SEQ ID NO: 941244 - DNA, 17 bp, Homo sapiens
tgtatctctgaagcatg

SEQ ID NO: 941245 - DNA, 16 bp, Homo sapiens
tgtatctctttcacat

SEQ ID NO: 941246 - DNA, 19 bp, Homo sapiens
tgtatctgagttgccaaga

SEQ ID NO: 941247 - DNA, 20 bp, Homo sapiens
tgtatctgcaggcagacacg

SEQ ID NO: 941248 - DNA, 16 bp, Homo sapiens
tgtatctgtctttcca

SEQ ID NO: 941249 - DNA, 22 bp, Homo sapiens
tgtatctgtctttccactctgg

SEQ ID NO: 941250 - DNA, 22 bp, Homo sapiens
tgtatctgtgcttctaatatta

SEQ ID NO: 941251 - DNA, 14 bp, Homo sapiens
tgtatctgtgcttt

SEQ ID NO: 941252 - DNA, 13 bp, Homo sapiens
tgtatcttccttt

SEQ ID NO: 941253 - DNA, 16 bp, Homo sapiens
tgtatcttcctttctt

SEQ ID NO: 941254 - DNA, 14 bp, Homo sapiens
tgtatctttatgct

SEQ ID NO: 941255 - DNA, 21 bp, Homo sapiens
tgtatctttatgctgtatttt

SEQ ID NO: 941256 - DNA, 18 bp, Homo sapiens
tgtatgaaaaattgggga

SEQ ID NO: 941257 - DNA, 21 bp, Homo sapiens
tgtatgaaaaattggggagga

SEQ ID NO: 941258 - DNA, 11 bp, Homo sapiens
tgtatgaaaat

SEQ ID NO: 941259 - DNA, 14 bp, Homo sapiens
tgtatgaaatatat

SEQ ID NO: 941260 - DNA, 21 bp, Homo sapiens
tgtatgaaggaatcattccag

SEQ ID NO: 941261 - DNA, 14 bp, Homo sapiens
tgtatgaaggcttt

SEQ ID NO: 941262 - DNA, 20 bp, Homo sapiens
tgtatgaataaaaggctgga

SEQ ID NO: 941263 - DNA, 13 bp, Homo sapiens
tgtatgacagtga

SEQ ID NO: 941264 - DNA, 23 bp, Homo sapiens
tgtatgacagtgaagcagcactg

SEQ ID NO: 941265 - DNA, 17 bp, Homo sapiens
tgtatgactgcacatga

SEQ ID NO: 941266 - DNA, 23 bp, Homo sapiens
tgtatgagagggccctgcctgct

SEQ ID NO: 941267 - DNA, 15 bp, Homo sapiens
tgtatgagttgcatt

SEQ ID NO: 941268 - DNA, 14 bp, Homo sapiens
tgtatgatactaaa

SEQ ID NO: 941269 - DNA, 15 bp, Homo sapiens
tgtatgatactaaag

SEQ ID NO: 941270 - DNA, 16 bp, Homo sapiens
tgtatgatactaaaga

SEQ ID NO: 941271 - DNA, 19 bp, Homo sapiens
tgtatgatgctaatcttgt

SEQ ID NO: 941272 - DNA, 13 bp, Homo sapiens
tgtatgattactg

SEQ ID NO: 941273 - DNA, 15 bp, Homo sapiens
tgtatgcacacacat

SEQ ID NO: 941274 - DNA, 19 bp, Homo sapiens
tgtatgcacacacatatat

SEQ ID NO: 941275 - DNA, 18 bp, Homo sapiens
tgtatgccaagtgagaag

SEQ ID NO: 941276 - DNA, 20 bp, Homo sapiens
tgtatgccaagtgagaagat

SEQ ID NO: 941277 - DNA, 19 bp, Homo sapiens
tgtatgccacacctggcct

SEQ ID NO: 941278 - DNA, 15 bp, Homo sapiens
tgtatgtttcttctt

SEQ ID NO: 941279 - DNA, 14 bp, Homo sapiens
tgtatgtttgcaca

SEQ ID NO: 941280 - DNA, 16 bp, Homo sapiens
tgtatgtttgcacact

SEQ ID NO: 941281 - DNA, 22 bp, Homo sapiens
tgtatgtttgcacacttgtgtg

SEQ ID NO: 941282 - DNA, 17 bp, Homo sapiens
tgtatgtttttttccaa

SEQ ID NO: 941283 - DNA, 17 bp, Homo sapiens
tgtattaaaaaaaacaa

SEQ ID NO: 941284 - DNA, 18 bp, Homo sapiens
tgtattaaatcttaaaca

SEQ ID NO: 941285 - DNA, 20 bp, Homo sapiens
tgtattaaatcttaaacaat

SEQ ID NO: 941286 - DNA, 12 bp, Homo sapiens
tgtattaacaaa

SEQ ID NO: 941287 - DNA, 13 bp, Homo sapiens
tgtattaacaaaa

SEQ ID NO: 941288 - DNA, 19 bp, Homo sapiens
tgtattaacaaaagttccc

SEQ ID NO: 941289 - DNA, 21 bp, Homo sapiens
tgtattaagccaaacatgagt

SEQ ID NO: 941290 - DNA, 14 bp, Homo sapiens
tgtattaagccaat

SEQ ID NO: 941291 - DNA, 22 bp, Homo sapiens
tgtattaagcccacagtatatt

SEQ ID NO: 941292 - DNA, 15 bp, Homo sapiens
tgtattaataaagca

SEQ ID NO: 941293 - DNA, 18 bp, Homo sapiens
tgtattaatcatagatta

SEQ ID NO: 941294 - DNA, 22 bp, Homo sapiens
tgtattaatccccatcattact

SEQ ID NO: 941295 - DNA, 16 bp, Homo sapiens
tgtattaatttctgat

SEQ ID NO: 941296 - DNA, 15 bp, Homo sapiens
tgtattacataaata

SEQ ID NO: 941297 - DNA, 15 bp, Homo sapiens
tgtattaggaaaata

SEQ ID NO: 941298 - DNA, 13 bp, Homo sapiens
tgtattataattg

SEQ ID NO: 941299 - DNA, 21 bp, Homo sapiens
tgtattataattgttgatatt

SEQ ID NO: 941300 - DNA, 15 bp, Homo sapiens
tgtattatgtcctgt

SEQ ID NO: 941301 - DNA, 20 bp, Homo sapiens
tgtattatgtcctgtgagat

SEQ ID NO: 941302 - DNA, 19 bp, Homo sapiens
tgtattatgtgcctaattt

SEQ ID NO: 941303 - DNA, 15 bp, Homo sapiens
tgtattattacaaat

SEQ ID NO: 941304 - DNA, 15 bp, Homo sapiens
tgtattattattaaa

SEQ ID NO: 941305 - DNA, 16 bp, Homo sapiens
tgtattattctgcagc

SEQ ID NO: 941306 - DNA, 21 bp, Homo sapiens
tgtattcaagcaaacatcaaa

SEQ ID NO: 941307 - DNA, 13 bp, Homo sapiens
tgtattccaagac

SEQ ID NO: 941308 - DNA, 18 bp, Homo sapiens
tgtattcccttgtatttt

SEQ ID NO: 941309 - DNA, 21 bp, Homo sapiens
tgtattctctgagctgtgcag

SEQ ID NO: 941310 - DNA, 12 bp, Homo sapiens
tgtattctctgt

SEQ ID NO: 941311 - DNA, 15 bp, Homo sapiens
tgtattcttctgtat

SEQ ID NO: 941312 - DNA, 22 bp, Homo sapiens
tgtattcttctgtatttctagg

SEQ ID NO: 941313 - DNA, 23 bp, Homo sapiens
tgtattcttgctttagaaaacat

SEQ ID NO: 941314 - DNA, 16 bp, Homo sapiens
tgtattcttgtttgaa

SEQ ID NO: 941315 - DNA, 22 bp, Homo sapiens
tgtattcttttccaagctcctt

SEQ ID NO: 941316 - DNA, 16 bp, Homo sapiens
tgtattgactgtacca

SEQ ID NO: 941317 - DNA, 22 bp, Homo sapiens
tgtattgagggccagtgatgat

SEQ ID NO: 941318 - DNA, 20 bp, Homo sapiens
tgtattgagtcttaactgta

SEQ ID NO: 941319 - DNA, 22 bp, Homo sapiens
tgtattgagtcttaactgtatt

SEQ ID NO: 941320 - DNA, 15 bp, Homo sapiens
tgtattgatgcaata

SEQ ID NO: 941321 - DNA, 12 bp, Homo sapiens
tgtattgattca

SEQ ID NO: 941322 - DNA, 18 bp, Homo sapiens
tgtattgattcaacaggg

SEQ ID NO: 941323 - DNA, 19 bp, Homo sapiens
tgtattgcacattgtaaaa

SEQ ID NO: 941324 - DNA, 16 bp, Homo sapiens
tgtattgcccccatgg

SEQ ID NO: 941325 - DNA, 12 bp, Homo sapiens
tgtattgcttta

SEQ ID NO: 941326 - DNA, 15 bp, Homo sapiens
tgtattgtaaatgtg

SEQ ID NO: 941327 - DNA, 16 bp, Homo sapiens
tgtattgtaaatgtgg

SEQ ID NO: 941328 - DNA, 18 bp, Homo sapiens
tgtattgtatattacaat

SEQ ID NO: 941329 - DNA, 21 bp, Homo sapiens
tgtattgtatattacaatgat

SEQ ID NO: 941330 - DNA, 17 bp, Homo sapiens
tgtattgttagatgttt

SEQ ID NO: 941331 - DNA, 12 bp, Homo sapiens
tgtattgttccc

SEQ ID NO: 941332 - DNA, 14 bp, Homo sapiens
tgtattgttcccag

SEQ ID NO: 941333 - DNA, 19 bp, Homo sapiens
tgtattgttcccagtgaca

SEQ ID NO: 941334 - DNA, 16 bp, Homo sapiens
tgtattgttttcccaa

SEQ ID NO: 941335 - DNA, 16 bp, Homo sapiens
tgtatttaaaaaaatc

SEQ ID NO: 941336 - DNA, 16 bp, Homo sapiens
tgtatttaacagaaat

SEQ ID NO: 941337 - DNA, 11 bp, Homo sapiens
tgtatttaatt

SEQ ID NO: 941338 - DNA, 20 bp, Homo sapiens
tgtatttacgctttgattca

SEQ ID NO: 941339 - DNA, 21 bp, Homo sapiens
tgtatttacgctttgattcat

SEQ ID NO: 941340 - DNA, 16 bp, Homo sapiens
tgtatttagtagttat

SEQ ID NO: 941341 - DNA, 14 bp, Homo sapiens
tgtatttataaata

SEQ ID NO: 941342 - DNA, 22 bp, Homo sapiens
tgtatttatacccccaggaaac

SEQ ID NO: 941343 - DNA, 21 bp, Homo sapiens
tgtatttatattttgtgctat

SEQ ID NO: 941344 - DNA, 22 bp, Homo sapiens
tgtatttattggttttgcagaa

SEQ ID NO: 941345 - DNA, 18 bp, Homo sapiens
tgtatttatttaaaactc

SEQ ID NO: 941346 - DNA, 18 bp, Homo sapiens
tgtatttattttcctccc

SEQ ID NO: 941347 - DNA, 22 bp, Homo sapiens
tgtatttcctgaaataaatgtt

SEQ ID NO: 941348 - DNA, 11 bp, Homo sapiens
tgtatttctaa

SEQ ID NO: 941349 - DNA, 15 bp, Homo sapiens
tgtatttctaagaag

SEQ ID NO: 941350 - DNA, 15 bp, Homo sapiens
tgtatttctcttgtc

SEQ ID NO: 941351 - DNA, 13 bp, Homo sapiens
tgtatttcttata

SEQ ID NO: 941352 - DNA, 14 bp, Homo sapiens
tgtatttctttgta

SEQ ID NO: 941353 - DNA, 14 bp, Homo sapiens
tgtatttgagaaga

SEQ ID NO: 941354 - DNA, 13 bp, Homo sapiens
tgtatttggaaat

SEQ ID NO: 941355 - DNA, 20 bp, Homo sapiens
tgtatttggaatatttgaat

SEQ ID NO: 941356 - DNA, 21 bp, Homo sapiens
tgtatttgtattaataaagca

SEQ ID NO: 941357 - DNA, 13 bp, Homo sapiens
tgtattttaacta

SEQ ID NO: 941358 - DNA, 15 bp, Homo sapiens
tgtattttaactcat

SEQ ID NO: 941359 - DNA, 16 bp, Homo sapiens
tgtattttattcagta

SEQ ID NO: 941360 - DNA, 13 bp, Homo sapiens
tgtattttcaact

SEQ ID NO: 941361 - DNA, 14 bp, Homo sapiens
tgtattttcagctc

SEQ ID NO: 941362 - DNA, 19 bp, Homo sapiens
tgtattttcatagatgtgt

SEQ ID NO: 941363 - DNA, 14 bp, Homo sapiens
tgtattttcatagt

SEQ ID NO: 941364 - DNA, 12 bp, Homo sapiens
tgtattttccta

SEQ ID NO: 941365 - DNA, 13 bp, Homo sapiens
tgtattttcctgg

SEQ ID NO: 941366 - DNA, 15 bp, Homo sapiens
tgtcaagccataatt

SEQ ID NO: 941367 - DNA, 20 bp, Homo sapiens
tgtcaagccccattccctct

SEQ ID NO: 941368 - DNA, 19 bp, Homo sapiens
tgtcaaggccgagggccag

SEQ ID NO: 941369 - DNA, 16 bp, Homo sapiens
tgtcaagtctctgctg

SEQ ID NO: 941370 - DNA, 17 bp, Homo sapiens
tgtcaagtctctgctgg

SEQ ID NO: 941371 - DNA, 19 bp, Homo sapiens
tgtcaagtctctgctggcc

SEQ ID NO: 941372 - DNA, 18 bp, Homo sapiens
tgtcaagttaacaaggaa

SEQ ID NO: 941373 - DNA, 21 bp, Homo sapiens
tgtcaagttaacaaggaatgc

SEQ ID NO: 941374 - DNA, 15 bp, Homo sapiens
tgtcaagttgtgctt

SEQ ID NO: 941375 - DNA, 16 bp, Homo sapiens
tgtcaataaacagctt

SEQ ID NO: 941376 - DNA, 23 bp, Homo sapiens
tgtcaataaacagcttcatgcct

SEQ ID NO: 941377 - DNA, 13 bp, Homo sapiens
tgtcaataaatga

SEQ ID NO: 941378 - DNA, 14 bp, Homo sapiens
tgtcaataaatgac

SEQ ID NO: 941379 - DNA, 21 bp, Homo sapiens
tgtcaataaatgacacccaga

SEQ ID NO: 941380 - DNA, 14 bp, Homo sapiens
tgtcaatattaaat

SEQ ID NO: 941381 - DNA, 21 bp, Homo sapiens
tgtcaatattaaatacagaca

SEQ ID NO: 941382 - DNA, 15 bp, Homo sapiens
tgtcaatctgtccgt

SEQ ID NO: 941383 - DNA, 16 bp, Homo sapiens
tgtcaattaccagaaa

SEQ ID NO: 941384 - DNA, 19 bp, Homo sapiens
tgtcaatttatgaatataa

SEQ ID NO: 941385 - DNA, 19 bp, Homo sapiens
tgtcaatttccctgactcc

SEQ ID NO: 941386 - DNA, 17 bp, Homo sapiens
tgtcaatttgtatatca

SEQ ID NO: 941387 - DNA, 18 bp, Homo sapiens
tgtcaatttgtatatcat

SEQ ID NO: 941388 - DNA, 18 bp, Homo sapiens
tgtcacaacctctctgat

SEQ ID NO: 941389 - DNA, 19 bp, Homo sapiens
tgtcacaataaatggccag

SEQ ID NO: 941390 - DNA, 16 bp, Homo sapiens
tgtcacaataaatgta

SEQ ID NO: 941391 - DNA, 12 bp, Homo sapiens
tgtcacacactg

SEQ ID NO: 941392 - DNA, 19 bp, Homo sapiens
tgtcacagaaatcagagga

SEQ ID NO: 941393 - DNA, 14 bp, Homo sapiens
tgtcacaggctggg

SEQ ID NO: 941394 - DNA, 16 bp, Homo sapiens
tgtcacaggctgggtc

SEQ ID NO: 941395 - DNA, 17 bp, Homo sapiens
tgtcacaggctgggtca

SEQ ID NO: 941396 - DNA, 17 bp, Homo sapiens
tgtcacagggactgaaa

SEQ ID NO: 941397 - DNA, 16 bp, Homo sapiens
tgtcacagtaaaaata

SEQ ID NO: 941398 - DNA, 18 bp, Homo sapiens
tgtcacagtaaaaataaa

SEQ ID NO: 941399 - DNA, 18 bp, Homo sapiens
tgtcacagtttcaggctt

SEQ ID NO: 941400 - DNA, 21 bp, Homo sapiens
tgtcacatggtgcccctagct

SEQ ID NO: 941401 - DNA, 17 bp, Homo sapiens
tgtcacattatttatta

SEQ ID NO: 941402 - DNA, 23 bp, Homo sapiens
tgtcacatttttcttgttttgtc

SEQ ID NO: 941403 - DNA, 23 bp, Homo sapiens
tgtcaccaaggaaacgctacctc

SEQ ID NO: 941404 - DNA, 18 bp, Homo sapiens
tgtcaccaccctgctcat

SEQ ID NO: 941405 - DNA, 22 bp, Homo sapiens
tgtcaccaccctgctcatccac

SEQ ID NO: 941406 - DNA, 15 bp, Homo sapiens
tgtcaccagctatct

SEQ ID NO: 941407 - DNA, 19 bp, Homo sapiens
tgtcaccagctatctgtca

SEQ ID NO: 941408 - DNA, 18 bp, Homo sapiens
tgtcacccaaagcctgtc

SEQ ID NO: 941409 - DNA, 22 bp, Homo sapiens
tgtcaccctccacctcttcacc

SEQ ID NO: 941410 - DNA, 16 bp, Homo sapiens
tgtcaccctgtgggtg

SEQ ID NO: 941411 - DNA, 21 bp, Homo sapiens
tgtcaccctgtgggtgtctcc

SEQ ID NO: 941412 - DNA, 17 bp, Homo sapiens
tgtcaccggtcagtgcc

SEQ ID NO: 941413 - DNA, 12 bp, Homo sapiens
tgtcacctcagc

SEQ ID NO: 941414 - DNA, 19 bp, Homo sapiens
tgtcacctgctcacaggga

SEQ ID NO: 941415 - DNA, 22 bp, Homo sapiens
tgtcacctgctcacagggatgc

SEQ ID NO: 941416 - DNA, 12 bp, Homo sapiens
tgtcacctggct

SEQ ID NO: 941417 - DNA, 15 bp, Homo sapiens
tgtcactcactgagg

SEQ ID NO: 941418 - DNA, 10 bp, Homo sapiens
tgtcactgcc

SEQ ID NO: 941419 - DNA, 11 bp, Homo sapiens
tgtcactgcca

SEQ ID NO: 941420 - DNA, 19 bp, Homo sapiens
tgtcactgccgacatccct

SEQ ID NO: 941421 - DNA, 16 bp, Homo sapiens
tgtcactggcagagca

SEQ ID NO: 941422 - DNA, 18 bp, Homo sapiens
tgtcactgtttctctgct

SEQ ID NO: 941423 - DNA, 19 bp, Homo sapiens
tgtcacttgccacatggtg

SEQ ID NO: 941424 - DNA, 18 bp, Homo sapiens
tgtcacttgtgctttgct

SEQ ID NO: 941425 - DNA, 17 bp, Homo sapiens
tgtcacttttccttttc

SEQ ID NO: 941426 - DNA, 18 bp, Homo sapiens
tgtcacttttccttttct

SEQ ID NO: 941427 - DNA, 16 bp, Homo sapiens
tgtcactttttatgct

SEQ ID NO: 941428 - DNA, 16 bp, Homo sapiens
tgtcactttttctgat

SEQ ID NO: 941429 - DNA, 15 bp, Homo sapiens
tgtcagaagcctcca

SEQ ID NO: 941430 - DNA, 22 bp, Homo sapiens
tgtcagaagcttggcatgacct

SEQ ID NO: 941431 - DNA, 22 bp, Homo sapiens
tgtcagaagggggttgtggcaa

SEQ ID NO: 941432 - DNA, 21 bp, Homo sapiens
tgtcagaataggaaaacattg

SEQ ID NO: 941433 - DNA, 24 bp, Homo sapiens
tgtcagaatggaatccatctgtct

SEQ ID NO: 941434 - DNA, 13 bp, Homo sapiens
tgtcagacacaga

SEQ ID NO: 941435 - DNA, 23 bp, Homo sapiens
tgtcagacagaacttgaatgtgt

SEQ ID NO: 941436 - DNA, 23 bp, Homo sapiens
tgtcagacatccatgtttgtaaa

SEQ ID NO: 941437 - DNA, 15 bp, Homo sapiens
tgtcagaccctggag

SEQ ID NO: 941438 - DNA, 17 bp, Homo sapiens
tgtcagaccctggaggc

SEQ ID NO: 941439 - DNA, 16 bp, Homo sapiens
tgtcagacttccaaat

SEQ ID NO: 941440 - DNA, 14 bp, Homo sapiens
tgtcagagcccagg

SEQ ID NO: 941441 - DNA, 22 bp, Homo sapiens
tgtcagagctatgttccctcca

SEQ ID NO: 941442 - DNA, 11 bp, Homo sapiens
tgtcagagctg

SEQ ID NO: 941443 - DNA, 14 bp, Homo sapiens
tgtcagagctggga

SEQ ID NO: 941444 - DNA, 15 bp, Homo sapiens
tgtcagaggacccca

SEQ ID NO: 941445 - DNA, 20 bp, Homo sapiens
tgtcagaggcacaaaagggt

SEQ ID NO: 941446 - DNA, 20 bp, Homo sapiens
tgtcagatattttttcagaa

SEQ ID NO: 941447 - DNA, 10 bp, Homo sapiens
tgtcagatgc

SEQ ID NO: 941448 - DNA, 20 bp, Homo sapiens
tgtgactgaagaagatgagc

SEQ ID NO: 941449 - DNA, 22 bp, Homo sapiens
tgtgactgaagaagatgagcct

SEQ ID NO: 941450 - DNA, 20 bp, Homo sapiens
tgtgactgagcaagactctt

SEQ ID NO: 941451 - DNA, 22 bp, Homo sapiens
tgtgactgccaggataaagctt

SEQ ID NO: 941452 - DNA, 15 bp, Homo sapiens
tgtgacttacaattt

SEQ ID NO: 941453 - DNA, 14 bp, Homo sapiens
tgtgacttcactgt

SEQ ID NO: 941454 - DNA, 16 bp, Homo sapiens
tgtgacttcactgtat

SEQ ID NO: 941455 - DNA, 18 bp, Homo sapiens
tgtgacttcactgtatat

SEQ ID NO: 941456 - DNA, 15 bp, Homo sapiens
tgtgacttctccagg

SEQ ID NO: 941457 - DNA, 14 bp, Homo sapiens
tgtgacttttaaaa

SEQ ID NO: 941458 - DNA, 19 bp, Homo sapiens
tgtgactttttagccagtg

SEQ ID NO: 941459 - DNA, 12 bp, Homo sapiens
tgtgactttttt

SEQ ID NO: 941460 - DNA, 21 bp, Homo sapiens
tgtgagaagccagccagaggc

SEQ ID NO: 941461 - DNA, 22 bp, Homo sapiens
tgtgagaagtgaatgctgggac

SEQ ID NO: 941462 - DNA, 16 bp, Homo sapiens
tgtgagacccccacac

SEQ ID NO: 941463 - DNA, 18 bp, Homo sapiens
tgtgagacccccacacct

SEQ ID NO: 941464 - DNA, 19 bp, Homo sapiens
tgtgagacccccacacctc

SEQ ID NO: 941465 - DNA, 15 bp, Homo sapiens
tgtgagactactaag

SEQ ID NO: 941466 - DNA, 13 bp, Homo sapiens
tgtgagagagact

SEQ ID NO: 941467 - DNA, 19 bp, Homo sapiens
tgtgagagtgtgagcaggg

SEQ ID NO: 941468 - DNA, 16 bp, Homo sapiens
tgtgagagttgtctct

SEQ ID NO: 941469 - DNA, 20 bp, Homo sapiens
tgtgagcagtggacacgtga

SEQ ID NO: 941470 - DNA, 14 bp, Homo sapiens
tgtgagcatcctgc

SEQ ID NO: 941471 - DNA, 22 bp, Homo sapiens
tgtgagccacagtgcctggccc

SEQ ID NO: 941472 - DNA, 16 bp, Homo sapiens
tgtgagccaccgctgc

SEQ ID NO: 941473 - DNA, 19 bp, Homo sapiens
tgtgagccaccgtgcctgg

SEQ ID NO: 941474 - DNA, 23 bp, Homo sapiens
tgtgagccactgcgcccagcctg

SEQ ID NO: 941475 - DNA, 19 bp, Homo sapiens
tgtgagccatgcctccctg

SEQ ID NO: 941476 - DNA, 23 bp, Homo sapiens
tgtgagccatgcctccctgggcc

SEQ ID NO: 941477 - DNA, 17 bp, Homo sapiens
tgtgagcccctggtcct

SEQ ID NO: 941478 - DNA, 15 bp, Homo sapiens
tgtgagccctctagg

SEQ ID NO: 941479 - DNA, 16 bp, Homo sapiens
tgtgagccctctaggg

SEQ ID NO: 941480 - DNA, 16 bp, Homo sapiens
tgtgagcgtggccttg

SEQ ID NO: 941481 - DNA, 17 bp, Homo sapiens
tgtgagcgtggccttgg

SEQ ID NO: 941482 - DNA, 18 bp, Homo sapiens
tgtgagctggatagactt

SEQ ID NO: 941483 - DNA, 22 bp, Homo sapiens
tgtgagctggatagacttggga

SEQ ID NO: 941484 - DNA, 17 bp, Homo sapiens
tgtgagctttgaagtag

SEQ ID NO: 941485 - DNA, 19 bp, Homo sapiens
tgtgaggaagtgtggaaaa

SEQ ID NO: 941486 - DNA, 17 bp, Homo sapiens
tgtgaggagctgctggc

SEQ ID NO: 941487 - DNA, 12 bp, Homo sapiens
tgtgaggcaggg

SEQ ID NO: 941488 - DNA, 21 bp, Homo sapiens
tgtgaggcattcggggaagct

SEQ ID NO: 941489 - DNA, 14 bp, Homo sapiens
tgtgaggccagggc

SEQ ID NO: 941490 - DNA, 16 bp, Homo sapiens
tgtgaggccagggcag

SEQ ID NO: 941491 - DNA, 17 bp, Homo sapiens
tgtgaggccagggcaga

SEQ ID NO: 941492 - DNA, 23 bp, Homo sapiens
tgtgaggcccatggttgagaaat

SEQ ID NO: 941493 - DNA, 18 bp, Homo sapiens
tgtgagggagtgcagaac

SEQ ID NO: 941494 - DNA, 20 bp, Homo sapiens
tgtgagtagcctatgaatga

SEQ ID NO: 941495 - DNA, 21 bp, Homo sapiens
tgtgagtagcctatgaatgaa

SEQ ID NO: 941496 - DNA, 19 bp, Homo sapiens
tgtgagtcctgttgaagac

SEQ ID NO: 941497 - DNA, 16 bp, Homo sapiens
tgtgagtgccttttgc

SEQ ID NO: 941498 - DNA, 21 bp, Homo sapiens
tgtgagtgccttttgcagaag

SEQ ID NO: 941499 - DNA, 14 bp, Homo sapiens
tgtgagtgcgcctc

SEQ ID NO: 941500 - DNA, 18 bp, Homo sapiens
tgtgagtgcgtgtgtgtg

SEQ ID NO: 941501 - DNA, 14 bp, Homo sapiens
tgtgagtggataat

SEQ ID NO: 941502 - DNA, 17 bp, Homo sapiens
tgtgagtggataatcag

SEQ ID NO: 941503 - DNA, 19 bp, Homo sapiens
tgtgagtggataatcagga

SEQ ID NO: 941504 - DNA, 14 bp, Homo sapiens
tgtgagtggcagcc

SEQ ID NO: 941505 - DNA, 20 bp, Homo sapiens
tgtgagtggcagccatgcct

SEQ ID NO: 941506 - DNA, 20 bp, Homo sapiens
tgtgagtgtaagtgtgagta

SEQ ID NO: 941507 - DNA, 12 bp, Homo sapiens
tgtgagtgtgac

SEQ ID NO: 941508 - DNA, 13 bp, Homo sapiens
tgtgagtgtgaca

SEQ ID NO: 941509 - DNA, 18 bp, Homo sapiens
tgtgagtgtgacagggcc

SEQ ID NO: 941510 - DNA, 16 bp, Homo sapiens
tgtgagtttaaagcaa

SEQ ID NO: 941511 - DNA, 23 bp, Homo sapiens
tgtgagtttaccttgtatactgt

SEQ ID NO: 941512 - DNA, 19 bp, Homo sapiens
tgtgagtttggtctggact

SEQ ID NO: 941513 - DNA, 16 bp, Homo sapiens
tgtgataaatcagtca

SEQ ID NO: 941514 - DNA, 17 bp, Homo sapiens
tgtgataactctgcaaa

SEQ ID NO: 941515 - DNA, 21 bp, Homo sapiens
tgtgataactctgcaaaggcc

SEQ ID NO: 941516 - DNA, 21 bp, Homo sapiens
tgtgatacaatgctgtgccct

SEQ ID NO: 941517 - DNA, 13 bp, Homo sapiens
tgtgatataaagg

SEQ ID NO: 941518 - DNA, 14 bp, Homo sapiens
tgtgcccccagcct

SEQ ID NO: 941519 - DNA, 16 bp, Homo sapiens
tgtgcccccagcctca

SEQ ID NO: 941520 - DNA, 17 bp, Homo sapiens
tgtgcccccagcctcag

SEQ ID NO: 941521 - DNA, 13 bp, Homo sapiens
tgtgccccctctg

SEQ ID NO: 941522 - DNA, 23 bp, Homo sapiens
tgtgcccctggcccatctcagcc

SEQ ID NO: 941523 - DNA, 20 bp, Homo sapiens
tgtgccctaaagtgtatttt

SEQ ID NO: 941524 - DNA, 21 bp, Homo sapiens
tgtgccctaaagtgtattttt

SEQ ID NO: 941525 - DNA, 18 bp, Homo sapiens
tgtgccctcaccccaatc

SEQ ID NO: 941526 - DNA, 15 bp, Homo sapiens
tgtgccctgggccag

SEQ ID NO: 941527 - DNA, 18 bp, Homo sapiens
tgtgccctgggccaggca

SEQ ID NO: 941528 - DNA, 11 bp, Homo sapiens
tgtgccctggt

SEQ ID NO: 941529 - DNA, 12 bp, Homo sapiens
tgtgcccttggg

SEQ ID NO: 941530 - DNA, 15 bp, Homo sapiens
tgtgcctaacaccag

SEQ ID NO: 941531 - DNA, 20 bp, Homo sapiens
tgtgcctatagtcccagcta

SEQ ID NO: 941532 - DNA, 15 bp, Homo sapiens
tgtgcctcaggccag

SEQ ID NO: 941533 - DNA, 17 bp, Homo sapiens
tgtgcctccaggaccag

SEQ ID NO: 941534 - DNA, 22 bp, Homo sapiens
tgtgcctcccttcccagtgggc

SEQ ID NO: 941535 - DNA, 18 bp, Homo sapiens
tgtgcctctgcccaagca

SEQ ID NO: 941536 - DNA, 13 bp, Homo sapiens
tgtgcctctgcct

SEQ ID NO: 941537 - DNA, 15 bp, Homo sapiens
tgtgcctgaccctac

SEQ ID NO: 941538 - DNA, 13 bp, Homo sapiens
tgtgcctgcagcc

SEQ ID NO: 941539 - DNA, 13 bp, Homo sapiens
tgtgcctgccctg

SEQ ID NO: 941540 - DNA, 22 bp, Homo sapiens
tgtgcctgccctggagggaggc

SEQ ID NO: 941541 - DNA, 13 bp, Homo sapiens
tgtgcctgctaga

SEQ ID NO: 941542 - DNA, 13 bp, Homo sapiens
tgtgcctggcccc

SEQ ID NO: 941543 - DNA, 13 bp, Homo sapiens
tgtgcctggggga

SEQ ID NO: 941544 - DNA, 21 bp, Homo sapiens
tgtgcctgtaatctttttctc

SEQ ID NO: 941545 - DNA, 14 bp, Homo sapiens
tgtgccttcgtctt

SEQ ID NO: 941546 - DNA, 19 bp, Homo sapiens
tgtgccttgattgattaga

SEQ ID NO: 941547 - DNA, 12 bp, Homo sapiens
tgtgccttgtcc

SEQ ID NO: 941548 - DNA, 17 bp, Homo sapiens
tgtgccttgtccaggaa

SEQ ID NO: 941549 - DNA, 15 bp, Homo sapiens
tgtgccttgtttttt

SEQ ID NO: 941550 - DNA, 16 bp, Homo sapiens
tgtgcctttgcaaatc

SEQ ID NO: 941551 - DNA, 20 bp, Homo sapiens
tgtgcctttgcaaatcagtg

SEQ ID NO: 941552 - DNA, 15 bp, Homo sapiens
tgtgccttttatagc

SEQ ID NO: 941553 - DNA, 16 bp, Homo sapiens
tgtgccttttatagct

SEQ ID NO: 941554 - DNA, 13 bp, Homo sapiens
tgtgccttttctg

SEQ ID NO: 941555 - DNA, 22 bp, Homo sapiens
tgtgcgcctgagtgagtgtgtg

SEQ ID NO: 941556 - DNA, 14 bp, Homo sapiens
tgtgcggaggcagg

SEQ ID NO: 941557 - DNA, 14 bp, Homo sapiens
tgtgcgtctctctt

SEQ ID NO: 941558 - DNA, 19 bp, Homo sapiens
tgtgcgtctctctttctcc

SEQ ID NO: 941559 - DNA, 15 bp, Homo sapiens
tgtgcgtgaaacaca

SEQ ID NO: 941560 - DNA, 16 bp, Homo sapiens
tgtgcgtgcgtgtgtg

SEQ ID NO: 941561 - DNA, 16 bp, Homo sapiens
tgtgctaagtctttcc

SEQ ID NO: 941562 - DNA, 23 bp, Homo sapiens
tgtgggtttgggtgcctcctgca

SEQ ID NO: 941563 - DNA, 18 bp, Homo sapiens
tgtgggtttggttagagg

SEQ ID NO: 941564 - DNA, 20 bp, Homo sapiens
tgtggtaattctatttgtat

SEQ ID NO: 941565 - DNA, 19 bp, Homo sapiens
tgtggtacatacacaccag

SEQ ID NO: 941566 - DNA, 19 bp, Homo sapiens
tgtggtacatggtgtttgt

SEQ ID NO: 941567 - DNA, 17 bp, Homo sapiens
tgtggtaccttcagccc

SEQ ID NO: 941568 - DNA, 18 bp, Homo sapiens
tgtggtaccttcagccct

SEQ ID NO: 941569 - DNA, 21 bp, Homo sapiens
tgtggtaccttcagccctggc

SEQ ID NO: 941570 - DNA, 13 bp, Homo sapiens
tgtggtagaaaca

SEQ ID NO: 941571 - DNA, 23 bp, Homo sapiens
tgtggtcacagcggaggtgtgga

SEQ ID NO: 941572 - DNA, 14 bp, Homo sapiens
tgtggtcacagtga

SEQ ID NO: 941573 - DNA, 14 bp, Homo sapiens
tgtggtcctagaag

SEQ ID NO: 941574 - DNA, 17 bp, Homo sapiens
tgtggtcttatgatttt

SEQ ID NO: 941575 - DNA, 19 bp, Homo sapiens
tgtggtgaagtgtggctgg

SEQ ID NO: 941576 - DNA, 20 bp, Homo sapiens
tgtggtgaagtgtggctggt

SEQ ID NO: 941577 - DNA, 18 bp, Homo sapiens
tgtggtgatgtgcctgta

SEQ ID NO: 941578 - DNA, 18 bp, Homo sapiens
tgtggtgggcgctgggga

SEQ ID NO: 941579 - DNA, 22 bp, Homo sapiens
tgtggtgggttctttggaagga

SEQ ID NO: 941580 - DNA, 23 bp, Homo sapiens
tgtggtgtgtccccctctgtcca

SEQ ID NO: 941581 - DNA, 19 bp, Homo sapiens
tgtggttaccgagtatctg

SEQ ID NO: 941582 - DNA, 21 bp, Homo sapiens
tgtggttaccgagtatctgta

SEQ ID NO: 941583 - DNA, 17 bp, Homo sapiens
tgtggttatttctctga

SEQ ID NO: 941584 - DNA, 23 bp, Homo sapiens
tgtggttcctaagcctgttgctg

SEQ ID NO: 941585 - DNA, 17 bp, Homo sapiens
tgtggttcctctgctca

SEQ ID NO: 941586 - DNA, 22 bp, Homo sapiens
tgtggttctataataagttttg

SEQ ID NO: 941587 - DNA, 13 bp, Homo sapiens
tgtggttctattt

SEQ ID NO: 941588 - DNA, 15 bp, Homo sapiens
tgtggttctatttta

SEQ ID NO: 941589 - DNA, 17 bp, Homo sapiens
tgtggtttcatgttagt

SEQ ID NO: 941590 - DNA, 22 bp, Homo sapiens
tgtggtttccctgcccctgtcc

SEQ ID NO: 941591 - DNA, 22 bp, Homo sapiens
tgtggtttgcattgtctccttc

SEQ ID NO: 941592 - DNA, 18 bp, Homo sapiens
tgtggtttggaatattaa

SEQ ID NO: 941593 - DNA, 18 bp, Homo sapiens
tgtggttttcgagattat

SEQ ID NO: 941594 - DNA, 13 bp, Homo sapiens
tgtggttttgtaa

SEQ ID NO: 941595 - DNA, 16 bp, Homo sapiens
tgtgtaaaaaatggaa

SEQ ID NO: 941596 - DNA, 14 bp, Homo sapiens
tgtgtaaagattta

SEQ ID NO: 941597 - DNA, 19 bp, Homo sapiens
tgtgtaaagatttatacag

SEQ ID NO: 941598 - DNA, 18 bp, Homo sapiens
tgtgtaacacttggctct

SEQ ID NO: 941599 - DNA, 13 bp, Homo sapiens
tgtgtaagatttg

SEQ ID NO: 941600 - DNA, 18 bp, Homo sapiens
tgtgtaataagaaagtat

SEQ ID NO: 941601 - DNA, 22 bp, Homo sapiens
tgtgtaatcatttcttgggccc

SEQ ID NO: 941602 - DNA, 23 bp, Homo sapiens
tgtgtaatcatttcttgggccct

SEQ ID NO: 941603 - DNA, 13 bp, Homo sapiens
tgtgtaatgaaaa

SEQ ID NO: 941604 - DNA, 17 bp, Homo sapiens
tgtgtaattgttccttt

SEQ ID NO: 941605 - DNA, 23 bp, Homo sapiens
tgtgtacaaaccaagagctttta

SEQ ID NO: 941606 - DNA, 19 bp, Homo sapiens
tgtgtacaaagaaataaca

SEQ ID NO: 941607 - DNA, 23 bp, Homo sapiens
tgtgtacagaattctgctacctc

SEQ ID NO: 941608 - DNA, 21 bp, Homo sapiens
tgtgtacagatgaatgataaa

SEQ ID NO: 941609 - DNA, 12 bp, Homo sapiens
tgtgtacagtga

SEQ ID NO: 941610 - DNA, 23 bp, Homo sapiens
tgtgtacagtgaattgtctttta

SEQ ID NO: 941611 - DNA, 19 bp, Homo sapiens
tgtgtacatggcagagttt

SEQ ID NO: 941612 - DNA, 23 bp, Homo sapiens
tgtgtactctttatttctagcag

SEQ ID NO: 941613 - DNA, 18 bp, Homo sapiens
tgtgtagacgatatactc

SEQ ID NO: 941614 - DNA, 13 bp, Homo sapiens
tgtgtagatttga

SEQ ID NO: 941615 - DNA, 15 bp, Homo sapiens
tgtgtagatttgaaa

SEQ ID NO: 941616 - DNA, 17 bp, Homo sapiens
tgtgtagatttgaaaat

SEQ ID NO: 941617 - DNA, 19 bp, Homo sapiens
tgtgtagatttgaaaattg

SEQ ID NO: 941618 - DNA, 16 bp, Homo sapiens
tgtgtagtcaataaaa

SEQ ID NO: 941619 - DNA, 12 bp, Homo sapiens
tgtgtatacata

SEQ ID NO: 941620 - DNA, 15 bp, Homo sapiens
tgtgtatacatgcca

SEQ ID NO: 941621 - DNA, 13 bp, Homo sapiens
tgtgtatataatt

SEQ ID NO: 941622 - DNA, 17 bp, Homo sapiens
tgtgtatatatcttata

SEQ ID NO: 941623 - DNA, 13 bp, Homo sapiens
tgtgtatatgtat

SEQ ID NO: 941624 - DNA, 14 bp, Homo sapiens
tgtgtatatgtatt

SEQ ID NO: 941625 - DNA, 21 bp, Homo sapiens
tgtgtatattgagaatccctt

SEQ ID NO: 941626 - DNA, 20 bp, Homo sapiens
tgtgtatgctgatgatcaaa

SEQ ID NO: 941627 - DNA, 11 bp, Homo sapiens
tgtgtatgtac

SEQ ID NO: 941628 - DNA, 14 bp, Homo sapiens
tgtgtatgtactta

SEQ ID NO: 941629 - DNA, 23 bp, Homo sapiens
tgtgtatgtacttagctgtacta

SEQ ID NO: 941630 - DNA, 18 bp, Homo sapiens
tgtgtatgtatacacaca

SEQ ID NO: 941631 - DNA, 14 bp, Homo sapiens
tgtgtatgtgcgtg

SEQ ID NO: 941632 - DNA, 16 bp, Homo sapiens
tgtgtatgtgtgtgag

SEQ ID NO: 941633 - DNA, 13 bp, Homo sapiens
tgtgtatgtttta

SEQ ID NO: 941634 - DNA, 16 bp, Homo sapiens
tgtgtattaaatggtt

SEQ ID NO: 941635 - DNA, 12 bp, Homo sapiens
tgtgtattgttc

SEQ ID NO: 941636 - DNA, 22 bp, Homo sapiens
tgtgtatttaacagggagggga

SEQ ID NO: 941637 - DNA, 14 bp, Homo sapiens
tgtgtatttatata

SEQ ID NO: 941638 - DNA, 22 bp, Homo sapiens
tgtgtatttatttaaaactctg

SEQ ID NO: 941639 - DNA, 19 bp, Homo sapiens
tgtgtatttccagtgcaat

SEQ ID NO: 941640 - DNA, 12 bp, Homo sapiens
tgtgtatttcta

SEQ ID NO: 941641 - DNA, 13 bp, Homo sapiens
tgtgtatttctaa

SEQ ID NO: 941642 - DNA, 16 bp, Homo sapiens
tgtgtattttctttgg

SEQ ID NO: 941643 - DNA, 17 bp, Homo sapiens
tgtgtatttttcaaggc

SEQ ID NO: 941644 - DNA, 22 bp, Homo sapiens
tgtgtcacttgtgctttgctct

SEQ ID NO: 941645 - DNA, 19 bp, Homo sapiens
tgtgtcagaataggaaaac

SEQ ID NO: 941646 - DNA, 14 bp, Homo sapiens
tgtgtcagaatctc

SEQ ID NO: 941647 - DNA, 17 bp, Homo sapiens
tgtgtcagagcctacct

SEQ ID NO: 941648 - DNA, 23 bp, Homo sapiens
tgtgtcagagcctaccttcacca

SEQ ID NO: 941649 - DNA, 19 bp, Homo sapiens
tgtgtcagcatagaagtaa

SEQ ID NO: 941650 - DNA, 14 bp, Homo sapiens
tgtgtcagctgagg

SEQ ID NO: 941651 - DNA, 16 bp, Homo sapiens
tgtgtcaggccctctg

SEQ ID NO: 941652 - DNA, 22 bp, Homo sapiens
tgtgtcatgaagaatgtttctg

SEQ ID NO: 941653 - DNA, 19 bp, Homo sapiens
tgtgtccacctgtgggtgt

SEQ ID NO: 941654 - DNA, 17 bp, Homo sapiens
tgtgtccacgactgtct

SEQ ID NO: 941655 - DNA, 18 bp, Homo sapiens
tgtgtccacgactgtctc

SEQ ID NO: 941656 - DNA, 14 bp, Homo sapiens
tgtgtccagcagct

SEQ ID NO: 941657 - DNA, 20 bp, Homo sapiens
tgtgtccagcattgaagaga

SEQ ID NO: 941658 - DNA, 14 bp, Homo sapiens
tgtgtccatctgac

SEQ ID NO: 941659 - DNA, 20 bp, Homo sapiens
tgtgtcccaaaatcccctca

SEQ ID NO: 941660 - DNA, 21 bp, Homo sapiens
tgtgtcccaaaatcccctcag

SEQ ID NO: 941661 - DNA, 19 bp, Homo sapiens
tgtgtcccatgatccctgt

SEQ ID NO: 941662 - DNA, 20 bp, Homo sapiens
tgtgtcccatgatccctgtg

SEQ ID NO: 941663 - DNA, 18 bp, Homo sapiens
tgtgtccccctctgtcca

SEQ ID NO: 941664 - DNA, 12 bp, Homo sapiens
tgtgtcccctca

SEQ ID NO: 941665 - DNA, 14 bp, Homo sapiens
tgtgtcccctcact

SEQ ID NO: 941666 - DNA, 15 bp, Homo sapiens
tgtgtcccctcactc

SEQ ID NO: 941667 - DNA, 17 bp, Homo sapiens
tgtgtcccctcactctg

SEQ ID NO: 941668 - DNA, 19 bp, Homo sapiens
tgtgtcccctcactctgtc

SEQ ID NO: 941669 - DNA, 21 bp, Homo sapiens
tgtgtcccctgacctgtccag

SEQ ID NO: 941670 - DNA, 17 bp, Homo sapiens
tgtgtccctcttctctt

SEQ ID NO: 941671 - DNA, 18 bp, Homo sapiens
tgtgtcctctgcctgggc

SEQ ID NO: 941672 - DNA, 19 bp, Homo sapiens
tgtgtcctggtgctctctg

SEQ ID NO: 941673 - DNA, 20 bp, Homo sapiens
tgtgtcctggtgctctctgc

SEQ ID NO: 941674 - DNA, 18 bp, Homo sapiens
tgtgtccttgaactgagg

SEQ ID NO: 941675 - DNA, 19 bp, Homo sapiens
tgtgtccttgcacctgcat

SEQ ID NO: 941676 - DNA, 18 bp, Homo sapiens
tgtgtcctttggtactat

SEQ ID NO: 941677 - DNA, 12 bp, Homo sapiens
tgtgtctaaact

SEQ ID NO: 941678 - DNA, 15 bp, Homo sapiens
tgtgtctaaactgca

SEQ ID NO: 941679 - DNA, 13 bp, Homo sapiens
tgtgtctcccaga

SEQ ID NO: 941680 - DNA, 16 bp, Homo sapiens
tgtgtctcctctcaga

SEQ ID NO: 941681 - DNA, 18 bp, Homo sapiens
tgtgtctctgctttcctt

SEQ ID NO: 941682 - DNA, 16 bp, Homo sapiens
tgtgtctcttttctct

SEQ ID NO: 941683 - DNA, 15 bp, Homo sapiens
tgtgtctgccaaaca

SEQ ID NO: 941684 - DNA, 14 bp, Homo sapiens
tgtgtctggacctc

SEQ ID NO: 941685 - DNA, 16 bp, Homo sapiens
tgtgtctgggagagcc

SEQ ID NO: 941686 - DNA, 20 bp, Homo sapiens
tgtgtttttaataaagacag

SEQ ID NO: 941687 - DNA, 16 bp, Homo sapiens
tgtgtttttctatata

SEQ ID NO: 941688 - DNA, 13 bp, Homo sapiens
tgtgtttttctca

SEQ ID NO: 941689 - DNA, 18 bp, Homo sapiens
tgtgtttttctttttcca

SEQ ID NO: 941690 - DNA, 14 bp, Homo sapiens
tgtgttttttaaga

SEQ ID NO: 941691 - DNA, 15 bp, Homo sapiens
tgtgttttttaagat

SEQ ID NO: 941692 - DNA, 16 bp, Homo sapiens
tgtgtttttttctaaa

SEQ ID NO: 941693 - DNA, 15 bp, Homo sapiens
tgttaaaaaagaaat

SEQ ID NO: 941694 - DNA, 18 bp, Homo sapiens
tgttaaaaaatttttgaa

SEQ ID NO: 941695 - DNA, 19 bp, Homo sapiens
tgttaaaaatagcagtatt

SEQ ID NO: 941696 - DNA, 13 bp, Homo sapiens
tgttaaaataaat

SEQ ID NO: 941697 - DNA, 20 bp, Homo sapiens
tgttaaaatatttgcctttt

SEQ ID NO: 941698 - DNA, 16 bp, Homo sapiens
tgttaaaatgtacact

SEQ ID NO: 941699 - DNA, 20 bp, Homo sapiens
tgttaaacaactctttaaag

SEQ ID NO: 941700 - DNA, 12 bp, Homo sapiens
tgttaaacagta

SEQ ID NO: 941701 - DNA, 22 bp, Homo sapiens
tgttaaactctgttgtaagtaa

SEQ ID NO: 941702 - DNA, 19 bp, Homo sapiens
tgttaaactgttagcactg

SEQ ID NO: 941703 - DNA, 21 bp, Homo sapiens
tgttaaactgttagcactgtt

SEQ ID NO: 941704 - DNA, 14 bp, Homo sapiens
tgttaaatggaatt

SEQ ID NO: 941705 - DNA, 17 bp, Homo sapiens
tgttaaatggaattcgt

SEQ ID NO: 941706 - DNA, 19 bp, Homo sapiens
tgttaaatggaattcgtgt

SEQ ID NO: 941707 - DNA, 13 bp, Homo sapiens
tgttaaattacat

SEQ ID NO: 941708 - DNA, 19 bp, Homo sapiens
tgttaacaatgcctattgt

SEQ ID NO: 941709 - DNA, 12 bp, Homo sapiens
tgttaacatcta

SEQ ID NO: 941710 - DNA, 19 bp, Homo sapiens
tgttaacctcagtgtcatt

SEQ ID NO: 941711 - DNA, 18 bp, Homo sapiens
tgttaaccttaaatacac

SEQ ID NO: 941712 - DNA, 20 bp, Homo sapiens
tgttaaccttaaatacactg

SEQ ID NO: 941713 - DNA, 21 bp, Homo sapiens
tgttaacgtgatgtgccacta

SEQ ID NO: 941714 - DNA, 14 bp, Homo sapiens
tgttaactacatat

SEQ ID NO: 941715 - DNA, 19 bp, Homo sapiens
tgttaactcttgtctattt

SEQ ID NO: 941716 - DNA, 20 bp, Homo sapiens
tgttaagaatgaagttctgc

SEQ ID NO: 941717 - DNA, 12 bp, Homo sapiens
tgttaagataac

SEQ ID NO: 941718 - DNA, 18 bp, Homo sapiens
tgttaagcagctaaattt

SEQ ID NO: 941719 - DNA, 20 bp, Homo sapiens
tgttaagcgtgtctgtattt

SEQ ID NO: 941720 - DNA, 22 bp, Homo sapiens
tgttaaggtcctgaaagtaact

SEQ ID NO: 941721 - DNA, 15 bp, Homo sapiens
tgttaagtattttca

SEQ ID NO: 941722 - DNA, 17 bp, Homo sapiens
tgttaagtattttcata

SEQ ID NO: 941723 - DNA, 23 bp, Homo sapiens
tgttaagtgccattactactgta

SEQ ID NO: 941724 - DNA, 21 bp, Homo sapiens
tgttaagttatagtgaatact

SEQ ID NO: 941725 - DNA, 19 bp, Homo sapiens
tgttaataaaagtacatgt

SEQ ID NO: 941726 - DNA, 18 bp, Homo sapiens
tgttaatacacagtactt

SEQ ID NO: 941727 - DNA, 21 bp, Homo sapiens
tgttaatatcactcattaatt

SEQ ID NO: 941728 - DNA, 19 bp, Homo sapiens
tgttaatcttaatgtatat

SEQ ID NO: 941729 - DNA, 22 bp, Homo sapiens
tgttaatcttaatgtatatcgt

SEQ ID NO: 941730 - DNA, 19 bp, Homo sapiens
tgttaatgaaaatgtcaga

SEQ ID NO: 941731 - DNA, 19 bp, Homo sapiens
tgttaatggatttcagaag

SEQ ID NO: 941732 - DNA, 20 bp, Homo sapiens
tgttaatggtgcaaatccta

SEQ ID NO: 941733 - DNA, 14 bp, Homo sapiens
tgttaatgtgatgg

SEQ ID NO: 941734 - DNA, 20 bp, Homo sapiens
tgttaattgatttggggatg

SEQ ID NO: 941735 - DNA, 19 bp, Homo sapiens
tgttaattgtaattgcatg

SEQ ID NO: 941736 - DNA, 22 bp, Homo sapiens
tgttaatttataatgtatttga

SEQ ID NO: 941737 - DNA, 20 bp, Homo sapiens
tgttaatttattttgctccc

SEQ ID NO: 941738 - DNA, 13 bp, Homo sapiens
tgttaatttttga

SEQ ID NO: 941739 - DNA, 19 bp, Homo sapiens
tgttaattttttggtacaa

SEQ ID NO: 941740 - DNA, 21 bp, Homo sapiens
tgttaattttttggtacaaaa

SEQ ID NO: 941741 - DNA, 18 bp, Homo sapiens
tgttacaagtttgctaaa

SEQ ID NO: 941742 - DNA, 19 bp, Homo sapiens
tgttacaagtttgctaaaa

SEQ ID NO: 941743 - DNA, 20 bp, Homo sapiens
tgttacacgtgcctgtagtc

SEQ ID NO: 941744 - DNA, 21 bp, Homo sapiens
tgttacacgtgcctgtagtcc

SEQ ID NO: 941745 - DNA, 18 bp, Homo sapiens
tgttacactttttggaag

SEQ ID NO: 941746 - DNA, 13 bp, Homo sapiens
tgttacagaggac

SEQ ID NO: 941747 - DNA, 17 bp, Homo sapiens
tgttacagtaatgtcat

SEQ ID NO: 941748 - DNA, 22 bp, Homo sapiens
tgttacagtttatattgtggaa

SEQ ID NO: 941749 - DNA, 19 bp, Homo sapiens
tgttacataaggatgactt

SEQ ID NO: 941750 - DNA, 15 bp, Homo sapiens
tgttacattattatc

SEQ ID NO: 941751 - DNA, 15 bp, Homo sapiens
tgttacattattcca

SEQ ID NO: 941752 - DNA, 22 bp, Homo sapiens
tgttacatttttaagtgctgca

SEQ ID NO: 941753 - DNA, 18 bp, Homo sapiens
tgttaccacattggggaa

SEQ ID NO: 941754 - DNA, 19 bp, Homo sapiens
tgttaccatactgtctctg

SEQ ID NO: 941755 - DNA, 20 bp, Homo sapiens
tgttaccatactgtctctgg

SEQ ID NO: 941756 - DNA, 14 bp, Homo sapiens
tgttacctgtagat

SEQ ID NO: 941757 - DNA, 16 bp, Homo sapiens
tgttacgtagcctaag

SEQ ID NO: 941758 - DNA, 22 bp, Homo sapiens
tgttactaaatggtgttacatt

SEQ ID NO: 941759 - DNA, 12 bp, Homo sapiens
tgttactagcct

SEQ ID NO: 941760 - DNA, 14 bp, Homo sapiens
tgttactagcctct

SEQ ID NO: 941761 - DNA, 20 bp, Homo sapiens
tgttactattttctacaatt

SEQ ID NO: 941762 - DNA, 19 bp, Homo sapiens
tgttactcatcgggcccag

SEQ ID NO: 941763 - DNA, 15 bp, Homo sapiens
tgttactgagatgtt

SEQ ID NO: 941764 - DNA, 13 bp, Homo sapiens
tgttactgatcat

SEQ ID NO: 941765 - DNA, 19 bp, Homo sapiens
tgttactgccttaataaaa

SEQ ID NO: 941766 - DNA, 17 bp, Homo sapiens
tgttactgctgattctt

SEQ ID NO: 941767 - DNA, 12 bp, Homo sapiens
tgttactgcttc

SEQ ID NO: 941768 - DNA, 20 bp, Homo sapiens
tgttactggataaattgttt

SEQ ID NO: 941769 - DNA, 14 bp, Homo sapiens
tgttacttacctaa

SEQ ID NO: 941770 - DNA, 17 bp, Homo sapiens
tgttactttacttttgc

SEQ ID NO: 941771 - DNA, 12 bp, Homo sapiens
tgttagagaggt

SEQ ID NO: 941772 - DNA, 20 bp, Homo sapiens
tgttagaggttttaaagtga

SEQ ID NO: 941773 - DNA, 21 bp, Homo sapiens
tgttagatagaatttccaata

SEQ ID NO: 941774 - DNA, 19 bp, Homo sapiens
tgttagatagctgcatgtg

SEQ ID NO: 941775 - DNA, 12 bp, Homo sapiens
tgttagatgttt

SEQ ID NO: 941776 - DNA, 20 bp, Homo sapiens
tgttagattaagaaatagac

SEQ ID NO: 941777 - DNA, 12 bp, Homo sapiens
tgttagcactgt

SEQ ID NO: 941778 - DNA, 14 bp, Homo sapiens
tgttagcactgttg

SEQ ID NO: 941779 - DNA, 12 bp, Homo sapiens
tgttagcagagt

SEQ ID NO: 941780 - DNA, 17 bp, Homo sapiens
tgttagcagagtctgtc

SEQ ID NO: 941781 - DNA, 16 bp, Homo sapiens
tgttagcctgcaaaca

SEQ ID NO: 941782 - DNA, 13 bp, Homo sapiens
tgttagccttaga

SEQ ID NO: 941783 - DNA, 16 bp, Homo sapiens
tgttaggaaaatttca

SEQ ID NO: 941784 - DNA, 21 bp, Homo sapiens
tgttaggaggctgcatgctct

SEQ ID NO: 941785 - DNA, 18 bp, Homo sapiens
tgttaggcttttctgcct

SEQ ID NO: 941786 - DNA, 23 bp, Homo sapiens
tgttagggagatgagttgcagtt

SEQ ID NO: 941787 - DNA, 21 bp, Homo sapiens
tgttagggtataagttgctgt

SEQ ID NO: 941788 - DNA, 14 bp, Homo sapiens
tgtgtgagcatcct

SEQ ID NO: 941789 - DNA, 16 bp, Homo sapiens
tgtgtgagcatcctgc

SEQ ID NO: 941790 - DNA, 17 bp, Homo sapiens
tgtgtgagcatcctgca

SEQ ID NO: 941791 - DNA, 23 bp, Homo sapiens
tgtgtgagcgcttctgcagcctc

SEQ ID NO: 941792 - DNA, 17 bp, Homo sapiens
tgtgtgaggagctgctg

SEQ ID NO: 941793 - DNA, 18 bp, Homo sapiens
tgtgtgaggctgtgtctc

SEQ ID NO: 941794 - DNA, 16 bp, Homo sapiens
tgtgtgagtgtaattc

SEQ ID NO: 941795 - DNA, 15 bp, Homo sapiens
tgtgtgatgcgcctt

SEQ ID NO: 941796 - DNA, 14 bp, Homo sapiens
tgtgtgattgaagg

SEQ ID NO: 941797 - DNA, 18 bp, Homo sapiens
tgtgtgattgacagcttt

SEQ ID NO: 941798 - DNA, 19 bp, Homo sapiens
tgtgtgattgacagctttg

SEQ ID NO: 941799 - DNA, 20 bp, Homo sapiens
tgtgtgatttcctaaacata

SEQ ID NO: 941800 - DNA, 21 bp, Homo sapiens
tgtgtgatttcctaaacataa

SEQ ID NO: 941801 - DNA, 17 bp, Homo sapiens
tgtgtgcacacgtgtgt

SEQ ID NO: 941802 - DNA, 20 bp, Homo sapiens
tgtgtgcacacgtgtgtatg

SEQ ID NO: 941803 - DNA, 12 bp, Homo sapiens
tgtgtgcagcaa

SEQ ID NO: 941804 - DNA, 15 bp, Homo sapiens
tgtgtgcatatttgt

SEQ ID NO: 941805 - DNA, 17 bp, Homo sapiens
tgtgtgcatatttgtta

SEQ ID NO: 941806 - DNA, 21 bp, Homo sapiens
tgtgtgccatagagtttaaca

SEQ ID NO: 941807 - DNA, 14 bp, Homo sapiens
tgtgtgccctgggc

SEQ ID NO: 941808 - DNA, 20 bp, Homo sapiens
tgtgtgcctcctagagtgca

SEQ ID NO: 941809 - DNA, 13 bp, Homo sapiens
tgtgtgccttctg

SEQ ID NO: 941810 - DNA, 13 bp, Homo sapiens
tgtgtgcgcctga

SEQ ID NO: 941811 - DNA, 16 bp, Homo sapiens
tgtgtgctgtttgaaa

SEQ ID NO: 941812 - DNA, 15 bp, Homo sapiens
tgtgtgcttctgctc

SEQ ID NO: 941813 - DNA, 12 bp, Homo sapiens
tgtgtgctttcc

SEQ ID NO: 941814 - DNA, 14 bp, Homo sapiens
tgtgtgctttccca

SEQ ID NO: 941815 - DNA, 23 bp, Homo sapiens
tgtgtggaaaaaaaaaaaaacta

SEQ ID NO: 941816 - DNA, 19 bp, Homo sapiens
tgtgtggactgtgatgcca

SEQ ID NO: 941817 - DNA, 14 bp, Homo sapiens
tgtgtggattcttt

SEQ ID NO: 941818 - DNA, 22 bp, Homo sapiens
tgtgtggccaaccaggacccag

SEQ ID NO: 941819 - DNA, 23 bp, Homo sapiens
tgtgtggccaaccaggacccagg

SEQ ID NO: 941820 - DNA, 18 bp, Homo sapiens
tgtgtggcccagttctga

SEQ ID NO: 941821 - DNA, 20 bp, Homo sapiens
tgtgtggcctccctggctcc

SEQ ID NO: 941822 - DNA, 13 bp, Homo sapiens
tgtgtggcctggt

SEQ ID NO: 941823 - DNA, 16 bp, Homo sapiens
tgtgtggcctggtggg

SEQ ID NO: 941824 - DNA, 20 bp, Homo sapiens
tgtgtggcctggtgggtcag

SEQ ID NO: 941825 - DNA, 22 bp, Homo sapiens
tgtgtggcctggtgggtcaggg

SEQ ID NO: 941826 - DNA, 22 bp, Homo sapiens
tgtgtggctgccccacctgccg

SEQ ID NO: 941827 - DNA, 14 bp, Homo sapiens
tgtgtggcttggag

SEQ ID NO: 941828 - DNA, 14 bp, Homo sapiens
tgtgtgggcagggt

SEQ ID NO: 941829 - DNA, 17 bp, Homo sapiens
tgtgtggggttctcagt

SEQ ID NO: 941830 - DNA, 15 bp, Homo sapiens
tgtgtgggtgctgat

SEQ ID NO: 941831 - DNA, 16 bp, Homo sapiens
tgtgtgggtgtgtgcg

SEQ ID NO: 941832 - DNA, 15 bp, Homo sapiens
tgtgtggtagaaaca

SEQ ID NO: 941833 - DNA, 21 bp, Homo sapiens
tgtgtgtactcactgaagcct

SEQ ID NO: 941834 - DNA, 14 bp, Homo sapiens
tgtgtgtatacatg

SEQ ID NO: 941835 - DNA, 21 bp, Homo sapiens
tgtgtgtatatatttaaaaaa

SEQ ID NO: 941836 - DNA, 22 bp, Homo sapiens
tgtgtgtatgatacgtgtataa

SEQ ID NO: 941837 - DNA, 15 bp, Homo sapiens
tgtgtgtatgctgat

SEQ ID NO: 941838 - DNA, 18 bp, Homo sapiens
tgtgtgtatgtatacaca

SEQ ID NO: 941839 - DNA, 18 bp, Homo sapiens
tgtgtgtattcagaggca

SEQ ID NO: 941840 - DNA, 19 bp, Homo sapiens
tgtgtgtattcagaggcag

SEQ ID NO: 941841 - DNA, 12 bp, Homo sapiens
tgtgtgtatttg

SEQ ID NO: 941842 - DNA, 22 bp, Homo sapiens
tgtgtgtccacgactgtctcca

SEQ ID NO: 941843 - DNA, 16 bp, Homo sapiens
tgtgtgtgaatgaaca

SEQ ID NO: 941844 - DNA, 16 bp, Homo sapiens
tgtgtgtgacaattct

SEQ ID NO: 941845 - DNA, 16 bp, Homo sapiens
tgtgtgtgagtttgct

SEQ ID NO: 941846 - DNA, 12 bp, Homo sapiens
tgtgtgtgggtg

SEQ ID NO: 941847 - DNA, 14 bp, Homo sapiens
tgtgtgtgtatgtg

SEQ ID NO: 941848 - DNA, 15 bp, Homo sapiens
tgtgtgtgtatgtga

SEQ ID NO: 941849 - DNA, 14 bp, Homo sapiens
tgtgtgtgtgggtg

SEQ ID NO: 941850 - DNA, 11 bp, Homo sapiens
tgtgtgtgtgt

SEQ ID NO: 941851 - DNA, 13 bp, Homo sapiens
tgtgtgtgtgtat

SEQ ID NO: 941852 - DNA, 14 bp, Homo sapiens
tgtgtgtgtgtgtg

SEQ ID NO: 941853 - DNA, 14 bp, Homo sapiens
tgtgtgtgttctgt

SEQ ID NO: 941854 - DNA, 22 bp, Homo sapiens
tgtgtgttcaccttcaaaatgt

SEQ ID NO: 941855 - DNA, 23 bp, Homo sapiens
tgtgtgttctgtaatggaactga

SEQ ID NO: 941856 - DNA, 16 bp, Homo sapiens
tgtgtgttctgtagct

SEQ ID NO: 941857 - DNA, 18 bp, Homo sapiens
tgtgtgttgtctcttgag

SEQ ID NO: 941858 - DNA, 12 bp, Homo sapiens
tgtgtgtttagg

SEQ ID NO: 941859 - DNA, 15 bp, Homo sapiens
tgtgtgtttctgtcc

SEQ ID NO: 941860 - DNA, 14 bp, Homo sapiens
tgtgttaaaatact

SEQ ID NO: 941861 - DNA, 23 bp, Homo sapiens
tgtgttacctgaaaacactgtgc

SEQ ID NO: 941862 - DNA, 18 bp, Homo sapiens
tgtgttactgctttgcaa

SEQ ID NO: 941863 - DNA, 14 bp, Homo sapiens
tgtgttagaaaagt

SEQ ID NO: 941864 - DNA, 19 bp, Homo sapiens
tgtgttagtgtctgtccat

SEQ ID NO: 941865 - DNA, 19 bp, Homo sapiens
tgtgttcagctctttccaa

SEQ ID NO: 941866 - DNA, 22 bp, Homo sapiens
tgtgttcatttggtgttcctgg

SEQ ID NO: 941867 - DNA, 19 bp, Homo sapiens
tgtgttccaactgccccca

SEQ ID NO: 941868 - DNA, 12 bp, Homo sapiens
tgtgttcctcca

SEQ ID NO: 941869 - DNA, 11 bp, Homo sapiens
tgtgttcctgg

SEQ ID NO: 941870 - DNA, 12 bp, Homo sapiens
tgtgttctgggc

SEQ ID NO: 941871 - DNA, 23 bp, Homo sapiens
tgtgttctgggctggggccacct

SEQ ID NO: 941872 - DNA, 18 bp, Homo sapiens
tgtgttctgtttgttaaa

SEQ ID NO: 941873 - DNA, 21 bp, Homo sapiens
tgtgttctgtttgttaaaact

SEQ ID NO: 941874 - DNA, 16 bp, Homo sapiens
tgtgttgactgctgct

SEQ ID NO: 941875 - DNA, 22 bp, Homo sapiens
tgtgttgccacagtagaactgt

SEQ ID NO: 941876 - DNA, 16 bp, Homo sapiens
tgtgttgccctggcat

SEQ ID NO: 941877 - DNA, 15 bp, Homo sapiens
tgtgttggacagaga

SEQ ID NO: 941878 - DNA, 19 bp, Homo sapiens
tgtgttggacagagaaggg

SEQ ID NO: 941879 - DNA, 19 bp, Homo sapiens
tgtgttggggccttggcct

SEQ ID NO: 941880 - DNA, 19 bp, Homo sapiens
tgtgttgtattaacaaaag

SEQ ID NO: 941881 - DNA, 14 bp, Homo sapiens
tgtgttgttgcttt

SEQ ID NO: 941882 - DNA, 22 bp, Homo sapiens
tgtgtttaaaaattgaaaaaag

SEQ ID NO: 941883 - DNA, 12 bp, Homo sapiens
tgtgtttaaata

SEQ ID NO: 941884 - DNA, 22 bp, Homo sapiens
tgtgtttaaataaagtatcatg

SEQ ID NO: 941885 - DNA, 23 bp, Homo sapiens
tgttagggtataagttgctgtaa

SEQ ID NO: 941886 - DNA, 15 bp, Homo sapiens
tgttagggtcagcca

SEQ ID NO: 941887 - DNA, 15 bp, Homo sapiens
tgttagggttatgtt

SEQ ID NO: 941888 - DNA, 21 bp, Homo sapiens
tgttaggtcggtttagatgaa

SEQ ID NO: 941889 - DNA, 13 bp, Homo sapiens
tgttagtaacatg

SEQ ID NO: 941890 - DNA, 14 bp, Homo sapiens
tgttagtctcccca

SEQ ID NO: 941891 - DNA, 16 bp, Homo sapiens
tgttagtgtctgtcca

SEQ ID NO: 941892 - DNA, 23 bp, Homo sapiens
tgttagtgtgtgtgcatgtgtgt

SEQ ID NO: 941893 - DNA, 14 bp, Homo sapiens
tgttagttataaaa

SEQ ID NO: 941894 - DNA, 17 bp, Homo sapiens
tgttagttatagatgtc

SEQ ID NO: 941895 - DNA, 13 bp, Homo sapiens
tgttagttcccaa

SEQ ID NO: 941896 - DNA, 14 bp, Homo sapiens
tgttagttcccaac

SEQ ID NO: 941897 - DNA, 21 bp, Homo sapiens
tgttagtttagtgtgtgtgca

SEQ ID NO: 941898 - DNA, 23 bp, Homo sapiens
tgttagtttagtgtgtgtgcaga

SEQ ID NO: 941899 - DNA, 23 bp, Homo sapiens
tgttagttttgtaaaaactgaag

SEQ ID NO: 941900 - DNA, 16 bp, Homo sapiens
tgttataaaataacat

SEQ ID NO: 941901 - DNA, 14 bp, Homo sapiens
tgttataactactc

SEQ ID NO: 941902 - DNA, 12 bp, Homo sapiens
tgttttttgggg

SEQ ID NO: 941903 - DNA, 11 bp, Homo sapiens
tgttttttgta

SEQ ID NO: 941904 - DNA, 12 bp, Homo sapiens
tgttttttgtaa

SEQ ID NO: 941905 - DNA, 14 bp, Homo sapiens
tgttttttgtaact

SEQ ID NO: 941906 - DNA, 21 bp, Homo sapiens
tgttttttgtaactacaaagc

SEQ ID NO: 941907 - DNA, 14 bp, Homo sapiens
tgttttttgttact

SEQ ID NO: 941908 - DNA, 19 bp, Homo sapiens
tgttttttgttactgtttt

SEQ ID NO: 941909 - DNA, 23 bp, Homo sapiens
tgttttttgttcaatgttccatt

SEQ ID NO: 941910 - DNA, 19 bp, Homo sapiens
tgtttttttaactgcattt

SEQ ID NO: 941911 - DNA, 23 bp, Homo sapiens
tgtttttttaatttctaagaagt

SEQ ID NO: 941912 - DNA, 22 bp, Homo sapiens
tgtttttttccctctcctgtcc

SEQ ID NO: 941913 - DNA, 21 bp, Homo sapiens
tgtttttttcctcatgtaaca

SEQ ID NO: 941914 - DNA, 15 bp, Homo sapiens
tgtttttttctaaaa

SEQ ID NO: 941915 - DNA, 16 bp, Homo sapiens
tgtttttttgttatta

SEQ ID NO: 941916 - DNA, 21 bp, Homo sapiens
tgttttttttttttttttaat

SEQ ID NO: 941917 - DNA, 16 bp, Homo sapiens
ttaaaaaaaaaagtca

SEQ ID NO: 941918 - DNA, 21 bp, Homo sapiens
ttaaaaaaaaaagtcaccaaa

SEQ ID NO: 941919 - DNA, 18 bp, Homo sapiens
ttaaaaaaaaagatctgt

SEQ ID NO: 941920 - DNA, 20 bp, Homo sapiens
ttaaaaaaaaagtcagagac

SEQ ID NO: 941921 - DNA, 19 bp, Homo sapiens
ttaaaaaaaaatactcttt

SEQ ID NO: 941922 - DNA, 16 bp, Homo sapiens
ttaaaaaaaaattgta

SEQ ID NO: 941923 - DNA, 13 bp, Homo sapiens
ttaaaaaaaagaa

SEQ ID NO: 941924 - DNA, 13 bp, Homo sapiens
ttaaaaaaactga

SEQ ID NO: 941925 - DNA, 15 bp, Homo sapiens
ttaaaaaaactgaag

SEQ ID NO: 941926 - DNA, 12 bp, Homo sapiens
ttaaaaaaatca

SEQ ID NO: 941927 - DNA, 18 bp, Homo sapiens
ttaaaaaaattactgtga

SEQ ID NO: 941928 - DNA, 21 bp, Homo sapiens
ttaaaaaaattggttggagaa

SEQ ID NO: 941929 - DNA, 11 bp, Homo sapiens
ttaaaaaacaa

SEQ ID NO: 941930 - DNA, 12 bp, Homo sapiens
ttaaaaaacaaa

SEQ ID NO: 941931 - DNA, 21 bp, Homo sapiens
ttaaaaaacaaaaaaagacaa

SEQ ID NO: 941932 - DNA, 13 bp, Homo sapiens
ttaaaaaacttca

SEQ ID NO: 941933 - DNA, 19 bp, Homo sapiens
ttaaaaaagactgaacatg

SEQ ID NO: 941934 - DNA, 12 bp, Homo sapiens
ttaaaaaagctt

SEQ ID NO: 941935 - DNA, 20 bp, Homo sapiens
ttaaaaaataccattgaaat

SEQ ID NO: 941936 - DNA, 11 bp, Homo sapiens
ttaaaaaatat

SEQ ID NO: 941937 - DNA, 14 bp, Homo sapiens
ttaaaaaatatttt

SEQ ID NO: 941938 - DNA, 17 bp, Homo sapiens
ttaaaaaatattttaag

SEQ ID NO: 941939 - DNA, 22 bp, Homo sapiens
ttaaaaaatattttaagaaaga

SEQ ID NO: 941940 - DNA, 20 bp, Homo sapiens
ttaaaaaatattttctctgt

SEQ ID NO: 941941 - DNA, 20 bp, Homo sapiens
ttaaaaaatcaatcaatggt

SEQ ID NO: 941942 - DNA, 22 bp, Homo sapiens
ttaaaaaatcaatcaatggtgc

SEQ ID NO: 941943 - DNA, 16 bp, Homo sapiens
ttaaaaaatgtccatg

SEQ ID NO: 941944 - DNA, 13 bp, Homo sapiens
ttaaaaaatgttt

SEQ ID NO: 941945 - DNA, 16 bp, Homo sapiens
ttaaaaaatttttgaa

SEQ ID NO: 941946 - DNA, 15 bp, Homo sapiens
ttaaaaactcctttt

SEQ ID NO: 941947 - DNA, 16 bp, Homo sapiens
ttaaaaactcttcagt

SEQ ID NO: 941948 - DNA, 18 bp, Homo sapiens
ttaaaaactcttcagtgc

SEQ ID NO: 941949 - DNA, 13 bp, Homo sapiens
ttaaaaactgtgt

SEQ ID NO: 941950 - DNA, 15 bp, Homo sapiens
ttaaaaactgtgtat

SEQ ID NO: 941951 - DNA, 22 bp, Homo sapiens
ttaaaaactgtgtatcattaaa

SEQ ID NO: 941952 - DNA, 16 bp, Homo sapiens
ttaaaaactttaaaga

SEQ ID NO: 941953 - DNA, 11 bp, Homo sapiens
ttaaaaagcaa

SEQ ID NO: 941954 - DNA, 13 bp, Homo sapiens
ttaaaaagccagt

SEQ ID NO: 941955 - DNA, 20 bp, Homo sapiens
ttaaaaaggcagtttgcaaa

SEQ ID NO: 941956 - DNA, 12 bp, Homo sapiens
ttaaaaaggcca

SEQ ID NO: 941957 - DNA, 14 bp, Homo sapiens
ttaaaaaggccaaa

SEQ ID NO: 941958 - DNA, 23 bp, Homo sapiens
ttaaaaagggcagggcatctcct

SEQ ID NO: 941959 - DNA, 15 bp, Homo sapiens
ttaaaaaggtaaatg

SEQ ID NO: 941960 - DNA, 19 bp, Homo sapiens
ttaaaaaggtaaatggtta

SEQ ID NO: 941961 - DNA, 20 bp, Homo sapiens
ttaaaaagtaataaaattca

SEQ ID NO: 941962 - DNA, 11 bp, Homo sapiens
ttaaaaagttt

SEQ ID NO: 941963 - DNA, 22 bp, Homo sapiens
ttaaaaataagtcaacagtaaa

SEQ ID NO: 941964 - DNA, 19 bp, Homo sapiens
ttaaaaataattattttat

SEQ ID NO: 941965 - DNA, 14 bp, Homo sapiens
ttaaaaatacatat

SEQ ID NO: 941966 - DNA, 22 bp, Homo sapiens
ttaaaaataccttctatgtatt

SEQ ID NO: 941967 - DNA, 17 bp, Homo sapiens
ttaaaaatacttctatg

SEQ ID NO: 941968 - DNA, 20 bp, Homo sapiens
ttaaaaatatggaacttcta

SEQ ID NO: 941969 - DNA, 22 bp, Homo sapiens
ttaaaaatatggaacttctaat

SEQ ID NO: 941970 - DNA, 23 bp, Homo sapiens
ttaaaaatatggaacttctaata

SEQ ID NO: 941971 - DNA, 14 bp, Homo sapiens
ttaaaaatatttca

SEQ ID NO: 941972 - DNA, 16 bp, Homo sapiens
ttaaaaatatttcaga

SEQ ID NO: 941973 - DNA, 14 bp, Homo sapiens
ttaaaaatgaaaat

SEQ ID NO: 941974 - DNA, 23 bp, Homo sapiens
ttaaaaatgcacacctcatgagt

SEQ ID NO: 941975 - DNA, 17 bp, Homo sapiens
ttaaaaatggtatcaaa

SEQ ID NO: 941976 - DNA, 24 bp, Homo sapiens
ttaaaaatggtatcaaaattacat

SEQ ID NO: 941977 - DNA, 14 bp, Homo sapiens
ttaaaaatgtgtca

SEQ ID NO: 941978 - DNA, 18 bp, Homo sapiens
ttaaaaatgttctcaaat

SEQ ID NO: 941979 - DNA, 20 bp, Homo sapiens
ttaaaaatgttttttcatgt

SEQ ID NO: 941980 - DNA, 24 bp, Homo sapiens
ttaaaaatgttttttcatgtgttt

SEQ ID NO: 941981 - DNA, 16 bp, Homo sapiens
ttaaaaattgtttctt

SEQ ID NO: 941982 - DNA, 18 bp, Homo sapiens
ttaaaacactttcaaaac

SEQ ID NO: 941983 - DNA, 22 bp, Homo sapiens
ttaaaacaggcaaagttttaca

SEQ ID NO: 941984 - DNA, 18 bp, Homo sapiens
ttaaaacatatttcattt

SEQ ID NO: 941985 - DNA, 16 bp, Homo sapiens
ttaaaaccacagctgg

SEQ ID NO: 941986 - DNA, 20 bp, Homo sapiens
ttaaaaccagagaatcttaa

SEQ ID NO: 941987 - DNA, 16 bp, Homo sapiens
ttaaaaccagttaccc

SEQ ID NO: 941988 - DNA, 14 bp, Homo sapiens
ttaaaacccaagtg

SEQ ID NO: 941989 - DNA, 21 bp, Homo sapiens
ttaaaacctgcgacagcttgt

SEQ ID NO: 941990 - DNA, 15 bp, Homo sapiens
ttaaaacgtcttaga

SEQ ID NO: 941991 - DNA, 16 bp, Homo sapiens
ttaaaactaagcacaa

SEQ ID NO: 941992 - DNA, 19 bp, Homo sapiens
ttaaaactaatgagtatga

SEQ ID NO: 941993 - DNA, 13 bp, Homo sapiens
ttaaaactctggt

SEQ ID NO: 941994 - DNA, 20 bp, Homo sapiens
ttaaaactgagtccatgaaa

SEQ ID NO: 941995 - DNA, 21 bp, Homo sapiens
ttaaaactgagtccatgaaaa

SEQ ID NO: 941996 - DNA, 13 bp, Homo sapiens
ttaaaactgcttt

SEQ ID NO: 941997 - DNA, 14 bp, Homo sapiens
ttaaaactgtattt

SEQ ID NO: 941998 - DNA, 15 bp, Homo sapiens
ttaaaactttgaagt

SEQ ID NO: 941999 - DNA, 14 bp, Homo sapiens
ttaaaagaaaaaat

SEQ ID NO: 942000 - DNA, 23 bp, Homo sapiens
ttaaaagaaaataaaaaaaagaa

SEQ ID NO: 942001 - DNA, 13 bp, Homo sapiens
ttaaaagaaatat

SEQ ID NO: 942002 - DNA, 13 bp, Homo sapiens
ttaaaagaatgac

SEQ ID NO: 942003 - DNA, 14 bp, Homo sapiens
ttaaaagaatgact

SEQ ID NO: 942004 - DNA, 15 bp, Homo sapiens
ttaaaagaatgacta

SEQ ID NO: 942005 - DNA, 14 bp, Homo sapiens
ttaaaagacatttt

SEQ ID NO: 942006 - DNA, 14 bp, Homo sapiens
ttaaaagcaaatca

SEQ ID NO: 942007 - DNA, 21 bp, Homo sapiens
ttaaaagcaaatcatttgttt

SEQ ID NO: 942008 - DNA, 20 bp, Homo sapiens
ttaaaagcacaagcgtgttt

SEQ ID NO: 942009 - DNA, 15 bp, Homo sapiens
ttaaaagccatgtat

SEQ ID NO: 942010 - DNA, 16 bp, Homo sapiens
ttaaaaggatgtataa

SEQ ID NO: 942011 - DNA, 19 bp, Homo sapiens
ttaaaaggatgtataaatt

SEQ ID NO: 942012 - DNA, 16 bp, Homo sapiens
ttaaaaggcaactcaa

SEQ ID NO: 942013 - DNA, 20 bp, Homo sapiens
ttaaaagtactttaaaaagg

SEQ ID NO: 942014 - DNA, 20 bp, Homo sapiens
ttaatagcaaagaattgact

SEQ ID NO: 942015 - DNA, 13 bp, Homo sapiens
ttaatagcaacag

SEQ ID NO: 942016 - DNA, 19 bp, Homo sapiens
ttaatagcaacagagcact

SEQ ID NO: 942017 - DNA, 22 bp, Homo sapiens
ttaatagcagcctttctctctt

SEQ ID NO: 942018 - DNA, 18 bp, Homo sapiens
ttaatagcttttattgta

SEQ ID NO: 942019 - DNA, 22 bp, Homo sapiens
ttaatagcttttattgtataaa

SEQ ID NO: 942020 - DNA, 14 bp, Homo sapiens
ttaatagtgctttt

SEQ ID NO: 942021 - DNA, 18 bp, Homo sapiens
ttaatagtttgtctattt

SEQ ID NO: 942022 - DNA, 22 bp, Homo sapiens
ttaatataccccaaattgtgta

SEQ ID NO: 942023 - DNA, 16 bp, Homo sapiens
ttaatatatcaatatt

SEQ ID NO: 942024 - DNA, 16 bp, Homo sapiens
ttaatatattaaaatt

SEQ ID NO: 942025 - DNA, 18 bp, Homo sapiens
ttaatatatttgaaaaaa

SEQ ID NO: 942026 - DNA, 20 bp, Homo sapiens
ttaatatcactcattaatta

SEQ ID NO: 942027 - DNA, 12 bp, Homo sapiens
ttaatatgaaaa

SEQ ID NO: 942028 - DNA, 15 bp, Homo sapiens
ttaatatgaaaactt

SEQ ID NO: 942029 - DNA, 15 bp, Homo sapiens
ttaatatgagcttca

SEQ ID NO: 942030 - DNA, 20 bp, Homo sapiens
ttaatatgagcttcaatata

SEQ ID NO: 942031 - DNA, 18 bp, Homo sapiens
ttaatatgctgcaacaaa

SEQ ID NO: 942032 - DNA, 22 bp, Homo sapiens
ttaatatgtgctgaacattgtt

SEQ ID NO: 942033 - DNA, 22 bp, Homo sapiens
ttaatattaaaaagtctgtatg

SEQ ID NO: 942034 - DNA, 16 bp, Homo sapiens
ttaatattactgtctt

SEQ ID NO: 942035 - DNA, 18 bp, Homo sapiens
ttaatattactgtcttta

SEQ ID NO: 942036 - DNA, 19 bp, Homo sapiens
ttaatattactgtctttat

SEQ ID NO: 942037 - DNA, 20 bp, Homo sapiens
ttaatattcttttgtttcca

SEQ ID NO: 942038 - DNA, 21 bp, Homo sapiens
ttaatattcttttgtttccat

SEQ ID NO: 942039 - DNA, 18 bp, Homo sapiens
ttaatatttaaacagcag

SEQ ID NO: 942040 - DNA, 12 bp, Homo sapiens
ttaatatttgct

SEQ ID NO: 942041 - DNA, 12 bp, Homo sapiens
ttaatatttgtt

SEQ ID NO: 942042 - DNA, 16 bp, Homo sapiens
ttaatatttgtttagt

SEQ ID NO: 942043 - DNA, 16 bp, Homo sapiens
ttaatattttatattg

SEQ ID NO: 942044 - DNA, 15 bp, Homo sapiens
ttaatattttgtaat

SEQ ID NO: 942045 - DNA, 20 bp, Homo sapiens
ttaatattttgtaatattct

SEQ ID NO: 942046 - DNA, 19 bp, Homo sapiens
ttaatattttgtattttca

SEQ ID NO: 942047 - DNA, 16 bp, Homo sapiens
ttaatattttgttctt

SEQ ID NO: 942048 - DNA, 19 bp, Homo sapiens
ttaatattttgttcttatt

SEQ ID NO: 942049 - DNA, 12 bp, Homo sapiens
ttaatcaaaggc

SEQ ID NO: 942050 - DNA, 12 bp, Homo sapiens
ttaatcaagaga

SEQ ID NO: 942051 - DNA, 19 bp, Homo sapiens
ttaatcaagagaaacttca

SEQ ID NO: 942052 - DNA, 14 bp, Homo sapiens
ttaatcaagttgaa

SEQ ID NO: 942053 - DNA, 20 bp, Homo sapiens
ttaatcacctctctgtagtt

SEQ ID NO: 942054 - DNA, 15 bp, Homo sapiens
ttaatcactactgta

SEQ ID NO: 942055 - DNA, 16 bp, Homo sapiens
ttaatcactactgtat

SEQ ID NO: 942056 - DNA, 22 bp, Homo sapiens
ttaatcattttgcctcttttct

SEQ ID NO: 942057 - DNA, 15 bp, Homo sapiens
ttaatccaatatttt

SEQ ID NO: 942058 - DNA, 12 bp, Homo sapiens
ttaatccaatgg

SEQ ID NO: 942059 - DNA, 18 bp, Homo sapiens
ttaatccagtctatcatt

SEQ ID NO: 942060 - DNA, 23 bp, Homo sapiens
ttaatccccatcattactggtaa

SEQ ID NO: 942061 - DNA, 18 bp, Homo sapiens
ttaatctaaaatgattgt

SEQ ID NO: 942062 - DNA, 15 bp, Homo sapiens
ttaatctaaatggaa

SEQ ID NO: 942063 - DNA, 13 bp, Homo sapiens
ttaatctaagaaa

SEQ ID NO: 942064 - DNA, 21 bp, Homo sapiens
ttaatctcaaagagattcgaa

SEQ ID NO: 942065 - DNA, 18 bp, Homo sapiens
ttaatctctaacagtgga

SEQ ID NO: 942066 - DNA, 15 bp, Homo sapiens
ttaatctgaaaattt

SEQ ID NO: 942067 - DNA, 20 bp, Homo sapiens
ttaatctgtgtgtatattga

SEQ ID NO: 942068 - DNA, 16 bp, Homo sapiens
ttaatcttaatgtata

SEQ ID NO: 942069 - DNA, 14 bp, Homo sapiens
ttaatcttagtgta

SEQ ID NO: 942070 - DNA, 21 bp, Homo sapiens
ttaatcttagtgtatgattac

SEQ ID NO: 942071 - DNA, 15 bp, Homo sapiens
ttaatcttcagtttt

SEQ ID NO: 942072 - DNA, 22 bp, Homo sapiens
ttaatcttcagttttatcttta

SEQ ID NO: 942073 - DNA, 14 bp, Homo sapiens
ttaatcttgtgtag

SEQ ID NO: 942074 - DNA, 14 bp, Homo sapiens
ttaatctttcctga

SEQ ID NO: 942075 - DNA, 17 bp, Homo sapiens
ttaatctttctttacct

SEQ ID NO: 942076 - DNA, 17 bp, Homo sapiens
ttaatctttgaaaggtt

SEQ ID NO: 942077 - DNA, 18 bp, Homo sapiens
ttaatctttgtgacagga

SEQ ID NO: 942078 - DNA, 14 bp, Homo sapiens
ttaatgaaaatgtc

SEQ ID NO: 942079 - DNA, 20 bp, Homo sapiens
ttaatgaaagactgtacaaa

SEQ ID NO: 942080 - DNA, 20 bp, Homo sapiens
ttaatgaaatgataaagact

SEQ ID NO: 942081 - DNA, 14 bp, Homo sapiens
ttaatgaagaaagt

SEQ ID NO: 942082 - DNA, 23 bp, Homo sapiens
ttaatgaatcacatttttttatg

SEQ ID NO: 942083 - DNA, 14 bp, Homo sapiens
ttaatgaatgacca

SEQ ID NO: 942084 - DNA, 19 bp, Homo sapiens
ttaatgaatttaaggcaaa

SEQ ID NO: 942085 - DNA, 15 bp, Homo sapiens
ttaatgacaacactt

SEQ ID NO: 942086 - DNA, 20 bp, Homo sapiens
ttaatgacaacacttaatag

SEQ ID NO: 942087 - DNA, 16 bp, Homo sapiens
ttaatgagactttaaa

SEQ ID NO: 942088 - DNA, 22 bp, Homo sapiens
ttaatgagatgttattactgtt

SEQ ID NO: 942089 - DNA, 24 bp, Homo sapiens
ttaatgagccatcactagaagaaa

SEQ ID NO: 942090 - DNA, 11 bp, Homo sapiens
ttaatgcactt

SEQ ID NO: 942091 - DNA, 18 bp, Homo sapiens
ttaatgcattaaacctgt

SEQ ID NO: 942092 - DNA, 16 bp, Homo sapiens
ttacaaccaagaacat

SEQ ID NO: 942093 - DNA, 12 bp, Homo sapiens
ttacaactaaat

SEQ ID NO: 942094 - DNA, 19 bp, Homo sapiens
ttacaacttgattttttca

SEQ ID NO: 942095 - DNA, 14 bp, Homo sapiens
ttacaactttctaa

SEQ ID NO: 942096 - DNA, 17 bp, Homo sapiens
ttacaagaaaaaatgaa

SEQ ID NO: 942097 - DNA, 16 bp, Homo sapiens
ttacaagaagaactca

SEQ ID NO: 942098 - DNA, 13 bp, Homo sapiens
ttacaagaagttt

SEQ ID NO: 942099 - DNA, 17 bp, Homo sapiens
ttacaagcccccccttc

SEQ ID NO: 942100 - DNA, 20 bp, Homo sapiens
ttacaagcccccccttccac

SEQ ID NO: 942101 - DNA, 16 bp, Homo sapiens
ttacaagcttaaagct

SEQ ID NO: 942102 - DNA, 18 bp, Homo sapiens
ttacaagcttaaagcttg

SEQ ID NO: 942103 - DNA, 17 bp, Homo sapiens
ttacaagtaacaaaaat

SEQ ID NO: 942104 - DNA, 19 bp, Homo sapiens
ttacaagtaacaaaaataa

SEQ ID NO: 942105 - DNA, 14 bp, Homo sapiens
ttacaagtgtatat

SEQ ID NO: 942106 - DNA, 14 bp, Homo sapiens
ttacaagtttgcta

SEQ ID NO: 942107 - DNA, 20 bp, Homo sapiens
ttacaagtttgctaaaagaa

SEQ ID NO: 942108 - DNA, 21 bp, Homo sapiens
ttacaataccgttaagataca

SEQ ID NO: 942109 - DNA, 12 bp, Homo sapiens
ttacaatagaat

SEQ ID NO: 942110 - DNA, 14 bp, Homo sapiens
ttacaatagaattt

SEQ ID NO: 942111 - DNA, 15 bp, Homo sapiens
ttacaatagttctgt

SEQ ID NO: 942112 - DNA, 17 bp, Homo sapiens
ttacaatagttctgtgg

SEQ ID NO: 942113 - DNA, 12 bp, Homo sapiens
ttacaatcaaag

SEQ ID NO: 942114 - DNA, 22 bp, Homo sapiens
ttacaatcattgctgaaaatgg

SEQ ID NO: 942115 - DNA, 16 bp, Homo sapiens
ttacaatgttcatccc

SEQ ID NO: 942116 - DNA, 18 bp, Homo sapiens
ttacaattccctgctgtc

SEQ ID NO: 942117 - DNA, 14 bp, Homo sapiens
ttacaattgaaatg

SEQ ID NO: 942118 - DNA, 13 bp, Homo sapiens
ttacaattgtcat

SEQ ID NO: 942119 - DNA, 18 bp, Homo sapiens
ttacaatttacaaagtgt

SEQ ID NO: 942120 - DNA, 14 bp, Homo sapiens
ttacaatttgcaca

SEQ ID NO: 942121 - DNA, 15 bp, Homo sapiens
ttacaatttgcacaa

SEQ ID NO: 942122 - DNA, 13 bp, Homo sapiens
ttacaattttatc

SEQ ID NO: 942123 - DNA, 15 bp, Homo sapiens
ttacaattttttatc

SEQ ID NO: 942124 - DNA, 17 bp, Homo sapiens
ttacaattttttatcat

SEQ ID NO: 942125 - DNA, 20 bp, Homo sapiens
ttacaattttttatcatgca

SEQ ID NO: 942126 - DNA, 22 bp, Homo sapiens
ttacacaatggtttttaaattt

SEQ ID NO: 942127 - DNA, 13 bp, Homo sapiens
ttacacaattaat

SEQ ID NO: 942128 - DNA, 16 bp, Homo sapiens
ttacacaattaattgt

SEQ ID NO: 942129 - DNA, 23 bp, Homo sapiens
ttacacagaaatgctgctggcca

SEQ ID NO: 942130 - DNA, 13 bp, Homo sapiens
ttacacagagaaa

SEQ ID NO: 942131 - DNA, 17 bp, Homo sapiens
ttacacagagaaataca

SEQ ID NO: 942132 - DNA, 21 bp, Homo sapiens
ttacacagagaaatacaaaat

SEQ ID NO: 942133 - DNA, 17 bp, Homo sapiens
ttacacagcccaagagg

SEQ ID NO: 942134 - DNA, 14 bp, Homo sapiens
ttacacattaagta

SEQ ID NO: 942135 - DNA, 14 bp, Homo sapiens
ttacacattatgtt

SEQ ID NO: 942136 - DNA, 17 bp, Homo sapiens
ttacacattatgttaga

SEQ ID NO: 942137 - DNA, 17 bp, Homo sapiens
ttacaccaactcctaat

SEQ ID NO: 942138 - DNA, 14 bp, Homo sapiens
ttacacgagatttc

SEQ ID NO: 942139 - DNA, 17 bp, Homo sapiens
ttacacgcttttgtgat

SEQ ID NO: 942140 - DNA, 22 bp, Homo sapiens
ttacactacacactgtgtactg

SEQ ID NO: 942141 - DNA, 17 bp, Homo sapiens
ttacactatgataaagt

SEQ ID NO: 942142 - DNA, 20 bp, Homo sapiens
ttacactggtctaatgtttg

SEQ ID NO: 942143 - DNA, 18 bp, Homo sapiens
ttacactgtgccttttcc

SEQ ID NO: 942144 - DNA, 18 bp, Homo sapiens
ttacacttcatatagcat

SEQ ID NO: 942145 - DNA, 16 bp, Homo sapiens
tgttccccaagcgcct

SEQ ID NO: 942146 - DNA, 16 bp, Homo sapiens
tgttccccctgtgcag

SEQ ID NO: 942147 - DNA, 14 bp, Homo sapiens
tgttcccctcactg

SEQ ID NO: 942148 - DNA, 15 bp, Homo sapiens
tgttcccctcactgg

SEQ ID NO: 942149 - DNA, 21 bp, Homo sapiens
tgttcccctctcccttccctc

SEQ ID NO: 942150 - DNA, 23 bp, Homo sapiens
tgttcccctctcccttccctcct

SEQ ID NO: 942151 - DNA, 21 bp, Homo sapiens
tgttcccctcttgtctcccct

SEQ ID NO: 942152 - DNA, 22 bp, Homo sapiens
tgttcccctcttgtctcccctg

SEQ ID NO: 942153 - DNA, 21 bp, Homo sapiens
tgttccccttccactgagggc

SEQ ID NO: 942154 - DNA, 20 bp, Homo sapiens
tgttcccgatggtctctctc

SEQ ID NO: 942155 - DNA, 21 bp, Homo sapiens
tgttcccgatggtctctctcc

SEQ ID NO: 942156 - DNA, 13 bp, Homo sapiens
tgttccctcctgg

SEQ ID NO: 942157 - DNA, 19 bp, Homo sapiens
ttactatgtgccagttcct

SEQ ID NO: 942158 - DNA, 21 bp, Homo sapiens
ttactatgtgccagttcctgt

SEQ ID NO: 942159 - DNA, 13 bp, Homo sapiens
ttactattaaaat

SEQ ID NO: 942160 - DNA, 12 bp, Homo sapiens
ttactcactgct

SEQ ID NO: 942161 - DNA, 18 bp, Homo sapiens
ttactcagaattctctag

SEQ ID NO: 942162 - DNA, 15 bp, Homo sapiens
ttactcagcagcaga

SEQ ID NO: 942163 - DNA, 19 bp, Homo sapiens
ttactcagtgttagagaaa

SEQ ID NO: 942164 - DNA, 17 bp, Homo sapiens
ttactcatgatcttgtg

SEQ ID NO: 942165 - DNA, 24 bp, Homo sapiens
ttactccaaggtttataaagcaga

SEQ ID NO: 942166 - DNA, 16 bp, Homo sapiens
ttactccataaacaga

SEQ ID NO: 942167 - DNA, 11 bp, Homo sapiens
ttactcccctt

SEQ ID NO: 942168 - DNA, 20 bp, Homo sapiens
ttactccccttgagctgaga

SEQ ID NO: 942169 - DNA, 16 bp, Homo sapiens
ttactcccttcctggc

SEQ ID NO: 942170 - DNA, 21 bp, Homo sapiens
ttactcccttctgtagttttt

SEQ ID NO: 942171 - DNA, 18 bp, Homo sapiens
ttactcctcctctttctc

SEQ ID NO: 942172 - DNA, 16 bp, Homo sapiens
ttactctacactgaaa

SEQ ID NO: 942173 - DNA, 18 bp, Homo sapiens
ttactctacactgaaacg

SEQ ID NO: 942174 - DNA, 19 bp, Homo sapiens
ttactctcaaaatctttgt

SEQ ID NO: 942175 - DNA, 16 bp, Homo sapiens
ttactctccaacctgg

SEQ ID NO: 942176 - DNA, 19 bp, Homo sapiens
ttactctccaacctggaca

SEQ ID NO: 942177 - DNA, 13 bp, Homo sapiens
ttactctgagccc

SEQ ID NO: 942178 - DNA, 17 bp, Homo sapiens
ttactctgagcccaggc

SEQ ID NO: 942179 - DNA, 19 bp, Homo sapiens
ttactctgtctcccaggct

SEQ ID NO: 942180 - DNA, 22 bp, Homo sapiens
ttactcttaaatcatttggtta

SEQ ID NO: 942181 - DNA, 16 bp, Homo sapiens
ttactcttaattttaa

SEQ ID NO: 942182 - DNA, 21 bp, Homo sapiens
ttactcttcttcattagcttt

SEQ ID NO: 942183 - DNA, 13 bp, Homo sapiens
ttactctttgcaa

SEQ ID NO: 942184 - DNA, 21 bp, Homo sapiens
ttactctttttctaaagtgtt

SEQ ID NO: 942185 - DNA, 20 bp, Homo sapiens
ttactgaataatatcaaata

SEQ ID NO: 942186 - DNA, 20 bp, Homo sapiens
ttactgacacttcctgtcct

SEQ ID NO: 942187 - DNA, 12 bp, Homo sapiens
ttactgagatgt

SEQ ID NO: 942188 - DNA, 13 bp, Homo sapiens
ttactgagatgtt

SEQ ID NO: 942189 - DNA, 17 bp, Homo sapiens
ttactgatcatgcattg

SEQ ID NO: 942190 - DNA, 21 bp, Homo sapiens
ttactgatcatgcattgttga

SEQ ID NO: 942191 - DNA, 22 bp, Homo sapiens
ttactgcagcctttgcctcccc

SEQ ID NO: 942192 - DNA, 23 bp, Homo sapiens
ttactgcctataatcttatacaa

SEQ ID NO: 942193 - DNA, 12 bp, Homo sapiens
ttactgcctgta

SEQ ID NO: 942194 - DNA, 23 bp, Homo sapiens
ttactgcctgtagcaatggccag

SEQ ID NO: 942195 - DNA, 17 bp, Homo sapiens
ttactgctctagaaagt

SEQ ID NO: 942196 - DNA, 17 bp, Homo sapiens
ttactgctgattcttgt

SEQ ID NO: 942197 - DNA, 16 bp, Homo sapiens
ttactgctgctgtgct

SEQ ID NO: 942198 - DNA, 13 bp, Homo sapiens
ttactgcttttca

SEQ ID NO: 942199 - DNA, 17 bp, Homo sapiens
ttactggacaaagaatt

SEQ ID NO: 942200 - DNA, 16 bp, Homo sapiens
ttactggataaattgt

SEQ ID NO: 942201 - DNA, 13 bp, Homo sapiens
ttactggcctttt

SEQ ID NO: 942202 - DNA, 16 bp, Homo sapiens
ttactggcctttttca

SEQ ID NO: 942203 - DNA, 20 bp, Homo sapiens
ttactggcctttttcattta

SEQ ID NO: 942204 - DNA, 16 bp, Homo sapiens
ttactggcttctcttg

SEQ ID NO: 942205 - DNA, 15 bp, Homo sapiens
ttactggtccaaaag

SEQ ID NO: 942206 - DNA, 14 bp, Homo sapiens
ttactggtgtgagc

SEQ ID NO: 942207 - DNA, 15 bp, Homo sapiens
ttactggttgcatgg

SEQ ID NO: 942208 - DNA, 23 bp, Homo sapiens
ttactggtttccccagggaagga

SEQ ID NO: 942209 - DNA, 22 bp, Homo sapiens
ttactgtacatgaaaacacatt

SEQ ID NO: 942210 - DNA, 13 bp, Homo sapiens
ttactgtacctgt

SEQ ID NO: 942211 - DNA, 16 bp, Homo sapiens
ttactgtagcctcaga

SEQ ID NO: 942212 - DNA, 16 bp, Homo sapiens
ttactgtatataaact

SEQ ID NO: 942213 - DNA, 13 bp, Homo sapiens
ttactgtcaataa

SEQ ID NO: 942214 - DNA, 17 bp, Homo sapiens
ttactgtcaataaacag

SEQ ID NO: 942215 - DNA, 18 bp, Homo sapiens
ttactgtcaataaacagc

SEQ ID NO: 942216 - DNA, 19 bp, Homo sapiens
ttactgtcagttgtacttc

SEQ ID NO: 942217 - DNA, 12 bp, Homo sapiens
ttactgtgtaaa

SEQ ID NO: 942218 - DNA, 17 bp, Homo sapiens
ttactgtttattacttc

SEQ ID NO: 942219 - DNA, 18 bp, Homo sapiens
ttattaaacgtatgcatg

SEQ ID NO: 942220 - DNA, 20 bp, Homo sapiens
ttattaaacgtatgcatgtg

SEQ ID NO: 942221 - DNA, 17 bp, Homo sapiens
ttattaaagaaaaatgc

SEQ ID NO: 942222 - DNA, 20 bp, Homo sapiens
ttattaaatacaaaacttcc

SEQ ID NO: 942223 - DNA, 18 bp, Homo sapiens
ttattaaatgtagcttca

SEQ ID NO: 942224 - DNA, 13 bp, Homo sapiens
ttattaaatgtat

SEQ ID NO: 942225 - DNA, 13 bp, Homo sapiens
ttattaaattgca

SEQ ID NO: 942226 - DNA, 21 bp, Homo sapiens
ttattaacgatgtccaacccg

SEQ ID NO: 942227 - DNA, 19 bp, Homo sapiens
ttattaacgggcatgtatt

SEQ ID NO: 942228 - DNA, 19 bp, Homo sapiens
ttattaactactgaataat

SEQ ID NO: 942229 - DNA, 18 bp, Homo sapiens
ttattaagaggtaagact

SEQ ID NO: 942230 - DNA, 22 bp, Homo sapiens
ttattaagccaggaaacatgaa

SEQ ID NO: 942231 - DNA, 15 bp, Homo sapiens
ttattaagctttttg

SEQ ID NO: 942232 - DNA, 16 bp, Homo sapiens
ttattaaggaaatact

SEQ ID NO: 942233 - DNA, 23 bp, Homo sapiens
ttattaagtctgggatgtagaac

SEQ ID NO: 942234 - DNA, 24 bp, Homo sapiens
ttattaagtctgggatgtagaact

SEQ ID NO: 942235 - DNA, 13 bp, Homo sapiens
ttattaagtgatt

SEQ ID NO: 942236 - DNA, 11 bp, Homo sapiens
ttattaatatt

SEQ ID NO: 942237 - DNA, 17 bp, Homo sapiens
ttattaatcttagtgta

SEQ ID NO: 942238 - DNA, 11 bp, Homo sapiens
ttattaatgca

SEQ ID NO: 942239 - DNA, 18 bp, Homo sapiens
ttattaatgcactttcta

SEQ ID NO: 942240 - DNA, 22 bp, Homo sapiens
ttattaattgttttgcactttt

SEQ ID NO: 942241 - DNA, 19 bp, Homo sapiens
ttattacaaattttcactg

SEQ ID NO: 942242 - DNA, 12 bp, Homo sapiens
ttattacaatgt

SEQ ID NO: 942243 - DNA, 16 bp, Homo sapiens
ttattacaatgtatct

SEQ ID NO: 942244 - DNA, 19 bp, Homo sapiens
ttattacagtgtttatcct

SEQ ID NO: 942245 - DNA, 12 bp, Homo sapiens
ttattacatctt

SEQ ID NO: 942246 - DNA, 13 bp, Homo sapiens
ttattacatgtaa

SEQ ID NO: 942247 - DNA, 18 bp, Homo sapiens
ttattacatgtaatttga

SEQ ID NO: 942248 - DNA, 18 bp, Homo sapiens
ttattacatttatacatc

SEQ ID NO: 942249 - DNA, 17 bp, Homo sapiens
ttattaccagcatttgt

SEQ ID NO: 942250 - DNA, 20 bp, Homo sapiens
ttattaccccctccttcaga

SEQ ID NO: 942251 - DNA, 13 bp, Homo sapiens
ttattacctctga

SEQ ID NO: 942252 - DNA, 20 bp, Homo sapiens
ttattactaattctatttct

SEQ ID NO: 942253 - DNA, 14 bp, Homo sapiens
ttattactattatt

SEQ ID NO: 942254 - DNA, 12 bp, Homo sapiens
ttattactgtcc

SEQ ID NO: 942255 - DNA, 16 bp, Homo sapiens
ttattacttccatgaa

SEQ ID NO: 942256 - DNA, 13 bp, Homo sapiens
ttattacttctgt

SEQ ID NO: 942257 - DNA, 15 bp, Homo sapiens
ttattacttctgttt

SEQ ID NO: 942258 - DNA, 17 bp, Homo sapiens
ttattacttctgtttct

SEQ ID NO: 942259 - DNA, 15 bp, Homo sapiens
ttattacttgtgcac

SEQ ID NO: 942260 - DNA, 16 bp, Homo sapiens
ttattacttgtgcact

SEQ ID NO: 942261 - DNA, 17 bp, Homo sapiens
ttattagagtgtctttc

SEQ ID NO: 942262 - DNA, 17 bp, Homo sapiens
ttattaggataatacat

SEQ ID NO: 942263 - DNA, 16 bp, Homo sapiens
ttattagggagaaaat

SEQ ID NO: 942264 - DNA, 17 bp, Homo sapiens
ttattagggagaaaatt

SEQ ID NO: 942265 - DNA, 18 bp, Homo sapiens
ttattagggagaaaattc

SEQ ID NO: 942266 - DNA, 20 bp, Homo sapiens
ttattagggagaaaattcaa

SEQ ID NO: 942267 - DNA, 15 bp, Homo sapiens
ttattagttaatata

SEQ ID NO: 942268 - DNA, 14 bp, Homo sapiens
ttattataaactat

SEQ ID NO: 942269 - DNA, 23 bp, Homo sapiens
ttattatctatggaaatgtgaga

SEQ ID NO: 942270 - DNA, 19 bp, Homo sapiens
ttattatgaaggaatttga

SEQ ID NO: 942271 - DNA, 14 bp, Homo sapiens
ttattatgcattat

SEQ ID NO: 942272 - DNA, 19 bp, Homo sapiens
ttattatgtttattacaat

SEQ ID NO: 942273 - DNA, 21 bp, Homo sapiens
ttattatgtttattacaattt

SEQ ID NO: 942274 - DNA, 13 bp, Homo sapiens
ttattattcctag

SEQ ID NO: 942275 - DNA, 15 bp, Homo sapiens
ttattattgaaattg

SEQ ID NO: 942276 - DNA, 14 bp, Homo sapiens
ttattatttctgtt

SEQ ID NO: 942277 - DNA, 15 bp, Homo sapiens
ttattcaaaaaatca

SEQ ID NO: 942278 - DNA, 20 bp, Homo sapiens
ttattcaaaaaatcatgttt

SEQ ID NO: 942279 - DNA, 14 bp, Homo sapiens
ttattcaaatgaag

SEQ ID NO: 942280 - DNA, 16 bp, Homo sapiens
ttattcaaatttgtac

SEQ ID NO: 942281 - DNA, 23 bp, Homo sapiens
ttattcaataaaaaaaagaaatg

SEQ ID NO: 942282 - DNA, 21 bp, Homo sapiens
ttattcaatttatttgaatga

SEQ ID NO: 942283 - DNA, 16 bp, Homo sapiens
ttattcacatatatca

SEQ ID NO: 942284 - DNA, 13 bp, Homo sapiens
ttattcactgtaa

SEQ ID NO: 942285 - DNA, 21 bp, Homo sapiens
ttattcagaactatttaaaat

SEQ ID NO: 942286 - DNA, 16 bp, Homo sapiens
ttattcagctagaatt

SEQ ID NO: 942287 - DNA, 21 bp, Homo sapiens
ttattcagctagaatttctgg

SEQ ID NO: 942288 - DNA, 20 bp, Homo sapiens
ttattcagcttcatttgtgt

SEQ ID NO: 942289 - DNA, 21 bp, Homo sapiens
ttattcataaaaaataatggt

SEQ ID NO: 942290 - DNA, 16 bp, Homo sapiens
ttattcatagttttat

SEQ ID NO: 942291 - DNA, 12 bp, Homo sapiens
ttattcattatt

SEQ ID NO: 942292 - DNA, 15 bp, Homo sapiens
ttattcattatttgt

SEQ ID NO: 942293 - DNA, 14 bp, Homo sapiens
ttattcatttgagt

SEQ ID NO: 942294 - DNA, 20 bp, Homo sapiens
ttattccagaatgctgtaca

SEQ ID NO: 942295 - DNA, 18 bp, Homo sapiens
ttattcccgacgacacat

SEQ ID NO: 942296 - DNA, 19 bp, Homo sapiens
ttattccctttcacaaaat

SEQ ID NO: 942297 - DNA, 16 bp, Homo sapiens
ttattccgagcattcc

SEQ ID NO: 942298 - DNA, 21 bp, Homo sapiens
ttattcctagtctttccagtc

SEQ ID NO: 942299 - DNA, 21 bp, Homo sapiens
ttattcctagtggatgactgt

SEQ ID NO: 942300 - DNA, 22 bp, Homo sapiens
ttattcctatatagtttattga

SEQ ID NO: 942301 - DNA, 21 bp, Homo sapiens
ttattcctcagattgctgaat

SEQ ID NO: 942302 - DNA, 17 bp, Homo sapiens
ttattccttctgtagtg

SEQ ID NO: 942303 - DNA, 14 bp, Homo sapiens
ttattcctttgaat

SEQ ID NO: 942304 - DNA, 21 bp, Homo sapiens
ttattctaagccctttgccat

SEQ ID NO: 942305 - DNA, 15 bp, Homo sapiens
ttattctaataaata

SEQ ID NO: 942306 - DNA, 23 bp, Homo sapiens
ttattctaataaatatactatga

SEQ ID NO: 942307 - DNA, 13 bp, Homo sapiens
ttattctagatta

SEQ ID NO: 942308 - DNA, 13 bp, Homo sapiens
ttattctagttaa

SEQ ID NO: 942309 - DNA, 15 bp, Homo sapiens
ttattctcaaagcag

SEQ ID NO: 942310 - DNA, 16 bp, Homo sapiens
ttattctcaaagcagg

SEQ ID NO: 942311 - DNA, 12 bp, Homo sapiens
ttatctgagttg

SEQ ID NO: 942312 - DNA, 14 bp, Homo sapiens
ttatctgatactta

SEQ ID NO: 942313 - DNA, 18 bp, Homo sapiens
ttatctgcaagtgaggtg

SEQ ID NO: 942314 - DNA, 14 bp, Homo sapiens
ttatctgcctggcc

SEQ ID NO: 942315 - DNA, 15 bp, Homo sapiens
ttatctgcctggcct

SEQ ID NO: 942316 - DNA, 22 bp, Homo sapiens
ttatctgtaattgtaattccaa

SEQ ID NO: 942317 - DNA, 17 bp, Homo sapiens
ttatctgtgaattcaga

SEQ ID NO: 942318 - DNA, 17 bp, Homo sapiens
ttatctgtggagttcct

SEQ ID NO: 942319 - DNA, 21 bp, Homo sapiens
ttatcttatactgtacaataa

SEQ ID NO: 942320 - DNA, 17 bp, Homo sapiens
ttatcttgtctctgggc

SEQ ID NO: 942321 - DNA, 13 bp, Homo sapiens
ttatctttaccaa

SEQ ID NO: 942322 - DNA, 16 bp, Homo sapiens
ttatctttacttttaa

SEQ ID NO: 942323 - DNA, 12 bp, Homo sapiens
ttatctttatat

SEQ ID NO: 942324 - DNA, 14 bp, Homo sapiens
ttatctttctttcc

SEQ ID NO: 942325 - DNA, 23 bp, Homo sapiens
ttatctttctttccatttacagt

SEQ ID NO: 942326 - DNA, 14 bp, Homo sapiens
ttatcttttcataa

SEQ ID NO: 942327 - DNA, 15 bp, Homo sapiens
ttatctttttacctt

SEQ ID NO: 942328 - DNA, 14 bp, Homo sapiens
ttatgaaaaagaag

SEQ ID NO: 942329 - DNA, 18 bp, Homo sapiens
ttatgaaaaagaagaatc

SEQ ID NO: 942330 - DNA, 12 bp, Homo sapiens
ttatgaaaactc

SEQ ID NO: 942331 - DNA, 19 bp, Homo sapiens
ttatgaaaatcctatatct

SEQ ID NO: 942332 - DNA, 21 bp, Homo sapiens
ttatgaaagcaacaaagaaat

SEQ ID NO: 942333 - DNA, 19 bp, Homo sapiens
ttatgaaattcaccccctt

SEQ ID NO: 942334 - DNA, 19 bp, Homo sapiens
ttatgaacacttaaattat

SEQ ID NO: 942335 - DNA, 15 bp, Homo sapiens
ttatgaaggaatttg

SEQ ID NO: 942336 - DNA, 23 bp, Homo sapiens
ttatgaatttttgtaagaaaccg

SEQ ID NO: 942337 - DNA, 22 bp, Homo sapiens
ttatgacctgaaataatatatt

SEQ ID NO: 942338 - DNA, 15 bp, Homo sapiens
ttatgagatctaatg

SEQ ID NO: 942339 - DNA, 14 bp, Homo sapiens
ttatgagatttact

SEQ ID NO: 942340 - DNA, 18 bp, Homo sapiens
ttatgagctacaacaaaa

SEQ ID NO: 942341 - DNA, 21 bp, Homo sapiens
ttatgaggacgtgtctgttat

SEQ ID NO: 942342 - DNA, 22 bp, Homo sapiens
ttatgaggacgtgtctgttatt

SEQ ID NO: 942343 - DNA, 15 bp, Homo sapiens
ttatgagtttgctta

SEQ ID NO: 942344 - DNA, 23 bp, Homo sapiens
ttatgagtttttgatagctttat

SEQ ID NO: 942345 - DNA, 19 bp, Homo sapiens
ttatgatgagccatattaa

SEQ ID NO: 942346 - DNA, 20 bp, Homo sapiens
ttatgatgcatacagttttc

SEQ ID NO: 942347 - DNA, 17 bp, Homo sapiens
ttatgatgctaagctga

SEQ ID NO: 942348 - DNA, 20 bp, Homo sapiens
ttatgatggttttaaacttt

SEQ ID NO: 942349 - DNA, 15 bp, Homo sapiens
ttatgattatttaaa

SEQ ID NO: 942350 - DNA, 18 bp, Homo sapiens
ttatgatttcattatcac

SEQ ID NO: 942351 - DNA, 21 bp, Homo sapiens
ttatgatttcattatcacatg

SEQ ID NO: 942352 - DNA, 16 bp, Homo sapiens
ttatgattttattaca

SEQ ID NO: 942353 - DNA, 23 bp, Homo sapiens
ttatgcaaaagcagctaaatgta

SEQ ID NO: 942354 - DNA, 18 bp, Homo sapiens
ttatgcaaggaaggaaag

SEQ ID NO: 942355 - DNA, 13 bp, Homo sapiens
ttatgcacagcct

SEQ ID NO: 942356 - DNA, 13 bp, Homo sapiens
ttatgcactgtgg

SEQ ID NO: 942357 - DNA, 22 bp, Homo sapiens
ttatgcactgtggtttcagatg

SEQ ID NO: 942358 - DNA, 18 bp, Homo sapiens
ttatgcacttttagaaat

SEQ ID NO: 942359 - DNA, 19 bp, Homo sapiens
ttatgcacttttagaaatg

SEQ ID NO: 942360 - DNA, 23 bp, Homo sapiens
ttatgcagaagcatattttgctg

SEQ ID NO: 942361 - DNA, 15 bp, Homo sapiens
ttatgcagaatttga

SEQ ID NO: 942362 - DNA, 22 bp, Homo sapiens
ttatgccacttccttttaactg

SEQ ID NO: 942363 - DNA, 15 bp, Homo sapiens
ttatgcgtgtgacag

SEQ ID NO: 942364 - DNA, 17 bp, Homo sapiens
ttatgctctcactgttt

SEQ ID NO: 942365 - DNA, 15 bp, Homo sapiens
ttatgctgatttatt

SEQ ID NO: 942366 - DNA, 12 bp, Homo sapiens
ttatgctgctgt

SEQ ID NO: 942367 - DNA, 14 bp, Homo sapiens
ttatgctgctgtga

SEQ ID NO: 942368 - DNA, 22 bp, Homo sapiens
ttatgcttaaaatatgtatgtc

SEQ ID NO: 942369 - DNA, 17 bp, Homo sapiens
ttatgctttgaacttta

SEQ ID NO: 942370 - DNA, 19 bp, Homo sapiens
ttatgcttttagagttgca

SEQ ID NO: 942371 - DNA, 18 bp, Homo sapiens
ttatggcaagtgatatca

SEQ ID NO: 942372 - DNA, 21 bp, Homo sapiens
ttatggcaagtgatatcacct

SEQ ID NO: 942373 - DNA, 14 bp, Homo sapiens
ttatggcacatcag

SEQ ID NO: 942374 - DNA, 21 bp, Homo sapiens
ttatggcagcccggctgctgc

SEQ ID NO: 942375 - DNA, 11 bp, Homo sapiens
ttatggcctca

SEQ ID NO: 942376 - DNA, 22 bp, Homo sapiens
ttatggcgtttttctcgtcccc

SEQ ID NO: 942377 - DNA, 16 bp, Homo sapiens
ttatggcttttgtgca

SEQ ID NO: 942378 - DNA, 17 bp, Homo sapiens
ttatggcttttgtgcat

SEQ ID NO: 942379 - DNA, 18 bp, Homo sapiens
ttatggcttttgtgcatt

SEQ ID NO: 942380 - DNA, 19 bp, Homo sapiens
ttatggcttttgtgcatta

SEQ ID NO: 942381 - DNA, 15 bp, Homo sapiens
ttatgggatgtaaac

SEQ ID NO: 942382 - DNA, 22 bp, Homo sapiens
ttatggtaactgctttctgttc

SEQ ID NO: 942383 - DNA, 13 bp, Homo sapiens
ttatggtagaaaa

SEQ ID NO: 942384 - DNA, 19 bp, Homo sapiens
ttatggtagaaaaatttca

SEQ ID NO: 942385 - DNA, 17 bp, Homo sapiens
ttatggtccagaaactc

SEQ ID NO: 942386 - DNA, 14 bp, Homo sapiens
ttatggttacttct

SEQ ID NO: 942387 - DNA, 20 bp, Homo sapiens
ttatggttacttcttctctt

SEQ ID NO: 942388 - DNA, 22 bp, Homo sapiens
ttatggttatgttcatctaaac

SEQ ID NO: 942389 - DNA, 13 bp, Homo sapiens
ttatgtaaaagga

SEQ ID NO: 942390 - DNA, 14 bp, Homo sapiens
ttatgtaaagtatg

SEQ ID NO: 942391 - DNA, 21 bp, Homo sapiens
ttatgtaaatatgaagagttt

SEQ ID NO: 942392 - DNA, 11 bp, Homo sapiens
ttatgtaattt

SEQ ID NO: 942393 - DNA, 13 bp, Homo sapiens
ttatgtacaaact

SEQ ID NO: 942394 - DNA, 15 bp, Homo sapiens
ttatgtacaaccctg

SEQ ID NO: 942395 - DNA, 14 bp, Homo sapiens
ttatgtacagaaaa

SEQ ID NO: 942396 - DNA, 16 bp, Homo sapiens
ttatgtagcacataaa

SEQ ID NO: 942397 - DNA, 13 bp, Homo sapiens
ttatgtagcacta

SEQ ID NO: 942398 - DNA, 14 bp, Homo sapiens
ttattttaaacaaa

SEQ ID NO: 942399 - DNA, 16 bp, Homo sapiens
ttattttaaacaaaat

SEQ ID NO: 942400 - DNA, 21 bp, Homo sapiens
ttattttaaatataaatagct

SEQ ID NO: 942401 - DNA, 12 bp, Homo sapiens
ttattttaagac

SEQ ID NO: 942402 - DNA, 13 bp, Homo sapiens
ttattttaatgta

SEQ ID NO: 942403 - DNA, 14 bp, Homo sapiens
ttattttaatgtaa

SEQ ID NO: 942404 - DNA, 16 bp, Homo sapiens
ttattttagcagttct

SEQ ID NO: 942405 - DNA, 20 bp, Homo sapiens
ttattttagcagttctgcaa

SEQ ID NO: 942406 - DNA, 21 bp, Homo sapiens
ttattttagcagttctgcaaa

SEQ ID NO: 942407 - DNA, 23 bp, Homo sapiens
ttattttaggcactgttcaatac

SEQ ID NO: 942408 - DNA, 20 bp, Homo sapiens
ttattttatatcatacagtt

SEQ ID NO: 942409 - DNA, 13 bp, Homo sapiens
ttattttatttgt

SEQ ID NO: 942410 - DNA, 18 bp, Homo sapiens
ttattttattttagcagt

SEQ ID NO: 942411 - DNA, 14 bp, Homo sapiens
ttattttcacctgt

SEQ ID NO: 942412 - DNA, 12 bp, Homo sapiens
ttattttcagta

SEQ ID NO: 942413 - DNA, 21 bp, Homo sapiens
ttattttcagtatactgtgtg

SEQ ID NO: 942414 - DNA, 22 bp, Homo sapiens
ttattttcagtgcatcattact

SEQ ID NO: 942415 - DNA, 15 bp, Homo sapiens
ttattttcctcccca

SEQ ID NO: 942416 - DNA, 12 bp, Homo sapiens
ttattttctaca

SEQ ID NO: 942417 - DNA, 21 bp, Homo sapiens
ttattttctggtagatagaaa

SEQ ID NO: 942418 - DNA, 15 bp, Homo sapiens
ttattttctgtcaga

SEQ ID NO: 942419 - DNA, 23 bp, Homo sapiens
ttattttgagtcctaggacttaa

SEQ ID NO: 942420 - DNA, 12 bp, Homo sapiens
ttattttgcaac

SEQ ID NO: 942421 - DNA, 21 bp, Homo sapiens
ttcaagacttgagcggagccc

SEQ ID NO: 942422 - DNA, 23 bp, Homo sapiens
ttcaagagctagaaaaataaaat

SEQ ID NO: 942423 - DNA, 21 bp, Homo sapiens
ttcaagatctaaatcatatat

SEQ ID NO: 942424 - DNA, 17 bp, Homo sapiens
ttcaagcaatcctccta

SEQ ID NO: 942425 - DNA, 19 bp, Homo sapiens
ttcaagcaatcctcctacc

SEQ ID NO: 942426 - DNA, 16 bp, Homo sapiens
ttcaagcacactggaa

SEQ ID NO: 942427 - DNA, 12 bp, Homo sapiens
ttcaagccatgg

SEQ ID NO: 942428 - DNA, 15 bp, Homo sapiens
ttcaagcctctaaac

SEQ ID NO: 942429 - DNA, 14 bp, Homo sapiens
ttcaagcctgtggg

SEQ ID NO: 942430 - DNA, 20 bp, Homo sapiens
ttcaagcctgtgggagtaga

SEQ ID NO: 942431 - DNA, 15 bp, Homo sapiens
ttcaagcgctccagg

SEQ ID NO: 942432 - DNA, 22 bp, Homo sapiens
ttcaagctctctgttgcgctcc

SEQ ID NO: 942433 - DNA, 14 bp, Homo sapiens
ttcaaggaaagtga

SEQ ID NO: 942434 - DNA, 11 bp, Homo sapiens
ttcaaggaagg

SEQ ID NO: 942435 - DNA, 22 bp, Homo sapiens
ttcaaggactgtttcagtgtga

SEQ ID NO: 942436 - DNA, 18 bp, Homo sapiens
ttcaaggagaatatgata

SEQ ID NO: 942437 - DNA, 18 bp, Homo sapiens
ttcaaggatctcctgttt

SEQ ID NO: 942438 - DNA, 17 bp, Homo sapiens
ttcagagcaggaggccg

SEQ ID NO: 942439 - DNA, 17 bp, Homo sapiens
ttcagagccagcctggc

SEQ ID NO: 942440 - DNA, 22 bp, Homo sapiens
ttcagagccagtgaaggagcca

SEQ ID NO: 942441 - DNA, 20 bp, Homo sapiens
ttcagagcccccagccctgg

SEQ ID NO: 942442 - DNA, 16 bp, Homo sapiens
ttcagagctgaggctt

SEQ ID NO: 942443 - DNA, 22 bp, Homo sapiens
ttcagaggcagcaccaccacac

SEQ ID NO: 942444 - DNA, 22 bp, Homo sapiens
ttcagagggaaactcagatgtc

SEQ ID NO: 942445 - DNA, 17 bp, Homo sapiens
ttcagagggaaagtaaa

SEQ ID NO: 942446 - DNA, 19 bp, Homo sapiens
ttcagagtgaagaatctta

SEQ ID NO: 942447 - DNA, 22 bp, Homo sapiens
ttcagagtttgtgtgtatttgt

SEQ ID NO: 942448 - DNA, 17 bp, Homo sapiens
ttcagatacaaactgca

SEQ ID NO: 942449 - DNA, 12 bp, Homo sapiens
ttcagatataaa

SEQ ID NO: 942450 - DNA, 14 bp, Homo sapiens
ttcagatataaaag

SEQ ID NO: 942451 - DNA, 15 bp, Homo sapiens
ttcagatataaaaga

SEQ ID NO: 942452 - DNA, 19 bp, Homo sapiens
ttcagatataaaagactga

SEQ ID NO: 942453 - DNA, 15 bp, Homo sapiens
ttcagatatatatca

SEQ ID NO: 942454 - DNA, 15 bp, Homo sapiens
ttcagatatcaaaat

SEQ ID NO: 942455 - DNA, 22 bp, Homo sapiens
ttcagatatcaaaattctagct

SEQ ID NO: 942456 - DNA, 18 bp, Homo sapiens
ttcagatattattgcttt

SEQ ID NO: 942457 - DNA, 18 bp, Homo sapiens
ttcagatcaaaatgcctt

SEQ ID NO: 942458 - DNA, 21 bp, Homo sapiens
ttcagatcaaaatgcctttca

SEQ ID NO: 942459 - DNA, 15 bp, Homo sapiens
ttcagatcactgaat

SEQ ID NO: 942460 - DNA, 16 bp, Homo sapiens
ttcagatcactgaatt

SEQ ID NO: 942461 - DNA, 18 bp, Homo sapiens
ttcagatcactgaattta

SEQ ID NO: 942462 - DNA, 21 bp, Homo sapiens
ttcagatcactgaatttataa

SEQ ID NO: 942463 - DNA, 17 bp, Homo sapiens
ttcagatctctaacttc

SEQ ID NO: 942464 - DNA, 21 bp, Homo sapiens
ttcagatcttaatataaattc

SEQ ID NO: 942465 - DNA, 15 bp, Homo sapiens
ttcagatgcttctgg

SEQ ID NO: 942466 - DNA, 14 bp, Homo sapiens
ttcagatgctttag

SEQ ID NO: 942467 - DNA, 19 bp, Homo sapiens
ttcagatgtcttctgcctg

SEQ ID NO: 942468 - DNA, 15 bp, Homo sapiens
ttcagatgtgcaata

SEQ ID NO: 942469 - DNA, 13 bp, Homo sapiens
ttcagatgtgcat

SEQ ID NO: 942470 - DNA, 14 bp, Homo sapiens
ttcagattcccaga

SEQ ID NO: 942471 - DNA, 13 bp, Homo sapiens
ttcagattgtctt

SEQ ID NO: 942472 - DNA, 17 bp, Homo sapiens
ttcagattttttaaaat

SEQ ID NO: 942473 - DNA, 23 bp, Homo sapiens
ttcagcaaactaaccagcattcc

SEQ ID NO: 942474 - DNA, 23 bp, Homo sapiens
ttcagcaacaagactgccaggtg

SEQ ID NO: 942475 - DNA, 13 bp, Homo sapiens
ttcagcaagacaa

SEQ ID NO: 942476 - DNA, 10 bp, Homo sapiens
ttcagcacac

SEQ ID NO: 942477 - DNA, 20 bp, Homo sapiens
ttcagcacaggaattctcaa

SEQ ID NO: 942478 - DNA, 22 bp, Homo sapiens
ttcagcacaggaattctcaaga

SEQ ID NO: 942479 - DNA, 16 bp, Homo sapiens
ttcagcaccaccctag

SEQ ID NO: 942480 - DNA, 18 bp, Homo sapiens
ttcagcacccccacccac

SEQ ID NO: 942481 - DNA, 17 bp, Homo sapiens
ttcagcaccctgggtgc

SEQ ID NO: 942482 - DNA, 22 bp, Homo sapiens
ttcagcacctacagtgtacagt

SEQ ID NO: 942483 - DNA, 20 bp, Homo sapiens
ttcagcactgtcccttgcct

SEQ ID NO: 942484 - DNA, 21 bp, Homo sapiens
ttcagcactgtcccttgcctc

SEQ ID NO: 942485 - DNA, 23 bp, Homo sapiens
ttcagcagaacctgcacacagga

SEQ ID NO: 942486 - DNA, 15 bp, Homo sapiens
ttcagcaggaagggt

SEQ ID NO: 942487 - DNA, 16 bp, Homo sapiens
ttcagcatatttatag

SEQ ID NO: 942488 - DNA, 23 bp, Homo sapiens
ttcagcatccgcaggtgctggtc

SEQ ID NO: 942489 - DNA, 22 bp, Homo sapiens
ttcagcattaagctgttcctgt

SEQ ID NO: 942490 - DNA, 11 bp, Homo sapiens
ttcagcatttg

SEQ ID NO: 942491 - DNA, 11 bp, Homo sapiens
ttcagccaagg

SEQ ID NO: 942492 - DNA, 19 bp, Homo sapiens
ttcagccaatttgtctcct

SEQ ID NO: 942493 - DNA, 16 bp, Homo sapiens
ttcagccactaagaac

SEQ ID NO: 942494 - DNA, 17 bp, Homo sapiens
ttcagcccctgatctct

SEQ ID NO: 942495 - DNA, 13 bp, Homo sapiens
ttcagccctggcc

SEQ ID NO: 942496 - DNA, 13 bp, Homo sapiens
ttcagccctttgc

SEQ ID NO: 942497 - DNA, 20 bp, Homo sapiens
ttcagcctactgcctcggat

SEQ ID NO: 942498 - DNA, 22 bp, Homo sapiens
ttcagcctagccgacctcagcc

SEQ ID NO: 942499 - DNA, 13 bp, Homo sapiens
ttcagccttcttt

SEQ ID NO: 942500 - DNA, 16 bp, Homo sapiens
ttcagcgatgtatgca

SEQ ID NO: 942501 - DNA, 18 bp, Homo sapiens
ttcagctagaatttctgg

SEQ ID NO: 942502 - DNA, 18 bp, Homo sapiens
ttcagctcaattgttaat

SEQ ID NO: 942503 - DNA, 21 bp, Homo sapiens
ttcagctcattatgaaaaaca

SEQ ID NO: 942504 - DNA, 23 bp, Homo sapiens
ttcagctcattatgaaaaacatc

SEQ ID NO: 942505 - DNA, 22 bp, Homo sapiens
ttcagctcatttaatcccagga

SEQ ID NO: 942506 - DNA, 19 bp, Homo sapiens
ttcagctcctgagtagctg

SEQ ID NO: 942507 - DNA, 17 bp, Homo sapiens
ttcagctcttaaaaaga

SEQ ID NO: 942508 - DNA, 16 bp, Homo sapiens
ttcagctctttccaaa

SEQ ID NO: 942509 - DNA, 18 bp, Homo sapiens
ttcagctctttccaaatt

SEQ ID NO: 942510 - DNA, 13 bp, Homo sapiens
ttcagctgcccca

SEQ ID NO: 942511 - DNA, 23 bp, Homo sapiens
ttcagctgcctgaaacagccatg

SEQ ID NO: 942512 - DNA, 14 bp, Homo sapiens
ttcagcttcatttg

SEQ ID NO: 942513 - DNA, 13 bp, Homo sapiens
ttcaggaaaatgt

SEQ ID NO: 942514 - DNA, 13 bp, Homo sapiens
ttcaggaaaattg

SEQ ID NO: 942515 - DNA, 21 bp, Homo sapiens
ttcaggaacaagtaatgtatt

SEQ ID NO: 942516 - DNA, 14 bp, Homo sapiens
ttcaggacacatct

SEQ ID NO: 942517 - DNA, 10 bp, Homo sapiens
ttcaggactt

SEQ ID NO: 942518 - DNA, 17 bp, Homo sapiens
ttcaggagcgcaagata

SEQ ID NO: 942519 - DNA, 18 bp, Homo sapiens
ttcaggagcgcaagatag

SEQ ID NO: 942520 - DNA, 20 bp, Homo sapiens
ttcaggaggccctggtgtca

SEQ ID NO: 942521 - DNA, 14 bp, Homo sapiens
ttcaggcactgaga

SEQ ID NO: 942522 - DNA, 22 bp, Homo sapiens
ttcaggcagcaggggctgctgt

SEQ ID NO: 942523 - DNA, 14 bp, Homo sapiens
ttcaggccagccca

SEQ ID NO: 942524 - DNA, 15 bp, Homo sapiens
ttcaggccagcccag

SEQ ID NO: 942525 - DNA, 17 bp, Homo sapiens
ttcaggccagtgtggtg

SEQ ID NO: 942526 - DNA, 14 bp, Homo sapiens
ttcaggctcctaaa

SEQ ID NO: 942527 - DNA, 16 bp, Homo sapiens
ttcaggctcttctcct

SEQ ID NO: 942528 - DNA, 16 bp, Homo sapiens
ttcaggctgcttggga

SEQ ID NO: 942529 - DNA, 15 bp, Homo sapiens
ttcaggcttttatga

SEQ ID NO: 942530 - DNA, 13 bp, Homo sapiens
ttcagggaactgc

SEQ ID NO: 942531 - DNA, 18 bp, Homo sapiens
ttcagggaccgtccaggg

SEQ ID NO: 942532 - DNA, 12 bp, Homo sapiens
ttcagggacctc

SEQ ID NO: 942533 - DNA, 22 bp, Homo sapiens
ttcagggacctcaggggcacct

SEQ ID NO: 942534 - DNA, 16 bp, Homo sapiens
ttcagggattccctgt

SEQ ID NO: 942535 - DNA, 23 bp, Homo sapiens
ttcagggccagaaggagggcaga

SEQ ID NO: 942536 - DNA, 20 bp, Homo sapiens
ttcagggctggctcctgatc

SEQ ID NO: 942537 - DNA, 16 bp, Homo sapiens
ttcaggggactcagcc

SEQ ID NO: 942538 - DNA, 21 bp, Homo sapiens
ttcaggggagtcccgtcagga

SEQ ID NO: 942539 - DNA, 12 bp, Homo sapiens
ttcaggggcttt

SEQ ID NO: 942540 - DNA, 16 bp, Homo sapiens
ttcaggggctttgggc

SEQ ID NO: 942541 - DNA, 16 bp, Homo sapiens
ttcagggtatcccaga

SEQ ID NO: 942542 - DNA, 15 bp, Homo sapiens
ttcagggtttaatag

SEQ ID NO: 942543 - DNA, 21 bp, Homo sapiens
ttcagggttttctgagggaaa

SEQ ID NO: 942544 - DNA, 14 bp, Homo sapiens
ttcaggtactaaat

SEQ ID NO: 942545 - DNA, 13 bp, Homo sapiens
ttcaggtaggccc

SEQ ID NO: 942546 - DNA, 16 bp, Homo sapiens
ttcaggtatgttgcct

SEQ ID NO: 942547 - DNA, 21 bp, Homo sapiens
ttcaggtgtagtagttctgtg

SEQ ID NO: 942548 - DNA, 13 bp, Homo sapiens
ttcaggtgtgaga

SEQ ID NO: 942549 - DNA, 20 bp, Homo sapiens
ttcaggtgtttagttgcaga

SEQ ID NO: 942550 - DNA, 15 bp, Homo sapiens
ttcaggttttgtaaa

SEQ ID NO: 942551 - DNA, 20 bp, Homo sapiens
ttcagtaataaactgtgttt

SEQ ID NO: 942552 - DNA, 14 bp, Homo sapiens
ttcagtacaaccca

SEQ ID NO: 942553 - DNA, 22 bp, Homo sapiens
ttcagtacacttggtgtactgg

SEQ ID NO: 942554 - DNA, 21 bp, Homo sapiens
ttcagtaccctctcagctcca

SEQ ID NO: 942555 - DNA, 18 bp, Homo sapiens
ttcagtagaattaccatt

SEQ ID NO: 942556 - DNA, 19 bp, Homo sapiens
ttcagtaggaacaagctgg

SEQ ID NO: 942557 - DNA, 16 bp, Homo sapiens
ttcagtataatttaac

SEQ ID NO: 942558 - DNA, 14 bp, Homo sapiens
ttcagtatactgtg

SEQ ID NO: 942559 - DNA, 16 bp, Homo sapiens
ttcagtatcatctcca

SEQ ID NO: 942560 - DNA, 15 bp, Homo sapiens
ttcagtatcttagag

SEQ ID NO: 942561 - DNA, 23 bp, Homo sapiens
ttcagtatcttagagtttacagt

SEQ ID NO: 942562 - DNA, 19 bp, Homo sapiens
ttcagtatgttgtcaaaga

SEQ ID NO: 942563 - DNA, 13 bp, Homo sapiens
ttcagtattttcc

SEQ ID NO: 942564 - DNA, 17 bp, Homo sapiens
ttcagtattttttactt

SEQ ID NO: 942565 - DNA, 13 bp, Homo sapiens
ttcagtcaattct

SEQ ID NO: 942566 - DNA, 15 bp, Homo sapiens
ttcagtcaattctga

SEQ ID NO: 942567 - DNA, 13 bp, Homo sapiens
ttcagtcattaaa

SEQ ID NO: 942568 - DNA, 16 bp, Homo sapiens
ttcagtcattaaatta

SEQ ID NO: 942569 - DNA, 15 bp, Homo sapiens
ttcagtcccctctct

SEQ ID NO: 942570 - DNA, 20 bp, Homo sapiens
ttcagtcccctctctctggg

SEQ ID NO: 942571 - DNA, 18 bp, Homo sapiens
ttcagtcctgctccagaa

SEQ ID NO: 942572 - DNA, 17 bp, Homo sapiens
ttcagtctgctccacca

SEQ ID NO: 942573 - DNA, 14 bp, Homo sapiens
ttcagtcttggtaa

SEQ ID NO: 942574 - DNA, 12 bp, Homo sapiens
ttcagtgaaatt

SEQ ID NO: 942575 - DNA, 20 bp, Homo sapiens
ttcagtgagcccctccccag

SEQ ID NO: 942576 - DNA, 20 bp, Homo sapiens
ttcagtgagggtcttcttac

SEQ ID NO: 942577 - DNA, 23 bp, Homo sapiens
ttcagtgcatcattactgttcca

SEQ ID NO: 942578 - DNA, 14 bp, Homo sapiens
ttcagtgcccacca

SEQ ID NO: 942579 - DNA, 13 bp, Homo sapiens
ttcagtgccttcc

SEQ ID NO: 942580 - DNA, 13 bp, Homo sapiens
ttcagtgctgtgg

SEQ ID NO: 942581 - DNA, 19 bp, Homo sapiens
ttcagtgctgtggcctggg

SEQ ID NO: 942582 - DNA, 20 bp, Homo sapiens
ttcagtggaccctgtggcca

SEQ ID NO: 942583 - DNA, 21 bp, Homo sapiens
ttcagtggaccgaaatctgta

SEQ ID NO: 942584 - DNA, 19 bp, Homo sapiens
ttcagtggcttcccagctc

SEQ ID NO: 942585 - DNA, 14 bp, Homo sapiens
ttcagtggggcagt

SEQ ID NO: 942586 - DNA, 20 bp, Homo sapiens
ttcagtgtagcgggaggaag

SEQ ID NO: 942587 - DNA, 20 bp, Homo sapiens
ttcagtgtatggaaataaat

SEQ ID NO: 942588 - DNA, 18 bp, Homo sapiens
ttcagtgtcccgggcccg

SEQ ID NO: 942589 - DNA, 21 bp, Homo sapiens
ttcagtgtcgggaattttccc

SEQ ID NO: 942590 - DNA, 22 bp, Homo sapiens
ttcagtgttacctgtgtgcttg

SEQ ID NO: 942591 - DNA, 10 bp, Homo sapiens
ttcagttcca

SEQ ID NO: 942592 - DNA, 14 bp, Homo sapiens
ttcagttccaagaa

SEQ ID NO: 942593 - DNA, 16 bp, Homo sapiens
ttcagttgatcactgg

SEQ ID NO: 942594 - DNA, 18 bp, Homo sapiens
ttcagtttctaaaattga

SEQ ID NO: 942595 - DNA, 19 bp, Homo sapiens
ttcagtttctaaaattgag

SEQ ID NO: 942596 - DNA, 17 bp, Homo sapiens
ttcagtttgtaaagtcg

SEQ ID NO: 942597 - DNA, 23 bp, Homo sapiens
ttcagtttttcatttgttttgct

SEQ ID NO: 942598 - DNA, 13 bp, Homo sapiens
ttcagtttttgta

SEQ ID NO: 942599 - DNA, 15 bp, Homo sapiens
ttcagtttttgtatc

SEQ ID NO: 942600 - DNA, 16 bp, Homo sapiens
ttcagtttttgtatct

SEQ ID NO: 942601 - DNA, 20 bp, Homo sapiens
ttcagtttttttttttccag

SEQ ID NO: 942602 - DNA, 14 bp, Homo sapiens
ttcataaatcatgt

SEQ ID NO: 942603 - DNA, 14 bp, Homo sapiens
ttcataaattattt

SEQ ID NO: 942604 - DNA, 20 bp, Homo sapiens
ttcataaattatttgattat

SEQ ID NO: 942605 - DNA, 16 bp, Homo sapiens
ttcataacttcctgta

SEQ ID NO: 942606 - DNA, 12 bp, Homo sapiens
ttcataagtatt

SEQ ID NO: 942607 - DNA, 17 bp, Homo sapiens
ttcataagtatttcaaa

SEQ ID NO: 942608 - DNA, 15 bp, Homo sapiens
ttcataatcactcta

SEQ ID NO: 942609 - DNA, 13 bp, Homo sapiens
ttcataatgaaaa

SEQ ID NO: 942610 - DNA, 23 bp, Homo sapiens
ttcataatgaaaaactatgtcag

SEQ ID NO: 942611 - DNA, 20 bp, Homo sapiens
ttcataatgaattataacag

SEQ ID NO: 942612 - DNA, 13 bp, Homo sapiens
ttcataattctga

SEQ ID NO: 942613 - DNA, 21 bp, Homo sapiens
ttcatacgcatcccatctctc

SEQ ID NO: 942614 - DNA, 17 bp, Homo sapiens
ttcatactccttttggc

SEQ ID NO: 942615 - DNA, 13 bp, Homo sapiens
ttcatagagaggc

SEQ ID NO: 942616 - DNA, 18 bp, Homo sapiens
ttcatagagatttgtcta

SEQ ID NO: 942617 - DNA, 20 bp, Homo sapiens
ttcatagagatttgtctaat

SEQ ID NO: 942618 - DNA, 13 bp, Homo sapiens
ttcatagcccagt

SEQ ID NO: 942619 - DNA, 21 bp, Homo sapiens
ttcataggcggtcatgtgtgc

SEQ ID NO: 942620 - DNA, 23 bp, Homo sapiens
ttcataggcggtcatgtgtgcat

SEQ ID NO: 942621 - DNA, 19 bp, Homo sapiens
ttcatagggtctcttcagg

SEQ ID NO: 942622 - DNA, 13 bp, Homo sapiens
ttcataggtctga

SEQ ID NO: 942623 - DNA, 18 bp, Homo sapiens
ttcatagtgcctttttcc

SEQ ID NO: 942624 - DNA, 19 bp, Homo sapiens
ttcatagttcagaatttag

SEQ ID NO: 942625 - DNA, 20 bp, Homo sapiens
ttcatagttcagaatttagt

SEQ ID NO: 942626 - DNA, 21 bp, Homo sapiens
ttcatataaaagttgcgttta

SEQ ID NO: 942627 - DNA, 21 bp, Homo sapiens
ttcatatagttagctaataaa

SEQ ID NO: 942628 - DNA, 18 bp, Homo sapiens
ttcatatatgaggacttg

SEQ ID NO: 942629 - DNA, 16 bp, Homo sapiens
ttcatatcatactgtt

SEQ ID NO: 942630 - DNA, 11 bp, Homo sapiens
ttcatatcatt

SEQ ID NO: 942631 - DNA, 13 bp, Homo sapiens
ttcatatccagct

SEQ ID NO: 942632 - DNA, 23 bp, Homo sapiens
ttcatatgcagaacgtatttagc

SEQ ID NO: 942633 - DNA, 14 bp, Homo sapiens
ttcatatgttgctc

SEQ ID NO: 942634 - DNA, 20 bp, Homo sapiens
ttcatattaagacagtgtac

SEQ ID NO: 942635 - DNA, 20 bp, Homo sapiens
ttcatattggattgcgcctt

SEQ ID NO: 942636 - DNA, 14 bp, Homo sapiens
ttcatattgtgcca

SEQ ID NO: 942637 - DNA, 22 bp, Homo sapiens
ttcatattgtgccaatatgtat

SEQ ID NO: 942638 - DNA, 23 bp, Homo sapiens
ttcatattgttgcattgcttttt

SEQ ID NO: 942639 - DNA, 19 bp, Homo sapiens
ttcatatttaagtgtattt

SEQ ID NO: 942640 - DNA, 21 bp, Homo sapiens
ttcatatttacttcttataca

SEQ ID NO: 942641 - DNA, 20 bp, Homo sapiens
ttcatcaatatccctcttgt

SEQ ID NO: 942642 - DNA, 13 bp, Homo sapiens
ttcatcactggga

SEQ ID NO: 942643 - DNA, 13 bp, Homo sapiens
ttcatcagcattt

SEQ ID NO: 942644 - DNA, 22 bp, Homo sapiens
ttcatcattgtttctgcatgaa

SEQ ID NO: 942645 - DNA, 15 bp, Homo sapiens
ttcatcatttcagcc

SEQ ID NO: 942646 - DNA, 16 bp, Homo sapiens
ttcatcatttcagcca

SEQ ID NO: 942647 - DNA, 17 bp, Homo sapiens
ttcatcatttcagccaa

SEQ ID NO: 942648 - DNA, 14 bp, Homo sapiens
ttcatcatttttta

SEQ ID NO: 942649 - DNA, 16 bp, Homo sapiens
ttcatccaatcctcac

SEQ ID NO: 942650 - DNA, 22 bp, Homo sapiens
ttcatccaatcctcactgggtg

SEQ ID NO: 942651 - DNA, 15 bp, Homo sapiens
ttcatccactagtgc

SEQ ID NO: 942652 - DNA, 18 bp, Homo sapiens
ttcatccaggactgagat

SEQ ID NO: 942653 - DNA, 21 bp, Homo sapiens
ttcatccaggcccaactgtga

SEQ ID NO: 942654 - DNA, 23 bp, Homo sapiens
ttcatccagtttgttctccgggt

SEQ ID NO: 942655 - DNA, 15 bp, Homo sapiens
ttcatccataactga

SEQ ID NO: 942656 - DNA, 16 bp, Homo sapiens
ttcatcccatgatgta

SEQ ID NO: 942657 - DNA, 12 bp, Homo sapiens
ttcatcccctcc

SEQ ID NO: 942658 - DNA, 19 bp, Homo sapiens
ttcatcccgtatcacagtg

SEQ ID NO: 942659 - DNA, 15 bp, Homo sapiens
ttcatcctaacatga

SEQ ID NO: 942660 - DNA, 21 bp, Homo sapiens
ttcatcctaacatgacagtat

SEQ ID NO: 942661 - DNA, 13 bp, Homo sapiens
ttcatcctggcct

SEQ ID NO: 942662 - DNA, 12 bp, Homo sapiens
ttcatcctgtgt

SEQ ID NO: 942663 - DNA, 17 bp, Homo sapiens
ttcatcctgtgtcccct

SEQ ID NO: 942664 - DNA, 15 bp, Homo sapiens
ttcatccttccccaa

SEQ ID NO: 942665 - DNA, 22 bp, Homo sapiens
ttcatccttttttctcttctgt

SEQ ID NO: 942666 - DNA, 17 bp, Homo sapiens
ttcatctatttctgaga

SEQ ID NO: 942667 - DNA, 21 bp, Homo sapiens
ttcatctcatgaggatttctt

SEQ ID NO: 942668 - DNA, 16 bp, Homo sapiens
ttcatctcatttaagg

SEQ ID NO: 942669 - DNA, 13 bp, Homo sapiens
ttcatctcctttt

SEQ ID NO: 942670 - DNA, 14 bp, Homo sapiens
ttcatctgggaaag

SEQ ID NO: 942671 - DNA, 12 bp, Homo sapiens
ttcatctgggtg

SEQ ID NO: 942672 - DNA, 13 bp, Homo sapiens
ttcatctgggtgg

SEQ ID NO: 942673 - DNA, 18 bp, Homo sapiens
ttcatctgtaactctaaa

SEQ ID NO: 942674 - DNA, 21 bp, Homo sapiens
ttcatctgtaactctaaaaga

SEQ ID NO: 942675 - DNA, 13 bp, Homo sapiens
ttcatcttaaact

SEQ ID NO: 942676 - DNA, 14 bp, Homo sapiens
ttcatcttaaacta

SEQ ID NO: 942677 - DNA, 20 bp, Homo sapiens
ttcccaggtaatttaaattg

SEQ ID NO: 942678 - DNA, 12 bp, Homo sapiens
ttcccaggtgct

SEQ ID NO: 942679 - DNA, 19 bp, Homo sapiens
ttcccagtatttttatacg

SEQ ID NO: 942680 - DNA, 15 bp, Homo sapiens
ttcccagtctgtcga

SEQ ID NO: 942681 - DNA, 21 bp, Homo sapiens
ttcccagtgagtcacatcctg

SEQ ID NO: 942682 - DNA, 14 bp, Homo sapiens
ttcccagttaaaga

SEQ ID NO: 942683 - DNA, 16 bp, Homo sapiens
ttcccagttaaagatt

SEQ ID NO: 942684 - DNA, 11 bp, Homo sapiens
ttcccataatt

SEQ ID NO: 942685 - DNA, 15 bp, Homo sapiens
ttcccataattttct

SEQ ID NO: 942686 - DNA, 23 bp, Homo sapiens
ttcccatcactggagcaccaggc

SEQ ID NO: 942687 - DNA, 15 bp, Homo sapiens
ttcccatctccaggg

SEQ ID NO: 942688 - DNA, 12 bp, Homo sapiens
ttcccatctgca

SEQ ID NO: 942689 - DNA, 16 bp, Homo sapiens
ttcccatgactcttgg

SEQ ID NO: 942690 - DNA, 14 bp, Homo sapiens
ttcccatggccatt

SEQ ID NO: 942691 - DNA, 17 bp, Homo sapiens
ttcccatggtgtatgtg

SEQ ID NO: 942692 - DNA, 17 bp, Homo sapiens
ttcccatgtagccccct

SEQ ID NO: 942693 - DNA, 14 bp, Homo sapiens
ttcccattcttgca

SEQ ID NO: 942694 - DNA, 14 bp, Homo sapiens
ttcccatttcagct

SEQ ID NO: 942695 - DNA, 15 bp, Homo sapiens
ttcccatttcagctg

SEQ ID NO: 942696 - DNA, 14 bp, Homo sapiens
ttcccattttgcaa

SEQ ID NO: 942697 - DNA, 19 bp, Homo sapiens
ttcccattttgcaaaattt

SEQ ID NO: 942698 - DNA, 18 bp, Homo sapiens
ttccccaaccacttcatt

SEQ ID NO: 942699 - DNA, 16 bp, Homo sapiens
ttccccaacttcccta

SEQ ID NO: 942700 - DNA, 14 bp, Homo sapiens
ttccccaagagaaa

SEQ ID NO: 942701 - DNA, 14 bp, Homo sapiens
ttccccaccccttc

SEQ ID NO: 942702 - DNA, 22 bp, Homo sapiens
ttccccacttctgtgccacccc

SEQ ID NO: 942703 - DNA, 19 bp, Homo sapiens
ttccccagactcagctcca

SEQ ID NO: 942704 - DNA, 21 bp, Homo sapiens
ttccccagactcagctccaga

SEQ ID NO: 942705 - DNA, 24 bp, Homo sapiens
ttccccagaggctcccaatcagct

SEQ ID NO: 942706 - DNA, 16 bp, Homo sapiens
ttccccagggaaggaa

SEQ ID NO: 942707 - DNA, 23 bp, Homo sapiens
ttccccataactcaatggcctaa

SEQ ID NO: 942708 - DNA, 15 bp, Homo sapiens
ttccccatcagctcc

SEQ ID NO: 942709 - DNA, 18 bp, Homo sapiens
ttccccatcagctcccaa

SEQ ID NO: 942710 - DNA, 13 bp, Homo sapiens
ttccccatctctg

SEQ ID NO: 942711 - DNA, 14 bp, Homo sapiens
ttccccatctctgt

SEQ ID NO: 942712 - DNA, 17 bp, Homo sapiens
ttccccatcttctaaac

SEQ ID NO: 942713 - DNA, 11 bp, Homo sapiens
ttccccatggg

SEQ ID NO: 942714 - DNA, 23 bp, Homo sapiens
ttcccccaccaccaaaactgctc

SEQ ID NO: 942715 - DNA, 23 bp, Homo sapiens
ttcccccaccggtccagctggcc

SEQ ID NO: 942716 - DNA, 14 bp, Homo sapiens
ttcccccagccctg

SEQ ID NO: 942717 - DNA, 23 bp, Homo sapiens
ttcccccatcccctttcctcccc

SEQ ID NO: 942718 - DNA, 13 bp, Homo sapiens
ttcccccatccct

SEQ ID NO: 942719 - DNA, 14 bp, Homo sapiens
ttcccccatcccta

SEQ ID NO: 942720 - DNA, 16 bp, Homo sapiens
ttcccccatccctacc

SEQ ID NO: 942721 - DNA, 19 bp, Homo sapiens
ttccccccactctccccac

SEQ ID NO: 942722 - DNA, 18 bp, Homo sapiens
ttcccccctctcctccca

SEQ ID NO: 942723 - DNA, 19 bp, Homo sapiens
ttcccccctctcctcccag

SEQ ID NO: 942724 - DNA, 15 bp, Homo sapiens
ttccccctcccaggg

SEQ ID NO: 942725 - DNA, 12 bp, Homo sapiens
ttcccccttaaa

SEQ ID NO: 942726 - DNA, 13 bp, Homo sapiens
ttcccccttcccg

SEQ ID NO: 942727 - DNA, 23 bp, Homo sapiens
ttcccccttgaggattgtggaaa

SEQ ID NO: 942728 - DNA, 19 bp, Homo sapiens
ttccccgatgtcccctgcg

SEQ ID NO: 942729 - DNA, 16 bp, Homo sapiens
ttccccggtcccttga

SEQ ID NO: 942730 - DNA, 14 bp, Homo sapiens
ttccccgtcccctg

SEQ ID NO: 942731 - DNA, 19 bp, Homo sapiens
ttcccctaacctcattccc

SEQ ID NO: 942732 - DNA, 21 bp, Homo sapiens
ttcccctaccccctcctctct

SEQ ID NO: 942733 - DNA, 11 bp, Homo sapiens
ttcccctagac

SEQ ID NO: 942734 - DNA, 16 bp, Homo sapiens
ttcccctagacctccc

SEQ ID NO: 942735 - DNA, 22 bp, Homo sapiens
ttcccctcaatgcagtcagtgt

SEQ ID NO: 942736 - DNA, 15 bp, Homo sapiens
ttcccctcccacctc

SEQ ID NO: 942737 - DNA, 19 bp, Homo sapiens
ttcccctcccacctctcct

SEQ ID NO: 942738 - DNA, 12 bp, Homo sapiens
ttcccctcccta

SEQ ID NO: 942739 - DNA, 13 bp, Homo sapiens
ttcccctccctgg

SEQ ID NO: 942740 - DNA, 17 bp, Homo sapiens
ttcccctcctttgtctt

SEQ ID NO: 942741 - DNA, 18 bp, Homo sapiens
ttcccctcctttgtcttt

SEQ ID NO: 942742 - DNA, 16 bp, Homo sapiens
ttcccctcttgtctcc

SEQ ID NO: 942743 - DNA, 17 bp, Homo sapiens
ttcccctcttgtctccc

SEQ ID NO: 942744 - DNA, 14 bp, Homo sapiens
ttcccctctttgaa

SEQ ID NO: 942745 - DNA, 19 bp, Homo sapiens
ttcccctgcacctggcctg

SEQ ID NO: 942746 - DNA, 19 bp, Homo sapiens
ttcccctgcactcccgacc

SEQ ID NO: 942747 - DNA, 14 bp, Homo sapiens
ttcccctgggatgc

SEQ ID NO: 942748 - DNA, 19 bp, Homo sapiens
ttcccctgggatgctgacc

SEQ ID NO: 942749 - DNA, 23 bp, Homo sapiens
ttcccctgggatgctgacccagg

SEQ ID NO: 942750 - DNA, 13 bp, Homo sapiens
ttcccctgtcctg

SEQ ID NO: 942751 - DNA, 13 bp, Homo sapiens
ttcccctgtgtca

SEQ ID NO: 942752 - DNA, 15 bp, Homo sapiens
ttcccctgtgtcatc

SEQ ID NO: 942753 - DNA, 19 bp, Homo sapiens
ttccccttctgtgtcacag

SEQ ID NO: 942754 - DNA, 14 bp, Homo sapiens
ttccccttgccctt

SEQ ID NO: 942755 - DNA, 20 bp, Homo sapiens
ttccccttgcccttgccctg

SEQ ID NO: 942756 - DNA, 21 bp, Homo sapiens
ttccccttgcccttgccctga

SEQ ID NO: 942757 - DNA, 17 bp, Homo sapiens
ttcccctttgtcctgcg

SEQ ID NO: 942758 - DNA, 16 bp, Homo sapiens
ttccccttttgccaat

SEQ ID NO: 942759 - DNA, 12 bp, Homo sapiens
ttcccgacccag

SEQ ID NO: 942760 - DNA, 14 bp, Homo sapiens
ttcccgagggagct

SEQ ID NO: 942761 - DNA, 18 bp, Homo sapiens
ttcccgatggtctctctc

SEQ ID NO: 942762 - DNA, 20 bp, Homo sapiens
ttcccgatggtctctctccc

SEQ ID NO: 942763 - DNA, 23 bp, Homo sapiens
ttcccgatggtctctctccctct

SEQ ID NO: 942764 - DNA, 18 bp, Homo sapiens
ttcccgccccacctccca

SEQ ID NO: 942765 - DNA, 12 bp, Homo sapiens
ttcccgcctccc

SEQ ID NO: 942766 - DNA, 14 bp, Homo sapiens
ttcccgctcagccc

SEQ ID NO: 942767 - DNA, 18 bp, Homo sapiens
ttcccgctcagccctccc

SEQ ID NO: 942768 - DNA, 19 bp, Homo sapiens
ttcccggagcacagccctg

SEQ ID NO: 942769 - DNA, 15 bp, Homo sapiens
ttcccggcccttacc

SEQ ID NO: 942770 - DNA, 18 bp, Homo sapiens
ttcccgggccagggctgc

SEQ ID NO: 942771 - DNA, 20 bp, Homo sapiens
ttcccggtcccgagtacagt

SEQ ID NO: 942772 - DNA, 20 bp, Homo sapiens
ttcccgtctcagaatctaaa

SEQ ID NO: 942773 - DNA, 15 bp, Homo sapiens
ttccctaactctcgg

SEQ ID NO: 942774 - DNA, 15 bp, Homo sapiens
ttccctacctcaggc

SEQ ID NO: 942775 - DNA, 13 bp, Homo sapiens
ttccctacttcct

SEQ ID NO: 942776 - DNA, 16 bp, Homo sapiens
ttccctacttcctgtg

SEQ ID NO: 942777 - DNA, 22 bp, Homo sapiens
ttccctagaaacttccaaatcc

SEQ ID NO: 942778 - DNA, 15 bp, Homo sapiens
ttccctagaaagcca

SEQ ID NO: 942779 - DNA, 23 bp, Homo sapiens
ttccctagaaagccatattccag

SEQ ID NO: 942780 - DNA, 13 bp, Homo sapiens
ttccctcaccccc

SEQ ID NO: 942781 - DNA, 19 bp, Homo sapiens
ttccctcactcttcctcat

SEQ ID NO: 942782 - DNA, 15 bp, Homo sapiens
ttccctcatctctcc

SEQ ID NO: 942783 - DNA, 23 bp, Homo sapiens
ttccctccatccccctttaccct

SEQ ID NO: 942784 - DNA, 19 bp, Homo sapiens
ttccctcccagaggagcca

SEQ ID NO: 942785 - DNA, 15 bp, Homo sapiens
ttccctccccagaat

SEQ ID NO: 942786 - DNA, 11 bp, Homo sapiens
ttccctccccc

SEQ ID NO: 942787 - DNA, 14 bp, Homo sapiens
ttccctcctgacaa

SEQ ID NO: 942788 - DNA, 14 bp, Homo sapiens
ttccctcctgccca

SEQ ID NO: 942789 - DNA, 17 bp, Homo sapiens
ttccctcctgcccagga

SEQ ID NO: 942790 - DNA, 19 bp, Homo sapiens
ttccctcctggtcctggac

SEQ ID NO: 942791 - DNA, 20 bp, Homo sapiens
ttccctcctgtgccccagct

SEQ ID NO: 942792 - DNA, 23 bp, Homo sapiens
ttccctcgacttgaccctttcct

SEQ ID NO: 942793 - DNA, 23 bp, Homo sapiens
ttccctcggcgttagtccctagc

SEQ ID NO: 942794 - DNA, 14 bp, Homo sapiens
ttccctctcatctc

SEQ ID NO: 942795 - DNA, 14 bp, Homo sapiens
ttccctctccctgt

SEQ ID NO: 942796 - DNA, 12 bp, Homo sapiens
ttccctctctga

SEQ ID NO: 942797 - DNA, 13 bp, Homo sapiens
ttcctattgtcat

SEQ ID NO: 942798 - DNA, 22 bp, Homo sapiens
ttcctattttcttttccattgc

SEQ ID NO: 942799 - DNA, 19 bp, Homo sapiens
ttcctcaaaataaagaagt

SEQ ID NO: 942800 - DNA, 20 bp, Homo sapiens
ttcctcaaaataaagaagta

SEQ ID NO: 942801 - DNA, 21 bp, Homo sapiens
ttcctcaaaataaagaagtat

SEQ ID NO: 942802 - DNA, 20 bp, Homo sapiens
ttcctcaaattttttgactt

SEQ ID NO: 942803 - DNA, 18 bp, Homo sapiens
ttcctcaagtatcttcta

SEQ ID NO: 942804 - DNA, 14 bp, Homo sapiens
ttcctcacactgct

SEQ ID NO: 942805 - DNA, 19 bp, Homo sapiens
ttcctcacactgctgtcct

SEQ ID NO: 942806 - DNA, 22 bp, Homo sapiens
ttcctcacactgctgtcctctc

SEQ ID NO: 942807 - DNA, 24 bp, Homo sapiens
ttcctcacactgctgtcctctccc

SEQ ID NO: 942808 - DNA, 13 bp, Homo sapiens
ttcctcacatttg

SEQ ID NO: 942809 - DNA, 23 bp, Homo sapiens
ttcctcactgcctggtaaaatta

SEQ ID NO: 942810 - DNA, 13 bp, Homo sapiens
ttcctcagaaccc

SEQ ID NO: 942811 - DNA, 20 bp, Homo sapiens
ttcctcagattcaataatga

SEQ ID NO: 942812 - DNA, 17 bp, Homo sapiens
ttcctcagattgctgaa

SEQ ID NO: 942813 - DNA, 13 bp, Homo sapiens
ttcctcagcctcc

SEQ ID NO: 942814 - DNA, 15 bp, Homo sapiens
ttcctcagcctccaa

SEQ ID NO: 942815 - DNA, 16 bp, Homo sapiens
ttcctcagcttatctc

SEQ ID NO: 942816 - DNA, 18 bp, Homo sapiens
ttcctcagggtgtcctga

SEQ ID NO: 942817 - DNA, 14 bp, Homo sapiens
ttcctcatcctgct

SEQ ID NO: 942818 - DNA, 20 bp, Homo sapiens
ttcctcatcctgcttctctt

SEQ ID NO: 942819 - DNA, 14 bp, Homo sapiens
ttcctcatcctttc

SEQ ID NO: 942820 - DNA, 16 bp, Homo sapiens
ttcctcatcctttccc

SEQ ID NO: 942821 - DNA, 19 bp, Homo sapiens
ttcctcatcctttccctct

SEQ ID NO: 942822 - DNA, 18 bp, Homo sapiens
ttcctcatctgggtctcc

SEQ ID NO: 942823 - DNA, 16 bp, Homo sapiens
ttcctcatctttaaaa

SEQ ID NO: 942824 - DNA, 14 bp, Homo sapiens
ttcctcatgtaaca

SEQ ID NO: 942825 - DNA, 21 bp, Homo sapiens
ttccttcctagaagcccctgt

SEQ ID NO: 942826 - DNA, 18 bp, Homo sapiens
ttccttcgaaaggccttc

SEQ ID NO: 942827 - DNA, 20 bp, Homo sapiens
ttccttcgaaaggccttcag

SEQ ID NO: 942828 - DNA, 18 bp, Homo sapiens
ttccttctaacatgttat

SEQ ID NO: 942829 - DNA, 20 bp, Homo sapiens
ttccttctcccatctcttcc

SEQ ID NO: 942830 - DNA, 11 bp, Homo sapiens
ttccttctctg

SEQ ID NO: 942831 - DNA, 21 bp, Homo sapiens
ttccttctgctcccaccccag

SEQ ID NO: 942832 - DNA, 20 bp, Homo sapiens
ttccttctgggactggacag

SEQ ID NO: 942833 - DNA, 17 bp, Homo sapiens
ttccttgagaaaaacaa

SEQ ID NO: 942834 - DNA, 22 bp, Homo sapiens
ttccttgagacacggagcccag

SEQ ID NO: 942835 - DNA, 24 bp, Homo sapiens
ttccttgagacacggagcccagcc

SEQ ID NO: 942836 - DNA, 16 bp, Homo sapiens
ttccttgctatttcaa

SEQ ID NO: 942837 - DNA, 13 bp, Homo sapiens
ttccttgctctcc

SEQ ID NO: 942838 - DNA, 18 bp, Homo sapiens
ttccttgctgtcctaggc

SEQ ID NO: 942839 - DNA, 17 bp, Homo sapiens
ttccttggcaattaaaa

SEQ ID NO: 942840 - DNA, 23 bp, Homo sapiens
ttccttggctcccattcactctt

SEQ ID NO: 942841 - DNA, 20 bp, Homo sapiens
ttccttgggcgtctccccca

SEQ ID NO: 942842 - DNA, 15 bp, Homo sapiens
ttccttgtatttaaa

SEQ ID NO: 942843 - DNA, 18 bp, Homo sapiens
ttccttgtatttaaatat

SEQ ID NO: 942844 - DNA, 16 bp, Homo sapiens
ttccttgtcaccagca

SEQ ID NO: 942845 - DNA, 22 bp, Homo sapiens
ttccttgttggtcagaggagtg

SEQ ID NO: 942846 - DNA, 14 bp, Homo sapiens
ttccttgtttatca

SEQ ID NO: 942847 - DNA, 15 bp, Homo sapiens
ttcctttactttccc

SEQ ID NO: 942848 - DNA, 14 bp, Homo sapiens
ttcctttatgtgaa

SEQ ID NO: 942849 - DNA, 15 bp, Homo sapiens
ttcctttatgtgaat

SEQ ID NO: 942850 - DNA, 20 bp, Homo sapiens
ttcctttcatctctctacct

SEQ ID NO: 942851 - DNA, 17 bp, Homo sapiens
ttcctttccctggagct

SEQ ID NO: 942852 - DNA, 12 bp, Homo sapiens
ttcctttccctt

SEQ ID NO: 942853 - DNA, 17 bp, Homo sapiens
ttcctttcccttcctct

SEQ ID NO: 942854 - DNA, 18 bp, Homo sapiens
ttcctttcccttcctctt

SEQ ID NO: 942855 - DNA, 11 bp, Homo sapiens
ttcctttcctc

SEQ ID NO: 942856 - DNA, 21 bp, Homo sapiens
ttcctttcctctgcagcactt

SEQ ID NO: 942857 - DNA, 23 bp, Homo sapiens
ttcctttcctgtgtgtactctgt

SEQ ID NO: 942858 - DNA, 14 bp, Homo sapiens
ttcctttccttttc

SEQ ID NO: 942859 - DNA, 12 bp, Homo sapiens
ttcctttctcag

SEQ ID NO: 942860 - DNA, 14 bp, Homo sapiens
ttcctttctcccct

SEQ ID NO: 942861 - DNA, 18 bp, Homo sapiens
ttcctttctctcctggct

SEQ ID NO: 942862 - DNA, 21 bp, Homo sapiens
tgcaggaacgagcactggcca

SEQ ID NO: 942863 - DNA, 23 bp, Homo sapiens
tgcaggaacgagcactggccaga

SEQ ID NO: 942864 - DNA, 17 bp, Homo sapiens
tgcaggaataaggcctt

SEQ ID NO: 942865 - DNA, 18 bp, Homo sapiens
tgcaggacagctcttgat

SEQ ID NO: 942866 - DNA, 19 bp, Homo sapiens
tgcaggaccctgtcctgca

SEQ ID NO: 942867 - DNA, 15 bp, Homo sapiens
tgcaggaccttgggc

SEQ ID NO: 942868 - DNA, 11 bp, Homo sapiens
tgcaggagaaa

SEQ ID NO: 942869 - DNA, 17 bp, Homo sapiens
tgcaggagcagggcggc

SEQ ID NO: 942870 - DNA, 22 bp, Homo sapiens
tgcaggagcagtatcatgaagc

SEQ ID NO: 942871 - DNA, 18 bp, Homo sapiens
tgcaggagcctccctgca

SEQ ID NO: 942872 - DNA, 13 bp, Homo sapiens
tgcaggaggtgga

SEQ ID NO: 942873 - DNA, 15 bp, Homo sapiens
tgcaggaggtggaga

SEQ ID NO: 942874 - DNA, 23 bp, Homo sapiens
tgcaggagttaaaaagggcaggg

SEQ ID NO: 942875 - DNA, 16 bp, Homo sapiens
tgcaggattcccttct

SEQ ID NO: 942876 - DNA, 21 bp, Homo sapiens
tgcaggattcccttctgggct

SEQ ID NO: 942877 - DNA, 22 bp, Homo sapiens
tgcaggattcccttctgggctt

SEQ ID NO: 942878 - DNA, 12 bp, Homo sapiens
tgcaggcagaca

SEQ ID NO: 942879 - DNA, 20 bp, Homo sapiens
tgcactgggcaggttcctgg

SEQ ID NO: 942880 - DNA, 15 bp, Homo sapiens
tgcactgtaaatatc

SEQ ID NO: 942881 - DNA, 17 bp, Homo sapiens
tgcactgtaaatatccc

SEQ ID NO: 942882 - DNA, 16 bp, Homo sapiens
tgcactgtatgctgga

SEQ ID NO: 942883 - DNA, 20 bp, Homo sapiens
tgcactgtattgctcctccc

SEQ ID NO: 942884 - DNA, 15 bp, Homo sapiens
tgcactgtcactttg

SEQ ID NO: 942885 - DNA, 22 bp, Homo sapiens
tgcactgtcactttgctctggg

SEQ ID NO: 942886 - DNA, 19 bp, Homo sapiens
tgcactgtgaatcctggca

SEQ ID NO: 942887 - DNA, 14 bp, Homo sapiens
tgcactgttccccc

SEQ ID NO: 942888 - DNA, 21 bp, Homo sapiens
tgcactgttccccctgtgcag

SEQ ID NO: 942889 - DNA, 14 bp, Homo sapiens
tgcactgtttttaa

SEQ ID NO: 942890 - DNA, 16 bp, Homo sapiens
tgcacttaaggcactc

SEQ ID NO: 942891 - DNA, 21 bp, Homo sapiens
tgcacttaaggcactctgtta

SEQ ID NO: 942892 - DNA, 20 bp, Homo sapiens
tgcacttaagttagcctcca

SEQ ID NO: 942893 - DNA, 18 bp, Homo sapiens
tgcacttacttgcttatt

SEQ ID NO: 942894 - DNA, 17 bp, Homo sapiens
tgcacttagtagttttt

SEQ ID NO: 942895 - DNA, 22 bp, Homo sapiens
tgcacttatttatgaacctgcc

SEQ ID NO: 942896 - DNA, 15 bp, Homo sapiens
tgcacttcagacacc

SEQ ID NO: 942897 - DNA, 21 bp, Homo sapiens
tgcacttgtgattatttatta

SEQ ID NO: 942898 - DNA, 18 bp, Homo sapiens
tgcacttgttatattata

SEQ ID NO: 942899 - DNA, 17 bp, Homo sapiens
tgcactttaattgaaga

SEQ ID NO: 942900 - DNA, 11 bp, Homo sapiens
tgcactttaga

SEQ ID NO: 942901 - DNA, 17 bp, Homo sapiens
tgcactttataaacact

SEQ ID NO: 942902 - DNA, 14 bp, Homo sapiens
tgcactttccccct

SEQ ID NO: 942903 - DNA, 16 bp, Homo sapiens
tgcactttcccccttc

SEQ ID NO: 942904 - DNA, 20 bp, Homo sapiens
tgcactttctatcctctgta

SEQ ID NO: 942905 - DNA, 13 bp, Homo sapiens
tgcactttgtaaa

SEQ ID NO: 942906 - DNA, 16 bp, Homo sapiens
tgcactttgtaaattc

SEQ ID NO: 942907 - DNA, 17 bp, Homo sapiens
tgcactttgtttagaaa

SEQ ID NO: 942908 - DNA, 15 bp, Homo sapiens
tgcacttttttatga

SEQ ID NO: 942909 - DNA, 17 bp, Homo sapiens
tgcactttttttacttc

SEQ ID NO: 942910 - DNA, 18 bp, Homo sapiens
tgcactttttttctatat

SEQ ID NO: 942911 - DNA, 17 bp, Homo sapiens
tgcagaaaattctgtgc

SEQ ID NO: 942912 - DNA, 14 bp, Homo sapiens
tgcagaacacctgg

SEQ ID NO: 942913 - DNA, 17 bp, Homo sapiens
tgcagaacacctggccg

SEQ ID NO: 942914 - DNA, 19 bp, Homo sapiens
tgcagaacgtatttagcca

SEQ ID NO: 942915 - DNA, 22 bp, Homo sapiens
tgcagaacgtatttagccatta

SEQ ID NO: 942916 - DNA, 20 bp, Homo sapiens
tgcagaactcctccaaagca

SEQ ID NO: 942917 - DNA, 19 bp, Homo sapiens
tgcagaacttaatctggac

SEQ ID NO: 942918 - DNA, 16 bp, Homo sapiens
tgcagaagaaggcatc

SEQ ID NO: 942919 - DNA, 15 bp, Homo sapiens
tgcagaagagggtgt

SEQ ID NO: 942920 - DNA, 20 bp, Homo sapiens
tgcagaagcatattttgctg

SEQ ID NO: 942921 - DNA, 16 bp, Homo sapiens
tgcagaagccagaagg

SEQ ID NO: 942922 - DNA, 17 bp, Homo sapiens
tgcagaagccagaaggt

SEQ ID NO: 942923 - DNA, 21 bp, Homo sapiens
tgcagaagccagaaggtgcag

SEQ ID NO: 942924 - DNA, 16 bp, Homo sapiens
tgcagaaggaaaaatg

SEQ ID NO: 942925 - DNA, 19 bp, Homo sapiens
tgcagaaggaaaaatgtgt

SEQ ID NO: 942926 - DNA, 23 bp, Homo sapiens
tgcagaaggcaatcttaaaacag

SEQ ID NO: 942927 - DNA, 15 bp, Homo sapiens
tgcagaaggccaaga

SEQ ID NO: 942928 - DNA, 13 bp, Homo sapiens
tgcagaataatgg

SEQ ID NO: 942929 - DNA, 21 bp, Homo sapiens
tgcagaatacagtaagctgct

SEQ ID NO: 942930 - DNA, 14 bp, Homo sapiens
tgcagaatcccttt

SEQ ID NO: 942931 - DNA, 20 bp, Homo sapiens
tgcagacatctctggagcca

SEQ ID NO: 942932 - DNA, 23 bp, Homo sapiens
tgcagacatctctggagccagag

SEQ ID NO: 942933 - DNA, 15 bp, Homo sapiens
tgcagacctcaagcc

SEQ ID NO: 942934 - DNA, 17 bp, Homo sapiens
tgcagacctcaagccat

SEQ ID NO: 942935 - DNA, 15 bp, Homo sapiens
tgcagacctcactgt

SEQ ID NO: 942936 - DNA, 16 bp, Homo sapiens
tgcagacctcactgtc

SEQ ID NO: 942937 - DNA, 18 bp, Homo sapiens
tgcagacctcactgtcag

SEQ ID NO: 942938 - DNA, 19 bp, Homo sapiens
tgcagacctcactgtcagg

SEQ ID NO: 942939 - DNA, 14 bp, Homo sapiens
tgcagacctcatgc

SEQ ID NO: 942940 - DNA, 15 bp, Homo sapiens
tgcagacctcatgcc

SEQ ID NO: 942941 - DNA, 22 bp, Homo sapiens
tgcagacctcatgcccagctct

SEQ ID NO: 942942 - DNA, 23 bp, Homo sapiens
tgcagacctgtcaccctgcagga

SEQ ID NO: 942943 - DNA, 14 bp, Homo sapiens
tgcagaccttactc

SEQ ID NO: 942944 - DNA, 23 bp, Homo sapiens
tgcagacgggaatgcctaggtcc

SEQ ID NO: 942945 - DNA, 19 bp, Homo sapiens
tgcagactagaattctagt

SEQ ID NO: 942946 - DNA, 22 bp, Homo sapiens
tgcagactagaattctagtgct

SEQ ID NO: 942947 - DNA, 16 bp, Homo sapiens
tgcagacttcccagct

SEQ ID NO: 942948 - DNA, 20 bp, Homo sapiens
tgcagagaaacttaagcaaa

SEQ ID NO: 942949 - DNA, 21 bp, Homo sapiens
tgcagagaaacttaagcaaag

SEQ ID NO: 942950 - DNA, 20 bp, Homo sapiens
tgcagagaagaataagacat

SEQ ID NO: 942951 - DNA, 18 bp, Homo sapiens
tgcagagaagattttata

SEQ ID NO: 942952 - DNA, 14 bp, Homo sapiens
tgcagagagaagcc

SEQ ID NO: 942953 - DNA, 18 bp, Homo sapiens
tgcagagatttcctccat

SEQ ID NO: 942954 - DNA, 21 bp, Homo sapiens
tgcagagatttcctccatggt

SEQ ID NO: 942955 - DNA, 18 bp, Homo sapiens
tgcagagcagcagcacct

SEQ ID NO: 942956 - DNA, 20 bp, Homo sapiens
tgcagagccttctcagaagc

SEQ ID NO: 942957 - DNA, 19 bp, Homo sapiens
tgcagagccttttacccct

SEQ ID NO: 942958 - DNA, 12 bp, Homo sapiens
tgcagaggagcc

SEQ ID NO: 942959 - DNA, 15 bp, Homo sapiens
tgcagaggccagagg

SEQ ID NO: 942960 - DNA, 12 bp, Homo sapiens
tgcagaggctgt

SEQ ID NO: 942961 - DNA, 13 bp, Homo sapiens
tgcagagggagac

SEQ ID NO: 942962 - DNA, 18 bp, Homo sapiens
tgcagtttgggagacatg

SEQ ID NO: 942963 - DNA, 16 bp, Homo sapiens
tgcagttttaagaatt

SEQ ID NO: 942964 - DNA, 14 bp, Homo sapiens
tgcagttttccagg

SEQ ID NO: 942965 - DNA, 12 bp, Homo sapiens
tgcagttttcct

SEQ ID NO: 942966 - DNA, 14 bp, Homo sapiens
tgcagtttttcagg

SEQ ID NO: 942967 - DNA, 12 bp, Homo sapiens
tgcataaaaaaa

SEQ ID NO: 942968 - DNA, 13 bp, Homo sapiens
tgcataaaccaat

SEQ ID NO: 942969 - DNA, 15 bp, Homo sapiens
tgcataaaccaatga

SEQ ID NO: 942970 - DNA, 13 bp, Homo sapiens
tgcataaattaat

SEQ ID NO: 942971 - DNA, 12 bp, Homo sapiens
tgcataagatta

SEQ ID NO: 942972 - DNA, 18 bp, Homo sapiens
tgcataagattaaaggaa

SEQ ID NO: 942973 - DNA, 23 bp, Homo sapiens
tgcataataagctaaagaggctg

SEQ ID NO: 942974 - DNA, 17 bp, Homo sapiens
tgcatacaataaaagag

SEQ ID NO: 942975 - DNA, 19 bp, Homo sapiens
tgcatacaataaaagagct

SEQ ID NO: 942976 - DNA, 20 bp, Homo sapiens
tgcatacaataaaagagctt

SEQ ID NO: 942977 - DNA, 22 bp, Homo sapiens
tgcatacaataaaagagcttta

SEQ ID NO: 942978 - DNA, 21 bp, Homo sapiens
tgcatacagttttctagcaat

SEQ ID NO: 942979 - DNA, 20 bp, Homo sapiens
tgcataccacttttgttctt

SEQ ID NO: 942980 - DNA, 13 bp, Homo sapiens
tgcatactttatt

SEQ ID NO: 942981 - DNA, 14 bp, Homo sapiens
tgcatactttattg

SEQ ID NO: 942982 - DNA, 18 bp, Homo sapiens
tgcatactttgacaagga

SEQ ID NO: 942983 - DNA, 19 bp, Homo sapiens
tgcatagcgtcctgccctg

SEQ ID NO: 942984 - DNA, 15 bp, Homo sapiens
tgcatagctctcctt

SEQ ID NO: 942985 - DNA, 20 bp, Homo sapiens
tgcatagtaccaatcatttt

SEQ ID NO: 942986 - DNA, 22 bp, Homo sapiens
tgcatagtaccaatcattttaa

SEQ ID NO: 942987 - DNA, 14 bp, Homo sapiens
tgcatagtgctggg

SEQ ID NO: 942988 - DNA, 18 bp, Homo sapiens
tgcatagttgtagacaaa

SEQ ID NO: 942989 - DNA, 21 bp, Homo sapiens
tgcatagttgtagacaaagta

SEQ ID NO: 942990 - DNA, 20 bp, Homo sapiens
tgcatataaaggttatgaaa

SEQ ID NO: 942991 - DNA, 20 bp, Homo sapiens
tgcatataacttatattgta

SEQ ID NO: 942992 - DNA, 20 bp, Homo sapiens
tgcatataatgaataaatca

SEQ ID NO: 942993 - DNA, 15 bp, Homo sapiens
tgcatatagaaaaca

SEQ ID NO: 942994 - DNA, 17 bp, Homo sapiens
tgcatatagatttagtt

SEQ ID NO: 942995 - DNA, 16 bp, Homo sapiens
tgcatatcctgagcca

SEQ ID NO: 942996 - DNA, 18 bp, Homo sapiens
tgcatatcctgagccatc

SEQ ID NO: 942997 - DNA, 16 bp, Homo sapiens
tgcatatctgcctccc

SEQ ID NO: 942998 - DNA, 17 bp, Homo sapiens
tgcatatgttaaagctt

SEQ ID NO: 942999 - DNA, 20 bp, Homo sapiens
tgcatatgttaaagcttatt

SEQ ID NO: 943000 - DNA, 13 bp, Homo sapiens
tgcatatgttgaa

SEQ ID NO: 943001 - DNA, 17 bp, Homo sapiens
tgcatatgttgaatact

SEQ ID NO: 943002 - DNA, 16 bp, Homo sapiens
tgcatattataaagga

SEQ ID NO: 943003 - DNA, 22 bp, Homo sapiens
tgcatattctattgtattattt

SEQ ID NO: 943004 - DNA, 22 bp, Homo sapiens
tgcatatttatccaaaatgtgt

SEQ ID NO: 943005 - DNA, 18 bp, Homo sapiens
tgcatatttattgcattg

SEQ ID NO: 943006 - DNA, 22 bp, Homo sapiens
tgcatatttattgcattgctgg

SEQ ID NO: 943007 - DNA, 14 bp, Homo sapiens
tgcatatttctgta

SEQ ID NO: 943008 - DNA, 17 bp, Homo sapiens
tgcatatttctgtatat

SEQ ID NO: 943009 - DNA, 21 bp, Homo sapiens
tgcatatttctgtatatttgt

SEQ ID NO: 943010 - DNA, 15 bp, Homo sapiens
tgcatatttgtttat

SEQ ID NO: 943011 - DNA, 14 bp, Homo sapiens
tgcatcaaccagga

SEQ ID NO: 943012 - DNA, 20 bp, Homo sapiens
tgcatcacactcaaggacag

SEQ ID NO: 943013 - DNA, 21 bp, Homo sapiens
tgcatcacccgcccctggact

SEQ ID NO: 943014 - DNA, 12 bp, Homo sapiens
tgcatcactggg

SEQ ID NO: 943015 - DNA, 13 bp, Homo sapiens
tgcatcactgggt

SEQ ID NO: 943016 - DNA, 13 bp, Homo sapiens
tgcatcaggtcct

SEQ ID NO: 943017 - DNA, 21 bp, Homo sapiens
tgcatccattcctcagggaca

SEQ ID NO: 943018 - DNA, 15 bp, Homo sapiens
tgcatccattgttgt

SEQ ID NO: 943019 - DNA, 22 bp, Homo sapiens
tgcatcccaaaccacgcctctt

SEQ ID NO: 943020 - DNA, 23 bp, Homo sapiens
tgcatcccaaaccacgcctcttg

SEQ ID NO: 943021 - DNA, 20 bp, Homo sapiens
tgcatcccagcacctgcctc

SEQ ID NO: 943022 - DNA, 23 bp, Homo sapiens
tgcatccccacgacccctgcctc

SEQ ID NO: 943023 - DNA, 18 bp, Homo sapiens
tgcatcccccctgctcag

SEQ ID NO: 943024 - DNA, 20 bp, Homo sapiens
tgcatccgtagttccctgaa

SEQ ID NO: 943025 - DNA, 15 bp, Homo sapiens
tgcatcctcctcagc

SEQ ID NO: 943026 - DNA, 17 bp, Homo sapiens
tgcatcctcctcagccc

SEQ ID NO: 943027 - DNA, 13 bp, Homo sapiens
tgcatcctgaggc

SEQ ID NO: 943028 - DNA, 14 bp, Homo sapiens
tgcatcctgctggg

SEQ ID NO: 943029 - DNA, 14 bp, Homo sapiens
tgcatccttgtaat

SEQ ID NO: 943030 - DNA, 15 bp, Homo sapiens
tgcatcgtttcatct

SEQ ID NO: 943031 - DNA, 14 bp, Homo sapiens
tgcatctcaaaatt

SEQ ID NO: 943032 - DNA, 13 bp, Homo sapiens
tgcatctcccaga

SEQ ID NO: 943033 - DNA, 17 bp, Homo sapiens
tgcatctgaccagcagc

SEQ ID NO: 943034 - DNA, 18 bp, Homo sapiens
tgcatctgaccagcagcg

SEQ ID NO: 943035 - DNA, 19 bp, Homo sapiens
tgcatctgggtagctgtaa

SEQ ID NO: 943036 - DNA, 21 bp, Homo sapiens
tgcatctgggtagctgtaagg

SEQ ID NO: 943037 - DNA, 21 bp, Homo sapiens
tgcatctgtataagtaagaaa

SEQ ID NO: 943038 - DNA, 13 bp, Homo sapiens
tgcatcttaacat

SEQ ID NO: 943039 - DNA, 14 bp, Homo sapiens
tgcatcttactgaa

SEQ ID NO: 943040 - DNA, 17 bp, Homo sapiens
tgcatcttactgaaggt

SEQ ID NO: 943041 - DNA, 22 bp, Homo sapiens
tgcatcttactgaaggtaaaat

SEQ ID NO: 943042 - DNA, 14 bp, Homo sapiens
tgcatgaaactagg

SEQ ID NO: 943043 - DNA, 21 bp, Homo sapiens
tgcatgaaattgtatctcagt

SEQ ID NO: 943044 - DNA, 16 bp, Homo sapiens
tgcatgaagagaagca

SEQ ID NO: 943045 - DNA, 20 bp, Homo sapiens
tgcatgaagagaagcaattt

SEQ ID NO: 943046 - DNA, 20 bp, Homo sapiens
tgcatgacctaccaggacag

SEQ ID NO: 943047 - DNA, 15 bp, Homo sapiens
tgcatgagcttttat

SEQ ID NO: 943048 - DNA, 21 bp, Homo sapiens
tgcatgatgccctcccctcag

SEQ ID NO: 943049 - DNA, 22 bp, Homo sapiens
tgcatgatgccctcccctcagc

SEQ ID NO: 943050 - DNA, 18 bp, Homo sapiens
tgcatgatgtttgcccaa

SEQ ID NO: 943051 - DNA, 17 bp, Homo sapiens
tgcatgattcttctctt

SEQ ID NO: 943052 - DNA, 18 bp, Homo sapiens
tgcatgattttgtaaccc

SEQ ID NO: 943053 - DNA, 11 bp, Homo sapiens
tgcatgcatgt

SEQ ID NO: 943054 - DNA, 22 bp, Homo sapiens
tgcatgccaaattgtagttctt

SEQ ID NO: 943055 - DNA, 21 bp, Homo sapiens
tgcatgccaaggggttaatga

SEQ ID NO: 943056 - DNA, 16 bp, Homo sapiens
tgcatgccaggctggg

SEQ ID NO: 943057 - DNA, 14 bp, Homo sapiens
tgcatgctctggaa

SEQ ID NO: 943058 - DNA, 13 bp, Homo sapiens
tgcatgctgccca

SEQ ID NO: 943059 - DNA, 14 bp, Homo sapiens
tgcatgctgcccag

SEQ ID NO: 943060 - DNA, 15 bp, Homo sapiens
tgcatgctgcccagc

SEQ ID NO: 943061 - DNA, 19 bp, Homo sapiens
tgcatggaagttggggcac

SEQ ID NO: 943062 - DNA, 23 bp, Homo sapiens
tgcatggacaccccttatccagg

SEQ ID NO: 943063 - DNA, 17 bp, Homo sapiens
tgcatggacctaacatt

SEQ ID NO: 943064 - DNA, 18 bp, Homo sapiens
tgcatggacctaacattc

SEQ ID NO: 943065 - DNA, 20 bp, Homo sapiens
tgcatggacctaacattcga

SEQ ID NO: 943066 - DNA, 21 bp, Homo sapiens
tgcatggacctaacattcgat

SEQ ID NO: 943067 - DNA, 12 bp, Homo sapiens
tgcatggagcct

SEQ ID NO: 943068 - DNA, 13 bp, Homo sapiens
tgcatggaggccc

SEQ ID NO: 943069 - DNA, 14 bp, Homo sapiens
tgcatggatttctt

SEQ ID NO: 943070 - DNA, 16 bp, Homo sapiens
tgcatggcatcagact

SEQ ID NO: 943071 - DNA, 15 bp, Homo sapiens
tgcatggctcctgtc

SEQ ID NO: 943072 - DNA, 18 bp, Homo sapiens
tgcatggctcctgtctgg

SEQ ID NO: 943073 - DNA, 17 bp, Homo sapiens
tgcatggggaggcagca

SEQ ID NO: 943074 - DNA, 23 bp, Homo sapiens
tgcatggggtggggtagggctga

SEQ ID NO: 943075 - DNA, 15 bp, Homo sapiens
tgcatgtcgcacaat

SEQ ID NO: 943076 - DNA, 19 bp, Homo sapiens
tgcatgtcttaaatgctca

SEQ ID NO: 943077 - DNA, 21 bp, Homo sapiens
tgcatgtcttaaatgctcata

SEQ ID NO: 943078 - DNA, 15 bp, Homo sapiens
tgcatgtgaagcatg

SEQ ID NO: 943079 - DNA, 17 bp, Homo sapiens
tgcatgtgaagcatgct

SEQ ID NO: 943080 - DNA, 17 bp, Homo sapiens
tgcatgtgctgtctcca

SEQ ID NO: 943081 - DNA, 22 bp, Homo sapiens
tgcatgtgtgcgtgtctccatg

SEQ ID NO: 943082 - DNA, 13 bp, Homo sapiens
tgcatgtgtgtgc

SEQ ID NO: 943083 - DNA, 14 bp, Homo sapiens
tgcatgtgtgtgct

SEQ ID NO: 943084 - DNA, 19 bp, Homo sapiens
tgcatgttacataagataa

SEQ ID NO: 943085 - DNA, 16 bp, Homo sapiens
tgcatgttatgtttaa

SEQ ID NO: 943086 - DNA, 22 bp, Homo sapiens
tgcatgttatgtttaataagct

SEQ ID NO: 943087 - DNA, 14 bp, Homo sapiens
tgataccagctgga

SEQ ID NO: 943088 - DNA, 15 bp, Homo sapiens
tgatacccaacagtt

SEQ ID NO: 943089 - DNA, 16 bp, Homo sapiens
tgatacgatgcttcaa

SEQ ID NO: 943090 - DNA, 23 bp, Homo sapiens
tgatacgtccgtgtgtcccagat

SEQ ID NO: 943091 - DNA, 13 bp, Homo sapiens
tgatactaataaa

SEQ ID NO: 943092 - DNA, 22 bp, Homo sapiens
tgatactaataaactaataatt

SEQ ID NO: 943093 - DNA, 15 bp, Homo sapiens
tgatactacaacttt

SEQ ID NO: 943094 - DNA, 14 bp, Homo sapiens
tgatactacagttt

SEQ ID NO: 943095 - DNA, 17 bp, Homo sapiens
tgatactacagtttgtt

SEQ ID NO: 943096 - DNA, 18 bp, Homo sapiens
tgatactatccagttact

SEQ ID NO: 943097 - DNA, 16 bp, Homo sapiens
tgatactcatttctta

SEQ ID NO: 943098 - DNA, 19 bp, Homo sapiens
tgatactgatgccatgtaa

SEQ ID NO: 943099 - DNA, 14 bp, Homo sapiens
tgatactgcttttc

SEQ ID NO: 943100 - DNA, 18 bp, Homo sapiens
tgatactgtagaacctgt

SEQ ID NO: 943101 - DNA, 20 bp, Homo sapiens
tgatactgtagaacctgtct

SEQ ID NO: 943102 - DNA, 21 bp, Homo sapiens
tgatactgtgtgttttcccaa

SEQ ID NO: 943103 - DNA, 13 bp, Homo sapiens
tgatactgtttct

SEQ ID NO: 943104 - DNA, 22 bp, Homo sapiens
tgatactgtttcttgcactgaa

SEQ ID NO: 943105 - DNA, 14 bp, Homo sapiens
tgatacttcactac

SEQ ID NO: 943106 - DNA, 12 bp, Homo sapiens
tgatacttccaa

SEQ ID NO: 943107 - DNA, 19 bp, Homo sapiens
tgatacttccaagtgataa

SEQ ID NO: 943108 - DNA, 11 bp, Homo sapiens
tgatactttag

SEQ ID NO: 943109 - DNA, 12 bp, Homo sapiens
tgatactttagc

SEQ ID NO: 943110 - DNA, 17 bp, Homo sapiens
tgatagacaattgaggt

SEQ ID NO: 943111 - DNA, 18 bp, Homo sapiens
tgatagcaaatggcctca

SEQ ID NO: 943112 - DNA, 12 bp, Homo sapiens
tgatagcacttt

SEQ ID NO: 943113 - DNA, 13 bp, Homo sapiens
tgatagcactttc

SEQ ID NO: 943114 - DNA, 14 bp, Homo sapiens
tgatagcactttct

SEQ ID NO: 943115 - DNA, 20 bp, Homo sapiens
tgatagcatggggcccctgg

SEQ ID NO: 943116 - DNA, 16 bp, Homo sapiens
tgatagcccagaacaa

SEQ ID NO: 943117 - DNA, 21 bp, Homo sapiens
tgatagctaacattttaaata

SEQ ID NO: 943118 - DNA, 13 bp, Homo sapiens
tgatagctttatt

SEQ ID NO: 943119 - DNA, 14 bp, Homo sapiens
tgatagctttattt

SEQ ID NO: 943120 - DNA, 14 bp, Homo sapiens
tgataggaaggaaa

SEQ ID NO: 943121 - DNA, 17 bp, Homo sapiens
tgataggaaggaaactg

SEQ ID NO: 943122 - DNA, 21 bp, Homo sapiens
tgatagtccaatttttactca

SEQ ID NO: 943123 - DNA, 21 bp, Homo sapiens
tgatagtcctttttccaatgt

SEQ ID NO: 943124 - DNA, 22 bp, Homo sapiens
tgatagttgaagggaggtgaag

SEQ ID NO: 943125 - DNA, 19 bp, Homo sapiens
tgatataaatcagattctt

SEQ ID NO: 943126 - DNA, 13 bp, Homo sapiens
tgatataaatgca

SEQ ID NO: 943127 - DNA, 16 bp, Homo sapiens
tgatataaatgcaata

SEQ ID NO: 943128 - DNA, 20 bp, Homo sapiens
tgatatacacagtggcaaaa

SEQ ID NO: 943129 - DNA, 13 bp, Homo sapiens
tgatatacattgt

SEQ ID NO: 943130 - DNA, 19 bp, Homo sapiens
tgatatacattgtgtgaaa

SEQ ID NO: 943131 - DNA, 22 bp, Homo sapiens
tgatatataagtgtacatatgt

SEQ ID NO: 943132 - DNA, 20 bp, Homo sapiens
tgatatatgagactttatgt

SEQ ID NO: 943133 - DNA, 13 bp, Homo sapiens
tgatatatgtgtt

SEQ ID NO: 943134 - DNA, 19 bp, Homo sapiens
tgatatatttaaaaatatt

SEQ ID NO: 943135 - DNA, 13 bp, Homo sapiens
tgatatattttac

SEQ ID NO: 943136 - DNA, 15 bp, Homo sapiens
tgatatattttacaa

SEQ ID NO: 943137 - DNA, 16 bp, Homo sapiens
tgatatcacctctctt

SEQ ID NO: 943138 - DNA, 21 bp, Homo sapiens
tgatatcatgcccctgtactc

SEQ ID NO: 943139 - DNA, 12 bp, Homo sapiens
tgatatgcagcc

SEQ ID NO: 943140 - DNA, 18 bp, Homo sapiens
tgatatgcatatttgttt

SEQ ID NO: 943141 - DNA, 21 bp, Homo sapiens
tgatatgtaaacataattctt

SEQ ID NO: 943142 - DNA, 17 bp, Homo sapiens
tgatatgttttatttca

SEQ ID NO: 943143 - DNA, 23 bp, Homo sapiens
tgatatgttttatttcattggtt

SEQ ID NO: 943144 - DNA, 14 bp, Homo sapiens
tgatattaaagatt

SEQ ID NO: 943145 - DNA, 16 bp, Homo sapiens
tgatattaaaggagtt

SEQ ID NO: 943146 - DNA, 23 bp, Homo sapiens
tgatattaaaggagttaagagta

SEQ ID NO: 943147 - DNA, 13 bp, Homo sapiens
tgatattaaattt

SEQ ID NO: 943148 - DNA, 14 bp, Homo sapiens
tgatattaatcaaa

SEQ ID NO: 943149 - DNA, 18 bp, Homo sapiens
tgatattcaaggctttaa

SEQ ID NO: 943150 - DNA, 21 bp, Homo sapiens
tgatattccccccacttaaga

SEQ ID NO: 943151 - DNA, 18 bp, Homo sapiens
tgatattctgttgcttta

SEQ ID NO: 943152 - DNA, 14 bp, Homo sapiens
tgatattctttaaa

SEQ ID NO: 943153 - DNA, 16 bp, Homo sapiens
tgatattctttaaaca

SEQ ID NO: 943154 - DNA, 15 bp, Homo sapiens
tgatattgtttaaaa

SEQ ID NO: 943155 - DNA, 17 bp, Homo sapiens
tgatattgtttaaaatt

SEQ ID NO: 943156 - DNA, 15 bp, Homo sapiens
tgatattgtttgctg

SEQ ID NO: 943157 - DNA, 17 bp, Homo sapiens
tgatattgtttgctgtt

SEQ ID NO: 943158 - DNA, 22 bp, Homo sapiens
tgatatttaggtttttggctga

SEQ ID NO: 943159 - DNA, 17 bp, Homo sapiens
tgatatttatttcctgc

SEQ ID NO: 943160 - DNA, 16 bp, Homo sapiens
tgatatttcttgcttt

SEQ ID NO: 943161 - DNA, 17 bp, Homo sapiens
tgatatttcttgctttc

SEQ ID NO: 943162 - DNA, 13 bp, Homo sapiens
tgatattttaaaa

SEQ ID NO: 943163 - DNA, 14 bp, Homo sapiens
tgatattttctcta

SEQ ID NO: 943164 - DNA, 17 bp, Homo sapiens
tgatattttctgtgcct

SEQ ID NO: 943165 - DNA, 20 bp, Homo sapiens
tgatattttgtctcctacct

SEQ ID NO: 943166 - DNA, 15 bp, Homo sapiens
tgatatttttatgtg

SEQ ID NO: 943167 - DNA, 18 bp, Homo sapiens
tgatatttttatgtgcag

SEQ ID NO: 943168 - DNA, 13 bp, Homo sapiens
tgatatttttcca

SEQ ID NO: 943169 - DNA, 20 bp, Homo sapiens
tgatatttttccatttattt

SEQ ID NO: 943170 - DNA, 15 bp, Homo sapiens
tgatcaaaacctgtg

SEQ ID NO: 943171 - DNA, 13 bp, Homo sapiens
tgatcaaaataaa

SEQ ID NO: 943172 - DNA, 16 bp, Homo sapiens
tgatcaaattcatttt

SEQ ID NO: 943173 - DNA, 23 bp, Homo sapiens
tgatcaaattcatttttttcact

SEQ ID NO: 943174 - DNA, 13 bp, Homo sapiens
tgatcaagatata

SEQ ID NO: 943175 - DNA, 16 bp, Homo sapiens
tgatcaagatatatgt

SEQ ID NO: 943176 - DNA, 13 bp, Homo sapiens
tgatcaataaaat

SEQ ID NO: 943177 - DNA, 15 bp, Homo sapiens
tgatcaataaaatgt

SEQ ID NO: 943178 - DNA, 21 bp, Homo sapiens
tgatcaataaaatgtgatttt

SEQ ID NO: 943179 - DNA, 16 bp, Homo sapiens
tgatcaattaaatgta

SEQ ID NO: 943180 - DNA, 12 bp, Homo sapiens
tgatcacacagt

SEQ ID NO: 943181 - DNA, 15 bp, Homo sapiens
tgatcacacagtgtt

SEQ ID NO: 943182 - DNA, 12 bp, Homo sapiens
tgatcacactct

SEQ ID NO: 943183 - DNA, 13 bp, Homo sapiens
tgatcacactctg

SEQ ID NO: 943184 - DNA, 16 bp, Homo sapiens
tgatcacagtgacttt

SEQ ID NO: 943185 - DNA, 15 bp, Homo sapiens
tgatcacattgtttc

SEQ ID NO: 943186 - DNA, 19 bp, Homo sapiens
tgatcaccgactgaaaata

SEQ ID NO: 943187 - DNA, 14 bp, Homo sapiens
tgatcacctgccct

SEQ ID NO: 943188 - DNA, 15 bp, Homo sapiens
tgatcactgagccat

SEQ ID NO: 943189 - DNA, 12 bp, Homo sapiens
tgatcagacagc

SEQ ID NO: 943190 - DNA, 16 bp, Homo sapiens
tgatcagatgctgaat

SEQ ID NO: 943191 - DNA, 18 bp, Homo sapiens
tgatcagctgtttgtcat

SEQ ID NO: 943192 - DNA, 16 bp, Homo sapiens
tgatcagggatccaat

SEQ ID NO: 943193 - DNA, 21 bp, Homo sapiens
tgatcagtactgactttctga

SEQ ID NO: 943194 - DNA, 20 bp, Homo sapiens
tgatcagttaagaaatttca

SEQ ID NO: 943195 - DNA, 21 bp, Homo sapiens
tgcaaccaggcagctgagacc

SEQ ID NO: 943196 - DNA, 16 bp, Homo sapiens
tgcaaccatttgaaac

SEQ ID NO: 943197 - DNA, 19 bp, Homo sapiens
tgcaacctcaccttcctgt

SEQ ID NO: 943198 - DNA, 21 bp, Homo sapiens
tgcaacctcaccttcctgtgg

SEQ ID NO: 943199 - DNA, 13 bp, Homo sapiens
tgcaacctccgcc

SEQ ID NO: 943200 - DNA, 21 bp, Homo sapiens
tgcaacctccgccttccgggt

SEQ ID NO: 943201 - DNA, 20 bp, Homo sapiens
tgcaacctcgctggactctc

SEQ ID NO: 943202 - DNA, 15 bp, Homo sapiens
tgcaacctgtggctc

SEQ ID NO: 943203 - DNA, 16 bp, Homo sapiens
tgcaacggcttagact

SEQ ID NO: 943204 - DNA, 20 bp, Homo sapiens
tgcaactaactgactctgtt

SEQ ID NO: 943205 - DNA, 22 bp, Homo sapiens
tgcaactaactgactctgttat

SEQ ID NO: 943206 - DNA, 17 bp, Homo sapiens
tgcaactaaggacaaat

SEQ ID NO: 943207 - DNA, 21 bp, Homo sapiens
tgcaactcttttaagtgcctt

SEQ ID NO: 943208 - DNA, 22 bp, Homo sapiens
tgcaacttcatgtcaacttctg

SEQ ID NO: 943209 - DNA, 14 bp, Homo sapiens
tgcaacttctatcc

SEQ ID NO: 943210 - DNA, 14 bp, Homo sapiens
tgcaacttctgcct

SEQ ID NO: 943211 - DNA, 13 bp, Homo sapiens
tgcaacttgtgaa

SEQ ID NO: 943212 - DNA, 17 bp, Homo sapiens
tgcaactttttaaagta

SEQ ID NO: 943213 - DNA, 22 bp, Homo sapiens
tgcaagaagcgccgactccctg

SEQ ID NO: 943214 - DNA, 15 bp, Homo sapiens
tgcaagaattaaaac

SEQ ID NO: 943215 - DNA, 19 bp, Homo sapiens
tgcaagaattaaaactgag

SEQ ID NO: 943216 - DNA, 20 bp, Homo sapiens
tgcaagaattaaaactgagt

SEQ ID NO: 943217 - DNA, 16 bp, Homo sapiens
tgcaagaccacggagg

SEQ ID NO: 943218 - DNA, 13 bp, Homo sapiens
tgcaagagtggac

SEQ ID NO: 943219 - DNA, 21 bp, Homo sapiens
tgcaagatggacacgagccac

SEQ ID NO: 943220 - DNA, 13 bp, Homo sapiens
tgcaagatgtgaa

SEQ ID NO: 943221 - DNA, 14 bp, Homo sapiens
tgcaagatgtgaat

SEQ ID NO: 943222 - DNA, 21 bp, Homo sapiens
tgcaagattttttttttaagt

SEQ ID NO: 943223 - DNA, 22 bp, Homo sapiens
tgcaagattttttttttaagtg

SEQ ID NO: 943224 - DNA, 16 bp, Homo sapiens
tgcaagcacagccctt

SEQ ID NO: 943225 - DNA, 19 bp, Homo sapiens
tgcaagcaggactttgagg

SEQ ID NO: 943226 - DNA, 23 bp, Homo sapiens
tgcaagcatttttccatctgtgt

SEQ ID NO: 943227 - DNA, 16 bp, Homo sapiens
tgcaagccccagggcc

SEQ ID NO: 943228 - DNA, 17 bp, Homo sapiens
tgcaagccccagggcct

SEQ ID NO: 943229 - DNA, 23 bp, Homo sapiens
tgcaagcccctgctccagaagat

SEQ ID NO: 943230 - DNA, 15 bp, Homo sapiens
tgcaagcttggtcaa

SEQ ID NO: 943231 - DNA, 23 bp, Homo sapiens
tgcaaggccgctgttcacccaca

SEQ ID NO: 943232 - DNA, 21 bp, Homo sapiens
tgcaaggcctggtgtttcttg

SEQ ID NO: 943233 - DNA, 20 bp, Homo sapiens
tgcaagggagttagggaaat

SEQ ID NO: 943234 - DNA, 13 bp, Homo sapiens
tgcaagggcccag

SEQ ID NO: 943235 - DNA, 15 bp, Homo sapiens
tgcaagggcccagag

SEQ ID NO: 943236 - DNA, 22 bp, Homo sapiens
tgcaagggcccagagtgaaccg

SEQ ID NO: 943237 - DNA, 19 bp, Homo sapiens
tgcaaggtatttctccagt

SEQ ID NO: 943238 - DNA, 14 bp, Homo sapiens
tgcaaggtgaaacg

SEQ ID NO: 943239 - DNA, 19 bp, Homo sapiens
tgcaaggtgaaacgactca

SEQ ID NO: 943240 - DNA, 16 bp, Homo sapiens
tgcaaggtgctggtgg

SEQ ID NO: 943241 - DNA, 16 bp, Homo sapiens
tgcaaggtggcctctg

SEQ ID NO: 943242 - DNA, 18 bp, Homo sapiens
tgcaaggtggcctctgcc

SEQ ID NO: 943243 - DNA, 15 bp, Homo sapiens
tgcaaggtggccttt

SEQ ID NO: 943244 - DNA, 19 bp, Homo sapiens
tgcaagtatgttttagcat

SEQ ID NO: 943245 - DNA, 12 bp, Homo sapiens
tgcaagtctctt

SEQ ID NO: 943246 - DNA, 16 bp, Homo sapiens
tgcaagtgtctgtgtg

SEQ ID NO: 943247 - DNA, 18 bp, Homo sapiens
tgcaagtgtctgtgtgca

SEQ ID NO: 943248 - DNA, 13 bp, Homo sapiens
tgcaagtgtgtgc

SEQ ID NO: 943249 - DNA, 14 bp, Homo sapiens
tgcaagtgtgtgca

SEQ ID NO: 943250 - DNA, 21 bp, Homo sapiens
tgcaagtgtgtgcacatgtgt

SEQ ID NO: 943251 - DNA, 23 bp, Homo sapiens
tgcaagttatattagtgaagatg

SEQ ID NO: 943252 - DNA, 15 bp, Homo sapiens
tgcaagttattttat

SEQ ID NO: 943253 - DNA, 20 bp, Homo sapiens
tgcaagttattttatttgct

SEQ ID NO: 943254 - DNA, 19 bp, Homo sapiens
tgcaagttgaggacttctt

SEQ ID NO: 943255 - DNA, 19 bp, Homo sapiens
tgcaagtttctgtttcaaa

SEQ ID NO: 943256 - DNA, 14 bp, Homo sapiens
tgcaataaagtata

SEQ ID NO: 943257 - DNA, 16 bp, Homo sapiens
tgcaataacagctgca

SEQ ID NO: 943258 - DNA, 16 bp, Homo sapiens
tgcaataatccacccc

SEQ ID NO: 943259 - DNA, 15 bp, Homo sapiens
tgcaataatgtgcaa

SEQ ID NO: 943260 - DNA, 11 bp, Homo sapiens
tgcaataattt

SEQ ID NO: 943261 - DNA, 14 bp, Homo sapiens
tgcaataatttgta

SEQ ID NO: 943262 - DNA, 20 bp, Homo sapiens
tgcaataatttgtacaatgg

SEQ ID NO: 943263 - DNA, 22 bp, Homo sapiens
tgcaataatttgtacaatggtt

SEQ ID NO: 943264 - DNA, 12 bp, Homo sapiens
tgcaataatttt

SEQ ID NO: 943265 - DNA, 23 bp, Homo sapiens
tgcaatacgggagtgacccagct

SEQ ID NO: 943266 - DNA, 18 bp, Homo sapiens
tgcaatagattactgatg

SEQ ID NO: 943267 - DNA, 13 bp, Homo sapiens
tgcaatatcttcg

SEQ ID NO: 943268 - DNA, 15 bp, Homo sapiens
tgcaatcactttttg

SEQ ID NO: 943269 - DNA, 17 bp, Homo sapiens
tgcaatcaggattttaa

SEQ ID NO: 943270 - DNA, 19 bp, Homo sapiens
tgcaatcctgtctttctga

SEQ ID NO: 943271 - DNA, 17 bp, Homo sapiens
tgcacccactcaccagg

SEQ ID NO: 943272 - DNA, 18 bp, Homo sapiens
tgcacccactcaccaggg

SEQ ID NO: 943273 - DNA, 15 bp, Homo sapiens
tgcaccccagcattc

SEQ ID NO: 943274 - DNA, 18 bp, Homo sapiens
tgcaccccagcattccag

SEQ ID NO: 943275 - DNA, 19 bp, Homo sapiens
tgcaccccagcattccagc

SEQ ID NO: 943276 - DNA, 20 bp, Homo sapiens
tgcaccccagcgtcaggcct

SEQ ID NO: 943277 - DNA, 13 bp, Homo sapiens
tgcacccctccca

SEQ ID NO: 943278 - DNA, 14 bp, Homo sapiens
tgcacccctcccat

SEQ ID NO: 943279 - DNA, 22 bp, Homo sapiens
tgcacccctgagttgggcagcc

SEQ ID NO: 943280 - DNA, 14 bp, Homo sapiens
tgcacccctgggcc

SEQ ID NO: 943281 - DNA, 20 bp, Homo sapiens
tgcaccccttctctcctccc

SEQ ID NO: 943282 - DNA, 14 bp, Homo sapiens
tgcacccctttcct

SEQ ID NO: 943283 - DNA, 21 bp, Homo sapiens
tgcacccctttcctccccata

SEQ ID NO: 943284 - DNA, 23 bp, Homo sapiens
tgcacccctttcctccccataca

SEQ ID NO: 943285 - DNA, 16 bp, Homo sapiens
tgcaccctcaggcagg

SEQ ID NO: 943286 - DNA, 17 bp, Homo sapiens
tgcaccctgcgcctcca

SEQ ID NO: 943287 - DNA, 18 bp, Homo sapiens
tgcaccctgcgcctccag

SEQ ID NO: 943288 - DNA, 21 bp, Homo sapiens
tgcaccctgcgcctccagagg

SEQ ID NO: 943289 - DNA, 23 bp, Homo sapiens
tgcacccttcttttctcatgtgt

SEQ ID NO: 943290 - DNA, 15 bp, Homo sapiens
tgcaccgaccccggg

SEQ ID NO: 943291 - DNA, 19 bp, Homo sapiens
tgcaccgacccgaggccca

SEQ ID NO: 943292 - DNA, 21 bp, Homo sapiens
tgcaccgccgcagaagcagcc

SEQ ID NO: 943293 - DNA, 16 bp, Homo sapiens
tgcaccgcctgccctc

SEQ ID NO: 943294 - DNA, 21 bp, Homo sapiens
tgcacctaaagaaaaacaaac

SEQ ID NO: 943295 - DNA, 20 bp, Homo sapiens
tgcacctagctgtgcaagac

SEQ ID NO: 943296 - DNA, 16 bp, Homo sapiens
tgcacctcaaggtcat

SEQ ID NO: 943297 - DNA, 16 bp, Homo sapiens
tgcacctccgcttgcc

SEQ ID NO: 943298 - DNA, 20 bp, Homo sapiens
tgcacctcctaccctcccac

SEQ ID NO: 943299 - DNA, 21 bp, Homo sapiens
tgcacctcctaccctcccacc

SEQ ID NO: 943300 - DNA, 17 bp, Homo sapiens
tgcacctctgttcattt

SEQ ID NO: 943301 - DNA, 19 bp, Homo sapiens
tgcacctgattagttgaaa

SEQ ID NO: 943302 - DNA, 18 bp, Homo sapiens
tgcacctgcatccgtagt

SEQ ID NO: 943303 - DNA, 20 bp, Homo sapiens
tgcacctgccagcctggctt

SEQ ID NO: 943304 - DNA, 13 bp, Homo sapiens
tgcacctgctgcg

SEQ ID NO: 943305 - DNA, 24 bp, Homo sapiens
tgcacctgctgcgtccccactccc

SEQ ID NO: 943306 - DNA, 17 bp, Homo sapiens
tgcacctggaatatata

SEQ ID NO: 943307 - DNA, 17 bp, Homo sapiens
tgcacctggcctgggcc

SEQ ID NO: 943308 - DNA, 18 bp, Homo sapiens
tgcacctggcctgggcca

SEQ ID NO: 943309 - DNA, 20 bp, Homo sapiens
tgcacctgtactcaggaggc
